United States Patent 7,374,927 (METHODS OF ANALYSIS OF DEGRADED NUCLEIC ACID SAMPLES) - sequence listing, part 14

SEQ ID NO: 521360 - DNA, 25 bp, Homo sapien
tatttccttaatccaaccatgctct

SEQ ID NO: 521361 - DNA, 25 bp, Homo sapien
aaccatgctctcgagggctgagcag

SEQ ID NO: 521362 - DNA, 25 bp, Homo sapien
gagcagagactagactcaaggcaca

SEQ ID NO: 521363 - DNA, 25 bp, Homo sapien
acagcggtatctcatgtctacacaa

SEQ ID NO: 521364 - DNA, 25 bp, Homo sapien
aggaacgttctgaaagctccaacaa

SEQ ID NO: 521365 - DNA, 25 bp, Homo sapien
gaaagctccaacaacttcttgaggg

SEQ ID NO: 521366 - DNA, 25 bp, Homo sapien
acagctttgggctcaggattcccta

SEQ ID NO: 521367 - DNA, 25 bp, Homo sapien
tgcccatcgcgtgcactgattggag

SEQ ID NO: 521368 - DNA, 25 bp, Homo sapien
actgattggaggagtctggcccaaa

SEQ ID NO: 521369 - DNA, 25 bp, Homo sapien
gcatccctattcagtagcaccagct

SEQ ID NO: 521370 - DNA, 25 bp, Homo sapien
ctattcagtagcaccagctggtcat

SEQ ID NO: 521371 - DNA, 25 bp, Homo sapien
agtagcaccagctggtcatggcttt

SEQ ID NO: 521372 - DNA, 25 bp, Homo sapien
acctcgaatccctggcgaccatgag

SEQ ID NO: 521373 - DNA, 25 bp, Homo sapien
ggcgaccatgagtcaccagctccaa

SEQ ID NO: 521374 - DNA, 25 bp, Homo sapien
tctgcagcgtttgtctagcgccctt

SEQ ID NO: 521375 - DNA, 25 bp, Homo sapien
tgtctagcgcccttgcagctccaga

SEQ ID NO: 521376 - DNA, 25 bp, Homo sapien
gggcctacagatgaagctggctctg

SEQ ID NO: 521377 - DNA, 25 bp, Homo sapien
agatgaagctggctctgagtgtccc

SEQ ID NO: 521378 - DNA, 25 bp, Homo sapien
tctgagtgtcccttccctagaaagg

SEQ ID NO: 521379 - DNA, 25 bp, Homo sapien
gtgtcccttccctagaaaggcctga

SEQ ID NO: 521380 - DNA, 25 bp, Homo sapien
cagctcactgctggctgtcctgtgt

SEQ ID NO: 521381 - DNA, 25 bp, Homo sapien
gggactcaacccgagtgtgcagacc

SEQ ID NO: 521382 - DNA, 25 bp, Homo sapien
tcaacccgagtgtgcagacccatga

SEQ ID NO: 521383 - DNA, 25 bp, Homo sapien
aacccgagtgtgcagacccatgatg

SEQ ID NO: 521384 - DNA, 25 bp, Homo sapien
acccgagtgtgcagacccatgatga

SEQ ID NO: 521385 - DNA, 25 bp, Homo sapien
ccgagtgtgcagacccatgatgacc

SEQ ID NO: 521386 - DNA, 25 bp, Homo sapien
cttcctgctctccttcttaatttat

SEQ ID NO: 521387 - DNA, 25 bp, Homo sapien
ttattttctgtcttggagggaagct

SEQ ID NO: 521388 - DNA, 25 bp, Homo sapien
ccctagggccagaagacctgtcagt

SEQ ID NO: 521389 - DNA, 25 bp, Homo sapien
tagggccagaagacctgtcagtcac

SEQ ID NO: 521390 - DNA, 25 bp, Homo sapien
ggccagaagacctgtcagtcacttt

SEQ ID NO: 521391 - DNA, 25 bp, Homo sapien
cgctggttcgatgcagaggaagaaa

SEQ ID NO: 521392 - DNA, 25 bp, Homo sapien
ggaagaaaccacacctagcacgtaa

SEQ ID NO: 521393 - DNA, 25 bp, Homo sapien
agaaaccacacctagcacgtaaagc

SEQ ID NO: 521394 - DNA, 25 bp, Homo sapien
acacctagcacgtaaagccctgaaa

SEQ ID NO: 521395 - DNA, 25 bp, Homo sapien
cacctagcacgtaaagccctgaaaa

SEQ ID NO: 521396 - DNA, 25 bp, Homo sapien
ctagcacgtaaagccctgaaaaaat

SEQ ID NO: 521397 - DNA, 25 bp, Homo sapien
agccctgaaaaaatagaggtgtaca

SEQ ID NO: 521398 - DNA, 25 bp, Homo sapien
agaggtgtacagtagagttttccag

SEQ ID NO: 521399 - DNA, 25 bp, Homo sapien
ggttcccgatgtggaggtccgtctt

SEQ ID NO: 521400 - DNA, 25 bp, Homo sapien
ttcccgatgtggaggtccgtcttgg

SEQ ID NO: 521401 - DNA, 25 bp, Homo sapien
ggaggcacccaggtcgctggttcga

SEQ ID NO: 521402 - DNA, 25 bp, Homo sapien
ggaaaacctttcgacttgtggctat

SEQ ID NO: 521403 - DNA, 25 bp, Homo sapien
gtggctatactattcaatatggctg

SEQ ID NO: 521404 - DNA, 25 bp, Homo sapien
atggctgtatagctcattgtgcttt

SEQ ID NO: 521405 - DNA, 25 bp, Homo sapien
agctcattgtgctttgaatacgttg

SEQ ID NO: 521406 - DNA, 25 bp, Homo sapien
gaatacgttggtggtgttgtcatgt

SEQ ID NO: 521407 - DNA, 25 bp, Homo sapien
gttgtcatgtgttctggaccatcaa

SEQ ID NO: 521408 - DNA, 25 bp, Homo sapien
gaccatcaatggagcctacaattca

SEQ ID NO: 521409 - DNA, 25 bp, Homo sapien
tgtctttgcagaaaatcttagtcga

SEQ ID NO: 521410 - DNA, 25 bp, Homo sapien
agtcgacatttttatggtatccaaa

SEQ ID NO: 521411 - DNA, 25 bp, Homo sapien
gacattgtgattgcaaaaagcccaa

SEQ ID NO: 521412 - DNA, 25 bp, Homo sapien
gcaaaaagcccaagtgatccaaaat

SEQ ID NO: 521413 - DNA, 25 bp, Homo sapien
cattctggccgagaggttgtcatga

SEQ ID NO: 521414 - DNA, 25 bp, Homo sapien
gttgtcatgagggtcactacagtct

SEQ ID NO: 521415 - DNA, 25 bp, Homo sapien
actacagtctgaactggactccagg

SEQ ID NO: 521416 - DNA, 25 bp, Homo sapien
ccaggagcagggatcttgagtcaat

SEQ ID NO: 521417 - DNA, 25 bp, Homo sapien
gagtcaatgcatcagtcagagaaga

SEQ ID NO: 521418 - DNA, 25 bp, Homo sapien
ccgtcaccgaggatctgtgtgggta

SEQ ID NO: 521419 - DNA, 25 bp, Homo sapien
ggatctgtgtgggtagcctcaagct

SEQ ID NO: 521420 - DNA, 25 bp, Homo sapien
tagcctcaagctggagacattgtct

SEQ ID NO: 521421 - DNA, 25 bp, Homo sapien
tgcccactgggtagagacacctgga

SEQ ID NO: 521422 - DNA, 25 bp, Homo sapien
gagacacctggatgacatttcagta

SEQ ID NO: 521423 - DNA, 25 bp, Homo sapien
atgacatttcagtacccgctggcag

SEQ ID NO: 521424 - DNA, 25 bp, Homo sapien
attaaggaatgggtagcgtttacat

SEQ ID NO: 521425 - DNA, 25 bp, Homo sapien
gtagcgtttacatttaagtacacca

SEQ ID NO: 521426 - DNA, 25 bp, Homo sapien
tttaagtacaccaatgtctgcccaa

SEQ ID NO: 521427 - DNA, 25 bp, Homo sapien
atgtctgcccaatttcctaatgtat

SEQ ID NO: 521428 - DNA, 25 bp, Homo sapien
gaaaacatagatgtttctagtgcct

SEQ ID NO: 521429 - DNA, 25 bp, Homo sapien
gtttctagtgcctttgaacttatac

SEQ ID NO: 521430 - DNA, 25 bp, Homo sapien
gtgcctttgaacttatactgtagtc

SEQ ID NO: 521431 - DNA, 25 bp, Homo sapien
gaacttatactgtagtctgactaat

SEQ ID NO: 521432 - DNA, 25 bp, Homo sapien
ataacttcagtagcattactataat

SEQ ID NO: 521433 - DNA, 25 bp, Homo sapien
aaagtcttctttcctacagggctgt

SEQ ID NO: 521434 - DNA, 25 bp, Homo sapien
cttctttcctacagggctgtgaatt

SEQ ID NO: 521435 - DNA, 25 bp, Homo sapien
cttgtcaggcaaagggtaggctgat

SEQ ID NO: 521436 - DNA, 25 bp, Homo sapien
caccggattcagtggtatggatacc

SEQ ID NO: 521437 - DNA, 25 bp, Homo sapien
ggtatggatacctcagtgtttattt

SEQ ID NO: 521438 - DNA, 25 bp, Homo sapien
gtttatttctgtaaggtgtagtgca

SEQ ID NO: 521439 - DNA, 25 bp, Homo sapien
tagtgcaagagagaggccagtccca

SEQ ID NO: 521440 - DNA, 25 bp, Homo sapien
agagaggccagtcccaaggtctcag

SEQ ID NO: 521441 - DNA, 25 bp, Homo sapien
aacaaacttcgttatccagcatcct

SEQ ID NO: 521442 - DNA, 25 bp, Homo sapien
aacttcgttatccagcatcctgctg

SEQ ID NO: 521443 - DNA, 25 bp, Homo sapien
tcctgctggtttaaacttgcctgtc

SEQ ID NO: 521444 - DNA, 25 bp, Homo sapien
taaacttgcctgtctactatggcta

SEQ ID NO: 521445 - DNA, 25 bp, Homo sapien
caaggaggtaatgtgtttgttaacg

SEQ ID NO: 521446 - DNA, 25 bp, Homo sapien
gattataatatcctcactggccaca

SEQ ID NO: 521447 - DNA, 25 bp, Homo sapien
tcctcactggccacaatctgtaaaa

SEQ ID NO: 521448 - DNA, 25 bp, Homo sapien
actggccacaatctgtaaaagtcga

SEQ ID NO: 521449 - DNA, 25 bp, Homo sapien
gtaaaagtcgatactggcacttttt

SEQ ID NO: 521450 - DNA, 25 bp, Homo sapien
cccctcaaaggaaatatgctaatag

SEQ ID NO: 521451 - DNA, 25 bp, Homo sapien
atgctaatagacagcccctttgcaa

SEQ ID NO: 521452 - DNA, 25 bp, Homo sapien
atagacagcccctttgcaaatataa

SEQ ID NO: 521453 - DNA, 25 bp, Homo sapien
cttcccaacccttcaaattgctaag

SEQ ID NO: 521454 - DNA, 25 bp, Homo sapien
ttcaaattgctaaggccccactggt

SEQ ID NO: 521455 - DNA, 25 bp, Homo sapien
agcaccttccctttcgagtccagga

SEQ ID NO: 521456 - DNA, 25 bp, Homo sapien
ctttcgagtccaggactactgttct

SEQ ID NO: 521457 - DNA, 25 bp, Homo sapien
gtacctaaccattgtaatccaaaag

SEQ ID NO: 521458 - DNA, 25 bp, Homo sapien
aagggtgtggtttacatgcttttca

SEQ ID NO: 521459 - DNA, 25 bp, Homo sapien
gggtgtggtttacatgcttttcaaa

SEQ ID NO: 521460 - DNA, 25 bp, Homo sapien
tttaggatttcaaatagtgataccc

SEQ ID NO: 521461 - DNA, 25 bp, Homo sapien
agtgataccctcctgagacatgagc

SEQ ID NO: 521462 - DNA, 25 bp, Homo sapien
taccctcctgagacatgagcatttg

SEQ ID NO: 521463 - DNA, 25 bp, Homo sapien
atttggagaggcctgagaacctaat

SEQ ID NO: 521464 - DNA, 25 bp, Homo sapien
agaggcctgagaacctaatagaact

SEQ ID NO: 521465 - DNA, 25 bp, Homo sapien
aaggaaagtctcccagtgctgtcaa

SEQ ID NO: 521466 - DNA, 25 bp, Homo sapien
cagtgctgtcaaaggaattgtggtt

SEQ ID NO: 521467 - DNA, 25 bp, Homo sapien
caaaggaattgtggttactacttgc

SEQ ID NO: 521468 - DNA, 25 bp, Homo sapien
aaaatatattttcaccctgacagtg

SEQ ID NO: 521469 - DNA, 25 bp, Homo sapien
gacagtgacccttgtaacttaaatg

SEQ ID NO: 521470 - DNA, 25 bp, Homo sapien
gtgacccttgtaacttaaatgattt

SEQ ID NO: 521471 - DNA, 25 bp, Homo sapien
atgtaagtataattcaaagttgtca

SEQ ID NO: 521472 - DNA, 25 bp, Homo sapien
tagcagaaaattggcaagatgtatt

SEQ ID NO: 521473 - DNA, 25 bp, Homo sapien
gtatttttactttccaagatgccgt

SEQ ID NO: 521474 - DNA, 25 bp, Homo sapien
ttactttccaagatgccgtgtgtgc

SEQ ID NO: 521475 - DNA, 25 bp, Homo sapien
actttccaagatgccgtgtgtgcca

SEQ ID NO: 521476 - DNA, 25 bp, Homo sapien
ttccaagatgccgtgtgtgccaaga

SEQ ID NO: 521477 - DNA, 25 bp, Homo sapien
caagatgccgtgtgtgccaagaata

SEQ ID NO: 521478 - DNA, 25 bp, Homo sapien
gatgccgtgtgtgccaagaataaat

SEQ ID NO: 521479 - DNA, 25 bp, Homo sapien
cagactcaggacatggcagcagctg

SEQ ID NO: 521480 - DNA, 25 bp, Homo sapien
gggtttttaggtatggctgaatgtt

SEQ ID NO: 521481 - DNA, 25 bp, Homo sapien
tttaggtatggctgaatgttgccat

SEQ ID NO: 521482 - DNA, 25 bp, Homo sapien
aatgtctctatgaagccctaagacc

SEQ ID NO: 521483 - DNA, 25 bp, Homo sapien
tctatgaagccctaagaccagacac

SEQ ID NO: 521484 - DNA, 25 bp, Homo sapien
aaattactaatggatctggctactg

SEQ ID NO: 521485 - DNA, 25 bp, Homo sapien
tggctactgagaccccctgaactaa

SEQ ID NO: 521486 - DNA, 25 bp, Homo sapien
cccctgaactaagaaagccatttga

SEQ ID NO: 521487 - DNA, 25 bp, Homo sapien
ctaagaaagccatttgatttgttca

SEQ ID NO: 521488 - DNA, 25 bp, Homo sapien
ttgatttgttcatacatgagagaga

SEQ ID NO: 521489 - DNA, 25 bp, Homo sapien
ttaggagtagtaacccaagacttgg

SEQ ID NO: 521490 - DNA, 25 bp, Homo sapien
tgaatccagggaaagctattgcaga

SEQ ID NO: 521491 - DNA, 25 bp, Homo sapien
gaatccagggaaagctattgcagag

SEQ ID NO: 521492 - DNA, 25 bp, Homo sapien
aatccagggaaagctattgcagaga

SEQ ID NO: 521493 - DNA, 25 bp, Homo sapien
atccagggaaagctattgcagagat

SEQ ID NO: 521494 - DNA, 25 bp, Homo sapien
gagatcaagaaaatgatggcaacct

SEQ ID NO: 521495 - DNA, 25 bp, Homo sapien
tcagtttaactgtttccatgctaaa

SEQ ID NO: 521496 - DNA, 25 bp, Homo sapien
tataaccagctcagagctgaacata

SEQ ID NO: 521497 - DNA, 25 bp, Homo sapien
aaccagctcagagctgaacataatt

SEQ ID NO: 521498 - DNA, 25 bp, Homo sapien
ttggttttccatgaatacagcatgt

SEQ ID NO: 521499 - DNA, 25 bp, Homo sapien
ggttttccatgaatacagcatgtat

SEQ ID NO: 521500 - DNA, 25 bp, Homo sapien
gttttccatgaatacagcatgtata

SEQ ID NO: 521501 - DNA, 25 bp, Homo sapien
taccaactattacttccctgactga

SEQ ID NO: 521502 - DNA, 25 bp, Homo sapien
ttccctgactgagccaatttttctg

SEQ ID NO: 521503 - DNA, 25 bp, Homo sapien
aaagataaggtaggcctgaattctg

SEQ ID NO: 521504 - DNA, 25 bp, Homo sapien
gcgagacaggtgcaaaagacactgc

SEQ ID NO: 521505 - DNA, 25 bp, Homo sapien
aagacactgcagaactcaggctcaa

SEQ ID NO: 521506 - DNA, 25 bp, Homo sapien
gaactcaggctcaaaatctcatcct

SEQ ID NO: 521507 - DNA, 25 bp, Homo sapien
tcaaaatctcatccttaactccttc

SEQ ID NO: 521508 - DNA, 25 bp, Homo sapien
atcccaccatgttgaatcagatgtc

SEQ ID NO: 521509 - DNA, 25 bp, Homo sapien
gaatcagatgtcaatagcaatttta

SEQ ID NO: 521510 - DNA, 25 bp, Homo sapien
tatggcattttttaagcttgcaaaa

SEQ ID NO: 521511 - DNA, 25 bp, Homo sapien
tatcactccatcacagacgaaaaac

SEQ ID NO: 521512 - DNA, 25 bp, Homo sapien
attcttgtttcaaatagaggtttgt

SEQ ID NO: 521513 - DNA, 25 bp, Homo sapien
gaggtttgttaggaattacagttgt

SEQ ID NO: 521514 - DNA, 25 bp, Homo sapien
tttgtgctgttttaatccaaaatgt

SEQ ID NO: 521515 - DNA, 25 bp, Homo sapien
atccaaaatgtatatccttaattgt

SEQ ID NO: 521516 - DNA, 25 bp, Homo sapien
atatgagggtattaagctactttga

SEQ ID NO: 521517 - DNA, 25 bp, Homo sapien
gagggtattaagctactttgaatta

SEQ ID NO: 521518 - DNA, 25 bp, Homo sapien
aattggaatcttttgtattttcgag

SEQ ID NO: 521519 - DNA, 25 bp, Homo sapien
ggaatcttttgtattttcgagcaat

SEQ ID NO: 521520 - DNA, 25 bp, Homo sapien
gtattttcgagcaataagaattcct

SEQ ID NO: 521521 - DNA, 25 bp, Homo sapien
tttcgagcaataagaattcctattc

SEQ ID NO: 521522 - DNA, 25 bp, Homo sapien
agaattcctattcttgtttcaaata

SEQ ID NO: 521523 - DNA, 25 bp, Homo sapien
aaagctcaattcctattttggtgtg

SEQ ID NO: 521524 - DNA, 25 bp, Homo sapien
ttcctattttggtgtgtttatatcc

SEQ ID NO: 521525 - DNA, 25 bp, Homo sapien
gtttatatccatttaggtgtcctat

SEQ ID NO: 521526 - DNA, 25 bp, Homo sapien
ggtgtcctattcttttttgtcatgc

SEQ ID NO: 521527 - DNA, 25 bp, Homo sapien
ctattcttttttgtcatgctttgga

SEQ ID NO: 521528 - DNA, 25 bp, Homo sapien
gtcatgctttggatatttcaaggat

SEQ ID NO: 521529 - DNA, 25 bp, Homo sapien
atctattcatccaagagtacttctg

SEQ ID NO: 521530 - DNA, 25 bp, Homo sapien
aatttatcaaatttgcagcactttg

SEQ ID NO: 521531 - DNA, 25 bp, Homo sapien
tgatgagattgcttcctacctttat

SEQ ID NO: 521532 - DNA, 25 bp, Homo sapien
gcttcctacctttatggatgtcttt

SEQ ID NO: 521533 - DNA, 25 bp, Homo sapien
ttctatgttatctaccattcaaaaa

SEQ ID NO: 521534 - DNA, 25 bp, Homo sapien
aacgagccgtccaggttggcacggt

SEQ ID NO: 521535 - DNA, 25 bp, Homo sapien
ctgagcttggcgtcagcccagtaga

SEQ ID NO: 521536 - DNA, 25 bp, Homo sapien
gcgtcagcccagtagagcttctgct

SEQ ID NO: 521537 - DNA, 25 bp, Homo sapien
tgctcctccaggtcgatggtcagtc

SEQ ID NO: 521538 - DNA, 25 bp, Homo sapien
atggtcagtccattgggccagtaaa

SEQ ID NO: 521539 - DNA, 25 bp, Homo sapien
ggccagtaaatgtccgagtccacaa

SEQ ID NO: 521540 - DNA, 25 bp, Homo sapien
gagtccacaatgatcttccgggtgc

SEQ ID NO: 521541 - DNA, 25 bp, Homo sapien
accccagtctgtccagtacatgtac

SEQ ID NO: 521542 - DNA, 25 bp, Homo sapien
tccagtacatgtacccgtgagcggg

SEQ ID NO: 521543 - DNA, 25 bp, Homo sapien
tgtccccggagaacttcagggcgaa

SEQ ID NO: 521544 - DNA, 25 bp, Homo sapien
ttctgccggaacgagccgtccaggt

SEQ ID NO: 521545 - DNA, 25 bp, Homo sapien
aatacagtactatttctgaagttga

SEQ ID NO: 521546 - DNA, 25 bp, Homo sapien
tatttctgaagttgatagccgatct

SEQ ID NO: 521547 - DNA, 25 bp, Homo sapien
tagccgatctttaagaagaccctgt

SEQ ID NO: 521548 - DNA, 25 bp, Homo sapien
gaaactagcaggcaaacacctaaat

SEQ ID NO: 521549 - DNA, 25 bp, Homo sapien
ggcaaacacctaaataatcgaaaat

SEQ ID NO: 521550 - DNA, 25 bp, Homo sapien
ttattactgtgacaccccttgcatt

SEQ ID NO: 521551 - DNA, 25 bp, Homo sapien
tgacaccccttgcattgctcagttg

SEQ ID NO: 521552 - DNA, 25 bp, Homo sapien
cattgctcagttgcctgtgtgtcaa

SEQ ID NO: 521553 - DNA, 25 bp, Homo sapien
gctcagttgcctgtgtgtcaaaata

SEQ ID NO: 521554 - DNA, 25 bp, Homo sapien
gtcaaaataacttgtggacgttgga

SEQ ID NO: 521555 - DNA, 25 bp, Homo sapien
acttgtggacgttggaaattatttg

SEQ ID NO: 521556 - DNA, 25 bp, Homo sapien
aatctggagagagaatgctcaccca

SEQ ID NO: 521557 - DNA, 25 bp, Homo sapien
tggagagagaatgctcacccaagct

SEQ ID NO: 521558 - DNA, 25 bp, Homo sapien
ggagagagaatgctcacccaagctg

SEQ ID NO: 521559 - DNA, 25 bp, Homo sapien
agagagaatgctcacccaagctgat

SEQ ID NO: 521560 - DNA, 25 bp, Homo sapien
gagagaatgctcacccaagctgatg

SEQ ID NO: 521561 - DNA, 25 bp, Homo sapien
agagaatgctcacccaagctgatga

SEQ ID NO: 521562 - DNA, 25 bp, Homo sapien
agaatgctcacccaagctgatgaaa

SEQ ID NO: 521563 - DNA, 25 bp, Homo sapien
gaatgctcacccaagctgatgaaaa

SEQ ID NO: 521564 - DNA, 25 bp, Homo sapien
aatgctcacccaagctgatgaaaag

SEQ ID NO: 521565 - DNA, 25 bp, Homo sapien
tgctcacccaagctgatgaaaagat

SEQ ID NO: 521566 - DNA, 25 bp, Homo sapien
cacccaagctgatgaaaagatctca

SEQ ID NO: 521567 - DNA, 25 bp, Homo sapien
gagtcctggtgaggtggtgggagtc

SEQ ID NO: 521568 - DNA, 25 bp, Homo sapien
agtcctggtgaggtggtgggagtct

SEQ ID NO: 521569 - DNA, 25 bp, Homo sapien
gtcctggtgaggtggtgggagtctg

SEQ ID NO: 521570 - DNA, 25 bp, Homo sapien
tcctggtgaggtggtgggagtctgg

SEQ ID NO: 521571 - DNA, 25 bp, Homo sapien
cctggtgaggtggtgggagtctggg

SEQ ID NO: 521572 - DNA, 25 bp, Homo sapien
ggagtctgggggacccagcccaact

SEQ ID NO: 521573 - DNA, 25 bp, Homo sapien
gagtctgggggacccagcccaacta

SEQ ID NO: 521574 - DNA, 25 bp, Homo sapien
cccagcccaactaaaataagaaatg

SEQ ID NO: 521575 - DNA, 25 bp, Homo sapien
ccagcccaactaaaataagaaatga

SEQ ID NO: 521576 - DNA, 25 bp, Homo sapien
aaaataagaaatgacggccgggcat

SEQ ID NO: 521577 - DNA, 25 bp, Homo sapien
aaataagaaatgacggccgggcatg

SEQ ID NO: 521578 - DNA, 25 bp, Homo sapien
ggagaaatgcaccacctcattcatt

SEQ ID NO: 521579 - DNA, 25 bp, Homo sapien
atgcaccacctcattcattgtaaat

SEQ ID NO: 521580 - DNA, 25 bp, Homo sapien
cttagaaatcctattaatcgtgtga

SEQ ID NO: 521581 - DNA, 25 bp, Homo sapien
taatttgttttatgtcctctagtga

SEQ ID NO: 521582 - DNA, 25 bp, Homo sapien
gttttatgtcctctagtgatctaag

SEQ ID NO: 521583 - DNA, 25 bp, Homo sapien
gtcctctagtgatctaagcatgaag

SEQ ID NO: 521584 - DNA, 25 bp, Homo sapien
ggcaaatgttaatgcttatctgtat

SEQ ID NO: 521585 - DNA, 25 bp, Homo sapien
aatcgtgtgaggtacctgggtcata

SEQ ID NO: 521586 - DNA, 25 bp, Homo sapien
ggtacctgggtcatagtagcagctt

SEQ ID NO: 521587 - DNA, 25 bp, Homo sapien
ggtcatagtagcagcttcatgcagt

SEQ ID NO: 521588 - DNA, 25 bp, Homo sapien
gcagcttcatgcagtgttaaaatta

SEQ ID NO: 521589 - DNA, 25 bp, Homo sapien
gcccacctgggtaccccatagatcc

SEQ ID NO: 521590 - DNA, 25 bp, Homo sapien
cacctgggtaccccatagatcccct

SEQ ID NO: 521591 - DNA, 25 bp, Homo sapien
ggtaccccatagatcccctcccctg

SEQ ID NO: 521592 - DNA, 25 bp, Homo sapien
gatcccctcccctggataagaatcc

SEQ ID NO: 521593 - DNA, 25 bp, Homo sapien
tcccctcccctggataagaatccct

SEQ ID NO: 521594 - DNA, 25 bp, Homo sapien
cccctcccctggataagaatccctg

SEQ ID NO: 521595 - DNA, 25 bp, Homo sapien
cctcccctggataagaatccctggg

SEQ ID NO: 521596 - DNA, 25 bp, Homo sapien
ctcccctggataagaatccctgggc

SEQ ID NO: 521597 - DNA, 25 bp, Homo sapien
tcccctggataagaatccctgggcc

SEQ ID NO: 521598 - DNA, 25 bp, Homo sapien
caaggcccccgaagagaggagagac

SEQ ID NO: 521599 - DNA, 25 bp, Homo sapien
agacccaacggtgagctcagagcaa

SEQ ID NO: 521600 - DNA, 25 bp, Homo sapien
tcagagcaagcttcacgcaggacgc

SEQ ID NO: 521601 - DNA, 25 bp, Homo sapien
aagcttcacgcaggacgctccgaaa

SEQ ID NO: 521602 - DNA, 25 bp, Homo sapien
aggacgctccgaaacactgtgtgga

SEQ ID NO: 521603 - DNA, 25 bp, Homo sapien
tgattctccttcctccgaacgggct

SEQ ID NO: 521604 - DNA, 25 bp, Homo sapien
cgaacgggctccttgatggcctggc

SEQ ID NO: 521605 - DNA, 25 bp, Homo sapien
gggctccttgatggcctggccacag

SEQ ID NO: 521606 - DNA, 25 bp, Homo sapien
ggcagctccccattggctgttagga

SEQ ID NO: 521607 - DNA, 25 bp, Homo sapien
tccccattggctgttaggaccagag

SEQ ID NO: 521608 - DNA, 25 bp, Homo sapien
ttggctgttaggaccagagtgtgaa

SEQ ID NO: 521609 - DNA, 25 bp, Homo sapien
agatatatcgaatacttctacccat

SEQ ID NO: 521610 - DNA, 25 bp, Homo sapien
tatcgaatacttctacccatctgtt

SEQ ID NO: 521611 - DNA, 25 bp, Homo sapien
atacttctacccatctgttcatagt

SEQ ID NO: 521612 - DNA, 25 bp, Homo sapien
tctacccatctgttcatagtttatg

SEQ ID NO: 521613 - DNA, 25 bp, Homo sapien
catctgttcatagtttatggactga

SEQ ID NO: 521614 - DNA, 25 bp, Homo sapien
tatggactgatgttccaagtttgta

SEQ ID NO: 521615 - DNA, 25 bp, Homo sapien
ctggaacaacatgcactagatttat

SEQ ID NO: 521616 - DNA, 25 bp, Homo sapien
catgcactagatttatgtcagaaat

SEQ ID NO: 521617 - DNA, 25 bp, Homo sapien
tgtcagaaatatctgttggttttcc

SEQ ID NO: 521618 - DNA, 25 bp, Homo sapien
gttttccaaaggttgttaacagatg

SEQ ID NO: 521619 - DNA, 25 bp, Homo sapien
taacagatgaagtttatgtgcaaaa

SEQ ID NO: 521620 - DNA, 25 bp, Homo sapien
atgagcacataagctgtgtccctgt

SEQ ID NO: 521621 - DNA, 25 bp, Homo sapien
cataagctgtgtccctgtgaaaaga

SEQ ID NO: 521622 - DNA, 25 bp, Homo sapien
attcttcatttctctgtgaccattg

SEQ ID NO: 521623 - DNA, 25 bp, Homo sapien
tgtgaccattgatcactgtcctttg

SEQ ID NO: 521624 - DNA, 25 bp, Homo sapien
atcactgtcctttgtgcattgtgtg

SEQ ID NO: 521625 - DNA, 25 bp, Homo sapien
tgcattgtgtgtctaagatgtcttc

SEQ ID NO: 521626 - DNA, 25 bp, Homo sapien
agtgttgctaatgctgttccttctt

SEQ ID NO: 521627 - DNA, 25 bp, Homo sapien
cttccaaaccacagttatttgccca

SEQ ID NO: 521628 - DNA, 25 bp, Homo sapien
agttatttgcccaaactacctctcg

SEQ ID NO: 521629 - DNA, 25 bp, Homo sapien
actacctctcgtggctggtttttca

SEQ ID NO: 521630 - DNA, 25 bp, Homo sapien
gctggtttttcattggcctggcctc

SEQ ID NO: 521631 - DNA, 25 bp, Homo sapien
tccgggcttggcttccttataccag

SEQ ID NO: 521632 - DNA, 25 bp, Homo sapien
cttggcttccttataccagcggaaa

SEQ ID NO: 521633 - DNA, 25 bp, Homo sapien
ggcttccttataccagcggaaaagg

SEQ ID NO: 521634 - DNA, 25 bp, Homo sapien
tcgtgtagagatgccggtggtcaaa

SEQ ID NO: 521635 - DNA, 25 bp, Homo sapien
agagatgccggtggtcaaaagtgca

SEQ ID NO: 521636 - DNA, 25 bp, Homo sapien
ggtgcagtgaagcttgagccttagc

SEQ ID NO: 521637 - DNA, 25 bp, Homo sapien
gagccttagcccgatgtcggcattg

SEQ ID NO: 521638 - DNA, 25 bp, Homo sapien
cttagcccgatgtcggcattggacg

SEQ ID NO: 521639 - DNA, 25 bp, Homo sapien
gacggggtgtagacacgctcctcca

SEQ ID NO: 521640 - DNA, 25 bp, Homo sapien
tccacatcagtctcagtccaagaag

SEQ ID NO: 521641 - DNA, 25 bp, Homo sapien
catcagtctcagtccaagaagaaga

SEQ ID NO: 521642 - DNA, 25 bp, Homo sapien
tgggactaggccaacatagagattg

SEQ ID NO: 521643 - DNA, 25 bp, Homo sapien
agattggcgatggttgtgagattct

SEQ ID NO: 521644 - DNA, 25 bp, Homo sapien
agagtgtgtgtgcatcttgacaata

SEQ ID NO: 521645 - DNA, 25 bp, Homo sapien
gaggctgagcccaagcaggcacatt

SEQ ID NO: 521646 - DNA, 25 bp, Homo sapien
gcccaagcaggcacattctcttcga

SEQ ID NO: 521647 - DNA, 25 bp, Homo sapien
cattcagtctgctttggagtctact

SEQ ID NO: 521648 - DNA, 25 bp, Homo sapien
gagtctactgaacatcaagcttgct

SEQ ID NO: 521649 - DNA, 25 bp, Homo sapien
agagctgaggaattggcctcccaat

SEQ ID NO: 521650 - DNA, 25 bp, Homo sapien
gcctcccaatccgaacaggtgttat

SEQ ID NO: 521651 - DNA, 25 bp, Homo sapien
aatcctttcttaataggttgtgctg

SEQ ID NO: 521652 - DNA, 25 bp, Homo sapien
ataggttgtgctgtggacccaatgt

SEQ ID NO: 521653 - DNA, 25 bp, Homo sapien
attcagaccatagcacttaaccttt

SEQ ID NO: 521654 - DNA, 25 bp, Homo sapien
ttcagaccatagcacttaaccttta

SEQ ID NO: 521655 - DNA, 25 bp, Homo sapien
tcagaccatagcacttaacctttat

SEQ ID NO: 521656 - DNA, 25 bp, Homo sapien
cagaccatagcacttaacctttatt

SEQ ID NO: 521657 - DNA, 25 bp, Homo sapien
agaccatagcacttaacctttattt

SEQ ID NO: 521658 - DNA, 25 bp, Homo sapien
gaccatagcacttaacctttatttt

SEQ ID NO: 521659 - DNA, 25 bp, Homo sapien
taaaccacattagttgggtttggtg

SEQ ID NO: 521660 - DNA, 25 bp, Homo sapien
tgatgggtgcctatagcagcaccta

SEQ ID NO: 521661 - DNA, 25 bp, Homo sapien
gatgggtgcctatagcagcacctac

SEQ ID NO: 521662 - DNA, 25 bp, Homo sapien
ggtgcctatagcagcacctacttgg

SEQ ID NO: 521663 - DNA, 25 bp, Homo sapien
gcctatagcagcacctacttgggag

SEQ ID NO: 521664 - DNA, 25 bp, Homo sapien
tcaagcttcctatgcaccctacttt

SEQ ID NO: 521665 - DNA, 25 bp, Homo sapien
ctttcccaggccaggatggttggca

SEQ ID NO: 521666 - DNA, 25 bp, Homo sapien
gatggttggcactgatcccaaacct

SEQ ID NO: 521667 - DNA, 25 bp, Homo sapien
ctgtggtgagccatttcttcatgtc

SEQ ID NO: 521668 - DNA, 25 bp, Homo sapien
ttcttcatgtccattcagctctgag

SEQ ID NO: 521669 - DNA, 25 bp, Homo sapien
tcctggccctagctgagatcatcat

SEQ ID NO: 521670 - DNA, 25 bp, Homo sapien
tcctcctttgcttttaccccaggag

SEQ ID NO: 521671 - DNA, 25 bp, Homo sapien
gtggattctgattccgtagcagcta

SEQ ID NO: 521672 - DNA, 25 bp, Homo sapien
tgaccatcctgcctttacccataaa

SEQ ID NO: 521673 - DNA, 25 bp, Homo sapien
tgcctttacccataaagcacccgtt

SEQ ID NO: 521674 - DNA, 25 bp, Homo sapien
ccgttcctactgaccaaatctcttt

SEQ ID NO: 521675 - DNA, 25 bp, Homo sapien
actcacacggaagcacgggtcttgt

SEQ ID NO: 521676 - DNA, 25 bp, Homo sapien
gaagcacgggtcttgtctcagtctc

SEQ ID NO: 521677 - DNA, 25 bp, Homo sapien
tcagtctcttcgctgcatttggaaa

SEQ ID NO: 521678 - DNA, 25 bp, Homo sapien
gcatttggaaagcagtctcctctcg

SEQ ID NO: 521679 - DNA, 25 bp, Homo sapien
ggaaagcagtctcctctcgggccag

SEQ ID NO: 521680 - DNA, 25 bp, Homo sapien
agcgccgggctgaggtgtccagagg

SEQ ID NO: 521681 - DNA, 25 bp, Homo sapien
gccacctgctttgggtcaacagttc

SEQ ID NO: 521682 - DNA, 25 bp, Homo sapien
gggtcaacagttcctttgccagcag

SEQ ID NO: 521683 - DNA, 25 bp, Homo sapien
ttgccagcagcatctcctaaattgt

SEQ ID NO: 521684 - DNA, 25 bp, Homo sapien
gcatctcctaaattgtaaggactct

SEQ ID NO: 521685 - DNA, 25 bp, Homo sapien
gagtggagctaacagcttagtcacc

SEQ ID NO: 521686 - DNA, 25 bp, Homo sapien
atgtccatgagccaaacaggcttat

SEQ ID NO: 521687 - DNA, 25 bp, Homo sapien
acaggcttatggaaagttcttctac

SEQ ID NO: 521688 - DNA, 25 bp, Homo sapien
tggaaagttcttctacacacaaaaa

SEQ ID NO: 521689 - DNA, 25 bp, Homo sapien
catccccaaccactgctagaaaatt

SEQ ID NO: 521690 - DNA, 25 bp, Homo sapien
aaccactgctagaaaattggccata

SEQ ID NO: 521691 - DNA, 25 bp, Homo sapien
ttggccataatgaaactgacttgac

SEQ ID NO: 521692 - DNA, 25 bp, Homo sapien
ggttaaaagaccctgtcctagatgc

SEQ ID NO: 521693 - DNA, 25 bp, Homo sapien
cctagatgcccaggaatcaggtagt

SEQ ID NO: 521694 - DNA, 25 bp, Homo sapien
aatcaggtagtcacacattttatgg

SEQ ID NO: 521695 - DNA, 25 bp, Homo sapien
cattttatggacttcatggcagcga

SEQ ID NO: 521696 - DNA, 25 bp, Homo sapien
ttcatggcagcgatgagtaatctgt

SEQ ID NO: 521697 - DNA, 25 bp, Homo sapien
cagctgaggaaggagtttcacccaa

SEQ ID NO: 521698 - DNA, 25 bp, Homo sapien
gctgaggaaggagtttcacccaaga

SEQ ID NO: 521699 - DNA, 25 bp, Homo sapien
gaaggagtttcacccaagattgtgg

SEQ ID NO: 521700 - DNA, 25 bp, Homo sapien
caagattgtgggttttccctttcag

SEQ ID NO: 521701 - DNA, 25 bp, Homo sapien
ttttccctttcagtttcagttatca

SEQ ID NO: 521702 - DNA, 25 bp, Homo sapien
cagttatcatttgttattgattctt

SEQ ID NO: 521703 - DNA, 25 bp, Homo sapien
catttgttattgattcttttctctt

SEQ ID NO: 521704 - DNA, 25 bp, Homo sapien
ttctcttttttcaagggtctgaatc

SEQ ID NO: 521705 - DNA, 25 bp, Homo sapien
gaatccagggaaagctattgcagag

SEQ ID NO: 521706 - DNA, 25 bp, Homo sapien
tcagtttaactgtttccatgctaaa

SEQ ID NO: 521707 - DNA, 25 bp, Homo sapien
ggttttccatgaatacagcatgtat

SEQ ID NO: 521708 - DNA, 25 bp, Homo sapien
agtcagcttggccagtgcttgtgat

SEQ ID NO: 521709 - DNA, 25 bp, Homo sapien
atccccttctcatgggttgggtgaa

SEQ ID NO: 521710 - DNA, 25 bp, Homo sapien
ttgggtgaagcctctagtgctgaag

SEQ ID NO: 521711 - DNA, 25 bp, Homo sapien
aactccccgcttttggctgtcagca

SEQ ID NO: 521712 - DNA, 25 bp, Homo sapien
gagcaagaaccaggaacaactccca

SEQ ID NO: 521713 - DNA, 25 bp, Homo sapien
ggaacaactcccagcatctcagaat

SEQ ID NO: 521714 - DNA, 25 bp, Homo sapien
gcatctcagaatcaaatctccactc

SEQ ID NO: 521715 - DNA, 25 bp, Homo sapien
aaatctccactcctggatgctctag

SEQ ID NO: 521716 - DNA, 25 bp, Homo sapien
gatgctctagtctttcctgattaca

SEQ ID NO: 521717 - DNA, 25 bp, Homo sapien
tttcctgattacaggcccacatgga

SEQ ID NO: 521718 - DNA, 25 bp, Homo sapien
tcagggcattgaggtctggatgtca

SEQ ID NO: 521719 - DNA, 25 bp, Homo sapien
taaaagtatggctgttgagctaaca

SEQ ID NO: 521720 - DNA, 25 bp, Homo sapien
atggctgttgagctaacagatgatt

SEQ ID NO: 521721 - DNA, 25 bp, Homo sapien
aacagatgattttataacatgaccc

SEQ ID NO: 521722 - DNA, 25 bp, Homo sapien
aacaaatttacctggggcgtgatgg

SEQ ID NO: 521723 - DNA, 25 bp, Homo sapien
taacatgacccaatgctatcttgat

SEQ ID NO: 521724 - DNA, 25 bp, Homo sapien
catgacccaatgctatcttgatcca

SEQ ID NO: 521725 - DNA, 25 bp, Homo sapien
gacccaatgctatcttgatccaact

SEQ ID NO: 521726 - DNA, 25 bp, Homo sapien
aatgctatcttgatccaacttaagc

SEQ ID NO: 521727 - DNA, 25 bp, Homo sapien
gctatcttgatccaacttaagccta

SEQ ID NO: 521728 - DNA, 25 bp, Homo sapien
tatcttgatccaacttaagcctaag

SEQ ID NO: 521729 - DNA, 25 bp, Homo sapien
taagcctaagaatcgttgctcccca

SEQ ID NO: 521730 - DNA, 25 bp, Homo sapien
caaatctattttctctgctgtgtat

SEQ ID NO: 521731 - DNA, 25 bp, Homo sapien
ttgtctgtttgcctgttgctcacca

SEQ ID NO: 521732 - DNA, 25 bp, Homo sapien
tgtttgcctgttgctcaccatagac

SEQ ID NO: 521733 - DNA, 25 bp, Homo sapien
ttgcctgttgctcaccatagacata

SEQ ID NO: 521734 - DNA, 25 bp, Homo sapien
gcctgttgctcaccatagacataat

SEQ ID NO: 521735 - DNA, 25 bp, Homo sapien
gttgctcaccatagacataattttc

SEQ ID NO: 521736 - DNA, 25 bp, Homo sapien
aacattctttgtataatcacctcag

SEQ ID NO: 521737 - DNA, 25 bp, Homo sapien
ttctttgtataatcacctcagagat

SEQ ID NO: 521738 - DNA, 25 bp, Homo sapien
acgtgagtaatttcacagtgcgtgt

SEQ ID NO: 521739 - DNA, 25 bp, Homo sapien
atttcacagtgcgtgtattgtatgt

SEQ ID NO: 521740 - DNA, 25 bp, Homo sapien
cacagtgcgtgtattgtatgttatt

SEQ ID NO: 521741 - DNA, 25 bp, Homo sapien
gacttctcgggaaaatcctataact

SEQ ID NO: 521742 - DNA, 25 bp, Homo sapien
atcctataacttgctttactttact

SEQ ID NO: 521743 - DNA, 25 bp, Homo sapien
tactttactttgtcccaggttggag

SEQ ID NO: 521744 - DNA, 25 bp, Homo sapien
tcccacctgatatgcagtgcttttg

SEQ ID NO: 521745 - DNA, 25 bp, Homo sapien
atgcagtgcttttgactatcttatg

SEQ ID NO: 521746 - DNA, 25 bp, Homo sapien
gcttttgactatcttatgcatggtt

SEQ ID NO: 521747 - DNA, 25 bp, Homo sapien
cttatgcatggtttattcctctggc

SEQ ID NO: 521748 - DNA, 25 bp, Homo sapien
tattcctctggcttggatgacaaca

SEQ ID NO: 521749 - DNA, 25 bp, Homo sapien
ggcttggatgacaacaatacccata

SEQ ID NO: 521750 - DNA, 25 bp, Homo sapien
aacaatacccatagtcaattttcct

SEQ ID NO: 521751 - DNA, 25 bp, Homo sapien
aatgatgcaacaacaggccttggga

SEQ ID NO: 521752 - DNA, 25 bp, Homo sapien
aacaaaataacggcagggtgcggtg

SEQ ID NO: 521753 - DNA, 25 bp, Homo sapien
acaaaataacggcagggtgcggtgg

SEQ ID NO: 521754 - DNA, 25 bp, Homo sapien
aaaataacggcagggtgcggtggct

SEQ ID NO: 521755 - DNA, 25 bp, Homo sapien
aaacacaaaatattggccgggcatg

SEQ ID NO: 521756 - DNA, 25 bp, Homo sapien
gaggtggagcatgcattgggccgag

SEQ ID NO: 521757 - DNA, 25 bp, Homo sapien
aggtggagcatgcattgggccgaga

SEQ ID NO: 521758 - DNA, 25 bp, Homo sapien
ggtggagcatgcattgggccgagat

SEQ ID NO: 521759 - DNA, 25 bp, Homo sapien
gtggagcatgcattgggccgagatc

SEQ ID NO: 521760 - DNA, 25 bp, Homo sapien
tggagcatgcattgggccgagatcg

SEQ ID NO: 521761 - DNA, 25 bp, Homo sapien
ggagcatgcattgggccgagatcgc

SEQ ID NO: 521762 - DNA, 25 bp, Homo sapien
gagcatgcattgggccgagatcgcg

SEQ ID NO: 521763 - DNA, 25 bp, Homo sapien
aaaatagcaacttggcattctttat

SEQ ID NO: 521764 - DNA, 25 bp, Homo sapien
gcaacttggcattctttattttgtt

SEQ ID NO: 521765 - DNA, 25 bp, Homo sapien
tcctggttgttttatttggagggat

SEQ ID NO: 521766 - DNA, 25 bp, Homo sapien
tggagggataataaatgtctaagtt

SEQ ID NO: 521767 - DNA, 25 bp, Homo sapien
atgtctaagttatttccattaaaat

SEQ ID NO: 521768 - DNA, 25 bp, Homo sapien
gtatactttatgtgtgccattttaa

SEQ ID NO: 521769 - DNA, 25 bp, Homo sapien
tttaaagtatatgcaagttctaagc

SEQ ID NO: 521770 - DNA, 25 bp, Homo sapien
aagttctaagcaataatctgcatgt

SEQ ID NO: 521771 - DNA, 25 bp, Homo sapien
atctgcatgttatacaaggttgaca

SEQ ID NO: 521772 - DNA, 25 bp, Homo sapien
aaggttgacatattttgtcctgaaa

SEQ ID NO: 521773 - DNA, 25 bp, Homo sapien
gtatgaatcagtgttactaggactt

SEQ ID NO: 521774 - DNA, 25 bp, Homo sapien
aattcctcgcactttattctcctgg

SEQ ID NO: 521775 - DNA, 25 bp, Homo sapien
tcgcactttattctcctgggtggtt

SEQ ID NO: 521776 - DNA, 25 bp, Homo sapien
tattctcctgggtggtttcgaacta

SEQ ID NO: 521777 - DNA, 25 bp, Homo sapien
tggtttcgaactaccctgtttctca

SEQ ID NO: 521778 - DNA, 25 bp, Homo sapien
ttcgaactaccctgtttctcagtgg

SEQ ID NO: 521779 - DNA, 25 bp, Homo sapien
aactaccctgtttctcagtggccat

SEQ ID NO: 521780 - DNA, 25 bp, Homo sapien
gggcttaatgactcaaaatctggga

SEQ ID NO: 521781 - DNA, 25 bp, Homo sapien
cccctctttcagcttagaatttggg

SEQ ID NO: 521782 - DNA, 25 bp, Homo sapien
gggaacctatagagaagtcacagaa

SEQ ID NO: 521783 - DNA, 25 bp, Homo sapien
gaagtcacagaatcccatgaaaggg

SEQ ID NO: 521784 - DNA, 25 bp, Homo sapien
gtctctgtctctgtgactgtaaatc

SEQ ID NO: 521785 - DNA, 25 bp, Homo sapien
gagggacatgtagattgtgtgcatt

SEQ ID NO: 521786 - DNA, 25 bp, Homo sapien
catgtagattgtgtgcattgtgcat

SEQ ID NO: 521787 - DNA, 25 bp, Homo sapien
tgtgcattgtgcatagtcaaggaaa

SEQ ID NO: 521788 - DNA, 25 bp, Homo sapien
gtcaaggaaatcctagggccacctc

SEQ ID NO: 521789 - DNA, 25 bp, Homo sapien
tagggccacctccagttcatttgtg

SEQ ID NO: 521790 - DNA, 25 bp, Homo sapien
cacctccagttcatttgtgtgggaa

SEQ ID NO: 521791 - DNA, 25 bp, Homo sapien
ctccagttcatttgtgtgggaacaa

SEQ ID NO: 521792 - DNA, 25 bp, Homo sapien
tcacttccttcaaactttttatctg

SEQ ID NO: 521793 - DNA, 25 bp, Homo sapien
gattgtctaaaattctaaccatgct

SEQ ID NO: 521794 - DNA, 25 bp, Homo sapien
taaaattctaaccatgcttttaact

SEQ ID NO: 521795 - DNA, 25 bp, Homo sapien
ctgaaggtcattgttcttgcctgtg

SEQ ID NO: 521796 - DNA, 25 bp, Homo sapien
caactggtaggtgcacagccgggtt

SEQ ID NO: 521797 - DNA, 25 bp, Homo sapien
acagccgggttctcgcactgcaaaa

SEQ ID NO: 521798 - DNA, 25 bp, Homo sapien
ggttctcgcactgcaaaaccacagg

SEQ ID NO: 521799 - DNA, 25 bp, Homo sapien
acttaatcatcccagcaactcttta

SEQ ID NO: 521800 - DNA, 25 bp, Homo sapien
accacaggcccctttggtggacaga

SEQ ID NO: 521801 - DNA, 25 bp, Homo sapien
gattccgaggattggatagtccatt

SEQ ID NO: 521802 - DNA, 25 bp, Homo sapien
atggcccattaccagaatcatgtga

SEQ ID NO: 521803 - DNA, 25 bp, Homo sapien
aggagtaccacagcaatcaccaaac

SEQ ID NO: 521804 - DNA, 25 bp, Homo sapien
caccaaactataactgagctcccaa

SEQ ID NO: 521805 - DNA, 25 bp, Homo sapien
atgccacccctgttgtgaggatgaa

SEQ ID NO: 521806 - DNA, 25 bp, Homo sapien
gaatcatctgatttttggagaggtt

SEQ ID NO: 521807 - DNA, 25 bp, Homo sapien
cggaagactcctggcccgggattat

SEQ ID NO: 521808 - DNA, 25 bp, Homo sapien
tcctggcccgggattatgccaagaa

SEQ ID NO: 521809 - DNA, 25 bp, Homo sapien
aaaggtgcagtgaccagcgaggccc

SEQ ID NO: 521810 - DNA, 25 bp, Homo sapien
tcaaggaccccgacgtatgcacaga

SEQ ID NO: 521811 - DNA, 25 bp, Homo sapien
ccgacgtatgcacagatcctgtcca

SEQ ID NO: 521812 - DNA, 25 bp, Homo sapien
agctcaccacatatgccatgggcgt

SEQ ID NO: 521813 - DNA, 25 bp, Homo sapien
atgccatgggcgtcaacatctacaa

SEQ ID NO: 521814 - DNA, 25 bp, Homo sapien
gtcaacatctacaaggaagggcagg

SEQ ID NO: 521815 - DNA, 25 bp, Homo sapien
aggatgtacccctgaaaccggatgc

SEQ ID NO: 521816 - DNA, 25 bp, Homo sapien
aaaccggatgctgagtaccctgaat

SEQ ID NO: 521817 - DNA, 25 bp, Homo sapien
cggatgctgagtaccctgaatggct

SEQ ID NO: 521818 - DNA, 25 bp, Homo sapien
gattatatccagactagttgttgga

SEQ ID NO: 521819 - DNA, 25 bp, Homo sapien
gagctgacaaatttggcaggattat

SEQ ID NO: 521820 - DNA, 25 bp, Homo sapien
gcaggattatacagagatgaacgat

SEQ ID NO: 521821 - DNA, 25 bp, Homo sapien
gcagagtcgctgaaacttgaaaact

SEQ ID NO: 521822 - DNA, 25 bp, Homo sapien
gaaactttccaaactcattggccta

SEQ ID NO: 521823 - DNA, 25 bp, Homo sapien
aactcattggcctacgcagaggtgg

SEQ ID NO: 521824 - DNA, 25 bp, Homo sapien
agaggataatggtcctacgcagggc

SEQ ID NO: 521825 - DNA, 25 bp, Homo sapien
ggttttgctacttgttcctatttat

SEQ ID NO: 521826 - DNA, 25 bp, Homo sapien
gttcctatttatgttcctgattcca

SEQ ID NO: 521827 - DNA, 25 bp, Homo sapien
gttcctgattccattttataataca

SEQ ID NO: 521828 - DNA, 25 bp, Homo sapien
tctctgcatgacttggagaaaacaa

SEQ ID NO: 521829 - DNA, 25 bp, Homo sapien
aagtgcttaaaccaccactcttagg

SEQ ID NO: 521830 - DNA, 25 bp, Homo sapien
actcttaggtctgctcactcttaga

SEQ ID NO: 521831 - DNA, 25 bp, Homo sapien
gtctgctcactcttagaacacacaa

SEQ ID NO: 521832 - DNA, 25 bp, Homo sapien
gggtttttgttttcactcattgtgg

SEQ ID NO: 521833 - DNA, 25 bp, Homo sapien
cattgtggtccccaagcctattgac

SEQ ID NO: 521834 - DNA, 25 bp, Homo sapien
aagcctattgacactagttgcctag

SEQ ID NO: 521835 - DNA, 25 bp, Homo sapien
tagttgcctagagtcccactgtgag

SEQ ID NO: 521836 - DNA, 25 bp, Homo sapien
ccactgtgagtcatggtcagcctgt

SEQ ID NO: 521837 - DNA, 25 bp, Homo sapien
tggtcagcctgtctgacatccaggt

SEQ ID NO: 521838 - DNA, 25 bp, Homo sapien
gtctgacatccaggttgtgctatta

SEQ ID NO: 521839 - DNA, 25 bp, Homo sapien
gaggcttagatgacttctgcaggat

SEQ ID NO: 521840 - DNA, 25 bp, Homo sapien
aagcagccctacagccgggatggga

SEQ ID NO: 521841 - DNA, 25 bp, Homo sapien
gatgggaggcacgtggcctctcttt

SEQ ID NO: 521842 - DNA, 25 bp, Homo sapien
gcctctcttttatccgtctatttat

SEQ ID NO: 521843 - DNA, 25 bp, Homo sapien
tttattttgtaagtgtattcgtgtg

SEQ ID NO: 521844 - DNA, 25 bp, Homo sapien
gtggaggaggttgttgctttatttt

SEQ ID NO: 521845 - DNA, 25 bp, Homo sapien
tttaaggctctggagtgttgtgtat

SEQ ID NO: 521846 - DNA, 25 bp, Homo sapien
ttgtgtatggtttcttttcacatcc

SEQ ID NO: 521847 - DNA, 25 bp, Homo sapien
cctcccatgggcacttctaagaaga

SEQ ID NO: 521848 - DNA, 25 bp, Homo sapien
aggagagaggaatcccctagagcag

SEQ ID NO: 521849 - DNA, 25 bp, Homo sapien
agaggaatcccctagagcagggaaa

SEQ ID NO: 521850 - DNA, 25 bp, Homo sapien
agctgttgtgcaccttcctgagaaa

SEQ ID NO: 521851 - DNA, 25 bp, Homo sapien
aaaactccttgcttatgtctttgta

SEQ ID NO: 521852 - DNA, 25 bp, Homo sapien
actccttgcttatgtctttgtattg

SEQ ID NO: 521853 - DNA, 25 bp, Homo sapien
gcttatgtctttgtattgcacattt

SEQ ID NO: 521854 - DNA, 25 bp, Homo sapien
gtatgcacatttcacaatggaggaa

SEQ ID NO: 521855 - DNA, 25 bp, Homo sapien
actgaggtaaagtgagcagggatac

SEQ ID NO: 521856 - DNA, 25 bp, Homo sapien
gaagagagctggagcctcacagtct

SEQ ID NO: 521857 - DNA, 25 bp, Homo sapien
agagctggagcctcacagtctgatt

SEQ ID NO: 521858 - DNA, 25 bp, Homo sapien
ctcacagtctgattctctcattgta

SEQ ID NO: 521859 - DNA, 25 bp, Homo sapien
gattctctcattgtacataaccttt

SEQ ID NO: 521860 - DNA, 25 bp, Homo sapien
tgtacataacctttagggtctttgt

SEQ ID NO: 521861 - DNA, 25 bp, Homo sapien
gggcactgttggcttgggctggtac

SEQ ID NO: 521862 - DNA, 25 bp, Homo sapien
agtccattccagagtcgaccagaag

SEQ ID NO: 521863 - DNA, 25 bp, Homo sapien
agagtcgaccagaagctgggtctga

SEQ ID NO: 521864 - DNA, 25 bp, Homo sapien
gggtctgaggattaccagcctcacg

SEQ ID NO: 521865 - DNA, 25 bp, Homo sapien
agcctcacggagtgacttccagaaa

SEQ ID NO: 521866 - DNA, 25 bp, Homo sapien
cttccagaaatatcctgacccacaa

SEQ ID NO: 521867 - DNA, 25 bp, Homo sapien
tgacccacaaggacgtaacagaaaa

SEQ ID NO: 521868 - DNA, 25 bp, Homo sapien
agacccaagtggtagagtccagact

SEQ ID NO: 521869 - DNA, 25 bp, Homo sapien
ccacctggagccaaggatgcaaatg

SEQ ID NO: 521870 - DNA, 25 bp, Homo sapien
ggctcaacaaggacactgcttgaga

SEQ ID NO: 521871 - DNA, 25 bp, Homo sapien
gaagccaagacccagtgggcgcatc

SEQ ID NO: 521872 - DNA, 25 bp, Homo sapien
ggtccgtgctgcatgcagatgagat

SEQ ID NO: 521873 - DNA, 25 bp, Homo sapien
ctctgccttgcttcagataggatat

SEQ ID NO: 521874 - DNA, 25 bp, Homo sapien
ccttctttttctaatgtagcagtga

SEQ ID NO: 521875 - DNA, 25 bp, Homo sapien
gatggaaaacaccagtctttgaaga

SEQ ID NO: 521876 - DNA, 25 bp, Homo sapien
aggtgaagtcggctctgtgccatcc

SEQ ID NO: 521877 - DNA, 25 bp, Homo sapien
aatggaggttcccagtgacatgaat

SEQ ID NO: 521878 - DNA, 25 bp, Homo sapien
gcatagaattctggtgccttgctcc

SEQ ID NO: 521879 - DNA, 25 bp, Homo sapien
aattctggtgccttgctccctgggt

SEQ ID NO: 521880 - DNA, 25 bp, Homo sapien
ggctctgtgccatcctgaaaaatca

SEQ ID NO: 521881 - DNA, 25 bp, Homo sapien
gataggtggacttcatcagatttgt

SEQ ID NO: 521882 - DNA, 25 bp, Homo sapien
atcagatttgtcagtccttccttgt

SEQ ID NO: 521883 - DNA, 25 bp, Homo sapien
gtcagtccttccttgttttaaagag

SEQ ID NO: 521884 - DNA, 25 bp, Homo sapien
gtgctgtgtcttggcgtgttctcct

SEQ ID NO: 521885 - DNA, 25 bp, Homo sapien
tcttggcgtgttctcctacgtgaag

SEQ ID NO: 521886 - DNA, 25 bp, Homo sapien
gcgtgttctcctacgtgaaggtggc

SEQ ID NO: 521887 - DNA, 25 bp, Homo sapien
ttctcctacgtgaaggtggcagcca

SEQ ID NO: 521888 - DNA, 25 bp, Homo sapien
ctacgtgaaggtggcagccagctcc

SEQ ID NO: 521889 - DNA, 25 bp, Homo sapien
cgtggccatccaggtgggctctctg

SEQ ID NO: 521890 - DNA, 25 bp, Homo sapien
tgctcggcgctgttgctatgttccc

SEQ ID NO: 521891 - DNA, 25 bp, Homo sapien
cgaccagcatctatcacgtgttcca

SEQ ID NO: 521892 - DNA, 25 bp, Homo sapien
atctatcacgtgttccacagcagaa

SEQ ID NO: 521893 - DNA, 25 bp, Homo sapien
aaggactgtgcagacccctgtgact

SEQ ID NO: 521894 - DNA, 25 bp, Homo sapien
tgtgcagacccctgtgactcctgag

SEQ ID NO: 521895 - DNA, 25 bp, Homo sapien
tttgtttttgacatcagctgtaatc

SEQ ID NO: 521896 - DNA, 25 bp, Homo sapien
catcagctgtaatcattcctgtgct

SEQ ID NO: 521897 - DNA, 25 bp, Homo sapien
cccttggtaggtattagacttgcac

SEQ ID NO: 521898 - DNA, 25 bp, Homo sapien
aaaaaggtttctgcatcgtggaagc

SEQ ID NO: 521899 - DNA, 25 bp, Homo sapien
tgcatcgtggaagcatttgacccag

SEQ ID NO: 521900 - DNA, 25 bp, Homo sapien
gcatttgacccagagtggaacgcgt

SEQ ID NO: 521901 - DNA, 25 bp, Homo sapien
aacgcgtggcctatgcaggtggatt

SEQ ID NO: 521902 - DNA, 25 bp, Homo sapien
atgcaggtggattccttcaggtctt

SEQ ID NO: 521903 - DNA, 25 bp, Homo sapien
gattccttcaggtctttcctttggt

SEQ ID NO: 521904 - DNA, 25 bp, Homo sapien
tttcattcgtctcccgtctttggtt

SEQ ID NO: 521905 - DNA, 25 bp, Homo sapien
cgtctttggttctccagttcaaatt

SEQ ID NO: 521906 - DNA, 25 bp, Homo sapien
tgggcgtgcgcccatcacacatatg

SEQ ID NO: 521907 - DNA, 25 bp, Homo sapien
atcacacatatgcaacgacgtcttc

SEQ ID NO: 521908 - DNA, 25 bp, Homo sapien
acatatgcaacgacgtcttccacgt

SEQ ID NO: 521909 - DNA, 25 bp, Homo sapien
cgccactcgctcaggtagcgggaca

SEQ ID NO: 521910 - DNA, 25 bp, Homo sapien
agcagggtgatgtagtagaacttcc

SEQ ID NO: 521911 - DNA, 25 bp, Homo sapien
ttgtacgggcagtccatgaactcct

SEQ ID NO: 521912 - DNA, 25 bp, Homo sapien
tagtagaacttcctgggcgtgcgca

SEQ ID NO: 521913 - DNA, 25 bp, Homo sapien
gcacgcagttggtgagctcggtcca

SEQ ID NO: 521914 - DNA, 25 bp, Homo sapien
agctcggtccagtcggcgtgcagcc

SEQ ID NO: 521915 - DNA, 25 bp, Homo sapien
agtccatgaactcctgtagcgtgca

SEQ ID NO: 521916 - DNA, 25 bp, Homo sapien
tgaactcctgtagcgtgcagcccga

SEQ ID NO: 521917 - DNA, 25 bp, Homo sapien
gaagtatgagacaccctcctgaaca

SEQ ID NO: 521918 - DNA, 25 bp, Homo sapien
atgagacaccctcctgaacagacaa

SEQ ID NO: 521919 - DNA, 25 bp, Homo sapien
gacaaatggtgtgcataccccacct

SEQ ID NO: 521920 - DNA, 25 bp, Homo sapien
cctgcgtcggagtctggaagccatc

SEQ ID NO: 521921 - DNA, 25 bp, Homo sapien
gaagccatcaaagcgatgtcctcca

SEQ ID NO: 521922 - DNA, 25 bp, Homo sapien
atcaaagcgatgtcctccaaaggcc

SEQ ID NO: 521923 - DNA, 25 bp, Homo sapien
agcactaagtcctcctcttgggtct

SEQ ID NO: 521924 - DNA, 25 bp, Homo sapien
tccaggctctcctgggagccagagt

SEQ ID NO: 521925 - DNA, 25 bp, Homo sapien
ccagagtttgagcagtggagaaaca

SEQ ID NO: 521926 - DNA, 25 bp, Homo sapien
agtggagaaacagtgcccatccctc

SEQ ID NO: 521927 - DNA, 25 bp, Homo sapien
ctgcccaaggagatggacattcctt

SEQ ID NO: 521928 - DNA, 25 bp, Homo sapien
aaaaaaggtttctgcatcgtggaag

SEQ ID NO: 521929 - DNA, 25 bp, Homo sapien
aaaggtttctgcatcgtggaagcat

SEQ ID NO: 521930 - DNA, 25 bp, Homo sapien
ggtttctgcatcgtggaagcatttg

SEQ ID NO: 521931 - DNA, 25 bp, Homo sapien
gcatcgtggaagcatttgacccaga

SEQ ID NO: 521932 - DNA, 25 bp, Homo sapien
ggaagcatttgacccagagtggaac

SEQ ID NO: 521933 - DNA, 25 bp, Homo sapien
catttgacccagagtggaacgcgtg

SEQ ID NO: 521934 - DNA, 25 bp, Homo sapien
tttgctttcattcgtctcccgtctt

SEQ ID NO: 521935 - DNA, 25 bp, Homo sapien
tttcattcgtctcccgtctttggtt

SEQ ID NO: 521936 - DNA, 25 bp, Homo sapien
ccgtctttggttctccagttcaaat

SEQ ID NO: 521937 - DNA, 25 bp, Homo sapien
gtctttggttctccagttcaaatta

SEQ ID NO: 521938 - DNA, 25 bp, Homo sapien
tttggttctccagttcaaattattg

SEQ ID NO: 521939 - DNA, 25 bp, Homo sapien
ggcaaatttcagtctgctacacttt

SEQ ID NO: 521940 - DNA, 25 bp, Homo sapien
gtctgctacactttgttaggtccag

SEQ ID NO: 521941 - DNA, 25 bp, Homo sapien
gaaggagctgcccatactactttct

SEQ ID NO: 521942 - DNA, 25 bp, Homo sapien
atactactttcttatgagcatgctc

SEQ ID NO: 521943 - DNA, 25 bp, Homo sapien
gagcatgctcagtatggcatatgga

SEQ ID NO: 521944 - DNA, 25 bp, Homo sapien
atttgtatgcagtagagagcctgtt

SEQ ID NO: 521945 - DNA, 25 bp, Homo sapien
gcctgttgtagaaaacgctccctgt

SEQ ID NO: 521946 - DNA, 25 bp, Homo sapien
aaaacgctccctgtatcttgctgta

SEQ ID NO: 521947 - DNA, 25 bp, Homo sapien
aaagctgaattccacattgccaaca

SEQ ID NO: 521948 - DNA, 25 bp, Homo sapien
aaatgttcatgaaccttcctccagg

SEQ ID NO: 521949 - DNA, 25 bp, Homo sapien
ggaaaagccattcaagcctgattat

SEQ ID NO: 521950 - DNA, 25 bp, Homo sapien
agagatgccagcaggatgccacttt

SEQ ID NO: 521951 - DNA, 25 bp, Homo sapien
aggatgccactttgccagcccgaca

SEQ ID NO: 521952 - DNA, 25 bp, Homo sapien
gcccgacacacggacctttgtaaag

SEQ ID NO: 521953 - DNA, 25 bp, Homo sapien
gcagcgtgtgaccagattgtgtccc

SEQ ID NO: 521954 - DNA, 25 bp, Homo sapien
ttgtgtcccgtcattgggtggcata

SEQ ID NO: 521955 - DNA, 25 bp, Homo sapien
aattcatgtacatttgcaacagcca

SEQ ID NO: 521956 - DNA, 25 bp, Homo sapien
agccagcccggtacagcctgtgtga

SEQ ID NO: 521957 - DNA, 25 bp, Homo sapien
gtacagcctgtgtgacttctctgta

SEQ ID NO: 521958 - DNA, 25 bp, Homo sapien
gtgtcgtgaccagcctaagtagtta

SEQ ID NO: 521959 - DNA, 25 bp, Homo sapien
aagatgctgatgtgcagtcacccat

SEQ ID NO: 521960 - DNA, 25 bp, Homo sapien
tgtgcagtcacccatcagagaaaat

SEQ ID NO: 521961 - DNA, 25 bp, Homo sapien
cacagtgccttacacaagagtggtc

SEQ ID NO: 521962 - DNA, 25 bp, Homo sapien
gtgccttacacaagagtggtcataa

SEQ ID NO: 521963 - DNA, 25 bp, Homo sapien
tttgaactgagtcccactacctcgg

SEQ ID NO: 521964 - DNA, 25 bp, Homo sapien
ctccccacttgttcaggcttctaaa

SEQ ID NO: 521965 - DNA, 25 bp, Homo sapien
acttgttcaggcttctaaaccagga

SEQ ID NO: 521966 - DNA, 25 bp, Homo sapien
gcttctaaaccaggaggcctccatt

SEQ ID NO: 521967 - DNA, 25 bp, Homo sapien
cattcactcccgttctcatttacat

SEQ ID NO: 521968 - DNA, 25 bp, Homo sapien
tcccgttctcatttacatctgtttt

SEQ ID NO: 521969 - DNA, 25 bp, Homo sapien
gttctcatttacatctgttttcctg

SEQ ID NO: 521970 - DNA, 25 bp, Homo sapien
catctgttttcctgttgtatatatc

SEQ ID NO: 521971 - DNA, 25 bp, Homo sapien
cctgttgtatatatcacctttgttg

SEQ ID NO: 521972 - DNA, 25 bp, Homo sapien
ctgaagcattggtggtgcagtgtaa

SEQ ID NO: 521973 - DNA, 25 bp, Homo sapien
agagacaagacctgatcatctgatc

SEQ ID NO: 521974 - DNA, 25 bp, Homo sapien
gatcatctgatcacacttgtgccaa

SEQ ID NO: 521975 - DNA, 25 bp, Homo sapien
cacacttgtgccaacttgattcata

SEQ ID NO: 521976 - DNA, 25 bp, Homo sapien
ttgggcattactaacaacccctggg

SEQ ID NO: 521977 - DNA, 25 bp, Homo sapien
aatcaataacattatccctgcctgc

SEQ ID NO: 521978 - DNA, 25 bp, Homo sapien
ctgcctgcatacatgtgaacaaaag

SEQ ID NO: 521979 - DNA, 25 bp, Homo sapien
gaggacatgcaaattctacagtcat

SEQ ID NO: 521980 - DNA, 25 bp, Homo sapien
gcaaattctacagtcattcctcata

SEQ ID NO: 521981 - DNA, 25 bp, Homo sapien
gtcattcctcatatgctttagacag

SEQ ID NO: 521982 - DNA, 25 bp, Homo sapien
agagtgcagctactggaatcttcca

SEQ ID NO: 521983 - DNA, 25 bp, Homo sapien
aactaagcaggcaggccgggcgtgg

SEQ ID NO: 521984 - DNA, 25 bp, Homo sapien
actaagcaggcaggccgggcgtggt

SEQ ID NO: 521985 - DNA, 25 bp, Homo sapien
ctaagcaggcaggccgggcgtggtt

SEQ ID NO: 521986 - DNA, 25 bp, Homo sapien
taagcaggcaggccgggcgtggttg

SEQ ID NO: 521987 - DNA, 25 bp, Homo sapien
aagcaggcaggccgggcgtggttgc

SEQ ID NO: 521988 - DNA, 25 bp, Homo sapien
agcaggcaggccgggcgtggttgct

SEQ ID NO: 521989 - DNA, 25 bp, Homo sapien
gcaggcaggccgggcgtggttgctc

SEQ ID NO: 521990 - DNA, 25 bp, Homo sapien
caggcaggccgggcgtggttgctca

SEQ ID NO: 521991 - DNA, 25 bp, Homo sapien
aggcaggccgggcgtggttgctcac

SEQ ID NO: 521992 - DNA, 25 bp, Homo sapien
ggcaggccgggcgtggttgctcacg

SEQ ID NO: 521993 - DNA, 25 bp, Homo sapien
gaaccagttgccaaggtagagagct

SEQ ID NO: 521994 - DNA, 25 bp, Homo sapien
ccagttgccaaggtagagagctgcc

SEQ ID NO: 521995 - DNA, 25 bp, Homo sapien
acatcaacaagacggctgccaacct

SEQ ID NO: 521996 - DNA, 25 bp, Homo sapien
aagacggctgccaacctgagaagtc

SEQ ID NO: 521997 - DNA, 25 bp, Homo sapien
gctgccaacctgagaagtcaccaaa

SEQ ID NO: 521998 - DNA, 25 bp, Homo sapien
acagccttcagggaaagactaccag

SEQ ID NO: 521999 - DNA, 25 bp, Homo sapien
cagggaaagactaccagctctgtct

SEQ ID NO: 522000 - DNA, 25 bp, Homo sapien
agctctgtctttctaccctctaatt

SEQ ID NO: 522001 - DNA, 25 bp, Homo sapien
tgtctttctaccctctaatttaaca

SEQ ID NO: 522002 - DNA, 25 bp, Homo sapien
tctaccctctaatttaacaatgcat

SEQ ID NO: 522003 - DNA, 25 bp, Homo sapien
gcataagagtcaataaaccctactt

SEQ ID NO: 522004 - DNA, 25 bp, Homo sapien
ttaatatgaactctgatatggtttg

SEQ ID NO: 522005 - DNA, 25 bp, Homo sapien
cttgacttgtaatctgaattataat

SEQ ID NO: 522006 - DNA, 25 bp, Homo sapien
ggagggacctcctggaacgtgatta

SEQ ID NO: 522007 - DNA, 25 bp, Homo sapien
ggacctcctggaacgtgattagctc

SEQ ID NO: 522008 - DNA, 25 bp, Homo sapien
acctcctggaacgtgattagctcat

SEQ ID NO: 522009 - DNA, 25 bp, Homo sapien
tcctggaacgtgattagctcatggg

SEQ ID NO: 522010 - DNA, 25 bp, Homo sapien
ctgttctagtgatagttctcagagg

SEQ ID NO: 522011 - DNA, 25 bp, Homo sapien
tctagtgatagttctcagaggatct

SEQ ID NO: 522012 - DNA, 25 bp, Homo sapien
tagtgatagttctcagaggatctga

SEQ ID NO: 522013 - DNA, 25 bp, Homo sapien
tcactctgcagttctcttgcctact

SEQ ID NO: 522014 - DNA, 25 bp, Homo sapien
tctcttgcctactgccatgtggaaa

SEQ ID NO: 522015 - DNA, 25 bp, Homo sapien
aaggctcgcccaaggttgctctgtg

SEQ ID NO: 522016 - DNA, 25 bp, Homo sapien
acgcgtccggcttcgaagatccagc

SEQ ID NO: 522017 - DNA, 25 bp, Homo sapien
tgtggtgacagctttacctccttgc

SEQ ID NO: 522018 - DNA, 25 bp, Homo sapien
acctccttgctatgtattctcagat

SEQ ID NO: 522019 - DNA, 25 bp, Homo sapien
aggtcgttcgacgatttcgacacgt

SEQ ID NO: 522020 - DNA, 25 bp, Homo sapien
ttcgacacgtcgcatccctgagagt

SEQ ID NO: 522021 - DNA, 25 bp, Homo sapien
tgagagtctctcgtgtcctgatcaa

SEQ ID NO: 522022 - DNA, 25 bp, Homo sapien
gtgtcctgatcaactcgagaactgg

SEQ ID NO: 522023 - DNA, 25 bp, Homo sapien
aagatccagcggcttgctgtgagtc

SEQ ID NO: 522024 - DNA, 25 bp, Homo sapien
aactggaggcggtgacattttagat

SEQ ID NO: 522025 - DNA, 25 bp, Homo sapien
gggaggcaaaattgtacccatttca

SEQ ID NO: 522026 - DNA, 25 bp, Homo sapien
agtgatgaatttgggttaccttctc

SEQ ID NO: 522027 - DNA, 25 bp, Homo sapien
tgggttaccttctcatgtgaacctg

SEQ ID NO: 522028 - DNA, 25 bp, Homo sapien
aagctcatgatgaactttatcacta

SEQ ID NO: 522029 - DNA, 25 bp, Homo sapien
gtgaacctggagattcaccagtctt

SEQ ID NO: 522030 - DNA, 25 bp, Homo sapien
gtgttttctctacattcatgcattg

SEQ ID NO: 522031 - DNA, 25 bp, Homo sapien
tcatgcattggatgttttgctaaat

SEQ ID NO: 522032 - DNA, 25 bp, Homo sapien
ttttgctaaataactcctgtggatt

SEQ ID NO: 522033 - DNA, 25 bp, Homo sapien
gtgctaatagcaatcttcctaattt

SEQ ID NO: 522034 - DNA, 25 bp, Homo sapien
ctatgcagttgagtattgaaagctt

SEQ ID NO: 522035 - DNA, 25 bp, Homo sapien
tttatcactagttatgccaccttaa

SEQ ID NO: 522036 - DNA, 25 bp, Homo sapien
gaaatggtgactcttgtctaaattt

SEQ ID NO: 522037 - DNA, 25 bp, Homo sapien
gcccttgcgcagagccactgtgaga

SEQ ID NO: 522038 - DNA, 25 bp, Homo sapien
gggcagtactgctcggcacatccca

SEQ ID NO: 522039 - DNA, 25 bp, Homo sapien
tgctcggcacatcccagcatcaggt

SEQ ID NO: 522040 - DNA, 25 bp, Homo sapien
attaagttcatatccaccttttggg

SEQ ID NO: 522041 - DNA, 25 bp, Homo sapien
ccaccaagtgtgtgacttctccata

SEQ ID NO: 522042 - DNA, 25 bp, Homo sapien
acttctccatatcccactgcagttt

SEQ ID NO: 522043 - DNA, 25 bp, Homo sapien
atgggaattttcaatcccctgtgct

SEQ ID NO: 522044 - DNA, 25 bp, Homo sapien
ttttcaatcccctgtgcttgtctaa

SEQ ID NO: 522045 - DNA, 25 bp, Homo sapien
gtgcttgtctaacgtctgctttaaa

SEQ ID NO: 522046 - DNA, 25 bp, Homo sapien
tgctttaaaaagtttgagaccctgt

SEQ ID NO: 522047 - DNA, 25 bp, Homo sapien
gagaccctgttactgtttgaaaatg

SEQ ID NO: 522048 - DNA, 25 bp, Homo sapien
ctcacctccggcagctgatggatga

SEQ ID NO: 522049 - DNA, 25 bp, Homo sapien
agggagcccggagctctaactcatc

SEQ ID NO: 522050 - DNA, 25 bp, Homo sapien
ctaactcatcatccccatcagtttt

SEQ ID NO: 522051 - DNA, 25 bp, Homo sapien
ctctcagacctgtctttgaggacaa

SEQ ID NO: 522052 - DNA, 25 bp, Homo sapien
cagatttgtcagctgtcagggtgca

SEQ ID NO: 522053 - DNA, 25 bp, Homo sapien
tcagagactatgtggtccatcgcct

SEQ ID NO: 522054 - DNA, 25 bp, Homo sapien
ggtccatcgccttcattgtgtaaat

SEQ ID NO: 522055 - DNA, 25 bp, Homo sapien
aggacacagactggcttggtcgcag

SEQ ID NO: 522056 - DNA, 25 bp, Homo sapien
agactggcttggtcgcagtgactgt

SEQ ID NO: 522057 - DNA, 25 bp, Homo sapien
gtgactgtggtgtccttgagatgct

SEQ ID NO: 522058 - DNA, 25 bp, Homo sapien
ttgagatgctcacattactgcccgg

SEQ ID NO: 522059 - DNA, 25 bp, Homo sapien
aacgggctgcgctgcacggacgaat

SEQ ID NO: 522060 - DNA, 25 bp, Homo sapien
ggacgaatgccgcaccgtcattgag

SEQ ID NO: 522061 - DNA, 25 bp, Homo sapien
atgccgcaccgtcattgaggacatg

SEQ ID NO: 522062 - DNA, 25 bp, Homo sapien
gctgctcaacgactgcgtgtgcgac

SEQ ID NO: 522063 - DNA, 25 bp, Homo sapien
acgactgcgtgtgcgacggcctcga

SEQ ID NO: 522064 - DNA, 25 bp, Homo sapien
ggcccatctgcgagtcggtcaagga

SEQ ID NO: 522065 - DNA, 25 bp, Homo sapien
gtcaaggagaacatggcccgcctgt

SEQ ID NO: 522066 - DNA, 25 bp, Homo sapien
ggcctggacgactactacgatgagg

SEQ ID NO: 522067 - DNA, 25 bp, Homo sapien
tacgatgaggactacgatgacgagc

SEQ ID NO: 522068 - DNA, 25 bp, Homo sapien
actacgatgacgagcagcgcaccgg

SEQ ID NO: 522069 - DNA, 25 bp, Homo sapien
tgagcagccgctggacgacgacgac

SEQ ID NO: 522070 - DNA, 25 bp, Homo sapien
ggtgtcctcagagcaagccctcaaa

SEQ ID NO: 522071 - DNA, 25 bp, Homo sapien
agcaagccctcaaagagctgggtct

SEQ ID NO: 522072 - DNA, 25 bp, Homo sapien
ccctcaaagagctgggtctggctga

SEQ ID NO: 522073 - DNA, 25 bp, Homo sapien
gtctggctgagcaccagctgcgctt

SEQ ID NO: 522074 - DNA, 25 bp, Homo sapien
atgacacacgcaaggagcaggagac

SEQ ID NO: 522075 - DNA, 25 bp, Homo sapien
aggagacggcattgcgcgtctacag

SEQ ID NO: 522076 - DNA, 25 bp, Homo sapien
agccacctcaagagcgtcctgaagg

SEQ ID NO: 522077 - DNA, 25 bp, Homo sapien
ctcaagagcgtcctgaaggaccact

SEQ ID NO: 522078 - DNA, 25 bp, Homo sapien
tgtgactgtggagtccgtcctcctc

SEQ ID NO: 522079 - DNA, 25 bp, Homo sapien
tgctggtctcctggacctaccagga

SEQ ID NO: 522080 - DNA, 25 bp, Homo sapien
cctggacctaccaggacgaggagct

SEQ ID NO: 522081 - DNA, 25 bp, Homo sapien
aaatccaaaatcactcagaggccaa

SEQ ID NO: 522082 - DNA, 25 bp, Homo sapien
agaggccaaatctgtaaaatcaaaa

SEQ ID NO: 522083 - DNA, 25 bp, Homo sapien
gtatcatcatattcccttttgctat

SEQ ID NO: 522084 - DNA, 25 bp, Homo sapien
ccttttctctatgccagataaacac

SEQ ID NO: 522085 - DNA, 25 bp, Homo sapien
gccagataaacactttctccttact

SEQ ID NO: 522086 - DNA, 25 bp, Homo sapien
ataaacactttctccttactcatca

SEQ ID NO: 522087 - DNA, 25 bp, Homo sapien
actttctccttactcatcaatcaag

SEQ ID NO: 522088 - DNA, 25 bp, Homo sapien
ctccttactcatcaatcaagaataa

SEQ ID NO: 522089 - DNA, 25 bp, Homo sapien
gtgtatatatgtttaaactccaaag

SEQ ID NO: 522090 - DNA, 25 bp, Homo sapien
taaactccaaagtttgggacattca

SEQ ID NO: 522091 - DNA, 25 bp, Homo sapien
gggacattcaaacaatgtacatgaa

SEQ ID NO: 522092 - DNA, 25 bp, Homo sapien
ttctgcaagaagacaatgaatccat

SEQ ID NO: 522093 - DNA, 25 bp, Homo sapien
gtatttctatataagtatcttcttc

SEQ ID NO: 522094 - DNA, 25 bp, Homo sapien
tatcttcttcatttttaacctgttt

SEQ ID NO: 522095 - DNA, 25 bp, Homo sapien
gctacataattttgtggctccctaa

SEQ ID NO: 522096 - DNA, 25 bp, Homo sapien
aattttgtggctccctaatgcaata

SEQ ID NO: 522097 - DNA, 25 bp, Homo sapien
gtggctccctaatgcaataatgtac

SEQ ID NO: 522098 - DNA, 25 bp, Homo sapien
tttgtctttctgttcgctgaatata

SEQ ID NO: 522099 - DNA, 25 bp, Homo sapien
ctttctgttcgctgaatatattgca

SEQ ID NO: 522100 - DNA, 25 bp, Homo sapien
gaatatattgcaggtcatgctccca

SEQ ID NO: 522101 - DNA, 25 bp, Homo sapien
atttttgcacctcttgtgcattctg

SEQ ID NO: 522102 - DNA, 25 bp, Homo sapien
gcacctcttgtgcattctgcaagaa

SEQ ID NO: 522103 - DNA, 25 bp, Homo sapien
atcaggttggtgtgatgcagactaa

SEQ ID NO: 522104 - DNA, 25 bp, Homo sapien
gtttcctttctgcaaggacttttca

SEQ ID NO: 522105 - DNA, 25 bp, Homo sapien
cagccttcaatgtgtgctgtgcatg

SEQ ID NO: 522106 - DNA, 25 bp, Homo sapien
gtgctgtgcatggtgaatccccaaa

SEQ ID NO: 522107 - DNA, 25 bp, Homo sapien
aatccttgagtctgtagcatttcct

SEQ ID NO: 522108 - DNA, 25 bp, Homo sapien
gcatttcctgaacttacatgaccag

SEQ ID NO: 522109 - DNA, 25 bp, Homo sapien
atgaccaggatactctattttgcag

SEQ ID NO: 522110 - DNA, 25 bp, Homo sapien
tattttgcagatcaccccacagagc

SEQ ID NO: 522111 - DNA, 25 bp, Homo sapien
acagagctagggttccaccgagtat

SEQ ID NO: 522112 - DNA, 25 bp, Homo sapien
ggttccaccgagtatactttgctta

SEQ ID NO: 522113 - DNA, 25 bp, Homo sapien
gacttagcatatctgaggtcttcaa

SEQ ID NO: 522114 - DNA, 25 bp, Homo sapien
tgccattcgccgcacaggccctatt

SEQ ID NO: 522115 - DNA, 25 bp, Homo sapien
attctctcagccctcggcggcgatg

SEQ ID NO: 522116 - DNA, 25 bp, Homo sapien
tcggcggcgatgaggcgctgaggcg

SEQ ID NO: 522117 - DNA, 25 bp, Homo sapien
ctgcgccggagcttaggactcggaa

SEQ ID NO: 522118 - DNA, 25 bp, Homo sapien
gcttaggactcggaagcggccgggc

SEQ ID NO: 522119 - DNA, 25 bp, Homo sapien
cctgaggcgagggtagcgggtgcat

SEQ ID NO: 522120 - DNA, 25 bp, Homo sapien
ggtgcatggcgcagtaacggcccct

SEQ ID NO: 522121 - DNA, 25 bp, Homo sapien
gtgcatggcgcagtaacggccccta

SEQ ID NO: 522122 - DNA, 25 bp, Homo sapien
tgcatggcgcagtaacggcccctat

SEQ ID NO: 522123 - DNA, 25 bp, Homo sapien
gcatggcgcagtaacggcccctatc

SEQ ID NO: 522124 - DNA, 25 bp, Homo sapien
gccgccatggccaatgacagcggcg

SEQ ID NO: 522125 - DNA, 25 bp, Homo sapien
gtttaaacacatttccgagaggcag

SEQ ID NO: 522126 - DNA, 25 bp, Homo sapien
aaacacatttccgagaggcagggca

SEQ ID NO: 522127 - DNA, 25 bp, Homo sapien
cacatttccgagaggcagggcaact

SEQ ID NO: 522128 - DNA, 25 bp, Homo sapien
atttccgagaggcagggcaactaat

SEQ ID NO: 522129 - DNA, 25 bp, Homo sapien
aggcagggcaactaataactggtca

SEQ ID NO: 522130 - DNA, 25 bp, Homo sapien
gggcaactaataactggtcagaaaa

SEQ ID NO: 522131 - DNA, 25 bp, Homo sapien
gtcagaaaaatttagacggtcttca

SEQ ID NO: 522132 - DNA, 25 bp, Homo sapien
caggaaggattaccatgaacttatt

SEQ ID NO: 522133 - DNA, 25 bp, Homo sapien
gaaggattaccatgaacttatttta

SEQ ID NO: 522134 - DNA, 25 bp, Homo sapien
ttattttaaatccatattgtaccag

SEQ ID NO: 522135 - DNA, 25 bp, Homo sapien
agtgatcaggaattgtgccactgca

SEQ ID NO: 522136 - DNA, 25 bp, Homo sapien
tcaggtagtttattttcctcaccta

SEQ ID NO: 522137 - DNA, 25 bp, Homo sapien
gtagtttattttcctcacctatgaa

SEQ ID NO: 522138 - DNA, 25 bp, Homo sapien
ttttcctcacctatgaaagaaagaa

SEQ ID NO: 522139 - DNA, 25 bp, Homo sapien
gggagcagctttgagaatctgatag

SEQ ID NO: 522140 - DNA, 25 bp, Homo sapien
attgagcccacctgggtaccccata

SEQ ID NO: 522141 - DNA, 25 bp, Homo sapien
gcccacctgggtaccccatagatcc

SEQ ID NO: 522142 - DNA, 25 bp, Homo sapien
cctcccctggataagaatccctggg

SEQ ID NO: 522143 - DNA, 25 bp, Homo sapien
ctcccctggataagaatccctgggc

SEQ ID NO: 522144 - DNA, 25 bp, Homo sapien
ccctggataagaatccctgggccca

SEQ ID NO: 522145 - DNA, 25 bp, Homo sapien
aatccctgggcccagtgagctctaa

SEQ ID NO: 522146 - DNA, 25 bp, Homo sapien
tgggaagccccccaaatacagattt

SEQ ID NO: 522147 - DNA, 25 bp, Homo sapien
atctttgatctttagtcttcatttt

SEQ ID NO: 522148 - DNA, 25 bp, Homo sapien
gtcttcattttctgtcactcagtga

SEQ ID NO: 522149 - DNA, 25 bp, Homo sapien
tgtcactcagtgagtttcttactgg

SEQ ID NO: 522150 - DNA, 25 bp, Homo sapien
gaaatgatgactcctgacaacagaa

SEQ ID NO: 522151 - DNA, 25 bp, Homo sapien
cctgacaacagaatttccacatttg

SEQ ID NO: 522152 - DNA, 25 bp, Homo sapien
ttctaaggtgactatgccagccaac

SEQ ID NO: 522153 - DNA, 25 bp, Homo sapien
agccaacctgggaaatacataaaag

SEQ ID NO: 522154 - DNA, 25 bp, Homo sapien
gatttatacaactgagcgccagagg

SEQ ID NO: 522155 - DNA, 25 bp, Homo sapien
gaaaatgcaccttgttggagtgaga

SEQ ID NO: 522156 - DNA, 25 bp, Homo sapien
gaattacttcttgtacagctgagat

SEQ ID NO: 522157 - DNA, 25 bp, Homo sapien
agctgagatagcttcttctgaacta

SEQ ID NO: 522158 - DNA, 25 bp, Homo sapien
aatctggagagagaatgctcaccca

SEQ ID NO: 522159 - DNA, 25 bp, Homo sapien
tggagagagaatgctcacccaagct

SEQ ID NO: 522160 - DNA, 25 bp, Homo sapien
agagagaatgctcacccaagctgat

SEQ ID NO: 522161 - DNA, 25 bp, Homo sapien
agagaatgctcacccaagctgatga

SEQ ID NO: 522162 - DNA, 25 bp, Homo sapien
gaatgctcacccaagctgatgaaaa

SEQ ID NO: 522163 - DNA, 25 bp, Homo sapien
aatgctcacccaagctgatgaaaag

SEQ ID NO: 522164 - DNA, 25 bp, Homo sapien
tgctcacccaagctgatgaaaagat

SEQ ID NO: 522165 - DNA, 25 bp, Homo sapien
cacccaagctgatgaaaagatctca

SEQ ID NO: 522166 - DNA, 25 bp, Homo sapien
aagatctcagtctgtggtagaagct

SEQ ID NO: 522167 - DNA, 25 bp, Homo sapien
agtctgtggtagaagctgggaccct

SEQ ID NO: 522168 - DNA, 25 bp, Homo sapien
tggctctggactgaaccctgagtca

SEQ ID NO: 522169 - DNA, 25 bp, Homo sapien
ttcttcaggccactctaattacaga

SEQ ID NO: 522170 - DNA, 25 bp, Homo sapien
aggccactctaattacagagtctgt

SEQ ID NO: 522171 - DNA, 25 bp, Homo sapien
cagagtctgtggtaggttgcgtgga

SEQ ID NO: 522172 - DNA, 25 bp, Homo sapien
ggaagcttccctgcgtattgtattt

SEQ ID NO: 522173 - DNA, 25 bp, Homo sapien
ccctgcgtattgtatttgcctataa

SEQ ID NO: 522174 - DNA, 25 bp, Homo sapien
aatagttaagtgaaatgtgcagcct

SEQ ID NO: 522175 - DNA, 25 bp, Homo sapien
gtgaaatgtgcagcctttgaaaact

SEQ ID NO: 522176 - DNA, 25 bp, Homo sapien
tttgaaaactggagaggaagccgtt

SEQ ID NO: 522177 - DNA, 25 bp, Homo sapien
ctggcgcgctcttaaagcgggagac

SEQ ID NO: 522178 - DNA, 25 bp, Homo sapien
aaagcgggagacgagcttcggccct

SEQ ID NO: 522179 - DNA, 25 bp, Homo sapien
ggagacgagcttcggccctgcccaa

SEQ ID NO: 522180 - DNA, 25 bp, Homo sapien
cggtgaccccggctggaacggccag

SEQ ID NO: 522181 - DNA, 25 bp, Homo sapien
acggccagcgcgacgcgccctggaa

SEQ ID NO: 522182 - DNA, 25 bp, Homo sapien
gacgccgcctggaacagccagttcg

SEQ ID NO: 522183 - DNA, 25 bp, Homo sapien
gccgcctggaacagccagttcgagg

SEQ ID NO: 522184 - DNA, 25 bp, Homo sapien
tggaacagccagttcgagggcccct

SEQ ID NO: 522185 - DNA, 25 bp, Homo sapien
ggaacagccagttcgagggcccctg

SEQ ID NO: 522186 - DNA, 25 bp, Homo sapien
aacagccagttcgagggcccctgga

SEQ ID NO: 522187 - DNA, 25 bp, Homo sapien
acagccagttcgagggcccctggaa

SEQ ID NO: 522188 - DNA, 25 bp, Homo sapien
tggaacagccagcacgagcagccgc

SEQ ID NO: 522189 - DNA, 25 bp, Homo sapien
cgagccacccttccgcatgcagcgg

SEQ ID NO: 522190 - DNA, 25 bp, Homo sapien
agcagcacccgcagttcaaccagcc

SEQ ID NO: 522191 - DNA, 25 bp, Homo sapien
tccatgcatgttattctcatttgat

SEQ ID NO: 522192 - DNA, 25 bp, Homo sapien
acagcaatcctgtgcactataggta

SEQ ID NO: 522193 - DNA, 25 bp, Homo sapien
gtgcactataggtattgctcccggg

SEQ ID NO: 522194 - DNA, 25 bp, Homo sapien
ctataggtattgctcccgggaacag

SEQ ID NO: 522195 - DNA, 25 bp, Homo sapien
attgctcccgggaacagatgaggaa

SEQ ID NO: 522196 - DNA, 25 bp, Homo sapien
caggagagtgcgagattacagtaat

SEQ ID NO: 522197 - DNA, 25 bp, Homo sapien
gaaggtttcagacatacaccctctc

SEQ ID NO: 522198 - DNA, 25 bp, Homo sapien
acaccctctctcatatgtcaaggat

SEQ ID NO: 522199 - DNA, 25 bp, Homo sapien
atatgaagtctaatgaatcccctaa

SEQ ID NO: 522200 - DNA, 25 bp, Homo sapien
agtctaatgaatcccctaaagcagc

SEQ ID NO: 522201 - DNA, 25 bp, Homo sapien
aaatcagcctactgcctgtttttgt

SEQ ID NO: 522202 - DNA, 25 bp, Homo sapien
gggatccagatctcaaagggacttg

SEQ ID NO: 522203 - DNA, 25 bp, Homo sapien
ggacttgtaggtaatggccaccact

SEQ ID NO: 522204 - DNA, 25 bp, Homo sapien
atggccaccactttggacttcatgt

SEQ ID NO: 522205 - DNA, 25 bp, Homo sapien
gacttcatgttttcggagtgacgga

SEQ ID NO: 522206 - DNA, 25 bp, Homo sapien
gagtgacggaaagtccctacagcct

SEQ ID NO: 522207 - DNA, 25 bp, Homo sapien
agcccctagctaagcctctattgat

SEQ ID NO: 522208 - DNA, 25 bp, Homo sapien
tattgattacttctccttcttgtgc

SEQ ID NO: 522209 - DNA, 25 bp, Homo sapien
ttcttgtgctcttatcacctgtact

SEQ ID NO: 522210 - DNA, 25 bp, Homo sapien
gtgtatcaattctatgtcctcaact

SEQ ID NO: 522211 - DNA, 25 bp, Homo sapien
tatgtcctcaactatgtctcaacgg

SEQ ID NO: 522212 - DNA, 25 bp, Homo sapien
gtctcaacggcaagaatcagtcata

SEQ ID NO: 522213 - DNA, 25 bp, Homo sapien
ggaagaaaccacacctagcacgtaa

SEQ ID NO: 522214 - DNA, 25 bp, Homo sapien
gaagaaaccacacctagcacgtaaa

SEQ ID NO: 522215 - DNA, 25 bp, Homo sapien
agaaaccacacctagcacgtaaagc

SEQ ID NO: 522216 - DNA, 25 bp, Homo sapien
acacctagcacgtaaagccctgaaa

SEQ ID NO: 522217 - DNA, 25 bp, Homo sapien
cacctagcacgtaaagccctgaaaa

SEQ ID NO: 522218 - DNA, 25 bp, Homo sapien
ctagcacgtaaagccctgaaaaaat

SEQ ID NO: 522219 - DNA, 25 bp, Homo sapien
agccctgaaaaaatagaggtgtaca

SEQ ID NO: 522220 - DNA, 25 bp, Homo sapien
ggttcccgatgtggaggtccgtctt

SEQ ID NO: 522221 - DNA, 25 bp, Homo sapien
ttcccgatgtggaggtccgtcttgg

SEQ ID NO: 522222 - DNA, 25 bp, Homo sapien
cgatgtggaggtccgtcttgggtgg

SEQ ID NO: 522223 - DNA, 25 bp, Homo sapien
ggaggcacccaggtcgctggttcga

SEQ ID NO: 522224 - DNA, 25 bp, Homo sapien
agaagagccttgctttattactcaa

SEQ ID NO: 522225 - DNA, 25 bp, Homo sapien
gaagagccttgctttattactcaat

SEQ ID NO: 522226 - DNA, 25 bp, Homo sapien
aagagccttgctttattactcaatt

SEQ ID NO: 522227 - DNA, 25 bp, Homo sapien
ccgatgcacccatgtcccaggtgta

SEQ ID NO: 522228 - DNA, 25 bp, Homo sapien
cgatgcacccatgtcccaggtgtat

SEQ ID NO: 522229 - DNA, 25 bp, Homo sapien
gatgcacccatgtcccaggtgtatg

SEQ ID NO: 522230 - DNA, 25 bp, Homo sapien
atgcacccatgtcccaggtgtatgg

SEQ ID NO: 522231 - DNA, 25 bp, Homo sapien
gcacccatgtcccaggtgtatggag

SEQ ID NO: 522232 - DNA, 25 bp, Homo sapien
atgagaagagccttgctttattact

SEQ ID NO: 522233 - DNA, 25 bp, Homo sapien
tgagaagagccttgctttattactc

SEQ ID NO: 522234 - DNA, 25 bp, Homo sapien
gagaagagccttgctttattactca

SEQ ID NO: 522235 - DNA, 25 bp, Homo sapien
tgtctgtccttgtccttgtggtgat

SEQ ID NO: 522236 - DNA, 25 bp, Homo sapien
tgtccttgtccttgtggtgatcctg

SEQ ID NO: 522237 - DNA, 25 bp, Homo sapien
cttgtccttgtggtgatcctggcat

SEQ ID NO: 522238 - DNA, 25 bp, Homo sapien
gtccttgtggtgatcctggcatggt

SEQ ID NO: 522239 - DNA, 25 bp, Homo sapien
gtgatatgctccactttgcattatc

SEQ ID NO: 522240 - DNA, 25 bp, Homo sapien
tgctccactttgcattatccatggt

SEQ ID NO: 522241 - DNA, 25 bp, Homo sapien
cactttgcattatccatggtctctt

SEQ ID NO: 522242 - DNA, 25 bp, Homo sapien
gaggatctaaccacgcctggtggtg

SEQ ID NO: 522243 - DNA, 25 bp, Homo sapien
atctaaccacgcctggtggtgagga

SEQ ID NO: 522244 - DNA, 25 bp, Homo sapien
aaccacgcctggtggtgaggaagct

SEQ ID NO: 522245 - DNA, 25 bp, Homo sapien
cctggtggtgaggaagctgaatttc

SEQ ID NO: 522246 - DNA, 25 bp, Homo sapien
cttggggtaagcagctcactgctgg

SEQ ID NO: 522247 - DNA, 25 bp, Homo sapien
gggactcaacccgagtgtgcagacc

SEQ ID NO: 522248 - DNA, 25 bp, Homo sapien
actcaacccgagtgtgcagacccat

SEQ ID NO: 522249 - DNA, 25 bp, Homo sapien
tcaacccgagtgtgcagacccatga

SEQ ID NO: 522250 - DNA, 25 bp, Homo sapien
aacccgagtgtgcagacccatgatg

SEQ ID NO: 522251 - DNA, 25 bp, Homo sapien
acccgagtgtgcagacccatgatga

SEQ ID NO: 522252 - DNA, 25 bp, Homo sapien
ccgagtgtgcagacccatgatgacc

SEQ ID NO: 522253 - DNA, 25 bp, Homo sapien
ccctagggccagaagacctgtcagt

SEQ ID NO: 522254 - DNA, 25 bp, Homo sapien
tagggccagaagacctgtcagtcac

SEQ ID NO: 522255 - DNA, 25 bp, Homo sapien
gggccagaagacctgtcagtcactt

SEQ ID NO: 522256 - DNA, 25 bp, Homo sapien
ggccagaagacctgtcagtcacttt

SEQ ID NO: 522257 - DNA, 25 bp, Homo sapien
gagcccaaggtgcaccgagcccaag

SEQ ID NO: 522258 - DNA, 25 bp, Homo sapien
accgagcccaagtgcccatatgaac

SEQ ID NO: 522259 - DNA, 25 bp, Homo sapien
caagtgcccatatgaacctctctgc

SEQ ID NO: 522260 - DNA, 25 bp, Homo sapien
atatgaacctctctgccctagccga

SEQ ID NO: 522261 - DNA, 25 bp, Homo sapien
tctgccctagccgagggacaaactg

SEQ ID NO: 522262 - DNA, 25 bp, Homo sapien
gaagtggaatgaatgctcctgttct

SEQ ID NO: 522263 - DNA, 25 bp, Homo sapien
ggaatgaatgctcctgttctgagaa

SEQ ID NO: 522264 - DNA, 25 bp, Homo sapien
gaatgctcctgttctgagaagcaca

SEQ ID NO: 522265 - DNA, 25 bp, Homo sapien
gctcctgttctgagaagcacacttg

SEQ ID NO: 522266 - DNA, 25 bp, Homo sapien
gaagcacacttgtaactgcatcttt

SEQ ID NO: 522267 - DNA, 25 bp, Homo sapien
acacttgtaactgcatcttttggaa

SEQ ID NO: 522268 - DNA, 25 bp, Homo sapien
tcattttaagtctccggcagcatca

SEQ ID NO: 522269 - DNA, 25 bp, Homo sapien
aacatgctctctcagcggctccagg

SEQ ID NO: 522270 - DNA, 25 bp, Homo sapien
agcggctccaggacattctctggtt

SEQ ID NO: 522271 - DNA, 25 bp, Homo sapien
tccagcaaaggtccctccatcattt

SEQ ID NO: 522272 - DNA, 25 bp, Homo sapien
aagtctccggcagcatcagagctta

SEQ ID NO: 522273 - DNA, 25 bp, Homo sapien
attggtaacaattttctgcccctga

SEQ ID NO: 522274 - DNA, 25 bp, Homo sapien
taggaatgctgagccggtcaatctc

SEQ ID NO: 522275 - DNA, 25 bp, Homo sapien
ggtcaatctcttccaacacctggtg

SEQ ID NO: 522276 - DNA, 25 bp, Homo sapien
catcagagcttaccccatggagcat

SEQ ID NO: 522277 - DNA, 25 bp, Homo sapien
ttaaaacagctctcatgcacctctt

SEQ ID NO: 522278 - DNA, 25 bp, Homo sapien
tctcatgcacctcttgctacggctg

SEQ ID NO: 522279 - DNA, 25 bp, Homo sapien
gagtctttcacccttagggtcctat

SEQ ID NO: 522280 - DNA, 25 bp, Homo sapien
gtcctatacagggacccaggcctgt

SEQ ID NO: 522281 - DNA, 25 bp, Homo sapien
ggagtgaaacttggctggacagatc

SEQ ID NO: 522282 - DNA, 25 bp, Homo sapien
tggacagatcatcctcactcagttc

SEQ ID NO: 522283 - DNA, 25 bp, Homo sapien
agttccctggtagcacagactgaca

SEQ ID NO: 522284 - DNA, 25 bp, Homo sapien
agactgacagctgctcttgggctat

SEQ ID NO: 522285 - DNA, 25 bp, Homo sapien
gacagctgctcttgggctatagctt

SEQ ID NO: 522286 - DNA, 25 bp, Homo sapien
gggccaagatgtctcacaccctaga

SEQ ID NO: 522287 - DNA, 25 bp, Homo sapien
atgtctcacaccctagaagcctagg

SEQ ID NO: 522288 - DNA, 25 bp, Homo sapien
ttgggtggcctctggtatttatttg

SEQ ID NO: 522289 - DNA, 25 bp, Homo sapien
ctctggtatttatttggcatttata

SEQ ID NO: 522290 - DNA, 25 bp, Homo sapien
gagaggccacagatcaccatcaatg

SEQ ID NO: 522291 - DNA, 25 bp, Homo sapien
gtgaaatcaccagcatcaagaagga

SEQ ID NO: 522292 - DNA, 25 bp, Homo sapien
tgcagtacctcaatctcatcaacta

SEQ ID NO: 522293 - DNA, 25 bp, Homo sapien
acctcaatctcatcaactactacaa

SEQ ID NO: 522294 - DNA, 25 bp, Homo sapien
tactacaagggccagtacatcctca

SEQ ID NO: 522295 - DNA, 25 bp, Homo sapien
cacactgtcagaggacatcgtggat

SEQ ID NO: 522296 - DNA, 25 bp, Homo sapien
atgagcgggccatgctcaagcggct

SEQ ID NO: 522297 - DNA, 25 bp, Homo sapien
tgctcaagcggctcctgcggatcga

SEQ ID NO: 522298 - DNA, 25 bp, Homo sapien
tcctgcggatcgactccaagtgtct

SEQ ID NO: 522299 - DNA, 25 bp, Homo sapien
ttggcctcctatcctatcgaagcta

SEQ ID NO: 522300 - DNA, 25 bp, Homo sapien
tcctatcgaagctactggtcccaga

SEQ ID NO: 522301 - DNA, 25 bp, Homo sapien
tggatcccttgtcatacctgtgtta

SEQ ID NO: 522302 - DNA, 25 bp, Homo sapien
tgttactgtttaaagcacacccacc

SEQ ID NO: 522303 - DNA, 25 bp, Homo sapien
ttacaagatcttaggctgctgtggt

SEQ ID NO: 522304 - DNA, 25 bp, Homo sapien
accttgagtctgctgatattcggga

SEQ ID NO: 522305 - DNA, 25 bp, Homo sapien
gaacaaggatctgcagtttcccctt

SEQ ID NO: 522306 - DNA, 25 bp, Homo sapien
tctcccctctgaagagtggttctta

SEQ ID NO: 522307 - DNA, 25 bp, Homo sapien
gagtggttcttatgtgcaatctgca

SEQ ID NO: 522308 - DNA, 25 bp, Homo sapien
gcaatctgcagtaaccttgaactcc

SEQ ID NO: 522309 - DNA, 25 bp, Homo sapien
gaatgcatgccactatgacagcagt

SEQ ID NO: 522310 - DNA, 25 bp, Homo sapien
atgacagcagtatgccaagctttgt

SEQ ID NO: 522311 - DNA, 25 bp, Homo sapien
caagctttgtgttcatctcctaata

SEQ ID NO: 522312 - DNA, 25 bp, Homo sapien
gctgctcaggcagagtacatcgaga

SEQ ID NO: 522313 - DNA, 25 bp, Homo sapien
gtacatcgagaagtttgccaaccct

SEQ ID NO: 522314 - DNA, 25 bp, Homo sapien
tttccctgcagcagtgcgagggttt

SEQ ID NO: 522315 - DNA, 25 bp, Homo sapien
tgcgagggtttgtggatgacatcat

SEQ ID NO: 522316 - DNA, 25 bp, Homo sapien
gtgcccgaatctgctgtgacctgga

SEQ ID NO: 522317 - DNA, 25 bp, Homo sapien
ccgaatctgctgtgacctggatgtc

SEQ ID NO: 522318 - DNA, 25 bp, Homo sapien
ttggccagcaagaaggtacaacgtc

SEQ ID NO: 522319 - DNA, 25 bp, Homo sapien
ggtacaacgtccttggagaaaacat

SEQ ID NO: 522320 - DNA, 25 bp, Homo sapien
aagaactgaattactgtctgcccat

SEQ ID NO: 522321 - DNA, 25 bp, Homo sapien
tgaattactgtctgcccattcacat

SEQ ID NO: 522322 - DNA, 25 bp, Homo sapien
attcctgccttttgcaatcatgaaa

SEQ ID NO: 522323 - DNA, 25 bp, Homo sapien
tcatttaattctcagccacttcact

SEQ ID NO: 522324 - DNA, 25 bp, Homo sapien
cagccacttcactgatactacaagg

SEQ ID NO: 522325 - DNA, 25 bp, Homo sapien
atagtggtttgatacagacatttgt

SEQ ID NO: 522326 - DNA, 25 bp, Homo sapien
gcgtaggtttagcacacccatgtta

SEQ ID NO: 522327 - DNA, 25 bp, Homo sapien
ttacccatgaactgtaattcagatt

SEQ ID NO: 522328 - DNA, 25 bp, Homo sapien
gattgataaggtgacctacccatga

SEQ ID NO: 522329 - DNA, 25 bp, Homo sapien
gacctacccatgaaaaagacacctg

SEQ ID NO: 522330 - DNA, 25 bp, Homo sapien
gacacctgagacctgtttacttttt

SEQ ID NO: 522331 - DNA, 25 bp, Homo sapien
acccatgttagcttgtccacattag

SEQ ID NO: 522332 - DNA, 25 bp, Homo sapien
ttgtccacattaggccttcttttga

SEQ ID NO: 522333 - DNA, 25 bp, Homo sapien
cttcttttgaaggtactgtatctaa

SEQ ID NO: 522334 - DNA, 25 bp, Homo sapien
ccagcagttcacaggtaaagcagaa

SEQ ID NO: 522335 - DNA, 25 bp, Homo sapien
aattctctttaaccagcaagtttct

SEQ ID NO: 522336 - DNA, 25 bp, Homo sapien
aaccagcaagtttctgctttttaag

SEQ ID NO: 522337 - DNA, 25 bp, Homo sapien
ttgctttgggttgtagtcaaaaact

SEQ ID NO: 522338 - DNA, 25 bp, Homo sapien
ataatttaatgtctctggcacacac

SEQ ID NO: 522339 - DNA, 25 bp, Homo sapien
acacactaaaaaccatacacttcag

SEQ ID NO: 522340 - DNA, 25 bp, Homo sapien
catacacttcagttgtgatctcagt

SEQ ID NO: 522341 - DNA, 25 bp, Homo sapien
gttgtgatctcagtggcatatttat

SEQ ID NO: 522342 - DNA, 25 bp, Homo sapien
gcatatttatttggttaggtttcgt

SEQ ID NO: 522343 - DNA, 25 bp, Homo sapien
attacagatgttcagttgaccaagt

SEQ ID NO: 522344 - DNA, 25 bp, Homo sapien
cagttgaccaagtagttcagtgttt

SEQ ID NO: 522345 - DNA, 25 bp, Homo sapien
agaatagtggaagccgcccgaatct

SEQ ID NO: 522346 - DNA, 25 bp, Homo sapien
gaatagtggaagccgcccgaatctg

SEQ ID NO: 522347 - DNA, 25 bp, Homo sapien
aatagtggaagccgcccgaatctgg

SEQ ID NO: 522348 - DNA, 25 bp, Homo sapien
tagtggaagccgcccgaatctggct

SEQ ID NO: 522349 - DNA, 25 bp, Homo sapien
ctggcttggcggaatatctctttga

SEQ ID NO: 522350 - DNA, 25 bp, Homo sapien
ggaatatctctttgacaagcacacc

SEQ ID NO: 522351 - DNA, 25 bp, Homo sapien
tggtcaccaaggcagtgcatgcatg

SEQ ID NO: 522352 - DNA, 25 bp, Homo sapien
ataagttgtaccaaaacatccactt

SEQ ID NO: 522353 - DNA, 25 bp, Homo sapien
atccacttaagttctttgatttgta

SEQ ID NO: 522354 - DNA, 25 bp, Homo sapien
aagttctttgatttgtaccattcct

SEQ ID NO: 522355 - DNA, 25 bp, Homo sapien
gttctttgatttgtaccattccttc

SEQ ID NO: 522356 - DNA, 25 bp, Homo sapien
gaagtatgagacaccctcctgaaca

SEQ ID NO: 522357 - DNA, 25 bp, Homo sapien
atgagacaccctcctgaacagacaa

SEQ ID NO: 522358 - DNA, 25 bp, Homo sapien
acagacaaatggtgtgcatacccca

SEQ ID NO: 522359 - DNA, 25 bp, Homo sapien
gacaaatggtgtgcataccccacct

SEQ ID NO: 522360 - DNA, 25 bp, Homo sapien
atggtgtgcataccccacctcacgt

SEQ ID NO: 522361 - DNA, 25 bp, Homo sapien
gtctggaagccatcaaagcgatgtc

SEQ ID NO: 522362 - DNA, 25 bp, Homo sapien
gaagccatcaaagcgatgtcctcca

SEQ ID NO: 522363 - DNA, 25 bp, Homo sapien
atcaaagcgatgtcctccaaaggcc

SEQ ID NO: 522364 - DNA, 25 bp, Homo sapien
aaagcgatgtcctccaaaggcccct

SEQ ID NO: 522365 - DNA, 25 bp, Homo sapien
ccagagtttgagcagtggagaaaca

SEQ ID NO: 522366 - DNA, 25 bp, Homo sapien
agtggagaaacagtgcccatccctc

SEQ ID NO: 522367 - DNA, 25 bp, Homo sapien
gaagagccttgctttattactcaat

SEQ ID NO: 522368 - DNA, 25 bp, Homo sapien
ggattccattcttgaggattatgca

SEQ ID NO: 522369 - DNA, 25 bp, Homo sapien
tgttgggtacccagctactctataa

SEQ ID NO: 522370 - DNA, 25 bp, Homo sapien
ttgggtacccagctactctataaat

SEQ ID NO: 522371 - DNA, 25 bp, Homo sapien
gggtacccagctactctataaattt

SEQ ID NO: 522372 - DNA, 25 bp, Homo sapien
ggtacccagctactctataaatttg

SEQ ID NO: 522373 - DNA, 25 bp, Homo sapien
gagaccacagtatgctgaaattctt

SEQ ID NO: 522374 - DNA, 25 bp, Homo sapien
tgaaattcttgcagatcatcccgat

SEQ ID NO: 522375 - DNA, 25 bp, Homo sapien
catgtcccaggtgtatggagcgcca

SEQ ID NO: 522376 - DNA, 25 bp, Homo sapien
gagcgccacatctcctgagattatt

SEQ ID NO: 522377 - DNA, 25 bp, Homo sapien
aatgttggcttatacacctctggat

SEQ ID NO: 522378 - DNA, 25 bp, Homo sapien
aaccctcctcctacagactaggaag

SEQ ID NO: 522379 - DNA, 25 bp, Homo sapien
tggattcctcctgcttcatcgattg

SEQ ID NO: 522380 - DNA, 25 bp, Homo sapien
tcctgcttcatcgattgcacttagg

SEQ ID NO: 522381 - DNA, 25 bp, Homo sapien
cttcatcgattgcacttaggagaga

SEQ ID NO: 522382 - DNA, 25 bp, Homo sapien
tgcatctctctctgatctagctagc

SEQ ID NO: 522383 - DNA, 25 bp, Homo sapien
tctctctgatctagctagcagtggg

SEQ ID NO: 522384 - DNA, 25 bp, Homo sapien
cacagggctcaggtacattctagat

SEQ ID NO: 522385 - DNA, 25 bp, Homo sapien
gggctcaggtacattctagatggct

SEQ ID NO: 522386 - DNA, 25 bp, Homo sapien
gtacattctagatggctgtcaggtg

SEQ ID NO: 522387 - DNA, 25 bp, Homo sapien
tcaggtggtgggtagctttagttac

SEQ ID NO: 522388 - DNA, 25 bp, Homo sapien
ggtgggtagctttagttacattgaa

SEQ ID NO: 522389 - DNA, 25 bp, Homo sapien
cgggctccatgctctggatgggact

SEQ ID NO: 522390 - DNA, 25 bp, Homo sapien
ctccatgctctggatgggactgggc

SEQ ID NO: 522391 - DNA, 25 bp, Homo sapien
acacgccagccggtgcagggttctt

SEQ ID NO: 522392 - DNA, 25 bp, Homo sapien
agccggtgcagggttcttccaagtg

SEQ ID NO: 522393 - DNA, 25 bp, Homo sapien
tgcagggttcttccaagtgcaaaac

SEQ ID NO: 522394 - DNA, 25 bp, Homo sapien
cgcgacgggcacagactccgaggca

SEQ ID NO: 522395 - DNA, 25 bp, Homo sapien
gcacagactccgaggcagcgctcaa

SEQ ID NO: 522396 - DNA, 25 bp, Homo sapien
gaggcagcgctcaacctgaagtgtc

SEQ ID NO: 522397 - DNA, 25 bp, Homo sapien
cagcgctcaacctgaagtgtcttag

SEQ ID NO: 522398 - DNA, 25 bp, Homo sapien
acctgaagtgtcttaggctggtttc

SEQ ID NO: 522399 - DNA, 25 bp, Homo sapien
aagtgtcttaggctggtttcctgtt

SEQ ID NO: 522400 - DNA, 25 bp, Homo sapien
gagacacgtgtaaaatctttgactg

SEQ ID NO: 522401 - DNA, 25 bp, Homo sapien
tgcccgttgacattattactgtttt

SEQ ID NO: 522402 - DNA, 25 bp, Homo sapien
gtaagtagaaacctgctcgtgatat

SEQ ID NO: 522403 - DNA, 25 bp, Homo sapien
ctgctcgtgatatcggtccatttac

SEQ ID NO: 522404 - DNA, 25 bp, Homo sapien
gatatcggtccatttacattttaca

SEQ ID NO: 522405 - DNA, 25 bp, Homo sapien
attacttttgtaggcccaatatttg

SEQ ID NO: 522406 - DNA, 25 bp, Homo sapien
gagaagctgttaatcttttagctga

SEQ ID NO: 522407 - DNA, 25 bp, Homo sapien
gttagactgaattacgtgtctccct

SEQ ID NO: 522408 - DNA, 25 bp, Homo sapien
aattacgtgtctccctggactgtga

SEQ ID NO: 522409 - DNA, 25 bp, Homo sapien
ggactgtgacatctattttctcatt

SEQ ID NO: 522410 - DNA, 25 bp, Homo sapien
gacatctattttctcattacagttt

SEQ ID NO: 522411 - DNA, 25 bp, Homo sapien
tgggcaagcaccagacacgtgtagc

SEQ ID NO: 522412 - DNA, 25 bp, Homo sapien
acggcttattcctcaagtcagtgct

SEQ ID NO: 522413 - DNA, 25 bp, Homo sapien
aagtcagtgctgtacgggaacctcg

SEQ ID NO: 522414 - DNA, 25 bp, Homo sapien
agtgctgtacgggaacctcggtgct

SEQ ID NO: 522415 - DNA, 25 bp, Homo sapien
gccacagttcgggagccacggatga

SEQ ID NO: 522416 - DNA, 25 bp, Homo sapien
ggatgaccctggacactcaagccaa

SEQ ID NO: 522417 - DNA, 25 bp, Homo sapien
aagccaaagttaggccacaccaggc

SEQ ID NO: 522418 - DNA, 25 bp, Homo sapien
tgctggtcaagccagggcagtcaca

SEQ ID NO: 522419 - DNA, 25 bp, Homo sapien
aagccagggcagtcacagctgcttg

SEQ ID NO: 522420 - DNA, 25 bp, Homo sapien
acctgcccaggtgaagacgattctg

SEQ ID NO: 522421 - DNA, 25 bp, Homo sapien
aggtgaagacgattctggagagcca

SEQ ID NO: 522422 - DNA, 25 bp, Homo sapien
gttcattggcagaatctaacccctt

SEQ ID NO: 522423 - DNA, 25 bp, Homo sapien
attggcagaatctaaccccttctgt

SEQ ID NO: 522424 - DNA, 25 bp, Homo sapien
gataaaaatgcttgaagagcctgag

SEQ ID NO: 522425 - DNA, 25 bp, Homo sapien
tgaagagcctgagagtaaaaagatt

SEQ ID NO: 522426 - DNA, 25 bp, Homo sapien
aagattatgctgcaaagctatgata

SEQ ID NO: 522427 - DNA, 25 bp, Homo sapien
gcaaagctatgatataaactgctct

SEQ ID NO: 522428 - DNA, 25 bp, Homo sapien
actgctcttgcagtccaaagggata

SEQ ID NO: 522429 - DNA, 25 bp, Homo sapien
ttgcagtccaaagggatacctgatt

SEQ ID NO: 522430 - DNA, 25 bp, Homo sapien
ggatacctgattaaagaagtttctt

SEQ ID NO: 522431 - DNA, 25 bp, Homo sapien
tcttatttaaacatctcagacgcaa

SEQ ID NO: 522432 - DNA, 25 bp, Homo sapien
acatctcagacgcaaaaattacatt

SEQ ID NO: 522433 - DNA, 25 bp, Homo sapien
gaaatggtctgctagagtgataaga

SEQ ID NO: 522434 - DNA, 25 bp, Homo sapien
tgataagactcagaacaggaagcct

SEQ ID NO: 522435 - DNA, 25 bp, Homo sapien
aggaagcctgcatgtgactgagcaa

SEQ ID NO: 522436 - DNA, 25 bp, Homo sapien
gagcaagtcacctacataaccctgc

SEQ ID NO: 522437 - DNA, 25 bp, Homo sapien
ccctgcctgtactaaggtgtacacc

SEQ ID NO: 522438 - DNA, 25 bp, Homo sapien
aaggtgtacacctgtctattgtaag

SEQ ID NO: 522439 - DNA, 25 bp, Homo sapien
ctattgtaagtttgcctaggctgtt

SEQ ID NO: 522440 - DNA, 25 bp, Homo sapien
aggctgttggtgtacagagaccaga

SEQ ID NO: 522441 - DNA, 25 bp, Homo sapien
ggagagagacacactaggactaaca

SEQ ID NO: 522442 - DNA, 25 bp, Homo sapien
caatgtcctaacaaaatggtactta

SEQ ID NO: 522443 - DNA, 25 bp, Homo sapien
gaattttcacttggttggacattgg

SEQ ID NO: 522444 - DNA, 25 bp, Homo sapien
tcctggcatggtgatatgctccact

SEQ ID NO: 522445 - DNA, 25 bp, Homo sapien
atgtagcctctccatgaactgcaga

SEQ ID NO: 522446 - DNA, 25 bp, Homo sapien
tagcctctccatgaactgcagaagg

SEQ ID NO: 522447 - DNA, 25 bp, Homo sapien
cctctccatgaactgcagaaggcat

SEQ ID NO: 522448 - DNA, 25 bp, Homo sapien
agaaggcatgttctgcatggttacc

SEQ ID NO: 522449 - DNA, 25 bp, Homo sapien
atggttaccagtaagtggctccctc

SEQ ID NO: 522450 - DNA, 25 bp, Homo sapien
gttaccagtaagtggctccctctca

SEQ ID NO: 522451 - DNA, 25 bp, Homo sapien
tggctccctctcaccgtgttcattg

SEQ ID NO: 522452 - DNA, 25 bp, Homo sapien
tcaaatgagagcaaactttaggtgt

SEQ ID NO: 522453 - DNA, 25 bp, Homo sapien
gcaaactttaggtgttggctccatt

SEQ ID NO: 522454 - DNA, 25 bp, Homo sapien
tttaggtgttggctccattgtacac

SEQ ID NO: 522455 - DNA, 25 bp, Homo sapien
tgaagctcagcagtagaagcgtaat

SEQ ID NO: 522456 - DNA, 25 bp, Homo sapien
gaagcgtaatgatttccctcaggaa

SEQ ID NO: 522457 - DNA, 25 bp, Homo sapien
aacttctgacagctaggtttttcaa

SEQ ID NO: 522458 - DNA, 25 bp, Homo sapien
tgacagctaggtttttcaagggttt

SEQ ID NO: 522459 - DNA, 25 bp, Homo sapien
tgcacctaatgaattcgtcacccag

SEQ ID NO: 522460 - DNA, 25 bp, Homo sapien
cctgtgctagctgagatgcaaaaca

SEQ ID NO: 522461 - DNA, 25 bp, Homo sapien
tggaagattgcatacctgtgtggta

SEQ ID NO: 522462 - DNA, 25 bp, Homo sapien
tgactttttcagtttcttgaacggt

SEQ ID NO: 522463 - DNA, 25 bp, Homo sapien
aattcgtcacccagtcgcaactttt

SEQ ID NO: 522464 - DNA, 25 bp, Homo sapien
tttccccgacgcacagaataaacat

SEQ ID NO: 522465 - DNA, 25 bp, Homo sapien
gaataaacatgaagctcagcagtag

SEQ ID NO: 522466 - DNA, 25 bp, Homo sapien
aggacaaaccccaatgcctgagcag

SEQ ID NO: 522467 - DNA, 25 bp, Homo sapien
caatgcctgagcagcgcctcggagc

SEQ ID NO: 522468 - DNA, 25 bp, Homo sapien
ctgcaccaaagcgaaacagaagctg

SEQ ID NO: 522469 - DNA, 25 bp, Homo sapien
tacaatccccgcagagtctccggtg

SEQ ID NO: 522470 - DNA, 25 bp, Homo sapien
agcggcgtgccaatctgcgggtccc

SEQ ID NO: 522471 - DNA, 25 bp, Homo sapien
gccgccccgccgaggtttgtagcag

SEQ ID NO: 522472 - DNA, 25 bp, Homo sapien
gaagctgaactggaagccccgggtc

SEQ ID NO: 522473 - DNA, 25 bp, Homo sapien
ggaagccccgggtcgctttcgatga

SEQ ID NO: 522474 - DNA, 25 bp, Homo sapien
cccgggtcgctttcgatgagctggt

SEQ ID NO: 522475 - DNA, 25 bp, Homo sapien
gagggagatggtgcacgccgacgtg

SEQ ID NO: 522476 - DNA, 25 bp, Homo sapien
gtggagctcatgaggacaaacccca

SEQ ID NO: 522477 - DNA, 25 bp, Homo sapien
gtacctggcaatgtaagagaccaat

SEQ ID NO: 522478 - DNA, 25 bp, Homo sapien
cctgttgttaaattactgctgcttt

SEQ ID NO: 522479 - DNA, 25 bp, Homo sapien
cccccaaagtcatctctgtttataa

SEQ ID NO: 522480 - DNA, 25 bp, Homo sapien
aggacactttgtgcccaccctatag

SEQ ID NO: 522481 - DNA, 25 bp, Homo sapien
tgtgcccaccctatagcctgatctt

SEQ ID NO: 522482 - DNA, 25 bp, Homo sapien
gcctgatcttcagtgctgatagcat

SEQ ID NO: 522483 - DNA, 25 bp, Homo sapien
ggaggcttgacgacatttacctaat

SEQ ID NO: 522484 - DNA, 25 bp, Homo sapien
actcagatgctattaactctgtccc

SEQ ID NO: 522485 - DNA, 25 bp, Homo sapien
ttacctaatgagctgttgtttggat

SEQ ID NO: 522486 - DNA, 25 bp, Homo sapien
gatggttggtgcatggcagtcattt

SEQ ID NO: 522487 - DNA, 25 bp, Homo sapien
gtcatttagcacaagtacctggcaa

SEQ ID NO: 522488 - DNA, 25 bp, Homo sapien
gggctcggcgagtaatgtgttttgt

SEQ ID NO: 522489 - DNA, 25 bp, Homo sapien
tgttttgtccccagttaaccaccat

SEQ ID NO: 522490 - DNA, 25 bp, Homo sapien
agttaaccaccattctgcggcctgg

SEQ ID NO: 522491 - DNA, 25 bp, Homo sapien
ttctgcggcctggttctgcaaggaa

SEQ ID NO: 522492 - DNA, 25 bp, Homo sapien
tggttctgcaaggaaccagggctgc

SEQ ID NO: 522493 - DNA, 25 bp, Homo sapien
tgactccattagttccgacacttgt

SEQ ID NO: 522494 - DNA, 25 bp, Homo sapien
gttccgacacttgtgaaactccgag

SEQ ID NO: 522495 - DNA, 25 bp, Homo sapien
gaaactccgagaagtgctgtggtct

SEQ ID NO: 522496 - DNA, 25 bp, Homo sapien
tgtggtctcagcaatgcacctgttt

SEQ ID NO: 522497 - DNA, 25 bp, Homo sapien
atgcacctgttttgtacatgattgt

SEQ ID NO: 522498 - DNA, 25 bp, Homo sapien
gttgtgattgtatgactgtggataa

SEQ ID NO: 522499 - DNA, 25 bp, Homo sapien
atgatctcaactgtctctgcttgtt

SEQ ID NO: 522500 - DNA, 25 bp, Homo sapien
aactgtctctgcttgttggaagtaa

SEQ ID NO: 522501 - DNA, 25 bp, Homo sapien
aagtaactgggcaatcttggcaggg

SEQ ID NO: 522502 - DNA, 25 bp, Homo sapien
ttaagctcagctcctatacacgtga

SEQ ID NO: 522503 - DNA, 25 bp, Homo sapien
tcctatacacgtgagcattgcagaa

SEQ ID NO: 522504 - DNA, 25 bp, Homo sapien
ttgcagaacaccaatgtttaacttt

SEQ ID NO: 522505 - DNA, 25 bp, Homo sapien
aacttttagccttgtccccatggtg

SEQ ID NO: 522506 - DNA, 25 bp, Homo sapien
catggtgccagttgaatgtggagct

SEQ ID NO: 522507 - DNA, 25 bp, Homo sapien
agaagggcctgtctacagctgtcct

SEQ ID NO: 522508 - DNA, 25 bp, Homo sapien
gctgtcctgcctggctactaaagga

SEQ ID NO: 522509 - DNA, 25 bp, Homo sapien
tggctactaaaggatccatgccttc

SEQ ID NO: 522510 - DNA, 25 bp, Homo sapien
taagggccccacacagatctaccag

SEQ ID NO: 522511 - DNA, 25 bp, Homo sapien
atcagccacacgtctaggccttaag

SEQ ID NO: 522512 - DNA, 25 bp, Homo sapien
tctaggccttaagcccacttcttaa

SEQ ID NO: 522513 - DNA, 25 bp, Homo sapien
aagcccacttcttaaaggatctgca

SEQ ID NO: 522514 - DNA, 25 bp, Homo sapien
ttcttaaaggatctgcacccatggg

SEQ ID NO: 522515 - DNA, 25 bp, Homo sapien
catagagggtcccagcctactggac

SEQ ID NO: 522516 - DNA, 25 bp, Homo sapien
gagctgcccttcaggtctaaagcaa

SEQ ID NO: 522517 - DNA, 25 bp, Homo sapien
taaagcaacatctggacatctcggc

SEQ ID NO: 522518 - DNA, 25 bp, Homo sapien
agcaacatctggacatctcggctgg

SEQ ID NO: 522519 - DNA, 25 bp, Homo sapien
atctaccagcatcacgagatcgacc

SEQ ID NO: 522520 - DNA, 25 bp, Homo sapien
cacgagatcgacctcagtgcctgag

SEQ ID NO: 522521 - DNA, 25 bp, Homo sapien
gatgtaatgcatatcacctgtcatg

SEQ ID NO: 522522 - DNA, 25 bp, Homo sapien
gtaatgcatatcacctgtcatgtaa

SEQ ID NO: 522523 - DNA, 25 bp, Homo sapien
atagtgggaaaaacatttgagacct

SEQ ID NO: 522524 - DNA, 25 bp, Homo sapien
acatcatgaaatgcactgaatttgg

SEQ ID NO: 522525 - DNA, 25 bp, Homo sapien
gcatatcacctgtcatgtaaaggga

SEQ ID NO: 522526 - DNA, 25 bp, Homo sapien
atttggaattctggcctagaaaggc

SEQ ID NO: 522527 - DNA, 25 bp, Homo sapien
attctggcctagaaaggctgtggct

SEQ ID NO: 522528 - DNA, 25 bp, Homo sapien
aaaggctgtggcttatgttgggatt

SEQ ID NO: 522529 - DNA, 25 bp, Homo sapien
ctgtggcttatgttgggattgatga

SEQ ID NO: 522530 - DNA, 25 bp, Homo sapien
acctgtcatgtaaagggacggtatg

SEQ ID NO: 522531 - DNA, 25 bp, Homo sapien
gatggtggaaaagttatgctaaaat

SEQ ID NO: 522532 - DNA, 25 bp, Homo sapien
aacaggcagcttcaacagatagtct

SEQ ID NO: 522533 - DNA, 25 bp, Homo sapien
gcttcaacagatagtctcagggtct

SEQ ID NO: 522534 - DNA, 25 bp, Homo sapien
gtctcagggtcttaaatgactctct

SEQ ID NO: 522535 - DNA, 25 bp, Homo sapien
atgactctctgaccccagagataga

SEQ ID NO: 522536 - DNA, 25 bp, Homo sapien
cagtggcggcagaacagatgctgaa

SEQ ID NO: 522537 - DNA, 25 bp, Homo sapien
gaacagatgctgaaaggacaataca

SEQ ID NO: 522538 - DNA, 25 bp, Homo sapien
tttgaaaactactgtcatgtactga

SEQ ID NO: 522539 - DNA, 25 bp, Homo sapien
gtcatgtactgaatctttcctgttg

SEQ ID NO: 522540 - DNA, 25 bp, Homo sapien
tcctgttgaagaaatccatgttata

SEQ ID NO: 522541 - DNA, 25 bp, Homo sapien
gaactttgcagtcagacattcgtca

SEQ ID NO: 522542 - DNA, 25 bp, Homo sapien
gacattcgtcatgggaaagttcaga

SEQ ID NO: 522543 - DNA, 25 bp, Homo sapien
agggagtacatagccattcattctc

SEQ ID NO: 522544 - DNA, 25 bp, Homo sapien
atagccattcattctcgaatcctgc

SEQ ID NO: 522545 - DNA, 25 bp, Homo sapien
cgaatcctgccattcattcagcata

SEQ ID NO: 522546 - DNA, 25 bp, Homo sapien
attcagcatatattgtgtgcccgta

SEQ ID NO: 522547 - DNA, 25 bp, Homo sapien
actagtcctggtggagtaagcccat

SEQ ID NO: 522548 - DNA, 25 bp, Homo sapien
gtggagtaagcccatggaagaacta

SEQ ID NO: 522549 - DNA, 25 bp, Homo sapien
gaagaactaggctgtaaggtgtcta

SEQ ID NO: 522550 - DNA, 25 bp, Homo sapien
aaggtgtctagactgtcttcctcac

SEQ ID NO: 522551 - DNA, 25 bp, Homo sapien
ttcctggaaggagggcatccaattt

SEQ ID NO: 522552 - DNA, 25 bp, Homo sapien
aactctatttcatggttgttgcagt

SEQ ID NO: 522553 - DNA, 25 bp, Homo sapien
gttgcagttgaagtgtttctggttt

SEQ ID NO: 522554 - DNA, 25 bp, Homo sapien
gggtttttaggtatggctgaatgtt

SEQ ID NO: 522555 - DNA, 25 bp, Homo sapien
tttaggtatggctgaatgttgccat

SEQ ID NO: 522556 - DNA, 25 bp, Homo sapien
aatgtctctatgaagccctaagacc

SEQ ID NO: 522557 - DNA, 25 bp, Homo sapien
tctatgaagccctaagaccagacac

SEQ ID NO: 522558 - DNA, 25 bp, Homo sapien
aatggacaaggaatgtcaaaaggcc

SEQ ID NO: 522559 - DNA, 25 bp, Homo sapien
gatctggctactgagaccccctgaa

SEQ ID NO: 522560 - DNA, 25 bp, Homo sapien
tactgagaccccctgaactaagaaa

SEQ ID NO: 522561 - DNA, 25 bp, Homo sapien
cccctgaactaagaaagccatttga

SEQ ID NO: 522562 - DNA, 25 bp, Homo sapien
ctaagaaagccatttgatttgttca

SEQ ID NO: 522563 - DNA, 25 bp, Homo sapien
ttgatttgttcatacatgagagaga

SEQ ID NO: 522564 - DNA, 25 bp, Homo sapien
ttaggagtagtaacccaagacttgg

SEQ ID NO: 522565 - DNA, 25 bp, Homo sapien
gggctgaggtcctctgagaagggac

SEQ ID NO: 522566 - DNA, 25 bp, Homo sapien
atcagcaggagaggactgactccag

SEQ ID NO: 522567 - DNA, 25 bp, Homo sapien
gagaggactgactccagaaaaatca

SEQ ID NO: 522568 - DNA, 25 bp, Homo sapien
gactccagaaaaatcagcgtttgta

SEQ ID NO: 522569 - DNA, 25 bp, Homo sapien
aaaaatcagcgtttgtacccactca

SEQ ID NO: 522570 - DNA, 25 bp, Homo sapien
aaatcagcgtttgtacccactcagg

SEQ ID NO: 522571 - DNA, 25 bp, Homo sapien
tttgtacccactcaggctgccaaga

SEQ ID NO: 522572 - DNA, 25 bp, Homo sapien
aggctgccaagacctgtgtccgtcc

SEQ ID NO: 522573 - DNA, 25 bp, Homo sapien
caagacctgtgtccgtccttccaag

SEQ ID NO: 522574 - DNA, 25 bp, Homo sapien
ttccaagctcaaccttcagagttca

SEQ ID NO: 522575 - DNA, 25 bp, Homo sapien
gctcaaccttcagagttcatgaggc

SEQ ID NO: 522576 - DNA, 25 bp, Homo sapien
agagttcatatacctggtctcctgt

SEQ ID NO: 522577 - DNA, 25 bp, Homo sapien
tcctgtgaagaatcttgaccctctt

SEQ ID NO: 522578 - DNA, 25 bp, Homo sapien
ctcttctcctcaaagtttctatcta

SEQ ID NO: 522579 - DNA, 25 bp, Homo sapien
acatcatttttgaaggtcctgtagc

SEQ ID NO: 522580 - DNA, 25 bp, Homo sapien
gtcctgtagcataaggctggtgtct

SEQ ID NO: 522581 - DNA, 25 bp, Homo sapien
gagagcatgtctcagcctagtgagt

SEQ ID NO: 522582 - DNA, 25 bp, Homo sapien
tagcttagccaaccatgtgtgtcca

SEQ ID NO: 522583 - DNA, 25 bp, Homo sapien
gtgtgtccacattaagaagggcttt

SEQ ID NO: 522584 - DNA, 25 bp, Homo sapien
ttttaattccctccttgacccatat

SEQ ID NO: 522585 - DNA, 25 bp, Homo sapien
ttgacccatatgcagtctttgcagg

SEQ ID NO: 522586 - DNA, 25 bp, Homo sapien
gaaatagcccctaaaagacagccaa

SEQ ID NO: 522587 - DNA, 25 bp, Homo sapien
tgggccaagccctccagccagagtt

SEQ ID NO: 522588 - DNA, 25 bp, Homo sapien
gggccaagccctccagccagagttg

SEQ ID NO: 522589 - DNA, 25 bp, Homo sapien
tccagccagagttgccagcaggcga

SEQ ID NO: 522590 - DNA, 25 bp, Homo sapien
ccagccagagttgccagcaggcgag

SEQ ID NO: 522591 - DNA, 25 bp, Homo sapien
agccagagttgccagcaggcgagtg

SEQ ID NO: 522592 - DNA, 25 bp, Homo sapien
agtccagggtcacaagtctctggta

SEQ ID NO: 522593 - DNA, 25 bp, Homo sapien
gtccagggtcacaagtctctggtac

SEQ ID NO: 522594 - DNA, 25 bp, Homo sapien
cagggtcacaagtctctggtaccaa

SEQ ID NO: 522595 - DNA, 25 bp, Homo sapien
agggtcacaagtctctggtaccaaa

SEQ ID NO: 522596 - DNA, 25 bp, Homo sapien
gggtcacaagtctctggtaccaaaa

SEQ ID NO: 522597 - DNA, 25 bp, Homo sapien
ggtcacaagtctctggtaccaaaag

SEQ ID NO: 522598 - DNA, 25 bp, Homo sapien
gaagtttatcaaggctgtcacacat

SEQ ID NO: 522599 - DNA, 25 bp, Homo sapien
ggctgtcacacatcaagttaaattt

SEQ ID NO: 522600 - DNA, 25 bp, Homo sapien
atttggtcaacaaaatccacgtcag

SEQ ID NO: 522601 - DNA, 25 bp, Homo sapien
aaatccacgtcaggtagcacagagt

SEQ ID NO: 522602 - DNA, 25 bp, Homo sapien
gctaaatgagctgttcaaacctgta

SEQ ID NO: 522603 - DNA, 25 bp, Homo sapien
gttcaaacctgtagttgctgctcaa

SEQ ID NO: 522604 - DNA, 25 bp, Homo sapien
aacctgtagttgctgctcaaaaaat

SEQ ID NO: 522605 - DNA, 25 bp, Homo sapien
aaaggtgcagatcccaagtctgtag

SEQ ID NO: 522606 - DNA, 25 bp, Homo sapien
gatcccaagtctgtagtatgtgcat

SEQ ID NO: 522607 - DNA, 25 bp, Homo sapien
gtatgtgcattcttcaagcaaggac

SEQ ID NO: 522608 - DNA, 25 bp, Homo sapien
gcaaggacagtgtactaaaggagat

SEQ ID NO: 522609 - DNA, 25 bp, Homo sapien
ggcgcctatgatggagaccctcagc

SEQ ID NO: 522610 - DNA, 25 bp, Homo sapien
agggactccatcttttgaccttgaa

SEQ ID NO: 522611 - DNA, 25 bp, Homo sapien
gaccttgaagtctcgctcaaacatt

SEQ ID NO: 522612 - DNA, 25 bp, Homo sapien
ctcgctcaaacattcccctaaaaga

SEQ ID NO: 522613 - DNA, 25 bp, Homo sapien
ggaatcggacaacttaaagtctcga

SEQ ID NO: 522614 - DNA, 25 bp, Homo sapien
aaagtctcgatatgagcctcggatt

SEQ ID NO: 522615 - DNA, 25 bp, Homo sapien
gaactcctgggttctagacccagct

SEQ ID NO: 522616 - DNA, 25 bp, Homo sapien
agctctgctactaacttgtctgacc

SEQ ID NO: 522617 - DNA, 25 bp, Homo sapien
ttgtctgaccttccccatttataaa

SEQ ID NO: 522618 - DNA, 25 bp, Homo sapien
gaccttccccatttataaactgttg

SEQ ID NO: 522619 - DNA, 25 bp, Homo sapien
ggactaggtgaactctgagagccct

SEQ ID NO: 522620 - DNA, 25 bp, Homo sapien
agagtcgctgatgcccttccgagta

SEQ ID NO: 522621 - DNA, 25 bp, Homo sapien
gatgcccttccgagtacatccttct

SEQ ID NO: 522622 - DNA, 25 bp, Homo sapien
ccccattgcagccttcttagaaatg

SEQ ID NO: 522623 - DNA, 25 bp, Homo sapien
agaaatgcagcagcagtctcaccca

SEQ ID NO: 522624 - DNA, 25 bp, Homo sapien
gcagtctcacccatcaggagcaaaa

SEQ ID NO: 522625 - DNA, 25 bp, Homo sapien
gaaagcctcagagcttttgcgactg

SEQ ID NO: 522626 - DNA, 25 bp, Homo sapien
agcctcagagcttttgcgactgtgt

SEQ ID NO: 522627 - DNA, 25 bp, Homo sapien
cagagcttttgcgactgtgtggtct

SEQ ID NO: 522628 - DNA, 25 bp, Homo sapien
tttgcgactgtgtggtctggctata

SEQ ID NO: 522629 - DNA, 25 bp, Homo sapien
gactgtgtggtctggctataaattt

SEQ ID NO: 522630 - DNA, 25 bp, Homo sapien
ctggctataaatttagactgttgct

SEQ ID NO: 522631 - DNA, 25 bp, Homo sapien
ttcttctactgcagccgcttttgaa

SEQ ID NO: 522632 - DNA, 25 bp, Homo sapien
tactgcagccgcttttgaaaagcta

SEQ ID NO: 522633 - DNA, 25 bp, Homo sapien
aggcagagtcagagtgaggaacaca

SEQ ID NO: 522634 - DNA, 25 bp, Homo sapien
gaacacagaagcatccaaccgcttc

SEQ ID NO: 522635 - DNA, 25 bp, Homo sapien
accgcttctgtcacgtaagcatgct

SEQ ID NO: 522636 - DNA, 25 bp, Homo sapien
gtaagcatgctgaggctgcggaaaa

SEQ ID NO: 522637 - DNA, 25 bp, Homo sapien
aaagagtgcgtctgactgtagtccg

SEQ ID NO: 522638 - DNA, 25 bp, Homo sapien
gcgtctgactgtagtccgggagaaa

SEQ ID NO: 522639 - DNA, 25 bp, Homo sapien
agaaatctagacttacatgcaggga

SEQ ID NO: 522640 - DNA, 25 bp, Homo sapien
cagggatatgcagggtataaacttt

SEQ ID NO: 522641 - DNA, 25 bp, Homo sapien
ggtttgaaagagcttccggtacaca

SEQ ID NO: 522642 - DNA, 25 bp, Homo sapien
gtgccatttcttctgatatgaaagt

SEQ ID NO: 522643 - DNA, 25 bp, Homo sapien
agtgttcaaatcgacatcatggagt

SEQ ID NO: 522644 - DNA, 25 bp, Homo sapien
atggagtccatttctccttcgacta

SEQ ID NO: 522645 - DNA, 25 bp, Homo sapien
cattcgatccactgcttacatgtgt

SEQ ID NO: 522646 - DNA, 25 bp, Homo sapien
gtactcgaacgcacgcttatactag

SEQ ID NO: 522647 - DNA, 25 bp, Homo sapien
cttatactagccattgcaccactaa

SEQ ID NO: 522648 - DNA, 25 bp, Homo sapien
atgcagagctatggcttcccggaag

SEQ ID NO: 522649 - DNA, 25 bp, Homo sapien
aagggttgcaaatcagtctctacag

SEQ ID NO: 522650 - DNA, 25 bp, Homo sapien
gtctctacagatgagctagtttccg

SEQ ID NO: 522651 - DNA, 25 bp, Homo sapien
tagtttccgttgaagtagctcggtt

SEQ ID NO: 522652 - DNA, 25 bp, Homo sapien
cgtggtggaggaacttttccacaca

SEQ ID NO: 522653 - DNA, 25 bp, Homo sapien
ccagatttcttctgttgtgtctgaa

SEQ ID NO: 522654 - DNA, 25 bp, Homo sapien
gtatattggtaatctattaggtcca

SEQ ID NO: 522655 - DNA, 25 bp, Homo sapien
gtaatctattaggtccattggcaaa

SEQ ID NO: 522656 - DNA, 25 bp, Homo sapien
ggtccattggcaaagtatattggtc

SEQ ID NO: 522657 - DNA, 25 bp, Homo sapien
gtatattggtccatattcaaaccta

SEQ ID NO: 522658 - DNA, 25 bp, Homo sapien
ggtccatattcaaacctattccaaa

SEQ ID NO: 522659 - DNA, 25 bp, Homo sapien
taagattcctttattgtggtaccat

SEQ ID NO: 522660 - DNA, 25 bp, Homo sapien
gattcctttattgtggtaccatgtc

SEQ ID NO: 522661 - DNA, 25 bp, Homo sapien
tattgtggtaccatgtctgtttacc

SEQ ID NO: 522662 - DNA, 25 bp, Homo sapien
tcccggtcacacaacagggtacgta

SEQ ID NO: 522663 - DNA, 25 bp, Homo sapien
ggtcacacaacagggtacgtaaata

SEQ ID NO: 522664 - DNA, 25 bp, Homo sapien
ctcaaaacttcttactcatcacaaa

SEQ ID NO: 522665 - DNA, 25 bp, Homo sapien
ttcttactcatcacaaagaccactt

SEQ ID NO: 522666 - DNA, 25 bp, Homo sapien
agttagctgtagaagcagttctcag

SEQ ID NO: 522667 - DNA, 25 bp, Homo sapien
gcagttctcagactgaaaggctctg

SEQ ID NO: 522668 - DNA, 25 bp, Homo sapien
catattatcaagaagctaggaggaa

SEQ ID NO: 522669 - DNA, 25 bp, Homo sapien
ggaagtttggcagattcctatttag

SEQ ID NO: 522670 - DNA, 25 bp, Homo sapien
ggagtaaatcaaccaaaacgaattg

SEQ ID NO: 522671 - DNA, 25 bp, Homo sapien
aattcttattgcaaatactggtatg

SEQ ID NO: 522672 - DNA, 25 bp, Homo sapien
gcaaatactggtatggatacagaca

SEQ ID NO: 522673 - DNA, 25 bp, Homo sapien
tggttcccgggtaagagttgactct

SEQ ID NO: 522674 - DNA, 25 bp, Homo sapien
agttgactctacagcaaaggttgca

SEQ ID NO: 522675 - DNA, 25 bp, Homo sapien
atgggatgattgtccacattctttc

SEQ ID NO: 522676 - DNA, 25 bp, Homo sapien
atgcatggaagctgtggtgcaagaa

SEQ ID NO: 522677 - DNA, 25 bp, Homo sapien
aataaagatttgtacctgcgtccgt

SEQ ID NO: 522678 - DNA, 25 bp, Homo sapien
aaagatttgtacctgcgtccgtgtg

SEQ ID NO: 522679 - DNA, 25 bp, Homo sapien
gtccgtgtgatggaaaagcccgcca

SEQ ID NO: 522680 - DNA, 25 bp, Homo sapien
tgtgatggaaaagcccgccagcagt

SEQ ID NO: 522681 - DNA, 25 bp, Homo sapien
atgctgtggatgaacgatgaatgtc

SEQ ID NO: 522682 - DNA, 25 bp, Homo sapien
atgaacgatgaatgtcaatgtcaga

SEQ ID NO: 522683 - DNA, 25 bp, Homo sapien
gccatcaaaatccagctccaagtga

SEQ ID NO: 522684 - DNA, 25 bp, Homo sapien
tccagctccaagtgaacttaaagag

SEQ ID NO: 522685 - DNA, 25 bp, Homo sapien
tgtgctcctggtgttaggagagaaa

SEQ ID NO: 522686 - DNA, 25 bp, Homo sapien
caggttcaagtgctggattgtgtca

SEQ ID NO: 522687 - DNA, 25 bp, Homo sapien
gattgtgtcatgtgaccatcccaaa

SEQ ID NO: 522688 - DNA, 25 bp, Homo sapien
tgtgaccatcccaaaactcagagca

SEQ ID NO: 522689 - DNA, 25 bp, Homo sapien
tcagagcaccctatggccgtctttg

SEQ ID NO: 522690 - DNA, 25 bp, Homo sapien
tttgccctctgtcacataacttgaa

SEQ ID NO: 522691 - DNA, 25 bp, Homo sapien
aaaactgcctgatggcctttttgca

SEQ ID NO: 522692 - DNA, 25 bp, Homo sapien
tttttgcagtggttccctccaggaa

SEQ ID NO: 522693 - DNA, 25 bp, Homo sapien
ggaagccttgatctcagttgaagaa

SEQ ID NO: 522694 - DNA, 25 bp, Homo sapien
gttgaagaagttctttcctggcatt

SEQ ID NO: 522695 - DNA, 25 bp, Homo sapien
tactcctcagacacccttaacaaag

SEQ ID NO: 522696 - DNA, 25 bp, Homo sapien
ttaacaaaggctgtcatgcacacaa

SEQ ID NO: 522697 - DNA, 25 bp, Homo sapien
catccctgaggagtattgattggcc

SEQ ID NO: 522698 - DNA, 25 bp, Homo sapien
ttgaatacttaccttgggctcagcc

SEQ ID NO: 522699 - DNA, 25 bp, Homo sapien
gctcagccaggttcttatctttatg

SEQ ID NO: 522700 - DNA, 25 bp, Homo sapien
gttcttatctttatgctagttggga

SEQ ID NO: 522701 - DNA, 25 bp, Homo sapien
tttgtttgtaagtaccagccttttg

SEQ ID NO: 522702 - DNA, 25 bp, Homo sapien
gtaccagccttttgatattgtaatc

SEQ ID NO: 522703 - DNA, 25 bp, Homo sapien
tattgtaatccttccagcctagtga

SEQ ID NO: 522704 - DNA, 25 bp, Homo sapien
agcctagtgaaatacctggctgttt

SEQ ID NO: 522705 - DNA, 25 bp, Homo sapien
gaaagttatccctgtaatggtaaat

SEQ ID NO: 522706 - DNA, 25 bp, Homo sapien
atacactttttcatactgtcccgtg

SEQ ID NO: 522707 - DNA, 25 bp, Homo sapien
ttttcatactgtcccgtgtctctta

SEQ ID NO: 522708 - DNA, 25 bp, Homo sapien
tgaagatgacgattggtcctctgat

SEQ ID NO: 522709 - DNA, 25 bp, Homo sapien
cgattggtcctctgatgaattctga

SEQ ID NO: 522710 - DNA, 25 bp, Homo sapien
ataatctcctaaatcactgacgttg

SEQ ID NO: 522711 - DNA, 25 bp, Homo sapien
cactgacgttgagatgtcatcatct

SEQ ID NO: 522712 - DNA, 25 bp, Homo sapien
atcagactttctaactagtatcaag

SEQ ID NO: 522713 - DNA, 25 bp, Homo sapien
actagtatcaagatcagtgtcagat

SEQ ID NO: 522714 - DNA, 25 bp, Homo sapien
atcagtgtcagatattgttgaggga

SEQ ID NO: 522715 - DNA, 25 bp, Homo sapien
aaaagcccagtttgtctttcagaag

SEQ ID NO: 522716 - DNA, 25 bp, Homo sapien
gtttgtctttcagaaggtgactttc

SEQ ID NO: 522717 - DNA, 25 bp, Homo sapien
aaggtgactttcatgtgcttgaaaa

SEQ ID NO: 522718 - DNA, 25 bp, Homo sapien
gaatattgtgtttaaccacatggta

SEQ ID NO: 522719 - DNA, 25 bp, Homo sapien
aggaacaggagcaactactaaaaga

SEQ ID NO: 522720 - DNA, 25 bp, Homo sapien
ggaacaggagcaactactaaaagag

SEQ ID NO: 522721 - DNA, 25 bp, Homo sapien
gaacaggagcaactactaaaagagg

SEQ ID NO: 522722 - DNA, 25 bp, Homo sapien
aacaggagcaactactaaaagaggg

SEQ ID NO: 522723 - DNA, 25 bp, Homo sapien
acaggagcaactactaaaagaggga

SEQ ID NO: 522724 - DNA, 25 bp, Homo sapien
caggagcaactactaaaagagggat

SEQ ID NO: 522725 - DNA, 25 bp, Homo sapien
aggagcaactactaaaagagggatt

SEQ ID NO: 522726 - DNA, 25 bp, Homo sapien
ggagcaactactaaaagagggattt

SEQ ID NO: 522727 - DNA, 25 bp, Homo sapien
gagcaactactaaaagagggatttc

SEQ ID NO: 522728 - DNA, 25 bp, Homo sapien
agcaactactaaaagagggatttca

SEQ ID NO: 522729 - DNA, 25 bp, Homo sapien
gcaactactaaaagagggatttcaa

SEQ ID NO: 522730 - DNA, 25 bp, Homo sapien
cacaagaaataactctcagcctcaa

SEQ ID NO: 522731 - DNA, 25 bp, Homo sapien
gcctcaagggaaaacttcctcctag

SEQ ID NO: 522732 - DNA, 25 bp, Homo sapien
agggaaaacttcctcctagtgcagc

SEQ ID NO: 522733 - DNA, 25 bp, Homo sapien
aaacttcctcctagtgcagccctat

SEQ ID NO: 522734 - DNA, 25 bp, Homo sapien
tcccaggttgtcacggtgcggaact

SEQ ID NO: 522735 - DNA, 25 bp, Homo sapien
tggatgaggacctgggagccgcctg

SEQ ID NO: 522736 - DNA, 25 bp, Homo sapien
ccgcctgggaggacagccccagaaa

SEQ ID NO: 522737 - DNA, 25 bp, Homo sapien
ccccagaaagggagcccgagaccag

SEQ ID NO: 522738 - DNA, 25 bp, Homo sapien
gagaccaggcgtgtcgccgacatgc

SEQ ID NO: 522739 - DNA, 25 bp, Homo sapien
cgtgtcgccgacatgcaaatgggtt

SEQ ID NO: 522740 - DNA, 25 bp, Homo sapien
cgccgacatgcaaatgggttgtttt

SEQ ID NO: 522741 - DNA, 25 bp, Homo sapien
aagcctgtgccatctttcactggga

SEQ ID NO: 522742 - DNA, 25 bp, Homo sapien
tcactgggaggcaaatatgtttttc

SEQ ID NO: 522743 - DNA, 25 bp, Homo sapien
ttttcatcctgccatatgacaccta

SEQ ID NO: 522744 - DNA, 25 bp, Homo sapien
gacacctatgagaaacgttcacagt

SEQ ID NO: 522745 - DNA, 25 bp, Homo sapien
cacagtgaggagtagccaggttgct

SEQ ID NO: 522746 - DNA, 25 bp, Homo sapien
gttgctaggacagtaaccctgccac

SEQ ID NO: 522747 - DNA, 25 bp, Homo sapien
actgcctgaaatcggaactcccttg

SEQ ID NO: 522748 - DNA, 25 bp, Homo sapien
ctccctcttaactaagtgacccatg

SEQ ID NO: 522749 - DNA, 25 bp, Homo sapien
tgacccatgtagaaggaagccagga

SEQ ID NO: 522750 - DNA, 25 bp, Homo sapien
agggtattggacacggcagcgtcct

SEQ ID NO: 522751 - DNA, 25 bp, Homo sapien
gcagcgtcctccttattgaaaacac

SEQ ID NO: 522752 - DNA, 25 bp, Homo sapien
gatttcacagcgtaaaatttgatgt

SEQ ID NO: 522753 - DNA, 25 bp, Homo sapien
atggaagagttcatgtgcctggaca

SEQ ID NO: 522754 - DNA, 25 bp, Homo sapien
gagttcatgtgcctggacacacagt

SEQ ID NO: 522755 - DNA, 25 bp, Homo sapien
ggacacacagttccctgtaatcctg

SEQ ID NO: 522756 - DNA, 25 bp, Homo sapien
ctgtaatcctgccatctagggagat

SEQ ID NO: 522757 - DNA, 25 bp, Homo sapien
aatcctgccatctagggagataaac

SEQ ID NO: 522758 - DNA, 25 bp, Homo sapien
gcatagttatgcatttatattctca

SEQ ID NO: 522759 - DNA, 25 bp, Homo sapien
atgtacattgctttgtagtctgctc

SEQ ID NO: 522760 - DNA, 25 bp, Homo sapien
acattgctttgtagtctgctctata

SEQ ID NO: 522761 - DNA, 25 bp, Homo sapien
gtagtctgctctatatattgtcaat

SEQ ID NO: 522762 - DNA, 25 bp, Homo sapien
atatattgtcaatatgttcccatat

SEQ ID NO: 522763 - DNA, 25 bp, Homo sapien
aagctctggatacttctctttcctt

SEQ ID NO: 522764 - DNA, 25 bp, Homo sapien
gtccaggattgaagactcttgggta

SEQ ID NO: 522765 - DNA, 25 bp, Homo sapien
aggttcatccagagctagaggtctt

SEQ ID NO: 522766 - DNA, 25 bp, Homo sapien
ggtcttacctgaagctcaagtgcaa

SEQ ID NO: 522767 - DNA, 25 bp, Homo sapien
gcaagccatggttgggtgtcatttt

SEQ ID NO: 522768 - DNA, 25 bp, Homo sapien
ttgggtgtcatttttacaggctgat

SEQ ID NO: 522769 - DNA, 25 bp, Homo sapien
acaggctgattggtggtacctataa

SEQ ID NO: 522770 - DNA, 25 bp, Homo sapien
ttagacttgccttcacacttgcttt

SEQ ID NO: 522771 - DNA, 25 bp, Homo sapien
tcacacttgctttctgccacatgca

SEQ ID NO: 522772 - DNA, 25 bp, Homo sapien
gccacatgcacacaactcataggtt

SEQ ID NO: 522773 - DNA, 25 bp, Homo sapien
ataggttgtcctggactgggttctc

SEQ ID NO: 522774 - DNA, 25 bp, Homo sapien
aacatccttggcaggctttgaagca

SEQ ID NO: 522775 - DNA, 25 bp, Homo sapien
ggctttgaagcacacagaattttct

SEQ ID NO: 522776 - DNA, 25 bp, Homo sapien
gcacacagaattttctagtatttct

SEQ ID NO: 522777 - DNA, 25 bp, Homo sapien
acatatacttagtttacctgatgag

SEQ ID NO: 522778 - DNA, 25 bp, Homo sapien
tacctgatgagtttagacataattc

SEQ ID NO: 522779 - DNA, 25 bp, Homo sapien
cataattctatataatgttcgctta

SEQ ID NO: 522780 - DNA, 25 bp, Homo sapien
ataatgttcgcttatattcatttat

SEQ ID NO: 522781 - DNA, 25 bp, Homo sapien
tattaactagcaacacttgtgcaag

SEQ ID NO: 522782 - DNA, 25 bp, Homo sapien
tgtgcaagaacaaggtattctgctt

SEQ ID NO: 522783 - DNA, 25 bp, Homo sapien
gaacaaggtattctgcttgaaaaca

SEQ ID NO: 522784 - DNA, 25 bp, Homo sapien
gaagcaagactctttaattcagtta

SEQ ID NO: 522785 - DNA, 25 bp, Homo sapien
tttggtagtacacaggttctccctt

SEQ ID NO: 522786 - DNA, 25 bp, Homo sapien
gtagtacacaggttctcccttgttc

SEQ ID NO: 522787 - DNA, 25 bp, Homo sapien
tacacaggttctcccttgttctttt

SEQ ID NO: 522788 - DNA, 25 bp, Homo sapien
taatgggtaaagcaacagctgtgta

SEQ ID NO: 522789 - DNA, 25 bp, Homo sapien
gcaacagctgtgtaatcacaaacta

SEQ ID NO: 522790 - DNA, 25 bp, Homo sapien
aactagatgcagaggaggtcttgcc

SEQ ID NO: 522791 - DNA, 25 bp, Homo sapien
aggtcttgccagcactccaaaatct

SEQ ID NO: 522792 - DNA, 25 bp, Homo sapien
cccagagctaactatcctgacgtat

SEQ ID NO: 522793 - DNA, 25 bp, Homo sapien
gagctaactatcctgacgtatggta

SEQ ID NO: 522794 - DNA, 25 bp, Homo sapien
tcctgacgtatggtaattctccctc

SEQ ID NO: 522795 - DNA, 25 bp, Homo sapien
tttgctcacttttgacttatataaa

SEQ ID NO: 522796 - DNA, 25 bp, Homo sapien
caaatacaggttttggtgggccagt

SEQ ID NO: 522797 - DNA, 25 bp, Homo sapien
ggtgggccagttattagttctctat

SEQ ID NO: 522798 - DNA, 25 bp, Homo sapien
gttattagttctctatatcatgaag

SEQ ID NO: 522799 - DNA, 25 bp, Homo sapien
atatttgattactgcagggaaaaca

SEQ ID NO: 522800 - DNA, 25 bp, Homo sapien
agagggtagggctctacttcactgg

SEQ ID NO: 522801 - DNA, 25 bp, Homo sapien
acttcactgggcctgtgatcgagga

SEQ ID NO: 522802 - DNA, 25 bp, Homo sapien
actgggcctgtgatcgaggacataa

SEQ ID NO: 522803 - DNA, 25 bp, Homo sapien
ggacataaggaactagtcacagtgt

SEQ ID NO: 522804 - DNA, 25 bp, Homo sapien
actagtcacagtgttgctgcaacat

SEQ ID NO: 522805 - DNA, 25 bp, Homo sapien
aactgtcaggacaatgaaggccaaa

SEQ ID NO: 522806 - DNA, 25 bp, Homo sapien
gaaggccaaacagctctacattatg

SEQ ID NO: 522807 - DNA, 25 bp, Homo sapien
gatctttcgagtaggttcggtctga

SEQ ID NO: 522808 - DNA, 25 bp, Homo sapien
ttcggtctgaaaggtgtgggccttt

SEQ ID NO: 522809 - DNA, 25 bp, Homo sapien
ggcctttatatttgatccacacacg

SEQ ID NO: 522810 - DNA, 25 bp, Homo sapien
tttgatccacacacgttggtctttt

SEQ ID NO: 522811 - DNA, 25 bp, Homo sapien
tccacacacgttggtcttttaaccg

SEQ ID NO: 522812 - DNA, 25 bp, Homo sapien
cacgttggtcttttaaccgtgctga

SEQ ID NO: 522813 - DNA, 25 bp, Homo sapien
atatagtttaagaaggctccccatt

SEQ ID NO: 522814 - DNA, 25 bp, Homo sapien
aggctccccatttggcatcgtttaa

SEQ ID NO: 522815 - DNA, 25 bp, Homo sapien
atgttatgttataagcacagctctc

SEQ ID NO: 522816 - DNA, 25 bp, Homo sapien
ttctccaattttcatcctgcaagca

SEQ ID NO: 522817 - DNA, 25 bp, Homo sapien
ttttcatcctgcaagcaactcaaaa

SEQ ID NO: 522818 - DNA, 25 bp, Homo sapien
gattcctgtctctaatccagacctg

SEQ ID NO: 522819 - DNA, 25 bp, Homo sapien
aatccagacctgagaatgcttgaat

SEQ ID NO: 522820 - DNA, 25 bp, Homo sapien
aaagtcctcctagctgggaccttgg

SEQ ID NO: 522821 - DNA, 25 bp, Homo sapien
tagctgggaccttgggagtgtcacc

SEQ ID NO: 522822 - DNA, 25 bp, Homo sapien
accttgggagtgtcacctgctgtaa

SEQ ID NO: 522823 - DNA, 25 bp, Homo sapien
acctgctgtaagacttgagtggcct

SEQ ID NO: 522824 - DNA, 25 bp, Homo sapien
taagacttgagtggcctgactgggt

SEQ ID NO: 522825 - DNA, 25 bp, Homo sapien
aggagaaaaggtgcaccaaggtgct

SEQ ID NO: 522826 - DNA, 25 bp, Homo sapien
gcaccaaggtgcttcctaagtcggg

SEQ ID NO: 522827 - DNA, 25 bp, Homo sapien
attcctgggagccacgtgactgacc

SEQ ID NO: 522828 - DNA, 25 bp, Homo sapien
tccaactcgtgctgatagctggccg

SEQ ID NO: 522829 - DNA, 25 bp, Homo sapien
tgggccaagccctccagccagagtt

SEQ ID NO: 522830 - DNA, 25 bp, Homo sapien
tccagccagagttgccagcaggcga

SEQ ID NO: 522831 - DNA, 25 bp, Homo sapien
ccagccagagttgccagcaggcgag

SEQ ID NO: 522832 - DNA, 25 bp, Homo sapien
ccagagttgccagcaggcgagtgct

SEQ ID NO: 522833 - DNA, 25 bp, Homo sapien
agtccagggtcacaagtctctggta

SEQ ID NO: 522834 - DNA, 25 bp, Homo sapien
cagggtcacaagtctctggtaccaa

SEQ ID NO: 522835 - DNA, 25 bp, Homo sapien
gggtcacaagtctctggtaccaaaa

SEQ ID NO: 522836 - DNA, 25 bp, Homo sapien
ggtcacaagtctctggtaccaaaag

SEQ ID NO: 522837 - DNA, 25 bp, Homo sapien
aaagggacccatggctgactgacag

SEQ ID NO: 522838 - DNA, 25 bp, Homo sapien
gaagaactgggagctccccaacttg

SEQ ID NO: 522839 - DNA, 25 bp, Homo sapien
gcagggcttgttagattgtggctac

SEQ ID NO: 522840 - DNA, 25 bp, Homo sapien
gcagcgatttggcatctaccggttc

SEQ ID NO: 522841 - DNA, 25 bp, Homo sapien
gatttggcatctaccggttcctgcc

SEQ ID NO: 522842 - DNA, 25 bp, Homo sapien
tgcccttcttttttgtcctgggagg

SEQ ID NO: 522843 - DNA, 25 bp, Homo sapien
tcttttttgtcctgggaggaacgat

SEQ ID NO: 522844 - DNA, 25 bp, Homo sapien
ggaacgatggagtggatcatgatta

SEQ ID NO: 522845 - DNA, 25 bp, Homo sapien
atcatgattaaagtgcgcgtgggcc

SEQ ID NO: 522846 - DNA, 25 bp, Homo sapien
gcgtgggccaggagaccttctatga

SEQ ID NO: 522847 - DNA, 25 bp, Homo sapien
gaccttctatgatgtctaccgtaga

SEQ ID NO: 522848 - DNA, 25 bp, Homo sapien
atgtctaccgtagaaaagcctcaga

SEQ ID NO: 522849 - DNA, 25 bp, Homo sapien
ggctggaagatgaatgagactgaac

SEQ ID NO: 522850 - DNA, 25 bp, Homo sapien
tgagactgaacttcagcagtcaata

SEQ ID NO: 522851 - DNA, 25 bp, Homo sapien
gatactgttgtagagctgatcttgt

SEQ ID NO: 522852 - DNA, 25 bp, Homo sapien
tagagctgatcttgtgcttctcacc

SEQ ID NO: 522853 - DNA, 25 bp, Homo sapien
cactctcacttgtggatttttggga

SEQ ID NO: 522854 - DNA, 25 bp, Homo sapien
ggagagctgaggatggacactttat

SEQ ID NO: 522855 - DNA, 25 bp, Homo sapien
ggacactttattgggctgtgagctc

SEQ ID NO: 522856 - DNA, 25 bp, Homo sapien
gctgtgagctctgcatgatggcaat

SEQ ID NO: 522857 - DNA, 25 bp, Homo sapien
ctgcatgatggcaatcgtgaggtct

SEQ ID NO: 522858 - DNA, 25 bp, Homo sapien
agacaggacggaattcctgggaagt

SEQ ID NO: 522859 - DNA, 25 bp, Homo sapien
tgggaagtcctacagctgctgtcta

SEQ ID NO: 522860 - DNA, 25 bp, Homo sapien
cctacagctgctgtctaccatagag

SEQ ID NO: 522861 - DNA, 25 bp, Homo sapien
accatagagttccattgtcttctcc

SEQ ID NO: 522862 - DNA, 25 bp, Homo sapien
tccctacctctgaatgacatgcttt

SEQ ID NO: 522863 - DNA, 25 bp, Homo sapien
catgctttttaattatagtacccaa

SEQ ID NO: 522864 - DNA, 25 bp, Homo sapien
aggttttatctttaagaggctgcat

SEQ ID NO: 522865 - DNA, 25 bp, Homo sapien
aagaggctgcatttcttctctaatt

SEQ ID NO: 522866 - DNA, 25 bp, Homo sapien
tcttctctaattctaggtgccaatg

SEQ ID NO: 522867 - DNA, 25 bp, Homo sapien
gccaatgggtcatgtttggttagaa

SEQ ID NO: 522868 - DNA, 25 bp, Homo sapien
gaaggtgacaatctacagaattcta

SEQ ID NO: 522869 - DNA, 25 bp, Homo sapien
tacagaattctacagattccaggtg

SEQ ID NO: 522870 - DNA, 25 bp, Homo sapien
ttccaggtgctatggacctattcca

SEQ ID NO: 522871 - DNA, 25 bp, Homo sapien
ttaggatttgtatctattctataaa

SEQ ID NO: 522872 - DNA, 25 bp, Homo sapien
gacatttctccctacctctgaatga

SEQ ID NO: 522873 - DNA, 25 bp, Homo sapien
ttctaagagcatgtatccctatcag

SEQ ID NO: 522874 - DNA, 25 bp, Homo sapien
gagcatgtatccctatcagtaacag

SEQ ID NO: 522875 - DNA, 25 bp, Homo sapien
acagggatacatgaagatacttata

SEQ ID NO: 522876 - DNA, 25 bp, Homo sapien
aaaactgcccagcaaatcagggccc

SEQ ID NO: 522877 - DNA, 25 bp, Homo sapien
ttctcttacgaagatggagtcttgc

SEQ ID NO: 522878 - DNA, 25 bp, Homo sapien
aatcagggccctaaacagttggtag

SEQ ID NO: 522879 - DNA, 25 bp, Homo sapien
ggccctaaacagttggtagattcca

SEQ ID NO: 522880 - DNA, 25 bp, Homo sapien
ggtagattccataaattcaactggc

SEQ ID NO: 522881 - DNA, 25 bp, Homo sapien
aaattcaactggctaccatgtatag

SEQ ID NO: 522882 - DNA, 25 bp, Homo sapien
ctaccatgtatagccctcactgtaa

SEQ ID NO: 522883 - DNA, 25 bp, Homo sapien
agccctcactgtaaggtaggtggtt

SEQ ID NO: 522884 - DNA, 25 bp, Homo sapien
tgccaatgggtcatgtttggttaga

SEQ ID NO: 522885 - DNA, 25 bp, Homo sapien
catgtttggttagaaggtgacaatc

SEQ ID NO: 522886 - DNA, 25 bp, Homo sapien
gaaggtgacaatctacagaattcta

SEQ ID NO: 522887 - DNA, 25 bp, Homo sapien
ggtgacaatctacagaattctacag

SEQ ID NO: 522888 - DNA, 25 bp, Homo sapien
tacagaattctacagattccaggtg

SEQ ID NO: 522889 - DNA, 25 bp, Homo sapien
acagattccaggtgctatggaccta

SEQ ID NO: 522890 - DNA, 25 bp, Homo sapien
ttccaggtgctatggacctattcca

SEQ ID NO: 522891 - DNA, 25 bp, Homo sapien
ggtgctatggacctattccatatgg

SEQ ID NO: 522892 - DNA, 25 bp, Homo sapien
gacctattccatatggactaataag

SEQ ID NO: 522893 - DNA, 25 bp, Homo sapien
ccatatggactaataagaggacgaa

SEQ ID NO: 522894 - DNA, 25 bp, Homo sapien
taagaggacgaatcttctttaagat

SEQ ID NO: 522895 - DNA, 25 bp, Homo sapien
catttaccagcacactactgggcct

SEQ ID NO: 522896 - DNA, 25 bp, Homo sapien
tactgggcctggtcacttcttgatt

SEQ ID NO: 522897 - DNA, 25 bp, Homo sapien
ggcctggtcacttcttgattcaaac

SEQ ID NO: 522898 - DNA, 25 bp, Homo sapien
gattcaaacctgtttcctcgtcttt

SEQ ID NO: 522899 - DNA, 25 bp, Homo sapien
aataatgcttgccttacctgtccag

SEQ ID NO: 522900 - DNA, 25 bp, Homo sapien
ctgtccagtacttcacagggtggtt

SEQ ID NO: 522901 - DNA, 25 bp, Homo sapien
aactaacaggtgtgacagtgctgtg

SEQ ID NO: 522902 - DNA, 25 bp, Homo sapien
gacagtgctgtgaaacctgtacaca

SEQ ID NO: 522903 - DNA, 25 bp, Homo sapien
attacaagtgatggtaacccaggga

SEQ ID NO: 522904 - DNA, 25 bp, Homo sapien
aacccagggaaattagaagacgcat

SEQ ID NO: 522905 - DNA, 25 bp, Homo sapien
ttagaagacgcatcaagtggagaca

SEQ ID NO: 522906 - DNA, 25 bp, Homo sapien
ccggacttggtctggcggttaatgt

SEQ ID NO: 522907 - DNA, 25 bp, Homo sapien
gccgcacacatattgctgctgagga

SEQ ID NO: 522908 - DNA, 25 bp, Homo sapien
ggccgaactcgcaggccaggtccag

SEQ ID NO: 522909 - DNA, 25 bp, Homo sapien
agttgtccaccatgcacgggttaga

SEQ ID NO: 522910 - DNA, 25 bp, Homo sapien
ggttagactggtgctgtagcagcat

SEQ ID NO: 522911 - DNA, 25 bp, Homo sapien
tggcggttaatgtcgatgccggctt

SEQ ID NO: 522912 - DNA, 25 bp, Homo sapien
gcagcatctcagacacatcatagtg

SEQ ID NO: 522913 - DNA, 25 bp, Homo sapien
acacatcatagtgaccatgctgggc

SEQ ID NO: 522914 - DNA, 25 bp, Homo sapien
cctgatgatgtcgatgtggccgttt

SEQ ID NO: 522915 - DNA, 25 bp, Homo sapien
cgatgtggccgtttttagctgcgag

SEQ ID NO: 522916 - DNA, 25 bp, Homo sapien
gccgtttttagctgcgaggtgcaaa

SEQ ID NO: 522917 - DNA, 25 bp, Homo sapien
cccagcccaactaggaaagggccat

SEQ ID NO: 522918 - DNA, 25 bp, Homo sapien
ccaactaggaaagggccatgggcag

SEQ ID NO: 522919 - DNA, 25 bp, Homo sapien
gcagagggctggtagccagtatctt

SEQ ID NO: 522920 - DNA, 25 bp, Homo sapien
agggctggtagccagtatcttccac

SEQ ID NO: 522921 - DNA, 25 bp, Homo sapien
ggctggtagccagtatcttccactg

SEQ ID NO: 522922 - DNA, 25 bp, Homo sapien
tggtagccagtatcttccactgccc

SEQ ID NO: 522923 - DNA, 25 bp, Homo sapien
agtatcttccactgccccatctgtt

SEQ ID NO: 522924 - DNA, 25 bp, Homo sapien
gtgggcaggcacttgatggctacaa

SEQ ID NO: 522925 - DNA, 25 bp, Homo sapien
gggcaggcacttgatggctacaaat

SEQ ID NO: 522926 - DNA, 25 bp, Homo sapien
caggcacttgatggctacaaataaa

SEQ ID NO: 522927 - DNA, 25 bp, Homo sapien
tacaaataaatgtcccgtggcccca

SEQ ID NO: 522928 - DNA, 25 bp, Homo sapien
ctgtattcattatagatgtagccct

SEQ ID NO: 522929 - DNA, 25 bp, Homo sapien
gatttctaaacttttgcgaaagtgg

SEQ ID NO: 522930 - DNA, 25 bp, Homo sapien
tttttgtttgactataatagcagga

SEQ ID NO: 522931 - DNA, 25 bp, Homo sapien
ggaagaattatagcaatctgtcatt

SEQ ID NO: 522932 - DNA, 25 bp, Homo sapien
gaattatagcaatctgtcattttac

SEQ ID NO: 522933 - DNA, 25 bp, Homo sapien
tttacctgaaacagacaagcctatg

SEQ ID NO: 522934 - DNA, 25 bp, Homo sapien
acagacaagcctatgtattatgaat

SEQ ID NO: 522935 - DNA, 25 bp, Homo sapien
aagcttccctttggaatatacaaga

SEQ ID NO: 522936 - DNA, 25 bp, Homo sapien
tccctttggaatatacaagacatgc

SEQ ID NO: 522937 - DNA, 25 bp, Homo sapien
caagacatgcgtttggagttacctt

SEQ ID NO: 522938 - DNA, 25 bp, Homo sapien
catgcgtttggagttacctttgttt

SEQ ID NO: 522939 - DNA, 25 bp, Homo sapien
cttctgaggacccaggcaccaaggt

SEQ ID NO: 522940 - DNA, 25 bp, Homo sapien
tgctggtctcctggacctaccagga

SEQ ID NO: 522941 - DNA, 25 bp, Homo sapien
ctggacctaccaggacgaggagctg

SEQ ID NO: 522942 - DNA, 25 bp, Homo sapien
ggagcttcctcacatctctgctgaa

SEQ ID NO: 522943 - DNA, 25 bp, Homo sapien
catctctgctgaagaagggcctccc

SEQ ID NO: 522944 - DNA, 25 bp, Homo sapien
gggacagaggccttgtgtcacctgc

SEQ ID NO: 522945 - DNA, 25 bp, Homo sapien
tgcccaggcagctgtttgcagctga

SEQ ID NO: 522946 - DNA, 25 bp, Homo sapien
tgaagaaacaaactggtctccaggc

SEQ ID NO: 522947 - DNA, 25 bp, Homo sapien
aacaaactggtctccaggctgtctt

SEQ ID NO: 522948 - DNA, 25 bp, Homo sapien
aggctgtcttgcctttattcctggt

SEQ ID NO: 522949 - DNA, 25 bp, Homo sapien
ttattcctggttagggcaggtggtc

SEQ ID NO: 522950 - DNA, 25 bp, Homo sapien
gataggccaaagtatgacatttacg

SEQ ID NO: 522951 - DNA, 25 bp, Homo sapien
gacatttacgtcttgcgtgactcag

SEQ ID NO: 522952 - DNA, 25 bp, Homo sapien
atccatgattcatacaccttatggg

SEQ ID NO: 522953 - DNA, 25 bp, Homo sapien
acgtcttgcgtgactcagagaaaat

SEQ ID NO: 522954 - DNA, 25 bp, Homo sapien
gatagaatgtttcaatttgcctgat

SEQ ID NO: 522955 - DNA, 25 bp, Homo sapien
atttgcctgatgctacactttactc

SEQ ID NO: 522956 - DNA, 25 bp, Homo sapien
tacactttactcagccttcgtttgt

SEQ ID NO: 522957 - DNA, 25 bp, Homo sapien
acaccttatgggattttgaggatac

SEQ ID NO: 522958 - DNA, 25 bp, Homo sapien
gatactttgcttatttcggtgttat

SEQ ID NO: 522959 - DNA, 25 bp, Homo sapien
gcttatttcggtgttatgtcatata

SEQ ID NO: 522960 - DNA, 25 bp, Homo sapien
acatggctgtgctttggtcaatgat

SEQ ID NO: 522961 - DNA, 25 bp, Homo sapien
taggcccccaaaatttaatagatat

SEQ ID NO: 522962 - DNA, 25 bp, Homo sapien
acattttattactgtatggcacaag

SEQ ID NO: 522963 - DNA, 25 bp, Homo sapien
aagtgacattgggtatgttagaaat

SEQ ID NO: 522964 - DNA, 25 bp, Homo sapien
aatgcattaccatttgtttaataat

SEQ ID NO: 522965 - DNA, 25 bp, Homo sapien
aattatctttacagaatgctagttt

SEQ ID NO: 522966 - DNA, 25 bp, Homo sapien
tttacagaatgctagtttaatgact

SEQ ID NO: 522967 - DNA, 25 bp, Homo sapien
cagaaatgtttgtattggtcacaga

SEQ ID NO: 522968 - DNA, 25 bp, Homo sapien
tgtattggtcacagatctatcataa

SEQ ID NO: 522969 - DNA, 25 bp, Homo sapien
ggtcacagatctatcataattgctt

SEQ ID NO: 522970 - DNA, 25 bp, Homo sapien
gatctatcataattgcttttctgat

SEQ ID NO: 522971 - DNA, 25 bp, Homo sapien
gtatattaccgatgcaaactgtgga

SEQ ID NO: 522972 - DNA, 25 bp, Homo sapien
gatggtgagctctgattgcttcagt

SEQ ID NO: 522973 - DNA, 25 bp, Homo sapien
ctgattgcttcagttggtcatcaac

SEQ ID NO: 522974 - DNA, 25 bp, Homo sapien
gggatggcctgctatcttgatgata

SEQ ID NO: 522975 - DNA, 25 bp, Homo sapien
ttgtgaatatcaggaggcagggatc

SEQ ID NO: 522976 - DNA, 25 bp, Homo sapien
gaggcagggatcactgtggaccatc

SEQ ID NO: 522977 - DNA, 25 bp, Homo sapien
tgtggaccatcttagcagttgacct

SEQ ID NO: 522978 - DNA, 25 bp, Homo sapien
tagcagttgacctaacacatcttct

SEQ ID NO: 522979 - DNA, 25 bp, Homo sapien
aacacatcttcttttcaatatctaa

SEQ ID NO: 522980 - DNA, 25 bp, Homo sapien
atctaagaacttttgccactgtgac

SEQ ID NO: 522981 - DNA, 25 bp, Homo sapien
ttgccactgtgactaatggtcctaa

SEQ ID NO: 522982 - DNA, 25 bp, Homo sapien
atggtcctaatattaagctgttgtt

SEQ ID NO: 522983 - DNA, 25 bp, Homo sapien
ttggcaagtataaaagcacattcag

SEQ ID NO: 522984 - DNA, 25 bp, Homo sapien
gcacattcagaatgtcactttcata

SEQ ID NO: 522985 - DNA, 25 bp, Homo sapien
acattcagaatgtcactttcataga

SEQ ID NO: 522986 - DNA, 25 bp, Homo sapien
gaatgtcactttcatagatactatg

SEQ ID NO: 522987 - DNA, 25 bp, Homo sapien
gaatatcaattgtcaagtgtgttga

SEQ ID NO: 522988 - DNA, 25 bp, Homo sapien
gagaattaatattacccaacttgtc

SEQ ID NO: 522989 - DNA, 25 bp, Homo sapien
gaattaatattacccaacttgtcca

SEQ ID NO: 522990 - DNA, 25 bp, Homo sapien
ttaatattacccaacttgtccaata

SEQ ID NO: 522991 - DNA, 25 bp, Homo sapien
attacccaacttgtccaataaaatg

SEQ ID NO: 522992 - DNA, 25 bp, Homo sapien
attttgaattgcatacctagctaaa

SEQ ID NO: 522993 - DNA, 25 bp, Homo sapien
gaattgcatacctagctaaattttt

SEQ ID NO: 522994 - DNA, 25 bp, Homo sapien
gtactgcatgtgtattcattactaa

SEQ ID NO: 522995 - DNA, 25 bp, Homo sapien
attcattactaagcactattgtaga

SEQ ID NO: 522996 - DNA, 25 bp, Homo sapien
ctaagcactattgtagatgttgaaa

SEQ ID NO: 522997 - DNA, 25 bp, Homo sapien
cagtttcccattactggattggatt

SEQ ID NO: 522998 - DNA, 25 bp, Homo sapien
cccattactggattggatttctatt

SEQ ID NO: 522999 - DNA, 25 bp, Homo sapien
gatttctattttaacacttatttct

SEQ ID NO: 523000 - DNA, 25 bp, Homo sapien
acttgtggggtgatgccaacattaa

SEQ ID NO: 523001 - DNA, 25 bp, Homo sapien
cattaaatgttttgaggaagctcct

SEQ ID NO: 523002 - DNA, 25 bp, Homo sapien
gaggaagctcctttgagatggcttt

SEQ ID NO: 523003 - DNA, 25 bp, Homo sapien
gaagctcctttgagatggctttgaa

SEQ ID NO: 523004 - DNA, 25 bp, Homo sapien
ggctttgaaaagtcctaagtgagaa

SEQ ID NO: 523005 - DNA, 25 bp, Homo sapien
ttgcgctccgccacattgcgcgacg

SEQ ID NO: 523006 - DNA, 25 bp, Homo sapien
cacactgcatctgctgccctgcgag

SEQ ID NO: 523007 - DNA, 25 bp, Homo sapien
tgctgccctgcgaggttgcggtgga

SEQ ID NO: 523008 - DNA, 25 bp, Homo sapien
tgcgaggttgcggtggacgggcccg

SEQ ID NO: 523009 - DNA, 25 bp, Homo sapien
ccgagggactcgaagtgtcgtttcg

SEQ ID NO: 523010 - DNA, 25 bp, Homo sapien
ctcgaagtgtcgtttcggggccgct

SEQ ID NO: 523011 - DNA, 25 bp, Homo sapien
ggcggtgccgcctggcctcgtggga

SEQ ID NO: 523012 - DNA, 25 bp, Homo sapien
gaccccttgcgggattccgggactg

SEQ ID NO: 523013 - DNA, 25 bp, Homo sapien
cccttgcgggattccgggactgacg

SEQ ID NO: 523014 - DNA, 25 bp, Homo sapien
catcgagaggcaccgcgtccacttg

SEQ ID NO: 523015 - DNA, 25 bp, Homo sapien
gagaggcaccgcgtccacttgcgct

SEQ ID NO: 523016 - DNA, 25 bp, Homo sapien
ggacacaggatgaaagccatggccc

SEQ ID NO: 523017 - DNA, 25 bp, Homo sapien
aagtgagtactctcactgtgtaccc

SEQ ID NO: 523018 - DNA, 25 bp, Homo sapien
cactgtgtaccccagcataggaata

SEQ ID NO: 523019 - DNA, 25 bp, Homo sapien
gtaccccagcataggaatagtgaaa

SEQ ID NO: 523020 - DNA, 25 bp, Homo sapien
gtgaaacctgctacaactggaggct

SEQ ID NO: 523021 - DNA, 25 bp, Homo sapien
acaactggaggctgcgttcccatga

SEQ ID NO: 523022 - DNA, 25 bp, Homo sapien
ggaggctgcgttcccatgacttcct

SEQ ID NO: 523023 - DNA, 25 bp, Homo sapien
ccttgtctgggacttgctggttcca

SEQ ID NO: 523024 - DNA, 25 bp, Homo sapien
ccccgagacggtgaggacaggcttc

SEQ ID NO: 523025 - DNA, 25 bp, Homo sapien
gacggtgaggacaggcttccgaccc

SEQ ID NO: 523026 - DNA, 25 bp, Homo sapien
ccctgtaagccagatccagtgggat

SEQ ID NO: 523027 - DNA, 25 bp, Homo sapien
tggagaaccccaccccaaggcatgc

SEQ ID NO: 523028 - DNA, 25 bp, Homo sapien
tcgcgccgtgggaaagcacactggg

SEQ ID NO: 523029 - DNA, 25 bp, Homo sapien
gtcagggacctgagagtaagcacat

SEQ ID NO: 523030 - DNA, 25 bp, Homo sapien
gggacctgagagtaagcacatgaca

SEQ ID NO: 523031 - DNA, 25 bp, Homo sapien
gagagtaagcacatgacagcgtctg

SEQ ID NO: 523032 - DNA, 25 bp, Homo sapien
taagcacatgacagcgtctgcttgc

SEQ ID NO: 523033 - DNA, 25 bp, Homo sapien
acatgacagcgtctgcttgcgttgt

SEQ ID NO: 523034 - DNA, 25 bp, Homo sapien
atgacagcgtctgcttgcgttgtgt

SEQ ID NO: 523035 - DNA, 25 bp, Homo sapien
acagcgtctgcttgcgttgtgtctg

SEQ ID NO: 523036 - DNA, 25 bp, Homo sapien
gtctgcttgcgttgtgtctgtttta

SEQ ID NO: 523037 - DNA, 25 bp, Homo sapien
ctgcttgcgttgtgtctgttttatg

SEQ ID NO: 523038 - DNA, 25 bp, Homo sapien
agctcacttcaagaaatctccatgt

SEQ ID NO: 523039 - DNA, 25 bp, Homo sapien
tcacttcaagaaatctccatgtatg

SEQ ID NO: 523040 - DNA, 25 bp, Homo sapien
aatctccatgtatgcacaagtaact

SEQ ID NO: 523041 - DNA, 25 bp, Homo sapien
atgtatgcacaagtaactcatcaga

SEQ ID NO: 523042 - DNA, 25 bp, Homo sapien
gcacaagtaactcatcagaaggctg

SEQ ID NO: 523043 - DNA, 25 bp, Homo sapien
ggagatctatagatatattcactat

SEQ ID NO: 523044 - DNA, 25 bp, Homo sapien
gacatacaaatgttaccaaatgatc

SEQ ID NO: 523045 - DNA, 25 bp, Homo sapien
gttaccaaatgatcttaaccaagat

SEQ ID NO: 523046 - DNA, 25 bp, Homo sapien
taaccaagatagactgaaatctgat

SEQ ID NO: 523047 - DNA, 25 bp, Homo sapien
atataatcaagctgctcaagatggg

SEQ ID NO: 523048 - DNA, 25 bp, Homo sapien
agatggggttttcaaagacctctca

SEQ ID NO: 523049 - DNA, 25 bp, Homo sapien
gcattatcttttttagggttagtag

SEQ ID NO: 523050 - DNA, 25 bp, Homo sapien
ttgtcaaaatgtacagccacagcct

SEQ ID NO: 523051 - DNA, 25 bp, Homo sapien
cagccttttaatttgggagcccctg

SEQ ID NO: 523052 - DNA, 25 bp, Homo sapien
ttgggagcccctgttgtcattcaaa

SEQ ID NO: 523053 - DNA, 25 bp, Homo sapien
caaatgtgtacctctacagttgtaa

SEQ ID NO: 523054 - DNA, 25 bp, Homo sapien
tctactatctgtgggttgtgcttgc

SEQ ID NO: 523055 - DNA, 25 bp, Homo sapien
gttgtgcttgccagacaggtcttaa

SEQ ID NO: 523056 - DNA, 25 bp, Homo sapien
gccagacaggtcttaaattgtatat

SEQ ID NO: 523057 - DNA, 25 bp, Homo sapien
atactctcttaggaatcattgtgaa

SEQ ID NO: 523058 - DNA, 25 bp, Homo sapien
gatcaagaaatcaggatggccattt

SEQ ID NO: 523059 - DNA, 25 bp, Homo sapien
attcatttcatgttagtgggactat

SEQ ID NO: 523060 - DNA, 25 bp, Homo sapien
aggaaaaagatcctttgctactgtt

SEQ ID NO: 523061 - DNA, 25 bp, Homo sapien
gaaaaagatcctttgctactgttaa

SEQ ID NO: 523062 - DNA, 25 bp, Homo sapien
aaaaccccatcctgatgtggcccac

SEQ ID NO: 523063 - DNA, 25 bp, Homo sapien
tctagttttatctgagcaagaggaa

SEQ ID NO: 523064 - DNA, 25 bp, Homo sapien
taaagacttaaaattctggaccatc

SEQ ID NO: 523065 - DNA, 25 bp, Homo sapien
agacttaaaattctggaccatcaag

SEQ ID NO: 523066 - DNA, 25 bp, Homo sapien
cttaaaattctggaccatcaagtgt

SEQ ID NO: 523067 - DNA, 25 bp, Homo sapien
aaaattctggaccatcaagtgtaaa

SEQ ID NO: 523068 - DNA, 25 bp, Homo sapien
attctggaccatcaagtgtaaattt

SEQ ID NO: 523069 - DNA, 25 bp, Homo sapien
ctggaccatcaagtgtaaatttaat

SEQ ID NO: 523070 - DNA, 25 bp, Homo sapien
ggaccatcaagtgtaaatttaatat

SEQ ID NO: 523071 - DNA, 25 bp, Homo sapien
ccgctgtggcttggtgtcagggaga

SEQ ID NO: 523072 - DNA, 25 bp, Homo sapien
tgtagagtggctgtgtcgggcatca

SEQ ID NO: 523073 - DNA, 25 bp, Homo sapien
tgtcgggcatcagatggagcacaca

SEQ ID NO: 523074 - DNA, 25 bp, Homo sapien
gcacacaggtggcttgcagcccagc

SEQ ID NO: 523075 - DNA, 25 bp, Homo sapien
acaggtggcttgcagcccagcccag

SEQ ID NO: 523076 - DNA, 25 bp, Homo sapien
agccttcccagcgttctcgatggtg

SEQ ID NO: 523077 - DNA, 25 bp, Homo sapien
cagcgttctcgatggtgccctggcc

SEQ ID NO: 523078 - DNA, 25 bp, Homo sapien
cacacggcccttcggagcctgggca

SEQ ID NO: 523079 - DNA, 25 bp, Homo sapien
tcctgccggtagtttagggccgaga

SEQ ID NO: 523080 - DNA, 25 bp, Homo sapien
ttagggccgagacggctagcttcac

SEQ ID NO: 523081 - DNA, 25 bp, Homo sapien
ggccgagacggctagcttcacgcca

SEQ ID NO: 523082 - DNA, 25 bp, Homo sapien
aaacacacacgggtagattgctggc

SEQ ID NO: 523083 - DNA, 25 bp, Homo sapien
acacgggtagattgctggcctgttg

SEQ ID NO: 523084 - DNA, 25 bp, Homo sapien
gtagggacacagatgaccgacctgg

SEQ ID NO: 523085 - DNA, 25 bp, Homo sapien
attcagtctggtatgtgaggcgtgc

SEQ ID NO: 523086 - DNA, 25 bp, Homo sapien
aggcgtgcgtgaagcaagaactcct

SEQ ID NO: 523087 - DNA, 25 bp, Homo sapien
caagaactcctggagctacagggac

SEQ ID NO: 523088 - DNA, 25 bp, Homo sapien
ggacagggagccatcattcctgcct

SEQ ID NO: 523089 - DNA, 25 bp, Homo sapien
acttcctgcaggagtcagcgttcaa

SEQ ID NO: 523090 - DNA, 25 bp, Homo sapien
gtcagcgttcaatcttgaccttgaa

SEQ ID NO: 523091 - DNA, 25 bp, Homo sapien
gatgttctttttacgtaccaattct

SEQ ID NO: 523092 - DNA, 25 bp, Homo sapien
cgtaccaattcttttgtcttttgat

SEQ ID NO: 523093 - DNA, 25 bp, Homo sapien
caagcgggcccgagcaatgcccgag

SEQ ID NO: 523094 - DNA, 25 bp, Homo sapien
aggagccagtgagaggtcctgccaa

SEQ ID NO: 523095 - DNA, 25 bp, Homo sapien
gtgagaggtcctgccaagaagcaaa

SEQ ID NO: 523096 - DNA, 25 bp, Homo sapien
gaggtcctgccaagaagcaaaagca

SEQ ID NO: 523097 - DNA, 25 bp, Homo sapien
gatgaagaactcaccaacacaagca

SEQ ID NO: 523098 - DNA, 25 bp, Homo sapien
gaactcaccaacacaagcaagaagg

SEQ ID NO: 523099 - DNA, 25 bp, Homo sapien
tgggcttgccccaccagagacgagg

SEQ ID NO: 523100 - DNA, 25 bp, Homo sapien
ttgccccaccagagacgaggaggaa

SEQ ID NO: 523101 - DNA, 25 bp, Homo sapien
gaagtagctgtcgtggcctgaagaa

SEQ ID NO: 523102 - DNA, 25 bp, Homo sapien
gctgtcgtggcctgaagaaattcat

SEQ ID NO: 523103 - DNA, 25 bp, Homo sapien
aaatcccttccctgtgggaagtcat

SEQ ID NO: 523104 - DNA, 25 bp, Homo sapien
atcactgtgtccatagaaaaactgt

SEQ ID NO: 523105 - DNA, 25 bp, Homo sapien
aaaactgtgctggtatttgctggac

SEQ ID NO: 523106 - DNA, 25 bp, Homo sapien
actgtgctggtatttgctggacaaa

SEQ ID NO: 523107 - DNA, 25 bp, Homo sapien
ttgctggacaaagggttgggcccct

SEQ ID NO: 523108 - DNA, 25 bp, Homo sapien
ctgggtgacacagccggtaaacgga

SEQ ID NO: 523109 - DNA, 25 bp, Homo sapien
gacacagccggtaaacggaatcacg

SEQ ID NO: 523110 - DNA, 25 bp, Homo sapien
aacggaatcacgtatggttctttct

SEQ ID NO: 523111 - DNA, 25 bp, Homo sapien
tcacgtatggttctttctgtgggtc

SEQ ID NO: 523112 - DNA, 25 bp, Homo sapien
accttgtggaagaccacacatgggt

SEQ ID NO: 523113 - DNA, 25 bp, Homo sapien
acacatgggtggtcccacagcatgg

SEQ ID NO: 523114 - DNA, 25 bp, Homo sapien
tgctgtcactgtctcattaaatata

SEQ ID NO: 523115 - DNA, 25 bp, Homo sapien
tgccattcgccgcacaggccctatt

SEQ ID NO: 523116 - DNA, 25 bp, Homo sapien
acaggccctattctctcagccctcg

SEQ ID NO: 523117 - DNA, 25 bp, Homo sapien
ctgcgccggagcttaggactcggaa

SEQ ID NO: 523118 - DNA, 25 bp, Homo sapien
ggagcttaggactcggaagcggccg

SEQ ID NO: 523119 - DNA, 25 bp, Homo sapien
gcttaggactcggaagcggccgggc

SEQ ID NO: 523120 - DNA, 25 bp, Homo sapien
cctgaggcgagggtagcgggtgcat

SEQ ID NO: 523121 - DNA, 25 bp, Homo sapien
gaggcgagggtagcgggtgcatggc

SEQ ID NO: 523122 - DNA, 25 bp, Homo sapien
ggtgcatggcgcagtaacggcccct

SEQ ID NO: 523123 - DNA, 25 bp, Homo sapien
gtgcatggcgcagtaacggccccta

SEQ ID NO: 523124 - DNA, 25 bp, Homo sapien
tgcatggcgcagtaacggcccctat

SEQ ID NO: 523125 - DNA, 25 bp, Homo sapien
gcatggcgcagtaacggcccctatc

SEQ ID NO: 523126 - DNA, 25 bp, Homo sapien
ttagcctcctacaggcgcgtgcctg

SEQ ID NO: 523127 - DNA, 25 bp, Homo sapien
gcgcgtgcctgacgatgcctggcta

SEQ ID NO: 523128 - DNA, 25 bp, Homo sapien
tgcgaccggcccatgagtctttatt

SEQ ID NO: 523129 - DNA, 25 bp, Homo sapien
accggcccatgagtctttattaata

SEQ ID NO: 523130 - DNA, 25 bp, Homo sapien
ggcccatgagtctttattaatagag

SEQ ID NO: 523131 - DNA, 25 bp, Homo sapien
gatttcttactggtgttatgtggca

SEQ ID NO: 523132 - DNA, 25 bp, Homo sapien
actggtgttatgtggcagattctgc

SEQ ID NO: 523133 - DNA, 25 bp, Homo sapien
tggcagattctgcatattcctcacc

SEQ ID NO: 523134 - DNA, 25 bp, Homo sapien
ttcctcacccatcatatgtattcca

SEQ ID NO: 523135 - DNA, 25 bp, Homo sapien
ccatcatatgtattccactttcctt

SEQ ID NO: 523136 - DNA, 25 bp, Homo sapien
gtattccactttcctttattatggg

SEQ ID NO: 523137 - DNA, 25 bp, Homo sapien
gcaagcactgtttcctgtttctaaa

SEQ ID NO: 523138 - DNA, 25 bp, Homo sapien
gaaaatcatccatacatcttacagt

SEQ ID NO: 523139 - DNA, 25 bp, Homo sapien
accacaaagggctctgttcactgtt

SEQ ID NO: 523140 - DNA, 25 bp, Homo sapien
cttacagttgtcagttttaaccaga

SEQ ID NO: 523141 - DNA, 25 bp, Homo sapien
aacagtggcactttgttgctgcttt

SEQ ID NO: 523142 - DNA, 25 bp, Homo sapien
gttgctgcttttttatctttagctt

SEQ ID NO: 523143 - DNA, 25 bp, Homo sapien
tagcttaggttaacaggaccctgga

SEQ ID NO: 523144 - DNA, 25 bp, Homo sapien
gctctgttcactgttttgttctcaa

SEQ ID NO: 523145 - DNA, 25 bp, Homo sapien
ttctcaaagatcatccttgcgctca

SEQ ID NO: 523146 - DNA, 25 bp, Homo sapien
catcctctgatcttgaatttctaca

SEQ ID NO: 523147 - DNA, 25 bp, Homo sapien
tctcagtttatatgccctgtggcaa

SEQ ID NO: 523148 - DNA, 25 bp, Homo sapien
agcatcacgcttcccctagtgaaat

SEQ ID NO: 523149 - DNA, 25 bp, Homo sapien
gcttcccctagtgaaatccatctgt

SEQ ID NO: 523150 - DNA, 25 bp, Homo sapien
ccctagtgaaatccatctgtcctga

SEQ ID NO: 523151 - DNA, 25 bp, Homo sapien
gtgaaatccatctgtcctgaaggga

SEQ ID NO: 523152 - DNA, 25 bp, Homo sapien
atccatctgtcctgaagggaaccct

SEQ ID NO: 523153 - DNA, 25 bp, Homo sapien
cacggggtcaggtcttcaccaaagg

SEQ ID NO: 523154 - DNA, 25 bp, Homo sapien
ttcaccaaagggaggccgcacggat

SEQ ID NO: 523155 - DNA, 25 bp, Homo sapien
aagggaggccgcacggattcccagt

SEQ ID NO: 523156 - DNA, 25 bp, Homo sapien
aggccgcacggattcccagtcgcaa

SEQ ID NO: 523157 - DNA, 25 bp, Homo sapien
cggattcccagtcgcaaacccaaag

SEQ ID NO: 523158 - DNA, 25 bp, Homo sapien
agtcgcaaacccaaagccttgctgc

SEQ ID NO: 523159 - DNA, 25 bp, Homo sapien
aaaacagttcctggtggcctttctg

SEQ ID NO: 523160 - DNA, 25 bp, Homo sapien
aaacagttcctggtggcctttctga

SEQ ID NO: 523161 - DNA, 25 bp, Homo sapien
aacagttcctggtggcctttctgaa

SEQ ID NO: 523162 - DNA, 25 bp, Homo sapien
acagttcctggtggcctttctgaaa

SEQ ID NO: 523163 - DNA, 25 bp, Homo sapien
gttcctggtggcctttctgaaaggc

SEQ ID NO: 523164 - DNA, 25 bp, Homo sapien
ttcctggtggcctttctgaaaggct

SEQ ID NO: 523165 - DNA, 25 bp, Homo sapien
tcctggtggcctttctgaaaggctg

SEQ ID NO: 523166 - DNA, 25 bp, Homo sapien
ggcctttctgaaaggctgggtccca

SEQ ID NO: 523167 - DNA, 25 bp, Homo sapien
gcctttctgaaaggctgggtcccag

SEQ ID NO: 523168 - DNA, 25 bp, Homo sapien
ctttctgaaaggctgggtcccaggt

SEQ ID NO: 523169 - DNA, 25 bp, Homo sapien
tttctgaaaggctgggtcccaggtt

SEQ ID NO: 523170 - DNA, 25 bp, Homo sapien
gaccacacttttgaatacctactgg

SEQ ID NO: 523171 - DNA, 25 bp, Homo sapien
ctactggtgtttggcagaaatctga

SEQ ID NO: 523172 - DNA, 25 bp, Homo sapien
agaaatctgagactggcaccagaca

SEQ ID NO: 523173 - DNA, 25 bp, Homo sapien
gactggcaccagacacaaattttag

SEQ ID NO: 523174 - DNA, 25 bp, Homo sapien
ggcaccagacacaaattttagacat

SEQ ID NO: 523175 - DNA, 25 bp, Homo sapien
ttagacatgggtatcttccctccag

SEQ ID NO: 523176 - DNA, 25 bp, Homo sapien
gtatcttccctccagtaattcactg

SEQ ID NO: 523177 - DNA, 25 bp, Homo sapien
gtaattcactgctcagagtaattta

SEQ ID NO: 523178 - DNA, 25 bp, Homo sapien
gaatatgtttgttaacatactctgc

SEQ ID NO: 523179 - DNA, 25 bp, Homo sapien
ttgaagtttgaaggcttgctggttc

SEQ ID NO: 523180 - DNA, 25 bp, Homo sapien
gttcttattttgcatgcaagtttag

SEQ ID NO: 523181 - DNA, 25 bp, Homo sapien
gaccttaatcctgtttagaagccct

SEQ ID NO: 523182 - DNA, 25 bp, Homo sapien
tagaagccctaacttaactctgaag

SEQ ID NO: 523183 - DNA, 25 bp, Homo sapien
gggatactgtctcttttaactcttg

SEQ ID NO: 523184 - DNA, 25 bp, Homo sapien
ctgtctcttttaactcttgctataa

SEQ ID NO: 523185 - DNA, 25 bp, Homo sapien
ctcttgctataatcatttgtatgga

SEQ ID NO: 523186 - DNA, 25 bp, Homo sapien
gataatactgataacattgcctgat

SEQ ID NO: 523187 - DNA, 25 bp, Homo sapien
taacattgcctgatttctctgcgta

SEQ ID NO: 523188 - DNA, 25 bp, Homo sapien
gcctgatttctctgcgtattattac

SEQ ID NO: 523189 - DNA, 25 bp, Homo sapien
ttaaccctttgaggccttgctgcaa

SEQ ID NO: 523190 - DNA, 25 bp, Homo sapien
ggccttgctgcaaataatttcaact

SEQ ID NO: 523191 - DNA, 25 bp, Homo sapien
gcaaataatttcaactaggctgttt

SEQ ID NO: 523192 - DNA, 25 bp, Homo sapien
gaatgagaatccctgaatccttgag

SEQ ID NO: 523193 - DNA, 25 bp, Homo sapien
agaatccctgaatccttgagtgtgg

SEQ ID NO: 523194 - DNA, 25 bp, Homo sapien
atatgtatctaacaagctccttgga

SEQ ID NO: 523195 - DNA, 25 bp, Homo sapien
acaagctccttggattagtcaagtt

SEQ ID NO: 523196 - DNA, 25 bp, Homo sapien
gggctcaggaatatatgtatctagc

SEQ ID NO: 523197 - DNA, 25 bp, Homo sapien
atgtatctagcaagctcctcagact

SEQ ID NO: 523198 - DNA, 25 bp, Homo sapien
aagctcctcagactagtcaactttc

SEQ ID NO: 523199 - DNA, 25 bp, Homo sapien
gtcaactttcttaatagtctgcata

SEQ ID NO: 523200 - DNA, 25 bp, Homo sapien
gtctgcatatttgtatattgcccag

SEQ ID NO: 523201 - DNA, 25 bp, Homo sapien
tgcccagaaagggacactttttgga

SEQ ID NO: 523202 - DNA, 25 bp, Homo sapien
ggacactttttggaatatactttct

SEQ ID NO: 523203 - DNA, 25 bp, Homo sapien
caatgctaatctggtggctgctttt

SEQ ID NO: 523204 - DNA, 25 bp, Homo sapien
tggctgcttttgagcagagcctggt

SEQ ID NO: 523205 - DNA, 25 bp, Homo sapien
gagcctggtgaatatgacatcccgc

SEQ ID NO: 523206 - DNA, 25 bp, Homo sapien
tgaatatgacatcccgcctgcgaca

SEQ ID NO: 523207 - DNA, 25 bp, Homo sapien
gcctgcgacacctggcagagacggc

SEQ ID NO: 523208 - DNA, 25 bp, Homo sapien
ccgaggagaaggacactgagctgct

SEQ ID NO: 523209 - DNA, 25 bp, Homo sapien
tgagctgctggatttgcgagaaacc

SEQ ID NO: 523210 - DNA, 25 bp, Homo sapien
ggatttgcgagaaaccatagacttt

SEQ ID NO: 523211 - DNA, 25 bp, Homo sapien
tgaggcccaggcagtcattcaggga

SEQ ID NO: 523212 - DNA, 25 bp, Homo sapien
ttcagggagcccttaatgcctcaga

SEQ ID NO: 523213 - DNA, 25 bp, Homo sapien
ttaatgcctcagaaaccacacccaa

SEQ ID NO: 523214 - DNA, 25 bp, Homo sapien
gacttacttacaaagttgctggcag

SEQ ID NO: 523215 - DNA, 25 bp, Homo sapien
gttgctggcagatgtatttgatggt

SEQ ID NO: 523216 - DNA, 25 bp, Homo sapien
gtatttgatggttactcttttgtaa

SEQ ID NO: 523217 - DNA, 25 bp, Homo sapien
tttgtaattcttgtccacttgtaaa

SEQ ID NO: 523218 - DNA, 25 bp, Homo sapien
tatacatacttttcagactgccttt

SEQ ID NO: 523219 - DNA, 25 bp, Homo sapien
atacttttcagactgcctttctttt

SEQ ID NO: 523220 - DNA, 25 bp, Homo sapien
gaatgacaaagctttccccattgtg

SEQ ID NO: 523221 - DNA, 25 bp, Homo sapien
agctttccccattgtgtcttcaaaa

SEQ ID NO: 523222 - DNA, 25 bp, Homo sapien
ttgtgtcttcaaaaacgctattata

SEQ ID NO: 523223 - DNA, 25 bp, Homo sapien
atccatgtgtggttaagctctgtgt

SEQ ID NO: 523224 - DNA, 25 bp, Homo sapien
gtgcatgtgcacagttagtgtaaaa

SEQ ID NO: 523225 - DNA, 25 bp, Homo sapien
agaggacgccatctcccttactgtt

SEQ ID NO: 523226 - DNA, 25 bp, Homo sapien
gccatctcccttactgttgctggga

SEQ ID NO: 523227 - DNA, 25 bp, Homo sapien
ccttactgttgctgggagcctcgcc

SEQ ID NO: 523228 - DNA, 25 bp, Homo sapien
cgccctttgtcccaactgggtagag

SEQ ID NO: 523229 - DNA, 25 bp, Homo sapien
ccaggtgctgtttgctcaggaggct

SEQ ID NO: 523230 - DNA, 25 bp, Homo sapien
gccctcttggctcagattcaatcaa

SEQ ID NO: 523231 - DNA, 25 bp, Homo sapien
ttcaatcaaatgttgcttccctctc

SEQ ID NO: 523232 - DNA, 25 bp, Homo sapien
atcaaatgttgcttccctctcctgt

SEQ ID NO: 523233 - DNA, 25 bp, Homo sapien
actggagccgcccaagcttgtaggt

SEQ ID NO: 523234 - DNA, 25 bp, Homo sapien
tccacatctgctcgttcttgccgag

SEQ ID NO: 523235 - DNA, 25 bp, Homo sapien
ttcttgccgagggtgcagtggtggc

SEQ ID NO: 523236 - DNA, 25 bp, Homo sapien
tctgctttggcagaagggacaaaaa

SEQ ID NO: 523237 - DNA, 25 bp, Homo sapien
cataccgggacagcaagatgactcg

SEQ ID NO: 523238 - DNA, 25 bp, Homo sapien
tgggaactgcagaaccaccatcgtc

SEQ ID NO: 523239 - DNA, 25 bp, Homo sapien
gcagaaccaccatcgtcatttgctg

SEQ ID NO: 523240 - DNA, 25 bp, Homo sapien
tcatttgctgttctccttctgtctt

SEQ ID NO: 523241 - DNA, 25 bp, Homo sapien
tccttctgtcttcaatgaggctgag

SEQ ID NO: 523242 - DNA, 25 bp, Homo sapien
gaggctgagaccaagtccacactga

SEQ ID NO: 523243 - DNA, 25 bp, Homo sapien
aagtccacactgatgttcggacaga

SEQ ID NO: 523244 - DNA, 25 bp, Homo sapien
gttcggacagagagctaagaccatc

SEQ ID NO: 523245 - DNA, 25 bp, Homo sapien
gagctaagaccatcaagaatacagt

SEQ ID NO: 523246 - DNA, 25 bp, Homo sapien
agtctctgtgaacctagaactgaca

SEQ ID NO: 523247 - DNA, 25 bp, Homo sapien
acgcgtgggtggacacaggaccagc

SEQ ID NO: 523248 - DNA, 25 bp, Homo sapien
cgcgtgggtggacacaggaccagct

SEQ ID NO: 523249 - DNA, 25 bp, Homo sapien
gcgtgggtggacacaggaccagctg

SEQ ID NO: 523250 - DNA, 25 bp, Homo sapien
cagctggacgtggcgttgaggacta

SEQ ID NO: 523251 - DNA, 25 bp, Homo sapien
agctggacgtggcgttgaggactat

SEQ ID NO: 523252 - DNA, 25 bp, Homo sapien
gctggacgtggcgttgaggactatg

SEQ ID NO: 523253 - DNA, 25 bp, Homo sapien
ctggacgtggcgttgaggactatga

SEQ ID NO: 523254 - DNA, 25 bp, Homo sapien
tggacgtggcgttgaggactatgag

SEQ ID NO: 523255 - DNA, 25 bp, Homo sapien
ggacgtggcgttgaggactatgaga

SEQ ID NO: 523256 - DNA, 25 bp, Homo sapien
gtactaatgggtactctgaactcat

SEQ ID NO: 523257 - DNA, 25 bp, Homo sapien
gaactcattaacattgacatctgca

SEQ ID NO: 523258 - DNA, 25 bp, Homo sapien
tgacatctgcaacaggaggcaacag

SEQ ID NO: 523259 - DNA, 25 bp, Homo sapien
aatctcatcttcttttccagtagaa

SEQ ID NO: 523260 - DNA, 25 bp, Homo sapien
gatgagggcattttatctgcttgct

SEQ ID NO: 523261 - DNA, 25 bp, Homo sapien
tttatctgcttgctgtgaccagcgt

SEQ ID NO: 523262 - DNA, 25 bp, Homo sapien
gcgtgtgtacacataaaccttaaca

SEQ ID NO: 523263 - DNA, 25 bp, Homo sapien
agactacaagtatattccagaagga

SEQ ID NO: 523264 - DNA, 25 bp, Homo sapien
acttcaaatgcgatggtcttgacta

SEQ ID NO: 523265 - DNA, 25 bp, Homo sapien
attagaccagatttagtagctccat

SEQ ID NO: 523266 - DNA, 25 bp, Homo sapien
gtagctccatatctaagatttttct

SEQ ID NO: 523267 - DNA, 25 bp, Homo sapien
tattctatgccttactgtactttat

SEQ ID NO: 523268 - DNA, 25 bp, Homo sapien
aaacattcttggcagagaagtcaca

SEQ ID NO: 523269 - DNA, 25 bp, Homo sapien
agaagtcacaaactggccgggtctc

SEQ ID NO: 523270 - DNA, 25 bp, Homo sapien
gctacattcaaattactgttcagag

SEQ ID NO: 523271 - DNA, 25 bp, Homo sapien
ttactgttcagagcctaaagacact

SEQ ID NO: 523272 - DNA, 25 bp, Homo sapien
gccttactgtactttatagatctga

SEQ ID NO: 523273 - DNA, 25 bp, Homo sapien
cactcaagtttgtcagctctggtag

SEQ ID NO: 523274 - DNA, 25 bp, Homo sapien
tctggtagagtttcccactggcaat

SEQ ID NO: 523275 - DNA, 25 bp, Homo sapien
tatttttcctgcatgagtttcaaca

SEQ ID NO: 523276 - DNA, 25 bp, Homo sapien
actaaaagtgtcttatagccagagg

SEQ ID NO: 523277 - DNA, 25 bp, Homo sapien
ctaagggacttattctgttgtaaag

SEQ ID NO: 523278 - DNA, 25 bp, Homo sapien
gggactcctccctgtatgtacgtgt

SEQ ID NO: 523279 - DNA, 25 bp, Homo sapien
gtatgtacgtgtgcgtggccctgcc

SEQ ID NO: 523280 - DNA, 25 bp, Homo sapien
ttcttgccccggacctggcctggtg

SEQ ID NO: 523281 - DNA, 25 bp, Homo sapien
agattgcagtcagggacgctcagcc

SEQ ID NO: 523282 - DNA, 25 bp, Homo sapien
gagctgaccctcaggtgaggcccta

SEQ ID NO: 523283 - DNA, 25 bp, Homo sapien
gtgaggccctaaggaagttcccaga

SEQ ID NO: 523284 - DNA, 25 bp, Homo sapien
taaggaagttcccagacctccctga

SEQ ID NO: 523285 - DNA, 25 bp, Homo sapien
tgaacctcagtatgctcatctgtcc

SEQ ID NO: 523286 - DNA, 25 bp, Homo sapien
agtatgctcatctgtccagcagcaa

SEQ ID NO: 523287 - DNA, 25 bp, Homo sapien
gggaccctgggatgatatccctacc

SEQ ID NO: 523288 - DNA, 25 bp, Homo sapien
ggacctggagagactctgtgccctg

SEQ ID NO: 523289 - DNA, 25 bp, Homo sapien
aggacgaccctagggctacctcagt

SEQ ID NO: 523290 - DNA, 25 bp, Homo sapien
tctggctatttggacttgaatccct

SEQ ID NO: 523291 - DNA, 25 bp, Homo sapien
ggcagggcttcagaaatgtcgatct

SEQ ID NO: 523292 - DNA, 25 bp, Homo sapien
agaaatgtcgatctcagggctctca

SEQ ID NO: 523293 - DNA, 25 bp, Homo sapien
tgtcttgccctcagacatgaggttt

SEQ ID NO: 523294 - DNA, 25 bp, Homo sapien
gaatgcggaagcgactaccaggttc

SEQ ID NO: 523295 - DNA, 25 bp, Homo sapien
taccaggttccttatttcattttga

SEQ ID NO: 523296 - DNA, 25 bp, Homo sapien
atttcattttgatctcagctccctc

SEQ ID NO: 523297 - DNA, 25 bp, Homo sapien
cagcctcaaccgtagctgctacagt

SEQ ID NO: 523298 - DNA, 25 bp, Homo sapien
tgctacagtctccaggcagcttgac

SEQ ID NO: 523299 - DNA, 25 bp, Homo sapien
agcttgacttgagaggacgacccta

SEQ ID NO: 523300 - DNA, 25 bp, Homo sapien
gagggcaaaaatcctttgaataatc

SEQ ID NO: 523301 - DNA, 25 bp, Homo sapien
atgaaagcagtttaagcctaatcct

SEQ ID NO: 523302 - DNA, 25 bp, Homo sapien
gcctaatcctaataaatgaattcgt

SEQ ID NO: 523303 - DNA, 25 bp, Homo sapien
tgaattcgtatactttttttgacct

SEQ ID NO: 523304 - DNA, 25 bp, Homo sapien
aaataccactttacacccagtgcta

SEQ ID NO: 523305 - DNA, 25 bp, Homo sapien
ttacacccagtgctacgtttgataa

SEQ ID NO: 523306 - DNA, 25 bp, Homo sapien
ccagtgctacgtttgataagtcata

SEQ ID NO: 523307 - DNA, 25 bp, Homo sapien
aagtcatagagaagcatgcacgcat

SEQ ID NO: 523308 - DNA, 25 bp, Homo sapien
gcatgcacgcataaagtgaatggaa

SEQ ID NO: 523309 - DNA, 25 bp, Homo sapien
gaaaaacaaactgcaggaaactgga

SEQ ID NO: 523310 - DNA, 25 bp, Homo sapien
gcccagctcttctgtaaattagaat

SEQ ID NO: 523311 - DNA, 25 bp, Homo sapien
atttcatttcactgtccaccaagtt

SEQ ID NO: 523312 - DNA, 25 bp, Homo sapien
tgtccaccaagtttccattgtcatc

SEQ ID NO: 523313 - DNA, 25 bp, Homo sapien
ttgtcatcccagctaaatgcacttc

SEQ ID NO: 523314 - DNA, 25 bp, Homo sapien
aatgcacttcctgaagtcctgaaga

SEQ ID NO: 523315 - DNA, 25 bp, Homo sapien
gaagaatccaggtgaccagtttcat

SEQ ID NO: 523316 - DNA, 25 bp, Homo sapien
accagtttcatcaaggtctgcagaa

SEQ ID NO: 523317 - DNA, 25 bp, Homo sapien
tcacctttgcttcttgatctttcag

SEQ ID NO: 523318 - DNA, 25 bp, Homo sapien
aagctgagtggcagttatctcccca

SEQ ID NO: 523319 - DNA, 25 bp, Homo sapien
tctccccactgctaagattcgaaag

SEQ ID NO: 523320 - DNA, 25 bp, Homo sapien
attcatctgaaatctcttctgcctg

SEQ ID NO: 523321 - DNA, 25 bp, Homo sapien
tggtcttctcctaggtttggatttt

SEQ ID NO: 523322 - DNA, 25 bp, Homo sapien
ttcttgttttctcctaaagcaggga

SEQ ID NO: 523323 - DNA, 25 bp, Homo sapien
gttttctcctaaagcagggagcttt

SEQ ID NO: 523324 - DNA, 25 bp, Homo sapien
agagatgattctgtccttggtaaat

SEQ ID NO: 523325 - DNA, 25 bp, Homo sapien
ttctgtccttggtaaatgtgagtga

SEQ ID NO: 523326 - DNA, 25 bp, Homo sapien
gagaatagcgttttgtttttcaagt

SEQ ID NO: 523327 - DNA, 25 bp, Homo sapien
aaactatttaccaagccaactacat

SEQ ID NO: 523328 - DNA, 25 bp, Homo sapien
ttaccaagccaactacattatatgt

SEQ ID NO: 523329 - DNA, 25 bp, Homo sapien
ataacatgtgtagaggtagctatac

SEQ ID NO: 523330 - DNA, 25 bp, Homo sapien
gttttatttcatgggcacctatctg

SEQ ID NO: 523331 - DNA, 25 bp, Homo sapien
atgggcacctatctgggtcctgagc

SEQ ID NO: 523332 - DNA, 25 bp, Homo sapien
cacctatctgggtcctgagcagaat

SEQ ID NO: 523333 - DNA, 25 bp, Homo sapien
gagtccatgatggtgatgaatctat

SEQ ID NO: 523334 - DNA, 25 bp, Homo sapien
gatggtgatgaatctattaatcatg

SEQ ID NO: 523335 - DNA, 25 bp, Homo sapien
ataggggtgctcttcaagacttaga

SEQ ID NO: 523336 - DNA, 25 bp, Homo sapien
ccagtttcaagcagagcccaaatgt

SEQ ID NO: 523337 - DNA, 25 bp, Homo sapien
agcagagcccaaatgtcacagttgt

SEQ ID NO: 523338 - DNA, 25 bp, Homo sapien
gagaaaccctgaatgcttacctctt

SEQ ID NO: 523339 - DNA, 25 bp, Homo sapien
gaaaccctgaatgcttacctctttg

SEQ ID NO: 523340 - DNA, 25 bp, Homo sapien
cctgaatgcttacctctttgggttt

SEQ ID NO: 523341 - DNA, 25 bp, Homo sapien
gaatgcttacctctttgggtttgaa

SEQ ID NO: 523342 - DNA, 25 bp, Homo sapien
aatgcttacctctttgggtttgaag

SEQ ID NO: 523343 - DNA, 25 bp, Homo sapien
gcttacctctttgggtttgaagctc

SEQ ID NO: 523344 - DNA, 25 bp, Homo sapien
ttcctcccttagaaagtttctctag

SEQ ID NO: 523345 - DNA, 25 bp, Homo sapien
gtttctctagttctatagtttattt

SEQ ID NO: 523346 - DNA, 25 bp, Homo sapien
atgaccaaagaatcagctgctctac

SEQ ID NO: 523347 - DNA, 25 bp, Homo sapien
gctgctctacaggaatagcatggtt

SEQ ID NO: 523348 - DNA, 25 bp, Homo sapien
gcatggttccagtgaattagagaaa

SEQ ID NO: 523349 - DNA, 25 bp, Homo sapien
aaacctgctgtaaagccatggtagt

SEQ ID NO: 523350 - DNA, 25 bp, Homo sapien
gccatggtagtgtctaagtggtatg

SEQ ID NO: 523351 - DNA, 25 bp, Homo sapien
gatgtactagcatttatttacagaa

SEQ ID NO: 523352 - DNA, 25 bp, Homo sapien
ttcccctctgtaaatgtccatgact

SEQ ID NO: 523353 - DNA, 25 bp, Homo sapien
tattgcccagagaaggcttacccct

SEQ ID NO: 523354 - DNA, 25 bp, Homo sapien
ccctctctagggttgcagttgcttt

SEQ ID NO: 523355 - DNA, 25 bp, Homo sapien
tgttccttaacagcctgccttttat

SEQ ID NO: 523356 - DNA, 25 bp, Homo sapien
tccttaacagcctgccttttattaa

SEQ ID NO: 523357 - DNA, 25 bp, Homo sapien
aacagcctgccttttattaatctca

SEQ ID NO: 523358 - DNA, 25 bp, Homo sapien
cctgccttttattaatctcaggctt

SEQ ID NO: 523359 - DNA, 25 bp, Homo sapien
ttttattaatctcaggcttttttat

SEQ ID NO: 523360 - DNA, 25 bp, Homo sapien
ttttggaatgtaaaccgatttaatg

SEQ ID NO: 523361 - DNA, 25 bp, Homo sapien
caccttaacctttgtttctcagtgt

SEQ ID NO: 523362 - DNA, 25 bp, Homo sapien
taacctttgtttctcagtgttcctt

SEQ ID NO: 523363 - DNA, 25 bp, Homo sapien
gtttctcagtgttccttaacagcct

SEQ ID NO: 523364 - DNA, 25 bp, Homo sapien
ttctcagtgttccttaacagcctgc

SEQ ID NO: 523365 - DNA, 25 bp, Homo sapien
tcagtgttccttaacagcctgcctt

SEQ ID NO: 523366 - DNA, 25 bp, Homo sapien
tgctttgtactgttggtgccttctt

SEQ ID NO: 523367 - DNA, 25 bp, Homo sapien
ttgtactgttggtgccttcttggta

SEQ ID NO: 523368 - DNA, 25 bp, Homo sapien
tgttggtgccttcttggtattgtac

SEQ ID NO: 523369 - DNA, 25 bp, Homo sapien
tggtgccttcttggtattgtacccc

SEQ ID NO: 523370 - DNA, 25 bp, Homo sapien
tgccttcttggtattgtaccccaaa

SEQ ID NO: 523371 - DNA, 25 bp, Homo sapien
ggtattgtaccccaaaattctgcat

SEQ ID NO: 523372 - DNA, 25 bp, Homo sapien
attgtaccccaaaattctgcataga

SEQ ID NO: 523373 - DNA, 25 bp, Homo sapien
gtaccccaaaattctgcatagatta

SEQ ID NO: 523374 - DNA, 25 bp, Homo sapien
tatttgtggtatttgtgatttggtt

SEQ ID NO: 523375 - DNA, 25 bp, Homo sapien
attcttttgatgttgtaaacgtact

SEQ ID NO: 523376 - DNA, 25 bp, Homo sapien
ttatttgaatgtttatggcacctga

SEQ ID NO: 523377 - DNA, 25 bp, Homo sapien
tgctctgtccttcttggtcatcttc

SEQ ID NO: 523378 - DNA, 25 bp, Homo sapien
atcttcctgggcctgcaacaaagct

SEQ ID NO: 523379 - DNA, 25 bp, Homo sapien
aggcagctccttacagaggctaacg

SEQ ID NO: 523380 - DNA, 25 bp, Homo sapien
taacgccgggtctggtccctggtga

SEQ ID NO: 523381 - DNA, 25 bp, Homo sapien
ggctgctgtgagaacttgtgacccc

SEQ ID NO: 523382 - DNA, 25 bp, Homo sapien
gagatcagaacagccttcgggtccc

SEQ ID NO: 523383 - DNA, 25 bp, Homo sapien
agagcttcccgcatgatcgtgtgtg

SEQ ID NO: 523384 - DNA, 25 bp, Homo sapien
catgatcgtgtgtggaacagaccgg

SEQ ID NO: 523385 - DNA, 25 bp, Homo sapien
aacagaccgggagattccagcagat

SEQ ID NO: 523386 - DNA, 25 bp, Homo sapien
gatatgggttcaacgttgaccacca

SEQ ID NO: 523387 - DNA, 25 bp, Homo sapien
caacgttgaccaccaaccttgacaa

SEQ ID NO: 523388 - DNA, 25 bp, Homo sapien
gagtccatgatggtgatgaatctat

SEQ ID NO: 523389 - DNA, 25 bp, Homo sapien
gggtgctcttcaagacttagacttc

SEQ ID NO: 523390 - DNA, 25 bp, Homo sapien
gaaaatccacacagcacagaatatt

SEQ ID NO: 523391 - DNA, 25 bp, Homo sapien
agaattcatgagctgagtttttata

SEQ ID NO: 523392 - DNA, 25 bp, Homo sapien
ccagtttcaagcagagcccaaatgt

SEQ ID NO: 523393 - DNA, 25 bp, Homo sapien
agcagagcccaaatgtcacagttgt

SEQ ID NO: 523394 - DNA, 25 bp, Homo sapien
gtcacagttgtcaagagaacacaca

SEQ ID NO: 523395 - DNA, 25 bp, Homo sapien
gagaaaccctgaatgcttacctctt

SEQ ID NO: 523396 - DNA, 25 bp, Homo sapien
gaaaccctgaatgcttacctctttg

SEQ ID NO: 523397 - DNA, 25 bp, Homo sapien
gaatgcttacctctttgggtttgaa

SEQ ID NO: 523398 - DNA, 25 bp, Homo sapien
gcttacctctttgggtttgaagctc

SEQ ID NO: 523399 - DNA, 25 bp, Homo sapien
tttgctgactttggggtaaacaact

SEQ ID NO: 523400 - DNA, 25 bp, Homo sapien
ctttgttataatacagtctctgcca

SEQ ID NO: 523401 - DNA, 25 bp, Homo sapien
cagtctctgccacagatgcatgtga

SEQ ID NO: 523402 - DNA, 25 bp, Homo sapien
tctgccacagatgcatgtgacctct

SEQ ID NO: 523403 - DNA, 25 bp, Homo sapien
gccacagatgcatgtgacctcttca

SEQ ID NO: 523404 - DNA, 25 bp, Homo sapien
gtgacctcttcaggggcccagagtg

SEQ ID NO: 523405 - DNA, 25 bp, Homo sapien
tgctgaaagccagtgtttagaatct

SEQ ID NO: 523406 - DNA, 25 bp, Homo sapien
gccagtgtttagaatctttgtgcag

SEQ ID NO: 523407 - DNA, 25 bp, Homo sapien
tagaatctttgtgcagatgaccaaa

SEQ ID NO: 523408 - DNA, 25 bp, Homo sapien
gcagatgaccaaagcaattgacttg

SEQ ID NO: 523409 - DNA, 25 bp, Homo sapien
gatgaccaaagcaattgacttggcc

SEQ ID NO: 523410 - DNA, 25 bp, Homo sapien
gttacttgtcaggatttctcctctt

SEQ ID NO: 523411 - DNA, 25 bp, Homo sapien
caggatttctcctcttcagagagat

SEQ ID NO: 523412 - DNA, 25 bp, Homo sapien
tttatagcacagattcctttgcccc

SEQ ID NO: 523413 - DNA, 25 bp, Homo sapien
ccccttttatctccttatctggata

SEQ ID NO: 523414 - DNA, 25 bp, Homo sapien
atgagggtctcactaactattttgt

SEQ ID NO: 523415 - DNA, 25 bp, Homo sapien
gtgtaaaactttgcagtagcattta

SEQ ID NO: 523416 - DNA, 25 bp, Homo sapien
tatttttctatcaagtgcactattc

SEQ ID NO: 523417 - DNA, 25 bp, Homo sapien
attcatttagtgtgttccagtttta

SEQ ID NO: 523418 - DNA, 25 bp, Homo sapien
gacttgtattagaaacactgcactg

SEQ ID NO: 523419 - DNA, 25 bp, Homo sapien
cactgcactgagttgtttgtacact

SEQ ID NO: 523420 - DNA, 25 bp, Homo sapien
gagaactctagatgtaactctattc

SEQ ID NO: 523421 - DNA, 25 bp, Homo sapien
aagctggccgtggagtcgagctggc

SEQ ID NO: 523422 - DNA, 25 bp, Homo sapien
gacggacccctttcacctggttatg

SEQ ID NO: 523423 - DNA, 25 bp, Homo sapien
tttcacctggttatgagccgacttc

SEQ ID NO: 523424 - DNA, 25 bp, Homo sapien
tatgagccgacttctttggtgttct

SEQ ID NO: 523425 - DNA, 25 bp, Homo sapien
tctttggtgttctggcctctggcct

SEQ ID NO: 523426 - DNA, 25 bp, Homo sapien
aaaaaggctggtggacagacccagg

SEQ ID NO: 523427 - DNA, 25 bp, Homo sapien
ggcctttgcagcgtctttttaacct

SEQ ID NO: 523428 - DNA, 25 bp, Homo sapien
ctttgcagcgtctttttaacctcag

SEQ ID NO: 523429 - DNA, 25 bp, Homo sapien
agaaaatttctcaatctatgtgatt

SEQ ID NO: 523430 - DNA, 25 bp, Homo sapien
gtgtaatactaatgagctttgggca

SEQ ID NO: 523431 - DNA, 25 bp, Homo sapien
gctttgggcaataaatacgggattt

SEQ ID NO: 523432 - DNA, 25 bp, Homo sapien
ccctttgttgctcgctgatgacaag

SEQ ID NO: 523433 - DNA, 25 bp, Homo sapien
tttgttgctcgctgatgacaagttt

SEQ ID NO: 523434 - DNA, 25 bp, Homo sapien
tgacaagtttggatgatcccgccaa

SEQ ID NO: 523435 - DNA, 25 bp, Homo sapien
gatcccgccaaacagcttgctaaga

SEQ ID NO: 523436 - DNA, 25 bp, Homo sapien
cagcttgctaagatgtagtccccag

SEQ ID NO: 523437 - DNA, 25 bp, Homo sapien
gctaagatgtagtccccagtgttgg

SEQ ID NO: 523438 - DNA, 25 bp, Homo sapien
gcctgatgggaggtgctacccttgt

SEQ ID NO: 523439 - DNA, 25 bp, Homo sapien
atgggaggtgctacccttgtgagat

SEQ ID NO: 523440 - DNA, 25 bp, Homo sapien
acccttgtgagataaggttgtgtaa

SEQ ID NO: 523441 - DNA, 25 bp, Homo sapien
tgtaaaagcctgtggcacctcccca

SEQ ID NO: 523442 - DNA, 25 bp, Homo sapien
ttctgccaggagtaaaagcccccga

SEQ ID NO: 523443 - DNA, 25 bp, Homo sapien
gagtgttgtattgtacatgttccat

SEQ ID NO: 523444 - DNA, 25 bp, Homo sapien
gctgtagagtacaagtttctctccc

SEQ ID NO: 523445 - DNA, 25 bp, Homo sapien
ttctctcccttattttctacaggcc

SEQ ID NO: 523446 - DNA, 25 bp, Homo sapien
cttattttctacaggcccatttagc

SEQ ID NO: 523447 - DNA, 25 bp, Homo sapien
ccatttagccacacagtcttgactg

SEQ ID NO: 523448 - DNA, 25 bp, Homo sapien
acagtcttgactgcctttttaccaa

SEQ ID NO: 523449 - DNA, 25 bp, Homo sapien
gcctttttaccaactgcagtgctat

SEQ ID NO: 523450 - DNA, 25 bp, Homo sapien
actgcagtgctatagcttcctgatt

SEQ ID NO: 523451 - DNA, 25 bp, Homo sapien
aatattagatcagcaatccatgtat

SEQ ID NO: 523452 - DNA, 25 bp, Homo sapien
cagcaatccatgtataaaggactat

SEQ ID NO: 523453 - DNA, 25 bp, Homo sapien
aggactattattgaggattttggat

SEQ ID NO: 523454 - DNA, 25 bp, Homo sapien
aagaattcatgagctgagtttttat

SEQ ID NO: 523455 - DNA, 25 bp, Homo sapien
agaattcatgagctgagtttttata

SEQ ID NO: 523456 - DNA, 25 bp, Homo sapien
tatctgaattccattgaagaaaacc

SEQ ID NO: 523457 - DNA, 25 bp, Homo sapien
tgaattccattgaagaaaacctatt

SEQ ID NO: 523458 - DNA, 25 bp, Homo sapien
agaaaacctatttttgtatgaatat

SEQ ID NO: 523459 - DNA, 25 bp, Homo sapien
gtatgaatatgaccagtttcaagca

SEQ ID NO: 523460 - DNA, 25 bp, Homo sapien
atgaatatgaccagtttcaagcaga

SEQ ID NO: 523461 - DNA, 25 bp, Homo sapien
aaatgtcacagttgtcaagagaaca

SEQ ID NO: 523462 - DNA, 25 bp, Homo sapien
atgtcacagttgtcaagagaacaca

SEQ ID NO: 523463 - DNA, 25 bp, Homo sapien
gtcacagttgtcaagagaacacaca

SEQ ID NO: 523464 - DNA, 25 bp, Homo sapien
ttgtcaagagaacacacaacagaga

SEQ ID NO: 523465 - DNA, 25 bp, Homo sapien
ggtcagcaccacctaccatacagaa

SEQ ID NO: 523466 - DNA, 25 bp, Homo sapien
tggtctagcctcagaagaagtctag

SEQ ID NO: 523467 - DNA, 25 bp, Homo sapien
ctagcctcagaagaagtctagacat

SEQ ID NO: 523468 - DNA, 25 bp, Homo sapien
gaagtctagacatcaccctgagaga

SEQ ID NO: 523469 - DNA, 25 bp, Homo sapien
accctgagagagatgggacccctca

SEQ ID NO: 523470 - DNA, 25 bp, Homo sapien
ggacccctcagagggttttaagcag

SEQ ID NO: 523471 - DNA, 25 bp, Homo sapien
tcttaggagagggaatgtctgtgct

SEQ ID NO: 523472 - DNA, 25 bp, Homo sapien
gagagggaatgtctgtgctgaggcc

SEQ ID NO: 523473 - DNA, 25 bp, Homo sapien
gagagttggccagggaactgagagc

SEQ ID NO: 523474 - DNA, 25 bp, Homo sapien
tgagagcagcgtgtgcagaggccca

SEQ ID NO: 523475 - DNA, 25 bp, Homo sapien
gtgcagaggcccagtggtcagcacc

SEQ ID NO: 523476 - DNA, 25 bp, Homo sapien
acgccgggtttaatgaggttctcag

SEQ ID NO: 523477 - DNA, 25 bp, Homo sapien
cctgctcctagcatgggatgtactt

SEQ ID NO: 523478 - DNA, 25 bp, Homo sapien
agcatgggatgtactttacgctggg

SEQ ID NO: 523479 - DNA, 25 bp, Homo sapien
gaggtgaaggagacccctagtaaca

SEQ ID NO: 523480 - DNA, 25 bp, Homo sapien
gacccctagtaacagtctccagctg

SEQ ID NO: 523481 - DNA, 25 bp, Homo sapien
agtagaacaaggtgcattcccaaga

SEQ ID NO: 523482 - DNA, 25 bp, Homo sapien
aagaacaatcctctccgtcggtgca

SEQ ID NO: 523483 - DNA, 25 bp, Homo sapien
tcctctccgtcggtgcaggaggaaa

SEQ ID NO: 523484 - DNA, 25 bp, Homo sapien
aaaggtgggatttgctaaaggctca

SEQ ID NO: 523485 - DNA, 25 bp, Homo sapien
ggatttgctaaaggctcagtgggaa

SEQ ID NO: 523486 - DNA, 25 bp, Homo sapien
agcgcgtgacaagaacgccgggttt

SEQ ID NO: 523487 - DNA, 25 bp, Homo sapien
gttgcctcaaatccagacagatgtt

SEQ ID NO: 523488 - DNA, 25 bp, Homo sapien
tgttgtacttccatcatgcaaaaaa

SEQ ID NO: 523489 - DNA, 25 bp, Homo sapien
tcctgctgaaactcctgtgaaagaa

SEQ ID NO: 523490 - DNA, 25 bp, Homo sapien
ttgtgtttaatcctcatcctttacc

SEQ ID NO: 523491 - DNA, 25 bp, Homo sapien
cctcatcctttacctttagacgtat

SEQ ID NO: 523492 - DNA, 25 bp, Homo sapien
attctgtcgttttggtaacctgatc

SEQ ID NO: 523493 - DNA, 25 bp, Homo sapien
aacctgatcgaagtttaccttgtgt

SEQ ID NO: 523494 - DNA, 25 bp, Homo sapien
gggtatgccaagtatgccgatagaa

SEQ ID NO: 523495 - DNA, 25 bp, Homo sapien
tgctaatgatgccattgccactcta

SEQ ID NO: 523496 - DNA, 25 bp, Homo sapien
tgccactctacatggaaagattctg

SEQ ID NO: 523497 - DNA, 25 bp, Homo sapien
aagttatgctggcagattcgccaag

SEQ ID NO: 523498 - DNA, 25 bp, Homo sapien
gggtcccagcagcaattcggctact

SEQ ID NO: 523499 - DNA, 25 bp, Homo sapien
aattcggctactccccagggcagca

SEQ ID NO: 523500 - DNA, 25 bp, Homo sapien
aaggacatctacaccatttggatca

SEQ ID NO: 523501 - DNA, 25 bp, Homo sapien
accatttggatcagggcgtgttaga

SEQ ID NO: 523502 - DNA, 25 bp, Homo sapien
gaaaattatttcaagccttcaatgc

SEQ ID NO: 523503 - DNA, 25 bp, Homo sapien
atgcttgaagatccttgggctggcc

SEQ ID NO: 523504 - DNA, 25 bp, Homo sapien
agatccttgggctggcctagaacca

SEQ ID NO: 523505 - DNA, 25 bp, Homo sapien
gcctagaaccagtatctgtagtgga

SEQ ID NO: 523506 - DNA, 25 bp, Homo sapien
ggatataagccaacaatacagcaat

SEQ ID NO: 523507 - DNA, 25 bp, Homo sapien
gcaatactcaaacattcacaggcaa

SEQ ID NO: 523508 - DNA, 25 bp, Homo sapien
gatacttttgttaacatttctgaaa

SEQ ID NO: 523509 - DNA, 25 bp, Homo sapien
tgattacctcttgggaaataatttt

SEQ ID NO: 523510 - DNA, 25 bp, Homo sapien
gccaacaaaaagatacacttgaagt

SEQ ID NO: 523511 - DNA, 25 bp, Homo sapien
acacttgaagtttcttaaggtggca

SEQ ID NO: 523512 - DNA, 25 bp, Homo sapien
ttgtgttggaccctcccagtttaga

SEQ ID NO: 523513 - DNA, 25 bp, Homo sapien
tggaccctcccagtttagatcaagt

SEQ ID NO: 523514 - DNA, 25 bp, Homo sapien
gaccctcccagtttagatcaagtat

SEQ ID NO: 523515 - DNA, 25 bp, Homo sapien
cccagtttagatcaagtatttcttg

SEQ ID NO: 523516 - DNA, 25 bp, Homo sapien
tgctattgtggttgataccaataaa

SEQ ID NO: 523517 - DNA, 25 bp, Homo sapien
ttaaagctcaaccattaattggaac

SEQ ID NO: 523518 - DNA, 25 bp, Homo sapien
tggaacatggtgaaacattgtacac

SEQ ID NO: 523519 - DNA, 25 bp, Homo sapien
gtacacattgtaaaagtagggaaca

SEQ ID NO: 523520 - DNA, 25 bp, Homo sapien
caccaggcctttctttgttcttagg

SEQ ID NO: 523521 - DNA, 25 bp, Homo sapien
ccaggcctttctttgttcttaggag

SEQ ID NO: 523522 - DNA, 25 bp, Homo sapien
caggcctttctttgttcttaggagt

SEQ ID NO: 523523 - DNA, 25 bp, Homo sapien
ggcctttctttgttcttaggagtat

SEQ ID NO: 523524 - DNA, 25 bp, Homo sapien
ttctttgttcttaggagtatagtca

SEQ ID NO: 523525 - DNA, 25 bp, Homo sapien
ttgttcttaggagtatagtcagact

SEQ ID NO: 523526 - DNA, 25 bp, Homo sapien
gtatagtcagactaacttctagtag

SEQ ID NO: 523527 - DNA, 25 bp, Homo sapien
gtcagactaacttctagtagttata

SEQ ID NO: 523528 - DNA, 25 bp, Homo sapien
acttctagtagttatatttctaata

SEQ ID NO: 523529 - DNA, 25 bp, Homo sapien
gaggatgtaagtaaggatcaaatct

SEQ ID NO: 523530 - DNA, 25 bp, Homo sapien
aaggatcaaatcttaaatcagtata

SEQ ID NO: 523531 - DNA, 25 bp, Homo sapien
gggacaaaaacacatgtgccatacc

SEQ ID NO: 523532 - DNA, 25 bp, Homo sapien
aaaaacacatgtgccataccgggac

SEQ ID NO: 523533 - DNA, 25 bp, Homo sapien
acacatgtgccataccgggacagca

SEQ ID NO: 523534 - DNA, 25 bp, Homo sapien
agatgactcggattcttcaggactc

SEQ ID NO: 523535 - DNA, 25 bp, Homo sapien
atgactcggattcttcaggactctt

SEQ ID NO: 523536 - DNA, 25 bp, Homo sapien
gactcggattcttcaggactctttg

SEQ ID NO: 523537 - DNA, 25 bp, Homo sapien
ctcggattcttcaggactctttggg

SEQ ID NO: 523538 - DNA, 25 bp, Homo sapien
cggattcttcaggactctttgggtg

SEQ ID NO: 523539 - DNA, 25 bp, Homo sapien
attcttcaggactctttgggtggga

SEQ ID NO: 523540 - DNA, 25 bp, Homo sapien
tcttcaggactctttgggtgggaac

SEQ ID NO: 523541 - DNA, 25 bp, Homo sapien
ttcaggactctttgggtgggaactg

SEQ ID NO: 523542 - DNA, 25 bp, Homo sapien
ccgaaccaggctcctcctgcttcaa

SEQ ID NO: 523543 - DNA, 25 bp, Homo sapien
cctcctgcttcaacagacccttggg

SEQ ID NO: 523544 - DNA, 25 bp, Homo sapien
gatgccaccgagacactcgcactgt

SEQ ID NO: 523545 - DNA, 25 bp, Homo sapien
gagacactcgcactgtcccttggct

SEQ ID NO: 523546 - DNA, 25 bp, Homo sapien
agacactcgcactgtcccttggctg

SEQ ID NO: 523547 - DNA, 25 bp, Homo sapien
gcactgtcccttggctgccgggcac

SEQ ID NO: 523548 - DNA, 25 bp, Homo sapien
tggctgccgggcaccccactgagcc

SEQ ID NO: 523549 - DNA, 25 bp, Homo sapien
aaagtctgccagcaacaggcccttt

SEQ ID NO: 523550 - DNA, 25 bp, Homo sapien
aagtctgccagcaacaggccctttg

SEQ ID NO: 523551 - DNA, 25 bp, Homo sapien
agtctgccagcaacaggccctttgc

SEQ ID NO: 523552 - DNA, 25 bp, Homo sapien
gcaacaggccctttgcctgggtgag

SEQ ID NO: 523553 - DNA, 25 bp, Homo sapien
gctgggaaactcctggaagacatga

SEQ ID NO: 523554 - DNA, 25 bp, Homo sapien
agagtgctcctagatcaccataaag

SEQ ID NO: 523555 - DNA, 25 bp, Homo sapien
gataaccatctaatccagtaaggag

SEQ ID NO: 523556 - DNA, 25 bp, Homo sapien
gggctgcccactctgtaaatgaagg

SEQ ID NO: 523557 - DNA, 25 bp, Homo sapien
ctcagtggagtctggccaagcacag

SEQ ID NO: 523558 - DNA, 25 bp, Homo sapien
agtctggccaagcacagaggctgct

SEQ ID NO: 523559 - DNA, 25 bp, Homo sapien
atcaccataaagacatgatcgtgga

SEQ ID NO: 523560 - DNA, 25 bp, Homo sapien
aagaatgtgggtgcctctgatgaca

SEQ ID NO: 523561 - DNA, 25 bp, Homo sapien
atgacatcctggagggagactggat

SEQ ID NO: 523562 - DNA, 25 bp, Homo sapien
agggagactggatttgcctgcactc

SEQ ID NO: 523563 - DNA, 25 bp, Homo sapien
ggatttgcctgcactctggaaggct

SEQ ID NO: 523564 - DNA, 25 bp, Homo sapien
ttgccttttcacttcaaaacctctt

SEQ ID NO: 523565 - DNA, 25 bp, Homo sapien
agacaaagggcacccttgtggcttt

SEQ ID NO: 523566 - DNA, 25 bp, Homo sapien
ttgtggctttgggacctaagtggtt

SEQ ID NO: 523567 - DNA, 25 bp, Homo sapien
tcccgaggtcactgaggactggtac

SEQ ID NO: 523568 - DNA, 25 bp, Homo sapien
aggactggtacctcgggaacgcaag

SEQ ID NO: 523569 - DNA, 25 bp, Homo sapien
gtacctcgggaacgcaagctgtcag

SEQ ID NO: 523570 - DNA, 25 bp, Homo sapien
tggaactgtcccacaagaattcaca

SEQ ID NO: 523571 - DNA, 25 bp, Homo sapien
agaattcacaggtctcaaagcagga

SEQ ID NO: 523572 - DNA, 25 bp, Homo sapien
gtctcaaagcaggaacagtgggttt

SEQ ID NO: 523573 - DNA, 25 bp, Homo sapien
agtgggtttgtgtctcacctgagta

SEQ ID NO: 523574 - DNA, 25 bp, Homo sapien
gtctcacctgagtatctggaatttt

SEQ ID NO: 523575 - DNA, 25 bp, Homo sapien
atctcttttcactcctagagaggaa

SEQ ID NO: 523576 - DNA, 25 bp, Homo sapien
ggaattgcaattgactcagaatgac

SEQ ID NO: 523577 - DNA, 25 bp, Homo sapien
ttttggcaccacgtgtgtagaaagc

SEQ ID NO: 523578 - DNA, 25 bp, Homo sapien
ccccactgttagatgatagcctcgt

SEQ ID NO: 523579 - DNA, 25 bp, Homo sapien
gatagcctcgtgaaattcatgtttc

SEQ ID NO: 523580 - DNA, 25 bp, Homo sapien
attcatgtttctgtattctcctatt

SEQ ID NO: 523581 - DNA, 25 bp, Homo sapien
ttctgtattctcctatttcttttca

SEQ ID NO: 523582 - DNA, 25 bp, Homo sapien
atcctaagagggaactgatttaaga

SEQ ID NO: 523583 - DNA, 25 bp, Homo sapien
tgatttaagaaacaaggccgccaaa

SEQ ID NO: 523584 - DNA, 25 bp, Homo sapien
acaaaggcagcagttccgactccag

SEQ ID NO: 523585 - DNA, 25 bp, Homo sapien
gaaggaaagtgaccccactttcact

SEQ ID NO: 523586 - DNA, 25 bp, Homo sapien
aatttgctttagttattccatctgc

SEQ ID NO: 523587 - DNA, 25 bp, Homo sapien
tgccatttcattgcaaagatttctg

SEQ ID NO: 523588 - DNA, 25 bp, Homo sapien
tattgactcatggatttccatagag

SEQ ID NO: 523589 - DNA, 25 bp, Homo sapien
agatttctgaattcattgtacaaac

SEQ ID NO: 523590 - DNA, 25 bp, Homo sapien
gtacaaacttgaaagtgtccatgtt

SEQ ID NO: 523591 - DNA, 25 bp, Homo sapien
gtgtccatgttatttatacttctgc

SEQ ID NO: 523592 - DNA, 25 bp, Homo sapien
atttatacttctgctagagatctag

SEQ ID NO: 523593 - DNA, 25 bp, Homo sapien
attctgctagaatcaataggttttg

SEQ ID NO: 523594 - DNA, 25 bp, Homo sapien
gatttatttcactctgctatcagcc

SEQ ID NO: 523595 - DNA, 25 bp, Homo sapien
tatcagccagctttttctatgaggc

SEQ ID NO: 523596 - DNA, 25 bp, Homo sapien
aggaacttaaagaatgctgcatttt

SEQ ID NO: 523597 - DNA, 25 bp, Homo sapien
ctttgtcaactctcatagaaagttt

SEQ ID NO: 523598 - DNA, 25 bp, Homo sapien
gaaagttttccttgtatcgagctca

SEQ ID NO: 523599 - DNA, 25 bp, Homo sapien
gtatcgagctcaaatctgcctcctg

SEQ ID NO: 523600 - DNA, 25 bp, Homo sapien
gtaccagctctgctgtcagagactt

SEQ ID NO: 523601 - DNA, 25 bp, Homo sapien
agagacttcacagtctgtgctccct

SEQ ID NO: 523602 - DNA, 25 bp, Homo sapien
tgccctgtgacgtcttcagactatt

SEQ ID NO: 523603 - DNA, 25 bp, Homo sapien
gacgtcttcagactatttgagaaca

SEQ ID NO: 523604 - DNA, 25 bp, Homo sapien
aatcatgactcctgggacttgcctt

SEQ ID NO: 523605 - DNA, 25 bp, Homo sapien
gccttttctctaggtcaaatacctc

SEQ ID NO: 523606 - DNA, 25 bp, Homo sapien
agcctaacaatcaaatctctttctt

SEQ ID NO: 523607 - DNA, 25 bp, Homo sapien
tctaggcagggacaggagctcattt

SEQ ID NO: 523608 - DNA, 25 bp, Homo sapien
aatggcaggctgaagcctagatatt

SEQ ID NO: 523609 - DNA, 25 bp, Homo sapien
ggttctagtctgataattattcatg

SEQ ID NO: 523610 - DNA, 25 bp, Homo sapien
atgtttctagattcatgcccatcat

SEQ ID NO: 523611 - DNA, 25 bp, Homo sapien
gattcatgcccatcatataaggtaa

SEQ ID NO: 523612 - DNA, 25 bp, Homo sapien
ttatacaaggccagagtgcgcgata

SEQ ID NO: 523613 - DNA, 25 bp, Homo sapien
gtaaacaatcttctgtacattttct

SEQ ID NO: 523614 - DNA, 25 bp, Homo sapien
ctaggcttaagttacagctaaaatt

SEQ ID NO: 523615 - DNA, 25 bp, Homo sapien
gccagagtgcgcgataaaacttaat

SEQ ID NO: 523616 - DNA, 25 bp, Homo sapien
ttttaatcagctagacacatgtcga

SEQ ID NO: 523617 - DNA, 25 bp, Homo sapien
agacacatgtcgattgaactataac

SEQ ID NO: 523618 - DNA, 25 bp, Homo sapien
tgaactataacaatggcaggctgaa

SEQ ID NO: 523619 - DNA, 25 bp, Homo sapien
ttttgtgctatgtagatctggccat

SEQ ID NO: 523620 - DNA, 25 bp, Homo sapien
gatctggccatacttgcattagtga

SEQ ID NO: 523621 - DNA, 25 bp, Homo sapien
gactgtcttgccttaaccacactta

SEQ ID NO: 523622 - DNA, 25 bp, Homo sapien
cacacttaagcaacccacaaatttc

SEQ ID NO: 523623 - DNA, 25 bp, Homo sapien
atttcttctcagatttgtttcctag

SEQ ID NO: 523624 - DNA, 25 bp, Homo sapien
tgatactcatcccatgtctcaataa

SEQ ID NO: 523625 - DNA, 25 bp, Homo sapien
gtgtcttttctttctggatgtgttc

SEQ ID NO: 523626 - DNA, 25 bp, Homo sapien
ttctggatgtgttctcttactccct

SEQ ID NO: 523627 - DNA, 25 bp, Homo sapien
ttaccaccatactttttgctctctt

SEQ ID NO: 523628 - DNA, 25 bp, Homo sapien
tgcaagcgtagtcttcacagggagt

SEQ ID NO: 523629 - DNA, 25 bp, Homo sapien
agggagtggcttcctgacatttttt

SEQ ID NO: 523630 - DNA, 25 bp, Homo sapien
ccaaggctgctttcagagtttcagt

SEQ ID NO: 523631 - DNA, 25 bp, Homo sapien
ttcttcactgttccctactcttgta

SEQ ID NO: 523632 - DNA, 25 bp, Homo sapien
gttccctactcttgtaagctcttaa

SEQ ID NO: 523633 - DNA, 25 bp, Homo sapien
gctcttaaatatgcctgctcagctc

SEQ ID NO: 523634 - DNA, 25 bp, Homo sapien
ctaaaggaactatttttgcagcaaa

SEQ ID NO: 523635 - DNA, 25 bp, Homo sapien
cttcctcctcggataaaacttcact

SEQ ID NO: 523636 - DNA, 25 bp, Homo sapien
ggctctggcttttgaagccaggctt

SEQ ID NO: 523637 - DNA, 25 bp, Homo sapien
tgaggtccctttcagtctggaggcc

SEQ ID NO: 523638 - DNA, 25 bp, Homo sapien
cctgtggtgatgtcagtgtgcctca

SEQ ID NO: 523639 - DNA, 25 bp, Homo sapien
cagtgtgcctcagctgttttcaatt

SEQ ID NO: 523640 - DNA, 25 bp, Homo sapien
gttttcaattaaacccctcgagctg

SEQ ID NO: 523641 - DNA, 25 bp, Homo sapien
acagagtattcaatgcatgttgtat

SEQ ID NO: 523642 - DNA, 25 bp, Homo sapien
gcatgttgtatgtgccaccaagtta

SEQ ID NO: 523643 - DNA, 25 bp, Homo sapien
gtatgtgccaccaagttactattaa

SEQ ID NO: 523644 - DNA, 25 bp, Homo sapien
gaagactctgtatagtcaatagttg

SEQ ID NO: 523645 - DNA, 25 bp, Homo sapien
gttgtgaaattcttctcaggctcct

SEQ ID NO: 523646 - DNA, 25 bp, Homo sapien
gaaattcttctcaggctccttaaac

SEQ ID NO: 523647 - DNA, 25 bp, Homo sapien
gctccttaaaccctcgctttgttgt

SEQ ID NO: 523648 - DNA, 25 bp, Homo sapien
aggacatgaggttttctttcttggt

SEQ ID NO: 523649 - DNA, 25 bp, Homo sapien
gtttttgtccaagatctttgcacct

SEQ ID NO: 523650 - DNA, 25 bp, Homo sapien
gatctttgcaccttaatattaatgg

SEQ ID NO: 523651 - DNA, 25 bp, Homo sapien
taatattaatggactgtttcaggta

SEQ ID NO: 523652 - DNA, 25 bp, Homo sapien
atgggctgcaacgagtgtacgcacc

SEQ ID NO: 523653 - DNA, 25 bp, Homo sapien
agcactcgctgagcatgctgggcat

SEQ ID NO: 523654 - DNA, 25 bp, Homo sapien
gcatcggccagtgcgtggaatgtga

SEQ ID NO: 523655 - DNA, 25 bp, Homo sapien
gaaggtggcctgcaacaagtgcaac

SEQ ID NO: 523656 - DNA, 25 bp, Homo sapien
gcaacaagtgcaacgtggtagcgca

SEQ ID NO: 523657 - DNA, 25 bp, Homo sapien
gtggtagcgcactgcttcgagaacg

SEQ ID NO: 523658 - DNA, 25 bp, Homo sapien
tcgagaacgcccaccgcgtgcgggt

SEQ ID NO: 523659 - DNA, 25 bp, Homo sapien
gggtgtccgccgacacctgcagtgt

SEQ ID NO: 523660 - DNA, 25 bp, Homo sapien
tgcagtgtctgtgaggccgccttgc

SEQ ID NO: 523661 - DNA, 25 bp, Homo sapien
aggccgccttgcttgatgtggactt

SEQ ID NO: 523662 - DNA, 25 bp, Homo sapien
gatgtggacttcaacaaggccaagt

SEQ ID NO: 523663 - DNA, 25 bp, Homo sapien
tcattcgatgtggtgacaaggtttc

SEQ ID NO: 523664 - DNA, 25 bp, Homo sapien
aggtttcaccaggtactgccttcta

SEQ ID NO: 523665 - DNA, 25 bp, Homo sapien
tgccttctaacttgagctggccatt

SEQ ID NO: 523666 - DNA, 25 bp, Homo sapien
gctggccatttccacatgtcagata

SEQ ID NO: 523667 - DNA, 25 bp, Homo sapien
gtcagataggaccaacttgcctttt

SEQ ID NO: 523668 - DNA, 25 bp, Homo sapien
ttgccttttaactacccgtgtgata

SEQ ID NO: 523669 - DNA, 25 bp, Homo sapien
gtgatacttaaacactgttgccggt

SEQ ID NO: 523670 - DNA, 25 bp, Homo sapien
actgttgccggtatcacagcttttc

SEQ ID NO: 523671 - DNA, 25 bp, Homo sapien
gaatgagggcattccagtagcagga

SEQ ID NO: 523672 - DNA, 25 bp, Homo sapien
tccagtagcaggagacagcatgcat

SEQ ID NO: 523673 - DNA, 25 bp, Homo sapien
aagagcctagcgcacgtgggaaact

SEQ ID NO: 523674 - DNA, 25 bp, Homo sapien
atggtattaaatcccattgtcattg

SEQ ID NO: 523675 - DNA, 25 bp, Homo sapien
tttcctacaatgaatggtgtatctc

SEQ ID NO: 523676 - DNA, 25 bp, Homo sapien
ggtgtatctcaagttttacagaatg

SEQ ID NO: 523677 - DNA, 25 bp, Homo sapien
gtaataaaatttctctgtgcatgcc

SEQ ID NO: 523678 - DNA, 25 bp, Homo sapien
tcagcagcaaaatactcctccgaag

SEQ ID NO: 523679 - DNA, 25 bp, Homo sapien
agcaaaatactcctccgaagtctga

SEQ ID NO: 523680 - DNA, 25 bp, Homo sapien
gcagcccagagagtgatgtaggcac

SEQ ID NO: 523681 - DNA, 25 bp, Homo sapien
agataacaagttaactcctccagaa

SEQ ID NO: 523682 - DNA, 25 bp, Homo sapien
aagttaactcctccagaatcccagt

SEQ ID NO: 523683 - DNA, 25 bp, Homo sapien
agtcaccactgcactggttagcaga

SEQ ID NO: 523684 - DNA, 25 bp, Homo sapien
ggttagcagatcttgcagagcaaaa

SEQ ID NO: 523685 - DNA, 25 bp, Homo sapien
ggaaagttttccctcatatactcac

SEQ ID NO: 523686 - DNA, 25 bp, Homo sapien
agttttccctcatatactcacatac

SEQ ID NO: 523687 - DNA, 25 bp, Homo sapien
atactcacatacagcctttgaaggg

SEQ ID NO: 523688 - DNA, 25 bp, Homo sapien
tacagcctttgaagggctctggctc

SEQ ID NO: 523689 - DNA, 25 bp, Homo sapien
aagggctctggctctgaccggttga

SEQ ID NO: 523690 - DNA, 25 bp, Homo sapien
ctgaccggttgatggccttgagcga

SEQ ID NO: 523691 - DNA, 25 bp, Homo sapien
atggccttgagcgagatgaaatcat

SEQ ID NO: 523692 - DNA, 25 bp, Homo sapien
taaagtagaataacacatgctgagt

SEQ ID NO: 523693 - DNA, 25 bp, Homo sapien
cacatgctgagtgtaaactggcttt

SEQ ID NO: 523694 - DNA, 25 bp, Homo sapien
aactggctttggattggtcagctgc

SEQ ID NO: 523695 - DNA, 25 bp, Homo sapien
gattggtcagctgcagtagtacaaa

SEQ ID NO: 523696 - DNA, 25 bp, Homo sapien
gatgaaagctctctggttccttcag

SEQ ID NO: 523697 - DNA, 25 bp, Homo sapien
aaagctctctggttccttcagcagc

SEQ ID NO: 523698 - DNA, 25 bp, Homo sapien
cttcagcagctctaggaacatcctt

SEQ ID NO: 523699 - DNA, 25 bp, Homo sapien
gcagctctaggaacatccttagcca

SEQ ID NO: 523700 - DNA, 25 bp, Homo sapien
aacatccttagccattatatcctct

SEQ ID NO: 523701 - DNA, 25 bp, Homo sapien
tagccattatatcctctctctttga

SEQ ID NO: 523702 - DNA, 25 bp, Homo sapien
gtccaggtaaatgtaatattgccag

SEQ ID NO: 523703 - DNA, 25 bp, Homo sapien
ttcttcgcttggtttgtggaatcaa

SEQ ID NO: 523704 - DNA, 25 bp, Homo sapien
tgtggaatcaaaatggttgcttatt

SEQ ID NO: 523705 - DNA, 25 bp, Homo sapien
gtactaagttaaacttgcagctgtg

SEQ ID NO: 523706 - DNA, 25 bp, Homo sapien
aacttgcagctgtgaacaaattaat

SEQ ID NO: 523707 - DNA, 25 bp, Homo sapien
gagcatgttttgtgtttcttgtgtt

SEQ ID NO: 523708 - DNA, 25 bp, Homo sapien
gatatggttaattgcattacatcta

SEQ ID NO: 523709 - DNA, 25 bp, Homo sapien
aattgtgtgtatgctcaggttcccc

SEQ ID NO: 523710 - DNA, 25 bp, Homo sapien
cctaacccctgtcatttacattggt

SEQ ID NO: 523711 - DNA, 25 bp, Homo sapien
ctgtcatttacattggtggcaactt

SEQ ID NO: 523712 - DNA, 25 bp, Homo sapien
tggcaactttaaatggtaaccaagc

SEQ ID NO: 523713 - DNA, 25 bp, Homo sapien
aatgagtattgataatcctgaggaa

SEQ ID NO: 523714 - DNA, 25 bp, Homo sapien
actagtgagtatatgggagccacct

SEQ ID NO: 523715 - DNA, 25 bp, Homo sapien
atatgggagccacctttgacctgtg

SEQ ID NO: 523716 - DNA, 25 bp, Homo sapien
cacctttgacctgtgccaaagcagt

SEQ ID NO: 523717 - DNA, 25 bp, Homo sapien
caaagcagtttctaatttcatttgc

SEQ ID NO: 523718 - DNA, 25 bp, Homo sapien
gaggcttgggtttgggtgcccacag

SEQ ID NO: 523719 - DNA, 25 bp, Homo sapien
agtgggagctggtgtgatatcatac

SEQ ID NO: 523720 - DNA, 25 bp, Homo sapien
ggtgtgatatcataccttcgccggc

SEQ ID NO: 523721 - DNA, 25 bp, Homo sapien
tgccccgtttctctgttttcgtgaa

SEQ ID NO: 523722 - DNA, 25 bp, Homo sapien
ctgttttcgtgaaagagctgaccct

SEQ ID NO: 523723 - DNA, 25 bp, Homo sapien
ctgtgagcctgctgctggtgaggtc

SEQ ID NO: 523724 - DNA, 25 bp, Homo sapien
caccccttggcagggtgatgctgag

SEQ ID NO: 523725 - DNA, 25 bp, Homo sapien
gtgatgctgaggtgtggatttttaa

SEQ ID NO: 523726 - DNA, 25 bp, Homo sapien
gtggatttttaacagttcccagact

SEQ ID NO: 523727 - DNA, 25 bp, Homo sapien
tttaacagttcccagactttcccag

SEQ ID NO: 523728 - DNA, 25 bp, Homo sapien
ttcccagactttcccaggaggcttg

SEQ ID NO: 523729 - DNA, 25 bp, Homo sapien
agagggtgggattctctcacaggcc

SEQ ID NO: 523730 - DNA, 25 bp, Homo sapien
ggtcagacaagatctggcatgttca

SEQ ID NO: 523731 - DNA, 25 bp, Homo sapien
tgtagaccaggctgggttctggcca

SEQ ID NO: 523732 - DNA, 25 bp, Homo sapien
ttctggccagagctgttgcactagg

SEQ ID NO: 523733 - DNA, 25 bp, Homo sapien
ggattctctcacaggccaggtgctg

SEQ ID NO: 523734 - DNA, 25 bp, Homo sapien
gctgttgcactaggcaatgctgcca

SEQ ID NO: 523735 - DNA, 25 bp, Homo sapien
atgaggaggcatcagggcagtcatc

SEQ ID NO: 523736 - DNA, 25 bp, Homo sapien
gggcagtcatcccttctgctgtttg

SEQ ID NO: 523737 - DNA, 25 bp, Homo sapien
tcccttctgctgtttgccccaagaa

SEQ ID NO: 523738 - DNA, 25 bp, Homo sapien
ttgccccaagaatgccatacaaacc

SEQ ID NO: 523739 - DNA, 25 bp, Homo sapien
gccaggtgctgtcatccacaaagga

SEQ ID NO: 523740 - DNA, 25 bp, Homo sapien
aattccttgcttttgtcgactgacc

SEQ ID NO: 523741 - DNA, 25 bp, Homo sapien
ttgcttttgtcgactgacctgcttg

SEQ ID NO: 523742 - DNA, 25 bp, Homo sapien
ttttgtcgactgacctgcttggtag

SEQ ID NO: 523743 - DNA, 25 bp, Homo sapien
gtcgactgacctgcttggtagtgtc

SEQ ID NO: 523744 - DNA, 25 bp, Homo sapien
gactgacctgcttggtagtgtctga

SEQ ID NO: 523745 - DNA, 25 bp, Homo sapien
acctgcttggtagtgtctgaggtga

SEQ ID NO: 523746 - DNA, 25 bp, Homo sapien
gtggatcccacgcagcgctgaaccg

SEQ ID NO: 523747 - DNA, 25 bp, Homo sapien
acgcagcgctgaaccgaaccgagta

SEQ ID NO: 523748 - DNA, 25 bp, Homo sapien
agcgctgaaccgaaccgagtaggaa

SEQ ID NO: 523749 - DNA, 25 bp, Homo sapien
aaatctactgagtgtatttctgttt

SEQ ID NO: 523750 - DNA, 25 bp, Homo sapien
ctactgagtgtatttctgttttttg

SEQ ID NO: 523751 - DNA, 25 bp, Homo sapien
gagtgtagtgatcttgtgcaaaaaa

SEQ ID NO: 523752 - DNA, 25 bp, Homo sapien
atgaacatttgtgagcttcttgctg

SEQ ID NO: 523753 - DNA, 25 bp, Homo sapien
ctgcccccctaggtgctaataaaag

SEQ ID NO: 523754 - DNA, 25 bp, Homo sapien
catttgtgagcttcttgctgtttta

SEQ ID NO: 523755 - DNA, 25 bp, Homo sapien
tgagcttcttgctgttttatagatt

SEQ ID NO: 523756 - DNA, 25 bp, Homo sapien
ttgttgttcttgttgcgaaggtttc

SEQ ID NO: 523757 - DNA, 25 bp, Homo sapien
gttcttgttgcgaaggtttcaaata

SEQ ID NO: 523758 - DNA, 25 bp, Homo sapien
tatttgtgactgaatgtacggtgaa

SEQ ID NO: 523759 - DNA, 25 bp, Homo sapien
gaatgtacggtgaaactgtcataat

SEQ ID NO: 523760 - DNA, 25 bp, Homo sapien
actgtcataatgttacctagctgag

SEQ ID NO: 523761 - DNA, 25 bp, Homo sapien
ggatatttacttcaaagtttctggt

SEQ ID NO: 523762 - DNA, 25 bp, Homo sapien
gaatgtgaactaagaacttctccat

SEQ ID NO: 523763 - DNA, 25 bp, Homo sapien
ctttcttcgacaaactgtcaccttt

SEQ ID NO: 523764 - DNA, 25 bp, Homo sapien
ctgtcaccttttttactccaaactg

SEQ ID NO: 523765 - DNA, 25 bp, Homo sapien
agaagttgtatttgccatttgtggc

SEQ ID NO: 523766 - DNA, 25 bp, Homo sapien
gccatttgtggctactcaagtctta

SEQ ID NO: 523767 - DNA, 25 bp, Homo sapien
tcaagtcttactgtccagccaaggg

SEQ ID NO: 523768 - DNA, 25 bp, Homo sapien
tacgtctcagcccaatgggttggtt

SEQ ID NO: 523769 - DNA, 25 bp, Homo sapien
agagaagccactctcatttctgtat

SEQ ID NO: 523770 - DNA, 25 bp, Homo sapien
atttctgtatcacagttgccctttt

SEQ ID NO: 523771 - DNA, 25 bp, Homo sapien
tgcccttttttagcaagtgtgtgaa

SEQ ID NO: 523772 - DNA, 25 bp, Homo sapien
aagtgtgtgaattcacagtgctttt

SEQ ID NO: 523773 - DNA, 25 bp, Homo sapien
cctctaagcctctgacacttaaaca

SEQ ID NO: 523774 - DNA, 25 bp, Homo sapien
acacttaaacacgagtcctgctgtc

SEQ ID NO: 523775 - DNA, 25 bp, Homo sapien
agcacacaactgcactgaagccttg

SEQ ID NO: 523776 - DNA, 25 bp, Homo sapien
aactgcactgaagccttgttcctct

SEQ ID NO: 523777 - DNA, 25 bp, Homo sapien
ccttgttcctctcggctggtgtaga

SEQ ID NO: 523778 - DNA, 25 bp, Homo sapien
tcggctggtgtagagctcatctgca

SEQ ID NO: 523779 - DNA, 25 bp, Homo sapien
agagctcatctgcatgttgtgtgca

SEQ ID NO: 523780 - DNA, 25 bp, Homo sapien
tgtgtgcagataccagtagcctccc

SEQ ID NO: 523781 - DNA, 25 bp, Homo sapien
gataccagtagcctccctgcttgaa

SEQ ID NO: 523782 - DNA, 25 bp, Homo sapien
caggtgttcagaggcatgaaggtct

SEQ ID NO: 523783 - DNA, 25 bp, Homo sapien
tctgaaatgggagttaccaggtttt

SEQ ID NO: 523784 - DNA, 25 bp, Homo sapien
gaatttgaatcatggcactaggtca

SEQ ID NO: 523785 - DNA, 25 bp, Homo sapien
tggattgaaatgaccttagttctca

SEQ ID NO: 523786 - DNA, 25 bp, Homo sapien
gttctcaaggagtgatttgtcctca

SEQ ID NO: 523787 - DNA, 25 bp, Homo sapien
atgaggaatgagacacttaccatca

SEQ ID NO: 523788 - DNA, 25 bp, Homo sapien
gacacttaccatcatctcaggttgt

SEQ ID NO: 523789 - DNA, 25 bp, Homo sapien
taccatcatctcaggttgtttctta

SEQ ID NO: 523790 - DNA, 25 bp, Homo sapien
tgttaaaaacttacagagggcctat

SEQ ID NO: 523791 - DNA, 25 bp, Homo sapien
gagggcctattttgaatgctttaag

SEQ ID NO: 523792 - DNA, 25 bp, Homo sapien
agatgtaggccaagtaatgtatttt

SEQ ID NO: 523793 - DNA, 25 bp, Homo sapien
agagctggtaccataaattttttca

SEQ ID NO: 523794 - DNA, 25 bp, Homo sapien
agtgtaaaatctgtatctcattgta

SEQ ID NO: 523795 - DNA, 25 bp, Homo sapien
gtgagggcaccacgataagtcctgt

SEQ ID NO: 523796 - DNA, 25 bp, Homo sapien
acgataagtcctgtaaacttggcac

SEQ ID NO: 523797 - DNA, 25 bp, Homo sapien
acttggcacctttcccggaggcaga

SEQ ID NO: 523798 - DNA, 25 bp, Homo sapien
tctgttccaggcaccatccgtagtg

SEQ ID NO: 523799 - DNA, 25 bp, Homo sapien
atccgtagtggttctctgtctgtag

SEQ ID NO: 523800 - DNA, 25 bp, Homo sapien
tggttctctgtctgtagcttccgct

SEQ ID NO: 523801 - DNA, 25 bp, Homo sapien
agcttccgctcgtctgtgtgggtga

SEQ ID NO: 523802 - DNA, 25 bp, Homo sapien
cgctcgtctgtgtgggtgatgatta

SEQ ID NO: 523803 - DNA, 25 bp, Homo sapien
aaagcattctcattgcacagttctg

SEQ ID NO: 523804 - DNA, 25 bp, Homo sapien
gtaacaatgggtgtagctcccctgc

SEQ ID NO: 523805 - DNA, 25 bp, Homo sapien
atcttggaggtgcatggcccatcag

SEQ ID NO: 523806 - DNA, 25 bp, Homo sapien
tattgtgtgaatctcttcctcctct

SEQ ID NO: 523807 - DNA, 25 bp, Homo sapien
agggaggagccctgatgtatatcat

SEQ ID NO: 523808 - DNA, 25 bp, Homo sapien
gatgtatatcatgaactcacagttc

SEQ ID NO: 523809 - DNA, 25 bp, Homo sapien
gaactcacagttcctagaccacagt

SEQ ID NO: 523810 - DNA, 25 bp, Homo sapien
cagttcctagaccacagtaattgag

SEQ ID NO: 523811 - DNA, 25 bp, Homo sapien
gggcctttatcggagaagctagaga

SEQ ID NO: 523812 - DNA, 25 bp, Homo sapien
agaacaagagtccttctcctcctta

SEQ ID NO: 523813 - DNA, 25 bp, Homo sapien
ccccaacaggacactaagagacaag

SEQ ID NO: 523814 - DNA, 25 bp, Homo sapien
aaggaaccatctttgttacgtgact

SEQ ID NO: 523815 - DNA, 25 bp, Homo sapien
gttacgtgacttccaaaatgtgaga

SEQ ID NO: 523816 - DNA, 25 bp, Homo sapien
gagatctcattgctgtcactgtgat

SEQ ID NO: 523817 - DNA, 25 bp, Homo sapien
aagtcaggattgtctctcaccactt

SEQ ID NO: 523818 - DNA, 25 bp, Homo sapien
tgtctctcaccacttgtctattaaa

SEQ ID NO: 523819 - DNA, 25 bp, Homo sapien
tggcattggcatcaaaacacatcgg

SEQ ID NO: 523820 - DNA, 25 bp, Homo sapien
tagatcaatgtccaattcttccaag

SEQ ID NO: 523821 - DNA, 25 bp, Homo sapien
ccaattcttccaagagtggcttgtt

SEQ ID NO: 523822 - DNA, 25 bp, Homo sapien
gtggcttgttatcttcaggatcatc

SEQ ID NO: 523823 - DNA, 25 bp, Homo sapien
gttataatccatgagaccaccctaa

SEQ ID NO: 523824 - DNA, 25 bp, Homo sapien
agccataacctctttgtctcagaaa

SEQ ID NO: 523825 - DNA, 25 bp, Homo sapien
aatgtagtagctgtagattctttga

SEQ ID NO: 523826 - DNA, 25 bp, Homo sapien
agaccaccctaaactgtccatataa

SEQ ID NO: 523827 - DNA, 25 bp, Homo sapien
gccagaggaccccaaaagtcaggat

SEQ ID NO: 523828 - DNA, 25 bp, Homo sapien
taactgcttgttatggtttataatt

SEQ ID NO: 523829 - DNA, 25 bp, Homo sapien
taatgtgcaatacaattcctgcatc

SEQ ID NO: 523830 - DNA, 25 bp, Homo sapien
caatacaattcctgcatctttaaaa

SEQ ID NO: 523831 - DNA, 25 bp, Homo sapien
aattcctgcatctttaaaatgtctg

SEQ ID NO: 523832 - DNA, 25 bp, Homo sapien
gcatctttaaaatgtctgcagaata

SEQ ID NO: 523833 - DNA, 25 bp, Homo sapien
tgttattggattggccgtaactttt

SEQ ID NO: 523834 - DNA, 25 bp, Homo sapien
gggaggtcattaattgctttttctt

SEQ ID NO: 523835 - DNA, 25 bp, Homo sapien
gtagacttatataaatacctgtttg

SEQ ID NO: 523836 - DNA, 25 bp, Homo sapien
acctgtttgtatatagcttgagtaa

SEQ ID NO: 523837 - DNA, 25 bp, Homo sapien
attgtgatatgattgtataccacta

SEQ ID NO: 523838 - DNA, 25 bp, Homo sapien
gattgtataccactaaaatattgtt

SEQ ID NO: 523839 - DNA, 25 bp, Homo sapien
ccgcatgggtgatgctgactaccta

SEQ ID NO: 523840 - DNA, 25 bp, Homo sapien
tgatgctgactacctagctgcctgg

SEQ ID NO: 523841 - DNA, 25 bp, Homo sapien
agctgcctggcatcgcctggtgctt

SEQ ID NO: 523842 - DNA, 25 bp, Homo sapien
tggtgcttcccattgcctacgagtt

SEQ ID NO: 523843 - DNA, 25 bp, Homo sapien
tcccattgcctacgagtttaaccca

SEQ ID NO: 523844 - DNA, 25 bp, Homo sapien
ggtgctggtctcagctggctttgat

SEQ ID NO: 523845 - DNA, 25 bp, Homo sapien
ggtctcagctggctttgatgctgca

SEQ ID NO: 523846 - DNA, 25 bp, Homo sapien
aggtgtcacctgagggttatgccca

SEQ ID NO: 523847 - DNA, 25 bp, Homo sapien
tcacctgagggttatgcccacctca

SEQ ID NO: 523848 - DNA, 25 bp, Homo sapien
agagggagctgatatcatgaggata

SEQ ID NO: 523849 - DNA, 25 bp, Homo sapien
tatcatgaggataacattggcggga

SEQ ID NO: 523850 - DNA, 25 bp, Homo sapien
cagtgctttgtgctccctgctcctt

SEQ ID NO: 523851 - DNA, 25 bp, Homo sapien
ttcccgcgtagccaggtgggcccaa

SEQ ID NO: 523852 - DNA, 25 bp, Homo sapien
ctggcagggagcactacccctggac

SEQ ID NO: 523853 - DNA, 25 bp, Homo sapien
gccactgggtgttcacctgcaaagt

SEQ ID NO: 523854 - DNA, 25 bp, Homo sapien
tgggtgttcacctgcaaagtttctg

SEQ ID NO: 523855 - DNA, 25 bp, Homo sapien
acctgcaaagtttctggttgtcact

SEQ ID NO: 523856 - DNA, 25 bp, Homo sapien
tctggttgtcactgcacagtggtcg

SEQ ID NO: 523857 - DNA, 25 bp, Homo sapien
acagtggtcgcgtcatccatgggta

SEQ ID NO: 523858 - DNA, 25 bp, Homo sapien
ggtcgcgtcatccatgggtattaaa

SEQ ID NO: 523859 - DNA, 25 bp, Homo sapien
tccatgggtattaaaaggacactgt

SEQ ID NO: 523860 - DNA, 25 bp, Homo sapien
ctctgttgtttgtaatattctctta

SEQ ID NO: 523861 - DNA, 25 bp, Homo sapien
tttaacttctctctataaggaactg

SEQ ID NO: 523862 - DNA, 25 bp, Homo sapien
taacttctctctataaggaactgat

SEQ ID NO: 523863 - DNA, 25 bp, Homo sapien
gaactgatttcatctgaaattgaag

SEQ ID NO: 523864 - DNA, 25 bp, Homo sapien
gaaaaactatagaccactcatgatg

SEQ ID NO: 523865 - DNA, 25 bp, Homo sapien
actatagaccactcatgatggttgt

SEQ ID NO: 523866 - DNA, 25 bp, Homo sapien
agaccactcatgatggttgttatat

SEQ ID NO: 523867 - DNA, 25 bp, Homo sapien
atgatggttgttatatgtgcttggc

SEQ ID NO: 523868 - DNA, 25 bp, Homo sapien
gcttggctgggccatgggtcccagt

SEQ ID NO: 523869 - DNA, 25 bp, Homo sapien
ggtcccagtgtttggtgaaacacag

SEQ ID NO: 523870 - DNA, 25 bp, Homo sapien
tgaggtacagcggaccttcctggca

SEQ ID NO: 523871 - DNA, 25 bp, Homo sapien
acagcggaccttcctggcatcagaa

SEQ ID NO: 523872 - DNA, 25 bp, Homo sapien
aagagaggagacacagcgtccccat

SEQ ID NO: 523873 - DNA, 25 bp, Homo sapien
gatgcgaatgatcctgtcacccagg

SEQ ID NO: 523874 - DNA, 25 bp, Homo sapien
gaaagaggttccacaggtgtgcctt

SEQ ID NO: 523875 - DNA, 25 bp, Homo sapien
aggtgtgccttgattctgtcctaaa

SEQ ID NO: 523876 - DNA, 25 bp, Homo sapien
cttttcctggtgtgggcgcttctaa

SEQ ID NO: 523877 - DNA, 25 bp, Homo sapien
gcttctaacctaatcctcaatcgat

SEQ ID NO: 523878 - DNA, 25 bp, Homo sapien
attactctgtttccacagtgatact

SEQ ID NO: 523879 - DNA, 25 bp, Homo sapien
cagtgatactgtgtctaggttttag

SEQ ID NO: 523880 - DNA, 25 bp, Homo sapien
ggtagtgagtatagcacccagtgaa

SEQ ID NO: 523881 - DNA, 25 bp, Homo sapien
gaaactgtagtctcatgccaggcac

SEQ ID NO: 523882 - DNA, 25 bp, Homo sapien
gtgctagcccactctggctcattta

SEQ ID NO: 523883 - DNA, 25 bp, Homo sapien
gatctagaatcagtaattttgtgtt

SEQ ID NO: 523884 - DNA, 25 bp, Homo sapien
gaaccgaaacaagattagtcctgag

SEQ ID NO: 523885 - DNA, 25 bp, Homo sapien
tagtcctgagttaacaatggctgca

SEQ ID NO: 523886 - DNA, 25 bp, Homo sapien
ctgagttaacaatggctgcaagctg

SEQ ID NO: 523887 - DNA, 25 bp, Homo sapien
atggctgcaagctggatacatggaa

SEQ ID NO: 523888 - DNA, 25 bp, Homo sapien
gctgcaagctggatacatggaattc

SEQ ID NO: 523889 - DNA, 25 bp, Homo sapien
catggaattcagcacacttttctcc

SEQ ID NO: 523890 - DNA, 25 bp, Homo sapien
tggaattcagcacacttttctccct

SEQ ID NO: 523891 - DNA, 25 bp, Homo sapien
acttttctccctcttactgattatg

SEQ ID NO: 523892 - DNA, 25 bp, Homo sapien
ttctccctcttactgattatgcttt

SEQ ID NO: 523893 - DNA, 25 bp, Homo sapien
ccctcttactgattatgcttttgaa

SEQ ID NO: 523894 - DNA, 25 bp, Homo sapien
gacaaggtgctcagattattcaatt

SEQ ID NO: 523895 - DNA, 25 bp, Homo sapien
agattattcaattcgggatcctcct

SEQ ID NO: 523896 - DNA, 25 bp, Homo sapien
attcaattcgggatcctccttttgt

SEQ ID NO: 523897 - DNA, 25 bp, Homo sapien
tttgagacaaccctagacctaaact

SEQ ID NO: 523898 - DNA, 25 bp, Homo sapien
aaccctagacctaaactgtgtcaca

SEQ ID NO: 523899 - DNA, 25 bp, Homo sapien
aactgtgtcacagacttctgaatgt

SEQ ID NO: 523900 - DNA, 25 bp, Homo sapien
acttctgaatgtttaggcagtgcta

SEQ ID NO: 523901 - DNA, 25 bp, Homo sapien
ggcagtgctagtaatttcctcgtaa

SEQ ID NO: 523902 - DNA, 25 bp, Homo sapien
gtaatttcctcgtaatgattctgtt

SEQ ID NO: 523903 - DNA, 25 bp, Homo sapien
gattctgttattactttcctattct

SEQ ID NO: 523904 - DNA, 25 bp, Homo sapien
tactttcctattctttattcctctt

SEQ ID NO: 523905 - DNA, 25 bp, Homo sapien
tagatactaaatacagacacttcaa

SEQ ID NO: 523906 - DNA, 25 bp, Homo sapien
gatactaaatacagacacttcaata

SEQ ID NO: 523907 - DNA, 25 bp, Homo sapien
tactaaatacagacacttcaatatt

SEQ ID NO: 523908 - DNA, 25 bp, Homo sapien
attttgttgaagctattgactgtac

SEQ ID NO: 523909 - DNA, 25 bp, Homo sapien
gttgaagctattgactgtacaatta

SEQ ID NO: 523910 - DNA, 25 bp, Homo sapien
gaagctattgactgtacaattaaac

SEQ ID NO: 523911 - DNA, 25 bp, Homo sapien
agctattgactgtacaattaaacat

SEQ ID NO: 523912 - DNA, 25 bp, Homo sapien
agtgttacatatggctttgtacatt

SEQ ID NO: 523913 - DNA, 25 bp, Homo sapien
gttacatatggctttgtacattaaa

SEQ ID NO: 523914 - DNA, 25 bp, Homo sapien
acatatggctttgtacattaaagtt

SEQ ID NO: 523915 - DNA, 25 bp, Homo sapien
atggctttgtacattaaagttgaaa

SEQ ID NO: 523916 - DNA, 25 bp, Homo sapien
gaggagcaggcagttaccccgcaga

SEQ ID NO: 523917 - DNA, 25 bp, Homo sapien
agcaggcagttaccccgcagaaaga

SEQ ID NO: 523918 - DNA, 25 bp, Homo sapien
gttaccccgcagaaagaggaactag

SEQ ID NO: 523919 - DNA, 25 bp, Homo sapien
gagcctacatcaagacccaagtgaa

SEQ ID NO: 523920 - DNA, 25 bp, Homo sapien
acatcaagacccaagtgaacaaaga

SEQ ID NO: 523921 - DNA, 25 bp, Homo sapien
aaggccagcgaggaaaggctcagca

SEQ ID NO: 523922 - DNA, 25 bp, Homo sapien
aaggctcagcagcaagttgactgca

SEQ ID NO: 523923 - DNA, 25 bp, Homo sapien
aagttgactgcactagagcggccct

SEQ ID NO: 523924 - DNA, 25 bp, Homo sapien
tgactgcactagagcggcccttcca

SEQ ID NO: 523925 - DNA, 25 bp, Homo sapien
ccgggtaaaggcaagagcaagacca

SEQ ID NO: 523926 - DNA, 25 bp, Homo sapien
aagagcaagaccaagtgacccccaa

SEQ ID NO: 523927 - DNA, 25 bp, Homo sapien
ctcaggcttttttatgaacactctc

SEQ ID NO: 523928 - DNA, 25 bp, Homo sapien
ttttatgaacactctcatttcagta

SEQ ID NO: 523929 - DNA, 25 bp, Homo sapien
ttggaaaactaagcgtggttggaat

SEQ ID NO: 523930 - DNA, 25 bp, Homo sapien
ggttggaatttctttgaattctgtt

SEQ ID NO: 523931 - DNA, 25 bp, Homo sapien
gaattctgttagtaatgcccaaaag

SEQ ID NO: 523932 - DNA, 25 bp, Homo sapien
caaaagaaaagtctcaagcagtccc

SEQ ID NO: 523933 - DNA, 25 bp, Homo sapien
cccctatccagtcatttttatggag

SEQ ID NO: 523934 - DNA, 25 bp, Homo sapien
agaggaatttatgtaaccatgactt

SEQ ID NO: 523935 - DNA, 25 bp, Homo sapien
tgtaaccatgactttgtaattttga

SEQ ID NO: 523936 - DNA, 25 bp, Homo sapien
ttgtaattttgagaattcctcccag

SEQ ID NO: 523937 - DNA, 25 bp, Homo sapien
gaattcctcccagtgatggtcagta

SEQ ID NO: 523938 - DNA, 25 bp, Homo sapien
acagaagccatatgccggccagccg

SEQ ID NO: 523939 - DNA, 25 bp, Homo sapien
cagaagccatatgccggccagccgc

SEQ ID NO: 523940 - DNA, 25 bp, Homo sapien
agaagccatatgccggccagccgcg

SEQ ID NO: 523941 - DNA, 25 bp, Homo sapien
gaagccatatgccggccagccgcgc

SEQ ID NO: 523942 - DNA, 25 bp, Homo sapien
agccatatgccggccagccgcgcct

SEQ ID NO: 523943 - DNA, 25 bp, Homo sapien
gcctgtggttctagcaggttctatg

SEQ ID NO: 523944 - DNA, 25 bp, Homo sapien
cctgtggttctagcaggttctatgc

SEQ ID NO: 523945 - DNA, 25 bp, Homo sapien
ctgtggttctagcaggttctatgcc

SEQ ID NO: 523946 - DNA, 25 bp, Homo sapien
tgtggttctagcaggttctatgcca

SEQ ID NO: 523947 - DNA, 25 bp, Homo sapien
gtggttctagcaggttctatgccat

SEQ ID NO: 523948 - DNA, 25 bp, Homo sapien
tggttctagcaggttctatgccatc

SEQ ID NO: 523949 - DNA, 25 bp, Homo sapien
gaggtccagtatgcgggctgcttcc

SEQ ID NO: 523950 - DNA, 25 bp, Homo sapien
gctgcttccctaaaggataagtggg

SEQ ID NO: 523951 - DNA, 25 bp, Homo sapien
acaaaccaagttacagccgatcaaa

SEQ ID NO: 523952 - DNA, 25 bp, Homo sapien
gatcaaaaagcatttctgcttctgg

SEQ ID NO: 523953 - DNA, 25 bp, Homo sapien
ctggaagaccacctcttaagcgaat

SEQ ID NO: 523954 - DNA, 25 bp, Homo sapien
aagggcaagttctcgagtaggagaa

SEQ ID NO: 523955 - DNA, 25 bp, Homo sapien
gagaaactgaagagctcccagaaat

SEQ ID NO: 523956 - DNA, 25 bp, Homo sapien
gctcccagaaatccgtgtggatgca

SEQ ID NO: 523957 - DNA, 25 bp, Homo sapien
tggatgcagcatctcctggacctag

SEQ ID NO: 523958 - DNA, 25 bp, Homo sapien
gcatctcctggacctagagtaactt

SEQ ID NO: 523959 - DNA, 25 bp, Homo sapien
gagtaacttttaatatccaggatac

SEQ ID NO: 523960 - DNA, 25 bp, Homo sapien
aactgggtatacacactgtcctatt

SEQ ID NO: 523961 - DNA, 25 bp, Homo sapien
cacactgtcctatttttggaacttt

SEQ ID NO: 523962 - DNA, 25 bp, Homo sapien
gattgagtcgattctcgtttcaaaa

SEQ ID NO: 523963 - DNA, 25 bp, Homo sapien
gtttccaataggcatgatgccggca

SEQ ID NO: 523964 - DNA, 25 bp, Homo sapien
gatgccggcatgaatggtttcagca

SEQ ID NO: 523965 - DNA, 25 bp, Homo sapien
aatggtttcagcaggtcacaggcag

SEQ ID NO: 523966 - DNA, 25 bp, Homo sapien
agccggaatcccaaaatagcgccat

SEQ ID NO: 523967 - DNA, 25 bp, Homo sapien
atagcgccattgtgtggacaacctg

SEQ ID NO: 523968 - DNA, 25 bp, Homo sapien
gacaacctgactccttacaaacgtg

SEQ ID NO: 523969 - DNA, 25 bp, Homo sapien
ttacaaacgtgcagtggcttcccaa

SEQ ID NO: 523970 - DNA, 25 bp, Homo sapien
aacgctgcctttgagtttctgggtc

SEQ ID NO: 523971 - DNA, 25 bp, Homo sapien
atgagtgtgcctacttcactgtcac

SEQ ID NO: 523972 - DNA, 25 bp, Homo sapien
agacgtctcctcgtggatcgtgtat

SEQ ID NO: 523973 - DNA, 25 bp, Homo sapien
gtggatcgtgtatcccagcggcaag

SEQ ID NO: 523974 - DNA, 25 bp, Homo sapien
atcccagcggcaaggtgtatgtggc

SEQ ID NO: 523975 - DNA, 25 bp, Homo sapien
cgtgtggtgctgacctgtgagctat

SEQ ID NO: 523976 - DNA, 25 bp, Homo sapien
acctgtgagctatgccggccctggg

SEQ ID NO: 523977 - DNA, 25 bp, Homo sapien
cgcgctgctcctgcagaaggaagac

SEQ ID NO: 523978 - DNA, 25 bp, Homo sapien
gaaggaagacactgtccgccgcctg

SEQ ID NO: 523979 - DNA, 25 bp, Homo sapien
tgtccagctcgaggactccggcgag

SEQ ID NO: 523980 - DNA, 25 bp, Homo sapien
ggactccggcgagtacttgtgtgaa

SEQ ID NO: 523981 - DNA, 25 bp, Homo sapien
aaattgacgatgagtcggcctcctt

SEQ ID NO: 523982 - DNA, 25 bp, Homo sapien
cttctaattcccagtccacatgtaa

SEQ ID NO: 523983 - DNA, 25 bp, Homo sapien
acctaattgtaaatggcactgtagc

SEQ ID NO: 523984 - DNA, 25 bp, Homo sapien
ggcactgtagcaacaggcttctttt

SEQ ID NO: 523985 - DNA, 25 bp, Homo sapien
caggcttctttttaacacttggatt

SEQ ID NO: 523986 - DNA, 25 bp, Homo sapien
gcttctttttaacacttggattggt

SEQ ID NO: 523987 - DNA, 25 bp, Homo sapien
cacttggattggtaaaggtcttgtt

SEQ ID NO: 523988 - DNA, 25 bp, Homo sapien
atgcatgctaggctcactgcggcac

SEQ ID NO: 523989 - DNA, 25 bp, Homo sapien
atgctaggctcactgcggcactacg

SEQ ID NO: 523990 - DNA, 25 bp, Homo sapien
actgcggcactacgttactgggttc

SEQ ID NO: 523991 - DNA, 25 bp, Homo sapien
ggcactacgttactgggttctggca

SEQ ID NO: 523992 - DNA, 25 bp, Homo sapien
cactacgttactgggttctggcaat

SEQ ID NO: 523993 - DNA, 25 bp, Homo sapien
tgtatagttttctgtttgaatctct

SEQ ID NO: 523994 - DNA, 25 bp, Homo sapien
tgaatctctgagcaccaaagctgcc

SEQ ID NO: 523995 - DNA, 25 bp, Homo sapien
aaagctgccctttgattttcacgag

SEQ ID NO: 523996 - DNA, 25 bp, Homo sapien
tgattttcacgagaactttccaaag

SEQ ID NO: 523997 - DNA, 25 bp, Homo sapien
ctttggtgtctgacggtgatgctgc

SEQ ID NO: 523998 - DNA, 25 bp, Homo sapien
gtgatgctgcggtggcatctctgcc

SEQ ID NO: 523999 - DNA, 25 bp, Homo sapien
atctctgcccgtgaatttctgtatg

SEQ ID NO: 524000 - DNA, 25 bp, Homo sapien
ctgtatgtgtgtgctgttacctcac

SEQ ID NO: 524001 - DNA, 25 bp, Homo sapien
tgtgtgctgttacctcacctgcaga

SEQ ID NO: 524002 - DNA, 25 bp, Homo sapien
tcacctgcagacatgaccctagtaa

SEQ ID NO: 524003 - DNA, 25 bp, Homo sapien
gaccctagtaaatctaacgtgcttg

SEQ ID NO: 524004 - DNA, 25 bp, Homo sapien
agaccaaccctatcatagctggaat

SEQ ID NO: 524005 - DNA, 25 bp, Homo sapien
taaatctgtataactctcttcccct

SEQ ID NO: 524006 - DNA, 25 bp, Homo sapien
tcttcccctggatttaggtagctgg

SEQ ID NO: 524007 - DNA, 25 bp, Homo sapien
ctttgattttttcactttgagcact

SEQ ID NO: 524008 - DNA, 25 bp, Homo sapien
aggtagctggatcaggtttcctagc

SEQ ID NO: 524009 - DNA, 25 bp, Homo sapien
atcaggtttcctagctgtagccagt

SEQ ID NO: 524010 - DNA, 25 bp, Homo sapien
tgtagccagttccttgttcactaac

SEQ ID NO: 524011 - DNA, 25 bp, Homo sapien
tgttcactaacttgcttgagctgat

SEQ ID NO: 524012 - DNA, 25 bp, Homo sapien
agctgatgagctgtgggtctttcta

SEQ ID NO: 524013 - DNA, 25 bp, Homo sapien
aatagtgctatgactttactcaagg

SEQ ID NO: 524014 - DNA, 25 bp, Homo sapien
ggatgtgttctttagaccaacccta

SEQ ID NO: 524015 - DNA, 25 bp, Homo sapien
gcatgtctcatggtgtgaatgtgtt

SEQ ID NO: 524016 - DNA, 25 bp, Homo sapien
gaatgtgtttcctgctcacaggtac

SEQ ID NO: 524017 - DNA, 25 bp, Homo sapien
caggtaccgttttgtgtcatgcagt

SEQ ID NO: 524018 - DNA, 25 bp, Homo sapien
gttttgtgtcatgcagttactggaa

SEQ ID NO: 524019 - DNA, 25 bp, Homo sapien
tactggaatgtacaaaagcagctgt

SEQ ID NO: 524020 - DNA, 25 bp, Homo sapien
gctgtgatctttgtgagagctgcac

SEQ ID NO: 524021 - DNA, 25 bp, Homo sapien
gagcaggagtctttatttggttcac

SEQ ID NO: 524022 - DNA, 25 bp, Homo sapien
tttatttggttcacttctggtctgc

SEQ ID NO: 524023 - DNA, 25 bp, Homo sapien
ttggttcacttctggtctgcagcaa

SEQ ID NO: 524024 - DNA, 25 bp, Homo sapien
gtctgcagcaaccacttgctactaa

SEQ ID NO: 524025 - DNA, 25 bp, Homo sapien
gaaatgtatgaccttcagtcctccc

SEQ ID NO: 524026 - DNA, 25 bp, Homo sapien
agaaatggcatgtctttgatgctgt

SEQ ID NO: 524027 - DNA, 25 bp, Homo sapien
cagcaggcacaacatatctgtgtta

SEQ ID NO: 524028 - DNA, 25 bp, Homo sapien
atctgtgttagtgccacgtggtatc

SEQ ID NO: 524029 - DNA, 25 bp, Homo sapien
cacgtggtatctgttaagtatggcc

SEQ ID NO: 524030 - DNA, 25 bp, Homo sapien
aagtatggccagagcctcacatata

SEQ ID NO: 524031 - DNA, 25 bp, Homo sapien
ggccagagcctcacatataagtgaa

SEQ ID NO: 524032 - DNA, 25 bp, Homo sapien
gagttaagacaattcttgctctttg

SEQ ID NO: 524033 - DNA, 25 bp, Homo sapien
atttctattggcaaaccatcccaga

SEQ ID NO: 524034 - DNA, 25 bp, Homo sapien
ccagacaacctgacctatcaaacaa

SEQ ID NO: 524035 - DNA, 25 bp, Homo sapien
agcaaataatccctgtctcagaact

SEQ ID NO: 524036 - DNA, 25 bp, Homo sapien
gaactgctggtctaaaagctagaag

SEQ ID NO: 524037 - DNA, 25 bp, Homo sapien
attgtggtatcagagaatacaggta

SEQ ID NO: 524038 - DNA, 25 bp, Homo sapien
atttttcatatatcaggactatgtg

SEQ ID NO: 524039 - DNA, 25 bp, Homo sapien
caggactatgtgatgatacttaagc

SEQ ID NO: 524040 - DNA, 25 bp, Homo sapien
tatatgtttaatatcgagtatggat

SEQ ID NO: 524041 - DNA, 25 bp, Homo sapien
gagtatggataatgaaggacttttc

SEQ ID NO: 524042 - DNA, 25 bp, Homo sapien
tttttcaccttgtttataatgacat

SEQ ID NO: 524043 - DNA, 25 bp, Homo sapien
tcaccttgtttataatgacatttta

SEQ ID NO: 524044 - DNA, 25 bp, Homo sapien
aattcatgttaactgtactatttta

SEQ ID NO: 524045 - DNA, 25 bp, Homo sapien
catgttaactgtactattttattga

SEQ ID NO: 524046 - DNA, 25 bp, Homo sapien
gttaactgtactattttattgaaat

SEQ ID NO: 524047 - DNA, 25 bp, Homo sapien
tctagtcttattattggataattag

SEQ ID NO: 524048 - DNA, 25 bp, Homo sapien
gtggctttatgaagttaacagtctc

SEQ ID NO: 524049 - DNA, 25 bp, Homo sapien
gtttaccaatcaacagcatgtctac

SEQ ID NO: 524050 - DNA, 25 bp, Homo sapien
gcatgtctactgcttggatccatac

SEQ ID NO: 524051 - DNA, 25 bp, Homo sapien
aactatcggttcaagttgatgtgac

SEQ ID NO: 524052 - DNA, 25 bp, Homo sapien
aagggagcaccagatgacacataaa

SEQ ID NO: 524053 - DNA, 25 bp, Homo sapien
aatctgtctgattctatgcctgtat

SEQ ID NO: 524054 - DNA, 25 bp, Homo sapien
tatttccaacaaacttactgtcaga

SEQ ID NO: 524055 - DNA, 25 bp, Homo sapien
gacctaaatccattttctaaactgt

SEQ ID NO: 524056 - DNA, 25 bp, Homo sapien
caaattattctagtcaactgctgtt

SEQ ID NO: 524057 - DNA, 25 bp, Homo sapien
caactgctgttttatgtcatactct

SEQ ID NO: 524058 - DNA, 25 bp, Homo sapien
gtcatactctgtgtaatctctgatt

SEQ ID NO: 524059 - DNA, 25 bp, Homo sapien
tgggcatttttcaaagtgtccttga

SEQ ID NO: 524060 - DNA, 25 bp, Homo sapien
aagtgtccttgaattcactcagcaa

SEQ ID NO: 524061 - DNA, 25 bp, Homo sapien
gaatctctcaaaacttaggccctgc

SEQ ID NO: 524062 - DNA, 25 bp, Homo sapien
gccctgctccatttggccaaaaatg

SEQ ID NO: 524063 - DNA, 25 bp, Homo sapien
atggctgctccaaaactctgaactt

SEQ ID NO: 524064 - DNA, 25 bp, Homo sapien
aacttcttaaaactccatctgctac

SEQ ID NO: 524065 - DNA, 25 bp, Homo sapien
catctgctacattatttctggagtt

SEQ ID NO: 524066 - DNA, 25 bp, Homo sapien
aacatgactttttctgtctttgagt

SEQ ID NO: 524067 - DNA, 25 bp, Homo sapien
aaggctccaagctgtattctatact

SEQ ID NO: 524068 - DNA, 25 bp, Homo sapien
tacttgggaatccttggtgccatct

SEQ ID NO: 524069 - DNA, 25 bp, Homo sapien
ggtgccatctttattctaccaagtg

SEQ ID NO: 524070 - DNA, 25 bp, Homo sapien
gaaaaagtgtggacatcattatcca

SEQ ID NO: 524071 - DNA, 25 bp, Homo sapien
atcattatccacttgtcctggctgc

SEQ ID NO: 524072 - DNA, 25 bp, Homo sapien
ttctaaccatttcatgcccattcta

SEQ ID NO: 524073 - DNA, 25 bp, Homo sapien
atgcccattctagtgtgggcttctg

SEQ ID NO: 524074 - DNA, 25 bp, Homo sapien
tgctcatttggtttttcatatagtt

SEQ ID NO: 524075 - DNA, 25 bp, Homo sapien
taaatcagttgttactgtcaagatg

SEQ ID NO: 524076 - DNA, 25 bp, Homo sapien
atatcacagatgttagtagcgcagt

SEQ ID NO: 524077 - DNA, 25 bp, Homo sapien
gtagcgcagtgctgagtgcttctta

SEQ ID NO: 524078 - DNA, 25 bp, Homo sapien
gtgctgagtgcttcttaaacagtat

SEQ ID NO: 524079 - DNA, 25 bp, Homo sapien
attaacttacatgcttgatgaccat

SEQ ID NO: 524080 - DNA, 25 bp, Homo sapien
tgatgaccatgtgttcttgattaac

SEQ ID NO: 524081 - DNA, 25 bp, Homo sapien
tgatccctgtgtggctaacagaatt

SEQ ID NO: 524082 - DNA, 25 bp, Homo sapien
tatatagttctcttaattccccacc

SEQ ID NO: 524083 - DNA, 25 bp, Homo sapien
atttctttaggaacagatgcccagg

SEQ ID NO: 524084 - DNA, 25 bp, Homo sapien
tttaggaacagatgcccaggagtca

SEQ ID NO: 524085 - DNA, 25 bp, Homo sapien
ggaacagatgcccaggagtcatatt

SEQ ID NO: 524086 - DNA, 25 bp, Homo sapien
gatgcccaggagtcatattactgag

SEQ ID NO: 524087 - DNA, 25 bp, Homo sapien
gagaatctagaaatcttttgcaaag

SEQ ID NO: 524088 - DNA, 25 bp, Homo sapien
agttcttgttatattgccaaattgc

SEQ ID NO: 524089 - DNA, 25 bp, Homo sapien
gttgttctaaaccataatttcacca

SEQ ID NO: 524090 - DNA, 25 bp, Homo sapien
ccataatttcaccagcaatgtaggg

SEQ ID NO: 524091 - DNA, 25 bp, Homo sapien
gggagaaccatttttatgctgccct

SEQ ID NO: 524092 - DNA, 25 bp, Homo sapien
aacttcattgcagaattgctgcctg

SEQ ID NO: 524093 - DNA, 25 bp, Homo sapien
attgctgcctgacaaatggtttgac

SEQ ID NO: 524094 - DNA, 25 bp, Homo sapien
ggttgaagatcctgtccatggcatt

SEQ ID NO: 524095 - DNA, 25 bp, Homo sapien
tcctgtccatggcattcatctagaa

SEQ ID NO: 524096 - DNA, 25 bp, Homo sapien
accagtgcctttggaatttgtacag

SEQ ID NO: 524097 - DNA, 25 bp, Homo sapien
gtacagcaggctcaaagtctaactc

SEQ ID NO: 524098 - DNA, 25 bp, Homo sapien
gtctaactccccaggactataatct

SEQ ID NO: 524099 - DNA, 25 bp, Homo sapien
taatctgaggtggtcaggccttttg

SEQ ID NO: 524100 - DNA, 25 bp, Homo sapien
gtttactgaatgtcagccggactga

SEQ ID NO: 524101 - DNA, 25 bp, Homo sapien
gccggactgattggcacatggcatt

SEQ ID NO: 524102 - DNA, 25 bp, Homo sapien
catggcatttactgggatgtcccgt

SEQ ID NO: 524103 - DNA, 25 bp, Homo sapien
tttctttacctcctaatgcaaaggg

SEQ ID NO: 524104 - DNA, 25 bp, Homo sapien
gcaaagggagccttaaatgcccaca

SEQ ID NO: 524105 - DNA, 25 bp, Homo sapien
ggagccttaaatgcccacatgaaag

SEQ ID NO: 524106 - DNA, 25 bp, Homo sapien
gcaaagctcattgagttttactcac

SEQ ID NO: 524107 - DNA, 25 bp, Homo sapien
gttttactcactaaactgtaagctc

SEQ ID NO: 524108 - DNA, 25 bp, Homo sapien
tccttaagggccgaaatgtatctta

SEQ ID NO: 524109 - DNA, 25 bp, Homo sapien
gaaagaggcaggtattcgtactcct

SEQ ID NO: 524110 - DNA, 25 bp, Homo sapien
ggtattcgtactcctgttttagata

SEQ ID NO: 524111 - DNA, 25 bp, Homo sapien
aaaaaggattaattaccatggctgt

SEQ ID NO: 524112 - DNA, 25 bp, Homo sapien
ccatggctgtggtatgaaacttgtt

SEQ ID NO: 524113 - DNA, 25 bp, Homo sapien
aaaaacatgcttgacccttgcagcc

SEQ ID NO: 524114 - DNA, 25 bp, Homo sapien
gttcagtgctgatacatcatctttc

SEQ ID NO: 524115 - DNA, 25 bp, Homo sapien
gaaaggatgtaagttctgtctgtga

SEQ ID NO: 524116 - DNA, 25 bp, Homo sapien
gtgaagtaaaagagttacagccttt

SEQ ID NO: 524117 - DNA, 25 bp, Homo sapien
tatccctgaatacttacctgtattt

SEQ ID NO: 524118 - DNA, 25 bp, Homo sapien
acctgtattttaatctgaagtatga

SEQ ID NO: 524119 - DNA, 25 bp, Homo sapien
gaagtatgatcatttgtgccttcta

SEQ ID NO: 524120 - DNA, 25 bp, Homo sapien
gtgccttctaaagcagattatttaa

SEQ ID NO: 524121 - DNA, 25 bp, Homo sapien
tttaactgattaaagagtcccttga

SEQ ID NO: 524122 - DNA, 25 bp, Homo sapien
agagtcccttgaaattgatttttca

SEQ ID NO: 524123 - DNA, 25 bp, Homo sapien
tttcaagcgttagaaggttagccat

SEQ ID NO: 524124 - DNA, 25 bp, Homo sapien
gaaggttagccatgtaaaggtattt

SEQ ID NO: 524125 - DNA, 25 bp, Homo sapien
tgctttaaactgcatgctgccaagt

SEQ ID NO: 524126 - DNA, 25 bp, Homo sapien
agcatcctcgtttcaacacagtgtg

SEQ ID NO: 524127 - DNA, 25 bp, Homo sapien
cacagtgtgctctctagttatcatg

SEQ ID NO: 524128 - DNA, 25 bp, Homo sapien
tgtaacgtgggttctgtttagcgaa

SEQ ID NO: 524129 - DNA, 25 bp, Homo sapien
aggacacgttagagatgcccttccc

SEQ ID NO: 524130 - DNA, 25 bp, Homo sapien
cctgtggcaccattatggttttttg

SEQ ID NO: 524131 - DNA, 25 bp, Homo sapien
ggctgtttgtatatacggttacgta

SEQ ID NO: 524132 - DNA, 25 bp, Homo sapien
acgtattaactctggaatcctatgg

SEQ ID NO: 524133 - DNA, 25 bp, Homo sapien
aatcctatgggctcatcttgctcac

SEQ ID NO: 524134 - DNA, 25 bp, Homo sapien
tcatcttgctcacccaatgtgggag

SEQ ID NO: 524135 - DNA, 25 bp, Homo sapien
gcaagcgagctgaatgtgactatta

SEQ ID NO: 524136 - DNA, 25 bp, Homo sapien
gtttgtacaagtttagagcagccta

SEQ ID NO: 524137 - DNA, 25 bp, Homo sapien
agagcagcctagctcgagtcctcaa

SEQ ID NO: 524138 - DNA, 25 bp, Homo sapien
caaccccagtcctcttagaagtgaa

SEQ ID NO: 524139 - DNA, 25 bp, Homo sapien
gaactgattgcactggatccctaaa

SEQ ID NO: 524140 - DNA, 25 bp, Homo sapien
tggatccctaaacccacaatgttga

SEQ ID NO: 524141 - DNA, 25 bp, Homo sapien
gacacatgtgatgactccacttgct

SEQ ID NO: 524142 - DNA, 25 bp, Homo sapien
ccaccacttgtaactaccacttaat

SEQ ID NO: 524143 - DNA, 25 bp, Homo sapien
agtctttcagatttgaactgcttaa

SEQ ID NO: 524144 - DNA, 25 bp, Homo sapien
gaactgcttaaacaaaccctacaga

SEQ ID NO: 524145 - DNA, 25 bp, Homo sapien
aaaccctacagataaattggcactc

SEQ ID NO: 524146 - DNA, 25 bp, Homo sapien
ttggcactctgatttgtaattctgt

SEQ ID NO: 524147 - DNA, 25 bp, Homo sapien
gccacgtcccctaggagcagctgga

SEQ ID NO: 524148 - DNA, 25 bp, Homo sapien
gagatggccaaaagagtgagctcag

SEQ ID NO: 524149 - DNA, 25 bp, Homo sapien
gtgagctcaggactactggatccca

SEQ ID NO: 524150 - DNA, 25 bp, Homo sapien
actactggatcccatgcccaggtgt

SEQ ID NO: 524151 - DNA, 25 bp, Homo sapien
caggtgtccagcagacctcaaggca

SEQ ID NO: 524152 - DNA, 25 bp, Homo sapien
acctcaaggcagaagggtcacctaa

SEQ ID NO: 524153 - DNA, 25 bp, Homo sapien
ggtcacctaacccaggagtccacag

SEQ ID NO: 524154 - DNA, 25 bp, Homo sapien
gagtccacagactgatgtgacctca

SEQ ID NO: 524155 - DNA, 25 bp, Homo sapien
atgtgacctcaggttcccacatcag

SEQ ID NO: 524156 - DNA, 25 bp, Homo sapien
tcaggttcccacatcagtggccaca

SEQ ID NO: 524157 - DNA, 25 bp, Homo sapien
cccacctggtagaagtgttctggat

SEQ ID NO: 524158 - DNA, 25 bp, Homo sapien
gtcttggtcaattcagatgatacgt

SEQ ID NO: 524159 - DNA, 25 bp, Homo sapien
gatacgtgaacctgataaatgctct

SEQ ID NO: 524160 - DNA, 25 bp, Homo sapien
gatatgctattttgtcctgtattgc

SEQ ID NO: 524161 - DNA, 25 bp, Homo sapien
attttgtcctgtattgcttgtttta

SEQ ID NO: 524162 - DNA, 25 bp, Homo sapien
gcttgttttacagtatggtgcatgt

SEQ ID NO: 524163 - DNA, 25 bp, Homo sapien
atggtgcatgttgtttgctaagtaa

SEQ ID NO: 524164 - DNA, 25 bp, Homo sapien
aaaattttgcacatatgcttcttga

SEQ ID NO: 524165 - DNA, 25 bp, Homo sapien
catatgcttcttgatattctgaaat

SEQ ID NO: 524166 - DNA, 25 bp, Homo sapien
attctgaaatgtattctgtggctta

SEQ ID NO: 524167 - DNA, 25 bp, Homo sapien
gtattctgtggcttaattatcttat

SEQ ID NO: 524168 - DNA, 25 bp, Homo sapien
gtggcttaattatcttattcataca

SEQ ID NO: 524169 - DNA, 25 bp, Homo sapien
tacacccaggatcctgctgagaaca

SEQ ID NO: 524170 - DNA, 25 bp, Homo sapien
gctgagaacagcaaccaactcacca

SEQ ID NO: 524171 - DNA, 25 bp, Homo sapien
gtgtgatacccagggcacacgcgtt

SEQ ID NO: 524172 - DNA, 25 bp, Homo sapien
tgctgccagccaccttgagtgaaga

SEQ ID NO: 524173 - DNA, 25 bp, Homo sapien
ccttgagtgaagatccgggttctct

SEQ ID NO: 524174 - DNA, 25 bp, Homo sapien
ttctctgggtgctactcagctgcta

SEQ ID NO: 524175 - DNA, 25 bp, Homo sapien
gcacacgcgtttgcacaggcacagg

SEQ ID NO: 524176 - DNA, 25 bp, Homo sapien
acaggccacacaagttctcacatgc

SEQ ID NO: 524177 - DNA, 25 bp, Homo sapien
atgctcagccccataagccgtgctg

SEQ ID NO: 524178 - DNA, 25 bp, Homo sapien
aagccgtgctggacaggcatggcca

SEQ ID NO: 524179 - DNA, 25 bp, Homo sapien
aggcatggccatttacacccaggat

SEQ ID NO: 524180 - DNA, 25 bp, Homo sapien
ccttcatggcagtaggctctaagtg

SEQ ID NO: 524181 - DNA, 25 bp, Homo sapien
ggctctaagtgggtgactggccaca

SEQ ID NO: 524182 - DNA, 25 bp, Homo sapien
tggccacaggccgagaaaagggtac

SEQ ID NO: 524183 - DNA, 25 bp, Homo sapien
agaaaagggtacagcctctaggtgg

SEQ ID NO: 524184 - DNA, 25 bp, Homo sapien
gccttcaggctggactgagctgctc

SEQ ID NO: 524185 - DNA, 25 bp, Homo sapien
gactgagctgctctcccacagggtt

SEQ ID NO: 524186 - DNA, 25 bp, Homo sapien
agctgctctcccacagggtttctgt

SEQ ID NO: 524187 - DNA, 25 bp, Homo sapien
ttctctgttgcatacatgcctggca

SEQ ID NO: 524188 - DNA, 25 bp, Homo sapien
ctgttgcatacatgcctggcatctg

SEQ ID NO: 524189 - DNA, 25 bp, Homo sapien
tctgagcaggctgtatctggattct

SEQ ID NO: 524190 - DNA, 25 bp, Homo sapien
agcaggctgtatctggattctggca

SEQ ID NO: 524191 - DNA, 25 bp, Homo sapien
attctatgatatttccctcatctcc

SEQ ID NO: 524192 - DNA, 25 bp, Homo sapien
ttccctcatctccatagaataccag

SEQ ID NO: 524193 - DNA, 25 bp, Homo sapien
gaataccagcttctgaatcctcaat

SEQ ID NO: 524194 - DNA, 25 bp, Homo sapien
aatcctcaatcagcctttactgcaa

SEQ ID NO: 524195 - DNA, 25 bp, Homo sapien
atcagcctttactgcaagaagaaaa

SEQ ID NO: 524196 - DNA, 25 bp, Homo sapien
aaaacctctctcattccaggtctgt

SEQ ID NO: 524197 - DNA, 25 bp, Homo sapien
tctcattccaggtctgtggtgcaga

SEQ ID NO: 524198 - DNA, 25 bp, Homo sapien
tagtcaaaacccattaaggccttag

SEQ ID NO: 524199 - DNA, 25 bp, Homo sapien
gccttagtcaaatgccagccgaatt

SEQ ID NO: 524200 - DNA, 25 bp, Homo sapien
gccagccgaattagaacgcaatgaa

SEQ ID NO: 524201 - DNA, 25 bp, Homo sapien
ttagacaaaacaacccaactggcca

SEQ ID NO: 524202 - DNA, 25 bp, Homo sapien
ttgcaattgggccagatgctaattt

SEQ ID NO: 524203 - DNA, 25 bp, Homo sapien
gatgctaatttgcacgttgattcac

SEQ ID NO: 524204 - DNA, 25 bp, Homo sapien
atttgcacgttgattcaccttcttt

SEQ ID NO: 524205 - DNA, 25 bp, Homo sapien
acgttgattcaccttctttgccttt

SEQ ID NO: 524206 - DNA, 25 bp, Homo sapien
gaatgtaccatttcaactttgattt

SEQ ID NO: 524207 - DNA, 25 bp, Homo sapien
atagtgctagttgatattggtaata

SEQ ID NO: 524208 - DNA, 25 bp, Homo sapien
ttagctgaagtcatttaaagatgga

SEQ ID NO: 524209 - DNA, 25 bp, Homo sapien
gatatttgatgtcattgtatccaca

SEQ ID NO: 524210 - DNA, 25 bp, Homo sapien
gtcattgtatccacatttgttgtaa

SEQ ID NO: 524211 - DNA, 25 bp, Homo sapien
gtatccacatttgttgtaagacata

SEQ ID NO: 524212 - DNA, 25 bp, Homo sapien
gttgtaagacatattgcataccaat

SEQ ID NO: 524213 - DNA, 25 bp, Homo sapien
agcactgcacacaatagacctgtta

SEQ ID NO: 524214 - DNA, 25 bp, Homo sapien
gcacacaatagacctgttacttccc

SEQ ID NO: 524215 - DNA, 25 bp, Homo sapien
tcacgagcactcctaatatttcatg

SEQ ID NO: 524216 - DNA, 25 bp, Homo sapien
aatatttcatgtgctcatccaattg

SEQ ID NO: 524217 - DNA, 25 bp, Homo sapien
atgtgctcatccaattgacttctcc

SEQ ID NO: 524218 - DNA, 25 bp, Homo sapien
atccaattgacttctcccactggtg

SEQ ID NO: 524219 - DNA, 25 bp, Homo sapien
tcccactggtgcctcatattgaatt

SEQ ID NO: 524220 - DNA, 25 bp, Homo sapien
atttgtagaatcacacctgctcctt

SEQ ID NO: 524221 - DNA, 25 bp, Homo sapien
aataattcactgaccccaaagttgt

SEQ ID NO: 524222 - DNA, 25 bp, Homo sapien
gatatttgaagactactcgcacaat

SEQ ID NO: 524223 - DNA, 25 bp, Homo sapien
gaagactactcgcacaattttaata

SEQ ID NO: 524224 - DNA, 25 bp, Homo sapien
caggtcccgaggtccacagcggtcc

SEQ ID NO: 524225 - DNA, 25 bp, Homo sapien
atccgggcgggcgtcggcgtggagg

SEQ ID NO: 524226 - DNA, 25 bp, Homo sapien
ggaggaagcagtgccttcaatcatc

SEQ ID NO: 524227 - DNA, 25 bp, Homo sapien
gtgccttcaatcatcgggggaacag

SEQ ID NO: 524228 - DNA, 25 bp, Homo sapien
aggccaggggcaactgatccggact

SEQ ID NO: 524229 - DNA, 25 bp, Homo sapien
caactgatccggactgcccacgctg

SEQ ID NO: 524230 - DNA, 25 bp, Homo sapien
acgctgccagtgctggagcttccat

SEQ ID NO: 524231 - DNA, 25 bp, Homo sapien
agtgctggagcttccatcgcctagg

SEQ ID NO: 524232 - DNA, 25 bp, Homo sapien
tgctggagcttccatcgcctaggtc

SEQ ID NO: 524233 - DNA, 25 bp, Homo sapien
tggagcttccatcgcctaggtcgcg

SEQ ID NO: 524234 - DNA, 25 bp, Homo sapien
gggcaaggcaagctcgggtgctggc

SEQ ID NO: 524235 - DNA, 25 bp, Homo sapien
atagttcacatcctggatctcactc

SEQ ID NO: 524236 - DNA, 25 bp, Homo sapien
tgttctcattcagcttcttcttcgt

SEQ ID NO: 524237 - DNA, 25 bp, Homo sapien
aggtcctcttcttcaaccaggaagt

SEQ ID NO: 524238 - DNA, 25 bp, Homo sapien
aaccaggaagttgtgcagctttgaa

SEQ ID NO: 524239 - DNA, 25 bp, Homo sapien
agctttgaaaactccgtgctgattc

SEQ ID NO: 524240 - DNA, 25 bp, Homo sapien
gtgctgattctcattcgctgactct

SEQ ID NO: 524241 - DNA, 25 bp, Homo sapien
tggatctcactcctggtcaacactt

SEQ ID NO: 524242 - DNA, 25 bp, Homo sapien
attcgctgactctttatcttatcct

SEQ ID NO: 524243 - DNA, 25 bp, Homo sapien
ttatcttatccttccactgtgtggc

SEQ ID NO: 524244 - DNA, 25 bp, Homo sapien
ggtcaacacttcttttggattctga

SEQ ID NO: 524245 - DNA, 25 bp, Homo sapien
ttggattctgaagcagctccagggt

SEQ ID NO: 524246 - DNA, 25 bp, Homo sapien
agtagctttttattcagcagtctag

SEQ ID NO: 524247 - DNA, 25 bp, Homo sapien
ctttttattcagcagtctaggtcct

SEQ ID NO: 524248 - DNA, 25 bp, Homo sapien
taggtcctgcattcccaatgtgaaa

SEQ ID NO: 524249 - DNA, 25 bp, Homo sapien
gtcctgcattcccaatgtgaaattg

SEQ ID NO: 524250 - DNA, 25 bp, Homo sapien
caaaacacacaccttagatagaata

SEQ ID NO: 524251 - DNA, 25 bp, Homo sapien
agaataatggttcgtgaccttccaa

SEQ ID NO: 524252 - DNA, 25 bp, Homo sapien
taatggttcgtgaccttccaaagct

SEQ ID NO: 524253 - DNA, 25 bp, Homo sapien
ggttcgtgaccttccaaagctcaat

SEQ ID NO: 524254 - DNA, 25 bp, Homo sapien
gtgaccttccaaagctcaatcttac

SEQ ID NO: 524255 - DNA, 25 bp, Homo sapien
agctcaatcttacccaacaaaatcc

SEQ ID NO: 524256 - DNA, 25 bp, Homo sapien
tcttacccaacaaaatcctattctt

SEQ ID NO: 524257 - DNA, 25 bp, Homo sapien
ctctgctcttgcgtaaagatgaccg

SEQ ID NO: 524258 - DNA, 25 bp, Homo sapien
gatgaccgatggagtccaaagccaa

SEQ ID NO: 524259 - DNA, 25 bp, Homo sapien
aagccaagtggcttcaccagctgac

SEQ ID NO: 524260 - DNA, 25 bp, Homo sapien
cagcctgagtttcacagtccactgg

SEQ ID NO: 524261 - DNA, 25 bp, Homo sapien
gtttgaatggttaagcccttgcagt

SEQ ID NO: 524262 - DNA, 25 bp, Homo sapien
cccttgcagtatttcagatcgggca

SEQ ID NO: 524263 - DNA, 25 bp, Homo sapien
ttgctttgtactcctcactgtttct

SEQ ID NO: 524264 - DNA, 25 bp, Homo sapien
tctgcctacgcaaaatatccatgtt

SEQ ID NO: 524265 - DNA, 25 bp, Homo sapien
gtttcctctgagaaatctgttgtgg

SEQ ID NO: 524266 - DNA, 25 bp, Homo sapien
tctgttgtggactgaaagcgctgct

SEQ ID NO: 524267 - DNA, 25 bp, Homo sapien
tgaaagcgctgctggctgtgaaatt

SEQ ID NO: 524268 - DNA, 25 bp, Homo sapien
actccaaagaacattatctatattg

SEQ ID NO: 524269 - DNA, 25 bp, Homo sapien
gtaatggcatagacatgtgtggtaa

SEQ ID NO: 524270 - DNA, 25 bp, Homo sapien
aactaaaagttctatacgcttcagg

SEQ ID NO: 524271 - DNA, 25 bp, Homo sapien
aaaagttctatacgcttcaggatat

SEQ ID NO: 524272 - DNA, 25 bp, Homo sapien
ataaggcaggaagtggatagcattg

SEQ ID NO: 524273 - DNA, 25 bp, Homo sapien
tggtggttatgtttggttactttag

SEQ ID NO: 524274 - DNA, 25 bp, Homo sapien
tgtttggttactttagttatgttag

SEQ ID NO: 524275 - DNA, 25 bp, Homo sapien
aaaagcaagctgttgaagaacatgg

SEQ ID NO: 524276 - DNA, 25 bp, Homo sapien
ttgaagaacatggtcagtatcctct

SEQ ID NO: 524277 - DNA, 25 bp, Homo sapien
ggtcagtatcctctcacttatgtaa

SEQ ID NO: 524278 - DNA, 25 bp, Homo sapien
gtatcctctcacttatgtaagttaa

SEQ ID NO: 524279 - DNA, 25 bp, Homo sapien
gcattaaacacagcttcgcaccatt

SEQ ID NO: 524280 - DNA, 25 bp, Homo sapien
gcttcgcaccattgaataaactcag

SEQ ID NO: 524281 - DNA, 25 bp, Homo sapien
taaactcagcaacaagccaatgcat

SEQ ID NO: 524282 - DNA, 25 bp, Homo sapien
aaagtaatctatgcttcaggtcaca

SEQ ID NO: 524283 - DNA, 25 bp, Homo sapien
aaacagaatactctagggccattgt

SEQ ID NO: 524284 - DNA, 25 bp, Homo sapien
tggacattgtccttccaactctggg

SEQ ID NO: 524285 - DNA, 25 bp, Homo sapien
tctagggccattgttcacaaactca

SEQ ID NO: 524286 - DNA, 25 bp, Homo sapien
acaaactcatctgaaaacatcctgg

SEQ ID NO: 524287 - DNA, 25 bp, Homo sapien
tccaactctgggaagctgctaagac

SEQ ID NO: 524288 - DNA, 25 bp, Homo sapien
agctgctaagactctgtccttactg

SEQ ID NO: 524289 - DNA, 25 bp, Homo sapien
gaagaaaaaacagccttgtaccctg

SEQ ID NO: 524290 - DNA, 25 bp, Homo sapien
gtgtgtgcctgtccagtgtatattg

SEQ ID NO: 524291 - DNA, 25 bp, Homo sapien
gtgcctgtccagtgtatattgtgtc

SEQ ID NO: 524292 - DNA, 25 bp, Homo sapien
gcctgtccagtgtatattgtgtctt

SEQ ID NO: 524293 - DNA, 25 bp, Homo sapien
gtgtatattgtgtcttagcttccat

SEQ ID NO: 524294 - DNA, 25 bp, Homo sapien
attgtgtcttagcttccattttaaa

SEQ ID NO: 524295 - DNA, 25 bp, Homo sapien
gttctgtacagagagagatgcagca

SEQ ID NO: 524296 - DNA, 25 bp, Homo sapien
caccgggtgtctgcggtaggaacaa

SEQ ID NO: 524297 - DNA, 25 bp, Homo sapien
aagagggctgagagggtctggtcct

SEQ ID NO: 524298 - DNA, 25 bp, Homo sapien
cttgggctcagcacgaaagggcttt

SEQ ID NO: 524299 - DNA, 25 bp, Homo sapien
ggctcagcacgaaagggctttcaat

SEQ ID NO: 524300 - DNA, 25 bp, Homo sapien
aagggctttcaatgaattaagtgaa

SEQ ID NO: 524301 - DNA, 25 bp, Homo sapien
gtgaagaagacatgcttcaggcagc

SEQ ID NO: 524302 - DNA, 25 bp, Homo sapien
ttcaggcagctgtgaccatgtcttt

SEQ ID NO: 524303 - DNA, 25 bp, Homo sapien
aggcagctgtgaccatgtctttaga

SEQ ID NO: 524304 - DNA, 25 bp, Homo sapien
cagctgtgaccatgtctttagaaac

SEQ ID NO: 524305 - DNA, 25 bp, Homo sapien
tatcctgtgtgattacagcataggg

SEQ ID NO: 524306 - DNA, 25 bp, Homo sapien
gtgattacagcatagggtccacttt

SEQ ID NO: 524307 - DNA, 25 bp, Homo sapien
tacagcatagggtccactttggtaa

SEQ ID NO: 524308 - DNA, 25 bp, Homo sapien
gggtccactttggtaatgtgtcaaa

SEQ ID NO: 524309 - DNA, 25 bp, Homo sapien
gaaataagacttttagcggtttgca

SEQ ID NO: 524310 - DNA, 25 bp, Homo sapien
aatgatcttccaaatattagccaaa

SEQ ID NO: 524311 - DNA, 25 bp, Homo sapien
gccaaagaggcattcagcaattaaa

SEQ ID NO: 524312 - DNA, 25 bp, Homo sapien
cttttgcagatcgtaaattgcattt

SEQ ID NO: 524313 - DNA, 25 bp, Homo sapien
aattgcatttgcctagtcgtgtgac

SEQ ID NO: 524314 - DNA, 25 bp, Homo sapien
atttgcctagtcgtgtgacctcaaa

SEQ ID NO: 524315 - DNA, 25 bp, Homo sapien
tagtcgtgtgacctcaaaagaagtc

SEQ ID NO: 524316 - DNA, 25 bp, Homo sapien
gaagtcagacatatttaatccagaa

SEQ ID NO: 524317 - DNA, 25 bp, Homo sapien
aatccagaaatagtttcgtttgagg

SEQ ID NO: 524318 - DNA, 25 bp, Homo sapien
gggcttgcaggtctgtaaatagcat

SEQ ID NO: 524319 - DNA, 25 bp, Homo sapien
atagcatttgctttcctggttagag

SEQ ID NO: 524320 - DNA, 25 bp, Homo sapien
tttcctggttagagattgggatgca

SEQ ID NO: 524321 - DNA, 25 bp, Homo sapien
gggtgaattctcttgccgtgttgca

SEQ ID NO: 524322 - DNA, 25 bp, Homo sapien
tctcttgccgtgttgcaaatgtgta

SEQ ID NO: 524323 - DNA, 25 bp, Homo sapien
ttacttctttatcctcatctgcagt

SEQ ID NO: 524324 - DNA, 25 bp, Homo sapien
tatcctcatctgcagttgtcatatt

SEQ ID NO: 524325 - DNA, 25 bp, Homo sapien
tgtcatatttgtgaactcgcggcaa

SEQ ID NO: 524326 - DNA, 25 bp, Homo sapien
aactcgcggcaagtgagatattgct

SEQ ID NO: 524327 - DNA, 25 bp, Homo sapien
ttgatcaataaaccattgtctcccc

SEQ ID NO: 524328 - DNA, 25 bp, Homo sapien
tctcccccagctgtgttagtgtttt

SEQ ID NO: 524329 - DNA, 25 bp, Homo sapien
gtttttgtgtattcagttctataat

SEQ ID NO: 524330 - DNA, 25 bp, Homo sapien
gatcaggccaaatttttatgtggga

SEQ ID NO: 524331 - DNA, 25 bp, Homo sapien
gtactttgctacattgacttggtga

SEQ ID NO: 524332 - DNA, 25 bp, Homo sapien
gacttggtgacattatttcagtggc

SEQ ID NO: 524333 - DNA, 25 bp, Homo sapien
ttatttcagtggctcaactctcttc

SEQ ID NO: 524334 - DNA, 25 bp, Homo sapien
atcctgctgccgaaccagaatggca

SEQ ID NO: 524335 - DNA, 25 bp, Homo sapien
tcccagtgtcattggtgaaggcctt

SEQ ID NO: 524336 - DNA, 25 bp, Homo sapien
ggattcgaggcagctgagtcctcac

SEQ ID NO: 524337 - DNA, 25 bp, Homo sapien
ctgagtcctcactgaccaaggatgc

SEQ ID NO: 524338 - DNA, 25 bp, Homo sapien
aaggatgcccttgtgcttactccag

SEQ ID NO: 524339 - DNA, 25 bp, Homo sapien
gcttactccagcctccttgtggaaa

SEQ ID NO: 524340 - DNA, 25 bp, Homo sapien
tcctgtctcccagtgaagacttgga

SEQ ID NO: 524341 - DNA, 25 bp, Homo sapien
gtgaagacttggatggcagccatca

SEQ ID NO: 524342 - DNA, 25 bp, Homo sapien
agccatcagggaaggctgggtccca

SEQ ID NO: 524343 - DNA, 25 bp, Homo sapien
ggtgtgagctctatagaccatccct

SEQ ID NO: 524344 - DNA, 25 bp, Homo sapien
atccctctctgcaatcaataaacac

SEQ ID NO: 524345 - DNA, 25 bp, Homo sapien
taagtgtgcactaagcctggaccac

SEQ ID NO: 524346 - DNA, 25 bp, Homo sapien
ggacatagtggttccaataaacacg

SEQ ID NO: 524347 - DNA, 25 bp, Homo sapien
acacgaataagccagttttcacatt

SEQ ID NO: 524348 - DNA, 25 bp, Homo sapien
agagaaataccagtttcttgcagaa

SEQ ID NO: 524349 - DNA, 25 bp, Homo sapien
gtttcttgcagaaatgcggtgcttt

SEQ ID NO: 524350 - DNA, 25 bp, Homo sapien
aagtcgtgctgagtgtctgggcttc

SEQ ID NO: 524351 - DNA, 25 bp, Homo sapien
gcagaaatgcggtgcttttaaaaga

SEQ ID NO: 524352 - DNA, 25 bp, Homo sapien
cagcaggtaattgttcgtggcacgt

SEQ ID NO: 524353 - DNA, 25 bp, Homo sapien
attgttcgtggcacgttgtggcaga

SEQ ID NO: 524354 - DNA, 25 bp, Homo sapien
ctgggcttcttctaggaaggtattt

SEQ ID NO: 524355 - DNA, 25 bp, Homo sapien
ggaaggtatttccaatcatcaaatg

SEQ ID NO: 524356 - DNA, 25 bp, Homo sapien
ttaattttatatcatgacccccttt

SEQ ID NO: 524357 - DNA, 25 bp, Homo sapien
ttttaagccagtgagctgggcttca

SEQ ID NO: 524358 - DNA, 25 bp, Homo sapien
gcttcagtttttcccaggccatgca

SEQ ID NO: 524359 - DNA, 25 bp, Homo sapien
cccaggccatgcacatttaatttat

SEQ ID NO: 524360 - DNA, 25 bp, Homo sapien
agagaaactctaattgtattttcac

SEQ ID NO: 524361 - DNA, 25 bp, Homo sapien
gtattttcactgcagtatcttgtat

SEQ ID NO: 524362 - DNA, 25 bp, Homo sapien
tcactgcagtatcttgtatttttta

SEQ ID NO: 524363 - DNA, 25 bp, Homo sapien
tacacagacacaataatggctaaca

SEQ ID NO: 524364 - DNA, 25 bp, Homo sapien
tggctaacattgtttctttcattcc

SEQ ID NO: 524365 - DNA, 25 bp, Homo sapien
gagctaaccactctaaaattgtttg

SEQ ID NO: 524366 - DNA, 25 bp, Homo sapien
aattgtttggtaatgtcacttagtg

SEQ ID NO: 524367 - DNA, 25 bp, Homo sapien
gaaactaacaatgatttaaccacag

SEQ ID NO: 524368 - DNA, 25 bp, Homo sapien
gaagcagacttttgggcctaaggaa

SEQ ID NO: 524369 - DNA, 25 bp, Homo sapien
gggcctaaggaatagacacaatata

SEQ ID NO: 524370 - DNA, 25 bp, Homo sapien
aatataatttggtagcatagcggga

SEQ ID NO: 524371 - DNA, 25 bp, Homo sapien
gtagcatagcgggaacaaaggatta

SEQ ID NO: 524372 - DNA, 25 bp, Homo sapien
tctcctttacttctggtctcaataa

SEQ ID NO: 524373 - DNA, 25 bp, Homo sapien
ttacttctggtctcaataacaaaat

SEQ ID NO: 524374 - DNA, 25 bp, Homo sapien
aaatcaatatatccatgctctaaac

SEQ ID NO: 524375 - DNA, 25 bp, Homo sapien
tatccatgctctaaactaattacag

SEQ ID NO: 524376 - DNA, 25 bp, Homo sapien
ggttgtaaacccaaatgtaatatag

SEQ ID NO: 524377 - DNA, 25 bp, Homo sapien
atatagagcaatggctcttaagtcc

SEQ ID NO: 524378 - DNA, 25 bp, Homo sapien
ggctcatggctcagatggcgaccac

SEQ ID NO: 524379 - DNA, 25 bp, Homo sapien
gctcatggctcagatggcgaccacg

SEQ ID NO: 524380 - DNA, 25 bp, Homo sapien
ctcatggctcagatggcgaccacgg

SEQ ID NO: 524381 - DNA, 25 bp, Homo sapien
tcatggctcagatggcgaccacggc

SEQ ID NO: 524382 - DNA, 25 bp, Homo sapien
gctcagatggcgaccacggccgcag

SEQ ID NO: 524383 - DNA, 25 bp, Homo sapien
gggctcggctgtgggacacgtcatg

SEQ ID NO: 524384 - DNA, 25 bp, Homo sapien
tcggctgtgggacacgtcatgggca

SEQ ID NO: 524385 - DNA, 25 bp, Homo sapien
tgggacacgtcatgggcagcgccct

SEQ ID NO: 524386 - DNA, 25 bp, Homo sapien
tgggcagcgccctgaccggagcctt

SEQ ID NO: 524387 - DNA, 25 bp, Homo sapien
cgccctgaccggagccttcagcggg

SEQ ID NO: 524388 - DNA, 25 bp, Homo sapien
gggccctgcgcctatgagatcaggc

SEQ ID NO: 524389 - DNA, 25 bp, Homo sapien
gcagtgggctgtaaactccagcata

SEQ ID NO: 524390 - DNA, 25 bp, Homo sapien
gatgtggatagcttgatgcgatctg

SEQ ID NO: 524391 - DNA, 25 bp, Homo sapien
atgcgatctgtgagccgagtcttta

SEQ ID NO: 524392 - DNA, 25 bp, Homo sapien
gagccgagtctttaagttcattgac

SEQ ID NO: 524393 - DNA, 25 bp, Homo sapien
gttcattgacatgccaacagaaggt

SEQ ID NO: 524394 - DNA, 25 bp, Homo sapien
gaatggccaactctcgaaagttatg

SEQ ID NO: 524395 - DNA, 25 bp, Homo sapien
gaaagatgacatctggccctcaggg

SEQ ID NO: 524396 - DNA, 25 bp, Homo sapien
atgactgtcaaagatctcacagcaa

SEQ ID NO: 524397 - DNA, 25 bp, Homo sapien
tgccatattagagaacatttccttc

SEQ ID NO: 524398 - DNA, 25 bp, Homo sapien
tttccttctcaataagtcctggcca

SEQ ID NO: 524399 - DNA, 25 bp, Homo sapien
tctcaataagtcctggccagagggt

SEQ ID NO: 524400 - DNA, 25 bp, Homo sapien
aatggcagtgttgggattaaaatcc

SEQ ID NO: 524401 - DNA, 25 bp, Homo sapien
gggattaaaatccagttcttatcta

SEQ ID NO: 524402 - DNA, 25 bp, Homo sapien
agttcttatctactctccctttatt

SEQ ID NO: 524403 - DNA, 25 bp, Homo sapien
cttatctactctccctttattcaga

SEQ ID NO: 524404 - DNA, 25 bp, Homo sapien
gcatttattggatgttgatctttgt

SEQ ID NO: 524405 - DNA, 25 bp, Homo sapien
gtgtatattttcctcagtctaccct

SEQ ID NO: 524406 - DNA, 25 bp, Homo sapien
atattttcctcagtctacccttctg

SEQ ID NO: 524407 - DNA, 25 bp, Homo sapien
ttctgctctagattgtctggactca

SEQ ID NO: 524408 - DNA, 25 bp, Homo sapien
ttgtctggactcaggagattgtggc

SEQ ID NO: 524409 - DNA, 25 bp, Homo sapien
gtggcagttactggatagttatttt

SEQ ID NO: 524410 - DNA, 25 bp, Homo sapien
aagtcatgtgtacttattgtagaaa

SEQ ID NO: 524411 - DNA, 25 bp, Homo sapien
gtttcagtcatttccggactaactg

SEQ ID NO: 524412 - DNA, 25 bp, Homo sapien
ttccggactaactgtgacaacgcgt

SEQ ID NO: 524413 - DNA, 25 bp, Homo sapien
tgacaacgcgtgagcagggagcacc

SEQ ID NO: 524414 - DNA, 25 bp, Homo sapien
gagtctccgggagggaatcctcctg

SEQ ID NO: 524415 - DNA, 25 bp, Homo sapien
agggagcaggcatgtccacccgcaa

SEQ ID NO: 524416 - DNA, 25 bp, Homo sapien
atgtccacccgcaagcctgggaggc

SEQ ID NO: 524417 - DNA, 25 bp, Homo sapien
agcctgggaggctaactctggcatt

SEQ ID NO: 524418 - DNA, 25 bp, Homo sapien
taactctggcattcctggccggagc

SEQ ID NO: 524419 - DNA, 25 bp, Homo sapien
gccatgctcattggtgggccagttt

SEQ ID NO: 524420 - DNA, 25 bp, Homo sapien
cagtttgggacatccccgtactcaa

SEQ ID NO: 524421 - DNA, 25 bp, Homo sapien
ggacatccccgtactcaaagaccat

SEQ ID NO: 524422 - DNA, 25 bp, Homo sapien
ttcttgtatatatctctttggctct

SEQ ID NO: 524423 - DNA, 25 bp, Homo sapien
gtatatatctctttggctctatctt

SEQ ID NO: 524424 - DNA, 25 bp, Homo sapien
ggctctatctttggtaatttcttaa

SEQ ID NO: 524425 - DNA, 25 bp, Homo sapien
tggaatcttagaattggactgtgaa

SEQ ID NO: 524426 - DNA, 25 bp, Homo sapien
gaaggtcatacatagatacaggttg

SEQ ID NO: 524427 - DNA, 25 bp, Homo sapien
ttggtatcctaactttaccctctca

SEQ ID NO: 524428 - DNA, 25 bp, Homo sapien
ctttaccctctcactgattaacatg

SEQ ID NO: 524429 - DNA, 25 bp, Homo sapien
tcacgagtaacttcctatgttttta

SEQ ID NO: 524430 - DNA, 25 bp, Homo sapien
ttctagtggttctaccttatccatc

SEQ ID NO: 524431 - DNA, 25 bp, Homo sapien
atccatccccacactgttgaaaatt

SEQ ID NO: 524432 - DNA, 25 bp, Homo sapien
tggttgtttcagatacttttattat

SEQ ID NO: 524433 - DNA, 25 bp, Homo sapien
atttcttccttccacagttatctta

SEQ ID NO: 524434 - DNA, 25 bp, Homo sapien
gttattcgtgaatagtcttttgcat

SEQ ID NO: 524435 - DNA, 25 bp, Homo sapien
gtcgcacaatgtttgatgtccccaa

SEQ ID NO: 524436 - DNA, 25 bp, Homo sapien
aaagtaccacactgagttctatcag

SEQ ID NO: 524437 - DNA, 25 bp, Homo sapien
ctatcagttatcctttgtgagccta

SEQ ID NO: 524438 - DNA, 25 bp, Homo sapien
tttgtgagcctatgatattccccat

SEQ ID NO: 524439 - DNA, 25 bp, Homo sapien
tattccccatttcctgtacaatcat

SEQ ID NO: 524440 - DNA, 25 bp, Homo sapien
gtacaatcatgaacagctctgagat

SEQ ID NO: 524441 - DNA, 25 bp, Homo sapien
aacagctctgagatcctggagtgat

SEQ ID NO: 524442 - DNA, 25 bp, Homo sapien
atccagagcagagtttacgggtctt

SEQ ID NO: 524443 - DNA, 25 bp, Homo sapien
tacgggtcttaggatgtctgtaata

SEQ ID NO: 524444 - DNA, 25 bp, Homo sapien
tagatactaaatacagacacttcaa

SEQ ID NO: 524445 - DNA, 25 bp, Homo sapien
gatactaaatacagacacttcaata

SEQ ID NO: 524446 - DNA, 25 bp, Homo sapien
attttgttgaagctattgactgtac

SEQ ID NO: 524447 - DNA, 25 bp, Homo sapien
gttgaagctattgactgtacaatta

SEQ ID NO: 524448 - DNA, 25 bp, Homo sapien
gaagctattgactgtacaattaaac

SEQ ID NO: 524449 - DNA, 25 bp, Homo sapien
taaaattgtctcattttggtaaaat

SEQ ID NO: 524450 - DNA, 25 bp, Homo sapien
tttttaaaacattggcttgcttttg

SEQ ID NO: 524451 - DNA, 25 bp, Homo sapien
gtgcaagtgttacatatggctttgt

SEQ ID NO: 524452 - DNA, 25 bp, Homo sapien
agtgttacatatggctttgtacatt

SEQ ID NO: 524453 - DNA, 25 bp, Homo sapien
gttacatatggctttgtacattaaa

SEQ ID NO: 524454 - DNA, 25 bp, Homo sapien
atggctttgtacattaaagttgaaa

SEQ ID NO: 524455 - DNA, 25 bp, Homo sapien
ctaagtacagtgttctctgggaata

SEQ ID NO: 524456 - DNA, 25 bp, Homo sapien
ggtggtcagtggtcgaactatttag

SEQ ID NO: 524457 - DNA, 25 bp, Homo sapien
agagatcagggcaggcttctagaaa

SEQ ID NO: 524458 - DNA, 25 bp, Homo sapien
gtctaactagtcttgaggtttacat

SEQ ID NO: 524459 - DNA, 25 bp, Homo sapien
gtttacataaaccacaccaggctga

SEQ ID NO: 524460 - DNA, 25 bp, Homo sapien
ggaagggcccactaagcagtgagac

SEQ ID NO: 524461 - DNA, 25 bp, Homo sapien
taagcagtgagaccattcccttttg

SEQ ID NO: 524462 - DNA, 25 bp, Homo sapien
agaccattcccttttggagagtcct

SEQ ID NO: 524463 - DNA, 25 bp, Homo sapien
ttttggagagtccttgcatcccctc

SEQ ID NO: 524464 - DNA, 25 bp, Homo sapien
taggactatctgatgctctttcctc

SEQ ID NO: 524465 - DNA, 25 bp, Homo sapien
tttcctctgctcaccattgcaatac

SEQ ID NO: 524466 - DNA, 25 bp, Homo sapien
acactgtatgtgttcaatctttgga

SEQ ID NO: 524467 - DNA, 25 bp, Homo sapien
gagacttattttttgacccagtatg

SEQ ID NO: 524468 - DNA, 25 bp, Homo sapien
tgacccagtatgtttgccctcatga

SEQ ID NO: 524469 - DNA, 25 bp, Homo sapien
tgtttgccctcatgaacattccata

SEQ ID NO: 524470 - DNA, 25 bp, Homo sapien
gaacattccatattcactagaaaaa

SEQ ID NO: 524471 - DNA, 25 bp, Homo sapien
ggatatagtgttatgcaaatgccac

SEQ ID NO: 524472 - DNA, 25 bp, Homo sapien
gcaaatgccactaaatcaagataaa

SEQ ID NO: 524473 - DNA, 25 bp, Homo sapien
aagataaatcttttgcactcttgtt

SEQ ID NO: 524474 - DNA, 25 bp, Homo sapien
tgcactcttgttttttgcctgcttg

SEQ ID NO: 524475 - DNA, 25 bp, Homo sapien
gttttttgcctgcttgttctaacaa

SEQ ID NO: 524476 - DNA, 25 bp, Homo sapien
gaaagaagtgttaatatctccaaaa

SEQ ID NO: 524477 - DNA, 25 bp, Homo sapien
aaatggtaacaatcagaggaactat

SEQ ID NO: 524478 - DNA, 25 bp, Homo sapien
gaggaactataagaacacctttaga

SEQ ID NO: 524479 - DNA, 25 bp, Homo sapien
ctgggatcaaactggcctgcaaaac

SEQ ID NO: 524480 - DNA, 25 bp, Homo sapien
ctggcctgcaaaaccatagtcagtt

SEQ ID NO: 524481 - DNA, 25 bp, Homo sapien
gcaaaaccatagtcagttaattctt

SEQ ID NO: 524482 - DNA, 25 bp, Homo sapien
tctatttatttattgaggacccatg

SEQ ID NO: 524483 - DNA, 25 bp, Homo sapien
tttatttattgaggacccatggtaa

SEQ ID NO: 524484 - DNA, 25 bp, Homo sapien
tgaggacccatggtaaaatgcaaat

SEQ ID NO: 524485 - DNA, 25 bp, Homo sapien
gtaaaatgcaaatagatccggtgtc

SEQ ID NO: 524486 - DNA, 25 bp, Homo sapien
gatccggtgtctaaatgcattcata

SEQ ID NO: 524487 - DNA, 25 bp, Homo sapien
cggtgtctaaatgcattcatatttt

SEQ ID NO: 524488 - DNA, 25 bp, Homo sapien
aggtagcctggttcagtcccagctg

SEQ ID NO: 524489 - DNA, 25 bp, Homo sapien
tcagtcccagctgggtcctgaagga

SEQ ID NO: 524490 - DNA, 25 bp, Homo sapien
gaaggagcacagtactagagcctga

SEQ ID NO: 524491 - DNA, 25 bp, Homo sapien
tactagagcctgagtcatgttgact

SEQ ID NO: 524492 - DNA, 25 bp, Homo sapien
aagttcatgatgcaggacagaggaa

SEQ ID NO: 524493 - DNA, 25 bp, Homo sapien
acaagtggacaagacaagtggagcc

SEQ ID NO: 524494 - DNA, 25 bp, Homo sapien
ggagcccagctctgttcgcatggga

SEQ ID NO: 524495 - DNA, 25 bp, Homo sapien
ggttggccgagttctcatagctaga

SEQ ID NO: 524496 - DNA, 25 bp, Homo sapien
ggccgtgtaggtataagtgcttaat

SEQ ID NO: 524497 - DNA, 25 bp, Homo sapien
aagtgcttaatgtttcatctgtctg

SEQ ID NO: 524498 - DNA, 25 bp, Homo sapien
gtttcatctgtctgaaagaccagct

SEQ ID NO: 524499 - DNA, 25 bp, Homo sapien
ggacagaaaatcattaagccctaca

SEQ ID NO: 524500 - DNA, 25 bp, Homo sapien
aagccctacagtaagcactatcctt

SEQ ID NO: 524501 - DNA, 25 bp, Homo sapien
gtaagcactatcctttgtactccct

SEQ ID NO: 524502 - DNA, 25 bp, Homo sapien
aacgtggcctccatgtggttgaagc

SEQ ID NO: 524503 - DNA, 25 bp, Homo sapien
gtggttgaagctagggagactctac

SEQ ID NO: 524504 - DNA, 25 bp, Homo sapien
gggagactctacatgggcctggaac

SEQ ID NO: 524505 - DNA, 25 bp, Homo sapien
gaagaaggccattgcaatcatggaa

SEQ ID NO: 524506 - DNA, 25 bp, Homo sapien
caatcatggaagtagctcacggcaa

SEQ ID NO: 524507 - DNA, 25 bp, Homo sapien
gtagctcacggcaaagatcatccat

SEQ ID NO: 524508 - DNA, 25 bp, Homo sapien
gaaagccactgaaactatgcagcat

SEQ ID NO: 524509 - DNA, 25 bp, Homo sapien
aactatgcagcatttcagttttcat

SEQ ID NO: 524510 - DNA, 25 bp, Homo sapien
aagtatttgtgataattctctagac

SEQ ID NO: 524511 - DNA, 25 bp, Homo sapien
gataattctctagacaaagctttca

SEQ ID NO: 524512 - DNA, 25 bp, Homo sapien
aaagctttcatagctgtgacaccaa

SEQ ID NO: 524513 - DNA, 25 bp, Homo sapien
aaagacagcgtttttattacaggag

SEQ ID NO: 524514 - DNA, 25 bp, Homo sapien
caggaggttgtaaaactagtctgtt

SEQ ID NO: 524515 - DNA, 25 bp, Homo sapien
tctgtttcagattaatctcaactta

SEQ ID NO: 524516 - DNA, 25 bp, Homo sapien
gaaaaatttgctctatatgccttca

SEQ ID NO: 524517 - DNA, 25 bp, Homo sapien
tttgctctatatgccttcattctgc

SEQ ID NO: 524518 - DNA, 25 bp, Homo sapien
cttcattctgcccatgctgttattg

SEQ ID NO: 524519 - DNA, 25 bp, Homo sapien
gttattgtcacaaactacatcttta

SEQ ID NO: 524520 - DNA, 25 bp, Homo sapien
atatgtccatcaacatagttttata

SEQ ID NO: 524521 - DNA, 25 bp, Homo sapien
acagatgaaccttgtatttgtgtaa

SEQ ID NO: 524522 - DNA, 25 bp, Homo sapien
tctcccaagggagagctatggttta

SEQ ID NO: 524523 - DNA, 25 bp, Homo sapien
ggagagctatggtttacattcaatt

SEQ ID NO: 524524 - DNA, 25 bp, Homo sapien
tcaattttttggtctttctgctatg

SEQ ID NO: 524525 - DNA, 25 bp, Homo sapien
ggtctttctgctatgaaacgtgttt

SEQ ID NO: 524526 - DNA, 25 bp, Homo sapien
aatgtgtttgcaaccttaagtaagg

SEQ ID NO: 524527 - DNA, 25 bp, Homo sapien
tctgaactctgatcttttgccgctt

SEQ ID NO: 524528 - DNA, 25 bp, Homo sapien
cttttgccgcttctgtagattttga

SEQ ID NO: 524529 - DNA, 25 bp, Homo sapien
gtgaggacattcaaaagcccatggt

SEQ ID NO: 524530 - DNA, 25 bp, Homo sapien
gcccatggtgaatgcatatgccttt

SEQ ID NO: 524531 - DNA, 25 bp, Homo sapien
atgcctttagaatattgtgcctgtt

SEQ ID NO: 524532 - DNA, 25 bp, Homo sapien
cgtccgtttcttctgtattagaagg

SEQ ID NO: 524533 - DNA, 25 bp, Homo sapien
gaaggctgcggtgattcaattagat

SEQ ID NO: 524534 - DNA, 25 bp, Homo sapien
caattagattgtcccactgctgaga

SEQ ID NO: 524535 - DNA, 25 bp, Homo sapien
ttgtcccactgctgagacctgtagg

SEQ ID NO: 524536 - DNA, 25 bp, Homo sapien
gacctgtagggcagcttctaacatg

SEQ ID NO: 524537 - DNA, 25 bp, Homo sapien
gcttctaacatgcttttttcaaggg

SEQ ID NO: 524538 - DNA, 25 bp, Homo sapien
acaagtcgtgtgtcggaattggatt

SEQ ID NO: 524539 - DNA, 25 bp, Homo sapien
tgagaacactctgaatgacccctgg

SEQ ID NO: 524540 - DNA, 25 bp, Homo sapien
cttcgggcgtgaactgaactccaga

SEQ ID NO: 524541 - DNA, 25 bp, Homo sapien
agacccctctttgtgttgggcagtg

SEQ ID NO: 524542 - DNA, 25 bp, Homo sapien
gggcagtgtcatcttgcttacaaac

SEQ ID NO: 524543 - DNA, 25 bp, Homo sapien
tcctgtcttcactcctaaatgcagt

SEQ ID NO: 524544 - DNA, 25 bp, Homo sapien
taaatgcagttctttggaatcaccc

SEQ ID NO: 524545 - DNA, 25 bp, Homo sapien
agttctttggaatcaccctactgtg

SEQ ID NO: 524546 - DNA, 25 bp, Homo sapien
tcaccctactgtggtgggcgtagta

SEQ ID NO: 524547 - DNA, 25 bp, Homo sapien
gagccatcagctaggaagaaacgtg

SEQ ID NO: 524548 - DNA, 25 bp, Homo sapien
gagatgtgaattccaagagttgcct

SEQ ID NO: 524549 - DNA, 25 bp, Homo sapien
tggacagggcaagtcatgttagcgt

SEQ ID NO: 524550 - DNA, 25 bp, Homo sapien
aacagaggattcaaaccgcaagtat

SEQ ID NO: 524551 - DNA, 25 bp, Homo sapien
agtatgggagatttaggccctgcag

SEQ ID NO: 524552 - DNA, 25 bp, Homo sapien
ctgcagaggcagaccattccttagt

SEQ ID NO: 524553 - DNA, 25 bp, Homo sapien
cagaccattccttagtatctcacaa

SEQ ID NO: 524554 - DNA, 25 bp, Homo sapien
cttttatttcaatgtccttacattt

SEQ ID NO: 524555 - DNA, 25 bp, Homo sapien
tgggatcttacaagggaagtaccaa

SEQ ID NO: 524556 - DNA, 25 bp, Homo sapien
gaatactttgcagaatacactaatg

SEQ ID NO: 524557 - DNA, 25 bp, Homo sapien
gatgactctcaagatatatatgttt

SEQ ID NO: 524558 - DNA, 25 bp, Homo sapien
ttgttttgaatgttggcagatgcca

SEQ ID NO: 524559 - DNA, 25 bp, Homo sapien
cagatgccaatagcccttaacattt

SEQ ID NO: 524560 - DNA, 25 bp, Homo sapien
atgccaatagcccttaacatttgaa

SEQ ID NO: 524561 - DNA, 25 bp, Homo sapien
tacactaatgtcaaaggcttgcagg

SEQ ID NO: 524562 - DNA, 25 bp, Homo sapien
caaaggcttgcaggattaatgtgta

SEQ ID NO: 524563 - DNA, 25 bp, Homo sapien
gcaggattaatgtgtaggaaccaac

SEQ ID NO: 524564 - DNA, 25 bp, Homo sapien
tgtgtaggaaccaacataagacatg

SEQ ID NO: 524565 - DNA, 25 bp, Homo sapien
aaaatgtatgcttccttgaactgtc

SEQ ID NO: 524566 - DNA, 25 bp, Homo sapien
gcttccttgaactgtcatatcgttg

SEQ ID NO: 524567 - DNA, 25 bp, Homo sapien
aaattcacctttggaacgtgacaca

SEQ ID NO: 524568 - DNA, 25 bp, Homo sapien
gtgacacaatgttaggcatacctcc

SEQ ID NO: 524569 - DNA, 25 bp, Homo sapien
ggcatacctccttttttctaataca

SEQ ID NO: 524570 - DNA, 25 bp, Homo sapien
gaatacattttgttggaggtaattt

SEQ ID NO: 524571 - DNA, 25 bp, Homo sapien
ttatgtgattcatataccactgcta

SEQ ID NO: 524572 - DNA, 25 bp, Homo sapien
ccactgctacagtgttagctgacaa

SEQ ID NO: 524573 - DNA, 25 bp, Homo sapien
gttagctgacaacatatagtatgag

SEQ ID NO: 524574 - DNA, 25 bp, Homo sapien
tgaggtaaggatctaattctgtttc

SEQ ID NO: 524575 - DNA, 25 bp, Homo sapien
gtttcctctcacatgattacttgat

SEQ ID NO: 524576 - DNA, 25 bp, Homo sapien
tggctgggagccaaccctcaggtac

SEQ ID NO: 524577 - DNA, 25 bp, Homo sapien
ttttcctctataaaagtcagggact

SEQ ID NO: 524578 - DNA, 25 bp, Homo sapien
cagggactatgatttatatgggtga

SEQ ID NO: 524579 - DNA, 25 bp, Homo sapien
tgggagccaaccctcaggtacttgg

SEQ ID NO: 524580 - DNA, 25 bp, Homo sapien
ggagtaggactgaagctgccattta

SEQ ID NO: 524581 - DNA, 25 bp, Homo sapien
gtaggactgaagctgccatttacaa

SEQ ID NO: 524582 - DNA, 25 bp, Homo sapien
gaagctgccatttacaaaccccttg

SEQ ID NO: 524583 - DNA, 25 bp, Homo sapien
acttggctctgagtaatgtgacggc

SEQ ID NO: 524584 - DNA, 25 bp, Homo sapien
ctgagtaatgtgacggcccaggcaa

SEQ ID NO: 524585 - DNA, 25 bp, Homo sapien
gacggcccaggcaagagggctccca

SEQ ID NO: 524586 - DNA, 25 bp, Homo sapien
ggctcccactgccaatgaggaacaa

SEQ ID NO: 524587 - DNA, 25 bp, Homo sapien
gcattttgtctggaggaaccccaaa

SEQ ID NO: 524588 - DNA, 25 bp, Homo sapien
ggaaccccaaaatgttgcctcgatc

SEQ ID NO: 524589 - DNA, 25 bp, Homo sapien
ccaaaatgttgcctcgatctttcga

SEQ ID NO: 524590 - DNA, 25 bp, Homo sapien
aaatgttgcctcgatctttcgaatc

SEQ ID NO: 524591 - DNA, 25 bp, Homo sapien
gttgcctcgatctttcgaatcttag

SEQ ID NO: 524592 - DNA, 25 bp, Homo sapien
cgatctttcgaatcttagcagtggg

SEQ ID NO: 524593 - DNA, 25 bp, Homo sapien
ggggagataactgccactcagctta

SEQ ID NO: 524594 - DNA, 25 bp, Homo sapien
gcttaccacttctgcagaccttgat

SEQ ID NO: 524595 - DNA, 25 bp, Homo sapien
accttgatgaaactggtcacctgga

SEQ ID NO: 524596 - DNA, 25 bp, Homo sapien
tgatgaaactggtcacctggattct

SEQ ID NO: 524597 - DNA, 25 bp, Homo sapien
aagcattttgtctggaggaacccca

SEQ ID NO: 524598 - DNA, 25 bp, Homo sapien
agccccaaatctagcaattctcata

SEQ ID NO: 524599 - DNA, 25 bp, Homo sapien
atccgattttagaattagcctccca

SEQ ID NO: 524600 - DNA, 25 bp, Homo sapien
gaattagcctcccagattaatctga

SEQ ID NO: 524601 - DNA, 25 bp, Homo sapien
taggcaagtcagtaagccacccact

SEQ ID NO: 524602 - DNA, 25 bp, Homo sapien
taagccacccactagacagccatat

SEQ ID NO: 524603 - DNA, 25 bp, Homo sapien
gacagccatatccagcaaaataaga

SEQ ID NO: 524604 - DNA, 25 bp, Homo sapien
agaagtttccagatgccaaatgata

SEQ ID NO: 524605 - DNA, 25 bp, Homo sapien
cttctggttggtttggctgtatgag

SEQ ID NO: 524606 - DNA, 25 bp, Homo sapien
tacccaaaattattcacacgacgtt

SEQ ID NO: 524607 - DNA, 25 bp, Homo sapien
gacgttaacttattggtactggcta

SEQ ID NO: 524608 - DNA, 25 bp, Homo sapien
actggctaagcaatacatgtatttc

SEQ ID NO: 524609 - DNA, 25 bp, Homo sapien
aagcctctgctctatacagctatta

SEQ ID NO: 524610 - DNA, 25 bp, Homo sapien
acagctattatatctgccaaaggat

SEQ ID NO: 524611 - DNA, 25 bp, Homo sapien
aaaggatagtgttaacatactctga

SEQ ID NO: 524612 - DNA, 25 bp, Homo sapien
atactctgacatctgaagatccagg

SEQ ID NO: 524613 - DNA, 25 bp, Homo sapien
tttccaacatttagagcaacttcac

SEQ ID NO: 524614 - DNA, 25 bp, Homo sapien
tagagcaacttcacctataagcccc

SEQ ID NO: 524615 - DNA, 25 bp, Homo sapien
atatatcatctcttccctcattctt

SEQ ID NO: 524616 - DNA, 25 bp, Homo sapien
tttgtgctacatctctaagaatcca

SEQ ID NO: 524617 - DNA, 25 bp, Homo sapien
tcttccctcattcttaactctctgt

SEQ ID NO: 524618 - DNA, 25 bp, Homo sapien
gaatccacagcagatttcatgtcaa

SEQ ID NO: 524619 - DNA, 25 bp, Homo sapien
aatgcatttgaaagcctctgctcta

SEQ ID NO: 524620 - DNA, 25 bp, Homo sapien
gaccccatgctgcattgtacttcac

SEQ ID NO: 524621 - DNA, 25 bp, Homo sapien
acgagcataggcaatgtgagcacta

SEQ ID NO: 524622 - DNA, 25 bp, Homo sapien
atgtgagcactacctctgcagagga

SEQ ID NO: 524623 - DNA, 25 bp, Homo sapien
ctctgcagaggatactgaggctcag

SEQ ID NO: 524624 - DNA, 25 bp, Homo sapien
gacatgggcttaagtccacacgact

SEQ ID NO: 524625 - DNA, 25 bp, Homo sapien
tccacacgactgactgtaaatgaca

SEQ ID NO: 524626 - DNA, 25 bp, Homo sapien
gaaccaaggtacacattccggcttt

SEQ ID NO: 524627 - DNA, 25 bp, Homo sapien
aaggtacacattccggctttctaat

SEQ ID NO: 524628 - DNA, 25 bp, Homo sapien
tttctaatcccaaagccagagtctt

SEQ ID NO: 524629 - DNA, 25 bp, Homo sapien
gtctagctgtgacaggagaccacaa

SEQ ID NO: 524630 - DNA, 25 bp, Homo sapien
tgaccgtgccgaagctcccatggga

SEQ ID NO: 524631 - DNA, 25 bp, Homo sapien
tcctcagaatactcactccgatggg

SEQ ID NO: 524632 - DNA, 25 bp, Homo sapien
gggagctatggagtattcctgtttt

SEQ ID NO: 524633 - DNA, 25 bp, Homo sapien
tgttttgagatccagagtccctcct

SEQ ID NO: 524634 - DNA, 25 bp, Homo sapien
gagtccctcctcttgtgcagattca

SEQ ID NO: 524635 - DNA, 25 bp, Homo sapien
gtgcagattcacagagccagatcat

SEQ ID NO: 524636 - DNA, 25 bp, Homo sapien
gatagaggctgaccttgaacactta

SEQ ID NO: 524637 - DNA, 25 bp, Homo sapien
aagttacaccattctttgccaaagg

SEQ ID NO: 524638 - DNA, 25 bp, Homo sapien
ttctttgccaaaggctggctggatc

SEQ ID NO: 524639 - DNA, 25 bp, Homo sapien
cctcacagacaagcactcagataaa

SEQ ID NO: 524640 - DNA, 25 bp, Homo sapien
ataaaagttagagccgcatgtcctg

SEQ ID NO: 524641 - DNA, 25 bp, Homo sapien
tagagccgcatgtcctggaggtgac

SEQ ID NO: 524642 - DNA, 25 bp, Homo sapien
tttctacatatgtggcactgcttgt

SEQ ID NO: 524643 - DNA, 25 bp, Homo sapien
acatatgtggcactgcttgttaatt

SEQ ID NO: 524644 - DNA, 25 bp, Homo sapien
gtggcactgcttgttaattgtgttg

SEQ ID NO: 524645 - DNA, 25 bp, Homo sapien
ctgagtagctgggtatgttgcccga

SEQ ID NO: 524646 - DNA, 25 bp, Homo sapien
atatctttactaacttttgtctgac

SEQ ID NO: 524647 - DNA, 25 bp, Homo sapien
cttttgtctgacctattaataattg

SEQ ID NO: 524648 - DNA, 25 bp, Homo sapien
gtattttgaattctcctactgtaat

SEQ ID NO: 524649 - DNA, 25 bp, Homo sapien
ttttgaattctcctactgtaatggt

SEQ ID NO: 524650 - DNA, 25 bp, Homo sapien
gaattctcctactgtaatggtagat

SEQ ID NO: 524651 - DNA, 25 bp, Homo sapien
ggtagatttgacaatttcccctctt

SEQ ID NO: 524652 - DNA, 25 bp, Homo sapien
gttttaactttatacattctattga

SEQ ID NO: 524653 - DNA, 25 bp, Homo sapien
aagtggctgctttattattcatttc

SEQ ID NO: 524654 - DNA, 25 bp, Homo sapien
ttaacaaagaagttagacgtgctgt

SEQ ID NO: 524655 - DNA, 25 bp, Homo sapien
tagacgtgctgtgtcacatgtgtat

SEQ ID NO: 524656 - DNA, 25 bp, Homo sapien
gtgctgtgtcacatgtgtatgagtt

SEQ ID NO: 524657 - DNA, 25 bp, Homo sapien
gtcacatgtgtatgagttttatggt

SEQ ID NO: 524658 - DNA, 25 bp, Homo sapien
ttatggtaaggactttccagttgtt

SEQ ID NO: 524659 - DNA, 25 bp, Homo sapien
ggactttccagttgttgttgtgtta

SEQ ID NO: 524660 - DNA, 25 bp, Homo sapien
gtgttatgtatacaaaggaatgctt

SEQ ID NO: 524661 - DNA, 25 bp, Homo sapien
aggtccatggaaacctctcttttct

SEQ ID NO: 524662 - DNA, 25 bp, Homo sapien
tccatggaaacctctcttttctcat

SEQ ID NO: 524663 - DNA, 25 bp, Homo sapien
cttcctgaagaagtggctgctttat

SEQ ID NO: 524664 - DNA, 25 bp, Homo sapien
aaaactgctgtttctggcctcacac

SEQ ID NO: 524665 - DNA, 25 bp, Homo sapien
ggcctcacacctggatcaggaggat

SEQ ID NO: 524666 - DNA, 25 bp, Homo sapien
ggatgaggagcccacttcagtcact

SEQ ID NO: 524667 - DNA, 25 bp, Homo sapien
gcccacttcagtcactggtcgaaaa

SEQ ID NO: 524668 - DNA, 25 bp, Homo sapien
ggtcgaaaagattcactcagtataa

SEQ ID NO: 524669 - DNA, 25 bp, Homo sapien
gagtttgtcacggatcaggcgttca

SEQ ID NO: 524670 - DNA, 25 bp, Homo sapien
tcaggcgttcaggaggtgcctcatt

SEQ ID NO: 524671 - DNA, 25 bp, Homo sapien
caggaggtgcctcattttttgaaag

SEQ ID NO: 524672 - DNA, 25 bp, Homo sapien
aagtcagtctgtaagcaagtctgca

SEQ ID NO: 524673 - DNA, 25 bp, Homo sapien
gtctgtaagcaagtctgcaagcaaa

SEQ ID NO: 524674 - DNA, 25 bp, Homo sapien
gcaagcaaaatggatactacgttaa

SEQ ID NO: 524675 - DNA, 25 bp, Homo sapien
ccttgaggtttcaggaatcacctaa

SEQ ID NO: 524676 - DNA, 25 bp, Homo sapien
ggaatcacctaatccactgtgactc

SEQ ID NO: 524677 - DNA, 25 bp, Homo sapien
cacctaatccactgtgactcacaaa

SEQ ID NO: 524678 - DNA, 25 bp, Homo sapien
tgactcacaaattcctgcctcttgg

SEQ ID NO: 524679 - DNA, 25 bp, Homo sapien
tgcctcttggctttgcctgcagcat

SEQ ID NO: 524680 - DNA, 25 bp, Homo sapien
tttgcctgcagcatatctcctggaa

SEQ ID NO: 524681 - DNA, 25 bp, Homo sapien
cctgcagcatatctcctggaagtgt

SEQ ID NO: 524682 - DNA, 25 bp, Homo sapien
caaagaagggcatggtcagcctgtc

SEQ ID NO: 524683 - DNA, 25 bp, Homo sapien
cagcctgtctgggagggagttgcat

SEQ ID NO: 524684 - DNA, 25 bp, Homo sapien
ggtagggacaggcatgcatcttaca

SEQ ID NO: 524685 - DNA, 25 bp, Homo sapien
gggacaggcatgcatcttacaggat

SEQ ID NO: 524686 - DNA, 25 bp, Homo sapien
atttgaataccaattatccacatta

SEQ ID NO: 524687 - DNA, 25 bp, Homo sapien
taaaattgtgtcctctatgtgtaag

SEQ ID NO: 524688 - DNA, 25 bp, Homo sapien
ttgtgtcctctatgtgtaaggcata

SEQ ID NO: 524689 - DNA, 25 bp, Homo sapien
gtgtaaggcatagcacatttagcac

SEQ ID NO: 524690 - DNA, 25 bp, Homo sapien
taagcacactaagcaccttacaaat

SEQ ID NO: 524691 - DNA, 25 bp, Homo sapien
accttacaaatatcctcatttattc

SEQ ID NO: 524692 - DNA, 25 bp, Homo sapien
aacaaactacagtatggtgcttgag

SEQ ID NO: 524693 - DNA, 25 bp, Homo sapien
atggtgcttgagtactgacttagga

SEQ ID NO: 524694 - DNA, 25 bp, Homo sapien
gagtactgacttaggaggtcagcat

SEQ ID NO: 524695 - DNA, 25 bp, Homo sapien
ggtttcactaggagcttctcaaagc

SEQ ID NO: 524696 - DNA, 25 bp, Homo sapien
ctaggagcttctcaaagcacgctgc

SEQ ID NO: 524697 - DNA, 25 bp, Homo sapien
ggctttctgggcactgcacttcagc

SEQ ID NO: 524698 - DNA, 25 bp, Homo sapien
tggctcctgagggtttttataccct

SEQ ID NO: 524699 - DNA, 25 bp, Homo sapien
tataccctttgtttgctaatgttta

SEQ ID NO: 524700 - DNA, 25 bp, Homo sapien
gcatcataatttctacattgtccct

SEQ ID NO: 524701 - DNA, 25 bp, Homo sapien
atttctacattgtccctgagtgtca

SEQ ID NO: 524702 - DNA, 25 bp, Homo sapien
acattgtccctgagtgtcagaacta

SEQ ID NO: 524703 - DNA, 25 bp, Homo sapien
gtctgtgccaagaaacgcaggctct

SEQ ID NO: 524704 - DNA, 25 bp, Homo sapien
gccaagaaacgcaggctctgggcct

SEQ ID NO: 524705 - DNA, 25 bp, Homo sapien
tgtgcttgtgggaacaccttgtacc

SEQ ID NO: 524706 - DNA, 25 bp, Homo sapien
gaacaccttgtacctgagcttacag

SEQ ID NO: 524707 - DNA, 25 bp, Homo sapien
agcttacaggtaccaataaagaggc

SEQ ID NO: 524708 - DNA, 25 bp, Homo sapien
gtgaacccagcaatgagagatcctt

SEQ ID NO: 524709 - DNA, 25 bp, Homo sapien
gagatccttaacagctagtgcccat

SEQ ID NO: 524710 - DNA, 25 bp, Homo sapien
gctaaacctaaagcctgggtggtga

SEQ ID NO: 524711 - DNA, 25 bp, Homo sapien
ggtggtgatggctcaaacgctaatg

SEQ ID NO: 524712 - DNA, 25 bp, Homo sapien
tgagtcagtgaatccttaccgaccc

SEQ ID NO: 524713 - DNA, 25 bp, Homo sapien
cccctggcctttataatctgaggca

SEQ ID NO: 524714 - DNA, 25 bp, Homo sapien
taatctgaggcaactttggctgcag

SEQ ID NO: 524715 - DNA, 25 bp, Homo sapien
aactttggctgcagcccgggaatgt

SEQ ID NO: 524716 - DNA, 25 bp, Homo sapien
ggcactagggaatacaaggccttct

SEQ ID NO: 524717 - DNA, 25 bp, Homo sapien
ttcttccctggttgtcttgtaataa

SEQ ID NO: 524718 - DNA, 25 bp, Homo sapien
ggttgtccctccagtccgagagact

SEQ ID NO: 524719 - DNA, 25 bp, Homo sapien
gcaaagctgaatgaaaacgcccaaa

SEQ ID NO: 524720 - DNA, 25 bp, Homo sapien
aaagctgaatgaaaacgcccaaaat

SEQ ID NO: 524721 - DNA, 25 bp, Homo sapien
gtgaggaaaaattacctgtcttgac

SEQ ID NO: 524722 - DNA, 25 bp, Homo sapien
atgtgttcatcatcttaagtattgt

SEQ ID NO: 524723 - DNA, 25 bp, Homo sapien
gtgttcatcatcttaagtattgtaa

SEQ ID NO: 524724 - DNA, 25 bp, Homo sapien
catcttaagtattgtaagctgctat

SEQ ID NO: 524725 - DNA, 25 bp, Homo sapien
ttgtaagctgctatgtatggattta

SEQ ID NO: 524726 - DNA, 25 bp, Homo sapien
gctgctatgtatggatttaaaccgt

SEQ ID NO: 524727 - DNA, 25 bp, Homo sapien
gatttaaaccgtaatcatatctttt

SEQ ID NO: 524728 - DNA, 25 bp, Homo sapien
ctatctgaggcactggtggaataaa

SEQ ID NO: 524729 - DNA, 25 bp, Homo sapien
gaggcactggtggaataaaaaacct

SEQ ID NO: 524730 - DNA, 25 bp, Homo sapien
tactgatgggattctctaatttagc

SEQ ID NO: 524731 - DNA, 25 bp, Homo sapien
aatttagcttttcagaaagagcctt

SEQ ID NO: 524732 - DNA, 25 bp, Homo sapien
gaaagagccttaatcagtccctttt

SEQ ID NO: 524733 - DNA, 25 bp, Homo sapien
gagccttaatcagtcccttttaaat

SEQ ID NO: 524734 - DNA, 25 bp, Homo sapien
aatcagtcccttttaaattctgact

SEQ ID NO: 524735 - DNA, 25 bp, Homo sapien
ttgaagagttattttgtgcattaga

SEQ ID NO: 524736 - DNA, 25 bp, Homo sapien
gtgcattagaaatctttaagcctta

SEQ ID NO: 524737 - DNA, 25 bp, Homo sapien
taagccttatatacatcttctaaga

SEQ ID NO: 524738 - DNA, 25 bp, Homo sapien
agagtaaaattgtatccacttgttt

SEQ ID NO: 524739 - DNA, 25 bp, Homo sapien
gctttttatcagcatgcttacttgg

SEQ ID NO: 524740 - DNA, 25 bp, Homo sapien
cagcatgcttacttggtgataaaga

SEQ ID NO: 524741 - DNA, 25 bp, Homo sapien
gatttgcaaagtcaactcagtacaa

SEQ ID NO: 524742 - DNA, 25 bp, Homo sapien
gtcaactcagtacaaatcaatcgtg

SEQ ID NO: 524743 - DNA, 25 bp, Homo sapien
gcaaaccacgatgcaagtcagtgat

SEQ ID NO: 524744 - DNA, 25 bp, Homo sapien
aagtgacagccctggcaatttactt

SEQ ID NO: 524745 - DNA, 25 bp, Homo sapien
gcaatttacttgcactcattcctta

SEQ ID NO: 524746 - DNA, 25 bp, Homo sapien
acttgcactcattccttacttaatt

SEQ ID NO: 524747 - DNA, 25 bp, Homo sapien
aaggttattcacatgcttgctggct

SEQ ID NO: 524748 - DNA, 25 bp, Homo sapien
gaggagtaactgctctatgctcatt

SEQ ID NO: 524749 - DNA, 25 bp, Homo sapien
aactgctctatgctcattgaagaat

SEQ ID NO: 524750 - DNA, 25 bp, Homo sapien
gttattcacatgcttgctggcttgc

SEQ ID NO: 524751 - DNA, 25 bp, Homo sapien
gaagcagttataacctatcagattt

SEQ ID NO: 524752 - DNA, 25 bp, Homo sapien
gtttgtaatcctcaaataatcccat

SEQ ID NO: 524753 - DNA, 25 bp, Homo sapien
aataatcccattgtcagaggcctcg

SEQ ID NO: 524754 - DNA, 25 bp, Homo sapien
tgatgggccttctcaccctcgagaa

SEQ ID NO: 524755 - DNA, 25 bp, Homo sapien
ttctcaccctcgagaaaggccaggg

SEQ ID NO: 524756 - DNA, 25 bp, Homo sapien
aaagatgggcagtgctccggttgtc

SEQ ID NO: 524757 - DNA, 25 bp, Homo sapien
gggcaacccttcaaggagagcttca

SEQ ID NO: 524758 - DNA, 25 bp, Homo sapien
gagagcttcagggtcatctctgtgt

SEQ ID NO: 524759 - DNA, 25 bp, Homo sapien
gggtcatctctgtgtgagacactat

SEQ ID NO: 524760 - DNA, 25 bp, Homo sapien
gtgagacactattgtatattcctgt

SEQ ID NO: 524761 - DNA, 25 bp, Homo sapien
gtatattcctgtaagattgcatttt

SEQ ID NO: 524762 - DNA, 25 bp, Homo sapien
tccacgacttcacagtcttactgtt

SEQ ID NO: 524763 - DNA, 25 bp, Homo sapien
taaccaagtagtgatgcagagcatt

SEQ ID NO: 524764 - DNA, 25 bp, Homo sapien
aaacttagccattaaccgtctgaat

SEQ ID NO: 524765 - DNA, 25 bp, Homo sapien
cattaaccgtctgaatcgtttcctt

SEQ ID NO: 524766 - DNA, 25 bp, Homo sapien
agtgctttctttgcccatgtaaatg

SEQ ID NO: 524767 - DNA, 25 bp, Homo sapien
aaatgagaactcaactgctgtttac

SEQ ID NO: 524768 - DNA, 25 bp, Homo sapien
tcaactgctgtttacagtgtcagat

SEQ ID NO: 524769 - DNA, 25 bp, Homo sapien
gaaaggtgtgatttctccaatttac

SEQ ID NO: 524770 - DNA, 25 bp, Homo sapien
aatttaccctctttggatggtgcca

SEQ ID NO: 524771 - DNA, 25 bp, Homo sapien
atggtgccaggtggacgtgacatct

SEQ ID NO: 524772 - DNA, 25 bp, Homo sapien
ggtggacgtgacatctcgtgcctgt

SEQ ID NO: 524773 - DNA, 25 bp, Homo sapien
acatctcgtgcctgtccggtgcggg

SEQ ID NO: 524774 - DNA, 25 bp, Homo sapien
ggtagcagacaggtggttacattag

SEQ ID NO: 524775 - DNA, 25 bp, Homo sapien
ggttacattagaatagtcacacaaa

SEQ ID NO: 524776 - DNA, 25 bp, Homo sapien
gtcacacaaactgttcagtgttgca

SEQ ID NO: 524777 - DNA, 25 bp, Homo sapien
agtgttgcaggaaccttttcttggg

SEQ ID NO: 524778 - DNA, 25 bp, Homo sapien
aatgcaatgcactaaaactatttta

SEQ ID NO: 524779 - DNA, 25 bp, Homo sapien
gaatgtagttaattctgcttattca

SEQ ID NO: 524780 - DNA, 25 bp, Homo sapien
tctgcttattcataaagtgggcatc

SEQ ID NO: 524781 - DNA, 25 bp, Homo sapien
agtgggcatcttctgtgttttaggt

SEQ ID NO: 524782 - DNA, 25 bp, Homo sapien
gcatcttctgtgttttaggtgtaat

SEQ ID NO: 524783 - DNA, 25 bp, Homo sapien
atatcgaagtcctggcttttctcgt

SEQ ID NO: 524784 - DNA, 25 bp, Homo sapien
tggcttttctcgttttctcacttgc

SEQ ID NO: 524785 - DNA, 25 bp, Homo sapien
ggaattttcatacctgtgtcagtct

SEQ ID NO: 524786 - DNA, 25 bp, Homo sapien
acctgtgtcagtctaaatgagcatt

SEQ ID NO: 524787 - DNA, 25 bp, Homo sapien
gagcattaccttgtctgaattgtct

SEQ ID NO: 524788 - DNA, 25 bp, Homo sapien
ttctttgtacacatttgcttctccc

SEQ ID NO: 524789 - DNA, 25 bp, Homo sapien
gtctaagtggtaagcttcgtgattt

SEQ ID NO: 524790 - DNA, 25 bp, Homo sapien
tttgaaaaactgcttccgtggatta

SEQ ID NO: 524791 - DNA, 25 bp, Homo sapien
agttgtcaccactaaagtgggctgt

SEQ ID NO: 524792 - DNA, 25 bp, Homo sapien
gtggtggagtcgatgctgatcctca

SEQ ID NO: 524793 - DNA, 25 bp, Homo sapien
gatgctgatcctcacttagggcagt

SEQ ID NO: 524794 - DNA, 25 bp, Homo sapien
ctcacttagggcagtggcctccaag

SEQ ID NO: 524795 - DNA, 25 bp, Homo sapien
tctcccaggatagtgtcatagtgcc

SEQ ID NO: 524796 - DNA, 25 bp, Homo sapien
atttcatagacttaagtgtattcct

SEQ ID NO: 524797 - DNA, 25 bp, Homo sapien
gtgtattcctaatttaacggtgcaa

SEQ ID NO: 524798 - DNA, 25 bp, Homo sapien
gtatatactgtacagttcagatttt

SEQ ID NO: 524799 - DNA, 25 bp, Homo sapien
aaagctgatatttttatatccctga

SEQ ID NO: 524800 - DNA, 25 bp, Homo sapien
atatccctgaattgtaagccgtttg

SEQ ID NO: 524801 - DNA, 25 bp, Homo sapien
taagccgtttgttacgctgcagtgc

SEQ ID NO: 524802 - DNA, 25 bp, Homo sapien
tacgctgcagtgctagatttgccag

SEQ ID NO: 524803 - DNA, 25 bp, Homo sapien
cagtgctagatttgccagggaacca

SEQ ID NO: 524804 - DNA, 25 bp, Homo sapien
ggatgaactgattgcttatatttta

SEQ ID NO: 524805 - DNA, 25 bp, Homo sapien
gatggtcaaatttacattgcctagt

SEQ ID NO: 524806 - DNA, 25 bp, Homo sapien
tacattgcctagtgatggaaaattc

SEQ ID NO: 524807 - DNA, 25 bp, Homo sapien
gacagacttcctacatcagggacag

SEQ ID NO: 524808 - DNA, 25 bp, Homo sapien
tatctgtgtgtcattatacaaaaca

SEQ ID NO: 524809 - DNA, 25 bp, Homo sapien
aatgatcttttgtactttaggacat

SEQ ID NO: 524810 - DNA, 25 bp, Homo sapien
aagcttaggaactttctgtttagca

SEQ ID NO: 524811 - DNA, 25 bp, Homo sapien
ttctgtttagcaggaaggcaacaca

SEQ ID NO: 524812 - DNA, 25 bp, Homo sapien
ggcaacacattcctacacttttaat

SEQ ID NO: 524813 - DNA, 25 bp, Homo sapien
gtatatgtttgttataatgtccatg

SEQ ID NO: 524814 - DNA, 25 bp, Homo sapien
aatgtccatgtaaacatgccctatg

SEQ ID NO: 524815 - DNA, 25 bp, Homo sapien
catgccctatgtttgtgccttttaa

SEQ ID NO: 524816 - DNA, 25 bp, Homo sapien
gccctatgtttgtgccttttaatta

SEQ ID NO: 524817 - DNA, 25 bp, Homo sapien
tgccttttaattagtttgtctcaat

SEQ ID NO: 524818 - DNA, 25 bp, Homo sapien
gcagagtacgtttttcccttctggt

SEQ ID NO: 524819 - DNA, 25 bp, Homo sapien
ttcccttctggttgtaacctggttg

SEQ ID NO: 524820 - DNA, 25 bp, Homo sapien
tggttgagagcttcccctttatcag

SEQ ID NO: 524821 - DNA, 25 bp, Homo sapien
agcttcccctttatcagattggcag

SEQ ID NO: 524822 - DNA, 25 bp, Homo sapien
agattggcagctaaacagttgtatt

SEQ ID NO: 524823 - DNA, 25 bp, Homo sapien
aatctgacatccagcctgttacgct

SEQ ID NO: 524824 - DNA, 25 bp, Homo sapien
tgttacgctctagggctcgctgctt

SEQ ID NO: 524825 - DNA, 25 bp, Homo sapien
tttattgtgtatccgttcccctcct

SEQ ID NO: 524826 - DNA, 25 bp, Homo sapien
tcctacggtgtgctcctgaatgaag

SEQ ID NO: 524827 - DNA, 25 bp, Homo sapien
agcagatgatgattttacctgtcaa

SEQ ID NO: 524828 - DNA, 25 bp, Homo sapien
ttacctgtcaataccagcactgtat

SEQ ID NO: 524829 - DNA, 25 bp, Homo sapien
ctcagagtttgcaaaccagattgta

SEQ ID NO: 524830 - DNA, 25 bp, Homo sapien
gagtttgcaaaccagattgtacaag

SEQ ID NO: 524831 - DNA, 25 bp, Homo sapien
agattgtacaagtcattagcgtcag

SEQ ID NO: 524832 - DNA, 25 bp, Homo sapien
tgtacaagtcattagcgtcagatag

SEQ ID NO: 524833 - DNA, 25 bp, Homo sapien
gtcattagcgtcagatagctttaaa

SEQ ID NO: 524834 - DNA, 25 bp, Homo sapien
aaagttgtgaccttcttgtacatga

SEQ ID NO: 524835 - DNA, 25 bp, Homo sapien
gtaacgaaacatgaaatcctagaat

SEQ ID NO: 524836 - DNA, 25 bp, Homo sapien
ggcataaggaaactcgtttgcaggc

SEQ ID NO: 524837 - DNA, 25 bp, Homo sapien
tttgcaggctctctgtccagggctg

SEQ ID NO: 524838 - DNA, 25 bp, Homo sapien
ggccagtgagtcttaggtatgttta

SEQ ID NO: 524839 - DNA, 25 bp, Homo sapien
ccagtgagtcttaggtatgtttatt

SEQ ID NO: 524840 - DNA, 25 bp, Homo sapien
ctgagagaccatcaagggaacttta

SEQ ID NO: 524841 - DNA, 25 bp, Homo sapien
gggaactttaacaacttgacaaatg

SEQ ID NO: 524842 - DNA, 25 bp, Homo sapien
atgtccttgaagtaagatgcctcat

SEQ ID NO: 524843 - DNA, 25 bp, Homo sapien
agatgcctcatctttagggaaaaat

SEQ ID NO: 524844 - DNA, 25 bp, Homo sapien
gatttctgcttaggcaaagtctcct

SEQ ID NO: 524845 - DNA, 25 bp, Homo sapien
taggcaaagtctcctgcagttcatc

SEQ ID NO: 524846 - DNA, 25 bp, Homo sapien
aaagtctcctgcagttcatccttct

SEQ ID NO: 524847 - DNA, 25 bp, Homo sapien
ggacctaaggtgaagcaaacttgaa

SEQ ID NO: 524848 - DNA, 25 bp, Homo sapien
gaagttctatctgacaagtttaggc

SEQ ID NO: 524849 - DNA, 25 bp, Homo sapien
ggagggaaatcggagcaaagctccc

SEQ ID NO: 524850 - DNA, 25 bp, Homo sapien
caaagctccctcactttattgttga

SEQ ID NO: 524851 - DNA, 25 bp, Homo sapien
gggcgatgctccagaggcctgacca

SEQ ID NO: 524852 - DNA, 25 bp, Homo sapien
ggcgatgctccagaggcctgaccag

SEQ ID NO: 524853 - DNA, 25 bp, Homo sapien
gcgatgctccagaggcctgaccagc

SEQ ID NO: 524854 - DNA, 25 bp, Homo sapien
tgctccagaggcctgaccagccatg

SEQ ID NO: 524855 - DNA, 25 bp, Homo sapien
tccagaggcctgaccagccatggag

SEQ ID NO: 524856 - DNA, 25 bp, Homo sapien
agaggcctgaccagccatggaggcc

SEQ ID NO: 524857 - DNA, 25 bp, Homo sapien
tggaggagctgacggacgaggagat

SEQ ID NO: 524858 - DNA, 25 bp, Homo sapien
acggacgaggagatggcggcgctag

SEQ ID NO: 524859 - DNA, 25 bp, Homo sapien
atggcggcgctaggcaaggaagagc

SEQ ID NO: 524860 - DNA, 25 bp, Homo sapien
aaggaagagctagtgcggcgcctgc

SEQ ID NO: 524861 - DNA, 25 bp, Homo sapien
ggaagagctagtgcggcgcctgcgg

SEQ ID NO: 524862 - DNA, 25 bp, Homo sapien
caaaagggacagtggcccatttggg

SEQ ID NO: 524863 - DNA, 25 bp, Homo sapien
gagacctttaggatcaatgggaatc

SEQ ID NO: 524864 - DNA, 25 bp, Homo sapien
gggaatcaattccattgttttgcct

SEQ ID NO: 524865 - DNA, 25 bp, Homo sapien
aattccattgttttgcctcagagta

SEQ ID NO: 524866 - DNA, 25 bp, Homo sapien
gttttgcctcagagtaaagtttctg

SEQ ID NO: 524867 - DNA, 25 bp, Homo sapien
atagaggcatatcccaagtcttcct

SEQ ID NO: 524868 - DNA, 25 bp, Homo sapien
agtcttccttcattccacaaataat

SEQ ID NO: 524869 - DNA, 25 bp, Homo sapien
attacaaacaacctactgtgtgcca

SEQ ID NO: 524870 - DNA, 25 bp, Homo sapien
ggcactattcttagcactggaaata

SEQ ID NO: 524871 - DNA, 25 bp, Homo sapien
gaagcagatgaggaccctgtttatt

SEQ ID NO: 524872 - DNA, 25 bp, Homo sapien
gaggaccctgtttattgtttctctc

SEQ ID NO: 524873 - DNA, 25 bp, Homo sapien
taattccaagtgaagcagcacagtg

SEQ ID NO: 524874 - DNA, 25 bp, Homo sapien
attccaagtgaagcagcacagtgct

SEQ ID NO: 524875 - DNA, 25 bp, Homo sapien
ttcatccatggtgccatgttaaaga

SEQ ID NO: 524876 - DNA, 25 bp, Homo sapien
tcttgaaaatcctatcttcctttta

SEQ ID NO: 524877 - DNA, 25 bp, Homo sapien
gaaaatcctatcttccttttaggct

SEQ ID NO: 524878 - DNA, 25 bp, Homo sapien
aatcctatcttccttttaggcttga

SEQ ID NO: 524879 - DNA, 25 bp, Homo sapien
tcctatcttccttttaggcttgaat

SEQ ID NO: 524880 - DNA, 25 bp, Homo sapien
atcttccttttaggcttgaatatga

SEQ ID NO: 524881 - DNA, 25 bp, Homo sapien
tttaggcttgaatatgatgctgaac

SEQ ID NO: 524882 - DNA, 25 bp, Homo sapien
ggcttgaatatgatgctgaacagta

SEQ ID NO: 524883 - DNA, 25 bp, Homo sapien
gatgctgaacagtaagtttgttaaa

SEQ ID NO: 524884 - DNA, 25 bp, Homo sapien
ggaaaaaccagtgtcctgcactctc

SEQ ID NO: 524885 - DNA, 25 bp, Homo sapien
ctgcactctctagcttcaaacagag

SEQ ID NO: 524886 - DNA, 25 bp, Homo sapien
aacagagtccagcacagtgtggcac

SEQ ID NO: 524887 - DNA, 25 bp, Homo sapien
cacccaaggtttccatgcagtttgc

SEQ ID NO: 524888 - DNA, 25 bp, Homo sapien
gcagtaaaccttttcggtcctactg

SEQ ID NO: 524889 - DNA, 25 bp, Homo sapien
ctatccaagggattgctgctgatct

SEQ ID NO: 524890 - DNA, 25 bp, Homo sapien
gctgctgatctttgtggtggattca

SEQ ID NO: 524891 - DNA, 25 bp, Homo sapien
gatcacagccgattacctgaagcca

SEQ ID NO: 524892 - DNA, 25 bp, Homo sapien
aataccttcatcagctaattgcagc

SEQ ID NO: 524893 - DNA, 25 bp, Homo sapien
taattgcagcaaacccagtacttcc

SEQ ID NO: 524894 - DNA, 25 bp, Homo sapien
tacttcctctggttgtgtttgcaaa

SEQ ID NO: 524895 - DNA, 25 bp, Homo sapien
ctttatatgagagggactgtctgtt

SEQ ID NO: 524896 - DNA, 25 bp, Homo sapien
gtctgttggaagcataatacactat

SEQ ID NO: 524897 - DNA, 25 bp, Homo sapien
gtaaatttaaaagcgtgactctcat

SEQ ID NO: 524898 - DNA, 25 bp, Homo sapien
ctatctaagatgttgggaattgtgt

SEQ ID NO: 524899 - DNA, 25 bp, Homo sapien
gtgtttattccatgttaacagtgaa

SEQ ID NO: 524900 - DNA, 25 bp, Homo sapien
gaaagtaggcattgttaaggcttta

SEQ ID NO: 524901 - DNA, 25 bp, Homo sapien
aattctcctttgatattagcagtct

SEQ ID NO: 524902 - DNA, 25 bp, Homo sapien
agcgtgactctcatttgaataactg

SEQ ID NO: 524903 - DNA, 25 bp, Homo sapien
gggtaaaccaagtagatctcatgaa

SEQ ID NO: 524904 - DNA, 25 bp, Homo sapien
aaccagaaattctcaatctattggc

SEQ ID NO: 524905 - DNA, 25 bp, Homo sapien
caatctattggcaacgggacaggtt

SEQ ID NO: 524906 - DNA, 25 bp, Homo sapien
aagtatatgattctgctgttgattc

SEQ ID NO: 524907 - DNA, 25 bp, Homo sapien
ccttttatcaatcattccagagtta

SEQ ID NO: 524908 - DNA, 25 bp, Homo sapien
gagttattttctattagtcaaactt

SEQ ID NO: 524909 - DNA, 25 bp, Homo sapien
ccttaccctggcaaattgcttcttt

SEQ ID NO: 524910 - DNA, 25 bp, Homo sapien
aattgcttctttacttgctggtttc

SEQ ID NO: 524911 - DNA, 25 bp, Homo sapien
tgcttctttacttgctggtttcctt

SEQ ID NO: 524912 - DNA, 25 bp, Homo sapien
tcctgcatttttagattccttttag

SEQ ID NO: 524913 - DNA, 25 bp, Homo sapien
cttttagttctaattgaggcctcac

SEQ ID NO: 524914 - DNA, 25 bp, Homo sapien
aattgaggcctcactagatgctctt

SEQ ID NO: 524915 - DNA, 25 bp, Homo sapien
aggcctcactagatgctcttcagtt

SEQ ID NO: 524916 - DNA, 25 bp, Homo sapien
actagatgctcttcagttctgtgta

SEQ ID NO: 524917 - DNA, 25 bp, Homo sapien
ccgaaccaggctcctcctgcttcaa

SEQ ID NO: 524918 - DNA, 25 bp, Homo sapien
cctcctgcttcaacagacccttggg

SEQ ID NO: 524919 - DNA, 25 bp, Homo sapien
gatgccaccgagacactcgcactgt

SEQ ID NO: 524920 - DNA, 25 bp, Homo sapien
gagacactcgcactgtcccttggct

SEQ ID NO: 524921 - DNA, 25 bp, Homo sapien
agacactcgcactgtcccttggctg

SEQ ID NO: 524922 - DNA, 25 bp, Homo sapien
gcactgtcccttggctgccgggcac

SEQ ID NO: 524923 - DNA, 25 bp, Homo sapien
tggctgccgggcaccccactgagcc

SEQ ID NO: 524924 - DNA, 25 bp, Homo sapien
aaagtctgccagcaacaggcccttt

SEQ ID NO: 524925 - DNA, 25 bp, Homo sapien
aagtctgccagcaacaggccctttg

SEQ ID NO: 524926 - DNA, 25 bp, Homo sapien
agtctgccagcaacaggccctttgc

SEQ ID NO: 524927 - DNA, 25 bp, Homo sapien
ccagcaacaggccctttgcctgggt

SEQ ID NO: 524928 - DNA, 25 bp, Homo sapien
aagagggcagaatccgcagctctca

SEQ ID NO: 524929 - DNA, 25 bp, Homo sapien
cagaatccgcagctctcatcattgt

SEQ ID NO: 524930 - DNA, 25 bp, Homo sapien
tgtgatgtgtagcatgtctgccctc

SEQ ID NO: 524931 - DNA, 25 bp, Homo sapien
gtctgccctctgactggacatcatt

SEQ ID NO: 524932 - DNA, 25 bp, Homo sapien
ggacatcattgccattaactttctt

SEQ ID NO: 524933 - DNA, 25 bp, Homo sapien
taactttcttctgggcatcacggca

SEQ ID NO: 524934 - DNA, 25 bp, Homo sapien
ttctgggcatcacggcaatgtcacg

SEQ ID NO: 524935 - DNA, 25 bp, Homo sapien
caatgtcacgatgcccagacttgga

SEQ ID NO: 524936 - DNA, 25 bp, Homo sapien
gcccagacttggagcaaggcaacct

SEQ ID NO: 524937 - DNA, 25 bp, Homo sapien
aaggcaaccttggagtcagtccact

SEQ ID NO: 524938 - DNA, 25 bp, Homo sapien
agtgtccctcctctatgtgaaaaga

SEQ ID NO: 524939 - DNA, 25 bp, Homo sapien
gcatttctggatgtctgagcttttc

SEQ ID NO: 524940 - DNA, 25 bp, Homo sapien
tctggatgtctgagcttttcaaatg

SEQ ID NO: 524941 - DNA, 25 bp, Homo sapien
gtctgagcttttcaaatgatacttc

SEQ ID NO: 524942 - DNA, 25 bp, Homo sapien
ttttcaaatgatacttcttttctgc

SEQ ID NO: 524943 - DNA, 25 bp, Homo sapien
ttcctttctgttggactggttccca

SEQ ID NO: 524944 - DNA, 25 bp, Homo sapien
tgttggactggttcccagagggtcc

SEQ ID NO: 524945 - DNA, 25 bp, Homo sapien
gtcatcttccttcccagcgctgttt

SEQ ID NO: 524946 - DNA, 25 bp, Homo sapien
cctgtttagaggtggaagcatgtaa

SEQ ID NO: 524947 - DNA, 25 bp, Homo sapien
ggatgcttgccaaaggacagcatat

SEQ ID NO: 524948 - DNA, 25 bp, Homo sapien
gacagcatattcaacatctggtatc

SEQ ID NO: 524949 - DNA, 25 bp, Homo sapien
caacatctggtatcaacaaggtaat

SEQ ID NO: 524950 - DNA, 25 bp, Homo sapien
gatgtggtgatattcttcttgctgt

SEQ ID NO: 524951 - DNA, 25 bp, Homo sapien
ggtgatattcttcttgctgtcaatg

SEQ ID NO: 524952 - DNA, 25 bp, Homo sapien
ttgctgtcaatggtagaagtacatc

SEQ ID NO: 524953 - DNA, 25 bp, Homo sapien
ggaatgatacatgcttgcttggcaa

SEQ ID NO: 524954 - DNA, 25 bp, Homo sapien
cttgcttggcaagactgctgaaaga

SEQ ID NO: 524955 - DNA, 25 bp, Homo sapien
ggaagaattactctaactattgttt

SEQ ID NO: 524956 - DNA, 25 bp, Homo sapien
taactattgtttcttggcctggcac

SEQ ID NO: 524957 - DNA, 25 bp, Homo sapien
tggcctggcacttttttatagaatc

SEQ ID NO: 524958 - DNA, 25 bp, Homo sapien
gaaacactatatttatcttgtcagt

SEQ ID NO: 524959 - DNA, 25 bp, Homo sapien
gtatgatcatctaatgaaagccagt

SEQ ID NO: 524960 - DNA, 25 bp, Homo sapien
tgaaagccagttacacctcagaaaa

SEQ ID NO: 524961 - DNA, 25 bp, Homo sapien
gtttgcttaacacctttctatgata

SEQ ID NO: 524962 - DNA, 25 bp, Homo sapien
cttgtagtatgtcttttaattttgt

SEQ ID NO: 524963 - DNA, 25 bp, Homo sapien
aatgttcactgatcaactgcagcag

SEQ ID NO: 524964 - DNA, 25 bp, Homo sapien
gttcaatgtgttatcaactgtttta

SEQ ID NO: 524965 - DNA, 25 bp, Homo sapien
gaaattcgtgtgcaaactgatatgt

SEQ ID NO: 524966 - DNA, 25 bp, Homo sapien
gatatgtatataactcctgaggcaa

SEQ ID NO: 524967 - DNA, 25 bp, Homo sapien
gaggcaacagaagtgcccggtcata

SEQ ID NO: 524968 - DNA, 25 bp, Homo sapien
agaagtgcccggtcatatggtgtaa

SEQ ID NO: 524969 - DNA, 25 bp, Homo sapien
actgcagcagtttatatctgtcatg

SEQ ID NO: 524970 - DNA, 25 bp, Homo sapien
atctgtcatgttttaatccactgca

SEQ ID NO: 524971 - DNA, 25 bp, Homo sapien
tgttttaatccactgcatgaggaag

SEQ ID NO: 524972 - DNA, 25 bp, Homo sapien
attcaagtcctttattttgtgtctt

SEQ ID NO: 524973 - DNA, 25 bp, Homo sapien
tattttaaattccacactcccttat

SEQ ID NO: 524974 - DNA, 25 bp, Homo sapien
acactcccttatttaatcactttgg

SEQ ID NO: 524975 - DNA, 25 bp, Homo sapien
ggtaagtgcctttgatgttttgaaa

SEQ ID NO: 524976 - DNA, 25 bp, Homo sapien
tgtaaatgtcatgtgccctgttccc

SEQ ID NO: 524977 - DNA, 25 bp, Homo sapien
tagcttctcaattcctcataaccat

SEQ ID NO: 524978 - DNA, 25 bp, Homo sapien
tcctcataaccatttttaccagtgt

SEQ ID NO: 524979 - DNA, 25 bp, Homo sapien
taccagtgttgcaaagtttagacct

SEQ ID NO: 524980 - DNA, 25 bp, Homo sapien
gtttagacctttgtgttaatatcag

SEQ ID NO: 524981 - DNA, 25 bp, Homo sapien
agaagtgtatttgtagcccctccat

SEQ ID NO: 524982 - DNA, 25 bp, Homo sapien
gtagcccctccatagtgaacaatga

SEQ ID NO: 524983 - DNA, 25 bp, Homo sapien
aaaataggccaaatcactttttatg

SEQ ID NO: 524984 - DNA, 25 bp, Homo sapien
gcaatcatgttttatacagtggtct

SEQ ID NO: 524985 - DNA, 25 bp, Homo sapien
tacagtggtctcattgcacattgtg

SEQ ID NO: 524986 - DNA, 25 bp, Homo sapien
ttctgcactttttacggtatcctta

SEQ ID NO: 524987 - DNA, 25 bp, Homo sapien
ttacggtatccttatcatgctggta

SEQ ID NO: 524988 - DNA, 25 bp, Homo sapien
gtatccttatcatgctggtatgtca

SEQ ID NO: 524989 - DNA, 25 bp, Homo sapien
gctggtatgtcaatatacaccctaa

SEQ ID NO: 524990 - DNA, 25 bp, Homo sapien
ctccatttaatgattgtgccttgta

SEQ ID NO: 524991 - DNA, 25 bp, Homo sapien
tgattgtgccttgtattctattatt

SEQ ID NO: 524992 - DNA, 25 bp, Homo sapien
gaatgtattgctatatgtactgcta

SEQ ID NO: 524993 - DNA, 25 bp, Homo sapien
tgctatatgtactgctatggaaaag

SEQ ID NO: 524994 - DNA, 25 bp, Homo sapien
tctcctgccactggaccatgtttgt

SEQ ID NO: 524995 - DNA, 25 bp, Homo sapien
atgtttgtctctcttgaacagccct

SEQ ID NO: 524996 - DNA, 25 bp, Homo sapien
ttgtctctcttgaacagccctgttt

SEQ ID NO: 524997 - DNA, 25 bp, Homo sapien
tctctcttgaacagccctgtttcta

SEQ ID NO: 524998 - DNA, 25 bp, Homo sapien
cttgaacagccctgtttctaccagt

SEQ ID NO: 524999 - DNA, 25 bp, Homo sapien
agcaagttccatgtcagcctcggca

SEQ ID NO: 525000 - DNA, 25 bp, Homo sapien
aagttccatgtcagcctcggcagaa

SEQ ID NO: 525001 - DNA, 25 bp, Homo sapien
tccatgtcagcctcggcagaagcct

SEQ ID NO: 525002 - DNA, 25 bp, Homo sapien
accttctatcccaaatcccagcatt

SEQ ID NO: 525003 - DNA, 25 bp, Homo sapien
agcattcccttcaggtgccacgctg

SEQ ID NO: 525004 - DNA, 25 bp, Homo sapien
attcccttcaggtgccacgctgtgc

SEQ ID NO: 525005 - DNA, 25 bp, Homo sapien
cccagtgggctttcggatttgtact

SEQ ID NO: 525006 - DNA, 25 bp, Homo sapien
ccagtgggctttcggatttgtactt

SEQ ID NO: 525007 - DNA, 25 bp, Homo sapien
gtgggctttcggatttgtacttaga

SEQ ID NO: 525008 - DNA, 25 bp, Homo sapien
ggctttcggatttgtacttagaaca

SEQ ID NO: 525009 - DNA, 25 bp, Homo sapien
tcggatttgtacttagaacatctag

SEQ ID NO: 525010 - DNA, 25 bp, Homo sapien
tttgtacttagaacatctaggaggg

SEQ ID NO: 525011 - DNA, 25 bp, Homo sapien
gaaaccacgtctctgctaaaactat

SEQ ID NO: 525012 - DNA, 25 bp, Homo sapien
attagctggccgtgatggcaagtga

SEQ ID NO: 525013 - DNA, 25 bp, Homo sapien
agctggccgtgatggcaagtgatta

SEQ ID NO: 525014 - DNA, 25 bp, Homo sapien
ggccgtgatggcaagtgattataat

SEQ ID NO: 525015 - DNA, 25 bp, Homo sapien
ggcaagtgattataatcccagctcc

SEQ ID NO: 525016 - DNA, 25 bp, Homo sapien
gctcaaactgcagcttgctacgtga

SEQ ID NO: 525017 - DNA, 25 bp, Homo sapien
ctgcagcttgctacgtgagtcacaa

SEQ ID NO: 525018 - DNA, 25 bp, Homo sapien
gagtcacaaggatagctagctggat

SEQ ID NO: 525019 - DNA, 25 bp, Homo sapien
gcataagaacatttgactgacacag

SEQ ID NO: 525020 - DNA, 25 bp, Homo sapien
tcccctgtatccaatgttctctttg

SEQ ID NO: 525021 - DNA, 25 bp, Homo sapien
ttccttatgcttttcccttttgcct

SEQ ID NO: 525022 - DNA, 25 bp, Homo sapien
cctttaaaagcttctcctggcttca

SEQ ID NO: 525023 - DNA, 25 bp, Homo sapien
cctggcttcaacctgtttggatatg

SEQ ID NO: 525024 - DNA, 25 bp, Homo sapien
ttcaacctgtttggatatgcctgtg

SEQ ID NO: 525025 - DNA, 25 bp, Homo sapien
tgtggtccctatagccctcatatgc

SEQ ID NO: 525026 - DNA, 25 bp, Homo sapien
ccctcatatgctggatttgcaaatc

SEQ ID NO: 525027 - DNA, 25 bp, Homo sapien
tttttaagaagccatcacctgagca

SEQ ID NO: 525028 - DNA, 25 bp, Homo sapien
taagaagccatcacctgagcaacca

SEQ ID NO: 525029 - DNA, 25 bp, Homo sapien
gaagccatcacctgagcaaccaaaa

SEQ ID NO: 525030 - DNA, 25 bp, Homo sapien
gccatcacctgagcaaccaaaaatt

SEQ ID NO: 525031 - DNA, 25 bp, Homo sapien
gagcaaccaaaaattcctctgcgct

SEQ ID NO: 525032 - DNA, 25 bp, Homo sapien
caaccaaaaattcctctgcgctggg

SEQ ID NO: 525033 - DNA, 25 bp, Homo sapien
ttggggaaaactgcagcccggccag

SEQ ID NO: 525034 - DNA, 25 bp, Homo sapien
cggccaggcagctgggaccagaatg

SEQ ID NO: 525035 - DNA, 25 bp, Homo sapien
tgggaccagaatgcaaccccagctc

SEQ ID NO: 525036 - DNA, 25 bp, Homo sapien
tcaccctgcggtgccctaaaggagg

SEQ ID NO: 525037 - DNA, 25 bp, Homo sapien
gggtatggcccccagtgcattccct

SEQ ID NO: 525038 - DNA, 25 bp, Homo sapien
atgccatttgttgccatgattaagg

SEQ ID NO: 525039 - DNA, 25 bp, Homo sapien
gggcctcgtattctggatttgcaat

SEQ ID NO: 525040 - DNA, 25 bp, Homo sapien
gaaaaggctgtgcttatggagaata

SEQ ID NO: 525041 - DNA, 25 bp, Homo sapien
gtctatctgactaattcgcttgagc

SEQ ID NO: 525042 - DNA, 25 bp, Homo sapien
attcgcttgagctagaacacataga

SEQ ID NO: 525043 - DNA, 25 bp, Homo sapien
gaagtcaagtttgcctccgaagcag

SEQ ID NO: 525044 - DNA, 25 bp, Homo sapien
taaaatcagggaagactgctgtcct

SEQ ID NO: 525045 - DNA, 25 bp, Homo sapien
tgtcctgggaaaccacttaatgttt

SEQ ID NO: 525046 - DNA, 25 bp, Homo sapien
aatagaacctggtgtgtccgtttct

SEQ ID NO: 525047 - DNA, 25 bp, Homo sapien
gtgtgtccgtttctctggtgaatcc

SEQ ID NO: 525048 - DNA, 25 bp, Homo sapien
atccaatggccacttctcaaccaaa

SEQ ID NO: 525049 - DNA, 25 bp, Homo sapien
ccatagaaagttcctgtggcaggca

SEQ ID NO: 525050 - DNA, 25 bp, Homo sapien
gtggcaggcacattcagcttattta

SEQ ID NO: 525051 - DNA, 25 bp, Homo sapien
catcatcttcccagctcattgcttt

SEQ ID NO: 525052 - DNA, 25 bp, Homo sapien
tggacacaaaccatcatcgcactgt

SEQ ID NO: 525053 - DNA, 25 bp, Homo sapien
cacaaaccatcatcgcactgtattg

SEQ ID NO: 525054 - DNA, 25 bp, Homo sapien
cactgtattgcaggagcatgtgctg

SEQ ID NO: 525055 - DNA, 25 bp, Homo sapien
ggaagcttttctttgcttcaacaga

SEQ ID NO: 525056 - DNA, 25 bp, Homo sapien
ggaaaacatcagtatctagtgtatt

SEQ ID NO: 525057 - DNA, 25 bp, Homo sapien
attgctttccttactccttcaccag

SEQ ID NO: 525058 - DNA, 25 bp, Homo sapien
ttcaccagtcagatatcatcaccat

SEQ ID NO: 525059 - DNA, 25 bp, Homo sapien
tttaaaataactgctctcacctgcc

SEQ ID NO: 525060 - DNA, 25 bp, Homo sapien
tttcatattgcttttgcagaacttt

SEQ ID NO: 525061 - DNA, 25 bp, Homo sapien
ttccctgatgagtttttgtcctgag

SEQ ID NO: 525062 - DNA, 25 bp, Homo sapien
gggccagtgcagttttcttgccact

SEQ ID NO: 525063 - DNA, 25 bp, Homo sapien
tttcttgccactttgttttcctctc

SEQ ID NO: 525064 - DNA, 25 bp, Homo sapien
tcctctcatataacttttccctgtc

SEQ ID NO: 525065 - DNA, 25 bp, Homo sapien
aacttttccctgtcaataaggcatt

SEQ ID NO: 525066 - DNA, 25 bp, Homo sapien
caataaggcatttaggctgagagaa

SEQ ID NO: 525067 - DNA, 25 bp, Homo sapien
gagcatgtgcatccaaatttgagat

SEQ ID NO: 525068 - DNA, 25 bp, Homo sapien
acctaatgactttaacttctttgat

SEQ ID NO: 525069 - DNA, 25 bp, Homo sapien
cttctttgatactgtgtttgtctta

SEQ ID NO: 525070 - DNA, 25 bp, Homo sapien
tatgaatataatggctttctcactt

SEQ ID NO: 525071 - DNA, 25 bp, Homo sapien
agggctcccttctcccgccaggcat

SEQ ID NO: 525072 - DNA, 25 bp, Homo sapien
gggctcccttctcccgccaggcatg

SEQ ID NO: 525073 - DNA, 25 bp, Homo sapien
ggctcccttctcccgccaggcatgg

SEQ ID NO: 525074 - DNA, 25 bp, Homo sapien
gctcccttctcccgccaggcatggg

SEQ ID NO: 525075 - DNA, 25 bp, Homo sapien
ctcccttctcccgccaggcatgggc

SEQ ID NO: 525076 - DNA, 25 bp, Homo sapien
tcccttctcccgccaggcatgggct

SEQ ID NO: 525077 - DNA, 25 bp, Homo sapien
cccttctcccgccaggcatgggctg

SEQ ID NO: 525078 - DNA, 25 bp, Homo sapien
ccttctcccgccaggcatgggctgc

SEQ ID NO: 525079 - DNA, 25 bp, Homo sapien
cttctcccgccaggcatgggctgca

SEQ ID NO: 525080 - DNA, 25 bp, Homo sapien
ttctcccgccaggcatgggctgcaa

SEQ ID NO: 525081 - DNA, 25 bp, Homo sapien
gatattagtttatttcgtctctctg

SEQ ID NO: 525082 - DNA, 25 bp, Homo sapien
gtttatttcgtctctctgacactct

SEQ ID NO: 525083 - DNA, 25 bp, Homo sapien
taagtttccacccagccttcctgta

SEQ ID NO: 525084 - DNA, 25 bp, Homo sapien
ttcctgtaaccaccttcctaaggat

SEQ ID NO: 525085 - DNA, 25 bp, Homo sapien
ttcctaaggatgactatggtcacat

SEQ ID NO: 525086 - DNA, 25 bp, Homo sapien
atggtcacattgttacagactctca

SEQ ID NO: 525087 - DNA, 25 bp, Homo sapien
tcacccacttatcttcctttctttt

SEQ ID NO: 525088 - DNA, 25 bp, Homo sapien
caaaagtcttcagatttccaaaagg

SEQ ID NO: 525089 - DNA, 25 bp, Homo sapien
gaaggactgcagcagacatttctgc

SEQ ID NO: 525090 - DNA, 25 bp, Homo sapien
aacagaggcagagttacataacggg

SEQ ID NO: 525091 - DNA, 25 bp, Homo sapien
gcagagataaaatcagccatattaa

SEQ ID NO: 525092 - DNA, 25 bp, Homo sapien
cttgagacccaaattgagcatgttg

SEQ ID NO: 525093 - DNA, 25 bp, Homo sapien
gagacccaaattgagcatgttgctg

SEQ ID NO: 525094 - DNA, 25 bp, Homo sapien
gacccaaattgagcatgttgctgtt

SEQ ID NO: 525095 - DNA, 25 bp, Homo sapien
aaattgagcatgttgctgttattcc

SEQ ID NO: 525096 - DNA, 25 bp, Homo sapien
tggagcaggagtggcagggctggct

SEQ ID NO: 525097 - DNA, 25 bp, Homo sapien
tggctgtgctgggttccagctcgct

SEQ ID NO: 525098 - DNA, 25 bp, Homo sapien
gagtggaagtgtttatcgagcatgc

SEQ ID NO: 525099 - DNA, 25 bp, Homo sapien
ggaagtgtttatcgagcatgcaaaa

SEQ ID NO: 525100 - DNA, 25 bp, Homo sapien
gcatgcaaaagaaaccctcacggct

SEQ ID NO: 525101 - DNA, 25 bp, Homo sapien
atgcaaaagaaaccctcacggctaa

SEQ ID NO: 525102 - DNA, 25 bp, Homo sapien
gctctgggagttgtgtctgtgtgac

SEQ ID NO: 525103 - DNA, 25 bp, Homo sapien
ggaaagtggagctgagcttgtcaca

SEQ ID NO: 525104 - DNA, 25 bp, Homo sapien
ctgagcttgtcacagacggatgcaa

SEQ ID NO: 525105 - DNA, 25 bp, Homo sapien
gacggatgcaagtgtgaactcagaa

SEQ ID NO: 525106 - DNA, 25 bp, Homo sapien
gtgaactcagaacatttcaatcaga

SEQ ID NO: 525107 - DNA, 25 bp, Homo sapien
gaaccaaaagtcctatttaatcatt

SEQ ID NO: 525108 - DNA, 25 bp, Homo sapien
gaggctggttgtaggtcttgcccaa

SEQ ID NO: 525109 - DNA, 25 bp, Homo sapien
gttgtaggtcttgcccaaataattc

SEQ ID NO: 525110 - DNA, 25 bp, Homo sapien
gaagtgcaattctgtggactgtcaa

SEQ ID NO: 525111 - DNA, 25 bp, Homo sapien
ggactgtcaaatgccaaacatggaa

SEQ ID NO: 525112 - DNA, 25 bp, Homo sapien
gtgcctgctgtattaacacactcgg

SEQ ID NO: 525113 - DNA, 25 bp, Homo sapien
taacacactcggaactttctggtga

SEQ ID NO: 525114 - DNA, 25 bp, Homo sapien
atgagggacatgacaaaatctgtgt

SEQ ID NO: 525115 - DNA, 25 bp, Homo sapien
atctgtgtccactagaatctaagct

SEQ ID NO: 525116 - DNA, 25 bp, Homo sapien
actagaatctaagctccatgcagga

SEQ ID NO: 525117 - DNA, 25 bp, Homo sapien
gctccatgcaggaacattgtttact

SEQ ID NO: 525118 - DNA, 25 bp, Homo sapien
ggaacattgtttactgctgcatgat

SEQ ID NO: 525119 - DNA, 25 bp, Homo sapien
actgctgcatgatcgtgaccttgaa

SEQ ID NO: 525120 - DNA, 25 bp, Homo sapien
gaccttgaacaagtacctaagaaat

SEQ ID NO: 525121 - DNA, 25 bp, Homo sapien
ctaagaaatagtggcttccctggaa

SEQ ID NO: 525122 - DNA, 25 bp, Homo sapien
gaatattttagtgagctcagcccca

SEQ ID NO: 525123 - DNA, 25 bp, Homo sapien
ctcagccccaattcgtcattataat

SEQ ID NO: 525124 - DNA, 25 bp, Homo sapien
aaaggattcttgcaagaagccttaa

SEQ ID NO: 525125 - DNA, 25 bp, Homo sapien
agccccgaagtgtaagcagcagcat

SEQ ID NO: 525126 - DNA, 25 bp, Homo sapien
gagcagcatcttggcgttattaaat

SEQ ID NO: 525127 - DNA, 25 bp, Homo sapien
tattaaattcaacccattccgatgg

SEQ ID NO: 525128 - DNA, 25 bp, Homo sapien
attccgatggctgcgtcagcatcta

SEQ ID NO: 525129 - DNA, 25 bp, Homo sapien
atcctgtgggctacagtttgccgac

SEQ ID NO: 525130 - DNA, 25 bp, Homo sapien
gcgtcagcatctattgctctgttta

SEQ ID NO: 525131 - DNA, 25 bp, Homo sapien
gtttttccttaagcaagcagttcca

SEQ ID NO: 525132 - DNA, 25 bp, Homo sapien
agcaagcagttccatttctagaaat

SEQ ID NO: 525133 - DNA, 25 bp, Homo sapien
gggcacatcggtgttatttatgacg

SEQ ID NO: 525134 - DNA, 25 bp, Homo sapien
gccgaccccatgcatgaggcagtaa

SEQ ID NO: 525135 - DNA, 25 bp, Homo sapien
ggccaagagcctggtataaattcat

SEQ ID NO: 525136 - DNA, 25 bp, Homo sapien
gttctggatgcaattcgtgcacgcc

SEQ ID NO: 525137 - DNA, 25 bp, Homo sapien
attcgtgcacgccaagaaactactt

SEQ ID NO: 525138 - DNA, 25 bp, Homo sapien
gaaactacttgcttgtcagtatttt

SEQ ID NO: 525139 - DNA, 25 bp, Homo sapien
tacatgtgtgtgaatatcagccagt

SEQ ID NO: 525140 - DNA, 25 bp, Homo sapien
aatatcagccagtacttacagtagg

SEQ ID NO: 525141 - DNA, 25 bp, Homo sapien
cagaaaaactgagaagacctgtctt

SEQ ID NO: 525142 - DNA, 25 bp, Homo sapien
gacctgtctttcaaaagatgggttt

SEQ ID NO: 525143 - DNA, 25 bp, Homo sapien
aaagtgacagtttggcatgggattt

SEQ ID NO: 525144 - DNA, 25 bp, Homo sapien
aattgagctgttgaagtcccacata

SEQ ID NO: 525145 - DNA, 25 bp, Homo sapien
gaagtcccacatataaccagattta

SEQ ID NO: 525146 - DNA, 25 bp, Homo sapien
gatttaataaagcttcacatgtgaa

SEQ ID NO: 525147 - DNA, 25 bp, Homo sapien
agcttggcctttgcgctttgattcc

SEQ ID NO: 525148 - DNA, 25 bp, Homo sapien
gcttggcctttgcgctttgattcca

SEQ ID NO: 525149 - DNA, 25 bp, Homo sapien
cttggcctttgcgctttgattccag

SEQ ID NO: 525150 - DNA, 25 bp, Homo sapien
tggcctttgcgctttgattccagat

SEQ ID NO: 525151 - DNA, 25 bp, Homo sapien
ggcctttgcgctttgattccagata

SEQ ID NO: 525152 - DNA, 25 bp, Homo sapien
gcctttgcgctttgattccagatag

SEQ ID NO: 525153 - DNA, 25 bp, Homo sapien
ctttgcgctttgattccagatagta

SEQ ID NO: 525154 - DNA, 25 bp, Homo sapien
tttgcgctttgattccagatagtaa

SEQ ID NO: 525155 - DNA, 25 bp, Homo sapien
ttgcgctttgattccagatagtaag

SEQ ID NO: 525156 - DNA, 25 bp, Homo sapien
cgccgtcttgtggatgctggccatg

SEQ ID NO: 525157 - DNA, 25 bp, Homo sapien
tgttcaaaccttccgcttggtcagt

SEQ ID NO: 525158 - DNA, 25 bp, Homo sapien
tcaaaccttccgcttggtcagtttt

SEQ ID NO: 525159 - DNA, 25 bp, Homo sapien
tttttctttggccagctgcccagtg

SEQ ID NO: 525160 - DNA, 25 bp, Homo sapien
gagaaaagtccacctttgggcagat

SEQ ID NO: 525161 - DNA, 25 bp, Homo sapien
tttgggcagatgtgatctccagcca

SEQ ID NO: 525162 - DNA, 25 bp, Homo sapien
atctccagccagtggctcagttttg

SEQ ID NO: 525163 - DNA, 25 bp, Homo sapien
tgtttgaaggacagcctgcatgtgg

SEQ ID NO: 525164 - DNA, 25 bp, Homo sapien
aaggacagcctgcatgtggctctgt

SEQ ID NO: 525165 - DNA, 25 bp, Homo sapien
ctgaatgtctttgtagagctacctg

SEQ ID NO: 525166 - DNA, 25 bp, Homo sapien
gtctttgtagagctacctggaaatt

SEQ ID NO: 525167 - DNA, 25 bp, Homo sapien
gagaggctgcctcagagctaaattt

SEQ ID NO: 525168 - DNA, 25 bp, Homo sapien
gttgcaagggtataagcagcacttt

SEQ ID NO: 525169 - DNA, 25 bp, Homo sapien
ggaagacagataacagcttcctgtc

SEQ ID NO: 525170 - DNA, 25 bp, Homo sapien
agcttcctgtctgggaaagattact

SEQ ID NO: 525171 - DNA, 25 bp, Homo sapien
actttgattcaacatttccttactc

SEQ ID NO: 525172 - DNA, 25 bp, Homo sapien
acatttccttactcttttggtgaga

SEQ ID NO: 525173 - DNA, 25 bp, Homo sapien
ggtgagaatgattcctactccctac

SEQ ID NO: 525174 - DNA, 25 bp, Homo sapien
tcctactccctacataaagtccagg

SEQ ID NO: 525175 - DNA, 25 bp, Homo sapien
agtccagggaggagctatttgtagc

SEQ ID NO: 525176 - DNA, 25 bp, Homo sapien
tctgtctgccatttaccaccatttg

SEQ ID NO: 525177 - DNA, 25 bp, Homo sapien
accaccatttgtaccccacagggag

SEQ ID NO: 525178 - DNA, 25 bp, Homo sapien
ttctgtgtacacaatcttgtcattt

SEQ ID NO: 525179 - DNA, 25 bp, Homo sapien
aggagagttttatctccttctaatc

SEQ ID NO: 525180 - DNA, 25 bp, Homo sapien
tctccttctaatcctgtatcttata

SEQ ID NO: 525181 - DNA, 25 bp, Homo sapien
ccttctaatcctgtatcttatatgg

SEQ ID NO: 525182 - DNA, 25 bp, Homo sapien
atgtgtttgcattgactgggacctc

SEQ ID NO: 525183 - DNA, 25 bp, Homo sapien
tttgcattgactgggacctctttca

SEQ ID NO: 525184 - DNA, 25 bp, Homo sapien
attgactgggacctctttcacaatt

SEQ ID NO: 525185 - DNA, 25 bp, Homo sapien
actgggacctctttcacaattgtga

SEQ ID NO: 525186 - DNA, 25 bp, Homo sapien
tgcacaattcaagcctgtattcaag

SEQ ID NO: 525187 - DNA, 25 bp, Homo sapien
tcaagcctgtattcaagagtcaact

SEQ ID NO: 525188 - DNA, 25 bp, Homo sapien
gctatattcatccattaattctaat

SEQ ID NO: 525189 - DNA, 25 bp, Homo sapien
atgcagtctcattgcaggactcctg

SEQ ID NO: 525190 - DNA, 25 bp, Homo sapien
aggactcctggaatattgtctggtt

SEQ ID NO: 525191 - DNA, 25 bp, Homo sapien
attgtctggttcttggtatttactg

SEQ ID NO: 525192 - DNA, 25 bp, Homo sapien
tactgtatgtaagcaacaacttgaa

SEQ ID NO: 525193 - DNA, 25 bp, Homo sapien
aaaggtggcaatatggtgtcgattt

SEQ ID NO: 525194 - DNA, 25 bp, Homo sapien
ggtgtcgatttggactatgaatcaa

SEQ ID NO: 525195 - DNA, 25 bp, Homo sapien
tgaatcaaaagacctttttcaggtt

SEQ ID NO: 525196 - DNA, 25 bp, Homo sapien
tcaggttctttcactattgtctggg

SEQ ID NO: 525197 - DNA, 25 bp, Homo sapien
gtttgtccatttaggtaacatctgt

SEQ ID NO: 525198 - DNA, 25 bp, Homo sapien
aggtaacatctgtcttaccttcctc

SEQ ID NO: 525199 - DNA, 25 bp, Homo sapien
ttaccttcctcacagactttgtaca

SEQ ID NO: 525200 - DNA, 25 bp, Homo sapien
cccagtgggctttcggatttgtact

SEQ ID NO: 525201 - DNA, 25 bp, Homo sapien
ccagtgggctttcggatttgtactt

SEQ ID NO: 525202 - DNA, 25 bp, Homo sapien
gtgggctttcggatttgtacttaga

SEQ ID NO: 525203 - DNA, 25 bp, Homo sapien
ggctttcggatttgtacttagaaca

SEQ ID NO: 525204 - DNA, 25 bp, Homo sapien
tcggatttgtacttagaacatctag

SEQ ID NO: 525205 - DNA, 25 bp, Homo sapien
tttgtacttagaacatctaggaggg

SEQ ID NO: 525206 - DNA, 25 bp, Homo sapien
attagctggccgtgatggcaagtga

SEQ ID NO: 525207 - DNA, 25 bp, Homo sapien
agctggccgtgatggcaagtgatta

SEQ ID NO: 525208 - DNA, 25 bp, Homo sapien
ggccgtgatggcaagtgattataat

SEQ ID NO: 525209 - DNA, 25 bp, Homo sapien
gatggcaagtgattataatcccagc

SEQ ID NO: 525210 - DNA, 25 bp, Homo sapien
ggcaagtgattataatcccagctcc

SEQ ID NO: 525211 - DNA, 25 bp, Homo sapien
tggagtttcctcttgaatgtacatg

SEQ ID NO: 525212 - DNA, 25 bp, Homo sapien
ctcttgaatgtacatgaaccactgt

SEQ ID NO: 525213 - DNA, 25 bp, Homo sapien
gaaccactgtaatagcattagactt

SEQ ID NO: 525214 - DNA, 25 bp, Homo sapien
gcattagacttttaattgagtgtgc

SEQ ID NO: 525215 - DNA, 25 bp, Homo sapien
ttgagtgtgcaatcgttttccatgg

SEQ ID NO: 525216 - DNA, 25 bp, Homo sapien
ttttccatggagtttggtccgttca

SEQ ID NO: 525217 - DNA, 25 bp, Homo sapien
atggagtttggtccgttcattattt

SEQ ID NO: 525218 - DNA, 25 bp, Homo sapien
tagttaactacacttcttgatattc

SEQ ID NO: 525219 - DNA, 25 bp, Homo sapien
gaaaaacactttactactgcagaag

SEQ ID NO: 525220 - DNA, 25 bp, Homo sapien
agaatataatatgaccatcttcagg

SEQ ID NO: 525221 - DNA, 25 bp, Homo sapien
catcttcaggtataacagtgttgtt

SEQ ID NO: 525222 - DNA, 25 bp, Homo sapien
gaaaagaattggactggtatcagac

SEQ ID NO: 525223 - DNA, 25 bp, Homo sapien
ctggtatcagacagtggaatcatat

SEQ ID NO: 525224 - DNA, 25 bp, Homo sapien
gtggaatcatatctatacctgttaa

SEQ ID NO: 525225 - DNA, 25 bp, Homo sapien
aggcatacacctaaacatactttga

SEQ ID NO: 525226 - DNA, 25 bp, Homo sapien
aagaagtctctttccagccaagcat

SEQ ID NO: 525227 - DNA, 25 bp, Homo sapien
aagggatgcagaaaggattccaaga

SEQ ID NO: 525228 - DNA, 25 bp, Homo sapien
gattccaagaatctatcatctgcat

SEQ ID NO: 525229 - DNA, 25 bp, Homo sapien
tcatctgcatatccccatctgaaga

SEQ ID NO: 525230 - DNA, 25 bp, Homo sapien
tctgcatatccccatctgaagaaac

SEQ ID NO: 525231 - DNA, 25 bp, Homo sapien
gaaactgaaaagaggactgtaacta

SEQ ID NO: 525232 - DNA, 25 bp, Homo sapien
gattccagacagaaagaagttattt

SEQ ID NO: 525233 - DNA, 25 bp, Homo sapien
gggaagatctcgtctgctcacctta

SEQ ID NO: 525234 - DNA, 25 bp, Homo sapien
ggaagatctcgtctgctcaccttag

SEQ ID NO: 525235 - DNA, 25 bp, Homo sapien
gaagatctcgtctgctcaccttagc

SEQ ID NO: 525236 - DNA, 25 bp, Homo sapien
aagatctcgtctgctcaccttagct

SEQ ID NO: 525237 - DNA, 25 bp, Homo sapien
agatctcgtctgctcaccttagctt

SEQ ID NO: 525238 - DNA, 25 bp, Homo sapien
gatctcgtctgctcaccttagcttt

SEQ ID NO: 525239 - DNA, 25 bp, Homo sapien
tcgtctgctcaccttagctttctgc

SEQ ID NO: 525240 - DNA, 25 bp, Homo sapien
ggctgcggaagaaagcacgctgggc

SEQ ID NO: 525241 - DNA, 25 bp, Homo sapien
ggcaggggtgcccaagccacaggga

SEQ ID NO: 525242 - DNA, 25 bp, Homo sapien
ttctggtgaccttggcgctccttca

SEQ ID NO: 525243 - DNA, 25 bp, Homo sapien
agtctctagcctctccatctgtctg

SEQ ID NO: 525244 - DNA, 25 bp, Homo sapien
tatttgaggatattaaggtactata

SEQ ID NO: 525245 - DNA, 25 bp, Homo sapien
aaggtactatattattgaagattcc

SEQ ID NO: 525246 - DNA, 25 bp, Homo sapien
ggtactatattattgaagattccat

SEQ ID NO: 525247 - DNA, 25 bp, Homo sapien
gtactatattattgaagattccatg

SEQ ID NO: 525248 - DNA, 25 bp, Homo sapien
ctatattattgaagattccatggtt

SEQ ID NO: 525249 - DNA, 25 bp, Homo sapien
attattgaagattccatggttatgt

SEQ ID NO: 525250 - DNA, 25 bp, Homo sapien
ttattgaagattccatggttatgtt

SEQ ID NO: 525251 - DNA, 25 bp, Homo sapien
attgaagattccatggttatgtttt

SEQ ID NO: 525252 - DNA, 25 bp, Homo sapien
ttgaagattccatggttatgttttt

SEQ ID NO: 525253 - DNA, 25 bp, Homo sapien
tgaagattccatggttatgtttttt

SEQ ID NO: 525254 - DNA, 25 bp, Homo sapien
gaagattccatggttatgtttttta

SEQ ID NO: 525255 - DNA, 25 bp, Homo sapien
gggccttgatttgatctcaaataag

SEQ ID NO: 525256 - DNA, 25 bp, Homo sapien
atttgatctcaaataagccatagag

SEQ ID NO: 525257 - DNA, 25 bp, Homo sapien
gcaggtgtgtactgacaattcccct

SEQ ID NO: 525258 - DNA, 25 bp, Homo sapien
acatgtcttgagctgggacctcgtc

SEQ ID NO: 525259 - DNA, 25 bp, Homo sapien
tgagctgggacctcgtcatctgaga

SEQ ID NO: 525260 - DNA, 25 bp, Homo sapien
tgggacctcgtcatctgagacttcc

SEQ ID NO: 525261 - DNA, 25 bp, Homo sapien
atgcaaatgcacacaaacccatgca

SEQ ID NO: 525262 - DNA, 25 bp, Homo sapien
aaacccatgcatacacaagcacaca

SEQ ID NO: 525263 - DNA, 25 bp, Homo sapien
tagccctgtccctattcagttggca

SEQ ID NO: 525264 - DNA, 25 bp, Homo sapien
tattcagttggcacaggctgcctga

SEQ ID NO: 525265 - DNA, 25 bp, Homo sapien
gttggcacaggctgcctgaccctgg

SEQ ID NO: 525266 - DNA, 25 bp, Homo sapien
attcaatgcccacatgcttttcctt

SEQ ID NO: 525267 - DNA, 25 bp, Homo sapien
gcttttccttcttgtttcagaacag

SEQ ID NO: 525268 - DNA, 25 bp, Homo sapien
ttgtttcagaacagcacatggtcac

SEQ ID NO: 525269 - DNA, 25 bp, Homo sapien
gcacatggtcacaacaagatatttt

SEQ ID NO: 525270 - DNA, 25 bp, Homo sapien
caaagccttttgtctccttgtgcct

SEQ ID NO: 525271 - DNA, 25 bp, Homo sapien
cttgtgcctctttttatccttagga

SEQ ID NO: 525272 - DNA, 25 bp, Homo sapien
gaaaagatccaggtgcttgtgaaaa

SEQ ID NO: 525273 - DNA, 25 bp, Homo sapien
tgaatgcaacaagggaggctggtcc

SEQ ID NO: 525274 - DNA, 25 bp, Homo sapien
tggtcctgttgctgtcgccgattaa

SEQ ID NO: 525275 - DNA, 25 bp, Homo sapien
tgctgtcgccgattaagttttaaac

SEQ ID NO: 525276 - DNA, 25 bp, Homo sapien
atttattatttatgtctgccgtatt

SEQ ID NO: 525277 - DNA, 25 bp, Homo sapien
gacttcgagagagcctgatcctggg

SEQ ID NO: 525278 - DNA, 25 bp, Homo sapien
gggtcttctgagactccaccaggag

SEQ ID NO: 525279 - DNA, 25 bp, Homo sapien
actccaccaggagccggagagggca

SEQ ID NO: 525280 - DNA, 25 bp, Homo sapien
ggagccaaatccagctaggaggtta

SEQ ID NO: 525281 - DNA, 25 bp, Homo sapien
gctaggaggttacagattgcttttc

SEQ ID NO: 525282 - DNA, 25 bp, Homo sapien
ggttacagattgcttttcctgggct

SEQ ID NO: 525283 - DNA, 25 bp, Homo sapien
acagattgcttttcctgggctgggc

SEQ ID NO: 525284 - DNA, 25 bp, Homo sapien
gcacaggggatttcaaacgttctac

SEQ ID NO: 525285 - DNA, 25 bp, Homo sapien
ctacgtcctaaagccaggaagagtg

SEQ ID NO: 525286 - DNA, 25 bp, Homo sapien
aggagcctccctgagaaggtgtcac

SEQ ID NO: 525287 - DNA, 25 bp, Homo sapien
agaaggtgtcaccttatctgtcctc

SEQ ID NO: 525288 - DNA, 25 bp, Homo sapien
agtggtcagcaccacctaccataca

SEQ ID NO: 525289 - DNA, 25 bp, Homo sapien
ggtcagcaccacctaccatacagaa

SEQ ID NO: 525290 - DNA, 25 bp, Homo sapien
gcaccacctaccatacagaacgcag

SEQ ID NO: 525291 - DNA, 25 bp, Homo sapien
tggtctagcctcagaagaagtctag

SEQ ID NO: 525292 - DNA, 25 bp, Homo sapien
ctagcctcagaagaagtctagacat

SEQ ID NO: 525293 - DNA, 25 bp, Homo sapien
ggacccctcagagggttttaagcag

SEQ ID NO: 525294 - DNA, 25 bp, Homo sapien
tcttaggagagggaatgtctgtgct

SEQ ID NO: 525295 - DNA, 25 bp, Homo sapien
gagagggaatgtctgtgctgaggcc

SEQ ID NO: 525296 - DNA, 25 bp, Homo sapien
gagagttggccagggaactgagagc

SEQ ID NO: 525297 - DNA, 25 bp, Homo sapien
tgagagcagcgtgtgcagaggccca

SEQ ID NO: 525298 - DNA, 25 bp, Homo sapien
gtgcagaggcccagtggtcagcacc

SEQ ID NO: 525299 - DNA, 25 bp, Homo sapien
agaaacacattctggtgcttagcga

SEQ ID NO: 525300 - DNA, 25 bp, Homo sapien
aacacattctggtgcttagcgagct

SEQ ID NO: 525301 - DNA, 25 bp, Homo sapien
acattctggtgcttagcgagctgcg

SEQ ID NO: 525302 - DNA, 25 bp, Homo sapien
attctggtgcttagcgagctgcgcg

SEQ ID NO: 525303 - DNA, 25 bp, Homo sapien
ttctggtgcttagcgagctgcgcgc

SEQ ID NO: 525304 - DNA, 25 bp, Homo sapien
gtgcttagcgagctgcgcgccgagg

SEQ ID NO: 525305 - DNA, 25 bp, Homo sapien
gtccctggctctactggaagtggag

SEQ ID NO: 525306 - DNA, 25 bp, Homo sapien
cctggctctactggaagtggaggca

SEQ ID NO: 525307 - DNA, 25 bp, Homo sapien
tggaagtggaggcattgcctctcca

SEQ ID NO: 525308 - DNA, 25 bp, Homo sapien
cccctcgcgagaagaccgttctggt

SEQ ID NO: 525309 - DNA, 25 bp, Homo sapien
cctcgcgagaagaccgttctggtgg

SEQ ID NO: 525310 - DNA, 25 bp, Homo sapien
caggtcccgaggtccacagcggtcc

SEQ ID NO: 525311 - DNA, 25 bp, Homo sapien
atccgggcgggcgtcggcgtggagg

SEQ ID NO: 525312 - DNA, 25 bp, Homo sapien
gcagtgccttcaatcatcgggggaa

SEQ ID NO: 525313 - DNA, 25 bp, Homo sapien
gtgccttcaatcatcgggggaacag

SEQ ID NO: 525314 - DNA, 25 bp, Homo sapien
aggccaggggcaactgatccggact

SEQ ID NO: 525315 - DNA, 25 bp, Homo sapien
caactgatccggactgcccacgctg

SEQ ID NO: 525316 - DNA, 25 bp, Homo sapien
cagtgctggagcttccatcgcctag

SEQ ID NO: 525317 - DNA, 25 bp, Homo sapien
gtgctggagcttccatcgcctaggt

SEQ ID NO: 525318 - DNA, 25 bp, Homo sapien
gctggagcttccatcgcctaggtcg

SEQ ID NO: 525319 - DNA, 25 bp, Homo sapien
tggagcttccatcgcctaggtcgcg

SEQ ID NO: 525320 - DNA, 25 bp, Homo sapien
gggcaaggcaagctcgggtgctggc

SEQ ID NO: 525321 - DNA, 25 bp, Homo sapien
gcacagtctctgaataggggccaac

SEQ ID NO: 525322 - DNA, 25 bp, Homo sapien
aacatgatagtgttgagacctgtaa

SEQ ID NO: 525323 - DNA, 25 bp, Homo sapien
cattacattgtaacttcttcaagta

SEQ ID NO: 525324 - DNA, 25 bp, Homo sapien
acttcttcaagtacaatccttagta

SEQ ID NO: 525325 - DNA, 25 bp, Homo sapien
attgttatcttttgcatattgctta

SEQ ID NO: 525326 - DNA, 25 bp, Homo sapien
tcttttgcatattgcttagagaaaa

SEQ ID NO: 525327 - DNA, 25 bp, Homo sapien
aattgtgttctaacttacacagact

SEQ ID NO: 525328 - DNA, 25 bp, Homo sapien
agactttcataaatctgaccaagag

SEQ ID NO: 525329 - DNA, 25 bp, Homo sapien
aaatctgaccaagagctatttgtgg

SEQ ID NO: 525330 - DNA, 25 bp, Homo sapien
agctatttgtggattaacattaaat

SEQ ID NO: 525331 - DNA, 25 bp, Homo sapien
aattgaatacatgttgtttttctac

SEQ ID NO: 525332 - DNA, 25 bp, Homo sapien
gggaagatctcgtctgctcacctta

SEQ ID NO: 525333 - DNA, 25 bp, Homo sapien
ggaagatctcgtctgctcaccttag

SEQ ID NO: 525334 - DNA, 25 bp, Homo sapien
aagatctcgtctgctcaccttagct

SEQ ID NO: 525335 - DNA, 25 bp, Homo sapien
gatctcgtctgctcaccttagcttt

SEQ ID NO: 525336 - DNA, 25 bp, Homo sapien
tcgtctgctcaccttagctttctgc

SEQ ID NO: 525337 - DNA, 25 bp, Homo sapien
ggctgcggaagaaagcacgctgggc

SEQ ID NO: 525338 - DNA, 25 bp, Homo sapien
gaagcctgctccattcttctggtga

SEQ ID NO: 525339 - DNA, 25 bp, Homo sapien
ttctggtgaccttggcgctccttca

SEQ ID NO: 525340 - DNA, 25 bp, Homo sapien
tcaggaactggtggcccagcttcca

SEQ ID NO: 525341 - DNA, 25 bp, Homo sapien
agtctctagcctctccatctgtctg

SEQ ID NO: 525342 - DNA, 25 bp, Homo sapien
gtgtatggcctggagtcactccttc

SEQ ID NO: 525343 - DNA, 25 bp, Homo sapien
agtaatcctttctcagtaaattcaa

SEQ ID NO: 525344 - DNA, 25 bp, Homo sapien
taaacttctttgttcttcaccagtc

SEQ ID NO: 525345 - DNA, 25 bp, Homo sapien
ttcttcaccagtcccactgcgtgga

SEQ ID NO: 525346 - DNA, 25 bp, Homo sapien
cactgcgtggagctaactgccataa

SEQ ID NO: 525347 - DNA, 25 bp, Homo sapien
gctaactgccataaacagtttgctt

SEQ ID NO: 525348 - DNA, 25 bp, Homo sapien
cagtttgctttatatggtcccaggt

SEQ ID NO: 525349 - DNA, 25 bp, Homo sapien
tatggtcccaggtttttccattcct

SEQ ID NO: 525350 - DNA, 25 bp, Homo sapien
ctggatgatgatgtagctatataaa

SEQ ID NO: 525351 - DNA, 25 bp, Homo sapien
gacaggatggtactgacataggatt

SEQ ID NO: 525352 - DNA, 25 bp, Homo sapien
aggattttgtaacgtgcttctccaa

SEQ ID NO: 525353 - DNA, 25 bp, Homo sapien
gtaacgtgcttctccaaacgaacaa

SEQ ID NO: 525354 - DNA, 25 bp, Homo sapien
ctcagagtttgcaaaccagattgta

SEQ ID NO: 525355 - DNA, 25 bp, Homo sapien
gagtttgcaaaccagattgtacaag

SEQ ID NO: 525356 - DNA, 25 bp, Homo sapien
agattgtacaagtcattagcgtcag

SEQ ID NO: 525357 - DNA, 25 bp, Homo sapien
tgtacaagtcattagcgtcagatag

SEQ ID NO: 525358 - DNA, 25 bp, Homo sapien
caagtcattagcgtcagatagcttt

SEQ ID NO: 525359 - DNA, 25 bp, Homo sapien
gtcattagcgtcagatagctttaaa

SEQ ID NO: 525360 - DNA, 25 bp, Homo sapien
gtaacgaaacatgaaatcctagaat

SEQ ID NO: 525361 - DNA, 25 bp, Homo sapien
ggcataaggaaactcgtttgcaggc

SEQ ID NO: 525362 - DNA, 25 bp, Homo sapien
actcgtttgcaggctctctgtccag

SEQ ID NO: 525363 - DNA, 25 bp, Homo sapien
ggccagtgagtcttaggtatgttta

SEQ ID NO: 525364 - DNA, 25 bp, Homo sapien
ccagtgagtcttaggtatgtttatt

SEQ ID NO: 525365 - DNA, 25 bp, Homo sapien
tttttcctgatatttccaccacttt

SEQ ID NO: 525366 - DNA, 25 bp, Homo sapien
atttccaccacttttcagagtcatc

SEQ ID NO: 525367 - DNA, 25 bp, Homo sapien
catctacaaaatttttctttcctca

SEQ ID NO: 525368 - DNA, 25 bp, Homo sapien
ttttgccttattccttatgccttcc

SEQ ID NO: 525369 - DNA, 25 bp, Homo sapien
tatgccttccccactggtattgagg

SEQ ID NO: 525370 - DNA, 25 bp, Homo sapien
ccactggtattgagggttttgataa

SEQ ID NO: 525371 - DNA, 25 bp, Homo sapien
atttccaggtgccaactgctaagca

SEQ ID NO: 525372 - DNA, 25 bp, Homo sapien
actgctaagcagatatattccaaaa

SEQ ID NO: 525373 - DNA, 25 bp, Homo sapien
atggtaactgtcatgtgcacactgt

SEQ ID NO: 525374 - DNA, 25 bp, Homo sapien
tcatgtgcacactgttggttatttt

SEQ ID NO: 525375 - DNA, 25 bp, Homo sapien
tatttttaataagcctcttcctact

SEQ ID NO: 525376 - DNA, 25 bp, Homo sapien
aacagtgagaccaatttttagagaa

SEQ ID NO: 525377 - DNA, 25 bp, Homo sapien
ggacagctagtcagttcttggaggc

SEQ ID NO: 525378 - DNA, 25 bp, Homo sapien
tagtcagttcttggaggctcctctc

SEQ ID NO: 525379 - DNA, 25 bp, Homo sapien
gcagggcatgaagcacgcaaacatt

SEQ ID NO: 525380 - DNA, 25 bp, Homo sapien
acattctgcccacgttttggtaact

SEQ ID NO: 525381 - DNA, 25 bp, Homo sapien
cacgttttggtaactgccagtgtca

SEQ ID NO: 525382 - DNA, 25 bp, Homo sapien
agtgtcattggcagattgacccctg

SEQ ID NO: 525383 - DNA, 25 bp, Homo sapien
aaatatattgctgcagacccacaga

SEQ ID NO: 525384 - DNA, 25 bp, Homo sapien
cagacccacagaatgatccaggtgt

SEQ ID NO: 525385 - DNA, 25 bp, Homo sapien
gtggcgggaaagtcagttcaatatt

SEQ ID NO: 525386 - DNA, 25 bp, Homo sapien
attaatcgagcctgttaacctccat

SEQ ID NO: 525387 - DNA, 25 bp, Homo sapien
tttcagcccggtggtctccacgatg

SEQ ID NO: 525388 - DNA, 25 bp, Homo sapien
atgctcccatctgtgtggacgacaa

SEQ ID NO: 525389 - DNA, 25 bp, Homo sapien
caatcagtgtcgctttttcggtgtt

SEQ ID NO: 525390 - DNA, 25 bp, Homo sapien
gctttttcggtgttcaggctgtccc

SEQ ID NO: 525391 - DNA, 25 bp, Homo sapien
aggctgtccccgatctgaagggccg

SEQ ID NO: 525392 - DNA, 25 bp, Homo sapien
tgaagggccgtcctaccagacagaa

SEQ ID NO: 525393 - DNA, 25 bp, Homo sapien
cagacagaacatgtcctgagatgga

SEQ ID NO: 525394 - DNA, 25 bp, Homo sapien
gatggatgccgcgttcgccacagac

SEQ ID NO: 525395 - DNA, 25 bp, Homo sapien
cgcgttcgccacagacgtggtgaag

SEQ ID NO: 525396 - DNA, 25 bp, Homo sapien
gtgaagacattgtctgcagcagccc

SEQ ID NO: 525397 - DNA, 25 bp, Homo sapien
cacctttttcttggccgggagccag

SEQ ID NO: 525398 - DNA, 25 bp, Homo sapien
aactcctaaaggatctcttcttgga

SEQ ID NO: 525399 - DNA, 25 bp, Homo sapien
aaggatctcttcttggaaacaattc

SEQ ID NO: 525400 - DNA, 25 bp, Homo sapien
gtcctggaaggtcttaaatatcaag

SEQ ID NO: 525401 - DNA, 25 bp, Homo sapien
tcattagtggttagtgtggaatctc

SEQ ID NO: 525402 - DNA, 25 bp, Homo sapien
gtggaatctcagtgtggcacggaat

SEQ ID NO: 525403 - DNA, 25 bp, Homo sapien
taaagtacatgggtaacggccccag

SEQ ID NO: 525404 - DNA, 25 bp, Homo sapien
attaccactcatcgcctgggtgatc

SEQ ID NO: 525405 - DNA, 25 bp, Homo sapien
cggtagctttaatttcctcacctgt

SEQ ID NO: 525406 - DNA, 25 bp, Homo sapien
aagagttttactgccaagctacaga

SEQ ID NO: 525407 - DNA, 25 bp, Homo sapien
aatgccatactgagaagactgatcg

SEQ ID NO: 525408 - DNA, 25 bp, Homo sapien
gaagactgatcgatttattaaagca

SEQ ID NO: 525409 - DNA, 25 bp, Homo sapien
gggccacgaccctcagtggagctct

SEQ ID NO: 525410 - DNA, 25 bp, Homo sapien
caccaagttacgtcaaagtctcagg

SEQ ID NO: 525411 - DNA, 25 bp, Homo sapien
gttacgtcaaagtctcaggagcagc

SEQ ID NO: 525412 - DNA, 25 bp, Homo sapien
gtcaaagtctcaggagcagctccgg

SEQ ID NO: 525413 - DNA, 25 bp, Homo sapien
ggagcagctccggtctccatagagg

SEQ ID NO: 525414 - DNA, 25 bp, Homo sapien
ggtctccatagaggctgggtcagca

SEQ ID NO: 525415 - DNA, 25 bp, Homo sapien
gctgggtcagcagtgggcaaaacaa

SEQ ID NO: 525416 - DNA, 25 bp, Homo sapien
aaaacaacttcctttgctgggagct

SEQ ID NO: 525417 - DNA, 25 bp, Homo sapien
acaacttcctttgctgggagctctg

SEQ ID NO: 525418 - DNA, 25 bp, Homo sapien
tcaagaacttcaccccttcagagac

SEQ ID NO: 525419 - DNA, 25 bp, Homo sapien
ttcagagacaccgaccatggacatc

SEQ ID NO: 525420 - DNA, 25 bp, Homo sapien
ttatttggatccacctctgagtgag

SEQ ID NO: 525421 - DNA, 25 bp, Homo sapien
tggatccacctctgagtgagcgcac

SEQ ID NO: 525422 - DNA, 25 bp, Homo sapien
ttcctccggatcctcttttgatctg

SEQ ID NO: 525423 - DNA, 25 bp, Homo sapien
ggatcctcttttgatctgcccagga

SEQ ID NO: 525424 - DNA, 25 bp, Homo sapien
ctcttttgatctgcccaggaaaggg

SEQ ID NO: 525425 - DNA, 25 bp, Homo sapien
aagggatgcattgacactctcctgc

SEQ ID NO: 525426 - DNA, 25 bp, Homo sapien
gatgcattgacactctcctgcatgc

SEQ ID NO: 525427 - DNA, 25 bp, Homo sapien
gtggtcctgaatcatataagttggt

SEQ ID NO: 525428 - DNA, 25 bp, Homo sapien
ataagttggtaatggaagctgtaat

SEQ ID NO: 525429 - DNA, 25 bp, Homo sapien
gaagctgtaatgaccaagtccccta

SEQ ID NO: 525430 - DNA, 25 bp, Homo sapien
gaccaagtcccctaaacatactatg

SEQ ID NO: 525431 - DNA, 25 bp, Homo sapien
gccatcatttgccaatcactgagaa

SEQ ID NO: 525432 - DNA, 25 bp, Homo sapien
ccatcatttgccaatcactgagaat

SEQ ID NO: 525433 - DNA, 25 bp, Homo sapien
catcatttgccaatcactgagaatt

SEQ ID NO: 525434 - DNA, 25 bp, Homo sapien
atcatttgccaatcactgagaatta

SEQ ID NO: 525435 - DNA, 25 bp, Homo sapien
tcatttgccaatcactgagaattag

SEQ ID NO: 525436 - DNA, 25 bp, Homo sapien
catttgccaatcactgagaattagt

SEQ ID NO: 525437 - DNA, 25 bp, Homo sapien
atttgccaatcactgagaattagtt

SEQ ID NO: 525438 - DNA, 25 bp, Homo sapien
tttgccaatcactgagaattagttt

SEQ ID NO: 525439 - DNA, 25 bp, Homo sapien
tgtaatctgtaaaacatttcttgta

SEQ ID NO: 525440 - DNA, 25 bp, Homo sapien
aaatgtttgccatggcgcattctgt

SEQ ID NO: 525441 - DNA, 25 bp, Homo sapien
ttgccatggcgcattctgtaaacat

SEQ ID NO: 525442 - DNA, 25 bp, Homo sapien
gcgcattctgtaaacattcccgtat

SEQ ID NO: 525443 - DNA, 25 bp, Homo sapien
ttcccgtattcttttccttaatgct

SEQ ID NO: 525444 - DNA, 25 bp, Homo sapien
ttcttttccttaatgcttatttgca

SEQ ID NO: 525445 - DNA, 25 bp, Homo sapien
gcttatttgcatgaaggtaacttgg

SEQ ID NO: 525446 - DNA, 25 bp, Homo sapien
gcatgaaggtaacttgggttttgct

SEQ ID NO: 525447 - DNA, 25 bp, Homo sapien
ttgcttgtttgtattggataaccat

SEQ ID NO: 525448 - DNA, 25 bp, Homo sapien
ggataaccattaagccaacttcagt

SEQ ID NO: 525449 - DNA, 25 bp, Homo sapien
tgtagtttaaccatttctaattttg

SEQ ID NO: 525450 - DNA, 25 bp, Homo sapien
ttcgcattatgcaaggtgaaaccgt

SEQ ID NO: 525451 - DNA, 25 bp, Homo sapien
tatgcaaggtgaaaccgtttgtttt

SEQ ID NO: 525452 - DNA, 25 bp, Homo sapien
ggacacattctgaaatcccttttgt

SEQ ID NO: 525453 - DNA, 25 bp, Homo sapien
ttctgaaatcccttttgttggagaa

SEQ ID NO: 525454 - DNA, 25 bp, Homo sapien
ggccagagatgagaaccctttgaaa

SEQ ID NO: 525455 - DNA, 25 bp, Homo sapien
aaaatactgattttcattctttcaa

SEQ ID NO: 525456 - DNA, 25 bp, Homo sapien
tcattctttcaagcttatttgtaaa

SEQ ID NO: 525457 - DNA, 25 bp, Homo sapien
gtaaatacctatttgaatgctgtgt

SEQ ID NO: 525458 - DNA, 25 bp, Homo sapien
gaatgctgtgtatttgtacaggaat

SEQ ID NO: 525459 - DNA, 25 bp, Homo sapien
aatgtatagagtgtgatgtccaatt

SEQ ID NO: 525460 - DNA, 25 bp, Homo sapien
atgtccaattggtattcagcactat

SEQ ID NO: 525461 - DNA, 25 bp, Homo sapien
ggcaaagcttgccaggtcacagaag

SEQ ID NO: 525462 - DNA, 25 bp, Homo sapien
ctccgtggtcgtctttgttgacaaa

SEQ ID NO: 525463 - DNA, 25 bp, Homo sapien
ttgttgacaaaggtgcagtttctcc

SEQ ID NO: 525464 - DNA, 25 bp, Homo sapien
tctcctgggcacctgtaacatgtga

SEQ ID NO: 525465 - DNA, 25 bp, Homo sapien
ttgccaggtcacagaagctcccaag

SEQ ID NO: 525466 - DNA, 25 bp, Homo sapien
acctgtaacatgtgatgcgctgcct

SEQ ID NO: 525467 - DNA, 25 bp, Homo sapien
aggtcacagaagctcccaagcccag

SEQ ID NO: 525468 - DNA, 25 bp, Homo sapien
agcatgagcagaaccgccgagggtc

SEQ ID NO: 525469 - DNA, 25 bp, Homo sapien
aaccgccgagggtcacttctgggca

SEQ ID NO: 525470 - DNA, 25 bp, Homo sapien
aaaggcctcagcctgtgcctgtgtc

SEQ ID NO: 525471 - DNA, 25 bp, Homo sapien
cctgtgtcgagctcagtcctgggag

SEQ ID NO: 525472 - DNA, 25 bp, Homo sapien
gtggtgttcgccatgctgtgcttgc

SEQ ID NO: 525473 - DNA, 25 bp, Homo sapien
gtgttcgccatgctgtgcttgctca

SEQ ID NO: 525474 - DNA, 25 bp, Homo sapien
ttcgccatgctgtgcttgctcatca

SEQ ID NO: 525475 - DNA, 25 bp, Homo sapien
cgccatgctgtgcttgctcatcatt

SEQ ID NO: 525476 - DNA, 25 bp, Homo sapien
catgctgtgcttgctcatcattctg

SEQ ID NO: 525477 - DNA, 25 bp, Homo sapien
gctcatcattctggggcgctatttt

SEQ ID NO: 525478 - DNA, 25 bp, Homo sapien
tggggcgctattttgccagacataa

SEQ ID NO: 525479 - DNA, 25 bp, Homo sapien
ttgccagacataaaggtacatactt

SEQ ID NO: 525480 - DNA, 25 bp, Homo sapien
gacataaaggtacatacttcactca

SEQ ID NO: 525481 - DNA, 25 bp, Homo sapien
taaaggtacatacttcactcatgaa

SEQ ID NO: 525482 - DNA, 25 bp, Homo sapien
aaggtacatacttcactcatgaagc

SEQ ID NO: 525483 - DNA, 25 bp, Homo sapien
agcctgcatgaaggcagccgggtct

SEQ ID NO: 525484 - DNA, 25 bp, Homo sapien
aaggcagccgggtctctctctgagt

SEQ ID NO: 525485 - DNA, 25 bp, Homo sapien
tgagtggctggtgcaccggctcatt

SEQ ID NO: 525486 - DNA, 25 bp, Homo sapien
gtgcaccggctcatttctgagtggc

SEQ ID NO: 525487 - DNA, 25 bp, Homo sapien
tgagtggcctcctgcgtatgaagaa

SEQ ID NO: 525488 - DNA, 25 bp, Homo sapien
gtggcctcctgcgtatgaagaaaaa

SEQ ID NO: 525489 - DNA, 25 bp, Homo sapien
gaaaaagcggccacgtggcatgcct

SEQ ID NO: 525490 - DNA, 25 bp, Homo sapien
ccttgctttcctctcaaagagccaa

SEQ ID NO: 525491 - DNA, 25 bp, Homo sapien
aaagagccaagtcacgctgcactgc

SEQ ID NO: 525492 - DNA, 25 bp, Homo sapien
gctgcactgcgctccgtggagcctt

SEQ ID NO: 525493 - DNA, 25 bp, Homo sapien
ggagcctttcccgatggagaagaga

SEQ ID NO: 525494 - DNA, 25 bp, Homo sapien
ccaaagttgcttgcacagcagcatc

SEQ ID NO: 525495 - DNA, 25 bp, Homo sapien
caaagttgcttgcacagcagcatcc

SEQ ID NO: 525496 - DNA, 25 bp, Homo sapien
aaagttgcttgcacagcagcatcca

SEQ ID NO: 525497 - DNA, 25 bp, Homo sapien
acctccagatcgacaggcagtacct

SEQ ID NO: 525498 - DNA, 25 bp, Homo sapien
cctccagatcgacaggcagtacctg

SEQ ID NO: 525499 - DNA, 25 bp, Homo sapien
ctccagatcgacaggcagtacctgg

SEQ ID NO: 525500 - DNA, 25 bp, Homo sapien
tccagatcgacaggcagtacctgga

SEQ ID NO: 525501 - DNA, 25 bp, Homo sapien
ccagatcgacaggcagtacctggaa

SEQ ID NO: 525502 - DNA, 25 bp, Homo sapien
cagatcgacaggcagtacctggaag

SEQ ID NO: 525503 - DNA, 25 bp, Homo sapien
agatcgacaggcagtacctggaaga

SEQ ID NO: 525504 - DNA, 25 bp, Homo sapien
atatggaagcaaagacgaagacaac

SEQ ID NO: 525505 - DNA, 25 bp, Homo sapien
gttgagttaatttttccgcattaca

SEQ ID NO: 525506 - DNA, 25 bp, Homo sapien
gagttaatttttccgcattacaaag

SEQ ID NO: 525507 - DNA, 25 bp, Homo sapien
cgcggtaacgttatcaaaggacaca

SEQ ID NO: 525508 - DNA, 25 bp, Homo sapien
caaaggacacagagcccaggcatat

SEQ ID NO: 525509 - DNA, 25 bp, Homo sapien
gagcccaggcatatctgtgtgttta

SEQ ID NO: 525510 - DNA, 25 bp, Homo sapien
ttacaggcacacacgcatggttttc

SEQ ID NO: 525511 - DNA, 25 bp, Homo sapien
cacacgcatggttttctcttttata

SEQ ID NO: 525512 - DNA, 25 bp, Homo sapien
cacgcatggttttctcttttatatg

SEQ ID NO: 525513 - DNA, 25 bp, Homo sapien
tcccgcagcaaaacttgtagcccag

SEQ ID NO: 525514 - DNA, 25 bp, Homo sapien
cgcagcaaaacttgtagcccagacc

SEQ ID NO: 525515 - DNA, 25 bp, Homo sapien
ccagctctctcgggactaggcaggt

SEQ ID NO: 525516 - DNA, 25 bp, Homo sapien
taattccccgagaccctcgtttgat

SEQ ID NO: 525517 - DNA, 25 bp, Homo sapien
ttcttcaagtgagtggcatgtgggt

SEQ ID NO: 525518 - DNA, 25 bp, Homo sapien
gcatgtgggttgtgatattgaccat

SEQ ID NO: 525519 - DNA, 25 bp, Homo sapien
gaccatgtgattatggacatcgata

SEQ ID NO: 525520 - DNA, 25 bp, Homo sapien
gtgggcatgtattagccagtcattg

SEQ ID NO: 525521 - DNA, 25 bp, Homo sapien
tagccagtcattgtaacctcgtgtc

SEQ ID NO: 525522 - DNA, 25 bp, Homo sapien
gtcattgtaacctcgtgtctagtag

SEQ ID NO: 525523 - DNA, 25 bp, Homo sapien
gtaacctcgtgtctagtagaacaat

SEQ ID NO: 525524 - DNA, 25 bp, Homo sapien
gtcatgtgtatgagaagtactttgt

SEQ ID NO: 525525 - DNA, 25 bp, Homo sapien
agtactttgtgctgatcgccttatt

SEQ ID NO: 525526 - DNA, 25 bp, Homo sapien
tgtgctgatcgccttatttatattc

SEQ ID NO: 525527 - DNA, 25 bp, Homo sapien
acagcaggcagctgttaacagataa

SEQ ID NO: 525528 - DNA, 25 bp, Homo sapien
cagcaggcagctgttaacagataag

SEQ ID NO: 525529 - DNA, 25 bp, Homo sapien
agcaggcagctgttaacagataagt

SEQ ID NO: 525530 - DNA, 25 bp, Homo sapien
gcaggcagctgttaacagataagtt

SEQ ID NO: 525531 - DNA, 25 bp, Homo sapien
caggcagctgttaacagataagttt

SEQ ID NO: 525532 - DNA, 25 bp, Homo sapien
aggcagctgttaacagataagttta

SEQ ID NO: 525533 - DNA, 25 bp, Homo sapien
ggcagctgttaacagataagtttaa

SEQ ID NO: 525534 - DNA, 25 bp, Homo sapien
gcagctgttaacagataagtttaac

SEQ ID NO: 525535 - DNA, 25 bp, Homo sapien
cagctgttaacagataagtttaact

SEQ ID NO: 525536 - DNA, 25 bp, Homo sapien
agctgttaacagataagtttaactt

SEQ ID NO: 525537 - DNA, 25 bp, Homo sapien
gctgttaacagataagtttaacttg

SEQ ID NO: 525538 - DNA, 25 bp, Homo sapien
gtatttcaatcaagacagtgcctgc

SEQ ID NO: 525539 - DNA, 25 bp, Homo sapien
aagacagtgcctgcagagaatctgg

SEQ ID NO: 525540 - DNA, 25 bp, Homo sapien
tgtctgaggacgacaacccgggtgc

SEQ ID NO: 525541 - DNA, 25 bp, Homo sapien
ttcatcagcccaagcgaagattttt

SEQ ID NO: 525542 - DNA, 25 bp, Homo sapien
aagatttttcttcaagcagccaggc

SEQ ID NO: 525543 - DNA, 25 bp, Homo sapien
ttcaagcagccaggcagaagtcccg

SEQ ID NO: 525544 - DNA, 25 bp, Homo sapien
ctctcgttcagggagggacttgtca

SEQ ID NO: 525545 - DNA, 25 bp, Homo sapien
gtcatgactcatggttacattcagg

SEQ ID NO: 525546 - DNA, 25 bp, Homo sapien
tacattcaggatacttgagcacttt

SEQ ID NO: 525547 - DNA, 25 bp, Homo sapien
tgagcactttatatactaccgtagc

SEQ ID NO: 525548 - DNA, 25 bp, Homo sapien
actaccgtagcactgtagctatttt

SEQ ID NO: 525549 - DNA, 25 bp, Homo sapien
caagggaagagactccatttagctt

SEQ ID NO: 525550 - DNA, 25 bp, Homo sapien
gggaagagactccatttagcttaac

SEQ ID NO: 525551 - DNA, 25 bp, Homo sapien
tgtgggtttcttaaacttgcacttc

SEQ ID NO: 525552 - DNA, 25 bp, Homo sapien
tgggtttcttaaacttgcacttcct

SEQ ID NO: 525553 - DNA, 25 bp, Homo sapien
ttcttaaacttgcacttcctaccca

SEQ ID NO: 525554 - DNA, 25 bp, Homo sapien
gggagccatttactatgtcaccatc

SEQ ID NO: 525555 - DNA, 25 bp, Homo sapien
gagccatttactatgtcaccatcac

SEQ ID NO: 525556 - DNA, 25 bp, Homo sapien
gccatttactatgtcaccatcactg

SEQ ID NO: 525557 - DNA, 25 bp, Homo sapien
ttaactgtttcccagcaatctaaac

SEQ ID NO: 525558 - DNA, 25 bp, Homo sapien
gtttcccagcaatctaaactttttg

SEQ ID NO: 525559 - DNA, 25 bp, Homo sapien
cccagcaatctaaactttttgaagt

SEQ ID NO: 525560 - DNA, 25 bp, Homo sapien
aaatggataatgaagcctcttggga

SEQ ID NO: 525561 - DNA, 25 bp, Homo sapien
cctaccataggatctgttgccatgc

SEQ ID NO: 525562 - DNA, 25 bp, Homo sapien
ggatctgttgccatgctcaaatgag

SEQ ID NO: 525563 - DNA, 25 bp, Homo sapien
gttgccatgctcaaatgagttactg

SEQ ID NO: 525564 - DNA, 25 bp, Homo sapien
tactgaataaggtgcttctgcttct

SEQ ID NO: 525565 - DNA, 25 bp, Homo sapien
gcttctgcttcttctagagatggtg

SEQ ID NO: 525566 - DNA, 25 bp, Homo sapien
aggactagcatatgagacttctggt

SEQ ID NO: 525567 - DNA, 25 bp, Homo sapien
gcatatgagacttctggtaccaatg

SEQ ID NO: 525568 - DNA, 25 bp, Homo sapien
cactgtgtggtgctaggactgccaa

SEQ ID NO: 525569 - DNA, 25 bp, Homo sapien
tggtgctaggactgccaatgccagg

SEQ ID NO: 525570 - DNA, 25 bp, Homo sapien
aaaaccttcaccattaacttgctgt

SEQ ID NO: 525571 - DNA, 25 bp, Homo sapien
ttccccatggtgaagtcaggcctaa

SEQ ID NO: 525572 - DNA, 25 bp, Homo sapien
actggtaagccagaagcctcttgct

SEQ ID NO: 525573 - DNA, 25 bp, Homo sapien
taagccagaagcctcttgctagggt

SEQ ID NO: 525574 - DNA, 25 bp, Homo sapien
gaagcctcttgctagggtgtgagca

SEQ ID NO: 525575 - DNA, 25 bp, Homo sapien
ctagggtgtgagcaaaacttggaca

SEQ ID NO: 525576 - DNA, 25 bp, Homo sapien
aaacttggacaggaactctcagtag

SEQ ID NO: 525577 - DNA, 25 bp, Homo sapien
ggacaggaactctcagtagatgttt

SEQ ID NO: 525578 - DNA, 25 bp, Homo sapien
gtttgtgtttgtcaagattctccag

SEQ ID NO: 525579 - DNA, 25 bp, Homo sapien
gtgtttgtcaagattctccagacaa

SEQ ID NO: 525580 - DNA, 25 bp, Homo sapien
aaaaggattggcttgtgttgttatt

SEQ ID NO: 525581 - DNA, 25 bp, Homo sapien
attaagtctaacaagtccaaaagct

SEQ ID NO: 525582 - DNA, 25 bp, Homo sapien
ctagatttctaggtggtattaatgt

SEQ ID NO: 525583 - DNA, 25 bp, Homo sapien
atgtgatagcattaggtgggaccag

SEQ ID NO: 525584 - DNA, 25 bp, Homo sapien
ggtgggaccagagaactcatttgtt

SEQ ID NO: 525585 - DNA, 25 bp, Homo sapien
catttgttttgtagctttcattata

SEQ ID NO: 525586 - DNA, 25 bp, Homo sapien
gttttgtagctttcattatacagat

SEQ ID NO: 525587 - DNA, 25 bp, Homo sapien
aaggattttttgttatgcttatctc

SEQ ID NO: 525588 - DNA, 25 bp, Homo sapien
tgttatgcttatctcttgaaacaaa

SEQ ID NO: 525589 - DNA, 25 bp, Homo sapien
attgtttgtgcccagaaaaatctaa

SEQ ID NO: 525590 - DNA, 25 bp, Homo sapien
aaagatgtgggttgacttctaagag

SEQ ID NO: 525591 - DNA, 25 bp, Homo sapien
gtgggttgacttctaagagatttaa

SEQ ID NO: 525592 - DNA, 25 bp, Homo sapien
taagagatttaagaacaagtcacct

SEQ ID NO: 525593 - DNA, 25 bp, Homo sapien
acacgtgggttcttttggctatgga

SEQ ID NO: 525594 - DNA, 25 bp, Homo sapien
gctatggaagtgtccttgagatcac

SEQ ID NO: 525595 - DNA, 25 bp, Homo sapien
actttttgcacgtgactcagctgaa

SEQ ID NO: 525596 - DNA, 25 bp, Homo sapien
acgtgactcagctgaagtgttcaaa

SEQ ID NO: 525597 - DNA, 25 bp, Homo sapien
cacttgccagtgacaggtggacgtt

SEQ ID NO: 525598 - DNA, 25 bp, Homo sapien
aggtggacgttgtatgtgttttctc

SEQ ID NO: 525599 - DNA, 25 bp, Homo sapien
ttattccattccttccctcgtgtat

SEQ ID NO: 525600 - DNA, 25 bp, Homo sapien
taaggatgcctaaactttcttttct

SEQ ID NO: 525601 - DNA, 25 bp, Homo sapien
ttccctcgtgtatcttatctttatt

SEQ ID NO: 525602 - DNA, 25 bp, Homo sapien
attgaattttccctcacaatccact

SEQ ID NO: 525603 - DNA, 25 bp, Homo sapien
gaaagtatcacacacgtgggttctt

SEQ ID NO: 525604 - DNA, 25 bp, Homo sapien
aacaatatttgaactactgtattta

SEQ ID NO: 525605 - DNA, 25 bp, Homo sapien
tattacctctaattgctttatttca

SEQ ID NO: 525606 - DNA, 25 bp, Homo sapien
gacattactgttttaatgtttgctt

SEQ ID NO: 525607 - DNA, 25 bp, Homo sapien
gaaccagatttattttctatagtga

SEQ ID NO: 525608 - DNA, 25 bp, Homo sapien
tagtgataaacccttttttctcaga

SEQ ID NO: 525609 - DNA, 25 bp, Homo sapien
tgataaacccttttttctcagaact

SEQ ID NO: 525610 - DNA, 25 bp, Homo sapien
ttctcagaactccatctttgtactc

SEQ ID NO: 525611 - DNA, 25 bp, Homo sapien
cagaactccatctttgtactcttca

SEQ ID NO: 525612 - DNA, 25 bp, Homo sapien
atgaatatatagacactgtggcata

SEQ ID NO: 525613 - DNA, 25 bp, Homo sapien
tatagacactgtggcatacattttt

SEQ ID NO: 525614 - DNA, 25 bp, Homo sapien
ttcattaaaaacttatggcttcata

SEQ ID NO: 525615 - DNA, 25 bp, Homo sapien
ataactttactgaatcctgtagccc

SEQ ID NO: 525616 - DNA, 25 bp, Homo sapien
ttactgaatcctgtagcccagcact

SEQ ID NO: 525617 - DNA, 25 bp, Homo sapien
gtatagtcagagttatgcgatcatc

SEQ ID NO: 525618 - DNA, 25 bp, Homo sapien
aaatagactctgtcctcatcaagcc

SEQ ID NO: 525619 - DNA, 25 bp, Homo sapien
gagttatgcgatcatcagcacaatc

SEQ ID NO: 525620 - DNA, 25 bp, Homo sapien
tgtcccccaaatatgccgtatcatt

SEQ ID NO: 525621 - DNA, 25 bp, Homo sapien
ccttaatgcatgcattttttcccca

SEQ ID NO: 525622 - DNA, 25 bp, Homo sapien
ccccagttccctacaatcttataat

SEQ ID NO: 525623 - DNA, 25 bp, Homo sapien
tcacaccctcctcgaggtattaaat

SEQ ID NO: 525624 - DNA, 25 bp, Homo sapien
atatttcagaatccacaatgcagcc

SEQ ID NO: 525625 - DNA, 25 bp, Homo sapien
tgcagccaatctcatcaataacttt

SEQ ID NO: 525626 - DNA, 25 bp, Homo sapien
aagtatacagtgcactgtttgaaat

SEQ ID NO: 525627 - DNA, 25 bp, Homo sapien
gagtattactttgtacaggttgatc

SEQ ID NO: 525628 - DNA, 25 bp, Homo sapien
attgatgccaaataagcttgttctt

SEQ ID NO: 525629 - DNA, 25 bp, Homo sapien
aagcttgttctttagtcacaccgac

SEQ ID NO: 525630 - DNA, 25 bp, Homo sapien
tagtcacaccgacgtcttatttttc

SEQ ID NO: 525631 - DNA, 25 bp, Homo sapien
cagttctgtttttaaggtgtacatg

SEQ ID NO: 525632 - DNA, 25 bp, Homo sapien
gtgtacatggacaatgttacagtgt

SEQ ID NO: 525633 - DNA, 25 bp, Homo sapien
tgttacagtgtaagaaactccatat

SEQ ID NO: 525634 - DNA, 25 bp, Homo sapien
atatccatatgttcccattcgcatt

SEQ ID NO: 525635 - DNA, 25 bp, Homo sapien
gttcccattcgcattttgtattggt

SEQ ID NO: 525636 - DNA, 25 bp, Homo sapien
gtattggttcatgtataccattttt

SEQ ID NO: 525637 - DNA, 25 bp, Homo sapien
taagatattctggactactggatgg

SEQ ID NO: 525638 - DNA, 25 bp, Homo sapien
tattctggactactggatggatgtt

SEQ ID NO: 525639 - DNA, 25 bp, Homo sapien
cagtagagatggtgatttcggtttt

SEQ ID NO: 525640 - DNA, 25 bp, Homo sapien
gatttcggttttgtagtatccttgt

SEQ ID NO: 525641 - DNA, 25 bp, Homo sapien
tgtagtatccttgtttctatgtctg

SEQ ID NO: 525642 - DNA, 25 bp, Homo sapien
gtttctatgtctgtgcatgttaaca

SEQ ID NO: 525643 - DNA, 25 bp, Homo sapien
gtctgtgcatgttaacattggatgt

SEQ ID NO: 525644 - DNA, 25 bp, Homo sapien
tcattctggcttgattagaagctaa

SEQ ID NO: 525645 - DNA, 25 bp, Homo sapien
ttagaagctaagtcagttactgagt

SEQ ID NO: 525646 - DNA, 25 bp, Homo sapien
gttactgagtaacattttgcaactt

SEQ ID NO: 525647 - DNA, 25 bp, Homo sapien
attccagcaagtactaaatcggcca

SEQ ID NO: 525648 - DNA, 25 bp, Homo sapien
gtacctgctggaagaattctagcat

SEQ ID NO: 525649 - DNA, 25 bp, Homo sapien
gaagaattctagcatgctacttggg

SEQ ID NO: 525650 - DNA, 25 bp, Homo sapien
gggctaggacagttgattcaacaaa

SEQ ID NO: 525651 - DNA, 25 bp, Homo sapien
tttttctcagtcctaatttgaacag

SEQ ID NO: 525652 - DNA, 25 bp, Homo sapien
aaagatgtgttcaggcattccaggt

SEQ ID NO: 525653 - DNA, 25 bp, Homo sapien
ggcattccaggtaacaggtgtgtat

SEQ ID NO: 525654 - DNA, 25 bp, Homo sapien
taggctttttaggaactcactcttt

SEQ ID NO: 525655 - DNA, 25 bp, Homo sapien
ggaactcactctttagatatttaca

SEQ ID NO: 525656 - DNA, 25 bp, Homo sapien
agatatttacatccagcttctcatg

SEQ ID NO: 525657 - DNA, 25 bp, Homo sapien
ttacatccagcttctcatgttaaat

SEQ ID NO: 525658 - DNA, 25 bp, Homo sapien
gtccttaaagggtttgagatgtaca

SEQ ID NO: 525659 - DNA, 25 bp, Homo sapien
gggtcacaaagtgttcttcctcatg

SEQ ID NO: 525660 - DNA, 25 bp, Homo sapien
tcacaaagtgttcttcctcatggaa

SEQ ID NO: 525661 - DNA, 25 bp, Homo sapien
tgacaactgcactgaatgacacttt

SEQ ID NO: 525662 - DNA, 25 bp, Homo sapien
gggaattggtgattacagtagcact

SEQ ID NO: 525663 - DNA, 25 bp, Homo sapien
tgattacagtagcactttgggaagt

SEQ ID NO: 525664 - DNA, 25 bp, Homo sapien
attccatttggataatcaggaagcc

SEQ ID NO: 525665 - DNA, 25 bp, Homo sapien
gtccatccatattgtgtcagagtgg

SEQ ID NO: 525666 - DNA, 25 bp, Homo sapien
gtcagagtgggattaacaaccctgg

SEQ ID NO: 525667 - DNA, 25 bp, Homo sapien
ttaacaaccctggaagagtccactg

SEQ ID NO: 525668 - DNA, 25 bp, Homo sapien
aaccctggaagagtccactgccaaa

SEQ ID NO: 525669 - DNA, 25 bp, Homo sapien
ggaagagtccactgccaaaagagta

SEQ ID NO: 525670 - DNA, 25 bp, Homo sapien
tcacaactacgaagaccttgattta

SEQ ID NO: 525671 - DNA, 25 bp, Homo sapien
gatttaccgttaacctattgtatgg

SEQ ID NO: 525672 - DNA, 25 bp, Homo sapien
ggcagtctatatatgttaaaccaat

SEQ ID NO: 525673 - DNA, 25 bp, Homo sapien
caaggaacttactctattcagtgga

SEQ ID NO: 525674 - DNA, 25 bp, Homo sapien
aatcatctctattgcttggtgtcat

SEQ ID NO: 525675 - DNA, 25 bp, Homo sapien
gtcatttataggaagcactgccagt

SEQ ID NO: 525676 - DNA, 25 bp, Homo sapien
gaagcactgccagttaaagagcatt

SEQ ID NO: 525677 - DNA, 25 bp, Homo sapien
gctgcctcttcgttttagcaacaag

SEQ ID NO: 525678 - DNA, 25 bp, Homo sapien
agaagactgctcttgactgataaca

SEQ ID NO: 525679 - DNA, 25 bp, Homo sapien
gctcttgactgataacagctctgtc

SEQ ID NO: 525680 - DNA, 25 bp, Homo sapien
agctctgtcaatattttgatgccac

SEQ ID NO: 525681 - DNA, 25 bp, Homo sapien
taaaaaccttagactctcttgagtg

SEQ ID NO: 525682 - DNA, 25 bp, Homo sapien
aaaccttagactctcttgagtgata

SEQ ID NO: 525683 - DNA, 25 bp, Homo sapien
gaagactcttggctgagtggatcct

SEQ ID NO: 525684 - DNA, 25 bp, Homo sapien
ctcttggctgagtggatcctggata

SEQ ID NO: 525685 - DNA, 25 bp, Homo sapien
ttggctgagtggatcctggatatct

SEQ ID NO: 525686 - DNA, 25 bp, Homo sapien
gtggatcctggatatcttaagaacg

SEQ ID NO: 525687 - DNA, 25 bp, Homo sapien
atcttaagaacggtggctagctgcc

SEQ ID NO: 525688 - DNA, 25 bp, Homo sapien
gaacggtggctagctgccagagaca

SEQ ID NO: 525689 - DNA, 25 bp, Homo sapien
tagctgccagagacacatacctgtg

SEQ ID NO: 525690 - DNA, 25 bp, Homo sapien
cagagacacatacctgtgatgcgag

SEQ ID NO: 525691 - DNA, 25 bp, Homo sapien
aaatgtctgagactgactaatttat

SEQ ID NO: 525692 - DNA, 25 bp, Homo sapien
gccactttctttttggaagccaacg

SEQ ID NO: 525693 - DNA, 25 bp, Homo sapien
gaatgccaagtagatgccaccaaag

SEQ ID NO: 525694 - DNA, 25 bp, Homo sapien
tttgaaacccaactttgccacagac

SEQ ID NO: 525695 - DNA, 25 bp, Homo sapien
tggcttgtgaaagcccagtgtcctg

SEQ ID NO: 525696 - DNA, 25 bp, Homo sapien
gggatcccagccaagtctgactgca

SEQ ID NO: 525697 - DNA, 25 bp, Homo sapien
ccaagtctgactgcaatgaggccaa

SEQ ID NO: 525698 - DNA, 25 bp, Homo sapien
aatgaggccaaacgttgccccagag

SEQ ID NO: 525699 - DNA, 25 bp, Homo sapien
tcccttttcctgacaaaccattgat

SEQ ID NO: 525700 - DNA, 25 bp, Homo sapien
tttgccacagaccagcatgttgatg

SEQ ID NO: 525701 - DNA, 25 bp, Homo sapien
aaccattgatggctgcgtttcacat

SEQ ID NO: 525702 - DNA, 25 bp, Homo sapien
tgatggctgcgtttcacattaacct

SEQ ID NO: 525703 - DNA, 25 bp, Homo sapien
gcacaggatgtattgatattatcat

SEQ ID NO: 525704 - DNA, 25 bp, Homo sapien
atcattcttgctgacatattctgga

SEQ ID NO: 525705 - DNA, 25 bp, Homo sapien
atattctggaagctttcagccccac

SEQ ID NO: 525706 - DNA, 25 bp, Homo sapien
cagtagggtctgatatttgtacata

SEQ ID NO: 525707 - DNA, 25 bp, Homo sapien
atgtgtacatatgtgcctcaatgaa

SEQ ID NO: 525708 - DNA, 25 bp, Homo sapien
aatgaacattgcctgtccacctgat

SEQ ID NO: 525709 - DNA, 25 bp, Homo sapien
attgcctgtccacctgatcatgggt

SEQ ID NO: 525710 - DNA, 25 bp, Homo sapien
gatcatgggtgtacatagacttcat

SEQ ID NO: 525711 - DNA, 25 bp, Homo sapien
acatagacttcatagagctccacag

SEQ ID NO: 525712 - DNA, 25 bp, Homo sapien
tcatagagctccacagtcttttgta

SEQ ID NO: 525713 - DNA, 25 bp, Homo sapien
gggatttattttaacatcattctgt

SEQ ID NO: 525714 - DNA, 25 bp, Homo sapien
tatggtaaatgatacaggtgcagta

SEQ ID NO: 525715 - DNA, 25 bp, Homo sapien
acaggtgcagtatcagtattgtaaa

SEQ ID NO: 525716 - DNA, 25 bp, Homo sapien
taccctatggtatggcaatatccct

SEQ ID NO: 525717 - DNA, 25 bp, Homo sapien
aaactacaaaagtcattctgtggat

SEQ ID NO: 525718 - DNA, 25 bp, Homo sapien
acaaaagtcattctgtggatatatt

SEQ ID NO: 525719 - DNA, 25 bp, Homo sapien
tggtatggcaatatccctacacctg

SEQ ID NO: 525720 - DNA, 25 bp, Homo sapien
aactatatttcagattcttgtgtga

SEQ ID NO: 525721 - DNA, 25 bp, Homo sapien
atggcaatatccctacacctgcgaa

SEQ ID NO: 525722 - DNA, 25 bp, Homo sapien
gcaatatccctacacctgcgaatta

SEQ ID NO: 525723 - DNA, 25 bp, Homo sapien
atatccctacacctgcgaattacct

SEQ ID NO: 525724 - DNA, 25 bp, Homo sapien
tcctcacctgccaatggaaacaaac

SEQ ID NO: 525725 - DNA, 25 bp, Homo sapien
gaaggccttgtggagagccgctatt

SEQ ID NO: 525726 - DNA, 25 bp, Homo sapien
agagccgctattggtcagctgtcac

SEQ ID NO: 525727 - DNA, 25 bp, Homo sapien
atactgcctattggtcatccttgga

SEQ ID NO: 525728 - DNA, 25 bp, Homo sapien
attggtcatccttggatgttgccct

SEQ ID NO: 525729 - DNA, 25 bp, Homo sapien
gtataaacatgagcacgatgatgat

SEQ ID NO: 525730 - DNA, 25 bp, Homo sapien
gatgatgatgcaaaacccaatttag

SEQ ID NO: 525731 - DNA, 25 bp, Homo sapien
aacccaatttagatccaatctgaac

SEQ ID NO: 525732 - DNA, 25 bp, Homo sapien
gacatgaatggcctaaaactgattt

SEQ ID NO: 525733 - DNA, 25 bp, Homo sapien
ttttccgttaaaatgtgtgtgtcaa

SEQ ID NO: 525734 - DNA, 25 bp, Homo sapien
gtcaagatacggagatttcagggtt

SEQ ID NO: 525735 - DNA, 25 bp, Homo sapien
atttcagttttctttagggcaacat

SEQ ID NO: 525736 - DNA, 25 bp, Homo sapien
ccagagacattcatttagttgatat

SEQ ID NO: 525737 - DNA, 25 bp, Homo sapien
tagttgatataatcctaccagaagg

SEQ ID NO: 525738 - DNA, 25 bp, Homo sapien
taatcctaccagaaggaaagcacta

SEQ ID NO: 525739 - DNA, 25 bp, Homo sapien
gaaagcactaagaaacactcgtttg

SEQ ID NO: 525740 - DNA, 25 bp, Homo sapien
gcactaagaaacactcgtttgttgt

SEQ ID NO: 525741 - DNA, 25 bp, Homo sapien
ggcaacagacttaaagttgtcctca

SEQ ID NO: 525742 - DNA, 25 bp, Homo sapien
gacttaaagttgtcctcagccaagg

SEQ ID NO: 525743 - DNA, 25 bp, Homo sapien
aaatttaaagtatcttgcactgata

SEQ ID NO: 525744 - DNA, 25 bp, Homo sapien
gttattaatttgtaaaggcagtgtt

SEQ ID NO: 525745 - DNA, 25 bp, Homo sapien
ggcagtgttacaaaatgttcagttt

SEQ ID NO: 525746 - DNA, 25 bp, Homo sapien
aaatgttcagtttatattgttttag

SEQ ID NO: 525747 - DNA, 25 bp, Homo sapien
aatagaagataacccttgatgccca

SEQ ID NO: 525748 - DNA, 25 bp, Homo sapien
gatgcccagggcaacattcaccttc

SEQ ID NO: 525749 - DNA, 25 bp, Homo sapien
attcaccttcacattggcctttggg

SEQ ID NO: 525750 - DNA, 25 bp, Homo sapien
gggttggcttcaaaggctctcccct

SEQ ID NO: 525751 - DNA, 25 bp, Homo sapien
agacaagttctccatcaccttattt

SEQ ID NO: 525752 - DNA, 25 bp, Homo sapien
accttatttccctgtggcctctcaa

SEQ ID NO: 525753 - DNA, 25 bp, Homo sapien
gtgctggtctacctcttggtgattc

SEQ ID NO: 525754 - DNA, 25 bp, Homo sapien
ggtgattctggaatgcatttcatca

SEQ ID NO: 525755 - DNA, 25 bp, Homo sapien
gcatttcatcaggttgggaagggca

SEQ ID NO: 525756 - DNA, 25 bp, Homo sapien
gctagttagttatatcctcactctg

SEQ ID NO: 525757 - DNA, 25 bp, Homo sapien
tgagagccggtaaggccgtcctgct

SEQ ID NO: 525758 - DNA, 25 bp, Homo sapien
atcgtcctgtactcttctccagtgg

SEQ ID NO: 525759 - DNA, 25 bp, Homo sapien
gtactcttctccagtgggacgtctg

SEQ ID NO: 525760 - DNA, 25 bp, Homo sapien
tcccacactctgcacatacaattta

SEQ ID NO: 525761 - DNA, 25 bp, Homo sapien
actctgcacatacaatttagggacc

SEQ ID NO: 525762 - DNA, 25 bp, Homo sapien
gcacatacaatttagggacctggca

SEQ ID NO: 525763 - DNA, 25 bp, Homo sapien
atacaatttagggacctggcagggt

SEQ ID NO: 525764 - DNA, 25 bp, Homo sapien
aatttagggacctggcagggtcttg

SEQ ID NO: 525765 - DNA, 25 bp, Homo sapien
gacctggcagggtcttggtggcctg

SEQ ID NO: 525766 - DNA, 25 bp, Homo sapien
tggcctgcagcttccctttctggaa

SEQ ID NO: 525767 - DNA, 25 bp, Homo sapien
agcttccctttctggaaccgactcg

SEQ ID NO: 525768 - DNA, 25 bp, Homo sapien
ctcccatcagagagccataactctt

SEQ ID NO: 525769 - DNA, 25 bp, Homo sapien
gagaagacaatcaatgtctgtgaga

SEQ ID NO: 525770 - DNA, 25 bp, Homo sapien
gtctgtgagaaaacggactttcttt

SEQ ID NO: 525771 - DNA, 25 bp, Homo sapien
tgagaaaacggactttcttttggat

SEQ ID NO: 525772 - DNA, 25 bp, Homo sapien
gtcattgtgagtgattgctttttcc

SEQ ID NO: 525773 - DNA, 25 bp, Homo sapien
tcctttgttctaaaacttagactga

SEQ ID NO: 525774 - DNA, 25 bp, Homo sapien
agactgacatctagctttgacaatc

SEQ ID NO: 525775 - DNA, 25 bp, Homo sapien
gacatctagctttgacaatcatagt

SEQ ID NO: 525776 - DNA, 25 bp, Homo sapien
gggaataacttataatgctgtttag

SEQ ID NO: 525777 - DNA, 25 bp, Homo sapien
ttgtactattggtgtgttggtgaat

SEQ ID NO: 525778 - DNA, 25 bp, Homo sapien
atttttaaactgtgtgctaactgca

SEQ ID NO: 525779 - DNA, 25 bp, Homo sapien
gtgtgctaactgcaataaattatat

SEQ ID NO: 525780 - DNA, 25 bp, Homo sapien
ttttttactgacaccacagctctac

SEQ ID NO: 525781 - DNA, 25 bp, Homo sapien
ttttactgacaccacagctctacag

SEQ ID NO: 525782 - DNA, 25 bp, Homo sapien
tgtttctccatgcttcatgggtgac

SEQ ID NO: 525783 - DNA, 25 bp, Homo sapien
gtttctccatgcttcatgggtgact

SEQ ID NO: 525784 - DNA, 25 bp, Homo sapien
caaaaggcatgtaaccacctgaatt

SEQ ID NO: 525785 - DNA, 25 bp, Homo sapien
caaggaattttcactgacatttccc

SEQ ID NO: 525786 - DNA, 25 bp, Homo sapien
actgacatttcccaggccagaccat

SEQ ID NO: 525787 - DNA, 25 bp, Homo sapien
ctgacatttcccaggccagaccatg

SEQ ID NO: 525788 - DNA, 25 bp, Homo sapien
atttcccaggccagaccatgctgct

SEQ ID NO: 525789 - DNA, 25 bp, Homo sapien
aggccagaccatgctgctgctaagc

SEQ ID NO: 525790 - DNA, 25 bp, Homo sapien
ggccagaccatgctgctgctaagca

SEQ ID NO: 525791 - DNA, 25 bp, Homo sapien
gcattttacctaaaaatacaccagc

SEQ ID NO: 525792 - DNA, 25 bp, Homo sapien
atacaccagcaaaatgtactcagct

SEQ ID NO: 525793 - DNA, 25 bp, Homo sapien
gcaaaatgtactcagcttcaatcac

SEQ ID NO: 525794 - DNA, 25 bp, Homo sapien
aatgtactcagcttcaatcacaaat

SEQ ID NO: 525795 - DNA, 25 bp, Homo sapien
gcttcaatcacaaatacgactgctt

SEQ ID NO: 525796 - DNA, 25 bp, Homo sapien
tcacaaatacgactgcttaaaactg

SEQ ID NO: 525797 - DNA, 25 bp, Homo sapien
atacgactgcttaaaactgcagaaa

SEQ ID NO: 525798 - DNA, 25 bp, Homo sapien
gcagaaatttcctcaacactcagcc

SEQ ID NO: 525799 - DNA, 25 bp, Homo sapien
agaaatttcctcaacactcagcctt

SEQ ID NO: 525800 - DNA, 25 bp, Homo sapien
aatttcctcaacactcagcctttat

SEQ ID NO: 525801 - DNA, 25 bp, Homo sapien
tttcctcaacactcagcctttatca

SEQ ID NO: 525802 - DNA, 25 bp, Homo sapien
tagctgcagatgaggctcctcgggt

SEQ ID NO: 525803 - DNA, 25 bp, Homo sapien
cctcgggtgcagtttgttgggaaca

SEQ ID NO: 525804 - DNA, 25 bp, Homo sapien
gttgggaacagattatcaagtacat

SEQ ID NO: 525805 - DNA, 25 bp, Homo sapien
cttccaaagtgttctattcttaaca

SEQ ID NO: 525806 - DNA, 25 bp, Homo sapien
aagtacatttcctctacagtttaag

SEQ ID NO: 525807 - DNA, 25 bp, Homo sapien
tacagtttaagacctgtgaactaaa

SEQ ID NO: 525808 - DNA, 25 bp, Homo sapien
actcaagttatctatcagccacctc

SEQ ID NO: 525809 - DNA, 25 bp, Homo sapien
attccaaggctcatctaattactac

SEQ ID NO: 525810 - DNA, 25 bp, Homo sapien
catctaattactacattggctcaaa

SEQ ID NO: 525811 - DNA, 25 bp, Homo sapien
ttggctcaaaaatccaggacatctt

SEQ ID NO: 525812 - DNA, 25 bp, Homo sapien
ctgaatcaggcctagctgcagatga

SEQ ID NO: 525813 - DNA, 25 bp, Homo sapien
aggagaggcagtacttgaaagataa

SEQ ID NO: 525814 - DNA, 25 bp, Homo sapien
ttaaataaaatccaggcctagactc

SEQ ID NO: 525815 - DNA, 25 bp, Homo sapien
taaaatccaggcctagactcaaggt

SEQ ID NO: 525816 - DNA, 25 bp, Homo sapien
tccaggcctagactcaaggtattgt

SEQ ID NO: 525817 - DNA, 25 bp, Homo sapien
ggcctagactcaaggtattgtaaat

SEQ ID NO: 525818 - DNA, 25 bp, Homo sapien
gaaagcaagacagtcaaatacttag

SEQ ID NO: 525819 - DNA, 25 bp, Homo sapien
tcaaatacttagtaggcttcctaac

SEQ ID NO: 525820 - DNA, 25 bp, Homo sapien
tacttagtaggcttcctaacagcaa

SEQ ID NO: 525821 - DNA, 25 bp, Homo sapien
gtaggcttcctaacagcaacaatgt

SEQ ID NO: 525822 - DNA, 25 bp, Homo sapien
ttcctaacagcaacaatgtacccaa

SEQ ID NO: 525823 - DNA, 25 bp, Homo sapien
cagcaacaatgtacccaaaagaggg

SEQ ID NO: 525824 - DNA, 25 bp, Homo sapien
gtctgtgagaaaacggactttcttt

SEQ ID NO: 525825 - DNA, 25 bp, Homo sapien
gattttctttttgtggtcattgtga

SEQ ID NO: 525826 - DNA, 25 bp, Homo sapien
gtcattgtgagtgattgctttttcc

SEQ ID NO: 525827 - DNA, 25 bp, Homo sapien
cttttcttagtttcacattcttcct

SEQ ID NO: 525828 - DNA, 25 bp, Homo sapien
tcctttgttctaaaacttagactga

SEQ ID NO: 525829 - DNA, 25 bp, Homo sapien
agactgacatctagctttgacaatc

SEQ ID NO: 525830 - DNA, 25 bp, Homo sapien
gacatctagctttgacaatcatagt

SEQ ID NO: 525831 - DNA, 25 bp, Homo sapien
gggaataacttataatgctgtttag

SEQ ID NO: 525832 - DNA, 25 bp, Homo sapien
ttgtactattggtgtgttggtgaat

SEQ ID NO: 525833 - DNA, 25 bp, Homo sapien
atttttaaactgtgtgctaactgca

SEQ ID NO: 525834 - DNA, 25 bp, Homo sapien
gtgtgctaactgcaataaattatat

SEQ ID NO: 525835 - DNA, 25 bp, Homo sapien
acttccttctgcttctaccagatgg

SEQ ID NO: 525836 - DNA, 25 bp, Homo sapien
cttctgcttctaccagatggcccaa

SEQ ID NO: 525837 - DNA, 25 bp, Homo sapien
agatggcccaaggaagcacatcgtc

SEQ ID NO: 525838 - DNA, 25 bp, Homo sapien
taataaccgttctaacctcttccag

SEQ ID NO: 525839 - DNA, 25 bp, Homo sapien
agaactactagcttttccacttaga

SEQ ID NO: 525840 - DNA, 25 bp, Homo sapien
ctactagcttttccacttagaagaa

SEQ ID NO: 525841 - DNA, 25 bp, Homo sapien
agggagccactccaccatgctatta

SEQ ID NO: 525842 - DNA, 25 bp, Homo sapien
gagccactccaccatgctattaaga

SEQ ID NO: 525843 - DNA, 25 bp, Homo sapien
actccaccatgctattaagactctg

SEQ ID NO: 525844 - DNA, 25 bp, Homo sapien
catgctattaagactctggcagagt

SEQ ID NO: 525845 - DNA, 25 bp, Homo sapien
ctctggcagagttatgggtaggata

SEQ ID NO: 525846 - DNA, 25 bp, Homo sapien
gagccacagcttgggaaggtgttga

SEQ ID NO: 525847 - DNA, 25 bp, Homo sapien
cagggtggattctgagggcttccct

SEQ ID NO: 525848 - DNA, 25 bp, Homo sapien
agggtggattctgagggcttccctc

SEQ ID NO: 525849 - DNA, 25 bp, Homo sapien
gggtggattctgagggcttccctct

SEQ ID NO: 525850 - DNA, 25 bp, Homo sapien
ggtggattctgagggcttccctctg

SEQ ID NO: 525851 - DNA, 25 bp, Homo sapien
gattctgagggcttccctctggaga

SEQ ID NO: 525852 - DNA, 25 bp, Homo sapien
attctgagggcttccctctggagag

SEQ ID NO: 525853 - DNA, 25 bp, Homo sapien
cctctggagaggaagcatgtgatga

SEQ ID NO: 525854 - DNA, 25 bp, Homo sapien
agcatgtgatgagaggtgtagacag

SEQ ID NO: 525855 - DNA, 25 bp, Homo sapien
gtgtagacagggtcaggctgggaca

SEQ ID NO: 525856 - DNA, 25 bp, Homo sapien
gagtgtctggcaagagtagactggc

SEQ ID NO: 525857 - DNA, 25 bp, Homo sapien
ttttgtgtgtgcgacctctgactag

SEQ ID NO: 525858 - DNA, 25 bp, Homo sapien
acctctgactaggtccctgtgggaa

SEQ ID NO: 525859 - DNA, 25 bp, Homo sapien
ctctgactaggtccctgtgggaatg

SEQ ID NO: 525860 - DNA, 25 bp, Homo sapien
cttagataccggccttgagcagccc

SEQ ID NO: 525861 - DNA, 25 bp, Homo sapien
accttggtggcaacggtgtgactga

SEQ ID NO: 525862 - DNA, 25 bp, Homo sapien
gtggcaacggtgtgactgacagcac

SEQ ID NO: 525863 - DNA, 25 bp, Homo sapien
caacggtgtgactgacagcaccacc

SEQ ID NO: 525864 - DNA, 25 bp, Homo sapien
tgcccaggggtcgagagccagtatc

SEQ ID NO: 525865 - DNA, 25 bp, Homo sapien
cagacaatgccacccgccatggaag

SEQ ID NO: 525866 - DNA, 25 bp, Homo sapien
aatgccacccgccatggaagaaaag

SEQ ID NO: 525867 - DNA, 25 bp, Homo sapien
tggaagaaaagctgaccctgcccac

SEQ ID NO: 525868 - DNA, 25 bp, Homo sapien
attgccttgagatctctgctctttg

SEQ ID NO: 525869 - DNA, 25 bp, Homo sapien
ttgccttgagatctctgctctttgt

SEQ ID NO: 525870 - DNA, 25 bp, Homo sapien
tgccttgagatctctgctctttgtc

SEQ ID NO: 525871 - DNA, 25 bp, Homo sapien
gccttgagatctctgctctttgtca

SEQ ID NO: 525872 - DNA, 25 bp, Homo sapien
cttgagatctctgctctttgtcaga

SEQ ID NO: 525873 - DNA, 25 bp, Homo sapien
ttgagatctctgctctttgtcagag

SEQ ID NO: 525874 - DNA, 25 bp, Homo sapien
tgagatctctgctctttgtcagaga

SEQ ID NO: 525875 - DNA, 25 bp, Homo sapien
agatctctgctctttgtcagagatt

SEQ ID NO: 525876 - DNA, 25 bp, Homo sapien
tctctgctctttgtcagagatttgc

SEQ ID NO: 525877 - DNA, 25 bp, Homo sapien
gtttttgttgttttctcatcattcc

SEQ ID NO: 525878 - DNA, 25 bp, Homo sapien
tgtgatactaagaaactaagaagct

SEQ ID NO: 525879 - DNA, 25 bp, Homo sapien
accaatgacagtagagcccctttaa

SEQ ID NO: 525880 - DNA, 25 bp, Homo sapien
gtagagcccctttaagctagccagg

SEQ ID NO: 525881 - DNA, 25 bp, Homo sapien
ctggtttacatttctgctctttcta

SEQ ID NO: 525882 - DNA, 25 bp, Homo sapien
gctctttctaattcagttgtctatt

SEQ ID NO: 525883 - DNA, 25 bp, Homo sapien
gtctattgcatgcagacatcccctg

SEQ ID NO: 525884 - DNA, 25 bp, Homo sapien
tgcccgacttctccattatggaagg

SEQ ID NO: 525885 - DNA, 25 bp, Homo sapien
agtttctctacctacacactaacat

SEQ ID NO: 525886 - DNA, 25 bp, Homo sapien
tttccccatggagtgaactctgcca

SEQ ID NO: 525887 - DNA, 25 bp, Homo sapien
aactctgccagttgtctttggacat

SEQ ID NO: 525888 - DNA, 25 bp, Homo sapien
agatgcaggctcagttctgctcttt

SEQ ID NO: 525889 - DNA, 25 bp, Homo sapien
acttctagatcttcctccatttaat

SEQ ID NO: 525890 - DNA, 25 bp, Homo sapien
aagcccctcttcactgcattggtga

SEQ ID NO: 525891 - DNA, 25 bp, Homo sapien
actgcattggtgacccagtgtcaga

SEQ ID NO: 525892 - DNA, 25 bp, Homo sapien
tggtgacccagtgtcagaaaatgga

SEQ ID NO: 525893 - DNA, 25 bp, Homo sapien
gcccgcagagcccatgacgattgat

SEQ ID NO: 525894 - DNA, 25 bp, Homo sapien
cagagcccatgacgattgatgaact

SEQ ID NO: 525895 - DNA, 25 bp, Homo sapien
ttgatgaactgtatgagctggtggt

SEQ ID NO: 525896 - DNA, 25 bp, Homo sapien
atctttggcttcagcttcaagggcg

SEQ ID NO: 525897 - DNA, 25 bp, Homo sapien
gaaccgttccacagcatcctgagtg

SEQ ID NO: 525898 - DNA, 25 bp, Homo sapien
tccacagcatcctgagtgtcctgaa

SEQ ID NO: 525899 - DNA, 25 bp, Homo sapien
agcatcctgagtgtcctgaagggac

SEQ ID NO: 525900 - DNA, 25 bp, Homo sapien
tcctgaagggactcactgtgcccat

SEQ ID NO: 525901 - DNA, 25 bp, Homo sapien
cccaaccttgagctttgtgggtgaa

SEQ ID NO: 525902 - DNA, 25 bp, Homo sapien
ggtgaacatgtaattcagacctcat

SEQ ID NO: 525903 - DNA, 25 bp, Homo sapien
aattcagacctcatcaatcagcaaa

SEQ ID NO: 525904 - DNA, 25 bp, Homo sapien
atccatctgaactgtggaggagaag

SEQ ID NO: 525905 - DNA, 25 bp, Homo sapien
gtggaggagaagctctctttactga

SEQ ID NO: 525906 - DNA, 25 bp, Homo sapien
tctttactgagggtgctttagcttt

SEQ ID NO: 525907 - DNA, 25 bp, Homo sapien
ctgagggtgctttagctttgtagga

SEQ ID NO: 525908 - DNA, 25 bp, Homo sapien
gctttagctttgtaggatgaaaacc

SEQ ID NO: 525909 - DNA, 25 bp, Homo sapien
acctcaaactaacagggcctaccat

SEQ ID NO: 525910 - DNA, 25 bp, Homo sapien
aactaacagggcctaccatgtagag

SEQ ID NO: 525911 - DNA, 25 bp, Homo sapien
acagggcctaccatgtagagaatga

SEQ ID NO: 525912 - DNA, 25 bp, Homo sapien
atccttgattttgagaatttcccct

SEQ ID NO: 525913 - DNA, 25 bp, Homo sapien
gagaatttcccctcaagtatgtggc

SEQ ID NO: 525914 - DNA, 25 bp, Homo sapien
tttcccctcaagtatgtggcagtaa

SEQ ID NO: 525915 - DNA, 25 bp, Homo sapien
agtaaatacaacaagacactctatg

SEQ ID NO: 525916 - DNA, 25 bp, Homo sapien
acactctatgtattaatgtctccat

SEQ ID NO: 525917 - DNA, 25 bp, Homo sapien
ctatgtattaatgtctccattgtct

SEQ ID NO: 525918 - DNA, 25 bp, Homo sapien
acaaaattcacctcctttctttatg

SEQ ID NO: 525919 - DNA, 25 bp, Homo sapien
acctcctttctttatgtgaatgtat

SEQ ID NO: 525920 - DNA, 25 bp, Homo sapien
gtgaatgtattctccataaaattcc

SEQ ID NO: 525921 - DNA, 25 bp, Homo sapien
gtactttctgttgtatcacaatcag

SEQ ID NO: 525922 - DNA, 25 bp, Homo sapien
tttctgaccttgtaaatttgtatat

SEQ ID NO: 525923 - DNA, 25 bp, Homo sapien
atcgcacgctcactgccgaggaggc

SEQ ID NO: 525924 - DNA, 25 bp, Homo sapien
ggaggaacaaggtgctgaaccactt

SEQ ID NO: 525925 - DNA, 25 bp, Homo sapien
aggaacaaggtgctgaaccacttca

SEQ ID NO: 525926 - DNA, 25 bp, Homo sapien
agcggcggctcaaggatcaggacca

SEQ ID NO: 525927 - DNA, 25 bp, Homo sapien
agaaggagaaacgtggccgcaggaa

SEQ ID NO: 525928 - DNA, 25 bp, Homo sapien
cgagctgcgcatccacgacctggag

SEQ ID NO: 525929 - DNA, 25 bp, Homo sapien
gacctggagatgtcgtccgatgcca

SEQ ID NO: 525930 - DNA, 25 bp, Homo sapien
gagatgtcgtccgatgccagtgatg

SEQ ID NO: 525931 - DNA, 25 bp, Homo sapien
atgtcgtccgatgccagtgatgcca

SEQ ID NO: 525932 - DNA, 25 bp, Homo sapien
tcgtccgatgccagtgatgccagtg

SEQ ID NO: 525933 - DNA, 25 bp, Homo sapien
ccgatgccagtgatgccagtggtga

SEQ ID NO: 525934 - DNA, 25 bp, Homo sapien
aggacgtgggttgtatcctgccagg

SEQ ID NO: 525935 - DNA, 25 bp, Homo sapien
ggctcacacgctagggtgagatgtc

SEQ ID NO: 525936 - DNA, 25 bp, Homo sapien
gtgagatgtcagaaagcgcttgtat

SEQ ID NO: 525937 - DNA, 25 bp, Homo sapien
gaattgtaagggtggcttgctgcca

SEQ ID NO: 525938 - DNA, 25 bp, Homo sapien
ttgctgccaggcttgcactgccgtt

SEQ ID NO: 525939 - DNA, 25 bp, Homo sapien
ctgctgctccttccgtaagaaaatg

SEQ ID NO: 525940 - DNA, 25 bp, Homo sapien
gaaatattctatgcctaatactcac

SEQ ID NO: 525941 - DNA, 25 bp, Homo sapien
tgcctaatactcacacgcaacattt

SEQ ID NO: 525942 - DNA, 25 bp, Homo sapien
tcacacgcaacatttcttgtacttt

SEQ ID NO: 525943 - DNA, 25 bp, Homo sapien
cttgtactttgtaagtcgtttgcga

SEQ ID NO: 525944 - DNA, 25 bp, Homo sapien
gtcgtttgcgagaatgcagaccacc

SEQ ID NO: 525945 - DNA, 25 bp, Homo sapien
cccaaccttgagctttgtgggtgaa

SEQ ID NO: 525946 - DNA, 25 bp, Homo sapien
gctttgtgggtgaacatgtaattca

SEQ ID NO: 525947 - DNA, 25 bp, Homo sapien
gtgggtgaacatgtaattcagacct

SEQ ID NO: 525948 - DNA, 25 bp, Homo sapien
ggtgaacatgtaattcagacctcat

SEQ ID NO: 525949 - DNA, 25 bp, Homo sapien
gaacatgtaattcagacctcatcaa

SEQ ID NO: 525950 - DNA, 25 bp, Homo sapien
acatgtaattcagacctcatcaatc

SEQ ID NO: 525951 - DNA, 25 bp, Homo sapien
atgtaattcagacctcatcaatcag

SEQ ID NO: 525952 - DNA, 25 bp, Homo sapien
gtaattcagacctcatcaatcagca

SEQ ID NO: 525953 - DNA, 25 bp, Homo sapien
taattcagacctcatcaatcagcaa

SEQ ID NO: 525954 - DNA, 25 bp, Homo sapien
aattcagacctcatcaatcagcaaa

SEQ ID NO: 525955 - DNA, 25 bp, Homo sapien
atccatctgaactgtggaggagaag

SEQ ID NO: 525956 - DNA, 25 bp, Homo sapien
gaggcaaacgaaacattggcacaca

SEQ ID NO: 525957 - DNA, 25 bp, Homo sapien
gaaacattggcacacagcacagcct

SEQ ID NO: 525958 - DNA, 25 bp, Homo sapien
agcacagcctcctcaatccacttga

SEQ ID NO: 525959 - DNA, 25 bp, Homo sapien
ttgatcccaactcatctctcattta

SEQ ID NO: 525960 - DNA, 25 bp, Homo sapien
atcccaactcatctctcatttattt

SEQ ID NO: 525961 - DNA, 25 bp, Homo sapien
aactcatctctcatttatttcggct

SEQ ID NO: 525962 - DNA, 25 bp, Homo sapien
tcatctctcatttatttcggcttct

SEQ ID NO: 525963 - DNA, 25 bp, Homo sapien
tttatttcggcttcttttattccag

SEQ ID NO: 525964 - DNA, 25 bp, Homo sapien
ttccaggattaatgtagtgtaacat

SEQ ID NO: 525965 - DNA, 25 bp, Homo sapien
tctgataacgaagagatacctgtct

SEQ ID NO: 525966 - DNA, 25 bp, Homo sapien
atacctgtctgaggcaaacgaaaca

SEQ ID NO: 525967 - DNA, 25 bp, Homo sapien
ggttcagttactactatgaggccat

SEQ ID NO: 525968 - DNA, 25 bp, Homo sapien
gaggccataatatatttgctggtat

SEQ ID NO: 525969 - DNA, 25 bp, Homo sapien
aaaattgatctagagactcattcaa

SEQ ID NO: 525970 - DNA, 25 bp, Homo sapien
ctgtcctcttacatttgagggatca

SEQ ID NO: 525971 - DNA, 25 bp, Homo sapien
gagggatcatagactgctgtgtgaa

SEQ ID NO: 525972 - DNA, 25 bp, Homo sapien
tggaaagtctcaggtccctaccagg

SEQ ID NO: 525973 - DNA, 25 bp, Homo sapien
taccagggcactgaatggcttctca

SEQ ID NO: 525974 - DNA, 25 bp, Homo sapien
tgaatggcttctcaatggctgtaga

SEQ ID NO: 525975 - DNA, 25 bp, Homo sapien
tgtagagacagtacagttttccaaa

SEQ ID NO: 525976 - DNA, 25 bp, Homo sapien
gcagcctaattcatctggacagcta

SEQ ID NO: 525977 - DNA, 25 bp, Homo sapien
ggacagctaccaggcactttggaaa

SEQ ID NO: 525978 - DNA, 25 bp, Homo sapien
tttcgttttgcttttagcctctaca

SEQ ID NO: 525979 - DNA, 25 bp, Homo sapien
gcttttagcctctacatgctaggat

SEQ ID NO: 525980 - DNA, 25 bp, Homo sapien
catgctaggatcacaggaagacttt

SEQ ID NO: 525981 - DNA, 25 bp, Homo sapien
ggacagtttaagttctcctgcaagg

SEQ ID NO: 525982 - DNA, 25 bp, Homo sapien
ttaagttctcctgcaaggtttaatt

SEQ ID NO: 525983 - DNA, 25 bp, Homo sapien
aatattccaaagcaggctgccttgt

SEQ ID NO: 525984 - DNA, 25 bp, Homo sapien
aagcaggctgccttgtggttttggc

SEQ ID NO: 525985 - DNA, 25 bp, Homo sapien
tgtggttttggccagccttgtgcta

SEQ ID NO: 525986 - DNA, 25 bp, Homo sapien
gccagccttgtgctatgttgataag

SEQ ID NO: 525987 - DNA, 25 bp, Homo sapien
gcttaaaatcactttactttatcca

SEQ ID NO: 525988 - DNA, 25 bp, Homo sapien
tactttatccaatttttactgaact

SEQ ID NO: 525989 - DNA, 25 bp, Homo sapien
atgcatggtttgtggcggaagacgg

SEQ ID NO: 525990 - DNA, 25 bp, Homo sapien
tgcatggtttgtggcggaagacggg

SEQ ID NO: 525991 - DNA, 25 bp, Homo sapien
agcggctcccccagcgctgaagcac

SEQ ID NO: 525992 - DNA, 25 bp, Homo sapien
tgaagcacggggttcagcggctccc

SEQ ID NO: 525993 - DNA, 25 bp, Homo sapien
gggctcgggaccatgaggatgacca

SEQ ID NO: 525994 - DNA, 25 bp, Homo sapien
tgaggatgaccagcaaaattcaaga

SEQ ID NO: 525995 - DNA, 25 bp, Homo sapien
gaggatgaccagcaaaattcaagaa

SEQ ID NO: 525996 - DNA, 25 bp, Homo sapien
aggatgaccagcaaaattcaagaac

SEQ ID NO: 525997 - DNA, 25 bp, Homo sapien
ggatgaccagcaaaattcaagaaca

SEQ ID NO: 525998 - DNA, 25 bp, Homo sapien
gatgaccagcaaaattcaagaacaa

SEQ ID NO: 525999 - DNA, 25 bp, Homo sapien
gaccagcaaaattcaagaacaaaac

SEQ ID NO: 526000 - DNA, 25 bp, Homo sapien
tggtagattccgtaactttaaattg

SEQ ID NO: 526001 - DNA, 25 bp, Homo sapien
tttaaattggtagctttcatttgct

SEQ ID NO: 526002 - DNA, 25 bp, Homo sapien
gataatgttctcatcagtagtaaga

SEQ ID NO: 526003 - DNA, 25 bp, Homo sapien
gaatctcagggttatgcttattccc

SEQ ID NO: 526004 - DNA, 25 bp, Homo sapien
gttatgcttattccccaatggaggt

SEQ ID NO: 526005 - DNA, 25 bp, Homo sapien
gtatgacatataatcttttctgcct

SEQ ID NO: 526006 - DNA, 25 bp, Homo sapien
ttctgcctttacttatcaattcacc

SEQ ID NO: 526007 - DNA, 25 bp, Homo sapien
acttatcaattcaccaaggagctgt

SEQ ID NO: 526008 - DNA, 25 bp, Homo sapien
aaggagctgttttctctgcatctag

SEQ ID NO: 526009 - DNA, 25 bp, Homo sapien
tgagatggacattgcctcttcattg

SEQ ID NO: 526010 - DNA, 25 bp, Homo sapien
tgcatctaggccatcatactgccag

SEQ ID NO: 526011 - DNA, 25 bp, Homo sapien
aagaaatgatgctgagggacctagt

SEQ ID NO: 526012 - DNA, 25 bp, Homo sapien
gctgagggacctagtgaaatcaatg

SEQ ID NO: 526013 - DNA, 25 bp, Homo sapien
aatcaatgaaactcttgagtcttgc

SEQ ID NO: 526014 - DNA, 25 bp, Homo sapien
aactcttgagtcttgcttaggctcg

SEQ ID NO: 526015 - DNA, 25 bp, Homo sapien
gagtcttgcttaggctcgcaaacaa

SEQ ID NO: 526016 - DNA, 25 bp, Homo sapien
gcttaggctcgcaaacaagaagtgg

SEQ ID NO: 526017 - DNA, 25 bp, Homo sapien
ggcttgggaaattaggatatgacat

SEQ ID NO: 526018 - DNA, 25 bp, Homo sapien
tgcccaaatatattgaatgtacaga

SEQ ID NO: 526019 - DNA, 25 bp, Homo sapien
gggcagatatcttggcctggttatg

SEQ ID NO: 526020 - DNA, 25 bp, Homo sapien
ggtaggacacccagattttcagact

SEQ ID NO: 526021 - DNA, 25 bp, Homo sapien
gacacccagattttcagacttacaa

SEQ ID NO: 526022 - DNA, 25 bp, Homo sapien
ctgttactgttgtggtacctggcac

SEQ ID NO: 526023 - DNA, 25 bp, Homo sapien
acagctctgataaagcacggtcact

SEQ ID NO: 526024 - DNA, 25 bp, Homo sapien
tatagagacatccagcacactccat

SEQ ID NO: 526025 - DNA, 25 bp, Homo sapien
aaagcaggtacaagatattttacat

SEQ ID NO: 526026 - DNA, 25 bp, Homo sapien
gatattttacattcacagaggtatg

SEQ ID NO: 526027 - DNA, 25 bp, Homo sapien
cagaggtatgatacagtactgtcct

SEQ ID NO: 526028 - DNA, 25 bp, Homo sapien
gagacatccagcacactccatttaa

SEQ ID NO: 526029 - DNA, 25 bp, Homo sapien
tacagtactgtcctatatctataat

SEQ ID NO: 526030 - DNA, 25 bp, Homo sapien
gtactgtcctatatctataatacta

SEQ ID NO: 526031 - DNA, 25 bp, Homo sapien
aaccccagaaaattgcaaagttctg

SEQ ID NO: 526032 - DNA, 25 bp, Homo sapien
aagttctgttactgttgtggtacct

SEQ ID NO: 526033 - DNA, 25 bp, Homo sapien
agaaatgcccaaggaacctgaagac

SEQ ID NO: 526034 - DNA, 25 bp, Homo sapien
aggtgaagactttacagtgactagt

SEQ ID NO: 526035 - DNA, 25 bp, Homo sapien
agtgactagtaagccagccggactt

SEQ ID NO: 526036 - DNA, 25 bp, Homo sapien
aatctgttcttgtttcaaagcacca

SEQ ID NO: 526037 - DNA, 25 bp, Homo sapien
agccagccggactttcagaagatca

SEQ ID NO: 526038 - DNA, 25 bp, Homo sapien
gactgcctttagtatcatttctgaa

SEQ ID NO: 526039 - DNA, 25 bp, Homo sapien
atattgaatattcatgctccggcct

SEQ ID NO: 526040 - DNA, 25 bp, Homo sapien
aaagcaccacttggaggctgcggaa

SEQ ID NO: 526041 - DNA, 25 bp, Homo sapien
gaggctgcggaagatacccgtgtaa

SEQ ID NO: 526042 - DNA, 25 bp, Homo sapien
gatacccgtgtaaaggaaccactgt

SEQ ID NO: 526043 - DNA, 25 bp, Homo sapien
ggaaccactgtcttcagcaaaaagc

SEQ ID NO: 526044 - DNA, 25 bp, Homo sapien
atttagaactttgaatacaggtcaa

SEQ ID NO: 526045 - DNA, 25 bp, Homo sapien
atattccctaatctatatagctgaa

SEQ ID NO: 526046 - DNA, 25 bp, Homo sapien
acataaattagttcctctccagtga

SEQ ID NO: 526047 - DNA, 25 bp, Homo sapien
taaattagttcctctccagtgaagt

SEQ ID NO: 526048 - DNA, 25 bp, Homo sapien
attagttcctctccagtgaagtatc

SEQ ID NO: 526049 - DNA, 25 bp, Homo sapien
gttcctctccagtgaagtatcttat

SEQ ID NO: 526050 - DNA, 25 bp, Homo sapien
tcctctccagtgaagtatcttattt

SEQ ID NO: 526051 - DNA, 25 bp, Homo sapien
tcttattttaccaatccatttcagg

SEQ ID NO: 526052 - DNA, 25 bp, Homo sapien
caatccatttcaggaaagaggttct

SEQ ID NO: 526053 - DNA, 25 bp, Homo sapien
ggttctgctgccgtaaaggcagaaa

SEQ ID NO: 526054 - DNA, 25 bp, Homo sapien
tttcaatgcatctgctattattttg

SEQ ID NO: 526055 - DNA, 25 bp, Homo sapien
ggaactgtaaatctgttgcccaatc

SEQ ID NO: 526056 - DNA, 25 bp, Homo sapien
gttgcccaatcttaacatttttgag

SEQ ID NO: 526057 - DNA, 25 bp, Homo sapien
ttgagctgcatttaagtagactttg

SEQ ID NO: 526058 - DNA, 25 bp, Homo sapien
gactttggaccgttaagctgggcaa

SEQ ID NO: 526059 - DNA, 25 bp, Homo sapien
gatttcttgtagatgtatccttcac

SEQ ID NO: 526060 - DNA, 25 bp, Homo sapien
gtagatgtatccttcacgttgtaaa

SEQ ID NO: 526061 - DNA, 25 bp, Homo sapien
ttgtagagtgaagccatgggaagcc

SEQ ID NO: 526062 - DNA, 25 bp, Homo sapien
agccatgtgtaacagagcttagaca

SEQ ID NO: 526063 - DNA, 25 bp, Homo sapien
gagcttagacatccaaaactaatca

SEQ ID NO: 526064 - DNA, 25 bp, Homo sapien
aaactaatcaatgctgaggtggcta

SEQ ID NO: 526065 - DNA, 25 bp, Homo sapien
gaggtggctaaatacctagcctttt

SEQ ID NO: 526066 - DNA, 25 bp, Homo sapien
gtggcccatgcagaccaggcgcacg

SEQ ID NO: 526067 - DNA, 25 bp, Homo sapien
tggcccatgcagaccaggcgcacgt

SEQ ID NO: 526068 - DNA, 25 bp, Homo sapien
ggcccatgcagaccaggcgcacgtg

SEQ ID NO: 526069 - DNA, 25 bp, Homo sapien
gcccatgcagaccaggcgcacgtgg

SEQ ID NO: 526070 - DNA, 25 bp, Homo sapien
acagtgccaccttctcaccattcca

SEQ ID NO: 526071 - DNA, 25 bp, Homo sapien
ttctcaccattccagccaaggagag

SEQ ID NO: 526072 - DNA, 25 bp, Homo sapien
tctcaccattccagccaaggagaga

SEQ ID NO: 526073 - DNA, 25 bp, Homo sapien
ctcaccattccagccaaggagagat

SEQ ID NO: 526074 - DNA, 25 bp, Homo sapien
tcaccattccagccaaggagagatg

SEQ ID NO: 526075 - DNA, 25 bp, Homo sapien
caccattccagccaaggagagatgt

SEQ ID NO: 526076 - DNA, 25 bp, Homo sapien
accattccagccaaggagagatgtg

SEQ ID NO: 526077 - DNA, 25 bp, Homo sapien
aacattatgcttagcatgtgtgtcc

SEQ ID NO: 526078 - DNA, 25 bp, Homo sapien
agtattgaaattcctcgagccgctg

SEQ ID NO: 526079 - DNA, 25 bp, Homo sapien
tgaaattcctcgagccgctgctttt

SEQ ID NO: 526080 - DNA, 25 bp, Homo sapien
tgcttttctcactccataattctgg

SEQ ID NO: 526081 - DNA, 25 bp, Homo sapien
ttctcactccataattctggccaga

SEQ ID NO: 526082 - DNA, 25 bp, Homo sapien
attctggccagaatttggtacttaa

SEQ ID NO: 526083 - DNA, 25 bp, Homo sapien
aatagctacttaagtcatctccctg

SEQ ID NO: 526084 - DNA, 25 bp, Homo sapien
tccactctgttgtctttcagggcgt

SEQ ID NO: 526085 - DNA, 25 bp, Homo sapien
tttcagggcgtcgtccacactgtag

SEQ ID NO: 526086 - DNA, 25 bp, Homo sapien
gtcgtccacactgtagccaaagtga

SEQ ID NO: 526087 - DNA, 25 bp, Homo sapien
actgtagccaaagtgatcttataaa

SEQ ID NO: 526088 - DNA, 25 bp, Homo sapien
ctttcagcttatgtggagaagtcgc

SEQ ID NO: 526089 - DNA, 25 bp, Homo sapien
gaagtcgctgtgaagccacctataa

SEQ ID NO: 526090 - DNA, 25 bp, Homo sapien
gaagaactcttttgccatcttaaaa

SEQ ID NO: 526091 - DNA, 25 bp, Homo sapien
aagtcatctcagctggtattctcat

SEQ ID NO: 526092 - DNA, 25 bp, Homo sapien
gtcatctcagctggtattctcatca

SEQ ID NO: 526093 - DNA, 25 bp, Homo sapien
ctcagctggtattctcatcagtatc

SEQ ID NO: 526094 - DNA, 25 bp, Homo sapien
gctggtattctcatcagtatcaggg

SEQ ID NO: 526095 - DNA, 25 bp, Homo sapien
gaaatctaaatttccgattctagga

SEQ ID NO: 526096 - DNA, 25 bp, Homo sapien
aaatttccgattctaggatttcctg

SEQ ID NO: 526097 - DNA, 25 bp, Homo sapien
atttccgattctaggatttcctgtt

SEQ ID NO: 526098 - DNA, 25 bp, Homo sapien
gattctaggatttcctgttttgtct

SEQ ID NO: 526099 - DNA, 25 bp, Homo sapien
tagatacttgaggttcattttcttt

SEQ ID NO: 526100 - DNA, 25 bp, Homo sapien
agatacttgaggttcattttctttt

SEQ ID NO: 526101 - DNA, 25 bp, Homo sapien
aaaccagtacagtacttactgataa

SEQ ID NO: 526102 - DNA, 25 bp, Homo sapien
aaccagtacagtacttactgataaa

SEQ ID NO: 526103 - DNA, 25 bp, Homo sapien
accagtacagtacttactgataaat

SEQ ID NO: 526104 - DNA, 25 bp, Homo sapien
ccagtacagtacttactgataaatc

SEQ ID NO: 526105 - DNA, 25 bp, Homo sapien
cagtacagtacttactgataaatcg

SEQ ID NO: 526106 - DNA, 25 bp, Homo sapien
agtacagtacttactgataaatcgt

SEQ ID NO: 526107 - DNA, 25 bp, Homo sapien
tatttcctattccaacgacctaaag

SEQ ID NO: 526108 - DNA, 25 bp, Homo sapien
tccaacgacctaaagcatgtgccaa

SEQ ID NO: 526109 - DNA, 25 bp, Homo sapien
gcatgtgccaagaaacttcgagcct

SEQ ID NO: 526110 - DNA, 25 bp, Homo sapien
gaaacttcgagccttagcagcagaa

SEQ ID NO: 526111 - DNA, 25 bp, Homo sapien
tcgagccttagcagcagaatgcaat

SEQ ID NO: 526112 - DNA, 25 bp, Homo sapien
cagaatgcaatgaccctgaggtgaa

SEQ ID NO: 526113 - DNA, 25 bp, Homo sapien
gattggctgtatgttcccaaacaaa

SEQ ID NO: 526114 - DNA, 25 bp, Homo sapien
gtaatattttggttttgcactctgg

SEQ ID NO: 526115 - DNA, 25 bp, Homo sapien
tttgcactctggaagtaatgcacat

SEQ ID NO: 526116 - DNA, 25 bp, Homo sapien
gaatattcttaatgctctttcacta

SEQ ID NO: 526117 - DNA, 25 bp, Homo sapien
gagcaaaagcatttacccaggacaa

SEQ ID NO: 526118 - DNA, 25 bp, Homo sapien
atcgtcctgtactcttctccagtgg

SEQ ID NO: 526119 - DNA, 25 bp, Homo sapien
tcccacactctgcacatacaattta

SEQ ID NO: 526120 - DNA, 25 bp, Homo sapien
actctgcacatacaatttagggacc

SEQ ID NO: 526121 - DNA, 25 bp, Homo sapien
gcacatacaatttagggacctggca

SEQ ID NO: 526122 - DNA, 25 bp, Homo sapien
atacaatttagggacctggcagggt

SEQ ID NO: 526123 - DNA, 25 bp, Homo sapien
aatttagggacctggcagggtcttg

SEQ ID NO: 526124 - DNA, 25 bp, Homo sapien
gacctggcagggtcttggtggcctg

SEQ ID NO: 526125 - DNA, 25 bp, Homo sapien
tggcctgcagcttccctttctggaa

SEQ ID NO: 526126 - DNA, 25 bp, Homo sapien
tgcagcttccctttctggaaccgac

SEQ ID NO: 526127 - DNA, 25 bp, Homo sapien
agcttccctttctggaaccgactcg

SEQ ID NO: 526128 - DNA, 25 bp, Homo sapien
aaccgactcgcctcccatcagagag

SEQ ID NO: 526129 - DNA, 25 bp, Homo sapien
gatttcctcattggttgatctctct

SEQ ID NO: 526130 - DNA, 25 bp, Homo sapien
cctcattggttgatctctctctctg

SEQ ID NO: 526131 - DNA, 25 bp, Homo sapien
gcaaattttcaccaggacagcgttt

SEQ ID NO: 526132 - DNA, 25 bp, Homo sapien
ttcaccaggacagcgttttttgatt

SEQ ID NO: 526133 - DNA, 25 bp, Homo sapien
gggagctctggcacagtatgcttta

SEQ ID NO: 526134 - DNA, 25 bp, Homo sapien
atgctttaatttagcaggaacttcc

SEQ ID NO: 526135 - DNA, 25 bp, Homo sapien
agatgatttaaattctcgatgctgt

SEQ ID NO: 526136 - DNA, 25 bp, Homo sapien
gatgacacacatatgatctttcgtg

SEQ ID NO: 526137 - DNA, 25 bp, Homo sapien
atctttcgtgtttctgagcgactct

SEQ ID NO: 526138 - DNA, 25 bp, Homo sapien
gagcgactctactttcattgtttgc

SEQ ID NO: 526139 - DNA, 25 bp, Homo sapien
tactttcattgtttgccagcgtggc

SEQ ID NO: 526140 - DNA, 25 bp, Homo sapien
tatgccttggcgatggctgtagcac

SEQ ID NO: 526141 - DNA, 25 bp, Homo sapien
atggctgtagcacagctcagcccgg

SEQ ID NO: 526142 - DNA, 25 bp, Homo sapien
agcccggccagttccataagttggt

SEQ ID NO: 526143 - DNA, 25 bp, Homo sapien
agttccataagttggtccacgctga

SEQ ID NO: 526144 - DNA, 25 bp, Homo sapien
ataagttggtccacgctgaactggt

SEQ ID NO: 526145 - DNA, 25 bp, Homo sapien
gtccacgctgaactggtattcgtta

SEQ ID NO: 526146 - DNA, 25 bp, Homo sapien
attcgttaaatagctcctggtccac

SEQ ID NO: 526147 - DNA, 25 bp, Homo sapien
taaatagctcctggtccacggcctg

SEQ ID NO: 526148 - DNA, 25 bp, Homo sapien
acaggcgatggtctggcttttgatc

SEQ ID NO: 526149 - DNA, 25 bp, Homo sapien
atggtctggcttttgatccgcggca

SEQ ID NO: 526150 - DNA, 25 bp, Homo sapien
tctggcttttgatccgcggcaggcg

SEQ ID NO: 526151 - DNA, 25 bp, Homo sapien
aaaaccatgctttccttgatttctc

SEQ ID NO: 526152 - DNA, 25 bp, Homo sapien
tgatttctcctcatgtcaagacatt

SEQ ID NO: 526153 - DNA, 25 bp, Homo sapien
atttcttacttctctagtctcctag

SEQ ID NO: 526154 - DNA, 25 bp, Homo sapien
tctcctagcattttgtgcctcacaa

SEQ ID NO: 526155 - DNA, 25 bp, Homo sapien
tgtgcctcacaaccctcaggacagg

SEQ ID NO: 526156 - DNA, 25 bp, Homo sapien
ctcaggacaggccagctagtgtatg

SEQ ID NO: 526157 - DNA, 25 bp, Homo sapien
atggctgtgggtttttatctcacct

SEQ ID NO: 526158 - DNA, 25 bp, Homo sapien
agtatactcaccctactcctacagt

SEQ ID NO: 526159 - DNA, 25 bp, Homo sapien
tacagtgccttgcattccgtagctg

SEQ ID NO: 526160 - DNA, 25 bp, Homo sapien
ttgcattccgtagctgctcagtaca

SEQ ID NO: 526161 - DNA, 25 bp, Homo sapien
gctgctcagtacattaacccattca

SEQ ID NO: 526162 - DNA, 25 bp, Homo sapien
aattacttctgaatgtgagcacatg

SEQ ID NO: 526163 - DNA, 25 bp, Homo sapien
gaatgtgagcacatgaagtattata

SEQ ID NO: 526164 - DNA, 25 bp, Homo sapien
aacaaagctgactggaacatgcaga

SEQ ID NO: 526165 - DNA, 25 bp, Homo sapien
ggaacatgcagaacaacggaggaaa

SEQ ID NO: 526166 - DNA, 25 bp, Homo sapien
ttccctttacttaggagatccttat

SEQ ID NO: 526167 - DNA, 25 bp, Homo sapien
aggagatccttatttaagagtgatt

SEQ ID NO: 526168 - DNA, 25 bp, Homo sapien
aagagtgattatgcttgcctgtcat

SEQ ID NO: 526169 - DNA, 25 bp, Homo sapien
gattatgcttgcctgtcataggagc

SEQ ID NO: 526170 - DNA, 25 bp, Homo sapien
atgcttgcctgtcataggagcaaaa

SEQ ID NO: 526171 - DNA, 25 bp, Homo sapien
aagcctaagtgaacctttactgcaa

SEQ ID NO: 526172 - DNA, 25 bp, Homo sapien
gtgaacctttactgcaagtgaggga

SEQ ID NO: 526173 - DNA, 25 bp, Homo sapien
aggctgtgctgtgtgccaatgtttc

SEQ ID NO: 526174 - DNA, 25 bp, Homo sapien
gtgccaatgtttcgtttgcctcaga

SEQ ID NO: 526175 - DNA, 25 bp, Homo sapien
tgtttcgtttgcctcagacaggtat

SEQ ID NO: 526176 - DNA, 25 bp, Homo sapien
gacaggtatctcttcgttatcagaa

SEQ ID NO: 526177 - DNA, 25 bp, Homo sapien
gaagagttgcttcatttcatctggg

SEQ ID NO: 526178 - DNA, 25 bp, Homo sapien
tgcttcatttcatctgggagcagaa

SEQ ID NO: 526179 - DNA, 25 bp, Homo sapien
gataagtttaacttgcatctgcagt

SEQ ID NO: 526180 - DNA, 25 bp, Homo sapien
ctgcagtattgcatgttagggataa

SEQ ID NO: 526181 - DNA, 25 bp, Homo sapien
gagctgtggagttcttaaatatcaa

SEQ ID NO: 526182 - DNA, 25 bp, Homo sapien
aaatatcaaccatggcactttctcc

SEQ ID NO: 526183 - DNA, 25 bp, Homo sapien
tatcaaccatggcactttctcctga

SEQ ID NO: 526184 - DNA, 25 bp, Homo sapien
ttcaaggccctgttcaaatgtctct

SEQ ID NO: 526185 - DNA, 25 bp, Homo sapien
aatgtctctgtcttaggctgacgca

SEQ ID NO: 526186 - DNA, 25 bp, Homo sapien
tctgtcttaggctgacgcagctgct

SEQ ID NO: 526187 - DNA, 25 bp, Homo sapien
ttctgtggccatacagtgctccttt

SEQ ID NO: 526188 - DNA, 25 bp, Homo sapien
catacagtgctccttttcacagatg

SEQ ID NO: 526189 - DNA, 25 bp, Homo sapien
ttcacagatgatggctcctgcaggg

SEQ ID NO: 526190 - DNA, 25 bp, Homo sapien
gtgcacgggaacgtctgctgatgcc

SEQ ID NO: 526191 - DNA, 25 bp, Homo sapien
tgatgcccaccctaaggccaatcaa

SEQ ID NO: 526192 - DNA, 25 bp, Homo sapien
ctaaggccaatcaaggagccacggg

SEQ ID NO: 526193 - DNA, 25 bp, Homo sapien
tgggtcctggtcctcacatcctctt

SEQ ID NO: 526194 - DNA, 25 bp, Homo sapien
atcttgcccttcttggagcgggcac

SEQ ID NO: 526195 - DNA, 25 bp, Homo sapien
caatgccgtcattttcagttagatg

SEQ ID NO: 526196 - DNA, 25 bp, Homo sapien
cagttagatgattttgcactttgag

SEQ ID NO: 526197 - DNA, 25 bp, Homo sapien
atgccatgtctatttgattagtctt

SEQ ID NO: 526198 - DNA, 25 bp, Homo sapien
atttttacaggcttatcagtctcac

SEQ ID NO: 526199 - DNA, 25 bp, Homo sapien
atcagtctcactgttggctgtcatt

SEQ ID NO: 526200 - DNA, 25 bp, Homo sapien
gttggctgtcattgtgacaaagtca

SEQ ID NO: 526201 - DNA, 25 bp, Homo sapien
ggacgacacacagtatggatcacat

SEQ ID NO: 526202 - DNA, 25 bp, Homo sapien
ttgtttgacattaagcttttgccag

SEQ ID NO: 526203 - DNA, 25 bp, Homo sapien
gcttttgccagaaaatgttgcatgt

SEQ ID NO: 526204 - DNA, 25 bp, Homo sapien
catgtgttttacctcgacttgctaa

SEQ ID NO: 526205 - DNA, 25 bp, Homo sapien
ttttacctcgacttgctaaaatcga

SEQ ID NO: 526206 - DNA, 25 bp, Homo sapien
acccagaccagagtgcctggacgcc

SEQ ID NO: 526207 - DNA, 25 bp, Homo sapien
actcaacatggttcccacacactgg

SEQ ID NO: 526208 - DNA, 25 bp, Homo sapien
atggttcccacacactggtctctgg

SEQ ID NO: 526209 - DNA, 25 bp, Homo sapien
acactggtctctgggccattcaggg

SEQ ID NO: 526210 - DNA, 25 bp, Homo sapien
gggatgccctttgtggacatgcaga

SEQ ID NO: 526211 - DNA, 25 bp, Homo sapien
gatgccctttgtggacatgcagaat

SEQ ID NO: 526212 - DNA, 25 bp, Homo sapien
gccctttgtggacatgcagaatttc

SEQ ID NO: 526213 - DNA, 25 bp, Homo sapien
cattttgtaacaatttgggtttcat

SEQ ID NO: 526214 - DNA, 25 bp, Homo sapien
ttgggtttcatagtaactgtgttac

SEQ ID NO: 526215 - DNA, 25 bp, Homo sapien
catagtaactgtgttacttgccaat

SEQ ID NO: 526216 - DNA, 25 bp, Homo sapien
agggagcaccatgggcctctgagac

SEQ ID NO: 526217 - DNA, 25 bp, Homo sapien
tttttaaccagcacccaccataatt

SEQ ID NO: 526218 - DNA, 25 bp, Homo sapien
tttcatctttcctggatcactacag

SEQ ID NO: 526219 - DNA, 25 bp, Homo sapien
atcactacagtgaagtattacagtt

SEQ ID NO: 526220 - DNA, 25 bp, Homo sapien
attacagttgtacagttcccagtct

SEQ ID NO: 526221 - DNA, 25 bp, Homo sapien
agttgtacagttcccagtctggcct

SEQ ID NO: 526222 - DNA, 25 bp, Homo sapien
cttgctcggataaaactttgtatgt

SEQ ID NO: 526223 - DNA, 25 bp, Homo sapien
gcatagattctatattgtaatgatg

SEQ ID NO: 526224 - DNA, 25 bp, Homo sapien
gtaatgatgtcctatgcaaaaagaa

SEQ ID NO: 526225 - DNA, 25 bp, Homo sapien
tattgttttaacgtgtatgcatgtt

SEQ ID NO: 526226 - DNA, 25 bp, Homo sapien
gtatgcatgtttagtgacgtttaca

SEQ ID NO: 526227 - DNA, 25 bp, Homo sapien
gcatgtttagtgacgtttacatttt

SEQ ID NO: 526228 - DNA, 25 bp, Homo sapien
atagctgaatctttttggtaacttt

SEQ ID NO: 526229 - DNA, 25 bp, Homo sapien
aaatctttatcatagactctgtaca

SEQ ID NO: 526230 - DNA, 25 bp, Homo sapien
atagactctgtacatatgttcaaat

SEQ ID NO: 526231 - DNA, 25 bp, Homo sapien
atgttcaaattagctgcttgcctga

SEQ ID NO: 526232 - DNA, 25 bp, Homo sapien
tagctgcttgcctgatgtgtgtatc

SEQ ID NO: 526233 - DNA, 25 bp, Homo sapien
cctgatgtgtgtatcatcggtggga

SEQ ID NO: 526234 - DNA, 25 bp, Homo sapien
atcggtgggatgacagaacaaacat

SEQ ID NO: 526235 - DNA, 25 bp, Homo sapien
ttattaggaagcatactctgttttt

SEQ ID NO: 526236 - DNA, 25 bp, Homo sapien
taatattccatgatacttttataga

SEQ ID NO: 526237 - DNA, 25 bp, Homo sapien
ttttatagaacaattctggcttcag

SEQ ID NO: 526238 - DNA, 25 bp, Homo sapien
aattctggcttcaggaaagtctaga

SEQ ID NO: 526239 - DNA, 25 bp, Homo sapien
ttaaatctcccttttgttatcgctc

SEQ ID NO: 526240 - DNA, 25 bp, Homo sapien
tgttatcgctcctgttgtagcgtgt

SEQ ID NO: 526241 - DNA, 25 bp, Homo sapien
ttgtagcgtgtccatcagtgtgtga

SEQ ID NO: 526242 - DNA, 25 bp, Homo sapien
ggagacaacatctgatgggatccaa

SEQ ID NO: 526243 - DNA, 25 bp, Homo sapien
catcagtgtgtgaagggtgcgccct

SEQ ID NO: 526244 - DNA, 25 bp, Homo sapien
cgccctgttccaatgatactgcatt

SEQ ID NO: 526245 - DNA, 25 bp, Homo sapien
aatgatactgcattgctgcatccag

SEQ ID NO: 526246 - DNA, 25 bp, Homo sapien
tgcatccagcctttcgtgggagcac

SEQ ID NO: 526247 - DNA, 25 bp, Homo sapien
gagcacggtaccaagcgtccggaat

SEQ ID NO: 526248 - DNA, 25 bp, Homo sapien
gcgtccggaattgattatcccaatc

SEQ ID NO: 526249 - DNA, 25 bp, Homo sapien
gtcagctcttggtgtgttttcattt

SEQ ID NO: 526250 - DNA, 25 bp, Homo sapien
tggatgcagagctggctgcacccag

SEQ ID NO: 526251 - DNA, 25 bp, Homo sapien
gctgggccagtgtgtcctgtaagac

SEQ ID NO: 526252 - DNA, 25 bp, Homo sapien
gtgtgtcctgtaagacttcttgcat

SEQ ID NO: 526253 - DNA, 25 bp, Homo sapien
ctgtaagacttcttgcattccttct

SEQ ID NO: 526254 - DNA, 25 bp, Homo sapien
tgtttttgccctgttttgattttgg

SEQ ID NO: 526255 - DNA, 25 bp, Homo sapien
tgccctgttttgattttggtcccac

SEQ ID NO: 526256 - DNA, 25 bp, Homo sapien
tttgattttggtcccacagagcagg

SEQ ID NO: 526257 - DNA, 25 bp, Homo sapien
gggatgtagtttgtacccaccatgg

SEQ ID NO: 526258 - DNA, 25 bp, Homo sapien
tagtttgtacccaccatggcgcaga

SEQ ID NO: 526259 - DNA, 25 bp, Homo sapien
caccatggcgcagacttccaaataa

SEQ ID NO: 526260 - DNA, 25 bp, Homo sapien
ggcgcagacttccaaataaatagta

SEQ ID NO: 526261 - DNA, 25 bp, Homo sapien
gttgcaggtgctgtttgatttttct

SEQ ID NO: 526262 - DNA, 25 bp, Homo sapien
tttttagcccttgatcccctttgct

SEQ ID NO: 526263 - DNA, 25 bp, Homo sapien
gggaactgctcactgacagcttctc

SEQ ID NO: 526264 - DNA, 25 bp, Homo sapien
ttctctgtaacctgcagtaccagtg

SEQ ID NO: 526265 - DNA, 25 bp, Homo sapien
ttcattagtgtcatttctttgtcat

SEQ ID NO: 526266 - DNA, 25 bp, Homo sapien
ttgtcattgaggacttttcccctta

SEQ ID NO: 526267 - DNA, 25 bp, Homo sapien
tttccccttacaacagtaacaccat

SEQ ID NO: 526268 - DNA, 25 bp, Homo sapien
gcaaaacttataatacctcctggga

SEQ ID NO: 526269 - DNA, 25 bp, Homo sapien
atacctcctgggattgtgagctagt

SEQ ID NO: 526270 - DNA, 25 bp, Homo sapien
gtgagctagtcattcagcctgtgta

SEQ ID NO: 526271 - DNA, 25 bp, Homo sapien
attcagcctgtgtaaccatgtggaa

SEQ ID NO: 526272 - DNA, 25 bp, Homo sapien
ttgccaaaggaaacaaccgtgggag

SEQ ID NO: 526273 - DNA, 25 bp, Homo sapien
gtgacacacaaacaacttacagact

SEQ ID NO: 526274 - DNA, 25 bp, Homo sapien
aacaacttacagacttccacaagca

SEQ ID NO: 526275 - DNA, 25 bp, Homo sapien
acttccacaagcaagtcactagtgc

SEQ ID NO: 526276 - DNA, 25 bp, Homo sapien
gcaagtcactagtgctgaggaatgt

SEQ ID NO: 526277 - DNA, 25 bp, Homo sapien
cactagtgctgaggaatgtaaacaa

SEQ ID NO: 526278 - DNA, 25 bp, Homo sapien
taaacaagtttgctgggccttgcga

SEQ ID NO: 526279 - DNA, 25 bp, Homo sapien
ccaggttgtttcgatagctcacact

SEQ ID NO: 526280 - DNA, 25 bp, Homo sapien
aggttgtttcgatagctcacactcc

SEQ ID NO: 526281 - DNA, 25 bp, Homo sapien
gagggaaaatcagcgcggattttaa

SEQ ID NO: 526282 - DNA, 25 bp, Homo sapien
taaaaagatggctgtggcctgcccg

SEQ ID NO: 526283 - DNA, 25 bp, Homo sapien
gaacattctagatcacatgggtgct

SEQ ID NO: 526284 - DNA, 25 bp, Homo sapien
atgggtgcttgtgccttccgatttt

SEQ ID NO: 526285 - DNA, 25 bp, Homo sapien
gtgccttccgattttcttgcatttg

SEQ ID NO: 526286 - DNA, 25 bp, Homo sapien
tttcctgacctgaagttgttgttac

SEQ ID NO: 526287 - DNA, 25 bp, Homo sapien
aatcagtcagactttgtgggctgaa

SEQ ID NO: 526288 - DNA, 25 bp, Homo sapien
ccctgtgagagttctgcagagtgct

SEQ ID NO: 526289 - DNA, 25 bp, Homo sapien
ggcatgtgcctggaactaccgagta

SEQ ID NO: 526290 - DNA, 25 bp, Homo sapien
aactaccgagtaggagccatttctt

SEQ ID NO: 526291 - DNA, 25 bp, Homo sapien
taggagccatttctttgtacccctg

SEQ ID NO: 526292 - DNA, 25 bp, Homo sapien
tccttccaagtccattgttgcaagc

SEQ ID NO: 526293 - DNA, 25 bp, Homo sapien
gttgcaagcaatattcttctcaatt

SEQ ID NO: 526294 - DNA, 25 bp, Homo sapien
ggtgctgacacatcccaaacattaa

SEQ ID NO: 526295 - DNA, 25 bp, Homo sapien
ctgacacatcccaaacattaaatag

SEQ ID NO: 526296 - DNA, 25 bp, Homo sapien
agaccctcaacgttgctagatgatt

SEQ ID NO: 526297 - DNA, 25 bp, Homo sapien
tcttgagatacgaggatgaattttc

SEQ ID NO: 526298 - DNA, 25 bp, Homo sapien
ggatgaattttcaagaggacaattt

SEQ ID NO: 526299 - DNA, 25 bp, Homo sapien
caacgttgctagatgattggctata

SEQ ID NO: 526300 - DNA, 25 bp, Homo sapien
aggacaatttagtctcattttaact

SEQ ID NO: 526301 - DNA, 25 bp, Homo sapien
caatttagtctcattttaacttgga

SEQ ID NO: 526302 - DNA, 25 bp, Homo sapien
gattggctatatggatgatttgact

SEQ ID NO: 526303 - DNA, 25 bp, Homo sapien
atatggatgatttgactgggaggta

SEQ ID NO: 526304 - DNA, 25 bp, Homo sapien
atggagtaataagaaacgctgtgca

SEQ ID NO: 526305 - DNA, 25 bp, Homo sapien
gacagctggtcagaaatgattctct

SEQ ID NO: 526306 - DNA, 25 bp, Homo sapien
gatacaaccattgaaggaacgtcag

SEQ ID NO: 526307 - DNA, 25 bp, Homo sapien
aggaacgtcagatgacctgactgtt

SEQ ID NO: 526308 - DNA, 25 bp, Homo sapien
agatgacctgactgttgtagatgca

SEQ ID NO: 526309 - DNA, 25 bp, Homo sapien
ttgtagatgcagcttcactaagacg

SEQ ID NO: 526310 - DNA, 25 bp, Homo sapien
atagacgtctacaacttctggaaga

SEQ ID NO: 526311 - DNA, 25 bp, Homo sapien
gaggagaacaaagaacgtgctaaaa

SEQ ID NO: 526312 - DNA, 25 bp, Homo sapien
gctttctggctgcttaatagctggc

SEQ ID NO: 526313 - DNA, 25 bp, Homo sapien
gctagaggtaacatcagccctcaaa

SEQ ID NO: 526314 - DNA, 25 bp, Homo sapien
gccctcaaaaatactgtctcaacag

SEQ ID NO: 526315 - DNA, 25 bp, Homo sapien
ctgtctcaacagctggaaatataaa

SEQ ID NO: 526316 - DNA, 25 bp, Homo sapien
gaatccactacagactacatctcag

SEQ ID NO: 526317 - DNA, 25 bp, Homo sapien
ctacagactacatctcagtcttcaa

SEQ ID NO: 526318 - DNA, 25 bp, Homo sapien
accaccatcaattaggctgccttca

SEQ ID NO: 526319 - DNA, 25 bp, Homo sapien
tgccttcagctcaaacacctaatgg

SEQ ID NO: 526320 - DNA, 25 bp, Homo sapien
gctcaaacacctaatggcacagatt

SEQ ID NO: 526321 - DNA, 25 bp, Homo sapien
gcacagattatgtagcctcaggaaa

SEQ ID NO: 526322 - DNA, 25 bp, Homo sapien
gtagcctcaggaaaatccatccaga

SEQ ID NO: 526323 - DNA, 25 bp, Homo sapien
ggaaaatccatccagaccccacagt

SEQ ID NO: 526324 - DNA, 25 bp, Homo sapien
tggcactctgacagctgaattatgg

SEQ ID NO: 526325 - DNA, 25 bp, Homo sapien
ctgacagctgaattatgggataaca

SEQ ID NO: 526326 - DNA, 25 bp, Homo sapien
tgggataacaaggtggccccaccag

SEQ ID NO: 526327 - DNA, 25 bp, Homo sapien
cagaaatgctgtaagtaacacttga

SEQ ID NO: 526328 - DNA, 25 bp, Homo sapien
aacacttgataaggatgtactttct

SEQ ID NO: 526329 - DNA, 25 bp, Homo sapien
gtacataaaagtaacccattccact

SEQ ID NO: 526330 - DNA, 25 bp, Homo sapien
cattccacttaccaggttgggatca

SEQ ID NO: 526331 - DNA, 25 bp, Homo sapien
gttgggatcatagtaggattcctga

SEQ ID NO: 526332 - DNA, 25 bp, Homo sapien
gaatattatttagctgcgtgatatc

SEQ ID NO: 526333 - DNA, 25 bp, Homo sapien
gcgtgatatcagcaggaagcatttt

SEQ ID NO: 526334 - DNA, 25 bp, Homo sapien
gagcaatttattagcatgtgttcca

SEQ ID NO: 526335 - DNA, 25 bp, Homo sapien
attagcatgtgttccagacctgtca

SEQ ID NO: 526336 - DNA, 25 bp, Homo sapien
gtgttccagacctgtcaaatcctaa

SEQ ID NO: 526337 - DNA, 25 bp, Homo sapien
gataaatctgttatgcgcattgtaa

SEQ ID NO: 526338 - DNA, 25 bp, Homo sapien
gtttgtgaagatggctacattgact

SEQ ID NO: 526339 - DNA, 25 bp, Homo sapien
gatggctacattgacttcaggtgga

SEQ ID NO: 526340 - DNA, 25 bp, Homo sapien
aaacaaagacttggagagctgcagt

SEQ ID NO: 526341 - DNA, 25 bp, Homo sapien
agagctgcagtgatgacgacaacca

SEQ ID NO: 526342 - DNA, 25 bp, Homo sapien
agcacacaaggctgcccgtcttggg

SEQ ID NO: 526343 - DNA, 25 bp, Homo sapien
aaggctgcccgtcttgggatcacaa

SEQ ID NO: 526344 - DNA, 25 bp, Homo sapien
gcccgtcttgggatcacaatgaagg

SEQ ID NO: 526345 - DNA, 25 bp, Homo sapien
aggccaagcttgctcgcctagaggc

SEQ ID NO: 526346 - DNA, 25 bp, Homo sapien
ttgctcgcctagaggcccaggagca

SEQ ID NO: 526347 - DNA, 25 bp, Homo sapien
aggccttcctggctcgtctcaaagg

SEQ ID NO: 526348 - DNA, 25 bp, Homo sapien
ggctcgtctcaaaggccaggaccct

SEQ ID NO: 526349 - DNA, 25 bp, Homo sapien
gggaccaggccccagaagtcagttt

SEQ ID NO: 526350 - DNA, 25 bp, Homo sapien
caggccccagaagtcagttttagtt

SEQ ID NO: 526351 - DNA, 25 bp, Homo sapien
ttagtttccaccctgtcccaaggca

SEQ ID NO: 526352 - DNA, 25 bp, Homo sapien
gggacagaaagacccacgcctttat

SEQ ID NO: 526353 - DNA, 25 bp, Homo sapien
agacccacgcctttatacacaaaca

SEQ ID NO: 526354 - DNA, 25 bp, Homo sapien
acaaacatcctggacagatcaaagt

SEQ ID NO: 526355 - DNA, 25 bp, Homo sapien
catcctggacagatcaaagtagagt

SEQ ID NO: 526356 - DNA, 25 bp, Homo sapien
cattagcaaatgtcggtcgttagta

SEQ ID NO: 526357 - DNA, 25 bp, Homo sapien
gtcggtcgttagtagacactgagca

SEQ ID NO: 526358 - DNA, 25 bp, Homo sapien
tcgttagtagacactgagcagagaa

SEQ ID NO: 526359 - DNA, 25 bp, Homo sapien
aagcttgaagaacggggatcctctc

SEQ ID NO: 526360 - DNA, 25 bp, Homo sapien
gactgttgcttgtttggaatgtttc

SEQ ID NO: 526361 - DNA, 25 bp, Homo sapien
tggaatgtttcttgtcactgatttt

SEQ ID NO: 526362 - DNA, 25 bp, Homo sapien
gtcactgattttaaggttgcatctg

SEQ ID NO: 526363 - DNA, 25 bp, Homo sapien
ctgattttaaggttgcatctggaaa

SEQ ID NO: 526364 - DNA, 25 bp, Homo sapien
gcatctggaaaagactaaaggcttc

SEQ ID NO: 526365 - DNA, 25 bp, Homo sapien
aaacccacacataaacaatgcacta

SEQ ID NO: 526366 - DNA, 25 bp, Homo sapien
aatgcactaaagatcactgaactgt

SEQ ID NO: 526367 - DNA, 25 bp, Homo sapien
actgtttaaacatttccacttgcca

SEQ ID NO: 526368 - DNA, 25 bp, Homo sapien
gtttaaacatttccacttgccagtt

SEQ ID NO: 526369 - DNA, 25 bp, Homo sapien
cttgccagtttaatttcttgaagac

SEQ ID NO: 526370 - DNA, 25 bp, Homo sapien
tcttgaagactgttgcttgtttgga

SEQ ID NO: 526371 - DNA, 25 bp, Homo sapien
tgcagcttctaacccaggaccatga

SEQ ID NO: 526372 - DNA, 25 bp, Homo sapien
aggaccatgaactcaggtgcctaga

SEQ ID NO: 526373 - DNA, 25 bp, Homo sapien
ggtgcctagagaagccaggcagcta

SEQ ID NO: 526374 - DNA, 25 bp, Homo sapien
aacaggaatgcagataccctttgaa

SEQ ID NO: 526375 - DNA, 25 bp, Homo sapien
accctttgaaggagcattcctgcta

SEQ ID NO: 526376 - DNA, 25 bp, Homo sapien
gtagacctatgtgaagtgctctgat

SEQ ID NO: 526377 - DNA, 25 bp, Homo sapien
gaagtgctctgatttctaaatattg

SEQ ID NO: 526378 - DNA, 25 bp, Homo sapien
ctagatttagcccacagttgccagt

SEQ ID NO: 526379 - DNA, 25 bp, Homo sapien
agttgccagtttctagcgctaccaa

SEQ ID NO: 526380 - DNA, 25 bp, Homo sapien
gtttctagcgctaccaaatgaatga

SEQ ID NO: 526381 - DNA, 25 bp, Homo sapien
ataaacatgagcttgcgctcctagc

SEQ ID NO: 526382 - DNA, 25 bp, Homo sapien
aataggaaagtgatgtgcttcagag

SEQ ID NO: 526383 - DNA, 25 bp, Homo sapien
gtgcttcagagaagggttcctcctt

SEQ ID NO: 526384 - DNA, 25 bp, Homo sapien
agaagggttcctccttaatgttgag

SEQ ID NO: 526385 - DNA, 25 bp, Homo sapien
atggctttaatcactcagagctaat

SEQ ID NO: 526386 - DNA, 25 bp, Homo sapien
tcactcagagctaatggcacctttc

SEQ ID NO: 526387 - DNA, 25 bp, Homo sapien
gagctaatggcacctttcctattta

SEQ ID NO: 526388 - DNA, 25 bp, Homo sapien
cacctttcctatttagcctcatttt

SEQ ID NO: 526389 - DNA, 25 bp, Homo sapien
atttagcctcattttagaatgcagt

SEQ ID NO: 526390 - DNA, 25 bp, Homo sapien
ccttgtgtgaagagagttgtcctgt

SEQ ID NO: 526391 - DNA, 25 bp, Homo sapien
aagagagttgtcctgtgctccttct

SEQ ID NO: 526392 - DNA, 25 bp, Homo sapien
ttgtcctgtgctccttctactgtac

SEQ ID NO: 526393 - DNA, 25 bp, Homo sapien
tgttcttaaatcaccattccttcct

SEQ ID NO: 526394 - DNA, 25 bp, Homo sapien
tccagggtggtctcacactgtaatt

SEQ ID NO: 526395 - DNA, 25 bp, Homo sapien
ggtctcacactgtaattagagctat

SEQ ID NO: 526396 - DNA, 25 bp, Homo sapien
agctattgaggagtctttacagcaa

SEQ ID NO: 526397 - DNA, 25 bp, Homo sapien
taagattcagatgccttgctaagtc

SEQ ID NO: 526398 - DNA, 25 bp, Homo sapien
gatgccttgctaagtctagagttct

SEQ ID NO: 526399 - DNA, 25 bp, Homo sapien
tagagttctagagttatgtttcaga

SEQ ID NO: 526400 - DNA, 25 bp, Homo sapien
gaaagtctaagaaacccacctcttg

SEQ ID NO: 526401 - DNA, 25 bp, Homo sapien
gaaacccacctcttgagaggtcagt

SEQ ID NO: 526402 - DNA, 25 bp, Homo sapien
catatctacaaaatgaccacaggat

SEQ ID NO: 526403 - DNA, 25 bp, Homo sapien
atcagatttctgcagatctgcttta

SEQ ID NO: 526404 - DNA, 25 bp, Homo sapien
gccatcgttgatggtaaccagtcct

SEQ ID NO: 526405 - DNA, 25 bp, Homo sapien
gtaaccagtcctacaattctcatta

SEQ ID NO: 526406 - DNA, 25 bp, Homo sapien
attaggcagttctgttaccccacta

SEQ ID NO: 526407 - DNA, 25 bp, Homo sapien
tctgttaccccactatttccttggg

SEQ ID NO: 526408 - DNA, 25 bp, Homo sapien
ggtctgttgtgctaaggacaggatt

SEQ ID NO: 526409 - DNA, 25 bp, Homo sapien
ggtgtggcacaaataaccctcagga

SEQ ID NO: 526410 - DNA, 25 bp, Homo sapien
taaccctcaggaatacaggccacag

SEQ ID NO: 526411 - DNA, 25 bp, Homo sapien
cacagagctaatgaagggccccaag

SEQ ID NO: 526412 - DNA, 25 bp, Homo sapien
aagacctgcccatcagcgatgaatt

SEQ ID NO: 526413 - DNA, 25 bp, Homo sapien
gatggaggttgcttctggctcatca

SEQ ID NO: 526414 - DNA, 25 bp, Homo sapien
tggctcatcagccatcgttgatggt

SEQ ID NO: 526415 - DNA, 25 bp, Homo sapien
ttagtttccaccctgtcccaaggca

SEQ ID NO: 526416 - DNA, 25 bp, Homo sapien
gggacagaaagacccacgcctttat

SEQ ID NO: 526417 - DNA, 25 bp, Homo sapien
acagaaagacccacgcctttataca

SEQ ID NO: 526418 - DNA, 25 bp, Homo sapien
agacccacgcctttatacacaaaca

SEQ ID NO: 526419 - DNA, 25 bp, Homo sapien
acaaacatcctggacagatcaaagt

SEQ ID NO: 526420 - DNA, 25 bp, Homo sapien
catcctggacagatcaaagtagagt

SEQ ID NO: 526421 - DNA, 25 bp, Homo sapien
gatcaaagtagagtcatagatttta

SEQ ID NO: 526422 - DNA, 25 bp, Homo sapien
cattagcaaatgtcggtcgttagta

SEQ ID NO: 526423 - DNA, 25 bp, Homo sapien
gtcggtcgttagtagacactgagca

SEQ ID NO: 526424 - DNA, 25 bp, Homo sapien
tcgttagtagacactgagcagagaa

SEQ ID NO: 526425 - DNA, 25 bp, Homo sapien
aagcttgaagaacggggatcctctc

SEQ ID NO: 526426 - DNA, 25 bp, Homo sapien
atggtggtcctggaaaggacatttt

SEQ ID NO: 526427 - DNA, 25 bp, Homo sapien
gaagatcaactatatcttcctgtgc

SEQ ID NO: 526428 - DNA, 25 bp, Homo sapien
atatcttcctgtgcattccgatgga

SEQ ID NO: 526429 - DNA, 25 bp, Homo sapien
ttccgatggaatttcagttcatcag

SEQ ID NO: 526430 - DNA, 25 bp, Homo sapien
gttcatcagatgttcaccatggcca

SEQ ID NO: 526431 - DNA, 25 bp, Homo sapien
atggccaccgcagaacaccgaagta

SEQ ID NO: 526432 - DNA, 25 bp, Homo sapien
acaccgaagtaattccagcatagcg

SEQ ID NO: 526433 - DNA, 25 bp, Homo sapien
agaagtcacagcacctagaaggcag

SEQ ID NO: 526434 - DNA, 25 bp, Homo sapien
tctcctctgattagatgaaactgtt

SEQ ID NO: 526435 - DNA, 25 bp, Homo sapien
tagatgaaactgttaccttacccta

SEQ ID NO: 526436 - DNA, 25 bp, Homo sapien
tgttaccttaccctaaacacagtat

SEQ ID NO: 526437 - DNA, 25 bp, Homo sapien
agtatgacccagtagctaggcacct

SEQ ID NO: 526438 - DNA, 25 bp, Homo sapien
tgaaagaagcccctttatcctgcag

SEQ ID NO: 526439 - DNA, 25 bp, Homo sapien
cctactgacaaagaacatggtgcta

SEQ ID NO: 526440 - DNA, 25 bp, Homo sapien
gaacatggtgctatctggcatggga

SEQ ID NO: 526441 - DNA, 25 bp, Homo sapien
gctatctggcatgggagaaatgttc

SEQ ID NO: 526442 - DNA, 25 bp, Homo sapien
aaatgttcagtttgctatggcttgt

SEQ ID NO: 526443 - DNA, 25 bp, Homo sapien
ctatggcttgtatgtgtcccctcaa

SEQ ID NO: 526444 - DNA, 25 bp, Homo sapien
cctcaaattcaagtgttgccaatgt

SEQ ID NO: 526445 - DNA, 25 bp, Homo sapien
tgccaatgtgacagcatcaagaggt

SEQ ID NO: 526446 - DNA, 25 bp, Homo sapien
gtctttaagagatcactaggccatg

SEQ ID NO: 526447 - DNA, 25 bp, Homo sapien
cactaggccatgagggattctctta

SEQ ID NO: 526448 - DNA, 25 bp, Homo sapien
cccatatattattacttggggggct

SEQ ID NO: 526449 - DNA, 25 bp, Homo sapien
ccatatattattacttggggggcta

SEQ ID NO: 526450 - DNA, 25 bp, Homo sapien
gctggagatgaggaaaggtagcctc

SEQ ID NO: 526451 - DNA, 25 bp, Homo sapien
ctggagatgaggaaaggtagcctcc

SEQ ID NO: 526452 - DNA, 25 bp, Homo sapien
tggagatgaggaaaggtagcctcct

SEQ ID NO: 526453 - DNA, 25 bp, Homo sapien
ggagatgaggaaaggtagcctccta

SEQ ID NO: 526454 - DNA, 25 bp, Homo sapien
gagatgaggaaaggtagcctcctac

SEQ ID NO: 526455 - DNA, 25 bp, Homo sapien
agatgaggaaaggtagcctcctact

SEQ ID NO: 526456 - DNA, 25 bp, Homo sapien
gatgaggaaaggtagcctcctactg

SEQ ID NO: 526457 - DNA, 25 bp, Homo sapien
atgaggaaaggtagcctcctactgt

SEQ ID NO: 526458 - DNA, 25 bp, Homo sapien
gaattattcacccacagacatgaga

SEQ ID NO: 526459 - DNA, 25 bp, Homo sapien
tttacagggctaacaagggatgatg

SEQ ID NO: 526460 - DNA, 25 bp, Homo sapien
tgatgtgtcatttagtatgttacta

SEQ ID NO: 526461 - DNA, 25 bp, Homo sapien
gagggaagcccaaagcagatcttaa

SEQ ID NO: 526462 - DNA, 25 bp, Homo sapien
agcccaaagcagatcttaatgtttc

SEQ ID NO: 526463 - DNA, 25 bp, Homo sapien
ttaatgtttcaaaggagtgcagccc

SEQ ID NO: 526464 - DNA, 25 bp, Homo sapien
ttcaaaggagtgcagcccttcacag

SEQ ID NO: 526465 - DNA, 25 bp, Homo sapien
gcccttcacagccatcagatatgag

SEQ ID NO: 526466 - DNA, 25 bp, Homo sapien
atatgagggcactgttctgtctggt

SEQ ID NO: 526467 - DNA, 25 bp, Homo sapien
ctgtctggtgttgtagccatctcaa

SEQ ID NO: 526468 - DNA, 25 bp, Homo sapien
ggtgttgtagccatctcaagaacaa

SEQ ID NO: 526469 - DNA, 25 bp, Homo sapien
agcattcccgggtggaagttggcgt

SEQ ID NO: 526470 - DNA, 25 bp, Homo sapien
gtggcggcgcgcgtgcttggtcagg

SEQ ID NO: 526471 - DNA, 25 bp, Homo sapien
gtgcttggtcaggtggtcgctgcgc

SEQ ID NO: 526472 - DNA, 25 bp, Homo sapien
gcgcatgaagcgcttctcgcagatg

SEQ ID NO: 526473 - DNA, 25 bp, Homo sapien
tgaacttcttctcgcccgtgtgtgt

SEQ ID NO: 526474 - DNA, 25 bp, Homo sapien
tagtgccgcgccagctcgtcggagc

SEQ ID NO: 526475 - DNA, 25 bp, Homo sapien
gtcggagcgcgcgaacttcttgttg

SEQ ID NO: 526476 - DNA, 25 bp, Homo sapien
gagcgcgcgaacttcttgttgcagt

SEQ ID NO: 526477 - DNA, 25 bp, Homo sapien
gcgcgaacttcttgttgcagtcctg

SEQ ID NO: 526478 - DNA, 25 bp, Homo sapien
cgaacttcttgttgcagtcctgcca

SEQ ID NO: 526479 - DNA, 25 bp, Homo sapien
agtcctgccagctgcaggcgaaggg

SEQ ID NO: 526480 - DNA, 25 bp, Homo sapien
tcacagactcgccaaacattccagg

SEQ ID NO: 526481 - DNA, 25 bp, Homo sapien
gcacttgccagtgcgctgatgaaga

SEQ ID NO: 526482 - DNA, 25 bp, Homo sapien
agaatcacggagaactccacctcat

SEQ ID NO: 526483 - DNA, 25 bp, Homo sapien
tcaaggccatcctcaacttctttca

SEQ ID NO: 526484 - DNA, 25 bp, Homo sapien
gaaaaagagcttcttgctatcccct

SEQ ID NO: 526485 - DNA, 25 bp, Homo sapien
gctatcccctacttcatagttaatg

SEQ ID NO: 526486 - DNA, 25 bp, Homo sapien
gaagccaaactgatcttgcacacat

SEQ ID NO: 526487 - DNA, 25 bp, Homo sapien
actgatcttgcacacattccactgg

SEQ ID NO: 526488 - DNA, 25 bp, Homo sapien
gggtgtgatgttgtaagccatagtt

SEQ ID NO: 526489 - DNA, 25 bp, Homo sapien
atagtttgtgcattttggccctggt

SEQ ID NO: 526490 - DNA, 25 bp, Homo sapien
tggccctggtctggacttttcaaaa

SEQ ID NO: 526491 - DNA, 25 bp, Homo sapien
aaacaagcaagtagtcatgtctgtg

SEQ ID NO: 526492 - DNA, 25 bp, Homo sapien
aacagcaggcacagacaagatttgg

SEQ ID NO: 526493 - DNA, 25 bp, Homo sapien
gatttggcccacaggcatagattcc

SEQ ID NO: 526494 - DNA, 25 bp, Homo sapien
atagattcccaactcatggtggtga

SEQ ID NO: 526495 - DNA, 25 bp, Homo sapien
aaaacacctgtctacaagcttttgt

SEQ ID NO: 526496 - DNA, 25 bp, Homo sapien
tcaggctaaatgttacctatgtttt

SEQ ID NO: 526497 - DNA, 25 bp, Homo sapien
cctatgttttggttggaagatttct

SEQ ID NO: 526498 - DNA, 25 bp, Homo sapien
ttctttggtttgaggaatgctttcc

SEQ ID NO: 526499 - DNA, 25 bp, Homo sapien
ggaatgctttcctcttgcattggca

SEQ ID NO: 526500 - DNA, 25 bp, Homo sapien
tttcctcttgcattggcatgccaag

SEQ ID NO: 526501 - DNA, 25 bp, Homo sapien
gatgactctgaaagacgcctcttca

SEQ ID NO: 526502 - DNA, 25 bp, Homo sapien
aagtttgtctcctgtgccacacaac

SEQ ID NO: 526503 - DNA, 25 bp, Homo sapien
gtctcctgtgccacacaacagagat

SEQ ID NO: 526504 - DNA, 25 bp, Homo sapien
actcctgacttgcaggcgagcacct

SEQ ID NO: 526505 - DNA, 25 bp, Homo sapien
tgacttgcaggcgagcacctaagga

SEQ ID NO: 526506 - DNA, 25 bp, Homo sapien
ttgcaggcgagcacctaaggacact

SEQ ID NO: 526507 - DNA, 25 bp, Homo sapien
acagcactttctatccaagagactg

SEQ ID NO: 526508 - DNA, 25 bp, Homo sapien
gcgagcacctaaggacactgactgt

SEQ ID NO: 526509 - DNA, 25 bp, Homo sapien
gcactttctatccaagagactgcaa

SEQ ID NO: 526510 - DNA, 25 bp, Homo sapien
caggctctggctgccgagtgcacat

SEQ ID NO: 526511 - DNA, 25 bp, Homo sapien
gctctggctgccgagtgcacataaa

SEQ ID NO: 526512 - DNA, 25 bp, Homo sapien
tctatccaagagactgcaagaaatt

SEQ ID NO: 526513 - DNA, 25 bp, Homo sapien
aagtcatctcagctggtattctcat

SEQ ID NO: 526514 - DNA, 25 bp, Homo sapien
gtcatctcagctggtattctcatca

SEQ ID NO: 526515 - DNA, 25 bp, Homo sapien
tcatctcagctggtattctcatcag

SEQ ID NO: 526516 - DNA, 25 bp, Homo sapien
ctcagctggtattctcatcagtatc

SEQ ID NO: 526517 - DNA, 25 bp, Homo sapien
cagctggtattctcatcagtatcag

SEQ ID NO: 526518 - DNA, 25 bp, Homo sapien
gctggtattctcatcagtatcaggg

SEQ ID NO: 526519 - DNA, 25 bp, Homo sapien
gaaatctaaatttccgattctagga

SEQ ID NO: 526520 - DNA, 25 bp, Homo sapien
aaatttccgattctaggatttcctg

SEQ ID NO: 526521 - DNA, 25 bp, Homo sapien
atttccgattctaggatttcctgtt

SEQ ID NO: 526522 - DNA, 25 bp, Homo sapien
ttccgattctaggatttcctgtttt

SEQ ID NO: 526523 - DNA, 25 bp, Homo sapien
gattctaggatttcctgttttgtct

SEQ ID NO: 526524 - DNA, 25 bp, Homo sapien
gaatgattaagtcacttcccaagtg

SEQ ID NO: 526525 - DNA, 25 bp, Homo sapien
acttcccaagtggttgtcatttgtt

SEQ ID NO: 526526 - DNA, 25 bp, Homo sapien
gtcttgctattatgacatttcattt

SEQ ID NO: 526527 - DNA, 25 bp, Homo sapien
gtttgtgttgtagctaactgttcaa

SEQ ID NO: 526528 - DNA, 25 bp, Homo sapien
gctaactgttcaagtctggtgctga

SEQ ID NO: 526529 - DNA, 25 bp, Homo sapien
ggtgctgactgctgttcttagccat

SEQ ID NO: 526530 - DNA, 25 bp, Homo sapien
actgctgttcttagccatcacaaaa

SEQ ID NO: 526531 - DNA, 25 bp, Homo sapien
tagccatcacaaaacgctaaatttg

SEQ ID NO: 526532 - DNA, 25 bp, Homo sapien
atttgtgtaattggagcttcctgct

SEQ ID NO: 526533 - DNA, 25 bp, Homo sapien
gctgttatctggaaatagcaggaaa

SEQ ID NO: 526534 - DNA, 25 bp, Homo sapien
agcgcagctttgtatattgtttcct

SEQ ID NO: 526535 - DNA, 25 bp, Homo sapien
aaatcattgtcattgggcctcagta

SEQ ID NO: 526536 - DNA, 25 bp, Homo sapien
atcattgtcattgggcctcagtagt

SEQ ID NO: 526537 - DNA, 25 bp, Homo sapien
gtcattgggcctcagtagtaaatct

SEQ ID NO: 526538 - DNA, 25 bp, Homo sapien
gaagtcttgcttcagtcgctattaa

SEQ ID NO: 526539 - DNA, 25 bp, Homo sapien
gtcttgcttcagtcgctattaatat

SEQ ID NO: 526540 - DNA, 25 bp, Homo sapien
gcttcagtcgctattaatattacca

SEQ ID NO: 526541 - DNA, 25 bp, Homo sapien
cagtcgctattaatattaccaagta

SEQ ID NO: 526542 - DNA, 25 bp, Homo sapien
aatttgtcatactttattatggttt

SEQ ID NO: 526543 - DNA, 25 bp, Homo sapien
gtaattatgtgtgatttgtaggtat

SEQ ID NO: 526544 - DNA, 25 bp, Homo sapien
gtaggtattaaagaacttagctaat

SEQ ID NO: 526545 - DNA, 25 bp, Homo sapien
gctaattgaatttacatggaactaa

SEQ ID NO: 526546 - DNA, 25 bp, Homo sapien
ccagctttaaaggtgagattgtaga

SEQ ID NO: 526547 - DNA, 25 bp, Homo sapien
tgtagagatgctgtcaaagggataa

SEQ ID NO: 526548 - DNA, 25 bp, Homo sapien
agcaagatttttaagtagtgtgttt

SEQ ID NO: 526549 - DNA, 25 bp, Homo sapien
gtgtgtttgtgaagactgatcccat

SEQ ID NO: 526550 - DNA, 25 bp, Homo sapien
gaagactgatcccattttacaactg

SEQ ID NO: 526551 - DNA, 25 bp, Homo sapien
tgatcccattttacaactgcctgtt

SEQ ID NO: 526552 - DNA, 25 bp, Homo sapien
tttacaactgcctgttctttctcca

SEQ ID NO: 526553 - DNA, 25 bp, Homo sapien
tgcctgttctttctccagtcctttt

SEQ ID NO: 526554 - DNA, 25 bp, Homo sapien
ttttccagccagcttgactattaga

SEQ ID NO: 526555 - DNA, 25 bp, Homo sapien
gtgagatataaaattgtgcagctat

SEQ ID NO: 526556 - DNA, 25 bp, Homo sapien
aatgtgttatttccagctttaaagg

SEQ ID NO: 526557 - DNA, 25 bp, Homo sapien
gcttggaaattaggtccatttaaag

SEQ ID NO: 526558 - DNA, 25 bp, Homo sapien
gaaattaggtccatttaaagtatgt

SEQ ID NO: 526559 - DNA, 25 bp, Homo sapien
tgtgcgcctattgtcccatctactt

SEQ ID NO: 526560 - DNA, 25 bp, Homo sapien
tgcgcctattgtcccatctacttga

SEQ ID NO: 526561 - DNA, 25 bp, Homo sapien
gcgcctattgtcccatctacttgag

SEQ ID NO: 526562 - DNA, 25 bp, Homo sapien
ctgatttctcaaattttatttaggt

SEQ ID NO: 526563 - DNA, 25 bp, Homo sapien
aattttatttaggtctttcatagct

SEQ ID NO: 526564 - DNA, 25 bp, Homo sapien
attttatttaggtctttcatagctt

SEQ ID NO: 526565 - DNA, 25 bp, Homo sapien
tttatttaggtctttcatagctttt

SEQ ID NO: 526566 - DNA, 25 bp, Homo sapien
tatttaggtctttcatagctttttt

SEQ ID NO: 526567 - DNA, 25 bp, Homo sapien
tttaggtctttcatagcttttttat

SEQ ID NO: 526568 - DNA, 25 bp, Homo sapien
ctttgtcattggtgctgaggagagc

SEQ ID NO: 526569 - DNA, 25 bp, Homo sapien
atttcggtagaagacagttgcgcct

SEQ ID NO: 526570 - DNA, 25 bp, Homo sapien
cagttgcgcctgaagattgagtgta

SEQ ID NO: 526571 - DNA, 25 bp, Homo sapien
gtgtaaatcattcaaaccagtggtt

SEQ ID NO: 526572 - DNA, 25 bp, Homo sapien
accagtggttctcagtgttggctgt

SEQ ID NO: 526573 - DNA, 25 bp, Homo sapien
acacatcgatgcttgggttccgtat

SEQ ID NO: 526574 - DNA, 25 bp, Homo sapien
ggttccgtatgccaagattctgatg

SEQ ID NO: 526575 - DNA, 25 bp, Homo sapien
gttggtctggaatatgagctggtca

SEQ ID NO: 526576 - DNA, 25 bp, Homo sapien
aaactttctggtcatttcaatatgc

SEQ ID NO: 526577 - DNA, 25 bp, Homo sapien
tcaatatgctgccaaggttgagaac

SEQ ID NO: 526578 - DNA, 25 bp, Homo sapien
accactgttgtaaaattcaccttga

SEQ ID NO: 526579 - DNA, 25 bp, Homo sapien
ttccttgttgtcttctagaaattat

SEQ ID NO: 526580 - DNA, 25 bp, Homo sapien
gggaactataatccatttggacttt

SEQ ID NO: 526581 - DNA, 25 bp, Homo sapien
tggactttaatctttgccagtgtta

SEQ ID NO: 526582 - DNA, 25 bp, Homo sapien
gcatctgatgcccaattattccagc

SEQ ID NO: 526583 - DNA, 25 bp, Homo sapien
attccagcatcattttttcaagacc

SEQ ID NO: 526584 - DNA, 25 bp, Homo sapien
ttttttcaagacctttgcacctctg

SEQ ID NO: 526585 - DNA, 25 bp, Homo sapien
tgcacctctgtcaaaaaccagttgt

SEQ ID NO: 526586 - DNA, 25 bp, Homo sapien
cagttgtccacatacatgttgggtt

SEQ ID NO: 526587 - DNA, 25 bp, Homo sapien
gttgggttatttctggactctattc

SEQ ID NO: 526588 - DNA, 25 bp, Homo sapien
attagaccaatgcacagccagcaga

SEQ ID NO: 526589 - DNA, 25 bp, Homo sapien
gggactgatcccaaaaacatatgag

SEQ ID NO: 526590 - DNA, 25 bp, Homo sapien
ccatatattattacttggggggcta

SEQ ID NO: 526591 - DNA, 25 bp, Homo sapien
catatattattacttggggggctaa

SEQ ID NO: 526592 - DNA, 25 bp, Homo sapien
tattattacttggggggctaaggtg

SEQ ID NO: 526593 - DNA, 25 bp, Homo sapien
gggcaactgagtaagaccttgcctc

SEQ ID NO: 526594 - DNA, 25 bp, Homo sapien
ctggagatgaggaaaggtagcctcc

SEQ ID NO: 526595 - DNA, 25 bp, Homo sapien
tggagatgaggaaaggtagcctcct

SEQ ID NO: 526596 - DNA, 25 bp, Homo sapien
ggagatgaggaaaggtagcctccta

SEQ ID NO: 526597 - DNA, 25 bp, Homo sapien
gagatgaggaaaggtagcctcctac

SEQ ID NO: 526598 - DNA, 25 bp, Homo sapien
agatgaggaaaggtagcctcctact

SEQ ID NO: 526599 - DNA, 25 bp, Homo sapien
gatgaggaaaggtagcctcctactg

SEQ ID NO: 526600 - DNA, 25 bp, Homo sapien
atgaggaaaggtagcctcctactgt

SEQ ID NO: 526601 - DNA, 25 bp, Homo sapien
agggatcactcccatcaaaagactg

SEQ ID NO: 526602 - DNA, 25 bp, Homo sapien
agttggaagctaagagcacatgcgc

SEQ ID NO: 526603 - DNA, 25 bp, Homo sapien
gagcacatgcgcatagccagctcct

SEQ ID NO: 526604 - DNA, 25 bp, Homo sapien
ccaggctggcagtcatgattacgag

SEQ ID NO: 526605 - DNA, 25 bp, Homo sapien
attacgagcatcattccagaatctt

SEQ ID NO: 526606 - DNA, 25 bp, Homo sapien
cattccagaatctttggcttctaga

SEQ ID NO: 526607 - DNA, 25 bp, Homo sapien
tggcttctagaaccaactccattct

SEQ ID NO: 526608 - DNA, 25 bp, Homo sapien
gaaccaactccattctgaagaacat

SEQ ID NO: 526609 - DNA, 25 bp, Homo sapien
gaataccttggtaataatcttttat

SEQ ID NO: 526610 - DNA, 25 bp, Homo sapien
acacaggagttttgtagcatgactt

SEQ ID NO: 526611 - DNA, 25 bp, Homo sapien
gtagcatgactttatgactaaactt

SEQ ID NO: 526612 - DNA, 25 bp, Homo sapien
ttgtttttgaacattcaatccgttc

SEQ ID NO: 526613 - DNA, 25 bp, Homo sapien
aacattcaatccgttcattttgtat

SEQ ID NO: 526614 - DNA, 25 bp, Homo sapien
attcaatccgttcattttgtatgta

SEQ ID NO: 526615 - DNA, 25 bp, Homo sapien
tatgtatgcttaatacgtgtcggtc

SEQ ID NO: 526616 - DNA, 25 bp, Homo sapien
gtatgcttaatacgtgtcggtcata

SEQ ID NO: 526617 - DNA, 25 bp, Homo sapien
tgcttaatacgtgtcggtcatatac

SEQ ID NO: 526618 - DNA, 25 bp, Homo sapien
taatacgtgtcggtcatatacagta

SEQ ID NO: 526619 - DNA, 25 bp, Homo sapien
acgtgtcggtcatatacagtattga

SEQ ID NO: 526620 - DNA, 25 bp, Homo sapien
gtcggtcatatacagtattgaattt

SEQ ID NO: 526621 - DNA, 25 bp, Homo sapien
tatttgcctgataaagtaattgaaa

SEQ ID NO: 526622 - DNA, 25 bp, Homo sapien
tggttttctgtcacaattgtaattt

SEQ ID NO: 526623 - DNA, 25 bp, Homo sapien
ccccgaccatcattgtctcatgaaa

SEQ ID NO: 526624 - DNA, 25 bp, Homo sapien
tataagtatacagcatctgtcctca

SEQ ID NO: 526625 - DNA, 25 bp, Homo sapien
tctgtcctcatagcagaatctggtc

SEQ ID NO: 526626 - DNA, 25 bp, Homo sapien
gaatctggtcaacctgtagttccgt

SEQ ID NO: 526627 - DNA, 25 bp, Homo sapien
agttccgttggacagacagtttctc

SEQ ID NO: 526628 - DNA, 25 bp, Homo sapien
acagtttctcatccatgaactaaat

SEQ ID NO: 526629 - DNA, 25 bp, Homo sapien
atacaatacctcttttatatgggat

SEQ ID NO: 526630 - DNA, 25 bp, Homo sapien
attttagcccatttcttgcgtggaa

SEQ ID NO: 526631 - DNA, 25 bp, Homo sapien
ttgcgtggaactaaggatggcatcc

SEQ ID NO: 526632 - DNA, 25 bp, Homo sapien
aggatggcatccagaatgcatttct

SEQ ID NO: 526633 - DNA, 25 bp, Homo sapien
atgcatttctgaaagggccttcact

SEQ ID NO: 526634 - DNA, 25 bp, Homo sapien
gagggtcattatttggagtatctgg

SEQ ID NO: 526635 - DNA, 25 bp, Homo sapien
gagtatctggagtccttgggcaatc

SEQ ID NO: 526636 - DNA, 25 bp, Homo sapien
ttgggcaatctgtaatatcttctgg

SEQ ID NO: 526637 - DNA, 25 bp, Homo sapien
acatctgtatcatattctctgcacc

SEQ ID NO: 526638 - DNA, 25 bp, Homo sapien
gcagcttgtgatgtagttcttctaa

SEQ ID NO: 526639 - DNA, 25 bp, Homo sapien
gttgtctacataagccaaacttttt

SEQ ID NO: 526640 - DNA, 25 bp, Homo sapien
tttttatctgttgtgactttcctca

SEQ ID NO: 526641 - DNA, 25 bp, Homo sapien
catattctctgcaccttgttttact

SEQ ID NO: 526642 - DNA, 25 bp, Homo sapien
gtgactttcctcagattttcagctc

SEQ ID NO: 526643 - DNA, 25 bp, Homo sapien
ggccttcaatctattgttgctagta

SEQ ID NO: 526644 - DNA, 25 bp, Homo sapien
tgctagtagaacaacgagggtcatt

SEQ ID NO: 526645 - DNA, 25 bp, Homo sapien
gatagagaatatttagccatttacc

SEQ ID NO: 526646 - DNA, 25 bp, Homo sapien
aatggtattttttacatgcaatgca

SEQ ID NO: 526647 - DNA, 25 bp, Homo sapien
gcaatgcatgtggtgaatcagtgaa

SEQ ID NO: 526648 - DNA, 25 bp, Homo sapien
aaagcatgtgtctgtttgcagaaac

SEQ ID NO: 526649 - DNA, 25 bp, Homo sapien
gaaactgtgaatgcctttcttgcat

SEQ ID NO: 526650 - DNA, 25 bp, Homo sapien
gcctttcttgcattgactgcggtaa

SEQ ID NO: 526651 - DNA, 25 bp, Homo sapien
attgactgcggtaaagatttctggg

SEQ ID NO: 526652 - DNA, 25 bp, Homo sapien
ggcgatgactataaaaaccacgtga

SEQ ID NO: 526653 - DNA, 25 bp, Homo sapien
ggtaaaacccacaaaggcgacatca

SEQ ID NO: 526654 - DNA, 25 bp, Homo sapien
aaaggcgacatcaaacagcaggcgt

SEQ ID NO: 526655 - DNA, 25 bp, Homo sapien
aacagcaggcgtggattcagaaaat

SEQ ID NO: 526656 - DNA, 25 bp, Homo sapien
aatccaaaactttagctgtatttca

SEQ ID NO: 526657 - DNA, 25 bp, Homo sapien
tccaaaactttagctgtatttcagt

SEQ ID NO: 526658 - DNA, 25 bp, Homo sapien
aacaaaaacataccttactagactg

SEQ ID NO: 526659 - DNA, 25 bp, Homo sapien
caaaaacataccttactagactgtg

SEQ ID NO: 526660 - DNA, 25 bp, Homo sapien
cttactagactgtgatggctcacac

SEQ ID NO: 526661 - DNA, 25 bp, Homo sapien
agtgaattctgatcgcaccactgaa

SEQ ID NO: 526662 - DNA, 25 bp, Homo sapien
gaactccagcccgtatgacagagtg

SEQ ID NO: 526663 - DNA, 25 bp, Homo sapien
caaacaacgtatcttactgactaaa

SEQ ID NO: 526664 - DNA, 25 bp, Homo sapien
aacgtatcttactgactaaactgga

SEQ ID NO: 526665 - DNA, 25 bp, Homo sapien
acgtatcttactgactaaactggaa

SEQ ID NO: 526666 - DNA, 25 bp, Homo sapien
attagtgttgtatttttctgcaaaa

SEQ ID NO: 526667 - DNA, 25 bp, Homo sapien
aagcgagggtctagtcccctcattc

SEQ ID NO: 526668 - DNA, 25 bp, Homo sapien
ggaacattggataccaccagccagc

SEQ ID NO: 526669 - DNA, 25 bp, Homo sapien
ataccaccagccagctttgccaaat

SEQ ID NO: 526670 - DNA, 25 bp, Homo sapien
gaaatcataggtacagtccaagcac

SEQ ID NO: 526671 - DNA, 25 bp, Homo sapien
agtcccctcattcttggagtgtgga

SEQ ID NO: 526672 - DNA, 25 bp, Homo sapien
ctgcctttccttgagctactaataa

SEQ ID NO: 526673 - DNA, 25 bp, Homo sapien
ctttccttgagctactaataatctg

SEQ ID NO: 526674 - DNA, 25 bp, Homo sapien
cctcattcttggagtgtggagacag

SEQ ID NO: 526675 - DNA, 25 bp, Homo sapien
aaccagtcctcttacaatgattgtg

SEQ ID NO: 526676 - DNA, 25 bp, Homo sapien
acaatgattgtgacctatttaaagc

SEQ ID NO: 526677 - DNA, 25 bp, Homo sapien
gacctatttaaagcattcagagaag

SEQ ID NO: 526678 - DNA, 25 bp, Homo sapien
gcatcctctttagggtgtcaattct

SEQ ID NO: 526679 - DNA, 25 bp, Homo sapien
tttagggtgtcaattctgtgctgct

SEQ ID NO: 526680 - DNA, 25 bp, Homo sapien
ttgttgaaacttttgattttctgtt

SEQ ID NO: 526681 - DNA, 25 bp, Homo sapien
cacttcttacagattagccaagaat

SEQ ID NO: 526682 - DNA, 25 bp, Homo sapien
ttttgggaggccctgctggtaaaat

SEQ ID NO: 526683 - DNA, 25 bp, Homo sapien
gggaggccctgctggtaaaattata

SEQ ID NO: 526684 - DNA, 25 bp, Homo sapien
ggccctgctggtaaaattatatatg

SEQ ID NO: 526685 - DNA, 25 bp, Homo sapien
gtattgcaagagtccattttccatt

SEQ ID NO: 526686 - DNA, 25 bp, Homo sapien
tccatttttaaatctgcaatatctg

SEQ ID NO: 526687 - DNA, 25 bp, Homo sapien
aatctgcaatatctgattacattga

SEQ ID NO: 526688 - DNA, 25 bp, Homo sapien
gatgaattccgttgtattgtatgtg

SEQ ID NO: 526689 - DNA, 25 bp, Homo sapien
gaggcggaaaacatccaaatgggat

SEQ ID NO: 526690 - DNA, 25 bp, Homo sapien
gattagtagtgctggttagtgcaga

SEQ ID NO: 526691 - DNA, 25 bp, Homo sapien
gttagtgcagatggacctttattaa

SEQ ID NO: 526692 - DNA, 25 bp, Homo sapien
tgtgagtgtacagtatcatgtttct

SEQ ID NO: 526693 - DNA, 25 bp, Homo sapien
gaagatagcagttgcaaccagacaa

SEQ ID NO: 526694 - DNA, 25 bp, Homo sapien
gttgcaaccagacaactgtcgtaaa

SEQ ID NO: 526695 - DNA, 25 bp, Homo sapien
tgtcctttcacagctgcagccatta

SEQ ID NO: 526696 - DNA, 25 bp, Homo sapien
acagctgcagccattatctcattct

SEQ ID NO: 526697 - DNA, 25 bp, Homo sapien
attatctcattctttttccacagag

SEQ ID NO: 526698 - DNA, 25 bp, Homo sapien
ttccacagagtgagcgtcataatat

SEQ ID NO: 526699 - DNA, 25 bp, Homo sapien
ccttacctcttataaaagtgccatg

SEQ ID NO: 526700 - DNA, 25 bp, Homo sapien
gactacaaccaacagcagccgaggg

SEQ ID NO: 526701 - DNA, 25 bp, Homo sapien
cagccgagggacgaacagcacctta

SEQ ID NO: 526702 - DNA, 25 bp, Homo sapien
ggacgaacagcaccttagccaagat

SEQ ID NO: 526703 - DNA, 25 bp, Homo sapien
agcaccttagccaagatcacaacct

SEQ ID NO: 526704 - DNA, 25 bp, Homo sapien
acaacctcagcgaagaccacgatga

SEQ ID NO: 526705 - DNA, 25 bp, Homo sapien
acgaggccgaccacagacgtgagtg

SEQ ID NO: 526706 - DNA, 25 bp, Homo sapien
gaccacagacgtgagtgcaggtgaa

SEQ ID NO: 526707 - DNA, 25 bp, Homo sapien
tgatgcagcagctccaccgggaact

SEQ ID NO: 526708 - DNA, 25 bp, Homo sapien
acttccaggtctccttactgcgtgt

SEQ ID NO: 526709 - DNA, 25 bp, Homo sapien
caggtctccttactgcgtgtcagga

SEQ ID NO: 526710 - DNA, 25 bp, Homo sapien
ccttactgcgtgtcaggagaggcta

SEQ ID NO: 526711 - DNA, 25 bp, Homo sapien
ctggacaagggcatgcagcgcaggg

SEQ ID NO: 526712 - DNA, 25 bp, Homo sapien
aatattttctctcccgtaaactctg

SEQ ID NO: 526713 - DNA, 25 bp, Homo sapien
ttttctctcccgtaaactctgactt

SEQ ID NO: 526714 - DNA, 25 bp, Homo sapien
ctcccgtaaactctgacttcatgtg

SEQ ID NO: 526715 - DNA, 25 bp, Homo sapien
aactctgacttcatgtgagcaggca

SEQ ID NO: 526716 - DNA, 25 bp, Homo sapien
ctgacttcatgtgagcaggcatggg

SEQ ID NO: 526717 - DNA, 25 bp, Homo sapien
ggtctccctgagagctgataaccgg

SEQ ID NO: 526718 - DNA, 25 bp, Homo sapien
ctgagagctgataaccgggaaaacc

SEQ ID NO: 526719 - DNA, 25 bp, Homo sapien
ttcactgaccgctgttgctctgctt

SEQ ID NO: 526720 - DNA, 25 bp, Homo sapien
cttttgtctttatatacagtagttt

SEQ ID NO: 526721 - DNA, 25 bp, Homo sapien
aataaaggagtgtcatgtcaactgt

SEQ ID NO: 526722 - DNA, 25 bp, Homo sapien
gggaagagactccatttagcttaac

SEQ ID NO: 526723 - DNA, 25 bp, Homo sapien
aattagtatgcaccttatctgcctg

SEQ ID NO: 526724 - DNA, 25 bp, Homo sapien
tgtgggtttcttaaacttgcacttc

SEQ ID NO: 526725 - DNA, 25 bp, Homo sapien
tgggtttcttaaacttgcacttcct

SEQ ID NO: 526726 - DNA, 25 bp, Homo sapien
ttcttaaacttgcacttcctaccca

SEQ ID NO: 526727 - DNA, 25 bp, Homo sapien
gggagccatttactatgtcaccatc

SEQ ID NO: 526728 - DNA, 25 bp, Homo sapien
gccatttactatgtcaccatcactg

SEQ ID NO: 526729 - DNA, 25 bp, Homo sapien
gtcaccatcactgttaactgtttcc

SEQ ID NO: 526730 - DNA, 25 bp, Homo sapien
ttaactgtttcccagcaatctaaac

SEQ ID NO: 526731 - DNA, 25 bp, Homo sapien
gtttcccagcaatctaaactttttg

SEQ ID NO: 526732 - DNA, 25 bp, Homo sapien
cccagcaatctaaactttttgaagt

SEQ ID NO: 526733 - DNA, 25 bp, Homo sapien
aatagaatgtgaagaggctgtgctg

SEQ ID NO: 526734 - DNA, 25 bp, Homo sapien
ctgtgctggccctcatagtgttaag

SEQ ID NO: 526735 - DNA, 25 bp, Homo sapien
gctggccctcatagtgttaagcaca

SEQ ID NO: 526736 - DNA, 25 bp, Homo sapien
ggccctcatagtgttaagcacaaaa

SEQ ID NO: 526737 - DNA, 25 bp, Homo sapien
agctgttttagctaaatgccaccta

SEQ ID NO: 526738 - DNA, 25 bp, Homo sapien
tagctaaatgccacctagagttatt

SEQ ID NO: 526739 - DNA, 25 bp, Homo sapien
tgccacctagagttattggaggtct

SEQ ID NO: 526740 - DNA, 25 bp, Homo sapien
aactatgtccaggagcagctgtaac

SEQ ID NO: 526741 - DNA, 25 bp, Homo sapien
gagcagctgtaacctgtagggaaat

SEQ ID NO: 526742 - DNA, 25 bp, Homo sapien
tggaacaatcatccataagagggat

SEQ ID NO: 526743 - DNA, 25 bp, Homo sapien
gttactgtaaacacaagatcaagat

SEQ ID NO: 526744 - DNA, 25 bp, Homo sapien
tcaactgggctctcttgttaatagg

SEQ ID NO: 526745 - DNA, 25 bp, Homo sapien
ggctctcttgttaataggacatcat

SEQ ID NO: 526746 - DNA, 25 bp, Homo sapien
gactatattgttagctgccacagta

SEQ ID NO: 526747 - DNA, 25 bp, Homo sapien
gtataggtaaatgcctgcacccata

SEQ ID NO: 526748 - DNA, 25 bp, Homo sapien
gcctgcacccataattttctagtaa

SEQ ID NO: 526749 - DNA, 25 bp, Homo sapien
tctagtaatagccacgaccaattta

SEQ ID NO: 526750 - DNA, 25 bp, Homo sapien
tttattaacagtcagggcctatcct

SEQ ID NO: 526751 - DNA, 25 bp, Homo sapien
agggcctatccttgcctgtagttct

SEQ ID NO: 526752 - DNA, 25 bp, Homo sapien
aaatcactgtgtaacattggctcac

SEQ ID NO: 526753 - DNA, 25 bp, Homo sapien
gtgtaacattggctcacttggtgag

SEQ ID NO: 526754 - DNA, 25 bp, Homo sapien
acttggtgagcatagggttgactga

SEQ ID NO: 526755 - DNA, 25 bp, Homo sapien
cagactgagatcttgtatgccaaac

SEQ ID NO: 526756 - DNA, 25 bp, Homo sapien
gtatgccaaactttaatctgctttt

SEQ ID NO: 526757 - DNA, 25 bp, Homo sapien
tatgttttcaggctgaaggtgtgaa

SEQ ID NO: 526758 - DNA, 25 bp, Homo sapien
atcctaagaggatttcatattgaat

SEQ ID NO: 526759 - DNA, 25 bp, Homo sapien
tatgtgtacacaatcttaactatcg

SEQ ID NO: 526760 - DNA, 25 bp, Homo sapien
tacacaatcttaactatcgtggtgg

SEQ ID NO: 526761 - DNA, 25 bp, Homo sapien
atcgtggtggaaaacatactactat

SEQ ID NO: 526762 - DNA, 25 bp, Homo sapien
tatcttccagataatgttattcatt

SEQ ID NO: 526763 - DNA, 25 bp, Homo sapien
gaatcaactttgtaagcactataaa

SEQ ID NO: 526764 - DNA, 25 bp, Homo sapien
aagttataaggtctatgatgtgttt

SEQ ID NO: 526765 - DNA, 25 bp, Homo sapien
tgctgttaaaagcaacacgtattaa

SEQ ID NO: 526766 - DNA, 25 bp, Homo sapien
ggagtttgacattctgctttcagat

SEQ ID NO: 526767 - DNA, 25 bp, Homo sapien
ttctgctttcagatgctgtcttttt

SEQ ID NO: 526768 - DNA, 25 bp, Homo sapien
gatgctgtctttttattagtgagtg

SEQ ID NO: 526769 - DNA, 25 bp, Homo sapien
ttgtaatcccatcaagtggctccat

SEQ ID NO: 526770 - DNA, 25 bp, Homo sapien
atcaagtggctccatatgtttctgc

SEQ ID NO: 526771 - DNA, 25 bp, Homo sapien
atatgtttctgctctctcgtgactg

SEQ ID NO: 526772 - DNA, 25 bp, Homo sapien
tctcgtgactgtgttaatgtttaac

SEQ ID NO: 526773 - DNA, 25 bp, Homo sapien
gttgtaccttaaagccgaaatcagt

SEQ ID NO: 526774 - DNA, 25 bp, Homo sapien
gtaactatgcatactgtaaccaagg

SEQ ID NO: 526775 - DNA, 25 bp, Homo sapien
gtaaccaaggtattgggcttacaga

SEQ ID NO: 526776 - DNA, 25 bp, Homo sapien
attgggcttacagagttgtttgttg

SEQ ID NO: 526777 - DNA, 25 bp, Homo sapien
ggagtgtgctggatgtctctataat

SEQ ID NO: 526778 - DNA, 25 bp, Homo sapien
gctggatgtctctataattttattc

SEQ ID NO: 526779 - DNA, 25 bp, Homo sapien
aattttattcagatgactgcagaac

SEQ ID NO: 526780 - DNA, 25 bp, Homo sapien
aaaagctgttgctgctattgatgca

SEQ ID NO: 526781 - DNA, 25 bp, Homo sapien
ctctgtgaatgtaaaatatcttgta

SEQ ID NO: 526782 - DNA, 25 bp, Homo sapien
agtgaccgtgctttatcagagctgt

SEQ ID NO: 526783 - DNA, 25 bp, Homo sapien
ccgtgctttatcagagctgttttta

SEQ ID NO: 526784 - DNA, 25 bp, Homo sapien
atgatgattcagaagctaattttaa

SEQ ID NO: 526785 - DNA, 25 bp, Homo sapien
aaaacggtgccaggtaccacaacag

SEQ ID NO: 526786 - DNA, 25 bp, Homo sapien
acggtgccaggtaccacaacagtaa

SEQ ID NO: 526787 - DNA, 25 bp, Homo sapien
gccaggtaccacaacagtaacagaa

SEQ ID NO: 526788 - DNA, 25 bp, Homo sapien
ttttgtgtgtgcgacctctgactag

SEQ ID NO: 526789 - DNA, 25 bp, Homo sapien
acctctgactaggtccctgtgggaa

SEQ ID NO: 526790 - DNA, 25 bp, Homo sapien
gatggcggccatcaccactgggtcc

SEQ ID NO: 526791 - DNA, 25 bp, Homo sapien
gcagaagcttagataccggccttga

SEQ ID NO: 526792 - DNA, 25 bp, Homo sapien
accttggtggcaacggtgtgactga

SEQ ID NO: 526793 - DNA, 25 bp, Homo sapien
gtggcaacggtgtgactgacagcac

SEQ ID NO: 526794 - DNA, 25 bp, Homo sapien
caacggtgtgactgacagcaccacc

SEQ ID NO: 526795 - DNA, 25 bp, Homo sapien
gggtcgagagccagtatccggccca

SEQ ID NO: 526796 - DNA, 25 bp, Homo sapien
gagagccagtatccggcccagacaa

SEQ ID NO: 526797 - DNA, 25 bp, Homo sapien
aatgccacccgccatggaagaaaag

SEQ ID NO: 526798 - DNA, 25 bp, Homo sapien
tggaagaaaagctgaccctgcccac

SEQ ID NO: 526799 - DNA, 25 bp, Homo sapien
gggttcaagaatttcatgacattcc

SEQ ID NO: 526800 - DNA, 25 bp, Homo sapien
atgacattccatgagaaggtgttta

SEQ ID NO: 526801 - DNA, 25 bp, Homo sapien
aaggtatatgtgtcttgggaagatt

SEQ ID NO: 526802 - DNA, 25 bp, Homo sapien
atttaattatggatgttcttggaac

SEQ ID NO: 526803 - DNA, 25 bp, Homo sapien
gaacatttgggttgcagtactccaa

SEQ ID NO: 526804 - DNA, 25 bp, Homo sapien
ggttctttcagtggttcctgtggga

SEQ ID NO: 526805 - DNA, 25 bp, Homo sapien
gttcctgtgggaatgtaggtaaatt

SEQ ID NO: 526806 - DNA, 25 bp, Homo sapien
gggtacaggaacagtactagccctt

SEQ ID NO: 526807 - DNA, 25 bp, Homo sapien
ggaacagtactagcccttacattta

SEQ ID NO: 526808 - DNA, 25 bp, Homo sapien
gtactagcccttacatttactagaa

SEQ ID NO: 526809 - DNA, 25 bp, Homo sapien
gttagacatctaaacaaacttgaag

SEQ ID NO: 526810 - DNA, 25 bp, Homo sapien
atccatgtagatatagcattaacca

SEQ ID NO: 526811 - DNA, 25 bp, Homo sapien
gatatagcattaaccacacacagtt

SEQ ID NO: 526812 - DNA, 25 bp, Homo sapien
ctgacctcatttaatatacatcaaa

SEQ ID NO: 526813 - DNA, 25 bp, Homo sapien
aatatacatcaaacaccgatcctgt

SEQ ID NO: 526814 - DNA, 25 bp, Homo sapien
aacaccgatcctgtttgtacaaagt

SEQ ID NO: 526815 - DNA, 25 bp, Homo sapien
gatcctgtttgtacaaagtcttgct

SEQ ID NO: 526816 - DNA, 25 bp, Homo sapien
ctgtttgtacaaagtcttgctttta

SEQ ID NO: 526817 - DNA, 25 bp, Homo sapien
agtcttgcttttataaggtttcaat

SEQ ID NO: 526818 - DNA, 25 bp, Homo sapien
aaagctgagaccattttatgaagat

SEQ ID NO: 526819 - DNA, 25 bp, Homo sapien
tgttgaaagtaaaaaggtgccatct

SEQ ID NO: 526820 - DNA, 25 bp, Homo sapien
aaggtgccatcttgtggtattgact

SEQ ID NO: 526821 - DNA, 25 bp, Homo sapien
ctggcactgcgcttcttcaaagaaa

SEQ ID NO: 526822 - DNA, 25 bp, Homo sapien
ggcaaagcatttcatccaacttatg

SEQ ID NO: 526823 - DNA, 25 bp, Homo sapien
gaagcttgtggcactgcataagcaa

SEQ ID NO: 526824 - DNA, 25 bp, Homo sapien
taagcaagttcttatgggcccatat

SEQ ID NO: 526825 - DNA, 25 bp, Homo sapien
gggcccatataatccagacacttgt

SEQ ID NO: 526826 - DNA, 25 bp, Homo sapien
gacacttgtcctgaggttggattct

SEQ ID NO: 526827 - DNA, 25 bp, Homo sapien
ggcagccctgggaaacatgtctaaa

SEQ ID NO: 526828 - DNA, 25 bp, Homo sapien
atggtggagtttgtcaagctcttaa

SEQ ID NO: 526829 - DNA, 25 bp, Homo sapien
aagctcttaaataggtgttgccatc

SEQ ID NO: 526830 - DNA, 25 bp, Homo sapien
ggtgttgccatctcttttcaacata

SEQ ID NO: 526831 - DNA, 25 bp, Homo sapien
tcaacatatgttgcgtcccacaaaa

SEQ ID NO: 526832 - DNA, 25 bp, Homo sapien
aagaaatgatgctgagggacctagt

SEQ ID NO: 526833 - DNA, 25 bp, Homo sapien
gctgagggacctagtgaaatcaatg

SEQ ID NO: 526834 - DNA, 25 bp, Homo sapien
aatcaatgaaactcttgagtcttgc

SEQ ID NO: 526835 - DNA, 25 bp, Homo sapien
aactcttgagtcttgcttaggctcg

SEQ ID NO: 526836 - DNA, 25 bp, Homo sapien
gagtcttgcttaggctcgcaaacaa

SEQ ID NO: 526837 - DNA, 25 bp, Homo sapien
gcttaggctcgcaaacaagaagtgg

SEQ ID NO: 526838 - DNA, 25 bp, Homo sapien
ggcttgggaaattaggatatgacat

SEQ ID NO: 526839 - DNA, 25 bp, Homo sapien
atagatgtatatatgcccaaatata

SEQ ID NO: 526840 - DNA, 25 bp, Homo sapien
tgcccaaatatattgaatgtacaga

SEQ ID NO: 526841 - DNA, 25 bp, Homo sapien
gggcagatatcttggcctggttatg

SEQ ID NO: 526842 - DNA, 25 bp, Homo sapien
tggggtaggacacccagattttcag

SEQ ID NO: 526843 - DNA, 25 bp, Homo sapien
gaaaaatactttgtgggcactaccg

SEQ ID NO: 526844 - DNA, 25 bp, Homo sapien
gggcactaccggctgctaggttact

SEQ ID NO: 526845 - DNA, 25 bp, Homo sapien
aggttactcctgtggtcactatgtc

SEQ ID NO: 526846 - DNA, 25 bp, Homo sapien
gtagtatcatctcaactggcacacc

SEQ ID NO: 526847 - DNA, 25 bp, Homo sapien
caaacccaccttcatagtaacacta

SEQ ID NO: 526848 - DNA, 25 bp, Homo sapien
aacactaagctgtcatttgcccttc

SEQ ID NO: 526849 - DNA, 25 bp, Homo sapien
ttcccactgcattggcatctgcaat

SEQ ID NO: 526850 - DNA, 25 bp, Homo sapien
aatggtggcaacttagcctgaatca

SEQ ID NO: 526851 - DNA, 25 bp, Homo sapien
ggcattgaagtgtcctatcccaaga

SEQ ID NO: 526852 - DNA, 25 bp, Homo sapien
gaggccttgcattcttccctgacat

SEQ ID NO: 526853 - DNA, 25 bp, Homo sapien
tgacatcttctctccattaaaaaca

SEQ ID NO: 526854 - DNA, 25 bp, Homo sapien
gccaacctgactgcgagacaacgag

SEQ ID NO: 526855 - DNA, 25 bp, Homo sapien
gagatccagaggactcccagcgaac

SEQ ID NO: 526856 - DNA, 25 bp, Homo sapien
cagcgaacggacgagggtgacaata

SEQ ID NO: 526857 - DNA, 25 bp, Homo sapien
atagagtgtggtgtcatgtttgtga

SEQ ID NO: 526858 - DNA, 25 bp, Homo sapien
acactttcgagtgccagaacccaag

SEQ ID NO: 526859 - DNA, 25 bp, Homo sapien
gtgccagaacccaaggaggtgcaaa

SEQ ID NO: 526860 - DNA, 25 bp, Homo sapien
catactgcgttatagcggccgtgaa

SEQ ID NO: 526861 - DNA, 25 bp, Homo sapien
gcggccgtgaaaatatttccacgtt

SEQ ID NO: 526862 - DNA, 25 bp, Homo sapien
ttcatggttgcgaagcagtgctccg

SEQ ID NO: 526863 - DNA, 25 bp, Homo sapien
agtgctccgctggttgtgcagcgat

SEQ ID NO: 526864 - DNA, 25 bp, Homo sapien
tgcagcgatggagagacccaagcca

SEQ ID NO: 526865 - DNA, 25 bp, Homo sapien
ctgctatggcaaacatgtacatcaa

SEQ ID NO: 526866 - DNA, 25 bp, Homo sapien
ggatagtgggaaaacctctgtggtt

SEQ ID NO: 526867 - DNA, 25 bp, Homo sapien
aacctctgtggttgtcgggacatgg

SEQ ID NO: 526868 - DNA, 25 bp, Homo sapien
actgctagagcttatcatcttcaag

SEQ ID NO: 526869 - DNA, 25 bp, Homo sapien
atcttcaagacgatggtacccagac

SEQ ID NO: 526870 - DNA, 25 bp, Homo sapien
acgatggtacccagacagtcaggat

SEQ ID NO: 526871 - DNA, 25 bp, Homo sapien
cagtcaggatggtgtcacattttta

SEQ ID NO: 526872 - DNA, 25 bp, Homo sapien
ctgacaaaccaagacaggtgactgt

SEQ ID NO: 526873 - DNA, 25 bp, Homo sapien
gaatcagattcacctcatgctgtta

SEQ ID NO: 526874 - DNA, 25 bp, Homo sapien
gttactgtatatatgctagagcctc

SEQ ID NO: 526875 - DNA, 25 bp, Homo sapien
atatatgctagagcctcactcctgt

SEQ ID NO: 526876 - DNA, 25 bp, Homo sapien
aatcctgtatccaagcaaactttaa

SEQ ID NO: 526877 - DNA, 25 bp, Homo sapien
ttatctttcagctattaatcttttg

SEQ ID NO: 526878 - DNA, 25 bp, Homo sapien
tcagctattaatcttttgaatgaat

SEQ ID NO: 526879 - DNA, 25 bp, Homo sapien
aatactgttatcacagcaccagcaa

SEQ ID NO: 526880 - DNA, 25 bp, Homo sapien
gcaccagcaagccataatctttata

SEQ ID NO: 526881 - DNA, 25 bp, Homo sapien
agccataatctttatacctatcagt

SEQ ID NO: 526882 - DNA, 25 bp, Homo sapien
tctttatacctatcagttctatttc

SEQ ID NO: 526883 - DNA, 25 bp, Homo sapien
gaaaggcaacttctgcacaatcctg

SEQ ID NO: 526884 - DNA, 25 bp, Homo sapien
aaggcaacttctgcacaatcctgta

SEQ ID NO: 526885 - DNA, 25 bp, Homo sapien
acttctgcacaatcctgtatccaag

SEQ ID NO: 526886 - DNA, 25 bp, Homo sapien
gcacaatcctgtatccaagcaaact

SEQ ID NO: 526887 - DNA, 25 bp, Homo sapien
aataaatctcatccaagcaagttag

SEQ ID NO: 526888 - DNA, 25 bp, Homo sapien
tcatccaagcaagttagagtccagc

SEQ ID NO: 526889 - DNA, 25 bp, Homo sapien
gtccagcctaatcaaatgtcataat

SEQ ID NO: 526890 - DNA, 25 bp, Homo sapien
atgtcataattgttgtacctattga

SEQ ID NO: 526891 - DNA, 25 bp, Homo sapien
aattctagtacctgaaatcctttca

SEQ ID NO: 526892 - DNA, 25 bp, Homo sapien
tttcaacagatttttatatagcaac

SEQ ID NO: 526893 - DNA, 25 bp, Homo sapien
tatagcaactgctctctgcaagtag

SEQ ID NO: 526894 - DNA, 25 bp, Homo sapien
tgctctctgcaagtagttaaactag

SEQ ID NO: 526895 - DNA, 25 bp, Homo sapien
ttaaactagaaactgggcacatggt

SEQ ID NO: 526896 - DNA, 25 bp, Homo sapien
actgggcacatggtagaggctcaca

SEQ ID NO: 526897 - DNA, 25 bp, Homo sapien
gtagaggctcacatgggagttgtcc

SEQ ID NO: 526898 - DNA, 25 bp, Homo sapien
gtttccacgtaggtgtctaagccca

SEQ ID NO: 526899 - DNA, 25 bp, Homo sapien
taagcccacgaagcctgcggagatg

SEQ ID NO: 526900 - DNA, 25 bp, Homo sapien
cctgcggagatgtccacggtggcaa

SEQ ID NO: 526901 - DNA, 25 bp, Homo sapien
caatgttgttggagttgccctggaa

SEQ ID NO: 526902 - DNA, 25 bp, Homo sapien
aagagctgacaaaggcctcacaaca

SEQ ID NO: 526903 - DNA, 25 bp, Homo sapien
aaaggcctcacaacacgtggcatca

SEQ ID NO: 526904 - DNA, 25 bp, Homo sapien
gcatcaacagccacgatgttagcgt

SEQ ID NO: 526905 - DNA, 25 bp, Homo sapien
ttagcgtgagctacgatgttagcgt

SEQ ID NO: 526906 - DNA, 25 bp, Homo sapien
gcgtgaactgtgtaggcagcccaga

SEQ ID NO: 526907 - DNA, 25 bp, Homo sapien
gaagtgcactaagtggctggcccac

SEQ ID NO: 526908 - DNA, 25 bp, Homo sapien
gtacgtcccaaacgctgtcaggagc

SEQ ID NO: 526909 - DNA, 25 bp, Homo sapien
aaagttaaggcattcaaagggcact

SEQ ID NO: 526910 - DNA, 25 bp, Homo sapien
gggcacttgaaaaccattcctttat

SEQ ID NO: 526911 - DNA, 25 bp, Homo sapien
accattcctttatgtgaaaactggg

SEQ ID NO: 526912 - DNA, 25 bp, Homo sapien
gtaactaggatcttagcagtgcaat

SEQ ID NO: 526913 - DNA, 25 bp, Homo sapien
tgcagaatcatttataccaccaagg

SEQ ID NO: 526914 - DNA, 25 bp, Homo sapien
ttataccaccaaggctacgtaaggc

SEQ ID NO: 526915 - DNA, 25 bp, Homo sapien
aaggctacgtaaggcacaccgctaa

SEQ ID NO: 526916 - DNA, 25 bp, Homo sapien
ggcacaccgctaagatatatcttcg

SEQ ID NO: 526917 - DNA, 25 bp, Homo sapien
gggcaatggtgttaacattattctt

SEQ ID NO: 526918 - DNA, 25 bp, Homo sapien
atcatcactctttttgtaaatccca

SEQ ID NO: 526919 - DNA, 25 bp, Homo sapien
gtaaatcccatatttagatggcaaa

SEQ ID NO: 526920 - DNA, 25 bp, Homo sapien
ggaaatattttcacggccgctataa

SEQ ID NO: 526921 - DNA, 25 bp, Homo sapien
tcacggccgctataacgcagtatgg

SEQ ID NO: 526922 - DNA, 25 bp, Homo sapien
ataacgcagtatggctctgtccatt

SEQ ID NO: 526923 - DNA, 25 bp, Homo sapien
tccttgggttctggcactcgaaagt

SEQ ID NO: 526924 - DNA, 25 bp, Homo sapien
cactcgaaagtgttttctctctcac

SEQ ID NO: 526925 - DNA, 25 bp, Homo sapien
ttttctctctcacaaacatgacacc

SEQ ID NO: 526926 - DNA, 25 bp, Homo sapien
acatgacaccacactctattgtcac

SEQ ID NO: 526927 - DNA, 25 bp, Homo sapien
tgggagtcctctggatctcgttgtc

SEQ ID NO: 526928 - DNA, 25 bp, Homo sapien
atctcgttgtctcgcagtcaggttg

SEQ ID NO: 526929 - DNA, 25 bp, Homo sapien
agtcaggttggcgtctgtccacacc

SEQ ID NO: 526930 - DNA, 25 bp, Homo sapien
ggagcactgcttcgcaaccatgaaa

SEQ ID NO: 526931 - DNA, 25 bp, Homo sapien
aaataaatatactaccagttacatt

SEQ ID NO: 526932 - DNA, 25 bp, Homo sapien
aataaatatactaccagttacattt

SEQ ID NO: 526933 - DNA, 25 bp, Homo sapien
ataaatatactaccagttacatttt

SEQ ID NO: 526934 - DNA, 25 bp, Homo sapien
taaatatactaccagttacatttta

SEQ ID NO: 526935 - DNA, 25 bp, Homo sapien
aaatatactaccagttacattttat

SEQ ID NO: 526936 - DNA, 25 bp, Homo sapien
gttacattttatgatttatgagtgg

SEQ ID NO: 526937 - DNA, 25 bp, Homo sapien
ttacattttatgatttatgagtggt

SEQ ID NO: 526938 - DNA, 25 bp, Homo sapien
tacattttatgatttatgagtggta

SEQ ID NO: 526939 - DNA, 25 bp, Homo sapien
acattttatgatttatgagtggtag

SEQ ID NO: 526940 - DNA, 25 bp, Homo sapien
attggttgttagaatatttttctca

SEQ ID NO: 526941 - DNA, 25 bp, Homo sapien
ttggttgttagaatatttttctcac

SEQ ID NO: 526942 - DNA, 25 bp, Homo sapien
agcttttccctttgcactgaatgat

SEQ ID NO: 526943 - DNA, 25 bp, Homo sapien
actgaatgatgttctctccgtctca

SEQ ID NO: 526944 - DNA, 25 bp, Homo sapien
ctctccgtctcatcggcagtatggg

SEQ ID NO: 526945 - DNA, 25 bp, Homo sapien
cagctgtcccagtgtcaatgtttac

SEQ ID NO: 526946 - DNA, 25 bp, Homo sapien
gtgttcttaggaggcgtgcgctctc

SEQ ID NO: 526947 - DNA, 25 bp, Homo sapien
tgcgctctctactatgccttgatgt

SEQ ID NO: 526948 - DNA, 25 bp, Homo sapien
tatgccttgatgttgcctaccttat

SEQ ID NO: 526949 - DNA, 25 bp, Homo sapien
gcctaccttattgtggtatcgtgga

SEQ ID NO: 526950 - DNA, 25 bp, Homo sapien
gtgttgcaccagttttttcatgttg

SEQ ID NO: 526951 - DNA, 25 bp, Homo sapien
aaagaatttcgctctgcagtttgaa

SEQ ID NO: 526952 - DNA, 25 bp, Homo sapien
gtggccacagctgtgacttgcagcc

SEQ ID NO: 526953 - DNA, 25 bp, Homo sapien
gttagaattggacctcagccgattt

SEQ ID NO: 526954 - DNA, 25 bp, Homo sapien
ggacctcagccgatttgagccaaaa

SEQ ID NO: 526955 - DNA, 25 bp, Homo sapien
ttgagccaaaatttaggaactattc

SEQ ID NO: 526956 - DNA, 25 bp, Homo sapien
ggaactattcagaagacagtttctt

SEQ ID NO: 526957 - DNA, 25 bp, Homo sapien
ttctttcttttgagtgcttaagaca

SEQ ID NO: 526958 - DNA, 25 bp, Homo sapien
gacagtgtaaatggttcgaatcaca

SEQ ID NO: 526959 - DNA, 25 bp, Homo sapien
atggttcgaatcacacacattttaa

SEQ ID NO: 526960 - DNA, 25 bp, Homo sapien
cagcccttttggtactactcagtat

SEQ ID NO: 526961 - DNA, 25 bp, Homo sapien
cacattttaagattccattgtatac

SEQ ID NO: 526962 - DNA, 25 bp, Homo sapien
gtactactcagtattgttgacaaca

SEQ ID NO: 526963 - DNA, 25 bp, Homo sapien
gattctccgttagaattggacctca

SEQ ID NO: 526964 - DNA, 25 bp, Homo sapien
aaggcagcttgtgcggagaaactga

SEQ ID NO: 526965 - DNA, 25 bp, Homo sapien
gcagcttgtgcggagaaactgaaac

SEQ ID NO: 526966 - DNA, 25 bp, Homo sapien
gcttgtgcggagaaactgaaacgat

SEQ ID NO: 526967 - DNA, 25 bp, Homo sapien
cttgtgcggagaaactgaaacgatt

SEQ ID NO: 526968 - DNA, 25 bp, Homo sapien
tgcggagaaactgaaacgattggat

SEQ ID NO: 526969 - DNA, 25 bp, Homo sapien
cggagaaactgaaacgattggatga

SEQ ID NO: 526970 - DNA, 25 bp, Homo sapien
actgaaacgattggatgagaagctt

SEQ ID NO: 526971 - DNA, 25 bp, Homo sapien
gaaacgattggatgagaagcttggc

SEQ ID NO: 526972 - DNA, 25 bp, Homo sapien
aacgattggatgagaagcttggcat

SEQ ID NO: 526973 - DNA, 25 bp, Homo sapien
gattggatgagaagcttggcatcct

SEQ ID NO: 526974 - DNA, 25 bp, Homo sapien
attggatgagaagcttggcatcctg

SEQ ID NO: 526975 - DNA, 25 bp, Homo sapien
aacatagaaaatgctgctttgcact

SEQ ID NO: 526976 - DNA, 25 bp, Homo sapien
gaaaatgctgctttgcactgaaata

SEQ ID NO: 526977 - DNA, 25 bp, Homo sapien
gctgctttgcactgaaatacttaaa

SEQ ID NO: 526978 - DNA, 25 bp, Homo sapien
ataaaatccaaccaacattcttgat

SEQ ID NO: 526979 - DNA, 25 bp, Homo sapien
ccaaccaacattcttgatttttcat

SEQ ID NO: 526980 - DNA, 25 bp, Homo sapien
tcatttttatgaacttgatcagaaa

SEQ ID NO: 526981 - DNA, 25 bp, Homo sapien
gaacttgatcagaaaaattcatctt

SEQ ID NO: 526982 - DNA, 25 bp, Homo sapien
taaccctgccctaatttttcttgag

SEQ ID NO: 526983 - DNA, 25 bp, Homo sapien
agagcaaactattttcaggttatgc

SEQ ID NO: 526984 - DNA, 25 bp, Homo sapien
actattttcaggttatgcttacaat

SEQ ID NO: 526985 - DNA, 25 bp, Homo sapien
atgactgaagatgtatgtttttgaa

SEQ ID NO: 526986 - DNA, 25 bp, Homo sapien
ctctctgagcatctttgggatcttg

SEQ ID NO: 526987 - DNA, 25 bp, Homo sapien
tgggatcttgttgctcaaaactctt

SEQ ID NO: 526988 - DNA, 25 bp, Homo sapien
gctcaaaactcttctgtgacttcat

SEQ ID NO: 526989 - DNA, 25 bp, Homo sapien
catttgtgcccatctcaagcctcag

SEQ ID NO: 526990 - DNA, 25 bp, Homo sapien
aagcctcagcaagaaaccatgtgga

SEQ ID NO: 526991 - DNA, 25 bp, Homo sapien
ggaacatgaagcttaatgacttgac

SEQ ID NO: 526992 - DNA, 25 bp, Homo sapien
atgacttgacagtgtactagtgtta

SEQ ID NO: 526993 - DNA, 25 bp, Homo sapien
tagtgttaaactctcatacctctgt

SEQ ID NO: 526994 - DNA, 25 bp, Homo sapien
actctcatacctctgttacaaagcg

SEQ ID NO: 526995 - DNA, 25 bp, Homo sapien
agcgagaaacgccacacccggactg

SEQ ID NO: 526996 - DNA, 25 bp, Homo sapien
gggcgaaacctgtgtatggatttca

SEQ ID NO: 526997 - DNA, 25 bp, Homo sapien
aatcttataggatctctgtcatatg

SEQ ID NO: 526998 - DNA, 25 bp, Homo sapien
ggatctctgtcatatgtggtcaatt

SEQ ID NO: 526999 - DNA, 25 bp, Homo sapien
atgtggtcaattgttgatcgaaaca

SEQ ID NO: 527000 - DNA, 25 bp, Homo sapien
gatcgaaacatgactgtatgtcgta

SEQ ID NO: 527001 - DNA, 25 bp, Homo sapien
tgactgtatgtcgtattttcagaaa

SEQ ID NO: 527002 - DNA, 25 bp, Homo sapien
ggaataggtaatcatcacttgtgtg

SEQ ID NO: 527003 - DNA, 25 bp, Homo sapien
atggtatctgtgtaatctaaacata

SEQ ID NO: 527004 - DNA, 25 bp, Homo sapien
gtttcaaaagctgttgcatttatta

SEQ ID NO: 527005 - DNA, 25 bp, Homo sapien
gaacagataatacattgtgctacaa

SEQ ID NO: 527006 - DNA, 25 bp, Homo sapien
gtgctacaatgtaacaatggctgtg

SEQ ID NO: 527007 - DNA, 25 bp, Homo sapien
atggctgtggcatcactaggtgata

SEQ ID NO: 527008 - DNA, 25 bp, Homo sapien
tcacccactaggactcaatgttcac

SEQ ID NO: 527009 - DNA, 25 bp, Homo sapien
gttcacaacaggaaggaccattgct

SEQ ID NO: 527010 - DNA, 25 bp, Homo sapien
aggaccattgctgcatactccttga

SEQ ID NO: 527011 - DNA, 25 bp, Homo sapien
actccttgaccagcaacttttttga

SEQ ID NO: 527012 - DNA, 25 bp, Homo sapien
atttttaagtgcagagtaggcctct

SEQ ID NO: 527013 - DNA, 25 bp, Homo sapien
gtaggcctctattcctgtatgtaat

SEQ ID NO: 527014 - DNA, 25 bp, Homo sapien
ggaacctcatctatcgggtctggaa

SEQ ID NO: 527015 - DNA, 25 bp, Homo sapien
atacagcagttcgaaagccgcgtcc

SEQ ID NO: 527016 - DNA, 25 bp, Homo sapien
catttctctccttcagtagtgcaga

SEQ ID NO: 527017 - DNA, 25 bp, Homo sapien
gcagaaatgagtccgattcaccagt

SEQ ID NO: 527018 - DNA, 25 bp, Homo sapien
gtccgattcaccagtacacacagaa

SEQ ID NO: 527019 - DNA, 25 bp, Homo sapien
cacaacatcaggaagtgtgtttgaa

SEQ ID NO: 527020 - DNA, 25 bp, Homo sapien
caggaagtgtgtttgaaagaagtac

SEQ ID NO: 527021 - DNA, 25 bp, Homo sapien
aatagtcttgagaagtcggaaaatc

SEQ ID NO: 527022 - DNA, 25 bp, Homo sapien
gagaagtcggaaaatcaaaatgaga

SEQ ID NO: 527023 - DNA, 25 bp, Homo sapien
gagagtattaagaattatttacagt

SEQ ID NO: 527024 - DNA, 25 bp, Homo sapien
tacagtttcttaaaacttcttatgt

SEQ ID NO: 527025 - DNA, 25 bp, Homo sapien
cttaaaacttcttatgtaacaatgt

SEQ ID NO: 527026 - DNA, 25 bp, Homo sapien
gaaaatgtcatctagagagagtgct

SEQ ID NO: 527027 - DNA, 25 bp, Homo sapien
atgtcatctagagagagtgctttac

SEQ ID NO: 527028 - DNA, 25 bp, Homo sapien
tcatctagagagagtgctttacaaa

SEQ ID NO: 527029 - DNA, 25 bp, Homo sapien
aaatattagatctggaaactgagct

SEQ ID NO: 527030 - DNA, 25 bp, Homo sapien
gcacaattttaatagtcatgcacta

SEQ ID NO: 527031 - DNA, 25 bp, Homo sapien
tttaatagtcatgcactacataatg

SEQ ID NO: 527032 - DNA, 25 bp, Homo sapien
atgacagaccacgtatatgttggca

SEQ ID NO: 527033 - DNA, 25 bp, Homo sapien
accacgtatatgttggcagtctcat

SEQ ID NO: 527034 - DNA, 25 bp, Homo sapien
tatgttggcagtctcataagattat

SEQ ID NO: 527035 - DNA, 25 bp, Homo sapien
aggtttgtagcctgttttgcatttt

SEQ ID NO: 527036 - DNA, 25 bp, Homo sapien
tttgtagcctgttttgcatttttct

SEQ ID NO: 527037 - DNA, 25 bp, Homo sapien
atttttcttaggttgtatgctcttc

SEQ ID NO: 527038 - DNA, 25 bp, Homo sapien
ttaggttgtatgctcttctgtttta

SEQ ID NO: 527039 - DNA, 25 bp, Homo sapien
ggtttgaatcaccagcatttttgtg

SEQ ID NO: 527040 - DNA, 25 bp, Homo sapien
gaatcaccagcatttttgtgatcaa

SEQ ID NO: 527041 - DNA, 25 bp, Homo sapien
tcgatcagagatcggcggagaccct

SEQ ID NO: 527042 - DNA, 25 bp, Homo sapien
ggagaccctcgaagtgcgcaaactt

SEQ ID NO: 527043 - DNA, 25 bp, Homo sapien
gaagtgcgcaaacttgacactcacc

SEQ ID NO: 527044 - DNA, 25 bp, Homo sapien
tgacactcaccctgaccggactggg

SEQ ID NO: 527045 - DNA, 25 bp, Homo sapien
tttggactcgatgagtttccaccga

SEQ ID NO: 527046 - DNA, 25 bp, Homo sapien
gatgagtttccaccgaaatgtcgga

SEQ ID NO: 527047 - DNA, 25 bp, Homo sapien
gaagtcaggccagagcacaaaagca

SEQ ID NO: 527048 - DNA, 25 bp, Homo sapien
agtatgcaacactcagtttatttaa

SEQ ID NO: 527049 - DNA, 25 bp, Homo sapien
cagctcgacatggattacagagtct

SEQ ID NO: 527050 - DNA, 25 bp, Homo sapien
tacagagtcttggaaaagtcggtat

SEQ ID NO: 527051 - DNA, 25 bp, Homo sapien
aagtcggtatttcacggcgtatgcc

SEQ ID NO: 527052 - DNA, 25 bp, Homo sapien
gcttggaaattaggtccatttaaag

SEQ ID NO: 527053 - DNA, 25 bp, Homo sapien
gaaattaggtccatttaaagtatgt

SEQ ID NO: 527054 - DNA, 25 bp, Homo sapien
tgtgcgcctattgtcccatctactt

SEQ ID NO: 527055 - DNA, 25 bp, Homo sapien
tgcgcctattgtcccatctacttga

SEQ ID NO: 527056 - DNA, 25 bp, Homo sapien
tgcttgggctcaggattttgaatcc

SEQ ID NO: 527057 - DNA, 25 bp, Homo sapien
ctgatttctcaaattttatttaggt

SEQ ID NO: 527058 - DNA, 25 bp, Homo sapien
aattttatttaggtctttcatagct

SEQ ID NO: 527059 - DNA, 25 bp, Homo sapien
attttatttaggtctttcatagctt

SEQ ID NO: 527060 - DNA, 25 bp, Homo sapien
tttatttaggtctttcatagctttt

SEQ ID NO: 527061 - DNA, 25 bp, Homo sapien
tatttaggtctttcatagctttttt

SEQ ID NO: 527062 - DNA, 25 bp, Homo sapien
tttaggtctttcatagcttttttat

SEQ ID NO: 527063 - DNA, 25 bp, Homo sapien
tgggtctttgcctcagcaactgtgg

SEQ ID NO: 527064 - DNA, 25 bp, Homo sapien
gggaccaggctctagaaagctcaca

SEQ ID NO: 527065 - DNA, 25 bp, Homo sapien
tctagaaagctcacagcggcgctat

SEQ ID NO: 527066 - DNA, 25 bp, Homo sapien
atggaaaaacctggagacagccctg

SEQ ID NO: 527067 - DNA, 25 bp, Homo sapien
agacggcccagtggatgaataggaa

SEQ ID NO: 527068 - DNA, 25 bp, Homo sapien
aaaatgcatggtgttatggccaaac

SEQ ID NO: 527069 - DNA, 25 bp, Homo sapien
tatggccaaacaccggaacactctt

SEQ ID NO: 527070 - DNA, 25 bp, Homo sapien
ggaacactcttcagctacccaaatg

SEQ ID NO: 527071 - DNA, 25 bp, Homo sapien
ttcagctacccaaatgcactgcagc

SEQ ID NO: 527072 - DNA, 25 bp, Homo sapien
acatcctcttgcacagtgggtcttt

SEQ ID NO: 527073 - DNA, 25 bp, Homo sapien
gcacagtgggtctttgcctcagcaa

SEQ ID NO: 527074 - DNA, 25 bp, Homo sapien
aggatgaatcacttgacacataggt

SEQ ID NO: 527075 - DNA, 25 bp, Homo sapien
ggatgaatcacttgacacataggta

SEQ ID NO: 527076 - DNA, 25 bp, Homo sapien
gatgaatcacttgacacataggtag

SEQ ID NO: 527077 - DNA, 25 bp, Homo sapien
atgaatcacttgacacataggtaga

SEQ ID NO: 527078 - DNA, 25 bp, Homo sapien
tgaatcacttgacacataggtagat

SEQ ID NO: 527079 - DNA, 25 bp, Homo sapien
gaatcacttgacacataggtagata

SEQ ID NO: 527080 - DNA, 25 bp, Homo sapien
aatcacttgacacataggtagatac

SEQ ID NO: 527081 - DNA, 25 bp, Homo sapien
tcacttgacacataggtagatactt

SEQ ID NO: 527082 - DNA, 25 bp, Homo sapien
cacttgacacataggtagatacttg

SEQ ID NO: 527083 - DNA, 25 bp, Homo sapien
acttgacacataggtagatacttga

SEQ ID NO: 527084 - DNA, 25 bp, Homo sapien
cttgacacataggtagatacttgag

SEQ ID NO: 527085 - DNA, 25 bp, Homo sapien
cttcacaaacttctgatacagcaag

SEQ ID NO: 527086 - DNA, 25 bp, Homo sapien
caagttgggcttgggatgattataa

SEQ ID NO: 527087 - DNA, 25 bp, Homo sapien
gattataacgggtggtctccttaga

SEQ ID NO: 527088 - DNA, 25 bp, Homo sapien
ggtggtctccttagaaaggctcctt

SEQ ID NO: 527089 - DNA, 25 bp, Homo sapien
gaaaggctccttatctgtactccat

SEQ ID NO: 527090 - DNA, 25 bp, Homo sapien
tgcccagtttccactaccaagttgg

SEQ ID NO: 527091 - DNA, 25 bp, Homo sapien
agtttccactaccaagttggccgca

SEQ ID NO: 527092 - DNA, 25 bp, Homo sapien
aagttggccgcagtcttgttgaaga

SEQ ID NO: 527093 - DNA, 25 bp, Homo sapien
ggccgcagtcttgttgaagagctca

SEQ ID NO: 527094 - DNA, 25 bp, Homo sapien
gaagagctcattccaccagtggttt

SEQ ID NO: 527095 - DNA, 25 bp, Homo sapien
aactccttggcagggtcatgtccta

SEQ ID NO: 527096 - DNA, 25 bp, Homo sapien
acactaaatcatcttcccaaatacc

SEQ ID NO: 527097 - DNA, 25 bp, Homo sapien
ctaaatcatcttcccaaatacctgc

SEQ ID NO: 527098 - DNA, 25 bp, Homo sapien
aaatacctgcccaaccatcagtagc

SEQ ID NO: 527099 - DNA, 25 bp, Homo sapien
tgcccaaccatcagtagcaaaagtt

SEQ ID NO: 527100 - DNA, 25 bp, Homo sapien
cagtagcaaaagttccctatgggaa

SEQ ID NO: 527101 - DNA, 25 bp, Homo sapien
tccctatgggaaaggaccttcattt

SEQ ID NO: 527102 - DNA, 25 bp, Homo sapien
tcatttaatcaggaacgtggaacat

SEQ ID NO: 527103 - DNA, 25 bp, Homo sapien
ggaacgtggaacatcttcacatctg

SEQ ID NO: 527104 - DNA, 25 bp, Homo sapien
aagacgaagacaacaatcagaaatt

SEQ ID NO: 527105 - DNA, 25 bp, Homo sapien
atttctgcagcagtagaacgtgctc

SEQ ID NO: 527106 - DNA, 25 bp, Homo sapien
agaacgtgctcgtaaacggcgtgaa

SEQ ID NO: 527107 - DNA, 25 bp, Homo sapien
gggactcactattcacctaatgagg

SEQ ID NO: 527108 - DNA, 25 bp, Homo sapien
tcacctaatgaggattcttcttttt

SEQ ID NO: 527109 - DNA, 25 bp, Homo sapien
cctaatgaggattcttctttttgag

SEQ ID NO: 527110 - DNA, 25 bp, Homo sapien
gagttattttccatgagaaattctg

SEQ ID NO: 527111 - DNA, 25 bp, Homo sapien
tttccatgagaaattctgagcaaac

SEQ ID NO: 527112 - DNA, 25 bp, Homo sapien
ctgagcaaactatagaacacacccc

SEQ ID NO: 527113 - DNA, 25 bp, Homo sapien
acaccccagggctaatttgagataa

SEQ ID NO: 527114 - DNA, 25 bp, Homo sapien
cccagggctaatttgagataagtac

SEQ ID NO: 527115 - DNA, 25 bp, Homo sapien
gtaataagtatctgatttccggaag

SEQ ID NO: 527116 - DNA, 25 bp, Homo sapien
tgatttccggaagatttactttact

SEQ ID NO: 527117 - DNA, 25 bp, Homo sapien
gaagatttactttactcaaggaact

SEQ ID NO: 527118 - DNA, 25 bp, Homo sapien
tgaagtgtgggaacgacctctctca

SEQ ID NO: 527119 - DNA, 25 bp, Homo sapien
tcaggcttagcctgggctgtagcta

SEQ ID NO: 527120 - DNA, 25 bp, Homo sapien
gggctgtagctatgataaaccggca

SEQ ID NO: 527121 - DNA, 25 bp, Homo sapien
agattggtggacctcgctcttatac

SEQ ID NO: 527122 - DNA, 25 bp, Homo sapien
gctcttataccatcgcagttgcttc

SEQ ID NO: 527123 - DNA, 25 bp, Homo sapien
aaaggagtggcctgtaatcctgcct

SEQ ID NO: 527124 - DNA, 25 bp, Homo sapien
taatcctgcctgcttcatcacacag

SEQ ID NO: 527125 - DNA, 25 bp, Homo sapien
acagctcctccctgtgaaaaggaag

SEQ ID NO: 527126 - DNA, 25 bp, Homo sapien
gctagggttctatgaatggacttca

SEQ ID NO: 527127 - DNA, 25 bp, Homo sapien
taagaagtcacataaatcccacagg

SEQ ID NO: 527128 - DNA, 25 bp, Homo sapien
aaatcccacaggcactgttttgctt

SEQ ID NO: 527129 - DNA, 25 bp, Homo sapien
accttgtgattcagtgtatctgttt

SEQ ID NO: 527130 - DNA, 25 bp, Homo sapien
cagtgtatctgtttactaactcaaa

SEQ ID NO: 527131 - DNA, 25 bp, Homo sapien
aaataaagcaattgttccctctgga

SEQ ID NO: 527132 - DNA, 25 bp, Homo sapien
cggtgtggcgccagccttgaagcac

SEQ ID NO: 527133 - DNA, 25 bp, Homo sapien
cttgaagcaccacggcccaaggatg

SEQ ID NO: 527134 - DNA, 25 bp, Homo sapien
acggcccaaggatgcggtgtacata

SEQ ID NO: 527135 - DNA, 25 bp, Homo sapien
catactgtatttctagattctcctt

SEQ ID NO: 527136 - DNA, 25 bp, Homo sapien
gattctcctttgtacagagtcactt

SEQ ID NO: 527137 - DNA, 25 bp, Homo sapien
gagtcacttcacaagtcaagctact

SEQ ID NO: 527138 - DNA, 25 bp, Homo sapien
gctactgttttacaggtgctcctta

SEQ ID NO: 527139 - DNA, 25 bp, Homo sapien
ccttatttattagagctgtgagagc

SEQ ID NO: 527140 - DNA, 25 bp, Homo sapien
taaactgtatgcatttgcctccagc

SEQ ID NO: 527141 - DNA, 25 bp, Homo sapien
tgcctccagcccaagattataaata

SEQ ID NO: 527142 - DNA, 25 bp, Homo sapien
aactgattatgatctgcatgttctc

SEQ ID NO: 527143 - DNA, 25 bp, Homo sapien
gcatgttctctctttgggttcaagc

SEQ ID NO: 527144 - DNA, 25 bp, Homo sapien
gtgttcactgtgcatcattcattca

SEQ ID NO: 527145 - DNA, 25 bp, Homo sapien
gggttcaagcatttccttacagaag

SEQ ID NO: 527146 - DNA, 25 bp, Homo sapien
tttccttacagaagagccaccgtgg

SEQ ID NO: 527147 - DNA, 25 bp, Homo sapien
gagccaccgtggaagtcatgggtaa

SEQ ID NO: 527148 - DNA, 25 bp, Homo sapien
gttgaattggtaactccctcttgga

SEQ ID NO: 527149 - DNA, 25 bp, Homo sapien
ttcattcaccccatgatgttctgga

SEQ ID NO: 527150 - DNA, 25 bp, Homo sapien
gttgtctttcgttggccagaggaat

SEQ ID NO: 527151 - DNA, 25 bp, Homo sapien
gcctgccaggtctctgggccttcag

SEQ ID NO: 527152 - DNA, 25 bp, Homo sapien
gggtcctggtgctgcggccacacca

SEQ ID NO: 527153 - DNA, 25 bp, Homo sapien
gggtgctcattgacagagctgccat

SEQ ID NO: 527154 - DNA, 25 bp, Homo sapien
gacagagctgccataatgaacttga

SEQ ID NO: 527155 - DNA, 25 bp, Homo sapien
gaacttgaaaggacgggaatcacga

SEQ ID NO: 527156 - DNA, 25 bp, Homo sapien
ggctcccctgcccacaggagaggat

SEQ ID NO: 527157 - DNA, 25 bp, Homo sapien
agaggatccccgttcttcaagcttc

SEQ ID NO: 527158 - DNA, 25 bp, Homo sapien
aagcttctctgctcagtgtctacta

SEQ ID NO: 527159 - DNA, 25 bp, Homo sapien
gtctactaacgaccgacatttgcta

SEQ ID NO: 527160 - DNA, 25 bp, Homo sapien
ctaattcttttacacagtctgtttt

SEQ ID NO: 527161 - DNA, 25 bp, Homo sapien
cacagtctgtttttaatctatttta

SEQ ID NO: 527162 - DNA, 25 bp, Homo sapien
gatagttcagagaggtaggagcatt

SEQ ID NO: 527163 - DNA, 25 bp, Homo sapien
ggtaggagcattatctcccattttt

SEQ ID NO: 527164 - DNA, 25 bp, Homo sapien
tttctggtgacttcttggagtatag

SEQ ID NO: 527165 - DNA, 25 bp, Homo sapien
tagaattcaccattttatccgtaag

SEQ ID NO: 527166 - DNA, 25 bp, Homo sapien
ccattttatccgtaagtcttcaaag

SEQ ID NO: 527167 - DNA, 25 bp, Homo sapien
ggattatggtggactagaacttaca

SEQ ID NO: 527168 - DNA, 25 bp, Homo sapien
cttacatagtgcaaaatagtcttct

SEQ ID NO: 527169 - DNA, 25 bp, Homo sapien
agaaaccagagctatttatttgtat

SEQ ID NO: 527170 - DNA, 25 bp, Homo sapien
gcactgtttattatttgtactgatt

SEQ ID NO: 527171 - DNA, 25 bp, Homo sapien
ttgtactgattcttatccctctgtg

SEQ ID NO: 527172 - DNA, 25 bp, Homo sapien
gattcttatccctctgtgtgaataa

SEQ ID NO: 527173 - DNA, 25 bp, Homo sapien
agcactttgtcttgtctctgcaaga

SEQ ID NO: 527174 - DNA, 25 bp, Homo sapien
aaattcgattccagtcatttcccat

SEQ ID NO: 527175 - DNA, 25 bp, Homo sapien
tcgattccagtcatttcccataaaa

SEQ ID NO: 527176 - DNA, 25 bp, Homo sapien
gtcatttcccataaaatacagacat

SEQ ID NO: 527177 - DNA, 25 bp, Homo sapien
caacataatatgctttgattgatgc

SEQ ID NO: 527178 - DNA, 25 bp, Homo sapien
tgcagcattatgctttgggcagtat

SEQ ID NO: 527179 - DNA, 25 bp, Homo sapien
gtattacaaaatagctggcgagtgc

SEQ ID NO: 527180 - DNA, 25 bp, Homo sapien
tagctggcgagtgctttctgtattt

SEQ ID NO: 527181 - DNA, 25 bp, Homo sapien
atgtttgtttggtcaatgtttccgc

SEQ ID NO: 527182 - DNA, 25 bp, Homo sapien
gtttggtcaatgtttccgcagtatt

SEQ ID NO: 527183 - DNA, 25 bp, Homo sapien
tcaatgtttccgcagtatttattaa

SEQ ID NO: 527184 - DNA, 25 bp, Homo sapien
gtcttgtccacagctggcaaattca

SEQ ID NO: 527185 - DNA, 25 bp, Homo sapien
gaatcaaactgatggctgaaggcga

SEQ ID NO: 527186 - DNA, 25 bp, Homo sapien
ttttgatgacctttcagattctttc

SEQ ID NO: 527187 - DNA, 25 bp, Homo sapien
agattctttctctggaactgaacca

SEQ ID NO: 527188 - DNA, 25 bp, Homo sapien
gtagtaggtttgtttctgcgtcaca

SEQ ID NO: 527189 - DNA, 25 bp, Homo sapien
tgcgtcacatgatcttggcctacag

SEQ ID NO: 527190 - DNA, 25 bp, Homo sapien
tggcctacagtaagctttctttcag

SEQ ID NO: 527191 - DNA, 25 bp, Homo sapien
agctttctttcagccaagtgtttaa

SEQ ID NO: 527192 - DNA, 25 bp, Homo sapien
agtgtttaaactgtacactgccctt

SEQ ID NO: 527193 - DNA, 25 bp, Homo sapien
tgtacactgcccttcagcagtactt

SEQ ID NO: 527194 - DNA, 25 bp, Homo sapien
gaggatgctgatatggaactgacca

SEQ ID NO: 527195 - DNA, 25 bp, Homo sapien
agctgctcagggttctctggtccaa

SEQ ID NO: 527196 - DNA, 25 bp, Homo sapien
ggttctctggtccaagaccctgctt

SEQ ID NO: 527197 - DNA, 25 bp, Homo sapien
aaagagagtctttggcgtgctcaga

SEQ ID NO: 527198 - DNA, 25 bp, Homo sapien
tttggcgtgctcagactccagcgct

SEQ ID NO: 527199 - DNA, 25 bp, Homo sapien
agcgctccgttcttcaaggaggttg

SEQ ID NO: 527200 - DNA, 25 bp, Homo sapien
aaggaggttgacttgcctctcgggc

SEQ ID NO: 527201 - DNA, 25 bp, Homo sapien
ggccccgtaggtaccaagagactgt

SEQ ID NO: 527202 - DNA, 25 bp, Homo sapien
gagactgtttacctcccagaatgtt

SEQ ID NO: 527203 - DNA, 25 bp, Homo sapien
gaaaacctcatcatttctaaggatg

SEQ ID NO: 527204 - DNA, 25 bp, Homo sapien
gacttaattactgtgccttttcctt

SEQ ID NO: 527205 - DNA, 25 bp, Homo sapien
tttttacacatcctactgtccctta

SEQ ID NO: 527206 - DNA, 25 bp, Homo sapien
agagaggtgatttttaaggcagtga

SEQ ID NO: 527207 - DNA, 25 bp, Homo sapien
ggcagtgaaagtactctctagggta

SEQ ID NO: 527208 - DNA, 25 bp, Homo sapien
tactctctagggtactgtaatttgt

SEQ ID NO: 527209 - DNA, 25 bp, Homo sapien
tagggtactgtaatttgtcaaaacg

SEQ ID NO: 527210 - DNA, 25 bp, Homo sapien
gtaatttgtcaaaacgcagagaatg

SEQ ID NO: 527211 - DNA, 25 bp, Homo sapien
aaccctaatgtcaactctggacttc

SEQ ID NO: 527212 - DNA, 25 bp, Homo sapien
gtcaactctggacttcagttaataa

SEQ ID NO: 527213 - DNA, 25 bp, Homo sapien
actgttggctcattaattgtaacaa

SEQ ID NO: 527214 - DNA, 25 bp, Homo sapien
gaaccataatgatgcaagatgttaa

SEQ ID NO: 527215 - DNA, 25 bp, Homo sapien
agaattctctatactttttgctcaa

SEQ ID NO: 527216 - DNA, 25 bp, Homo sapien
aattctctatactttttgctcaact

SEQ ID NO: 527217 - DNA, 25 bp, Homo sapien
tctttactgagggtgctttagcttt

SEQ ID NO: 527218 - DNA, 25 bp, Homo sapien
ttactgagggtgctttagctttgta

SEQ ID NO: 527219 - DNA, 25 bp, Homo sapien
ctgagggtgctttagctttgtagga

SEQ ID NO: 527220 - DNA, 25 bp, Homo sapien
gctttagctttgtaggatgaaaacc

SEQ ID NO: 527221 - DNA, 25 bp, Homo sapien
ttagctttgtaggatgaaaacctca

SEQ ID NO: 527222 - DNA, 25 bp, Homo sapien
acctcaaactaacagggcctaccat

SEQ ID NO: 527223 - DNA, 25 bp, Homo sapien
ctcaaactaacagggcctaccatgt

SEQ ID NO: 527224 - DNA, 25 bp, Homo sapien
aactaacagggcctaccatgtagag

SEQ ID NO: 527225 - DNA, 25 bp, Homo sapien
taacagggcctaccatgtagagaat

SEQ ID NO: 527226 - DNA, 25 bp, Homo sapien
acagggcctaccatgtagagaatga

SEQ ID NO: 527227 - DNA, 25 bp, Homo sapien
ggcctaccatgtagagaatgaagcc

SEQ ID NO: 527228 - DNA, 25 bp, Homo sapien
gaagaatagttttttgtccccagag

SEQ ID NO: 527229 - DNA, 25 bp, Homo sapien
ccagagacattcatttagttgatat

SEQ ID NO: 527230 - DNA, 25 bp, Homo sapien
tagttgatataatcctaccagaagg

SEQ ID NO: 527231 - DNA, 25 bp, Homo sapien
taatcctaccagaaggaaagcacta

SEQ ID NO: 527232 - DNA, 25 bp, Homo sapien
gaaagcactaagaaacactcgtttg

SEQ ID NO: 527233 - DNA, 25 bp, Homo sapien
gcactaagaaacactcgtttgttgt

SEQ ID NO: 527234 - DNA, 25 bp, Homo sapien
ggcaacagacttaaagttgtcctca

SEQ ID NO: 527235 - DNA, 25 bp, Homo sapien
gacttaaagttgtcctcagccaagg

SEQ ID NO: 527236 - DNA, 25 bp, Homo sapien
gttgtcctcagccaaggaaaaatga

SEQ ID NO: 527237 - DNA, 25 bp, Homo sapien
aaatttaaagtatcttgcactgata

SEQ ID NO: 527238 - DNA, 25 bp, Homo sapien
ggcagtgttacaaaatgttcagttt

SEQ ID NO: 527239 - DNA, 25 bp, Homo sapien
cccatcagataccagtgccatgctt

SEQ ID NO: 527240 - DNA, 25 bp, Homo sapien
ccatcagataccagtgccatgcttc

SEQ ID NO: 527241 - DNA, 25 bp, Homo sapien
tctcatgagatctggcacttcaccc

SEQ ID NO: 527242 - DNA, 25 bp, Homo sapien
ttaccgagtctcaggcactttttat

SEQ ID NO: 527243 - DNA, 25 bp, Homo sapien
taccgagtctcaggcactttttata

SEQ ID NO: 527244 - DNA, 25 bp, Homo sapien
ccgagtctcaggcactttttatagc

SEQ ID NO: 527245 - DNA, 25 bp, Homo sapien
cgagtctcaggcactttttatagca

SEQ ID NO: 527246 - DNA, 25 bp, Homo sapien
atgagatctggcacttcacccctca

SEQ ID NO: 527247 - DNA, 25 bp, Homo sapien
ggactaatacatatactttagcata

SEQ ID NO: 527248 - DNA, 25 bp, Homo sapien
atgtggagtgctcactccccttttg

SEQ ID NO: 527249 - DNA, 25 bp, Homo sapien
tggagtgctcactccccttttgcct

SEQ ID NO: 527250 - DNA, 25 bp, Homo sapien
gggtagcagaggtacatcttgactt

SEQ ID NO: 527251 - DNA, 25 bp, Homo sapien
atcttgacttaccacagtttctttc

SEQ ID NO: 527252 - DNA, 25 bp, Homo sapien
tattttattctttactcctggcaag

SEQ ID NO: 527253 - DNA, 25 bp, Homo sapien
ttattctttactcctggcaagctgt

SEQ ID NO: 527254 - DNA, 25 bp, Homo sapien
agctgtgacacagttattttcaaga

SEQ ID NO: 527255 - DNA, 25 bp, Homo sapien
gatgtaatatactacttcatgcgta

SEQ ID NO: 527256 - DNA, 25 bp, Homo sapien
ctacttcatgcgtaagaactgtaca

SEQ ID NO: 527257 - DNA, 25 bp, Homo sapien
tatataccttttttgccagtcccaa

SEQ ID NO: 527258 - DNA, 25 bp, Homo sapien
gccagtcccaattttatgcagttgt

SEQ ID NO: 527259 - DNA, 25 bp, Homo sapien
gaccacttaggttttaatgtgtact

SEQ ID NO: 527260 - DNA, 25 bp, Homo sapien
aacagtaagcagtctcttctgttga

SEQ ID NO: 527261 - DNA, 25 bp, Homo sapien
tggcaggatgaatcacttgacacat

SEQ ID NO: 527262 - DNA, 25 bp, Homo sapien
cacttgacacataggtagatacttg

SEQ ID NO: 527263 - DNA, 25 bp, Homo sapien
tagatacttgaggttcattttcttt

SEQ ID NO: 527264 - DNA, 25 bp, Homo sapien
agatacttgaggttcattttctttt

SEQ ID NO: 527265 - DNA, 25 bp, Homo sapien
atgttttcttctctgatttgttcaa

SEQ ID NO: 527266 - DNA, 25 bp, Homo sapien
gaaaacacaaaaccagtacagtact

SEQ ID NO: 527267 - DNA, 25 bp, Homo sapien
aaaccagtacagtacttactgataa

SEQ ID NO: 527268 - DNA, 25 bp, Homo sapien
accagtacagtacttactgataaat

SEQ ID NO: 527269 - DNA, 25 bp, Homo sapien
agtacagtacttactgataaatcgt

SEQ ID NO: 527270 - DNA, 25 bp, Homo sapien
aaatcgtagtgactgtaatttgttt

SEQ ID NO: 527271 - DNA, 25 bp, Homo sapien
taatgctctacaattaaagctggat

SEQ ID NO: 527272 - DNA, 25 bp, Homo sapien
cataatggccccaggtgtacatgtc

SEQ ID NO: 527273 - DNA, 25 bp, Homo sapien
tgtacatgtcatcaggtccagtgct

SEQ ID NO: 527274 - DNA, 25 bp, Homo sapien
caggtccagtgcttgcaagagacaa

SEQ ID NO: 527275 - DNA, 25 bp, Homo sapien
gctggtgactctgtcctgattccag

SEQ ID NO: 527276 - DNA, 25 bp, Homo sapien
gattccagcttctcagcttaggtga

SEQ ID NO: 527277 - DNA, 25 bp, Homo sapien
tcagcttaggtgaagtcccaccaac

SEQ ID NO: 527278 - DNA, 25 bp, Homo sapien
taatgaggaactctggatctaaggc

SEQ ID NO: 527279 - DNA, 25 bp, Homo sapien
aataatggatgaccggtgccacccc

SEQ ID NO: 527280 - DNA, 25 bp, Homo sapien
cctaatgggagatggtgttcagaga

SEQ ID NO: 527281 - DNA, 25 bp, Homo sapien
aagaggtgtgctcctccacagaaaa

SEQ ID NO: 527282 - DNA, 25 bp, Homo sapien
aactgtaaaatcaaggctacggtgg

SEQ ID NO: 527283 - DNA, 25 bp, Homo sapien
ggacatgctgaattctggatctcta

SEQ ID NO: 527284 - DNA, 25 bp, Homo sapien
ttctggatctctaagggtgcctgga

SEQ ID NO: 527285 - DNA, 25 bp, Homo sapien
aagagagccacattctcagggtctc

SEQ ID NO: 527286 - DNA, 25 bp, Homo sapien
gtgtgcttgcggacttgatgactga

SEQ ID NO: 527287 - DNA, 25 bp, Homo sapien
tgatgactgatgttgcctctgcagc

SEQ ID NO: 527288 - DNA, 25 bp, Homo sapien
gggttcaacactgggttatgctcgt

SEQ ID NO: 527289 - DNA, 25 bp, Homo sapien
gttatgctcgttttttcctggagtc

SEQ ID NO: 527290 - DNA, 25 bp, Homo sapien
tggagtcagtgctgctagcttcatg

SEQ ID NO: 527291 - DNA, 25 bp, Homo sapien
tagcttcatgttgctctgcgacaat

SEQ ID NO: 527292 - DNA, 25 bp, Homo sapien
aactcctcaatttaaatccgccttg

SEQ ID NO: 527293 - DNA, 25 bp, Homo sapien
gccttgagcaaacgttctctgtggt

SEQ ID NO: 527294 - DNA, 25 bp, Homo sapien
taggaggcaccaggaaatcccgcgg

SEQ ID NO: 527295 - DNA, 25 bp, Homo sapien
tggcccatgcagaccaggcgcacgt

SEQ ID NO: 527296 - DNA, 25 bp, Homo sapien
ggcagaattgccaaggacagctcac

SEQ ID NO: 527297 - DNA, 25 bp, Homo sapien
ggacagctcacgacagtgccacctt

SEQ ID NO: 527298 - DNA, 25 bp, Homo sapien
ttctcaccattccagccaaggagag

SEQ ID NO: 527299 - DNA, 25 bp, Homo sapien
accattccagccaaggagagatgtg

SEQ ID NO: 527300 - DNA, 25 bp, Homo sapien
atgtgacgttggaactgctctggca

SEQ ID NO: 527301 - DNA, 25 bp, Homo sapien
attgccttgagatctctgctctttg

SEQ ID NO: 527302 - DNA, 25 bp, Homo sapien
tctgctctttgtcagagatttgcaa

SEQ ID NO: 527303 - DNA, 25 bp, Homo sapien
gcaaagactcacgtttttgttgttt

SEQ ID NO: 527304 - DNA, 25 bp, Homo sapien
ttctcatcattccattgtgatacta

SEQ ID NO: 527305 - DNA, 25 bp, Homo sapien
ggaacgaaactgacgtctacctcat

SEQ ID NO: 527306 - DNA, 25 bp, Homo sapien
acgaaactgacgtctacctcatggg

SEQ ID NO: 527307 - DNA, 25 bp, Homo sapien
gtgggtttgggaggcaaaaatctat

SEQ ID NO: 527308 - DNA, 25 bp, Homo sapien
aatcccataggtgccacatctatga

SEQ ID NO: 527309 - DNA, 25 bp, Homo sapien
aggtgccacatctatgagatgtttg

SEQ ID NO: 527310 - DNA, 25 bp, Homo sapien
gtgaatatgcttttacatttgggct

SEQ ID NO: 527311 - DNA, 25 bp, Homo sapien
tacatttgggcttatctaatttgca

SEQ ID NO: 527312 - DNA, 25 bp, Homo sapien
taatttgcaataagagagcctctct

SEQ ID NO: 527313 - DNA, 25 bp, Homo sapien
gagagcctctctctatcaacaccag

SEQ ID NO: 527314 - DNA, 25 bp, Homo sapien
tctctcgggctgtttgctcagggaa

SEQ ID NO: 527315 - DNA, 25 bp, Homo sapien
cctctgccttctctaaagtgctgtt

SEQ ID NO: 527316 - DNA, 25 bp, Homo sapien
aatttcaatagccatgtgtgatctg

SEQ ID NO: 527317 - DNA, 25 bp, Homo sapien
agccatgtgtgatctgtgactacca

SEQ ID NO: 527318 - DNA, 25 bp, Homo sapien
tctatatctgtgctacccaatacag

SEQ ID NO: 527319 - DNA, 25 bp, Homo sapien
gtgtgatctgtgactaccatgttag

SEQ ID NO: 527320 - DNA, 25 bp, Homo sapien
gactaccatgttaggcagcacagct

SEQ ID NO: 527321 - DNA, 25 bp, Homo sapien
agcacagctttatgagattaatatt

SEQ ID NO: 527322 - DNA, 25 bp, Homo sapien
gcattgtgagagaacagttacgtga

SEQ ID NO: 527323 - DNA, 25 bp, Homo sapien
tataaggaagcatagagctcatggg

SEQ ID NO: 527324 - DNA, 25 bp, Homo sapien
gagccagtcagaatcgcatttttaa

SEQ ID NO: 527325 - DNA, 25 bp, Homo sapien
ttagtgtcttgctgcatatagctat

SEQ ID NO: 527326 - DNA, 25 bp, Homo sapien
tgtcttgctgcatatagctattgag

SEQ ID NO: 527327 - DNA, 25 bp, Homo sapien
ttgttccgcaacactaaggcagccg

SEQ ID NO: 527328 - DNA, 25 bp, Homo sapien
cattggtggtgtcaagaacatgctc

SEQ ID NO: 527329 - DNA, 25 bp, Homo sapien
gaacatgctcttggagtggtgccga

SEQ ID NO: 527330 - DNA, 25 bp, Homo sapien
gagtggtgccgagccatgacaaaaa

SEQ ID NO: 527331 - DNA, 25 bp, Homo sapien
aaaaatacgagcatgtggacatcca

SEQ ID NO: 527332 - DNA, 25 bp, Homo sapien
cctccagctggagcagtggtatggc

SEQ ID NO: 527333 - DNA, 25 bp, Homo sapien
gagcagtggtatggccttctgtgcc

SEQ ID NO: 527334 - DNA, 25 bp, Homo sapien
acaagttcttccctgacgcctttga

SEQ ID NO: 527335 - DNA, 25 bp, Homo sapien
acgcctttgactacgcagagctgga

SEQ ID NO: 527336 - DNA, 25 bp, Homo sapien
gcagagctggatcccgcaaagcgcc

SEQ ID NO: 527337 - DNA, 25 bp, Homo sapien
tggatcccgcaaagcgccggcacaa

SEQ ID NO: 527338 - DNA, 25 bp, Homo sapien
aatgatttacatgaggagagagcct

SEQ ID NO: 527339 - DNA, 25 bp, Homo sapien
ggagagagcctgtatatctgacttg

SEQ ID NO: 527340 - DNA, 25 bp, Homo sapien
gagcctgtatatctgacttgggaaa

SEQ ID NO: 527341 - DNA, 25 bp, Homo sapien
gggaaacattaagcagaccctattt

SEQ ID NO: 527342 - DNA, 25 bp, Homo sapien
cctattttcactggcgcggtaataa

SEQ ID NO: 527343 - DNA, 25 bp, Homo sapien
cactggcgcggtaataactatttat

SEQ ID NO: 527344 - DNA, 25 bp, Homo sapien
ctgggaatgagcctacgtgcgactt

SEQ ID NO: 527345 - DNA, 25 bp, Homo sapien
agcctacgtgcgactttgatgagat

SEQ ID NO: 527346 - DNA, 25 bp, Homo sapien
tggtgttggaacgaccacatagcaa

SEQ ID NO: 527347 - DNA, 25 bp, Homo sapien
ttttttattgtaacactctgtgtaa

SEQ ID NO: 527348 - DNA, 25 bp, Homo sapien
ctctgtgtaaacgttgacaccttat

SEQ ID NO: 527349 - DNA, 25 bp, Homo sapien
gaaggcagggtctatttacacaatt

SEQ ID NO: 527350 - DNA, 25 bp, Homo sapien
gggtctatttacacaattaagctga

SEQ ID NO: 527351 - DNA, 25 bp, Homo sapien
tatattttgctattactgtatgtgt

SEQ ID NO: 527352 - DNA, 25 bp, Homo sapien
gtgtatgtgactgctcaagcacttt

SEQ ID NO: 527353 - DNA, 25 bp, Homo sapien
gactgctcaagcactttgtaaagaa

SEQ ID NO: 527354 - DNA, 25 bp, Homo sapien
gatattttagaatggtacactatgc

SEQ ID NO: 527355 - DNA, 25 bp, Homo sapien
atggtacactatgcattcaaatgaa

SEQ ID NO: 527356 - DNA, 25 bp, Homo sapien
gaaatgtgcctttcactatgtcatt

SEQ ID NO: 527357 - DNA, 25 bp, Homo sapien
gtgcctttcactatgtcattctaag

SEQ ID NO: 527358 - DNA, 25 bp, Homo sapien
acaagtgttttttgcagtcataaat

SEQ ID NO: 527359 - DNA, 25 bp, Homo sapien
gttttttgcagtcataaattatcac

SEQ ID NO: 527360 - DNA, 25 bp, Homo sapien
aatccaaaactttagctgtatttca

SEQ ID NO: 527361 - DNA, 25 bp, Homo sapien
atccaaaactttagctgtatttcag

SEQ ID NO: 527362 - DNA, 25 bp, Homo sapien
tccaaaactttagctgtatttcagt

SEQ ID NO: 527363 - DNA, 25 bp, Homo sapien
aacaaaaacataccttactagactg

SEQ ID NO: 527364 - DNA, 25 bp, Homo sapien
caaaaacataccttactagactgtg

SEQ ID NO: 527365 - DNA, 25 bp, Homo sapien
cttactagactgtgatggctcacac

SEQ ID NO: 527366 - DNA, 25 bp, Homo sapien
agtgaattctgatcgcaccactgaa

SEQ ID NO: 527367 - DNA, 25 bp, Homo sapien
caaacaacgtatcttactgactaaa

SEQ ID NO: 527368 - DNA, 25 bp, Homo sapien
aacaacgtatcttactgactaaact

SEQ ID NO: 527369 - DNA, 25 bp, Homo sapien
aacgtatcttactgactaaactgga

SEQ ID NO: 527370 - DNA, 25 bp, Homo sapien
acgtatcttactgactaaactggaa

SEQ ID NO: 527371 - DNA, 25 bp, Homo sapien
atcagtttggcttcattaactatga

SEQ ID NO: 527372 - DNA, 25 bp, Homo sapien
gcaagaagctctttttccatgtgaa

SEQ ID NO: 527373 - DNA, 25 bp, Homo sapien
tcaggatggcattgagctacaggca

SEQ ID NO: 527374 - DNA, 25 bp, Homo sapien
ggtggagttctcagtgattcttaat

SEQ ID NO: 527375 - DNA, 25 bp, Homo sapien
gattcttaatcagcgcactggcaag

SEQ ID NO: 527376 - DNA, 25 bp, Homo sapien
actggcaagtgcagcgcctgtaatg

SEQ ID NO: 527377 - DNA, 25 bp, Homo sapien
tttggcgagtctgtgagggccccaa

SEQ ID NO: 527378 - DNA, 25 bp, Homo sapien
agggccccaaggctgttgcagctcc

SEQ ID NO: 527379 - DNA, 25 bp, Homo sapien
ttgcagctcctcgacctgatcggtt

SEQ ID NO: 527380 - DNA, 25 bp, Homo sapien
ctgatcggttggtcaatcgcttgaa

SEQ ID NO: 527381 - DNA, 25 bp, Homo sapien
atcgcttgaagaatatcactctgga

SEQ ID NO: 527382 - DNA, 25 bp, Homo sapien
tttctcacgctcccgttctttttct

SEQ ID NO: 527383 - DNA, 25 bp, Homo sapien
gatgccaagcttctcatccaatcgt

SEQ ID NO: 527384 - DNA, 25 bp, Homo sapien
aagcttctcatccaatcgtttcagt

SEQ ID NO: 527385 - DNA, 25 bp, Homo sapien
gcttctcatccaatcgtttcagttt

SEQ ID NO: 527386 - DNA, 25 bp, Homo sapien
tctcatccaatcgtttcagtttctc

SEQ ID NO: 527387 - DNA, 25 bp, Homo sapien
tcatccaatcgtttcagtttctccg

SEQ ID NO: 527388 - DNA, 25 bp, Homo sapien
atccaatcgtttcagtttctccgca

SEQ ID NO: 527389 - DNA, 25 bp, Homo sapien
aatcgtttcagtttctccgcacaag

SEQ ID NO: 527390 - DNA, 25 bp, Homo sapien
gtttcagtttctccgcacaagctgc

SEQ ID NO: 527391 - DNA, 25 bp, Homo sapien
tcagtttctccgcacaagctgcctt

SEQ ID NO: 527392 - DNA, 25 bp, Homo sapien
gcacaagctgccttcctttgttctt

SEQ ID NO: 527393 - DNA, 25 bp, Homo sapien
aaatcattgtcattgggcctcagta

SEQ ID NO: 527394 - DNA, 25 bp, Homo sapien
gtcattgggcctcagtagtaaatct

SEQ ID NO: 527395 - DNA, 25 bp, Homo sapien
gaagtcttgcttcagtcgctattaa

SEQ ID NO: 527396 - DNA, 25 bp, Homo sapien
gtcttgcttcagtcgctattaatat

SEQ ID NO: 527397 - DNA, 25 bp, Homo sapien
gcttcagtcgctattaatattacca

SEQ ID NO: 527398 - DNA, 25 bp, Homo sapien
cagtcgctattaatattaccaagta

SEQ ID NO: 527399 - DNA, 25 bp, Homo sapien
caggcagagtttatcataatgttat

SEQ ID NO: 527400 - DNA, 25 bp, Homo sapien
gtaattatgtgtgatttgtaggtat

SEQ ID NO: 527401 - DNA, 25 bp, Homo sapien
gtaggtattaaagaacttagctaat

SEQ ID NO: 527402 - DNA, 25 bp, Homo sapien
gctaattgaatttacatggaactaa

SEQ ID NO: 527403 - DNA, 25 bp, Homo sapien
taaaatctttactactgagccccaa

SEQ ID NO: 527404 - DNA, 25 bp, Homo sapien
acccgcgtcgtggtgtagtcataga

SEQ ID NO: 527405 - DNA, 25 bp, Homo sapien
ggtgtagtcatagagctgcaagctg

SEQ ID NO: 527406 - DNA, 25 bp, Homo sapien
gggatggttgttgacccctctctcc

SEQ ID NO: 527407 - DNA, 25 bp, Homo sapien
gttgttgacccctctctcctagaga

SEQ ID NO: 527408 - DNA, 25 bp, Homo sapien
agaccttgaggctggcacggcgact

SEQ ID NO: 527409 - DNA, 25 bp, Homo sapien
ttgaggctggcacggcgactcccaa

SEQ ID NO: 527410 - DNA, 25 bp, Homo sapien
aactcagcctgctctcactacgagt

SEQ ID NO: 527411 - DNA, 25 bp, Homo sapien
ctgctctcactacgagttttcatac

SEQ ID NO: 527412 - DNA, 25 bp, Homo sapien
tacgagttttcatactctgcctccc

SEQ ID NO: 527413 - DNA, 25 bp, Homo sapien
atggatctggtggaccgatgctgtc

SEQ ID NO: 527414 - DNA, 25 bp, Homo sapien
tggaccgatgctgtcagaactggga

SEQ ID NO: 527415 - DNA, 25 bp, Homo sapien
gctggtggacagcataaagaactac

SEQ ID NO: 527416 - DNA, 25 bp, Homo sapien
agcataaagaactaccgctcccggg

SEQ ID NO: 527417 - DNA, 25 bp, Homo sapien
agaactaccgctcccgggcgactat

SEQ ID NO: 527418 - DNA, 25 bp, Homo sapien
tcccgggcgactatctttgagatca

SEQ ID NO: 527419 - DNA, 25 bp, Homo sapien
actatctttgagatcaacgcctcca

SEQ ID NO: 527420 - DNA, 25 bp, Homo sapien
tatctttgagatcaacgcctccagc

SEQ ID NO: 527421 - DNA, 25 bp, Homo sapien
cgagacctgtgcagccaggtgatgc

SEQ ID NO: 527422 - DNA, 25 bp, Homo sapien
acctgtgcagccaggtgatgcgcgc

SEQ ID NO: 527423 - DNA, 25 bp, Homo sapien
gcagaaggaccgcaaggccatcgcc

SEQ ID NO: 527424 - DNA, 25 bp, Homo sapien
agaaggaccgcaaggccatcgcccg

SEQ ID NO: 527425 - DNA, 25 bp, Homo sapien
cgagccgcccagcactgcaggagaa

SEQ ID NO: 527426 - DNA, 25 bp, Homo sapien
aaaaattcaatttactgcatgcaga

SEQ ID NO: 527427 - DNA, 25 bp, Homo sapien
gcatgcagactgtttcttgactgaa

SEQ ID NO: 527428 - DNA, 25 bp, Homo sapien
aattcctttcattcagaatcagtat

SEQ ID NO: 527429 - DNA, 25 bp, Homo sapien
agtatgcatattcactggctatatt

SEQ ID NO: 527430 - DNA, 25 bp, Homo sapien
ggctatatttcatctcacatctgca

SEQ ID NO: 527431 - DNA, 25 bp, Homo sapien
tttttcctttcttggtcatcagaag

SEQ ID NO: 527432 - DNA, 25 bp, Homo sapien
aaattttagtccaggcaatagatcc

SEQ ID NO: 527433 - DNA, 25 bp, Homo sapien
gcaatagatcctacttggcaagctc

SEQ ID NO: 527434 - DNA, 25 bp, Homo sapien
cttggcaagctcaaaataactcaat

SEQ ID NO: 527435 - DNA, 25 bp, Homo sapien
agcagcacacaaagaccagtagtga

SEQ ID NO: 527436 - DNA, 25 bp, Homo sapien
gaccagtagtgacttccaaaggatt

SEQ ID NO: 527437 - DNA, 25 bp, Homo sapien
tctttgtggtcatcattgaatatac

SEQ ID NO: 527438 - DNA, 25 bp, Homo sapien
gtgagcaaaataccgaatactgaat

SEQ ID NO: 527439 - DNA, 25 bp, Homo sapien
taagtattaggacttcatatgcaac

SEQ ID NO: 527440 - DNA, 25 bp, Homo sapien
acttgaatttttggtgctgtccgga

SEQ ID NO: 527441 - DNA, 25 bp, Homo sapien
aatttttggtgctgtccggagtcta

SEQ ID NO: 527442 - DNA, 25 bp, Homo sapien
agtctagagccccacaatctgtttt

SEQ ID NO: 527443 - DNA, 25 bp, Homo sapien
agccccacaatctgttttggttaca

SEQ ID NO: 527444 - DNA, 25 bp, Homo sapien
ctgttttggttacagtttatccctg

SEQ ID NO: 527445 - DNA, 25 bp, Homo sapien
atccctgtaggataaatgatccatt

SEQ ID NO: 527446 - DNA, 25 bp, Homo sapien
gatccatttaactattcatcagagg

SEQ ID NO: 527447 - DNA, 25 bp, Homo sapien
ttaaattgtctcttgtctccttcag

SEQ ID NO: 527448 - DNA, 25 bp, Homo sapien
tgaagccaaaggagccgatgacgca

SEQ ID NO: 527449 - DNA, 25 bp, Homo sapien
gccgatgacgcagcagacgcagaca

SEQ ID NO: 527450 - DNA, 25 bp, Homo sapien
gacgcagacacagctataatcaatg

SEQ ID NO: 527451 - DNA, 25 bp, Homo sapien
gacacagctataatcaatgcagaag

SEQ ID NO: 527452 - DNA, 25 bp, Homo sapien
ggaggacagaacaactccgaagaaa

SEQ ID NO: 527453 - DNA, 25 bp, Homo sapien
gagtacttcatctagatcagccttt

SEQ ID NO: 527454 - DNA, 25 bp, Homo sapien
agatcagcctttttgtttcaatgag

SEQ ID NO: 527455 - DNA, 25 bp, Homo sapien
tttcaatgaggtgtccaactggccc

SEQ ID NO: 527456 - DNA, 25 bp, Homo sapien
gtccaactggccctatttagatgat

SEQ ID NO: 527457 - DNA, 25 bp, Homo sapien
gagacagtgatattggaacttgcga

SEQ ID NO: 527458 - DNA, 25 bp, Homo sapien
gaacttgcgagaaattcgtgtgttt

SEQ ID NO: 527459 - DNA, 25 bp, Homo sapien
tgatttccttcagttatcttccaaa

SEQ ID NO: 527460 - DNA, 25 bp, Homo sapien
acattgttctctatgcacttctcaa

SEQ ID NO: 527461 - DNA, 25 bp, Homo sapien
tatgcacttctcaatacattttcat

SEQ ID NO: 527462 - DNA, 25 bp, Homo sapien
ttctcaagcctctttgtggatgact

SEQ ID NO: 527463 - DNA, 25 bp, Homo sapien
gtggatgactcctaaatataacttc

SEQ ID NO: 527464 - DNA, 25 bp, Homo sapien
aaatataacttcttccactagctct

SEQ ID NO: 527465 - DNA, 25 bp, Homo sapien
actagctctagatccgtatttccaa

SEQ ID NO: 527466 - DNA, 25 bp, Homo sapien
aaaatcccctacctgaatattcaag

SEQ ID NO: 527467 - DNA, 25 bp, Homo sapien
gttaaacatgtccagaatacttact

SEQ ID NO: 527468 - DNA, 25 bp, Homo sapien
taatagccactattctgttgtctgg

SEQ ID NO: 527469 - DNA, 25 bp, Homo sapien
aactaatttgcatccctttatcttc

SEQ ID NO: 527470 - DNA, 25 bp, Homo sapien
tttgggaccaactgcagtggttgtt

SEQ ID NO: 527471 - DNA, 25 bp, Homo sapien
ggttgtttaaaatgctggttcctgc

SEQ ID NO: 527472 - DNA, 25 bp, Homo sapien
ctgcacacaattctctatctactga

SEQ ID NO: 527473 - DNA, 25 bp, Homo sapien
tactgaagcacatctgttttctttg

SEQ ID NO: 527474 - DNA, 25 bp, Homo sapien
cccagtgattccagtgcacctgaaa

SEQ ID NO: 527475 - DNA, 25 bp, Homo sapien
aaaagttgagaaccacaggcttagt

SEQ ID NO: 527476 - DNA, 25 bp, Homo sapien
gggtttcccacgctaggctgcatag

SEQ ID NO: 527477 - DNA, 25 bp, Homo sapien
ggctgcatagcattataacctggga

SEQ ID NO: 527478 - DNA, 25 bp, Homo sapien
cagacattcttgattcttagtgtag

SEQ ID NO: 527479 - DNA, 25 bp, Homo sapien
cttagtgtagttatgatgtggatcc

SEQ ID NO: 527480 - DNA, 25 bp, Homo sapien
gatgtggatcctacgtattttttaa

SEQ ID NO: 527481 - DNA, 25 bp, Homo sapien
gctagatactgagctttgatagaat

SEQ ID NO: 527482 - DNA, 25 bp, Homo sapien
tgatgtgtcatctctgaccttgttt

SEQ ID NO: 527483 - DNA, 25 bp, Homo sapien
tctgaccttgtttcagcaaagtaaa

SEQ ID NO: 527484 - DNA, 25 bp, Homo sapien
tcagcaaagtaaacagcactcccca

SEQ ID NO: 527485 - DNA, 25 bp, Homo sapien
ttactcatcttggaaaaggttagtc

SEQ ID NO: 527486 - DNA, 25 bp, Homo sapien
ggttagtctttcagtacacgttact

SEQ ID NO: 527487 - DNA, 25 bp, Homo sapien
gtctttcagtacacgttactggtaa

SEQ ID NO: 527488 - DNA, 25 bp, Homo sapien
gtagtttccaagttacgtgttgtca

SEQ ID NO: 527489 - DNA, 25 bp, Homo sapien
acgtgttgtcactgggttgaagtat

SEQ ID NO: 527490 - DNA, 25 bp, Homo sapien
gtgtgtaaccataaactatattcat

SEQ ID NO: 527491 - DNA, 25 bp, Homo sapien
catatctgtttcatttggaggattt

SEQ ID NO: 527492 - DNA, 25 bp, Homo sapien
cttgcgagacttcaccaggttgttt

SEQ ID NO: 527493 - DNA, 25 bp, Homo sapien
caggttgtttcgatagctcacactc

SEQ ID NO: 527494 - DNA, 25 bp, Homo sapien
caaaaaccagactgtgtcccacaat

SEQ ID NO: 527495 - DNA, 25 bp, Homo sapien
accagactgtgtcccacaatcagaa

SEQ ID NO: 527496 - DNA, 25 bp, Homo sapien
tgtgtcccacaatcagaaacctccg

SEQ ID NO: 527497 - DNA, 25 bp, Homo sapien
aatcagaaacctccgttgtggcaga

SEQ ID NO: 527498 - DNA, 25 bp, Homo sapien
cagaaacctccgttgtggcagaggg

SEQ ID NO: 527499 - DNA, 25 bp, Homo sapien
gccttctgaggccatcctgaggagt

SEQ ID NO: 527500 - DNA, 25 bp, Homo sapien
aggccatcctgaggagttcctgttt

SEQ ID NO: 527501 - DNA, 25 bp, Homo sapien
gagggaaaatcagcgcggattttaa

SEQ ID NO: 527502 - DNA, 25 bp, Homo sapien
aaaaagatggctgtggcctgcccgg

SEQ ID NO: 527503 - DNA, 25 bp, Homo sapien
gaaactctggaaatcacgtgtgtgg

SEQ ID NO: 527504 - DNA, 25 bp, Homo sapien
gtgatggctgcagttgccgtgcctc

SEQ ID NO: 527505 - DNA, 25 bp, Homo sapien
agttgccgtgcctctgttggaacgc

SEQ ID NO: 527506 - DNA, 25 bp, Homo sapien
aagtgcctgcaactcacgtcaatca

SEQ ID NO: 527507 - DNA, 25 bp, Homo sapien
gcctgcaactcacgtcaatcataga

SEQ ID NO: 527508 - DNA, 25 bp, Homo sapien
caatcatagaattgtgacgcacagt

SEQ ID NO: 527509 - DNA, 25 bp, Homo sapien
attgtgacgcacagttggcaaaata

SEQ ID NO: 527510 - DNA, 25 bp, Homo sapien
cacagttggcaaaatagttctttat

SEQ ID NO: 527511 - DNA, 25 bp, Homo sapien
tagttctttatgctatttctcaaaa

SEQ ID NO: 527512 - DNA, 25 bp, Homo sapien
tttgaggacaaacccagattgggat

SEQ ID NO: 527513 - DNA, 25 bp, Homo sapien
ttgggattggaatatgcactgtaaa

SEQ ID NO: 527514 - DNA, 25 bp, Homo sapien
ggtggcaggctcctcgggaggctga

SEQ ID NO: 527515 - DNA, 25 bp, Homo sapien
ggcatgaacccggtaggcagaagtt

SEQ ID NO: 527516 - DNA, 25 bp, Homo sapien
gcatgaacccggtaggcagaagttg

SEQ ID NO: 527517 - DNA, 25 bp, Homo sapien
atgaacccggtaggcagaagttgca

SEQ ID NO: 527518 - DNA, 25 bp, Homo sapien
gacaaaataatcctaaaaatgtata

SEQ ID NO: 527519 - DNA, 25 bp, Homo sapien
atgtatatgaaaatgcagaggatgc

SEQ ID NO: 527520 - DNA, 25 bp, Homo sapien
tgtatatgaaaatgcagaggatgca

SEQ ID NO: 527521 - DNA, 25 bp, Homo sapien
gtatatgaaaatgcagaggatgcag

SEQ ID NO: 527522 - DNA, 25 bp, Homo sapien
tatatgaaaatgcagaggatgcaga

SEQ ID NO: 527523 - DNA, 25 bp, Homo sapien
aaatgcagaggatgcagaagggcca

SEQ ID NO: 527524 - DNA, 25 bp, Homo sapien
aatgcagaggatgcagaagggccaa

SEQ ID NO: 527525 - DNA, 25 bp, Homo sapien
gttaagttgctagacactgcgaaac

SEQ ID NO: 527526 - DNA, 25 bp, Homo sapien
actgcgaaaccaagctgactcacaa

SEQ ID NO: 527527 - DNA, 25 bp, Homo sapien
aaaatagcaacccttcatttgctct

SEQ ID NO: 527528 - DNA, 25 bp, Homo sapien
catttgctctctgtgccaccaatag

SEQ ID NO: 527529 - DNA, 25 bp, Homo sapien
gtgccaccaatagcttctgagtttt

SEQ ID NO: 527530 - DNA, 25 bp, Homo sapien
aagtaccattctaatacttcttcaa

SEQ ID NO: 527531 - DNA, 25 bp, Homo sapien
cttcttcaaaagtggctcctcattg

SEQ ID NO: 527532 - DNA, 25 bp, Homo sapien
gctcctcattgtacttcagcgtaaa

SEQ ID NO: 527533 - DNA, 25 bp, Homo sapien
agcgtaaatatgagcactggaaaca

SEQ ID NO: 527534 - DNA, 25 bp, Homo sapien
gtgaacatcggccatgaaaatccat

SEQ ID NO: 527535 - DNA, 25 bp, Homo sapien
gaaaatccatcacgaatacttttgg

SEQ ID NO: 527536 - DNA, 25 bp, Homo sapien
agtactatttacatatctgcattta

SEQ ID NO: 527537 - DNA, 25 bp, Homo sapien
tacttcctttacattattctcctat

SEQ ID NO: 527538 - DNA, 25 bp, Homo sapien
aacaaattgtccagtggcctcctgt

SEQ ID NO: 527539 - DNA, 25 bp, Homo sapien
ttatactccttaattccatgcaaat

SEQ ID NO: 527540 - DNA, 25 bp, Homo sapien
taaaattttaaatctgtagcctggg

SEQ ID NO: 527541 - DNA, 25 bp, Homo sapien
tagcctgggtgtacgtttcactcaa

SEQ ID NO: 527542 - DNA, 25 bp, Homo sapien
tgtacgtttcactcaagttctccta

SEQ ID NO: 527543 - DNA, 25 bp, Homo sapien
tcaagttctcctactgaggactctt

SEQ ID NO: 527544 - DNA, 25 bp, Homo sapien
gactaacagcatactggcagtttca

SEQ ID NO: 527545 - DNA, 25 bp, Homo sapien
cagtttcaccttaacctgctcgtta

SEQ ID NO: 527546 - DNA, 25 bp, Homo sapien
aacctgctcgttaaataatgtgttg

SEQ ID NO: 527547 - DNA, 25 bp, Homo sapien
tgtttctccatgcttcatgggtgac

SEQ ID NO: 527548 - DNA, 25 bp, Homo sapien
gtttctccatgcttcatgggtgact

SEQ ID NO: 527549 - DNA, 25 bp, Homo sapien
cactgacatttcccaggccagacca

SEQ ID NO: 527550 - DNA, 25 bp, Homo sapien
actgacatttcccaggccagaccat

SEQ ID NO: 527551 - DNA, 25 bp, Homo sapien
ctgacatttcccaggccagaccatg

SEQ ID NO: 527552 - DNA, 25 bp, Homo sapien
tgacatttcccaggccagaccatgc

SEQ ID NO: 527553 - DNA, 25 bp, Homo sapien
gacatttcccaggccagaccatgct

SEQ ID NO: 527554 - DNA, 25 bp, Homo sapien
acatttcccaggccagaccatgctg

SEQ ID NO: 527555 - DNA, 25 bp, Homo sapien
gagccacagcttgggaaggtgttga

SEQ ID NO: 527556 - DNA, 25 bp, Homo sapien
cagggtggattctgagggcttccct

SEQ ID NO: 527557 - DNA, 25 bp, Homo sapien
agggtggattctgagggcttccctc

SEQ ID NO: 527558 - DNA, 25 bp, Homo sapien
gggtggattctgagggcttccctct

SEQ ID NO: 527559 - DNA, 25 bp, Homo sapien
ggtggattctgagggcttccctctg

SEQ ID NO: 527560 - DNA, 25 bp, Homo sapien
ttctgagggcttccctctggagagg

SEQ ID NO: 527561 - DNA, 25 bp, Homo sapien
agcatgtgatgagaggtgtagacag

SEQ ID NO: 527562 - DNA, 25 bp, Homo sapien
gtgtagacagggtcaggctgggaca

SEQ ID NO: 527563 - DNA, 25 bp, Homo sapien
gagtgtctggcaagagtagactggc

SEQ ID NO: 527564 - DNA, 25 bp, Homo sapien
gaaggagaggaggtaagcgagaaaa

SEQ ID NO: 527565 - DNA, 25 bp, Homo sapien
agccggaaatggaggagagaggaca

SEQ ID NO: 527566 - DNA, 25 bp, Homo sapien
tacctttgttgtttatatttgcatg

SEQ ID NO: 527567 - DNA, 25 bp, Homo sapien
atttgcatgttgtttcccacttgaa

SEQ ID NO: 527568 - DNA, 25 bp, Homo sapien
gtattcccagaacaattccctggca

SEQ ID NO: 527569 - DNA, 25 bp, Homo sapien
ttccctggcaaatatttggtactca

SEQ ID NO: 527570 - DNA, 25 bp, Homo sapien
aaaataacgtgtctatggccaaaat

SEQ ID NO: 527571 - DNA, 25 bp, Homo sapien
ataaaacctgaaatccctgtcctat

SEQ ID NO: 527572 - DNA, 25 bp, Homo sapien
tccctgtcctatttcccagaggtaa

SEQ ID NO: 527573 - DNA, 25 bp, Homo sapien
ttcccagaggtaactgctgttaata

SEQ ID NO: 527574 - DNA, 25 bp, Homo sapien
gtttagttgtgtgcttccagacata

SEQ ID NO: 527575 - DNA, 25 bp, Homo sapien
agttgtgtgcttccagacatacctt

SEQ ID NO: 527576 - DNA, 25 bp, Homo sapien
gcttccagacataccttcacagaat

SEQ ID NO: 527577 - DNA, 25 bp, Homo sapien
gcttcaatgactggataatgatatc

SEQ ID NO: 527578 - DNA, 25 bp, Homo sapien
taatgatatctttcatgagagagat

SEQ ID NO: 527579 - DNA, 25 bp, Homo sapien
gaataaagttcagccaaaaggatca

SEQ ID NO: 527580 - DNA, 25 bp, Homo sapien
acacacttagtcttgtaatttcagg

SEQ ID NO: 527581 - DNA, 25 bp, Homo sapien
ttagtcttgtaatttcaggccagaa

SEQ ID NO: 527582 - DNA, 25 bp, Homo sapien
ttcaggccagaaattctcaacacta

SEQ ID NO: 527583 - DNA, 25 bp, Homo sapien
attctcaacactattttgcatctgt

SEQ ID NO: 527584 - DNA, 25 bp, Homo sapien
agatgttctggtctatcataaaaga

SEQ ID NO: 527585 - DNA, 25 bp, Homo sapien
catttcagtcattcggtatgtggct

SEQ ID NO: 527586 - DNA, 25 bp, Homo sapien
agtcattcggtatgtggctttgtaa

SEQ ID NO: 527587 - DNA, 25 bp, Homo sapien
ttcggtatgtggctttgtaaattaa

SEQ ID NO: 527588 - DNA, 25 bp, Homo sapien
ggacttggacccctggttgtcgtca

SEQ ID NO: 527589 - DNA, 25 bp, Homo sapien
ttggacccctggttgtcgtcatcac

SEQ ID NO: 527590 - DNA, 25 bp, Homo sapien
tggttgtcgtcatcactgcagctct

SEQ ID NO: 527591 - DNA, 25 bp, Homo sapien
ttgtcgtcatcactgcagctctcca

SEQ ID NO: 527592 - DNA, 25 bp, Homo sapien
tgtttggcttctctccacctgaagt

SEQ ID NO: 527593 - DNA, 25 bp, Homo sapien
tggcttctctccacctgaagtcaat

SEQ ID NO: 527594 - DNA, 25 bp, Homo sapien
ttctctccacctgaagtcaatgtag

SEQ ID NO: 527595 - DNA, 25 bp, Homo sapien
ctccacctgaagtcaatgtagccat

SEQ ID NO: 527596 - DNA, 25 bp, Homo sapien
cacctgaagtcaatgtagccatctt

SEQ ID NO: 527597 - DNA, 25 bp, Homo sapien
cctgaagtcaatgtagccatcttca

SEQ ID NO: 527598 - DNA, 25 bp, Homo sapien
tgtactccatcctgcccagtttcca

SEQ ID NO: 527599 - DNA, 25 bp, Homo sapien
catgccacgattttgtctttctgtg

SEQ ID NO: 527600 - DNA, 25 bp, Homo sapien
gattttgtctttctgtggactcaac

SEQ ID NO: 527601 - DNA, 25 bp, Homo sapien
tggactcaacattcacttcgattaa

SEQ ID NO: 527602 - DNA, 25 bp, Homo sapien
aatagcaatttgaccaagttggact

SEQ ID NO: 527603 - DNA, 25 bp, Homo sapien
gttggacttccactacaaagcagct

SEQ ID NO: 527604 - DNA, 25 bp, Homo sapien
gctgttttccaaagttcaatgctga

SEQ ID NO: 527605 - DNA, 25 bp, Homo sapien
gacaacgttggcatgttcttttctg

SEQ ID NO: 527606 - DNA, 25 bp, Homo sapien
tgtttgtctattaatgggcctgctt

SEQ ID NO: 527607 - DNA, 25 bp, Homo sapien
agcaattcatgttacttttctggtc

SEQ ID NO: 527608 - DNA, 25 bp, Homo sapien
acttttctggtcttttcatggcata

SEQ ID NO: 527609 - DNA, 25 bp, Homo sapien
tggtcttttcatggcatatgagcaa

SEQ ID NO: 527610 - DNA, 25 bp, Homo sapien
gtcccatccaacactatttggcgac

SEQ ID NO: 527611 - DNA, 25 bp, Homo sapien
atttggcgactgttaatatgttata

SEQ ID NO: 527612 - DNA, 25 bp, Homo sapien
ttattagacagtggaaaagccttta

SEQ ID NO: 527613 - DNA, 25 bp, Homo sapien
tattgactaattgatttaacctcag

SEQ ID NO: 527614 - DNA, 25 bp, Homo sapien
tttaacctcagtccaaagaacagtc

SEQ ID NO: 527615 - DNA, 25 bp, Homo sapien
aagaacagtctctatacttgccctc

SEQ ID NO: 527616 - DNA, 25 bp, Homo sapien
gccctcatttactgataggctgcta

SEQ ID NO: 527617 - DNA, 25 bp, Homo sapien
gataggctgctactagttaccattt

SEQ ID NO: 527618 - DNA, 25 bp, Homo sapien
tactagttaccatttgattgtcttg

SEQ ID NO: 527619 - DNA, 25 bp, Homo sapien
ctttcgtcttcagttgaattggtga

SEQ ID NO: 527620 - DNA, 25 bp, Homo sapien
aaatgttctgcattgtagtcaataa

SEQ ID NO: 527621 - DNA, 25 bp, Homo sapien
atataggtgatcttctttcaagcag

SEQ ID NO: 527622 - DNA, 25 bp, Homo sapien
tttcaagcagtattgatcgaacagc

SEQ ID NO: 527623 - DNA, 25 bp, Homo sapien
gatcgaacagcaacgctccgaaaga

SEQ ID NO: 527624 - DNA, 25 bp, Homo sapien
aacgctccgaaagacagcatctgaa

SEQ ID NO: 527625 - DNA, 25 bp, Homo sapien
aactctgttaagaagacgctaaccg

SEQ ID NO: 527626 - DNA, 25 bp, Homo sapien
agacgctaaccgaactaaagagtga

SEQ ID NO: 527627 - DNA, 25 bp, Homo sapien
gagtgacttcgacaaacatacagat

SEQ ID NO: 527628 - DNA, 25 bp, Homo sapien
aagacagtgacttttgcaaatgatc

SEQ ID NO: 527629 - DNA, 25 bp, Homo sapien
gcaaatgatctaaaaccaaaggtgt

SEQ ID NO: 527630 - DNA, 25 bp, Homo sapien
tcccgtttagaaccattagtaaatg

SEQ ID NO: 527631 - DNA, 25 bp, Homo sapien
taaatgatttaacactacgcattgg

SEQ ID NO: 527632 - DNA, 25 bp, Homo sapien
gttacttacaggactgagacatctt

SEQ ID NO: 527633 - DNA, 25 bp, Homo sapien
gacatcttctgtaaactgctacccc

SEQ ID NO: 527634 - DNA, 25 bp, Homo sapien
tcttctgtaaactgctacccctggg

SEQ ID NO: 527635 - DNA, 25 bp, Homo sapien
agggcacctgcgtggctgacagcca

SEQ ID NO: 527636 - DNA, 25 bp, Homo sapien
gtggctgacagccaggctcttactc

SEQ ID NO: 527637 - DNA, 25 bp, Homo sapien
cagcccagccctgtgaaagatggag

SEQ ID NO: 527638 - DNA, 25 bp, Homo sapien
gggacctgatttatagggcaagaga

SEQ ID NO: 527639 - DNA, 25 bp, Homo sapien
tttatagggcaagagaagtcacact

SEQ ID NO: 527640 - DNA, 25 bp, Homo sapien
ggcctctcagaattcacttgaggtt

SEQ ID NO: 527641 - DNA, 25 bp, Homo sapien
ctcagaattcacttgaggttcaatt

SEQ ID NO: 527642 - DNA, 25 bp, Homo sapien
gaggttcaattaaatacagtcacac

SEQ ID NO: 527643 - DNA, 25 bp, Homo sapien
gctcagtcacttgaagaaactgttg

SEQ ID NO: 527644 - DNA, 25 bp, Homo sapien
gaaactgttgctaaccaagctcttg

SEQ ID NO: 527645 - DNA, 25 bp, Homo sapien
aagctcttgactctgtttcccttaa

SEQ ID NO: 527646 - DNA, 25 bp, Homo sapien
gtttcccttaatgatacaagtctct

SEQ ID NO: 527647 - DNA, 25 bp, Homo sapien
acaagtctctgtaccagcgctttat

SEQ ID NO: 527648 - DNA, 25 bp, Homo sapien
gtaccagcgctttatgttaattacc

SEQ ID NO: 527649 - DNA, 25 bp, Homo sapien
gttaattaccaaaactctcctgcat

SEQ ID NO: 527650 - DNA, 25 bp, Homo sapien
atctgtatacatttcaccaatttat

SEQ ID NO: 527651 - DNA, 25 bp, Homo sapien
gactttgttataccttatttgctac

SEQ ID NO: 527652 - DNA, 25 bp, Homo sapien
gatcatatcattgctactttgactt

SEQ ID NO: 527653 - DNA, 25 bp, Homo sapien
gacttagcatttgcatcataaacat

SEQ ID NO: 527654 - DNA, 25 bp, Homo sapien
ttcaactggtttgtgaacccgctga

SEQ ID NO: 527655 - DNA, 25 bp, Homo sapien
tgaacccgctgaagacctttgtctt

SEQ ID NO: 527656 - DNA, 25 bp, Homo sapien
ttgtcttcttcatctggcgccggta

SEQ ID NO: 527657 - DNA, 25 bp, Homo sapien
cggtactggcgcaccctggtgctgc

SEQ ID NO: 527658 - DNA, 25 bp, Homo sapien
agatcagccaggtcatcttccgtcc

SEQ ID NO: 527659 - DNA, 25 bp, Homo sapien
acaagtgactctcgctgaccttgga

SEQ ID NO: 527660 - DNA, 25 bp, Homo sapien
ttcaatgcctgctcctggaagtctt

SEQ ID NO: 527661 - DNA, 25 bp, Homo sapien
ctggaagtctttcttacccatgtga

SEQ ID NO: 527662 - DNA, 25 bp, Homo sapien
ttacccatgtgagctaccccagagt

SEQ ID NO: 527663 - DNA, 25 bp, Homo sapien
gagtctagtgcttcctctgaataaa

SEQ ID NO: 527664 - DNA, 25 bp, Homo sapien
gtgcttcctctgaataaacctatca

SEQ ID NO: 527665 - DNA, 25 bp, Homo sapien
ctcggctaacgccaagtcgcgcaga

SEQ ID NO: 527666 - DNA, 25 bp, Homo sapien
tcggctaacgccaagtcgcgcagac

SEQ ID NO: 527667 - DNA, 25 bp, Homo sapien
gctaacgccaagtcgcgcagaccta

SEQ ID NO: 527668 - DNA, 25 bp, Homo sapien
ctaacgccaagtcgcgcagacctaa

SEQ ID NO: 527669 - DNA, 25 bp, Homo sapien
cgccaagtcgcgcagacctaaggag

SEQ ID NO: 527670 - DNA, 25 bp, Homo sapien
gccaagtcgcgcagacctaaggaga

SEQ ID NO: 527671 - DNA, 25 bp, Homo sapien
ccaagtcgcgcagacctaaggagaa

SEQ ID NO: 527672 - DNA, 25 bp, Homo sapien
aagtcgcgcagacctaaggagaagc

SEQ ID NO: 527673 - DNA, 25 bp, Homo sapien
gcagacctaaggagaagcgggagaa

SEQ ID NO: 527674 - DNA, 25 bp, Homo sapien
agaggaggaggcacggtctcggtgg

SEQ ID NO: 527675 - DNA, 25 bp, Homo sapien
tgaagccgctgccccgagataaaat

SEQ ID NO: 527676 - DNA, 25 bp, Homo sapien
attacttctgaggtgtaaaccaaat

SEQ ID NO: 527677 - DNA, 25 bp, Homo sapien
tctcaagatttctaggcattttcct

SEQ ID NO: 527678 - DNA, 25 bp, Homo sapien
aggcattttcctatgtctaatagta

SEQ ID NO: 527679 - DNA, 25 bp, Homo sapien
gtctaatagtaggatgttctctctg

SEQ ID NO: 527680 - DNA, 25 bp, Homo sapien
aaacagtcgcaataccagaacacca

SEQ ID NO: 527681 - DNA, 25 bp, Homo sapien
ccagaacaccattgtagtcgtttgt

SEQ ID NO: 527682 - DNA, 25 bp, Homo sapien
gtgacttctttactgtgttcatgca

SEQ ID NO: 527683 - DNA, 25 bp, Homo sapien
tactgtgttcatgcagagacaagct

SEQ ID NO: 527684 - DNA, 25 bp, Homo sapien
gagacaagctttgtaatacctttgt

SEQ ID NO: 527685 - DNA, 25 bp, Homo sapien
aatacctttgtaactactgtacagg

SEQ ID NO: 527686 - DNA, 25 bp, Homo sapien
ctgtacaggtgcgtggttagattcc

SEQ ID NO: 527687 - DNA, 25 bp, Homo sapien
agattaaatagtgtctgaagaggcc

SEQ ID NO: 527688 - DNA, 25 bp, Homo sapien
gattaaatagtgtctgaagaggccg

SEQ ID NO: 527689 - DNA, 25 bp, Homo sapien
attaaatagtgtctgaagaggccgg

SEQ ID NO: 527690 - DNA, 25 bp, Homo sapien
ttaaatagtgtctgaagaggccggg

SEQ ID NO: 527691 - DNA, 25 bp, Homo sapien
taaatagtgtctgaagaggccgggc

SEQ ID NO: 527692 - DNA, 25 bp, Homo sapien
aaatagtgtctgaagaggccgggcg

SEQ ID NO: 527693 - DNA, 25 bp, Homo sapien
aatagtgtctgaagaggccgggcgc

SEQ ID NO: 527694 - DNA, 25 bp, Homo sapien
atagtgtctgaagaggccgggcgcg

SEQ ID NO: 527695 - DNA, 25 bp, Homo sapien
tagtgtctgaagaggccgggcgcgg

SEQ ID NO: 527696 - DNA, 25 bp, Homo sapien
agtgtctgaagaggccgggcgcggt

SEQ ID NO: 527697 - DNA, 25 bp, Homo sapien
gtgtctgaagaggccgggcgcggtg

SEQ ID NO: 527698 - DNA, 25 bp, Homo sapien
atggtctgcctcaaatagtaatgta

SEQ ID NO: 527699 - DNA, 25 bp, Homo sapien
atttttctgcattcacttggatata

SEQ ID NO: 527700 - DNA, 25 bp, Homo sapien
ggaagaggtatgtgctgatttgttt

SEQ ID NO: 527701 - DNA, 25 bp, Homo sapien
gtttggatatttgacaaggcactct

SEQ ID NO: 527702 - DNA, 25 bp, Homo sapien
aaggcactctgatgtgacttccctg

SEQ ID NO: 527703 - DNA, 25 bp, Homo sapien
cactctgatgtgacttccctgacta

SEQ ID NO: 527704 - DNA, 25 bp, Homo sapien
ttccctgactactaccttcatattt

SEQ ID NO: 527705 - DNA, 25 bp, Homo sapien
ctactaccttcatatttcatttcaa

SEQ ID NO: 527706 - DNA, 25 bp, Homo sapien
ttcaaacttctgaggttgcagcata

SEQ ID NO: 527707 - DNA, 25 bp, Homo sapien
acttttgaggtttctgctgtattgt

SEQ ID NO: 527708 - DNA, 25 bp, Homo sapien
gaggtttctgctgtattgtttcaaa

SEQ ID NO: 527709 - DNA, 25 bp, Homo sapien
gtctcctctccatatggtggctgtg

SEQ ID NO: 527710 - DNA, 25 bp, Homo sapien
ttaggctctttgtgtcctcccctag

SEQ ID NO: 527711 - DNA, 25 bp, Homo sapien
gctgtcgtatgcctttgggagcctc

SEQ ID NO: 527712 - DNA, 25 bp, Homo sapien
tgtcgtatgcctttgggagcctctt

SEQ ID NO: 527713 - DNA, 25 bp, Homo sapien
tcgtatgcctttgggagcctcttct

SEQ ID NO: 527714 - DNA, 25 bp, Homo sapien
gggagcctcttctcagggaaactct

SEQ ID NO: 527715 - DNA, 25 bp, Homo sapien
tcagggaaactctgtgtcactaaca

SEQ ID NO: 527716 - DNA, 25 bp, Homo sapien
ggaaactctgtgtcactaacagtgg

SEQ ID NO: 527717 - DNA, 25 bp, Homo sapien
aactctgtgtcactaacagtgggta

SEQ ID NO: 527718 - DNA, 25 bp, Homo sapien
ctctgtgtcactaacagtgggtatg

SEQ ID NO: 527719 - DNA, 25 bp, Homo sapien
tggggtgactgttctgcattcatga

SEQ ID NO: 527720 - DNA, 25 bp, Homo sapien
cgatatgctcttggctagcttttta

SEQ ID NO: 527721 - DNA, 25 bp, Homo sapien
gctcttggctagctttttataagtt

SEQ ID NO: 527722 - DNA, 25 bp, Homo sapien
aacacctggatcaacagtacatctc

SEQ ID NO: 527723 - DNA, 25 bp, Homo sapien
agtacatctcatatgcaatctgcat

SEQ ID NO: 527724 - DNA, 25 bp, Homo sapien
tatgcaatctgcatcagctcctatt

SEQ ID NO: 527725 - DNA, 25 bp, Homo sapien
atcagctcctattctgtctggatgt

SEQ ID NO: 527726 - DNA, 25 bp, Homo sapien
agaactgttggaagattttgacgtc

SEQ ID NO: 527727 - DNA, 25 bp, Homo sapien
gattttgacgtcttaagccctaggt

SEQ ID NO: 527728 - DNA, 25 bp, Homo sapien
ttgacgtcttaagccctaggttttg

SEQ ID NO: 527729 - DNA, 25 bp, Homo sapien
tcttaagccctaggttttgctttgg

SEQ ID NO: 527730 - DNA, 25 bp, Homo sapien
gttcattgcattaagatttgtgtgt

SEQ ID NO: 527731 - DNA, 25 bp, Homo sapien
ttcagtggcaaaaaccgcgatttct

SEQ ID NO: 527732 - DNA, 25 bp, Homo sapien
gcaaaaaccgcgatttcttttgtgc

SEQ ID NO: 527733 - DNA, 25 bp, Homo sapien
ttgtgccaacctaatgcttaaggat

SEQ ID NO: 527734 - DNA, 25 bp, Homo sapien
tatttcagattcatagcaacctaat

SEQ ID NO: 527735 - DNA, 25 bp, Homo sapien
gcaacctaataacaaggatttacaa

SEQ ID NO: 527736 - DNA, 25 bp, Homo sapien
ctgaaggaaggtttttgtattgact

SEQ ID NO: 527737 - DNA, 25 bp, Homo sapien
tgtattgacttggtttaacttacaa

SEQ ID NO: 527738 - DNA, 25 bp, Homo sapien
gacttggtttaacttacaaatcaga

SEQ ID NO: 527739 - DNA, 25 bp, Homo sapien
gaaaccaagaaacattatccttatt

SEQ ID NO: 527740 - DNA, 25 bp, Homo sapien
gctatataatagtaaacctgttttt

SEQ ID NO: 527741 - DNA, 25 bp, Homo sapien
tttttccagagaattgggactgaat

SEQ ID NO: 527742 - DNA, 25 bp, Homo sapien
atatgcacgttcttctgtcttgtga

SEQ ID NO: 527743 - DNA, 25 bp, Homo sapien
gaatcagtgtttttctgctgtatca

SEQ ID NO: 527744 - DNA, 25 bp, Homo sapien
ctgctgtatcaaggaaccagtttcc

SEQ ID NO: 527745 - DNA, 25 bp, Homo sapien
gacatggttttctggctgagctggc

SEQ ID NO: 527746 - DNA, 25 bp, Homo sapien
ccagggcaagcaggcagtcatcctg

SEQ ID NO: 527747 - DNA, 25 bp, Homo sapien
atcctgcatttatctccttctagaa

SEQ ID NO: 527748 - DNA, 25 bp, Homo sapien
ttcagaaggaactgcttttaagcca

SEQ ID NO: 527749 - DNA, 25 bp, Homo sapien
taagccactgggtcaagcggatatt

SEQ ID NO: 527750 - DNA, 25 bp, Homo sapien
gcggatattttaagcctggtgccca

SEQ ID NO: 527751 - DNA, 25 bp, Homo sapien
gcctggtgcccagcattgaacattt

SEQ ID NO: 527752 - DNA, 25 bp, Homo sapien
acatttctccttgacatatgcacgt

SEQ ID NO: 527753 - DNA, 25 bp, Homo sapien
agggtttgggtgtgacctcacagtc

SEQ ID NO: 527754 - DNA, 25 bp, Homo sapien
gggtgtgacctcacagtccagacca

SEQ ID NO: 527755 - DNA, 25 bp, Homo sapien
acagtccagaccagactgtcccagt

SEQ ID NO: 527756 - DNA, 25 bp, Homo sapien
gactgtcccagtcctatgtcaggga

SEQ ID NO: 527757 - DNA, 25 bp, Homo sapien
tcctatgtcagggacacccagatgt

SEQ ID NO: 527758 - DNA, 25 bp, Homo sapien
tcagggacacccagatgtagaagct

SEQ ID NO: 527759 - DNA, 25 bp, Homo sapien
atgtagaagctgactgagacctgct

SEQ ID NO: 527760 - DNA, 25 bp, Homo sapien
ggtgctcccctctgcttggaggctg

SEQ ID NO: 527761 - DNA, 25 bp, Homo sapien
gctgggtgtaccttgagctgggcac

SEQ ID NO: 527762 - DNA, 25 bp, Homo sapien
aggtgtgcttctcccgtagcagtcc

SEQ ID NO: 527763 - DNA, 25 bp, Homo sapien
tcccgtagcagtcctaggcttctct

SEQ ID NO: 527764 - DNA, 25 bp, Homo sapien
aaagattcccttgcatttgaattag

SEQ ID NO: 527765 - DNA, 25 bp, Homo sapien
tcccttgcatttgaattagttctct

SEQ ID NO: 527766 - DNA, 25 bp, Homo sapien
tctcctattgctaaatgtgtgatat

SEQ ID NO: 527767 - DNA, 25 bp, Homo sapien
gactatgtacttgtctggtttttgt

SEQ ID NO: 527768 - DNA, 25 bp, Homo sapien
atgcttataagcctcctttacactg

SEQ ID NO: 527769 - DNA, 25 bp, Homo sapien
ataagcctcctttacactgaataag

SEQ ID NO: 527770 - DNA, 25 bp, Homo sapien
acctgtaaaatacctcacatggttg

SEQ ID NO: 527771 - DNA, 25 bp, Homo sapien
acctcacatggttgtttttacacat

SEQ ID NO: 527772 - DNA, 25 bp, Homo sapien
tatgcgaacatacctgatatcaaga

SEQ ID NO: 527773 - DNA, 25 bp, Homo sapien
ctgatatcaagaggagtatgcacca

SEQ ID NO: 527774 - DNA, 25 bp, Homo sapien
agaggagtatgcaccaaataaattt

SEQ ID NO: 527775 - DNA, 25 bp, Homo sapien
aagcttcttagaaaacacgctgaga

SEQ ID NO: 527776 - DNA, 25 bp, Homo sapien
gaaaacacgctgagattttatttac

SEQ ID NO: 527777 - DNA, 25 bp, Homo sapien
tggtgtgtagtcaagtatagcaagt

SEQ ID NO: 527778 - DNA, 25 bp, Homo sapien
gttcctacagtcatacatattcatt

SEQ ID NO: 527779 - DNA, 25 bp, Homo sapien
aagttttatgttgttggtctgatct

SEQ ID NO: 527780 - DNA, 25 bp, Homo sapien
tgttggtctgatctgattcttcttt

SEQ ID NO: 527781 - DNA, 25 bp, Homo sapien
ctttgtttgtgggtggaacggcact

SEQ ID NO: 527782 - DNA, 25 bp, Homo sapien
gaacggcactgagagaagtatagtt

SEQ ID NO: 527783 - DNA, 25 bp, Homo sapien
gaacatgttcagtagttacattgcc

SEQ ID NO: 527784 - DNA, 25 bp, Homo sapien
gttacattgccttagaaaacccaga

SEQ ID NO: 527785 - DNA, 25 bp, Homo sapien
tagaaaacccagacacatagcagtg

SEQ ID NO: 527786 - DNA, 25 bp, Homo sapien
tgaggattgcttctgccatggagct

SEQ ID NO: 527787 - DNA, 25 bp, Homo sapien
gggagcctttccctagcagtggaac

SEQ ID NO: 527788 - DNA, 25 bp, Homo sapien
ggaacgctgtggtcattttctctag

SEQ ID NO: 527789 - DNA, 25 bp, Homo sapien
ttttctctagcatattcccttggga

SEQ ID NO: 527790 - DNA, 25 bp, Homo sapien
gatttgctattaatctggctgagaa

SEQ ID NO: 527791 - DNA, 25 bp, Homo sapien
ctggctgagaatctaagttctgtgc

SEQ ID NO: 527792 - DNA, 25 bp, Homo sapien
aagttctgtgccttagagacagttt

SEQ ID NO: 527793 - DNA, 25 bp, Homo sapien
agagacagtttgcactttcccatat

SEQ ID NO: 527794 - DNA, 25 bp, Homo sapien
gcactttcccatattgtgcctggga

SEQ ID NO: 527795 - DNA, 25 bp, Homo sapien
gtgcctgggacagccatatgatttt

SEQ ID NO: 527796 - DNA, 25 bp, Homo sapien
ttttttcccaccaaacaagtatgca

SEQ ID NO: 527797 - DNA, 25 bp, Homo sapien
gtggaatgtgttttctagctttctt

SEQ ID NO: 527798 - DNA, 25 bp, Homo sapien
gaatgtgttttctagctttctttga

SEQ ID NO: 527799 - DNA, 25 bp, Homo sapien
atgtgttttctagctttctttgaat

SEQ ID NO: 527800 - DNA, 25 bp, Homo sapien
ttctttgaattatgtatggcaacct

SEQ ID NO: 527801 - DNA, 25 bp, Homo sapien
ttgaattatgtatggcaacctggtt

SEQ ID NO: 527802 - DNA, 25 bp, Homo sapien
attatgtatggcaacctggtttagc

SEQ ID NO: 527803 - DNA, 25 bp, Homo sapien
atgtatggcaacctggtttagcact

SEQ ID NO: 527804 - DNA, 25 bp, Homo sapien
gtatggcaacctggtttagcactgg

SEQ ID NO: 527805 - DNA, 25 bp, Homo sapien
atggcaacctggtttagcactggca

SEQ ID NO: 527806 - DNA, 25 bp, Homo sapien
caacctggtttagcactggcatcct

SEQ ID NO: 527807 - DNA, 25 bp, Homo sapien
aacctggtttagcactggcatcctg

SEQ ID NO: 527808 - DNA, 25 bp, Homo sapien
aaccctagtatgtcctctgctttct

SEQ ID NO: 527809 - DNA, 25 bp, Homo sapien
actcgtgcccgctgagttccatcta

SEQ ID NO: 527810 - DNA, 25 bp, Homo sapien
tgagttccatctacctctcatgctg

SEQ ID NO: 527811 - DNA, 25 bp, Homo sapien
atctacctctcatgctggatgccag

SEQ ID NO: 527812 - DNA, 25 bp, Homo sapien
atgctggatgccagctggcccctca

SEQ ID NO: 527813 - DNA, 25 bp, Homo sapien
tgcccacacagttcccctttaagtg

SEQ ID NO: 527814 - DNA, 25 bp, Homo sapien
tacccttcttatatcctgcggtatt

SEQ ID NO: 527815 - DNA, 25 bp, Homo sapien
tatatcctgcggtattaagctagaa

SEQ ID NO: 527816 - DNA, 25 bp, Homo sapien
tcctgcggtattaagctagaaaccc

SEQ ID NO: 527817 - DNA, 25 bp, Homo sapien
ctagaaacccggatgctgctggatt

SEQ ID NO: 527818 - DNA, 25 bp, Homo sapien
aaacccggatgctgctggattggtg

SEQ ID NO: 527819 - DNA, 25 bp, Homo sapien
gaactaagcattttactcacaccca

SEQ ID NO: 527820 - DNA, 25 bp, Homo sapien
aagcattttactcacacccacagca

SEQ ID NO: 527821 - DNA, 25 bp, Homo sapien
agatattccacctgtaatagcactt

SEQ ID NO: 527822 - DNA, 25 bp, Homo sapien
cactttggaactgtgggcaaaacca

SEQ ID NO: 527823 - DNA, 25 bp, Homo sapien
ttccatttattccatgttggtgtat

SEQ ID NO: 527824 - DNA, 25 bp, Homo sapien
gttgaactggaaaattccctgaggc

SEQ ID NO: 527825 - DNA, 25 bp, Homo sapien
attccctgaggcaaaactcactggc

SEQ ID NO: 527826 - DNA, 25 bp, Homo sapien
tgtatgtgtctgatgatattcagtc

SEQ ID NO: 527827 - DNA, 25 bp, Homo sapien
tattcagtctgatgttccgcaattt

SEQ ID NO: 527828 - DNA, 25 bp, Homo sapien
cagtctgatgttccgcaattttaaa

SEQ ID NO: 527829 - DNA, 25 bp, Homo sapien
gatgttccgcaattttaaaagttat

SEQ ID NO: 527830 - DNA, 25 bp, Homo sapien
gatggcaggtggttataacacaaca

SEQ ID NO: 527831 - DNA, 25 bp, Homo sapien
taacacaacagatcttgccctgaga

SEQ ID NO: 527832 - DNA, 25 bp, Homo sapien
agatcttgccctgagaatatctggg

SEQ ID NO: 527833 - DNA, 25 bp, Homo sapien
gggacccagccaacagccttcaagg

SEQ ID NO: 527834 - DNA, 25 bp, Homo sapien
cagccttcaaggcagggcactcctg

SEQ ID NO: 527835 - DNA, 25 bp, Homo sapien
ggcactcctgcggaagagatggctt

SEQ ID NO: 527836 - DNA, 25 bp, Homo sapien
gcttgtgaacatgactgtggaccca

SEQ ID NO: 527837 - DNA, 25 bp, Homo sapien
tcaccccagagctcccatataaaat

SEQ ID NO: 527838 - DNA, 25 bp, Homo sapien
cagagaaactaagagcagccttggg

SEQ ID NO: 527839 - DNA, 25 bp, Homo sapien
gaagtaagtgattcatcatctagaa

SEQ ID NO: 527840 - DNA, 25 bp, Homo sapien
aaatttgcaccaacagatggcaggt

SEQ ID NO: 527841 - DNA, 25 bp, Homo sapien
ccagtctccttggtggtacctttgt

SEQ ID NO: 527842 - DNA, 25 bp, Homo sapien
gtctccttggtggtacctttgtggg

SEQ ID NO: 527843 - DNA, 25 bp, Homo sapien
tccttggtggtacctttgtgggcat

SEQ ID NO: 527844 - DNA, 25 bp, Homo sapien
tggtggtacctttgtgggcattgca

SEQ ID NO: 527845 - DNA, 25 bp, Homo sapien
gtggtacctttgtgggcattgcata

SEQ ID NO: 527846 - DNA, 25 bp, Homo sapien
tggtacctttgtgggcattgcatac

SEQ ID NO: 527847 - DNA, 25 bp, Homo sapien
acctttgtgggcattgcatacttcc

SEQ ID NO: 527848 - DNA, 25 bp, Homo sapien
tttgtgggcattgcatacttcctca

SEQ ID NO: 527849 - DNA, 25 bp, Homo sapien
ttgtgggcattgcatacttcctcac

SEQ ID NO: 527850 - DNA, 25 bp, Homo sapien
gtgggcattgcatacttcctcacac

SEQ ID NO: 527851 - DNA, 25 bp, Homo sapien
gggcattgcatacttcctcacacag

SEQ ID NO: 527852 - DNA, 25 bp, Homo sapien
ttcttgggctgggacagcccctttc

SEQ ID NO: 527853 - DNA, 25 bp, Homo sapien
agccacactccagggcggagttgga

SEQ ID NO: 527854 - DNA, 25 bp, Homo sapien
ggagttggatgaggcccgtccggag

SEQ ID NO: 527855 - DNA, 25 bp, Homo sapien
cgtccggagggagccatctcttgct

SEQ ID NO: 527856 - DNA, 25 bp, Homo sapien
gagggagccatctcttgctcccgag

SEQ ID NO: 527857 - DNA, 25 bp, Homo sapien
tctcttgctcccgaggctgggacag

SEQ ID NO: 527858 - DNA, 25 bp, Homo sapien
cgaggctgggacagtcctttctgtg

SEQ ID NO: 527859 - DNA, 25 bp, Homo sapien
gagcccgcgttgctgttcccacagg

SEQ ID NO: 527860 - DNA, 25 bp, Homo sapien
gcctcggtttttcctaacttgctct

SEQ ID NO: 527861 - DNA, 25 bp, Homo sapien
ggtttttcctaacttgctctgcatg

SEQ ID NO: 527862 - DNA, 25 bp, Homo sapien
tttcctaacttgctctgcatgctgt

SEQ ID NO: 527863 - DNA, 25 bp, Homo sapien
gctttttatgacttttggattctgt

SEQ ID NO: 527864 - DNA, 25 bp, Homo sapien
gacttttggattctgtaccacgtaa

SEQ ID NO: 527865 - DNA, 25 bp, Homo sapien
ggattctgtaccacgtaataatttt

SEQ ID NO: 527866 - DNA, 25 bp, Homo sapien
ctgtaccacgtaataattttgatgt

SEQ ID NO: 527867 - DNA, 25 bp, Homo sapien
ttacttgttcatgtagtgattttat

SEQ ID NO: 527868 - DNA, 25 bp, Homo sapien
gtgcttgtaaatgcagtaagtatct

SEQ ID NO: 527869 - DNA, 25 bp, Homo sapien
tttctatcaatgaatatcctgggat

SEQ ID NO: 527870 - DNA, 25 bp, Homo sapien
ataaacccctcatgatcataatgaa

SEQ ID NO: 527871 - DNA, 25 bp, Homo sapien
atgcagtaagtatctttggaagtat

SEQ ID NO: 527872 - DNA, 25 bp, Homo sapien
tctttggaagtatacctaaaaattg

SEQ ID NO: 527873 - DNA, 25 bp, Homo sapien
tccagggaagaacagatgggtgcca

SEQ ID NO: 527874 - DNA, 25 bp, Homo sapien
attgtgtgctctcagatttcttcca

SEQ ID NO: 527875 - DNA, 25 bp, Homo sapien
gtgctctcagatttcttccactgtt

SEQ ID NO: 527876 - DNA, 25 bp, Homo sapien
tccagagataatcctagccatcctc

SEQ ID NO: 527877 - DNA, 25 bp, Homo sapien
acttactacctgtgcactttgccac

SEQ ID NO: 527878 - DNA, 25 bp, Homo sapien
tttgccactcgggacacctggatgg

SEQ ID NO: 527879 - DNA, 25 bp, Homo sapien
gggacacctggatggtttctcttag

SEQ ID NO: 527880 - DNA, 25 bp, Homo sapien
acctggatggtttctcttaggactt

SEQ ID NO: 527881 - DNA, 25 bp, Homo sapien
ccttctcatggcacttgctgtggaa

SEQ ID NO: 527882 - DNA, 25 bp, Homo sapien
tggaaaatgcctggctggcctcgtg

SEQ ID NO: 527883 - DNA, 25 bp, Homo sapien
gggcctgtctcacttttccaggaga

SEQ ID NO: 527884 - DNA, 25 bp, Homo sapien
caggagacatgacccactaacgtgg

SEQ ID NO: 527885 - DNA, 25 bp, Homo sapien
tgctgtattaagttcaagtcttcat

SEQ ID NO: 527886 - DNA, 25 bp, Homo sapien
taagttcaagtcttcatggttaggt

SEQ ID NO: 527887 - DNA, 25 bp, Homo sapien
gaggttgagatctagttccatagcc

SEQ ID NO: 527888 - DNA, 25 bp, Homo sapien
atctagttccatagccttcctgaga

SEQ ID NO: 527889 - DNA, 25 bp, Homo sapien
tacctctgctgggactgggacggca

SEQ ID NO: 527890 - DNA, 25 bp, Homo sapien
actgggacggcagatactgcgcctg

SEQ ID NO: 527891 - DNA, 25 bp, Homo sapien
ctgcggctgctggctgtaatatggc

SEQ ID NO: 527892 - DNA, 25 bp, Homo sapien
taatatggctgttggccctgctggc

SEQ ID NO: 527893 - DNA, 25 bp, Homo sapien
tgctggcagtaaccactcacacctt

SEQ ID NO: 527894 - DNA, 25 bp, Homo sapien
tcacaccttgctgtccatactgagg

SEQ ID NO: 527895 - DNA, 25 bp, Homo sapien
ttgctgtccatactgaggtggcatc

SEQ ID NO: 527896 - DNA, 25 bp, Homo sapien
tatatgcacctataggccggcagaa

SEQ ID NO: 527897 - DNA, 25 bp, Homo sapien
ggccggcagaaatatctagccctga

SEQ ID NO: 527898 - DNA, 25 bp, Homo sapien
atatctagccctgaaaagtgaaatg

SEQ ID NO: 527899 - DNA, 25 bp, Homo sapien
aagtgaaatgaagcatgctttctga

SEQ ID NO: 527900 - DNA, 25 bp, Homo sapien
ccctgtttgtgtaacgaatccccat

SEQ ID NO: 527901 - DNA, 25 bp, Homo sapien
gaagaagctagtagaagcttccacc

SEQ ID NO: 527902 - DNA, 25 bp, Homo sapien
agcttccaccttgttaatctttatg

SEQ ID NO: 527903 - DNA, 25 bp, Homo sapien
atttagttatcaagtcatttgtctt

SEQ ID NO: 527904 - DNA, 25 bp, Homo sapien
acgaatccccatttacagtagtctg

SEQ ID NO: 527905 - DNA, 25 bp, Homo sapien
acagtagtctgtaggcagacattgt

SEQ ID NO: 527906 - DNA, 25 bp, Homo sapien
gacattgtgaagaaactagtagttc

SEQ ID NO: 527907 - DNA, 25 bp, Homo sapien
tgttgggtatttttctcttaataag

SEQ ID NO: 527908 - DNA, 25 bp, Homo sapien
ttgggtatttttctcttaataagag

SEQ ID NO: 527909 - DNA, 25 bp, Homo sapien
tgggtatttttctcttaataagaga

SEQ ID NO: 527910 - DNA, 25 bp, Homo sapien
gagaaatattggccatcgattttta

SEQ ID NO: 527911 - DNA, 25 bp, Homo sapien
agaaatattggccatcgatttttac

SEQ ID NO: 527912 - DNA, 25 bp, Homo sapien
aatattggccatcgatttttacata

SEQ ID NO: 527913 - DNA, 25 bp, Homo sapien
atattggccatcgatttttacatat

SEQ ID NO: 527914 - DNA, 25 bp, Homo sapien
ttggccatcgatttttacatataat

SEQ ID NO: 527915 - DNA, 25 bp, Homo sapien
tggccatcgatttttacatataata

SEQ ID NO: 527916 - DNA, 25 bp, Homo sapien
tgatataatttagtttgagaagttc

SEQ ID NO: 527917 - DNA, 25 bp, Homo sapien
ggcagttaaatgaacccaggaaaga

SEQ ID NO: 527918 - DNA, 25 bp, Homo sapien
gcagttaaatgaacccaggaaagac

SEQ ID NO: 527919 - DNA, 25 bp, Homo sapien
cagagtcctgaaaatcaaactatac

SEQ ID NO: 527920 - DNA, 25 bp, Homo sapien
gagtcctgaaaatcaaactatacaa

SEQ ID NO: 527921 - DNA, 25 bp, Homo sapien
ctatacaagtagtaggaagtccatt

SEQ ID NO: 527922 - DNA, 25 bp, Homo sapien
agtaggaagtccattaagctgttta

SEQ ID NO: 527923 - DNA, 25 bp, Homo sapien
gtaggaagtccattaagctgtttag

SEQ ID NO: 527924 - DNA, 25 bp, Homo sapien
taggaagtccattaagctgtttaga

SEQ ID NO: 527925 - DNA, 25 bp, Homo sapien
aggaagtccattaagctgtttagag

SEQ ID NO: 527926 - DNA, 25 bp, Homo sapien
ggaagtccattaagctgtttagagg

SEQ ID NO: 527927 - DNA, 25 bp, Homo sapien
gaagtccattaagctgtttagagga

SEQ ID NO: 527928 - DNA, 25 bp, Homo sapien
atttcttctgtatttgcagtgtaat

SEQ ID NO: 527929 - DNA, 25 bp, Homo sapien
tttttgtggcaaagtgtattaagca

SEQ ID NO: 527930 - DNA, 25 bp, Homo sapien
gtggcaaagtgtattaagcaatttt

SEQ ID NO: 527931 - DNA, 25 bp, Homo sapien
aagcaatttttcattatcttgaagt

SEQ ID NO: 527932 - DNA, 25 bp, Homo sapien
tttcattatcttgaagttccacaaa

SEQ ID NO: 527933 - DNA, 25 bp, Homo sapien
ttatattctcacatgcattttaggc

SEQ ID NO: 527934 - DNA, 25 bp, Homo sapien
cacatgcattttaggcacttttgat

SEQ ID NO: 527935 - DNA, 25 bp, Homo sapien
taggcacttttgatatgtgaaaata

SEQ ID NO: 527936 - DNA, 25 bp, Homo sapien
gtattttctgatgcatttggttaat

SEQ ID NO: 527937 - DNA, 25 bp, Homo sapien
tgttctttgctattttgaattccat

SEQ ID NO: 527938 - DNA, 25 bp, Homo sapien
gaattccattatagattcatgaata

SEQ ID NO: 527939 - DNA, 25 bp, Homo sapien
atgagtctaaaatgtgattgggtaa

SEQ ID NO: 527940 - DNA, 25 bp, Homo sapien
aaatatactaccagttacattttat

SEQ ID NO: 527941 - DNA, 25 bp, Homo sapien
gttacattttatgatttatgagtgg

SEQ ID NO: 527942 - DNA, 25 bp, Homo sapien
ttggttgttagaatatttttctcac

SEQ ID NO: 527943 - DNA, 25 bp, Homo sapien
atatttttctcacacatagacatgg

SEQ ID NO: 527944 - DNA, 25 bp, Homo sapien
tttctcacacatagacatggaagtc

SEQ ID NO: 527945 - DNA, 25 bp, Homo sapien
gacatggaagtcagattcattcttt

SEQ ID NO: 527946 - DNA, 25 bp, Homo sapien
ggaagtcagattcattctttgtgat

SEQ ID NO: 527947 - DNA, 25 bp, Homo sapien
gtcagattcattctttgtgatgttt

SEQ ID NO: 527948 - DNA, 25 bp, Homo sapien
tctttgtgatgtttgtagccaccat

SEQ ID NO: 527949 - DNA, 25 bp, Homo sapien
ctttgtgatgtttgtagccaccatt

SEQ ID NO: 527950 - DNA, 25 bp, Homo sapien
gaaccaaggcaatgacttctctctc

SEQ ID NO: 527951 - DNA, 25 bp, Homo sapien
cagatctcctagctactggtcctgg

SEQ ID NO: 527952 - DNA, 25 bp, Homo sapien
gagtcatttaaactcttcagtttac

SEQ ID NO: 527953 - DNA, 25 bp, Homo sapien
aaaagacaagcatttcagtaagcta

SEQ ID NO: 527954 - DNA, 25 bp, Homo sapien
gctagttattttcatgggttgctca

SEQ ID NO: 527955 - DNA, 25 bp, Homo sapien
tttcatgggttgctcatccattttt

SEQ ID NO: 527956 - DNA, 25 bp, Homo sapien
tagggagatggctactactgaagtt

SEQ ID NO: 527957 - DNA, 25 bp, Homo sapien
gatggctactactgaagttgtctgt

SEQ ID NO: 527958 - DNA, 25 bp, Homo sapien
aaggatgctgaggacctagatgaga

SEQ ID NO: 527959 - DNA, 25 bp, Homo sapien
aggacctagatgagaagttacctgc

SEQ ID NO: 527960 - DNA, 25 bp, Homo sapien
ggcaaaagggttacttagtgtcaga

SEQ ID NO: 527961 - DNA, 25 bp, Homo sapien
gcatttgtttgtcactagttgggca

SEQ ID NO: 527962 - DNA, 25 bp, Homo sapien
tttgtcactagttgggcacgtgcca

SEQ ID NO: 527963 - DNA, 25 bp, Homo sapien
gggcacgtgccaataatattctctc

SEQ ID NO: 527964 - DNA, 25 bp, Homo sapien
taatattctctccattccttatctg

SEQ ID NO: 527965 - DNA, 25 bp, Homo sapien
ttccttatctgccatctctgttttg

SEQ ID NO: 527966 - DNA, 25 bp, Homo sapien
tctgttttgcctgatttctcttcaa

SEQ ID NO: 527967 - DNA, 25 bp, Homo sapien
gcctgatttctcttcaactgaataa

SEQ ID NO: 527968 - DNA, 25 bp, Homo sapien
ctgaataatggctttttgcatggaa

SEQ ID NO: 527969 - DNA, 25 bp, Homo sapien
ctgtttgacactccttagcttagat

SEQ ID NO: 527970 - DNA, 25 bp, Homo sapien
gttgtttttgttatccctataatgt

SEQ ID NO: 527971 - DNA, 25 bp, Homo sapien
ttttaagtcattgtgtactgcattt

SEQ ID NO: 527972 - DNA, 25 bp, Homo sapien
tgggctcggccagcgagtacgacta

SEQ ID NO: 527973 - DNA, 25 bp, Homo sapien
cagcgagtacgactacgtgagcttc

SEQ ID NO: 527974 - DNA, 25 bp, Homo sapien
actacgtgagcttccagtcggacat

SEQ ID NO: 527975 - DNA, 25 bp, Homo sapien
gtgagcttccagtcggacatcggcc

SEQ ID NO: 527976 - DNA, 25 bp, Homo sapien
gacatcggcccgtaccagagcgggc

SEQ ID NO: 527977 - DNA, 25 bp, Homo sapien
agagcgggcgcttctacaccaagcc

SEQ ID NO: 527978 - DNA, 25 bp, Homo sapien
tcagtgcgtggacatccccgcggac

SEQ ID NO: 527979 - DNA, 25 bp, Homo sapien
acctgcggctgtgccacaacgtggg

SEQ ID NO: 527980 - DNA, 25 bp, Homo sapien
cacaacgtgggctacaagaagatgg

SEQ ID NO: 527981 - DNA, 25 bp, Homo sapien
tgctggagcacgagaccatggcgga

SEQ ID NO: 527982 - DNA, 25 bp, Homo sapien
tgctcaacaagaactgccacgccgg

SEQ ID NO: 527983 - DNA, 25 bp, Homo sapien
gtgaccctagggaagtaatggattt

SEQ ID NO: 527984 - DNA, 25 bp, Homo sapien
atctttgaatatagactcgagtctt

SEQ ID NO: 527985 - DNA, 25 bp, Homo sapien
agactcgagtctttgggaaactcat

SEQ ID NO: 527986 - DNA, 25 bp, Homo sapien
gaagcaactgtttgtctttataaga

SEQ ID NO: 527987 - DNA, 25 bp, Homo sapien
atctttgcagattactctgcctcca

SEQ ID NO: 527988 - DNA, 25 bp, Homo sapien
ttgcagattactctgcctccaaatg

SEQ ID NO: 527989 - DNA, 25 bp, Homo sapien
gcctccaaatgcagggcctttcaga

SEQ ID NO: 527990 - DNA, 25 bp, Homo sapien
ggcctttcagagatgcattgtgatt

SEQ ID NO: 527991 - DNA, 25 bp, Homo sapien
gatgcattgtgattgtaattactga

SEQ ID NO: 527992 - DNA, 25 bp, Homo sapien
attactgagttgaagctccaaccaa

SEQ ID NO: 527993 - DNA, 25 bp, Homo sapien
gaagctccaaccaatttgaatttgt

SEQ ID NO: 527994 - DNA, 25 bp, Homo sapien
agaagattaaatagtgtctgaagag

SEQ ID NO: 527995 - DNA, 25 bp, Homo sapien
gaagattaaatagtgtctgaagagg

SEQ ID NO: 527996 - DNA, 25 bp, Homo sapien
aagattaaatagtgtctgaagaggc

SEQ ID NO: 527997 - DNA, 25 bp, Homo sapien
agattaaatagtgtctgaagaggcc

SEQ ID NO: 527998 - DNA, 25 bp, Homo sapien
gattaaatagtgtctgaagaggccg

SEQ ID NO: 527999 - DNA, 25 bp, Homo sapien
attaaatagtgtctgaagaggccgg

SEQ ID NO: 528000 - DNA, 25 bp, Homo sapien
ttaaatagtgtctgaagaggccggg

SEQ ID NO: 528001 - DNA, 25 bp, Homo sapien
taaatagtgtctgaagaggccgggc

SEQ ID NO: 528002 - DNA, 25 bp, Homo sapien
aaatagtgtctgaagaggccgggcg

SEQ ID NO: 528003 - DNA, 25 bp, Homo sapien
aatagtgtctgaagaggccgggcgc

SEQ ID NO: 528004 - DNA, 25 bp, Homo sapien
atagtgtctgaagaggccgggcgcg

SEQ ID NO: 528005 - DNA, 25 bp, Homo sapien
cttggtaaattatcttgcacttgaa

SEQ ID NO: 528006 - DNA, 25 bp, Homo sapien
tgcacttgaatgtctcatgattaca

SEQ ID NO: 528007 - DNA, 25 bp, Homo sapien
gattacatatgaaatcgctttgaca

SEQ ID NO: 528008 - DNA, 25 bp, Homo sapien
atcgctttgacatatctttagacag

SEQ ID NO: 528009 - DNA, 25 bp, Homo sapien
gggaaattatagagctgtgtgactt

SEQ ID NO: 528010 - DNA, 25 bp, Homo sapien
gactttagggagtaggttgaaccag

SEQ ID NO: 528011 - DNA, 25 bp, Homo sapien
gttgaaccaggtgattacctaaaat

SEQ ID NO: 528012 - DNA, 25 bp, Homo sapien
taaaattccttccagttcaaaggca

SEQ ID NO: 528013 - DNA, 25 bp, Homo sapien
tttatcctatctaccatttcttaag

SEQ ID NO: 528014 - DNA, 25 bp, Homo sapien
tttcttaagaagacattactccaaa

SEQ ID NO: 528015 - DNA, 25 bp, Homo sapien
ttatcaggtctgcatatagaatctt

SEQ ID NO: 528016 - DNA, 25 bp, Homo sapien
ggacggcagcgaactcagctacttt

SEQ ID NO: 528017 - DNA, 25 bp, Homo sapien
cagttccagtgctcctcggacagca

SEQ ID NO: 528018 - DNA, 25 bp, Homo sapien
tcctcggacagcaccaacgggactg

SEQ ID NO: 528019 - DNA, 25 bp, Homo sapien
gtgggcagatccctgagctcatttt

SEQ ID NO: 528020 - DNA, 25 bp, Homo sapien
cagatccctgagctcattttctatg

SEQ ID NO: 528021 - DNA, 25 bp, Homo sapien
cattttctatgcctgaggtgcccgg

SEQ ID NO: 528022 - DNA, 25 bp, Homo sapien
gatgctaactgcttcttgacaccat

SEQ ID NO: 528023 - DNA, 25 bp, Homo sapien
ttgacaccatgaaaggctgctctta

SEQ ID NO: 528024 - DNA, 25 bp, Homo sapien
aaggctgctcttaactttgtctctc

SEQ ID NO: 528025 - DNA, 25 bp, Homo sapien
aactttgtctctctttgacatgtag

SEQ ID NO: 528026 - DNA, 25 bp, Homo sapien
agctgaagcttgactgtgtagagac

SEQ ID NO: 528027 - DNA, 25 bp, Homo sapien
ttttcccgaggttgggctgtacagt

SEQ ID NO: 528028 - DNA, 25 bp, Homo sapien
aggttgggctgtacagtgtctccgt

SEQ ID NO: 528029 - DNA, 25 bp, Homo sapien
tacagtgtctccgtccgcggaaaaa

SEQ ID NO: 528030 - DNA, 25 bp, Homo sapien
tccgtccgcggaaaaagaagcctct

SEQ ID NO: 528031 - DNA, 25 bp, Homo sapien
gaaaaagaagcctctgaacccgcgc

SEQ ID NO: 528032 - DNA, 25 bp, Homo sapien
agtgccgaggtgtttctgtgaccct

SEQ ID NO: 528033 - DNA, 25 bp, Homo sapien
actcccattcccttctgaaagggca

SEQ ID NO: 528034 - DNA, 25 bp, Homo sapien
gaaagggcacctgctcttggtgaga

SEQ ID NO: 528035 - DNA, 25 bp, Homo sapien
atagcacgaagagccagtatcagaa

SEQ ID NO: 528036 - DNA, 25 bp, Homo sapien
gtatcagaagagtatccatcacccg

SEQ ID NO: 528037 - DNA, 25 bp, Homo sapien
gaagagtatccatcacccgcagcaa

SEQ ID NO: 528038 - DNA, 25 bp, Homo sapien
ttcactctttttcatactattataa

SEQ ID NO: 528039 - DNA, 25 bp, Homo sapien
ctattataagttattctggtattaa

SEQ ID NO: 528040 - DNA, 25 bp, Homo sapien
atgaatgaatgctggttgtatttta

SEQ ID NO: 528041 - DNA, 25 bp, Homo sapien
atgaatgctggttgtattttatttg

SEQ ID NO: 528042 - DNA, 25 bp, Homo sapien
attttatttgaatgagtcatgattc

SEQ ID NO: 528043 - DNA, 25 bp, Homo sapien
aaaaatcagcaaatttcttctatgt

SEQ ID NO: 528044 - DNA, 25 bp, Homo sapien
gatgacaaggcaatataggacaact

SEQ ID NO: 528045 - DNA, 25 bp, Homo sapien
tgacaaggcaatataggacaactat

SEQ ID NO: 528046 - DNA, 25 bp, Homo sapien
ggcaatataggacaactattcacat

SEQ ID NO: 528047 - DNA, 25 bp, Homo sapien
ataggacaactattcacatgatttt

SEQ ID NO: 528048 - DNA, 25 bp, Homo sapien
aggacaactattcacatgatttttt

SEQ ID NO: 528049 - DNA, 25 bp, Homo sapien
gtcaacggtcacttcaacgtaaatg

SEQ ID NO: 528050 - DNA, 25 bp, Homo sapien
gggaactgaacaaagctccaccatt

SEQ ID NO: 528051 - DNA, 25 bp, Homo sapien
acaaagctccaccattgtgtctgaa

SEQ ID NO: 528052 - DNA, 25 bp, Homo sapien
gctccaccattgtgtctgaaatcat

SEQ ID NO: 528053 - DNA, 25 bp, Homo sapien
aagaatgatttttttgggcccacat

SEQ ID NO: 528054 - DNA, 25 bp, Homo sapien
gggcccacattcaaccaaagaacaa

SEQ ID NO: 528055 - DNA, 25 bp, Homo sapien
gacgattttctaatatgtacacagc

SEQ ID NO: 528056 - DNA, 25 bp, Homo sapien
gaatgtcatattatccacctgtgaa

SEQ ID NO: 528057 - DNA, 25 bp, Homo sapien
tatccacctgtgaaacatctagtaa

SEQ ID NO: 528058 - DNA, 25 bp, Homo sapien
gaaacatctagtaagcaattgcatc

SEQ ID NO: 528059 - DNA, 25 bp, Homo sapien
gtaagcaattgcatctatattttat

SEQ ID NO: 528060 - DNA, 25 bp, Homo sapien
gagcccgccctggtctcatctggat

SEQ ID NO: 528061 - DNA, 25 bp, Homo sapien
gatcccgccacctggacgctgaggg

SEQ ID NO: 528062 - DNA, 25 bp, Homo sapien
gacgggccctcgtgtgggaagcctg

SEQ ID NO: 528063 - DNA, 25 bp, Homo sapien
ccaggtggccgcagggacgatgcag

SEQ ID NO: 528064 - DNA, 25 bp, Homo sapien
gacgatgcagatgcagagcccacgt

SEQ ID NO: 528065 - DNA, 25 bp, Homo sapien
atgcagatgcagagcccacgtcaca

SEQ ID NO: 528066 - DNA, 25 bp, Homo sapien
agatgcagagcccacgtcacatgct

SEQ ID NO: 528067 - DNA, 25 bp, Homo sapien
gactctggccggatcccaggcctgt

SEQ ID NO: 528068 - DNA, 25 bp, Homo sapien
ctggtcccttgaggaggtcgtgaca

SEQ ID NO: 528069 - DNA, 25 bp, Homo sapien
tcccttgaggaggtcgtgacaggct

SEQ ID NO: 528070 - DNA, 25 bp, Homo sapien
aggaggtcgtgacaggctcagcctg

SEQ ID NO: 528071 - DNA, 25 bp, Homo sapien
ggttgcttgctcataactcggcagt

SEQ ID NO: 528072 - DNA, 25 bp, Homo sapien
tgcttgctcataactcggcagtaag

SEQ ID NO: 528073 - DNA, 25 bp, Homo sapien
aactcggcagtaagcatttttaagc

SEQ ID NO: 528074 - DNA, 25 bp, Homo sapien
ggcagtaagcatttttaagcatgaa

SEQ ID NO: 528075 - DNA, 25 bp, Homo sapien
ggagtgagatttctggtctacagaa

SEQ ID NO: 528076 - DNA, 25 bp, Homo sapien
gacatttatcgtcatgatgctttgc

SEQ ID NO: 528077 - DNA, 25 bp, Homo sapien
gtcatgatgctttgcacaagggctg

SEQ ID NO: 528078 - DNA, 25 bp, Homo sapien
atttagatcatctttagcggtgaat

SEQ ID NO: 528079 - DNA, 25 bp, Homo sapien
tctttagcggtgaatgagtggatta

SEQ ID NO: 528080 - DNA, 25 bp, Homo sapien
ggattaattttactacaactactga

SEQ ID NO: 528081 - DNA, 25 bp, Homo sapien
actacaactactgatggtggtggtg

SEQ ID NO: 528082 - DNA, 25 bp, Homo sapien
aagccctatgagaggacggctgccc

SEQ ID NO: 528083 - DNA, 25 bp, Homo sapien
accagcacttgctcctgaaggaaca

SEQ ID NO: 528084 - DNA, 25 bp, Homo sapien
aaaaagcccattgttgtcaccatct

SEQ ID NO: 528085 - DNA, 25 bp, Homo sapien
tgttgtcaccatctcaaatctgttg

SEQ ID NO: 528086 - DNA, 25 bp, Homo sapien
caccatctcaaatctgttgggtaga

SEQ ID NO: 528087 - DNA, 25 bp, Homo sapien
ttgggtagataccacagccgggtct

SEQ ID NO: 528088 - DNA, 25 bp, Homo sapien
taccacagccgggtcttcgcatgat

SEQ ID NO: 528089 - DNA, 25 bp, Homo sapien
ccctgtctgcagttagcagagctgt

SEQ ID NO: 528090 - DNA, 25 bp, Homo sapien
gctgtgtggccgtggaatgatctcc

SEQ ID NO: 528091 - DNA, 25 bp, Homo sapien
gatctccagatttcatgtgatgcca

SEQ ID NO: 528092 - DNA, 25 bp, Homo sapien
atgtgatgccaatgaagtacaggaa

SEQ ID NO: 528093 - DNA, 25 bp, Homo sapien
agtcatgatgtgctgcctgagccac

SEQ ID NO: 528094 - DNA, 25 bp, Homo sapien
gccacatcctccacaataggtttga

SEQ ID NO: 528095 - DNA, 25 bp, Homo sapien
acaataggtttgatcctctgcagag

SEQ ID NO: 528096 - DNA, 25 bp, Homo sapien
aagcaagcagataccctaggcatcc

SEQ ID NO: 528097 - DNA, 25 bp, Homo sapien
taaccctgctgtgttactggcactg

SEQ ID NO: 528098 - DNA, 25 bp, Homo sapien
gttactggcactgggctgtggcctc

SEQ ID NO: 528099 - DNA, 25 bp, Homo sapien
ttcttcgtctcctttcatcatactt

SEQ ID NO: 528100 - DNA, 25 bp, Homo sapien
tactttcccttcgtgccacataaat

SEQ ID NO: 528101 - DNA, 25 bp, Homo sapien
ctgggactggtctaatggctctgag

SEQ ID NO: 528102 - DNA, 25 bp, Homo sapien
atggctctgagtggaccctgagtct

SEQ ID NO: 528103 - DNA, 25 bp, Homo sapien
agtcttccccattttcagtcatgat

SEQ ID NO: 528104 - DNA, 25 bp, Homo sapien
ccctctgagaagtcccaagctgaga

SEQ ID NO: 528105 - DNA, 25 bp, Homo sapien
ggaggaggccaaactcccagtgctg

SEQ ID NO: 528106 - DNA, 25 bp, Homo sapien
aggaggccaaactcccagtgctggg

SEQ ID NO: 528107 - DNA, 25 bp, Homo sapien
cacctggtggacacaaagctctcac

SEQ ID NO: 528108 - DNA, 25 bp, Homo sapien
aagctctcacatcgataggatccca

SEQ ID NO: 528109 - DNA, 25 bp, Homo sapien
ctctcacatcgataggatcccatga

SEQ ID NO: 528110 - DNA, 25 bp, Homo sapien
taggatcccatgaggatggtcccct

SEQ ID NO: 528111 - DNA, 25 bp, Homo sapien
gatcccatgaggatggtccccttca

SEQ ID NO: 528112 - DNA, 25 bp, Homo sapien
tggtccccttcacctgggagaaaag

SEQ ID NO: 528113 - DNA, 25 bp, Homo sapien
agaaaagtgacccagtttaggagct

SEQ ID NO: 528114 - DNA, 25 bp, Homo sapien
aagtgacccagtttaggagctggag

SEQ ID NO: 528115 - DNA, 25 bp, Homo sapien
ccagcggatcccagtgagtggcaga

SEQ ID NO: 528116 - DNA, 25 bp, Homo sapien
tccacctgccatgtgtatgtgagtg

SEQ ID NO: 528117 - DNA, 25 bp, Homo sapien
atgtgagtgaagaccacctggatct

SEQ ID NO: 528118 - DNA, 25 bp, Homo sapien
agagggaagacgacatgctagacat

SEQ ID NO: 528119 - DNA, 25 bp, Homo sapien
aagacgacatgctagacatggcccc

SEQ ID NO: 528120 - DNA, 25 bp, Homo sapien
tcctccaggagaactcgcggctggg

SEQ ID NO: 528121 - DNA, 25 bp, Homo sapien
agaactcgcggctgggctgccagat

SEQ ID NO: 528122 - DNA, 25 bp, Homo sapien
tgggctgccagattgtgctgacacc

SEQ ID NO: 528123 - DNA, 25 bp, Homo sapien
ccagattgtgctgacaccggagctg

SEQ ID NO: 528124 - DNA, 25 bp, Homo sapien
tggaaggagcggaattcaccctgcc

SEQ ID NO: 528125 - DNA, 25 bp, Homo sapien
gagcggaattcaccctgcccaagat

SEQ ID NO: 528126 - DNA, 25 bp, Homo sapien
tggctggttcctttacaatacactg

SEQ ID NO: 528127 - DNA, 25 bp, Homo sapien
gttcctttacaatacactgctttct

SEQ ID NO: 528128 - DNA, 25 bp, Homo sapien
cactgctttcttaagtacaaataat

SEQ ID NO: 528129 - DNA, 25 bp, Homo sapien
cttggttaagaatatgagttccctc

SEQ ID NO: 528130 - DNA, 25 bp, Homo sapien
agaatatgagttccctcttcaaaat

SEQ ID NO: 528131 - DNA, 25 bp, Homo sapien
ggtggcaaaatgtaaacactgcttc

SEQ ID NO: 528132 - DNA, 25 bp, Homo sapien
acactgcttcctattactgtgcaag

SEQ ID NO: 528133 - DNA, 25 bp, Homo sapien
gcttcctattactgtgcaagttttt

SEQ ID NO: 528134 - DNA, 25 bp, Homo sapien
tttttatgtcaactttactatttca

SEQ ID NO: 528135 - DNA, 25 bp, Homo sapien
ctatttcatgtttgttgtggagatt

SEQ ID NO: 528136 - DNA, 25 bp, Homo sapien
aaggaaacaatctcacttgaaggat

SEQ ID NO: 528137 - DNA, 25 bp, Homo sapien
atggtgtttatagacctatggtttt

SEQ ID NO: 528138 - DNA, 25 bp, Homo sapien
atggttttataatacatcccttgga

SEQ ID NO: 528139 - DNA, 25 bp, Homo sapien
agtttcatttggagctcatcagttt

SEQ ID NO: 528140 - DNA, 25 bp, Homo sapien
gagagaaaccagagccaaagaccga

SEQ ID NO: 528141 - DNA, 25 bp, Homo sapien
cagagccaaagaccgaacccagggt

SEQ ID NO: 528142 - DNA, 25 bp, Homo sapien
tttggagctcatcagtttgaaatct

SEQ ID NO: 528143 - DNA, 25 bp, Homo sapien
tgggccagtggctggaatgcacagc

SEQ ID NO: 528144 - DNA, 25 bp, Homo sapien
agctcatcagtttgaaatctcagtg

SEQ ID NO: 528145 - DNA, 25 bp, Homo sapien
aatctcagtgagacttccaaattga

SEQ ID NO: 528146 - DNA, 25 bp, Homo sapien
gagacttccaaattgaataggcagt

SEQ ID NO: 528147 - DNA, 25 bp, Homo sapien
aataggcagttggatgcagagatgt

SEQ ID NO: 528148 - DNA, 25 bp, Homo sapien
acggcctccagcttccaaagagcag

SEQ ID NO: 528149 - DNA, 25 bp, Homo sapien
agcttccaaagagcagcgagccgcg

SEQ ID NO: 528150 - DNA, 25 bp, Homo sapien
ttccaaagagcagcgagccgcggag

SEQ ID NO: 528151 - DNA, 25 bp, Homo sapien
tggaaccttttctgtgcccctatct

SEQ ID NO: 528152 - DNA, 25 bp, Homo sapien
tgcttccccttcttggtattaagtg

SEQ ID NO: 528153 - DNA, 25 bp, Homo sapien
ttccccttcttggtattaagtgcaa

SEQ ID NO: 528154 - DNA, 25 bp, Homo sapien
ccccttcttggtattaagtgcaatt

SEQ ID NO: 528155 - DNA, 25 bp, Homo sapien
aagtgcaattaaagccgtgggtgtc

SEQ ID NO: 528156 - DNA, 25 bp, Homo sapien
aattaaagccgtgggtgtcgcatct

SEQ ID NO: 528157 - DNA, 25 bp, Homo sapien
aaagccgtgggtgtcgcatcttctc

SEQ ID NO: 528158 - DNA, 25 bp, Homo sapien
tgggtgtcgcatcttctccagcgct

SEQ ID NO: 528159 - DNA, 25 bp, Homo sapien
ccagctggtggcgtggacttcgatg

SEQ ID NO: 528160 - DNA, 25 bp, Homo sapien
cagctggtggcgtggacttcgatga

SEQ ID NO: 528161 - DNA, 25 bp, Homo sapien
agctggtggcgtggacttcgatgag

SEQ ID NO: 528162 - DNA, 25 bp, Homo sapien
gctggtggcgtggacttcgatgaga

SEQ ID NO: 528163 - DNA, 25 bp, Homo sapien
gaggcagtctttgaggcccccatca

SEQ ID NO: 528164 - DNA, 25 bp, Homo sapien
aggcagtctttgaggcccccatcag

SEQ ID NO: 528165 - DNA, 25 bp, Homo sapien
ggcagtctttgaggcccccatcaga

SEQ ID NO: 528166 - DNA, 25 bp, Homo sapien
agtctttgaggcccccatcagagac

SEQ ID NO: 528167 - DNA, 25 bp, Homo sapien
gtcctgggccaggactaacacggct

SEQ ID NO: 528168 - DNA, 25 bp, Homo sapien
tcctgggccaggactaacacggctc

SEQ ID NO: 528169 - DNA, 25 bp, Homo sapien
cctgggccaggactaacacggctcc

SEQ ID NO: 528170 - DNA, 25 bp, Homo sapien
acagagacgtggtcgccgtctccag

SEQ ID NO: 528171 - DNA, 25 bp, Homo sapien
gacgtggtcgccgtctccaggaaca

SEQ ID NO: 528172 - DNA, 25 bp, Homo sapien
gaaagtcagcctgctacggcaactg

SEQ ID NO: 528173 - DNA, 25 bp, Homo sapien
agtcagcctgctacggcaactggag

SEQ ID NO: 528174 - DNA, 25 bp, Homo sapien
agcctgctacggcaactggagctgc

SEQ ID NO: 528175 - DNA, 25 bp, Homo sapien
gctacggcaactggagctgctcagg

SEQ ID NO: 528176 - DNA, 25 bp, Homo sapien
tcagggagctgaatacacggctgcg

SEQ ID NO: 528177 - DNA, 25 bp, Homo sapien
ctgaatacacggctgcgggatgaca

SEQ ID NO: 528178 - DNA, 25 bp, Homo sapien
ggatgacagggacgcctgcgaggcc

SEQ ID NO: 528179 - DNA, 25 bp, Homo sapien
aggaaggctctgacaacagcccgcc

SEQ ID NO: 528180 - DNA, 25 bp, Homo sapien
gaaggctctgacaacagcccgcctg

SEQ ID NO: 528181 - DNA, 25 bp, Homo sapien
atgacttctggccagatgtggaacc

SEQ ID NO: 528182 - DNA, 25 bp, Homo sapien
atgtggaaccatatccgtggacctc

SEQ ID NO: 528183 - DNA, 25 bp, Homo sapien
tccgtggacctccatatgctcataa

SEQ ID NO: 528184 - DNA, 25 bp, Homo sapien
atgctcataagaacccacacaatgg

SEQ ID NO: 528185 - DNA, 25 bp, Homo sapien
ggacaagtgagctacattcatggga

SEQ ID NO: 528186 - DNA, 25 bp, Homo sapien
ccaggctcagtttgtggcagaatca

SEQ ID NO: 528187 - DNA, 25 bp, Homo sapien
gaatcacacattattctggtactga

SEQ ID NO: 528188 - DNA, 25 bp, Homo sapien
tactgaatgccgctatcaccatggg

SEQ ID NO: 528189 - DNA, 25 bp, Homo sapien
agacggataatttgcctagtgggat

SEQ ID NO: 528190 - DNA, 25 bp, Homo sapien
ggtggtcttcttcttcagttttcta

SEQ ID NO: 528191 - DNA, 25 bp, Homo sapien
ttctactttcaatatttcgttccaa

SEQ ID NO: 528192 - DNA, 25 bp, Homo sapien
gacaccaaattccaagagccccagc

SEQ ID NO: 528193 - DNA, 25 bp, Homo sapien
catctctaataaatggaaggcccca

SEQ ID NO: 528194 - DNA, 25 bp, Homo sapien
aaatggaaggccccaaggccctgag

SEQ ID NO: 528195 - DNA, 25 bp, Homo sapien
ggatctcaaatcctggaaccccgat

SEQ ID NO: 528196 - DNA, 25 bp, Homo sapien
tggaaccccgatttcaatctacgtt

SEQ ID NO: 528197 - DNA, 25 bp, Homo sapien
tcaatctacgttctagtcactggcc

SEQ ID NO: 528198 - DNA, 25 bp, Homo sapien
tacgttctagtcactggcctcaaag

SEQ ID NO: 528199 - DNA, 25 bp, Homo sapien
gttctagtcactggcctcaaaggac

SEQ ID NO: 528200 - DNA, 25 bp, Homo sapien
tgggccagaccaacagctcgaggga

SEQ ID NO: 528201 - DNA, 25 bp, Homo sapien
ccaacagctcgagggagaacctgaa

SEQ ID NO: 528202 - DNA, 25 bp, Homo sapien
tgcatgtccccaaactcagcatgac

SEQ ID NO: 528203 - DNA, 25 bp, Homo sapien
ttgctcgcctggcactaaggaccca

SEQ ID NO: 528204 - DNA, 25 bp, Homo sapien
cacagagatgtcactcggtttaatg

SEQ ID NO: 528205 - DNA, 25 bp, Homo sapien
ttgcggtatcagtctccccacaaac

SEQ ID NO: 528206 - DNA, 25 bp, Homo sapien
tgtcactcggtttaatgctgtctca

SEQ ID NO: 528207 - DNA, 25 bp, Homo sapien
atgctgtctcattttgatgcctggc

SEQ ID NO: 528208 - DNA, 25 bp, Homo sapien
actgcaggatgctggctgggcactc

SEQ ID NO: 528209 - DNA, 25 bp, Homo sapien
actcagcagtcgaggcgctgggcat

SEQ ID NO: 528210 - DNA, 25 bp, Homo sapien
cacaaacaaacgctccccagagttt

SEQ ID NO: 528211 - DNA, 25 bp, Homo sapien
ttaagccgacctataaacaagcagt

SEQ ID NO: 528212 - DNA, 25 bp, Homo sapien
cctataaacaagcagtttgtccctg

SEQ ID NO: 528213 - DNA, 25 bp, Homo sapien
agtttgtccctgcttgctcgcctgg

SEQ ID NO: 528214 - DNA, 25 bp, Homo sapien
aatttcttgagaacagcaaactgca

SEQ ID NO: 528215 - DNA, 25 bp, Homo sapien
cagcaaactgcatttaccatcgtaa

SEQ ID NO: 528216 - DNA, 25 bp, Homo sapien
caacatctgacttacgggagctgca

SEQ ID NO: 528217 - DNA, 25 bp, Homo sapien
tggtgagacagttcgaacggctcct

SEQ ID NO: 528218 - DNA, 25 bp, Homo sapien
gaacggctcctcagaaatccagtga

SEQ ID NO: 528219 - DNA, 25 bp, Homo sapien
tcctcagaaatccagtgacccaatt

SEQ ID NO: 528220 - DNA, 25 bp, Homo sapien
aagaccatagcacctgcaagtgaca

SEQ ID NO: 528221 - DNA, 25 bp, Homo sapien
gcaagtgacacaacaagcagattta

SEQ ID NO: 528222 - DNA, 25 bp, Homo sapien
ggtgttaagttctgtgaatgtcttt

SEQ ID NO: 528223 - DNA, 25 bp, Homo sapien
gcataattgtgcttgactggataaa

SEQ ID NO: 528224 - DNA, 25 bp, Homo sapien
agtccacccttatgtttataataat

SEQ ID NO: 528225 - DNA, 25 bp, Homo sapien
agagctccttactgtaggtcttacc

SEQ ID NO: 528226 - DNA, 25 bp, Homo sapien
gtaggtcttaccctggacaaggatt

SEQ ID NO: 528227 - DNA, 25 bp, Homo sapien
atgagcaatctgacattcccacagc

SEQ ID NO: 528228 - DNA, 25 bp, Homo sapien
gcccctcaaacatgcaaggctacta

SEQ ID NO: 528229 - DNA, 25 bp, Homo sapien
gatggatattgaccaagacctgctt

SEQ ID NO: 528230 - DNA, 25 bp, Homo sapien
aagacctgcttggacggagaccgcc

SEQ ID NO: 528231 - DNA, 25 bp, Homo sapien
gacggagaccgccatattatctgtt

SEQ ID NO: 528232 - DNA, 25 bp, Homo sapien
ttatctgttctcttcgttcacaaaa

SEQ ID NO: 528233 - DNA, 25 bp, Homo sapien
aaaacagccttcacttgtctcagaa

SEQ ID NO: 528234 - DNA, 25 bp, Homo sapien
gagcaggagcttcagatgcactctt

SEQ ID NO: 528235 - DNA, 25 bp, Homo sapien
gatgcactctttacacattttgttg

SEQ ID NO: 528236 - DNA, 25 bp, Homo sapien
atgcatacccttatataagcagaat

SEQ ID NO: 528237 - DNA, 25 bp, Homo sapien
gtagtagtgtttgtttcctatctca

SEQ ID NO: 528238 - DNA, 25 bp, Homo sapien
gtttgtttcctatctcaagggcgaa

SEQ ID NO: 528239 - DNA, 25 bp, Homo sapien
gtttcctatctcaagggcgaaattt

SEQ ID NO: 528240 - DNA, 25 bp, Homo sapien
gggcgaaattttatgggaactcaat

SEQ ID NO: 528241 - DNA, 25 bp, Homo sapien
ggaactcaatttattatgcagtttt

SEQ ID NO: 528242 - DNA, 25 bp, Homo sapien
gcaatatgattttataatggctcct

SEQ ID NO: 528243 - DNA, 25 bp, Homo sapien
aatggctcctcattatgcttgctgt

SEQ ID NO: 528244 - DNA, 25 bp, Homo sapien
gctcctcattatgcttgctgttgaa

SEQ ID NO: 528245 - DNA, 25 bp, Homo sapien
atgcttgctgttgaaccttttatga

SEQ ID NO: 528246 - DNA, 25 bp, Homo sapien
gctgttgaaccttttatgaggagtg

SEQ ID NO: 528247 - DNA, 25 bp, Homo sapien
gaaattaaattgagtcctggtacct

SEQ ID NO: 528248 - DNA, 25 bp, Homo sapien
aattgagtcctggtacctggtcaaa

SEQ ID NO: 528249 - DNA, 25 bp, Homo sapien
gtacctggtcaaaatcattagaagt

SEQ ID NO: 528250 - DNA, 25 bp, Homo sapien
attagaagtttacctggcttctcaa

SEQ ID NO: 528251 - DNA, 25 bp, Homo sapien
ggttcagactgttggtaagagctgt

SEQ ID NO: 528252 - DNA, 25 bp, Homo sapien
gagctgtccagatacccagatggga

SEQ ID NO: 528253 - DNA, 25 bp, Homo sapien
aggaaggagacagccgcgcgcttca

SEQ ID NO: 528254 - DNA, 25 bp, Homo sapien
atttgtcacctcatgcatggaccat

SEQ ID NO: 528255 - DNA, 25 bp, Homo sapien
gcatggaccatactctgggtttgag

SEQ ID NO: 528256 - DNA, 25 bp, Homo sapien
ggtttgagatcattcttcattgaag

SEQ ID NO: 528257 - DNA, 25 bp, Homo sapien
gttgaaattgtaaagctccatgatc

SEQ ID NO: 528258 - DNA, 25 bp, Homo sapien
tgctattcttcgaggcagtggaccc

SEQ ID NO: 528259 - DNA, 25 bp, Homo sapien
gcagtggaccctgtttgctgatggt

SEQ ID NO: 528260 - DNA, 25 bp, Homo sapien
gtttgctgatggtcaacactctggc

SEQ ID NO: 528261 - DNA, 25 bp, Homo sapien
tgatggtcaacactctggccctgct

SEQ ID NO: 528262 - DNA, 25 bp, Homo sapien
tgccccatgtccctgtggagaagtg

SEQ ID NO: 528263 - DNA, 25 bp, Homo sapien
ccatgtccctgtggagaagtgtgaa

SEQ ID NO: 528264 - DNA, 25 bp, Homo sapien
tgccttaaacccacacttccaggga

SEQ ID NO: 528265 - DNA, 25 bp, Homo sapien
ttccagggacccttcagcacaggtc

SEQ ID NO: 528266 - DNA, 25 bp, Homo sapien
ttcccatggtgcttctcaccctgaa

SEQ ID NO: 528267 - DNA, 25 bp, Homo sapien
cctcagagctacagccagggataga

SEQ ID NO: 528268 - DNA, 25 bp, Homo sapien
tacagccagggatagagcagatgag

SEQ ID NO: 528269 - DNA, 25 bp, Homo sapien
gtaagagctgtccagatacccagat

SEQ ID NO: 528270 - DNA, 25 bp, Homo sapien
gagctgtccagatacccagatggga

SEQ ID NO: 528271 - DNA, 25 bp, Homo sapien
tgtccagatacccagatgggaagga

SEQ ID NO: 528272 - DNA, 25 bp, Homo sapien
aggaaggagacagccgcgcgcttca

SEQ ID NO: 528273 - DNA, 25 bp, Homo sapien
gcttcactccatttgtcacctcatg

SEQ ID NO: 528274 - DNA, 25 bp, Homo sapien
atttgtcacctcatgcatggaccat

SEQ ID NO: 528275 - DNA, 25 bp, Homo sapien
tgtcacctcatgcatggaccatact

SEQ ID NO: 528276 - DNA, 25 bp, Homo sapien
tcatgcatggaccatactctgggtt

SEQ ID NO: 528277 - DNA, 25 bp, Homo sapien
gcatggaccatactctgggtttgag

SEQ ID NO: 528278 - DNA, 25 bp, Homo sapien
ggaccatactctgggtttgagatca

SEQ ID NO: 528279 - DNA, 25 bp, Homo sapien
gttgaaattgtaaagctccatgatc

SEQ ID NO: 528280 - DNA, 25 bp, Homo sapien
agcaaggctgttgtctgtatggaag

SEQ ID NO: 528281 - DNA, 25 bp, Homo sapien
gtatggaaggacacgctcgcggcaa

SEQ ID NO: 528282 - DNA, 25 bp, Homo sapien
gcctgtccagtcctgcagacaaggg

SEQ ID NO: 528283 - DNA, 25 bp, Homo sapien
aagaatgaggacaccctcggcacgg

SEQ ID NO: 528284 - DNA, 25 bp, Homo sapien
tcggcacgggaacccattcacttag

SEQ ID NO: 528285 - DNA, 25 bp, Homo sapien
attcacttagcgtttgctccagtag

SEQ ID NO: 528286 - DNA, 25 bp, Homo sapien
ttagcgtttgctccagtagctttcc

SEQ ID NO: 528287 - DNA, 25 bp, Homo sapien
agtagctttccctctgctaccaatg

SEQ ID NO: 528288 - DNA, 25 bp, Homo sapien
ctaccaatgcagataaacgcggctt

SEQ ID NO: 528289 - DNA, 25 bp, Homo sapien
aacgcggcttgttttactcaggcaa

SEQ ID NO: 528290 - DNA, 25 bp, Homo sapien
tagtgccaagaaaatcctttacatt

SEQ ID NO: 528291 - DNA, 25 bp, Homo sapien
agctttaatagccatgggttctttt

SEQ ID NO: 528292 - DNA, 25 bp, Homo sapien
gggtaatgtacacacctaactgcat

SEQ ID NO: 528293 - DNA, 25 bp, Homo sapien
actgcatttgttttgacttctttaa

SEQ ID NO: 528294 - DNA, 25 bp, Homo sapien
aagccatcatgtgggctttcttcat

SEQ ID NO: 528295 - DNA, 25 bp, Homo sapien
ttcttcagcatattatccgcttcgc

SEQ ID NO: 528296 - DNA, 25 bp, Homo sapien
tatccgcttcgctttctgtttatca

SEQ ID NO: 528297 - DNA, 25 bp, Homo sapien
aatgtacatgtttggctctactcct

SEQ ID NO: 528298 - DNA, 25 bp, Homo sapien
ggctctactccttggttatttttag

SEQ ID NO: 528299 - DNA, 25 bp, Homo sapien
aaagcatgcagtcggtttttcagcc

SEQ ID NO: 528300 - DNA, 25 bp, Homo sapien
tttcagccacttttagatactcatg

SEQ ID NO: 528301 - DNA, 25 bp, Homo sapien
gatactcatgcaacatagcctactt

SEQ ID NO: 528302 - DNA, 25 bp, Homo sapien
ccacccagagagagatgacttcaca

SEQ ID NO: 528303 - DNA, 25 bp, Homo sapien
gatgacttcacagtttgttcatatg

SEQ ID NO: 528304 - DNA, 25 bp, Homo sapien
atatgagcatcatcccatgtcgtcc

SEQ ID NO: 528305 - DNA, 25 bp, Homo sapien
tgtcgtccccaacccagggctggta

SEQ ID NO: 528306 - DNA, 25 bp, Homo sapien
aggtgctacagcttgtgcttcatgc

SEQ ID NO: 528307 - DNA, 25 bp, Homo sapien
gagctttgcagggtctactgcagac

SEQ ID NO: 528308 - DNA, 25 bp, Homo sapien
tctctgacattaccctgtgcaactt

SEQ ID NO: 528309 - DNA, 25 bp, Homo sapien
ttaccctgtgcaacttttctcaaag

SEQ ID NO: 528310 - DNA, 25 bp, Homo sapien
cttttctcaaagtctgttgcaccac

SEQ ID NO: 528311 - DNA, 25 bp, Homo sapien
aagtctgttgcaccactcagcaaag

SEQ ID NO: 528312 - DNA, 25 bp, Homo sapien
gcaagttgcaccagctatatcagaa

SEQ ID NO: 528313 - DNA, 25 bp, Homo sapien
gtcagatttccccacatatttgaac

SEQ ID NO: 528314 - DNA, 25 bp, Homo sapien
tatttgaacccttattctgggtcca

SEQ ID NO: 528315 - DNA, 25 bp, Homo sapien
gtcttcacttccacaactgctgtgt

SEQ ID NO: 528316 - DNA, 25 bp, Homo sapien
tggatcttctgggagccatttgtaa

SEQ ID NO: 528317 - DNA, 25 bp, Homo sapien
acgagatggtacttctcttgggccc

SEQ ID NO: 528318 - DNA, 25 bp, Homo sapien
cggatcgctattctcgactatttgc

SEQ ID NO: 528319 - DNA, 25 bp, Homo sapien
tcgactatttgcgtttcgcgaccgg

SEQ ID NO: 528320 - DNA, 25 bp, Homo sapien
taaaactcttcgatgtctcactgct

SEQ ID NO: 528321 - DNA, 25 bp, Homo sapien
atgtctcactgctgttgttcagtca

SEQ ID NO: 528322 - DNA, 25 bp, Homo sapien
tgttgttcagtcactctctgactta

SEQ ID NO: 528323 - DNA, 25 bp, Homo sapien
ttagaggtcagatttccccacatat

SEQ ID NO: 528324 - DNA, 25 bp, Homo sapien
ggcagttaaatgaacccaggaaaga

SEQ ID NO: 528325 - DNA, 25 bp, Homo sapien
atgaacccaggaaagacccatcctc

SEQ ID NO: 528326 - DNA, 25 bp, Homo sapien
tctctgaggccccatgaggccaagc

SEQ ID NO: 528327 - DNA, 25 bp, Homo sapien
tacccagccaaactccagttttagt

SEQ ID NO: 528328 - DNA, 25 bp, Homo sapien
cagagtcctgaaaatcaaactatac

SEQ ID NO: 528329 - DNA, 25 bp, Homo sapien
gagtcctgaaaatcaaactatacaa

SEQ ID NO: 528330 - DNA, 25 bp, Homo sapien
ctatacaagtagtaggaagtccatt

SEQ ID NO: 528331 - DNA, 25 bp, Homo sapien
agtaggaagtccattaagctgttta

SEQ ID NO: 528332 - DNA, 25 bp, Homo sapien
taggaagtccattaagctgtttaga

SEQ ID NO: 528333 - DNA, 25 bp, Homo sapien
ggaagtccattaagctgtttagagg

SEQ ID NO: 528334 - DNA, 25 bp, Homo sapien
gaagtccattaagctgtttagagga

SEQ ID NO: 528335 - DNA, 25 bp, Homo sapien
gaagccatggcttctgatctccact

SEQ ID NO: 528336 - DNA, 25 bp, Homo sapien
atctccactccactttatttctctg

SEQ ID NO: 528337 - DNA, 25 bp, Homo sapien
aataggctgcaggtctccagagcat

SEQ ID NO: 528338 - DNA, 25 bp, Homo sapien
ggtctccagagcatatcgatgcagt

SEQ ID NO: 528339 - DNA, 25 bp, Homo sapien
agtactgtactagagctgttgtgac

SEQ ID NO: 528340 - DNA, 25 bp, Homo sapien
gagctgttgtgactgattcactcaa

SEQ ID NO: 528341 - DNA, 25 bp, Homo sapien
gattcactcaaactttcctgcatac

SEQ ID NO: 528342 - DNA, 25 bp, Homo sapien
ccaggccttgggtttacagcataag

SEQ ID NO: 528343 - DNA, 25 bp, Homo sapien
ttgtggtgcaacctggcaaatccct

SEQ ID NO: 528344 - DNA, 25 bp, Homo sapien
gattggatcctacttgggctatcac

SEQ ID NO: 528345 - DNA, 25 bp, Homo sapien
gggctatcacagagcattgaccatt

SEQ ID NO: 528346 - DNA, 25 bp, Homo sapien
attaatgagatttgtcttcagccac

SEQ ID NO: 528347 - DNA, 25 bp, Homo sapien
tggccttgaagcagagggcacagcc

SEQ ID NO: 528348 - DNA, 25 bp, Homo sapien
gccttgaagcagagggcacagccct

SEQ ID NO: 528349 - DNA, 25 bp, Homo sapien
ataagtatgaatacacagtgtggca

SEQ ID NO: 528350 - DNA, 25 bp, Homo sapien
acagtgtggcagtgttgtggttttt

SEQ ID NO: 528351 - DNA, 25 bp, Homo sapien
ttttttaaaccgaaatctgtggatg

SEQ ID NO: 528352 - DNA, 25 bp, Homo sapien
aaaccgaaatctgtggatgaaatag

SEQ ID NO: 528353 - DNA, 25 bp, Homo sapien
aatctgtggatgaaatagaagctgg

SEQ ID NO: 528354 - DNA, 25 bp, Homo sapien
gagccctcctcttggaatattcagc

SEQ ID NO: 528355 - DNA, 25 bp, Homo sapien
ggaatattcagcctaagaacctcat

SEQ ID NO: 528356 - DNA, 25 bp, Homo sapien
aatattcagcctaagaacctcatag

SEQ ID NO: 528357 - DNA, 25 bp, Homo sapien
gggcgctgctcgcttgcgggcgggc

SEQ ID NO: 528358 - DNA, 25 bp, Homo sapien
atgccaagaggtccatgtaagcctg

SEQ ID NO: 528359 - DNA, 25 bp, Homo sapien
aagaggtccatgtaagcctgggact

SEQ ID NO: 528360 - DNA, 25 bp, Homo sapien
aggtccatgtaagcctgggactcgg

SEQ ID NO: 528361 - DNA, 25 bp, Homo sapien
ggaccagctcccgaatcctttgagg

SEQ ID NO: 528362 - DNA, 25 bp, Homo sapien
accagctcccgaatcctttgaggga

SEQ ID NO: 528363 - DNA, 25 bp, Homo sapien
gctcccgaatcctttgagggaggat

SEQ ID NO: 528364 - DNA, 25 bp, Homo sapien
gagggaggattttgtcagccatctt

SEQ ID NO: 528365 - DNA, 25 bp, Homo sapien
gggaggattttgtcagccatcttcc

SEQ ID NO: 528366 - DNA, 25 bp, Homo sapien
gaggattttgtcagccatcttcctc

SEQ ID NO: 528367 - DNA, 25 bp, Homo sapien
gattttgtcagccatcttcctcctc

SEQ ID NO: 528368 - DNA, 25 bp, Homo sapien
gggctcacaaaccatgcaaatgcta

SEQ ID NO: 528369 - DNA, 25 bp, Homo sapien
aatgctatgagatgcatggagggct

SEQ ID NO: 528370 - DNA, 25 bp, Homo sapien
ccagcacttgtgttgtctggtggtg

SEQ ID NO: 528371 - DNA, 25 bp, Homo sapien
ttcaaagctttttccagaggctatt

SEQ ID NO: 528372 - DNA, 25 bp, Homo sapien
tccagaggctattattttcactgta

SEQ ID NO: 528373 - DNA, 25 bp, Homo sapien
tttcactgtagaatgatttcatgct

SEQ ID NO: 528374 - DNA, 25 bp, Homo sapien
gaatgatttcatgctatctctgtgt

SEQ ID NO: 528375 - DNA, 25 bp, Homo sapien
gatttcatgctatctctgtgtgcac

SEQ ID NO: 528376 - DNA, 25 bp, Homo sapien
ctctgtgtgcacaaatatttatttt

SEQ ID NO: 528377 - DNA, 25 bp, Homo sapien
tttctttctgtaaccataacaactt

SEQ ID NO: 528378 - DNA, 25 bp, Homo sapien
catatatgaggacttgtgtctctgt

SEQ ID NO: 528379 - DNA, 25 bp, Homo sapien
gagccttgggagataagccccatcc

SEQ ID NO: 528380 - DNA, 25 bp, Homo sapien
ccatccccagagatttcgattcatt

SEQ ID NO: 528381 - DNA, 25 bp, Homo sapien
cgattcatttgatactggcttggtg

SEQ ID NO: 528382 - DNA, 25 bp, Homo sapien
ttgatactggcttggtgtggaactg

SEQ ID NO: 528383 - DNA, 25 bp, Homo sapien
tccaggtgattgttgtgtacagcca

SEQ ID NO: 528384 - DNA, 25 bp, Homo sapien
acagccagcattcagattataggtg

SEQ ID NO: 528385 - DNA, 25 bp, Homo sapien
aggtgtaccctagataacataagtt

SEQ ID NO: 528386 - DNA, 25 bp, Homo sapien
cataagttagggtggctgttgttgc

SEQ ID NO: 528387 - DNA, 25 bp, Homo sapien
tggctgttgttgctgttactatctt

SEQ ID NO: 528388 - DNA, 25 bp, Homo sapien
gctgttactatcttggcacctttat

SEQ ID NO: 528389 - DNA, 25 bp, Homo sapien
ggcacctttattattaatgggtcat

SEQ ID NO: 528390 - DNA, 25 bp, Homo sapien
gttccttttcaaagtggagagacct

SEQ ID NO: 528391 - DNA, 25 bp, Homo sapien
gagagacctgaatatagattgtaac

SEQ ID NO: 528392 - DNA, 25 bp, Homo sapien
caagcaggcatatatgtctctggga

SEQ ID NO: 528393 - DNA, 25 bp, Homo sapien
ggcatatatgtctctgggatgcaga

SEQ ID NO: 528394 - DNA, 25 bp, Homo sapien
ctaggtgataccagagatgtgaata

SEQ ID NO: 528395 - DNA, 25 bp, Homo sapien
gagttcattccttgaaagtccaaac

SEQ ID NO: 528396 - DNA, 25 bp, Homo sapien
tgaaagtccaaacctaactggtctt

SEQ ID NO: 528397 - DNA, 25 bp, Homo sapien
acctaactggtcttaattgattact

SEQ ID NO: 528398 - DNA, 25 bp, Homo sapien
aaccctatgaattttcagtttgtgc

SEQ ID NO: 528399 - DNA, 25 bp, Homo sapien
cagtttgtgcttacattttctaaca

SEQ ID NO: 528400 - DNA, 25 bp, Homo sapien
tgcttacattttctaacattggatg

SEQ ID NO: 528401 - DNA, 25 bp, Homo sapien
aaaccagacgagctaaactttgcct

SEQ ID NO: 528402 - DNA, 25 bp, Homo sapien
gagctaaactttgcctagtgtgtct

SEQ ID NO: 528403 - DNA, 25 bp, Homo sapien
tacaaccattttttaggagacgcag

SEQ ID NO: 528404 - DNA, 25 bp, Homo sapien
ggagacgcaggaataccagggcata

SEQ ID NO: 528405 - DNA, 25 bp, Homo sapien
ataccagggcataataagatcagat

SEQ ID NO: 528406 - DNA, 25 bp, Homo sapien
agatcagattggtgtaattttgtat

SEQ ID NO: 528407 - DNA, 25 bp, Homo sapien
gtatgtttttgaaatccttcattaa

SEQ ID NO: 528408 - DNA, 25 bp, Homo sapien
ccttcattaattgtagaaccttgat

SEQ ID NO: 528409 - DNA, 25 bp, Homo sapien
acaaacaggtttcagtatttgcaca

SEQ ID NO: 528410 - DNA, 25 bp, Homo sapien
gaacaacccctcaaaatagatattt

SEQ ID NO: 528411 - DNA, 25 bp, Homo sapien
tatctatactttatgttatactgga

SEQ ID NO: 528412 - DNA, 25 bp, Homo sapien
gatcagcatttgcatggaacacatg

SEQ ID NO: 528413 - DNA, 25 bp, Homo sapien
atggaacacatggacggcggctccc

SEQ ID NO: 528414 - DNA, 25 bp, Homo sapien
gcggctccctggaccaggtgctgaa

SEQ ID NO: 528415 - DNA, 25 bp, Homo sapien
gaccaggtgctgaaagaggccaaga

SEQ ID NO: 528416 - DNA, 25 bp, Homo sapien
ggccaagaggattcccgaggagatc

SEQ ID NO: 528417 - DNA, 25 bp, Homo sapien
gggaaagtcagcatcgcggttctcc

SEQ ID NO: 528418 - DNA, 25 bp, Homo sapien
gcttggcgtacctccgagagaagca

SEQ ID NO: 528419 - DNA, 25 bp, Homo sapien
acctccgagagaagcaccagatcat

SEQ ID NO: 528420 - DNA, 25 bp, Homo sapien
accagatcatgcaccgagatgtgaa

SEQ ID NO: 528421 - DNA, 25 bp, Homo sapien
tccaacatcctcgtgaactctagag

SEQ ID NO: 528422 - DNA, 25 bp, Homo sapien
gagcggccagctcatagactccatg

SEQ ID NO: 528423 - DNA, 25 bp, Homo sapien
ggacttaattccttcctgagttgtg

SEQ ID NO: 528424 - DNA, 25 bp, Homo sapien
gacttaattccttcctgagttgtgg

SEQ ID NO: 528425 - DNA, 25 bp, Homo sapien
ctataagcttggaagagtctgtata

SEQ ID NO: 528426 - DNA, 25 bp, Homo sapien
gaagagtctgtataattgtaatcac

SEQ ID NO: 528427 - DNA, 25 bp, Homo sapien
aattgtaatcacagggtgacagcac

SEQ ID NO: 528428 - DNA, 25 bp, Homo sapien
gggtgacagcactcagaatctaaac

SEQ ID NO: 528429 - DNA, 25 bp, Homo sapien
gacagcactcagaatctaaactggg

SEQ ID NO: 528430 - DNA, 25 bp, Homo sapien
agcactcagaatctaaactgggctt

SEQ ID NO: 528431 - DNA, 25 bp, Homo sapien
agaatctaaactgggcttatgtggt

SEQ ID NO: 528432 - DNA, 25 bp, Homo sapien
tctaaactgggcttatgtggtattc

SEQ ID NO: 528433 - DNA, 25 bp, Homo sapien
taaactgggcttatgtggtattctc

SEQ ID NO: 528434 - DNA, 25 bp, Homo sapien
ctctgttctgtgcatactgtttttt

SEQ ID NO: 528435 - DNA, 25 bp, Homo sapien
ttccaagaaaccctcttattataat

SEQ ID NO: 528436 - DNA, 25 bp, Homo sapien
aaaatcttgagtcatttcagctatg

SEQ ID NO: 528437 - DNA, 25 bp, Homo sapien
catttcagctatgtgcaaagttgat

SEQ ID NO: 528438 - DNA, 25 bp, Homo sapien
gcaaagttgataaagtcactgactg

SEQ ID NO: 528439 - DNA, 25 bp, Homo sapien
agcttgatgcttaaatgcttaaata

SEQ ID NO: 528440 - DNA, 25 bp, Homo sapien
ttaagcatttatgtcagtgaattca

SEQ ID NO: 528441 - DNA, 25 bp, Homo sapien
atctttaaatcactcaaaacccatt

SEQ ID NO: 528442 - DNA, 25 bp, Homo sapien
ttaaacttgtatgcctttactcagt

SEQ ID NO: 528443 - DNA, 25 bp, Homo sapien
gtatgcctttactcagttagttcca

SEQ ID NO: 528444 - DNA, 25 bp, Homo sapien
tgcctttactcagttagttccaatg

SEQ ID NO: 528445 - DNA, 25 bp, Homo sapien
ggaactggatgaatggtacctacaa

SEQ ID NO: 528446 - DNA, 25 bp, Homo sapien
ggatgcctaaccaaggactagagct

SEQ ID NO: 528447 - DNA, 25 bp, Homo sapien
gagctccttcttgagatctaaatct

SEQ ID NO: 528448 - DNA, 25 bp, Homo sapien
aagcagtgtgcttcaaaggcatcag

SEQ ID NO: 528449 - DNA, 25 bp, Homo sapien
gtgcttcaaaggcatcagacgatga

SEQ ID NO: 528450 - DNA, 25 bp, Homo sapien
gaaagcaacataccacaactaggag

SEQ ID NO: 528451 - DNA, 25 bp, Homo sapien
acaactaggagttatttctcaaact

SEQ ID NO: 528452 - DNA, 25 bp, Homo sapien
ctcaaacttaaatgtcctctgggaa

SEQ ID NO: 528453 - DNA, 25 bp, Homo sapien
agagcaaacttaacacactatccat

SEQ ID NO: 528454 - DNA, 25 bp, Homo sapien
acactatccattttcgagcaaactt

SEQ ID NO: 528455 - DNA, 25 bp, Homo sapien
gcaaacttaacccactatatccatt

SEQ ID NO: 528456 - DNA, 25 bp, Homo sapien
gaaatgtcatctaagccccagtgaa

SEQ ID NO: 528457 - DNA, 25 bp, Homo sapien
agtgaacctcctgggaggagagcta

SEQ ID NO: 528458 - DNA, 25 bp, Homo sapien
tggccagctgtctccaaagtgactg

SEQ ID NO: 528459 - DNA, 25 bp, Homo sapien
gtctccaaagtgactggatgctaca

SEQ ID NO: 528460 - DNA, 25 bp, Homo sapien
gctacagaagaactgggactgtctt

SEQ ID NO: 528461 - DNA, 25 bp, Homo sapien
cctggagttgtcagaacactgagca

SEQ ID NO: 528462 - DNA, 25 bp, Homo sapien
aacactgagcagtctcctagttctg

SEQ ID NO: 528463 - DNA, 25 bp, Homo sapien
agttctgcgtccgtctagccatggg

SEQ ID NO: 528464 - DNA, 25 bp, Homo sapien
gggtctgccatgaaagcctgtggat

SEQ ID NO: 528465 - DNA, 25 bp, Homo sapien
aagcctgtggatctgctattgggtt

SEQ ID NO: 528466 - DNA, 25 bp, Homo sapien
ttcacttgggtgaaacttgttcatc

SEQ ID NO: 528467 - DNA, 25 bp, Homo sapien
tcctctcagggcaggcacatgtacg

SEQ ID NO: 528468 - DNA, 25 bp, Homo sapien
gggcatacaaggcacagcgcctgtt

SEQ ID NO: 528469 - DNA, 25 bp, Homo sapien
aggcacagcgcctgttggaacaggt

SEQ ID NO: 528470 - DNA, 25 bp, Homo sapien
tgcaccagtcacatgcactggacga

SEQ ID NO: 528471 - DNA, 25 bp, Homo sapien
tcacatgcactggacgagggccgaa

SEQ ID NO: 528472 - DNA, 25 bp, Homo sapien
gagggccgaaactcctgtctgctat

SEQ ID NO: 528473 - DNA, 25 bp, Homo sapien
tgtctgctatcgagccctggtgcta

SEQ ID NO: 528474 - DNA, 25 bp, Homo sapien
ctggtgctatgtggccccggagcca

SEQ ID NO: 528475 - DNA, 25 bp, Homo sapien
agcacaatcatctcagtggcgaagc

SEQ ID NO: 528476 - DNA, 25 bp, Homo sapien
tggcgaagcacaccacttgattcta

SEQ ID NO: 528477 - DNA, 25 bp, Homo sapien
agcacaccacttgattctatttttt

SEQ ID NO: 528478 - DNA, 25 bp, Homo sapien
tgtgctacagtttattgtgcataat

SEQ ID NO: 528479 - DNA, 25 bp, Homo sapien
gaaaaacaactatgacagccttcag

SEQ ID NO: 528480 - DNA, 25 bp, Homo sapien
tgacagccttcagtcgggccagggt

SEQ ID NO: 528481 - DNA, 25 bp, Homo sapien
gccagggtgaagctgcttataccac

SEQ ID NO: 528482 - DNA, 25 bp, Homo sapien
tataccacctctgccgtcagaggga

SEQ ID NO: 528483 - DNA, 25 bp, Homo sapien
cacagggcgcactagagagagctca

SEQ ID NO: 528484 - DNA, 25 bp, Homo sapien
tagagagagctcagcacccctgctg

SEQ ID NO: 528485 - DNA, 25 bp, Homo sapien
ccagcagagcccgtgctgagggaat

SEQ ID NO: 528486 - DNA, 25 bp, Homo sapien
tgctgagggaatgccgcacagatgc

SEQ ID NO: 528487 - DNA, 25 bp, Homo sapien
tgccgcacagatgctgatgcactgg

SEQ ID NO: 528488 - DNA, 25 bp, Homo sapien
gatgcactgggtgaaatttctagta

SEQ ID NO: 528489 - DNA, 25 bp, Homo sapien
tttctttatatcctttatgtcgtgt

SEQ ID NO: 528490 - DNA, 25 bp, Homo sapien
ctttatatcctttatgtcgtgtagt

SEQ ID NO: 528491 - DNA, 25 bp, Homo sapien
atcctttatgtcgtgtagtttgtat

SEQ ID NO: 528492 - DNA, 25 bp, Homo sapien
gtcgtgtagtttgtataatgtgttt

SEQ ID NO: 528493 - DNA, 25 bp, Homo sapien
cacgcccagcctagaaatgattctt

SEQ ID NO: 528494 - DNA, 25 bp, Homo sapien
aatgattcttagagctgtaggcctt

SEQ ID NO: 528495 - DNA, 25 bp, Homo sapien
gattcttagagctgtaggcctttac

SEQ ID NO: 528496 - DNA, 25 bp, Homo sapien
cttagagctgtaggcctttacttca

SEQ ID NO: 528497 - DNA, 25 bp, Homo sapien
agagctgtaggcctttacttcatca

SEQ ID NO: 528498 - DNA, 25 bp, Homo sapien
gctgtaggcctttacttcatcattt

SEQ ID NO: 528499 - DNA, 25 bp, Homo sapien
cagtttaaattaatcagttgcttat

SEQ ID NO: 528500 - DNA, 25 bp, Homo sapien
ggaaaagttcagttagaagacatac

SEQ ID NO: 528501 - DNA, 25 bp, Homo sapien
gaagacatacttcaccatcttgaaa

SEQ ID NO: 528502 - DNA, 25 bp, Homo sapien
gaagaaatcaatccccttgctacta

SEQ ID NO: 528503 - DNA, 25 bp, Homo sapien
caatccccttgctactacagaagaa

SEQ ID NO: 528504 - DNA, 25 bp, Homo sapien
gaagaacaactctgtttggtgctta

SEQ ID NO: 528505 - DNA, 25 bp, Homo sapien
aacaactctgtttggtgcttattcc

SEQ ID NO: 528506 - DNA, 25 bp, Homo sapien
ctctgtttggtgcttattccagcca

SEQ ID NO: 528507 - DNA, 25 bp, Homo sapien
ctgaggactgctaccacagatgtag

SEQ ID NO: 528508 - DNA, 25 bp, Homo sapien
tatagtgaagcacatgggtgaaaca

SEQ ID NO: 528509 - DNA, 25 bp, Homo sapien
gacacctgtgattttgttcattgcc

SEQ ID NO: 528510 - DNA, 25 bp, Homo sapien
gattttgttcattgcccttcattaa

SEQ ID NO: 528511 - DNA, 25 bp, Homo sapien
taatctgaagagcaccacttctcct

SEQ ID NO: 528512 - DNA, 25 bp, Homo sapien
ttgccactgatatttttactggata

SEQ ID NO: 528513 - DNA, 25 bp, Homo sapien
ggctaattgttgaactggtgtcgta

SEQ ID NO: 528514 - DNA, 25 bp, Homo sapien
gggcccacgtctaaaagagcacata

SEQ ID NO: 528515 - DNA, 25 bp, Homo sapien
gaaattgtctacaggagccaaggtg

SEQ ID NO: 528516 - DNA, 25 bp, Homo sapien
agccaaggtgaaagtctctgatgac

SEQ ID NO: 528517 - DNA, 25 bp, Homo sapien
gaaagtctctgatgacggcggaact

SEQ ID NO: 528518 - DNA, 25 bp, Homo sapien
atgacggcggaactggctccattag

SEQ ID NO: 528519 - DNA, 25 bp, Homo sapien
tggctccattagaccatggttcatc

SEQ ID NO: 528520 - DNA, 25 bp, Homo sapien
aatgctttgctgactaatgttgacc

SEQ ID NO: 528521 - DNA, 25 bp, Homo sapien
actaatgttgaccagattgtccagg

SEQ ID NO: 528522 - DNA, 25 bp, Homo sapien
agctatgaaactggtgcccttgaaa

SEQ ID NO: 528523 - DNA, 25 bp, Homo sapien
ttataggcagagcatcgacaagttg

SEQ ID NO: 528524 - DNA, 25 bp, Homo sapien
gacaccccacagattgttcaagcca

SEQ ID NO: 528525 - DNA, 25 bp, Homo sapien
aaaatcaatgcccagcagctgagtc

SEQ ID NO: 528526 - DNA, 25 bp, Homo sapien
gcagctgagtcatgtgaattaccgt

SEQ ID NO: 528527 - DNA, 25 bp, Homo sapien
gaattaccgtgctgactatgagaaa

SEQ ID NO: 528528 - DNA, 25 bp, Homo sapien
gttgaattacacattgccccaggat

SEQ ID NO: 528529 - DNA, 25 bp, Homo sapien
cccaggatgttcctcagctggtgaa

SEQ ID NO: 528530 - DNA, 25 bp, Homo sapien
tcagctggtgaaggccaaaaccaat

SEQ ID NO: 528531 - DNA, 25 bp, Homo sapien
aaaccaatgccaaactcttcagtga

SEQ ID NO: 528532 - DNA, 25 bp, Homo sapien
gatttgagatgaagctggatgccat

SEQ ID NO: 528533 - DNA, 25 bp, Homo sapien
attgttgccagatatgcatattgga

SEQ ID NO: 528534 - DNA, 25 bp, Homo sapien
gcatattggaatcccatctacccat

SEQ ID NO: 528535 - DNA, 25 bp, Homo sapien
atctacccatagttcctctgaaggt

SEQ ID NO: 528536 - DNA, 25 bp, Homo sapien
cccatagttcctctgaaggtgattt

SEQ ID NO: 528537 - DNA, 25 bp, Homo sapien
atatacctaaaagcgaatttgtggc

SEQ ID NO: 528538 - DNA, 25 bp, Homo sapien
aagcgaatttgtggctgagaggata

SEQ ID NO: 528539 - DNA, 25 bp, Homo sapien
tgtttgctcatgttctgtgccccac

SEQ ID NO: 528540 - DNA, 25 bp, Homo sapien
acacccaccaatacctaaatctgtt

SEQ ID NO: 528541 - DNA, 25 bp, Homo sapien
tgttttctttgtgctcattgagtag

SEQ ID NO: 528542 - DNA, 25 bp, Homo sapien
gtgctcattgagtagttccagacag

SEQ ID NO: 528543 - DNA, 25 bp, Homo sapien
aagtacccagaattatcagaaacga

SEQ ID NO: 528544 - DNA, 25 bp, Homo sapien
gctagtttttctcctttgtttgact

SEQ ID NO: 528545 - DNA, 25 bp, Homo sapien
ttgtcaatttctatctggtttttaa

SEQ ID NO: 528546 - DNA, 25 bp, Homo sapien
gtcaatttctatctggtttttaagg

SEQ ID NO: 528547 - DNA, 25 bp, Homo sapien
tttctatctggtttttaagggtctg

SEQ ID NO: 528548 - DNA, 25 bp, Homo sapien
ctatctggtttttaagggtctgagc

SEQ ID NO: 528549 - DNA, 25 bp, Homo sapien
atctggtttttaagggtctgagctt

SEQ ID NO: 528550 - DNA, 25 bp, Homo sapien
ggtttttaagggtctgagcttagct

SEQ ID NO: 528551 - DNA, 25 bp, Homo sapien
aagggtctgagcttagcttgtgcat

SEQ ID NO: 528552 - DNA, 25 bp, Homo sapien
gggtctgagcttagcttgtgcatgc

SEQ ID NO: 528553 - DNA, 25 bp, Homo sapien
gtctgagcttagcttgtgcatgcaa

SEQ ID NO: 528554 - DNA, 25 bp, Homo sapien
gagcttagcttgtgcatgcaaggtt

SEQ ID NO: 528555 - DNA, 25 bp, Homo sapien
atgccttttcagtactaaacaccca

SEQ ID NO: 528556 - DNA, 25 bp, Homo sapien
tcagtactaaacacccatttcattg

SEQ ID NO: 528557 - DNA, 25 bp, Homo sapien
ccatttcattgctgattcctgtcta

SEQ ID NO: 528558 - DNA, 25 bp, Homo sapien
tttcattgctgattcctgtctaaga

SEQ ID NO: 528559 - DNA, 25 bp, Homo sapien
attcctgtctaagaagccattcacg

SEQ ID NO: 528560 - DNA, 25 bp, Homo sapien
ctaagaagccattcacgtcagcatg

SEQ ID NO: 528561 - DNA, 25 bp, Homo sapien
attcacgtcagcatggcgatagaaa

SEQ ID NO: 528562 - DNA, 25 bp, Homo sapien
aaaaccctgctgaatcatacagtaa

SEQ ID NO: 528563 - DNA, 25 bp, Homo sapien
tctttaaagcacatagtagttacat

SEQ ID NO: 528564 - DNA, 25 bp, Homo sapien
ttataactaacacaaggcaggatct

SEQ ID NO: 528565 - DNA, 25 bp, Homo sapien
ggcaggatcttgtgactctaagagt

SEQ ID NO: 528566 - DNA, 25 bp, Homo sapien
caagggaagatgtgctagcgcaagt

SEQ ID NO: 528567 - DNA, 25 bp, Homo sapien
gatgtgctagcgcaagtaggcaact

SEQ ID NO: 528568 - DNA, 25 bp, Homo sapien
gtaggcaactcaacacaagactcag

SEQ ID NO: 528569 - DNA, 25 bp, Homo sapien
acacaagactcagttggagagggaa

SEQ ID NO: 528570 - DNA, 25 bp, Homo sapien
ttcttcttattgtaggcgactggga

SEQ ID NO: 528571 - DNA, 25 bp, Homo sapien
gcgactgggagtcataattaccaaa

SEQ ID NO: 528572 - DNA, 25 bp, Homo sapien
taaaatgaccaaaatgttgctctta

SEQ ID NO: 528573 - DNA, 25 bp, Homo sapien
gctcttacctgagtatgttggcata

SEQ ID NO: 528574 - DNA, 25 bp, Homo sapien
gtatgttggcatacaactggaatgt

SEQ ID NO: 528575 - DNA, 25 bp, Homo sapien
acaactggaatgtatctgatggaag

SEQ ID NO: 528576 - DNA, 25 bp, Homo sapien
ttagcaaaaatgtcaaccagcaagg

SEQ ID NO: 528577 - DNA, 25 bp, Homo sapien
tatttcgtctcattaatgttgattc

SEQ ID NO: 528578 - DNA, 25 bp, Homo sapien
gttgattctataggttgttacttct

SEQ ID NO: 528579 - DNA, 25 bp, Homo sapien
atctgcttctataatgtcatggtga

SEQ ID NO: 528580 - DNA, 25 bp, Homo sapien
aggccacacagcaaaagtcaccaac

SEQ ID NO: 528581 - DNA, 25 bp, Homo sapien
gcatgtatacttatgagacctccct

SEQ ID NO: 528582 - DNA, 25 bp, Homo sapien
acttatgagacctcccttggaatga

SEQ ID NO: 528583 - DNA, 25 bp, Homo sapien
tcccttggaatgagggaggtctcaa

SEQ ID NO: 528584 - DNA, 25 bp, Homo sapien
gtcaccaactcaaacctacttctta

SEQ ID NO: 528585 - DNA, 25 bp, Homo sapien
acttcttatttactccaaagcctgt

SEQ ID NO: 528586 - DNA, 25 bp, Homo sapien
caaagcctgttgttcttaactgcaa

SEQ ID NO: 528587 - DNA, 25 bp, Homo sapien
aactgcaacatattatttcgtctca

SEQ ID NO: 528588 - DNA, 25 bp, Homo sapien
tcatcacagtccaatctaccaaact

SEQ ID NO: 528589 - DNA, 25 bp, Homo sapien
caaactgagtgaccctaaaggacat

SEQ ID NO: 528590 - DNA, 25 bp, Homo sapien
aatgttcccatagcatcaggtgagc

SEQ ID NO: 528591 - DNA, 25 bp, Homo sapien
ggatgcccactgtagaccacatgga

SEQ ID NO: 528592 - DNA, 25 bp, Homo sapien
ggaaatggcagtccctccacggaga

SEQ ID NO: 528593 - DNA, 25 bp, Homo sapien
gggaatcacaggaacacatttacca

SEQ ID NO: 528594 - DNA, 25 bp, Homo sapien
tttctccctaatcagtgtccttatt

SEQ ID NO: 528595 - DNA, 25 bp, Homo sapien
gtgtccttatttcagtgtgctcaca

SEQ ID NO: 528596 - DNA, 25 bp, Homo sapien
agtgtgctcacatgctcgcctagga

SEQ ID NO: 528597 - DNA, 25 bp, Homo sapien
gctcgcctaggactgctttagagta

SEQ ID NO: 528598 - DNA, 25 bp, Homo sapien
tttagagtacaactctggacccgcc

SEQ ID NO: 528599 - DNA, 25 bp, Homo sapien
aatgtagtacaacagtgacagttat

SEQ ID NO: 528600 - DNA, 25 bp, Homo sapien
gtgacagttatgacaggcttacctt

SEQ ID NO: 528601 - DNA, 25 bp, Homo sapien
caggcttaccttggaagagttgtca

SEQ ID NO: 528602 - DNA, 25 bp, Homo sapien
gagttgtcatttttactgccaattt

SEQ ID NO: 528603 - DNA, 25 bp, Homo sapien
aacctttcaaaatggtctgcaaaca

SEQ ID NO: 528604 - DNA, 25 bp, Homo sapien
gagcaggaattgcacaattaactca

SEQ ID NO: 528605 - DNA, 25 bp, Homo sapien
gctcccttagtgaggccgatcttaa

SEQ ID NO: 528606 - DNA, 25 bp, Homo sapien
gccgatcttaagatggccgattctg

SEQ ID NO: 528607 - DNA, 25 bp, Homo sapien
aagatggccgattctgcccgttgaa

SEQ ID NO: 528608 - DNA, 25 bp, Homo sapien
atggccgattctgcccgttgaaggc

SEQ ID NO: 528609 - DNA, 25 bp, Homo sapien
atctcaccacgacttctcctggagt

SEQ ID NO: 528610 - DNA, 25 bp, Homo sapien
ctcggctaacgccaagtcgcgcaga

SEQ ID NO: 528611 - DNA, 25 bp, Homo sapien
tcggctaacgccaagtcgcgcagac

SEQ ID NO: 528612 - DNA, 25 bp, Homo sapien
gctaacgccaagtcgcgcagaccta

SEQ ID NO: 528613 - DNA, 25 bp, Homo sapien
ctaacgccaagtcgcgcagacctaa

SEQ ID NO: 528614 - DNA, 25 bp, Homo sapien
cgccaagtcgcgcagacctaaggag

SEQ ID NO: 528615 - DNA, 25 bp, Homo sapien
gccaagtcgcgcagacctaaggaga

SEQ ID NO: 528616 - DNA, 25 bp, Homo sapien
ccaagtcgcgcagacctaaggagaa

SEQ ID NO: 528617 - DNA, 25 bp, Homo sapien
caagtcgcgcagacctaaggagaag

SEQ ID NO: 528618 - DNA, 25 bp, Homo sapien
aagtcgcgcagacctaaggagaagc

SEQ ID NO: 528619 - DNA, 25 bp, Homo sapien
cgcgcagacctaaggagaagcggga

SEQ ID NO: 528620 - DNA, 25 bp, Homo sapien
agaggaggaggcacggtctcggtgg

SEQ ID NO: 528621 - DNA, 25 bp, Homo sapien
ttgcatgttgaagcctgtataaaac

SEQ ID NO: 528622 - DNA, 25 bp, Homo sapien
gttgaagcctgtataaaacatggta

SEQ ID NO: 528623 - DNA, 25 bp, Homo sapien
tgaagcctgtataaaacatggtaca

SEQ ID NO: 528624 - DNA, 25 bp, Homo sapien
gcctgtataaaacatggtacagtga

SEQ ID NO: 528625 - DNA, 25 bp, Homo sapien
ccatccccaagaacactttatacat

SEQ ID NO: 528626 - DNA, 25 bp, Homo sapien
catccccaagaacactttatacata

SEQ ID NO: 528627 - DNA, 25 bp, Homo sapien
tggatatatgattactgtgcaaaaa

SEQ ID NO: 528628 - DNA, 25 bp, Homo sapien
tatatgattactgtgcaaaaattca

SEQ ID NO: 528629 - DNA, 25 bp, Homo sapien
ggaaatgaacatatatttgagcact

SEQ ID NO: 528630 - DNA, 25 bp, Homo sapien
aatgaacatatatttgagcactaat

SEQ ID NO: 528631 - DNA, 25 bp, Homo sapien
tttgagcactaatatgtaatgtaca

SEQ ID NO: 528632 - DNA, 25 bp, Homo sapien
ctttgaggtgtcagcagctggattg

SEQ ID NO: 528633 - DNA, 25 bp, Homo sapien
actgggcctggaagggctaaacatg

SEQ ID NO: 528634 - DNA, 25 bp, Homo sapien
ggctaaacatgctgagtgacccctg

SEQ ID NO: 528635 - DNA, 25 bp, Homo sapien
aaacatgctgagtgacccctgtgcc

SEQ ID NO: 528636 - DNA, 25 bp, Homo sapien
tgccctgctgcctgatcctgctgtg

SEQ ID NO: 528637 - DNA, 25 bp, Homo sapien
cctgctgtggaggagtcattccgca

SEQ ID NO: 528638 - DNA, 25 bp, Homo sapien
tggaggagtcattccgcagtgaccg

SEQ ID NO: 528639 - DNA, 25 bp, Homo sapien
gcagtgaccggctccaatgagggca

SEQ ID NO: 528640 - DNA, 25 bp, Homo sapien
tccaatgagggcacctcatcaccat

SEQ ID NO: 528641 - DNA, 25 bp, Homo sapien
aggtagagactctactctctgtccc

SEQ ID NO: 528642 - DNA, 25 bp, Homo sapien
cccagatcctctttctagcatgaat

SEQ ID NO: 528643 - DNA, 25 bp, Homo sapien
aaaaatccagtttacatctctgcag

SEQ ID NO: 528644 - DNA, 25 bp, Homo sapien
atccagtttacatctctgcagagag

SEQ ID NO: 528645 - DNA, 25 bp, Homo sapien
aaaattgttatccatatgtctttta

SEQ ID NO: 528646 - DNA, 25 bp, Homo sapien
agttatgtgtaagtcccatttattt

SEQ ID NO: 528647 - DNA, 25 bp, Homo sapien
gttaaagaactggatgataatgcct

SEQ ID NO: 528648 - DNA, 25 bp, Homo sapien
gatgataatgcctatatttttgcct

SEQ ID NO: 528649 - DNA, 25 bp, Homo sapien
aatgcctatatttttgccttatgaa

SEQ ID NO: 528650 - DNA, 25 bp, Homo sapien
tttgccttatgaattgtgctgtgta

SEQ ID NO: 528651 - DNA, 25 bp, Homo sapien
gaattgtgctgtgtattataaacca

SEQ ID NO: 528652 - DNA, 25 bp, Homo sapien
ctgtgtattataaaccagcaacggt

SEQ ID NO: 528653 - DNA, 25 bp, Homo sapien
ccagcaacggttttgattttaacag

SEQ ID NO: 528654 - DNA, 25 bp, Homo sapien
aaacatttaactccatgccagacct

SEQ ID NO: 528655 - DNA, 25 bp, Homo sapien
aactccatgccagaccttgttttaa

SEQ ID NO: 528656 - DNA, 25 bp, Homo sapien
ttgttttaacccctctcacatcatg

SEQ ID NO: 528657 - DNA, 25 bp, Homo sapien
tgttctttccttttttgcgagttat

SEQ ID NO: 528658 - DNA, 25 bp, Homo sapien
gcgagttattttgcattaaccaact

SEQ ID NO: 528659 - DNA, 25 bp, Homo sapien
attaaccaactttgtcagtgacaga

SEQ ID NO: 528660 - DNA, 25 bp, Homo sapien
gatgcgtatctgagggtgtcacaca

SEQ ID NO: 528661 - DNA, 25 bp, Homo sapien
tgtcacacacgaccttcagcaggga

SEQ ID NO: 528662 - DNA, 25 bp, Homo sapien
tcagcagggaagacttctgggccat

SEQ ID NO: 528663 - DNA, 25 bp, Homo sapien
gagggccgtctaatacatggactta

SEQ ID NO: 528664 - DNA, 25 bp, Homo sapien
ggacttataaactgactgcatgagc

SEQ ID NO: 528665 - DNA, 25 bp, Homo sapien
gaaaaggctttctgcaaatacatgc

SEQ ID NO: 528666 - DNA, 25 bp, Homo sapien
atgccctaaagtttctcagagcctg

SEQ ID NO: 528667 - DNA, 25 bp, Homo sapien
caaaggtctcaactcctcatcattt

SEQ ID NO: 528668 - DNA, 25 bp, Homo sapien
ctcaactcctcatcatttcaatggg

SEQ ID NO: 528669 - DNA, 25 bp, Homo sapien
atttcaatgggtgccagggtctctg

SEQ ID NO: 528670 - DNA, 25 bp, Homo sapien
tgccagggtctctgttctcaggctg

SEQ ID NO: 528671 - DNA, 25 bp, Homo sapien
tcctgggtcaggttttccttctagg

SEQ ID NO: 528672 - DNA, 25 bp, Homo sapien
caggttttccttctaggtgctgttc

SEQ ID NO: 528673 - DNA, 25 bp, Homo sapien
gtgctgttccggtggattctgaaat

SEQ ID NO: 528674 - DNA, 25 bp, Homo sapien
attctgaaatgcagtagagggcttt

SEQ ID NO: 528675 - DNA, 25 bp, Homo sapien
aataaagtgcatttgctcaggcccc

SEQ ID NO: 528676 - DNA, 25 bp, Homo sapien
aaaacttctgacctgagacatcgaa

SEQ ID NO: 528677 - DNA, 25 bp, Homo sapien
gaagcagataaaaagccgctacaca

SEQ ID NO: 528678 - DNA, 25 bp, Homo sapien
aagttaacagttatctctgaccaca

SEQ ID NO: 528679 - DNA, 25 bp, Homo sapien
atgtatcgctacaactagagggcag

SEQ ID NO: 528680 - DNA, 25 bp, Homo sapien
actagagggcagtcttgcctttctt

SEQ ID NO: 528681 - DNA, 25 bp, Homo sapien
tcttgcctttcttccattcaattat

SEQ ID NO: 528682 - DNA, 25 bp, Homo sapien
tcagtttctcatgttcctaagtgcc

SEQ ID NO: 528683 - DNA, 25 bp, Homo sapien
tcatgttcctaagtgccagcccaga

SEQ ID NO: 528684 - DNA, 25 bp, Homo sapien
gtgccagcccagaaccatggaatgt

SEQ ID NO: 528685 - DNA, 25 bp, Homo sapien
aagaaacacaaaactcactcctctg

SEQ ID NO: 528686 - DNA, 25 bp, Homo sapien
caacccttttcagggacagaaagca

SEQ ID NO: 528687 - DNA, 25 bp, Homo sapien
ttacagatgaaatctcactgctaat

SEQ ID NO: 528688 - DNA, 25 bp, Homo sapien
tacagatgaaatctcactgctaatg

SEQ ID NO: 528689 - DNA, 25 bp, Homo sapien
acagatgaaatctcactgctaatgc

SEQ ID NO: 528690 - DNA, 25 bp, Homo sapien
ttgccttggttattatggatgatag

SEQ ID NO: 528691 - DNA, 25 bp, Homo sapien
atagcccttataatgccttaactaa

SEQ ID NO: 528692 - DNA, 25 bp, Homo sapien
tagcccttataatgccttaactaag

SEQ ID NO: 528693 - DNA, 25 bp, Homo sapien
agcccttataatgccttaactaagg

SEQ ID NO: 528694 - DNA, 25 bp, Homo sapien
gcccttataatgccttaactaagga

SEQ ID NO: 528695 - DNA, 25 bp, Homo sapien
ccttataatgccttaactaaggaag

SEQ ID NO: 528696 - DNA, 25 bp, Homo sapien
cttataatgccttaactaaggaaga

SEQ ID NO: 528697 - DNA, 25 bp, Homo sapien
tataatgccttaactaaggaagaaa

SEQ ID NO: 528698 - DNA, 25 bp, Homo sapien
gctagtttttctcctttgtttgact

SEQ ID NO: 528699 - DNA, 25 bp, Homo sapien
gactttgtcaatttctatctggttt

SEQ ID NO: 528700 - DNA, 25 bp, Homo sapien
agcttagcttgtgcatgcaaggttt

SEQ ID NO: 528701 - DNA, 25 bp, Homo sapien
tttttgagcacagcttttcaccttt

SEQ ID NO: 528702 - DNA, 25 bp, Homo sapien
tgttgggtatttttctcttaataag

SEQ ID NO: 528703 - DNA, 25 bp, Homo sapien
ttgggtatttttctcttaataagag

SEQ ID NO: 528704 - DNA, 25 bp, Homo sapien
agaaatattggccatcgatttttac

SEQ ID NO: 528705 - DNA, 25 bp, Homo sapien
aatattggccatcgatttttacata

SEQ ID NO: 528706 - DNA, 25 bp, Homo sapien
ttggccatcgatttttacatataat

SEQ ID NO: 528707 - DNA, 25 bp, Homo sapien
tggccatcgatttttacatataata

SEQ ID NO: 528708 - DNA, 25 bp, Homo sapien
tgatataatttagtttgagaagttc

SEQ ID NO: 528709 - DNA, 25 bp, Homo sapien
gctgtcgtatgcctttgggagcctc

SEQ ID NO: 528710 - DNA, 25 bp, Homo sapien
tgtcgtatgcctttgggagcctctt

SEQ ID NO: 528711 - DNA, 25 bp, Homo sapien
gtcgtatgcctttgggagcctcttc

SEQ ID NO: 528712 - DNA, 25 bp, Homo sapien
tcgtatgcctttgggagcctcttct

SEQ ID NO: 528713 - DNA, 25 bp, Homo sapien
tcagggaaactctgtgtcactaaca

SEQ ID NO: 528714 - DNA, 25 bp, Homo sapien
agggaaactctgtgtcactaacagt

SEQ ID NO: 528715 - DNA, 25 bp, Homo sapien
ggaaactctgtgtcactaacagtgg

SEQ ID NO: 528716 - DNA, 25 bp, Homo sapien
aaactctgtgtcactaacagtgggt

SEQ ID NO: 528717 - DNA, 25 bp, Homo sapien
actctgtgtcactaacagtgggtat

SEQ ID NO: 528718 - DNA, 25 bp, Homo sapien
ctctgtgtcactaacagtgggtatg

SEQ ID NO: 528719 - DNA, 25 bp, Homo sapien
tggggtgactgttctgcattcatga

SEQ ID NO: 528720 - DNA, 25 bp, Homo sapien
aggcccagcactccgtctgatggga

SEQ ID NO: 528721 - DNA, 25 bp, Homo sapien
cccagcactccgtctgatgggagga

SEQ ID NO: 528722 - DNA, 25 bp, Homo sapien
tacccctcttcatgcactgatttgg

SEQ ID NO: 528723 - DNA, 25 bp, Homo sapien
ttggggaacatgactcccttttact

SEQ ID NO: 528724 - DNA, 25 bp, Homo sapien
cacatcacttaatttatttccgttt

SEQ ID NO: 528725 - DNA, 25 bp, Homo sapien
tttgtttctggttactgtgaatccc

SEQ ID NO: 528726 - DNA, 25 bp, Homo sapien
actgtgaatcccagaggagtctctc

SEQ ID NO: 528727 - DNA, 25 bp, Homo sapien
ctgtgcccacatgaagctgcttttt

SEQ ID NO: 528728 - DNA, 25 bp, Homo sapien
cccacatgaagctgctttttccggg

SEQ ID NO: 528729 - DNA, 25 bp, Homo sapien
gggcctctgtacagttgttactgac

SEQ ID NO: 528730 - DNA, 25 bp, Homo sapien
gttgttactgactctgatttctaag

SEQ ID NO: 528731 - DNA, 25 bp, Homo sapien
ccacgaggacggaccactgtactac

SEQ ID NO: 528732 - DNA, 25 bp, Homo sapien
gaggacggaccactgtactacccga

SEQ ID NO: 528733 - DNA, 25 bp, Homo sapien
ggaccactgtactacccgactgtca

SEQ ID NO: 528734 - DNA, 25 bp, Homo sapien
tgtactacccgactgtcagcaccat

SEQ ID NO: 528735 - DNA, 25 bp, Homo sapien
cgactgtcagcaccatcagcctggg

SEQ ID NO: 528736 - DNA, 25 bp, Homo sapien
ggcggccagaggacgatgaccctac

SEQ ID NO: 528737 - DNA, 25 bp, Homo sapien
ggccagaggacgatgaccctacaga

SEQ ID NO: 528738 - DNA, 25 bp, Homo sapien
ggacgatgaccctacagaacagcct

SEQ ID NO: 528739 - DNA, 25 bp, Homo sapien
cgatgaccctacagaacagcctcgg

SEQ ID NO: 528740 - DNA, 25 bp, Homo sapien
acctcgctactgctggaaccgcgca

SEQ ID NO: 528741 - DNA, 25 bp, Homo sapien
gcgtagacgcgctggacgccgcctc

SEQ ID NO: 528742 - DNA, 25 bp, Homo sapien
ctgtgcccacatgaagctgcttttt

SEQ ID NO: 528743 - DNA, 25 bp, Homo sapien
tgtgcccacatgaagctgctttttc

SEQ ID NO: 528744 - DNA, 25 bp, Homo sapien
tgcccacatgaagctgctttttccg

SEQ ID NO: 528745 - DNA, 25 bp, Homo sapien
cccacatgaagctgctttttccggg

SEQ ID NO: 528746 - DNA, 25 bp, Homo sapien
atgaagctgctttttccggggccac

SEQ ID NO: 528747 - DNA, 25 bp, Homo sapien
gggcctctgtacagttgttactgac

SEQ ID NO: 528748 - DNA, 25 bp, Homo sapien
gcctctgtacagttgttactgactc

SEQ ID NO: 528749 - DNA, 25 bp, Homo sapien
ctctgtacagttgttactgactctg

SEQ ID NO: 528750 - DNA, 25 bp, Homo sapien
ctgtacagttgttactgactctgat

SEQ ID NO: 528751 - DNA, 25 bp, Homo sapien
gtacagttgttactgactctgattt

SEQ ID NO: 528752 - DNA, 25 bp, Homo sapien
gttgttactgactctgatttctaag

SEQ ID NO: 528753 - DNA, 25 bp, Homo sapien
aagagtgagcataaagctgttgctt

SEQ ID NO: 528754 - DNA, 25 bp, Homo sapien
gttgctttctctacgatgctacaaa

SEQ ID NO: 528755 - DNA, 25 bp, Homo sapien
gctttctctacgatgctacaaaaga

SEQ ID NO: 528756 - DNA, 25 bp, Homo sapien
gggcaaatttttaatcttgcagtaa

SEQ ID NO: 528757 - DNA, 25 bp, Homo sapien
taagtcaatttacacagacctttgt

SEQ ID NO: 528758 - DNA, 25 bp, Homo sapien
ctttgtatttaatatgtctccctat

SEQ ID NO: 528759 - DNA, 25 bp, Homo sapien
taatatgtctccctatttgtataga

SEQ ID NO: 528760 - DNA, 25 bp, Homo sapien
gtctccctatttgtatagaatttca

SEQ ID NO: 528761 - DNA, 25 bp, Homo sapien
agaatttcagatgggtctagatgag

SEQ ID NO: 528762 - DNA, 25 bp, Homo sapien
ggtctagatgagaaccctatgcata

SEQ ID NO: 528763 - DNA, 25 bp, Homo sapien
gaaccctatgcataagcttggatct

SEQ ID NO: 528764 - DNA, 25 bp, Homo sapien
atgtttcacggcgagggaaccctgt

SEQ ID NO: 528765 - DNA, 25 bp, Homo sapien
cagcggaaccaatacgacgccattt

SEQ ID NO: 528766 - DNA, 25 bp, Homo sapien
agggcacatatacgttctcagatgg

SEQ ID NO: 528767 - DNA, 25 bp, Homo sapien
tacgttctcagatgggctgcactat

SEQ ID NO: 528768 - DNA, 25 bp, Homo sapien
aactggcattactgcgacggctatg

SEQ ID NO: 528769 - DNA, 25 bp, Homo sapien
gacggctatgatcggaggttttaca

SEQ ID NO: 528770 - DNA, 25 bp, Homo sapien
aggttttacacagagatcctcaatg

SEQ ID NO: 528771 - DNA, 25 bp, Homo sapien
gagatcctcaatggcttgaagcctg

SEQ ID NO: 528772 - DNA, 25 bp, Homo sapien
tgcaggtatggctcaactcaccaat

SEQ ID NO: 528773 - DNA, 25 bp, Homo sapien
aactcaccaatatggacccacctag

SEQ ID NO: 528774 - DNA, 25 bp, Homo sapien
acatcctccctaccgaaacaatata

SEQ ID NO: 528775 - DNA, 25 bp, Homo sapien
ttgtttcaatataagctggccagtc

SEQ ID NO: 528776 - DNA, 25 bp, Homo sapien
taagctggccagtctggaaccaaaa

SEQ ID NO: 528777 - DNA, 25 bp, Homo sapien
tgtgggaatttcttgcctcctttct

SEQ ID NO: 528778 - DNA, 25 bp, Homo sapien
aacttgtataatcttcttgcaggga

SEQ ID NO: 528779 - DNA, 25 bp, Homo sapien
tttgcaagcataaaaggcacaaagt

SEQ ID NO: 528780 - DNA, 25 bp, Homo sapien
atcacaaggcaaaatttgttgtttg

SEQ ID NO: 528781 - DNA, 25 bp, Homo sapien
gggagcagtattaacaagcaaataa

SEQ ID NO: 528782 - DNA, 25 bp, Homo sapien
tcctttctatcacttctgagaacaa

SEQ ID NO: 528783 - DNA, 25 bp, Homo sapien
aattctataagcagaaatgcctgga

SEQ ID NO: 528784 - DNA, 25 bp, Homo sapien
gaaatgcctggaattattgtctggg

SEQ ID NO: 528785 - DNA, 25 bp, Homo sapien
gggtcgaggtgttttgtttcaatat

SEQ ID NO: 528786 - DNA, 25 bp, Homo sapien
aggcgctgccaggagagccttccat

SEQ ID NO: 528787 - DNA, 25 bp, Homo sapien
gctctttgaggttccctccttctgg

SEQ ID NO: 528788 - DNA, 25 bp, Homo sapien
ttgaggttccctccttctgggtgtt

SEQ ID NO: 528789 - DNA, 25 bp, Homo sapien
tccttctgggtgttcttcaggctga

SEQ ID NO: 528790 - DNA, 25 bp, Homo sapien
ttctgggtgttcttcaggctgagca

SEQ ID NO: 528791 - DNA, 25 bp, Homo sapien
tctgggtgttcttcaggctgagcag

SEQ ID NO: 528792 - DNA, 25 bp, Homo sapien
ggctgagcagagaggctcctgtacc

SEQ ID NO: 528793 - DNA, 25 bp, Homo sapien
tgtaccctctctctcggaatctgaa

SEQ ID NO: 528794 - DNA, 25 bp, Homo sapien
taccctctctctcggaatctgaaga

SEQ ID NO: 528795 - DNA, 25 bp, Homo sapien
gaagagccagatttaggccgggcaa

SEQ ID NO: 528796 - DNA, 25 bp, Homo sapien
agagccagatttaggccgggcaaag

SEQ ID NO: 528797 - DNA, 25 bp, Homo sapien
gtacagtgagtgaatatacccccat

SEQ ID NO: 528798 - DNA, 25 bp, Homo sapien
agtgagtgaatatacccccatcccc

SEQ ID NO: 528799 - DNA, 25 bp, Homo sapien
agtgaatatacccccatccccaaga

SEQ ID NO: 528800 - DNA, 25 bp, Homo sapien
tatgtaatgtacacctgccctaagg

SEQ ID NO: 528801 - DNA, 25 bp, Homo sapien
tgtacacctgccctaaggagaaaat

SEQ ID NO: 528802 - DNA, 25 bp, Homo sapien
ccaagcatgtcttagaataatctat

SEQ ID NO: 528803 - DNA, 25 bp, Homo sapien
caagcatgtcttagaataatctatg

SEQ ID NO: 528804 - DNA, 25 bp, Homo sapien
aagcatgtcttagaataatctatgt

SEQ ID NO: 528805 - DNA, 25 bp, Homo sapien
gaataatctatgtgttgatgcatgt

SEQ ID NO: 528806 - DNA, 25 bp, Homo sapien
aataatctatgtgttgatgcatgta

SEQ ID NO: 528807 - DNA, 25 bp, Homo sapien
ataatctatgtgttgatgcatgtaa

SEQ ID NO: 528808 - DNA, 25 bp, Homo sapien
aatcagtgattcagccgactgctct

SEQ ID NO: 528809 - DNA, 25 bp, Homo sapien
agccgactgctctttgagtccagat

SEQ ID NO: 528810 - DNA, 25 bp, Homo sapien
gagtccagatgttgatccagttctt

SEQ ID NO: 528811 - DNA, 25 bp, Homo sapien
gatccagttcttgcttttcaacgag

SEQ ID NO: 528812 - DNA, 25 bp, Homo sapien
ttcaacgagaaggatttggacgtca

SEQ ID NO: 528813 - DNA, 25 bp, Homo sapien
atagctgacgagactaaactcaata

SEQ ID NO: 528814 - DNA, 25 bp, Homo sapien
gagactaaactcaatacagtggatg

SEQ ID NO: 528815 - DNA, 25 bp, Homo sapien
gatgaccagaaagcaggttctccca

SEQ ID NO: 528816 - DNA, 25 bp, Homo sapien
gaaagcaggttctcccagcagagat

SEQ ID NO: 528817 - DNA, 25 bp, Homo sapien
tgggtccttccctgggtctgaagaa

SEQ ID NO: 528818 - DNA, 25 bp, Homo sapien
tccctgggtctgaagaagtcaagct

SEQ ID NO: 528819 - DNA, 25 bp, Homo sapien
gagaaccactgaggtccaatgatga

SEQ ID NO: 528820 - DNA, 25 bp, Homo sapien
gagacttggaggtctggatccagtc

SEQ ID NO: 528821 - DNA, 25 bp, Homo sapien
gtctggatccagtctctctttgttt

SEQ ID NO: 528822 - DNA, 25 bp, Homo sapien
aatgtgacttaggtgctgtcaacat

SEQ ID NO: 528823 - DNA, 25 bp, Homo sapien
ggtgctgtcaacattagcaagataa

SEQ ID NO: 528824 - DNA, 25 bp, Homo sapien
gataatggaaatcacgacgccagtg

SEQ ID NO: 528825 - DNA, 25 bp, Homo sapien
aaatcacgacgccagtgggtgctta

SEQ ID NO: 528826 - DNA, 25 bp, Homo sapien
agtgggtgcttacctccctgctagg

SEQ ID NO: 528827 - DNA, 25 bp, Homo sapien
cttacctccctgctaggcatgcagg

SEQ ID NO: 528828 - DNA, 25 bp, Homo sapien
ggagggagagtttgtcctctttgcc

SEQ ID NO: 528829 - DNA, 25 bp, Homo sapien
acagtctacccttcagggccttgtg

SEQ ID NO: 528830 - DNA, 25 bp, Homo sapien
tcctttggttccttagccccagctc

SEQ ID NO: 528831 - DNA, 25 bp, Homo sapien
ttcccctgttatcctggtctaataa

SEQ ID NO: 528832 - DNA, 25 bp, Homo sapien
tcccctgttatcctggtctaataac

SEQ ID NO: 528833 - DNA, 25 bp, Homo sapien
acacatacacctctggtgacctatt

SEQ ID NO: 528834 - DNA, 25 bp, Homo sapien
tacacctctggtgacctatttgcac

SEQ ID NO: 528835 - DNA, 25 bp, Homo sapien
gacctatttgcacagaccgtcgtct

SEQ ID NO: 528836 - DNA, 25 bp, Homo sapien
acctatttgcacagaccgtcgtctt

SEQ ID NO: 528837 - DNA, 25 bp, Homo sapien
gtcttccctccagtcttctgaggga

SEQ ID NO: 528838 - DNA, 25 bp, Homo sapien
ttccctccagtcttctgagggatag

SEQ ID NO: 528839 - DNA, 25 bp, Homo sapien
ccctccagtcttctgagggataggg

SEQ ID NO: 528840 - DNA, 25 bp, Homo sapien
ttacccacacctatccttttgaggg

SEQ ID NO: 528841 - DNA, 25 bp, Homo sapien
tccttaccctctgtcagaaaacaat

SEQ ID NO: 528842 - DNA, 25 bp, Homo sapien
agagtggaagagctttccatcacgg

SEQ ID NO: 528843 - DNA, 25 bp, Homo sapien
ttccatcacggaagattcatcatga

SEQ ID NO: 528844 - DNA, 25 bp, Homo sapien
gaagattcatcatgagtctccggaa

SEQ ID NO: 528845 - DNA, 25 bp, Homo sapien
tgagtctccggaaagcagctatggc

SEQ ID NO: 528846 - DNA, 25 bp, Homo sapien
gaaagcagctatggcagagcccaat

SEQ ID NO: 528847 - DNA, 25 bp, Homo sapien
ggcagagcccaatgcaaagtttatt

SEQ ID NO: 528848 - DNA, 25 bp, Homo sapien
gatgggagttcagtacaaggataaa

SEQ ID NO: 528849 - DNA, 25 bp, Homo sapien
aggaaaagcctggtctccaataaag

SEQ ID NO: 528850 - DNA, 25 bp, Homo sapien
gcctggtctccaataaagtttctgt

SEQ ID NO: 528851 - DNA, 25 bp, Homo sapien
ggctttcttatgaagaatgcaccac

SEQ ID NO: 528852 - DNA, 25 bp, Homo sapien
ccaccattcattctgtctgtctgtt

SEQ ID NO: 528853 - DNA, 25 bp, Homo sapien
cctggacactgcctaaaagggtctc

SEQ ID NO: 528854 - DNA, 25 bp, Homo sapien
gacactgcctaaaagggtctcaaga

SEQ ID NO: 528855 - DNA, 25 bp, Homo sapien
aaagggtctcaagacagtgccctgt

SEQ ID NO: 528856 - DNA, 25 bp, Homo sapien
gtctcaagacagtgccctgtgggtt

SEQ ID NO: 528857 - DNA, 25 bp, Homo sapien
aagacagtgccctgtgggttcctag

SEQ ID NO: 528858 - DNA, 25 bp, Homo sapien
acagtgccctgtgggttcctaggac

SEQ ID NO: 528859 - DNA, 25 bp, Homo sapien
gcagctttaaaatggctaaccacag

SEQ ID NO: 528860 - DNA, 25 bp, Homo sapien
aaatggctaaccacagcagagggca

SEQ ID NO: 528861 - DNA, 25 bp, Homo sapien
gcagagggcagatgcttgatagatt

SEQ ID NO: 528862 - DNA, 25 bp, Homo sapien
agatgcttgatagattatcttttcc

SEQ ID NO: 528863 - DNA, 25 bp, Homo sapien
gcagcagccaatcgtgttgccaact

SEQ ID NO: 528864 - DNA, 25 bp, Homo sapien
agccaatcgtgttgccaactgtttg

SEQ ID NO: 528865 - DNA, 25 bp, Homo sapien
gtgttgccaactgtttggcgtccac

SEQ ID NO: 528866 - DNA, 25 bp, Homo sapien
aactgtttggcgtccaccgccaacg

SEQ ID NO: 528867 - DNA, 25 bp, Homo sapien
gggcgaggctccaaaacacatcggc

SEQ ID NO: 528868 - DNA, 25 bp, Homo sapien
agtccgggaacccaggcgccttcag

SEQ ID NO: 528869 - DNA, 25 bp, Homo sapien
aggcgccttcagtagcgcggcgtca

SEQ ID NO: 528870 - DNA, 25 bp, Homo sapien
agtagcgcggcgtcacagtgtccct

SEQ ID NO: 528871 - DNA, 25 bp, Homo sapien
aggctccaaaacacatcggctcatg

SEQ ID NO: 528872 - DNA, 25 bp, Homo sapien
aaacacatcggctcatggctctact

SEQ ID NO: 528873 - DNA, 25 bp, Homo sapien
atggctctactcagccgctgtccgg

SEQ ID NO: 528874 - DNA, 25 bp, Homo sapien
attaatgagatttgtcttcagccac

SEQ ID NO: 528875 - DNA, 25 bp, Homo sapien
tcagccaccagtgttggccttgaag

SEQ ID NO: 528876 - DNA, 25 bp, Homo sapien
gccttgaagcagagggcacagccct

SEQ ID NO: 528877 - DNA, 25 bp, Homo sapien
ggcacagcccttggtgtttgtaaaa

SEQ ID NO: 528878 - DNA, 25 bp, Homo sapien
ataagtatgaatacacagtgtggca

SEQ ID NO: 528879 - DNA, 25 bp, Homo sapien
acagtgtggcagtgttgtggttttt

SEQ ID NO: 528880 - DNA, 25 bp, Homo sapien
ttttttaaaccgaaatctgtggatg

SEQ ID NO: 528881 - DNA, 25 bp, Homo sapien
tggatgaaatagaagctggagccct

SEQ ID NO: 528882 - DNA, 25 bp, Homo sapien
gagccctcctcttggaatattcagc

SEQ ID NO: 528883 - DNA, 25 bp, Homo sapien
ggaatattcagcctaagaacctcat

SEQ ID NO: 528884 - DNA, 25 bp, Homo sapien
aatattcagcctaagaacctcatag

SEQ ID NO: 528885 - DNA, 25 bp, Homo sapien
gaagtgactccagacattaggtcca

SEQ ID NO: 528886 - DNA, 25 bp, Homo sapien
actccagacattaggtccagacatt

SEQ ID NO: 528887 - DNA, 25 bp, Homo sapien
atctcttctctctagaaaagataac

SEQ ID NO: 528888 - DNA, 25 bp, Homo sapien
caattaataatccttcccactttca

SEQ ID NO: 528889 - DNA, 25 bp, Homo sapien
taatccttcccactttcattgagat

SEQ ID NO: 528890 - DNA, 25 bp, Homo sapien
ccttcccactttcattgagatcagc

SEQ ID NO: 528891 - DNA, 25 bp, Homo sapien
gtctgataacctgatatgagtgtga

SEQ ID NO: 528892 - DNA, 25 bp, Homo sapien
tgctggtgcatttaagaagatagta

SEQ ID NO: 528893 - DNA, 25 bp, Homo sapien
gatgagttcatcttttcttcgaaca

SEQ ID NO: 528894 - DNA, 25 bp, Homo sapien
ttcttcgaacattcctattcctaga

SEQ ID NO: 528895 - DNA, 25 bp, Homo sapien
tcctattcctagatgtagtttacct

SEQ ID NO: 528896 - DNA, 25 bp, Homo sapien
agggcctgctgggtgagtcaccatc

SEQ ID NO: 528897 - DNA, 25 bp, Homo sapien
tgctgggtgagtcaccatcccaaag

SEQ ID NO: 528898 - DNA, 25 bp, Homo sapien
catttagggcagaggacaaaaggat

SEQ ID NO: 528899 - DNA, 25 bp, Homo sapien
atgtcagcaattgcttgggctgctt

SEQ ID NO: 528900 - DNA, 25 bp, Homo sapien
tgggctgcttggctatgcaagcctc

SEQ ID NO: 528901 - DNA, 25 bp, Homo sapien
cttggctatgcaagcctcctgcctg

SEQ ID NO: 528902 - DNA, 25 bp, Homo sapien
tcctgcctgctgatggccacttcag

SEQ ID NO: 528903 - DNA, 25 bp, Homo sapien
ctgatggccacttcagggacagcct

SEQ ID NO: 528904 - DNA, 25 bp, Homo sapien
gggatggcggcagcttcctgcacct

SEQ ID NO: 528905 - DNA, 25 bp, Homo sapien
cctgcacctttcagatttcttggtg

SEQ ID NO: 528906 - DNA, 25 bp, Homo sapien
cagatttcttggtggcattaaagca

SEQ ID NO: 528907 - DNA, 25 bp, Homo sapien
aaatgtatgacttggtgttttaaag

SEQ ID NO: 528908 - DNA, 25 bp, Homo sapien
atgttgtacaactgaccgaaagaaa

SEQ ID NO: 528909 - DNA, 25 bp, Homo sapien
ttggaatccccaaaaagataacatt

SEQ ID NO: 528910 - DNA, 25 bp, Homo sapien
taaaaactgaaattccctgttctag

SEQ ID NO: 528911 - DNA, 25 bp, Homo sapien
cctgttctagttcctaacaattctc

SEQ ID NO: 528912 - DNA, 25 bp, Homo sapien
gttctagttcctaacaattctcatt

SEQ ID NO: 528913 - DNA, 25 bp, Homo sapien
agttcctaacaattctcattacata

SEQ ID NO: 528914 - DNA, 25 bp, Homo sapien
caattctcattacatactatgccag

SEQ ID NO: 528915 - DNA, 25 bp, Homo sapien
ttctcattacatactatgccagatt

SEQ ID NO: 528916 - DNA, 25 bp, Homo sapien
tactatgccagattacaaaatactt

SEQ ID NO: 528917 - DNA, 25 bp, Homo sapien
aatctatatattgactttcttatca

SEQ ID NO: 528918 - DNA, 25 bp, Homo sapien
gaaaattcatcattgagcttgctca

SEQ ID NO: 528919 - DNA, 25 bp, Homo sapien
gagcttgctcatatgatcaaagaca

SEQ ID NO: 528920 - DNA, 25 bp, Homo sapien
gagtaatgtgcgaactttcccttct

SEQ ID NO: 528921 - DNA, 25 bp, Homo sapien
taggagcatctggtgacagcctttc

SEQ ID NO: 528922 - DNA, 25 bp, Homo sapien
ggtgacagcctttcttgccctctga

SEQ ID NO: 528923 - DNA, 25 bp, Homo sapien
tgacctcaaaggctagctgcgcata

SEQ ID NO: 528924 - DNA, 25 bp, Homo sapien
tagctgcgcatagctcttgacactc

SEQ ID NO: 528925 - DNA, 25 bp, Homo sapien
cggccatctctgtgggtaaggtgtc

SEQ ID NO: 528926 - DNA, 25 bp, Homo sapien
ggtaaggtgtccctcggatctgtcc

SEQ ID NO: 528927 - DNA, 25 bp, Homo sapien
ggatctgtcctcttcgtgtacacag

SEQ ID NO: 528928 - DNA, 25 bp, Homo sapien
cttcgtgtacacagttgtttctgaa

SEQ ID NO: 528929 - DNA, 25 bp, Homo sapien
aggatagcagttagccttggccaag

SEQ ID NO: 528930 - DNA, 25 bp, Homo sapien
gggcatttatctggtgctgggaata

SEQ ID NO: 528931 - DNA, 25 bp, Homo sapien
ctggtgctgggaataatctgtttct

SEQ ID NO: 528932 - DNA, 25 bp, Homo sapien
atctgtttctaaacctaggtgctaa

SEQ ID NO: 528933 - DNA, 25 bp, Homo sapien
aggtgctaagtatttgagtgtgttc

SEQ ID NO: 528934 - DNA, 25 bp, Homo sapien
gtgtgttctgagctgtgcacttaag

SEQ ID NO: 528935 - DNA, 25 bp, Homo sapien
tctgagctgtgcacttaagatatgt

SEQ ID NO: 528936 - DNA, 25 bp, Homo sapien
ttaagatatgtgtatttttctgcat

SEQ ID NO: 528937 - DNA, 25 bp, Homo sapien
gttttctaaaatcacaaatggctaa

SEQ ID NO: 528938 - DNA, 25 bp, Homo sapien
aatggctaacatttgtgtcgctcat

SEQ ID NO: 528939 - DNA, 25 bp, Homo sapien
taacatttgtgtcgctcatcactct

SEQ ID NO: 528940 - DNA, 25 bp, Homo sapien
gggcagaactgtccggatctaacaa

SEQ ID NO: 528941 - DNA, 25 bp, Homo sapien
agaactgtccggatctaacaatccc

SEQ ID NO: 528942 - DNA, 25 bp, Homo sapien
gaactgtccggatctaacaatccct

SEQ ID NO: 528943 - DNA, 25 bp, Homo sapien
aactgtccggatctaacaatccctg

SEQ ID NO: 528944 - DNA, 25 bp, Homo sapien
actgtccggatctaacaatccctgg

SEQ ID NO: 528945 - DNA, 25 bp, Homo sapien
ctgtccggatctaacaatccctggg

SEQ ID NO: 528946 - DNA, 25 bp, Homo sapien
tccggatctaacaatccctggggag

SEQ ID NO: 528947 - DNA, 25 bp, Homo sapien
ggaggcgttaacagtgggcgggcgt

SEQ ID NO: 528948 - DNA, 25 bp, Homo sapien
cacccggatgctaacacccaggaag

SEQ ID NO: 528949 - DNA, 25 bp, Homo sapien
ggcgttaacagtgggcgggcgtggc

SEQ ID NO: 528950 - DNA, 25 bp, Homo sapien
cagtgggcgggcgtggctcgggctc

SEQ ID NO: 528951 - DNA, 25 bp, Homo sapien
cgtctgttgtaccactagcatctat

SEQ ID NO: 528952 - DNA, 25 bp, Homo sapien
gtaccactagcatctatatgacttt

SEQ ID NO: 528953 - DNA, 25 bp, Homo sapien
gcatctatatgacttttgtgtaatt

SEQ ID NO: 528954 - DNA, 25 bp, Homo sapien
tctcttgaactctggtgctgttttt

SEQ ID NO: 528955 - DNA, 25 bp, Homo sapien
aattctgtgcagatgtcctgacttg

SEQ ID NO: 528956 - DNA, 25 bp, Homo sapien
gtgcagatgtcctgacttggcaatt

SEQ ID NO: 528957 - DNA, 25 bp, Homo sapien
gatgtcctgacttggcaattttgtg

SEQ ID NO: 528958 - DNA, 25 bp, Homo sapien
tgacttggcaattttgtgtccctgc

SEQ ID NO: 528959 - DNA, 25 bp, Homo sapien
aattttgtgtccctgcctcactgtc

SEQ ID NO: 528960 - DNA, 25 bp, Homo sapien
ccccgcctgtcctagtgttgttctg

SEQ ID NO: 528961 - DNA, 25 bp, Homo sapien
atttcacttcactgagtcctgacac

SEQ ID NO: 528962 - DNA, 25 bp, Homo sapien
aggagctttacatttcggttctaat

SEQ ID NO: 528963 - DNA, 25 bp, Homo sapien
tgaattaacacccatgttgcatgca

SEQ ID NO: 528964 - DNA, 25 bp, Homo sapien
taacacccatgttgcatgcattcca

SEQ ID NO: 528965 - DNA, 25 bp, Homo sapien
acccatgttgcatgcattccacata

SEQ ID NO: 528966 - DNA, 25 bp, Homo sapien
tgttgcatgcattccacatattaaa

SEQ ID NO: 528967 - DNA, 25 bp, Homo sapien
gcatgcattccacatattaaaattt

SEQ ID NO: 528968 - DNA, 25 bp, Homo sapien
tatagctaccagacttagatccgat

SEQ ID NO: 528969 - DNA, 25 bp, Homo sapien
gctaccagacttagatccgataaat

SEQ ID NO: 528970 - DNA, 25 bp, Homo sapien
tgctgacttccctgttgagcaacct

SEQ ID NO: 528971 - DNA, 25 bp, Homo sapien
gacttccctgttgagcaacctgaag

SEQ ID NO: 528972 - DNA, 25 bp, Homo sapien
ctgttgagcaacctgaagaaaatta

SEQ ID NO: 528973 - DNA, 25 bp, Homo sapien
ctggacctggagtcaggaggcggtg

SEQ ID NO: 528974 - DNA, 25 bp, Homo sapien
tggacctggagtcaggaggcggtgt

SEQ ID NO: 528975 - DNA, 25 bp, Homo sapien
ggacctggagtcaggaggcggtgtc

SEQ ID NO: 528976 - DNA, 25 bp, Homo sapien
gacctggagtcaggaggcggtgtcc

SEQ ID NO: 528977 - DNA, 25 bp, Homo sapien
acctggagtcaggaggcggtgtcca

SEQ ID NO: 528978 - DNA, 25 bp, Homo sapien
cctggagtcaggaggcggtgtccag

SEQ ID NO: 528979 - DNA, 25 bp, Homo sapien
ctggagtcaggaggcggtgtccagg

SEQ ID NO: 528980 - DNA, 25 bp, Homo sapien
tcctcaaattccttccctgtcaaat

SEQ ID NO: 528981 - DNA, 25 bp, Homo sapien
cctcaaattccttccctgtcaaata

SEQ ID NO: 528982 - DNA, 25 bp, Homo sapien
ctcaaattccttccctgtcaaataa

SEQ ID NO: 528983 - DNA, 25 bp, Homo sapien
tcaaattccttccctgtcaaataaa

SEQ ID NO: 528984 - DNA, 25 bp, Homo sapien
tgggtcacattggactaccactcaa

SEQ ID NO: 528985 - DNA, 25 bp, Homo sapien
gtcacattggactaccactcaaaga

SEQ ID NO: 528986 - DNA, 25 bp, Homo sapien
ggagagcgcacctgtgccagatgca

SEQ ID NO: 528987 - DNA, 25 bp, Homo sapien
tgtgccagatgcatgccactttcag

SEQ ID NO: 528988 - DNA, 25 bp, Homo sapien
agatgcatgccactttcagtagctg

SEQ ID NO: 528989 - DNA, 25 bp, Homo sapien
atgccactttcagtagctgccaaat

SEQ ID NO: 528990 - DNA, 25 bp, Homo sapien
gtagctgccaaatgtgcctttaatt

SEQ ID NO: 528991 - DNA, 25 bp, Homo sapien
gtgcctttaattaagaacatctcta

SEQ ID NO: 528992 - DNA, 25 bp, Homo sapien
gggtgcaaatatctggtgaaaccac

SEQ ID NO: 528993 - DNA, 25 bp, Homo sapien
accaccagagaatttgtttgtcaaa

SEQ ID NO: 528994 - DNA, 25 bp, Homo sapien
gcaaattagctaacagtgggtcaca

SEQ ID NO: 528995 - DNA, 25 bp, Homo sapien
ttcacatgccgttgactctcacagt

SEQ ID NO: 528996 - DNA, 25 bp, Homo sapien
tgccgttgactctcacagtctaaga

SEQ ID NO: 528997 - DNA, 25 bp, Homo sapien
acagtctaagacttcagggccggga

SEQ ID NO: 528998 - DNA, 25 bp, Homo sapien
ttcagggccgggacctttgtccagc

SEQ ID NO: 528999 - DNA, 25 bp, Homo sapien
tttgtccagcctgcacagtagagtg

SEQ ID NO: 529000 - DNA, 25 bp, Homo sapien
cacagtagagtgaggctgcctctcc

SEQ ID NO: 529001 - DNA, 25 bp, Homo sapien
ccgccaggcattgggatcccattta

SEQ ID NO: 529002 - DNA, 25 bp, Homo sapien
tgggatcccatttagaaacggcatt

SEQ ID NO: 529003 - DNA, 25 bp, Homo sapien
gaaacggcattcacttcagaaggta

SEQ ID NO: 529004 - DNA, 25 bp, Homo sapien
ggcattcacttcagaaggtactttt

SEQ ID NO: 529005 - DNA, 25 bp, Homo sapien
aaactcctgataacacttgctacat

SEQ ID NO: 529006 - DNA, 25 bp, Homo sapien
gatgtaaatttttgaagggcagttt

SEQ ID NO: 529007 - DNA, 25 bp, Homo sapien
gaatgaacttaagatgtctgtactc

SEQ ID NO: 529008 - DNA, 25 bp, Homo sapien
gatgtctgtactctatatgtgatgc

SEQ ID NO: 529009 - DNA, 25 bp, Homo sapien
gtactctatatgtgatgctgtgcag

SEQ ID NO: 529010 - DNA, 25 bp, Homo sapien
tatatgtgatgctgtgcagtttgtt

SEQ ID NO: 529011 - DNA, 25 bp, Homo sapien
gatgtcaactatagccataaccaat

SEQ ID NO: 529012 - DNA, 25 bp, Homo sapien
aaactgatgaggcatgcagctttca

SEQ ID NO: 529013 - DNA, 25 bp, Homo sapien
gcagctttcagcacatcttttatac

SEQ ID NO: 529014 - DNA, 25 bp, Homo sapien
tcagcacatcttttatacatgaaga

SEQ ID NO: 529015 - DNA, 25 bp, Homo sapien
gttgaaatatccaagatgttctgta

SEQ ID NO: 529016 - DNA, 25 bp, Homo sapien
gtatctatgtaaacatgattccttt

SEQ ID NO: 529017 - DNA, 25 bp, Homo sapien
cctcttttcatcatgctgatctgca

SEQ ID NO: 529018 - DNA, 25 bp, Homo sapien
aaaaatcatcttcaccctgacacgg

SEQ ID NO: 529019 - DNA, 25 bp, Homo sapien
gaacaatataccaagagcacggctg

SEQ ID NO: 529020 - DNA, 25 bp, Homo sapien
gagcacggctgaagactctaaaaat

SEQ ID NO: 529021 - DNA, 25 bp, Homo sapien
aatgacggttgcatttgccacttca

SEQ ID NO: 529022 - DNA, 25 bp, Homo sapien
gccacttcatttactgtctgctgga

SEQ ID NO: 529023 - DNA, 25 bp, Homo sapien
tccctactatgtcctaggaatttgg

SEQ ID NO: 529024 - DNA, 25 bp, Homo sapien
gaatttggtattggtttgatcctga

SEQ ID NO: 529025 - DNA, 25 bp, Homo sapien
gttaaacaggttgtcagacccagta

SEQ ID NO: 529026 - DNA, 25 bp, Homo sapien
gacccagtaaatcacttcttctttc

SEQ ID NO: 529027 - DNA, 25 bp, Homo sapien
ttgcctttttaaacccatgctttga

SEQ ID NO: 529028 - DNA, 25 bp, Homo sapien
tcctgcttgtttaggttttctgttg

SEQ ID NO: 529029 - DNA, 25 bp, Homo sapien
aacaaaattgctgtctcagactgaa

SEQ ID NO: 529030 - DNA, 25 bp, Homo sapien
gactgaatctacttgaatctaggaa

SEQ ID NO: 529031 - DNA, 25 bp, Homo sapien
atctaggaaggcacatctcatccct

SEQ ID NO: 529032 - DNA, 25 bp, Homo sapien
cacatctcatccctattgtggtttt

SEQ ID NO: 529033 - DNA, 25 bp, Homo sapien
atgagaggaccaattcaggacagaa

SEQ ID NO: 529034 - DNA, 25 bp, Homo sapien
gaagagccctcgtgaataccaacgt

SEQ ID NO: 529035 - DNA, 25 bp, Homo sapien
aataccaacgtgctagctcaggttc

SEQ ID NO: 529036 - DNA, 25 bp, Homo sapien
tctttcctccatcagagctattggt

SEQ ID NO: 529037 - DNA, 25 bp, Homo sapien
agggttttaaggtcgtgtgtgcatc

SEQ ID NO: 529038 - DNA, 25 bp, Homo sapien
tcgtgtgtgcatcatgcttccaatg

SEQ ID NO: 529039 - DNA, 25 bp, Homo sapien
tcaccaggatgggaggaagcctatt

SEQ ID NO: 529040 - DNA, 25 bp, Homo sapien
ccaggatgggaggaagcctattgat

SEQ ID NO: 529041 - DNA, 25 bp, Homo sapien
tgctgccatccatccactactgaga

SEQ ID NO: 529042 - DNA, 25 bp, Homo sapien
atccatccactactgagatcctcaa

SEQ ID NO: 529043 - DNA, 25 bp, Homo sapien
caggtgagcgccgaccttatggagc

SEQ ID NO: 529044 - DNA, 25 bp, Homo sapien
tgagcgccgaccttatggagcgagc

SEQ ID NO: 529045 - DNA, 25 bp, Homo sapien
gagcgccgaccttatggagcgagca

SEQ ID NO: 529046 - DNA, 25 bp, Homo sapien
agcgccgaccttatggagcgagcag

SEQ ID NO: 529047 - DNA, 25 bp, Homo sapien
gccgaccttatggagcgagcagcca

SEQ ID NO: 529048 - DNA, 25 bp, Homo sapien
ccgaccttatggagcgagcagccac

SEQ ID NO: 529049 - DNA, 25 bp, Homo sapien
atcttcaccaggatgggaggaagcc

SEQ ID NO: 529050 - DNA, 25 bp, Homo sapien
agaatgggcagttcatgttaaaatc

SEQ ID NO: 529051 - DNA, 25 bp, Homo sapien
gaatgggcagttcatgttaaaatca

SEQ ID NO: 529052 - DNA, 25 bp, Homo sapien
aatgggcagttcatgttaaaatcac

SEQ ID NO: 529053 - DNA, 25 bp, Homo sapien
atgttaaaatcacttttcatggaaa

SEQ ID NO: 529054 - DNA, 25 bp, Homo sapien
ttcatggaaagagctctatgtaaca

SEQ ID NO: 529055 - DNA, 25 bp, Homo sapien
tcatggaaagagctctatgtaacag

SEQ ID NO: 529056 - DNA, 25 bp, Homo sapien
catggaaagagctctatgtaacagc

SEQ ID NO: 529057 - DNA, 25 bp, Homo sapien
tggaaagagctctatgtaacagcat

SEQ ID NO: 529058 - DNA, 25 bp, Homo sapien
ggaaagagctctatgtaacagcata

SEQ ID NO: 529059 - DNA, 25 bp, Homo sapien
gaaagagctctatgtaacagcataa

SEQ ID NO: 529060 - DNA, 25 bp, Homo sapien
aaagagctctatgtaacagcataat

SEQ ID NO: 529061 - DNA, 25 bp, Homo sapien
gtgaaatcagcctaacgccgtttct

SEQ ID NO: 529062 - DNA, 25 bp, Homo sapien
taacgccgtttctcaatgacgtgga

SEQ ID NO: 529063 - DNA, 25 bp, Homo sapien
tcaatgacgtggatcgccctaggcc

SEQ ID NO: 529064 - DNA, 25 bp, Homo sapien
ggaagctctctcagctcagttccca

SEQ ID NO: 529065 - DNA, 25 bp, Homo sapien
tccttctacctcaccggttgctagt

SEQ ID NO: 529066 - DNA, 25 bp, Homo sapien
tagtcctccgcttcgcagctgaaaa

SEQ ID NO: 529067 - DNA, 25 bp, Homo sapien
gcttcgcagctgaaaatgtgcccgg

SEQ ID NO: 529068 - DNA, 25 bp, Homo sapien
tactgtgggcctagccaggcctgct

SEQ ID NO: 529069 - DNA, 25 bp, Homo sapien
tagccaggcctgcttacgcagtgca

SEQ ID NO: 529070 - DNA, 25 bp, Homo sapien
ttacgcagtgcagtttcccatgaat

SEQ ID NO: 529071 - DNA, 25 bp, Homo sapien
gcagtttcccatgaatgatgcccag

SEQ ID NO: 529072 - DNA, 25 bp, Homo sapien
ttgggttttatgagaggctgttact

SEQ ID NO: 529073 - DNA, 25 bp, Homo sapien
ggctgttacttagtggccttaaatc

SEQ ID NO: 529074 - DNA, 25 bp, Homo sapien
ttagtggccttaaatcttttctgaa

SEQ ID NO: 529075 - DNA, 25 bp, Homo sapien
ttttctgaatgtctgtttcctaaga

SEQ ID NO: 529076 - DNA, 25 bp, Homo sapien
gaatgtctgtttcctaagatctgtg

SEQ ID NO: 529077 - DNA, 25 bp, Homo sapien
tgtttcctaagatctgtgatacagt

SEQ ID NO: 529078 - DNA, 25 bp, Homo sapien
actgacttgtttcaatggttacttg

SEQ ID NO: 529079 - DNA, 25 bp, Homo sapien
ttctgttaatcaacaagggctctgt

SEQ ID NO: 529080 - DNA, 25 bp, Homo sapien
gttaatcaacaagggctctgtattt

SEQ ID NO: 529081 - DNA, 25 bp, Homo sapien
aatattttcatttctcagtaagtag

SEQ ID NO: 529082 - DNA, 25 bp, Homo sapien
tcatttctcagtaagtagtcagtta

SEQ ID NO: 529083 - DNA, 25 bp, Homo sapien
gggcgcgtctggcaccgggaaggtg

SEQ ID NO: 529084 - DNA, 25 bp, Homo sapien
accgggaaggtgtagatcatctaga

SEQ ID NO: 529085 - DNA, 25 bp, Homo sapien
tcatctagaatgacggcgattccga

SEQ ID NO: 529086 - DNA, 25 bp, Homo sapien
ccggtcagtcctgcgtgattggcga

SEQ ID NO: 529087 - DNA, 25 bp, Homo sapien
tgcgtgattggcgagggtgcatctg

SEQ ID NO: 529088 - DNA, 25 bp, Homo sapien
ggtgcatctgtcgtgagaattccca

SEQ ID NO: 529089 - DNA, 25 bp, Homo sapien
gtcgtgagaattcccagttctgaag

SEQ ID NO: 529090 - DNA, 25 bp, Homo sapien
gagagcaaggagactgatcccgcgt

SEQ ID NO: 529091 - DNA, 25 bp, Homo sapien
aaggagactgatcccgcgtagtcca

SEQ ID NO: 529092 - DNA, 25 bp, Homo sapien
gatcccgcgtagtccaaggcattgg

SEQ ID NO: 529093 - DNA, 25 bp, Homo sapien
aaggcattggctcccctgttgctct

SEQ ID NO: 529094 - DNA, 25 bp, Homo sapien
ttgcttcaagccttctgaaaatata

SEQ ID NO: 529095 - DNA, 25 bp, Homo sapien
ataaccatagttacctaagcacaca

SEQ ID NO: 529096 - DNA, 25 bp, Homo sapien
atagttacctaagcacacagtgaat

SEQ ID NO: 529097 - DNA, 25 bp, Homo sapien
gtgaatagtcacatggtagtacttg

SEQ ID NO: 529098 - DNA, 25 bp, Homo sapien
gtagtacttgtgattagagcatgta

SEQ ID NO: 529099 - DNA, 25 bp, Homo sapien
tgtaattgaaaagtcagcttccata

SEQ ID NO: 529100 - DNA, 25 bp, Homo sapien
agaacaccctactttttatctagtg

SEQ ID NO: 529101 - DNA, 25 bp, Homo sapien
ttatattatgttacctgtgctgaat

SEQ ID NO: 529102 - DNA, 25 bp, Homo sapien
ctgtgctgaattaggtttggtactt

SEQ ID NO: 529103 - DNA, 25 bp, Homo sapien
atattagtaagttgcttttgcttct

SEQ ID NO: 529104 - DNA, 25 bp, Homo sapien
ttgcttctttctgtcaacttatttt

SEQ ID NO: 529105 - DNA, 25 bp, Homo sapien
cactgttttatgatatagttcactg

SEQ ID NO: 529106 - DNA, 25 bp, Homo sapien
gatatagttcactgagcacttacat

SEQ ID NO: 529107 - DNA, 25 bp, Homo sapien
gttcactgagcacttacatagatta

SEQ ID NO: 529108 - DNA, 25 bp, Homo sapien
gagcacttacatagattaacagtta

SEQ ID NO: 529109 - DNA, 25 bp, Homo sapien
cagttacaagtttccataaatcagt

SEQ ID NO: 529110 - DNA, 25 bp, Homo sapien
gttagaatatgactagcttcaggga

SEQ ID NO: 529111 - DNA, 25 bp, Homo sapien
tagcttcagggaaggaattttcaac

SEQ ID NO: 529112 - DNA, 25 bp, Homo sapien
ggaattttcaacaactgcaatcttt

SEQ ID NO: 529113 - DNA, 25 bp, Homo sapien
aatctttgattgttttactgtggga

SEQ ID NO: 529114 - DNA, 25 bp, Homo sapien
gattgttttactgtgggaacttgca

SEQ ID NO: 529115 - DNA, 25 bp, Homo sapien
ggaacttgcagtgatataattgaca

SEQ ID NO: 529116 - DNA, 25 bp, Homo sapien
atttactgtcatatcaattgctgga

SEQ ID NO: 529117 - DNA, 25 bp, Homo sapien
tcaattgctggaaaatgctatgatt

SEQ ID NO: 529118 - DNA, 25 bp, Homo sapien
tattattaccttctaagttgtattc

SEQ ID NO: 529119 - DNA, 25 bp, Homo sapien
agttgtattctctcttacactgtag

SEQ ID NO: 529120 - DNA, 25 bp, Homo sapien
attctctcttacactgtagcctcaa

SEQ ID NO: 529121 - DNA, 25 bp, Homo sapien
gtagcctcaactaaggcaattctgc

SEQ ID NO: 529122 - DNA, 25 bp, Homo sapien
ggcaattctgctatgtttgttcttc

SEQ ID NO: 529123 - DNA, 25 bp, Homo sapien
ctgctatgtttgttcttcactatga

SEQ ID NO: 529124 - DNA, 25 bp, Homo sapien
cttcactatgatttactgtgtgcca

SEQ ID NO: 529125 - DNA, 25 bp, Homo sapien
tgccaaaggagttttgacagggtac

SEQ ID NO: 529126 - DNA, 25 bp, Homo sapien
gacagggtacagagtattttactaa

SEQ ID NO: 529127 - DNA, 25 bp, Homo sapien
ggctgaagtcccaaaccaagttgtg

SEQ ID NO: 529128 - DNA, 25 bp, Homo sapien
caagttgtggactattacaatggca

SEQ ID NO: 529129 - DNA, 25 bp, Homo sapien
gaaatgtatgaatcttccagaacac

SEQ ID NO: 529130 - DNA, 25 bp, Homo sapien
atcttccagaacactagcaccatga

SEQ ID NO: 529131 - DNA, 25 bp, Homo sapien
atgaactccccacacagttttacag

SEQ ID NO: 529132 - DNA, 25 bp, Homo sapien
tccccacacagttttacagagttct

SEQ ID NO: 529133 - DNA, 25 bp, Homo sapien
gagttctgaaatactattcctgcta

SEQ ID NO: 529134 - DNA, 25 bp, Homo sapien
atatttaatacttctactactcctg

SEQ ID NO: 529135 - DNA, 25 bp, Homo sapien
taaaaatagcacgttttggtgattt

SEQ ID NO: 529136 - DNA, 25 bp, Homo sapien
ggtgatttttaactatctgacaatt

SEQ ID NO: 529137 - DNA, 25 bp, Homo sapien
ttttttgcatgtgtagccctgaggc

SEQ ID NO: 529138 - DNA, 25 bp, Homo sapien
caatttatggtttgtaactgctttt

SEQ ID NO: 529139 - DNA, 25 bp, Homo sapien
gtaactgctttttagggagataatt

SEQ ID NO: 529140 - DNA, 25 bp, Homo sapien
ggataatttaatttacgtgcttctg

SEQ ID NO: 529141 - DNA, 25 bp, Homo sapien
aatttacgtgcttctgttattcaga

SEQ ID NO: 529142 - DNA, 25 bp, Homo sapien
aagagagaagactacgctgcatatt

SEQ ID NO: 529143 - DNA, 25 bp, Homo sapien
gactacgctgcatattcaagagttg

SEQ ID NO: 529144 - DNA, 25 bp, Homo sapien
gctgcatattcaagagttgtacctt

SEQ ID NO: 529145 - DNA, 25 bp, Homo sapien
gttgtaccttaacattggtgaaaca

SEQ ID NO: 529146 - DNA, 25 bp, Homo sapien
gagaaatcataaccactgtcctaac

SEQ ID NO: 529147 - DNA, 25 bp, Homo sapien
cataaccactgtcctaacttggtaa

SEQ ID NO: 529148 - DNA, 25 bp, Homo sapien
tgtcctaacttggtaaacaaactgt

SEQ ID NO: 529149 - DNA, 25 bp, Homo sapien
taaaagacaaccttcttgcttctgg

SEQ ID NO: 529150 - DNA, 25 bp, Homo sapien
tgcttctgggacatccagcctgaca

SEQ ID NO: 529151 - DNA, 25 bp, Homo sapien
tgacagccaccaaacagttgcatcg

SEQ ID NO: 529152 - DNA, 25 bp, Homo sapien
aacagttgcatcgtccaagaatcac

SEQ ID NO: 529153 - DNA, 25 bp, Homo sapien
gaatcacgagaatctgcctcaggga

SEQ ID NO: 529154 - DNA, 25 bp, Homo sapien
atctgcctcagggacttgatatttt

SEQ ID NO: 529155 - DNA, 25 bp, Homo sapien
tgaagtattctcgagctctatacct

SEQ ID NO: 529156 - DNA, 25 bp, Homo sapien
atacctggcccttctgaagtgacca

SEQ ID NO: 529157 - DNA, 25 bp, Homo sapien
ccacatccttgctatttactgccaa

SEQ ID NO: 529158 - DNA, 25 bp, Homo sapien
aagcattgttgcactgtcctgaaat

SEQ ID NO: 529159 - DNA, 25 bp, Homo sapien
gttgcactgtcctgaaatttcaatt

SEQ ID NO: 529160 - DNA, 25 bp, Homo sapien
actaaagatcataaagagcctcaga

SEQ ID NO: 529161 - DNA, 25 bp, Homo sapien
aagagcctcagatcaagtttggtca

SEQ ID NO: 529162 - DNA, 25 bp, Homo sapien
atcaagtttggtcaggttttgtcac

SEQ ID NO: 529163 - DNA, 25 bp, Homo sapien
caggttttgtcaccaagctttgtaa

SEQ ID NO: 529164 - DNA, 25 bp, Homo sapien
ggttttgtcaccaagctttgtaaat

SEQ ID NO: 529165 - DNA, 25 bp, Homo sapien
gtaaataaactggttttcatagctt

SEQ ID NO: 529166 - DNA, 25 bp, Homo sapien
taagaaattgtgtctctgtcctttt

SEQ ID NO: 529167 - DNA, 25 bp, Homo sapien
agaaattgtgtctctgtcctttttt

SEQ ID NO: 529168 - DNA, 25 bp, Homo sapien
tttactgtaacatcttttgaattgg

SEQ ID NO: 529169 - DNA, 25 bp, Homo sapien
ttttcctctttgcagaatgggcagt

SEQ ID NO: 529170 - DNA, 25 bp, Homo sapien
tcctctttgcagaatgggcagttca

SEQ ID NO: 529171 - DNA, 25 bp, Homo sapien
agatccccagagaggtggccctgga

SEQ ID NO: 529172 - DNA, 25 bp, Homo sapien
ggtgtccaggagagtcgctcatcaa

SEQ ID NO: 529173 - DNA, 25 bp, Homo sapien
catcaaccccgggttcaagagtaag

SEQ ID NO: 529174 - DNA, 25 bp, Homo sapien
caagagtaagaaaccagctggtggc

SEQ ID NO: 529175 - DNA, 25 bp, Homo sapien
cagctggtggcgtggacttcgatga

SEQ ID NO: 529176 - DNA, 25 bp, Homo sapien
ggcgtggacttcgatgagacctgaa

SEQ ID NO: 529177 - DNA, 25 bp, Homo sapien
aaggtgcagcacaagcgtggccccg

SEQ ID NO: 529178 - DNA, 25 bp, Homo sapien
gaggcagtctttgaggcccccatca

SEQ ID NO: 529179 - DNA, 25 bp, Homo sapien
tcctgggccaggactaacacggctc

SEQ ID NO: 529180 - DNA, 25 bp, Homo sapien
gactaacacggctcctcaaattcct

SEQ ID NO: 529181 - DNA, 25 bp, Homo sapien
ctcaaattccttccctgtcaaataa

SEQ ID NO: 529182 - DNA, 25 bp, Homo sapien
agcccttcaagctcaggaaaccacg

SEQ ID NO: 529183 - DNA, 25 bp, Homo sapien
aggaaaccacgcttcactcgtgctg

SEQ ID NO: 529184 - DNA, 25 bp, Homo sapien
gcttcactcgtgctgacctgaaagt

SEQ ID NO: 529185 - DNA, 25 bp, Homo sapien
cgtgctgacctgaaagttaatcttt

SEQ ID NO: 529186 - DNA, 25 bp, Homo sapien
tcgattttgaaaaactccgcctcct

SEQ ID NO: 529187 - DNA, 25 bp, Homo sapien
ataaggaactgtcctgctttgtggg

SEQ ID NO: 529188 - DNA, 25 bp, Homo sapien
aagagggctgttgcttgtcaggcaa

SEQ ID NO: 529189 - DNA, 25 bp, Homo sapien
tcaggcaaaaaagttttctcttcct

SEQ ID NO: 529190 - DNA, 25 bp, Homo sapien
ttcccttgcatttggcaggctgtat

SEQ ID NO: 529191 - DNA, 25 bp, Homo sapien
gctgtatgaagccaatgagctgcga

SEQ ID NO: 529192 - DNA, 25 bp, Homo sapien
caatgagctgcgaggtgttttgaca

SEQ ID NO: 529193 - DNA, 25 bp, Homo sapien
aaccctcctggaagaaaatccatct

SEQ ID NO: 529194 - DNA, 25 bp, Homo sapien
ccatctcttctgaagggatctgaga

SEQ ID NO: 529195 - DNA, 25 bp, Homo sapien
gcgactccgaatccatgacatctga

SEQ ID NO: 529196 - DNA, 25 bp, Homo sapien
atgacatctgagagtcttcctgacc

SEQ ID NO: 529197 - DNA, 25 bp, Homo sapien
atctgagagtcttcctgaccacaaa

SEQ ID NO: 529198 - DNA, 25 bp, Homo sapien
tgaccacaaacctctgggatcccga

SEQ ID NO: 529199 - DNA, 25 bp, Homo sapien
gctccctacccaagaatcactttga

SEQ ID NO: 529200 - DNA, 25 bp, Homo sapien
gaatcactttgagcacagcatccca

SEQ ID NO: 529201 - DNA, 25 bp, Homo sapien
gcatcccaaggagcccatagagcga

SEQ ID NO: 529202 - DNA, 25 bp, Homo sapien
agcccatagagcgatcccttgcatt

SEQ ID NO: 529203 - DNA, 25 bp, Homo sapien
cctttccaactcacaaccaataaag

SEQ ID NO: 529204 - DNA, 25 bp, Homo sapien
agctggactctctgttatccaccgg

SEQ ID NO: 529205 - DNA, 25 bp, Homo sapien
gactctctgttatccaccggtgata

SEQ ID NO: 529206 - DNA, 25 bp, Homo sapien
tatccaccggtgatatctgggcctt

SEQ ID NO: 529207 - DNA, 25 bp, Homo sapien
ccttgtgatgggtgctgggaaccct

SEQ ID NO: 529208 - DNA, 25 bp, Homo sapien
aaccctgaggatgtacttgggacat

SEQ ID NO: 529209 - DNA, 25 bp, Homo sapien
cttgggacatagcttatattctggg

SEQ ID NO: 529210 - DNA, 25 bp, Homo sapien
agagagactccagtcatttccctat

SEQ ID NO: 529211 - DNA, 25 bp, Homo sapien
gagactccagtcatttccctatggc

SEQ ID NO: 529212 - DNA, 25 bp, Homo sapien
tgaactatggcaacccagcacaatg

SEQ ID NO: 529213 - DNA, 25 bp, Homo sapien
acccagcacaatgccaggagagctt

SEQ ID NO: 529214 - DNA, 25 bp, Homo sapien
gggcatcgcggccaaaataggactc

SEQ ID NO: 529215 - DNA, 25 bp, Homo sapien
gaggtcactggtgaccacattccca

SEQ ID NO: 529216 - DNA, 25 bp, Homo sapien
gcaagaccttcctcaacggaagccg

SEQ ID NO: 529217 - DNA, 25 bp, Homo sapien
ggaagccgtcccttgttgctagcaa

SEQ ID NO: 529218 - DNA, 25 bp, Homo sapien
gctgaactgcatgaatctgctaaat

SEQ ID NO: 529219 - DNA, 25 bp, Homo sapien
tgaatctgctaaatctcattatttc

SEQ ID NO: 529220 - DNA, 25 bp, Homo sapien
attcactagtcatttgagactgaca

SEQ ID NO: 529221 - DNA, 25 bp, Homo sapien
gagactgacagctttgcaggtagca

SEQ ID NO: 529222 - DNA, 25 bp, Homo sapien
ggtagcagtagtgtgtgctgctatt

SEQ ID NO: 529223 - DNA, 25 bp, Homo sapien
gctgctattgtggaatatacgtgtg

SEQ ID NO: 529224 - DNA, 25 bp, Homo sapien
ttgattagtttaacagtgcactggt

SEQ ID NO: 529225 - DNA, 25 bp, Homo sapien
aacagtgcactggtgaagaggacat

SEQ ID NO: 529226 - DNA, 25 bp, Homo sapien
gaaacaacagaagctgcccgcaata

SEQ ID NO: 529227 - DNA, 25 bp, Homo sapien
agctgcccgcaataatgaaaacaca

SEQ ID NO: 529228 - DNA, 25 bp, Homo sapien
gatgctctgagccatgaatgtacag

SEQ ID NO: 529229 - DNA, 25 bp, Homo sapien
tgagccatgaatgtacagctaagcc

SEQ ID NO: 529230 - DNA, 25 bp, Homo sapien
tgtttcccagagtggaggtgcagtc

SEQ ID NO: 529231 - DNA, 25 bp, Homo sapien
aggtgcagtcagaacaactcacggt

SEQ ID NO: 529232 - DNA, 25 bp, Homo sapien
acaactcacggtggaagagcagatt

SEQ ID NO: 529233 - DNA, 25 bp, Homo sapien
gaaacaggtgctacagtgacactga

SEQ ID NO: 529234 - DNA, 25 bp, Homo sapien
cactgagtaaaatatctatggccac

SEQ ID NO: 529235 - DNA, 25 bp, Homo sapien
tatggccactgacagtccacactta

SEQ ID NO: 529236 - DNA, 25 bp, Homo sapien
agtccacacttaggcactgagagat

SEQ ID NO: 529237 - DNA, 25 bp, Homo sapien
taagaaagttcagcccttctctgac

SEQ ID NO: 529238 - DNA, 25 bp, Homo sapien
tcagcccttctctgacttacctgga

SEQ ID NO: 529239 - DNA, 25 bp, Homo sapien
tccaaaggaccctctgggaatccat

SEQ ID NO: 529240 - DNA, 25 bp, Homo sapien
gggaatccatagcttcctaatctgg

SEQ ID NO: 529241 - DNA, 25 bp, Homo sapien
ttccttgaagtttcttgggttcaca

SEQ ID NO: 529242 - DNA, 25 bp, Homo sapien
tttcttgggttcacagaggagcccc

SEQ ID NO: 529243 - DNA, 25 bp, Homo sapien
tcacttggtgttctcccgtgagcca

SEQ ID NO: 529244 - DNA, 25 bp, Homo sapien
aaagacactctggtcctcgtatagt

SEQ ID NO: 529245 - DNA, 25 bp, Homo sapien
ctctggtcctcgtatagtgagtaat

SEQ ID NO: 529246 - DNA, 25 bp, Homo sapien
gggctcagggcctctccaacaacag

SEQ ID NO: 529247 - DNA, 25 bp, Homo sapien
gagctgatgctgtagggctgacccc

SEQ ID NO: 529248 - DNA, 25 bp, Homo sapien
tctatgctacattagttaggtacgt

SEQ ID NO: 529249 - DNA, 25 bp, Homo sapien
atcgcaaaaacccagtctgtcgaga

SEQ ID NO: 529250 - DNA, 25 bp, Homo sapien
acccagtctgtcgagaaatgtccat

SEQ ID NO: 529251 - DNA, 25 bp, Homo sapien
agaaatgtccatggcgcttttatcg

SEQ ID NO: 529252 - DNA, 25 bp, Homo sapien
gcttttatcgaaccttgcccaaggg

SEQ ID NO: 529253 - DNA, 25 bp, Homo sapien
ggacgcactagcagcaagggccata

SEQ ID NO: 529254 - DNA, 25 bp, Homo sapien
agcaagggccatagctgtgcagaaa

SEQ ID NO: 529255 - DNA, 25 bp, Homo sapien
tggaaccacctagcgtagacatgat

SEQ ID NO: 529256 - DNA, 25 bp, Homo sapien
tagacatgatgtgcagggcggccaa

SEQ ID NO: 529257 - DNA, 25 bp, Homo sapien
ggcggccaaggctttgctagccatg

SEQ ID NO: 529258 - DNA, 25 bp, Homo sapien
aaggctttgctagccatggccagag

SEQ ID NO: 529259 - DNA, 25 bp, Homo sapien
ggaaatctcttgacattggaagcat

SEQ ID NO: 529260 - DNA, 25 bp, Homo sapien
caacaggtgccataatatctaacaa

SEQ ID NO: 529261 - DNA, 25 bp, Homo sapien
gaagcatgatgcacacacgacctta

SEQ ID NO: 529262 - DNA, 25 bp, Homo sapien
taaaaccctaccaatagctctgatg

SEQ ID NO: 529263 - DNA, 25 bp, Homo sapien
gggaacctgagctagcacgttggta

SEQ ID NO: 529264 - DNA, 25 bp, Homo sapien
acgttggtattcacgagggctcttc

SEQ ID NO: 529265 - DNA, 25 bp, Homo sapien
ttctgtcctgaattggtcctctcat

SEQ ID NO: 529266 - DNA, 25 bp, Homo sapien
ttggtcctctcatctctgggaaaga

SEQ ID NO: 529267 - DNA, 25 bp, Homo sapien
aatgacaggctattggaagaccagg

SEQ ID NO: 529268 - DNA, 25 bp, Homo sapien
gctcatgtatttcaccagctggaaa

SEQ ID NO: 529269 - DNA, 25 bp, Homo sapien
aattcatctagtaaacaggctgttt

SEQ ID NO: 529270 - DNA, 25 bp, Homo sapien
catgagcgagaatggctacgacccc

SEQ ID NO: 529271 - DNA, 25 bp, Homo sapien
cccagcagaacctgaacgacctgat

SEQ ID NO: 529272 - DNA, 25 bp, Homo sapien
gaacctgaacgacctgatgctgctt

SEQ ID NO: 529273 - DNA, 25 bp, Homo sapien
ctgaacgacctgatgctgcttcagc

SEQ ID NO: 529274 - DNA, 25 bp, Homo sapien
cagcagcgtgacgatactgccactg

SEQ ID NO: 529275 - DNA, 25 bp, Homo sapien
gcctctgcagaacgccacggtggaa

SEQ ID NO: 529276 - DNA, 25 bp, Homo sapien
ggtggaagccggcaccagatgccag

SEQ ID NO: 529277 - DNA, 25 bp, Homo sapien
gaggaccagtgtcgccccaacaacg

SEQ ID NO: 529278 - DNA, 25 bp, Homo sapien
agtgtcgccccaacaacgtgtgcac

SEQ ID NO: 529279 - DNA, 25 bp, Homo sapien
aacaacgtgtgcaccggtgtgctca

SEQ ID NO: 529280 - DNA, 25 bp, Homo sapien
acccgccgcggtggcatctgcaatg

SEQ ID NO: 529281 - DNA, 25 bp, Homo sapien
aatactcaatttcttctacttcact

SEQ ID NO: 529282 - DNA, 25 bp, Homo sapien
tactcaatttcttctacttcactta

SEQ ID NO: 529283 - DNA, 25 bp, Homo sapien
ttcttcatcccactaatattgtctt

SEQ ID NO: 529284 - DNA, 25 bp, Homo sapien
tcccaagttccttttgagagagcgg

SEQ ID NO: 529285 - DNA, 25 bp, Homo sapien
caagttccttttgagagagcgggag

SEQ ID NO: 529286 - DNA, 25 bp, Homo sapien
atattgtcttagatgttgtcaacca

SEQ ID NO: 529287 - DNA, 25 bp, Homo sapien
gttgtcaaccaagaaacatttatgg

SEQ ID NO: 529288 - DNA, 25 bp, Homo sapien
atttatggtaaggagagcgtactgc

SEQ ID NO: 529289 - DNA, 25 bp, Homo sapien
gtaaggagagcgtactgcatacaac

SEQ ID NO: 529290 - DNA, 25 bp, Homo sapien
gagagcgtactgcatacaactgtat

SEQ ID NO: 529291 - DNA, 25 bp, Homo sapien
gcgtactgcatacaactgtattgat

SEQ ID NO: 529292 - DNA, 25 bp, Homo sapien
cctcatacaagatttttctcagcct

SEQ ID NO: 529293 - DNA, 25 bp, Homo sapien
agccttcagcctaccactgcagaat

SEQ ID NO: 529294 - DNA, 25 bp, Homo sapien
agcctaccactgcagaatccgatgt

SEQ ID NO: 529295 - DNA, 25 bp, Homo sapien
gaatccgatgtgacccaccattagg

SEQ ID NO: 529296 - DNA, 25 bp, Homo sapien
ccaccattagggagtctgcatcttg

SEQ ID NO: 529297 - DNA, 25 bp, Homo sapien
tagggagtctgcatcttggaagagt

SEQ ID NO: 529298 - DNA, 25 bp, Homo sapien
ggaaataaccctttaacatcaacat

SEQ ID NO: 529299 - DNA, 25 bp, Homo sapien
aacatcaacatgcttcaaagacttt

SEQ ID NO: 529300 - DNA, 25 bp, Homo sapien
caaagactttttgcctttggcctag

SEQ ID NO: 529301 - DNA, 25 bp, Homo sapien
gactttttgcctttggcctagtaag

SEQ ID NO: 529302 - DNA, 25 bp, Homo sapien
tttggcctagtaagatgcctctcca

SEQ ID NO: 529303 - DNA, 25 bp, Homo sapien
tcctttcctcagaactctaggtcgt

SEQ ID NO: 529304 - DNA, 25 bp, Homo sapien
actctaggtcgtcattgccatcaga

SEQ ID NO: 529305 - DNA, 25 bp, Homo sapien
tgtctaccaggcctccagggtatct

SEQ ID NO: 529306 - DNA, 25 bp, Homo sapien
agggtatctgcggtttccaattcac

SEQ ID NO: 529307 - DNA, 25 bp, Homo sapien
tgcggtttccaattcacagcactac

SEQ ID NO: 529308 - DNA, 25 bp, Homo sapien
cagccactgcaagggtcaggagtca

SEQ ID NO: 529309 - DNA, 25 bp, Homo sapien
gtcaagactcagacgggactttcct

SEQ ID NO: 529310 - DNA, 25 bp, Homo sapien
gggactttcctagggcttctggatt

SEQ ID NO: 529311 - DNA, 25 bp, Homo sapien
ctggatttgggcaaacagaactgaa

SEQ ID NO: 529312 - DNA, 25 bp, Homo sapien
agaactgaatgagcccatagctgct

SEQ ID NO: 529313 - DNA, 25 bp, Homo sapien
ttccagctgcctctggaacctaggc

SEQ ID NO: 529314 - DNA, 25 bp, Homo sapien
cgtcatgcctgctgtcggcgtttga

SEQ ID NO: 529315 - DNA, 25 bp, Homo sapien
tgtcggcgtttgaccttccacgtga

SEQ ID NO: 529316 - DNA, 25 bp, Homo sapien
tttgaccttccacgtgacagttctt

SEQ ID NO: 529317 - DNA, 25 bp, Homo sapien
gacagttcttcacaattcctttcat

SEQ ID NO: 529318 - DNA, 25 bp, Homo sapien
gttcttcacaattcctttcatcatt

SEQ ID NO: 529319 - DNA, 25 bp, Homo sapien
cacaattcctttcatcattttttaa

SEQ ID NO: 529320 - DNA, 25 bp, Homo sapien
ttttttactgcctatgggctgtgat

SEQ ID NO: 529321 - DNA, 25 bp, Homo sapien
ctgcctatgggctgtgatgtatata

SEQ ID NO: 529322 - DNA, 25 bp, Homo sapien
gttgtacattaaacataccctcatt

SEQ ID NO: 529323 - DNA, 25 bp, Homo sapien
tttcatgatgtggtaactacgaagt

SEQ ID NO: 529324 - DNA, 25 bp, Homo sapien
tttcattagggccatatctccaaaa

SEQ ID NO: 529325 - DNA, 25 bp, Homo sapien
tgttcttttagcagatctgtccctg

SEQ ID NO: 529326 - DNA, 25 bp, Homo sapien
tgtccctgtgggtggtgtctaagaa

SEQ ID NO: 529327 - DNA, 25 bp, Homo sapien
gaagtcggacaccttggtttttgtg

SEQ ID NO: 529328 - DNA, 25 bp, Homo sapien
ttgtgttagattgagctgggcagct

SEQ ID NO: 529329 - DNA, 25 bp, Homo sapien
gggcagctgcaatcagcttctttat

SEQ ID NO: 529330 - DNA, 25 bp, Homo sapien
aaattaggcacgacccatctgtggt

SEQ ID NO: 529331 - DNA, 25 bp, Homo sapien
gacccatctgtggttcctggttggt

SEQ ID NO: 529332 - DNA, 25 bp, Homo sapien
tggttcctggttggtggctaatgaa

SEQ ID NO: 529333 - DNA, 25 bp, Homo sapien
tcccattggctttggccaggccaga

SEQ ID NO: 529334 - DNA, 25 bp, Homo sapien
aggccagacacttcacatcgtttac

SEQ ID NO: 529335 - DNA, 25 bp, Homo sapien
gacacttcacatcgtttacatggtt

SEQ ID NO: 529336 - DNA, 25 bp, Homo sapien
tcaccaggatgggaggaagcctatt

SEQ ID NO: 529337 - DNA, 25 bp, Homo sapien
ccaggatgggaggaagcctattgat

SEQ ID NO: 529338 - DNA, 25 bp, Homo sapien
aggaagcctattgatgagcgtgtgc

SEQ ID NO: 529339 - DNA, 25 bp, Homo sapien
tgctgccatccatccactactgaga

SEQ ID NO: 529340 - DNA, 25 bp, Homo sapien
atccatccactactgagatcctcaa

SEQ ID NO: 529341 - DNA, 25 bp, Homo sapien
caggtgagcgccgaccttatggagc

SEQ ID NO: 529342 - DNA, 25 bp, Homo sapien
gagcgccgaccttatggagcgagca

SEQ ID NO: 529343 - DNA, 25 bp, Homo sapien
gccgaccttatggagcgagcagcca

SEQ ID NO: 529344 - DNA, 25 bp, Homo sapien
atccctggatgatgtgtctttgaca

SEQ ID NO: 529345 - DNA, 25 bp, Homo sapien
caggaaggagttccacagaagcagt

SEQ ID NO: 529346 - DNA, 25 bp, Homo sapien
atcttcaccaggatgggaggaagcc

SEQ ID NO: 529347 - DNA, 25 bp, Homo sapien
tcgagtattcaattaccttcccagc

SEQ ID NO: 529348 - DNA, 25 bp, Homo sapien
ccagccgcagggaaagtgtgagcta

SEQ ID NO: 529349 - DNA, 25 bp, Homo sapien
tgtgagctagggaccaagcgagctt

SEQ ID NO: 529350 - DNA, 25 bp, Homo sapien
gaccaagcgagcttcagaggcagct

SEQ ID NO: 529351 - DNA, 25 bp, Homo sapien
aatgccttggactacgcgggatcag

SEQ ID NO: 529352 - DNA, 25 bp, Homo sapien
gggatcagtctccttgctctcttca

SEQ ID NO: 529353 - DNA, 25 bp, Homo sapien
ttcagaactgggaattctcacgaca

SEQ ID NO: 529354 - DNA, 25 bp, Homo sapien
ggaattctcacgacagatgcaccct

SEQ ID NO: 529355 - DNA, 25 bp, Homo sapien
tcgccaatcacgcaggactgaccgg

SEQ ID NO: 529356 - DNA, 25 bp, Homo sapien
gtcggaatcgccgtcattctagatg

SEQ ID NO: 529357 - DNA, 25 bp, Homo sapien
attctagatgatctacaccttcccg

SEQ ID NO: 529358 - DNA, 25 bp, Homo sapien
ttcccagatcaacctgccagtggag

SEQ ID NO: 529359 - DNA, 25 bp, Homo sapien
tggagtcaggcagtgcactcctgga

SEQ ID NO: 529360 - DNA, 25 bp, Homo sapien
agtgcactcctggagccaagaggga

SEQ ID NO: 529361 - DNA, 25 bp, Homo sapien
gtagagagggtatgtccagtagcct

SEQ ID NO: 529362 - DNA, 25 bp, Homo sapien
gtatgtccagtagcctggagctcca

SEQ ID NO: 529363 - DNA, 25 bp, Homo sapien
tggagctccatggtggcttcatgcc

SEQ ID NO: 529364 - DNA, 25 bp, Homo sapien
tgagggctccctcggaacagtgcct

SEQ ID NO: 529365 - DNA, 25 bp, Homo sapien
agtgcctcaaatcctgacccaaggg

SEQ ID NO: 529366 - DNA, 25 bp, Homo sapien
gatggttgcaggcaaaatgcacttt

SEQ ID NO: 529367 - DNA, 25 bp, Homo sapien
ttctattgctgggaaggtgtgtttc

SEQ ID NO: 529368 - DNA, 25 bp, Homo sapien
gtgtgtttctcccacaatttgtttg

SEQ ID NO: 529369 - DNA, 25 bp, Homo sapien
ccacgaggacggaccactgtactac

SEQ ID NO: 529370 - DNA, 25 bp, Homo sapien
gaggacggaccactgtactacccga

SEQ ID NO: 529371 - DNA, 25 bp, Homo sapien
tgtactacccgactgtcagcaccat

SEQ ID NO: 529372 - DNA, 25 bp, Homo sapien
cgactgtcagcaccatcagcctggg

SEQ ID NO: 529373 - DNA, 25 bp, Homo sapien
tgggctcccacaccgtgctggactt

SEQ ID NO: 529374 - DNA, 25 bp, Homo sapien
tggacttctacgagccgcggcggcc

SEQ ID NO: 529375 - DNA, 25 bp, Homo sapien
ggcggccagaggacgatgaccctac

SEQ ID NO: 529376 - DNA, 25 bp, Homo sapien
ggacgatgaccctacagaacagcct

SEQ ID NO: 529377 - DNA, 25 bp, Homo sapien
cgatgaccctacagaacagcctcgg

SEQ ID NO: 529378 - DNA, 25 bp, Homo sapien
gctactgctggaaccgcgcagcctg

SEQ ID NO: 529379 - DNA, 25 bp, Homo sapien
tggaaccgcgcagcctgctggtgct

SEQ ID NO: 529380 - DNA, 25 bp, Homo sapien
gccaggacatgtgtgtacacagtga

SEQ ID NO: 529381 - DNA, 25 bp, Homo sapien
tcttctctcacgtggccactgtcat

SEQ ID NO: 529382 - DNA, 25 bp, Homo sapien
actgtcatcccggaactactgtggc

SEQ ID NO: 529383 - DNA, 25 bp, Homo sapien
gtcatcccggaactactgtggccca

SEQ ID NO: 529384 - DNA, 25 bp, Homo sapien
ctgaagccctgaacccgaagggtag

SEQ ID NO: 529385 - DNA, 25 bp, Homo sapien
ggtagggattccggagcccctgcca

SEQ ID NO: 529386 - DNA, 25 bp, Homo sapien
gagactacactacttagagagtcat

SEQ ID NO: 529387 - DNA, 25 bp, Homo sapien
actacttagagagtcattccaaaag

SEQ ID NO: 529388 - DNA, 25 bp, Homo sapien
ttggaagtccagagggcaacacggc

SEQ ID NO: 529389 - DNA, 25 bp, Homo sapien
ggcaacacggcctgccctgatcttg

SEQ ID NO: 529390 - DNA, 25 bp, Homo sapien
tgtgcagccaggacatgtgtgtaca

SEQ ID NO: 529391 - DNA, 25 bp, Homo sapien
tcatgatcacaggtgattcacacgt

SEQ ID NO: 529392 - DNA, 25 bp, Homo sapien
acaggtgattcacacgtacacacat

SEQ ID NO: 529393 - DNA, 25 bp, Homo sapien
agtgcagcctgaagtaactcccaca

SEQ ID NO: 529394 - DNA, 25 bp, Homo sapien
aagtaactcccacagaaaccatcat

SEQ ID NO: 529395 - DNA, 25 bp, Homo sapien
tcccacagaaaccatcatcgtcttt

SEQ ID NO: 529396 - DNA, 25 bp, Homo sapien
atcatcgtctttgtacatcgtatgt

SEQ ID NO: 529397 - DNA, 25 bp, Homo sapien
tacatcgtatgtacaatgcaatcat

SEQ ID NO: 529398 - DNA, 25 bp, Homo sapien
tcatttcatactttaaactggtcaa

SEQ ID NO: 529399 - DNA, 25 bp, Homo sapien
ttgtgatttctagtcttgcaaagct

SEQ ID NO: 529400 - DNA, 25 bp, Homo sapien
tctagtcttgcaaagctgtatgtag

SEQ ID NO: 529401 - DNA, 25 bp, Homo sapien
gtagttagatgatgtgacaacctct

SEQ ID NO: 529402 - DNA, 25 bp, Homo sapien
gaacatggaccccaactctatggca

SEQ ID NO: 529403 - DNA, 25 bp, Homo sapien
actctatggcaagcaagatcgcaga

SEQ ID NO: 529404 - DNA, 25 bp, Homo sapien
gcatcatccgcaaggacttcaggtc

SEQ ID NO: 529405 - DNA, 25 bp, Homo sapien
caggtctcccttggctggagatgag

SEQ ID NO: 529406 - DNA, 25 bp, Homo sapien
ggagatgaggatccacattaaatgt

SEQ ID NO: 529407 - DNA, 25 bp, Homo sapien
atgtttgtaacacaccaggccacag

SEQ ID NO: 529408 - DNA, 25 bp, Homo sapien
gaaagctcgctacacacagatgctt

SEQ ID NO: 529409 - DNA, 25 bp, Homo sapien
atgctgactctcagaggctgctaag

SEQ ID NO: 529410 - DNA, 25 bp, Homo sapien
ttcaagccaccagagacctgtctgt

SEQ ID NO: 529411 - DNA, 25 bp, Homo sapien
gacctgtctgtacaactggaaaggc

SEQ ID NO: 529412 - DNA, 25 bp, Homo sapien
atttatttaatgtacctcaaggtgt

SEQ ID NO: 529413 - DNA, 25 bp, Homo sapien
gtggcagattacattattcagtccc

SEQ ID NO: 529414 - DNA, 25 bp, Homo sapien
ttacattattcagtcccacaagcac

SEQ ID NO: 529415 - DNA, 25 bp, Homo sapien
attattcagtcccacaagcacagaa

SEQ ID NO: 529416 - DNA, 25 bp, Homo sapien
aagcacagaaacatagtaacactag

SEQ ID NO: 529417 - DNA, 25 bp, Homo sapien
acatttattttacaatcgactgaat

SEQ ID NO: 529418 - DNA, 25 bp, Homo sapien
acttttgtagagattgtatgtgtga

SEQ ID NO: 529419 - DNA, 25 bp, Homo sapien
gataatgtaatgttcttttccagtt

SEQ ID NO: 529420 - DNA, 25 bp, Homo sapien
tttccagtttttggactacagttga

SEQ ID NO: 529421 - DNA, 25 bp, Homo sapien
atctttaccgaataacatgtgatgg

SEQ ID NO: 529422 - DNA, 25 bp, Homo sapien
gtaaatacgtatttcctgatgtgat

SEQ ID NO: 529423 - DNA, 25 bp, Homo sapien
atttcctgatgtgatttttgtgaga

SEQ ID NO: 529424 - DNA, 25 bp, Homo sapien
gaggtctctcagaactcaagggcct

SEQ ID NO: 529425 - DNA, 25 bp, Homo sapien
caacaggtgtcttccggtcccaggg

SEQ ID NO: 529426 - DNA, 25 bp, Homo sapien
tcttccggtcccagggagggcaagt

SEQ ID NO: 529427 - DNA, 25 bp, Homo sapien
agggcaagtttcctgaacctcgaag

SEQ ID NO: 529428 - DNA, 25 bp, Homo sapien
gcaagtttcctgaacctcgaaggca

SEQ ID NO: 529429 - DNA, 25 bp, Homo sapien
ggcagacagtggaggcctcccttcc

SEQ ID NO: 529430 - DNA, 25 bp, Homo sapien
cccaggaactgtcatcagagcagaa

SEQ ID NO: 529431 - DNA, 25 bp, Homo sapien
agagcagaaatcaagcccagtccca

SEQ ID NO: 529432 - DNA, 25 bp, Homo sapien
agaaatcaagcccagtcccaggcct

SEQ ID NO: 529433 - DNA, 25 bp, Homo sapien
gggcatctgccccattgatatttgc

SEQ ID NO: 529434 - DNA, 25 bp, Homo sapien
gccccattgatatttgcttggtaat

SEQ ID NO: 529435 - DNA, 25 bp, Homo sapien
gaagccgcctccttacatactgtaa

SEQ ID NO: 529436 - DNA, 25 bp, Homo sapien
catactgtaagtttagcctataggt

SEQ ID NO: 529437 - DNA, 25 bp, Homo sapien
agcctataggtttctccatacgtag

SEQ ID NO: 529438 - DNA, 25 bp, Homo sapien
tctccatacgtagtgaacagtcatc

SEQ ID NO: 529439 - DNA, 25 bp, Homo sapien
tgtggacactgtaacctactcttga

SEQ ID NO: 529440 - DNA, 25 bp, Homo sapien
ctactcttgaatcagtcacaggcag

SEQ ID NO: 529441 - DNA, 25 bp, Homo sapien
aggcagcagcacttcaaactctgtt

SEQ ID NO: 529442 - DNA, 25 bp, Homo sapien
taagccagacacgagctgtagccac

SEQ ID NO: 529443 - DNA, 25 bp, Homo sapien
acgagctgtagccaccctgctgttt

SEQ ID NO: 529444 - DNA, 25 bp, Homo sapien
tcccttttctgtccgtaagtctttg

SEQ ID NO: 529445 - DNA, 25 bp, Homo sapien
ctctctgagcctattctggtttgag

SEQ ID NO: 529446 - DNA, 25 bp, Homo sapien
aatcgaaatcaggtgtttgctcaaa

SEQ ID NO: 529447 - DNA, 25 bp, Homo sapien
aatcaggtgtttgctcaaatgaggg

SEQ ID NO: 529448 - DNA, 25 bp, Homo sapien
gagacctcagcagagtacttttctt

SEQ ID NO: 529449 - DNA, 25 bp, Homo sapien
ctcagcagagtacttttctttttgt

SEQ ID NO: 529450 - DNA, 25 bp, Homo sapien
cccacaaacccatcagtctgggaga

SEQ ID NO: 529451 - DNA, 25 bp, Homo sapien
aaacccatcagtctgggagagcatt

SEQ ID NO: 529452 - DNA, 25 bp, Homo sapien
ccatcagtctgggagagcattggga

SEQ ID NO: 529453 - DNA, 25 bp, Homo sapien
attgggagtggaaatcatgttgcct

SEQ ID NO: 529454 - DNA, 25 bp, Homo sapien
ggaaatcatgttgcctgggatgctg

SEQ ID NO: 529455 - DNA, 25 bp, Homo sapien
cctgggatgctggtttctttgtata

SEQ ID NO: 529456 - DNA, 25 bp, Homo sapien
aaatgtctctccatttgggctgggg

SEQ ID NO: 529457 - DNA, 25 bp, Homo sapien
caaatgtgtcctgtgggtggtatct

SEQ ID NO: 529458 - DNA, 25 bp, Homo sapien
gggatgaccaatgtgcagagctcac

SEQ ID NO: 529459 - DNA, 25 bp, Homo sapien
ataggccggcccatgtgttcccttt

SEQ ID NO: 529460 - DNA, 25 bp, Homo sapien
gtgctccgtaaaagtgagctgcgat

SEQ ID NO: 529461 - DNA, 25 bp, Homo sapien
gctgcgatgcggaggtgggcaagct

SEQ ID NO: 529462 - DNA, 25 bp, Homo sapien
ggaagagctctcaacccagagggat

SEQ ID NO: 529463 - DNA, 25 bp, Homo sapien
agctctcaacccagagggatctgac

SEQ ID NO: 529464 - DNA, 25 bp, Homo sapien
caacccagagggatctgaccaggaa

SEQ ID NO: 529465 - DNA, 25 bp, Homo sapien
gagctgtcccttctgggccctagtg

SEQ ID NO: 529466 - DNA, 25 bp, Homo sapien
ttctgggccctagtgtggcacttca

SEQ ID NO: 529467 - DNA, 25 bp, Homo sapien
tgtggcacttcacacacaaatgtgt

SEQ ID NO: 529468 - DNA, 25 bp, Homo sapien
gaccttagttcaaagccccctgaga

SEQ ID NO: 529469 - DNA, 25 bp, Homo sapien
agccccctgagagatcacttttaga

SEQ ID NO: 529470 - DNA, 25 bp, Homo sapien
ggagccctgtttgccttgagataaa

SEQ ID NO: 529471 - DNA, 25 bp, Homo sapien
ccttgagataaacggccttggcatt

SEQ ID NO: 529472 - DNA, 25 bp, Homo sapien
aaacggccttggcattttctggcat

SEQ ID NO: 529473 - DNA, 25 bp, Homo sapien
ggccttggcattttctggcattaat

SEQ ID NO: 529474 - DNA, 25 bp, Homo sapien
atgttcctatgatgacatattttca

SEQ ID NO: 529475 - DNA, 25 bp, Homo sapien
aagaaacactttcttatttactgtg

SEQ ID NO: 529476 - DNA, 25 bp, Homo sapien
aaaatgttgctaaatgtgttgttac

SEQ ID NO: 529477 - DNA, 25 bp, Homo sapien
gtgttgttacattatgtcactgctg

SEQ ID NO: 529478 - DNA, 25 bp, Homo sapien
gttacattatgtcactgctgaaagt

SEQ ID NO: 529479 - DNA, 25 bp, Homo sapien
atgcatggaccatactctgggtttg

SEQ ID NO: 529480 - DNA, 25 bp, Homo sapien
ggtttgagatcattcttcattgaag

SEQ ID NO: 529481 - DNA, 25 bp, Homo sapien
gttgaaattgtaaagctccatgatc

SEQ ID NO: 529482 - DNA, 25 bp, Homo sapien
aacaagctgcaagttattccctggc

SEQ ID NO: 529483 - DNA, 25 bp, Homo sapien
attccctggcatgctcaaaggattt

SEQ ID NO: 529484 - DNA, 25 bp, Homo sapien
caaaggattttcgtgcttttcactt

SEQ ID NO: 529485 - DNA, 25 bp, Homo sapien
ggattttcgtgcttttcacttaata

SEQ ID NO: 529486 - DNA, 25 bp, Homo sapien
aaagtctcttaaattcctgctgcag

SEQ ID NO: 529487 - DNA, 25 bp, Homo sapien
ttcctgctgcagacatcaatagctt

SEQ ID NO: 529488 - DNA, 25 bp, Homo sapien
gcttatctatattctcaaacaccaa

SEQ ID NO: 529489 - DNA, 25 bp, Homo sapien
atgtagtggtatgctaagctggctc

SEQ ID NO: 529490 - DNA, 25 bp, Homo sapien
agtgcactaaaacaatttcctgaac

SEQ ID NO: 529491 - DNA, 25 bp, Homo sapien
aatttcctgaactcacctgttgtac

SEQ ID NO: 529492 - DNA, 25 bp, Homo sapien
aactcacctgttgtactattcacct

SEQ ID NO: 529493 - DNA, 25 bp, Homo sapien
ttgtactattcaccttttaaaccat

SEQ ID NO: 529494 - DNA, 25 bp, Homo sapien
aaaccataaattgctctttagccat

SEQ ID NO: 529495 - DNA, 25 bp, Homo sapien
tctttagccatttgtagtgcagtaa

SEQ ID NO: 529496 - DNA, 25 bp, Homo sapien
aagacttggcacattttcttccaaa

SEQ ID NO: 529497 - DNA, 25 bp, Homo sapien
ggtatgttgtcagaccagggttttc

SEQ ID NO: 529498 - DNA, 25 bp, Homo sapien
cagaccagggttttcagagttgatg

SEQ ID NO: 529499 - DNA, 25 bp, Homo sapien
gatcacactgactggatctgtccac

SEQ ID NO: 529500 - DNA, 25 bp, Homo sapien
gactggatctgtccacgacatggaa

SEQ ID NO: 529501 - DNA, 25 bp, Homo sapien
atcttaaacttagcagagaggattt

SEQ ID NO: 529502 - DNA, 25 bp, Homo sapien
cttagcagagaggattttctgtcat

SEQ ID NO: 529503 - DNA, 25 bp, Homo sapien
gcagagaggattttctgtcatggaa

SEQ ID NO: 529504 - DNA, 25 bp, Homo sapien
aagcttggggcattcgttttgctca

SEQ ID NO: 529505 - DNA, 25 bp, Homo sapien
gcattcgttttgctcatctttggaa

SEQ ID NO: 529506 - DNA, 25 bp, Homo sapien
tggttgggaattttagtttagcact

SEQ ID NO: 529507 - DNA, 25 bp, Homo sapien
gggaattttagtttagcactcatca

SEQ ID NO: 529508 - DNA, 25 bp, Homo sapien
aattttagtttagcactcatcattt

SEQ ID NO: 529509 - DNA, 25 bp, Homo sapien
agcactcatcatttttgattggatt

SEQ ID NO: 529510 - DNA, 25 bp, Homo sapien
atattttcctacttcttacaagaat

SEQ ID NO: 529511 - DNA, 25 bp, Homo sapien
gcaagaatgaattattccggaagac

SEQ ID NO: 529512 - DNA, 25 bp, Homo sapien
tacatcttgggcaactagttaccaa

SEQ ID NO: 529513 - DNA, 25 bp, Homo sapien
gttaccaaatgaattgtgccaccat

SEQ ID NO: 529514 - DNA, 25 bp, Homo sapien
gaattgtgccaccataactgatttt

SEQ ID NO: 529515 - DNA, 25 bp, Homo sapien
aaaatatttgttgcccaggtgttat

SEQ ID NO: 529516 - DNA, 25 bp, Homo sapien
tgttgcccaggtgttatgaaagaat

SEQ ID NO: 529517 - DNA, 25 bp, Homo sapien
gtatagactaccttagcatgaagat

SEQ ID NO: 529518 - DNA, 25 bp, Homo sapien
gaagatgctcatgcctaagaatgaa

SEQ ID NO: 529519 - DNA, 25 bp, Homo sapien
gttgaggttatctcccattcaatca

SEQ ID NO: 529520 - DNA, 25 bp, Homo sapien
atctcccattcaatcatgtagcaag

SEQ ID NO: 529521 - DNA, 25 bp, Homo sapien
gaaattcactactgcagtttttatt

SEQ ID NO: 529522 - DNA, 25 bp, Homo sapien
tacaatttagtttgtgtggtctttt

SEQ ID NO: 529523 - DNA, 25 bp, Homo sapien
atacccagctggtcttttccttcat

SEQ ID NO: 529524 - DNA, 25 bp, Homo sapien
ttttccttcatctctatctgatcat

SEQ ID NO: 529525 - DNA, 25 bp, Homo sapien
gatcattttgatcctcctttggcat

SEQ ID NO: 529526 - DNA, 25 bp, Homo sapien
acaccatcacttccagtaacttttt

SEQ ID NO: 529527 - DNA, 25 bp, Homo sapien
tcctttggcatgtttgctgatacca

SEQ ID NO: 529528 - DNA, 25 bp, Homo sapien
ttgctgataccaccaagctctgcag

SEQ ID NO: 529529 - DNA, 25 bp, Homo sapien
tccctcatctgtggattactagcat

SEQ ID NO: 529530 - DNA, 25 bp, Homo sapien
ttactagcataagtcaccttctgga

SEQ ID NO: 529531 - DNA, 25 bp, Homo sapien
gtcaccttctggacttggtgtctcc

SEQ ID NO: 529532 - DNA, 25 bp, Homo sapien
ctccagggtagggtgtctgagacaa

SEQ ID NO: 529533 - DNA, 25 bp, Homo sapien
aaatctgatcaaatacccagctggt

SEQ ID NO: 529534 - DNA, 25 bp, Homo sapien
gcacttggcaggtcaaccgtcaagc

SEQ ID NO: 529535 - DNA, 25 bp, Homo sapien
ttggcaggtcaaccgtcaagcacac

SEQ ID NO: 529536 - DNA, 25 bp, Homo sapien
aggtcaaccgtcaagcacacacacg

SEQ ID NO: 529537 - DNA, 25 bp, Homo sapien
acacacacgcacagctgtatgtcag

SEQ ID NO: 529538 - DNA, 25 bp, Homo sapien
acagctgtatgtcagagctctgtga

SEQ ID NO: 529539 - DNA, 25 bp, Homo sapien
ttattggctcatcaaggagtgtgcc

SEQ ID NO: 529540 - DNA, 25 bp, Homo sapien
ggagtgtgccacatgccagatgctc

SEQ ID NO: 529541 - DNA, 25 bp, Homo sapien
gccacatgccagatgctctgcagaa

SEQ ID NO: 529542 - DNA, 25 bp, Homo sapien
tgctcctccatggaaacaacaagaa

SEQ ID NO: 529543 - DNA, 25 bp, Homo sapien
ccttcttaaaatacacacatggtga

SEQ ID NO: 529544 - DNA, 25 bp, Homo sapien
acacacatggtgaggtttgaagagg

SEQ ID NO: 529545 - DNA, 25 bp, Homo sapien
gggagggcacctccggtcacccgag

SEQ ID NO: 529546 - DNA, 25 bp, Homo sapien
gccgtccgaagaaggtgtcgccccg

SEQ ID NO: 529547 - DNA, 25 bp, Homo sapien
tccgaagaaggtgtcgccccgggct

SEQ ID NO: 529548 - DNA, 25 bp, Homo sapien
ccaccgggcggctggtatgtgtcca

SEQ ID NO: 529549 - DNA, 25 bp, Homo sapien
accgggcggctggtatgtgtccacc

SEQ ID NO: 529550 - DNA, 25 bp, Homo sapien
gcccagcgtggcttaggccaggtac

SEQ ID NO: 529551 - DNA, 25 bp, Homo sapien
cagcgtggcttaggccaggtacaac

SEQ ID NO: 529552 - DNA, 25 bp, Homo sapien
caagccctgggctagggacgcctgc

SEQ ID NO: 529553 - DNA, 25 bp, Homo sapien
gctagggacgcctgcgggagttcac

SEQ ID NO: 529554 - DNA, 25 bp, Homo sapien
ggcgccggtgtctgaggtctgagaa

SEQ ID NO: 529555 - DNA, 25 bp, Homo sapien
ctggtatgtgtccaccggcccctag

SEQ ID NO: 529556 - DNA, 25 bp, Homo sapien
gtgcaccgtaaatttgctgtggagg

SEQ ID NO: 529557 - DNA, 25 bp, Homo sapien
gtggaggagggcgaccacctcacta

SEQ ID NO: 529558 - DNA, 25 bp, Homo sapien
gaccacctcactatgctcaatatat

SEQ ID NO: 529559 - DNA, 25 bp, Homo sapien
acatttcctgaattacaagggtctt

SEQ ID NO: 529560 - DNA, 25 bp, Homo sapien
aagggtcttgtcagagctgcgactg

SEQ ID NO: 529561 - DNA, 25 bp, Homo sapien
gaaaaagcttcttgtcaagtttcaa

SEQ ID NO: 529562 - DNA, 25 bp, Homo sapien
caagtttcaagtgcccaggaagtct

SEQ ID NO: 529563 - DNA, 25 bp, Homo sapien
taacgaagttatacagacctccaag

SEQ ID NO: 529564 - DNA, 25 bp, Homo sapien
tacagacctccaagtactacatgag

SEQ ID NO: 529565 - DNA, 25 bp, Homo sapien
agatgtgactgccattgaatcggcc

SEQ ID NO: 529566 - DNA, 25 bp, Homo sapien
attgaatcggcctggctgttggagc

SEQ ID NO: 529567 - DNA, 25 bp, Homo sapien
gttcagtccatagagctactttagc

SEQ ID NO: 529568 - DNA, 25 bp, Homo sapien
agctactttagctccaggtgtgtcc

SEQ ID NO: 529569 - DNA, 25 bp, Homo sapien
tttagctccaggtgtgtcccggcca

SEQ ID NO: 529570 - DNA, 25 bp, Homo sapien
cggccaccaatcacatcaagacatg

SEQ ID NO: 529571 - DNA, 25 bp, Homo sapien
acatgtatcactggcctaaaagggt

SEQ ID NO: 529572 - DNA, 25 bp, Homo sapien
ggcagtagtatgtttgctaaagtaa

SEQ ID NO: 529573 - DNA, 25 bp, Homo sapien
tgaattaggtcccttttatcttagg

SEQ ID NO: 529574 - DNA, 25 bp, Homo sapien
caaggacaagttgatcactgagata

SEQ ID NO: 529575 - DNA, 25 bp, Homo sapien
atttttattcagtctccacttctgc

SEQ ID NO: 529576 - DNA, 25 bp, Homo sapien
cacttctgcctgaattgcccatgtt

SEQ ID NO: 529577 - DNA, 25 bp, Homo sapien
aattgcccatgttcagtccatagag

SEQ ID NO: 529578 - DNA, 25 bp, Homo sapien
ccagtagctgaattctacctgaagg

SEQ ID NO: 529579 - DNA, 25 bp, Homo sapien
gaagaagaggctatcacttccaagt

SEQ ID NO: 529580 - DNA, 25 bp, Homo sapien
ggctatcacttccaagtatcctgca

SEQ ID NO: 529581 - DNA, 25 bp, Homo sapien
gtcttttgggccacccaccaaacag

SEQ ID NO: 529582 - DNA, 25 bp, Homo sapien
cccaccaaacagcactggcattatg

SEQ ID NO: 529583 - DNA, 25 bp, Homo sapien
tcaccctagaccatggttacacgtg

SEQ ID NO: 529584 - DNA, 25 bp, Homo sapien
tagaccatggttacacgtggtaaaa

SEQ ID NO: 529585 - DNA, 25 bp, Homo sapien
taaaacaaccccttctggtgataca

SEQ ID NO: 529586 - DNA, 25 bp, Homo sapien
aaccccttctggtgatacattcaca

SEQ ID NO: 529587 - DNA, 25 bp, Homo sapien
tacattcacaactctctagtttccc

SEQ ID NO: 529588 - DNA, 25 bp, Homo sapien
gcttgccttttcctcagacttaaaa

SEQ ID NO: 529589 - DNA, 25 bp, Homo sapien
acggagtaacaaaccttgctctact

SEQ ID NO: 529590 - DNA, 25 bp, Homo sapien
caaaccttgctctactttaagttga

SEQ ID NO: 529591 - DNA, 25 bp, Homo sapien
taagttgaatgatagattcctctat

SEQ ID NO: 529592 - DNA, 25 bp, Homo sapien
gcaattaactgccataattagggaa

SEQ ID NO: 529593 - DNA, 25 bp, Homo sapien
gaaaactgtttaaagcatactgcat

SEQ ID NO: 529594 - DNA, 25 bp, Homo sapien
atactgcatttacttggccacagcg

SEQ ID NO: 529595 - DNA, 25 bp, Homo sapien
cacagcgccatctcatggtaatttt

SEQ ID NO: 529596 - DNA, 25 bp, Homo sapien
tttaaacgactcacacctaatgaaa

SEQ ID NO: 529597 - DNA, 25 bp, Homo sapien
tgctaccgtagccaaattgaactaa

SEQ ID NO: 529598 - DNA, 25 bp, Homo sapien
gccaaattgaactaagtcactgtac

SEQ ID NO: 529599 - DNA, 25 bp, Homo sapien
tcacacctaatgaaacacagttgtc

SEQ ID NO: 529600 - DNA, 25 bp, Homo sapien
agtgggctgcaattggcccagacct

SEQ ID NO: 529601 - DNA, 25 bp, Homo sapien
cagacctgcttcctactttgttttc

SEQ ID NO: 529602 - DNA, 25 bp, Homo sapien
tctcgcaagcaaccacctggtgatt

SEQ ID NO: 529603 - DNA, 25 bp, Homo sapien
acctggtgattcctgacgaggcctg

SEQ ID NO: 529604 - DNA, 25 bp, Homo sapien
acgaggcctgacttccggaaggcaa

SEQ ID NO: 529605 - DNA, 25 bp, Homo sapien
tttggctccagcttggcatgtatag

SEQ ID NO: 529606 - DNA, 25 bp, Homo sapien
gcttggcatgtataggagctgccca

SEQ ID NO: 529607 - DNA, 25 bp, Homo sapien
gctgcccaaggaatgacagacttct

SEQ ID NO: 529608 - DNA, 25 bp, Homo sapien
aatgacagacttcttgttcttgagg

SEQ ID NO: 529609 - DNA, 25 bp, Homo sapien
aaaaaaatgccagtccttccaggag

SEQ ID NO: 529610 - DNA, 25 bp, Homo sapien
gacagatattcaggcgtccggtggc

SEQ ID NO: 529611 - DNA, 25 bp, Homo sapien
ggagtgagatttctggtctacagaa

SEQ ID NO: 529612 - DNA, 25 bp, Homo sapien
gacatttatcgtcatgatgctttgc

SEQ ID NO: 529613 - DNA, 25 bp, Homo sapien
gtcatgatgctttgcacaagggctg

SEQ ID NO: 529614 - DNA, 25 bp, Homo sapien
caagggctgcaccaatttagatcat

SEQ ID NO: 529615 - DNA, 25 bp, Homo sapien
tttagatcatctttagcggtgaatg

SEQ ID NO: 529616 - DNA, 25 bp, Homo sapien
tactacaactactgatggtggtggt

SEQ ID NO: 529617 - DNA, 25 bp, Homo sapien
tcagttgcttttttttgcgaggtta

SEQ ID NO: 529618 - DNA, 25 bp, Homo sapien
ttacttttgtttgatgactagtggt

SEQ ID NO: 529619 - DNA, 25 bp, Homo sapien
gaatttttcgctgcctgttatattg

SEQ ID NO: 529620 - DNA, 25 bp, Homo sapien
tcgctgcctgttatattgcttgtat

SEQ ID NO: 529621 - DNA, 25 bp, Homo sapien
gcttgtatactttgcctgtttgtgt

SEQ ID NO: 529622 - DNA, 25 bp, Homo sapien
gtacagtgagtgaatatacccccat

SEQ ID NO: 529623 - DNA, 25 bp, Homo sapien
agtgagtgaatatacccccatcccc

SEQ ID NO: 529624 - DNA, 25 bp, Homo sapien
agtgaatatacccccatccccaaga

SEQ ID NO: 529625 - DNA, 25 bp, Homo sapien
ccaagcatgtcttagaataatctat

SEQ ID NO: 529626 - DNA, 25 bp, Homo sapien
caagcatgtcttagaataatctatg

SEQ ID NO: 529627 - DNA, 25 bp, Homo sapien
aagcatgtcttagaataatctatgt

SEQ ID NO: 529628 - DNA, 25 bp, Homo sapien
tagaataatctatgtgttgatgcat

SEQ ID NO: 529629 - DNA, 25 bp, Homo sapien
agaataatctatgtgttgatgcatg

SEQ ID NO: 529630 - DNA, 25 bp, Homo sapien
gaataatctatgtgttgatgcatgt

SEQ ID NO: 529631 - DNA, 25 bp, Homo sapien
aataatctatgtgttgatgcatgta

SEQ ID NO: 529632 - DNA, 25 bp, Homo sapien
ataatctatgtgttgatgcatgtaa

SEQ ID NO: 529633 - DNA, 25 bp, Homo sapien
atcctgtgaattagtactaatgaaa

SEQ ID NO: 529634 - DNA, 25 bp, Homo sapien
gcaattattttttgactttctcaaa

SEQ ID NO: 529635 - DNA, 25 bp, Homo sapien
ttttcaacaaccaactgacctacag

SEQ ID NO: 529636 - DNA, 25 bp, Homo sapien
gtgaatgaaactttgactgtagaga

SEQ ID NO: 529637 - DNA, 25 bp, Homo sapien
ggtttagtatatcttagttgatcca

SEQ ID NO: 529638 - DNA, 25 bp, Homo sapien
gtatatcttagttgatccatttatt

SEQ ID NO: 529639 - DNA, 25 bp, Homo sapien
atcttagttgatccatttatttatt

SEQ ID NO: 529640 - DNA, 25 bp, Homo sapien
attttcctgaagaactaatttgctt

SEQ ID NO: 529641 - DNA, 25 bp, Homo sapien
cctgaagaactaatttgctttgcat

SEQ ID NO: 529642 - DNA, 25 bp, Homo sapien
gaactaatttgctttgcatgtaact

SEQ ID NO: 529643 - DNA, 25 bp, Homo sapien
atttgctttgcatgtaacttacaat

SEQ ID NO: 529644 - DNA, 25 bp, Homo sapien
agcagctctttgtcatgggttaaaa

SEQ ID NO: 529645 - DNA, 25 bp, Homo sapien
gaatacaaattcttagtcgttcaaa

SEQ ID NO: 529646 - DNA, 25 bp, Homo sapien
gtcgttcaaaattggaagcgctctt

SEQ ID NO: 529647 - DNA, 25 bp, Homo sapien
aagcgctcttagaagtgtcaagctc

SEQ ID NO: 529648 - DNA, 25 bp, Homo sapien
gaagtgtcaagctcagctttccatt

SEQ ID NO: 529649 - DNA, 25 bp, Homo sapien
aagctcagctttccattccacaaat

SEQ ID NO: 529650 - DNA, 25 bp, Homo sapien
gtaactggtaactgtgacttattat

SEQ ID NO: 529651 - DNA, 25 bp, Homo sapien
agttatacagtgacaaccaggacaa

SEQ ID NO: 529652 - DNA, 25 bp, Homo sapien
tagggttctagattccccttctggt

SEQ ID NO: 529653 - DNA, 25 bp, Homo sapien
agattccccttctggtgctcttttt

SEQ ID NO: 529654 - DNA, 25 bp, Homo sapien
cttagaacattttagcagctctttg

SEQ ID NO: 529655 - DNA, 25 bp, Homo sapien
atgggtcgtgtgatgagatgcattt

SEQ ID NO: 529656 - DNA, 25 bp, Homo sapien
gagatgcatttaaggccgatagtga

SEQ ID NO: 529657 - DNA, 25 bp, Homo sapien
aggccgatagtgatagatgtttttt

SEQ ID NO: 529658 - DNA, 25 bp, Homo sapien
tatttcttgaacacaggctttgtct

SEQ ID NO: 529659 - DNA, 25 bp, Homo sapien
acacaggctttgtctgaatgatgtt

SEQ ID NO: 529660 - DNA, 25 bp, Homo sapien
gaatgatgttcttttatctcttgaa

SEQ ID NO: 529661 - DNA, 25 bp, Homo sapien
atgataactacaggttttaagtgct

SEQ ID NO: 529662 - DNA, 25 bp, Homo sapien
ttaagtgctgttacattaataccat

SEQ ID NO: 529663 - DNA, 25 bp, Homo sapien
tctctagtctcaatatgtatgtgta

SEQ ID NO: 529664 - DNA, 25 bp, Homo sapien
gtgcaatttgctagtaggacaatgc

SEQ ID NO: 529665 - DNA, 25 bp, Homo sapien
ggacaatgcagtgactgactagcat

SEQ ID NO: 529666 - DNA, 25 bp, Homo sapien
tttatcttaaacttagcagagagga

SEQ ID NO: 529667 - DNA, 25 bp, Homo sapien
cttaaacttagcagagaggattttc

SEQ ID NO: 529668 - DNA, 25 bp, Homo sapien
cttagcagagaggattttctgtcat

SEQ ID NO: 529669 - DNA, 25 bp, Homo sapien
gcagagaggattttctgtcatggaa

SEQ ID NO: 529670 - DNA, 25 bp, Homo sapien
aagcttggggcattcgttttgctca

SEQ ID NO: 529671 - DNA, 25 bp, Homo sapien
tggttgggaattttagtttagcact

SEQ ID NO: 529672 - DNA, 25 bp, Homo sapien
tgggaattttagtttagcactcatc

SEQ ID NO: 529673 - DNA, 25 bp, Homo sapien
ggaattttagtttagcactcatcat

SEQ ID NO: 529674 - DNA, 25 bp, Homo sapien
aattttagtttagcactcatcattt

SEQ ID NO: 529675 - DNA, 25 bp, Homo sapien
atattttcctacttcttacaagaat

SEQ ID NO: 529676 - DNA, 25 bp, Homo sapien
gcaagaatgaattattccggaagac

SEQ ID NO: 529677 - DNA, 25 bp, Homo sapien
gagcatagtccaaagtgcaaaactt

SEQ ID NO: 529678 - DNA, 25 bp, Homo sapien
gtgcaaaacttggtgtttacaagga

SEQ ID NO: 529679 - DNA, 25 bp, Homo sapien
aattgtcttccagaactccactgtc

SEQ ID NO: 529680 - DNA, 25 bp, Homo sapien
agaactccactgtcatcactttcac

SEQ ID NO: 529681 - DNA, 25 bp, Homo sapien
ctttcaccaaagtggaagtttgcat

SEQ ID NO: 529682 - DNA, 25 bp, Homo sapien
gaatctaatattcaatgttctgtta

SEQ ID NO: 529683 - DNA, 25 bp, Homo sapien
gtaagtgaagtccagctacaaaata

SEQ ID NO: 529684 - DNA, 25 bp, Homo sapien
atttgtacatatgcagagtacggta

SEQ ID NO: 529685 - DNA, 25 bp, Homo sapien
gcagagtacggtatttctgtatgga

SEQ ID NO: 529686 - DNA, 25 bp, Homo sapien
tctgctttattcctatttttcccaa

SEQ ID NO: 529687 - DNA, 25 bp, Homo sapien
ttttcccaactctgatgagtagaat

SEQ ID NO: 529688 - DNA, 25 bp, Homo sapien
taatctgtaccataaaacctacaag

SEQ ID NO: 529689 - DNA, 25 bp, Homo sapien
acaagttaccaattactattcaatt

SEQ ID NO: 529690 - DNA, 25 bp, Homo sapien
taaagttcaaccgtattactgaaat

SEQ ID NO: 529691 - DNA, 25 bp, Homo sapien
ttactgaaatatacttctgattttg

SEQ ID NO: 529692 - DNA, 25 bp, Homo sapien
gattttgaaatgttgagcccaaata

SEQ ID NO: 529693 - DNA, 25 bp, Homo sapien
gagcccaaatatgtgattgcatctt

SEQ ID NO: 529694 - DNA, 25 bp, Homo sapien
gtgattgcatcttcatgctgcatat

SEQ ID NO: 529695 - DNA, 25 bp, Homo sapien
ttcatgctgcatattcagtgttcac

SEQ ID NO: 529696 - DNA, 25 bp, Homo sapien
gaaatgtaaaaggatgtccagccaa

SEQ ID NO: 529697 - DNA, 25 bp, Homo sapien
gatgtccagccaatgtaattttcct

SEQ ID NO: 529698 - DNA, 25 bp, Homo sapien
gccaatgtaattttccttcatcact

SEQ ID NO: 529699 - DNA, 25 bp, Homo sapien
ttcttgttatcaccattccacgttg

SEQ ID NO: 529700 - DNA, 25 bp, Homo sapien
attccacgttgccacacaaggtgca

SEQ ID NO: 529701 - DNA, 25 bp, Homo sapien
ggtgcacaggctggaagtcttttgt

SEQ ID NO: 529702 - DNA, 25 bp, Homo sapien
tcttttgtgaaattcccagttaaat

SEQ ID NO: 529703 - DNA, 25 bp, Homo sapien
gtgacttagtgcacaacacatttgt

SEQ ID NO: 529704 - DNA, 25 bp, Homo sapien
acatttgtgaaataacctactccta

SEQ ID NO: 529705 - DNA, 25 bp, Homo sapien
taacctactcctatatactgacctg

SEQ ID NO: 529706 - DNA, 25 bp, Homo sapien
tactcctatatactgacctgcctgt

SEQ ID NO: 529707 - DNA, 25 bp, Homo sapien
acctgcctgtccacgaataattgta

SEQ ID NO: 529708 - DNA, 25 bp, Homo sapien
acaaatggccttaaattctcacgga

SEQ ID NO: 529709 - DNA, 25 bp, Homo sapien
attctcacggaattcctggaaatga

SEQ ID NO: 529710 - DNA, 25 bp, Homo sapien
tactgggcatgtgcctgtctgagcc

SEQ ID NO: 529711 - DNA, 25 bp, Homo sapien
tgggcatgtgcctgtctgagcccca

SEQ ID NO: 529712 - DNA, 25 bp, Homo sapien
gggcatgtgcctgtctgagccccag

SEQ ID NO: 529713 - DNA, 25 bp, Homo sapien
ggcatgtgcctgtctgagccccagg

SEQ ID NO: 529714 - DNA, 25 bp, Homo sapien
tgtctgagccccaggtctgtctaca

SEQ ID NO: 529715 - DNA, 25 bp, Homo sapien
gtgggttcctaggactagggcccat

SEQ ID NO: 529716 - DNA, 25 bp, Homo sapien
gggttcctaggactagggcccatca

SEQ ID NO: 529717 - DNA, 25 bp, Homo sapien
ggttcctaggactagggcccatcac

SEQ ID NO: 529718 - DNA, 25 bp, Homo sapien
gttcctaggactagggcccatcact

SEQ ID NO: 529719 - DNA, 25 bp, Homo sapien
ttcctaggactagggcccatcactg

SEQ ID NO: 529720 - DNA, 25 bp, Homo sapien
taggactagggcccatcactgttct

SEQ ID NO: 529721 - DNA, 25 bp, Homo sapien
tcgggaatcctcttggcctctttca

SEQ ID NO: 529722 - DNA, 25 bp, Homo sapien
agggagccgccgtccatgtgttcca

SEQ ID NO: 529723 - DNA, 25 bp, Homo sapien
gtgttccatgcaaatgctgatctcc

SEQ ID NO: 529724 - DNA, 25 bp, Homo sapien
tgatctccccgtcactgtagaaggc

SEQ ID NO: 529725 - DNA, 25 bp, Homo sapien
agaaggccccgtagaagcccacgat

SEQ ID NO: 529726 - DNA, 25 bp, Homo sapien
agcccacgatgtacggcgagttgca

SEQ ID NO: 529727 - DNA, 25 bp, Homo sapien
gagttgcattcgtgcaggacctgca

SEQ ID NO: 529728 - DNA, 25 bp, Homo sapien
aggacctgcagctcgcggatgatct

SEQ ID NO: 529729 - DNA, 25 bp, Homo sapien
cggatggccggcttgatctcaaggt

SEQ ID NO: 529730 - DNA, 25 bp, Homo sapien
atctcaaggtggatcagcttcctgg

SEQ ID NO: 529731 - DNA, 25 bp, Homo sapien
cagctctgagatcctttcgaagtca

SEQ ID NO: 529732 - DNA, 25 bp, Homo sapien
agtgatgatgaaccctcactaggga

SEQ ID NO: 529733 - DNA, 25 bp, Homo sapien
tcactagggaggtgccccattattg

SEQ ID NO: 529734 - DNA, 25 bp, Homo sapien
tgccccattattgcttcactaagtt

SEQ ID NO: 529735 - DNA, 25 bp, Homo sapien
aagttttggtgccacacgcacattt

SEQ ID NO: 529736 - DNA, 25 bp, Homo sapien
aagagtgaagatacccttggatcat

SEQ ID NO: 529737 - DNA, 25 bp, Homo sapien
acccttggatcatggtaccttgtta

SEQ ID NO: 529738 - DNA, 25 bp, Homo sapien
atggaaggagcgacacaagctgact

SEQ ID NO: 529739 - DNA, 25 bp, Homo sapien
tgactggcagcatcgagtgcccaaa

SEQ ID NO: 529740 - DNA, 25 bp, Homo sapien
gtgcccaaagaataccactctagag

SEQ ID NO: 529741 - DNA, 25 bp, Homo sapien
agaaccgagagtgaacctgaccttt

SEQ ID NO: 529742 - DNA, 25 bp, Homo sapien
ttactctgcaatctttatcgcaatg

SEQ ID NO: 529743 - DNA, 25 bp, Homo sapien
gagctgccacgccagccttggtatc

SEQ ID NO: 529744 - DNA, 25 bp, Homo sapien
cgccagccttggtatctacttttta

SEQ ID NO: 529745 - DNA, 25 bp, Homo sapien
tactttttatacaaatctcctctag

SEQ ID NO: 529746 - DNA, 25 bp, Homo sapien
tctcctctagactgttccaggctgc

SEQ ID NO: 529747 - DNA, 25 bp, Homo sapien
tgctgcctctgttgctggatcgagc

SEQ ID NO: 529748 - DNA, 25 bp, Homo sapien
tctgttgctggatcgagccaccgac

SEQ ID NO: 529749 - DNA, 25 bp, Homo sapien
atcgagccaccgacctgatcttgga

SEQ ID NO: 529750 - DNA, 25 bp, Homo sapien
cttggaccacatccgtgagcgaagc

SEQ ID NO: 529751 - DNA, 25 bp, Homo sapien
accacatccgtgagcgaagccaggg

SEQ ID NO: 529752 - DNA, 25 bp, Homo sapien
ggccgtgacactagtggccatggct

SEQ ID NO: 529753 - DNA, 25 bp, Homo sapien
cgtgacactagtggccatggctgcc

SEQ ID NO: 529754 - DNA, 25 bp, Homo sapien
acttgtcacacttaagcatctcggg

SEQ ID NO: 529755 - DNA, 25 bp, Homo sapien
acacttaagcatctcgggccagtag

SEQ ID NO: 529756 - DNA, 25 bp, Homo sapien
gcatctcgggccagtagaagccgaa

SEQ ID NO: 529757 - DNA, 25 bp, Homo sapien
atgaccggctcgcacgagtcgcgca

SEQ ID NO: 529758 - DNA, 25 bp, Homo sapien
gacacgggtagatgggccggtccag

SEQ ID NO: 529759 - DNA, 25 bp, Homo sapien
cggtccaggcagacgggcgcgaaga

SEQ ID NO: 529760 - DNA, 25 bp, Homo sapien
ggaagacctgggtgccggcgtggca

SEQ ID NO: 529761 - DNA, 25 bp, Homo sapien
agttcttgttgagcaggggcaccca

SEQ ID NO: 529762 - DNA, 25 bp, Homo sapien
atggtctcgtgctccagcaggttgg

SEQ ID NO: 529763 - DNA, 25 bp, Homo sapien
tcgtgctccagcaggttgggcagca

SEQ ID NO: 529764 - DNA, 25 bp, Homo sapien
agcaccatcttcttgtagcccacgt

SEQ ID NO: 529765 - DNA, 25 bp, Homo sapien
atttcttctgtatttgcagtgtaat

SEQ ID NO: 529766 - DNA, 25 bp, Homo sapien
ttcttctgtatttgcagtgtaatga

SEQ ID NO: 529767 - DNA, 25 bp, Homo sapien
tttttgtggcaaagtgtattaagca

SEQ ID NO: 529768 - DNA, 25 bp, Homo sapien
gtggcaaagtgtattaagcaatttt

SEQ ID NO: 529769 - DNA, 25 bp, Homo sapien
aagcaatttttcattatcttgaagt

SEQ ID NO: 529770 - DNA, 25 bp, Homo sapien
atttttcattatcttgaagttccac

SEQ ID NO: 529771 - DNA, 25 bp, Homo sapien
tttcattatcttgaagttccacaaa

SEQ ID NO: 529772 - DNA, 25 bp, Homo sapien
cacatgcattttaggcacttttgat

SEQ ID NO: 529773 - DNA, 25 bp, Homo sapien
taggcacttttgatatgtgaaaata

SEQ ID NO: 529774 - DNA, 25 bp, Homo sapien
tttgctattttgaattccattatag

SEQ ID NO: 529775 - DNA, 25 bp, Homo sapien
gaattccattatagattcatgaata

SEQ ID NO: 529776 - DNA, 25 bp, Homo sapien
tacttcctcacacagctgatttttg

SEQ ID NO: 529777 - DNA, 25 bp, Homo sapien
cacacagctgatttttgtgaatgat

SEQ ID NO: 529778 - DNA, 25 bp, Homo sapien
atgatttagacatttctgccccgca

SEQ ID NO: 529779 - DNA, 25 bp, Homo sapien
atttagacatttctgccccgcagtg

SEQ ID NO: 529780 - DNA, 25 bp, Homo sapien
atttctgccccgcagtggccaatta

SEQ ID NO: 529781 - DNA, 25 bp, Homo sapien
cccgcagtggccaattattgcattt

SEQ ID NO: 529782 - DNA, 25 bp, Homo sapien
attgcatttggtggtttagctggat

SEQ ID NO: 529783 - DNA, 25 bp, Homo sapien
ggtttagctggattactaggatcaa

SEQ ID NO: 529784 - DNA, 25 bp, Homo sapien
ctaggatcaattgtggactcatact

SEQ ID NO: 529785 - DNA, 25 bp, Homo sapien
atcaattgtggactcatacttaggg

SEQ ID NO: 529786 - DNA, 25 bp, Homo sapien
taggggctacaatgcagtatactgg

SEQ ID NO: 529787 - DNA, 25 bp, Homo sapien
cagattgggcaatgtatacagttta

SEQ ID NO: 529788 - DNA, 25 bp, Homo sapien
gagttagtactaagaacagcattga

SEQ ID NO: 529789 - DNA, 25 bp, Homo sapien
agaggattcataacagtcactttta

SEQ ID NO: 529790 - DNA, 25 bp, Homo sapien
tattgttttggctttctactttgga

SEQ ID NO: 529791 - DNA, 25 bp, Homo sapien
gttttggctttctactttggagctg

SEQ ID NO: 529792 - DNA, 25 bp, Homo sapien
tggctttctactttggagctgtaat

SEQ ID NO: 529793 - DNA, 25 bp, Homo sapien
tctactttggagctgtaattttaaa

SEQ ID NO: 529794 - DNA, 25 bp, Homo sapien
tttttgtaaacagctcagtgaggac

SEQ ID NO: 529795 - DNA, 25 bp, Homo sapien
gtgaggactttggactggcataaat

SEQ ID NO: 529796 - DNA, 25 bp, Homo sapien
ggactttggactggcataaatcata

SEQ ID NO: 529797 - DNA, 25 bp, Homo sapien
ggactggcataaatcataggaatat

SEQ ID NO: 529798 - DNA, 25 bp, Homo sapien
ttcacagtgtgcatggaaaccatca

SEQ ID NO: 529799 - DNA, 25 bp, Homo sapien
gcatggaaaccatcacagcttgcct

SEQ ID NO: 529800 - DNA, 25 bp, Homo sapien
tcagcctgtgggtggtgatcgcctt

SEQ ID NO: 529801 - DNA, 25 bp, Homo sapien
tgtgggtggtgatcgcctttctccg

SEQ ID NO: 529802 - DNA, 25 bp, Homo sapien
tccgcttcattctacagcttgtggt

SEQ ID NO: 529803 - DNA, 25 bp, Homo sapien
ttcattctacagcttgtggtctctg

SEQ ID NO: 529804 - DNA, 25 bp, Homo sapien
cagcttgtggtctctgtgggccaga

SEQ ID NO: 529805 - DNA, 25 bp, Homo sapien
tcctgacagagcaccgcgacggatt

SEQ ID NO: 529806 - DNA, 25 bp, Homo sapien
gcgacggattccagcacggagagct

SEQ ID NO: 529807 - DNA, 25 bp, Homo sapien
ggttttactttgtcttcatgaatgc

SEQ ID NO: 529808 - DNA, 25 bp, Homo sapien
tgtcttcatgaatgccctgtggctg

SEQ ID NO: 529809 - DNA, 25 bp, Homo sapien
aatgtatttgcctttgacaaaagac

SEQ ID NO: 529810 - DNA, 25 bp, Homo sapien
gacaaaagactgacacaagagcaaa

SEQ ID NO: 529811 - DNA, 25 bp, Homo sapien
aaatcgggtgttatgtgctttcctc

SEQ ID NO: 529812 - DNA, 25 bp, Homo sapien
tatgtgctttcctccatttttgagc

SEQ ID NO: 529813 - DNA, 25 bp, Homo sapien
gaatgatgcagtttaagtaagcctt

SEQ ID NO: 529814 - DNA, 25 bp, Homo sapien
gtaagccttgttataccattgtcat

SEQ ID NO: 529815 - DNA, 25 bp, Homo sapien
ttataccattgtcatggacccctgt

SEQ ID NO: 529816 - DNA, 25 bp, Homo sapien
ggacccctgtcataaagccatttct

SEQ ID NO: 529817 - DNA, 25 bp, Homo sapien
gtcataaagccatttcttggtttgt

SEQ ID NO: 529818 - DNA, 25 bp, Homo sapien
gcatatgggatttatacagattcac

SEQ ID NO: 529819 - DNA, 25 bp, Homo sapien
cagattcacttgtaaatgttggatt

SEQ ID NO: 529820 - DNA, 25 bp, Homo sapien
tgaacattcctttccattgatccca

SEQ ID NO: 529821 - DNA, 25 bp, Homo sapien
atcccaggtcttcagctgagctgaa

SEQ ID NO: 529822 - DNA, 25 bp, Homo sapien
agctgagctgaaccaattgtcaacc

SEQ ID NO: 529823 - DNA, 25 bp, Homo sapien
gaatttacctacagcctggaagcac

SEQ ID NO: 529824 - DNA, 25 bp, Homo sapien
ccgctgcttcgagttgtcctgcctt

SEQ ID NO: 529825 - DNA, 25 bp, Homo sapien
gttgtcctgcctttctgaactcaac

SEQ ID NO: 529826 - DNA, 25 bp, Homo sapien
gtcctgcctttctgaactcaaccaa

SEQ ID NO: 529827 - DNA, 25 bp, Homo sapien
gattgatgcctcagtcctccctaaa

SEQ ID NO: 529828 - DNA, 25 bp, Homo sapien
ttgatgcctcagtcctccctaaaat

SEQ ID NO: 529829 - DNA, 25 bp, Homo sapien
atgcctcagtcctccctaaaatgta

SEQ ID NO: 529830 - DNA, 25 bp, Homo sapien
tcccaggccctcctgaggtctgtgt

SEQ ID NO: 529831 - DNA, 25 bp, Homo sapien
agaagcgtgttagcccatttgaggt

SEQ ID NO: 529832 - DNA, 25 bp, Homo sapien
ggaatcatgtaaagggtacccagac

SEQ ID NO: 529833 - DNA, 25 bp, Homo sapien
gtacccagacctcacttttagttat

SEQ ID NO: 529834 - DNA, 25 bp, Homo sapien
gccaaacatcttggtgggatttgat

SEQ ID NO: 529835 - DNA, 25 bp, Homo sapien
aaatgccttgggacctggagtgctg

SEQ ID NO: 529836 - DNA, 25 bp, Homo sapien
ctgggcttgtgcacaggaagagcac

SEQ ID NO: 529837 - DNA, 25 bp, Homo sapien
acaggaagagcaccagccgctgagt

SEQ ID NO: 529838 - DNA, 25 bp, Homo sapien
agccgctgagtcaggatcctgtcag

SEQ ID NO: 529839 - DNA, 25 bp, Homo sapien
tgagtcaggatcctgtcagttccat

SEQ ID NO: 529840 - DNA, 25 bp, Homo sapien
tgtcagttccatgagctattcctct

SEQ ID NO: 529841 - DNA, 25 bp, Homo sapien
tgagctattcctctttggtttggct

SEQ ID NO: 529842 - DNA, 25 bp, Homo sapien
agccctggagattgcaggacccaag

SEQ ID NO: 529843 - DNA, 25 bp, Homo sapien
acccaaggagctggcaggatggata

SEQ ID NO: 529844 - DNA, 25 bp, Homo sapien
gcagccacggctgaagttggtctga

SEQ ID NO: 529845 - DNA, 25 bp, Homo sapien
cacggctgaagttggtctgacctca

SEQ ID NO: 529846 - DNA, 25 bp, Homo sapien
tgacctcagggtccaaatcccagaa

SEQ ID NO: 529847 - DNA, 25 bp, Homo sapien
cagaactcagagaacttgtccttaa

SEQ ID NO: 529848 - DNA, 25 bp, Homo sapien
agaacttgtccttaacggtgctcca

SEQ ID NO: 529849 - DNA, 25 bp, Homo sapien
tccttaacggtgctccagtagtctt

SEQ ID NO: 529850 - DNA, 25 bp, Homo sapien
tagtctttcagggaactgaagccat

SEQ ID NO: 529851 - DNA, 25 bp, Homo sapien
gtccagctttattgggaggccagca

SEQ ID NO: 529852 - DNA, 25 bp, Homo sapien
gtaggagagcactgagaatactgtc

SEQ ID NO: 529853 - DNA, 25 bp, Homo sapien
accacagggtccttgccagtcttgg

SEQ ID NO: 529854 - DNA, 25 bp, Homo sapien
tcctggtcattgagcagcttggcca

SEQ ID NO: 529855 - DNA, 25 bp, Homo sapien
cattgagcagcttggccaagaagtt

SEQ ID NO: 529856 - DNA, 25 bp, Homo sapien
atggccaggcggaggatctcattct

SEQ ID NO: 529857 - DNA, 25 bp, Homo sapien
aggcggaggatctcattcttgctga

SEQ ID NO: 529858 - DNA, 25 bp, Homo sapien
aggatctcattcttgctgagcttct

SEQ ID NO: 529859 - DNA, 25 bp, Homo sapien
attcttgctgagcttcttgtccggg

SEQ ID NO: 529860 - DNA, 25 bp, Homo sapien
gatcagcttgcggagctcggcaaag

SEQ ID NO: 529861 - DNA, 25 bp, Homo sapien
aaaggccccgttcacattctgctgc

SEQ ID NO: 529862 - DNA, 25 bp, Homo sapien
gctgttggtgaagatacgccgcaca

SEQ ID NO: 529863 - DNA, 25 bp, Homo sapien
gatacgccgcacaactttggtgtgg

SEQ ID NO: 529864 - DNA, 25 bp, Homo sapien
agcagccaccaaagtctggcagact

SEQ ID NO: 529865 - DNA, 25 bp, Homo sapien
gcagccaccaaagtctggcagactt

SEQ ID NO: 529866 - DNA, 25 bp, Homo sapien
cagccaccaaagtctggcagacttt

SEQ ID NO: 529867 - DNA, 25 bp, Homo sapien
agccaccaaagtctggcagactttc

SEQ ID NO: 529868 - DNA, 25 bp, Homo sapien
gccaccaaagtctggcagactttct

SEQ ID NO: 529869 - DNA, 25 bp, Homo sapien
ccaccaaagtctggcagactttctg

SEQ ID NO: 529870 - DNA, 25 bp, Homo sapien
caccaaagtctggcagactttctgc

SEQ ID NO: 529871 - DNA, 25 bp, Homo sapien
accaaagtctggcagactttctgca

SEQ ID NO: 529872 - DNA, 25 bp, Homo sapien
ccaaagtctggcagactttctgcat

SEQ ID NO: 529873 - DNA, 25 bp, Homo sapien
tgctggtgccattgccccatgtgaa

SEQ ID NO: 529874 - DNA, 25 bp, Homo sapien
gtgccattgccccatgtgaagtcac

SEQ ID NO: 529875 - DNA, 25 bp, Homo sapien
gccattgccccatgtgaagtcactg

SEQ ID NO: 529876 - DNA, 25 bp, Homo sapien
attgccccatgtgaagtcactgtgc

SEQ ID NO: 529877 - DNA, 25 bp, Homo sapien
tgccccatgtgaagtcactgtgcca

SEQ ID NO: 529878 - DNA, 25 bp, Homo sapien
ccccatgtgaagtcactgtgccagc

SEQ ID NO: 529879 - DNA, 25 bp, Homo sapien
gccagcccagaacactggtctcggg

SEQ ID NO: 529880 - DNA, 25 bp, Homo sapien
agaacactggtctcgggcccgagaa

SEQ ID NO: 529881 - DNA, 25 bp, Homo sapien
taggtatcaccactaaaatctccag

SEQ ID NO: 529882 - DNA, 25 bp, Homo sapien
ggtatcaccactaaaatctccaggg

SEQ ID NO: 529883 - DNA, 25 bp, Homo sapien
aatctccaggggcaccattgaaatc

SEQ ID NO: 529884 - DNA, 25 bp, Homo sapien
cagagcacctccaaactgcattgag

SEQ ID NO: 529885 - DNA, 25 bp, Homo sapien
gcacctccaaactgcattgaggaga

SEQ ID NO: 529886 - DNA, 25 bp, Homo sapien
agaaagattaaagccatgttgacta

SEQ ID NO: 529887 - DNA, 25 bp, Homo sapien
agccatgttgactattttacagcca

SEQ ID NO: 529888 - DNA, 25 bp, Homo sapien
gttgactattttacagccactggag

SEQ ID NO: 529889 - DNA, 25 bp, Homo sapien
gactattttacagccactggagtta

SEQ ID NO: 529890 - DNA, 25 bp, Homo sapien
acagccactggagttaactaaccct

SEQ ID NO: 529891 - DNA, 25 bp, Homo sapien
ttttcttttgatgtccagttacacc

SEQ ID NO: 529892 - DNA, 25 bp, Homo sapien
tttgatgtccagttacaccatccat

SEQ ID NO: 529893 - DNA, 25 bp, Homo sapien
gttacaccatccattctgttaattt

SEQ ID NO: 529894 - DNA, 25 bp, Homo sapien
ggaagaatataatgaactgtacagt

SEQ ID NO: 529895 - DNA, 25 bp, Homo sapien
atgtgctatactgcatactttttaa

SEQ ID NO: 529896 - DNA, 25 bp, Homo sapien
ggaaatggctttgtgattcaatctg

SEQ ID NO: 529897 - DNA, 25 bp, Homo sapien
ctgtgtattccaagacatgtctgtt

SEQ ID NO: 529898 - DNA, 25 bp, Homo sapien
atgtctgttctacatagatgcttag

SEQ ID NO: 529899 - DNA, 25 bp, Homo sapien
tagatgcttagtccctcatgcaaat

SEQ ID NO: 529900 - DNA, 25 bp, Homo sapien
catgcaaatcaattactggtccaaa

SEQ ID NO: 529901 - DNA, 25 bp, Homo sapien
ttactggtccaaaagattgctgaaa

SEQ ID NO: 529902 - DNA, 25 bp, Homo sapien
gctgaaattttatatgcttactgat

SEQ ID NO: 529903 - DNA, 25 bp, Homo sapien
aattttttatcatgcatgtcctgta

SEQ ID NO: 529904 - DNA, 25 bp, Homo sapien
atcatgcatgtcctgtaaaggttac

SEQ ID NO: 529905 - DNA, 25 bp, Homo sapien
taaaggttacaagcctgcacaataa

SEQ ID NO: 529906 - DNA, 25 bp, Homo sapien
ggagacgcagcgtggagcctacctc

SEQ ID NO: 529907 - DNA, 25 bp, Homo sapien
tgctccgactggctgcagcggacac

SEQ ID NO: 529908 - DNA, 25 bp, Homo sapien
tgcagcggacactgcccaaagcaga

SEQ ID NO: 529909 - DNA, 25 bp, Homo sapien
gggagtctcagtgtcctgctagcca

SEQ ID NO: 529910 - DNA, 25 bp, Homo sapien
tgtcctgctagccagccgaacactt

SEQ ID NO: 529911 - DNA, 25 bp, Homo sapien
gaacacttctctccggaagcaggct

SEQ ID NO: 529912 - DNA, 25 bp, Homo sapien
tctccggaagcaggctggttcgact

SEQ ID NO: 529913 - DNA, 25 bp, Homo sapien
ggtgtttgactaaactgtttctctg

SEQ ID NO: 529914 - DNA, 25 bp, Homo sapien
tgtttctctgactcgccccagaggt

SEQ ID NO: 529915 - DNA, 25 bp, Homo sapien
agaggtcgtggctcaaaggcactta

SEQ ID NO: 529916 - DNA, 25 bp, Homo sapien
aggcacttaggacgccttaaatttg

SEQ ID NO: 529917 - DNA, 25 bp, Homo sapien
aaacctgttgtgcagagctcttccc

SEQ ID NO: 529918 - DNA, 25 bp, Homo sapien
gttgtgcagagctcttccccggaga

SEQ ID NO: 529919 - DNA, 25 bp, Homo sapien
tccacacaccctggctttgaagtgg

SEQ ID NO: 529920 - DNA, 25 bp, Homo sapien
aagtggagtctgtgactgctctgca

SEQ ID NO: 529921 - DNA, 25 bp, Homo sapien
tgtgactgctctgcattctctgctt

SEQ ID NO: 529922 - DNA, 25 bp, Homo sapien
aaaaccattgcaggtgccagtgtcc

SEQ ID NO: 529923 - DNA, 25 bp, Homo sapien
gcaggtgccagtgtcccatatgttc

SEQ ID NO: 529924 - DNA, 25 bp, Homo sapien
cttcaggctacttttatgagttagc

SEQ ID NO: 529925 - DNA, 25 bp, Homo sapien
ctacttttatgagttagccagatgc

SEQ ID NO: 529926 - DNA, 25 bp, Homo sapien
agccagatgcttgtgtatcctcaga

SEQ ID NO: 529927 - DNA, 25 bp, Homo sapien
gcttgtgtatcctcagaccaaactg

SEQ ID NO: 529928 - DNA, 25 bp, Homo sapien
aatgagaatgtgaggttcccctcgc

SEQ ID NO: 529929 - DNA, 25 bp, Homo sapien
tgagaatgtgaggttcccctcgcac

SEQ ID NO: 529930 - DNA, 25 bp, Homo sapien
gaatgtgaggttcccctcgcaccct

SEQ ID NO: 529931 - DNA, 25 bp, Homo sapien
tgtagcccgcctcatgcactgacca

SEQ ID NO: 529932 - DNA, 25 bp, Homo sapien
gaggatggtactggatctggcccca

SEQ ID NO: 529933 - DNA, 25 bp, Homo sapien
aggatggtactggatctggccccat

SEQ ID NO: 529934 - DNA, 25 bp, Homo sapien
atggtactggatctggccccatctt

SEQ ID NO: 529935 - DNA, 25 bp, Homo sapien
ggtactggatctggccccatcttct

SEQ ID NO: 529936 - DNA, 25 bp, Homo sapien
atcttctggcccttagctggtgcca

SEQ ID NO: 529937 - DNA, 25 bp, Homo sapien
ttctggcccttagctggtgccactt

SEQ ID NO: 529938 - DNA, 25 bp, Homo sapien
ttagctggtgccacttccctcctgt

SEQ ID NO: 529939 - DNA, 25 bp, Homo sapien
ttctgttggcagagcttttgcattt

SEQ ID NO: 529940 - DNA, 25 bp, Homo sapien
agagcttttgcatttcctgtgtttg

SEQ ID NO: 529941 - DNA, 25 bp, Homo sapien
atttcctgtgtttgtcctgggttct

SEQ ID NO: 529942 - DNA, 25 bp, Homo sapien
agccagctaccccttgtgggcaaag

SEQ ID NO: 529943 - DNA, 25 bp, Homo sapien
agctaccccttgtgggcaaaggcag

SEQ ID NO: 529944 - DNA, 25 bp, Homo sapien
aaggcagggccacttttgaagtctt

SEQ ID NO: 529945 - DNA, 25 bp, Homo sapien
ttgaagtcttccctcagatttccat

SEQ ID NO: 529946 - DNA, 25 bp, Homo sapien
ttccctcagatttccattgtgtggc

SEQ ID NO: 529947 - DNA, 25 bp, Homo sapien
agatttccattgtgtggcctggtgg

SEQ ID NO: 529948 - DNA, 25 bp, Homo sapien
gggagtctttgcaccaaagatgtcc

SEQ ID NO: 529949 - DNA, 25 bp, Homo sapien
accaaagatgtcctgactttgcccc

SEQ ID NO: 529950 - DNA, 25 bp, Homo sapien
gcaatgtttaattaagtgcccaaag

SEQ ID NO: 529951 - DNA, 25 bp, Homo sapien
tgcccaaagagcacaaacatttttc

SEQ ID NO: 529952 - DNA, 25 bp, Homo sapien
atatcttgtgttgtccttttgtctt

SEQ ID NO: 529953 - DNA, 25 bp, Homo sapien
ttttgtcttctctgtctcagacttt

SEQ ID NO: 529954 - DNA, 25 bp, Homo sapien
tgtctcagacttttgtacatctggc

SEQ ID NO: 529955 - DNA, 25 bp, Homo sapien
tgtggtaggccttttaacattttgt

SEQ ID NO: 529956 - DNA, 25 bp, Homo sapien
aacattttgttcttacacatacagt

SEQ ID NO: 529957 - DNA, 25 bp, Homo sapien
gttttatgctcttttttactcattg

SEQ ID NO: 529958 - DNA, 25 bp, Homo sapien
tgtcacgtactgtctgattggcttg

SEQ ID NO: 529959 - DNA, 25 bp, Homo sapien
gaattgttatagactgccgtgcatt

SEQ ID NO: 529960 - DNA, 25 bp, Homo sapien
gactgccgtgcattagcacagattt

SEQ ID NO: 529961 - DNA, 25 bp, Homo sapien
cagagcacctccaaactgcattgag

SEQ ID NO: 529962 - DNA, 25 bp, Homo sapien
gcacctccaaactgcattgaggaga

SEQ ID NO: 529963 - DNA, 25 bp, Homo sapien
ggagaagttccagaaccatcccctt

SEQ ID NO: 529964 - DNA, 25 bp, Homo sapien
agaaagattaaagccatgttgacta

SEQ ID NO: 529965 - DNA, 25 bp, Homo sapien
agccatgttgactattttacagcca

SEQ ID NO: 529966 - DNA, 25 bp, Homo sapien
gttgactattttacagccactggag

SEQ ID NO: 529967 - DNA, 25 bp, Homo sapien
acagccactggagttaactaaccct

SEQ ID NO: 529968 - DNA, 25 bp, Homo sapien
ttaactaacccttccttgtatctgt

SEQ ID NO: 529969 - DNA, 25 bp, Homo sapien
ttttcttttgatgtccagttacacc

SEQ ID NO: 529970 - DNA, 25 bp, Homo sapien
tttgatgtccagttacaccatccat

SEQ ID NO: 529971 - DNA, 25 bp, Homo sapien
gttacaccatccattctgttaattt

SEQ ID NO: 529972 - DNA, 25 bp, Homo sapien
gagcgagctttaaaactaatctgag

SEQ ID NO: 529973 - DNA, 25 bp, Homo sapien
taatctgagcataacccccaacgtg

SEQ ID NO: 529974 - DNA, 25 bp, Homo sapien
aacgtggctctatgcttgtgtacct

SEQ ID NO: 529975 - DNA, 25 bp, Homo sapien
tgcacatattttgtttagtacagtt

SEQ ID NO: 529976 - DNA, 25 bp, Homo sapien
tcatatttgagtttgcagaattatc

SEQ ID NO: 529977 - DNA, 25 bp, Homo sapien
acgtggttcttatttaactgtctag

SEQ ID NO: 529978 - DNA, 25 bp, Homo sapien
tgatagaatttaccaggtctggctg

SEQ ID NO: 529979 - DNA, 25 bp, Homo sapien
ctggctgaatgaagatgttggcacg

SEQ ID NO: 529980 - DNA, 25 bp, Homo sapien
agatgttggcacgtgtcattttagt

SEQ ID NO: 529981 - DNA, 25 bp, Homo sapien
gtcattttagtggtttaaatcctct

SEQ ID NO: 529982 - DNA, 25 bp, Homo sapien
gtggtttaaatcctcttatttatgg

SEQ ID NO: 529983 - DNA, 25 bp, Homo sapien
ataagattttgcaactggatgacac

SEQ ID NO: 529984 - DNA, 25 bp, Homo sapien
gcaactggatgacacaagattttac

SEQ ID NO: 529985 - DNA, 25 bp, Homo sapien
aaatctgattttgcagcgatcactt

SEQ ID NO: 529986 - DNA, 25 bp, Homo sapien
agcgatcacttttaaaccctgtagt

SEQ ID NO: 529987 - DNA, 25 bp, Homo sapien
aaaccctgtagtgatgtaagactaa

SEQ ID NO: 529988 - DNA, 25 bp, Homo sapien
gatatgacttttctgcactgtactc

SEQ ID NO: 529989 - DNA, 25 bp, Homo sapien
tgcactgtactctcttcataggatt

SEQ ID NO: 529990 - DNA, 25 bp, Homo sapien
gtactctcttcataggattgtaaag

SEQ ID NO: 529991 - DNA, 25 bp, Homo sapien
aaggtgttctaatccaattgcatga

SEQ ID NO: 529992 - DNA, 25 bp, Homo sapien
aattgcatgatgtagtaagcctctt

SEQ ID NO: 529993 - DNA, 25 bp, Homo sapien
gtaagcctcttaaatatgtgtgtta

SEQ ID NO: 529994 - DNA, 25 bp, Homo sapien
tgagcaacacgaccgccatcgccga

SEQ ID NO: 529995 - DNA, 25 bp, Homo sapien
caagagggcgtttgtgcactggtat

SEQ ID NO: 529996 - DNA, 25 bp, Homo sapien
tctccgaggcccgtgaggatatggc

SEQ ID NO: 529997 - DNA, 25 bp, Homo sapien
ctccgaggcccgtgaggatatggct

SEQ ID NO: 529998 - DNA, 25 bp, Homo sapien
attatgaggaggtgggcatcgactc

SEQ ID NO: 529999 - DNA, 25 bp, Homo sapien
aggtgggcatcgactcctatgagga

SEQ ID NO: 530000 - DNA, 25 bp, Homo sapien
gtgggcatcgactcctatgaggacg

SEQ ID NO: 530001 - DNA, 25 bp, Homo sapien
tgggcatcgactcctatgaggacga

SEQ ID NO: 530002 - DNA, 25 bp, Homo sapien
gcatcgactcctatgaggacgagga

SEQ ID NO: 530003 - DNA, 25 bp, Homo sapien
atcgactcctatgaggacgaggatg

SEQ ID NO: 530004 - DNA, 25 bp, Homo sapien
gggagaagaataaagcagctgcctg

SEQ ID NO: 530005 - DNA, 25 bp, Homo sapien
gggctgccctttggcactcactggg

SEQ ID NO: 530006 - DNA, 25 bp, Homo sapien
gagcaaacaccaaggtcctctggag

SEQ ID NO: 530007 - DNA, 25 bp, Homo sapien
tggagaccagaatcggccagtgcag

SEQ ID NO: 530008 - DNA, 25 bp, Homo sapien
aatcggccagtgcagccatttggct

SEQ ID NO: 530009 - DNA, 25 bp, Homo sapien
ttcaggaccagctgggtcagttccc

SEQ ID NO: 530010 - DNA, 25 bp, Homo sapien
ggtcagttcccaggccctgaggcaa

SEQ ID NO: 530011 - DNA, 25 bp, Homo sapien
gagaaagacgaccagcagcacaatc

SEQ ID NO: 530012 - DNA, 25 bp, Homo sapien
gaccagcagcacaatcaggatgatg

SEQ ID NO: 530013 - DNA, 25 bp, Homo sapien
cagcatggccagtacagcaggctgc

SEQ ID NO: 530014 - DNA, 25 bp, Homo sapien
agtacagcaggctgccctcaagggc

SEQ ID NO: 530015 - DNA, 25 bp, Homo sapien
gccagtctgtggcatgacaggaaat

SEQ ID NO: 530016 - DNA, 25 bp, Homo sapien
cattgcttgaatgggcggccactga

SEQ ID NO: 530017 - DNA, 25 bp, Homo sapien
gaatgggcggccactgatccatcat

SEQ ID NO: 530018 - DNA, 25 bp, Homo sapien
gatccatcatgcgaagcctcatctt

SEQ ID NO: 530019 - DNA, 25 bp, Homo sapien
atcttctctaccattcctttcattt

SEQ ID NO: 530020 - DNA, 25 bp, Homo sapien
cattcctttcatttctgtacccttt

SEQ ID NO: 530021 - DNA, 25 bp, Homo sapien
tatccaaagtactgcctagaagagg

SEQ ID NO: 530022 - DNA, 25 bp, Homo sapien
gactgtggaggtggatcattttcca

SEQ ID NO: 530023 - DNA, 25 bp, Homo sapien
gctgaatattcagatccctgttccc

SEQ ID NO: 530024 - DNA, 25 bp, Homo sapien
cctgttccctctggtgtgactaagg

SEQ ID NO: 530025 - DNA, 25 bp, Homo sapien
tccaaaaagcctcaggcgcatgtca

SEQ ID NO: 530026 - DNA, 25 bp, Homo sapien
ggaacctgtgtggaccattgcttga

SEQ ID NO: 530027 - DNA, 25 bp, Homo sapien
ggcaaagctgccaaatgaataacct

SEQ ID NO: 530028 - DNA, 25 bp, Homo sapien
aaatgaataacctgccacatctgca

SEQ ID NO: 530029 - DNA, 25 bp, Homo sapien
tctgcaggtggtaggactaacatgg

SEQ ID NO: 530030 - DNA, 25 bp, Homo sapien
gggtcatatatcttgggatcttctg

SEQ ID NO: 530031 - DNA, 25 bp, Homo sapien
ttgggatcttctggctctaccacca

SEQ ID NO: 530032 - DNA, 25 bp, Homo sapien
gatattatccttgcatctgatgtgt

SEQ ID NO: 530033 - DNA, 25 bp, Homo sapien
tttttgatgcacaagaatcccaagg

SEQ ID NO: 530034 - DNA, 25 bp, Homo sapien
gaatcccaaggtccaattgtggtct

SEQ ID NO: 530035 - DNA, 25 bp, Homo sapien
gtccaattgtggtctacttatcaag

SEQ ID NO: 530036 - DNA, 25 bp, Homo sapien
gagtgctgactggtcacttgaagct

SEQ ID NO: 530037 - DNA, 25 bp, Homo sapien
ggtcacttgaagctttactctacaa

SEQ ID NO: 530038 - DNA, 25 bp, Homo sapien
agaagaagggcaagcgccgccacag

SEQ ID NO: 530039 - DNA, 25 bp, Homo sapien
tgcccacggagagcgacgaggacat

SEQ ID NO: 530040 - DNA, 25 bp, Homo sapien
gcccagcaggtggacatcgtcacag

SEQ ID NO: 530041 - DNA, 25 bp, Homo sapien
gagatgcctgagaatgctctgccca

SEQ ID NO: 530042 - DNA, 25 bp, Homo sapien
gaatgctctgcccagcgacgaggat

SEQ ID NO: 530043 - DNA, 25 bp, Homo sapien
gcgacgaggatgacaaagaccccaa

SEQ ID NO: 530044 - DNA, 25 bp, Homo sapien
aacgacccctacagggctctggata

SEQ ID NO: 530045 - DNA, 25 bp, Homo sapien
gggctctggatattgacctggataa

SEQ ID NO: 530046 - DNA, 25 bp, Homo sapien
tattgacctggataagcccttagcc

SEQ ID NO: 530047 - DNA, 25 bp, Homo sapien
gataagcccttagccgacagcgaga

SEQ ID NO: 530048 - DNA, 25 bp, Homo sapien
gacagcgagaaactgcctattcaga

SEQ ID NO: 530049 - DNA, 25 bp, Homo sapien
tggtgggtcggaacagcgccatcgc

SEQ ID NO: 530050 - DNA, 25 bp, Homo sapien
tgggtactgcatctacttcgaccgc

SEQ ID NO: 530051 - DNA, 25 bp, Homo sapien
gaccgcaaaagacgaagtgacccca

SEQ ID NO: 530052 - DNA, 25 bp, Homo sapien
aagacgaagtgaccccaacttcaag

SEQ ID NO: 530053 - DNA, 25 bp, Homo sapien
accccaacttcaagaacaggcttcg

SEQ ID NO: 530054 - DNA, 25 bp, Homo sapien
ttcaagaacaggcttcgagaacgaa

SEQ ID NO: 530055 - DNA, 25 bp, Homo sapien
agagctgggctttccaagttacctg

SEQ ID NO: 530056 - DNA, 25 bp, Homo sapien
agctgggctttccaagttacctgac

SEQ ID NO: 530057 - DNA, 25 bp, Homo sapien
tgggctttccaagttacctgacctt

SEQ ID NO: 530058 - DNA, 25 bp, Homo sapien
caagttacctgaccttaaagatgct

SEQ ID NO: 530059 - DNA, 25 bp, Homo sapien
tacctgaccttaaagatgctgaagc

SEQ ID NO: 530060 - DNA, 25 bp, Homo sapien
gaggcagtgctgatccggctgctcc

SEQ ID NO: 530061 - DNA, 25 bp, Homo sapien
cagcccttcagacgagatcctgttt

SEQ ID NO: 530062 - DNA, 25 bp, Homo sapien
tcagacgagatcctgtttcagctaa

SEQ ID NO: 530063 - DNA, 25 bp, Homo sapien
gagatcctgtttcagctaaatgcag

SEQ ID NO: 530064 - DNA, 25 bp, Homo sapien
cctgtttcagctaaatgcagggaaa

SEQ ID NO: 530065 - DNA, 25 bp, Homo sapien
taaagcctttttttaggccacattg

SEQ ID NO: 530066 - DNA, 25 bp, Homo sapien
ttaggccacattgacagtggtgggc

SEQ ID NO: 530067 - DNA, 25 bp, Homo sapien
gatagggaacactcatccctggtcg

SEQ ID NO: 530068 - DNA, 25 bp, Homo sapien
atccctggtcgtctatcccagtgtg

SEQ ID NO: 530069 - DNA, 25 bp, Homo sapien
gtttaacattcacagcccagaacca

SEQ ID NO: 530070 - DNA, 25 bp, Homo sapien
gtctgggagagcctggcaaggcatt

SEQ ID NO: 530071 - DNA, 25 bp, Homo sapien
gcaagaccaagtacaacgggtgact

SEQ ID NO: 530072 - DNA, 25 bp, Homo sapien
ctggtctgccagaaggacggagcct

SEQ ID NO: 530073 - DNA, 25 bp, Homo sapien
cctggaccctggtgggcattgtgtc

SEQ ID NO: 530074 - DNA, 25 bp, Homo sapien
tgtacgcccgtgtcaccaagctcat

SEQ ID NO: 530075 - DNA, 25 bp, Homo sapien
gtgtcaccaagctcataccctgggt

SEQ ID NO: 530076 - DNA, 25 bp, Homo sapien
aagctcataccctgggtgcagaaga

SEQ ID NO: 530077 - DNA, 25 bp, Homo sapien
ataccctgggtgcagaagatcctgg

SEQ ID NO: 530078 - DNA, 25 bp, Homo sapien
gcagaagatcctggccgccaactga

SEQ ID NO: 530079 - DNA, 25 bp, Homo sapien
cctgccttaagatttcccattaaat

SEQ ID NO: 530080 - DNA, 25 bp, Homo sapien
tgccttaagatttcccattaaatgc

SEQ ID NO: 530081 - DNA, 25 bp, Homo sapien
ttcccattaaatgcatctgtttaga

SEQ ID NO: 530082 - DNA, 25 bp, Homo sapien
tgctctaccaccacgcccgctgtgt

SEQ ID NO: 530083 - DNA, 25 bp, Homo sapien
gctctaccaccacgcccgctgtgta

SEQ ID NO: 530084 - DNA, 25 bp, Homo sapien
accacgcccgctgtgtacgcccgtg

SEQ ID NO: 530085 - DNA, 25 bp, Homo sapien
ccacgcccgctgtgtacgcccgtgt

SEQ ID NO: 530086 - DNA, 25 bp, Homo sapien
cacgcccgctgtgtacgcccgtgtc

SEQ ID NO: 530087 - DNA, 25 bp, Homo sapien
gccgccaactgagcccgcagctcct

SEQ ID NO: 530088 - DNA, 25 bp, Homo sapien
cgccaactgagcccgcagctcctgc

SEQ ID NO: 530089 - DNA, 25 bp, Homo sapien
tcctgccacccctgccttaagattt

SEQ ID NO: 530090 - DNA, 25 bp, Homo sapien
cctgccttaagatttcccattaaat

SEQ ID NO: 530091 - DNA, 25 bp, Homo sapien
ctgccttaagatttcccattaaatg

SEQ ID NO: 530092 - DNA, 25 bp, Homo sapien
tgccttaagatttcccattaaatgc

SEQ ID NO: 530093 - DNA, 25 bp, Homo sapien
taggtattggtttccttggaaggca

SEQ ID NO: 530094 - DNA, 25 bp, Homo sapien
attggtttccttggaaggcatgata

SEQ ID NO: 530095 - DNA, 25 bp, Homo sapien
agaaagattcacaatggccaacagt

SEQ ID NO: 530096 - DNA, 25 bp, Homo sapien
ttcacaatggccaacagtgtgtatg

SEQ ID NO: 530097 - DNA, 25 bp, Homo sapien
ccttgctttgtgtcagaggcaaagg

SEQ ID NO: 530098 - DNA, 25 bp, Homo sapien
ttgtgtcagaggcaaaggaacccaa

SEQ ID NO: 530099 - DNA, 25 bp, Homo sapien
aaggcgccaagtcctcagccttgag

SEQ ID NO: 530100 - DNA, 25 bp, Homo sapien
aagtcctcagccttgagtgtactgc

SEQ ID NO: 530101 - DNA, 25 bp, Homo sapien
agccttgagtgtactgctgacaact

SEQ ID NO: 530102 - DNA, 25 bp, Homo sapien
actgctgacaactaaactcacaggc

SEQ ID NO: 530103 - DNA, 25 bp, Homo sapien
agatgcctgttatttcacatcactg

SEQ ID NO: 530104 - DNA, 25 bp, Homo sapien
gatgtatcggcaagcagtgtaaacg

SEQ ID NO: 530105 - DNA, 25 bp, Homo sapien
ggcaagcagtgtaaacggaggactt

SEQ ID NO: 530106 - DNA, 25 bp, Homo sapien
aaaaggaccacatagtccatcgaag

SEQ ID NO: 530107 - DNA, 25 bp, Homo sapien
tagtccatcgaagaagagtccttgg

SEQ ID NO: 530108 - DNA, 25 bp, Homo sapien
gagtccttggaacaagcaactggct

SEQ ID NO: 530109 - DNA, 25 bp, Homo sapien
cagtgcagagtgcttggctgtttcc

SEQ ID NO: 530110 - DNA, 25 bp, Homo sapien
ttggctgtttcctgttttctcccga

SEQ ID NO: 530111 - DNA, 25 bp, Homo sapien
tttctcccgattgctcctgtgtaaa

SEQ ID NO: 530112 - DNA, 25 bp, Homo sapien
tcctgtgtaaagatgccttgtcgtg

SEQ ID NO: 530113 - DNA, 25 bp, Homo sapien
agatgccttgtcgtgcagaaacaaa

SEQ ID NO: 530114 - DNA, 25 bp, Homo sapien
ttgtcgtgcagaaacaaatggctgt

SEQ ID NO: 530115 - DNA, 25 bp, Homo sapien
atgcatatttgcacttccagatggg

SEQ ID NO: 530116 - DNA, 25 bp, Homo sapien
gcacttccagatgggttgcataaga

SEQ ID NO: 530117 - DNA, 25 bp, Homo sapien
ccttaaatacctcccaatctgatga

SEQ ID NO: 530118 - DNA, 25 bp, Homo sapien
gtaacatttcccagaatggaggaat

SEQ ID NO: 530119 - DNA, 25 bp, Homo sapien
atttttgtccaagcgatgagctgac

SEQ ID NO: 530120 - DNA, 25 bp, Homo sapien
gagctgacggtggtattgcttctct

SEQ ID NO: 530121 - DNA, 25 bp, Homo sapien
ttgcttctctgcatgttatcagtgt

SEQ ID NO: 530122 - DNA, 25 bp, Homo sapien
agtgtgtacatctggtgcttttcat

SEQ ID NO: 530123 - DNA, 25 bp, Homo sapien
atctggtgcttttcatgtgtcattt

SEQ ID NO: 530124 - DNA, 25 bp, Homo sapien
tcatgtgtcatttgtgagccacaaa

SEQ ID NO: 530125 - DNA, 25 bp, Homo sapien
tgaattcagtcaggctacagggtgg

SEQ ID NO: 530126 - DNA, 25 bp, Homo sapien
ggagtgaacatcaataggaatactt

SEQ ID NO: 530127 - DNA, 25 bp, Homo sapien
attttaaactacagatggacttggt

SEQ ID NO: 530128 - DNA, 25 bp, Homo sapien
ctacagatggacttggtttgaggga

SEQ ID NO: 530129 - DNA, 25 bp, Homo sapien
tcacagatttggtgctaagttaatt

SEQ ID NO: 530130 - DNA, 25 bp, Homo sapien
agttaattagaaactggcagcgttt

SEQ ID NO: 530131 - DNA, 25 bp, Homo sapien
ggcagcgttttacagtagtacacca

SEQ ID NO: 530132 - DNA, 25 bp, Homo sapien
tttacagtagtacaccagcctggat

SEQ ID NO: 530133 - DNA, 25 bp, Homo sapien
ggagaaagagtactgtggaaaacct

SEQ ID NO: 530134 - DNA, 25 bp, Homo sapien
ggaaaacctctgcttgagtaccatg

SEQ ID NO: 530135 - DNA, 25 bp, Homo sapien
tctgcttgagtaccatgtggccagg

SEQ ID NO: 530136 - DNA, 25 bp, Homo sapien
ggccaggcctatgtggatggctact

SEQ ID NO: 530137 - DNA, 25 bp, Homo sapien
accttcaactgaactcaacaaaatc

SEQ ID NO: 530138 - DNA, 25 bp, Homo sapien
aactcaacaaaatcttcaacttcat

SEQ ID NO: 530139 - DNA, 25 bp, Homo sapien
aaatcttcaacttcatacagtagtc

SEQ ID NO: 530140 - DNA, 25 bp, Homo sapien
tcttcaacttcatacagtagtcaca

SEQ ID NO: 530141 - DNA, 25 bp, Homo sapien
gttagtaataacactggcattttta

SEQ ID NO: 530142 - DNA, 25 bp, Homo sapien
agcaaataagtagtgatgtaatgtc

SEQ ID NO: 530143 - DNA, 25 bp, Homo sapien
ataaactcaagtaaacaccctgtag

SEQ ID NO: 530144 - DNA, 25 bp, Homo sapien
actcaagtaaacaccctgtagtctt

SEQ ID NO: 530145 - DNA, 25 bp, Homo sapien
gtaaacaccctgtagtctttcacat

SEQ ID NO: 530146 - DNA, 25 bp, Homo sapien
taaacaccctgtagtctttcacatg

SEQ ID NO: 530147 - DNA, 25 bp, Homo sapien
aacaccctgtagtctttcacatgaa

SEQ ID NO: 530148 - DNA, 25 bp, Homo sapien
ataacttaatctcttcatgttcagt

SEQ ID NO: 530149 - DNA, 25 bp, Homo sapien
aacttaatctcttcatgttcagttt

SEQ ID NO: 530150 - DNA, 25 bp, Homo sapien
tttacttcactctttattcttttct

SEQ ID NO: 530151 - DNA, 25 bp, Homo sapien
cttttctttgattatggtatgctta

SEQ ID NO: 530152 - DNA, 25 bp, Homo sapien
tgattatggtatgcttatttggaaa

SEQ ID NO: 530153 - DNA, 25 bp, Homo sapien
tgcttatttggaaagtcagtgaaac

SEQ ID NO: 530154 - DNA, 25 bp, Homo sapien
gatcttttagtttcaactcagcttt

SEQ ID NO: 530155 - DNA, 25 bp, Homo sapien
taaacttttggtttgtgaacttcat

SEQ ID NO: 530156 - DNA, 25 bp, Homo sapien
gtgaacttcatatttgatcttttct

SEQ ID NO: 530157 - DNA, 25 bp, Homo sapien
ttctcttccaatcaaatgtctaggc

SEQ ID NO: 530158 - DNA, 25 bp, Homo sapien
atgtctaggcttgtttgacttccac

SEQ ID NO: 530159 - DNA, 25 bp, Homo sapien
atgctttgtttcatgttatgggtga

SEQ ID NO: 530160 - DNA, 25 bp, Homo sapien
atgggtgaggacctacatacactct

SEQ ID NO: 530161 - DNA, 25 bp, Homo sapien
aggacctacatacactcttacttta

SEQ ID NO: 530162 - DNA, 25 bp, Homo sapien
acactcttactttagcagtcactta

SEQ ID NO: 530163 - DNA, 25 bp, Homo sapien
agtcacttaaccttctccagcaagg

SEQ ID NO: 530164 - DNA, 25 bp, Homo sapien
taaccttctccagcaaggcagttgt

SEQ ID NO: 530165 - DNA, 25 bp, Homo sapien
gggttcactaggatttagtgcctga

SEQ ID NO: 530166 - DNA, 25 bp, Homo sapien
ctaggatttagtgcctgatcttttt

SEQ ID NO: 530167 - DNA, 25 bp, Homo sapien
ccacctgcacctagcaaggaacagg

SEQ ID NO: 530168 - DNA, 25 bp, Homo sapien
attttgctcatgactgcagtatgca

SEQ ID NO: 530169 - DNA, 25 bp, Homo sapien
gctcatgactgcagtatgcatgtat

SEQ ID NO: 530170 - DNA, 25 bp, Homo sapien
tctccatctgatctctaacaccagt

SEQ ID NO: 530171 - DNA, 25 bp, Homo sapien
atctgatctctaacaccagttaaaa

SEQ ID NO: 530172 - DNA, 25 bp, Homo sapien
cagttaaaaccaagcttccatactt

SEQ ID NO: 530173 - DNA, 25 bp, Homo sapien
aagcttccatactttttggtctgta

SEQ ID NO: 530174 - DNA, 25 bp, Homo sapien
tttttggtctgtaaagccgcaccct

SEQ ID NO: 530175 - DNA, 25 bp, Homo sapien
ttggtctgtaaagccgcaccctgtc

SEQ ID NO: 530176 - DNA, 25 bp, Homo sapien
gcaccctgtctcgagcttaaggata

SEQ ID NO: 530177 - DNA, 25 bp, Homo sapien
gtctcgagcttaaggatatgtgtgt

SEQ ID NO: 530178 - DNA, 25 bp, Homo sapien
gtgtatgtgcgtgtacagacacaca

SEQ ID NO: 530179 - DNA, 25 bp, Homo sapien
catataaagtggtagtttgctgcaa

SEQ ID NO: 530180 - DNA, 25 bp, Homo sapien
ataaagtggtagtttgctgcaaata

SEQ ID NO: 530181 - DNA, 25 bp, Homo sapien
aatcccaggcagcttgtgtgtacaa

SEQ ID NO: 530182 - DNA, 25 bp, Homo sapien
ttgtgtgtacaatcagcttctctag

SEQ ID NO: 530183 - DNA, 25 bp, Homo sapien
acaatcagcttctctagcaactctg

SEQ ID NO: 530184 - DNA, 25 bp, Homo sapien
agagaatattttgcctccacatatg

SEQ ID NO: 530185 - DNA, 25 bp, Homo sapien
atattttgcctccacatatgtaccc

SEQ ID NO: 530186 - DNA, 25 bp, Homo sapien
agatggatttaaaccaagatgcctc

SEQ ID NO: 530187 - DNA, 25 bp, Homo sapien
agatgcctccaggaaagaggacgaa

SEQ ID NO: 530188 - DNA, 25 bp, Homo sapien
gaggacgaaatgagtatattcacag

SEQ ID NO: 530189 - DNA, 25 bp, Homo sapien
tgagtatattcacagaggaatccaa

SEQ ID NO: 530190 - DNA, 25 bp, Homo sapien
atttttgatgagatgggtgaaggac

SEQ ID NO: 530191 - DNA, 25 bp, Homo sapien
caagaagtgagttgtgtcaattatt

SEQ ID NO: 530192 - DNA, 25 bp, Homo sapien
cagctcctgccggtgagtggccctg

SEQ ID NO: 530193 - DNA, 25 bp, Homo sapien
agctcctgccggtgagtggccctgg

SEQ ID NO: 530194 - DNA, 25 bp, Homo sapien
ggcctggcccgtggcgcatcctcac

SEQ ID NO: 530195 - DNA, 25 bp, Homo sapien
tggcccgtggcgcatcctcactccc

SEQ ID NO: 530196 - DNA, 25 bp, Homo sapien
gcccgtggcgcatcctcactcccag

SEQ ID NO: 530197 - DNA, 25 bp, Homo sapien
cactcccagcctgcgggtaacctgc

SEQ ID NO: 530198 - DNA, 25 bp, Homo sapien
cagcctgcgggtaacctgccgccct

SEQ ID NO: 530199 - DNA, 25 bp, Homo sapien
agcctgcgggtaacctgccgccctc

SEQ ID NO: 530200 - DNA, 25 bp, Homo sapien
gcctgcgggtaacctgccgccctct

SEQ ID NO: 530201 - DNA, 25 bp, Homo sapien
tgcgggtaacctgccgccctctcct

SEQ ID NO: 530202 - DNA, 25 bp, Homo sapien
tctccccacagctacccttcgagga

SEQ ID NO: 530203 - DNA, 25 bp, Homo sapien
ttctctggaagccacaactggtgtc

SEQ ID NO: 530204 - DNA, 25 bp, Homo sapien
aagccacaactggtgtcagggctcg

SEQ ID NO: 530205 - DNA, 25 bp, Homo sapien
acaactggtgtcagggctcggtttg

SEQ ID NO: 530206 - DNA, 25 bp, Homo sapien
gtcagggctcggtttgtgcttagaa

SEQ ID NO: 530207 - DNA, 25 bp, Homo sapien
cagggctcggtttgtgcttagaact

SEQ ID NO: 530208 - DNA, 25 bp, Homo sapien
ggctcggtttgtgcttagaactttc

SEQ ID NO: 530209 - DNA, 25 bp, Homo sapien
ggtttgtgcttagaactttcccagc

SEQ ID NO: 530210 - DNA, 25 bp, Homo sapien
tgcttagaactttcccagcttcatg

SEQ ID NO: 530211 - DNA, 25 bp, Homo sapien
ttagaactttcccagcttcatgacc

SEQ ID NO: 530212 - DNA, 25 bp, Homo sapien
tttcccagcttcatgaccttgagag

SEQ ID NO: 530213 - DNA, 25 bp, Homo sapien
tcccagcttcatgaccttgagagaa

SEQ ID NO: 530214 - DNA, 25 bp, Homo sapien
tactgtttaaggccaaaagtaacag

SEQ ID NO: 530215 - DNA, 25 bp, Homo sapien
ttgtgaacttcatatttgatctttt

SEQ ID NO: 530216 - DNA, 25 bp, Homo sapien
tgtgaacttcatatttgatcttttc

SEQ ID NO: 530217 - DNA, 25 bp, Homo sapien
gtgaacttcatatttgatcttttct

SEQ ID NO: 530218 - DNA, 25 bp, Homo sapien
tgaacttcatatttgatcttttctc

SEQ ID NO: 530219 - DNA, 25 bp, Homo sapien
ttctcttccaatcaaatgtctaggc

SEQ ID NO: 530220 - DNA, 25 bp, Homo sapien
tctcttccaatcaaatgtctaggct

SEQ ID NO: 530221 - DNA, 25 bp, Homo sapien
ctcttccaatcaaatgtctaggctt

SEQ ID NO: 530222 - DNA, 25 bp, Homo sapien
tcttccaatcaaatgtctaggcttg

SEQ ID NO: 530223 - DNA, 25 bp, Homo sapien
ttcctgaggcaaaggccatctccta

SEQ ID NO: 530224 - DNA, 25 bp, Homo sapien
ggccatctcctaatagactggactt

SEQ ID NO: 530225 - DNA, 25 bp, Homo sapien
atctcctaatagactggacttaacc

SEQ ID NO: 530226 - DNA, 25 bp, Homo sapien
tcctaatagactggacttaacccct

SEQ ID NO: 530227 - DNA, 25 bp, Homo sapien
tgtccccagttactctaaccgttat

SEQ ID NO: 530228 - DNA, 25 bp, Homo sapien
tactctaaccgttatttcatttagc

SEQ ID NO: 530229 - DNA, 25 bp, Homo sapien
tttcatttagcttccatatatattt

SEQ ID NO: 530230 - DNA, 25 bp, Homo sapien
ccatatatattttcttacctaagag

SEQ ID NO: 530231 - DNA, 25 bp, Homo sapien
tacctaagagaatagtttcctgctt

SEQ ID NO: 530232 - DNA, 25 bp, Homo sapien
gagaatagtttcctgctttaagcaa

SEQ ID NO: 530233 - DNA, 25 bp, Homo sapien
ctttaagcaaaagacctacaatagg

SEQ ID NO: 530234 - DNA, 25 bp, Homo sapien
gcctttttgctgatggcagaggtgt

SEQ ID NO: 530235 - DNA, 25 bp, Homo sapien
gctgatggcagaggtgtgctcctct

SEQ ID NO: 530236 - DNA, 25 bp, Homo sapien
tcttctttccaagggtacttcctca

SEQ ID NO: 530237 - DNA, 25 bp, Homo sapien
tcaaccctgctacagtccttatcaa

SEQ ID NO: 530238 - DNA, 25 bp, Homo sapien
gtccttatcaacacagcattcattc

SEQ ID NO: 530239 - DNA, 25 bp, Homo sapien
aacacagcattcattctcagggaat

SEQ ID NO: 530240 - DNA, 25 bp, Homo sapien
ggaattgaaagctccaagtcaccct

SEQ ID NO: 530241 - DNA, 25 bp, Homo sapien
agcagacacctcacctaacctggaa

SEQ ID NO: 530242 - DNA, 25 bp, Homo sapien
atcaagctaactacctctgctcttt

SEQ ID NO: 530243 - DNA, 25 bp, Homo sapien
ttttccattgtttcaaaacctcttg

SEQ ID NO: 530244 - DNA, 25 bp, Homo sapien
aaaacctcttgaaatgcagcagaaa

SEQ ID NO: 530245 - DNA, 25 bp, Homo sapien
agccagccatattactctagtccct

SEQ ID NO: 530246 - DNA, 25 bp, Homo sapien
tagtccctaccaaactgctctagaa

SEQ ID NO: 530247 - DNA, 25 bp, Homo sapien
tgctctagaaggtcatttccatttt

SEQ ID NO: 530248 - DNA, 25 bp, Homo sapien
gtttgtgatatttagacgcgcagac

SEQ ID NO: 530249 - DNA, 25 bp, Homo sapien
tttagacgcgcagacttcaggaagt

SEQ ID NO: 530250 - DNA, 25 bp, Homo sapien
tcacctttaacttcagcattccaga

SEQ ID NO: 530251 - DNA, 25 bp, Homo sapien
gatgaagtttcctgactcagtgctt

SEQ ID NO: 530252 - DNA, 25 bp, Homo sapien
gactcagtgcttttgcataaggaac

SEQ ID NO: 530253 - DNA, 25 bp, Homo sapien
aattggagatgctaacatcctcccc

SEQ ID NO: 530254 - DNA, 25 bp, Homo sapien
catcccaactgcaccttaaaatatg

SEQ ID NO: 530255 - DNA, 25 bp, Homo sapien
aaaatatgcatgtcaccttcaaggt

SEQ ID NO: 530256 - DNA, 25 bp, Homo sapien
atcaccgtggagtggcgggctcagt

SEQ ID NO: 530257 - DNA, 25 bp, Homo sapien
ccgtggagtggcgggctcagtctga

SEQ ID NO: 530258 - DNA, 25 bp, Homo sapien
agtggcgggctcagtctgaatctgc

SEQ ID NO: 530259 - DNA, 25 bp, Homo sapien
gtggcgggctcagtctgaatctgcc

SEQ ID NO: 530260 - DNA, 25 bp, Homo sapien
ggcgggctcagtctgaatctgccca

SEQ ID NO: 530261 - DNA, 25 bp, Homo sapien
gcgggctcagtctgaatctgcccag

SEQ ID NO: 530262 - DNA, 25 bp, Homo sapien
cgggctcagtctgaatctgcccaga

SEQ ID NO: 530263 - DNA, 25 bp, Homo sapien
gggctcagtctgaatctgcccagag

SEQ ID NO: 530264 - DNA, 25 bp, Homo sapien
gcactgactcctgagactattttaa

SEQ ID NO: 530265 - DNA, 25 bp, Homo sapien
cactgactcctgagactattttaac

SEQ ID NO: 530266 - DNA, 25 bp, Homo sapien
actgactcctgagactattttaact

SEQ ID NO: 530267 - DNA, 25 bp, Homo sapien
ttttggatacaggatggacatacgt

SEQ ID NO: 530268 - DNA, 25 bp, Homo sapien
ggacatacgtactcaaactgtgttt

SEQ ID NO: 530269 - DNA, 25 bp, Homo sapien
aaactgtgtttttcaatttgtactg

SEQ ID NO: 530270 - DNA, 25 bp, Homo sapien
actgtatttgtttctctcgacctga

SEQ ID NO: 530271 - DNA, 25 bp, Homo sapien
ttctctcgacctgacttagtgatag

SEQ ID NO: 530272 - DNA, 25 bp, Homo sapien
aaagtcttccactagcatggtagat

SEQ ID NO: 530273 - DNA, 25 bp, Homo sapien
ttctgtaattctgtcatttttactt

SEQ ID NO: 530274 - DNA, 25 bp, Homo sapien
atgtgtaatgtaactaggtgcgtag

SEQ ID NO: 530275 - DNA, 25 bp, Homo sapien
gtgcgtagaggtttagatattctcc

SEQ ID NO: 530276 - DNA, 25 bp, Homo sapien
tttattttcagtagggccatacctt

SEQ ID NO: 530277 - DNA, 25 bp, Homo sapien
gggccataccttttcataccaataa

SEQ ID NO: 530278 - DNA, 25 bp, Homo sapien
ttcctgaggcaaaggccatctccta

SEQ ID NO: 530279 - DNA, 25 bp, Homo sapien
tcctgaggcaaaggccatctcctaa

SEQ ID NO: 530280 - DNA, 25 bp, Homo sapien
cctgaggcaaaggccatctcctaat

SEQ ID NO: 530281 - DNA, 25 bp, Homo sapien
gtccccacgaccaactgtccccagt

SEQ ID NO: 530282 - DNA, 25 bp, Homo sapien
tgtccccagttactctaaccgttat

SEQ ID NO: 530283 - DNA, 25 bp, Homo sapien
ccagttactctaaccgttatttcat

SEQ ID NO: 530284 - DNA, 25 bp, Homo sapien
cagttactctaaccgttatttcatt

SEQ ID NO: 530285 - DNA, 25 bp, Homo sapien
ttactctaaccgttatttcatttag

SEQ ID NO: 530286 - DNA, 25 bp, Homo sapien
tactctaaccgttatttcatttagc

SEQ ID NO: 530287 - DNA, 25 bp, Homo sapien
ccatatatattttcttacctaagag

SEQ ID NO: 530288 - DNA, 25 bp, Homo sapien
tatatattttcttacctaagagaat

SEQ ID NO: 530289 - DNA, 25 bp, Homo sapien
atagctcaccaaatttcctggagag

SEQ ID NO: 530290 - DNA, 25 bp, Homo sapien
gagagtctggttcacaggctgtcca

SEQ ID NO: 530291 - DNA, 25 bp, Homo sapien
ggttcacaggctgtccatcccaaag

SEQ ID NO: 530292 - DNA, 25 bp, Homo sapien
catcccaaagctcattgctgcaggg

SEQ ID NO: 530293 - DNA, 25 bp, Homo sapien
aaagctcattgctgcagggttaaaa

SEQ ID NO: 530294 - DNA, 25 bp, Homo sapien
gaggatatagttcagagttcccata

SEQ ID NO: 530295 - DNA, 25 bp, Homo sapien
tagttcagagttcccatatgccatg

SEQ ID NO: 530296 - DNA, 25 bp, Homo sapien
atgccatgcccctattattaatacc

SEQ ID NO: 530297 - DNA, 25 bp, Homo sapien
aattagcgaaccaataccgacgtat

SEQ ID NO: 530298 - DNA, 25 bp, Homo sapien
gaactaaagtccctagattattcgg

SEQ ID NO: 530299 - DNA, 25 bp, Homo sapien
tagattattcggatttccttcgttt

SEQ ID NO: 530300 - DNA, 25 bp, Homo sapien
tagtgtaactcgcatcccattgcag

SEQ ID NO: 530301 - DNA, 25 bp, Homo sapien
tgtgttgctgtctcttagattaacc

SEQ ID NO: 530302 - DNA, 25 bp, Homo sapien
cttagattaaccgtgctgaggctcc

SEQ ID NO: 530303 - DNA, 25 bp, Homo sapien
agagtgaagttgctgtgcccacatt

SEQ ID NO: 530304 - DNA, 25 bp, Homo sapien
tgcccacattgtttgaactcgcgta

SEQ ID NO: 530305 - DNA, 25 bp, Homo sapien
tcgcgtaccccgtagatacattgtg

SEQ ID NO: 530306 - DNA, 25 bp, Homo sapien
gatacattgtgcaacgttcttctgt

SEQ ID NO: 530307 - DNA, 25 bp, Homo sapien
aacgttcttctgttattcccttgag

SEQ ID NO: 530308 - DNA, 25 bp, Homo sapien
ttcccttgaggtggtaacttcgtat

SEQ ID NO: 530309 - DNA, 25 bp, Homo sapien
aacttcgtatgttcagtttatgcga

SEQ ID NO: 530310 - DNA, 25 bp, Homo sapien
aatgcaatgccgtagtttggattaa

SEQ ID NO: 530311 - DNA, 25 bp, Homo sapien
tccccttagagtgctgtgagatgag

SEQ ID NO: 530312 - DNA, 25 bp, Homo sapien
agaagggatcctaatcccttcctct

SEQ ID NO: 530313 - DNA, 25 bp, Homo sapien
ctcccattcaccctgtgtaacagga

SEQ ID NO: 530314 - DNA, 25 bp, Homo sapien
ttcaccctgtgtaacaggaccccaa

SEQ ID NO: 530315 - DNA, 25 bp, Homo sapien
ggaagtgccttaacctagagggtcg

SEQ ID NO: 530316 - DNA, 25 bp, Homo sapien
ggaggttgtgtcactgactcaggct

SEQ ID NO: 530317 - DNA, 25 bp, Homo sapien
actcaggctgctccttctctagttt

SEQ ID NO: 530318 - DNA, 25 bp, Homo sapien
tagtttcccctctcatctgacctta

SEQ ID NO: 530319 - DNA, 25 bp, Homo sapien
tcatctgaccttagtttgctgccat

SEQ ID NO: 530320 - DNA, 25 bp, Homo sapien
tttgctgccatcagtctagtggttt

SEQ ID NO: 530321 - DNA, 25 bp, Homo sapien
ccatcagtctagtggtttcgtggtt

SEQ ID NO: 530322 - DNA, 25 bp, Homo sapien
aaaccctgcaccaagttgaacctgt

SEQ ID NO: 530323 - DNA, 25 bp, Homo sapien
agttgaacctgtcctttgtgatgag

SEQ ID NO: 530324 - DNA, 25 bp, Homo sapien
gaagagcagcgtagcagtctgtcta

SEQ ID NO: 530325 - DNA, 25 bp, Homo sapien
attcagctaaatgccaactccgatc

SEQ ID NO: 530326 - DNA, 25 bp, Homo sapien
actccgatccctttgagatggtgaa

SEQ ID NO: 530327 - DNA, 25 bp, Homo sapien
tgaacaggctgaacccagggatcgt

SEQ ID NO: 530328 - DNA, 25 bp, Homo sapien
cagggatcgtgtcatccctcagtat

SEQ ID NO: 530329 - DNA, 25 bp, Homo sapien
tcagtatccagacttcttcagagaa

SEQ ID NO: 530330 - DNA, 25 bp, Homo sapien
gaaccatgtggtgaaacttcttgat

SEQ ID NO: 530331 - DNA, 25 bp, Homo sapien
ggttacaggctctatatctgctttc

SEQ ID NO: 530332 - DNA, 25 bp, Homo sapien
gtaggattctattctgacaagcaca

SEQ ID NO: 530333 - DNA, 25 bp, Homo sapien
actcttgcatcactaattgcacaag

SEQ ID NO: 530334 - DNA, 25 bp, Homo sapien
aagtgatttcaggtgcaattctgat

SEQ ID NO: 530335 - DNA, 25 bp, Homo sapien
tgcaattctgattagcctgcgtcca

SEQ ID NO: 530336 - DNA, 25 bp, Homo sapien
cctgcgtccacacagtgatcgatga

SEQ ID NO: 530337 - DNA, 25 bp, Homo sapien
gatcgatgatcctatgtgcctagaa

SEQ ID NO: 530338 - DNA, 25 bp, Homo sapien
ctatgtgcctagaaaggacactgtg

SEQ ID NO: 530339 - DNA, 25 bp, Homo sapien
tgtgtgctgctcatgacctgcaaca

SEQ ID NO: 530340 - DNA, 25 bp, Homo sapien
tgctgctcatgacctgcaacaggaa

SEQ ID NO: 530341 - DNA, 25 bp, Homo sapien
aagccatttcttgttagcagtgtaa

SEQ ID NO: 530342 - DNA, 25 bp, Homo sapien
agcagtgtaagaaccttagagcaaa

SEQ ID NO: 530343 - DNA, 25 bp, Homo sapien
aggagttgaccttctgattgaatat

SEQ ID NO: 530344 - DNA, 25 bp, Homo sapien
ccttggcactgatgggcactggaaa

SEQ ID NO: 530345 - DNA, 25 bp, Homo sapien
agacctgagatgctggtcaagcccc

SEQ ID NO: 530346 - DNA, 25 bp, Homo sapien
ttgagttcatcatgagccgttgcta

SEQ ID NO: 530347 - DNA, 25 bp, Homo sapien
gccgttgctaatgccaggccagtaa

SEQ ID NO: 530348 - DNA, 25 bp, Homo sapien
aatctggacttatttttggacttag

SEQ ID NO: 530349 - DNA, 25 bp, Homo sapien
cttcagcagctagagctcagtatac

SEQ ID NO: 530350 - DNA, 25 bp, Homo sapien
gctcagtatactaatgccctatctt

SEQ ID NO: 530351 - DNA, 25 bp, Homo sapien
tttagtggtggtgtctcactctttc

SEQ ID NO: 530352 - DNA, 25 bp, Homo sapien
ttctctctttgtcccggataggcta

SEQ ID NO: 530353 - DNA, 25 bp, Homo sapien
gtcccggataggctaatcaataccc

SEQ ID NO: 530354 - DNA, 25 bp, Homo sapien
atcaatacccttggcactgatgggc

SEQ ID NO: 530355 - DNA, 25 bp, Homo sapien
catcacagaacttcactgattatca

SEQ ID NO: 530356 - DNA, 25 bp, Homo sapien
tatcatcatttagccagtcttgaag

SEQ ID NO: 530357 - DNA, 25 bp, Homo sapien
gaagcaagtgctaattacaatcaca

SEQ ID NO: 530358 - DNA, 25 bp, Homo sapien
agacttcatgaagagcactgcgcta

SEQ ID NO: 530359 - DNA, 25 bp, Homo sapien
gagcactgcgctataataaaagaag

SEQ ID NO: 530360 - DNA, 25 bp, Homo sapien
gagcacatacattcttttactgaca

SEQ ID NO: 530361 - DNA, 25 bp, Homo sapien
ttactgacagtcaaatggtgaaggt

SEQ ID NO: 530362 - DNA, 25 bp, Homo sapien
aaggtgggcagaatcattatgtgat

SEQ ID NO: 530363 - DNA, 25 bp, Homo sapien
atcattatgtgatgcaacatggcaa

SEQ ID NO: 530364 - DNA, 25 bp, Homo sapien
aaaagtatacagacagtgcatccag

SEQ ID NO: 530365 - DNA, 25 bp, Homo sapien
tacagacagtgcatccagaggaagg

SEQ ID NO: 530366 - DNA, 25 bp, Homo sapien
aggagggcaaaggtcccaatgctcg

SEQ ID NO: 530367 - DNA, 25 bp, Homo sapien
tcccaatgctcggaggaagcccaag

SEQ ID NO: 530368 - DNA, 25 bp, Homo sapien
aagggcagccctcgtgtacctgatg

SEQ ID NO: 530369 - DNA, 25 bp, Homo sapien
cgtgtacctgatgccaagaagccta

SEQ ID NO: 530370 - DNA, 25 bp, Homo sapien
aagaaagtagctcccctgaaaatca

SEQ ID NO: 530371 - DNA, 25 bp, Homo sapien
ttggttccaagcgtaagagatcctc

SEQ ID NO: 530372 - DNA, 25 bp, Homo sapien
aatctgacttcgatgatgccagtat

SEQ ID NO: 530373 - DNA, 25 bp, Homo sapien
gccagtatcaatagctattctgttt

SEQ ID NO: 530374 - DNA, 25 bp, Homo sapien
tattctgtttctgatggttccacca

SEQ ID NO: 530375 - DNA, 25 bp, Homo sapien
atggttccaccagccgtagtagccg

SEQ ID NO: 530376 - DNA, 25 bp, Homo sapien
tggaggtgcctatccgcaaggccaa

SEQ ID NO: 530377 - DNA, 25 bp, Homo sapien
actttcgaagtaggccctggcaggc

SEQ ID NO: 530378 - DNA, 25 bp, Homo sapien
ctgggagccatcctgaagagctgta

SEQ ID NO: 530379 - DNA, 25 bp, Homo sapien
gccatcctgaagagctgtaacatgc

SEQ ID NO: 530380 - DNA, 25 bp, Homo sapien
aggcctggaagtcctacagcgccgt

SEQ ID NO: 530381 - DNA, 25 bp, Homo sapien
tacagcgccgtggatgtgctgcaga

SEQ ID NO: 530382 - DNA, 25 bp, Homo sapien
tgctgcagaccctcgaacatgtgga

SEQ ID NO: 530383 - DNA, 25 bp, Homo sapien
cgaacatgtggacctggaccctcag

SEQ ID NO: 530384 - DNA, 25 bp, Homo sapien
tctgtcctcctgaggagaggctgta

SEQ ID NO: 530385 - DNA, 25 bp, Homo sapien
aggctgtaggctgtgcctgtcgccc

SEQ ID NO: 530386 - DNA, 25 bp, Homo sapien
aagggatttgtttgcaacgtgcttt

SEQ ID NO: 530387 - DNA, 25 bp, Homo sapien
gcaacgtgctttgaaggccacataa

SEQ ID NO: 530388 - DNA, 25 bp, Homo sapien
tattagagaatattggatggatcct

SEQ ID NO: 530389 - DNA, 25 bp, Homo sapien
tattggatggatcctgaaggtgaaa

SEQ ID NO: 530390 - DNA, 25 bp, Homo sapien
ggtatttctttaaatccagaacaat

SEQ ID NO: 530391 - DNA, 25 bp, Homo sapien
ctttaaatccagaacaatggagcca

SEQ ID NO: 530392 - DNA, 25 bp, Homo sapien
aaatgaggtacgttagtgttcgcga

SEQ ID NO: 530393 - DNA, 25 bp, Homo sapien
gaggtacgttagtgttcgcgatttt

SEQ ID NO: 530394 - DNA, 25 bp, Homo sapien
tacgttagtgttcgcgattttaaag

SEQ ID NO: 530395 - DNA, 25 bp, Homo sapien
gttagtgttcgcgattttaaaggca

SEQ ID NO: 530396 - DNA, 25 bp, Homo sapien
gtgttcgcgattttaaaggcaaagt

SEQ ID NO: 530397 - DNA, 25 bp, Homo sapien
cgcgattttaaaggcaaagtgctaa

SEQ ID NO: 530398 - DNA, 25 bp, Homo sapien
aaaggcaaagtgctaattgatatta

SEQ ID NO: 530399 - DNA, 25 bp, Homo sapien
aactgtaagccctcgcgttctggga

SEQ ID NO: 530400 - DNA, 25 bp, Homo sapien
aagccctcgcgttctgggaatcgct

SEQ ID NO: 530401 - DNA, 25 bp, Homo sapien
tgggaatcgctctctgctgctcttt

SEQ ID NO: 530402 - DNA, 25 bp, Homo sapien
tgctgctctttcctggaagctaagc

SEQ ID NO: 530403 - DNA, 25 bp, Homo sapien
ttcctggaagctaagcctgtctcca

SEQ ID NO: 530404 - DNA, 25 bp, Homo sapien
tggaagctaagcctgtctccaccgc

SEQ ID NO: 530405 - DNA, 25 bp, Homo sapien
cgccgcagttgcgtttgctttggac

SEQ ID NO: 530406 - DNA, 25 bp, Homo sapien
agttgcgtttgctttggaccttgcg

SEQ ID NO: 530407 - DNA, 25 bp, Homo sapien
cgtttgctttggaccttgcgtgcgg

SEQ ID NO: 530408 - DNA, 25 bp, Homo sapien
gctcctttctgtacacctagcgctg

SEQ ID NO: 530409 - DNA, 25 bp, Homo sapien
gccccgcttgtgtctgaggtcgtgt

SEQ ID NO: 530410 - DNA, 25 bp, Homo sapien
gatgtggacctctactttccaggct

SEQ ID NO: 530411 - DNA, 25 bp, Homo sapien
gtggacctctactttccaggctagt

SEQ ID NO: 530412 - DNA, 25 bp, Homo sapien
tactttccaggctagtccggaccca

SEQ ID NO: 530413 - DNA, 25 bp, Homo sapien
cagctccccaagtggtttccacatg

SEQ ID NO: 530414 - DNA, 25 bp, Homo sapien
aagtggtttccacatgctctgagaa

SEQ ID NO: 530415 - DNA, 25 bp, Homo sapien
tggtttccacatgctctgagaagag

SEQ ID NO: 530416 - DNA, 25 bp, Homo sapien
ctgagaagaggagccctcatcttga

SEQ ID NO: 530417 - DNA, 25 bp, Homo sapien
gagaggaactccttggcctagccca

SEQ ID NO: 530418 - DNA, 25 bp, Homo sapien
tgcaatgtatcccttctcacagcac

SEQ ID NO: 530419 - DNA, 25 bp, Homo sapien
aatgtatcccttctcacagcacatg

SEQ ID NO: 530420 - DNA, 25 bp, Homo sapien
tatcccttctcacagcacatgctgg

SEQ ID NO: 530421 - DNA, 25 bp, Homo sapien
attcttggttatcagaatactcata

SEQ ID NO: 530422 - DNA, 25 bp, Homo sapien
ttggttatcagaatactcatatagc

SEQ ID NO: 530423 - DNA, 25 bp, Homo sapien
ggttatcagaatactcatatagctt

SEQ ID NO: 530424 - DNA, 25 bp, Homo sapien
ttatcagaatactcatatagctttg

SEQ ID NO: 530425 - DNA, 25 bp, Homo sapien
atcagaatactcatatagctttggg

SEQ ID NO: 530426 - DNA, 25 bp, Homo sapien
tcagaatactcatatagctttggga

SEQ ID NO: 530427 - DNA, 25 bp, Homo sapien
cagaatactcatatagctttgggat

SEQ ID NO: 530428 - DNA, 25 bp, Homo sapien
agaatactcatatagctttgggatt

SEQ ID NO: 530429 - DNA, 25 bp, Homo sapien
gaatactcatatagctttgggattt

SEQ ID NO: 530430 - DNA, 25 bp, Homo sapien
gcctacacacaggatctagaagaat

SEQ ID NO: 530431 - DNA, 25 bp, Homo sapien
tacacacaggatctagaagaatatg

SEQ ID NO: 530432 - DNA, 25 bp, Homo sapien
atcccaggtcttcagctgagctgaa

SEQ ID NO: 530433 - DNA, 25 bp, Homo sapien
tcccaggtcttcagctgagctgaac

SEQ ID NO: 530434 - DNA, 25 bp, Homo sapien
agctgagctgaaccaattgtcaacc

SEQ ID NO: 530435 - DNA, 25 bp, Homo sapien
tacctacagcctggaagcacccacc

SEQ ID NO: 530436 - DNA, 25 bp, Homo sapien
ccgctgcttcgagttgtcctgcctt

SEQ ID NO: 530437 - DNA, 25 bp, Homo sapien
gttgtcctgcctttctgaactcaac

SEQ ID NO: 530438 - DNA, 25 bp, Homo sapien
tgtcctgcctttctgaactcaacca

SEQ ID NO: 530439 - DNA, 25 bp, Homo sapien
gtcctgcctttctgaactcaaccaa

SEQ ID NO: 530440 - DNA, 25 bp, Homo sapien
gattgatgcctcagtcctccctaaa

SEQ ID NO: 530441 - DNA, 25 bp, Homo sapien
ttgatgcctcagtcctccctaaaat

SEQ ID NO: 530442 - DNA, 25 bp, Homo sapien
atgcctcagtcctccctaaaatgta

SEQ ID NO: 530443 - DNA, 25 bp, Homo sapien
gcagcatttttttcactctccttag

SEQ ID NO: 530444 - DNA, 25 bp, Homo sapien
ttttcactctccttagaattggaac

SEQ ID NO: 530445 - DNA, 25 bp, Homo sapien
tctccttagaattggaactatgcag

SEQ ID NO: 530446 - DNA, 25 bp, Homo sapien
ggaactatgcagttaaggcagataa

SEQ ID NO: 530447 - DNA, 25 bp, Homo sapien
atttcctatataaaactgatttggg

SEQ ID NO: 530448 - DNA, 25 bp, Homo sapien
aaagatgcaagataggactttgtgc

SEQ ID NO: 530449 - DNA, 25 bp, Homo sapien
taggactttgtgcaatgtatttttg

SEQ ID NO: 530450 - DNA, 25 bp, Homo sapien
aaatatctgtctttggtagtgcttc

SEQ ID NO: 530451 - DNA, 25 bp, Homo sapien
tatctgtctttggtagtgcttctgc

SEQ ID NO: 530452 - DNA, 25 bp, Homo sapien
tctttggtagtgcttctgctgctgc

SEQ ID NO: 530453 - DNA, 25 bp, Homo sapien
ctgctgccaccaaattgataagatg

SEQ ID NO: 530454 - DNA, 25 bp, Homo sapien
aagattggtctgaccatgctctctg

SEQ ID NO: 530455 - DNA, 25 bp, Homo sapien
ctgaccatgctctctggtgggaaaa

SEQ ID NO: 530456 - DNA, 25 bp, Homo sapien
ccatgctctctggtgggaaaagaag

SEQ ID NO: 530457 - DNA, 25 bp, Homo sapien
aagtatggtattcaggcagatgcta

SEQ ID NO: 530458 - DNA, 25 bp, Homo sapien
gtattcaggcagatgctaagcttca

SEQ ID NO: 530459 - DNA, 25 bp, Homo sapien
agatgctaagcttcagttcacccct

SEQ ID NO: 530460 - DNA, 25 bp, Homo sapien
cagcttcccaacatgaagtatgtga

SEQ ID NO: 530461 - DNA, 25 bp, Homo sapien
gaaggtgaaagtgaatttctctgat

SEQ ID NO: 530462 - DNA, 25 bp, Homo sapien
tctctgatagagtcttcaaagctgt

SEQ ID NO: 530463 - DNA, 25 bp, Homo sapien
gacttttaatatcagacaccccgaa

SEQ ID NO: 530464 - DNA, 25 bp, Homo sapien
taatatcagacaccccgaagaactt

SEQ ID NO: 530465 - DNA, 25 bp, Homo sapien
caattctcaggaatgttgcagagtg

SEQ ID NO: 530466 - DNA, 25 bp, Homo sapien
ttgtccaatccatgagaatttacat

SEQ ID NO: 530467 - DNA, 25 bp, Homo sapien
tgagaatttacatccttattaggtg

SEQ ID NO: 530468 - DNA, 25 bp, Homo sapien
gaaccagacattgctgatctattat

SEQ ID NO: 530469 - DNA, 25 bp, Homo sapien
ctattatagaaactctcctcctgcc

SEQ ID NO: 530470 - DNA, 25 bp, Homo sapien
tcctcctgccccttaatttacagaa

SEQ ID NO: 530471 - DNA, 25 bp, Homo sapien
gaaagaataaagcaggatccataga

SEQ ID NO: 530472 - DNA, 25 bp, Homo sapien
ggaaaacgatgaacctgcaggaaag

SEQ ID NO: 530473 - DNA, 25 bp, Homo sapien
tttcctaaattagtgatcccttcaa

SEQ ID NO: 530474 - DNA, 25 bp, Homo sapien
ctaaattagtgatcccttcaaaggg

SEQ ID NO: 530475 - DNA, 25 bp, Homo sapien
ggctgatctggccaaagtattcaat

SEQ ID NO: 530476 - DNA, 25 bp, Homo sapien
ttggatgaaggtaaacgatgcttgg

SEQ ID NO: 530477 - DNA, 25 bp, Homo sapien
aaacgatgcttggaattggaaactg

SEQ ID NO: 530478 - DNA, 25 bp, Homo sapien
gcttggaattggaaactgagactta

SEQ ID NO: 530479 - DNA, 25 bp, Homo sapien
acttatagagggattattacattat

SEQ ID NO: 530480 - DNA, 25 bp, Homo sapien
gaaaccacagagaaacttgtgtctt

SEQ ID NO: 530481 - DNA, 25 bp, Homo sapien
gagaaacttgtgtcttcctgctctc

SEQ ID NO: 530482 - DNA, 25 bp, Homo sapien
gctgcctggcagttattaacctaaa

SEQ ID NO: 530483 - DNA, 25 bp, Homo sapien
attaacctaaacagatagccacaag

SEQ ID NO: 530484 - DNA, 25 bp, Homo sapien
gatagccacaagaggttgggacaga

SEQ ID NO: 530485 - DNA, 25 bp, Homo sapien
ggctcagaaggaggttcaacctctg

SEQ ID NO: 530486 - DNA, 25 bp, Homo sapien
ggaggttcaacctctgactcacctg

SEQ ID NO: 530487 - DNA, 25 bp, Homo sapien
gccttccccgggtggacgacgtgct

SEQ ID NO: 530488 - DNA, 25 bp, Homo sapien
ttccccgggtggacgacgtgcttgc

SEQ ID NO: 530489 - DNA, 25 bp, Homo sapien
tggacgacgtgcttgcgtccctgca

SEQ ID NO: 530490 - DNA, 25 bp, Homo sapien
gacgtgcttgcgtccctgcaggtct

SEQ ID NO: 530491 - DNA, 25 bp, Homo sapien
tgcaggtctcttcgcacaagtgtaa

SEQ ID NO: 530492 - DNA, 25 bp, Homo sapien
caggtctcttcgcacaagtgtaaag

SEQ ID NO: 530493 - DNA, 25 bp, Homo sapien
ggtctcttcgcacaagtgtaaagtg

SEQ ID NO: 530494 - DNA, 25 bp, Homo sapien
cttcgcacaagtgtaaagtgatgta

SEQ ID NO: 530495 - DNA, 25 bp, Homo sapien
gtaaagtgatgtactacaccgaggt

SEQ ID NO: 530496 - DNA, 25 bp, Homo sapien
agtgatgtactacaccgaggtgatc

SEQ ID NO: 530497 - DNA, 25 bp, Homo sapien
atgtactacaccgaggtgatcggct

SEQ ID NO: 530498 - DNA, 25 bp, Homo sapien
gatactgctatttctcttcagggaa

SEQ ID NO: 530499 - DNA, 25 bp, Homo sapien
taaagaaatgtaactgccgggcagc

SEQ ID NO: 530500 - DNA, 25 bp, Homo sapien
aactgccgggcagcaaagcttctaa

SEQ ID NO: 530501 - DNA, 25 bp, Homo sapien
aagcttctaagtgaaacctgtagta

SEQ ID NO: 530502 - DNA, 25 bp, Homo sapien
gaaaatgtgtagtcatcaagtgaaa

SEQ ID NO: 530503 - DNA, 25 bp, Homo sapien
ggatctatgatttatgatgtcttaa

SEQ ID NO: 530504 - DNA, 25 bp, Homo sapien
tgtcttaatagaccctaaattgttc

SEQ ID NO: 530505 - DNA, 25 bp, Homo sapien
caagagtggcagtctctgaagtcat

SEQ ID NO: 530506 - DNA, 25 bp, Homo sapien
gtctctgaagtcatttgtgagcttg

SEQ ID NO: 530507 - DNA, 25 bp, Homo sapien
gacttttgtatttagcaatgttgca

SEQ ID NO: 530508 - DNA, 25 bp, Homo sapien
tagcaatgttgcatgctcacataat

SEQ ID NO: 530509 - DNA, 25 bp, Homo sapien
agcggcgcagggagcggtggcccgg

SEQ ID NO: 530510 - DNA, 25 bp, Homo sapien
atgagcagcgaggccgagacccagc

SEQ ID NO: 530511 - DNA, 25 bp, Homo sapien
agcagcgaggccgagacccagcagc

SEQ ID NO: 530512 - DNA, 25 bp, Homo sapien
acaagaaggtcatcggtgaggaccg

SEQ ID NO: 530513 - DNA, 25 bp, Homo sapien
agaaggtcatcggtgaggaccgaca

SEQ ID NO: 530514 - DNA, 25 bp, Homo sapien
aaggtcatcggtgaggaccgacagg

SEQ ID NO: 530515 - DNA, 25 bp, Homo sapien
gtcatcggtgaggaccgacagggac

SEQ ID NO: 530516 - DNA, 25 bp, Homo sapien
catcggtgaggaccgacagggacgg

SEQ ID NO: 530517 - DNA, 25 bp, Homo sapien
agcgccgccgacaccaagcccggca

SEQ ID NO: 530518 - DNA, 25 bp, Homo sapien
aagcccggcactacgggcagcggcg

SEQ ID NO: 530519 - DNA, 25 bp, Homo sapien
ggcactacgggcagcggcgcaggga

SEQ ID NO: 530520 - DNA, 25 bp, Homo sapien
tcttccagcagttgagttctagggc

SEQ ID NO: 530521 - DNA, 25 bp, Homo sapien
cttccagcagttgagttctagggca

SEQ ID NO: 530522 - DNA, 25 bp, Homo sapien
ttccagcagttgagttctagggcag

SEQ ID NO: 530523 - DNA, 25 bp, Homo sapien
tccagcagttgagttctagggcagg

SEQ ID NO: 530524 - DNA, 25 bp, Homo sapien
ccagcagttgagttctagggcaggg

SEQ ID NO: 530525 - DNA, 25 bp, Homo sapien
cagcagttgagttctagggcaggga

SEQ ID NO: 530526 - DNA, 25 bp, Homo sapien
agcagttgagttctagggcagggag

SEQ ID NO: 530527 - DNA, 25 bp, Homo sapien
gcagttgagttctagggcagggaga

SEQ ID NO: 530528 - DNA, 25 bp, Homo sapien
cagttgagttctagggcagggagac

SEQ ID NO: 530529 - DNA, 25 bp, Homo sapien
agttgagttctagggcagggagaca

SEQ ID NO: 530530 - DNA, 25 bp, Homo sapien
gttgagttctagggcagggagacag

SEQ ID NO: 530531 - DNA, 25 bp, Homo sapien
cgcagggagcggtggcccgggcggc

SEQ ID NO: 530532 - DNA, 25 bp, Homo sapien
tcagcgccgccgacaccaagcccgg

SEQ ID NO: 530533 - DNA, 25 bp, Homo sapien
cagcgccgccgacaccaagcccggc

SEQ ID NO: 530534 - DNA, 25 bp, Homo sapien
agcgccgccgacaccaagcccggca

SEQ ID NO: 530535 - DNA, 25 bp, Homo sapien
gcgccgccgacaccaagcccggcac

SEQ ID NO: 530536 - DNA, 25 bp, Homo sapien
cgccgccgacaccaagcccggcact

SEQ ID NO: 530537 - DNA, 25 bp, Homo sapien
gccgccgacaccaagcccggcacta

SEQ ID NO: 530538 - DNA, 25 bp, Homo sapien
ccgccgacaccaagcccggcactac

SEQ ID NO: 530539 - DNA, 25 bp, Homo sapien
tttccaatgtagtctatgaggttca

SEQ ID NO: 530540 - DNA, 25 bp, Homo sapien
gggtttacaaggacacgagtgcaac

SEQ ID NO: 530541 - DNA, 25 bp, Homo sapien
ggacacgagtgcaacactctttata

SEQ ID NO: 530542 - DNA, 25 bp, Homo sapien
gacaggaaatagaccttgagctcta

SEQ ID NO: 530543 - DNA, 25 bp, Homo sapien
ttgagctctaaacctttgcctgacc

SEQ ID NO: 530544 - DNA, 25 bp, Homo sapien
tctgtgggcctgtgtttctggacaa

SEQ ID NO: 530545 - DNA, 25 bp, Homo sapien
gggaggtttacagccagtatgagca

SEQ ID NO: 530546 - DNA, 25 bp, Homo sapien
tacagccagtatgagcagagcagac

SEQ ID NO: 530547 - DNA, 25 bp, Homo sapien
agagcagactgggagcacctcaatc

SEQ ID NO: 530548 - DNA, 25 bp, Homo sapien
ctatgtgtgtggctagaaggcattt

SEQ ID NO: 530549 - DNA, 25 bp, Homo sapien
atttgttataatcctgatccctttt

SEQ ID NO: 530550 - DNA, 25 bp, Homo sapien
tgttcaacgttaagaatacctatat

SEQ ID NO: 530551 - DNA, 25 bp, Homo sapien
cctatattccttttgtagatgagta

SEQ ID NO: 530552 - DNA, 25 bp, Homo sapien
ccttttgtagatgagtatgattttg

SEQ ID NO: 530553 - DNA, 25 bp, Homo sapien
agttcagggtcgcttaaggagtcac

SEQ ID NO: 530554 - DNA, 25 bp, Homo sapien
gttcagggtcgcttaaggagtcacc

SEQ ID NO: 530555 - DNA, 25 bp, Homo sapien
tacagaggcaagattttaggagttt

SEQ ID NO: 530556 - DNA, 25 bp, Homo sapien
gtttgaattggttcttgtttgttct

SEQ ID NO: 530557 - DNA, 25 bp, Homo sapien
tattcattcaaattttttgcagtgt

SEQ ID NO: 530558 - DNA, 25 bp, Homo sapien
aattttttgcagtgttaatctgtaa

SEQ ID NO: 530559 - DNA, 25 bp, Homo sapien
caacagtaactgagagaaacgaatt

SEQ ID NO: 530560 - DNA, 25 bp, Homo sapien
gagagaaacgaattcattttgtaaa

SEQ ID NO: 530561 - DNA, 25 bp, Homo sapien
tttcccaagaatttacagagttgct

SEQ ID NO: 530562 - DNA, 25 bp, Homo sapien
aaaagttatgattcatccagatcca

SEQ ID NO: 530563 - DNA, 25 bp, Homo sapien
agagaagaccttcagcaatggcact

SEQ ID NO: 530564 - DNA, 25 bp, Homo sapien
gcaatggcactggtaaagcattcag

SEQ ID NO: 530565 - DNA, 25 bp, Homo sapien
aagcattcagtattgctgtccgctt

SEQ ID NO: 530566 - DNA, 25 bp, Homo sapien
attgctgtccgcttctagaaagagt

SEQ ID NO: 530567 - DNA, 25 bp, Homo sapien
aagcacagatggcaaaagctgcagc

SEQ ID NO: 530568 - DNA, 25 bp, Homo sapien
tgaggaaagagcactcttcactgac

SEQ ID NO: 530569 - DNA, 25 bp, Homo sapien
ttcactgaccggatggccactaggt

SEQ ID NO: 530570 - DNA, 25 bp, Homo sapien
aggtccaccacccagagtaatagaa

SEQ ID NO: 530571 - DNA, 25 bp, Homo sapien
atagaacatctcgacttattggaaa

SEQ ID NO: 530572 - DNA, 25 bp, Homo sapien
ggctggccacccaggtattggcaaa

SEQ ID NO: 530573 - DNA, 25 bp, Homo sapien
gtattggcaaaagtgactgtcgggc

SEQ ID NO: 530574 - DNA, 25 bp, Homo sapien
tggagcactcacgatgcggtccggc

SEQ ID NO: 530575 - DNA, 25 bp, Homo sapien
ggcgtgctccggatgaagcacttga

SEQ ID NO: 530576 - DNA, 25 bp, Homo sapien
ggatgaagcacttgatctggccctt

SEQ ID NO: 530577 - DNA, 25 bp, Homo sapien
gaagcacttgatctggcccttctcg

SEQ ID NO: 530578 - DNA, 25 bp, Homo sapien
cccttctcgccgtggagggcgtgct

SEQ ID NO: 530579 - DNA, 25 bp, Homo sapien
aaaggcctgcaattgtgtcttcacg

SEQ ID NO: 530580 - DNA, 25 bp, Homo sapien
gtgtcttcacgatgcttttccaaga

SEQ ID NO: 530581 - DNA, 25 bp, Homo sapien
ccaagacagccaaggcaggtataat

SEQ ID NO: 530582 - DNA, 25 bp, Homo sapien
gtataattttcctcagcaagaaaga

SEQ ID NO: 530583 - DNA, 25 bp, Homo sapien
aacttccagagggagtcttcaacac

SEQ ID NO: 530584 - DNA, 25 bp, Homo sapien
ttccagagggagtcttcaacacagg

SEQ ID NO: 530585 - DNA, 25 bp, Homo sapien
acacaggccccgtgctcgtaggaat

SEQ ID NO: 530586 - DNA, 25 bp, Homo sapien
ggtagcacctatgtaggaagtgcgt

SEQ ID NO: 530587 - DNA, 25 bp, Homo sapien
cctatgtaggaagtgcgtggagttt

SEQ ID NO: 530588 - DNA, 25 bp, Homo sapien
gatgccaaacatccagaatgtgatg

SEQ ID NO: 530589 - DNA, 25 bp, Homo sapien
agaggtccggccaggtctccttgtc

SEQ ID NO: 530590 - DNA, 25 bp, Homo sapien
agctccctccactggttagcagtgt

SEQ ID NO: 530591 - DNA, 25 bp, Homo sapien
ggttagcagtgtgttgtgttttcca

SEQ ID NO: 530592 - DNA, 25 bp, Homo sapien
tgttgtgttttccattcatttcaga

SEQ ID NO: 530593 - DNA, 25 bp, Homo sapien
gtgttttccattcatttcagaagag

SEQ ID NO: 530594 - DNA, 25 bp, Homo sapien
agcgtgtgttactaggtgatcctcc

SEQ ID NO: 530595 - DNA, 25 bp, Homo sapien
gatcctccaacttcaaataacttca

SEQ ID NO: 530596 - DNA, 25 bp, Homo sapien
aacttcattaggtcaaagaattgtc

SEQ ID NO: 530597 - DNA, 25 bp, Homo sapien
gaattgtccatgaatatcaccacat

SEQ ID NO: 530598 - DNA, 25 bp, Homo sapien
gaatatcaccacatactgtgattgg

SEQ ID NO: 530599 - DNA, 25 bp, Homo sapien
actgtgattggagcatctacttcta

SEQ ID NO: 530600 - DNA, 25 bp, Homo sapien
ggagcatctacttctatcatagtct

SEQ ID NO: 530601 - DNA, 25 bp, Homo sapien
atagtcttctcttgcctcaggatgg

SEQ ID NO: 530602 - DNA, 25 bp, Homo sapien
ttatctttaaggctacttcctcttc

SEQ ID NO: 530603 - DNA, 25 bp, Homo sapien
tatactgaaatagcctctgtccaca

SEQ ID NO: 530604 - DNA, 25 bp, Homo sapien
gaaatagcctctgtccacatagtca

SEQ ID NO: 530605 - DNA, 25 bp, Homo sapien
gtaagtctcagtcctttaaaactca

SEQ ID NO: 530606 - DNA, 25 bp, Homo sapien
gtctcagtcctttaaaactcagaaa

SEQ ID NO: 530607 - DNA, 25 bp, Homo sapien
ttcctttctgtaagtctcagtgtct

SEQ ID NO: 530608 - DNA, 25 bp, Homo sapien
tctgtaagtctcagtgtctgcacta

SEQ ID NO: 530609 - DNA, 25 bp, Homo sapien
gtctcagtgtctgcactatttgtct

SEQ ID NO: 530610 - DNA, 25 bp, Homo sapien
gcactatttgtcttggagacttaaa

SEQ ID NO: 530611 - DNA, 25 bp, Homo sapien
aattatcccttgaaagcataagaag

SEQ ID NO: 530612 - DNA, 25 bp, Homo sapien
gaaagcataagaagtacaccccaaa

SEQ ID NO: 530613 - DNA, 25 bp, Homo sapien
aaaccagctttgtccttcctgtcct

SEQ ID NO: 530614 - DNA, 25 bp, Homo sapien
cctgtcctcttctagtttacatttt

SEQ ID NO: 530615 - DNA, 25 bp, Homo sapien
ataaatttggacttgacgtgagcaa

SEQ ID NO: 530616 - DNA, 25 bp, Homo sapien
gtaaatcttttatcactttctcaaa

SEQ ID NO: 530617 - DNA, 25 bp, Homo sapien
agctggctgacttgccagccacaag

SEQ ID NO: 530618 - DNA, 25 bp, Homo sapien
agctgctcttgcagagttcttacca

SEQ ID NO: 530619 - DNA, 25 bp, Homo sapien
tgcagagttcttaccattcctgtaa

SEQ ID NO: 530620 - DNA, 25 bp, Homo sapien
accattcctgtaaatgttttgactt

SEQ ID NO: 530621 - DNA, 25 bp, Homo sapien
ttgacttgttgcagaaattcctatc

SEQ ID NO: 530622 - DNA, 25 bp, Homo sapien
gaaattcctatctactttattaagc

SEQ ID NO: 530623 - DNA, 25 bp, Homo sapien
aagcagtattgatctgactgtggaa

SEQ ID NO: 530624 - DNA, 25 bp, Homo sapien
gactgtggaaacatcctctcacttg

SEQ ID NO: 530625 - DNA, 25 bp, Homo sapien
aaacatcctctcacttgcattcttt

SEQ ID NO: 530626 - DNA, 25 bp, Homo sapien
agaactgatgttccgattattgtat

SEQ ID NO: 530627 - DNA, 25 bp, Homo sapien
gcaggaaccttctgggctggagcct

SEQ ID NO: 530628 - DNA, 25 bp, Homo sapien
gagcctttttactcgcggcggtgat

SEQ ID NO: 530629 - DNA, 25 bp, Homo sapien
cggcggtgatcttttttgctggaac

SEQ ID NO: 530630 - DNA, 25 bp, Homo sapien
gcagtacccttagtaccaggtgctt

SEQ ID NO: 530631 - DNA, 25 bp, Homo sapien
gaagctttcaggagagctgcctttt

SEQ ID NO: 530632 - DNA, 25 bp, Homo sapien
gagagctgccttttgaagcttctta

SEQ ID NO: 530633 - DNA, 25 bp, Homo sapien
aagcttcttaacttcattcttgatt

SEQ ID NO: 530634 - DNA, 25 bp, Homo sapien
tctttgccttcataactttaaaacg

SEQ ID NO: 530635 - DNA, 25 bp, Homo sapien
aaaatctgtcatcttggctttcctt

SEQ ID NO: 530636 - DNA, 25 bp, Homo sapien
ctttctctggcttcaatcttcttgg

SEQ ID NO: 530637 - DNA, 25 bp, Homo sapien
atcttcttggcccatcgtgtggctg

SEQ ID NO: 530638 - DNA, 25 bp, Homo sapien
ccctgtcgggctttgtgtgaaggca

SEQ ID NO: 530639 - DNA, 25 bp, Homo sapien
attttgggcatgtgggcttcaactc

SEQ ID NO: 530640 - DNA, 25 bp, Homo sapien
caactcctcgacatcactgttcatg

SEQ ID NO: 530641 - DNA, 25 bp, Homo sapien
actgttcatgctggcgagtgaatgc

SEQ ID NO: 530642 - DNA, 25 bp, Homo sapien
gtgctgagtagatgcgcagccccat

SEQ ID NO: 530643 - DNA, 25 bp, Homo sapien
atctgtgcattctcctggatgctta

SEQ ID NO: 530644 - DNA, 25 bp, Homo sapien
tagagggatttctttgctgtaagat

SEQ ID NO: 530645 - DNA, 25 bp, Homo sapien
tgctgtaagatgtctgtttgctgat

SEQ ID NO: 530646 - DNA, 25 bp, Homo sapien
tttgctgatggtctggtctatgttc

SEQ ID NO: 530647 - DNA, 25 bp, Homo sapien
gatggtctggtctatgttccgaatt

SEQ ID NO: 530648 - DNA, 25 bp, Homo sapien
acaaaacctgtcctatgaatgcttt

SEQ ID NO: 530649 - DNA, 25 bp, Homo sapien
cgcctggaccataagttcgatctca

SEQ ID NO: 530650 - DNA, 25 bp, Homo sapien
gcctggaccataagttcgatctcat

SEQ ID NO: 530651 - DNA, 25 bp, Homo sapien
cctggaccataagttcgatctcatg

SEQ ID NO: 530652 - DNA, 25 bp, Homo sapien
ctggaccataagttcgatctcatgt

SEQ ID NO: 530653 - DNA, 25 bp, Homo sapien
ggaccataagttcgatctcatgtat

SEQ ID NO: 530654 - DNA, 25 bp, Homo sapien
gaccataagttcgatctcatgtatg

SEQ ID NO: 530655 - DNA, 25 bp, Homo sapien
ataagttcgatctcatgtatgccaa

SEQ ID NO: 530656 - DNA, 25 bp, Homo sapien
gagttctctgaggcccgcgaggacc

SEQ ID NO: 530657 - DNA, 25 bp, Homo sapien
aggcccgcgaggacctggcagctct

SEQ ID NO: 530658 - DNA, 25 bp, Homo sapien
ttatgaagaggtgggcgtggattcc

SEQ ID NO: 530659 - DNA, 25 bp, Homo sapien
agaggtgggcgtggattccgtggaa

SEQ ID NO: 530660 - DNA, 25 bp, Homo sapien
ttagaaaggtaatctggggccaggc

SEQ ID NO: 530661 - DNA, 25 bp, Homo sapien
tagaaaggtaatctggggccaggcg

SEQ ID NO: 530662 - DNA, 25 bp, Homo sapien
agaaaggtaatctggggccaggcgt

SEQ ID NO: 530663 - DNA, 25 bp, Homo sapien
gaaaggtaatctggggccaggcgtg

SEQ ID NO: 530664 - DNA, 25 bp, Homo sapien
aaaggtaatctggggccaggcgtgg

SEQ ID NO: 530665 - DNA, 25 bp, Homo sapien
aaggtaatctggggccaggcgtggt

SEQ ID NO: 530666 - DNA, 25 bp, Homo sapien
aggtaatctggggccaggcgtggtg

SEQ ID NO: 530667 - DNA, 25 bp, Homo sapien
ccaggcgtggagcacgtgcctgtag

SEQ ID NO: 530668 - DNA, 25 bp, Homo sapien
tgagatttggccactgcactgcact

SEQ ID NO: 530669 - DNA, 25 bp, Homo sapien
gagatttggccactgcactgcactc

SEQ ID NO: 530670 - DNA, 25 bp, Homo sapien
agatttggccactgcactgcactcc

SEQ ID NO: 530671 - DNA, 25 bp, Homo sapien
agccctactcatggggacattcagg

SEQ ID NO: 530672 - DNA, 25 bp, Homo sapien
ggacattcagggacctccaggaagt

SEQ ID NO: 530673 - DNA, 25 bp, Homo sapien
aaagtgggtccattgaggtggccct

SEQ ID NO: 530674 - DNA, 25 bp, Homo sapien
tgggtccattgaggtggccctgctc

SEQ ID NO: 530675 - DNA, 25 bp, Homo sapien
attgaggtggccctgctccatcagc

SEQ ID NO: 530676 - DNA, 25 bp, Homo sapien
ccctacgggacttgtgttcattaca

SEQ ID NO: 530677 - DNA, 25 bp, Homo sapien
acgggacttgtgttcattacagtga

SEQ ID NO: 530678 - DNA, 25 bp, Homo sapien
ggacttgtgttcattacagtgaggg

SEQ ID NO: 530679 - DNA, 25 bp, Homo sapien
cagggagaagggttccaagatcaca

SEQ ID NO: 530680 - DNA, 25 bp, Homo sapien
gagaagggttccaagatcacaaaat

SEQ ID NO: 530681 - DNA, 25 bp, Homo sapien
gggttccaagatcacaaaatgtcaa

SEQ ID NO: 530682 - DNA, 25 bp, Homo sapien
agctccctccactggttagcagtgt

SEQ ID NO: 530683 - DNA, 25 bp, Homo sapien
tccctccactggttagcagtgtgtt

SEQ ID NO: 530684 - DNA, 25 bp, Homo sapien
ggttagcagtgtgttgtgttttcca

SEQ ID NO: 530685 - DNA, 25 bp, Homo sapien
tgttgtgttttccattcatttcaga

SEQ ID NO: 530686 - DNA, 25 bp, Homo sapien
ttgtgttttccattcatttcagaag

SEQ ID NO: 530687 - DNA, 25 bp, Homo sapien
gtgttttccattcatttcagaagag

SEQ ID NO: 530688 - DNA, 25 bp, Homo sapien
tttccattcatttcagaagagctac

SEQ ID NO: 530689 - DNA, 25 bp, Homo sapien
tttcagaagagctacattgtgtcac

SEQ ID NO: 530690 - DNA, 25 bp, Homo sapien
gaagagctacattgtgtcactggac

SEQ ID NO: 530691 - DNA, 25 bp, Homo sapien
agagctacattgtgtcactggacat

SEQ ID NO: 530692 - DNA, 25 bp, Homo sapien
agctacattgtgtcactggacattt

SEQ ID NO: 530693 - DNA, 25 bp, Homo sapien
aaaaatccagtgtagctggccactt

SEQ ID NO: 530694 - DNA, 25 bp, Homo sapien
aaaatccagtgtagctggccactta

SEQ ID NO: 530695 - DNA, 25 bp, Homo sapien
aatccagtgtagctggccacttatc

SEQ ID NO: 530696 - DNA, 25 bp, Homo sapien
tccagtgtagctggccacttatcca

SEQ ID NO: 530697 - DNA, 25 bp, Homo sapien
agtgtagctggccacttatccaggg

SEQ ID NO: 530698 - DNA, 25 bp, Homo sapien
gtgtagctggccacttatccagggc

SEQ ID NO: 530699 - DNA, 25 bp, Homo sapien
gtagctggccacttatccagggctt

SEQ ID NO: 530700 - DNA, 25 bp, Homo sapien
tagctggccacttatccagggcttt

SEQ ID NO: 530701 - DNA, 25 bp, Homo sapien
agctggccacttatccagggctttt

SEQ ID NO: 530702 - DNA, 25 bp, Homo sapien
gctggccacttatccagggcttttt

SEQ ID NO: 530703 - DNA, 25 bp, Homo sapien
gaaagtgtctgctttttttatcctt

SEQ ID NO: 530704 - DNA, 25 bp, Homo sapien
tgattaacagttatgtggtcacatg

SEQ ID NO: 530705 - DNA, 25 bp, Homo sapien
gtcacatgatgtgcatagagatagc

SEQ ID NO: 530706 - DNA, 25 bp, Homo sapien
gtgcatagagatagctacagtgtaa

SEQ ID NO: 530707 - DNA, 25 bp, Homo sapien
taataatttacactattttgtgctc

SEQ ID NO: 530708 - DNA, 25 bp, Homo sapien
atgaaactattttacctgaactaga

SEQ ID NO: 530709 - DNA, 25 bp, Homo sapien
ttttacctgaactagattttatctg

SEQ ID NO: 530710 - DNA, 25 bp, Homo sapien
gtagaatttttgctatgctgtaatt

SEQ ID NO: 530711 - DNA, 25 bp, Homo sapien
tttgctatgctgtaatttgttgtat

SEQ ID NO: 530712 - DNA, 25 bp, Homo sapien
gctgtaatttgttgtatattctggt

SEQ ID NO: 530713 - DNA, 25 bp, Homo sapien
tatttgaggtgagatggctgctctt

SEQ ID NO: 530714 - DNA, 25 bp, Homo sapien
attgtgtctcaacagaaactaaatg

SEQ ID NO: 530715 - DNA, 25 bp, Homo sapien
tcaagctgcctcaaagaatgaatct

SEQ ID NO: 530716 - DNA, 25 bp, Homo sapien
acaatgcagactttggagtatctca

SEQ ID NO: 530717 - DNA, 25 bp, Homo sapien
ggagtatctcattagaaggactgta

SEQ ID NO: 530718 - DNA, 25 bp, Homo sapien
gaatctaatttcagaagagcgcact

SEQ ID NO: 530719 - DNA, 25 bp, Homo sapien
aagagcgcactgtcttctcagtcaa

SEQ ID NO: 530720 - DNA, 25 bp, Homo sapien
tgtcttctcagtcaacaaggttgcc

SEQ ID NO: 530721 - DNA, 25 bp, Homo sapien
aacaaggttgcccagccacagaggg

SEQ ID NO: 530722 - DNA, 25 bp, Homo sapien
ccacagagggtcagagaaaatgtcc

SEQ ID NO: 530723 - DNA, 25 bp, Homo sapien
gaatcctctctcaggcctaactgag

SEQ ID NO: 530724 - DNA, 25 bp, Homo sapien
ggcctaactgagctgtcatatccaa

SEQ ID NO: 530725 - DNA, 25 bp, Homo sapien
agctgtcatatccaattcagactga

SEQ ID NO: 530726 - DNA, 25 bp, Homo sapien
gattaccttaagcaacacatgaaaa

SEQ ID NO: 530727 - DNA, 25 bp, Homo sapien
catgaaaactcatgccccagaaagg

SEQ ID NO: 530728 - DNA, 25 bp, Homo sapien
aagggatgtatgtcgctgtccaaga

SEQ ID NO: 530729 - DNA, 25 bp, Homo sapien
tatgtcgctgtccaagagaaggctg

SEQ ID NO: 530730 - DNA, 25 bp, Homo sapien
ggctgtggaagaacctatacaactg

SEQ ID NO: 530731 - DNA, 25 bp, Homo sapien
tacaactgtgtttaatctccaaagc

SEQ ID NO: 530732 - DNA, 25 bp, Homo sapien
tttaatctccaaagccatatcctct

SEQ ID NO: 530733 - DNA, 25 bp, Homo sapien
catatcctctccttccatgaggaaa

SEQ ID NO: 530734 - DNA, 25 bp, Homo sapien
aaagccgcccttttgtgtgtgaaca

SEQ ID NO: 530735 - DNA, 25 bp, Homo sapien
agtctcactaggcatgctgttgtac

SEQ ID NO: 530736 - DNA, 25 bp, Homo sapien
atgctgttgtacatgatcctgacaa

SEQ ID NO: 530737 - DNA, 25 bp, Homo sapien
gagtatcgccaataagaacatcgcc

SEQ ID NO: 530738 - DNA, 25 bp, Homo sapien
atcgccaataagaacatcgccaacc

SEQ ID NO: 530739 - DNA, 25 bp, Homo sapien
gctgcatgatgctggaccacctcaa

SEQ ID NO: 530740 - DNA, 25 bp, Homo sapien
catgatgctggaccacctcaagctg

SEQ ID NO: 530741 - DNA, 25 bp, Homo sapien
aatgagaatgtgaggttcccctcgc

SEQ ID NO: 530742 - DNA, 25 bp, Homo sapien
gagaatgtgaggttcccctcgcacc

SEQ ID NO: 530743 - DNA, 25 bp, Homo sapien
gaggatggtactggatctggcccca

SEQ ID NO: 530744 - DNA, 25 bp, Homo sapien
atggtactggatctggccccatctt

SEQ ID NO: 530745 - DNA, 25 bp, Homo sapien
atcttctggcccttagctggtgcca

SEQ ID NO: 530746 - DNA, 25 bp, Homo sapien
ttctggcccttagctggtgccactt

SEQ ID NO: 530747 - DNA, 25 bp, Homo sapien
ttagctggtgccacttccctcctgt

SEQ ID NO: 530748 - DNA, 25 bp, Homo sapien
tgcctgtagctgctgtatggtgatt

SEQ ID NO: 530749 - DNA, 25 bp, Homo sapien
ggtgattgcacttggacatcagtcc

SEQ ID NO: 530750 - DNA, 25 bp, Homo sapien
agtccaatgactgcaagtcggcctg

SEQ ID NO: 530751 - DNA, 25 bp, Homo sapien
aagtcggcctggattttcacttgca

SEQ ID NO: 530752 - DNA, 25 bp, Homo sapien
ggattttcacttgcagaggctacag

SEQ ID NO: 530753 - DNA, 25 bp, Homo sapien
gaggctacagctgcattgtcaggtc

SEQ ID NO: 530754 - DNA, 25 bp, Homo sapien
aacagtgtgttcagtggtgaaaatc

SEQ ID NO: 530755 - DNA, 25 bp, Homo sapien
gtggtgaaaatcgttgcatgcatgt

SEQ ID NO: 530756 - DNA, 25 bp, Homo sapien
catgcatgttttcatctgagcgtgt

SEQ ID NO: 530757 - DNA, 25 bp, Homo sapien
atgttttcatctgagcgtgtccttc

SEQ ID NO: 530758 - DNA, 25 bp, Homo sapien
atctgagcgtgtccttctcccatac

SEQ ID NO: 530759 - DNA, 25 bp, Homo sapien
aggtgagcgacgaccttacagagcg

SEQ ID NO: 530760 - DNA, 25 bp, Homo sapien
tgagcgacgaccttacagagcgagc

SEQ ID NO: 530761 - DNA, 25 bp, Homo sapien
gagcgacgaccttacagagcgagcc

SEQ ID NO: 530762 - DNA, 25 bp, Homo sapien
agcgacgaccttacagagcgagccg

SEQ ID NO: 530763 - DNA, 25 bp, Homo sapien
gcgacgaccttacagagcgagccgc

SEQ ID NO: 530764 - DNA, 25 bp, Homo sapien
gacgaccttacagagcgagccgcca

SEQ ID NO: 530765 - DNA, 25 bp, Homo sapien
ttacagagcgagccgccacctttgg

SEQ ID NO: 530766 - DNA, 25 bp, Homo sapien
gaccttcgggaaggagttcacagaa

SEQ ID NO: 530767 - DNA, 25 bp, Homo sapien
accttcgggaaggagttcacagaag

SEQ ID NO: 530768 - DNA, 25 bp, Homo sapien
cttcgggaaggagttcacagaagcg

SEQ ID NO: 530769 - DNA, 25 bp, Homo sapien
gaaggagttcacagaagcggtggaa

SEQ ID NO: 530770 - DNA, 25 bp, Homo sapien
gtctgaagggtacttctcagggcct

SEQ ID NO: 530771 - DNA, 25 bp, Homo sapien
actctctggacttggctgaggtctg

SEQ ID NO: 530772 - DNA, 25 bp, Homo sapien
tgaggtctgtatctccttcacagct

SEQ ID NO: 530773 - DNA, 25 bp, Homo sapien
ttcacagcttcctttaaggctttca

SEQ ID NO: 530774 - DNA, 25 bp, Homo sapien
aaatcctgcttgttcccctcagatt

SEQ ID NO: 530775 - DNA, 25 bp, Homo sapien
ttcccctcagattcttccagggagg

SEQ ID NO: 530776 - DNA, 25 bp, Homo sapien
gaggcaacctttgccttcatgtcat

SEQ ID NO: 530777 - DNA, 25 bp, Homo sapien
catgtcattgatctccttctggctc

SEQ ID NO: 530778 - DNA, 25 bp, Homo sapien
tcctcttctggacttctgtgaagat

SEQ ID NO: 530779 - DNA, 25 bp, Homo sapien
atggcgatgttgtcgttgatggatt

SEQ ID NO: 530780 - DNA, 25 bp, Homo sapien
gttgatggatttggtgagctccgtc

SEQ ID NO: 530781 - DNA, 25 bp, Homo sapien
gggtgacaagcagatactgctgtgt

SEQ ID NO: 530782 - DNA, 25 bp, Homo sapien
actgctgtgtaatggttacactaac

SEQ ID NO: 530783 - DNA, 25 bp, Homo sapien
gttacactaaccaaaagacaccagc

SEQ ID NO: 530784 - DNA, 25 bp, Homo sapien
taaccaaaagacaccagccactcag

SEQ ID NO: 530785 - DNA, 25 bp, Homo sapien
gccactcagagttctatactgtaaa

SEQ ID NO: 530786 - DNA, 25 bp, Homo sapien
gagttctatactgtaaagcgcagat

SEQ ID NO: 530787 - DNA, 25 bp, Homo sapien
taaagcgcagataacatttgtgtgt

SEQ ID NO: 530788 - DNA, 25 bp, Homo sapien
acatttgtgtgttataccttgattg

SEQ ID NO: 530789 - DNA, 25 bp, Homo sapien
atttgtgtgttataccttgattggg

SEQ ID NO: 530790 - DNA, 25 bp, Homo sapien
cctgggctctggttttagtataccg

SEQ ID NO: 530791 - DNA, 25 bp, Homo sapien
tgggctctggttttagtataccgga

SEQ ID NO: 530792 - DNA, 25 bp, Homo sapien
ttgttgttaataggtcttctttttg

SEQ ID NO: 530793 - DNA, 25 bp, Homo sapien
taataggtcttctttttgaaacaat

SEQ ID NO: 530794 - DNA, 25 bp, Homo sapien
gaactttgaagctagtgcattggaa

SEQ ID NO: 530795 - DNA, 25 bp, Homo sapien
agtgcattggaaaaatgcacccttt

SEQ ID NO: 530796 - DNA, 25 bp, Homo sapien
ttccctcctttggaatgctgtatta

SEQ ID NO: 530797 - DNA, 25 bp, Homo sapien
ccctcctttggaatgctgtattaat

SEQ ID NO: 530798 - DNA, 25 bp, Homo sapien
ggaatgctgtattaatgtagtataa

SEQ ID NO: 530799 - DNA, 25 bp, Homo sapien
taataattactggttttgtaacttg

SEQ ID NO: 530800 - DNA, 25 bp, Homo sapien
ttgttctggtaatgtccttcccgga

SEQ ID NO: 530801 - DNA, 25 bp, Homo sapien
tggtaatgtccttcccggactcttt

SEQ ID NO: 530802 - DNA, 25 bp, Homo sapien
tgtctccccctaagttttatacttg

SEQ ID NO: 530803 - DNA, 25 bp, Homo sapien
tagtcacccagaaagaggtagcgtg

SEQ ID NO: 530804 - DNA, 25 bp, Homo sapien
agtcacccagaaagaggtagcgtgt

SEQ ID NO: 530805 - DNA, 25 bp, Homo sapien
gatggcagccccatcattgattatc

SEQ ID NO: 530806 - DNA, 25 bp, Homo sapien
atggcagccccatcattgattatct

SEQ ID NO: 530807 - DNA, 25 bp, Homo sapien
tggcagccccatcattgattatctt

SEQ ID NO: 530808 - DNA, 25 bp, Homo sapien
ggcagccccatcattgattatcttt

SEQ ID NO: 530809 - DNA, 25 bp, Homo sapien
gcagccccatcattgattatcttta

SEQ ID NO: 530810 - DNA, 25 bp, Homo sapien
cagccccatcattgattatctttaa

SEQ ID NO: 530811 - DNA, 25 bp, Homo sapien
aggaacatcccttgaggtgacccag

SEQ ID NO: 530812 - DNA, 25 bp, Homo sapien
ttgaggtgacccagccaacctgtgg

SEQ ID NO: 530813 - DNA, 25 bp, Homo sapien
ccagccaacctgtggccagaaggag

SEQ ID NO: 530814 - DNA, 25 bp, Homo sapien
gaggtagaaaatcaattcaattgtc

SEQ ID NO: 530815 - DNA, 25 bp, Homo sapien
aatcaattcaattgtcgcatcattc

SEQ ID NO: 530816 - DNA, 25 bp, Homo sapien
ttcaattgtcgcatcattcatggtt

SEQ ID NO: 530817 - DNA, 25 bp, Homo sapien
attgtcgcatcattcatggttcttt

SEQ ID NO: 530818 - DNA, 25 bp, Homo sapien
gtcgcatcattcatggttctttaat

SEQ ID NO: 530819 - DNA, 25 bp, Homo sapien
ggttctttaatattgatgctcagtg

SEQ ID NO: 530820 - DNA, 25 bp, Homo sapien
ttctttaatattgatgctcagtgca

SEQ ID NO: 530821 - DNA, 25 bp, Homo sapien
atatcccagcctctcttctggtttg

SEQ ID NO: 530822 - DNA, 25 bp, Homo sapien
ctagctgtaatatagttttgtgaat

SEQ ID NO: 530823 - DNA, 25 bp, Homo sapien
gaatttattgcactgatgttgtacc

SEQ ID NO: 530824 - DNA, 25 bp, Homo sapien
ttattgcactgatgttgtaccttgt

SEQ ID NO: 530825 - DNA, 25 bp, Homo sapien
gcactgatgttgtaccttgtggtat

SEQ ID NO: 530826 - DNA, 25 bp, Homo sapien
gtaccttgtggtatatctgtcccta

SEQ ID NO: 530827 - DNA, 25 bp, Homo sapien
ttgtggtatatctgtccctattaaa

SEQ ID NO: 530828 - DNA, 25 bp, Homo sapien
tatctgtccctattaaataagtgtt

SEQ ID NO: 530829 - DNA, 25 bp, Homo sapien
tctcctctttaatattgctgtgaac

SEQ ID NO: 530830 - DNA, 25 bp, Homo sapien
tgctgtgaacagtggtgcccattgt

SEQ ID NO: 530831 - DNA, 25 bp, Homo sapien
atctggattttttgtgtgcatacat

SEQ ID NO: 530832 - DNA, 25 bp, Homo sapien
gcagttttaatcctgtattatttct

SEQ ID NO: 530833 - DNA, 25 bp, Homo sapien
agaagcctctggacattgactacat

SEQ ID NO: 530834 - DNA, 25 bp, Homo sapien
gagctgtcggactggatccaccagc

SEQ ID NO: 530835 - DNA, 25 bp, Homo sapien
ggatccaccagctggagtctgagaa

SEQ ID NO: 530836 - DNA, 25 bp, Homo sapien
tatgagatcaacgtgctgtacaacc

SEQ ID NO: 530837 - DNA, 25 bp, Homo sapien
gatcaacgtgctgtacaaccgcatc

SEQ ID NO: 530838 - DNA, 25 bp, Homo sapien
agccacgcccagaagttccggaagg

SEQ ID NO: 530839 - DNA, 25 bp, Homo sapien
aagggccgcgttggaggccgctgga

SEQ ID NO: 530840 - DNA, 25 bp, Homo sapien
ctgggagtgtttgtcccatcggtag

SEQ ID NO: 530841 - DNA, 25 bp, Homo sapien
tgtttgtcccatcggtagcttgaaa

SEQ ID NO: 530842 - DNA, 25 bp, Homo sapien
ttgtcccatcggtagcttgaaataa

SEQ ID NO: 530843 - DNA, 25 bp, Homo sapien
gtagcttgaaataaacgctcccctc

SEQ ID NO: 530844 - DNA, 25 bp, Homo sapien
caagagtatcgccaataagaacatc

SEQ ID NO: 530845 - DNA, 25 bp, Homo sapien
aagagtatcgccaataagaacatcg

SEQ ID NO: 530846 - DNA, 25 bp, Homo sapien
agagtatcgccaataagaacatcgc

SEQ ID NO: 530847 - DNA, 25 bp, Homo sapien
gagtatcgccaataagaacatcgcc

SEQ ID NO: 530848 - DNA, 25 bp, Homo sapien
agtatcgccaataagaacatcgcca

SEQ ID NO: 530849 - DNA, 25 bp, Homo sapien
gtatcgccaataagaacatcgccaa

SEQ ID NO: 530850 - DNA, 25 bp, Homo sapien
tatcgccaataagaacatcgccaac

SEQ ID NO: 530851 - DNA, 25 bp, Homo sapien
atcgccaataagaacatcgccaacc

SEQ ID NO: 530852 - DNA, 25 bp, Homo sapien
gccaataagaacatcgccaacccca

SEQ ID NO: 530853 - DNA, 25 bp, Homo sapien
caataagaacatcgccaaccccacg

SEQ ID NO: 530854 - DNA, 25 bp, Homo sapien
aagaacatcgccaaccccacggcca

SEQ ID NO: 530855 - DNA, 25 bp, Homo sapien
aatttttatacccaagccattgatg

SEQ ID NO: 530856 - DNA, 25 bp, Homo sapien
agccattgatgtacttttccttgta

SEQ ID NO: 530857 - DNA, 25 bp, Homo sapien
tttccttgtactctcccttgtgggt

SEQ ID NO: 530858 - DNA, 25 bp, Homo sapien
ttgtgggtcccttgtctggcttggc

SEQ ID NO: 530859 - DNA, 25 bp, Homo sapien
gttggacagacctggctgaacctta

SEQ ID NO: 530860 - DNA, 25 bp, Homo sapien
gacctggctgaaccttagtttcttc

SEQ ID NO: 530861 - DNA, 25 bp, Homo sapien
tgggaatatgaattactgcagcagc

SEQ ID NO: 530862 - DNA, 25 bp, Homo sapien
cagcagcttttagggcagatttgcc

SEQ ID NO: 530863 - DNA, 25 bp, Homo sapien
tttgccatggcatatacaaggtaac

SEQ ID NO: 530864 - DNA, 25 bp, Homo sapien
ggtaactaccatagtgctccttggg

SEQ ID NO: 530865 - DNA, 25 bp, Homo sapien
gtgctccttgggtattgccaatatc

SEQ ID NO: 530866 - DNA, 25 bp, Homo sapien
cctgtgtgggagaccatcgtgtgca

SEQ ID NO: 530867 - DNA, 25 bp, Homo sapien
accatcgtgtgcaccatgcgagaag

SEQ ID NO: 530868 - DNA, 25 bp, Homo sapien
gggagattgcccagttcctctgtga

SEQ ID NO: 530869 - DNA, 25 bp, Homo sapien
agttcctctgtgacatcaagcatgt

SEQ ID NO: 530870 - DNA, 25 bp, Homo sapien
acatcaagcatgtggtcctgtaccc

SEQ ID NO: 530871 - DNA, 25 bp, Homo sapien
tgtacccgctggtggccaagagtct

SEQ ID NO: 530872 - DNA, 25 bp, Homo sapien
aagagtctccgcaacatcgcggtgg

SEQ ID NO: 530873 - DNA, 25 bp, Homo sapien
gcaacatcgcggtgggcaaggaccc

SEQ ID NO: 530874 - DNA, 25 bp, Homo sapien
agcggcactgctgcggtgttgcaca

SEQ ID NO: 530875 - DNA, 25 bp, Homo sapien
ctgcggtgttgcacagatgcgtgaa

SEQ ID NO: 530876 - DNA, 25 bp, Homo sapien
agatgcgtgaacacagctccctggg

SEQ ID NO: 530877 - DNA, 25 bp, Homo sapien
gaggtagaaaatcaattcaattgtc

SEQ ID NO: 530878 - DNA, 25 bp, Homo sapien
gaaaatcaattcaattgtcgcatca

SEQ ID NO: 530879 - DNA, 25 bp, Homo sapien
aatcaattcaattgtcgcatcattc

SEQ ID NO: 530880 - DNA, 25 bp, Homo sapien
atcattcatggttctttaatattga

SEQ ID NO: 530881 - DNA, 25 bp, Homo sapien
tcatggttctttaatattgatgctc

SEQ ID NO: 530882 - DNA, 25 bp, Homo sapien
catggttctttaatattgatgctca

SEQ ID NO: 530883 - DNA, 25 bp, Homo sapien
atggttctttaatattgatgctcag

SEQ ID NO: 530884 - DNA, 25 bp, Homo sapien
tggttctttaatattgatgctcagt

SEQ ID NO: 530885 - DNA, 25 bp, Homo sapien
ggttctttaatattgatgctcagtg

SEQ ID NO: 530886 - DNA, 25 bp, Homo sapien
gttctttaatattgatgctcagtgc

SEQ ID NO: 530887 - DNA, 25 bp, Homo sapien
ttctttaatattgatgctcagtgca

SEQ ID NO: 530888 - DNA, 25 bp, Homo sapien
gagtgtgctgctgttaattgtttaa

SEQ ID NO: 530889 - DNA, 25 bp, Homo sapien
gttaccataaattccatgaacttaa

SEQ ID NO: 530890 - DNA, 25 bp, Homo sapien
attccatgaacttaaatctgtgatt

SEQ ID NO: 530891 - DNA, 25 bp, Homo sapien
atctgtgattcattgccttaaaact

SEQ ID NO: 530892 - DNA, 25 bp, Homo sapien
aaactttctctcttagaatttccat

SEQ ID NO: 530893 - DNA, 25 bp, Homo sapien
tagaatttccataccgcatgccaaa

SEQ ID NO: 530894 - DNA, 25 bp, Homo sapien
taccgcatgccaaaccagtaaaatg

SEQ ID NO: 530895 - DNA, 25 bp, Homo sapien
ttgtttacctattgaatgttacctg

SEQ ID NO: 530896 - DNA, 25 bp, Homo sapien
atgttacctgtttatgtagagctct

SEQ ID NO: 530897 - DNA, 25 bp, Homo sapien
acctgtttatgtagagctctttaga

SEQ ID NO: 530898 - DNA, 25 bp, Homo sapien
gtagagctctttagatgtaataaaa

SEQ ID NO: 530899 - DNA, 25 bp, Homo sapien
tacttactaacgaacagacctgatt

SEQ ID NO: 530900 - DNA, 25 bp, Homo sapien
aaacacaatttagctttgccaacag

SEQ ID NO: 530901 - DNA, 25 bp, Homo sapien
tttagctttgccaacagaagagtaa

SEQ ID NO: 530902 - DNA, 25 bp, Homo sapien
aatgtgttcctccttgttggagaca

SEQ ID NO: 530903 - DNA, 25 bp, Homo sapien
gttcctccttgttggagacattagc

SEQ ID NO: 530904 - DNA, 25 bp, Homo sapien
tttagaccaacttatacaaacagag

SEQ ID NO: 530905 - DNA, 25 bp, Homo sapien
gagtattgatttgtacacattctgg

SEQ ID NO: 530906 - DNA, 25 bp, Homo sapien
gtacacattctggagacttgctata

SEQ ID NO: 530907 - DNA, 25 bp, Homo sapien
gacttgctatatcatggtttgctat

SEQ ID NO: 530908 - DNA, 25 bp, Homo sapien
ggtttgctatggcacagactcagct

SEQ ID NO: 530909 - DNA, 25 bp, Homo sapien
atggcacagactcagcttagcatgg

SEQ ID NO: 530910 - DNA, 25 bp, Homo sapien
aggccattctgagccacactgaaaa

SEQ ID NO: 530911 - DNA, 25 bp, Homo sapien
ttataacccagtgagttcagccttt

SEQ ID NO: 530912 - DNA, 25 bp, Homo sapien
gagttcagcctttaagataccttga

SEQ ID NO: 530913 - DNA, 25 bp, Homo sapien
gaagacctggactattgaatggagc

SEQ ID NO: 530914 - DNA, 25 bp, Homo sapien
tggagcagaaattcacctctctcac

SEQ ID NO: 530915 - DNA, 25 bp, Homo sapien
aattcacctctctcactgactatta

SEQ ID NO: 530916 - DNA, 25 bp, Homo sapien
gactattacagttgcatttttatgg

SEQ ID NO: 530917 - DNA, 25 bp, Homo sapien
tgcatttttatggagttcttcttct

SEQ ID NO: 530918 - DNA, 25 bp, Homo sapien
gttcttcttctcctaggattcctaa

SEQ ID NO: 530919 - DNA, 25 bp, Homo sapien
tctcctaggattcctaagactgctg

SEQ ID NO: 530920 - DNA, 25 bp, Homo sapien
gtttgtgaatgtgactacttagtgg

SEQ ID NO: 530921 - DNA, 25 bp, Homo sapien
aatgatgaaggtctgcagaaactga

SEQ ID NO: 530922 - DNA, 25 bp, Homo sapien
gaaactgaaacccagacatgtgtct

SEQ ID NO: 530923 - DNA, 25 bp, Homo sapien
cccctctatgtgggcatggttttgc

SEQ ID NO: 530924 - DNA, 25 bp, Homo sapien
gtgcttctaagtgcaggagaacatg

SEQ ID NO: 530925 - DNA, 25 bp, Homo sapien
ggagaacatgtcacctgaggctagt

SEQ ID NO: 530926 - DNA, 25 bp, Homo sapien
gtcacctgaggctagttttgcattc

SEQ ID NO: 530927 - DNA, 25 bp, Homo sapien
gaggctagttttgcattcaggtccc

SEQ ID NO: 530928 - DNA, 25 bp, Homo sapien
ctagttttgcattcaggtccctggc

SEQ ID NO: 530929 - DNA, 25 bp, Homo sapien
aggtccctggcttcgtttcttgttg

SEQ ID NO: 530930 - DNA, 25 bp, Homo sapien
cttcgtttcttgttggtatgcctcc

SEQ ID NO: 530931 - DNA, 25 bp, Homo sapien
ttcttgttggtatgcctccccagat

SEQ ID NO: 530932 - DNA, 25 bp, Homo sapien
aggaaaaagactggtattacgctca

SEQ ID NO: 530933 - DNA, 25 bp, Homo sapien
ggaaaaagactggtattacgctcaa

SEQ ID NO: 530934 - DNA, 25 bp, Homo sapien
gaaaaagactggtattacgctcaac

SEQ ID NO: 530935 - DNA, 25 bp, Homo sapien
aaaaagactggtattacgctcaact

SEQ ID NO: 530936 - DNA, 25 bp, Homo sapien
aaaagactggtattacgctcaactt

SEQ ID NO: 530937 - DNA, 25 bp, Homo sapien
aaagactggtattacgctcaacttc

SEQ ID NO: 530938 - DNA, 25 bp, Homo sapien
aagactggtattacgctcaacttca

SEQ ID NO: 530939 - DNA, 25 bp, Homo sapien
agactggtattacgctcaacttcag

SEQ ID NO: 530940 - DNA, 25 bp, Homo sapien
actggtattacgctcaacttcagaa

SEQ ID NO: 530941 - DNA, 25 bp, Homo sapien
ctggtattacgctcaacttcagaat

SEQ ID NO: 530942 - DNA, 25 bp, Homo sapien
tggtattacgctcaacttcagaatc

SEQ ID NO: 530943 - DNA, 25 bp, Homo sapien
agtgggtggtgggagcctggagcaa

SEQ ID NO: 530944 - DNA, 25 bp, Homo sapien
gggtgttgtatattgtgttgatgac

SEQ ID NO: 530945 - DNA, 25 bp, Homo sapien
atattgtgttgatgacgtacgttat

SEQ ID NO: 530946 - DNA, 25 bp, Homo sapien
gatgacgtacgttatttccatggaa

SEQ ID NO: 530947 - DNA, 25 bp, Homo sapien
tatttccatggaagatagccgctgt

SEQ ID NO: 530948 - DNA, 25 bp, Homo sapien
tccatggaagatagccgctgtggca

SEQ ID NO: 530949 - DNA, 25 bp, Homo sapien
agctccctagggtctgccgagaagg

SEQ ID NO: 530950 - DNA, 25 bp, Homo sapien
ggcaggcagtctttgggttctgttc

SEQ ID NO: 530951 - DNA, 25 bp, Homo sapien
ttgggttctgttctttgtcacgtcc

SEQ ID NO: 530952 - DNA, 25 bp, Homo sapien
tgtcacgtcccctacaagtaaattt

SEQ ID NO: 530953 - DNA, 25 bp, Homo sapien
tcacgtcccctacaagtaaattttg

SEQ ID NO: 530954 - DNA, 25 bp, Homo sapien
gacacccagtggatcaccaaaccag

SEQ ID NO: 530955 - DNA, 25 bp, Homo sapien
acacccagtggatcaccaaaccagt

SEQ ID NO: 530956 - DNA, 25 bp, Homo sapien
agtggatcaccaaaccagtccacaa

SEQ ID NO: 530957 - DNA, 25 bp, Homo sapien
gtggatcaccaaaccagtccacaag

SEQ ID NO: 530958 - DNA, 25 bp, Homo sapien
catctgcaggccgaaagagccgtgg

SEQ ID NO: 530959 - DNA, 25 bp, Homo sapien
atctgcaggccgaaagagccgtggc

SEQ ID NO: 530960 - DNA, 25 bp, Homo sapien
tctgcaggccgaaagagccgtggcc

SEQ ID NO: 530961 - DNA, 25 bp, Homo sapien
tgcaggccgaaagagccgtggcctt

SEQ ID NO: 530962 - DNA, 25 bp, Homo sapien
gccgaaagagccgtggccttggaaa

SEQ ID NO: 530963 - DNA, 25 bp, Homo sapien
ccgaaagagccgtggccttggaaag

SEQ ID NO: 530964 - DNA, 25 bp, Homo sapien
ttaccgctaatataagtaaagtttg

SEQ ID NO: 530965 - DNA, 25 bp, Homo sapien
ttatggtgtagacagccctccccca

SEQ ID NO: 530966 - DNA, 25 bp, Homo sapien
aaacgtcctggactgcacagacctc

SEQ ID NO: 530967 - DNA, 25 bp, Homo sapien
accatccaggcctggttcccaagac

SEQ ID NO: 530968 - DNA, 25 bp, Homo sapien
ctgcaaccagacagtctacaactgc

SEQ ID NO: 530969 - DNA, 25 bp, Homo sapien
tccagcccattttctgccgtgaaac

SEQ ID NO: 530970 - DNA, 25 bp, Homo sapien
ttttctgccgtgaaaccccagccag

SEQ ID NO: 530971 - DNA, 25 bp, Homo sapien
cagactctggaaccctttttcgact

SEQ ID NO: 530972 - DNA, 25 bp, Homo sapien
gactctggaaccctttttcgactgc

SEQ ID NO: 530973 - DNA, 25 bp, Homo sapien
tttcgactgccccaactcttggaca

SEQ ID NO: 530974 - DNA, 25 bp, Homo sapien
aactcttggacaccaggccaactag

SEQ ID NO: 530975 - DNA, 25 bp, Homo sapien
tcttggacaccaggccaactagaac

SEQ ID NO: 530976 - DNA, 25 bp, Homo sapien
actttggaagagatgaactgtgtat

SEQ ID NO: 530977 - DNA, 25 bp, Homo sapien
ctttggaagagatgaactgtgtatt

SEQ ID NO: 530978 - DNA, 25 bp, Homo sapien
ggaagagatgaactgtgtatttaac

SEQ ID NO: 530979 - DNA, 25 bp, Homo sapien
gaagagatgaactgtgtatttaact

SEQ ID NO: 530980 - DNA, 25 bp, Homo sapien
aagagatgaactgtgtatttaactt

SEQ ID NO: 530981 - DNA, 25 bp, Homo sapien
gtgtatttaacttaagctattgctc

SEQ ID NO: 530982 - DNA, 25 bp, Homo sapien
tgtatttaacttaagctattgctct

SEQ ID NO: 530983 - DNA, 25 bp, Homo sapien
gtatttaacttaagctattgctctt

SEQ ID NO: 530984 - DNA, 25 bp, Homo sapien
tatttaacttaagctattgctctta

SEQ ID NO: 530985 - DNA, 25 bp, Homo sapien
atttaacttaagctattgctcttaa

SEQ ID NO: 530986 - DNA, 25 bp, Homo sapien
taacttaagctattgctcttaaaac

SEQ ID NO: 530987 - DNA, 25 bp, Homo sapien
cactgtccccaggtacgtgtacatg

SEQ ID NO: 530988 - DNA, 25 bp, Homo sapien
aggtacgtgtacatggagccaaact

SEQ ID NO: 530989 - DNA, 25 bp, Homo sapien
atggagccaaactgtgtgtcctgtg

SEQ ID NO: 530990 - DNA, 25 bp, Homo sapien
aactgtgtgtcctgtggcattgtca

SEQ ID NO: 530991 - DNA, 25 bp, Homo sapien
ggcattgtcagagttatgttgaaat

SEQ ID NO: 530992 - DNA, 25 bp, Homo sapien
gaaaatgttagcaacttacttgcat

SEQ ID NO: 530993 - DNA, 25 bp, Homo sapien
gcaacttacttgcatttttaaagac

SEQ ID NO: 530994 - DNA, 25 bp, Homo sapien
aagagctggtaacctatggcctcaa

SEQ ID NO: 530995 - DNA, 25 bp, Homo sapien
gtaacctatggcctcaagcatctgt

SEQ ID NO: 530996 - DNA, 25 bp, Homo sapien
gtgggatgtagtgcttaatggaaac

SEQ ID NO: 530997 - DNA, 25 bp, Homo sapien
gcttaatggaaactgctaaatcttt

SEQ ID NO: 530998 - DNA, 25 bp, Homo sapien
agctcctgccggtgagtggccctgg

SEQ ID NO: 530999 - DNA, 25 bp, Homo sapien
tggcctggcccgtggcgcatcctca

SEQ ID NO: 531000 - DNA, 25 bp, Homo sapien
cactcccagcctgcgggtaacctgc

SEQ ID NO: 531001 - DNA, 25 bp, Homo sapien
agcctgcgggtaacctgccgccctc

SEQ ID NO: 531002 - DNA, 25 bp, Homo sapien
tctccccacagctacccttcgagga

SEQ ID NO: 531003 - DNA, 25 bp, Homo sapien
cacagctacccttcgaggaactgga

SEQ ID NO: 531004 - DNA, 25 bp, Homo sapien
cttcgaggaactggagtcccagaga

SEQ ID NO: 531005 - DNA, 25 bp, Homo sapien
ggagtcccagagaggcctgccccag

SEQ ID NO: 531006 - DNA, 25 bp, Homo sapien
tcaagagctacctgaggcagaagct

SEQ ID NO: 531007 - DNA, 25 bp, Homo sapien
acctgaggcagaagctccaggccct

SEQ ID NO: 531008 - DNA, 25 bp, Homo sapien
gatgatttgcactttggttccctgt

SEQ ID NO: 531009 - DNA, 25 bp, Homo sapien
atagggaaaccctgtatctatcaca

SEQ ID NO: 531010 - DNA, 25 bp, Homo sapien
tagggaaaccctgtatctatcacaa

SEQ ID NO: 531011 - DNA, 25 bp, Homo sapien
agggaaaccctgtatctatcacaaa

SEQ ID NO: 531012 - DNA, 25 bp, Homo sapien
gggaaaccctgtatctatcacaaaa

SEQ ID NO: 531013 - DNA, 25 bp, Homo sapien
ggaaaccctgtatctatcacaaaaa

SEQ ID NO: 531014 - DNA, 25 bp, Homo sapien
tttaaaatttgctgggcacagcggc

SEQ ID NO: 531015 - DNA, 25 bp, Homo sapien
ggcacagcggcacacacacctgtag

SEQ ID NO: 531016 - DNA, 25 bp, Homo sapien
aatgagctgtgataatgccgctgcc

SEQ ID NO: 531017 - DNA, 25 bp, Homo sapien
tgataatgccgctgccctgtggctt

SEQ ID NO: 531018 - DNA, 25 bp, Homo sapien
gataatgccgctgccctgtggcttg

SEQ ID NO: 531019 - DNA, 25 bp, Homo sapien
ccgctgccctgtggcttgggtgaca

SEQ ID NO: 531020 - DNA, 25 bp, Homo sapien
aaaatgcttgcggaagaggatgtcg

SEQ ID NO: 531021 - DNA, 25 bp, Homo sapien
gtcggctatgacgttgcagggcgcg

SEQ ID NO: 531022 - DNA, 25 bp, Homo sapien
tggccttgggtcttcctgagtgctt

SEQ ID NO: 531023 - DNA, 25 bp, Homo sapien
gggtcttcctgagtgcttccagcag

SEQ ID NO: 531024 - DNA, 25 bp, Homo sapien
tggatccggctctcattgccctgtt

SEQ ID NO: 531025 - DNA, 25 bp, Homo sapien
ggaaaaccgccggatgtccttccag

SEQ ID NO: 531026 - DNA, 25 bp, Homo sapien
ccggatgtccttccaggtaggtcca

SEQ ID NO: 531027 - DNA, 25 bp, Homo sapien
tccttccaggtaggtccattattaa

SEQ ID NO: 531028 - DNA, 25 bp, Homo sapien
ttcccctgtccctgtgcgcatggaa

SEQ ID NO: 531029 - DNA, 25 bp, Homo sapien
ggaggtcgcctctgcccgagaactc

SEQ ID NO: 531030 - DNA, 25 bp, Homo sapien
ctgcccgagaactcgtccttgtagt

SEQ ID NO: 531031 - DNA, 25 bp, Homo sapien
aaagatgcacaaagcaatgctgcca

SEQ ID NO: 531032 - DNA, 25 bp, Homo sapien
aatgctgccagagactttgttaact

SEQ ID NO: 531033 - DNA, 25 bp, Homo sapien
gctgccagagactttgttaactatt

SEQ ID NO: 531034 - DNA, 25 bp, Homo sapien
gagactttgttaactatttggttcg

SEQ ID NO: 531035 - DNA, 25 bp, Homo sapien
gagtgaagaagttccagcttttggg

SEQ ID NO: 531036 - DNA, 25 bp, Homo sapien
acttactgatactcctgacactaca

SEQ ID NO: 531037 - DNA, 25 bp, Homo sapien
gatactcctgacactacagcaaatg

SEQ ID NO: 531038 - DNA, 25 bp, Homo sapien
ctcctgacactacagcaaatgctga

SEQ ID NO: 531039 - DNA, 25 bp, Homo sapien
caaatgctgaaggagatttaccaac

SEQ ID NO: 531040 - DNA, 25 bp, Homo sapien
gcctctggctatggtgttcctgggc

SEQ ID NO: 531041 - DNA, 25 bp, Homo sapien
tggctatggtgttcctgggcccacc

SEQ ID NO: 531042 - DNA, 25 bp, Homo sapien
ttatccttaaaattcacctgtcagg

SEQ ID NO: 531043 - DNA, 25 bp, Homo sapien
tatccttaaaattcacctgtcaggg

SEQ ID NO: 531044 - DNA, 25 bp, Homo sapien
aaaattcacctgtcagggaggcatt

SEQ ID NO: 531045 - DNA, 25 bp, Homo sapien
aaattcacctgtcagggaggcatta

SEQ ID NO: 531046 - DNA, 25 bp, Homo sapien
aattcacctgtcagggaggcattaa

SEQ ID NO: 531047 - DNA, 25 bp, Homo sapien
attcacctgtcagggaggcattaaa

SEQ ID NO: 531048 - DNA, 25 bp, Homo sapien
ttcacctgtcagggaggcattaaaa

SEQ ID NO: 531049 - DNA, 25 bp, Homo sapien
tcacctgtcagggaggcattaaaaa

SEQ ID NO: 531050 - DNA, 25 bp, Homo sapien
cacctgtcagggaggcattaaaaat

SEQ ID NO: 531051 - DNA, 25 bp, Homo sapien
acctgtcagggaggcattaaaaatt

SEQ ID NO: 531052 - DNA, 25 bp, Homo sapien
gagaaacatgacaaagggccccgca

SEQ ID NO: 531053 - DNA, 25 bp, Homo sapien
gaaacatgacaaagggccccgcagc

SEQ ID NO: 531054 - DNA, 25 bp, Homo sapien
attgtccatccttgttgtccgtgag

SEQ ID NO: 531055 - DNA, 25 bp, Homo sapien
ttgttgtccgtgagtccttggcctc

SEQ ID NO: 531056 - DNA, 25 bp, Homo sapien
ttggcctccaccaagcacgtgtggc

SEQ ID NO: 531057 - DNA, 25 bp, Homo sapien
accaagcacgtgtggccattgtgtg

SEQ ID NO: 531058 - DNA, 25 bp, Homo sapien
gccattgtgtgcctgccttagtgac

SEQ ID NO: 531059 - DNA, 25 bp, Homo sapien
tgccttagtgactccgtggttttgt

SEQ ID NO: 531060 - DNA, 25 bp, Homo sapien
gcagagtgtgtatgatttttgcctc

SEQ ID NO: 531061 - DNA, 25 bp, Homo sapien
atgatttttgcctcagaaactatac

SEQ ID NO: 531062 - DNA, 25 bp, Homo sapien
agaaactatactcttctgtgtaaca

SEQ ID NO: 531063 - DNA, 25 bp, Homo sapien
tgaacctggcagatgcagctaggct

SEQ ID NO: 531064 - DNA, 25 bp, Homo sapien
atgcagctaggctctgcagtgctgt

SEQ ID NO: 531065 - DNA, 25 bp, Homo sapien
gacacatgtggatcaggcccaggaa

SEQ ID NO: 531066 - DNA, 25 bp, Homo sapien
gggctgagcactacagaagtcacat

SEQ ID NO: 531067 - DNA, 25 bp, Homo sapien
agcactacagaagtcacatgggttc

SEQ ID NO: 531068 - DNA, 25 bp, Homo sapien
cacatgggttctcagggtatgccag

SEQ ID NO: 531069 - DNA, 25 bp, Homo sapien
ggcagaaacagtaccggctctctgt

SEQ ID NO: 531070 - DNA, 25 bp, Homo sapien
tctctgtcactcaccttgagagtag

SEQ ID NO: 531071 - DNA, 25 bp, Homo sapien
tgagagtagagcagaccctgttctg

SEQ ID NO: 531072 - DNA, 25 bp, Homo sapien
accctgttctgctctgggctgtgaa

SEQ ID NO: 531073 - DNA, 25 bp, Homo sapien
gcaggcagtggccagctttgccctt

SEQ ID NO: 531074 - DNA, 25 bp, Homo sapien
tctgaacatagaaactcgggcttga

SEQ ID NO: 531075 - DNA, 25 bp, Homo sapien
gagtgagaagagcttgcacagccaa

SEQ ID NO: 531076 - DNA, 25 bp, Homo sapien
aagagcttgcacagccaacgagaca

SEQ ID NO: 531077 - DNA, 25 bp, Homo sapien
acagccaacgagacacattgccttc

SEQ ID NO: 531078 - DNA, 25 bp, Homo sapien
cacattgccttctggagctgggaga

SEQ ID NO: 531079 - DNA, 25 bp, Homo sapien
ttactttcttcaccaagtgcaatag

SEQ ID NO: 531080 - DNA, 25 bp, Homo sapien
ttactgatgtgatattctgttgctt

SEQ ID NO: 531081 - DNA, 25 bp, Homo sapien
gttgctttacagttacagttgatgt

SEQ ID NO: 531082 - DNA, 25 bp, Homo sapien
gggatcgatgtgctcagccaaattt

SEQ ID NO: 531083 - DNA, 25 bp, Homo sapien
gtgctcagccaaatttcctgtttga

SEQ ID NO: 531084 - DNA, 25 bp, Homo sapien
aaaaaccatgttgcgttcaaagagg

SEQ ID NO: 531085 - DNA, 25 bp, Homo sapien
tgcctgatgtgggaacagctcttct

SEQ ID NO: 531086 - DNA, 25 bp, Homo sapien
gcctgatgtgggaacagctcttctc

SEQ ID NO: 531087 - DNA, 25 bp, Homo sapien
cctgatgtgggaacagctcttctcc

SEQ ID NO: 531088 - DNA, 25 bp, Homo sapien
ctgatgtgggaacagctcttctccc

SEQ ID NO: 531089 - DNA, 25 bp, Homo sapien
tgatgtgggaacagctcttctccca

SEQ ID NO: 531090 - DNA, 25 bp, Homo sapien
atgtgggaacagctcttctcccaga

SEQ ID NO: 531091 - DNA, 25 bp, Homo sapien
tgtgggaacagctcttctcccagat

SEQ ID NO: 531092 - DNA, 25 bp, Homo sapien
ggaacagctcttctcccagatgtaa

SEQ ID NO: 531093 - DNA, 25 bp, Homo sapien
tgtaaatagaacaacctgcacaacc

SEQ ID NO: 531094 - DNA, 25 bp, Homo sapien
aacactgagccatttgctgcatttc

SEQ ID NO: 531095 - DNA, 25 bp, Homo sapien
tctttttatactaaatatgtgactg

SEQ ID NO: 531096 - DNA, 25 bp, Homo sapien
ttgcacacctctactccggagctga

SEQ ID NO: 531097 - DNA, 25 bp, Homo sapien
agctgagatttcttttacatagatg

SEQ ID NO: 531098 - DNA, 25 bp, Homo sapien
ttttacatagatgacctcgcttcaa

SEQ ID NO: 531099 - DNA, 25 bp, Homo sapien
atgacctcgcttcaaatacgttacc

SEQ ID NO: 531100 - DNA, 25 bp, Homo sapien
aaatacgttaccttactgatgatag

SEQ ID NO: 531101 - DNA, 25 bp, Homo sapien
atgataggatcttttcttgtagcac

SEQ ID NO: 531102 - DNA, 25 bp, Homo sapien
aggatcttttcttgtagcactatac

SEQ ID NO: 531103 - DNA, 25 bp, Homo sapien
gtagcactataccttgtgggaattt

SEQ ID NO: 531104 - DNA, 25 bp, Homo sapien
aatgtacacctgatttgagaagctg

SEQ ID NO: 531105 - DNA, 25 bp, Homo sapien
gaagcactcactttgaggagtacag

SEQ ID NO: 531106 - DNA, 25 bp, Homo sapien
gaaatgattcattcagtgtttgaaa

SEQ ID NO: 531107 - DNA, 25 bp, Homo sapien
gcaggaggtgatccgaggctgggaa

SEQ ID NO: 531108 - DNA, 25 bp, Homo sapien
gccaaactgactatatctccagatt

SEQ ID NO: 531109 - DNA, 25 bp, Homo sapien
gactatatctccagattatgcctat

SEQ ID NO: 531110 - DNA, 25 bp, Homo sapien
tctccagattatgcctatggtgcca

SEQ ID NO: 531111 - DNA, 25 bp, Homo sapien
tatggtgccactgggcacccaggca

SEQ ID NO: 531112 - DNA, 25 bp, Homo sapien
atgccactctcgtcttcgatgtgga

SEQ ID NO: 531113 - DNA, 25 bp, Homo sapien
tcgtcttcgatgtggagcttctaaa

SEQ ID NO: 531114 - DNA, 25 bp, Homo sapien
cttcgatgtggagcttctaaaactg

SEQ ID NO: 531115 - DNA, 25 bp, Homo sapien
agcttctaaaactggaatgacagga

SEQ ID NO: 531116 - DNA, 25 bp, Homo sapien
ggaatgacaggaatggcctcctccc

SEQ ID NO: 531117 - DNA, 25 bp, Homo sapien
gacaggaatggcctcctcccttagc

SEQ ID NO: 531118 - DNA, 25 bp, Homo sapien
gcacatagtcacttcatctcttttt

SEQ ID NO: 531119 - DNA, 25 bp, Homo sapien
aacccatcccaacattgacatgcta

SEQ ID NO: 531120 - DNA, 25 bp, Homo sapien
acattgacatgctatctgtggacaa

SEQ ID NO: 531121 - DNA, 25 bp, Homo sapien
gtggacaaatagcagttctcagaat

SEQ ID NO: 531122 - DNA, 25 bp, Homo sapien
gcagttctcagaatctagtcaagtt

SEQ ID NO: 531123 - DNA, 25 bp, Homo sapien
aatctagtcaagttgccatcatccc

SEQ ID NO: 531124 - DNA, 25 bp, Homo sapien
ttgccttggccgttcatagtaggta

SEQ ID NO: 531125 - DNA, 25 bp, Homo sapien
gtttctgtacagtactgtgtgtgtg

SEQ ID NO: 531126 - DNA, 25 bp, Homo sapien
acatctgtatgcacacatctttgat

SEQ ID NO: 531127 - DNA, 25 bp, Homo sapien
gactagcagggttaaagtggctttt

SEQ ID NO: 531128 - DNA, 25 bp, Homo sapien
gtggcttttaattacttcgtgagtg

SEQ ID NO: 531129 - DNA, 25 bp, Homo sapien
tcctccttggattccttcacgaaag

SEQ ID NO: 531130 - DNA, 25 bp, Homo sapien
ttccttcacgaaagcctcctcggat

SEQ ID NO: 531131 - DNA, 25 bp, Homo sapien
gacagtggcgtctgcttcagggaca

SEQ ID NO: 531132 - DNA, 25 bp, Homo sapien
atcttgttcttctctacttgttcac

SEQ ID NO: 531133 - DNA, 25 bp, Homo sapien
tacttgttcactctggcgctggttc

SEQ ID NO: 531134 - DNA, 25 bp, Homo sapien
attcctgttccgtgaccttagatgc

SEQ ID NO: 531135 - DNA, 25 bp, Homo sapien
ctgttccgtgaccttagatgcagca

SEQ ID NO: 531136 - DNA, 25 bp, Homo sapien
tcagggacatgagcaccgagcgcag

SEQ ID NO: 531137 - DNA, 25 bp, Homo sapien
agcgcaggcgggacacatctttgca

SEQ ID NO: 531138 - DNA, 25 bp, Homo sapien
gttgaagtcacatagctgggccacc

SEQ ID NO: 531139 - DNA, 25 bp, Homo sapien
aagtcacatagctgggccaccttct

SEQ ID NO: 531140 - DNA, 25 bp, Homo sapien
gcagagagcagattcccccatggga

SEQ ID NO: 531141 - DNA, 25 bp, Homo sapien
agatgggcaagcatcgtgccccttc

SEQ ID NO: 531142 - DNA, 25 bp, Homo sapien
ttcttcttggaattcccatccccac

SEQ ID NO: 531143 - DNA, 25 bp, Homo sapien
gagctggagccctaggtccgactaa

SEQ ID NO: 531144 - DNA, 25 bp, Homo sapien
ctggagccctaggtccgactaaaat

SEQ ID NO: 531145 - DNA, 25 bp, Homo sapien
ggagccctaggtccgactaaaatgt

SEQ ID NO: 531146 - DNA, 25 bp, Homo sapien
aagcagagcttggagcttggagctt

SEQ ID NO: 531147 - DNA, 25 bp, Homo sapien
gcttggagcttggagcttggaacct

SEQ ID NO: 531148 - DNA, 25 bp, Homo sapien
agcttggagcttggaacctggatcc

SEQ ID NO: 531149 - DNA, 25 bp, Homo sapien
ttggagcttggaacctggatcctcc

SEQ ID NO: 531150 - DNA, 25 bp, Homo sapien
agcttggaacctggatcctcccgta

SEQ ID NO: 531151 - DNA, 25 bp, Homo sapien
gagacacagaagtccatctattaca

SEQ ID NO: 531152 - DNA, 25 bp, Homo sapien
gacacagaagtccatctattacatc

SEQ ID NO: 531153 - DNA, 25 bp, Homo sapien
gaagtccatctattacatcactggt

SEQ ID NO: 531154 - DNA, 25 bp, Homo sapien
gtccatctattacatcactggtgag

SEQ ID NO: 531155 - DNA, 25 bp, Homo sapien
ccatctattacatcactggtgagag

SEQ ID NO: 531156 - DNA, 25 bp, Homo sapien
acatcactggtgagagcaaagagca

SEQ ID NO: 531157 - DNA, 25 bp, Homo sapien
tgagagcaaagagcaggtggccaac

SEQ ID NO: 531158 - DNA, 25 bp, Homo sapien
caaagagcaggtggccaactcagct

SEQ ID NO: 531159 - DNA, 25 bp, Homo sapien
agagcaggtggccaactcagctttt

SEQ ID NO: 531160 - DNA, 25 bp, Homo sapien
agcaggtggccaactcagcttttgt

SEQ ID NO: 531161 - DNA, 25 bp, Homo sapien
gcaggtggccaactcagcttttgtg

SEQ ID NO: 531162 - DNA, 25 bp, Homo sapien
aaggaggttaaatctacagcccctg

SEQ ID NO: 531163 - DNA, 25 bp, Homo sapien
ggttaaatctacagcccctgagact

SEQ ID NO: 531164 - DNA, 25 bp, Homo sapien
agcccctgagactgccattgagtgt

SEQ ID NO: 531165 - DNA, 25 bp, Homo sapien
gagactgccattgagtgtacacagg

SEQ ID NO: 531166 - DNA, 25 bp, Homo sapien
tgcctcagaggatgaaaaggtcgtt

SEQ ID NO: 531167 - DNA, 25 bp, Homo sapien
gaggatgaaaaggtcgttgttgaac

SEQ ID NO: 531168 - DNA, 25 bp, Homo sapien
tgaaggagagaacagaggaacctat

SEQ ID NO: 531169 - DNA, 25 bp, Homo sapien
aggaacctatggagacagagcccaa

SEQ ID NO: 531170 - DNA, 25 bp, Homo sapien
gtcagcaatagatctgacccctatt

SEQ ID NO: 531171 - DNA, 25 bp, Homo sapien
tagatctgacccctattgtggtaga

SEQ ID NO: 531172 - DNA, 25 bp, Homo sapien
tctgacccctattgtggtagaagac

SEQ ID NO: 531173 - DNA, 25 bp, Homo sapien
tgagcaacacgaccgccatcgccga

SEQ ID NO: 531174 - DNA, 25 bp, Homo sapien
tctccgaggcccgtgaggatatggc

SEQ ID NO: 531175 - DNA, 25 bp, Homo sapien
ctccgaggcccgtgaggatatggct

SEQ ID NO: 531176 - DNA, 25 bp, Homo sapien
attatgaggaggtgggcatcgactc

SEQ ID NO: 531177 - DNA, 25 bp, Homo sapien
aggaggtgggcatcgactcctatga

SEQ ID NO: 531178 - DNA, 25 bp, Homo sapien
aggtgggcatcgactcctatgagga

SEQ ID NO: 531179 - DNA, 25 bp, Homo sapien
gtgggcatcgactcctatgaggacg

SEQ ID NO: 531180 - DNA, 25 bp, Homo sapien
tgggcatcgactcctatgaggacga

SEQ ID NO: 531181 - DNA, 25 bp, Homo sapien
ggcatcgactcctatgaggacgagg

SEQ ID NO: 531182 - DNA, 25 bp, Homo sapien
catcgactcctatgaggacgaggat

SEQ ID NO: 531183 - DNA, 25 bp, Homo sapien
atcgactcctatgaggacgaggatg

SEQ ID NO: 531184 - DNA, 25 bp, Homo sapien
gggatggaccctaggtgattcatag

SEQ ID NO: 531185 - DNA, 25 bp, Homo sapien
gaccctaggtgattcataggcacac

SEQ ID NO: 531186 - DNA, 25 bp, Homo sapien
ataggcacactgaaatctgagaacc

SEQ ID NO: 531187 - DNA, 25 bp, Homo sapien
gaaatctgagaaccaggtacaggaa

SEQ ID NO: 531188 - DNA, 25 bp, Homo sapien
cattgcttttggtaagaggctggac

SEQ ID NO: 531189 - DNA, 25 bp, Homo sapien
aatggatttctgtgagcaccacaga

SEQ ID NO: 531190 - DNA, 25 bp, Homo sapien
tttggtgaggtttagtaggactccg

SEQ ID NO: 531191 - DNA, 25 bp, Homo sapien
taggactccggaggaataacattcg

SEQ ID NO: 531192 - DNA, 25 bp, Homo sapien
aacattcgggaaggacaggatgtct

SEQ ID NO: 531193 - DNA, 25 bp, Homo sapien
caggatgtctgaactgtatgaccag

SEQ ID NO: 531194 - DNA, 25 bp, Homo sapien
gaactgtatgaccagtcctgtcctt

SEQ ID NO: 531195 - DNA, 25 bp, Homo sapien
ttgtggttgccccatattctgccct

SEQ ID NO: 531196 - DNA, 25 bp, Homo sapien
ttctgccctctgatccttaaccaat

SEQ ID NO: 531197 - DNA, 25 bp, Homo sapien
gagaacccgttaaaaatgagacatt

SEQ ID NO: 531198 - DNA, 25 bp, Homo sapien
gagacattgagccagtgctgttcac

SEQ ID NO: 531199 - DNA, 25 bp, Homo sapien
gagccagtgctgttcactttttaag

SEQ ID NO: 531200 - DNA, 25 bp, Homo sapien
ttttaagtgccaacttccctctact

SEQ ID NO: 531201 - DNA, 25 bp, Homo sapien
cctctactttccacttgtttatagt

SEQ ID NO: 531202 - DNA, 25 bp, Homo sapien
atagttgtttccagtgcctttagtt

SEQ ID NO: 531203 - DNA, 25 bp, Homo sapien
ttcagagtttgcagttgctatcagc

SEQ ID NO: 531204 - DNA, 25 bp, Homo sapien
cccttctgtgcctcctgtttttggg

SEQ ID NO: 531205 - DNA, 25 bp, Homo sapien
tttccccttttatgttccagctgtt

SEQ ID NO: 531206 - DNA, 25 bp, Homo sapien
ggctacacggtgtgcccctaatgtt

SEQ ID NO: 531207 - DNA, 25 bp, Homo sapien
ggtgtgcccctaatgttttatttat

SEQ ID NO: 531208 - DNA, 25 bp, Homo sapien
ttgttttttgtagggagggcatctc

SEQ ID NO: 531209 - DNA, 25 bp, Homo sapien
gagggcatctccctaggtgtctaga

SEQ ID NO: 531210 - DNA, 25 bp, Homo sapien
atctccctaggtgtctagactggtc

SEQ ID NO: 531211 - DNA, 25 bp, Homo sapien
ggtgtctagactggtctcaattcct

SEQ ID NO: 531212 - DNA, 25 bp, Homo sapien
accacactcggccatctttaaagat

SEQ ID NO: 531213 - DNA, 25 bp, Homo sapien
gtaagcttggagtcttgcattggca

SEQ ID NO: 531214 - DNA, 25 bp, Homo sapien
gagtcttgcattggcatcttctgaa

SEQ ID NO: 531215 - DNA, 25 bp, Homo sapien
acagagctcatcatgaccctttcaa

SEQ ID NO: 531216 - DNA, 25 bp, Homo sapien
ctcatcatgaccctttcaacatcta

SEQ ID NO: 531217 - DNA, 25 bp, Homo sapien
atttgaccaatttccagtgctctta

SEQ ID NO: 531218 - DNA, 25 bp, Homo sapien
agtgctcttagcattttacttaaag

SEQ ID NO: 531219 - DNA, 25 bp, Homo sapien
tgctttgcttcattaatgcctaaga

SEQ ID NO: 531220 - DNA, 25 bp, Homo sapien
gaacttaagaatactcctacctcat

SEQ ID NO: 531221 - DNA, 25 bp, Homo sapien
tactcctacctcattagctactcaa

SEQ ID NO: 531222 - DNA, 25 bp, Homo sapien
agctactcaagatgctgtgacgatc

SEQ ID NO: 531223 - DNA, 25 bp, Homo sapien
gatgctgtgacgatcaaatctattc

SEQ ID NO: 531224 - DNA, 25 bp, Homo sapien
aatctattctacataatgcgtttag

SEQ ID NO: 531225 - DNA, 25 bp, Homo sapien
agtatattctgacttggctattgag

SEQ ID NO: 531226 - DNA, 25 bp, Homo sapien
aattcagtattaagtgttcctcaca

SEQ ID NO: 531227 - DNA, 25 bp, Homo sapien
gttcctcacaggagatatgttagca

SEQ ID NO: 531228 - DNA, 25 bp, Homo sapien
agggcttcctgcatctgaagttcgc

SEQ ID NO: 531229 - DNA, 25 bp, Homo sapien
ttcctgcatctgaagttcgcgcgga

SEQ ID NO: 531230 - DNA, 25 bp, Homo sapien
gcatctgaagttcgcgcggacccgt

SEQ ID NO: 531231 - DNA, 25 bp, Homo sapien
agttcgcgcggacccgtgagaacca

SEQ ID NO: 531232 - DNA, 25 bp, Homo sapien
gtggtgctgggccaacacagcgggc

SEQ ID NO: 531233 - DNA, 25 bp, Homo sapien
agttcacgcccactgccggtgcagg

SEQ ID NO: 531234 - DNA, 25 bp, Homo sapien
tgcagggtgccgagcatctggctct

SEQ ID NO: 531235 - DNA, 25 bp, Homo sapien
agggtgccgagcatctggctctgct

SEQ ID NO: 531236 - DNA, 25 bp, Homo sapien
atctggctctgctgtaccccgtggt

SEQ ID NO: 531237 - DNA, 25 bp, Homo sapien
ccttttgagtcctcgggcccagaat

SEQ ID NO: 531238 - DNA, 25 bp, Homo sapien
tcgggcccagaatcgtatcccaaag

SEQ ID NO: 531239 - DNA, 25 bp, Homo sapien
atttctgtcccaagaaaggcaggat

SEQ ID NO: 531240 - DNA, 25 bp, Homo sapien
attcttggttatcagaatactcata

SEQ ID NO: 531241 - DNA, 25 bp, Homo sapien
ggttatcagaatactcatatagctt

SEQ ID NO: 531242 - DNA, 25 bp, Homo sapien
atcagaatactcatatagctttggg

SEQ ID NO: 531243 - DNA, 25 bp, Homo sapien
cagaatactcatatagctttgggat

SEQ ID NO: 531244 - DNA, 25 bp, Homo sapien
gaatactcatatagctttgggattt

SEQ ID NO: 531245 - DNA, 25 bp, Homo sapien
gtacagtctcagtcccataaaattg

SEQ ID NO: 531246 - DNA, 25 bp, Homo sapien
gcctacacacaggatctagaagaat

SEQ ID NO: 531247 - DNA, 25 bp, Homo sapien
tacacacaggatctagaagaatatg

SEQ ID NO: 531248 - DNA, 25 bp, Homo sapien
gaatgactttgttctttgcttgtgt

SEQ ID NO: 531249 - DNA, 25 bp, Homo sapien
tctttgcttgtgtttttcaatttcc

SEQ ID NO: 531250 - DNA, 25 bp, Homo sapien
tttcaagggcaaagaactcgtggga

SEQ ID NO: 531251 - DNA, 25 bp, Homo sapien
aagaactcgtgggaggatgtctgtt

SEQ ID NO: 531252 - DNA, 25 bp, Homo sapien
tgtatgtaatactcacaatggcttt

SEQ ID NO: 531253 - DNA, 25 bp, Homo sapien
aatactcacaatggcttttggttag

SEQ ID NO: 531254 - DNA, 25 bp, Homo sapien
acaatggcttttggttagtgttgaa

SEQ ID NO: 531255 - DNA, 25 bp, Homo sapien
gaagagcatttgtaggtccagaaga

SEQ ID NO: 531256 - DNA, 25 bp, Homo sapien
gcacgcacacatacaatctgggtta

SEQ ID NO: 531257 - DNA, 25 bp, Homo sapien
gcacacatacaatctgggttatctt

SEQ ID NO: 531258 - DNA, 25 bp, Homo sapien
caatctgggttatctttgtgctata

SEQ ID NO: 531259 - DNA, 25 bp, Homo sapien
ggttatctttgtgctatatagtgga

SEQ ID NO: 531260 - DNA, 25 bp, Homo sapien
gaattacattaaggagtgttcttta

SEQ ID NO: 531261 - DNA, 25 bp, Homo sapien
aggtttcccactgcggaacaggagt

SEQ ID NO: 531262 - DNA, 25 bp, Homo sapien
acaggagtgactctggctgccaaga

SEQ ID NO: 531263 - DNA, 25 bp, Homo sapien
tggctgccaagataccttcatggtg

SEQ ID NO: 531264 - DNA, 25 bp, Homo sapien
atggtgttcatgacaagtggaatca

SEQ ID NO: 531265 - DNA, 25 bp, Homo sapien
acaagtggaatcattattttcaacc

SEQ ID NO: 531266 - DNA, 25 bp, Homo sapien
tgcaggcaagacaccttcccagctg

SEQ ID NO: 531267 - DNA, 25 bp, Homo sapien
gcagtcctcggcagctccggaagga

SEQ ID NO: 531268 - DNA, 25 bp, Homo sapien
gggccgggcaaacactttggccaca

SEQ ID NO: 531269 - DNA, 25 bp, Homo sapien
caaacaagcgccaccgtgggagagg

SEQ ID NO: 531270 - DNA, 25 bp, Homo sapien
gaggctgctgtcactggtaccggat

SEQ ID NO: 531271 - DNA, 25 bp, Homo sapien
ctgtcactggtaccggatgcagacc

SEQ ID NO: 531272 - DNA, 25 bp, Homo sapien
aagtgcatgtcatttcttaatacac

SEQ ID NO: 531273 - DNA, 25 bp, Homo sapien
taaattaaagtacacaagtccaagt

SEQ ID NO: 531274 - DNA, 25 bp, Homo sapien
aaactttagtacttttccatgcaga

SEQ ID NO: 531275 - DNA, 25 bp, Homo sapien
tagtacttttccatgcagatttgtg

SEQ ID NO: 531276 - DNA, 25 bp, Homo sapien
ttccatgcagatttgtgcacatgtg

SEQ ID NO: 531277 - DNA, 25 bp, Homo sapien
tgcacatgtgagagggtgtccagtt

SEQ ID NO: 531278 - DNA, 25 bp, Homo sapien
tgtgagagggtgtccagtttgtcta

SEQ ID NO: 531279 - DNA, 25 bp, Homo sapien
gagggtgtccagtttgtctagtgat

SEQ ID NO: 531280 - DNA, 25 bp, Homo sapien
ggtgtccagtttgtctagtgattgt

SEQ ID NO: 531281 - DNA, 25 bp, Homo sapien
tgtccagtttgtctagtgattgtta

SEQ ID NO: 531282 - DNA, 25 bp, Homo sapien
gctgtttaagttgccaacctcccct

SEQ ID NO: 531283 - DNA, 25 bp, Homo sapien
actgagctattgaagtcccattaac

SEQ ID NO: 531284 - DNA, 25 bp, Homo sapien
gagctattgaagtcccattaactta

SEQ ID NO: 531285 - DNA, 25 bp, Homo sapien
ttgccattgctactattgcttgtcg

SEQ ID NO: 531286 - DNA, 25 bp, Homo sapien
cattgctactattgcttgtcggtgt

SEQ ID NO: 531287 - DNA, 25 bp, Homo sapien
actattgcttgtcggtgtattttat

SEQ ID NO: 531288 - DNA, 25 bp, Homo sapien
tgcttgtcggtgtattttattttat

SEQ ID NO: 531289 - DNA, 25 bp, Homo sapien
ccagggatcagaatatatttgtaag

SEQ ID NO: 531290 - DNA, 25 bp, Homo sapien
tttctgtttacatgtccttgctact

SEQ ID NO: 531291 - DNA, 25 bp, Homo sapien
ttacatgtccttgctacttttaaaa

SEQ ID NO: 531292 - DNA, 25 bp, Homo sapien
aaaaacttgcatttattcctcagat

SEQ ID NO: 531293 - DNA, 25 bp, Homo sapien
aacttgcatttattcctcagatttt

SEQ ID NO: 531294 - DNA, 25 bp, Homo sapien
tgggaaacatgcaccgagcaaatgt

SEQ ID NO: 531295 - DNA, 25 bp, Homo sapien
accgagcaaatgtgattagacttat

SEQ ID NO: 531296 - DNA, 25 bp, Homo sapien
ttagacttatggatgagcgagacct

SEQ ID NO: 531297 - DNA, 25 bp, Homo sapien
agcgagacctgcgactggttcaaag

SEQ ID NO: 531298 - DNA, 25 bp, Homo sapien
gaacctgcagagtatcagctcatga

SEQ ID NO: 531299 - DNA, 25 bp, Homo sapien
tgacaggattgcagatcctccagga

SEQ ID NO: 531300 - DNA, 25 bp, Homo sapien
gatggagaaggcgaaccccaaaact

SEQ ID NO: 531301 - DNA, 25 bp, Homo sapien
gaaaggaactgattttgtcttcaaa

SEQ ID NO: 531302 - DNA, 25 bp, Homo sapien
tattggacaacatgatttggacaca

SEQ ID NO: 531303 - DNA, 25 bp, Homo sapien
gactaaacagattcagcagtggatt

SEQ ID NO: 531304 - DNA, 25 bp, Homo sapien
aaacacctagtccagattaccataa

SEQ ID NO: 531305 - DNA, 25 bp, Homo sapien
gtattgttagatgtttgttgagctg

SEQ ID NO: 531306 - DNA, 25 bp, Homo sapien
tgttgagctggtaacatcgttgcaa

SEQ ID NO: 531307 - DNA, 25 bp, Homo sapien
tggtaacatcgttgcaaccactgca

SEQ ID NO: 531308 - DNA, 25 bp, Homo sapien
gcaatatcttcgttagtaatctgta

SEQ ID NO: 531309 - DNA, 25 bp, Homo sapien
ctttgtatacaagtactggtaagat

SEQ ID NO: 531310 - DNA, 25 bp, Homo sapien
ttgttattaaatgtagcttcagtca

SEQ ID NO: 531311 - DNA, 25 bp, Homo sapien
tactatagcaaagtagtacttcttc

SEQ ID NO: 531312 - DNA, 25 bp, Homo sapien
atttacaatgtattaagcccacagt

SEQ ID NO: 531313 - DNA, 25 bp, Homo sapien
gtattaagcccacagtatattttat

SEQ ID NO: 531314 - DNA, 25 bp, Homo sapien
catctcatcatgtctattgtccaaa

SEQ ID NO: 531315 - DNA, 25 bp, Homo sapien
gtctattgtccaaagttacctggaa

SEQ ID NO: 531316 - DNA, 25 bp, Homo sapien
atgcctccaatatcgaggatcagtc

SEQ ID NO: 531317 - DNA, 25 bp, Homo sapien
ggatcagtctgagacagaagccaat

SEQ ID NO: 531318 - DNA, 25 bp, Homo sapien
gaagccaatgtgagtcttgcaagtt

SEQ ID NO: 531319 - DNA, 25 bp, Homo sapien
gaagacagccatctttgctttcaat

SEQ ID NO: 531320 - DNA, 25 bp, Homo sapien
ttcaatatttcccacgtcagtaaca

SEQ ID NO: 531321 - DNA, 25 bp, Homo sapien
ttcccacgtcagtaacaaggttcga

SEQ ID NO: 531322 - DNA, 25 bp, Homo sapien
gttcgaatcctagaactccttccag

SEQ ID NO: 531323 - DNA, 25 bp, Homo sapien
ttccagctcttacaactctgacgaa

SEQ ID NO: 531324 - DNA, 25 bp, Homo sapien
tcagctacctccacttcacaaagaa

SEQ ID NO: 531325 - DNA, 25 bp, Homo sapien
gccagtggctggaacctattcatta

SEQ ID NO: 531326 - DNA, 25 bp, Homo sapien
ttacaaatcagtagtactccacttt

SEQ ID NO: 531327 - DNA, 25 bp, Homo sapien
tgttcagtctcatctaaccttccaa

SEQ ID NO: 531328 - DNA, 25 bp, Homo sapien
ctcatctaaccttccaatgtctgat

SEQ ID NO: 531329 - DNA, 25 bp, Homo sapien
tctaaccttccaatgtctgatgttc

SEQ ID NO: 531330 - DNA, 25 bp, Homo sapien
ctgccaaattcctgcctgattctgg

SEQ ID NO: 531331 - DNA, 25 bp, Homo sapien
aaattcctgcctgattctgggtccg

SEQ ID NO: 531332 - DNA, 25 bp, Homo sapien
ctgcctgattctgggtccgtcctga

SEQ ID NO: 531333 - DNA, 25 bp, Homo sapien
tgggtccgtcctgacctccaaaggt

SEQ ID NO: 531334 - DNA, 25 bp, Homo sapien
gacctccaaaggtcagcttggtgct

SEQ ID NO: 531335 - DNA, 25 bp, Homo sapien
aaggtcagcttggtgcttgaggtct

SEQ ID NO: 531336 - DNA, 25 bp, Homo sapien
cttagcccctctgctgggtagagag

SEQ ID NO: 531337 - DNA, 25 bp, Homo sapien
tagcccctctgctgggtagagaggc

SEQ ID NO: 531338 - DNA, 25 bp, Homo sapien
aagtccaagtcctcgtcggtctcca

SEQ ID NO: 531339 - DNA, 25 bp, Homo sapien
agtccaagtcctcgtcggtctccag

SEQ ID NO: 531340 - DNA, 25 bp, Homo sapien
tcctcgtcggtctccagatctcgtt

SEQ ID NO: 531341 - DNA, 25 bp, Homo sapien
tcgtcggtctccagatctcgttcgc

SEQ ID NO: 531342 - DNA, 25 bp, Homo sapien
gtcggtctccagatctcgttcgcgg

SEQ ID NO: 531343 - DNA, 25 bp, Homo sapien
atctcgttcgcggtccaggtcccgg

SEQ ID NO: 531344 - DNA, 25 bp, Homo sapien
caggtcccggtctcggtccaggagt

SEQ ID NO: 531345 - DNA, 25 bp, Homo sapien
gtcccggtctcggtccaggagtcct

SEQ ID NO: 531346 - DNA, 25 bp, Homo sapien
cccagtgtccaagagggaatccaaa

SEQ ID NO: 531347 - DNA, 25 bp, Homo sapien
ccagtgtccaagagggaatccaaat

SEQ ID NO: 531348 - DNA, 25 bp, Homo sapien
caggtcgcgatcgaagagtcccccc

SEQ ID NO: 531349 - DNA, 25 bp, Homo sapien
gaagggcaggacatgctgtaccaat

SEQ ID NO: 531350 - DNA, 25 bp, Homo sapien
aatccctgaagctcactaatggcat

SEQ ID NO: 531351 - DNA, 25 bp, Homo sapien
gcatttggattttggccgaactacg

SEQ ID NO: 531352 - DNA, 25 bp, Homo sapien
gccgaactacgtatccagccaggaa

SEQ ID NO: 531353 - DNA, 25 bp, Homo sapien
aggaaaccccaattacacgctgtca

SEQ ID NO: 531354 - DNA, 25 bp, Homo sapien
gtcactgaagtgtagagctcctgaa

SEQ ID NO: 531355 - DNA, 25 bp, Homo sapien
agctcctgaagtctctcaatacatc

SEQ ID NO: 531356 - DNA, 25 bp, Homo sapien
atacatctatcaggtctacgacagc

SEQ ID NO: 531357 - DNA, 25 bp, Homo sapien
agtacccttcaaccatgctgtgatc

SEQ ID NO: 531358 - DNA, 25 bp, Homo sapien
gatcggtgcaagtcaagaactctta

SEQ ID NO: 531359 - DNA, 25 bp, Homo sapien
gaatctgaacacactgaggccacct

SEQ ID NO: 531360 - DNA, 25 bp, Homo sapien
ggtccctttatgagttattccttct

SEQ ID NO: 531361 - DNA, 25 bp, Homo sapien
cttctttcagttcatctcactggag

SEQ ID NO: 531362 - DNA, 25 bp, Homo sapien
gttcatctcactggagcacagccaa

SEQ ID NO: 531363 - DNA, 25 bp, Homo sapien
gcacagccaagatggacatgtttat

SEQ ID NO: 531364 - DNA, 25 bp, Homo sapien
acatgtttatggacagtgctctaga

SEQ ID NO: 531365 - DNA, 25 bp, Homo sapien
tggacagtgctctagatgtgaaaac

SEQ ID NO: 531366 - DNA, 25 bp, Homo sapien
gaataacgcaggtcccttttcttgg

SEQ ID NO: 531367 - DNA, 25 bp, Homo sapien
aaggcttgtactatggccatgacag

SEQ ID NO: 531368 - DNA, 25 bp, Homo sapien
gacagtgacattgccctcaccatga

SEQ ID NO: 531369 - DNA, 25 bp, Homo sapien
atgatccctctccaaagtggttgtc

SEQ ID NO: 531370 - DNA, 25 bp, Homo sapien
gtctttctttaccttgtgtcttctc

SEQ ID NO: 531371 - DNA, 25 bp, Homo sapien
tggaacttcattggcatccaccata

SEQ ID NO: 531372 - DNA, 25 bp, Homo sapien
cataacacgtttttcatctagcatt

SEQ ID NO: 531373 - DNA, 25 bp, Homo sapien
atcaggcctgttcagtccaagtagg

SEQ ID NO: 531374 - DNA, 25 bp, Homo sapien
ggaaagccatttggatgacatccag

SEQ ID NO: 531375 - DNA, 25 bp, Homo sapien
ggagtaatgatagtccatcctgctt

SEQ ID NO: 531376 - DNA, 25 bp, Homo sapien
gatagtccatcctgctttcttgaaa

SEQ ID NO: 531377 - DNA, 25 bp, Homo sapien
gatcaatctggtgacatggtcggtc

SEQ ID NO: 531378 - DNA, 25 bp, Homo sapien
ggttggaaagcacaataccaggtcc

SEQ ID NO: 531379 - DNA, 25 bp, Homo sapien
taggactgtaaggtgcctcggcgcc

SEQ ID NO: 531380 - DNA, 25 bp, Homo sapien
gcaggtccagcaatggaagcctcct

SEQ ID NO: 531381 - DNA, 25 bp, Homo sapien
agcctcctcccagggaattgggaat

SEQ ID NO: 531382 - DNA, 25 bp, Homo sapien
tgtcttgtgagctgatcgcttggag

SEQ ID NO: 531383 - DNA, 25 bp, Homo sapien
agctgatcgcttggagggtcctctt

SEQ ID NO: 531384 - DNA, 25 bp, Homo sapien
ttggagggtcctctttttatgttga

SEQ ID NO: 531385 - DNA, 25 bp, Homo sapien
ttttatgttgagttgctgcttcccg

SEQ ID NO: 531386 - DNA, 25 bp, Homo sapien
gttgagttgctgcttcccggcatgc

SEQ ID NO: 531387 - DNA, 25 bp, Homo sapien
gctaagatggtatagggactgtcat

SEQ ID NO: 531388 - DNA, 25 bp, Homo sapien
agggactgtcataccagtgaagaat

SEQ ID NO: 531389 - DNA, 25 bp, Homo sapien
gatatgatgacaaggttgatccact

SEQ ID NO: 531390 - DNA, 25 bp, Homo sapien
ggttgatccacttcaagaattgctt

SEQ ID NO: 531391 - DNA, 25 bp, Homo sapien
tcaagaattgcttgctttcaggaag

SEQ ID NO: 531392 - DNA, 25 bp, Homo sapien
gtgtttcaacaagccaactaaaata

SEQ ID NO: 531393 - DNA, 25 bp, Homo sapien
cttctctagacaacctgaaagcctc

SEQ ID NO: 531394 - DNA, 25 bp, Homo sapien
tgaaagcctcagtcagccaagtgga

SEQ ID NO: 531395 - DNA, 25 bp, Homo sapien
gtggaggcggacttgaaaatgctca

SEQ ID NO: 531396 - DNA, 25 bp, Homo sapien
gaaaatgctcaggactgctgtggac

SEQ ID NO: 531397 - DNA, 25 bp, Homo sapien
gacagtttggttgcatactcggtca

SEQ ID NO: 531398 - DNA, 25 bp, Homo sapien
gaacaatctggaatcagccaagggt

SEQ ID NO: 531399 - DNA, 25 bp, Homo sapien
gccaagggtttactagatgacctga

SEQ ID NO: 531400 - DNA, 25 bp, Homo sapien
atgacctgaggaatgatctggatag

SEQ ID NO: 531401 - DNA, 25 bp, Homo sapien
aggtctaaatgaattgcgtgtgcag

SEQ ID NO: 531402 - DNA, 25 bp, Homo sapien
gtgcagggcgcggatttaaagtcca

SEQ ID NO: 531403 - DNA, 25 bp, Homo sapien
taaagtccaatttctcatgaccaaa

SEQ ID NO: 531404 - DNA, 25 bp, Homo sapien
gtatctgggaagcaaaggtattcat

SEQ ID NO: 531405 - DNA, 25 bp, Homo sapien
ttcataatatgtcccatggccagct

SEQ ID NO: 531406 - DNA, 25 bp, Homo sapien
gccagctgcgagcagtatttaacta

SEQ ID NO: 531407 - DNA, 25 bp, Homo sapien
agtatttaactagacatgctgttgt

SEQ ID NO: 531408 - DNA, 25 bp, Homo sapien
gaacatgaatcaagccaaatactga

SEQ ID NO: 531409 - DNA, 25 bp, Homo sapien
aagccaaatactgatatagctattg

SEQ ID NO: 531410 - DNA, 25 bp, Homo sapien
atagctattgagagaaggttggcag

SEQ ID NO: 531411 - DNA, 25 bp, Homo sapien
gtgggagtgataatcttagctatag

SEQ ID NO: 531412 - DNA, 25 bp, Homo sapien
aaaactgattctgaaagctttcttt

SEQ ID NO: 531413 - DNA, 25 bp, Homo sapien
ttttcttctacatgtttctagcaca

SEQ ID NO: 531414 - DNA, 25 bp, Homo sapien
ttctagcacaaggactcaatttttt

SEQ ID NO: 531415 - DNA, 25 bp, Homo sapien
ataacttaatctcttcatgttcagt

SEQ ID NO: 531416 - DNA, 25 bp, Homo sapien
taacttaatctcttcatgttcagtt

SEQ ID NO: 531417 - DNA, 25 bp, Homo sapien
aacttaatctcttcatgttcagttt

SEQ ID NO: 531418 - DNA, 25 bp, Homo sapien
cttttctttgattatggtatgctta

SEQ ID NO: 531419 - DNA, 25 bp, Homo sapien
ttttctttgattatggtatgcttat

SEQ ID NO: 531420 - DNA, 25 bp, Homo sapien
tttctttgattatggtatgcttatt

SEQ ID NO: 531421 - DNA, 25 bp, Homo sapien
ttctttgattatggtatgcttattt

SEQ ID NO: 531422 - DNA, 25 bp, Homo sapien
ctttgattatggtatgcttatttgg

SEQ ID NO: 531423 - DNA, 25 bp, Homo sapien
ttgattatggtatgcttatttggaa

SEQ ID NO: 531424 - DNA, 25 bp, Homo sapien
tgattatggtatgcttatttggaaa

SEQ ID NO: 531425 - DNA, 25 bp, Homo sapien
tatggtatgcttatttggaaagtca

SEQ ID NO: 531426 - DNA, 25 bp, Homo sapien
ctctagtgctgcctatcaacttgtc

SEQ ID NO: 531427 - DNA, 25 bp, Homo sapien
tgcctatcaacttgtcccctttttt

SEQ ID NO: 531428 - DNA, 25 bp, Homo sapien
ttttcccaataacctgtcttccagg

SEQ ID NO: 531429 - DNA, 25 bp, Homo sapien
aataacctgtcttccaggtggtaca

SEQ ID NO: 531430 - DNA, 25 bp, Homo sapien
acctgtcttccaggtggtacagtta

SEQ ID NO: 531431 - DNA, 25 bp, Homo sapien
tggtttgcctcattgcctttgccac

SEQ ID NO: 531432 - DNA, 25 bp, Homo sapien
attgcctttgccacatctgaagttc

SEQ ID NO: 531433 - DNA, 25 bp, Homo sapien
ttgccacatctgaagttctcagcag

SEQ ID NO: 531434 - DNA, 25 bp, Homo sapien
tgaagttctcagcagcactacctta

SEQ ID NO: 531435 - DNA, 25 bp, Homo sapien
ttctcagcagcactaccttagactt

SEQ ID NO: 531436 - DNA, 25 bp, Homo sapien
tacgctaataaattgctgtggtgca

SEQ ID NO: 531437 - DNA, 25 bp, Homo sapien
aaaccagaaatcttggtagtggaag

SEQ ID NO: 531438 - DNA, 25 bp, Homo sapien
ccagaaatcttggtagtggaagaaa

SEQ ID NO: 531439 - DNA, 25 bp, Homo sapien
aaatgtgtaaggtcaccccaatcgg

SEQ ID NO: 531440 - DNA, 25 bp, Homo sapien
atgtgtaaggtcaccccaatcggta

SEQ ID NO: 531441 - DNA, 25 bp, Homo sapien
tgtgtaaggtcaccccaatcggtag

SEQ ID NO: 531442 - DNA, 25 bp, Homo sapien
gtaaggtcaccccaatcggtagatt

SEQ ID NO: 531443 - DNA, 25 bp, Homo sapien
taaggtcaccccaatcggtagattt

SEQ ID NO: 531444 - DNA, 25 bp, Homo sapien
tcaccccaatcggtagattttaatg

SEQ ID NO: 531445 - DNA, 25 bp, Homo sapien
ccaatcggtagattttaatgaacgt

SEQ ID NO: 531446 - DNA, 25 bp, Homo sapien
ctaagaattcaatgtaatggccaaa

SEQ ID NO: 531447 - DNA, 25 bp, Homo sapien
agaattcaatgtaatggccaaaagg

SEQ ID NO: 531448 - DNA, 25 bp, Homo sapien
gaagcagtggacatcagcagtagga

SEQ ID NO: 531449 - DNA, 25 bp, Homo sapien
gaatggctcaggtccaagaaggcta

SEQ ID NO: 531450 - DNA, 25 bp, Homo sapien
atgcctaccagacccggttgatgtg

SEQ ID NO: 531451 - DNA, 25 bp, Homo sapien
ggttgatgtgcttccccggatttac

SEQ ID NO: 531452 - DNA, 25 bp, Homo sapien
gcctgcacctctcgcttagggtaga

SEQ ID NO: 531453 - DNA, 25 bp, Homo sapien
tcgcttagggtagaggcctggcctc

SEQ ID NO: 531454 - DNA, 25 bp, Homo sapien
gtgaaggtcatgcttcagcactgcc

SEQ ID NO: 531455 - DNA, 25 bp, Homo sapien
cctccctgacagaggctctgatgat

SEQ ID NO: 531456 - DNA, 25 bp, Homo sapien
atgatgggatgctctgactcagact

SEQ ID NO: 531457 - DNA, 25 bp, Homo sapien
gctctgactcagactcaggtgagaa

SEQ ID NO: 531458 - DNA, 25 bp, Homo sapien
gaacagaatgctcttgcctagcagt

SEQ ID NO: 531459 - DNA, 25 bp, Homo sapien
atagggaaaccctgtatctatcaca

SEQ ID NO: 531460 - DNA, 25 bp, Homo sapien
tagggaaaccctgtatctatcacaa

SEQ ID NO: 531461 - DNA, 25 bp, Homo sapien
agggaaaccctgtatctatcacaaa

SEQ ID NO: 531462 - DNA, 25 bp, Homo sapien
gggaaaccctgtatctatcacaaaa

SEQ ID NO: 531463 - DNA, 25 bp, Homo sapien
ggaaaccctgtatctatcacaaaaa

SEQ ID NO: 531464 - DNA, 25 bp, Homo sapien
ccctgtatctatcacaaaaaaattt

SEQ ID NO: 531465 - DNA, 25 bp, Homo sapien
ggcacagcggcacacacacctgtag

SEQ ID NO: 531466 - DNA, 25 bp, Homo sapien
tgataatgccgctgccctgtggctt

SEQ ID NO: 531467 - DNA, 25 bp, Homo sapien
ccctgtggcttgggtgacagggtga

SEQ ID NO: 531468 - DNA, 25 bp, Homo sapien
tagatgcagcatctaggaccccaca

SEQ ID NO: 531469 - DNA, 25 bp, Homo sapien
gatgcagcatctaggaccccacaag

SEQ ID NO: 531470 - DNA, 25 bp, Homo sapien
cagcatctaggaccccacaagagaa

SEQ ID NO: 531471 - DNA, 25 bp, Homo sapien
tctaggaccccacaagagaatgagt

SEQ ID NO: 531472 - DNA, 25 bp, Homo sapien
gaccccacaagagaatgagtggctg

SEQ ID NO: 531473 - DNA, 25 bp, Homo sapien
tgctttccagctgggatgcacaggc

SEQ ID NO: 531474 - DNA, 25 bp, Homo sapien
ttccagctgggatgcacaggcccgg

SEQ ID NO: 531475 - DNA, 25 bp, Homo sapien
ggcccagtcccacattaaggcatgc

SEQ ID NO: 531476 - DNA, 25 bp, Homo sapien
agtcccacattaaggcatgcagcat

SEQ ID NO: 531477 - DNA, 25 bp, Homo sapien
ccacattaaggcatgcagcatccca

SEQ ID NO: 531478 - DNA, 25 bp, Homo sapien
taaggcatgcagcatcccatgcact

SEQ ID NO: 531479 - DNA, 25 bp, Homo sapien
caatatcatggagagctaactttag

SEQ ID NO: 531480 - DNA, 25 bp, Homo sapien
ctaactttagaaaactagctggagt

SEQ ID NO: 531481 - DNA, 25 bp, Homo sapien
ctagctggagtattttaggagattc

SEQ ID NO: 531482 - DNA, 25 bp, Homo sapien
ggagattctgggtcaagtaatgttt

SEQ ID NO: 531483 - DNA, 25 bp, Homo sapien
tagacactccccaaatttctaaatt

SEQ ID NO: 531484 - DNA, 25 bp, Homo sapien
ttttcagaaatatcgaaggagccaa

SEQ ID NO: 531485 - DNA, 25 bp, Homo sapien
agtggctatatcaacatcagggcta

SEQ ID NO: 531486 - DNA, 25 bp, Homo sapien
atcagggctagcacatctttctcta

SEQ ID NO: 531487 - DNA, 25 bp, Homo sapien
cacatctttctctattatccttcta

SEQ ID NO: 531488 - DNA, 25 bp, Homo sapien
ttatccttctattggaattctagta

SEQ ID NO: 531489 - DNA, 25 bp, Homo sapien
ggaattctagtattctgtattcaaa

SEQ ID NO: 531490 - DNA, 25 bp, Homo sapien
tggtttctaggttgcctgatgcttt

SEQ ID NO: 531491 - DNA, 25 bp, Homo sapien
tgatgctttccctgtatcagtgtaa

SEQ ID NO: 531492 - DNA, 25 bp, Homo sapien
tagaaaattccatcactccactaca

SEQ ID NO: 531493 - DNA, 25 bp, Homo sapien
atcactccactacaagacttggttt

SEQ ID NO: 531494 - DNA, 25 bp, Homo sapien
acttggttttcaggtctatcttgac

SEQ ID NO: 531495 - DNA, 25 bp, Homo sapien
ctatcttgaccatgccaaagccata

SEQ ID NO: 531496 - DNA, 25 bp, Homo sapien
aagccatatcctttgttgaagacat

SEQ ID NO: 531497 - DNA, 25 bp, Homo sapien
gttgaagacatccttagcagccttt

SEQ ID NO: 531498 - DNA, 25 bp, Homo sapien
gcctttcctaggtcacagtacgttg

SEQ ID NO: 531499 - DNA, 25 bp, Homo sapien
cacagtacgttggtgtgttacacat

SEQ ID NO: 531500 - DNA, 25 bp, Homo sapien
gaaaaatctctctcaggctcttatg

SEQ ID NO: 531501 - DNA, 25 bp, Homo sapien
gatgtttgactatttttgctgaagt

SEQ ID NO: 531502 - DNA, 25 bp, Homo sapien
tttagagtattgaatgtcttctctc

SEQ ID NO: 531503 - DNA, 25 bp, Homo sapien
tttcagctcctgtagccagagatca

SEQ ID NO: 531504 - DNA, 25 bp, Homo sapien
ctgtagccagagatcacaggtcttc

SEQ ID NO: 531505 - DNA, 25 bp, Homo sapien
gatcacaggtcttccctgtgaaact

SEQ ID NO: 531506 - DNA, 25 bp, Homo sapien
ttggtttctttctataaatgtgtgt

SEQ ID NO: 531507 - DNA, 25 bp, Homo sapien
gtgtgtggttttcagcgctcaactc

SEQ ID NO: 531508 - DNA, 25 bp, Homo sapien
caactcctgtcttcaaatggtagta

SEQ ID NO: 531509 - DNA, 25 bp, Homo sapien
ggtagtaagttctacttctacttct

SEQ ID NO: 531510 - DNA, 25 bp, Homo sapien
ttctacttctacttctgtcattcag

SEQ ID NO: 531511 - DNA, 25 bp, Homo sapien
gcatatttgtaactgaaggaagctt

SEQ ID NO: 531512 - DNA, 25 bp, Homo sapien
ccctgctttttctggtgtcctgaac

SEQ ID NO: 531513 - DNA, 25 bp, Homo sapien
ttttctggtgtcctgaacctggaag

SEQ ID NO: 531514 - DNA, 25 bp, Homo sapien
tgtcctgaacctggaagttgtgctt

SEQ ID NO: 531515 - DNA, 25 bp, Homo sapien
agtcttatgatgtaatcagcacgat

SEQ ID NO: 531516 - DNA, 25 bp, Homo sapien
gtaatcagcacgatttcacttcctg

SEQ ID NO: 531517 - DNA, 25 bp, Homo sapien
gcacgatttcacttcctgaatttcg

SEQ ID NO: 531518 - DNA, 25 bp, Homo sapien
ttcgatgaattctaagacatgggca

SEQ ID NO: 531519 - DNA, 25 bp, Homo sapien
tcatggtgaacttaccaaagcaaac

SEQ ID NO: 531520 - DNA, 25 bp, Homo sapien
agcagccaaccagtgaactcttttg

SEQ ID NO: 531521 - DNA, 25 bp, Homo sapien
gccaaccagtgaactcttttggtga

SEQ ID NO: 531522 - DNA, 25 bp, Homo sapien
gtgacatcctgttcttgttgtataa

SEQ ID NO: 531523 - DNA, 25 bp, Homo sapien
gaaggagttactctctaagaagcat

SEQ ID NO: 531524 - DNA, 25 bp, Homo sapien
ttactctctaagaagcatgctgcct

SEQ ID NO: 531525 - DNA, 25 bp, Homo sapien
gaagcatgctgcctatgcttggcct

SEQ ID NO: 531526 - DNA, 25 bp, Homo sapien
tgcttggcctttctataaaccagtg

SEQ ID NO: 531527 - DNA, 25 bp, Homo sapien
ggcctttctataaaccagtggatgc

SEQ ID NO: 531528 - DNA, 25 bp, Homo sapien
aaaccagtggatgcttctgcacttg

SEQ ID NO: 531529 - DNA, 25 bp, Homo sapien
atgcttctgcacttggcctgcatga

SEQ ID NO: 531530 - DNA, 25 bp, Homo sapien
ttggcctgcatgactaccatgacat

SEQ ID NO: 531531 - DNA, 25 bp, Homo sapien
gcatgactaccatgacatcattaag

SEQ ID NO: 531532 - DNA, 25 bp, Homo sapien
agaaccgtgattaccgggatgcaca

SEQ ID NO: 531533 - DNA, 25 bp, Homo sapien
gtgattaccgggatgcacaggagtt

SEQ ID NO: 531534 - DNA, 25 bp, Homo sapien
aaagcttctacctttgaattgtaat

SEQ ID NO: 531535 - DNA, 25 bp, Homo sapien
gaaaatgtcaggtaaacttggctta

SEQ ID NO: 531536 - DNA, 25 bp, Homo sapien
gtcaggtaaacttggcttataaatt

SEQ ID NO: 531537 - DNA, 25 bp, Homo sapien
tttagagagattgtgaaacctgagt

SEQ ID NO: 531538 - DNA, 25 bp, Homo sapien
gtgaaacctgagtattttacccaat

SEQ ID NO: 531539 - DNA, 25 bp, Homo sapien
attttacccaatcctctgaaattag

SEQ ID NO: 531540 - DNA, 25 bp, Homo sapien
tacccaatcctctgaaattagtccc

SEQ ID NO: 531541 - DNA, 25 bp, Homo sapien
aatcctctgaaattagtccctagca

SEQ ID NO: 531542 - DNA, 25 bp, Homo sapien
gaaattagtccctagcatcagaatt

SEQ ID NO: 531543 - DNA, 25 bp, Homo sapien
attagtccctagcatcagaattaaa

SEQ ID NO: 531544 - DNA, 25 bp, Homo sapien
gtccctagcatcagaattaaagaat

SEQ ID NO: 531545 - DNA, 25 bp, Homo sapien
aaggtgaaacactgctgagtccttt

SEQ ID NO: 531546 - DNA, 25 bp, Homo sapien
caagttcctgaagcctgtggagctg

SEQ ID NO: 531547 - DNA, 25 bp, Homo sapien
gaagcctgtggagctgcgcttacca

SEQ ID NO: 531548 - DNA, 25 bp, Homo sapien
gtggagctgcgcttaccacactgtg

SEQ ID NO: 531549 - DNA, 25 bp, Homo sapien
gtgatcctaaaacctggcaaaacaa

SEQ ID NO: 531550 - DNA, 25 bp, Homo sapien
aacaagtgtcttcccggagatccaa

SEQ ID NO: 531551 - DNA, 25 bp, Homo sapien
gtgtcttcccggagatccaaattat

SEQ ID NO: 531552 - DNA, 25 bp, Homo sapien
ggagatccaaattatctcgttggag

SEQ ID NO: 531553 - DNA, 25 bp, Homo sapien
atctcgttggagcaaactgtgtttc

SEQ ID NO: 531554 - DNA, 25 bp, Homo sapien
aaactgtgtttctgtccttattgac

SEQ ID NO: 531555 - DNA, 25 bp, Homo sapien
gtccttattgaccacttttaactct

SEQ ID NO: 531556 - DNA, 25 bp, Homo sapien
tgcttctggtaaaatggccagtact

SEQ ID NO: 531557 - DNA, 25 bp, Homo sapien
aatggccagtacttttcatatgtgt

SEQ ID NO: 531558 - DNA, 25 bp, Homo sapien
ttttcatatgtgttggccttcacct

SEQ ID NO: 531559 - DNA, 25 bp, Homo sapien
atatgtgttggccttcacctcgatg

SEQ ID NO: 531560 - DNA, 25 bp, Homo sapien
gttggccttcacctcgatggtgaac

SEQ ID NO: 531561 - DNA, 25 bp, Homo sapien
acctcgatggtgaacggtggaacac

SEQ ID NO: 531562 - DNA, 25 bp, Homo sapien
gaacggtggaacacaggcgttttct

SEQ ID NO: 531563 - DNA, 25 bp, Homo sapien
aggcgttttctgctctgcccactat

SEQ ID NO: 531564 - DNA, 25 bp, Homo sapien
gggtcccattcgttgtaagaagaga

SEQ ID NO: 531565 - DNA, 25 bp, Homo sapien
aatttcagcaacagcctttttcaaa

SEQ ID NO: 531566 - DNA, 25 bp, Homo sapien
agcaacagcctttttcaaatgatct

SEQ ID NO: 531567 - DNA, 25 bp, Homo sapien
tttgtactgtaggtgtgctcctgag

SEQ ID NO: 531568 - DNA, 25 bp, Homo sapien
ctgtaggtgtgctcctgagaaaatt

SEQ ID NO: 531569 - DNA, 25 bp, Homo sapien
gagaaaattagaagcaggcattcga

SEQ ID NO: 531570 - DNA, 25 bp, Homo sapien
caggcattcgaggaatcagtcatgt

SEQ ID NO: 531571 - DNA, 25 bp, Homo sapien
tggtagtactgcgtgatgttgttca

SEQ ID NO: 531572 - DNA, 25 bp, Homo sapien
gcgtgatgttgttcaggcttatcct

SEQ ID NO: 531573 - DNA, 25 bp, Homo sapien
ggcttatcctgaagttcgcattgtt

SEQ ID NO: 531574 - DNA, 25 bp, Homo sapien
tattgataccagcatgttttgtgaa

SEQ ID NO: 531575 - DNA, 25 bp, Homo sapien
taccagcatgttttgtgaatatttc

SEQ ID NO: 531576 - DNA, 25 bp, Homo sapien
ggaggacttacccagttcaagaata

SEQ ID NO: 531577 - DNA, 25 bp, Homo sapien
ttctggaagactgcattcagatgac

SEQ ID NO: 531578 - DNA, 25 bp, Homo sapien
gtctcctccctgtcgggtctggctg

SEQ ID NO: 531579 - DNA, 25 bp, Homo sapien
aggccccatgctcgtgatgtatgtt

SEQ ID NO: 531580 - DNA, 25 bp, Homo sapien
ccatgctcgtgatgtatgttgcaga

SEQ ID NO: 531581 - DNA, 25 bp, Homo sapien
atgtatgttgcagatcattttcccc

SEQ ID NO: 531582 - DNA, 25 bp, Homo sapien
atgttgcagatcattttcccccatt

SEQ ID NO: 531583 - DNA, 25 bp, Homo sapien
aaaagcacataacataaactgtacc

SEQ ID NO: 531584 - DNA, 25 bp, Homo sapien
aaccatttgaaagtatatatcccag

SEQ ID NO: 531585 - DNA, 25 bp, Homo sapien
gaaagtatatatcccagactgtctt

SEQ ID NO: 531586 - DNA, 25 bp, Homo sapien
tcccagactgtcttttatctttaga

SEQ ID NO: 531587 - DNA, 25 bp, Homo sapien
ttatctttagacttcacttgtggtt

SEQ ID NO: 531588 - DNA, 25 bp, Homo sapien
tagacttcacttgtggtttgttgcc

SEQ ID NO: 531589 - DNA, 25 bp, Homo sapien
tcctacgcagatgctgtcactggca

SEQ ID NO: 531590 - DNA, 25 bp, Homo sapien
agatgctgtcactggcagagcacag

SEQ ID NO: 531591 - DNA, 25 bp, Homo sapien
gggatcacagcgtttcaggaacgtt

SEQ ID NO: 531592 - DNA, 25 bp, Homo sapien
gtttcaggaacgttgccacaccaat

SEQ ID NO: 531593 - DNA, 25 bp, Homo sapien
gaacgttgccacaccaatcagagag

SEQ ID NO: 531594 - DNA, 25 bp, Homo sapien
ttgccacaccaatcagagagcctag

SEQ ID NO: 531595 - DNA, 25 bp, Homo sapien
gagagcctagaacatccctgggcaa

SEQ ID NO: 531596 - DNA, 25 bp, Homo sapien
ctagaacatccctgggcaagtggat

SEQ ID NO: 531597 - DNA, 25 bp, Homo sapien
acatccctgggcaagtggatggccc

SEQ ID NO: 531598 - DNA, 25 bp, Homo sapien
tggagcccgcttcaagctctctgtt

SEQ ID NO: 531599 - DNA, 25 bp, Homo sapien
gcatttctcatgcttcttctcatgg

SEQ ID NO: 531600 - DNA, 25 bp, Homo sapien
gattatctctcaggagttctaattc

SEQ ID NO: 531601 - DNA, 25 bp, Homo sapien
aattcttgccagtgaactgtcgagg

SEQ ID NO: 531602 - DNA, 25 bp, Homo sapien
gaactgtcgaggctgtctgtcaaca

SEQ ID NO: 531603 - DNA, 25 bp, Homo sapien
ctgtctgtcaacagcgtgactgctg

SEQ ID NO: 531604 - DNA, 25 bp, Homo sapien
gtgactgctggagactactcccgac

SEQ ID NO: 531605 - DNA, 25 bp, Homo sapien
aatgagctggattccggttttcgcc

SEQ ID NO: 531606 - DNA, 25 bp, Homo sapien
tttcgccttctcaacctgaaaaatg

SEQ ID NO: 531607 - DNA, 25 bp, Homo sapien
aaatgactccctgaggaagcgctac

SEQ ID NO: 531608 - DNA, 25 bp, Homo sapien
ggaagcgctacgacggattgaaata

SEQ ID NO: 531609 - DNA, 25 bp, Homo sapien
ggaagtggtctatgatctctccatc

SEQ ID NO: 531610 - DNA, 25 bp, Homo sapien
gagacggcagcagcttgtgttgaaa

SEQ ID NO: 531611 - DNA, 25 bp, Homo sapien
taatgaacgttgtggaatgttggga

SEQ ID NO: 531612 - DNA, 25 bp, Homo sapien
ggatggttaaggtgaatgccgaaat

SEQ ID NO: 531613 - DNA, 25 bp, Homo sapien
gatggttaaggtgaatgccgaaatt

SEQ ID NO: 531614 - DNA, 25 bp, Homo sapien
atggttaaggtgaatgccgaaattc

SEQ ID NO: 531615 - DNA, 25 bp, Homo sapien
tggttaaggtgaatgccgaaattca

SEQ ID NO: 531616 - DNA, 25 bp, Homo sapien
ggttaaggtgaatgccgaaattcat

SEQ ID NO: 531617 - DNA, 25 bp, Homo sapien
gttaaggtgaatgccgaaattcatt

SEQ ID NO: 531618 - DNA, 25 bp, Homo sapien
aaggtgaatgccgaaattcattaag

SEQ ID NO: 531619 - DNA, 25 bp, Homo sapien
aggtgaatgccgaaattcattaagt

SEQ ID NO: 531620 - DNA, 25 bp, Homo sapien
ggtgaatgccgaaattcattaagtc

SEQ ID NO: 531621 - DNA, 25 bp, Homo sapien
gtgaatgccgaaattcattaagtcc

SEQ ID NO: 531622 - DNA, 25 bp, Homo sapien
gatcaagtaaatacaccagcagttg

SEQ ID NO: 531623 - DNA, 25 bp, Homo sapien
atacaccagcagttgtcattcaatg

SEQ ID NO: 531624 - DNA, 25 bp, Homo sapien
ccagcagttgtcattcaatgcaggt

SEQ ID NO: 531625 - DNA, 25 bp, Homo sapien
cattcaatgcaggtttttgtactta

SEQ ID NO: 531626 - DNA, 25 bp, Homo sapien
gcaggtttttgtacttaattatatg

SEQ ID NO: 531627 - DNA, 25 bp, Homo sapien
gcagaaacggaaattgacctccccg

SEQ ID NO: 531628 - DNA, 25 bp, Homo sapien
ggaaattgacctccccgccatgtgt

SEQ ID NO: 531629 - DNA, 25 bp, Homo sapien
acctccccgccatgtgtttaatatt

SEQ ID NO: 531630 - DNA, 25 bp, Homo sapien
attttcttgataatcgtaagccttg

SEQ ID NO: 531631 - DNA, 25 bp, Homo sapien
gtaagccttgagagtgtttgtgaaa

SEQ ID NO: 531632 - DNA, 25 bp, Homo sapien
aattgtggttatgaaactaatttgc

SEQ ID NO: 531633 - DNA, 25 bp, Homo sapien
attcactgatttcttagacactcta

SEQ ID NO: 531634 - DNA, 25 bp, Homo sapien
gacactctaatatgatatgctttct

SEQ ID NO: 531635 - DNA, 25 bp, Homo sapien
aagtacttgagaccaaggccagcat

SEQ ID NO: 531636 - DNA, 25 bp, Homo sapien
aggccagcatcaattccagacatct

SEQ ID NO: 531637 - DNA, 25 bp, Homo sapien
gacatcttcatgttcctaataggct

SEQ ID NO: 531638 - DNA, 25 bp, Homo sapien
ttttctcatctgtaccttatatctc

SEQ ID NO: 531639 - DNA, 25 bp, Homo sapien
ctcatctgtaccttatatctcataa

SEQ ID NO: 531640 - DNA, 25 bp, Homo sapien
attttatgtcagtagcttagctgtt

SEQ ID NO: 531641 - DNA, 25 bp, Homo sapien
tcagtagcttagctgtttattgtct

SEQ ID NO: 531642 - DNA, 25 bp, Homo sapien
gtaaacttcaatgttctatctggaa

SEQ ID NO: 531643 - DNA, 25 bp, Homo sapien
ttcaatgttctatctggaagcagaa

SEQ ID NO: 531644 - DNA, 25 bp, Homo sapien
gacagtgaaaaactgcttggccctg

SEQ ID NO: 531645 - DNA, 25 bp, Homo sapien
cttggccctggctgatgataagaag

SEQ ID NO: 531646 - DNA, 25 bp, Homo sapien
attgcatttccatccatcggcagcg

SEQ ID NO: 531647 - DNA, 25 bp, Homo sapien
atcggcagcggcaggaacggttttc

SEQ ID NO: 531648 - DNA, 25 bp, Homo sapien
agctgattctgaaggccatctccag

SEQ ID NO: 531649 - DNA, 25 bp, Homo sapien
aaggccatctccagttacttcgtgt

SEQ ID NO: 531650 - DNA, 25 bp, Homo sapien
ctccagttacttcgtgtctacaatg

SEQ ID NO: 531651 - DNA, 25 bp, Homo sapien
aatgtcctcttccatcaaaacggtg

SEQ ID NO: 531652 - DNA, 25 bp, Homo sapien
tcaaaacggtgtacttcgtgctttt

SEQ ID NO: 531653 - DNA, 25 bp, Homo sapien
cgagagtataggcatctatgtgcag

SEQ ID NO: 531654 - DNA, 25 bp, Homo sapien
tgagcaatgacagaaccagctgcac

SEQ ID NO: 531655 - DNA, 25 bp, Homo sapien
ggtatcgttgtcatggcagacccca

SEQ ID NO: 531656 - DNA, 25 bp, Homo sapien
tggcagaccccaaagggaaggccta

SEQ ID NO: 531657 - DNA, 25 bp, Homo sapien
ttgtttgaaagtaccaccagtgaat

SEQ ID NO: 531658 - DNA, 25 bp, Homo sapien
accagtgaatctgtcttctgtctct

SEQ ID NO: 531659 - DNA, 25 bp, Homo sapien
ccgtgacacacagagcaggcatgga

SEQ ID NO: 531660 - DNA, 25 bp, Homo sapien
tgttctggacagacacttgtacatg

SEQ ID NO: 531661 - DNA, 25 bp, Homo sapien
atcactactgtggatactacaagac

SEQ ID NO: 531662 - DNA, 25 bp, Homo sapien
aaatcgtatgttgtcattctctggc

SEQ ID NO: 531663 - DNA, 25 bp, Homo sapien
tatgttgtcattctctggctatgga

SEQ ID NO: 531664 - DNA, 25 bp, Homo sapien
ggctatggagtgtttgtggccttca

SEQ ID NO: 531665 - DNA, 25 bp, Homo sapien
acaggaaccaataaatccctcagag

SEQ ID NO: 531666 - DNA, 25 bp, Homo sapien
ggagacagagtttacaagataagga

SEQ ID NO: 531667 - DNA, 25 bp, Homo sapien
atatatatgtagtatgctgcaagtt

SEQ ID NO: 531668 - DNA, 25 bp, Homo sapien
tgtagtatgctgcaagttaactgct

SEQ ID NO: 531669 - DNA, 25 bp, Homo sapien
agttaactgctgtgtgggaaatcca

SEQ ID NO: 531670 - DNA, 25 bp, Homo sapien
tgtgatttgaattgagggccacact

SEQ ID NO: 531671 - DNA, 25 bp, Homo sapien
tgcccaggtcgtgctccgtcaaggg

SEQ ID NO: 531672 - DNA, 25 bp, Homo sapien
cagctggaggcaacagcacatgcaa

SEQ ID NO: 531673 - DNA, 25 bp, Homo sapien
tggaggcaacagcacatgcaaaggc

SEQ ID NO: 531674 - DNA, 25 bp, Homo sapien
tgagccaggatgtgctgcaataagg

SEQ ID NO: 531675 - DNA, 25 bp, Homo sapien
gatgtgctgcaataagggccactga

SEQ ID NO: 531676 - DNA, 25 bp, Homo sapien
tgtgctgcaataagggccactgagg

SEQ ID NO: 531677 - DNA, 25 bp, Homo sapien
atgtcccagccttgatctgtctgct

SEQ ID NO: 531678 - DNA, 25 bp, Homo sapien
tcctactcctcacatctggaggatt

SEQ ID NO: 531679 - DNA, 25 bp, Homo sapien
tgcttgcgacctgctgagggcttgt

SEQ ID NO: 531680 - DNA, 25 bp, Homo sapien
aggccagatgtgtagcttcgggtat

SEQ ID NO: 531681 - DNA, 25 bp, Homo sapien
ttcgggtatcagaggaggctgacct

SEQ ID NO: 531682 - DNA, 25 bp, Homo sapien
gaacttcagtgagactaagggaccc

SEQ ID NO: 531683 - DNA, 25 bp, Homo sapien
cccatcctagggatcttgtcagggt

SEQ ID NO: 531684 - DNA, 25 bp, Homo sapien
agggatcttgtcagggttccttact

SEQ ID NO: 531685 - DNA, 25 bp, Homo sapien
tcagggttccttactgaccagagga

SEQ ID NO: 531686 - DNA, 25 bp, Homo sapien
ttactgaccagaggagcccgcagca

SEQ ID NO: 531687 - DNA, 25 bp, Homo sapien
agaggagcccgcagcaatctccaca

SEQ ID NO: 531688 - DNA, 25 bp, Homo sapien
ttatattccgtattcttacaagaag

SEQ ID NO: 531689 - DNA, 25 bp, Homo sapien
gtaatatattcactattcgttaggt

SEQ ID NO: 531690 - DNA, 25 bp, Homo sapien
ttcgttaggtagaagtgaatcatcc

SEQ ID NO: 531691 - DNA, 25 bp, Homo sapien
catcttcacgctgagtagtctgagg

SEQ ID NO: 531692 - DNA, 25 bp, Homo sapien
gagcaagaggagttggtctttctgt

SEQ ID NO: 531693 - DNA, 25 bp, Homo sapien
ttggtctttctgtcccagtggcaga

SEQ ID NO: 531694 - DNA, 25 bp, Homo sapien
tttctgtcccagtggcagaggtgga

SEQ ID NO: 531695 - DNA, 25 bp, Homo sapien
gaaaatccacagatacgtggacctg

SEQ ID NO: 531696 - DNA, 25 bp, Homo sapien
gatacgtggacctgcgcagttcaaa

SEQ ID NO: 531697 - DNA, 25 bp, Homo sapien
ttgtttgggtcaactgtattgtaat

SEQ ID NO: 531698 - DNA, 25 bp, Homo sapien
ttttctcagacttttacgagtatga

SEQ ID NO: 531699 - DNA, 25 bp, Homo sapien
aacacacaaggcctgatcttcgtgg

SEQ ID NO: 531700 - DNA, 25 bp, Homo sapien
cacacaaggcctgatcttcgtggtg

SEQ ID NO: 531701 - DNA, 25 bp, Homo sapien
ttcgtggtggacagcaatgacagag

SEQ ID NO: 531702 - DNA, 25 bp, Homo sapien
tggacagcaatgacagagagcgtgt

SEQ ID NO: 531703 - DNA, 25 bp, Homo sapien
gcaatgacagagagcgtgtgaacga

SEQ ID NO: 531704 - DNA, 25 bp, Homo sapien
tgaacgaggcccgtgaggagctcat

SEQ ID NO: 531705 - DNA, 25 bp, Homo sapien
aacgaggcccgtgaggagctcatga

SEQ ID NO: 531706 - DNA, 25 bp, Homo sapien
catgaggatgctggccgaggacgag

SEQ ID NO: 531707 - DNA, 25 bp, Homo sapien
aacgccatgaatgcggccgagatca

SEQ ID NO: 531708 - DNA, 25 bp, Homo sapien
tgaatgcggccgagatcacagacaa

SEQ ID NO: 531709 - DNA, 25 bp, Homo sapien
ggctgcactcactacgccacaggaa

SEQ ID NO: 531710 - DNA, 25 bp, Homo sapien
agctcaggggcagctcatagagtcc

SEQ ID NO: 531711 - DNA, 25 bp, Homo sapien
tctagggttgctggagcctgagtca

SEQ ID NO: 531712 - DNA, 25 bp, Homo sapien
agagatggacagttcacaccctgca

SEQ ID NO: 531713 - DNA, 25 bp, Homo sapien
atggacagttcacaccctgcaaggc

SEQ ID NO: 531714 - DNA, 25 bp, Homo sapien
tgcaaggcccacaggaggcaagcaa

SEQ ID NO: 531715 - DNA, 25 bp, Homo sapien
gaggcaagcaagctctcttgccgag

SEQ ID NO: 531716 - DNA, 25 bp, Homo sapien
gcaagcaagctctcttgccgaggag

SEQ ID NO: 531717 - DNA, 25 bp, Homo sapien
agctctcttgccgaggagccaggca

SEQ ID NO: 531718 - DNA, 25 bp, Homo sapien
tgccgaggagccaggcaacttcagt

SEQ ID NO: 531719 - DNA, 25 bp, Homo sapien
aggcaacttcagtcctgggagaccc

SEQ ID NO: 531720 - DNA, 25 bp, Homo sapien
aacttcagtcctgggagacccatgt

SEQ ID NO: 531721 - DNA, 25 bp, Homo sapien
ggtgcgaggaagattattgctaatt

SEQ ID NO: 531722 - DNA, 25 bp, Homo sapien
aataaagagtctagccctctccttt

SEQ ID NO: 531723 - DNA, 25 bp, Homo sapien
tagccctctccttttaatgaactta

SEQ ID NO: 531724 - DNA, 25 bp, Homo sapien
aatgaacttaactctcgctggcatc

SEQ ID NO: 531725 - DNA, 25 bp, Homo sapien
tctcgctggcatctgtagtatcatt

SEQ ID NO: 531726 - DNA, 25 bp, Homo sapien
gtatcattgggagcttaggcgcaca

SEQ ID NO: 531727 - DNA, 25 bp, Homo sapien
gagcttaggcgcacatggaaatgag

SEQ ID NO: 531728 - DNA, 25 bp, Homo sapien
gagagcccggcgcatggattttaat

SEQ ID NO: 531729 - DNA, 25 bp, Homo sapien
tgtttttctaacaactgtggagatt

SEQ ID NO: 531730 - DNA, 25 bp, Homo sapien
atacctagtttacttgccagtctct

SEQ ID NO: 531731 - DNA, 25 bp, Homo sapien
cttgccagtctcttgtgtaaattac

SEQ ID NO: 531732 - DNA, 25 bp, Homo sapien
ggtgcggctgagtctctgagctcca

SEQ ID NO: 531733 - DNA, 25 bp, Homo sapien
tctctgagctccatgcctggcaaga

SEQ ID NO: 531734 - DNA, 25 bp, Homo sapien
tgcctggcaagaatgcagtcaccct

SEQ ID NO: 531735 - DNA, 25 bp, Homo sapien
tggcaagaatgcagtcaccctgcgg

SEQ ID NO: 531736 - DNA, 25 bp, Homo sapien
tgaaactggccctgcgtcatggagc

SEQ ID NO: 531737 - DNA, 25 bp, Homo sapien
tgcgtcatggagctgacctggttcc

SEQ ID NO: 531738 - DNA, 25 bp, Homo sapien
atggagctgacctggttcccatcta

SEQ ID NO: 531739 - DNA, 25 bp, Homo sapien
gttcccatctactcctttggagaga

SEQ ID NO: 531740 - DNA, 25 bp, Homo sapien
aagtgtacaagcaggtgatcttcga

SEQ ID NO: 531741 - DNA, 25 bp, Homo sapien
gaaatacattggtttcgccccatgc

SEQ ID NO: 531742 - DNA, 25 bp, Homo sapien
atgcatcttccatggtcgaggcctc

SEQ ID NO: 531743 - DNA, 25 bp, Homo sapien
actgggaaatcaaaatggtcaccgt

SEQ ID NO: 531744 - DNA, 25 bp, Homo sapien
aatggtcaccgtagagtttgcagat

SEQ ID NO: 531745 - DNA, 25 bp, Homo sapien
tttgcagatgaagtacgattgtcct

SEQ ID NO: 531746 - DNA, 25 bp, Homo sapien
ttgtccttcatttgtactgaagtag

SEQ ID NO: 531747 - DNA, 25 bp, Homo sapien
gattgcaaagtggttcatgaattca

SEQ ID NO: 531748 - DNA, 25 bp, Homo sapien
tcattggtggctacatatttctctc

SEQ ID NO: 531749 - DNA, 25 bp, Homo sapien
acatatttctctcaacacgtgcaaa

SEQ ID NO: 531750 - DNA, 25 bp, Homo sapien
gatgttctacaaacttaccagtggt

SEQ ID NO: 531751 - DNA, 25 bp, Homo sapien
tgtttaatgaaactccacggccata

SEQ ID NO: 531752 - DNA, 25 bp, Homo sapien
tccacggccataacaatatttaact

SEQ ID NO: 531753 - DNA, 25 bp, Homo sapien
gctgtttgttatatgctgcttaata

SEQ ID NO: 531754 - DNA, 25 bp, Homo sapien
aaaccatcttatttgaactgagagc

SEQ ID NO: 531755 - DNA, 25 bp, Homo sapien
gagagcatccagagcagttaacctt

SEQ ID NO: 531756 - DNA, 25 bp, Homo sapien
gagcagttaaccttaaggaaacaat

SEQ ID NO: 531757 - DNA, 25 bp, Homo sapien
tgaaaaactccctttgtatgcctgg

SEQ ID NO: 531758 - DNA, 25 bp, Homo sapien
aaactccctttgtatgcctgggcat

SEQ ID NO: 531759 - DNA, 25 bp, Homo sapien
tgttagaggagaaaactgctgctga

SEQ ID NO: 531760 - DNA, 25 bp, Homo sapien
gagagtattggcaggcttggcctca

SEQ ID NO: 531761 - DNA, 25 bp, Homo sapien
attggcaggcttggcctcagtttgg

SEQ ID NO: 531762 - DNA, 25 bp, Homo sapien
gtaattttctttggacccaagtctg

SEQ ID NO: 531763 - DNA, 25 bp, Homo sapien
tttggacccaagtctgtaacctctg

SEQ ID NO: 531764 - DNA, 25 bp, Homo sapien
tgtaacctctgcgtacttcttctct

SEQ ID NO: 531765 - DNA, 25 bp, Homo sapien
tcaatgcagtgaggctctctgggtg

SEQ ID NO: 531766 - DNA, 25 bp, Homo sapien
gaggctctctgggtgaggctcccaa

SEQ ID NO: 531767 - DNA, 25 bp, Homo sapien
ggtgaggctcccaacctggcagtcc

SEQ ID NO: 531768 - DNA, 25 bp, Homo sapien
tcccagcatctgtgagcgtctgttg

SEQ ID NO: 531769 - DNA, 25 bp, Homo sapien
atctgtgagcgtctgttggacttta

SEQ ID NO: 531770 - DNA, 25 bp, Homo sapien
gttggactttacagaagagcctcat

SEQ ID NO: 531771 - DNA, 25 bp, Homo sapien
gaatcaacatcttccgagtccttct

SEQ ID NO: 531772 - DNA, 25 bp, Homo sapien
caacatcttccgagtccttcttggg

SEQ ID NO: 531773 - DNA, 25 bp, Homo sapien
gggaaatagcagagccccacttaac

SEQ ID NO: 531774 - DNA, 25 bp, Homo sapien
agagccccacttaactccataaact

SEQ ID NO: 531775 - DNA, 25 bp, Homo sapien
ttaactccataaactgcttcccatt

SEQ ID NO: 531776 - DNA, 25 bp, Homo sapien
caggatttgccaaatgctatggcca

SEQ ID NO: 531777 - DNA, 25 bp, Homo sapien
atgctatggccatcagtgaaatgac

SEQ ID NO: 531778 - DNA, 25 bp, Homo sapien
gacagataaactagggcttcagtct

SEQ ID NO: 531779 - DNA, 25 bp, Homo sapien
ggcttcagtctcttcgtaacagaac

SEQ ID NO: 531780 - DNA, 25 bp, Homo sapien
aacatggtatgttcaagccacttgt

SEQ ID NO: 531781 - DNA, 25 bp, Homo sapien
tgttcaagccacttgtgcaacacaa

SEQ ID NO: 531782 - DNA, 25 bp, Homo sapien
tctgtatgaaggacttgactggctg

SEQ ID NO: 531783 - DNA, 25 bp, Homo sapien
gactggctgtcaaatgagctttcaa

SEQ ID NO: 531784 - DNA, 25 bp, Homo sapien
ggatatctaaccaaggacatgtttg

SEQ ID NO: 531785 - DNA, 25 bp, Homo sapien
aattggtctaggcttgttacaacaa

SEQ ID NO: 531786 - DNA, 25 bp, Homo sapien
acagtatctgggactggtttgggca

SEQ ID NO: 531787 - DNA, 25 bp, Homo sapien
acaagaaggtcatcggtgaggaccg

SEQ ID NO: 531788 - DNA, 25 bp, Homo sapien
caagaaggtcatcggtgaggaccga

SEQ ID NO: 531789 - DNA, 25 bp, Homo sapien
agaaggtcatcggtgaggaccgaca

SEQ ID NO: 531790 - DNA, 25 bp, Homo sapien
gaaggtcatcggtgaggaccgacag

SEQ ID NO: 531791 - DNA, 25 bp, Homo sapien
aaggtcatcggtgaggaccgacagg

SEQ ID NO: 531792 - DNA, 25 bp, Homo sapien
aggtcatcggtgaggaccgacaggg

SEQ ID NO: 531793 - DNA, 25 bp, Homo sapien
ggtcatcggtgaggaccgacaggga

SEQ ID NO: 531794 - DNA, 25 bp, Homo sapien
gtcatcggtgaggaccgacagggac

SEQ ID NO: 531795 - DNA, 25 bp, Homo sapien
tcatcggtgaggaccgacagggacg

SEQ ID NO: 531796 - DNA, 25 bp, Homo sapien
catcggtgaggaccgacagggacgg

SEQ ID NO: 531797 - DNA, 25 bp, Homo sapien
atcggtgaggaccgacagggacggg

SEQ ID NO: 531798 - DNA, 25 bp, Homo sapien
atccgtcgcggtgctctgtcaggaa

SEQ ID NO: 531799 - DNA, 25 bp, Homo sapien
agtagagcacatccccatagatctg

SEQ ID NO: 531800 - DNA, 25 bp, Homo sapien
tagatctggcccacagagaccacaa

SEQ ID NO: 531801 - DNA, 25 bp, Homo sapien
gagaaaggcgatcaccacccacagg

SEQ ID NO: 531802 - DNA, 25 bp, Homo sapien
acaggctgagtggtccccacaggca

SEQ ID NO: 531803 - DNA, 25 bp, Homo sapien
aggcaagctgtgatggtttccatgc

SEQ ID NO: 531804 - DNA, 25 bp, Homo sapien
gatggtttccatgcacactgtgaag

SEQ ID NO: 531805 - DNA, 25 bp, Homo sapien
agttgtcacccaggatgtatcggct

SEQ ID NO: 531806 - DNA, 25 bp, Homo sapien
tgtatcggctgtctcccttggcata

SEQ ID NO: 531807 - DNA, 25 bp, Homo sapien
cttggcatactctttccagagttga

SEQ ID NO: 531808 - DNA, 25 bp, Homo sapien
ggtctccaagcaggtcttcgtagta

SEQ ID NO: 531809 - DNA, 25 bp, Homo sapien
gaggagttccgctatgacatggatg

SEQ ID NO: 531810 - DNA, 25 bp, Homo sapien
ggatgagggaaacattaattctgaa

SEQ ID NO: 531811 - DNA, 25 bp, Homo sapien
gaaactagacagtcagacctccagg

SEQ ID NO: 531812 - DNA, 25 bp, Homo sapien
tagacagtcagacctccaggactaa

SEQ ID NO: 531813 - DNA, 25 bp, Homo sapien
gtcagacctccaggactaagatgaa

SEQ ID NO: 531814 - DNA, 25 bp, Homo sapien
ccaggactaagatgaagtgagccga

SEQ ID NO: 531815 - DNA, 25 bp, Homo sapien
gtgagccgagaggagatcgtatcat

SEQ ID NO: 531816 - DNA, 25 bp, Homo sapien
gatcgtatcataagaatgcttctgt

SEQ ID NO: 531817 - DNA, 25 bp, Homo sapien
tcataagaatgcttctgtcgttagc

SEQ ID NO: 531818 - DNA, 25 bp, Homo sapien
gatgaagatgcagacgtcctccggg

SEQ ID NO: 531819 - DNA, 25 bp, Homo sapien
atgcagacgtcctccgggaagagag

SEQ ID NO: 531820 - DNA, 25 bp, Homo sapien
tctcacttagggcaagagccaggta

SEQ ID NO: 531821 - DNA, 25 bp, Homo sapien
aagagccaggtatagtctcccttcc

SEQ ID NO: 531822 - DNA, 25 bp, Homo sapien
gaatttgtaactgagaagatctttt

SEQ ID NO: 531823 - DNA, 25 bp, Homo sapien
aatttgtaactgagaagatcttttc

SEQ ID NO: 531824 - DNA, 25 bp, Homo sapien
atttgtaactgagaagatcttttct

SEQ ID NO: 531825 - DNA, 25 bp, Homo sapien
tttgtaactgagaagatcttttctt

SEQ ID NO: 531826 - DNA, 25 bp, Homo sapien
ttgtaactgagaagatcttttcttt

SEQ ID NO: 531827 - DNA, 25 bp, Homo sapien
tgtaactgagaagatcttttctttt

SEQ ID NO: 531828 - DNA, 25 bp, Homo sapien
gtaactgagaagatcttttcttttt

SEQ ID NO: 531829 - DNA, 25 bp, Homo sapien
taactgagaagatcttttctttttc

SEQ ID NO: 531830 - DNA, 25 bp, Homo sapien
actgagaagatcttttctttttcct

SEQ ID NO: 531831 - DNA, 25 bp, Homo sapien
aaactgaggcccacggtttcagcta

SEQ ID NO: 531832 - DNA, 25 bp, Homo sapien
ggcccacggtttcagctagacaatg

SEQ ID NO: 531833 - DNA, 25 bp, Homo sapien
ctagacaatgatttggccaggccta

SEQ ID NO: 531834 - DNA, 25 bp, Homo sapien
atttggccaggcctagtaaccaagg

SEQ ID NO: 531835 - DNA, 25 bp, Homo sapien
aggcctagtaaccaaggccctgtct

SEQ ID NO: 531836 - DNA, 25 bp, Homo sapien
tctggctactccctggaccacgagg

SEQ ID NO: 531837 - DNA, 25 bp, Homo sapien
tggaccacgaggctgattcctctca

SEQ ID NO: 531838 - DNA, 25 bp, Homo sapien
acgaggctgattcctctcatttcca

SEQ ID NO: 531839 - DNA, 25 bp, Homo sapien
agcttctcagtttctgcctgggcaa

SEQ ID NO: 531840 - DNA, 25 bp, Homo sapien
caaggccctgcatctgtctgctctg

SEQ ID NO: 531841 - DNA, 25 bp, Homo sapien
tgcatctgtctgctctgcatatatg

SEQ ID NO: 531842 - DNA, 25 bp, Homo sapien
atcttttttagtctgaggtgacacc

SEQ ID NO: 531843 - DNA, 25 bp, Homo sapien
gaggtgacaccatcattaaggattc

SEQ ID NO: 531844 - DNA, 25 bp, Homo sapien
cattaaggattcgacacccgtttgt

SEQ ID NO: 531845 - DNA, 25 bp, Homo sapien
aatgacatcagcaattactctgaaa

SEQ ID NO: 531846 - DNA, 25 bp, Homo sapien
tactctgaaatgtttctagtttgca

SEQ ID NO: 531847 - DNA, 25 bp, Homo sapien
ttagcaatgtgatgttattaaccct

SEQ ID NO: 531848 - DNA, 25 bp, Homo sapien
agagacctgtcctaagctctgaacc

SEQ ID NO: 531849 - DNA, 25 bp, Homo sapien
taagctctgaaccactcattccttc

SEQ ID NO: 531850 - DNA, 25 bp, Homo sapien
tcttcttaccccaggtggttgatga

SEQ ID NO: 531851 - DNA, 25 bp, Homo sapien
tgatgagcagtggtccctggtgttc

SEQ ID NO: 531852 - DNA, 25 bp, Homo sapien
ccctggtgttccacaaagagtcatt

SEQ ID NO: 531853 - DNA, 25 bp, Homo sapien
tgtcccgccgtagtttgcgcctggc

SEQ ID NO: 531854 - DNA, 25 bp, Homo sapien
cgtagtttgcgcctggccacgacag

SEQ ID NO: 531855 - DNA, 25 bp, Homo sapien
gtagtttgcgcctggccacgacagc

SEQ ID NO: 531856 - DNA, 25 bp, Homo sapien
tagtttgcgcctggccacgacagca

SEQ ID NO: 531857 - DNA, 25 bp, Homo sapien
tttgcgcctggccacgacagcatgc

SEQ ID NO: 531858 - DNA, 25 bp, Homo sapien
ttgcgcctggccacgacagcatgca

SEQ ID NO: 531859 - DNA, 25 bp, Homo sapien
tgcgcctggccacgacagcatgcac

SEQ ID NO: 531860 - DNA, 25 bp, Homo sapien
gcctggccacgacagcatgcaccct

SEQ ID NO: 531861 - DNA, 25 bp, Homo sapien
gcaccagcagcgctgtctccctgaa

SEQ ID NO: 531862 - DNA, 25 bp, Homo sapien
gtctccctgaagaaccgagcggcca

SEQ ID NO: 531863 - DNA, 25 bp, Homo sapien
tctccctgaagaaccgagcggccag

SEQ ID NO: 531864 - DNA, 25 bp, Homo sapien
cgagggatcggagagtgctcccgaa

SEQ ID NO: 531865 - DNA, 25 bp, Homo sapien
gcaggcgaaggttcccaccttacta

SEQ ID NO: 531866 - DNA, 25 bp, Homo sapien
gttcccaccttactacatgcggaga

SEQ ID NO: 531867 - DNA, 25 bp, Homo sapien
atgggcgtcgaccacagtattccaa

SEQ ID NO: 531868 - DNA, 25 bp, Homo sapien
agtattccaaccctcctgtgcaggg

SEQ ID NO: 531869 - DNA, 25 bp, Homo sapien
ttccaaccctcctgtgcagggagaa

SEQ ID NO: 531870 - DNA, 25 bp, Homo sapien
aagtgatggagggtgctgacaacca

SEQ ID NO: 531871 - DNA, 25 bp, Homo sapien
tgctgacaaccagggtgcaggagaa

SEQ ID NO: 531872 - DNA, 25 bp, Homo sapien
gtgcaggagaacaaggtagaccagt

SEQ ID NO: 531873 - DNA, 25 bp, Homo sapien
ggatatagaccacgattccgcaggg

SEQ ID NO: 531874 - DNA, 25 bp, Homo sapien
aagacagcctagagaggacggcaat

SEQ ID NO: 531875 - DNA, 25 bp, Homo sapien
agccgagataatagaggccccctct

SEQ ID NO: 531876 - DNA, 25 bp, Homo sapien
ttgcctgcgcgctggaagccaatct

SEQ ID NO: 531877 - DNA, 25 bp, Homo sapien
gctggcgcggattttagggacttcc

SEQ ID NO: 531878 - DNA, 25 bp, Homo sapien
aagccaatctgggtgtgtagcgcga

SEQ ID NO: 531879 - DNA, 25 bp, Homo sapien
attttagggacttcctgggatgcgg

SEQ ID NO: 531880 - DNA, 25 bp, Homo sapien
ccaatctgggtgtgtagcgcgaaga

SEQ ID NO: 531881 - DNA, 25 bp, Homo sapien
agcgcgaagagcgaaagagaaactt

SEQ ID NO: 531882 - DNA, 25 bp, Homo sapien
agagaaacttctgcgtgactgacta

SEQ ID NO: 531883 - DNA, 25 bp, Homo sapien
aacttctgcgtgactgactagatga

SEQ ID NO: 531884 - DNA, 25 bp, Homo sapien
gactagatgaggctcctcccgagaa

SEQ ID NO: 531885 - DNA, 25 bp, Homo sapien
gctcctcccgagaagccgagataat

SEQ ID NO: 531886 - DNA, 25 bp, Homo sapien
gggtgcagcctaaaaggacctatgt

SEQ ID NO: 531887 - DNA, 25 bp, Homo sapien
tgcagcctaaaaggacctatgtcct

SEQ ID NO: 531888 - DNA, 25 bp, Homo sapien
aaaaggacctatgtcctcacaccat

SEQ ID NO: 531889 - DNA, 25 bp, Homo sapien
aggacctatgtcctcacaccattga

SEQ ID NO: 531890 - DNA, 25 bp, Homo sapien
gacctatgtcctcacaccattgaaa

SEQ ID NO: 531891 - DNA, 25 bp, Homo sapien
tatgtcctcacaccattgaaaccac

SEQ ID NO: 531892 - DNA, 25 bp, Homo sapien
tcctcacaccattgaaaccactagt

SEQ ID NO: 531893 - DNA, 25 bp, Homo sapien
acaccattgaaaccactagttctgt

SEQ ID NO: 531894 - DNA, 25 bp, Homo sapien
cattgaaaccactagttctgtcccc

SEQ ID NO: 531895 - DNA, 25 bp, Homo sapien
gtgtgtgagtggttgaccttcctcc

SEQ ID NO: 531896 - DNA, 25 bp, Homo sapien
tgtgtgagtggttgaccttcctcca

SEQ ID NO: 531897 - DNA, 25 bp, Homo sapien
tattgttacctaaagttaatccaga

SEQ ID NO: 531898 - DNA, 25 bp, Homo sapien
gttaatccagattatatggtcctta

SEQ ID NO: 531899 - DNA, 25 bp, Homo sapien
atatggtccttatatgtgtacaaca

SEQ ID NO: 531900 - DNA, 25 bp, Homo sapien
aaatgaaaggctttgtcttgcattg

SEQ ID NO: 531901 - DNA, 25 bp, Homo sapien
tcttgcattgtgaggtacaggcgga

SEQ ID NO: 531902 - DNA, 25 bp, Homo sapien
tacaggcggaagttggaatcaggtt

SEQ ID NO: 531903 - DNA, 25 bp, Homo sapien
tctgtctctcattagctgaataatg

SEQ ID NO: 531904 - DNA, 25 bp, Homo sapien
ataatgtgaggattaacttctgcca

SEQ ID NO: 531905 - DNA, 25 bp, Homo sapien
agctcagaccatttcctaatcagtt

SEQ ID NO: 531906 - DNA, 25 bp, Homo sapien
gggaaacaagtatttcagtctcaaa

SEQ ID NO: 531907 - DNA, 25 bp, Homo sapien
ataatgcacaagtcttaagtgatta

SEQ ID NO: 531908 - DNA, 25 bp, Homo sapien
ggcctggtacaagatcactgactct

SEQ ID NO: 531909 - DNA, 25 bp, Homo sapien
tcactgactctgaggacaaggccct

SEQ ID NO: 531910 - DNA, 25 bp, Homo sapien
aaggccctcatgaacggctccgaga

SEQ ID NO: 531911 - DNA, 25 bp, Homo sapien
ggctccgagagcaggttcttcgtga

SEQ ID NO: 531912 - DNA, 25 bp, Homo sapien
agagcaggttcttcgtgagttcctc

SEQ ID NO: 531913 - DNA, 25 bp, Homo sapien
tgagttcctcgcagggccggtcaga

SEQ ID NO: 531914 - DNA, 25 bp, Homo sapien
gggccggtcagagctacacattgag

SEQ ID NO: 531915 - DNA, 25 bp, Homo sapien
gagctacacattgagaacctgaaca

SEQ ID NO: 531916 - DNA, 25 bp, Homo sapien
agtaccggtgcaacggcaccagctc

SEQ ID NO: 531917 - DNA, 25 bp, Homo sapien
tgcaacggcaccagctccaagggct

SEQ ID NO: 531918 - DNA, 25 bp, Homo sapien
aagggctccgaccaggccatcatca

SEQ ID NO: 531919 - DNA, 25 bp, Homo sapien
gtactttattcctgatacattttgg

SEQ ID NO: 531920 - DNA, 25 bp, Homo sapien
tggtttccatgtaggtgttgagctc

SEQ ID NO: 531921 - DNA, 25 bp, Homo sapien
atgtaggtgttgagctcctggtttt

SEQ ID NO: 531922 - DNA, 25 bp, Homo sapien
tggcttggctgttccttgttattcc

SEQ ID NO: 531923 - DNA, 25 bp, Homo sapien
ttggctgttccttgttattccgaaa

SEQ ID NO: 531924 - DNA, 25 bp, Homo sapien
tgttccttgttattccgaaagccct

SEQ ID NO: 531925 - DNA, 25 bp, Homo sapien
tgttattccgaaagccctggtttgg

SEQ ID NO: 531926 - DNA, 25 bp, Homo sapien
actggctctcagtctagtcaggtgc

SEQ ID NO: 531927 - DNA, 25 bp, Homo sapien
gtctagtcaggtgcaatgttcttga

SEQ ID NO: 531928 - DNA, 25 bp, Homo sapien
tagtcaggtgcaatgttcttgagag

SEQ ID NO: 531929 - DNA, 25 bp, Homo sapien
gtggggacctaattattaccagagt

SEQ ID NO: 531930 - DNA, 25 bp, Homo sapien
gtttgaatatcctctcaccatgttc

SEQ ID NO: 531931 - DNA, 25 bp, Homo sapien
tatcctctcaccatgttcagcataa

SEQ ID NO: 531932 - DNA, 25 bp, Homo sapien
gttcagcataaagtaccattcttaa

SEQ ID NO: 531933 - DNA, 25 bp, Homo sapien
tgattatcctcaacaagacaggtgt

SEQ ID NO: 531934 - DNA, 25 bp, Homo sapien
acccctttgaattaattatggctgc

SEQ ID NO: 531935 - DNA, 25 bp, Homo sapien
ggctgcctatgaaaggaggttccct

SEQ ID NO: 531936 - DNA, 25 bp, Homo sapien
gaggttccctacatgtcctttgatt

SEQ ID NO: 531937 - DNA, 25 bp, Homo sapien
atgtcctttgattccgatgttcgtg

SEQ ID NO: 531938 - DNA, 25 bp, Homo sapien
tccgatgttcgtgggcagtgacact

SEQ ID NO: 531939 - DNA, 25 bp, Homo sapien
tcatgtcattgaaaggcgctgcaag

SEQ ID NO: 531940 - DNA, 25 bp, Homo sapien
cattgaaaggcgctgcaagctggat

SEQ ID NO: 531941 - DNA, 25 bp, Homo sapien
attcctgttccgtgaccttagatgc

SEQ ID NO: 531942 - DNA, 25 bp, Homo sapien
ctgttccgtgaccttagatgcagca

SEQ ID NO: 531943 - DNA, 25 bp, Homo sapien
agatgcagcatctaggaccccacaa

SEQ ID NO: 531944 - DNA, 25 bp, Homo sapien
gcagcatctaggaccccacaagaga

SEQ ID NO: 531945 - DNA, 25 bp, Homo sapien
tctaggaccccacaagagaatgagt

SEQ ID NO: 531946 - DNA, 25 bp, Homo sapien
tgctttccagctgggatgcacaggc

SEQ ID NO: 531947 - DNA, 25 bp, Homo sapien
ttccagctgggatgcacaggcccgg

SEQ ID NO: 531948 - DNA, 25 bp, Homo sapien
ggcccagtcccacattaaggcatgc

SEQ ID NO: 531949 - DNA, 25 bp, Homo sapien
agtcccacattaaggcatgcagcat

SEQ ID NO: 531950 - DNA, 25 bp, Homo sapien
ccacattaaggcatgcagcatccca

SEQ ID NO: 531951 - DNA, 25 bp, Homo sapien
taaggcatgcagcatcccatgcact

SEQ ID NO: 531952 - DNA, 25 bp, Homo sapien
aacacacgccggagggtcgcacgcg

SEQ ID NO: 531953 - DNA, 25 bp, Homo sapien
gtcgcacgcgggttccagttgtgat

SEQ ID NO: 531954 - DNA, 25 bp, Homo sapien
acgcgggttccagttgtgattgctg

SEQ ID NO: 531955 - DNA, 25 bp, Homo sapien
gttccagttgtgattgctggagttg

SEQ ID NO: 531956 - DNA, 25 bp, Homo sapien
gtgtattgccaggaggctctccgag

SEQ ID NO: 531957 - DNA, 25 bp, Homo sapien
ttgccaggaggctctccgagattgg

SEQ ID NO: 531958 - DNA, 25 bp, Homo sapien
gattggggtcgggtcactgcctcat

SEQ ID NO: 531959 - DNA, 25 bp, Homo sapien
actgcctcatccaccggagcgatgg

SEQ ID NO: 531960 - DNA, 25 bp, Homo sapien
atccaccggagcgatggcgtttctc

SEQ ID NO: 531961 - DNA, 25 bp, Homo sapien
ccttcagttttgtgtatttaccgag

SEQ ID NO: 531962 - DNA, 25 bp, Homo sapien
tgtatttaccgaggtggttttcatc

SEQ ID NO: 531963 - DNA, 25 bp, Homo sapien
acccggcagtgcctgtagcaccgag

SEQ ID NO: 531964 - DNA, 25 bp, Homo sapien
gcagtgcctgtagcaccgaggagca

SEQ ID NO: 531965 - DNA, 25 bp, Homo sapien
agtgcctgtagcaccgaggagcaaa

SEQ ID NO: 531966 - DNA, 25 bp, Homo sapien
catccatgttgacatcttctgactg

SEQ ID NO: 531967 - DNA, 25 bp, Homo sapien
atgttgacatcttctgactgtcccc

SEQ ID NO: 531968 - DNA, 25 bp, Homo sapien
gttgacatcttctgactgtcccctg

SEQ ID NO: 531969 - DNA, 25 bp, Homo sapien
acatcttctgactgtcccctgcttg

SEQ ID NO: 531970 - DNA, 25 bp, Homo sapien
ggcccttccctagagtttcgtcaag

SEQ ID NO: 531971 - DNA, 25 bp, Homo sapien
ttccctagagtttcgtcaagagcct

SEQ ID NO: 531972 - DNA, 25 bp, Homo sapien
tagagtttcgtcaagagcctcctgg

SEQ ID NO: 531973 - DNA, 25 bp, Homo sapien
agagtttcgtcaagagcctcctggg

SEQ ID NO: 531974 - DNA, 25 bp, Homo sapien
gccattcctgttccgtgaccttaga

SEQ ID NO: 531975 - DNA, 25 bp, Homo sapien
cattcctgttccgtgaccttagatg

SEQ ID NO: 531976 - DNA, 25 bp, Homo sapien
attcctgttccgtgaccttagatgc

SEQ ID NO: 531977 - DNA, 25 bp, Homo sapien
ttcctgttccgtgaccttagatgca

SEQ ID NO: 531978 - DNA, 25 bp, Homo sapien
tcctgttccgtgaccttagatgcag

SEQ ID NO: 531979 - DNA, 25 bp, Homo sapien
cctgttccgtgaccttagatgcagc

SEQ ID NO: 531980 - DNA, 25 bp, Homo sapien
ctgttccgtgaccttagatgcagca

SEQ ID NO: 531981 - DNA, 25 bp, Homo sapien
agctcttgcagccgtttcctctgct

SEQ ID NO: 531982 - DNA, 25 bp, Homo sapien
tcttgcagccgtttcctctgctcct

SEQ ID NO: 531983 - DNA, 25 bp, Homo sapien
tgctcctctcgccacttgcggatgc

SEQ ID NO: 531984 - DNA, 25 bp, Homo sapien
ctcctctcgccacttgcggatgctc

SEQ ID NO: 531985 - DNA, 25 bp, Homo sapien
ttttttgactttgccttggagagcc

SEQ ID NO: 531986 - DNA, 25 bp, Homo sapien
ttggagagccagagcttccgcattt

SEQ ID NO: 531987 - DNA, 25 bp, Homo sapien
gagcttccgcattttctttactatt

SEQ ID NO: 531988 - DNA, 25 bp, Homo sapien
agtttcactgtgtagagaacatata

SEQ ID NO: 531989 - DNA, 25 bp, Homo sapien
aatcttccaattatcatgctcacct

SEQ ID NO: 531990 - DNA, 25 bp, Homo sapien
cttccaattatcatgctcacctgaa

SEQ ID NO: 531991 - DNA, 25 bp, Homo sapien
gctcacctgaaagaggtatgctctc

SEQ ID NO: 531992 - DNA, 25 bp, Homo sapien
agaggtatgctctcttaggaataca

SEQ ID NO: 531993 - DNA, 25 bp, Homo sapien
tatgctctcttaggaatacagtttc

SEQ ID NO: 531994 - DNA, 25 bp, Homo sapien
taggaatacagtttctagcattaaa

SEQ ID NO: 531995 - DNA, 25 bp, Homo sapien
taataaaatgttcctcgcattcccc

SEQ ID NO: 531996 - DNA, 25 bp, Homo sapien
gtcccacctcgctttacaaaacagt

SEQ ID NO: 531997 - DNA, 25 bp, Homo sapien
acctcgctttacaaaacagtcctga

SEQ ID NO: 531998 - DNA, 25 bp, Homo sapien
aacagtcctgaagcttaatcaaata

SEQ ID NO: 531999 - DNA, 25 bp, Homo sapien
aaagcagtgctttattgagttgtca

SEQ ID NO: 532000 - DNA, 25 bp, Homo sapien
gcctggtgttccctttaagcgaagg

SEQ ID NO: 532001 - DNA, 25 bp, Homo sapien
tccctttaagcgaaggtggctccac

SEQ ID NO: 532002 - DNA, 25 bp, Homo sapien
gcatcgtcgcttcctcaaggcaaaa

SEQ ID NO: 532003 - DNA, 25 bp, Homo sapien
gtcgcttcctcaaggcaaaacagca

SEQ ID NO: 532004 - DNA, 25 bp, Homo sapien
tttattgagttgtcatgagcctcgg

SEQ ID NO: 532005 - DNA, 25 bp, Homo sapien
acgctccgggaaaccgcagctggcg

SEQ ID NO: 532006 - DNA, 25 bp, Homo sapien
gcagctggcgtgtgccacatcggtc

SEQ ID NO: 532007 - DNA, 25 bp, Homo sapien
acacgttgtgtttcactttgctcgt

SEQ ID NO: 532008 - DNA, 25 bp, Homo sapien
tgagggtcagctgggttccgccgga

SEQ ID NO: 532009 - DNA, 25 bp, Homo sapien
ggttccgccggatgacaaagttatt

SEQ ID NO: 532010 - DNA, 25 bp, Homo sapien
acaaagttatttcggccagtctgca

SEQ ID NO: 532011 - DNA, 25 bp, Homo sapien
atttcggccagtctgcatttcaggg

SEQ ID NO: 532012 - DNA, 25 bp, Homo sapien
cagtctgcatttcagggcctgcgac

SEQ ID NO: 532013 - DNA, 25 bp, Homo sapien
agggcctgcgactgcagcagcactg

SEQ ID NO: 532014 - DNA, 25 bp, Homo sapien
gggcaacactccactggttgccatg

SEQ ID NO: 532015 - DNA, 25 bp, Homo sapien
tgctggcagctacaaccccggtggt

SEQ ID NO: 532016 - DNA, 25 bp, Homo sapien
ggtggttgcccctgaggttccttct

SEQ ID NO: 532017 - DNA, 25 bp, Homo sapien
aggttccttctgctggttgtgtttc

SEQ ID NO: 532018 - DNA, 25 bp, Homo sapien
ggttttcagaagatcctgacactga

SEQ ID NO: 532019 - DNA, 25 bp, Homo sapien
atagatgacgtgcatcggctgtttc

SEQ ID NO: 532020 - DNA, 25 bp, Homo sapien
gcatcggctgtttcgggacaagtac

SEQ ID NO: 532021 - DNA, 25 bp, Homo sapien
gacaagtaccgcacagagatccaac

SEQ ID NO: 532022 - DNA, 25 bp, Homo sapien
gagatccaacagcaaagtgctttaa

SEQ ID NO: 532023 - DNA, 25 bp, Homo sapien
ggcacttttgatttccaaaatgact

SEQ ID NO: 532024 - DNA, 25 bp, Homo sapien
aaaatgacttcctgcggctccttcg

SEQ ID NO: 532025 - DNA, 25 bp, Homo sapien
tgcggctccttcgtgaagcagagga

SEQ ID NO: 532026 - DNA, 25 bp, Homo sapien
agagcagtaagatccgtgctcccac

SEQ ID NO: 532027 - DNA, 25 bp, Homo sapien
gtgctcccactaccatgaagaaatt

SEQ ID NO: 532028 - DNA, 25 bp, Homo sapien
aaacctgtgaggtccatgattgaga

SEQ ID NO: 532029 - DNA, 25 bp, Homo sapien
atagtaatatatcccctccttctaa

SEQ ID NO: 532030 - DNA, 25 bp, Homo sapien
atatatcccctccttctaaatagta

SEQ ID NO: 532031 - DNA, 25 bp, Homo sapien
aagctctgattgtacaagaattacc

SEQ ID NO: 532032 - DNA, 25 bp, Homo sapien
caagaattacctgtgctagtcaagt

SEQ ID NO: 532033 - DNA, 25 bp, Homo sapien
tacctgtgctagtcaagttgttgtt

SEQ ID NO: 532034 - DNA, 25 bp, Homo sapien
tttgacagtacataatcagttctac

SEQ ID NO: 532035 - DNA, 25 bp, Homo sapien
aatcagttctactaaccaaagcttg

SEQ ID NO: 532036 - DNA, 25 bp, Homo sapien
gttctactaaccaaagcttgtattt

SEQ ID NO: 532037 - DNA, 25 bp, Homo sapien
tataatgcttaaaatactttgtcac

SEQ ID NO: 532038 - DNA, 25 bp, Homo sapien
aaatactttgtcactttataagcaa

SEQ ID NO: 532039 - DNA, 25 bp, Homo sapien
aatgcatagtacttaatttgtttat

SEQ ID NO: 532040 - DNA, 25 bp, Homo sapien
catggctcccatagttctcatcctg

SEQ ID NO: 532041 - DNA, 25 bp, Homo sapien
atagttctcatcctgctgggcctgc

SEQ ID NO: 532042 - DNA, 25 bp, Homo sapien
tgggcctgctgctcttcaaaatgta

SEQ ID NO: 532043 - DNA, 25 bp, Homo sapien
tgctgctcttcaaaatgtaccccat

SEQ ID NO: 532044 - DNA, 25 bp, Homo sapien
atgtaccccattgatgaggagaggc

SEQ ID NO: 532045 - DNA, 25 bp, Homo sapien
actgagggacgaggccagcagctct

SEQ ID NO: 532046 - DNA, 25 bp, Homo sapien
gctctggctgctcagaaacagactc

SEQ ID NO: 532047 - DNA, 25 bp, Homo sapien
agagctggctagcatcctctagggc

SEQ ID NO: 532048 - DNA, 25 bp, Homo sapien
agaagggatcaggacctgtctgccg

SEQ ID NO: 532049 - DNA, 25 bp, Homo sapien
tgtctgccggcttgctgagcagctg

SEQ ID NO: 532050 - DNA, 25 bp, Homo sapien
actgaagactcaaggaggtggccca

SEQ ID NO: 532051 - DNA, 25 bp, Homo sapien
agtggagcattcagacttgtctttc

SEQ ID NO: 532052 - DNA, 25 bp, Homo sapien
tctttcagcaaggactggtctttct

SEQ ID NO: 532053 - DNA, 25 bp, Homo sapien
aggactggtctttctatctcttgta

SEQ ID NO: 532054 - DNA, 25 bp, Homo sapien
gtctttctatctcttgtactacact

SEQ ID NO: 532055 - DNA, 25 bp, Homo sapien
tcttgtactacactgaattcacccc

SEQ ID NO: 532056 - DNA, 25 bp, Homo sapien
gaattcacccccactgaaaaagatg

SEQ ID NO: 532057 - DNA, 25 bp, Homo sapien
agatgagtatgcctgccgtgtgaac

SEQ ID NO: 532058 - DNA, 25 bp, Homo sapien
atgagtatgcctgccgtgtgaacca

SEQ ID NO: 532059 - DNA, 25 bp, Homo sapien
gccgtgtgaaccatgtgactttgtc

SEQ ID NO: 532060 - DNA, 25 bp, Homo sapien
tgaaccatgtgactttgtcacagcc

SEQ ID NO: 532061 - DNA, 25 bp, Homo sapien
tagttaagtgggatcgagacatgta

SEQ ID NO: 532062 - DNA, 25 bp, Homo sapien
agttgcagtttagacacatgttgtt

SEQ ID NO: 532063 - DNA, 25 bp, Homo sapien
gggtgtctttctggtgcccaaactt

SEQ ID NO: 532064 - DNA, 25 bp, Homo sapien
ggtgcccaaactttcaggcactttt

SEQ ID NO: 532065 - DNA, 25 bp, Homo sapien
gtaatggtagcagtacctccctaaa

SEQ ID NO: 532066 - DNA, 25 bp, Homo sapien
gcagtacctccctaaagcattttga

SEQ ID NO: 532067 - DNA, 25 bp, Homo sapien
atgaatgtgggtgaagccgccctaa

SEQ ID NO: 532068 - DNA, 25 bp, Homo sapien
tgaagccgccctaaggattttcctt

SEQ ID NO: 532069 - DNA, 25 bp, Homo sapien
atttctctggagtaatactgtacca

SEQ ID NO: 532070 - DNA, 25 bp, Homo sapien
tactgtaccatactggtctttgctt

SEQ ID NO: 532071 - DNA, 25 bp, Homo sapien
tactggtctttgcttttagtaataa

SEQ ID NO: 532072 - DNA, 25 bp, Homo sapien
ggagggaactttgatcttcctaaga

SEQ ID NO: 532073 - DNA, 25 bp, Homo sapien
gaagggcaaattaaactcctaagat

SEQ ID NO: 532074 - DNA, 25 bp, Homo sapien
tagagctgaagactgagagctaatc

SEQ ID NO: 532075 - DNA, 25 bp, Homo sapien
agagctaatcagaagttctcagatg

SEQ ID NO: 532076 - DNA, 25 bp, Homo sapien
gatgaaactagattcttgatattgc

SEQ ID NO: 532077 - DNA, 25 bp, Homo sapien
gatattgctacaaaaggtttctttc

SEQ ID NO: 532078 - DNA, 25 bp, Homo sapien
aaggtttctttctgatctgccatcg

SEQ ID NO: 532079 - DNA, 25 bp, Homo sapien
tctgccatcgcagtaaccgttgtgg

SEQ ID NO: 532080 - DNA, 25 bp, Homo sapien
aaccgttgtggacgatcagcctgta

SEQ ID NO: 532081 - DNA, 25 bp, Homo sapien
gatcagcctgtactgcctggccagg

SEQ ID NO: 532082 - DNA, 25 bp, Homo sapien
tgccttacaatcttctgcgcttctg

SEQ ID NO: 532083 - DNA, 25 bp, Homo sapien
agcacaggtgccatcgaggttcagg

SEQ ID NO: 532084 - DNA, 25 bp, Homo sapien
agaacggtcaatttgagccgcgtcg

SEQ ID NO: 532085 - DNA, 25 bp, Homo sapien
aacggtcaatttgagccgcgtcgag

SEQ ID NO: 532086 - DNA, 25 bp, Homo sapien
ttctgggacctttcggtgcgtccga

SEQ ID NO: 532087 - DNA, 25 bp, Homo sapien
cctttcggtgcgtccgagcgcgaca

SEQ ID NO: 532088 - DNA, 25 bp, Homo sapien
ctttcggtgcgtccgagcgcgacac

SEQ ID NO: 532089 - DNA, 25 bp, Homo sapien
ttcggtgcgtccgagcgcgacaccg

SEQ ID NO: 532090 - DNA, 25 bp, Homo sapien
cggtcaatttgagccgcgtcgaggt

SEQ ID NO: 532091 - DNA, 25 bp, Homo sapien
gggcgcgagctgtgttggaagcaaa

SEQ ID NO: 532092 - DNA, 25 bp, Homo sapien
gttggaagcaaagtcctccttgtgg

SEQ ID NO: 532093 - DNA, 25 bp, Homo sapien
ttggaagcaaagtcctccttgtggg

SEQ ID NO: 532094 - DNA, 25 bp, Homo sapien
aagcaaagtcctccttgtgggttgg

SEQ ID NO: 532095 - DNA, 25 bp, Homo sapien
catttctgcgtcttactggcaacca

SEQ ID NO: 532096 - DNA, 25 bp, Homo sapien
cttactggcaaccacacaactcagg

SEQ ID NO: 532097 - DNA, 25 bp, Homo sapien
acacaactcagggaaaggaatgcct

SEQ ID NO: 532098 - DNA, 25 bp, Homo sapien
tgcaggcgggcagcactgagggacc

SEQ ID NO: 532099 - DNA, 25 bp, Homo sapien
gcagcttctcaagtgagactgacct

SEQ ID NO: 532100 - DNA, 25 bp, Homo sapien
gagactgacctgtctcacccagcag

SEQ ID NO: 532101 - DNA, 25 bp, Homo sapien
ggcaagggccagtgcgcctgctcct

SEQ ID NO: 532102 - DNA, 25 bp, Homo sapien
aaggaaggccacttctcaactggca

SEQ ID NO: 532103 - DNA, 25 bp, Homo sapien
ttctcaactggcagaacttctgaag

SEQ ID NO: 532104 - DNA, 25 bp, Homo sapien
ggaattacttccttactagtgtctt

SEQ ID NO: 532105 - DNA, 25 bp, Homo sapien
attacttccttactagtgtcttttg

SEQ ID NO: 532106 - DNA, 25 bp, Homo sapien
gggcaccatggtcggcatcttcata

SEQ ID NO: 532107 - DNA, 25 bp, Homo sapien
accatggtcggcatcttcatagcac

SEQ ID NO: 532108 - DNA, 25 bp, Homo sapien
tcccgtgtggatggcttcgtgcctc

SEQ ID NO: 532109 - DNA, 25 bp, Homo sapien
tggcttcgtgcctccggagattgta

SEQ ID NO: 532110 - DNA, 25 bp, Homo sapien
ctccggagattgtagccgttcttga

SEQ ID NO: 532111 - DNA, 25 bp, Homo sapien
agattgtagccgttcttgaactcct

SEQ ID NO: 532112 - DNA, 25 bp, Homo sapien
actccttggcgcacagagcgcagat

SEQ ID NO: 532113 - DNA, 25 bp, Homo sapien
acagagcgcagatgtagggcccctt

SEQ ID NO: 532114 - DNA, 25 bp, Homo sapien
gagcgcagatgtagggccccttgct

SEQ ID NO: 532115 - DNA, 25 bp, Homo sapien
tgtcttcttctccaaggcagacgcg

SEQ ID NO: 532116 - DNA, 25 bp, Homo sapien
cttctccaaggcagacgcgaccggg

SEQ ID NO: 532117 - DNA, 25 bp, Homo sapien
ctccaaatctgggagaattttcaaa

SEQ ID NO: 532118 - DNA, 25 bp, Homo sapien
atgatatactatgactaggctgtgt

SEQ ID NO: 532119 - DNA, 25 bp, Homo sapien
gctgtgtatttcttttcagggattt

SEQ ID NO: 532120 - DNA, 25 bp, Homo sapien
tcagggatttttctaccttcagggt

SEQ ID NO: 532121 - DNA, 25 bp, Homo sapien
ttttctaccttcagggttggatgta

SEQ ID NO: 532122 - DNA, 25 bp, Homo sapien
gttactattaccatagccaacctgt

SEQ ID NO: 532123 - DNA, 25 bp, Homo sapien
accatagccaacctgtagttttaca

SEQ ID NO: 532124 - DNA, 25 bp, Homo sapien
atacattttcttgtggagcaataga

SEQ ID NO: 532125 - DNA, 25 bp, Homo sapien
gaatattttccacaagatgctgcaa

SEQ ID NO: 532126 - DNA, 25 bp, Homo sapien
aagatgctgcaatgtgagttatcac

SEQ ID NO: 532127 - DNA, 25 bp, Homo sapien
gagttatcacttcatttatcttaaa

SEQ ID NO: 532128 - DNA, 25 bp, Homo sapien
tgtcctcatgccagcggctttggct

SEQ ID NO: 532129 - DNA, 25 bp, Homo sapien
tggtctgaagcctgcacgcggcagt

SEQ ID NO: 532130 - DNA, 25 bp, Homo sapien
tgcacgcggcagttctttgttaaag

SEQ ID NO: 532131 - DNA, 25 bp, Homo sapien
tctttgttaaagatctgagggactc

SEQ ID NO: 532132 - DNA, 25 bp, Homo sapien
tgagggactcgtcagtcctagcgtc

SEQ ID NO: 532133 - DNA, 25 bp, Homo sapien
agggactcgtcagtcctagcgtcgc

SEQ ID NO: 532134 - DNA, 25 bp, Homo sapien
ggactcgtcagtcctagcgtcgccg

SEQ ID NO: 532135 - DNA, 25 bp, Homo sapien
aacctgcaaaaacggagctgggctg

SEQ ID NO: 532136 - DNA, 25 bp, Homo sapien
aagaagatgcatgcctagcgtgttc

SEQ ID NO: 532137 - DNA, 25 bp, Homo sapien
aagatgcatgcctagcgtgttcttt

SEQ ID NO: 532138 - DNA, 25 bp, Homo sapien
gatgcatgcctagcgtgttcttttt

SEQ ID NO: 532139 - DNA, 25 bp, Homo sapien
tggtgatgtctgctactatgccagc

SEQ ID NO: 532140 - DNA, 25 bp, Homo sapien
gctactatgccagccggaacgacaa

SEQ ID NO: 532141 - DNA, 25 bp, Homo sapien
gccggaacgacaagtcctactggct

SEQ ID NO: 532142 - DNA, 25 bp, Homo sapien
tgcccgtggccgaggacgagatcaa

SEQ ID NO: 532143 - DNA, 25 bp, Homo sapien
ggacgagatcaagccctacatcagc

SEQ ID NO: 532144 - DNA, 25 bp, Homo sapien
atcgcggtccacagtcaggatgtct

SEQ ID NO: 532145 - DNA, 25 bp, Homo sapien
agtcaggatgtctccatcccacact

SEQ ID NO: 532146 - DNA, 25 bp, Homo sapien
tgtggatcggatattccttcctcat

SEQ ID NO: 532147 - DNA, 25 bp, Homo sapien
ttcctcatgcacacggcggcgggag

SEQ ID NO: 532148 - DNA, 25 bp, Homo sapien
aaggcggtggccaatcactggtgtc

SEQ ID NO: 532149 - DNA, 25 bp, Homo sapien
aatcactggtgtcaccgggcagctg

SEQ ID NO: 532150 - DNA, 25 bp, Homo sapien
aggatatttactacttttgcatgaa

SEQ ID NO: 532151 - DNA, 25 bp, Homo sapien
tagagctttcaagtacatggctagc

SEQ ID NO: 532152 - DNA, 25 bp, Homo sapien
gtacatggctagcttttatggcagt

SEQ ID NO: 532153 - DNA, 25 bp, Homo sapien
ggctagcttttatggcagttctggt

SEQ ID NO: 532154 - DNA, 25 bp, Homo sapien
atggcagttctggtgaatgttcaat

SEQ ID NO: 532155 - DNA, 25 bp, Homo sapien
atgttcaatgggaactggtcaccat

SEQ ID NO: 532156 - DNA, 25 bp, Homo sapien
tggtcaccatgaaactttagagatt

SEQ ID NO: 532157 - DNA, 25 bp, Homo sapien
gattaacgacaagattttctacttt

SEQ ID NO: 532158 - DNA, 25 bp, Homo sapien
gtccttcagccaaacacaatatggg

SEQ ID NO: 532159 - DNA, 25 bp, Homo sapien
tttgaaatgtcatttggtgccagta

SEQ ID NO: 532160 - DNA, 25 bp, Homo sapien
taactgcataatagcctaacatgat

SEQ ID NO: 532161 - DNA, 25 bp, Homo sapien
gtttttaaagaatcaccctcattgt

SEQ ID NO: 532162 - DNA, 25 bp, Homo sapien
gtaaatgtactcttagggtgcgaat

SEQ ID NO: 532163 - DNA, 25 bp, Homo sapien
gaagataattctgattccattggga

SEQ ID NO: 532164 - DNA, 25 bp, Homo sapien
tccattgggaatcttaggttttcgt

SEQ ID NO: 532165 - DNA, 25 bp, Homo sapien
aatagtttttcctgtactgctgaag

SEQ ID NO: 532166 - DNA, 25 bp, Homo sapien
ttttcctgtactgctgaagtttctt

SEQ ID NO: 532167 - DNA, 25 bp, Homo sapien
aaatccagtattagctgcctatttc

SEQ ID NO: 532168 - DNA, 25 bp, Homo sapien
agctgcctatttcagacacttaata

SEQ ID NO: 532169 - DNA, 25 bp, Homo sapien
tcagacacttaatacttgcagagat

SEQ ID NO: 532170 - DNA, 25 bp, Homo sapien
ttgcagagatctatgttacatttac

SEQ ID NO: 532171 - DNA, 25 bp, Homo sapien
gttacatttaccacactgaagtttt

SEQ ID NO: 532172 - DNA, 25 bp, Homo sapien
aaaggtcaaaaccacatgcctgtgg

SEQ ID NO: 532173 - DNA, 25 bp, Homo sapien
catgcctgtggagaaagtgcgacat

SEQ ID NO: 532174 - DNA, 25 bp, Homo sapien
gatgaaagacatcaggatcccacca

SEQ ID NO: 532175 - DNA, 25 bp, Homo sapien
atcccaccaccgcaaggtaaagtga

SEQ ID NO: 532176 - DNA, 25 bp, Homo sapien
ttctggaacccctgtggcacaggag

SEQ ID NO: 532177 - DNA, 25 bp, Homo sapien
ggcacaggagtaccaattttccttt

SEQ ID NO: 532178 - DNA, 25 bp, Homo sapien
ttcctttccaacgaactggatttct

SEQ ID NO: 532179 - DNA, 25 bp, Homo sapien
ggatttctggataggcattttggct

SEQ ID NO: 532180 - DNA, 25 bp, Homo sapien
ataagaccacagtccttagcccaat

SEQ ID NO: 532181 - DNA, 25 bp, Homo sapien
ttagcccaatcccagctatacagtc

SEQ ID NO: 532182 - DNA, 25 bp, Homo sapien
tacagtcaccccaatttccacaaat

SEQ ID NO: 532183 - DNA, 25 bp, Homo sapien
tggagcccatttctcactggagagg

SEQ ID NO: 532184 - DNA, 25 bp, Homo sapien
gaggaaaacttgtcatctggctttg

SEQ ID NO: 532185 - DNA, 25 bp, Homo sapien
aaacttgtcatctggctttgcggag

SEQ ID NO: 532186 - DNA, 25 bp, Homo sapien
ggctttgcggagaaggttccacctt

SEQ ID NO: 532187 - DNA, 25 bp, Homo sapien
agaaggttccaccttacgctcgtag

SEQ ID NO: 532188 - DNA, 25 bp, Homo sapien
tacgctcgtagtacattatctttac

SEQ ID NO: 532189 - DNA, 25 bp, Homo sapien
acttgaatgagcttgtattataaca

SEQ ID NO: 532190 - DNA, 25 bp, Homo sapien
tattattgagagtatctgctttcca

SEQ ID NO: 532191 - DNA, 25 bp, Homo sapien
agtgattcattcattattctagtcc

SEQ ID NO: 532192 - DNA, 25 bp, Homo sapien
ttattctagtcctgctttagtcctt

SEQ ID NO: 532193 - DNA, 25 bp, Homo sapien
gtcctgctttagtcctttgtaattt

SEQ ID NO: 532194 - DNA, 25 bp, Homo sapien
acttccagcccatgtacactagtgg

SEQ ID NO: 532195 - DNA, 25 bp, Homo sapien
agcccatgtacactagtggcccacg

SEQ ID NO: 532196 - DNA, 25 bp, Homo sapien
atgtacactagtggcccacgaccaa

SEQ ID NO: 532197 - DNA, 25 bp, Homo sapien
gcccacgaccaaggggtcttcattt

SEQ ID NO: 532198 - DNA, 25 bp, Homo sapien
tcatttccatgaaaaagggactcca

SEQ ID NO: 532199 - DNA, 25 bp, Homo sapien
aaaagggactccaagaggcagtggt

SEQ ID NO: 532200 - DNA, 25 bp, Homo sapien
gtggcccccaactttggtgctccag

SEQ ID NO: 532201 - DNA, 25 bp, Homo sapien
gcacctgggaggtcaaaggtctcca

SEQ ID NO: 532202 - DNA, 25 bp, Homo sapien
gggaggtcaaaggtctccaccacat

SEQ ID NO: 532203 - DNA, 25 bp, Homo sapien
gaggtcaaaggtctccaccacatca

SEQ ID NO: 532204 - DNA, 25 bp, Homo sapien
ggtcaaaggtctccaccacatcaac

SEQ ID NO: 532205 - DNA, 25 bp, Homo sapien
gtattaatgggcttctttaaattct

SEQ ID NO: 532206 - DNA, 25 bp, Homo sapien
atagtatttcagttccgtgtcttaa

SEQ ID NO: 532207 - DNA, 25 bp, Homo sapien
gttccgtgtcttaacagtttgtgat

SEQ ID NO: 532208 - DNA, 25 bp, Homo sapien
gtgataatttctaaaactgtctttt

SEQ ID NO: 532209 - DNA, 25 bp, Homo sapien
gatgttgacacttttggcttttatt

SEQ ID NO: 532210 - DNA, 25 bp, Homo sapien
ctggtattagagtttgtattttcac

SEQ ID NO: 532211 - DNA, 25 bp, Homo sapien
ttcacagagtgctttgtagcaggca

SEQ ID NO: 532212 - DNA, 25 bp, Homo sapien
gtagcaggcattacaattaatctgt

SEQ ID NO: 532213 - DNA, 25 bp, Homo sapien
ccaacagcttgatggtggcgttttt

SEQ ID NO: 532214 - DNA, 25 bp, Homo sapien
tggtggcgtttttgaaatgtagaac

SEQ ID NO: 532215 - DNA, 25 bp, Homo sapien
atgtagaacagagtgcttgcaaaat

SEQ ID NO: 532216 - DNA, 25 bp, Homo sapien
acacaggaacacgatgacatggcca

SEQ ID NO: 532217 - DNA, 25 bp, Homo sapien
gaacacgatgacatggccagggcca

SEQ ID NO: 532218 - DNA, 25 bp, Homo sapien
aacacgatgacatggccagggccac

SEQ ID NO: 532219 - DNA, 25 bp, Homo sapien
atggccagggccacaacttcttctg

SEQ ID NO: 532220 - DNA, 25 bp, Homo sapien
ggccagggccacaacttcttctgtc

SEQ ID NO: 532221 - DNA, 25 bp, Homo sapien
gggccacaacttcttctgtcgtggg

SEQ ID NO: 532222 - DNA, 25 bp, Homo sapien
tttccagagccagaaacaggatttt

SEQ ID NO: 532223 - DNA, 25 bp, Homo sapien
gatgaaaagacaagaccagggctgg

SEQ ID NO: 532224 - DNA, 25 bp, Homo sapien
aggaagcacctctaggccctggacc

SEQ ID NO: 532225 - DNA, 25 bp, Homo sapien
ctggcccctaagactccatctcttc

SEQ ID NO: 532226 - DNA, 25 bp, Homo sapien
aatttattgtaatggggtccgcgca

SEQ ID NO: 532227 - DNA, 25 bp, Homo sapien
gctggcatggtgaggcttttcaagt

SEQ ID NO: 532228 - DNA, 25 bp, Homo sapien
ttcaagtacctatatttagccccaa

SEQ ID NO: 532229 - DNA, 25 bp, Homo sapien
tatatttagccccaacaccatttct

SEQ ID NO: 532230 - DNA, 25 bp, Homo sapien
ccaacaccatttctgggctcctggg

SEQ ID NO: 532231 - DNA, 25 bp, Homo sapien
gggctcagcctagtgaactgcaacc

SEQ ID NO: 532232 - DNA, 25 bp, Homo sapien
gtgaactgcaacctcaaaggagcaa

SEQ ID NO: 532233 - DNA, 25 bp, Homo sapien
gcaacctcaaaggagcaagccttga

SEQ ID NO: 532234 - DNA, 25 bp, Homo sapien
gcagcaaacttggtgaaactacatc

SEQ ID NO: 532235 - DNA, 25 bp, Homo sapien
gaaactacatctccaatgtgctttc

SEQ ID NO: 532236 - DNA, 25 bp, Homo sapien
tccaatgtgctttctaatctcctgc

SEQ ID NO: 532237 - DNA, 25 bp, Homo sapien
taatctcctgccagctcttctcaag

SEQ ID NO: 532238 - DNA, 25 bp, Homo sapien
gtaagaaggcctttcgttctatctc

SEQ ID NO: 532239 - DNA, 25 bp, Homo sapien
aaggcctttcgttctatctcaggtc

SEQ ID NO: 532240 - DNA, 25 bp, Homo sapien
tcgttctatctcaggtctttctcaa

SEQ ID NO: 532241 - DNA, 25 bp, Homo sapien
tctatctcaggtctttctcaacata

SEQ ID NO: 532242 - DNA, 25 bp, Homo sapien
tctcaggtctttctcaacataagag

SEQ ID NO: 532243 - DNA, 25 bp, Homo sapien
gtgataaggcctttaatcgcagtga

SEQ ID NO: 532244 - DNA, 25 bp, Homo sapien
aaggcctttaatcgcagtgatcgac

SEQ ID NO: 532245 - DNA, 25 bp, Homo sapien
aatcgcagtgatcgacttactcaac

SEQ ID NO: 532246 - DNA, 25 bp, Homo sapien
gcagtgatcgacttactcaacatga

SEQ ID NO: 532247 - DNA, 25 bp, Homo sapien
tactggtgtgaaaccacagaaatgc

SEQ ID NO: 532248 - DNA, 25 bp, Homo sapien
ctcaactaatttatcatcagacaat

SEQ ID NO: 532249 - DNA, 25 bp, Homo sapien
aaaagaattcaggctagagttggga

SEQ ID NO: 532250 - DNA, 25 bp, Homo sapien
gaattcaggctagagttgggaggag

SEQ ID NO: 532251 - DNA, 25 bp, Homo sapien
ttgggaggaggatgcaagagctact

SEQ ID NO: 532252 - DNA, 25 bp, Homo sapien
gaggatgcaagagctactgggaagg

SEQ ID NO: 532253 - DNA, 25 bp, Homo sapien
aggatgcaagagctactgggaaggg

SEQ ID NO: 532254 - DNA, 25 bp, Homo sapien
gagctcagtctgaacctgggggatc

SEQ ID NO: 532255 - DNA, 25 bp, Homo sapien
agctcagtctgaacctgggggatca

SEQ ID NO: 532256 - DNA, 25 bp, Homo sapien
gtaggggactctccccttgtccact

SEQ ID NO: 532257 - DNA, 25 bp, Homo sapien
ggggactctccccttgtccactgat

SEQ ID NO: 532258 - DNA, 25 bp, Homo sapien
ggggggtctggctgttactcctctc

SEQ ID NO: 532259 - DNA, 25 bp, Homo sapien
gggggtctggctgttactcctctcc

SEQ ID NO: 532260 - DNA, 25 bp, Homo sapien
agagtccaagtgctttgattgttca

SEQ ID NO: 532261 - DNA, 25 bp, Homo sapien
agtaaaaactatgcctcctgactgg

SEQ ID NO: 532262 - DNA, 25 bp, Homo sapien
actatgcctcctgactggagagctg

SEQ ID NO: 532263 - DNA, 25 bp, Homo sapien
cactcttaacaacttaccctactat

SEQ ID NO: 532264 - DNA, 25 bp, Homo sapien
ttaccctactattaaggcacttgag

SEQ ID NO: 532265 - DNA, 25 bp, Homo sapien
gagcaaggaagtcccagaccaaacc

SEQ ID NO: 532266 - DNA, 25 bp, Homo sapien
ccaaaccccttctggatcctggaga

SEQ ID NO: 532267 - DNA, 25 bp, Homo sapien
agtgctgttgcactggtttccttca

SEQ ID NO: 532268 - DNA, 25 bp, Homo sapien
gaaagagccggcagagacctctgta

SEQ ID NO: 532269 - DNA, 25 bp, Homo sapien
gcccctcaaacgctggtgttaggca

SEQ ID NO: 532270 - DNA, 25 bp, Homo sapien
gcacagggacaatgccagtgccata

SEQ ID NO: 532271 - DNA, 25 bp, Homo sapien
gtcacgctgcgcctcgagttcccgg

SEQ ID NO: 532272 - DNA, 25 bp, Homo sapien
tgctcacctcggtgtgcctgctgct

SEQ ID NO: 532273 - DNA, 25 bp, Homo sapien
acctcggtgtgcctgctgctgttcg

SEQ ID NO: 532274 - DNA, 25 bp, Homo sapien
tgctgttcgccgtgcacttcgccgt

SEQ ID NO: 532275 - DNA, 25 bp, Homo sapien
tgttcgccgtgcacttcgccgtggc

SEQ ID NO: 532276 - DNA, 25 bp, Homo sapien
tcgccgtggccgaggcccgtacttg

SEQ ID NO: 532277 - DNA, 25 bp, Homo sapien
tggccgaggcccgtacttggcacag

SEQ ID NO: 532278 - DNA, 25 bp, Homo sapien
cgaggcccgtacttggcacagggaa

SEQ ID NO: 532279 - DNA, 25 bp, Homo sapien
ttggcacagggaagggcgctggcgc

SEQ ID NO: 532280 - DNA, 25 bp, Homo sapien
gcgtgctgcggctcggagcctgggc

SEQ ID NO: 532281 - DNA, 25 bp, Homo sapien
ctgacggcggccacggcactggtac

SEQ ID NO: 532282 - DNA, 25 bp, Homo sapien
aaaaatgtgttacactcagccaggc

SEQ ID NO: 532283 - DNA, 25 bp, Homo sapien
aaatgtgttacactcagccaggctg

SEQ ID NO: 532284 - DNA, 25 bp, Homo sapien
acagaaaactgcgtggtgggaatcc

SEQ ID NO: 532285 - DNA, 25 bp, Homo sapien
aaactgcgtggtgggaatccaggcc

SEQ ID NO: 532286 - DNA, 25 bp, Homo sapien
actgcgtggtgggaatccaggccaa

SEQ ID NO: 532287 - DNA, 25 bp, Homo sapien
tgcgtggtgggaatccaggccaata

SEQ ID NO: 532288 - DNA, 25 bp, Homo sapien
cgtggtgggaatccaggccaataca

SEQ ID NO: 532289 - DNA, 25 bp, Homo sapien
ggtgggaatccaggccaatacagaa

SEQ ID NO: 532290 - DNA, 25 bp, Homo sapien
aggccaatacagaaaggatcaacaa

SEQ ID NO: 532291 - DNA, 25 bp, Homo sapien
atcaacaagctgatgaatgagtctc

SEQ ID NO: 532292 - DNA, 25 bp, Homo sapien
gtatgacaaggcagcaaagattgct

SEQ ID NO: 532293 - DNA, 25 bp, Homo sapien
gatcaagatacggaagagcccagca

SEQ ID NO: 532294 - DNA, 25 bp, Homo sapien
gaagagcccagcactccacgatgct

SEQ ID NO: 532295 - DNA, 25 bp, Homo sapien
tccatcatgcccctttgcagaaaat

SEQ ID NO: 532296 - DNA, 25 bp, Homo sapien
tttgcagaaaatactgcctcctcca

SEQ ID NO: 532297 - DNA, 25 bp, Homo sapien
tgcctcctccagtaaacactattct

SEQ ID NO: 532298 - DNA, 25 bp, Homo sapien
cagtaaacactattctgatgtcact

SEQ ID NO: 532299 - DNA, 25 bp, Homo sapien
tagttttgcctcttcgtgaactttg

SEQ ID NO: 532300 - DNA, 25 bp, Homo sapien
gaacaatatgaactgtcctgtgtga

SEQ ID NO: 532301 - DNA, 25 bp, Homo sapien
aactgtcctgtgtgatttcttgtat

SEQ ID NO: 532302 - DNA, 25 bp, Homo sapien
atttcattatgggtggtgtgctatt

SEQ ID NO: 532303 - DNA, 25 bp, Homo sapien
gtgtgctattgtatcaacagggtat

SEQ ID NO: 532304 - DNA, 25 bp, Homo sapien
agtttcttactgctcatggattaca

SEQ ID NO: 532305 - DNA, 25 bp, Homo sapien
attacatcggtattaacttggcaac

SEQ ID NO: 532306 - DNA, 25 bp, Homo sapien
gtataaaccccatagctctgtattt

SEQ ID NO: 532307 - DNA, 25 bp, Homo sapien
gctgctgttaccagtccaaaagtct

SEQ ID NO: 532308 - DNA, 25 bp, Homo sapien
aaaagtctgatgacctcggtcccca

SEQ ID NO: 532309 - DNA, 25 bp, Homo sapien
tcggtccccatgaacggaacaagca

SEQ ID NO: 532310 - DNA, 25 bp, Homo sapien
aagcatccagtggaagaaccacgat

SEQ ID NO: 532311 - DNA, 25 bp, Homo sapien
gaaccacgatcaaaacaaccacaac

SEQ ID NO: 532312 - DNA, 25 bp, Homo sapien
aacacagaccggagcagccataagg

SEQ ID NO: 532313 - DNA, 25 bp, Homo sapien
aggacagcatgaactgaccaccctt

SEQ ID NO: 532314 - DNA, 25 bp, Homo sapien
atgaactgaccacccttagaagcac

SEQ ID NO: 532315 - DNA, 25 bp, Homo sapien
tttgcctcctgtagcacagacatgt

SEQ ID NO: 532316 - DNA, 25 bp, Homo sapien
tcctgtagcacagacatgtgtatcc

SEQ ID NO: 532317 - DNA, 25 bp, Homo sapien
atgtgtatccatgtgtgcaggctcg

SEQ ID NO: 532318 - DNA, 25 bp, Homo sapien
gtatccatgtgtgcaggctcggctg

SEQ ID NO: 532319 - DNA, 25 bp, Homo sapien
tccatgtgtgcaggctcggctgtga

SEQ ID NO: 532320 - DNA, 25 bp, Homo sapien
cagtcaaaaccttccagggacacac

SEQ ID NO: 532321 - DNA, 25 bp, Homo sapien
aaccttccagggacacacaaacgag

SEQ ID NO: 532322 - DNA, 25 bp, Homo sapien
tccagggacacacaaacgaggtcaa

SEQ ID NO: 532323 - DNA, 25 bp, Homo sapien
tcctgctcggatgacatgacattga

SEQ ID NO: 532324 - DNA, 25 bp, Homo sapien
atgacatgacattgaagatctggag

SEQ ID NO: 532325 - DNA, 25 bp, Homo sapien
gatctacaccatcaagtggagcccc

SEQ ID NO: 532326 - DNA, 25 bp, Homo sapien
aaagaggactgaaggctatgcagcc

SEQ ID NO: 532327 - DNA, 25 bp, Homo sapien
ggctatgcagcctttcaggaagata

SEQ ID NO: 532328 - DNA, 25 bp, Homo sapien
gcagcctttcaggaagatagctctg

SEQ ID NO: 532329 - DNA, 25 bp, Homo sapien
ctttcaggaagatagctctggagat

SEQ ID NO: 532330 - DNA, 25 bp, Homo sapien
gagatgaggcagaaagtccttctaa

SEQ ID NO: 532331 - DNA, 25 bp, Homo sapien
ccaagggaatccatgttttcaagaa

SEQ ID NO: 532332 - DNA, 25 bp, Homo sapien
gaatccatgttttcaagaagcccag

SEQ ID NO: 532333 - DNA, 25 bp, Homo sapien
ccatgttttcaagaagcccagcttt

SEQ ID NO: 532334 - DNA, 25 bp, Homo sapien
gaagcccagcttttctaaaaagaag

SEQ ID NO: 532335 - DNA, 25 bp, Homo sapien
agaagtcaaaagacttgacagcagc

SEQ ID NO: 532336 - DNA, 25 bp, Homo sapien
tgacagcagctgatgttgttaaaca

SEQ ID NO: 532337 - DNA, 25 bp, Homo sapien
tgggtataagtgcatatctgtgtct

SEQ ID NO: 532338 - DNA, 25 bp, Homo sapien
ctgtgtcttgaatgaccaagcacat

SEQ ID NO: 532339 - DNA, 25 bp, Homo sapien
caattggagttggttctgtctggtt

SEQ ID NO: 532340 - DNA, 25 bp, Homo sapien
gaaagaacttcatggtatcagtaat

SEQ ID NO: 532341 - DNA, 25 bp, Homo sapien
gtaatatttggcgattccatttcat

SEQ ID NO: 532342 - DNA, 25 bp, Homo sapien
tccatttcatactcatcttcatctg

SEQ ID NO: 532343 - DNA, 25 bp, Homo sapien
gtgaggctacctgacacagtgtcta

SEQ ID NO: 532344 - DNA, 25 bp, Homo sapien
acacagtgtctaaataaaccctatt

SEQ ID NO: 532345 - DNA, 25 bp, Homo sapien
tgtcacatttcagaataccattcat

SEQ ID NO: 532346 - DNA, 25 bp, Homo sapien
gaataccattcatatacagcacaat

SEQ ID NO: 532347 - DNA, 25 bp, Homo sapien
tacatgttgtaattactgctaatgg

SEQ ID NO: 532348 - DNA, 25 bp, Homo sapien
gctgagctgtggacctctcgggcaa

SEQ ID NO: 532349 - DNA, 25 bp, Homo sapien
acctctcgggcaactctgtgggtgt

SEQ ID NO: 532350 - DNA, 25 bp, Homo sapien
cttgagacctcaccgggcctgtgat

SEQ ID NO: 532351 - DNA, 25 bp, Homo sapien
ggcctgtgatatttgctctcctgaa

SEQ ID NO: 532352 - DNA, 25 bp, Homo sapien
gtgatatttgctctcctgaactctc

SEQ ID NO: 532353 - DNA, 25 bp, Homo sapien
tctcctctgtggcttttcctgttat

SEQ ID NO: 532354 - DNA, 25 bp, Homo sapien
tttcctgttattgtcccctaatgat

SEQ ID NO: 532355 - DNA, 25 bp, Homo sapien
ctgcctacctggagattcagtagga

SEQ ID NO: 532356 - DNA, 25 bp, Homo sapien
gattcagtaggatcttttgagtgga

SEQ ID NO: 532357 - DNA, 25 bp, Homo sapien
agcaaggagggcaggacacttagca

SEQ ID NO: 532358 - DNA, 25 bp, Homo sapien
caggacacttagcaggcactgagca

SEQ ID NO: 532359 - DNA, 25 bp, Homo sapien
aagagtatgagtcttctgtaattca

SEQ ID NO: 532360 - DNA, 25 bp, Homo sapien
tctgtaattcattgagcagttagct

SEQ ID NO: 532361 - DNA, 25 bp, Homo sapien
gagcagttagctcatttgagataaa

SEQ ID NO: 532362 - DNA, 25 bp, Homo sapien
aaacactagctctgtattaatcccc

SEQ ID NO: 532363 - DNA, 25 bp, Homo sapien
gtattaatccccatcattactggta

SEQ ID NO: 532364 - DNA, 25 bp, Homo sapien
taatccccatcattactggtaaagc

SEQ ID NO: 532365 - DNA, 25 bp, Homo sapien
atccccatcattactggtaaagcct

SEQ ID NO: 532366 - DNA, 25 bp, Homo sapien
cattactggtaaagcctcatttgaa

SEQ ID NO: 532367 - DNA, 25 bp, Homo sapien
tactggtaaagcctcatttgaatgt

SEQ ID NO: 532368 - DNA, 25 bp, Homo sapien
aagcctcatttgaatgtgtgaattc

SEQ ID NO: 532369 - DNA, 25 bp, Homo sapien
gtgtgaattcaatacaggctatgta

SEQ ID NO: 532370 - DNA, 25 bp, Homo sapien
ctacacaaaccagtacttgcctttt

SEQ ID NO: 532371 - DNA, 25 bp, Homo sapien
agtacttgccttttgctggaaacat

SEQ ID NO: 532372 - DNA, 25 bp, Homo sapien
cattgattatgtgctcctcacgtag

SEQ ID NO: 532373 - DNA, 25 bp, Homo sapien
gattatgtgctcctcacgtagtaga

SEQ ID NO: 532374 - DNA, 25 bp, Homo sapien
ctcacgtagtagaaagcggtatcct

SEQ ID NO: 532375 - DNA, 25 bp, Homo sapien
aagcggtatcctgattagtctaaca

SEQ ID NO: 532376 - DNA, 25 bp, Homo sapien
atcctgattagtctaacagttgtgt

SEQ ID NO: 532377 - DNA, 25 bp, Homo sapien
acagttgtgttagactttagggcca

SEQ ID NO: 532378 - DNA, 25 bp, Homo sapien
gactttagggccagtattgtcagca

SEQ ID NO: 532379 - DNA, 25 bp, Homo sapien
tatgtacctttgttatgatgggata

SEQ ID NO: 532380 - DNA, 25 bp, Homo sapien
gacattgatgactgatttgtacata

SEQ ID NO: 532381 - DNA, 25 bp, Homo sapien
gtggcagcaataaggcagtctctca

SEQ ID NO: 532382 - DNA, 25 bp, Homo sapien
gtctctcaaaagtcatactgccaga

SEQ ID NO: 532383 - DNA, 25 bp, Homo sapien
actgccagagtctctagggcaagga

SEQ ID NO: 532384 - DNA, 25 bp, Homo sapien
gaaacaactagctggacaatactca

SEQ ID NO: 532385 - DNA, 25 bp, Homo sapien
ggacaatactcaattcacaacttag

SEQ ID NO: 532386 - DNA, 25 bp, Homo sapien
acaacttagcattttgccatctgaa

SEQ ID NO: 532387 - DNA, 25 bp, Homo sapien
gaagcttggcaaactagtatctgct

SEQ ID NO: 532388 - DNA, 25 bp, Homo sapien
gtatctgctgtaaaacaacctatat

SEQ ID NO: 532389 - DNA, 25 bp, Homo sapien
gtgaaccgtagtattcctgagcaaa

SEQ ID NO: 532390 - DNA, 25 bp, Homo sapien
ctgagcaaaacgtggctttcatcgc

SEQ ID NO: 532391 - DNA, 25 bp, Homo sapien
gctttcatcgctttgtaaaaatttg

SEQ ID NO: 532392 - DNA, 25 bp, Homo sapien
tggcacaatcgtaattcattgcagc

SEQ ID NO: 532393 - DNA, 25 bp, Homo sapien
cacaatcgtaattcattgcagcctt

SEQ ID NO: 532394 - DNA, 25 bp, Homo sapien
acaatcgtaattcattgcagccttg

SEQ ID NO: 532395 - DNA, 25 bp, Homo sapien
caatcgtaattcattgcagccttga

SEQ ID NO: 532396 - DNA, 25 bp, Homo sapien
acacccagccaatgtgccgaagaaa

SEQ ID NO: 532397 - DNA, 25 bp, Homo sapien
cacccagccaatgtgccgaagaaag

SEQ ID NO: 532398 - DNA, 25 bp, Homo sapien
acccagccaatgtgccgaagaaaga

SEQ ID NO: 532399 - DNA, 25 bp, Homo sapien
cccagccaatgtgccgaagaaagaa

SEQ ID NO: 532400 - DNA, 25 bp, Homo sapien
ccagccaatgtgccgaagaaagaaa

SEQ ID NO: 532401 - DNA, 25 bp, Homo sapien
agccaatgtgccgaagaaagaaaga

SEQ ID NO: 532402 - DNA, 25 bp, Homo sapien
gccaatgtgccgaagaaagaaagaa

SEQ ID NO: 532403 - DNA, 25 bp, Homo sapien
attgcaggccgccacagttcggcag

SEQ ID NO: 532404 - DNA, 25 bp, Homo sapien
acagttcggcaggtctgcagacact

SEQ ID NO: 532405 - DNA, 25 bp, Homo sapien
ttcggcaggtctgcagacactcctt

SEQ ID NO: 532406 - DNA, 25 bp, Homo sapien
cactccttttctgtgacgaagttgt

SEQ ID NO: 532407 - DNA, 25 bp, Homo sapien
ttctgtgacgaagttgttaccgttg

SEQ ID NO: 532408 - DNA, 25 bp, Homo sapien
tgtaccattatagaaatacctgctg

SEQ ID NO: 532409 - DNA, 25 bp, Homo sapien
agaaatacctgctggtcattcccat

SEQ ID NO: 532410 - DNA, 25 bp, Homo sapien
gaccggccgagtagcccagctggca

SEQ ID NO: 532411 - DNA, 25 bp, Homo sapien
ggcaggaatcttctttcttggtgac

SEQ ID NO: 532412 - DNA, 25 bp, Homo sapien
aatcttctttcttggtgacttcagt

SEQ ID NO: 532413 - DNA, 25 bp, Homo sapien
ggtgacttcagttaccagttgccca

SEQ ID NO: 532414 - DNA, 25 bp, Homo sapien
tagcatggctaggtctggaactata

SEQ ID NO: 532415 - DNA, 25 bp, Homo sapien
gcagggtcagactgtgggttcctct

SEQ ID NO: 532416 - DNA, 25 bp, Homo sapien
ttctcctgtgcttgagctctggttt

SEQ ID NO: 532417 - DNA, 25 bp, Homo sapien
tctggtttgagagctggcgctacca

SEQ ID NO: 532418 - DNA, 25 bp, Homo sapien
gagagctggcgctaccaaccttttt

SEQ ID NO: 532419 - DNA, 25 bp, Homo sapien
caacctttttcctatatcccgagtg

SEQ ID NO: 532420 - DNA, 25 bp, Homo sapien
agacggtggatctctgcccagtgtg

SEQ ID NO: 532421 - DNA, 25 bp, Homo sapien
gtctggcttggcttttcaatattgt

SEQ ID NO: 532422 - DNA, 25 bp, Homo sapien
tattgtgaggtctgaatggatctga

SEQ ID NO: 532423 - DNA, 25 bp, Homo sapien
aatgattcacagctctggcagttcc

SEQ ID NO: 532424 - DNA, 25 bp, Homo sapien
agctctggcagttcccaagtctggg

SEQ ID NO: 532425 - DNA, 25 bp, Homo sapien
atgacatcattgcagcagccaagcg

SEQ ID NO: 532426 - DNA, 25 bp, Homo sapien
tgctgatggctgagatgtctcggct

SEQ ID NO: 532427 - DNA, 25 bp, Homo sapien
atggctgagatgtctcggctggtaa

SEQ ID NO: 532428 - DNA, 25 bp, Homo sapien
ggcagtggtaccaagcgggcactca

SEQ ID NO: 532429 - DNA, 25 bp, Homo sapien
taccaagcgggcactcattcagtgt

SEQ ID NO: 532430 - DNA, 25 bp, Homo sapien
agcgggcactcattcagtgtgccaa

SEQ ID NO: 532431 - DNA, 25 bp, Homo sapien
attcagtgtgccaaggacatcgcca

SEQ ID NO: 532432 - DNA, 25 bp, Homo sapien
ggacatcgccaaggcctcagatgag

SEQ ID NO: 532433 - DNA, 25 bp, Homo sapien
tcagatgaggtgactcggttggcca

SEQ ID NO: 532434 - DNA, 25 bp, Homo sapien
actcggttggccaaggaggttgcca

SEQ ID NO: 532435 - DNA, 25 bp, Homo sapien
caagcagtgcacagataaacggatt

SEQ ID NO: 532436 - DNA, 25 bp, Homo sapien
catccagtgcttaacctaaaaaact

SEQ ID NO: 532437 - DNA, 25 bp, Homo sapien
taaaaaactccttaactctgccttg

SEQ ID NO: 532438 - DNA, 25 bp, Homo sapien
ttaactctgccttgacctgaggaag

SEQ ID NO: 532439 - DNA, 25 bp, Homo sapien
tctgccttgacctgaggaagaccat

SEQ ID NO: 532440 - DNA, 25 bp, Homo sapien
ggaagaccatgctaactggtgttat

SEQ ID NO: 532441 - DNA, 25 bp, Homo sapien
ttattttgtatgtaccctgtgctta

SEQ ID NO: 532442 - DNA, 25 bp, Homo sapien
gtatgtaccctgtgcttaattctat

SEQ ID NO: 532443 - DNA, 25 bp, Homo sapien
aacagtaaaccccatacgcaggtgg

SEQ ID NO: 532444 - DNA, 25 bp, Homo sapien
ggaggaacaccggtgcctcggtcac

SEQ ID NO: 532445 - DNA, 25 bp, Homo sapien
tgctgtgaaattaaacctgttctaa

SEQ ID NO: 532446 - DNA, 25 bp, Homo sapien
acctgttctaagtgtacttgtttga

SEQ ID NO: 532447 - DNA, 25 bp, Homo sapien
ctgagggactcgtcagtcctagcgt

SEQ ID NO: 532448 - DNA, 25 bp, Homo sapien
tgagggactcgtcagtcctagcgtc

SEQ ID NO: 532449 - DNA, 25 bp, Homo sapien
gagggactcgtcagtcctagcgtcg

SEQ ID NO: 532450 - DNA, 25 bp, Homo sapien
agggactcgtcagtcctagcgtcgc

SEQ ID NO: 532451 - DNA, 25 bp, Homo sapien
gggactcgtcagtcctagcgtcgcc

SEQ ID NO: 532452 - DNA, 25 bp, Homo sapien
ggactcgtcagtcctagcgtcgccg

SEQ ID NO: 532453 - DNA, 25 bp, Homo sapien
gactcgtcagtcctagcgtcgccgc

SEQ ID NO: 532454 - DNA, 25 bp, Homo sapien
actcgtcagtcctagcgtcgccgcc

SEQ ID NO: 532455 - DNA, 25 bp, Homo sapien
ctcgtcagtcctagcgtcgccgcct

SEQ ID NO: 532456 - DNA, 25 bp, Homo sapien
tcgtcagtcctagcgtcgccgcctg

SEQ ID NO: 532457 - DNA, 25 bp, Homo sapien
cagtcctagcgtcgccgcctgcagc

SEQ ID NO: 532458 - DNA, 25 bp, Homo sapien
ttttatgaactaactgtggtgtgtg

SEQ ID NO: 532459 - DNA, 25 bp, Homo sapien
ttatgaactaactgtggtgtgtgaa

SEQ ID NO: 532460 - DNA, 25 bp, Homo sapien
aaaactggaaatcttattccgtgtg

SEQ ID NO: 532461 - DNA, 25 bp, Homo sapien
aaactggaaatcttattccgtgtgt

SEQ ID NO: 532462 - DNA, 25 bp, Homo sapien
aactggaaatcttattccgtgtgtg

SEQ ID NO: 532463 - DNA, 25 bp, Homo sapien
actggaaatcttattccgtgtgtgt

SEQ ID NO: 532464 - DNA, 25 bp, Homo sapien
ctggaaatcttattccgtgtgtgtt

SEQ ID NO: 532465 - DNA, 25 bp, Homo sapien
tggaaatcttattccgtgtgtgttt

SEQ ID NO: 532466 - DNA, 25 bp, Homo sapien
ggaaatcttattccgtgtgtgtttg

SEQ ID NO: 532467 - DNA, 25 bp, Homo sapien
aaatcttattccgtgtgtgtttggg

SEQ ID NO: 532468 - DNA, 25 bp, Homo sapien
cgtgtgtgtttgggagttgcttggg

SEQ ID NO: 532469 - DNA, 25 bp, Homo sapien
gaatttatctcaaggaaatcccagg

SEQ ID NO: 532470 - DNA, 25 bp, Homo sapien
tatctcaaggaaatcccagggatct

SEQ ID NO: 532471 - DNA, 25 bp, Homo sapien
aaatcccagggatctgtgtgaagct

SEQ ID NO: 532472 - DNA, 25 bp, Homo sapien
cccagggatctgtgtgaagctgcac

SEQ ID NO: 532473 - DNA, 25 bp, Homo sapien
gatctgtgtgaagctgcacatgctg

SEQ ID NO: 532474 - DNA, 25 bp, Homo sapien
tgctcagtgcgggactgtttataat

SEQ ID NO: 532475 - DNA, 25 bp, Homo sapien
tgtaactcaaatgtccagaagaact

SEQ ID NO: 532476 - DNA, 25 bp, Homo sapien
gtgcatgttttcagtaagttcatat

SEQ ID NO: 532477 - DNA, 25 bp, Homo sapien
aaagtgggtgtgttgagagacaaat

SEQ ID NO: 532478 - DNA, 25 bp, Homo sapien
gggacactctgtgatgtttttggag

SEQ ID NO: 532479 - DNA, 25 bp, Homo sapien
aatattcagtcttacaattacattt

SEQ ID NO: 532480 - DNA, 25 bp, Homo sapien
gagcatgaaacaggaggtgtgcatc

SEQ ID NO: 532481 - DNA, 25 bp, Homo sapien
catgaaacaggaggtgtgcatccat

SEQ ID NO: 532482 - DNA, 25 bp, Homo sapien
aaacaggaggtgtgcatccatgatc

SEQ ID NO: 532483 - DNA, 25 bp, Homo sapien
acaggaggtgtgcatccatgatctt

SEQ ID NO: 532484 - DNA, 25 bp, Homo sapien
aggaggtgtgcatccatgatcttca

SEQ ID NO: 532485 - DNA, 25 bp, Homo sapien
gaggtgtgcatccatgatcttcagg

SEQ ID NO: 532486 - DNA, 25 bp, Homo sapien
aggtgtgcatccatgatcttcaggc

SEQ ID NO: 532487 - DNA, 25 bp, Homo sapien
ggtgtgcatccatgatcttcaggct

SEQ ID NO: 532488 - DNA, 25 bp, Homo sapien
gtgtgcatccatgatcttcaggctc

SEQ ID NO: 532489 - DNA, 25 bp, Homo sapien
tgtgcatccatgatcttcaggctca

SEQ ID NO: 532490 - DNA, 25 bp, Homo sapien
gtgcatccatgatcttcaggctcac

SEQ ID NO: 532491 - DNA, 25 bp, Homo sapien
atagagaacatgtctggctgtacgt

SEQ ID NO: 532492 - DNA, 25 bp, Homo sapien
tggctgtacgtctgacacagacaat

SEQ ID NO: 532493 - DNA, 25 bp, Homo sapien
gcacaagccagaatgcaaaacttca

SEQ ID NO: 532494 - DNA, 25 bp, Homo sapien
tgcaaaacttcagtgagtggcggaa

SEQ ID NO: 532495 - DNA, 25 bp, Homo sapien
cagtgagtggcggaaggaacatttc

SEQ ID NO: 532496 - DNA, 25 bp, Homo sapien
aggaacatttctgcatttgacaaga

SEQ ID NO: 532497 - DNA, 25 bp, Homo sapien
aagcagacccttacatttgacaaag

SEQ ID NO: 532498 - DNA, 25 bp, Homo sapien
gacccttacatttgacaaagtgcac

SEQ ID NO: 532499 - DNA, 25 bp, Homo sapien
aaagtgcacttcacttggctccatg

SEQ ID NO: 532500 - DNA, 25 bp, Homo sapien
cttggctccatgatctatttcttag

SEQ ID NO: 532501 - DNA, 25 bp, Homo sapien
aaagtcaagtcctacggtgtcgcga

SEQ ID NO: 532502 - DNA, 25 bp, Homo sapien
gtcagctgatgaaggaacactattt

SEQ ID NO: 532503 - DNA, 25 bp, Homo sapien
tggtttttggcatgcaactcggaaa

SEQ ID NO: 532504 - DNA, 25 bp, Homo sapien
actagcattctcacctatttatgta

SEQ ID NO: 532505 - DNA, 25 bp, Homo sapien
gtaaaaccatttctcagcacttgta

SEQ ID NO: 532506 - DNA, 25 bp, Homo sapien
ctcagcacttgtatctgtgaaaaca

SEQ ID NO: 532507 - DNA, 25 bp, Homo sapien
gaaccctgttaatctaccagtagga

SEQ ID NO: 532508 - DNA, 25 bp, Homo sapien
accagtaggaactattcatccagat

SEQ ID NO: 532509 - DNA, 25 bp, Homo sapien
ttaattggtgggtcagccccatcta

SEQ ID NO: 532510 - DNA, 25 bp, Homo sapien
tcagccccatctatctcactaagag

SEQ ID NO: 532511 - DNA, 25 bp, Homo sapien
ttcaacaaaattaatggtggcccat

SEQ ID NO: 532512 - DNA, 25 bp, Homo sapien
ggtggcccatgaattgtcagctgat

SEQ ID NO: 532513 - DNA, 25 bp, Homo sapien
agaccacaaaaattgactcaaatct

SEQ ID NO: 532514 - DNA, 25 bp, Homo sapien
gaccacaaaaattgactcaaatctc

SEQ ID NO: 532515 - DNA, 25 bp, Homo sapien
acaaaaattgactcaaatctccagt

SEQ ID NO: 532516 - DNA, 25 bp, Homo sapien
caaaaattgactcaaatctccagta

SEQ ID NO: 532517 - DNA, 25 bp, Homo sapien
aaaaattgactcaaatctccagtat

SEQ ID NO: 532518 - DNA, 25 bp, Homo sapien
aaaattgactcaaatctccagtatt

SEQ ID NO: 532519 - DNA, 25 bp, Homo sapien
aaattgactcaaatctccagtattc

SEQ ID NO: 532520 - DNA, 25 bp, Homo sapien
aattgactcaaatctccagtattct

SEQ ID NO: 532521 - DNA, 25 bp, Homo sapien
attgactcaaatctccagtattctt

SEQ ID NO: 532522 - DNA, 25 bp, Homo sapien
ttgactcaaatctccagtattcttg

SEQ ID NO: 532523 - DNA, 25 bp, Homo sapien
tgactcaaatctccagtattcttgt

SEQ ID NO: 532524 - DNA, 25 bp, Homo sapien
gctggagagccatgtatatggcttc

SEQ ID NO: 532525 - DNA, 25 bp, Homo sapien
tatggcttcaaagccacctacggca

SEQ ID NO: 532526 - DNA, 25 bp, Homo sapien
ttcaaagccacctacggcagggaca

SEQ ID NO: 532527 - DNA, 25 bp, Homo sapien
acggcagggacacactcgtgagcat

SEQ ID NO: 532528 - DNA, 25 bp, Homo sapien
cactcgtgagcatgtgtggcctgca

SEQ ID NO: 532529 - DNA, 25 bp, Homo sapien
tcaggtgatacatttaccagtgttc

SEQ ID NO: 532530 - DNA, 25 bp, Homo sapien
ttcttgtttgtgtggtgccaggaaa

SEQ ID NO: 532531 - DNA, 25 bp, Homo sapien
ggtgccaggaaattgattttggaaa

SEQ ID NO: 532532 - DNA, 25 bp, Homo sapien
gtgaatgtgaggcttctacttttat

SEQ ID NO: 532533 - DNA, 25 bp, Homo sapien
gctatattagctaggctgtttctga

SEQ ID NO: 532534 - DNA, 25 bp, Homo sapien
ggctgtttctgatatccaatcattg

SEQ ID NO: 532535 - DNA, 25 bp, Homo sapien
aaattattctgtctgcttaagttgg

SEQ ID NO: 532536 - DNA, 25 bp, Homo sapien
ctgtctgcttaagttggaggctact

SEQ ID NO: 532537 - DNA, 25 bp, Homo sapien
ttggaggctacttactctttcacct

SEQ ID NO: 532538 - DNA, 25 bp, Homo sapien
ccttttattcttccagatcaggaat

SEQ ID NO: 532539 - DNA, 25 bp, Homo sapien
gaaatttccatgctgctcataaaga

SEQ ID NO: 532540 - DNA, 25 bp, Homo sapien
tagtcagggttttaaatgcacattt

SEQ ID NO: 532541 - DNA, 25 bp, Homo sapien
atgcacatttattccaagtatcttt

SEQ ID NO: 532542 - DNA, 25 bp, Homo sapien
attccaagtatctttgtgttttctc

SEQ ID NO: 532543 - DNA, 25 bp, Homo sapien
tatttaaacttattctctctgtgag

SEQ ID NO: 532544 - DNA, 25 bp, Homo sapien
atataagtagactggagggacatcc

SEQ ID NO: 532545 - DNA, 25 bp, Homo sapien
ggagggacatccagatgtccagttt

SEQ ID NO: 532546 - DNA, 25 bp, Homo sapien
tactttcctgcaaaattttcttcaa

SEQ ID NO: 532547 - DNA, 25 bp, Homo sapien
tttcttcaaagcaacaagtcctagg

SEQ ID NO: 532548 - DNA, 25 bp, Homo sapien
aagtcctaggagcacacaaagcaac

SEQ ID NO: 532549 - DNA, 25 bp, Homo sapien
tggaaaagctctttcttacctaaag

SEQ ID NO: 532550 - DNA, 25 bp, Homo sapien
gaaggtagctttttattactccgtg

SEQ ID NO: 532551 - DNA, 25 bp, Homo sapien
ggagcatgtacagagctctgtgtat

SEQ ID NO: 532552 - DNA, 25 bp, Homo sapien
gagctctgtgtatacacagcttcac

SEQ ID NO: 532553 - DNA, 25 bp, Homo sapien
cacccaccagattgttactacagtg

SEQ ID NO: 532554 - DNA, 25 bp, Homo sapien
tactacagtgggttgggttttcata

SEQ ID NO: 532555 - DNA, 25 bp, Homo sapien
gaaaagtcaaaggtgcttcagcctt

SEQ ID NO: 532556 - DNA, 25 bp, Homo sapien
gtgcttcagccttgtactgtgtata

SEQ ID NO: 532557 - DNA, 25 bp, Homo sapien
acaagacattccagccccagggact

SEQ ID NO: 532558 - DNA, 25 bp, Homo sapien
ggactttgcaggcttcattccctgt

SEQ ID NO: 532559 - DNA, 25 bp, Homo sapien
gcaggcttcattccctgtctgtgtc

SEQ ID NO: 532560 - DNA, 25 bp, Homo sapien
ggaagcttcaaacttgagcaggcca

SEQ ID NO: 532561 - DNA, 25 bp, Homo sapien
gagcaggccagagatgtccttacca

SEQ ID NO: 532562 - DNA, 25 bp, Homo sapien
ggccagagatgtccttaccaaattg

SEQ ID NO: 532563 - DNA, 25 bp, Homo sapien
tctcaaagacgcctccagaaatgga

SEQ ID NO: 532564 - DNA, 25 bp, Homo sapien
gaaatggacaaaatggccttccctt

SEQ ID NO: 532565 - DNA, 25 bp, Homo sapien
ccttcgttcctttccaggcaataat

SEQ ID NO: 532566 - DNA, 25 bp, Homo sapien
ctttccaggcaataatgacatcatt

SEQ ID NO: 532567 - DNA, 25 bp, Homo sapien
gatgcaattctatttgtctttctct

SEQ ID NO: 532568 - DNA, 25 bp, Homo sapien
cggtcagttagcctggctgggtgag

SEQ ID NO: 532569 - DNA, 25 bp, Homo sapien
tgctgggtaatgacctcggccctgg

SEQ ID NO: 532570 - DNA, 25 bp, Homo sapien
tgggtaatgacctcggccctgggtt

SEQ ID NO: 532571 - DNA, 25 bp, Homo sapien
gagcctcagaaagggccaagggcaa

SEQ ID NO: 532572 - DNA, 25 bp, Homo sapien
gggctctgggaatctcagctctagc

SEQ ID NO: 532573 - DNA, 25 bp, Homo sapien
tgggaatctcagctctagccctgta

SEQ ID NO: 532574 - DNA, 25 bp, Homo sapien
gaatctcagctctagccctgtatgg

SEQ ID NO: 532575 - DNA, 25 bp, Homo sapien
agctctagccctgtatggccaggat

SEQ ID NO: 532576 - DNA, 25 bp, Homo sapien
tctagccctgtatggccaggatctg

SEQ ID NO: 532577 - DNA, 25 bp, Homo sapien
tgtatggccaggatctgctgtctcc

SEQ ID NO: 532578 - DNA, 25 bp, Homo sapien
atggccaggatctgctgtctccgtc

SEQ ID NO: 532579 - DNA, 25 bp, Homo sapien
ttccttccatcttccttgcagaaac

SEQ ID NO: 532580 - DNA, 25 bp, Homo sapien
ttccatcttccttgcagaaaccacg

SEQ ID NO: 532581 - DNA, 25 bp, Homo sapien
atcttccttgcagaaaccacgagaa

SEQ ID NO: 532582 - DNA, 25 bp, Homo sapien
cacgagaacaaagccagttccctgt

SEQ ID NO: 532583 - DNA, 25 bp, Homo sapien
ctgtcagtgacagggcttcttgtaa

SEQ ID NO: 532584 - DNA, 25 bp, Homo sapien
cagtgacagggcttcttgtaatttg

SEQ ID NO: 532585 - DNA, 25 bp, Homo sapien
gtatgtgccttaaacctgaatgtct

SEQ ID NO: 532586 - DNA, 25 bp, Homo sapien
tatgtgccttaaacctgaatgtctg

SEQ ID NO: 532587 - DNA, 25 bp, Homo sapien
ctgaatgtctgtagccaaaacttgt

SEQ ID NO: 532588 - DNA, 25 bp, Homo sapien
atgtctgtagccaaaacttgtttcc

SEQ ID NO: 532589 - DNA, 25 bp, Homo sapien
tctgtagccaaaacttgtttccaca

SEQ ID NO: 532590 - DNA, 25 bp, Homo sapien
gtgtgtcatcagaaaggtttatccc

SEQ ID NO: 532591 - DNA, 25 bp, Homo sapien
aggtttatccctttgagagtatcaa

SEQ ID NO: 532592 - DNA, 25 bp, Homo sapien
aagtcctcagttaatgattcttgct

SEQ ID NO: 532593 - DNA, 25 bp, Homo sapien
ttcatccctccagtatttgctgtgg

SEQ ID NO: 532594 - DNA, 25 bp, Homo sapien
gtgggagctcgttttattctttaat

SEQ ID NO: 532595 - DNA, 25 bp, Homo sapien
gacatttttcttggttcttatctga

SEQ ID NO: 532596 - DNA, 25 bp, Homo sapien
tcatctgtaacctttcatgtgtgtt

SEQ ID NO: 532597 - DNA, 25 bp, Homo sapien
actgatctgatcatttgggatttgc

SEQ ID NO: 532598 - DNA, 25 bp, Homo sapien
ttgctgaggcatttgtgagtcttcc

SEQ ID NO: 532599 - DNA, 25 bp, Homo sapien
tgtgagtcttccttataaacctgat

SEQ ID NO: 532600 - DNA, 25 bp, Homo sapien
gatctcaactatctagcttgtgtgt

SEQ ID NO: 532601 - DNA, 25 bp, Homo sapien
ctagctttagtagtgctgctacaac

SEQ ID NO: 532602 - DNA, 25 bp, Homo sapien
gtagtgctgctacaaccagctctta

SEQ ID NO: 532603 - DNA, 25 bp, Homo sapien
gctacaaccagctcttataagtaag

SEQ ID NO: 532604 - DNA, 25 bp, Homo sapien
gcacttgataattatcctgacagct

SEQ ID NO: 532605 - DNA, 25 bp, Homo sapien
ctgacagctctgatctctgtaatag

SEQ ID NO: 532606 - DNA, 25 bp, Homo sapien
aatagattcactcttcagctctggg

SEQ ID NO: 532607 - DNA, 25 bp, Homo sapien
actcttcagctctgggcagaaccag

SEQ ID NO: 532608 - DNA, 25 bp, Homo sapien
cagaggcagggttcacaccaaattt

SEQ ID NO: 532609 - DNA, 25 bp, Homo sapien
ggcagggttcacaccaaatttgtaa

SEQ ID NO: 532610 - DNA, 25 bp, Homo sapien
aataccatatgtgggtctggtgtcc

SEQ ID NO: 532611 - DNA, 25 bp, Homo sapien
tctggtgtccaggaacttttttctt

SEQ ID NO: 532612 - DNA, 25 bp, Homo sapien
ggatcatcaaggaaacccagcgttt

SEQ ID NO: 532613 - DNA, 25 bp, Homo sapien
tcatcaaggaaacccagcgtttgct

SEQ ID NO: 532614 - DNA, 25 bp, Homo sapien
agcaacgcccgttattttcatgtgg

SEQ ID NO: 532615 - DNA, 25 bp, Homo sapien
aacgcccgttattttcatgtggtca

SEQ ID NO: 532616 - DNA, 25 bp, Homo sapien
gcccgttattttcatgtggtcattg

SEQ ID NO: 532617 - DNA, 25 bp, Homo sapien
ccgttattttcatgtggtcattgct

SEQ ID NO: 532618 - DNA, 25 bp, Homo sapien
caatggcagcccctaaagtacgttt

SEQ ID NO: 532619 - DNA, 25 bp, Homo sapien
atggcagcccctaaagtacgtttca

SEQ ID NO: 532620 - DNA, 25 bp, Homo sapien
gcagcccctaaagtacgtttcatga

SEQ ID NO: 532621 - DNA, 25 bp, Homo sapien
gcccctaaagtacgtttcatgacca

SEQ ID NO: 532622 - DNA, 25 bp, Homo sapien
agtacgtttcatgaccaaaatttat

SEQ ID NO: 532623 - DNA, 25 bp, Homo sapien
ttctgggacctttcggtgcgtccga

SEQ ID NO: 532624 - DNA, 25 bp, Homo sapien
tctgggacctttcggtgcgtccgag

SEQ ID NO: 532625 - DNA, 25 bp, Homo sapien
tgggacctttcggtgcgtccgagcg

SEQ ID NO: 532626 - DNA, 25 bp, Homo sapien
gggacctttcggtgcgtccgagcgc

SEQ ID NO: 532627 - DNA, 25 bp, Homo sapien
cctttcggtgcgtccgagcgcgaca

SEQ ID NO: 532628 - DNA, 25 bp, Homo sapien
ctttcggtgcgtccgagcgcgacac

SEQ ID NO: 532629 - DNA, 25 bp, Homo sapien
tttcggtgcgtccgagcgcgacacc

SEQ ID NO: 532630 - DNA, 25 bp, Homo sapien
tcggtgcgtccgagcgcgacaccgc

SEQ ID NO: 532631 - DNA, 25 bp, Homo sapien
gggcgcgagctgtgttggaagcaaa

SEQ ID NO: 532632 - DNA, 25 bp, Homo sapien
gttggaagcaaagtcctccttgtgg

SEQ ID NO: 532633 - DNA, 25 bp, Homo sapien
ttggaagcaaagtcctccttgtggg

SEQ ID NO: 532634 - DNA, 25 bp, Homo sapien
aaccagttatatacccagtgcaata

SEQ ID NO: 532635 - DNA, 25 bp, Homo sapien
atatacccagtgcaatattattgtg

SEQ ID NO: 532636 - DNA, 25 bp, Homo sapien
gaaatctctgcacttcaaccctaaa

SEQ ID NO: 532637 - DNA, 25 bp, Homo sapien
gggtctgcttttcaggtctgaaagt

SEQ ID NO: 532638 - DNA, 25 bp, Homo sapien
gaaaacacttcagcacaactggcaa

SEQ ID NO: 532639 - DNA, 25 bp, Homo sapien
aactggcaaactccaatgagacctt

SEQ ID NO: 532640 - DNA, 25 bp, Homo sapien
atgagaccttacatgaaagcagttt

SEQ ID NO: 532641 - DNA, 25 bp, Homo sapien
gaaagcagttttacctacattcact

SEQ ID NO: 532642 - DNA, 25 bp, Homo sapien
ttacctacattcactggcaggaggg

SEQ ID NO: 532643 - DNA, 25 bp, Homo sapien
gcactgggaatatcctctggcacca

SEQ ID NO: 532644 - DNA, 25 bp, Homo sapien
atatcctctggcaccagaacagatt

SEQ ID NO: 532645 - DNA, 25 bp, Homo sapien
gaactgactgagtgggccgcaactg

SEQ ID NO: 532646 - DNA, 25 bp, Homo sapien
caactgactgagtgggccgcggctc

SEQ ID NO: 532647 - DNA, 25 bp, Homo sapien
aaggactgaacagcagccgacttcc

SEQ ID NO: 532648 - DNA, 25 bp, Homo sapien
gacttcccaggctctaaaaatcgtg

SEQ ID NO: 532649 - DNA, 25 bp, Homo sapien
gtgcctctgagttagagctacctca

SEQ ID NO: 532650 - DNA, 25 bp, Homo sapien
gaaatggagtcttttggccagtatt

SEQ ID NO: 532651 - DNA, 25 bp, Homo sapien
gggtgttcggaattcaagcgtatga

SEQ ID NO: 532652 - DNA, 25 bp, Homo sapien
gacggtagcgttgagaattttcatt

SEQ ID NO: 532653 - DNA, 25 bp, Homo sapien
tttgaagatctcgtcttaaccaccc

SEQ ID NO: 532654 - DNA, 25 bp, Homo sapien
tcttaaccaccccaagtgtagtcag

SEQ ID NO: 532655 - DNA, 25 bp, Homo sapien
aagtgtagtcagaggcggcgttttc

SEQ ID NO: 532656 - DNA, 25 bp, Homo sapien
agagaaggagacgtcagctgagaaa

SEQ ID NO: 532657 - DNA, 25 bp, Homo sapien
aaggagagtggctcgacccttgacc

SEQ ID NO: 532658 - DNA, 25 bp, Homo sapien
tgacctttctggctccagagagacg

SEQ ID NO: 532659 - DNA, 25 bp, Homo sapien
attctcttaggctccaaccaaggct

SEQ ID NO: 532660 - DNA, 25 bp, Homo sapien
accattcccggagtaataaatccag

SEQ ID NO: 532661 - DNA, 25 bp, Homo sapien
taaatccagttggagcagcagtgat

SEQ ID NO: 532662 - DNA, 25 bp, Homo sapien
ggatcgacacgttccgatcacaaca

SEQ ID NO: 532663 - DNA, 25 bp, Homo sapien
acaacaccagtaccagcacgaagag

SEQ ID NO: 532664 - DNA, 25 bp, Homo sapien
gaagagcctcctcccgaaagagtct

SEQ ID NO: 532665 - DNA, 25 bp, Homo sapien
aaagagtctcggctggacaccttct

SEQ ID NO: 532666 - DNA, 25 bp, Homo sapien
acaccttctgggactagcagtgaat

SEQ ID NO: 532667 - DNA, 25 bp, Homo sapien
aagtcatgctgaatactcctcccct

SEQ ID NO: 532668 - DNA, 25 bp, Homo sapien
agtctgggttactcttcgcttctgg

SEQ ID NO: 532669 - DNA, 25 bp, Homo sapien
ttactcttcgcttctggtatctggc

SEQ ID NO: 532670 - DNA, 25 bp, Homo sapien
ctggtatctggcgttctttggtaca

SEQ ID NO: 532671 - DNA, 25 bp, Homo sapien
tgctgacattcccatcacaacattc

SEQ ID NO: 532672 - DNA, 25 bp, Homo sapien
acaacattcctcagacaagcctgta

SEQ ID NO: 532673 - DNA, 25 bp, Homo sapien
attcctcagacaagcctgtaaacta

SEQ ID NO: 532674 - DNA, 25 bp, Homo sapien
ctgatggcacagaaggatcttaatt

SEQ ID NO: 532675 - DNA, 25 bp, Homo sapien
aggatcttaattcccatctctatac

SEQ ID NO: 532676 - DNA, 25 bp, Homo sapien
atctctatacttctcctttggacat

SEQ ID NO: 532677 - DNA, 25 bp, Homo sapien
atacttctcctttggacatggaaag

SEQ ID NO: 532678 - DNA, 25 bp, Homo sapien
ttccttcctcagcatacagacttca

SEQ ID NO: 532679 - DNA, 25 bp, Homo sapien
gagtcttagctattagggcagtttc

SEQ ID NO: 532680 - DNA, 25 bp, Homo sapien
gcagtttctgcttctccattttggg

SEQ ID NO: 532681 - DNA, 25 bp, Homo sapien
gggacaaaggccttgcccagtacaa

SEQ ID NO: 532682 - DNA, 25 bp, Homo sapien
tgcccagtacaaatctagccccttg

SEQ ID NO: 532683 - DNA, 25 bp, Homo sapien
cccttgtcccacagacttctggatg

SEQ ID NO: 532684 - DNA, 25 bp, Homo sapien
taaacctagtggcaatgtagcaacc

SEQ ID NO: 532685 - DNA, 25 bp, Homo sapien
gcaaccataggctagaaccaaaccc

SEQ ID NO: 532686 - DNA, 25 bp, Homo sapien
ccaagatttgggtcagtgccctgtt

SEQ ID NO: 532687 - DNA, 25 bp, Homo sapien
gtcagtgccctgttaagggttttag

SEQ ID NO: 532688 - DNA, 25 bp, Homo sapien
ggtaaggacaccacagctaaatctg

SEQ ID NO: 532689 - DNA, 25 bp, Homo sapien
tggcacaatcgtaattcattgcagc

SEQ ID NO: 532690 - DNA, 25 bp, Homo sapien
cacaatcgtaattcattgcagcctt

SEQ ID NO: 532691 - DNA, 25 bp, Homo sapien
acaatcgtaattcattgcagccttg

SEQ ID NO: 532692 - DNA, 25 bp, Homo sapien
caatcgtaattcattgcagccttga

SEQ ID NO: 532693 - DNA, 25 bp, Homo sapien
ttataggcatggagccgccacaccc

SEQ ID NO: 532694 - DNA, 25 bp, Homo sapien
acacccagccaatgtgccgaagaaa

SEQ ID NO: 532695 - DNA, 25 bp, Homo sapien
cacccagccaatgtgccgaagaaag

SEQ ID NO: 532696 - DNA, 25 bp, Homo sapien
acccagccaatgtgccgaagaaaga

SEQ ID NO: 532697 - DNA, 25 bp, Homo sapien
cccagccaatgtgccgaagaaagaa

SEQ ID NO: 532698 - DNA, 25 bp, Homo sapien
agccaatgtgccgaagaaagaaaga

SEQ ID NO: 532699 - DNA, 25 bp, Homo sapien
gccaatgtgccgaagaaagaaagaa

SEQ ID NO: 532700 - DNA, 25 bp, Homo sapien
gtcattcattgaaacttcggcccta

SEQ ID NO: 532701 - DNA, 25 bp, Homo sapien
ttcggccctagactctacaaatgta

SEQ ID NO: 532702 - DNA, 25 bp, Homo sapien
gaagctgcttttcagacaattttaa

SEQ ID NO: 532703 - DNA, 25 bp, Homo sapien
gatttaccgcattgtttctcagaag

SEQ ID NO: 532704 - DNA, 25 bp, Homo sapien
aatgacatgtctccaagcaacaatg

SEQ ID NO: 532705 - DNA, 25 bp, Homo sapien
gtggttcctattcatgttccaccaa

SEQ ID NO: 532706 - DNA, 25 bp, Homo sapien
gttccaccaaccactgaaaacaagc

SEQ ID NO: 532707 - DNA, 25 bp, Homo sapien
aacatctaaggcatttctcttctcc

SEQ ID NO: 532708 - DNA, 25 bp, Homo sapien
tcttctcccctagaaggctgtgtat

SEQ ID NO: 532709 - DNA, 25 bp, Homo sapien
aaggctgtgtatagtccatttccca

SEQ ID NO: 532710 - DNA, 25 bp, Homo sapien
gtccatttcccaggtctgagattta

SEQ ID NO: 532711 - DNA, 25 bp, Homo sapien
aatctatcaatatatgcatacatga

SEQ ID NO: 532712 - DNA, 25 bp, Homo sapien
gggctgttgtactctcactttactt

SEQ ID NO: 532713 - DNA, 25 bp, Homo sapien
ggctgttgtactctcactttactta

SEQ ID NO: 532714 - DNA, 25 bp, Homo sapien
gctgttgtactctcactttacttat

SEQ ID NO: 532715 - DNA, 25 bp, Homo sapien
ctgttgtactctcactttacttatc

SEQ ID NO: 532716 - DNA, 25 bp, Homo sapien
gttgtactctcactttacttatcct

SEQ ID NO: 532717 - DNA, 25 bp, Homo sapien
ttgtactctcactttacttatcctt

SEQ ID NO: 532718 - DNA, 25 bp, Homo sapien
tgtactctcactttacttatcctta

SEQ ID NO: 532719 - DNA, 25 bp, Homo sapien
gtactctcactttacttatccttaa

SEQ ID NO: 532720 - DNA, 25 bp, Homo sapien
tactctcactttacttatccttaaa

SEQ ID NO: 532721 - DNA, 25 bp, Homo sapien
tacatacttatgtttgtattaatct

SEQ ID NO: 532722 - DNA, 25 bp, Homo sapien
agatttgctgttgtgcttttagaga

SEQ ID NO: 532723 - DNA, 25 bp, Homo sapien
gagaaaagtctggactcagccacaa

SEQ ID NO: 532724 - DNA, 25 bp, Homo sapien
ggactcagccacaaactctaataag

SEQ ID NO: 532725 - DNA, 25 bp, Homo sapien
gacctgtacatctgagaacctttcc

SEQ ID NO: 532726 - DNA, 25 bp, Homo sapien
ctgagaacctttcccgttactgcgt

SEQ ID NO: 532727 - DNA, 25 bp, Homo sapien
gttactgcgttttcaccacctgtct

SEQ ID NO: 532728 - DNA, 25 bp, Homo sapien
cttccccatgctttatttatctgta

SEQ ID NO: 532729 - DNA, 25 bp, Homo sapien
gaacacagatttgacattacagcta

SEQ ID NO: 532730 - DNA, 25 bp, Homo sapien
gattcagaaatcctggcatgtgaca

SEQ ID NO: 532731 - DNA, 25 bp, Homo sapien
atcctggcatgtgacaattttgtta

SEQ ID NO: 532732 - DNA, 25 bp, Homo sapien
taatttctcaatattatgcgccaag

SEQ ID NO: 532733 - DNA, 25 bp, Homo sapien
atgctgggcaagagatctgccatcc

SEQ ID NO: 532734 - DNA, 25 bp, Homo sapien
tgctgggcaagagatctgccatcct

SEQ ID NO: 532735 - DNA, 25 bp, Homo sapien
gctgggcaagagatctgccatccta

SEQ ID NO: 532736 - DNA, 25 bp, Homo sapien
ctgggcaagagatctgccatcctaa

SEQ ID NO: 532737 - DNA, 25 bp, Homo sapien
tgggcaagagatctgccatcctaaa

SEQ ID NO: 532738 - DNA, 25 bp, Homo sapien
gggcaagagatctgccatcctaaaa

SEQ ID NO: 532739 - DNA, 25 bp, Homo sapien
ggcaagagatctgccatcctaaaaa

SEQ ID NO: 532740 - DNA, 25 bp, Homo sapien
gcaagagatctgccatcctaaaaat

SEQ ID NO: 532741 - DNA, 25 bp, Homo sapien
caagagatctgccatcctaaaaatg

SEQ ID NO: 532742 - DNA, 25 bp, Homo sapien
agcttgcatggccttgtactgcatt

SEQ ID NO: 532743 - DNA, 25 bp, Homo sapien
ttgcatggccttgtactgcattggg

SEQ ID NO: 532744 - DNA, 25 bp, Homo sapien
ggtggcacgtcccagtatttacgga

SEQ ID NO: 532745 - DNA, 25 bp, Homo sapien
cagtatttacggaccttcttcttct

SEQ ID NO: 532746 - DNA, 25 bp, Homo sapien
gggaacgaatcagtccaccgtgctc

SEQ ID NO: 532747 - DNA, 25 bp, Homo sapien
atcagtccaccgtgctcctctttag

SEQ ID NO: 532748 - DNA, 25 bp, Homo sapien
ctctttagcgcctctggtcaaaggt

SEQ ID NO: 532749 - DNA, 25 bp, Homo sapien
tagcgcctctggtcaaaggtttgct

SEQ ID NO: 532750 - DNA, 25 bp, Homo sapien
ggtcaaaggtttgctgcgtcgtcgc

SEQ ID NO: 532751 - DNA, 25 bp, Homo sapien
aaggtttgctgcgtcgtcgcctgtc

SEQ ID NO: 532752 - DNA, 25 bp, Homo sapien
gagcagtggctggaatctgacccgc

SEQ ID NO: 532753 - DNA, 25 bp, Homo sapien
gttctggacattgaacagttctcta

SEQ ID NO: 532754 - DNA, 25 bp, Homo sapien
gaacagttctctacggtcaagggcg

SEQ ID NO: 532755 - DNA, 25 bp, Homo sapien
tctctacggtcaagggcgtggagct

SEQ ID NO: 532756 - DNA, 25 bp, Homo sapien
ggagctggagcctaccgaccaggac

SEQ ID NO: 532757 - DNA, 25 bp, Homo sapien
tggagcctaccgaccaggacttcta

SEQ ID NO: 532758 - DNA, 25 bp, Homo sapien
ttctaccagaagtttgccacaggca

SEQ ID NO: 532759 - DNA, 25 bp, Homo sapien
agaagtttgccacaggcagtgtgcc

SEQ ID NO: 532760 - DNA, 25 bp, Homo sapien
ctgaatgtctttgggctggatggct

SEQ ID NO: 532761 - DNA, 25 bp, Homo sapien
tttgggctggatggctcagttcccc

SEQ ID NO: 532762 - DNA, 25 bp, Homo sapien
ctgcacctcctaaaaagggactgct

SEQ ID NO: 532763 - DNA, 25 bp, Homo sapien
aagggactgctgcagagactcttca

SEQ ID NO: 532764 - DNA, 25 bp, Homo sapien
gggcaggtgcttccatagcccctcc

SEQ ID NO: 532765 - DNA, 25 bp, Homo sapien
actctgccaagcttttccagcagca

SEQ ID NO: 532766 - DNA, 25 bp, Homo sapien
tctgccaagcttttccagcagcatt

SEQ ID NO: 532767 - DNA, 25 bp, Homo sapien
ctgccaagcttttccagcagcattg

SEQ ID NO: 532768 - DNA, 25 bp, Homo sapien
cttttccagcagcattgactctcct

SEQ ID NO: 532769 - DNA, 25 bp, Homo sapien
ttttccagcagcattgactctcctg

SEQ ID NO: 532770 - DNA, 25 bp, Homo sapien
gcagcattgactctcctggggctga

SEQ ID NO: 532771 - DNA, 25 bp, Homo sapien
ctgaatgtgacaggcttgtggtgtt

SEQ ID NO: 532772 - DNA, 25 bp, Homo sapien
aatgtgacaggcttgtggtgttcct

SEQ ID NO: 532773 - DNA, 25 bp, Homo sapien
ctccacaatggcctcctttaagagg

SEQ ID NO: 532774 - DNA, 25 bp, Homo sapien
tccacaatggcctcctttaagaggg

SEQ ID NO: 532775 - DNA, 25 bp, Homo sapien
gtgcagcagatcatgagtgacccag

SEQ ID NO: 532776 - DNA, 25 bp, Homo sapien
agcagatcatgagtgacccagccat

SEQ ID NO: 532777 - DNA, 25 bp, Homo sapien
agccatgcgccttatcctggaacag

SEQ ID NO: 532778 - DNA, 25 bp, Homo sapien
gccttatcctggaacagatgcagaa

SEQ ID NO: 532779 - DNA, 25 bp, Homo sapien
caggcactcagcgaacacttaaaga

SEQ ID NO: 532780 - DNA, 25 bp, Homo sapien
gcgaacacttaaagaatcctgtaat

SEQ ID NO: 532781 - DNA, 25 bp, Homo sapien
atcctgtaatagcacagaagatcca

SEQ ID NO: 532782 - DNA, 25 bp, Homo sapien
gatgtgggtctgattgcaattcggt

SEQ ID NO: 532783 - DNA, 25 bp, Homo sapien
tctgattgcaattcggtgatgactt

SEQ ID NO: 532784 - DNA, 25 bp, Homo sapien
gggagagaaggcctcatctctctat

SEQ ID NO: 532785 - DNA, 25 bp, Homo sapien
gaaggcctcatctctctatatttat

SEQ ID NO: 532786 - DNA, 25 bp, Homo sapien
gagagtcgcttctaagatgctccga

SEQ ID NO: 532787 - DNA, 25 bp, Homo sapien
taagatgctccgagggaagccggca

SEQ ID NO: 532788 - DNA, 25 bp, Homo sapien
gactgacctgcccacgtatgagcac

SEQ ID NO: 532789 - DNA, 25 bp, Homo sapien
tatgagcacatccagaccgccctgt

SEQ ID NO: 532790 - DNA, 25 bp, Homo sapien
cagaccgccctgtcgagtaaggacg

SEQ ID NO: 532791 - DNA, 25 bp, Homo sapien
ccggcctgacagacccagggagctg

SEQ ID NO: 532792 - DNA, 25 bp, Homo sapien
gttcccgtgcgtgttagtttggaca

SEQ ID NO: 532793 - DNA, 25 bp, Homo sapien
atttagtctaaaaagctgtctggtt

SEQ ID NO: 532794 - DNA, 25 bp, Homo sapien
gctgtctggttgtataaacggtgca

SEQ ID NO: 532795 - DNA, 25 bp, Homo sapien
aacggtgcaaacaatgtcgccacag

SEQ ID NO: 532796 - DNA, 25 bp, Homo sapien
agcacccacgcggtttgcattcttt

SEQ ID NO: 532797 - DNA, 25 bp, Homo sapien
tcgggttctgacaagatggccgggc

SEQ ID NO: 532798 - DNA, 25 bp, Homo sapien
gggttctgacaagatggccgggctg

SEQ ID NO: 532799 - DNA, 25 bp, Homo sapien
ggttctgacaagatggccgggctgc

SEQ ID NO: 532800 - DNA, 25 bp, Homo sapien
tgtggtcattgctggccctcaggat

SEQ ID NO: 532801 - DNA, 25 bp, Homo sapien
gtggtcattgctggccctcaggatt

SEQ ID NO: 532802 - DNA, 25 bp, Homo sapien
tggtcattgctggccctcaggattc

SEQ ID NO: 532803 - DNA, 25 bp, Homo sapien
gtcattgctggccctcaggattccc

SEQ ID NO: 532804 - DNA, 25 bp, Homo sapien
tttaaacttgaactattccttccag

SEQ ID NO: 532805 - DNA, 25 bp, Homo sapien
ttaaacttgaactattccttccaga

SEQ ID NO: 532806 - DNA, 25 bp, Homo sapien
taaacttgaactattccttccagaa

SEQ ID NO: 532807 - DNA, 25 bp, Homo sapien
aaacttgaactattccttccagaag

SEQ ID NO: 532808 - DNA, 25 bp, Homo sapien
gatgaagttgcattacacctcactg

SEQ ID NO: 532809 - DNA, 25 bp, Homo sapien
gaagttgcattacacctcactgcaa

SEQ ID NO: 532810 - DNA, 25 bp, Homo sapien
agttgcattacacctcactgcaagg

SEQ ID NO: 532811 - DNA, 25 bp, Homo sapien
attttatttatatcccatctagaat

SEQ ID NO: 532812 - DNA, 25 bp, Homo sapien
atttatatcccatctagaattcagc

SEQ ID NO: 532813 - DNA, 25 bp, Homo sapien
gaattcagctaggtgctgctgctgc

SEQ ID NO: 532814 - DNA, 25 bp, Homo sapien
tgctctgtttcctttgatgacgctt

SEQ ID NO: 532815 - DNA, 25 bp, Homo sapien
tctgtttcctttgatgacgctttga

SEQ ID NO: 532816 - DNA, 25 bp, Homo sapien
ctgtttcctttgatgacgctttgaa

SEQ ID NO: 532817 - DNA, 25 bp, Homo sapien
ttcctttgatgacgctttgaaataa

SEQ ID NO: 532818 - DNA, 25 bp, Homo sapien
gatgacgctttgaaataaaggcagg

SEQ ID NO: 532819 - DNA, 25 bp, Homo sapien
tcttcagattgatagggagttttaa

SEQ ID NO: 532820 - DNA, 25 bp, Homo sapien
gttactaaaattatgttactgtatt

SEQ ID NO: 532821 - DNA, 25 bp, Homo sapien
aactgcttatgaaaagtactaatag

SEQ ID NO: 532822 - DNA, 25 bp, Homo sapien
ctttctaaccttcacgattaactgt

SEQ ID NO: 532823 - DNA, 25 bp, Homo sapien
gattaactgtgaaatgtacgtcatt

SEQ ID NO: 532824 - DNA, 25 bp, Homo sapien
gtacgtcatttgtgcaagaccgttt

SEQ ID NO: 532825 - DNA, 25 bp, Homo sapien
gtcatttgtgcaagaccgtttgtcc

SEQ ID NO: 532826 - DNA, 25 bp, Homo sapien
atttgtgcaagaccgtttgtccact

SEQ ID NO: 532827 - DNA, 25 bp, Homo sapien
gtgcaagaccgtttgtccacttcat

SEQ ID NO: 532828 - DNA, 25 bp, Homo sapien
ataatcacagttgtgttcctgacac

SEQ ID NO: 532829 - DNA, 25 bp, Homo sapien
gtgttcctgacactcaataaacagt

SEQ ID NO: 532830 - DNA, 25 bp, Homo sapien
gatgtttgactgtaccattgactgt

SEQ ID NO: 532831 - DNA, 25 bp, Homo sapien
gactgtaccattgactgttatggaa

SEQ ID NO: 532832 - DNA, 25 bp, Homo sapien
gttcagcgttgtatgtctctctcta

SEQ ID NO: 532833 - DNA, 25 bp, Homo sapien
gatgaagttgcattacacctcactg

SEQ ID NO: 532834 - DNA, 25 bp, Homo sapien
agttgcattacacctcactgcaagg

SEQ ID NO: 532835 - DNA, 25 bp, Homo sapien
cactgcaaggattctttacttagct

SEQ ID NO: 532836 - DNA, 25 bp, Homo sapien
atttatatcccatctagaattcagc

SEQ ID NO: 532837 - DNA, 25 bp, Homo sapien
gaattcagctaggtgctgctgctgc

SEQ ID NO: 532838 - DNA, 25 bp, Homo sapien
tgctctgtttcctttgatgacgctt

SEQ ID NO: 532839 - DNA, 25 bp, Homo sapien
tctgtttcctttgatgacgctttga

SEQ ID NO: 532840 - DNA, 25 bp, Homo sapien
ttcctttgatgacgctttgaaataa

SEQ ID NO: 532841 - DNA, 25 bp, Homo sapien
ttttgtgaaagatcatccgcaggct

SEQ ID NO: 532842 - DNA, 25 bp, Homo sapien
agatcatccgcaggctatgttaaaa

SEQ ID NO: 532843 - DNA, 25 bp, Homo sapien
aaggaaactacctcatgctctgaag

SEQ ID NO: 532844 - DNA, 25 bp, Homo sapien
gctctgaaggttttgtagaagcaca

SEQ ID NO: 532845 - DNA, 25 bp, Homo sapien
taaaatggctttgttacaccagagc

SEQ ID NO: 532846 - DNA, 25 bp, Homo sapien
gagccatctggtgtgaagaactcta

SEQ ID NO: 532847 - DNA, 25 bp, Homo sapien
agaactctatatttgtatgttgaga

SEQ ID NO: 532848 - DNA, 25 bp, Homo sapien
ttttgctggcaatagacacattctt

SEQ ID NO: 532849 - DNA, 25 bp, Homo sapien
ctttattatttgcagattcctcatc

SEQ ID NO: 532850 - DNA, 25 bp, Homo sapien
gattcctcatcaaatctgtaattat

SEQ ID NO: 532851 - DNA, 25 bp, Homo sapien
aattatgcacagtttctgttatcaa

SEQ ID NO: 532852 - DNA, 25 bp, Homo sapien
tgaaccaagggttagacgccagagg

SEQ ID NO: 532853 - DNA, 25 bp, Homo sapien
agacgccagaggttgggcttctgtt

SEQ ID NO: 532854 - DNA, 25 bp, Homo sapien
gggcttctgttagagtggcttcaaa

SEQ ID NO: 532855 - DNA, 25 bp, Homo sapien
tgagccttatgggaagtagccttaa

SEQ ID NO: 532856 - DNA, 25 bp, Homo sapien
atgggtatacgcagtgacttccgat

SEQ ID NO: 532857 - DNA, 25 bp, Homo sapien
gtgacttccgatggaaatctccaaa

SEQ ID NO: 532858 - DNA, 25 bp, Homo sapien
agaacattctctttcatctataaag

SEQ ID NO: 532859 - DNA, 25 bp, Homo sapien
gttgaattaccaacagcctgtgaag

SEQ ID NO: 532860 - DNA, 25 bp, Homo sapien
agatcagtttgaccggtgtggacac

SEQ ID NO: 532861 - DNA, 25 bp, Homo sapien
accggtgtggacacgtgctggttaa

SEQ ID NO: 532862 - DNA, 25 bp, Homo sapien
cgtgctggttaagcactcaggccta

SEQ ID NO: 532863 - DNA, 25 bp, Homo sapien
gttaatgatggttgatgggttctaa

SEQ ID NO: 532864 - DNA, 25 bp, Homo sapien
tgggttctaattttggatggagtcc

SEQ ID NO: 532865 - DNA, 25 bp, Homo sapien
agaaagtgatttctagaaagcctgt

SEQ ID NO: 532866 - DNA, 25 bp, Homo sapien
ctggatgaaataactccttcttgta

SEQ ID NO: 532867 - DNA, 25 bp, Homo sapien
aactccttcttgtagtagtctcatt

SEQ ID NO: 532868 - DNA, 25 bp, Homo sapien
cttgtagtagtctcattacttttga

SEQ ID NO: 532869 - DNA, 25 bp, Homo sapien
tacttttgaagtaatcccgccacct

SEQ ID NO: 532870 - DNA, 25 bp, Homo sapien
taatcccgccacctatctcgtggga

SEQ ID NO: 532871 - DNA, 25 bp, Homo sapien
atctcgtgggagagccatccaaata

SEQ ID NO: 532872 - DNA, 25 bp, Homo sapien
gagagccatccaaataagaaaccta

SEQ ID NO: 532873 - DNA, 25 bp, Homo sapien
taattggttcttggtagagattcat

SEQ ID NO: 532874 - DNA, 25 bp, Homo sapien
caccccatatcttctttccatttat

SEQ ID NO: 532875 - DNA, 25 bp, Homo sapien
aaagtattctgttgggatctgggct

SEQ ID NO: 532876 - DNA, 25 bp, Homo sapien
tgggatctgggcttcctcacttctg

SEQ ID NO: 532877 - DNA, 25 bp, Homo sapien
atctgggcttcctcacttctggaga

SEQ ID NO: 532878 - DNA, 25 bp, Homo sapien
ttctggagaagtggccatcccatgc

SEQ ID NO: 532879 - DNA, 25 bp, Homo sapien
atgcccacctgtgccatggaggagt

SEQ ID NO: 532880 - DNA, 25 bp, Homo sapien
acctgtgccatggaggagtgggccc

SEQ ID NO: 532881 - DNA, 25 bp, Homo sapien
agctgccacagctgcatgacctgct

SEQ ID NO: 532882 - DNA, 25 bp, Homo sapien
ccccgagagcatcgctatgatctaa

SEQ ID NO: 532883 - DNA, 25 bp, Homo sapien
gagagcatcgctatgatctaaggtc

SEQ ID NO: 532884 - DNA, 25 bp, Homo sapien
gcatcgctatgatctaaggtctggg

SEQ ID NO: 532885 - DNA, 25 bp, Homo sapien
aaacgtgttaggatcactactggtg

SEQ ID NO: 532886 - DNA, 25 bp, Homo sapien
ggtggaaattgtaaccagcctttgg

SEQ ID NO: 532887 - DNA, 25 bp, Homo sapien
taaccagcctttgggcatcttaaag

SEQ ID NO: 532888 - DNA, 25 bp, Homo sapien
cttaaagggtgacatgtggcatgcc

SEQ ID NO: 532889 - DNA, 25 bp, Homo sapien
aagattgtagtgttgatcagcgcaa

SEQ ID NO: 532890 - DNA, 25 bp, Homo sapien
tgatcagcgcaacaattcaagtgtg

SEQ ID NO: 532891 - DNA, 25 bp, Homo sapien
aacaggatagtttgcctcttcactt

SEQ ID NO: 532892 - DNA, 25 bp, Homo sapien
ctcttcactttacccctggataaag

SEQ ID NO: 532893 - DNA, 25 bp, Homo sapien
ataaaggcactttcactgcctgtca

SEQ ID NO: 532894 - DNA, 25 bp, Homo sapien
tcagcagatactgacttgttgccat

SEQ ID NO: 532895 - DNA, 25 bp, Homo sapien
gaacttgacttcttatgtgtgctct

SEQ ID NO: 532896 - DNA, 25 bp, Homo sapien
atgcatacatgaatatatccacccc

SEQ ID NO: 532897 - DNA, 25 bp, Homo sapien
atccacccccctagattttaagcag

SEQ ID NO: 532898 - DNA, 25 bp, Homo sapien
agaacggtcaatttgagccgcgtcg

SEQ ID NO: 532899 - DNA, 25 bp, Homo sapien
aacggtcaatttgagccgcgtcgag

SEQ ID NO: 532900 - DNA, 25 bp, Homo sapien
acggtcaatttgagccgcgtcgagg

SEQ ID NO: 532901 - DNA, 25 bp, Homo sapien
cggtcaatttgagccgcgtcgaggt

SEQ ID NO: 532902 - DNA, 25 bp, Homo sapien
aatttgagccgcgtcgaggtcgggc

SEQ ID NO: 532903 - DNA, 25 bp, Homo sapien
tcgaggtcgggcttgggaagggtca

SEQ ID NO: 532904 - DNA, 25 bp, Homo sapien
cttgggaagggtcagcgggaggcct

SEQ ID NO: 532905 - DNA, 25 bp, Homo sapien
gggtcagcgggaggcctgagggcgc

SEQ ID NO: 532906 - DNA, 25 bp, Homo sapien
gctgttgtactctcactttacttat

SEQ ID NO: 532907 - DNA, 25 bp, Homo sapien
cgctgtgatgacatttagacctcat

SEQ ID NO: 532908 - DNA, 25 bp, Homo sapien
gacatttagacctcatttgtgctat

SEQ ID NO: 532909 - DNA, 25 bp, Homo sapien
atttgtgctatgacctttggctcat

SEQ ID NO: 532910 - DNA, 25 bp, Homo sapien
tttaacattgccaggttctagtgat

SEQ ID NO: 532911 - DNA, 25 bp, Homo sapien
gatttaaaaccacaactgcccactt

SEQ ID NO: 532912 - DNA, 25 bp, Homo sapien
aactgcccacttggtgaaaacgtgc

SEQ ID NO: 532913 - DNA, 25 bp, Homo sapien
gaaaacgtgctctcgatgctgattt

SEQ ID NO: 532914 - DNA, 25 bp, Homo sapien
atgctgatttgtggtgtgctgctgt

SEQ ID NO: 532915 - DNA, 25 bp, Homo sapien
aaggcagaggatactgcgaccaccc

SEQ ID NO: 532916 - DNA, 25 bp, Homo sapien
gagcaacggatggtcagctgcgaac

SEQ ID NO: 532917 - DNA, 25 bp, Homo sapien
tcagctgcgaacagtctcgtccgat

SEQ ID NO: 532918 - DNA, 25 bp, Homo sapien
attaaatgttggctggactgagtca

SEQ ID NO: 532919 - DNA, 25 bp, Homo sapien
atgttggctggactgagtcagcccc

SEQ ID NO: 532920 - DNA, 25 bp, Homo sapien
catcttggcaccttgagtcctcaga

SEQ ID NO: 532921 - DNA, 25 bp, Homo sapien
ttggcaccttgagtcctcagaaaag

SEQ ID NO: 532922 - DNA, 25 bp, Homo sapien
gagtcctcagaaaagcagtgccatc

SEQ ID NO: 532923 - DNA, 25 bp, Homo sapien
ctcagaaaagcagtgccatccatga

SEQ ID NO: 532924 - DNA, 25 bp, Homo sapien
agtgccatccatgagaagcaacttg

SEQ ID NO: 532925 - DNA, 25 bp, Homo sapien
gccatccatgagaagcaacttgaat

SEQ ID NO: 532926 - DNA, 25 bp, Homo sapien
ccatgagaagcaacttgaattgtat

SEQ ID NO: 532927 - DNA, 25 bp, Homo sapien
tggacccatgggttagagctccata

SEQ ID NO: 532928 - DNA, 25 bp, Homo sapien
cccatgggttagagctccatacata

SEQ ID NO: 532929 - DNA, 25 bp, Homo sapien
ggtaatctatgtatgtgctaatggg

SEQ ID NO: 532930 - DNA, 25 bp, Homo sapien
gttggaaagaaccttacagagcata

SEQ ID NO: 532931 - DNA, 25 bp, Homo sapien
agagcatattacctgataaactgga

SEQ ID NO: 532932 - DNA, 25 bp, Homo sapien
tattgtgtctcctagttggtacctg

SEQ ID NO: 532933 - DNA, 25 bp, Homo sapien
gttggtacctgggagcaattgacat

SEQ ID NO: 532934 - DNA, 25 bp, Homo sapien
ccttcagaaccttaactgttagtag

SEQ ID NO: 532935 - DNA, 25 bp, Homo sapien
aactgttagtagcagtggctgtaac

SEQ ID NO: 532936 - DNA, 25 bp, Homo sapien
accagtgaccagagataacagcttt

SEQ ID NO: 532937 - DNA, 25 bp, Homo sapien
taacagcttttaggccaagctggcc

SEQ ID NO: 532938 - DNA, 25 bp, Homo sapien
caagctggcctgacggtatggctgc

SEQ ID NO: 532939 - DNA, 25 bp, Homo sapien
tgagcagtagcggtactcagccaga

SEQ ID NO: 532940 - DNA, 25 bp, Homo sapien
gtaaattagtttgacactgcttttt

SEQ ID NO: 532941 - DNA, 25 bp, Homo sapien
actgcttttttgataggtgtggtca

SEQ ID NO: 532942 - DNA, 25 bp, Homo sapien
ttgataggtgtggtcatttctcccc

SEQ ID NO: 532943 - DNA, 25 bp, Homo sapien
gataggtgtggtcatttctccccat

SEQ ID NO: 532944 - DNA, 25 bp, Homo sapien
taggtgtggtcatttctccccatgg

SEQ ID NO: 532945 - DNA, 25 bp, Homo sapien
cagaaactgaattctggacagattt

SEQ ID NO: 532946 - DNA, 25 bp, Homo sapien
tctggacagatttaagccttgacac

SEQ ID NO: 532947 - DNA, 25 bp, Homo sapien
ggacagatttaagccttgacacact

SEQ ID NO: 532948 - DNA, 25 bp, Homo sapien
gatttaagccttgacacactgtgtt

SEQ ID NO: 532949 - DNA, 25 bp, Homo sapien
taagccttgacacactgtgtttttt

SEQ ID NO: 532950 - DNA, 25 bp, Homo sapien
ccccattgtgatgtttggtaacgaa

SEQ ID NO: 532951 - DNA, 25 bp, Homo sapien
aaagcttatgtttcttgtcaaatgc

SEQ ID NO: 532952 - DNA, 25 bp, Homo sapien
tgtcaaatgcagaaatgttccttcc

SEQ ID NO: 532953 - DNA, 25 bp, Homo sapien
ttccttccgccactcactgaagttt

SEQ ID NO: 532954 - DNA, 25 bp, Homo sapien
ctgaagttttgcattctggcttgtg

SEQ ID NO: 532955 - DNA, 25 bp, Homo sapien
gcattctggcttgtgcagtttttat

SEQ ID NO: 532956 - DNA, 25 bp, Homo sapien
tgtctgtgtcagacgtacagccaga

SEQ ID NO: 532957 - DNA, 25 bp, Homo sapien
gtcagacgtacagccagacatgttc

SEQ ID NO: 532958 - DNA, 25 bp, Homo sapien
ggcatttttccgattctgttcagat

SEQ ID NO: 532959 - DNA, 25 bp, Homo sapien
tgttcagatgacagcgaccgccttt

SEQ ID NO: 532960 - DNA, 25 bp, Homo sapien
tcaccctcacgctctttgaagaaaa

SEQ ID NO: 532961 - DNA, 25 bp, Homo sapien
aaaaatcaccttgtgtgttgtagct

SEQ ID NO: 532962 - DNA, 25 bp, Homo sapien
gaatgtcagaactgccaaaggatac

SEQ ID NO: 532963 - DNA, 25 bp, Homo sapien
ggataccaagtgatcatacgatgat

SEQ ID NO: 532964 - DNA, 25 bp, Homo sapien
gatgatttgcatgatcgggtctatt

SEQ ID NO: 532965 - DNA, 25 bp, Homo sapien
gatcgggtctatttcacccaatagt

SEQ ID NO: 532966 - DNA, 25 bp, Homo sapien
ttcacccaatagtcacttgtgtgtc

SEQ ID NO: 532967 - DNA, 25 bp, Homo sapien
cgaaattgggatgggtgagcaccct

SEQ ID NO: 532968 - DNA, 25 bp, Homo sapien
gtgagcacccttgctgtggtgtaaa

SEQ ID NO: 532969 - DNA, 25 bp, Homo sapien
gctgtggtgtaaacttcctgttatt

SEQ ID NO: 532970 - DNA, 25 bp, Homo sapien
gaactttctaagaaactccatgaaa

SEQ ID NO: 532971 - DNA, 25 bp, Homo sapien
aaatgttcattccaagtggcaagtc

SEQ ID NO: 532972 - DNA, 25 bp, Homo sapien
aagtggcaagtcttattggacacat

SEQ ID NO: 532973 - DNA, 25 bp, Homo sapien
gtagtcaatgagtactcctcagaac

SEQ ID NO: 532974 - DNA, 25 bp, Homo sapien
gtaatatcccaactaaccttcgtgt

SEQ ID NO: 532975 - DNA, 25 bp, Homo sapien
taaccttcgtgtgcttcgttcaatc

SEQ ID NO: 532976 - DNA, 25 bp, Homo sapien
gtgtgcttcgttcaatcctggaaaa

SEQ ID NO: 532977 - DNA, 25 bp, Homo sapien
gttagaatctgatgtctcagctcaa

SEQ ID NO: 532978 - DNA, 25 bp, Homo sapien
gatgtctcagctcaaatggaatatt

SEQ ID NO: 532979 - DNA, 25 bp, Homo sapien
aatggaatattgtcgcaccccatgc

SEQ ID NO: 532980 - DNA, 25 bp, Homo sapien
accccatgcactggtcagtttgcaa

SEQ ID NO: 532981 - DNA, 25 bp, Homo sapien
ggtcagtttgcaatattccctgtgg

SEQ ID NO: 532982 - DNA, 25 bp, Homo sapien
atattccctgtggttgtctgggcaa

SEQ ID NO: 532983 - DNA, 25 bp, Homo sapien
cctgtggttgtctgggcaaagaatg

SEQ ID NO: 532984 - DNA, 25 bp, Homo sapien
aaaaacgtgctgaagatccgccggc

SEQ ID NO: 532985 - DNA, 25 bp, Homo sapien
aagatgaaccaccacaagtaccgga

SEQ ID NO: 532986 - DNA, 25 bp, Homo sapien
gaaccaccacaagtaccggaagctg

SEQ ID NO: 532987 - DNA, 25 bp, Homo sapien
accaccacaagtaccggaagctggt

SEQ ID NO: 532988 - DNA, 25 bp, Homo sapien
ctggtgaagaagacgcggttcctgc

SEQ ID NO: 532989 - DNA, 25 bp, Homo sapien
agaagacgcggttcctgcggaggaa

SEQ ID NO: 532990 - DNA, 25 bp, Homo sapien
aggaaggtccaggagggacgcctga

SEQ ID NO: 532991 - DNA, 25 bp, Homo sapien
agggacgcctgagacgcaagcagat

SEQ ID NO: 532992 - DNA, 25 bp, Homo sapien
gcctgagacgcaagcagatcaagtt

SEQ ID NO: 532993 - DNA, 25 bp, Homo sapien
gacgcaagcagatcaagttcgagaa

SEQ ID NO: 532994 - DNA, 25 bp, Homo sapien
gcaagcagatcaagttcgagaaaga

SEQ ID NO: 532995 - DNA, 25 bp, Homo sapien
aatggtatttgttttacagcataca

SEQ ID NO: 532996 - DNA, 25 bp, Homo sapien
ggtatttgttttacagcatacataa

SEQ ID NO: 532997 - DNA, 25 bp, Homo sapien
gtactgtaaaacatttaacattcat

SEQ ID NO: 532998 - DNA, 25 bp, Homo sapien
tggctttggagtttacatatactga

SEQ ID NO: 532999 - DNA, 25 bp, Homo sapien
gctttggagtttacatatactgaac

SEQ ID NO: 533000 - DNA, 25 bp, Homo sapien
ggagtttacatatactgaacatgaa

SEQ ID NO: 533001 - DNA, 25 bp, Homo sapien
tgatgatacaactttcaacattgtc

SEQ ID NO: 533002 - DNA, 25 bp, Homo sapien
tattactttagttacgaattccaat

SEQ ID NO: 533003 - DNA, 25 bp, Homo sapien
ttactttagttacgaattccaatat

SEQ ID NO: 533004 - DNA, 25 bp, Homo sapien
ttagttacgaattccaatatacttt

SEQ ID NO: 533005 - DNA, 25 bp, Homo sapien
tacgaattccaatatactttaaaat

SEQ ID NO: 533006 - DNA, 25 bp, Homo sapien
ttctgattcaaatagcatgatccat

SEQ ID NO: 533007 - DNA, 25 bp, Homo sapien
tagcatgatccatgcttattattta

SEQ ID NO: 533008 - DNA, 25 bp, Homo sapien
taaaatcttgtgttgcaagggcaac

SEQ ID NO: 533009 - DNA, 25 bp, Homo sapien
gcaagggcaacctcgtccattttaa

SEQ ID NO: 533010 - DNA, 25 bp, Homo sapien
gcaacctcgtccattttaactggca

SEQ ID NO: 533011 - DNA, 25 bp, Homo sapien
gtccattttaactggcacctcaggg

SEQ ID NO: 533012 - DNA, 25 bp, Homo sapien
ttttaactggcacctcagggattaa

SEQ ID NO: 533013 - DNA, 25 bp, Homo sapien
tggcacctcagggattaaaatccta

SEQ ID NO: 533014 - DNA, 25 bp, Homo sapien
tagaactattgtattatgggagatg

SEQ ID NO: 533015 - DNA, 25 bp, Homo sapien
tatgggagatgtgtcagtgaactag

SEQ ID NO: 533016 - DNA, 25 bp, Homo sapien
gaaaatgtcaataacctcaaaggat

SEQ ID NO: 533017 - DNA, 25 bp, Homo sapien
ttatgatcttgaatacaccaatatt

SEQ ID NO: 533018 - DNA, 25 bp, Homo sapien
gatcttgaatacaccaatatttctt

SEQ ID NO: 533019 - DNA, 25 bp, Homo sapien
aaaaaatctttcaggttgcttggtg

SEQ ID NO: 533020 - DNA, 25 bp, Homo sapien
aaaatctttcaggttgcttggtgga

SEQ ID NO: 533021 - DNA, 25 bp, Homo sapien
aaatctttcaggttgcttggtggat

SEQ ID NO: 533022 - DNA, 25 bp, Homo sapien
aatctttcaggttgcttggtggata

SEQ ID NO: 533023 - DNA, 25 bp, Homo sapien
tctttcaggttgcttggtggataca

SEQ ID NO: 533024 - DNA, 25 bp, Homo sapien
tttcaggttgcttggtggatacaat

SEQ ID NO: 533025 - DNA, 25 bp, Homo sapien
tcaggttgcttggtggatacaatat

SEQ ID NO: 533026 - DNA, 25 bp, Homo sapien
gttgcttggtggatacaatatgtgt

SEQ ID NO: 533027 - DNA, 25 bp, Homo sapien
ttggtggatacaatatgtgttgttc

SEQ ID NO: 533028 - DNA, 25 bp, Homo sapien
aaggaatagtgtggcattgcagtga

SEQ ID NO: 533029 - DNA, 25 bp, Homo sapien
atagtgtggcattgcagtgatggct

SEQ ID NO: 533030 - DNA, 25 bp, Homo sapien
cagtgatggctgtttaataaaggtc

SEQ ID NO: 533031 - DNA, 25 bp, Homo sapien
gctgtttaataaaggtccatcgcca

SEQ ID NO: 533032 - DNA, 25 bp, Homo sapien
ataaaggtccatcgccatcatcttg

SEQ ID NO: 533033 - DNA, 25 bp, Homo sapien
atcgccatcatcttggcttatgctg

SEQ ID NO: 533034 - DNA, 25 bp, Homo sapien
ttggcttatgctggccaattccaga

SEQ ID NO: 533035 - DNA, 25 bp, Homo sapien
gctggccaattccagatacttacat

SEQ ID NO: 533036 - DNA, 25 bp, Homo sapien
gaccagttattatcaacatgaacct

SEQ ID NO: 533037 - DNA, 25 bp, Homo sapien
actctgcctttgatattaagtgttt

SEQ ID NO: 533038 - DNA, 25 bp, Homo sapien
gataatcagaaatttgttagactca

SEQ ID NO: 533039 - DNA, 25 bp, Homo sapien
gggtctaaatcttatccaagtctct

SEQ ID NO: 533040 - DNA, 25 bp, Homo sapien
tatccaagtctctaaatatgccagt

SEQ ID NO: 533041 - DNA, 25 bp, Homo sapien
atatgccagtaagagcacccaccag

SEQ ID NO: 533042 - DNA, 25 bp, Homo sapien
gtaagagcacccaccaggattgaaa

SEQ ID NO: 533043 - DNA, 25 bp, Homo sapien
ttggagtaaccctggtcttggcccg

SEQ ID NO: 533044 - DNA, 25 bp, Homo sapien
ggacaggccatctgctattcgtcca

SEQ ID NO: 533045 - DNA, 25 bp, Homo sapien
atctgctattcgtccaccaacctga

SEQ ID NO: 533046 - DNA, 25 bp, Homo sapien
ttccctcctcccaggtgttatgtct

SEQ ID NO: 533047 - DNA, 25 bp, Homo sapien
ggtctggcgggttgctatgggtgaa

SEQ ID NO: 533048 - DNA, 25 bp, Homo sapien
gtgttggcagggtctaaatcttatc

SEQ ID NO: 533049 - DNA, 25 bp, Homo sapien
ggcagggtctaaatcttatccaagt

SEQ ID NO: 533050 - DNA, 25 bp, Homo sapien
tggctccggggagacgttcagctac

SEQ ID NO: 533051 - DNA, 25 bp, Homo sapien
ggctccggggagacgttcagctacc

SEQ ID NO: 533052 - DNA, 25 bp, Homo sapien
tccggggagacgttcagctaccctg

SEQ ID NO: 533053 - DNA, 25 bp, Homo sapien
cggggagacgttcagctaccctgac

SEQ ID NO: 533054 - DNA, 25 bp, Homo sapien
ggggagacgttcagctaccctgact

SEQ ID NO: 533055 - DNA, 25 bp, Homo sapien
tttctcaggatgatgctgggcaaga

SEQ ID NO: 533056 - DNA, 25 bp, Homo sapien
ttctcaggatgatgctgggcaagag

SEQ ID NO: 533057 - DNA, 25 bp, Homo sapien
tctcaggatgatgctgggcaagaga

SEQ ID NO: 533058 - DNA, 25 bp, Homo sapien
atcctgatgtatgaggaaaaagcga

SEQ ID NO: 533059 - DNA, 25 bp, Homo sapien
gatgtatgaggaaaaagcgagagaa

SEQ ID NO: 533060 - DNA, 25 bp, Homo sapien
ccaacaggccccccagccaagaaag

SEQ ID NO: 533061 - DNA, 25 bp, Homo sapien
gacacctggtacctaagtgcaaatt

SEQ ID NO: 533062 - DNA, 25 bp, Homo sapien
aaattacaacatctgagcctaccgc

SEQ ID NO: 533063 - DNA, 25 bp, Homo sapien
gagcctaccgcataaatgtttgtac

SEQ ID NO: 533064 - DNA, 25 bp, Homo sapien
tttgtactgaacgtctgccttgaag

SEQ ID NO: 533065 - DNA, 25 bp, Homo sapien
gggaggatcccttggttcaatgtat

SEQ ID NO: 533066 - DNA, 25 bp, Homo sapien
accagggtctaactgggagcccgat

SEQ ID NO: 533067 - DNA, 25 bp, Homo sapien
aggtccctgggagtgagaccgccct

SEQ ID NO: 533068 - DNA, 25 bp, Homo sapien
gatgaagccccgcttttgaaaaagc

SEQ ID NO: 533069 - DNA, 25 bp, Homo sapien
atgaggatctccaaacagcctggtg

SEQ ID NO: 533070 - DNA, 25 bp, Homo sapien
cagcctggtggaattctttttagtc

SEQ ID NO: 533071 - DNA, 25 bp, Homo sapien
ttagtctgtttcctgacacctggta

SEQ ID NO: 533072 - DNA, 25 bp, Homo sapien
aaatgtagtcaatgagtactcctca

SEQ ID NO: 533073 - DNA, 25 bp, Homo sapien
gtagtcaatgagtactcctcagaac

SEQ ID NO: 533074 - DNA, 25 bp, Homo sapien
gaaaagcaccaattatatatagatg

SEQ ID NO: 533075 - DNA, 25 bp, Homo sapien
aactaaccttcgtgtgcttcgttca

SEQ ID NO: 533076 - DNA, 25 bp, Homo sapien
taaccttcgtgtgcttcgttcaatc

SEQ ID NO: 533077 - DNA, 25 bp, Homo sapien
accttcgtgtgcttcgttcaatcct

SEQ ID NO: 533078 - DNA, 25 bp, Homo sapien
gaaaacctgagaagcaaaatacaaa

SEQ ID NO: 533079 - DNA, 25 bp, Homo sapien
gttagaatctgatgtctcagctcaa

SEQ ID NO: 533080 - DNA, 25 bp, Homo sapien
gatgtctcagctcaaatggaatatt

SEQ ID NO: 533081 - DNA, 25 bp, Homo sapien
aatggaatattgtcgcaccccatgc

SEQ ID NO: 533082 - DNA, 25 bp, Homo sapien
gaatattgtcgcaccccatgcactg

SEQ ID NO: 533083 - DNA, 25 bp, Homo sapien
tgttgttgctttaggctcacggcac

SEQ ID NO: 533084 - DNA, 25 bp, Homo sapien
ttaggctcacggcacgcttgcgtat

SEQ ID NO: 533085 - DNA, 25 bp, Homo sapien
gcttgcgtatgtctgttaccatgtc

SEQ ID NO: 533086 - DNA, 25 bp, Homo sapien
tgtcactgtggtcctatgccgaatg

SEQ ID NO: 533087 - DNA, 25 bp, Homo sapien
ggtcctatgccgaatgccctcaggg

SEQ ID NO: 533088 - DNA, 25 bp, Homo sapien
aaccaggtttagacagtatgagtca

SEQ ID NO: 533089 - DNA, 25 bp, Homo sapien
agacagtatgagtcaatgtgcagtg

SEQ ID NO: 533090 - DNA, 25 bp, Homo sapien
agcccacacttgagaggatgaatgt

SEQ ID NO: 533091 - DNA, 25 bp, Homo sapien
tgtgtttgttcctacagcccctttt

SEQ ID NO: 533092 - DNA, 25 bp, Homo sapien
tacagcccctttttcatatgttgct

SEQ ID NO: 533093 - DNA, 25 bp, Homo sapien
tttcatatgttgctcagtctccctt

SEQ ID NO: 533094 - DNA, 25 bp, Homo sapien
agcgtcgggcacagggcagctccca

SEQ ID NO: 533095 - DNA, 25 bp, Homo sapien
cgggcacagggcagctcccactggt

SEQ ID NO: 533096 - DNA, 25 bp, Homo sapien
ggcacagggcagctcccactggtct

SEQ ID NO: 533097 - DNA, 25 bp, Homo sapien
gggcagctcccactggtctcggcaa

SEQ ID NO: 533098 - DNA, 25 bp, Homo sapien
agctcccactggtctcggcaacaca

SEQ ID NO: 533099 - DNA, 25 bp, Homo sapien
ggcaacacacccagccgcctggtac

SEQ ID NO: 533100 - DNA, 25 bp, Homo sapien
agcccggtctcacccatggtccagt

SEQ ID NO: 533101 - DNA, 25 bp, Homo sapien
gggtctccttaaatgccacctcggg

SEQ ID NO: 533102 - DNA, 25 bp, Homo sapien
ggtctccttaaatgccacctcgggc

SEQ ID NO: 533103 - DNA, 25 bp, Homo sapien
tccttaaatgccacctcgggcaagt

SEQ ID NO: 533104 - DNA, 25 bp, Homo sapien
ttaaatgccacctcgggcaagtccc

SEQ ID NO: 533105 - DNA, 25 bp, Homo sapien
ccacatgtggctgctcgtatttaag

SEQ ID NO: 533106 - DNA, 25 bp, Homo sapien
cacatgtggctgctcgtatttaagt

SEQ ID NO: 533107 - DNA, 25 bp, Homo sapien
acatgtggctgctcgtatttaagtt

SEQ ID NO: 533108 - DNA, 25 bp, Homo sapien
catgtggctgctcgtatttaagtta

SEQ ID NO: 533109 - DNA, 25 bp, Homo sapien
atgtggctgctcgtatttaagttaa

SEQ ID NO: 533110 - DNA, 25 bp, Homo sapien
tgtggctgctcgtatttaagttaat

SEQ ID NO: 533111 - DNA, 25 bp, Homo sapien
gtggctgctcgtatttaagttaatt

SEQ ID NO: 533112 - DNA, 25 bp, Homo sapien
tggctgctcgtatttaagttaatta

SEQ ID NO: 533113 - DNA, 25 bp, Homo sapien
ggctgctcgtatttaagttaattaa

SEQ ID NO: 533114 - DNA, 25 bp, Homo sapien
gctgctcgtatttaagttaattaaa

SEQ ID NO: 533115 - DNA, 25 bp, Homo sapien
taaaatggaacgttggccgggcgtg

SEQ ID NO: 533116 - DNA, 25 bp, Homo sapien
gcgggccctggatatacccgcaggt

SEQ ID NO: 533117 - DNA, 25 bp, Homo sapien
gccctggatatacccgcaggtccag

SEQ ID NO: 533118 - DNA, 25 bp, Homo sapien
aagtcggccccgatcggcagcggcc

SEQ ID NO: 533119 - DNA, 25 bp, Homo sapien
ggttcctacgcacagcgcccgctgg

SEQ ID NO: 533120 - DNA, 25 bp, Homo sapien
cgcttctgcattggctcaggccccg

SEQ ID NO: 533121 - DNA, 25 bp, Homo sapien
tccggttagtggaatcacggtccca

SEQ ID NO: 533122 - DNA, 25 bp, Homo sapien
ggttagtggaatcacggtcccagtc

SEQ ID NO: 533123 - DNA, 25 bp, Homo sapien
ttagtggaatcacggtcccagtcct

SEQ ID NO: 533124 - DNA, 25 bp, Homo sapien
agtggaatcacggtcccagtcctcg

SEQ ID NO: 533125 - DNA, 25 bp, Homo sapien
tggaatcacggtcccagtcctcgcg

SEQ ID NO: 533126 - DNA, 25 bp, Homo sapien
tccgcctggtcccttacggaggcaa

SEQ ID NO: 533127 - DNA, 25 bp, Homo sapien
acacaggaacacgatgacatggcca

SEQ ID NO: 533128 - DNA, 25 bp, Homo sapien
aggaacacgatgacatggccagggc

SEQ ID NO: 533129 - DNA, 25 bp, Homo sapien
gaacacgatgacatggccagggcca

SEQ ID NO: 533130 - DNA, 25 bp, Homo sapien
aacacgatgacatggccagggccac

SEQ ID NO: 533131 - DNA, 25 bp, Homo sapien
atggccagggccacaacttcttctg

SEQ ID NO: 533132 - DNA, 25 bp, Homo sapien
ggccagggccacaacttcttctgtc

SEQ ID NO: 533133 - DNA, 25 bp, Homo sapien
cacaacttcttctgtcgtggggaag

SEQ ID NO: 533134 - DNA, 25 bp, Homo sapien
ttttccagagccagaaacaggattt

SEQ ID NO: 533135 - DNA, 25 bp, Homo sapien
tttccagagccagaaacaggatttt

SEQ ID NO: 533136 - DNA, 25 bp, Homo sapien
ctggcccctaagactccatctcttc

SEQ ID NO: 533137 - DNA, 25 bp, Homo sapien
aatttattgtaatggggtccgcgca

SEQ ID NO: 533138 - DNA, 25 bp, Homo sapien
tgtctgtaataatcttgaaaggccc

SEQ ID NO: 533139 - DNA, 25 bp, Homo sapien
taataatcttgaaaggcccaagggc

SEQ ID NO: 533140 - DNA, 25 bp, Homo sapien
ttaaaggcatctgcttccctgtttc

SEQ ID NO: 533141 - DNA, 25 bp, Homo sapien
aaaggcatctgcttccctgtttcat

SEQ ID NO: 533142 - DNA, 25 bp, Homo sapien
aggcatctgcttccctgtttcatat

SEQ ID NO: 533143 - DNA, 25 bp, Homo sapien
gcatctgcttccctgtttcatatca

SEQ ID NO: 533144 - DNA, 25 bp, Homo sapien
atctgcttccctgtttcatatcaca

SEQ ID NO: 533145 - DNA, 25 bp, Homo sapien
tgcttccctgtttcatatcacatga

SEQ ID NO: 533146 - DNA, 25 bp, Homo sapien
gcttccctgtttcatatcacatgac

SEQ ID NO: 533147 - DNA, 25 bp, Homo sapien
ttccctgtttcatatcacatgacag

SEQ ID NO: 533148 - DNA, 25 bp, Homo sapien
ctgtttcatatcacatgacagagaa

SEQ ID NO: 533149 - DNA, 25 bp, Homo sapien
cagcgagtgcccacccaatgtcaga

SEQ ID NO: 533150 - DNA, 25 bp, Homo sapien
acccaatgtcagagcagcccgaggg

SEQ ID NO: 533151 - DNA, 25 bp, Homo sapien
ccacaagccacgttgatcttcacaa

SEQ ID NO: 533152 - DNA, 25 bp, Homo sapien
gttgatcttcacaacgaccctgggc

SEQ ID NO: 533153 - DNA, 25 bp, Homo sapien
ttcacaacgaccctgggccgctggg

SEQ ID NO: 533154 - DNA, 25 bp, Homo sapien
gggtcacccaagagaagcagccctg

SEQ ID NO: 533155 - DNA, 25 bp, Homo sapien
ggcactcgcctgtccacttctgagt

SEQ ID NO: 533156 - DNA, 25 bp, Homo sapien
gatcgaggtgttaactgtgattcca

SEQ ID NO: 533157 - DNA, 25 bp, Homo sapien
gaggtgttaactgtgattccatcca

SEQ ID NO: 533158 - DNA, 25 bp, Homo sapien
gttaactgtgattccatccagcgag

SEQ ID NO: 533159 - DNA, 25 bp, Homo sapien
tgtgattccatccagcgagtgccca

SEQ ID NO: 533160 - DNA, 25 bp, Homo sapien
gcagcattgccgctccacatctttg

SEQ ID NO: 533161 - DNA, 25 bp, Homo sapien
ccacatctttgctcaatgttttcat

SEQ ID NO: 533162 - DNA, 25 bp, Homo sapien
acatctttgctcaatgttttcattt

SEQ ID NO: 533163 - DNA, 25 bp, Homo sapien
aatacatttgttccaatggggagct

SEQ ID NO: 533164 - DNA, 25 bp, Homo sapien
gagcttggaagatggcgttcccaga

SEQ ID NO: 533165 - DNA, 25 bp, Homo sapien
gaagatggcgttcccagaaagtatt

SEQ ID NO: 533166 - DNA, 25 bp, Homo sapien
tggcgttcccagaaagtattttaat

SEQ ID NO: 533167 - DNA, 25 bp, Homo sapien
aaggaaaagcacacgcatgcgcctc

SEQ ID NO: 533168 - DNA, 25 bp, Homo sapien
aaaagcacacgcatgcgcctcagca

SEQ ID NO: 533169 - DNA, 25 bp, Homo sapien
acgcatgcgcctcagcaaatggcag

SEQ ID NO: 533170 - DNA, 25 bp, Homo sapien
gtataggtttgaaaggctgtttgaa

SEQ ID NO: 533171 - DNA, 25 bp, Homo sapien
cagattgttctcaagagggccatca

SEQ ID NO: 533172 - DNA, 25 bp, Homo sapien
agccaaagagttcacagcctcagca

SEQ ID NO: 533173 - DNA, 25 bp, Homo sapien
agcaccaacaactcaacatggtcat

SEQ ID NO: 533174 - DNA, 25 bp, Homo sapien
tttctatatggtttttccagctagc

SEQ ID NO: 533175 - DNA, 25 bp, Homo sapien
tggtttttccagctagcagtactcc

SEQ ID NO: 533176 - DNA, 25 bp, Homo sapien
tcccttccatacctgtgactgggca

SEQ ID NO: 533177 - DNA, 25 bp, Homo sapien
tgactgggcagtgcttttctctctc

SEQ ID NO: 533178 - DNA, 25 bp, Homo sapien
cccatgtctagcctccaaaagttaa

SEQ ID NO: 533179 - DNA, 25 bp, Homo sapien
gtctagcctccaaaagttaagtgaa

SEQ ID NO: 533180 - DNA, 25 bp, Homo sapien
gaaaattagtcaactgcacgtggaa

SEQ ID NO: 533181 - DNA, 25 bp, Homo sapien
tttatttcttttcagccagggacct

SEQ ID NO: 533182 - DNA, 25 bp, Homo sapien
tagtatttaccatagggagtgaagt

SEQ ID NO: 533183 - DNA, 25 bp, Homo sapien
accatagggagtgaagtggagttat

SEQ ID NO: 533184 - DNA, 25 bp, Homo sapien
atggtttcattcaatagagtattgc

SEQ ID NO: 533185 - DNA, 25 bp, Homo sapien
tattgctgattatacttgagtggaa

SEQ ID NO: 533186 - DNA, 25 bp, Homo sapien
ttgagtggaatcctttcctcacgta

SEQ ID NO: 533187 - DNA, 25 bp, Homo sapien
agtggaatcctttcctcacgtactc

SEQ ID NO: 533188 - DNA, 25 bp, Homo sapien
tcacgtactcccacagacgtctggg

SEQ ID NO: 533189 - DNA, 25 bp, Homo sapien
tcccacagacgtctgggcctggaaa

SEQ ID NO: 533190 - DNA, 25 bp, Homo sapien
tagaaaaacaccacttttattatgt

SEQ ID NO: 533191 - DNA, 25 bp, Homo sapien
cattagcttgaattgtatagatttt

SEQ ID NO: 533192 - DNA, 25 bp, Homo sapien
tcactgttgggctttgaaagcattg

SEQ ID NO: 533193 - DNA, 25 bp, Homo sapien
tagacactgtgtcaggtagcctcac

SEQ ID NO: 533194 - DNA, 25 bp, Homo sapien
gtgtcaggtagcctcactatctaca

SEQ ID NO: 533195 - DNA, 25 bp, Homo sapien
gcctcactatctacaacttaacatc

SEQ ID NO: 533196 - DNA, 25 bp, Homo sapien
tctacaacttaacatcatcagatga

SEQ ID NO: 533197 - DNA, 25 bp, Homo sapien
gatgagtatgaaatggaatcgccaa

SEQ ID NO: 533198 - DNA, 25 bp, Homo sapien
gaatcgccaaatattactgatacca

SEQ ID NO: 533199 - DNA, 25 bp, Homo sapien
gataccatgaagttctttctttatg

SEQ ID NO: 533200 - DNA, 25 bp, Homo sapien
ggtcattcaagacacagatatgcac

SEQ ID NO: 533201 - DNA, 25 bp, Homo sapien
gacacagatatgcacttatacccat

SEQ ID NO: 533202 - DNA, 25 bp, Homo sapien
gcacttatacccataccattagcag

SEQ ID NO: 533203 - DNA, 25 bp, Homo sapien
taccattagcagtaattacaacatg

SEQ ID NO: 533204 - DNA, 25 bp, Homo sapien
ggaggagggatcttattcagctaat

SEQ ID NO: 533205 - DNA, 25 bp, Homo sapien
gggatcttattcagctaatgttctc

SEQ ID NO: 533206 - DNA, 25 bp, Homo sapien
attcagctaatgttctcattctgca

SEQ ID NO: 533207 - DNA, 25 bp, Homo sapien
gttctcattctgcaagactcccctg

SEQ ID NO: 533208 - DNA, 25 bp, Homo sapien
gcaagactcccctggaacttttgta

SEQ ID NO: 533209 - DNA, 25 bp, Homo sapien
gactcccctggaacttttgtagtat

SEQ ID NO: 533210 - DNA, 25 bp, Homo sapien
acttttgtagtattccctttgactg

SEQ ID NO: 533211 - DNA, 25 bp, Homo sapien
tgtagtattccctttgactgtgcta

SEQ ID NO: 533212 - DNA, 25 bp, Homo sapien
gtattccctttgactgtgctacaga

SEQ ID NO: 533213 - DNA, 25 bp, Homo sapien
gactgtgctacagatcggatttttg

SEQ ID NO: 533214 - DNA, 25 bp, Homo sapien
atcggatttttggatcaagctttat

SEQ ID NO: 533215 - DNA, 25 bp, Homo sapien
gctctcacaaaggaggttcaaagac

SEQ ID NO: 533216 - DNA, 25 bp, Homo sapien
gtaccgatgaaacgcgcaactttgt

SEQ ID NO: 533217 - DNA, 25 bp, Homo sapien
aacgcgcaactttgtaatcccaaca

SEQ ID NO: 533218 - DNA, 25 bp, Homo sapien
atcccaacactttctattttctaga

SEQ ID NO: 533219 - DNA, 25 bp, Homo sapien
tggtttttcagtcggctggaattct

SEQ ID NO: 533220 - DNA, 25 bp, Homo sapien
cagtcggctggaattctatcttctg

SEQ ID NO: 533221 - DNA, 25 bp, Homo sapien
gggccttccgtctgagatggaagct

SEQ ID NO: 533222 - DNA, 25 bp, Homo sapien
tggaagctgtcttgggcttgttgtc

SEQ ID NO: 533223 - DNA, 25 bp, Homo sapien
tttccactctgtctggtgagctctg

SEQ ID NO: 533224 - DNA, 25 bp, Homo sapien
ggtgagctctgctttttcagtgcac

SEQ ID NO: 533225 - DNA, 25 bp, Homo sapien
tctgctttttcagtgcaccatcaag

SEQ ID NO: 533226 - DNA, 25 bp, Homo sapien
gagatcaccgtggagcttagctgtg

SEQ ID NO: 533227 - DNA, 25 bp, Homo sapien
ttagctgtgagaagttcccacctga

SEQ ID NO: 533228 - DNA, 25 bp, Homo sapien
gttcccacctgaagagactctgaag

SEQ ID NO: 533229 - DNA, 25 bp, Homo sapien
aaaaactccctcattagctaccttg

SEQ ID NO: 533230 - DNA, 25 bp, Homo sapien
cttgagcagatacaccgaggagtta

SEQ ID NO: 533231 - DNA, 25 bp, Homo sapien
ggatttgtccgagaccttcaaggta

SEQ ID NO: 533232 - DNA, 25 bp, Homo sapien
aaggtaacccaattgcgaatgccac

SEQ ID NO: 533233 - DNA, 25 bp, Homo sapien
aatgccaccatctccgtggaaggaa

SEQ ID NO: 533234 - DNA, 25 bp, Homo sapien
actggagattgcttatacctggaaa

SEQ ID NO: 533235 - DNA, 25 bp, Homo sapien
tataaacttacagcctcagctccag

SEQ ID NO: 533236 - DNA, 25 bp, Homo sapien
tcagctccaggctatctggcaataa

SEQ ID NO: 533237 - DNA, 25 bp, Homo sapien
taattgttaatattccctaaacaca

SEQ ID NO: 533238 - DNA, 25 bp, Homo sapien
atattccctaaacacaattttatga

SEQ ID NO: 533239 - DNA, 25 bp, Homo sapien
cacaattttatgaagggagaagaca

SEQ ID NO: 533240 - DNA, 25 bp, Homo sapien
gggagaagacattggtttgttgaca

SEQ ID NO: 533241 - DNA, 25 bp, Homo sapien
ggagaagacattggtttgttgacaa

SEQ ID NO: 533242 - DNA, 25 bp, Homo sapien
gagaagacattggtttgttgacaat

SEQ ID NO: 533243 - DNA, 25 bp, Homo sapien
gaagacattggtttgttgacaataa

SEQ ID NO: 533244 - DNA, 25 bp, Homo sapien
aagacattggtttgttgacaataac

SEQ ID NO: 533245 - DNA, 25 bp, Homo sapien
agacattggtttgttgacaataaca

SEQ ID NO: 533246 - DNA, 25 bp, Homo sapien
gacattggtttgttgacaataacag

SEQ ID NO: 533247 - DNA, 25 bp, Homo sapien
attggtttgttgacaataacagtac

SEQ ID NO: 533248 - DNA, 25 bp, Homo sapien
acctgctgtctgttgaactagactg

SEQ ID NO: 533249 - DNA, 25 bp, Homo sapien
atatattttctcacaagctccatcc

SEQ ID NO: 533250 - DNA, 25 bp, Homo sapien
tccctttttctttaggacatgttat

SEQ ID NO: 533251 - DNA, 25 bp, Homo sapien
ggacatgttatatataatccatctc

SEQ ID NO: 533252 - DNA, 25 bp, Homo sapien
tataatccatctcagaagttgaaga

SEQ ID NO: 533253 - DNA, 25 bp, Homo sapien
ttgaagatgtgatgttgctcggcct

SEQ ID NO: 533254 - DNA, 25 bp, Homo sapien
atgtgatgttgctcggcctttggaa

SEQ ID NO: 533255 - DNA, 25 bp, Homo sapien
gttgctcggcctttggaataatttt

SEQ ID NO: 533256 - DNA, 25 bp, Homo sapien
gcattattgtaattcctgtgttaac

SEQ ID NO: 533257 - DNA, 25 bp, Homo sapien
tcctgtgttaacagtttgtgtgtct

SEQ ID NO: 533258 - DNA, 25 bp, Homo sapien
caggagttggcataaattttgttaa

SEQ ID NO: 533259 - DNA, 25 bp, Homo sapien
gtctgcagggcgtccgtgtagatta

SEQ ID NO: 533260 - DNA, 25 bp, Homo sapien
tgctgcaggcaccatacctgcgatg

SEQ ID NO: 533261 - DNA, 25 bp, Homo sapien
ggcaccatacctgcgatggtgtaca

SEQ ID NO: 533262 - DNA, 25 bp, Homo sapien
tacctgcgatggtgtacagggctgt

SEQ ID NO: 533263 - DNA, 25 bp, Homo sapien
tacagggctgtgatgccgagcgtga

SEQ ID NO: 533264 - DNA, 25 bp, Homo sapien
gcagggcgtccgtgtagattacagc

SEQ ID NO: 533265 - DNA, 25 bp, Homo sapien
ctgtgatgccgagcgtgaggatggt

SEQ ID NO: 533266 - DNA, 25 bp, Homo sapien
agggcgtccgtgtagattacagcag

SEQ ID NO: 533267 - DNA, 25 bp, Homo sapien
gcgtccgtgtagattacagcagcca

SEQ ID NO: 533268 - DNA, 25 bp, Homo sapien
gtgtagattacagcagccaggcccc

SEQ ID NO: 533269 - DNA, 25 bp, Homo sapien
aggccccctgccagtggaagcaagg

SEQ ID NO: 533270 - DNA, 25 bp, Homo sapien
gatggcatacatagacaaactgact

SEQ ID NO: 533271 - DNA, 25 bp, Homo sapien
tgttcatgaccaaagtgactggcca

SEQ ID NO: 533272 - DNA, 25 bp, Homo sapien
aagtgactggccagacagtctagac

SEQ ID NO: 533273 - DNA, 25 bp, Homo sapien
gacagtctagacaggccaggttcta

SEQ ID NO: 533274 - DNA, 25 bp, Homo sapien
agacaggccaggttctaccttactg

SEQ ID NO: 533275 - DNA, 25 bp, Homo sapien
ttactgccttgaaactgaggaatca

SEQ ID NO: 533276 - DNA, 25 bp, Homo sapien
tgaggaatcaatatctctgcacaca

SEQ ID NO: 533277 - DNA, 25 bp, Homo sapien
gatgctatagcacatttgtttgtaa

SEQ ID NO: 533278 - DNA, 25 bp, Homo sapien
ttgtttgtaatctctgaactaggtg

SEQ ID NO: 533279 - DNA, 25 bp, Homo sapien
taaatggcaagaagtgcctcagaga

SEQ ID NO: 533280 - DNA, 25 bp, Homo sapien
cctcagagagagacagccatgataa

SEQ ID NO: 533281 - DNA, 25 bp, Homo sapien
gaagtggcgcaagcttgctttgtaa

SEQ ID NO: 533282 - DNA, 25 bp, Homo sapien
aatatctgtggtcccgatgtagtgc

SEQ ID NO: 533283 - DNA, 25 bp, Homo sapien
gatgtagtgcccagaacgtttgtgc

SEQ ID NO: 533284 - DNA, 25 bp, Homo sapien
gaacgtttgtgcgaggcagctctgc

SEQ ID NO: 533285 - DNA, 25 bp, Homo sapien
gcgtcttcggagtgcttgtgacagt

SEQ ID NO: 533286 - DNA, 25 bp, Homo sapien
gtgacagtccttgcccagtatctag

SEQ ID NO: 533287 - DNA, 25 bp, Homo sapien
tcgccccgtgcaggagacgtaggta

SEQ ID NO: 533288 - DNA, 25 bp, Homo sapien
gtaggacgtcgtgtcagctgtgcac

SEQ ID NO: 533289 - DNA, 25 bp, Homo sapien
tcagctgtgcactgacggccagtct

SEQ ID NO: 533290 - DNA, 25 bp, Homo sapien
tccgagctgtgcgtttgtatcgcca

SEQ ID NO: 533291 - DNA, 25 bp, Homo sapien
gtttgtatcgccactgtatttgtgt

SEQ ID NO: 533292 - DNA, 25 bp, Homo sapien
tgtgctgctgctttttgatctcttc

SEQ ID NO: 533293 - DNA, 25 bp, Homo sapien
gctgctttttgatctcttcgactaa

SEQ ID NO: 533294 - DNA, 25 bp, Homo sapien
ttgatctcttcgactaaaatttttt

SEQ ID NO: 533295 - DNA, 25 bp, Homo sapien
tttttatccggagtgtatttaatcg

SEQ ID NO: 533296 - DNA, 25 bp, Homo sapien
atttaatcggttctgttctgtcctc

SEQ ID NO: 533297 - DNA, 25 bp, Homo sapien
tacaccaacccgaggctctttgttt

SEQ ID NO: 533298 - DNA, 25 bp, Homo sapien
ttgtttcccctcttggatctgttga

SEQ ID NO: 533299 - DNA, 25 bp, Homo sapien
ccctcttggatctgttgagtttctt

SEQ ID NO: 533300 - DNA, 25 bp, Homo sapien
gaagaagccagcatgggtgcccagt

SEQ ID NO: 533301 - DNA, 25 bp, Homo sapien
aagccagcatgggtgcccagttctc

SEQ ID NO: 533302 - DNA, 25 bp, Homo sapien
agttctccaagaccgcagcgaaggg

SEQ ID NO: 533303 - DNA, 25 bp, Homo sapien
gatgactccacttttgcccctgtgg

SEQ ID NO: 533304 - DNA, 25 bp, Homo sapien
gcccctgtggcaccttgaacaaagc

SEQ ID NO: 533305 - DNA, 25 bp, Homo sapien
gtggcaccttgaacaaagcagttct

SEQ ID NO: 533306 - DNA, 25 bp, Homo sapien
agagaaacatttgactttgactgcc

SEQ ID NO: 533307 - DNA, 25 bp, Homo sapien
aaagtgtgcagttggtcgtctttct

SEQ ID NO: 533308 - DNA, 25 bp, Homo sapien
tgtgcagttggtcgtctttcttctc

SEQ ID NO: 533309 - DNA, 25 bp, Homo sapien
cagttggtcgtctttcttctccttt

SEQ ID NO: 533310 - DNA, 25 bp, Homo sapien
ctttaggatagtaagagactcactc

SEQ ID NO: 533311 - DNA, 25 bp, Homo sapien
cttaactttcccttcagaatacatg

SEQ ID NO: 533312 - DNA, 25 bp, Homo sapien
aagaaatagcgatgactccactttt

SEQ ID NO: 533313 - DNA, 25 bp, Homo sapien
aaatagcgatgactccacttttgcc

SEQ ID NO: 533314 - DNA, 25 bp, Homo sapien
tgaccctgtgggtggacccctatga

SEQ ID NO: 533315 - DNA, 25 bp, Homo sapien
ctatgaggtgtcctaccgcattggg

SEQ ID NO: 533316 - DNA, 25 bp, Homo sapien
gctccatctgcgtcttgtacgagga

SEQ ID NO: 533317 - DNA, 25 bp, Homo sapien
tcctcacctgcaagaaccaagtgct

SEQ ID NO: 533318 - DNA, 25 bp, Homo sapien
acctgcaagaaccaagtgctgctgg

SEQ ID NO: 533319 - DNA, 25 bp, Homo sapien
gagcagcccctccaagaactacgtg

SEQ ID NO: 533320 - DNA, 25 bp, Homo sapien
aagaactacgtgatggcagtctcca

SEQ ID NO: 533321 - DNA, 25 bp, Homo sapien
tacgtgatggcagtctccagctagg

SEQ ID NO: 533322 - DNA, 25 bp, Homo sapien
gatggcagtctccagctaggccctt

SEQ ID NO: 533323 - DNA, 25 bp, Homo sapien
cgtgctcatgctgccgtgacaacag

SEQ ID NO: 533324 - DNA, 25 bp, Homo sapien
tgccgtgacaacaggccaccacata

SEQ ID NO: 533325 - DNA, 25 bp, Homo sapien
ggatagcttctagggatattagtaa

SEQ ID NO: 533326 - DNA, 25 bp, Homo sapien
tattagtaatagattgccatgatcc

SEQ ID NO: 533327 - DNA, 25 bp, Homo sapien
agaacactgtgaagataatactgac

SEQ ID NO: 533328 - DNA, 25 bp, Homo sapien
agaatcagtgaaaacagcctaacaa

SEQ ID NO: 533329 - DNA, 25 bp, Homo sapien
agcctaacaaaacctctgacatcag

SEQ ID NO: 533330 - DNA, 25 bp, Homo sapien
cctctgacatcagtatatcaacttt

SEQ ID NO: 533331 - DNA, 25 bp, Homo sapien
tatcaacttttaacagcccactcac

SEQ ID NO: 533332 - DNA, 25 bp, Homo sapien
cagcccactcactggcttttctaaa

SEQ ID NO: 533333 - DNA, 25 bp, Homo sapien
tatcctaatatttatagccagcagc

SEQ ID NO: 533334 - DNA, 25 bp, Homo sapien
agccagcagctgttactttgtttgt

SEQ ID NO: 533335 - DNA, 25 bp, Homo sapien
cagcagctgttactttgtttgtaaa

SEQ ID NO: 533336 - DNA, 25 bp, Homo sapien
aataattaaccatctacctctgttt

SEQ ID NO: 533337 - DNA, 25 bp, Homo sapien
taaccatctacctctgtttttaatt

SEQ ID NO: 533338 - DNA, 25 bp, Homo sapien
aattttctttccaaaaggcagcttg

SEQ ID NO: 533339 - DNA, 25 bp, Homo sapien
ggcagcttgaaatgttggtcctaat

SEQ ID NO: 533340 - DNA, 25 bp, Homo sapien
gaaatgttggtcctaatcttaattt

SEQ ID NO: 533341 - DNA, 25 bp, Homo sapien
tttttcctcttctatagacttgaga

SEQ ID NO: 533342 - DNA, 25 bp, Homo sapien
gacttagaatgtacacagatccaaa

SEQ ID NO: 533343 - DNA, 25 bp, Homo sapien
aagacttagaacatacacagatcct

SEQ ID NO: 533344 - DNA, 25 bp, Homo sapien
atacacagatcctaagtagaaccag

SEQ ID NO: 533345 - DNA, 25 bp, Homo sapien
gtagaaccaggtaattgtctctttt

SEQ ID NO: 533346 - DNA, 25 bp, Homo sapien
ccaggtaattgtctctttttctaat

SEQ ID NO: 533347 - DNA, 25 bp, Homo sapien
gaggattgtgctgatgtagtgacca

SEQ ID NO: 533348 - DNA, 25 bp, Homo sapien
gctgatgtagtgaccaagtgcaata

SEQ ID NO: 533349 - DNA, 25 bp, Homo sapien
ccaagtgcaatatgggcgggcagtc

SEQ ID NO: 533350 - DNA, 25 bp, Homo sapien
tatgggcgggcagtcgctgcaggga

SEQ ID NO: 533351 - DNA, 25 bp, Homo sapien
gcagggagcaccacggccagaagta

SEQ ID NO: 533352 - DNA, 25 bp, Homo sapien
gcaccacggccagaagtaacttatt

SEQ ID NO: 533353 - DNA, 25 bp, Homo sapien
aacttattttgtactagtgtccgca

SEQ ID NO: 533354 - DNA, 25 bp, Homo sapien
tttgtactagtgtccgcataagaaa

SEQ ID NO: 533355 - DNA, 25 bp, Homo sapien
gaatcggcagtattttctgttttta

SEQ ID NO: 533356 - DNA, 25 bp, Homo sapien
aaatgtatgctatcctcttattcct

SEQ ID NO: 533357 - DNA, 25 bp, Homo sapien
gtatgctatcctcttattcctttaa

SEQ ID NO: 533358 - DNA, 25 bp, Homo sapien
tttctctgttttgcttggcttattt

SEQ ID NO: 533359 - DNA, 25 bp, Homo sapien
cttggcttattttatgttattcaca

SEQ ID NO: 533360 - DNA, 25 bp, Homo sapien
gttattcacacatgcttaaacatat

SEQ ID NO: 533361 - DNA, 25 bp, Homo sapien
gagcttaataaaatcatgacactga

SEQ ID NO: 533362 - DNA, 25 bp, Homo sapien
aatcatgacactgattcttcggtca

SEQ ID NO: 533363 - DNA, 25 bp, Homo sapien
gacactgattcttcggtcatgatca

SEQ ID NO: 533364 - DNA, 25 bp, Homo sapien
gattcttcggtcatgatcatatagt

SEQ ID NO: 533365 - DNA, 25 bp, Homo sapien
gtcatgatcatatagtttttattcc

SEQ ID NO: 533366 - DNA, 25 bp, Homo sapien
ttcttttgggagctaatttggtaca

SEQ ID NO: 533367 - DNA, 25 bp, Homo sapien
ttgggagctaatttggtacagtgca

SEQ ID NO: 533368 - DNA, 25 bp, Homo sapien
gtgcataactatgatttctctgttt

SEQ ID NO: 533369 - DNA, 25 bp, Homo sapien
tctccctcctggtgaagtgtgactt

SEQ ID NO: 533370 - DNA, 25 bp, Homo sapien
agtgtgacttcgaattagtttgcac

SEQ ID NO: 533371 - DNA, 25 bp, Homo sapien
gaattagtttgcacttcctattgga

SEQ ID NO: 533372 - DNA, 25 bp, Homo sapien
tattggaaggtagagcccactgctc

SEQ ID NO: 533373 - DNA, 25 bp, Homo sapien
gaaggtagagcccactgctcattgt

SEQ ID NO: 533374 - DNA, 25 bp, Homo sapien
gagcccactgctcattgtataagcc

SEQ ID NO: 533375 - DNA, 25 bp, Homo sapien
ctgctcattgtataagccccgaggc

SEQ ID NO: 533376 - DNA, 25 bp, Homo sapien
cccgaggcctagagtggcagccaag

SEQ ID NO: 533377 - DNA, 25 bp, Homo sapien
agagccatctgaagccacctctctg

SEQ ID NO: 533378 - DNA, 25 bp, Homo sapien
tgttcctcccaagaggccagggtgg

SEQ ID NO: 533379 - DNA, 25 bp, Homo sapien
acaataaaaaccaaactctgtgtca

SEQ ID NO: 533380 - DNA, 25 bp, Homo sapien
ccctattatgggaatgactctgact

SEQ ID NO: 533381 - DNA, 25 bp, Homo sapien
tattatgggaatgactctgactttg

SEQ ID NO: 533382 - DNA, 25 bp, Homo sapien
tctgactttgagacggtgtaccagc

SEQ ID NO: 533383 - DNA, 25 bp, Homo sapien
agacggtgtaccagcagtgtgtcag

SEQ ID NO: 533384 - DNA, 25 bp, Homo sapien
gtgtaccagcagtgtgtcaggtgct

SEQ ID NO: 533385 - DNA, 25 bp, Homo sapien
accagcagtgtgtcaggtgctgcag

SEQ ID NO: 533386 - DNA, 25 bp, Homo sapien
gcccactgaggcaggttcgtgccct

SEQ ID NO: 533387 - DNA, 25 bp, Homo sapien
aggttcgtgccctgctgcggccagc

SEQ ID NO: 533388 - DNA, 25 bp, Homo sapien
accctgaggtcctgcatttctcagt

SEQ ID NO: 533389 - DNA, 25 bp, Homo sapien
aggtcctgcatttctcagtcggtgt

SEQ ID NO: 533390 - DNA, 25 bp, Homo sapien
tgcatttctcagtcggtgtgtaatc

SEQ ID NO: 533391 - DNA, 25 bp, Homo sapien
gttgtagttttttattcatgctgaa

SEQ ID NO: 533392 - DNA, 25 bp, Homo sapien
aaagtgtctttttacctacgcagtg

SEQ ID NO: 533393 - DNA, 25 bp, Homo sapien
gtgtctttttacctacgcagtgaaa

SEQ ID NO: 533394 - DNA, 25 bp, Homo sapien
tacctacgcagtgaaatgtcagact

SEQ ID NO: 533395 - DNA, 25 bp, Homo sapien
atgtcagactgtaaaaccttgtgtg

SEQ ID NO: 533396 - DNA, 25 bp, Homo sapien
gactgtaaaaccttgtgtggaaatg

SEQ ID NO: 533397 - DNA, 25 bp, Homo sapien
taaatttgctgttctggtattacca

SEQ ID NO: 533398 - DNA, 25 bp, Homo sapien
ggtattaccaaaccacacatttgta

SEQ ID NO: 533399 - DNA, 25 bp, Homo sapien
cacacatttgtaccgaattggcagt

SEQ ID NO: 533400 - DNA, 25 bp, Homo sapien
taccgaattggcagtaaatgttagc

SEQ ID NO: 533401 - DNA, 25 bp, Homo sapien
tagccatttacagcaatgccaaata

SEQ ID NO: 533402 - DNA, 25 bp, Homo sapien
tcatttgccccgcaggtagatcttg

SEQ ID NO: 533403 - DNA, 25 bp, Homo sapien
atttgccccgcaggtagatcttggg

SEQ ID NO: 533404 - DNA, 25 bp, Homo sapien
gccttcagccagatgcgcctcaggt

SEQ ID NO: 533405 - DNA, 25 bp, Homo sapien
agatgcgcctcaggtctttctcgaa

SEQ ID NO: 533406 - DNA, 25 bp, Homo sapien
gcctcaggtctttctcgaacttgat

SEQ ID NO: 533407 - DNA, 25 bp, Homo sapien
caggtctttctcgaacttgatctgc

SEQ ID NO: 533408 - DNA, 25 bp, Homo sapien
tttctcgaacttgatctgcttgcgt

SEQ ID NO: 533409 - DNA, 25 bp, Homo sapien
tctcgaacttgatctgcttgcgtct

SEQ ID NO: 533410 - DNA, 25 bp, Homo sapien
cgaacttgatctgcttgcgtctcag

SEQ ID NO: 533411 - DNA, 25 bp, Homo sapien
aatttattactacggatcacagcag

SEQ ID NO: 533412 - DNA, 25 bp, Homo sapien
attactacggatcacagcagcaacg

SEQ ID NO: 533413 - DNA, 25 bp, Homo sapien
tgggtccatctgtagcaaatgggtt

SEQ ID NO: 533414 - DNA, 25 bp, Homo sapien
gcaaatgggttgagtgtgtcagtat

SEQ ID NO: 533415 - DNA, 25 bp, Homo sapien
ggttactgtgtattcgccaggaatc

SEQ ID NO: 533416 - DNA, 25 bp, Homo sapien
attcgccaggaatcaccccgatagg

SEQ ID NO: 533417 - DNA, 25 bp, Homo sapien
gataggctgccaccctattaggtga

SEQ ID NO: 533418 - DNA, 25 bp, Homo sapien
taggtgatacctgtttaatatgttg

SEQ ID NO: 533419 - DNA, 25 bp, Homo sapien
tagactagtagttgcatcagtttgc

SEQ ID NO: 533420 - DNA, 25 bp, Homo sapien
atcagtttgctgtaacaagtaacca

SEQ ID NO: 533421 - DNA, 25 bp, Homo sapien
agtccgggagatgaatggctgtcta

SEQ ID NO: 533422 - DNA, 25 bp, Homo sapien
tctaggaaggaggatgtcagtgcac

SEQ ID NO: 533423 - DNA, 25 bp, Homo sapien
tcagtgcacggttagtgtttgagca

SEQ ID NO: 533424 - DNA, 25 bp, Homo sapien
cagattgaggcggtgctcctcaata

SEQ ID NO: 533425 - DNA, 25 bp, Homo sapien
tgctcctcaatagcctgcagcagta

SEQ ID NO: 533426 - DNA, 25 bp, Homo sapien
caatagcctgcagcagtaccgtcag

SEQ ID NO: 533427 - DNA, 25 bp, Homo sapien
cccagcagcgggagaagctgtctct

SEQ ID NO: 533428 - DNA, 25 bp, Homo sapien
gaagctgtctctgatccgcaagcat

SEQ ID NO: 533429 - DNA, 25 bp, Homo sapien
tgatccgcaagcatgctcagacctt

SEQ ID NO: 533430 - DNA, 25 bp, Homo sapien
cgcaagcatgctcagaccttcattg

SEQ ID NO: 533431 - DNA, 25 bp, Homo sapien
atgctcagaccttcattgctctgtg

SEQ ID NO: 533432 - DNA, 25 bp, Homo sapien
agaccttcattgctctgtgtgccac

SEQ ID NO: 533433 - DNA, 25 bp, Homo sapien
ccaacacagacgtggattgtctcaa

SEQ ID NO: 533434 - DNA, 25 bp, Homo sapien
acgtggattgtctcaaagcttgcca

SEQ ID NO: 533435 - DNA, 25 bp, Homo sapien
gggcaggtgcttccatagcccctcc

SEQ ID NO: 533436 - DNA, 25 bp, Homo sapien
ttggcttcccactctgccaagcttt

SEQ ID NO: 533437 - DNA, 25 bp, Homo sapien
actctgccaagcttttccagcagca

SEQ ID NO: 533438 - DNA, 25 bp, Homo sapien
ctgccaagcttttccagcagcattg

SEQ ID NO: 533439 - DNA, 25 bp, Homo sapien
ttttccagcagcattgactctcctg

SEQ ID NO: 533440 - DNA, 25 bp, Homo sapien
aatgtgacaggcttgtggtgttcct

SEQ ID NO: 533441 - DNA, 25 bp, Homo sapien
aggcttgtggtgttcctgtgccact

SEQ ID NO: 533442 - DNA, 25 bp, Homo sapien
tccacaatggcctcctttaagaggg

SEQ ID NO: 533443 - DNA, 25 bp, Homo sapien
aagttcgagcgtgccagaggccgac

SEQ ID NO: 533444 - DNA, 25 bp, Homo sapien
aggccgacgggccagccgaggctac

SEQ ID NO: 533445 - DNA, 25 bp, Homo sapien
ccctggatcctactctcttattaaa

SEQ ID NO: 533446 - DNA, 25 bp, Homo sapien
gaggaaaagtctggcctcggcgcca

SEQ ID NO: 533447 - DNA, 25 bp, Homo sapien
gaaaagtctggcctcggcgccaaga

SEQ ID NO: 533448 - DNA, 25 bp, Homo sapien
aaagtctggcctcggcgccaagatc

SEQ ID NO: 533449 - DNA, 25 bp, Homo sapien
gcgccaagatcccagtcacaattat

SEQ ID NO: 533450 - DNA, 25 bp, Homo sapien
gccaagatcccagtcacaattatca

SEQ ID NO: 533451 - DNA, 25 bp, Homo sapien
agtcacaattatcaccgggtattta

SEQ ID NO: 533452 - DNA, 25 bp, Homo sapien
attatcaccgggtatttaggtgctg

SEQ ID NO: 533453 - DNA, 25 bp, Homo sapien
tcaccgggtatttaggtgctgggaa

SEQ ID NO: 533454 - DNA, 25 bp, Homo sapien
ggaagacaacacttctgaactatat

SEQ ID NO: 533455 - DNA, 25 bp, Homo sapien
gcaacatagtaaaagagtagcggtc

SEQ ID NO: 533456 - DNA, 25 bp, Homo sapien
aaaagagtagcggtcattttaaatg

SEQ ID NO: 533457 - DNA, 25 bp, Homo sapien
acttgtccctgtctgttgggaaact

SEQ ID NO: 533458 - DNA, 25 bp, Homo sapien
tgggaaacttggtctcactctagtc

SEQ ID NO: 533459 - DNA, 25 bp, Homo sapien
aaacttggtctcactctagtctgtg

SEQ ID NO: 533460 - DNA, 25 bp, Homo sapien
ggtctcactctagtctgtgctggct

SEQ ID NO: 533461 - DNA, 25 bp, Homo sapien
cactctagtctgtgctggctctttt

SEQ ID NO: 533462 - DNA, 25 bp, Homo sapien
gtttgaaactatggtgctgtgtcct

SEQ ID NO: 533463 - DNA, 25 bp, Homo sapien
ttgtgttctctgttcttcttaaggt

SEQ ID NO: 533464 - DNA, 25 bp, Homo sapien
gtgttctctgttcttcttaaggtat

SEQ ID NO: 533465 - DNA, 25 bp, Homo sapien
ctctgttcttcttaaggtattaggt

SEQ ID NO: 533466 - DNA, 25 bp, Homo sapien
ggtattaggtaagctgtatgtaaac

SEQ ID NO: 533467 - DNA, 25 bp, Homo sapien
agctgtatgtaaactcttattagaa

SEQ ID NO: 533468 - DNA, 25 bp, Homo sapien
gtgaaggaggtcaggccccactcct

SEQ ID NO: 533469 - DNA, 25 bp, Homo sapien
ccttcctgattgtttacagtcattg

SEQ ID NO: 533470 - DNA, 25 bp, Homo sapien
taaggcatggctcagatcggccaca

SEQ ID NO: 533471 - DNA, 25 bp, Homo sapien
agatcggccacagggcggtaccttg

SEQ ID NO: 533472 - DNA, 25 bp, Homo sapien
tttgccccaagtcctcatttaaaag

SEQ ID NO: 533473 - DNA, 25 bp, Homo sapien
tttaaaagcataaggccggacgcat

SEQ ID NO: 533474 - DNA, 25 bp, Homo sapien
aaggccggacgcatctcaaaacaga

SEQ ID NO: 533475 - DNA, 25 bp, Homo sapien
ggctgcattcgaagaaacccttgct

SEQ ID NO: 533476 - DNA, 25 bp, Homo sapien
ttgctgctttagtcccgatagggta

SEQ ID NO: 533477 - DNA, 25 bp, Homo sapien
tcccgatagggtatttgaccccgat

SEQ ID NO: 533478 - DNA, 25 bp, Homo sapien
gaccccgatatattttagcatttta

SEQ ID NO: 533479 - DNA, 25 bp, Homo sapien
gacagagaaacctgttctcatggca

SEQ ID NO: 533480 - DNA, 25 bp, Homo sapien
aaacctgttctcatggcatgtaaca

SEQ ID NO: 533481 - DNA, 25 bp, Homo sapien
ttctcatggcatgtaacatccctgt

SEQ ID NO: 533482 - DNA, 25 bp, Homo sapien
tcatggcatgtaacatccctgtgaa

SEQ ID NO: 533483 - DNA, 25 bp, Homo sapien
ggcatgtaacatccctgtgaagaga

SEQ ID NO: 533484 - DNA, 25 bp, Homo sapien
gtaacatccctgtgaagagagcgtt

SEQ ID NO: 533485 - DNA, 25 bp, Homo sapien
catccctgtgaagagagcgttgtat

SEQ ID NO: 533486 - DNA, 25 bp, Homo sapien
ccctgtgaagagagcgttgtatatg

SEQ ID NO: 533487 - DNA, 25 bp, Homo sapien
gagcgttgtatatgattttgtattt

SEQ ID NO: 533488 - DNA, 25 bp, Homo sapien
ttcattttaatctacaggttggaat

SEQ ID NO: 533489 - DNA, 25 bp, Homo sapien
tctacaggttggaatctaattttta

SEQ ID NO: 533490 - DNA, 25 bp, Homo sapien
ggtggacctctgaaaaccaaaccag

SEQ ID NO: 533491 - DNA, 25 bp, Homo sapien
tctgaaaaccaaaccagtacctggg

SEQ ID NO: 533492 - DNA, 25 bp, Homo sapien
tgtgtttcaggcttggagtgtatga

SEQ ID NO: 533493 - DNA, 25 bp, Homo sapien
cttggagtgtatgagtggttttgct

SEQ ID NO: 533494 - DNA, 25 bp, Homo sapien
tgcttgtattttcctccagagattt

SEQ ID NO: 533495 - DNA, 25 bp, Homo sapien
gtaaaattgtgaacatatttccttt

SEQ ID NO: 533496 - DNA, 25 bp, Homo sapien
gtattgtagactgtacatgtgcctt

SEQ ID NO: 533497 - DNA, 25 bp, Homo sapien
gtagactgtacatgtgccttcttaa

SEQ ID NO: 533498 - DNA, 25 bp, Homo sapien
atgtgccttcttaatgtgtttctcg

SEQ ID NO: 533499 - DNA, 25 bp, Homo sapien
tgccttcttaatgtgtttctcgaca

SEQ ID NO: 533500 - DNA, 25 bp, Homo sapien
taatgtgtttctcgacacatttttt

SEQ ID NO: 533501 - DNA, 25 bp, Homo sapien
gcctctaaactggaattcggttgct

SEQ ID NO: 533502 - DNA, 25 bp, Homo sapien
taaactggaattcggttgctgaccc

SEQ ID NO: 533503 - DNA, 25 bp, Homo sapien
actggaattcggttgctgacccagc

SEQ ID NO: 533504 - DNA, 25 bp, Homo sapien
tggaattcggttgctgacccagccc

SEQ ID NO: 533505 - DNA, 25 bp, Homo sapien
tcggctttcttgtcggcaccaggtg

SEQ ID NO: 533506 - DNA, 25 bp, Homo sapien
tttcttgtcggcaccaggtggcaca

SEQ ID NO: 533507 - DNA, 25 bp, Homo sapien
ttgtcggcaccaggtggcacagcac

SEQ ID NO: 533508 - DNA, 25 bp, Homo sapien
aggtggcacagcactccgtctgtag

SEQ ID NO: 533509 - DNA, 25 bp, Homo sapien
ctcttgtgagtctcgcaggtcgctc

SEQ ID NO: 533510 - DNA, 25 bp, Homo sapien
tacggcgtagggtggcaggcacaat

SEQ ID NO: 533511 - DNA, 25 bp, Homo sapien
tttggctgtaagtttattcaatgca

SEQ ID NO: 533512 - DNA, 25 bp, Homo sapien
agaagtgccgtccttatctcatcaa

SEQ ID NO: 533513 - DNA, 25 bp, Homo sapien
cttatctcatcaaagccaggctgct

SEQ ID NO: 533514 - DNA, 25 bp, Homo sapien
ccaggctgctttattgcaggtgctg

SEQ ID NO: 533515 - DNA, 25 bp, Homo sapien
gctttattgcaggtgctgatatcaa

SEQ ID NO: 533516 - DNA, 25 bp, Homo sapien
gatatcaacatgttagccgcttgca

SEQ ID NO: 533517 - DNA, 25 bp, Homo sapien
acatgttagccgcttgcaagaccct

SEQ ID NO: 533518 - DNA, 25 bp, Homo sapien
gccgcttgcaagacccttcaagaag

SEQ ID NO: 533519 - DNA, 25 bp, Homo sapien
caagaagtaacacagctatcacaag

SEQ ID NO: 533520 - DNA, 25 bp, Homo sapien
cttgaaaagtccacaaagcctattg

SEQ ID NO: 533521 - DNA, 25 bp, Homo sapien
tgccatcaatggatcctgcctggga

SEQ ID NO: 533522 - DNA, 25 bp, Homo sapien
atttcatgccaatacagaatagcaa

SEQ ID NO: 533523 - DNA, 25 bp, Homo sapien
ggcttcacagatttcttactgccca

SEQ ID NO: 533524 - DNA, 25 bp, Homo sapien
agatttcttactgcccatgttggag

SEQ ID NO: 533525 - DNA, 25 bp, Homo sapien
tgcccatgttggagctgatccctga

SEQ ID NO: 533526 - DNA, 25 bp, Homo sapien
agtgtctccggcacccttggcttaa

SEQ ID NO: 533527 - DNA, 25 bp, Homo sapien
ggcacccttggcttaactcctaagc

SEQ ID NO: 533528 - DNA, 25 bp, Homo sapien
ttcctcttcccttttcagggtgaag

SEQ ID NO: 533529 - DNA, 25 bp, Homo sapien
ggtgaagctcttccttcaagagttt

SEQ ID NO: 533530 - DNA, 25 bp, Homo sapien
tcttccttcaagagtttctagatct

SEQ ID NO: 533531 - DNA, 25 bp, Homo sapien
ccaacatgttcatttgggtttgctt

SEQ ID NO: 533532 - DNA, 25 bp, Homo sapien
tttgcttacttgaccctgtggagat

SEQ ID NO: 533533 - DNA, 25 bp, Homo sapien
cagccattgggcatcctaggtgaat

SEQ ID NO: 533534 - DNA, 25 bp, Homo sapien
atgtcctctggtgtccagtcaggga

SEQ ID NO: 533535 - DNA, 25 bp, Homo sapien
tggtgtccagtcagggacgcccatc

SEQ ID NO: 533536 - DNA, 25 bp, Homo sapien
gtcagggacgcccatcaccaatgat

SEQ ID NO: 533537 - DNA, 25 bp, Homo sapien
ggacgcccatcaccaatgatctctt

SEQ ID NO: 533538 - DNA, 25 bp, Homo sapien
tgtttgaagggctctcagatgatga

SEQ ID NO: 533539 - DNA, 25 bp, Homo sapien
atgatgaggatgactttcacccaaa

SEQ ID NO: 533540 - DNA, 25 bp, Homo sapien
ggatgactttcacccaaacaccagg

SEQ ID NO: 533541 - DNA, 25 bp, Homo sapien
atcacccagagtgagctggccaccg

SEQ ID NO: 533542 - DNA, 25 bp, Homo sapien
ctggccagcactccggagagcagct

SEQ ID NO: 533543 - DNA, 25 bp, Homo sapien
cagggtcattcctcagggacctcac

SEQ ID NO: 533544 - DNA, 25 bp, Homo sapien
tcaccaatgtcctctggtgtccagt

SEQ ID NO: 533545 - DNA, 25 bp, Homo sapien
aaattgccacattttcttatggcat

SEQ ID NO: 533546 - DNA, 25 bp, Homo sapien
aattgccacattttcttatggcatt

SEQ ID NO: 533547 - DNA, 25 bp, Homo sapien
tattccatttaatggatgcaactca

SEQ ID NO: 533548 - DNA, 25 bp, Homo sapien
aaagttgcagaaatttggtgtacat

SEQ ID NO: 533549 - DNA, 25 bp, Homo sapien
atttggtgtacataaaactgtctcc

SEQ ID NO: 533550 - DNA, 25 bp, Homo sapien
ggtgtacataaaactgtctccatat

SEQ ID NO: 533551 - DNA, 25 bp, Homo sapien
gtacataaaactgtctccatataat

SEQ ID NO: 533552 - DNA, 25 bp, Homo sapien
taaaactgtctccatataattgatt

SEQ ID NO: 533553 - DNA, 25 bp, Homo sapien
tgtctccatataattgattattagg

SEQ ID NO: 533554 - DNA, 25 bp, Homo sapien
gattattaggatatattcccatgaa

SEQ ID NO: 533555 - DNA, 25 bp, Homo sapien
ttaggatatattcccatgaaggatt

SEQ ID NO: 533556 - DNA, 25 bp, Homo sapien
ttggagagccagagcttccgcattt

SEQ ID NO: 533557 - DNA, 25 bp, Homo sapien
agtttcactgtgtagagaacatata

SEQ ID NO: 533558 - DNA, 25 bp, Homo sapien
aatcttccaattatcatgctcacct

SEQ ID NO: 533559 - DNA, 25 bp, Homo sapien
cttccaattatcatgctcacctgaa

SEQ ID NO: 533560 - DNA, 25 bp, Homo sapien
attatcatgctcacctgaaagaggt

SEQ ID NO: 533561 - DNA, 25 bp, Homo sapien
gctcacctgaaagaggtatgctctc

SEQ ID NO: 533562 - DNA, 25 bp, Homo sapien
agaggtatgctctcttaggaataca

SEQ ID NO: 533563 - DNA, 25 bp, Homo sapien
tatgctctcttaggaatacagtttc

SEQ ID NO: 533564 - DNA, 25 bp, Homo sapien
taggaatacagtttctagcattaaa

SEQ ID NO: 533565 - DNA, 25 bp, Homo sapien
ggtgtaataaaatgttcctcgcatt

SEQ ID NO: 533566 - DNA, 25 bp, Homo sapien
taataaaatgttcctcgcattcccc

SEQ ID NO: 533567 - DNA, 25 bp, Homo sapien
ttcggcctctggtcctctctggtcc

SEQ ID NO: 533568 - DNA, 25 bp, Homo sapien
tctctggtcccctcctgggtttctt

SEQ ID NO: 533569 - DNA, 25 bp, Homo sapien
ctcctgggtttcttacgtagttgat

SEQ ID NO: 533570 - DNA, 25 bp, Homo sapien
tcctgggtttcttacgtagttgatt

SEQ ID NO: 533571 - DNA, 25 bp, Homo sapien
ttcttacgtagttgatttttcctct

SEQ ID NO: 533572 - DNA, 25 bp, Homo sapien
tcttacgtagttgatttttcctctt

SEQ ID NO: 533573 - DNA, 25 bp, Homo sapien
ctctgtggcagtttcatatttgcta

SEQ ID NO: 533574 - DNA, 25 bp, Homo sapien
atatttgctaagacgaatttgctca

SEQ ID NO: 533575 - DNA, 25 bp, Homo sapien
tttgctaagacgaatttgctcatta

SEQ ID NO: 533576 - DNA, 25 bp, Homo sapien
gctaagacgaatttgctcattaaac

SEQ ID NO: 533577 - DNA, 25 bp, Homo sapien
aagacgaatttgctcattaaacatt

SEQ ID NO: 533578 - DNA, 25 bp, Homo sapien
agaccggctgggatagcctccccac

SEQ ID NO: 533579 - DNA, 25 bp, Homo sapien
gatagctcccaaagagaaatcagtg

SEQ ID NO: 533580 - DNA, 25 bp, Homo sapien
ttcagcaacatatatcctcgaccag

SEQ ID NO: 533581 - DNA, 25 bp, Homo sapien
gcaacatatatcctcgaccagatgc

SEQ ID NO: 533582 - DNA, 25 bp, Homo sapien
atatatcctcgaccagatgcagtgc

SEQ ID NO: 533583 - DNA, 25 bp, Homo sapien
atatcctcgaccagatgcagtgcta

SEQ ID NO: 533584 - DNA, 25 bp, Homo sapien
tcctcgaccagatgcagtgctataa

SEQ ID NO: 533585 - DNA, 25 bp, Homo sapien
gatgcagtgctataagaacagaacg

SEQ ID NO: 533586 - DNA, 25 bp, Homo sapien
gaacagaacgcattttggatgttat

SEQ ID NO: 533587 - DNA, 25 bp, Homo sapien
gaacgcattttggatgttattatta

SEQ ID NO: 533588 - DNA, 25 bp, Homo sapien
ggatgttattattaagaaccaaatg

SEQ ID NO: 533589 - DNA, 25 bp, Homo sapien
atttcctctatactcagggaaggcc

SEQ ID NO: 533590 - DNA, 25 bp, Homo sapien
agaatggcagttgtcagtcctgtcc

SEQ ID NO: 533591 - DNA, 25 bp, Homo sapien
ttgtcagtcctgtccgtgtaacaga

SEQ ID NO: 533592 - DNA, 25 bp, Homo sapien
agtcctgtccgtgtaacagaggagt

SEQ ID NO: 533593 - DNA, 25 bp, Homo sapien
gctcttttccatggattttgaactc

SEQ ID NO: 533594 - DNA, 25 bp, Homo sapien
gaactctggaggaaggcagcaacta

SEQ ID NO: 533595 - DNA, 25 bp, Homo sapien
ggcagcaactaaataactgtctcat

SEQ ID NO: 533596 - DNA, 25 bp, Homo sapien
aactgtctcattctgctattatgca

SEQ ID NO: 533597 - DNA, 25 bp, Homo sapien
aaatatagtctatctggttacaaat

SEQ ID NO: 533598 - DNA, 25 bp, Homo sapien
gcttaaaactttacatatcctagga

SEQ ID NO: 533599 - DNA, 25 bp, Homo sapien
tatcctaggaaatatctctacccct

SEQ ID NO: 533600 - DNA, 25 bp, Homo sapien
aaatagttgctcttctacactaggg

SEQ ID NO: 533601 - DNA, 25 bp, Homo sapien
gggtttcacctgcaggtttgacacg

SEQ ID NO: 533602 - DNA, 25 bp, Homo sapien
gtttgacacgcagttgctcgctttt

SEQ ID NO: 533603 - DNA, 25 bp, Homo sapien
gtcaagcttctctgttctggcgtga

SEQ ID NO: 533604 - DNA, 25 bp, Homo sapien
ctctgttctggcgtgagttgtgaaa

SEQ ID NO: 533605 - DNA, 25 bp, Homo sapien
gagttgaagacagcttcccatgccg

SEQ ID NO: 533606 - DNA, 25 bp, Homo sapien
tgccggtacacagccagtagcctaa

SEQ ID NO: 533607 - DNA, 25 bp, Homo sapien
gtagcctaaatctccagtacttgag

SEQ ID NO: 533608 - DNA, 25 bp, Homo sapien
gtacttgagctgaccattgaactag

SEQ ID NO: 533609 - DNA, 25 bp, Homo sapien
tagttgaatttcagtccttacgggt

SEQ ID NO: 533610 - DNA, 25 bp, Homo sapien
aacagattgagcatggctctctatt

SEQ ID NO: 533611 - DNA, 25 bp, Homo sapien
ccccagtctcacctacgaaatatga

SEQ ID NO: 533612 - DNA, 25 bp, Homo sapien
aaaagctgattttgcttacttgcta

SEQ ID NO: 533613 - DNA, 25 bp, Homo sapien
tgcttacttgctaaactgttgggaa

SEQ ID NO: 533614 - DNA, 25 bp, Homo sapien
aactgttgggaaagctctgtagagc

SEQ ID NO: 533615 - DNA, 25 bp, Homo sapien
aagctctgtagagcatggttccagt

SEQ ID NO: 533616 - DNA, 25 bp, Homo sapien
tccagtgaggccaagattgaaattt

SEQ ID NO: 533617 - DNA, 25 bp, Homo sapien
aggccacctagctttttgcagataa

SEQ ID NO: 533618 - DNA, 25 bp, Homo sapien
gaaagctattccaagactcagatga

SEQ ID NO: 533619 - DNA, 25 bp, Homo sapien
gactcagatgatgccagctgtctcc

SEQ ID NO: 533620 - DNA, 25 bp, Homo sapien
tgtctcccacgtgtgtattatggtt

SEQ ID NO: 533621 - DNA, 25 bp, Homo sapien
acgtgtgtattatggttcaccaggg

SEQ ID NO: 533622 - DNA, 25 bp, Homo sapien
aattcgagaccaagagcgcgcgggt

SEQ ID NO: 533623 - DNA, 25 bp, Homo sapien
aagggctcagctttcaccccaaaag

SEQ ID NO: 533624 - DNA, 25 bp, Homo sapien
aaagaccttggatcctgactagttt

SEQ ID NO: 533625 - DNA, 25 bp, Homo sapien
gggtcatccagttatgggactatcg

SEQ ID NO: 533626 - DNA, 25 bp, Homo sapien
gggactatcggatgtgcactctcat

SEQ ID NO: 533627 - DNA, 25 bp, Homo sapien
gtgcactctcattgacaagtttgat

SEQ ID NO: 533628 - DNA, 25 bp, Homo sapien
tggtccagtgcgaggcattgacttc

SEQ ID NO: 533629 - DNA, 25 bp, Homo sapien
attgacttccataagcagcagccac

SEQ ID NO: 533630 - DNA, 25 bp, Homo sapien
agccactgttcgtctctggaggaga

SEQ ID NO: 533631 - DNA, 25 bp, Homo sapien
ggaattacaagcttcggcgctgtct

SEQ ID NO: 533632 - DNA, 25 bp, Homo sapien
gctgtcttttcacattgcttgggca

SEQ ID NO: 533633 - DNA, 25 bp, Homo sapien
gatgcatttctaatcaccgtgatac

SEQ ID NO: 533634 - DNA, 25 bp, Homo sapien
gtgatacgtcgatcccttaattgtt

SEQ ID NO: 533635 - DNA, 25 bp, Homo sapien
attatcaatccactgcaggactgtg

SEQ ID NO: 533636 - DNA, 25 bp, Homo sapien
aacgggagcctctgtaacaatctca

SEQ ID NO: 533637 - DNA, 25 bp, Homo sapien
tcaaggcatttgtgtcatcacctaa

SEQ ID NO: 533638 - DNA, 25 bp, Homo sapien
gtcatcacctaagacgattggcgaa

SEQ ID NO: 533639 - DNA, 25 bp, Homo sapien
tgtgaattacttcgttcctccagga

SEQ ID NO: 533640 - DNA, 25 bp, Homo sapien
ccaggattcccgcagtgttgaggaa

SEQ ID NO: 533641 - DNA, 25 bp, Homo sapien
tgaggaattccttactctgtcccta

SEQ ID NO: 533642 - DNA, 25 bp, Homo sapien
tctgtccctaggtctcagtctcgtt

SEQ ID NO: 533643 - DNA, 25 bp, Homo sapien
cagtctcgtttctgagtagcagcaa

SEQ ID NO: 533644 - DNA, 25 bp, Homo sapien
atgctgggcaagagatctgccatcc

SEQ ID NO: 533645 - DNA, 25 bp, Homo sapien
tgctgggcaagagatctgccatcct

SEQ ID NO: 533646 - DNA, 25 bp, Homo sapien
gctgggcaagagatctgccatccta

SEQ ID NO: 533647 - DNA, 25 bp, Homo sapien
ctgggcaagagatctgccatcctaa

SEQ ID NO: 533648 - DNA, 25 bp, Homo sapien
tgggcaagagatctgccatcctaaa

SEQ ID NO: 533649 - DNA, 25 bp, Homo sapien
gggcaagagatctgccatcctaaaa

SEQ ID NO: 533650 - DNA, 25 bp, Homo sapien
ggcaagagatctgccatcctaaaaa

SEQ ID NO: 533651 - DNA, 25 bp, Homo sapien
gcaagagatctgccatcctaaaaat

SEQ ID NO: 533652 - DNA, 25 bp, Homo sapien
caagagatctgccatcctaaaaatg

SEQ ID NO: 533653 - DNA, 25 bp, Homo sapien
gttctctccttcattgtgatgacat

SEQ ID NO: 533654 - DNA, 25 bp, Homo sapien
attgatgagcaggaaggcactattc

SEQ ID NO: 533655 - DNA, 25 bp, Homo sapien
gcactattcagagccttgttttgac

SEQ ID NO: 533656 - DNA, 25 bp, Homo sapien
agagccttgttttgacagccctcat

SEQ ID NO: 533657 - DNA, 25 bp, Homo sapien
gacagccctcatgccttaaggttag

SEQ ID NO: 533658 - DNA, 25 bp, Homo sapien
gaggagtatctgtccatcactaaga

SEQ ID NO: 533659 - DNA, 25 bp, Homo sapien
actaagacaaatctctggagtcctg

SEQ ID NO: 533660 - DNA, 25 bp, Homo sapien
agtcctggcttccagaaacaggatt

SEQ ID NO: 533661 - DNA, 25 bp, Homo sapien
aggattgccaaattgtccctgtggg

SEQ ID NO: 533662 - DNA, 25 bp, Homo sapien
gatattgctatcttcttagtacccg

SEQ ID NO: 533663 - DNA, 25 bp, Homo sapien
tatcttcttagtacccgtaccttag

SEQ ID NO: 533664 - DNA, 25 bp, Homo sapien
aggcaaataaccctcaactgaaaga

SEQ ID NO: 533665 - DNA, 25 bp, Homo sapien
gagggtttacagaatatggaggcca

SEQ ID NO: 533666 - DNA, 25 bp, Homo sapien
attcatgaaccctttcaacatgcct

SEQ ID NO: 533667 - DNA, 25 bp, Homo sapien
caacatgcctaatctgtatcagaag

SEQ ID NO: 533668 - DNA, 25 bp, Homo sapien
gagagtgatcccaggacaaggacac

SEQ ID NO: 533669 - DNA, 25 bp, Homo sapien
aggacactactcagtgatcctacct

SEQ ID NO: 533670 - DNA, 25 bp, Homo sapien
tgatcctacctaccgggagctgata

SEQ ID NO: 533671 - DNA, 25 bp, Homo sapien
agctacgaaacaagccttctgacct

SEQ ID NO: 533672 - DNA, 25 bp, Homo sapien
tctgacctgggcacgaaactacaag

SEQ ID NO: 533673 - DNA, 25 bp, Homo sapien
gcacgaaactacaagatccccggat

SEQ ID NO: 533674 - DNA, 25 bp, Homo sapien
aagatccccggatcatgaccactct

SEQ ID NO: 533675 - DNA, 25 bp, Homo sapien
tatagcaggcttatgtttggtggca

SEQ ID NO: 533676 - DNA, 25 bp, Homo sapien
gtttggtggcattaaattggtttct

SEQ ID NO: 533677 - DNA, 25 bp, Homo sapien
ttggtttctttaaaatgctttggtg

SEQ ID NO: 533678 - DNA, 25 bp, Homo sapien
atgctttggtggcacttttgtaaac

SEQ ID NO: 533679 - DNA, 25 bp, Homo sapien
acagattgcttctagattgttacaa

SEQ ID NO: 533680 - DNA, 25 bp, Homo sapien
gattgttacaaaccaagcctaagac

SEQ ID NO: 533681 - DNA, 25 bp, Homo sapien
ccaagcctaagacacatctgtgaat

SEQ ID NO: 533682 - DNA, 25 bp, Homo sapien
agatttgtagcttaatcacattcta

SEQ ID NO: 533683 - DNA, 25 bp, Homo sapien
cacattctagacttgtgagttgaat

SEQ ID NO: 533684 - DNA, 25 bp, Homo sapien
tggttttaaaatctggtaactccat

SEQ ID NO: 533685 - DNA, 25 bp, Homo sapien
aaatctggtaactccatgatgaaaa

SEQ ID NO: 533686 - DNA, 25 bp, Homo sapien
aaaaagaatccaatactgcccaagg

SEQ ID NO: 533687 - DNA, 25 bp, Homo sapien
actgcccaaggataggtattttata

SEQ ID NO: 533688 - DNA, 25 bp, Homo sapien
tattttatagatgggcaactggctg

SEQ ID NO: 533689 - DNA, 25 bp, Homo sapien
gaaaggttaattctctagggctagt

SEQ ID NO: 533690 - DNA, 25 bp, Homo sapien
tagggctagtagaactggatcccaa

SEQ ID NO: 533691 - DNA, 25 bp, Homo sapien
gatcccaacaccaaactcttaatta

SEQ ID NO: 533692 - DNA, 25 bp, Homo sapien
taattagacctaggcctcagctgca

SEQ ID NO: 533693 - DNA, 25 bp, Homo sapien
gctgcactgcccgaaaagcatttgg

SEQ ID NO: 533694 - DNA, 25 bp, Homo sapien
ccgaaaagcatttgggcagaccctg

SEQ ID NO: 533695 - DNA, 25 bp, Homo sapien
ttgggcagaccctgagcagaatact

SEQ ID NO: 533696 - DNA, 25 bp, Homo sapien
gcagaatactggtctcaggccaagc

SEQ ID NO: 533697 - DNA, 25 bp, Homo sapien
gaccaagagaacatatcgtggacct

SEQ ID NO: 533698 - DNA, 25 bp, Homo sapien
ctgacagtcagcagtatagggacct

SEQ ID NO: 533699 - DNA, 25 bp, Homo sapien
agcagtatagggaccttccgcacaa

SEQ ID NO: 533700 - DNA, 25 bp, Homo sapien
ttccgcacaagctctgtgttaagat

SEQ ID NO: 533701 - DNA, 25 bp, Homo sapien
gtcttttctaagagtcaaccacagg

SEQ ID NO: 533702 - DNA, 25 bp, Homo sapien
caggcatttaagtcagccaaagaat

SEQ ID NO: 533703 - DNA, 25 bp, Homo sapien
tgttaccttaaagcactattttatt

SEQ ID NO: 533704 - DNA, 25 bp, Homo sapien
gatatatctagtgcatctacatctc

SEQ ID NO: 533705 - DNA, 25 bp, Homo sapien
ctacatctctatactgtacactcac

SEQ ID NO: 533706 - DNA, 25 bp, Homo sapien
ctctatactgtacactcacccataa

SEQ ID NO: 533707 - DNA, 25 bp, Homo sapien
tacaccatggtataaagtgggcatt

SEQ ID NO: 533708 - DNA, 25 bp, Homo sapien
ggcaagccaaaattccttccggata

SEQ ID NO: 533709 - DNA, 25 bp, Homo sapien
agccaaaattccttccggatagaat

SEQ ID NO: 533710 - DNA, 25 bp, Homo sapien
ttccttccggatagaatatgatacc

SEQ ID NO: 533711 - DNA, 25 bp, Homo sapien
gaatatgatacctttggtgaactaa

SEQ ID NO: 533712 - DNA, 25 bp, Homo sapien
ggtgaactaaaggtgccaaatgata

SEQ ID NO: 533713 - DNA, 25 bp, Homo sapien
aaatgataagtattatggcgcccag

SEQ ID NO: 533714 - DNA, 25 bp, Homo sapien
gataagtattatggcgcccagaccg

SEQ ID NO: 533715 - DNA, 25 bp, Homo sapien
tattatggcgcccagaccgtgagat

SEQ ID NO: 533716 - DNA, 25 bp, Homo sapien
tatggcgcccagaccgtgagatcta

SEQ ID NO: 533717 - DNA, 25 bp, Homo sapien
gcccagaccgtgagatctacgatga

SEQ ID NO: 533718 - DNA, 25 bp, Homo sapien
gatctacgatgaactttaagattgg

SEQ ID NO: 533719 - DNA, 25 bp, Homo sapien
gtgctaatatggttctgtgttttgc

SEQ ID NO: 533720 - DNA, 25 bp, Homo sapien
ctgtgttttgcctgaaacgatacca

SEQ ID NO: 533721 - DNA, 25 bp, Homo sapien
aacgataccaggttcccctgaatag

SEQ ID NO: 533722 - DNA, 25 bp, Homo sapien
gcaactttacaaggtccatgtggga

SEQ ID NO: 533723 - DNA, 25 bp, Homo sapien
aacccagatgccctgctgagtgtcc

SEQ ID NO: 533724 - DNA, 25 bp, Homo sapien
tgtccctgaaaccatggcagctcca

SEQ ID NO: 533725 - DNA, 25 bp, Homo sapien
ggcagctccatctgtcaagatggca

SEQ ID NO: 533726 - DNA, 25 bp, Homo sapien
taacagcaggcatctgggcaggcca

SEQ ID NO: 533727 - DNA, 25 bp, Homo sapien
gggcaggccagtcctcaaagcagct

SEQ ID NO: 533728 - DNA, 25 bp, Homo sapien
accagtctcaagctatgcctctaat

SEQ ID NO: 533729 - DNA, 25 bp, Homo sapien
gctatgcctctaatttcaccaggga

SEQ ID NO: 533730 - DNA, 25 bp, Homo sapien
aaagcttttgcttgtatggatacag

SEQ ID NO: 533731 - DNA, 25 bp, Homo sapien
atgtctctgaacaaagcaacaattt

SEQ ID NO: 533732 - DNA, 25 bp, Homo sapien
taaagcaacgacattttctgtcctt

SEQ ID NO: 533733 - DNA, 25 bp, Homo sapien
ggtgtgttttcaaaggcagaagtct

SEQ ID NO: 533734 - DNA, 25 bp, Homo sapien
ggcagaagtctgcattttgagcaaa

SEQ ID NO: 533735 - DNA, 25 bp, Homo sapien
ttgagcaaaaggtggcttcccagct

SEQ ID NO: 533736 - DNA, 25 bp, Homo sapien
tggcttcccagctctaacaaggtaa

SEQ ID NO: 533737 - DNA, 25 bp, Homo sapien
aggtaactggttagcatgacattaa

SEQ ID NO: 533738 - DNA, 25 bp, Homo sapien
catgacattaaagcttgggcaaggc

SEQ ID NO: 533739 - DNA, 25 bp, Homo sapien
accaaaagcctgctgagttgattac

SEQ ID NO: 533740 - DNA, 25 bp, Homo sapien
tacagctgggccaatacagtacgag

SEQ ID NO: 533741 - DNA, 25 bp, Homo sapien
ttttcaagtattcctattgtactgg

SEQ ID NO: 533742 - DNA, 25 bp, Homo sapien
agtattcctattgtactggagaagc

SEQ ID NO: 533743 - DNA, 25 bp, Homo sapien
gaagctgggaaggagattgttaact

SEQ ID NO: 533744 - DNA, 25 bp, Homo sapien
aggagattgttaactctgaggagtg

SEQ ID NO: 533745 - DNA, 25 bp, Homo sapien
gtgaaaaaacctcaaaccctcatgg

SEQ ID NO: 533746 - DNA, 25 bp, Homo sapien
aaaaacctcaaaccctcatggagct

SEQ ID NO: 533747 - DNA, 25 bp, Homo sapien
ccctcatggagctgcatcaagaaaa

SEQ ID NO: 533748 - DNA, 25 bp, Homo sapien
gaagaagcatcgaaagagcagttca

SEQ ID NO: 533749 - DNA, 25 bp, Homo sapien
agagcagttcagatagtgatgatga

SEQ ID NO: 533750 - DNA, 25 bp, Homo sapien
gcccgccttcttcatgtcaaggaga

SEQ ID NO: 533751 - DNA, 25 bp, Homo sapien
caaggagaccatgcagattgatgag

SEQ ID NO: 533752 - DNA, 25 bp, Homo sapien
cttctctagaaattgctaactttag

SEQ ID NO: 533753 - DNA, 25 bp, Homo sapien
tagaaattgctaactttaggtccat

SEQ ID NO: 533754 - DNA, 25 bp, Homo sapien
gaaattgctaactttaggtccattt

SEQ ID NO: 533755 - DNA, 25 bp, Homo sapien
ccattttactgtgaatgaggaatag

SEQ ID NO: 533756 - DNA, 25 bp, Homo sapien
ggaataggagtgagttttagaataa

SEQ ID NO: 533757 - DNA, 25 bp, Homo sapien
ccagatgatttgattaaaaccttaa

SEQ ID NO: 533758 - DNA, 25 bp, Homo sapien
aaaaccttaatcatacattgacata

SEQ ID NO: 533759 - DNA, 25 bp, Homo sapien
tacattgacataattcattgcttct

SEQ ID NO: 533760 - DNA, 25 bp, Homo sapien
cattgacataattcattgcttcttt

SEQ ID NO: 533761 - DNA, 25 bp, Homo sapien
tgacataattcattgcttctttttt

SEQ ID NO: 533762 - DNA, 25 bp, Homo sapien
cataattcattgcttctttttttga

SEQ ID NO: 533763 - DNA, 25 bp, Homo sapien
cagctcacactaatagatgattctt

SEQ ID NO: 533764 - DNA, 25 bp, Homo sapien
agatgattcttaattgccaaatgtg

SEQ ID NO: 533765 - DNA, 25 bp, Homo sapien
gagtttgtatatcctactcctgggc

SEQ ID NO: 533766 - DNA, 25 bp, Homo sapien
ttgtatatcctactcctgggcctta

SEQ ID NO: 533767 - DNA, 25 bp, Homo sapien
tgggccttacatgtcgcctgttggg

SEQ ID NO: 533768 - DNA, 25 bp, Homo sapien
aagaccaggttgataagtaggaact

SEQ ID NO: 533769 - DNA, 25 bp, Homo sapien
gtaggaactgaaagtcttccagatt

SEQ ID NO: 533770 - DNA, 25 bp, Homo sapien
gaaagtcttccagattcacagtaga

SEQ ID NO: 533771 - DNA, 25 bp, Homo sapien
gttactgtaaataccttgtacctgt

SEQ ID NO: 533772 - DNA, 25 bp, Homo sapien
aataccttgtacctgttcatggatt

SEQ ID NO: 533773 - DNA, 25 bp, Homo sapien
ccttgtacctgttcatggattattt

SEQ ID NO: 533774 - DNA, 25 bp, Homo sapien
ggtacccaaaagatacaagtcagag

SEQ ID NO: 533775 - DNA, 25 bp, Homo sapien
gtcagagacaacatccttgtccata

SEQ ID NO: 533776 - DNA, 25 bp, Homo sapien
ttgtccatatccaaacccagtgttt

SEQ ID NO: 533777 - DNA, 25 bp, Homo sapien
aaacccagtgtttcagtgctagcaa

SEQ ID NO: 533778 - DNA, 25 bp, Homo sapien
gtgtttcagtgctagcaacttaatt

SEQ ID NO: 533779 - DNA, 25 bp, Homo sapien
gtttggtttgctttgctagttgtgt

SEQ ID NO: 533780 - DNA, 25 bp, Homo sapien
ttgtgtgaatcattgggctgttttt

SEQ ID NO: 533781 - DNA, 25 bp, Homo sapien
gctgtttttagagccactgttaaga

SEQ ID NO: 533782 - DNA, 25 bp, Homo sapien
tgacaattactactgtttccacatt

SEQ ID NO: 533783 - DNA, 25 bp, Homo sapien
aattgtgtacttaaatgaacctcat

SEQ ID NO: 533784 - DNA, 25 bp, Homo sapien
tttatttctgaatggcttgtctgag

SEQ ID NO: 533785 - DNA, 25 bp, Homo sapien
ccacatgtggctgctcgtatttaag

SEQ ID NO: 533786 - DNA, 25 bp, Homo sapien
cacatgtggctgctcgtatttaagt

SEQ ID NO: 533787 - DNA, 25 bp, Homo sapien
acatgtggctgctcgtatttaagtt

SEQ ID NO: 533788 - DNA, 25 bp, Homo sapien
catgtggctgctcgtatttaagtta

SEQ ID NO: 533789 - DNA, 25 bp, Homo sapien
atgtggctgctcgtatttaagttaa

SEQ ID NO: 533790 - DNA, 25 bp, Homo sapien
tgtggctgctcgtatttaagttaat

SEQ ID NO: 533791 - DNA, 25 bp, Homo sapien
gtggctgctcgtatttaagttaatt

SEQ ID NO: 533792 - DNA, 25 bp, Homo sapien
tggctgctcgtatttaagttaatta

SEQ ID NO: 533793 - DNA, 25 bp, Homo sapien
ggctgctcgtatttaagttaattaa

SEQ ID NO: 533794 - DNA, 25 bp, Homo sapien
aaagcagacctgaaaattgggacct

SEQ ID NO: 533795 - DNA, 25 bp, Homo sapien
gacctgggagaaatagacgagtgct

SEQ ID NO: 533796 - DNA, 25 bp, Homo sapien
gacgagtgctctaaaccagtatcat

SEQ ID NO: 533797 - DNA, 25 bp, Homo sapien
aaaccagtatcatggctccagttcc

SEQ ID NO: 533798 - DNA, 25 bp, Homo sapien
ctccagttcctctgacaaggattca

SEQ ID NO: 533799 - DNA, 25 bp, Homo sapien
atgctggttccaggtccctcaggaa

SEQ ID NO: 533800 - DNA, 25 bp, Homo sapien
tggtctgcccttgaactctatactg

SEQ ID NO: 533801 - DNA, 25 bp, Homo sapien
ttgaactctatactggccccagggt

SEQ ID NO: 533802 - DNA, 25 bp, Homo sapien
tggccccagggtatcccaggattgt

SEQ ID NO: 533803 - DNA, 25 bp, Homo sapien
gtatcccaggattgtcagaaaggcc

SEQ ID NO: 533804 - DNA, 25 bp, Homo sapien
gagggatcagcatctctgcaaagtt

SEQ ID NO: 533805 - DNA, 25 bp, Homo sapien
tggccaacacgcctcatctgaggga

SEQ ID NO: 533806 - DNA, 25 bp, Homo sapien
atctgagggagcttcacttggacaa

SEQ ID NO: 533807 - DNA, 25 bp, Homo sapien
tcctccttcccttacggaattacat

SEQ ID NO: 533808 - DNA, 25 bp, Homo sapien
tcccttacggaattacatcttgatg

SEQ ID NO: 533809 - DNA, 25 bp, Homo sapien
cggaattacatcttgatggcaacaa

SEQ ID NO: 533810 - DNA, 25 bp, Homo sapien
tgatggcaacaaaatcagcagagtt

SEQ ID NO: 533811 - DNA, 25 bp, Homo sapien
tcagcagagttgatgcagctagcct

SEQ ID NO: 533812 - DNA, 25 bp, Homo sapien
ttgatgcagctagcctgaaaggact

SEQ ID NO: 533813 - DNA, 25 bp, Homo sapien
tgcagctagcctgaaaggactgaat

SEQ ID NO: 533814 - DNA, 25 bp, Homo sapien
agttgggattgagtttcaacagcat

SEQ ID NO: 533815 - DNA, 25 bp, Homo sapien
tctgctgttgacaatggctctctgg

SEQ ID NO: 533816 - DNA, 25 bp, Homo sapien
aggaccttgcagctctgacctctga

SEQ ID NO: 533817 - DNA, 25 bp, Homo sapien
tgacctctgagggttcctgggctca

SEQ ID NO: 533818 - DNA, 25 bp, Homo sapien
atgcatttagcattgaacacgcctt

SEQ ID NO: 533819 - DNA, 25 bp, Homo sapien
attgaacacgccttgaatcctgaca

SEQ ID NO: 533820 - DNA, 25 bp, Homo sapien
gaatcctgacaccaaccctgtgatg

SEQ ID NO: 533821 - DNA, 25 bp, Homo sapien
tgtgatgccatgctactctgatttt

SEQ ID NO: 533822 - DNA, 25 bp, Homo sapien
gattttaagtcctgccagtcagtgt

SEQ ID NO: 533823 - DNA, 25 bp, Homo sapien
gggaaccacaatttgaacgcaggct

SEQ ID NO: 533824 - DNA, 25 bp, Homo sapien
gaacgcaggctatattggatcaaag

SEQ ID NO: 533825 - DNA, 25 bp, Homo sapien
tgttctgtcacagcctttgtatgtc

SEQ ID NO: 533826 - DNA, 25 bp, Homo sapien
atgtctgtcctacctaccagggatt

SEQ ID NO: 533827 - DNA, 25 bp, Homo sapien
agcagcattcacccgtgtctgttca

SEQ ID NO: 533828 - DNA, 25 bp, Homo sapien
accaaagtccacaatttgtcaaggt

SEQ ID NO: 533829 - DNA, 25 bp, Homo sapien
gctctggttcctctttaagtggtaa

SEQ ID NO: 533830 - DNA, 25 bp, Homo sapien
gttcctctttaagtggtaatgcttc

SEQ ID NO: 533831 - DNA, 25 bp, Homo sapien
gtaatgcttcataccaactttccca

SEQ ID NO: 533832 - DNA, 25 bp, Homo sapien
gcttcataccaactttcccaaagta

SEQ ID NO: 533833 - DNA, 25 bp, Homo sapien
tggtatttgtcgaagttgatccggt

SEQ ID NO: 533834 - DNA, 25 bp, Homo sapien
gttgatccggtggtgatgcagacca

SEQ ID NO: 533835 - DNA, 25 bp, Homo sapien
atgcagaccaccagcattaccgcgg

SEQ ID NO: 533836 - DNA, 25 bp, Homo sapien
taagtttccgggtcttcctcagtct

SEQ ID NO: 533837 - DNA, 25 bp, Homo sapien
tcttcctcagtctggatggcatgtt

SEQ ID NO: 533838 - DNA, 25 bp, Homo sapien
ctgtgctccctgaagtggctttgac

SEQ ID NO: 533839 - DNA, 25 bp, Homo sapien
tgctccctgaagtggctttgacgtg

SEQ ID NO: 533840 - DNA, 25 bp, Homo sapien
caccattgactctccccggtagtgg

SEQ ID NO: 533841 - DNA, 25 bp, Homo sapien
ctccccggtagtggctgctgtggct

SEQ ID NO: 533842 - DNA, 25 bp, Homo sapien
tgttgcaccagccacagctcctagt

SEQ ID NO: 533843 - DNA, 25 bp, Homo sapien
acagctcctagtggctcatgggtgc

SEQ ID NO: 533844 - DNA, 25 bp, Homo sapien
ggcctgccataataactggcccagg

SEQ ID NO: 533845 - DNA, 25 bp, Homo sapien
tggcccaggtaccaatgcccaggtt

SEQ ID NO: 533846 - DNA, 25 bp, Homo sapien
gcacttctgtgctgcttgcagtcat

SEQ ID NO: 533847 - DNA, 25 bp, Homo sapien
gtgctgcttgcagtcatagctttcc

SEQ ID NO: 533848 - DNA, 25 bp, Homo sapien
ttgcagtcatagctttccttgtccc

SEQ ID NO: 533849 - DNA, 25 bp, Homo sapien
gtcaccccagcaaccctaaaagaga

SEQ ID NO: 533850 - DNA, 25 bp, Homo sapien
attttgtacattctgtatcccacag

SEQ ID NO: 533851 - DNA, 25 bp, Homo sapien
ccacagatttggtcagccatttcaa

SEQ ID NO: 533852 - DNA, 25 bp, Homo sapien
agccatttcaaaattccctccagtt

SEQ ID NO: 533853 - DNA, 25 bp, Homo sapien
aatctgtcttcggtttcagctggat

SEQ ID NO: 533854 - DNA, 25 bp, Homo sapien
tcagctggatgatgaatccttgttt

SEQ ID NO: 533855 - DNA, 25 bp, Homo sapien
ttgtttttcaggtggctccaaaaag

SEQ ID NO: 533856 - DNA, 25 bp, Homo sapien
tgttgcatgtgttcagaccatcctg

SEQ ID NO: 533857 - DNA, 25 bp, Homo sapien
gttcagaccatcctgagcagagcca

SEQ ID NO: 533858 - DNA, 25 bp, Homo sapien
gagcagagccaccaaatttagtgac

SEQ ID NO: 533859 - DNA, 25 bp, Homo sapien
gtgacagtgtctagccatgttagca

SEQ ID NO: 533860 - DNA, 25 bp, Homo sapien
ttccttcttaactcaagacttgtag

SEQ ID NO: 533861 - DNA, 25 bp, Homo sapien
tgtagtgttgtaaacctgcctcaca

SEQ ID NO: 533862 - DNA, 25 bp, Homo sapien
aagacagcctttacaccatttctag

SEQ ID NO: 533863 - DNA, 25 bp, Homo sapien
ttacaccatttctagtggcacacta

SEQ ID NO: 533864 - DNA, 25 bp, Homo sapien
gtggcacactattttggcaatgtta

SEQ ID NO: 533865 - DNA, 25 bp, Homo sapien
ggcaatgttatgcaccacttcaatt

SEQ ID NO: 533866 - DNA, 25 bp, Homo sapien
caccacttcaatttccccattgtga

SEQ ID NO: 533867 - DNA, 25 bp, Homo sapien
cattgtgacccctatcacttcattt

SEQ ID NO: 533868 - DNA, 25 bp, Homo sapien
ttgatatccctttttgacccaccca

SEQ ID NO: 533869 - DNA, 25 bp, Homo sapien
catctccttcatatatgggcatgtc

SEQ ID NO: 533870 - DNA, 25 bp, Homo sapien
atgggcatgtccatagattgacaaa

SEQ ID NO: 533871 - DNA, 25 bp, Homo sapien
ataacttgaatgttgttcctataaa

SEQ ID NO: 533872 - DNA, 25 bp, Homo sapien
gatcataactcatgatatgtttgta

SEQ ID NO: 533873 - DNA, 25 bp, Homo sapien
gagtatctggaaatattgtagcaat

SEQ ID NO: 533874 - DNA, 25 bp, Homo sapien
atattgtagcaatacttggtttaaa

SEQ ID NO: 533875 - DNA, 25 bp, Homo sapien
taaaattttggacctgagacactgt

SEQ ID NO: 533876 - DNA, 25 bp, Homo sapien
ctgagacactgtggctgtctaatgt

SEQ ID NO: 533877 - DNA, 25 bp, Homo sapien
tgtggctgtctaatgtaatccttta

SEQ ID NO: 533878 - DNA, 25 bp, Homo sapien
ggctgtctaatgtaatcctttaaaa

SEQ ID NO: 533879 - DNA, 25 bp, Homo sapien
aattctctgcattgtcagtaaatgt

SEQ ID NO: 533880 - DNA, 25 bp, Homo sapien
gtatattattgtacagctactcata

SEQ ID NO: 533881 - DNA, 25 bp, Homo sapien
tgtacagctactcataattttttaa

SEQ ID NO: 533882 - DNA, 25 bp, Homo sapien
tggctccggggagacgttcagctac

SEQ ID NO: 533883 - DNA, 25 bp, Homo sapien
ggctccggggagacgttcagctacc

SEQ ID NO: 533884 - DNA, 25 bp, Homo sapien
tccggggagacgttcagctaccctg

SEQ ID NO: 533885 - DNA, 25 bp, Homo sapien
cggggagacgttcagctaccctgac

SEQ ID NO: 533886 - DNA, 25 bp, Homo sapien
ggggagacgttcagctaccctgact

SEQ ID NO: 533887 - DNA, 25 bp, Homo sapien
tttctcaggatgatgctgggcaaga

SEQ ID NO: 533888 - DNA, 25 bp, Homo sapien
ttctcaggatgatgctgggcaagag

SEQ ID NO: 533889 - DNA, 25 bp, Homo sapien
tctcaggatgatgctgggcaagaga

SEQ ID NO: 533890 - DNA, 25 bp, Homo sapien
atcctgatgtatgaggaaaaagcga

SEQ ID NO: 533891 - DNA, 25 bp, Homo sapien
gatgtatgaggaaaaagcgagagaa

SEQ ID NO: 533892 - DNA, 25 bp, Homo sapien
ccaacaggccccccagccaagaaag

SEQ ID NO: 533893 - DNA, 25 bp, Homo sapien
gggtatctgcatgaaggctcctgtc

SEQ ID NO: 533894 - DNA, 25 bp, Homo sapien
gaaggctcctgtctgactattccag

SEQ ID NO: 533895 - DNA, 25 bp, Homo sapien
ggatccaatattactgccttctgaa

SEQ ID NO: 533896 - DNA, 25 bp, Homo sapien
gccttctgaaacttcctctttaggg

SEQ ID NO: 533897 - DNA, 25 bp, Homo sapien
gtaaccatcatgtatgcccacgagg

SEQ ID NO: 533898 - DNA, 25 bp, Homo sapien
aagttgcttagagtacttctttgac

SEQ ID NO: 533899 - DNA, 25 bp, Homo sapien
acagacaccctaccgatagaacagt

SEQ ID NO: 533900 - DNA, 25 bp, Homo sapien
agatcttacttgctcctgcttacga

SEQ ID NO: 533901 - DNA, 25 bp, Homo sapien
gctcctgcttacgaagtattcccaa

SEQ ID NO: 533902 - DNA, 25 bp, Homo sapien
gtattcccaatcactggtcatctga

SEQ ID NO: 533903 - DNA, 25 bp, Homo sapien
ggtcatctgaccctacttgaacact

SEQ ID NO: 533904 - DNA, 25 bp, Homo sapien
gtacttttcttacttctaatatcca

SEQ ID NO: 533905 - DNA, 25 bp, Homo sapien
ccatccctggactttttgtattcca

SEQ ID NO: 533906 - DNA, 25 bp, Homo sapien
tccctggactttttgtattccaaat

SEQ ID NO: 533907 - DNA, 25 bp, Homo sapien
ggactttttgtattccaaatgtttg

SEQ ID NO: 533908 - DNA, 25 bp, Homo sapien
tccaaatgtttgtgatgctgagaag

SEQ ID NO: 533909 - DNA, 25 bp, Homo sapien
gatgctgagaagtgaagttcatttt

SEQ ID NO: 533910 - DNA, 25 bp, Homo sapien
cattttatgtgatcttcatgcgtcg

SEQ ID NO: 533911 - DNA, 25 bp, Homo sapien
atgtgatcttcatgcgtcgtaatct

SEQ ID NO: 533912 - DNA, 25 bp, Homo sapien
gatcttcatgcgtcgtaatctactt

SEQ ID NO: 533913 - DNA, 25 bp, Homo sapien
tcatgcgtcgtaatctacttttggt

SEQ ID NO: 533914 - DNA, 25 bp, Homo sapien
gattattaaaccctcatttaaatgt

SEQ ID NO: 533915 - DNA, 25 bp, Homo sapien
gcattggcgagaaatgatcgttgac

SEQ ID NO: 533916 - DNA, 25 bp, Homo sapien
agaaatgatcgttgacatgtctgtc

SEQ ID NO: 533917 - DNA, 25 bp, Homo sapien
cgtgtgtgatgctagggtagaatcc

SEQ ID NO: 533918 - DNA, 25 bp, Homo sapien
gatgctagggtagaatccgatgtat

SEQ ID NO: 533919 - DNA, 25 bp, Homo sapien
gaatccgatgtatgttggccttctt

SEQ ID NO: 533920 - DNA, 25 bp, Homo sapien
atccgatgtatgttggccttcttac

SEQ ID NO: 533921 - DNA, 25 bp, Homo sapien
ccgatgtatgttggccttcttacga

SEQ ID NO: 533922 - DNA, 25 bp, Homo sapien
atgtatgttggccttcttacgagcc

SEQ ID NO: 533923 - DNA, 25 bp, Homo sapien
gtatgttggccttcttacgagccaa

SEQ ID NO: 533924 - DNA, 25 bp, Homo sapien
atgttggccttcttacgagccaaaa

SEQ ID NO: 533925 - DNA, 25 bp, Homo sapien
ggccttcttacgagccaaaacctgc

SEQ ID NO: 533926 - DNA, 25 bp, Homo sapien
ggagagaccgagtgaacctaccttc

SEQ ID NO: 533927 - DNA, 25 bp, Homo sapien
agtgaacctaccttcatttcaggag

SEQ ID NO: 533928 - DNA, 25 bp, Homo sapien
ttcatttcaggagggattggccgct

SEQ ID NO: 533929 - DNA, 25 bp, Homo sapien
ggattggccgcttggcacatgacaa

SEQ ID NO: 533930 - DNA, 25 bp, Homo sapien
ggccgcttggcacatgacaactttg

SEQ ID NO: 533931 - DNA, 25 bp, Homo sapien
acatgacaactttgccagcttttcc

SEQ ID NO: 533932 - DNA, 25 bp, Homo sapien
tcccttgggttctgatattgccgca

SEQ ID NO: 533933 - DNA, 25 bp, Homo sapien
ttgggttctgatattgccgcactag

SEQ ID NO: 533934 - DNA, 25 bp, Homo sapien
caacctcagacttaccaggaagcag

SEQ ID NO: 533935 - DNA, 25 bp, Homo sapien
tcagacttaccaggaagcagataca

SEQ ID NO: 533936 - DNA, 25 bp, Homo sapien
ttatgtaagagcaccttcctcactt

SEQ ID NO: 533937 - DNA, 25 bp, Homo sapien
atttatctcaaggaaatcccaggga

SEQ ID NO: 533938 - DNA, 25 bp, Homo sapien
aaatcccagggatctgtgtgaagct

SEQ ID NO: 533939 - DNA, 25 bp, Homo sapien
ggatctgtgtgaagctgcacatgct

SEQ ID NO: 533940 - DNA, 25 bp, Homo sapien
tgtgaagctgcacatgctgctgctg

SEQ ID NO: 533941 - DNA, 25 bp, Homo sapien
tgctcagtgcgggactgtttataat

SEQ ID NO: 533942 - DNA, 25 bp, Homo sapien
tgtaactcaaatgtccagaagaact

SEQ ID NO: 533943 - DNA, 25 bp, Homo sapien
agaagaactgtacactctgtgcatg

SEQ ID NO: 533944 - DNA, 25 bp, Homo sapien
gtgcatgttttcagtaagttcatat

SEQ ID NO: 533945 - DNA, 25 bp, Homo sapien
aaagtgggtgtgttgagagacaaat

SEQ ID NO: 533946 - DNA, 25 bp, Homo sapien
gggacactctgtgatgtttttggag

SEQ ID NO: 533947 - DNA, 25 bp, Homo sapien
aatattcagtcttacaattacattt

SEQ ID NO: 533948 - DNA, 25 bp, Homo sapien
gagcgacctgcgagactcacaagag

SEQ ID NO: 533949 - DNA, 25 bp, Homo sapien
tacagacggagtgctgtgccacctg

SEQ ID NO: 533950 - DNA, 25 bp, Homo sapien
gtgccacctggtgccgacaagaaag

SEQ ID NO: 533951 - DNA, 25 bp, Homo sapien
acctggtgccgacaagaaagccgag

SEQ ID NO: 533952 - DNA, 25 bp, Homo sapien
tagaggcggatttggtcgtggacgt

SEQ ID NO: 533953 - DNA, 25 bp, Homo sapien
tggtcgtggacgtggtcagccacct

SEQ ID NO: 533954 - DNA, 25 bp, Homo sapien
cgtggtcagccacctcagtaaaatt

SEQ ID NO: 533955 - DNA, 25 bp, Homo sapien
gtcagccacctcagtaaaattggag

SEQ ID NO: 533956 - DNA, 25 bp, Homo sapien
aaattggagaggattcttttgcatt

SEQ ID NO: 533957 - DNA, 25 bp, Homo sapien
ggagaggattcttttgcattgaata

SEQ ID NO: 533958 - DNA, 25 bp, Homo sapien
attgtgcctgccaccctacgccgta

SEQ ID NO: 533959 - DNA, 25 bp, Homo sapien
gattgaatggctggaaagccaccaa

SEQ ID NO: 533960 - DNA, 25 bp, Homo sapien
gaaagccaccaagatgctgacattg

SEQ ID NO: 533961 - DNA, 25 bp, Homo sapien
ttcaaccaattatcagcaaactcta

SEQ ID NO: 533962 - DNA, 25 bp, Homo sapien
aaactctatggaagtgcaggccctc

SEQ ID NO: 533963 - DNA, 25 bp, Homo sapien
ccccaactggtgaagaggatacagc

SEQ ID NO: 533964 - DNA, 25 bp, Homo sapien
gatgagttgtagacactgatctgct

SEQ ID NO: 533965 - DNA, 25 bp, Homo sapien
actgatctgctagtgctgtaatatt

SEQ ID NO: 533966 - DNA, 25 bp, Homo sapien
ctgctagtgctgtaatattgtaaat

SEQ ID NO: 533967 - DNA, 25 bp, Homo sapien
ttgtaaatactggactcaggaactt

SEQ ID NO: 533968 - DNA, 25 bp, Homo sapien
tggactcaggaacttttgttaggaa

SEQ ID NO: 533969 - DNA, 25 bp, Homo sapien
acctcagagtggagttgaaactgct

SEQ ID NO: 533970 - DNA, 25 bp, Homo sapien
ttattacatctcagaaccagctggg

SEQ ID NO: 533971 - DNA, 25 bp, Homo sapien
aaccagctgggcattaaaggaacag

SEQ ID NO: 533972 - DNA, 25 bp, Homo sapien
aaattacagctgcatattcctacgt

SEQ ID NO: 533973 - DNA, 25 bp, Homo sapien
agctgcatattcctacgttgtctac

SEQ ID NO: 533974 - DNA, 25 bp, Homo sapien
atattcctacgttgtctacctttct

SEQ ID NO: 533975 - DNA, 25 bp, Homo sapien
tgtctacctttcttaaaggccctag

SEQ ID NO: 533976 - DNA, 25 bp, Homo sapien
gagatgtgtaccttttcagaaatga

SEQ ID NO: 533977 - DNA, 25 bp, Homo sapien
gaatttacattgtccaaagagaaca

SEQ ID NO: 533978 - DNA, 25 bp, Homo sapien
aacattatgtcagttatcaacctaa

SEQ ID NO: 533979 - DNA, 25 bp, Homo sapien
gattgaaatgtctgccttatcatta

SEQ ID NO: 533980 - DNA, 25 bp, Homo sapien
gtctgccttatcattacaattgaag

SEQ ID NO: 533981 - DNA, 25 bp, Homo sapien
ttttgagaaagtattctgttgggat

SEQ ID NO: 533982 - DNA, 25 bp, Homo sapien
tgggatctgggcttcctcacttctg

SEQ ID NO: 533983 - DNA, 25 bp, Homo sapien
ggatctgggcttcctcacttctgga

SEQ ID NO: 533984 - DNA, 25 bp, Homo sapien
atctgggcttcctcacttctggaga

SEQ ID NO: 533985 - DNA, 25 bp, Homo sapien
ttctggagaagtggccatcccatgc

SEQ ID NO: 533986 - DNA, 25 bp, Homo sapien
atgcccacctgtgccatggaggagt

SEQ ID NO: 533987 - DNA, 25 bp, Homo sapien
acctgtgccatggaggagtgggccc

SEQ ID NO: 533988 - DNA, 25 bp, Homo sapien
ccccgagagcatcgctatgatctaa

SEQ ID NO: 533989 - DNA, 25 bp, Homo sapien
gagagcatcgctatgatctaaggtc

SEQ ID NO: 533990 - DNA, 25 bp, Homo sapien
gagcatcgctatgatctaaggtctg

SEQ ID NO: 533991 - DNA, 25 bp, Homo sapien
gcatcgctatgatctaaggtctggg

SEQ ID NO: 533992 - DNA, 25 bp, Homo sapien
ggacaaggtgtgagcctgagccctc

SEQ ID NO: 533993 - DNA, 25 bp, Homo sapien
aaggtgtgagcctgagccctcccgc

SEQ ID NO: 533994 - DNA, 25 bp, Homo sapien
tccaagccgtgttcgaggccctgct

SEQ ID NO: 533995 - DNA, 25 bp, Homo sapien
tgctcacccagtttgaccgactcaa

SEQ ID NO: 533996 - DNA, 25 bp, Homo sapien
cagtttgaccgactcaaccaggcca

SEQ ID NO: 533997 - DNA, 25 bp, Homo sapien
ttgaccgactcaaccaggccacaga

SEQ ID NO: 533998 - DNA, 25 bp, Homo sapien
gaccgactcaaccaggccacagagg

SEQ ID NO: 533999 - DNA, 25 bp, Homo sapien
tcaaccaggccacagaggacgtcta

SEQ ID NO: 534000 - DNA, 25 bp, Homo sapien
aggccacagaggacgtctaccagct

SEQ ID NO: 534001 - DNA, 25 bp, Homo sapien
cacagaggacgtctaccagctggag

SEQ ID NO: 534002 - DNA, 25 bp, Homo sapien
cagaggacgtctaccagctggagca

SEQ ID NO: 534003 - DNA, 25 bp, Homo sapien
attcatctgcggagccaaaacccag

SEQ ID NO: 534004 - DNA, 25 bp, Homo sapien
cagggcttctgtggaacttggaacg

SEQ ID NO: 534005 - DNA, 25 bp, Homo sapien
ggaacttggaacgtgccaggaccac

SEQ ID NO: 534006 - DNA, 25 bp, Homo sapien
tcagatcattgattgggcctccact

SEQ ID NO: 534007 - DNA, 25 bp, Homo sapien
ttgggcctccacttgggtatgtgaa

SEQ ID NO: 534008 - DNA, 25 bp, Homo sapien
aagtgctctggttctgagatgagta

SEQ ID NO: 534009 - DNA, 25 bp, Homo sapien
gtattttattcgtgttctgtttccg

SEQ ID NO: 534010 - DNA, 25 bp, Homo sapien
tctgtttccgaaacacttagcaaag

SEQ ID NO: 534011 - DNA, 25 bp, Homo sapien
tcacagtgatgtggagtcgccgcac

SEQ ID NO: 534012 - DNA, 25 bp, Homo sapien
tcgccgcacccatctttgaagatag

SEQ ID NO: 534013 - DNA, 25 bp, Homo sapien
tctttgaagatagccagtgtccctg

SEQ ID NO: 534014 - DNA, 25 bp, Homo sapien
ttctaagccagctggtaccaccaag

SEQ ID NO: 534015 - DNA, 25 bp, Homo sapien
gctggtaccaccaagaattcttcaa

SEQ ID NO: 534016 - DNA, 25 bp, Homo sapien
ttcaaataagccagctgtcaccacc

SEQ ID NO: 534017 - DNA, 25 bp, Homo sapien
gtcaccaccaagtcacctgcagtga

SEQ ID NO: 534018 - DNA, 25 bp, Homo sapien
aagtcacctgcagtgaagccagctg

SEQ ID NO: 534019 - DNA, 25 bp, Homo sapien
caagcaacctgtgggcggtggccag

SEQ ID NO: 534020 - DNA, 25 bp, Homo sapien
tggccagaagcttctgacgagaaag

SEQ ID NO: 534021 - DNA, 25 bp, Homo sapien
tgacgagaaaggctgacagcagctc

SEQ ID NO: 534022 - DNA, 25 bp, Homo sapien
aagacaaagaagatggtggccacca

SEQ ID NO: 534023 - DNA, 25 bp, Homo sapien
atggtggccaccactaagcccaagg

SEQ ID NO: 534024 - DNA, 25 bp, Homo sapien
gccaagcaggctcctcagggtagta

SEQ ID NO: 534025 - DNA, 25 bp, Homo sapien
gatacatattagttacttgtgcttt

SEQ ID NO: 534026 - DNA, 25 bp, Homo sapien
ttgcaagggcaaaactacaagtaac

SEQ ID NO: 534027 - DNA, 25 bp, Homo sapien
gttacaggttttcatgttcaggata

SEQ ID NO: 534028 - DNA, 25 bp, Homo sapien
ggataaaccatacttccaccttggg

SEQ ID NO: 534029 - DNA, 25 bp, Homo sapien
aaaccatacttccaccttgggtgag

SEQ ID NO: 534030 - DNA, 25 bp, Homo sapien
tccaccttgggtgagaacacttgca

SEQ ID NO: 534031 - DNA, 25 bp, Homo sapien
gtgagaacacttgcaacagtttatt

SEQ ID NO: 534032 - DNA, 25 bp, Homo sapien
ggtgactttcaccttaggacaactg

SEQ ID NO: 534033 - DNA, 25 bp, Homo sapien
aggacaactgttgcatgccaagttt

SEQ ID NO: 534034 - DNA, 25 bp, Homo sapien
ctgttgcatgccaagttttttgtgt

SEQ ID NO: 534035 - DNA, 25 bp, Homo sapien
ttggttgtatctaatatgccccagg

SEQ ID NO: 534036 - DNA, 25 bp, Homo sapien
gtttgcaaaacccagtggactgggc

SEQ ID NO: 534037 - DNA, 25 bp, Homo sapien
tgtctgagcagctcctggctccggt

SEQ ID NO: 534038 - DNA, 25 bp, Homo sapien
tggctccggtgggaactgcacacaa

SEQ ID NO: 534039 - DNA, 25 bp, Homo sapien
tgggaactgcacacaagtccactgg

SEQ ID NO: 534040 - DNA, 25 bp, Homo sapien
acacaagtccactggcctggcttgg

SEQ ID NO: 534041 - DNA, 25 bp, Homo sapien
aggcattgcaattgacagacatttg

SEQ ID NO: 534042 - DNA, 25 bp, Homo sapien
cagacatttgcatttcatacggtaa

SEQ ID NO: 534043 - DNA, 25 bp, Homo sapien
aaatgaggactcagcacagccaacc

SEQ ID NO: 534044 - DNA, 25 bp, Homo sapien
caaccataatcagcatgtctgggat

SEQ ID NO: 534045 - DNA, 25 bp, Homo sapien
gcatgtctgggatagactggtctag

SEQ ID NO: 534046 - DNA, 25 bp, Homo sapien
gaagtttccattgctttgtttgctt

SEQ ID NO: 534047 - DNA, 25 bp, Homo sapien
gatttctcaagcagtctcaactcca

SEQ ID NO: 534048 - DNA, 25 bp, Homo sapien
tcacccttactattgctcttgcttt

SEQ ID NO: 534049 - DNA, 25 bp, Homo sapien
cttctcactagtaaaactgccttcc

SEQ ID NO: 534050 - DNA, 25 bp, Homo sapien
tcactagtaaaactgccttcccttt

SEQ ID NO: 534051 - DNA, 25 bp, Homo sapien
ggtacagttgtaagtcagagttaat

SEQ ID NO: 534052 - DNA, 25 bp, Homo sapien
agagttaatataatagggcctgtga

SEQ ID NO: 534053 - DNA, 25 bp, Homo sapien
tagggcctgtgaaaacagaggcttt

SEQ ID NO: 534054 - DNA, 25 bp, Homo sapien
ttgcattgtctcttgacatcagaag

SEQ ID NO: 534055 - DNA, 25 bp, Homo sapien
gacatcagaagttacaataggcata

SEQ ID NO: 534056 - DNA, 25 bp, Homo sapien
aaatggtgtagcaggctcactggcc

SEQ ID NO: 534057 - DNA, 25 bp, Homo sapien
agcaggctcactggccgtttgtttt

SEQ ID NO: 534058 - DNA, 25 bp, Homo sapien
agaactgggagagtacggtttccat

SEQ ID NO: 534059 - DNA, 25 bp, Homo sapien
gagagtacggtttccatgaatatac

SEQ ID NO: 534060 - DNA, 25 bp, Homo sapien
acggtttccatgaatatacagaggt

SEQ ID NO: 534061 - DNA, 25 bp, Homo sapien
tcacagtgaaaatctctcagaagaa

SEQ ID NO: 534062 - DNA, 25 bp, Homo sapien
gagaagctcttcaatagctaagcat

SEQ ID NO: 534063 - DNA, 25 bp, Homo sapien
tagctaagcatctccttacagtcac

SEQ ID NO: 534064 - DNA, 25 bp, Homo sapien
aagcatctccttacagtcactaata

SEQ ID NO: 534065 - DNA, 25 bp, Homo sapien
actacccatagaaaacttgacatgt

SEQ ID NO: 534066 - DNA, 25 bp, Homo sapien
tagaaaacttgacatgtagcttctt

SEQ ID NO: 534067 - DNA, 25 bp, Homo sapien
tcttctgaaagaattatttgccttc

SEQ ID NO: 534068 - DNA, 25 bp, Homo sapien
tgccttctgaaatgtgacccccaag

SEQ ID NO: 534069 - DNA, 25 bp, Homo sapien
gttggccctggcgaagtaatgtgtc

SEQ ID NO: 534070 - DNA, 25 bp, Homo sapien
aaatgtgtggacacttgcaagtgct

SEQ ID NO: 534071 - DNA, 25 bp, Homo sapien
acttgcaagtgctcatggatgaatt

SEQ ID NO: 534072 - DNA, 25 bp, Homo sapien
gtgtaccctttgatagaagcacatt

SEQ ID NO: 534073 - DNA, 25 bp, Homo sapien
ttccaaaggcgtggttattaaccag

SEQ ID NO: 534074 - DNA, 25 bp, Homo sapien
tattaaccagcagaattatagcagg

SEQ ID NO: 534075 - DNA, 25 bp, Homo sapien
atagcaggtatacataacttaagtg

SEQ ID NO: 534076 - DNA, 25 bp, Homo sapien
tcaatagcgtgtgaagtggattaac

SEQ ID NO: 534077 - DNA, 25 bp, Homo sapien
tagagaatcaagagcatcggaaaat

SEQ ID NO: 534078 - DNA, 25 bp, Homo sapien
ttagtgcatagtgcttctaacaagc

SEQ ID NO: 534079 - DNA, 25 bp, Homo sapien
agtgcttctaacaagctgcatgaag

SEQ ID NO: 534080 - DNA, 25 bp, Homo sapien
aaacccagtggactgggctgggtct

SEQ ID NO: 534081 - DNA, 25 bp, Homo sapien
tcctggctccggtgggaactgcaca

SEQ ID NO: 534082 - DNA, 25 bp, Homo sapien
tggctccggtgggaactgcacacaa

SEQ ID NO: 534083 - DNA, 25 bp, Homo sapien
cagacatttgcatttcatacggtaa

SEQ ID NO: 534084 - DNA, 25 bp, Homo sapien
agacatttgcatttcatacggtaaa

SEQ ID NO: 534085 - DNA, 25 bp, Homo sapien
gacatttgcatttcatacggtaaat

SEQ ID NO: 534086 - DNA, 25 bp, Homo sapien
tttgcatttcatacggtaaatgagg

SEQ ID NO: 534087 - DNA, 25 bp, Homo sapien
caaccataatcagcatgtctgggat

SEQ ID NO: 534088 - DNA, 25 bp, Homo sapien
accataatcagcatgtctgggatag

SEQ ID NO: 534089 - DNA, 25 bp, Homo sapien
cataatcagcatgtctgggatagac

SEQ ID NO: 534090 - DNA, 25 bp, Homo sapien
taatcagcatgtctgggatagactg

SEQ ID NO: 534091 - DNA, 25 bp, Homo sapien
gggtccagccgagagggtccgggcg

SEQ ID NO: 534092 - DNA, 25 bp, Homo sapien
gggtccgggcgccaggcaacgcgat

SEQ ID NO: 534093 - DNA, 25 bp, Homo sapien
ggtccgggcgccaggcaacgcgatt

SEQ ID NO: 534094 - DNA, 25 bp, Homo sapien
cgggcgccaggcaacgcgattcgcg

SEQ ID NO: 534095 - DNA, 25 bp, Homo sapien
ggcgccaggcaacgcgattcgcgcg

SEQ ID NO: 534096 - DNA, 25 bp, Homo sapien
tcgaggtcgggcttgggaagggtca

SEQ ID NO: 534097 - DNA, 25 bp, Homo sapien
gaggtcgggcttgggaagggtcagc

SEQ ID NO: 534098 - DNA, 25 bp, Homo sapien
cttgggaagggtcagcgggaggcct

SEQ ID NO: 534099 - DNA, 25 bp, Homo sapien
aagggtcagcgggaggcctgagggc

SEQ ID NO: 534100 - DNA, 25 bp, Homo sapien
tcagcgggaggcctgagggcgccgg

SEQ ID NO: 534101 - DNA, 25 bp, Homo sapien
ggaggcctgagggcgccgggcgctg

SEQ ID NO: 534102 - DNA, 25 bp, Homo sapien
cacagatggcgagggagtgggtcct

SEQ ID NO: 534103 - DNA, 25 bp, Homo sapien
ttgagagtacagttggattaatctt

SEQ ID NO: 534104 - DNA, 25 bp, Homo sapien
aagccgagtctaggatatttgagat

SEQ ID NO: 534105 - DNA, 25 bp, Homo sapien
tttgagattgggattgcggcttcct

SEQ ID NO: 534106 - DNA, 25 bp, Homo sapien
gagattgggattgcggcttcctgtc

SEQ ID NO: 534107 - DNA, 25 bp, Homo sapien
gggattgcggcttcctgtcttctgt

SEQ ID NO: 534108 - DNA, 25 bp, Homo sapien
ctgtcttctgtcttcatatctcata

SEQ ID NO: 534109 - DNA, 25 bp, Homo sapien
tctgtcttcatatctcataagcagg

SEQ ID NO: 534110 - DNA, 25 bp, Homo sapien
tcataagcaggagacttccccaggg

SEQ ID NO: 534111 - DNA, 25 bp, Homo sapien
gggagtttaattgctaccaagaaga

SEQ ID NO: 534112 - DNA, 25 bp, Homo sapien
attgctaccaagaagagggtcgggc

SEQ ID NO: 534113 - DNA, 25 bp, Homo sapien
ctgcaagagcttcggcgcctaatga

SEQ ID NO: 534114 - DNA, 25 bp, Homo sapien
gcttcggcgcctaatgatgtctaaa

SEQ ID NO: 534115 - DNA, 25 bp, Homo sapien
tcagccgcccgaaggacagtgttac

SEQ ID NO: 534116 - DNA, 25 bp, Homo sapien
ttccccccaattcgatttaatcagt

SEQ ID NO: 534117 - DNA, 25 bp, Homo sapien
ttaatcagtcttcattttccacagt

SEQ ID NO: 534118 - DNA, 25 bp, Homo sapien
cagtcttcattttccacagtagtaa

SEQ ID NO: 534119 - DNA, 25 bp, Homo sapien
tttctagatacgtcttgtagacctc

SEQ ID NO: 534120 - DNA, 25 bp, Homo sapien
gtcttgtagacctcaaagtaccgga

SEQ ID NO: 534121 - DNA, 25 bp, Homo sapien
gtaccggaaaggaagctcccattca

SEQ ID NO: 534122 - DNA, 25 bp, Homo sapien
aggaagctcccattcaaaggaaatt

SEQ ID NO: 534123 - DNA, 25 bp, Homo sapien
gtaaatgatactaattttttgtcca

SEQ ID NO: 534124 - DNA, 25 bp, Homo sapien
caagccctgcgtccagcgagcgtca

SEQ ID NO: 534125 - DNA, 25 bp, Homo sapien
aagccctgcgtccagcgagcgtcac

SEQ ID NO: 534126 - DNA, 25 bp, Homo sapien
agccctgcgtccagcgagcgtcaca

SEQ ID NO: 534127 - DNA, 25 bp, Homo sapien
cctgcgtccagcgagcgtcacagca

SEQ ID NO: 534128 - DNA, 25 bp, Homo sapien
tgcgtccagcgagcgtcacagcaca

SEQ ID NO: 534129 - DNA, 25 bp, Homo sapien
tcatttcagagattcggtttttaag

SEQ ID NO: 534130 - DNA, 25 bp, Homo sapien
catttcagagattcggtttttaaga

SEQ ID NO: 534131 - DNA, 25 bp, Homo sapien
ttcagagattcggtttttaagaaga

SEQ ID NO: 534132 - DNA, 25 bp, Homo sapien
tcagagattcggtttttaagaagat

SEQ ID NO: 534133 - DNA, 25 bp, Homo sapien
cagagattcggtttttaagaagatg

SEQ ID NO: 534134 - DNA, 25 bp, Homo sapien
agagattcggtttttaagaagatgc

SEQ ID NO: 534135 - DNA, 25 bp, Homo sapien
atcccacatgaaccccgtgttatta

SEQ ID NO: 534136 - DNA, 25 bp, Homo sapien
ccgtgttattacaaatcttccagta

SEQ ID NO: 534137 - DNA, 25 bp, Homo sapien
gtatttatcagctactaggtaccgc

SEQ ID NO: 534138 - DNA, 25 bp, Homo sapien
gtaccgctgattaaaagttttcaca

SEQ ID NO: 534139 - DNA, 25 bp, Homo sapien
atccaaaatgatcaaccttctgttg

SEQ ID NO: 534140 - DNA, 25 bp, Homo sapien
aaccgaatagttcttggctacagcc

SEQ ID NO: 534141 - DNA, 25 bp, Homo sapien
atagttcttggctacagccgggagg

SEQ ID NO: 534142 - DNA, 25 bp, Homo sapien
caagtgtaggctgccgagggccctt

SEQ ID NO: 534143 - DNA, 25 bp, Homo sapien
gagagactctccatagtatcgatgt

SEQ ID NO: 534144 - DNA, 25 bp, Homo sapien
tagtatcgatgttcagcaaacacca

SEQ ID NO: 534145 - DNA, 25 bp, Homo sapien
acaccaacatagctttcagttcctc

SEQ ID NO: 534146 - DNA, 25 bp, Homo sapien
ccatgttgtatgttccttgctgtac

SEQ ID NO: 534147 - DNA, 25 bp, Homo sapien
gtatgttccttgctgtacacgtggt

SEQ ID NO: 534148 - DNA, 25 bp, Homo sapien
ttccttgctgtacacgtggttgaca

SEQ ID NO: 534149 - DNA, 25 bp, Homo sapien
gctgtacacgtggttgacaaagaaa

SEQ ID NO: 534150 - DNA, 25 bp, Homo sapien
gcttatcatcaaacgcacgcatcca

SEQ ID NO: 534151 - DNA, 25 bp, Homo sapien
tcatcaaacgcacgcatccacttat

SEQ ID NO: 534152 - DNA, 25 bp, Homo sapien
gcacgcatccacttatcatcaaaca

SEQ ID NO: 534153 - DNA, 25 bp, Homo sapien
acttatcatcaaacacctcgggtga

SEQ ID NO: 534154 - DNA, 25 bp, Homo sapien
atggagtccctgtctgaccgggcca

SEQ ID NO: 534155 - DNA, 25 bp, Homo sapien
gtctgaccgggccatgttgtatgtt

SEQ ID NO: 534156 - DNA, 25 bp, Homo sapien
gaccgggccatgttgtatgttcctt

SEQ ID NO: 534157 - DNA, 25 bp, Homo sapien
aaggcacagctaaccacttcgcaca

SEQ ID NO: 534158 - DNA, 25 bp, Homo sapien
actgcactttccaatgccacagaca

SEQ ID NO: 534159 - DNA, 25 bp, Homo sapien
tttccaatgccacagacaactcaca

SEQ ID NO: 534160 - DNA, 25 bp, Homo sapien
aatgccacagacaactcacattgtt

SEQ ID NO: 534161 - DNA, 25 bp, Homo sapien
agacaactcacattgttcaactccc

SEQ ID NO: 534162 - DNA, 25 bp, Homo sapien
gggacagacgagacaacagcacaca

SEQ ID NO: 534163 - DNA, 25 bp, Homo sapien
gagacaacagcacacaggcagccag

SEQ ID NO: 534164 - DNA, 25 bp, Homo sapien
tccatgttctcccaaataccgttga

SEQ ID NO: 534165 - DNA, 25 bp, Homo sapien
tgttctcccaaataccgttgatgtg

SEQ ID NO: 534166 - DNA, 25 bp, Homo sapien
ctcccaaataccgttgatgtgaatt

SEQ ID NO: 534167 - DNA, 25 bp, Homo sapien
taccgttgatgtgaattattttaaa

SEQ ID NO: 534168 - DNA, 25 bp, Homo sapien
tggttggaggcctggtctggagccc

SEQ ID NO: 534169 - DNA, 25 bp, Homo sapien
tgcaccctctgctatgtctgtgatg

SEQ ID NO: 534170 - DNA, 25 bp, Homo sapien
gtctgtgatgtcagtagtgcctgtg

SEQ ID NO: 534171 - DNA, 25 bp, Homo sapien
tagtgcctgtgatcgtgtgttgcca

SEQ ID NO: 534172 - DNA, 25 bp, Homo sapien
tgtgatcgtgtgttgccattttgtc

SEQ ID NO: 534173 - DNA, 25 bp, Homo sapien
gttgccattttgtctggctgtggcc

SEQ ID NO: 534174 - DNA, 25 bp, Homo sapien
cattttgtctggctgtggcccctcc

SEQ ID NO: 534175 - DNA, 25 bp, Homo sapien
cctccccaaggaagaacaaatatga

SEQ ID NO: 534176 - DNA, 25 bp, Homo sapien
gaacaaatatgattctcctctccca

SEQ ID NO: 534177 - DNA, 25 bp, Homo sapien
atatgattctcctctcccaaataaa

SEQ ID NO: 534178 - DNA, 25 bp, Homo sapien
tgattctcctctcccaaataaactc

SEQ ID NO: 534179 - DNA, 25 bp, Homo sapien
acagagtgacccttgtctccaagaa

SEQ ID NO: 534180 - DNA, 25 bp, Homo sapien
agagtgacccttgtctccaagaaaa

SEQ ID NO: 534181 - DNA, 25 bp, Homo sapien
aaaagcaaatgggattaaggactca

SEQ ID NO: 534182 - DNA, 25 bp, Homo sapien
atgggattaaggactcatggaatgg

SEQ ID NO: 534183 - DNA, 25 bp, Homo sapien
gggagtcttactatatgtggaataa

SEQ ID NO: 534184 - DNA, 25 bp, Homo sapien
ggaataaacttgctcagtgttgcca

SEQ ID NO: 534185 - DNA, 25 bp, Homo sapien
ataaacttgctcagtgttgccacag

SEQ ID NO: 534186 - DNA, 25 bp, Homo sapien
cagtgttgccacagagttacattac

SEQ ID NO: 534187 - DNA, 25 bp, Homo sapien
gttgccacagagttacattaccaat

SEQ ID NO: 534188 - DNA, 25 bp, Homo sapien
tgccacagagttacattaccaatgt

SEQ ID NO: 534189 - DNA, 25 bp, Homo sapien
taccaatgtgtagaagtcagaaact

SEQ ID NO: 534190 - DNA, 25 bp, Homo sapien
tagtagtttgattctggtttccctc

SEQ ID NO: 534191 - DNA, 25 bp, Homo sapien
tggtttccctcctacagtgtgtcct

SEQ ID NO: 534192 - DNA, 25 bp, Homo sapien
agtgtgtcctccgtctctgtgcagc

SEQ ID NO: 534193 - DNA, 25 bp, Homo sapien
gtgcagctccgtcattaccataggg

SEQ ID NO: 534194 - DNA, 25 bp, Homo sapien
gggacttggttttagactctgatga

SEQ ID NO: 534195 - DNA, 25 bp, Homo sapien
gagaaatccacatgcttcagaattc

SEQ ID NO: 534196 - DNA, 25 bp, Homo sapien
ttcagagggttcagggaatggtttc

SEQ ID NO: 534197 - DNA, 25 bp, Homo sapien
gaatggtttcggatagtaggctctc

SEQ ID NO: 534198 - DNA, 25 bp, Homo sapien
tttcggatagtaggctctccctgct

SEQ ID NO: 534199 - DNA, 25 bp, Homo sapien
tcccttctctacaggaatctctgga

SEQ ID NO: 534200 - DNA, 25 bp, Homo sapien
ggaatctctggaaaactatcagaag

SEQ ID NO: 534201 - DNA, 25 bp, Homo sapien
aaggccggctggatcttcattcaca

SEQ ID NO: 534202 - DNA, 25 bp, Homo sapien
tggatcttcattcacagctctatgt

SEQ ID NO: 534203 - DNA, 25 bp, Homo sapien
cacagctctatgtgttctgtctggg

SEQ ID NO: 534204 - DNA, 25 bp, Homo sapien
cttcttggcaaagaggttggtccag

SEQ ID NO: 534205 - DNA, 25 bp, Homo sapien
gtccagaaagctacttctttgtcct

SEQ ID NO: 534206 - DNA, 25 bp, Homo sapien
gggtgttggcaccaatctgcagata

SEQ ID NO: 534207 - DNA, 25 bp, Homo sapien
caatctgcagatacccttccttctg

SEQ ID NO: 534208 - DNA, 25 bp, Homo sapien
aattccccagccatggtaagatgcc

SEQ ID NO: 534209 - DNA, 25 bp, Homo sapien
gtaagatgccttctgaacctgcaat

SEQ ID NO: 534210 - DNA, 25 bp, Homo sapien
aacctgcaatccctttcgcaaaaga

SEQ ID NO: 534211 - DNA, 25 bp, Homo sapien
tttcgcaaaagaccccagtctttgc

SEQ ID NO: 534212 - DNA, 25 bp, Homo sapien
ttcccttatttaggagccctgaact

SEQ ID NO: 534213 - DNA, 25 bp, Homo sapien
tttttatgccccaccgatacactgg

SEQ ID NO: 534214 - DNA, 25 bp, Homo sapien
cccttaccccggacaggatgaatgg

SEQ ID NO: 534215 - DNA, 25 bp, Homo sapien
accccggacaggatgaatggatcaa

SEQ ID NO: 534216 - DNA, 25 bp, Homo sapien
gtgaggttgctaaagaacatccttt

SEQ ID NO: 534217 - DNA, 25 bp, Homo sapien
ttcctctccccgattccttgtagag

SEQ ID NO: 534218 - DNA, 25 bp, Homo sapien
ccgattccttgtagagctgctgcaa

SEQ ID NO: 534219 - DNA, 25 bp, Homo sapien
tagagctgctgcaattcttagaggg

SEQ ID NO: 534220 - DNA, 25 bp, Homo sapien
agaggggcagttctacctcctctgt

SEQ ID NO: 534221 - DNA, 25 bp, Homo sapien
tctgtccctcggcagaaagacgttt

SEQ ID NO: 534222 - DNA, 25 bp, Homo sapien
ggcagaaagacgtttccacacctct

SEQ ID NO: 534223 - DNA, 25 bp, Homo sapien
taccgtcttgccagtttcttctttt

SEQ ID NO: 534224 - DNA, 25 bp, Homo sapien
ttcatccattctgttctcccttggg

SEQ ID NO: 534225 - DNA, 25 bp, Homo sapien
aacagctcagcagatttttggagac

SEQ ID NO: 534226 - DNA, 25 bp, Homo sapien
caaaccaaaggtctcactaggaaat

SEQ ID NO: 534227 - DNA, 25 bp, Homo sapien
ggtctcactaggaaatttatctgtt

SEQ ID NO: 534228 - DNA, 25 bp, Homo sapien
atctgttttaaaacattgcttcctt

SEQ ID NO: 534229 - DNA, 25 bp, Homo sapien
ccttcctggctctgctaaattgaat

SEQ ID NO: 534230 - DNA, 25 bp, Homo sapien
ggctctgctaaattgaatgctcatt

SEQ ID NO: 534231 - DNA, 25 bp, Homo sapien
ttgaatgctcattgtttgttgttgt

SEQ ID NO: 534232 - DNA, 25 bp, Homo sapien
ctgcgtgctgtatgaatctagaaag

SEQ ID NO: 534233 - DNA, 25 bp, Homo sapien
tagaaagccttaatttactaccaag

SEQ ID NO: 534234 - DNA, 25 bp, Homo sapien
gggcctgcttccttcaaatagagga

SEQ ID NO: 534235 - DNA, 25 bp, Homo sapien
gatgggtgctatgaaacctattcac

SEQ ID NO: 534236 - DNA, 25 bp, Homo sapien
aacctattcactctggacttgggat

SEQ ID NO: 534237 - DNA, 25 bp, Homo sapien
tggacttgggatggctcttctccat

SEQ ID NO: 534238 - DNA, 25 bp, Homo sapien
tctccatcttcccaagtctgagctg

SEQ ID NO: 534239 - DNA, 25 bp, Homo sapien
tctgctctgctcttctatttcctga

SEQ ID NO: 534240 - DNA, 25 bp, Homo sapien
atttcctgacagcagctaaggcatg

SEQ ID NO: 534241 - DNA, 25 bp, Homo sapien
cagctaaggcatgttcctgttctgc

SEQ ID NO: 534242 - DNA, 25 bp, Homo sapien
ccccaaattgaccttactaacagtg

SEQ ID NO: 534243 - DNA, 25 bp, Homo sapien
gaacttggaggagtcttcgggtctt

SEQ ID NO: 534244 - DNA, 25 bp, Homo sapien
tgtccacactctttgctccaataaa

SEQ ID NO: 534245 - DNA, 25 bp, Homo sapien
gtagtagtttgattctggtttccct

SEQ ID NO: 534246 - DNA, 25 bp, Homo sapien
tagtagtttgattctggtttccctc

SEQ ID NO: 534247 - DNA, 25 bp, Homo sapien
gactgagaaatccacatgcttcaga

SEQ ID NO: 534248 - DNA, 25 bp, Homo sapien
tgagaaatccacatgcttcagaatt

SEQ ID NO: 534249 - DNA, 25 bp, Homo sapien
gagaaatccacatgcttcagaattc

SEQ ID NO: 534250 - DNA, 25 bp, Homo sapien
ttcagagggttcagggaatggtttc

SEQ ID NO: 534251 - DNA, 25 bp, Homo sapien
gaatggtttcggatagtaggctctc

SEQ ID NO: 534252 - DNA, 25 bp, Homo sapien
atggtttcggatagtaggctctccc

SEQ ID NO: 534253 - DNA, 25 bp, Homo sapien
ggtttcggatagtaggctctccctg

SEQ ID NO: 534254 - DNA, 25 bp, Homo sapien
tttcggatagtaggctctccctgct

SEQ ID NO: 534255 - DNA, 25 bp, Homo sapien
ggatagtaggctctccctgctccct

SEQ ID NO: 534256 - DNA, 25 bp, Homo sapien
ggagctgagcccgacttctaccggg

SEQ ID NO: 534257 - DNA, 25 bp, Homo sapien
tttcctgacactaccagcctgggag

SEQ ID NO: 534258 - DNA, 25 bp, Homo sapien
aggtcctggagccacgtccagcaca

SEQ ID NO: 534259 - DNA, 25 bp, Homo sapien
gtcctggagccacgtccagcacaga

SEQ ID NO: 534260 - DNA, 25 bp, Homo sapien
ggagccacgtccagcacagagtgga

SEQ ID NO: 534261 - DNA, 25 bp, Homo sapien
gagccacgtccagcacagagtggac

SEQ ID NO: 534262 - DNA, 25 bp, Homo sapien
tccagcacagagtggacggattcac

SEQ ID NO: 534263 - DNA, 25 bp, Homo sapien
agcacagagtggacggattcaccgt

SEQ ID NO: 534264 - DNA, 25 bp, Homo sapien
cagagtggacggattcaccgtggcc

SEQ ID NO: 534265 - DNA, 25 bp, Homo sapien
gagtggacggattcaccgtggccga

SEQ ID NO: 534266 - DNA, 25 bp, Homo sapien
gactcttttccctgctttggtttgt

SEQ ID NO: 534267 - DNA, 25 bp, Homo sapien
ggtctagctggctccattcagtatt

SEQ ID NO: 534268 - DNA, 25 bp, Homo sapien
ggctccattcagtatttgagacatt

SEQ ID NO: 534269 - DNA, 25 bp, Homo sapien
gacatttggaatttgtctgcattta

SEQ ID NO: 534270 - DNA, 25 bp, Homo sapien
gcatttaaaaccaagagatcacaca

SEQ ID NO: 534271 - DNA, 25 bp, Homo sapien
cacacacctgtctggatttggagtt

SEQ ID NO: 534272 - DNA, 25 bp, Homo sapien
ctgtctggatttggagtttctcttg

SEQ ID NO: 534273 - DNA, 25 bp, Homo sapien
gtttctcttgaaaactcgccagtcc

SEQ ID NO: 534274 - DNA, 25 bp, Homo sapien
aaaactcgccagtccggccgtctga

SEQ ID NO: 534275 - DNA, 25 bp, Homo sapien
gagcctgcactgacgcctggtgaag

SEQ ID NO: 534276 - DNA, 25 bp, Homo sapien
ggcctgctgcactcactgataggaa

SEQ ID NO: 534277 - DNA, 25 bp, Homo sapien
tcactgataggaaattctgacccca

SEQ ID NO: 534278 - DNA, 25 bp, Homo sapien
aaagatcagagtcggctaaaggaaa

SEQ ID NO: 534279 - DNA, 25 bp, Homo sapien
gacatgacttccttttacaacactc

SEQ ID NO: 534280 - DNA, 25 bp, Homo sapien
gaggaacatgcagctatttgacaaa

SEQ ID NO: 534281 - DNA, 25 bp, Homo sapien
tgacaaaggcggtgatgaatctgct

SEQ ID NO: 534282 - DNA, 25 bp, Homo sapien
caaacaatgatgacccgtgtctgat

SEQ ID NO: 534283 - DNA, 25 bp, Homo sapien
atgacccgtgtctgattagctagtg

SEQ ID NO: 534284 - DNA, 25 bp, Homo sapien
aaggtgtaggaagctctgttgagac

SEQ ID NO: 534285 - DNA, 25 bp, Homo sapien
agctctgttgagacacatgttctga

SEQ ID NO: 534286 - DNA, 25 bp, Homo sapien
catgttctgaagtgtgttgtgtttc

SEQ ID NO: 534287 - DNA, 25 bp, Homo sapien
gtgtttcatgttcaagcttaatcaa

SEQ ID NO: 534288 - DNA, 25 bp, Homo sapien
caaggcagccattaatatacgaact

SEQ ID NO: 534289 - DNA, 25 bp, Homo sapien
gattacagatgttggctcaagttca

SEQ ID NO: 534290 - DNA, 25 bp, Homo sapien
gttggctcaagttcagggccaccat

SEQ ID NO: 534291 - DNA, 25 bp, Homo sapien
ggccaccatcatatacctaacaaga

SEQ ID NO: 534292 - DNA, 25 bp, Homo sapien
ttgtatttttccatcttaagcttta

SEQ ID NO: 534293 - DNA, 25 bp, Homo sapien
taaaattcttgttgtcagtccagca

SEQ ID NO: 534294 - DNA, 25 bp, Homo sapien
gtcagtccagcaattgaggctttca

SEQ ID NO: 534295 - DNA, 25 bp, Homo sapien
gaggctttcatagttcagtgttata

SEQ ID NO: 534296 - DNA, 25 bp, Homo sapien
tataatattcagtagggaccctcaa

SEQ ID NO: 534297 - DNA, 25 bp, Homo sapien
tatgttgctcactctataatcctcc

SEQ ID NO: 534298 - DNA, 25 bp, Homo sapien
ataatcctcctatggctaacctcta

SEQ ID NO: 534299 - DNA, 25 bp, Homo sapien
ctaacctctaggatagttctgccac

SEQ ID NO: 534300 - DNA, 25 bp, Homo sapien
tggtgacttcagtggagagcaactc

SEQ ID NO: 534301 - DNA, 25 bp, Homo sapien
gagagcaactcaaatggcaggaaga

SEQ ID NO: 534302 - DNA, 25 bp, Homo sapien
gaagagaacctttttgagatcatca

SEQ ID NO: 534303 - DNA, 25 bp, Homo sapien
acctttttgagatcatcacagcaga

SEQ ID NO: 534304 - DNA, 25 bp, Homo sapien
acagcagatgaagtgcactatttct

SEQ ID NO: 534305 - DNA, 25 bp, Homo sapien
gtgcactatttcttgcaagcagcca

SEQ ID NO: 534306 - DNA, 25 bp, Homo sapien
ccccaaggagcgcacagagtggatc

SEQ ID NO: 534307 - DNA, 25 bp, Homo sapien
cagagtggatcaaagccatccagat

SEQ ID NO: 534308 - DNA, 25 bp, Homo sapien
agatggcctcccgaactgggaagta

SEQ ID NO: 534309 - DNA, 25 bp, Homo sapien
tcttgagagaagaccctgcctacct

SEQ ID NO: 534310 - DNA, 25 bp, Homo sapien
atcccctgggagcaattcacttgag

SEQ ID NO: 534311 - DNA, 25 bp, Homo sapien
tgtgccaccagttttgtgatttagg

SEQ ID NO: 534312 - DNA, 25 bp, Homo sapien
ccagttttgtgatttaggttgcttt

SEQ ID NO: 534313 - DNA, 25 bp, Homo sapien
atttaggttgctttagtgggtgact

SEQ ID NO: 534314 - DNA, 25 bp, Homo sapien
gtgggtgactaacttttgttcagtg

SEQ ID NO: 534315 - DNA, 25 bp, Homo sapien
ttttttctttgctacttacatattt

SEQ ID NO: 534316 - DNA, 25 bp, Homo sapien
ggtacaagtttcttatttcaaatct

SEQ ID NO: 534317 - DNA, 25 bp, Homo sapien
ttcaaatctctactgatagtgccct

SEQ ID NO: 534318 - DNA, 25 bp, Homo sapien
atctctactgatagtgccctatggg

SEQ ID NO: 534319 - DNA, 25 bp, Homo sapien
ggagatgctggaacacattttgcaa

SEQ ID NO: 534320 - DNA, 25 bp, Homo sapien
gaagcctgtgtcatgttagttgctg

SEQ ID NO: 534321 - DNA, 25 bp, Homo sapien
ctgtgtcatgttagttgctgctgcc

SEQ ID NO: 534322 - DNA, 25 bp, Homo sapien
ccccattgaagggagagccttctca

SEQ ID NO: 534323 - DNA, 25 bp, Homo sapien
gagagccttctcagacatgaagcaa

SEQ ID NO: 534324 - DNA, 25 bp, Homo sapien
aagcaagggaaacatactgaatagt

SEQ ID NO: 534325 - DNA, 25 bp, Homo sapien
acacaaatttgatctggcttccatt

SEQ ID NO: 534326 - DNA, 25 bp, Homo sapien
ggattctcaatgtataagttgcctt

SEQ ID NO: 534327 - DNA, 25 bp, Homo sapien
aagttgccttatctgttaatgtcta

SEQ ID NO: 534328 - DNA, 25 bp, Homo sapien
gttaatgtctatcttctgtctcttt

SEQ ID NO: 534329 - DNA, 25 bp, Homo sapien
aatgtctatcttctgtctctttaat

SEQ ID NO: 534330 - DNA, 25 bp, Homo sapien
ctatcttctgtctctttaattttgt

SEQ ID NO: 534331 - DNA, 25 bp, Homo sapien
tatatctgctgttttgcttttggat

SEQ ID NO: 534332 - DNA, 25 bp, Homo sapien
ctgctgttttgcttttggatacatt

SEQ ID NO: 534333 - DNA, 25 bp, Homo sapien
taggcagtttttacttggccagaaa

SEQ ID NO: 534334 - DNA, 25 bp, Homo sapien
gaatacttgaaactgtgtgctctgt

SEQ ID NO: 534335 - DNA, 25 bp, Homo sapien
gtgctctgttctacttaatgttctg

SEQ ID NO: 534336 - DNA, 25 bp, Homo sapien
atgttcttttgtaggcagtatgtca

SEQ ID NO: 534337 - DNA, 25 bp, Homo sapien
ttgtctgtttccaagttacactgtg

SEQ ID NO: 534338 - DNA, 25 bp, Homo sapien
gttacactgtgaagtctgcgaccct

SEQ ID NO: 534339 - DNA, 25 bp, Homo sapien
tctgcgacccttttgaggtggtcat

SEQ ID NO: 534340 - DNA, 25 bp, Homo sapien
caaagacacagattccttgtttaac

SEQ ID NO: 534341 - DNA, 25 bp, Homo sapien
ttgtttaaccaagtgtcccaaagca

SEQ ID NO: 534342 - DNA, 25 bp, Homo sapien
gtgtcccaaagcatgtacctgaagt

SEQ ID NO: 534343 - DNA, 25 bp, Homo sapien
gctatgcagcttatattctgaaaac

SEQ ID NO: 534344 - DNA, 25 bp, Homo sapien
atgtatttgatactgtgatatgttc

SEQ ID NO: 534345 - DNA, 25 bp, Homo sapien
gatatgttcacgaaaagtattcttt

SEQ ID NO: 534346 - DNA, 25 bp, Homo sapien
attctttgttatagtagagctgttc

SEQ ID NO: 534347 - DNA, 25 bp, Homo sapien
tagtagagctgttcattatggatat

SEQ ID NO: 534348 - DNA, 25 bp, Homo sapien
ttgctttcaaatgccatgggttaca

SEQ ID NO: 534349 - DNA, 25 bp, Homo sapien
tgggttacacttttatgggcatgac

SEQ ID NO: 534350 - DNA, 25 bp, Homo sapien
acttttatgggcatgactataacca

SEQ ID NO: 534351 - DNA, 25 bp, Homo sapien
aaatacagtactcaacttcctttca

SEQ ID NO: 534352 - DNA, 25 bp, Homo sapien
cttcctttcatattagcatcatcaa

SEQ ID NO: 534353 - DNA, 25 bp, Homo sapien
ttagcatcatcaaccctctaattca

SEQ ID NO: 534354 - DNA, 25 bp, Homo sapien
atcaaccctctaattcaccttatgg

SEQ ID NO: 534355 - DNA, 25 bp, Homo sapien
agacagaccctggatctccttcctt

SEQ ID NO: 534356 - DNA, 25 bp, Homo sapien
acgccccgggaagacgcgagtcaga

SEQ ID NO: 534357 - DNA, 25 bp, Homo sapien
ccgggaagacgcgagtcagacagat

SEQ ID NO: 534358 - DNA, 25 bp, Homo sapien
aggagagctggcatctgacacgtgt

SEQ ID NO: 534359 - DNA, 25 bp, Homo sapien
agagctggcatctgacacgtgtctg

SEQ ID NO: 534360 - DNA, 25 bp, Homo sapien
ctggcatctgacacgtgtctgggag

SEQ ID NO: 534361 - DNA, 25 bp, Homo sapien
gggcaccaagcaattctcagcttcc

SEQ ID NO: 534362 - DNA, 25 bp, Homo sapien
aagcaattctcagcttccttgtagt

SEQ ID NO: 534363 - DNA, 25 bp, Homo sapien
gtaagctgtgaattctcagaccaac

SEQ ID NO: 534364 - DNA, 25 bp, Homo sapien
gtgaattctcagaccaacagataaa

SEQ ID NO: 534365 - DNA, 25 bp, Homo sapien
gataaacctgtacacaaagatcagt

SEQ ID NO: 534366 - DNA, 25 bp, Homo sapien
gagtgcatctagtgagagtgaagct

SEQ ID NO: 534367 - DNA, 25 bp, Homo sapien
gtgaagctgaaaatcttgaagcaca

SEQ ID NO: 534368 - DNA, 25 bp, Homo sapien
aatcttgaagcacaaccccagtcta

SEQ ID NO: 534369 - DNA, 25 bp, Homo sapien
ccagtctactgtccgtccagaagag

SEQ ID NO: 534370 - DNA, 25 bp, Homo sapien
tactgtccgtccagaagagatccct

SEQ ID NO: 534371 - DNA, 25 bp, Homo sapien
agaagagatccctcctatacctgaa

SEQ ID NO: 534372 - DNA, 25 bp, Homo sapien
gagatccctcctatacctgaaaata

SEQ ID NO: 534373 - DNA, 25 bp, Homo sapien
gattcctaatgagaaaaagtcctcc

SEQ ID NO: 534374 - DNA, 25 bp, Homo sapien
gaaaaagtcctcctaaagctgatga

SEQ ID NO: 534375 - DNA, 25 bp, Homo sapien
gagagtgtaatccacctaactccca

SEQ ID NO: 534376 - DNA, 25 bp, Homo sapien
agcctgcttcataccagagacgact

SEQ ID NO: 534377 - DNA, 25 bp, Homo sapien
tggtcagtgcggacacggccatccc

SEQ ID NO: 534378 - DNA, 25 bp, Homo sapien
gagagcgccgtcacccacttgaaaa

SEQ ID NO: 534379 - DNA, 25 bp, Homo sapien
aaacccaggaccttcagacaggatg

SEQ ID NO: 534380 - DNA, 25 bp, Homo sapien
aggaccttcagacaggatgaatggt

SEQ ID NO: 534381 - DNA, 25 bp, Homo sapien
gggctactgagaaagcaggacttga

SEQ ID NO: 534382 - DNA, 25 bp, Homo sapien
aagcaggacttgacgctcatacgct

SEQ ID NO: 534383 - DNA, 25 bp, Homo sapien
ttgacgctcatacgctccactgaaa

SEQ ID NO: 534384 - DNA, 25 bp, Homo sapien
atacgctccactgaaacgcaggact

SEQ ID NO: 534385 - DNA, 25 bp, Homo sapien
tccactgaaacgcaggacttcccag

SEQ ID NO: 534386 - DNA, 25 bp, Homo sapien
gtattcagttacaaatgtgttctaa

SEQ ID NO: 534387 - DNA, 25 bp, Homo sapien
aggttaggccgagcactctccacag

SEQ ID NO: 534388 - DNA, 25 bp, Homo sapien
gctctgctctcggtgcgtaaattca

SEQ ID NO: 534389 - DNA, 25 bp, Homo sapien
tgctctcggtgcgtaaattcacaga

SEQ ID NO: 534390 - DNA, 25 bp, Homo sapien
ctcggtgcgtaaattcacagagaaa

SEQ ID NO: 534391 - DNA, 25 bp, Homo sapien
tcacagagaaacacgaatgggtaac

SEQ ID NO: 534392 - DNA, 25 bp, Homo sapien
gaatgggtaacaacagaaaatggca

SEQ ID NO: 534393 - DNA, 25 bp, Homo sapien
tggcattggaacagtgggaatcagc

SEQ ID NO: 534394 - DNA, 25 bp, Homo sapien
aacagtgggaatcagcaattttgca

SEQ ID NO: 534395 - DNA, 25 bp, Homo sapien
cagcaattttgcacaggaagcgttg

SEQ ID NO: 534396 - DNA, 25 bp, Homo sapien
ttttgcacaggaagcgttgggagat

SEQ ID NO: 534397 - DNA, 25 bp, Homo sapien
gaagcgttgggagatgttgtttatt

SEQ ID NO: 534398 - DNA, 25 bp, Homo sapien
ttgggagatgttgtttattgtagtc

SEQ ID NO: 534399 - DNA, 25 bp, Homo sapien
aggccaacagctggtccctggagga

SEQ ID NO: 534400 - DNA, 25 bp, Homo sapien
tgcctggaagtcaacgtcaccacct

SEQ ID NO: 534401 - DNA, 25 bp, Homo sapien
acccttgacgcttgcagcttcggag

SEQ ID NO: 534402 - DNA, 25 bp, Homo sapien
gcagcttcggagtcacgggtttgaa

SEQ ID NO: 534403 - DNA, 25 bp, Homo sapien
acaacaagctgtcactgtccaatgc

SEQ ID NO: 534404 - DNA, 25 bp, Homo sapien
acgcagctgcgctgggtcaagcaga

SEQ ID NO: 534405 - DNA, 25 bp, Homo sapien
gtcaagcagacaaacaccgagaaga

SEQ ID NO: 534406 - DNA, 25 bp, Homo sapien
gaaggccagtgtggtaaccttacct

SEQ ID NO: 534407 - DNA, 25 bp, Homo sapien
taaccttacctgtctacctgaactt

SEQ ID NO: 534408 - DNA, 25 bp, Homo sapien
tctacctgaacttcacccgtgcaga

SEQ ID NO: 534409 - DNA, 25 bp, Homo sapien
ctcatcttcaccgtggacttcgaaa

SEQ ID NO: 534410 - DNA, 25 bp, Homo sapien
ggctgtcagtcccagcatgaacagc

SEQ ID NO: 534411 - DNA, 25 bp, Homo sapien
taaaaatctcccgtctggttgctgc

SEQ ID NO: 534412 - DNA, 25 bp, Homo sapien
tcccgtctggttgctgctcggagag

SEQ ID NO: 534413 - DNA, 25 bp, Homo sapien
gttgctgctcggagaggctccaaga

SEQ ID NO: 534414 - DNA, 25 bp, Homo sapien
gaaaatgctgccctgagaaccagag

SEQ ID NO: 534415 - DNA, 25 bp, Homo sapien
tgctgccctgagaaccagagcgagg

SEQ ID NO: 534416 - DNA, 25 bp, Homo sapien
gaaagatgccttcaacacagactct

SEQ ID NO: 534417 - DNA, 25 bp, Homo sapien
agatgccttcaacacagactcttct

SEQ ID NO: 534418 - DNA, 25 bp, Homo sapien
acagactcttctaggaatccagcca

SEQ ID NO: 534419 - DNA, 25 bp, Homo sapien
gaatccagccagctttgggacggcc

SEQ ID NO: 534420 - DNA, 25 bp, Homo sapien
ccagctttgggacggccgtttcaca

SEQ ID NO: 534421 - DNA, 25 bp, Homo sapien
gaatttattggagcatgaccacgga

SEQ ID NO: 534422 - DNA, 25 bp, Homo sapien
tgaccacggaggatagtatgagccc

SEQ ID NO: 534423 - DNA, 25 bp, Homo sapien
aaaatccagactctttcgataccca

SEQ ID NO: 534424 - DNA, 25 bp, Homo sapien
gatacccaggaccaagccacagcag

SEQ ID NO: 534425 - DNA, 25 bp, Homo sapien
agccatgcccgcattagctcttaga

SEQ ID NO: 534426 - DNA, 25 bp, Homo sapien
tagacccacagactggttttgcaac

SEQ ID NO: 534427 - DNA, 25 bp, Homo sapien
gttttgcaacgtttacaccgactag

SEQ ID NO: 534428 - DNA, 25 bp, Homo sapien
cacctcgggcacattttgggaagtt

SEQ ID NO: 534429 - DNA, 25 bp, Homo sapien
gcatttacagaaacgcatccagcaa

SEQ ID NO: 534430 - DNA, 25 bp, Homo sapien
gcatccagcaagaatattgtccctt

SEQ ID NO: 534431 - DNA, 25 bp, Homo sapien
gaatattgtccctttgagcagaaat

SEQ ID NO: 534432 - DNA, 25 bp, Homo sapien
gatcctgaaaggcactttctgctta

SEQ ID NO: 534433 - DNA, 25 bp, Homo sapien
gaaaggcactttctgcttagggcaa

SEQ ID NO: 534434 - DNA, 25 bp, Homo sapien
cttagggcaagcagtcatggaataa

SEQ ID NO: 534435 - DNA, 25 bp, Homo sapien
aagcatgtaaacaagctggcttctc

SEQ ID NO: 534436 - DNA, 25 bp, Homo sapien
aacctagcattttatttagatcttc

SEQ ID NO: 534437 - DNA, 25 bp, Homo sapien
gtttttctgtaggacaccttggcct

SEQ ID NO: 534438 - DNA, 25 bp, Homo sapien
tctgtaggacaccttggcctacctg

SEQ ID NO: 534439 - DNA, 25 bp, Homo sapien
tagatcttcattaaactgttggaat

SEQ ID NO: 534440 - DNA, 25 bp, Homo sapien
ggaattgagaaccagacatacgtaa

SEQ ID NO: 534441 - DNA, 25 bp, Homo sapien
cagacatacgtaataaacctccaaa

SEQ ID NO: 534442 - DNA, 25 bp, Homo sapien
taaacctccaaaaatagatcctgaa

SEQ ID NO: 534443 - DNA, 25 bp, Homo sapien
agaagactgagccccgacattccag

SEQ ID NO: 534444 - DNA, 25 bp, Homo sapien
gagcccctcgttccagagctgagat

SEQ ID NO: 534445 - DNA, 25 bp, Homo sapien
ccagagctgagatggcataggcctt

SEQ ID NO: 534446 - DNA, 25 bp, Homo sapien
gcataggccttagcagtaacgggta

SEQ ID NO: 534447 - DNA, 25 bp, Homo sapien
agcagtaacgggtagcagcagatgt

SEQ ID NO: 534448 - DNA, 25 bp, Homo sapien
gtagtttcagacttggagtaaaact

SEQ ID NO: 534449 - DNA, 25 bp, Homo sapien
agaatcttccatatttatacagcag

SEQ ID NO: 534450 - DNA, 25 bp, Homo sapien
agaagctgtaggactgtttgtgact

SEQ ID NO: 534451 - DNA, 25 bp, Homo sapien
gtaggactgtttgtgactggccctg

SEQ ID NO: 534452 - DNA, 25 bp, Homo sapien
actgtttgtgactggccctgtcctg

SEQ ID NO: 534453 - DNA, 25 bp, Homo sapien
cctgtcctggcatcagtagcatctg

SEQ ID NO: 534454 - DNA, 25 bp, Homo sapien
tatctgagtgtaccttttatagtta

SEQ ID NO: 534455 - DNA, 25 bp, Homo sapien
gagtgtaccttttatagttagtaga

SEQ ID NO: 534456 - DNA, 25 bp, Homo sapien
gtacttaaatggtatgcagaggcac

SEQ ID NO: 534457 - DNA, 25 bp, Homo sapien
tatgcagaggcacagatgtaaggtt

SEQ ID NO: 534458 - DNA, 25 bp, Homo sapien
aggcacagatgtaaggtttataact

SEQ ID NO: 534459 - DNA, 25 bp, Homo sapien
tccacttaggatttcctaatctcct

SEQ ID NO: 534460 - DNA, 25 bp, Homo sapien
ctaatctccttgtcatccaattcaa

SEQ ID NO: 534461 - DNA, 25 bp, Homo sapien
ttgtcatccaattcaagctcaagat

SEQ ID NO: 534462 - DNA, 25 bp, Homo sapien
caagctcaagatgaagcacaattct

SEQ ID NO: 534463 - DNA, 25 bp, Homo sapien
gaagcacaattctttgatctccctt

SEQ ID NO: 534464 - DNA, 25 bp, Homo sapien
gcacaattctttgatctccctttgc

SEQ ID NO: 534465 - DNA, 25 bp, Homo sapien
ctgccttctcggatgggccaacagt

SEQ ID NO: 534466 - DNA, 25 bp, Homo sapien
tcggatgggccaacagtcgtaagaa

SEQ ID NO: 534467 - DNA, 25 bp, Homo sapien
acagtcgtaagaaagccctctctgc

SEQ ID NO: 534468 - DNA, 25 bp, Homo sapien
taagaaagccctctctgcccgttct

SEQ ID NO: 534469 - DNA, 25 bp, Homo sapien
tcattctttccaaacctcgaaacca

SEQ ID NO: 534470 - DNA, 25 bp, Homo sapien
tcgaaaccaaccaaaacgtgagaag

SEQ ID NO: 534471 - DNA, 25 bp, Homo sapien
gagaagtatttttgtaccctgtgta

SEQ ID NO: 534472 - DNA, 25 bp, Homo sapien
aaaggatttttcatgtgcgtaccat

SEQ ID NO: 534473 - DNA, 25 bp, Homo sapien
ggatttttcatgtgcgtaccattaa

SEQ ID NO: 534474 - DNA, 25 bp, Homo sapien
tcatgtgcgtaccattaattattaa

SEQ ID NO: 534475 - DNA, 25 bp, Homo sapien
ttaattattaaagcgacctcgttcg

SEQ ID NO: 534476 - DNA, 25 bp, Homo sapien
tccccttcatgtcgctgatgatggt

SEQ ID NO: 534477 - DNA, 25 bp, Homo sapien
atgtcgctgatgatggtctggaaga

SEQ ID NO: 534478 - DNA, 25 bp, Homo sapien
cattttcccggctccggcagggcga

SEQ ID NO: 534479 - DNA, 25 bp, Homo sapien
gaaggcagctgctgctactactgtt

SEQ ID NO: 534480 - DNA, 25 bp, Homo sapien
gaaggaatttcaccttccgagagac

SEQ ID NO: 534481 - DNA, 25 bp, Homo sapien
gaatttcaccttccgagagacccac

SEQ ID NO: 534482 - DNA, 25 bp, Homo sapien
gagagacccacctcggactcgcagc

SEQ ID NO: 534483 - DNA, 25 bp, Homo sapien
ctgctgctactactgttgtcgaaag

SEQ ID NO: 534484 - DNA, 25 bp, Homo sapien
ctactactgttgtcgaaagctggga

SEQ ID NO: 534485 - DNA, 25 bp, Homo sapien
gaaatcttcccaaactggatagctc

SEQ ID NO: 534486 - DNA, 25 bp, Homo sapien
caaactggatagctccccttcatgt

SEQ ID NO: 534487 - DNA, 25 bp, Homo sapien
aggcccagctagcagacgacgtcct

SEQ ID NO: 534488 - DNA, 25 bp, Homo sapien
acctcacccagacatgttcaaggag

SEQ ID NO: 534489 - DNA, 25 bp, Homo sapien
agatcttcaatctcatgaagtttga

SEQ ID NO: 534490 - DNA, 25 bp, Homo sapien
gaagtttgatagctacactcgcttt

SEQ ID NO: 534491 - DNA, 25 bp, Homo sapien
gatagctacactcgctttctgaagt

SEQ ID NO: 534492 - DNA, 25 bp, Homo sapien
ctcgctttctgaagtccccgctgta

SEQ ID NO: 534493 - DNA, 25 bp, Homo sapien
gtgcactcccggactcgcagcaggt

SEQ ID NO: 534494 - DNA, 25 bp, Homo sapien
ggttcagaccactccagtgtgtcca

SEQ ID NO: 534495 - DNA, 25 bp, Homo sapien
gtgtgtccacgccaaaaaagttaag

SEQ ID NO: 534496 - DNA, 25 bp, Homo sapien
gaaaatcaaaatccggccgatccct

SEQ ID NO: 534497 - DNA, 25 bp, Homo sapien
cggccgatccctgaatgaagagctg

SEQ ID NO: 534498 - DNA, 25 bp, Homo sapien
gggtaagccacaacatctagaaatc

SEQ ID NO: 534499 - DNA, 25 bp, Homo sapien
gaggaagcaagcgtgtcttcccctg

SEQ ID NO: 534500 - DNA, 25 bp, Homo sapien
agcacacagcgacttgcgttgacaa

SEQ ID NO: 534501 - DNA, 25 bp, Homo sapien
ggaggaaacgattactctgtaaaca

SEQ ID NO: 534502 - DNA, 25 bp, Homo sapien
tacttgggagattgccacagcctgc

SEQ ID NO: 534503 - DNA, 25 bp, Homo sapien
agcctgctgctgagttgagttacca

SEQ ID NO: 534504 - DNA, 25 bp, Homo sapien
gttaccagacatcctccatgtgaga

SEQ ID NO: 534505 - DNA, 25 bp, Homo sapien
gaagcagcgaacattgaatctcagg

SEQ ID NO: 534506 - DNA, 25 bp, Homo sapien
gaatctcagggatggcccacaactg

SEQ ID NO: 534507 - DNA, 25 bp, Homo sapien
ggatggcccacaactgggtccacat

SEQ ID NO: 534508 - DNA, 25 bp, Homo sapien
gggtccacatgtaatgagccctgtt

SEQ ID NO: 534509 - DNA, 25 bp, Homo sapien
tggaagttgtcctttctgatcctct

SEQ ID NO: 534510 - DNA, 25 bp, Homo sapien
ctctcttcttttcccatttacaaat

SEQ ID NO: 534511 - DNA, 25 bp, Homo sapien
gactgtagtttttgttcaccttctg

SEQ ID NO: 534512 - DNA, 25 bp, Homo sapien
tttgttcaccttctgtgcatctggc

SEQ ID NO: 534513 - DNA, 25 bp, Homo sapien
gaaaatgacttctgttctgtccccg

SEQ ID NO: 534514 - DNA, 25 bp, Homo sapien
aagtctctcccactttgggatcctg

SEQ ID NO: 534515 - DNA, 25 bp, Homo sapien
gatcctgctgaagctaggttcatga

SEQ ID NO: 534516 - DNA, 25 bp, Homo sapien
ggttcatgaggtcggaaatccccac

SEQ ID NO: 534517 - DNA, 25 bp, Homo sapien
caccacatttgcctagactttgggc

SEQ ID NO: 534518 - DNA, 25 bp, Homo sapien
gactttgggcacaggagttcttagt

SEQ ID NO: 534519 - DNA, 25 bp, Homo sapien
ggagttcttagtccaccaaatcaga

SEQ ID NO: 534520 - DNA, 25 bp, Homo sapien
accggaaataccttgatgggctgga

SEQ ID NO: 534521 - DNA, 25 bp, Homo sapien
aaataccttgatgggctggatgtgt

SEQ ID NO: 534522 - DNA, 25 bp, Homo sapien
atgggctggatgtgtgccgcttccc

SEQ ID NO: 534523 - DNA, 25 bp, Homo sapien
tgtgtgccgcttccccttgctggat

SEQ ID NO: 534524 - DNA, 25 bp, Homo sapien
gcccactgccacttgactggatgta

SEQ ID NO: 534525 - DNA, 25 bp, Homo sapien
actgccacttgactggatgtatctt

SEQ ID NO: 534526 - DNA, 25 bp, Homo sapien
gccacttgactggatgtatcttgtc

SEQ ID NO: 534527 - DNA, 25 bp, Homo sapien
gactggatgtatcttgtctacacca

SEQ ID NO: 534528 - DNA, 25 bp, Homo sapien
ggatgtatcttgtctacaccatcat

SEQ ID NO: 534529 - DNA, 25 bp, Homo sapien
gtatcttgtctacaccatcatgttt

SEQ ID NO: 534530 - DNA, 25 bp, Homo sapien
atcttgtctacaccatcatgtttct

SEQ ID NO: 534531 - DNA, 25 bp, Homo sapien
atggtgggaccccattattctctca

SEQ ID NO: 534532 - DNA, 25 bp, Homo sapien
attattctctcatctcggcattcag

SEQ ID NO: 534533 - DNA, 25 bp, Homo sapien
ctctcatctcggcattcagggaaca

SEQ ID NO: 534534 - DNA, 25 bp, Homo sapien
ttagcggcccctggtcacatgtcat

SEQ ID NO: 534535 - DNA, 25 bp, Homo sapien
tggtcacatgtcatcgggctgggca

SEQ ID NO: 534536 - DNA, 25 bp, Homo sapien
tcgtgcccgctgtcggctggttata

SEQ ID NO: 534537 - DNA, 25 bp, Homo sapien
tgtcggctggttatagcacttccac

SEQ ID NO: 534538 - DNA, 25 bp, Homo sapien
gttatagcacttccactgctactgt

SEQ ID NO: 534539 - DNA, 25 bp, Homo sapien
acttccactgctactgtcagatagg

SEQ ID NO: 534540 - DNA, 25 bp, Homo sapien
gctactgtcagataggaagtgatcg

SEQ ID NO: 534541 - DNA, 25 bp, Homo sapien
ggcaaagagaaagcccatatttgtt

SEQ ID NO: 534542 - DNA, 25 bp, Homo sapien
gaaggatgcggtacatactaaggta

SEQ ID NO: 534543 - DNA, 25 bp, Homo sapien
tacatactaaggtactactttcttt

SEQ ID NO: 534544 - DNA, 25 bp, Homo sapien
aaagttaagggcactagagaagctt

SEQ ID NO: 534545 - DNA, 25 bp, Homo sapien
gaagcttaataacctaattctagta

SEQ ID NO: 534546 - DNA, 25 bp, Homo sapien
gaaagggctaatctgcatcttttag

SEQ ID NO: 534547 - DNA, 25 bp, Homo sapien
aatctgcatcttttagcaacccacc

SEQ ID NO: 534548 - DNA, 25 bp, Homo sapien
atcttttagcaacccaccaggtgat

SEQ ID NO: 534549 - DNA, 25 bp, Homo sapien
acccaccaggtgattctcaaaaagt

SEQ ID NO: 534550 - DNA, 25 bp, Homo sapien
ggtgattctcaaaaagtctaaagtt

SEQ ID NO: 534551 - DNA, 25 bp, Homo sapien
aaccactggtagagataactgagaa

SEQ ID NO: 534552 - DNA, 25 bp, Homo sapien
acttctgttatgatagggtggctga

SEQ ID NO: 534553 - DNA, 25 bp, Homo sapien
ctgaaggatgggaagccaggaagtg

SEQ ID NO: 534554 - DNA, 25 bp, Homo sapien
gcccaatgtaggtgtagagggacta

SEQ ID NO: 534555 - DNA, 25 bp, Homo sapien
aggtgtagagggactacagccctga

SEQ ID NO: 534556 - DNA, 25 bp, Homo sapien
gggctgctccatgcggcattcttgg

SEQ ID NO: 534557 - DNA, 25 bp, Homo sapien
tgctccatgcggcattcttggaggt

SEQ ID NO: 534558 - DNA, 25 bp, Homo sapien
tccatgcggcattcttggaggtcca

SEQ ID NO: 534559 - DNA, 25 bp, Homo sapien
ccatgcggcattcttggaggtccaa

SEQ ID NO: 534560 - DNA, 25 bp, Homo sapien
catgcggcattcttggaggtccaag

SEQ ID NO: 534561 - DNA, 25 bp, Homo sapien
atgcggcattcttggaggtccaaga

SEQ ID NO: 534562 - DNA, 25 bp, Homo sapien
tgcggcattcttggaggtccaagag

SEQ ID NO: 534563 - DNA, 25 bp, Homo sapien
gggcagcgccaccttgggccaggct

SEQ ID NO: 534564 - DNA, 25 bp, Homo sapien
gtggcggctacaaataacctatata

SEQ ID NO: 534565 - DNA, 25 bp, Homo sapien
atattccaggacaaggttaactagg

SEQ ID NO: 534566 - DNA, 25 bp, Homo sapien
caggacaaggttaactaggtggaca

SEQ ID NO: 534567 - DNA, 25 bp, Homo sapien
ctaggtggacaagttattacttaat

SEQ ID NO: 534568 - DNA, 25 bp, Homo sapien
taatctcacatactgaatactagtc

SEQ ID NO: 534569 - DNA, 25 bp, Homo sapien
tactgaatactagtcaaacaagttt

SEQ ID NO: 534570 - DNA, 25 bp, Homo sapien
tcttcatttgatgcattgactttaa

SEQ ID NO: 534571 - DNA, 25 bp, Homo sapien
ccctatacaggaaatgattggaata

SEQ ID NO: 534572 - DNA, 25 bp, Homo sapien
attaaaaggagtccaacattcccag

SEQ ID NO: 534573 - DNA, 25 bp, Homo sapien
cctaggtgtctgctgcgataaaatg

SEQ ID NO: 534574 - DNA, 25 bp, Homo sapien
gtgtctgctgcgataaaatgaggtt

SEQ ID NO: 534575 - DNA, 25 bp, Homo sapien
aaaaaacgccatgtcattgataact

SEQ ID NO: 534576 - DNA, 25 bp, Homo sapien
cccggtctgctgatcactctttcat

SEQ ID NO: 534577 - DNA, 25 bp, Homo sapien
ttcatgcctgtgtatccagggtgct

SEQ ID NO: 534578 - DNA, 25 bp, Homo sapien
gtatccagggtgctctgtttcccca

SEQ ID NO: 534579 - DNA, 25 bp, Homo sapien
gcagagggccgggacagctttcctc

SEQ ID NO: 534580 - DNA, 25 bp, Homo sapien
ccgggacagctttcctctcagtcat

SEQ ID NO: 534581 - DNA, 25 bp, Homo sapien
agtcattgttcaccccacttgaaaa

SEQ ID NO: 534582 - DNA, 25 bp, Homo sapien
gttcaccccacttgaaaattcagac

SEQ ID NO: 534583 - DNA, 25 bp, Homo sapien
aagatttcatgtgtgggaaccacag

SEQ ID NO: 534584 - DNA, 25 bp, Homo sapien
ggaaccacagttcctggctgccttt

SEQ ID NO: 534585 - DNA, 25 bp, Homo sapien
ctgtgtatgtgtaaattccttaata

SEQ ID NO: 534586 - DNA, 25 bp, Homo sapien
aaataaaccatatcgcccaattcca

SEQ ID NO: 534587 - DNA, 25 bp, Homo sapien
atatcgcccaattccagtgacatgg

SEQ ID NO: 534588 - DNA, 25 bp, Homo sapien
aattccagtgacatgggtacctcct

SEQ ID NO: 534589 - DNA, 25 bp, Homo sapien
tcctcctggaatgcattgtgaccgg

SEQ ID NO: 534590 - DNA, 25 bp, Homo sapien
gcattgtgaccggaatcactggatt

SEQ ID NO: 534591 - DNA, 25 bp, Homo sapien
ggaatcactggattaatcctcacat

SEQ ID NO: 534592 - DNA, 25 bp, Homo sapien
ttaatcctcacatgttagcacctca

SEQ ID NO: 534593 - DNA, 25 bp, Homo sapien
agcacctcactaacttcgtttttga

SEQ ID NO: 534594 - DNA, 25 bp, Homo sapien
cttcgtttttgattgtgttggtgtc

SEQ ID NO: 534595 - DNA, 25 bp, Homo sapien
gtagtgaagttagatgggccaaacc

SEQ ID NO: 534596 - DNA, 25 bp, Homo sapien
tgggccaaaccatcaaacttatttt

SEQ ID NO: 534597 - DNA, 25 bp, Homo sapien
catggactgggctgccagtctagca

SEQ ID NO: 534598 - DNA, 25 bp, Homo sapien
gggctgccagtctagcatttgtttc

SEQ ID NO: 534599 - DNA, 25 bp, Homo sapien
gccagtctagcatttgtttccaaat

SEQ ID NO: 534600 - DNA, 25 bp, Homo sapien
attcatgttcttttggagtatcttc

SEQ ID NO: 534601 - DNA, 25 bp, Homo sapien
tcttttggagtatcttcatctcctc

SEQ ID NO: 534602 - DNA, 25 bp, Homo sapien
atcttctgccctttactattctggg

SEQ ID NO: 534603 - DNA, 25 bp, Homo sapien
ctgccctttactattctgggaaaat

SEQ ID NO: 534604 - DNA, 25 bp, Homo sapien
ggcaaaaaagcttcacatgtgtcca

SEQ ID NO: 534605 - DNA, 25 bp, Homo sapien
aagcttcacatgtgtccacaaaatg

SEQ ID NO: 534606 - DNA, 25 bp, Homo sapien
attctgtatcagttactttttccaa

SEQ ID NO: 534607 - DNA, 25 bp, Homo sapien
gcaatctaaagtataccaaactgta

SEQ ID NO: 534608 - DNA, 25 bp, Homo sapien
tatagatagaaacagctggaaaact

SEQ ID NO: 534609 - DNA, 25 bp, Homo sapien
tacattttttttctgggtgtgcatc

SEQ ID NO: 534610 - DNA, 25 bp, Homo sapien
gcatctgttgaaatgctcaagactt

SEQ ID NO: 534611 - DNA, 25 bp, Homo sapien
gctcaagacttaattatttgccttt

SEQ ID NO: 534612 - DNA, 25 bp, Homo sapien
caagacttaattatttgccttttga

SEQ ID NO: 534613 - DNA, 25 bp, Homo sapien
tgaaatcactgtaaatgcccccatc

SEQ ID NO: 534614 - DNA, 25 bp, Homo sapien
tcttcttcccaggtgtgccaaggaa

SEQ ID NO: 534615 - DNA, 25 bp, Homo sapien
tcttcccaggtgtgccaaggaatta

SEQ ID NO: 534616 - DNA, 25 bp, Homo sapien
ccaggtgtgccaaggaattaatctt

SEQ ID NO: 534617 - DNA, 25 bp, Homo sapien
ggaattaatcttggtttcactacaa

SEQ ID NO: 534618 - DNA, 25 bp, Homo sapien
taatcttggtttcactacaattaaa

SEQ ID NO: 534619 - DNA, 25 bp, Homo sapien
gctcctggcctctggtagagtgaga

SEQ ID NO: 534620 - DNA, 25 bp, Homo sapien
ctggcctctggtagagtgagacttc

SEQ ID NO: 534621 - DNA, 25 bp, Homo sapien
ggtagagtgagacttcagacgttct

SEQ ID NO: 534622 - DNA, 25 bp, Homo sapien
gagacttcagacgttctgatgcctt

SEQ ID NO: 534623 - DNA, 25 bp, Homo sapien
agacgttctgatgccttccggatgt

SEQ ID NO: 534624 - DNA, 25 bp, Homo sapien
gttctgatgccttccggatgtcatc

SEQ ID NO: 534625 - DNA, 25 bp, Homo sapien
tgatgccttccggatgtcatctctc

SEQ ID NO: 534626 - DNA, 25 bp, Homo sapien
agatgtgaggacttctaatttaaat

SEQ ID NO: 534627 - DNA, 25 bp, Homo sapien
gacttctaatttaaatgtgggactc

SEQ ID NO: 534628 - DNA, 25 bp, Homo sapien
tttaaatgtgggactcggagggatt

SEQ ID NO: 534629 - DNA, 25 bp, Homo sapien
ggactcggagggattttgtaaactg

SEQ ID NO: 534630 - DNA, 25 bp, Homo sapien
ctcagtcttgtggacagagtcaagt

SEQ ID NO: 534631 - DNA, 25 bp, Homo sapien
aaaagtgctccagaaaggccggaat

SEQ ID NO: 534632 - DNA, 25 bp, Homo sapien
aggccggaatagtcatgtagtggat

SEQ ID NO: 534633 - DNA, 25 bp, Homo sapien
gtcacaaaactgcttaagaccagct

SEQ ID NO: 534634 - DNA, 25 bp, Homo sapien
gaccagctgtcttgccagtaattgc

SEQ ID NO: 534635 - DNA, 25 bp, Homo sapien
gtcttgccagtaattgcagtgcttt

SEQ ID NO: 534636 - DNA, 25 bp, Homo sapien
agatttaattagtcacggctgctac

SEQ ID NO: 534637 - DNA, 25 bp, Homo sapien
acggctgctacgtgtatctgatgta

SEQ ID NO: 534638 - DNA, 25 bp, Homo sapien
atctgatgtagttaaccatggcctg

SEQ ID NO: 534639 - DNA, 25 bp, Homo sapien
gtagttaaccatggcctgtcatgat

SEQ ID NO: 534640 - DNA, 25 bp, Homo sapien
ggcctgtcatgattatattgctata

SEQ ID NO: 534641 - DNA, 25 bp, Homo sapien
gatcacatctaagtgacactcctat

SEQ ID NO: 534642 - DNA, 25 bp, Homo sapien
acactcctattgtcaggtctaaata

SEQ ID NO: 534643 - DNA, 25 bp, Homo sapien
aaacctcatgtgtaataggcgtata

SEQ ID NO: 534644 - DNA, 25 bp, Homo sapien
taacaggtgaccaatgttttctgaa

SEQ ID NO: 534645 - DNA, 25 bp, Homo sapien
tcaaacacagtacttcctaaacaac

SEQ ID NO: 534646 - DNA, 25 bp, Homo sapien
aacatggaacgaatggaagcttgta

SEQ ID NO: 534647 - DNA, 25 bp, Homo sapien
agcttgtaaggacatgcttgtttta

SEQ ID NO: 534648 - DNA, 25 bp, Homo sapien
atgcttgttttagtccagtggtttc

SEQ ID NO: 534649 - DNA, 25 bp, Homo sapien
agtggtttccacagctggctaagcc

SEQ ID NO: 534650 - DNA, 25 bp, Homo sapien
caggagtcacttggaggcttttaaa

SEQ ID NO: 534651 - DNA, 25 bp, Homo sapien
atacaaaacattggagctggaggcc

SEQ ID NO: 534652 - DNA, 25 bp, Homo sapien
ggaggtattggagagttttcagcaa

SEQ ID NO: 534653 - DNA, 25 bp, Homo sapien
agcaagagaatgacctatctttggg

SEQ ID NO: 534654 - DNA, 25 bp, Homo sapien
gggttgaatcacaagcctaccgata

SEQ ID NO: 534655 - DNA, 25 bp, Homo sapien
gaatcacaagcctaccgataatgta

SEQ ID NO: 534656 - DNA, 25 bp, Homo sapien
agcctaccgataatgtaaactgcca

SEQ ID NO: 534657 - DNA, 25 bp, Homo sapien
atgtaaactgccacagtcagttcct

SEQ ID NO: 534658 - DNA, 25 bp, Homo sapien
tgacagaccaagctctcttccttga

SEQ ID NO: 534659 - DNA, 25 bp, Homo sapien
agaccaagctctcttccttgatggt

SEQ ID NO: 534660 - DNA, 25 bp, Homo sapien
agctctcttccttgatggtgggcaa

SEQ ID NO: 534661 - DNA, 25 bp, Homo sapien
ctctcttccttgatggtgggcaaat

SEQ ID NO: 534662 - DNA, 25 bp, Homo sapien
gtagtccccactgtagaatttcctt

SEQ ID NO: 534663 - DNA, 25 bp, Homo sapien
ttttctgcgaatttgggccccttga

SEQ ID NO: 534664 - DNA, 25 bp, Homo sapien
aatttgggccccttgatcctctgat

SEQ ID NO: 534665 - DNA, 25 bp, Homo sapien
ttagggaggctgttcaggctttgca

SEQ ID NO: 534666 - DNA, 25 bp, Homo sapien
tgttcaggctttgcaggtcccttac

SEQ ID NO: 534667 - DNA, 25 bp, Homo sapien
ggtcccttacctgaacacatagaaa

SEQ ID NO: 534668 - DNA, 25 bp, Homo sapien
tgaacacatagaaaccctggagctg

SEQ ID NO: 534669 - DNA, 25 bp, Homo sapien
gaaaccctggagctgtgactgtgtc

SEQ ID NO: 534670 - DNA, 25 bp, Homo sapien
ggtagagaaaatggctctgctcaga

SEQ ID NO: 534671 - DNA, 25 bp, Homo sapien
tctgctcagagggaagatacgcata

SEQ ID NO: 534672 - DNA, 25 bp, Homo sapien
atacgcatagcaaggcagggaccag

SEQ ID NO: 534673 - DNA, 25 bp, Homo sapien
ggaccagaggaatcacaggcgcctg

SEQ ID NO: 534674 - DNA, 25 bp, Homo sapien
gacaagatggccacaccggcggtac

SEQ ID NO: 534675 - DNA, 25 bp, Homo sapien
acaagatggccacaccggcggtacc

SEQ ID NO: 534676 - DNA, 25 bp, Homo sapien
aagatggccacaccggcggtaccag

SEQ ID NO: 534677 - DNA, 25 bp, Homo sapien
gccacaccggcggtaccagtaagtg

SEQ ID NO: 534678 - DNA, 25 bp, Homo sapien
cacaccggcggtaccagtaagtgct

SEQ ID NO: 534679 - DNA, 25 bp, Homo sapien
acaccggcggtaccagtaagtgctc

SEQ ID NO: 534680 - DNA, 25 bp, Homo sapien
accggcggtaccagtaagtgctcct

SEQ ID NO: 534681 - DNA, 25 bp, Homo sapien
agtaagtgctcctccggccacgcca

SEQ ID NO: 534682 - DNA, 25 bp, Homo sapien
tgcggctccggttcccgctgcggct

SEQ ID NO: 534683 - DNA, 25 bp, Homo sapien
atcctcagaccctgcggcagcagcg

SEQ ID NO: 534684 - DNA, 25 bp, Homo sapien
cggcctcagcgcaagctccagcgca

SEQ ID NO: 534685 - DNA, 25 bp, Homo sapien
ctcagtcttgtggacagagtcaagt

SEQ ID NO: 534686 - DNA, 25 bp, Homo sapien
gtggacagagtcaagtagattttca

SEQ ID NO: 534687 - DNA, 25 bp, Homo sapien
aaaagggcagtcacaaaactgctta

SEQ ID NO: 534688 - DNA, 25 bp, Homo sapien
gaccagctgtcttgccagtaattgc

SEQ ID NO: 534689 - DNA, 25 bp, Homo sapien
accagctgtcttgccagtaattgca

SEQ ID NO: 534690 - DNA, 25 bp, Homo sapien
cagctgtcttgccagtaattgcagt

SEQ ID NO: 534691 - DNA, 25 bp, Homo sapien
gctgtcttgccagtaattgcagtgc

SEQ ID NO: 534692 - DNA, 25 bp, Homo sapien
ctgtcttgccagtaattgcagtgct

SEQ ID NO: 534693 - DNA, 25 bp, Homo sapien
gtcttgccagtaattgcagtgcttt

SEQ ID NO: 534694 - DNA, 25 bp, Homo sapien
cttgccagtaattgcagtgctttaa

SEQ ID NO: 534695 - DNA, 25 bp, Homo sapien
tgccagtaattgcagtgctttaaga

SEQ ID NO: 534696 - DNA, 25 bp, Homo sapien
gcctagaacaggatctggtacagtg

SEQ ID NO: 534697 - DNA, 25 bp, Homo sapien
gaacaggatctggtacagtgtaaat

SEQ ID NO: 534698 - DNA, 25 bp, Homo sapien
ggatctggtacagtgtaaataatca

SEQ ID NO: 534699 - DNA, 25 bp, Homo sapien
tatttataagcatctaactactttg

SEQ ID NO: 534700 - DNA, 25 bp, Homo sapien
gcatctaactactttgctaattcta

SEQ ID NO: 534701 - DNA, 25 bp, Homo sapien
aactactttgctaattctagtataa

SEQ ID NO: 534702 - DNA, 25 bp, Homo sapien
gtataatcatactcaagcctttcca

SEQ ID NO: 534703 - DNA, 25 bp, Homo sapien
aatcatactcaagcctttccatttt

SEQ ID NO: 534704 - DNA, 25 bp, Homo sapien
actttctaccatataaaggttctgg

SEQ ID NO: 534705 - DNA, 25 bp, Homo sapien
catataaaggttctggtgaggctta

SEQ ID NO: 534706 - DNA, 25 bp, Homo sapien
aaaggttctggtgaggcttaaatga

SEQ ID NO: 534707 - DNA, 25 bp, Homo sapien
tggccccgagaggtgcttctggtcc

SEQ ID NO: 534708 - DNA, 25 bp, Homo sapien
ggtcctcagtgtaaacagcagtgtc

SEQ ID NO: 534709 - DNA, 25 bp, Homo sapien
tcagtgtaaacagcagtgtcttcct

SEQ ID NO: 534710 - DNA, 25 bp, Homo sapien
aggccctgggaatcccactgcactt

SEQ ID NO: 534711 - DNA, 25 bp, Homo sapien
tgcacttggcctacaattccagcct

SEQ ID NO: 534712 - DNA, 25 bp, Homo sapien
ttggcctacaattccagcctggtca

SEQ ID NO: 534713 - DNA, 25 bp, Homo sapien
ttccagcctggtcaccttccaagag

SEQ ID NO: 534714 - DNA, 25 bp, Homo sapien
gggggtcaacaccacagagctgcca

SEQ ID NO: 534715 - DNA, 25 bp, Homo sapien
acccagatccttgagtgggcagctg

SEQ ID NO: 534716 - DNA, 25 bp, Homo sapien
cagatccttgagtgggcagctgaga

SEQ ID NO: 534717 - DNA, 25 bp, Homo sapien
aagcccaggggtcactgtccttctg

SEQ ID NO: 534718 - DNA, 25 bp, Homo sapien
aggagtgaggcccaggcgccgagac

SEQ ID NO: 534719 - DNA, 25 bp, Homo sapien
agactctccccttgccagacgtggt

SEQ ID NO: 534720 - DNA, 25 bp, Homo sapien
cttgccagacgtggttccagacggg

SEQ ID NO: 534721 - DNA, 25 bp, Homo sapien
ggattcagctgctcaacgggcatgc

SEQ ID NO: 534722 - DNA, 25 bp, Homo sapien
attcagctgctcaacgggcatgcgc

SEQ ID NO: 534723 - DNA, 25 bp, Homo sapien
ggcgccctggcgaacttgtttgtga

SEQ ID NO: 534724 - DNA, 25 bp, Homo sapien
ccctggcgaacttgtttgtgatagt

SEQ ID NO: 534725 - DNA, 25 bp, Homo sapien
atagttgggtttgcagcctttgctt

SEQ ID NO: 534726 - DNA, 25 bp, Homo sapien
agcctttgcttacacggtcaagtac

SEQ ID NO: 534727 - DNA, 25 bp, Homo sapien
gcttacacggtcaagtacgtgctga

SEQ ID NO: 534728 - DNA, 25 bp, Homo sapien
gagcatcgcgcaggagtgaggccca

SEQ ID NO: 534729 - DNA, 25 bp, Homo sapien
ggcacttctctactgtctggctgtg

SEQ ID NO: 534730 - DNA, 25 bp, Homo sapien
aagtgcccagcattatacggagaca

SEQ ID NO: 534731 - DNA, 25 bp, Homo sapien
attatacggagacagccttggatga

SEQ ID NO: 534732 - DNA, 25 bp, Homo sapien
aaaattgctcaaatgtgttcgagaa

SEQ ID NO: 534733 - DNA, 25 bp, Homo sapien
agaaagtgatcccagtgacccaaac

SEQ ID NO: 534734 - DNA, 25 bp, Homo sapien
caaagacatggtggtccagctcatt

SEQ ID NO: 534735 - DNA, 25 bp, Homo sapien
tggtccagctcattgacgacttcaa

SEQ ID NO: 534736 - DNA, 25 bp, Homo sapien
gctcattgacgacttcaagatttca

SEQ ID NO: 534737 - DNA, 25 bp, Homo sapien
tgggatacatgtctgcatggtcttc

SEQ ID NO: 534738 - DNA, 25 bp, Homo sapien
atgtctgcatggtcttcgaagtact

SEQ ID NO: 534739 - DNA, 25 bp, Homo sapien
tggtcttcgaagtacttggccacca

SEQ ID NO: 534740 - DNA, 25 bp, Homo sapien
gggttctatgctctttccccatacc

SEQ ID NO: 534741 - DNA, 25 bp, Homo sapien
ggttctatgctctttccccataccc

SEQ ID NO: 534742 - DNA, 25 bp, Homo sapien
gttctatgctctttccccatacccc

SEQ ID NO: 534743 - DNA, 25 bp, Homo sapien
ttctatgctctttccccataccccg

SEQ ID NO: 534744 - DNA, 25 bp, Homo sapien
tctatgctctttccccataccccgg

SEQ ID NO: 534745 - DNA, 25 bp, Homo sapien
atgctctttccccataccccggtct

SEQ ID NO: 534746 - DNA, 25 bp, Homo sapien
ccataccccggtctccgcctcatct

SEQ ID NO: 534747 - DNA, 25 bp, Homo sapien
atatgaatttttgttcccgtgagaa

SEQ ID NO: 534748 - DNA, 25 bp, Homo sapien
aacttctggctcttgatcaactcca

SEQ ID NO: 534749 - DNA, 25 bp, Homo sapien
acttctggctcttgatcaactccac

SEQ ID NO: 534750 - DNA, 25 bp, Homo sapien
ttctggctcttgatcaactccacgg

SEQ ID NO: 534751 - DNA, 25 bp, Homo sapien
actgttgtcattcttgttctgatca

SEQ ID NO: 534752 - DNA, 25 bp, Homo sapien
attcttgttctgatcattttggacc

SEQ ID NO: 534753 - DNA, 25 bp, Homo sapien
gttctgatcattttggaccttgaag

SEQ ID NO: 534754 - DNA, 25 bp, Homo sapien
ggtgattctctcctagaattagaca

SEQ ID NO: 534755 - DNA, 25 bp, Homo sapien
ataatgattgttttcctgccttaaa

SEQ ID NO: 534756 - DNA, 25 bp, Homo sapien
gcttttataacaggctgtttccctc

SEQ ID NO: 534757 - DNA, 25 bp, Homo sapien
ctgtttccctctggacaggtattaa

SEQ ID NO: 534758 - DNA, 25 bp, Homo sapien
tccctctggacaggtattaattctg

SEQ ID NO: 534759 - DNA, 25 bp, Homo sapien
ttttcagtgactacataaggatttg

SEQ ID NO: 534760 - DNA, 25 bp, Homo sapien
gtgtaccaaggcacaatcattaaaa

SEQ ID NO: 534761 - DNA, 25 bp, Homo sapien
cattaaaaggagttggaggcatcat

SEQ ID NO: 534762 - DNA, 25 bp, Homo sapien
tgcctaataatagcagttaccctga

SEQ ID NO: 534763 - DNA, 25 bp, Homo sapien
accctgattgtaatttatgtaactt

SEQ ID NO: 534764 - DNA, 25 bp, Homo sapien
tgcctgccttatttgcttactgagc

SEQ ID NO: 534765 - DNA, 25 bp, Homo sapien
ttactgagcacaggacagaggcaat

SEQ ID NO: 534766 - DNA, 25 bp, Homo sapien
aggcaatatacaactctgggttcac

SEQ ID NO: 534767 - DNA, 25 bp, Homo sapien
aactctgggttcacacacaagctga

SEQ ID NO: 534768 - DNA, 25 bp, Homo sapien
gggttcacacacaagctgagatgag

SEQ ID NO: 534769 - DNA, 25 bp, Homo sapien
gtataattatatagtgcttttctcc

SEQ ID NO: 534770 - DNA, 25 bp, Homo sapien
gtgcttttctccctcaaagtatttt

SEQ ID NO: 534771 - DNA, 25 bp, Homo sapien
atcttgcattgctttcctctgagct

SEQ ID NO: 534772 - DNA, 25 bp, Homo sapien
ttcctctgagctttagtgggtccta

SEQ ID NO: 534773 - DNA, 25 bp, Homo sapien
ttggaattttttcacccatagaaag

SEQ ID NO: 534774 - DNA, 25 bp, Homo sapien
aatttagcaggtggagtttcatagt

SEQ ID NO: 534775 - DNA, 25 bp, Homo sapien
aaaacagcttttgactcagctttga

SEQ ID NO: 534776 - DNA, 25 bp, Homo sapien
tgactcagctttgatttatcctcat

SEQ ID NO: 534777 - DNA, 25 bp, Homo sapien
tgatttatcctcatttgatttggcc

SEQ ID NO: 534778 - DNA, 25 bp, Homo sapien
ggtaatatgcattgattggcttctg

SEQ ID NO: 534779 - DNA, 25 bp, Homo sapien
gattggcttctgattccaattcagt

SEQ ID NO: 534780 - DNA, 25 bp, Homo sapien
ttccaattcagtatagcaaggtgct

SEQ ID NO: 534781 - DNA, 25 bp, Homo sapien
aagccttagaatgggtggcccttgt

SEQ ID NO: 534782 - DNA, 25 bp, Homo sapien
cttgtgacctgaaacacttcccaca

SEQ ID NO: 534783 - DNA, 25 bp, Homo sapien
ttcccacataagctacttaacaaga

SEQ ID NO: 534784 - DNA, 25 bp, Homo sapien
acaaggctagttcagtgttctaagt

SEQ ID NO: 534785 - DNA, 25 bp, Homo sapien
gaactgctaagatctggaagtacca

SEQ ID NO: 534786 - DNA, 25 bp, Homo sapien
ggaagtaccacctggactcacagag

SEQ ID NO: 534787 - DNA, 25 bp, Homo sapien
gagctgctttagtgcagcattgcac

SEQ ID NO: 534788 - DNA, 25 bp, Homo sapien
gcattgcacaggagttcatttcagt

SEQ ID NO: 534789 - DNA, 25 bp, Homo sapien
tcatttcagttcagtctacatttaa

SEQ ID NO: 534790 - DNA, 25 bp, Homo sapien
gtgtcatttcatcaacaagtatttc

SEQ ID NO: 534791 - DNA, 25 bp, Homo sapien
tttggcttcaactacatgtcaggtg

SEQ ID NO: 534792 - DNA, 25 bp, Homo sapien
cagcctacccttgagaagcagatgt

SEQ ID NO: 534793 - DNA, 25 bp, Homo sapien
gaagcagatgtaattccttgagtga

SEQ ID NO: 534794 - DNA, 25 bp, Homo sapien
gagtgaggctagtaagtctctgaaa

SEQ ID NO: 534795 - DNA, 25 bp, Homo sapien
cattcagtttttgcacaaggagaag

SEQ ID NO: 534796 - DNA, 25 bp, Homo sapien
ggaggtgtccacgttacgcaaggat

SEQ ID NO: 534797 - DNA, 25 bp, Homo sapien
gttacgcaaggatgtcaccgcccta

SEQ ID NO: 534798 - DNA, 25 bp, Homo sapien
gatgtcaccgccctaaagatcatga

SEQ ID NO: 534799 - DNA, 25 bp, Homo sapien
ctatgagcagattgtgaaggcacac

SEQ ID NO: 534800 - DNA, 25 bp, Homo sapien
gaggaccaggtctctgaccaggtca

SEQ ID NO: 534801 - DNA, 25 bp, Homo sapien
aggtctctgaccaggtcaagttcaa

SEQ ID NO: 534802 - DNA, 25 bp, Homo sapien
gttcaacgtgtttcaaggcatcatg

SEQ ID NO: 534803 - DNA, 25 bp, Homo sapien
tccttcaatgcctccatctcagtgg

SEQ ID NO: 534804 - DNA, 25 bp, Homo sapien
gtcttcagctggatcgaggagcact

SEQ ID NO: 534805 - DNA, 25 bp, Homo sapien
aggagcactgtaagcctcagaccct

SEQ ID NO: 534806 - DNA, 25 bp, Homo sapien
agaagagcatctttctcgtggccca

SEQ ID NO: 534807 - DNA, 25 bp, Homo sapien
ctcgtggcccacaggaaagatccta

SEQ ID NO: 534808 - DNA, 25 bp, Homo sapien
gatgatatttggcagctgtcctcca

SEQ ID NO: 534809 - DNA, 25 bp, Homo sapien
gctgtcctccagtcttaaaaggttt

SEQ ID NO: 534810 - DNA, 25 bp, Homo sapien
tgatgacaaatacaccttgaagctg

SEQ ID NO: 534811 - DNA, 25 bp, Homo sapien
gaagctgaccttcatcagtgggaga

SEQ ID NO: 534812 - DNA, 25 bp, Homo sapien
gaagccgagttcacaaagtccattg

SEQ ID NO: 534813 - DNA, 25 bp, Homo sapien
tccattgctaagttttttgaccaca

SEQ ID NO: 534814 - DNA, 25 bp, Homo sapien
ttttgaccacagtgggacactggtc

SEQ ID NO: 534815 - DNA, 25 bp, Homo sapien
actggtcatggatgcatatgagcct

SEQ ID NO: 534816 - DNA, 25 bp, Homo sapien
aatatccaggctccatgacagtctt

SEQ ID NO: 534817 - DNA, 25 bp, Homo sapien
ctttctgctttcctctagactggaa

SEQ ID NO: 534818 - DNA, 25 bp, Homo sapien
gctttcctctagactggaacattga

SEQ ID NO: 534819 - DNA, 25 bp, Homo sapien
tggaacattgattagggagtgcctc

SEQ ID NO: 534820 - DNA, 25 bp, Homo sapien
ggagtgcctcagacatgacattctt

SEQ ID NO: 534821 - DNA, 25 bp, Homo sapien
gacattcttgtgctgtccttggaat

SEQ ID NO: 534822 - DNA, 25 bp, Homo sapien
ttgtgctgtccttggaattaatctg

SEQ ID NO: 534823 - DNA, 25 bp, Homo sapien
ttggaattaatctggcagcaggagg

SEQ ID NO: 534824 - DNA, 25 bp, Homo sapien
caggagggagcagactatgtaaaca

SEQ ID NO: 534825 - DNA, 25 bp, Homo sapien
gggcttatttctcacggtggcactt

SEQ ID NO: 534826 - DNA, 25 bp, Homo sapien
tatttctcacggtggcacttggcct

SEQ ID NO: 534827 - DNA, 25 bp, Homo sapien
aggaccagctccaagcgctagtgtt

SEQ ID NO: 534828 - DNA, 25 bp, Homo sapien
gaaggagggcacagggtccttccac

SEQ ID NO: 534829 - DNA, 25 bp, Homo sapien
ttccacctccctggaaaggtgcaga

SEQ ID NO: 534830 - DNA, 25 bp, Homo sapien
aaggtgcagaatgagccaggcctaa

SEQ ID NO: 534831 - DNA, 25 bp, Homo sapien
aatgagccaggcctaactacagggc

SEQ ID NO: 534832 - DNA, 25 bp, Homo sapien
gccaggcctaactacagggccatga

SEQ ID NO: 534833 - DNA, 25 bp, Homo sapien
agggccatgagcctctagaagctta

SEQ ID NO: 534834 - DNA, 25 bp, Homo sapien
gccatgagcctctagaagcttaggg

SEQ ID NO: 534835 - DNA, 25 bp, Homo sapien
gaaacactgtgaacttagatatata

SEQ ID NO: 534836 - DNA, 25 bp, Homo sapien
ataaatagagagagacccaagcaat

SEQ ID NO: 534837 - DNA, 25 bp, Homo sapien
gagagagacccaagcaataggccgg

SEQ ID NO: 534838 - DNA, 25 bp, Homo sapien
aataggccgggcctgactcccagac

SEQ ID NO: 534839 - DNA, 25 bp, Homo sapien
aagtatagaaacagcccacctgtgc

SEQ ID NO: 534840 - DNA, 25 bp, Homo sapien
gtgcccactttgaccattggtgagg

SEQ ID NO: 534841 - DNA, 25 bp, Homo sapien
tcacttcttccaacgaagcctaggt

SEQ ID NO: 534842 - DNA, 25 bp, Homo sapien
gaagcctaggtgaaaatctatttat

SEQ ID NO: 534843 - DNA, 25 bp, Homo sapien
tttataaatggaccacaactctggg

SEQ ID NO: 534844 - DNA, 25 bp, Homo sapien
gtgctgtgacttcctaattattgct

SEQ ID NO: 534845 - DNA, 25 bp, Homo sapien
actactgtttagttggtaatggtgt

SEQ ID NO: 534846 - DNA, 25 bp, Homo sapien
gtgtaaaattacattcagctccttc

SEQ ID NO: 534847 - DNA, 25 bp, Homo sapien
cattcagctccttcttgtcatataa

SEQ ID NO: 534848 - DNA, 25 bp, Homo sapien
gaatttggagggtgtcgcttaaaat

SEQ ID NO: 534849 - DNA, 25 bp, Homo sapien
aaattttattccacctgtacatttg

SEQ ID NO: 534850 - DNA, 25 bp, Homo sapien
taattttgtcaagcacagctgtggt

SEQ ID NO: 534851 - DNA, 25 bp, Homo sapien
attttgtcaagcacagctgtggtgg

SEQ ID NO: 534852 - DNA, 25 bp, Homo sapien
ttgtcaagcacagctgtggtgggaa

SEQ ID NO: 534853 - DNA, 25 bp, Homo sapien
agcacagctgtggtgggaagagtta

SEQ ID NO: 534854 - DNA, 25 bp, Homo sapien
aagagttagggccagtgtcttgaaa

SEQ ID NO: 534855 - DNA, 25 bp, Homo sapien
gagttagggccagtgtcttgaaaat

SEQ ID NO: 534856 - DNA, 25 bp, Homo sapien
gttagggccagtgtcttgaaaatca

SEQ ID NO: 534857 - DNA, 25 bp, Homo sapien
ttagggccagtgtcttgaaaatcaa

SEQ ID NO: 534858 - DNA, 25 bp, Homo sapien
agggccagtgtcttgaaaatcaatc

SEQ ID NO: 534859 - DNA, 25 bp, Homo sapien
ggccagtgtcttgaaaatcaatcaa

SEQ ID NO: 534860 - DNA, 25 bp, Homo sapien
caatcaagtagtgaatgtgatctct

SEQ ID NO: 534861 - DNA, 25 bp, Homo sapien
tgttgagtttccgacagggaaagag

SEQ ID NO: 534862 - DNA, 25 bp, Homo sapien
cagggaaagaggattcctccaatgc

SEQ ID NO: 534863 - DNA, 25 bp, Homo sapien
cctagagagaaagcctgagcaggag

SEQ ID NO: 534864 - DNA, 25 bp, Homo sapien
gggaagggccctgtggtgccgccgc

SEQ ID NO: 534865 - DNA, 25 bp, Homo sapien
ttccttcagcctccgaagggtgatg

SEQ ID NO: 534866 - DNA, 25 bp, Homo sapien
tcagcctccgaagggtgatggaaat

SEQ ID NO: 534867 - DNA, 25 bp, Homo sapien
cttcccagcattgagcccttggttg

SEQ ID NO: 534868 - DNA, 25 bp, Homo sapien
agcattgagcccttggttgcctggg

SEQ ID NO: 534869 - DNA, 25 bp, Homo sapien
tgagcccttggttgcctgggcccag

SEQ ID NO: 534870 - DNA, 25 bp, Homo sapien
tttcagtatttgtaagcatttcagc

SEQ ID NO: 534871 - DNA, 25 bp, Homo sapien
gtatttgtaagcatttcagcagaac

SEQ ID NO: 534872 - DNA, 25 bp, Homo sapien
ttttccagccgtctcacagttgacc

SEQ ID NO: 534873 - DNA, 25 bp, Homo sapien
atacaactactgtactctctgcatc

SEQ ID NO: 534874 - DNA, 25 bp, Homo sapien
ctctctgcatctgtacaaagtatga

SEQ ID NO: 534875 - DNA, 25 bp, Homo sapien
aaactgcccaggtagtgtgagatac

SEQ ID NO: 534876 - DNA, 25 bp, Homo sapien
gtgtgagatacgtaatgcatgaatg

SEQ ID NO: 534877 - DNA, 25 bp, Homo sapien
gaatatcctgaaatctgccttctta

SEQ ID NO: 534878 - DNA, 25 bp, Homo sapien
agttgaccccaactttggaactcag

SEQ ID NO: 534879 - DNA, 25 bp, Homo sapien
caactttggaactcagatcatagga

SEQ ID NO: 534880 - DNA, 25 bp, Homo sapien
gatcataggatctcccagaggtttc

SEQ ID NO: 534881 - DNA, 25 bp, Homo sapien
gatctcccagaggtttcaggtgttc

SEQ ID NO: 534882 - DNA, 25 bp, Homo sapien
tcccagaggtttcaggtgttcctaa

SEQ ID NO: 534883 - DNA, 25 bp, Homo sapien
accttacggcgctaatgcattaagt

SEQ ID NO: 534884 - DNA, 25 bp, Homo sapien
aggccttctctccagctggacacaa

SEQ ID NO: 534885 - DNA, 25 bp, Homo sapien
ccagctggacacaaacctcctttga

SEQ ID NO: 534886 - DNA, 25 bp, Homo sapien
aataattgccgttaggcttcacagt

SEQ ID NO: 534887 - DNA, 25 bp, Homo sapien
gcttcacagtagtgctttttccttt

SEQ ID NO: 534888 - DNA, 25 bp, Homo sapien
ggatttgcattttaacctgcatttc

SEQ ID NO: 534889 - DNA, 25 bp, Homo sapien
atgttttctatttccgacaatgcca

SEQ ID NO: 534890 - DNA, 25 bp, Homo sapien
tatttccgacaatgccaggaggctt

SEQ ID NO: 534891 - DNA, 25 bp, Homo sapien
gccaggaggcttcattgacgttgta

SEQ ID NO: 534892 - DNA, 25 bp, Homo sapien
gcattaagttgaagtcgactgccaa

SEQ ID NO: 534893 - DNA, 25 bp, Homo sapien
agttgaagtcgactgccaaagaggc

SEQ ID NO: 534894 - DNA, 25 bp, Homo sapien
gttcaaaaagtgctccatcaggaca

SEQ ID NO: 534895 - DNA, 25 bp, Homo sapien
catcaggacagactgtgaggttctt

SEQ ID NO: 534896 - DNA, 25 bp, Homo sapien
aaggtcttcaatgtaccctgcatac

SEQ ID NO: 534897 - DNA, 25 bp, Homo sapien
gtaccctgcatacgaagttggatca

SEQ ID NO: 534898 - DNA, 25 bp, Homo sapien
gaatgtatattccaatgcggtcact

SEQ ID NO: 534899 - DNA, 25 bp, Homo sapien
caatgcggtcactggttttggaaaa

SEQ ID NO: 534900 - DNA, 25 bp, Homo sapien
aaccatgagtcctgggctaggaatc

SEQ ID NO: 534901 - DNA, 25 bp, Homo sapien
gggctaggaatctggtcacggtatt

SEQ ID NO: 534902 - DNA, 25 bp, Homo sapien
gtcacggtattttggaacctcatcg

SEQ ID NO: 534903 - DNA, 25 bp, Homo sapien
gatcattcataccactgcatgcttg

SEQ ID NO: 534904 - DNA, 25 bp, Homo sapien
acataaactggacccttctgttcaa

SEQ ID NO: 534905 - DNA, 25 bp, Homo sapien
ggctacagaagcttggggccaaccc

SEQ ID NO: 534906 - DNA, 25 bp, Homo sapien
gctacagaagcttggggccaaccct

SEQ ID NO: 534907 - DNA, 25 bp, Homo sapien
ctacagaagcttggggccaaccctg

SEQ ID NO: 534908 - DNA, 25 bp, Homo sapien
cagaagcttggggccaaccctggct

SEQ ID NO: 534909 - DNA, 25 bp, Homo sapien
tcctctttccccagcttctgtctgt

SEQ ID NO: 534910 - DNA, 25 bp, Homo sapien
gcttctgtctgtctcactgtcttcc

SEQ ID NO: 534911 - DNA, 25 bp, Homo sapien
ccagctgaggtgtggccctcaggcc

SEQ ID NO: 534912 - DNA, 25 bp, Homo sapien
gaagactgaggctaggtgccagaat

SEQ ID NO: 534913 - DNA, 25 bp, Homo sapien
aagactgaggctaggtgccagaatg

SEQ ID NO: 534914 - DNA, 25 bp, Homo sapien
agactgaggctaggtgccagaatgg

SEQ ID NO: 534915 - DNA, 25 bp, Homo sapien
gactgaggctaggtgccagaatgga

SEQ ID NO: 534916 - DNA, 25 bp, Homo sapien
aatttgtgacagtggaaaccctgat

SEQ ID NO: 534917 - DNA, 25 bp, Homo sapien
gaaaccctgatatgtgcaactgagc

SEQ ID NO: 534918 - DNA, 25 bp, Homo sapien
gatatgtgcaactgagcttatagaa

SEQ ID NO: 534919 - DNA, 25 bp, Homo sapien
gataccactttaaactgtgcttgta

SEQ ID NO: 534920 - DNA, 25 bp, Homo sapien
gcttgtattcatgtgttgacccttg

SEQ ID NO: 534921 - DNA, 25 bp, Homo sapien
catgtgttgacccttgtcagctggg

SEQ ID NO: 534922 - DNA, 25 bp, Homo sapien
gtcagctgggaaatctgtacattca

SEQ ID NO: 534923 - DNA, 25 bp, Homo sapien
ctgtacattcagtatatgtcagcat

SEQ ID NO: 534924 - DNA, 25 bp, Homo sapien
atgtcagcatttcattggagcctgg

SEQ ID NO: 534925 - DNA, 25 bp, Homo sapien
gggcaacagacaaacttgcttctga

SEQ ID NO: 534926 - DNA, 25 bp, Homo sapien
tgaatttggctgttacattttgtct

SEQ ID NO: 534927 - DNA, 25 bp, Homo sapien
tggatcatggctgacttcctcacta

SEQ ID NO: 534928 - DNA, 25 bp, Homo sapien
ctcactatcctcttcacatgtaact

SEQ ID NO: 534929 - DNA, 25 bp, Homo sapien
gtaacttctgcagacctatcacaag

SEQ ID NO: 534930 - DNA, 25 bp, Homo sapien
acagaaatccctttctctcctgact

SEQ ID NO: 534931 - DNA, 25 bp, Homo sapien
tggataccattctcaacaagtcaat

SEQ ID NO: 534932 - DNA, 25 bp, Homo sapien
agtcaatccaagtcagcccgttaag

SEQ ID NO: 534933 - DNA, 25 bp, Homo sapien
ttaaggttagcggatcatgtacaag

SEQ ID NO: 534934 - DNA, 25 bp, Homo sapien
gaaatcacctacaccagagagccat

SEQ ID NO: 534935 - DNA, 25 bp, Homo sapien
gagccattttggtattttgccttta

SEQ ID NO: 534936 - DNA, 25 bp, Homo sapien
aaaagcctcctttatctggctgtgc

SEQ ID NO: 534937 - DNA, 25 bp, Homo sapien
tgtgcagccttgctctgtggctttt

SEQ ID NO: 534938 - DNA, 25 bp, Homo sapien
acaaaagggcatgatctcttctata

SEQ ID NO: 534939 - DNA, 25 bp, Homo sapien
aagggcatgatctcttctataagaa

SEQ ID NO: 534940 - DNA, 25 bp, Homo sapien
taaaaccatgctgtacactgaagac

SEQ ID NO: 534941 - DNA, 25 bp, Homo sapien
ctgtacactgaagacagcaatatat

SEQ ID NO: 534942 - DNA, 25 bp, Homo sapien
gcatttacttaccaaaacgccacca

SEQ ID NO: 534943 - DNA, 25 bp, Homo sapien
ttacttaccaaaacgccaccatata

SEQ ID NO: 534944 - DNA, 25 bp, Homo sapien
aaacgccaccatataactgtattct

SEQ ID NO: 534945 - DNA, 25 bp, Homo sapien
ataactgtattctcaggtggcaaaa

SEQ ID NO: 534946 - DNA, 25 bp, Homo sapien
ggcaaaacccagagtcaaacaagat

SEQ ID NO: 534947 - DNA, 25 bp, Homo sapien
gatgtggtcatctactcatagtgaa

SEQ ID NO: 534948 - DNA, 25 bp, Homo sapien
ggtcatctactcatagtgaaaaaca

SEQ ID NO: 534949 - DNA, 25 bp, Homo sapien
cggagcacgccatccacaaggtgct

SEQ ID NO: 534950 - DNA, 25 bp, Homo sapien
ggcgcggcgagatccagcatcgcat

SEQ ID NO: 534951 - DNA, 25 bp, Homo sapien
gagatccagcatcgcatgcagcgca

SEQ ID NO: 534952 - DNA, 25 bp, Homo sapien
gatccagcatcgcatgcagcgcaag

SEQ ID NO: 534953 - DNA, 25 bp, Homo sapien
agcatcgcatgcagcgcaaggttct

SEQ ID NO: 534954 - DNA, 25 bp, Homo sapien
gcatgcagcgcaaggttctctaccg

SEQ ID NO: 534955 - DNA, 25 bp, Homo sapien
caaggttctctaccgcctcaagtga

SEQ ID NO: 534956 - DNA, 25 bp, Homo sapien
gttctctaccgcctcaagtgagtcg

SEQ ID NO: 534957 - DNA, 25 bp, Homo sapien
tctctaccgcctcaagtgagtcgcg

SEQ ID NO: 534958 - DNA, 25 bp, Homo sapien
ctgcctgccattgacaatgttgctg

SEQ ID NO: 534959 - DNA, 25 bp, Homo sapien
ccattgacaatgttgctgggacctc

SEQ ID NO: 534960 - DNA, 25 bp, Homo sapien
gttctggcacaggagcatgacgtcc

SEQ ID NO: 534961 - DNA, 25 bp, Homo sapien
atgacgtccttctctaggtcgttga

SEQ ID NO: 534962 - DNA, 25 bp, Homo sapien
ctaggtcgttgaggctgcggtactt

SEQ ID NO: 534963 - DNA, 25 bp, Homo sapien
cggtacttgtggttgcgaatgcgct

SEQ ID NO: 534964 - DNA, 25 bp, Homo sapien
cgaatgcgctcctttatcttcttga

SEQ ID NO: 534965 - DNA, 25 bp, Homo sapien
atcttcttgaagtccacgggcttgc

SEQ ID NO: 534966 - DNA, 25 bp, Homo sapien
aagtccacgggcttgcggatgagct

SEQ ID NO: 534967 - DNA, 25 bp, Homo sapien
gatgagctcgtagtactcgggcagc

SEQ ID NO: 534968 - DNA, 25 bp, Homo sapien
gctcctttcgcgagggcagctggat

SEQ ID NO: 534969 - DNA, 25 bp, Homo sapien
atgaagacctcgctgagctgacgtc

SEQ ID NO: 534970 - DNA, 25 bp, Homo sapien
acggcatccacaatcttcttcatct

SEQ ID NO: 534971 - DNA, 25 bp, Homo sapien
tggatcatggctgacttcctcacta

SEQ ID NO: 534972 - DNA, 25 bp, Homo sapien
cacaagtttacatgtaaccacagaa

SEQ ID NO: 534973 - DNA, 25 bp, Homo sapien
aagtttacatgtaaccacagaaatc

SEQ ID NO: 534974 - DNA, 25 bp, Homo sapien
aatggataccattctcaacaagtca

SEQ ID NO: 534975 - DNA, 25 bp, Homo sapien
tggataccattctcaacaagtcaat

SEQ ID NO: 534976 - DNA, 25 bp, Homo sapien
taccattctcaacaagtcaatccaa

SEQ ID NO: 534977 - DNA, 25 bp, Homo sapien
caagctgagtgtgaaagtagaaatc

SEQ ID NO: 534978 - DNA, 25 bp, Homo sapien
gtagaaatcacctacaccagagagc

SEQ ID NO: 534979 - DNA, 25 bp, Homo sapien
ggctgtgcagccttgctctgtggct

SEQ ID NO: 534980 - DNA, 25 bp, Homo sapien
tgtgcagccttgctctgtggctttt

SEQ ID NO: 534981 - DNA, 25 bp, Homo sapien
gcagccttgctctgtggcttttccc

SEQ ID NO: 534982 - DNA, 25 bp, Homo sapien
tggctgcctgccgaagccctgcgca

SEQ ID NO: 534983 - DNA, 25 bp, Homo sapien
ctgcgcaccctcaggtacttatcgt

SEQ ID NO: 534984 - DNA, 25 bp, Homo sapien
cctcaggtacttatcgtccgtggaa

SEQ ID NO: 534985 - DNA, 25 bp, Homo sapien
tcaggtacttatcgtccgtggaaac

SEQ ID NO: 534986 - DNA, 25 bp, Homo sapien
tacttatcgtccgtggaaacccagg

SEQ ID NO: 534987 - DNA, 25 bp, Homo sapien
tatcgtccgtggaaacccaggaagg

SEQ ID NO: 534988 - DNA, 25 bp, Homo sapien
atatgaatttttgttcccgtgagaa

SEQ ID NO: 534989 - DNA, 25 bp, Homo sapien
aacttctggctcttgatcaactcca

SEQ ID NO: 534990 - DNA, 25 bp, Homo sapien
gacaaagtgcatataattggccaca

SEQ ID NO: 534991 - DNA, 25 bp, Homo sapien
gtgcatataattggccacattcccc

SEQ ID NO: 534992 - DNA, 25 bp, Homo sapien
tataattggccacattcccccaggg

SEQ ID NO: 534993 - DNA, 25 bp, Homo sapien
tgggcaggcggcatccagacacagt

SEQ ID NO: 534994 - DNA, 25 bp, Homo sapien
tctgagtcacatcacacttcagcac

SEQ ID NO: 534995 - DNA, 25 bp, Homo sapien
gagtcacatcacacttcagcacctg

SEQ ID NO: 534996 - DNA, 25 bp, Homo sapien
tgcttgaccgcctgtctcaacttct

SEQ ID NO: 534997 - DNA, 25 bp, Homo sapien
ttctctggacccttgactctgttcc

SEQ ID NO: 534998 - DNA, 25 bp, Homo sapien
tgactctgttcccttcaagatcaca

SEQ ID NO: 534999 - DNA, 25 bp, Homo sapien
actctgttcccttcaagatcacaca

SEQ ID NO: 535000 - DNA, 25 bp, Homo sapien
agatcacacacataggtcaccactg

SEQ ID NO: 535001 - DNA, 25 bp, Homo sapien
atcacacacataggtcaccactggg

SEQ ID NO: 535002 - DNA, 25 bp, Homo sapien
actggggaccagtcaaaggcctctg

SEQ ID NO: 535003 - DNA, 25 bp, Homo sapien
aaaggcctctggctctttcttcagc

SEQ ID NO: 535004 - DNA, 25 bp, Homo sapien
cagagcaggctgtctcagccttgcc

SEQ ID NO: 535005 - DNA, 25 bp, Homo sapien
gctgtctcagccttgccactgtcgg

SEQ ID NO: 535006 - DNA, 25 bp, Homo sapien
gccttgccactgtcggcatctcggg

SEQ ID NO: 535007 - DNA, 25 bp, Homo sapien
ggcatctcgggctgggtaattctgt

SEQ ID NO: 535008 - DNA, 25 bp, Homo sapien
atctcgggctgggtaattctgttgt

SEQ ID NO: 535009 - DNA, 25 bp, Homo sapien
tctcgggctgggtaattctgttgtg

SEQ ID NO: 535010 - DNA, 25 bp, Homo sapien
ccagttgtgacaatagtctctaaac

SEQ ID NO: 535011 - DNA, 25 bp, Homo sapien
caatagtctctaaacattgtcaaat

SEQ ID NO: 535012 - DNA, 25 bp, Homo sapien
acattgtcaaatggtccaaggaaag

SEQ ID NO: 535013 - DNA, 25 bp, Homo sapien
ataacagtgttgttgattctgattg

SEQ ID NO: 535014 - DNA, 25 bp, Homo sapien
gttgttgattctgattgtgaatccc

SEQ ID NO: 535015 - DNA, 25 bp, Homo sapien
ctgcgcaccctcaggtacttatcgt

SEQ ID NO: 535016 - DNA, 25 bp, Homo sapien
tgcgcaccctcaggtacttatcgtc

SEQ ID NO: 535017 - DNA, 25 bp, Homo sapien
gcgcaccctcaggtacttatcgtcc

SEQ ID NO: 535018 - DNA, 25 bp, Homo sapien
gcaccctcaggtacttatcgtccgt

SEQ ID NO: 535019 - DNA, 25 bp, Homo sapien
caccctcaggtacttatcgtccgtg

SEQ ID NO: 535020 - DNA, 25 bp, Homo sapien
accctcaggtacttatcgtccgtgg

SEQ ID NO: 535021 - DNA, 25 bp, Homo sapien
ccctcaggtacttatcgtccgtgga

SEQ ID NO: 535022 - DNA, 25 bp, Homo sapien
cctcaggtacttatcgtccgtggaa

SEQ ID NO: 535023 - DNA, 25 bp, Homo sapien
ctcaggtacttatcgtccgtggaaa

SEQ ID NO: 535024 - DNA, 25 bp, Homo sapien
tcaggtacttatcgtccgtggaaac

SEQ ID NO: 535025 - DNA, 25 bp, Homo sapien
ggtgccaaggccaagcaaagagttt

SEQ ID NO: 535026 - DNA, 25 bp, Homo sapien
caaggccaagcaaagagtttcagaa

SEQ ID NO: 535027 - DNA, 25 bp, Homo sapien
aaggagcgataacccccagaatgca

SEQ ID NO: 535028 - DNA, 25 bp, Homo sapien
gggcatcattatccggtgcttgaac

SEQ ID NO: 535029 - DNA, 25 bp, Homo sapien
ttttttaggacttgtgaggaacaca

SEQ ID NO: 535030 - DNA, 25 bp, Homo sapien
tgtgaggaacacagcaacggaaatc

SEQ ID NO: 535031 - DNA, 25 bp, Homo sapien
agcaacggaaatccatccacaaagg

SEQ ID NO: 535032 - DNA, 25 bp, Homo sapien
atccacaaaggatgcagtgccccaa

SEQ ID NO: 535033 - DNA, 25 bp, Homo sapien
caaaggatgcagtgccccaacttgt

SEQ ID NO: 535034 - DNA, 25 bp, Homo sapien
ccaacttgtactgcgcctgaatagt

SEQ ID NO: 535035 - DNA, 25 bp, Homo sapien
actgcgcctgaatagtcatgtgata

SEQ ID NO: 535036 - DNA, 25 bp, Homo sapien
gcagggagaaattgacctttgcctt

SEQ ID NO: 535037 - DNA, 25 bp, Homo sapien
gggagaaattgacctttgccttgtc

SEQ ID NO: 535038 - DNA, 25 bp, Homo sapien
agaaattgacctttgccttgtcgcc

SEQ ID NO: 535039 - DNA, 25 bp, Homo sapien
aaattgacctttgccttgtcgccca

SEQ ID NO: 535040 - DNA, 25 bp, Homo sapien
tgacctttgccttgtcgcccaggaa

SEQ ID NO: 535041 - DNA, 25 bp, Homo sapien
cctttgccttgtcgcccaggaagtg

SEQ ID NO: 535042 - DNA, 25 bp, Homo sapien
agtggggctcggcacccataactaa

SEQ ID NO: 535043 - DNA, 25 bp, Homo sapien
tcccacccttggaaaccatgtcttc

SEQ ID NO: 535044 - DNA, 25 bp, Homo sapien
ggtgagatgaccattctgggtctaa

SEQ ID NO: 535045 - DNA, 25 bp, Homo sapien
gatgaccattctgggtctaagactg

SEQ ID NO: 535046 - DNA, 25 bp, Homo sapien
caggcaggagttcctggaccctcag

SEQ ID NO: 535047 - DNA, 25 bp, Homo sapien
cctgcatgccaatggaggcctgtgt

SEQ ID NO: 535048 - DNA, 25 bp, Homo sapien
atggaggcctgtgtcgccgagagtc

SEQ ID NO: 535049 - DNA, 25 bp, Homo sapien
ccgagagtcgcagggctctgtgtcc

SEQ ID NO: 535050 - DNA, 25 bp, Homo sapien
tcggaggcctgcaggactttggcac

SEQ ID NO: 535051 - DNA, 25 bp, Homo sapien
aggactttggcacccgagaaggaca

SEQ ID NO: 535052 - DNA, 25 bp, Homo sapien
ctttggcacccgagaaggacaaggc

SEQ ID NO: 535053 - DNA, 25 bp, Homo sapien
aaggacaaggccaccaagcactgct

SEQ ID NO: 535054 - DNA, 25 bp, Homo sapien
aagcactgctgcattcatctcccgg

SEQ ID NO: 535055 - DNA, 25 bp, Homo sapien
attcatctcccggatgggacatcct

SEQ ID NO: 535056 - DNA, 25 bp, Homo sapien
ggatgggacatcctgcgtggtggct

SEQ ID NO: 535057 - DNA, 25 bp, Homo sapien
gtggctgtcaaggcgggcttctcca

SEQ ID NO: 535058 - DNA, 25 bp, Homo sapien
ttaatttcctctggatagtcaaacc

SEQ ID NO: 535059 - DNA, 25 bp, Homo sapien
tggatagtcaaacctgccagatatc

SEQ ID NO: 535060 - DNA, 25 bp, Homo sapien
aacctgccagatatcaaacctgagg

SEQ ID NO: 535061 - DNA, 25 bp, Homo sapien
aactagggtagagagaggttgctat

SEQ ID NO: 535062 - DNA, 25 bp, Homo sapien
gagaggttgctataaaacgagcatt

SEQ ID NO: 535063 - DNA, 25 bp, Homo sapien
taaaacgagcatttggagggcccac

SEQ ID NO: 535064 - DNA, 25 bp, Homo sapien
acgagcatttggagggcccacggct

SEQ ID NO: 535065 - DNA, 25 bp, Homo sapien
gagggcccacggcttcactcaggac

SEQ ID NO: 535066 - DNA, 25 bp, Homo sapien
tgggcttgtgtaccccaggagccct

SEQ ID NO: 535067 - DNA, 25 bp, Homo sapien
tagacttggaacaatgctaaaggaa

SEQ ID NO: 535068 - DNA, 25 bp, Homo sapien
gctaaaggaaagcatttggcaatat

SEQ ID NO: 535069 - DNA, 25 bp, Homo sapien
gagccttgtagggaggcctctacac

SEQ ID NO: 535070 - DNA, 25 bp, Homo sapien
tagggaggcctctacacagaagaaa

SEQ ID NO: 535071 - DNA, 25 bp, Homo sapien
gggaggcctctacacagaagaaagc

SEQ ID NO: 535072 - DNA, 25 bp, Homo sapien
cagccagcagcacggatgttactgt

SEQ ID NO: 535073 - DNA, 25 bp, Homo sapien
gcagcacggatgttactgtcctgct

SEQ ID NO: 535074 - DNA, 25 bp, Homo sapien
acggatgttactgtcctgctccttc

SEQ ID NO: 535075 - DNA, 25 bp, Homo sapien
gggcaaagggcacgtcccatcactc

SEQ ID NO: 535076 - DNA, 25 bp, Homo sapien
aatgtggcagccactgtgggccagg

SEQ ID NO: 535077 - DNA, 25 bp, Homo sapien
tgtgggccaggctcagggcagggca

SEQ ID NO: 535078 - DNA, 25 bp, Homo sapien
tcagggcagggcaggcgattccagt

SEQ ID NO: 535079 - DNA, 25 bp, Homo sapien
tggcgcctgctgcttactgcagttt

SEQ ID NO: 535080 - DNA, 25 bp, Homo sapien
tttagcttctctcgcagtttagtgg

SEQ ID NO: 535081 - DNA, 25 bp, Homo sapien
cttctctcgcagtttagtggtggta

SEQ ID NO: 535082 - DNA, 25 bp, Homo sapien
tttagtggtggtaagtccaggctgt

SEQ ID NO: 535083 - DNA, 25 bp, Homo sapien
gtccaggctgtagcttctttgcgct

SEQ ID NO: 535084 - DNA, 25 bp, Homo sapien
tgtagcttctttgcgctcctatgtc

SEQ ID NO: 535085 - DNA, 25 bp, Homo sapien
gctcctatgtcccaagaaactgcag

SEQ ID NO: 535086 - DNA, 25 bp, Homo sapien
ccaagaaactgcagcgggcacccgg

SEQ ID NO: 535087 - DNA, 25 bp, Homo sapien
cgggccgtcgggtctgaggtatggg

SEQ ID NO: 535088 - DNA, 25 bp, Homo sapien
gtatgggtcgttgctgagtctctcc

SEQ ID NO: 535089 - DNA, 25 bp, Homo sapien
gcgcgttaccggcagtctgctgtcc

SEQ ID NO: 535090 - DNA, 25 bp, Homo sapien
taaacacgtttagcttctctcgcag

SEQ ID NO: 535091 - DNA, 25 bp, Homo sapien
gaccaggtgtctagaggcaacagtg

SEQ ID NO: 535092 - DNA, 25 bp, Homo sapien
tagaggcaacagtgttctgagcccc

SEQ ID NO: 535093 - DNA, 25 bp, Homo sapien
gcctgaccatcccatgagcagtcca

SEQ ID NO: 535094 - DNA, 25 bp, Homo sapien
gtgcttgggcttctgcggtgaggca

SEQ ID NO: 535095 - DNA, 25 bp, Homo sapien
gggagtctgcttgtcttagatgttg

SEQ ID NO: 535096 - DNA, 25 bp, Homo sapien
gcttgtcttagatgttggtggtgca

SEQ ID NO: 535097 - DNA, 25 bp, Homo sapien
ttagatgttggtggtgcagccccag

SEQ ID NO: 535098 - DNA, 25 bp, Homo sapien
tgcagccccaggaccaagcttaagg

SEQ ID NO: 535099 - DNA, 25 bp, Homo sapien
gccccaggaccaagcttaaggagag

SEQ ID NO: 535100 - DNA, 25 bp, Homo sapien
taaggagaggagagcatctgctctg

SEQ ID NO: 535101 - DNA, 25 bp, Homo sapien
aggagagcatctgctctgagacgga

SEQ ID NO: 535102 - DNA, 25 bp, Homo sapien
tggagcgctccaccagcaccgtgtg

SEQ ID NO: 535103 - DNA, 25 bp, Homo sapien
tggacctgcgggtccgaaaggaact

SEQ ID NO: 535104 - DNA, 25 bp, Homo sapien
ggtccgaaaggaacttgcgcatctg

SEQ ID NO: 535105 - DNA, 25 bp, Homo sapien
aaggaacttgcgcatctgctccagg

SEQ ID NO: 535106 - DNA, 25 bp, Homo sapien
gaacttgcgcatctgctccagggcg

SEQ ID NO: 535107 - DNA, 25 bp, Homo sapien
agcggcaccagcttgcgcaggtgct

SEQ ID NO: 535108 - DNA, 25 bp, Homo sapien
accagcttgcgcaggtgcttctgca

SEQ ID NO: 535109 - DNA, 25 bp, Homo sapien
aggtgcttctgcagcaccgacacgt

SEQ ID NO: 535110 - DNA, 25 bp, Homo sapien
attctgcacggccgacacttccaat

SEQ ID NO: 535111 - DNA, 25 bp, Homo sapien
catggtgtcgcgctcgggaccttcc

SEQ ID NO: 535112 - DNA, 25 bp, Homo sapien
tcgggaccttccaggagcgatgaga

SEQ ID NO: 535113 - DNA, 25 bp, Homo sapien
aggccgtgccctttgccaacgagga

SEQ ID NO: 535114 - DNA, 25 bp, Homo sapien
gaacaagctcacttttgaggtggtc

SEQ ID NO: 535115 - DNA, 25 bp, Homo sapien
tggcgcacaatctcatctacttcgg

SEQ ID NO: 535116 - DNA, 25 bp, Homo sapien
aatctcatctacttcggcttctaca

SEQ ID NO: 535117 - DNA, 25 bp, Homo sapien
cttcggcttctacagcttcagcgag

SEQ ID NO: 535118 - DNA, 25 bp, Homo sapien
ggctcactcgcacactgctgggcat

SEQ ID NO: 535119 - DNA, 25 bp, Homo sapien
aggcctatgaggaccccggtggcaa

SEQ ID NO: 535120 - DNA, 25 bp, Homo sapien
tggcaagaatgtgcggcggtccatc

SEQ ID NO: 535121 - DNA, 25 bp, Homo sapien
gggcacatgatgtccaccatggtgc

SEQ ID NO: 535122 - DNA, 25 bp, Homo sapien
accatggtgctgagccgcaagcagt

SEQ ID NO: 535123 - DNA, 25 bp, Homo sapien
gagccgcaagcagtccgtcttcagt

SEQ ID NO: 535124 - DNA, 25 bp, Homo sapien
aattacctaatgattctcgagtaga

SEQ ID NO: 535125 - DNA, 25 bp, Homo sapien
gagagacgattccacttttcacagt

SEQ ID NO: 535126 - DNA, 25 bp, Homo sapien
cacagtctctaacagtaatccacga

SEQ ID NO: 535127 - DNA, 25 bp, Homo sapien
taatccacgacttcttattctcctt

SEQ ID NO: 535128 - DNA, 25 bp, Homo sapien
tctccttgaaggaaagcccagaaaa

SEQ ID NO: 535129 - DNA, 25 bp, Homo sapien
gaagccaattttcccaggcgagtgc

SEQ ID NO: 535130 - DNA, 25 bp, Homo sapien
tgccctgcatcccttcagaggagtg

SEQ ID NO: 535131 - DNA, 25 bp, Homo sapien
atcccttcagaggagtggcccaatc

SEQ ID NO: 535132 - DNA, 25 bp, Homo sapien
actcagccacacagaagttcttttt

SEQ ID NO: 535133 - DNA, 25 bp, Homo sapien
gttctttttgttcaggacctaactg

SEQ ID NO: 535134 - DNA, 25 bp, Homo sapien
ggacctaactgacgaatgacatttt

SEQ ID NO: 535135 - DNA, 25 bp, Homo sapien
caaagggccaataataacatgctat

SEQ ID NO: 535136 - DNA, 25 bp, Homo sapien
gggccaataataacatgctatagag

SEQ ID NO: 535137 - DNA, 25 bp, Homo sapien
aacatgctatagagagattcaaagg

SEQ ID NO: 535138 - DNA, 25 bp, Homo sapien
gattcaaaggaaaggccagttcaat

SEQ ID NO: 535139 - DNA, 25 bp, Homo sapien
aaggaaaggccagttcaataaagag

SEQ ID NO: 535140 - DNA, 25 bp, Homo sapien
gggcccactcaagacggttttcaag

SEQ ID NO: 535141 - DNA, 25 bp, Homo sapien
ggcccactcaagacggttttcaaga

SEQ ID NO: 535142 - DNA, 25 bp, Homo sapien
gcccactcaagacggttttcaagac

SEQ ID NO: 535143 - DNA, 25 bp, Homo sapien
ccactcaagacggttttcaagacaa

SEQ ID NO: 535144 - DNA, 25 bp, Homo sapien
cactcaagacggttttcaagacaag

SEQ ID NO: 535145 - DNA, 25 bp, Homo sapien
ctcaagacggttttcaagacaagga

SEQ ID NO: 535146 - DNA, 25 bp, Homo sapien
gggaaatattgactggcctgccaga

SEQ ID NO: 535147 - DNA, 25 bp, Homo sapien
actggcctgccagaaacacagaaat

SEQ ID NO: 535148 - DNA, 25 bp, Homo sapien
agaagcatgctggtgaatggtcaaa

SEQ ID NO: 535149 - DNA, 25 bp, Homo sapien
catgctggtgaatggtcaaagtctt

SEQ ID NO: 535150 - DNA, 25 bp, Homo sapien
gtcaaagtctttggcaccttatttc

SEQ ID NO: 535151 - DNA, 25 bp, Homo sapien
tttggcaccttatttcacttctgct

SEQ ID NO: 535152 - DNA, 25 bp, Homo sapien
acttctgctgtgatcaatttcatgc

SEQ ID NO: 535153 - DNA, 25 bp, Homo sapien
aatttcatgctgttgacctgtgtgt

SEQ ID NO: 535154 - DNA, 25 bp, Homo sapien
atgctgttgacctgtgtgtcactta

SEQ ID NO: 535155 - DNA, 25 bp, Homo sapien
gtgtcacttaagctgtgatcccata

SEQ ID NO: 535156 - DNA, 25 bp, Homo sapien
ttaagctgtgatcccataattcttt

SEQ ID NO: 535157 - DNA, 25 bp, Homo sapien
tgctttgttgtggtgtctgctggaa

SEQ ID NO: 535158 - DNA, 25 bp, Homo sapien
gtctgctggaagtctactgccatta

SEQ ID NO: 535159 - DNA, 25 bp, Homo sapien
gtctactgccattatagggaacctt

SEQ ID NO: 535160 - DNA, 25 bp, Homo sapien
gaaccttgcttgttagcttctctag

SEQ ID NO: 535161 - DNA, 25 bp, Homo sapien
tagcttctctagatctctattctaa

SEQ ID NO: 535162 - DNA, 25 bp, Homo sapien
atgataaattctgtaggagggtcta

SEQ ID NO: 535163 - DNA, 25 bp, Homo sapien
ggagggtctattctgagccgttaac

SEQ ID NO: 535164 - DNA, 25 bp, Homo sapien
tctgagccgttaacttcctgtaagg

SEQ ID NO: 535165 - DNA, 25 bp, Homo sapien
ggtgggttaccagaaataccattga

SEQ ID NO: 535166 - DNA, 25 bp, Homo sapien
aaataccattgaagcagggtgggct

SEQ ID NO: 535167 - DNA, 25 bp, Homo sapien
tacgaaacacttttgtacacaactg

SEQ ID NO: 535168 - DNA, 25 bp, Homo sapien
gcgtgtactgaatgccagtctggcc

SEQ ID NO: 535169 - DNA, 25 bp, Homo sapien
gtactgaatgccagtctggccggca

SEQ ID NO: 535170 - DNA, 25 bp, Homo sapien
tggccggcacactcgaacgctaaga

SEQ ID NO: 535171 - DNA, 25 bp, Homo sapien
actcgaacgctaagagaatggtcca

SEQ ID NO: 535172 - DNA, 25 bp, Homo sapien
gagaatggtccaatttgatgatctt

SEQ ID NO: 535173 - DNA, 25 bp, Homo sapien
atcttatttctatttcgatcaggtt

SEQ ID NO: 535174 - DNA, 25 bp, Homo sapien
ttctatttcgatcaggttttgactt

SEQ ID NO: 535175 - DNA, 25 bp, Homo sapien
tagatgaaaactaccagggaaaagg

SEQ ID NO: 535176 - DNA, 25 bp, Homo sapien
tgaaagttaagtccaccaacccttg

SEQ ID NO: 535177 - DNA, 25 bp, Homo sapien
caacccttgggcttaatcaggacgg

SEQ ID NO: 535178 - DNA, 25 bp, Homo sapien
ccttgggcttaatcaggacggaaga

SEQ ID NO: 535179 - DNA, 25 bp, Homo sapien
gtcattagttctgcaatattagctg

SEQ ID NO: 535180 - DNA, 25 bp, Homo sapien
ttagacatttgggttcagttgcttg

SEQ ID NO: 535181 - DNA, 25 bp, Homo sapien
ggttcagttgcttgtagtctgtaaa

SEQ ID NO: 535182 - DNA, 25 bp, Homo sapien
acagcttaatttggtacaggttaca

SEQ ID NO: 535183 - DNA, 25 bp, Homo sapien
gtacaggttacacatatggccattt

SEQ ID NO: 535184 - DNA, 25 bp, Homo sapien
ggccatttatgtaaagtccctctaa

SEQ ID NO: 535185 - DNA, 25 bp, Homo sapien
gtccctctaagactacatacttttt

SEQ ID NO: 535186 - DNA, 25 bp, Homo sapien
cttcttggaagggaacattgatatt

SEQ ID NO: 535187 - DNA, 25 bp, Homo sapien
gttgtaacttaaggtatcttgctac

SEQ ID NO: 535188 - DNA, 25 bp, Homo sapien
taaggtatcttgctacagtagacag

SEQ ID NO: 535189 - DNA, 25 bp, Homo sapien
gacagaattggtaatagcaactttt

SEQ ID NO: 535190 - DNA, 25 bp, Homo sapien
aatactaactgctagaagagaagac

SEQ ID NO: 535191 - DNA, 25 bp, Homo sapien
tactaactgctagaagagaagactc

SEQ ID NO: 535192 - DNA, 25 bp, Homo sapien
agaagactctgggttatactggtgc

SEQ ID NO: 535193 - DNA, 25 bp, Homo sapien
gaagactctgggttatactggtgcg

SEQ ID NO: 535194 - DNA, 25 bp, Homo sapien
aagactctgggttatactggtgcga

SEQ ID NO: 535195 - DNA, 25 bp, Homo sapien
agactctgggttatactggtgcgag

SEQ ID NO: 535196 - DNA, 25 bp, Homo sapien
actctgggttatactggtgcgaggc

SEQ ID NO: 535197 - DNA, 25 bp, Homo sapien
ggttatactggtgcgaggctgccac

SEQ ID NO: 535198 - DNA, 25 bp, Homo sapien
ttatactggtgcgaggctgccacag

SEQ ID NO: 535199 - DNA, 25 bp, Homo sapien
tatactggtgcgaggctgccacaga

SEQ ID NO: 535200 - DNA, 25 bp, Homo sapien
atactggtgcgaggctgccacagag

SEQ ID NO: 535201 - DNA, 25 bp, Homo sapien
gtcttgtcagacctgtagcctggac

SEQ ID NO: 535202 - DNA, 25 bp, Homo sapien
agacctgtagcctggacctcgccgg

SEQ ID NO: 535203 - DNA, 25 bp, Homo sapien
accagggagtgcacgtctgtagatc

SEQ ID NO: 535204 - DNA, 25 bp, Homo sapien
ggagtgcacgtctgtagatctgtac

SEQ ID NO: 535205 - DNA, 25 bp, Homo sapien
atctgtacatatctgggcctttgga

SEQ ID NO: 535206 - DNA, 25 bp, Homo sapien
tacctggtccctttcacagccagga

SEQ ID NO: 535207 - DNA, 25 bp, Homo sapien
tcacagccaggacacgcctggatga

SEQ ID NO: 535208 - DNA, 25 bp, Homo sapien
gacacgcctggatgagaaagcctga

SEQ ID NO: 535209 - DNA, 25 bp, Homo sapien
atccgtcttggtggacacctgtgtg

SEQ ID NO: 535210 - DNA, 25 bp, Homo sapien
gtgtggctctcacctgcgttttgag

SEQ ID NO: 535211 - DNA, 25 bp, Homo sapien
acctgcgttttgagtctgttcttcc

SEQ ID NO: 535212 - DNA, 25 bp, Homo sapien
atgcttcccttgtcactgctgaaga

SEQ ID NO: 535213 - DNA, 25 bp, Homo sapien
tgaagacggctcagaatcaccccat

SEQ ID NO: 535214 - DNA, 25 bp, Homo sapien
aatcaccccatgttggtggagctga

SEQ ID NO: 535215 - DNA, 25 bp, Homo sapien
gggagacgtacaatggacacctggt

SEQ ID NO: 535216 - DNA, 25 bp, Homo sapien
ggacacctggtgagctgcgacaact

SEQ ID NO: 535217 - DNA, 25 bp, Homo sapien
gagctgcgacaactggatgaacatt

SEQ ID NO: 535218 - DNA, 25 bp, Homo sapien
ctggatgaacattaacctgcgagaa

SEQ ID NO: 535219 - DNA, 25 bp, Homo sapien
acctgcgagaagtcatctgcacgtc

SEQ ID NO: 535220 - DNA, 25 bp, Homo sapien
aagttctggcggatgcccgagtgct

SEQ ID NO: 535221 - DNA, 25 bp, Homo sapien
atgcccgagtgctacatccgcggca

SEQ ID NO: 535222 - DNA, 25 bp, Homo sapien
tacatccgcggcagcaccatcaagt

SEQ ID NO: 535223 - DNA, 25 bp, Homo sapien
gcaagccagcagagttgtcttaaat

SEQ ID NO: 535224 - DNA, 25 bp, Homo sapien
gagttgtcttaaattagtggtggat

SEQ ID NO: 535225 - DNA, 25 bp, Homo sapien
tagaaacttttagtattaccgatgg

SEQ ID NO: 535226 - DNA, 25 bp, Homo sapien
aaactactgttaacactgctaatga

SEQ ID NO: 535227 - DNA, 25 bp, Homo sapien
aatgccctttaactttctaatgatt

SEQ ID NO: 535228 - DNA, 25 bp, Homo sapien
aatataatatgcgtctttttcacaa

SEQ ID NO: 535229 - DNA, 25 bp, Homo sapien
atgcgtctttttcacaatatcctat

SEQ ID NO: 535230 - DNA, 25 bp, Homo sapien
gtctttttcacaatatcctatgatt

SEQ ID NO: 535231 - DNA, 25 bp, Homo sapien
ctatgatttttagactaggctctag

SEQ ID NO: 535232 - DNA, 25 bp, Homo sapien
ctaggctctagtgttcagaattcat

SEQ ID NO: 535233 - DNA, 25 bp, Homo sapien
aacattgttattcttaagccttata

SEQ ID NO: 535234 - DNA, 25 bp, Homo sapien
gaaatccggcatgttcttgtcacac

SEQ ID NO: 535235 - DNA, 25 bp, Homo sapien
ggcatgttcttgtcacactgggtga

SEQ ID NO: 535236 - DNA, 25 bp, Homo sapien
tatcaactatgaagagctcgtccgc

SEQ ID NO: 535237 - DNA, 25 bp, Homo sapien
tcaactatgaagagctcgtccgcat

SEQ ID NO: 535238 - DNA, 25 bp, Homo sapien
gagctcgtccgcatggtgctgaatg

SEQ ID NO: 535239 - DNA, 25 bp, Homo sapien
cgtccgcatggtgctgaatggctga

SEQ ID NO: 535240 - DNA, 25 bp, Homo sapien
gtgtgaattttgtatctagcctaaa

SEQ ID NO: 535241 - DNA, 25 bp, Homo sapien
ttgtatctagcctaaagtttcccta

SEQ ID NO: 535242 - DNA, 25 bp, Homo sapien
taggctttcttgtctcagcaacttt

SEQ ID NO: 535243 - DNA, 25 bp, Homo sapien
ccatcttgtctctcttggatgatgt

SEQ ID NO: 535244 - DNA, 25 bp, Homo sapien
tctctcttggatgatgtttgccgtc

SEQ ID NO: 535245 - DNA, 25 bp, Homo sapien
tgcttcaagaagaaacccggcagaa

SEQ ID NO: 535246 - DNA, 25 bp, Homo sapien
gaaacccggcagaagctcaacgtgt

SEQ ID NO: 535247 - DNA, 25 bp, Homo sapien
ggcagaagctcaacgtgtctacgaa

SEQ ID NO: 535248 - DNA, 25 bp, Homo sapien
aacgtgtctacgaagctgcgccagc

SEQ ID NO: 535249 - DNA, 25 bp, Homo sapien
gtctacgaagctgcgccagctggag

SEQ ID NO: 535250 - DNA, 25 bp, Homo sapien
gaggagcggaacagcctgcaagacc

SEQ ID NO: 535251 - DNA, 25 bp, Homo sapien
aagcagaacctggagcgccacatct

SEQ ID NO: 535252 - DNA, 25 bp, Homo sapien
gcaggactttgccagcaccgtggaa

SEQ ID NO: 535253 - DNA, 25 bp, Homo sapien
cagcaccgtggaagctctggaagag

SEQ ID NO: 535254 - DNA, 25 bp, Homo sapien
aagaggttccagaaggagatcgaga

SEQ ID NO: 535255 - DNA, 25 bp, Homo sapien
gaacctcacccagcagtacgaggag

SEQ ID NO: 535256 - DNA, 25 bp, Homo sapien
aataccatgatagtgacgaggcaac

SEQ ID NO: 535257 - DNA, 25 bp, Homo sapien
gaggcaactgctgcgaggctcctgt

SEQ ID NO: 535258 - DNA, 25 bp, Homo sapien
gaggctcctgtttaatatggccggg

SEQ ID NO: 535259 - DNA, 25 bp, Homo sapien
gaaattcataccgaagtgcagcaag

SEQ ID NO: 535260 - DNA, 25 bp, Homo sapien
gtgcagcaagattgtcattgacttt

SEQ ID NO: 535261 - DNA, 25 bp, Homo sapien
gattcaattaacagcagaccgagtc

SEQ ID NO: 535262 - DNA, 25 bp, Homo sapien
gcagaccgagtcaaaagcttcagtg

SEQ ID NO: 535263 - DNA, 25 bp, Homo sapien
gcttcagtgagttacatctcattca

SEQ ID NO: 535264 - DNA, 25 bp, Homo sapien
ttgggattatcgtcttctaagaggt

SEQ ID NO: 535265 - DNA, 25 bp, Homo sapien
ggttgctaatgcctttcatcttgaa

SEQ ID NO: 535266 - DNA, 25 bp, Homo sapien
gccagtatggcaaaagtaggcatct

SEQ ID NO: 535267 - DNA, 25 bp, Homo sapien
aagtcccagacgctgcccatggagg

SEQ ID NO: 535268 - DNA, 25 bp, Homo sapien
gccgctggatgctaagtccgatgtc

SEQ ID NO: 535269 - DNA, 25 bp, Homo sapien
gatgtcaccaaccagcttgtagatt

SEQ ID NO: 535270 - DNA, 25 bp, Homo sapien
cagcttgtagattttcagtggaaac

SEQ ID NO: 535271 - DNA, 25 bp, Homo sapien
gaaactgggtatggctgtgagctca

SEQ ID NO: 535272 - DNA, 25 bp, Homo sapien
gctgtgagctcagacacttgcagat

SEQ ID NO: 535273 - DNA, 25 bp, Homo sapien
ttgcagatctcttaagtatccttac

SEQ ID NO: 535274 - DNA, 25 bp, Homo sapien
gtatccttacgttgcagtgatgcta

SEQ ID NO: 535275 - DNA, 25 bp, Homo sapien
aagtggcagatcattcaggccaagt

SEQ ID NO: 535276 - DNA, 25 bp, Homo sapien
caggccaagtaaagaccaagtgctt

SEQ ID NO: 535277 - DNA, 25 bp, Homo sapien
gttctctcgagtccgggccgcaagt

SEQ ID NO: 535278 - DNA, 25 bp, Homo sapien
gggtatctatatgaacttgacacag

SEQ ID NO: 535279 - DNA, 25 bp, Homo sapien
gaacttgacacagtattttcagctt

SEQ ID NO: 535280 - DNA, 25 bp, Homo sapien
ttgtattccatactaaagccatgaa

SEQ ID NO: 535281 - DNA, 25 bp, Homo sapien
gaactacacgtaacatcatcatttg

SEQ ID NO: 535282 - DNA, 25 bp, Homo sapien
ttgcacaactccaatgctaaaggtt

SEQ ID NO: 535283 - DNA, 25 bp, Homo sapien
agaggaatcggctctgtatttgcct

SEQ ID NO: 535284 - DNA, 25 bp, Homo sapien
tatggattcctttttaccgtgtcac

SEQ ID NO: 535285 - DNA, 25 bp, Homo sapien
gtgtcacatttactttggtcctcta

SEQ ID NO: 535286 - DNA, 25 bp, Homo sapien
tactttggtcctctatgtatttaaa

SEQ ID NO: 535287 - DNA, 25 bp, Homo sapien
taaatgtttgaagtgccttagactc

SEQ ID NO: 535288 - DNA, 25 bp, Homo sapien
ccttagactcttgccatattttcaa

SEQ ID NO: 535289 - DNA, 25 bp, Homo sapien
gaaatccggcatgttcttgtcacac

SEQ ID NO: 535290 - DNA, 25 bp, Homo sapien
aatccggcatgttcttgtcacactg

SEQ ID NO: 535291 - DNA, 25 bp, Homo sapien
ggcatgttcttgtcacactgggtga

SEQ ID NO: 535292 - DNA, 25 bp, Homo sapien
catgttcttgtcacactgggtgaga

SEQ ID NO: 535293 - DNA, 25 bp, Homo sapien
gttcttgtcacactgggtgagaaga

SEQ ID NO: 535294 - DNA, 25 bp, Homo sapien
tcacactgggtgagaagatgacaga

SEQ ID NO: 535295 - DNA, 25 bp, Homo sapien
cgcatggtgctgaatggctgaggac

SEQ ID NO: 535296 - DNA, 25 bp, Homo sapien
gtgtgaattttgtatctagcctaaa

SEQ ID NO: 535297 - DNA, 25 bp, Homo sapien
ttgtatctagcctaaagtttcccta

SEQ ID NO: 535298 - DNA, 25 bp, Homo sapien
ccatcttgtctctcttggatgatgt

SEQ ID NO: 535299 - DNA, 25 bp, Homo sapien
atcttgtctctcttggatgatgttt

SEQ ID NO: 535300 - DNA, 25 bp, Homo sapien
ggtcccagaaggtcaggcccgtgat

SEQ ID NO: 535301 - DNA, 25 bp, Homo sapien
ggcccgtgatggtgcacttcaaatg

SEQ ID NO: 535302 - DNA, 25 bp, Homo sapien
cttcaaatgcgcaacaagctctttc

SEQ ID NO: 535303 - DNA, 25 bp, Homo sapien
agctctttctttagtaccagggtca

SEQ ID NO: 535304 - DNA, 25 bp, Homo sapien
agggtcatggcgtcgtcggcacact

SEQ ID NO: 535305 - DNA, 25 bp, Homo sapien
gtcggcacactttgtctggatcaag

SEQ ID NO: 535306 - DNA, 25 bp, Homo sapien
agctccgggctacaagtgtccttgg

SEQ ID NO: 535307 - DNA, 25 bp, Homo sapien
gcgggtgaggtctgcagcctaccac

SEQ ID NO: 535308 - DNA, 25 bp, Homo sapien
taccaccgcagctggaggcatgaag

SEQ ID NO: 535309 - DNA, 25 bp, Homo sapien
ggtagctccacgaaggatgccacaa

SEQ ID NO: 535310 - DNA, 25 bp, Homo sapien
aatgctggcattgagcatccgggcc

SEQ ID NO: 535311 - DNA, 25 bp, Homo sapien
gggactgtggtccattgtacaagcc

SEQ ID NO: 535312 - DNA, 25 bp, Homo sapien
ggtccattgtacaagccaagatttc

SEQ ID NO: 535313 - DNA, 25 bp, Homo sapien
caagccaagatttcatctattgaat

SEQ ID NO: 535314 - DNA, 25 bp, Homo sapien
tgaatttgggtacatggactacgcc

SEQ ID NO: 535315 - DNA, 25 bp, Homo sapien
gggtacatggactacgcccaagcaa

SEQ ID NO: 535316 - DNA, 25 bp, Homo sapien
ggactacgcccaagcaaggtttgat

SEQ ID NO: 535317 - DNA, 25 bp, Homo sapien
cgcccaagcaaggtttgatgcctat

SEQ ID NO: 535318 - DNA, 25 bp, Homo sapien
atccacctcatcactggactgcatg

SEQ ID NO: 535319 - DNA, 25 bp, Homo sapien
tctgtgcttcgactactgctcctgt

SEQ ID NO: 535320 - DNA, 25 bp, Homo sapien
aggaggctttgggtggctcactact

SEQ ID NO: 535321 - DNA, 25 bp, Homo sapien
tttgggtggctcactactgaacaca

SEQ ID NO: 535322 - DNA, 25 bp, Homo sapien
tgttctgaaactttcgtgactaata

SEQ ID NO: 535323 - DNA, 25 bp, Homo sapien
tttcgtgactaataccatgcatctg

SEQ ID NO: 535324 - DNA, 25 bp, Homo sapien
gactaataccatgcatctgtgatca

SEQ ID NO: 535325 - DNA, 25 bp, Homo sapien
tgcatctgtgatcaatgaactatgt

SEQ ID NO: 535326 - DNA, 25 bp, Homo sapien
aactatgtggttttgaatcggatgt

SEQ ID NO: 535327 - DNA, 25 bp, Homo sapien
gaatcggatgtagaccattagtact

SEQ ID NO: 535328 - DNA, 25 bp, Homo sapien
gtactactacttgagctaaacttct

SEQ ID NO: 535329 - DNA, 25 bp, Homo sapien
gagctaaacttctgcatggttcata

SEQ ID NO: 535330 - DNA, 25 bp, Homo sapien
aaacttctgcatggttcataatttt

SEQ ID NO: 535331 - DNA, 25 bp, Homo sapien
atatgcatgttatcgtcctttcttc

SEQ ID NO: 535332 - DNA, 25 bp, Homo sapien
catgttatcgtcctttcttccattc

SEQ ID NO: 535333 - DNA, 25 bp, Homo sapien
aagcccctggcctttatcttttcat

SEQ ID NO: 535334 - DNA, 25 bp, Homo sapien
ggatttttccccaatccacagaagg

SEQ ID NO: 535335 - DNA, 25 bp, Homo sapien
ggccccttttcttgcaaaaatctat

SEQ ID NO: 535336 - DNA, 25 bp, Homo sapien
aatagcttccgaaatccatccaggt

SEQ ID NO: 535337 - DNA, 25 bp, Homo sapien
caggtcttttttggtgtgctcaaat

SEQ ID NO: 535338 - DNA, 25 bp, Homo sapien
ggtgtgctcaaattcatgtgatgat

SEQ ID NO: 535339 - DNA, 25 bp, Homo sapien
gtggtgagtattttttctagttcct

SEQ ID NO: 535340 - DNA, 25 bp, Homo sapien
taattctagctcttgccgaatgact

SEQ ID NO: 535341 - DNA, 25 bp, Homo sapien
gccgaatgacttcttggaactgaga

SEQ ID NO: 535342 - DNA, 25 bp, Homo sapien
gaactgagaagcaccatcttgagac

SEQ ID NO: 535343 - DNA, 25 bp, Homo sapien
ccatcttgagacattgctttgctaa

SEQ ID NO: 535344 - DNA, 25 bp, Homo sapien
atggaggaggacgagctcccctcgt

SEQ ID NO: 535345 - DNA, 25 bp, Homo sapien
aggaggacgagctcccctcgtggat

SEQ ID NO: 535346 - DNA, 25 bp, Homo sapien
agctcccctcgtggatcatcaagga

SEQ ID NO: 535347 - DNA, 25 bp, Homo sapien
tcccctcgtggatcatcaaggacga

SEQ ID NO: 535348 - DNA, 25 bp, Homo sapien
cgtggatcatcaaggacgacgcgga

SEQ ID NO: 535349 - DNA, 25 bp, Homo sapien
aggtggagcggctgacctgtgagga

SEQ ID NO: 535350 - DNA, 25 bp, Homo sapien
tcccgccaccgcaaggaggtggact

SEQ ID NO: 535351 - DNA, 25 bp, Homo sapien
aggtggactacagcgactcactgac

SEQ ID NO: 535352 - DNA, 25 bp, Homo sapien
gactacagcgactcactgacggaga

SEQ ID NO: 535353 - DNA, 25 bp, Homo sapien
tacagcgactcactgacggagaagc

SEQ ID NO: 535354 - DNA, 25 bp, Homo sapien
agcgactcactgacggagaagcagt

SEQ ID NO: 535355 - DNA, 25 bp, Homo sapien
gttccccagctgcttccaaaattct

SEQ ID NO: 535356 - DNA, 25 bp, Homo sapien
gcttccaaaattctcgcaggttctt

SEQ ID NO: 535357 - DNA, 25 bp, Homo sapien
aaattctcgcaggttcttgaactca

SEQ ID NO: 535358 - DNA, 25 bp, Homo sapien
aggttcttgaactcattgctgcgat

SEQ ID NO: 535359 - DNA, 25 bp, Homo sapien
tgaactcattgctgcgatcgatctc

SEQ ID NO: 535360 - DNA, 25 bp, Homo sapien
attgctgcgatcgatctcctgggcc

SEQ ID NO: 535361 - DNA, 25 bp, Homo sapien
ctcctgaaggaacttagccatggtc

SEQ ID NO: 535362 - DNA, 25 bp, Homo sapien
aggaacttagccatggtctgacgaa

SEQ ID NO: 535363 - DNA, 25 bp, Homo sapien
ttagccatggtctgacgaagctgcc

SEQ ID NO: 535364 - DNA, 25 bp, Homo sapien
gcccgctgggaaacgaagccggcaa

SEQ ID NO: 535365 - DNA, 25 bp, Homo sapien
agtcgcagtcgccatctctgccatg

SEQ ID NO: 535366 - DNA, 25 bp, Homo sapien
tctgctccccttactattctggcaa

SEQ ID NO: 535367 - DNA, 25 bp, Homo sapien
tcaacaagttccagccgttcaacgt

SEQ ID NO: 535368 - DNA, 25 bp, Homo sapien
aagttccagccgttcaacgtggctg

SEQ ID NO: 535369 - DNA, 25 bp, Homo sapien
cgttcaacgtggctgtttctagcaa

SEQ ID NO: 535370 - DNA, 25 bp, Homo sapien
aacgtggctgtttctagcaacgtgc

SEQ ID NO: 535371 - DNA, 25 bp, Homo sapien
tggctgtttctagcaacgtgctgtt

SEQ ID NO: 535372 - DNA, 25 bp, Homo sapien
ttctagcaacgtgctgttcctgctg

SEQ ID NO: 535373 - DNA, 25 bp, Homo sapien
atctaccagagcctgttcctgcggg

SEQ ID NO: 535374 - DNA, 25 bp, Homo sapien
tgccatctctgcaggacatcgacgc

SEQ ID NO: 535375 - DNA, 25 bp, Homo sapien
atctctgcaggacatcgacgcacag

SEQ ID NO: 535376 - DNA, 25 bp, Homo sapien
atcgacgcacagatggactaccagc

SEQ ID NO: 535377 - DNA, 25 bp, Homo sapien
gacattgttaccattcgtcttccaa

SEQ ID NO: 535378 - DNA, 25 bp, Homo sapien
tgttaccattcgtcttccaaattta

SEQ ID NO: 535379 - DNA, 25 bp, Homo sapien
agacaactgaatgaaaagccaattt

SEQ ID NO: 535380 - DNA, 25 bp, Homo sapien
caggatatacaactgcatacaattt

SEQ ID NO: 535381 - DNA, 25 bp, Homo sapien
gcctgttagcaggaaaatagtccct

SEQ ID NO: 535382 - DNA, 25 bp, Homo sapien
aatagtccctatttatctgctaatg

SEQ ID NO: 535383 - DNA, 25 bp, Homo sapien
gtccctatttatctgctaatggtca

SEQ ID NO: 535384 - DNA, 25 bp, Homo sapien
atctgctaatggtcaaaaagagtta

SEQ ID NO: 535385 - DNA, 25 bp, Homo sapien
aggatataaatcgtaccaaaatgtt

SEQ ID NO: 535386 - DNA, 25 bp, Homo sapien
accaaaatgtttccaatcactcaga

SEQ ID NO: 535387 - DNA, 25 bp, Homo sapien
gtttccaatcactcagaaaaactga

SEQ ID NO: 535388 - DNA, 25 bp, Homo sapien
ccatcttgctccagggctacaacaa

SEQ ID NO: 535389 - DNA, 25 bp, Homo sapien
gccctgggggttcttatctatgaaa

SEQ ID NO: 535390 - DNA, 25 bp, Homo sapien
ttatctatgaaatggccgctggcta

SEQ ID NO: 535391 - DNA, 25 bp, Homo sapien
atgaaatggccgctggctacccgcc

SEQ ID NO: 535392 - DNA, 25 bp, Homo sapien
atctatgagaagatcgtctctggga

SEQ ID NO: 535393 - DNA, 25 bp, Homo sapien
gtctctgggaaggtgaggtccggat

SEQ ID NO: 535394 - DNA, 25 bp, Homo sapien
atgtgggacacagccctggaagaaa

SEQ ID NO: 535395 - DNA, 25 bp, Homo sapien
acagccctggaagaaacagaccgtt

SEQ ID NO: 535396 - DNA, 25 bp, Homo sapien
gaagaaacagaccgttccctgctca

SEQ ID NO: 535397 - DNA, 25 bp, Homo sapien
gggagccctgcttgttgtcagaata

SEQ ID NO: 535398 - DNA, 25 bp, Homo sapien
gagccctgcttgttgtcagaataat

SEQ ID NO: 535399 - DNA, 25 bp, Homo sapien
agactccatcgtcttgcagtcggtc

SEQ ID NO: 535400 - DNA, 25 bp, Homo sapien
atcgtcttgcagtcggtcttcacca

SEQ ID NO: 535401 - DNA, 25 bp, Homo sapien
ttgcagtcggtcttcaccagcgtgc

SEQ ID NO: 535402 - DNA, 25 bp, Homo sapien
gaggaaggctccgaatccgaatctc

SEQ ID NO: 535403 - DNA, 25 bp, Homo sapien
gaaggctccgaatccgaatctcggt

SEQ ID NO: 535404 - DNA, 25 bp, Homo sapien
gaatccgaatctcggtccgtcaaag

SEQ ID NO: 535405 - DNA, 25 bp, Homo sapien
tccgaatctcggtccgtcaaagtga

SEQ ID NO: 535406 - DNA, 25 bp, Homo sapien
tctcggtccgtcaaagtgaagatca

SEQ ID NO: 535407 - DNA, 25 bp, Homo sapien
aagtgaagatcaagcttggccggaa

SEQ ID NO: 535408 - DNA, 25 bp, Homo sapien
tgaagatcaagcttggccggaagga

SEQ ID NO: 535409 - DNA, 25 bp, Homo sapien
gtcccgagccaagccggtcgtgagt

SEQ ID NO: 535410 - DNA, 25 bp, Homo sapien
tacacacccacaaaaatgctcatga

SEQ ID NO: 535411 - DNA, 25 bp, Homo sapien
aaaatgctcatgaacccaatccgga

SEQ ID NO: 535412 - DNA, 25 bp, Homo sapien
tgctcatgaacccaatccggagaag

SEQ ID NO: 535413 - DNA, 25 bp, Homo sapien
gaacccaatccggagaaggttccag

SEQ ID NO: 535414 - DNA, 25 bp, Homo sapien
tctcccctttactctttgggtggtg

SEQ ID NO: 535415 - DNA, 25 bp, Homo sapien
ttactctttgggtggtgttgctttt

SEQ ID NO: 535416 - DNA, 25 bp, Homo sapien
gtattttactgatatcaccaggata

SEQ ID NO: 535417 - DNA, 25 bp, Homo sapien
atatcaccaggatagtttactctcc

SEQ ID NO: 535418 - DNA, 25 bp, Homo sapien
ggatagtttactctccttctagctt

SEQ ID NO: 535419 - DNA, 25 bp, Homo sapien
agtttactctccttctagctttctg

SEQ ID NO: 535420 - DNA, 25 bp, Homo sapien
ccgcacactggataacacacacata

SEQ ID NO: 535421 - DNA, 25 bp, Homo sapien
taatgcttcacatccgtgttttctg

SEQ ID NO: 535422 - DNA, 25 bp, Homo sapien
ttttctgttgccctcaccttctata

SEQ ID NO: 535423 - DNA, 25 bp, Homo sapien
tctatactcccctcttgcactgaga

SEQ ID NO: 535424 - DNA, 25 bp, Homo sapien
cacacccagcagctaatgttcactg

SEQ ID NO: 535425 - DNA, 25 bp, Homo sapien
gctaatgttcactgcccagagcaag

SEQ ID NO: 535426 - DNA, 25 bp, Homo sapien
aaggagttgtcagccttacctctct

SEQ ID NO: 535427 - DNA, 25 bp, Homo sapien
accggaaggcagtgatcaagaacgc

SEQ ID NO: 535428 - DNA, 25 bp, Homo sapien
gtctgaggacatgcaacaggatgcc

SEQ ID NO: 535429 - DNA, 25 bp, Homo sapien
aacaggatgccgttgactgcgccac

SEQ ID NO: 535430 - DNA, 25 bp, Homo sapien
actgcgccacgcaggccatggagaa

SEQ ID NO: 535431 - DNA, 25 bp, Homo sapien
ggacattgctgcctatatcaagaag

SEQ ID NO: 535432 - DNA, 25 bp, Homo sapien
gccctgggggttcttatctatgaaa

SEQ ID NO: 535433 - DNA, 25 bp, Homo sapien
atgaaatggccgctggctacccgcc

SEQ ID NO: 535434 - DNA, 25 bp, Homo sapien
tgaaatggccgctggctacccgccc

SEQ ID NO: 535435 - DNA, 25 bp, Homo sapien
gaaatggccgctggctacccgccct

SEQ ID NO: 535436 - DNA, 25 bp, Homo sapien
aatggccgctggctacccgcccttc

SEQ ID NO: 535437 - DNA, 25 bp, Homo sapien
atggccgctggctacccgcccttct

SEQ ID NO: 535438 - DNA, 25 bp, Homo sapien
tggccgctggctacccgcccttctt

SEQ ID NO: 535439 - DNA, 25 bp, Homo sapien
tggctacccgcccttcttcgcagac

SEQ ID NO: 535440 - DNA, 25 bp, Homo sapien
tacccgcccttcttcgcagaccagc

SEQ ID NO: 535441 - DNA, 25 bp, Homo sapien
cgcccttcttcgcagaccagcccat

SEQ ID NO: 535442 - DNA, 25 bp, Homo sapien
gcccttcttcgcagaccagcccatc

SEQ ID NO: 535443 - DNA, 25 bp, Homo sapien
atggctttcatgatcagccgcgaaa

SEQ ID NO: 535444 - DNA, 25 bp, Homo sapien
agccgcgaaactgagaacgtcaagt

SEQ ID NO: 535445 - DNA, 25 bp, Homo sapien
aacgtcaagtccagcgaggagattg

SEQ ID NO: 535446 - DNA, 25 bp, Homo sapien
agcgaggagattgagagcgccttcc

SEQ ID NO: 535447 - DNA, 25 bp, Homo sapien
cagagggaaagccttacgtgaccaa

SEQ ID NO: 535448 - DNA, 25 bp, Homo sapien
aaagccttacgtgaccaaggaggag

SEQ ID NO: 535449 - DNA, 25 bp, Homo sapien
tgacccgggaacaagccgactactg

SEQ ID NO: 535450 - DNA, 25 bp, Homo sapien
gactactgcgtctcccacatgaagc

SEQ ID NO: 535451 - DNA, 25 bp, Homo sapien
acatgaagccctacgtggacggcaa

SEQ ID NO: 535452 - DNA, 25 bp, Homo sapien
acccgctcgcttttcgtgaactgag

SEQ ID NO: 535453 - DNA, 25 bp, Homo sapien
gtgaactgagccactccctgggtca

SEQ ID NO: 535454 - DNA, 25 bp, Homo sapien
gtattcccagaaatgagctcccttt

SEQ ID NO: 535455 - DNA, 25 bp, Homo sapien
gctccctttccttagcttagaagaa

SEQ ID NO: 535456 - DNA, 25 bp, Homo sapien
gattatatccaggacatcatgttca

SEQ ID NO: 535457 - DNA, 25 bp, Homo sapien
atcatgttcagaaaacttagtttac

SEQ ID NO: 535458 - DNA, 25 bp, Homo sapien
agcatagaatgcattactgttggaa

SEQ ID NO: 535459 - DNA, 25 bp, Homo sapien
actgttggaataattggcctctagc

SEQ ID NO: 535460 - DNA, 25 bp, Homo sapien
ggaataattggcctctagctcttaa

SEQ ID NO: 535461 - DNA, 25 bp, Homo sapien
tggcctctagctcttaaatgtctct

SEQ ID NO: 535462 - DNA, 25 bp, Homo sapien
tctagctcttaaatgtctctgataa

SEQ ID NO: 535463 - DNA, 25 bp, Homo sapien
atagagtgcaactacttttgtgtaa

SEQ ID NO: 535464 - DNA, 25 bp, Homo sapien
ttagtatttcatatcagcacatcga

SEQ ID NO: 535465 - DNA, 25 bp, Homo sapien
acagtgtaaacatatcccagatgaa

SEQ ID NO: 535466 - DNA, 25 bp, Homo sapien
acatatcccagatgaaaactgctgt

SEQ ID NO: 535467 - DNA, 25 bp, Homo sapien
atcccagatgaaaactgctgtatgg

SEQ ID NO: 535468 - DNA, 25 bp, Homo sapien
aaagtaactgattgacactgttgat

SEQ ID NO: 535469 - DNA, 25 bp, Homo sapien
aactgattgacactgttgattcaca

SEQ ID NO: 535470 - DNA, 25 bp, Homo sapien
ctttcctctgctcactttaagaact

SEQ ID NO: 535471 - DNA, 25 bp, Homo sapien
ttcctctgctcactttaagaacttt

SEQ ID NO: 535472 - DNA, 25 bp, Homo sapien
attatatttaagatgctcaacaaga

SEQ ID NO: 535473 - DNA, 25 bp, Homo sapien
aattacttctttattgacttgtcca

SEQ ID NO: 535474 - DNA, 25 bp, Homo sapien
ttacttctttattgacttgtccaaa

SEQ ID NO: 535475 - DNA, 25 bp, Homo sapien
tctttattgacttgtccaaatttca

SEQ ID NO: 535476 - DNA, 25 bp, Homo sapien
taggaaatcccccagtaccttcaga

SEQ ID NO: 535477 - DNA, 25 bp, Homo sapien
ccccagtaccttcagatgataagat

SEQ ID NO: 535478 - DNA, 25 bp, Homo sapien
atttttgcatgtggtatgatttctg

SEQ ID NO: 535479 - DNA, 25 bp, Homo sapien
ggtatgatttctgtgcttcacacat

SEQ ID NO: 535480 - DNA, 25 bp, Homo sapien
atgatttctgtgcttcacacatgct

SEQ ID NO: 535481 - DNA, 25 bp, Homo sapien
atttctgtgcttcacacatgctcgt

SEQ ID NO: 535482 - DNA, 25 bp, Homo sapien
tgtgcttcacacatgctcgtgcagg

SEQ ID NO: 535483 - DNA, 25 bp, Homo sapien
ttcacacatgctcgtgcaggctaaa

SEQ ID NO: 535484 - DNA, 25 bp, Homo sapien
acatgctcgtgcaggctaaaagttg

SEQ ID NO: 535485 - DNA, 25 bp, Homo sapien
ggtttgctgcacgagtttttcaata

SEQ ID NO: 535486 - DNA, 25 bp, Homo sapien
tgctgcacgagtttttcaataaaat

SEQ ID NO: 535487 - DNA, 25 bp, Homo sapien
gattctggaggccaagcacttgaag

SEQ ID NO: 535488 - DNA, 25 bp, Homo sapien
gaggccaagcacttgaagctccaac

SEQ ID NO: 535489 - DNA, 25 bp, Homo sapien
aagcacttgaagctccaactcaggg

SEQ ID NO: 535490 - DNA, 25 bp, Homo sapien
tgaagctccaactcagggctgcgct

SEQ ID NO: 535491 - DNA, 25 bp, Homo sapien
ccaactcagggctgcgcttaaggac

SEQ ID NO: 535492 - DNA, 25 bp, Homo sapien
gaggctgccacagagtcttctcttc

SEQ ID NO: 535493 - DNA, 25 bp, Homo sapien
ccacagagtcttctcttctagcagt

SEQ ID NO: 535494 - DNA, 25 bp, Homo sapien
cttctagcagttagtatttggtact

SEQ ID NO: 535495 - DNA, 25 bp, Homo sapien
tttggtacttcagaggatgtgttcc

SEQ ID NO: 535496 - DNA, 25 bp, Homo sapien
tgtgttcctgcctcgcagggtcttg

SEQ ID NO: 535497 - DNA, 25 bp, Homo sapien
ctcgcagggtcttgcagctttactt

SEQ ID NO: 535498 - DNA, 25 bp, Homo sapien
ccaaattcctcttgtgatctcctca

SEQ ID NO: 535499 - DNA, 25 bp, Homo sapien
aaattcctcttgtgatctcctcacc

SEQ ID NO: 535500 - DNA, 25 bp, Homo sapien
tccattgataccaactctttccctt

SEQ ID NO: 535501 - DNA, 25 bp, Homo sapien
ttgataccaactctttcccttcatt

SEQ ID NO: 535502 - DNA, 25 bp, Homo sapien
caacatcctgttgctctaactggag

SEQ ID NO: 535503 - DNA, 25 bp, Homo sapien
cctgttgctctaactggagcacatt

SEQ ID NO: 535504 - DNA, 25 bp, Homo sapien
ggagcacattcacttacgaacacca

SEQ ID NO: 535505 - DNA, 25 bp, Homo sapien
gcacattcacttacgaacaccagga

SEQ ID NO: 535506 - DNA, 25 bp, Homo sapien
acaccaggaaaccacagggcccttg

SEQ ID NO: 535507 - DNA, 25 bp, Homo sapien
ccaggaaaccacagggcccttgtcg

SEQ ID NO: 535508 - DNA, 25 bp, Homo sapien
ttcccttatttaggagccctgaact

SEQ ID NO: 535509 - DNA, 25 bp, Homo sapien
gcagcacttcttgggaggcctggtc

SEQ ID NO: 535510 - DNA, 25 bp, Homo sapien
agcacttcttgggaggcctggtcac

SEQ ID NO: 535511 - DNA, 25 bp, Homo sapien
cacttcttgggaggcctggtcacca

SEQ ID NO: 535512 - DNA, 25 bp, Homo sapien
ttcttgggaggcctggtcaccacag

SEQ ID NO: 535513 - DNA, 25 bp, Homo sapien
ttgggaggcctggtcaccacagtca

SEQ ID NO: 535514 - DNA, 25 bp, Homo sapien
gaggcctggtcaccacagtcacctt

SEQ ID NO: 535515 - DNA, 25 bp, Homo sapien
accttcactgggatgatgcgctgca

SEQ ID NO: 535516 - DNA, 25 bp, Homo sapien
ttcactgggatgatgcgctgcagcc

SEQ ID NO: 535517 - DNA, 25 bp, Homo sapien
cactgggatgatgcgctgcagccag

SEQ ID NO: 535518 - DNA, 25 bp, Homo sapien
tgggatgatgcgctgcagccagctg

SEQ ID NO: 535519 - DNA, 25 bp, Homo sapien
aggccacacactacagccttctggc

SEQ ID NO: 535520 - DNA, 25 bp, Homo sapien
tatactgtttagagcttaaagctac

SEQ ID NO: 535521 - DNA, 25 bp, Homo sapien
gctacagaagcattgttaggaattg

SEQ ID NO: 535522 - DNA, 25 bp, Homo sapien
ttgttaggaattgcttggacactga

SEQ ID NO: 535523 - DNA, 25 bp, Homo sapien
aactttttgacattgttaacaagca

SEQ ID NO: 535524 - DNA, 25 bp, Homo sapien
gacattgttaacaagcatgttcatc

SEQ ID NO: 535525 - DNA, 25 bp, Homo sapien
gcatgttcatcttttcttgtcacta

SEQ ID NO: 535526 - DNA, 25 bp, Homo sapien
tgttcatcttttcttgtcactagtc

SEQ ID NO: 535527 - DNA, 25 bp, Homo sapien
ggctttgtatatgttaacctgtttt

SEQ ID NO: 535528 - DNA, 25 bp, Homo sapien
tgttaacctgttttaatgccaaaag

SEQ ID NO: 535529 - DNA, 25 bp, Homo sapien
ccaaaagtttgctttgtccacaatt

SEQ ID NO: 535530 - DNA, 25 bp, Homo sapien
ttgccttaatgaatactgttgggaa

SEQ ID NO: 535531 - DNA, 25 bp, Homo sapien
caggccctcctttcttgggtgtcaa

SEQ ID NO: 535532 - DNA, 25 bp, Homo sapien
ggccctcctttcttgggtgtcaaat

SEQ ID NO: 535533 - DNA, 25 bp, Homo sapien
ccctcctttcttgggtgtcaaatga

SEQ ID NO: 535534 - DNA, 25 bp, Homo sapien
tgtgtcctggacatctgatgcacca

SEQ ID NO: 535535 - DNA, 25 bp, Homo sapien
gtcctggacatctgatgcaccacct

SEQ ID NO: 535536 - DNA, 25 bp, Homo sapien
agaagcccatcctcagaagactgga

SEQ ID NO: 535537 - DNA, 25 bp, Homo sapien
tgattgaggaatgcatgggcaccgt

SEQ ID NO: 535538 - DNA, 25 bp, Homo sapien
tgtgctccatcacaaacacctctca

SEQ ID NO: 535539 - DNA, 25 bp, Homo sapien
acacctctcagaaacaacgtgggat

SEQ ID NO: 535540 - DNA, 25 bp, Homo sapien
aaagcaagacagttcatacagtatg

SEQ ID NO: 535541 - DNA, 25 bp, Homo sapien
gttcatacagtatgatgccattttt

SEQ ID NO: 535542 - DNA, 25 bp, Homo sapien
aatcactgtctttaccagtgagtac

SEQ ID NO: 535543 - DNA, 25 bp, Homo sapien
actgtctttaccagtgagtacaaaa

SEQ ID NO: 535544 - DNA, 25 bp, Homo sapien
taatttttccagaagtttagtgcgt

SEQ ID NO: 535545 - DNA, 25 bp, Homo sapien
gaagtttagtgcgtttcttttccat

SEQ ID NO: 535546 - DNA, 25 bp, Homo sapien
gtttagtgcgtttcttttccatact

SEQ ID NO: 535547 - DNA, 25 bp, Homo sapien
gaagagaacttaatggcaaataaac

SEQ ID NO: 535548 - DNA, 25 bp, Homo sapien
aacaacaaaccaggacatgcatttt

SEQ ID NO: 535549 - DNA, 25 bp, Homo sapien
aaaccaggacatgcattttaatacc

SEQ ID NO: 535550 - DNA, 25 bp, Homo sapien
caggacatgcattttaataccctaa

SEQ ID NO: 535551 - DNA, 25 bp, Homo sapien
tggaaccctcaaatataactcctcc

SEQ ID NO: 535552 - DNA, 25 bp, Homo sapien
accaccctaatgtgcctcagtctgg

SEQ ID NO: 535553 - DNA, 25 bp, Homo sapien
ttcaaaagtgctccagaaaggccgg

SEQ ID NO: 535554 - DNA, 25 bp, Homo sapien
aaagtgctccagaaaggccggaata

SEQ ID NO: 535555 - DNA, 25 bp, Homo sapien
ccagaaaggccggaatagtcatgta

SEQ ID NO: 535556 - DNA, 25 bp, Homo sapien
aggccggaatagtcatgtagtggat

SEQ ID NO: 535557 - DNA, 25 bp, Homo sapien
taagatttaattagtcacggctgct

SEQ ID NO: 535558 - DNA, 25 bp, Homo sapien
gatttaattagtcacggctgctacg

SEQ ID NO: 535559 - DNA, 25 bp, Homo sapien
acggctgctacgtgtatctgatgta

SEQ ID NO: 535560 - DNA, 25 bp, Homo sapien
atctgatgtagttaaccatggcctg

SEQ ID NO: 535561 - DNA, 25 bp, Homo sapien
gatgtagttaaccatggcctgtcat

SEQ ID NO: 535562 - DNA, 25 bp, Homo sapien
gttaaccatggcctgtcatgattat

SEQ ID NO: 535563 - DNA, 25 bp, Homo sapien
ggcctgtcatgattatattgctata

SEQ ID NO: 535564 - DNA, 25 bp, Homo sapien
caacagaagtaaatttggcatctat

SEQ ID NO: 535565 - DNA, 25 bp, Homo sapien
tatatcaatatagcatctctttaat

SEQ ID NO: 535566 - DNA, 25 bp, Homo sapien
tagcatctctttaatgttagtcatt

SEQ ID NO: 535567 - DNA, 25 bp, Homo sapien
gttagtcatttattagaaagatcct

SEQ ID NO: 535568 - DNA, 25 bp, Homo sapien
gaaagatcctttatcctgatttgct

SEQ ID NO: 535569 - DNA, 25 bp, Homo sapien
gatcctttatcctgatttgcttaaa

SEQ ID NO: 535570 - DNA, 25 bp, Homo sapien
ttgcttaaacctttcaataaattgc

SEQ ID NO: 535571 - DNA, 25 bp, Homo sapien
aaaaattcaagtacacacatcagtg

SEQ ID NO: 535572 - DNA, 25 bp, Homo sapien
acacatcagtgttggttactatgca

SEQ ID NO: 535573 - DNA, 25 bp, Homo sapien
tgttggttactatgcagagaatgtc

SEQ ID NO: 535574 - DNA, 25 bp, Homo sapien
agagaatgtcattgtgtatagtttc

SEQ ID NO: 535575 - DNA, 25 bp, Homo sapien
atacttggcaaactcctttgctctg

SEQ ID NO: 535576 - DNA, 25 bp, Homo sapien
tgtcatcctgtgtacccttgtcaat

SEQ ID NO: 535577 - DNA, 25 bp, Homo sapien
gtacccttgtcaatccatggagctg

SEQ ID NO: 535578 - DNA, 25 bp, Homo sapien
ccatggagctggttcactgtaacta

SEQ ID NO: 535579 - DNA, 25 bp, Homo sapien
taactagcaggccacaggaagcaaa

SEQ ID NO: 535580 - DNA, 25 bp, Homo sapien
aagcaaagccttggtgcctgtgagc

SEQ ID NO: 535581 - DNA, 25 bp, Homo sapien
cccaggatggtgactaagtagctta

SEQ ID NO: 535582 - DNA, 25 bp, Homo sapien
gtagcttagctagtgatcagctcat

SEQ ID NO: 535583 - DNA, 25 bp, Homo sapien
gatcagctcatcctttaccataaaa

SEQ ID NO: 535584 - DNA, 25 bp, Homo sapien
tgctgtttagcttgactgttttcct

SEQ ID NO: 535585 - DNA, 25 bp, Homo sapien
aagaacatcgatctgaaggattcat

SEQ ID NO: 535586 - DNA, 25 bp, Homo sapien
ccccagaactgcagcatcatgtaat

SEQ ID NO: 535587 - DNA, 25 bp, Homo sapien
ccagaactgcagcatcatgtaatct

SEQ ID NO: 535588 - DNA, 25 bp, Homo sapien
gaactgcagcatcatgtaatctggg

SEQ ID NO: 535589 - DNA, 25 bp, Homo sapien
actgcagcatcatgtaatctgggac

SEQ ID NO: 535590 - DNA, 25 bp, Homo sapien
tgcagcatcatgtaatctgggacct

SEQ ID NO: 535591 - DNA, 25 bp, Homo sapien
cagcatcatgtaatctgggacctgc

SEQ ID NO: 535592 - DNA, 25 bp, Homo sapien
gcatcatgtaatctgggacctgcca

SEQ ID NO: 535593 - DNA, 25 bp, Homo sapien
catcatgtaatctgggacctgccag

SEQ ID NO: 535594 - DNA, 25 bp, Homo sapien
gtggaggcttcctgcgtcctcctca

SEQ ID NO: 535595 - DNA, 25 bp, Homo sapien
ccctgccctgcacgtcatgggaggg

SEQ ID NO: 535596 - DNA, 25 bp, Homo sapien
tctacagtggttttatactgaagga

SEQ ID NO: 535597 - DNA, 25 bp, Homo sapien
gtggcccctccctgagatggccaga

SEQ ID NO: 535598 - DNA, 25 bp, Homo sapien
agatggccagaaagcccttggcctc

SEQ ID NO: 535599 - DNA, 25 bp, Homo sapien
catcatagcctgtgggaaccaggag

SEQ ID NO: 535600 - DNA, 25 bp, Homo sapien
tgggactgaccaggcagccctagtc

SEQ ID NO: 535601 - DNA, 25 bp, Homo sapien
tttcacccttcatggctgtgggaat

SEQ ID NO: 535602 - DNA, 25 bp, Homo sapien
ctctttttctcccatacagctactg

SEQ ID NO: 535603 - DNA, 25 bp, Homo sapien
tacagctactgccaaaatgcccaaa

SEQ ID NO: 535604 - DNA, 25 bp, Homo sapien
gctactgccaaaatgcccaaacttg

SEQ ID NO: 535605 - DNA, 25 bp, Homo sapien
ggagggcttcccttaccacccagag

SEQ ID NO: 535606 - DNA, 25 bp, Homo sapien
tcccttaccacccagagcagaggag

SEQ ID NO: 535607 - DNA, 25 bp, Homo sapien
ggaggaacctggtggcccctccctg

SEQ ID NO: 535608 - DNA, 25 bp, Homo sapien
cagagcaggctgtctcagccttgcc

SEQ ID NO: 535609 - DNA, 25 bp, Homo sapien
gctgtctcagccttgccactgtcgg

SEQ ID NO: 535610 - DNA, 25 bp, Homo sapien
gccttgccactgtcggcatctcggg

SEQ ID NO: 535611 - DNA, 25 bp, Homo sapien
ggcatctcgggctgggtaattctgt

SEQ ID NO: 535612 - DNA, 25 bp, Homo sapien
tctcgggctgggtaattctgttgtg

SEQ ID NO: 535613 - DNA, 25 bp, Homo sapien
gactgtcctgttccttgtaggatgt

SEQ ID NO: 535614 - DNA, 25 bp, Homo sapien
ccagttgtgacaatagtctctaaac

SEQ ID NO: 535615 - DNA, 25 bp, Homo sapien
caatagtctctaaacattgtcaaat

SEQ ID NO: 535616 - DNA, 25 bp, Homo sapien
acattgtcaaatggtccaaggaaag

SEQ ID NO: 535617 - DNA, 25 bp, Homo sapien
ataacagtgttgttgattctgattg

SEQ ID NO: 535618 - DNA, 25 bp, Homo sapien
tgattctgattgtgaatcccctcaa

SEQ ID NO: 535619 - DNA, 25 bp, Homo sapien
atcgtgggcattgttctcatcatct

SEQ ID NO: 535620 - DNA, 25 bp, Homo sapien
ttgttctcatcatctacttccggaa

SEQ ID NO: 535621 - DNA, 25 bp, Homo sapien
tcatcatctacttccggaagccttg

SEQ ID NO: 535622 - DNA, 25 bp, Homo sapien
cggaagccttgctcaggtgactgat

SEQ ID NO: 535623 - DNA, 25 bp, Homo sapien
ggtgactgattcttccagaccagag

SEQ ID NO: 535624 - DNA, 25 bp, Homo sapien
gaccagagtttgatgccagcagctt

SEQ ID NO: 535625 - DNA, 25 bp, Homo sapien
gtttgatgccagcagcttcggccat

SEQ ID NO: 535626 - DNA, 25 bp, Homo sapien
agcttcggccatccaaacagaggat

SEQ ID NO: 535627 - DNA, 25 bp, Homo sapien
caaacagaggatgctcagatttctc

SEQ ID NO: 535628 - DNA, 25 bp, Homo sapien
cccaggatctcctcttagggtagaa

SEQ ID NO: 535629 - DNA, 25 bp, Homo sapien
tagggtagaagaagtctctgggaca

SEQ ID NO: 535630 - DNA, 25 bp, Homo sapien
gcccaatgtaggtgtagagggacta

SEQ ID NO: 535631 - DNA, 25 bp, Homo sapien
aggtgtagagggactacagccctga

SEQ ID NO: 535632 - DNA, 25 bp, Homo sapien
gggctgctccatgcggcattcttgg

SEQ ID NO: 535633 - DNA, 25 bp, Homo sapien
tgctccatgcggcattcttggaggt

SEQ ID NO: 535634 - DNA, 25 bp, Homo sapien
tccatgcggcattcttggaggtcca

SEQ ID NO: 535635 - DNA, 25 bp, Homo sapien
ccatgcggcattcttggaggtccaa

SEQ ID NO: 535636 - DNA, 25 bp, Homo sapien
catgcggcattcttggaggtccaag

SEQ ID NO: 535637 - DNA, 25 bp, Homo sapien
tgcggcattcttggaggtccaagag

SEQ ID NO: 535638 - DNA, 25 bp, Homo sapien
gggcagcgccaccttgggccaggct

SEQ ID NO: 535639 - DNA, 25 bp, Homo sapien
tcctctccagcagccttggtatggg

SEQ ID NO: 535640 - DNA, 25 bp, Homo sapien
tgggaagacccctgatgcagcctgt

SEQ ID NO: 535641 - DNA, 25 bp, Homo sapien
tttccctcgctatgtgcactgatat

SEQ ID NO: 535642 - DNA, 25 bp, Homo sapien
tcgctatgtgcactgatatgggttt

SEQ ID NO: 535643 - DNA, 25 bp, Homo sapien
actgaagcccatttctccgttgagt

SEQ ID NO: 535644 - DNA, 25 bp, Homo sapien
atttctccgttgagtcatcttgtaa

SEQ ID NO: 535645 - DNA, 25 bp, Homo sapien
atcttgtaatttccagctttctccc

SEQ ID NO: 535646 - DNA, 25 bp, Homo sapien
gctttctccccgctaaggaagatat

SEQ ID NO: 535647 - DNA, 25 bp, Homo sapien
aacccagcagttctgttatatcccc

SEQ ID NO: 535648 - DNA, 25 bp, Homo sapien
agcagttctgttatatcccctgcta

SEQ ID NO: 535649 - DNA, 25 bp, Homo sapien
tcccctgctaccctagatgaattaa

SEQ ID NO: 535650 - DNA, 25 bp, Homo sapien
ggaacttttattagataacacactt

SEQ ID NO: 535651 - DNA, 25 bp, Homo sapien
acacactttttattagataacgctt

SEQ ID NO: 535652 - DNA, 25 bp, Homo sapien
gcaacactgtactcagggcatcctg

SEQ ID NO: 535653 - DNA, 25 bp, Homo sapien
atcctggatgcgagctgatgcccct

SEQ ID NO: 535654 - DNA, 25 bp, Homo sapien
gcaagtcacttgagagtccaatcac

SEQ ID NO: 535655 - DNA, 25 bp, Homo sapien
aaagcaggtcttcatgatcaggtca

SEQ ID NO: 535656 - DNA, 25 bp, Homo sapien
atgatcaggtcaactccgatgcgtt

SEQ ID NO: 535657 - DNA, 25 bp, Homo sapien
tccgatgcgttcagtgtcgtagtac

SEQ ID NO: 535658 - DNA, 25 bp, Homo sapien
gtacgcgtatttcactgtcagaggc

SEQ ID NO: 535659 - DNA, 25 bp, Homo sapien
agaggcgtgaacatcactcccatgg

SEQ ID NO: 535660 - DNA, 25 bp, Homo sapien
gggactcccattaaagtgctgacgt

SEQ ID NO: 535661 - DNA, 25 bp, Homo sapien
acgtaggctttgatgctcatgcggc

SEQ ID NO: 535662 - DNA, 25 bp, Homo sapien
atgcggccgttctggagacttgtgt

SEQ ID NO: 535663 - DNA, 25 bp, Homo sapien
ggctgggctcggtcgggcgctgtct

SEQ ID NO: 535664 - DNA, 25 bp, Homo sapien
tcggctctgcgggtgtcagttcgtc

SEQ ID NO: 535665 - DNA, 25 bp, Homo sapien
tctgcgggtgtcagttcgtccggct

SEQ ID NO: 535666 - DNA, 25 bp, Homo sapien
tgcgggtgtcagttcgtccggcttc

SEQ ID NO: 535667 - DNA, 25 bp, Homo sapien
ggtgtcagttcgtccggcttcctca

SEQ ID NO: 535668 - DNA, 25 bp, Homo sapien
cactcccggcggctgacagcagcag

SEQ ID NO: 535669 - DNA, 25 bp, Homo sapien
gcggcgcctggcgtttcgaggctga

SEQ ID NO: 535670 - DNA, 25 bp, Homo sapien
ctggcgtttcgaggctgagcggcac

SEQ ID NO: 535671 - DNA, 25 bp, Homo sapien
ccgcggcggctgttattgttcggct

SEQ ID NO: 535672 - DNA, 25 bp, Homo sapien
cggctgttattgttcggctgggctc

SEQ ID NO: 535673 - DNA, 25 bp, Homo sapien
ttattgttcggctgggctcggtcgg

SEQ ID NO: 535674 - DNA, 25 bp, Homo sapien
gagcatcgcgcaggagtgaggccca

SEQ ID NO: 535675 - DNA, 25 bp, Homo sapien
agggcaccgcgcaccagagcgtgac

SEQ ID NO: 535676 - DNA, 25 bp, Homo sapien
caccagagcgtgacctcggcaggct

SEQ ID NO: 535677 - DNA, 25 bp, Homo sapien
agacccaccaggctcctaggtttag

SEQ ID NO: 535678 - DNA, 25 bp, Homo sapien
caccaggctcctaggtttagctttt

SEQ ID NO: 535679 - DNA, 25 bp, Homo sapien
aaaccaaaatgtgtgactgggcttt

SEQ ID NO: 535680 - DNA, 25 bp, Homo sapien
ggccttgtgtgctggatttgtagct

SEQ ID NO: 535681 - DNA, 25 bp, Homo sapien
tgtgtgctggatttgtagcttatct

SEQ ID NO: 535682 - DNA, 25 bp, Homo sapien
gtagcttatcttccgtgttgtcttt

SEQ ID NO: 535683 - DNA, 25 bp, Homo sapien
ttatcttccgtgttgtctttggacc

SEQ ID NO: 535684 - DNA, 25 bp, Homo sapien
tccgtgttgtctttggacctgtttt

SEQ ID NO: 535685 - DNA, 25 bp, Homo sapien
atagccctttctatatgaggtttga

SEQ ID NO: 535686 - DNA, 25 bp, Homo sapien
aactgctatgcatagcttgggcaat

SEQ ID NO: 535687 - DNA, 25 bp, Homo sapien
gcttgggcaatagccctaaattgct

SEQ ID NO: 535688 - DNA, 25 bp, Homo sapien
gccctaaattgctatgacaactaat

SEQ ID NO: 535689 - DNA, 25 bp, Homo sapien
gacaactaatgaaccagctacgtat

SEQ ID NO: 535690 - DNA, 25 bp, Homo sapien
cgtatactggtattttaggtgcaag

SEQ ID NO: 535691 - DNA, 25 bp, Homo sapien
atatctgtgtattctgcttggttaa

SEQ ID NO: 535692 - DNA, 25 bp, Homo sapien
aatgtatatttgtagccctttcctg

SEQ ID NO: 535693 - DNA, 25 bp, Homo sapien
tgtagccctttcctgcaatagcatt

SEQ ID NO: 535694 - DNA, 25 bp, Homo sapien
cctgcaatagcattcaagttgttgt

SEQ ID NO: 535695 - DNA, 25 bp, Homo sapien
atagcaacgtttatggatatcacaa

SEQ ID NO: 535696 - DNA, 25 bp, Homo sapien
atgttaaggctattggaaagtccaa

SEQ ID NO: 535697 - DNA, 25 bp, Homo sapien
atttaaatgacaaggttactgacca

SEQ ID NO: 535698 - DNA, 25 bp, Homo sapien
tcaagtcaccattactggcagttct

SEQ ID NO: 535699 - DNA, 25 bp, Homo sapien
cattactggcagttctggttttgga

SEQ ID NO: 535700 - DNA, 25 bp, Homo sapien
tggttttggaactgatcccagaatt

SEQ ID NO: 535701 - DNA, 25 bp, Homo sapien
tgatcccagaattctaccttgcagg

SEQ ID NO: 535702 - DNA, 25 bp, Homo sapien
taccttgcaggctaggagatctctt

SEQ ID NO: 535703 - DNA, 25 bp, Homo sapien
gagatctcttaaaatggctgttagt

SEQ ID NO: 535704 - DNA, 25 bp, Homo sapien
agctagtaatagtgcatggtggaaa

SEQ ID NO: 535705 - DNA, 25 bp, Homo sapien
gcgaaagcttaaagacctttctgga

SEQ ID NO: 535706 - DNA, 25 bp, Homo sapien
cttctcagaggccatgttaaggcta

SEQ ID NO: 535707 - DNA, 25 bp, Homo sapien
gggcaaccacatgggcacccttgtt

SEQ ID NO: 535708 - DNA, 25 bp, Homo sapien
tgggcacccttgttcataccaaagg

SEQ ID NO: 535709 - DNA, 25 bp, Homo sapien
taccaaagggtgagcagtggccaga

SEQ ID NO: 535710 - DNA, 25 bp, Homo sapien
acctctcgagtgtctttaccaattg

SEQ ID NO: 535711 - DNA, 25 bp, Homo sapien
taccaattgagctttttatcgccat

SEQ ID NO: 535712 - DNA, 25 bp, Homo sapien
ttttatcgccatagccccttggagt

SEQ ID NO: 535713 - DNA, 25 bp, Homo sapien
ctgccctgaggtcaatcaaggaaaa

SEQ ID NO: 535714 - DNA, 25 bp, Homo sapien
tcaacttacagatcgtttttaaagc

SEQ ID NO: 535715 - DNA, 25 bp, Homo sapien
ttaaatttatgaaccacctttgtgg

SEQ ID NO: 535716 - DNA, 25 bp, Homo sapien
ttatgaataccgcagggcagccttc

SEQ ID NO: 535717 - DNA, 25 bp, Homo sapien
ccgcagggcagccttcttaaatgac

SEQ ID NO: 535718 - DNA, 25 bp, Homo sapien
gggacgagacctaccctgggtgcat

SEQ ID NO: 535719 - DNA, 25 bp, Homo sapien
ataaaccatcttgcagagaccattg

SEQ ID NO: 535720 - DNA, 25 bp, Homo sapien
gggtgaccggcaacaaagtgtatcg

SEQ ID NO: 535721 - DNA, 25 bp, Homo sapien
caaagtgtatcgaaaggctgcggcg

SEQ ID NO: 535722 - DNA, 25 bp, Homo sapien
gggctgcgggcgtctcaaccaaaag

SEQ ID NO: 535723 - DNA, 25 bp, Homo sapien
tgcgggcgtctcaaccaaaaggctg

SEQ ID NO: 535724 - DNA, 25 bp, Homo sapien
ggcgtctcaaccaaaaggctgcaca

SEQ ID NO: 535725 - DNA, 25 bp, Homo sapien
aaaaggctgcacaccggcgccggaa

SEQ ID NO: 535726 - DNA, 25 bp, Homo sapien
agagaccattgcataaccgcacgac

SEQ ID NO: 535727 - DNA, 25 bp, Homo sapien
ttgcataaccgcacgacacagacgt

SEQ ID NO: 535728 - DNA, 25 bp, Homo sapien
gcacgacacagacgtcttctcacaa

SEQ ID NO: 535729 - DNA, 25 bp, Homo sapien
aaactattcaacttttgcaacatag

SEQ ID NO: 535730 - DNA, 25 bp, Homo sapien
aactattcaacttttgcaacatagg

SEQ ID NO: 535731 - DNA, 25 bp, Homo sapien
actattcaacttttgcaacataggc

SEQ ID NO: 535732 - DNA, 25 bp, Homo sapien
ctattcaacttttgcaacataggca

SEQ ID NO: 535733 - DNA, 25 bp, Homo sapien
tattcaacttttgcaacataggcat

SEQ ID NO: 535734 - DNA, 25 bp, Homo sapien
attcaacttttgcaacataggcata

SEQ ID NO: 535735 - DNA, 25 bp, Homo sapien
ttcaacttttgcaacataggcataa

SEQ ID NO: 535736 - DNA, 25 bp, Homo sapien
tcaacttttgcaacataggcataac

SEQ ID NO: 535737 - DNA, 25 bp, Homo sapien
aacttttgcaacataggcataacat

SEQ ID NO: 535738 - DNA, 25 bp, Homo sapien
acttttgcaacataggcataacatt

SEQ ID NO: 535739 - DNA, 25 bp, Homo sapien
gcaacataggcataacatttcacaa

SEQ ID NO: 535740 - DNA, 25 bp, Homo sapien
gatcttcacagcatagagctcatct

SEQ ID NO: 535741 - DNA, 25 bp, Homo sapien
tcatctgtgccttttcgttctgaaa

SEQ ID NO: 535742 - DNA, 25 bp, Homo sapien
aagcatgaccttgccaaagctgcct

SEQ ID NO: 535743 - DNA, 25 bp, Homo sapien
ctttccccagcaccattaggaagtt

SEQ ID NO: 535744 - DNA, 25 bp, Homo sapien
aaaatcggtcagtttcatccggtct

SEQ ID NO: 535745 - DNA, 25 bp, Homo sapien
catccggtctctgttgccattgttg

SEQ ID NO: 535746 - DNA, 25 bp, Homo sapien
agacagtgttggtcgtcttttcttc

SEQ ID NO: 535747 - DNA, 25 bp, Homo sapien
tgccgcagttcttcattggcctcac

SEQ ID NO: 535748 - DNA, 25 bp, Homo sapien
ccttctggtggcacaggcacattga

SEQ ID NO: 535749 - DNA, 25 bp, Homo sapien
ggcacattgaagtactcgccttcct

SEQ ID NO: 535750 - DNA, 25 bp, Homo sapien
ttcctcctggctcagtaacttaaac

SEQ ID NO: 535751 - DNA, 25 bp, Homo sapien
ctatgtctgcagcacttcttgggag

SEQ ID NO: 535752 - DNA, 25 bp, Homo sapien
agcacttcttgggaggcctggtcac

SEQ ID NO: 535753 - DNA, 25 bp, Homo sapien
ttcttgggaggcctggtcaccacag

SEQ ID NO: 535754 - DNA, 25 bp, Homo sapien
ttgggaggcctggtcaccacagtca

SEQ ID NO: 535755 - DNA, 25 bp, Homo sapien
gaggcctggtcaccacagtcacctt

SEQ ID NO: 535756 - DNA, 25 bp, Homo sapien
accttcactgggatgatgcgctgca

SEQ ID NO: 535757 - DNA, 25 bp, Homo sapien
tcactgggatgatgcgctgcagcca

SEQ ID NO: 535758 - DNA, 25 bp, Homo sapien
atgatgcgctgcagccagctggccc

SEQ ID NO: 535759 - DNA, 25 bp, Homo sapien
aggccacacactacagccttctggc

SEQ ID NO: 535760 - DNA, 25 bp, Homo sapien
tgctgctgggcactctggccggagg

SEQ ID NO: 535761 - DNA, 25 bp, Homo sapien
ctgcctttcccgttctgtacctgga

SEQ ID NO: 535762 - DNA, 25 bp, Homo sapien
cactgcttcttcaccgtgatcttcg

SEQ ID NO: 535763 - DNA, 25 bp, Homo sapien
ttcaccgtgatcttcgccatcttct

SEQ ID NO: 535764 - DNA, 25 bp, Homo sapien
tgatcttcgccatcttctccgctat

SEQ ID NO: 535765 - DNA, 25 bp, Homo sapien
atcttctccgctatcatcttcctgt

SEQ ID NO: 535766 - DNA, 25 bp, Homo sapien
gctatcatcttcctgtcattcgagg

SEQ ID NO: 535767 - DNA, 25 bp, Homo sapien
atcatcttcctgtcattcgaggctg

SEQ ID NO: 535768 - DNA, 25 bp, Homo sapien
atcttcctgtcattcgaggctgtgt

SEQ ID NO: 535769 - DNA, 25 bp, Homo sapien
tgtcattcgaggctgtgtcatcact

SEQ ID NO: 535770 - DNA, 25 bp, Homo sapien
ttcgaggctgtgtcatcactgtcaa

SEQ ID NO: 535771 - DNA, 25 bp, Homo sapien
ggctgtgtcatcactgtcaaagctg

SEQ ID NO: 535772 - DNA, 25 bp, Homo sapien
agtggaggatgccagaggtttcacc

SEQ ID NO: 535773 - DNA, 25 bp, Homo sapien
caggccctcctttcttgggtgtcaa

SEQ ID NO: 535774 - DNA, 25 bp, Homo sapien
ggccctcctttcttgggtgtcaaat

SEQ ID NO: 535775 - DNA, 25 bp, Homo sapien
ccctcctttcttgggtgtcaaatga

SEQ ID NO: 535776 - DNA, 25 bp, Homo sapien
tgtgtcctggacatctgatgcacca

SEQ ID NO: 535777 - DNA, 25 bp, Homo sapien
gtgtcctggacatctgatgcaccac

SEQ ID NO: 535778 - DNA, 25 bp, Homo sapien
gtcctggacatctgatgcaccacct

SEQ ID NO: 535779 - DNA, 25 bp, Homo sapien
ggacatctgatgcaccacctgccct

SEQ ID NO: 535780 - DNA, 25 bp, Homo sapien
tgattgaggaatgcatgggcaccgt

SEQ ID NO: 535781 - DNA, 25 bp, Homo sapien
tgctccatcacaaacacctctcaga

SEQ ID NO: 535782 - DNA, 25 bp, Homo sapien
aaagcaagacagttcatacagtatg

SEQ ID NO: 535783 - DNA, 25 bp, Homo sapien
gttcatacagtatgatgccattttt

SEQ ID NO: 535784 - DNA, 25 bp, Homo sapien
gtatgtgttgtgtttattatgcgta

SEQ ID NO: 535785 - DNA, 25 bp, Homo sapien
ttatgcgtaattttcactggatgat

SEQ ID NO: 535786 - DNA, 25 bp, Homo sapien
gatacatggtgatactatgtcagtt

SEQ ID NO: 535787 - DNA, 25 bp, Homo sapien
gacaggaagctctacttatttgtac

SEQ ID NO: 535788 - DNA, 25 bp, Homo sapien
acttatttgtacataggctgtctga

SEQ ID NO: 535789 - DNA, 25 bp, Homo sapien
gtatgtacttctgtcacatggactt

SEQ ID NO: 535790 - DNA, 25 bp, Homo sapien
catggacttcattctgataaagggt

SEQ ID NO: 535791 - DNA, 25 bp, Homo sapien
ttcttgtttcactgtccataccttt

SEQ ID NO: 535792 - DNA, 25 bp, Homo sapien
catacctttgtgcttctactactga

SEQ ID NO: 535793 - DNA, 25 bp, Homo sapien
gtgcttctactactgataatcaatt

SEQ ID NO: 535794 - DNA, 25 bp, Homo sapien
gtaactaagtctcctcagtgtgaaa

SEQ ID NO: 535795 - DNA, 25 bp, Homo sapien
agtatttgtacatactctgcttctc

SEQ ID NO: 535796 - DNA, 25 bp, Homo sapien
atactctgcttctctctgtcagcgt

SEQ ID NO: 535797 - DNA, 25 bp, Homo sapien
gctgctctagaagactgtccgtgga

SEQ ID NO: 535798 - DNA, 25 bp, Homo sapien
ctgtccgtggatgagtttagtgtac

SEQ ID NO: 535799 - DNA, 25 bp, Homo sapien
atgagtttagtgtacagacttgtaa

SEQ ID NO: 535800 - DNA, 25 bp, Homo sapien
tctctgctcagtctagttcccagat

SEQ ID NO: 535801 - DNA, 25 bp, Homo sapien
aaaattgtcctaatctttcctagct

SEQ ID NO: 535802 - DNA, 25 bp, Homo sapien
ttgtcctaatctttcctagcttttt

SEQ ID NO: 535803 - DNA, 25 bp, Homo sapien
cagtttgtgagctcttctctgtcgc

SEQ ID NO: 535804 - DNA, 25 bp, Homo sapien
tgtcgccctgaagggtcactgtatt

SEQ ID NO: 535805 - DNA, 25 bp, Homo sapien
gaagggtcactgtattctgtatgaa

SEQ ID NO: 535806 - DNA, 25 bp, Homo sapien
ctttccctccttcctggagtggtgg

SEQ ID NO: 535807 - DNA, 25 bp, Homo sapien
cctccttcctggagtggtggctaca

SEQ ID NO: 535808 - DNA, 25 bp, Homo sapien
gctacagaagcttggggccaaccct

SEQ ID NO: 535809 - DNA, 25 bp, Homo sapien
tcctctttccccagcttctgtctgt

SEQ ID NO: 535810 - DNA, 25 bp, Homo sapien
gcttctgtctgtctcactgtcttcc

SEQ ID NO: 535811 - DNA, 25 bp, Homo sapien
ccagctgaggtgtggccctcaggcc

SEQ ID NO: 535812 - DNA, 25 bp, Homo sapien
gaagactgaggctaggtgccagaat

SEQ ID NO: 535813 - DNA, 25 bp, Homo sapien
aagactgaggctaggtgccagaatg

SEQ ID NO: 535814 - DNA, 25 bp, Homo sapien
gactgaggctaggtgccagaatgga

SEQ ID NO: 535815 - DNA, 25 bp, Homo sapien
tgaaggcgtgtctagagtgtgggct

SEQ ID NO: 535816 - DNA, 25 bp, Homo sapien
gcgtgtctagagtgtgggctggctg

SEQ ID NO: 535817 - DNA, 25 bp, Homo sapien
ggagctgagcccgacttctaccggg

SEQ ID NO: 535818 - DNA, 25 bp, Homo sapien
aggtcctggagccacgtccagcaca

SEQ ID NO: 535819 - DNA, 25 bp, Homo sapien
gtcctggagccacgtccagcacaga

SEQ ID NO: 535820 - DNA, 25 bp, Homo sapien
ctggagccacgtccagcacagagtg

SEQ ID NO: 535821 - DNA, 25 bp, Homo sapien
ggagccacgtccagcacagagtgga

SEQ ID NO: 535822 - DNA, 25 bp, Homo sapien
gagccacgtccagcacagagtggac

SEQ ID NO: 535823 - DNA, 25 bp, Homo sapien
tccagcacagagtggacggattcac

SEQ ID NO: 535824 - DNA, 25 bp, Homo sapien
ccagcacagagtggacggattcacc

SEQ ID NO: 535825 - DNA, 25 bp, Homo sapien
agcacagagtggacggattcaccgt

SEQ ID NO: 535826 - DNA, 25 bp, Homo sapien
cagagtggacggattcaccgtggcc

SEQ ID NO: 535827 - DNA, 25 bp, Homo sapien
gagtggacggattcaccgtggccga

SEQ ID NO: 535828 - DNA, 25 bp, Homo sapien
agaagtgcacttcctagctgttttt

SEQ ID NO: 535829 - DNA, 25 bp, Homo sapien
aagtgcacttcctagctgtttttta

SEQ ID NO: 535830 - DNA, 25 bp, Homo sapien
tttaggtataggaacacacaatgag

SEQ ID NO: 535831 - DNA, 25 bp, Homo sapien
ggaacacacaatgagaaccttatgt

SEQ ID NO: 535832 - DNA, 25 bp, Homo sapien
gaaccttatgtttagaatgtagcag

SEQ ID NO: 535833 - DNA, 25 bp, Homo sapien
gtagcagtaacaacagagggtaact

SEQ ID NO: 535834 - DNA, 25 bp, Homo sapien
gagggtaactacactgcaagactta

SEQ ID NO: 535835 - DNA, 25 bp, Homo sapien
gcaagacttaaatggtttgagcatg

SEQ ID NO: 535836 - DNA, 25 bp, Homo sapien
gtttgagcatgtgacactatccttt

SEQ ID NO: 535837 - DNA, 25 bp, Homo sapien
gtatgtttaacttccatgatattta

SEQ ID NO: 535838 - DNA, 25 bp, Homo sapien
gacatttgtgattgtttagagttct

SEQ ID NO: 535839 - DNA, 25 bp, Homo sapien
catgtaatacttttgcaagtgttgg

SEQ ID NO: 535840 - DNA, 25 bp, Homo sapien
gagtaatttaacttttgggtgccag

SEQ ID NO: 535841 - DNA, 25 bp, Homo sapien
ggaaatgggttttctcaaagtccat

SEQ ID NO: 535842 - DNA, 25 bp, Homo sapien
gggttttctcaaagtccattgccgg

SEQ ID NO: 535843 - DNA, 25 bp, Homo sapien
ttttctcaaagtccattgccggcaa

SEQ ID NO: 535844 - DNA, 25 bp, Homo sapien
tgggcaggcctgcaaatactggcac

SEQ ID NO: 535845 - DNA, 25 bp, Homo sapien
gcaggcctgcaaatactggcacaga

SEQ ID NO: 535846 - DNA, 25 bp, Homo sapien
gcctgcaaatactggcacagagcat

SEQ ID NO: 535847 - DNA, 25 bp, Homo sapien
ggcacagagcattaatcatacacct

SEQ ID NO: 535848 - DNA, 25 bp, Homo sapien
ttaatcatacaccttattaacggtg

SEQ ID NO: 535849 - DNA, 25 bp, Homo sapien
attaacggtgaggtgaataactttg

SEQ ID NO: 535850 - DNA, 25 bp, Homo sapien
aaggataataatttatctctgctcc

SEQ ID NO: 535851 - DNA, 25 bp, Homo sapien
ctctgctcctaatattactatccca

SEQ ID NO: 535852 - DNA, 25 bp, Homo sapien
aattatttataaccctcaagccagt

SEQ ID NO: 535853 - DNA, 25 bp, Homo sapien
taaccctcaagccagttgattttta

SEQ ID NO: 535854 - DNA, 25 bp, Homo sapien
ggaaaagaactctctggtattatta

SEQ ID NO: 535855 - DNA, 25 bp, Homo sapien
ggtattattaagactcacacagaat

SEQ ID NO: 535856 - DNA, 25 bp, Homo sapien
gactcacacagaatcagggacaggg

SEQ ID NO: 535857 - DNA, 25 bp, Homo sapien
gacagggcccccaaaggagtttgct

SEQ ID NO: 535858 - DNA, 25 bp, Homo sapien
ggcccaaccctgcattcaagtgtaa

SEQ ID NO: 535859 - DNA, 25 bp, Homo sapien
gcattcaagtgtaacagcattctgt

SEQ ID NO: 535860 - DNA, 25 bp, Homo sapien
agcattctgtcagggtcactttgaa

SEQ ID NO: 535861 - DNA, 25 bp, Homo sapien
cagcttttaattaatgtaactgttc

SEQ ID NO: 535862 - DNA, 25 bp, Homo sapien
gtaactgttcaagattacagccggt

SEQ ID NO: 535863 - DNA, 25 bp, Homo sapien
ttacagccggtcatcagctttctaa

SEQ ID NO: 535864 - DNA, 25 bp, Homo sapien
gtcatcagctttctaaccagtgcct

SEQ ID NO: 535865 - DNA, 25 bp, Homo sapien
cagctttctaaccagtgcctcacag

SEQ ID NO: 535866 - DNA, 25 bp, Homo sapien
gctggaagagccttgctccggtgat

SEQ ID NO: 535867 - DNA, 25 bp, Homo sapien
agccttgctccggtgatggttgatt

SEQ ID NO: 535868 - DNA, 25 bp, Homo sapien
ggtgatggttgatttgccattctct

SEQ ID NO: 535869 - DNA, 25 bp, Homo sapien
tcactgtcaacgtgccatctgtcag

SEQ ID NO: 535870 - DNA, 25 bp, Homo sapien
tcaacgtgccatctgtcaggtgcat

SEQ ID NO: 535871 - DNA, 25 bp, Homo sapien
gccatctgtcaggtgcatgttataa

SEQ ID NO: 535872 - DNA, 25 bp, Homo sapien
aaaggctgcagacagtcacagggaa

SEQ ID NO: 535873 - DNA, 25 bp, Homo sapien
atgtcaaggatgtcactgggagccc

SEQ ID NO: 535874 - DNA, 25 bp, Homo sapien
actgggagccctttggcttcacact

SEQ ID NO: 535875 - DNA, 25 bp, Homo sapien
ttggcttcacactcgcctgttagcg

SEQ ID NO: 535876 - DNA, 25 bp, Homo sapien
tgttagcgccttgctttcgctgaat

SEQ ID NO: 535877 - DNA, 25 bp, Homo sapien
gccttgctttcgctgaattaccaga

SEQ ID NO: 535878 - DNA, 25 bp, Homo sapien
tgaattaccagagcctaccactcgg

SEQ ID NO: 535879 - DNA, 25 bp, Homo sapien
gcctaccactcggaggaaggtcttg

SEQ ID NO: 535880 - DNA, 25 bp, Homo sapien
acaagtgtcaaagttctcttagatt

SEQ ID NO: 535881 - DNA, 25 bp, Homo sapien
gttctcttagattctgaagtcggtg

SEQ ID NO: 535882 - DNA, 25 bp, Homo sapien
gaagtcggtgatgagcacacaatta

SEQ ID NO: 535883 - DNA, 25 bp, Homo sapien
ccatcgaggagggcacgctggagga

SEQ ID NO: 535884 - DNA, 25 bp, Homo sapien
aggagatcgaagaggaggtccggca

SEQ ID NO: 535885 - DNA, 25 bp, Homo sapien
gagatcgaagaggaggtccggcaga

SEQ ID NO: 535886 - DNA, 25 bp, Homo sapien
agatcgaagaggaggtccggcagaa

SEQ ID NO: 535887 - DNA, 25 bp, Homo sapien
aggaggtccggcagaagaaatcatc

SEQ ID NO: 535888 - DNA, 25 bp, Homo sapien
ggaggtccggcagaagaaatcatca

SEQ ID NO: 535889 - DNA, 25 bp, Homo sapien
gaggtccggcagaagaaatcatcac

SEQ ID NO: 535890 - DNA, 25 bp, Homo sapien
aggtccggcagaagaaatcatcacg

SEQ ID NO: 535891 - DNA, 25 bp, Homo sapien
ggtccggcagaagaaatcatcacgg

SEQ ID NO: 535892 - DNA, 25 bp, Homo sapien
aagcgagacagcgacgccggctcct

SEQ ID NO: 535893 - DNA, 25 bp, Homo sapien
agcgagacagcgacgccggctcctc

SEQ ID NO: 535894 - DNA, 25 bp, Homo sapien
gatgtgtgccccaaaacatgcgaga

SEQ ID NO: 535895 - DNA, 25 bp, Homo sapien
catgcgagaactttcgttgtctttg

SEQ ID NO: 535896 - DNA, 25 bp, Homo sapien
actttcgttgtctttgtacaggtga

SEQ ID NO: 535897 - DNA, 25 bp, Homo sapien
gaccgggaaatcaactcagaaacca

SEQ ID NO: 535898 - DNA, 25 bp, Homo sapien
gagttgtctctttcacagagttgtc

SEQ ID NO: 535899 - DNA, 25 bp, Homo sapien
gagttgtcaaggattttatggttca

SEQ ID NO: 535900 - DNA, 25 bp, Homo sapien
caaggtggtgacttcagtgaaggaa

SEQ ID NO: 535901 - DNA, 25 bp, Homo sapien
agacgagagtttcgctgttaaacac

SEQ ID NO: 535902 - DNA, 25 bp, Homo sapien
aatttctcttgtcaatggccaacag

SEQ ID NO: 535903 - DNA, 25 bp, Homo sapien
ggatacaaatggttcacagttcttc

SEQ ID NO: 535904 - DNA, 25 bp, Homo sapien
ggttcacagttcttcataacaacga

SEQ ID NO: 535905 - DNA, 25 bp, Homo sapien
gtcccagtgtgtgttatgccccgag

SEQ ID NO: 535906 - DNA, 25 bp, Homo sapien
cagtgtgtgttatgccccgagccag

SEQ ID NO: 535907 - DNA, 25 bp, Homo sapien
tatgccccgagccagtcaagctgaa

SEQ ID NO: 535908 - DNA, 25 bp, Homo sapien
ccgagccagtcaagctgaagggaga

SEQ ID NO: 535909 - DNA, 25 bp, Homo sapien
cctgggattgcgtcgcggcctctgc

SEQ ID NO: 535910 - DNA, 25 bp, Homo sapien
ggcctctgcttgtcgacctgggtgc

SEQ ID NO: 535911 - DNA, 25 bp, Homo sapien
cctgggtgctggctgtcctatttta

SEQ ID NO: 535912 - DNA, 25 bp, Homo sapien
gctggctgtcctattttactactat

SEQ ID NO: 535913 - DNA, 25 bp, Homo sapien
ggctgtcctattttactactattga

SEQ ID NO: 535914 - DNA, 25 bp, Homo sapien
cctattttactactattgaccctga

SEQ ID NO: 535915 - DNA, 25 bp, Homo sapien
tattgaccctgaaggccatcgagga

SEQ ID NO: 535916 - DNA, 25 bp, Homo sapien
aaaggacgcctttcaggcattagct

SEQ ID NO: 535917 - DNA, 25 bp, Homo sapien
ggcattagctaaacttccacttcat

SEQ ID NO: 535918 - DNA, 25 bp, Homo sapien
tccacttcataactttcggcgagac

SEQ ID NO: 535919 - DNA, 25 bp, Homo sapien
tgagcctcctggtgtagagttcttt

SEQ ID NO: 535920 - DNA, 25 bp, Homo sapien
agagttcttttgtctttgtatggaa

SEQ ID NO: 535921 - DNA, 25 bp, Homo sapien
gactttttgctgtgatggttttgaa

SEQ ID NO: 535922 - DNA, 25 bp, Homo sapien
gtttctgctgtctgcttagtaccca

SEQ ID NO: 535923 - DNA, 25 bp, Homo sapien
agtacccatgcctgaattttttgag

SEQ ID NO: 535924 - DNA, 25 bp, Homo sapien
aaaggagttagattgtgttctgaca

SEQ ID NO: 535925 - DNA, 25 bp, Homo sapien
tgttctgacatggttgtagactttc

SEQ ID NO: 535926 - DNA, 25 bp, Homo sapien
ttcacctggattattgatattctac

SEQ ID NO: 535927 - DNA, 25 bp, Homo sapien
gttgctttcgctcgtcttccagttc

SEQ ID NO: 535928 - DNA, 25 bp, Homo sapien
tccagttccgtctcatactcgtgaa

SEQ ID NO: 535929 - DNA, 25 bp, Homo sapien
catactcgtgaagctgtctctgcag

SEQ ID NO: 535930 - DNA, 25 bp, Homo sapien
gggcttggagatccctttcgaactg

SEQ ID NO: 535931 - DNA, 25 bp, Homo sapien
gatccctttcgaactggcccttgag

SEQ ID NO: 535932 - DNA, 25 bp, Homo sapien
cccttgagcgcctgcatgttgactt

SEQ ID NO: 535933 - DNA, 25 bp, Homo sapien
atgttgacttccagccgcagtttgg

SEQ ID NO: 535934 - DNA, 25 bp, Homo sapien
agtttggcgtcctccgtggcttgca

SEQ ID NO: 535935 - DNA, 25 bp, Homo sapien
atctcctccatctgggtctccaggg

SEQ ID NO: 535936 - DNA, 25 bp, Homo sapien
agcttcttctttgctgcagctgcca

SEQ ID NO: 535937 - DNA, 25 bp, Homo sapien
agctgccagggcacgttgctttcgc

SEQ ID NO: 535938 - DNA, 25 bp, Homo sapien
ctttcaagggcgacgggagagacac

SEQ ID NO: 535939 - DNA, 25 bp, Homo sapien
gcgacgggagagacacaggataaaa

SEQ ID NO: 535940 - DNA, 25 bp, Homo sapien
ttgggtctagggtgtcctcaaacag

SEQ ID NO: 535941 - DNA, 25 bp, Homo sapien
tctagggtgtcctcaaacaggctga

SEQ ID NO: 535942 - DNA, 25 bp, Homo sapien
ggctgaggaggttccgaggctcaaa

SEQ ID NO: 535943 - DNA, 25 bp, Homo sapien
ggaggctctgagttgatgtcactta

SEQ ID NO: 535944 - DNA, 25 bp, Homo sapien
gttgatgtcacttaggtccagggca

SEQ ID NO: 535945 - DNA, 25 bp, Homo sapien
gtcacttaggtccagggcatccctg

SEQ ID NO: 535946 - DNA, 25 bp, Homo sapien
gagagtagtgacactcaggatccaa

SEQ ID NO: 535947 - DNA, 25 bp, Homo sapien
gtgacactcaggatccaaaagctag

SEQ ID NO: 535948 - DNA, 25 bp, Homo sapien
aggatccaaaagctagccctgccca

SEQ ID NO: 535949 - DNA, 25 bp, Homo sapien
aaatcttgtctgttaatgaaatagg

SEQ ID NO: 535950 - DNA, 25 bp, Homo sapien
tggtcattgccgtttgagctgctga

SEQ ID NO: 535951 - DNA, 25 bp, Homo sapien
gagctgctgattttcatgagtcgcc

SEQ ID NO: 535952 - DNA, 25 bp, Homo sapien
atgagtcgccttcaaaactctcgtg

SEQ ID NO: 535953 - DNA, 25 bp, Homo sapien
aactctcgtgtagggttgacaatgt

SEQ ID NO: 535954 - DNA, 25 bp, Homo sapien
gggggatccagcttattcttttatt

SEQ ID NO: 535955 - DNA, 25 bp, Homo sapien
ttttattttcaagtccattcttggg

SEQ ID NO: 535956 - DNA, 25 bp, Homo sapien
gaggcaggagaatacccctccctaa

SEQ ID NO: 535957 - DNA, 25 bp, Homo sapien
cctaagcccttagtgtgtgccgagc

SEQ ID NO: 535958 - DNA, 25 bp, Homo sapien
agcccttagtgtgtgccgagcttgc

SEQ ID NO: 535959 - DNA, 25 bp, Homo sapien
ccgagcttgctttgtgatgttggca

SEQ ID NO: 535960 - DNA, 25 bp, Homo sapien
tcctcctgaggatgggttattgtca

SEQ ID NO: 535961 - DNA, 25 bp, Homo sapien
gttattgtcatcaagaagccacctg

SEQ ID NO: 535962 - DNA, 25 bp, Homo sapien
aagaagccacctgcatagccgtatc

SEQ ID NO: 535963 - DNA, 25 bp, Homo sapien
atagccgtatccattacctcatggt

SEQ ID NO: 535964 - DNA, 25 bp, Homo sapien
tacctcatggtaattcccggtgctt

SEQ ID NO: 535965 - DNA, 25 bp, Homo sapien
gttctgaggttttttgggacttctg

SEQ ID NO: 535966 - DNA, 25 bp, Homo sapien
gcaataggagcaagggacccaggca

SEQ ID NO: 535967 - DNA, 25 bp, Homo sapien
ggcagagcaataccttccgaagctt

SEQ ID NO: 535968 - DNA, 25 bp, Homo sapien
ggtttatatggtcagtagctcacgt

SEQ ID NO: 535969 - DNA, 25 bp, Homo sapien
gtagctcacgtgaagtcatctgaat

SEQ ID NO: 535970 - DNA, 25 bp, Homo sapien
gaatctttcttaaatctgctctctt

SEQ ID NO: 535971 - DNA, 25 bp, Homo sapien
aaatatctttgctcccagtttcttg

SEQ ID NO: 535972 - DNA, 25 bp, Homo sapien
agtttcttgagatctgctgacagat

SEQ ID NO: 535973 - DNA, 25 bp, Homo sapien
atctgctgacagatgttccatcctg

SEQ ID NO: 535974 - DNA, 25 bp, Homo sapien
gttccatcctgtacaagtgctcagt

SEQ ID NO: 535975 - DNA, 25 bp, Homo sapien
aagtgctcagttccaatgtgcccag

SEQ ID NO: 535976 - DNA, 25 bp, Homo sapien
atgtgcccagtcatgacatttctca

SEQ ID NO: 535977 - DNA, 25 bp, Homo sapien
catttctcaaagtttttacagtgta

SEQ ID NO: 535978 - DNA, 25 bp, Homo sapien
acagtgtatctcgaagtcttccatc

SEQ ID NO: 535979 - DNA, 25 bp, Homo sapien
gaagtcttccatcagcagtgattga

SEQ ID NO: 535980 - DNA, 25 bp, Homo sapien
tgattgaagtatctgtacctgcccc

SEQ ID NO: 535981 - DNA, 25 bp, Homo sapien
tcagcatttcggtgcttccctttca

SEQ ID NO: 535982 - DNA, 25 bp, Homo sapien
tggatcgtctgttctaatatgctgc

SEQ ID NO: 535983 - DNA, 25 bp, Homo sapien
gtcagtttcactgtctaaattgccc

SEQ ID NO: 535984 - DNA, 25 bp, Homo sapien
aaggttgagtgcacgtctttgtccc

SEQ ID NO: 535985 - DNA, 25 bp, Homo sapien
tcccctctggcagcagattctagta

SEQ ID NO: 535986 - DNA, 25 bp, Homo sapien
agtagctgattttagcaggtcctcg

SEQ ID NO: 535987 - DNA, 25 bp, Homo sapien
agcaggtcctcggaactttctgaag

SEQ ID NO: 535988 - DNA, 25 bp, Homo sapien
aactttctgaagcttctcccttatg

SEQ ID NO: 535989 - DNA, 25 bp, Homo sapien
tgaagcttctcccttatgatgaaag

SEQ ID NO: 535990 - DNA, 25 bp, Homo sapien
ggacccagaacttcttgtttcacat

SEQ ID NO: 535991 - DNA, 25 bp, Homo sapien
gtcaagatcagcaatgaaggcttct

SEQ ID NO: 535992 - DNA, 25 bp, Homo sapien
tgaaggcttctagctcttttgtgtc

SEQ ID NO: 535993 - DNA, 25 bp, Homo sapien
gcactctgggaacctataaaggcag

SEQ ID NO: 535994 - DNA, 25 bp, Homo sapien
tataaaggcaggtatttcgggccct

SEQ ID NO: 535995 - DNA, 25 bp, Homo sapien
tcttcctgaagacatggcccagtcg

SEQ ID NO: 535996 - DNA, 25 bp, Homo sapien
atggcccagtcgaaggcccaggatg

SEQ ID NO: 535997 - DNA, 25 bp, Homo sapien
aggatggcttttgctgcggccccgt

SEQ ID NO: 535998 - DNA, 25 bp, Homo sapien
gagtcagcctccacattcagaggca

SEQ ID NO: 535999 - DNA, 25 bp, Homo sapien
tcagaggcatcacaagtaatggcac

SEQ ID NO: 536000 - DNA, 25 bp, Homo sapien
gtaatggcacaattcttcggatgac

SEQ ID NO: 536001 - DNA, 25 bp, Homo sapien
acaattcttcggatgactgcagaaa

SEQ ID NO: 536002 - DNA, 25 bp, Homo sapien
gtgttttgtagttcaacaactcaag

SEQ ID NO: 536003 - DNA, 25 bp, Homo sapien
caagacgaagcttatttctgaggat

SEQ ID NO: 536004 - DNA, 25 bp, Homo sapien
agactacttgggagcaccgcctgtg

SEQ ID NO: 536005 - DNA, 25 bp, Homo sapien
gggagcaccgcctgtgaaataccaa

SEQ ID NO: 536006 - DNA, 25 bp, Homo sapien
accgcctgtgaaataccaacctgaa

SEQ ID NO: 536007 - DNA, 25 bp, Homo sapien
gcctgtgaaataccaacctgaagac

SEQ ID NO: 536008 - DNA, 25 bp, Homo sapien
ttcattcaggcaacgcacaaaacag

SEQ ID NO: 536009 - DNA, 25 bp, Homo sapien
tcaggcaacgcacaaaacagaaaat

SEQ ID NO: 536010 - DNA, 25 bp, Homo sapien
caagcacagatgttcttcaactgtt

SEQ ID NO: 536011 - DNA, 25 bp, Homo sapien
gatgttcttcaactgtttttgtcta

SEQ ID NO: 536012 - DNA, 25 bp, Homo sapien
actgtttttgtctacactctttctc

SEQ ID NO: 536013 - DNA, 25 bp, Homo sapien
tttttgtctacactctttctctttt

SEQ ID NO: 536014 - DNA, 25 bp, Homo sapien
gacaggaagatggtgccatcagcaa

SEQ ID NO: 536015 - DNA, 25 bp, Homo sapien
ggataaagtttccagcaataggatc

SEQ ID NO: 536016 - DNA, 25 bp, Homo sapien
gtttccagcaataggatcataaaca

SEQ ID NO: 536017 - DNA, 25 bp, Homo sapien
ttacacacataaaagctacagaact

SEQ ID NO: 536018 - DNA, 25 bp, Homo sapien
gctacagaactagatagagtggaaa

SEQ ID NO: 536019 - DNA, 25 bp, Homo sapien
gaaaggctattactaggtgactcca

SEQ ID NO: 536020 - DNA, 25 bp, Homo sapien
ttactaggtgactccaaaagtggct

SEQ ID NO: 536021 - DNA, 25 bp, Homo sapien
gtgactccaaaagtggcttcagtga

SEQ ID NO: 536022 - DNA, 25 bp, Homo sapien
gtggcttcagtgatgacaaaacacg

SEQ ID NO: 536023 - DNA, 25 bp, Homo sapien
tgatgacaaaacacggacacagaac

SEQ ID NO: 536024 - DNA, 25 bp, Homo sapien
cggacacagaacatgcgtacttagt

SEQ ID NO: 536025 - DNA, 25 bp, Homo sapien
cacagaacatgcgtacttagtaaaa

SEQ ID NO: 536026 - DNA, 25 bp, Homo sapien
tctcgtgtagggttgacaatgtggg

SEQ ID NO: 536027 - DNA, 25 bp, Homo sapien
tttcaagtccattcttggggctggt

SEQ ID NO: 536028 - DNA, 25 bp, Homo sapien
gaggcaggagaatacccctccctaa

SEQ ID NO: 536029 - DNA, 25 bp, Homo sapien
ggcaggagaatacccctccctaagc

SEQ ID NO: 536030 - DNA, 25 bp, Homo sapien
tccctaagcccttagtgtgtgccga

SEQ ID NO: 536031 - DNA, 25 bp, Homo sapien
cctaagcccttagtgtgtgccgagc

SEQ ID NO: 536032 - DNA, 25 bp, Homo sapien
ctaagcccttagtgtgtgccgagct

SEQ ID NO: 536033 - DNA, 25 bp, Homo sapien
taagcccttagtgtgtgccgagctt

SEQ ID NO: 536034 - DNA, 25 bp, Homo sapien
aagcccttagtgtgtgccgagcttg

SEQ ID NO: 536035 - DNA, 25 bp, Homo sapien
agcccttagtgtgtgccgagcttgc

SEQ ID NO: 536036 - DNA, 25 bp, Homo sapien
gcccttagtgtgtgccgagcttgct

SEQ ID NO: 536037 - DNA, 25 bp, Homo sapien
tctgagtcacatcacacttcagcac

SEQ ID NO: 536038 - DNA, 25 bp, Homo sapien
gagtcacatcacacttcagcacctg

SEQ ID NO: 536039 - DNA, 25 bp, Homo sapien
tgcttgaccgcctgtctcaacttct

SEQ ID NO: 536040 - DNA, 25 bp, Homo sapien
ttctctggacccttgactctgttcc

SEQ ID NO: 536041 - DNA, 25 bp, Homo sapien
tggacccttgactctgttcccttca

SEQ ID NO: 536042 - DNA, 25 bp, Homo sapien
cttgactctgttcccttcaagatca

SEQ ID NO: 536043 - DNA, 25 bp, Homo sapien
tgactctgttcccttcaagatcaca

SEQ ID NO: 536044 - DNA, 25 bp, Homo sapien
actctgttcccttcaagatcacaca

SEQ ID NO: 536045 - DNA, 25 bp, Homo sapien
agatcacacacataggtcaccactg

SEQ ID NO: 536046 - DNA, 25 bp, Homo sapien
atcacacacataggtcaccactggg

SEQ ID NO: 536047 - DNA, 25 bp, Homo sapien
actggggaccagtcaaaggcctctg

SEQ ID NO: 536048 - DNA, 25 bp, Homo sapien
ttgcttgctaaagaagtggtctcct

SEQ ID NO: 536049 - DNA, 25 bp, Homo sapien
gaagtggtctcctgaggtcttaaga

SEQ ID NO: 536050 - DNA, 25 bp, Homo sapien
tctcctgaggtcttaagacattcct

SEQ ID NO: 536051 - DNA, 25 bp, Homo sapien
agacattcctgacagtgtcttgagt

SEQ ID NO: 536052 - DNA, 25 bp, Homo sapien
gctgtcattgcgctgtggaatttca

SEQ ID NO: 536053 - DNA, 25 bp, Homo sapien
tttcacagatgagaaccacgcctag

SEQ ID NO: 536054 - DNA, 25 bp, Homo sapien
tgagaaccacgcctagccaaaatca

SEQ ID NO: 536055 - DNA, 25 bp, Homo sapien
aaaatcacttttcctgtttgcctca

SEQ ID NO: 536056 - DNA, 25 bp, Homo sapien
gtttgcctcagtgacacagctgcag

SEQ ID NO: 536057 - DNA, 25 bp, Homo sapien
gacacagctgcagggaccctcgtgg

SEQ ID NO: 536058 - DNA, 25 bp, Homo sapien
gggaccctcgtggatgttgtattaa

SEQ ID NO: 536059 - DNA, 25 bp, Homo sapien
ttccccattctccagagggagggag

SEQ ID NO: 536060 - DNA, 25 bp, Homo sapien
cgagtccaagtgtgaggctgttgat

SEQ ID NO: 536061 - DNA, 25 bp, Homo sapien
gaggctgttgatttgttttcaatat

SEQ ID NO: 536062 - DNA, 25 bp, Homo sapien
ttcaatatttcttttcgtgctgtat

SEQ ID NO: 536063 - DNA, 25 bp, Homo sapien
atttcttttcgtgctgtatggtgat

SEQ ID NO: 536064 - DNA, 25 bp, Homo sapien
cgtgctgtatggtgatgctttctta

SEQ ID NO: 536065 - DNA, 25 bp, Homo sapien
ggtgatgctttcttagtattctaca

SEQ ID NO: 536066 - DNA, 25 bp, Homo sapien
gatgctttcttagtattctacacaa

SEQ ID NO: 536067 - DNA, 25 bp, Homo sapien
gacaaagtcctcgagattcttatga

SEQ ID NO: 536068 - DNA, 25 bp, Homo sapien
gtcctcgagattcttatgagttttg

SEQ ID NO: 536069 - DNA, 25 bp, Homo sapien
gaaaactctttcactatatttgttg

SEQ ID NO: 536070 - DNA, 25 bp, Homo sapien
gaacacacatgctgctgagtccgca

SEQ ID NO: 536071 - DNA, 25 bp, Homo sapien
gcagaggacagcgtgcttttgtgta

SEQ ID NO: 536072 - DNA, 25 bp, Homo sapien
agcgtgcttttgtgtactgttggaa

SEQ ID NO: 536073 - DNA, 25 bp, Homo sapien
tgttggaagactggctcctcctgta

SEQ ID NO: 536074 - DNA, 25 bp, Homo sapien
tgtacagcacctctgagcccttgtg

SEQ ID NO: 536075 - DNA, 25 bp, Homo sapien
tggccgtgtgaccacccacagctga

SEQ ID NO: 536076 - DNA, 25 bp, Homo sapien
gactgggcagcaggcacaggcccta

SEQ ID NO: 536077 - DNA, 25 bp, Homo sapien
gagttggctcgcatgactccagctg

SEQ ID NO: 536078 - DNA, 25 bp, Homo sapien
gaggctgcctgtgtacatttctcca

SEQ ID NO: 536079 - DNA, 25 bp, Homo sapien
tgtacatttctccagataccctatg

SEQ ID NO: 536080 - DNA, 25 bp, Homo sapien
gataccctatggctaattttgttat

SEQ ID NO: 536081 - DNA, 25 bp, Homo sapien
ggtgggatattgattcagtataatc

SEQ ID NO: 536082 - DNA, 25 bp, Homo sapien
gattcagtataatcttttatagtgt

SEQ ID NO: 536083 - DNA, 25 bp, Homo sapien
ccagtttcactctcatagaatactt

SEQ ID NO: 536084 - DNA, 25 bp, Homo sapien
gtttcactctcatagaatacttttg

SEQ ID NO: 536085 - DNA, 25 bp, Homo sapien
gaatacttttgtgattactatgctg

SEQ ID NO: 536086 - DNA, 25 bp, Homo sapien
tacttttgtgattactatgctgagc

SEQ ID NO: 536087 - DNA, 25 bp, Homo sapien
ttactatgctgagctttagaaaaaa

SEQ ID NO: 536088 - DNA, 25 bp, Homo sapien
ggaactaagagatttcacataatga

SEQ ID NO: 536089 - DNA, 25 bp, Homo sapien
tagattattttgtgtaaggtgaaga

SEQ ID NO: 536090 - DNA, 25 bp, Homo sapien
aatctttaggtgtcaatttgagtga

SEQ ID NO: 536091 - DNA, 25 bp, Homo sapien
gtgtcaatttgagtgagagaatgta

SEQ ID NO: 536092 - DNA, 25 bp, Homo sapien
agctattttgcttaaatttctacag

SEQ ID NO: 536093 - DNA, 25 bp, Homo sapien
aaaatgatgaagacgggtgcacctg

SEQ ID NO: 536094 - DNA, 25 bp, Homo sapien
aagacgggtgcacctgtctgagttt

SEQ ID NO: 536095 - DNA, 25 bp, Homo sapien
acctgtctgagtttggccctcatgt

SEQ ID NO: 536096 - DNA, 25 bp, Homo sapien
agtttggccctcatgtgagctgtgc

SEQ ID NO: 536097 - DNA, 25 bp, Homo sapien
ttggccctcatgtgagctgtgccct

SEQ ID NO: 536098 - DNA, 25 bp, Homo sapien
tccagcggcttctgccaaccatggg

SEQ ID NO: 536099 - DNA, 25 bp, Homo sapien
actccaatcctttccatttcagttt

SEQ ID NO: 536100 - DNA, 25 bp, Homo sapien
aagttcatcacagggtctttctttc

SEQ ID NO: 536101 - DNA, 25 bp, Homo sapien
tcatcacagggtctttctttctact

SEQ ID NO: 536102 - DNA, 25 bp, Homo sapien
gggtctttctttctactccaggact

SEQ ID NO: 536103 - DNA, 25 bp, Homo sapien
aattggaatgctggcgggcatcttc

SEQ ID NO: 536104 - DNA, 25 bp, Homo sapien
aaatgcctcttctacattggaagca

SEQ ID NO: 536105 - DNA, 25 bp, Homo sapien
cgggcatcttctaaccaggttgtca

SEQ ID NO: 536106 - DNA, 25 bp, Homo sapien
agtggttgaatgtatctctccgtgt

SEQ ID NO: 536107 - DNA, 25 bp, Homo sapien
gtatctctccgtgtaatatcgtaaa

SEQ ID NO: 536108 - DNA, 25 bp, Homo sapien
aaactagtaaagctcctgctgcacc

SEQ ID NO: 536109 - DNA, 25 bp, Homo sapien
tgctgcacctctgtaatacgacctt

SEQ ID NO: 536110 - DNA, 25 bp, Homo sapien
gaacgaaaggattcttgccctgccg

SEQ ID NO: 536111 - DNA, 25 bp, Homo sapien
agtcttagcagacgtttccatgaag

SEQ ID NO: 536112 - DNA, 25 bp, Homo sapien
agatgagtccatgttctcgtgcaaa

SEQ ID NO: 536113 - DNA, 25 bp, Homo sapien
gtgcaaaagcttcaccttcttcttt

SEQ ID NO: 536114 - DNA, 25 bp, Homo sapien
tggaaatcatgacccgagaggtgca

SEQ ID NO: 536115 - DNA, 25 bp, Homo sapien
aatcatgacccgagaggtgcagaca

SEQ ID NO: 536116 - DNA, 25 bp, Homo sapien
atgacccgagaggtgcagacaaatg

SEQ ID NO: 536117 - DNA, 25 bp, Homo sapien
cccgagaggtgcagacaaatgactt

SEQ ID NO: 536118 - DNA, 25 bp, Homo sapien
ccgagaggtgcagacaaatgacttg

SEQ ID NO: 536119 - DNA, 25 bp, Homo sapien
cgagaggtgcagacaaatgacttga

SEQ ID NO: 536120 - DNA, 25 bp, Homo sapien
ggtgcagacaaatgacttgaaagaa

SEQ ID NO: 536121 - DNA, 25 bp, Homo sapien
gtgcagacaaatgacttgaaagaag

SEQ ID NO: 536122 - DNA, 25 bp, Homo sapien
tgcagacaaatgacttgaaagaagt

SEQ ID NO: 536123 - DNA, 25 bp, Homo sapien
ttgccaatctatttatcctctccat

SEQ ID NO: 536124 - DNA, 25 bp, Homo sapien
tcctctccatgatgtcttcgttaga

SEQ ID NO: 536125 - DNA, 25 bp, Homo sapien
ttgatttttgctttgggtgggctcc

SEQ ID NO: 536126 - DNA, 25 bp, Homo sapien
gatttttgctttgggtgggctcctc

SEQ ID NO: 536127 - DNA, 25 bp, Homo sapien
tttgctttgggtgggctcctcttgg

SEQ ID NO: 536128 - DNA, 25 bp, Homo sapien
caacgtgcaaatggtagacagccga

SEQ ID NO: 536129 - DNA, 25 bp, Homo sapien
caaatggtagacagccgaatcagct

SEQ ID NO: 536130 - DNA, 25 bp, Homo sapien
tagacagccgaatcagctgtaagga

SEQ ID NO: 536131 - DNA, 25 bp, Homo sapien
gaggaacttctcttgggcagaacga

SEQ ID NO: 536132 - DNA, 25 bp, Homo sapien
ggaacttctcttgggcagaacgagc

SEQ ID NO: 536133 - DNA, 25 bp, Homo sapien
cttctcttgggcagaacgagccctt

SEQ ID NO: 536134 - DNA, 25 bp, Homo sapien
caatatgatgactgtatcaggttaa

SEQ ID NO: 536135 - DNA, 25 bp, Homo sapien
gatatagtctgtggatggatcatct

SEQ ID NO: 536136 - DNA, 25 bp, Homo sapien
gttttgacactgacacaggtctaaa

SEQ ID NO: 536137 - DNA, 25 bp, Homo sapien
gacacaggtctaaaacaggctttgg

SEQ ID NO: 536138 - DNA, 25 bp, Homo sapien
gtgaatgactacaatcctctgatga

SEQ ID NO: 536139 - DNA, 25 bp, Homo sapien
tcctctgatgaaagatttccctctg

SEQ ID NO: 536140 - DNA, 25 bp, Homo sapien
gtgaccaaactggatcgagatcctg

SEQ ID NO: 536141 - DNA, 25 bp, Homo sapien
tcctgcatcaggaactgccttacag

SEQ ID NO: 536142 - DNA, 25 bp, Homo sapien
ttttggctaaacttggaacgtgcgt

SEQ ID NO: 536143 - DNA, 25 bp, Homo sapien
ggaacgtgcgttataccgcatccag

SEQ ID NO: 536144 - DNA, 25 bp, Homo sapien
ggagagcccggaagttctcctgact

SEQ ID NO: 536145 - DNA, 25 bp, Homo sapien
cctgactctggatatcttgaaacat

SEQ ID NO: 536146 - DNA, 25 bp, Homo sapien
gaaacatggcaagcgcttccatgcc

SEQ ID NO: 536147 - DNA, 25 bp, Homo sapien
tgggttgcaggaacatcctcttcac

SEQ ID NO: 536148 - DNA, 25 bp, Homo sapien
ttgcaggaacatcctcttcaccaac

SEQ ID NO: 536149 - DNA, 25 bp, Homo sapien
tgcctagggcagctacaaaaaccag

SEQ ID NO: 536150 - DNA, 25 bp, Homo sapien
gggcagctacaaaaaccaggccagc

SEQ ID NO: 536151 - DNA, 25 bp, Homo sapien
agctacaaaaaccaggccagcctct

SEQ ID NO: 536152 - DNA, 25 bp, Homo sapien
aggccagcctctgaaaggtgctcca

SEQ ID NO: 536153 - DNA, 25 bp, Homo sapien
agcctctgaaaggtgctccacatct

SEQ ID NO: 536154 - DNA, 25 bp, Homo sapien
gtgctccacatctcattaaaaaccg

SEQ ID NO: 536155 - DNA, 25 bp, Homo sapien
taaaaaccgtgaaatcgcactgccc

SEQ ID NO: 536156 - DNA, 25 bp, Homo sapien
aaaaccgtgaaatcgcactgcccca

SEQ ID NO: 536157 - DNA, 25 bp, Homo sapien
gtgaaatcgcactgccccactatca

SEQ ID NO: 536158 - DNA, 25 bp, Homo sapien
gcctccatcagcttcttatttagta

SEQ ID NO: 536159 - DNA, 25 bp, Homo sapien
atttcatatgcccattagccctatg

SEQ ID NO: 536160 - DNA, 25 bp, Homo sapien
agccctatgcttcagatgacacgtt

SEQ ID NO: 536161 - DNA, 25 bp, Homo sapien
gacacgttttgtttagagctacttt

SEQ ID NO: 536162 - DNA, 25 bp, Homo sapien
agctactttgctccaagactcttaa

SEQ ID NO: 536163 - DNA, 25 bp, Homo sapien
gctccaagactcttaagcccaaagt

SEQ ID NO: 536164 - DNA, 25 bp, Homo sapien
gtaactggtatgtcactgagtaact

SEQ ID NO: 536165 - DNA, 25 bp, Homo sapien
gagtaacttgactcggtgtcagagc

SEQ ID NO: 536166 - DNA, 25 bp, Homo sapien
gagcattttaactagccactcagat

SEQ ID NO: 536167 - DNA, 25 bp, Homo sapien
aacttctctttttactcatcagctg

SEQ ID NO: 536168 - DNA, 25 bp, Homo sapien
tttttactcatcagctgcaagcaaa

SEQ ID NO: 536169 - DNA, 25 bp, Homo sapien
aaagggatagtcaccacctcaatca

SEQ ID NO: 536170 - DNA, 25 bp, Homo sapien
atagtcaccacctcaatcaaactga

SEQ ID NO: 536171 - DNA, 25 bp, Homo sapien
tgagatccaaaacagcagctgcttt

SEQ ID NO: 536172 - DNA, 25 bp, Homo sapien
agctgctttcctacaaggaaagaca

SEQ ID NO: 536173 - DNA, 25 bp, Homo sapien
aggaaagacatcaagaactactgag

SEQ ID NO: 536174 - DNA, 25 bp, Homo sapien
aactactgagtctgaagggtgacat

SEQ ID NO: 536175 - DNA, 25 bp, Homo sapien
gaagggtgacataatcaaccacaag

SEQ ID NO: 536176 - DNA, 25 bp, Homo sapien
gaaaatgttacggtttagcctggca

SEQ ID NO: 536177 - DNA, 25 bp, Homo sapien
atgttacggtttagcctggcacagt

SEQ ID NO: 536178 - DNA, 25 bp, Homo sapien
ttacggtttagcctggcacagtggt

SEQ ID NO: 536179 - DNA, 25 bp, Homo sapien
ttcaaggtcagcctcggcaatataa

SEQ ID NO: 536180 - DNA, 25 bp, Homo sapien
ttcccgcttatgctacctttgcagt

SEQ ID NO: 536181 - DNA, 25 bp, Homo sapien
ctttcctttccacagagctcgtccg

SEQ ID NO: 536182 - DNA, 25 bp, Homo sapien
gagctcgtccgcatggtgctgaatg

SEQ ID NO: 536183 - DNA, 25 bp, Homo sapien
cgtccgcatggtgctgaatggctga

SEQ ID NO: 536184 - DNA, 25 bp, Homo sapien
atggctgaggaccttcccagtctcc

SEQ ID NO: 536185 - DNA, 25 bp, Homo sapien
gtgtgaattttgtatctagcctaaa

SEQ ID NO: 536186 - DNA, 25 bp, Homo sapien
ttgtatctagcctaaagtttcccta

SEQ ID NO: 536187 - DNA, 25 bp, Homo sapien
ccatcttgtctctcttggatgatgt

SEQ ID NO: 536188 - DNA, 25 bp, Homo sapien
gtctctcttggatgatgtttgccgt

SEQ ID NO: 536189 - DNA, 25 bp, Homo sapien
cttggatgatgtttgccgtcagcat

SEQ ID NO: 536190 - DNA, 25 bp, Homo sapien
atgttcccgcttatgctacctttgc

SEQ ID NO: 536191 - DNA, 25 bp, Homo sapien
gcgaagtcacggaacagacgcagaa

SEQ ID NO: 536192 - DNA, 25 bp, Homo sapien
ctggctctggcgtctttccgggccg

SEQ ID NO: 536193 - DNA, 25 bp, Homo sapien
ctctgccatgttccgtggacagcga

SEQ ID NO: 536194 - DNA, 25 bp, Homo sapien
tgccatgttccgtggacagcgaaca

SEQ ID NO: 536195 - DNA, 25 bp, Homo sapien
gttccgtggacagcgaacacccggg

SEQ ID NO: 536196 - DNA, 25 bp, Homo sapien
tggacagcgaacacccgggccggag

SEQ ID NO: 536197 - DNA, 25 bp, Homo sapien
attacctactgtgaaggccagcgca

SEQ ID NO: 536198 - DNA, 25 bp, Homo sapien
gacagggtgggtttcttgccggcgg

SEQ ID NO: 536199 - DNA, 25 bp, Homo sapien
tcgacgcgatgcacctgcggtacat

SEQ ID NO: 536200 - DNA, 25 bp, Homo sapien
tgcggtacatcccacccaggcgaag

SEQ ID NO: 536201 - DNA, 25 bp, Homo sapien
cacccaggcgaagtcacggaacaga

SEQ ID NO: 536202 - DNA, 25 bp, Homo sapien
aaatctccagcaagcatctcattta

SEQ ID NO: 536203 - DNA, 25 bp, Homo sapien
atctccagcaagcatctcatttaaa

SEQ ID NO: 536204 - DNA, 25 bp, Homo sapien
ccagcaagcatctcatttaaataaa

SEQ ID NO: 536205 - DNA, 25 bp, Homo sapien
aatacagcaatatgtgactttttaa

SEQ ID NO: 536206 - DNA, 25 bp, Homo sapien
aaagctgtcaaataggtgtgaccct

SEQ ID NO: 536207 - DNA, 25 bp, Homo sapien
gtcaaataggtgtgaccctactaat

SEQ ID NO: 536208 - DNA, 25 bp, Homo sapien
aaataggtgtgaccctactaataat

SEQ ID NO: 536209 - DNA, 25 bp, Homo sapien
aaacatcgagtacctcaagtcagtt

SEQ ID NO: 536210 - DNA, 25 bp, Homo sapien
tcgagtacctcaagtcagtttgcct

SEQ ID NO: 536211 - DNA, 25 bp, Homo sapien
tgcttcgtaattttggagtaggagg

SEQ ID NO: 536212 - DNA, 25 bp, Homo sapien
tggagtaggaggttccctcctcaat

SEQ ID NO: 536213 - DNA, 25 bp, Homo sapien
gaagaaaggtgagtttgagctgcct

SEQ ID NO: 536214 - DNA, 25 bp, Homo sapien
ttgagctgccttccctagctttaga

SEQ ID NO: 536215 - DNA, 25 bp, Homo sapien
ttccctagctttagaccctgggtgg

SEQ ID NO: 536216 - DNA, 25 bp, Homo sapien
tagctttagaccctgggtgggctct

SEQ ID NO: 536217 - DNA, 25 bp, Homo sapien
ttagaccctgggtgggctctgtgca

SEQ ID NO: 536218 - DNA, 25 bp, Homo sapien
agtcactggaggttgaagccaagtg

SEQ ID NO: 536219 - DNA, 25 bp, Homo sapien
tgtggcagtggttttggcaaacgct

SEQ ID NO: 536220 - DNA, 25 bp, Homo sapien
ggcagtggttttggcaaacgctaaa

SEQ ID NO: 536221 - DNA, 25 bp, Homo sapien
tttggcaaacgctaaagagcccttg

SEQ ID NO: 536222 - DNA, 25 bp, Homo sapien
ggcaaacgctaaagagcccttgcct

SEQ ID NO: 536223 - DNA, 25 bp, Homo sapien
tcctccccaaatcaatacactagtt

SEQ ID NO: 536224 - DNA, 25 bp, Homo sapien
gagccttgtagggaggcctctacac

SEQ ID NO: 536225 - DNA, 25 bp, Homo sapien
tagggaggcctctacacagaagaaa

SEQ ID NO: 536226 - DNA, 25 bp, Homo sapien
cagccagcagcacggatgttactgt

SEQ ID NO: 536227 - DNA, 25 bp, Homo sapien
gcagcacggatgttactgtcctgct

SEQ ID NO: 536228 - DNA, 25 bp, Homo sapien
acggatgttactgtcctgctccttc

SEQ ID NO: 536229 - DNA, 25 bp, Homo sapien
gggcaaagggcacgtcccatcactc

SEQ ID NO: 536230 - DNA, 25 bp, Homo sapien
ctgtctgaaatgtggcagccactgt

SEQ ID NO: 536231 - DNA, 25 bp, Homo sapien
tggcagccactgtgggccaggctca

SEQ ID NO: 536232 - DNA, 25 bp, Homo sapien
tcagggcagggcaggcgattccagt

SEQ ID NO: 536233 - DNA, 25 bp, Homo sapien
tggcgcctgctgcttactgcagttt

SEQ ID NO: 536234 - DNA, 25 bp, Homo sapien
tttcatgcaggcctctgctccttgt

SEQ ID NO: 536235 - DNA, 25 bp, Homo sapien
ccgcatggtgctgaatggctgagga

SEQ ID NO: 536236 - DNA, 25 bp, Homo sapien
gcatggtgctgaatggctgaggacc

SEQ ID NO: 536237 - DNA, 25 bp, Homo sapien
gtgtgaattttgtatctagcctaaa

SEQ ID NO: 536238 - DNA, 25 bp, Homo sapien
gtgaattttgtatctagcctaaagt

SEQ ID NO: 536239 - DNA, 25 bp, Homo sapien
gaattttgtatctagcctaaagttt

SEQ ID NO: 536240 - DNA, 25 bp, Homo sapien
tttgtatctagcctaaagtttccct

SEQ ID NO: 536241 - DNA, 25 bp, Homo sapien
ttgtatctagcctaaagtttcccta

SEQ ID NO: 536242 - DNA, 25 bp, Homo sapien
ccatcttgtctctcttggatgatgt

SEQ ID NO: 536243 - DNA, 25 bp, Homo sapien
catcttgtctctcttggatgatgtt

SEQ ID NO: 536244 - DNA, 25 bp, Homo sapien
atcttgtctctcttggatgatgttt

SEQ ID NO: 536245 - DNA, 25 bp, Homo sapien
cttggatgatgtttgccgtcagcat

SEQ ID NO: 536246 - DNA, 25 bp, Homo sapien
cacagacaggcaattccagaaagtg

SEQ ID NO: 536247 - DNA, 25 bp, Homo sapien
gccagattccagagagtgaccctgc

SEQ ID NO: 536248 - DNA, 25 bp, Homo sapien
tgaccctgcagacctgagcccaagg

SEQ ID NO: 536249 - DNA, 25 bp, Homo sapien
gagcccaagggatactccacaagga

SEQ ID NO: 536250 - DNA, 25 bp, Homo sapien
gaagacatgctgaacgccatccgaa

SEQ ID NO: 536251 - DNA, 25 bp, Homo sapien
gaaactgaagaagaccacgacaaac

SEQ ID NO: 536252 - DNA, 25 bp, Homo sapien
aagaccacgacaaacgatcgctcag

SEQ ID NO: 536253 - DNA, 25 bp, Homo sapien
ccctcgcttttcttaggttcacaag

SEQ ID NO: 536254 - DNA, 25 bp, Homo sapien
ttaggttcacaagaaatgcgccggt

SEQ ID NO: 536255 - DNA, 25 bp, Homo sapien
atttgtcttgatccattccactcta

SEQ ID NO: 536256 - DNA, 25 bp, Homo sapien
gtcttgatccattccactctataat

SEQ ID NO: 536257 - DNA, 25 bp, Homo sapien
ttccctcttggaaggacagatctgc

SEQ ID NO: 536258 - DNA, 25 bp, Homo sapien
atctgccgggctgctatttatagtt

SEQ ID NO: 536259 - DNA, 25 bp, Homo sapien
tttatagttgcctttggcctttcac

SEQ ID NO: 536260 - DNA, 25 bp, Homo sapien
ggcctttcactgctctgcgatttgg

SEQ ID NO: 536261 - DNA, 25 bp, Homo sapien
taaccctatgtgtccacaagcctca

SEQ ID NO: 536262 - DNA, 25 bp, Homo sapien
ttgtttcaggtcaccctcaaatcac

SEQ ID NO: 536263 - DNA, 25 bp, Homo sapien
ctcaaatcacactctctttaggcaa

SEQ ID NO: 536264 - DNA, 25 bp, Homo sapien
gtgacaaattttaatgccagacatt

SEQ ID NO: 536265 - DNA, 25 bp, Homo sapien
tattgttgattccatttactcatgc

SEQ ID NO: 536266 - DNA, 25 bp, Homo sapien
atgcttgcaaaactagagaccccta

SEQ ID NO: 536267 - DNA, 25 bp, Homo sapien
tagagacccctaaggcagaactgag

SEQ ID NO: 536268 - DNA, 25 bp, Homo sapien
aaactttccttctgttggatcccag

SEQ ID NO: 536269 - DNA, 25 bp, Homo sapien
gttggatcccagtgacgtggaagtc

SEQ ID NO: 536270 - DNA, 25 bp, Homo sapien
tggaagtcatcagaaccccacggta

SEQ ID NO: 536271 - DNA, 25 bp, Homo sapien
atcagaaccccacggtacttggagt

SEQ ID NO: 536272 - DNA, 25 bp, Homo sapien
ttggagtacctctctgcaccaagat

SEQ ID NO: 536273 - DNA, 25 bp, Homo sapien
tctctgcaccaagatagctggctga

SEQ ID NO: 536274 - DNA, 25 bp, Homo sapien
tagctggctgattttctgctcagtc

SEQ ID NO: 536275 - DNA, 25 bp, Homo sapien
ttctgctcagtcacaattttacttg

SEQ ID NO: 536276 - DNA, 25 bp, Homo sapien
gcaagaattgtcctagctccttttc

SEQ ID NO: 536277 - DNA, 25 bp, Homo sapien
gtttaacgttcaaagcagggtctca

SEQ ID NO: 536278 - DNA, 25 bp, Homo sapien
acgttcaaagcagggtctcattaaa

SEQ ID NO: 536279 - DNA, 25 bp, Homo sapien
aggccacggagagcaacgaggccat

SEQ ID NO: 536280 - DNA, 25 bp, Homo sapien
ggccgcgaggtgaacgcactcaaga

SEQ ID NO: 536281 - DNA, 25 bp, Homo sapien
gtgaacgcactcaagagcaagctca

SEQ ID NO: 536282 - DNA, 25 bp, Homo sapien
gcgaggaaacgagacctctttcgtt

SEQ ID NO: 536283 - DNA, 25 bp, Homo sapien
agacctctttcgttccttctagaag

SEQ ID NO: 536284 - DNA, 25 bp, Homo sapien
ccttctagaaggtctggaggacgta

SEQ ID NO: 536285 - DNA, 25 bp, Homo sapien
gaaacggacactcgagacgcagact

SEQ ID NO: 536286 - DNA, 25 bp, Homo sapien
gagacgcagacttcaatggaaccaa

SEQ ID NO: 536287 - DNA, 25 bp, Homo sapien
ggccagtgaataagcaactttctac

SEQ ID NO: 536288 - DNA, 25 bp, Homo sapien
actttctacagttttgcaccacggc

SEQ ID NO: 536289 - DNA, 25 bp, Homo sapien
tacagttttgcaccacggcaagaaa

SEQ ID NO: 536290 - DNA, 25 bp, Homo sapien
tctgtcatccagctcctatgtctgt

SEQ ID NO: 536291 - DNA, 25 bp, Homo sapien
tcctatgtctgttatccagctccaa

SEQ ID NO: 536292 - DNA, 25 bp, Homo sapien
ctatgtctgttatccagctccaagt

SEQ ID NO: 536293 - DNA, 25 bp, Homo sapien
atgtctgttatccagctccaagtac

SEQ ID NO: 536294 - DNA, 25 bp, Homo sapien
gtctgttatccagctccaagtacag

SEQ ID NO: 536295 - DNA, 25 bp, Homo sapien
gttatccagctccaagtacagcttg

SEQ ID NO: 536296 - DNA, 25 bp, Homo sapien
atccagctccaagtacagcttgtgt

SEQ ID NO: 536297 - DNA, 25 bp, Homo sapien
ccagctccaagtacagcttgtgtat

SEQ ID NO: 536298 - DNA, 25 bp, Homo sapien
gctccaagtacagcttgtgtatatc

SEQ ID NO: 536299 - DNA, 25 bp, Homo sapien
gtacagcttgtgtatatcaacattt

SEQ ID NO: 536300 - DNA, 25 bp, Homo sapien
taaactaccaaatgaaatccagatg

SEQ ID NO: 536301 - DNA, 25 bp, Homo sapien
ttcctccagtggacgcctgcaggac

SEQ ID NO: 536302 - DNA, 25 bp, Homo sapien
ctgcaggacccaggtgagacacgga

SEQ ID NO: 536303 - DNA, 25 bp, Homo sapien
tcccggaatccaagcggccttttgc

SEQ ID NO: 536304 - DNA, 25 bp, Homo sapien
gggtctcccgagatgcatcgaaatt

SEQ ID NO: 536305 - DNA, 25 bp, Homo sapien
atcgaaattgagctcgtccacacag

SEQ ID NO: 536306 - DNA, 25 bp, Homo sapien
cgtgatgcccttttctgacttaaaa

SEQ ID NO: 536307 - DNA, 25 bp, Homo sapien
tgacttaaaacattccttgtacctt

SEQ ID NO: 536308 - DNA, 25 bp, Homo sapien
gtacctttatttacacgatccaagt

SEQ ID NO: 536309 - DNA, 25 bp, Homo sapien
acgatccaagttgcagtgtgcctag

SEQ ID NO: 536310 - DNA, 25 bp, Homo sapien
gttgcagtgtgcctagattttcctc

SEQ ID NO: 536311 - DNA, 25 bp, Homo sapien
gtgcctagattttcctccaaggaca

SEQ ID NO: 536312 - DNA, 25 bp, Homo sapien
aggccggctctgctctcctgctctc

SEQ ID NO: 536313 - DNA, 25 bp, Homo sapien
ccatcttgctccagggctacaacaa

SEQ ID NO: 536314 - DNA, 25 bp, Homo sapien
gtctctgggaaggtgaggtccggat

SEQ ID NO: 536315 - DNA, 25 bp, Homo sapien
ctctgggaaggtgaggtccggatgt

SEQ ID NO: 536316 - DNA, 25 bp, Homo sapien
gtgaggtccggatgtgggacacagc

SEQ ID NO: 536317 - DNA, 25 bp, Homo sapien
gaagaaacagaccgttccctgctca

SEQ ID NO: 536318 - DNA, 25 bp, Homo sapien
agaaacagaccgttccctgctcacc

SEQ ID NO: 536319 - DNA, 25 bp, Homo sapien
ctgctcacccatcctattccctggg

SEQ ID NO: 536320 - DNA, 25 bp, Homo sapien
gggagccctgcttgttgtcagaata

SEQ ID NO: 536321 - DNA, 25 bp, Homo sapien
ggagccctgcttgttgtcagaataa

SEQ ID NO: 536322 - DNA, 25 bp, Homo sapien
gagccctgcttgttgtcagaataat

SEQ ID NO: 536323 - DNA, 25 bp, Homo sapien
taaagagaactccagtgttgctatg

SEQ ID NO: 536324 - DNA, 25 bp, Homo sapien
agaactccagtgttgctatgtgcaa

SEQ ID NO: 536325 - DNA, 25 bp, Homo sapien
ccagtgttgctatgtgcaagatcct

SEQ ID NO: 536326 - DNA, 25 bp, Homo sapien
gcaattaaaggtgtgctatttgtca

SEQ ID NO: 536327 - DNA, 25 bp, Homo sapien
gtgctatttgtcagtagccattttt

SEQ ID NO: 536328 - DNA, 25 bp, Homo sapien
tttttgcagtgatttgaagaccaaa

SEQ ID NO: 536329 - DNA, 25 bp, Homo sapien
accaaagttgttttacagctgtgtt

SEQ ID NO: 536330 - DNA, 25 bp, Homo sapien
ttacagctgtgttaccgttaaaggt

SEQ ID NO: 536331 - DNA, 25 bp, Homo sapien
actgtttaaagctttgaatatctgc

SEQ ID NO: 536332 - DNA, 25 bp, Homo sapien
gctttgaatatctgcaatctttgcc

SEQ ID NO: 536333 - DNA, 25 bp, Homo sapien
gcaatctttgccaaggtactttttt

SEQ ID NO: 536334 - DNA, 25 bp, Homo sapien
cagcatgccaaggatttcaaggaat

SEQ ID NO: 536335 - DNA, 25 bp, Homo sapien
gaatatcacagatccgtcacaggca

SEQ ID NO: 536336 - DNA, 25 bp, Homo sapien
agatccgtcacaggcaaaatccaga

SEQ ID NO: 536337 - DNA, 25 bp, Homo sapien
aatccagaagctgaccaaggcagtg

SEQ ID NO: 536338 - DNA, 25 bp, Homo sapien
gggtaccgcaagctcatcgaccaga

SEQ ID NO: 536339 - DNA, 25 bp, Homo sapien
cgcaagctcatcgaccagaagaagg

SEQ ID NO: 536340 - DNA, 25 bp, Homo sapien
gaagaaggacaagcgcctggcctac

SEQ ID NO: 536341 - DNA, 25 bp, Homo sapien
tggcctacctcttgcagcagacaga

SEQ ID NO: 536342 - DNA, 25 bp, Homo sapien
ttgcagcagacagacgagtacgtgg

SEQ ID NO: 536343 - DNA, 25 bp, Homo sapien
agtacgtggctaacctcacggagct

SEQ ID NO: 536344 - DNA, 25 bp, Homo sapien
acaaggctgcccaggtcgccaagga

SEQ ID NO: 536345 - DNA, 25 bp, Homo sapien
gttacaagaattcacaaggtccgac

SEQ ID NO: 536346 - DNA, 25 bp, Homo sapien
aaggtccgacagatgcatttgctaa

SEQ ID NO: 536347 - DNA, 25 bp, Homo sapien
atggcagtcagtcagaaagttcagt

SEQ ID NO: 536348 - DNA, 25 bp, Homo sapien
aaagttcagtgtctactccatctgc

SEQ ID NO: 536349 - DNA, 25 bp, Homo sapien
tccatctgcgtcatttgaacctaac

SEQ ID NO: 536350 - DNA, 25 bp, Homo sapien
acacttgtgaaaactctcagtccag

SEQ ID NO: 536351 - DNA, 25 bp, Homo sapien
agtccagaaatgcagagctttgtga

SEQ ID NO: 536352 - DNA, 25 bp, Homo sapien
gagctttgtgagataccacccactt

SEQ ID NO: 536353 - DNA, 25 bp, Homo sapien
ttcctctcaggagcctagtggatgc

SEQ ID NO: 536354 - DNA, 25 bp, Homo sapien
ggatgctcagatcagagacctgcag

SEQ ID NO: 536355 - DNA, 25 bp, Homo sapien
agaggacctcaacatccgagtggaa

SEQ ID NO: 536356 - DNA, 25 bp, Homo sapien
acgccccgggaagacgcgagtcaga

SEQ ID NO: 536357 - DNA, 25 bp, Homo sapien
gacgcgagtcagacagatggcaaat

SEQ ID NO: 536358 - DNA, 25 bp, Homo sapien
aggagagctggcatctgacacgtgt

SEQ ID NO: 536359 - DNA, 25 bp, Homo sapien
ctggcatctgacacgtgtctgggag

SEQ ID NO: 536360 - DNA, 25 bp, Homo sapien
aaagccacgtttcccaggacagagg

SEQ ID NO: 536361 - DNA, 25 bp, Homo sapien
acgtttcccaggacagaggagtcgg

SEQ ID NO: 536362 - DNA, 25 bp, Homo sapien
gggcaccaagcaattctcagcttcc

SEQ ID NO: 536363 - DNA, 25 bp, Homo sapien
aagcaattctcagcttccttgtagt

SEQ ID NO: 536364 - DNA, 25 bp, Homo sapien
gtaagctgtgaattctcagaccaac

SEQ ID NO: 536365 - DNA, 25 bp, Homo sapien
gtgaattctcagaccaacagataaa

SEQ ID NO: 536366 - DNA, 25 bp, Homo sapien
gataaacctgtacacaaagatcagt

SEQ ID NO: 536367 - DNA, 25 bp, Homo sapien
ctctttggattctggtcatgagaag

SEQ ID NO: 536368 - DNA, 25 bp, Homo sapien
tgagaagaaggtaatttccagcctt

SEQ ID NO: 536369 - DNA, 25 bp, Homo sapien
aggtaatttccagccttcaagaaga

SEQ ID NO: 536370 - DNA, 25 bp, Homo sapien
gtaatttccagccttcaagaagaca

SEQ ID NO: 536371 - DNA, 25 bp, Homo sapien
atttccagccttcaagaagacagac

SEQ ID NO: 536372 - DNA, 25 bp, Homo sapien
gaagacagacatttagaagaagagc

SEQ ID NO: 536373 - DNA, 25 bp, Homo sapien
aaaagaagaacagctgcaggaaggg

SEQ ID NO: 536374 - DNA, 25 bp, Homo sapien
tgagcactgcgtacaaacatccaaa

SEQ ID NO: 536375 - DNA, 25 bp, Homo sapien
agcactgcgtacaaacatccaaaag

SEQ ID NO: 536376 - DNA, 25 bp, Homo sapien
gcgtacaaacatccaaaagttcaac

SEQ ID NO: 536377 - DNA, 25 bp, Homo sapien
caacaacaccagaactgtgtgtctc

SEQ ID NO: 536378 - DNA, 25 bp, Homo sapien
tacttgtctcaactaccactattta

SEQ ID NO: 536379 - DNA, 25 bp, Homo sapien
gtctcaactaccactatttattgtg

SEQ ID NO: 536380 - DNA, 25 bp, Homo sapien
ggaagtcctcttcagggattcagca

SEQ ID NO: 536381 - DNA, 25 bp, Homo sapien
gtcctcttcagggattcagcaaggg

SEQ ID NO: 536382 - DNA, 25 bp, Homo sapien
tcagcaagggctgtacttttgctta

SEQ ID NO: 536383 - DNA, 25 bp, Homo sapien
ttttgcttaatactagtggttcctt

SEQ ID NO: 536384 - DNA, 25 bp, Homo sapien
gtggttccttattctaagtgatgac

SEQ ID NO: 536385 - DNA, 25 bp, Homo sapien
tgatgacatcatccacctttcctag

SEQ ID NO: 536386 - DNA, 25 bp, Homo sapien
tttcctagaaatgggtctttgtgcc

SEQ ID NO: 536387 - DNA, 25 bp, Homo sapien
aatgggtctttgtgcctagtatgat

SEQ ID NO: 536388 - DNA, 25 bp, Homo sapien
tgtgcctagtatgatatctttccaa

SEQ ID NO: 536389 - DNA, 25 bp, Homo sapien
aagaatctcattttgtttcacacac

SEQ ID NO: 536390 - DNA, 25 bp, Homo sapien
ctcattttgtttcacacactggcac

SEQ ID NO: 536391 - DNA, 25 bp, Homo sapien
ttgtttcacacactggcacctggta

SEQ ID NO: 536392 - DNA, 25 bp, Homo sapien
ttcacacactggcacctggtatgga

SEQ ID NO: 536393 - DNA, 25 bp, Homo sapien
cactggcacctggtatggagatcaa

SEQ ID NO: 536394 - DNA, 25 bp, Homo sapien
gatcaacagttgctcaaaggaattt

SEQ ID NO: 536395 - DNA, 25 bp, Homo sapien
aattgggaattgattctgcaaggca

SEQ ID NO: 536396 - DNA, 25 bp, Homo sapien
aggcaaagtcaaacatttgttttat

SEQ ID NO: 536397 - DNA, 25 bp, Homo sapien
gcagttcttgcaagagatcacctat

SEQ ID NO: 536398 - DNA, 25 bp, Homo sapien
tgcaagagatcacctatactttttt

SEQ ID NO: 536399 - DNA, 25 bp, Homo sapien
ttcccccatcaggtataatgggtct

SEQ ID NO: 536400 - DNA, 25 bp, Homo sapien
agtgaatttcactgatgttgatatt

SEQ ID NO: 536401 - DNA, 25 bp, Homo sapien
ttcactgatgttgatattcattgtg

SEQ ID NO: 536402 - DNA, 25 bp, Homo sapien
gctaatgccagctgcgtgtctagtt

SEQ ID NO: 536403 - DNA, 25 bp, Homo sapien
atgccagctgcgtgtctagttttga

SEQ ID NO: 536404 - DNA, 25 bp, Homo sapien
gccagctgcgtgtctagttttgagt

SEQ ID NO: 536405 - DNA, 25 bp, Homo sapien
cagctgcgtgtctagttttgagtgc

SEQ ID NO: 536406 - DNA, 25 bp, Homo sapien
gcgtgtctagttttgagtgcagtaa

SEQ ID NO: 536407 - DNA, 25 bp, Homo sapien
agcaaatcactcttatttttcatcc

SEQ ID NO: 536408 - DNA, 25 bp, Homo sapien
gtgggagcagtgtacaccaactctt

SEQ ID NO: 536409 - DNA, 25 bp, Homo sapien
gagcagtgtacaccaactcttcctg

SEQ ID NO: 536410 - DNA, 25 bp, Homo sapien
accaactcttcctgtatattgcctt

SEQ ID NO: 536411 - DNA, 25 bp, Homo sapien
agtggtatgacttgatgcttctcta

SEQ ID NO: 536412 - DNA, 25 bp, Homo sapien
gtatgacttgatgcttctctattta

SEQ ID NO: 536413 - DNA, 25 bp, Homo sapien
tgcttctctatttaaaggcaaggaa

SEQ ID NO: 536414 - DNA, 25 bp, Homo sapien
ggattggtatatgattgcctgtaat

SEQ ID NO: 536415 - DNA, 25 bp, Homo sapien
aaattgcgtgattattggagtacat

SEQ ID NO: 536416 - DNA, 25 bp, Homo sapien
aacagaggagtattgaggagcttga

SEQ ID NO: 536417 - DNA, 25 bp, Homo sapien
tcaaactaaagccaagcctgaagat

SEQ ID NO: 536418 - DNA, 25 bp, Homo sapien
gaatcagttgtaaaagtgtgttggc

SEQ ID NO: 536419 - DNA, 25 bp, Homo sapien
aaagtgtgttggcaatgtccgaaat

SEQ ID NO: 536420 - DNA, 25 bp, Homo sapien
gtgttggcaatgtccgaaattgaat

SEQ ID NO: 536421 - DNA, 25 bp, Homo sapien
gaatgaaaaacatctggcttataag

SEQ ID NO: 536422 - DNA, 25 bp, Homo sapien
ggaacaaccatatagccaacctgtg

SEQ ID NO: 536423 - DNA, 25 bp, Homo sapien
atagccaacctgtggtctggcagaa

SEQ ID NO: 536424 - DNA, 25 bp, Homo sapien
ggtctggcagaaacaacgtctctag

SEQ ID NO: 536425 - DNA, 25 bp, Homo sapien
aacgtctctagcaatagtaccaaag

SEQ ID NO: 536426 - DNA, 25 bp, Homo sapien
tggcaggtctgcagtaaaagataac

SEQ ID NO: 536427 - DNA, 25 bp, Homo sapien
attttcttttcttagtcctcctgct

SEQ ID NO: 536428 - DNA, 25 bp, Homo sapien
tattttgcctttgaatacgtgggtt

SEQ ID NO: 536429 - DNA, 25 bp, Homo sapien
agcccaaaatggtaactgtctccag

SEQ ID NO: 536430 - DNA, 25 bp, Homo sapien
gtctccagaacagcaaccacattga

SEQ ID NO: 536431 - DNA, 25 bp, Homo sapien
aattcttgtgacttaggaaagcttc

SEQ ID NO: 536432 - DNA, 25 bp, Homo sapien
gaaagcttcttatagttgctgacat

SEQ ID NO: 536433 - DNA, 25 bp, Homo sapien
gctactacaccaacaggcatgatag

SEQ ID NO: 536434 - DNA, 25 bp, Homo sapien
ggatatggaattcctccacaaatgg

SEQ ID NO: 536435 - DNA, 25 bp, Homo sapien
gggaagtgttcctgtaatgacgcaa

SEQ ID NO: 536436 - DNA, 25 bp, Homo sapien
tttggccctgtatcaggagcacaga

SEQ ID NO: 536437 - DNA, 25 bp, Homo sapien
gcagcaaaatccttacttccagcaa

SEQ ID NO: 536438 - DNA, 25 bp, Homo sapien
cttccagcaaaatccaaactgctgt

SEQ ID NO: 536439 - DNA, 25 bp, Homo sapien
caaactgctgtctcttaaatctctt

SEQ ID NO: 536440 - DNA, 25 bp, Homo sapien
aaatctcttaaactctcttcttcca

SEQ ID NO: 536441 - DNA, 25 bp, Homo sapien
aatctcttaaactctcttcttccat

SEQ ID NO: 536442 - DNA, 25 bp, Homo sapien
aactctcttcttccattaaaatgta

SEQ ID NO: 536443 - DNA, 25 bp, Homo sapien
aaaatgtatgttagcaaaatgggtg

SEQ ID NO: 536444 - DNA, 25 bp, Homo sapien
aatgaaacgggcagccatggccctc

SEQ ID NO: 536445 - DNA, 25 bp, Homo sapien
ctccacagcccgcagtatatttttg

SEQ ID NO: 536446 - DNA, 25 bp, Homo sapien
gcccgcagtatatttttggagattt

SEQ ID NO: 536447 - DNA, 25 bp, Homo sapien
gagattttagccctgatgaattcaa

SEQ ID NO: 536448 - DNA, 25 bp, Homo sapien
atcaattctttgtgactcctcgatc

SEQ ID NO: 536449 - DNA, 25 bp, Homo sapien
gactcctcgatcttcagttgagctt

SEQ ID NO: 536450 - DNA, 25 bp, Homo sapien
agttgagcttcctccatacagtgga

SEQ ID NO: 536451 - DNA, 25 bp, Homo sapien
acagtggaacagttctgtgtggcac

SEQ ID NO: 536452 - DNA, 25 bp, Homo sapien
tgtgtggcacacaggctgtggataa

SEQ ID NO: 536453 - DNA, 25 bp, Homo sapien
gctgtggataaactacctgatggac

SEQ ID NO: 536454 - DNA, 25 bp, Homo sapien
ggaggatcgcggagtcccaatgaaa

SEQ ID NO: 536455 - DNA, 25 bp, Homo sapien
acttaccacttcaggatgactatcc

SEQ ID NO: 536456 - DNA, 25 bp, Homo sapien
taccacttcaggatgactatcctcc

SEQ ID NO: 536457 - DNA, 25 bp, Homo sapien
gagaagctgaaaacggtgctgcaga

SEQ ID NO: 536458 - DNA, 25 bp, Homo sapien
ggtgaaagacttccacatcaacttc

SEQ ID NO: 536459 - DNA, 25 bp, Homo sapien
gacttccacatcaacttcctggaga

SEQ ID NO: 536460 - DNA, 25 bp, Homo sapien
gaagtacgcgtgaggacgcctgagc

SEQ ID NO: 536461 - DNA, 25 bp, Homo sapien
agccccagcgggagacctgtccttg

SEQ ID NO: 536462 - DNA, 25 bp, Homo sapien
cagcgggagacctgtccttggctct

SEQ ID NO: 536463 - DNA, 25 bp, Homo sapien
tcgcagaggccgctggtcacttcgt

SEQ ID NO: 536464 - DNA, 25 bp, Homo sapien
gctggtcacttcgtcatcattttgc

SEQ ID NO: 536465 - DNA, 25 bp, Homo sapien
cttcgtcatcattttgcccctggag

SEQ ID NO: 536466 - DNA, 25 bp, Homo sapien
gttatttaacagctgaattatctat

SEQ ID NO: 536467 - DNA, 25 bp, Homo sapien
gctgaattatctatacatatcttta

SEQ ID NO: 536468 - DNA, 25 bp, Homo sapien
ttattaatcactattgttccagcag

SEQ ID NO: 536469 - DNA, 25 bp, Homo sapien
tgttccagcagttttcaagtcaaat

SEQ ID NO: 536470 - DNA, 25 bp, Homo sapien
ccagcagttttcaagtcaaattaat

SEQ ID NO: 536471 - DNA, 25 bp, Homo sapien
gttactaggtaacttcatattgctg

SEQ ID NO: 536472 - DNA, 25 bp, Homo sapien
gttcaattagaatagtgttctgcaa

SEQ ID NO: 536473 - DNA, 25 bp, Homo sapien
atagtgttctgcaaaaatatttata

SEQ ID NO: 536474 - DNA, 25 bp, Homo sapien
aaaacttctcaagatactgctactg

SEQ ID NO: 536475 - DNA, 25 bp, Homo sapien
acttctcaagatactgctactgtaa

SEQ ID NO: 536476 - DNA, 25 bp, Homo sapien
gatactgctactgtaattttatatg

SEQ ID NO: 536477 - DNA, 25 bp, Homo sapien
aaggctgctgttcatcccacatcgt

SEQ ID NO: 536478 - DNA, 25 bp, Homo sapien
tgctgttcatcccacatcgtgtggg

SEQ ID NO: 536479 - DNA, 25 bp, Homo sapien
agtgtccatcccctgcagctacttg

SEQ ID NO: 536480 - DNA, 25 bp, Homo sapien
atcccctgcagctacttggtgactt

SEQ ID NO: 536481 - DNA, 25 bp, Homo sapien
cctgcagctacttggtgacttaaca

SEQ ID NO: 536482 - DNA, 25 bp, Homo sapien
gcagctacttggtgacttaacaact

SEQ ID NO: 536483 - DNA, 25 bp, Homo sapien
ggtgacttaacaactccaggagccc

SEQ ID NO: 536484 - DNA, 25 bp, Homo sapien
gacttaacaactccaggagccctgt

SEQ ID NO: 536485 - DNA, 25 bp, Homo sapien
aacaactccaggagccctgtcagct

SEQ ID NO: 536486 - DNA, 25 bp, Homo sapien
ccagcttttctcaaaatagtcctat

SEQ ID NO: 536487 - DNA, 25 bp, Homo sapien
ctcaaaatagtcctatagatactgg

SEQ ID NO: 536488 - DNA, 25 bp, Homo sapien
agcacgccaaggcagtgtcctactg

SEQ ID NO: 536489 - DNA, 25 bp, Homo sapien
gtgtcctactgatccaggctatgag

SEQ ID NO: 536490 - DNA, 25 bp, Homo sapien
gatccaggctatgagaatccaaaca

SEQ ID NO: 536491 - DNA, 25 bp, Homo sapien
acattctttcccaggtttggcattt

SEQ ID NO: 536492 - DNA, 25 bp, Homo sapien
ggcattttatagttagaagcatttc

SEQ ID NO: 536493 - DNA, 25 bp, Homo sapien
gttagaagcatttctgcaacagcag

SEQ ID NO: 536494 - DNA, 25 bp, Homo sapien
gcaacagcagtttcatggaacctct

SEQ ID NO: 536495 - DNA, 25 bp, Homo sapien
tttcatggaacctctcttagctaac

SEQ ID NO: 536496 - DNA, 25 bp, Homo sapien
tctcttagctaacctggtccatggg

SEQ ID NO: 536497 - DNA, 25 bp, Homo sapien
gggcagcagttacgctctaagaatc

SEQ ID NO: 536498 - DNA, 25 bp, Homo sapien
tacgctctaagaatccatgtggtaa

SEQ ID NO: 536499 - DNA, 25 bp, Homo sapien
ggagcaatccaagccacatatcttc

SEQ ID NO: 536500 - DNA, 25 bp, Homo sapien
agccacatatcttctacatcaaatt

SEQ ID NO: 536501 - DNA, 25 bp, Homo sapien
atctggtattgcattttgccttccc

SEQ ID NO: 536502 - DNA, 25 bp, Homo sapien
cttccctgttcatacctcaaattga

SEQ ID NO: 536503 - DNA, 25 bp, Homo sapien
gattcatacctcagtttaattcaga

SEQ ID NO: 536504 - DNA, 25 bp, Homo sapien
agtgacggattctgttgtggtttga

SEQ ID NO: 536505 - DNA, 25 bp, Homo sapien
aatgcagtaccagtgttctcttcga

SEQ ID NO: 536506 - DNA, 25 bp, Homo sapien
tgttctcttcgagcaaagtagacct

SEQ ID NO: 536507 - DNA, 25 bp, Homo sapien
gtagacctgggtcactgtaggcata

SEQ ID NO: 536508 - DNA, 25 bp, Homo sapien
ggacttggattgcttcagatggttt

SEQ ID NO: 536509 - DNA, 25 bp, Homo sapien
tggtttgctgtatcatttttcttct

SEQ ID NO: 536510 - DNA, 25 bp, Homo sapien
gtagattgcttctgtagtactcctt

SEQ ID NO: 536511 - DNA, 25 bp, Homo sapien
gattgcttctgtagtactccttaag

SEQ ID NO: 536512 - DNA, 25 bp, Homo sapien
gtactccttaagaacacaaagcggg

SEQ ID NO: 536513 - DNA, 25 bp, Homo sapien
tttgtgagagcgaggctgagcctac

SEQ ID NO: 536514 - DNA, 25 bp, Homo sapien
ggctgagcctacagatgaactcttt

SEQ ID NO: 536515 - DNA, 25 bp, Homo sapien
tgagcctacagatgaactctttctg

SEQ ID NO: 536516 - DNA, 25 bp, Homo sapien
gtcaataaacagcttcatgcctttg

SEQ ID NO: 536517 - DNA, 25 bp, Homo sapien
cagcttcatgcctttgtaagttatt

SEQ ID NO: 536518 - DNA, 25 bp, Homo sapien
ttgtttgtttgggtatcctgcccag

SEQ ID NO: 536519 - DNA, 25 bp, Homo sapien
tcctgcccagtgttgtttgtaaata

SEQ ID NO: 536520 - DNA, 25 bp, Homo sapien
gagatttggagcactctgagtttac

SEQ ID NO: 536521 - DNA, 25 bp, Homo sapien
cctcctgttctggaatgctgccgaa

SEQ ID NO: 536522 - DNA, 25 bp, Homo sapien
gtctgacaagcattggcactgtggt

SEQ ID NO: 536523 - DNA, 25 bp, Homo sapien
gtgcacagtcagtgaacttcttcat

SEQ ID NO: 536524 - DNA, 25 bp, Homo sapien
gaacttcttcattattctccagtcc

SEQ ID NO: 536525 - DNA, 25 bp, Homo sapien
tattctccagtccagagattctgac

SEQ ID NO: 536526 - DNA, 25 bp, Homo sapien
gtccagagattctgactctctacta

SEQ ID NO: 536527 - DNA, 25 bp, Homo sapien
gagattctgactctctactaaaagt

SEQ ID NO: 536528 - DNA, 25 bp, Homo sapien
attgcaatttgggtatgttaagaaa

SEQ ID NO: 536529 - DNA, 25 bp, Homo sapien
aagcactaaggttttaagctgcctg

SEQ ID NO: 536530 - DNA, 25 bp, Homo sapien
aaggttttaagctgcctgaatcttt

SEQ ID NO: 536531 - DNA, 25 bp, Homo sapien
aagctgcctgaatcttttagtagaa

SEQ ID NO: 536532 - DNA, 25 bp, Homo sapien
agagccatcagctgtgtcgatccag

SEQ ID NO: 536533 - DNA, 25 bp, Homo sapien
atcagctgtgtcgatccaggatgcc

SEQ ID NO: 536534 - DNA, 25 bp, Homo sapien
aggacgcgcatgtcctgctcagcag

SEQ ID NO: 536535 - DNA, 25 bp, Homo sapien
agcctggtacggtgatgctgtccac

SEQ ID NO: 536536 - DNA, 25 bp, Homo sapien
tccccaggaggtcatagagcccgta

SEQ ID NO: 536537 - DNA, 25 bp, Homo sapien
gtcatagagcccgtagttgttctgg

SEQ ID NO: 536538 - DNA, 25 bp, Homo sapien
ggaactttccctgccacaggttggt

SEQ ID NO: 536539 - DNA, 25 bp, Homo sapien
tccctgccacaggttggtgcggttt

SEQ ID NO: 536540 - DNA, 25 bp, Homo sapien
gtgcggtttggctggaaccagttcc

SEQ ID NO: 536541 - DNA, 25 bp, Homo sapien
ccccatgggtaaacttgaccttcat

SEQ ID NO: 536542 - DNA, 25 bp, Homo sapien
aacttgaccttcattggctgggtgg

SEQ ID NO: 536543 - DNA, 25 bp, Homo sapien
ttgccaaaagcaaaaacccgggcag

SEQ ID NO: 536544 - DNA, 25 bp, Homo sapien
cagctgacttgttggtgaatcccct

SEQ ID NO: 536545 - DNA, 25 bp, Homo sapien
gacttgttggtgaatcccctggatc

SEQ ID NO: 536546 - DNA, 25 bp, Homo sapien
ggtgaatcccctggatccgcggaat

SEQ ID NO: 536547 - DNA, 25 bp, Homo sapien
gttgggtgcataaacacttcacgga

SEQ ID NO: 536548 - DNA, 25 bp, Homo sapien
agacgcgtcagtaccgctccataga

SEQ ID NO: 536549 - DNA, 25 bp, Homo sapien
gtaccgctccatagaggttttaata

SEQ ID NO: 536550 - DNA, 25 bp, Homo sapien
ggtacagcacccctgcggacatctg

SEQ ID NO: 536551 - DNA, 25 bp, Homo sapien
cggacatctggagcacggcgtgtat

SEQ ID NO: 536552 - DNA, 25 bp, Homo sapien
ctggcaacgggagattatttgtttg

SEQ ID NO: 536553 - DNA, 25 bp, Homo sapien
attatttgtttgaaccacattctgg

SEQ ID NO: 536554 - DNA, 25 bp, Homo sapien
accagctctttatcgcttttcttta

SEQ ID NO: 536555 - DNA, 25 bp, Homo sapien
aggtataccatttagcagctgtccg

SEQ ID NO: 536556 - DNA, 25 bp, Homo sapien
atttagcagctgtccgccttcggga

SEQ ID NO: 536557 - DNA, 25 bp, Homo sapien
ttcgggatctctgtgccaaactaga

SEQ ID NO: 536558 - DNA, 25 bp, Homo sapien
aaatctggacctgctttgaattctc

SEQ ID NO: 536559 - DNA, 25 bp, Homo sapien
ttcagtgtcctgaacttatgatgga

SEQ ID NO: 536560 - DNA, 25 bp, Homo sapien
atggacagacatctggaccagttat

SEQ ID NO: 536561 - DNA, 25 bp, Homo sapien
ggaccagttattaatgtgtgccatt

SEQ ID NO: 536562 - DNA, 25 bp, Homo sapien
tccttccagaacattatgcgttgtt

SEQ ID NO: 536563 - DNA, 25 bp, Homo sapien
ttgttataggactcagccgcaggcc

SEQ ID NO: 536564 - DNA, 25 bp, Homo sapien
ccggagccaggtgtatagaagtgtt

SEQ ID NO: 536565 - DNA, 25 bp, Homo sapien
ggttttctggatataaatttgcatg

SEQ ID NO: 536566 - DNA, 25 bp, Homo sapien
gcatggtatagtcataatagctttt

SEQ ID NO: 536567 - DNA, 25 bp, Homo sapien
gctttttatatgcatttggcaccaa

SEQ ID NO: 536568 - DNA, 25 bp, Homo sapien
atttggcaccaagactgggatccac

SEQ ID NO: 536569 - DNA, 25 bp, Homo sapien
gactgggatccacaactttgtagac

SEQ ID NO: 536570 - DNA, 25 bp, Homo sapien
acaactttgtagacactgcgatgaa

SEQ ID NO: 536571 - DNA, 25 bp, Homo sapien
gtagacactgcgatgaagttaacat

SEQ ID NO: 536572 - DNA, 25 bp, Homo sapien
gaagttaacatattagctatactat

SEQ ID NO: 536573 - DNA, 25 bp, Homo sapien
aagatccttgggtatgtgtttgctt

SEQ ID NO: 536574 - DNA, 25 bp, Homo sapien
gtgtttgctttactccatttcagaa

SEQ ID NO: 536575 - DNA, 25 bp, Homo sapien
tttgctttactccatttcagaagaa

SEQ ID NO: 536576 - DNA, 25 bp, Homo sapien
aaacattttgttactcttggaattg

SEQ ID NO: 536577 - DNA, 25 bp, Homo sapien
tactcttggaattgactctggctgt

SEQ ID NO: 536578 - DNA, 25 bp, Homo sapien
gtgagccattagagtaacatcgaat

SEQ ID NO: 536579 - DNA, 25 bp, Homo sapien
agagctgcccaggtgaattaaattt

SEQ ID NO: 536580 - DNA, 25 bp, Homo sapien
aatttttccaggacactagctagtg

SEQ ID NO: 536581 - DNA, 25 bp, Homo sapien
actagctagtgtgccttggattgat

SEQ ID NO: 536582 - DNA, 25 bp, Homo sapien
tgtgccttggattgattacctcttc

SEQ ID NO: 536583 - DNA, 25 bp, Homo sapien
tctactgcattgaaaggcgccatgt

SEQ ID NO: 536584 - DNA, 25 bp, Homo sapien
attgaaaggcgccatgttttcctga

SEQ ID NO: 536585 - DNA, 25 bp, Homo sapien
gaaatactaaattcccaacacctgg

SEQ ID NO: 536586 - DNA, 25 bp, Homo sapien
gtaaacaatgaccttccagagagtg

SEQ ID NO: 536587 - DNA, 25 bp, Homo sapien
gaagaaaactattgtactcttttgt

SEQ ID NO: 536588 - DNA, 25 bp, Homo sapien
aatagatgtctgttcatgtgttaag

SEQ ID NO: 536589 - DNA, 25 bp, Homo sapien
atgtctgttcatgtgttaagtgtta

SEQ ID NO: 536590 - DNA, 25 bp, Homo sapien
gttcatgtgttaagtgttatagcaa

SEQ ID NO: 536591 - DNA, 25 bp, Homo sapien
gtttttgttttatcagaatggcaac

SEQ ID NO: 536592 - DNA, 25 bp, Homo sapien
gaatggcaacagacagaagtacttt

SEQ ID NO: 536593 - DNA, 25 bp, Homo sapien
gtactttgtagagattgacttccta

SEQ ID NO: 536594 - DNA, 25 bp, Homo sapien
gagattgacttcctaagctacttaa

SEQ ID NO: 536595 - DNA, 25 bp, Homo sapien
gctacttaagacaacttgcaccact

SEQ ID NO: 536596 - DNA, 25 bp, Homo sapien
aagacaacttgcaccactaagaaaa

SEQ ID NO: 536597 - DNA, 25 bp, Homo sapien
tgaaatttagtagttccaagtttca

SEQ ID NO: 536598 - DNA, 25 bp, Homo sapien
acagaagggcagtgactcgacaaag

SEQ ID NO: 536599 - DNA, 25 bp, Homo sapien
cagaagggcagtgactcgacaaagg

SEQ ID NO: 536600 - DNA, 25 bp, Homo sapien
agaagggcagtgactcgacaaaggc

SEQ ID NO: 536601 - DNA, 25 bp, Homo sapien
gaagggcagtgactcgacaaaggcc

SEQ ID NO: 536602 - DNA, 25 bp, Homo sapien
aagggcagtgactcgacaaaggcca

SEQ ID NO: 536603 - DNA, 25 bp, Homo sapien
agggcagtgactcgacaaaggccac

SEQ ID NO: 536604 - DNA, 25 bp, Homo sapien
gggcagtgactcgacaaaggccaca

SEQ ID NO: 536605 - DNA, 25 bp, Homo sapien
ggcagtgactcgacaaaggccacag

SEQ ID NO: 536606 - DNA, 25 bp, Homo sapien
gcagtgactcgacaaaggccacagg

SEQ ID NO: 536607 - DNA, 25 bp, Homo sapien
cagtgactcgacaaaggccacaggc

SEQ ID NO: 536608 - DNA, 25 bp, Homo sapien
ctcctgaggatctgcggctggtgct

SEQ ID NO: 536609 - DNA, 25 bp, Homo sapien
agctccgcacggagcacaagccttg

SEQ ID NO: 536610 - DNA, 25 bp, Homo sapien
ggagcacaagccttgcacctatcaa

SEQ ID NO: 536611 - DNA, 25 bp, Homo sapien
aagccttgcacctatcaacaatgtc

SEQ ID NO: 536612 - DNA, 25 bp, Homo sapien
ctatcaacaatgtccctgcaaccga

SEQ ID NO: 536613 - DNA, 25 bp, Homo sapien
tccctgcaaccgacttcgggaagag

SEQ ID NO: 536614 - DNA, 25 bp, Homo sapien
gacttcgggaagagtgccccctgga

SEQ ID NO: 536615 - DNA, 25 bp, Homo sapien
cctggacacaagtctctgtactgac

SEQ ID NO: 536616 - DNA, 25 bp, Homo sapien
gacacaagtctctgtactgacacca

SEQ ID NO: 536617 - DNA, 25 bp, Homo sapien
agtctctgtactgacaccaactgtg

SEQ ID NO: 536618 - DNA, 25 bp, Homo sapien
tgacaccaactgtgcctctcagagc

SEQ ID NO: 536619 - DNA, 25 bp, Homo sapien
ttgaaatgatggatggctcactgcc

SEQ ID NO: 536620 - DNA, 25 bp, Homo sapien
ggatggctcactgccataggctgat

SEQ ID NO: 536621 - DNA, 25 bp, Homo sapien
tgccataggctgatagcagttgtca

SEQ ID NO: 536622 - DNA, 25 bp, Homo sapien
aaatctttcatattggcttgttggt

SEQ ID NO: 536623 - DNA, 25 bp, Homo sapien
attggcttgttggttatataacttc

SEQ ID NO: 536624 - DNA, 25 bp, Homo sapien
tacttacgtagtaattacatttcct

SEQ ID NO: 536625 - DNA, 25 bp, Homo sapien
agtgaatagaaatccctagccattt

SEQ ID NO: 536626 - DNA, 25 bp, Homo sapien
gaatgggacatccaagatccctaaa

SEQ ID NO: 536627 - DNA, 25 bp, Homo sapien
aaaagaattgttcgatagcgtgcat

SEQ ID NO: 536628 - DNA, 25 bp, Homo sapien
gttcgatagcgtgcatgtgttataa

SEQ ID NO: 536629 - DNA, 25 bp, Homo sapien
tgttataaagtggtgacacgggcat

SEQ ID NO: 536630 - DNA, 25 bp, Homo sapien
attatgatcatctaccaccaactct

SEQ ID NO: 536631 - DNA, 25 bp, Homo sapien
ctctgctcagccctgtaacagggta

SEQ ID NO: 536632 - DNA, 25 bp, Homo sapien
ggaagagctttgacttgtccctgtc

SEQ ID NO: 536633 - DNA, 25 bp, Homo sapien
gtccctgtctatacattctctgtat

SEQ ID NO: 536634 - DNA, 25 bp, Homo sapien
gggtaacttcttggcagtttttcag

SEQ ID NO: 536635 - DNA, 25 bp, Homo sapien
gcagtttttcagtgttcagccatgt

SEQ ID NO: 536636 - DNA, 25 bp, Homo sapien
gtgttcagccatgtcagttgaaact

SEQ ID NO: 536637 - DNA, 25 bp, Homo sapien
attttttacttacccatgtgagcct

SEQ ID NO: 536638 - DNA, 25 bp, Homo sapien
atgtgagcctaacactatcctgtaa

SEQ ID NO: 536639 - DNA, 25 bp, Homo sapien
cctgtaattcattttctcaggctat

SEQ ID NO: 536640 - DNA, 25 bp, Homo sapien
ggctatgtgtaaatgtagaacccta

SEQ ID NO: 536641 - DNA, 25 bp, Homo sapien
aaccaaacattctatttaatttgca

SEQ ID NO: 536642 - DNA, 25 bp, Homo sapien
aatgacttgcagtacttttttccct

SEQ ID NO: 536643 - DNA, 25 bp, Homo sapien
ttttttccctatccttatcctgtga

SEQ ID NO: 536644 - DNA, 25 bp, Homo sapien
ccctatccttatcctgtgaaactta

SEQ ID NO: 536645 - DNA, 25 bp, Homo sapien
tccttatcctgtgaaacttactatc

SEQ ID NO: 536646 - DNA, 25 bp, Homo sapien
ttactatcataaggttctaaaacag

SEQ ID NO: 536647 - DNA, 25 bp, Homo sapien
ttataatttgcaccattacaaagaa

SEQ ID NO: 536648 - DNA, 25 bp, Homo sapien
tacaaagaaattgctgtcagggttt

SEQ ID NO: 536649 - DNA, 25 bp, Homo sapien
aaattgctgtcagggttttacacat

SEQ ID NO: 536650 - DNA, 25 bp, Homo sapien
caatttcaaatgtgtatatcgtcaa

SEQ ID NO: 536651 - DNA, 25 bp, Homo sapien
aatgtgtatatcgtcaataaatcta

SEQ ID NO: 536652 - DNA, 25 bp, Homo sapien
gtttcctctgacttggtatatgctc

SEQ ID NO: 536653 - DNA, 25 bp, Homo sapien
tcctctgacttggtatatgctcatc

SEQ ID NO: 536654 - DNA, 25 bp, Homo sapien
gacttggtatatgctcatctgagtg

SEQ ID NO: 536655 - DNA, 25 bp, Homo sapien
gtatatgctcatctgagtgacggat

SEQ ID NO: 536656 - DNA, 25 bp, Homo sapien
atgctcatctgagtgacggatatgt

SEQ ID NO: 536657 - DNA, 25 bp, Homo sapien
tctgagtgacggatatgtgaaattt

SEQ ID NO: 536658 - DNA, 25 bp, Homo sapien
gtgaaatttgtagaactggttagtc

SEQ ID NO: 536659 - DNA, 25 bp, Homo sapien
gtagaactggttagtcaaatggcca

SEQ ID NO: 536660 - DNA, 25 bp, Homo sapien
gtcaaatggccagactatttcatta

SEQ ID NO: 536661 - DNA, 25 bp, Homo sapien
aaatggccagactatttcattaatt

SEQ ID NO: 536662 - DNA, 25 bp, Homo sapien
ttaaagcacctttgttagtaaacag

SEQ ID NO: 536663 - DNA, 25 bp, Homo sapien
gcacatacagtctatactttgttta

SEQ ID NO: 536664 - DNA, 25 bp, Homo sapien
ttataaataccctaggtcctccctg

SEQ ID NO: 536665 - DNA, 25 bp, Homo sapien
atatattttggtgaagctgtggtgc

SEQ ID NO: 536666 - DNA, 25 bp, Homo sapien
gctgtggtgcactattaattttctg

SEQ ID NO: 536667 - DNA, 25 bp, Homo sapien
aattcttgcagctgtgttttggaaa

SEQ ID NO: 536668 - DNA, 25 bp, Homo sapien
gattaagcaatatttctcaaacctg

SEQ ID NO: 536669 - DNA, 25 bp, Homo sapien
ctcaaacctgatgattcttggatat

SEQ ID NO: 536670 - DNA, 25 bp, Homo sapien
ggatatttagctattgtcctccaaa

SEQ ID NO: 536671 - DNA, 25 bp, Homo sapien
tcctccaaagagtcatcgtttcacg

SEQ ID NO: 536672 - DNA, 25 bp, Homo sapien
gagtcatcgtttcacgttttcaaac

SEQ ID NO: 536673 - DNA, 25 bp, Homo sapien
gttttcaaacatgtgctttgtgctg

SEQ ID NO: 536674 - DNA, 25 bp, Homo sapien
cccgagcagcggtggtacatgaacc

SEQ ID NO: 536675 - DNA, 25 bp, Homo sapien
tgaaccgatttgtgggcatcctcat

SEQ ID NO: 536676 - DNA, 25 bp, Homo sapien
tcatggctgggatcttgcccttcgg

SEQ ID NO: 536677 - DNA, 25 bp, Homo sapien
atgttcatcgagctcttcttcatct

SEQ ID NO: 536678 - DNA, 25 bp, Homo sapien
ttcatcttcagtgctatctgggaga

SEQ ID NO: 536679 - DNA, 25 bp, Homo sapien
agttctattacctctttggcttcct

SEQ ID NO: 536680 - DNA, 25 bp, Homo sapien
tgttttcatcatcctggtggtatcc

SEQ ID NO: 536681 - DNA, 25 bp, Homo sapien
ggtggtatcctgttcacaaatcagc

SEQ ID NO: 536682 - DNA, 25 bp, Homo sapien
agcatcgtcatggtgtacttccagc

SEQ ID NO: 536683 - DNA, 25 bp, Homo sapien
agctgtgtgcagaggattaccgctg

SEQ ID NO: 536684 - DNA, 25 bp, Homo sapien
gtggagaaatttcctagtctccggg

SEQ ID NO: 536685 - DNA, 25 bp, Homo sapien
cggtactctggataacgaagcttgt

SEQ ID NO: 536686 - DNA, 25 bp, Homo sapien
gaagcttgtgcagagtggtaaccat

SEQ ID NO: 536687 - DNA, 25 bp, Homo sapien
gtggtaaccatgcttacacactaaa

SEQ ID NO: 536688 - DNA, 25 bp, Homo sapien
gaagccatgttaatctgagagcagt

SEQ ID NO: 536689 - DNA, 25 bp, Homo sapien
ctgagagcagtgtcgccatagttgt

SEQ ID NO: 536690 - DNA, 25 bp, Homo sapien
gtgtcgccatagttgtgttgtttac

SEQ ID NO: 536691 - DNA, 25 bp, Homo sapien
taaatgggttcctgttgccctgtaa

SEQ ID NO: 536692 - DNA, 25 bp, Homo sapien
tgccctgtaattaaactgctgcccg

SEQ ID NO: 536693 - DNA, 25 bp, Homo sapien
aaactgctgcccgtagaggcctttc

SEQ ID NO: 536694 - DNA, 25 bp, Homo sapien
tagaggcctttcagttccttttctg

SEQ ID NO: 536695 - DNA, 25 bp, Homo sapien
ttccccttcttaacacaagctcaaa

SEQ ID NO: 536696 - DNA, 25 bp, Homo sapien
ctggcccactctgtaatagttcagt

SEQ ID NO: 536697 - DNA, 25 bp, Homo sapien
gattttacctatccacaatagtcag

SEQ ID NO: 536698 - DNA, 25 bp, Homo sapien
acaacttggcatttctatactttac

SEQ ID NO: 536699 - DNA, 25 bp, Homo sapien
gatttccatcttaatgttactcaga

SEQ ID NO: 536700 - DNA, 25 bp, Homo sapien
aagagaagtctcattcgcctttgtc

SEQ ID NO: 536701 - DNA, 25 bp, Homo sapien
attcgcctttgtcttgtacttctgt

SEQ ID NO: 536702 - DNA, 25 bp, Homo sapien
gtcttgtacttctgtgttcattttt

SEQ ID NO: 536703 - DNA, 25 bp, Homo sapien
tttggctagagtttccactatccca

SEQ ID NO: 536704 - DNA, 25 bp, Homo sapien
gagtttccactatcccaatcaaaga

SEQ ID NO: 536705 - DNA, 25 bp, Homo sapien
gaattacagtacacatccccagaat

SEQ ID NO: 536706 - DNA, 25 bp, Homo sapien
gtacacatccccagaatccataaat

SEQ ID NO: 536707 - DNA, 25 bp, Homo sapien
gagcagaagcttcgtgcctgtttag

SEQ ID NO: 536708 - DNA, 25 bp, Homo sapien
agcagaagcttcgtgcctgtttaga

SEQ ID NO: 536709 - DNA, 25 bp, Homo sapien
gcagaagcttcgtgcctgtttagag

SEQ ID NO: 536710 - DNA, 25 bp, Homo sapien
cagaagcttcgtgcctgtttagagg

SEQ ID NO: 536711 - DNA, 25 bp, Homo sapien
aagcttcgtgcctgtttagagggta

SEQ ID NO: 536712 - DNA, 25 bp, Homo sapien
gcttcgtgcctgtttagagggtagt

SEQ ID NO: 536713 - DNA, 25 bp, Homo sapien
ttcgtgcctgtttagagggtagtat

SEQ ID NO: 536714 - DNA, 25 bp, Homo sapien
aagtccagtcttctcatgagctgtc

SEQ ID NO: 536715 - DNA, 25 bp, Homo sapien
agtccagtcttctcatgagctgtct

SEQ ID NO: 536716 - DNA, 25 bp, Homo sapien
gtccagtcttctcatgagctgtctg

SEQ ID NO: 536717 - DNA, 25 bp, Homo sapien
tccagtcttctcatgagctgtctgg

SEQ ID NO: 536718 - DNA, 25 bp, Homo sapien
ggcaggggtgcttcctcctcaggcc

SEQ ID NO: 536719 - DNA, 25 bp, Homo sapien
ctgctcccctggaggacagagggag

SEQ ID NO: 536720 - DNA, 25 bp, Homo sapien
cagagggagacagggctgctcccca

SEQ ID NO: 536721 - DNA, 25 bp, Homo sapien
gacagaagggcagtgactcgacaaa

SEQ ID NO: 536722 - DNA, 25 bp, Homo sapien
ggcagtgactcgacaaaggccacag

SEQ ID NO: 536723 - DNA, 25 bp, Homo sapien
aaggccacaggcagtccaggcctct

SEQ ID NO: 536724 - DNA, 25 bp, Homo sapien
ccacacctggcatggtgcagggaga

SEQ ID NO: 536725 - DNA, 25 bp, Homo sapien
tgcagggagacatctgcacccctga

SEQ ID NO: 536726 - DNA, 25 bp, Homo sapien
acatctgcacccctgagttgggcag

SEQ ID NO: 536727 - DNA, 25 bp, Homo sapien
gcacccctgagttgggcagccagga

SEQ ID NO: 536728 - DNA, 25 bp, Homo sapien
gagtgcccccgggaatggataataa

SEQ ID NO: 536729 - DNA, 25 bp, Homo sapien
aaatgaccctgtgactaacatctgt

SEQ ID NO: 536730 - DNA, 25 bp, Homo sapien
tgaccctgtgactaacatctgtcag

SEQ ID NO: 536731 - DNA, 25 bp, Homo sapien
gactaacatctgtcaggcagctgac

SEQ ID NO: 536732 - DNA, 25 bp, Homo sapien
gtcaggcagctgacaaacagctatt

SEQ ID NO: 536733 - DNA, 25 bp, Homo sapien
gctgacaaacagctattcacgcttg

SEQ ID NO: 536734 - DNA, 25 bp, Homo sapien
aacagctattcacgcttgttgagtg

SEQ ID NO: 536735 - DNA, 25 bp, Homo sapien
ttcacgcttgttgagtgggcgaaga

SEQ ID NO: 536736 - DNA, 25 bp, Homo sapien
gggcgaagaggatcccacacttttc

SEQ ID NO: 536737 - DNA, 25 bp, Homo sapien
agaggatcccacacttttcctcctt

SEQ ID NO: 536738 - DNA, 25 bp, Homo sapien
tccttgcctctggatgatcaggtca

SEQ ID NO: 536739 - DNA, 25 bp, Homo sapien
tgatcaggtcatattgctgcgggca

SEQ ID NO: 536740 - DNA, 25 bp, Homo sapien
atcgcagacagatcttcctgccaga

SEQ ID NO: 536741 - DNA, 25 bp, Homo sapien
cgagcagccctcgaggcttcaggat

SEQ ID NO: 536742 - DNA, 25 bp, Homo sapien
gaggcttcaggatccagttctcgta

SEQ ID NO: 536743 - DNA, 25 bp, Homo sapien
gatccagttctcgtagtgagcaggc

SEQ ID NO: 536744 - DNA, 25 bp, Homo sapien
agttctcgtagtgagcaggctctct

SEQ ID NO: 536745 - DNA, 25 bp, Homo sapien
gggtccgggtgtgctgtgggcctct

SEQ ID NO: 536746 - DNA, 25 bp, Homo sapien
ctgtgggcctctgtgggccacgctt

SEQ ID NO: 536747 - DNA, 25 bp, Homo sapien
tggtccctgggagcacttcaagtga

SEQ ID NO: 536748 - DNA, 25 bp, Homo sapien
agcacttcaagtgaacatggaggag

SEQ ID NO: 536749 - DNA, 25 bp, Homo sapien
ggtgagctgaaagacacttgcactt

SEQ ID NO: 536750 - DNA, 25 bp, Homo sapien
aagcttcccagtacgttaaggagca

SEQ ID NO: 536751 - DNA, 25 bp, Homo sapien
tgggctgtccatcatgggtatatct

SEQ ID NO: 536752 - DNA, 25 bp, Homo sapien
atgggtatatctctggattccagga

SEQ ID NO: 536753 - DNA, 25 bp, Homo sapien
atctctggattccaggattgctagt

SEQ ID NO: 536754 - DNA, 25 bp, Homo sapien
gcacctcacatttgagggtctgtgc

SEQ ID NO: 536755 - DNA, 25 bp, Homo sapien
gagggtctgtgctattcagtctaga

SEQ ID NO: 536756 - DNA, 25 bp, Homo sapien
gtctgtgctattcagtctagaatca

SEQ ID NO: 536757 - DNA, 25 bp, Homo sapien
cagtctagaatcagagttggatgag

SEQ ID NO: 536758 - DNA, 25 bp, Homo sapien
atcaactttgaacaccacctttggg

SEQ ID NO: 536759 - DNA, 25 bp, Homo sapien
cgagactaaccggagcaacatagta

SEQ ID NO: 536760 - DNA, 25 bp, Homo sapien
ggagcaacatagtaaggccacatct

SEQ ID NO: 536761 - DNA, 25 bp, Homo sapien
gcaacatagtaaggccacatctgta

SEQ ID NO: 536762 - DNA, 25 bp, Homo sapien
cgggatcgcagacagatcttcctgc

SEQ ID NO: 536763 - DNA, 25 bp, Homo sapien
ggatcgcagacagatcttcctgcca

SEQ ID NO: 536764 - DNA, 25 bp, Homo sapien
atcgcagacagatcttcctgccaga

SEQ ID NO: 536765 - DNA, 25 bp, Homo sapien
cgcagacagatcttcctgccagagc

SEQ ID NO: 536766 - DNA, 25 bp, Homo sapien
cgagcagccctcgaggcttcaggat

SEQ ID NO: 536767 - DNA, 25 bp, Homo sapien
gagcagccctcgaggcttcaggatc

SEQ ID NO: 536768 - DNA, 25 bp, Homo sapien
agccctcgaggcttcaggatccagt

SEQ ID NO: 536769 - DNA, 25 bp, Homo sapien
gccctcgaggcttcaggatccagtt

SEQ ID NO: 536770 - DNA, 25 bp, Homo sapien
cctcgaggcttcaggatccagttct

SEQ ID NO: 536771 - DNA, 25 bp, Homo sapien
ctcgaggcttcaggatccagttctc

SEQ ID NO: 536772 - DNA, 25 bp, Homo sapien
gaggcttcaggatccagttctcgta

SEQ ID NO: 536773 - DNA, 25 bp, Homo sapien
tagtacatgaatatgccttgtttaa

SEQ ID NO: 536774 - DNA, 25 bp, Homo sapien
gaatatgccttgtttaattacagaa

SEQ ID NO: 536775 - DNA, 25 bp, Homo sapien
agaaaggcaggaatgtctcctaagc

SEQ ID NO: 536776 - DNA, 25 bp, Homo sapien
tttcctggacagcagatgaatgagc

SEQ ID NO: 536777 - DNA, 25 bp, Homo sapien
gagcggtagctttagtttgtacgta

SEQ ID NO: 536778 - DNA, 25 bp, Homo sapien
tgtacgtaggtacagttggagcact

SEQ ID NO: 536779 - DNA, 25 bp, Homo sapien
gttggagcactatatgtactctctg

SEQ ID NO: 536780 - DNA, 25 bp, Homo sapien
ctatatgtactctctggactacttt

SEQ ID NO: 536781 - DNA, 25 bp, Homo sapien
gggaatcagctcactacaaattgtg

SEQ ID NO: 536782 - DNA, 25 bp, Homo sapien
agctcactacaaattgtgactgtaa

SEQ ID NO: 536783 - DNA, 25 bp, Homo sapien
gtgactgtaaacattgtactgtaaa

SEQ ID NO: 536784 - DNA, 25 bp, Homo sapien
tgttcaggccctgggatgctgcatc

SEQ ID NO: 536785 - DNA, 25 bp, Homo sapien
tgctgcatctccaggcaactatgca

SEQ ID NO: 536786 - DNA, 25 bp, Homo sapien
tccaggcaactatgcactttcccgg

SEQ ID NO: 536787 - DNA, 25 bp, Homo sapien
tttcccggggagagaaccagtatga

SEQ ID NO: 536788 - DNA, 25 bp, Homo sapien
ggcagggcacacattcatctttgta

SEQ ID NO: 536789 - DNA, 25 bp, Homo sapien
gggcacacattcatctttgtaggaa

SEQ ID NO: 536790 - DNA, 25 bp, Homo sapien
catctttgtaggaaggtctggcctg

SEQ ID NO: 536791 - DNA, 25 bp, Homo sapien
aaggagggcccaggtcagttctggg

SEQ ID NO: 536792 - DNA, 25 bp, Homo sapien
cgctgctgctccctgtttctggagc

SEQ ID NO: 536793 - DNA, 25 bp, Homo sapien
gttgagctgcctgagccaatgtgtc

SEQ ID NO: 536794 - DNA, 25 bp, Homo sapien
ctgcctgagccaatgtgtctgtctt

SEQ ID NO: 536795 - DNA, 25 bp, Homo sapien
aaatcgtatcagtgtttgtgaataa

SEQ ID NO: 536796 - DNA, 25 bp, Homo sapien
gattgttaatgattggtgctcttaa

SEQ ID NO: 536797 - DNA, 25 bp, Homo sapien
ttaatgattggtgctcttaaagtga

SEQ ID NO: 536798 - DNA, 25 bp, Homo sapien
agacgtatatccaaatttgtcctgt

SEQ ID NO: 536799 - DNA, 25 bp, Homo sapien
tttgtcctgtagtaatagattaata

SEQ ID NO: 536800 - DNA, 25 bp, Homo sapien
atattcatagattgttggtgtttaa

SEQ ID NO: 536801 - DNA, 25 bp, Homo sapien
attgttggtgtttaaagatctgaag

SEQ ID NO: 536802 - DNA, 25 bp, Homo sapien
gtagaatgtattcagctgtttaaca

SEQ ID NO: 536803 - DNA, 25 bp, Homo sapien
atgtattcagctgtttaacatgtag

SEQ ID NO: 536804 - DNA, 25 bp, Homo sapien
taacatgtagtttagatattcaaaa

SEQ ID NO: 536805 - DNA, 25 bp, Homo sapien
agatattcaaaagtatgcatgtaga

SEQ ID NO: 536806 - DNA, 25 bp, Homo sapien
ttgtatgttggtgttctctgagtgg

SEQ ID NO: 536807 - DNA, 25 bp, Homo sapien
ttttgtttggtggtcacttagcatt

SEQ ID NO: 536808 - DNA, 25 bp, Homo sapien
gcatttgaaaacatccacttccttg

SEQ ID NO: 536809 - DNA, 25 bp, Homo sapien
cacttccttgtgacttagctgggta

SEQ ID NO: 536810 - DNA, 25 bp, Homo sapien
tagctgggtatcttttaacatctgg

SEQ ID NO: 536811 - DNA, 25 bp, Homo sapien
taacatctggaagccacgtccctga

SEQ ID NO: 536812 - DNA, 25 bp, Homo sapien
acgtccctgattgaaatctctggag

SEQ ID NO: 536813 - DNA, 25 bp, Homo sapien
tctctggagacaacttacctttcac

SEQ ID NO: 536814 - DNA, 25 bp, Homo sapien
ttcaccaacttgtctgccaaattgc

SEQ ID NO: 536815 - DNA, 25 bp, Homo sapien
gccaaattgcaccatggaccaagat

SEQ ID NO: 536816 - DNA, 25 bp, Homo sapien
tgcagtggctgcatcaagtctaggc

SEQ ID NO: 536817 - DNA, 25 bp, Homo sapien
acatctgtggtaaactttattttga

SEQ ID NO: 536818 - DNA, 25 bp, Homo sapien
agttgcactagtattttaccaccag

SEQ ID NO: 536819 - DNA, 25 bp, Homo sapien
gcactagtattttaccaccagatga

SEQ ID NO: 536820 - DNA, 25 bp, Homo sapien
tagtattttaccaccagatgagaaa

SEQ ID NO: 536821 - DNA, 25 bp, Homo sapien
caggctttgttttgaatggaatctt

SEQ ID NO: 536822 - DNA, 25 bp, Homo sapien
ttcccccaattcttaatgtaaagat

SEQ ID NO: 536823 - DNA, 25 bp, Homo sapien
atgtaaagatcttgtgctataactt

SEQ ID NO: 536824 - DNA, 25 bp, Homo sapien
agatcttgtgctataacttttaaag

SEQ ID NO: 536825 - DNA, 25 bp, Homo sapien
gtgctataacttttaaagccataca

SEQ ID NO: 536826 - DNA, 25 bp, Homo sapien
tttaaagccatacaaataagagtgc

SEQ ID NO: 536827 - DNA, 25 bp, Homo sapien
ataagagtgctaaactgtggactta

SEQ ID NO: 536828 - DNA, 25 bp, Homo sapien
ggaatgctacgaggccacgagtccc

SEQ ID NO: 536829 - DNA, 25 bp, Homo sapien
tgagaaattgttgctctggagtcga

SEQ ID NO: 536830 - DNA, 25 bp, Homo sapien
ctctggagtcgaagttttcacactt

SEQ ID NO: 536831 - DNA, 25 bp, Homo sapien
gagtcgaagttttcacacttggctg

SEQ ID NO: 536832 - DNA, 25 bp, Homo sapien
gccacgagtcccctgcacttgaagg

SEQ ID NO: 536833 - DNA, 25 bp, Homo sapien
cgcctggcggcatccacaggaggct

SEQ ID NO: 536834 - DNA, 25 bp, Homo sapien
cacttgaaggaactttcaccacgga

SEQ ID NO: 536835 - DNA, 25 bp, Homo sapien
cggaaagtttgtccgcccaaagatg

SEQ ID NO: 536836 - DNA, 25 bp, Homo sapien
ttgtccgcccaaagatgctcacgtg

SEQ ID NO: 536837 - DNA, 25 bp, Homo sapien
ccaaagatgctcacgtgtgcggtgg

SEQ ID NO: 536838 - DNA, 25 bp, Homo sapien
ggtggggccacataaatgcctgagc

SEQ ID NO: 536839 - DNA, 25 bp, Homo sapien
tgtccagcagtcatgaaccccttca

SEQ ID NO: 536840 - DNA, 25 bp, Homo sapien
tcatgaaccccttcacctccaatga

SEQ ID NO: 536841 - DNA, 25 bp, Homo sapien
tcccacatacacaggaggagtattt

SEQ ID NO: 536842 - DNA, 25 bp, Homo sapien
ggaggagtatttcatttctccttaa

SEQ ID NO: 536843 - DNA, 25 bp, Homo sapien
gtgtccctaatttgagaagtaacct

SEQ ID NO: 536844 - DNA, 25 bp, Homo sapien
ttctccttaatgaaggctctggccc

SEQ ID NO: 536845 - DNA, 25 bp, Homo sapien
ttaatgaaggctctggccctaaccc

SEQ ID NO: 536846 - DNA, 25 bp, Homo sapien
cctcagcactgtctccagataggaa

SEQ ID NO: 536847 - DNA, 25 bp, Homo sapien
ctcagcactgtctccagataggaac

SEQ ID NO: 536848 - DNA, 25 bp, Homo sapien
gaagtaaccttttggaatagcatta

SEQ ID NO: 536849 - DNA, 25 bp, Homo sapien
gtaaccttttggaatagcattagac

SEQ ID NO: 536850 - DNA, 25 bp, Homo sapien
tttctccttaatgaaggctctggcc

SEQ ID NO: 536851 - DNA, 25 bp, Homo sapien
ttctccttaatgaaggctctggccc

SEQ ID NO: 536852 - DNA, 25 bp, Homo sapien
aaggctctggccctaacccctcagc

SEQ ID NO: 536853 - DNA, 25 bp, Homo sapien
aggctctggccctaacccctcagca

SEQ ID NO: 536854 - DNA, 25 bp, Homo sapien
ggctctggccctaacccctcagcac

SEQ ID NO: 536855 - DNA, 25 bp, Homo sapien
ccctcagcactgtctccagatagga

SEQ ID NO: 536856 - DNA, 25 bp, Homo sapien
cctcagcactgtctccagataggaa

SEQ ID NO: 536857 - DNA, 25 bp, Homo sapien
ctcagcactgtctccagataggaac

SEQ ID NO: 536858 - DNA, 25 bp, Homo sapien
gggactcagcccagatctacgtgag

SEQ ID NO: 536859 - DNA, 25 bp, Homo sapien
gcccagatctacgtgagacattttt

SEQ ID NO: 536860 - DNA, 25 bp, Homo sapien
gacatttttctgtgtcactgtggga

SEQ ID NO: 536861 - DNA, 25 bp, Homo sapien
actgcgtgttgctctgcgtgtgttc

SEQ ID NO: 536862 - DNA, 25 bp, Homo sapien
gttgctctgcgtgtgttcccatgtc

SEQ ID NO: 536863 - DNA, 25 bp, Homo sapien
tcccatgtccatgcgtgtgttgaga

SEQ ID NO: 536864 - DNA, 25 bp, Homo sapien
atgcgtgtgttgagagcccatcagg

SEQ ID NO: 536865 - DNA, 25 bp, Homo sapien
catcaggagggcatgcatgactctt

SEQ ID NO: 536866 - DNA, 25 bp, Homo sapien
ggcatgcatgactctttggcaacat

SEQ ID NO: 536867 - DNA, 25 bp, Homo sapien
gagccacgtgtttttattgctgact

SEQ ID NO: 536868 - DNA, 25 bp, Homo sapien
gaacccagaggatctaggccctgtt

SEQ ID NO: 536869 - DNA, 25 bp, Homo sapien
gacttcacaaccattagatcttctt

SEQ ID NO: 536870 - DNA, 25 bp, Homo sapien
accattgctaacttgaagccattag

SEQ ID NO: 536871 - DNA, 25 bp, Homo sapien
aacttgaagccattagatcttctta

SEQ ID NO: 536872 - DNA, 25 bp, Homo sapien
gagtacctggctaaagaatctccag

SEQ ID NO: 536873 - DNA, 25 bp, Homo sapien
aagaatctccagctagacaaagtag

SEQ ID NO: 536874 - DNA, 25 bp, Homo sapien
acaaagtagaagtgtctgtgctctg

SEQ ID NO: 536875 - DNA, 25 bp, Homo sapien
gtgtctgtgctctggcagttgaata

SEQ ID NO: 536876 - DNA, 25 bp, Homo sapien
gtgctctggcagttgaatatattgt

SEQ ID NO: 536877 - DNA, 25 bp, Homo sapien
ttgtatcaggctcaacagcaccttt

SEQ ID NO: 536878 - DNA, 25 bp, Homo sapien
ggctcaacagcacctttcaccaaag

SEQ ID NO: 536879 - DNA, 25 bp, Homo sapien
ttcaccaaaggatgagacttcacaa

SEQ ID NO: 536880 - DNA, 25 bp, Homo sapien
ggacccagagaagttagcccaggaa

SEQ ID NO: 536881 - DNA, 25 bp, Homo sapien
cccagagaagttagcccaggaactg

SEQ ID NO: 536882 - DNA, 25 bp, Homo sapien
agccagacggtctcagagtgccgag

SEQ ID NO: 536883 - DNA, 25 bp, Homo sapien
agacggtctcagagtgccgagctga

SEQ ID NO: 536884 - DNA, 25 bp, Homo sapien
gagtgccgagctgaacagggattta

SEQ ID NO: 536885 - DNA, 25 bp, Homo sapien
gagctgaacagggatttatgcaaag

SEQ ID NO: 536886 - DNA, 25 bp, Homo sapien
ttatgcaaagcccacagcgccctgg

SEQ ID NO: 536887 - DNA, 25 bp, Homo sapien
tccgaggagcccaccggaagcagga

SEQ ID NO: 536888 - DNA, 25 bp, Homo sapien
agcccaccggaagcaggaagagcaa

SEQ ID NO: 536889 - DNA, 25 bp, Homo sapien
gagcaacgccggaagttggagcagc

SEQ ID NO: 536890 - DNA, 25 bp, Homo sapien
tggcggtgctcgaagccactgcaag

SEQ ID NO: 536891 - DNA, 25 bp, Homo sapien
caaaggaagggatctgtcagaaagc

SEQ ID NO: 536892 - DNA, 25 bp, Homo sapien
gatctgtcagaaagcaacacttgtt

SEQ ID NO: 536893 - DNA, 25 bp, Homo sapien
acttgttatcttgggcttggcagca

SEQ ID NO: 536894 - DNA, 25 bp, Homo sapien
ggtagtggagatcctgcaatctgaa

SEQ ID NO: 536895 - DNA, 25 bp, Homo sapien
aaagcagactgaaaggtgacaaaga

SEQ ID NO: 536896 - DNA, 25 bp, Homo sapien
gagagaggtataacattccagcccc

SEQ ID NO: 536897 - DNA, 25 bp, Homo sapien
tccagcccctcaatctagaaatgtt

SEQ ID NO: 536898 - DNA, 25 bp, Homo sapien
gttagtaagaaccaacaacagctta

SEQ ID NO: 536899 - DNA, 25 bp, Homo sapien
aaccaacaacagcttaacagacaga

SEQ ID NO: 536900 - DNA, 25 bp, Homo sapien
cagacagaagaccaaggaacagaat

SEQ ID NO: 536901 - DNA, 25 bp, Homo sapien
cagaattcccagatgaagattgttc

SEQ ID NO: 536902 - DNA, 25 bp, Homo sapien
aaggaagtccccattgtccaaactg

SEQ ID NO: 536903 - DNA, 25 bp, Homo sapien
aaccatcacatatgagtctccacag

SEQ ID NO: 536904 - DNA, 25 bp, Homo sapien
atgagtctccacagattgatggcgg

SEQ ID NO: 536905 - DNA, 25 bp, Homo sapien
ggtgattcgggcacgttactgaccg

SEQ ID NO: 536906 - DNA, 25 bp, Homo sapien
tcgggcacgttactgaccgcacaaa

SEQ ID NO: 536907 - DNA, 25 bp, Homo sapien
tgaccgcacaaaccatcacatctga

SEQ ID NO: 536908 - DNA, 25 bp, Homo sapien
atcacatctgagtccgtgtcaacaa

SEQ ID NO: 536909 - DNA, 25 bp, Homo sapien
gtgtcaacaacgacaaccacacaca

SEQ ID NO: 536910 - DNA, 25 bp, Homo sapien
ttgagaaacgcattgtgatcacagg

SEQ ID NO: 536911 - DNA, 25 bp, Homo sapien
gatattgatcatgaccaggcactgg

SEQ ID NO: 536912 - DNA, 25 bp, Homo sapien
aggcactggctcaggcgatcaggga

SEQ ID NO: 536913 - DNA, 25 bp, Homo sapien
gaaattcctctctgtatgctaactc

SEQ ID NO: 536914 - DNA, 25 bp, Homo sapien
gctaactccgtaatacaagcgtttg

SEQ ID NO: 536915 - DNA, 25 bp, Homo sapien
ttaaaatcacagctgttccaaatat

SEQ ID NO: 536916 - DNA, 25 bp, Homo sapien
gttccaaatataatctagcctcgtt

SEQ ID NO: 536917 - DNA, 25 bp, Homo sapien
ctccgtcggatgataggtgttcttc

SEQ ID NO: 536918 - DNA, 25 bp, Homo sapien
ataggtgttcttcaggacagtttta

SEQ ID NO: 536919 - DNA, 25 bp, Homo sapien
attttaagcaattcttagtctcaag

SEQ ID NO: 536920 - DNA, 25 bp, Homo sapien
ttagtctcaagtaaacaccatcatt

SEQ ID NO: 536921 - DNA, 25 bp, Homo sapien
tgagaactattatcaattcttcctt

SEQ ID NO: 536922 - DNA, 25 bp, Homo sapien
caattcttcctttggagtccatctt

SEQ ID NO: 536923 - DNA, 25 bp, Homo sapien
ttcctttggagtccatcttcaatgg

SEQ ID NO: 536924 - DNA, 25 bp, Homo sapien
aaagggtgtcatcacagtaaaggat

SEQ ID NO: 536925 - DNA, 25 bp, Homo sapien
aaggcatgaagtttgatcgaggcta

SEQ ID NO: 536926 - DNA, 25 bp, Homo sapien
ttgatcgaggctatatttctccata

SEQ ID NO: 536927 - DNA, 25 bp, Homo sapien
gtgaattccaggatgcctatgttct

SEQ ID NO: 536928 - DNA, 25 bp, Homo sapien
aggatgcctatgttctgttgagtga

SEQ ID NO: 536929 - DNA, 25 bp, Homo sapien
atttctagtatccagtccattgtac

SEQ ID NO: 536930 - DNA, 25 bp, Homo sapien
tccagtccattgtacctgctcttga

SEQ ID NO: 536931 - DNA, 25 bp, Homo sapien
tgaaattgccaatgctcaccgtaag

SEQ ID NO: 536932 - DNA, 25 bp, Homo sapien
aatgctcaccgtaagcctttggtca

SEQ ID NO: 536933 - DNA, 25 bp, Homo sapien
aagcctttggtcataatcgctgaag

SEQ ID NO: 536934 - DNA, 25 bp, Homo sapien
atgttgatggagaagctctaagtac

SEQ ID NO: 536935 - DNA, 25 bp, Homo sapien
cagagtgccgcgagctgccatcacg

SEQ ID NO: 536936 - DNA, 25 bp, Homo sapien
gagctgccatcacgcctacatcgtg

SEQ ID NO: 536937 - DNA, 25 bp, Homo sapien
gcctacatcgtgctctgcattgaga

SEQ ID NO: 536938 - DNA, 25 bp, Homo sapien
ctacatcgtgctctgcattgagaac

SEQ ID NO: 536939 - DNA, 25 bp, Homo sapien
tgagaacagcttcatgactgcctcc

SEQ ID NO: 536940 - DNA, 25 bp, Homo sapien
acagcttcatgactgcctccaagta

SEQ ID NO: 536941 - DNA, 25 bp, Homo sapien
ttcatgactgcctccaagtagccac

SEQ ID NO: 536942 - DNA, 25 bp, Homo sapien
gaggaccggcggctcggaggaagcc

SEQ ID NO: 536943 - DNA, 25 bp, Homo sapien
ctggctgccatactttcctgtatag

SEQ ID NO: 536944 - DNA, 25 bp, Homo sapien
gctgccatactttcctgtatagttc

SEQ ID NO: 536945 - DNA, 25 bp, Homo sapien
atactttcctgtatagttcacgttt

SEQ ID NO: 536946 - DNA, 25 bp, Homo sapien
gatccagttctcgtagtgagcaggc

SEQ ID NO: 536947 - DNA, 25 bp, Homo sapien
agttctcgtagtgagcaggctctct

SEQ ID NO: 536948 - DNA, 25 bp, Homo sapien
gggtccgggtgtgctgtgggcctct

SEQ ID NO: 536949 - DNA, 25 bp, Homo sapien
ctgtgggcctctgtgggccacgctt

SEQ ID NO: 536950 - DNA, 25 bp, Homo sapien
gccacgcttggtccctgggagcact

SEQ ID NO: 536951 - DNA, 25 bp, Homo sapien
tggtccctgggagcacttcaagtga

SEQ ID NO: 536952 - DNA, 25 bp, Homo sapien
gtccctgggagcacttcaagtgaac

SEQ ID NO: 536953 - DNA, 25 bp, Homo sapien
agcacttcaagtgaacatggaggag

SEQ ID NO: 536954 - DNA, 25 bp, Homo sapien
ggtgagctgaaagacacttgcactt

SEQ ID NO: 536955 - DNA, 25 bp, Homo sapien
aagcttcccagtacgttaaggagca

SEQ ID NO: 536956 - DNA, 25 bp, Homo sapien
ttcccagtacgttaaggagcataaa

SEQ ID NO: 536957 - DNA, 25 bp, Homo sapien
gagtcaatgtgtgttacgactacca

SEQ ID NO: 536958 - DNA, 25 bp, Homo sapien
gtgtgttacgactaccaaggctcat

SEQ ID NO: 536959 - DNA, 25 bp, Homo sapien
gactaccaaggctcattagactgaa

SEQ ID NO: 536960 - DNA, 25 bp, Homo sapien
accaaggctcattagactgaacatg

SEQ ID NO: 536961 - DNA, 25 bp, Homo sapien
gactgaacatgttaagttggctctt

SEQ ID NO: 536962 - DNA, 25 bp, Homo sapien
gttggctcttggatgcagatgatat

SEQ ID NO: 536963 - DNA, 25 bp, Homo sapien
gaaagacatcctcaatctaagtact

SEQ ID NO: 536964 - DNA, 25 bp, Homo sapien
aagtacttaactattctccagaaat

SEQ ID NO: 536965 - DNA, 25 bp, Homo sapien
tattctccagaaatggatactgccg

SEQ ID NO: 536966 - DNA, 25 bp, Homo sapien
atggatactgccgttctctccaatc

SEQ ID NO: 536967 - DNA, 25 bp, Homo sapien
gccgttctctccaatcattcagaaa

SEQ ID NO: 536968 - DNA, 25 bp, Homo sapien
gctgtgctcttctgggaggttcccg

SEQ ID NO: 536969 - DNA, 25 bp, Homo sapien
ggaggttcccgcttgctgccttcag

SEQ ID NO: 536970 - DNA, 25 bp, Homo sapien
agggcgctcctcagagctctatttt

SEQ ID NO: 536971 - DNA, 25 bp, Homo sapien
gcctttagatcctgagaaggaggga

SEQ ID NO: 536972 - DNA, 25 bp, Homo sapien
gggtgctgacacagtccctctggga

SEQ ID NO: 536973 - DNA, 25 bp, Homo sapien
gacacagtccctctgggagagctct

SEQ ID NO: 536974 - DNA, 25 bp, Homo sapien
gagagctctgcctagtctggtttgg

SEQ ID NO: 536975 - DNA, 25 bp, Homo sapien
ctggtttggcgagggcccttgatca

SEQ ID NO: 536976 - DNA, 25 bp, Homo sapien
ttggcgagggcccttgatcaccttg

SEQ ID NO: 536977 - DNA, 25 bp, Homo sapien
tttccctcaaaatagtcctgagaac

SEQ ID NO: 536978 - DNA, 25 bp, Homo sapien
atagtcctgagaactaattgtcaca

SEQ ID NO: 536979 - DNA, 25 bp, Homo sapien
tatgttaatactcatgagaattggg

SEQ ID NO: 536980 - DNA, 25 bp, Homo sapien
atcaccatttgattggtagcaacag

SEQ ID NO: 536981 - DNA, 25 bp, Homo sapien
tcaccatttgattggtagcaacagt

SEQ ID NO: 536982 - DNA, 25 bp, Homo sapien
catttgattggtagcaacagtggtt

SEQ ID NO: 536983 - DNA, 25 bp, Homo sapien
tttgattggtagcaacagtggttgt

SEQ ID NO: 536984 - DNA, 25 bp, Homo sapien
ggtagcaacagtggttgtaaaactt

SEQ ID NO: 536985 - DNA, 25 bp, Homo sapien
tagcaacagtggttgtaaaacttgg

SEQ ID NO: 536986 - DNA, 25 bp, Homo sapien
gaatcttgttagtgttgcaatctaa

SEQ ID NO: 536987 - DNA, 25 bp, Homo sapien
atcttgttagtgttgcaatctaaat

SEQ ID NO: 536988 - DNA, 25 bp, Homo sapien
gttagtgttgcaatctaaatagaat

SEQ ID NO: 536989 - DNA, 25 bp, Homo sapien
acaggtgttaagacatatttatagt

SEQ ID NO: 536990 - DNA, 25 bp, Homo sapien
gggaagtgttcctgtaatgacgcaa

SEQ ID NO: 536991 - DNA, 25 bp, Homo sapien
ggaagtgttcctgtaatgacgcaac

SEQ ID NO: 536992 - DNA, 25 bp, Homo sapien
gaagtgttcctgtaatgacgcaacc

SEQ ID NO: 536993 - DNA, 25 bp, Homo sapien
aagtgttcctgtaatgacgcaacca

SEQ ID NO: 536994 - DNA, 25 bp, Homo sapien
agtgttcctgtaatgacgcaaccaa

SEQ ID NO: 536995 - DNA, 25 bp, Homo sapien
cctttggccctgtatcaggagcaca

SEQ ID NO: 536996 - DNA, 25 bp, Homo sapien
ctttggccctgtatcaggagcacag

SEQ ID NO: 536997 - DNA, 25 bp, Homo sapien
tttggccctgtatcaggagcacaga

SEQ ID NO: 536998 - DNA, 25 bp, Homo sapien
tggccctgtatcaggagcacagata

SEQ ID NO: 536999 - DNA, 25 bp, Homo sapien
ggccctgtatcaggagcacagatac

SEQ ID NO: 537000 - DNA, 25 bp, Homo sapien
tcaggagcacagatacagtttatgt

SEQ ID NO: 537001 - DNA, 25 bp, Homo sapien
gccagaaaagcttccagaggctgct

SEQ ID NO: 537002 - DNA, 25 bp, Homo sapien
gctgctgattttggaactacgtctt

SEQ ID NO: 537003 - DNA, 25 bp, Homo sapien
tcttctctgcattttgtccacatga

SEQ ID NO: 537004 - DNA, 25 bp, Homo sapien
gagaggattacctttccaagccaat

SEQ ID NO: 537005 - DNA, 25 bp, Homo sapien
taaacttttttgctccactcaagcc

SEQ ID NO: 537006 - DNA, 25 bp, Homo sapien
caagcctgttagaatcaccatggaa

SEQ ID NO: 537007 - DNA, 25 bp, Homo sapien
gaatacagctccagtgggaaggcca

SEQ ID NO: 537008 - DNA, 25 bp, Homo sapien
gctgatgtgcactttgagacccatg

SEQ ID NO: 537009 - DNA, 25 bp, Homo sapien
aggatgctgttgcagcgatgctcaa

SEQ ID NO: 537010 - DNA, 25 bp, Homo sapien
gatgctcaaggatcggtcccacgtt

SEQ ID NO: 537011 - DNA, 25 bp, Homo sapien
ggtcccacgttcatcataggtatat

SEQ ID NO: 537012 - DNA, 25 bp, Homo sapien
gtgctctggccaatactggtttcga

SEQ ID NO: 537013 - DNA, 25 bp, Homo sapien
tactggtttcgattctatttcttaa

SEQ ID NO: 537014 - DNA, 25 bp, Homo sapien
agtttcggtctaaagtctatgtcag

SEQ ID NO: 537015 - DNA, 25 bp, Homo sapien
tgtcagaacccacatgacagttgtt

SEQ ID NO: 537016 - DNA, 25 bp, Homo sapien
cagttgttttccaaggtgtccaaag

SEQ ID NO: 537017 - DNA, 25 bp, Homo sapien
ccaaggtgtccaaagaggcctctaa

SEQ ID NO: 537018 - DNA, 25 bp, Homo sapien
ttgcacagaagtaccctgatcgtct

SEQ ID NO: 537019 - DNA, 25 bp, Homo sapien
tgatcgtctgacatgtcatcggctt

SEQ ID NO: 537020 - DNA, 25 bp, Homo sapien
ttgtggtccacaagactgtctggct

SEQ ID NO: 537021 - DNA, 25 bp, Homo sapien
tgctcattcgagtcctctgtcaaat

SEQ ID NO: 537022 - DNA, 25 bp, Homo sapien
gagtcctctgtcaaatcaatgatga

SEQ ID NO: 537023 - DNA, 25 bp, Homo sapien
tgtccagcagtcatgaaccccttca

SEQ ID NO: 537024 - DNA, 25 bp, Homo sapien
gtccagcagtcatgaaccccttcac

SEQ ID NO: 537025 - DNA, 25 bp, Homo sapien
tccagcagtcatgaaccccttcacc

SEQ ID NO: 537026 - DNA, 25 bp, Homo sapien
ccagcagtcatgaaccccttcacct

SEQ ID NO: 537027 - DNA, 25 bp, Homo sapien
cagcagtcatgaaccccttcacctc

SEQ ID NO: 537028 - DNA, 25 bp, Homo sapien
agcagtcatgaaccccttcacctcc

SEQ ID NO: 537029 - DNA, 25 bp, Homo sapien
gcagtcatgaaccccttcacctcca

SEQ ID NO: 537030 - DNA, 25 bp, Homo sapien
agtcatgaaccccttcacctccaat

SEQ ID NO: 537031 - DNA, 25 bp, Homo sapien
gtcatgaaccccttcacctccaatg

SEQ ID NO: 537032 - DNA, 25 bp, Homo sapien
tcatgaaccccttcacctccaatga

SEQ ID NO: 537033 - DNA, 25 bp, Homo sapien
catgaaccccttcacctccaatgac

SEQ ID NO: 537034 - DNA, 25 bp, Homo sapien
aagtctactctattttatactgttt

SEQ ID NO: 537035 - DNA, 25 bp, Homo sapien
gaattgacattttataaccaacctg

SEQ ID NO: 537036 - DNA, 25 bp, Homo sapien
tgacattttataaccaacctgtttt

SEQ ID NO: 537037 - DNA, 25 bp, Homo sapien
ctgtttttatctacggtgggaatct

SEQ ID NO: 537038 - DNA, 25 bp, Homo sapien
atctacggtgggaatctttgatgcc

SEQ ID NO: 537039 - DNA, 25 bp, Homo sapien
ggtgggaatctttgatgccagaaat

SEQ ID NO: 537040 - DNA, 25 bp, Homo sapien
aaagaggttctgtatcttcacacct

SEQ ID NO: 537041 - DNA, 25 bp, Homo sapien
ggttctgtatcttcacaccttgaat

SEQ ID NO: 537042 - DNA, 25 bp, Homo sapien
gtatcttcacaccttgaataagcat

SEQ ID NO: 537043 - DNA, 25 bp, Homo sapien
gacacttgacatgtcaatgtatttg

SEQ ID NO: 537044 - DNA, 25 bp, Homo sapien
ttcattttaaactcgtatttgtggt

SEQ ID NO: 537045 - DNA, 25 bp, Homo sapien
ttcaaacaagtgactttggtttatt

SEQ ID NO: 537046 - DNA, 25 bp, Homo sapien
tatttcatacattacactttttctt

SEQ ID NO: 537047 - DNA, 25 bp, Homo sapien
catacattacactttttcttgcaga

SEQ ID NO: 537048 - DNA, 25 bp, Homo sapien
tacattacactttttcttgcagaaa

SEQ ID NO: 537049 - DNA, 25 bp, Homo sapien
aatataaaattcttccaccatgaaa

SEQ ID NO: 537050 - DNA, 25 bp, Homo sapien
attcataaagacacagcaccagcat

SEQ ID NO: 537051 - DNA, 25 bp, Homo sapien
taaagacacagcaccagcatgtgat

SEQ ID NO: 537052 - DNA, 25 bp, Homo sapien
gacacagcaccagcatgtgatgcct

SEQ ID NO: 537053 - DNA, 25 bp, Homo sapien
acagcaccagcatgtgatgcctcca

SEQ ID NO: 537054 - DNA, 25 bp, Homo sapien
aagcaaattaattagccctgtcact

SEQ ID NO: 537055 - DNA, 25 bp, Homo sapien
aattaattagccctgtcactagcca

SEQ ID NO: 537056 - DNA, 25 bp, Homo sapien
taaaggcacgactgggatttcttct

SEQ ID NO: 537057 - DNA, 25 bp, Homo sapien
ggatttcttctgagactgtggtgaa

SEQ ID NO: 537058 - DNA, 25 bp, Homo sapien
tctgagactgtggtgaaactccttc

SEQ ID NO: 537059 - DNA, 25 bp, Homo sapien
ggactcggcaccacttgatattcaa

SEQ ID NO: 537060 - DNA, 25 bp, Homo sapien
tgatattcaacagccacttgagcca

SEQ ID NO: 537061 - DNA, 25 bp, Homo sapien
gtatttacagctgatggactcaatt

SEQ ID NO: 537062 - DNA, 25 bp, Homo sapien
ggactcaatttgagccttcaaactt

SEQ ID NO: 537063 - DNA, 25 bp, Homo sapien
gagccttcaaacttgtagttatcct

SEQ ID NO: 537064 - DNA, 25 bp, Homo sapien
gtctagcattgatttggttcctgtg

SEQ ID NO: 537065 - DNA, 25 bp, Homo sapien
tggttcctgtgcatatgtattttca

SEQ ID NO: 537066 - DNA, 25 bp, Homo sapien
cctccccagatcttaattaaaccag

SEQ ID NO: 537067 - DNA, 25 bp, Homo sapien
acagcaatcagctaacaggcaaatt

SEQ ID NO: 537068 - DNA, 25 bp, Homo sapien
cttctggctggtgacagtaaagctg

SEQ ID NO: 537069 - DNA, 25 bp, Homo sapien
gaggcttttgacacagttattagtt

SEQ ID NO: 537070 - DNA, 25 bp, Homo sapien
atacggagcagtgcctagtatctgg

SEQ ID NO: 537071 - DNA, 25 bp, Homo sapien
tagtatctggagagcagcactacca

SEQ ID NO: 537072 - DNA, 25 bp, Homo sapien
gcagcactaccatttattctttcat

SEQ ID NO: 537073 - DNA, 25 bp, Homo sapien
ttgacggtactaacaaagtggtcgc

SEQ ID NO: 537074 - DNA, 25 bp, Homo sapien
ctaacaaagtggtcgcaggagattt

SEQ ID NO: 537075 - DNA, 25 bp, Homo sapien
caggagattttggaacggctggttt

SEQ ID NO: 537076 - DNA, 25 bp, Homo sapien
ggaacggctggtttaaatggcttca

SEQ ID NO: 537077 - DNA, 25 bp, Homo sapien
gcttcaggagacttcagttttttgt

SEQ ID NO: 537078 - DNA, 25 bp, Homo sapien
gcctgtggcctttgtcgagtcactg

SEQ ID NO: 537079 - DNA, 25 bp, Homo sapien
cctgtggcctttgtcgagtcactgc

SEQ ID NO: 537080 - DNA, 25 bp, Homo sapien
ctgtggcctttgtcgagtcactgcc

SEQ ID NO: 537081 - DNA, 25 bp, Homo sapien
tgtggcctttgtcgagtcactgccc

SEQ ID NO: 537082 - DNA, 25 bp, Homo sapien
gtggcctttgtcgagtcactgccct

SEQ ID NO: 537083 - DNA, 25 bp, Homo sapien
tggcctttgtcgagtcactgccctt

SEQ ID NO: 537084 - DNA, 25 bp, Homo sapien
ggcctttgtcgagtcactgcccttc

SEQ ID NO: 537085 - DNA, 25 bp, Homo sapien
gcctttgtcgagtcactgcccttct

SEQ ID NO: 537086 - DNA, 25 bp, Homo sapien
catgaaactgacagatgtttttcta

SEQ ID NO: 537087 - DNA, 25 bp, Homo sapien
aggactattatcagtttccaaatac

SEQ ID NO: 537088 - DNA, 25 bp, Homo sapien
atacaatacttctctcttctggttt

SEQ ID NO: 537089 - DNA, 25 bp, Homo sapien
tcctgaatgagcctgattttgttgc

SEQ ID NO: 537090 - DNA, 25 bp, Homo sapien
gtacccttaaaatccctgtggccag

SEQ ID NO: 537091 - DNA, 25 bp, Homo sapien
taaaatccctgtggccagtttgaac

SEQ ID NO: 537092 - DNA, 25 bp, Homo sapien
tgtggccagtttgaacacccctgtt

SEQ ID NO: 537093 - DNA, 25 bp, Homo sapien
tttgaacacccctgttgtattcttt

SEQ ID NO: 537094 - DNA, 25 bp, Homo sapien
tgttcagtgtgtcagctattttgtg

SEQ ID NO: 537095 - DNA, 25 bp, Homo sapien
agatgcttagatgtatagttttgat

SEQ ID NO: 537096 - DNA, 25 bp, Homo sapien
gtatagttttgataaccacagtttt

SEQ ID NO: 537097 - DNA, 25 bp, Homo sapien
ttccgcaggagcctgggcaagaatt

SEQ ID NO: 537098 - DNA, 25 bp, Homo sapien
caagaattacaaggagcccgagccg

SEQ ID NO: 537099 - DNA, 25 bp, Homo sapien
tccgtgtccatcacgggctccgtgg

SEQ ID NO: 537100 - DNA, 25 bp, Homo sapien
acgggctccgtggacgaccactttg

SEQ ID NO: 537101 - DNA, 25 bp, Homo sapien
gtggacgaccactttgccaaagctc

SEQ ID NO: 537102 - DNA, 25 bp, Homo sapien
actttgccaaagctctgggtgacac

SEQ ID NO: 537103 - DNA, 25 bp, Homo sapien
aaagctctgggtgacacgtggctcc

SEQ ID NO: 537104 - DNA, 25 bp, Homo sapien
ggtgacacgtggctccagatcaaag

SEQ ID NO: 537105 - DNA, 25 bp, Homo sapien
ggctccagatcaaagcggccaagga

SEQ ID NO: 537106 - DNA, 25 bp, Homo sapien
aaagcggccaaggacggagcatcca

SEQ ID NO: 537107 - DNA, 25 bp, Homo sapien
ggccaaggacggagcatccagcagc

SEQ ID NO: 537108 - DNA, 25 bp, Homo sapien
taccaaaacatcatattgcacactg

SEQ ID NO: 537109 - DNA, 25 bp, Homo sapien
aacatcatattgcacactgtgaata

SEQ ID NO: 537110 - DNA, 25 bp, Homo sapien
atacctcaatacagctggaaataca

SEQ ID NO: 537111 - DNA, 25 bp, Homo sapien
gaggataatactgatcctacctgta

SEQ ID NO: 537112 - DNA, 25 bp, Homo sapien
gataatactgatcctacctgtaata

SEQ ID NO: 537113 - DNA, 25 bp, Homo sapien
actgatcctacctgtaataggacca

SEQ ID NO: 537114 - DNA, 25 bp, Homo sapien
gaaaggatttcacaggatgaggttt

SEQ ID NO: 537115 - DNA, 25 bp, Homo sapien
cacaggatgaggtttatgaaaatac

SEQ ID NO: 537116 - DNA, 25 bp, Homo sapien
ataattctacatcatatacctgaaa

SEQ ID NO: 537117 - DNA, 25 bp, Homo sapien
catcatatacctgaaatttgctaag

SEQ ID NO: 537118 - DNA, 25 bp, Homo sapien
gaggtgatacatacgctaattagct

SEQ ID NO: 537119 - DNA, 25 bp, Homo sapien
agggctcttggatggcgctcaccac

SEQ ID NO: 537120 - DNA, 25 bp, Homo sapien
ttggatggcgctcaccacgtcacgt

SEQ ID NO: 537121 - DNA, 25 bp, Homo sapien
accacgtcacgtcttctgtgctttc

SEQ ID NO: 537122 - DNA, 25 bp, Homo sapien
tcttctgtgctttcggccaagcact

SEQ ID NO: 537123 - DNA, 25 bp, Homo sapien
tgctttcggccaagcactgggccag

SEQ ID NO: 537124 - DNA, 25 bp, Homo sapien
tgggccaggtggctgtcaacatcca

SEQ ID NO: 537125 - DNA, 25 bp, Homo sapien
gggccaggtggctgtcaacatccag

SEQ ID NO: 537126 - DNA, 25 bp, Homo sapien
gccaggtggctgtcaacatccagct

SEQ ID NO: 537127 - DNA, 25 bp, Homo sapien
gggcgaactccttctggcacatggg

SEQ ID NO: 537128 - DNA, 25 bp, Homo sapien
gggcagctgcgcagggccgcggcac

SEQ ID NO: 537129 - DNA, 25 bp, Homo sapien
gctttaatgcgcatgcgggggaccc

SEQ ID NO: 537130 - DNA, 25 bp, Homo sapien
aggaccgcaagagccgcaagaagcc

SEQ ID NO: 537131 - DNA, 25 bp, Homo sapien
caagagccgcaagaagcctgtggag

SEQ ID NO: 537132 - DNA, 25 bp, Homo sapien
aagaggcccatgtctgcatacatgc

SEQ ID NO: 537133 - DNA, 25 bp, Homo sapien
catgtctgcatacatgctgtggctc

SEQ ID NO: 537134 - DNA, 25 bp, Homo sapien
atgctgtggctcaatgccagccgag

SEQ ID NO: 537135 - DNA, 25 bp, Homo sapien
tcaatgccagccgagagaagatcaa

SEQ ID NO: 537136 - DNA, 25 bp, Homo sapien
ccgagagaagatcaagtcagaccat

SEQ ID NO: 537137 - DNA, 25 bp, Homo sapien
tggcatcagcatcacggatctttcc

SEQ ID NO: 537138 - DNA, 25 bp, Homo sapien
cagcatcacggatctttccaagaag

SEQ ID NO: 537139 - DNA, 25 bp, Homo sapien
gatctttccaagaaggcaggcgaga

SEQ ID NO: 537140 - DNA, 25 bp, Homo sapien
aggatgccaggagggactatgaaaa

SEQ ID NO: 537141 - DNA, 25 bp, Homo sapien
tccccaatccccaggaatggacaag

SEQ ID NO: 537142 - DNA, 25 bp, Homo sapien
aagaagggtctcacgtggctggcct

SEQ ID NO: 537143 - DNA, 25 bp, Homo sapien
cacccgtgcatgtcatcacaaacat

SEQ ID NO: 537144 - DNA, 25 bp, Homo sapien
caaacatttgctcttaagttacaag

SEQ ID NO: 537145 - DNA, 25 bp, Homo sapien
aagttacaagagaccacatccaccc

SEQ ID NO: 537146 - DNA, 25 bp, Homo sapien
ccacatccacccagggattagggtt

SEQ ID NO: 537147 - DNA, 25 bp, Homo sapien
gattagggttcaagtagcagctgct

SEQ ID NO: 537148 - DNA, 25 bp, Homo sapien
aagtagcagctgctaacccttgcac

SEQ ID NO: 537149 - DNA, 25 bp, Homo sapien
gggactcccaacacaagacaaagct

SEQ ID NO: 537150 - DNA, 25 bp, Homo sapien
agacaaagctcaggatgctggtgat

SEQ ID NO: 537151 - DNA, 25 bp, Homo sapien
tgatgctaggaagatgtccctcccc

SEQ ID NO: 537152 - DNA, 25 bp, Homo sapien
gaaagtaacccagcttgttgctcta

SEQ ID NO: 537153 - DNA, 25 bp, Homo sapien
agaaatctctggtcaccgtgatctt

SEQ ID NO: 537154 - DNA, 25 bp, Homo sapien
gtgatcttcggcctcattctaatac

SEQ ID NO: 537155 - DNA, 25 bp, Homo sapien
aatacctgttctttggacagtcttt

SEQ ID NO: 537156 - DNA, 25 bp, Homo sapien
gacagtctttttcctttggtgctct

SEQ ID NO: 537157 - DNA, 25 bp, Homo sapien
tttggtgctctcttgcctttagcta

SEQ ID NO: 537158 - DNA, 25 bp, Homo sapien
gcctttagctaccttctctaatatg

SEQ ID NO: 537159 - DNA, 25 bp, Homo sapien
cagggtctaagattggtcatacatt

SEQ ID NO: 537160 - DNA, 25 bp, Homo sapien
gtcatacattcccaatttactctca

SEQ ID NO: 537161 - DNA, 25 bp, Homo sapien
atttactctcagttccagtcaagct

SEQ ID NO: 537162 - DNA, 25 bp, Homo sapien
cagtcaagctggttgctctgaaagt

SEQ ID NO: 537163 - DNA, 25 bp, Homo sapien
ttccctcccttgaaaggttgacact

SEQ ID NO: 537164 - DNA, 25 bp, Homo sapien
aaggttgacactggacaaccttggg

SEQ ID NO: 537165 - DNA, 25 bp, Homo sapien
gcctcctggctggaaccatgagaag

SEQ ID NO: 537166 - DNA, 25 bp, Homo sapien
aaggaagctcagtacttcccacagt

SEQ ID NO: 537167 - DNA, 25 bp, Homo sapien
agtgtccctgttgataactgttttt

SEQ ID NO: 537168 - DNA, 25 bp, Homo sapien
ttttttgtactgtccccttattgat

SEQ ID NO: 537169 - DNA, 25 bp, Homo sapien
gtactgtccccttattgatgttacc

SEQ ID NO: 537170 - DNA, 25 bp, Homo sapien
gtccccttattgatgttacccagtt

SEQ ID NO: 537171 - DNA, 25 bp, Homo sapien
cttattgatgttacccagttttaat

SEQ ID NO: 537172 - DNA, 25 bp, Homo sapien
tacctactgtgagagagctcttccc

SEQ ID NO: 537173 - DNA, 25 bp, Homo sapien
tactgtgagagagctcttccctgag

SEQ ID NO: 537174 - DNA, 25 bp, Homo sapien
tagcaatctattgggtcaactgaca

SEQ ID NO: 537175 - DNA, 25 bp, Homo sapien
gggtcaactgacatccattgtatat

SEQ ID NO: 537176 - DNA, 25 bp, Homo sapien
aatgcagggcccctttctgatctca

SEQ ID NO: 537177 - DNA, 25 bp, Homo sapien
tttctgatctcaccatttcaccatg

SEQ ID NO: 537178 - DNA, 25 bp, Homo sapien
tctcaccatttcaccatgcatcttg

SEQ ID NO: 537179 - DNA, 25 bp, Homo sapien
gaattcagtaagtgcatatcctaac

SEQ ID NO: 537180 - DNA, 25 bp, Homo sapien
gtgcatatcctaacttgcccatatt

SEQ ID NO: 537181 - DNA, 25 bp, Homo sapien
acttgcccatattctaaatcatctg

SEQ ID NO: 537182 - DNA, 25 bp, Homo sapien
atcatctggttggttttcagcctag

SEQ ID NO: 537183 - DNA, 25 bp, Homo sapien
ttcagcctagaatttgatacgcttt

SEQ ID NO: 537184 - DNA, 25 bp, Homo sapien
tacgctttttagaaatatgcccaga

SEQ ID NO: 537185 - DNA, 25 bp, Homo sapien
actctggaagctctgcgcttcatca

SEQ ID NO: 537186 - DNA, 25 bp, Homo sapien
tctggaagctctgcgcttcatcagg

SEQ ID NO: 537187 - DNA, 25 bp, Homo sapien
gaagctctgcgcttcatcaggaggc

SEQ ID NO: 537188 - DNA, 25 bp, Homo sapien
aagtgggagccagaggtttgactca

SEQ ID NO: 537189 - DNA, 25 bp, Homo sapien
gtgggagccagaggtttgactcact

SEQ ID NO: 537190 - DNA, 25 bp, Homo sapien
gggagccagaggtttgactcacttt

SEQ ID NO: 537191 - DNA, 25 bp, Homo sapien
ggagccagaggtttgactcactttg

SEQ ID NO: 537192 - DNA, 25 bp, Homo sapien
gagccagaggtttgactcactttgc

SEQ ID NO: 537193 - DNA, 25 bp, Homo sapien
gccagaggtttgactcactttgctt

SEQ ID NO: 537194 - DNA, 25 bp, Homo sapien
gctttatttttcaggctacaataca

SEQ ID NO: 537195 - DNA, 25 bp, Homo sapien
ctttatttttcaggctacaatacag

SEQ ID NO: 537196 - DNA, 25 bp, Homo sapien
taaatgaatgttaccttgtcgggaa

SEQ ID NO: 537197 - DNA, 25 bp, Homo sapien
caatctaggttttagctgtatgagc

SEQ ID NO: 537198 - DNA, 25 bp, Homo sapien
gctgtatgagctatgtttattatgg

SEQ ID NO: 537199 - DNA, 25 bp, Homo sapien
ggtgctaatgttcagtagccacatt

SEQ ID NO: 537200 - DNA, 25 bp, Homo sapien
ctgtgatgctgtggctagcagcaga

SEQ ID NO: 537201 - DNA, 25 bp, Homo sapien
tagcagcagagctcgccagttcatg

SEQ ID NO: 537202 - DNA, 25 bp, Homo sapien
gccagttcatgcctggacatactgt

SEQ ID NO: 537203 - DNA, 25 bp, Homo sapien
catgcctggacatactgtcagggct

SEQ ID NO: 537204 - DNA, 25 bp, Homo sapien
gggccctccagctagctcctttggg

SEQ ID NO: 537205 - DNA, 25 bp, Homo sapien
gggttgagtccgtatctttttgatg

SEQ ID NO: 537206 - DNA, 25 bp, Homo sapien
gaattgacctttatgagtgaagact

SEQ ID NO: 537207 - DNA, 25 bp, Homo sapien
ccagaagatggcattcatggattca

SEQ ID NO: 537208 - DNA, 25 bp, Homo sapien
gatggcattcatggattcaacttta

SEQ ID NO: 537209 - DNA, 25 bp, Homo sapien
ggcattcatggattcaactttacaa

SEQ ID NO: 537210 - DNA, 25 bp, Homo sapien
gattcaactttacaagaacatccat

SEQ ID NO: 537211 - DNA, 25 bp, Homo sapien
aagaacatccatttatccatttttg

SEQ ID NO: 537212 - DNA, 25 bp, Homo sapien
atccatttttggacttcatgccgtc

SEQ ID NO: 537213 - DNA, 25 bp, Homo sapien
atttttggacttcatgccgtctccc

SEQ ID NO: 537214 - DNA, 25 bp, Homo sapien
cccaggtggtcaggtggaacccatg

SEQ ID NO: 537215 - DNA, 25 bp, Homo sapien
aggtggtcaggtggaacccatgcct

SEQ ID NO: 537216 - DNA, 25 bp, Homo sapien
atgcctggagcctcaccgcttcaat

SEQ ID NO: 537217 - DNA, 25 bp, Homo sapien
gcctcaccgcttcaatgacacagag

SEQ ID NO: 537218 - DNA, 25 bp, Homo sapien
aagaggaacctgaggctgaccaaga

SEQ ID NO: 537219 - DNA, 25 bp, Homo sapien
gctgaccaagaacatgcctgaactc

SEQ ID NO: 537220 - DNA, 25 bp, Homo sapien
gaacatgcctgaactctaagaaatg

SEQ ID NO: 537221 - DNA, 25 bp, Homo sapien
taagaaatggctttccacatcccca

SEQ ID NO: 537222 - DNA, 25 bp, Homo sapien
cttcctgtcctgctcacgtctgtga

SEQ ID NO: 537223 - DNA, 25 bp, Homo sapien
tcacgtctgtgagtctgtcctttcc

SEQ ID NO: 537224 - DNA, 25 bp, Homo sapien
tgccgcagaggatgctgctgccaag

SEQ ID NO: 537225 - DNA, 25 bp, Homo sapien
gatgctgctgccaaggcaacagccc

SEQ ID NO: 537226 - DNA, 25 bp, Homo sapien
gcagccaagctgaagagaacataga

SEQ ID NO: 537227 - DNA, 25 bp, Homo sapien
gaagctgtagatgaaaccaaaccta

SEQ ID NO: 537228 - DNA, 25 bp, Homo sapien
caaacctaaggaaagtgcccggcag

SEQ ID NO: 537229 - DNA, 25 bp, Homo sapien
gggtgcagatgtctccctgcaccat

SEQ ID NO: 537230 - DNA, 25 bp, Homo sapien
cctgcaccatgccaggtgtggtgca

SEQ ID NO: 537231 - DNA, 25 bp, Homo sapien
gaggcctggactgcctgtggccttt

SEQ ID NO: 537232 - DNA, 25 bp, Homo sapien
gcctgtggcctttgtcgagtcactg

SEQ ID NO: 537233 - DNA, 25 bp, Homo sapien
tggcctttgtcgagtcactgccctt

SEQ ID NO: 537234 - DNA, 25 bp, Homo sapien
gggagcagccctgtctccctctgtc

SEQ ID NO: 537235 - DNA, 25 bp, Homo sapien
gttctctagtatctttattatccat

SEQ ID NO: 537236 - DNA, 25 bp, Homo sapien
tctctagtatctttattatccattc

SEQ ID NO: 537237 - DNA, 25 bp, Homo sapien
tagtatctttattatccattcccgg

SEQ ID NO: 537238 - DNA, 25 bp, Homo sapien
agtatctttattatccattcccggg

SEQ ID NO: 537239 - DNA, 25 bp, Homo sapien
tttattatccattcccgggggcact

SEQ ID NO: 537240 - DNA, 25 bp, Homo sapien
gattcagagaaggaccaaattatat

SEQ ID NO: 537241 - DNA, 25 bp, Homo sapien
gaatgtcttacaatggaatttactt

SEQ ID NO: 537242 - DNA, 25 bp, Homo sapien
caatggaatttacttgttactgatt

SEQ ID NO: 537243 - DNA, 25 bp, Homo sapien
ttttttgttctattgtaccactatt

SEQ ID NO: 537244 - DNA, 25 bp, Homo sapien
ttttgcacagtgtaaaatgacataa

SEQ ID NO: 537245 - DNA, 25 bp, Homo sapien
gattgctatggtttaggctgtatat

SEQ ID NO: 537246 - DNA, 25 bp, Homo sapien
gagacatgtagaagaacctctaaca

SEQ ID NO: 537247 - DNA, 25 bp, Homo sapien
aacaaggttaatgtgcatgcccaag

SEQ ID NO: 537248 - DNA, 25 bp, Homo sapien
gttaatgtgcatgcccaaggtcttt

SEQ ID NO: 537249 - DNA, 25 bp, Homo sapien
gtgcatgcccaaggtcttttgaaat

SEQ ID NO: 537250 - DNA, 25 bp, Homo sapien
atgcccaaggtcttttgaaatttca

SEQ ID NO: 537251 - DNA, 25 bp, Homo sapien
gttgttctcaatgacattagccaaa

SEQ ID NO: 537252 - DNA, 25 bp, Homo sapien
ttagccaaagttgggtttgccattc

SEQ ID NO: 537253 - DNA, 25 bp, Homo sapien
ttgggtttgccattcatcccctagg

SEQ ID NO: 537254 - DNA, 25 bp, Homo sapien
atcccctaggcatggtaaatcttgt

SEQ ID NO: 537255 - DNA, 25 bp, Homo sapien
tggtaaatcttgtgttgttccctgc

SEQ ID NO: 537256 - DNA, 25 bp, Homo sapien
aaatcttgtgttgttccctgctgtc

SEQ ID NO: 537257 - DNA, 25 bp, Homo sapien
gctgtcctccgtattacgtgaccgg

SEQ ID NO: 537258 - DNA, 25 bp, Homo sapien
ctccgtattacgtgaccggcaaata

SEQ ID NO: 537259 - DNA, 25 bp, Homo sapien
tacgtgaccggcaaataaatctcat

SEQ ID NO: 537260 - DNA, 25 bp, Homo sapien
gaatgcaaaatgttggcacgtcaaa

SEQ ID NO: 537261 - DNA, 25 bp, Homo sapien
gacaactgtagttgtgctcagtttg

SEQ ID NO: 537262 - DNA, 25 bp, Homo sapien
ggctcatgccactatacctggctag

SEQ ID NO: 537263 - DNA, 25 bp, Homo sapien
gggcccaagtgatctgctcgcttca

SEQ ID NO: 537264 - DNA, 25 bp, Homo sapien
agtggcacagttctctgcaacctca

SEQ ID NO: 537265 - DNA, 25 bp, Homo sapien
gtggcacagttctctgcaacctcag

SEQ ID NO: 537266 - DNA, 25 bp, Homo sapien
tggcacagttctctgcaacctcagc

SEQ ID NO: 537267 - DNA, 25 bp, Homo sapien
acagttctctgcaacctcagccttt

SEQ ID NO: 537268 - DNA, 25 bp, Homo sapien
atctacaaaaacaggataggcattg

SEQ ID NO: 537269 - DNA, 25 bp, Homo sapien
gttctctgcaacctcagcctttggg

SEQ ID NO: 537270 - DNA, 25 bp, Homo sapien
tctctgcaacctcagcctttgggct

SEQ ID NO: 537271 - DNA, 25 bp, Homo sapien
aacctcagcctttgggctcaaatga

SEQ ID NO: 537272 - DNA, 25 bp, Homo sapien
ctttgggctcaaatgaccctcctac

SEQ ID NO: 537273 - DNA, 25 bp, Homo sapien
tctttattatccattcccgggggca

SEQ ID NO: 537274 - DNA, 25 bp, Homo sapien
tttattatccattcccgggggcact

SEQ ID NO: 537275 - DNA, 25 bp, Homo sapien
ttattatccattcccgggggcactc

SEQ ID NO: 537276 - DNA, 25 bp, Homo sapien
tattatccattcccgggggcactcc

SEQ ID NO: 537277 - DNA, 25 bp, Homo sapien
attatccattcccgggggcactcct

SEQ ID NO: 537278 - DNA, 25 bp, Homo sapien
ttatccattcccgggggcactcctg

SEQ ID NO: 537279 - DNA, 25 bp, Homo sapien
tatccattcccgggggcactcctgg

SEQ ID NO: 537280 - DNA, 25 bp, Homo sapien
atccattcccgggggcactcctggc

SEQ ID NO: 537281 - DNA, 25 bp, Homo sapien
tccattcccgggggcactcctggct

SEQ ID NO: 537282 - DNA, 25 bp, Homo sapien
caaaggcatgaagctgtttattgac

SEQ ID NO: 537283 - DNA, 25 bp, Homo sapien
gacagtaatcagctttcatcaaatt

SEQ ID NO: 537284 - DNA, 25 bp, Homo sapien
acacagttaacgaaggcaggccaga

SEQ ID NO: 537285 - DNA, 25 bp, Homo sapien
agagttcatctgtaggctcagcctc

SEQ ID NO: 537286 - DNA, 25 bp, Homo sapien
ccgctttgtgttcttaaggagtact

SEQ ID NO: 537287 - DNA, 25 bp, Homo sapien
ggagtactacagaagcaatctacag

SEQ ID NO: 537288 - DNA, 25 bp, Homo sapien
aatctacagtctctattgcagtttg

SEQ ID NO: 537289 - DNA, 25 bp, Homo sapien
agtctctattgcagtttgtaacccc

SEQ ID NO: 537290 - DNA, 25 bp, Homo sapien
cccctttaatactgaatgagatcga

SEQ ID NO: 537291 - DNA, 25 bp, Homo sapien
gagatcgaatgttaggtccatgcag

SEQ ID NO: 537292 - DNA, 25 bp, Homo sapien
ggtccatgcagttcttggtcaatgt

SEQ ID NO: 537293 - DNA, 25 bp, Homo sapien
attcaagattcccactccccagagg

SEQ ID NO: 537294 - DNA, 25 bp, Homo sapien
actccccagaggtgaccactttcaa

SEQ ID NO: 537295 - DNA, 25 bp, Homo sapien
gagtttttcaggtatatacctccat

SEQ ID NO: 537296 - DNA, 25 bp, Homo sapien
atatacctccatgtttctaagtaat

SEQ ID NO: 537297 - DNA, 25 bp, Homo sapien
tatgcttatattgttcacttctttt

SEQ ID NO: 537298 - DNA, 25 bp, Homo sapien
atttcataccatggaggaaggctct

SEQ ID NO: 537299 - DNA, 25 bp, Homo sapien
gaaggctctgttccacatatatttc

SEQ ID NO: 537300 - DNA, 25 bp, Homo sapien
tccacatatatttccacttcttcat

SEQ ID NO: 537301 - DNA, 25 bp, Homo sapien
acttcttcattctctcggtatagtt

SEQ ID NO: 537302 - DNA, 25 bp, Homo sapien
tctctcggtatagttttgtcacaat

SEQ ID NO: 537303 - DNA, 25 bp, Homo sapien
gtctacataactaatacagctgagc

SEQ ID NO: 537304 - DNA, 25 bp, Homo sapien
tgataaaccttcactctaccgattc

SEQ ID NO: 537305 - DNA, 25 bp, Homo sapien
ctaccgattcagttgtgagcattct

SEQ ID NO: 537306 - DNA, 25 bp, Homo sapien
ttccttctcaaaacctactatgatt

SEQ ID NO: 537307 - DNA, 25 bp, Homo sapien
aaggttatcaaccacacatccagtc

SEQ ID NO: 537308 - DNA, 25 bp, Homo sapien
catccagtcctgacatggagctttt

SEQ ID NO: 537309 - DNA, 25 bp, Homo sapien
tggagacatttctcaatcccctgct

SEQ ID NO: 537310 - DNA, 25 bp, Homo sapien
tcaatcccctgctgtggtaggaact

SEQ ID NO: 537311 - DNA, 25 bp, Homo sapien
ttgcgcgcctgcagccagagttgca

SEQ ID NO: 537312 - DNA, 25 bp, Homo sapien
gaaagctcgtacttactgcgagcag

SEQ ID NO: 537313 - DNA, 25 bp, Homo sapien
ctgcgagcagcatgtaatctttttt

SEQ ID NO: 537314 - DNA, 25 bp, Homo sapien
gtaatcttttttcttcctggacata

SEQ ID NO: 537315 - DNA, 25 bp, Homo sapien
aagtagctgaagctcagaggctttc

SEQ ID NO: 537316 - DNA, 25 bp, Homo sapien
gctcagaggctttcagcaacagaga

SEQ ID NO: 537317 - DNA, 25 bp, Homo sapien
gttggcaaacgctgaaacgcactgt

SEQ ID NO: 537318 - DNA, 25 bp, Homo sapien
caaacgctgaaacgcactgtggtat

SEQ ID NO: 537319 - DNA, 25 bp, Homo sapien
cactgtggtatgaagcgcattgcat

SEQ ID NO: 537320 - DNA, 25 bp, Homo sapien
gcgcattgcatttccatagcactga

SEQ ID NO: 537321 - DNA, 25 bp, Homo sapien
atagcactgaagtaccagtttccat

SEQ ID NO: 537322 - DNA, 25 bp, Homo sapien
cctgggctgagattgtttttcccgt

SEQ ID NO: 537323 - DNA, 25 bp, Homo sapien
ttttcccgtggttgtattgttctga

SEQ ID NO: 537324 - DNA, 25 bp, Homo sapien
gtattgttctgatttcacgtacacc

SEQ ID NO: 537325 - DNA, 25 bp, Homo sapien
gatttcacgtacaccagagtaactg

SEQ ID NO: 537326 - DNA, 25 bp, Homo sapien
tttcattgtggtaaaagttcttcct

SEQ ID NO: 537327 - DNA, 25 bp, Homo sapien
ttttctctttcccaggtcatgttct

SEQ ID NO: 537328 - DNA, 25 bp, Homo sapien
caggtcatgttcttcctcaaatttt

SEQ ID NO: 537329 - DNA, 25 bp, Homo sapien
tgttcttcctcaaattttttccata

SEQ ID NO: 537330 - DNA, 25 bp, Homo sapien
tataggaaacacaaggctgcatgat

SEQ ID NO: 537331 - DNA, 25 bp, Homo sapien
aagtgcattgttactgtgcagttaa

SEQ ID NO: 537332 - DNA, 25 bp, Homo sapien
gttaaattttggcttctggctttct

SEQ ID NO: 537333 - DNA, 25 bp, Homo sapien
ggcttctggctttctttagtttgaa

SEQ ID NO: 537334 - DNA, 25 bp, Homo sapien
tgaacaaacgttcttgtctacccca

SEQ ID NO: 537335 - DNA, 25 bp, Homo sapien
ttgtctaccccagtagtcacagatg

SEQ ID NO: 537336 - DNA, 25 bp, Homo sapien
taccccagtagtcacagatgccatc

SEQ ID NO: 537337 - DNA, 25 bp, Homo sapien
gggcaagttccttacaatgtgtcac

SEQ ID NO: 537338 - DNA, 25 bp, Homo sapien
gggactttgagggacatttcattaa

SEQ ID NO: 537339 - DNA, 25 bp, Homo sapien
agaggttactcatttacggtgcaat

SEQ ID NO: 537340 - DNA, 25 bp, Homo sapien
acggtgcaattgcttctgtttgcta

SEQ ID NO: 537341 - DNA, 25 bp, Homo sapien
gcttctgtttgctaatgctgctttg

SEQ ID NO: 537342 - DNA, 25 bp, Homo sapien
tgccgaccacccacgggcataaaat

SEQ ID NO: 537343 - DNA, 25 bp, Homo sapien
caagtgcatttcagcattgcctaaa

SEQ ID NO: 537344 - DNA, 25 bp, Homo sapien
attgcctaaagagctctgacaccac

SEQ ID NO: 537345 - DNA, 25 bp, Homo sapien
gctctgacaccacttttcatgttaa

SEQ ID NO: 537346 - DNA, 25 bp, Homo sapien
gttaagatcttcatttagctccttt

SEQ ID NO: 537347 - DNA, 25 bp, Homo sapien
tcagcttagcgggatgggcaagttc

SEQ ID NO: 537348 - DNA, 25 bp, Homo sapien
taaatcaacccccaaggctatcctt

SEQ ID NO: 537349 - DNA, 25 bp, Homo sapien
gcagagggaacttttgtcagactct

SEQ ID NO: 537350 - DNA, 25 bp, Homo sapien
gtcagactctgcaacaaactcctag

SEQ ID NO: 537351 - DNA, 25 bp, Homo sapien
aaactcctagctctatccagagtgt

SEQ ID NO: 537352 - DNA, 25 bp, Homo sapien
agctctatccagagtgtcctctgct

SEQ ID NO: 537353 - DNA, 25 bp, Homo sapien
tctgctgctaagattggtatctttc

SEQ ID NO: 537354 - DNA, 25 bp, Homo sapien
aagattggtatctttctcctcaaaa

SEQ ID NO: 537355 - DNA, 25 bp, Homo sapien
tggtatctttctcctcaaaagcctg

SEQ ID NO: 537356 - DNA, 25 bp, Homo sapien
gggtgcattagtcagaattctccag

SEQ ID NO: 537357 - DNA, 25 bp, Homo sapien
aaaaataagattcgcgtgtgtgtgc

SEQ ID NO: 537358 - DNA, 25 bp, Homo sapien
gattcgcgtgtgtgtgcaaacatat

SEQ ID NO: 537359 - DNA, 25 bp, Homo sapien
catttttctgacctaataattacgg

SEQ ID NO: 537360 - DNA, 25 bp, Homo sapien
taattacgggaaatggaaagtctgg

SEQ ID NO: 537361 - DNA, 25 bp, Homo sapien
aaatgaatatgagaacatcttgttc

SEQ ID NO: 537362 - DNA, 25 bp, Homo sapien
gaacatcttgttcttcaatatcacg

SEQ ID NO: 537363 - DNA, 25 bp, Homo sapien
ttgttcttcaatatcacgggttttt

SEQ ID NO: 537364 - DNA, 25 bp, Homo sapien
caatatcacgggtttttgttaatgt

SEQ ID NO: 537365 - DNA, 25 bp, Homo sapien
atgtttcataagtaattctccccac

SEQ ID NO: 537366 - DNA, 25 bp, Homo sapien
cataagtaattctccccacttgatt

SEQ ID NO: 537367 - DNA, 25 bp, Homo sapien
aaatcccatagaacaatgtttatgc

SEQ ID NO: 537368 - DNA, 25 bp, Homo sapien
atagaacaatgtttatgctatagcc

SEQ ID NO: 537369 - DNA, 25 bp, Homo sapien
gttttacacgaatgtaagagcatgt

SEQ ID NO: 537370 - DNA, 25 bp, Homo sapien
gattctctagaatatcaatgatccc

SEQ ID NO: 537371 - DNA, 25 bp, Homo sapien
gttgcagcagatgtagttgtagaac

SEQ ID NO: 537372 - DNA, 25 bp, Homo sapien
tcccttttcatccatggttcatcaa

SEQ ID NO: 537373 - DNA, 25 bp, Homo sapien
ggttcatcaaaaacatactaactgc

SEQ ID NO: 537374 - DNA, 25 bp, Homo sapien
gaaacaagacacataatcctcttag

SEQ ID NO: 537375 - DNA, 25 bp, Homo sapien
atcctcttaggaattaccattatat

SEQ ID NO: 537376 - DNA, 25 bp, Homo sapien
ttaccattatatcacattaccactg

SEQ ID NO: 537377 - DNA, 25 bp, Homo sapien
atatcacattaccactgtgaggtag

SEQ ID NO: 537378 - DNA, 25 bp, Homo sapien
gttgtagaacatgcattgaggcgta

SEQ ID NO: 537379 - DNA, 25 bp, Homo sapien
cactgtgaggtagaatggatcattc

SEQ ID NO: 537380 - DNA, 25 bp, Homo sapien
aacatgcattgaggcgtattataag

SEQ ID NO: 537381 - DNA, 25 bp, Homo sapien
atggggcttatataaactctgtaca

SEQ ID NO: 537382 - DNA, 25 bp, Homo sapien
actctgtacatgtaagattttgtac

SEQ ID NO: 537383 - DNA, 25 bp, Homo sapien
ttaccttgtgtgtgatagtctagtc

SEQ ID NO: 537384 - DNA, 25 bp, Homo sapien
gtgtgtgatagtctagtcattgcat

SEQ ID NO: 537385 - DNA, 25 bp, Homo sapien
gatagtctagtcattgcatgtaaat

SEQ ID NO: 537386 - DNA, 25 bp, Homo sapien
acattgatgacttacatttttactg

SEQ ID NO: 537387 - DNA, 25 bp, Homo sapien
tttactggtaagtcaacatccgttg

SEQ ID NO: 537388 - DNA, 25 bp, Homo sapien
actggtaagtcaacatccgttggat

SEQ ID NO: 537389 - DNA, 25 bp, Homo sapien
atccgttggatgttttctgaagtgg

SEQ ID NO: 537390 - DNA, 25 bp, Homo sapien
tttctgaagtggctctttttgaagt

SEQ ID NO: 537391 - DNA, 25 bp, Homo sapien
gaagtggctctttttgaagtgataa

SEQ ID NO: 537392 - DNA, 25 bp, Homo sapien
tgtgtctccttttgggacctaaact

SEQ ID NO: 537393 - DNA, 25 bp, Homo sapien
acctgttacagacagtctacctggg

SEQ ID NO: 537394 - DNA, 25 bp, Homo sapien
agcctgcccgccagatcctggtgct

SEQ ID NO: 537395 - DNA, 25 bp, Homo sapien
tgctggacaacgctgccattgtctg

SEQ ID NO: 537396 - DNA, 25 bp, Homo sapien
ctggacaacgctgccattgtctgca

SEQ ID NO: 537397 - DNA, 25 bp, Homo sapien
gccattgtctgcaactttggcagtg

SEQ ID NO: 537398 - DNA, 25 bp, Homo sapien
aagctggactgagcgcagggcctcc

SEQ ID NO: 537399 - DNA, 25 bp, Homo sapien
gggccaatgcactgaacctggactt

SEQ ID NO: 537400 - DNA, 25 bp, Homo sapien
ccaatgcactgaacctggacttggg

SEQ ID NO: 537401 - DNA, 25 bp, Homo sapien
gaaagagccgagtatcttccagccg

SEQ ID NO: 537402 - DNA, 25 bp, Homo sapien
agagccgagtatcttccagccgctg

SEQ ID NO: 537403 - DNA, 25 bp, Homo sapien
acagaagggcagtgactcgacaaag

SEQ ID NO: 537404 - DNA, 25 bp, Homo sapien
cagaagggcagtgactcgacaaagg

SEQ ID NO: 537405 - DNA, 25 bp, Homo sapien
agaagggcagtgactcgacaaaggc

SEQ ID NO: 537406 - DNA, 25 bp, Homo sapien
gaagggcagtgactcgacaaaggcc

SEQ ID NO: 537407 - DNA, 25 bp, Homo sapien
aagggcagtgactcgacaaaggcca

SEQ ID NO: 537408 - DNA, 25 bp, Homo sapien
agggcagtgactcgacaaaggccac

SEQ ID NO: 537409 - DNA, 25 bp, Homo sapien
gggcagtgactcgacaaaggccaca

SEQ ID NO: 537410 - DNA, 25 bp, Homo sapien
ggcagtgactcgacaaaggccacag

SEQ ID NO: 537411 - DNA, 25 bp, Homo sapien
gcagtgactcgacaaaggccacagg

SEQ ID NO: 537412 - DNA, 25 bp, Homo sapien
cagtgactcgacaaaggccacaggc

SEQ ID NO: 537413 - DNA, 25 bp, Homo sapien
agaggctgcgaccaaagtcattcct

SEQ ID NO: 537414 - DNA, 25 bp, Homo sapien
tgacgctgcgggagatcttgcgccc

SEQ ID NO: 537415 - DNA, 25 bp, Homo sapien
acgctgcgggagatcttgcgccctg

SEQ ID NO: 537416 - DNA, 25 bp, Homo sapien
ggctccggatccagttctggcacgt

SEQ ID NO: 537417 - DNA, 25 bp, Homo sapien
atccagttctggcacgttgttgcac

SEQ ID NO: 537418 - DNA, 25 bp, Homo sapien
ttctggcacgttgttgcacctgtga

SEQ ID NO: 537419 - DNA, 25 bp, Homo sapien
acgttgttgcacctgtgacttgtcc

SEQ ID NO: 537420 - DNA, 25 bp, Homo sapien
gttgcacctgtgacttgtccttggc

SEQ ID NO: 537421 - DNA, 25 bp, Homo sapien
tgacttgtccttggcctggcactgt

SEQ ID NO: 537422 - DNA, 25 bp, Homo sapien
gggatgctcacgtggtcgctttgct

SEQ ID NO: 537423 - DNA, 25 bp, Homo sapien
gatgctcacgtggtcgctttgctcc

SEQ ID NO: 537424 - DNA, 25 bp, Homo sapien
gtatattgccattacccagggagga

SEQ ID NO: 537425 - DNA, 25 bp, Homo sapien
ttacccagggaggagcaatacagct

SEQ ID NO: 537426 - DNA, 25 bp, Homo sapien
ggagcaatacagctggctaacaatg

SEQ ID NO: 537427 - DNA, 25 bp, Homo sapien
agggcctgcaaacattaaccatgac

SEQ ID NO: 537428 - DNA, 25 bp, Homo sapien
taaccatgaccaatgcagcagccac

SEQ ID NO: 537429 - DNA, 25 bp, Homo sapien
agccgggtactaccattctacagta

SEQ ID NO: 537430 - DNA, 25 bp, Homo sapien
accattctacagtatgcacagacca

SEQ ID NO: 537431 - DNA, 25 bp, Homo sapien
gatggacagcagatcttagtgccca

SEQ ID NO: 537432 - DNA, 25 bp, Homo sapien
gatcttagtgcccagcaaccaagtt

SEQ ID NO: 537433 - DNA, 25 bp, Homo sapien
tgcctctggagacgtacaaacatac

SEQ ID NO: 537434 - DNA, 25 bp, Homo sapien
gcactattgcccctggagttgttat

SEQ ID NO: 537435 - DNA, 25 bp, Homo sapien
agacgccatcattctccggaaaggg

SEQ ID NO: 537436 - DNA, 25 bp, Homo sapien
ggcctcagtggagcacgtgtgccac

SEQ ID NO: 537437 - DNA, 25 bp, Homo sapien
agtggagcacgtgtgccaccgcatc

SEQ ID NO: 537438 - DNA, 25 bp, Homo sapien
ggtcactcgccagccagttcaagta

SEQ ID NO: 537439 - DNA, 25 bp, Homo sapien
agccagttcaagtacgccctggtgt

SEQ ID NO: 537440 - DNA, 25 bp, Homo sapien
agcaccaagtacagtccgcagcggg

SEQ ID NO: 537441 - DNA, 25 bp, Homo sapien
tgggcctgacccacaccatggagca

SEQ ID NO: 537442 - DNA, 25 bp, Homo sapien
accatggagcatgaggacgtcatcc

SEQ ID NO: 537443 - DNA, 25 bp, Homo sapien
agcatgaggacgtcatccagatcgt

SEQ ID NO: 537444 - DNA, 25 bp, Homo sapien
aggacgtcatccagatcgtgaagaa

SEQ ID NO: 537445 - DNA, 25 bp, Homo sapien
tcgtgaagaagtaacggcgcctgcc

SEQ ID NO: 537446 - DNA, 25 bp, Homo sapien
tggccaagcactggatgttacactt

SEQ ID NO: 537447 - DNA, 25 bp, Homo sapien
ggatgttacactttcctcgtattac

SEQ ID NO: 537448 - DNA, 25 bp, Homo sapien
tcgtattacatatcccctagtgcat

SEQ ID NO: 537449 - DNA, 25 bp, Homo sapien
gttatgcggtctgaaccttttttgg

SEQ ID NO: 537450 - DNA, 25 bp, Homo sapien
gcaaaacttgttttaggtgcttgaa

SEQ ID NO: 537451 - DNA, 25 bp, Homo sapien
ttcttcctactgtgctggacacagg

SEQ ID NO: 537452 - DNA, 25 bp, Homo sapien
ggacacaggacaaggcttcaaactt

SEQ ID NO: 537453 - DNA, 25 bp, Homo sapien
taatttggaccccaaagcgggatat

SEQ ID NO: 537454 - DNA, 25 bp, Homo sapien
gcgggatattaataagcactcatac

SEQ ID NO: 537455 - DNA, 25 bp, Homo sapien
gcactcatactaccaattatcacta

SEQ ID NO: 537456 - DNA, 25 bp, Homo sapien
aacttgccattttttgtatgctgta

SEQ ID NO: 537457 - DNA, 25 bp, Homo sapien
cgtgcctttggcacgcgcgatgcgt

SEQ ID NO: 537458 - DNA, 25 bp, Homo sapien
tttggcacgcgcgatgcgttgcacc

SEQ ID NO: 537459 - DNA, 25 bp, Homo sapien
tggcacgcgcgatgcgttgcacctg

SEQ ID NO: 537460 - DNA, 25 bp, Homo sapien
acgcgcgatgcgttgcacctgggct

SEQ ID NO: 537461 - DNA, 25 bp, Homo sapien
gcgcgatgcgttgcacctgggcttc

SEQ ID NO: 537462 - DNA, 25 bp, Homo sapien
cgatgcgttgcacctgggcttcccg

SEQ ID NO: 537463 - DNA, 25 bp, Homo sapien
atgcgttgcacctgggcttcccgcg

SEQ ID NO: 537464 - DNA, 25 bp, Homo sapien
ttgcacctgggcttcccgcgggagc

SEQ ID NO: 537465 - DNA, 25 bp, Homo sapien
tcgagtcgccgctgctgctcgacag

SEQ ID NO: 537466 - DNA, 25 bp, Homo sapien
cttcatccacaacgcggacgagcgg

SEQ ID NO: 537467 - DNA, 25 bp, Homo sapien
atccacaacgcggacgagcggcggc

SEQ ID NO: 537468 - DNA, 25 bp, Homo sapien
tccactgccagccagaatcttaaat

SEQ ID NO: 537469 - DNA, 25 bp, Homo sapien
aattttccgagctgaattctgactc

SEQ ID NO: 537470 - DNA, 25 bp, Homo sapien
caactgggtctttcaatgcctcgtc

SEQ ID NO: 537471 - DNA, 25 bp, Homo sapien
tttcaatgcctcgtccatgccaaaa

SEQ ID NO: 537472 - DNA, 25 bp, Homo sapien
atcgttttaccctctgctggctcgg

SEQ ID NO: 537473 - DNA, 25 bp, Homo sapien
ctcggttctttgcttgcctcaagtt

SEQ ID NO: 537474 - DNA, 25 bp, Homo sapien
aagttcccagaaagtggtgtcatcg

SEQ ID NO: 537475 - DNA, 25 bp, Homo sapien
gtgtcatcggacagccatgggttag

SEQ ID NO: 537476 - DNA, 25 bp, Homo sapien
gtattctaaatactgttccgtgtaa

SEQ ID NO: 537477 - DNA, 25 bp, Homo sapien
gttccgtgtaacttagtagactgtc

SEQ ID NO: 537478 - DNA, 25 bp, Homo sapien
gactgtcagcgacttttgacatttt

SEQ ID NO: 537479 - DNA, 25 bp, Homo sapien
gcagtagttgtagatatgctaagtt

SEQ ID NO: 537480 - DNA, 25 bp, Homo sapien
gttgtagatatgctaagtttttcaa

SEQ ID NO: 537481 - DNA, 25 bp, Homo sapien
tcaagtggagattgtttttactttt

SEQ ID NO: 537482 - DNA, 25 bp, Homo sapien
cttttaagggtattgcttttgtgat

SEQ ID NO: 537483 - DNA, 25 bp, Homo sapien
taagggtattgcttttgtgatagca

SEQ ID NO: 537484 - DNA, 25 bp, Homo sapien
ttgtaatgtaaattaattgctggca

SEQ ID NO: 537485 - DNA, 25 bp, Homo sapien
aattgctggcaacttttgtattccc

SEQ ID NO: 537486 - DNA, 25 bp, Homo sapien
attgctggcaacttttgtattccca

SEQ ID NO: 537487 - DNA, 25 bp, Homo sapien
tgctggcaacttttgtattcccata

SEQ ID NO: 537488 - DNA, 25 bp, Homo sapien
tagtttatgctttagtactatatat

SEQ ID NO: 537489 - DNA, 25 bp, Homo sapien
acttctgtttatatcatttgtacaa

SEQ ID NO: 537490 - DNA, 25 bp, Homo sapien
gtgtaaaatgttgtgctgaagaaga

SEQ ID NO: 537491 - DNA, 25 bp, Homo sapien
gactgaaatactagatccagatact

SEQ ID NO: 537492 - DNA, 25 bp, Homo sapien
gatccagatactttggaaaaccaag

SEQ ID NO: 537493 - DNA, 25 bp, Homo sapien
aaaccaagctacagttgaattccat

SEQ ID NO: 537494 - DNA, 25 bp, Homo sapien
gctacagttgaattccatagtggag

SEQ ID NO: 537495 - DNA, 25 bp, Homo sapien
tggagtgtgaaaagcttggattatc

SEQ ID NO: 537496 - DNA, 25 bp, Homo sapien
tacagtgaagcacaaggtcaaaatt

SEQ ID NO: 537497 - DNA, 25 bp, Homo sapien
gcagaaattcatcagactgtagaga

SEQ ID NO: 537498 - DNA, 25 bp, Homo sapien
aaaaatggcagctagctcctcttcg

SEQ ID NO: 537499 - DNA, 25 bp, Homo sapien
gctagctcctcttcgtaagatggga

SEQ ID NO: 537500 - DNA, 25 bp, Homo sapien
taagatgggacaaccagttttacct

SEQ ID NO: 537501 - DNA, 25 bp, Homo sapien
tggccctctggttcacttctattat

SEQ ID NO: 537502 - DNA, 25 bp, Homo sapien
cctctggttcacttctattatgaat

SEQ ID NO: 537503 - DNA, 25 bp, Homo sapien
aaatttgcaccaatagccccattag

SEQ ID NO: 537504 - DNA, 25 bp, Homo sapien
atttgcaccaatagccccattagtt

SEQ ID NO: 537505 - DNA, 25 bp, Homo sapien
gtaatttctggtaagcttgagctac

SEQ ID NO: 537506 - DNA, 25 bp, Homo sapien
aagcttgagctactttaatttttat

SEQ ID NO: 537507 - DNA, 25 bp, Homo sapien
atgaaactgatatcccttgatgtgg

SEQ ID NO: 537508 - DNA, 25 bp, Homo sapien
tatcccttgatgtgggaaacaggca

SEQ ID NO: 537509 - DNA, 25 bp, Homo sapien
gtgtggcaccgtgcaaacaaaatga

SEQ ID NO: 537510 - DNA, 25 bp, Homo sapien
tgacaaatttcaactcacaatcttt

SEQ ID NO: 537511 - DNA, 25 bp, Homo sapien
atttcaactcacaatctttgtaaga

SEQ ID NO: 537512 - DNA, 25 bp, Homo sapien
acacatgagggataagactacccat

SEQ ID NO: 537513 - DNA, 25 bp, Homo sapien
aagactacccataaagtagagttca

SEQ ID NO: 537514 - DNA, 25 bp, Homo sapien
gtagagttcatactgctcacatgac

SEQ ID NO: 537515 - DNA, 25 bp, Homo sapien
gttcatactgctcacatgacaggtg

SEQ ID NO: 537516 - DNA, 25 bp, Homo sapien
gctcacatgacaggtgcaccaaaat

SEQ ID NO: 537517 - DNA, 25 bp, Homo sapien
taagttatgactattaccacccttt

SEQ ID NO: 537518 - DNA, 25 bp, Homo sapien
ttaccaccctttcaccatttctgaa

SEQ ID NO: 537519 - DNA, 25 bp, Homo sapien
caccctttcaccatttctgaaagct

SEQ ID NO: 537520 - DNA, 25 bp, Homo sapien
gagggataagactacacataaggtg

SEQ ID NO: 537521 - DNA, 25 bp, Homo sapien
tacacataaggtggagttcatacac

SEQ ID NO: 537522 - DNA, 25 bp, Homo sapien
tggagttcatacacatgagggataa

SEQ ID NO: 537523 - DNA, 25 bp, Homo sapien
ggacccagagaagttagcccaggaa

SEQ ID NO: 537524 - DNA, 25 bp, Homo sapien
cagcatcgctcaccaggacactgga

SEQ ID NO: 537525 - DNA, 25 bp, Homo sapien
agccagacggtctcagagtgccgag

SEQ ID NO: 537526 - DNA, 25 bp, Homo sapien
agacggtctcagagtgccgagctga

SEQ ID NO: 537527 - DNA, 25 bp, Homo sapien
gagtgccgagctgaacagggattta

SEQ ID NO: 537528 - DNA, 25 bp, Homo sapien
gagctgaacagggatttatgcaaag

SEQ ID NO: 537529 - DNA, 25 bp, Homo sapien
ttatgcaaagcccacagcgccctgg

SEQ ID NO: 537530 - DNA, 25 bp, Homo sapien
tccgaggagcccaccggaagcagga

SEQ ID NO: 537531 - DNA, 25 bp, Homo sapien
agcccaccggaagcaggaagagcaa

SEQ ID NO: 537532 - DNA, 25 bp, Homo sapien
agttggagcagcagatggcactcat

SEQ ID NO: 537533 - DNA, 25 bp, Homo sapien
tggcggtgctcgaagccactgcaag

SEQ ID NO: 537534 - DNA, 25 bp, Homo sapien
ttgtgtgttatctcttacctgccag

SEQ ID NO: 537535 - DNA, 25 bp, Homo sapien
ctcttacctgccagaatgttctcaa

SEQ ID NO: 537536 - DNA, 25 bp, Homo sapien
tactgaaactacttaatgaggcaat

SEQ ID NO: 537537 - DNA, 25 bp, Homo sapien
acttcgaaggagtcatcactaggtg

SEQ ID NO: 537538 - DNA, 25 bp, Homo sapien
agtcatcactaggtgctttgtcctt

SEQ ID NO: 537539 - DNA, 25 bp, Homo sapien
tttttgtattctagttgcacccacc

SEQ ID NO: 537540 - DNA, 25 bp, Homo sapien
ctagttgcacccacctcttggattg

SEQ ID NO: 537541 - DNA, 25 bp, Homo sapien
catttattggccgttgtgagctctt

SEQ ID NO: 537542 - DNA, 25 bp, Homo sapien
tgtgagctcttgatcccagtcatta

SEQ ID NO: 537543 - DNA, 25 bp, Homo sapien
cagtcattacccctgagaactaaaa

SEQ ID NO: 537544 - DNA, 25 bp, Homo sapien
gatggttcttaattcaacttactga

SEQ ID NO: 537545 - DNA, 25 bp, Homo sapien
caggaaatctgaaaacttcgatgga

SEQ ID NO: 537546 - DNA, 25 bp, Homo sapien
aaaccacagcagtattagtacctgt

SEQ ID NO: 537547 - DNA, 25 bp, Homo sapien
cagtattagtacctgtgtctctgtc

SEQ ID NO: 537548 - DNA, 25 bp, Homo sapien
tgtctctgtcatcactaggaatcac

SEQ ID NO: 537549 - DNA, 25 bp, Homo sapien
gaatcacagatatccacgttacaga

SEQ ID NO: 537550 - DNA, 25 bp, Homo sapien
atccacgttacagatatcttaaaat

SEQ ID NO: 537551 - DNA, 25 bp, Homo sapien
aaaatatttatgtacagcaccactc

SEQ ID NO: 537552 - DNA, 25 bp, Homo sapien
gtacagcaccactctgaaattatgg

SEQ ID NO: 537553 - DNA, 25 bp, Homo sapien
ttatggtaataattagatccacccc

SEQ ID NO: 537554 - DNA, 25 bp, Homo sapien
ccctaggtcttgtaatctttaatat

SEQ ID NO: 537555 - DNA, 25 bp, Homo sapien
gaagcacatctattatgtgacagat

SEQ ID NO: 537556 - DNA, 25 bp, Homo sapien
ttctgtcaggcacccgtagaaagac

SEQ ID NO: 537557 - DNA, 25 bp, Homo sapien
ggcacccgtagaaagacctcagtac

SEQ ID NO: 537558 - DNA, 25 bp, Homo sapien
aagacctcagtacatgctttgcact

SEQ ID NO: 537559 - DNA, 25 bp, Homo sapien
agtacatgctttgcactctcctttg

SEQ ID NO: 537560 - DNA, 25 bp, Homo sapien
cctttttccaatttcttattgcata

SEQ ID NO: 537561 - DNA, 25 bp, Homo sapien
gcagcatttttaaatgtccgtgtta

SEQ ID NO: 537562 - DNA, 25 bp, Homo sapien
taagaattggcccactggtaccaac

SEQ ID NO: 537563 - DNA, 25 bp, Homo sapien
gaattggcccactggtaccaactca

SEQ ID NO: 537564 - DNA, 25 bp, Homo sapien
taccaactcacctctattttgtcag

SEQ ID NO: 537565 - DNA, 25 bp, Homo sapien
ctcacctctattttgtcagttcata

SEQ ID NO: 537566 - DNA, 25 bp, Homo sapien
gtcagttcatagttgaagatttgtt

SEQ ID NO: 537567 - DNA, 25 bp, Homo sapien
tgatcacctgcaaatgtttgaggac

SEQ ID NO: 537568 - DNA, 25 bp, Homo sapien
aaatgtttgaggacggagctgtgca

SEQ ID NO: 537569 - DNA, 25 bp, Homo sapien
ggtgctgcaggccttgcgcctccaa

SEQ ID NO: 537570 - DNA, 25 bp, Homo sapien
ccaaccaggactttcttcttaatgc

SEQ ID NO: 537571 - DNA, 25 bp, Homo sapien
aggactttcttcttaatgctctcga

SEQ ID NO: 537572 - DNA, 25 bp, Homo sapien
aatgctctcgacacttagctaaaca

SEQ ID NO: 537573 - DNA, 25 bp, Homo sapien
tagctaaacacgactatatcccggc

SEQ ID NO: 537574 - DNA, 25 bp, Homo sapien
taaacacgactatatcccggcccag

SEQ ID NO: 537575 - DNA, 25 bp, Homo sapien
ctgtgggttggtcttaaagcaaatt

SEQ ID NO: 537576 - DNA, 25 bp, Homo sapien
tgttttgtggactgcctggcaattt

SEQ ID NO: 537577 - DNA, 25 bp, Homo sapien
tggactgcctggcaattttttagct

SEQ ID NO: 537578 - DNA, 25 bp, Homo sapien
gaagctcttgttgctttggcattaa

SEQ ID NO: 537579 - DNA, 25 bp, Homo sapien
aatagcagctttagaattgggcact

SEQ ID NO: 537580 - DNA, 25 bp, Homo sapien
attgggcactgctgagaaagatcta

SEQ ID NO: 537581 - DNA, 25 bp, Homo sapien
agtgctaaacttgtacagattttac

SEQ ID NO: 537582 - DNA, 25 bp, Homo sapien
gattttacatagactgctagcagat

SEQ ID NO: 537583 - DNA, 25 bp, Homo sapien
gagaagtgctcctgaaatcaaatat

SEQ ID NO: 537584 - DNA, 25 bp, Homo sapien
attccatggtcctgatatgtgctct

SEQ ID NO: 537585 - DNA, 25 bp, Homo sapien
atatgtgctcttatgggatctgaat

SEQ ID NO: 537586 - DNA, 25 bp, Homo sapien
gggatctgaatgtctacacaaggaa

SEQ ID NO: 537587 - DNA, 25 bp, Homo sapien
gcttttctagatgtcgtatccaaac

SEQ ID NO: 537588 - DNA, 25 bp, Homo sapien
gtatccaaacttcgcagtcatgaga

SEQ ID NO: 537589 - DNA, 25 bp, Homo sapien
tcagcatattttgactccatgaaga

SEQ ID NO: 537590 - DNA, 25 bp, Homo sapien
catgaagatcccttcaggacagcct

SEQ ID NO: 537591 - DNA, 25 bp, Homo sapien
caggacagcctgagacagcagatgt

SEQ ID NO: 537592 - DNA, 25 bp, Homo sapien
ctgagacagcagatgtgtccaggga

SEQ ID NO: 537593 - DNA, 25 bp, Homo sapien
tggacagggcaagtaactccctgat

SEQ ID NO: 537594 - DNA, 25 bp, Homo sapien
ctccctgatttctggactgagtcaa

SEQ ID NO: 537595 - DNA, 25 bp, Homo sapien
gtgaagtcctggaacgctcccactc

SEQ ID NO: 537596 - DNA, 25 bp, Homo sapien
tgaagctgacccctgcctcaagtac

SEQ ID NO: 537597 - DNA, 25 bp, Homo sapien
taacctccatgcctatcttcaaggc

SEQ ID NO: 537598 - DNA, 25 bp, Homo sapien
tatcttcaaggcaacacccaggtct

SEQ ID NO: 537599 - DNA, 25 bp, Homo sapien
aggtctctcgaaagaaacttctgcc

SEQ ID NO: 537600 - DNA, 25 bp, Homo sapien
gaatgggccgttaggagtatttgaa

SEQ ID NO: 537601 - DNA, 25 bp, Homo sapien
aatgggatgcctttgctaagggaac

SEQ ID NO: 537602 - DNA, 25 bp, Homo sapien
gctaagggaaccaaagccctcatgg

SEQ ID NO: 537603 - DNA, 25 bp, Homo sapien
ttgtgaaagccacttccaagggctg

SEQ ID NO: 537604 - DNA, 25 bp, Homo sapien
ccaagggctgcatcactgttatagg

SEQ ID NO: 537605 - DNA, 25 bp, Homo sapien
gcggtgccagtctagagcttctgga

SEQ ID NO: 537606 - DNA, 25 bp, Homo sapien
ctgtggtcctgagagcaacaagaat

SEQ ID NO: 537607 - DNA, 25 bp, Homo sapien
ggtcctgagagcaacaagaatcatg

SEQ ID NO: 537608 - DNA, 25 bp, Homo sapien
gaatcatgctcaagttgtggctcaa

SEQ ID NO: 537609 - DNA, 25 bp, Homo sapien
caagttgtggctcaagcaaggctaa

SEQ ID NO: 537610 - DNA, 25 bp, Homo sapien
ctcaagcaaggctaattgtttggaa

SEQ ID NO: 537611 - DNA, 25 bp, Homo sapien
aaagtcctcttcatatatttccatt

SEQ ID NO: 537612 - DNA, 25 bp, Homo sapien
actgtgctgctttttagtgtctggc

SEQ ID NO: 537613 - DNA, 25 bp, Homo sapien
tgctttttagtgtctggctgcataa

SEQ ID NO: 537614 - DNA, 25 bp, Homo sapien
gtctggctgcataatgtacaagtca

SEQ ID NO: 537615 - DNA, 25 bp, Homo sapien
gtacaagtcacaatttgctgttttt

SEQ ID NO: 537616 - DNA, 25 bp, Homo sapien
gggaacctcctttactattctatat

SEQ ID NO: 537617 - DNA, 25 bp, Homo sapien
aatctacttctaatcagctttatac

SEQ ID NO: 537618 - DNA, 25 bp, Homo sapien
agctttatactgttgcctgtacagc

SEQ ID NO: 537619 - DNA, 25 bp, Homo sapien
actgttgcctgtacagctcagtgaa

SEQ ID NO: 537620 - DNA, 25 bp, Homo sapien
gctcagtgaatgtactttcatcttt

SEQ ID NO: 537621 - DNA, 25 bp, Homo sapien
ttaagagttcagatatatgccagtg

SEQ ID NO: 537622 - DNA, 25 bp, Homo sapien
tctccatatgcctccaaaaacatgt

SEQ ID NO: 537623 - DNA, 25 bp, Homo sapien
atatgcctccaaaaacatgtccctg

SEQ ID NO: 537624 - DNA, 25 bp, Homo sapien
atgcctccaaaaacatgtccctgga

SEQ ID NO: 537625 - DNA, 25 bp, Homo sapien
aacatgtccctggagagtagcctgc

SEQ ID NO: 537626 - DNA, 25 bp, Homo sapien
acatgtccctggagagtagcctgct

SEQ ID NO: 537627 - DNA, 25 bp, Homo sapien
atgtccctggagagtagcctgctcc

SEQ ID NO: 537628 - DNA, 25 bp, Homo sapien
gtccctggagagtagcctgctccca

SEQ ID NO: 537629 - DNA, 25 bp, Homo sapien
tcccacactgtcactggatgtcatg

SEQ ID NO: 537630 - DNA, 25 bp, Homo sapien
ccacactgtcactggatgtcatggg

SEQ ID NO: 537631 - DNA, 25 bp, Homo sapien
gtcactggatgtcatggggccaata

SEQ ID NO: 537632 - DNA, 25 bp, Homo sapien
ggccaataaaatctcctgcaattgt

SEQ ID NO: 537633 - DNA, 25 bp, Homo sapien
aaagcattctgcattagtactaaaa

SEQ ID NO: 537634 - DNA, 25 bp, Homo sapien
aaataagccatcaatgccagtccac

SEQ ID NO: 537635 - DNA, 25 bp, Homo sapien
caccctctctattcatggctaaata

SEQ ID NO: 537636 - DNA, 25 bp, Homo sapien
tatagcttctttaatgaattcttct

SEQ ID NO: 537637 - DNA, 25 bp, Homo sapien
atgaattcttcttaaacaaagtgaa

SEQ ID NO: 537638 - DNA, 25 bp, Homo sapien
agtgaaattatgtcctagaaaagta

SEQ ID NO: 537639 - DNA, 25 bp, Homo sapien
agaagctattcgtaactagagcagt

SEQ ID NO: 537640 - DNA, 25 bp, Homo sapien
attcgtaactagagcagtgcaactt

SEQ ID NO: 537641 - DNA, 25 bp, Homo sapien
ctagagcagtgcaactttaaagttt

SEQ ID NO: 537642 - DNA, 25 bp, Homo sapien
gggcgagcttgcatccccactagtt

SEQ ID NO: 537643 - DNA, 25 bp, Homo sapien
gcttgcatccccactagttaatgga

SEQ ID NO: 537644 - DNA, 25 bp, Homo sapien
gcagcttgggtcttcttgggcacct

SEQ ID NO: 537645 - DNA, 25 bp, Homo sapien
ggcccaaagggcagacctttctttg

SEQ ID NO: 537646 - DNA, 25 bp, Homo sapien
agggcagacctttctttgggactgt

SEQ ID NO: 537647 - DNA, 25 bp, Homo sapien
tgtgtggaccaaggagcttccatct

SEQ ID NO: 537648 - DNA, 25 bp, Homo sapien
ggaccaaggagcttccatctagtga

SEQ ID NO: 537649 - DNA, 25 bp, Homo sapien
ggagcttccatctagtgacaagtga

SEQ ID NO: 537650 - DNA, 25 bp, Homo sapien
gcttccatctagtgacaagtgaccc

SEQ ID NO: 537651 - DNA, 25 bp, Homo sapien
actttccagggtggactctgtcttg

SEQ ID NO: 537652 - DNA, 25 bp, Homo sapien
ttccagggtggactctgtcttgttc

SEQ ID NO: 537653 - DNA, 25 bp, Homo sapien
gttcactgcagtatcccaactgcag

SEQ ID NO: 537654 - DNA, 25 bp, Homo sapien
tgcaggcaataaatatgtgatggac

SEQ ID NO: 537655 - DNA, 25 bp, Homo sapien
taaggatcccacgactttttactgc

SEQ ID NO: 537656 - DNA, 25 bp, Homo sapien
tttttactgccatctgagctactca

SEQ ID NO: 537657 - DNA, 25 bp, Homo sapien
gagctactcagtgtttgaatcccaa

SEQ ID NO: 537658 - DNA, 25 bp, Homo sapien
atcccaagaggaagtcagtttacct

SEQ ID NO: 537659 - DNA, 25 bp, Homo sapien
agtttacctctcaggtctgttgtag

SEQ ID NO: 537660 - DNA, 25 bp, Homo sapien
agcaatgccatgttatgtggttgaa

SEQ ID NO: 537661 - DNA, 25 bp, Homo sapien
ttagtatcaggagcactgagctcac

SEQ ID NO: 537662 - DNA, 25 bp, Homo sapien
ctgagctcacagactgacttgggct

SEQ ID NO: 537663 - DNA, 25 bp, Homo sapien
actgacttgggctcctactggtggg

SEQ ID NO: 537664 - DNA, 25 bp, Homo sapien
gggacctctgttagtcactttacct

SEQ ID NO: 537665 - DNA, 25 bp, Homo sapien
gttagtcactttacctcatccaaag

SEQ ID NO: 537666 - DNA, 25 bp, Homo sapien
tgtctctgcagattctatttttgtt

SEQ ID NO: 537667 - DNA, 25 bp, Homo sapien
gctcgtgccatgttatgatcatata

SEQ ID NO: 537668 - DNA, 25 bp, Homo sapien
gtatctttaaagttaatgtctagcc

SEQ ID NO: 537669 - DNA, 25 bp, Homo sapien
atgtctagccaagagtttagtaaac

SEQ ID NO: 537670 - DNA, 25 bp, Homo sapien
gaattaaactgcactgttgatcggt

SEQ ID NO: 537671 - DNA, 25 bp, Homo sapien
actgttgatcggtgctttgtgtaaa

SEQ ID NO: 537672 - DNA, 25 bp, Homo sapien
aatacatctttaacatttgggtgga

SEQ ID NO: 537673 - DNA, 25 bp, Homo sapien
gaaggacagttcattgtaggaaagc

SEQ ID NO: 537674 - DNA, 25 bp, Homo sapien
aattctgtacatgagtttaagcatt

SEQ ID NO: 537675 - DNA, 25 bp, Homo sapien
cattcttgttgcattgtctctgcag

SEQ ID NO: 537676 - DNA, 25 bp, Homo sapien
gcattgtctctgcagattctatttt

SEQ ID NO: 537677 - DNA, 25 bp, Homo sapien
actctggaagctctgcgcttcatca

SEQ ID NO: 537678 - DNA, 25 bp, Homo sapien
gaagctctgcgcttcatcaggaggc

SEQ ID NO: 537679 - DNA, 25 bp, Homo sapien
aagtgggagccagaggtttgactca

SEQ ID NO: 537680 - DNA, 25 bp, Homo sapien
gggagccagaggtttgactcacttt

SEQ ID NO: 537681 - DNA, 25 bp, Homo sapien
gccagaggtttgactcactttgctt

SEQ ID NO: 537682 - DNA, 25 bp, Homo sapien
ggtttgactcactttgctttatttt

SEQ ID NO: 537683 - DNA, 25 bp, Homo sapien
gctttatttttcaggctacaataca

SEQ ID NO: 537684 - DNA, 25 bp, Homo sapien
ggctacaatacaggtcagagacaat

SEQ ID NO: 537685 - DNA, 25 bp, Homo sapien
tgacctttctgcacactccagacaa

SEQ ID NO: 537686 - DNA, 25 bp, Homo sapien
tttctgcacactccagacaaacttc

SEQ ID NO: 537687 - DNA, 25 bp, Homo sapien
ctttgtgcctctacgtggagagggt

SEQ ID NO: 537688 - DNA, 25 bp, Homo sapien
gaaagctgacagtctgttctttgta

SEQ ID NO: 537689 - DNA, 25 bp, Homo sapien
taaactgcctttccctgtttttctg

SEQ ID NO: 537690 - DNA, 25 bp, Homo sapien
ttcattttttactaagccccttctg

SEQ ID NO: 537691 - DNA, 25 bp, Homo sapien
gccccttctgacacctaggcagata

SEQ ID NO: 537692 - DNA, 25 bp, Homo sapien
agtgcgcagtacaaatgtcagctct

SEQ ID NO: 537693 - DNA, 25 bp, Homo sapien
aagtaaatcttcaatgctagggcag

SEQ ID NO: 537694 - DNA, 25 bp, Homo sapien
atgctagggcagatcttcactatcc

SEQ ID NO: 537695 - DNA, 25 bp, Homo sapien
agatcttcactatccgtgatccagt

SEQ ID NO: 537696 - DNA, 25 bp, Homo sapien
atccgtgatccagtcttaatttgag

SEQ ID NO: 537697 - DNA, 25 bp, Homo sapien
gatccagtcttaatttgagcatgag

SEQ ID NO: 537698 - DNA, 25 bp, Homo sapien
gagcaaaatttagtcatctacacaa

SEQ ID NO: 537699 - DNA, 25 bp, Homo sapien
gtagactcttattgataaatgcaac

SEQ ID NO: 537700 - DNA, 25 bp, Homo sapien
gtcttttgatcagatgcctttagtc

SEQ ID NO: 537701 - DNA, 25 bp, Homo sapien
gatgcctttagtcaggtaagtttaa

SEQ ID NO: 537702 - DNA, 25 bp, Homo sapien
ggtacatataattatgtctgccaaa

SEQ ID NO: 537703 - DNA, 25 bp, Homo sapien
attatgtctgccaaagaaacctttg

SEQ ID NO: 537704 - DNA, 25 bp, Homo sapien
aacctttgattgtatcatattgcct

SEQ ID NO: 537705 - DNA, 25 bp, Homo sapien
catattgcctatttagtagtgcata

SEQ ID NO: 537706 - DNA, 25 bp, Homo sapien
gtagtgcatagggttcagagtacat

SEQ ID NO: 537707 - DNA, 25 bp, Homo sapien
gctttgcattgataagtgtctcata

SEQ ID NO: 537708 - DNA, 25 bp, Homo sapien
ctcataatatttgctgtgattggag

SEQ ID NO: 537709 - DNA, 25 bp, Homo sapien
aaaaatgtagtcgtagccaataaat

SEQ ID NO: 537710 - DNA, 25 bp, Homo sapien
caggctacaatacaggtcagagaca

SEQ ID NO: 537711 - DNA, 25 bp, Homo sapien
aggctacaatacaggtcagagacaa

SEQ ID NO: 537712 - DNA, 25 bp, Homo sapien
ggctacaatacaggtcagagacaat

SEQ ID NO: 537713 - DNA, 25 bp, Homo sapien
gctacaatacaggtcagagacaatg

SEQ ID NO: 537714 - DNA, 25 bp, Homo sapien
ctacaatacaggtcagagacaatgg

SEQ ID NO: 537715 - DNA, 25 bp, Homo sapien
tacaatacaggtcagagacaatggc

SEQ ID NO: 537716 - DNA, 25 bp, Homo sapien
acaatacaggtcagagacaatggct

SEQ ID NO: 537717 - DNA, 25 bp, Homo sapien
ggaaagttatcacattaaaagatgg

SEQ ID NO: 537718 - DNA, 25 bp, Homo sapien
gaaagttatcacattaaaagatgga

SEQ ID NO: 537719 - DNA, 25 bp, Homo sapien
aagttatcacattaaaagatggagg

SEQ ID NO: 537720 - DNA, 25 bp, Homo sapien
agttatcacattaaaagatggagga

SEQ ID NO: 537721 - DNA, 25 bp, Homo sapien
ggccctctctgctcttttattgcag

SEQ ID NO: 537722 - DNA, 25 bp, Homo sapien
ctgctcttttattgcaggcagagtg

SEQ ID NO: 537723 - DNA, 25 bp, Homo sapien
gctcttttattgcaggcagagtgtc

SEQ ID NO: 537724 - DNA, 25 bp, Homo sapien
tcttttattgcaggcagagtgtctc

SEQ ID NO: 537725 - DNA, 25 bp, Homo sapien
ggccagaccacatgggagtgggctc

SEQ ID NO: 537726 - DNA, 25 bp, Homo sapien
gggccagcactcctatgacctgggt

SEQ ID NO: 537727 - DNA, 25 bp, Homo sapien
agcactcctatgacctgggtccctg

SEQ ID NO: 537728 - DNA, 25 bp, Homo sapien
tgccacaacctgcaggcagccctgg

SEQ ID NO: 537729 - DNA, 25 bp, Homo sapien
gggatgggatcaccttccagaccac

SEQ ID NO: 537730 - DNA, 25 bp, Homo sapien
gatgggatcaccttccagaccacag

SEQ ID NO: 537731 - DNA, 25 bp, Homo sapien
ggatcaccttccagaccacagcaga

SEQ ID NO: 537732 - DNA, 25 bp, Homo sapien
gtgagctgctcacaactgggtcaac

SEQ ID NO: 537733 - DNA, 25 bp, Homo sapien
ctgggtcaacgctttaggctgagtc

SEQ ID NO: 537734 - DNA, 25 bp, Homo sapien
ttaggctgagtcactcctcgggtct

SEQ ID NO: 537735 - DNA, 25 bp, Homo sapien
gtctctccataattcagcccaacaa

SEQ ID NO: 537736 - DNA, 25 bp, Homo sapien
ggtttatttcaatcagctctgacac

SEQ ID NO: 537737 - DNA, 25 bp, Homo sapien
gacacttgtttagacgattggccat

SEQ ID NO: 537738 - DNA, 25 bp, Homo sapien
gacgattggccattctaaagttggt

SEQ ID NO: 537739 - DNA, 25 bp, Homo sapien
gagtttgtcaagcaactatcgactt

SEQ ID NO: 537740 - DNA, 25 bp, Homo sapien
ctatcgacttgatcagttcagccaa

SEQ ID NO: 537741 - DNA, 25 bp, Homo sapien
atcaaaaacccacttgtcagttcag

SEQ ID NO: 537742 - DNA, 25 bp, Homo sapien
ggcaggacaatctgcttgtgtctcc

SEQ ID NO: 537743 - DNA, 25 bp, Homo sapien
tagtttcaagaaggacttagctcag

SEQ ID NO: 537744 - DNA, 25 bp, Homo sapien
tgtggttctcagctttgatgcctac

SEQ ID NO: 537745 - DNA, 25 bp, Homo sapien
ggttctcagctttgatgcctacaga

SEQ ID NO: 537746 - DNA, 25 bp, Homo sapien
ctcagctttgatgcctacagagatt

SEQ ID NO: 537747 - DNA, 25 bp, Homo sapien
gctttgatgcctacagagattctga

SEQ ID NO: 537748 - DNA, 25 bp, Homo sapien
tttgatgcctacagagattctgatt

SEQ ID NO: 537749 - DNA, 25 bp, Homo sapien
gattctgatttaaattgctggagga

SEQ ID NO: 537750 - DNA, 25 bp, Homo sapien
gcatacattttttaagtttcccaag

SEQ ID NO: 537751 - DNA, 25 bp, Homo sapien
tttaagtttcccaagtgattctaat

SEQ ID NO: 537752 - DNA, 25 bp, Homo sapien
gtttcccaagtgattctaatttaca

SEQ ID NO: 537753 - DNA, 25 bp, Homo sapien
ttacatctagggttaaaaacagcca

SEQ ID NO: 537754 - DNA, 25 bp, Homo sapien
tgggtccctgccacaacctgcaggc

SEQ ID NO: 537755 - DNA, 25 bp, Homo sapien
gggtccctgccacaacctgcaggca

SEQ ID NO: 537756 - DNA, 25 bp, Homo sapien
ctgccacaacctgcaggcagccctg

SEQ ID NO: 537757 - DNA, 25 bp, Homo sapien
cattgcctggggatgggatcacctt

SEQ ID NO: 537758 - DNA, 25 bp, Homo sapien
gggatgggatcaccttccagaccac

SEQ ID NO: 537759 - DNA, 25 bp, Homo sapien
ggatgggatcaccttccagaccaca

SEQ ID NO: 537760 - DNA, 25 bp, Homo sapien
gatgggatcaccttccagaccacag

SEQ ID NO: 537761 - DNA, 25 bp, Homo sapien
atgggatcaccttccagaccacagc

SEQ ID NO: 537762 - DNA, 25 bp, Homo sapien
tgggatcaccttccagaccacagca

SEQ ID NO: 537763 - DNA, 25 bp, Homo sapien
gggatcaccttccagaccacagcag

SEQ ID NO: 537764 - DNA, 25 bp, Homo sapien
ggatcaccttccagaccacagcaga

SEQ ID NO: 537765 - DNA, 25 bp, Homo sapien
gctgttgagtagagaaccttctgca

SEQ ID NO: 537766 - DNA, 25 bp, Homo sapien
agtccgcttagcatcaggcacattt

SEQ ID NO: 537767 - DNA, 25 bp, Homo sapien
gaaatgaattcccaacagaaggcta

SEQ ID NO: 537768 - DNA, 25 bp, Homo sapien
gaaggctataatccatgatcttgaa

SEQ ID NO: 537769 - DNA, 25 bp, Homo sapien
gatcttgaagctttctagcacccgg

SEQ ID NO: 537770 - DNA, 25 bp, Homo sapien
acccggcagtctctctgaagtgttt

SEQ ID NO: 537771 - DNA, 25 bp, Homo sapien
gaagtgttttcataagcgcgttgta

SEQ ID NO: 537772 - DNA, 25 bp, Homo sapien
agcgcgttgtatgtttccgtatcaa

SEQ ID NO: 537773 - DNA, 25 bp, Homo sapien
gtatcaaaatacaacccttcgtgca

SEQ ID NO: 537774 - DNA, 25 bp, Homo sapien
acccttcgtgcatgtcttgcaggaa

SEQ ID NO: 537775 - DNA, 25 bp, Homo sapien
ttctctctctctttacgggatgctc

SEQ ID NO: 537776 - DNA, 25 bp, Homo sapien
atcctcaaccgatgactactaagaa

SEQ ID NO: 537777 - DNA, 25 bp, Homo sapien
ggtgtataaacacccagacccctca

SEQ ID NO: 537778 - DNA, 25 bp, Homo sapien
agacccctcactcttggaagcatac

SEQ ID NO: 537779 - DNA, 25 bp, Homo sapien
ttggaagcatacattctaccccatg

SEQ ID NO: 537780 - DNA, 25 bp, Homo sapien
attctaccccatgttgcagagtttc

SEQ ID NO: 537781 - DNA, 25 bp, Homo sapien
atgttgcagagtttccccagcagga

SEQ ID NO: 537782 - DNA, 25 bp, Homo sapien
tccccagcaggaatgaagctcaact

SEQ ID NO: 537783 - DNA, 25 bp, Homo sapien
gaagctcaactcatacatcaaaata

SEQ ID NO: 537784 - DNA, 25 bp, Homo sapien
gtgagggatgaattcttgctgtctt

SEQ ID NO: 537785 - DNA, 25 bp, Homo sapien
cattcaaatttcatctcattgccca

SEQ ID NO: 537786 - DNA, 25 bp, Homo sapien
tctcattgcccacttttcgggagaa

SEQ ID NO: 537787 - DNA, 25 bp, Homo sapien
acactaggtatcatcacttatcaaa

SEQ ID NO: 537788 - DNA, 25 bp, Homo sapien
atcacttatcaaatctttcccaatt

SEQ ID NO: 537789 - DNA, 25 bp, Homo sapien
aaatctttcccaatttggtagctgg

SEQ ID NO: 537790 - DNA, 25 bp, Homo sapien
ccaatttggtagctgggataatagt

SEQ ID NO: 537791 - DNA, 25 bp, Homo sapien
gtagctgggataatagtatgtcaat

SEQ ID NO: 537792 - DNA, 25 bp, Homo sapien
tttctttgattcttcgcgaataaca

SEQ ID NO: 537793 - DNA, 25 bp, Homo sapien
tgattcttcgcgaataacattttca

SEQ ID NO: 537794 - DNA, 25 bp, Homo sapien
aatgctgcaaatatgctttccaagt

SEQ ID NO: 537795 - DNA, 25 bp, Homo sapien
aatatgctttccaagtgctttgctt

SEQ ID NO: 537796 - DNA, 25 bp, Homo sapien
agtgctttgctttcaaattttgttt

SEQ ID NO: 537797 - DNA, 25 bp, Homo sapien
ggtgctttttgacatacataaattc

SEQ ID NO: 537798 - DNA, 25 bp, Homo sapien
ggcttctctgatcttgccatgcaag

SEQ ID NO: 537799 - DNA, 25 bp, Homo sapien
gccatgcaagtaatgacgtctccat

SEQ ID NO: 537800 - DNA, 25 bp, Homo sapien
gacgtctccatctaagaactacatt

SEQ ID NO: 537801 - DNA, 25 bp, Homo sapien
gaactacattctctctgtgatcagt

SEQ ID NO: 537802 - DNA, 25 bp, Homo sapien
ctctgtgatcagtgggagcatctgt

SEQ ID NO: 537803 - DNA, 25 bp, Homo sapien
agtgggagcatctgtatattgttcc

SEQ ID NO: 537804 - DNA, 25 bp, Homo sapien
gtatattgttcctgattggcctgat

SEQ ID NO: 537805 - DNA, 25 bp, Homo sapien
attgttcctgattggcctgatgtgt

SEQ ID NO: 537806 - DNA, 25 bp, Homo sapien
gcctgatgtgtggacggatcaccaa

SEQ ID NO: 537807 - DNA, 25 bp, Homo sapien
ggacggatcaccaagcgagtgacac

SEQ ID NO: 537808 - DNA, 25 bp, Homo sapien
cgagtgacacgagagctcaaggaca

SEQ ID NO: 537809 - DNA, 25 bp, Homo sapien
taagagaaatgtcatttgtttttgt

SEQ ID NO: 537810 - DNA, 25 bp, Homo sapien
aagagaaatgtcatttgtttttgtt

SEQ ID NO: 537811 - DNA, 25 bp, Homo sapien
ccaaatagctgggagaaatgtcctg

SEQ ID NO: 537812 - DNA, 25 bp, Homo sapien
ctgggagaaatgtcctgtttttaat

SEQ ID NO: 537813 - DNA, 25 bp, Homo sapien
gggagaaatgtcctgtttttaatga

SEQ ID NO: 537814 - DNA, 25 bp, Homo sapien
ggagaaatgtcctgtttttaatgaa

SEQ ID NO: 537815 - DNA, 25 bp, Homo sapien
gagaaatgtcctgtttttaatgaat

SEQ ID NO: 537816 - DNA, 25 bp, Homo sapien
atgtcctgtttttaatgaatttgtc

SEQ ID NO: 537817 - DNA, 25 bp, Homo sapien
tttgtcttcctttttgtcttgtttg

SEQ ID NO: 537818 - DNA, 25 bp, Homo sapien
ttgtcttcctttttgtcttgtttgt

SEQ ID NO: 537819 - DNA, 25 bp, Homo sapien
tgtcttcctttttgtcttgtttgtt

SEQ ID NO: 537820 - DNA, 25 bp, Homo sapien
tcagattaacaattgcacacagtgc

SEQ ID NO: 537821 - DNA, 25 bp, Homo sapien
acacagtgcttgaaatttagaggta

SEQ ID NO: 537822 - DNA, 25 bp, Homo sapien
gaaatttagaggtatttcacctgaa

SEQ ID NO: 537823 - DNA, 25 bp, Homo sapien
atttcacctgaaaagatgtctagag

SEQ ID NO: 537824 - DNA, 25 bp, Homo sapien
ttgaaagaaaacatgctgggcatat

SEQ ID NO: 537825 - DNA, 25 bp, Homo sapien
acatgctgggcatatgatttgaaaa

SEQ ID NO: 537826 - DNA, 25 bp, Homo sapien
ttctatcttttctggcacctagata

SEQ ID NO: 537827 - DNA, 25 bp, Homo sapien
cttttctggcacctagatataccat

SEQ ID NO: 537828 - DNA, 25 bp, Homo sapien
ttttaagccctggaaaatcttgatt

SEQ ID NO: 537829 - DNA, 25 bp, Homo sapien
aaagaggacatttcagtattgcaaa

SEQ ID NO: 537830 - DNA, 25 bp, Homo sapien
atgcatggtatttgtgtaacattgt

SEQ ID NO: 537831 - DNA, 25 bp, Homo sapien
catttttggcatttaccttcgtggt

SEQ ID NO: 537832 - DNA, 25 bp, Homo sapien
tttttggcatttaccttcgtggttg

SEQ ID NO: 537833 - DNA, 25 bp, Homo sapien
tttggcatttaccttcgtggttgag

SEQ ID NO: 537834 - DNA, 25 bp, Homo sapien
tggcatttaccttcgtggttgagac

SEQ ID NO: 537835 - DNA, 25 bp, Homo sapien
gcatttaccttcgtggttgagactg

SEQ ID NO: 537836 - DNA, 25 bp, Homo sapien
tttaccttcgtggttgagactgctg

SEQ ID NO: 537837 - DNA, 25 bp, Homo sapien
taccttcgtggttgagactgctgtc

SEQ ID NO: 537838 - DNA, 25 bp, Homo sapien
accttcgtggttgagactgctgtct

SEQ ID NO: 537839 - DNA, 25 bp, Homo sapien
cttcgtggttgagactgctgtctgt

SEQ ID NO: 537840 - DNA, 25 bp, Homo sapien
tcgtggttgagactgctgtctgtat

SEQ ID NO: 537841 - DNA, 25 bp, Homo sapien
ctgctgtctgtatgtctgggaatgg

SEQ ID NO: 537842 - DNA, 25 bp, Homo sapien
atcctgcacttcagactatttgtcg

SEQ ID NO: 537843 - DNA, 25 bp, Homo sapien
gactatttgtcggagcacggatcta

SEQ ID NO: 537844 - DNA, 25 bp, Homo sapien
atttgtcggagcacggatctaccac

SEQ ID NO: 537845 - DNA, 25 bp, Homo sapien
gatctaccacaccattgcatatttg

SEQ ID NO: 537846 - DNA, 25 bp, Homo sapien
accacaccattgcatatttgacacc

SEQ ID NO: 537847 - DNA, 25 bp, Homo sapien
accattgcatatttgacaccccttc

SEQ ID NO: 537848 - DNA, 25 bp, Homo sapien
ttccccagccaaatagagctttgag

SEQ ID NO: 537849 - DNA, 25 bp, Homo sapien
tttgttggatatggagttactcttt

SEQ ID NO: 537850 - DNA, 25 bp, Homo sapien
gagttactctttccatggcttacag

SEQ ID NO: 537851 - DNA, 25 bp, Homo sapien
tctttccatggcttacaggttgctg

SEQ ID NO: 537852 - DNA, 25 bp, Homo sapien
tccatggcttacaggttgctgaaaa

SEQ ID NO: 537853 - DNA, 25 bp, Homo sapien
cctttccctcattcctgttgttatt

SEQ ID NO: 537854 - DNA, 25 bp, Homo sapien
taggcttttccgttagttctcaagg

SEQ ID NO: 537855 - DNA, 25 bp, Homo sapien
tccgttagttctcaaggatcctctt

SEQ ID NO: 537856 - DNA, 25 bp, Homo sapien
ggatcctcttttggctcttgggaaa

SEQ ID NO: 537857 - DNA, 25 bp, Homo sapien
cttgggaaagaattgtacctgtaca

SEQ ID NO: 537858 - DNA, 25 bp, Homo sapien
tagaatgcgaactgctttgcctcat

SEQ ID NO: 537859 - DNA, 25 bp, Homo sapien
tttgcctcattccatactgatcatc

SEQ ID NO: 537860 - DNA, 25 bp, Homo sapien
attccatactgatcatcccagctga

SEQ ID NO: 537861 - DNA, 25 bp, Homo sapien
gatcatcccagctgaacaatttgaa

SEQ ID NO: 537862 - DNA, 25 bp, Homo sapien
aaactgttctgcctttttgttacat

SEQ ID NO: 537863 - DNA, 25 bp, Homo sapien
gcctttttgttacatgaatctgtca

SEQ ID NO: 537864 - DNA, 25 bp, Homo sapien
ggttatatgttccatttaatgtgac

SEQ ID NO: 537865 - DNA, 25 bp, Homo sapien
gaatcagagtcctttgcagagtgtg

SEQ ID NO: 537866 - DNA, 25 bp, Homo sapien
tcctttgcagagtgtgacagacgac

SEQ ID NO: 537867 - DNA, 25 bp, Homo sapien
gacagacgactcaataacctcattt

SEQ ID NO: 537868 - DNA, 25 bp, Homo sapien
gactcaataacctcatttgtttcta

SEQ ID NO: 537869 - DNA, 25 bp, Homo sapien
agtgcctaaatctgtgctttcgtat

SEQ ID NO: 537870 - DNA, 25 bp, Homo sapien
gtgctttcgtatagagtaacatgat

SEQ ID NO: 537871 - DNA, 25 bp, Homo sapien
atgatgtgctactgttgatgtctga

SEQ ID NO: 537872 - DNA, 25 bp, Homo sapien
gttgatgtctgattttgccgttcat

SEQ ID NO: 537873 - DNA, 25 bp, Homo sapien
ttgccgttcatgttagagcctactg

SEQ ID NO: 537874 - DNA, 25 bp, Homo sapien
tgggaaaaaccctcaattgtgattt

SEQ ID NO: 537875 - DNA, 25 bp, Homo sapien
aaaggcacatgaggaccacggtttg

SEQ ID NO: 537876 - DNA, 25 bp, Homo sapien
ggaccacggtttgcctcagtttctg

SEQ ID NO: 537877 - DNA, 25 bp, Homo sapien
acaaggtctggagtgcccctgcaaa

SEQ ID NO: 537878 - DNA, 25 bp, Homo sapien
aagggtattgatggacttcctgcca

SEQ ID NO: 537879 - DNA, 25 bp, Homo sapien
ggacttcctgccagtgacagagcat

SEQ ID NO: 537880 - DNA, 25 bp, Homo sapien
gacagagcatgtctattgcaaacaa

SEQ ID NO: 537881 - DNA, 25 bp, Homo sapien
aattctctcagttacgttcagcact

SEQ ID NO: 537882 - DNA, 25 bp, Homo sapien
ataggatctttagcaactttttcac

SEQ ID NO: 537883 - DNA, 25 bp, Homo sapien
acatcatagaaggtgcaatcgctca

SEQ ID NO: 537884 - DNA, 25 bp, Homo sapien
aatcgctcacttgggaacactactg

SEQ ID NO: 537885 - DNA, 25 bp, Homo sapien
aacactactgagagtgacttctctt

SEQ ID NO: 537886 - DNA, 25 bp, Homo sapien
ctgctgaccagctaaacaccaattt

SEQ ID NO: 537887 - DNA, 25 bp, Homo sapien
cagctaaacaccaatttcttcctgc

SEQ ID NO: 537888 - DNA, 25 bp, Homo sapien
tctccacttggtttggaaaatcaca

SEQ ID NO: 537889 - DNA, 25 bp, Homo sapien
aaatcacacagttttcaggctccat

SEQ ID NO: 537890 - DNA, 25 bp, Homo sapien
ttcaggctccatctgtttggagaaa

SEQ ID NO: 537891 - DNA, 25 bp, Homo sapien
tacattctgaagcatccccaattca

SEQ ID NO: 537892 - DNA, 25 bp, Homo sapien
gcatccccaattcaccttctaaaaa

SEQ ID NO: 537893 - DNA, 25 bp, Homo sapien
ccttctaaaaactcatgtgcaggtt

SEQ ID NO: 537894 - DNA, 25 bp, Homo sapien
tgtgcaggtttgataaacaccagaa

SEQ ID NO: 537895 - DNA, 25 bp, Homo sapien
attcacttttttcatgacctagaaa

SEQ ID NO: 537896 - DNA, 25 bp, Homo sapien
aacattccagtgttcaactgtttta

SEQ ID NO: 537897 - DNA, 25 bp, Homo sapien
tggttggccatttctggttcttcaa

SEQ ID NO: 537898 - DNA, 25 bp, Homo sapien
ttctggttcttcaaattgcacatag

SEQ ID NO: 537899 - DNA, 25 bp, Homo sapien
aaattgcacataggcttcccctgtt

SEQ ID NO: 537900 - DNA, 25 bp, Homo sapien
ctccctctatagtccatcacaaaag

SEQ ID NO: 537901 - DNA, 25 bp, Homo sapien
agaagtctacaatgtctttctcatt

SEQ ID NO: 537902 - DNA, 25 bp, Homo sapien
atgtctttctcattgcaactataag

SEQ ID NO: 537903 - DNA, 25 bp, Homo sapien
aggaagtcctctcaaacgaaccaca

SEQ ID NO: 537904 - DNA, 25 bp, Homo sapien
tttaccacaggcgaagatttgacct

SEQ ID NO: 537905 - DNA, 25 bp, Homo sapien
gcatccacatcttcattgtttatct

SEQ ID NO: 537906 - DNA, 25 bp, Homo sapien
tggcccatgtacatgcggtgcttct

SEQ ID NO: 537907 - DNA, 25 bp, Homo sapien
gtacatgcggtgcttctctaaggct

SEQ ID NO: 537908 - DNA, 25 bp, Homo sapien
gtagagagcgcatcctttttgatct

SEQ ID NO: 537909 - DNA, 25 bp, Homo sapien
atcctttttgatctcctgggcggag

SEQ ID NO: 537910 - DNA, 25 bp, Homo sapien
tctcctgggcggagtgaacctgcag

SEQ ID NO: 537911 - DNA, 25 bp, Homo sapien
gccaccccagaaaccttggttctga

SEQ ID NO: 537912 - DNA, 25 bp, Homo sapien
cttggttctgatgcactgcaagcaa

SEQ ID NO: 537913 - DNA, 25 bp, Homo sapien
gcaagcaagtaaccagcttctcact

SEQ ID NO: 537914 - DNA, 25 bp, Homo sapien
ttctcactccagtttcaagtggcta

SEQ ID NO: 537915 - DNA, 25 bp, Homo sapien
gttgcccactgacatgttaccagaa

SEQ ID NO: 537916 - DNA, 25 bp, Homo sapien
gttaccagaagttgtaccatgatgt

SEQ ID NO: 537917 - DNA, 25 bp, Homo sapien
catgatgttgttttgacccctgtga

SEQ ID NO: 537918 - DNA, 25 bp, Homo sapien
ggccctgctctgtgcacatttctgt

SEQ ID NO: 537919 - DNA, 25 bp, Homo sapien
agtggcacagttctctgcaacctca

SEQ ID NO: 537920 - DNA, 25 bp, Homo sapien
gtggcacagttctctgcaacctcag

SEQ ID NO: 537921 - DNA, 25 bp, Homo sapien
tggcacagttctctgcaacctcagc

SEQ ID NO: 537922 - DNA, 25 bp, Homo sapien
gcacagttctctgcaacctcagcct

SEQ ID NO: 537923 - DNA, 25 bp, Homo sapien
aatctacaaaaacaggataggcatt

SEQ ID NO: 537924 - DNA, 25 bp, Homo sapien
atctacaaaaacaggataggcattg

SEQ ID NO: 537925 - DNA, 25 bp, Homo sapien
tctacaaaaacaggataggcattgt

SEQ ID NO: 537926 - DNA, 25 bp, Homo sapien
cctcagcctttgggctcaaatgacc

SEQ ID NO: 537927 - DNA, 25 bp, Homo sapien
caaccctcaatcagagctacttaca

SEQ ID NO: 537928 - DNA, 25 bp, Homo sapien
gctacttacagccaggcaggatggg

SEQ ID NO: 537929 - DNA, 25 bp, Homo sapien
gggctttccccaaagcaattggccg

SEQ ID NO: 537930 - DNA, 25 bp, Homo sapien
aagcaattggccgtttgtccagtgg

SEQ ID NO: 537931 - DNA, 25 bp, Homo sapien
attggccgtttgtccagtggcagac

SEQ ID NO: 537932 - DNA, 25 bp, Homo sapien
aatggtggctacagcctttgtgctt

SEQ ID NO: 537933 - DNA, 25 bp, Homo sapien
ctttgtgcttttaagagtgggctgg

SEQ ID NO: 537934 - DNA, 25 bp, Homo sapien
gggcttggctttgtcagaacttgta

SEQ ID NO: 537935 - DNA, 25 bp, Homo sapien
gaacttgtacaatcttcttttgatg

SEQ ID NO: 537936 - DNA, 25 bp, Homo sapien
gaaattatctgaactcaacatctag

SEQ ID NO: 537937 - DNA, 25 bp, Homo sapien
tctgaactcaacatctagcacatag

SEQ ID NO: 537938 - DNA, 25 bp, Homo sapien
aagatgcccatgctgaccctgaaat

SEQ ID NO: 537939 - DNA, 25 bp, Homo sapien
tgcccatgctgaccctgaaatccag

SEQ ID NO: 537940 - DNA, 25 bp, Homo sapien
tgatgcagaagaccacaagcctttg

SEQ ID NO: 537941 - DNA, 25 bp, Homo sapien
gcagaagaccacaagcctttgaaaa

SEQ ID NO: 537942 - DNA, 25 bp, Homo sapien
aggaagtcgaactccttcagacagg

SEQ ID NO: 537943 - DNA, 25 bp, Homo sapien
gaactccttcagacaggactgtgaa

SEQ ID NO: 537944 - DNA, 25 bp, Homo sapien
aaaagaagatagtgacgacagccta

SEQ ID NO: 537945 - DNA, 25 bp, Homo sapien
gggttaatggccagttcaatgagga

SEQ ID NO: 537946 - DNA, 25 bp, Homo sapien
gatggctcctttattggacaataca

SEQ ID NO: 537947 - DNA, 25 bp, Homo sapien
gaaagagccggctgaaggaaacgaa

SEQ ID NO: 537948 - DNA, 25 bp, Homo sapien
aaacgaaagctcagaggcaccttct

SEQ ID NO: 537949 - DNA, 25 bp, Homo sapien
ttctttattctaagcagcaaacatt

SEQ ID NO: 537950 - DNA, 25 bp, Homo sapien
gtaaccatacactttattccacaaa

SEQ ID NO: 537951 - DNA, 25 bp, Homo sapien
tgttatttaacaagactgagggttt

SEQ ID NO: 537952 - DNA, 25 bp, Homo sapien
aatgactttgccttaacttttgtat

SEQ ID NO: 537953 - DNA, 25 bp, Homo sapien
gactttgccttaacttttgtataag

SEQ ID NO: 537954 - DNA, 25 bp, Homo sapien
gacagcttagagtccatggagcccg

SEQ ID NO: 537955 - DNA, 25 bp, Homo sapien
agcttagagtccatggagcccggcc

SEQ ID NO: 537956 - DNA, 25 bp, Homo sapien
gagcccggccctgggttggcgtgag

SEQ ID NO: 537957 - DNA, 25 bp, Homo sapien
ggtcagagttactcagttactgcgt

SEQ ID NO: 537958 - DNA, 25 bp, Homo sapien
tactcagttactgcgtggatctcct

SEQ ID NO: 537959 - DNA, 25 bp, Homo sapien
gtggatctcctgtcgctagttttac

SEQ ID NO: 537960 - DNA, 25 bp, Homo sapien
gatttcaaggtttgtgctgagctcc

SEQ ID NO: 537961 - DNA, 25 bp, Homo sapien
ttagggacagaattaccccagcctc

SEQ ID NO: 537962 - DNA, 25 bp, Homo sapien
aattaccccagcctcttgagctgaa

SEQ ID NO: 537963 - DNA, 25 bp, Homo sapien
agctgaagtaatgtgtgggccgcat

SEQ ID NO: 537964 - DNA, 25 bp, Homo sapien
tgtgggccgcatgcataaagtaagt

SEQ ID NO: 537965 - DNA, 25 bp, Homo sapien
gaagtgttgattgccaaattgacat

SEQ ID NO: 537966 - DNA, 25 bp, Homo sapien
aattgacatgttgtcacattctcat

SEQ ID NO: 537967 - DNA, 25 bp, Homo sapien
agttgttaagagacataccctctaa

SEQ ID NO: 537968 - DNA, 25 bp, Homo sapien
gaactttagcatggtattgaaggaa

SEQ ID NO: 537969 - DNA, 25 bp, Homo sapien
gtgctttttatgtatgttgtcttct

SEQ ID NO: 537970 - DNA, 25 bp, Homo sapien
atgtatgttgtcttcttcaatactg

SEQ ID NO: 537971 - DNA, 25 bp, Homo sapien
gcagttactactgtggtgttctaat

SEQ ID NO: 537972 - DNA, 25 bp, Homo sapien
ctactgtggtgttctaatggtgatt

SEQ ID NO: 537973 - DNA, 25 bp, Homo sapien
cactatgctaaggtggtgtctgcta

SEQ ID NO: 537974 - DNA, 25 bp, Homo sapien
ttctatttctctcaatccttctaca

SEQ ID NO: 537975 - DNA, 25 bp, Homo sapien
atttctctcaatccttctacattta

SEQ ID NO: 537976 - DNA, 25 bp, Homo sapien
aaggaagagttgtcagttctggatt

SEQ ID NO: 537977 - DNA, 25 bp, Homo sapien
gtgtctgctaggattcgctactgta

SEQ ID NO: 537978 - DNA, 25 bp, Homo sapien
ggattcgctactgtaaacttactgt

SEQ ID NO: 537979 - DNA, 25 bp, Homo sapien
ctgtaaacttactgtgttttccttg

SEQ ID NO: 537980 - DNA, 25 bp, Homo sapien
gtgttttccttgtaattattgaata

SEQ ID NO: 537981 - DNA, 25 bp, Homo sapien
ttattgaatatttgctggagatacc

SEQ ID NO: 537982 - DNA, 25 bp, Homo sapien
tacctttaagtgtccctagattcaa

SEQ ID NO: 537983 - DNA, 25 bp, Homo sapien
cttcccgcctgttctgcggtgggta

SEQ ID NO: 537984 - DNA, 25 bp, Homo sapien
taatgttcctgtgctaaccttcgtg

SEQ ID NO: 537985 - DNA, 25 bp, Homo sapien
taaccttcgtgtctctgtgacatga

SEQ ID NO: 537986 - DNA, 25 bp, Homo sapien
tgtctctgtgacatgactgttgaaa

SEQ ID NO: 537987 - DNA, 25 bp, Homo sapien
gagtgcggaatctttggagttttaa

SEQ ID NO: 537988 - DNA, 25 bp, Homo sapien
ggagttttaagcttgccaactgtgc

SEQ ID NO: 537989 - DNA, 25 bp, Homo sapien
taagcttgccaactgtgcggcctag

SEQ ID NO: 537990 - DNA, 25 bp, Homo sapien
tgcggcctagcagaatcctgggaga

SEQ ID NO: 537991 - DNA, 25 bp, Homo sapien
tcctgggagacggaaggacagccaa

SEQ ID NO: 537992 - DNA, 25 bp, Homo sapien
cagccaagaggctaggatttacctt

SEQ ID NO: 537993 - DNA, 25 bp, Homo sapien
gaggcagcatgccttgctggttaaa

SEQ ID NO: 537994 - DNA, 25 bp, Homo sapien
gcatgccttgctggttaaaacctta

SEQ ID NO: 537995 - DNA, 25 bp, Homo sapien
aattacctgttgttttattcctgct

SEQ ID NO: 537996 - DNA, 25 bp, Homo sapien
tacctgttgttttattcctgctctg

SEQ ID NO: 537997 - DNA, 25 bp, Homo sapien
cctgttgttttattcctgctctgtt

SEQ ID NO: 537998 - DNA, 25 bp, Homo sapien
tattcctgctctgttgaatgtccac

SEQ ID NO: 537999 - DNA, 25 bp, Homo sapien
gctggttaaaaccttaggctcataa

SEQ ID NO: 538000 - DNA, 25 bp, Homo sapien
cttaggctcataagtcagaccactt

SEQ ID NO: 538001 - DNA, 25 bp, Homo sapien
ggctcataagtcagaccacttacat

SEQ ID NO: 538002 - DNA, 25 bp, Homo sapien
agcctcatcacttggtgcttatgtg

SEQ ID NO: 538003 - DNA, 25 bp, Homo sapien
cacttggtgcttatgtgaccctcag

SEQ ID NO: 538004 - DNA, 25 bp, Homo sapien
aaaattctgatttagggctaggtgt

SEQ ID NO: 538005 - DNA, 25 bp, Homo sapien
aattctgatttagggctaggtgtgg

SEQ ID NO: 538006 - DNA, 25 bp, Homo sapien
tagcgagacccctatctgtattaaa

SEQ ID NO: 538007 - DNA, 25 bp, Homo sapien
gcgagacccctatctgtattaaaaa

SEQ ID NO: 538008 - DNA, 25 bp, Homo sapien
attcctgaagtaaaggtttgcacct

SEQ ID NO: 538009 - DNA, 25 bp, Homo sapien
tgaagtaaaggtttgcacctattaa

SEQ ID NO: 538010 - DNA, 25 bp, Homo sapien
agacattcttaacagggcggcagtc

SEQ ID NO: 538011 - DNA, 25 bp, Homo sapien
acattcttaacagggcggcagtcta

SEQ ID NO: 538012 - DNA, 25 bp, Homo sapien
acagggcggcagtctagtgttgaaa

SEQ ID NO: 538013 - DNA, 25 bp, Homo sapien
ggcggcagtctagtgttgaaagttt

SEQ ID NO: 538014 - DNA, 25 bp, Homo sapien
ggcagtctagtgttgaaagttttat

SEQ ID NO: 538015 - DNA, 25 bp, Homo sapien
gcctgtggcctttgtcgagtcactg

SEQ ID NO: 538016 - DNA, 25 bp, Homo sapien
cctgtggcctttgtcgagtcactgc

SEQ ID NO: 538017 - DNA, 25 bp, Homo sapien
ctgtggcctttgtcgagtcactgcc

SEQ ID NO: 538018 - DNA, 25 bp, Homo sapien
tgtggcctttgtcgagtcactgccc

SEQ ID NO: 538019 - DNA, 25 bp, Homo sapien
gtggcctttgtcgagtcactgccct

SEQ ID NO: 538020 - DNA, 25 bp, Homo sapien
tggcctttgtcgagtcactgccctt

SEQ ID NO: 538021 - DNA, 25 bp, Homo sapien
ggcctttgtcgagtcactgcccttc

SEQ ID NO: 538022 - DNA, 25 bp, Homo sapien
gcctttgtcgagtcactgcccttct

SEQ ID NO: 538023 - DNA, 25 bp, Homo sapien
tgatggttggatgaatccctttctg

SEQ ID NO: 538024 - DNA, 25 bp, Homo sapien
ctttctgaagaagcttggtacaaga

SEQ ID NO: 538025 - DNA, 25 bp, Homo sapien
gagggagccagcaatgatgactact

SEQ ID NO: 538026 - DNA, 25 bp, Homo sapien
tgactactgatgtggtgccatctcc

SEQ ID NO: 538027 - DNA, 25 bp, Homo sapien
catctcctgcttctatatcttgagc

SEQ ID NO: 538028 - DNA, 25 bp, Homo sapien
tatcttgagccttagacagctccac

SEQ ID NO: 538029 - DNA, 25 bp, Homo sapien
gcattctggctgctggatgtaatac

SEQ ID NO: 538030 - DNA, 25 bp, Homo sapien
taacaaagtttctctgtcactcagt

SEQ ID NO: 538031 - DNA, 25 bp, Homo sapien
tgtcactcagttccacaggtcgaga

SEQ ID NO: 538032 - DNA, 25 bp, Homo sapien
ccacaggtcgagacatgtcagtcaa

SEQ ID NO: 538033 - DNA, 25 bp, Homo sapien
gtcagtcaagatttcaatgcccttt

SEQ ID NO: 538034 - DNA, 25 bp, Homo sapien
caagctctaggagttctgaacggaa

SEQ ID NO: 538035 - DNA, 25 bp, Homo sapien
gcagacgagaggcactttatccagt

SEQ ID NO: 538036 - DNA, 25 bp, Homo sapien
tttatccagtcccagaaagaatctc

SEQ ID NO: 538037 - DNA, 25 bp, Homo sapien
aaagaatctctaaccgtgtgactga

SEQ ID NO: 538038 - DNA, 25 bp, Homo sapien
aaccgtgtgactgagaagtcatcta

SEQ ID NO: 538039 - DNA, 25 bp, Homo sapien
gggcttaccagacctcacagagtat

SEQ ID NO: 538040 - DNA, 25 bp, Homo sapien
acctcacagagtattggacgtctac

SEQ ID NO: 538041 - DNA, 25 bp, Homo sapien
ggacgtctacaagtgcttttatatt

SEQ ID NO: 538042 - DNA, 25 bp, Homo sapien
agaagtttcatatgcacagaagagc

SEQ ID NO: 538043 - DNA, 25 bp, Homo sapien
gttggaaatctggtcgactgcaata

SEQ ID NO: 538044 - DNA, 25 bp, Homo sapien
gtacaaagatgttgcattcagacta

SEQ ID NO: 538045 - DNA, 25 bp, Homo sapien
ctctgctttaactacaaatatgtcg

SEQ ID NO: 538046 - DNA, 25 bp, Homo sapien
gtcatctttgtcaagtctgattgtt

SEQ ID NO: 538047 - DNA, 25 bp, Homo sapien
aagtctgattgttgagtatgtgaat

SEQ ID NO: 538048 - DNA, 25 bp, Homo sapien
gtatgtgaatggatgtttttggctc

SEQ ID NO: 538049 - DNA, 25 bp, Homo sapien
gaatggatgtttttggctcaatgtt

SEQ ID NO: 538050 - DNA, 25 bp, Homo sapien
ggatgtttttggctcaatgttagag

SEQ ID NO: 538051 - DNA, 25 bp, Homo sapien
gaagattttaacaattatgctctaa

SEQ ID NO: 538052 - DNA, 25 bp, Homo sapien
tatgctctaagatggaacatgacaa

SEQ ID NO: 538053 - DNA, 25 bp, Homo sapien
tgacaatttaggagtcactgggatc

SEQ ID NO: 538054 - DNA, 25 bp, Homo sapien
tttccaacgttactctgctttaact

SEQ ID NO: 538055 - DNA, 25 bp, Homo sapien
caacgttactctgctttaactacaa

SEQ ID NO: 538056 - DNA, 25 bp, Homo sapien
aaagcttcgggacacttacattgaa

SEQ ID NO: 538057 - DNA, 25 bp, Homo sapien
caattgcaagagcagtttgacaact

SEQ ID NO: 538058 - DNA, 25 bp, Homo sapien
gtttgacaacttaaatgctgcgcat

SEQ ID NO: 538059 - DNA, 25 bp, Homo sapien
aatgctgcgcatgaaacctctaagt

SEQ ID NO: 538060 - DNA, 25 bp, Homo sapien
gcgcatgaaacctctaagttggaaa

SEQ ID NO: 538061 - DNA, 25 bp, Homo sapien
ggaaattgaagctagccactcagag

SEQ ID NO: 538062 - DNA, 25 bp, Homo sapien
gccactcagagaaacttgaattgct

SEQ ID NO: 538063 - DNA, 25 bp, Homo sapien
aagaaggcctatgaagcctcccttt

SEQ ID NO: 538064 - DNA, 25 bp, Homo sapien
cctatgaagcctccctttcagaaat

SEQ ID NO: 538065 - DNA, 25 bp, Homo sapien
atcgcttgaagatttactttctgag

SEQ ID NO: 538066 - DNA, 25 bp, Homo sapien
gcaggaatcgctagagaagcaaatc

SEQ ID NO: 538067 - DNA, 25 bp, Homo sapien
tgggtccctcagaatatgactctct

SEQ ID NO: 538068 - DNA, 25 bp, Homo sapien
atgactctctgcctgaaaatagcga

SEQ ID NO: 538069 - DNA, 25 bp, Homo sapien
atgagtctcaaccagacagccagga

SEQ ID NO: 538070 - DNA, 25 bp, Homo sapien
tgctagtgacatgtatcttatatca

SEQ ID NO: 538071 - DNA, 25 bp, Homo sapien
gatggatagtgaccagtatgtgcca

SEQ ID NO: 538072 - DNA, 25 bp, Homo sapien
gtatgtgccaatcacaacggtggct

SEQ ID NO: 538073 - DNA, 25 bp, Homo sapien
aatcacaacggtggctaacctcgac

SEQ ID NO: 538074 - DNA, 25 bp, Homo sapien
ggctaacctcgaccacatcaagaag

SEQ ID NO: 538075 - DNA, 25 bp, Homo sapien
ctcgaccacatcaagaagctcagca

SEQ ID NO: 538076 - DNA, 25 bp, Homo sapien
tcagcactgatgtggacttgattgt

SEQ ID NO: 538077 - DNA, 25 bp, Homo sapien
gtggaagtgctaagatctttacctt

SEQ ID NO: 538078 - DNA, 25 bp, Homo sapien
atgcctgttttgtgaccttgattga

SEQ ID NO: 538079 - DNA, 25 bp, Homo sapien
ccttgattgagttgcttgggcttta

SEQ ID NO: 538080 - DNA, 25 bp, Homo sapien
ttgggctttacttctgcctacaaat

SEQ ID NO: 538081 - DNA, 25 bp, Homo sapien
ctcttggaggaaaggtgcttggacc

SEQ ID NO: 538082 - DNA, 25 bp, Homo sapien
tgcttggaccaagtctcaggtgtgt

SEQ ID NO: 538083 - DNA, 25 bp, Homo sapien
aagtctcaggtgtgtctgcctgtgg

SEQ ID NO: 538084 - DNA, 25 bp, Homo sapien
ggctgcacaggctctctaaccgaaa

SEQ ID NO: 538085 - DNA, 25 bp, Homo sapien
aaccgaaacctcactttcagagaga

SEQ ID NO: 538086 - DNA, 25 bp, Homo sapien
agatgtgggtcctttgtctccagga

SEQ ID NO: 538087 - DNA, 25 bp, Homo sapien
ggatccacaccctagattttaacac

SEQ ID NO: 538088 - DNA, 25 bp, Homo sapien
gattttaacactgcattctcactat

SEQ ID NO: 538089 - DNA, 25 bp, Homo sapien
tgactgtgttgctttttcccattta

SEQ ID NO: 538090 - DNA, 25 bp, Homo sapien
ttcccatttacacttggtgagtcat

SEQ ID NO: 538091 - DNA, 25 bp, Homo sapien
ggtgagtcatcaactctactgagat

SEQ ID NO: 538092 - DNA, 25 bp, Homo sapien
ctccaagcacctgctgtgattgggt

SEQ ID NO: 538093 - DNA, 25 bp, Homo sapien
ggtggcctgctctgatcagatagca

SEQ ID NO: 538094 - DNA, 25 bp, Homo sapien
gagtaaactcttcatgccatataca

SEQ ID NO: 538095 - DNA, 25 bp, Homo sapien
tcttcatgccatatacatcattttc

SEQ ID NO: 538096 - DNA, 25 bp, Homo sapien
atatgctttgtgaactcagatgtct

SEQ ID NO: 538097 - DNA, 25 bp, Homo sapien
tcagatgtctgtagccaggaagcca

SEQ ID NO: 538098 - DNA, 25 bp, Homo sapien
gaagccagggtgtgtaaatccaaaa

SEQ ID NO: 538099 - DNA, 25 bp, Homo sapien
gtgtgtaaatccaaaatctatgcag

SEQ ID NO: 538100 - DNA, 25 bp, Homo sapien
acaaaagctttgtctccgtcggtgt

SEQ ID NO: 538101 - DNA, 25 bp, Homo sapien
aaagctttgtctccgtcggtgtgca

SEQ ID NO: 538102 - DNA, 25 bp, Homo sapien
tgtctccgtcggtgtgcagcgagcc

SEQ ID NO: 538103 - DNA, 25 bp, Homo sapien
agccacaggcgcagggtccgcgagg

SEQ ID NO: 538104 - DNA, 25 bp, Homo sapien
tcggaacctgcgcgcacgctgagca

SEQ ID NO: 538105 - DNA, 25 bp, Homo sapien
tgagcagcccgaagggccgggtgca

SEQ ID NO: 538106 - DNA, 25 bp, Homo sapien
ccagacatcttagggagggttttat

SEQ ID NO: 538107 - DNA, 25 bp, Homo sapien
agggagggttttatgcttctgaatt

SEQ ID NO: 538108 - DNA, 25 bp, Homo sapien
tttctttcctccttaatttcatcac

SEQ ID NO: 538109 - DNA, 25 bp, Homo sapien
tttcctccttaatttcatcactcag

SEQ ID NO: 538110 - DNA, 25 bp, Homo sapien
tcatcactcaggaaatcaacaaaag

SEQ ID NO: 538111 - DNA, 25 bp, Homo sapien
gagctggtggcgactgagtccttct

SEQ ID NO: 538112 - DNA, 25 bp, Homo sapien
gactgagtccttctgtacgtgcaac

SEQ ID NO: 538113 - DNA, 25 bp, Homo sapien
agtccttctgtacgtgcaactggga

SEQ ID NO: 538114 - DNA, 25 bp, Homo sapien
ccttctgtacgtgcaactgggaaac

SEQ ID NO: 538115 - DNA, 25 bp, Homo sapien
tgtcctttgaggctaggcagctccc

SEQ ID NO: 538116 - DNA, 25 bp, Homo sapien
ttgaggctaggcagctccctgccct

SEQ ID NO: 538117 - DNA, 25 bp, Homo sapien
tgtagtggcagaccagcgtcacctt

SEQ ID NO: 538118 - DNA, 25 bp, Homo sapien
cagaccagcgtcacctttgaagtat

SEQ ID NO: 538119 - DNA, 25 bp, Homo sapien
cagcgtcacctttgaagtatacgtg

SEQ ID NO: 538120 - DNA, 25 bp, Homo sapien
acctttgaagtatacgtgagagaaa

SEQ ID NO: 538121 - DNA, 25 bp, Homo sapien
tatttacaaatgctttattctcttc

SEQ ID NO: 538122 - DNA, 25 bp, Homo sapien
gtttcagcagctggtacagtgccta

SEQ ID NO: 538123 - DNA, 25 bp, Homo sapien
agcagctggtacagtgcctaacaga

SEQ ID NO: 538124 - DNA, 25 bp, Homo sapien
ggtacagtgcctaacagagtttcat

SEQ ID NO: 538125 - DNA, 25 bp, Homo sapien
gcctaacagagtttcatgcagccct

SEQ ID NO: 538126 - DNA, 25 bp, Homo sapien
taacagagtttcatgcagccctggg

SEQ ID NO: 538127 - DNA, 25 bp, Homo sapien
gtcggggctcacttgaagcctgtca

SEQ ID NO: 538128 - DNA, 25 bp, Homo sapien
gtatctaacacaacgccaacagaag

SEQ ID NO: 538129 - DNA, 25 bp, Homo sapien
gccaacagaagcacatttgtcttcc

SEQ ID NO: 538130 - DNA, 25 bp, Homo sapien
aagacagacttaataatgtggcata

SEQ ID NO: 538131 - DNA, 25 bp, Homo sapien
atgtggcatattttctagatatcac

SEQ ID NO: 538132 - DNA, 25 bp, Homo sapien
agatatcacttttattaggttgaac

SEQ ID NO: 538133 - DNA, 25 bp, Homo sapien
gctgaaacaatgtcagggtcctcaa

SEQ ID NO: 538134 - DNA, 25 bp, Homo sapien
acaatgtcagggtcctcaagggtcc

SEQ ID NO: 538135 - DNA, 25 bp, Homo sapien
gtcagggtcctcaagggtcccattt

SEQ ID NO: 538136 - DNA, 25 bp, Homo sapien
ggtcccatttagacagacccacggc

SEQ ID NO: 538137 - DNA, 25 bp, Homo sapien
tagacagacccacggcttgtaacag

SEQ ID NO: 538138 - DNA, 25 bp, Homo sapien
gacccacggcttgtaacagtgcgct

SEQ ID NO: 538139 - DNA, 25 bp, Homo sapien
ctcaggaggcagcactagcgcatac

SEQ ID NO: 538140 - DNA, 25 bp, Homo sapien
aggaggcagcactagcgcataccca

SEQ ID NO: 538141 - DNA, 25 bp, Homo sapien
cacggacactgagttcctggtgaca

SEQ ID NO: 538142 - DNA, 25 bp, Homo sapien
ggacactgagttcctggtgacagct

SEQ ID NO: 538143 - DNA, 25 bp, Homo sapien
gagaggactgacgtggccctgtcat

SEQ ID NO: 538144 - DNA, 25 bp, Homo sapien
accacctggcgtgtagaatctccag

SEQ ID NO: 538145 - DNA, 25 bp, Homo sapien
agaatctccaggaagcctggctgca

SEQ ID NO: 538146 - DNA, 25 bp, Homo sapien
gcagcttcccatttggttacgaggt

SEQ ID NO: 538147 - DNA, 25 bp, Homo sapien
tgggctgtcttcatcatactccgca

SEQ ID NO: 538148 - DNA, 25 bp, Homo sapien
atcatactccgcagtcagactgggc

SEQ ID NO: 538149 - DNA, 25 bp, Homo sapien
tggtagtaagctgccggtggaacac

SEQ ID NO: 538150 - DNA, 25 bp, Homo sapien
ggtggaacacaatcatttgccctgg

SEQ ID NO: 538151 - DNA, 25 bp, Homo sapien
atttgccctgggtgtccttggtcct

SEQ ID NO: 538152 - DNA, 25 bp, Homo sapien
tggctctctgtagtggaggctcccc

SEQ ID NO: 538153 - DNA, 25 bp, Homo sapien
tggcccttaggatctccccatttgg

SEQ ID NO: 538154 - DNA, 25 bp, Homo sapien
tccccatttggagacagagccattt

SEQ ID NO: 538155 - DNA, 25 bp, Homo sapien
gggccatcctggaatgatactgact

SEQ ID NO: 538156 - DNA, 25 bp, Homo sapien
gatactgactgattaattattcctg

SEQ ID NO: 538157 - DNA, 25 bp, Homo sapien
attattcctgataacatctcaagaa

SEQ ID NO: 538158 - DNA, 25 bp, Homo sapien
aagtgtttctggagaatgttctttc

SEQ ID NO: 538159 - DNA, 25 bp, Homo sapien
tgttctttcacatcactggaatctg

SEQ ID NO: 538160 - DNA, 25 bp, Homo sapien
acatcactggaatctgcaattcaag

SEQ ID NO: 538161 - DNA, 25 bp, Homo sapien
aagggagaattcttgctttacctat

SEQ ID NO: 538162 - DNA, 25 bp, Homo sapien
ttacctatggactggcttaagccgt

SEQ ID NO: 538163 - DNA, 25 bp, Homo sapien
gcttaagccgtgtggcatccgagga

SEQ ID NO: 538164 - DNA, 25 bp, Homo sapien
gtgtggcatccgaggaatgtttcaa

SEQ ID NO: 538165 - DNA, 25 bp, Homo sapien
aattggatgcagtgtgggccatcct

SEQ ID NO: 538166 - DNA, 25 bp, Homo sapien
agatctcttctgacatcaattgttt

SEQ ID NO: 538167 - DNA, 25 bp, Homo sapien
ttcaaatcattgttgggctctgtcg

SEQ ID NO: 538168 - DNA, 25 bp, Homo sapien
ttgggctctgtcgtgttctgcaatc

SEQ ID NO: 538169 - DNA, 25 bp, Homo sapien
tgtcgtgttctgcaatcttccccat

SEQ ID NO: 538170 - DNA, 25 bp, Homo sapien
attcccctcatgatctctggcttat

SEQ ID NO: 538171 - DNA, 25 bp, Homo sapien
ggcttatcttttatccaatctgtat

SEQ ID NO: 538172 - DNA, 25 bp, Homo sapien
ccaatctgtatggactttttaggat

SEQ ID NO: 538173 - DNA, 25 bp, Homo sapien
aataattttcagatcccagctttgg

SEQ ID NO: 538174 - DNA, 25 bp, Homo sapien
gatcccagctttggtaaatgtgtta

SEQ ID NO: 538175 - DNA, 25 bp, Homo sapien
aaatgtgttaattctactttgtgaa

SEQ ID NO: 538176 - DNA, 25 bp, Homo sapien
aaatgagtgatctgctaaaaatggc

SEQ ID NO: 538177 - DNA, 25 bp, Homo sapien
gcttcggcagtagtggtgccttctc

SEQ ID NO: 538178 - DNA, 25 bp, Homo sapien
ttcatccttcttattagcttcagcc

SEQ ID NO: 538179 - DNA, 25 bp, Homo sapien
agcagcttggacatcatccttcttc

SEQ ID NO: 538180 - DNA, 25 bp, Homo sapien
ctttttccttgttatgtgtccacgg

SEQ ID NO: 538181 - DNA, 25 bp, Homo sapien
gtgtccacggaagctagcctgaatt

SEQ ID NO: 538182 - DNA, 25 bp, Homo sapien
cctgaattttggttgcggccttatg

SEQ ID NO: 538183 - DNA, 25 bp, Homo sapien
cggccttatgagctttatcttctgg

SEQ ID NO: 538184 - DNA, 25 bp, Homo sapien
tatcttctggtttgataccatcttg

SEQ ID NO: 538185 - DNA, 25 bp, Homo sapien
gttcaatcttttggtcgtcatcatt

SEQ ID NO: 538186 - DNA, 25 bp, Homo sapien
acagctaatgtcatacttgatggtg

SEQ ID NO: 538187 - DNA, 25 bp, Homo sapien
aaacatcgaatgtcgggaggagcca

SEQ ID NO: 538188 - DNA, 25 bp, Homo sapien
agttttatgtatcaccagactgggt

SEQ ID NO: 538189 - DNA, 25 bp, Homo sapien
tcaccagactgggttattgccaagt

SEQ ID NO: 538190 - DNA, 25 bp, Homo sapien
tgccaagttatatatcaccaaaagc

SEQ ID NO: 538191 - DNA, 25 bp, Homo sapien
aagctgtatgactggatgttctggt

SEQ ID NO: 538192 - DNA, 25 bp, Homo sapien
gatgttctggttacctggtttacaa

SEQ ID NO: 538193 - DNA, 25 bp, Homo sapien
gtactttgatatctctcagtgcttc

SEQ ID NO: 538194 - DNA, 25 bp, Homo sapien
gcttcagtgctatcattgtgagcaa

SEQ ID NO: 538195 - DNA, 25 bp, Homo sapien
gagcaattgtcttttatatacggta

SEQ ID NO: 538196 - DNA, 25 bp, Homo sapien
atacggtactgtagccatactaggc

SEQ ID NO: 538197 - DNA, 25 bp, Homo sapien
atactaggcctgtctgtggcattct

SEQ ID NO: 538198 - DNA, 25 bp, Homo sapien
ggcattctctagatgtttctttttt

SEQ ID NO: 538199 - DNA, 25 bp, Homo sapien
ttcctggctgtctggttgagactca

SEQ ID NO: 538200 - DNA, 25 bp, Homo sapien
tggttgagactcatttcctcctgtc

SEQ ID NO: 538201 - DNA, 25 bp, Homo sapien
atttcctcctgtctcgctattttca

SEQ ID NO: 538202 - DNA, 25 bp, Homo sapien
tcgctattttcaggcagagagtcat

SEQ ID NO: 538203 - DNA, 25 bp, Homo sapien
gagagtcatattctgagggacccag

SEQ ID NO: 538204 - DNA, 25 bp, Homo sapien
ggacccagagcgagagcgttcatgt

SEQ ID NO: 538205 - DNA, 25 bp, Homo sapien
agagcgagagcgttcatgtctgctg

SEQ ID NO: 538206 - DNA, 25 bp, Homo sapien
atgtctgctgggtccgactcctgcg

SEQ ID NO: 538207 - DNA, 25 bp, Homo sapien
ggtccgactcctgcgggtctggcaa

SEQ ID NO: 538208 - DNA, 25 bp, Homo sapien
tgcgggtctggcaatgcggcattct

SEQ ID NO: 538209 - DNA, 25 bp, Homo sapien
aatgcggcattctcatggccctggt

SEQ ID NO: 538210 - DNA, 25 bp, Homo sapien
tgacccagctggatgttgacagcca

SEQ ID NO: 538211 - DNA, 25 bp, Homo sapien
agctggatgttgacagccacctggc

SEQ ID NO: 538212 - DNA, 25 bp, Homo sapien
tggatgttgacagccacctggccca

SEQ ID NO: 538213 - DNA, 25 bp, Homo sapien
acctggcccagtgcttggccgaaag

SEQ ID NO: 538214 - DNA, 25 bp, Homo sapien
ggcccagtgcttggccgaaagcaca

SEQ ID NO: 538215 - DNA, 25 bp, Homo sapien
gaaagcacagaagacgtgacgtggt

SEQ ID NO: 538216 - DNA, 25 bp, Homo sapien
aagacgtgacgtggtgagcgccatc

SEQ ID NO: 538217 - DNA, 25 bp, Homo sapien
acgtgacgtggtgagcgccatccaa

SEQ ID NO: 538218 - DNA, 25 bp, Homo sapien
gtgacgtggtgagcgccatccaaga

SEQ ID NO: 538219 - DNA, 25 bp, Homo sapien
catccaagagccctgcgcagagtgc

SEQ ID NO: 538220 - DNA, 25 bp, Homo sapien
aaagcagggcgggctcctgtctgtc

SEQ ID NO: 538221 - DNA, 25 bp, Homo sapien
ggcacagtcattcagtcttaggtaa

SEQ ID NO: 538222 - DNA, 25 bp, Homo sapien
ggtaaataatgtactctcttaatat

SEQ ID NO: 538223 - DNA, 25 bp, Homo sapien
tatgttaatactcatgagaattggg

SEQ ID NO: 538224 - DNA, 25 bp, Homo sapien
tctgatgcatcaccatttgattggt

SEQ ID NO: 538225 - DNA, 25 bp, Homo sapien
atcaccatttgattggtagcaacag

SEQ ID NO: 538226 - DNA, 25 bp, Homo sapien
tttgattggtagcaacagtggttgt

SEQ ID NO: 538227 - DNA, 25 bp, Homo sapien
tagcaacagtggttgtaaaacttgg

SEQ ID NO: 538228 - DNA, 25 bp, Homo sapien
ggttgctgaattgagttgtttctat

SEQ ID NO: 538229 - DNA, 25 bp, Homo sapien
gaatcttgttagtgttgcaatctaa

SEQ ID NO: 538230 - DNA, 25 bp, Homo sapien
gttagtgttgcaatctaaatagaat

SEQ ID NO: 538231 - DNA, 25 bp, Homo sapien
acaggtgttaagacatatttatagt

SEQ ID NO: 538232 - DNA, 25 bp, Homo sapien
ggcaggtccagcatagttaggagtt

SEQ ID NO: 538233 - DNA, 25 bp, Homo sapien
tccagcatagttaggagttaggctt

SEQ ID NO: 538234 - DNA, 25 bp, Homo sapien
gagatcagagcagctcttcctgctg

SEQ ID NO: 538235 - DNA, 25 bp, Homo sapien
tgctggcccctgcaatcagttgttg

SEQ ID NO: 538236 - DNA, 25 bp, Homo sapien
ggcccctgcaatcagttgttgggat

SEQ ID NO: 538237 - DNA, 25 bp, Homo sapien
cccctgcaatcagttgttgggatgc

SEQ ID NO: 538238 - DNA, 25 bp, Homo sapien
gccagtgcagatcactaagtagtaa

SEQ ID NO: 538239 - DNA, 25 bp, Homo sapien
gattttaatcaaacacgaccaggtc

SEQ ID NO: 538240 - DNA, 25 bp, Homo sapien
acacgaccaggtccgaaatgcaggt

SEQ ID NO: 538241 - DNA, 25 bp, Homo sapien
ggtccgaaatgcaggtcatgagtgt

SEQ ID NO: 538242 - DNA, 25 bp, Homo sapien
gtatagacagtttaacatttggtat

SEQ ID NO: 538243 - DNA, 25 bp, Homo sapien
tatagatagacctgagaaggacagc

SEQ ID NO: 538244 - DNA, 25 bp, Homo sapien
ggacagccaggatagaattccattt

SEQ ID NO: 538245 - DNA, 25 bp, Homo sapien
agaattccatttgtgcctattccct

SEQ ID NO: 538246 - DNA, 25 bp, Homo sapien
ctaccagttggttattttctcattg

SEQ ID NO: 538247 - DNA, 25 bp, Homo sapien
tgatgtgttcactgcctagcctctc

SEQ ID NO: 538248 - DNA, 25 bp, Homo sapien
gacaagtgggctgactgatctgctc

SEQ ID NO: 538249 - DNA, 25 bp, Homo sapien
tgggctgactgatctgctctaaatc

SEQ ID NO: 538250 - DNA, 25 bp, Homo sapien
atctgctctaaatctactgtggtga

SEQ ID NO: 538251 - DNA, 25 bp, Homo sapien
atctactgtggtgattaaatcttgg

SEQ ID NO: 538252 - DNA, 25 bp, Homo sapien
aaatcttggttacaacatcctggga

SEQ ID NO: 538253 - DNA, 25 bp, Homo sapien
aacatcctgggaagtttcctgaaca

SEQ ID NO: 538254 - DNA, 25 bp, Homo sapien
atatgtatatgtgctcgcttgtgta

SEQ ID NO: 538255 - DNA, 25 bp, Homo sapien
tgctcgcttgtgtaggatgaatgtc

SEQ ID NO: 538256 - DNA, 25 bp, Homo sapien
gaatgtcttagagtcgtttgtggta

SEQ ID NO: 538257 - DNA, 25 bp, Homo sapien
ttttatgttgttgactctggctcca

SEQ ID NO: 538258 - DNA, 25 bp, Homo sapien
gacagataagtattgcccagagcta

SEQ ID NO: 538259 - DNA, 25 bp, Homo sapien
attgcccagagctaagtggcactac

SEQ ID NO: 538260 - DNA, 25 bp, Homo sapien
taagtggcactacttacaaagtttt

SEQ ID NO: 538261 - DNA, 25 bp, Homo sapien
aatgtcttctacatactgattcatg

SEQ ID NO: 538262 - DNA, 25 bp, Homo sapien
ttgagctctctttatagaattttct

SEQ ID NO: 538263 - DNA, 25 bp, Homo sapien
gtttcaaacctctaagttgtagcct

SEQ ID NO: 538264 - DNA, 25 bp, Homo sapien
acctctaagttgtagcctgtaatta

SEQ ID NO: 538265 - DNA, 25 bp, Homo sapien
gggtgcagatgtctccctgcaccat

SEQ ID NO: 538266 - DNA, 25 bp, Homo sapien
gcctgtggcctttgtcgagtcactg

SEQ ID NO: 538267 - DNA, 25 bp, Homo sapien
ttttttgagttctctagtgtcttta

SEQ ID NO: 538268 - DNA, 25 bp, Homo sapien
tttttgagttctctagtgtctttat

SEQ ID NO: 538269 - DNA, 25 bp, Homo sapien
ttttgagttctctagtgtctttatt

SEQ ID NO: 538270 - DNA, 25 bp, Homo sapien
gttctctagtgtctttattatccat

SEQ ID NO: 538271 - DNA, 25 bp, Homo sapien
tctctagtgtctttattatccattc

SEQ ID NO: 538272 - DNA, 25 bp, Homo sapien
tctagtgtctttattatccattccc

SEQ ID NO: 538273 - DNA, 25 bp, Homo sapien
tagtgtctttattatccattcccgg

SEQ ID NO: 538274 - DNA, 25 bp, Homo sapien
agtgtctttattatccattcccggg

SEQ ID NO: 538275 - DNA, 25 bp, Homo sapien
tttattatccattcccgggggcact

SEQ ID NO: 538276 - DNA, 25 bp, Homo sapien
atttgcaggctgcttcaggattaca

SEQ ID NO: 538277 - DNA, 25 bp, Homo sapien
ggctgcttcaggattacatttaaat

SEQ ID NO: 538278 - DNA, 25 bp, Homo sapien
actgttaaaatgttgtatcttgtaa

SEQ ID NO: 538279 - DNA, 25 bp, Homo sapien
caaaagaaagattgcctgctaggat

SEQ ID NO: 538280 - DNA, 25 bp, Homo sapien
gcctgctaggattgtgccatcttta

SEQ ID NO: 538281 - DNA, 25 bp, Homo sapien
tgctaggattgtgccatctttaaaa

SEQ ID NO: 538282 - DNA, 25 bp, Homo sapien
ttactattggtcatttgcagaacag

SEQ ID NO: 538283 - DNA, 25 bp, Homo sapien
tctgtgtgttggtacagagtgctct

SEQ ID NO: 538284 - DNA, 25 bp, Homo sapien
agagtgctctgtaccagtgctcatc

SEQ ID NO: 538285 - DNA, 25 bp, Homo sapien
gtaccagtgctcatcatcccttctt

SEQ ID NO: 538286 - DNA, 25 bp, Homo sapien
cataccaacggtccctagttatagg

SEQ ID NO: 538287 - DNA, 25 bp, Homo sapien
caggagctgccgaccatcaggacgc

SEQ ID NO: 538288 - DNA, 25 bp, Homo sapien
atcaggacgcctgcagacatttaca

SEQ ID NO: 538289 - DNA, 25 bp, Homo sapien
ggacgcctgcagacatttacagagc

SEQ ID NO: 538290 - DNA, 25 bp, Homo sapien
ctgcagacatttacagagcctttgt

SEQ ID NO: 538291 - DNA, 25 bp, Homo sapien
tacagagcctttgttgatgttgtga

SEQ ID NO: 538292 - DNA, 25 bp, Homo sapien
tggagaatatgtccctcgcaaatcc

SEQ ID NO: 538293 - DNA, 25 bp, Homo sapien
agaatatgtccctcgcaaatccatc

SEQ ID NO: 538294 - DNA, 25 bp, Homo sapien
agtgtgtgtagcgacactagtgaaa

SEQ ID NO: 538295 - DNA, 25 bp, Homo sapien
acactagtgaaagcagtgctgctga

SEQ ID NO: 538296 - DNA, 25 bp, Homo sapien
agttttgaggagtatcagctgcgaa

SEQ ID NO: 538297 - DNA, 25 bp, Homo sapien
aaacgtaaacgaaagaacagcactg

SEQ ID NO: 538298 - DNA, 25 bp, Homo sapien
gatactaattatacactcaacacag

SEQ ID NO: 538299 - DNA, 25 bp, Homo sapien
actcaacacagattccttggactgg

SEQ ID NO: 538300 - DNA, 25 bp, Homo sapien
atgaccacctaatggatttccttgc

SEQ ID NO: 538301 - DNA, 25 bp, Homo sapien
gtacattacttttcttgaagacctc

SEQ ID NO: 538302 - DNA, 25 bp, Homo sapien
gaagacctcaagagttttgtcaaga

SEQ ID NO: 538303 - DNA, 25 bp, Homo sapien
caagagccagtagagcagacagatg

SEQ ID NO: 538304 - DNA, 25 bp, Homo sapien
gacagatgctgaaagccatagtttc

SEQ ID NO: 538305 - DNA, 25 bp, Homo sapien
atagtttcatggcaggctttggcca

SEQ ID NO: 538306 - DNA, 25 bp, Homo sapien
tcatggcaggctttggccagtgaac

SEQ ID NO: 538307 - DNA, 25 bp, Homo sapien
gtgaacaaatcctactctgaagcta

SEQ ID NO: 538308 - DNA, 25 bp, Homo sapien
actctgaagctagacatgtgctttg

SEQ ID NO: 538309 - DNA, 25 bp, Homo sapien
tctttattatccattcccgggggca

SEQ ID NO: 538310 - DNA, 25 bp, Homo sapien
tttattatccattcccgggggcact

SEQ ID NO: 538311 - DNA, 25 bp, Homo sapien
ttattatccattcccgggggcactc

SEQ ID NO: 538312 - DNA, 25 bp, Homo sapien
tattatccattcccgggggcactcc

SEQ ID NO: 538313 - DNA, 25 bp, Homo sapien
attatccattcccgggggcactcct

SEQ ID NO: 538314 - DNA, 25 bp, Homo sapien
ttatccattcccgggggcactcctg

SEQ ID NO: 538315 - DNA, 25 bp, Homo sapien
tatccattcccgggggcactcctgg

SEQ ID NO: 538316 - DNA, 25 bp, Homo sapien
atccattcccgggggcactcctggc

SEQ ID NO: 538317 - DNA, 25 bp, Homo sapien
tccattcccgggggcactcctggct

SEQ ID NO: 538318 - DNA, 25 bp, Homo sapien
gtgtgttggtacagagtgctctgta

SEQ ID NO: 538319 - DNA, 25 bp, Homo sapien
tacagagtgctctgtaccagtgctc

SEQ ID NO: 538320 - DNA, 25 bp, Homo sapien
acagagtgctctgtaccagtgctca

SEQ ID NO: 538321 - DNA, 25 bp, Homo sapien
cagagtgctctgtaccagtgctcat

SEQ ID NO: 538322 - DNA, 25 bp, Homo sapien
agagtgctctgtaccagtgctcatc

SEQ ID NO: 538323 - DNA, 25 bp, Homo sapien
gagtgctctgtaccagtgctcatca

SEQ ID NO: 538324 - DNA, 25 bp, Homo sapien
agtgctctgtaccagtgctcatcat

SEQ ID NO: 538325 - DNA, 25 bp, Homo sapien
gtgctctgtaccagtgctcatcatc

SEQ ID NO: 538326 - DNA, 25 bp, Homo sapien
tgctctgtaccagtgctcatcatcc

SEQ ID NO: 538327 - DNA, 25 bp, Homo sapien
tgtaccagtgctcatcatcccttct

SEQ ID NO: 538328 - DNA, 25 bp, Homo sapien
gtaccagtgctcatcatcccttctt

SEQ ID NO: 538329 - DNA, 25 bp, Homo sapien
gggattagacctgtggcacacttcc

SEQ ID NO: 538330 - DNA, 25 bp, Homo sapien
catctgtaggatttgggctgcccca

SEQ ID NO: 538331 - DNA, 25 bp, Homo sapien
gggctctgaatgtattttgtaccgt

SEQ ID NO: 538332 - DNA, 25 bp, Homo sapien
ggagaatttttagtcttctttcatg

SEQ ID NO: 538333 - DNA, 25 bp, Homo sapien
agtcttctttcatgaagcagtggag

SEQ ID NO: 538334 - DNA, 25 bp, Homo sapien
gttgactctctctgggagactcttg

SEQ ID NO: 538335 - DNA, 25 bp, Homo sapien
actcttggtccaagacctgggtcag

SEQ ID NO: 538336 - DNA, 25 bp, Homo sapien
aagacctgggtcagttctttgctgg

SEQ ID NO: 538337 - DNA, 25 bp, Homo sapien
tctgaccacaagcttctgcctgaag

SEQ ID NO: 538338 - DNA, 25 bp, Homo sapien
ttctgcctgaagattcctcaggtca

SEQ ID NO: 538339 - DNA, 25 bp, Homo sapien
attcctcaggtcaacaccatcatta

SEQ ID NO: 538340 - DNA, 25 bp, Homo sapien
tgaaactgtactaaatttttgccta

SEQ ID NO: 538341 - DNA, 25 bp, Homo sapien
actgtactaaatttttgcctacaat

SEQ ID NO: 538342 - DNA, 25 bp, Homo sapien
ttgcctacaatttaccttgttaaat

SEQ ID NO: 538343 - DNA, 25 bp, Homo sapien
acatgagcagtggtgttctaatgaa

SEQ ID NO: 538344 - DNA, 25 bp, Homo sapien
gagcagtggtgttctaatgaagtta

SEQ ID NO: 538345 - DNA, 25 bp, Homo sapien
ctaatgaagttatgacatctgtcct

SEQ ID NO: 538346 - DNA, 25 bp, Homo sapien
gaagttatgacatctgtcctaatta

SEQ ID NO: 538347 - DNA, 25 bp, Homo sapien
tacatttactacttaatggttttga

SEQ ID NO: 538348 - DNA, 25 bp, Homo sapien
aacttgctaataaccttttgttcag

SEQ ID NO: 538349 - DNA, 25 bp, Homo sapien
tgctaataaccttttgttcagaatt

SEQ ID NO: 538350 - DNA, 25 bp, Homo sapien
agtagattgtttaatgcaggacatc

SEQ ID NO: 538351 - DNA, 25 bp, Homo sapien
gactgcaaagagatcaggagcgtct

SEQ ID NO: 538352 - DNA, 25 bp, Homo sapien
agcgtctgggcaagcagctcaagtt

SEQ ID NO: 538353 - DNA, 25 bp, Homo sapien
tctgggcaagcagctcaagttacgt

SEQ ID NO: 538354 - DNA, 25 bp, Homo sapien
gggcaagcagctcaagttacgtgca

SEQ ID NO: 538355 - DNA, 25 bp, Homo sapien
aagcagctcaagttacgtgcagaaa

SEQ ID NO: 538356 - DNA, 25 bp, Homo sapien
gctcaagttacgtgcagaaagggaa

SEQ ID NO: 538357 - DNA, 25 bp, Homo sapien
gagcggcgcaaggagagacaggaag

SEQ ID NO: 538358 - DNA, 25 bp, Homo sapien
cccctccgcagaataactaagaaat

SEQ ID NO: 538359 - DNA, 25 bp, Homo sapien
gaaattcgtcaaaggctctacagag

SEQ ID NO: 538360 - DNA, 25 bp, Homo sapien
attcgtcaaaggctctacagagaag

SEQ ID NO: 538361 - DNA, 25 bp, Homo sapien
agaagaacaagctcagactgcaaag

SEQ ID NO: 538362 - DNA, 25 bp, Homo sapien
acagccccaagcaaacagcagaatt

SEQ ID NO: 538363 - DNA, 25 bp, Homo sapien
ttattgactttattgtcccttaaat

SEQ ID NO: 538364 - DNA, 25 bp, Homo sapien
gactgttgtgattccatcaagtttg

SEQ ID NO: 538365 - DNA, 25 bp, Homo sapien
caagtttgtacactcttttctctcc

SEQ ID NO: 538366 - DNA, 25 bp, Homo sapien
taaaacacctcctgttgtggatggt

SEQ ID NO: 538367 - DNA, 25 bp, Homo sapien
ttgtggatggtgagcccctgatgcc

SEQ ID NO: 538368 - DNA, 25 bp, Homo sapien
gatgccgcttatttgccgtgagttt

SEQ ID NO: 538369 - DNA, 25 bp, Homo sapien
agcaagactctgtggagtttgttca

SEQ ID NO: 538370 - DNA, 25 bp, Homo sapien
gagtttgttcagtggtacggtgtcc

SEQ ID NO: 538371 - DNA, 25 bp, Homo sapien
ggtacggtgtccaagcaaacagcag

SEQ ID NO: 538372 - DNA, 25 bp, Homo sapien
aatgcaactttctaaacagccccaa

SEQ ID NO: 538373 - DNA, 25 bp, Homo sapien
acaagcacttgcacacatgtggact

SEQ ID NO: 538374 - DNA, 25 bp, Homo sapien
ttgcacacatgtggactcctaacca

SEQ ID NO: 538375 - DNA, 25 bp, Homo sapien
atgtggactcctaaccatgctaacc

SEQ ID NO: 538376 - DNA, 25 bp, Homo sapien
taaccatgctaacctcactggctgg

SEQ ID NO: 538377 - DNA, 25 bp, Homo sapien
caaggcttagggtgtggccagccct

SEQ ID NO: 538378 - DNA, 25 bp, Homo sapien
tggccagccctgaaagctacttgga

SEQ ID NO: 538379 - DNA, 25 bp, Homo sapien
gctacttggacacaggtttcagctg

SEQ ID NO: 538380 - DNA, 25 bp, Homo sapien
ttctgggtgctctacacctcaggtt

SEQ ID NO: 538381 - DNA, 25 bp, Homo sapien
gtgctctacacctcaggttaccagg

SEQ ID NO: 538382 - DNA, 25 bp, Homo sapien
aggttaccaggcctgaggcatctca

SEQ ID NO: 538383 - DNA, 25 bp, Homo sapien
ggcctgaggcatctcagccaagctt

SEQ ID NO: 538384 - DNA, 25 bp, Homo sapien
cagagctctaaattggtccttctat

SEQ ID NO: 538385 - DNA, 25 bp, Homo sapien
tctaaattggtccttctatttttca

SEQ ID NO: 538386 - DNA, 25 bp, Homo sapien
atataatattgcatcctttgtggga

SEQ ID NO: 538387 - DNA, 25 bp, Homo sapien
tgcatcctttgtgggaatgactata

SEQ ID NO: 538388 - DNA, 25 bp, Homo sapien
atgtagtaagtaacgcagaaccagg

SEQ ID NO: 538389 - DNA, 25 bp, Homo sapien
gcagaaccagggttggctttattta

SEQ ID NO: 538390 - DNA, 25 bp, Homo sapien
gttgtaagtacagtggcaaatgctt

SEQ ID NO: 538391 - DNA, 25 bp, Homo sapien
gtggcaaatgcttattacttacttc

SEQ ID NO: 538392 - DNA, 25 bp, Homo sapien
gcttattacttacttcaaactgttt

SEQ ID NO: 538393 - DNA, 25 bp, Homo sapien
aacttaaggctgttcatgagaaggc

SEQ ID NO: 538394 - DNA, 25 bp, Homo sapien
gaaggccttgaaaagttactctaga

SEQ ID NO: 538395 - DNA, 25 bp, Homo sapien
aagccaaacagcatggtggctctaa

SEQ ID NO: 538396 - DNA, 25 bp, Homo sapien
ggtggctctaaaagaccctcagata

SEQ ID NO: 538397 - DNA, 25 bp, Homo sapien
taaaagaccctcagatagcagccgc

SEQ ID NO: 538398 - DNA, 25 bp, Homo sapien
tagcagccgccccaaggaacacgag

SEQ ID NO: 538399 - DNA, 25 bp, Homo sapien
cgccccaaggaacacgagcatgaag

SEQ ID NO: 538400 - DNA, 25 bp, Homo sapien
gaaggaataggcacaggtctctcca

SEQ ID NO: 538401 - DNA, 25 bp, Homo sapien
acaggtctctccaaagtgaatgaac

SEQ ID NO: 538402 - DNA, 25 bp, Homo sapien
tgaatgaactcttacccataaccct

SEQ ID NO: 538403 - DNA, 25 bp, Homo sapien
tacccataaccctaatgatgcaagt

SEQ ID NO: 538404 - DNA, 25 bp, Homo sapien
accaaatctgggtgccagatcccag

SEQ ID NO: 538405 - DNA, 25 bp, Homo sapien
tgggtgccagatcccagcactactt

SEQ ID NO: 538406 - DNA, 25 bp, Homo sapien
gctggcttctctctgcaacaggaga

SEQ ID NO: 538407 - DNA, 25 bp, Homo sapien
gaaaacctggagctacagtgtcccc

SEQ ID NO: 538408 - DNA, 25 bp, Homo sapien
tctgcgaatctgctcccaaaggaag

SEQ ID NO: 538409 - DNA, 25 bp, Homo sapien
aaggaagctgaccagagcaagatct

SEQ ID NO: 538410 - DNA, 25 bp, Homo sapien
agtgcctgggacaggactgtgacct

SEQ ID NO: 538411 - DNA, 25 bp, Homo sapien
gggcctagatgtagcctctgttcct

SEQ ID NO: 538412 - DNA, 25 bp, Homo sapien
ctctgttcctcctggacataggaag

SEQ ID NO: 538413 - DNA, 25 bp, Homo sapien
ggaaggtcccaagcttagtatccca

SEQ ID NO: 538414 - DNA, 25 bp, Homo sapien
tagtatcccacgtggcctttacaaa

SEQ ID NO: 538415 - DNA, 25 bp, Homo sapien
ctttacaaatcctatggctggcctt

SEQ ID NO: 538416 - DNA, 25 bp, Homo sapien
ggctggccttctcattccacaaggg

SEQ ID NO: 538417 - DNA, 25 bp, Homo sapien
gggtgtcctccaacatctctgaacc

SEQ ID NO: 538418 - DNA, 25 bp, Homo sapien
tcttgcctcagtcgtcggagatgga

SEQ ID NO: 538419 - DNA, 25 bp, Homo sapien
ttgcctcagtcgtcggagatggaga

SEQ ID NO: 538420 - DNA, 25 bp, Homo sapien
gctgaagattggcaggcggcggcca

SEQ ID NO: 538421 - DNA, 25 bp, Homo sapien
cgaggctgggagactcagagccgct

SEQ ID NO: 538422 - DNA, 25 bp, Homo sapien
actcagagccgctgaggctgccgga

SEQ ID NO: 538423 - DNA, 25 bp, Homo sapien
ctgccggagctcagggagccgctta

SEQ ID NO: 538424 - DNA, 25 bp, Homo sapien
tcagggagccgcttaggtagctgtc

SEQ ID NO: 538425 - DNA, 25 bp, Homo sapien
gcttaggtagctgtcgcggtccgac

SEQ ID NO: 538426 - DNA, 25 bp, Homo sapien
gtcgcggtccgacagcgagtccggg

SEQ ID NO: 538427 - DNA, 25 bp, Homo sapien
gggcgcgtcgaacacgggcgagtcg

SEQ ID NO: 538428 - DNA, 25 bp, Homo sapien
acgaggctagattatatttggaaca

SEQ ID NO: 538429 - DNA, 25 bp, Homo sapien
cacaaacgcttgtattacggagtta

SEQ ID NO: 538430 - DNA, 25 bp, Homo sapien
gagaggaatttctcataaccccttc

SEQ ID NO: 538431 - DNA, 25 bp, Homo sapien
tcataaccccttccagcaaatgttt

SEQ ID NO: 538432 - DNA, 25 bp, Homo sapien
ccagcaaatgtttccggagtataat

SEQ ID NO: 538433 - DNA, 25 bp, Homo sapien
ggagtataatgctccttccgctcta

SEQ ID NO: 538434 - DNA, 25 bp, Homo sapien
ttccgctctagagacccatagaaca

SEQ ID NO: 538435 - DNA, 25 bp, Homo sapien
gagacccatagaacaggcatcaagg

SEQ ID NO: 538436 - DNA, 25 bp, Homo sapien
gttacactaagaccgctaaagcctc

SEQ ID NO: 538437 - DNA, 25 bp, Homo sapien
gaccgctaaagcctccaatttatat

SEQ ID NO: 538438 - DNA, 25 bp, Homo sapien
aaatctttcgtctaaacacccatga

SEQ ID NO: 538439 - DNA, 25 bp, Homo sapien
acacttatagtctactgcccatgta

SEQ ID NO: 538440 - DNA, 25 bp, Homo sapien
tagtctactgcccatgtaaggatca

SEQ ID NO: 538441 - DNA, 25 bp, Homo sapien
ccatgtaaggatcagctccggctaa

SEQ ID NO: 538442 - DNA, 25 bp, Homo sapien
gatcagctccggctaagaggccaaa

SEQ ID NO: 538443 - DNA, 25 bp, Homo sapien
atgggtgacatcgttatgctctgcc

SEQ ID NO: 538444 - DNA, 25 bp, Homo sapien
ttctttcttacccacttagcttcct

SEQ ID NO: 538445 - DNA, 25 bp, Homo sapien
ccacttagcttcctaattggaggaa

SEQ ID NO: 538446 - DNA, 25 bp, Homo sapien
actgtcataatctctggggtcatca

SEQ ID NO: 538447 - DNA, 25 bp, Homo sapien
gtctttgggccaagataagggcagt

SEQ ID NO: 538448 - DNA, 25 bp, Homo sapien
gcagtgggatttatgatgtgttgtt

SEQ ID NO: 538449 - DNA, 25 bp, Homo sapien
tagtctgaaactactctggtgatca

SEQ ID NO: 538450 - DNA, 25 bp, Homo sapien
gcagagcttgtagccctggatggcc

SEQ ID NO: 538451 - DNA, 25 bp, Homo sapien
cagagcttgtagccctggatggcct

SEQ ID NO: 538452 - DNA, 25 bp, Homo sapien
tggggcaggaccactagctaagcaa

SEQ ID NO: 538453 - DNA, 25 bp, Homo sapien
aggagaagacccctgcccaagtggc

SEQ ID NO: 538454 - DNA, 25 bp, Homo sapien
aagacccctgcccaagtggctcttg

SEQ ID NO: 538455 - DNA, 25 bp, Homo sapien
agacccctgcccaagtggctcttgg

SEQ ID NO: 538456 - DNA, 25 bp, Homo sapien
gacccctgcccaagtggctcttggg

SEQ ID NO: 538457 - DNA, 25 bp, Homo sapien
acctgcccatgtccagagggactgg

SEQ ID NO: 538458 - DNA, 25 bp, Homo sapien
ctgcccatgtccagagggactggac

SEQ ID NO: 538459 - DNA, 25 bp, Homo sapien
atgtccagagggactggacagccag

SEQ ID NO: 538460 - DNA, 25 bp, Homo sapien
tgagggtgtcggctgtgaggcgggt

SEQ ID NO: 538461 - DNA, 25 bp, Homo sapien
ttctctcaccgattacataactctt

SEQ ID NO: 538462 - DNA, 25 bp, Homo sapien
cataactcttaaatccatgtgctga

SEQ ID NO: 538463 - DNA, 25 bp, Homo sapien
atccatgtgctgatgcagaggtaca

SEQ ID NO: 538464 - DNA, 25 bp, Homo sapien
agggagatgtccacacggagctgaa

SEQ ID NO: 538465 - DNA, 25 bp, Homo sapien
gagctgaagatgtggactctctcca

SEQ ID NO: 538466 - DNA, 25 bp, Homo sapien
gaacacggacagaaatgtgcacaga

SEQ ID NO: 538467 - DNA, 25 bp, Homo sapien
acaacatcatggtacaacttctggt

SEQ ID NO: 538468 - DNA, 25 bp, Homo sapien
aacttctggtaacatgtcagtgggc

SEQ ID NO: 538469 - DNA, 25 bp, Homo sapien
aaagtgtatgttttcatgtaggttc

SEQ ID NO: 538470 - DNA, 25 bp, Homo sapien
tgtaggttctattcacaatgtgctt

SEQ ID NO: 538471 - DNA, 25 bp, Homo sapien
cataatagccacttgaaactggagt

SEQ ID NO: 538472 - DNA, 25 bp, Homo sapien
gagaagtctctgttaactctatagg

SEQ ID NO: 538473 - DNA, 25 bp, Homo sapien
ggaagcttttctttggcgattcagt

SEQ ID NO: 538474 - DNA, 25 bp, Homo sapien
ttttctttggcgattcagtgtcaca

SEQ ID NO: 538475 - DNA, 25 bp, Homo sapien
ttcagtgtcacaaaataactccaga

SEQ ID NO: 538476 - DNA, 25 bp, Homo sapien
aactccagaaagaagcacttagcgt

SEQ ID NO: 538477 - DNA, 25 bp, Homo sapien
cttagcgtgctgttcctgtggaaaa

SEQ ID NO: 538478 - DNA, 25 bp, Homo sapien
gaaaaacttcagagactacctgttt

SEQ ID NO: 538479 - DNA, 25 bp, Homo sapien
tacctgttttattttcctcaacatc

SEQ ID NO: 538480 - DNA, 25 bp, Homo sapien
tttcctcaacatcttgaagttatgt

SEQ ID NO: 538481 - DNA, 25 bp, Homo sapien
aaaaacagccataattctttaacat

SEQ ID NO: 538482 - DNA, 25 bp, Homo sapien
aaggcataagaaccattatcccaat

SEQ ID NO: 538483 - DNA, 25 bp, Homo sapien
aggaaggccagcaccgtgaccatgg

SEQ ID NO: 538484 - DNA, 25 bp, Homo sapien
aggtcacactgcaccacagtacagg

SEQ ID NO: 538485 - DNA, 25 bp, Homo sapien
tgcaccacagtacagggcgccgagt

SEQ ID NO: 538486 - DNA, 25 bp, Homo sapien
gcgccgagtcgcagcttacgagaac

SEQ ID NO: 538487 - DNA, 25 bp, Homo sapien
gcagcttacgagaactggatcctga

SEQ ID NO: 538488 - DNA, 25 bp, Homo sapien
aactggatcctgaagcctcgagggc

SEQ ID NO: 538489 - DNA, 25 bp, Homo sapien
tgctcgggctctggcaggaagatct

SEQ ID NO: 538490 - DNA, 25 bp, Homo sapien
aggaagatctgtctgcgatcccgct

SEQ ID NO: 538491 - DNA, 25 bp, Homo sapien
ctgcgatcccgcttgtgatgggccg

SEQ ID NO: 538492 - DNA, 25 bp, Homo sapien
ccccagtccaccttgagaggattga

SEQ ID NO: 538493 - DNA, 25 bp, Homo sapien
gctgtgggaagcactgaagcgcccc

SEQ ID NO: 538494 - DNA, 25 bp, Homo sapien
cggttaacgagcatctttggtctct

SEQ ID NO: 538495 - DNA, 25 bp, Homo sapien
agcatctttggtctcttgtggaatt

SEQ ID NO: 538496 - DNA, 25 bp, Homo sapien
ggtctcttgtggaatttgaactaaa

SEQ ID NO: 538497 - DNA, 25 bp, Homo sapien
tgaactaaaactatgagccttattc

SEQ ID NO: 538498 - DNA, 25 bp, Homo sapien
gagccttattcaatatctataattc

SEQ ID NO: 538499 - DNA, 25 bp, Homo sapien
atgaataatgtttgcccttactgtg

SEQ ID NO: 538500 - DNA, 25 bp, Homo sapien
aatgtttgcccttactgtgttatga

SEQ ID NO: 538501 - DNA, 25 bp, Homo sapien
ttgcccttactgtgttatgaatgag

SEQ ID NO: 538502 - DNA, 25 bp, Homo sapien
agttttttgtagtgtgtctgggtgc

SEQ ID NO: 538503 - DNA, 25 bp, Homo sapien
tagtgtgtctgggtgcatgatgcaa

SEQ ID NO: 538504 - DNA, 25 bp, Homo sapien
ttaaagattgctataattgcgctat

SEQ ID NO: 538505 - DNA, 25 bp, Homo sapien
gtcttctcccgctcatgggtgggct

SEQ ID NO: 538506 - DNA, 25 bp, Homo sapien
gggaggaacagcaatctaattccaa

SEQ ID NO: 538507 - DNA, 25 bp, Homo sapien
cccgctcatgggtgggctgcacgaa

SEQ ID NO: 538508 - DNA, 25 bp, Homo sapien
ccctgctggtacagctccaggagct

SEQ ID NO: 538509 - DNA, 25 bp, Homo sapien
tccgcagcactcagagtcgtgaact

SEQ ID NO: 538510 - DNA, 25 bp, Homo sapien
agtcgtgaactccaggaagcggtat

SEQ ID NO: 538511 - DNA, 25 bp, Homo sapien
gaagcggtattcataggacacatct

SEQ ID NO: 538512 - DNA, 25 bp, Homo sapien
aattccaagatgtagccttcattgt

SEQ ID NO: 538513 - DNA, 25 bp, Homo sapien
gtagccttcattgtgaagatcagtt

SEQ ID NO: 538514 - DNA, 25 bp, Homo sapien
agttttctgagatctgtcggttttc

SEQ ID NO: 538515 - DNA, 25 bp, Homo sapien
gatggctctaaagatgtgctccagg

SEQ ID NO: 538516 - DNA, 25 bp, Homo sapien
actgttaaaatgttgtatcttgtaa

SEQ ID NO: 538517 - DNA, 25 bp, Homo sapien
gtaaacaaaagaaagattgcctgct

SEQ ID NO: 538518 - DNA, 25 bp, Homo sapien
taaacaaaagaaagattgcctgcta

SEQ ID NO: 538519 - DNA, 25 bp, Homo sapien
caaaagaaagattgcctgctaggat

SEQ ID NO: 538520 - DNA, 25 bp, Homo sapien
aaaagaaagattgcctgctaggatt

SEQ ID NO: 538521 - DNA, 25 bp, Homo sapien
gcctgctaggattgtgccatcttta

SEQ ID NO: 538522 - DNA, 25 bp, Homo sapien
cctgctaggattgtgccatctttaa

SEQ ID NO: 538523 - DNA, 25 bp, Homo sapien
ctgctaggattgtgccatctttaaa

SEQ ID NO: 538524 - DNA, 25 bp, Homo sapien
tgctaggattgtgccatctttaaaa

SEQ ID NO: 538525 - DNA, 25 bp, Homo sapien
gctaggattgtgccatctttaaaat

SEQ ID NO: 538526 - DNA, 25 bp, Homo sapien
gtccctagttataggaatttaatat

SEQ ID NO: 538527 - DNA, 25 bp, Homo sapien
gttcctcacaggcttccaggttagg

SEQ ID NO: 538528 - DNA, 25 bp, Homo sapien
actgtgaataggctcagctcctcta

SEQ ID NO: 538529 - DNA, 25 bp, Homo sapien
tcctctagagagctgaagccatctg

SEQ ID NO: 538530 - DNA, 25 bp, Homo sapien
tggttcttagattcctctcccagtc

SEQ ID NO: 538531 - DNA, 25 bp, Homo sapien
attgttctgttgctccaccttattg

SEQ ID NO: 538532 - DNA, 25 bp, Homo sapien
ttattgtctcaaggccgtaatctca

SEQ ID NO: 538533 - DNA, 25 bp, Homo sapien
cgtaatctcatcaggttgggacatt

SEQ ID NO: 538534 - DNA, 25 bp, Homo sapien
gacattaatcttttcaactccttgt

SEQ ID NO: 538535 - DNA, 25 bp, Homo sapien
tttggtttctctacatgtcctgcag

SEQ ID NO: 538536 - DNA, 25 bp, Homo sapien
cacttctcctttacgctgtgtagag

SEQ ID NO: 538537 - DNA, 25 bp, Homo sapien
gagaatgctctgcagtttaggcaat

SEQ ID NO: 538538 - DNA, 25 bp, Homo sapien
agatgtataaggttaagtttgcaaa

SEQ ID NO: 538539 - DNA, 25 bp, Homo sapien
ggaaatgctgtatatcttttgaagt

SEQ ID NO: 538540 - DNA, 25 bp, Homo sapien
gaagtgatgaaatccacgttggaat

SEQ ID NO: 538541 - DNA, 25 bp, Homo sapien
tatgttgtaataatgctgttgtaag

SEQ ID NO: 538542 - DNA, 25 bp, Homo sapien
ttaatgtctctttgcctgttttcta

SEQ ID NO: 538543 - DNA, 25 bp, Homo sapien
ttgcctgttttctatttcagcacat

SEQ ID NO: 538544 - DNA, 25 bp, Homo sapien
gttttctatttcagcacattcattg

SEQ ID NO: 538545 - DNA, 25 bp, Homo sapien
gcattataactgcttagccattgaa

SEQ ID NO: 538546 - DNA, 25 bp, Homo sapien
taactgcttagccattgaatgataa

SEQ ID NO: 538547 - DNA, 25 bp, Homo sapien
gcttagccattgaatgataacattt

SEQ ID NO: 538548 - DNA, 25 bp, Homo sapien
aatttatttgtgaaattctgcagaa

SEQ ID NO: 538549 - DNA, 25 bp, Homo sapien
ctcagcagacacaggaagaccacgt

SEQ ID NO: 538550 - DNA, 25 bp, Homo sapien
gacacaggaagaccacgtctgtcca

SEQ ID NO: 538551 - DNA, 25 bp, Homo sapien
gtctgtccaccacagactgccagtg

SEQ ID NO: 538552 - DNA, 25 bp, Homo sapien
tgagccgtgtgcagggcaaccttcg

SEQ ID NO: 538553 - DNA, 25 bp, Homo sapien
cagggcaaccttcggattccttata

SEQ ID NO: 538554 - DNA, 25 bp, Homo sapien
tcggattccttatactctctctgaa

SEQ ID NO: 538555 - DNA, 25 bp, Homo sapien
tatactctctctgaaggcaaagatg

SEQ ID NO: 538556 - DNA, 25 bp, Homo sapien
gtcagaatgttgacactttgatgaa

SEQ ID NO: 538557 - DNA, 25 bp, Homo sapien
gcattctgtaagtggtcaaaggaca

SEQ ID NO: 538558 - DNA, 25 bp, Homo sapien
ttactttctccacactaagtcttct

SEQ ID NO: 538559 - DNA, 25 bp, Homo sapien
ctaagtcttctccatgttttgtggc

SEQ ID NO: 538560 - DNA, 25 bp, Homo sapien
gcctgtctgtgcttcagaggcccct

SEQ ID NO: 538561 - DNA, 25 bp, Homo sapien
tgtctgtgcttcagaggcccctcca

SEQ ID NO: 538562 - DNA, 25 bp, Homo sapien
tctgtgcttcagaggcccctccagt

SEQ ID NO: 538563 - DNA, 25 bp, Homo sapien
aggcagggaactgcaatccagccct

SEQ ID NO: 538564 - DNA, 25 bp, Homo sapien
ggcagggaactgcaatccagccctg

SEQ ID NO: 538565 - DNA, 25 bp, Homo sapien
gggcgtctgtccacttgtcacctta

SEQ ID NO: 538566 - DNA, 25 bp, Homo sapien
tctgtccacttgtcaccttaggttt

SEQ ID NO: 538567 - DNA, 25 bp, Homo sapien
tgtccacttgtcaccttaggttttc

SEQ ID NO: 538568 - DNA, 25 bp, Homo sapien
tccacttgtcaccttaggttttcac

SEQ ID NO: 538569 - DNA, 25 bp, Homo sapien
acttgtcaccttaggttttcactca

SEQ ID NO: 538570 - DNA, 25 bp, Homo sapien
cttgtcaccttaggttttcactcat

SEQ ID NO: 538571 - DNA, 25 bp, Homo sapien
tgtgctgttccagtatatgcaatac

SEQ ID NO: 538572 - DNA, 25 bp, Homo sapien
gttccagtatatgcaatacacttta

SEQ ID NO: 538573 - DNA, 25 bp, Homo sapien
gcaatacactttaatgttttattct

SEQ ID NO: 538574 - DNA, 25 bp, Homo sapien
gtgcaatatggagatgtatacagtc

SEQ ID NO: 538575 - DNA, 25 bp, Homo sapien
ggagatgtatacagtctttactata

SEQ ID NO: 538576 - DNA, 25 bp, Homo sapien
acagtctttactatattaggtttat

SEQ ID NO: 538577 - DNA, 25 bp, Homo sapien
gaatttcatccttttgccaaaatgg

SEQ ID NO: 538578 - DNA, 25 bp, Homo sapien
ttggtaaatcataaatcctgtggtg

SEQ ID NO: 538579 - DNA, 25 bp, Homo sapien
aatcctgtggtgaatggtggtgtac

SEQ ID NO: 538580 - DNA, 25 bp, Homo sapien
gtggtgaatggtggtgtactttaaa

SEQ ID NO: 538581 - DNA, 25 bp, Homo sapien
aagctgtcaccatgttatattttct

SEQ ID NO: 538582 - DNA, 25 bp, Homo sapien
gcctgcagcaagcactttggagagc

SEQ ID NO: 538583 - DNA, 25 bp, Homo sapien
atctgtgcagagagtaacgcggagt

SEQ ID NO: 538584 - DNA, 25 bp, Homo sapien
gtcaagaggtgtgcagaaaatccaa

SEQ ID NO: 538585 - DNA, 25 bp, Homo sapien
aaggctgaggacaatgtgtgtgtca

SEQ ID NO: 538586 - DNA, 25 bp, Homo sapien
accagaagtcatagggacagtgaag

SEQ ID NO: 538587 - DNA, 25 bp, Homo sapien
gggacagtgaagatatttgacagaa

SEQ ID NO: 538588 - DNA, 25 bp, Homo sapien
atttgacagaaaaatcgaactggga

SEQ ID NO: 538589 - DNA, 25 bp, Homo sapien
aagagtgcgaaggttctcatgcaga

SEQ ID NO: 538590 - DNA, 25 bp, Homo sapien
gaaggttctcatgcagaatcagaaa

SEQ ID NO: 538591 - DNA, 25 bp, Homo sapien
ggaaattcagactccatgtgcctga

SEQ ID NO: 538592 - DNA, 25 bp, Homo sapien
gactccatgtgcctgagatcaagaa

SEQ ID NO: 538593 - DNA, 25 bp, Homo sapien
gaatcctgttacaaatcctgcactg

SEQ ID NO: 538594 - DNA, 25 bp, Homo sapien
gtttgtctgattagccaatctcacc

SEQ ID NO: 538595 - DNA, 25 bp, Homo sapien
tagccaatctcaccacccaaatggg

SEQ ID NO: 538596 - DNA, 25 bp, Homo sapien
gggaggtatacatgtttgaagaact

SEQ ID NO: 538597 - DNA, 25 bp, Homo sapien
catgtttgaagaactgtgtaactca

SEQ ID NO: 538598 - DNA, 25 bp, Homo sapien
aactcagtaattgatttgttctgat

SEQ ID NO: 538599 - DNA, 25 bp, Homo sapien
agacagtgtctgttcttttgtgcca

SEQ ID NO: 538600 - DNA, 25 bp, Homo sapien
ttcttttgtgccagctctgtatgat

SEQ ID NO: 538601 - DNA, 25 bp, Homo sapien
gtgccagctctgtatgatgtttgta

SEQ ID NO: 538602 - DNA, 25 bp, Homo sapien
gtttgtaagaccatgtttgtaagac

SEQ ID NO: 538603 - DNA, 25 bp, Homo sapien
gtaagacatgaataaattgctgctt

SEQ ID NO: 538604 - DNA, 25 bp, Homo sapien
agaacttgagttcatgttttatatg

SEQ ID NO: 538605 - DNA, 25 bp, Homo sapien
aacttctttaagctggtaaagtgag

SEQ ID NO: 538606 - DNA, 25 bp, Homo sapien
gcccaccagcagtgatctcctgatg

SEQ ID NO: 538607 - DNA, 25 bp, Homo sapien
agcagtgatctcctgatgccttact

SEQ ID NO: 538608 - DNA, 25 bp, Homo sapien
ctgatgccttactggaaactttgtt

SEQ ID NO: 538609 - DNA, 25 bp, Homo sapien
tgtttacttgtctgctaccctctga

SEQ ID NO: 538610 - DNA, 25 bp, Homo sapien
tctgctaccctctgatttgttttta

SEQ ID NO: 538611 - DNA, 25 bp, Homo sapien
tgctaccctctgatttgtttttagt

SEQ ID NO: 538612 - DNA, 25 bp, Homo sapien
gttagtttttattgtgagcacacat

SEQ ID NO: 538613 - DNA, 25 bp, Homo sapien
ttgtgagcacacatagtacctagtt

SEQ ID NO: 538614 - DNA, 25 bp, Homo sapien
gtacctagttacatcttaagatcag

SEQ ID NO: 538615 - DNA, 25 bp, Homo sapien
acagaaggtcatgagttcagggtca

SEQ ID NO: 538616 - DNA, 25 bp, Homo sapien
ggtcatgagttcagggtcagacgca

SEQ ID NO: 538617 - DNA, 25 bp, Homo sapien
gagttcagggtcagacgcagccgct

SEQ ID NO: 538618 - DNA, 25 bp, Homo sapien
cagggtcagacgcagccgctcagca

SEQ ID NO: 538619 - DNA, 25 bp, Homo sapien
gagagttgctggtagcaggctccct

SEQ ID NO: 538620 - DNA, 25 bp, Homo sapien
ggctctgttcccagcgtttgccaga

SEQ ID NO: 538621 - DNA, 25 bp, Homo sapien
gttcccagcgtttgccagaggtggc

SEQ ID NO: 538622 - DNA, 25 bp, Homo sapien
cagaggtggccacttcagccaagcc

SEQ ID NO: 538623 - DNA, 25 bp, Homo sapien
gccacttcagccaagcccggagaag

SEQ ID NO: 538624 - DNA, 25 bp, Homo sapien
tggatccatggctgactctgcctgg

SEQ ID NO: 538625 - DNA, 25 bp, Homo sapien
atccatggctgactctgcctggagg

SEQ ID NO: 538626 - DNA, 25 bp, Homo sapien
gggaccatggagcagtatacagcaa

SEQ ID NO: 538627 - DNA, 25 bp, Homo sapien
acagcaatagttcgacagagcagat

SEQ ID NO: 538628 - DNA, 25 bp, Homo sapien
cagagcagattgttgtccaggcagg

SEQ ID NO: 538629 - DNA, 25 bp, Homo sapien
gtccaggcaggacagattcagcagc

SEQ ID NO: 538630 - DNA, 25 bp, Homo sapien
gggcagccattaatggtgcaggtca

SEQ ID NO: 538631 - DNA, 25 bp, Homo sapien
tgcaggtcagtggaggccagctaat

SEQ ID NO: 538632 - DNA, 25 bp, Homo sapien
tggaggccagctaatcacatcaact

SEQ ID NO: 538633 - DNA, 25 bp, Homo sapien
acatcaactggccaacccatcatgg

SEQ ID NO: 538634 - DNA, 25 bp, Homo sapien
catgcaagtacctgtttctggaaca

SEQ ID NO: 538635 - DNA, 25 bp, Homo sapien
agcaaatacagttggtcccacctgg

SEQ ID NO: 538636 - DNA, 25 bp, Homo sapien
tccagatccagggtggacaggctgt

SEQ ID NO: 538637 - DNA, 25 bp, Homo sapien
agctgttgccagcagaggtggtgaa

SEQ ID NO: 538638 - DNA, 25 bp, Homo sapien
cagcagaggtggtgaaagtcaacaa

SEQ ID NO: 538639 - DNA, 25 bp, Homo sapien
gtgaaagtcaacaacagggcactgg

SEQ ID NO: 538640 - DNA, 25 bp, Homo sapien
aacagggcactggacacacatagaa

SEQ ID NO: 538641 - DNA, 25 bp, Homo sapien
gggcactggacacacatagaaatgt

SEQ ID NO: 538642 - DNA, 25 bp, Homo sapien
gaaatgtgacccacagctatggttt

SEQ ID NO: 538643 - DNA, 25 bp, Homo sapien
tgtgacccacagctatggtttgcaa

SEQ ID NO: 538644 - DNA, 25 bp, Homo sapien
aagaagtcctgccatgtcctaaatg

SEQ ID NO: 538645 - DNA, 25 bp, Homo sapien
gaagtcctgccatgtcctaaatgcc

SEQ ID NO: 538646 - DNA, 25 bp, Homo sapien
tgccatgtcctaaatgcccaaatcc

SEQ ID NO: 538647 - DNA, 25 bp, Homo sapien
aaatcccttgcctcccatgattctt

SEQ ID NO: 538648 - DNA, 25 bp, Homo sapien
atttcatccagtcctgagctcagct

SEQ ID NO: 538649 - DNA, 25 bp, Homo sapien
gagctcagcttaagggaggcttctt

SEQ ID NO: 538650 - DNA, 25 bp, Homo sapien
gaggcttcttgcctgtgggttccct

SEQ ID NO: 538651 - DNA, 25 bp, Homo sapien
gtttgcctggaattgttctgtacct

SEQ ID NO: 538652 - DNA, 25 bp, Homo sapien
gttctgtacctctttgtagcacgta

SEQ ID NO: 538653 - DNA, 25 bp, Homo sapien
gtacctctttgtagcacgtagtgtt

SEQ ID NO: 538654 - DNA, 25 bp, Homo sapien
actaagccactaattgagtttctgg

SEQ ID NO: 538655 - DNA, 25 bp, Homo sapien
actaattgagtttctggctcccctc

SEQ ID NO: 538656 - DNA, 25 bp, Homo sapien
gggttgtaagttttgttcattcatg

SEQ ID NO: 538657 - DNA, 25 bp, Homo sapien
gttttgttcattcatgagggccgac

SEQ ID NO: 538658 - DNA, 25 bp, Homo sapien
gccacaggagatgtccaataaagta

SEQ ID NO: 538659 - DNA, 25 bp, Homo sapien
ccaggctctgttaaggcactattct

SEQ ID NO: 538660 - DNA, 25 bp, Homo sapien
ggcactattctgctaagaagtatca

SEQ ID NO: 538661 - DNA, 25 bp, Homo sapien
gcgtaggaaacgtaaagtcttgcat

SEQ ID NO: 538662 - DNA, 25 bp, Homo sapien
gtcttgcatcttgtttcccagtgga

SEQ ID NO: 538663 - DNA, 25 bp, Homo sapien
gtttcccagtggattgctctgtaca

SEQ ID NO: 538664 - DNA, 25 bp, Homo sapien
ggattgctctgtacaaagactggtt

SEQ ID NO: 538665 - DNA, 25 bp, Homo sapien
gtacaaagactggttacctgaagat

SEQ ID NO: 538666 - DNA, 25 bp, Homo sapien
ataggaatgtactggatgatgttta

SEQ ID NO: 538667 - DNA, 25 bp, Homo sapien
agatacttggaatgcaccgtcgtca

SEQ ID NO: 538668 - DNA, 25 bp, Homo sapien
gcaccgtcgtcacactgtagatgaa

SEQ ID NO: 538669 - DNA, 25 bp, Homo sapien
gtcacactgtagatgaatattcacc

SEQ ID NO: 538670 - DNA, 25 bp, Homo sapien
ttttgcagaaggtcagctttaaaat

SEQ ID NO: 538671 - DNA, 25 bp, Homo sapien
gaaaaatttccagttgacatgctaa

SEQ ID NO: 538672 - DNA, 25 bp, Homo sapien
aatttccagttgacatgctaagttg

SEQ ID NO: 538673 - DNA, 25 bp, Homo sapien
cagttgacatgctaagttggattaa

SEQ ID NO: 538674 - DNA, 25 bp, Homo sapien
gacatgctaagttggattaaatgct

SEQ ID NO: 538675 - DNA, 25 bp, Homo sapien
gcaccaacctaatactacagttgca

SEQ ID NO: 538676 - DNA, 25 bp, Homo sapien
aacctaatactacagttgcagactt

SEQ ID NO: 538677 - DNA, 25 bp, Homo sapien
aatactacagttgcagacttttatt

SEQ ID NO: 538678 - DNA, 25 bp, Homo sapien
gttgcagacttttattagtgacgct

SEQ ID NO: 538679 - DNA, 25 bp, Homo sapien
gcagacttttattagtgacgctgat

SEQ ID NO: 538680 - DNA, 25 bp, Homo sapien
gacttttattagtgacgctgatctt

SEQ ID NO: 538681 - DNA, 25 bp, Homo sapien
ggccaaggtttcgttatcgttgtct

SEQ ID NO: 538682 - DNA, 25 bp, Homo sapien
cgttatcgttgtctcccatgaaggg

SEQ ID NO: 538683 - DNA, 25 bp, Homo sapien
ggaaaggccactgactctggagaga

SEQ ID NO: 538684 - DNA, 25 bp, Homo sapien
cgcgacgaccagatgagggaattga

SEQ ID NO: 538685 - DNA, 25 bp, Homo sapien
acctgcccaaagattcacagccagt

SEQ ID NO: 538686 - DNA, 25 bp, Homo sapien
tcacagccagtgagattggaagcca

SEQ ID NO: 538687 - DNA, 25 bp, Homo sapien
ggaagccaggtatctgcctctagag

SEQ ID NO: 538688 - DNA, 25 bp, Homo sapien
gcctctagagcctgtcctcttaaat

SEQ ID NO: 538689 - DNA, 25 bp, Homo sapien
atcgaatgcctcgtcgtcgaagtcc

SEQ ID NO: 538690 - DNA, 25 bp, Homo sapien
tcgaagtcccaggtggctgaggtaa

SEQ ID NO: 538691 - DNA, 25 bp, Homo sapien
gctgaggtaacgttggccaaggttt

SEQ ID NO: 538692 - DNA, 25 bp, Homo sapien
gcagcgacattgcatgcagcagagt

SEQ ID NO: 538693 - DNA, 25 bp, Homo sapien
gcagcagagtctttgcttcgaaaga

SEQ ID NO: 538694 - DNA, 25 bp, Homo sapien
gagaacatttatcttagtcccacgt

SEQ ID NO: 538695 - DNA, 25 bp, Homo sapien
tcttagtcccacgttcaggtgagaa

SEQ ID NO: 538696 - DNA, 25 bp, Homo sapien
agaagacctcaaaggtaccctctgt

SEQ ID NO: 538697 - DNA, 25 bp, Homo sapien
tcaaaggtaccctctgtccagaata

SEQ ID NO: 538698 - DNA, 25 bp, Homo sapien
ggaacaatctctcaattggcttttg

SEQ ID NO: 538699 - DNA, 25 bp, Homo sapien
ttggcttttgtcactacacataatg

SEQ ID NO: 538700 - DNA, 25 bp, Homo sapien
ataatgtaatctcccttctttcagc

SEQ ID NO: 538701 - DNA, 25 bp, Homo sapien
ccaacagtgagcatgcttcccaaaa

SEQ ID NO: 538702 - DNA, 25 bp, Homo sapien
aaaaccaggaatgtccccgcatcta

SEQ ID NO: 538703 - DNA, 25 bp, Homo sapien
tagaagcctgcccacgattcctagg

SEQ ID NO: 538704 - DNA, 25 bp, Homo sapien
agcctgcccacgattcctaggaagg

SEQ ID NO: 538705 - DNA, 25 bp, Homo sapien
gcccacgattcctaggaaggctggc

SEQ ID NO: 538706 - DNA, 25 bp, Homo sapien
gggagctactggcaaactctcctgg

SEQ ID NO: 538707 - DNA, 25 bp, Homo sapien
agctactggcaaactctcctggatt

SEQ ID NO: 538708 - DNA, 25 bp, Homo sapien
aaaggctgccctggggatcaacttt

SEQ ID NO: 538709 - DNA, 25 bp, Homo sapien
tgtggctcaggagttcttctgcaga

SEQ ID NO: 538710 - DNA, 25 bp, Homo sapien
tcttctgcagagatggcgctatctt

SEQ ID NO: 538711 - DNA, 25 bp, Homo sapien
agagatggcgctatctttcctcctc

SEQ ID NO: 538712 - DNA, 25 bp, Homo sapien
tgtgatgtcctgctcccaaccattt

SEQ ID NO: 538713 - DNA, 25 bp, Homo sapien
tcccaaccatttgtactcttcatta

SEQ ID NO: 538714 - DNA, 25 bp, Homo sapien
cgccctaatctcagcctttttatat

SEQ ID NO: 538715 - DNA, 25 bp, Homo sapien
cactttttggcatcccctaacaaga

SEQ ID NO: 538716 - DNA, 25 bp, Homo sapien
tttggcatcccctaacaagaagtcc

SEQ ID NO: 538717 - DNA, 25 bp, Homo sapien
atcccctaacaagaagtcctcagag

SEQ ID NO: 538718 - DNA, 25 bp, Homo sapien
agtcctcagagatttttactactca

SEQ ID NO: 538719 - DNA, 25 bp, Homo sapien
ttactactcaacatgtgtgcgtccc

SEQ ID NO: 538720 - DNA, 25 bp, Homo sapien
atgtgtgcgtcccactcagatgtat

SEQ ID NO: 538721 - DNA, 25 bp, Homo sapien
gtgcgtcccactcagatgtattgtg

SEQ ID NO: 538722 - DNA, 25 bp, Homo sapien
tgtattgtgttctttctgttcaccc

SEQ ID NO: 538723 - DNA, 25 bp, Homo sapien
tgttctttctgttcaccctctactt

SEQ ID NO: 538724 - DNA, 25 bp, Homo sapien
ttcttcctctgacttagggttagaa

SEQ ID NO: 538725 - DNA, 25 bp, Homo sapien
ggatacttgcaaggaccaaatgtca

SEQ ID NO: 538726 - DNA, 25 bp, Homo sapien
agatgtggtacccattgagcctcat

SEQ ID NO: 538727 - DNA, 25 bp, Homo sapien
gagcctcatgctctgttcttgggaa

SEQ ID NO: 538728 - DNA, 25 bp, Homo sapien
ctgttcttgggaatccatggaggga

SEQ ID NO: 538729 - DNA, 25 bp, Homo sapien
ctgtcctgtgtcaagtctggtgatg

SEQ ID NO: 538730 - DNA, 25 bp, Homo sapien
tggtgatgagaccagactccagctg

SEQ ID NO: 538731 - DNA, 25 bp, Homo sapien
atgagaccagactccagctggaggc

SEQ ID NO: 538732 - DNA, 25 bp, Homo sapien
ccagctggaggcagttaacatcact

SEQ ID NO: 538733 - DNA, 25 bp, Homo sapien
gttaacatcactgacctgagcgaga

SEQ ID NO: 538734 - DNA, 25 bp, Homo sapien
agaacagaaagcaggacaagcgctt

SEQ ID NO: 538735 - DNA, 25 bp, Homo sapien
tggttcctctgcacagcgatggaag

SEQ ID NO: 538736 - DNA, 25 bp, Homo sapien
aaccggctttgagggcttctccagc

SEQ ID NO: 538737 - DNA, 25 bp, Homo sapien
ttgagggcttctccagcttttaaga

SEQ ID NO: 538738 - DNA, 25 bp, Homo sapien
agggcttctccagcttttaagatgc

SEQ ID NO: 538739 - DNA, 25 bp, Homo sapien
gcttctccagcttttaagatgcgat

SEQ ID NO: 538740 - DNA, 25 bp, Homo sapien
ccagcttttaagatgcgataatgat

SEQ ID NO: 538741 - DNA, 25 bp, Homo sapien
ttatggcttaaggttgcctcgctcc

SEQ ID NO: 538742 - DNA, 25 bp, Homo sapien
tggcttaaggttgcctcgctcctca

SEQ ID NO: 538743 - DNA, 25 bp, Homo sapien
ctcgctcctcatctgtaatcagtga

SEQ ID NO: 538744 - DNA, 25 bp, Homo sapien
gctcctcatctgtaatcagtgaaag

SEQ ID NO: 538745 - DNA, 25 bp, Homo sapien
taatcagtgaaagtttatccagagg

SEQ ID NO: 538746 - DNA, 25 bp, Homo sapien
ttaccggttttctggtgggtatctg

SEQ ID NO: 538747 - DNA, 25 bp, Homo sapien
gtgcagctgtttgatctccagaaaa

SEQ ID NO: 538748 - DNA, 25 bp, Homo sapien
agaaaagctcccagaaacccacagt

SEQ ID NO: 538749 - DNA, 25 bp, Homo sapien
gaaacccacagttttgatcaagcaa

SEQ ID NO: 538750 - DNA, 25 bp, Homo sapien
ggatgaaagccctgtctactgtctg

SEQ ID NO: 538751 - DNA, 25 bp, Homo sapien
cctgtctactgtctggagttcaaca

SEQ ID NO: 538752 - DNA, 25 bp, Homo sapien
agttcaacagccagcagactcagct

SEQ ID NO: 538753 - DNA, 25 bp, Homo sapien
agactcagctcttggctgcgggcga

SEQ ID NO: 538754 - DNA, 25 bp, Homo sapien
cagagttcacggaacaagggccccg

SEQ ID NO: 538755 - DNA, 25 bp, Homo sapien
ctgaggacctggactgcctggcagc

SEQ ID NO: 538756 - DNA, 25 bp, Homo sapien
cgggtgcaagccttcgctgtgccga

SEQ ID NO: 538757 - DNA, 25 bp, Homo sapien
agccttgtgtttctgacgcaagcca

SEQ ID NO: 538758 - DNA, 25 bp, Homo sapien
gatttttctaactgatagttttcac

SEQ ID NO: 538759 - DNA, 25 bp, Homo sapien
atagttttcactcatttataatcag

SEQ ID NO: 538760 - DNA, 25 bp, Homo sapien
agtaggagagactgtctagatgttg

SEQ ID NO: 538761 - DNA, 25 bp, Homo sapien
gggcagctctatgatttaagtctgt

SEQ ID NO: 538762 - DNA, 25 bp, Homo sapien
gttataactgaatttagtaccctag

SEQ ID NO: 538763 - DNA, 25 bp, Homo sapien
ttcttttaatgacttctggatcctg

SEQ ID NO: 538764 - DNA, 25 bp, Homo sapien
taatgacttctggatcctgagctcc

SEQ ID NO: 538765 - DNA, 25 bp, Homo sapien
ctccctttgcagtctgaaaaaggta

SEQ ID NO: 538766 - DNA, 25 bp, Homo sapien
aggtattgcagtcagaactgtgtac

SEQ ID NO: 538767 - DNA, 25 bp, Homo sapien
gatgataaaagcctctggtagcaat

SEQ ID NO: 538768 - DNA, 25 bp, Homo sapien
aagcctctggtagcaataaaaagtt

SEQ ID NO: 538769 - DNA, 25 bp, Homo sapien
tgggaggctgcctaagcctgtctgt

SEQ ID NO: 538770 - DNA, 25 bp, Homo sapien
gaggctgcctaagcctgtctgtgct

SEQ ID NO: 538771 - DNA, 25 bp, Homo sapien
atgagctgtggccacaggtgagcaa

SEQ ID NO: 538772 - DNA, 25 bp, Homo sapien
tggccacaggtgagcaaggcaggga

SEQ ID NO: 538773 - DNA, 25 bp, Homo sapien
aggcagggaactgcaatccagccct

SEQ ID NO: 538774 - DNA, 25 bp, Homo sapien
gccaatgctgctgtgccttcaagga

SEQ ID NO: 538775 - DNA, 25 bp, Homo sapien
ccttcaaggactgacaagttacgta

SEQ ID NO: 538776 - DNA, 25 bp, Homo sapien
ttcaaggactgacaagttacgtagg

SEQ ID NO: 538777 - DNA, 25 bp, Homo sapien
ggcagaggtcgccagctagccagtg

SEQ ID NO: 538778 - DNA, 25 bp, Homo sapien
tctgtccacttgtcaccttaggttt

SEQ ID NO: 538779 - DNA, 25 bp, Homo sapien
gttttcactcatttgtcaccttggg

SEQ ID NO: 538780 - DNA, 25 bp, Homo sapien
tgaagcccctttgggtttaagagca

SEQ ID NO: 538781 - DNA, 25 bp, Homo sapien
tttgttcttcctgcaacttctgctg

SEQ ID NO: 538782 - DNA, 25 bp, Homo sapien
tgcctgagctgccatgcttgtaatc

SEQ ID NO: 538783 - DNA, 25 bp, Homo sapien
atgcttgtaatccagcgtccatttc

SEQ ID NO: 538784 - DNA, 25 bp, Homo sapien
gtaatccagcgtccatttcctgtga

SEQ ID NO: 538785 - DNA, 25 bp, Homo sapien
ttcctgtgacagcagtacaactcgt

SEQ ID NO: 538786 - DNA, 25 bp, Homo sapien
gtacaactcgtcttgcaaacgtctc

SEQ ID NO: 538787 - DNA, 25 bp, Homo sapien
cggccatccgcatatgaccagtctg

SEQ ID NO: 538788 - DNA, 25 bp, Homo sapien
gaggcaggagttgctttttattgac

SEQ ID NO: 538789 - DNA, 25 bp, Homo sapien
attgacttggaagtgggctcttcag

SEQ ID NO: 538790 - DNA, 25 bp, Homo sapien
ggctcttcagtgaagcccctttggg

SEQ ID NO: 538791 - DNA, 25 bp, Homo sapien
aatgagcatgattcccagagtcaaa

SEQ ID NO: 538792 - DNA, 25 bp, Homo sapien
gcatgattcccagagtcaaacccaa

SEQ ID NO: 538793 - DNA, 25 bp, Homo sapien
aagaaccagcctcataacctgggag

SEQ ID NO: 538794 - DNA, 25 bp, Homo sapien
cataacctgggagcagcgcctgcag

SEQ ID NO: 538795 - DNA, 25 bp, Homo sapien
gcctgcaggcaggtgtatgcatcca

SEQ ID NO: 538796 - DNA, 25 bp, Homo sapien
gcaggtgtatgcatccatgaaagac

SEQ ID NO: 538797 - DNA, 25 bp, Homo sapien
gaaagactggttagagctggcctca

SEQ ID NO: 538798 - DNA, 25 bp, Homo sapien
agagctggcctcaggttctgcagga

SEQ ID NO: 538799 - DNA, 25 bp, Homo sapien
tctgcaggacccacatccatttttt

SEQ ID NO: 538800 - DNA, 25 bp, Homo sapien
ttcatttgtcagaaacggatagtga

SEQ ID NO: 538801 - DNA, 25 bp, Homo sapien
atctctactggctggctttgtggaa

SEQ ID NO: 538802 - DNA, 25 bp, Homo sapien
gtgaatccgctggtgacgccgcaga

SEQ ID NO: 538803 - DNA, 25 bp, Homo sapien
atctccggcattggtaacgctccat

SEQ ID NO: 538804 - DNA, 25 bp, Homo sapien
taacgctccatgctcttgtgggctt

SEQ ID NO: 538805 - DNA, 25 bp, Homo sapien
tctccaccatcactctgaaagtgtc

SEQ ID NO: 538806 - DNA, 25 bp, Homo sapien
agccaatagttggtgaacgtgtcac

SEQ ID NO: 538807 - DNA, 25 bp, Homo sapien
cacacttgtgtggtaggaccttgaa

SEQ ID NO: 538808 - DNA, 25 bp, Homo sapien
ggaccttgaagtctaagttgctttc

SEQ ID NO: 538809 - DNA, 25 bp, Homo sapien
tctaagttgctttcctgagtattct

SEQ ID NO: 538810 - DNA, 25 bp, Homo sapien
tcttttcctgcttgtgatagtcaac

SEQ ID NO: 538811 - DNA, 25 bp, Homo sapien
gatagtcaacaactgaaacccctca

SEQ ID NO: 538812 - DNA, 25 bp, Homo sapien
atgccctgaaataaaggtcccggat

SEQ ID NO: 538813 - DNA, 25 bp, Homo sapien
ggctccagctgttgccagcagaggt

SEQ ID NO: 538814 - DNA, 25 bp, Homo sapien
cagcagaggtggtgaaagtcaacaa

SEQ ID NO: 538815 - DNA, 25 bp, Homo sapien
gtgaaagtcaacaacagggcactgg

SEQ ID NO: 538816 - DNA, 25 bp, Homo sapien
aacagggcactggacacacatagaa

SEQ ID NO: 538817 - DNA, 25 bp, Homo sapien
gggcactggacacacatagaaatgt

SEQ ID NO: 538818 - DNA, 25 bp, Homo sapien
gaaatgtgacccacagctatggttt

SEQ ID NO: 538819 - DNA, 25 bp, Homo sapien
tgtgacccacagctatggtttgcaa

SEQ ID NO: 538820 - DNA, 25 bp, Homo sapien
aagaagtcctgccatgtcctaaatg

SEQ ID NO: 538821 - DNA, 25 bp, Homo sapien
tgccatgtcctaaatgcccaaatcc

SEQ ID NO: 538822 - DNA, 25 bp, Homo sapien
aaatcccttgcctcccatgattctt

SEQ ID NO: 538823 - DNA, 25 bp, Homo sapien
ctcccatgattcttctcctcaaagg

SEQ ID NO: 538824 - DNA, 25 bp, Homo sapien
gatttatctcgtgatctagacaaag

SEQ ID NO: 538825 - DNA, 25 bp, Homo sapien
catattgtgttcaaaccatctgggt

SEQ ID NO: 538826 - DNA, 25 bp, Homo sapien
aaaccatctgggtgagcctcaagtt

SEQ ID NO: 538827 - DNA, 25 bp, Homo sapien
gagcctcaagttattactaagcagt

SEQ ID NO: 538828 - DNA, 25 bp, Homo sapien
cagtttatccaattgcatcagcatt

SEQ ID NO: 538829 - DNA, 25 bp, Homo sapien
cagcattgattgacctgctgcttat

SEQ ID NO: 538830 - DNA, 25 bp, Homo sapien
cctgctgcttattcagagggattag

SEQ ID NO: 538831 - DNA, 25 bp, Homo sapien
agaagcgagctctggctgtgacatc

SEQ ID NO: 538832 - DNA, 25 bp, Homo sapien
agctctggctgtgacatcagttgtc

SEQ ID NO: 538833 - DNA, 25 bp, Homo sapien
agaactgggatggaacgccacctct

SEQ ID NO: 538834 - DNA, 25 bp, Homo sapien
tgtcacctggttcctgcttttggct

SEQ ID NO: 538835 - DNA, 25 bp, Homo sapien
tacaccggccgagcagggaccttaa

SEQ ID NO: 538836 - DNA, 25 bp, Homo sapien
ggccgagcagggaccttaagaagca

SEQ ID NO: 538837 - DNA, 25 bp, Homo sapien
aagcaggcgtgggagcagggtccca

SEQ ID NO: 538838 - DNA, 25 bp, Homo sapien
tgggagcagggtcccagctcagacg

SEQ ID NO: 538839 - DNA, 25 bp, Homo sapien
agctcagacgagttccaccttggca

SEQ ID NO: 538840 - DNA, 25 bp, Homo sapien
agacgagttccaccttggcattggg

SEQ ID NO: 538841 - DNA, 25 bp, Homo sapien
gcagaggagctttattagagggaca

SEQ ID NO: 538842 - DNA, 25 bp, Homo sapien
agctttattagagggacagggtgaa

SEQ ID NO: 538843 - DNA, 25 bp, Homo sapien
gagggacagggtgaaacatatttac

SEQ ID NO: 538844 - DNA, 25 bp, Homo sapien
gaaacatatttacaccggccgagca

SEQ ID NO: 538845 - DNA, 25 bp, Homo sapien
aacatatttacaccggccgagcagg

SEQ ID NO: 538846 - DNA, 25 bp, Homo sapien
tctggtgtggccttgtagctagtgc

SEQ ID NO: 538847 - DNA, 25 bp, Homo sapien
gccttgtagctagtgcctgggcaca

SEQ ID NO: 538848 - DNA, 25 bp, Homo sapien
tgcctgggcacaggtgtttttcttt

SEQ ID NO: 538849 - DNA, 25 bp, Homo sapien
gttttacctagtgctgggagttcag

SEQ ID NO: 538850 - DNA, 25 bp, Homo sapien
gtgctgggagttcagttctttttcc

SEQ ID NO: 538851 - DNA, 25 bp, Homo sapien
tccagagcctaatttttcccagatg

SEQ ID NO: 538852 - DNA, 25 bp, Homo sapien
ttcccagatgcatatttagctctag

SEQ ID NO: 538853 - DNA, 25 bp, Homo sapien
ctttagctgcctgaactgactgagg

SEQ ID NO: 538854 - DNA, 25 bp, Homo sapien
tgaactgactgaggcccactcacta

SEQ ID NO: 538855 - DNA, 25 bp, Homo sapien
gaggcccactcactagagccatgtt

SEQ ID NO: 538856 - DNA, 25 bp, Homo sapien
gagccatgttcagtgctactgtgat

SEQ ID NO: 538857 - DNA, 25 bp, Homo sapien
ggaactggagttattctacgctaat

SEQ ID NO: 538858 - DNA, 25 bp, Homo sapien
agttattctacgctaatggattgga

SEQ ID NO: 538859 - DNA, 25 bp, Homo sapien
taaatcttttctaactatgccctaa

SEQ ID NO: 538860 - DNA, 25 bp, Homo sapien
tatgccctaaactgcagaactcaaa

SEQ ID NO: 538861 - DNA, 25 bp, Homo sapien
tagtgccattgttagtagtcattct

SEQ ID NO: 538862 - DNA, 25 bp, Homo sapien
ggagtatctctccagttattcccag

SEQ ID NO: 538863 - DNA, 25 bp, Homo sapien
gttattcccagattcactagtgatc

SEQ ID NO: 538864 - DNA, 25 bp, Homo sapien
agtgatccttaaagtctctattcag

SEQ ID NO: 538865 - DNA, 25 bp, Homo sapien
gaagacactttccatctcagagata

SEQ ID NO: 538866 - DNA, 25 bp, Homo sapien
gatagactcgtgttaccttgatgga

SEQ ID NO: 538867 - DNA, 25 bp, Homo sapien
attggatttgtctaagtctcttcta

SEQ ID NO: 538868 - DNA, 25 bp, Homo sapien
gccacagcctgtgctaaagagccat

SEQ ID NO: 538869 - DNA, 25 bp, Homo sapien
ccacagcctgtgctaaagagccatg

SEQ ID NO: 538870 - DNA, 25 bp, Homo sapien
acagcctgtgctaaagagccatgga

SEQ ID NO: 538871 - DNA, 25 bp, Homo sapien
agcctgtgctaaagagccatggagc

SEQ ID NO: 538872 - DNA, 25 bp, Homo sapien
tcaccccagggttctttctgcagag

SEQ ID NO: 538873 - DNA, 25 bp, Homo sapien
accccagggttctttctgcagagca

SEQ ID NO: 538874 - DNA, 25 bp, Homo sapien
agttttcattcttatttgactatgt

SEQ ID NO: 538875 - DNA, 25 bp, Homo sapien
cattcttatttgactatgtatatgt

SEQ ID NO: 538876 - DNA, 25 bp, Homo sapien
tgtaaagaaacgatcctatgcattg

SEQ ID NO: 538877 - DNA, 25 bp, Homo sapien
agaaacgatcctatgcattgtcttt

SEQ ID NO: 538878 - DNA, 25 bp, Homo sapien
aaacgatcctatgcattgtctttct

SEQ ID NO: 538879 - DNA, 25 bp, Homo sapien
tgtttgttcatttaatagcttctaa

SEQ ID NO: 538880 - DNA, 25 bp, Homo sapien
taatagcttctaaaaggcctttttg

SEQ ID NO: 538881 - DNA, 25 bp, Homo sapien
ggcctttttgttatacagtgctttt

SEQ ID NO: 538882 - DNA, 25 bp, Homo sapien
actgtaataatgtcttgtttttagc

SEQ ID NO: 538883 - DNA, 25 bp, Homo sapien
tgtttttagccatgtaactacaaac

SEQ ID NO: 538884 - DNA, 25 bp, Homo sapien
gtaactacaaacagatattctcttg

SEQ ID NO: 538885 - DNA, 25 bp, Homo sapien
gatattctcttgatgtcttagtaaa

SEQ ID NO: 538886 - DNA, 25 bp, Homo sapien
gatgtcttagtaaatttgcatttga

SEQ ID NO: 538887 - DNA, 25 bp, Homo sapien
tacgcatctgtccagcatcttatta

SEQ ID NO: 538888 - DNA, 25 bp, Homo sapien
ctgtccagcatcttattaaccataa

SEQ ID NO: 538889 - DNA, 25 bp, Homo sapien
attatttggaaatatgtcctatgga

SEQ ID NO: 538890 - DNA, 25 bp, Homo sapien
tcagattttctatgttctaaggaca

SEQ ID NO: 538891 - DNA, 25 bp, Homo sapien
tgttctaaggacatggctgctgtag

SEQ ID NO: 538892 - DNA, 25 bp, Homo sapien
gctgctgtagaatagcacagacgtg

SEQ ID NO: 538893 - DNA, 25 bp, Homo sapien
aattatccccagaagcagcatgaca

SEQ ID NO: 538894 - DNA, 25 bp, Homo sapien
ggaagggaaattgcagttctgttga

SEQ ID NO: 538895 - DNA, 25 bp, Homo sapien
aatcccttggtaaagacacagcctg

SEQ ID NO: 538896 - DNA, 25 bp, Homo sapien
aagacacagcctgttaggctcgtgt

SEQ ID NO: 538897 - DNA, 25 bp, Homo sapien
gttaggctcgtgtgggcctccagta

SEQ ID NO: 538898 - DNA, 25 bp, Homo sapien
tgggcctccagtatgttcaccaggg

SEQ ID NO: 538899 - DNA, 25 bp, Homo sapien
aatggctgggatttctcggcactct

SEQ ID NO: 538900 - DNA, 25 bp, Homo sapien
tcggcactctgcatcatccatcttt

SEQ ID NO: 538901 - DNA, 25 bp, Homo sapien
ctgagtctcctccaattgttgagga

SEQ ID NO: 538902 - DNA, 25 bp, Homo sapien
aaacagaggcaatcggttgcaagac

SEQ ID NO: 538903 - DNA, 25 bp, Homo sapien
gttgcaagacaacagacagttcaga

SEQ ID NO: 538904 - DNA, 25 bp, Homo sapien
gggtggccaagtgacaatcgatcca

SEQ ID NO: 538905 - DNA, 25 bp, Homo sapien
agtgacaatcgatccaatcagtggc

SEQ ID NO: 538906 - DNA, 25 bp, Homo sapien
aatcagtggcatggacgatcctggg

SEQ ID NO: 538907 - DNA, 25 bp, Homo sapien
gggtaacaactacccgcaacacaga

SEQ ID NO: 538908 - DNA, 25 bp, Homo sapien
tacccgcaacacagacaagaacctt

SEQ ID NO: 538909 - DNA, 25 bp, Homo sapien
gaaccttactatccccagcaatatg

SEQ ID NO: 538910 - DNA, 25 bp, Homo sapien
tggacattatggttacaaccagcgg

SEQ ID NO: 538911 - DNA, 25 bp, Homo sapien
cctccttacggttactactgataga

SEQ ID NO: 538912 - DNA, 25 bp, Homo sapien
aataactattggtaacttcaggaat

SEQ ID NO: 538913 - DNA, 25 bp, Homo sapien
aacttcaggaatttgtcagttgcct

SEQ ID NO: 538914 - DNA, 25 bp, Homo sapien
gaatttgtcagttgccttatgtgag

SEQ ID NO: 538915 - DNA, 25 bp, Homo sapien
gtcagttgccttatgtgaggatgaa

SEQ ID NO: 538916 - DNA, 25 bp, Homo sapien
gatgaatagatccaccaagcacgcc

SEQ ID NO: 538917 - DNA, 25 bp, Homo sapien
agatccaccaagcacgcctataata

SEQ ID NO: 538918 - DNA, 25 bp, Homo sapien
caagcacgcctataatacaaagtaa

SEQ ID NO: 538919 - DNA, 25 bp, Homo sapien
tctgtccatttcattttacaattat

SEQ ID NO: 538920 - DNA, 25 bp, Homo sapien
tatcttaccacttatttttgtacca

SEQ ID NO: 538921 - DNA, 25 bp, Homo sapien
gtaccatgtatttcaattgcctgtt

SEQ ID NO: 538922 - DNA, 25 bp, Homo sapien
atgtatttcaattgcctgtttagtg

SEQ ID NO: 538923 - DNA, 25 bp, Homo sapien
cacgagaaacgtggataaacctaag

SEQ ID NO: 538924 - DNA, 25 bp, Homo sapien
tcctatattgtaacctggtcacgag

SEQ ID NO: 538925 - DNA, 25 bp, Homo sapien
tatattgtaacctggtcacgagatg

SEQ ID NO: 538926 - DNA, 25 bp, Homo sapien
ttgtaacctggtcacgagatgatat

SEQ ID NO: 538927 - DNA, 25 bp, Homo sapien
gtaacctggtcacgagatgatatgt

SEQ ID NO: 538928 - DNA, 25 bp, Homo sapien
cctggtcacgagatgatatgtggta

SEQ ID NO: 538929 - DNA, 25 bp, Homo sapien
gatatgtggtaaggttaaccaacaa

SEQ ID NO: 538930 - DNA, 25 bp, Homo sapien
tcagggctgcctcctttgactgtgg

SEQ ID NO: 538931 - DNA, 25 bp, Homo sapien
tgcctcctttgactgtggtgaagca

SEQ ID NO: 538932 - DNA, 25 bp, Homo sapien
tcctttgactgtggtgaagcagcct

SEQ ID NO: 538933 - DNA, 25 bp, Homo sapien
ctttgactgtggtgaagcagcctgg

SEQ ID NO: 538934 - DNA, 25 bp, Homo sapien
agaaactctggtccttctgtctggt

SEQ ID NO: 538935 - DNA, 25 bp, Homo sapien
gtccttctgtctggtggcacttaga

SEQ ID NO: 538936 - DNA, 25 bp, Homo sapien
gtctggtggcacttagagtcttttg

SEQ ID NO: 538937 - DNA, 25 bp, Homo sapien
cacttagagtcttttgtgccataat

SEQ ID NO: 538938 - DNA, 25 bp, Homo sapien
gtcttttgtgccataatgcagcagt

SEQ ID NO: 538939 - DNA, 25 bp, Homo sapien
cagcagtatggagggaggattttat

SEQ ID NO: 538940 - DNA, 25 bp, Homo sapien
tttcagggacttttctagctgtatg

SEQ ID NO: 538941 - DNA, 25 bp, Homo sapien
ggtatctttcatctgaccatccata

SEQ ID NO: 538942 - DNA, 25 bp, Homo sapien
gaccatccatatccaatgttctcat

SEQ ID NO: 538943 - DNA, 25 bp, Homo sapien
ttaaacattacccagcatcattgtt

SEQ ID NO: 538944 - DNA, 25 bp, Homo sapien
acccagcatcattgtttataatcag

SEQ ID NO: 538945 - DNA, 25 bp, Homo sapien
atatgtgtaggatggcattcatgaa

SEQ ID NO: 538946 - DNA, 25 bp, Homo sapien
gcattcatgaaagcactgcttttta

SEQ ID NO: 538947 - DNA, 25 bp, Homo sapien
gtgacccaaacacctagaaattcat

SEQ ID NO: 538948 - DNA, 25 bp, Homo sapien
gacccaaacacctagaaattcatca

SEQ ID NO: 538949 - DNA, 25 bp, Homo sapien
atcaaaaatagcttctatcgaggct

SEQ ID NO: 538950 - DNA, 25 bp, Homo sapien
cctgtgctgcagtgatttccataat

SEQ ID NO: 538951 - DNA, 25 bp, Homo sapien
tgtgctgcagtgatttccataatac

SEQ ID NO: 538952 - DNA, 25 bp, Homo sapien
tgctgcagtgatttccataatactt

SEQ ID NO: 538953 - DNA, 25 bp, Homo sapien
cacagggtgggtgcttagtgaacct

SEQ ID NO: 538954 - DNA, 25 bp, Homo sapien
gtgggtgcttagtgaacctgttcaa

SEQ ID NO: 538955 - DNA, 25 bp, Homo sapien
gaacctgttcaagatttactttgta

SEQ ID NO: 538956 - DNA, 25 bp, Homo sapien
atggcgcccatgtgtttggtcaaac

SEQ ID NO: 538957 - DNA, 25 bp, Homo sapien
acttatggttattggtgattaacac

SEQ ID NO: 538958 - DNA, 25 bp, Homo sapien
gattaacacttaatgcgtctcctct

SEQ ID NO: 538959 - DNA, 25 bp, Homo sapien
atgcgtctcctctgattttgtgttc

SEQ ID NO: 538960 - DNA, 25 bp, Homo sapien
tttgtgttccatgaggtgcttggaa

SEQ ID NO: 538961 - DNA, 25 bp, Homo sapien
gcttggaacatttggagtgctctgt

SEQ ID NO: 538962 - DNA, 25 bp, Homo sapien
aacatttggagtgctctgtgcgagg

SEQ ID NO: 538963 - DNA, 25 bp, Homo sapien
gtgctctgtgcgagggacatacagt

SEQ ID NO: 538964 - DNA, 25 bp, Homo sapien
taatacccaaaacccactttatcag

SEQ ID NO: 538965 - DNA, 25 bp, Homo sapien
acccactttatcagatatggtattg

SEQ ID NO: 538966 - DNA, 25 bp, Homo sapien
aacttggtgaggctatggcgcccat

SEQ ID NO: 538967 - DNA, 25 bp, Homo sapien
gcgagaaagctgactccattcatca

SEQ ID NO: 538968 - DNA, 25 bp, Homo sapien
gactccattcatcagatccagttta

SEQ ID NO: 538969 - DNA, 25 bp, Homo sapien
tgagcaagggctgtctgcagaaacc

SEQ ID NO: 538970 - DNA, 25 bp, Homo sapien
gagctgctgaatgaagtgtcccttc

SEQ ID NO: 538971 - DNA, 25 bp, Homo sapien
gaagtgtcccttcccatcagtttga

SEQ ID NO: 538972 - DNA, 25 bp, Homo sapien
gcatcatttgacataaagcacttgt

SEQ ID NO: 538973 - DNA, 25 bp, Homo sapien
aaagcacttgttcacagatctccaa

SEQ ID NO: 538974 - DNA, 25 bp, Homo sapien
ttgttcacagatctccaaaaccagg

SEQ ID NO: 538975 - DNA, 25 bp, Homo sapien
gggagttaaatctgttcagctgtta

SEQ ID NO: 538976 - DNA, 25 bp, Homo sapien
tattaaactgtcatttctcccgcta

SEQ ID NO: 538977 - DNA, 25 bp, Homo sapien
tcccgctaaatgaaaaccgtgttgt

SEQ ID NO: 538978 - DNA, 25 bp, Homo sapien
agggatgaccacatcggtgcgctgc

SEQ ID NO: 538979 - DNA, 25 bp, Homo sapien
gacgccagccgtgacatgaagcaga

SEQ ID NO: 538980 - DNA, 25 bp, Homo sapien
gtgcccctcttcaaggacattgtgg

SEQ ID NO: 538981 - DNA, 25 bp, Homo sapien
aaggacattgtggtgcccagcctga

SEQ ID NO: 538982 - DNA, 25 bp, Homo sapien
tggtgcccagcctgaacgtggccaa

SEQ ID NO: 538983 - DNA, 25 bp, Homo sapien
aagctgctcaagtagcctccgccgg

SEQ ID NO: 538984 - DNA, 25 bp, Homo sapien
tcggtccctgcctttagaaacgcgg

SEQ ID NO: 538985 - DNA, 25 bp, Homo sapien
aaacgcgggacagctgattgctctc

SEQ ID NO: 538986 - DNA, 25 bp, Homo sapien
gacagctgattgctctccttggcca

SEQ ID NO: 538987 - DNA, 25 bp, Homo sapien
tggccacacgtgctccttttagctg

SEQ ID NO: 538988 - DNA, 25 bp, Homo sapien
tagctgcacggcctgtctttaggtg

SEQ ID NO: 538989 - DNA, 25 bp, Homo sapien
tggaggagggtttaagcattaagat

SEQ ID NO: 538990 - DNA, 25 bp, Homo sapien
taagcattaagataggaagcaggaa

SEQ ID NO: 538991 - DNA, 25 bp, Homo sapien
gcaggaaatttgattgctctaaatt

SEQ ID NO: 538992 - DNA, 25 bp, Homo sapien
ggtggtaatgataattgaggcaaat

SEQ ID NO: 538993 - DNA, 25 bp, Homo sapien
gtatttattttggtgacattttgca

SEQ ID NO: 538994 - DNA, 25 bp, Homo sapien
ttctgaaataggaccttcaagatcc

SEQ ID NO: 538995 - DNA, 25 bp, Homo sapien
aaataggaccttcaagatcctaggg

SEQ ID NO: 538996 - DNA, 25 bp, Homo sapien
ataaaaaatcttctgcccacactgg

SEQ ID NO: 538997 - DNA, 25 bp, Homo sapien
taaaaaatcttctgcccacactggc

SEQ ID NO: 538998 - DNA, 25 bp, Homo sapien
aaaaaatcttctgcccacactggca

SEQ ID NO: 538999 - DNA, 25 bp, Homo sapien
cacactggcattttaaggtgactga

SEQ ID NO: 539000 - DNA, 25 bp, Homo sapien
gggaacagcgagatgccccaccacc

SEQ ID NO: 539001 - DNA, 25 bp, Homo sapien
ctcctggcgagtccttcctgttcag

SEQ ID NO: 539002 - DNA, 25 bp, Homo sapien
ctggcgagtccttcctgttcagctc

SEQ ID NO: 539003 - DNA, 25 bp, Homo sapien
cctgtgcgaccctccagggatgcag

SEQ ID NO: 539004 - DNA, 25 bp, Homo sapien
caggggatccaggattctctgccct

SEQ ID NO: 539005 - DNA, 25 bp, Homo sapien
ctgccctgtcacacggcgagtcaga

SEQ ID NO: 539006 - DNA, 25 bp, Homo sapien
tggccccaggcagagttttgcacca

SEQ ID NO: 539007 - DNA, 25 bp, Homo sapien
cccaggcagagttttgcaccagcag

SEQ ID NO: 539008 - DNA, 25 bp, Homo sapien
gcagagttttgcaccagcaggaccc

SEQ ID NO: 539009 - DNA, 25 bp, Homo sapien
cagcaggacccctttgagggccttc

SEQ ID NO: 539010 - DNA, 25 bp, Homo sapien
gccttcaaggctctcccaggagtcc

SEQ ID NO: 539011 - DNA, 25 bp, Homo sapien
gccgcctgggttccacttccagcaa

SEQ ID NO: 539012 - DNA, 25 bp, Homo sapien
agcaacagctcctgcagcagtaccg

SEQ ID NO: 539013 - DNA, 25 bp, Homo sapien
aacagctcctgcagcagtaccgagt

SEQ ID NO: 539014 - DNA, 25 bp, Homo sapien
agctcctgcagcagtaccgagtgcc

SEQ ID NO: 539015 - DNA, 25 bp, Homo sapien
tccccaaggctgacccgggtcattg

SEQ ID NO: 539016 - DNA, 25 bp, Homo sapien
acccgggtcattggtgggccagctt

SEQ ID NO: 539017 - DNA, 25 bp, Homo sapien
cgggtcattggtgggccagcttctt

SEQ ID NO: 539018 - DNA, 25 bp, Homo sapien
gaccttcgcatcaacacagcagaca

SEQ ID NO: 539019 - DNA, 25 bp, Homo sapien
ttcgcatcaacacagcagacaccaa

SEQ ID NO: 539020 - DNA, 25 bp, Homo sapien
tcgcatcaacacagcagacaccaaa

SEQ ID NO: 539021 - DNA, 25 bp, Homo sapien
agcagacaccaaaaaccagtgagag

SEQ ID NO: 539022 - DNA, 25 bp, Homo sapien
acatcattaaatcacgtgcctgctt

SEQ ID NO: 539023 - DNA, 25 bp, Homo sapien
catcattaaatcacgtgcctgcttc

SEQ ID NO: 539024 - DNA, 25 bp, Homo sapien
atcattaaatcacgtgcctgcttcc

SEQ ID NO: 539025 - DNA, 25 bp, Homo sapien
agaactctgccccagagcacatcag

SEQ ID NO: 539026 - DNA, 25 bp, Homo sapien
tctgccccagagcacatcagctatg

SEQ ID NO: 539027 - DNA, 25 bp, Homo sapien
ctgccccagagcacatcagctatgt

SEQ ID NO: 539028 - DNA, 25 bp, Homo sapien
tgccccagagcacatcagctatgtg

SEQ ID NO: 539029 - DNA, 25 bp, Homo sapien
agctatgtgccccagctctcaaacg

SEQ ID NO: 539030 - DNA, 25 bp, Homo sapien
gctatgtgccccagctctcaaacga

SEQ ID NO: 539031 - DNA, 25 bp, Homo sapien
tatgtgccccagctctcaaacgaca

SEQ ID NO: 539032 - DNA, 25 bp, Homo sapien
gccccagctctcaaacgacaccttg

SEQ ID NO: 539033 - DNA, 25 bp, Homo sapien
aatgacagaggccatgtccaaaatc

SEQ ID NO: 539034 - DNA, 25 bp, Homo sapien
tgacagaggccatgtccaaaatccc

SEQ ID NO: 539035 - DNA, 25 bp, Homo sapien
ttttctaagccaggactggttttag

SEQ ID NO: 539036 - DNA, 25 bp, Homo sapien
agccaggactggttttagtcaggtc

SEQ ID NO: 539037 - DNA, 25 bp, Homo sapien
ccaggactggttttagtcaggtcct

SEQ ID NO: 539038 - DNA, 25 bp, Homo sapien
tacgggtaaggaaggcacccaacag

SEQ ID NO: 539039 - DNA, 25 bp, Homo sapien
gtaaggaaggcacccaacagggctt

SEQ ID NO: 539040 - DNA, 25 bp, Homo sapien
aggaaggcacccaacagggctttca

SEQ ID NO: 539041 - DNA, 25 bp, Homo sapien
gaaggcacccaacagggctttcaca

SEQ ID NO: 539042 - DNA, 25 bp, Homo sapien
aggcacccaacagggctttcacaat

SEQ ID NO: 539043 - DNA, 25 bp, Homo sapien
agtgttaaaagagaggcacaggccg

SEQ ID NO: 539044 - DNA, 25 bp, Homo sapien
atcagttaaatatccccttcttctc

SEQ ID NO: 539045 - DNA, 25 bp, Homo sapien
ttcttctcaccctgccaaaattagc

SEQ ID NO: 539046 - DNA, 25 bp, Homo sapien
ctgccaaaattagcagttggatttt

SEQ ID NO: 539047 - DNA, 25 bp, Homo sapien
tgttgtttttcgtcttccaaaggtg

SEQ ID NO: 539048 - DNA, 25 bp, Homo sapien
gaaagctatgatacagttccactta

SEQ ID NO: 539049 - DNA, 25 bp, Homo sapien
gatacagttccacttaaattttagt

SEQ ID NO: 539050 - DNA, 25 bp, Homo sapien
tactcagctcaagcattaatttttg

SEQ ID NO: 539051 - DNA, 25 bp, Homo sapien
taagtcttaatctgcatgacctgtg

SEQ ID NO: 539052 - DNA, 25 bp, Homo sapien
taatctgcatgacctgtgaatctga

SEQ ID NO: 539053 - DNA, 25 bp, Homo sapien
gcatgacctgtgaatctgaatccat

SEQ ID NO: 539054 - DNA, 25 bp, Homo sapien
ctgtgaatctgaatccatcatctcc

SEQ ID NO: 539055 - DNA, 25 bp, Homo sapien
gtgagcttaaaacttgccactgttt

SEQ ID NO: 539056 - DNA, 25 bp, Homo sapien
tgccactgtttagtaagttagcccc

SEQ ID NO: 539057 - DNA, 25 bp, Homo sapien
catagaatgtgaccctgtctgcaga

SEQ ID NO: 539058 - DNA, 25 bp, Homo sapien
tgtctgcagagtctcatttacccct

SEQ ID NO: 539059 - DNA, 25 bp, Homo sapien
ttacccctctttttctcattgtcat

SEQ ID NO: 539060 - DNA, 25 bp, Homo sapien
tgttggctttattagggctgtctta

SEQ ID NO: 539061 - DNA, 25 bp, Homo sapien
gttggcatttactatcatgtcttta

SEQ ID NO: 539062 - DNA, 25 bp, Homo sapien
aatcaccatataattcgttgcccaa

SEQ ID NO: 539063 - DNA, 25 bp, Homo sapien
tgcccaaattgggactattgagaga

SEQ ID NO: 539064 - DNA, 25 bp, Homo sapien
gggatgctattaattacaccagatc

SEQ ID NO: 539065 - DNA, 25 bp, Homo sapien
aaggcataaaccagacctgtcccag

SEQ ID NO: 539066 - DNA, 25 bp, Homo sapien
ctgccggcgccggaccctgcgacaa

SEQ ID NO: 539067 - DNA, 25 bp, Homo sapien
gctctgcccgtagccctgagaatta

SEQ ID NO: 539068 - DNA, 25 bp, Homo sapien
ctgcccgtagccctgagaattaaac

SEQ ID NO: 539069 - DNA, 25 bp, Homo sapien
tgcccgtagccctgagaattaaacg

SEQ ID NO: 539070 - DNA, 25 bp, Homo sapien
gcccgtagccctgagaattaaacgc

SEQ ID NO: 539071 - DNA, 25 bp, Homo sapien
ccgtagccctgagaattaaacgccg

SEQ ID NO: 539072 - DNA, 25 bp, Homo sapien
cgtagccctgagaattaaacgccgg

SEQ ID NO: 539073 - DNA, 25 bp, Homo sapien
gtagccctgagaattaaacgccggc

SEQ ID NO: 539074 - DNA, 25 bp, Homo sapien
gccctgagaattaaacgccggctct

SEQ ID NO: 539075 - DNA, 25 bp, Homo sapien
ccctgagaattaaacgccggctctc

SEQ ID NO: 539076 - DNA, 25 bp, Homo sapien
ctgagaattaaacgccggctctccc

SEQ ID NO: 539077 - DNA, 25 bp, Homo sapien
ttttttcaaatggtggtacttgcaa

SEQ ID NO: 539078 - DNA, 25 bp, Homo sapien
atggtggtacttgcaatctgtttta

SEQ ID NO: 539079 - DNA, 25 bp, Homo sapien
ggtacttgcaatctgttttataatt

SEQ ID NO: 539080 - DNA, 25 bp, Homo sapien
gttttataattagtgctccatttaa

SEQ ID NO: 539081 - DNA, 25 bp, Homo sapien
tagtgctccatttaaatctaattta

SEQ ID NO: 539082 - DNA, 25 bp, Homo sapien
atggccagttttaagattgtgttgc

SEQ ID NO: 539083 - DNA, 25 bp, Homo sapien
tttaagattgtgttgcctgtaacac

SEQ ID NO: 539084 - DNA, 25 bp, Homo sapien
gtgttgcctgtaacacaaaatgtta

SEQ ID NO: 539085 - DNA, 25 bp, Homo sapien
aaaggaaacagtacacttggagcta

SEQ ID NO: 539086 - DNA, 25 bp, Homo sapien
tacacttggagctaggaaaccaaag

SEQ ID NO: 539087 - DNA, 25 bp, Homo sapien
actggcacagtgatagagaattgct

SEQ ID NO: 539088 - DNA, 25 bp, Homo sapien
aaaaccacaggcacatttttcggtg

SEQ ID NO: 539089 - DNA, 25 bp, Homo sapien
tttcggtgcggacagatttgccagc

SEQ ID NO: 539090 - DNA, 25 bp, Homo sapien
ttgccagcacataactgggcagcca

SEQ ID NO: 539091 - DNA, 25 bp, Homo sapien
gggcagccagctagaatactttgtg

SEQ ID NO: 539092 - DNA, 25 bp, Homo sapien
taagcgaggttttccatttcagccc

SEQ ID NO: 539093 - DNA, 25 bp, Homo sapien
atttcagccccatggtgcatggtgg

SEQ ID NO: 539094 - DNA, 25 bp, Homo sapien
gccgatgaatgtgtcagtctgctca

SEQ ID NO: 539095 - DNA, 25 bp, Homo sapien
tcaaaactgtgttcactgtttgggt

SEQ ID NO: 539096 - DNA, 25 bp, Homo sapien
gtgtttttgtctctgtataggtaga

SEQ ID NO: 539097 - DNA, 25 bp, Homo sapien
ggtagaggtattcacatcttactcc

SEQ ID NO: 539098 - DNA, 25 bp, Homo sapien
ttactccgactgtaaggttgtctta

SEQ ID NO: 539099 - DNA, 25 bp, Homo sapien
agcctttgattgattaccagcatga

SEQ ID NO: 539100 - DNA, 25 bp, Homo sapien
cctttgattgattaccagcatgaga

SEQ ID NO: 539101 - DNA, 25 bp, Homo sapien
cagcatgagaattcaccttggtttc

SEQ ID NO: 539102 - DNA, 25 bp, Homo sapien
tcccctaattatatggaagctattg

SEQ ID NO: 539103 - DNA, 25 bp, Homo sapien
atggaagctattggaacttttgtat

SEQ ID NO: 539104 - DNA, 25 bp, Homo sapien
ttcagtgctaaatactaagtcaagg

SEQ ID NO: 539105 - DNA, 25 bp, Homo sapien
aggtaagttttttcagtgactgtgc

SEQ ID NO: 539106 - DNA, 25 bp, Homo sapien
ttttttcagtgactgtgcctttagc

SEQ ID NO: 539107 - DNA, 25 bp, Homo sapien
ttagcattcagtcattataagaaaa

SEQ ID NO: 539108 - DNA, 25 bp, Homo sapien
aacatgtaattcttttatatagtga

SEQ ID NO: 539109 - DNA, 25 bp, Homo sapien
tatagtgattatcatgtactgcatt

SEQ ID NO: 539110 - DNA, 25 bp, Homo sapien
gttcttattcactcctacatttggc

SEQ ID NO: 539111 - DNA, 25 bp, Homo sapien
acattctccaaggacccagacttga

SEQ ID NO: 539112 - DNA, 25 bp, Homo sapien
aatatctgtttcgttttagaccagg

SEQ ID NO: 539113 - DNA, 25 bp, Homo sapien
ctttttcttcaatccatgacagtgg

SEQ ID NO: 539114 - DNA, 25 bp, Homo sapien
atgacagtggacttttcttctctgt

SEQ ID NO: 539115 - DNA, 25 bp, Homo sapien
gtctccagacacactgtcattttca

SEQ ID NO: 539116 - DNA, 25 bp, Homo sapien
atatactgatcttcctttcgctctt

SEQ ID NO: 539117 - DNA, 25 bp, Homo sapien
tttcgctcttccaaagtggcagaca

SEQ ID NO: 539118 - DNA, 25 bp, Homo sapien
gtggcagacacaagagaaagctccc

SEQ ID NO: 539119 - DNA, 25 bp, Homo sapien
agcagccagttccttctcagagaac

SEQ ID NO: 539120 - DNA, 25 bp, Homo sapien
gaactggcccaagagtttctggaca

SEQ ID NO: 539121 - DNA, 25 bp, Homo sapien
attcctgttttgtacgagtgcctca

SEQ ID NO: 539122 - DNA, 25 bp, Homo sapien
acgagtgcctcattttgtagtcatg

SEQ ID NO: 539123 - DNA, 25 bp, Homo sapien
aatgactaatctaaggtctaggaat

SEQ ID NO: 539124 - DNA, 25 bp, Homo sapien
attgtagaagctaagtagaacactt

SEQ ID NO: 539125 - DNA, 25 bp, Homo sapien
gggtgtcaattttctatcaacgcaa

SEQ ID NO: 539126 - DNA, 25 bp, Homo sapien
tatcaacgcaaacaccttagggtac

SEQ ID NO: 539127 - DNA, 25 bp, Homo sapien
tagggtacccagaccaattttatgt

SEQ ID NO: 539128 - DNA, 25 bp, Homo sapien
atgctccctttttaatgtggtcatt

SEQ ID NO: 539129 - DNA, 25 bp, Homo sapien
taatgtggtcatttgttgccttcta

SEQ ID NO: 539130 - DNA, 25 bp, Homo sapien
tggtcatttgttgccttctaagttg

SEQ ID NO: 539131 - DNA, 25 bp, Homo sapien
gttgccttctaagttgagaggacaa

SEQ ID NO: 539132 - DNA, 25 bp, Homo sapien
gggctgccccttaagtgtcggtgaa

SEQ ID NO: 539133 - DNA, 25 bp, Homo sapien
ggctgccccttaagtgtcggtgaat

SEQ ID NO: 539134 - DNA, 25 bp, Homo sapien
gctgccccttaagtgtcggtgaata

SEQ ID NO: 539135 - DNA, 25 bp, Homo sapien
ctgccccttaagtgtcggtgaatag

SEQ ID NO: 539136 - DNA, 25 bp, Homo sapien
tgccccttaagtgtcggtgaatagt

SEQ ID NO: 539137 - DNA, 25 bp, Homo sapien
gccccttaagtgtcggtgaatagtg

SEQ ID NO: 539138 - DNA, 25 bp, Homo sapien
gtcggtgaatagtgaggctggaggc

SEQ ID NO: 539139 - DNA, 25 bp, Homo sapien
tcggtgaatagtgaggctggaggcc

SEQ ID NO: 539140 - DNA, 25 bp, Homo sapien
ctcgctcccatgtttccacccggca

SEQ ID NO: 539141 - DNA, 25 bp, Homo sapien
tttccacccggcaccctgatcctca

SEQ ID NO: 539142 - DNA, 25 bp, Homo sapien
gatcctcacccgaatctcctttttt

SEQ ID NO: 539143 - DNA, 25 bp, Homo sapien
tgctgactcgggaatgcttttcaaa

SEQ ID NO: 539144 - DNA, 25 bp, Homo sapien
gaaggtcaagtaacagtcatacagc

SEQ ID NO: 539145 - DNA, 25 bp, Homo sapien
gtcatacagctagaaaagtccctga

SEQ ID NO: 539146 - DNA, 25 bp, Homo sapien
tgcagcttagttttcctttatttat

SEQ ID NO: 539147 - DNA, 25 bp, Homo sapien
gtggtcatgaagactatccccattt

SEQ ID NO: 539148 - DNA, 25 bp, Homo sapien
gactatccccatttctccataaaat

SEQ ID NO: 539149 - DNA, 25 bp, Homo sapien
ataaaatcctccctccatactgctg

SEQ ID NO: 539150 - DNA, 25 bp, Homo sapien
catactgctgcattatggcacaaaa

SEQ ID NO: 539151 - DNA, 25 bp, Homo sapien
acaaaagactctaagtgccaccaga

SEQ ID NO: 539152 - DNA, 25 bp, Homo sapien
agtgccaccagacagaaggaccaga

SEQ ID NO: 539153 - DNA, 25 bp, Homo sapien
gaaatttatgctgactcgggaatgc

SEQ ID NO: 539154 - DNA, 25 bp, Homo sapien
cttacatttttccacgagctggtgc

SEQ ID NO: 539155 - DNA, 25 bp, Homo sapien
tttttccacgagctggtgcagacag

SEQ ID NO: 539156 - DNA, 25 bp, Homo sapien
agctctgccatcaggcagctgtgtg

SEQ ID NO: 539157 - DNA, 25 bp, Homo sapien
gacaccttgttaaaggacttgtgca

SEQ ID NO: 539158 - DNA, 25 bp, Homo sapien
gtgcaaaatgtacaccacacttaca

SEQ ID NO: 539159 - DNA, 25 bp, Homo sapien
acacttacagcccttgtcagatatt

SEQ ID NO: 539160 - DNA, 25 bp, Homo sapien
tcagatattatctccaggtgtgtca

SEQ ID NO: 539161 - DNA, 25 bp, Homo sapien
agctggtgaagctgtctggttctca

SEQ ID NO: 539162 - DNA, 25 bp, Homo sapien
gaagctgtctggttctcatctgacc

SEQ ID NO: 539163 - DNA, 25 bp, Homo sapien
attctttcatttcttacgtacagaa

SEQ ID NO: 539164 - DNA, 25 bp, Homo sapien
aagagcctgaactatacgggagaga

SEQ ID NO: 539165 - DNA, 25 bp, Homo sapien
cagcgttatctaactcctggagggt

SEQ ID NO: 539166 - DNA, 25 bp, Homo sapien
ctcctggagggtggactctgtcctg

SEQ ID NO: 539167 - DNA, 25 bp, Homo sapien
tgtcctggcttgtttggtgtcctca

SEQ ID NO: 539168 - DNA, 25 bp, Homo sapien
gtttggtgtcctcagatatctttca

SEQ ID NO: 539169 - DNA, 25 bp, Homo sapien
gatatctttcacacagtagagcaaa

SEQ ID NO: 539170 - DNA, 25 bp, Homo sapien
gtagagcaaaatcaccagccctgca

SEQ ID NO: 539171 - DNA, 25 bp, Homo sapien
agccctgcactgatgtcactttatg

SEQ ID NO: 539172 - DNA, 25 bp, Homo sapien
cctgcactgatgtcactttatgtag

SEQ ID NO: 539173 - DNA, 25 bp, Homo sapien
tagaaaaaggccttagctggacctg

SEQ ID NO: 539174 - DNA, 25 bp, Homo sapien
gttgccgtctatgcaaatgcatgca

SEQ ID NO: 539175 - DNA, 25 bp, Homo sapien
tgcatgcaaatactccaggccctgg

SEQ ID NO: 539176 - DNA, 25 bp, Homo sapien
ccttttgcaaaaagcacagctgaaa

SEQ ID NO: 539177 - DNA, 25 bp, Homo sapien
caggctggcttcgtttttccaagga

SEQ ID NO: 539178 - DNA, 25 bp, Homo sapien
ggctggcttcgtttttccaaggagc

SEQ ID NO: 539179 - DNA, 25 bp, Homo sapien
gcttcgtttttccaaggagcctttg

SEQ ID NO: 539180 - DNA, 25 bp, Homo sapien
tttttccaaggagcctttggtgagt

SEQ ID NO: 539181 - DNA, 25 bp, Homo sapien
ctttggtgagttcaattatctggta

SEQ ID NO: 539182 - DNA, 25 bp, Homo sapien
ggtgagttcaattatctggtaaata

SEQ ID NO: 539183 - DNA, 25 bp, Homo sapien
tggtaaatatccagcgcttcacctg

SEQ ID NO: 539184 - DNA, 25 bp, Homo sapien
atatccagcgcttcacctgaaagat

SEQ ID NO: 539185 - DNA, 25 bp, Homo sapien
gcgcttcacctgaaagatagtgcaa

SEQ ID NO: 539186 - DNA, 25 bp, Homo sapien
cctgaaagatagtgcaaattggtta

SEQ ID NO: 539187 - DNA, 25 bp, Homo sapien
ggttgtggaagcctatggtattctt

SEQ ID NO: 539188 - DNA, 25 bp, Homo sapien
ttcttggctattgcagctgtggctc

SEQ ID NO: 539189 - DNA, 25 bp, Homo sapien
tgtggctctgtatgtgttacccaac

SEQ ID NO: 539190 - DNA, 25 bp, Homo sapien
gtgttacccaacatgcgacagcagg

SEQ ID NO: 539191 - DNA, 25 bp, Homo sapien
atgcgacagcaggagtcagagttct

SEQ ID NO: 539192 - DNA, 25 bp, Homo sapien
agtcagagttctgcctcatggagtg

SEQ ID NO: 539193 - DNA, 25 bp, Homo sapien
tcatggagtgatggcagaccttggc

SEQ ID NO: 539194 - DNA, 25 bp, Homo sapien
ttggccagcgcgagggcagatcccc

SEQ ID NO: 539195 - DNA, 25 bp, Homo sapien
accaccctcagctttgggcaggaca

SEQ ID NO: 539196 - DNA, 25 bp, Homo sapien
cagctttgggcaggacacactgtgc

SEQ ID NO: 539197 - DNA, 25 bp, Homo sapien
tcctgccttgtgtaagaacctgagt

SEQ ID NO: 539198 - DNA, 25 bp, Homo sapien
gttgtcacaagaggactactgctgt

SEQ ID NO: 539199 - DNA, 25 bp, Homo sapien
ctactgctgttcaagtcatcacttc

SEQ ID NO: 539200 - DNA, 25 bp, Homo sapien
tgttcaagtcatcacttccacattc

SEQ ID NO: 539201 - DNA, 25 bp, Homo sapien
aggtagagggccagaagtatcccct

SEQ ID NO: 539202 - DNA, 25 bp, Homo sapien
aagtatcccctccttttatcaggag

SEQ ID NO: 539203 - DNA, 25 bp, Homo sapien
ggagccattaactttcccagaaact

SEQ ID NO: 539204 - DNA, 25 bp, Homo sapien
agacctccacttacatctcactagg

SEQ ID NO: 539205 - DNA, 25 bp, Homo sapien
taggcagaactcctatcacttggcc

SEQ ID NO: 539206 - DNA, 25 bp, Homo sapien
ctggaagggtgagcattcagctata

SEQ ID NO: 539207 - DNA, 25 bp, Homo sapien
agtggaagcacaagcagcaagggaa

SEQ ID NO: 539208 - DNA, 25 bp, Homo sapien
gtcagtaattgctgtagagtttcct

SEQ ID NO: 539209 - DNA, 25 bp, Homo sapien
attggtcaggaccacccactaacca

SEQ ID NO: 539210 - DNA, 25 bp, Homo sapien
taaccagtgccttccttcttaacat

SEQ ID NO: 539211 - DNA, 25 bp, Homo sapien
gccttccttcttaacattcactttt

SEQ ID NO: 539212 - DNA, 25 bp, Homo sapien
cttaacattcacttttagcagcttg

SEQ ID NO: 539213 - DNA, 25 bp, Homo sapien
aacattcacttttagcagcttgtgt

SEQ ID NO: 539214 - DNA, 25 bp, Homo sapien
cttgtgtttattttacatgggcagt

SEQ ID NO: 539215 - DNA, 25 bp, Homo sapien
tttacatgggcagttttgatgggaa

SEQ ID NO: 539216 - DNA, 25 bp, Homo sapien
ggaaattgccatgaccacaggggtt

SEQ ID NO: 539217 - DNA, 25 bp, Homo sapien
ctttctctcctactccatttagaaa

SEQ ID NO: 539218 - DNA, 25 bp, Homo sapien
cgggataattctgctaccggctcct

SEQ ID NO: 539219 - DNA, 25 bp, Homo sapien
accggctcctccctgatgattctga

SEQ ID NO: 539220 - DNA, 25 bp, Homo sapien
agaagggtgtgggtttggccccatg

SEQ ID NO: 539221 - DNA, 25 bp, Homo sapien
gccccatgtcactggccggaaggat

SEQ ID NO: 539222 - DNA, 25 bp, Homo sapien
actggccggaaggatgtgtctcagc

SEQ ID NO: 539223 - DNA, 25 bp, Homo sapien
atgggaggctgtcccatctcccagt

SEQ ID NO: 539224 - DNA, 25 bp, Homo sapien
cttgccctgtgtgggattcgcagtg

SEQ ID NO: 539225 - DNA, 25 bp, Homo sapien
ggattcgcagtgtctcatttggtga

SEQ ID NO: 539226 - DNA, 25 bp, Homo sapien
gcagtgtctcatttggtgacgtctt

SEQ ID NO: 539227 - DNA, 25 bp, Homo sapien
atttggtgacgtcttactggtgatc

SEQ ID NO: 539228 - DNA, 25 bp, Homo sapien
tgacgtcttactggtgatcatctcc

SEQ ID NO: 539229 - DNA, 25 bp, Homo sapien
gtcttactggtgatcatctcctcac

SEQ ID NO: 539230 - DNA, 25 bp, Homo sapien
gaataaatacatgttagcacttccc

SEQ ID NO: 539231 - DNA, 25 bp, Homo sapien
gtgtgtcttctttaaagccttggct

SEQ ID NO: 539232 - DNA, 25 bp, Homo sapien
aagccttggctttaatcatgggaaa

SEQ ID NO: 539233 - DNA, 25 bp, Homo sapien
gtatcctatgtttggtattctgtat

SEQ ID NO: 539234 - DNA, 25 bp, Homo sapien
ggtattctgtatgtctgatccataa

SEQ ID NO: 539235 - DNA, 25 bp, Homo sapien
atctctgtggattggtaggtttggc

SEQ ID NO: 539236 - DNA, 25 bp, Homo sapien
gtaggtttggccatttgaccattat

SEQ ID NO: 539237 - DNA, 25 bp, Homo sapien
tcaagttggttgtatgctaaggtaa

SEQ ID NO: 539238 - DNA, 25 bp, Homo sapien
taaggtaagttgacgccatagcatt

SEQ ID NO: 539239 - DNA, 25 bp, Homo sapien
gttgacgccatagcattatacagtt

SEQ ID NO: 539240 - DNA, 25 bp, Homo sapien
tatacagttatcttcattgctcttg

SEQ ID NO: 539241 - DNA, 25 bp, Homo sapien
attgctcttgaatgatatctgttat

SEQ ID NO: 539242 - DNA, 25 bp, Homo sapien
cagatcaatatggtctaaagcttca

SEQ ID NO: 539243 - DNA, 25 bp, Homo sapien
aagacagctaagtgaatgtgtgtaa

SEQ ID NO: 539244 - DNA, 25 bp, Homo sapien
gacagatatttatgtacagtattca

SEQ ID NO: 539245 - DNA, 25 bp, Homo sapien
gaaactcaccataatagtgccgtct

SEQ ID NO: 539246 - DNA, 25 bp, Homo sapien
tagtgccgtctaaaaatctttgtaa

SEQ ID NO: 539247 - DNA, 25 bp, Homo sapien
taatgtcctttagaagtgggagtct

SEQ ID NO: 539248 - DNA, 25 bp, Homo sapien
aactgtgttggatttaagatacctt

SEQ ID NO: 539249 - DNA, 25 bp, Homo sapien
taagataccttttcactcttccgta

SEQ ID NO: 539250 - DNA, 25 bp, Homo sapien
cttttcactcttccgtatgtcatga

SEQ ID NO: 539251 - DNA, 25 bp, Homo sapien
tcttccgtatgtcatgagccttgtg

SEQ ID NO: 539252 - DNA, 25 bp, Homo sapien
atgtcatgagccttgtgcgtcacct

SEQ ID NO: 539253 - DNA, 25 bp, Homo sapien
agggtaatgtgcataggcggatcca

SEQ ID NO: 539254 - DNA, 25 bp, Homo sapien
gaacagagagcagatcgcagcccgc

SEQ ID NO: 539255 - DNA, 25 bp, Homo sapien
gagagcagatcgcagcccgcgcctt

SEQ ID NO: 539256 - DNA, 25 bp, Homo sapien
attaccggccgcctctggtcatgtg

SEQ ID NO: 539257 - DNA, 25 bp, Homo sapien
gcctctggtcatgtgcataatcgtc

SEQ ID NO: 539258 - DNA, 25 bp, Homo sapien
gtgcataatcgtcacaggctcattt

SEQ ID NO: 539259 - DNA, 25 bp, Homo sapien
tcgtcacaggctcattttaaatagg

SEQ ID NO: 539260 - DNA, 25 bp, Homo sapien
acattttattattggcctgctggat

SEQ ID NO: 539261 - DNA, 25 bp, Homo sapien
attattggcctgctggatttaagta

SEQ ID NO: 539262 - DNA, 25 bp, Homo sapien
tggcctgctggatttaagtatttgc

SEQ ID NO: 539263 - DNA, 25 bp, Homo sapien
aagtatttgcatgtttgatatgtct

SEQ ID NO: 539264 - DNA, 25 bp, Homo sapien
tatttttcttaatacacaaagcagg

SEQ ID NO: 539265 - DNA, 25 bp, Homo sapien
acacaaagcaggtgtcagctgttgt

SEQ ID NO: 539266 - DNA, 25 bp, Homo sapien
caggtgtcagctgttgtattctcac

SEQ ID NO: 539267 - DNA, 25 bp, Homo sapien
tgtattctcacccttcttaagaaaa

SEQ ID NO: 539268 - DNA, 25 bp, Homo sapien
gataatatatctcttaataccaaag

SEQ ID NO: 539269 - DNA, 25 bp, Homo sapien
tctagtgtacttttctttgttccct

SEQ ID NO: 539270 - DNA, 25 bp, Homo sapien
agtgtacttttctttgttccctcat

SEQ ID NO: 539271 - DNA, 25 bp, Homo sapien
gtacttttctttgttccctcatgtc

SEQ ID NO: 539272 - DNA, 25 bp, Homo sapien
ttctttgttccctcatgtctttttc

SEQ ID NO: 539273 - DNA, 25 bp, Homo sapien
tttcaatctgtacactaacatacct

SEQ ID NO: 539274 - DNA, 25 bp, Homo sapien
gtacactaacatacctagcaaattt

SEQ ID NO: 539275 - DNA, 25 bp, Homo sapien
ttaaggcatagttttgttgtttgtt

SEQ ID NO: 539276 - DNA, 25 bp, Homo sapien
cttgtttgttgcaggctgtaaggca

SEQ ID NO: 539277 - DNA, 25 bp, Homo sapien
ttgttgcaggctgtaaggcatggct

SEQ ID NO: 539278 - DNA, 25 bp, Homo sapien
catctcattcatattacctgtggag

SEQ ID NO: 539279 - DNA, 25 bp, Homo sapien
atattacctgtggagttgcatatcc

SEQ ID NO: 539280 - DNA, 25 bp, Homo sapien
ggagttgcatatccaaaccttagtg

SEQ ID NO: 539281 - DNA, 25 bp, Homo sapien
gttgcatatccaaaccttagtgagt

SEQ ID NO: 539282 - DNA, 25 bp, Homo sapien
tatccaaaccttagtgagttttgaa

SEQ ID NO: 539283 - DNA, 25 bp, Homo sapien
gtgagttttgaagctttaagcaaat

SEQ ID NO: 539284 - DNA, 25 bp, Homo sapien
tgaagctttaagcaaattcttttaa

SEQ ID NO: 539285 - DNA, 25 bp, Homo sapien
attcttgtatttctagcattactag

SEQ ID NO: 539286 - DNA, 25 bp, Homo sapien
accccggcccggaggaggctcatgc

SEQ ID NO: 539287 - DNA, 25 bp, Homo sapien
aggctcatgcgggatttcaagcggt

SEQ ID NO: 539288 - DNA, 25 bp, Homo sapien
catgcgggatttcaagcggttacaa

SEQ ID NO: 539289 - DNA, 25 bp, Homo sapien
ggatttcaagcggttacaagaggac

SEQ ID NO: 539290 - DNA, 25 bp, Homo sapien
tatttggaccagaagggacaccttt

SEQ ID NO: 539291 - DNA, 25 bp, Homo sapien
tggaccagaagggacaccttttgaa

SEQ ID NO: 539292 - DNA, 25 bp, Homo sapien
agggacaccttttgaagatggtact

SEQ ID NO: 539293 - DNA, 25 bp, Homo sapien
gatggtacttttaaactagtaatag

SEQ ID NO: 539294 - DNA, 25 bp, Homo sapien
tccaaataaaccaccaactgttagg

SEQ ID NO: 539295 - DNA, 25 bp, Homo sapien
ttatccaaaatgtttcatccaaatg

SEQ ID NO: 539296 - DNA, 25 bp, Homo sapien
gtttcatccaaatgtgtatgctgat

SEQ ID NO: 539297 - DNA, 25 bp, Homo sapien
tgtgcctcagaaatctatttctctt

SEQ ID NO: 539298 - DNA, 25 bp, Homo sapien
gcctcagaaatctatttctctttta

SEQ ID NO: 539299 - DNA, 25 bp, Homo sapien
tttctcttttagatgttgaaccctg

SEQ ID NO: 539300 - DNA, 25 bp, Homo sapien
ctcttttagatgttgaaccctgaga

SEQ ID NO: 539301 - DNA, 25 bp, Homo sapien
ttagatgttgaaccctgagagaact

SEQ ID NO: 539302 - DNA, 25 bp, Homo sapien
gatgttgaaccctgagagaactaag

SEQ ID NO: 539303 - DNA, 25 bp, Homo sapien
gttgaaccctgagagaactaagatg

SEQ ID NO: 539304 - DNA, 25 bp, Homo sapien
gaaccctgagagaactaagatgata

SEQ ID NO: 539305 - DNA, 25 bp, Homo sapien
gaactaagatgatatttcagaagag

SEQ ID NO: 539306 - DNA, 25 bp, Homo sapien
ttcagaagagttggctgccttctct

SEQ ID NO: 539307 - DNA, 25 bp, Homo sapien
gctgccttctctggaaacaaggaaa

SEQ ID NO: 539308 - DNA, 25 bp, Homo sapien
aagagacccagggagaagcggacgg

SEQ ID NO: 539309 - DNA, 25 bp, Homo sapien
gggtgcgatggaccccgcggcatcc

SEQ ID NO: 539310 - DNA, 25 bp, Homo sapien
gtattagggcccgttcacttctccg

SEQ ID NO: 539311 - DNA, 25 bp, Homo sapien
tggcccgcccttcctaagttatcgg

SEQ ID NO: 539312 - DNA, 25 bp, Homo sapien
ccttcctaagttatcggcctgcgag

SEQ ID NO: 539313 - DNA, 25 bp, Homo sapien
ttcctaagttatcggcctgcgagcc

SEQ ID NO: 539314 - DNA, 25 bp, Homo sapien
aagttatcggcctgcgagccggaga

SEQ ID NO: 539315 - DNA, 25 bp, Homo sapien
atcggcctgcgagccggagagacaa

SEQ ID NO: 539316 - DNA, 25 bp, Homo sapien
caatggagagaactgcagaggccga

SEQ ID NO: 539317 - DNA, 25 bp, Homo sapien
tgcagaggccgagtggcgaccaggc

SEQ ID NO: 539318 - DNA, 25 bp, Homo sapien
gaccaggccccaagcggaaggccat

SEQ ID NO: 539319 - DNA, 25 bp, Homo sapien
gcgggcggccttcgtccggcgagag

SEQ ID NO: 539320 - DNA, 25 bp, Homo sapien
cttcgtccggcgagagctaggccga

SEQ ID NO: 539321 - DNA, 25 bp, Homo sapien
ttcgtccggcgagagctaggccgag

SEQ ID NO: 539322 - DNA, 25 bp, Homo sapien
tccggcgagagctaggccgaggacc

SEQ ID NO: 539323 - DNA, 25 bp, Homo sapien
agagctaggccgaggacccgcgccg

SEQ ID NO: 539324 - DNA, 25 bp, Homo sapien
gtccttcaccgactcccgcggcgcg

SEQ ID NO: 539325 - DNA, 25 bp, Homo sapien
gggcgggggtctcctccaggctgcg

SEQ ID NO: 539326 - DNA, 25 bp, Homo sapien
aagacaagtcgggagaggccggtag

SEQ ID NO: 539327 - DNA, 25 bp, Homo sapien
gacaagtcgggagaggccggtaggc

SEQ ID NO: 539328 - DNA, 25 bp, Homo sapien
ccggtaggcgtgaggcgggcctgaa

SEQ ID NO: 539329 - DNA, 25 bp, Homo sapien
gtgaggcgggcctgaagcggcagcg

SEQ ID NO: 539330 - DNA, 25 bp, Homo sapien
ttgtgagagggactctgagaacact

SEQ ID NO: 539331 - DNA, 25 bp, Homo sapien
gagggactctgagaacacttgagta

SEQ ID NO: 539332 - DNA, 25 bp, Homo sapien
gagaacacttgagtaacacttggga

SEQ ID NO: 539333 - DNA, 25 bp, Homo sapien
tcatgcccttcccatgtgcttttct

SEQ ID NO: 539334 - DNA, 25 bp, Homo sapien
ttcccatgtgcttttctgcagaagg

SEQ ID NO: 539335 - DNA, 25 bp, Homo sapien
cccatgtgcttttctgcagaaggta

SEQ ID NO: 539336 - DNA, 25 bp, Homo sapien
ttctgcagaaggtaacttgacagca

SEQ ID NO: 539337 - DNA, 25 bp, Homo sapien
agaaggtaacttgacagcaagctga

SEQ ID NO: 539338 - DNA, 25 bp, Homo sapien
aagctgatgccctgaggctgggcac

SEQ ID NO: 539339 - DNA, 25 bp, Homo sapien
gctgggcacagtggaaatcataata

SEQ ID NO: 539340 - DNA, 25 bp, Homo sapien
tcataataaagcgattgcgatgctc

SEQ ID NO: 539341 - DNA, 25 bp, Homo sapien
ggcttcctgccgccggtggtgcggg

SEQ ID NO: 539342 - DNA, 25 bp, Homo sapien
gggcctgtgcacacccggcaccatc

SEQ ID NO: 539343 - DNA, 25 bp, Homo sapien
caccatccgctacggccccgcggag

SEQ ID NO: 539344 - DNA, 25 bp, Homo sapien
agctgggcctggtgtacccgcacct

SEQ ID NO: 539345 - DNA, 25 bp, Homo sapien
tgggcctggtgtacccgcacctgca

SEQ ID NO: 539346 - DNA, 25 bp, Homo sapien
ctggtgtacccgcacctgcagaggc

SEQ ID NO: 539347 - DNA, 25 bp, Homo sapien
tggtgtacccgcacctgcagaggct

SEQ ID NO: 539348 - DNA, 25 bp, Homo sapien
gcagaggctgggtccgggccccgcg

SEQ ID NO: 539349 - DNA, 25 bp, Homo sapien
gggcccgcgggcaccaggctgccgc

SEQ ID NO: 539350 - DNA, 25 bp, Homo sapien
cccaggacagtaggcccggctctgc

SEQ ID NO: 539351 - DNA, 25 bp, Homo sapien
gacagtaggcccggctctgcccgta

SEQ ID NO: 539352 - DNA, 25 bp, Homo sapien
taattggtttaatgcctagttatgc

SEQ ID NO: 539353 - DNA, 25 bp, Homo sapien
gcctagttatgcaacttgagtgctt

SEQ ID NO: 539354 - DNA, 25 bp, Homo sapien
taactgcactggtacattgaacatg

SEQ ID NO: 539355 - DNA, 25 bp, Homo sapien
attgaacatgtcagtgtcgatgcca

SEQ ID NO: 539356 - DNA, 25 bp, Homo sapien
gtgtcgatgccactggaccaacaga

SEQ ID NO: 539357 - DNA, 25 bp, Homo sapien
gccactggaccaacagagcattttg

SEQ ID NO: 539358 - DNA, 25 bp, Homo sapien
agcattttgtggctatagggtgcct

SEQ ID NO: 539359 - DNA, 25 bp, Homo sapien
tatagggtgcctgataataatgtct

SEQ ID NO: 539360 - DNA, 25 bp, Homo sapien
gggattcaactatatcgaaggtttt

SEQ ID NO: 539361 - DNA, 25 bp, Homo sapien
gggcgtacaggtgatcgatcattaa

SEQ ID NO: 539362 - DNA, 25 bp, Homo sapien
gtgatcgatcattaatgtcattgca

SEQ ID NO: 539363 - DNA, 25 bp, Homo sapien
acaagcacacgactgggattccttt

SEQ ID NO: 539364 - DNA, 25 bp, Homo sapien
caagtgcgggcaaagggaagctcct

SEQ ID NO: 539365 - DNA, 25 bp, Homo sapien
agctcctcccgtttttcataaacag

SEQ ID NO: 539366 - DNA, 25 bp, Homo sapien
gaagtaagatgtcctctttcccagg

SEQ ID NO: 539367 - DNA, 25 bp, Homo sapien
tttcccaggtttgcacaatcacttc

SEQ ID NO: 539368 - DNA, 25 bp, Homo sapien
ttgaaggtccttgaattcagccagt

SEQ ID NO: 539369 - DNA, 25 bp, Homo sapien
attcagccagtgcacgaaacctttg

SEQ ID NO: 539370 - DNA, 25 bp, Homo sapien
gcacgaaacctttgcatgttcttct

SEQ ID NO: 539371 - DNA, 25 bp, Homo sapien
ttcttctgaaactgtacttcttccc

SEQ ID NO: 539372 - DNA, 25 bp, Homo sapien
tctgcgaactttgccttttccttaa

SEQ ID NO: 539373 - DNA, 25 bp, Homo sapien
attccagaccaaacactgttcagtt

SEQ ID NO: 539374 - DNA, 25 bp, Homo sapien
cagtataggtcagtggttcttagct

SEQ ID NO: 539375 - DNA, 25 bp, Homo sapien
tgaattcctttgaaagtctagtaaa

SEQ ID NO: 539376 - DNA, 25 bp, Homo sapien
acatacccccagatgttttagacat

SEQ ID NO: 539377 - DNA, 25 bp, Homo sapien
tattttcaattgctccatggacctt

SEQ ID NO: 539378 - DNA, 25 bp, Homo sapien
tgctccatggaccttaagaaaactt

SEQ ID NO: 539379 - DNA, 25 bp, Homo sapien
taagaaaacttggttggtgtgcagt

SEQ ID NO: 539380 - DNA, 25 bp, Homo sapien
gttggtgtgcagtttggtgtattat

SEQ ID NO: 539381 - DNA, 25 bp, Homo sapien
gtattatgggtaagactggacctgg

SEQ ID NO: 539382 - DNA, 25 bp, Homo sapien
taggcattatagtagtgctaggcac

SEQ ID NO: 539383 - DNA, 25 bp, Homo sapien
agtgctaggcactatagtaatgctg

SEQ ID NO: 539384 - DNA, 25 bp, Homo sapien
ttccttatttcaggtaacttacagt

SEQ ID NO: 539385 - DNA, 25 bp, Homo sapien
agcagccttaactgtgacacttgcc

SEQ ID NO: 539386 - DNA, 25 bp, Homo sapien
cactgtgtcgtcgtttgtttgccta

SEQ ID NO: 539387 - DNA, 25 bp, Homo sapien
ctccagggcacggtggcaggaacaa

SEQ ID NO: 539388 - DNA, 25 bp, Homo sapien
gcaggaacaactatcctcgtctgtc

SEQ ID NO: 539389 - DNA, 25 bp, Homo sapien
tcgtctgtcccaacactgagcaggc

SEQ ID NO: 539390 - DNA, 25 bp, Homo sapien
tgagcaggcactcggtaaacacgaa

SEQ ID NO: 539391 - DNA, 25 bp, Homo sapien
aagatctgtctttccaatggccggg

SEQ ID NO: 539392 - DNA, 25 bp, Homo sapien
tttggtccccaaattaaggctattg

SEQ ID NO: 539393 - DNA, 25 bp, Homo sapien
aaggctattggacatctgcacagga

SEQ ID NO: 539394 - DNA, 25 bp, Homo sapien
gacatctgcacaggacagtcctatt

SEQ ID NO: 539395 - DNA, 25 bp, Homo sapien
tttgatgtcctttcctttctgaaaa

SEQ ID NO: 539396 - DNA, 25 bp, Homo sapien
gcattacagattgtatgtgatttat

SEQ ID NO: 539397 - DNA, 25 bp, Homo sapien
gaagcaatcaagaatgccatagcaa

SEQ ID NO: 539398 - DNA, 25 bp, Homo sapien
tcaagaatgccatagcaaatgcttc

SEQ ID NO: 539399 - DNA, 25 bp, Homo sapien
tctggctgaagtggagaggctgaag

SEQ ID NO: 539400 - DNA, 25 bp, Homo sapien
ggttgctgcagtctggtcagatccc

SEQ ID NO: 539401 - DNA, 25 bp, Homo sapien
ttgctgcagtctggtcagatccctg

SEQ ID NO: 539402 - DNA, 25 bp, Homo sapien
tgcagtctggtcagatccctggcag

SEQ ID NO: 539403 - DNA, 25 bp, Homo sapien
gtctggtcagatccctggcagagaa

SEQ ID NO: 539404 - DNA, 25 bp, Homo sapien
ggtcagatccctggcagagaacgca

SEQ ID NO: 539405 - DNA, 25 bp, Homo sapien
cagatccctggcagagaacgcagat

SEQ ID NO: 539406 - DNA, 25 bp, Homo sapien
tccctggcagagaacgcagatcagg

SEQ ID NO: 539407 - DNA, 25 bp, Homo sapien
atctttgtaagcagaacagtacggc

SEQ ID NO: 539408 - DNA, 25 bp, Homo sapien
agcagaacagtacggcacttcacca

SEQ ID NO: 539409 - DNA, 25 bp, Homo sapien
agaacagtacggcacttcaccacat

SEQ ID NO: 539410 - DNA, 25 bp, Homo sapien
gtacggcacttcaccacatctgctt

SEQ ID NO: 539411 - DNA, 25 bp, Homo sapien
accatgcttctaagcagctgtcttc

SEQ ID NO: 539412 - DNA, 25 bp, Homo sapien
tgtcttccccctgctaatgttacaa

SEQ ID NO: 539413 - DNA, 25 bp, Homo sapien
aatgttacaaccaaagcagccaccc

SEQ ID NO: 539414 - DNA, 25 bp, Homo sapien
tcgtgttgagcctcacgaccgctga

SEQ ID NO: 539415 - DNA, 25 bp, Homo sapien
gactctgctcagagccagcattcca

SEQ ID NO: 539416 - DNA, 25 bp, Homo sapien
cattccagccacaaagagggcctcc

SEQ ID NO: 539417 - DNA, 25 bp, Homo sapien
tatattttaggctttttatctttat

SEQ ID NO: 539418 - DNA, 25 bp, Homo sapien
gcacgctctgtctctgtccatcgtc

SEQ ID NO: 539419 - DNA, 25 bp, Homo sapien
accatacccctacagaagactctgt

SEQ ID NO: 539420 - DNA, 25 bp, Homo sapien
catacccctacagaagactctgtgt

SEQ ID NO: 539421 - DNA, 25 bp, Homo sapien
gaagactctgtgtgattctcatggc

SEQ ID NO: 539422 - DNA, 25 bp, Homo sapien
aagactctgtgtgattctcatggcg

SEQ ID NO: 539423 - DNA, 25 bp, Homo sapien
gactctgtgtgattctcatggcgga

SEQ ID NO: 539424 - DNA, 25 bp, Homo sapien
actctgtgtgattctcatggcggaa

SEQ ID NO: 539425 - DNA, 25 bp, Homo sapien
ctctgtgtgattctcatggcggaag

SEQ ID NO: 539426 - DNA, 25 bp, Homo sapien
tgtgtgattctcatggcggaaggac

SEQ ID NO: 539427 - DNA, 25 bp, Homo sapien
tgtgattctcatggcggaaggacaa

SEQ ID NO: 539428 - DNA, 25 bp, Homo sapien
attctcatggcggaaggacaagagg

SEQ ID NO: 539429 - DNA, 25 bp, Homo sapien
aacaaagaagaccacacactgggaa

SEQ ID NO: 539430 - DNA, 25 bp, Homo sapien
aagaagaccacacactgggaaacat

SEQ ID NO: 539431 - DNA, 25 bp, Homo sapien
aagaccacacactgggaaacatcat

SEQ ID NO: 539432 - DNA, 25 bp, Homo sapien
ctccagccttcgagtcgttcttgct

SEQ ID NO: 539433 - DNA, 25 bp, Homo sapien
agccttcgagtcgttcttgctcttc

SEQ ID NO: 539434 - DNA, 25 bp, Homo sapien
ttcgagtcgttcttgctcttcgagg

SEQ ID NO: 539435 - DNA, 25 bp, Homo sapien
agtcgttcttgctcttcgagggcga

SEQ ID NO: 539436 - DNA, 25 bp, Homo sapien
cgttcttgctcttcgagggcgagaa

SEQ ID NO: 539437 - DNA, 25 bp, Homo sapien
ttcttgctcttcgagggcgagaaga

SEQ ID NO: 539438 - DNA, 25 bp, Homo sapien
aaggacaccaaggtacccaatgcct

SEQ ID NO: 539439 - DNA, 25 bp, Homo sapien
aggacaccaaggtacccaatgcctg

SEQ ID NO: 539440 - DNA, 25 bp, Homo sapien
gcactacagactacagggccggaga

SEQ ID NO: 539441 - DNA, 25 bp, Homo sapien
tacagggccggagacaccaggcttg

SEQ ID NO: 539442 - DNA, 25 bp, Homo sapien
gacaccaggcttggaagtgaccact

SEQ ID NO: 539443 - DNA, 25 bp, Homo sapien
gtgaccactggccaagagctgacat

SEQ ID NO: 539444 - DNA, 25 bp, Homo sapien
tgacataaaagccaacttccccaaa

SEQ ID NO: 539445 - DNA, 25 bp, Homo sapien
caggaagggcctgttcttcacaaag

SEQ ID NO: 539446 - DNA, 25 bp, Homo sapien
gccatgcaaaattaaccagtacatc

SEQ ID NO: 539447 - DNA, 25 bp, Homo sapien
attaacttcttttactctgctgtgc

SEQ ID NO: 539448 - DNA, 25 bp, Homo sapien
tgctgtgcactgaataccattatga

SEQ ID NO: 539449 - DNA, 25 bp, Homo sapien
gcatttttgtggaaaatctgctaca

SEQ ID NO: 539450 - DNA, 25 bp, Homo sapien
aaaatctgctacatgttttcataaa

SEQ ID NO: 539451 - DNA, 25 bp, Homo sapien
aaacccagactaattgtgtgtaatt

SEQ ID NO: 539452 - DNA, 25 bp, Homo sapien
gaaagtacatttcctataatagcat

SEQ ID NO: 539453 - DNA, 25 bp, Homo sapien
aatagcatagtactgtttgcatgta

SEQ ID NO: 539454 - DNA, 25 bp, Homo sapien
catgtaagagtatgcaaaaccttgt

SEQ ID NO: 539455 - DNA, 25 bp, Homo sapien
gtcttagtgtgtgtaaggcatggca

SEQ ID NO: 539456 - DNA, 25 bp, Homo sapien
ggcatggcagccaactttgtatctg

SEQ ID NO: 539457 - DNA, 25 bp, Homo sapien
gccaactttgtatctgctattttta

SEQ ID NO: 539458 - DNA, 25 bp, Homo sapien
ctatttttagtacgagcagagcttc

SEQ ID NO: 539459 - DNA, 25 bp, Homo sapien
gcagagcttcataattgtggtcact

SEQ ID NO: 539460 - DNA, 25 bp, Homo sapien
ttgtggtcactagaactgtacttac

SEQ ID NO: 539461 - DNA, 25 bp, Homo sapien
gtacttaccatggacagttaaaact

SEQ ID NO: 539462 - DNA, 25 bp, Homo sapien
tggggacacgcagcctagccactgt

SEQ ID NO: 539463 - DNA, 25 bp, Homo sapien
agcctagccactgtcctgcctggga

SEQ ID NO: 539464 - DNA, 25 bp, Homo sapien
ccggctgcagggtggataaagagga

SEQ ID NO: 539465 - DNA, 25 bp, Homo sapien
agacaaaagcaaaaggacatcctgt

SEQ ID NO: 539466 - DNA, 25 bp, Homo sapien
atcctgtcagtaggaaacggccgaa

SEQ ID NO: 539467 - DNA, 25 bp, Homo sapien
gtcagtaggaaacggccgaattaca

SEQ ID NO: 539468 - DNA, 25 bp, Homo sapien
gaaacggccgaattacaattcagat

SEQ ID NO: 539469 - DNA, 25 bp, Homo sapien
caattcagatgtgcaatgtttgcat

SEQ ID NO: 539470 - DNA, 25 bp, Homo sapien
gtgcaatgtttgcataagtaaactg

SEQ ID NO: 539471 - DNA, 25 bp, Homo sapien
ggatccgagggctccgtccttgtgc

SEQ ID NO: 539472 - DNA, 25 bp, Homo sapien
gagggctccgtccttgtgctgtctt

SEQ ID NO: 539473 - DNA, 25 bp, Homo sapien
gcattaacaactcttttatttgaaa

SEQ ID NO: 539474 - DNA, 25 bp, Homo sapien
gaaaagagccttttgagttcacagg

SEQ ID NO: 539475 - DNA, 25 bp, Homo sapien
gagccttttgagttcacaggtgccc

SEQ ID NO: 539476 - DNA, 25 bp, Homo sapien
cttttgagttcacaggtgccccttc

SEQ ID NO: 539477 - DNA, 25 bp, Homo sapien
actctccgtcttcttagggagcagt

SEQ ID NO: 539478 - DNA, 25 bp, Homo sapien
tgggcgatggtgactttgcccagca

SEQ ID NO: 539479 - DNA, 25 bp, Homo sapien
ggcgatggtgactttgcccagcagc

SEQ ID NO: 539480 - DNA, 25 bp, Homo sapien
gatggtgactttgcccagcagcttg

SEQ ID NO: 539481 - DNA, 25 bp, Homo sapien
gtgactttgcccagcagcttgttca

SEQ ID NO: 539482 - DNA, 25 bp, Homo sapien
actttgcccagcagcttgttcagtt

SEQ ID NO: 539483 - DNA, 25 bp, Homo sapien
tgcccagcagcttgttcagttcctc

SEQ ID NO: 539484 - DNA, 25 bp, Homo sapien
ttcgaactggtcctttcactttgag

SEQ ID NO: 539485 - DNA, 25 bp, Homo sapien
gaactggtcctttcactttgagatt

SEQ ID NO: 539486 - DNA, 25 bp, Homo sapien
ctggtcctttcactttgagattctt

SEQ ID NO: 539487 - DNA, 25 bp, Homo sapien
ttcgaattcggtgaattgccacctc

SEQ ID NO: 539488 - DNA, 25 bp, Homo sapien
attcggtgaattgccacctccggct

SEQ ID NO: 539489 - DNA, 25 bp, Homo sapien
agccatggctgttgcgcgcgggctt

SEQ ID NO: 539490 - DNA, 25 bp, Homo sapien
gcgcgggcttcctgaccgacttgtt

SEQ ID NO: 539491 - DNA, 25 bp, Homo sapien
tgaccgacttgttcctcggcgagag

SEQ ID NO: 539492 - DNA, 25 bp, Homo sapien
ttcctcggcgagagcgaacagcggt

SEQ ID NO: 539493 - DNA, 25 bp, Homo sapien
ggagcgtgcggaccaaaaatcctca

SEQ ID NO: 539494 - DNA, 25 bp, Homo sapien
agcgtgcggaccaaaaatcctcagc

SEQ ID NO: 539495 - DNA, 25 bp, Homo sapien
ggaggctctaggaaggttctgggtt

SEQ ID NO: 539496 - DNA, 25 bp, Homo sapien
gtcagtgcatctcagggagaaccaa

SEQ ID NO: 539497 - DNA, 25 bp, Homo sapien
gtgcatctcagggagaaccaaggaa

SEQ ID NO: 539498 - DNA, 25 bp, Homo sapien
ggaaggagccccaggtgtcagggca

SEQ ID NO: 539499 - DNA, 25 bp, Homo sapien
ccccaggtgtcagggcagtaggctg

SEQ ID NO: 539500 - DNA, 25 bp, Homo sapien
tgtcagggcagtaggctgggagtca

SEQ ID NO: 539501 - DNA, 25 bp, Homo sapien
tgagagaaggcagcgaggcggcaga

SEQ ID NO: 539502 - DNA, 25 bp, Homo sapien
gggtgggtcagctgtcagcatccct

SEQ ID NO: 539503 - DNA, 25 bp, Homo sapien
gtgggtcagctgtcagcatccctca

SEQ ID NO: 539504 - DNA, 25 bp, Homo sapien
gggtcagctgtcagcatccctcaga

SEQ ID NO: 539505 - DNA, 25 bp, Homo sapien
tcagctgtcagcatccctcagagga

SEQ ID NO: 539506 - DNA, 25 bp, Homo sapien
tccaggttgagaattacctgttttc

SEQ ID NO: 539507 - DNA, 25 bp, Homo sapien
caggttgagaattacctgttttcca

SEQ ID NO: 539508 - DNA, 25 bp, Homo sapien
tacctgttttccactctgaggggat

SEQ ID NO: 539509 - DNA, 25 bp, Homo sapien
cctgttttccactctgaggggatta

SEQ ID NO: 539510 - DNA, 25 bp, Homo sapien
ttgtgtgaagaagattggccttctc

SEQ ID NO: 539511 - DNA, 25 bp, Homo sapien
gtgtgaagaagattggccttctcca

SEQ ID NO: 539512 - DNA, 25 bp, Homo sapien
tgtgaagaagattggccttctccac

SEQ ID NO: 539513 - DNA, 25 bp, Homo sapien
gtgaagaagattggccttctccacc

SEQ ID NO: 539514 - DNA, 25 bp, Homo sapien
aagaagattggccttctccacctct

SEQ ID NO: 539515 - DNA, 25 bp, Homo sapien
agaagattggccttctccacctctc

SEQ ID NO: 539516 - DNA, 25 bp, Homo sapien
cttctccacctctcctgtgaaataa

SEQ ID NO: 539517 - DNA, 25 bp, Homo sapien
aatctgtcaccgactgcttgacttg

SEQ ID NO: 539518 - DNA, 25 bp, Homo sapien
agtctaggattggtgccaagagcat

SEQ ID NO: 539519 - DNA, 25 bp, Homo sapien
gaaggtggaccacttatttcccatt

SEQ ID NO: 539520 - DNA, 25 bp, Homo sapien
ttatttcccattgctaattgcctgc

SEQ ID NO: 539521 - DNA, 25 bp, Homo sapien
attgcctgcccggttttgaaacagt

SEQ ID NO: 539522 - DNA, 25 bp, Homo sapien
gaaacagtctgcagtacacacggtg

SEQ ID NO: 539523 - DNA, 25 bp, Homo sapien
gtacacacggtgacaggagaatgac

SEQ ID NO: 539524 - DNA, 25 bp, Homo sapien
tgacctgtgggagagatacatgttt

SEQ ID NO: 539525 - DNA, 25 bp, Homo sapien
gtatatgatggagtgaaccggtcca

SEQ ID NO: 539526 - DNA, 25 bp, Homo sapien
gaaccggtccatggatgtgtaacac

SEQ ID NO: 539527 - DNA, 25 bp, Homo sapien
gtgtaacacaagaccaactgagagt

SEQ ID NO: 539528 - DNA, 25 bp, Homo sapien
ccagtggcgactacagcagggactg

SEQ ID NO: 539529 - DNA, 25 bp, Homo sapien
gactacagcagggactggctgccaa

SEQ ID NO: 539530 - DNA, 25 bp, Homo sapien
actacagcagggactggctgccaac

SEQ ID NO: 539531 - DNA, 25 bp, Homo sapien
tacagcagggactggctgccaaccc

SEQ ID NO: 539532 - DNA, 25 bp, Homo sapien
ttaccgagctcccagactggtcata

SEQ ID NO: 539533 - DNA, 25 bp, Homo sapien
accgagctcccagactggtcatatg

SEQ ID NO: 539534 - DNA, 25 bp, Homo sapien
ccgagctcccagactggtcatatgc

SEQ ID NO: 539535 - DNA, 25 bp, Homo sapien
cagactggtcatatgcggatggccg

SEQ ID NO: 539536 - DNA, 25 bp, Homo sapien
ggagacgtttgcaagacgagttgta

SEQ ID NO: 539537 - DNA, 25 bp, Homo sapien
agacgtttgcaagacgagttgtact

SEQ ID NO: 539538 - DNA, 25 bp, Homo sapien
acgtttgcaagacgagttgtactgc

SEQ ID NO: 539539 - DNA, 25 bp, Homo sapien
caagatctcctataaggacgcgctg

SEQ ID NO: 539540 - DNA, 25 bp, Homo sapien
gatctcctataaggacgcgctggac

SEQ ID NO: 539541 - DNA, 25 bp, Homo sapien
tctcctataaggacgcgctggaccg

SEQ ID NO: 539542 - DNA, 25 bp, Homo sapien
tataaggacgcgctggaccgcagca

SEQ ID NO: 539543 - DNA, 25 bp, Homo sapien
taaggacgcgctggaccgcagcatg

SEQ ID NO: 539544 - DNA, 25 bp, Homo sapien
aggctgccgcgcagtccaccaaggg

SEQ ID NO: 539545 - DNA, 25 bp, Homo sapien
cgcagtccaccaagggctactacag

SEQ ID NO: 539546 - DNA, 25 bp, Homo sapien
tactacagcccctacagcgtcagcg

SEQ ID NO: 539547 - DNA, 25 bp, Homo sapien
agcgtcagcggctccggctctaccg

SEQ ID NO: 539548 - DNA, 25 bp, Homo sapien
gccgcggcagctttgacgccaccgg

SEQ ID NO: 539549 - DNA, 25 bp, Homo sapien
atgaccttctcttcatcctcctact

SEQ ID NO: 539550 - DNA, 25 bp, Homo sapien
tgagggccaagctgcctggccactg

SEQ ID NO: 539551 - DNA, 25 bp, Homo sapien
gggctggagtctggctggtccaaca

SEQ ID NO: 539552 - DNA, 25 bp, Homo sapien
aacacagattctgcctggtccaaca

SEQ ID NO: 539553 - DNA, 25 bp, Homo sapien
acagattctgcctggtccaacacag

SEQ ID NO: 539554 - DNA, 25 bp, Homo sapien
gattctgcctggtccaacacagatt

SEQ ID NO: 539555 - DNA, 25 bp, Homo sapien
ttctgcctggtccaacacagattct

SEQ ID NO: 539556 - DNA, 25 bp, Homo sapien
tctgcctgagcctccttatttattt

SEQ ID NO: 539557 - DNA, 25 bp, Homo sapien
ccagggcaggcagaagctagggcct

SEQ ID NO: 539558 - DNA, 25 bp, Homo sapien
gggatgctccccagggttagggtgc

SEQ ID NO: 539559 - DNA, 25 bp, Homo sapien
ctccccagggttagggtgctggtgt

SEQ ID NO: 539560 - DNA, 25 bp, Homo sapien
agaaacatggttttgtacagaaata

SEQ ID NO: 539561 - DNA, 25 bp, Homo sapien
ccctcctggctcagggttgccggga

SEQ ID NO: 539562 - DNA, 25 bp, Homo sapien
gtgatggctgctgtgcctctcctga

SEQ ID NO: 539563 - DNA, 25 bp, Homo sapien
cgtttgtctccaggcgcagtgtcag

SEQ ID NO: 539564 - DNA, 25 bp, Homo sapien
gcagtgtcagtctcgttctttaagc

SEQ ID NO: 539565 - DNA, 25 bp, Homo sapien
agtctcgttctttaagcgcttctga

SEQ ID NO: 539566 - DNA, 25 bp, Homo sapien
tttaagcgcttctgaggtcccatca

SEQ ID NO: 539567 - DNA, 25 bp, Homo sapien
tgaggtcccatcagcacaggtctcg

SEQ ID NO: 539568 - DNA, 25 bp, Homo sapien
ggtctcgtcttacctggaaaggctt

SEQ ID NO: 539569 - DNA, 25 bp, Homo sapien
gaaaggcttgttgccttgtgcctgg

SEQ ID NO: 539570 - DNA, 25 bp, Homo sapien
ttgtgcctgggactttttattctgt

SEQ ID NO: 539571 - DNA, 25 bp, Homo sapien
tgggactttttattctgtgcttttc

SEQ ID NO: 539572 - DNA, 25 bp, Homo sapien
atcaccgacctcatcagtgagctgt

SEQ ID NO: 539573 - DNA, 25 bp, Homo sapien
tcatcagtgagctgtccctgctgga

SEQ ID NO: 539574 - DNA, 25 bp, Homo sapien
cctgctggaggagcgctttcgggtg

SEQ ID NO: 539575 - DNA, 25 bp, Homo sapien
gagccccgttcctacctgtgcctga

SEQ ID NO: 539576 - DNA, 25 bp, Homo sapien
tgtgcctgaccctccgctccaggta

SEQ ID NO: 539577 - DNA, 25 bp, Homo sapien
gctccaggtaccacaccgaggagag

SEQ ID NO: 539578 - DNA, 25 bp, Homo sapien
tccaggtaccacaccgaggagagcg

SEQ ID NO: 539579 - DNA, 25 bp, Homo sapien
gaggagagcggccggtcccagccat

SEQ ID NO: 539580 - DNA, 25 bp, Homo sapien
cggtcccagccatggcccgccttgt

SEQ ID NO: 539581 - DNA, 25 bp, Homo sapien
ctgacaccgacgtgtcctgtacata

SEQ ID NO: 539582 - DNA, 25 bp, Homo sapien
gacgtgtcctgtacatagattaggt

SEQ ID NO: 539583 - DNA, 25 bp, Homo sapien
cacaagtgttgtggccttcctgaac

SEQ ID NO: 539584 - DNA, 25 bp, Homo sapien
ttcctgaactgggaagtccctggct

SEQ ID NO: 539585 - DNA, 25 bp, Homo sapien
gggcaaatgcctccgggactgacac

SEQ ID NO: 539586 - DNA, 25 bp, Homo sapien
gggactgacactccaggcagctttg

SEQ ID NO: 539587 - DNA, 25 bp, Homo sapien
gtcatttccagatttcattacctcc

SEQ ID NO: 539588 - DNA, 25 bp, Homo sapien
atttcattacctcctacttgccatt

SEQ ID NO: 539589 - DNA, 25 bp, Homo sapien
aaagtcagggtcacagctggtctgt

SEQ ID NO: 539590 - DNA, 25 bp, Homo sapien
gtctgtgtgtccagttccctaaaag

SEQ ID NO: 539591 - DNA, 25 bp, Homo sapien
aaaagcctgttctgttgggcagcct

SEQ ID NO: 539592 - DNA, 25 bp, Homo sapien
gttgcccgaatcctagttcagtttt

SEQ ID NO: 539593 - DNA, 25 bp, Homo sapien
tcagttttttgacttcctttgccct

SEQ ID NO: 539594 - DNA, 25 bp, Homo sapien
tctactctgaagcacacagggggct

SEQ ID NO: 539595 - DNA, 25 bp, Homo sapien
cgtctggagacgtcgatgtggtcat

SEQ ID NO: 539596 - DNA, 25 bp, Homo sapien
tggagacgtcgatgtggtcatagca

SEQ ID NO: 539597 - DNA, 25 bp, Homo sapien
acgtcgatgtggtcatagcagggcc

SEQ ID NO: 539598 - DNA, 25 bp, Homo sapien
cgatgtggtcatagcagggcctgga

SEQ ID NO: 539599 - DNA, 25 bp, Homo sapien
ggtctggcctgaactagagaaatga

SEQ ID NO: 539600 - DNA, 25 bp, Homo sapien
ccctggcctcagatgaagaggctct

SEQ ID NO: 539601 - DNA, 25 bp, Homo sapien
tggccttcggagttacgaggaaacg

SEQ ID NO: 539602 - DNA, 25 bp, Homo sapien
gccttcggagttacgaggaaacgag

SEQ ID NO: 539603 - DNA, 25 bp, Homo sapien
gaaacgaggaccaggaccagggatt

SEQ ID NO: 539604 - DNA, 25 bp, Homo sapien
ggaccagggattctgcatcagcaca

SEQ ID NO: 539605 - DNA, 25 bp, Homo sapien
ttcaacctcaaagagaccccagtgt

SEQ ID NO: 539606 - DNA, 25 bp, Homo sapien
cattcaagcagcctttaggttatag

SEQ ID NO: 539607 - DNA, 25 bp, Homo sapien
gagatgatttacagtcacatggaag

SEQ ID NO: 539608 - DNA, 25 bp, Homo sapien
gtcacatggaaggagagttttgctt

SEQ ID NO: 539609 - DNA, 25 bp, Homo sapien
agtgatggacttaaccaggatttaa

SEQ ID NO: 539610 - DNA, 25 bp, Homo sapien
aatgaggtaagcttgctagctacac

SEQ ID NO: 539611 - DNA, 25 bp, Homo sapien
gctacacaaatcatcttcacaactc

SEQ ID NO: 539612 - DNA, 25 bp, Homo sapien
ttaaccaggatttaaccctcggcag

SEQ ID NO: 539613 - DNA, 25 bp, Homo sapien
ggatttaaccctcggcagtctgatc

SEQ ID NO: 539614 - DNA, 25 bp, Homo sapien
tgatccccgagctccgagtgctaat

SEQ ID NO: 539615 - DNA, 25 bp, Homo sapien
gagctccgagtgctaatcgttcacc

SEQ ID NO: 539616 - DNA, 25 bp, Homo sapien
gacacatgcagggtgctcatctggg

SEQ ID NO: 539617 - DNA, 25 bp, Homo sapien
ggtggcctcgctgctgccattgtga

SEQ ID NO: 539618 - DNA, 25 bp, Homo sapien
tcgctgctgccattgtgagggactg

SEQ ID NO: 539619 - DNA, 25 bp, Homo sapien
ttgtccatatggagatcccaggctt

SEQ ID NO: 539620 - DNA, 25 bp, Homo sapien
ggagatcccaggcttggtctgccat

SEQ ID NO: 539621 - DNA, 25 bp, Homo sapien
ttggtctgccatcttctggcccagt

SEQ ID NO: 539622 - DNA, 25 bp, Homo sapien
ttctggcccagtcccggtgcctgag

SEQ ID NO: 539623 - DNA, 25 bp, Homo sapien
ctgctggttgttgggctgccgtcct

SEQ ID NO: 539624 - DNA, 25 bp, Homo sapien
gccgtcctggatctcaggatcgatg

SEQ ID NO: 539625 - DNA, 25 bp, Homo sapien
atcgatgtggatcctgtgtgcctga

SEQ ID NO: 539626 - DNA, 25 bp, Homo sapien
tgcctgagccttgctgtcatcaggg

SEQ ID NO: 539627 - DNA, 25 bp, Homo sapien
cattttctgattaaacgactgtgtc

SEQ ID NO: 539628 - DNA, 25 bp, Homo sapien
aaacgactgtgtctttgtcacctct

SEQ ID NO: 539629 - DNA, 25 bp, Homo sapien
tgtcacctctgcttaactttaggag

SEQ ID NO: 539630 - DNA, 25 bp, Homo sapien
ggagtatccattcctgtgattgtag

SEQ ID NO: 539631 - DNA, 25 bp, Homo sapien
atcattcttttcttgaagggttggt

SEQ ID NO: 539632 - DNA, 25 bp, Homo sapien
aatcaatcatgaaggcagttactat

SEQ ID NO: 539633 - DNA, 25 bp, Homo sapien
ggcagttactattttgagtctaaag

SEQ ID NO: 539634 - DNA, 25 bp, Homo sapien
taaaaattaacctcacatcccttct

SEQ ID NO: 539635 - DNA, 25 bp, Homo sapien
acatcccttctgttagggtctttca

SEQ ID NO: 539636 - DNA, 25 bp, Homo sapien
tgttagggtctttcagaatatcttt

SEQ ID NO: 539637 - DNA, 25 bp, Homo sapien
gcttttgctacatgatttgtgtgtg

SEQ ID NO: 539638 - DNA, 25 bp, Homo sapien
gatagattgtacataacatcagcag

SEQ ID NO: 539639 - DNA, 25 bp, Homo sapien
atctatagatgagtcagctccacac

SEQ ID NO: 539640 - DNA, 25 bp, Homo sapien
agatgagtcagctccacacttgagt

SEQ ID NO: 539641 - DNA, 25 bp, Homo sapien
agtcagctccacacttgagtctctt

SEQ ID NO: 539642 - DNA, 25 bp, Homo sapien
tccacacttgagtctctttttagag

SEQ ID NO: 539643 - DNA, 25 bp, Homo sapien
cacttgagtctctttttagagggaa

SEQ ID NO: 539644 - DNA, 25 bp, Homo sapien
actttgtaaggtaagagagtatcca

SEQ ID NO: 539645 - DNA, 25 bp, Homo sapien
gagagtatccatatgcttagatgtg

SEQ ID NO: 539646 - DNA, 25 bp, Homo sapien
gatgtgctcgtttctaaaattctag

SEQ ID NO: 539647 - DNA, 25 bp, Homo sapien
gctcgtttctaaaattctagaggtt

SEQ ID NO: 539648 - DNA, 25 bp, Homo sapien
ttctagaggttgatataatcagctc

SEQ ID NO: 539649 - DNA, 25 bp, Homo sapien
ttttttcaccctgaaccattggcaa

SEQ ID NO: 539650 - DNA, 25 bp, Homo sapien
tttcaccctgaaccattggcaacca

SEQ ID NO: 539651 - DNA, 25 bp, Homo sapien
accctgaaccattggcaaccacaat

SEQ ID NO: 539652 - DNA, 25 bp, Homo sapien
tggcaaccacaattttactttcttt

SEQ ID NO: 539653 - DNA, 25 bp, Homo sapien
ctgtgagtttgattacttgatactt

SEQ ID NO: 539654 - DNA, 25 bp, Homo sapien
gtttgattacttgatacttcatgtg

SEQ ID NO: 539655 - DNA, 25 bp, Homo sapien
tacttgatacttcatgtgagtggaa

SEQ ID NO: 539656 - DNA, 25 bp, Homo sapien
gcttaatgtcttcaagtttgaccca

SEQ ID NO: 539657 - DNA, 25 bp, Homo sapien
agtttgacccataccatatcatgtg

SEQ ID NO: 539658 - DNA, 25 bp, Homo sapien
gacccataccatatcatgtggcagg

SEQ ID NO: 539659 - DNA, 25 bp, Homo sapien
ataccatatcatgtggcaggatttt

SEQ ID NO: 539660 - DNA, 25 bp, Homo sapien
atctacatagatatgctttgctgag

SEQ ID NO: 539661 - DNA, 25 bp, Homo sapien
gctttgctgagaagttaggtctgtg

SEQ ID NO: 539662 - DNA, 25 bp, Homo sapien
aagttaggtctgtggtagaccagaa

SEQ ID NO: 539663 - DNA, 25 bp, Homo sapien
gatttctggagtgtctgttattcaa

SEQ ID NO: 539664 - DNA, 25 bp, Homo sapien
gagtgtctgttattcaatgatgtat

SEQ ID NO: 539665 - DNA, 25 bp, Homo sapien
tatatactcccacagctcgcatgaa

SEQ ID NO: 539666 - DNA, 25 bp, Homo sapien
tcccacagctcgcatgaaggaacag

SEQ ID NO: 539667 - DNA, 25 bp, Homo sapien
aggaacagcctctattgatacttgg

SEQ ID NO: 539668 - DNA, 25 bp, Homo sapien
cagcctctattgatacttggttgta

SEQ ID NO: 539669 - DNA, 25 bp, Homo sapien
agggtggatggctgtcagagctctt

SEQ ID NO: 539670 - DNA, 25 bp, Homo sapien
tgcagatactgtgttcactaaataa

SEQ ID NO: 539671 - DNA, 25 bp, Homo sapien
cctgcctgaatggatgggtccatcc

SEQ ID NO: 539672 - DNA, 25 bp, Homo sapien
atgggtccatcccaggcactggtac

SEQ ID NO: 539673 - DNA, 25 bp, Homo sapien
accctaggcccttgagaagctgata

SEQ ID NO: 539674 - DNA, 25 bp, Homo sapien
gaagctgatacttctccttttgctc

SEQ ID NO: 539675 - DNA, 25 bp, Homo sapien
tccttttgctcacagctgccttggc

SEQ ID NO: 539676 - DNA, 25 bp, Homo sapien
cccacccctgggagatgtagcaaat

SEQ ID NO: 539677 - DNA, 25 bp, Homo sapien
tgtgggttttggagtctgagcctca

SEQ ID NO: 539678 - DNA, 25 bp, Homo sapien
gagcctcaggctcaaatccaggcca

SEQ ID NO: 539679 - DNA, 25 bp, Homo sapien
ggcaagttaatctctgggaactttg

SEQ ID NO: 539680 - DNA, 25 bp, Homo sapien
tctctgggaactttgggtttcttat

SEQ ID NO: 539681 - DNA, 25 bp, Homo sapien
gtttcttatcctcaaaaaaggcgat

SEQ ID NO: 539682 - DNA, 25 bp, Homo sapien
agggccccatttctgatgtcgccag

SEQ ID NO: 539683 - DNA, 25 bp, Homo sapien
ttctgatgtcgccaggtgtgcctga

SEQ ID NO: 539684 - DNA, 25 bp, Homo sapien
ggaggatgggatgaccccctgttcc

SEQ ID NO: 539685 - DNA, 25 bp, Homo sapien
gccatggtggaaaaggccctgccat

SEQ ID NO: 539686 - DNA, 25 bp, Homo sapien
ggaacgggtcccaggacagactcat

SEQ ID NO: 539687 - DNA, 25 bp, Homo sapien
aggacagactcatagctagaccccg

SEQ ID NO: 539688 - DNA, 25 bp, Homo sapien
actcatagctagaccccgttggcgg

SEQ ID NO: 539689 - DNA, 25 bp, Homo sapien
gttggcggcctctgtgttgaaccag

SEQ ID NO: 539690 - DNA, 25 bp, Homo sapien
gcggcctctgtgttgaaccagaact

SEQ ID NO: 539691 - DNA, 25 bp, Homo sapien
ctgtgttgaaccagaactcattaaa

SEQ ID NO: 539692 - DNA, 25 bp, Homo sapien
aactcattaaacacctcctcttgct

SEQ ID NO: 539693 - DNA, 25 bp, Homo sapien
atcttcagggcttacgtctttactt

SEQ ID NO: 539694 - DNA, 25 bp, Homo sapien
cgtctttactttcttggctaaccag

SEQ ID NO: 539695 - DNA, 25 bp, Homo sapien
ttggctaaccagtttcttagaagaa

SEQ ID NO: 539696 - DNA, 25 bp, Homo sapien
gggatctacagtcatgctttagcat

SEQ ID NO: 539697 - DNA, 25 bp, Homo sapien
gcatggctatggagctaattatcaa

SEQ ID NO: 539698 - DNA, 25 bp, Homo sapien
ttcactcctagtctcccttggaaga

SEQ ID NO: 539699 - DNA, 25 bp, Homo sapien
gtctcccttggaagagcagtccagg

SEQ ID NO: 539700 - DNA, 25 bp, Homo sapien
aaactgaagctgtcaatagtgaagg

SEQ ID NO: 539701 - DNA, 25 bp, Homo sapien
gggaattcttcgttgctttggcatt

SEQ ID NO: 539702 - DNA, 25 bp, Homo sapien
tcttcgttgctttggcattgacaca

SEQ ID NO: 539703 - DNA, 25 bp, Homo sapien
tggcattgacacataagtactttga

SEQ ID NO: 539704 - DNA, 25 bp, Homo sapien
gaacgtccccaagccctgtctccct

SEQ ID NO: 539705 - DNA, 25 bp, Homo sapien
aacgtccccaagccctgtctccctg

SEQ ID NO: 539706 - DNA, 25 bp, Homo sapien
acgtccccaagccctgtctccctgt

SEQ ID NO: 539707 - DNA, 25 bp, Homo sapien
tctccctgtctctacagctgcatgc

SEQ ID NO: 539708 - DNA, 25 bp, Homo sapien
ctccctgtctctacagctgcatgct

SEQ ID NO: 539709 - DNA, 25 bp, Homo sapien
tccctgtctctacagctgcatgctc

SEQ ID NO: 539710 - DNA, 25 bp, Homo sapien
ccctgtctctacagctgcatgctcc

SEQ ID NO: 539711 - DNA, 25 bp, Homo sapien
cctgtctctacagctgcatgctcct

SEQ ID NO: 539712 - DNA, 25 bp, Homo sapien
ctgtctctacagctgcatgctcctc

SEQ ID NO: 539713 - DNA, 25 bp, Homo sapien
tgtctctacagctgcatgctcctct

SEQ ID NO: 539714 - DNA, 25 bp, Homo sapien
gtctctacagctgcatgctcctctg

SEQ ID NO: 539715 - DNA, 25 bp, Homo sapien
tggaacagaatcaccaaagggtgaa

SEQ ID NO: 539716 - DNA, 25 bp, Homo sapien
aaagggtgaacaggactaaggcaat

SEQ ID NO: 539717 - DNA, 25 bp, Homo sapien
aaggcaatgtagtgtatggctcagc

SEQ ID NO: 539718 - DNA, 25 bp, Homo sapien
ggcaatgtagtgtatggctcagcta

SEQ ID NO: 539719 - DNA, 25 bp, Homo sapien
tagtgtatggctcagctacgtcaga

SEQ ID NO: 539720 - DNA, 25 bp, Homo sapien
ggctcagctacgtcagagtggaaaa

SEQ ID NO: 539721 - DNA, 25 bp, Homo sapien
gaaaaggtgttattagagcagaaac

SEQ ID NO: 539722 - DNA, 25 bp, Homo sapien
agaaactatggtccctgcgtcacag

SEQ ID NO: 539723 - DNA, 25 bp, Homo sapien
actatggtccctgcgtcacagggaa

SEQ ID NO: 539724 - DNA, 25 bp, Homo sapien
tgcgtcacagggaagcaacctacag

SEQ ID NO: 539725 - DNA, 25 bp, Homo sapien
acagggaagcaacctacagagaagc

SEQ ID NO: 539726 - DNA, 25 bp, Homo sapien
ttcaatggggctgataccttcacag

SEQ ID NO: 539727 - DNA, 25 bp, Homo sapien
cacagcatgggcacttatgaggaca

SEQ ID NO: 539728 - DNA, 25 bp, Homo sapien
gcatgggcacttatgaggacaaagt

SEQ ID NO: 539729 - DNA, 25 bp, Homo sapien
gagtttcttttaaataatcagcggg

SEQ ID NO: 539730 - DNA, 25 bp, Homo sapien
aatcagcgggtgttggtgatttgta

SEQ ID NO: 539731 - DNA, 25 bp, Homo sapien
gttggtgatttgtagcccttctgcc

SEQ ID NO: 539732 - DNA, 25 bp, Homo sapien
cccttaaatgcttccttgggcaaga

SEQ ID NO: 539733 - DNA, 25 bp, Homo sapien
ttccttgggcaagagctgtctgtcc

SEQ ID NO: 539734 - DNA, 25 bp, Homo sapien
tgggcaagagctgtctgtcctccct

SEQ ID NO: 539735 - DNA, 25 bp, Homo sapien
tgtctgtcctccctgcaggaggctg

SEQ ID NO: 539736 - DNA, 25 bp, Homo sapien
gtatcattcattgtttctctattaa

SEQ ID NO: 539737 - DNA, 25 bp, Homo sapien
agtcctgttggccaccaagtgtcag

SEQ ID NO: 539738 - DNA, 25 bp, Homo sapien
aagtgtcagcctcagcactcccggg

SEQ ID NO: 539739 - DNA, 25 bp, Homo sapien
cactcccgggactattgccaagaag

SEQ ID NO: 539740 - DNA, 25 bp, Homo sapien
caagaaggtgagacccttcccggtg

SEQ ID NO: 539741 - DNA, 25 bp, Homo sapien
tgtttggtactgtccatgtctgggt

SEQ ID NO: 539742 - DNA, 25 bp, Homo sapien
tgggtgtgtgcctattacctcagca

SEQ ID NO: 539743 - DNA, 25 bp, Homo sapien
ttacctcagcatttctcacaaagtg

SEQ ID NO: 539744 - DNA, 25 bp, Homo sapien
cacaaagtgtaccatgtagcatgtt

SEQ ID NO: 539745 - DNA, 25 bp, Homo sapien
aaatatattcccagattatccttgt

SEQ ID NO: 539746 - DNA, 25 bp, Homo sapien
atccttgtaatgacacgaatctgca

SEQ ID NO: 539747 - DNA, 25 bp, Homo sapien
gaatctgcaataaaagccatcagtg

SEQ ID NO: 539748 - DNA, 25 bp, Homo sapien
ccagcacaggcagctagaagggccg

SEQ ID NO: 539749 - DNA, 25 bp, Homo sapien
aggcagctagaagggccggtgggca

SEQ ID NO: 539750 - DNA, 25 bp, Homo sapien
gcaacttcagtgtccctgttagagc

SEQ ID NO: 539751 - DNA, 25 bp, Homo sapien
caacttcagtgtccctgttagagca

SEQ ID NO: 539752 - DNA, 25 bp, Homo sapien
tgttagagcaacacgggtccctccg

SEQ ID NO: 539753 - DNA, 25 bp, Homo sapien
agagcaacacgggtccctccgtggg

SEQ ID NO: 539754 - DNA, 25 bp, Homo sapien
tgccgtgtatttcctccccagggag

SEQ ID NO: 539755 - DNA, 25 bp, Homo sapien
cgtgtatttcctccccagggagtgg

SEQ ID NO: 539756 - DNA, 25 bp, Homo sapien
gagctgacgccaccaccctgcttag

SEQ ID NO: 539757 - DNA, 25 bp, Homo sapien
tcacagggccccaaggtgtccgagt

SEQ ID NO: 539758 - DNA, 25 bp, Homo sapien
acagggccccaaggtgtccgagtgt

SEQ ID NO: 539759 - DNA, 25 bp, Homo sapien
agtggctctgcagggtcactcatgg

SEQ ID NO: 539760 - DNA, 25 bp, Homo sapien
gggaacagcgagatgccccaccacc

SEQ ID NO: 539761 - DNA, 25 bp, Homo sapien
tcctggcgagtccttcctgttcagc

SEQ ID NO: 539762 - DNA, 25 bp, Homo sapien
cctgtgcgaccctccagggatgcag

SEQ ID NO: 539763 - DNA, 25 bp, Homo sapien
gggatccaggattctctgccctgtc

SEQ ID NO: 539764 - DNA, 25 bp, Homo sapien
ctgccctgtcacacggcgagtcaga

SEQ ID NO: 539765 - DNA, 25 bp, Homo sapien
tggccccaggcagagttttgcacca

SEQ ID NO: 539766 - DNA, 25 bp, Homo sapien
cccaggcagagttttgcaccagcag

SEQ ID NO: 539767 - DNA, 25 bp, Homo sapien
gcagagttttgcaccagcaggaccc

SEQ ID NO: 539768 - DNA, 25 bp, Homo sapien
cagcaggacccctttgagggccttc

SEQ ID NO: 539769 - DNA, 25 bp, Homo sapien
gccttcaaggctctcccaggagtcc

SEQ ID NO: 539770 - DNA, 25 bp, Homo sapien
aagcccatcgtgactcaaaactcac

SEQ ID NO: 539771 - DNA, 25 bp, Homo sapien
atcgtgactcaaaactcacttgtat

SEQ ID NO: 539772 - DNA, 25 bp, Homo sapien
agcgctcctgtaccctttaattgtg

SEQ ID NO: 539773 - DNA, 25 bp, Homo sapien
gctcctgtaccctttaattgtgtgt

SEQ ID NO: 539774 - DNA, 25 bp, Homo sapien
aattgtgtgtctttctcacagctat

SEQ ID NO: 539775 - DNA, 25 bp, Homo sapien
gtctttctcacagctatccgtcagt

SEQ ID NO: 539776 - DNA, 25 bp, Homo sapien
gctatccgtcagtccatctccaaag

SEQ ID NO: 539777 - DNA, 25 bp, Homo sapien
ggtggcctattaccagaaatatgtg

SEQ ID NO: 539778 - DNA, 25 bp, Homo sapien
aatatgtggatgaggcttccaagaa

SEQ ID NO: 539779 - DNA, 25 bp, Homo sapien
gagatcaaagacatcctcatccagt

SEQ ID NO: 539780 - DNA, 25 bp, Homo sapien
tccaaaaagtttggaggccctggtg

SEQ ID NO: 539781 - DNA, 25 bp, Homo sapien
ataattctcaaagtcctactctgcc

SEQ ID NO: 539782 - DNA, 25 bp, Homo sapien
tcaaagtcctactctgccaaaagaa

SEQ ID NO: 539783 - DNA, 25 bp, Homo sapien
aaagtcatacattacattacaagga

SEQ ID NO: 539784 - DNA, 25 bp, Homo sapien
gggttgctgaaaatcaacaacgctt

SEQ ID NO: 539785 - DNA, 25 bp, Homo sapien
gaaaatcaacaacgcttgaagttaa

SEQ ID NO: 539786 - DNA, 25 bp, Homo sapien
tgtgtctttgtagatttcattgtat

SEQ ID NO: 539787 - DNA, 25 bp, Homo sapien
gtatttcttaggagatggctgactt

SEQ ID NO: 539788 - DNA, 25 bp, Homo sapien
ggctgacttgattgatctacgctaa

SEQ ID NO: 539789 - DNA, 25 bp, Homo sapien
gatctacgctaagtggagacatttc

SEQ ID NO: 539790 - DNA, 25 bp, Homo sapien
tgttcaatctgtattactctttgcc

SEQ ID NO: 539791 - DNA, 25 bp, Homo sapien
tcttgtatgtagaggctatttttaa

SEQ ID NO: 539792 - DNA, 25 bp, Homo sapien
agtgatgttaactgcctccagctgg

SEQ ID NO: 539793 - DNA, 25 bp, Homo sapien
tggtctcatcaccagacttgacaca

SEQ ID NO: 539794 - DNA, 25 bp, Homo sapien
acttgacacaggacaggcacatctt

SEQ ID NO: 539795 - DNA, 25 bp, Homo sapien
gcatgaggctcaatgggtaccacat

SEQ ID NO: 539796 - DNA, 25 bp, Homo sapien
ggtaccacatctatcttttcttcta

SEQ ID NO: 539797 - DNA, 25 bp, Homo sapien
gacatttggtccttgcaagtatccg

SEQ ID NO: 539798 - DNA, 25 bp, Homo sapien
gcaagtatccggcaactagttggtt

SEQ ID NO: 539799 - DNA, 25 bp, Homo sapien
actagttggttgttcctcagataga

SEQ ID NO: 539800 - DNA, 25 bp, Homo sapien
atcccagattctgaaggcttgcatc

SEQ ID NO: 539801 - DNA, 25 bp, Homo sapien
aaggcttgcatcttgctggattttc

SEQ ID NO: 539802 - DNA, 25 bp, Homo sapien
ggcagatcgtcttgtgaatcctttc

SEQ ID NO: 539803 - DNA, 25 bp, Homo sapien
tcaacgctaacctgcttcagtggga

SEQ ID NO: 539804 - DNA, 25 bp, Homo sapien
gcaagaatgagcagccacggattgt

SEQ ID NO: 539805 - DNA, 25 bp, Homo sapien
aatgagcagccacggattgttgaac

SEQ ID NO: 539806 - DNA, 25 bp, Homo sapien
gccacggattgttgaactgttacca

SEQ ID NO: 539807 - DNA, 25 bp, Homo sapien
gttgaactgttaccagcaccatgct

SEQ ID NO: 539808 - DNA, 25 bp, Homo sapien
gcaccatgcttttcagcaacatttc

SEQ ID NO: 539809 - DNA, 25 bp, Homo sapien
ttttcagcaacatttcagcggagtt

SEQ ID NO: 539810 - DNA, 25 bp, Homo sapien
ttcagcggagttggaaacatttttt

SEQ ID NO: 539811 - DNA, 25 bp, Homo sapien
gcaaaaccattacaacgaagtccct

SEQ ID NO: 539812 - DNA, 25 bp, Homo sapien
catctcaagctaacacccaattact

SEQ ID NO: 539813 - DNA, 25 bp, Homo sapien
gctaacacccaattacttgcaaaca

SEQ ID NO: 539814 - DNA, 25 bp, Homo sapien
aagactaggtagatatggcatggcg

SEQ ID NO: 539815 - DNA, 25 bp, Homo sapien
tagtggaatgcctggctaaaacatt

SEQ ID NO: 539816 - DNA, 25 bp, Homo sapien
atacatccaacccatgttctgagca

SEQ ID NO: 539817 - DNA, 25 bp, Homo sapien
aacccatgttctgagcaactactta

SEQ ID NO: 539818 - DNA, 25 bp, Homo sapien
tctgagcaactacttacttttaggg

SEQ ID NO: 539819 - DNA, 25 bp, Homo sapien
aatatcttttcatttcctcttctat

SEQ ID NO: 539820 - DNA, 25 bp, Homo sapien
tcatttcctcttctattatgaaaga

SEQ ID NO: 539821 - DNA, 25 bp, Homo sapien
attttctaacaaggtttggccatag

SEQ ID NO: 539822 - DNA, 25 bp, Homo sapien
ccttttataatcttctgtaggctat

SEQ ID NO: 539823 - DNA, 25 bp, Homo sapien
gtaggctatctttcaaacactggca

SEQ ID NO: 539824 - DNA, 25 bp, Homo sapien
cactggcatcagaatattttttata

SEQ ID NO: 539825 - DNA, 25 bp, Homo sapien
ggagcaagaattccgatccatcttt

SEQ ID NO: 539826 - DNA, 25 bp, Homo sapien
ttccgatccatctttgaccacatta

SEQ ID NO: 539827 - DNA, 25 bp, Homo sapien
gaccacattaagttgccacaggcca

SEQ ID NO: 539828 - DNA, 25 bp, Homo sapien
acaggccagcaaaagcacttcagag

SEQ ID NO: 539829 - DNA, 25 bp, Homo sapien
tgtgtccttggttcatcatgttaaa

SEQ ID NO: 539830 - DNA, 25 bp, Homo sapien
gagcaatacttcaagtcagctgcaa

SEQ ID NO: 539831 - DNA, 25 bp, Homo sapien
gcaatgaccctaaacgagcggttca

SEQ ID NO: 539832 - DNA, 25 bp, Homo sapien
gagcggttcacttcgtatcagaaag

SEQ ID NO: 539833 - DNA, 25 bp, Homo sapien
tagtactcggcaaaagagccctgaa

SEQ ID NO: 539834 - DNA, 25 bp, Homo sapien
gaattgacatctcaccaagtaccct

SEQ ID NO: 539835 - DNA, 25 bp, Homo sapien
gtaccctgaggaagcatacccgttt

SEQ ID NO: 539836 - DNA, 25 bp, Homo sapien
tgttctgatgaccacacagtgtgat

SEQ ID NO: 539837 - DNA, 25 bp, Homo sapien
cacacagtgtgatttctttagcaga

SEQ ID NO: 539838 - DNA, 25 bp, Homo sapien
cacttttctaagactgtacagttta

SEQ ID NO: 539839 - DNA, 25 bp, Homo sapien
gtgaaaagcctaattacagaaaatt

SEQ ID NO: 539840 - DNA, 25 bp, Homo sapien
gaaaattgtgcagatactagtgaag

SEQ ID NO: 539841 - DNA, 25 bp, Homo sapien
ttacaaagtgcttgatctcttcata

SEQ ID NO: 539842 - DNA, 25 bp, Homo sapien
gtgcttgatctcttcatatttcaca

SEQ ID NO: 539843 - DNA, 25 bp, Homo sapien
gatctcttcatatttcacacgcatg

SEQ ID NO: 539844 - DNA, 25 bp, Homo sapien
ttcatatttcacacgcatgttttag

SEQ ID NO: 539845 - DNA, 25 bp, Homo sapien
cacacgcatgttttagaatagattt

SEQ ID NO: 539846 - DNA, 25 bp, Homo sapien
tagattttagggagtgtttaattca

SEQ ID NO: 539847 - DNA, 25 bp, Homo sapien
atgacttatcattcagccctttttg

SEQ ID NO: 539848 - DNA, 25 bp, Homo sapien
acttatcattcagccctttttgagt

SEQ ID NO: 539849 - DNA, 25 bp, Homo sapien
ttgagttttgggttgcttgcagagt

SEQ ID NO: 539850 - DNA, 25 bp, Homo sapien
ttgggttgcttgcagagtttaacct

SEQ ID NO: 539851 - DNA, 25 bp, Homo sapien
cagagtttaaccttgcctgtaattg

SEQ ID NO: 539852 - DNA, 25 bp, Homo sapien
taaccttgcctgtaattgaaactta

SEQ ID NO: 539853 - DNA, 25 bp, Homo sapien
gtaatagcataacttcatgtaagaa

SEQ ID NO: 539854 - DNA, 25 bp, Homo sapien
ggtgacataatagacaattgcagat

SEQ ID NO: 539855 - DNA, 25 bp, Homo sapien
gtaagacaaggataccacgagcgta

SEQ ID NO: 539856 - DNA, 25 bp, Homo sapien
gataccacgagcgtaatagacagtg

SEQ ID NO: 539857 - DNA, 25 bp, Homo sapien
agccattcttttgtctttacctgaa

SEQ ID NO: 539858 - DNA, 25 bp, Homo sapien
gcactcactccttggttgtcaagaa

SEQ ID NO: 539859 - DNA, 25 bp, Homo sapien
ggtggataactcacaggattaaaaa

SEQ ID NO: 539860 - DNA, 25 bp, Homo sapien
aaaaatcattttagcttgaagccaa

SEQ ID NO: 539861 - DNA, 25 bp, Homo sapien
gaagccaatatgtctggatcatagg

SEQ ID NO: 539862 - DNA, 25 bp, Homo sapien
tgtcattattcccattcctggtgtt

SEQ ID NO: 539863 - DNA, 25 bp, Homo sapien
aggttttgagttcataatccagtaa

SEQ ID NO: 539864 - DNA, 25 bp, Homo sapien
aatccagtaataacagctttcagct

SEQ ID NO: 539865 - DNA, 25 bp, Homo sapien
gctttcagctttctatgagtatata

SEQ ID NO: 539866 - DNA, 25 bp, Homo sapien
cattcctggtgtttttactggttca

SEQ ID NO: 539867 - DNA, 25 bp, Homo sapien
gtttttactggttcatatacaatgg

SEQ ID NO: 539868 - DNA, 25 bp, Homo sapien
tatgtgatctcagcactcactcctt

SEQ ID NO: 539869 - DNA, 25 bp, Homo sapien
acctgtggcacttaaaatttgttag

SEQ ID NO: 539870 - DNA, 25 bp, Homo sapien
gaccagttgtctattatgaatcatt

SEQ ID NO: 539871 - DNA, 25 bp, Homo sapien
gaatcattccagctttgttcaacaa

SEQ ID NO: 539872 - DNA, 25 bp, Homo sapien
ttgttcaacaatggccgaaactctt

SEQ ID NO: 539873 - DNA, 25 bp, Homo sapien
ggccgaaactcttttctcatattct

SEQ ID NO: 539874 - DNA, 25 bp, Homo sapien
catattctcgtttgttttcctgata

SEQ ID NO: 539875 - DNA, 25 bp, Homo sapien
tgataaagctgtgctgcctggctat

SEQ ID NO: 539876 - DNA, 25 bp, Homo sapien
tgcctggctattggctggactgtta

SEQ ID NO: 539877 - DNA, 25 bp, Homo sapien
gctggactgttaggattcggttcat

SEQ ID NO: 539878 - DNA, 25 bp, Homo sapien
gattcggttcatccagcagagactg

SEQ ID NO: 539879 - DNA, 25 bp, Homo sapien
tgttggactccatcgattctgaagg

SEQ ID NO: 539880 - DNA, 25 bp, Homo sapien
tctgtaattctttcctaacccttag

SEQ ID NO: 539881 - DNA, 25 bp, Homo sapien
tctttcctaacccttagtatccagc

SEQ ID NO: 539882 - DNA, 25 bp, Homo sapien
taacccttagtatccagcctcagtc

SEQ ID NO: 539883 - DNA, 25 bp, Homo sapien
gggctattttatgccggctctctcc

SEQ ID NO: 539884 - DNA, 25 bp, Homo sapien
tctctcctgagtgtcacacatctgg

SEQ ID NO: 539885 - DNA, 25 bp, Homo sapien
gagtgtcacacatctggtcctcagg

SEQ ID NO: 539886 - DNA, 25 bp, Homo sapien
tcacacatctggtcctcaggaaaca

SEQ ID NO: 539887 - DNA, 25 bp, Homo sapien
ggtcctcaggaaacattctcacatc

SEQ ID NO: 539888 - DNA, 25 bp, Homo sapien
ttctcacatccctggcctgaaaaaa

SEQ ID NO: 539889 - DNA, 25 bp, Homo sapien
aacaatttcagggagatcgcatggc

SEQ ID NO: 539890 - DNA, 25 bp, Homo sapien
atttcagggagatcgcatggcagca

SEQ ID NO: 539891 - DNA, 25 bp, Homo sapien
gcctcttccttcaagtatcaagctt

SEQ ID NO: 539892 - DNA, 25 bp, Homo sapien
ttgagcgagtttgcaatccctgtca

SEQ ID NO: 539893 - DNA, 25 bp, Homo sapien
aatccctgtcacaagcatctgatga

SEQ ID NO: 539894 - DNA, 25 bp, Homo sapien
tgaagcaatattctaccagcccatc

SEQ ID NO: 539895 - DNA, 25 bp, Homo sapien
cagcccatcataagactggaggcca

SEQ ID NO: 539896 - DNA, 25 bp, Homo sapien
gaggccaagacctggaccaaaacgt

SEQ ID NO: 539897 - DNA, 25 bp, Homo sapien
caaaacgtttatgcaggctcctctg

SEQ ID NO: 539898 - DNA, 25 bp, Homo sapien
ggctcctctgtacctgtgttttagc

SEQ ID NO: 539899 - DNA, 25 bp, Homo sapien
agctgtcaggatctcatagagccca

SEQ ID NO: 539900 - DNA, 25 bp, Homo sapien
atagagcccagttcttagagtcaac

SEQ ID NO: 539901 - DNA, 25 bp, Homo sapien
gggttactggaaattttgctcattt

SEQ ID NO: 539902 - DNA, 25 bp, Homo sapien
gaataaattgctccttgacattgta

SEQ ID NO: 539903 - DNA, 25 bp, Homo sapien
gacattgtagagcttctggcacttg

SEQ ID NO: 539904 - DNA, 25 bp, Homo sapien
tggcacttggagacttgtatgaaag

SEQ ID NO: 539905 - DNA, 25 bp, Homo sapien
atgaaagatggctgtgcctctgcct

SEQ ID NO: 539906 - DNA, 25 bp, Homo sapien
gcagagcaggaaacatgactcgtat

SEQ ID NO: 539907 - DNA, 25 bp, Homo sapien
tgactcgtatatgtctcaggtccct

SEQ ID NO: 539908 - DNA, 25 bp, Homo sapien
aagcacctagcctcgctcttggcag

SEQ ID NO: 539909 - DNA, 25 bp, Homo sapien
ctcttggcaggtactcagcgaatga

SEQ ID NO: 539910 - DNA, 25 bp, Homo sapien
tgttgggtgcaaagttccctacttc

SEQ ID NO: 539911 - DNA, 25 bp, Homo sapien
aagttccctacttcctgtgacttca

SEQ ID NO: 539912 - DNA, 25 bp, Homo sapien
tgtgacttcagctctgttttacaat

SEQ ID NO: 539913 - DNA, 25 bp, Homo sapien
agaagctttgtcagtaccattttgc

SEQ ID NO: 539914 - DNA, 25 bp, Homo sapien
gcagttttgtagacatttgatcctt

SEQ ID NO: 539915 - DNA, 25 bp, Homo sapien
agttgatgtactttgcacttcagaa

SEQ ID NO: 539916 - DNA, 25 bp, Homo sapien
gcacttcagaaacattacccagcga

SEQ ID NO: 539917 - DNA, 25 bp, Homo sapien
ttacccagcgaaggagcagtacgga

SEQ ID NO: 539918 - DNA, 25 bp, Homo sapien
agtacggagacacactgcatttctg

SEQ ID NO: 539919 - DNA, 25 bp, Homo sapien
acactgcatttctgtcggcactgca

SEQ ID NO: 539920 - DNA, 25 bp, Homo sapien
ctgcagcattctcttttggaaggac

SEQ ID NO: 539921 - DNA, 25 bp, Homo sapien
tttggaaggactcaggacacccctg

SEQ ID NO: 539922 - DNA, 25 bp, Homo sapien
atgggacatcatcaccttaggccag

SEQ ID NO: 539923 - DNA, 25 bp, Homo sapien
ccccacgttgtatatgcttagtgaa

SEQ ID NO: 539924 - DNA, 25 bp, Homo sapien
tcgggacaacaagaagacgcgcatc

SEQ ID NO: 539925 - DNA, 25 bp, Homo sapien
caaagtcaccatcgcccaggggcgc

SEQ ID NO: 539926 - DNA, 25 bp, Homo sapien
gggcgcgtcttgcctaacatccagg

SEQ ID NO: 539927 - DNA, 25 bp, Homo sapien
ggcgcgtcttgcctaacatccaggc

SEQ ID NO: 539928 - DNA, 25 bp, Homo sapien
ttgcctaacatccaggccgtactgc

SEQ ID NO: 539929 - DNA, 25 bp, Homo sapien
ggccgtactgctccctaagaagacg

SEQ ID NO: 539930 - DNA, 25 bp, Homo sapien
gcacctgtgaactcaaaaggctctt

SEQ ID NO: 539931 - DNA, 25 bp, Homo sapien
cctgtgaactcaaaaggctcttttc

SEQ ID NO: 539932 - DNA, 25 bp, Homo sapien
ttcagagccacccacgttttcaaat

SEQ ID NO: 539933 - DNA, 25 bp, Homo sapien
tcagagccacccacgttttcaaata

SEQ ID NO: 539934 - DNA, 25 bp, Homo sapien
cagagccacccacgttttcaaataa

SEQ ID NO: 539935 - DNA, 25 bp, Homo sapien
acctctcgtggccattgccaggagc

SEQ ID NO: 539936 - DNA, 25 bp, Homo sapien
aaagaacaactcctcaccagttcat

SEQ ID NO: 539937 - DNA, 25 bp, Homo sapien
tcaccagttcatcctgaggctggga

SEQ ID NO: 539938 - DNA, 25 bp, Homo sapien
gaggaccgggatgctggattctgtt

SEQ ID NO: 539939 - DNA, 25 bp, Homo sapien
ggattctgttttccgaagtcactgc

SEQ ID NO: 539940 - DNA, 25 bp, Homo sapien
gttttccgaagtcactgcagcggat

SEQ ID NO: 539941 - DNA, 25 bp, Homo sapien
gaagtcactgcagcggatgatggaa

SEQ ID NO: 539942 - DNA, 25 bp, Homo sapien
gcggatgatggaactgaatcgatac

SEQ ID NO: 539943 - DNA, 25 bp, Homo sapien
gaatcgatacggtgttttctgtccc

SEQ ID NO: 539944 - DNA, 25 bp, Homo sapien
gatacggtgttttctgtccctccta

SEQ ID NO: 539945 - DNA, 25 bp, Homo sapien
ggactacagacaactctttctttaa

SEQ ID NO: 539946 - DNA, 25 bp, Homo sapien
gacctcctgggtgctcttagccaag

SEQ ID NO: 539947 - DNA, 25 bp, Homo sapien
tgggtgctcttagccaagccctctt

SEQ ID NO: 539948 - DNA, 25 bp, Homo sapien
gtgtgctagaaagtgagggtcactc

SEQ ID NO: 539949 - DNA, 25 bp, Homo sapien
ccttccacacaagggagtgaattga

SEQ ID NO: 539950 - DNA, 25 bp, Homo sapien
agcagcaaagctggacacaggccaa

SEQ ID NO: 539951 - DNA, 25 bp, Homo sapien
aaagctggacacaggccaaattgcc

SEQ ID NO: 539952 - DNA, 25 bp, Homo sapien
ggacacaggccaaattgccaatcct

SEQ ID NO: 539953 - DNA, 25 bp, Homo sapien
aggccaaattgccaatcctgagtcc

SEQ ID NO: 539954 - DNA, 25 bp, Homo sapien
aaattgccaatcctgagtccctctg

SEQ ID NO: 539955 - DNA, 25 bp, Homo sapien
ttgccaatcctgagtccctctgtca

SEQ ID NO: 539956 - DNA, 25 bp, Homo sapien
gggaagcttgtcctcatcctccatc

SEQ ID NO: 539957 - DNA, 25 bp, Homo sapien
aaatgttcacattttactttgaatg

SEQ ID NO: 539958 - DNA, 25 bp, Homo sapien
gcaagtagacttgcccattacatta

SEQ ID NO: 539959 - DNA, 25 bp, Homo sapien
gtagacttgcccattacattaacat

SEQ ID NO: 539960 - DNA, 25 bp, Homo sapien
gacttgcccattacattaacataac

SEQ ID NO: 539961 - DNA, 25 bp, Homo sapien
cataacagcataaggttgaggagtt

SEQ ID NO: 539962 - DNA, 25 bp, Homo sapien
gttgttgataaataatacctgtttc

SEQ ID NO: 539963 - DNA, 25 bp, Homo sapien
gataaataatacctgtttcatacaa

SEQ ID NO: 539964 - DNA, 25 bp, Homo sapien
ggtatagtgggctaaaaggccatca

SEQ ID NO: 539965 - DNA, 25 bp, Homo sapien
agtgggctaaaaggccatcagatgt

SEQ ID NO: 539966 - DNA, 25 bp, Homo sapien
gctaaaaggccatcagatgtaggta

SEQ ID NO: 539967 - DNA, 25 bp, Homo sapien
aggccatcagatgtaggtaataatg

SEQ ID NO: 539968 - DNA, 25 bp, Homo sapien
ggaaaatgatcatctccttctatag

SEQ ID NO: 539969 - DNA, 25 bp, Homo sapien
gatcatctccttctatagcatttgc

SEQ ID NO: 539970 - DNA, 25 bp, Homo sapien
catctccttctatagcatttgcaga

SEQ ID NO: 539971 - DNA, 25 bp, Homo sapien
tctatagcatttgcagattcaaggg

SEQ ID NO: 539972 - DNA, 25 bp, Homo sapien
gacagttgttacttatttttccagg

SEQ ID NO: 539973 - DNA, 25 bp, Homo sapien
atttttccaggtgctgttagtataa

SEQ ID NO: 539974 - DNA, 25 bp, Homo sapien
tccaggtgctgttagtataaacatt

SEQ ID NO: 539975 - DNA, 25 bp, Homo sapien
tataaacattgtttcctcttcaccc

SEQ ID NO: 539976 - DNA, 25 bp, Homo sapien
attgtttcctcttcacccctgctaa

SEQ ID NO: 539977 - DNA, 25 bp, Homo sapien
taaagtatttctaccaaactgtgaa

SEQ ID NO: 539978 - DNA, 25 bp, Homo sapien
ctgtgaacccaatctcagggaaaag

SEQ ID NO: 539979 - DNA, 25 bp, Homo sapien
ttgggatgtattatggagctaaaac

SEQ ID NO: 539980 - DNA, 25 bp, Homo sapien
ggagctaaaactctaacctcttaat

SEQ ID NO: 539981 - DNA, 25 bp, Homo sapien
tacccaattggtgatatgatcttaa

SEQ ID NO: 539982 - DNA, 25 bp, Homo sapien
gatatgatcttaagcttttgtgtca

SEQ ID NO: 539983 - DNA, 25 bp, Homo sapien
taagcttttgtgtcagattatttaa

SEQ ID NO: 539984 - DNA, 25 bp, Homo sapien
tgatgacttcatgctttattatgcc

SEQ ID NO: 539985 - DNA, 25 bp, Homo sapien
tcatgctttattatgccttattatg

SEQ ID NO: 539986 - DNA, 25 bp, Homo sapien
ccttattatggctgacgtattactg

SEQ ID NO: 539987 - DNA, 25 bp, Homo sapien
ggctgacgtattactgtggtgaaac

SEQ ID NO: 539988 - DNA, 25 bp, Homo sapien
ataaagtacctttgagcatgagtgt

SEQ ID NO: 539989 - DNA, 25 bp, Homo sapien
gcatgagtgtatcacagctttcatt

SEQ ID NO: 539990 - DNA, 25 bp, Homo sapien
tgccggcgagcattgagttgtagaa

SEQ ID NO: 539991 - DNA, 25 bp, Homo sapien
ccggcgagcattgagttgtagaaaa

SEQ ID NO: 539992 - DNA, 25 bp, Homo sapien
gaacttaatatgtctgtaactctga

SEQ ID NO: 539993 - DNA, 25 bp, Homo sapien
gtaactctgagattaaacaacaagt

SEQ ID NO: 539994 - DNA, 25 bp, Homo sapien
aacaacaagttcgtggctcttaatg

SEQ ID NO: 539995 - DNA, 25 bp, Homo sapien
caagttcgtggctcttaatgttttc

SEQ ID NO: 539996 - DNA, 25 bp, Homo sapien
taatgttttcctcatagaatgtgac

SEQ ID NO: 539997 - DNA, 25 bp, Homo sapien
tttcctcatagaatgtgactgttga

SEQ ID NO: 539998 - DNA, 25 bp, Homo sapien
agaacatgcatcgaaagttgctttc

SEQ ID NO: 539999 - DNA, 25 bp, Homo sapien
ttcgaaagtacaacgctttattgaa

SEQ ID NO: 540000 - DNA, 25 bp, Homo sapien
gtacaacgctttattgaatcttaat

SEQ ID NO: 540001 - DNA, 25 bp, Homo sapien
tacttcagaaccgttggagtccaac

SEQ ID NO: 540002 - DNA, 25 bp, Homo sapien
agtccaacctatgatgtgtcttcca

SEQ ID NO: 540003 - DNA, 25 bp, Homo sapien
tccattctaacatccatacagtctc

SEQ ID NO: 540004 - DNA, 25 bp, Homo sapien
atacagtctctgttggatgaaccca

SEQ ID NO: 540005 - DNA, 25 bp, Homo sapien
gatgaacccaatcccaatagtccag

SEQ ID NO: 540006 - DNA, 25 bp, Homo sapien
atcccaatagtccagcaaacagcca

SEQ ID NO: 540007 - DNA, 25 bp, Homo sapien
aaagctggcgtgattgttgaccccg

SEQ ID NO: 540008 - DNA, 25 bp, Homo sapien
gcgtgattgttgaccccgggtacag

SEQ ID NO: 540009 - DNA, 25 bp, Homo sapien
tacagtttaaagaagctggccataa

SEQ ID NO: 540010 - DNA, 25 bp, Homo sapien
tattgatgtgtttgtcacctcccta

SEQ ID NO: 540011 - DNA, 25 bp, Homo sapien
tccctactcctgtcattacatttac

SEQ ID NO: 540012 - DNA, 25 bp, Homo sapien
ttgcttacacttacgctgccatgta

SEQ ID NO: 540013 - DNA, 25 bp, Homo sapien
cacttacgctgccatgtatgacaaa

SEQ ID NO: 540014 - DNA, 25 bp, Homo sapien
gtatgacaaaggacccttccggagt

SEQ ID NO: 540015 - DNA, 25 bp, Homo sapien
tgtggcttccaagtcttagaacctc

SEQ ID NO: 540016 - DNA, 25 bp, Homo sapien
ggcttccaagtcttagaacctcaac

SEQ ID NO: 540017 - DNA, 25 bp, Homo sapien
gaacctcaactgacatatagcattg

SEQ ID NO: 540018 - DNA, 25 bp, Homo sapien
atagcattgggcacactccagcaga

SEQ ID NO: 540019 - DNA, 25 bp, Homo sapien
gcccgaattcaaatcctggaaggat

SEQ ID NO: 540020 - DNA, 25 bp, Homo sapien
aggatggaagaaacgcctggagaat

SEQ ID NO: 540021 - DNA, 25 bp, Homo sapien
gaatatttgggatgagacaccactg

SEQ ID NO: 540022 - DNA, 25 bp, Homo sapien
ggatgagacaccactgtattttgct

SEQ ID NO: 540023 - DNA, 25 bp, Homo sapien
aattcattggatagcttgtgccaga

SEQ ID NO: 540024 - DNA, 25 bp, Homo sapien
gcttgtgccagaaagaacagtcaat

SEQ ID NO: 540025 - DNA, 25 bp, Homo sapien
gaagcaaaactgacgattagctcag

SEQ ID NO: 540026 - DNA, 25 bp, Homo sapien
gggagttttcttgtctggaacacaa

SEQ ID NO: 540027 - DNA, 25 bp, Homo sapien
gtctggaacacaaacacctacaagt

SEQ ID NO: 540028 - DNA, 25 bp, Homo sapien
agtagagtgtgagctggttcttgac

SEQ ID NO: 540029 - DNA, 25 bp, Homo sapien
gggaggcttgggatatacctaaatg

SEQ ID NO: 540030 - DNA, 25 bp, Homo sapien
ggttcttgacaatcagatctcatca

SEQ ID NO: 540031 - DNA, 25 bp, Homo sapien
agatctcatcaaccctttgaaatgt

SEQ ID NO: 540032 - DNA, 25 bp, Homo sapien
gatttatcttccaccttgagggatg

SEQ ID NO: 540033 - DNA, 25 bp, Homo sapien
ggaaactatgcacttgaattttaat

SEQ ID NO: 540034 - DNA, 25 bp, Homo sapien
aaaacatgtattacccaattctaat

SEQ ID NO: 540035 - DNA, 25 bp, Homo sapien
cagattgtttgttggaagagtcatc

SEQ ID NO: 540036 - DNA, 25 bp, Homo sapien
agagtcatcacctaaattacccaga

SEQ ID NO: 540037 - DNA, 25 bp, Homo sapien
acctggatcccagagtaaagatcta

SEQ ID NO: 540038 - DNA, 25 bp, Homo sapien
aagatctactgaggcaaggcagcaa

SEQ ID NO: 540039 - DNA, 25 bp, Homo sapien
aagcgctgtcagtgttgtggttcca

SEQ ID NO: 540040 - DNA, 25 bp, Homo sapien
gttgtggttccagtggcacacattt

SEQ ID NO: 540041 - DNA, 25 bp, Homo sapien
agtggcacacatttagcctgctcct

SEQ ID NO: 540042 - DNA, 25 bp, Homo sapien
ttagcctgctcctcattacggtcat

SEQ ID NO: 540043 - DNA, 25 bp, Homo sapien
ctcattacggtcatgggagcaaaat

SEQ ID NO: 540044 - DNA, 25 bp, Homo sapien
tatctacaattcaggagagttccaa

SEQ ID NO: 540045 - DNA, 25 bp, Homo sapien
cggtccaggtcatctcacaaagatt

SEQ ID NO: 540046 - DNA, 25 bp, Homo sapien
ggtccaggtcatctcacaaagattc

SEQ ID NO: 540047 - DNA, 25 bp, Homo sapien
gtccaggtcatctcacaaagattct

SEQ ID NO: 540048 - DNA, 25 bp, Homo sapien
ctcacaaagattctcctagagatgt

SEQ ID NO: 540049 - DNA, 25 bp, Homo sapien
cacaaagattctcctagagatgtta

SEQ ID NO: 540050 - DNA, 25 bp, Homo sapien
caaagattctcctagagatgttagc

SEQ ID NO: 540051 - DNA, 25 bp, Homo sapien
aagattctcctagagatgttagcaa

SEQ ID NO: 540052 - DNA, 25 bp, Homo sapien
agattctcctagagatgttagcaaa

SEQ ID NO: 540053 - DNA, 25 bp, Homo sapien
attctcctagagatgttagcaaaaa

SEQ ID NO: 540054 - DNA, 25 bp, Homo sapien
tcctagagatgttagcaaaaaagcc

SEQ ID NO: 540055 - DNA, 25 bp, Homo sapien
gagatgttagcaaaaaagccaaaag

SEQ ID NO: 540056 - DNA, 25 bp, Homo sapien
acagaaaatggatactcttcctatt

SEQ ID NO: 540057 - DNA, 25 bp, Homo sapien
aaatggatactcttcctattcaaaa

SEQ ID NO: 540058 - DNA, 25 bp, Homo sapien
tggatactcttcctattcaaaaaca

SEQ ID NO: 540059 - DNA, 25 bp, Homo sapien
aaacaggagcaaataccattaacat

SEQ ID NO: 540060 - DNA, 25 bp, Homo sapien
ggagcaaataccattaacatacata

SEQ ID NO: 540061 - DNA, 25 bp, Homo sapien
ataccattaacatacatagttgaga

SEQ ID NO: 540062 - DNA, 25 bp, Homo sapien
gatatatgaagaatgttgcagtcct

SEQ ID NO: 540063 - DNA, 25 bp, Homo sapien
tatgaagaatgttgcagtccttatc

SEQ ID NO: 540064 - DNA, 25 bp, Homo sapien
ttgcagtccttatcattttatgtta

SEQ ID NO: 540065 - DNA, 25 bp, Homo sapien
atattcagggtcaaatcatgtacat

SEQ ID NO: 540066 - DNA, 25 bp, Homo sapien
acagatattatctaaattcttctag

SEQ ID NO: 540067 - DNA, 25 bp, Homo sapien
aatgttctacatcatttatgttgta

SEQ ID NO: 540068 - DNA, 25 bp, Homo sapien
gtaacctgtgaactatgcttttcca

SEQ ID NO: 540069 - DNA, 25 bp, Homo sapien
gtgaactatgcttttccataacttt

SEQ ID NO: 540070 - DNA, 25 bp, Homo sapien
aacagtgaactattgcaccttttgc

SEQ ID NO: 540071 - DNA, 25 bp, Homo sapien
attgcaccttttgctaatgcctcta

SEQ ID NO: 540072 - DNA, 25 bp, Homo sapien
tgctaatgcctctatttacttgctt

SEQ ID NO: 540073 - DNA, 25 bp, Homo sapien
tatttacttgctttggcataaagaa

SEQ ID NO: 540074 - DNA, 25 bp, Homo sapien
atgagccaatgaacctctgtgtcct

SEQ ID NO: 540075 - DNA, 25 bp, Homo sapien
caatgaacctctgtgtcctgtggaa

SEQ ID NO: 540076 - DNA, 25 bp, Homo sapien
aatgttatctgatattgctcttaga

SEQ ID NO: 540077 - DNA, 25 bp, Homo sapien
gatattgctcttagatgtaatgcta

SEQ ID NO: 540078 - DNA, 25 bp, Homo sapien
gaagacacccaaataggcttacaga

SEQ ID NO: 540079 - DNA, 25 bp, Homo sapien
aggcttacagatacgatatgtttta

SEQ ID NO: 540080 - DNA, 25 bp, Homo sapien
ggaaatggcaacaggaagatagcaa

SEQ ID NO: 540081 - DNA, 25 bp, Homo sapien
aacaggtacatgttccaaggcaggt

SEQ ID NO: 540082 - DNA, 25 bp, Homo sapien
tacatgttccaaggcaggtggctgt

SEQ ID NO: 540083 - DNA, 25 bp, Homo sapien
ctgtgaacttcctctgagtgaaggc

SEQ ID NO: 540084 - DNA, 25 bp, Homo sapien
aacttcctctgagtgaaggcatccc

SEQ ID NO: 540085 - DNA, 25 bp, Homo sapien
tgagtgaaggcatcccctccagcac

SEQ ID NO: 540086 - DNA, 25 bp, Homo sapien
gcacctttcagcctgctagttagga

SEQ ID NO: 540087 - DNA, 25 bp, Homo sapien
tcagcctgctagttaggacgacccg

SEQ ID NO: 540088 - DNA, 25 bp, Homo sapien
tgctagttaggacgacccgccgcca

SEQ ID NO: 540089 - DNA, 25 bp, Homo sapien
tgggaggctgcctaagcctgtctgt

SEQ ID NO: 540090 - DNA, 25 bp, Homo sapien
ggaggctgcctaagcctgtctgtgc

SEQ ID NO: 540091 - DNA, 25 bp, Homo sapien
gaggctgcctaagcctgtctgtgct

SEQ ID NO: 540092 - DNA, 25 bp, Homo sapien
aggctgcctaagcctgtctgtgctt

SEQ ID NO: 540093 - DNA, 25 bp, Homo sapien
gggtatgagctgtggccacaggtga

SEQ ID NO: 540094 - DNA, 25 bp, Homo sapien
atgagctgtggccacaggtgagcaa

SEQ ID NO: 540095 - DNA, 25 bp, Homo sapien
gctgtggccacaggtgagcaaggca

SEQ ID NO: 540096 - DNA, 25 bp, Homo sapien
tggccacaggtgagcaaggcaggga

SEQ ID NO: 540097 - DNA, 25 bp, Homo sapien
ccttcaaggactgacaagttacgta

SEQ ID NO: 540098 - DNA, 25 bp, Homo sapien
ttcaaggactgacaagttacgtagg

SEQ ID NO: 540099 - DNA, 25 bp, Homo sapien
ggcagaggtcgccagctagccagtg

SEQ ID NO: 540100 - DNA, 25 bp, Homo sapien
ggtttggtcggaattagctgccggg

SEQ ID NO: 540101 - DNA, 25 bp, Homo sapien
agcctccgagctgccgggttttgag

SEQ ID NO: 540102 - DNA, 25 bp, Homo sapien
cgagctgccgggttttgagtctgaa

SEQ ID NO: 540103 - DNA, 25 bp, Homo sapien
agctgccgggttttgagtctgaagc

SEQ ID NO: 540104 - DNA, 25 bp, Homo sapien
ctgccgggttttgagtctgaagctg

SEQ ID NO: 540105 - DNA, 25 bp, Homo sapien
tgagtctgaagctggggccccgtca

SEQ ID NO: 540106 - DNA, 25 bp, Homo sapien
cacttttggtctcctgggcggcagg

SEQ ID NO: 540107 - DNA, 25 bp, Homo sapien
gagctgcgggcgcctcagtcttttt

SEQ ID NO: 540108 - DNA, 25 bp, Homo sapien
ccttgggtgtggaactaggcgcttc

SEQ ID NO: 540109 - DNA, 25 bp, Homo sapien
cttgggtgtggaactaggcgcttcc

SEQ ID NO: 540110 - DNA, 25 bp, Homo sapien
aactaggcgcttccgtggctgcggg

SEQ ID NO: 540111 - DNA, 25 bp, Homo sapien
ggcacagaggccaggatctcacgcg

SEQ ID NO: 540112 - DNA, 25 bp, Homo sapien
acagaggccaggatctcacgcgcga

SEQ ID NO: 540113 - DNA, 25 bp, Homo sapien
cagaggccaggatctcacgcgcgac

SEQ ID NO: 540114 - DNA, 25 bp, Homo sapien
agaggccaggatctcacgcgcgacc

SEQ ID NO: 540115 - DNA, 25 bp, Homo sapien
gaggccaggatctcacgcgcgaccg

SEQ ID NO: 540116 - DNA, 25 bp, Homo sapien
aggccaggatctcacgcgcgaccgc

SEQ ID NO: 540117 - DNA, 25 bp, Homo sapien
ggccaggatctcacgcgcgaccgca

SEQ ID NO: 540118 - DNA, 25 bp, Homo sapien
gccaggatctcacgcgcgaccgcac

SEQ ID NO: 540119 - DNA, 25 bp, Homo sapien
gatctcacgcgcgaccgcacgaggc

SEQ ID NO: 540120 - DNA, 25 bp, Homo sapien
tctcacgcgcgaccgcacgaggccg

SEQ ID NO: 540121 - DNA, 25 bp, Homo sapien
acgcgcgaccgcacgaggccgggac

SEQ ID NO: 540122 - DNA, 25 bp, Homo sapien
agacatctttctccagcttcagact

SEQ ID NO: 540123 - DNA, 25 bp, Homo sapien
ctttctccagcttcagacttgtaga

SEQ ID NO: 540124 - DNA, 25 bp, Homo sapien
cagacttgtagatataactcgttca

SEQ ID NO: 540125 - DNA, 25 bp, Homo sapien
tataactcgttcatcttcatttact

SEQ ID NO: 540126 - DNA, 25 bp, Homo sapien
gtgttccccaaatcagagaatagcc

SEQ ID NO: 540127 - DNA, 25 bp, Homo sapien
aaatcagagaatagcccgccatccc

SEQ ID NO: 540128 - DNA, 25 bp, Homo sapien
caccttgccaggtgcaggtgaggat

SEQ ID NO: 540129 - DNA, 25 bp, Homo sapien
atggtgcaccagacagggtagctgt

SEQ ID NO: 540130 - DNA, 25 bp, Homo sapien
gtctccacgtttgtttccccagtgt

SEQ ID NO: 540131 - DNA, 25 bp, Homo sapien
gtttgtttccccagtgtctggcggg

SEQ ID NO: 540132 - DNA, 25 bp, Homo sapien
gagccaggtgacatcataaatactt

SEQ ID NO: 540133 - DNA, 25 bp, Homo sapien
gggctctggccttctcatgcagaga

SEQ ID NO: 540134 - DNA, 25 bp, Homo sapien
tctcatgcagagaggtccgggacag

SEQ ID NO: 540135 - DNA, 25 bp, Homo sapien
ggtcagtatcgtgggcatgtgtata

SEQ ID NO: 540136 - DNA, 25 bp, Homo sapien
gtatagcttcccaagttcttttaca

SEQ ID NO: 540137 - DNA, 25 bp, Homo sapien
agttcttttacagtccctgctggga

SEQ ID NO: 540138 - DNA, 25 bp, Homo sapien
tgctgggactccctgacttactttg

SEQ ID NO: 540139 - DNA, 25 bp, Homo sapien
tactttggttggttcctagtgctac

SEQ ID NO: 540140 - DNA, 25 bp, Homo sapien
ggttcctagtgctacttgttttaca

SEQ ID NO: 540141 - DNA, 25 bp, Homo sapien
gaattgattagattaccttgtttat

SEQ ID NO: 540142 - DNA, 25 bp, Homo sapien
tgtgcctttttgtctcaatcttcca

SEQ ID NO: 540143 - DNA, 25 bp, Homo sapien
gtctcaatcttccaatacaggtata

SEQ ID NO: 540144 - DNA, 25 bp, Homo sapien
gagggaagaatctaggccttagctt

SEQ ID NO: 540145 - DNA, 25 bp, Homo sapien
agaatctaggccttagcttgccctc

SEQ ID NO: 540146 - DNA, 25 bp, Homo sapien
cttccccttgtagatactgccttaa

SEQ ID NO: 540147 - DNA, 25 bp, Homo sapien
tgtagatactgccttaacactccct

SEQ ID NO: 540148 - DNA, 25 bp, Homo sapien
aggtttctccgtgctcactaattta

SEQ ID NO: 540149 - DNA, 25 bp, Homo sapien
gtgctcactaatttatttccaggaa

SEQ ID NO: 540150 - DNA, 25 bp, Homo sapien
tgtgtggaagacatgagccgtgtat

SEQ ID NO: 540151 - DNA, 25 bp, Homo sapien
gacatgagccgtgtataatattttt

SEQ ID NO: 540152 - DNA, 25 bp, Homo sapien
aacattttcattgcagtattgacca

SEQ ID NO: 540153 - DNA, 25 bp, Homo sapien
attgcagtattgaccatcatccttg

SEQ ID NO: 540154 - DNA, 25 bp, Homo sapien
atcatccttggttgtgtatcgtgta

SEQ ID NO: 540155 - DNA, 25 bp, Homo sapien
aacttgactctacatgtattgctga

SEQ ID NO: 540156 - DNA, 25 bp, Homo sapien
cacactgccacataaagcccaagaa

SEQ ID NO: 540157 - DNA, 25 bp, Homo sapien
gcccaagaaattcagctgacaagac

SEQ ID NO: 540158 - DNA, 25 bp, Homo sapien
gacaagacagatttagcattatcaa

SEQ ID NO: 540159 - DNA, 25 bp, Homo sapien
tcccatttgccctgaaaaagctgtc

SEQ ID NO: 540160 - DNA, 25 bp, Homo sapien
aaaagctgtcctccattgtactgaa

SEQ ID NO: 540161 - DNA, 25 bp, Homo sapien
tgtactgaacagacagtcctgtcga

SEQ ID NO: 540162 - DNA, 25 bp, Homo sapien
cagtcctgtcgattgtgttatttag

SEQ ID NO: 540163 - DNA, 25 bp, Homo sapien
tagaaacatacactgaatgtgggct

SEQ ID NO: 540164 - DNA, 25 bp, Homo sapien
gaatgtgggctgaaatcatcatctt

SEQ ID NO: 540165 - DNA, 25 bp, Homo sapien
gaaactattcacaatgcattcctta

SEQ ID NO: 540166 - DNA, 25 bp, Homo sapien
tgtgctcatgtgcacctgggtgtaa

SEQ ID NO: 540167 - DNA, 25 bp, Homo sapien
gctcatgtgcacctgggtgtaaaat

SEQ ID NO: 540168 - DNA, 25 bp, Homo sapien
tgcccaagacaggtttttcccttgt

SEQ ID NO: 540169 - DNA, 25 bp, Homo sapien
tttcccttgtaccatcttcagagag

SEQ ID NO: 540170 - DNA, 25 bp, Homo sapien
tgtaccatcttcagagaggtcaggg

SEQ ID NO: 540171 - DNA, 25 bp, Homo sapien
gggtcgctatggataaccactaaga

SEQ ID NO: 540172 - DNA, 25 bp, Homo sapien
atggataaccactaagaccagactg

SEQ ID NO: 540173 - DNA, 25 bp, Homo sapien
ctaagaccagactgctgccaggagg

SEQ ID NO: 540174 - DNA, 25 bp, Homo sapien
agaccagactgctgccaggaggagt

SEQ ID NO: 540175 - DNA, 25 bp, Homo sapien
gggataatgaggtggccccagggtc

SEQ ID NO: 540176 - DNA, 25 bp, Homo sapien
cagggtcctggcacctggctttggt

SEQ ID NO: 540177 - DNA, 25 bp, Homo sapien
ggaatccaatgcagccatattcata

SEQ ID NO: 540178 - DNA, 25 bp, Homo sapien
gccatattcatatttcggtctctct

SEQ ID NO: 540179 - DNA, 25 bp, Homo sapien
atattcatatttcggtctctcttaa

SEQ ID NO: 540180 - DNA, 25 bp, Homo sapien
tcatatttcggtctctcttaatgga

SEQ ID NO: 540181 - DNA, 25 bp, Homo sapien
tttcggtctctcttaatggaccttg

SEQ ID NO: 540182 - DNA, 25 bp, Homo sapien
tctctcttaatggaccttgctggaa

SEQ ID NO: 540183 - DNA, 25 bp, Homo sapien
aaagaacattctgtgctaagaaaat

SEQ ID NO: 540184 - DNA, 25 bp, Homo sapien
gaaaactttaagaatgagccttcac

SEQ ID NO: 540185 - DNA, 25 bp, Homo sapien
ctttaagaatgagccttcacacctc

SEQ ID NO: 540186 - DNA, 25 bp, Homo sapien
ctcctgcagcaggtgatagctctgt

SEQ ID NO: 540187 - DNA, 25 bp, Homo sapien
gcaggtgatagctctgtacttcaga

SEQ ID NO: 540188 - DNA, 25 bp, Homo sapien
gtctttgtcattgtctggttcttaa

SEQ ID NO: 540189 - DNA, 25 bp, Homo sapien
ggttcttaagagtcccagactttgg

SEQ ID NO: 540190 - DNA, 25 bp, Homo sapien
tgcctctccgtcttgtaatgagttg

SEQ ID NO: 540191 - DNA, 25 bp, Homo sapien
actcttaacataggatcatttggaa

SEQ ID NO: 540192 - DNA, 25 bp, Homo sapien
gagggttttgctattgactgacttg

SEQ ID NO: 540193 - DNA, 25 bp, Homo sapien
gactgacttgaacgatggcttctcc

SEQ ID NO: 540194 - DNA, 25 bp, Homo sapien
gatggcttctcctcaagctgtaggc

SEQ ID NO: 540195 - DNA, 25 bp, Homo sapien
aagctgtaggctccagagcttccta

SEQ ID NO: 540196 - DNA, 25 bp, Homo sapien
gagcttcctaacctagtaaaatgtc

SEQ ID NO: 540197 - DNA, 25 bp, Homo sapien
ggagatattagtgtctttccctcta

SEQ ID NO: 540198 - DNA, 25 bp, Homo sapien
tttccctctatcattaaaggtgttt

SEQ ID NO: 540199 - DNA, 25 bp, Homo sapien
cagctggtggccaagagattggtgt

SEQ ID NO: 540200 - DNA, 25 bp, Homo sapien
aagaaggaaggagtcccttagctct

SEQ ID NO: 540201 - DNA, 25 bp, Homo sapien
tcattgtcccctttacttcctgcta

SEQ ID NO: 540202 - DNA, 25 bp, Homo sapien
tctctcttgcctctatgcctgtatt

SEQ ID NO: 540203 - DNA, 25 bp, Homo sapien
atgcctgtatttctggcaatatgac

SEQ ID NO: 540204 - DNA, 25 bp, Homo sapien
tatttctggcaatatgacaggcctg

SEQ ID NO: 540205 - DNA, 25 bp, Homo sapien
tctggcaatatgacaggcctgccta

SEQ ID NO: 540206 - DNA, 25 bp, Homo sapien
atatgacaggcctgcctacccaaga

SEQ ID NO: 540207 - DNA, 25 bp, Homo sapien
tgcctacccaagatcagaactccaa

SEQ ID NO: 540208 - DNA, 25 bp, Homo sapien
aagatcagaactccaaaaccactcc

SEQ ID NO: 540209 - DNA, 25 bp, Homo sapien
aggtcctcagctccatgggaaataa

SEQ ID NO: 540210 - DNA, 25 bp, Homo sapien
tccgggttgctggttccagcagcta

SEQ ID NO: 540211 - DNA, 25 bp, Homo sapien
tgctcctccttgtttggtgtggcca

SEQ ID NO: 540212 - DNA, 25 bp, Homo sapien
tcgccagtcaccagtgccgagagaa

SEQ ID NO: 540213 - DNA, 25 bp, Homo sapien
accagtgccgagagaactgcagcca

SEQ ID NO: 540214 - DNA, 25 bp, Homo sapien
gagaactgcagccagaaagagcttc

SEQ ID NO: 540215 - DNA, 25 bp, Homo sapien
accgacggcagcagcttcatggtcc

SEQ ID NO: 540216 - DNA, 25 bp, Homo sapien
tcatggtcccgcaccgagaggaggc

SEQ ID NO: 540217 - DNA, 25 bp, Homo sapien
gtggcttggaggataaagtgactct

SEQ ID NO: 540218 - DNA, 25 bp, Homo sapien
gtgactctcaaaaggtccagatctg

SEQ ID NO: 540219 - DNA, 25 bp, Homo sapien
agatctgcctcttgcaagtcacgga

SEQ ID NO: 540220 - DNA, 25 bp, Homo sapien
ttgcaagtcacggactttccggtcc

SEQ ID NO: 540221 - DNA, 25 bp, Homo sapien
ataagcccaaagacattggtggctc

SEQ ID NO: 540222 - DNA, 25 bp, Homo sapien
acattggtggctcaaaggcccctgt

SEQ ID NO: 540223 - DNA, 25 bp, Homo sapien
ttggaccagtcttcacagaggttga

SEQ ID NO: 540224 - DNA, 25 bp, Homo sapien
ccacacccttctgtgttggagataa

SEQ ID NO: 540225 - DNA, 25 bp, Homo sapien
gataaatttttcgtacctctgcaga

SEQ ID NO: 540226 - DNA, 25 bp, Homo sapien
atttttcgtacctctgcagagactc

SEQ ID NO: 540227 - DNA, 25 bp, Homo sapien
gcagagactccttgcgtatcccaag

SEQ ID NO: 540228 - DNA, 25 bp, Homo sapien
gtatcccaagttgaaccgcttatgt

SEQ ID NO: 540229 - DNA, 25 bp, Homo sapien
gttgaaccgcttatgtgctaatgaa

SEQ ID NO: 540230 - DNA, 25 bp, Homo sapien
ttgctgactcaattcctctgagcag

SEQ ID NO: 540231 - DNA, 25 bp, Homo sapien
gctgacctgcgtaattattttgatg

SEQ ID NO: 540232 - DNA, 25 bp, Homo sapien
gaatccctggctctaccagctgtga

SEQ ID NO: 540233 - DNA, 25 bp, Homo sapien
gacgccgcagaagggaagcaccctg

SEQ ID NO: 540234 - DNA, 25 bp, Homo sapien
cgccgcagaagggaagcaccctgga

SEQ ID NO: 540235 - DNA, 25 bp, Homo sapien
gccgcagaagggaagcaccctggac

SEQ ID NO: 540236 - DNA, 25 bp, Homo sapien
ccgcagaagggaagcaccctggaca

SEQ ID NO: 540237 - DNA, 25 bp, Homo sapien
cgcagaagggaagcaccctggacaa

SEQ ID NO: 540238 - DNA, 25 bp, Homo sapien
gcagaagggaagcaccctggacaac

SEQ ID NO: 540239 - DNA, 25 bp, Homo sapien
cagaagggaagcaccctggacaaca

SEQ ID NO: 540240 - DNA, 25 bp, Homo sapien
ccctggacaacagcctgcacaagga

SEQ ID NO: 540241 - DNA, 25 bp, Homo sapien
aaggacctgctgggcgccatctccg

SEQ ID NO: 540242 - DNA, 25 bp, Homo sapien
gacctgctgggcgccatctccggca

SEQ ID NO: 540243 - DNA, 25 bp, Homo sapien
gtaaaacagaagttccagagcacag

SEQ ID NO: 540244 - DNA, 25 bp, Homo sapien
agagcacagaaggtcatcatcacaa

SEQ ID NO: 540245 - DNA, 25 bp, Homo sapien
aggtcatcatcacaagcaaacttta

SEQ ID NO: 540246 - DNA, 25 bp, Homo sapien
gctgttatttgttttatcacttcta

SEQ ID NO: 540247 - DNA, 25 bp, Homo sapien
ttgttttatcacttctatatttggt

SEQ ID NO: 540248 - DNA, 25 bp, Homo sapien
atttggtgaacagccacagttactg

SEQ ID NO: 540249 - DNA, 25 bp, Homo sapien
tacaaggtcaatacataagccagag

SEQ ID NO: 540250 - DNA, 25 bp, Homo sapien
taagccagagtgaatgatactacaa

SEQ ID NO: 540251 - DNA, 25 bp, Homo sapien
gatactacaagttgagcatctctaa

SEQ ID NO: 540252 - DNA, 25 bp, Homo sapien
tttttgagcactgacttgaccccac

SEQ ID NO: 540253 - DNA, 25 bp, Homo sapien
gcactgacttgaccccacaagtgga

SEQ ID NO: 540254 - DNA, 25 bp, Homo sapien
gaagggtacaaagtcatgtacaccc

SEQ ID NO: 540255 - DNA, 25 bp, Homo sapien
catggctcctggtaactacctgatc

SEQ ID NO: 540256 - DNA, 25 bp, Homo sapien
gtcaaatacggtgggcccaaccaca

SEQ ID NO: 540257 - DNA, 25 bp, Homo sapien
aaggtgacaggccagcgtctagtta

SEQ ID NO: 540258 - DNA, 25 bp, Homo sapien
gtctagttagccctggctcagccaa

SEQ ID NO: 540259 - DNA, 25 bp, Homo sapien
gtggagtcagtgaccaggtcgtcta

SEQ ID NO: 540260 - DNA, 25 bp, Homo sapien
cagtgaccaggtcgtctacagagac

SEQ ID NO: 540261 - DNA, 25 bp, Homo sapien
tacagagacctgctatagcgccatt

SEQ ID NO: 540262 - DNA, 25 bp, Homo sapien
tgctatagcgccattcccaaggcat

SEQ ID NO: 540263 - DNA, 25 bp, Homo sapien
aaggcatcctcggacgccagcaagg

SEQ ID NO: 540264 - DNA, 25 bp, Homo sapien
gacgccagcaaggtgacctctaagg

SEQ ID NO: 540265 - DNA, 25 bp, Homo sapien
ggaccatatatatcttgacagtgta

SEQ ID NO: 540266 - DNA, 25 bp, Homo sapien
ttttaagtaggttcatttccatttg

SEQ ID NO: 540267 - DNA, 25 bp, Homo sapien
gaaagtttctgtctttaggaaactg

SEQ ID NO: 540268 - DNA, 25 bp, Homo sapien
gaaatactgtggatgctatgactgt

SEQ ID NO: 540269 - DNA, 25 bp, Homo sapien
ctgtggatgctatgactgtttgtct

SEQ ID NO: 540270 - DNA, 25 bp, Homo sapien
gatgctatgactgtttgtcttgtat

SEQ ID NO: 540271 - DNA, 25 bp, Homo sapien
aataagctgcctattgagtggtata

SEQ ID NO: 540272 - DNA, 25 bp, Homo sapien
gtggtatagctgtatgcttacccaa

SEQ ID NO: 540273 - DNA, 25 bp, Homo sapien
agctgtatgcttacccaaaaaaggg

SEQ ID NO: 540274 - DNA, 25 bp, Homo sapien
cactgtggttatgacttgtattata

SEQ ID NO: 540275 - DNA, 25 bp, Homo sapien
tgacttgtattataaactttctgta

SEQ ID NO: 540276 - DNA, 25 bp, Homo sapien
gaggagttttatgcctgtaccagca

SEQ ID NO: 540277 - DNA, 25 bp, Homo sapien
gtaccagcagaggttcagccttcca

SEQ ID NO: 540278 - DNA, 25 bp, Homo sapien
agccttccaggaatctcatcatgat

SEQ ID NO: 540279 - DNA, 25 bp, Homo sapien
atcatgatccatactgctgacacag

SEQ ID NO: 540280 - DNA, 25 bp, Homo sapien
gcctttgtcacctgaagcattctta

SEQ ID NO: 540281 - DNA, 25 bp, Homo sapien
gtgaactccactttgtaagcatcat

SEQ ID NO: 540282 - DNA, 25 bp, Homo sapien
ttacaactcattctgaagactcctt

SEQ ID NO: 540283 - DNA, 25 bp, Homo sapien
tgaagactcctttattcttgctctt

SEQ ID NO: 540284 - DNA, 25 bp, Homo sapien
ctttattcttgctcttcccagagag

SEQ ID NO: 540285 - DNA, 25 bp, Homo sapien
agctactgtgtttagtcatgctcac

SEQ ID NO: 540286 - DNA, 25 bp, Homo sapien
tcatgctcactgcactcacaagaga

SEQ ID NO: 540287 - DNA, 25 bp, Homo sapien
tctactctgaagcacacagggggct

SEQ ID NO: 540288 - DNA, 25 bp, Homo sapien
cgtctggagacgtcgatgtggtcat

SEQ ID NO: 540289 - DNA, 25 bp, Homo sapien
tggagacgtcgatgtggtcatagca

SEQ ID NO: 540290 - DNA, 25 bp, Homo sapien
acgtcgatgtggtcatagcagggcc

SEQ ID NO: 540291 - DNA, 25 bp, Homo sapien
cgatgtggtcatagcagggcctgga

SEQ ID NO: 540292 - DNA, 25 bp, Homo sapien
ccctggcctcagatgaagaggctct

SEQ ID NO: 540293 - DNA, 25 bp, Homo sapien
ctggcctcagatgaagaggctctgg

SEQ ID NO: 540294 - DNA, 25 bp, Homo sapien
tggccttcggagttacgaggaaacg

SEQ ID NO: 540295 - DNA, 25 bp, Homo sapien
gccttcggagttacgaggaaacgag

SEQ ID NO: 540296 - DNA, 25 bp, Homo sapien
gagttacgaggaaacgaggaccagg

SEQ ID NO: 540297 - DNA, 25 bp, Homo sapien
ggaccagggattctgcatcagcaca

SEQ ID NO: 540298 - DNA, 25 bp, Homo sapien
gcacggagagcggtgcccgcgtcag

SEQ ID NO: 540299 - DNA, 25 bp, Homo sapien
cacggagagcggtgcccgcgtcagt

SEQ ID NO: 540300 - DNA, 25 bp, Homo sapien
acggagagcggtgcccgcgtcagtg

SEQ ID NO: 540301 - DNA, 25 bp, Homo sapien
agcggtgcccgcgtcagtgaccgaa

SEQ ID NO: 540302 - DNA, 25 bp, Homo sapien
gcggtgcccgcgtcagtgaccgaag

SEQ ID NO: 540303 - DNA, 25 bp, Homo sapien
cggtgcccgcgtcagtgaccgaagg

SEQ ID NO: 540304 - DNA, 25 bp, Homo sapien
gtgcccgcgtcagtgaccgaaggaa

SEQ ID NO: 540305 - DNA, 25 bp, Homo sapien
tgcccgcgtcagtgaccgaaggaag

SEQ ID NO: 540306 - DNA, 25 bp, Homo sapien
gcccgcgtcagtgaccgaaggaaga

SEQ ID NO: 540307 - DNA, 25 bp, Homo sapien
cccgcgtcagtgaccgaaggaagag

SEQ ID NO: 540308 - DNA, 25 bp, Homo sapien
ccgcgtcagtgaccgaaggaagaga

SEQ ID NO: 540309 - DNA, 25 bp, Homo sapien
ttgccaaaaattcatgccccagtat

SEQ ID NO: 540310 - DNA, 25 bp, Homo sapien
tgccaaaaattcatgccccagtatt

SEQ ID NO: 540311 - DNA, 25 bp, Homo sapien
gccaaaaattcatgccccagtatta

SEQ ID NO: 540312 - DNA, 25 bp, Homo sapien
aaattcatgccccagtattagcaat

SEQ ID NO: 540313 - DNA, 25 bp, Homo sapien
aattcatgccccagtattagcaatg

SEQ ID NO: 540314 - DNA, 25 bp, Homo sapien
attcatgccccagtattagcaatga

SEQ ID NO: 540315 - DNA, 25 bp, Homo sapien
tcatgccccagtattagcaatgaat

SEQ ID NO: 540316 - DNA, 25 bp, Homo sapien
catgccccagtattagcaatgaatt

SEQ ID NO: 540317 - DNA, 25 bp, Homo sapien
atgccccagtattagcaatgaatta

SEQ ID NO: 540318 - DNA, 25 bp, Homo sapien
gccccagtattagcaatgaattagt

SEQ ID NO: 540319 - DNA, 25 bp, Homo sapien
ccccagtattagcaatgaattagtt

SEQ ID NO: 540320 - DNA, 25 bp, Homo sapien
atgttttctccataggccttgtgca

SEQ ID NO: 540321 - DNA, 25 bp, Homo sapien
aggttttctcattgcatccatactg

SEQ ID NO: 540322 - DNA, 25 bp, Homo sapien
cagaacgggttgtgcctcagaaatc

SEQ ID NO: 540323 - DNA, 25 bp, Homo sapien
gtgcctcagaaatctatttctcttt

SEQ ID NO: 540324 - DNA, 25 bp, Homo sapien
tttctcttttagatgttgaaccctg

SEQ ID NO: 540325 - DNA, 25 bp, Homo sapien
ctcttttagatgttgaaccctgaga

SEQ ID NO: 540326 - DNA, 25 bp, Homo sapien
ttagatgttgaaccctgagagaact

SEQ ID NO: 540327 - DNA, 25 bp, Homo sapien
gatgttgaaccctgagagaactaag

SEQ ID NO: 540328 - DNA, 25 bp, Homo sapien
gaaccctgagagaactaagatgata

SEQ ID NO: 540329 - DNA, 25 bp, Homo sapien
ttcagaagagttggctgccttctct

SEQ ID NO: 540330 - DNA, 25 bp, Homo sapien
gctgccttctctggaaacaaggaaa

SEQ ID NO: 540331 - DNA, 25 bp, Homo sapien
attggtacttgagtttggccagcca

SEQ ID NO: 540332 - DNA, 25 bp, Homo sapien
tttggccagccattgaattacttca

SEQ ID NO: 540333 - DNA, 25 bp, Homo sapien
gatttgaaggcattttccgcacatt

SEQ ID NO: 540334 - DNA, 25 bp, Homo sapien
ttttccgcacattcactttccacat

SEQ ID NO: 540335 - DNA, 25 bp, Homo sapien
tgtgcttccctagtgattgcctttt

SEQ ID NO: 540336 - DNA, 25 bp, Homo sapien
aatctctggttttccaaaggccctg

SEQ ID NO: 540337 - DNA, 25 bp, Homo sapien
aaaggccctggaaacttcatgatat

SEQ ID NO: 540338 - DNA, 25 bp, Homo sapien
ttcatgatatcctttggatctgcct

SEQ ID NO: 540339 - DNA, 25 bp, Homo sapien
ggatgagcctttacggtagctaaaa

SEQ ID NO: 540340 - DNA, 25 bp, Homo sapien
aacctatccaaaagactgctagcca

SEQ ID NO: 540341 - DNA, 25 bp, Homo sapien
actgctagccagagcaaatgtttct

SEQ ID NO: 540342 - DNA, 25 bp, Homo sapien
tgttttcatctgtgatagtcatgga

SEQ ID NO: 540343 - DNA, 25 bp, Homo sapien
atctgtgatagtcatggatgctttt

SEQ ID NO: 540344 - DNA, 25 bp, Homo sapien
tagtcatggatgcttttattttcct

SEQ ID NO: 540345 - DNA, 25 bp, Homo sapien
gaatatagttttaatttctctctac

SEQ ID NO: 540346 - DNA, 25 bp, Homo sapien
tagttttaatttctctctacagttt

SEQ ID NO: 540347 - DNA, 25 bp, Homo sapien
gtttgtgggctgttggaattgtaat

SEQ ID NO: 540348 - DNA, 25 bp, Homo sapien
gtgggctgttggaattgtaattttt

SEQ ID NO: 540349 - DNA, 25 bp, Homo sapien
ttaacaatgtctgatctcagctgaa

SEQ ID NO: 540350 - DNA, 25 bp, Homo sapien
gatctcagctgaacaaattagatgt

SEQ ID NO: 540351 - DNA, 25 bp, Homo sapien
gggtcaactggcttacagatttaca

SEQ ID NO: 540352 - DNA, 25 bp, Homo sapien
ggcttacagatttacatgtgcacac

SEQ ID NO: 540353 - DNA, 25 bp, Homo sapien
gatcacttggcctggatttgagcct

SEQ ID NO: 540354 - DNA, 25 bp, Homo sapien
gcctggatttgagcctgaggctcag

SEQ ID NO: 540355 - DNA, 25 bp, Homo sapien
tgaggctcagactccaaaacccaca

SEQ ID NO: 540356 - DNA, 25 bp, Homo sapien
aaacccacactcaatttgctacatc

SEQ ID NO: 540357 - DNA, 25 bp, Homo sapien
actcaatttgctacatctcccaggg

SEQ ID NO: 540358 - DNA, 25 bp, Homo sapien
gccaaggcagctgtgagcaaaagga

SEQ ID NO: 540359 - DNA, 25 bp, Homo sapien
tatcagcttctcaagggcctagggt

SEQ ID NO: 540360 - DNA, 25 bp, Homo sapien
tctcaagggcctagggtttgttgga

SEQ ID NO: 540361 - DNA, 25 bp, Homo sapien
cccttccatcgccttttttgaggat

SEQ ID NO: 540362 - DNA, 25 bp, Homo sapien
gataagaaacccaaagttcccagag

SEQ ID NO: 540363 - DNA, 25 bp, Homo sapien
ttcccagagattaacttgcccaaga

SEQ ID NO: 540364 - DNA, 25 bp, Homo sapien
ctcagaaactgctctgtgtttagaa

SEQ ID NO: 540365 - DNA, 25 bp, Homo sapien
aactgctctgtgtttagaaggaata

SEQ ID NO: 540366 - DNA, 25 bp, Homo sapien
aagagtccagctttttcatttccac

SEQ ID NO: 540367 - DNA, 25 bp, Homo sapien
catttccacaatttcctatatccag

SEQ ID NO: 540368 - DNA, 25 bp, Homo sapien
tcctatatccagatttgttttgaca

SEQ ID NO: 540369 - DNA, 25 bp, Homo sapien
atccagatttgttttgacaatgtag

SEQ ID NO: 540370 - DNA, 25 bp, Homo sapien
gaagaactaagattctaatctctga

SEQ ID NO: 540371 - DNA, 25 bp, Homo sapien
atctctgaagaaccttatagggcct

SEQ ID NO: 540372 - DNA, 25 bp, Homo sapien
tgaagaaccttatagggccttctaa

SEQ ID NO: 540373 - DNA, 25 bp, Homo sapien
gccttctaaaacataagagtttcct

SEQ ID NO: 540374 - DNA, 25 bp, Homo sapien
attttagttgtactctagaaagcta

SEQ ID NO: 540375 - DNA, 25 bp, Homo sapien
gtctggggacagatagaacctgttg

SEQ ID NO: 540376 - DNA, 25 bp, Homo sapien
gggttgcctttgtcctatccctgag

SEQ ID NO: 540377 - DNA, 25 bp, Homo sapien
gttgcctttgtcctatccctgagct

SEQ ID NO: 540378 - DNA, 25 bp, Homo sapien
tgcctttgtcctatccctgagcttg

SEQ ID NO: 540379 - DNA, 25 bp, Homo sapien
tttgtcctatccctgagcttgctca

SEQ ID NO: 540380 - DNA, 25 bp, Homo sapien
ttgtcctatccctgagcttgctcaa

SEQ ID NO: 540381 - DNA, 25 bp, Homo sapien
gtcctatccctgagcttgctcaaca

SEQ ID NO: 540382 - DNA, 25 bp, Homo sapien
ctatccctgagcttgctcaacaaga

SEQ ID NO: 540383 - DNA, 25 bp, Homo sapien
tatccctgagcttgctcaacaagag

SEQ ID NO: 540384 - DNA, 25 bp, Homo sapien
atccctgagcttgctcaacaagaga

SEQ ID NO: 540385 - DNA, 25 bp, Homo sapien
tccctgagcttgctcaacaagagaa

SEQ ID NO: 540386 - DNA, 25 bp, Homo sapien
gcaagttaaggttctttggtaacag

SEQ ID NO: 540387 - DNA, 25 bp, Homo sapien
ctttggtaacagaattcttgcaact

SEQ ID NO: 540388 - DNA, 25 bp, Homo sapien
gaagtcatgtaaacggttaacaagc

SEQ ID NO: 540389 - DNA, 25 bp, Homo sapien
gttaacaagcttaccaaggttagca

SEQ ID NO: 540390 - DNA, 25 bp, Homo sapien
caaggttagcaaaactttcattgta

SEQ ID NO: 540391 - DNA, 25 bp, Homo sapien
gactttcaggatgtcatactacttc

SEQ ID NO: 540392 - DNA, 25 bp, Homo sapien
atactacttctgtacctagcatttt

SEQ ID NO: 540393 - DNA, 25 bp, Homo sapien
gtacctagcattttcagtccttata

SEQ ID NO: 540394 - DNA, 25 bp, Homo sapien
agtccttatatttgcaatgttacac

SEQ ID NO: 540395 - DNA, 25 bp, Homo sapien
acaaactgtactattttcttttatg

SEQ ID NO: 540396 - DNA, 25 bp, Homo sapien
gtgcagtttgcatgagtaaaccatc

SEQ ID NO: 540397 - DNA, 25 bp, Homo sapien
gcgggcggccttcgtccggcgagag

SEQ ID NO: 540398 - DNA, 25 bp, Homo sapien
cttcgtccggcgagagctaggccga

SEQ ID NO: 540399 - DNA, 25 bp, Homo sapien
ttcgtccggcgagagctaggccgag

SEQ ID NO: 540400 - DNA, 25 bp, Homo sapien
tccggcgagagctaggccgaggacc

SEQ ID NO: 540401 - DNA, 25 bp, Homo sapien
agagctaggccgaggacccgcgccg

SEQ ID NO: 540402 - DNA, 25 bp, Homo sapien
gggcgggggtctcctccaggctgcg

SEQ ID NO: 540403 - DNA, 25 bp, Homo sapien
aagacaagtcgggagaggccggtag

SEQ ID NO: 540404 - DNA, 25 bp, Homo sapien
gacaagtcgggagaggccggtaggc

SEQ ID NO: 540405 - DNA, 25 bp, Homo sapien
ccggtaggcgtgaggcgggcctgaa

SEQ ID NO: 540406 - DNA, 25 bp, Homo sapien
gtgaggcgggcctgaagcggcagcg

SEQ ID NO: 540407 - DNA, 25 bp, Homo sapien
gcctgaagcggcagcgggcggcctt

SEQ ID NO: 540408 - DNA, 25 bp, Homo sapien
gcagatgtgcagtaaatgtcgcatc

SEQ ID NO: 540409 - DNA, 25 bp, Homo sapien
tcatggttttcctccttgcaatctg

SEQ ID NO: 540410 - DNA, 25 bp, Homo sapien
atgtcgcatcgttatcacttcaaag

SEQ ID NO: 540411 - DNA, 25 bp, Homo sapien
gataatttcattcctggaagactgg

SEQ ID NO: 540412 - DNA, 25 bp, Homo sapien
cctgggttttggcaaacacttacat

SEQ ID NO: 540413 - DNA, 25 bp, Homo sapien
acttacattagagttgctcagtcag

SEQ ID NO: 540414 - DNA, 25 bp, Homo sapien
gagttgctcagtcagttgcagcttt

SEQ ID NO: 540415 - DNA, 25 bp, Homo sapien
gttgcagctttaaaccatggcgccc

SEQ ID NO: 540416 - DNA, 25 bp, Homo sapien
cccagccagctgataatttatgaga

SEQ ID NO: 540417 - DNA, 25 bp, Homo sapien
gcaatctggcctcactttagggaga

SEQ ID NO: 540418 - DNA, 25 bp, Homo sapien
tttagggagatattctcatcaggga

SEQ ID NO: 540419 - DNA, 25 bp, Homo sapien
cttgggcagtcagggcacgtcatgt

SEQ ID NO: 540420 - DNA, 25 bp, Homo sapien
tcagggcacgtcatgtaaatctttt

SEQ ID NO: 540421 - DNA, 25 bp, Homo sapien
cgaagagtacagttataagcagcta

SEQ ID NO: 540422 - DNA, 25 bp, Homo sapien
gagaactctacttgggttgttcata

SEQ ID NO: 540423 - DNA, 25 bp, Homo sapien
attgctttgcattgaccataaactg

SEQ ID NO: 540424 - DNA, 25 bp, Homo sapien
aaaatatcctcattccacagtcttg

SEQ ID NO: 540425 - DNA, 25 bp, Homo sapien
acagtcttgccatgccttctttctg

SEQ ID NO: 540426 - DNA, 25 bp, Homo sapien
cttctttctgagcacatggcagtca

SEQ ID NO: 540427 - DNA, 25 bp, Homo sapien
acatggcagtcagtctctagcacat

SEQ ID NO: 540428 - DNA, 25 bp, Homo sapien
tagcacatccagtgtaagatagaac

SEQ ID NO: 540429 - DNA, 25 bp, Homo sapien
gatagaacagagatcccaggccacc

SEQ ID NO: 540430 - DNA, 25 bp, Homo sapien
ggctgaaggatagactagctggaca

SEQ ID NO: 540431 - DNA, 25 bp, Homo sapien
gagccttgagcctgcgagaagagtc

SEQ ID NO: 540432 - DNA, 25 bp, Homo sapien
gagcctgcgagaagagtctcctaga

SEQ ID NO: 540433 - DNA, 25 bp, Homo sapien
gagtctcctagaatagagaagctga

SEQ ID NO: 540434 - DNA, 25 bp, Homo sapien
aaggagatccagaatcatgacagag

SEQ ID NO: 540435 - DNA, 25 bp, Homo sapien
tcatgacagagagatgacctttgcc

SEQ ID NO: 540436 - DNA, 25 bp, Homo sapien
gatgacctttgccaagagcacagcc

SEQ ID NO: 540437 - DNA, 25 bp, Homo sapien
tttgccaagagcacagccatctttc

SEQ ID NO: 540438 - DNA, 25 bp, Homo sapien
agccatctttcactgtcacagagag

SEQ ID NO: 540439 - DNA, 25 bp, Homo sapien
gtaggacaaaacgattggtgttcaa

SEQ ID NO: 540440 - DNA, 25 bp, Homo sapien
caagaattggtttgtagcacaatat

SEQ ID NO: 540441 - DNA, 25 bp, Homo sapien
tctaggcctgccctgccgccgtgga

SEQ ID NO: 540442 - DNA, 25 bp, Homo sapien
ctaggcctgccctgccgccgtggag

SEQ ID NO: 540443 - DNA, 25 bp, Homo sapien
taggcctgccctgccgccgtggagc

SEQ ID NO: 540444 - DNA, 25 bp, Homo sapien
aggcctgccctgccgccgtggagcc

SEQ ID NO: 540445 - DNA, 25 bp, Homo sapien
tgccctgccgccgtggagccctggg

SEQ ID NO: 540446 - DNA, 25 bp, Homo sapien
gccctgccgccgtggagccctgggc

SEQ ID NO: 540447 - DNA, 25 bp, Homo sapien
ccctgccgccgtggagccctgggca

SEQ ID NO: 540448 - DNA, 25 bp, Homo sapien
cctgccgccgtggagccctgggcaa

SEQ ID NO: 540449 - DNA, 25 bp, Homo sapien
ctgccgccgtggagccctgggcaag

SEQ ID NO: 540450 - DNA, 25 bp, Homo sapien
gccgtggagccctgggcaagctctt

SEQ ID NO: 540451 - DNA, 25 bp, Homo sapien
ctgggtctccccatctcttcaatgg

SEQ ID NO: 540452 - DNA, 25 bp, Homo sapien
gaactgaactcccagcactaggtaa

SEQ ID NO: 540453 - DNA, 25 bp, Homo sapien
gaaaaacacctgtgcccaggcacta

SEQ ID NO: 540454 - DNA, 25 bp, Homo sapien
gcactagctacaaggccacaccaga

SEQ ID NO: 540455 - DNA, 25 bp, Homo sapien
tggaagcttcaggacaggaactctt

SEQ ID NO: 540456 - DNA, 25 bp, Homo sapien
caggaactcttccttggtcaagttt

SEQ ID NO: 540457 - DNA, 25 bp, Homo sapien
ttggtcaagttttccccagcaccta

SEQ ID NO: 540458 - DNA, 25 bp, Homo sapien
ctagtcctctccctagagctaaata

SEQ ID NO: 540459 - DNA, 25 bp, Homo sapien
aaggtgcttgatgagtgagtgttaa

SEQ ID NO: 540460 - DNA, 25 bp, Homo sapien
gtgttaaatgaacctgtgagtgctc

SEQ ID NO: 540461 - DNA, 25 bp, Homo sapien
gagctaaatatgcatctgggaaaaa

SEQ ID NO: 540462 - DNA, 25 bp, Homo sapien
ctgggaaaaattaggctctggagca

SEQ ID NO: 540463 - DNA, 25 bp, Homo sapien
gagggtgacttaccagactgagtat

SEQ ID NO: 540464 - DNA, 25 bp, Homo sapien
gtgacttaccagactgagtatttct

SEQ ID NO: 540465 - DNA, 25 bp, Homo sapien
acctgggcatgaatttccatttcga

SEQ ID NO: 540466 - DNA, 25 bp, Homo sapien
ttccatttcgattcagatgggactg

SEQ ID NO: 540467 - DNA, 25 bp, Homo sapien
gggactggaaacaaccattcaattt

SEQ ID NO: 540468 - DNA, 25 bp, Homo sapien
atcttactggacattatggatttac

SEQ ID NO: 540469 - DNA, 25 bp, Homo sapien
acattatgccctttggttgtcacta

SEQ ID NO: 540470 - DNA, 25 bp, Homo sapien
ttggttgtcactaccttgcaaatgt

SEQ ID NO: 540471 - DNA, 25 bp, Homo sapien
atgtgctaatgtggcagtgactgta

SEQ ID NO: 540472 - DNA, 25 bp, Homo sapien
gtgactgtaaaactggcacatggca

SEQ ID NO: 540473 - DNA, 25 bp, Homo sapien
ggcacatggcatttattaatcctga

SEQ ID NO: 540474 - DNA, 25 bp, Homo sapien
ggcacagaggccaggatctcacgcg

SEQ ID NO: 540475 - DNA, 25 bp, Homo sapien
acagaggccaggatctcacgcgcga

SEQ ID NO: 540476 - DNA, 25 bp, Homo sapien
cagaggccaggatctcacgcgcgac

SEQ ID NO: 540477 - DNA, 25 bp, Homo sapien
agcggtgcccgcgtcagtgaccgaa

SEQ ID NO: 540478 - DNA, 25 bp, Homo sapien
tgcccgcgtcagtgaccgaaggaag

SEQ ID NO: 540479 - DNA, 25 bp, Homo sapien
agaggccaggatctcacgcgcgacc

SEQ ID NO: 540480 - DNA, 25 bp, Homo sapien
agtgaccgaaggaagagaccaagat

SEQ ID NO: 540481 - DNA, 25 bp, Homo sapien
gaggccaggatctcacgcgcgaccg

SEQ ID NO: 540482 - DNA, 25 bp, Homo sapien
cagagcccgagaggaagtttggcgt

SEQ ID NO: 540483 - DNA, 25 bp, Homo sapien
gatctcacgcgcgaccgcacgaggc

SEQ ID NO: 540484 - DNA, 25 bp, Homo sapien
gcgaccgcacgaggccgggaccctc

SEQ ID NO: 540485 - DNA, 25 bp, Homo sapien
gggtcctcaaaaatccaggtgacaa

SEQ ID NO: 540486 - DNA, 25 bp, Homo sapien
aatcatttcaagcaagtccataggt

SEQ ID NO: 540487 - DNA, 25 bp, Homo sapien
atgacaggtcatagagcgcggtaac

SEQ ID NO: 540488 - DNA, 25 bp, Homo sapien
tgaactggcggcagaatctcgggct

SEQ ID NO: 540489 - DNA, 25 bp, Homo sapien
gggctggcactgaatatctgcttca

SEQ ID NO: 540490 - DNA, 25 bp, Homo sapien
ttcagcgtctgaatggatcccggca

SEQ ID NO: 540491 - DNA, 25 bp, Homo sapien
ggcaccaaacagcagtagtcatcta

SEQ ID NO: 540492 - DNA, 25 bp, Homo sapien
agtagtcatctacaagggccttggc

SEQ ID NO: 540493 - DNA, 25 bp, Homo sapien
gccttggctaacctcacacagtaaa

SEQ ID NO: 540494 - DNA, 25 bp, Homo sapien
acacagtaaaccacgggcgtccgct

SEQ ID NO: 540495 - DNA, 25 bp, Homo sapien
aacaccgggattcgacacacagcca

SEQ ID NO: 540496 - DNA, 25 bp, Homo sapien
tggaggagggtttaagcattaagat

SEQ ID NO: 540497 - DNA, 25 bp, Homo sapien
taagcattaagataggaagcaggaa

SEQ ID NO: 540498 - DNA, 25 bp, Homo sapien
gcaggaaatttgattgctctaaatt

SEQ ID NO: 540499 - DNA, 25 bp, Homo sapien
aatttgattgctctaaatttagaaa

SEQ ID NO: 540500 - DNA, 25 bp, Homo sapien
ggtggtaatgataattgaggcaaat

SEQ ID NO: 540501 - DNA, 25 bp, Homo sapien
ttctgaaataggaccttcaagatcc

SEQ ID NO: 540502 - DNA, 25 bp, Homo sapien
gaaataggaccttcaagatcctagg

SEQ ID NO: 540503 - DNA, 25 bp, Homo sapien
aaataggaccttcaagatcctaggg

SEQ ID NO: 540504 - DNA, 25 bp, Homo sapien
ataaaaaatcttctgcccacactgg

SEQ ID NO: 540505 - DNA, 25 bp, Homo sapien
taaaaaatcttctgcccacactggc

SEQ ID NO: 540506 - DNA, 25 bp, Homo sapien
aaaaaatcttctgcccacactggca

SEQ ID NO: 540507 - DNA, 25 bp, Homo sapien
ttttactctaagatgtgtggcacat

SEQ ID NO: 540508 - DNA, 25 bp, Homo sapien
cattactaataaagacgtggatttc

SEQ ID NO: 540509 - DNA, 25 bp, Homo sapien
gacgtggatttctatttatgtaaag

SEQ ID NO: 540510 - DNA, 25 bp, Homo sapien
gtaattgtagcaatattcctagatg

SEQ ID NO: 540511 - DNA, 25 bp, Homo sapien
gcaatattcctagatgctacctaaa

SEQ ID NO: 540512 - DNA, 25 bp, Homo sapien
gctacctaaatgattgttctgtcca

SEQ ID NO: 540513 - DNA, 25 bp, Homo sapien
atgattgttctgtccatttgccatc

SEQ ID NO: 540514 - DNA, 25 bp, Homo sapien
gttctgtccatttgccatcacaaat

SEQ ID NO: 540515 - DNA, 25 bp, Homo sapien
aaatacttttatctttggatgatta

SEQ ID NO: 540516 - DNA, 25 bp, Homo sapien
atctttggatgattatgttagtcag

SEQ ID NO: 540517 - DNA, 25 bp, Homo sapien
caacatagtttgaaattcttcctgt

SEQ ID NO: 540518 - DNA, 25 bp, Homo sapien
gctgaggtctggtccccagtgctgt

SEQ ID NO: 540519 - DNA, 25 bp, Homo sapien
tcggccttagggtcacttgttattg

SEQ ID NO: 540520 - DNA, 25 bp, Homo sapien
agtggtgtacatctttgagctcagg

SEQ ID NO: 540521 - DNA, 25 bp, Homo sapien
ggctcgctagtagagaccaaaggct

SEQ ID NO: 540522 - DNA, 25 bp, Homo sapien
ctctccggaggtgggtgtctgcact

SEQ ID NO: 540523 - DNA, 25 bp, Homo sapien
tgcactgctgttgtgctccccagag

SEQ ID NO: 540524 - DNA, 25 bp, Homo sapien
gagcgtctgggcttaccaccagcac

SEQ ID NO: 540525 - DNA, 25 bp, Homo sapien
ttaccaccagcaccccaaggagaag

SEQ ID NO: 540526 - DNA, 25 bp, Homo sapien
gagaagcgtggccatttccaggcaa

SEQ ID NO: 540527 - DNA, 25 bp, Homo sapien
atttccaggcaaacaggcaggagca

SEQ ID NO: 540528 - DNA, 25 bp, Homo sapien
ggaatcaggattcctggctcttggc

SEQ ID NO: 540529 - DNA, 25 bp, Homo sapien
gatacacctgaaccagaatagtttt

SEQ ID NO: 540530 - DNA, 25 bp, Homo sapien
gaatagttttcttaccctcacattg

SEQ ID NO: 540531 - DNA, 25 bp, Homo sapien
gttttcttaccctcacattgaaatg

SEQ ID NO: 540532 - DNA, 25 bp, Homo sapien
cacattgaaatgaggattttgctta

SEQ ID NO: 540533 - DNA, 25 bp, Homo sapien
aaaacagcacttgccgccagtggga

SEQ ID NO: 540534 - DNA, 25 bp, Homo sapien
ttatttattcccacagtttctcctg

SEQ ID NO: 540535 - DNA, 25 bp, Homo sapien
tgggtgtgtcattgcgcccgccgtc

SEQ ID NO: 540536 - DNA, 25 bp, Homo sapien
aggaggtgataaccaccctcccaga

SEQ ID NO: 540537 - DNA, 25 bp, Homo sapien
tgataaccaccctcccagagtttct

SEQ ID NO: 540538 - DNA, 25 bp, Homo sapien
ccagagtttctctcggctctttttt

SEQ ID NO: 540539 - DNA, 25 bp, Homo sapien
caacaaataggattcttgctgggaa

SEQ ID NO: 540540 - DNA, 25 bp, Homo sapien
tcagcagcctcgtcttacagcgtga

SEQ ID NO: 540541 - DNA, 25 bp, Homo sapien
cctcgtcttacagcgtgactgcaaa

SEQ ID NO: 540542 - DNA, 25 bp, Homo sapien
gtcttacagcgtgactgcaaagaaa

SEQ ID NO: 540543 - DNA, 25 bp, Homo sapien
aagaaaagcagctcggtgactccgt

SEQ ID NO: 540544 - DNA, 25 bp, Homo sapien
agcagctcggtgactccgtccacat

SEQ ID NO: 540545 - DNA, 25 bp, Homo sapien
gtccacatcgccacagttgagtcag

SEQ ID NO: 540546 - DNA, 25 bp, Homo sapien
acatcgccacagttgagtcagatgg

SEQ ID NO: 540547 - DNA, 25 bp, Homo sapien
agtcagatggcagtggcagtccttt

SEQ ID NO: 540548 - DNA, 25 bp, Homo sapien
aggaccgctgcttccggcgccgtaa

SEQ ID NO: 540549 - DNA, 25 bp, Homo sapien
cagtggcagtcctttgccagtggaa

SEQ ID NO: 540550 - DNA, 25 bp, Homo sapien
tgccagtggaaggagttcctgctaa

SEQ ID NO: 540551 - DNA, 25 bp, Homo sapien
gggcgtatagcagccaggtgatgca

SEQ ID NO: 540552 - DNA, 25 bp, Homo sapien
gccacttacagtggcctggagagcc

SEQ ID NO: 540553 - DNA, 25 bp, Homo sapien
acagtggcctggagagccagtcagt

SEQ ID NO: 540554 - DNA, 25 bp, Homo sapien
gagccagtcagtgagtggctgttac

SEQ ID NO: 540555 - DNA, 25 bp, Homo sapien
ccggctacagtgggcagaacagcat

SEQ ID NO: 540556 - DNA, 25 bp, Homo sapien
aacagcatgggtggctatgactagt

SEQ ID NO: 540557 - DNA, 25 bp, Homo sapien
ggaacatttgagttacttcaatcat

SEQ ID NO: 540558 - DNA, 25 bp, Homo sapien
tcaatcattttcacaggcagccaac

SEQ ID NO: 540559 - DNA, 25 bp, Homo sapien
tcacaggcagccaacaagcaattaa

SEQ ID NO: 540560 - DNA, 25 bp, Homo sapien
gccaacaagcaattaagagcagtta

SEQ ID NO: 540561 - DNA, 25 bp, Homo sapien
ccattttgcaccatgagtttgtgaa

SEQ ID NO: 540562 - DNA, 25 bp, Homo sapien
tactgtgttactttggctctgtgac

SEQ ID NO: 540563 - DNA, 25 bp, Homo sapien
atgggatccctaaatgtatctgtga

SEQ ID NO: 540564 - DNA, 25 bp, Homo sapien
ggctttctaaatatgatactctggg

SEQ ID NO: 540565 - DNA, 25 bp, Homo sapien
gaaatgcttggtttgtgtacaagga

SEQ ID NO: 540566 - DNA, 25 bp, Homo sapien
tgtacaaggagaccagcctacacag

SEQ ID NO: 540567 - DNA, 25 bp, Homo sapien
gcctacacagtccatcaaatacatc

SEQ ID NO: 540568 - DNA, 25 bp, Homo sapien
tacatctgcccctcatagccaagga

SEQ ID NO: 540569 - DNA, 25 bp, Homo sapien
attccacctcctaccggaatataat

SEQ ID NO: 540570 - DNA, 25 bp, Homo sapien
gatactatgacatgttgccaacacc

SEQ ID NO: 540571 - DNA, 25 bp, Homo sapien
acatgttgccaacaccttgagaagc

SEQ ID NO: 540572 - DNA, 25 bp, Homo sapien
caccttgagaagcattatttgtttc

SEQ ID NO: 540573 - DNA, 25 bp, Homo sapien
atcaccatctggttcaaggacacct

SEQ ID NO: 540574 - DNA, 25 bp, Homo sapien
tggttcaaggacacctaaaaggtct

SEQ ID NO: 540575 - DNA, 25 bp, Homo sapien
ctaaaaggtctaggcgatcacggtc

SEQ ID NO: 540576 - DNA, 25 bp, Homo sapien
gtctaggcgatcacggtctagatct

SEQ ID NO: 540577 - DNA, 25 bp, Homo sapien
gaaagaagtccagatcccagtccag

SEQ ID NO: 540578 - DNA, 25 bp, Homo sapien
agaagtccagatcccagtccagatc

SEQ ID NO: 540579 - DNA, 25 bp, Homo sapien
agtccagatctccacacaggtctca

SEQ ID NO: 540580 - DNA, 25 bp, Homo sapien
gatctccacacaggtctcataaaaa

SEQ ID NO: 540581 - DNA, 25 bp, Homo sapien
acgtaaatttttaagatgctgtcac

SEQ ID NO: 540582 - DNA, 25 bp, Homo sapien
gatgctgtcacttattggaaatgcg

SEQ ID NO: 540583 - DNA, 25 bp, Homo sapien
gtcacttattggaaatgcgatttgt

SEQ ID NO: 540584 - DNA, 25 bp, Homo sapien
gttggttgaatttcactgatcttcc

SEQ ID NO: 540585 - DNA, 25 bp, Homo sapien
gctgctgatggtgttgtaattagaa

SEQ ID NO: 540586 - DNA, 25 bp, Homo sapien
gaaagatggtgccaatcctaaaaga

SEQ ID NO: 540587 - DNA, 25 bp, Homo sapien
atcctaaaagatttgtgtgggctaa

SEQ ID NO: 540588 - DNA, 25 bp, Homo sapien
gtgtgggctaaaagtgcttgtactt

SEQ ID NO: 540589 - DNA, 25 bp, Homo sapien
ttacttttttctgcacttataactg

SEQ ID NO: 540590 - DNA, 25 bp, Homo sapien
ttttctgcacttataactgatttgg

SEQ ID NO: 540591 - DNA, 25 bp, Homo sapien
aaattgtgtgcgtgtatctgttctt

SEQ ID NO: 540592 - DNA, 25 bp, Homo sapien
tatctgttctttctctgttgtggca

SEQ ID NO: 540593 - DNA, 25 bp, Homo sapien
tttctctgttgtggcagcttgtact

SEQ ID NO: 540594 - DNA, 25 bp, Homo sapien
gttgtggcagcttgtactattaaaa

SEQ ID NO: 540595 - DNA, 25 bp, Homo sapien
atccagaggagatccaagtcaattg

SEQ ID NO: 540596 - DNA, 25 bp, Homo sapien
aggctctaccgaccttcaaactaca

SEQ ID NO: 540597 - DNA, 25 bp, Homo sapien
gaccttcaaactacaacagagcttt

SEQ ID NO: 540598 - DNA, 25 bp, Homo sapien
tcaaactacaacagagctttcagga

SEQ ID NO: 540599 - DNA, 25 bp, Homo sapien
agaatgcggagagacggcttcccac

SEQ ID NO: 540600 - DNA, 25 bp, Homo sapien
attgctcctcattcagccagaaagg

SEQ ID NO: 540601 - DNA, 25 bp, Homo sapien
ctcattcagccagaaaggactccaa

SEQ ID NO: 540602 - DNA, 25 bp, Homo sapien
accacgctttggacttgctcacttt

SEQ ID NO: 540603 - DNA, 25 bp, Homo sapien
gctttggacttgctcacttttattt

SEQ ID NO: 540604 - DNA, 25 bp, Homo sapien
tggacttgctcacttttatttaaga

SEQ ID NO: 540605 - DNA, 25 bp, Homo sapien
tcacttttatttaagagtccgacgg

SEQ ID NO: 540606 - DNA, 25 bp, Homo sapien
taaaatgtatgctaaccccaaaata

SEQ ID NO: 540607 - DNA, 25 bp, Homo sapien
taaccccaaaataatactaggcatg

SEQ ID NO: 540608 - DNA, 25 bp, Homo sapien
actaggcatgaggtgacctctctga

SEQ ID NO: 540609 - DNA, 25 bp, Homo sapien
tgaggtgacctctctgatttggtca

SEQ ID NO: 540610 - DNA, 25 bp, Homo sapien
gatttggtcaccttgtagaaccttg

SEQ ID NO: 540611 - DNA, 25 bp, Homo sapien
gtcaccttgtagaaccttggagggt

SEQ ID NO: 540612 - DNA, 25 bp, Homo sapien
accttggagggtgtcagggcatctc

SEQ ID NO: 540613 - DNA, 25 bp, Homo sapien
agggcatctctttgagtatcagtta

SEQ ID NO: 540614 - DNA, 25 bp, Homo sapien
atcatgagtcaggaggttcaagaac

SEQ ID NO: 540615 - DNA, 25 bp, Homo sapien
gagagctgtcattgagtcccaaaat

SEQ ID NO: 540616 - DNA, 25 bp, Homo sapien
gagctgtcattgagtcccaaaatgg

SEQ ID NO: 540617 - DNA, 25 bp, Homo sapien
ataagatatggtcaagtacagctct

SEQ ID NO: 540618 - DNA, 25 bp, Homo sapien
tcaagtacagctctgtgaaagttct

SEQ ID NO: 540619 - DNA, 25 bp, Homo sapien
tgaaagttctgattctcttccttcc

SEQ ID NO: 540620 - DNA, 25 bp, Homo sapien
cttccctgtttgtcaatgttttatt

SEQ ID NO: 540621 - DNA, 25 bp, Homo sapien
tattctgaagtaaacgttagctcta

SEQ ID NO: 540622 - DNA, 25 bp, Homo sapien
gttagctctacatataaatcctgga

SEQ ID NO: 540623 - DNA, 25 bp, Homo sapien
taatttgaacacactacatcgtagg

SEQ ID NO: 540624 - DNA, 25 bp, Homo sapien
cactacatcgtagggtgactgattt

SEQ ID NO: 540625 - DNA, 25 bp, Homo sapien
gactgatttttgaagtataccacag

SEQ ID NO: 540626 - DNA, 25 bp, Homo sapien
gttactatggtaaactaagctagtt

SEQ ID NO: 540627 - DNA, 25 bp, Homo sapien
gctagtttaacacttgagcaaatgc

SEQ ID NO: 540628 - DNA, 25 bp, Homo sapien
cggcggtgtccaatcagggaatgaa

SEQ ID NO: 540629 - DNA, 25 bp, Homo sapien
gaatgaacacacttgccagtcttca

SEQ ID NO: 540630 - DNA, 25 bp, Homo sapien
gtcttcacctccgtaatatagatat

SEQ ID NO: 540631 - DNA, 25 bp, Homo sapien
ctaagagagtcctgtctgggctgaa

SEQ ID NO: 540632 - DNA, 25 bp, Homo sapien
tagagcgtggactatccggcagttc

SEQ ID NO: 540633 - DNA, 25 bp, Homo sapien
tcccatttcatccaccgggttttat

SEQ ID NO: 540634 - DNA, 25 bp, Homo sapien
caccgggttttatcttctaccagct

SEQ ID NO: 540635 - DNA, 25 bp, Homo sapien
tgcagaagccgctgagctcccatgg

SEQ ID NO: 540636 - DNA, 25 bp, Homo sapien
gagtatccggacagcattcttttct

SEQ ID NO: 540637 - DNA, 25 bp, Homo sapien
cggacagcattcttttctgggacaa

SEQ ID NO: 540638 - DNA, 25 bp, Homo sapien
gggacaaccttcatggcgctcagta

SEQ ID NO: 540639 - DNA, 25 bp, Homo sapien
agtgaactgcagaggcaggtcacca

SEQ ID NO: 540640 - DNA, 25 bp, Homo sapien
tgcagaggcaggtcaccaaccagtg

SEQ ID NO: 540641 - DNA, 25 bp, Homo sapien
aggcaggtcaccaaccagtgtggag

SEQ ID NO: 540642 - DNA, 25 bp, Homo sapien
tcaccaaccagtgtggaggctaaaa

SEQ ID NO: 540643 - DNA, 25 bp, Homo sapien
gtggaggctaaaagcgggcctcttt

SEQ ID NO: 540644 - DNA, 25 bp, Homo sapien
aagtgttggacatctgtagtattcc

SEQ ID NO: 540645 - DNA, 25 bp, Homo sapien
gtagtattcctggtctcgaatcatc

SEQ ID NO: 540646 - DNA, 25 bp, Homo sapien
tcctggtctcgaatcatcctgatat

SEQ ID NO: 540647 - DNA, 25 bp, Homo sapien
aatcatcctgatattcttcattttg

SEQ ID NO: 540648 - DNA, 25 bp, Homo sapien
attttgttattcacattggactagg

SEQ ID NO: 540649 - DNA, 25 bp, Homo sapien
gttattcacattggactaggagata

SEQ ID NO: 540650 - DNA, 25 bp, Homo sapien
tgacttgataagaggcgcaaaagaa

SEQ ID NO: 540651 - DNA, 25 bp, Homo sapien
aagaatctcaaagtgaaaggaccag

SEQ ID NO: 540652 - DNA, 25 bp, Homo sapien
agaatctcaaagtgaaaggaccagt

SEQ ID NO: 540653 - DNA, 25 bp, Homo sapien
ctcaaagtgaaaggaccagttcgaa

SEQ ID NO: 540654 - DNA, 25 bp, Homo sapien
ggaccagttcgaatgcctaccaaga

SEQ ID NO: 540655 - DNA, 25 bp, Homo sapien
gttcgaatgcctaccaagactttga

SEQ ID NO: 540656 - DNA, 25 bp, Homo sapien
gcctaccaagactttgagaatcact

SEQ ID NO: 540657 - DNA, 25 bp, Homo sapien
tggtgaaggttctaagacgtgggat

SEQ ID NO: 540658 - DNA, 25 bp, Homo sapien
tgaaggttctaagacgtgggatcgt

SEQ ID NO: 540659 - DNA, 25 bp, Homo sapien
gttctaagacgtgggatcgtttcca

SEQ ID NO: 540660 - DNA, 25 bp, Homo sapien
gaattcacaagcgactcattgactt

SEQ ID NO: 540661 - DNA, 25 bp, Homo sapien
tgcttcttaaggtccctgctcggcc

SEQ ID NO: 540662 - DNA, 25 bp, Homo sapien
ctgctcggccggtgtaaatatgttt

SEQ ID NO: 540663 - DNA, 25 bp, Homo sapien
tgctcggccggtgtaaatatgtttc

SEQ ID NO: 540664 - DNA, 25 bp, Homo sapien
gtccctctaataaagctcctctgct

SEQ ID NO: 540665 - DNA, 25 bp, Homo sapien
acgtggtggcggtgtaccccaatgc

SEQ ID NO: 540666 - DNA, 25 bp, Homo sapien
tggtggcggtgtaccccaatgccaa

SEQ ID NO: 540667 - DNA, 25 bp, Homo sapien
ccaatgccaaggtggaactcgtctg

SEQ ID NO: 540668 - DNA, 25 bp, Homo sapien
tgccaaggtggaactcgtctgagct

SEQ ID NO: 540669 - DNA, 25 bp, Homo sapien
ccaaggtggaactcgtctgagctgg

SEQ ID NO: 540670 - DNA, 25 bp, Homo sapien
gtggaactcgtctgagctgggaccc

SEQ ID NO: 540671 - DNA, 25 bp, Homo sapien
tggaactcgtctgagctgggaccct

SEQ ID NO: 540672 - DNA, 25 bp, Homo sapien
acctgaactgtcctggaggccccaa

SEQ ID NO: 540673 - DNA, 25 bp, Homo sapien
agccatgttccccagttcagtgttg

SEQ ID NO: 540674 - DNA, 25 bp, Homo sapien
ttccccagttcagtgttgcatgtat

SEQ ID NO: 540675 - DNA, 25 bp, Homo sapien
ttgcatgtataatagatttctcctc

SEQ ID NO: 540676 - DNA, 25 bp, Homo sapien
ccttggcatgggtgagacctgacca

SEQ ID NO: 540677 - DNA, 25 bp, Homo sapien
atgggtgagacctgaccagtcagat

SEQ ID NO: 540678 - DNA, 25 bp, Homo sapien
acctgaccagtcagatggtagttga

SEQ ID NO: 540679 - DNA, 25 bp, Homo sapien
gatggtagttgagggtgacttttcc

SEQ ID NO: 540680 - DNA, 25 bp, Homo sapien
cctggcctttataattttactcact

SEQ ID NO: 540681 - DNA, 25 bp, Homo sapien
tttataattttactcactcactctg

SEQ ID NO: 540682 - DNA, 25 bp, Homo sapien
tcactcactctgatttatgttttga

SEQ ID NO: 540683 - DNA, 25 bp, Homo sapien
ttttttcaccctgaaccattggcaa

SEQ ID NO: 540684 - DNA, 25 bp, Homo sapien
tttcaccctgaaccattggcaacca

SEQ ID NO: 540685 - DNA, 25 bp, Homo sapien
accctgaaccattggcaaccacaat

SEQ ID NO: 540686 - DNA, 25 bp, Homo sapien
ctgtgagtttgattacttgatactt

SEQ ID NO: 540687 - DNA, 25 bp, Homo sapien
gagtttgattacttgatacttcatg

SEQ ID NO: 540688 - DNA, 25 bp, Homo sapien
gattacttgatacttcatgtgagtg

SEQ ID NO: 540689 - DNA, 25 bp, Homo sapien
tacttgatacttcatgtgagtggaa

SEQ ID NO: 540690 - DNA, 25 bp, Homo sapien
tcaagtttgacccataccatatcat

SEQ ID NO: 540691 - DNA, 25 bp, Homo sapien
agtttgacccataccatatcatgtg

SEQ ID NO: 540692 - DNA, 25 bp, Homo sapien
gacccataccatatcatgtggcagg

SEQ ID NO: 540693 - DNA, 25 bp, Homo sapien
ataccatatcatgtggcaggatttt

SEQ ID NO: 540694 - DNA, 25 bp, Homo sapien
gtatttcttgtgcattaatctgacg

SEQ ID NO: 540695 - DNA, 25 bp, Homo sapien
taatctgacgataatttccctgtat

SEQ ID NO: 540696 - DNA, 25 bp, Homo sapien
aatttccctgtatattatgttcatt

SEQ ID NO: 540697 - DNA, 25 bp, Homo sapien
attagatcaggttgtctgcatttgt

SEQ ID NO: 540698 - DNA, 25 bp, Homo sapien
tctgcatttgttggtgtaagtgaac

SEQ ID NO: 540699 - DNA, 25 bp, Homo sapien
ggtgtaagtgaacatcatcacagtt

SEQ ID NO: 540700 - DNA, 25 bp, Homo sapien
gaacatcatcacagttatcctgagt

SEQ ID NO: 540701 - DNA, 25 bp, Homo sapien
gttatcctgagttgagtttaagcca

SEQ ID NO: 540702 - DNA, 25 bp, Homo sapien
acatgcatagaaaagggtcttccta

SEQ ID NO: 540703 - DNA, 25 bp, Homo sapien
tagaaaagggtcttcctattaatgg

SEQ ID NO: 540704 - DNA, 25 bp, Homo sapien
taggatgtgtattatttcagttttg

SEQ ID NO: 540705 - DNA, 25 bp, Homo sapien
actaaaatagaccacaactgagcac

SEQ ID NO: 540706 - DNA, 25 bp, Homo sapien
gaccacaactgagcacaaattcctt

SEQ ID NO: 540707 - DNA, 25 bp, Homo sapien
gagcacaaattccttttataaatgt

SEQ ID NO: 540708 - DNA, 25 bp, Homo sapien
acacatttgtgaattgtggttcagt

SEQ ID NO: 540709 - DNA, 25 bp, Homo sapien
tatttatctttagggaaggctgatc

SEQ ID NO: 540710 - DNA, 25 bp, Homo sapien
gggaaggctgatcatttatcttata

SEQ ID NO: 540711 - DNA, 25 bp, Homo sapien
cccagcctcttattcattatggtta

SEQ ID NO: 540712 - DNA, 25 bp, Homo sapien
gaatatagtacatatcagttgggtt

SEQ ID NO: 540713 - DNA, 25 bp, Homo sapien
gggtttggttttggtcatcgagact

SEQ ID NO: 540714 - DNA, 25 bp, Homo sapien
ttggtcatcgagactaaaagctcca

SEQ ID NO: 540715 - DNA, 25 bp, Homo sapien
ttgtgttttctgctaacttatttaa

SEQ ID NO: 540716 - DNA, 25 bp, Homo sapien
cagccagccccaagatctcaggagc

SEQ ID NO: 540717 - DNA, 25 bp, Homo sapien
atctcaggagctttagggagaagac

SEQ ID NO: 540718 - DNA, 25 bp, Homo sapien
gggctggagcacaccttgggcctca

SEQ ID NO: 540719 - DNA, 25 bp, Homo sapien
ggagcacaccttgggcctcagtggt

SEQ ID NO: 540720 - DNA, 25 bp, Homo sapien
ctcagtggtttctgtgtccctgtgg

SEQ ID NO: 540721 - DNA, 25 bp, Homo sapien
tgtccctgtggtgccagtgcttctg

SEQ ID NO: 540722 - DNA, 25 bp, Homo sapien
ccactctggctcagcaacctggtta

SEQ ID NO: 540723 - DNA, 25 bp, Homo sapien
aggcatgggcccactgcctgtccat

SEQ ID NO: 540724 - DNA, 25 bp, Homo sapien
tattgaaactcaccattgccctatc

SEQ ID NO: 540725 - DNA, 25 bp, Homo sapien
tcaccattgccctatccttgtgtct

SEQ ID NO: 540726 - DNA, 25 bp, Homo sapien
cacccccttccatgtgttgaataat

SEQ ID NO: 540727 - DNA, 25 bp, Homo sapien
aagtaagattacaacagagcagaac

SEQ ID NO: 540728 - DNA, 25 bp, Homo sapien
acaacagagcagaacttgcacccac

SEQ ID NO: 540729 - DNA, 25 bp, Homo sapien
cagagcagaacttgcacccaccatt

SEQ ID NO: 540730 - DNA, 25 bp, Homo sapien
aaattttactgtttgcaagtagtct

SEQ ID NO: 540731 - DNA, 25 bp, Homo sapien
actgtttgcaagtagtctatagaaa

SEQ ID NO: 540732 - DNA, 25 bp, Homo sapien
ttgttttaagtcttcaaatatcttg

SEQ ID NO: 540733 - DNA, 25 bp, Homo sapien
gagaaatagtagactgtatgttgaa

SEQ ID NO: 540734 - DNA, 25 bp, Homo sapien
accatatttgtaactatcaactttt

SEQ ID NO: 540735 - DNA, 25 bp, Homo sapien
cttttaacgtttttgttacatgcat

SEQ ID NO: 540736 - DNA, 25 bp, Homo sapien
taacgtttttgttacatgcattgta

SEQ ID NO: 540737 - DNA, 25 bp, Homo sapien
tttgttacatgcattgtaattctgc

SEQ ID NO: 540738 - DNA, 25 bp, Homo sapien
gaaatttctgtgcttccaatccaca

SEQ ID NO: 540739 - DNA, 25 bp, Homo sapien
gcttccaatccacaatgagatgcat

SEQ ID NO: 540740 - DNA, 25 bp, Homo sapien
gaaaatgcgcaactgatcgcctagg

SEQ ID NO: 540741 - DNA, 25 bp, Homo sapien
tgatcgcctaggagagggcctcgta

SEQ ID NO: 540742 - DNA, 25 bp, Homo sapien
ggcacagctggagatagtttcaaag

SEQ ID NO: 540743 - DNA, 25 bp, Homo sapien
catcctgaggaaagcctcctatgga

SEQ ID NO: 540744 - DNA, 25 bp, Homo sapien
gcctcctatggaatgtaaagtgcaa

SEQ ID NO: 540745 - DNA, 25 bp, Homo sapien
atgtaaagtgcaatcatttcttcag

SEQ ID NO: 540746 - DNA, 25 bp, Homo sapien
gatataagactttccccaacaatgt

SEQ ID NO: 540747 - DNA, 25 bp, Homo sapien
caacaatgtgattggattcctttat

SEQ ID NO: 540748 - DNA, 25 bp, Homo sapien
aatcgagagaagctgccatccacct

SEQ ID NO: 540749 - DNA, 25 bp, Homo sapien
taattctaatgtgcacggtgtgact

SEQ ID NO: 540750 - DNA, 25 bp, Homo sapien
ggcagagtgagtttaaaagctttac

SEQ ID NO: 540751 - DNA, 25 bp, Homo sapien
aaagctttacgagtgattaattgct

SEQ ID NO: 540752 - DNA, 25 bp, Homo sapien
gattaattgcttggcaggcacccac

SEQ ID NO: 540753 - DNA, 25 bp, Homo sapien
ggcaggcacccacgctatctgcatt

SEQ ID NO: 540754 - DNA, 25 bp, Homo sapien
agaactttactgatgcatccatgta

SEQ ID NO: 540755 - DNA, 25 bp, Homo sapien
atgcatccatgtacatttccactga

SEQ ID NO: 540756 - DNA, 25 bp, Homo sapien
tgctgcctcacaatgtcacgtgtat

SEQ ID NO: 540757 - DNA, 25 bp, Homo sapien
gtcacgtgtattaaagtctaagcag

SEQ ID NO: 540758 - DNA, 25 bp, Homo sapien
aagcagtcacttctgattcacttgc

SEQ ID NO: 540759 - DNA, 25 bp, Homo sapien
tctgattcacttgcactgtttggga

SEQ ID NO: 540760 - DNA, 25 bp, Homo sapien
caaagtcattgtcattagagtgtac

SEQ ID NO: 540761 - DNA, 25 bp, Homo sapien
gagtgtacttgattactgggcatcc

SEQ ID NO: 540762 - DNA, 25 bp, Homo sapien
gtacttgattactgggcatccttgt

SEQ ID NO: 540763 - DNA, 25 bp, Homo sapien
actgggcatccttgtaatataattt

SEQ ID NO: 540764 - DNA, 25 bp, Homo sapien
atataatttcataccactgacacat

SEQ ID NO: 540765 - DNA, 25 bp, Homo sapien
ataccactgacacattatacttgta

SEQ ID NO: 540766 - DNA, 25 bp, Homo sapien
agagaacatctttcccagagtgcct

SEQ ID NO: 540767 - DNA, 25 bp, Homo sapien
aacatctttcccagagtgcctcaga

SEQ ID NO: 540768 - DNA, 25 bp, Homo sapien
aaagttgactgaatctggtatagac

SEQ ID NO: 540769 - DNA, 25 bp, Homo sapien
gaatctggtatagactttgggagta

SEQ ID NO: 540770 - DNA, 25 bp, Homo sapien
ttgtgaatggaatgccttgcaatat

SEQ ID NO: 540771 - DNA, 25 bp, Homo sapien
tggtgaattttctaggagcgatgat

SEQ ID NO: 540772 - DNA, 25 bp, Homo sapien
aggagcgatgatgtactgtaatttt

SEQ ID NO: 540773 - DNA, 25 bp, Homo sapien
tttttaaatgcttgttctaagacat

SEQ ID NO: 540774 - DNA, 25 bp, Homo sapien
gaatgtagaccattttccaaaaagg

SEQ ID NO: 540775 - DNA, 25 bp, Homo sapien
gtagtaattcctaatcttggagaat

SEQ ID NO: 540776 - DNA, 25 bp, Homo sapien
ttcattatttctcgagtactttcag

SEQ ID NO: 540777 - DNA, 25 bp, Homo sapien
tttctcgagtactttcagaaagtct

SEQ ID NO: 540778 - DNA, 25 bp, Homo sapien
aagtctgacactttcattgttgtgc

SEQ ID NO: 540779 - DNA, 25 bp, Homo sapien
gacactttcattgttgtgccagctg

SEQ ID NO: 540780 - DNA, 25 bp, Homo sapien
tcattgttgtgccagctggttgaaa

SEQ ID NO: 540781 - DNA, 25 bp, Homo sapien
gctggttgaaattaaaactctgata

SEQ ID NO: 540782 - DNA, 25 bp, Homo sapien
aggtcctcatgcctccaaatggcat

SEQ ID NO: 540783 - DNA, 25 bp, Homo sapien
aaatggcatctagagtttgagcagc

SEQ ID NO: 540784 - DNA, 25 bp, Homo sapien
ctagggcccgcagagcatttggtgc

SEQ ID NO: 540785 - DNA, 25 bp, Homo sapien
gtgcccctccatgttgcaatgcaaa

SEQ ID NO: 540786 - DNA, 25 bp, Homo sapien
ttgcaatgcaaacaccttcaccact

SEQ ID NO: 540787 - DNA, 25 bp, Homo sapien
gcactaatccccttagtaccaagaa

SEQ ID NO: 540788 - DNA, 25 bp, Homo sapien
gccaggatttagtcctggcccagcc

SEQ ID NO: 540789 - DNA, 25 bp, Homo sapien
gggacctggagcacgatctgttgac

SEQ ID NO: 540790 - DNA, 25 bp, Homo sapien
tggagcacgatctgttgacttccct

SEQ ID NO: 540791 - DNA, 25 bp, Homo sapien
tgttgacttccctgggtaggacact

SEQ ID NO: 540792 - DNA, 25 bp, Homo sapien
gacttccctgggtaggacactgcca

SEQ ID NO: 540793 - DNA, 25 bp, Homo sapien
gggatctggctcacgagttctatga

SEQ ID NO: 540794 - DNA, 25 bp, Homo sapien
agttctatgaggagacaatcgtcac

SEQ ID NO: 540795 - DNA, 25 bp, Homo sapien
gacaatcgtcaccaagaacgggcag

SEQ ID NO: 540796 - DNA, 25 bp, Homo sapien
ccaagctgaggcgagtgcataagaa

SEQ ID NO: 540797 - DNA, 25 bp, Homo sapien
aggcgagtgcataagaatctgattc

SEQ ID NO: 540798 - DNA, 25 bp, Homo sapien
gaatctgattcctcagggcatcgtg

SEQ ID NO: 540799 - DNA, 25 bp, Homo sapien
attcctcagggcatcgtgaagctgg

SEQ ID NO: 540800 - DNA, 25 bp, Homo sapien
gggcatcgtgaagctggatcacccc

SEQ ID NO: 540801 - DNA, 25 bp, Homo sapien
tggatttccctgtgatcctctatga

SEQ ID NO: 540802 - DNA, 25 bp, Homo sapien
tgatcctctatgaggtgtgaccctg

SEQ ID NO: 540803 - DNA, 25 bp, Homo sapien
gaggtggcagacagaagcaccccct

SEQ ID NO: 540804 - DNA, 25 bp, Homo sapien
catggtggctaagggctacggttat

SEQ ID NO: 540805 - DNA, 25 bp, Homo sapien
ctaagggctacggttatcaggtgaa

SEQ ID NO: 540806 - DNA, 25 bp, Homo sapien
agggctacggttatcaggtgaaatt

SEQ ID NO: 540807 - DNA, 25 bp, Homo sapien
aatttgagatttgtaggctgactat

SEQ ID NO: 540808 - DNA, 25 bp, Homo sapien
atttgtaggctgactatattttcaa

SEQ ID NO: 540809 - DNA, 25 bp, Homo sapien
cccaaagcctctagcgtcatagttt

SEQ ID NO: 540810 - DNA, 25 bp, Homo sapien
aaagcctctagcgtcatagtttcct

SEQ ID NO: 540811 - DNA, 25 bp, Homo sapien
tcatagtttcctcacccaaattact

SEQ ID NO: 540812 - DNA, 25 bp, Homo sapien
attactatgtttccacaagatttat

SEQ ID NO: 540813 - DNA, 25 bp, Homo sapien
ccacaagatttatatagttggtcta

SEQ ID NO: 540814 - DNA, 25 bp, Homo sapien
ctgcggtccttgaaagtgaagttgg

SEQ ID NO: 540815 - DNA, 25 bp, Homo sapien
attatctacctgttctgtagctttc

SEQ ID NO: 540816 - DNA, 25 bp, Homo sapien
tgtagctttctggaatttacctccc

SEQ ID NO: 540817 - DNA, 25 bp, Homo sapien
tggaatttacctccccttttctatg

SEQ ID NO: 540818 - DNA, 25 bp, Homo sapien
ctccccttttctatgttgctattgt

SEQ ID NO: 540819 - DNA, 25 bp, Homo sapien
gttgctattgtaaggtctttgtaaa

SEQ ID NO: 540820 - DNA, 25 bp, Homo sapien
gtaaggtctttgtaaaatcttgcag

SEQ ID NO: 540821 - DNA, 25 bp, Homo sapien
aatcttgcagttttgtaagccctct

SEQ ID NO: 540822 - DNA, 25 bp, Homo sapien
gtaagccctctttaatgctgtcttt

SEQ ID NO: 540823 - DNA, 25 bp, Homo sapien
tgctgtctttgtggactgtgggtct

SEQ ID NO: 540824 - DNA, 25 bp, Homo sapien
ctgtgggtctggactaaccctgtgg

SEQ ID NO: 540825 - DNA, 25 bp, Homo sapien
tggactaaccctgtggttgcctgcc

SEQ ID NO: 540826 - DNA, 25 bp, Homo sapien
ggtagaacaaaccttcttctgtgtt

SEQ ID NO: 540827 - DNA, 25 bp, Homo sapien
gatgttcaaaatccaccaggacaga

SEQ ID NO: 540828 - DNA, 25 bp, Homo sapien
caggacagatgctacttgggtttaa

SEQ ID NO: 540829 - DNA, 25 bp, Homo sapien
atagatgatacaaagtcctcttggg

SEQ ID NO: 540830 - DNA, 25 bp, Homo sapien
gggctgaaaatcacttcctatttgc

SEQ ID NO: 540831 - DNA, 25 bp, Homo sapien
aatcacttcctatttgcatggcttt

SEQ ID NO: 540832 - DNA, 25 bp, Homo sapien
gcatggctttactaactggtttctg

SEQ ID NO: 540833 - DNA, 25 bp, Homo sapien
tgttttccattatctttttcacaga

SEQ ID NO: 540834 - DNA, 25 bp, Homo sapien
agtcttggtcagtatttttccagca

SEQ ID NO: 540835 - DNA, 25 bp, Homo sapien
aaacggtcagtattagaccactgct

SEQ ID NO: 540836 - DNA, 25 bp, Homo sapien
gaccactgctaggttatgtagtcaa

SEQ ID NO: 540837 - DNA, 25 bp, Homo sapien
cagataccctctctctaattgggtt

SEQ ID NO: 540838 - DNA, 25 bp, Homo sapien
ctctctctaattgggttcttgcatg

SEQ ID NO: 540839 - DNA, 25 bp, Homo sapien
ggttcttgcatgtaaaatactccac

SEQ ID NO: 540840 - DNA, 25 bp, Homo sapien
atttcctaaagtttgcacttaattg

SEQ ID NO: 540841 - DNA, 25 bp, Homo sapien
tgcacttaattgtgaggattctcag

SEQ ID NO: 540842 - DNA, 25 bp, Homo sapien
gaatgtgttgaatgtcgcgtttgct

SEQ ID NO: 540843 - DNA, 25 bp, Homo sapien
gaatgtcgcgtttgctgtccactcg

SEQ ID NO: 540844 - DNA, 25 bp, Homo sapien
tgtccactcgtcctagaagtttagt

SEQ ID NO: 540845 - DNA, 25 bp, Homo sapien
gtttagtgtttttgtcactgtcatg

SEQ ID NO: 540846 - DNA, 25 bp, Homo sapien
ttttgtcactgtcatgtgtttctgt

SEQ ID NO: 540847 - DNA, 25 bp, Homo sapien
tcagtgcacccgaggctcagagcat

SEQ ID NO: 540848 - DNA, 25 bp, Homo sapien
agcagatgtgatcacatcaccccgt

SEQ ID NO: 540849 - DNA, 25 bp, Homo sapien
gtgatcacatcaccccgtcattggg

SEQ ID NO: 540850 - DNA, 25 bp, Homo sapien
attgggcaccgctgactccagcatg

SEQ ID NO: 540851 - DNA, 25 bp, Homo sapien
actccagcatggaggacaccaggga

SEQ ID NO: 540852 - DNA, 25 bp, Homo sapien
agctgtgatcttgcccagaacctct

SEQ ID NO: 540853 - DNA, 25 bp, Homo sapien
tgatcttgcccagaacctctcttgg

SEQ ID NO: 540854 - DNA, 25 bp, Homo sapien
ctctcttggcttcataaacagctgt

SEQ ID NO: 540855 - DNA, 25 bp, Homo sapien
taaacagctgtgaaccctcccctga

SEQ ID NO: 540856 - DNA, 25 bp, Homo sapien
aagcagaagtcgctcgcactggtca

SEQ ID NO: 540857 - DNA, 25 bp, Homo sapien
aagtcgctcgcactggtcagtcgga

SEQ ID NO: 540858 - DNA, 25 bp, Homo sapien
ggcaagatcagatcctggaggactt

SEQ ID NO: 540859 - DNA, 25 bp, Homo sapien
cctgtcctgagtgggcagtccacgt

SEQ ID NO: 540860 - DNA, 25 bp, Homo sapien
tgggcagtccacgtttgccgtgcca

SEQ ID NO: 540861 - DNA, 25 bp, Homo sapien
gtgccacccatgcagaacttcatgg

SEQ ID NO: 540862 - DNA, 25 bp, Homo sapien
gtaccagacccaaggactggtgggc

SEQ ID NO: 540863 - DNA, 25 bp, Homo sapien
actggtgggcagtagcaatggttcc

SEQ ID NO: 540864 - DNA, 25 bp, Homo sapien
gcagtagcaatggttccagtcacaa

SEQ ID NO: 540865 - DNA, 25 bp, Homo sapien
cagtcacaaaaagagcgggaaccta

SEQ ID NO: 540866 - DNA, 25 bp, Homo sapien
gagcgggaacctatcttgttacaac

SEQ ID NO: 540867 - DNA, 25 bp, Homo sapien
gaacctatcttgttacaactgcggg

SEQ ID NO: 540868 - DNA, 25 bp, Homo sapien
aggactgcaaacagccgtccatgga

SEQ ID NO: 540869 - DNA, 25 bp, Homo sapien
aacagccgtccatggacttcaaccg

SEQ ID NO: 540870 - DNA, 25 bp, Homo sapien
attctgtttattatgacaaatgaaa

SEQ ID NO: 540871 - DNA, 25 bp, Homo sapien
aatggaaagtttgtagcatttttct

SEQ ID NO: 540872 - DNA, 25 bp, Homo sapien
tttttctaataggtactgccatatt

SEQ ID NO: 540873 - DNA, 25 bp, Homo sapien
aataggtactgccatatttttctgt

SEQ ID NO: 540874 - DNA, 25 bp, Homo sapien
ccatatttttctgtgtggagtattt

SEQ ID NO: 540875 - DNA, 25 bp, Homo sapien
ttctgtgtggagtatttttataatt

SEQ ID NO: 540876 - DNA, 25 bp, Homo sapien
ttatctgtataagctgtaatatcat

SEQ ID NO: 540877 - DNA, 25 bp, Homo sapien
atgcattatttagtcaattgtttaa

SEQ ID NO: 540878 - DNA, 25 bp, Homo sapien
ttatctgaatattagatgctctgag

SEQ ID NO: 540879 - DNA, 25 bp, Homo sapien
gatgctctgagaaattgaatgtacc

SEQ ID NO: 540880 - DNA, 25 bp, Homo sapien
attgaatgtaccttatttaaaagat

SEQ ID NO: 540881 - DNA, 25 bp, Homo sapien
gttctttagaaggagcacacacatc

SEQ ID NO: 540882 - DNA, 25 bp, Homo sapien
agaaggagcacacacatcccttgat

SEQ ID NO: 540883 - DNA, 25 bp, Homo sapien
cttgattcctccctgatgtggtaaa

SEQ ID NO: 540884 - DNA, 25 bp, Homo sapien
tcctccctgatgtggtaaactggca

SEQ ID NO: 540885 - DNA, 25 bp, Homo sapien
ggaaataattctctcctttgttttg

SEQ ID NO: 540886 - DNA, 25 bp, Homo sapien
taattctctcctttgttttgaacct

SEQ ID NO: 540887 - DNA, 25 bp, Homo sapien
aaaccctaggaattgcttaactgca

SEQ ID NO: 540888 - DNA, 25 bp, Homo sapien
gcaacaagtaattttcattcccaca

SEQ ID NO: 540889 - DNA, 25 bp, Homo sapien
tcattcccacaaaaacctgaggcag

SEQ ID NO: 540890 - DNA, 25 bp, Homo sapien
aaacctgaggcagctcttttgccca

SEQ ID NO: 540891 - DNA, 25 bp, Homo sapien
cttttgcccagagcgttccctgtag

SEQ ID NO: 540892 - DNA, 25 bp, Homo sapien
aaatccagtttcagcagaactgact

SEQ ID NO: 540893 - DNA, 25 bp, Homo sapien
gcagaactgacttaattttgctgta

SEQ ID NO: 540894 - DNA, 25 bp, Homo sapien
cagtagatagctgagtataacccca

SEQ ID NO: 540895 - DNA, 25 bp, Homo sapien
gagtataaccccaggaatgtaactt

SEQ ID NO: 540896 - DNA, 25 bp, Homo sapien
ggaatgtaacttcccaagatcgtaa

SEQ ID NO: 540897 - DNA, 25 bp, Homo sapien
agatcgtaaaaaatgtgcacacact

SEQ ID NO: 540898 - DNA, 25 bp, Homo sapien
atgtgcacacactacagaccaggag

SEQ ID NO: 540899 - DNA, 25 bp, Homo sapien
aggagacaaaacttgccagggctct

SEQ ID NO: 540900 - DNA, 25 bp, Homo sapien
ccagggctctgctgtttaaaaagag

SEQ ID NO: 540901 - DNA, 25 bp, Homo sapien
gaaattcatccatgattctgcaata

SEQ ID NO: 540902 - DNA, 25 bp, Homo sapien
attctgcaatacagtggctgagcct

SEQ ID NO: 540903 - DNA, 25 bp, Homo sapien
aggttccaatcttcgtgttcacttt

SEQ ID NO: 540904 - DNA, 25 bp, Homo sapien
gaacactcgtgaaactgctcaggcc

SEQ ID NO: 540905 - DNA, 25 bp, Homo sapien
gctcaggccatcaagggtatgcata

SEQ ID NO: 540906 - DNA, 25 bp, Homo sapien
ggtatgcatatacgaaaagccacga

SEQ ID NO: 540907 - DNA, 25 bp, Homo sapien
aaagccacgaagtatctgaaagatg

SEQ ID NO: 540908 - DNA, 25 bp, Homo sapien
gaaacagtgtgtaccattccgacgt

SEQ ID NO: 540909 - DNA, 25 bp, Homo sapien
cattccgacgttacaatggtggagt

SEQ ID NO: 540910 - DNA, 25 bp, Homo sapien
ctggacacaaggtcggtggcccaaa

SEQ ID NO: 540911 - DNA, 25 bp, Homo sapien
ggtggcccaaaaagagtgctgaatt

SEQ ID NO: 540912 - DNA, 25 bp, Homo sapien
gctgaatttttgctgcacatgctta

SEQ ID NO: 540913 - DNA, 25 bp, Homo sapien
tttgctgcacatgcttaaaaacgca

SEQ ID NO: 540914 - DNA, 25 bp, Homo sapien
gaagtgaagtgatggactccgattt

SEQ ID NO: 540915 - DNA, 25 bp, Homo sapien
gtgatggactccgatttggagagta

SEQ ID NO: 540916 - DNA, 25 bp, Homo sapien
tccgatttggagagtagtaagacgt

SEQ ID NO: 540917 - DNA, 25 bp, Homo sapien
tgtttaagcaccatggccttgatga

SEQ ID NO: 540918 - DNA, 25 bp, Homo sapien
tttaagcaccatggccttgatgatt

SEQ ID NO: 540919 - DNA, 25 bp, Homo sapien
gaaaagtaactggttgtcacctatg

SEQ ID NO: 540920 - DNA, 25 bp, Homo sapien
actggttgtcacctatgagaccctt

SEQ ID NO: 540921 - DNA, 25 bp, Homo sapien
ttgtcacctatgagacccttacgtg

SEQ ID NO: 540922 - DNA, 25 bp, Homo sapien
acctatgagacccttacgtgattgt

SEQ ID NO: 540923 - DNA, 25 bp, Homo sapien
gagacccttacgtgattgttagtta

SEQ ID NO: 540924 - DNA, 25 bp, Homo sapien
ttcaaagcagctgtaatttagttaa

SEQ ID NO: 540925 - DNA, 25 bp, Homo sapien
cataggactttcttattccccagtt

SEQ ID NO: 540926 - DNA, 25 bp, Homo sapien
gtatttaaagactacctacacatag

SEQ ID NO: 540927 - DNA, 25 bp, Homo sapien
aagactacctacacatagatatatg

SEQ ID NO: 540928 - DNA, 25 bp, Homo sapien
ttccaaagtcatactttctccatcc

SEQ ID NO: 540929 - DNA, 25 bp, Homo sapien
tccatccccacattagccaagtgaa

SEQ ID NO: 540930 - DNA, 25 bp, Homo sapien
tagccaagtgaatacagggccaaat

SEQ ID NO: 540931 - DNA, 25 bp, Homo sapien
acagggccaaatgggttcttggaat

SEQ ID NO: 540932 - DNA, 25 bp, Homo sapien
caaagcattacaaagtgggtcccct

SEQ ID NO: 540933 - DNA, 25 bp, Homo sapien
agcattacaaagtgggtccccttgg

SEQ ID NO: 540934 - DNA, 25 bp, Homo sapien
tgggtccccttggttccagccttgt

SEQ ID NO: 540935 - DNA, 25 bp, Homo sapien
gccttgtccagagtttttggttata

SEQ ID NO: 540936 - DNA, 25 bp, Homo sapien
ataacttagccctagaagcccattc

SEQ ID NO: 540937 - DNA, 25 bp, Homo sapien
tagaagcccattcacttgtaagcaa

SEQ ID NO: 540938 - DNA, 25 bp, Homo sapien
ggtgattgttagtttgagccagtct

SEQ ID NO: 540939 - DNA, 25 bp, Homo sapien
gagccagtctactcactttgtaagc

SEQ ID NO: 540940 - DNA, 25 bp, Homo sapien
actcactttgtaagccctttgtact

SEQ ID NO: 540941 - DNA, 25 bp, Homo sapien
gtaagccctttgtactcctgttgta

SEQ ID NO: 540942 - DNA, 25 bp, Homo sapien
tactcctgttgtacaagggccatcc

SEQ ID NO: 540943 - DNA, 25 bp, Homo sapien
agggccatccccatgataaaggttc

SEQ ID NO: 540944 - DNA, 25 bp, Homo sapien
aaggttccattctgttatttgagca

SEQ ID NO: 540945 - DNA, 25 bp, Homo sapien
aaaatgatggcactacccagagatg

SEQ ID NO: 540946 - DNA, 25 bp, Homo sapien
gattatcctagtttatgaatttcca

SEQ ID NO: 540947 - DNA, 25 bp, Homo sapien
ggaaaccctgttgcaggatttggga

SEQ ID NO: 540948 - DNA, 25 bp, Homo sapien
gatttgggaactttcatgcttcaga

SEQ ID NO: 540949 - DNA, 25 bp, Homo sapien
gaaattcaggcatgtgagcatcact

SEQ ID NO: 540950 - DNA, 25 bp, Homo sapien
aggcatgtgagcatcactgcagaat

SEQ ID NO: 540951 - DNA, 25 bp, Homo sapien
gaatgtggtgcatcattgccatcat

SEQ ID NO: 540952 - DNA, 25 bp, Homo sapien
gtgcatcattgccatcatgagtaat

SEQ ID NO: 540953 - DNA, 25 bp, Homo sapien
atgagtaatcacttgctgctcctac

SEQ ID NO: 540954 - DNA, 25 bp, Homo sapien
tgctcctacttctgagaccaagact

SEQ ID NO: 540955 - DNA, 25 bp, Homo sapien
gagaccaagactcttttgtcatatt

SEQ ID NO: 540956 - DNA, 25 bp, Homo sapien
catattctttagcaataggacgggt

SEQ ID NO: 540957 - DNA, 25 bp, Homo sapien
gattccaacatatctgaatgtgcag

SEQ ID NO: 540958 - DNA, 25 bp, Homo sapien
attttcctccctcctgtttcaggtg

SEQ ID NO: 540959 - DNA, 25 bp, Homo sapien
tcctgtttcaggtgggtcacattct

SEQ ID NO: 540960 - DNA, 25 bp, Homo sapien
ttcaggtgggtcacattctgatgaa

SEQ ID NO: 540961 - DNA, 25 bp, Homo sapien
attctgatgaatgtttcccttgtac

SEQ ID NO: 540962 - DNA, 25 bp, Homo sapien
tgaatgtttcccttgtacagatccc

SEQ ID NO: 540963 - DNA, 25 bp, Homo sapien
aatgtttcccttgtacagatcccag

SEQ ID NO: 540964 - DNA, 25 bp, Homo sapien
tttcccttgtacagatcccagctta

SEQ ID NO: 540965 - DNA, 25 bp, Homo sapien
gtacagatcccagcttatggccttg

SEQ ID NO: 540966 - DNA, 25 bp, Homo sapien
agcttatggccttgacccagccgtc

SEQ ID NO: 540967 - DNA, 25 bp, Homo sapien
agccgtcctcacagatgccgggtga

SEQ ID NO: 540968 - DNA, 25 bp, Homo sapien
agatgccgggtgaccctctagctct

SEQ ID NO: 540969 - DNA, 25 bp, Homo sapien
aagaaagctcatcacagctcacgta

SEQ ID NO: 540970 - DNA, 25 bp, Homo sapien
gtagaacctctgctagccagacaac

SEQ ID NO: 540971 - DNA, 25 bp, Homo sapien
gaacctctgctagccagacaactat

SEQ ID NO: 540972 - DNA, 25 bp, Homo sapien
tctgctagccagacaactatattat

SEQ ID NO: 540973 - DNA, 25 bp, Homo sapien
agacaactatattattttgctcaac

SEQ ID NO: 540974 - DNA, 25 bp, Homo sapien
caaaacagtggacatttcctgaggg

SEQ ID NO: 540975 - DNA, 25 bp, Homo sapien
gggctacgatttaccagaacacatc

SEQ ID NO: 540976 - DNA, 25 bp, Homo sapien
taccagaacacatcagcaatccaga

SEQ ID NO: 540977 - DNA, 25 bp, Homo sapien
tcagcaatccagaagattaccacag

SEQ ID NO: 540978 - DNA, 25 bp, Homo sapien
aagattaccacagatctatccgcca

SEQ ID NO: 540979 - DNA, 25 bp, Homo sapien
attaccacagatctatccgccattc

SEQ ID NO: 540980 - DNA, 25 bp, Homo sapien
aatgcatttttcaaccgaaagggca

SEQ ID NO: 540981 - DNA, 25 bp, Homo sapien
ttttcaaccgaaagggcagatccaa

SEQ ID NO: 540982 - DNA, 25 bp, Homo sapien
ggcagatccaatagaagacccgctc

SEQ ID NO: 540983 - DNA, 25 bp, Homo sapien
gaagacccgctccttaaataaacat

SEQ ID NO: 540984 - DNA, 25 bp, Homo sapien
tccatctggaaactgaacttttgtc

SEQ ID NO: 540985 - DNA, 25 bp, Homo sapien
gaaactgaacttttgtccttgaact

SEQ ID NO: 540986 - DNA, 25 bp, Homo sapien
tgaacttttgtccttgaacttgtgt

SEQ ID NO: 540987 - DNA, 25 bp, Homo sapien
gtccttgaacttgtgttggcaccaa

SEQ ID NO: 540988 - DNA, 25 bp, Homo sapien
acttgtgttggcaccaagcctcata

SEQ ID NO: 540989 - DNA, 25 bp, Homo sapien
tggcaccaagcctcatacacagtga

SEQ ID NO: 540990 - DNA, 25 bp, Homo sapien
ctcaataactgttgggacaaaggaa

SEQ ID NO: 540991 - DNA, 25 bp, Homo sapien
gtaccagttatattcctaggacctt

SEQ ID NO: 540992 - DNA, 25 bp, Homo sapien
aggaccttagagagcagtagtgtga

SEQ ID NO: 540993 - DNA, 25 bp, Homo sapien
tgcctttctatttgggttaaactat

SEQ ID NO: 540994 - DNA, 25 bp, Homo sapien
atgaagtcaagtgttctgcctggtg

SEQ ID NO: 540995 - DNA, 25 bp, Homo sapien
tgggaagtggccacacgctgcactg

SEQ ID NO: 540996 - DNA, 25 bp, Homo sapien
gctgctcttgtttactctgttcttt

SEQ ID NO: 540997 - DNA, 25 bp, Homo sapien
tgttctttcagagcctttgtacttt

SEQ ID NO: 540998 - DNA, 25 bp, Homo sapien
agagcctttgtactttgccatcact

SEQ ID NO: 540999 - DNA, 25 bp, Homo sapien
gtactttgccatcactgctagtaat

SEQ ID NO: 541000 - DNA, 25 bp, Homo sapien
gctagtaatttcttggtccttttca

SEQ ID NO: 541001 - DNA, 25 bp, Homo sapien
cttggtccttttcaatactccattt

SEQ ID NO: 541002 - DNA, 25 bp, Homo sapien
ggtttgcccactgagctcaagagaa

SEQ ID NO: 541003 - DNA, 25 bp, Homo sapien
acagttggacagtggtcacagacca

SEQ ID NO: 541004 - DNA, 25 bp, Homo sapien
tcacagaccaagcaaagagacgcaa

SEQ ID NO: 541005 - DNA, 25 bp, Homo sapien
agacgcaatcagcagctggtctcac

SEQ ID NO: 541006 - DNA, 25 bp, Homo sapien
tcctctgaacagtgaccaaaccttt

SEQ ID NO: 541007 - DNA, 25 bp, Homo sapien
tgaccaaacctttcacctgatgagc

SEQ ID NO: 541008 - DNA, 25 bp, Homo sapien
tgatgatcttgaccgacccagtgag

SEQ ID NO: 541009 - DNA, 25 bp, Homo sapien
gaccgacccagtgaggaagttttct

SEQ ID NO: 541010 - DNA, 25 bp, Homo sapien
ggaagttttctctagagatctttca

SEQ ID NO: 541011 - DNA, 25 bp, Homo sapien
tagagatctttcagattttccatct

SEQ ID NO: 541012 - DNA, 25 bp, Homo sapien
atgaattaagccttggtttgcccac

SEQ ID NO: 541013 - DNA, 25 bp, Homo sapien
attccaagatggtctttgaaacagg

SEQ ID NO: 541014 - DNA, 25 bp, Homo sapien
acaggacagtttgacgatgctgaag

SEQ ID NO: 541015 - DNA, 25 bp, Homo sapien
tgtggagctttctgccttgtaggtg

SEQ ID NO: 541016 - DNA, 25 bp, Homo sapien
tgggcgggcctccacgtcaagatct

SEQ ID NO: 541017 - DNA, 25 bp, Homo sapien
tccacgtcaagatctcttttcctgt

SEQ ID NO: 541018 - DNA, 25 bp, Homo sapien
ctcttttcctgtcttggaggtgaaa

SEQ ID NO: 541019 - DNA, 25 bp, Homo sapien
aaaatgtttgcagtgacccctagtc

SEQ ID NO: 541020 - DNA, 25 bp, Homo sapien
cacagaccagtgttccttattgaca

SEQ ID NO: 541021 - DNA, 25 bp, Homo sapien
acagtgttcaataaggccccgtcat

SEQ ID NO: 541022 - DNA, 25 bp, Homo sapien
attctcgccagtctgttgttgttct

SEQ ID NO: 541023 - DNA, 25 bp, Homo sapien
cttaatgggctcctccttgaaatgt

SEQ ID NO: 541024 - DNA, 25 bp, Homo sapien
gctagaattacttccacatatttat

SEQ ID NO: 541025 - DNA, 25 bp, Homo sapien
ttacttccacatatttatccctttt

SEQ ID NO: 541026 - DNA, 25 bp, Homo sapien
ggtattttacaatatttcaacagca

SEQ ID NO: 541027 - DNA, 25 bp, Homo sapien
gaccttctgctcttcgagtagtttg

SEQ ID NO: 541028 - DNA, 25 bp, Homo sapien
gctcttcgagtagtttgatttggtt

SEQ ID NO: 541029 - DNA, 25 bp, Homo sapien
ggtttagtaaccagattgcattatg

SEQ ID NO: 541030 - DNA, 25 bp, Homo sapien
gtaattgtttctgcaaaatacctag

SEQ ID NO: 541031 - DNA, 25 bp, Homo sapien
atcagcagatatgggccatctgttt

SEQ ID NO: 541032 - DNA, 25 bp, Homo sapien
gcagatatgggccatctgtttttaa

SEQ ID NO: 541033 - DNA, 25 bp, Homo sapien
aagtatgttgtattcagtttataaa

SEQ ID NO: 541034 - DNA, 25 bp, Homo sapien
gattgttattctacacataattatg

SEQ ID NO: 541035 - DNA, 25 bp, Homo sapien
ggagctgagaccatttcaaagaaaa

SEQ ID NO: 541036 - DNA, 25 bp, Homo sapien
gtatgacttagatgggtccaggcaa

SEQ ID NO: 541037 - DNA, 25 bp, Homo sapien
gacttagatgggtccaggcaaataa

SEQ ID NO: 541038 - DNA, 25 bp, Homo sapien
gtgaaggcaacatgtatcgtctggc

SEQ ID NO: 541039 - DNA, 25 bp, Homo sapien
aaggcaacatgtatcgtctggcaga

SEQ ID NO: 541040 - DNA, 25 bp, Homo sapien
gcaacatgtatcgtctggcagaact

SEQ ID NO: 541041 - DNA, 25 bp, Homo sapien
atcgtctggcagaactaaatcttgg

SEQ ID NO: 541042 - DNA, 25 bp, Homo sapien
ctggcagaactaaatcttggagtgg

SEQ ID NO: 541043 - DNA, 25 bp, Homo sapien
gatgggtgcgctaaagtcgcagaaa

SEQ ID NO: 541044 - DNA, 25 bp, Homo sapien
cgctaaagtcgcagaaatcactaaa

SEQ ID NO: 541045 - DNA, 25 bp, Homo sapien
agaaatcactaaagaactcatccat

SEQ ID NO: 541046 - DNA, 25 bp, Homo sapien
acagacagcaccctgcttgtgactt

SEQ ID NO: 541047 - DNA, 25 bp, Homo sapien
agcaccctgcttgtgacttcactgg

SEQ ID NO: 541048 - DNA, 25 bp, Homo sapien
ttgtgacttcactggcccaactcat

SEQ ID NO: 541049 - DNA, 25 bp, Homo sapien
tggaccccttgagcaagaccatggc

SEQ ID NO: 541050 - DNA, 25 bp, Homo sapien
gcaagaccatggctggattccagga

SEQ ID NO: 541051 - DNA, 25 bp, Homo sapien
ccatggctggattccaggaactggt

SEQ ID NO: 541052 - DNA, 25 bp, Homo sapien
agtggatccaggaaaatgccgtgtg

SEQ ID NO: 541053 - DNA, 25 bp, Homo sapien
tgaagggaggactcagatgcactcc

SEQ ID NO: 541054 - DNA, 25 bp, Homo sapien
tgtggtctgggctcaaccagccaaa

SEQ ID NO: 541055 - DNA, 25 bp, Homo sapien
tgggctcaaccagccaaaagagcaa

SEQ ID NO: 541056 - DNA, 25 bp, Homo sapien
aatcccttggccatctgtggagccc

SEQ ID NO: 541057 - DNA, 25 bp, Homo sapien
tggcatgcggcgaaaagttcctgga

SEQ ID NO: 541058 - DNA, 25 bp, Homo sapien
gacaaaatattgaccatcgaagtga

SEQ ID NO: 541059 - DNA, 25 bp, Homo sapien
ggaaggagaccagacctccaacaac

SEQ ID NO: 541060 - DNA, 25 bp, Homo sapien
ctccaacaacattccagctgatatc

SEQ ID NO: 541061 - DNA, 25 bp, Homo sapien
cagctgatatcgtctttgttttaaa

SEQ ID NO: 541062 - DNA, 25 bp, Homo sapien
gacaagccccacaatatctttaaga

SEQ ID NO: 541063 - DNA, 25 bp, Homo sapien
ggctctgatgtcatttatcctgcca

SEQ ID NO: 541064 - DNA, 25 bp, Homo sapien
gcacagtgaacgtccccactctgga

SEQ ID NO: 541065 - DNA, 25 bp, Homo sapien
actctggacggcaggacgatacccg

SEQ ID NO: 541066 - DNA, 25 bp, Homo sapien
ggacgatacccgtcgtattcaaaga

SEQ ID NO: 541067 - DNA, 25 bp, Homo sapien
aagatgttatcaggcctggcatgcg

SEQ ID NO: 541068 - DNA, 25 bp, Homo sapien
gcaggcgagagctacttccagagcc

SEQ ID NO: 541069 - DNA, 25 bp, Homo sapien
ttccagagccttccagtgcatggga

SEQ ID NO: 541070 - DNA, 25 bp, Homo sapien
ctaggtgtagcggtgtctcctcttt

SEQ ID NO: 541071 - DNA, 25 bp, Homo sapien
agcggtgtctcctctttgaaattaa

SEQ ID NO: 541072 - DNA, 25 bp, Homo sapien
agaactatctttcttgtagcaaagc

SEQ ID NO: 541073 - DNA, 25 bp, Homo sapien
tatctttcttgtagcaaagctgcac

SEQ ID NO: 541074 - DNA, 25 bp, Homo sapien
gcctctcctctctgtgttgtctggg

SEQ ID NO: 541075 - DNA, 25 bp, Homo sapien
gttgtctgggcccttgtttacaagc

SEQ ID NO: 541076 - DNA, 25 bp, Homo sapien
tgggcccttgtttacaagcacgcgt

SEQ ID NO: 541077 - DNA, 25 bp, Homo sapien
gggagccatgctctagcccctggag

SEQ ID NO: 541078 - DNA, 25 bp, Homo sapien
cccctcagttcgtgctgcaataaag

SEQ ID NO: 541079 - DNA, 25 bp, Homo sapien
gcaaactttacgttctcgaggttcg

SEQ ID NO: 541080 - DNA, 25 bp, Homo sapien
tcgaggttcgatgtcttggctacaa

SEQ ID NO: 541081 - DNA, 25 bp, Homo sapien
tggcaatttgttcagcacttggctc

SEQ ID NO: 541082 - DNA, 25 bp, Homo sapien
tcagcacttggctcaacaacttcat

SEQ ID NO: 541083 - DNA, 25 bp, Homo sapien
aaactcctgggtattgagcctgaac

SEQ ID NO: 541084 - DNA, 25 bp, Homo sapien
tgaagatcaatttcacctgcacctc

SEQ ID NO: 541085 - DNA, 25 bp, Homo sapien
cctccgcctatgcttagaatcttaa

SEQ ID NO: 541086 - DNA, 25 bp, Homo sapien
ttgtgtctccaatccttcctattat

SEQ ID NO: 541087 - DNA, 25 bp, Homo sapien
tgcctggcagcttcttgtccatgaa

SEQ ID NO: 541088 - DNA, 25 bp, Homo sapien
gtccatgaattcctgcatgcactgg

SEQ ID NO: 541089 - DNA, 25 bp, Homo sapien
tgcatgcactggtgttccgtggaat

SEQ ID NO: 541090 - DNA, 25 bp, Homo sapien
ccgtggtccatttgggtgacaacca

SEQ ID NO: 541091 - DNA, 25 bp, Homo sapien
atttgggtgacaaccagtgacttgg

SEQ ID NO: 541092 - DNA, 25 bp, Homo sapien
tgggaagcacatagatacatcttac

SEQ ID NO: 541093 - DNA, 25 bp, Homo sapien
tgagaataccagttcaggtgcagct

SEQ ID NO: 541094 - DNA, 25 bp, Homo sapien
gttcaggtgcagctcttaaacacat

SEQ ID NO: 541095 - DNA, 25 bp, Homo sapien
cagctcttaaacacattgccttatg

SEQ ID NO: 541096 - DNA, 25 bp, Homo sapien
aacacattgccttatgactattaga

SEQ ID NO: 541097 - DNA, 25 bp, Homo sapien
gactattagaatatgcctctctttt

SEQ ID NO: 541098 - DNA, 25 bp, Homo sapien
gaatatgcctctcttttcataaata

SEQ ID NO: 541099 - DNA, 25 bp, Homo sapien
aggagtgggttcatacacggagaat

SEQ ID NO: 541100 - DNA, 25 bp, Homo sapien
aaacatgcattaaccaatattcaga

SEQ ID NO: 541101 - DNA, 25 bp, Homo sapien
ggaaaagcagctccagttggttttt

SEQ ID NO: 541102 - DNA, 25 bp, Homo sapien
ggtttttcaactgtcaaacttgaat

SEQ ID NO: 541103 - DNA, 25 bp, Homo sapien
acttgaatgtgtaagtccccacaga

SEQ ID NO: 541104 - DNA, 25 bp, Homo sapien
tccccacagagcatggacagtcggt

SEQ ID NO: 541105 - DNA, 25 bp, Homo sapien
cagtcggtgcagagttccaaggaaa

SEQ ID NO: 541106 - DNA, 25 bp, Homo sapien
aattattgcctgatgaccacttcca

SEQ ID NO: 541107 - DNA, 25 bp, Homo sapien
cctgatgaccacttccattttgtat

SEQ ID NO: 541108 - DNA, 25 bp, Homo sapien
tacactctttggttcgtataggcca

SEQ ID NO: 541109 - DNA, 25 bp, Homo sapien
gttcgtataggccatattccaactg

SEQ ID NO: 541110 - DNA, 25 bp, Homo sapien
ggccatattccaactggctttttag

SEQ ID NO: 541111 - DNA, 25 bp, Homo sapien
tgaggttctaacctagtgtgttaat

SEQ ID NO: 541112 - DNA, 25 bp, Homo sapien
gtgtgtgtgtcttgtgcttcctcag

SEQ ID NO: 541113 - DNA, 25 bp, Homo sapien
gtgtgtgtcttgtgcttcctcagac

SEQ ID NO: 541114 - DNA, 25 bp, Homo sapien
tgtgtcttgtgcttcctcagacctt

SEQ ID NO: 541115 - DNA, 25 bp, Homo sapien
gtcttgtgcttcctcagacctttct

SEQ ID NO: 541116 - DNA, 25 bp, Homo sapien
agacctttctcgcttctgagcttgg

SEQ ID NO: 541117 - DNA, 25 bp, Homo sapien
acctttctcgcttctgagcttggtg

SEQ ID NO: 541118 - DNA, 25 bp, Homo sapien
tttctcgcttctgagcttggtggcc

SEQ ID NO: 541119 - DNA, 25 bp, Homo sapien
tcgcttctgagcttggtggcctgtt

SEQ ID NO: 541120 - DNA, 25 bp, Homo sapien
ttctgagcttggtggcctgttccct

SEQ ID NO: 541121 - DNA, 25 bp, Homo sapien
gagcttggtggcctgttccctccat

SEQ ID NO: 541122 - DNA, 25 bp, Homo sapien
ttggtggcctgttccctccatctct

SEQ ID NO: 541123 - DNA, 25 bp, Homo sapien
gacttccatgagacaaacacctact

SEQ ID NO: 541124 - DNA, 25 bp, Homo sapien
gagacaaacacctacttggaaatca

SEQ ID NO: 541125 - DNA, 25 bp, Homo sapien
taccttttgaaggagcaggaatttc

SEQ ID NO: 541126 - DNA, 25 bp, Homo sapien
attcgctgcatcctttccagcaaga

SEQ ID NO: 541127 - DNA, 25 bp, Homo sapien
ccagcaagatgtaattctgagattt

SEQ ID NO: 541128 - DNA, 25 bp, Homo sapien
agatttttgtcattcctgggcgtta

SEQ ID NO: 541129 - DNA, 25 bp, Homo sapien
ttcctgggcgttatgaggactgcca

SEQ ID NO: 541130 - DNA, 25 bp, Homo sapien
tgaggactgccaagggacacaattc

SEQ ID NO: 541131 - DNA, 25 bp, Homo sapien
agatagaacatgtcgacccctttta

SEQ ID NO: 541132 - DNA, 25 bp, Homo sapien
ttagccatccccagtgcaggacatg

SEQ ID NO: 541133 - DNA, 25 bp, Homo sapien
gtgcaggacatgctattgacttcca

SEQ ID NO: 541134 - DNA, 25 bp, Homo sapien
ctgtcaaccagtgcccaggagtata

SEQ ID NO: 541135 - DNA, 25 bp, Homo sapien
agggcagagtctaaggccccagctt

SEQ ID NO: 541136 - DNA, 25 bp, Homo sapien
ggagttcaacaatggcctgcggtcc

SEQ ID NO: 541137 - DNA, 25 bp, Homo sapien
accagttcacattccgtgcttcttg

SEQ ID NO: 541138 - DNA, 25 bp, Homo sapien
gtgcttcttgcggatgacagccatg

SEQ ID NO: 541139 - DNA, 25 bp, Homo sapien
tgacagccatggcaagcagccgatc

SEQ ID NO: 541140 - DNA, 25 bp, Homo sapien
ttcgcgcagcttggcctcagtgaga

SEQ ID NO: 541141 - DNA, 25 bp, Homo sapien
cccagcttccacttcaggaggaaac

SEQ ID NO: 541142 - DNA, 25 bp, Homo sapien
gaggatgccaggtcaccagcaagag

SEQ ID NO: 541143 - DNA, 25 bp, Homo sapien
aagagagtccagctgccttaagcct

SEQ ID NO: 541144 - DNA, 25 bp, Homo sapien
aagcctcagtactgtcaaccagtgc

SEQ ID NO: 541145 - DNA, 25 bp, Homo sapien
catgcccggccttaaaatgccttct

SEQ ID NO: 541146 - DNA, 25 bp, Homo sapien
ggaaaaatgccaactccatccttaa

SEQ ID NO: 541147 - DNA, 25 bp, Homo sapien
aaaatgccaactccatccttaatct

SEQ ID NO: 541148 - DNA, 25 bp, Homo sapien
taatctcaaggaaatctgattgtcc

SEQ ID NO: 541149 - DNA, 25 bp, Homo sapien
atctcaaggaaatctgattgtccaa

SEQ ID NO: 541150 - DNA, 25 bp, Homo sapien
ggaaatctgattgtccaaatagatc

SEQ ID NO: 541151 - DNA, 25 bp, Homo sapien
aatctgattgtccaaatagatctgt

SEQ ID NO: 541152 - DNA, 25 bp, Homo sapien
tctgattgtccaaatagatctgtta

SEQ ID NO: 541153 - DNA, 25 bp, Homo sapien
ctgattgtccaaatagatctgttaa

SEQ ID NO: 541154 - DNA, 25 bp, Homo sapien
gattgtccaaatagatctgttaata

SEQ ID NO: 541155 - DNA, 25 bp, Homo sapien
gtccaaatagatctgttaatatgta

SEQ ID NO: 541156 - DNA, 25 bp, Homo sapien
taatctcaaggaaatctgattgtcc

SEQ ID NO: 541157 - DNA, 25 bp, Homo sapien
atctcaaggaaatctgattgtccaa

SEQ ID NO: 541158 - DNA, 25 bp, Homo sapien
ggaaatctgattgtccaaatagatc

SEQ ID NO: 541159 - DNA, 25 bp, Homo sapien
gaaatctgattgtccaaatagatct

SEQ ID NO: 541160 - DNA, 25 bp, Homo sapien
aatctgattgtccaaatagatctgt

SEQ ID NO: 541161 - DNA, 25 bp, Homo sapien
tctgattgtccaaatagatctgtta

SEQ ID NO: 541162 - DNA, 25 bp, Homo sapien
ctgattgtccaaatagatctgttaa

SEQ ID NO: 541163 - DNA, 25 bp, Homo sapien
tgattgtccaaatagatctgttaat

SEQ ID NO: 541164 - DNA, 25 bp, Homo sapien
gattgtccaaatagatctgttaata

SEQ ID NO: 541165 - DNA, 25 bp, Homo sapien
ttgtccaaatagatctgttaatatg

SEQ ID NO: 541166 - DNA, 25 bp, Homo sapien
gtccaaatagatctgttaatatgta

SEQ ID NO: 541167 - DNA, 25 bp, Homo sapien
gttcttaaaacagtggggatgccta

SEQ ID NO: 541168 - DNA, 25 bp, Homo sapien
gggatgcctatattttccttgagtt

SEQ ID NO: 541169 - DNA, 25 bp, Homo sapien
ctttggctatatatacctttctggg

SEQ ID NO: 541170 - DNA, 25 bp, Homo sapien
ttattttgattaccgagggtatttg

SEQ ID NO: 541171 - DNA, 25 bp, Homo sapien
tgagatgtgtaattcttttatggag

SEQ ID NO: 541172 - DNA, 25 bp, Homo sapien
atattgtttttctaacatggcttca

SEQ ID NO: 541173 - DNA, 25 bp, Homo sapien
tgtttttctaacatggcttcattaa

SEQ ID NO: 541174 - DNA, 25 bp, Homo sapien
ctaacatggcttcattaaacgttta

SEQ ID NO: 541175 - DNA, 25 bp, Homo sapien
aatatgtaatatttggaccagatgt

SEQ ID NO: 541176 - DNA, 25 bp, Homo sapien
atatttggaccagatgttgtgaata

SEQ ID NO: 541177 - DNA, 25 bp, Homo sapien
gtagagataaagctattttattctg

SEQ ID NO: 541178 - DNA, 25 bp, Homo sapien
ggaaaactgctgaatactctggatt

SEQ ID NO: 541179 - DNA, 25 bp, Homo sapien
tactctggattcatctatgtctaca

SEQ ID NO: 541180 - DNA, 25 bp, Homo sapien
aaaactacactgtgctaggcgcatt

SEQ ID NO: 541181 - DNA, 25 bp, Homo sapien
gctaggcgcattctaggacatgaat

SEQ ID NO: 541182 - DNA, 25 bp, Homo sapien
gacatgaatatgaccacaccctctt

SEQ ID NO: 541183 - DNA, 25 bp, Homo sapien
tttcaccgggtgtttctgtagcaag

SEQ ID NO: 541184 - DNA, 25 bp, Homo sapien
gggtgtttctgtagcaagttttcat

SEQ ID NO: 541185 - DNA, 25 bp, Homo sapien
agcaagttttcatattcttttcaaa

SEQ ID NO: 541186 - DNA, 25 bp, Homo sapien
aacaatggtttctctgcgttaatta

SEQ ID NO: 541187 - DNA, 25 bp, Homo sapien
gaaaactacccatgcatgatgtaga

SEQ ID NO: 541188 - DNA, 25 bp, Homo sapien
ccatgcatgatgtagagagctgttg

SEQ ID NO: 541189 - DNA, 25 bp, Homo sapien
gaggacttccgcatggccaccctct

SEQ ID NO: 541190 - DNA, 25 bp, Homo sapien
cccagggctgagttaaaggagaaat

SEQ ID NO: 541191 - DNA, 25 bp, Homo sapien
cttctgcaaggcccagggcttcaca

SEQ ID NO: 541192 - DNA, 25 bp, Homo sapien
ataagtgcatgacggaacaatagga

SEQ ID NO: 541193 - DNA, 25 bp, Homo sapien
aagtgcatgacggaacaataggact

SEQ ID NO: 541194 - DNA, 25 bp, Homo sapien
agtgcatgacggaacaataggactc

SEQ ID NO: 541195 - DNA, 25 bp, Homo sapien
gtgcatgacggaacaataggactcc

SEQ ID NO: 541196 - DNA, 25 bp, Homo sapien
tgcatgacggaacaataggactccc

SEQ ID NO: 541197 - DNA, 25 bp, Homo sapien
gcatgacggaacaataggactcccc

SEQ ID NO: 541198 - DNA, 25 bp, Homo sapien
catgacggaacaataggactcccca

SEQ ID NO: 541199 - DNA, 25 bp, Homo sapien
atgacggaacaataggactccccag

SEQ ID NO: 541200 - DNA, 25 bp, Homo sapien
atcccagagcacctgatccctttgg

SEQ ID NO: 541201 - DNA, 25 bp, Homo sapien
gtgtgacaagtgtgggctcctgaaa

SEQ ID NO: 541202 - DNA, 25 bp, Homo sapien
acaagtgtgggctcctgaaaggaat

SEQ ID NO: 541203 - DNA, 25 bp, Homo sapien
ggaatgttccagagaaaccagctaa

SEQ ID NO: 541204 - DNA, 25 bp, Homo sapien
ttgtgtgatgcctccttaggcacac

SEQ ID NO: 541205 - DNA, 25 bp, Homo sapien
tccttaggcacacaggcaatgtctc

SEQ ID NO: 541206 - DNA, 25 bp, Homo sapien
acaggcaatgtctcaagtactttga

SEQ ID NO: 541207 - DNA, 25 bp, Homo sapien
gcaaagctgccagtaaatgtctcag

SEQ ID NO: 541208 - DNA, 25 bp, Homo sapien
aatgtctcagcattgctgctaattt

SEQ ID NO: 541209 - DNA, 25 bp, Homo sapien
gctgctaattttggtcctgctagtt

SEQ ID NO: 541210 - DNA, 25 bp, Homo sapien
gtcctgctagtttctggattgtaca

SEQ ID NO: 541211 - DNA, 25 bp, Homo sapien
atttacttggctggtcttcgtggag

SEQ ID NO: 541212 - DNA, 25 bp, Homo sapien
acttggctggtcttcgtggaggaaa

SEQ ID NO: 541213 - DNA, 25 bp, Homo sapien
aaagagcgaaatcaccgatgaggtc

SEQ ID NO: 541214 - DNA, 25 bp, Homo sapien
cgatgaggtcaaggtgaacttaact

SEQ ID NO: 541215 - DNA, 25 bp, Homo sapien
ttaactagagatgtggatgaaacct

SEQ ID NO: 541216 - DNA, 25 bp, Homo sapien
gatgaaacctaattacagacaacgt

SEQ ID NO: 541217 - DNA, 25 bp, Homo sapien
aaatagatgctactcaattatgaac

SEQ ID NO: 541218 - DNA, 25 bp, Homo sapien
gtggcacattcattggttgtgtgac

SEQ ID NO: 541219 - DNA, 25 bp, Homo sapien
gtgtgactgtttattgggttcccat

SEQ ID NO: 541220 - DNA, 25 bp, Homo sapien
gggttcccatattttatcaaactgt

SEQ ID NO: 541221 - DNA, 25 bp, Homo sapien
ttatcaaactgttttctgtaacaca

SEQ ID NO: 541222 - DNA, 25 bp, Homo sapien
tctggtcatttgtctaaataggaat

SEQ ID NO: 541223 - DNA, 25 bp, Homo sapien
gaaaagcaacaatccaatctttttt

SEQ ID NO: 541224 - DNA, 25 bp, Homo sapien
aaaaattatgctggggtctcgacta

SEQ ID NO: 541225 - DNA, 25 bp, Homo sapien
aattggaaaattctggtgttggttg

SEQ ID NO: 541226 - DNA, 25 bp, Homo sapien
tggagttccatcttgcaagggataa

SEQ ID NO: 541227 - DNA, 25 bp, Homo sapien
caaatcctatgatctctatgcccaa

SEQ ID NO: 541228 - DNA, 25 bp, Homo sapien
cctatgatctctatgcccaatatgc

SEQ ID NO: 541229 - DNA, 25 bp, Homo sapien
aatatgctgcctcaactctgagctg

SEQ ID NO: 541230 - DNA, 25 bp, Homo sapien
actctgagctgtctgcaaggcttag

SEQ ID NO: 541231 - DNA, 25 bp, Homo sapien
ctgtctgcaaggcttagtaagtatt

SEQ ID NO: 541232 - DNA, 25 bp, Homo sapien
ttatacaataccatgttaaccacat

SEQ ID NO: 541233 - DNA, 25 bp, Homo sapien
gagggatagatctccgactggacag

SEQ ID NO: 541234 - DNA, 25 bp, Homo sapien
gatctccgactggacagaagactac

SEQ ID NO: 541235 - DNA, 25 bp, Homo sapien
gacagaagactactctgcagcccgc

SEQ ID NO: 541236 - DNA, 25 bp, Homo sapien
cctttcctagagttgggttgtcact

SEQ ID NO: 541237 - DNA, 25 bp, Homo sapien
agagttgggttgtcactgtccggca

SEQ ID NO: 541238 - DNA, 25 bp, Homo sapien
cagcaaacaccactgcctgcaggag

SEQ ID NO: 541239 - DNA, 25 bp, Homo sapien
actggttgggactcaccgaagatcc

SEQ ID NO: 541240 - DNA, 25 bp, Homo sapien
tgggactcaccgaagatcccttctt

SEQ ID NO: 541241 - DNA, 25 bp, Homo sapien
ggaacagctgctctgtgtagcccaa

SEQ ID NO: 541242 - DNA, 25 bp, Homo sapien
tgtgtagcccaactctgcagaagag

SEQ ID NO: 541243 - DNA, 25 bp, Homo sapien
gagagaagacctagacctggcaccc

SEQ ID NO: 541244 - DNA, 25 bp, Homo sapien
gctcctgcacttacttgcttatttg

SEQ ID NO: 541245 - DNA, 25 bp, Homo sapien
gcttatttgacaacgtttcagcgac

SEQ ID NO: 541246 - DNA, 25 bp, Homo sapien
actccgttggccactccgagaggtg

SEQ ID NO: 541247 - DNA, 25 bp, Homo sapien
gcaccaccaagccaagggaacctgt

SEQ ID NO: 541248 - DNA, 25 bp, Homo sapien
tccggtattcgatactgcgactttc

SEQ ID NO: 541249 - DNA, 25 bp, Homo sapien
gcgactttctgcctggagtgtatga

SEQ ID NO: 541250 - DNA, 25 bp, Homo sapien
agtgtatgactgcacatgactcggg

SEQ ID NO: 541251 - DNA, 25 bp, Homo sapien
gggtcggctgaccatgctcatctgc

SEQ ID NO: 541252 - DNA, 25 bp, Homo sapien
atgctcatctgctggtccgtgggac

SEQ ID NO: 541253 - DNA, 25 bp, Homo sapien
tccgtgggacggtgcccaagccaga

SEQ ID NO: 541254 - DNA, 25 bp, Homo sapien
gcccaagccagaggctgggttcatt

SEQ ID NO: 541255 - DNA, 25 bp, Homo sapien
ttccgcttaatttcaaagataaaat

SEQ ID NO: 541256 - DNA, 25 bp, Homo sapien
tttgggggtggaaggctcatcttaa

SEQ ID NO: 541257 - DNA, 25 bp, Homo sapien
tatttggaatagcagaaggttaagt

SEQ ID NO: 541258 - DNA, 25 bp, Homo sapien
gttaaactaaagcagtacttcagtg

SEQ ID NO: 541259 - DNA, 25 bp, Homo sapien
ctaaagcagtacttcagtgggactt

SEQ ID NO: 541260 - DNA, 25 bp, Homo sapien
gcagtacttcagtgggacttaacaa

SEQ ID NO: 541261 - DNA, 25 bp, Homo sapien
acttcagtgggacttaacaagtatt

SEQ ID NO: 541262 - DNA, 25 bp, Homo sapien
agatagggccgtgatactgtgtttt

SEQ ID NO: 541263 - DNA, 25 bp, Homo sapien
atagggccgtgatactgtgttttga

SEQ ID NO: 541264 - DNA, 25 bp, Homo sapien
gccgtgatactgtgttttgagccac

SEQ ID NO: 541265 - DNA, 25 bp, Homo sapien
tactgtgttttgagccacagaaggt

SEQ ID NO: 541266 - DNA, 25 bp, Homo sapien
cagagtgaatgtcccccatcatgtg

SEQ ID NO: 541267 - DNA, 25 bp, Homo sapien
aacagtgtgcatgggttattttgga

SEQ ID NO: 541268 - DNA, 25 bp, Homo sapien
ggttattttggagtgtaggtgactt

SEQ ID NO: 541269 - DNA, 25 bp, Homo sapien
gtaggtgacttgtttactcattgaa

SEQ ID NO: 541270 - DNA, 25 bp, Homo sapien
gacttgtttactcattgaagcagat

SEQ ID NO: 541271 - DNA, 25 bp, Homo sapien
gggtgtacctaaatatttatcatat

SEQ ID NO: 541272 - DNA, 25 bp, Homo sapien
atttatcatatccttgcccttgagt

SEQ ID NO: 541273 - DNA, 25 bp, Homo sapien
tatcatatccttgcccttgagtgct

SEQ ID NO: 541274 - DNA, 25 bp, Homo sapien
tatccttgcccttgagtgcttgtta

SEQ ID NO: 541275 - DNA, 25 bp, Homo sapien
cttgcccttgagtgcttgttagaga

SEQ ID NO: 541276 - DNA, 25 bp, Homo sapien
gcccttgagtgcttgttagagagaa

SEQ ID NO: 541277 - DNA, 25 bp, Homo sapien
tttcacagtaagtggctggcatcac

SEQ ID NO: 541278 - DNA, 25 bp, Homo sapien
ggctggcatcacatcatctttaaat

SEQ ID NO: 541279 - DNA, 25 bp, Homo sapien
atccagaccactaaattccaattca

SEQ ID NO: 541280 - DNA, 25 bp, Homo sapien
attccaattcaaccccttgaagtgc

SEQ ID NO: 541281 - DNA, 25 bp, Homo sapien
ttgaagtgcttctcccagagtttca

SEQ ID NO: 541282 - DNA, 25 bp, Homo sapien
gcttctcccagagtttcatggtaat

SEQ ID NO: 541283 - DNA, 25 bp, Homo sapien
gatacttttttttgaccccacacag

SEQ ID NO: 541284 - DNA, 25 bp, Homo sapien
agtacttatatgtttcttgacgatt

SEQ ID NO: 541285 - DNA, 25 bp, Homo sapien
ttcttgacgattatggtagggccca

SEQ ID NO: 541286 - DNA, 25 bp, Homo sapien
gtagggcccaacagtattcatccat

SEQ ID NO: 541287 - DNA, 25 bp, Homo sapien
taagacaacttcctctttatcttga

SEQ ID NO: 541288 - DNA, 25 bp, Homo sapien
taatcactttctcatttgggttctg

SEQ ID NO: 541289 - DNA, 25 bp, Homo sapien
cactttctcatttgggttctgaatt

SEQ ID NO: 541290 - DNA, 25 bp, Homo sapien
catttgggttctgaattggagactc

SEQ ID NO: 541291 - DNA, 25 bp, Homo sapien
ggttctgaattggagactcagtttt

SEQ ID NO: 541292 - DNA, 25 bp, Homo sapien
gagactcagtttttatgagacacat

SEQ ID NO: 541293 - DNA, 25 bp, Homo sapien
aatgctttctttctttgactcctct

SEQ ID NO: 541294 - DNA, 25 bp, Homo sapien
tttctttctttgactcctcttctgc

SEQ ID NO: 541295 - DNA, 25 bp, Homo sapien
ctttctttgactcctcttctgcctg

SEQ ID NO: 541296 - DNA, 25 bp, Homo sapien
aagcatcattttcttatgtgaggtg

SEQ ID NO: 541297 - DNA, 25 bp, Homo sapien
gcatcattttcttatgtgaggtggg

SEQ ID NO: 541298 - DNA, 25 bp, Homo sapien
taagcaattggctgtgatgctcaaa

SEQ ID NO: 541299 - DNA, 25 bp, Homo sapien
gcactgtatcgggttggctgaagct

SEQ ID NO: 541300 - DNA, 25 bp, Homo sapien
gtgcagggctccaggaatcccgttt

SEQ ID NO: 541301 - DNA, 25 bp, Homo sapien
tccaggaatcccgtttggctgaagg

SEQ ID NO: 541302 - DNA, 25 bp, Homo sapien
ggttcctgtagccagggatgtttat

SEQ ID NO: 541303 - DNA, 25 bp, Homo sapien
gccagggatgtttatgaggtctctc

SEQ ID NO: 541304 - DNA, 25 bp, Homo sapien
ttatgaggtctctctgatgccccag

SEQ ID NO: 541305 - DNA, 25 bp, Homo sapien
tgccccaggcgcaggacatgtgtgc

SEQ ID NO: 541306 - DNA, 25 bp, Homo sapien
gtggagaaaagcaggccctttcagt

SEQ ID NO: 541307 - DNA, 25 bp, Homo sapien
tgaggagtcctgaaccctgggtgca

SEQ ID NO: 541308 - DNA, 25 bp, Homo sapien
aaccctgggtgcagcatcctagcat

SEQ ID NO: 541309 - DNA, 25 bp, Homo sapien
atcctagcatcctgggagtcctttt

SEQ ID NO: 541310 - DNA, 25 bp, Homo sapien
ggttatcagcacttaaagcacaatt

SEQ ID NO: 541311 - DNA, 25 bp, Homo sapien
atgataatcaccttagtcccaaaga

SEQ ID NO: 541312 - DNA, 25 bp, Homo sapien
acagacacactgaatgaagtagcat

SEQ ID NO: 541313 - DNA, 25 bp, Homo sapien
gcatgatacgcatatatcctactca

SEQ ID NO: 541314 - DNA, 25 bp, Homo sapien
tcctactcagtatcattggcctttt

SEQ ID NO: 541315 - DNA, 25 bp, Homo sapien
tactcagtatcattggccttttatc

SEQ ID NO: 541316 - DNA, 25 bp, Homo sapien
gttacctttcagttacatgcctttg

SEQ ID NO: 541317 - DNA, 25 bp, Homo sapien
atgcctttgatcctaaaattctcta

SEQ ID NO: 541318 - DNA, 25 bp, Homo sapien
ttgatcctaaaattctctacttttg

SEQ ID NO: 541319 - DNA, 25 bp, Homo sapien
atcagttctttgcaatctgcctgtg

SEQ ID NO: 541320 - DNA, 25 bp, Homo sapien
atctgcctgtggttatcagcactta

SEQ ID NO: 541321 - DNA, 25 bp, Homo sapien
ttttcttagctaaatctggcaactg

SEQ ID NO: 541322 - DNA, 25 bp, Homo sapien
tgaaaacctgaaagtgtacaaagaa

SEQ ID NO: 541323 - DNA, 25 bp, Homo sapien
agcagaatctgccatatgagtaata

SEQ ID NO: 541324 - DNA, 25 bp, Homo sapien
gagtaatagaagtgagcaggcccag

SEQ ID NO: 541325 - DNA, 25 bp, Homo sapien
tagaagtgagcaggcccaggactcc

SEQ ID NO: 541326 - DNA, 25 bp, Homo sapien
caggactccctaagtcaagaaacca

SEQ ID NO: 541327 - DNA, 25 bp, Homo sapien
gtcaagaaaccaagaggcgtcatta

SEQ ID NO: 541328 - DNA, 25 bp, Homo sapien
accaagaggcgtcattacggaaaag

SEQ ID NO: 541329 - DNA, 25 bp, Homo sapien
ggcgtcattacggaaaagagtaact

SEQ ID NO: 541330 - DNA, 25 bp, Homo sapien
aaagagtaactcaccctgtgtgctc

SEQ ID NO: 541331 - DNA, 25 bp, Homo sapien
gtaactcaccctgtgtgctccttgg

SEQ ID NO: 541332 - DNA, 25 bp, Homo sapien
aggagcatgttgagcttctggtttg

SEQ ID NO: 541333 - DNA, 25 bp, Homo sapien
gaaacagcaagacccaccatttatg

SEQ ID NO: 541334 - DNA, 25 bp, Homo sapien
gacccaccatttatgacaaggacag

SEQ ID NO: 541335 - DNA, 25 bp, Homo sapien
gacagccatgaggttaatacttgga

SEQ ID NO: 541336 - DNA, 25 bp, Homo sapien
tacttggagtttaactgccttccct

SEQ ID NO: 541337 - DNA, 25 bp, Homo sapien
ttccctttgaactagttaaaatctg

SEQ ID NO: 541338 - DNA, 25 bp, Homo sapien
tataggatacacatttactcactga

SEQ ID NO: 541339 - DNA, 25 bp, Homo sapien
actgagctccagttccaatactaaa

SEQ ID NO: 541340 - DNA, 25 bp, Homo sapien
aaatgaaatgctagaactgccgttc

SEQ ID NO: 541341 - DNA, 25 bp, Homo sapien
agaactgccgttctttggatcgcca

SEQ ID NO: 541342 - DNA, 25 bp, Homo sapien
cgttctttggatcgccactctatgg

SEQ ID NO: 541343 - DNA, 25 bp, Homo sapien
gatatagaaactgcactgtaggaga

SEQ ID NO: 541344 - DNA, 25 bp, Homo sapien
aactgcactgtaggagaattggaat

SEQ ID NO: 541345 - DNA, 25 bp, Homo sapien
gaatatttaaggctggttgacattt

SEQ ID NO: 541346 - DNA, 25 bp, Homo sapien
atatcttttgtatagctctacaagg

SEQ ID NO: 541347 - DNA, 25 bp, Homo sapien
tgtatagctctacaaggcagtgttt

SEQ ID NO: 541348 - DNA, 25 bp, Homo sapien
ttatgaagatccagtacttggcagc

SEQ ID NO: 541349 - DNA, 25 bp, Homo sapien
acttggcagccatagtttagacaat

SEQ ID NO: 541350 - DNA, 25 bp, Homo sapien
gacaatattgttcagtgctgtttgc

SEQ ID NO: 541351 - DNA, 25 bp, Homo sapien
gcttgcatgttaacaacaaaacctt

SEQ ID NO: 541352 - DNA, 25 bp, Homo sapien
accttttagaggacccacaaatcat

SEQ ID NO: 541353 - DNA, 25 bp, Homo sapien
ttagaggacccacaaatcatgatat

SEQ ID NO: 541354 - DNA, 25 bp, Homo sapien
tattttccttagctttttccactca

SEQ ID NO: 541355 - DNA, 25 bp, Homo sapien
gctttttccactcaaattaagggca

SEQ ID NO: 541356 - DNA, 25 bp, Homo sapien
tccactcaaattaagggcaagcgaa

SEQ ID NO: 541357 - DNA, 25 bp, Homo sapien
tttggcattctttaagcctacagaa

SEQ ID NO: 541358 - DNA, 25 bp, Homo sapien
gcctacagaatgtgattctttcact

SEQ ID NO: 541359 - DNA, 25 bp, Homo sapien
tattacactggctcgtggacagaac

SEQ ID NO: 541360 - DNA, 25 bp, Homo sapien
tggctcgtggacagaacaatttgaa

SEQ ID NO: 541361 - DNA, 25 bp, Homo sapien
gattttgctttacttttcgaagcat

SEQ ID NO: 541362 - DNA, 25 bp, Homo sapien
gagtgttttactccaacgattgaaa

SEQ ID NO: 541363 - DNA, 25 bp, Homo sapien
actccaacgattgaaacattttcct

SEQ ID NO: 541364 - DNA, 25 bp, Homo sapien
gttagaatcacaggaggcaaaaaat

SEQ ID NO: 541365 - DNA, 25 bp, Homo sapien
gaagaagctatgaccttttgctgaa

SEQ ID NO: 541366 - DNA, 25 bp, Homo sapien
agctatgaccttttgctgaaatatc

SEQ ID NO: 541367 - DNA, 25 bp, Homo sapien
cagttactgaacaggcaggccactt

SEQ ID NO: 541368 - DNA, 25 bp, Homo sapien
tttgcctctaaattacctctgataa

SEQ ID NO: 541369 - DNA, 25 bp, Homo sapien
ctgataattctagagattttaccat

SEQ ID NO: 541370 - DNA, 25 bp, Homo sapien
gattttaccatatttctaaactttg

SEQ ID NO: 541371 - DNA, 25 bp, Homo sapien
aactctgagaagatcatatttatgt

SEQ ID NO: 541372 - DNA, 25 bp, Homo sapien
gcagaatttaaataaggctctacct

SEQ ID NO: 541373 - DNA, 25 bp, Homo sapien
aggctctacctcaaagacctttgca

SEQ ID NO: 541374 - DNA, 25 bp, Homo sapien
caaagacctttgcacagtttattgg

SEQ ID NO: 541375 - DNA, 25 bp, Homo sapien
gcacagtttattggtgtcatattat

SEQ ID NO: 541376 - DNA, 25 bp, Homo sapien
tttggttacagtttcattcttaaca

SEQ ID NO: 541377 - DNA, 25 bp, Homo sapien
gtttcattcttaacaagtctactac

SEQ ID NO: 541378 - DNA, 25 bp, Homo sapien
gtctactactgtttaatctctcagg

SEQ ID NO: 541379 - DNA, 25 bp, Homo sapien
caaaggaatgtcaagagaagggccc

SEQ ID NO: 541380 - DNA, 25 bp, Homo sapien
attctcagggatataactgctattc

SEQ ID NO: 541381 - DNA, 25 bp, Homo sapien
actgctattccagtttaataactag

SEQ ID NO: 541382 - DNA, 25 bp, Homo sapien
ctagatgaataatgtacaaccacca

SEQ ID NO: 541383 - DNA, 25 bp, Homo sapien
gtacaaccaccatcttcgtctgagc

SEQ ID NO: 541384 - DNA, 25 bp, Homo sapien
accatcttcgtctgagcttgttatt

SEQ ID NO: 541385 - DNA, 25 bp, Homo sapien
gtctgagcttgttattactttcaaa

SEQ ID NO: 541386 - DNA, 25 bp, Homo sapien
ttactttcaaacacaaagcttcatt

SEQ ID NO: 541387 - DNA, 25 bp, Homo sapien
tgcatttttccatatcatctccggt

SEQ ID NO: 541388 - DNA, 25 bp, Homo sapien
cggttcgatcgcgtccagatggaaa

SEQ ID NO: 541389 - DNA, 25 bp, Homo sapien
aagcagaggcttctaatcgtcgcat

SEQ ID NO: 541390 - DNA, 25 bp, Homo sapien
taatcgtcgcatttactggctccag

SEQ ID NO: 541391 - DNA, 25 bp, Homo sapien
tccagtgcaacacatccatctgaaa

SEQ ID NO: 541392 - DNA, 25 bp, Homo sapien
aacactcggaagtctggtgcttgga

SEQ ID NO: 541393 - DNA, 25 bp, Homo sapien
gcttggagagggtgccattgtctct

SEQ ID NO: 541394 - DNA, 25 bp, Homo sapien
ggtgccattgtctcttgtacataag

SEQ ID NO: 541395 - DNA, 25 bp, Homo sapien
gtacataaggtcatgacgtgtctat

SEQ ID NO: 541396 - DNA, 25 bp, Homo sapien
gacgtgtctatgtcaaaagttctta

SEQ ID NO: 541397 - DNA, 25 bp, Homo sapien
gaatggaacgttgtaaatgcttgtc

SEQ ID NO: 541398 - DNA, 25 bp, Homo sapien
tgtaccttaaacttccacatcactg

SEQ ID NO: 541399 - DNA, 25 bp, Homo sapien
gtcacactctcagatctgtgtcaag

SEQ ID NO: 541400 - DNA, 25 bp, Homo sapien
tgtcaagttcaatgtgagccctggc

SEQ ID NO: 541401 - DNA, 25 bp, Homo sapien
gagccctggcaaggctggcatatta

SEQ ID NO: 541402 - DNA, 25 bp, Homo sapien
ctgccttctggcttctgaaagtgag

SEQ ID NO: 541403 - DNA, 25 bp, Homo sapien
agatttgtatatgggctgcactcac

SEQ ID NO: 541404 - DNA, 25 bp, Homo sapien
tgggctgcactcacgcatatacgag

SEQ ID NO: 541405 - DNA, 25 bp, Homo sapien
acgagttggtttatctttgtgtaca

SEQ ID NO: 541406 - DNA, 25 bp, Homo sapien
gtgtacatgactataacccagtgat

SEQ ID NO: 541407 - DNA, 25 bp, Homo sapien
tgctgaggtcatgtgctggaatgct

SEQ ID NO: 541408 - DNA, 25 bp, Homo sapien
gctgtatttggaccacacatttcaa

SEQ ID NO: 541409 - DNA, 25 bp, Homo sapien
tgggcgatacttggcagtgactgtt

SEQ ID NO: 541410 - DNA, 25 bp, Homo sapien
ggcagtgactgttctaccttgaggc

SEQ ID NO: 541411 - DNA, 25 bp, Homo sapien
tgactgttctaccttgaggctttgt

SEQ ID NO: 541412 - DNA, 25 bp, Homo sapien
taagctgaattagtcatgtccattc

SEQ ID NO: 541413 - DNA, 25 bp, Homo sapien
gtcatgtccattcagacataacctg

SEQ ID NO: 541414 - DNA, 25 bp, Homo sapien
gacataacctgaactactgaaaaga

SEQ ID NO: 541415 - DNA, 25 bp, Homo sapien
agatcaatttccagaaggtttattc

SEQ ID NO: 541416 - DNA, 25 bp, Homo sapien
gtataaactacatgttagtcttcag

SEQ ID NO: 541417 - DNA, 25 bp, Homo sapien
gttagtcttcagtagagtatctttt

SEQ ID NO: 541418 - DNA, 25 bp, Homo sapien
ttttatttcggttgtttgatgtgca

SEQ ID NO: 541419 - DNA, 25 bp, Homo sapien
cggttgtttgatgtgcaatatgttt

SEQ ID NO: 541420 - DNA, 25 bp, Homo sapien
gtaagcacccttaattcaggcactg

SEQ ID NO: 541421 - DNA, 25 bp, Homo sapien
taattcaggcactgtccattagctt

SEQ ID NO: 541422 - DNA, 25 bp, Homo sapien
ctgtccattagcttcctttgcaaag

SEQ ID NO: 541423 - DNA, 25 bp, Homo sapien
gcaaaggctacttatggccggtcac

SEQ ID NO: 541424 - DNA, 25 bp, Homo sapien
ttatggccggtcacaatccagcact

SEQ ID NO: 541425 - DNA, 25 bp, Homo sapien
aatccagcactcagacagagccaag

SEQ ID NO: 541426 - DNA, 25 bp, Homo sapien
aaggcaatatcctcttgcccatggc

SEQ ID NO: 541427 - DNA, 25 bp, Homo sapien
tgatgtcagacagtggatgggctcc

SEQ ID NO: 541428 - DNA, 25 bp, Homo sapien
gatgggctccagcaacaagagacaa

SEQ ID NO: 541429 - DNA, 25 bp, Homo sapien
ataactaaaggcctttgctctcctc

SEQ ID NO: 541430 - DNA, 25 bp, Homo sapien
tgctctcctctgacattgaggcctg

SEQ ID NO: 541431 - DNA, 25 bp, Homo sapien
gttcttccaggatcttctcgttgag

SEQ ID NO: 541432 - DNA, 25 bp, Homo sapien
ggatcttctcgttgagccgagactg

SEQ ID NO: 541433 - DNA, 25 bp, Homo sapien
tccacgttgacctgtgatgaggcct

SEQ ID NO: 541434 - DNA, 25 bp, Homo sapien
tgtgatgaggccttgctggacagaa

SEQ ID NO: 541435 - DNA, 25 bp, Homo sapien
aggccttgctggacagaaaggtcat

SEQ ID NO: 541436 - DNA, 25 bp, Homo sapien
tgcatctgcgtcttatcttgcattt

SEQ ID NO: 541437 - DNA, 25 bp, Homo sapien
taaaatcttcacatgctagccaaaa

SEQ ID NO: 541438 - DNA, 25 bp, Homo sapien
taaatcttttcacgccttctgggtc

SEQ ID NO: 541439 - DNA, 25 bp, Homo sapien
ttctgggtcttccagcagattctcc

SEQ ID NO: 541440 - DNA, 25 bp, Homo sapien
tccagcagattctccagggatgccg

SEQ ID NO: 541441 - DNA, 25 bp, Homo sapien
gggatgccgcccatttggctgtgct

SEQ ID NO: 541442 - DNA, 25 bp, Homo sapien
cattgcttactgagagggtttttga

SEQ ID NO: 541443 - DNA, 25 bp, Homo sapien
gggagaactgctttctcagatacct

SEQ ID NO: 541444 - DNA, 25 bp, Homo sapien
tcagataccttaactcccgagaaga

SEQ ID NO: 541445 - DNA, 25 bp, Homo sapien
agaagagagtccttgtgcacagaac

SEQ ID NO: 541446 - DNA, 25 bp, Homo sapien
gcacagaacttgtgggagcctccat

SEQ ID NO: 541447 - DNA, 25 bp, Homo sapien
cgctgctctttacctttggatacag

SEQ ID NO: 541448 - DNA, 25 bp, Homo sapien
ggatacagtgtgcaagtttcatgac

SEQ ID NO: 541449 - DNA, 25 bp, Homo sapien
attgtcctaattctggtgcgattca

SEQ ID NO: 541450 - DNA, 25 bp, Homo sapien
gtgcgattcatggatatactggtaa

SEQ ID NO: 541451 - DNA, 25 bp, Homo sapien
ggcaaagtgaaacttatcagcgtag

SEQ ID NO: 541452 - DNA, 25 bp, Homo sapien
atcagcgtagtttctgttctttaaa

SEQ ID NO: 541453 - DNA, 25 bp, Homo sapien
tctgccctgcacagagaagtgattg

SEQ ID NO: 541454 - DNA, 25 bp, Homo sapien
tgccctgcacagagaagtgattgaa

SEQ ID NO: 541455 - DNA, 25 bp, Homo sapien
gaagccagaaaagtttaaagtccag

SEQ ID NO: 541456 - DNA, 25 bp, Homo sapien
aaagtccagtgtttgacagacatca

SEQ ID NO: 541457 - DNA, 25 bp, Homo sapien
ttccccaacacagaacccttttatg

SEQ ID NO: 541458 - DNA, 25 bp, Homo sapien
atgctgcttttggaaaccgaccagc

SEQ ID NO: 541459 - DNA, 25 bp, Homo sapien
tgcttttggaaaccgaccagctgat

SEQ ID NO: 541460 - DNA, 25 bp, Homo sapien
ggaaaccgaccagctgatgtgtatt

SEQ ID NO: 541461 - DNA, 25 bp, Homo sapien
accgaccagctgatgtgtattcata

SEQ ID NO: 541462 - DNA, 25 bp, Homo sapien
gtgtattcatacaagcaagtaggag

SEQ ID NO: 541463 - DNA, 25 bp, Homo sapien
caagcaagtaggagtgtctttgaat

SEQ ID NO: 541464 - DNA, 25 bp, Homo sapien
ggccacatgaccctctattgattag

SEQ ID NO: 541465 - DNA, 25 bp, Homo sapien
accctctattgattagccccaagta

SEQ ID NO: 541466 - DNA, 25 bp, Homo sapien
ttagccccaagtagaaagtcctgtg

SEQ ID NO: 541467 - DNA, 25 bp, Homo sapien
gtagaaagtcctgtggttttatgtt

SEQ ID NO: 541468 - DNA, 25 bp, Homo sapien
ggcataattttctatcagcttccta

SEQ ID NO: 541469 - DNA, 25 bp, Homo sapien
cagcttcctactcagtcactataaa

SEQ ID NO: 541470 - DNA, 25 bp, Homo sapien
aatgtccaaatacctaaatgtgcta

SEQ ID NO: 541471 - DNA, 25 bp, Homo sapien
actggaggtaactatttctaggtag

SEQ ID NO: 541472 - DNA, 25 bp, Homo sapien
gaaagtcatgatcagccacacaact

SEQ ID NO: 541473 - DNA, 25 bp, Homo sapien
gccacacaactgttttgtacatact

SEQ ID NO: 541474 - DNA, 25 bp, Homo sapien
atacttattttctcatgcacttttc

SEQ ID NO: 541475 - DNA, 25 bp, Homo sapien
tatccatttgattagctgctcttaa

SEQ ID NO: 541476 - DNA, 25 bp, Homo sapien
tttagtttagttccaacgccatctg

SEQ ID NO: 541477 - DNA, 25 bp, Homo sapien
gttccaacgccatctgttccagagg

SEQ ID NO: 541478 - DNA, 25 bp, Homo sapien
gggatctttgaaaccagctgctttt

SEQ ID NO: 541479 - DNA, 25 bp, Homo sapien
caaaaagaccagcaaaacctccaag

SEQ ID NO: 541480 - DNA, 25 bp, Homo sapien
aatggtatcatgtttattgcatagc

SEQ ID NO: 541481 - DNA, 25 bp, Homo sapien
gtggcttttgctaaaggctgaattt

SEQ ID NO: 541482 - DNA, 25 bp, Homo sapien
ggctgaattttcttgaccagcatat

SEQ ID NO: 541483 - DNA, 25 bp, Homo sapien
gaccagcatatttccagctgcgata

SEQ ID NO: 541484 - DNA, 25 bp, Homo sapien
atagctgggcaatctatgtaagaac

SEQ ID NO: 541485 - DNA, 25 bp, Homo sapien
agttcaaaattgtatcttatccatt

SEQ ID NO: 541486 - DNA, 25 bp, Homo sapien
gaatttgaaaatccagaggttccta

SEQ ID NO: 541487 - DNA, 25 bp, Homo sapien
gaggttcctagagaggaccagcaac

SEQ ID NO: 541488 - DNA, 25 bp, Homo sapien
agcagcatcagcagcgtgatgttat

SEQ ID NO: 541489 - DNA, 25 bp, Homo sapien
gtgatgttatcgatgagcccattat

SEQ ID NO: 541490 - DNA, 25 bp, Homo sapien
ttattgaagagccaagccgcctcca

SEQ ID NO: 541491 - DNA, 25 bp, Homo sapien
tgatggaggccagcagaacaaacat

SEQ ID NO: 541492 - DNA, 25 bp, Homo sapien
catagatgagtcagctatgcctcca

SEQ ID NO: 541493 - DNA, 25 bp, Homo sapien
caccacctcagggagttaagcgaaa

SEQ ID NO: 541494 - DNA, 25 bp, Homo sapien
agagcctgtgatgcctcctcagcag

SEQ ID NO: 541495 - DNA, 25 bp, Homo sapien
gcctcctcagcaggtagagcagatg

SEQ ID NO: 541496 - DNA, 25 bp, Homo sapien
atggaaataccacctgtagagcttc

SEQ ID NO: 541497 - DNA, 25 bp, Homo sapien
aggactccaggccatcaataaagat

SEQ ID NO: 541498 - DNA, 25 bp, Homo sapien
gtccaggcagtgagcgtacttttta

SEQ ID NO: 541499 - DNA, 25 bp, Homo sapien
gagcgtactttttacaccctgtaga

SEQ ID NO: 541500 - DNA, 25 bp, Homo sapien
ctgtagaattgtgggctgtagcgtt

SEQ ID NO: 541501 - DNA, 25 bp, Homo sapien
tgtagcgttactctgattttctgtc

SEQ ID NO: 541502 - DNA, 25 bp, Homo sapien
tttaggacttgtactctgaattttc

SEQ ID NO: 541503 - DNA, 25 bp, Homo sapien
tttcaggaaccgtcaaaggagcagc

SEQ ID NO: 541504 - DNA, 25 bp, Homo sapien
ggagcagcagcaaattcacatattt

SEQ ID NO: 541505 - DNA, 25 bp, Homo sapien
tcgacttgagaaatgcttgtggtat

SEQ ID NO: 541506 - DNA, 25 bp, Homo sapien
ttgtggtatgtgttttccaaactgc

SEQ ID NO: 541507 - DNA, 25 bp, Homo sapien
accactgattgccttgttattacta

SEQ ID NO: 541508 - DNA, 25 bp, Homo sapien
gggaccaccatagagaaattcagac

SEQ ID NO: 541509 - DNA, 25 bp, Homo sapien
gaaattcagactcctaaaactaatg

SEQ ID NO: 541510 - DNA, 25 bp, Homo sapien
actaatggataacttgcaggagatt

SEQ ID NO: 541511 - DNA, 25 bp, Homo sapien
gagggtacaaagtcaccaccgaggc

SEQ ID NO: 541512 - DNA, 25 bp, Homo sapien
gtacaaagtcaccaccgaggcttag

SEQ ID NO: 541513 - DNA, 25 bp, Homo sapien
aaagtcaccaccgaggcttagcatc

SEQ ID NO: 541514 - DNA, 25 bp, Homo sapien
accaccgaggcttagcatctatttt

SEQ ID NO: 541515 - DNA, 25 bp, Homo sapien
ccgaggcttagcatctattttatac

SEQ ID NO: 541516 - DNA, 25 bp, Homo sapien
gcttagcatctattttatactcttt

SEQ ID NO: 541517 - DNA, 25 bp, Homo sapien
gcatctattttatactctttactca

SEQ ID NO: 541518 - DNA, 25 bp, Homo sapien
atactctttactcaagagggacaag

SEQ ID NO: 541519 - DNA, 25 bp, Homo sapien
tttcagcaccgatggccatgtaaat

SEQ ID NO: 541520 - DNA, 25 bp, Homo sapien
gatgattatggagccttagaggtct

SEQ ID NO: 541521 - DNA, 25 bp, Homo sapien
cttagaggtctttaatcattggttc

SEQ ID NO: 541522 - DNA, 25 bp, Homo sapien
ggctgcttttatgtagtttaggctg

SEQ ID NO: 541523 - DNA, 25 bp, Homo sapien
gctggaaatggtttcacttgctctt

SEQ ID NO: 541524 - DNA, 25 bp, Homo sapien
tgctctttgactgtcagcaagactg

SEQ ID NO: 541525 - DNA, 25 bp, Homo sapien
gcaagactgaagatggcttttcctg

SEQ ID NO: 541526 - DNA, 25 bp, Homo sapien
atggcttttcctggacagctagaaa

SEQ ID NO: 541527 - DNA, 25 bp, Homo sapien
acaaaatcttgtaggtcattgcacc

SEQ ID NO: 541528 - DNA, 25 bp, Homo sapien
ctatctcagccataggtgcagtttg

SEQ ID NO: 541529 - DNA, 25 bp, Homo sapien
ataggtgcagtttgcttctacatga

SEQ ID NO: 541530 - DNA, 25 bp, Homo sapien
taatgtgtcaactttttaatggata

SEQ ID NO: 541531 - DNA, 25 bp, Homo sapien
aatgtgtcaactttttaatggatag

SEQ ID NO: 541532 - DNA, 25 bp, Homo sapien
atgtgtcaactttttaatggataga

SEQ ID NO: 541533 - DNA, 25 bp, Homo sapien
tgtgtcaactttttaatggatagaa

SEQ ID NO: 541534 - DNA, 25 bp, Homo sapien
gtgtcaactttttaatggatagaaa

SEQ ID NO: 541535 - DNA, 25 bp, Homo sapien
taatggatagaaaatagacacgaat

SEQ ID NO: 541536 - DNA, 25 bp, Homo sapien
tggatagaaaatagacacgaatagt

SEQ ID NO: 541537 - DNA, 25 bp, Homo sapien
cacgaatagtgattatgtgttcatt

SEQ ID NO: 541538 - DNA, 25 bp, Homo sapien
tttcaattttccagaataactgaag

SEQ ID NO: 541539 - DNA, 25 bp, Homo sapien
tcaattttccagaataactgaagtg

SEQ ID NO: 541540 - DNA, 25 bp, Homo sapien
caattttccagaataactgaagtga

SEQ ID NO: 541541 - DNA, 25 bp, Homo sapien
tttgtgcatgaaatgagacttcctt

SEQ ID NO: 541542 - DNA, 25 bp, Homo sapien
tgtgttaaatttgcagcagagcttg

SEQ ID NO: 541543 - DNA, 25 bp, Homo sapien
gttaaatttgcagcagagcttgaga

SEQ ID NO: 541544 - DNA, 25 bp, Homo sapien
aaatttgcagcagagcttgagaaaa

SEQ ID NO: 541545 - DNA, 25 bp, Homo sapien
gcagcagagcttgagaaaagtacat

SEQ ID NO: 541546 - DNA, 25 bp, Homo sapien
gttctggaatttcatcattaacatt

SEQ ID NO: 541547 - DNA, 25 bp, Homo sapien
tggaatttcatcattaacattttat

SEQ ID NO: 541548 - DNA, 25 bp, Homo sapien
ttttttgcacatctgaatatcgtgg

SEQ ID NO: 541549 - DNA, 25 bp, Homo sapien
tttgcacatctgaatatcgtggaag

SEQ ID NO: 541550 - DNA, 25 bp, Homo sapien
gcacatctgaatatcgtggaagaaa

SEQ ID NO: 541551 - DNA, 25 bp, Homo sapien
ctgaatatcgtggaagaaacaataa

SEQ ID NO: 541552 - DNA, 25 bp, Homo sapien
gtaattgatcacatttagttctttt

SEQ ID NO: 541553 - DNA, 25 bp, Homo sapien
agaacctgagtgattctgtacactt

SEQ ID NO: 541554 - DNA, 25 bp, Homo sapien
gagtgattctgtacacttcttttta

SEQ ID NO: 541555 - DNA, 25 bp, Homo sapien
acacttctttttacatctaatgaac

SEQ ID NO: 541556 - DNA, 25 bp, Homo sapien
aagttctgttgatttctaccattta

SEQ ID NO: 541557 - DNA, 25 bp, Homo sapien
tagtccttaacgactaggtttcctg

SEQ ID NO: 541558 - DNA, 25 bp, Homo sapien
aacgactaggtttcctgcctccaga

SEQ ID NO: 541559 - DNA, 25 bp, Homo sapien
tgcctccagaataagctgaagtcct

SEQ ID NO: 541560 - DNA, 25 bp, Homo sapien
gctgaagtcctccaagatgtactgt

SEQ ID NO: 541561 - DNA, 25 bp, Homo sapien
gatgtactgtggttttctctaagaa

SEQ ID NO: 541562 - DNA, 25 bp, Homo sapien
ttctttccccagatatcccagaaga

SEQ ID NO: 541563 - DNA, 25 bp, Homo sapien
gatacttactttgtggttcctcctg

SEQ ID NO: 541564 - DNA, 25 bp, Homo sapien
gttagggatccttgccaactgaaac

SEQ ID NO: 541565 - DNA, 25 bp, Homo sapien
aactgaaacctccagcctgtatggg

SEQ ID NO: 541566 - DNA, 25 bp, Homo sapien
aaacctccagcctgtatgggtgtgg

SEQ ID NO: 541567 - DNA, 25 bp, Homo sapien
gatttcaccttaaataaaactagcg

SEQ ID NO: 541568 - DNA, 25 bp, Homo sapien
aaaactagcgttcattgacgtttga

SEQ ID NO: 541569 - DNA, 25 bp, Homo sapien
cattgacgtttgatggatttgcttc

SEQ ID NO: 541570 - DNA, 25 bp, Homo sapien
atggatttgcttcatcttgatgctt

SEQ ID NO: 541571 - DNA, 25 bp, Homo sapien
cttgatgcttcaaatgttattctga

SEQ ID NO: 541572 - DNA, 25 bp, Homo sapien
aaacacctaatgagggcggtgatct

SEQ ID NO: 541573 - DNA, 25 bp, Homo sapien
gggcggtgatctgtgatacttactt

SEQ ID NO: 541574 - DNA, 25 bp, Homo sapien
gactacttagaatgatcacatggtt

SEQ ID NO: 541575 - DNA, 25 bp, Homo sapien
tggagagagcatgattctgggtttt

SEQ ID NO: 541576 - DNA, 25 bp, Homo sapien
aaaagtcatggatctcaatctcagc

SEQ ID NO: 541577 - DNA, 25 bp, Homo sapien
caatctcagctcctattactaacta

SEQ ID NO: 541578 - DNA, 25 bp, Homo sapien
agtcacttcatatctttaggcctta

SEQ ID NO: 541579 - DNA, 25 bp, Homo sapien
tctttaggccttaatttcctcatct

SEQ ID NO: 541580 - DNA, 25 bp, Homo sapien
ggaaggcctgacttgttgagcttta

SEQ ID NO: 541581 - DNA, 25 bp, Homo sapien
caagtttctatagatgtggttcaga

SEQ ID NO: 541582 - DNA, 25 bp, Homo sapien
gtggttcagaattgtgacttattta

SEQ ID NO: 541583 - DNA, 25 bp, Homo sapien
ttattgtacatcaggtgtgattcac

SEQ ID NO: 541584 - DNA, 25 bp, Homo sapien
aggtgtgattcacaagtgagcttgt

SEQ ID NO: 541585 - DNA, 25 bp, Homo sapien
acaggcacctctccaatatgacagt

SEQ ID NO: 541586 - DNA, 25 bp, Homo sapien
aggcacctctccaatatgacagtat

SEQ ID NO: 541587 - DNA, 25 bp, Homo sapien
ggcacctctccaatatgacagtatt

SEQ ID NO: 541588 - DNA, 25 bp, Homo sapien
gcacctctccaatatgacagtattt

SEQ ID NO: 541589 - DNA, 25 bp, Homo sapien
acctctccaatatgacagtatttta

SEQ ID NO: 541590 - DNA, 25 bp, Homo sapien
actctcactcactccttcttttatt

SEQ ID NO: 541591 - DNA, 25 bp, Homo sapien
taataggttatctttgtttggtgat

SEQ ID NO: 541592 - DNA, 25 bp, Homo sapien
tctttgtgccaattcataagtattc

SEQ ID NO: 541593 - DNA, 25 bp, Homo sapien
tttgtgccaattcataagtattctg

SEQ ID NO: 541594 - DNA, 25 bp, Homo sapien
gtgccaattcataagtattctggtg

SEQ ID NO: 541595 - DNA, 25 bp, Homo sapien
caattcataagtattctggtgtaat

SEQ ID NO: 541596 - DNA, 25 bp, Homo sapien
tttaagtatcatattttcttttgcc

SEQ ID NO: 541597 - DNA, 25 bp, Homo sapien
tcttttgcctgtatccaactgcttc

SEQ ID NO: 541598 - DNA, 25 bp, Homo sapien
cctgtatccaactgcttctttgagt

SEQ ID NO: 541599 - DNA, 25 bp, Homo sapien
gtattttcatctagtttaatgtgag

SEQ ID NO: 541600 - DNA, 25 bp, Homo sapien
tgtgagtaatagatgctgtgctgtc

SEQ ID NO: 541601 - DNA, 25 bp, Homo sapien
tgctgtgctgtcattgaagtgttca

SEQ ID NO: 541602 - DNA, 25 bp, Homo sapien
gaagtgttcaacattttgttcattt

SEQ ID NO: 541603 - DNA, 25 bp, Homo sapien
gatacatatcttaattgatttctca

SEQ ID NO: 541604 - DNA, 25 bp, Homo sapien
caactattttataagtaactggaat

SEQ ID NO: 541605 - DNA, 25 bp, Homo sapien
ggaatttttcattagatcttataca

SEQ ID NO: 541606 - DNA, 25 bp, Homo sapien
acttttatgtgctcattttgtaatt

SEQ ID NO: 541607 - DNA, 25 bp, Homo sapien
tgcactggagtctgttgccttcact

SEQ ID NO: 541608 - DNA, 25 bp, Homo sapien
actggagtctgttgccttcactgag

SEQ ID NO: 541609 - DNA, 25 bp, Homo sapien
aagtcgggttgagtgactggtggca

SEQ ID NO: 541610 - DNA, 25 bp, Homo sapien
gaggagtcgtggaggctctttccct

SEQ ID NO: 541611 - DNA, 25 bp, Homo sapien
cttctttctcctctgagagctcgtt

SEQ ID NO: 541612 - DNA, 25 bp, Homo sapien
ttctcctctgagagctcgttcttca

SEQ ID NO: 541613 - DNA, 25 bp, Homo sapien
ctgagagctcgttcttcaggctctt

SEQ ID NO: 541614 - DNA, 25 bp, Homo sapien
ttcaggctcttccagcttgtcatgt

SEQ ID NO: 541615 - DNA, 25 bp, Homo sapien
aggctcttccagcttgtcatgtcga

SEQ ID NO: 541616 - DNA, 25 bp, Homo sapien
ttccagcttgtcatgtcgagtgcct

SEQ ID NO: 541617 - DNA, 25 bp, Homo sapien
gcttgtcatgtcgagtgcctggcca

SEQ ID NO: 541618 - DNA, 25 bp, Homo sapien
agttcgtaaatgctccacaccagaa

SEQ ID NO: 541619 - DNA, 25 bp, Homo sapien
tcgtaaatgctccacaccagaagaa

SEQ ID NO: 541620 - DNA, 25 bp, Homo sapien
gtaaatgctccacaccagaagaaat

SEQ ID NO: 541621 - DNA, 25 bp, Homo sapien
aatgctccacaccagaagaaatcaa

SEQ ID NO: 541622 - DNA, 25 bp, Homo sapien
gctccacaccagaagaaatcaagaa

SEQ ID NO: 541623 - DNA, 25 bp, Homo sapien
tcagtgcagacaaaaagtgcatcat

SEQ ID NO: 541624 - DNA, 25 bp, Homo sapien
cctttcaagcattttgtgggaatgc

SEQ ID NO: 541625 - DNA, 25 bp, Homo sapien
gcattttgtgggaatgcttcctgaa

SEQ ID NO: 541626 - DNA, 25 bp, Homo sapien
ttgtgggaatgcttcctgaaaaaga

SEQ ID NO: 541627 - DNA, 25 bp, Homo sapien
gctatgctttgtatgatgcaagctt

SEQ ID NO: 541628 - DNA, 25 bp, Homo sapien
gtatgatgcaagctttgaaacaaaa

SEQ ID NO: 541629 - DNA, 25 bp, Homo sapien
tccacggaaggctcccagaacatca

SEQ ID NO: 541630 - DNA, 25 bp, Homo sapien
gcattgcctatctggacgaagcagc

SEQ ID NO: 541631 - DNA, 25 bp, Homo sapien
tggacgaagcagctggcaacctcaa

SEQ ID NO: 541632 - DNA, 25 bp, Homo sapien
tcatccagggctccaatgacgtgga

SEQ ID NO: 541633 - DNA, 25 bp, Homo sapien
agagggcaatagcaggttcacgtac

SEQ ID NO: 541634 - DNA, 25 bp, Homo sapien
gttcacgtacactgccctgaaggat

SEQ ID NO: 541635 - DNA, 25 bp, Homo sapien
gatggctgcacgaaacataccggta

SEQ ID NO: 541636 - DNA, 25 bp, Homo sapien
ggcaagactgttatcgagtaccggt

SEQ ID NO: 541637 - DNA, 25 bp, Homo sapien
tgttatcgagtaccggtcacagaag

SEQ ID NO: 541638 - DNA, 25 bp, Homo sapien
agtaccggtcacagaagacctcacg

SEQ ID NO: 541639 - DNA, 25 bp, Homo sapien
attgacattgcacccatggacatag

SEQ ID NO: 541640 - DNA, 25 bp, Homo sapien
gcccatcatctctgcgggcagcgaa

SEQ ID NO: 541641 - DNA, 25 bp, Homo sapien
tctgcgggcagcgaactgtgtctac

SEQ ID NO: 541642 - DNA, 25 bp, Homo sapien
tgcgggcagcgaactgtgtctacag

SEQ ID NO: 541643 - DNA, 25 bp, Homo sapien
cgggcagcgaactgtgtctacagca

SEQ ID NO: 541644 - DNA, 25 bp, Homo sapien
tattccctaactctcgggacctcgt

SEQ ID NO: 541645 - DNA, 25 bp, Homo sapien
taactctcgggacctcgtttgggag

SEQ ID NO: 541646 - DNA, 25 bp, Homo sapien
tcgggacctcgtttgggagtgttct

SEQ ID NO: 541647 - DNA, 25 bp, Homo sapien
cagagctgggagtagcatggactct

SEQ ID NO: 541648 - DNA, 25 bp, Homo sapien
agtagcatggactctgggtttcata

SEQ ID NO: 541649 - DNA, 25 bp, Homo sapien
agcatggactctgggtttcatatcc

SEQ ID NO: 541650 - DNA, 25 bp, Homo sapien
gtttgagtcaaaagcctgggtgaga

SEQ ID NO: 541651 - DNA, 25 bp, Homo sapien
ggagtgacgactttggttcgagttt

SEQ ID NO: 541652 - DNA, 25 bp, Homo sapien
ctttggttcgagtttgtgatgctac

SEQ ID NO: 541653 - DNA, 25 bp, Homo sapien
ggttcgagtttgtgatgctacatat

SEQ ID NO: 541654 - DNA, 25 bp, Homo sapien
ctacatatgataaagctccagttga

SEQ ID NO: 541655 - DNA, 25 bp, Homo sapien
gaaggggagcgttcaattccaaaca

SEQ ID NO: 541656 - DNA, 25 bp, Homo sapien
agcccctgtggagatctcctatgag

SEQ ID NO: 541657 - DNA, 25 bp, Homo sapien
atctcctatgagaacatgcgttttc

SEQ ID NO: 541658 - DNA, 25 bp, Homo sapien
gaacatgcgttttctgataactcac

SEQ ID NO: 541659 - DNA, 25 bp, Homo sapien
gcgttttctgataactcacaaccct

SEQ ID NO: 541660 - DNA, 25 bp, Homo sapien
gataactcacaaccctaccaatgct

SEQ ID NO: 541661 - DNA, 25 bp, Homo sapien
aatgctactctcaacaagttcacag

SEQ ID NO: 541662 - DNA, 25 bp, Homo sapien
ttagcccaaaacagttgccaaactt

SEQ ID NO: 541663 - DNA, 25 bp, Homo sapien
aaactttgccattgtgctcctgcat

SEQ ID NO: 541664 - DNA, 25 bp, Homo sapien
attgtgctcctgcatttgtgtttga

SEQ ID NO: 541665 - DNA, 25 bp, Homo sapien
cctgcatttgtgtttgagctgctat

SEQ ID NO: 541666 - DNA, 25 bp, Homo sapien
tacactgaaagttgactaagagact

SEQ ID NO: 541667 - DNA, 25 bp, Homo sapien
acatgtgagagacatctcatctgct

SEQ ID NO: 541668 - DNA, 25 bp, Homo sapien
catctcatctgctgtattttactta

SEQ ID NO: 541669 - DNA, 25 bp, Homo sapien
tgaatattgttcactcttccgtgtc

SEQ ID NO: 541670 - DNA, 25 bp, Homo sapien
tcactcttccgtgtctgatgtcttg

SEQ ID NO: 541671 - DNA, 25 bp, Homo sapien
tgtcttgctgaatgctgtgactcat

SEQ ID NO: 541672 - DNA, 25 bp, Homo sapien
tgaatgctgtgactcatagtttact

SEQ ID NO: 541673 - DNA, 25 bp, Homo sapien
gatgttctaattctttctgctctga

SEQ ID NO: 541674 - DNA, 25 bp, Homo sapien
tgttctaattctttctgctctgaga

SEQ ID NO: 541675 - DNA, 25 bp, Homo sapien
ctaattctttctgctctgagacgaa

SEQ ID NO: 541676 - DNA, 25 bp, Homo sapien
attctttctgctctgagacgaatgc

SEQ ID NO: 541677 - DNA, 25 bp, Homo sapien
ttctgctctgagacgaatgctatgg

SEQ ID NO: 541678 - DNA, 25 bp, Homo sapien
tgctctgagacgaatgctatgggct

SEQ ID NO: 541679 - DNA, 25 bp, Homo sapien
tctgagacgaatgctatgggctgca

SEQ ID NO: 541680 - DNA, 25 bp, Homo sapien
gacgaatgctatgggctgcagatga

SEQ ID NO: 541681 - DNA, 25 bp, Homo sapien
ctgcagatgacttcttagaggattt

SEQ ID NO: 541682 - DNA, 25 bp, Homo sapien
tagaggatttgccttttgagcaaat

SEQ ID NO: 541683 - DNA, 25 bp, Homo sapien
tgccttttgagcaaatagggaatct

SEQ ID NO: 541684 - DNA, 25 bp, Homo sapien
tttgtgcatgaaatgagacttcctt

SEQ ID NO: 541685 - DNA, 25 bp, Homo sapien
tgtgttaaatttgcagcagagcttg

SEQ ID NO: 541686 - DNA, 25 bp, Homo sapien
gtgttaaatttgcagcagagcttga

SEQ ID NO: 541687 - DNA, 25 bp, Homo sapien
gttaaatttgcagcagagcttgaga

SEQ ID NO: 541688 - DNA, 25 bp, Homo sapien
taaatttgcagcagagcttgagaaa

SEQ ID NO: 541689 - DNA, 25 bp, Homo sapien
aatttgcagcagagcttgagaaaag

SEQ ID NO: 541690 - DNA, 25 bp, Homo sapien
ttgcagcagagcttgagaaaagtac

SEQ ID NO: 541691 - DNA, 25 bp, Homo sapien
gcagcagagcttgagaaaagtacat

SEQ ID NO: 541692 - DNA, 25 bp, Homo sapien
gttctggaatttcatcattaacatt

SEQ ID NO: 541693 - DNA, 25 bp, Homo sapien
tctggaatttcatcattaacatttt

SEQ ID NO: 541694 - DNA, 25 bp, Homo sapien
tggaatttcatcattaacattttat

SEQ ID NO: 541695 - DNA, 25 bp, Homo sapien
gaaggtgtctttaacctaatgcgag

SEQ ID NO: 541696 - DNA, 25 bp, Homo sapien
cctaatgcgaggaatgcatgttgtt

SEQ ID NO: 541697 - DNA, 25 bp, Homo sapien
tattgtagtgtgatgccttttccct

SEQ ID NO: 541698 - DNA, 25 bp, Homo sapien
ttgtagtgtgatgccttttccctta

SEQ ID NO: 541699 - DNA, 25 bp, Homo sapien
tcccttacacctactaactattcaa

SEQ ID NO: 541700 - DNA, 25 bp, Homo sapien
gtaacttcaaagaaacttgtttgct

SEQ ID NO: 541701 - DNA, 25 bp, Homo sapien
aacttgtttgctgtgtctattattt

SEQ ID NO: 541702 - DNA, 25 bp, Homo sapien
tgctgtgtctattattttgaacata

SEQ ID NO: 541703 - DNA, 25 bp, Homo sapien
catttcctgtgtacagagaatcaca

SEQ ID NO: 541704 - DNA, 25 bp, Homo sapien
caatgaagcaattgtgtgcaccaga

SEQ ID NO: 541705 - DNA, 25 bp, Homo sapien
gaagcaattgtgtgcaccagaaata

SEQ ID NO: 541706 - DNA, 25 bp, Homo sapien
gaggttctgttctcaatgttgctgc

SEQ ID NO: 541707 - DNA, 25 bp, Homo sapien
aatgttgctgccctgttggcatcag

SEQ ID NO: 541708 - DNA, 25 bp, Homo sapien
tgccctgttggcatcaggaacacaa

SEQ ID NO: 541709 - DNA, 25 bp, Homo sapien
ggaacacaagtaacacctcagatag

SEQ ID NO: 541710 - DNA, 25 bp, Homo sapien
gtaacacctcagatagccatggcag

SEQ ID NO: 541711 - DNA, 25 bp, Homo sapien
gatagccatggcagctcagatggca

SEQ ID NO: 541712 - DNA, 25 bp, Homo sapien
ggcagccctgcaagctaaagctttg

SEQ ID NO: 541713 - DNA, 25 bp, Homo sapien
aggaatagctgttcctagctactat

SEQ ID NO: 541714 - DNA, 25 bp, Homo sapien
tagctactataacccagccgctgtt

SEQ ID NO: 541715 - DNA, 25 bp, Homo sapien
cccagccgctgttaatccaatgaaa

SEQ ID NO: 541716 - DNA, 25 bp, Homo sapien
gcaatggatgcacaggaagctttag

SEQ ID NO: 541717 - DNA, 25 bp, Homo sapien
ttgctgcctctttaagactaggact

SEQ ID NO: 541718 - DNA, 25 bp, Homo sapien
tgcctctttaagactaggactgaga

SEQ ID NO: 541719 - DNA, 25 bp, Homo sapien
gccgtcacatggatggtggtctatt

SEQ ID NO: 541720 - DNA, 25 bp, Homo sapien
aagtttgagccccaggcttaagcct

SEQ ID NO: 541721 - DNA, 25 bp, Homo sapien
gagccccaggcttaagcctttccaa

SEQ ID NO: 541722 - DNA, 25 bp, Homo sapien
ataataacaatcatcggcggcggca

SEQ ID NO: 541723 - DNA, 25 bp, Homo sapien
aataacaatcatcggcggcggcagg

SEQ ID NO: 541724 - DNA, 25 bp, Homo sapien
atcggcggcggcaggatcggccaga

SEQ ID NO: 541725 - DNA, 25 bp, Homo sapien
ggagggaagcgctttttttgatcct

SEQ ID NO: 541726 - DNA, 25 bp, Homo sapien
atggtggtctattaacttgttcaaa

SEQ ID NO: 541727 - DNA, 25 bp, Homo sapien
tttttgatcctgattccagtttgcc

SEQ ID NO: 541728 - DNA, 25 bp, Homo sapien
gggatggctgtactcctgggcccag

SEQ ID NO: 541729 - DNA, 25 bp, Homo sapien
tcctgggcccagtgtctaagtgaaa

SEQ ID NO: 541730 - DNA, 25 bp, Homo sapien
gggcccagtgtctaagtgaaaatta

SEQ ID NO: 541731 - DNA, 25 bp, Homo sapien
tggcgagcgaggacagactggccaa

SEQ ID NO: 541732 - DNA, 25 bp, Homo sapien
actcctgaagtcctcacgagggaga

SEQ ID NO: 541733 - DNA, 25 bp, Homo sapien
tcacgagggagaagcagcctctcct

SEQ ID NO: 541734 - DNA, 25 bp, Homo sapien
tgaaggtaaaatcagctcctcagtg

SEQ ID NO: 541735 - DNA, 25 bp, Homo sapien
aatgccatgggctgggaggcgccat

SEQ ID NO: 541736 - DNA, 25 bp, Homo sapien
gaggcgccatgggtgaacagacttc

SEQ ID NO: 541737 - DNA, 25 bp, Homo sapien
atgggtgaacagacttccctacttc

SEQ ID NO: 541738 - DNA, 25 bp, Homo sapien
ggtgaacagacttccctacttcctg

SEQ ID NO: 541739 - DNA, 25 bp, Homo sapien
cgctacgacgtgagcgccctgcagt

SEQ ID NO: 541740 - DNA, 25 bp, Homo sapien
ctgcagtacaactccatgaccagct

SEQ ID NO: 541741 - DNA, 25 bp, Homo sapien
tgaccagctcgcagacctacatgaa

SEQ ID NO: 541742 - DNA, 25 bp, Homo sapien
tacagcatgtcctactcgcagcagg

SEQ ID NO: 541743 - DNA, 25 bp, Homo sapien
ggcacccctggcatggctcttggct

SEQ ID NO: 541744 - DNA, 25 bp, Homo sapien
atggctcttggctccatgggttcgg

SEQ ID NO: 541745 - DNA, 25 bp, Homo sapien
tccatgggttcggtggtcaagtccg

SEQ ID NO: 541746 - DNA, 25 bp, Homo sapien
tggtcaagtccgaggccagctccag

SEQ ID NO: 541747 - DNA, 25 bp, Homo sapien
cacatgaacggctggagcaacggca

SEQ ID NO: 541748 - DNA, 25 bp, Homo sapien
tggagcaacggcagctacagcatga

SEQ ID NO: 541749 - DNA, 25 bp, Homo sapien
gctacagcatgatgcaggaccagct

SEQ ID NO: 541750 - DNA, 25 bp, Homo sapien
attgaatctgggttcttttttgact

SEQ ID NO: 541751 - DNA, 25 bp, Homo sapien
aatcctgcatgtaatatatctgctg

SEQ ID NO: 541752 - DNA, 25 bp, Homo sapien
tatatctgctgtcatcttagttgga

SEQ ID NO: 541753 - DNA, 25 bp, Homo sapien
gctgtcatcttagttggaccaactt

SEQ ID NO: 541754 - DNA, 25 bp, Homo sapien
tagttggaccaacttcccatttatt

SEQ ID NO: 541755 - DNA, 25 bp, Homo sapien
ggaccaacttcccatttatttatct

SEQ ID NO: 541756 - DNA, 25 bp, Homo sapien
tacagttacatcttaattccatcca

SEQ ID NO: 541757 - DNA, 25 bp, Homo sapien
agttacatcttaattccatccaaag

SEQ ID NO: 541758 - DNA, 25 bp, Homo sapien
cagtttgaagacagaagtgtactct

SEQ ID NO: 541759 - DNA, 25 bp, Homo sapien
gaagtgtactctctacaatgcaatt

SEQ ID NO: 541760 - DNA, 25 bp, Homo sapien
acaatgcaatttactgtacagttag

SEQ ID NO: 541761 - DNA, 25 bp, Homo sapien
agcccacgtgctccttgggtgtcag

SEQ ID NO: 541762 - DNA, 25 bp, Homo sapien
ttgggtgtcagcttcctgtgcctct

SEQ ID NO: 541763 - DNA, 25 bp, Homo sapien
agggcagctgccttgtgttatgtct

SEQ ID NO: 541764 - DNA, 25 bp, Homo sapien
tcaaccccgggagtggtgttcccag

SEQ ID NO: 541765 - DNA, 25 bp, Homo sapien
tggtgttcccagtgtggctcccaga

SEQ ID NO: 541766 - DNA, 25 bp, Homo sapien
ggctcccagagctttgaccagattg

SEQ ID NO: 541767 - DNA, 25 bp, Homo sapien
tttgaccagattgtgatcccagctg

SEQ ID NO: 541768 - DNA, 25 bp, Homo sapien
tgttctggactgaggcctttgctgt

SEQ ID NO: 541769 - DNA, 25 bp, Homo sapien
ggcctttgctgtgaactgcagtgtt

SEQ ID NO: 541770 - DNA, 25 bp, Homo sapien
tgcagtgtttcatacgaaccatctt

SEQ ID NO: 541771 - DNA, 25 bp, Homo sapien
gaaccatctttcctagtgcatgaga

SEQ ID NO: 541772 - DNA, 25 bp, Homo sapien
cttggttgttgcagttcagacaaat

SEQ ID NO: 541773 - DNA, 25 bp, Homo sapien
gagacacatcttaaggggacccaca

SEQ ID NO: 541774 - DNA, 25 bp, Homo sapien
gacccacaagtattgccctttaaca

SEQ ID NO: 541775 - DNA, 25 bp, Homo sapien
acaagtattgccctttaacaagact

SEQ ID NO: 541776 - DNA, 25 bp, Homo sapien
aagacttcaaagttttctgctgtaa

SEQ ID NO: 541777 - DNA, 25 bp, Homo sapien
aaaactaaatgttgcgtgggtggca

SEQ ID NO: 541778 - DNA, 25 bp, Homo sapien
actaaatgttgcgtgggtggcatga

SEQ ID NO: 541779 - DNA, 25 bp, Homo sapien
aaggcttgtaaatttacccaatgca

SEQ ID NO: 541780 - DNA, 25 bp, Homo sapien
aaatttacccaatgcagtttggctt

SEQ ID NO: 541781 - DNA, 25 bp, Homo sapien
tacccaatgcagtttggctttttaa

SEQ ID NO: 541782 - DNA, 25 bp, Homo sapien
taaattattttgtgcctatttatga

SEQ ID NO: 541783 - DNA, 25 bp, Homo sapien
aagtgcatcattgtagaagaaggca

SEQ ID NO: 541784 - DNA, 25 bp, Homo sapien
agatgttggtgtaaccataactgat

SEQ ID NO: 541785 - DNA, 25 bp, Homo sapien
gatgttggtgtaaccataactgatc

SEQ ID NO: 541786 - DNA, 25 bp, Homo sapien
atgttggtgtaaccataactgatcc

SEQ ID NO: 541787 - DNA, 25 bp, Homo sapien
tgttggtgtaaccataactgatcct

SEQ ID NO: 541788 - DNA, 25 bp, Homo sapien
gttggtgtaaccataactgatcctt

SEQ ID NO: 541789 - DNA, 25 bp, Homo sapien
ttggtgtaaccataactgatccttt

SEQ ID NO: 541790 - DNA, 25 bp, Homo sapien
tggtgtaaccataactgatcctttc

SEQ ID NO: 541791 - DNA, 25 bp, Homo sapien
ggtgtaaccataactgatcctttca

SEQ ID NO: 541792 - DNA, 25 bp, Homo sapien
gtgtaaccataactgatcctttcaa

SEQ ID NO: 541793 - DNA, 25 bp, Homo sapien
gttgaagggctatagatgaatcagt

SEQ ID NO: 541794 - DNA, 25 bp, Homo sapien
gaagggctatagatgaatcagtatg

SEQ ID NO: 541795 - DNA, 25 bp, Homo sapien
gaatcagtatgtgtaaaacacttag

SEQ ID NO: 541796 - DNA, 25 bp, Homo sapien
aaacacttagaaaggggccaggcat

SEQ ID NO: 541797 - DNA, 25 bp, Homo sapien
tagtaagacgctgtctctttttaaa

SEQ ID NO: 541798 - DNA, 25 bp, Homo sapien
acacttagaaaggaacttggcaagt

SEQ ID NO: 541799 - DNA, 25 bp, Homo sapien
ggaacttggcaagtagtaagttatt

SEQ ID NO: 541800 - DNA, 25 bp, Homo sapien
gtaagttatttgtaatccaaacact

SEQ ID NO: 541801 - DNA, 25 bp, Homo sapien
caaacactttgccagactgaagcag

SEQ ID NO: 541802 - DNA, 25 bp, Homo sapien
aaacactttgccagactgaagcagg

SEQ ID NO: 541803 - DNA, 25 bp, Homo sapien
aacactttgccagactgaagcagga

SEQ ID NO: 541804 - DNA, 25 bp, Homo sapien
ggtgctcagggttcagcgggtgtgt

SEQ ID NO: 541805 - DNA, 25 bp, Homo sapien
gaggagccttgagctgccctggact

SEQ ID NO: 541806 - DNA, 25 bp, Homo sapien
ggagccttgagctgccctggactct

SEQ ID NO: 541807 - DNA, 25 bp, Homo sapien
tgccccaggatctggaagaggagtc

SEQ ID NO: 541808 - DNA, 25 bp, Homo sapien
ccccaggatctggaagaggagtcag

SEQ ID NO: 541809 - DNA, 25 bp, Homo sapien
gagtcagcagtgagggcgagggcgg

SEQ ID NO: 541810 - DNA, 25 bp, Homo sapien
gtccccagggatcagattacagccc

SEQ ID NO: 541811 - DNA, 25 bp, Homo sapien
agggatcagattacagcccctaggg

SEQ ID NO: 541812 - DNA, 25 bp, Homo sapien
tggggggtcgcattccacttccgaa

SEQ ID NO: 541813 - DNA, 25 bp, Homo sapien
acagacacacccacgccactgggca

SEQ ID NO: 541814 - DNA, 25 bp, Homo sapien
tcagggtcaccctgcactggcaagc

SEQ ID NO: 541815 - DNA, 25 bp, Homo sapien
tgatggtctcatctctgaatttata

SEQ ID NO: 541816 - DNA, 25 bp, Homo sapien
tatttctcattcttttgaacatact

SEQ ID NO: 541817 - DNA, 25 bp, Homo sapien
attcttttgaacatactatagctaa

SEQ ID NO: 541818 - DNA, 25 bp, Homo sapien
gttgctaaattgcttctatctagca

SEQ ID NO: 541819 - DNA, 25 bp, Homo sapien
aattgcttctatctagcatgttaaa

SEQ ID NO: 541820 - DNA, 25 bp, Homo sapien
gattatgttttatgatttcaggcaa

SEQ ID NO: 541821 - DNA, 25 bp, Homo sapien
gatttcaggcaagtattcattttta

SEQ ID NO: 541822 - DNA, 25 bp, Homo sapien
gtattcatttttaacttgctaccta

SEQ ID NO: 541823 - DNA, 25 bp, Homo sapien
tcatttttaacttgctacctacttt

SEQ ID NO: 541824 - DNA, 25 bp, Homo sapien
acctggataatcagtgtatgttgca

SEQ ID NO: 541825 - DNA, 25 bp, Homo sapien
atcagtgtatgttgcaccagaatca

SEQ ID NO: 541826 - DNA, 25 bp, Homo sapien
aaaacacaacaacgatacccagcac

SEQ ID NO: 541827 - DNA, 25 bp, Homo sapien
acaacaacgatacccagcacatctg

SEQ ID NO: 541828 - DNA, 25 bp, Homo sapien
agcacatctgggagtctgactccaa

SEQ ID NO: 541829 - DNA, 25 bp, Homo sapien
gagtctgactccaatgaattttctg

SEQ ID NO: 541830 - DNA, 25 bp, Homo sapien
gactccaatgaattttctgtaattg

SEQ ID NO: 541831 - DNA, 25 bp, Homo sapien
attgctgacccaagaggaaacactc

SEQ ID NO: 541832 - DNA, 25 bp, Homo sapien
ccaagaggaaacactctaggacggg

SEQ ID NO: 541833 - DNA, 25 bp, Homo sapien
gaagcatctgattaccttgaattgg

SEQ ID NO: 541834 - DNA, 25 bp, Homo sapien
ctgattaccttgaattggatacaat

SEQ ID NO: 541835 - DNA, 25 bp, Homo sapien
ggatacaattaaaaatctcgtcaaa

SEQ ID NO: 541836 - DNA, 25 bp, Homo sapien
tctcgtcaaaaaatattcacagttc

SEQ ID NO: 541837 - DNA, 25 bp, Homo sapien
agagaatcaggagcacaggcgagct

SEQ ID NO: 541838 - DNA, 25 bp, Homo sapien
gagcacaggcgagctgaagtacaca

SEQ ID NO: 541839 - DNA, 25 bp, Homo sapien
aggcgagctgaagtacacaaagttt

SEQ ID NO: 541840 - DNA, 25 bp, Homo sapien
aagtacacaaagtttcaaggccaga

SEQ ID NO: 541841 - DNA, 25 bp, Homo sapien
caaggccagaaaatgagcaactcag

SEQ ID NO: 541842 - DNA, 25 bp, Homo sapien
gagcaactcagaaatgataacaaga

SEQ ID NO: 541843 - DNA, 25 bp, Homo sapien
taacaagagacaagtagctccaggt

SEQ ID NO: 541844 - DNA, 25 bp, Homo sapien
ctgtaaatactagttctacttgctc

SEQ ID NO: 541845 - DNA, 25 bp, Homo sapien
gggagaaggagtcctgtatcaacca

SEQ ID NO: 541846 - DNA, 25 bp, Homo sapien
aggagtcctgtatcaaccaggcctt

SEQ ID NO: 541847 - DNA, 25 bp, Homo sapien
cctgtatcaaccaggcctttgccat

SEQ ID NO: 541848 - DNA, 25 bp, Homo sapien
tcgccatggagctacaccagaatca

SEQ ID NO: 541849 - DNA, 25 bp, Homo sapien
aggagcattttgtacccaaggccct

SEQ ID NO: 541850 - DNA, 25 bp, Homo sapien
aaggcccttatcactgtcctagcaa

SEQ ID NO: 541851 - DNA, 25 bp, Homo sapien
gcaagtccaaaatgccttcagtcag

SEQ ID NO: 541852 - DNA, 25 bp, Homo sapien
cttcagtcagagtaggcgtgcccaa

SEQ ID NO: 541853 - DNA, 25 bp, Homo sapien
gttatcttgggagcctggatcttgg

SEQ ID NO: 541854 - DNA, 25 bp, Homo sapien
ttggctcatggcttggtcctcgtgc

SEQ ID NO: 541855 - DNA, 25 bp, Homo sapien
aaaacctcgctggaatctggatttg

SEQ ID NO: 541856 - DNA, 25 bp, Homo sapien
tgttggctctccaccaacagatggg

SEQ ID NO: 541857 - DNA, 25 bp, Homo sapien
agcttggcttcatattcctgttcag

SEQ ID NO: 541858 - DNA, 25 bp, Homo sapien
ttcagtgttctgactcgccatggag

SEQ ID NO: 541859 - DNA, 25 bp, Homo sapien
gatgtcaacagagttacctaccagg

SEQ ID NO: 541860 - DNA, 25 bp, Homo sapien
gctgggccagctgacactagaaaac

SEQ ID NO: 541861 - DNA, 25 bp, Homo sapien
ggccagctgacactagaaaaccttc

SEQ ID NO: 541862 - DNA, 25 bp, Homo sapien
gaaaaccttcagatgctgccagaga

SEQ ID NO: 541863 - DNA, 25 bp, Homo sapien
atgaggagagctatgacacagagtc

SEQ ID NO: 541864 - DNA, 25 bp, Homo sapien
gagtcagagttcacggagttcacag

SEQ ID NO: 541865 - DNA, 25 bp, Homo sapien
gagttcacagaggacgagctgccct

SEQ ID NO: 541866 - DNA, 25 bp, Homo sapien
ggacgagctgccctatgatgactgt

SEQ ID NO: 541867 - DNA, 25 bp, Homo sapien
gctgccctatgatgactgtgtgttt

SEQ ID NO: 541868 - DNA, 25 bp, Homo sapien
atgatgactgtgtgtttggaggcca

SEQ ID NO: 541869 - DNA, 25 bp, Homo sapien
tggaggccagcgtctgacgttatga

SEQ ID NO: 541870 - DNA, 25 bp, Homo sapien
gtccaaggaaaccacagctgctgga

SEQ ID NO: 541871 - DNA, 25 bp, Homo sapien
cagctgctggagactcctaggcagg

SEQ ID NO: 541872 - DNA, 25 bp, Homo sapien
gagactcctaggcaggacatgctga

SEQ ID NO: 541873 - DNA, 25 bp, Homo sapien
ggacatgctgaagccaaagccaata

SEQ ID NO: 541874 - DNA, 25 bp, Homo sapien
gaagccaaagccaataacacacagc

SEQ ID NO: 541875 - DNA, 25 bp, Homo sapien
tcccataaccgctgattctcagggt

SEQ ID NO: 541876 - DNA, 25 bp, Homo sapien
ataaccgctgattctcagggtctct

SEQ ID NO: 541877 - DNA, 25 bp, Homo sapien
taggacgccacccagcaaaaggttg

SEQ ID NO: 541878 - DNA, 25 bp, Homo sapien
gacgccacccagcaaaaggttgttc

SEQ ID NO: 541879 - DNA, 25 bp, Homo sapien
gggcagctgatacaaattgcagact

SEQ ID NO: 541880 - DNA, 25 bp, Homo sapien
gctgatacaaattgcagactgtgta

SEQ ID NO: 541881 - DNA, 25 bp, Homo sapien
gagcctgcccacagctatgccttgg

SEQ ID NO: 541882 - DNA, 25 bp, Homo sapien
agaaacaccctgacaggctcagaga

SEQ ID NO: 541883 - DNA, 25 bp, Homo sapien
aacaccctgacaggctcagagagga

SEQ ID NO: 541884 - DNA, 25 bp, Homo sapien
ggagatggaaactgacatacccaac

SEQ ID NO: 541885 - DNA, 25 bp, Homo sapien
ggaaactgacatacccaacccactt

SEQ ID NO: 541886 - DNA, 25 bp, Homo sapien
acttcctcaaacacttcatgctgct

SEQ ID NO: 541887 - DNA, 25 bp, Homo sapien
ttcccgcagacttggcctaatgaaa

SEQ ID NO: 541888 - DNA, 25 bp, Homo sapien
cgcagacttggcctaatgaaaatac

SEQ ID NO: 541889 - DNA, 25 bp, Homo sapien
gaaaatacatacttcttcattcgga

SEQ ID NO: 541890 - DNA, 25 bp, Homo sapien
acatacttcttcattcggagagaca

SEQ ID NO: 541891 - DNA, 25 bp, Homo sapien
tcttcattcggagagacaaaacaag

SEQ ID NO: 541892 - DNA, 25 bp, Homo sapien
aatgttcctaatactgatgttcctg

SEQ ID NO: 541893 - DNA, 25 bp, Homo sapien
actgatgttcctgaatggtagataa

SEQ ID NO: 541894 - DNA, 25 bp, Homo sapien
atgtcttatcatctctttatcttct

SEQ ID NO: 541895 - DNA, 25 bp, Homo sapien
cttatcatctctttatcttctaggg

SEQ ID NO: 541896 - DNA, 25 bp, Homo sapien
tcttctagggttatgatcatagcta

SEQ ID NO: 541897 - DNA, 25 bp, Homo sapien
agctactacttcattgcaaccttta

SEQ ID NO: 541898 - DNA, 25 bp, Homo sapien
gcaacctttattactgaccacatca

SEQ ID NO: 541899 - DNA, 25 bp, Homo sapien
cagacatcatgctaaatacctgaat

SEQ ID NO: 541900 - DNA, 25 bp, Homo sapien
aaatgcaactgtattgctgagcaaa

SEQ ID NO: 541901 - DNA, 25 bp, Homo sapien
taaaagggctttattctatagttga

SEQ ID NO: 541902 - DNA, 25 bp, Homo sapien
tctatagttgaatcacctctgaata

SEQ ID NO: 541903 - DNA, 25 bp, Homo sapien
tgtcccgttcatctggtggcctgca

SEQ ID NO: 541904 - DNA, 25 bp, Homo sapien
tggcctgcagcagggtgcaaatccg

SEQ ID NO: 541905 - DNA, 25 bp, Homo sapien
tgcaaatccggcatgtagtggttgt

SEQ ID NO: 541906 - DNA, 25 bp, Homo sapien
atggttgaaatactggttgttgagc

SEQ ID NO: 541907 - DNA, 25 bp, Homo sapien
ttctgcagctgcatgctggccggca

SEQ ID NO: 541908 - DNA, 25 bp, Homo sapien
ggacccatgaactgggagttgttaa

SEQ ID NO: 541909 - DNA, 25 bp, Homo sapien
ctgggagttgttaaacctggccgcg

SEQ ID NO: 541910 - DNA, 25 bp, Homo sapien
atcgcatgcctgatgccgctcgtgg

SEQ ID NO: 541911 - DNA, 25 bp, Homo sapien
gctcgtggcattcatgttgcccgcg

SEQ ID NO: 541912 - DNA, 25 bp, Homo sapien
gttgcccgcgccgtagtgtatgtgc

SEQ ID NO: 541913 - DNA, 25 bp, Homo sapien
tagtgtatgtgctcgcccattaggg

SEQ ID NO: 541914 - DNA, 25 bp, Homo sapien
ttatccttcttcatgagcgtcttgg

SEQ ID NO: 541915 - DNA, 25 bp, Homo sapien
atgagcgtcttggttttccgccggg

SEQ ID NO: 541916 - DNA, 25 bp, Homo sapien
ggtatttataatccgggtgctcctt

SEQ ID NO: 541917 - DNA, 25 bp, Homo sapien
aatccgggtgctccttcatgtgcag

SEQ ID NO: 541918 - DNA, 25 bp, Homo sapien
atgtgcagcgctcgcagccgcttag

SEQ ID NO: 541919 - DNA, 25 bp, Homo sapien
ttagcctcgtcgatgaacggccgct

SEQ ID NO: 541920 - DNA, 25 bp, Homo sapien
gcttctccgtctccgacaaaagttt

SEQ ID NO: 541921 - DNA, 25 bp, Homo sapien
gacaaaagtttccactcggcgccca

SEQ ID NO: 541922 - DNA, 25 bp, Homo sapien
aggcgcttgctgatctccgagttgt

SEQ ID NO: 541923 - DNA, 25 bp, Homo sapien
gctgatctccgagttgtgcatcttg

SEQ ID NO: 541924 - DNA, 25 bp, Homo sapien
cgggcagcgtgtacttatccttctt

SEQ ID NO: 541925 - DNA, 25 bp, Homo sapien
caatgcattttgatactttatagtt

SEQ ID NO: 541926 - DNA, 25 bp, Homo sapien
tatgtcactctcaagaactcctata

SEQ ID NO: 541927 - DNA, 25 bp, Homo sapien
ctcaagaactcctataagaccaaga

SEQ ID NO: 541928 - DNA, 25 bp, Homo sapien
ataagaccaagagtcatctttggac

SEQ ID NO: 541929 - DNA, 25 bp, Homo sapien
gtcatctttggactgtaggatttca

SEQ ID NO: 541930 - DNA, 25 bp, Homo sapien
ataataacgctctgttatttttgac

SEQ ID NO: 541931 - DNA, 25 bp, Homo sapien
ggttttactaaacagctcatgagcc

SEQ ID NO: 541932 - DNA, 25 bp, Homo sapien
actaaacagctcatgagccctcatt

SEQ ID NO: 541933 - DNA, 25 bp, Homo sapien
agccctcattctgccagtgaggaag

SEQ ID NO: 541934 - DNA, 25 bp, Homo sapien
cattctgccagtgaggaagccttca

SEQ ID NO: 541935 - DNA, 25 bp, Homo sapien
tgccagtgaggaagccttcaacccc

SEQ ID NO: 541936 - DNA, 25 bp, Homo sapien
tgatcatagctactacttcattgca

SEQ ID NO: 541937 - DNA, 25 bp, Homo sapien
atagctactacttcattgcaacctt

SEQ ID NO: 541938 - DNA, 25 bp, Homo sapien
gctactacttcattgcaacctttat

SEQ ID NO: 541939 - DNA, 25 bp, Homo sapien
tgcaacctttattactgaccacatc

SEQ ID NO: 541940 - DNA, 25 bp, Homo sapien
gcaacctttattactgaccacatca

SEQ ID NO: 541941 - DNA, 25 bp, Homo sapien
ttattactgaccacatcagacatca

SEQ ID NO: 541942 - DNA, 25 bp, Homo sapien
cagacatcatgctaaatacctgaat

SEQ ID NO: 541943 - DNA, 25 bp, Homo sapien
gctaaatacctgaatgcatgaaaaa

SEQ ID NO: 541944 - DNA, 25 bp, Homo sapien
ctgaatgcatgaaaaaactccaaat

SEQ ID NO: 541945 - DNA, 25 bp, Homo sapien
aagagaatctcttcaggattataaa

SEQ ID NO: 541946 - DNA, 25 bp, Homo sapien
aaatgcaactgtattgctgagcaaa

SEQ ID NO: 541947 - DNA, 25 bp, Homo sapien
ggacgcatgtccacaggtcacttgg

SEQ ID NO: 541948 - DNA, 25 bp, Homo sapien
acaggtcacttggtaaattaactca

SEQ ID NO: 541949 - DNA, 25 bp, Homo sapien
aaacatgagttgatccggcaaaccc

SEQ ID NO: 541950 - DNA, 25 bp, Homo sapien
tgatccggcaaacccaggctactgg

SEQ ID NO: 541951 - DNA, 25 bp, Homo sapien
ctgccagtcgccttttgggttaaat

SEQ ID NO: 541952 - DNA, 25 bp, Homo sapien
tatttctcgagagcaagttcagtgc

SEQ ID NO: 541953 - DNA, 25 bp, Homo sapien
gtttacaaaacagagattccttcaa

SEQ ID NO: 541954 - DNA, 25 bp, Homo sapien
ttccttcaacactggacacgtcgag

SEQ ID NO: 541955 - DNA, 25 bp, Homo sapien
gacacgtcgagcattttgtagctta

SEQ ID NO: 541956 - DNA, 25 bp, Homo sapien
ttgtagcttaattaaacctcatgta

SEQ ID NO: 541957 - DNA, 25 bp, Homo sapien
gtatcacactaccttttaccttgta

SEQ ID NO: 541958 - DNA, 25 bp, Homo sapien
ttgcaagaagctgttcccgtgaaga

SEQ ID NO: 541959 - DNA, 25 bp, Homo sapien
gggtgatactgtcgcaactctttct

SEQ ID NO: 541960 - DNA, 25 bp, Homo sapien
gatactgtcgcaactctttctgaaa

SEQ ID NO: 541961 - DNA, 25 bp, Homo sapien
ataaaatatttcctgcagcccttca

SEQ ID NO: 541962 - DNA, 25 bp, Homo sapien
gaggaatgaagccttttaattcaga

SEQ ID NO: 541963 - DNA, 25 bp, Homo sapien
tgaagccttttaattcagaaatggg

SEQ ID NO: 541964 - DNA, 25 bp, Homo sapien
ggccagtttagaaagaattatttgc

SEQ ID NO: 541965 - DNA, 25 bp, Homo sapien
ctgtttgcatggtggttttttatca

SEQ ID NO: 541966 - DNA, 25 bp, Homo sapien
tggttttttatcatggacttggccc

SEQ ID NO: 541967 - DNA, 25 bp, Homo sapien
ttttatcatggacttggcccaaaag

SEQ ID NO: 541968 - DNA, 25 bp, Homo sapien
gacttggcccaaaagaaaaactgct

SEQ ID NO: 541969 - DNA, 25 bp, Homo sapien
aatcagtacaatcacacaaggagga

SEQ ID NO: 541970 - DNA, 25 bp, Homo sapien
caaggaggatgaaacgccggaacaa

SEQ ID NO: 541971 - DNA, 25 bp, Homo sapien
atgaggtgtgtagaacagggtccca

SEQ ID NO: 541972 - DNA, 25 bp, Homo sapien
tgtagaacagggtcccacaggtttg

SEQ ID NO: 541973 - DNA, 25 bp, Homo sapien
cattgagatcacttgtcttgtggtg

SEQ ID NO: 541974 - DNA, 25 bp, Homo sapien
tccagcagctggtccaacagtcgta

SEQ ID NO: 541975 - DNA, 25 bp, Homo sapien
tggtccaacagtcgtatcctggtga

SEQ ID NO: 541976 - DNA, 25 bp, Homo sapien
gtcgtatcctggtgaatgtctgttc

SEQ ID NO: 541977 - DNA, 25 bp, Homo sapien
tggtgaatgtctgttcagctcttct

SEQ ID NO: 541978 - DNA, 25 bp, Homo sapien
gttcagctcttctgtgagaatatga

SEQ ID NO: 541979 - DNA, 25 bp, Homo sapien
tataagtattggtttgggtgttcct

SEQ ID NO: 541980 - DNA, 25 bp, Homo sapien
tagagcctcaaagcttccaggccaa

SEQ ID NO: 541981 - DNA, 25 bp, Homo sapien
caggccaagacaagcatcccaaggc

SEQ ID NO: 541982 - DNA, 25 bp, Homo sapien
atcccaaggccactaacacaacgaa

SEQ ID NO: 541983 - DNA, 25 bp, Homo sapien
gtttggcctctaatcgatattctcg

SEQ ID NO: 541984 - DNA, 25 bp, Homo sapien
gatattctcgtcttcctaaaccaaa

SEQ ID NO: 541985 - DNA, 25 bp, Homo sapien
taagtacatagccatcacctgccaa

SEQ ID NO: 541986 - DNA, 25 bp, Homo sapien
atcacctgccaatttgtttcttaaa

SEQ ID NO: 541987 - DNA, 25 bp, Homo sapien
caatctcttctgtaatagctttatg

SEQ ID NO: 541988 - DNA, 25 bp, Homo sapien
ttatgtgcagcttgcagcttgctac

SEQ ID NO: 541989 - DNA, 25 bp, Homo sapien
agcttgctactgtggtggaggttcc

SEQ ID NO: 541990 - DNA, 25 bp, Homo sapien
gaggttccattgaaagcctgcaaat

SEQ ID NO: 541991 - DNA, 25 bp, Homo sapien
aatatatcaccactattgctggagt

SEQ ID NO: 541992 - DNA, 25 bp, Homo sapien
ttgctggagtcatgacactaagtca

SEQ ID NO: 541993 - DNA, 25 bp, Homo sapien
ggctttgttcgaaagaatggtgtca

SEQ ID NO: 541994 - DNA, 25 bp, Homo sapien
ggtgtcaatgaagccaaaatagatg

SEQ ID NO: 541995 - DNA, 25 bp, Homo sapien
aatgtccaagacacagcagaacaga

SEQ ID NO: 541996 - DNA, 25 bp, Homo sapien
aaagttcaactgcttcgtaattggc

SEQ ID NO: 541997 - DNA, 25 bp, Homo sapien
cgtaattggcatcaacttcatggaa

SEQ ID NO: 541998 - DNA, 25 bp, Homo sapien
agaagcgtatgacacattgattaaa

SEQ ID NO: 541999 - DNA, 25 bp, Homo sapien
aagccaatctttgtactcttgcaga

SEQ ID NO: 542000 - DNA, 25 bp, Homo sapien
aaattcagactatcatcctcaagga

SEQ ID NO: 542001 - DNA, 25 bp, Homo sapien
caaggacattactagtgactcagaa

SEQ ID NO: 542002 - DNA, 25 bp, Homo sapien
aaatatgccctttccagagctaccc

SEQ ID NO: 542003 - DNA, 25 bp, Homo sapien
agagctacccagaccatatggtgca

SEQ ID NO: 542004 - DNA, 25 bp, Homo sapien
atatggtgcacccacagatccagct

SEQ ID NO: 542005 - DNA, 25 bp, Homo sapien
tgcagctggtcctttaggtccatgg

SEQ ID NO: 542006 - DNA, 25 bp, Homo sapien
gggatccatgtcttctggaccttgg

SEQ ID NO: 542007 - DNA, 25 bp, Homo sapien
tcttctggaccttgggcgccaggaa

SEQ ID NO: 542008 - DNA, 25 bp, Homo sapien
aatgggagggcagtatcctacccct

SEQ ID NO: 542009 - DNA, 25 bp, Homo sapien
gtatcctacccctaatatgccatat

SEQ ID NO: 542010 - DNA, 25 bp, Homo sapien
aatatgccatatccatctccaggcc

SEQ ID NO: 542011 - DNA, 25 bp, Homo sapien
atatcctgcccctacaggatcgtat

SEQ ID NO: 542012 - DNA, 25 bp, Homo sapien
tacaggatcgtatcccacaccagga

SEQ ID NO: 542013 - DNA, 25 bp, Homo sapien
aattgtccctcgtattatttctcca

SEQ ID NO: 542014 - DNA, 25 bp, Homo sapien
tatttctccacgtctgttttagttt

SEQ ID NO: 542015 - DNA, 25 bp, Homo sapien
gttttagtttaatgtctcctaagct

SEQ ID NO: 542016 - DNA, 25 bp, Homo sapien
agcttttctctcatagcgtagacct

SEQ ID NO: 542017 - DNA, 25 bp, Homo sapien
tctctcatagcgtagacctagggaa

SEQ ID NO: 542018 - DNA, 25 bp, Homo sapien
gatgggaagattgcccagtccccga

SEQ ID NO: 542019 - DNA, 25 bp, Homo sapien
gtccccgatggctgcgcacacagga

SEQ ID NO: 542020 - DNA, 25 bp, Homo sapien
aagtgagtttgcactgtcagcccca

SEQ ID NO: 542021 - DNA, 25 bp, Homo sapien
tgtcagccccagaccgtaagcttgg

SEQ ID NO: 542022 - DNA, 25 bp, Homo sapien
gaccgtaagcttggctacactgatg

SEQ ID NO: 542023 - DNA, 25 bp, Homo sapien
ctgatgtttttctttactaaggata

SEQ ID NO: 542024 - DNA, 25 bp, Homo sapien
gtgtgacaagtgtgggctcctgaaa

SEQ ID NO: 542025 - DNA, 25 bp, Homo sapien
ggaatgttccagagaaaccagctaa

SEQ ID NO: 542026 - DNA, 25 bp, Homo sapien
taactcccgatgaggttgtggaact

SEQ ID NO: 542027 - DNA, 25 bp, Homo sapien
actgaccaacctgaagcagaagtac

SEQ ID NO: 542028 - DNA, 25 bp, Homo sapien
gcagaagtacctgactgtgatttca

SEQ ID NO: 542029 - DNA, 25 bp, Homo sapien
gtacctgactgtgatttcaaacccc

SEQ ID NO: 542030 - DNA, 25 bp, Homo sapien
tgtgatttcaaaccccaggtggtta

SEQ ID NO: 542031 - DNA, 25 bp, Homo sapien
gttactggagcccatacctaggaaa

SEQ ID NO: 542032 - DNA, 25 bp, Homo sapien
tgtattccaggtagacatcccagag

SEQ ID NO: 542033 - DNA, 25 bp, Homo sapien
aggtagacatcccagagcacctgat

SEQ ID NO: 542034 - DNA, 25 bp, Homo sapien
atcccagagcacctgatccctttgg

SEQ ID NO: 542035 - DNA, 25 bp, Homo sapien
accctctcacagttcggacttttct

SEQ ID NO: 542036 - DNA, 25 bp, Homo sapien
tcccctctctttctaagagacctga

SEQ ID NO: 542037 - DNA, 25 bp, Homo sapien
gagacctgaactgggcagactgcaa

SEQ ID NO: 542038 - DNA, 25 bp, Homo sapien
gactgcaaaataaaatctcggtgtt

SEQ ID NO: 542039 - DNA, 25 bp, Homo sapien
aaatctcggtgttctatttatttat

SEQ ID NO: 542040 - DNA, 25 bp, Homo sapien
gcagaggcaggaaactaactggtgt

SEQ ID NO: 542041 - DNA, 25 bp, Homo sapien
ctaactggtgtgagtcaaatgcccc

SEQ ID NO: 542042 - DNA, 25 bp, Homo sapien
agaagacctcccttcaggtgccggg

SEQ ID NO: 542043 - DNA, 25 bp, Homo sapien
ggaactgtgtgtgtcctacacaatg

SEQ ID NO: 542044 - DNA, 25 bp, Homo sapien
gtgtcctacacaatggtgctattct

SEQ ID NO: 542045 - DNA, 25 bp, Homo sapien
gtgctattctgtgtcaaacacctct

SEQ ID NO: 542046 - DNA, 25 bp, Homo sapien
gatagatcaacttaactggctagta

SEQ ID NO: 542047 - DNA, 25 bp, Homo sapien
aacttaactggctagtacattgaaa

SEQ ID NO: 542048 - DNA, 25 bp, Homo sapien
gtacattgaaaaatcttcctaagaa

SEQ ID NO: 542049 - DNA, 25 bp, Homo sapien
taagaatcctttgttagcataatct

SEQ ID NO: 542050 - DNA, 25 bp, Homo sapien
atcatcatgatgcatataaactcta

SEQ ID NO: 542051 - DNA, 25 bp, Homo sapien
gaaatacaaaaccatgcattagcca

SEQ ID NO: 542052 - DNA, 25 bp, Homo sapien
aaaccatgcattagccaaaaaattg

SEQ ID NO: 542053 - DNA, 25 bp, Homo sapien
tacaggtagtgttcagatcagcaaa

SEQ ID NO: 542054 - DNA, 25 bp, Homo sapien
cattcagtctggtaaatgcctgcct

SEQ ID NO: 542055 - DNA, 25 bp, Homo sapien
tcagtctggtaaatgcctgcctggg

SEQ ID NO: 542056 - DNA, 25 bp, Homo sapien
gggctatgatatcattctcaatgca

SEQ ID NO: 542057 - DNA, 25 bp, Homo sapien
cagaacgtgtctgcgatcacagcac

SEQ ID NO: 542058 - DNA, 25 bp, Homo sapien
gcgatcacagcacacatttttcaga

SEQ ID NO: 542059 - DNA, 25 bp, Homo sapien
aacgcatctgcggtcatggtgcatg

SEQ ID NO: 542060 - DNA, 25 bp, Homo sapien
tggtcatagcgcatgtatttttcag

SEQ ID NO: 542061 - DNA, 25 bp, Homo sapien
tttttcagaacgtctgccatcacgg

SEQ ID NO: 542062 - DNA, 25 bp, Homo sapien
cgcacgtgtttttcagaacgcgtct

SEQ ID NO: 542063 - DNA, 25 bp, Homo sapien
acgtgctgcgatcacagtgcatgta

SEQ ID NO: 542064 - DNA, 25 bp, Homo sapien
gtgcatgtatttttgcgaacgcgtc

SEQ ID NO: 542065 - DNA, 25 bp, Homo sapien
gcgaacgcgtctgtgattatggtac

SEQ ID NO: 542066 - DNA, 25 bp, Homo sapien
ggtacacgtatttttcagaacgcgt

SEQ ID NO: 542067 - DNA, 25 bp, Homo sapien
tgggcgcaagtagttttcagaacgt

SEQ ID NO: 542068 - DNA, 25 bp, Homo sapien
gggaggaaattatcaactgtgcaca

SEQ ID NO: 542069 - DNA, 25 bp, Homo sapien
aattatcaactgtgcacaaggaaaa

SEQ ID NO: 542070 - DNA, 25 bp, Homo sapien
ggttcacgtaaatttcctcacatca

SEQ ID NO: 542071 - DNA, 25 bp, Homo sapien
gtaaatttcctcacatcacagaaga

SEQ ID NO: 542072 - DNA, 25 bp, Homo sapien
gagaagtatctaagaccaaagggat

SEQ ID NO: 542073 - DNA, 25 bp, Homo sapien
gtatctaagaccaaagggatgtgtt

SEQ ID NO: 542074 - DNA, 25 bp, Homo sapien
aagggatgtgttttattaatgtcta

SEQ ID NO: 542075 - DNA, 25 bp, Homo sapien
gtgttttattaatgtctaggatgaa

SEQ ID NO: 542076 - DNA, 25 bp, Homo sapien
gcatagaacattgtagtacttgtaa

SEQ ID NO: 542077 - DNA, 25 bp, Homo sapien
atttttcttggatttatgttctgta

SEQ ID NO: 542078 - DNA, 25 bp, Homo sapien
ggatttatgttctgtatctgtgaaa

SEQ ID NO: 542079 - DNA, 25 bp, Homo sapien
catgtgtatctatctattgtcagtc

SEQ ID NO: 542080 - DNA, 25 bp, Homo sapien
tatctattgtcagtcgtctctcagt

SEQ ID NO: 542081 - DNA, 25 bp, Homo sapien
tgtcagtcgtctctcagttcttgag

SEQ ID NO: 542082 - DNA, 25 bp, Homo sapien
attccatgccttaatatgcttgcaa

SEQ ID NO: 542083 - DNA, 25 bp, Homo sapien
atatcttcagatgggtgaataccaa

SEQ ID NO: 542084 - DNA, 25 bp, Homo sapien
ggctttcagtttttagtcagaaatc

SEQ ID NO: 542085 - DNA, 25 bp, Homo sapien
caagcattgggctgtggtagccaaa

SEQ ID NO: 542086 - DNA, 25 bp, Homo sapien
ggtagccaaaaaccataggttagct

SEQ ID NO: 542087 - DNA, 25 bp, Homo sapien
ggttaataacaaatgaatccagact

SEQ ID NO: 542088 - DNA, 25 bp, Homo sapien
tccagacttgtctaacagattttcc

SEQ ID NO: 542089 - DNA, 25 bp, Homo sapien
gtctaacagattttccatcaacaaa

SEQ ID NO: 542090 - DNA, 25 bp, Homo sapien
cttaactcccgatgaggttgtggaa

SEQ ID NO: 542091 - DNA, 25 bp, Homo sapien
aactcccgatgaggttgtggaacta

SEQ ID NO: 542092 - DNA, 25 bp, Homo sapien
cccgatgaggttgtggaactagaaa

SEQ ID NO: 542093 - DNA, 25 bp, Homo sapien
actgaccaacctgaagcagaagtac

SEQ ID NO: 542094 - DNA, 25 bp, Homo sapien
agcagaagtacctgactgtgatttc

SEQ ID NO: 542095 - DNA, 25 bp, Homo sapien
gaagtacctgactgtgatttcaaac

SEQ ID NO: 542096 - DNA, 25 bp, Homo sapien
gtacctgactgtgatttcaaacccc

SEQ ID NO: 542097 - DNA, 25 bp, Homo sapien
ctgactgtgatttcaaaccccaggt

SEQ ID NO: 542098 - DNA, 25 bp, Homo sapien
gactgtgatttcaaaccccaggtgg

SEQ ID NO: 542099 - DNA, 25 bp, Homo sapien
tgtgatttcaaaccccaggtggtta

SEQ ID NO: 542100 - DNA, 25 bp, Homo sapien
gaaaggaggcaaggatgtattccag

SEQ ID NO: 542101 - DNA, 25 bp, Homo sapien
gatgttcatgaagactcccttacag

SEQ ID NO: 542102 - DNA, 25 bp, Homo sapien
gaagactcccttacagttgtttttg

SEQ ID NO: 542103 - DNA, 25 bp, Homo sapien
taattggcaaccagaacgccaggtt

SEQ ID NO: 542104 - DNA, 25 bp, Homo sapien
gaacgccaggttccatttaatgaag

SEQ ID NO: 542105 - DNA, 25 bp, Homo sapien
taatgaagttagattaccaccacca

SEQ ID NO: 542106 - DNA, 25 bp, Homo sapien
attaccaccaccacctgatataaaa

SEQ ID NO: 542107 - DNA, 25 bp, Homo sapien
gcaaatgaccaagagccatgtgggt

SEQ ID NO: 542108 - DNA, 25 bp, Homo sapien
gaatatgctgcttgtgacgctactt

SEQ ID NO: 542109 - DNA, 25 bp, Homo sapien
gcttgtgacgctacttacaatgaaa

SEQ ID NO: 542110 - DNA, 25 bp, Homo sapien
gtcacatttgaacgacttcggcctg

SEQ ID NO: 542111 - DNA, 25 bp, Homo sapien
aacgacttcggcctgtcaatcaaaa

SEQ ID NO: 542112 - DNA, 25 bp, Homo sapien
agcattcactggtgcttactatgtg

SEQ ID NO: 542113 - DNA, 25 bp, Homo sapien
tactatgtgctattgctgtgccaag

SEQ ID NO: 542114 - DNA, 25 bp, Homo sapien
tgctgtgccaagtatctgaaacctg

SEQ ID NO: 542115 - DNA, 25 bp, Homo sapien
gtatctgaaacctgtcttcttacct

SEQ ID NO: 542116 - DNA, 25 bp, Homo sapien
atgtggcaggtattactatctcaat

SEQ ID NO: 542117 - DNA, 25 bp, Homo sapien
acatttactaacttgcctgggtcac

SEQ ID NO: 542118 - DNA, 25 bp, Homo sapien
gaagaggtggacttgcccagctttg

SEQ ID NO: 542119 - DNA, 25 bp, Homo sapien
cccagctttgcataaaactcctcaa

SEQ ID NO: 542120 - DNA, 25 bp, Homo sapien
aaagagttgcctatactccctgact

SEQ ID NO: 542121 - DNA, 25 bp, Homo sapien
tgactccacttatcttcctactatc

SEQ ID NO: 542122 - DNA, 25 bp, Homo sapien
tatcttcctactatcctctttttaa

SEQ ID NO: 542123 - DNA, 25 bp, Homo sapien
tagactttaaagacactaaccatat

SEQ ID NO: 542124 - DNA, 25 bp, Homo sapien
gacactaaccatataacttttatgt

SEQ ID NO: 542125 - DNA, 25 bp, Homo sapien
tacaaaaaccactccaaagtgaagg

SEQ ID NO: 542126 - DNA, 25 bp, Homo sapien
cattttgctgcatatgcctttaaaa

SEQ ID NO: 542127 - DNA, 25 bp, Homo sapien
aaatcaatgcagtattaccattaaa

SEQ ID NO: 542128 - DNA, 25 bp, Homo sapien
aacatgggactctaactaaagccac

SEQ ID NO: 542129 - DNA, 25 bp, Homo sapien
gggactctaactaaagccacttagg

SEQ ID NO: 542130 - DNA, 25 bp, Homo sapien
actaaagccacttaggagcagacag

SEQ ID NO: 542131 - DNA, 25 bp, Homo sapien
gagcagacagcagcgttgttaggta

SEQ ID NO: 542132 - DNA, 25 bp, Homo sapien
gacagcagcgttgttaggtactgaa

SEQ ID NO: 542133 - DNA, 25 bp, Homo sapien
tgttaggtactgaagggttcttcct

SEQ ID NO: 542134 - DNA, 25 bp, Homo sapien
gggaggaaattatcaactgtgcaca

SEQ ID NO: 542135 - DNA, 25 bp, Homo sapien
gaggaaattatcaactgtgcacaag

SEQ ID NO: 542136 - DNA, 25 bp, Homo sapien
aggaaattatcaactgtgcacaagg

SEQ ID NO: 542137 - DNA, 25 bp, Homo sapien
aattatcaactgtgcacaaggaaaa

SEQ ID NO: 542138 - DNA, 25 bp, Homo sapien
ttatcaactgtgcacaaggaaaaaa

SEQ ID NO: 542139 - DNA, 25 bp, Homo sapien
ccaaagagaagtatctaagaccaaa

SEQ ID NO: 542140 - DNA, 25 bp, Homo sapien
gagaagtatctaagaccaaagggat

SEQ ID NO: 542141 - DNA, 25 bp, Homo sapien
gtatctaagaccaaagggatgtgtt

SEQ ID NO: 542142 - DNA, 25 bp, Homo sapien
atgcatagaacattgtagtacttgt

SEQ ID NO: 542143 - DNA, 25 bp, Homo sapien
gcatagaacattgtagtacttgtaa

SEQ ID NO: 542144 - DNA, 25 bp, Homo sapien
tagaacattgtagtacttgtaaata

SEQ ID NO: 542145 - DNA, 25 bp, Homo sapien
cgctctgcctcacggaaagacagat

SEQ ID NO: 542146 - DNA, 25 bp, Homo sapien
tctgcctcacggaaagacagatcaa

SEQ ID NO: 542147 - DNA, 25 bp, Homo sapien
gaaagacagatcaagatttggtttc

SEQ ID NO: 542148 - DNA, 25 bp, Homo sapien
accaccggccaagacagggctgaag

SEQ ID NO: 542149 - DNA, 25 bp, Homo sapien
caccggccaagacagggctgaagca

SEQ ID NO: 542150 - DNA, 25 bp, Homo sapien
ccggccaagacagggctgaagcaga

SEQ ID NO: 542151 - DNA, 25 bp, Homo sapien
gaagagaagcccagctctgggaact

SEQ ID NO: 542152 - DNA, 25 bp, Homo sapien
gcccagctctgggaactgaatcagg

SEQ ID NO: 542153 - DNA, 25 bp, Homo sapien
ggaactgaatcaggaaactcaaatc

SEQ ID NO: 542154 - DNA, 25 bp, Homo sapien
gaatcaggaaactcaaatcgaatag

SEQ ID NO: 542155 - DNA, 25 bp, Homo sapien
caggaaactcaaatcgaatagggaa

SEQ ID NO: 542156 - DNA, 25 bp, Homo sapien
tccctagccaatgctgtcttggata

SEQ ID NO: 542157 - DNA, 25 bp, Homo sapien
gtcttggataacagatttgccctgg

SEQ ID NO: 542158 - DNA, 25 bp, Homo sapien
acagatttgccctggaatatcttct

SEQ ID NO: 542159 - DNA, 25 bp, Homo sapien
acaagggcgggtatgcacagtaata

SEQ ID NO: 542160 - DNA, 25 bp, Homo sapien
ggtatgcacagtaataaaccacatc

SEQ ID NO: 542161 - DNA, 25 bp, Homo sapien
aaaccacatctgttgttcttacatt

SEQ ID NO: 542162 - DNA, 25 bp, Homo sapien
gttgttcttacattaacagttcagg

SEQ ID NO: 542163 - DNA, 25 bp, Homo sapien
acattaacagttcaggattggctaa

SEQ ID NO: 542164 - DNA, 25 bp, Homo sapien
gttcaggattggctaaactgcaagt

SEQ ID NO: 542165 - DNA, 25 bp, Homo sapien
aactgcaagttcaaaagatttacca

SEQ ID NO: 542166 - DNA, 25 bp, Homo sapien
aagatttaccaagaccaggcacaat

SEQ ID NO: 542167 - DNA, 25 bp, Homo sapien
tcacaacattgaaagcacaagcaat

SEQ ID NO: 542168 - DNA, 25 bp, Homo sapien
gggtggaagctgacccaaacttaga

SEQ ID NO: 542169 - DNA, 25 bp, Homo sapien
aagctgacccaaacttagaaggagt

SEQ ID NO: 542170 - DNA, 25 bp, Homo sapien
cttagaaggagtatggcagtttgcc

SEQ ID NO: 542171 - DNA, 25 bp, Homo sapien
gagtatggcagtttgccgtgaacat

SEQ ID NO: 542172 - DNA, 25 bp, Homo sapien
agtttgccgtgaacataaaagatgc

SEQ ID NO: 542173 - DNA, 25 bp, Homo sapien
ataaaagatgcttactcagtatggt

SEQ ID NO: 542174 - DNA, 25 bp, Homo sapien
actcagtatggtaagttacttgcca

SEQ ID NO: 542175 - DNA, 25 bp, Homo sapien
gtatggtaagttacttgccagaaaa

SEQ ID NO: 542176 - DNA, 25 bp, Homo sapien
aaggcaagccctattcaaactactt

SEQ ID NO: 542177 - DNA, 25 bp, Homo sapien
gcaagccctattcaaactactttgt

SEQ ID NO: 542178 - DNA, 25 bp, Homo sapien
agacttcctctccagtggttaccct

SEQ ID NO: 542179 - DNA, 25 bp, Homo sapien
aactttaggatctctgaggtatact

SEQ ID NO: 542180 - DNA, 25 bp, Homo sapien
ctggatgtcccacgtttacactcca

SEQ ID NO: 542181 - DNA, 25 bp, Homo sapien
ttaacaaagtcctccactgggtcaa

SEQ ID NO: 542182 - DNA, 25 bp, Homo sapien
tgggtcaaaccatacatcgcttcgt

SEQ ID NO: 542183 - DNA, 25 bp, Homo sapien
atcgcttcgtctctgtagtgatgac

SEQ ID NO: 542184 - DNA, 25 bp, Homo sapien
tagtgatgacttcctgtcctctgct

SEQ ID NO: 542185 - DNA, 25 bp, Homo sapien
tcctctgctctgtggataaagaccc

SEQ ID NO: 542186 - DNA, 25 bp, Homo sapien
ataaagaccccagataaagatgcct

SEQ ID NO: 542187 - DNA, 25 bp, Homo sapien
ataaagatgcctgtgttgctcaact

SEQ ID NO: 542188 - DNA, 25 bp, Homo sapien
gtatactggagatgacagcagcgta

SEQ ID NO: 542189 - DNA, 25 bp, Homo sapien
cctttcgagaacaccctgtggcagt

SEQ ID NO: 542190 - DNA, 25 bp, Homo sapien
tggcagttcagagacacgcttttcc

SEQ ID NO: 542191 - DNA, 25 bp, Homo sapien
agacacgcttttcctacactgcatg

SEQ ID NO: 542192 - DNA, 25 bp, Homo sapien
aagaagtggtcttgagcccagctga

SEQ ID NO: 542193 - DNA, 25 bp, Homo sapien
gagcccagctgagaagcacttcaca

SEQ ID NO: 542194 - DNA, 25 bp, Homo sapien
cacactcctctctcttgttctgaat

SEQ ID NO: 542195 - DNA, 25 bp, Homo sapien
gtttgtgtcagtctgcagctgtgta

SEQ ID NO: 542196 - DNA, 25 bp, Homo sapien
gcagctgtgtatggtattatgtctt

SEQ ID NO: 542197 - DNA, 25 bp, Homo sapien
gtcttataatcctgcatcacttcta

SEQ ID NO: 542198 - DNA, 25 bp, Homo sapien
atcacttctatcctatccagtcata

SEQ ID NO: 542199 - DNA, 25 bp, Homo sapien
tatcctatccagtcatatctaatgt

SEQ ID NO: 542200 - DNA, 25 bp, Homo sapien
atatcagtgttggacgttaatgccc

SEQ ID NO: 542201 - DNA, 25 bp, Homo sapien
gttaatgcccacttttcttattctt

SEQ ID NO: 542202 - DNA, 25 bp, Homo sapien
ttcttattcttactcagcccctttt

SEQ ID NO: 542203 - DNA, 25 bp, Homo sapien
ttttcctcccttaggagcattggtc

SEQ ID NO: 542204 - DNA, 25 bp, Homo sapien
ttaggagcattggtcctctgttgtc

SEQ ID NO: 542205 - DNA, 25 bp, Homo sapien
cctctgttgtccatttttatcacca

SEQ ID NO: 542206 - DNA, 25 bp, Homo sapien
gttttccactgaagcatgcacatgc

SEQ ID NO: 542207 - DNA, 25 bp, Homo sapien
atgcacatgccactgtcaccaaaac

SEQ ID NO: 542208 - DNA, 25 bp, Homo sapien
actttccaaatttcattcagaacca

SEQ ID NO: 542209 - DNA, 25 bp, Homo sapien
ttcaatgatgaaataccctaagtta

SEQ ID NO: 542210 - DNA, 25 bp, Homo sapien
actttattgcctagatgctgcaatg

SEQ ID NO: 542211 - DNA, 25 bp, Homo sapien
cacgatgcccaggtagccatggata

SEQ ID NO: 542212 - DNA, 25 bp, Homo sapien
aagtgtagacacgtgtggcctggaa

SEQ ID NO: 542213 - DNA, 25 bp, Homo sapien
gacacgtgtggcctggaagaacaaa

SEQ ID NO: 542214 - DNA, 25 bp, Homo sapien
ggaacaagtagtcttatcttctgaa

SEQ ID NO: 542215 - DNA, 25 bp, Homo sapien
tgaattttaagaacccacagtctgg

SEQ ID NO: 542216 - DNA, 25 bp, Homo sapien
cagtctgggttctgaaagaacttta

SEQ ID NO: 542217 - DNA, 25 bp, Homo sapien
aaaggcatccaataggcactttgca

SEQ ID NO: 542218 - DNA, 25 bp, Homo sapien
ggcactttgcacacatattttctca

SEQ ID NO: 542219 - DNA, 25 bp, Homo sapien
acacatattttctcaaccttccaaa

SEQ ID NO: 542220 - DNA, 25 bp, Homo sapien
ataagcacgaggagcctgactcagt

SEQ ID NO: 542221 - DNA, 25 bp, Homo sapien
acgaggagcctgactcagtgcgtcg

SEQ ID NO: 542222 - DNA, 25 bp, Homo sapien
cagaacgatttgaaggtccatatac

SEQ ID NO: 542223 - DNA, 25 bp, Homo sapien
aaggtccatatacagacttcacccc

SEQ ID NO: 542224 - DNA, 25 bp, Homo sapien
agacttcaccccttggacaacagaa

SEQ ID NO: 542225 - DNA, 25 bp, Homo sapien
acaagctttgaaaacatacccagta

SEQ ID NO: 542226 - DNA, 25 bp, Homo sapien
aacatacccagtaaatacacctgaa

SEQ ID NO: 542227 - DNA, 25 bp, Homo sapien
aaaatagcagaagcggtgcctggca

SEQ ID NO: 542228 - DNA, 25 bp, Homo sapien
aaagaaggactgcatgaaacgatac

SEQ ID NO: 542229 - DNA, 25 bp, Homo sapien
ctgcatgaaacgatacaaggaactt

SEQ ID NO: 542230 - DNA, 25 bp, Homo sapien
caaggaacttgtcgagatggtaaaa

SEQ ID NO: 542231 - DNA, 25 bp, Homo sapien
gctgctcaagaacaagtgctgaatg

SEQ ID NO: 542232 - DNA, 25 bp, Homo sapien
aagtgctgaatgcaagtagagccaa

SEQ ID NO: 542233 - DNA, 25 bp, Homo sapien
gggaacccatgagttgtcagctttg

SEQ ID NO: 542234 - DNA, 25 bp, Homo sapien
tgtcagctttgactttatctcctgc

SEQ ID NO: 542235 - DNA, 25 bp, Homo sapien
ttatctcctgctctttctacatgac

SEQ ID NO: 542236 - DNA, 25 bp, Homo sapien
tgctctttctacatgactgggcctc

SEQ ID NO: 542237 - DNA, 25 bp, Homo sapien
gattctctattggaggtgagatcac

SEQ ID NO: 542238 - DNA, 25 bp, Homo sapien
aaggacttggagagaatcatgctgt

SEQ ID NO: 542239 - DNA, 25 bp, Homo sapien
gaatcatgctgttgcatttagaact

SEQ ID NO: 542240 - DNA, 25 bp, Homo sapien
tagaactttctgctttgcacaggaa

SEQ ID NO: 542241 - DNA, 25 bp, Homo sapien
tttgcacaggaaagagtcacacaat

SEQ ID NO: 542242 - DNA, 25 bp, Homo sapien
gagtcacacaattaatcaacatgta

SEQ ID NO: 542243 - DNA, 25 bp, Homo sapien
agagctctatttctctacggtttta

SEQ ID NO: 542244 - DNA, 25 bp, Homo sapien
cgctctgcctcacggaaagacagat

SEQ ID NO: 542245 - DNA, 25 bp, Homo sapien
ctctgcctcacggaaagacagatca

SEQ ID NO: 542246 - DNA, 25 bp, Homo sapien
tctgcctcacggaaagacagatcaa

SEQ ID NO: 542247 - DNA, 25 bp, Homo sapien
ggaactgaatcaggaaactcaaatc

SEQ ID NO: 542248 - DNA, 25 bp, Homo sapien
gaactgaatcaggaaactcaaatcg

SEQ ID NO: 542249 - DNA, 25 bp, Homo sapien
aactgaatcaggaaactcaaatcga

SEQ ID NO: 542250 - DNA, 25 bp, Homo sapien
ctgaatcaggaaactcaaatcgaat

SEQ ID NO: 542251 - DNA, 25 bp, Homo sapien
gaatcaggaaactcaaatcgaatag

SEQ ID NO: 542252 - DNA, 25 bp, Homo sapien
atcaggaaactcaaatcgaataggg

SEQ ID NO: 542253 - DNA, 25 bp, Homo sapien
tcaggaaactcaaatcgaataggga

SEQ ID NO: 542254 - DNA, 25 bp, Homo sapien
caggaaactcaaatcgaatagggaa

SEQ ID NO: 542255 - DNA, 25 bp, Homo sapien
tggaggatccccagggtcttctcat

SEQ ID NO: 542256 - DNA, 25 bp, Homo sapien
cccagggtcttctcatggttgcagc

SEQ ID NO: 542257 - DNA, 25 bp, Homo sapien
cagcaggaaggacacctctctgagg

SEQ ID NO: 542258 - DNA, 25 bp, Homo sapien
gagatggccagaacatttaactgtg

SEQ ID NO: 542259 - DNA, 25 bp, Homo sapien
ttggcgctgtccttgtggtatcaaa

SEQ ID NO: 542260 - DNA, 25 bp, Homo sapien
gtggttgcacgagctgaaggttccc

SEQ ID NO: 542261 - DNA, 25 bp, Homo sapien
gagctgaaggttccccacgtgtgaa

SEQ ID NO: 542262 - DNA, 25 bp, Homo sapien
ggttccccacgtgtgaaagtcaaga

SEQ ID NO: 542263 - DNA, 25 bp, Homo sapien
gcatgcaaataaatgggtcagtgtt

SEQ ID NO: 542264 - DNA, 25 bp, Homo sapien
agtgttgaagaatggctccctgaca

SEQ ID NO: 542265 - DNA, 25 bp, Homo sapien
aatggctccctgacaaatcatttct

SEQ ID NO: 542266 - DNA, 25 bp, Homo sapien
tctcggctcggtgacagccaacctg

SEQ ID NO: 542267 - DNA, 25 bp, Homo sapien
tccccacaccaatcagccaggctga

SEQ ID NO: 542268 - DNA, 25 bp, Homo sapien
tgagccgggccttctagtcgtagtg

SEQ ID NO: 542269 - DNA, 25 bp, Homo sapien
gggccttctagtcgtagtgccttca

SEQ ID NO: 542270 - DNA, 25 bp, Homo sapien
gccttctagtcgtagtgccttcagg

SEQ ID NO: 542271 - DNA, 25 bp, Homo sapien
ttctagtcgtagtgccttcagggtc

SEQ ID NO: 542272 - DNA, 25 bp, Homo sapien
tagtcgtagtgccttcagggtccga

SEQ ID NO: 542273 - DNA, 25 bp, Homo sapien
agtcgtagtgccttcagggtccgag

SEQ ID NO: 542274 - DNA, 25 bp, Homo sapien
agtgccttcagggtccgaggagcat

SEQ ID NO: 542275 - DNA, 25 bp, Homo sapien
tgccttcagggtccgaggagcatca

SEQ ID NO: 542276 - DNA, 25 bp, Homo sapien
tcagggtccgaggagcatcaggctc

SEQ ID NO: 542277 - DNA, 25 bp, Homo sapien
cttaagtgtggcactgttgtgcgtg

SEQ ID NO: 542278 - DNA, 25 bp, Homo sapien
cttttgagaaagtctcagtggattc

SEQ ID NO: 542279 - DNA, 25 bp, Homo sapien
gcccaagaattgtgctaacaagcac

SEQ ID NO: 542280 - DNA, 25 bp, Homo sapien
taacaagcactcaaggcgattctgg

SEQ ID NO: 542281 - DNA, 25 bp, Homo sapien
gcactcaaggcgattctggtacata

SEQ ID NO: 542282 - DNA, 25 bp, Homo sapien
ggcgattctggtacataattagggt

SEQ ID NO: 542283 - DNA, 25 bp, Homo sapien
tacataattagggttcagacctcag

SEQ ID NO: 542284 - DNA, 25 bp, Homo sapien
gttcagacctcagctgattggtcta

SEQ ID NO: 542285 - DNA, 25 bp, Homo sapien
cagctgattggtctactgttggtca

SEQ ID NO: 542286 - DNA, 25 bp, Homo sapien
tggtctactgttggtcaggaacaaa

SEQ ID NO: 542287 - DNA, 25 bp, Homo sapien
aactgcaagtatactctgtttccag

SEQ ID NO: 542288 - DNA, 25 bp, Homo sapien
gatggttaacatcaaaaggctgcct

SEQ ID NO: 542289 - DNA, 25 bp, Homo sapien
acaggcacctctccaatatgacagt

SEQ ID NO: 542290 - DNA, 25 bp, Homo sapien
aggcacctctccaatatgacagtat

SEQ ID NO: 542291 - DNA, 25 bp, Homo sapien
gcacctctccaatatgacagtattt

SEQ ID NO: 542292 - DNA, 25 bp, Homo sapien
acctctccaatatgacagtatttta

SEQ ID NO: 542293 - DNA, 25 bp, Homo sapien
acacagttcatcattgcttgcttgc

SEQ ID NO: 542294 - DNA, 25 bp, Homo sapien
actctcactcactccttcttttatt

SEQ ID NO: 542295 - DNA, 25 bp, Homo sapien
taataggttatctttgtttggtgat

SEQ ID NO: 542296 - DNA, 25 bp, Homo sapien
tctttgtgccaattcataagtattc

SEQ ID NO: 542297 - DNA, 25 bp, Homo sapien
gtgccaattcataagtattctggtg

SEQ ID NO: 542298 - DNA, 25 bp, Homo sapien
caattcataagtattctggtgtaat

SEQ ID NO: 542299 - DNA, 25 bp, Homo sapien
gattcaagtaacatcagttctcctc

SEQ ID NO: 542300 - DNA, 25 bp, Homo sapien
ttcatgcttttccttcccaggtgca

SEQ ID NO: 542301 - DNA, 25 bp, Homo sapien
cttcccaggtgcagcctgtgattct

SEQ ID NO: 542302 - DNA, 25 bp, Homo sapien
tgcctcctaggacttattttcccag

SEQ ID NO: 542303 - DNA, 25 bp, Homo sapien
attttcccaggaggccatttacaag

SEQ ID NO: 542304 - DNA, 25 bp, Homo sapien
atctggatgacctgctgatggagat

SEQ ID NO: 542305 - DNA, 25 bp, Homo sapien
gatggagatccagcttgccagggac

SEQ ID NO: 542306 - DNA, 25 bp, Homo sapien
cagcttgccagggacttaggtttat

SEQ ID NO: 542307 - DNA, 25 bp, Homo sapien
gccagggacttaggtttatcctgtt

SEQ ID NO: 542308 - DNA, 25 bp, Homo sapien
cctgttttgtttgctactggttaca

SEQ ID NO: 542309 - DNA, 25 bp, Homo sapien
tgctactggttacaaattctatttt

SEQ ID NO: 542310 - DNA, 25 bp, Homo sapien
tctacttccccaagttttgatgagt

SEQ ID NO: 542311 - DNA, 25 bp, Homo sapien
taaacatctgtcttactctagggcc

SEQ ID NO: 542312 - DNA, 25 bp, Homo sapien
atctgtcttactctagggccaataa

SEQ ID NO: 542313 - DNA, 25 bp, Homo sapien
tctagggccaataagagatcacata

SEQ ID NO: 542314 - DNA, 25 bp, Homo sapien
aagagatcacatagagcatgttggg

SEQ ID NO: 542315 - DNA, 25 bp, Homo sapien
gggcaaatttctagaggccctttga

SEQ ID NO: 542316 - DNA, 25 bp, Homo sapien
tagaggccctttgacaagacccatt

SEQ ID NO: 542317 - DNA, 25 bp, Homo sapien
aggccctttgacaagacccatttgc

SEQ ID NO: 542318 - DNA, 25 bp, Homo sapien
tgcccacaatcatttgaggcctatt

SEQ ID NO: 542319 - DNA, 25 bp, Homo sapien
gaggcctattgataataccttagat

SEQ ID NO: 542320 - DNA, 25 bp, Homo sapien
aataccttagatatattcttgttga

SEQ ID NO: 542321 - DNA, 25 bp, Homo sapien
ggtggcactgaaagccatgggttct

SEQ ID NO: 542322 - DNA, 25 bp, Homo sapien
aagtcccaagggtctgaatgaaagc

SEQ ID NO: 542323 - DNA, 25 bp, Homo sapien
gaaagcatctttaatcaacactcaa

SEQ ID NO: 542324 - DNA, 25 bp, Homo sapien
aacactcaacactcgcaatattcta

SEQ ID NO: 542325 - DNA, 25 bp, Homo sapien
catatactgtgctggttgaggccaa

SEQ ID NO: 542326 - DNA, 25 bp, Homo sapien
ggccaaaggttaacattgctccact

SEQ ID NO: 542327 - DNA, 25 bp, Homo sapien
ttgctccactgttcaccaaggaagg

SEQ ID NO: 542328 - DNA, 25 bp, Homo sapien
gcggcctcacgtgcgttgtaacaag

SEQ ID NO: 542329 - DNA, 25 bp, Homo sapien
tcacatgtgtgagtcttacgtgcac

SEQ ID NO: 542330 - DNA, 25 bp, Homo sapien
aggctttggtactgaaactggacac

SEQ ID NO: 542331 - DNA, 25 bp, Homo sapien
ggacaccttgtgtactcgatacctt

SEQ ID NO: 542332 - DNA, 25 bp, Homo sapien
ctactggttagatttattgtctcac

SEQ ID NO: 542333 - DNA, 25 bp, Homo sapien
tattgtctcacaaaaatgtttttag

SEQ ID NO: 542334 - DNA, 25 bp, Homo sapien
aatgttttctttctcatgctgatga

SEQ ID NO: 542335 - DNA, 25 bp, Homo sapien
ttctttctcatgctgatgatcaact

SEQ ID NO: 542336 - DNA, 25 bp, Homo sapien
gatcaactgatttttgtctacaggt

SEQ ID NO: 542337 - DNA, 25 bp, Homo sapien
ttttgtctacaggtgttagcttctc

SEQ ID NO: 542338 - DNA, 25 bp, Homo sapien
gtctacaggtgttagcttctcacag

SEQ ID NO: 542339 - DNA, 25 bp, Homo sapien
acaggtgttagcttctcacagtatt

SEQ ID NO: 542340 - DNA, 25 bp, Homo sapien
gagtctatttaccaaatgaccattt

SEQ ID NO: 542341 - DNA, 25 bp, Homo sapien
actgaggaattgaggtatgtaaatc

SEQ ID NO: 542342 - DNA, 25 bp, Homo sapien
gtgcctaaatatttttgtaatggtg

SEQ ID NO: 542343 - DNA, 25 bp, Homo sapien
gctaggtttttactgattattttca

SEQ ID NO: 542344 - DNA, 25 bp, Homo sapien
atagctatcctaagtccatattttg

SEQ ID NO: 542345 - DNA, 25 bp, Homo sapien
gctatcctaagtccatattttgatg

SEQ ID NO: 542346 - DNA, 25 bp, Homo sapien
atcctaagtccatattttgatgcat

SEQ ID NO: 542347 - DNA, 25 bp, Homo sapien
ttttgatgcatattaatggacattt

SEQ ID NO: 542348 - DNA, 25 bp, Homo sapien
gcatattaatggacatttatgtcac

SEQ ID NO: 542349 - DNA, 25 bp, Homo sapien
ttatgtcacttttgaaatctagaat

SEQ ID NO: 542350 - DNA, 25 bp, Homo sapien
accatgtacatggtaccaccatctt

SEQ ID NO: 542351 - DNA, 25 bp, Homo sapien
atggtaccaccatcttactgtaaca

SEQ ID NO: 542352 - DNA, 25 bp, Homo sapien
ggtaccaccatcttactgtaacatt

SEQ ID NO: 542353 - DNA, 25 bp, Homo sapien
accaccatcttactgtaacattttt

SEQ ID NO: 542354 - DNA, 25 bp, Homo sapien
aattccttagtcatggtgttgcgta

SEQ ID NO: 542355 - DNA, 25 bp, Homo sapien
aatcatattttagctgcacggcatt

SEQ ID NO: 542356 - DNA, 25 bp, Homo sapien
attttagctgcacggcattacccca

SEQ ID NO: 542357 - DNA, 25 bp, Homo sapien
attaccccacacagggtggcagaac

SEQ ID NO: 542358 - DNA, 25 bp, Homo sapien
gaacttgaagggttactgacgtgta

SEQ ID NO: 542359 - DNA, 25 bp, Homo sapien
tactgacgtgtaaatgctggtattt

SEQ ID NO: 542360 - DNA, 25 bp, Homo sapien
taagggcattttacccttgcagttt

SEQ ID NO: 542361 - DNA, 25 bp, Homo sapien
ttccaagcttcatattaaccctacc

SEQ ID NO: 542362 - DNA, 25 bp, Homo sapien
taaccctacctgtcaacgtaacgat

SEQ ID NO: 542363 - DNA, 25 bp, Homo sapien
tattatattgtcgaattcctactga

SEQ ID NO: 542364 - DNA, 25 bp, Homo sapien
attcctactgacaacattataactg

SEQ ID NO: 542365 - DNA, 25 bp, Homo sapien
tatggtgtaatttaaactctgggca

SEQ ID NO: 542366 - DNA, 25 bp, Homo sapien
gaaatataatagctgccttagacat

SEQ ID NO: 542367 - DNA, 25 bp, Homo sapien
atagctgccttagacattatgaggt

SEQ ID NO: 542368 - DNA, 25 bp, Homo sapien
gacattatgaggtatacaactagta

SEQ ID NO: 542369 - DNA, 25 bp, Homo sapien
agataccatttaatatgccccgtaa

SEQ ID NO: 542370 - DNA, 25 bp, Homo sapien
atatgccccgtaaatgtcttcagtg

SEQ ID NO: 542371 - DNA, 25 bp, Homo sapien
ccgtaaatgtcttcagtgttcttca

SEQ ID NO: 542372 - DNA, 25 bp, Homo sapien
gttcttcagggtagttgggatctca

SEQ ID NO: 542373 - DNA, 25 bp, Homo sapien
gggatctcaaaagatttggttcaga

SEQ ID NO: 542374 - DNA, 25 bp, Homo sapien
ggttcagatccaaacaaatacacat

SEQ ID NO: 542375 - DNA, 25 bp, Homo sapien
caaatacacattctgtgttttagct

SEQ ID NO: 542376 - DNA, 25 bp, Homo sapien
gctttaggtctaaaatgactccagg

SEQ ID NO: 542377 - DNA, 25 bp, Homo sapien
atgactccaggtgtcgaagatccct

SEQ ID NO: 542378 - DNA, 25 bp, Homo sapien
ccaggtgtcgaagatccctgatctt

SEQ ID NO: 542379 - DNA, 25 bp, Homo sapien
tgtcgaagatccctgatctttggca

SEQ ID NO: 542380 - DNA, 25 bp, Homo sapien
gcaaattttaaactaatctgtggtg

SEQ ID NO: 542381 - DNA, 25 bp, Homo sapien
agagagagtactgggctaggaagct

SEQ ID NO: 542382 - DNA, 25 bp, Homo sapien
aggaagctgggctcgtttcagctgt

SEQ ID NO: 542383 - DNA, 25 bp, Homo sapien
tcgtttcagctgtgcgatcctaaat

SEQ ID NO: 542384 - DNA, 25 bp, Homo sapien
gctgtgcgatcctaaataagtccat

SEQ ID NO: 542385 - DNA, 25 bp, Homo sapien
gcgatcctaaataagtccattcaat

SEQ ID NO: 542386 - DNA, 25 bp, Homo sapien
aataagtccattcaataaagtgtta

SEQ ID NO: 542387 - DNA, 25 bp, Homo sapien
gtacatgtacaacattaaacgtgtt

SEQ ID NO: 542388 - DNA, 25 bp, Homo sapien
aaaggtaccagcgatcacttgtccc

SEQ ID NO: 542389 - DNA, 25 bp, Homo sapien
gatcacttgtcccttgccatttttt

SEQ ID NO: 542390 - DNA, 25 bp, Homo sapien
cttgtcccttgccattttttcttgt

SEQ ID NO: 542391 - DNA, 25 bp, Homo sapien
atgttagacaaatcttggcggcggg

SEQ ID NO: 542392 - DNA, 25 bp, Homo sapien
attgttttaattctacagctgtagg

SEQ ID NO: 542393 - DNA, 25 bp, Homo sapien
gctgtaggagctttgtattgctgaa

SEQ ID NO: 542394 - DNA, 25 bp, Homo sapien
tattgctgaactttcatctggaaaa

SEQ ID NO: 542395 - DNA, 25 bp, Homo sapien
tctggaaaagtttcacagtgacatt

SEQ ID NO: 542396 - DNA, 25 bp, Homo sapien
ttttatctgccgaattctaccagtg

SEQ ID NO: 542397 - DNA, 25 bp, Homo sapien
gccgaattctaccagtgtaaccttt

SEQ ID NO: 542398 - DNA, 25 bp, Homo sapien
tgcgcggtttccagccaggaagctt

SEQ ID NO: 542399 - DNA, 25 bp, Homo sapien
ggtttccagccaggaagcttcggga

SEQ ID NO: 542400 - DNA, 25 bp, Homo sapien
aagcttcgggaagcctggacgtctg

SEQ ID NO: 542401 - DNA, 25 bp, Homo sapien
gaagcctggacgtctgctcactgga

SEQ ID NO: 542402 - DNA, 25 bp, Homo sapien
ggacgtctgctcactggagatgaca

SEQ ID NO: 542403 - DNA, 25 bp, Homo sapien
tgctcactggagatgacacgtgcgt

SEQ ID NO: 542404 - DNA, 25 bp, Homo sapien
aggtgacttcgcctgtgatggactt

SEQ ID NO: 542405 - DNA, 25 bp, Homo sapien
acttcgcctgtgatggacttccagt

SEQ ID NO: 542406 - DNA, 25 bp, Homo sapien
cctgtgatggacttccagtgtgagc

SEQ ID NO: 542407 - DNA, 25 bp, Homo sapien
agcactggccagagtgaccaggctg

SEQ ID NO: 542408 - DNA, 25 bp, Homo sapien
gagtgaccaggctgaccagcaccag

SEQ ID NO: 542409 - DNA, 25 bp, Homo sapien
tacactgttgccttgctaggatcca

SEQ ID NO: 542410 - DNA, 25 bp, Homo sapien
atatctgaatgaaatccaccctagg

SEQ ID NO: 542411 - DNA, 25 bp, Homo sapien
aatccaccctaggagacggagtcaa

SEQ ID NO: 542412 - DNA, 25 bp, Homo sapien
gacggagtcaaactaaacttgtggt

SEQ ID NO: 542413 - DNA, 25 bp, Homo sapien
atttaacttttgactacagcatggc

SEQ ID NO: 542414 - DNA, 25 bp, Homo sapien
ccatggcatccacaccaagagggtg

SEQ ID NO: 542415 - DNA, 25 bp, Homo sapien
gtgccggtgtgcaaagggaacttta

SEQ ID NO: 542416 - DNA, 25 bp, Homo sapien
agtttttccactggttcttatctgc

SEQ ID NO: 542417 - DNA, 25 bp, Homo sapien
ggttcttatctgctagccttttaca

SEQ ID NO: 542418 - DNA, 25 bp, Homo sapien
tctgctagccttttacatacatgtg

SEQ ID NO: 542419 - DNA, 25 bp, Homo sapien
atttgtttatagactgtaggtggat

SEQ ID NO: 542420 - DNA, 25 bp, Homo sapien
gtaatgtatttgaaagtgctttgta

SEQ ID NO: 542421 - DNA, 25 bp, Homo sapien
ggtggtggcccatctcagtgacaga

SEQ ID NO: 542422 - DNA, 25 bp, Homo sapien
gtggcccatctcagtgacagacact

SEQ ID NO: 542423 - DNA, 25 bp, Homo sapien
atctcagtgacagacactcctgcaa

SEQ ID NO: 542424 - DNA, 25 bp, Homo sapien
gacagacactcctgcaacccagttt

SEQ ID NO: 542425 - DNA, 25 bp, Homo sapien
ttttccagccaccagtgggatgatg

SEQ ID NO: 542426 - DNA, 25 bp, Homo sapien
gggatgatggtatgtgccagcacat

SEQ ID NO: 542427 - DNA, 25 bp, Homo sapien
gccagcacatggtaattttggtgta

SEQ ID NO: 542428 - DNA, 25 bp, Homo sapien
ggtgtaattctaacttgggcacaac

SEQ ID NO: 542429 - DNA, 25 bp, Homo sapien
gggcacaacgaatgctatttgtcat

SEQ ID NO: 542430 - DNA, 25 bp, Homo sapien
actgaatccgaaagaaactcctatt

SEQ ID NO: 542431 - DNA, 25 bp, Homo sapien
atctctaccatatggccactggggt

SEQ ID NO: 542432 - DNA, 25 bp, Homo sapien
gtggtggcccatctcagtgacagac

SEQ ID NO: 542433 - DNA, 25 bp, Homo sapien
tggtggcccatctcagtgacagaca

SEQ ID NO: 542434 - DNA, 25 bp, Homo sapien
ggtggcccatctcagtgacagacac

SEQ ID NO: 542435 - DNA, 25 bp, Homo sapien
gtggcccatctcagtgacagacact

SEQ ID NO: 542436 - DNA, 25 bp, Homo sapien
atctcagtgacagacactcctgcaa

SEQ ID NO: 542437 - DNA, 25 bp, Homo sapien
tctcagtgacagacactcctgcaac

SEQ ID NO: 542438 - DNA, 25 bp, Homo sapien
agtgacagacactcctgcaacccag

SEQ ID NO: 542439 - DNA, 25 bp, Homo sapien
gacagacactcctgcaacccagttt

SEQ ID NO: 542440 - DNA, 25 bp, Homo sapien
acactcctgcaacccagttttccag

SEQ ID NO: 542441 - DNA, 25 bp, Homo sapien
ttttccagccaccagtgggatgatg

SEQ ID NO: 542442 - DNA, 25 bp, Homo sapien
caagattcttaatttatgctccgta

SEQ ID NO: 542443 - DNA, 25 bp, Homo sapien
tttatgctccgtaaatgctagaggc

SEQ ID NO: 542444 - DNA, 25 bp, Homo sapien
aaatgctagaggcttgggcaatacg

SEQ ID NO: 542445 - DNA, 25 bp, Homo sapien
tgggcaatacggtctgtcctgaaaa

SEQ ID NO: 542446 - DNA, 25 bp, Homo sapien
aacaggactctgtgtctcattgcct

SEQ ID NO: 542447 - DNA, 25 bp, Homo sapien
tctcattgcctctagaatccttagg

SEQ ID NO: 542448 - DNA, 25 bp, Homo sapien
aatccttaggtagcagtttctgttc

SEQ ID NO: 542449 - DNA, 25 bp, Homo sapien
ttaggtagcagtttctgttcactgt

SEQ ID NO: 542450 - DNA, 25 bp, Homo sapien
aatatctgctggacacaattacggc

SEQ ID NO: 542451 - DNA, 25 bp, Homo sapien
attacggccattacatgatgcaggt

SEQ ID NO: 542452 - DNA, 25 bp, Homo sapien
gatgcaggtgattctacctattttt

SEQ ID NO: 542453 - DNA, 25 bp, Homo sapien
tagactttaaagacactaaccatat

SEQ ID NO: 542454 - DNA, 25 bp, Homo sapien
gacactaaccatataacttttatgt

SEQ ID NO: 542455 - DNA, 25 bp, Homo sapien
tttatgtttcttccagtttctctcc

SEQ ID NO: 542456 - DNA, 25 bp, Homo sapien
tacaaaaaccactccaaagtgaagg

SEQ ID NO: 542457 - DNA, 25 bp, Homo sapien
cattttgctgcatatgcctttaaaa

SEQ ID NO: 542458 - DNA, 25 bp, Homo sapien
aaatcaatgcagtattaccattaaa

SEQ ID NO: 542459 - DNA, 25 bp, Homo sapien
atgggactctaactaaagccactta

SEQ ID NO: 542460 - DNA, 25 bp, Homo sapien
actaaagccacttaggagcagacag

SEQ ID NO: 542461 - DNA, 25 bp, Homo sapien
gcagacagcagcgttgttaggtact

SEQ ID NO: 542462 - DNA, 25 bp, Homo sapien
tgttaggtactgaagggttcttcct

SEQ ID NO: 542463 - DNA, 25 bp, Homo sapien
actgtgtgggccgatagctgtgaac

SEQ ID NO: 542464 - DNA, 25 bp, Homo sapien
gtgattattttctaaggacccttct

SEQ ID NO: 542465 - DNA, 25 bp, Homo sapien
gattattttctaaggacccttctag

SEQ ID NO: 542466 - DNA, 25 bp, Homo sapien
tttctaaggacccttctagccctgg

SEQ ID NO: 542467 - DNA, 25 bp, Homo sapien
tctaaggacccttctagccctggtt

SEQ ID NO: 542468 - DNA, 25 bp, Homo sapien
tctagccctggttttaagaaatatg

SEQ ID NO: 542469 - DNA, 25 bp, Homo sapien
gtttaatgcattaagcattagctta

SEQ ID NO: 542470 - DNA, 25 bp, Homo sapien
aaatttgaatgaaggcagatgtgaa

SEQ ID NO: 542471 - DNA, 25 bp, Homo sapien
tttgccacatgttgtaataatcatg

SEQ ID NO: 542472 - DNA, 25 bp, Homo sapien
tttttataatttagcagacactgca

SEQ ID NO: 542473 - DNA, 25 bp, Homo sapien
agcagacactgcatcttaatataag

SEQ ID NO: 542474 - DNA, 25 bp, Homo sapien
gacactgcatcttaatataagttac

SEQ ID NO: 542475 - DNA, 25 bp, Homo sapien
aaatagttcacttcaggtttgggat

SEQ ID NO: 542476 - DNA, 25 bp, Homo sapien
tcacttcaggtttgggattgagatt

SEQ ID NO: 542477 - DNA, 25 bp, Homo sapien
tagttgcaatatatttagaagctcc

SEQ ID NO: 542478 - DNA, 25 bp, Homo sapien
tagaagctcctacatgacagcacag

SEQ ID NO: 542479 - DNA, 25 bp, Homo sapien
atgacagcacagatcactgccatct

SEQ ID NO: 542480 - DNA, 25 bp, Homo sapien
cactgccatctgctgaactgctaaa

SEQ ID NO: 542481 - DNA, 25 bp, Homo sapien
ctgaactgctaaagtgcttggtgcc

SEQ ID NO: 542482 - DNA, 25 bp, Homo sapien
tgcttggtgccatgttgagaaaact

SEQ ID NO: 542483 - DNA, 25 bp, Homo sapien
aacattactgagaatgcctcacgtt

SEQ ID NO: 542484 - DNA, 25 bp, Homo sapien
gagaatgcctcacgttagcaaatac

SEQ ID NO: 542485 - DNA, 25 bp, Homo sapien
gcctcacgttagcaaatactatgaa

SEQ ID NO: 542486 - DNA, 25 bp, Homo sapien
aagttaagtctggttctgtcctaga

SEQ ID NO: 542487 - DNA, 25 bp, Homo sapien
taagtctggttctgtcctagaggaa

SEQ ID NO: 542488 - DNA, 25 bp, Homo sapien
taattcatgtcttaagttacttggg

SEQ ID NO: 542489 - DNA, 25 bp, Homo sapien
aacactttcagccacccagattaat

SEQ ID NO: 542490 - DNA, 25 bp, Homo sapien
ttcagccacccagattaattaaagt

SEQ ID NO: 542491 - DNA, 25 bp, Homo sapien
gttctgggcttagcgacagaggcaa

SEQ ID NO: 542492 - DNA, 25 bp, Homo sapien
cttagcgacagaggcaagcaaggga

SEQ ID NO: 542493 - DNA, 25 bp, Homo sapien
agcaagggactggtgtctctggtga

SEQ ID NO: 542494 - DNA, 25 bp, Homo sapien
gtttgatgtatctctgtcctatgct

SEQ ID NO: 542495 - DNA, 25 bp, Homo sapien
atgtatctctgtcctatgctggtct

SEQ ID NO: 542496 - DNA, 25 bp, Homo sapien
tctgtcctatgctggtctctcttct

SEQ ID NO: 542497 - DNA, 25 bp, Homo sapien
gagtaaacctgaagtttctgaccag

SEQ ID NO: 542498 - DNA, 25 bp, Homo sapien
ttctgaccaggacgagaagcaccgt

SEQ ID NO: 542499 - DNA, 25 bp, Homo sapien
aagcaccgtggctgagtctgtgagc

SEQ ID NO: 542500 - DNA, 25 bp, Homo sapien
gtgagccagcagattttgcgccaga

SEQ ID NO: 542501 - DNA, 25 bp, Homo sapien
ccagcagattttgcgccagaaccgg

SEQ ID NO: 542502 - DNA, 25 bp, Homo sapien
tgtgaccggcctgtggccaagacca

SEQ ID NO: 542503 - DNA, 25 bp, Homo sapien
aaggctgagggcaccgtgttcaccg

SEQ ID NO: 542504 - DNA, 25 bp, Homo sapien
ggcaccgtgttcaccgaggaagact

SEQ ID NO: 542505 - DNA, 25 bp, Homo sapien
gttccagcaggaatacttcggcagc

SEQ ID NO: 542506 - DNA, 25 bp, Homo sapien
acttcggcagctaggctccctggag

SEQ ID NO: 542507 - DNA, 25 bp, Homo sapien
tgaagaggccttcaagccctgcagc

SEQ ID NO: 542508 - DNA, 25 bp, Homo sapien
ggtgtgaatgccagcctgtgagtcc

SEQ ID NO: 542509 - DNA, 25 bp, Homo sapien
cagcctgtgagtcccggaactatgt

SEQ ID NO: 542510 - DNA, 25 bp, Homo sapien
ctgtgagtcccggaactatgtgggt

SEQ ID NO: 542511 - DNA, 25 bp, Homo sapien
gtgagtcccggaactatgtgggtac

SEQ ID NO: 542512 - DNA, 25 bp, Homo sapien
tgagtcccggaactatgtgggtacc

SEQ ID NO: 542513 - DNA, 25 bp, Homo sapien
atgtgggtacccctacccctcacag

SEQ ID NO: 542514 - DNA, 25 bp, Homo sapien
tacccctcacagaagccaagggcat

SEQ ID NO: 542515 - DNA, 25 bp, Homo sapien
cctcacagaagccaagggcatggag

SEQ ID NO: 542516 - DNA, 25 bp, Homo sapien
ggtccctccacagtgacaacggtgt

SEQ ID NO: 542517 - DNA, 25 bp, Homo sapien
gtccctccacagtgacaacggtgtg

SEQ ID NO: 542518 - DNA, 25 bp, Homo sapien
ccctccacagtgacaacggtgtggg

SEQ ID NO: 542519 - DNA, 25 bp, Homo sapien
ttctgtcatttaacctggtaaaggc

SEQ ID NO: 542520 - DNA, 25 bp, Homo sapien
agagagattttcatcgggtgcattc

SEQ ID NO: 542521 - DNA, 25 bp, Homo sapien
attttcatcgggtgcattctctctg

SEQ ID NO: 542522 - DNA, 25 bp, Homo sapien
tctctctgcttcgtgtgtgacaagt

SEQ ID NO: 542523 - DNA, 25 bp, Homo sapien
ctgcttcgtgtgtgacaagttatct

SEQ ID NO: 542524 - DNA, 25 bp, Homo sapien
acaagttatcttggctgctgagaaa

SEQ ID NO: 542525 - DNA, 25 bp, Homo sapien
tgctgagaaagagtgccctgcccca

SEQ ID NO: 542526 - DNA, 25 bp, Homo sapien
acctcatcagtatgattcagtttct

SEQ ID NO: 542527 - DNA, 25 bp, Homo sapien
ttatcaattggactctcccaggttc

SEQ ID NO: 542528 - DNA, 25 bp, Homo sapien
ctcccaggttccacagaacagtaat

SEQ ID NO: 542529 - DNA, 25 bp, Homo sapien
caataggtacaatagaaggtcttct

SEQ ID NO: 542530 - DNA, 25 bp, Homo sapien
tgtggtgactaagggccacggttat

SEQ ID NO: 542531 - DNA, 25 bp, Homo sapien
ggccacggttattgggtgaaatttg

SEQ ID NO: 542532 - DNA, 25 bp, Homo sapien
gagattgtaggccaactgtattttc

SEQ ID NO: 542533 - DNA, 25 bp, Homo sapien
aggccaactgtattttcaagcttct

SEQ ID NO: 542534 - DNA, 25 bp, Homo sapien
taggcaaaatattcatcgcaaagtc

SEQ ID NO: 542535 - DNA, 25 bp, Homo sapien
tcgcaaagtctctagcgtcatattt

SEQ ID NO: 542536 - DNA, 25 bp, Homo sapien
tctctagcgtcatatttttctcacc

SEQ ID NO: 542537 - DNA, 25 bp, Homo sapien
ccaaattacgtttccacgagattat

SEQ ID NO: 542538 - DNA, 25 bp, Homo sapien
acgtttccacgagattatttatata

SEQ ID NO: 542539 - DNA, 25 bp, Homo sapien
tgttttgggatgtcagcagtggcct

SEQ ID NO: 542540 - DNA, 25 bp, Homo sapien
cagtggcctgaagtgagttgtgcaa

SEQ ID NO: 542541 - DNA, 25 bp, Homo sapien
ccaggtatgtcaacctagttatcta

SEQ ID NO: 542542 - DNA, 25 bp, Homo sapien
atgtcaacctagttatctagtgtag

SEQ ID NO: 542543 - DNA, 25 bp, Homo sapien
agttatctagtgtagaatccttcag

SEQ ID NO: 542544 - DNA, 25 bp, Homo sapien
tctagtgtagaatccttcagagata

SEQ ID NO: 542545 - DNA, 25 bp, Homo sapien
gaatccttcagagatatttcagtct

SEQ ID NO: 542546 - DNA, 25 bp, Homo sapien
cttcagagatatttcagtctctctc

SEQ ID NO: 542547 - DNA, 25 bp, Homo sapien
ctctcttcactggatggcctgaaga

SEQ ID NO: 542548 - DNA, 25 bp, Homo sapien
ggaaaggtacaactggaattaggat

SEQ ID NO: 542549 - DNA, 25 bp, Homo sapien
acaactggaattaggattttctcct

SEQ ID NO: 542550 - DNA, 25 bp, Homo sapien
ggaattaggattttctcctgatgaa

SEQ ID NO: 542551 - DNA, 25 bp, Homo sapien
taggattttctcctgatgaaggaaa

SEQ ID NO: 542552 - DNA, 25 bp, Homo sapien
cccaccacagatcccagagataggg

SEQ ID NO: 542553 - DNA, 25 bp, Homo sapien
gagcatagagatgttttccaggaag

SEQ ID NO: 542554 - DNA, 25 bp, Homo sapien
tcagaagctgcactaggccccgagt

SEQ ID NO: 542555 - DNA, 25 bp, Homo sapien
tccccatgtgtctccttgaattgat

SEQ ID NO: 542556 - DNA, 25 bp, Homo sapien
ctccttgaattgatgaggatgctcc

SEQ ID NO: 542557 - DNA, 25 bp, Homo sapien
gctcctgggagggatgcgtgactat

SEQ ID NO: 542558 - DNA, 25 bp, Homo sapien
gcgtgactatgtggtgttgcacccg

SEQ ID NO: 542559 - DNA, 25 bp, Homo sapien
aggcccatgggctcagaccaggctt

SEQ ID NO: 542560 - DNA, 25 bp, Homo sapien
atgggctcagaccaggctttgttgt

SEQ ID NO: 542561 - DNA, 25 bp, Homo sapien
tgtcctgctctgagtatcctgagat

SEQ ID NO: 542562 - DNA, 25 bp, Homo sapien
gagtatcctgagattaaactgaatt

SEQ ID NO: 542563 - DNA, 25 bp, Homo sapien
tccaaaggacctactgttcggacaa

SEQ ID NO: 542564 - DNA, 25 bp, Homo sapien
acgaagctgtcttagagtgggacca

SEQ ID NO: 542565 - DNA, 25 bp, Homo sapien
agtgggaccaacttcctgttgatgt

SEQ ID NO: 542566 - DNA, 25 bp, Homo sapien
gtgaatgtggattcttcccacacag

SEQ ID NO: 542567 - DNA, 25 bp, Homo sapien
gtggattcttcccacacagaatata

SEQ ID NO: 542568 - DNA, 25 bp, Homo sapien
gaatatacattgtcctctttgacta

SEQ ID NO: 542569 - DNA, 25 bp, Homo sapien
tcctctttgactagtgacacattgt

SEQ ID NO: 542570 - DNA, 25 bp, Homo sapien
gactagtgacacattgtacatggta

SEQ ID NO: 542571 - DNA, 25 bp, Homo sapien
gtacatggtacgaatggcagcatac

SEQ ID NO: 542572 - DNA, 25 bp, Homo sapien
gaatggcagcatacacagatgaagg

SEQ ID NO: 542573 - DNA, 25 bp, Homo sapien
ctaccccaaagtttgctcaaggaga

SEQ ID NO: 542574 - DNA, 25 bp, Homo sapien
gcatatattttagggctgctagact

SEQ ID NO: 542575 - DNA, 25 bp, Homo sapien
tttagggctgctagacttactttcc

SEQ ID NO: 542576 - DNA, 25 bp, Homo sapien
ggctgctagacttactttcctattt

SEQ ID NO: 542577 - DNA, 25 bp, Homo sapien
ttttccaagcccttttacagctctt

SEQ ID NO: 542578 - DNA, 25 bp, Homo sapien
gcctgtgaggtaactgggatcgcac

SEQ ID NO: 542579 - DNA, 25 bp, Homo sapien
aactgggatcgcaccttttatacca

SEQ ID NO: 542580 - DNA, 25 bp, Homo sapien
taggactagaaaaacttgggtctct

SEQ ID NO: 542581 - DNA, 25 bp, Homo sapien
aacttgggtctcttaccgcgagact

SEQ ID NO: 542582 - DNA, 25 bp, Homo sapien
tcttaccgcgagactgagaggcaga

SEQ ID NO: 542583 - DNA, 25 bp, Homo sapien
agaggcagaagtcagcccgaatgcc

SEQ ID NO: 542584 - DNA, 25 bp, Homo sapien
agtcagcccgaatgcctgtcagttt

SEQ ID NO: 542585 - DNA, 25 bp, Homo sapien
gagagtcaaaccctgcaagcagaag

SEQ ID NO: 542586 - DNA, 25 bp, Homo sapien
gaaaataacaaagtcaccgtggaga

SEQ ID NO: 542587 - DNA, 25 bp, Homo sapien
gtcaccgtggagataatttcaaaac

SEQ ID NO: 542588 - DNA, 25 bp, Homo sapien
tttcattttcagatacattggacta

SEQ ID NO: 542589 - DNA, 25 bp, Homo sapien
cattggactatttcactgatgttaa

SEQ ID NO: 542590 - DNA, 25 bp, Homo sapien
gttgtttcttttttgcagcctaatg

SEQ ID NO: 542591 - DNA, 25 bp, Homo sapien
gccacgtttggagcaaggtcttatt

SEQ ID NO: 542592 - DNA, 25 bp, Homo sapien
tggagcaaggtcttatttacacctg

SEQ ID NO: 542593 - DNA, 25 bp, Homo sapien
tttacacctgccatggtcatcggct

SEQ ID NO: 542594 - DNA, 25 bp, Homo sapien
atggtcatcggctcgctcttttagg

SEQ ID NO: 542595 - DNA, 25 bp, Homo sapien
ggctcgctcttttaggtctccccaa

SEQ ID NO: 542596 - DNA, 25 bp, Homo sapien
tgtgacccacacagcttctgggctc

SEQ ID NO: 542597 - DNA, 25 bp, Homo sapien
tctgcctctgctctaagaagtgctg

SEQ ID NO: 542598 - DNA, 25 bp, Homo sapien
ggacatgctgttgggaatgtacacc

SEQ ID NO: 542599 - DNA, 25 bp, Homo sapien
tgttgggaatgtacacctgggcaga

SEQ ID NO: 542600 - DNA, 25 bp, Homo sapien
cctgttaagatgtgactgtagccac

SEQ ID NO: 542601 - DNA, 25 bp, Homo sapien
gtagccacagccagggatgggatcc

SEQ ID NO: 542602 - DNA, 25 bp, Homo sapien
gatgggatccctgggtctctggaat

SEQ ID NO: 542603 - DNA, 25 bp, Homo sapien
atccctgggtctctggaatctgaaa

SEQ ID NO: 542604 - DNA, 25 bp, Homo sapien
tctctggaatctgaaacctcaacaa

SEQ ID NO: 542605 - DNA, 25 bp, Homo sapien
aacaaataccagtcttgacccctag

SEQ ID NO: 542606 - DNA, 25 bp, Homo sapien
gggttggtttgctattaagtcagat

SEQ ID NO: 542607 - DNA, 25 bp, Homo sapien
gtgttttaaacttgcattggaatgg

SEQ ID NO: 542608 - DNA, 25 bp, Homo sapien
aacttgcattggaatggactccgaa

SEQ ID NO: 542609 - DNA, 25 bp, Homo sapien
ttggaatggactccgaatgtatttt

SEQ ID NO: 542610 - DNA, 25 bp, Homo sapien
tgtggtgttacgttatccgtagatt

SEQ ID NO: 542611 - DNA, 25 bp, Homo sapien
tacgttatccgtagatttctagcat

SEQ ID NO: 542612 - DNA, 25 bp, Homo sapien
gtagatttctagcatgaagttagcc

SEQ ID NO: 542613 - DNA, 25 bp, Homo sapien
gaagttagcctcacgatgctgtgca

SEQ ID NO: 542614 - DNA, 25 bp, Homo sapien
gttagcctcacgatgctgtgcaaag

SEQ ID NO: 542615 - DNA, 25 bp, Homo sapien
ctcacgatgctgtgcaaaggatttt

SEQ ID NO: 542616 - DNA, 25 bp, Homo sapien
ctgttcatgttaaatgctctatgga

SEQ ID NO: 542617 - DNA, 25 bp, Homo sapien
aatgctctatggattttaattaaag

SEQ ID NO: 542618 - DNA, 25 bp, Homo sapien
ggaagtacctgtaccactgtggcca

SEQ ID NO: 542619 - DNA, 25 bp, Homo sapien
gaatggcggcacatgccatatgctc

SEQ ID NO: 542620 - DNA, 25 bp, Homo sapien
acatgccatatgctcagccgggata

SEQ ID NO: 542621 - DNA, 25 bp, Homo sapien
atgctcagccgggatacctatgagt

SEQ ID NO: 542622 - DNA, 25 bp, Homo sapien
agccgggatacctatgagtgcacct

SEQ ID NO: 542623 - DNA, 25 bp, Homo sapien
gggatacctatgagtgcacctgtca

SEQ ID NO: 542624 - DNA, 25 bp, Homo sapien
atacctatgagtgcacctgtcaagt

SEQ ID NO: 542625 - DNA, 25 bp, Homo sapien
atgagtgcacctgtcaagtcgggtt

SEQ ID NO: 542626 - DNA, 25 bp, Homo sapien
gtgcacctgtcaagtcgggtttaca

SEQ ID NO: 542627 - DNA, 25 bp, Homo sapien
tgtcaagtcgggtttacaggtaagg

SEQ ID NO: 542628 - DNA, 25 bp, Homo sapien
ttacaggtaaggagtgccaatggac

SEQ ID NO: 542629 - DNA, 25 bp, Homo sapien
gctcatttagctgttaattgtggca

SEQ ID NO: 542630 - DNA, 25 bp, Homo sapien
taattgtggcaggatgtgacttttg

SEQ ID NO: 542631 - DNA, 25 bp, Homo sapien
gacttttgaaagctctgaacatata

SEQ ID NO: 542632 - DNA, 25 bp, Homo sapien
gcaacagtatgcacacttatttact

SEQ ID NO: 542633 - DNA, 25 bp, Homo sapien
cttatttactatttagctcagtgga

SEQ ID NO: 542634 - DNA, 25 bp, Homo sapien
gaaaaacagcctgctctttgagctt

SEQ ID NO: 542635 - DNA, 25 bp, Homo sapien
aatgcacttgctttaatgcttttgt

SEQ ID NO: 542636 - DNA, 25 bp, Homo sapien
gcttttgttctcaatcaatctctgg

SEQ ID NO: 542637 - DNA, 25 bp, Homo sapien
tcaatcaatctctggaagctattcc

SEQ ID NO: 542638 - DNA, 25 bp, Homo sapien
ggaagctattccaaacatggcattt

SEQ ID NO: 542639 - DNA, 25 bp, Homo sapien
gaatgtgcaaaattattctccaatg

SEQ ID NO: 542640 - DNA, 25 bp, Homo sapien
ctgacatgggctgcactcgctgagg

SEQ ID NO: 542641 - DNA, 25 bp, Homo sapien
gacatgggctgcactcgctgaggcc

SEQ ID NO: 542642 - DNA, 25 bp, Homo sapien
ggctgcactcgctgaggccaggcag

SEQ ID NO: 542643 - DNA, 25 bp, Homo sapien
tgaggccaggcagcgctgcggagag

SEQ ID NO: 542644 - DNA, 25 bp, Homo sapien
agaggagcggcagagtgggttgtct

SEQ ID NO: 542645 - DNA, 25 bp, Homo sapien
agtgggttgtctgccgcaggcaacc

SEQ ID NO: 542646 - DNA, 25 bp, Homo sapien
gtctgccgcaggcaaccaggcaagt

SEQ ID NO: 542647 - DNA, 25 bp, Homo sapien
ccgcaggcaaccaggcaagtgtgtc

SEQ ID NO: 542648 - DNA, 25 bp, Homo sapien
gaatgccagcctgtgagtcccggaa

SEQ ID NO: 542649 - DNA, 25 bp, Homo sapien
ggtccctccacagtgacaacggtgt

SEQ ID NO: 542650 - DNA, 25 bp, Homo sapien
agtgcctatgtgatcacctcttaaa

SEQ ID NO: 542651 - DNA, 25 bp, Homo sapien
taccacacaccaaacacaaacatga

SEQ ID NO: 542652 - DNA, 25 bp, Homo sapien
atctccaaatggaccagaggcctaa

SEQ ID NO: 542653 - DNA, 25 bp, Homo sapien
ggaccagaggcctaaacataaacca

SEQ ID NO: 542654 - DNA, 25 bp, Homo sapien
gggataatttgtgcctcccagtcac

SEQ ID NO: 542655 - DNA, 25 bp, Homo sapien
tttgtgcctcccagtcacacatttt

SEQ ID NO: 542656 - DNA, 25 bp, Homo sapien
tctgccttcagtgtatggatatcac

SEQ ID NO: 542657 - DNA, 25 bp, Homo sapien
ggatatcactggcaatgctgctcat

SEQ ID NO: 542658 - DNA, 25 bp, Homo sapien
tggcaatgctgctcatcaacccagc

SEQ ID NO: 542659 - DNA, 25 bp, Homo sapien
atcaacccagcctagcaggtgaagg

SEQ ID NO: 542660 - DNA, 25 bp, Homo sapien
aggaacaggctagacagggttgcca

SEQ ID NO: 542661 - DNA, 25 bp, Homo sapien
aggctagatgcctatccatttggaa

SEQ ID NO: 542662 - DNA, 25 bp, Homo sapien
tcggctactacctggatggaaggca

SEQ ID NO: 542663 - DNA, 25 bp, Homo sapien
aaggcacagggattcttagtagtct

SEQ ID NO: 542664 - DNA, 25 bp, Homo sapien
aagaagagtgccactaggcatcccc

SEQ ID NO: 542665 - DNA, 25 bp, Homo sapien
cctctcagtcatgtctccaaatgag

SEQ ID NO: 542666 - DNA, 25 bp, Homo sapien
tccaaatgagccctctgacgatgag

SEQ ID NO: 542667 - DNA, 25 bp, Homo sapien
ggaaggctcctcagattacaagtgt

SEQ ID NO: 542668 - DNA, 25 bp, Homo sapien
tacaagtgtagactctgtgaacagt

SEQ ID NO: 542669 - DNA, 25 bp, Homo sapien
ccctcaggaaccaaatggcccaagt

SEQ ID NO: 542670 - DNA, 25 bp, Homo sapien
atggcccaagttgggagggcacctc

SEQ ID NO: 542671 - DNA, 25 bp, Homo sapien
ggcacctctgggaatgtcacattta

SEQ ID NO: 542672 - DNA, 25 bp, Homo sapien
gtcacatttacatcttcggctacta

SEQ ID NO: 542673 - DNA, 25 bp, Homo sapien
cctgtgatgatagcttcttcccatg

SEQ ID NO: 542674 - DNA, 25 bp, Homo sapien
gaggagtctagcaatccaagcgcag

SEQ ID NO: 542675 - DNA, 25 bp, Homo sapien
tgatgatagcttcttcccatgtggg

SEQ ID NO: 542676 - DNA, 25 bp, Homo sapien
ggtcagtgctccgagtcccagggct

SEQ ID NO: 542677 - DNA, 25 bp, Homo sapien
gagtcccagggctcagaaccagcag

SEQ ID NO: 542678 - DNA, 25 bp, Homo sapien
tcagaaccagcagggcgaccacatg

SEQ ID NO: 542679 - DNA, 25 bp, Homo sapien
agcagggcgaccacatgagcgagcc

SEQ ID NO: 542680 - DNA, 25 bp, Homo sapien
cgcaagcatgcccatggccagaggg

SEQ ID NO: 542681 - DNA, 25 bp, Homo sapien
gaatggtccaaacccggaaggagct

SEQ ID NO: 542682 - DNA, 25 bp, Homo sapien
caaacccggaaggagctaatggaga

SEQ ID NO: 542683 - DNA, 25 bp, Homo sapien
agctaatggagaggatagggccaaa

SEQ ID NO: 542684 - DNA, 25 bp, Homo sapien
gctggaaatatgctggtcaagaaaa

SEQ ID NO: 542685 - DNA, 25 bp, Homo sapien
gtcaagaaaattcagcctttagcaa

SEQ ID NO: 542686 - DNA, 25 bp, Homo sapien
ttagcaaaagccacttccagatcag

SEQ ID NO: 542687 - DNA, 25 bp, Homo sapien
gccacttccagatcaggctgtaaag

SEQ ID NO: 542688 - DNA, 25 bp, Homo sapien
aaagttgatcttggaggttttgctg

SEQ ID NO: 542689 - DNA, 25 bp, Homo sapien
aaaagcagctggtttcaaagatccc

SEQ ID NO: 542690 - DNA, 25 bp, Homo sapien
tctggcctctggaacagatggcgtt

SEQ ID NO: 542691 - DNA, 25 bp, Homo sapien
acagatggcgttggaactaaactaa

SEQ ID NO: 542692 - DNA, 25 bp, Homo sapien
gagtttgacttacaaggaatctgga

SEQ ID NO: 542693 - DNA, 25 bp, Homo sapien
gaatctggagtagatatcgcagctg

SEQ ID NO: 542694 - DNA, 25 bp, Homo sapien
gtagatatcgcagctggaaatatgc

SEQ ID NO: 542695 - DNA, 25 bp, Homo sapien
gaggaagaggagtctagcaatccaa

SEQ ID NO: 542696 - DNA, 25 bp, Homo sapien
aagaggagtctagcaatccaagcgc

SEQ ID NO: 542697 - DNA, 25 bp, Homo sapien
gaggagtctagcaatccaagcgcag

SEQ ID NO: 542698 - DNA, 25 bp, Homo sapien
ggagtctagcaatccaagcgcaggg

SEQ ID NO: 542699 - DNA, 25 bp, Homo sapien
ccaagcgcaggggtcagtgctccga

SEQ ID NO: 542700 - DNA, 25 bp, Homo sapien
ctccgagtcccagggctcagaacca

SEQ ID NO: 542701 - DNA, 25 bp, Homo sapien
tcagaaccagcagggcgaccacatg

SEQ ID NO: 542702 - DNA, 25 bp, Homo sapien
aaccagcagggcgaccacatgagcg

SEQ ID NO: 542703 - DNA, 25 bp, Homo sapien
accagcagggcgaccacatgagcga

SEQ ID NO: 542704 - DNA, 25 bp, Homo sapien
agcagggcgaccacatgagcgagcc

SEQ ID NO: 542705 - DNA, 25 bp, Homo sapien
gggcgccggcgctgtagcagggatc

SEQ ID NO: 542706 - DNA, 25 bp, Homo sapien
gtaagtgttgtatgtaccgttgatg

SEQ ID NO: 542707 - DNA, 25 bp, Homo sapien
gtatgtaccgttgatgttgataaaa

SEQ ID NO: 542708 - DNA, 25 bp, Homo sapien
aaagctaaacaaaacttgcatgcag

SEQ ID NO: 542709 - DNA, 25 bp, Homo sapien
cttttgactgtttccagagtgctta

SEQ ID NO: 542710 - DNA, 25 bp, Homo sapien
tgactgtttccagagtgcttataat

SEQ ID NO: 542711 - DNA, 25 bp, Homo sapien
gcttataatatacataactccctgg

SEQ ID NO: 542712 - DNA, 25 bp, Homo sapien
taatatacataactccctggaaata

SEQ ID NO: 542713 - DNA, 25 bp, Homo sapien
cctggaaataactgagcactttgaa

SEQ ID NO: 542714 - DNA, 25 bp, Homo sapien
atatttctagtatggcacatgatat

SEQ ID NO: 542715 - DNA, 25 bp, Homo sapien
agtatggcacatgatatgagtcact

SEQ ID NO: 542716 - DNA, 25 bp, Homo sapien
atggtgtatgacagttagagatgct

SEQ ID NO: 542717 - DNA, 25 bp, Homo sapien
ttgcttcaaaagcagtggactgtct

SEQ ID NO: 542718 - DNA, 25 bp, Homo sapien
cagtggactgtcttttggattcaaa

SEQ ID NO: 542719 - DNA, 25 bp, Homo sapien
tggattcaaagtgggcaaaggccaa

SEQ ID NO: 542720 - DNA, 25 bp, Homo sapien
gaggaagctttatttacaaccaggg

SEQ ID NO: 542721 - DNA, 25 bp, Homo sapien
agctttatttacaaccagggagtct

SEQ ID NO: 542722 - DNA, 25 bp, Homo sapien
accagggagtctgtggttgactact

SEQ ID NO: 542723 - DNA, 25 bp, Homo sapien
gagtctgtggttgactactgcaaca

SEQ ID NO: 542724 - DNA, 25 bp, Homo sapien
gactactgcaacaggcttttaaaga

SEQ ID NO: 542725 - DNA, 25 bp, Homo sapien
caacatggcggaacgcaggagacac

SEQ ID NO: 542726 - DNA, 25 bp, Homo sapien
tggcggaacgcaggagacacaagaa

SEQ ID NO: 542727 - DNA, 25 bp, Homo sapien
gagacacaagaagcggatccaggaa

SEQ ID NO: 542728 - DNA, 25 bp, Homo sapien
gaacatacattctcacattagtgta

SEQ ID NO: 542729 - DNA, 25 bp, Homo sapien
attctcacattagtgtactttctgg

SEQ ID NO: 542730 - DNA, 25 bp, Homo sapien
cacattagtgtactttctggtagaa

SEQ ID NO: 542731 - DNA, 25 bp, Homo sapien
tttctggtagaaagttgctgcaaaa

SEQ ID NO: 542732 - DNA, 25 bp, Homo sapien
aagttgctgcaaaaacatttgaaat

SEQ ID NO: 542733 - DNA, 25 bp, Homo sapien
gtatattaacctaatgtatgtcata

SEQ ID NO: 542734 - DNA, 25 bp, Homo sapien
ctttgtgtaagttcaagactattga

SEQ ID NO: 542735 - DNA, 25 bp, Homo sapien
caagactattgatctgtgaagttat

SEQ ID NO: 542736 - DNA, 25 bp, Homo sapien
gtgaagttattttgtaaggacatac

SEQ ID NO: 542737 - DNA, 25 bp, Homo sapien
taagtaagtttgtgtcccaggaaat

SEQ ID NO: 542738 - DNA, 25 bp, Homo sapien
accctttctaaatatgcaggccatt

SEQ ID NO: 542739 - DNA, 25 bp, Homo sapien
acccagtcagcttagtcacttagta

SEQ ID NO: 542740 - DNA, 25 bp, Homo sapien
acagaggtctgtttgatcgaaattt

SEQ ID NO: 542741 - DNA, 25 bp, Homo sapien
gaaattttcacttccaagctgtgta

SEQ ID NO: 542742 - DNA, 25 bp, Homo sapien
ctgtgtacactgtgggtacttaata

SEQ ID NO: 542743 - DNA, 25 bp, Homo sapien
ggtacttaataaatcctcctagact

SEQ ID NO: 542744 - DNA, 25 bp, Homo sapien
acttctgctgaatctcctcaaacct

SEQ ID NO: 542745 - DNA, 25 bp, Homo sapien
tcctcaaacctcatcacgtagacgt

SEQ ID NO: 542746 - DNA, 25 bp, Homo sapien
atcacgtagacgtctcataattctc

SEQ ID NO: 542747 - DNA, 25 bp, Homo sapien
cttccccactttcaaagaccttgag

SEQ ID NO: 542748 - DNA, 25 bp, Homo sapien
aaagaccttgagagcttttgaaact

SEQ ID NO: 542749 - DNA, 25 bp, Homo sapien
gggaacatctgatacacccagtcag

SEQ ID NO: 542750 - DNA, 25 bp, Homo sapien
aatatatctgtgaaaactgagactc

SEQ ID NO: 542751 - DNA, 25 bp, Homo sapien
agactcagattgtatgtctctaaga

SEQ ID NO: 542752 - DNA, 25 bp, Homo sapien
cagatcaagacacttaaaactttcc

SEQ ID NO: 542753 - DNA, 25 bp, Homo sapien
tacaaaacctccctgccttgacttt

SEQ ID NO: 542754 - DNA, 25 bp, Homo sapien
ttctctttctctttgcagatttcta

SEQ ID NO: 542755 - DNA, 25 bp, Homo sapien
tctttgcagatttctaggccgcttc

SEQ ID NO: 542756 - DNA, 25 bp, Homo sapien
atttctaggccgcttctgctcagtg

SEQ ID NO: 542757 - DNA, 25 bp, Homo sapien
ccgcttctgctcagtgtcttcattt

SEQ ID NO: 542758 - DNA, 25 bp, Homo sapien
tcattttcttccatatttgttttat

SEQ ID NO: 542759 - DNA, 25 bp, Homo sapien
cttttctatagttcatgttttcttt

SEQ ID NO: 542760 - DNA, 25 bp, Homo sapien
gagaccatctagtaaatgacctcat

SEQ ID NO: 542761 - DNA, 25 bp, Homo sapien
gagcaaatactgaggttcatgttgt

SEQ ID NO: 542762 - DNA, 25 bp, Homo sapien
atactgaggttcatgttgtaccaaa

SEQ ID NO: 542763 - DNA, 25 bp, Homo sapien
gaggttcatgttgtaccaaataata

SEQ ID NO: 542764 - DNA, 25 bp, Homo sapien
gtaacacgtaagaacaattgaaatt

SEQ ID NO: 542765 - DNA, 25 bp, Homo sapien
attaatgctacagccatttatcctg

SEQ ID NO: 542766 - DNA, 25 bp, Homo sapien
gctacagccatttatcctgtgttat

SEQ ID NO: 542767 - DNA, 25 bp, Homo sapien
acagccatttatcctgtgttatgtg

SEQ ID NO: 542768 - DNA, 25 bp, Homo sapien
cctgtgttatgtgttatataatctg

SEQ ID NO: 542769 - DNA, 25 bp, Homo sapien
atataatctgaaatttgtcacaatg

SEQ ID NO: 542770 - DNA, 25 bp, Homo sapien
gtcacaatgttacaatcaggaagtt

SEQ ID NO: 542771 - DNA, 25 bp, Homo sapien
aggaaaataatagcctacttgtatt

SEQ ID NO: 542772 - DNA, 25 bp, Homo sapien
gaaggaatgactctagctacaataa

SEQ ID NO: 542773 - DNA, 25 bp, Homo sapien
tgactctagctacaataatacacag

SEQ ID NO: 542774 - DNA, 25 bp, Homo sapien
atgtttaagcaggttcccttggttg

SEQ ID NO: 542775 - DNA, 25 bp, Homo sapien
taagcaggttcccttggttgttgca

SEQ ID NO: 542776 - DNA, 25 bp, Homo sapien
caggttcccttggttgttgcattaa

SEQ ID NO: 542777 - DNA, 25 bp, Homo sapien
attttagagcacagaacaacactgt

SEQ ID NO: 542778 - DNA, 25 bp, Homo sapien
caacactgtgttgatctagtaggtt

SEQ ID NO: 542779 - DNA, 25 bp, Homo sapien
tgatctagtaggtttctatttttcc

SEQ ID NO: 542780 - DNA, 25 bp, Homo sapien
acaatgcacataatactttcctgta

SEQ ID NO: 542781 - DNA, 25 bp, Homo sapien
ttcctgtatttatatcataacgtgt

SEQ ID NO: 542782 - DNA, 25 bp, Homo sapien
tttatatctgcttttgtttcaccaa

SEQ ID NO: 542783 - DNA, 25 bp, Homo sapien
cctccagtgtttggtgttgtgtaga

SEQ ID NO: 542784 - DNA, 25 bp, Homo sapien
gctgcctgtagttagtagagaagaa

SEQ ID NO: 542785 - DNA, 25 bp, Homo sapien
gtggttcttcttgtgtatttatttg

SEQ ID NO: 542786 - DNA, 25 bp, Homo sapien
gaccataagcatcatttagcagttg

SEQ ID NO: 542787 - DNA, 25 bp, Homo sapien
ttagcagttgtagccattttctagt

SEQ ID NO: 542788 - DNA, 25 bp, Homo sapien
gtagccattttctagttaactcatg

SEQ ID NO: 542789 - DNA, 25 bp, Homo sapien
gtaacataacagtattaccctttca

SEQ ID NO: 542790 - DNA, 25 bp, Homo sapien
ttaccctttcactgttctcacagga

SEQ ID NO: 542791 - DNA, 25 bp, Homo sapien
tgttctcacaggacatgtacctaat

SEQ ID NO: 542792 - DNA, 25 bp, Homo sapien
atggtacttatttatgtagtcactg

SEQ ID NO: 542793 - DNA, 25 bp, Homo sapien
gtagtcactgtatttctggattttt

SEQ ID NO: 542794 - DNA, 25 bp, Homo sapien
ttgcattttttctaactcgtgtctc

SEQ ID NO: 542795 - DNA, 25 bp, Homo sapien
gcattttttctaactcgtgtctcaa

SEQ ID NO: 542796 - DNA, 25 bp, Homo sapien
ttttttctaactcgtgtctcaagtg

SEQ ID NO: 542797 - DNA, 25 bp, Homo sapien
tttctaactcgtgtctcaagtgttt

SEQ ID NO: 542798 - DNA, 25 bp, Homo sapien
tctaactcgtgtctcaagtgtttta

SEQ ID NO: 542799 - DNA, 25 bp, Homo sapien
aatggcaaaccatataatattgtac

SEQ ID NO: 542800 - DNA, 25 bp, Homo sapien
catataatattgtacattcactgtc

SEQ ID NO: 542801 - DNA, 25 bp, Homo sapien
ttcactgtcaaaaagcaaacccttg

SEQ ID NO: 542802 - DNA, 25 bp, Homo sapien
agcaaacccttgttttgataacttg

SEQ ID NO: 542803 - DNA, 25 bp, Homo sapien
acccttgttttgataacttgttgat

SEQ ID NO: 542804 - DNA, 25 bp, Homo sapien
gttgattgataaaagttttccaaat

SEQ ID NO: 542805 - DNA, 25 bp, Homo sapien
ttgctttgccttaagagttccctag

SEQ ID NO: 542806 - DNA, 25 bp, Homo sapien
ttgccttaagagttccctagggagt

SEQ ID NO: 542807 - DNA, 25 bp, Homo sapien
taagagttccctagggagttaccag

SEQ ID NO: 542808 - DNA, 25 bp, Homo sapien
gtgtagcttttgcagcatggatcaa

SEQ ID NO: 542809 - DNA, 25 bp, Homo sapien
gcagcatggatcaaacattggctta

SEQ ID NO: 542810 - DNA, 25 bp, Homo sapien
tcaaacattggcttactgtgctaat

SEQ ID NO: 542811 - DNA, 25 bp, Homo sapien
ttggcttactgtgctaatgtgtgaa

SEQ ID NO: 542812 - DNA, 25 bp, Homo sapien
agcaggtgagctttaatgaacaaat

SEQ ID NO: 542813 - DNA, 25 bp, Homo sapien
aatgtgtattttatctgagtttgag

SEQ ID NO: 542814 - DNA, 25 bp, Homo sapien
tatctgagtttgagtagggtgcgtt

SEQ ID NO: 542815 - DNA, 25 bp, Homo sapien
agtagggtgcgttgtggattttgtt

SEQ ID NO: 542816 - DNA, 25 bp, Homo sapien
ggagtggaccattatcctcaaatat

SEQ ID NO: 542817 - DNA, 25 bp, Homo sapien
atattctatgtcacttctcatttaa

SEQ ID NO: 542818 - DNA, 25 bp, Homo sapien
aagactcttgttatgaactattaga

SEQ ID NO: 542819 - DNA, 25 bp, Homo sapien
atttgcggcaaaataaaggcctatt

SEQ ID NO: 542820 - DNA, 25 bp, Homo sapien
aataaaggcctattctactcttatt

SEQ ID NO: 542821 - DNA, 25 bp, Homo sapien
acactgtatacttgtttctctccaa

SEQ ID NO: 542822 - DNA, 25 bp, Homo sapien
gtttctctccaaagcgaaattaagt

SEQ ID NO: 542823 - DNA, 25 bp, Homo sapien
tttcaattgcctcgataagtttcca

SEQ ID NO: 542824 - DNA, 25 bp, Homo sapien
gcctcgataagtttccaagtcactg

SEQ ID NO: 542825 - DNA, 25 bp, Homo sapien
gaaatctgctgaaggttttactgta

SEQ ID NO: 542826 - DNA, 25 bp, Homo sapien
tttgtctcaatgtcaacttttttca

SEQ ID NO: 542827 - DNA, 25 bp, Homo sapien
tttatatctatttccaactgcacat

SEQ ID NO: 542828 - DNA, 25 bp, Homo sapien
aactgcacatagttgagctgtctat

SEQ ID NO: 542829 - DNA, 25 bp, Homo sapien
gagctgtctattattcaatttttcc

SEQ ID NO: 542830 - DNA, 25 bp, Homo sapien
ctactccttgtagtgtttgatgctt

SEQ ID NO: 542831 - DNA, 25 bp, Homo sapien
tagtgtttgatgcttagtgtccaca

SEQ ID NO: 542832 - DNA, 25 bp, Homo sapien
acgtcagtctgtacctcattgattt

SEQ ID NO: 542833 - DNA, 25 bp, Homo sapien
tttaatctgtcgtagttcttcctca

SEQ ID NO: 542834 - DNA, 25 bp, Homo sapien
tgtcgtagttcttcctcagctgcag

SEQ ID NO: 542835 - DNA, 25 bp, Homo sapien
gattgtgacagcaagtattttttat

SEQ ID NO: 542836 - DNA, 25 bp, Homo sapien
tttactgttccaaatacttcatctt

SEQ ID NO: 542837 - DNA, 25 bp, Homo sapien
aatacttcatctttaatgtggccac

SEQ ID NO: 542838 - DNA, 25 bp, Homo sapien
tgggcagacgactctgaacacggct

SEQ ID NO: 542839 - DNA, 25 bp, Homo sapien
tgaacacggcttcatattggccttc

SEQ ID NO: 542840 - DNA, 25 bp, Homo sapien
tattggccttccatgagtgggtgaa

SEQ ID NO: 542841 - DNA, 25 bp, Homo sapien
gtctctccagcgcttgcttattttc

SEQ ID NO: 542842 - DNA, 25 bp, Homo sapien
tgccatgggcattcagtacagtcct

SEQ ID NO: 542843 - DNA, 25 bp, Homo sapien
agtacagtcctgtaagcaagggtag

SEQ ID NO: 542844 - DNA, 25 bp, Homo sapien
ggcacaccaggtggatttaagcgca

SEQ ID NO: 542845 - DNA, 25 bp, Homo sapien
agcgcaaagacaggacgactgcttt

SEQ ID NO: 542846 - DNA, 25 bp, Homo sapien
acaggcgcctttacagccagcagtg

SEQ ID NO: 542847 - DNA, 25 bp, Homo sapien
acagccagcagtgaacagttagaca

SEQ ID NO: 542848 - DNA, 25 bp, Homo sapien
ttagacatattcaccttcctctagg

SEQ ID NO: 542849 - DNA, 25 bp, Homo sapien
gttgaagggctatagatgaatcagt

SEQ ID NO: 542850 - DNA, 25 bp, Homo sapien
gaagggctatagatgaatcagtatg

SEQ ID NO: 542851 - DNA, 25 bp, Homo sapien
gaatcagtatgtgtaaaacacttag

SEQ ID NO: 542852 - DNA, 25 bp, Homo sapien
aaacacttagaaaggggccaggcat

SEQ ID NO: 542853 - DNA, 25 bp, Homo sapien
acacttagaaaggaacttggcaagt

SEQ ID NO: 542854 - DNA, 25 bp, Homo sapien
ggaacttggcaagtagtaagttatt

SEQ ID NO: 542855 - DNA, 25 bp, Homo sapien
gcaagtagtaagttatttgtaatcc

SEQ ID NO: 542856 - DNA, 25 bp, Homo sapien
gtaagttatttgtaatccaaacact

SEQ ID NO: 542857 - DNA, 25 bp, Homo sapien
caaacactttgccagactgaagcag

SEQ ID NO: 542858 - DNA, 25 bp, Homo sapien
aaacactttgccagactgaagcagg

SEQ ID NO: 542859 - DNA, 25 bp, Homo sapien
aacactttgccagactgaagcagga

SEQ ID NO: 542860 - DNA, 25 bp, Homo sapien
attcggccgaggtctgtattctgaa

SEQ ID NO: 542861 - DNA, 25 bp, Homo sapien
atggcctgtgaaacacgtggattct

SEQ ID NO: 542862 - DNA, 25 bp, Homo sapien
acgtggattctgttgcactggattt

SEQ ID NO: 542863 - DNA, 25 bp, Homo sapien
ataaatgacgctgaacttcctgctt

SEQ ID NO: 542864 - DNA, 25 bp, Homo sapien
agctcaaccctgatgctgaactgac

SEQ ID NO: 542865 - DNA, 25 bp, Homo sapien
gatgctgaactgacaccaggcgaat

SEQ ID NO: 542866 - DNA, 25 bp, Homo sapien
ccaggcgaatgtcagggctcccaaa

SEQ ID NO: 542867 - DNA, 25 bp, Homo sapien
aaccactagtgccaaagggtcatgt

SEQ ID NO: 542868 - DNA, 25 bp, Homo sapien
accttagtatttttgcactttacag

SEQ ID NO: 542869 - DNA, 25 bp, Homo sapien
actgtttttcagtggcttgagcgtt

SEQ ID NO: 542870 - DNA, 25 bp, Homo sapien
gtggcttgagcgttttgccttttca

SEQ ID NO: 542871 - DNA, 25 bp, Homo sapien
catggtggctaagggctacggttat

SEQ ID NO: 542872 - DNA, 25 bp, Homo sapien
aagggctacggttatcaggtgaaat

SEQ ID NO: 542873 - DNA, 25 bp, Homo sapien
aatttgagatttgtaggctgactat

SEQ ID NO: 542874 - DNA, 25 bp, Homo sapien
atttgtaggctgactatattttcaa

SEQ ID NO: 542875 - DNA, 25 bp, Homo sapien
tgcaaaatattcatcccaaagcctc

SEQ ID NO: 542876 - DNA, 25 bp, Homo sapien
aaagcctctagcgtcatagtttcct

SEQ ID NO: 542877 - DNA, 25 bp, Homo sapien
tcatagtttcctcacccaaattact

SEQ ID NO: 542878 - DNA, 25 bp, Homo sapien
attactatgtttccacaagatttat

SEQ ID NO: 542879 - DNA, 25 bp, Homo sapien
atatagttggtctatctctgcggtc

SEQ ID NO: 542880 - DNA, 25 bp, Homo sapien
ctgcggtccttgaaagtgaagttgg

SEQ ID NO: 542881 - DNA, 25 bp, Homo sapien
ttggtgttactaggctgtgggtttt

SEQ ID NO: 542882 - DNA, 25 bp, Homo sapien
gacaagaagctgggtatttgggttt

SEQ ID NO: 542883 - DNA, 25 bp, Homo sapien
gattttcttgactctgagcttgtat

SEQ ID NO: 542884 - DNA, 25 bp, Homo sapien
gactctgagcttgtatcagtatttc

SEQ ID NO: 542885 - DNA, 25 bp, Homo sapien
gtatcagtatttctagcttttgttt

SEQ ID NO: 542886 - DNA, 25 bp, Homo sapien
agcttttgttttgtctgacagtatt

SEQ ID NO: 542887 - DNA, 25 bp, Homo sapien
ttgtctgacagtattgcagtcttga

SEQ ID NO: 542888 - DNA, 25 bp, Homo sapien
gacagtattgcagtcttgaaaatcc

SEQ ID NO: 542889 - DNA, 25 bp, Homo sapien
gcagtcttgaaaatcctgagagcta

SEQ ID NO: 542890 - DNA, 25 bp, Homo sapien
aaatcctgagagctaaaaaactgaa

SEQ ID NO: 542891 - DNA, 25 bp, Homo sapien
gtagatcactatggtatttcaattt

SEQ ID NO: 542892 - DNA, 25 bp, Homo sapien
atatagccacaaactggacaagaag

SEQ ID NO: 542893 - DNA, 25 bp, Homo sapien
aatcaatgaggtacagactgacgtg

SEQ ID NO: 542894 - DNA, 25 bp, Homo sapien
ggacactaagcatcaaacactacaa

SEQ ID NO: 542895 - DNA, 25 bp, Homo sapien
taatagacagctcaactatgtgcag

SEQ ID NO: 542896 - DNA, 25 bp, Homo sapien
tggccaacacaacaaatacagaact

SEQ ID NO: 542897 - DNA, 25 bp, Homo sapien
tacagaactgaaagatttgccaaag

SEQ ID NO: 542898 - DNA, 25 bp, Homo sapien
gatttgccaaagaggattcccaagg

SEQ ID NO: 542899 - DNA, 25 bp, Homo sapien
gattcccaaggattcagctcgttac

SEQ ID NO: 542900 - DNA, 25 bp, Homo sapien
aaggattcagctcgttaccatttct

SEQ ID NO: 542901 - DNA, 25 bp, Homo sapien
gctcgttaccatttctttctgtata

SEQ ID NO: 542902 - DNA, 25 bp, Homo sapien
tttctgtataaacattcccatgaag

SEQ ID NO: 542903 - DNA, 25 bp, Homo sapien
tcccatgaaggagactatttagagt

SEQ ID NO: 542904 - DNA, 25 bp, Homo sapien
atacaatgggaacagaataggtcta

SEQ ID NO: 542905 - DNA, 25 bp, Homo sapien
aaaaactgacaggtgaccgatgtac

SEQ ID NO: 542906 - DNA, 25 bp, Homo sapien
ggtgaccgatgtacaggactttcct

SEQ ID NO: 542907 - DNA, 25 bp, Homo sapien
gatgtacaggactttcctctaaaat

SEQ ID NO: 542908 - DNA, 25 bp, Homo sapien
gaggagaacagtgagagtgctctac

SEQ ID NO: 542909 - DNA, 25 bp, Homo sapien
gtgagagtgctctacggaaacgtat

SEQ ID NO: 542910 - DNA, 25 bp, Homo sapien
ctacggaaacgtattcgagaggaca

SEQ ID NO: 542911 - DNA, 25 bp, Homo sapien
attcgagaggacagaaaggccacca

SEQ ID NO: 542912 - DNA, 25 bp, Homo sapien
gaaaggccaccacagctcagaaggt

SEQ ID NO: 542913 - DNA, 25 bp, Homo sapien
ggccaccacagctcagaaggtgcag

SEQ ID NO: 542914 - DNA, 25 bp, Homo sapien
ggtgcagcagatgaaacagaggcta

SEQ ID NO: 542915 - DNA, 25 bp, Homo sapien
ctgacatgggctgcactcgctgagg

SEQ ID NO: 542916 - DNA, 25 bp, Homo sapien
tgacatgggctgcactcgctgaggc

SEQ ID NO: 542917 - DNA, 25 bp, Homo sapien
gacatgggctgcactcgctgaggcc

SEQ ID NO: 542918 - DNA, 25 bp, Homo sapien
ggctgcactcgctgaggccaggcag

SEQ ID NO: 542919 - DNA, 25 bp, Homo sapien
agaggagcggcagagtgggttgtct

SEQ ID NO: 542920 - DNA, 25 bp, Homo sapien
aggagcggcagagtgggttgtctgc

SEQ ID NO: 542921 - DNA, 25 bp, Homo sapien
gcagagtgggttgtctgccgcaggc

SEQ ID NO: 542922 - DNA, 25 bp, Homo sapien
gtctgccgcaggcaaccaggcaagt

SEQ ID NO: 542923 - DNA, 25 bp, Homo sapien
tctgccgcaggcaaccaggcaagtg

SEQ ID NO: 542924 - DNA, 25 bp, Homo sapien
ctgccgcaggcaaccaggcaagtgt

SEQ ID NO: 542925 - DNA, 25 bp, Homo sapien
ccgcaggcaaccaggcaagtgtgtc

SEQ ID NO: 542926 - DNA, 25 bp, Homo sapien
gaagacttttatgtgctcattttgt

SEQ ID NO: 542927 - DNA, 25 bp, Homo sapien
aaatatctttacattgtctgccaat

SEQ ID NO: 542928 - DNA, 25 bp, Homo sapien
gtgttttaaacttgcattggaatgg

SEQ ID NO: 542929 - DNA, 25 bp, Homo sapien
aacttgcattggaatggactccgaa

SEQ ID NO: 542930 - DNA, 25 bp, Homo sapien
ttggaatggactccgaatgtatttt

SEQ ID NO: 542931 - DNA, 25 bp, Homo sapien
tgtggtgttacgttatccgtagatt

SEQ ID NO: 542932 - DNA, 25 bp, Homo sapien
tacgttatccgtagatttctagcat

SEQ ID NO: 542933 - DNA, 25 bp, Homo sapien
gtagatttctagcatgaagttagcc

SEQ ID NO: 542934 - DNA, 25 bp, Homo sapien
gaagttagcctcacgatgctgtgca

SEQ ID NO: 542935 - DNA, 25 bp, Homo sapien
gcctcacgatgctgtgcaaaggatt

SEQ ID NO: 542936 - DNA, 25 bp, Homo sapien
ctgttcatgttaaatgctctatgga

SEQ ID NO: 542937 - DNA, 25 bp, Homo sapien
gcagcaaagggcgaatccagcggca

SEQ ID NO: 542938 - DNA, 25 bp, Homo sapien
ttggagagtggcaacccggccatct

SEQ ID NO: 542939 - DNA, 25 bp, Homo sapien
gccatcttcacttctgggatcattg

SEQ ID NO: 542940 - DNA, 25 bp, Homo sapien
gggatcattgactcacagatttcca

SEQ ID NO: 542941 - DNA, 25 bp, Homo sapien
cacagatttccaagcaagccctcag

SEQ ID NO: 542942 - DNA, 25 bp, Homo sapien
gattgagggacgacacaaggacatt

SEQ ID NO: 542943 - DNA, 25 bp, Homo sapien
gcagcatcaaggagcttcacgacat

SEQ ID NO: 542944 - DNA, 25 bp, Homo sapien
aggagcttcacgacatgtttatgga

SEQ ID NO: 542945 - DNA, 25 bp, Homo sapien
tgtttatggacatcgccatgctggt

SEQ ID NO: 542946 - DNA, 25 bp, Homo sapien
gataattatcattgtgctagtagtt

SEQ ID NO: 542947 - DNA, 25 bp, Homo sapien
tgctagtagttgtgttgctgggcat

SEQ ID NO: 542948 - DNA, 25 bp, Homo sapien
gggccgtacttgaccctgattctca

SEQ ID NO: 542949 - DNA, 25 bp, Homo sapien
gaccctgattctcatcaggcacaga

SEQ ID NO: 542950 - DNA, 25 bp, Homo sapien
tcaggcacagatgaatcacaggcac

SEQ ID NO: 542951 - DNA, 25 bp, Homo sapien
tcacaggcacctaagaatcggcaca

SEQ ID NO: 542952 - DNA, 25 bp, Homo sapien
gaatcggcacagaacttccatgagg

SEQ ID NO: 542953 - DNA, 25 bp, Homo sapien
ttccatgaggcctcagtcagcattt

SEQ ID NO: 542954 - DNA, 25 bp, Homo sapien
gagctgaggccattcaaggaggcta

SEQ ID NO: 542955 - DNA, 25 bp, Homo sapien
gaagagtctatagtcatcaagttgt

SEQ ID NO: 542956 - DNA, 25 bp, Homo sapien
atcaagttgtatccatgccagcctc

SEQ ID NO: 542957 - DNA, 25 bp, Homo sapien
cacccactgggtaggtgcttcataa

SEQ ID NO: 542958 - DNA, 25 bp, Homo sapien
gcttcataaagctttaccgagttaa

SEQ ID NO: 542959 - DNA, 25 bp, Homo sapien
gaatgttttaaactactgggcactg

SEQ ID NO: 542960 - DNA, 25 bp, Homo sapien
ggaggctttattgaacattcccctt

SEQ ID NO: 542961 - DNA, 25 bp, Homo sapien
tttattgaacattcccctttttcag

SEQ ID NO: 542962 - DNA, 25 bp, Homo sapien
ttcagttggttcaaagttcagcact

SEQ ID NO: 542963 - DNA, 25 bp, Homo sapien
gttcagcactgtggttatcattggt

SEQ ID NO: 542964 - DNA, 25 bp, Homo sapien
gtggttatcattggtgatgccagaa

SEQ ID NO: 542965 - DNA, 25 bp, Homo sapien
tgccagaaaacattagtagacttag

SEQ ID NO: 542966 - DNA, 25 bp, Homo sapien
agacttagacaattgctatggcagt

SEQ ID NO: 542967 - DNA, 25 bp, Homo sapien
gctatggcagtttctaaacagagct

SEQ ID NO: 542968 - DNA, 25 bp, Homo sapien
aaacagagctttttctatacactat

SEQ ID NO: 542969 - DNA, 25 bp, Homo sapien
ttctatacactatttgcaactggag

SEQ ID NO: 542970 - DNA, 25 bp, Homo sapien
gcagcagattgtaatttggtttatt

SEQ ID NO: 542971 - DNA, 25 bp, Homo sapien
attggatgtgatggacgttctgtaa

SEQ ID NO: 542972 - DNA, 25 bp, Homo sapien
ggacgttctgtaatagaaaacctga

SEQ ID NO: 542973 - DNA, 25 bp, Homo sapien
aaacctgaaacgatgattgaatggg

SEQ ID NO: 542974 - DNA, 25 bp, Homo sapien
tttgtcgtaggatgtatacagactt

SEQ ID NO: 542975 - DNA, 25 bp, Homo sapien
gtttcctgtgtcaagtatttgtgca

SEQ ID NO: 542976 - DNA, 25 bp, Homo sapien
tcaagtatttgtgcagtcagagctg

SEQ ID NO: 542977 - DNA, 25 bp, Homo sapien
gtcagagctgacttgtaaactattc

SEQ ID NO: 542978 - DNA, 25 bp, Homo sapien
agctgacttgtaaactattcttgta

SEQ ID NO: 542979 - DNA, 25 bp, Homo sapien
attcttgtaatagctcattattttg

SEQ ID NO: 542980 - DNA, 25 bp, Homo sapien
gatgaattctggatatatgaccaat

SEQ ID NO: 542981 - DNA, 25 bp, Homo sapien
gaactgggacattggcaccctggat

SEQ ID NO: 542982 - DNA, 25 bp, Homo sapien
ggcaccctggatttgaatatctaga

SEQ ID NO: 542983 - DNA, 25 bp, Homo sapien
gagagggcacccaatggtcatacta

SEQ ID NO: 542984 - DNA, 25 bp, Homo sapien
aatgtttgccataacagtctcttct

SEQ ID NO: 542985 - DNA, 25 bp, Homo sapien
gcagccaagagagagcattccctag

SEQ ID NO: 542986 - DNA, 25 bp, Homo sapien
cagtctcttctaggtctagacttga

SEQ ID NO: 542987 - DNA, 25 bp, Homo sapien
catatggaagggtccttgggctaga

SEQ ID NO: 542988 - DNA, 25 bp, Homo sapien
tgactcccttttaatacttctaatt

SEQ ID NO: 542989 - DNA, 25 bp, Homo sapien
tgaagatctggtcttctccctacca

SEQ ID NO: 542990 - DNA, 25 bp, Homo sapien
aggtgaggagtctccagtggcccaa

SEQ ID NO: 542991 - DNA, 25 bp, Homo sapien
ggaggttacactgccgaactgggac

SEQ ID NO: 542992 - DNA, 25 bp, Homo sapien
tgagacaggccgctgatgatgcaca

SEQ ID NO: 542993 - DNA, 25 bp, Homo sapien
gatgatgcacaggacttgcggtaca

SEQ ID NO: 542994 - DNA, 25 bp, Homo sapien
gacttgcggtacatgatccctgtaa

SEQ ID NO: 542995 - DNA, 25 bp, Homo sapien
gagctgagttaacgtgcaccggcaa

SEQ ID NO: 542996 - DNA, 25 bp, Homo sapien
ggcaaaagaatagctgtccctctca

SEQ ID NO: 542997 - DNA, 25 bp, Homo sapien
gcccaaatccaaacggacagctctt

SEQ ID NO: 542998 - DNA, 25 bp, Homo sapien
acagcccagagactaggtgaggtca

SEQ ID NO: 542999 - DNA, 25 bp, Homo sapien
gaagtgcttcggattgtctcattga

SEQ ID NO: 543000 - DNA, 25 bp, Homo sapien
aaagagacaggcactatttcattag

SEQ ID NO: 543001 - DNA, 25 bp, Homo sapien
aagcgatttgagatgccaatacctg

SEQ ID NO: 543002 - DNA, 25 bp, Homo sapien
gatgccaatacctgtgaatacctgt

SEQ ID NO: 543003 - DNA, 25 bp, Homo sapien
aatattttcagattctagagtattt

SEQ ID NO: 543004 - DNA, 25 bp, Homo sapien
ataattcctacttatgttagctatg

SEQ ID NO: 543005 - DNA, 25 bp, Homo sapien
gttagctatgatttagggccaaaac

SEQ ID NO: 543006 - DNA, 25 bp, Homo sapien
tgatttagggccaaaactaccctgg

SEQ ID NO: 543007 - DNA, 25 bp, Homo sapien
actaccctggttttgtcttgcaact

SEQ ID NO: 543008 - DNA, 25 bp, Homo sapien
gtcttgcaacttgaaacattgtgta

SEQ ID NO: 543009 - DNA, 25 bp, Homo sapien
gaaacattgtgtattttaaactata

SEQ ID NO: 543010 - DNA, 25 bp, Homo sapien
tattttatagactgtggataaccaa

SEQ ID NO: 543011 - DNA, 25 bp, Homo sapien
ctgtggataaccaaatataagattt

SEQ ID NO: 543012 - DNA, 25 bp, Homo sapien
gtgatttttaatgcttcatttgtgt

SEQ ID NO: 543013 - DNA, 25 bp, Homo sapien
atgcattttctagctcattaaaagt

SEQ ID NO: 543014 - DNA, 25 bp, Homo sapien
agttgtgcttcctttgaggctatta

SEQ ID NO: 543015 - DNA, 25 bp, Homo sapien
tgtgcttcctttgaggctattaggg

SEQ ID NO: 543016 - DNA, 25 bp, Homo sapien
ttttaggatgggtgtgggtaactca

SEQ ID NO: 543017 - DNA, 25 bp, Homo sapien
gggtgtgggtaactcatctacctaa

SEQ ID NO: 543018 - DNA, 25 bp, Homo sapien
taactcatctacctaaacttttaat

SEQ ID NO: 543019 - DNA, 25 bp, Homo sapien
taatttctttacaacattcagcaag

SEQ ID NO: 543020 - DNA, 25 bp, Homo sapien
ctttacaacattcagcaagagaggg

SEQ ID NO: 543021 - DNA, 25 bp, Homo sapien
gggtcagtagtctctatctgctaat

SEQ ID NO: 543022 - DNA, 25 bp, Homo sapien
agtctctatctgctaataaatgaag

SEQ ID NO: 543023 - DNA, 25 bp, Homo sapien
ttctgaagctggatgctcaaaaatt

SEQ ID NO: 543024 - DNA, 25 bp, Homo sapien
ctggatgctcaaaaattaaaacgtt

SEQ ID NO: 543025 - DNA, 25 bp, Homo sapien
aatggtagtaagtgccaaggcccca

SEQ ID NO: 543026 - DNA, 25 bp, Homo sapien
aaggccccagaaccctcatgtttgg

SEQ ID NO: 543027 - DNA, 25 bp, Homo sapien
atgtttgggtccgactcccacattg

SEQ ID NO: 543028 - DNA, 25 bp, Homo sapien
attgccagagactaggcagctcaca

SEQ ID NO: 543029 - DNA, 25 bp, Homo sapien
gtctttctcacaggccgcattgaag

SEQ ID NO: 543030 - DNA, 25 bp, Homo sapien
tcatccgtagtgacagggctggcct

SEQ ID NO: 543031 - DNA, 25 bp, Homo sapien
tttgatcatgatagcttccactccg

SEQ ID NO: 543032 - DNA, 25 bp, Homo sapien
atagcttccactccgtgactggtca

SEQ ID NO: 543033 - DNA, 25 bp, Homo sapien
gtgactggtcacgatctgccaggcg

SEQ ID NO: 543034 - DNA, 25 bp, Homo sapien
caggcgctgtgctaaacactttcat

SEQ ID NO: 543035 - DNA, 25 bp, Homo sapien
taaacactttcataggccttgtccc

SEQ ID NO: 543036 - DNA, 25 bp, Homo sapien
gattatactcactcaaggcagtgca

SEQ ID NO: 543037 - DNA, 25 bp, Homo sapien
ggcagtgcaagatcttgaagtactt

SEQ ID NO: 543038 - DNA, 25 bp, Homo sapien
gtgcatgtcattgacatctgcctta

SEQ ID NO: 543039 - DNA, 25 bp, Homo sapien
gacatctgccttagaacttctggga

SEQ ID NO: 543040 - DNA, 25 bp, Homo sapien
acttctgggacaatcctgattcgag

SEQ ID NO: 543041 - DNA, 25 bp, Homo sapien
ctgattcgagagattctatcccatt

SEQ ID NO: 543042 - DNA, 25 bp, Homo sapien
gagattctatcccattatttacata

SEQ ID NO: 543043 - DNA, 25 bp, Homo sapien
gttaatttaatgtgttggcttccca

SEQ ID NO: 543044 - DNA, 25 bp, Homo sapien
ttaatgtgttggcttcccaactcct

SEQ ID NO: 543045 - DNA, 25 bp, Homo sapien
actcctgaacacgacacaattttat

SEQ ID NO: 543046 - DNA, 25 bp, Homo sapien
tttgtatggtgattttaggctatga

SEQ ID NO: 543047 - DNA, 25 bp, Homo sapien
gagtgcaacactgaagtgagcttac

SEQ ID NO: 543048 - DNA, 25 bp, Homo sapien
gcaacactgaagtgagcttacttta

SEQ ID NO: 543049 - DNA, 25 bp, Homo sapien
acactgaagtgagcttactttaatt

SEQ ID NO: 543050 - DNA, 25 bp, Homo sapien
ttaatttgtaagtgaagctgttgct

SEQ ID NO: 543051 - DNA, 25 bp, Homo sapien
gaagctgttgctgaacatgaccact

SEQ ID NO: 543052 - DNA, 25 bp, Homo sapien
aagctgttgctgaacatgaccacta

SEQ ID NO: 543053 - DNA, 25 bp, Homo sapien
gaacatgaccactatcgttgctgaa

SEQ ID NO: 543054 - DNA, 25 bp, Homo sapien
acatgaccactatcgttgctgaaat

SEQ ID NO: 543055 - DNA, 25 bp, Homo sapien
atgaccactatcgttgctgaaatat

SEQ ID NO: 543056 - DNA, 25 bp, Homo sapien
tatactcactgattgtaatggttga

SEQ ID NO: 543057 - DNA, 25 bp, Homo sapien
actcactgattgtaatggttgaaat

SEQ ID NO: 543058 - DNA, 25 bp, Homo sapien
ttgacttctgctcaaatatgtgttg

SEQ ID NO: 543059 - DNA, 25 bp, Homo sapien
atatgtgttgataccctacagtaaa

SEQ ID NO: 543060 - DNA, 25 bp, Homo sapien
tattatttcatggactagccttacg

SEQ ID NO: 543061 - DNA, 25 bp, Homo sapien
tggactagccttacgttaagtgaaa

SEQ ID NO: 543062 - DNA, 25 bp, Homo sapien
tatttatgttgttaccacccctaag

SEQ ID NO: 543063 - DNA, 25 bp, Homo sapien
ttaccacccctaagagtgactctga

SEQ ID NO: 543064 - DNA, 25 bp, Homo sapien
gactctgatatattatggatgaccc

SEQ ID NO: 543065 - DNA, 25 bp, Homo sapien
atggatgacccaggacggtcttaaa

SEQ ID NO: 543066 - DNA, 25 bp, Homo sapien
ctgcctagtttgtaagtatttgaat

SEQ ID NO: 543067 - DNA, 25 bp, Homo sapien
agtatttgaatccagttcttttcta

SEQ ID NO: 543068 - DNA, 25 bp, Homo sapien
caaaatttttgctacagggtcaact

SEQ ID NO: 543069 - DNA, 25 bp, Homo sapien
atatttaattcgatttcattgcctc

SEQ ID NO: 543070 - DNA, 25 bp, Homo sapien
gatttcattgcctcccttcttaaag

SEQ ID NO: 543071 - DNA, 25 bp, Homo sapien
cttcccagtgaaaggtacaaagcaa

SEQ ID NO: 543072 - DNA, 25 bp, Homo sapien
ataagcatcatgcatcctcccctta

SEQ ID NO: 543073 - DNA, 25 bp, Homo sapien
tctggctcaggttgctcaaagcaca

SEQ ID NO: 543074 - DNA, 25 bp, Homo sapien
tgctcaaagcacagatcctctctta

SEQ ID NO: 543075 - DNA, 25 bp, Homo sapien
ccgtccccaggtttgaaacacatag

SEQ ID NO: 543076 - DNA, 25 bp, Homo sapien
caggtttgaaacacatagcctcatt

SEQ ID NO: 543077 - DNA, 25 bp, Homo sapien
gaaacacatagcctcatttcaaggt

SEQ ID NO: 543078 - DNA, 25 bp, Homo sapien
tagcctcatttcaaggtgtagccag

SEQ ID NO: 543079 - DNA, 25 bp, Homo sapien
catttcaaggtgtagccaggttccc

SEQ ID NO: 543080 - DNA, 25 bp, Homo sapien
aaagcacgtggttttggagagatgt

SEQ ID NO: 543081 - DNA, 25 bp, Homo sapien
gagagatgtgtttctccctggatgc

SEQ ID NO: 543082 - DNA, 25 bp, Homo sapien
gagatgtgtttctccctggatgcgg

SEQ ID NO: 543083 - DNA, 25 bp, Homo sapien
atgtgtttctccctggatgcgggcc

SEQ ID NO: 543084 - DNA, 25 bp, Homo sapien
tggatgcgggcccagcccaggtgtc

SEQ ID NO: 543085 - DNA, 25 bp, Homo sapien
agcccaggtgtctgcaaggtgccct

SEQ ID NO: 543086 - DNA, 25 bp, Homo sapien
aggtgtctgcaaggtgccctccctg

SEQ ID NO: 543087 - DNA, 25 bp, Homo sapien
gtgtctgcaaggtgccctccctggt

SEQ ID NO: 543088 - DNA, 25 bp, Homo sapien
aaggtgccctccctggtggccgagg

SEQ ID NO: 543089 - DNA, 25 bp, Homo sapien
agggagcaagtatcacagcagccac

SEQ ID NO: 543090 - DNA, 25 bp, Homo sapien
ggagcaagtatcacagcagccaccc

SEQ ID NO: 543091 - DNA, 25 bp, Homo sapien
gagaacagattcatttgcttaattt

SEQ ID NO: 543092 - DNA, 25 bp, Homo sapien
tatgtctccatattactgtttcatg

SEQ ID NO: 543093 - DNA, 25 bp, Homo sapien
tactgtttcatgactgactgactaa

SEQ ID NO: 543094 - DNA, 25 bp, Homo sapien
atgactgactgactaaatgacaccc

SEQ ID NO: 543095 - DNA, 25 bp, Homo sapien
actgactaaatgacacccaaaatgg

SEQ ID NO: 543096 - DNA, 25 bp, Homo sapien
gttaagatgtacttgactagtttac

SEQ ID NO: 543097 - DNA, 25 bp, Homo sapien
gactagtttacttatgcatctcttt

SEQ ID NO: 543098 - DNA, 25 bp, Homo sapien
gtttacttatgcatctctttgcaag

SEQ ID NO: 543099 - DNA, 25 bp, Homo sapien
ctttgcaagaatcagccagccaaca

SEQ ID NO: 543100 - DNA, 25 bp, Homo sapien
aagaatcagccagccaacaatgtct

SEQ ID NO: 543101 - DNA, 25 bp, Homo sapien
agatggttgtaagctattatagtat

SEQ ID NO: 543102 - DNA, 25 bp, Homo sapien
ttccttaatacttctgaactcatta

SEQ ID NO: 543103 - DNA, 25 bp, Homo sapien
ataatactactacactttaccagca

SEQ ID NO: 543104 - DNA, 25 bp, Homo sapien
atactactacactttaccagcaatt

SEQ ID NO: 543105 - DNA, 25 bp, Homo sapien
cactttaccagcaattaacttctcc

SEQ ID NO: 543106 - DNA, 25 bp, Homo sapien
tttaccagcaattaacttctcccta

SEQ ID NO: 543107 - DNA, 25 bp, Homo sapien
ttaccagcaattaacttctccctac

SEQ ID NO: 543108 - DNA, 25 bp, Homo sapien
ctgtctgaaaatggaactaatttgt

SEQ ID NO: 543109 - DNA, 25 bp, Homo sapien
ggaactaatttgtcttattcgtgct

SEQ ID NO: 543110 - DNA, 25 bp, Homo sapien
aatttgtcttattcgtgcttatatc

SEQ ID NO: 543111 - DNA, 25 bp, Homo sapien
gtcttattcgtgcttatatctgtat

SEQ ID NO: 543112 - DNA, 25 bp, Homo sapien
attcgtgcttatatctgtattaaat

SEQ ID NO: 543113 - DNA, 25 bp, Homo sapien
aggtagccgacgatatccccattgg

SEQ ID NO: 543114 - DNA, 25 bp, Homo sapien
acgatatccccattgggcctccgtg

SEQ ID NO: 543115 - DNA, 25 bp, Homo sapien
tggcctgcaccttgaacttgtaggg

SEQ ID NO: 543116 - DNA, 25 bp, Homo sapien
agctcagctgcagcgagtctgggct

SEQ ID NO: 543117 - DNA, 25 bp, Homo sapien
ctcagctgcagcgagtctgggctca

SEQ ID NO: 543118 - DNA, 25 bp, Homo sapien
tgggctcagggcagtgaacaccagc

SEQ ID NO: 543119 - DNA, 25 bp, Homo sapien
tcagggcagtgaacaccagcgggcc

SEQ ID NO: 543120 - DNA, 25 bp, Homo sapien
gacacagtgggctctgcgggtgcac

SEQ ID NO: 543121 - DNA, 25 bp, Homo sapien
acttgtagggcacgttctcgctgag

SEQ ID NO: 543122 - DNA, 25 bp, Homo sapien
tgtctccatccacccggaatgcggt

SEQ ID NO: 543123 - DNA, 25 bp, Homo sapien
atccacccggaatgcggtggctggc

SEQ ID NO: 543124 - DNA, 25 bp, Homo sapien
gagggtcatggctcctgtacttggc

SEQ ID NO: 543125 - DNA, 25 bp, Homo sapien
atggctcctgtacttggctgcctgc

SEQ ID NO: 543126 - DNA, 25 bp, Homo sapien
tttgctagtgggagccaacaccttt

SEQ ID NO: 543127 - DNA, 25 bp, Homo sapien
tcctctttgcagtaggttgcccact

SEQ ID NO: 543128 - DNA, 25 bp, Homo sapien
ctttcctgtgtgagagtcaagggct

SEQ ID NO: 543129 - DNA, 25 bp, Homo sapien
ccccagggaatgaagctgatgccag

SEQ ID NO: 543130 - DNA, 25 bp, Homo sapien
ctgatgccagagtcagacccgagga

SEQ ID NO: 543131 - DNA, 25 bp, Homo sapien
agccactgatggagatgcggctccg

SEQ ID NO: 543132 - DNA, 25 bp, Homo sapien
ggatgcgcctcagcacttctatgca

SEQ ID NO: 543133 - DNA, 25 bp, Homo sapien
agcacttctatgcagcactgctgca

SEQ ID NO: 543134 - DNA, 25 bp, Homo sapien
agctgggcctcaagtacctctttat

SEQ ID NO: 543135 - DNA, 25 bp, Homo sapien
aaagcaggtctgtcaatattattct

SEQ ID NO: 543136 - DNA, 25 bp, Homo sapien
aatattattcttgtttccccggctg

SEQ ID NO: 543137 - DNA, 25 bp, Homo sapien
ccggctgccctttaataacttgatg

SEQ ID NO: 543138 - DNA, 25 bp, Homo sapien
atgctaattgaatcttgtttgaaac

SEQ ID NO: 543139 - DNA, 25 bp, Homo sapien
tcccctgcagtggtctttgacatga

SEQ ID NO: 543140 - DNA, 25 bp, Homo sapien
ggtctttgacatgacaatgtttcct

SEQ ID NO: 543141 - DNA, 25 bp, Homo sapien
gacaatgtttcctttttgataagca

SEQ ID NO: 543142 - DNA, 25 bp, Homo sapien
caacaaaataccaacatgctgggtc

SEQ ID NO: 543143 - DNA, 25 bp, Homo sapien
atgctgggtcatttccttaatctac

SEQ ID NO: 543144 - DNA, 25 bp, Homo sapien
tgggtcatttccttaatctaccacc

SEQ ID NO: 543145 - DNA, 25 bp, Homo sapien
taatctaccacccttttctctgaga

SEQ ID NO: 543146 - DNA, 25 bp, Homo sapien
aaggtgaggagcctgagaacttctt

SEQ ID NO: 543147 - DNA, 25 bp, Homo sapien
agaacttcttctgggtgggcattgg

SEQ ID NO: 543148 - DNA, 25 bp, Homo sapien
gaagccctatgatgacgatgccgag

SEQ ID NO: 543149 - DNA, 25 bp, Homo sapien
gacgatgccgagtacatgaaacaca

SEQ ID NO: 543150 - DNA, 25 bp, Homo sapien
atgaaacacacacgtctcttccggt

SEQ ID NO: 543151 - DNA, 25 bp, Homo sapien
gtgctccaacgagaagggctacttt

SEQ ID NO: 543152 - DNA, 25 bp, Homo sapien
aagggctactttgcagtgactgaga

SEQ ID NO: 543153 - DNA, 25 bp, Homo sapien
aaatgctccgacttttgccaagatg

SEQ ID NO: 543154 - DNA, 25 bp, Homo sapien
acatcatgttgctagacaatggcca

SEQ ID NO: 543155 - DNA, 25 bp, Homo sapien
gacaatggccaagaggtctacatgt

SEQ ID NO: 543156 - DNA, 25 bp, Homo sapien
ggacccagactagccaggtggagat

SEQ ID NO: 543157 - DNA, 25 bp, Homo sapien
tagcgaaccaaccatgacagcagcg

SEQ ID NO: 543158 - DNA, 25 bp, Homo sapien
gaaccaaccatgacagcagcgggag

SEQ ID NO: 543159 - DNA, 25 bp, Homo sapien
tcgcgcccgcagacgcctgggaact

SEQ ID NO: 543160 - DNA, 25 bp, Homo sapien
accatgacagcagcgggaggacctc

SEQ ID NO: 543161 - DNA, 25 bp, Homo sapien
ggaggacctccgagcccgctcgtta

SEQ ID NO: 543162 - DNA, 25 bp, Homo sapien
gagcccgctcgttacagcagaacgc

SEQ ID NO: 543163 - DNA, 25 bp, Homo sapien
gttacagcagaacgcgcggtcaagt

SEQ ID NO: 543164 - DNA, 25 bp, Homo sapien
cagaacgcgcggtcaagtttggcgc

SEQ ID NO: 543165 - DNA, 25 bp, Homo sapien
gcggtcaagtttggcgcgaaattgt

SEQ ID NO: 543166 - DNA, 25 bp, Homo sapien
aagtttggcgcgaaattgtggccgc

SEQ ID NO: 543167 - DNA, 25 bp, Homo sapien
ttggcgcgaaattgtggccgccccg

SEQ ID NO: 543168 - DNA, 25 bp, Homo sapien
ttaccaccccctgatgtattatttg

SEQ ID NO: 543169 - DNA, 25 bp, Homo sapien
gaatactactagtttccttttctgt

SEQ ID NO: 543170 - DNA, 25 bp, Homo sapien
attattgatatctaggtgacctgaa

SEQ ID NO: 543171 - DNA, 25 bp, Homo sapien
aatagtgaatgtgctttgtaaactg

SEQ ID NO: 543172 - DNA, 25 bp, Homo sapien
gtaaactgtaaagcacttgtattct

SEQ ID NO: 543173 - DNA, 25 bp, Homo sapien
acttgtattctactgtgataagcgt

SEQ ID NO: 543174 - DNA, 25 bp, Homo sapien
gtattctactgtgataagcgttgtg

SEQ ID NO: 543175 - DNA, 25 bp, Homo sapien
ggatacaaagaaaggagcaagcata

SEQ ID NO: 543176 - DNA, 25 bp, Homo sapien
gcaagcataaaaaagtgctctttca

SEQ ID NO: 543177 - DNA, 25 bp, Homo sapien
aaaaagtgctctttcaaaaggatat

SEQ ID NO: 543178 - DNA, 25 bp, Homo sapien
gatatagtactatgcagacacaagg

SEQ ID NO: 543179 - DNA, 25 bp, Homo sapien
atacatggacgatcaagctaagaac

SEQ ID NO: 543180 - DNA, 25 bp, Homo sapien
cctcaaaaaagctgtggttctcaaa

SEQ ID NO: 543181 - DNA, 25 bp, Homo sapien
gattccggtatatcgttcttcaaga

SEQ ID NO: 543182 - DNA, 25 bp, Homo sapien
tcaagacacttgctctaagcggaat

SEQ ID NO: 543183 - DNA, 25 bp, Homo sapien
gcaagactgtctttgaatatagaac

SEQ ID NO: 543184 - DNA, 25 bp, Homo sapien
gaatgtggcacgcttgcccatcata

SEQ ID NO: 543185 - DNA, 25 bp, Homo sapien
ccatcatagatcttgctcctgtgga

SEQ ID NO: 543186 - DNA, 25 bp, Homo sapien
tgctcctgtggatgttggcggcaca

SEQ ID NO: 543187 - DNA, 25 bp, Homo sapien
gttggcggcacagaccaggaattcg

SEQ ID NO: 543188 - DNA, 25 bp, Homo sapien
aattcggcgttgaaattgggccagt

SEQ ID NO: 543189 - DNA, 25 bp, Homo sapien
gtaaagtaagccaagacacatcgac

SEQ ID NO: 543190 - DNA, 25 bp, Homo sapien
aatattttcagattctagagtattt

SEQ ID NO: 543191 - DNA, 25 bp, Homo sapien
ataattcctacttatgttagctatg

SEQ ID NO: 543192 - DNA, 25 bp, Homo sapien
tatgttagctatgatttagggccaa

SEQ ID NO: 543193 - DNA, 25 bp, Homo sapien
gttagctatgatttagggccaaaac

SEQ ID NO: 543194 - DNA, 25 bp, Homo sapien
tgatttagggccaaaactaccctgg

SEQ ID NO: 543195 - DNA, 25 bp, Homo sapien
ttgtcttgcaacttgaaacattgtg

SEQ ID NO: 543196 - DNA, 25 bp, Homo sapien
cttgcaacttgaaacattgtgtatt

SEQ ID NO: 543197 - DNA, 25 bp, Homo sapien
gaaacattgtgtattttaaactata

SEQ ID NO: 543198 - DNA, 25 bp, Homo sapien
tattttatagactgtggataaccaa

SEQ ID NO: 543199 - DNA, 25 bp, Homo sapien
ctgtggataaccaaatataagattt

SEQ ID NO: 543200 - DNA, 25 bp, Homo sapien
gtgatttttaatgcttcatttgtgt

SEQ ID NO: 543201 - DNA, 25 bp, Homo sapien
tgtttcggttggtaagttcttccag

SEQ ID NO: 543202 - DNA, 25 bp, Homo sapien
aagttcttccagctgaagccacttt

SEQ ID NO: 543203 - DNA, 25 bp, Homo sapien
gctgaagccactttttccttatagt

SEQ ID NO: 543204 - DNA, 25 bp, Homo sapien
acctgcagcagttcaggatgactaa

SEQ ID NO: 543205 - DNA, 25 bp, Homo sapien
aagcaattagcttgaacatttagaa

SEQ ID NO: 543206 - DNA, 25 bp, Homo sapien
ttctgtgccttctaattcctgcatc

SEQ ID NO: 543207 - DNA, 25 bp, Homo sapien
ttctaattcctgcatcctgttcaaa

SEQ ID NO: 543208 - DNA, 25 bp, Homo sapien
attcctgcatcctgttcaaaacatc

SEQ ID NO: 543209 - DNA, 25 bp, Homo sapien
gttcaaaacatctttccagacatta

SEQ ID NO: 543210 - DNA, 25 bp, Homo sapien
aaaacatctttccagacattaactt

SEQ ID NO: 543211 - DNA, 25 bp, Homo sapien
ttacacattgtataaaaccgaccaa

SEQ ID NO: 543212 - DNA, 25 bp, Homo sapien
ataaaagtgaattagacccaccttg

SEQ ID NO: 543213 - DNA, 25 bp, Homo sapien
ccttgacctggcctacagaagtaaa

SEQ ID NO: 543214 - DNA, 25 bp, Homo sapien
aatgcctcaggcgtgctttttgatt

SEQ ID NO: 543215 - DNA, 25 bp, Homo sapien
tcaggcgtgctttttgattcatttg

SEQ ID NO: 543216 - DNA, 25 bp, Homo sapien
gtggaatataccattctgggtcctg

SEQ ID NO: 543217 - DNA, 25 bp, Homo sapien
ataccattctgggtcctgaggataa

SEQ ID NO: 543218 - DNA, 25 bp, Homo sapien
agatgagggcattagatcactgaca

SEQ ID NO: 543219 - DNA, 25 bp, Homo sapien
gggcattagatcactgacagctgaa

SEQ ID NO: 543220 - DNA, 25 bp, Homo sapien
atttcaatgcctattctctgcaagg

SEQ ID NO: 543221 - DNA, 25 bp, Homo sapien
ttctctgcaaggtactatgtttcgt

SEQ ID NO: 543222 - DNA, 25 bp, Homo sapien
gtaaattaaataggtctggcccaga

SEQ ID NO: 543223 - DNA, 25 bp, Homo sapien
tctcatcatcctgaagcctataatg

SEQ ID NO: 543224 - DNA, 25 bp, Homo sapien
aactgagttgtggagctgactctaa

SEQ ID NO: 543225 - DNA, 25 bp, Homo sapien
ggagctgactctaatcaaatgtgat

SEQ ID NO: 543226 - DNA, 25 bp, Homo sapien
tggaattagaccatttggcctttga

SEQ ID NO: 543227 - DNA, 25 bp, Homo sapien
acccaacatttcttagcatgagcta

SEQ ID NO: 543228 - DNA, 25 bp, Homo sapien
gcatgagctacctcatctctagaag

SEQ ID NO: 543229 - DNA, 25 bp, Homo sapien
tctctagaagctgggatggacttac

SEQ ID NO: 543230 - DNA, 25 bp, Homo sapien
gggatggacttactattcttgttta

SEQ ID NO: 543231 - DNA, 25 bp, Homo sapien
gatactgaaaggtgctatgcttctg

SEQ ID NO: 543232 - DNA, 25 bp, Homo sapien
ggtgctatgcttctgttattattcc

SEQ ID NO: 543233 - DNA, 25 bp, Homo sapien
ccaagactggagataggcagggcta

SEQ ID NO: 543234 - DNA, 25 bp, Homo sapien
aaatcctaagatattggcattcatg

SEQ ID NO: 543235 - DNA, 25 bp, Homo sapien
attggcattcatgtgatggatgtct

SEQ ID NO: 543236 - DNA, 25 bp, Homo sapien
atggatgtcttgaggcagataacac

SEQ ID NO: 543237 - DNA, 25 bp, Homo sapien
tgtcttgaggcagataacacagttg

SEQ ID NO: 543238 - DNA, 25 bp, Homo sapien
gaagaaacacagatcttttcacatg

SEQ ID NO: 543239 - DNA, 25 bp, Homo sapien
gatcttttcacatgaagttgtactt

SEQ ID NO: 543240 - DNA, 25 bp, Homo sapien
gttgtacttgaaaaatattgccata

SEQ ID NO: 543241 - DNA, 25 bp, Homo sapien
tatacagtgtagttatcaggaaatg

SEQ ID NO: 543242 - DNA, 25 bp, Homo sapien
aaggaacagcctctaatggaaatta

SEQ ID NO: 543243 - DNA, 25 bp, Homo sapien
cagcctctaatggaaattagcatgt

SEQ ID NO: 543244 - DNA, 25 bp, Homo sapien
attagcatgtgattgatgttgtata

SEQ ID NO: 543245 - DNA, 25 bp, Homo sapien
gtctgatgaggccacaacccctagg

SEQ ID NO: 543246 - DNA, 25 bp, Homo sapien
taggcccctcaggagctttgcagag

SEQ ID NO: 543247 - DNA, 25 bp, Homo sapien
ggcccctcaggagctttgcagagag

SEQ ID NO: 543248 - DNA, 25 bp, Homo sapien
gaggacgtgtactccaggcgaggcc

SEQ ID NO: 543249 - DNA, 25 bp, Homo sapien
aggcgaggcctctggacctgtgttc

SEQ ID NO: 543250 - DNA, 25 bp, Homo sapien
aggcctctggacctgtgttcctgtg

SEQ ID NO: 543251 - DNA, 25 bp, Homo sapien
gtgttcctgtgccaaagtcctgtca

SEQ ID NO: 543252 - DNA, 25 bp, Homo sapien
ctgtgccaaagtcctgtcaggctgg

SEQ ID NO: 543253 - DNA, 25 bp, Homo sapien
tgccaaagtcctgtcaggctggtgg

SEQ ID NO: 543254 - DNA, 25 bp, Homo sapien
tgagccagccggaaactcttcctcc

SEQ ID NO: 543255 - DNA, 25 bp, Homo sapien
ggagaacatccctcccattctggga

SEQ ID NO: 543256 - DNA, 25 bp, Homo sapien
ctcagataacgcatagcaaaatgga

SEQ ID NO: 543257 - DNA, 25 bp, Homo sapien
ggagatggagacatgatttctcatg

SEQ ID NO: 543258 - DNA, 25 bp, Homo sapien
gatttctcatgcaacagcttctcta

SEQ ID NO: 543259 - DNA, 25 bp, Homo sapien
tttctcatgcaacagcttctctaat

SEQ ID NO: 543260 - DNA, 25 bp, Homo sapien
ctcatgcaacagcttctctaattat

SEQ ID NO: 543261 - DNA, 25 bp, Homo sapien
gcaacagcttctctaattatacctt

SEQ ID NO: 543262 - DNA, 25 bp, Homo sapien
acagcttctctaattataccttaga

SEQ ID NO: 543263 - DNA, 25 bp, Homo sapien
tcctttttatcatcaaatctgctca

SEQ ID NO: 543264 - DNA, 25 bp, Homo sapien
ttttatcatcaaatctgctcaagaa

SEQ ID NO: 543265 - DNA, 25 bp, Homo sapien
atcagtggatgaaaacagcttaaca

SEQ ID NO: 543266 - DNA, 25 bp, Homo sapien
tgaaaacagcttaacattttaccat

SEQ ID NO: 543267 - DNA, 25 bp, Homo sapien
aatgtttatcacacctttatcttgg

SEQ ID NO: 543268 - DNA, 25 bp, Homo sapien
tcttggtctttgttgatttgggttt

SEQ ID NO: 543269 - DNA, 25 bp, Homo sapien
acagtaggcttctatatatcctgga

SEQ ID NO: 543270 - DNA, 25 bp, Homo sapien
atatcctggatttctgaactggtct

SEQ ID NO: 543271 - DNA, 25 bp, Homo sapien
ggtcttgttgacaaggattcccaag

SEQ ID NO: 543272 - DNA, 25 bp, Homo sapien
aatggatcttttcactggctgactc

SEQ ID NO: 543273 - DNA, 25 bp, Homo sapien
ctgactctcccatatctgcaagaga

SEQ ID NO: 543274 - DNA, 25 bp, Homo sapien
gattctgcaggaactgggtgtgcac

SEQ ID NO: 543275 - DNA, 25 bp, Homo sapien
aactgggtgtgcacacggtgttgta

SEQ ID NO: 543276 - DNA, 25 bp, Homo sapien
gcacacggtgttgtagccagttcag

SEQ ID NO: 543277 - DNA, 25 bp, Homo sapien
gttgtagccagttcaggtactgaat

SEQ ID NO: 543278 - DNA, 25 bp, Homo sapien
tcagtttacaaacctgtgagctact

SEQ ID NO: 543279 - DNA, 25 bp, Homo sapien
gtttacaaacctgtgagctactgtt

SEQ ID NO: 543280 - DNA, 25 bp, Homo sapien
ttacaaacctgtgagctactgttgg

SEQ ID NO: 543281 - DNA, 25 bp, Homo sapien
tacaaacctgtgagctactgttggc

SEQ ID NO: 543282 - DNA, 25 bp, Homo sapien
acaaacctgtgagctactgttggct

SEQ ID NO: 543283 - DNA, 25 bp, Homo sapien
aaacctgtgagctactgttggctgc

SEQ ID NO: 543284 - DNA, 25 bp, Homo sapien
aacctgtgagctactgttggctgct

SEQ ID NO: 543285 - DNA, 25 bp, Homo sapien
acctgtgagctactgttggctgctg

SEQ ID NO: 543286 - DNA, 25 bp, Homo sapien
ctgtgagctactgttggctgctgcc

SEQ ID NO: 543287 - DNA, 25 bp, Homo sapien
gtgagctactgttggctgctgccct

SEQ ID NO: 543288 - DNA, 25 bp, Homo sapien
tgagctactgttggctgctgccctc

SEQ ID NO: 543289 - DNA, 25 bp, Homo sapien
aagcaaacccctacctgaagtgact

SEQ ID NO: 543290 - DNA, 25 bp, Homo sapien
gatctgtttatattaaaggcttccc

SEQ ID NO: 543291 - DNA, 25 bp, Homo sapien
taaaggcttcccaactgatgcaact

SEQ ID NO: 543292 - DNA, 25 bp, Homo sapien
ttcccaactgatgcaactcttgatg

SEQ ID NO: 543293 - DNA, 25 bp, Homo sapien
gatgcaactcttgatgacataaaag

SEQ ID NO: 543294 - DNA, 25 bp, Homo sapien
cattgcataaagcatttaagggatc

SEQ ID NO: 543295 - DNA, 25 bp, Homo sapien
ttgtgtttgatagcattgaatctgc

SEQ ID NO: 543296 - DNA, 25 bp, Homo sapien
agaaatttgtagagacccctggcca

SEQ ID NO: 543297 - DNA, 25 bp, Homo sapien
gagacccctggccagaagtacaaag

SEQ ID NO: 543298 - DNA, 25 bp, Homo sapien
aacagacctgctaatacttttcaag

SEQ ID NO: 543299 - DNA, 25 bp, Homo sapien
tacttttcaaggacgattactttgc

SEQ ID NO: 543300 - DNA, 25 bp, Homo sapien
ccggattgcagaaggtacagagcct

SEQ ID NO: 543301 - DNA, 25 bp, Homo sapien
ggattgcagaaggtacagagcctcc

SEQ ID NO: 543302 - DNA, 25 bp, Homo sapien
attgcagaaggtacagagcctccga

SEQ ID NO: 543303 - DNA, 25 bp, Homo sapien
ttgcagaaggtacagagcctccgaa

SEQ ID NO: 543304 - DNA, 25 bp, Homo sapien
tgcagaaggtacagagcctccgaag

SEQ ID NO: 543305 - DNA, 25 bp, Homo sapien
cagaaggtacagagcctccgaaggg

SEQ ID NO: 543306 - DNA, 25 bp, Homo sapien
ggtcaagccgcctcgccttgggcct

SEQ ID NO: 543307 - DNA, 25 bp, Homo sapien
tgggcctggccggagcgcagaagcc

SEQ ID NO: 543308 - DNA, 25 bp, Homo sapien
ccggagcgcagaagcccagccggaa

SEQ ID NO: 543309 - DNA, 25 bp, Homo sapien
gcgcagaagcccagccggaagccca

SEQ ID NO: 543310 - DNA, 25 bp, Homo sapien
tggagcccacgctggagccagagcc

SEQ ID NO: 543311 - DNA, 25 bp, Homo sapien
gaattgagtatggtttctctacact

SEQ ID NO: 543312 - DNA, 25 bp, Homo sapien
atggtttctctacactaattttatt

SEQ ID NO: 543313 - DNA, 25 bp, Homo sapien
tggatattttccagtttgactagga

SEQ ID NO: 543314 - DNA, 25 bp, Homo sapien
gaccattgtattgatatattcttca

SEQ ID NO: 543315 - DNA, 25 bp, Homo sapien
ttcttcagtgtgatttaggtgagtc

SEQ ID NO: 543316 - DNA, 25 bp, Homo sapien
gagtcaggaatttttcctctggaga

SEQ ID NO: 543317 - DNA, 25 bp, Homo sapien
gaatttttcctctggagactgcata

SEQ ID NO: 543318 - DNA, 25 bp, Homo sapien
ggagactgcataaatcagggatgtc

SEQ ID NO: 543319 - DNA, 25 bp, Homo sapien
taagaattgtctcaggccacgcata

SEQ ID NO: 543320 - DNA, 25 bp, Homo sapien
ttgtctcaggccacgcataaagtac

SEQ ID NO: 543321 - DNA, 25 bp, Homo sapien
ctcaggccacgcataaagtacacta

SEQ ID NO: 543322 - DNA, 25 bp, Homo sapien
tcaggctgcaagcagccaaagtgcc

SEQ ID NO: 543323 - DNA, 25 bp, Homo sapien
caggctgcaagcagccaaagtgccc

SEQ ID NO: 543324 - DNA, 25 bp, Homo sapien
gctgcaagcagccaaagtgcccagg

SEQ ID NO: 543325 - DNA, 25 bp, Homo sapien
ctgcaagcagccaaagtgcccaggg

SEQ ID NO: 543326 - DNA, 25 bp, Homo sapien
aagcagccaaagtgcccagggctct

SEQ ID NO: 543327 - DNA, 25 bp, Homo sapien
aagtgggcggttgtggtagtgcctt

SEQ ID NO: 543328 - DNA, 25 bp, Homo sapien
gtgggcggttgtggtagtgccttct

SEQ ID NO: 543329 - DNA, 25 bp, Homo sapien
ggcggttgtggtagtgccttctgga

SEQ ID NO: 543330 - DNA, 25 bp, Homo sapien
cggttgtggtagtgccttctggaga

SEQ ID NO: 543331 - DNA, 25 bp, Homo sapien
ggttgtggtagtgccttctggagag

SEQ ID NO: 543332 - DNA, 25 bp, Homo sapien
ctcatcctgagatgggagccctctc

SEQ ID NO: 543333 - DNA, 25 bp, Homo sapien
tgaaccccagctcaaactttgagag

SEQ ID NO: 543334 - DNA, 25 bp, Homo sapien
tgggcagcttcagttcgtcgtcggc

SEQ ID NO: 543335 - DNA, 25 bp, Homo sapien
gcttcagttcgtcgtcggcgctcga

SEQ ID NO: 543336 - DNA, 25 bp, Homo sapien
gcgctcgaccgggacctggatttta

SEQ ID NO: 543337 - DNA, 25 bp, Homo sapien
gacctggattttaacttcgagcccg

SEQ ID NO: 543338 - DNA, 25 bp, Homo sapien
ctggattttaacttcgagcccggct

SEQ ID NO: 543339 - DNA, 25 bp, Homo sapien
cgcccgaggtgagcgagatgatctc

SEQ ID NO: 543340 - DNA, 25 bp, Homo sapien
ggagactggctcgagtccagcatct

SEQ ID NO: 543341 - DNA, 25 bp, Homo sapien
agcatctccaacctggttttcacct

SEQ ID NO: 543342 - DNA, 25 bp, Homo sapien
gttttcacctactgaagggcgcgca

SEQ ID NO: 543343 - DNA, 25 bp, Homo sapien
tcacctactgaagggcgcgcaggca

SEQ ID NO: 543344 - DNA, 25 bp, Homo sapien
cggccccttggaagagttgttgcca

SEQ ID NO: 543345 - DNA, 25 bp, Homo sapien
ggccccttggaagagttgttgccag

SEQ ID NO: 543346 - DNA, 25 bp, Homo sapien
gccccttggaagagttgttgccaga

SEQ ID NO: 543347 - DNA, 25 bp, Homo sapien
ccccttggaagagttgttgccagac

SEQ ID NO: 543348 - DNA, 25 bp, Homo sapien
ccttggaagagttgttgccagacca

SEQ ID NO: 543349 - DNA, 25 bp, Homo sapien
ttggaagagttgttgccagaccagg

SEQ ID NO: 543350 - DNA, 25 bp, Homo sapien
aagagttgttgccagaccagggttt

SEQ ID NO: 543351 - DNA, 25 bp, Homo sapien
agagttgttgccagaccagggtttt

SEQ ID NO: 543352 - DNA, 25 bp, Homo sapien
gagttgttgccagaccagggttttg

SEQ ID NO: 543353 - DNA, 25 bp, Homo sapien
agttgttgccagaccagggttttgg

SEQ ID NO: 543354 - DNA, 25 bp, Homo sapien
gggaaacctgtcttgacattcaaaa

SEQ ID NO: 543355 - DNA, 25 bp, Homo sapien
tagctctgacttgccactgtgacaa

SEQ ID NO: 543356 - DNA, 25 bp, Homo sapien
gccactgtgacaaagttcacgtagc

SEQ ID NO: 543357 - DNA, 25 bp, Homo sapien
agttcacgtagcaggtctaggcaaa

SEQ ID NO: 543358 - DNA, 25 bp, Homo sapien
tctaggcaaagactgggcaattgag

SEQ ID NO: 543359 - DNA, 25 bp, Homo sapien
aggagacggacctgtgagtctgacc

SEQ ID NO: 543360 - DNA, 25 bp, Homo sapien
ttttgtcaggttgtccttgtttgga

SEQ ID NO: 543361 - DNA, 25 bp, Homo sapien
gtccttgtttggatccctcaactag

SEQ ID NO: 543362 - DNA, 25 bp, Homo sapien
gatccctcaactaggtgataagcac

SEQ ID NO: 543363 - DNA, 25 bp, Homo sapien
ggatgacccgccttggacgtgtttc

SEQ ID NO: 543364 - DNA, 25 bp, Homo sapien
gacgtgtttctttaacctcatccat

SEQ ID NO: 543365 - DNA, 25 bp, Homo sapien
acctcatccatataatagggccgtg

SEQ ID NO: 543366 - DNA, 25 bp, Homo sapien
agggagggcgtctgatgctctctct

SEQ ID NO: 543367 - DNA, 25 bp, Homo sapien
tctgggagggccagttccacattga

SEQ ID NO: 543368 - DNA, 25 bp, Homo sapien
tgggagggccagttccacattgagc

SEQ ID NO: 543369 - DNA, 25 bp, Homo sapien
ggagggccagttccacattgagcca

SEQ ID NO: 543370 - DNA, 25 bp, Homo sapien
agggccagttccacattgagccagc

SEQ ID NO: 543371 - DNA, 25 bp, Homo sapien
cagttccacattgagccagcctggt

SEQ ID NO: 543372 - DNA, 25 bp, Homo sapien
attgagccagcctggtcccatggaa

SEQ ID NO: 543373 - DNA, 25 bp, Homo sapien
ggtcccatggaaaatgatggcctgg

SEQ ID NO: 543374 - DNA, 25 bp, Homo sapien
gctttctgaggccttatctgatgcc

SEQ ID NO: 543375 - DNA, 25 bp, Homo sapien
ttctgaggccttatctgatgcctct

SEQ ID NO: 543376 - DNA, 25 bp, Homo sapien
tgatgcctctgcagttcatgtcccc

SEQ ID NO: 543377 - DNA, 25 bp, Homo sapien
gggccaaggcctgctgagctgattc

SEQ ID NO: 543378 - DNA, 25 bp, Homo sapien
ggccaaggcctgctgagctgattct

SEQ ID NO: 543379 - DNA, 25 bp, Homo sapien
tttccgccttgcacagcacagaggt

SEQ ID NO: 543380 - DNA, 25 bp, Homo sapien
ttccgccttgcacagcacagaggtg

SEQ ID NO: 543381 - DNA, 25 bp, Homo sapien
tccgccttgcacagcacagaggtgg

SEQ ID NO: 543382 - DNA, 25 bp, Homo sapien
cgccttgcacagcacagaggtggtc

SEQ ID NO: 543383 - DNA, 25 bp, Homo sapien
gccttgcacagcacagaggtggtca

SEQ ID NO: 543384 - DNA, 25 bp, Homo sapien
ccttgcacagcacagaggtggtcac

SEQ ID NO: 543385 - DNA, 25 bp, Homo sapien
cttgcacagcacagaggtggtcacc

SEQ ID NO: 543386 - DNA, 25 bp, Homo sapien
ttgcacagcacagaggtggtcaccc

SEQ ID NO: 543387 - DNA, 25 bp, Homo sapien
caacagccagggacttgattttgat

SEQ ID NO: 543388 - DNA, 25 bp, Homo sapien
ctctttccttggagggtccctgatt

SEQ ID NO: 543389 - DNA, 25 bp, Homo sapien
tttccttggagggtccctgattcct

SEQ ID NO: 543390 - DNA, 25 bp, Homo sapien
ggtccctgattcctgaggatcctcc

SEQ ID NO: 543391 - DNA, 25 bp, Homo sapien
ggaccacagggctgccgtgagcacc

SEQ ID NO: 543392 - DNA, 25 bp, Homo sapien
tgagcacccaccctggttctccagg

SEQ ID NO: 543393 - DNA, 25 bp, Homo sapien
agggcctgaacctcgggctcctgcc

SEQ ID NO: 543394 - DNA, 25 bp, Homo sapien
ctgcctggaccagtgacagcattgg

SEQ ID NO: 543395 - DNA, 25 bp, Homo sapien
gggtcttcagaccagccagcaaggg

SEQ ID NO: 543396 - DNA, 25 bp, Homo sapien
gcccagagagcaggtcagacaacag

SEQ ID NO: 543397 - DNA, 25 bp, Homo sapien
agcaggtcagacaacaggcaaccct

SEQ ID NO: 543398 - DNA, 25 bp, Homo sapien
gacaacaggcaaccctgaggcagct

SEQ ID NO: 543399 - DNA, 25 bp, Homo sapien
ttctaaagggtacctatagtttatg

SEQ ID NO: 543400 - DNA, 25 bp, Homo sapien
gggtacctatagtttatgggaattg

SEQ ID NO: 543401 - DNA, 25 bp, Homo sapien
gaaaaatcaccaacgctctcatgtt

SEQ ID NO: 543402 - DNA, 25 bp, Homo sapien
accaacgctctcatgtttctcataa

SEQ ID NO: 543403 - DNA, 25 bp, Homo sapien
aatgctcagctttatttggaaactt

SEQ ID NO: 543404 - DNA, 25 bp, Homo sapien
ttggaaactttggccattgttttct

SEQ ID NO: 543405 - DNA, 25 bp, Homo sapien
tttgagttaaaaaggccacagtctg

SEQ ID NO: 543406 - DNA, 25 bp, Homo sapien
aaggccacagtctgacctacttata

SEQ ID NO: 543407 - DNA, 25 bp, Homo sapien
cagtctgacctacttatatgtgtga

SEQ ID NO: 543408 - DNA, 25 bp, Homo sapien
ctctgccaaggctatttattctaat

SEQ ID NO: 543409 - DNA, 25 bp, Homo sapien
tattctaatgatttatctactcaag

SEQ ID NO: 543410 - DNA, 25 bp, Homo sapien
cctgccctgttgttggtatatctgg

SEQ ID NO: 543411 - DNA, 25 bp, Homo sapien
gcccagagaagccagtgatatatcc

SEQ ID NO: 543412 - DNA, 25 bp, Homo sapien
gccagtgatatatccaggtcacaca

SEQ ID NO: 543413 - DNA, 25 bp, Homo sapien
acacagcaggcctgggtctagcatc

SEQ ID NO: 543414 - DNA, 25 bp, Homo sapien
aggcctgggtctagcatctgtctcc

SEQ ID NO: 543415 - DNA, 25 bp, Homo sapien
ttacttacacagttatcgctgccca

SEQ ID NO: 543416 - DNA, 25 bp, Homo sapien
atcgctgcccactgggcattctttg

SEQ ID NO: 543417 - DNA, 25 bp, Homo sapien
gagttttgttaggtggcctctgcat

SEQ ID NO: 543418 - DNA, 25 bp, Homo sapien
ggtggcctctgcatacctatgggaa

SEQ ID NO: 543419 - DNA, 25 bp, Homo sapien
gcctctgcatacctatgggaactca

SEQ ID NO: 543420 - DNA, 25 bp, Homo sapien
atgggaactcagtgatgtaatgcaa

SEQ ID NO: 543421 - DNA, 25 bp, Homo sapien
cttctcaagactttccattcacaga

SEQ ID NO: 543422 - DNA, 25 bp, Homo sapien
caagactttccattcacagattgaa

SEQ ID NO: 543423 - DNA, 25 bp, Homo sapien
ttccattcacagattgaagggtcct

SEQ ID NO: 543424 - DNA, 25 bp, Homo sapien
cagattgaagggtcctgggatccca

SEQ ID NO: 543425 - DNA, 25 bp, Homo sapien
gatcccagggtctgggagtttccca

SEQ ID NO: 543426 - DNA, 25 bp, Homo sapien
tgggagtttcccaagtggtccattg

SEQ ID NO: 543427 - DNA, 25 bp, Homo sapien
gagtttcccaagtggtccattggta

SEQ ID NO: 543428 - DNA, 25 bp, Homo sapien
tggtccattggtaacacacgaacgt

SEQ ID NO: 543429 - DNA, 25 bp, Homo sapien
ggtaacacacgaacgtgggcacaca

SEQ ID NO: 543430 - DNA, 25 bp, Homo sapien
gaacgtgggcacacacactttacgg

SEQ ID NO: 543431 - DNA, 25 bp, Homo sapien
acgtgggcacacacactttacggat

SEQ ID NO: 543432 - DNA, 25 bp, Homo sapien
ttatttttcgtttgctctttcttct

SEQ ID NO: 543433 - DNA, 25 bp, Homo sapien
tctttcttctacacgcgcctgatgg

SEQ ID NO: 543434 - DNA, 25 bp, Homo sapien
ttctacacgcgcctgatggatagtg

SEQ ID NO: 543435 - DNA, 25 bp, Homo sapien
cgcgcctgatggatagtgaacctat

SEQ ID NO: 543436 - DNA, 25 bp, Homo sapien
gatggatagtgaacctattcatcaa

SEQ ID NO: 543437 - DNA, 25 bp, Homo sapien
ttcatcaaaaaagtgcactgctctt

SEQ ID NO: 543438 - DNA, 25 bp, Homo sapien
aaaagtgcactgctcttctgtctat

SEQ ID NO: 543439 - DNA, 25 bp, Homo sapien
actgctcttctgtctattgtaccga

SEQ ID NO: 543440 - DNA, 25 bp, Homo sapien
tattgtaccgacttaacctcttcca

SEQ ID NO: 543441 - DNA, 25 bp, Homo sapien
ccaagtccgcatctgtgtgtatcat

SEQ ID NO: 543442 - DNA, 25 bp, Homo sapien
gtccgcatctgtgtgtatcatcaat

SEQ ID NO: 543443 - DNA, 25 bp, Homo sapien
ccctgggtttacatcaagagaagca

SEQ ID NO: 543444 - DNA, 25 bp, Homo sapien
gggaaaccttttcatctccaagagc

SEQ ID NO: 543445 - DNA, 25 bp, Homo sapien
gaaaccttttcatctccaagagcgg

SEQ ID NO: 543446 - DNA, 25 bp, Homo sapien
aaccttttcatctccaagagcgggc

SEQ ID NO: 543447 - DNA, 25 bp, Homo sapien
ttttcatctccaagagcgggcagga

SEQ ID NO: 543448 - DNA, 25 bp, Homo sapien
tcatctccaagagcgggcaggaaca

SEQ ID NO: 543449 - DNA, 25 bp, Homo sapien
ccaagagcgggcaggaacagcagct

SEQ ID NO: 543450 - DNA, 25 bp, Homo sapien
ggcctgaacttgaaggtacaccagg

SEQ ID NO: 543451 - DNA, 25 bp, Homo sapien
gaacttgaaggtacaccaggtagct

SEQ ID NO: 543452 - DNA, 25 bp, Homo sapien
aaggtacaccaggtagcttgcgtgg

SEQ ID NO: 543453 - DNA, 25 bp, Homo sapien
acaccaggtagcttgcgtgggccag

SEQ ID NO: 543454 - DNA, 25 bp, Homo sapien
gtaggcttggcttaaaatttccatt

SEQ ID NO: 543455 - DNA, 25 bp, Homo sapien
atttccattttgtgtctgtatttca

SEQ ID NO: 543456 - DNA, 25 bp, Homo sapien
gtgtctgtatttcacatctcagttt

SEQ ID NO: 543457 - DNA, 25 bp, Homo sapien
atttagtgaacattgagggatcgaa

SEQ ID NO: 543458 - DNA, 25 bp, Homo sapien
acattgagggatcgaaagaaatcta

SEQ ID NO: 543459 - DNA, 25 bp, Homo sapien
aagaaatctaagtgatacgccccaa

SEQ ID NO: 543460 - DNA, 25 bp, Homo sapien
gaaatctaagtgatacgccccaatg

SEQ ID NO: 543461 - DNA, 25 bp, Homo sapien
atctaagtgatacgccccaatgaag

SEQ ID NO: 543462 - DNA, 25 bp, Homo sapien
agtgatacgccccaatgaagctaaa

SEQ ID NO: 543463 - DNA, 25 bp, Homo sapien
atacgccccaatgaagctaaaatat

SEQ ID NO: 543464 - DNA, 25 bp, Homo sapien
taaaatatagccttctgttaagcaa

SEQ ID NO: 543465 - DNA, 25 bp, Homo sapien
ttgtgtgtaatttcatggtggccta

SEQ ID NO: 543466 - DNA, 25 bp, Homo sapien
taatttcatggtggcctagtgttgt

SEQ ID NO: 543467 - DNA, 25 bp, Homo sapien
ctggtaatggtaatagaagctcaac

SEQ ID NO: 543468 - DNA, 25 bp, Homo sapien
ggatttcagtttttatcatcagaag

SEQ ID NO: 543469 - DNA, 25 bp, Homo sapien
gaagtcctagacagtgacatttctt

SEQ ID NO: 543470 - DNA, 25 bp, Homo sapien
gacatttcttaatggtgggagtcca

SEQ ID NO: 543471 - DNA, 25 bp, Homo sapien
aatggtgggagtccagctcatgcat

SEQ ID NO: 543472 - DNA, 25 bp, Homo sapien
gagtccagctcatgcatttctgatt

SEQ ID NO: 543473 - DNA, 25 bp, Homo sapien
gctcatgcatttctgattatacaaa

SEQ ID NO: 543474 - DNA, 25 bp, Homo sapien
aacagtttgcagtaggttatttgtc

SEQ ID NO: 543475 - DNA, 25 bp, Homo sapien
gtaggttatttgtcatttcagtttt

SEQ ID NO: 543476 - DNA, 25 bp, Homo sapien
acagacatttgggagcttgcacatc

SEQ ID NO: 543477 - DNA, 25 bp, Homo sapien
ggagcttgcacatcctgatgagcag

SEQ ID NO: 543478 - DNA, 25 bp, Homo sapien
gactcactgtggtggccttagggaa

SEQ ID NO: 543479 - DNA, 25 bp, Homo sapien
ggccttagggaattacacgctcact

SEQ ID NO: 543480 - DNA, 25 bp, Homo sapien
acacgctcactttggtggttctcta

SEQ ID NO: 543481 - DNA, 25 bp, Homo sapien
gttctctatgctcggaagcctctga

SEQ ID NO: 543482 - DNA, 25 bp, Homo sapien
aagcctctgagagtggccttggcag

SEQ ID NO: 543483 - DNA, 25 bp, Homo sapien
ggcagaggctttggagtcttcttag

SEQ ID NO: 543484 - DNA, 25 bp, Homo sapien
aggactgtaagtgcccattgaggat

SEQ ID NO: 543485 - DNA, 25 bp, Homo sapien
aagtaggcccaagtcaaatctgatg

SEQ ID NO: 543486 - DNA, 25 bp, Homo sapien
ggactaatctgcgttgtcattttta

SEQ ID NO: 543487 - DNA, 25 bp, Homo sapien
gaggctgattcgctgtgacttcgaa

SEQ ID NO: 543488 - DNA, 25 bp, Homo sapien
ggctgattcgctgtgacttcgaatt

SEQ ID NO: 543489 - DNA, 25 bp, Homo sapien
cgctgtgacttcgaattgcatcctt

SEQ ID NO: 543490 - DNA, 25 bp, Homo sapien
tgtgacttcgaattgcatccttctg

SEQ ID NO: 543491 - DNA, 25 bp, Homo sapien
gacttcgaattgcatccttctgcaa

SEQ ID NO: 543492 - DNA, 25 bp, Homo sapien
gaattgcatccttctgcaatccggt

SEQ ID NO: 543493 - DNA, 25 bp, Homo sapien
tgcatccttctgcaatccggtgcgc

SEQ ID NO: 543494 - DNA, 25 bp, Homo sapien
tctgggcccagctcggactggtccg

SEQ ID NO: 543495 - DNA, 25 bp, Homo sapien
gccttctggaaagcgctggctggga

SEQ ID NO: 543496 - DNA, 25 bp, Homo sapien
tgggacttcaccctcctccttgaag

SEQ ID NO: 543497 - DNA, 25 bp, Homo sapien
tcaccctcctccttgaagagcagaa

SEQ ID NO: 543498 - DNA, 25 bp, Homo sapien
aacagtgccattgtctttatatgaa

SEQ ID NO: 543499 - DNA, 25 bp, Homo sapien
gaacatagactagagaaaccgtcct

SEQ ID NO: 543500 - DNA, 25 bp, Homo sapien
tagagaaaccgtcctctttttccat

SEQ ID NO: 543501 - DNA, 25 bp, Homo sapien
tcctctttttccatcataattctaa

SEQ ID NO: 543502 - DNA, 25 bp, Homo sapien
agatttgcccatttacacttttgag

SEQ ID NO: 543503 - DNA, 25 bp, Homo sapien
gcccatttacacttttgagactttt

SEQ ID NO: 543504 - DNA, 25 bp, Homo sapien
gtgttttcagagcattagctgtcag

SEQ ID NO: 543505 - DNA, 25 bp, Homo sapien
cagagcattagctgtcagtgtattt

SEQ ID NO: 543506 - DNA, 25 bp, Homo sapien
agctgtcagtgtattttccagtttt

SEQ ID NO: 543507 - DNA, 25 bp, Homo sapien
ttccagttttgggtattgcagattt

SEQ ID NO: 543508 - DNA, 25 bp, Homo sapien
gggtattgcagattttacatacaac

SEQ ID NO: 543509 - DNA, 25 bp, Homo sapien
agaaggcaccagagcccttgggccc

SEQ ID NO: 543510 - DNA, 25 bp, Homo sapien
accagtccgagctgggcccagagca

SEQ ID NO: 543511 - DNA, 25 bp, Homo sapien
cgaggagccggtggagtccagggcc

SEQ ID NO: 543512 - DNA, 25 bp, Homo sapien
cggcgcaccggattgcagaaggtac

SEQ ID NO: 543513 - DNA, 25 bp, Homo sapien
attgcagaaggtacagagcctccga

SEQ ID NO: 543514 - DNA, 25 bp, Homo sapien
cagaaggtacagagcctccgaaggg

SEQ ID NO: 543515 - DNA, 25 bp, Homo sapien
tttcgggccggaaaggccctgcagc

SEQ ID NO: 543516 - DNA, 25 bp, Homo sapien
tcgccttgggcctggccggagcgca

SEQ ID NO: 543517 - DNA, 25 bp, Homo sapien
ccggagcgcagaagcccagccggaa

SEQ ID NO: 543518 - DNA, 25 bp, Homo sapien
agccggaagcccagcctgcgctgga

SEQ ID NO: 543519 - DNA, 25 bp, Homo sapien
tggagcccacgctggagccagagcc

SEQ ID NO: 543520 - DNA, 25 bp, Homo sapien
gaagtttcaaggagaccgccagctc

SEQ ID NO: 543521 - DNA, 25 bp, Homo sapien
aaggagaccgccagctcaagatgga

SEQ ID NO: 543522 - DNA, 25 bp, Homo sapien
agctcaagatggaaaccgcggcccg

SEQ ID NO: 543523 - DNA, 25 bp, Homo sapien
acgggcttcagctcccgctggcaaa

SEQ ID NO: 543524 - DNA, 25 bp, Homo sapien
tcagctcccgctggcaaaaagagaa

SEQ ID NO: 543525 - DNA, 25 bp, Homo sapien
caaaaagagaaagtcgagcccgcct

SEQ ID NO: 543526 - DNA, 25 bp, Homo sapien
agagaaagtcgagcccgccttcctg

SEQ ID NO: 543527 - DNA, 25 bp, Homo sapien
catgacaacaagaaccccggaggga

SEQ ID NO: 543528 - DNA, 25 bp, Homo sapien
agtggaatgagtgacgtcacagccg

SEQ ID NO: 543529 - DNA, 25 bp, Homo sapien
tcacagccgcgctctgaggctgaca

SEQ ID NO: 543530 - DNA, 25 bp, Homo sapien
ggtagggaagtcagccgacttgaaa

SEQ ID NO: 543531 - DNA, 25 bp, Homo sapien
ataacagtgccattgtctttatatg

SEQ ID NO: 543532 - DNA, 25 bp, Homo sapien
aacagtgccattgtctttatatgaa

SEQ ID NO: 543533 - DNA, 25 bp, Homo sapien
cagtgccattgtctttatatgaaca

SEQ ID NO: 543534 - DNA, 25 bp, Homo sapien
tgccattgtctttatatgaacatag

SEQ ID NO: 543535 - DNA, 25 bp, Homo sapien
gaacatagactagagaaaccgtcct

SEQ ID NO: 543536 - DNA, 25 bp, Homo sapien
tagactagagaaaccgtcctctttt

SEQ ID NO: 543537 - DNA, 25 bp, Homo sapien
tagagaaaccgtcctctttttccat

SEQ ID NO: 543538 - DNA, 25 bp, Homo sapien
tttccatcataattctaatctaaca

SEQ ID NO: 543539 - DNA, 25 bp, Homo sapien
taatctaacaatggaagatttgccc

SEQ ID NO: 543540 - DNA, 25 bp, Homo sapien
gaagatttgcccatttacacttttg

SEQ ID NO: 543541 - DNA, 25 bp, Homo sapien
agatttgcccatttacacttttgag

SEQ ID NO: 543542 - DNA, 25 bp, Homo sapien
gcaccagagcccttgggcccggcgg

SEQ ID NO: 543543 - DNA, 25 bp, Homo sapien
tgggcccggcggaccagtccgagct

SEQ ID NO: 543544 - DNA, 25 bp, Homo sapien
cggaccagtccgagctgggcccaga

SEQ ID NO: 543545 - DNA, 25 bp, Homo sapien
accagtccgagctgggcccagagca

SEQ ID NO: 543546 - DNA, 25 bp, Homo sapien
ccagtccgagctgggcccagagcag

SEQ ID NO: 543547 - DNA, 25 bp, Homo sapien
ggaggccgaagttggagagagctcg

SEQ ID NO: 543548 - DNA, 25 bp, Homo sapien
cgaagttggagagagctcggacgag

SEQ ID NO: 543549 - DNA, 25 bp, Homo sapien
aagttggagagagctcggacgagga

SEQ ID NO: 543550 - DNA, 25 bp, Homo sapien
cgaggagccggtggagtccagggcc

SEQ ID NO: 543551 - DNA, 25 bp, Homo sapien
ggctgcggcgcaccggattgcagaa

SEQ ID NO: 543552 - DNA, 25 bp, Homo sapien
ctgcggcgcaccggattgcagaagg

SEQ ID NO: 543553 - DNA, 25 bp, Homo sapien
ccttaggattgagcgtcccgtctga

SEQ ID NO: 543554 - DNA, 25 bp, Homo sapien
gtcccgtctgacgtggagttgccac

SEQ ID NO: 543555 - DNA, 25 bp, Homo sapien
ggagttgccaccaaccgctaaaatg

SEQ ID NO: 543556 - DNA, 25 bp, Homo sapien
cgctaaaatgcacgccatcatcgag

SEQ ID NO: 543557 - DNA, 25 bp, Homo sapien
gcacggccagcttcgtgtgcaggca

SEQ ID NO: 543558 - DNA, 25 bp, Homo sapien
gtttgagatcatgctgaaggccaag

SEQ ID NO: 543559 - DNA, 25 bp, Homo sapien
gaactcccagtttgactttctgcgc

SEQ ID NO: 543560 - DNA, 25 bp, Homo sapien
agtttgactttctgcgcttcgacca

SEQ ID NO: 543561 - DNA, 25 bp, Homo sapien
tcaacccctactataagttcatcca

SEQ ID NO: 543562 - DNA, 25 bp, Homo sapien
ccatgaaagagggacgctacactgt

SEQ ID NO: 543563 - DNA, 25 bp, Homo sapien
gacgctacactgtcctggcagaaaa

SEQ ID NO: 543564 - DNA, 25 bp, Homo sapien
aggcagctggacatgggacccagca

SEQ ID NO: 543565 - DNA, 25 bp, Homo sapien
atgggacccagcaactgctgcatgg

SEQ ID NO: 543566 - DNA, 25 bp, Homo sapien
ctgctgcatggagacagtgctgatg

SEQ ID NO: 543567 - DNA, 25 bp, Homo sapien
ggtggtggcctctcaggactgaaac

SEQ ID NO: 543568 - DNA, 25 bp, Homo sapien
ggactgaaacccacaggtaagcttg

SEQ ID NO: 543569 - DNA, 25 bp, Homo sapien
ggtaagcttgtgcaaagccatcaga

SEQ ID NO: 543570 - DNA, 25 bp, Homo sapien
aaagccatcagaagccctttccttt

SEQ ID NO: 543571 - DNA, 25 bp, Homo sapien
tttaccacaaacaacctgatctcac

SEQ ID NO: 543572 - DNA, 25 bp, Homo sapien
aggaaacctcagcatcaagatggca

SEQ ID NO: 543573 - DNA, 25 bp, Homo sapien
acagcatccctcttccttggaaggt

SEQ ID NO: 543574 - DNA, 25 bp, Homo sapien
ttggaaggtcctcaatacaaacact

SEQ ID NO: 543575 - DNA, 25 bp, Homo sapien
gtttaatataacatgacaggcacta

SEQ ID NO: 543576 - DNA, 25 bp, Homo sapien
tataacatgacaggcactaggacgt

SEQ ID NO: 543577 - DNA, 25 bp, Homo sapien
acatgacaggcactaggacgtctgc

SEQ ID NO: 543578 - DNA, 25 bp, Homo sapien
tgacaggcactaggacgtctgcctt

SEQ ID NO: 543579 - DNA, 25 bp, Homo sapien
ggcactaggacgtctgcctttttaa

SEQ ID NO: 543580 - DNA, 25 bp, Homo sapien
cactaggacgtctgcctttttaagg

SEQ ID NO: 543581 - DNA, 25 bp, Homo sapien
atccatcctgtgcaatatgccgtgt

SEQ ID NO: 543582 - DNA, 25 bp, Homo sapien
catcctgtgcaatatgccgtgtaga

SEQ ID NO: 543583 - DNA, 25 bp, Homo sapien
cctgtgcaatatgccgtgtagaata

SEQ ID NO: 543584 - DNA, 25 bp, Homo sapien
tatgccgtgtagaatatttgtctta

SEQ ID NO: 543585 - DNA, 25 bp, Homo sapien
attcaaggccacaaaaacaatgttt

SEQ ID NO: 543586 - DNA, 25 bp, Homo sapien
cagccagaccctaaggattcctgta

SEQ ID NO: 543587 - DNA, 25 bp, Homo sapien
agaccctaaggattcctgtagctgc

SEQ ID NO: 543588 - DNA, 25 bp, Homo sapien
cctaaggattcctgtagctgcctca

SEQ ID NO: 543589 - DNA, 25 bp, Homo sapien
actgcggctgaggtccatcctgctg

SEQ ID NO: 543590 - DNA, 25 bp, Homo sapien
aggtccatcctgctggacgctatgt

SEQ ID NO: 543591 - DNA, 25 bp, Homo sapien
tgctggacgctatgtcctctgccct

SEQ ID NO: 543592 - DNA, 25 bp, Homo sapien
agccccgctcagcctgctgataggg

SEQ ID NO: 543593 - DNA, 25 bp, Homo sapien
aggatggtgcctgagacaaccctcc

SEQ ID NO: 543594 - DNA, 25 bp, Homo sapien
ctggtactccctctcaggatccaag

SEQ ID NO: 543595 - DNA, 25 bp, Homo sapien
tccctctcaggatccaagctaagca

SEQ ID NO: 543596 - DNA, 25 bp, Homo sapien
aggatccaagctaagcactgccact

SEQ ID NO: 543597 - DNA, 25 bp, Homo sapien
gctgctgggtcttgagccacagctg

SEQ ID NO: 543598 - DNA, 25 bp, Homo sapien
agctgcagccaatgcagcagctcgc

SEQ ID NO: 543599 - DNA, 25 bp, Homo sapien
ttttcctccttgaggcgcttgcgct

SEQ ID NO: 543600 - DNA, 25 bp, Homo sapien
ccttgaggcgcttgcgctccttctt

SEQ ID NO: 543601 - DNA, 25 bp, Homo sapien
gctccttcttctctaggtcctggag

SEQ ID NO: 543602 - DNA, 25 bp, Homo sapien
ttcttctctaggtcctggagcagct

SEQ ID NO: 543603 - DNA, 25 bp, Homo sapien
gcagctcctggaagcgggcactcct

SEQ ID NO: 543604 - DNA, 25 bp, Homo sapien
ctggaagcgggcactccttgggtcc

SEQ ID NO: 543605 - DNA, 25 bp, Homo sapien
ttgggtccacctggtagcccaggag

SEQ ID NO: 543606 - DNA, 25 bp, Homo sapien
acaaagcctcaggagctgggtgccc

SEQ ID NO: 543607 - DNA, 25 bp, Homo sapien
aaagcctcaggagctgggtgcccca

SEQ ID NO: 543608 - DNA, 25 bp, Homo sapien
aaatcagatggatcaaactttgtgt

SEQ ID NO: 543609 - DNA, 25 bp, Homo sapien
cagatggatcaaactttgtgtttaa

SEQ ID NO: 543610 - DNA, 25 bp, Homo sapien
agctaaatgttgaatctgaaatggt

SEQ ID NO: 543611 - DNA, 25 bp, Homo sapien
gaatctgaaatggtaattactgaat

SEQ ID NO: 543612 - DNA, 25 bp, Homo sapien
tcaaagtcagcattttggaagtggt

SEQ ID NO: 543613 - DNA, 25 bp, Homo sapien
ggaagtggtactttcatagattttt

SEQ ID NO: 543614 - DNA, 25 bp, Homo sapien
aaattccataatgtgccttatcttt

SEQ ID NO: 543615 - DNA, 25 bp, Homo sapien
atgtgccttatcttttcattgcagg

SEQ ID NO: 543616 - DNA, 25 bp, Homo sapien
tgccttatcttttcattgcaggatg

SEQ ID NO: 543617 - DNA, 25 bp, Homo sapien
atcttttcattgcaggatgacagac

SEQ ID NO: 543618 - DNA, 25 bp, Homo sapien
ttcattgcaggatgacagaccaaag

SEQ ID NO: 543619 - DNA, 25 bp, Homo sapien
ttggaaatcagagcactgcctcctg

SEQ ID NO: 543620 - DNA, 25 bp, Homo sapien
agcactgcctcctgggacagagatg

SEQ ID NO: 543621 - DNA, 25 bp, Homo sapien
gggctcttcaccagggtgatggtct

SEQ ID NO: 543622 - DNA, 25 bp, Homo sapien
gatgatctgagtcacaggacccgtg

SEQ ID NO: 543623 - DNA, 25 bp, Homo sapien
gtgatggtcttggtgaccccgccca

SEQ ID NO: 543624 - DNA, 25 bp, Homo sapien
acctgggcttgctgggccactgtca

SEQ ID NO: 543625 - DNA, 25 bp, Homo sapien
tgcctgacttgtgcactgtgatgat

SEQ ID NO: 543626 - DNA, 25 bp, Homo sapien
ggaggaaaccgatgtccccacctgg

SEQ ID NO: 543627 - DNA, 25 bp, Homo sapien
acgcctggcctgtgactgctgaagt

SEQ ID NO: 543628 - DNA, 25 bp, Homo sapien
ctgaactggtttggtctggaccacc

SEQ ID NO: 543629 - DNA, 25 bp, Homo sapien
cgacatcactttgcccagattggaa

SEQ ID NO: 543630 - DNA, 25 bp, Homo sapien
acatgactaggctgataatcttatt

SEQ ID NO: 543631 - DNA, 25 bp, Homo sapien
tttaggcttctatacagttaattct

SEQ ID NO: 543632 - DNA, 25 bp, Homo sapien
tctcttctccaatcaagcacttgga

SEQ ID NO: 543633 - DNA, 25 bp, Homo sapien
gttagatctaggtccttctatctcg

SEQ ID NO: 543634 - DNA, 25 bp, Homo sapien
tatctcgtccctctacagatgtatt

SEQ ID NO: 543635 - DNA, 25 bp, Homo sapien
tacagatgtattttccacttgcata

SEQ ID NO: 543636 - DNA, 25 bp, Homo sapien
atgccaacactggttttcttaggtt

SEQ ID NO: 543637 - DNA, 25 bp, Homo sapien
ttctccattttcacctctagtgatg

SEQ ID NO: 543638 - DNA, 25 bp, Homo sapien
ctagtgatggccctactcatatctt

SEQ ID NO: 543639 - DNA, 25 bp, Homo sapien
catatcttctctaatttggtcctga

SEQ ID NO: 543640 - DNA, 25 bp, Homo sapien
tggctcactgtcttacaatcactgc

SEQ ID NO: 543641 - DNA, 25 bp, Homo sapien
gattcacttaattccaactcagtga

SEQ ID NO: 543642 - DNA, 25 bp, Homo sapien
gataaaccactgacattagggttga

SEQ ID NO: 543643 - DNA, 25 bp, Homo sapien
aagttcccttgaatggtagcttcat

SEQ ID NO: 543644 - DNA, 25 bp, Homo sapien
gaatttcctttgtacttaattgaat

SEQ ID NO: 543645 - DNA, 25 bp, Homo sapien
tacttaattgaatagcttttcccct

SEQ ID NO: 543646 - DNA, 25 bp, Homo sapien
acactctaagaaaatgcagtcctct

SEQ ID NO: 543647 - DNA, 25 bp, Homo sapien
aaatgcagtcctctatttagcctag

SEQ ID NO: 543648 - DNA, 25 bp, Homo sapien
agtcctctatttagcctaggcttga

SEQ ID NO: 543649 - DNA, 25 bp, Homo sapien
agcctaggcttgacaatacttaaat

SEQ ID NO: 543650 - DNA, 25 bp, Homo sapien
taaaggcttactccctaatctttgg

SEQ ID NO: 543651 - DNA, 25 bp, Homo sapien
gcttactccctaatctttgggtggc

SEQ ID NO: 543652 - DNA, 25 bp, Homo sapien
tcagtttacaaacctgtgagctact

SEQ ID NO: 543653 - DNA, 25 bp, Homo sapien
gtttacaaacctgtgagctactgtt

SEQ ID NO: 543654 - DNA, 25 bp, Homo sapien
tacaaacctgtgagctactgttggc

SEQ ID NO: 543655 - DNA, 25 bp, Homo sapien
aaacctgtgagctactgttggctgc

SEQ ID NO: 543656 - DNA, 25 bp, Homo sapien
aacctgtgagctactgttggctgct

SEQ ID NO: 543657 - DNA, 25 bp, Homo sapien
acctgtgagctactgttggctgctg

SEQ ID NO: 543658 - DNA, 25 bp, Homo sapien
tgtgagctactgttggctgctgccc

SEQ ID NO: 543659 - DNA, 25 bp, Homo sapien
tgagctactgttggctgctgccctc

SEQ ID NO: 543660 - DNA, 25 bp, Homo sapien
agagacgttgtgatgatgcgactga

SEQ ID NO: 543661 - DNA, 25 bp, Homo sapien
cgttgtgatgatgcgactgaggatt

SEQ ID NO: 543662 - DNA, 25 bp, Homo sapien
atgatgcgactgaggattatgcaac

SEQ ID NO: 543663 - DNA, 25 bp, Homo sapien
ataggggccaccatcgtcctcaaag

SEQ ID NO: 543664 - DNA, 25 bp, Homo sapien
tcaaagtctggcatgtcgaagcggg

SEQ ID NO: 543665 - DNA, 25 bp, Homo sapien
gggtgccccataaggagcctcccgg

SEQ ID NO: 543666 - DNA, 25 bp, Homo sapien
tagcgcaggtggtgggtacaactca

SEQ ID NO: 543667 - DNA, 25 bp, Homo sapien
gtggtgggtacaactcaggcccata

SEQ ID NO: 543668 - DNA, 25 bp, Homo sapien
gggtacaactcaggcccatatggga

SEQ ID NO: 543669 - DNA, 25 bp, Homo sapien
acaactcaggcccatatgggaggcc

SEQ ID NO: 543670 - DNA, 25 bp, Homo sapien
gccctggtaaggtggacctaagtct

SEQ ID NO: 543671 - DNA, 25 bp, Homo sapien
taaggtggacctaagtctgggccgt

SEQ ID NO: 543672 - DNA, 25 bp, Homo sapien
ggacctaagtctgggccgtactcgt

SEQ ID NO: 543673 - DNA, 25 bp, Homo sapien
gagtccaaagccacctggtcgcggg

SEQ ID NO: 543674 - DNA, 25 bp, Homo sapien
atttttccaatatagagtctttgca

SEQ ID NO: 543675 - DNA, 25 bp, Homo sapien
acactgaggcatcttgcacagctgc

SEQ ID NO: 543676 - DNA, 25 bp, Homo sapien
ggcatcttgcacagctgcagttaag

SEQ ID NO: 543677 - DNA, 25 bp, Homo sapien
tgtacacaatgggttccggtttcct

SEQ ID NO: 543678 - DNA, 25 bp, Homo sapien
ggttccggtttccttgcaccttgtg

SEQ ID NO: 543679 - DNA, 25 bp, Homo sapien
gcaccttgtgcagtatcctttattt

SEQ ID NO: 543680 - DNA, 25 bp, Homo sapien
ttgtgcagtatcctttatttctgtg

SEQ ID NO: 543681 - DNA, 25 bp, Homo sapien
ttctgtgctgttctctcctgagcat

SEQ ID NO: 543682 - DNA, 25 bp, Homo sapien
gatcattatccaatttgtatttcct

SEQ ID NO: 543683 - DNA, 25 bp, Homo sapien
tgtatttccttggtacatattttaa

SEQ ID NO: 543684 - DNA, 25 bp, Homo sapien
acagtcattgactttacaattcagt

SEQ ID NO: 543685 - DNA, 25 bp, Homo sapien
acgctctttaagagtctgcactgga

SEQ ID NO: 543686 - DNA, 25 bp, Homo sapien
attaccagctcccttcttgcagaag

SEQ ID NO: 543687 - DNA, 25 bp, Homo sapien
acatttattcatgccagtctgttgc

SEQ ID NO: 543688 - DNA, 25 bp, Homo sapien
ggcttcctaccttgcaacaaaataa

SEQ ID NO: 543689 - DNA, 25 bp, Homo sapien
aattgcaccaactccttagtgccga

SEQ ID NO: 543690 - DNA, 25 bp, Homo sapien
attccgcccacagagagtcctggag

SEQ ID NO: 543691 - DNA, 25 bp, Homo sapien
gagccacagtcttttttgctttgca

SEQ ID NO: 543692 - DNA, 25 bp, Homo sapien
gtgctagagactatgtcgctttcct

SEQ ID NO: 543693 - DNA, 25 bp, Homo sapien
atgtcgctttcctgagctaccgaga

SEQ ID NO: 543694 - DNA, 25 bp, Homo sapien
tgagctaccgagagcgctcgtgaac

SEQ ID NO: 543695 - DNA, 25 bp, Homo sapien
gagcgctcgtgaactggaatcaact

SEQ ID NO: 543696 - DNA, 25 bp, Homo sapien
gattcagagctaaatattcaccata

SEQ ID NO: 543697 - DNA, 25 bp, Homo sapien
aaatattcaccataatccaggaggg

SEQ ID NO: 543698 - DNA, 25 bp, Homo sapien
caccataatccaggagggtctcctt

SEQ ID NO: 543699 - DNA, 25 bp, Homo sapien
cagaggcagaacgtccaagaatgga

SEQ ID NO: 543700 - DNA, 25 bp, Homo sapien
tcatagtaaagtctcagtctgaata

SEQ ID NO: 543701 - DNA, 25 bp, Homo sapien
gtctcagtctgaatatttagcaaga

SEQ ID NO: 543702 - DNA, 25 bp, Homo sapien
gcagaggaacccaaaggcagtaaat

SEQ ID NO: 543703 - DNA, 25 bp, Homo sapien
ttttcatccaaaagactttcacaga

SEQ ID NO: 543704 - DNA, 25 bp, Homo sapien
acagaaacacattactcacagccat

SEQ ID NO: 543705 - DNA, 25 bp, Homo sapien
attactcacagccatgtatatcttg

SEQ ID NO: 543706 - DNA, 25 bp, Homo sapien
gccatgtatatcttggacagagttt

SEQ ID NO: 543707 - DNA, 25 bp, Homo sapien
taattctagaatttaagcatcagtc

SEQ ID NO: 543708 - DNA, 25 bp, Homo sapien
gaatttaagcatcagtctgttctta

SEQ ID NO: 543709 - DNA, 25 bp, Homo sapien
agcatcagtctgttcttataaaagt

SEQ ID NO: 543710 - DNA, 25 bp, Homo sapien
cagtctgttcttataaaagttaggt

SEQ ID NO: 543711 - DNA, 25 bp, Homo sapien
acatttgttgtttaatatttctgtc

SEQ ID NO: 543712 - DNA, 25 bp, Homo sapien
ccccaaaaattgctatcactctata

SEQ ID NO: 543713 - DNA, 25 bp, Homo sapien
attgctatcactctataatcctaag

SEQ ID NO: 543714 - DNA, 25 bp, Homo sapien
cactctataatcctaagtatttttc

SEQ ID NO: 543715 - DNA, 25 bp, Homo sapien
gactatgttcatacttctctaattt

SEQ ID NO: 543716 - DNA, 25 bp, Homo sapien
ctatgttcatacttctctaattttt

SEQ ID NO: 543717 - DNA, 25 bp, Homo sapien
agtttgtgttttatgcctttagtca

SEQ ID NO: 543718 - DNA, 25 bp, Homo sapien
ttacacctccttattctttctttca

SEQ ID NO: 543719 - DNA, 25 bp, Homo sapien
tctttctttcatttcctaaggcttt

SEQ ID NO: 543720 - DNA, 25 bp, Homo sapien
taaggctttttgtctcagggcttct

SEQ ID NO: 543721 - DNA, 25 bp, Homo sapien
agaaagtgtttctcactctccagca

SEQ ID NO: 543722 - DNA, 25 bp, Homo sapien
tcactctccagcagctacagatgga

SEQ ID NO: 543723 - DNA, 25 bp, Homo sapien
cagcagctacagatggatgtctact

SEQ ID NO: 543724 - DNA, 25 bp, Homo sapien
gtttattgagaacaactaatcctag

SEQ ID NO: 543725 - DNA, 25 bp, Homo sapien
tatgggagtcctaacgatcacccac

SEQ ID NO: 543726 - DNA, 25 bp, Homo sapien
cgatcacccaccattctgagaaatg

SEQ ID NO: 543727 - DNA, 25 bp, Homo sapien
aaatggttggtatctatggacccct

SEQ ID NO: 543728 - DNA, 25 bp, Homo sapien
ttggtatctatggacccctttcctg

SEQ ID NO: 543729 - DNA, 25 bp, Homo sapien
ccctgggtttacatcaagagaagca

SEQ ID NO: 543730 - DNA, 25 bp, Homo sapien
gggaaaccttttcatctccaagagc

SEQ ID NO: 543731 - DNA, 25 bp, Homo sapien
gaaaccttttcatctccaagagcgg

SEQ ID NO: 543732 - DNA, 25 bp, Homo sapien
accttttcatctccaagagcgggca

SEQ ID NO: 543733 - DNA, 25 bp, Homo sapien
tttcatctccaagagcgggcaggaa

SEQ ID NO: 543734 - DNA, 25 bp, Homo sapien
ccaagagcgggcaggaacagcagct

SEQ ID NO: 543735 - DNA, 25 bp, Homo sapien
acagcagctggcctgaacttgaagg

SEQ ID NO: 543736 - DNA, 25 bp, Homo sapien
gaacttgaaggtacaccaggtagct

SEQ ID NO: 543737 - DNA, 25 bp, Homo sapien
aaggtacaccaggtagcttgcgtgg

SEQ ID NO: 543738 - DNA, 25 bp, Homo sapien
acaccaggtagcttgcgtgggccag

SEQ ID NO: 543739 - DNA, 25 bp, Homo sapien
gagaaggtgattctcttctatgcct

SEQ ID NO: 543740 - DNA, 25 bp, Homo sapien
agccccagcctagggtcagacaggg

SEQ ID NO: 543741 - DNA, 25 bp, Homo sapien
gggtcagacagggtgagcctcatac

SEQ ID NO: 543742 - DNA, 25 bp, Homo sapien
gggtgagcctcatacagactgtgcc

SEQ ID NO: 543743 - DNA, 25 bp, Homo sapien
tcatacagactgtgccttgatggcc

SEQ ID NO: 543744 - DNA, 25 bp, Homo sapien
cttgatggccccagccttgggagaa

SEQ ID NO: 543745 - DNA, 25 bp, Homo sapien
gaatttactgttaacctggaagact

SEQ ID NO: 543746 - DNA, 25 bp, Homo sapien
acctggaagactactgaatcatttt

SEQ ID NO: 543747 - DNA, 25 bp, Homo sapien
atcattttacccttgcccagtggaa

SEQ ID NO: 543748 - DNA, 25 bp, Homo sapien
tttacccttgcccagtggaatagga

SEQ ID NO: 543749 - DNA, 25 bp, Homo sapien
cttgcccagtggaataggacctaaa

SEQ ID NO: 543750 - DNA, 25 bp, Homo sapien
gggtagcaattgatactgttttgta

SEQ ID NO: 543751 - DNA, 25 bp, Homo sapien
gggccaaggcctgctgagctgattc

SEQ ID NO: 543752 - DNA, 25 bp, Homo sapien
ggccaaggcctgctgagctgattct

SEQ ID NO: 543753 - DNA, 25 bp, Homo sapien
gctgagctgattctccagctgctgc

SEQ ID NO: 543754 - DNA, 25 bp, Homo sapien
tttccgccttgcacagcacagaggt

SEQ ID NO: 543755 - DNA, 25 bp, Homo sapien
tccgccttgcacagcacagaggtgg

SEQ ID NO: 543756 - DNA, 25 bp, Homo sapien
gccttgcacagcacagaggtggtca

SEQ ID NO: 543757 - DNA, 25 bp, Homo sapien
ttgcacagcacagaggtggtcaccc

SEQ ID NO: 543758 - DNA, 25 bp, Homo sapien
cccggccactcagacttgtttgaag

SEQ ID NO: 543759 - DNA, 25 bp, Homo sapien
gcactggcagcttttttgtctcctt

SEQ ID NO: 543760 - DNA, 25 bp, Homo sapien
tcctttgggtattcacaacagccag

SEQ ID NO: 543761 - DNA, 25 bp, Homo sapien
caacagccagggacttgattttgat

SEQ ID NO: 543762 - DNA, 25 bp, Homo sapien
agtaggcttggcttaaaatttccat

SEQ ID NO: 543763 - DNA, 25 bp, Homo sapien
taggcttggcttaaaatttccattt

SEQ ID NO: 543764 - DNA, 25 bp, Homo sapien
atttagtgaacattgagggatcgaa

SEQ ID NO: 543765 - DNA, 25 bp, Homo sapien
acattgagggatcgaaagaaatcta

SEQ ID NO: 543766 - DNA, 25 bp, Homo sapien
aagaaatctaagtgatacgccccaa

SEQ ID NO: 543767 - DNA, 25 bp, Homo sapien
gaaatctaagtgatacgccccaatg

SEQ ID NO: 543768 - DNA, 25 bp, Homo sapien
atctaagtgatacgccccaatgaag

SEQ ID NO: 543769 - DNA, 25 bp, Homo sapien
agtgatacgccccaatgaagctaaa

SEQ ID NO: 543770 - DNA, 25 bp, Homo sapien
atacgccccaatgaagctaaaatat

SEQ ID NO: 543771 - DNA, 25 bp, Homo sapien
gaagctaaaatatagccttctgtta

SEQ ID NO: 543772 - DNA, 25 bp, Homo sapien
taaaatatagccttctgttaagcaa

SEQ ID NO: 543773 - DNA, 25 bp, Homo sapien
cggccccttggaagagttgttgcca

SEQ ID NO: 543774 - DNA, 25 bp, Homo sapien
gccccttggaagagttgttgccaga

SEQ ID NO: 543775 - DNA, 25 bp, Homo sapien
ccttggaagagttgttgccagacca

SEQ ID NO: 543776 - DNA, 25 bp, Homo sapien
aagagttgttgccagaccagggttt

SEQ ID NO: 543777 - DNA, 25 bp, Homo sapien
agagttgttgccagaccagggtttt

SEQ ID NO: 543778 - DNA, 25 bp, Homo sapien
gagttgttgccagaccagggttttg

SEQ ID NO: 543779 - DNA, 25 bp, Homo sapien
agttgttgccagaccagggttttgg

SEQ ID NO: 543780 - DNA, 25 bp, Homo sapien
gggaaacctgtcttgacattcaaaa

SEQ ID NO: 543781 - DNA, 25 bp, Homo sapien
tgtcttgacattcaaaacctttttc

SEQ ID NO: 543782 - DNA, 25 bp, Homo sapien
atctgaacccctgttgactaatctt

SEQ ID NO: 543783 - DNA, 25 bp, Homo sapien
gactaatcttgcctgggtttgtgta

SEQ ID NO: 543784 - DNA, 25 bp, Homo sapien
cactgcagtagatgttatttggcca

SEQ ID NO: 543785 - DNA, 25 bp, Homo sapien
atttggccatctcctggttatatac

SEQ ID NO: 543786 - DNA, 25 bp, Homo sapien
ttggccatctcctggttatatacaa

SEQ ID NO: 543787 - DNA, 25 bp, Homo sapien
gccatctcctggttatatacaaatg

SEQ ID NO: 543788 - DNA, 25 bp, Homo sapien
gttatatacaaatgtgacccgtgat

SEQ ID NO: 543789 - DNA, 25 bp, Homo sapien
tatacaaatgtgacccgtgataatg

SEQ ID NO: 543790 - DNA, 25 bp, Homo sapien
gtgacccgtgataatgtgattgaac

SEQ ID NO: 543791 - DNA, 25 bp, Homo sapien
gtgattgaacactttagtaatgcaa

SEQ ID NO: 543792 - DNA, 25 bp, Homo sapien
aaataactcatttccaactactgct

SEQ ID NO: 543793 - DNA, 25 bp, Homo sapien
aaacctgtagcgattcgttacactg

SEQ ID NO: 543794 - DNA, 25 bp, Homo sapien
acctgtagcgattcgttacactggg

SEQ ID NO: 543795 - DNA, 25 bp, Homo sapien
cttcctttgtgtttatatggcgttt

SEQ ID NO: 543796 - DNA, 25 bp, Homo sapien
agtatttcaactgctgtaaaattat

SEQ ID NO: 543797 - DNA, 25 bp, Homo sapien
agttcctcgctctgggatgcaggca

SEQ ID NO: 543798 - DNA, 25 bp, Homo sapien
ctctgggatgcaggcatgcttctca

SEQ ID NO: 543799 - DNA, 25 bp, Homo sapien
agagctgcacttggcctcagctggc

SEQ ID NO: 543800 - DNA, 25 bp, Homo sapien
cttggcctcagctggctgtatggaa

SEQ ID NO: 543801 - DNA, 25 bp, Homo sapien
tgtatggaaatgcaccctccctcct

SEQ ID NO: 543802 - DNA, 25 bp, Homo sapien
tagaaccttctagaacctgggctgt

SEQ ID NO: 543803 - DNA, 25 bp, Homo sapien
cttctagaacctgggctgtgctgct

SEQ ID NO: 543804 - DNA, 25 bp, Homo sapien
agggcagcatctcggttctgcgcca

SEQ ID NO: 543805 - DNA, 25 bp, Homo sapien
tgcgccacttcctttgtgtttatat

SEQ ID NO: 543806 - DNA, 25 bp, Homo sapien
tcaacctggccatgtgtcatctgaa

SEQ ID NO: 543807 - DNA, 25 bp, Homo sapien
acctggccatgtgtcatctgaaact

SEQ ID NO: 543808 - DNA, 25 bp, Homo sapien
tcatctgaaactacaggccttctct

SEQ ID NO: 543809 - DNA, 25 bp, Homo sapien
aggccttctctgctgccattgaaag

SEQ ID NO: 543810 - DNA, 25 bp, Homo sapien
ttctctgctgccattgaaagctgta

SEQ ID NO: 543811 - DNA, 25 bp, Homo sapien
gaaagctgtaacaaggccctagaac

SEQ ID NO: 543812 - DNA, 25 bp, Homo sapien
caaggccctagaactggacagcaac

SEQ ID NO: 543813 - DNA, 25 bp, Homo sapien
cctggccgtgaatgactttgaactg

SEQ ID NO: 543814 - DNA, 25 bp, Homo sapien
atgactttgaactggcacgggctga

SEQ ID NO: 543815 - DNA, 25 bp, Homo sapien
gcacgggctgatttccagaaggtcc

SEQ ID NO: 543816 - DNA, 25 bp, Homo sapien
atttccagaaggtcctgcagctcta

SEQ ID NO: 543817 - DNA, 25 bp, Homo sapien
ggcctcagcctgcagtcgggccctc

SEQ ID NO: 543818 - DNA, 25 bp, Homo sapien
tcctctccttgtcagcctgggcctt

SEQ ID NO: 543819 - DNA, 25 bp, Homo sapien
gctgctgctgccagttcacaatcat

SEQ ID NO: 543820 - DNA, 25 bp, Homo sapien
tgctgctgccagttcacaatcatct

SEQ ID NO: 543821 - DNA, 25 bp, Homo sapien
gctgctgccagttcacaatcatctg

SEQ ID NO: 543822 - DNA, 25 bp, Homo sapien
ctgctgccagttcacaatcatctgt

SEQ ID NO: 543823 - DNA, 25 bp, Homo sapien
tgctgccagttcacaatcatctgtg

SEQ ID NO: 543824 - DNA, 25 bp, Homo sapien
gctgccagttcacaatcatctgtgg

SEQ ID NO: 543825 - DNA, 25 bp, Homo sapien
ctgccagttcacaatcatctgtggc

SEQ ID NO: 543826 - DNA, 25 bp, Homo sapien
gccagttcacaatcatctgtggcat

SEQ ID NO: 543827 - DNA, 25 bp, Homo sapien
ccagttcacaatcatctgtggcatc

SEQ ID NO: 543828 - DNA, 25 bp, Homo sapien
tcttctgtagttaagcaaacacttg

SEQ ID NO: 543829 - DNA, 25 bp, Homo sapien
tatgtgcacggcatgggcccatatg

SEQ ID NO: 543830 - DNA, 25 bp, Homo sapien
gtgtgaggagcttgtctaattatgt

SEQ ID NO: 543831 - DNA, 25 bp, Homo sapien
gtaggaagcaatagatctcggtagt

SEQ ID NO: 543832 - DNA, 25 bp, Homo sapien
gatctcggtagttacgtattgggca

SEQ ID NO: 543833 - DNA, 25 bp, Homo sapien
cgtattgggcagatacttactgtat

SEQ ID NO: 543834 - DNA, 25 bp, Homo sapien
gaaagaacatcacagtaatcacaat

SEQ ID NO: 543835 - DNA, 25 bp, Homo sapien
gtaatcacaatatcagagctgaatt

SEQ ID NO: 543836 - DNA, 25 bp, Homo sapien
aattatcctcagtgtagcttcttgg

SEQ ID NO: 543837 - DNA, 25 bp, Homo sapien
agcttcttggaattcagtttctgga

SEQ ID NO: 543838 - DNA, 25 bp, Homo sapien
aaaaactcctgttgagactgtgtct

SEQ ID NO: 543839 - DNA, 25 bp, Homo sapien
gtttaatataacatgacaggcacta

SEQ ID NO: 543840 - DNA, 25 bp, Homo sapien
taacatgacaggcactaggacgtct

SEQ ID NO: 543841 - DNA, 25 bp, Homo sapien
tgacaggcactaggacgtctgcctt

SEQ ID NO: 543842 - DNA, 25 bp, Homo sapien
ggcactaggacgtctgcctttttaa

SEQ ID NO: 543843 - DNA, 25 bp, Homo sapien
cactaggacgtctgcctttttaagg

SEQ ID NO: 543844 - DNA, 25 bp, Homo sapien
atccatcctgtgcaatatgccgtgt

SEQ ID NO: 543845 - DNA, 25 bp, Homo sapien
atcctgtgcaatatgccgtgtagaa

SEQ ID NO: 543846 - DNA, 25 bp, Homo sapien
tatgccgtgtagaatatttgtctta

SEQ ID NO: 543847 - DNA, 25 bp, Homo sapien
atttgtcttaaaattcaaggccaca

SEQ ID NO: 543848 - DNA, 25 bp, Homo sapien
attcaaggccacaaaaacaatgttt

SEQ ID NO: 543849 - DNA, 25 bp, Homo sapien
aatcatgtcaagttcactgcctgtc

SEQ ID NO: 543850 - DNA, 25 bp, Homo sapien
tccagccacgtccagtgccacagtc

SEQ ID NO: 543851 - DNA, 25 bp, Homo sapien
tgccacagtccccagtagcctcaag

SEQ ID NO: 543852 - DNA, 25 bp, Homo sapien
gggtctgggaaatccaactctctcc

SEQ ID NO: 543853 - DNA, 25 bp, Homo sapien
ggtctgggaaatccaactctctcca

SEQ ID NO: 543854 - DNA, 25 bp, Homo sapien
tgggaaatccaactctctccacagt

SEQ ID NO: 543855 - DNA, 25 bp, Homo sapien
ggaaatccaactctctccacagtgt

SEQ ID NO: 543856 - DNA, 25 bp, Homo sapien
aaatccaactctctccacagtgtga

SEQ ID NO: 543857 - DNA, 25 bp, Homo sapien
ctcactcttccgctagggataaagc

SEQ ID NO: 543858 - DNA, 25 bp, Homo sapien
cactcttccgctagggataaagcag

SEQ ID NO: 543859 - DNA, 25 bp, Homo sapien
tcttccgctagggataaagcagatg

SEQ ID NO: 543860 - DNA, 25 bp, Homo sapien
ttccgctagggataaagcagatgtg

SEQ ID NO: 543861 - DNA, 25 bp, Homo sapien
agagcctggctgaggagcacgaggg

SEQ ID NO: 543862 - DNA, 25 bp, Homo sapien
atcgacctgcagttcctgcatggct

SEQ ID NO: 543863 - DNA, 25 bp, Homo sapien
ttcctgcatggctactacgagccta

SEQ ID NO: 543864 - DNA, 25 bp, Homo sapien
tgcatggctactacgagcctaccct

SEQ ID NO: 543865 - DNA, 25 bp, Homo sapien
tcatcctgtttgagcccaaccagac

SEQ ID NO: 543866 - DNA, 25 bp, Homo sapien
ttgagcccaaccagacctggcctgg

SEQ ID NO: 543867 - DNA, 25 bp, Homo sapien
aggacacgtgctccattgtggccat

SEQ ID NO: 543868 - DNA, 25 bp, Homo sapien
attgtggccatctcactgaacatca

SEQ ID NO: 543869 - DNA, 25 bp, Homo sapien
ccatctcactgaacatcacgcagaa

SEQ ID NO: 543870 - DNA, 25 bp, Homo sapien
aacatcacgcagaaggtgcaccccg

SEQ ID NO: 543871 - DNA, 25 bp, Homo sapien
gcagaaggtgcaccccgtcatctgg

SEQ ID NO: 543872 - DNA, 25 bp, Homo sapien
ggaggtggtgattgccggcatgtcc

SEQ ID NO: 543873 - DNA, 25 bp, Homo sapien
tgattgccggcatgtccgggaagct

SEQ ID NO: 543874 - DNA, 25 bp, Homo sapien
attgccggcatgtccgggaagctgc

SEQ ID NO: 543875 - DNA, 25 bp, Homo sapien
ggaagctgccagagtcggagaactt

SEQ ID NO: 543876 - DNA, 25 bp, Homo sapien
aagctgccagagtcggagaacttgc

SEQ ID NO: 543877 - DNA, 25 bp, Homo sapien
agctgccagagtcggagaacttgca

SEQ ID NO: 543878 - DNA, 25 bp, Homo sapien
tgccagagtcggagaacttgcagga

SEQ ID NO: 543879 - DNA, 25 bp, Homo sapien
ccagagtcggagaacttgcaggagt

SEQ ID NO: 543880 - DNA, 25 bp, Homo sapien
gagtcggagaacttgcaggagttct

SEQ ID NO: 543881 - DNA, 25 bp, Homo sapien
tgggacaacctcatcggcggtgtgg

SEQ ID NO: 543882 - DNA, 25 bp, Homo sapien
ggacaacctcatcggcggtgtggac

SEQ ID NO: 543883 - DNA, 25 bp, Homo sapien
atcgacttcatgactagagagacgg

SEQ ID NO: 543884 - DNA, 25 bp, Homo sapien
agagagacggctgacaccgacactg

SEQ ID NO: 543885 - DNA, 25 bp, Homo sapien
gacactgccgagcaggtcatcgcct

SEQ ID NO: 543886 - DNA, 25 bp, Homo sapien
cttccggatcctggcttctgataag

SEQ ID NO: 543887 - DNA, 25 bp, Homo sapien
gataagccatacatcctggcggagg

SEQ ID NO: 543888 - DNA, 25 bp, Homo sapien
actgcatcaagaggatgcccgccta

SEQ ID NO: 543889 - DNA, 25 bp, Homo sapien
gcagtgtgcctggtgcactggatta

SEQ ID NO: 543890 - DNA, 25 bp, Homo sapien
gtgcactggattacgctgcgttctc

SEQ ID NO: 543891 - DNA, 25 bp, Homo sapien
gagcgatctgtgatgctgagcttct

SEQ ID NO: 543892 - DNA, 25 bp, Homo sapien
tgagcttctgtaatcactcatccca

SEQ ID NO: 543893 - DNA, 25 bp, Homo sapien
aatcactcatcccatcagaatgcaa

SEQ ID NO: 543894 - DNA, 25 bp, Homo sapien
aatcaaaatatccttctgttttggc

SEQ ID NO: 543895 - DNA, 25 bp, Homo sapien
tctgttttggcattgcattactaaa

SEQ ID NO: 543896 - DNA, 25 bp, Homo sapien
agccaggttggtccatttggctcaa

SEQ ID NO: 543897 - DNA, 25 bp, Homo sapien
gaaggcagctatactagtgttttac

SEQ ID NO: 543898 - DNA, 25 bp, Homo sapien
tgttttactgtatatctctattcca

SEQ ID NO: 543899 - DNA, 25 bp, Homo sapien
ctctattccagtaatttcatctcta

SEQ ID NO: 543900 - DNA, 25 bp, Homo sapien
atctctacttaattgttatcatctg

SEQ ID NO: 543901 - DNA, 25 bp, Homo sapien
gtgggattgtttatctgcacttgat

SEQ ID NO: 543902 - DNA, 25 bp, Homo sapien
ggtccatttggctcaagctcataca

SEQ ID NO: 543903 - DNA, 25 bp, Homo sapien
gcacttgatagtaaaatacggtcta

SEQ ID NO: 543904 - DNA, 25 bp, Homo sapien
atacggtctacttaggcttggatga

SEQ ID NO: 543905 - DNA, 25 bp, Homo sapien
cttggatttggctcatacgttgata

SEQ ID NO: 543906 - DNA, 25 bp, Homo sapien
gatttggctcatacgttgataaaac

SEQ ID NO: 543907 - DNA, 25 bp, Homo sapien
ggctcatacgttgataaaacagttt

SEQ ID NO: 543908 - DNA, 25 bp, Homo sapien
tatcttgttgatgtctcagcatcaa

SEQ ID NO: 543909 - DNA, 25 bp, Homo sapien
aaaacagtttcaccatacattagca

SEQ ID NO: 543910 - DNA, 25 bp, Homo sapien
gtttcaccatacattagcatccacc

SEQ ID NO: 543911 - DNA, 25 bp, Homo sapien
atacattagcatccaccccgaaagg

SEQ ID NO: 543912 - DNA, 25 bp, Homo sapien
gcatccaccccgaaaggattcataa

SEQ ID NO: 543913 - DNA, 25 bp, Homo sapien
ccaccccgaaaggattcataatcaa

SEQ ID NO: 543914 - DNA, 25 bp, Homo sapien
gatgtctcagcatcaatgcacaata

SEQ ID NO: 543915 - DNA, 25 bp, Homo sapien
attccgttggaaacgatttatctag

SEQ ID NO: 543916 - DNA, 25 bp, Homo sapien
gtgctggaaaatatattcaccaaac

SEQ ID NO: 543917 - DNA, 25 bp, Homo sapien
tagtttacacctatactgcataatc

SEQ ID NO: 543918 - DNA, 25 bp, Homo sapien
tacacctatactgcataatccaaca

SEQ ID NO: 543919 - DNA, 25 bp, Homo sapien
atactgcataatccaacaattttaa

SEQ ID NO: 543920 - DNA, 25 bp, Homo sapien
cagttgaagacatgttactaatata

SEQ ID NO: 543921 - DNA, 25 bp, Homo sapien
ggatgtgtaattaaccatatcttct

SEQ ID NO: 543922 - DNA, 25 bp, Homo sapien
atgtaacatcaatattgaccttggt

SEQ ID NO: 543923 - DNA, 25 bp, Homo sapien
atattgaccttggtttcttacacaa

SEQ ID NO: 543924 - DNA, 25 bp, Homo sapien
gaccttggtttcttacacaagtgtt

SEQ ID NO: 543925 - DNA, 25 bp, Homo sapien
cacaagtgttgctaactcaatagtg

SEQ ID NO: 543926 - DNA, 25 bp, Homo sapien
gctaactcaatagtgaaggagacac

SEQ ID NO: 543927 - DNA, 25 bp, Homo sapien
taggcatagctatcccagtgcaagt

SEQ ID NO: 543928 - DNA, 25 bp, Homo sapien
agtgcaagttaggtgggaacccaga

SEQ ID NO: 543929 - DNA, 25 bp, Homo sapien
cctcaggttactggctgtctccttg

SEQ ID NO: 543930 - DNA, 25 bp, Homo sapien
ctccttgacatttccatctgcagaa

SEQ ID NO: 543931 - DNA, 25 bp, Homo sapien
gaaggcaccctcaaatagagtcctc

SEQ ID NO: 543932 - DNA, 25 bp, Homo sapien
aatagagtcctccatgttgccctca

SEQ ID NO: 543933 - DNA, 25 bp, Homo sapien
gaggctgttcctccccaaggctttc

SEQ ID NO: 543934 - DNA, 25 bp, Homo sapien
agaaagagcaacaccatccacctag

SEQ ID NO: 543935 - DNA, 25 bp, Homo sapien
atccacctagcagttcaagccagaa

SEQ ID NO: 543936 - DNA, 25 bp, Homo sapien
gccagaaaccttggaatctaacttc

SEQ ID NO: 543937 - DNA, 25 bp, Homo sapien
tcatttccaaccctcagacttttta

SEQ ID NO: 543938 - DNA, 25 bp, Homo sapien
gcatgacaagatgttattagctggt

SEQ ID NO: 543939 - DNA, 25 bp, Homo sapien
acaagatgttattagctggtaagca

SEQ ID NO: 543940 - DNA, 25 bp, Homo sapien
gttattagctggtaagcatatacaa

SEQ ID NO: 543941 - DNA, 25 bp, Homo sapien
gagtgagacctctagaaagaagtaa

SEQ ID NO: 543942 - DNA, 25 bp, Homo sapien
gtagctgagcatgatagtatgtgtc

SEQ ID NO: 543943 - DNA, 25 bp, Homo sapien
gctgagcatgatagtatgtgtctgt

SEQ ID NO: 543944 - DNA, 25 bp, Homo sapien
catgatagtatgtgtctgtggtctc

SEQ ID NO: 543945 - DNA, 25 bp, Homo sapien
atgatagtatgtgtctgtggtctca

SEQ ID NO: 543946 - DNA, 25 bp, Homo sapien
taaggtcagaggattgcctgcgccc

SEQ ID NO: 543947 - DNA, 25 bp, Homo sapien
aaggtcagaggattgcctgcgccca

SEQ ID NO: 543948 - DNA, 25 bp, Homo sapien
aggtcagaggattgcctgcgcccag

SEQ ID NO: 543949 - DNA, 25 bp, Homo sapien
atggaatgcgtgaggctggcttctg

SEQ ID NO: 543950 - DNA, 25 bp, Homo sapien
gcttctgggttgtccacaccactct

SEQ ID NO: 543951 - DNA, 25 bp, Homo sapien
tctgctgtgttgacttcctgttgtc

SEQ ID NO: 543952 - DNA, 25 bp, Homo sapien
tccgtggtattctaaaattaggcca

SEQ ID NO: 543953 - DNA, 25 bp, Homo sapien
attctaaaattaggccagcagtggg

SEQ ID NO: 543954 - DNA, 25 bp, Homo sapien
gagggcatctgtgttagtcctttcc

SEQ ID NO: 543955 - DNA, 25 bp, Homo sapien
atctgtgttagtcctttcctggctg

SEQ ID NO: 543956 - DNA, 25 bp, Homo sapien
tgttagtcctttcctggctgtgacc

SEQ ID NO: 543957 - DNA, 25 bp, Homo sapien
gcagcctgttgataagctaccctgt

SEQ ID NO: 543958 - DNA, 25 bp, Homo sapien
tgataagctaccctgtctcaccatg

SEQ ID NO: 543959 - DNA, 25 bp, Homo sapien
ctgtctcaccatgtgctggtgtgga

SEQ ID NO: 543960 - DNA, 25 bp, Homo sapien
ctttacaagcaggtgtgggttccca

SEQ ID NO: 543961 - DNA, 25 bp, Homo sapien
tacaagcaggtgtgggttcccacgt

SEQ ID NO: 543962 - DNA, 25 bp, Homo sapien
gtgggttcccacgtgggcacagagt

SEQ ID NO: 543963 - DNA, 25 bp, Homo sapien
gggcagattcccctgggtatgcctc

SEQ ID NO: 543964 - DNA, 25 bp, Homo sapien
agattcccctgggtatgcctctgtg

SEQ ID NO: 543965 - DNA, 25 bp, Homo sapien
tgggtatgcctctgtgccacaggag

SEQ ID NO: 543966 - DNA, 25 bp, Homo sapien
gcctctgtgccacaggagcgattat

SEQ ID NO: 543967 - DNA, 25 bp, Homo sapien
cgattatagtgaccgcagtttgctg

SEQ ID NO: 543968 - DNA, 25 bp, Homo sapien
tatagtgaccgcagtttgctgcaga

SEQ ID NO: 543969 - DNA, 25 bp, Homo sapien
ccttgttgtgtctcccacgcaatct

SEQ ID NO: 543970 - DNA, 25 bp, Homo sapien
gtctcccacgcaatctcaaggataa

SEQ ID NO: 543971 - DNA, 25 bp, Homo sapien
tggtctgtctgctctgttgtctgtt

SEQ ID NO: 543972 - DNA, 25 bp, Homo sapien
tctgttgtctgttctttccctgact

SEQ ID NO: 543973 - DNA, 25 bp, Homo sapien
ccaccgaaggcctgatggctactca

SEQ ID NO: 543974 - DNA, 25 bp, Homo sapien
ggaccgccaccttttctgcaggaaa

SEQ ID NO: 543975 - DNA, 25 bp, Homo sapien
gtgcccagcagctcttggtcaaagc

SEQ ID NO: 543976 - DNA, 25 bp, Homo sapien
gctcttggtcaaagcactgttgcta

SEQ ID NO: 543977 - DNA, 25 bp, Homo sapien
gcactgttgctataagctatctctg

SEQ ID NO: 543978 - DNA, 25 bp, Homo sapien
taagctatctctgggatgcctctag

SEQ ID NO: 543979 - DNA, 25 bp, Homo sapien
ctctacacacctctgggaaaagatt

SEQ ID NO: 543980 - DNA, 25 bp, Homo sapien
gattacactgtattaactctcgagg

SEQ ID NO: 543981 - DNA, 25 bp, Homo sapien
aactctcgaggagtttcctcaccaa

SEQ ID NO: 543982 - DNA, 25 bp, Homo sapien
atcttcaagtactatagtattctct

SEQ ID NO: 543983 - DNA, 25 bp, Homo sapien
actatagtattctcttacagaagag

SEQ ID NO: 543984 - DNA, 25 bp, Homo sapien
cttacagaagaggagttttatagtc

SEQ ID NO: 543985 - DNA, 25 bp, Homo sapien
agtctgatggtaaatgtcttcattt

SEQ ID NO: 543986 - DNA, 25 bp, Homo sapien
gaaatgtcaagtttcctgttacact

SEQ ID NO: 543987 - DNA, 25 bp, Homo sapien
gtcaagtttcctgttacactatgga

SEQ ID NO: 543988 - DNA, 25 bp, Homo sapien
gaaacatcagacatcattgcgtgta

SEQ ID NO: 543989 - DNA, 25 bp, Homo sapien
cattgcgtgtacagaccttttgcat

SEQ ID NO: 543990 - DNA, 25 bp, Homo sapien
gtacagaccttttgcatgggtgagt

SEQ ID NO: 543991 - DNA, 25 bp, Homo sapien
tgagtgctgtgaacggtgtgaaata

SEQ ID NO: 543992 - DNA, 25 bp, Homo sapien
gtcttcatctctgcaataaactaaa

SEQ ID NO: 543993 - DNA, 25 bp, Homo sapien
agggtttgatgtggatatgctaaat

SEQ ID NO: 543994 - DNA, 25 bp, Homo sapien
gggtttgatgtggatatgctaaatt

SEQ ID NO: 543995 - DNA, 25 bp, Homo sapien
ggtttgatgtggatatgctaaatta

SEQ ID NO: 543996 - DNA, 25 bp, Homo sapien
gtttgatgtggatatgctaaattaa

SEQ ID NO: 543997 - DNA, 25 bp, Homo sapien
tttgatgtggatatgctaaattaat

SEQ ID NO: 543998 - DNA, 25 bp, Homo sapien
ttgatgtggatatgctaaattaatt

SEQ ID NO: 543999 - DNA, 25 bp, Homo sapien
tgatgtggatatgctaaattaattt

SEQ ID NO: 544000 - DNA, 25 bp, Homo sapien
gatgtggatatgctaaattaatttt

SEQ ID NO: 544001 - DNA, 25 bp, Homo sapien
ttgaaaactaaactgtccacccaga

SEQ ID NO: 544002 - DNA, 25 bp, Homo sapien
aactgtccacccagaaagacactca

SEQ ID NO: 544003 - DNA, 25 bp, Homo sapien
ttcctacacttaaatacctcgtgta

SEQ ID NO: 544004 - DNA, 25 bp, Homo sapien
aatacctcgtgtatggtgcaatcag

SEQ ID NO: 544005 - DNA, 25 bp, Homo sapien
gtgtatggtgcaatcagaccacaaa

SEQ ID NO: 544006 - DNA, 25 bp, Homo sapien
atcagaccacaaaatcagaagctgg

SEQ ID NO: 544007 - DNA, 25 bp, Homo sapien
gctgggtataatatttcaagttaca

SEQ ID NO: 544008 - DNA, 25 bp, Homo sapien
gaaattatgacttaaatacccaatg

SEQ ID NO: 544009 - DNA, 25 bp, Homo sapien
gacttaaatacccaatgactcctta

SEQ ID NO: 544010 - DNA, 25 bp, Homo sapien
gaaatttcaattcaaatgcagacta

SEQ ID NO: 544011 - DNA, 25 bp, Homo sapien
attcaaatgcagactaattataggg

SEQ ID NO: 544012 - DNA, 25 bp, Homo sapien
aggagtatatgtgggctaatcagag

SEQ ID NO: 544013 - DNA, 25 bp, Homo sapien
atgtgggctaatcagaggttaataa

SEQ ID NO: 544014 - DNA, 25 bp, Homo sapien
ggttaataatgtcctcatctcctac

SEQ ID NO: 544015 - DNA, 25 bp, Homo sapien
taataatgtcctcatctcctactct

SEQ ID NO: 544016 - DNA, 25 bp, Homo sapien
gggagtagttaagcaaaatcaacag

SEQ ID NO: 544017 - DNA, 25 bp, Homo sapien
aaatcaacagtcatcctactatgtt

SEQ ID NO: 544018 - DNA, 25 bp, Homo sapien
acagtcatcctactatgttgaaaga

SEQ ID NO: 544019 - DNA, 25 bp, Homo sapien
catcctactatgttgaaagaaccaa

SEQ ID NO: 544020 - DNA, 25 bp, Homo sapien
gataaatatcatttgtccttttact

SEQ ID NO: 544021 - DNA, 25 bp, Homo sapien
ataaaaatgggctcatattgtgcat

SEQ ID NO: 544022 - DNA, 25 bp, Homo sapien
tatattgggaacatcttttccaggt

SEQ ID NO: 544023 - DNA, 25 bp, Homo sapien
ggagaggacatacaataccaaagtg

SEQ ID NO: 544024 - DNA, 25 bp, Homo sapien
aaatgtttgcctcacggaggaagca

SEQ ID NO: 544025 - DNA, 25 bp, Homo sapien
gaggaagcagcgctactggccattc

SEQ ID NO: 544026 - DNA, 25 bp, Homo sapien
tccatggactgcaccggcacagagg

SEQ ID NO: 544027 - DNA, 25 bp, Homo sapien
agaggcccacatctccagctgcaag

SEQ ID NO: 544028 - DNA, 25 bp, Homo sapien
cccaggtgtcactggaccccatgaa

SEQ ID NO: 544029 - DNA, 25 bp, Homo sapien
ggaccccatgaagaatgtcacctgc

SEQ ID NO: 544030 - DNA, 25 bp, Homo sapien
aagaatgtcacctgcgagaatgggc

SEQ ID NO: 544031 - DNA, 25 bp, Homo sapien
agttgtgtgcctgggcaggtcttca

SEQ ID NO: 544032 - DNA, 25 bp, Homo sapien
gggcaggtcttcagccctgacggac

SEQ ID NO: 544033 - DNA, 25 bp, Homo sapien
gagcaacccctggtgcgactgagag

SEQ ID NO: 544034 - DNA, 25 bp, Homo sapien
gcatgacaagatgttattagctggt

SEQ ID NO: 544035 - DNA, 25 bp, Homo sapien
acaagatgttattagctggtaagca

SEQ ID NO: 544036 - DNA, 25 bp, Homo sapien
gttattagctggtaagcatatacaa

SEQ ID NO: 544037 - DNA, 25 bp, Homo sapien
aagttgctttttgccaggtgtggtg

SEQ ID NO: 544038 - DNA, 25 bp, Homo sapien
ttgcttgtggctagaatttcgagac

SEQ ID NO: 544039 - DNA, 25 bp, Homo sapien
gagtgagacctctagaaagaagtaa

SEQ ID NO: 544040 - DNA, 25 bp, Homo sapien
gtagctgagcatgatagtatgtgtc

SEQ ID NO: 544041 - DNA, 25 bp, Homo sapien
catgatagtatgtgtctgtggtctc

SEQ ID NO: 544042 - DNA, 25 bp, Homo sapien
atgatagtatgtgtctgtggtctca

SEQ ID NO: 544043 - DNA, 25 bp, Homo sapien
taaggtcagaggattgcctgcgccc

SEQ ID NO: 544044 - DNA, 25 bp, Homo sapien
aggtcagaggattgcctgcgcccag

SEQ ID NO: 544045 - DNA, 25 bp, Homo sapien
gagaatctagtgtagcagcctccag

SEQ ID NO: 544046 - DNA, 25 bp, Homo sapien
aatctagtgtagcagcctccaggca

SEQ ID NO: 544047 - DNA, 25 bp, Homo sapien
agcctccaggcaggattcagcacaa

SEQ ID NO: 544048 - DNA, 25 bp, Homo sapien
aggcaggattcagcacaacactggg

SEQ ID NO: 544049 - DNA, 25 bp, Homo sapien
tctgcctaccaacaactgggcttat

SEQ ID NO: 544050 - DNA, 25 bp, Homo sapien
aacaactgggcttatcactgggaaa

SEQ ID NO: 544051 - DNA, 25 bp, Homo sapien
gggcttatcactgggaaaacacaaa

SEQ ID NO: 544052 - DNA, 25 bp, Homo sapien
cctgtttcacttatagggtctagaa

SEQ ID NO: 544053 - DNA, 25 bp, Homo sapien
atagggtctagaatgcttgtgttga

SEQ ID NO: 544054 - DNA, 25 bp, Homo sapien
atattcaaagctgctaaatgttctc

SEQ ID NO: 544055 - DNA, 25 bp, Homo sapien
gttctctttgccataaagactccgt

SEQ ID NO: 544056 - DNA, 25 bp, Homo sapien
tgcccagctacatcatcgacgtgcg

SEQ ID NO: 544057 - DNA, 25 bp, Homo sapien
gcccagctacatcatcgacgtgcgg

SEQ ID NO: 544058 - DNA, 25 bp, Homo sapien
ccagctacatcatcgacgtgcgggc

SEQ ID NO: 544059 - DNA, 25 bp, Homo sapien
cagctacatcatcgacgtgcgggcc

SEQ ID NO: 544060 - DNA, 25 bp, Homo sapien
tacatcatcgacgtgcgggccctag

SEQ ID NO: 544061 - DNA, 25 bp, Homo sapien
acatcatcgacgtgcgggccctaga

SEQ ID NO: 544062 - DNA, 25 bp, Homo sapien
acgtgcgggccctagacgagaagct

SEQ ID NO: 544063 - DNA, 25 bp, Homo sapien
tgcgggccctagacgagaagctgct

SEQ ID NO: 544064 - DNA, 25 bp, Homo sapien
gggccctagacgagaagctgctcaa

SEQ ID NO: 544065 - DNA, 25 bp, Homo sapien
ggccctagacgagaagctgctcaac

SEQ ID NO: 544066 - DNA, 25 bp, Homo sapien
gccctagacgagaagctgctcaaca

SEQ ID NO: 544067 - DNA, 25 bp, Homo sapien
atcagcctcacacacatatttacct

SEQ ID NO: 544068 - DNA, 25 bp, Homo sapien
aactgcatgtataagatggttgtca

SEQ ID NO: 544069 - DNA, 25 bp, Homo sapien
tggttgtcatttgcttgaatacccc

SEQ ID NO: 544070 - DNA, 25 bp, Homo sapien
gattcttgagcatcagtgggacata

SEQ ID NO: 544071 - DNA, 25 bp, Homo sapien
gaggtgtctgaagaaccattttaca

SEQ ID NO: 544072 - DNA, 25 bp, Homo sapien
gatttcataaataggaggtctctgc

SEQ ID NO: 544073 - DNA, 25 bp, Homo sapien
taggaggtctctgcattaccatgtt

SEQ ID NO: 544074 - DNA, 25 bp, Homo sapien
gtttgcttgcaaagtggaaaccttt

SEQ ID NO: 544075 - DNA, 25 bp, Homo sapien
aaccttttagatgtgtaacttgaat

SEQ ID NO: 544076 - DNA, 25 bp, Homo sapien
atatgtatcaagatctcaagtgctt

SEQ ID NO: 544077 - DNA, 25 bp, Homo sapien
caagatctcaagtgcttaatgataa

SEQ ID NO: 544078 - DNA, 25 bp, Homo sapien
gtgggccagaatttcatattacctt

SEQ ID NO: 544079 - DNA, 25 bp, Homo sapien
gaatttcatattaccttccacaaaa

SEQ ID NO: 544080 - DNA, 25 bp, Homo sapien
taccttccacaaaactaacttccag

SEQ ID NO: 544081 - DNA, 25 bp, Homo sapien
actaacttccagagaggtcttcagg

SEQ ID NO: 544082 - DNA, 25 bp, Homo sapien
gtcttcaggaagttggcaaatttta

SEQ ID NO: 544083 - DNA, 25 bp, Homo sapien
gaacttttaagaactacatctcgtt

SEQ ID NO: 544084 - DNA, 25 bp, Homo sapien
atctcgttaattatatgtattccgt

SEQ ID NO: 544085 - DNA, 25 bp, Homo sapien
gagtgcattggtgctttaaagtgct

SEQ ID NO: 544086 - DNA, 25 bp, Homo sapien
ggtgctttaaagtgctgtcaactac

SEQ ID NO: 544087 - DNA, 25 bp, Homo sapien
agtgctgtcaactactctgagaatg

SEQ ID NO: 544088 - DNA, 25 bp, Homo sapien
atgtgtatcttacaactccttcctt

SEQ ID NO: 544089 - DNA, 25 bp, Homo sapien
gtttagttgcacaaattgggccaaa

SEQ ID NO: 544090 - DNA, 25 bp, Homo sapien
ttgggccaaagaaacattgccttga

SEQ ID NO: 544091 - DNA, 25 bp, Homo sapien
aatactgttttactgtccaaagaca

SEQ ID NO: 544092 - DNA, 25 bp, Homo sapien
agacatgtttatagtgctctgtaaa

SEQ ID NO: 544093 - DNA, 25 bp, Homo sapien
aatgttcctttcctttgtagtctct

SEQ ID NO: 544094 - DNA, 25 bp, Homo sapien
ctttcctttgtagtctctggcaaga

SEQ ID NO: 544095 - DNA, 25 bp, Homo sapien
gtagtctctggcaagatgctttagg

SEQ ID NO: 544096 - DNA, 25 bp, Homo sapien
gttgaagtttatacccgtttcacat

SEQ ID NO: 544097 - DNA, 25 bp, Homo sapien
tacccgtttcacatgcttttcaaga

SEQ ID NO: 544098 - DNA, 25 bp, Homo sapien
gcttttcaagaatgtcgcaattact

SEQ ID NO: 544099 - DNA, 25 bp, Homo sapien
gaatgtcgcaattactaagaagcag

SEQ ID NO: 544100 - DNA, 25 bp, Homo sapien
aaacaacggtggcaacagctcctct

SEQ ID NO: 544101 - DNA, 25 bp, Homo sapien
aacaacggtggcaacagctcctctt

SEQ ID NO: 544102 - DNA, 25 bp, Homo sapien
agctctctcctaccccaggtaaaag

SEQ ID NO: 544103 - DNA, 25 bp, Homo sapien
tctctcctaccccaggtaaaaggtg

SEQ ID NO: 544104 - DNA, 25 bp, Homo sapien
ggtgctcctttgcctgggtttgaat

SEQ ID NO: 544105 - DNA, 25 bp, Homo sapien
gtttgaattccagcgctgccacttc

SEQ ID NO: 544106 - DNA, 25 bp, Homo sapien
tctctgcacctcctggcaagtttct

SEQ ID NO: 544107 - DNA, 25 bp, Homo sapien
ctggcaagtttcttctattccccac

SEQ ID NO: 544108 - DNA, 25 bp, Homo sapien
ttaaagcgatggcacctccgtccca

SEQ ID NO: 544109 - DNA, 25 bp, Homo sapien
aaagcgatggcacctccgtcccagg

SEQ ID NO: 544110 - DNA, 25 bp, Homo sapien
atggcacctccgtcccagggtggtg

SEQ ID NO: 544111 - DNA, 25 bp, Homo sapien
acaggcaatgactgcgcagagtgga

SEQ ID NO: 544112 - DNA, 25 bp, Homo sapien
gcaatgactgcgcagagtggattaa

SEQ ID NO: 544113 - DNA, 25 bp, Homo sapien
actgcgcagagtggattaaaggcaa

SEQ ID NO: 544114 - DNA, 25 bp, Homo sapien
gagaagcctgggtggctcagcatcc

SEQ ID NO: 544115 - DNA, 25 bp, Homo sapien
aagcctgggtggctcagcatcctcc

SEQ ID NO: 544116 - DNA, 25 bp, Homo sapien
cttgaaagtgaacaatcagcggcat

SEQ ID NO: 544117 - DNA, 25 bp, Homo sapien
agtgaacaatcagcggcatttagta

SEQ ID NO: 544118 - DNA, 25 bp, Homo sapien
aatcagcggcatttagtacatccag

SEQ ID NO: 544119 - DNA, 25 bp, Homo sapien
cagcggcatttagtacatccagaaa

SEQ ID NO: 544120 - DNA, 25 bp, Homo sapien
ggcatttagtacatccagaaagttg

SEQ ID NO: 544121 - DNA, 25 bp, Homo sapien
gaaagttgtgtaggcaccacctctg

SEQ ID NO: 544122 - DNA, 25 bp, Homo sapien
ctagtcattgtatggagcaacttta

SEQ ID NO: 544123 - DNA, 25 bp, Homo sapien
aaatgttgtaaacaagttcttgcca

SEQ ID NO: 544124 - DNA, 25 bp, Homo sapien
caagttcttgccaaaccaatccctt

SEQ ID NO: 544125 - DNA, 25 bp, Homo sapien
tgacgatgccacaaggtcgctgctt

SEQ ID NO: 544126 - DNA, 25 bp, Homo sapien
atgccacaaggtcgctgcttatgag

SEQ ID NO: 544127 - DNA, 25 bp, Homo sapien
ggtcgctgcttatgagggcgcaaac

SEQ ID NO: 544128 - DNA, 25 bp, Homo sapien
atgagggcgcaaacttcttggcttg

SEQ ID NO: 544129 - DNA, 25 bp, Homo sapien
aaacttcttggcttgtgctcggacc

SEQ ID NO: 544130 - DNA, 25 bp, Homo sapien
tgtgctcggacccttttctcgtact

SEQ ID NO: 544131 - DNA, 25 bp, Homo sapien
actctgttttggcagtaaatcgtgt

SEQ ID NO: 544132 - DNA, 25 bp, Homo sapien
cctaataggatctgtttgattgtga

SEQ ID NO: 544133 - DNA, 25 bp, Homo sapien
agggagggcgtctgatgctctctct

SEQ ID NO: 544134 - DNA, 25 bp, Homo sapien
gggggcagcccatgcgagcccttct

SEQ ID NO: 544135 - DNA, 25 bp, Homo sapien
tctgggagggccagttccacattga

SEQ ID NO: 544136 - DNA, 25 bp, Homo sapien
tgggagggccagttccacattgagc

SEQ ID NO: 544137 - DNA, 25 bp, Homo sapien
ggagggccagttccacattgagcca

SEQ ID NO: 544138 - DNA, 25 bp, Homo sapien
gagggccagttccacattgagccag

SEQ ID NO: 544139 - DNA, 25 bp, Homo sapien
agggccagttccacattgagccagc

SEQ ID NO: 544140 - DNA, 25 bp, Homo sapien
ggccagttccacattgagccagcct

SEQ ID NO: 544141 - DNA, 25 bp, Homo sapien
cagttccacattgagccagcctggt

SEQ ID NO: 544142 - DNA, 25 bp, Homo sapien
gctttctgaggccttatctgatgcc

SEQ ID NO: 544143 - DNA, 25 bp, Homo sapien
ttctgaggccttatctgatgcctct

SEQ ID NO: 544144 - DNA, 25 bp, Homo sapien
gcaaccttgctgacaaatccacagg

SEQ ID NO: 544145 - DNA, 25 bp, Homo sapien
tctgccaattgcctgcctgtatgaa

SEQ ID NO: 544146 - DNA, 25 bp, Homo sapien
ctgcctgtatgaactgggcacctgg

SEQ ID NO: 544147 - DNA, 25 bp, Homo sapien
aggctactcatcttggctttcacag

SEQ ID NO: 544148 - DNA, 25 bp, Homo sapien
ttggctttcacagccaaagggcctg

SEQ ID NO: 544149 - DNA, 25 bp, Homo sapien
agggcctgggtggaacctcagctta

SEQ ID NO: 544150 - DNA, 25 bp, Homo sapien
gtggaacctcagcttactgtgttta

SEQ ID NO: 544151 - DNA, 25 bp, Homo sapien
gcttactgtgtttactgactgggta

SEQ ID NO: 544152 - DNA, 25 bp, Homo sapien
ctgactgggtaatgtggcctctgaa

SEQ ID NO: 544153 - DNA, 25 bp, Homo sapien
cctctgaagctgtcacctatctata

SEQ ID NO: 544154 - DNA, 25 bp, Homo sapien
gaagctgtcacctatctataaaatg

SEQ ID NO: 544155 - DNA, 25 bp, Homo sapien
gaatttcagagtcgcctgacggcag

SEQ ID NO: 544156 - DNA, 25 bp, Homo sapien
actgtccctgcagagtggatgcttc

SEQ ID NO: 544157 - DNA, 25 bp, Homo sapien
agagtggatgcttctgcctagtgac

SEQ ID NO: 544158 - DNA, 25 bp, Homo sapien
gatgcttctgcctagtgacaggtta

SEQ ID NO: 544159 - DNA, 25 bp, Homo sapien
gtgacaggttatcaccacgttatat

SEQ ID NO: 544160 - DNA, 25 bp, Homo sapien
ccacgttatatattccctaccgaag

SEQ ID NO: 544161 - DNA, 25 bp, Homo sapien
tattccctaccgaaggagacacctt

SEQ ID NO: 544162 - DNA, 25 bp, Homo sapien
acccagaacagcctttaaatcacaa

SEQ ID NO: 544163 - DNA, 25 bp, Homo sapien
gaaagttaaccacggaggcaccgag

SEQ ID NO: 544164 - DNA, 25 bp, Homo sapien
acggaggcaccgagttccaggtagt

SEQ ID NO: 544165 - DNA, 25 bp, Homo sapien
gcaccgagttccaggtagtggtttt

SEQ ID NO: 544166 - DNA, 25 bp, Homo sapien
acagggaaatccatgtgaagacaca

SEQ ID NO: 544167 - DNA, 25 bp, Homo sapien
gacacatggagaaaacagccatcta

SEQ ID NO: 544168 - DNA, 25 bp, Homo sapien
ggacttctggcctttagaatcataa

SEQ ID NO: 544169 - DNA, 25 bp, Homo sapien
atttttattgttgaagccacccact

SEQ ID NO: 544170 - DNA, 25 bp, Homo sapien
ttgttgaagccacccactctgtgat

SEQ ID NO: 544171 - DNA, 25 bp, Homo sapien
acccactctgtgatacactgctatg

SEQ ID NO: 544172 - DNA, 25 bp, Homo sapien
tgatacactgctatggcagccctag

SEQ ID NO: 544173 - DNA, 25 bp, Homo sapien
gccctagcaaactaaaacagtgagt

SEQ ID NO: 544174 - DNA, 25 bp, Homo sapien
gtatatgggtatactctatagccta

SEQ ID NO: 544175 - DNA, 25 bp, Homo sapien
ctatagcctatattgcaacttattt

SEQ ID NO: 544176 - DNA, 25 bp, Homo sapien
aaaaagtgaattcctactgaacaca

SEQ ID NO: 544177 - DNA, 25 bp, Homo sapien
caactaccagctgggcacagggcag

SEQ ID NO: 544178 - DNA, 25 bp, Homo sapien
atgaggacgcctggagccctgtgga

SEQ ID NO: 544179 - DNA, 25 bp, Homo sapien
tggagaaccgtgtggtcttatctgt

SEQ ID NO: 544180 - DNA, 25 bp, Homo sapien
cgtgtggtcttatctgtgtccagcg

SEQ ID NO: 544181 - DNA, 25 bp, Homo sapien
gggccagcatacagtcttattagtc

SEQ ID NO: 544182 - DNA, 25 bp, Homo sapien
agagctgatgaagcctctgagggcc

SEQ ID NO: 544183 - DNA, 25 bp, Homo sapien
acaacctccctcacagaacagggaa

SEQ ID NO: 544184 - DNA, 25 bp, Homo sapien
acagggaagcagtgacagctgcaga

SEQ ID NO: 544185 - DNA, 25 bp, Homo sapien
gctgcagatggcagcgggcctctcc

SEQ ID NO: 544186 - DNA, 25 bp, Homo sapien
agccctgagcactgtgtcagttcct

SEQ ID NO: 544187 - DNA, 25 bp, Homo sapien
agcactgtgtcagttcctgcctttt

SEQ ID NO: 544188 - DNA, 25 bp, Homo sapien
ctcagataacgcatagcaaaatgga

SEQ ID NO: 544189 - DNA, 25 bp, Homo sapien
ggagatggagacatgatttctcatg

SEQ ID NO: 544190 - DNA, 25 bp, Homo sapien
gatttctcatgcaacagcttctcta

SEQ ID NO: 544191 - DNA, 25 bp, Homo sapien
gcaacagcttctctaattatacctt

SEQ ID NO: 544192 - DNA, 25 bp, Homo sapien
tcctttttatcatcaaatctgctca

SEQ ID NO: 544193 - DNA, 25 bp, Homo sapien
caaatctgctcaagaagggcttttt

SEQ ID NO: 544194 - DNA, 25 bp, Homo sapien
atcagtggatgaaaacagcttaaca

SEQ ID NO: 544195 - DNA, 25 bp, Homo sapien
tgaaaacagcttaacattttaccat

SEQ ID NO: 544196 - DNA, 25 bp, Homo sapien
atttctctaaatgtaggcctggctg

SEQ ID NO: 544197 - DNA, 25 bp, Homo sapien
aaatgtaggcctggctgggctttga

SEQ ID NO: 544198 - DNA, 25 bp, Homo sapien
ttccgtttttaaatcactcacagag

SEQ ID NO: 544199 - DNA, 25 bp, Homo sapien
attccatggctgttgtgctgattcc

SEQ ID NO: 544200 - DNA, 25 bp, Homo sapien
tgctgattccaatgctttcacgttg

SEQ ID NO: 544201 - DNA, 25 bp, Homo sapien
aatgctttcacgttggttcctggcg

SEQ ID NO: 544202 - DNA, 25 bp, Homo sapien
tcctggcgtgggaactgctctcctt

SEQ ID NO: 544203 - DNA, 25 bp, Homo sapien
ttatgtaagctttccgtggcatgcg

SEQ ID NO: 544204 - DNA, 25 bp, Homo sapien
cccgctgcgtaagactctgtatttg

SEQ ID NO: 544205 - DNA, 25 bp, Homo sapien
tggatgccaatccacaggcctgaag

SEQ ID NO: 544206 - DNA, 25 bp, Homo sapien
aggcctgaagaaactgcttgttgtg

SEQ ID NO: 544207 - DNA, 25 bp, Homo sapien
gcttgttgtgtatcagtaatcatta

SEQ ID NO: 544208 - DNA, 25 bp, Homo sapien
tagtggcaatgatgacattctgaaa

SEQ ID NO: 544209 - DNA, 25 bp, Homo sapien
gaaaagctgcaatacttatacaata

SEQ ID NO: 544210 - DNA, 25 bp, Homo sapien
tggactttgccttcccgggcagcac

SEQ ID NO: 544211 - DNA, 25 bp, Homo sapien
ctcacacgggactacaactcactga

SEQ ID NO: 544212 - DNA, 25 bp, Homo sapien
tcacacgggactacaactcactgac

SEQ ID NO: 544213 - DNA, 25 bp, Homo sapien
tacaactcactgacccgctcagaac

SEQ ID NO: 544214 - DNA, 25 bp, Homo sapien
tgacccgctcagaacactcacactc

SEQ ID NO: 544215 - DNA, 25 bp, Homo sapien
gactctcgcctgactgctggtgtgc

SEQ ID NO: 544216 - DNA, 25 bp, Homo sapien
actctcgcctgactgctggtgtgcc

SEQ ID NO: 544217 - DNA, 25 bp, Homo sapien
tcgcctgactgctggtgtgcccgac

SEQ ID NO: 544218 - DNA, 25 bp, Homo sapien
cctgactgctggtgtgcccgacacg

SEQ ID NO: 544219 - DNA, 25 bp, Homo sapien
tgactgctggtgtgcccgacacgcc

SEQ ID NO: 544220 - DNA, 25 bp, Homo sapien
acccgcctggtgttctctgccctgg

SEQ ID NO: 544221 - DNA, 25 bp, Homo sapien
ctaaaggatttcatattctatcatc

SEQ ID NO: 544222 - DNA, 25 bp, Homo sapien
ccatttgttaaaccgtatataccat

SEQ ID NO: 544223 - DNA, 25 bp, Homo sapien
gttaaaccgtatataccattgaaga

SEQ ID NO: 544224 - DNA, 25 bp, Homo sapien
accgtatataccattgaagatgttt

SEQ ID NO: 544225 - DNA, 25 bp, Homo sapien
accattgaagatgttttgggtataa

SEQ ID NO: 544226 - DNA, 25 bp, Homo sapien
gccaaagttatgaagaagatcagga

SEQ ID NO: 544227 - DNA, 25 bp, Homo sapien
tattctatcatcagacaacgaaaga

SEQ ID NO: 544228 - DNA, 25 bp, Homo sapien
aattgtggtcaatatttgattttcc

SEQ ID NO: 544229 - DNA, 25 bp, Homo sapien
aaatggctgcatgaatcattgaaag

SEQ ID NO: 544230 - DNA, 25 bp, Homo sapien
atcattgaaagaaacttccctgctt

SEQ ID NO: 544231 - DNA, 25 bp, Homo sapien
cattgaaagaaacttccctgctttt

SEQ ID NO: 544232 - DNA, 25 bp, Homo sapien
gcaaaagctggaagatcgcctcgca

SEQ ID NO: 544233 - DNA, 25 bp, Homo sapien
tggaagatcgcctcgcagctgctgc

SEQ ID NO: 544234 - DNA, 25 bp, Homo sapien
gcccaggcgtctaaggagtcaaaag

SEQ ID NO: 544235 - DNA, 25 bp, Homo sapien
acagcttcaagcagaacgtaaaagg

SEQ ID NO: 544236 - DNA, 25 bp, Homo sapien
gcggcgttatttttacagaccctca

SEQ ID NO: 544237 - DNA, 25 bp, Homo sapien
ttacagaccctcaaaaatcctctgc

SEQ ID NO: 544238 - DNA, 25 bp, Homo sapien
ctcaaaaatcctctgccggaagcag

SEQ ID NO: 544239 - DNA, 25 bp, Homo sapien
tgaggagagtcctttcagtgtcgag

SEQ ID NO: 544240 - DNA, 25 bp, Homo sapien
agtcctttcagtgtcgaggaatcca

SEQ ID NO: 544241 - DNA, 25 bp, Homo sapien
gtgtcgaggaatccagcactacgcc

SEQ ID NO: 544242 - DNA, 25 bp, Homo sapien
ttaaaccacccgataggccttcgag

SEQ ID NO: 544243 - DNA, 25 bp, Homo sapien
aatgagtgctcaggtggattttatc

SEQ ID NO: 544244 - DNA, 25 bp, Homo sapien
tggattttatcctcgcaagcatgtt

SEQ ID NO: 544245 - DNA, 25 bp, Homo sapien
atcctcgcaagcatgttgttataag

SEQ ID NO: 544246 - DNA, 25 bp, Homo sapien
tataagaattgtgggtgtgcctatc

SEQ ID NO: 544247 - DNA, 25 bp, Homo sapien
aattgtgggtgtgcctatcataaca

SEQ ID NO: 544248 - DNA, 25 bp, Homo sapien
gggtgtgcctatcataacaattgtt

SEQ ID NO: 544249 - DNA, 25 bp, Homo sapien
tcttgaaaaagtattctccacattt

SEQ ID NO: 544250 - DNA, 25 bp, Homo sapien
gaattctttaatgcacacttgtcaa

SEQ ID NO: 544251 - DNA, 25 bp, Homo sapien
tatagtaccaatgttacctttttat

SEQ ID NO: 544252 - DNA, 25 bp, Homo sapien
gttttagatgtaagagcatgctcat

SEQ ID NO: 544253 - DNA, 25 bp, Homo sapien
gagcatgctcatatgttaggtactt

SEQ ID NO: 544254 - DNA, 25 bp, Homo sapien
gcccgggcaccgagacagctgagta

SEQ ID NO: 544255 - DNA, 25 bp, Homo sapien
agctgagtaccagtcattgtgccct

SEQ ID NO: 544256 - DNA, 25 bp, Homo sapien
agtaccagtcattgtgccctcacgg

SEQ ID NO: 544257 - DNA, 25 bp, Homo sapien
gagacctgagcctccggagagacgt

SEQ ID NO: 544258 - DNA, 25 bp, Homo sapien
agcctccggagagacgtggacgaat

SEQ ID NO: 544259 - DNA, 25 bp, Homo sapien
atgtcagctcttccgagaccaggtg

SEQ ID NO: 544260 - DNA, 25 bp, Homo sapien
ctcttccgagaccaggtgtgcaaga

SEQ ID NO: 544261 - DNA, 25 bp, Homo sapien
ccccgggctactcatgctattgcag

SEQ ID NO: 544262 - DNA, 25 bp, Homo sapien
gctattgcagcaacggctactacta

SEQ ID NO: 544263 - DNA, 25 bp, Homo sapien
tgcagcaacggctactactaccaca

SEQ ID NO: 544264 - DNA, 25 bp, Homo sapien
tactaccacacacagcggctggagt

SEQ ID NO: 544265 - DNA, 25 bp, Homo sapien
gtgtttttgttgcatctccaagtca

SEQ ID NO: 544266 - DNA, 25 bp, Homo sapien
tctccaagtcagaataaatgccttt

SEQ ID NO: 544267 - DNA, 25 bp, Homo sapien
gcagatatatttcatttagcattta

SEQ ID NO: 544268 - DNA, 25 bp, Homo sapien
gtatcatcttcatcaatactcgtat

SEQ ID NO: 544269 - DNA, 25 bp, Homo sapien
ttattcccactctacaacgcatgtc

SEQ ID NO: 544270 - DNA, 25 bp, Homo sapien
aacgcatgtcaaaggtgatctgttt

SEQ ID NO: 544271 - DNA, 25 bp, Homo sapien
gtttttccttagtatcgaacatatc

SEQ ID NO: 544272 - DNA, 25 bp, Homo sapien
atcgaacatatcacagctactcaat

SEQ ID NO: 544273 - DNA, 25 bp, Homo sapien
aatgaagtttcttctcaactaaaga

SEQ ID NO: 544274 - DNA, 25 bp, Homo sapien
ttagagaatttgttcctgtgtttcc

SEQ ID NO: 544275 - DNA, 25 bp, Homo sapien
ctgtgtttccaccataagataaatg

SEQ ID NO: 544276 - DNA, 25 bp, Homo sapien
gccgccacacctagtaggctgcgtg

SEQ ID NO: 544277 - DNA, 25 bp, Homo sapien
acacctagtaggctgcgtgcctgtc

SEQ ID NO: 544278 - DNA, 25 bp, Homo sapien
acctagtaggctgcgtgcctgtcgc

SEQ ID NO: 544279 - DNA, 25 bp, Homo sapien
cagcgactcctgcatggtcgccagg

SEQ ID NO: 544280 - DNA, 25 bp, Homo sapien
tgcatggtcgccaggctcgggtacc

SEQ ID NO: 544281 - DNA, 25 bp, Homo sapien
atggtcgccaggctcgggtaccatt

SEQ ID NO: 544282 - DNA, 25 bp, Homo sapien
aggctcgggtaccattcgcgttctt

SEQ ID NO: 544283 - DNA, 25 bp, Homo sapien
tcgggtaccattcgcgttcttcggc

SEQ ID NO: 544284 - DNA, 25 bp, Homo sapien
gctgctccggcgacggccataacga

SEQ ID NO: 544285 - DNA, 25 bp, Homo sapien
tccggcgacggccataacgaaccgg

SEQ ID NO: 544286 - DNA, 25 bp, Homo sapien
ggcgccgtaacgcgcgaactgctta

SEQ ID NO: 544287 - DNA, 25 bp, Homo sapien
tcccatctgggaacacgggaggagc

SEQ ID NO: 544288 - DNA, 25 bp, Homo sapien
agtcgggctcagatgaaagggttcc

SEQ ID NO: 544289 - DNA, 25 bp, Homo sapien
tcgggctcagatgaaagggttcccc

SEQ ID NO: 544290 - DNA, 25 bp, Homo sapien
ggctcagatgaaagggttcccccct

SEQ ID NO: 544291 - DNA, 25 bp, Homo sapien
gggcccacgagactctataatcctg

SEQ ID NO: 544292 - DNA, 25 bp, Homo sapien
ggcccacgagactctataatcctgg

SEQ ID NO: 544293 - DNA, 25 bp, Homo sapien
cacgagactctataatcctggctgg

SEQ ID NO: 544294 - DNA, 25 bp, Homo sapien
acgagactctataatcctggctggg

SEQ ID NO: 544295 - DNA, 25 bp, Homo sapien
cgagactctataatcctggctggga

SEQ ID NO: 544296 - DNA, 25 bp, Homo sapien
agactctataatcctggctgggagg

SEQ ID NO: 544297 - DNA, 25 bp, Homo sapien
aatcctggctgggaggccagcagcg

SEQ ID NO: 544298 - DNA, 25 bp, Homo sapien
ctctttccttggagggtccctgatt

SEQ ID NO: 544299 - DNA, 25 bp, Homo sapien
ggtccctgattcctgaggatcctcc

SEQ ID NO: 544300 - DNA, 25 bp, Homo sapien
tgattcctgaggatcctccccgagc

SEQ ID NO: 544301 - DNA, 25 bp, Homo sapien
ggaccacagggctgccgtgagcacc

SEQ ID NO: 544302 - DNA, 25 bp, Homo sapien
tgtccagaggcagggcctgaacctc

SEQ ID NO: 544303 - DNA, 25 bp, Homo sapien
ctgcctggaccagtgacagcattgg

SEQ ID NO: 544304 - DNA, 25 bp, Homo sapien
gggtcttcagaccagccagcaaggg

SEQ ID NO: 544305 - DNA, 25 bp, Homo sapien
gccagtgcccagagagcaggtcaga

SEQ ID NO: 544306 - DNA, 25 bp, Homo sapien
gcccagagagcaggtcagacaacag

SEQ ID NO: 544307 - DNA, 25 bp, Homo sapien
agcaggtcagacaacaggcaaccct

SEQ ID NO: 544308 - DNA, 25 bp, Homo sapien
gacaacaggcaaccctgaggcagct

SEQ ID NO: 544309 - DNA, 25 bp, Homo sapien
aatagactgagtcagatgggtctga

SEQ ID NO: 544310 - DNA, 25 bp, Homo sapien
tctcttctgaggaccgctgataagc

SEQ ID NO: 544311 - DNA, 25 bp, Homo sapien
ggaccgctgataagcattgacttgc

SEQ ID NO: 544312 - DNA, 25 bp, Homo sapien
gtcccctaaggaaatccgagcggct

SEQ ID NO: 544313 - DNA, 25 bp, Homo sapien
atccgagcggctacaaagcgtttct

SEQ ID NO: 544314 - DNA, 25 bp, Homo sapien
agcggctacaaagcgtttctttact

SEQ ID NO: 544315 - DNA, 25 bp, Homo sapien
ttcgcttggtgagtgcgtacttttt

SEQ ID NO: 544316 - DNA, 25 bp, Homo sapien
tgagtgcgtactttttctacctgta

SEQ ID NO: 544317 - DNA, 25 bp, Homo sapien
gcgtactttttctacctgtacacat

SEQ ID NO: 544318 - DNA, 25 bp, Homo sapien
ttctacctgtacacattcctgcatt

SEQ ID NO: 544319 - DNA, 25 bp, Homo sapien
tttgactaaagctatgttacatgga

SEQ ID NO: 544320 - DNA, 25 bp, Homo sapien
ttcagtaccctctctccattttcat

SEQ ID NO: 544321 - DNA, 25 bp, Homo sapien
aatcattctgtagcctatctcctaa

SEQ ID NO: 544322 - DNA, 25 bp, Homo sapien
ttgtgcttcaggtaaagtctcatag

SEQ ID NO: 544323 - DNA, 25 bp, Homo sapien
taaagtctcatagctttcttgccaa

SEQ ID NO: 544324 - DNA, 25 bp, Homo sapien
tttcttgccaaggaactcgttgttc

SEQ ID NO: 544325 - DNA, 25 bp, Homo sapien
ctcgttgttcctaagttctgagaca

SEQ ID NO: 544326 - DNA, 25 bp, Homo sapien
gacagagcaagtatgaatggtctac

SEQ ID NO: 544327 - DNA, 25 bp, Homo sapien
gaatggtctactcatttattgccac

SEQ ID NO: 544328 - DNA, 25 bp, Homo sapien
gccactaaagtgtaaccctcaaggg

SEQ ID NO: 544329 - DNA, 25 bp, Homo sapien
tcacctgcagggactacccaaagag

SEQ ID NO: 544330 - DNA, 25 bp, Homo sapien
gggactacccaaagaggcaacatac

SEQ ID NO: 544331 - DNA, 25 bp, Homo sapien
aagaaacttctggacattgaaggat

SEQ ID NO: 544332 - DNA, 25 bp, Homo sapien
tatattcaaaagttcgatctcgata

SEQ ID NO: 544333 - DNA, 25 bp, Homo sapien
gatctcgatatagtttcatacaggc

SEQ ID NO: 544334 - DNA, 25 bp, Homo sapien
gtttcatacaggctcttgtcagacg

SEQ ID NO: 544335 - DNA, 25 bp, Homo sapien
aggctcttgtcagacgtatccgtgg

SEQ ID NO: 544336 - DNA, 25 bp, Homo sapien
agacgtatccgtggcctcttgagga

SEQ ID NO: 544337 - DNA, 25 bp, Homo sapien
atccgtggcctcttgaggatatcaa

SEQ ID NO: 544338 - DNA, 25 bp, Homo sapien
aaggaactgagagcccgtgcttatg

SEQ ID NO: 544339 - DNA, 25 bp, Homo sapien
agcccgtgcttatgctcttctatga

SEQ ID NO: 544340 - DNA, 25 bp, Homo sapien
tgtaaacttcttcccctagttccat

SEQ ID NO: 544341 - DNA, 25 bp, Homo sapien
agttccatcctcactagtaaaaaat

SEQ ID NO: 544342 - DNA, 25 bp, Homo sapien
tacatttagtgtttcaagagattca

SEQ ID NO: 544343 - DNA, 25 bp, Homo sapien
aagagattcacttaattgccttttt

SEQ ID NO: 544344 - DNA, 25 bp, Homo sapien
tttttgcccacgtatattatgtagt

SEQ ID NO: 544345 - DNA, 25 bp, Homo sapien
gcccacgtatattatgtagtctatt

SEQ ID NO: 544346 - DNA, 25 bp, Homo sapien
gtagtctatttgcaactgttcttaa

SEQ ID NO: 544347 - DNA, 25 bp, Homo sapien
attagtggatgttaattgtctcccc

SEQ ID NO: 544348 - DNA, 25 bp, Homo sapien
attgtctccccacctatatttatgg

SEQ ID NO: 544349 - DNA, 25 bp, Homo sapien
atttatgggtgttagcgcaactgct

SEQ ID NO: 544350 - DNA, 25 bp, Homo sapien
gtgttagcgcaactgctttgctagt

SEQ ID NO: 544351 - DNA, 25 bp, Homo sapien
gcgcaactgctttgctagttgcaaa

SEQ ID NO: 544352 - DNA, 25 bp, Homo sapien
gtgtatttgtaaactgtatgggaac

SEQ ID NO: 544353 - DNA, 25 bp, Homo sapien
cgacctggagacctacacggtggac

SEQ ID NO: 544354 - DNA, 25 bp, Homo sapien
acggtggacatgagccacatcctgg

SEQ ID NO: 544355 - DNA, 25 bp, Homo sapien
gatggccccacgaaaacctattgtc

SEQ ID NO: 544356 - DNA, 25 bp, Homo sapien
gaaaacctattgtcaccggcgactg

SEQ ID NO: 544357 - DNA, 25 bp, Homo sapien
gtcaccggcgactgaactttctgga

SEQ ID NO: 544358 - DNA, 25 bp, Homo sapien
tctggaatccaagttcagccttcat

SEQ ID NO: 544359 - DNA, 25 bp, Homo sapien
aagttcagccttcatgagatgttaa

SEQ ID NO: 544360 - DNA, 25 bp, Homo sapien
gaaatgtccgagttcaaagagttga

SEQ ID NO: 544361 - DNA, 25 bp, Homo sapien
ccaacctggattacttggtccacat

SEQ ID NO: 544362 - DNA, 25 bp, Homo sapien
tggattacttggtccacatgcaggg

SEQ ID NO: 544363 - DNA, 25 bp, Homo sapien
gggcatcctctttgtgtatgataac

SEQ ID NO: 544364 - DNA, 25 bp, Homo sapien
agggttgagccaactatagctctgt

SEQ ID NO: 544365 - DNA, 25 bp, Homo sapien
caactatagctctgtgttcctactg

SEQ ID NO: 544366 - DNA, 25 bp, Homo sapien
tgggctttccctaatgtggttggga

SEQ ID NO: 544367 - DNA, 25 bp, Homo sapien
gttgggagttatgccctagactaac

SEQ ID NO: 544368 - DNA, 25 bp, Homo sapien
tgccctagactaactgtattgtcct

SEQ ID NO: 544369 - DNA, 25 bp, Homo sapien
tgtattgtcctagtcacagctcctt

SEQ ID NO: 544370 - DNA, 25 bp, Homo sapien
ctagtcacagctccttgctttgatt

SEQ ID NO: 544371 - DNA, 25 bp, Homo sapien
tgaaacttacactacttctccaagc

SEQ ID NO: 544372 - DNA, 25 bp, Homo sapien
ttctccaagccttttgctgtcttaa

SEQ ID NO: 544373 - DNA, 25 bp, Homo sapien
gacctgagattaacactaaccctag

SEQ ID NO: 544374 - DNA, 25 bp, Homo sapien
tacagaatttctgttgctccccaga

SEQ ID NO: 544375 - DNA, 25 bp, Homo sapien
cctccatggcacactgcagcaggaa

SEQ ID NO: 544376 - DNA, 25 bp, Homo sapien
tgcagcaggaacatgggccggtcct

SEQ ID NO: 544377 - DNA, 25 bp, Homo sapien
aacatgggccggtcctccaggtagg

SEQ ID NO: 544378 - DNA, 25 bp, Homo sapien
tcctccaggtaggtggtctgctgca

SEQ ID NO: 544379 - DNA, 25 bp, Homo sapien
aggtaggtggtctgctgcaccatct

SEQ ID NO: 544380 - DNA, 25 bp, Homo sapien
tgctgcaccatctccgcattgagga

SEQ ID NO: 544381 - DNA, 25 bp, Homo sapien
atctccgcattgaggaccaggtcag

SEQ ID NO: 544382 - DNA, 25 bp, Homo sapien
gggcggtttctgagcaggcaactcc

SEQ ID NO: 544383 - DNA, 25 bp, Homo sapien
taggactggccgattgttgtggatc

SEQ ID NO: 544384 - DNA, 25 bp, Homo sapien
ggtttctgagcaggcaactccggcc

SEQ ID NO: 544385 - DNA, 25 bp, Homo sapien
ggcagtgcgccagggacagctccgt

SEQ ID NO: 544386 - DNA, 25 bp, Homo sapien
aatatgtgcacattctgtttgctgc

SEQ ID NO: 544387 - DNA, 25 bp, Homo sapien
gtgcacattctgtttgctgcaaact

SEQ ID NO: 544388 - DNA, 25 bp, Homo sapien
ttgctgcaaactgtaaaaccatgat

SEQ ID NO: 544389 - DNA, 25 bp, Homo sapien
ccatgatgacaaaaaggcttaaata

SEQ ID NO: 544390 - DNA, 25 bp, Homo sapien
ttgcagatcacatgattgcatagaa

SEQ ID NO: 544391 - DNA, 25 bp, Homo sapien
atgattgcatagaaaatcctaggga

SEQ ID NO: 544392 - DNA, 25 bp, Homo sapien
ataagtgtgtttaagcaaggtctcc

SEQ ID NO: 544393 - DNA, 25 bp, Homo sapien
gtgtgtttaagcaaggtctccagat

SEQ ID NO: 544394 - DNA, 25 bp, Homo sapien
gcaaggtctccagatataaggtcaa

SEQ ID NO: 544395 - DNA, 25 bp, Homo sapien
gtctccagatataaggtcaacgtaa

SEQ ID NO: 544396 - DNA, 25 bp, Homo sapien
atttatataatctatctgtaacagt

SEQ ID NO: 544397 - DNA, 25 bp, Homo sapien
cttgatatggagatcagtccccaaa

SEQ ID NO: 544398 - DNA, 25 bp, Homo sapien
agtccccaaatcactgaattgtccc

SEQ ID NO: 544399 - DNA, 25 bp, Homo sapien
actgaattgtcccagcagtgctatg

SEQ ID NO: 544400 - DNA, 25 bp, Homo sapien
agtgctatgccctaggtactaccaa

SEQ ID NO: 544401 - DNA, 25 bp, Homo sapien
gccctaggtactaccaatatcactc

SEQ ID NO: 544402 - DNA, 25 bp, Homo sapien
tgcaggatgagagctgtctgtctct

SEQ ID NO: 544403 - DNA, 25 bp, Homo sapien
tctcttacctgcctgtatttgtgcc

SEQ ID NO: 544404 - DNA, 25 bp, Homo sapien
tgcctgtatttgtgccccattttta

SEQ ID NO: 544405 - DNA, 25 bp, Homo sapien
gccacaggaaaggtatcagcccttg

SEQ ID NO: 544406 - DNA, 25 bp, Homo sapien
atcagcccttggtgataggcacatt

SEQ ID NO: 544407 - DNA, 25 bp, Homo sapien
tttaccagtctatcatttggtcatt

SEQ ID NO: 544408 - DNA, 25 bp, Homo sapien
gaatcgtacctcatcatgggccaga

SEQ ID NO: 544409 - DNA, 25 bp, Homo sapien
atgggccagacgtcagacctgtgga

SEQ ID NO: 544410 - DNA, 25 bp, Homo sapien
agacctgtggagaatcaaatctgat

SEQ ID NO: 544411 - DNA, 25 bp, Homo sapien
ctgattacagctatgttctgggcaa

SEQ ID NO: 544412 - DNA, 25 bp, Homo sapien
ttctgggcaaggagacgttcctcat

SEQ ID NO: 544413 - DNA, 25 bp, Homo sapien
gttcctcatcctttggccagcagat

SEQ ID NO: 544414 - DNA, 25 bp, Homo sapien
aattgcgggaccaactggaggaatt

SEQ ID NO: 544415 - DNA, 25 bp, Homo sapien
gaatttttggaatatatgcgcaccc

SEQ ID NO: 544416 - DNA, 25 bp, Homo sapien
tgagcctcttctgctttcagggagg

SEQ ID NO: 544417 - DNA, 25 bp, Homo sapien
ttcagggaggtgtcatcaggcagct

SEQ ID NO: 544418 - DNA, 25 bp, Homo sapien
gcagctctgggccactgggtttaac

SEQ ID NO: 544419 - DNA, 25 bp, Homo sapien
tcatgaatcatgagaaaatttccac

SEQ ID NO: 544420 - DNA, 25 bp, Homo sapien
aaatttccacagatacttcccttag

SEQ ID NO: 544421 - DNA, 25 bp, Homo sapien
aatttccacagatacttcccttaga

SEQ ID NO: 544422 - DNA, 25 bp, Homo sapien
ttccacagatacttcccttagaaaa

SEQ ID NO: 544423 - DNA, 25 bp, Homo sapien
cagatacttcccttagaaaatttgc

SEQ ID NO: 544424 - DNA, 25 bp, Homo sapien
aaatttgctataaactctgtatcat

SEQ ID NO: 544425 - DNA, 25 bp, Homo sapien
ataaactctgtatcattggtagcac

SEQ ID NO: 544426 - DNA, 25 bp, Homo sapien
aactctgtatcattggtagcacaaa

SEQ ID NO: 544427 - DNA, 25 bp, Homo sapien
tggtagcacaaatttgagcgaggcc

SEQ ID NO: 544428 - DNA, 25 bp, Homo sapien
ggtggaaataggaaggaccacaaca

SEQ ID NO: 544429 - DNA, 25 bp, Homo sapien
cttgtacttctaataacatttttca

SEQ ID NO: 544430 - DNA, 25 bp, Homo sapien
ctgggtattcttgaattgcttttac

SEQ ID NO: 544431 - DNA, 25 bp, Homo sapien
tacccctcaactttaatttgcccag

SEQ ID NO: 544432 - DNA, 25 bp, Homo sapien
atttgcccagttatacctcagtgtt

SEQ ID NO: 544433 - DNA, 25 bp, Homo sapien
gtagcagtactgtgatacctggcac

SEQ ID NO: 544434 - DNA, 25 bp, Homo sapien
atgccctctgtactgacctgaagga

SEQ ID NO: 544435 - DNA, 25 bp, Homo sapien
tgaaggagacctaagagtcctttcc

SEQ ID NO: 544436 - DNA, 25 bp, Homo sapien
ctttccctttttgagtttgaatcat

SEQ ID NO: 544437 - DNA, 25 bp, Homo sapien
catagccttgatgtggtctcttgtt

SEQ ID NO: 544438 - DNA, 25 bp, Homo sapien
gttttatgtccttgttcctaatgta

SEQ ID NO: 544439 - DNA, 25 bp, Homo sapien
aagtgcttaactgcttcttggttgt

SEQ ID NO: 544440 - DNA, 25 bp, Homo sapien
cttcttggttgtattgggtagcatt

SEQ ID NO: 544441 - DNA, 25 bp, Homo sapien
gaaattaggaggatctagggacaga

SEQ ID NO: 544442 - DNA, 25 bp, Homo sapien
tgtgaaaatacaaaatacccaagat

SEQ ID NO: 544443 - DNA, 25 bp, Homo sapien
atttatctctaatatgcttatgtga

SEQ ID NO: 544444 - DNA, 25 bp, Homo sapien
tatgcttatgtgattggccctaggg

SEQ ID NO: 544445 - DNA, 25 bp, Homo sapien
tttattttcatgcttatccaaagat

SEQ ID NO: 544446 - DNA, 25 bp, Homo sapien
attttcatgcttatccaaagattac

SEQ ID NO: 544447 - DNA, 25 bp, Homo sapien
catgcttatccaaagattactattg

SEQ ID NO: 544448 - DNA, 25 bp, Homo sapien
gcttatccaaagattactattgtat

SEQ ID NO: 544449 - DNA, 25 bp, Homo sapien
agattactattgtatcttcaaatga

SEQ ID NO: 544450 - DNA, 25 bp, Homo sapien
atgaacttaatattgtgagatggaa

SEQ ID NO: 544451 - DNA, 25 bp, Homo sapien
tgagatggaactgccggggattaaa

SEQ ID NO: 544452 - DNA, 25 bp, Homo sapien
ttcaccctaaggatccaatggaata

SEQ ID NO: 544453 - DNA, 25 bp, Homo sapien
gaaatcacttccttgaaaattttat

SEQ ID NO: 544454 - DNA, 25 bp, Homo sapien
aacaaaaagcctgtccacccttgag

SEQ ID NO: 544455 - DNA, 25 bp, Homo sapien
ttgagaatccttcctctccttggaa

SEQ ID NO: 544456 - DNA, 25 bp, Homo sapien
ctctccttggaacgtcaatgtttgt

SEQ ID NO: 544457 - DNA, 25 bp, Homo sapien
gatgaaaccatctcatgctctgtgg

SEQ ID NO: 544458 - DNA, 25 bp, Homo sapien
gggtttctgttactattttatgcac

SEQ ID NO: 544459 - DNA, 25 bp, Homo sapien
gttactattttatgcacttgggaga

SEQ ID NO: 544460 - DNA, 25 bp, Homo sapien
gctttcccatttattgtttggccag

SEQ ID NO: 544461 - DNA, 25 bp, Homo sapien
ggccagctatgccaatgtggtgcta

SEQ ID NO: 544462 - DNA, 25 bp, Homo sapien
tgccaatgtggtgctattgtttctt

SEQ ID NO: 544463 - DNA, 25 bp, Homo sapien
ttcatgctcctgaaaaccattctct

SEQ ID NO: 544464 - DNA, 25 bp, Homo sapien
gaaaaccattctctgcagcagaatt

SEQ ID NO: 544465 - DNA, 25 bp, Homo sapien
agcagaattggctggtttcgcgcct

SEQ ID NO: 544466 - DNA, 25 bp, Homo sapien
tttcgcgcctgagttgggctctagt

SEQ ID NO: 544467 - DNA, 25 bp, Homo sapien
gggctctagtgactcgagactcaat

SEQ ID NO: 544468 - DNA, 25 bp, Homo sapien
gagactcaatgactgggacttagac

SEQ ID NO: 544469 - DNA, 25 bp, Homo sapien
ggcctcgctctgaaaagtgcttaag

SEQ ID NO: 544470 - DNA, 25 bp, Homo sapien
agaaaatcttctcagttctccttgc

SEQ ID NO: 544471 - DNA, 25 bp, Homo sapien
agttctccttgcagaggactggcgc

SEQ ID NO: 544472 - DNA, 25 bp, Homo sapien
acgcgaagagcaacgggcgctgcac

SEQ ID NO: 544473 - DNA, 25 bp, Homo sapien
agcgacaggcggcagcacagcacct

SEQ ID NO: 544474 - DNA, 25 bp, Homo sapien
ctgtgaggttaccaacctgaatgac

SEQ ID NO: 544475 - DNA, 25 bp, Homo sapien
tgtgaggttaccaacctgaatgact

SEQ ID NO: 544476 - DNA, 25 bp, Homo sapien
gtgaggttaccaacctgaatgacta

SEQ ID NO: 544477 - DNA, 25 bp, Homo sapien
tgaggttaccaacctgaatgactac

SEQ ID NO: 544478 - DNA, 25 bp, Homo sapien
gaggttaccaacctgaatgactacc

SEQ ID NO: 544479 - DNA, 25 bp, Homo sapien
aggttaccaacctgaatgactaccg

SEQ ID NO: 544480 - DNA, 25 bp, Homo sapien
ggttaccaacctgaatgactaccga

SEQ ID NO: 544481 - DNA, 25 bp, Homo sapien
gttaccaacctgaatgactaccgag

SEQ ID NO: 544482 - DNA, 25 bp, Homo sapien
ttaccaacctgaatgactaccgaga

SEQ ID NO: 544483 - DNA, 25 bp, Homo sapien
agctggctgatagcagaactgggat

SEQ ID NO: 544484 - DNA, 25 bp, Homo sapien
gaactgggattctaaatccttcgat

SEQ ID NO: 544485 - DNA, 25 bp, Homo sapien
aaatccttcgatttctaatctagtg

SEQ ID NO: 544486 - DNA, 25 bp, Homo sapien
tgatctttgtatttcactgaaggtt

SEQ ID NO: 544487 - DNA, 25 bp, Homo sapien
ggtttttcaaactgtgctgtccaga

SEQ ID NO: 544488 - DNA, 25 bp, Homo sapien
gaaggacagagctgtacccctattc

SEQ ID NO: 544489 - DNA, 25 bp, Homo sapien
accccacccagaattgagcagtttt

SEQ ID NO: 544490 - DNA, 25 bp, Homo sapien
gacctagttcattctccttatttaa

SEQ ID NO: 544491 - DNA, 25 bp, Homo sapien
cattctccttatttaacaggtgagg

SEQ ID NO: 544492 - DNA, 25 bp, Homo sapien
ggaaatctgtaccatagaggttcag

SEQ ID NO: 544493 - DNA, 25 bp, Homo sapien
agaggttcagtaacacagctggctg

SEQ ID NO: 544494 - DNA, 25 bp, Homo sapien
atcaccccaaggaacgatttctcag

SEQ ID NO: 544495 - DNA, 25 bp, Homo sapien
gagatgatcaccgtgaatccggctt

SEQ ID NO: 544496 - DNA, 25 bp, Homo sapien
aatccggcttcctctgagcattcga

SEQ ID NO: 544497 - DNA, 25 bp, Homo sapien
tgagcattcgatggccttagcacct

SEQ ID NO: 544498 - DNA, 25 bp, Homo sapien
ttagcacctcatcaagccagcacat

SEQ ID NO: 544499 - DNA, 25 bp, Homo sapien
agcctggctgggtttattcttcagt

SEQ ID NO: 544500 - DNA, 25 bp, Homo sapien
ttcagttaccctaatcccatgatgc

SEQ ID NO: 544501 - DNA, 25 bp, Homo sapien
gatgcctggaaccttgattaccgtt

SEQ ID NO: 544502 - DNA, 25 bp, Homo sapien
gattaccgttttacatcagctcttg

SEQ ID NO: 544503 - DNA, 25 bp, Homo sapien
catcagctcttgtacttttcagtat

SEQ ID NO: 544504 - DNA, 25 bp, Homo sapien
atttagactttgaacagctctggga

SEQ ID NO: 544505 - DNA, 25 bp, Homo sapien
aatatattattcttcaacgacattt

SEQ ID NO: 544506 - DNA, 25 bp, Homo sapien
cccctttgtgttggactgcaaattg

SEQ ID NO: 544507 - DNA, 25 bp, Homo sapien
gtgttggactgcaaattgagtttct

SEQ ID NO: 544508 - DNA, 25 bp, Homo sapien
ggactgcaaattgagtttctttctc

SEQ ID NO: 544509 - DNA, 25 bp, Homo sapien
ttctctttaggcctttcacaactag

SEQ ID NO: 544510 - DNA, 25 bp, Homo sapien
tttaggcctttcacaactaggactg

SEQ ID NO: 544511 - DNA, 25 bp, Homo sapien
ggcctttcacaactaggactgagaa

SEQ ID NO: 544512 - DNA, 25 bp, Homo sapien
caactaggactgagaatgtatgtaa

SEQ ID NO: 544513 - DNA, 25 bp, Homo sapien
gtaaaagttctgtgacagtacagaa

SEQ ID NO: 544514 - DNA, 25 bp, Homo sapien
gacagtacagaaggaaaacaacttt

SEQ ID NO: 544515 - DNA, 25 bp, Homo sapien
gaaaacaactttttatgtatagctt

SEQ ID NO: 544516 - DNA, 25 bp, Homo sapien
gataaataaacttacagacactgaa

SEQ ID NO: 544517 - DNA, 25 bp, Homo sapien
gacactgaattaatttcccctgcta

SEQ ID NO: 544518 - DNA, 25 bp, Homo sapien
ctgaattaatttcccctgctacttt

SEQ ID NO: 544519 - DNA, 25 bp, Homo sapien
tttcccctgctactttgaaaccaga

SEQ ID NO: 544520 - DNA, 25 bp, Homo sapien
atgactggccattcgttacatctgt

SEQ ID NO: 544521 - DNA, 25 bp, Homo sapien
ggccattcgttacatctgtcttagt

SEQ ID NO: 544522 - DNA, 25 bp, Homo sapien
gttacatctgtcttagttgaaaagc

SEQ ID NO: 544523 - DNA, 25 bp, Homo sapien
tattcaattcacttatggcagagga

SEQ ID NO: 544524 - DNA, 25 bp, Homo sapien
ggaatatcaatcctaatgacttcta

SEQ ID NO: 544525 - DNA, 25 bp, Homo sapien
tcattatcttacatttactgtttaa

SEQ ID NO: 544526 - DNA, 25 bp, Homo sapien
gaaaatgtatggctagagtgtcata

SEQ ID NO: 544527 - DNA, 25 bp, Homo sapien
acatacaaactaccacgcttacaat

SEQ ID NO: 544528 - DNA, 25 bp, Homo sapien
acgcttacaatctccatgaacctaa

SEQ ID NO: 544529 - DNA, 25 bp, Homo sapien
gaacctaagtgcatcagtggcgctg

SEQ ID NO: 544530 - DNA, 25 bp, Homo sapien
gggatgctatacatgccgaaagtgt

SEQ ID NO: 544531 - DNA, 25 bp, Homo sapien
atgccgaaagtgtacatcatcattt

SEQ ID NO: 544532 - DNA, 25 bp, Homo sapien
tcattttccaccctgaactcaatgt

SEQ ID NO: 544533 - DNA, 25 bp, Homo sapien
aaggcggtagtcacagcagccacca

SEQ ID NO: 544534 - DNA, 25 bp, Homo sapien
atgtcatcgaggctgtcacacaaac

SEQ ID NO: 544535 - DNA, 25 bp, Homo sapien
aaacccagtgacagacccaacggtg

SEQ ID NO: 544536 - DNA, 25 bp, Homo sapien
aggcaaagaccgagctctgtgaaaa

SEQ ID NO: 544537 - DNA, 25 bp, Homo sapien
tgaaaacgtagacccaaacagccct

SEQ ID NO: 544538 - DNA, 25 bp, Homo sapien
gctaaaacagccatcttcaagacag

SEQ ID NO: 544539 - DNA, 25 bp, Homo sapien
tcaagacagcccctgaaaagagacc

SEQ ID NO: 544540 - DNA, 25 bp, Homo sapien
aaagagaccagttcaggtcctgccc

SEQ ID NO: 544541 - DNA, 25 bp, Homo sapien
agttcaggtcctgccctgctgttct

SEQ ID NO: 544542 - DNA, 25 bp, Homo sapien
caagaggaactcttggagttggctg

SEQ ID NO: 544543 - DNA, 25 bp, Homo sapien
gtgagagggctctccatttgctacc

SEQ ID NO: 544544 - DNA, 25 bp, Homo sapien
atttgctacctgtagtagcctgcct

SEQ ID NO: 544545 - DNA, 25 bp, Homo sapien
tagcctgcctcttaactggttgctt

SEQ ID NO: 544546 - DNA, 25 bp, Homo sapien
actggttgcttctccctagttccag

SEQ ID NO: 544547 - DNA, 25 bp, Homo sapien
caacactgcccttgctttgttttcc

SEQ ID NO: 544548 - DNA, 25 bp, Homo sapien
cctgtcacctccctattattaaatg

SEQ ID NO: 544549 - DNA, 25 bp, Homo sapien
tcttcagctgtctacttggaagaac

SEQ ID NO: 544550 - DNA, 25 bp, Homo sapien
ttcagctgtctacttggaagaacat

SEQ ID NO: 544551 - DNA, 25 bp, Homo sapien
agctgtctacttggaagaacatgga

SEQ ID NO: 544552 - DNA, 25 bp, Homo sapien
ctgtctacttggaagaacatggaat

SEQ ID NO: 544553 - DNA, 25 bp, Homo sapien
ggaagaacatggaataagcatactt

SEQ ID NO: 544554 - DNA, 25 bp, Homo sapien
ggaataagcatacttaacagtgaaa

SEQ ID NO: 544555 - DNA, 25 bp, Homo sapien
tacttaacagtgaaaagaatcttta

SEQ ID NO: 544556 - DNA, 25 bp, Homo sapien
agaaggctttctaacaatgactgac

SEQ ID NO: 544557 - DNA, 25 bp, Homo sapien
aaggctttctaacaatgactgacta

SEQ ID NO: 544558 - DNA, 25 bp, Homo sapien
ggctttctaacaatgactgactaaa

SEQ ID NO: 544559 - DNA, 25 bp, Homo sapien
ataaagctgtctgctcctgcattga

SEQ ID NO: 544560 - DNA, 25 bp, Homo sapien
gagggcctcccctgccaatggtgct

SEQ ID NO: 544561 - DNA, 25 bp, Homo sapien
gccaatggtgctggtatcccatgca

SEQ ID NO: 544562 - DNA, 25 bp, Homo sapien
tggtgctggtatcccatgcagctca

SEQ ID NO: 544563 - DNA, 25 bp, Homo sapien
cagctcaccactggctgcgtggaaa

SEQ ID NO: 544564 - DNA, 25 bp, Homo sapien
actggctgcgtggaaactccctttt

SEQ ID NO: 544565 - DNA, 25 bp, Homo sapien
ttattggccttctaaggagctgttt

SEQ ID NO: 544566 - DNA, 25 bp, Homo sapien
tcccatgccattttaatactacaga

SEQ ID NO: 544567 - DNA, 25 bp, Homo sapien
aatactacagatgtactacgtatct

SEQ ID NO: 544568 - DNA, 25 bp, Homo sapien
ctacgtatctgtttatatactgtac

SEQ ID NO: 544569 - DNA, 25 bp, Homo sapien
tatactgtacctacatctgtgcttt

SEQ ID NO: 544570 - DNA, 25 bp, Homo sapien
gaggacagagactcatttgaacatg

SEQ ID NO: 544571 - DNA, 25 bp, Homo sapien
ctgggctctcttgggctttatccat

SEQ ID NO: 544572 - DNA, 25 bp, Homo sapien
cttgggctttatccatgtctttaga

SEQ ID NO: 544573 - DNA, 25 bp, Homo sapien
aaccgcgcagttcattggccactct

SEQ ID NO: 544574 - DNA, 25 bp, Homo sapien
tggccactctgcacgcattcagtat

SEQ ID NO: 544575 - DNA, 25 bp, Homo sapien
gcacgcattcagtattaccatggag

SEQ ID NO: 544576 - DNA, 25 bp, Homo sapien
cattcagtattaccatggagctggg

SEQ ID NO: 544577 - DNA, 25 bp, Homo sapien
agcaccaggcggtctcctctacaga

SEQ ID NO: 544578 - DNA, 25 bp, Homo sapien
ggtctcctctacagactgccttggc

SEQ ID NO: 544579 - DNA, 25 bp, Homo sapien
tgccttggcccacccattgaacatt

SEQ ID NO: 544580 - DNA, 25 bp, Homo sapien
acccattgaacattcggcacgtgac

SEQ ID NO: 544581 - DNA, 25 bp, Homo sapien
aacattcggcacgtgaccttgtggg

SEQ ID NO: 544582 - DNA, 25 bp, Homo sapien
agcatcccatgctgacttgcggttg

SEQ ID NO: 544583 - DNA, 25 bp, Homo sapien
ccatgctgacttgcggttggccaat

SEQ ID NO: 544584 - DNA, 25 bp, Homo sapien
tgctgacttgcggttggccaatccc

SEQ ID NO: 544585 - DNA, 25 bp, Homo sapien
tcctcgtagatttcctccacatttt

SEQ ID NO: 544586 - DNA, 25 bp, Homo sapien
tttcctgtgggaagttctttttctg

SEQ ID NO: 544587 - DNA, 25 bp, Homo sapien
tcctgtgggaagttctttttctggg

SEQ ID NO: 544588 - DNA, 25 bp, Homo sapien
ggctgtggctggtcttacgtagttc

SEQ ID NO: 544589 - DNA, 25 bp, Homo sapien
gctggtcttacgtagttcggtggaa

SEQ ID NO: 544590 - DNA, 25 bp, Homo sapien
agtgttagatactgtgctgcacctc

SEQ ID NO: 544591 - DNA, 25 bp, Homo sapien
ttagatactgtgctgcacctccagg

SEQ ID NO: 544592 - DNA, 25 bp, Homo sapien
tgctgcacctccaggagtgtccaat

SEQ ID NO: 544593 - DNA, 25 bp, Homo sapien
agacacacacaggagggcctggcca

SEQ ID NO: 544594 - DNA, 25 bp, Homo sapien
gggcctagggactcctcatgcctct

SEQ ID NO: 544595 - DNA, 25 bp, Homo sapien
atgcctctgagatggaatggtggta

SEQ ID NO: 544596 - DNA, 25 bp, Homo sapien
agatggaatggtggtatcctgccgt

SEQ ID NO: 544597 - DNA, 25 bp, Homo sapien
aagcctgaaggaccctcaaaactgc

SEQ ID NO: 544598 - DNA, 25 bp, Homo sapien
aggaccctcaaaactgcctcctgga

SEQ ID NO: 544599 - DNA, 25 bp, Homo sapien
gagtccacggttcctgacctccgag

SEQ ID NO: 544600 - DNA, 25 bp, Homo sapien
tcagctatgccctctgggtcaacca

SEQ ID NO: 544601 - DNA, 25 bp, Homo sapien
gggtcaaccagaattagagccagac

SEQ ID NO: 544602 - DNA, 25 bp, Homo sapien
ggcagacaagatgctcagagcgact

SEQ ID NO: 544603 - DNA, 25 bp, Homo sapien
gatgctcagagcgactattaaagaa

SEQ ID NO: 544604 - DNA, 25 bp, Homo sapien
ctgttggcagaagggaatgtcactc

SEQ ID NO: 544605 - DNA, 25 bp, Homo sapien
atgtcactccctggaaacaggttca

SEQ ID NO: 544606 - DNA, 25 bp, Homo sapien
ggttcagcatgtttgcacttgttat

SEQ ID NO: 544607 - DNA, 25 bp, Homo sapien
ttgcacttgttattttgtagcttta

SEQ ID NO: 544608 - DNA, 25 bp, Homo sapien
gcaaatgtctctaagcttggtgttt

SEQ ID NO: 544609 - DNA, 25 bp, Homo sapien
gcttggtgtttagagctgcttcata

SEQ ID NO: 544610 - DNA, 25 bp, Homo sapien
gttccattccacagttctagttcaa

SEQ ID NO: 544611 - DNA, 25 bp, Homo sapien
tagttcaaaccagtttttacagcct

SEQ ID NO: 544612 - DNA, 25 bp, Homo sapien
agcctcctgggtgggtcgtcttgac

SEQ ID NO: 544613 - DNA, 25 bp, Homo sapien
tcgtcttgacccaaactcttgtgtt

SEQ ID NO: 544614 - DNA, 25 bp, Homo sapien
gaggttttcataccagaatgtacca

SEQ ID NO: 544615 - DNA, 25 bp, Homo sapien
gtgataccaaatcttcagctgtcta

SEQ ID NO: 544616 - DNA, 25 bp, Homo sapien
gataccaaatcttcagctgtctact

SEQ ID NO: 544617 - DNA, 25 bp, Homo sapien
ttcagctgtctacttggaagaacat

SEQ ID NO: 544618 - DNA, 25 bp, Homo sapien
gctgtctacttggaagaacatggaa

SEQ ID NO: 544619 - DNA, 25 bp, Homo sapien
ggaagaacatggaataagcatactt

SEQ ID NO: 544620 - DNA, 25 bp, Homo sapien
ggaataagcatacttaacagtgaaa

SEQ ID NO: 544621 - DNA, 25 bp, Homo sapien
gaaggctttctaacaatgactgact

SEQ ID NO: 544622 - DNA, 25 bp, Homo sapien
ggctttctaacaatgactgactaaa

SEQ ID NO: 544623 - DNA, 25 bp, Homo sapien
ataaagctgtctgctcctgcattga

SEQ ID NO: 544624 - DNA, 25 bp, Homo sapien
tcactaagtgtagactgatgactgt

SEQ ID NO: 544625 - DNA, 25 bp, Homo sapien
gtagactgatgactgtatagagatg

SEQ ID NO: 544626 - DNA, 25 bp, Homo sapien
gaactatactgctttgagatctcat

SEQ ID NO: 544627 - DNA, 25 bp, Homo sapien
tcagaagaacggcatgaacagtctt

SEQ ID NO: 544628 - DNA, 25 bp, Homo sapien
gaacagtcttcagccacagttgtga

SEQ ID NO: 544629 - DNA, 25 bp, Homo sapien
gccacagttgtgatggttgttaaat

SEQ ID NO: 544630 - DNA, 25 bp, Homo sapien
gctcacaattgtgcattcttagggt

SEQ ID NO: 544631 - DNA, 25 bp, Homo sapien
acaattgtgcattcttagggttttt

SEQ ID NO: 544632 - DNA, 25 bp, Homo sapien
ggttggcttcttgtctgcaagccag

SEQ ID NO: 544633 - DNA, 25 bp, Homo sapien
aagccagctgatatggtagcaacca

SEQ ID NO: 544634 - DNA, 25 bp, Homo sapien
ggtagcaaccaaagattccagtgtt

SEQ ID NO: 544635 - DNA, 25 bp, Homo sapien
aagattccagtgtttgagcatatga

SEQ ID NO: 544636 - DNA, 25 bp, Homo sapien
gtttgagcatatgaaagactctgcc

SEQ ID NO: 544637 - DNA, 25 bp, Homo sapien
tggcgggaatcctatttatcagact

SEQ ID NO: 544638 - DNA, 25 bp, Homo sapien
gaatcctatttatcagactctgtaa

SEQ ID NO: 544639 - DNA, 25 bp, Homo sapien
aaatgttttactcagaggagctgca

SEQ ID NO: 544640 - DNA, 25 bp, Homo sapien
gaggagctgcaaattgcctgcaaaa

SEQ ID NO: 544641 - DNA, 25 bp, Homo sapien
gaaatccagtgagcactagaatatt

SEQ ID NO: 544642 - DNA, 25 bp, Homo sapien
aacatcattactgccatctttatca

SEQ ID NO: 544643 - DNA, 25 bp, Homo sapien
gaagcacatcaattacaagctgtag

SEQ ID NO: 544644 - DNA, 25 bp, Homo sapien
ttacaagctgtagaccacctaatat

SEQ ID NO: 544645 - DNA, 25 bp, Homo sapien
gtagaccacctaatatcaatttgta

SEQ ID NO: 544646 - DNA, 25 bp, Homo sapien
ttcaattatactaaacctcacaaag

SEQ ID NO: 544647 - DNA, 25 bp, Homo sapien
gtagaggaatccatgtaaattgcaa

SEQ ID NO: 544648 - DNA, 25 bp, Homo sapien
gacgatgggaaatcatggacttgta

SEQ ID NO: 544649 - DNA, 25 bp, Homo sapien
tgaacttggtaacttctgggtttag

SEQ ID NO: 544650 - DNA, 25 bp, Homo sapien
aacttctgggtttagtagagcctca

SEQ ID NO: 544651 - DNA, 25 bp, Homo sapien
agagcctcagtgtcgctttaactta

SEQ ID NO: 544652 - DNA, 25 bp, Homo sapien
cagtgtcgctttaacttagtttact

SEQ ID NO: 544653 - DNA, 25 bp, Homo sapien
atttttaaagcagcaatggatggtt

SEQ ID NO: 544654 - DNA, 25 bp, Homo sapien
aaatatgactgtaacacagctttgt

SEQ ID NO: 544655 - DNA, 25 bp, Homo sapien
ctttgtggtagctgtgacacagttc

SEQ ID NO: 544656 - DNA, 25 bp, Homo sapien
gacacagttcacttgggcaaaggag

SEQ ID NO: 544657 - DNA, 25 bp, Homo sapien
gtggtgatggactcgttaaaatcat

SEQ ID NO: 544658 - DNA, 25 bp, Homo sapien
atacttgaatagtccattgaccgaa

SEQ ID NO: 544659 - DNA, 25 bp, Homo sapien
agcagacccgacaggtgcagcaggt

SEQ ID NO: 544660 - DNA, 25 bp, Homo sapien
acaggtgcagcaggttgtccacgct

SEQ ID NO: 544661 - DNA, 25 bp, Homo sapien
tgcagcaggttgtccacgctggcgt

SEQ ID NO: 544662 - DNA, 25 bp, Homo sapien
gtgcgtggccaggatcacatcgttg

SEQ ID NO: 544663 - DNA, 25 bp, Homo sapien
ggtccatggtggtcttcagcaggcc

SEQ ID NO: 544664 - DNA, 25 bp, Homo sapien
tggtggtcttcagcaggcccctgta

SEQ ID NO: 544665 - DNA, 25 bp, Homo sapien
aggcccctgtagacgcggtaatcgc

SEQ ID NO: 544666 - DNA, 25 bp, Homo sapien
ggtaatcgccgctagcgtccaggac

SEQ ID NO: 544667 - DNA, 25 bp, Homo sapien
tagcgtccaggacgcctccagaggc

SEQ ID NO: 544668 - DNA, 25 bp, Homo sapien
cagtggctgctcagcgcgtaggcca

SEQ ID NO: 544669 - DNA, 25 bp, Homo sapien
tgctcagcgcgtaggccagcaccgt

SEQ ID NO: 544670 - DNA, 25 bp, Homo sapien
actccagccgctgttggctgggaat

SEQ ID NO: 544671 - DNA, 25 bp, Homo sapien
ccgctgttggctgggaatcgaagtt

SEQ ID NO: 544672 - DNA, 25 bp, Homo sapien
gaagttagaggtgacttccaaaggc

SEQ ID NO: 544673 - DNA, 25 bp, Homo sapien
agcgactctgcggtgccagtgcctt

SEQ ID NO: 544674 - DNA, 25 bp, Homo sapien
cagtgccttgttggcttttccggct

SEQ ID NO: 544675 - DNA, 25 bp, Homo sapien
ggctacgcaccctgcagtcactgag

SEQ ID NO: 544676 - DNA, 25 bp, Homo sapien
agtcactgagctctcggtctgacgt

SEQ ID NO: 544677 - DNA, 25 bp, Homo sapien
gagctctcggtctgacgtctgatgt

SEQ ID NO: 544678 - DNA, 25 bp, Homo sapien
cggtctgacgtctgatgtttgtggt

SEQ ID NO: 544679 - DNA, 25 bp, Homo sapien
tgacgtctgatgtttgtggtttgtt

SEQ ID NO: 544680 - DNA, 25 bp, Homo sapien
tagcccgctcccagaatgtcttatt

SEQ ID NO: 544681 - DNA, 25 bp, Homo sapien
aattgtaaactgtactagtctgtgt

SEQ ID NO: 544682 - DNA, 25 bp, Homo sapien
ttgtaaactgtactagtctgtgtgg

SEQ ID NO: 544683 - DNA, 25 bp, Homo sapien
gtaaactgtactagtctgtgtggga

SEQ ID NO: 544684 - DNA, 25 bp, Homo sapien
aaactgtactagtctgtgtgggact

SEQ ID NO: 544685 - DNA, 25 bp, Homo sapien
actgtactagtctgtgtgggactgt

SEQ ID NO: 544686 - DNA, 25 bp, Homo sapien
tgtactagtctgtgtgggactgtac

SEQ ID NO: 544687 - DNA, 25 bp, Homo sapien
tactagtctgtgtgggactgtacac

SEQ ID NO: 544688 - DNA, 25 bp, Homo sapien
actagtctgtgtgggactgtacaca

SEQ ID NO: 544689 - DNA, 25 bp, Homo sapien
tagtctgtgtgggactgtacacact

SEQ ID NO: 544690 - DNA, 25 bp, Homo sapien
gtctgtgtgggactgtacacacttt

SEQ ID NO: 544691 - DNA, 25 bp, Homo sapien
ctgtgtgggactgtacacactttat

SEQ ID NO: 544692 - DNA, 25 bp, Homo sapien
tcccatctgggaacacgggaggagc

SEQ ID NO: 544693 - DNA, 25 bp, Homo sapien
agtcgggctcagatgaaagggttcc

SEQ ID NO: 544694 - DNA, 25 bp, Homo sapien
ggctcagatgaaagggttcccccct

SEQ ID NO: 544695 - DNA, 25 bp, Homo sapien
gggcccacgagactctataatcctg

SEQ ID NO: 544696 - DNA, 25 bp, Homo sapien
acgagactctataatcctggctggg

SEQ ID NO: 544697 - DNA, 25 bp, Homo sapien
agactctataatcctggctgggagg

SEQ ID NO: 544698 - DNA, 25 bp, Homo sapien
aatcctggctgggaggccagcagcg

SEQ ID NO: 544699 - DNA, 25 bp, Homo sapien
gactctcgcctgactgctggtgtgc

SEQ ID NO: 544700 - DNA, 25 bp, Homo sapien
tgactgctggtgtgcccgacacgcc

SEQ ID NO: 544701 - DNA, 25 bp, Homo sapien
gggcccacatctctcagagtgagct

SEQ ID NO: 544702 - DNA, 25 bp, Homo sapien
ccacatctctcagagtgagctggca

SEQ ID NO: 544703 - DNA, 25 bp, Homo sapien
gaggcagacctgactctcttaagga

SEQ ID NO: 544704 - DNA, 25 bp, Homo sapien
aactgctgtcccaaacatgcacttc

SEQ ID NO: 544705 - DNA, 25 bp, Homo sapien
aaacatgcacttccttgcttaaggt

SEQ ID NO: 544706 - DNA, 25 bp, Homo sapien
gtatggtacaagcaatgcctgccca

SEQ ID NO: 544707 - DNA, 25 bp, Homo sapien
aatgcctgcccattggagagaaaaa

SEQ ID NO: 544708 - DNA, 25 bp, Homo sapien
tcttcaccttaggaataatctcctg

SEQ ID NO: 544709 - DNA, 25 bp, Homo sapien
ataatctcctgttaatatggtgtac

SEQ ID NO: 544710 - DNA, 25 bp, Homo sapien
atatggtgtacattcttcctgatta

SEQ ID NO: 544711 - DNA, 25 bp, Homo sapien
cttcctgattattttctacacatac

SEQ ID NO: 544712 - DNA, 25 bp, Homo sapien
aaatagggttgtactatgctgttat

SEQ ID NO: 544713 - DNA, 25 bp, Homo sapien
ctatgctgttatgagtggctttaat

SEQ ID NO: 544714 - DNA, 25 bp, Homo sapien
gtatatgtgggctaatcagaggtta

SEQ ID NO: 544715 - DNA, 25 bp, Homo sapien
ggttaataatgtcctcatctcctac

SEQ ID NO: 544716 - DNA, 25 bp, Homo sapien
taataatgtcctcatctcctactct

SEQ ID NO: 544717 - DNA, 25 bp, Homo sapien
catctcctactctccatttaaaaaa

SEQ ID NO: 544718 - DNA, 25 bp, Homo sapien
gggagtagttaagcaaaatcaacag

SEQ ID NO: 544719 - DNA, 25 bp, Homo sapien
aaatcaacagtcatcctactatgtt

SEQ ID NO: 544720 - DNA, 25 bp, Homo sapien
acagtcatcctactatgttgaaaga

SEQ ID NO: 544721 - DNA, 25 bp, Homo sapien
catcctactatgttgaaagaaccaa

SEQ ID NO: 544722 - DNA, 25 bp, Homo sapien
gataaatatcatttgtccttttact

SEQ ID NO: 544723 - DNA, 25 bp, Homo sapien
aaaatgggctcatattgtgcatacc

SEQ ID NO: 544724 - DNA, 25 bp, Homo sapien
tatattgggaacatcttttccaggt

SEQ ID NO: 544725 - DNA, 25 bp, Homo sapien
ttctttccagattggaggtttccaa

SEQ ID NO: 544726 - DNA, 25 bp, Homo sapien
tttccagattggaggtttccaagag

SEQ ID NO: 544727 - DNA, 25 bp, Homo sapien
caccgtggaagtaaccaagggcgct

SEQ ID NO: 544728 - DNA, 25 bp, Homo sapien
ggaagtaaccaagggcgcttccttg

SEQ ID NO: 544729 - DNA, 25 bp, Homo sapien
accaagggcgcttccttgtgggcag

SEQ ID NO: 544730 - DNA, 25 bp, Homo sapien
agctgctcctttcccagtttgattt

SEQ ID NO: 544731 - DNA, 25 bp, Homo sapien
gctcctttcccagtttgatttcaat

SEQ ID NO: 544732 - DNA, 25 bp, Homo sapien
tcctttcccagtttgatttcaataa

SEQ ID NO: 544733 - DNA, 25 bp, Homo sapien
tttcaataaatctgtccactcccct

SEQ ID NO: 544734 - DNA, 25 bp, Homo sapien
aataaatctgtccactccccttttg

SEQ ID NO: 544735 - DNA, 25 bp, Homo sapien
aatctgtccactccccttttgtggg

SEQ ID NO: 544736 - DNA, 25 bp, Homo sapien
taagcagttcgcgcgttacggcgcc

SEQ ID NO: 544737 - DNA, 25 bp, Homo sapien
ttcgttatggccgtcgccggagcag

SEQ ID NO: 544738 - DNA, 25 bp, Homo sapien
aagaacgcgaatggtacccgagcct

SEQ ID NO: 544739 - DNA, 25 bp, Homo sapien
gaatggtacccgagcctggcgacca

SEQ ID NO: 544740 - DNA, 25 bp, Homo sapien
agcctggcgaccatgcaggagtcgc

SEQ ID NO: 544741 - DNA, 25 bp, Homo sapien
cagctggccgaagagcagaagcgtc

SEQ ID NO: 544742 - DNA, 25 bp, Homo sapien
gggagcagcacatcgcagagtgcat

SEQ ID NO: 544743 - DNA, 25 bp, Homo sapien
cacatcgcagagtgcatggccaaga

SEQ ID NO: 544744 - DNA, 25 bp, Homo sapien
gagtgcatggccaagatgccacaga

SEQ ID NO: 544745 - DNA, 25 bp, Homo sapien
ggccaagatgccacagatgattgtg

SEQ ID NO: 544746 - DNA, 25 bp, Homo sapien
agatgattgtgaactggcagcagca

SEQ ID NO: 544747 - DNA, 25 bp, Homo sapien
aatcagatggatcaaactttgtgtt

SEQ ID NO: 544748 - DNA, 25 bp, Homo sapien
tcaaagtcagcattttggaagtggt

SEQ ID NO: 544749 - DNA, 25 bp, Homo sapien
ggaagtggtactttcatagattttt

SEQ ID NO: 544750 - DNA, 25 bp, Homo sapien
aattccataatgtgccttatctttt

SEQ ID NO: 544751 - DNA, 25 bp, Homo sapien
gtgccttatcttttcattgcaggat

SEQ ID NO: 544752 - DNA, 25 bp, Homo sapien
ttttcattgcaggatgacagaccaa

SEQ ID NO: 544753 - DNA, 25 bp, Homo sapien
gacagaccaaagttaaacaagcctc

SEQ ID NO: 544754 - DNA, 25 bp, Homo sapien
aacaagcctccggaaactcttatca

SEQ ID NO: 544755 - DNA, 25 bp, Homo sapien
tattgattctagttccagttggtgg

SEQ ID NO: 544756 - DNA, 25 bp, Homo sapien
ctgcagtggccgtcgccttgatgta

SEQ ID NO: 544757 - DNA, 25 bp, Homo sapien
ggccgtcgccttgatgtatcgccta

SEQ ID NO: 544758 - DNA, 25 bp, Homo sapien
accagggcacagagctctttagaca

SEQ ID NO: 544759 - DNA, 25 bp, Homo sapien
aagatgcaatctgaaaggtggcgat

SEQ ID NO: 544760 - DNA, 25 bp, Homo sapien
gaacagcacgaaggccgcatagcac

SEQ ID NO: 544761 - DNA, 25 bp, Homo sapien
gtgtgcgccagaaggaagaccagcc

SEQ ID NO: 544762 - DNA, 25 bp, Homo sapien
ggccccgcacgtccgagacaatgaa

SEQ ID NO: 544763 - DNA, 25 bp, Homo sapien
tgacgcccgcgatgagcagcttgga

SEQ ID NO: 544764 - DNA, 25 bp, Homo sapien
gatgagcagcttggaccagcgcgcc

SEQ ID NO: 544765 - DNA, 25 bp, Homo sapien
atgatggtcttgacgatggtggcaa

SEQ ID NO: 544766 - DNA, 25 bp, Homo sapien
gtggcaaagaacgtgttgaccccga

SEQ ID NO: 544767 - DNA, 25 bp, Homo sapien
agaacgtgttgaccccgaagaccag

SEQ ID NO: 544768 - DNA, 25 bp, Homo sapien
gaagaccagggcacagagctcttta

SEQ ID NO: 544769 - DNA, 25 bp, Homo sapien
gagaaagcatcggagccattcattc

SEQ ID NO: 544770 - DNA, 25 bp, Homo sapien
gcatcggagccattcattcggagaa

SEQ ID NO: 544771 - DNA, 25 bp, Homo sapien
gccattcattcggagaaaacgtttt

SEQ ID NO: 544772 - DNA, 25 bp, Homo sapien
atggagacttttgtagtcgtttcaa

SEQ ID NO: 544773 - DNA, 25 bp, Homo sapien
gtcgtttcaaaagagcacctgagtc

SEQ ID NO: 544774 - DNA, 25 bp, Homo sapien
gcacctgagtcatgtgtattcccgg

SEQ ID NO: 544775 - DNA, 25 bp, Homo sapien
tgacccggtcaagttggtttcaaag

SEQ ID NO: 544776 - DNA, 25 bp, Homo sapien
cgacaggcttgtctgtttactagct

SEQ ID NO: 544777 - DNA, 25 bp, Homo sapien
tttactagctgcgtggccttggacg

SEQ ID NO: 544778 - DNA, 25 bp, Homo sapien
ctgtaaagaatcctcctgtgatgaa

SEQ ID NO: 544779 - DNA, 25 bp, Homo sapien
aagaatcctcctgtgatgaaactga

SEQ ID NO: 544780 - DNA, 25 bp, Homo sapien
gatgacagaccaaagttaaacaagc

SEQ ID NO: 544781 - DNA, 25 bp, Homo sapien
atgacagaccaaagttaaacaagcc

SEQ ID NO: 544782 - DNA, 25 bp, Homo sapien
atcactactattgattctagttcca

SEQ ID NO: 544783 - DNA, 25 bp, Homo sapien
cactactattgattctagttccagt

SEQ ID NO: 544784 - DNA, 25 bp, Homo sapien
tactattgattctagttccagttgg

SEQ ID NO: 544785 - DNA, 25 bp, Homo sapien
ctattgattctagttccagttggtg

SEQ ID NO: 544786 - DNA, 25 bp, Homo sapien
tattgattctagttccagttggtgg

SEQ ID NO: 544787 - DNA, 25 bp, Homo sapien
attgattctagttccagttggtgga

SEQ ID NO: 544788 - DNA, 25 bp, Homo sapien
tctgcagtggccgtcgccttgatgt

SEQ ID NO: 544789 - DNA, 25 bp, Homo sapien
ctgcagtggccgtcgccttgatgta

SEQ ID NO: 544790 - DNA, 25 bp, Homo sapien
ggccgtcgccttgatgtatcgccta

SEQ ID NO: 544791 - DNA, 25 bp, Homo sapien
tctctggccctgtccatgtgacttt

SEQ ID NO: 544792 - DNA, 25 bp, Homo sapien
ccatgtgactttggcccttggtttt

SEQ ID NO: 544793 - DNA, 25 bp, Homo sapien
ttctttccagattggaggtttccaa

SEQ ID NO: 544794 - DNA, 25 bp, Homo sapien
cagattggaggtttccaagaggccc

SEQ ID NO: 544795 - DNA, 25 bp, Homo sapien
caccgtggaagtaaccaagggcgct

SEQ ID NO: 544796 - DNA, 25 bp, Homo sapien
ggaagtaaccaagggcgcttccttg

SEQ ID NO: 544797 - DNA, 25 bp, Homo sapien
accaagggcgcttccttgtgggcag

SEQ ID NO: 544798 - DNA, 25 bp, Homo sapien
agctgctcctttcccagtttgattt

SEQ ID NO: 544799 - DNA, 25 bp, Homo sapien
gctcctttcccagtttgatttcaat

SEQ ID NO: 544800 - DNA, 25 bp, Homo sapien
tttcaataaatctgtccactcccct

SEQ ID NO: 544801 - DNA, 25 bp, Homo sapien
aaatctgtccactccccttttgtgg

SEQ ID NO: 544802 - DNA, 25 bp, Homo sapien
gaattacttctatagctatatttta

SEQ ID NO: 544803 - DNA, 25 bp, Homo sapien
gaagtgattgtttctcaaaatcgca

SEQ ID NO: 544804 - DNA, 25 bp, Homo sapien
gattgtttctcaaaatcgcatttta

SEQ ID NO: 544805 - DNA, 25 bp, Homo sapien
gacgttttatggtacttgttggaat

SEQ ID NO: 544806 - DNA, 25 bp, Homo sapien
tggtacttgttggaattgggactta

SEQ ID NO: 544807 - DNA, 25 bp, Homo sapien
gaaactgggataattttctgaactt

SEQ ID NO: 544808 - DNA, 25 bp, Homo sapien
actttgacatttaacacttgggaca

SEQ ID NO: 544809 - DNA, 25 bp, Homo sapien
gacatttaacacttgggacaacatt

SEQ ID NO: 544810 - DNA, 25 bp, Homo sapien
cacttgggacaacatttattataaa

SEQ ID NO: 544811 - DNA, 25 bp, Homo sapien
agaggtttgtctacccacagtgtca

SEQ ID NO: 544812 - DNA, 25 bp, Homo sapien
ttgtctacccacagtgtcatggaat

SEQ ID NO: 544813 - DNA, 25 bp, Homo sapien
aaatagggacatttgcaagaccttt

SEQ ID NO: 544814 - DNA, 25 bp, Homo sapien
gacatttgcaagaccttttccattt

SEQ ID NO: 544815 - DNA, 25 bp, Homo sapien
gaccttttccatttaatcatcagtt

SEQ ID NO: 544816 - DNA, 25 bp, Homo sapien
aaaaatcatgcttttggtacagtgt

SEQ ID NO: 544817 - DNA, 25 bp, Homo sapien
agtgttcatgtaccataactgtatt

SEQ ID NO: 544818 - DNA, 25 bp, Homo sapien
gtaccataactgtattggaatattt

SEQ ID NO: 544819 - DNA, 25 bp, Homo sapien
gtgtgatgggtttgattgtgcaaac

SEQ ID NO: 544820 - DNA, 25 bp, Homo sapien
gattgtgcaaacagatttagtagtt

SEQ ID NO: 544821 - DNA, 25 bp, Homo sapien
tagtagttatgtgatttaggctttt

SEQ ID NO: 544822 - DNA, 25 bp, Homo sapien
atgtgatttaggcttttgtagttaa

SEQ ID NO: 544823 - DNA, 25 bp, Homo sapien
gttaaatggagtttctgtcttcaaa

SEQ ID NO: 544824 - DNA, 25 bp, Homo sapien
tggagctcgagccttgacaaacatc

SEQ ID NO: 544825 - DNA, 25 bp, Homo sapien
gacaaacatcaaagatcccacttag

SEQ ID NO: 544826 - DNA, 25 bp, Homo sapien
gaagccctttcaatagccagtaacc

SEQ ID NO: 544827 - DNA, 25 bp, Homo sapien
agcccagtcacaaaaatactcagct

SEQ ID NO: 544828 - DNA, 25 bp, Homo sapien
tactcagctccatcaagaggaattg

SEQ ID NO: 544829 - DNA, 25 bp, Homo sapien
aattgtgtctaagaggatacccctg

SEQ ID NO: 544830 - DNA, 25 bp, Homo sapien
gaggatacccctgttaatctccttt

SEQ ID NO: 544831 - DNA, 25 bp, Homo sapien
atctggacatggctttggacttgga

SEQ ID NO: 544832 - DNA, 25 bp, Homo sapien
ggatatcttggattggattgcacaa

SEQ ID NO: 544833 - DNA, 25 bp, Homo sapien
ggattgcacaatggcttaaattctt

SEQ ID NO: 544834 - DNA, 25 bp, Homo sapien
aattcttgattctgcctcaggagaa

SEQ ID NO: 544835 - DNA, 25 bp, Homo sapien
taaaaatttatattgcctctgccaa

SEQ ID NO: 544836 - DNA, 25 bp, Homo sapien
tgcctctgccaaacaggcctaatag

SEQ ID NO: 544837 - DNA, 25 bp, Homo sapien
gcaagttgagacaaaccaggcagat

SEQ ID NO: 544838 - DNA, 25 bp, Homo sapien
gacaaaccaggcagattcagtgtgt

SEQ ID NO: 544839 - DNA, 25 bp, Homo sapien
atagggagacagcagccttaatcta

SEQ ID NO: 544840 - DNA, 25 bp, Homo sapien
atctacataattcttcatctcgcca

SEQ ID NO: 544841 - DNA, 25 bp, Homo sapien
ataattcttcatctcgccaattcag

SEQ ID NO: 544842 - DNA, 25 bp, Homo sapien
attcagccgcagcctttaaagagtt

SEQ ID NO: 544843 - DNA, 25 bp, Homo sapien
gttagtgttaatggctttctggttt

SEQ ID NO: 544844 - DNA, 25 bp, Homo sapien
aaatgcatctatgtggttgaaagtt

SEQ ID NO: 544845 - DNA, 25 bp, Homo sapien
aagtttgggaggagattcaccaata

SEQ ID NO: 544846 - DNA, 25 bp, Homo sapien
ggaaactggccccatagcagccata

SEQ ID NO: 544847 - DNA, 25 bp, Homo sapien
tggccccatagcagccatacctgga

SEQ ID NO: 544848 - DNA, 25 bp, Homo sapien
agccatacctggagctggatctgac

SEQ ID NO: 544849 - DNA, 25 bp, Homo sapien
catacctggagctggatctgaccct

SEQ ID NO: 544850 - DNA, 25 bp, Homo sapien
agtgctgagccttgggagcccctgc

SEQ ID NO: 544851 - DNA, 25 bp, Homo sapien
acctgcacctgtggacagtggccaa

SEQ ID NO: 544852 - DNA, 25 bp, Homo sapien
cctgtggacagtggccaacaggctc

SEQ ID NO: 544853 - DNA, 25 bp, Homo sapien
ccttcccagtgaaagagacgttgtg

SEQ ID NO: 544854 - DNA, 25 bp, Homo sapien
ggccgtcctgccaaaaacaagagga

SEQ ID NO: 544855 - DNA, 25 bp, Homo sapien
acaagaggaggaaactggccccata

SEQ ID NO: 544856 - DNA, 25 bp, Homo sapien
gaggaggaaactggccccatagcag

SEQ ID NO: 544857 - DNA, 25 bp, Homo sapien
tggacagatggacacacagagcctc

SEQ ID NO: 544858 - DNA, 25 bp, Homo sapien
agatggacacacagagcctcggcgg

SEQ ID NO: 544859 - DNA, 25 bp, Homo sapien
gccactgctggcacggtgtgagcgc

SEQ ID NO: 544860 - DNA, 25 bp, Homo sapien
ggtgtgagcgccaggcatctcccac

SEQ ID NO: 544861 - DNA, 25 bp, Homo sapien
acggaaccgagatgcactttagacc

SEQ ID NO: 544862 - DNA, 25 bp, Homo sapien
agatgcactttagaccagggagctg

SEQ ID NO: 544863 - DNA, 25 bp, Homo sapien
actaacttattttgcccggctgagg

SEQ ID NO: 544864 - DNA, 25 bp, Homo sapien
gggtgcacgattccctcagctctgg

SEQ ID NO: 544865 - DNA, 25 bp, Homo sapien
gattccctcagctctgggtttaatg

SEQ ID NO: 544866 - DNA, 25 bp, Homo sapien
ctcagctctgggtttaatgtattat

SEQ ID NO: 544867 - DNA, 25 bp, Homo sapien
gacagtgccccaataaagggtcaga

SEQ ID NO: 544868 - DNA, 25 bp, Homo sapien
gagcaccccctccaggcatgatggg

SEQ ID NO: 544869 - DNA, 25 bp, Homo sapien
tgggcccacctcctggtatgagacc

SEQ ID NO: 544870 - DNA, 25 bp, Homo sapien
gggcccacctcctggtatgagacct

SEQ ID NO: 544871 - DNA, 25 bp, Homo sapien
acctcctggtatgagacctcctatg

SEQ ID NO: 544872 - DNA, 25 bp, Homo sapien
ctcctggtatgagacctcctatggg

SEQ ID NO: 544873 - DNA, 25 bp, Homo sapien
tcctggtatgagacctcctatgggt

SEQ ID NO: 544874 - DNA, 25 bp, Homo sapien
ctggtatgagacctcctatgggtcc

SEQ ID NO: 544875 - DNA, 25 bp, Homo sapien
ggaagagggactccaatgggcatgc

SEQ ID NO: 544876 - DNA, 25 bp, Homo sapien
gggaatgcgcccaccaaggccctag

SEQ ID NO: 544877 - DNA, 25 bp, Homo sapien
ggaatgcgcccaccaaggccctaga

SEQ ID NO: 544878 - DNA, 25 bp, Homo sapien
caccaaggccctagactcatcttgg

SEQ ID NO: 544879 - DNA, 25 bp, Homo sapien
tgtttcggttggtaagttcttccag

SEQ ID NO: 544880 - DNA, 25 bp, Homo sapien
acctgcagcagttcaggatgactaa

SEQ ID NO: 544881 - DNA, 25 bp, Homo sapien
gcagcagttcaggatgactaatgaa

SEQ ID NO: 544882 - DNA, 25 bp, Homo sapien
aagcaattagcttgaacatttagaa

SEQ ID NO: 544883 - DNA, 25 bp, Homo sapien
ttctgtgccttctaattcctgcatc

SEQ ID NO: 544884 - DNA, 25 bp, Homo sapien
ttctaattcctgcatcctgttcaaa

SEQ ID NO: 544885 - DNA, 25 bp, Homo sapien
ctaattcctgcatcctgttcaaaac

SEQ ID NO: 544886 - DNA, 25 bp, Homo sapien
attcctgcatcctgttcaaaacatc

SEQ ID NO: 544887 - DNA, 25 bp, Homo sapien
gttcaaaacatctttccagacatta

SEQ ID NO: 544888 - DNA, 25 bp, Homo sapien
aaaacatctttccagacattaactt

SEQ ID NO: 544889 - DNA, 25 bp, Homo sapien
ttacacattgtataaaaccgaccaa

SEQ ID NO: 544890 - DNA, 25 bp, Homo sapien
caatctttacgtgaaaatccccact

SEQ ID NO: 544891 - DNA, 25 bp, Homo sapien
gaaaatccccactaatagtgccaca

SEQ ID NO: 544892 - DNA, 25 bp, Homo sapien
agtgccacaataatttctatagaaa

SEQ ID NO: 544893 - DNA, 25 bp, Homo sapien
aagacggttcttcattgtgtcagga

SEQ ID NO: 544894 - DNA, 25 bp, Homo sapien
gtgtcaggatgacctttcatatcat

SEQ ID NO: 544895 - DNA, 25 bp, Homo sapien
tgacctttcatatcattctcaccaa

SEQ ID NO: 544896 - DNA, 25 bp, Homo sapien
attctcaccaacttgtagtgcccac

SEQ ID NO: 544897 - DNA, 25 bp, Homo sapien
gtagtgcccaccgttatttgtaact

SEQ ID NO: 544898 - DNA, 25 bp, Homo sapien
gtatgtttgtaaccagcattgtgat

SEQ ID NO: 544899 - DNA, 25 bp, Homo sapien
gtgatatattctgtacttgtattgc

SEQ ID NO: 544900 - DNA, 25 bp, Homo sapien
gacctaataaatatagtgttcctgc

SEQ ID NO: 544901 - DNA, 25 bp, Homo sapien
tggagagagttggatttcccagacc

SEQ ID NO: 544902 - DNA, 25 bp, Homo sapien
ggagagagttggatttcccagaccc

SEQ ID NO: 544903 - DNA, 25 bp, Homo sapien
gagagttggatttcccagacccctg

SEQ ID NO: 544904 - DNA, 25 bp, Homo sapien
agagttggatttcccagacccctga

SEQ ID NO: 544905 - DNA, 25 bp, Homo sapien
gggactgtggcactggacgtggctg

SEQ ID NO: 544906 - DNA, 25 bp, Homo sapien
ggcactggacgtggctggagcaggt

SEQ ID NO: 544907 - DNA, 25 bp, Homo sapien
ggcatccacatctgctttatcccta

SEQ ID NO: 544908 - DNA, 25 bp, Homo sapien
acatctgctttatccctagcggaag

SEQ ID NO: 544909 - DNA, 25 bp, Homo sapien
catctgctttatccctagcggaaga

SEQ ID NO: 544910 - DNA, 25 bp, Homo sapien
tctgctttatccctagcggaagagt

SEQ ID NO: 544911 - DNA, 25 bp, Homo sapien
gctttatccctagcggaagagtgag

SEQ ID NO: 544912 - DNA, 25 bp, Homo sapien
aaccaagtggagacacagcagctgt

SEQ ID NO: 544913 - DNA, 25 bp, Homo sapien
acagcagctgtatttgaagaaggtg

SEQ ID NO: 544914 - DNA, 25 bp, Homo sapien
ggtgatgtggacgatttattggaca

SEQ ID NO: 544915 - DNA, 25 bp, Homo sapien
gggaatctaagagagctgccatcgc

SEQ ID NO: 544916 - DNA, 25 bp, Homo sapien
aagagagctgccatcgctgtgatgc

SEQ ID NO: 544917 - DNA, 25 bp, Homo sapien
atcgctgtgatgctgggagttctaa

SEQ ID NO: 544918 - DNA, 25 bp, Homo sapien
gatgctgggagttctaacaaaacaa

SEQ ID NO: 544919 - DNA, 25 bp, Homo sapien
aaacaagttggatgcggccattcaa

SEQ ID NO: 544920 - DNA, 25 bp, Homo sapien
tcaagaaattcccagcaggttacct

SEQ ID NO: 544921 - DNA, 25 bp, Homo sapien
caggttacctggaggcggatcatct

SEQ ID NO: 544922 - DNA, 25 bp, Homo sapien
gcggatcatctaattctctgtggaa

SEQ ID NO: 544923 - DNA, 25 bp, Homo sapien
tccagtgggaatcagaacaggtcag

SEQ ID NO: 544924 - DNA, 25 bp, Homo sapien
aagccagagcaggtgggcgcatctc

SEQ ID NO: 544925 - DNA, 25 bp, Homo sapien
gcaggtgggcgcatctcccaggaaa

SEQ ID NO: 544926 - DNA, 25 bp, Homo sapien
tcccaggaaaccctgcatcattctt

SEQ ID NO: 544927 - DNA, 25 bp, Homo sapien
tgcatcattctttcctggtgattct

SEQ ID NO: 544928 - DNA, 25 bp, Homo sapien
ctttgttatggttcacatgagtcta

SEQ ID NO: 544929 - DNA, 25 bp, Homo sapien
gagtctatggagtgctcattctaca

SEQ ID NO: 544930 - DNA, 25 bp, Homo sapien
tacattctccgttcttatcttcatc

SEQ ID NO: 544931 - DNA, 25 bp, Homo sapien
aacaggtcaggcagtctcctctttg

SEQ ID NO: 544932 - DNA, 25 bp, Homo sapien
catcctatgcaactttagaccgcta

SEQ ID NO: 544933 - DNA, 25 bp, Homo sapien
ccagatttcatttggctttgggatc

SEQ ID NO: 544934 - DNA, 25 bp, Homo sapien
gtcaccatggtgttccacggttggg

SEQ ID NO: 544935 - DNA, 25 bp, Homo sapien
aggctggactgtgtggtagttttac

SEQ ID NO: 544936 - DNA, 25 bp, Homo sapien
gtagttttacagacatgatggtttc

SEQ ID NO: 544937 - DNA, 25 bp, Homo sapien
acagacatgatggtttccggtgacc

SEQ ID NO: 544938 - DNA, 25 bp, Homo sapien
gtttccggtgaccaggtgtctacaa

SEQ ID NO: 544939 - DNA, 25 bp, Homo sapien
ggtgaccaggtgtctacaaggacaa

SEQ ID NO: 544940 - DNA, 25 bp, Homo sapien
aggtgtctacaaggacaaggttcag

SEQ ID NO: 544941 - DNA, 25 bp, Homo sapien
tcagaaattgtacagccaactggaa

SEQ ID NO: 544942 - DNA, 25 bp, Homo sapien
attgtacagccaactggaaagatat

SEQ ID NO: 544943 - DNA, 25 bp, Homo sapien
taaaagtttgggtctgtctcctctc

SEQ ID NO: 544944 - DNA, 25 bp, Homo sapien
ctgtctcctctccttcagaaatgaa

SEQ ID NO: 544945 - DNA, 25 bp, Homo sapien
gttaggactcccatataatcttaaa

SEQ ID NO: 544946 - DNA, 25 bp, Homo sapien
aatgttcattttagttcatcccaaa

SEQ ID NO: 544947 - DNA, 25 bp, Homo sapien
tttagttcatcccaaacattctagg

SEQ ID NO: 544948 - DNA, 25 bp, Homo sapien
gacactctgagtagtatatatgcat

SEQ ID NO: 544949 - DNA, 25 bp, Homo sapien
acattctaggattagttgttctcaa

SEQ ID NO: 544950 - DNA, 25 bp, Homo sapien
gttgttctcaataaacctgacccat

SEQ ID NO: 544951 - DNA, 25 bp, Homo sapien
actatttaatgctccccagtagaca

SEQ ID NO: 544952 - DNA, 25 bp, Homo sapien
gtagacatccatctgtagctgctgg

SEQ ID NO: 544953 - DNA, 25 bp, Homo sapien
aacactttctatttgacactgctgg

SEQ ID NO: 544954 - DNA, 25 bp, Homo sapien
gggtccatagataccaaccatttct

SEQ ID NO: 544955 - DNA, 25 bp, Homo sapien
aatggtgggtgatcgttaggactcc

SEQ ID NO: 544956 - DNA, 25 bp, Homo sapien
agcgggccttctggctggacgtctc

SEQ ID NO: 544957 - DNA, 25 bp, Homo sapien
tggacgtctcgcacaaccgcctgga

SEQ ID NO: 544958 - DNA, 25 bp, Homo sapien
acaaccgcctggaggcattgcccaa

SEQ ID NO: 544959 - DNA, 25 bp, Homo sapien
gaggcattgcccaacagcctcttgg

SEQ ID NO: 544960 - DNA, 25 bp, Homo sapien
ggctgcgctacctcagcctcaggaa

SEQ ID NO: 544961 - DNA, 25 bp, Homo sapien
gcctcaggaacaactcactgcggac

SEQ ID NO: 544962 - DNA, 25 bp, Homo sapien
aggaacaactcactgcggaccttca

SEQ ID NO: 544963 - DNA, 25 bp, Homo sapien
gctggagggtaacccctgggactgt

SEQ ID NO: 544964 - DNA, 25 bp, Homo sapien
tgtggctgccctctcaaggcgctgc

SEQ ID NO: 544965 - DNA, 25 bp, Homo sapien
ctctcaaggcgctgcgggacttcgc

SEQ ID NO: 544966 - DNA, 25 bp, Homo sapien
gctgcgggacttcgccctgcagaac

SEQ ID NO: 544967 - DNA, 25 bp, Homo sapien
cgttccgggaagtgctgcgctgggc

SEQ ID NO: 544968 - DNA, 25 bp, Homo sapien
ggctctgacgcccagcaatctgttc

SEQ ID NO: 544969 - DNA, 25 bp, Homo sapien
cagcaatctgttcctgcttgcagtc

SEQ ID NO: 544970 - DNA, 25 bp, Homo sapien
atctgttcctgcttgcagtcctcgg

SEQ ID NO: 544971 - DNA, 25 bp, Homo sapien
tcgcatcagcgagtgcgacagtgtt

SEQ ID NO: 544972 - DNA, 25 bp, Homo sapien
ggatgttctttcgatggtactgcag

SEQ ID NO: 544973 - DNA, 25 bp, Homo sapien
ttctttcgatggtactgcagtggca

SEQ ID NO: 544974 - DNA, 25 bp, Homo sapien
gatggtactgcagtggcaactaaca

SEQ ID NO: 544975 - DNA, 25 bp, Homo sapien
gtggcaactaacaaaggtatctttc

SEQ ID NO: 544976 - DNA, 25 bp, Homo sapien
ttccctatcctatttccatcctgaa

SEQ ID NO: 544977 - DNA, 25 bp, Homo sapien
tatcctatttccatcctgaaaataa

SEQ ID NO: 544978 - DNA, 25 bp, Homo sapien
gaagctctcttatgttttatgtcca

SEQ ID NO: 544979 - DNA, 25 bp, Homo sapien
ttctgtgaccactagttactgtatc

SEQ ID NO: 544980 - DNA, 25 bp, Homo sapien
tatcagaactcatcaggtacccact

SEQ ID NO: 544981 - DNA, 25 bp, Homo sapien
aggtacccacttataaatagcactg

SEQ ID NO: 544982 - DNA, 25 bp, Homo sapien
atctggctgtatactgatccatcac

SEQ ID NO: 544983 - DNA, 25 bp, Homo sapien
gatccatcactaacctgttttctag

SEQ ID NO: 544984 - DNA, 25 bp, Homo sapien
tgttttctaggacccagcgtatgta

SEQ ID NO: 544985 - DNA, 25 bp, Homo sapien
ggacccagcgtatgtagcatttgta

SEQ ID NO: 544986 - DNA, 25 bp, Homo sapien
tccctggcttacttgtgttttgcac

SEQ ID NO: 544987 - DNA, 25 bp, Homo sapien
attttgacagggtaattgccacttt

SEQ ID NO: 544988 - DNA, 25 bp, Homo sapien
tgccactttacttgtgcaatactgc

SEQ ID NO: 544989 - DNA, 25 bp, Homo sapien
tacttgcagtttatgaagctgcccc

SEQ ID NO: 544990 - DNA, 25 bp, Homo sapien
ctcagttaattgcagtctaatgtca

SEQ ID NO: 544991 - DNA, 25 bp, Homo sapien
gcagtctaatgtcaagaggcacttc

SEQ ID NO: 544992 - DNA, 25 bp, Homo sapien
gaggcacttctttattaattaccaa

SEQ ID NO: 544993 - DNA, 25 bp, Homo sapien
accaaatagtctttgtgaccaagga

SEQ ID NO: 544994 - DNA, 25 bp, Homo sapien
gtgaccaaggactaacatttttaag

SEQ ID NO: 544995 - DNA, 25 bp, Homo sapien
ttaagttactcagctctatcctcat

SEQ ID NO: 544996 - DNA, 25 bp, Homo sapien
agctctatcctcatgggcctatata

SEQ ID NO: 544997 - DNA, 25 bp, Homo sapien
gggcctatatatttaatacctccaa

SEQ ID NO: 544998 - DNA, 25 bp, Homo sapien
tcaggataggctttgtatactttta

SEQ ID NO: 544999 - DNA, 25 bp, Homo sapien
gaatccagtggtatgtttgtggtat

SEQ ID NO: 545000 - DNA, 25 bp, Homo sapien
tcccaaggctgtgcgttcctgaggg

SEQ ID NO: 545001 - DNA, 25 bp, Homo sapien
caaggctgtgcgttcctgagggcca

SEQ ID NO: 545002 - DNA, 25 bp, Homo sapien
gaggaaaggcgtccctcttggccct

SEQ ID NO: 545003 - DNA, 25 bp, Homo sapien
cagagtggctttcctggcaccctgg

SEQ ID NO: 545004 - DNA, 25 bp, Homo sapien
tttcctggcaccctggcctgggtgt

SEQ ID NO: 545005 - DNA, 25 bp, Homo sapien
cttccccttgtgtttccagtcacct

SEQ ID NO: 545006 - DNA, 25 bp, Homo sapien
gctcagtgaccccacaggaagctta

SEQ ID NO: 545007 - DNA, 25 bp, Homo sapien
gaccccacaggaagcttacacattt

SEQ ID NO: 545008 - DNA, 25 bp, Homo sapien
cacaggaagcttacacattttctca

SEQ ID NO: 545009 - DNA, 25 bp, Homo sapien
acattttctcagaggcctttgtgct

SEQ ID NO: 545010 - DNA, 25 bp, Homo sapien
tttctcagaggcctttgtgctccca

SEQ ID NO: 545011 - DNA, 25 bp, Homo sapien
gcgcgctgcggtgctgctgggcgtg

SEQ ID NO: 545012 - DNA, 25 bp, Homo sapien
tcgtactcctacctggccgtgctgg

SEQ ID NO: 545013 - DNA, 25 bp, Homo sapien
tggtgcccgtgttcctgctcaccga

SEQ ID NO: 545014 - DNA, 25 bp, Homo sapien
tgcgctacacgccggtgctgctgct

SEQ ID NO: 545015 - DNA, 25 bp, Homo sapien
ctcagcttcgtgtcggtgtggctgc

SEQ ID NO: 545016 - DNA, 25 bp, Homo sapien
tgggccactcggtggcgcacatgca

SEQ ID NO: 545017 - DNA, 25 bp, Homo sapien
cggtggcgcacatgcagctcatgga

SEQ ID NO: 545018 - DNA, 25 bp, Homo sapien
agctcatggagctcttctacagcgt

SEQ ID NO: 545019 - DNA, 25 bp, Homo sapien
atggagctcttctacagcgtcacca

SEQ ID NO: 545020 - DNA, 25 bp, Homo sapien
gagctcttctacagcgtcaccatgg

SEQ ID NO: 545021 - DNA, 25 bp, Homo sapien
gcgctaccagcgtgtggccggctac

SEQ ID NO: 545022 - DNA, 25 bp, Homo sapien
aaataccactgcaaagtgatggaaa

SEQ ID NO: 545023 - DNA, 25 bp, Homo sapien
gaattctttatgaagtatcagtcag

SEQ ID NO: 545024 - DNA, 25 bp, Homo sapien
gggaagaatgtctgatactgatcta

SEQ ID NO: 545025 - DNA, 25 bp, Homo sapien
gtctgatactgatctattagagagg

SEQ ID NO: 545026 - DNA, 25 bp, Homo sapien
gagaggtactttagaggcttcttga

SEQ ID NO: 545027 - DNA, 25 bp, Homo sapien
ttagaggcttcttgattggcataaa

SEQ ID NO: 545028 - DNA, 25 bp, Homo sapien
ttgattggcataaagttcctaaggt

SEQ ID NO: 545029 - DNA, 25 bp, Homo sapien
ccccttttggctgtatagcaaagtg

SEQ ID NO: 545030 - DNA, 25 bp, Homo sapien
tagcaaagtgttttaatccacggtt

SEQ ID NO: 545031 - DNA, 25 bp, Homo sapien
gtgttttaatccacggttgtgcctt

SEQ ID NO: 545032 - DNA, 25 bp, Homo sapien
gttgtgccttattgttccattaaaa

SEQ ID NO: 545033 - DNA, 25 bp, Homo sapien
agcccctggacagctggtcatgctg

SEQ ID NO: 545034 - DNA, 25 bp, Homo sapien
ggacagctggtcatgctggccgctc

SEQ ID NO: 545035 - DNA, 25 bp, Homo sapien
tggccgctccggttggaccacgttg

SEQ ID NO: 545036 - DNA, 25 bp, Homo sapien
tggaccacgttgcataatcctcagt

SEQ ID NO: 545037 - DNA, 25 bp, Homo sapien
ataatcctcagtcgcatcatcacaa

SEQ ID NO: 545038 - DNA, 25 bp, Homo sapien
atcatcacaacgtctctgagcgttt

SEQ ID NO: 545039 - DNA, 25 bp, Homo sapien
caacgtctctgagcgttttgatggg

SEQ ID NO: 545040 - DNA, 25 bp, Homo sapien
gagtgtctcccatagaaaagcagtg

SEQ ID NO: 545041 - DNA, 25 bp, Homo sapien
gagaggcccagagggctctctttgc

SEQ ID NO: 545042 - DNA, 25 bp, Homo sapien
aaaagcagtggaggccccacagggc

SEQ ID NO: 545043 - DNA, 25 bp, Homo sapien
gccccacagggcaagtacaaaacag

SEQ ID NO: 545044 - DNA, 25 bp, Homo sapien
gaacagcggagagcggaacatcact

SEQ ID NO: 545045 - DNA, 25 bp, Homo sapien
gagagcggaacatcactcccctgct

SEQ ID NO: 545046 - DNA, 25 bp, Homo sapien
atggtggttcacaacgacaggctac

SEQ ID NO: 545047 - DNA, 25 bp, Homo sapien
aacgacaggctactgagcacccttt

SEQ ID NO: 545048 - DNA, 25 bp, Homo sapien
tactgagcacccttttcaacacgac

SEQ ID NO: 545049 - DNA, 25 bp, Homo sapien
aacacgaccaccatctctcaagtgg

SEQ ID NO: 545050 - DNA, 25 bp, Homo sapien
tcaagtggcccctggcgaggactag

SEQ ID NO: 545051 - DNA, 25 bp, Homo sapien
cctggcgaggactagcttctgacac

SEQ ID NO: 545052 - DNA, 25 bp, Homo sapien
gccccaaagtcttgggccttcatta

SEQ ID NO: 545053 - DNA, 25 bp, Homo sapien
gtcttgggccttcattaattctgtc

SEQ ID NO: 545054 - DNA, 25 bp, Homo sapien
gggccttcattaattctgtcaataa

SEQ ID NO: 545055 - DNA, 25 bp, Homo sapien
agagctcaagccaaacgcttctgtc

SEQ ID NO: 545056 - DNA, 25 bp, Homo sapien
aagccaaacgcttctgtcctctttc

SEQ ID NO: 545057 - DNA, 25 bp, Homo sapien
tctttccttctgcattaaccctttg

SEQ ID NO: 545058 - DNA, 25 bp, Homo sapien
tccttctgcattaaccctttgctga

SEQ ID NO: 545059 - DNA, 25 bp, Homo sapien
ggacagagcctgttttcatgtactg

SEQ ID NO: 545060 - DNA, 25 bp, Homo sapien
gcctgttttcatgtactgcaggtgg

SEQ ID NO: 545061 - DNA, 25 bp, Homo sapien
ctgacatgtttgctcttggttgatg

SEQ ID NO: 545062 - DNA, 25 bp, Homo sapien
tgctcttggttgatggagaaggtac

SEQ ID NO: 545063 - DNA, 25 bp, Homo sapien
gaagagttaggtgtctcatagtcac

SEQ ID NO: 545064 - DNA, 25 bp, Homo sapien
gttaggtgtctcatagtcactcata

SEQ ID NO: 545065 - DNA, 25 bp, Homo sapien
gtgtctcatagtcactcatagtggg

SEQ ID NO: 545066 - DNA, 25 bp, Homo sapien
tcatctgctttattcacataaatga

SEQ ID NO: 545067 - DNA, 25 bp, Homo sapien
gacacaaggaattaagtggcttcgt

SEQ ID NO: 545068 - DNA, 25 bp, Homo sapien
acaaggaattaagtggcttcgtcat

SEQ ID NO: 545069 - DNA, 25 bp, Homo sapien
caaagataatttattccaaaagcta

SEQ ID NO: 545070 - DNA, 25 bp, Homo sapien
gtgaccaccagaaagtaatcttaag

SEQ ID NO: 545071 - DNA, 25 bp, Homo sapien
accagaaagtaatcttaagccatct

SEQ ID NO: 545072 - DNA, 25 bp, Homo sapien
gaaagtaatcttaagccatctagat

SEQ ID NO: 545073 - DNA, 25 bp, Homo sapien
gtaatcttaagccatctagatgtca

SEQ ID NO: 545074 - DNA, 25 bp, Homo sapien
tcttaagccatctagatgtcacaat

SEQ ID NO: 545075 - DNA, 25 bp, Homo sapien
agccatctagatgtcacaattgaaa

SEQ ID NO: 545076 - DNA, 25 bp, Homo sapien
tagatgtcacaattgaaacaaactg

SEQ ID NO: 545077 - DNA, 25 bp, Homo sapien
ggatatgatgaccaatagccatttt

SEQ ID NO: 545078 - DNA, 25 bp, Homo sapien
agccattttttctagtccactgtca

SEQ ID NO: 545079 - DNA, 25 bp, Homo sapien
tgtcagaatctctcattgctttcct

SEQ ID NO: 545080 - DNA, 25 bp, Homo sapien
tcattgctttcctggtttcctttat

SEQ ID NO: 545081 - DNA, 25 bp, Homo sapien
tggtttcctttattcctcctggagc

SEQ ID NO: 545082 - DNA, 25 bp, Homo sapien
cgacgagtttgagttgaggcctgaa

SEQ ID NO: 545083 - DNA, 25 bp, Homo sapien
aaacctttggcggttcatctcctat

SEQ ID NO: 545084 - DNA, 25 bp, Homo sapien
ggcggttcatctcctattttggaat

SEQ ID NO: 545085 - DNA, 25 bp, Homo sapien
atgaatgtccatttggatccactga

SEQ ID NO: 545086 - DNA, 25 bp, Homo sapien
gatccactgaaagttgaccgaagtt

SEQ ID NO: 545087 - DNA, 25 bp, Homo sapien
gacaccatttggtccattgtctgga

SEQ ID NO: 545088 - DNA, 25 bp, Homo sapien
ctgcgcgcccttcagtaggtgaaaa

SEQ ID NO: 545089 - DNA, 25 bp, Homo sapien
ttggagatgctggactcgagccagt

SEQ ID NO: 545090 - DNA, 25 bp, Homo sapien
tcgagccagtctcccgagatcatct

SEQ ID NO: 545091 - DNA, 25 bp, Homo sapien
tcacctcgggcgtgcagtagtccgg

SEQ ID NO: 545092 - DNA, 25 bp, Homo sapien
agtagtccgggaactcgaagtgcga

SEQ ID NO: 545093 - DNA, 25 bp, Homo sapien
agccgggctcgaagttaaaatccag

SEQ ID NO: 545094 - DNA, 25 bp, Homo sapien
ttaaaatccaggtcccggtcgagcg

SEQ ID NO: 545095 - DNA, 25 bp, Homo sapien
ggtcgagcgccgacgacgaactgaa

SEQ ID NO: 545096 - DNA, 25 bp, Homo sapien
acgacgaactgaagctgcccaggga

SEQ ID NO: 545097 - DNA, 25 bp, Homo sapien
ttctctttaaactcttcgtctgtcc

SEQ ID NO: 545098 - DNA, 25 bp, Homo sapien
taaactcttcgtctgtccttttcgt

SEQ ID NO: 545099 - DNA, 25 bp, Homo sapien
tacctggtagagcatgtaccatctt

SEQ ID NO: 545100 - DNA, 25 bp, Homo sapien
gtaccatcttacatgcttaaataac

SEQ ID NO: 545101 - DNA, 25 bp, Homo sapien
tacatgcttaaataactccacattt

SEQ ID NO: 545102 - DNA, 25 bp, Homo sapien
atttgtgtttattactctgtgttat

SEQ ID NO: 545103 - DNA, 25 bp, Homo sapien
ctttgtcctgtaactaccactgaaa

SEQ ID NO: 545104 - DNA, 25 bp, Homo sapien
gtcctgtaactaccactgaaagggt

SEQ ID NO: 545105 - DNA, 25 bp, Homo sapien
gtaactaccactgaaagggtgcaat

SEQ ID NO: 545106 - DNA, 25 bp, Homo sapien
aagggtgcaatacagctttcttgaa

SEQ ID NO: 545107 - DNA, 25 bp, Homo sapien
ggtgcaatacagctttcttgaaatg

SEQ ID NO: 545108 - DNA, 25 bp, Homo sapien
tcttgaaatgtgtattgaacggatg

SEQ ID NO: 545109 - DNA, 25 bp, Homo sapien
tttgtaaatttctgcttattcttag

SEQ ID NO: 545110 - DNA, 25 bp, Homo sapien
agccatgtccgaggagaagcccaag

SEQ ID NO: 545111 - DNA, 25 bp, Homo sapien
gagaatgaccacatcaacctgaagg

SEQ ID NO: 545112 - DNA, 25 bp, Homo sapien
aggacggctccgtggtgcagttcaa

SEQ ID NO: 545113 - DNA, 25 bp, Homo sapien
ggctccgtggtgcagttcaagatca

SEQ ID NO: 545114 - DNA, 25 bp, Homo sapien
gcagttcaagatcaagaggcacacg

SEQ ID NO: 545115 - DNA, 25 bp, Homo sapien
cctactgcgagaggcagggcttgtc

SEQ ID NO: 545116 - DNA, 25 bp, Homo sapien
atcagattcaggttcgacgggcagc

SEQ ID NO: 545117 - DNA, 25 bp, Homo sapien
gattcaggttcgacgggcagccaat

SEQ ID NO: 545118 - DNA, 25 bp, Homo sapien
tgaaactgacactccagcacagctg

SEQ ID NO: 545119 - DNA, 25 bp, Homo sapien
tggaggacgaggacaccatcgacgt

SEQ ID NO: 545120 - DNA, 25 bp, Homo sapien
ggacaccatcgacgtgttccagcag

SEQ ID NO: 545121 - DNA, 25 bp, Homo sapien
gtagctgtgctatgtgtttccagat

SEQ ID NO: 545122 - DNA, 25 bp, Homo sapien
atgtgtttccagatctgcttattgt

SEQ ID NO: 545123 - DNA, 25 bp, Homo sapien
cagatctgcttattgtttgggttca

SEQ ID NO: 545124 - DNA, 25 bp, Homo sapien
gtttgggttcaagccaccccagagg

SEQ ID NO: 545125 - DNA, 25 bp, Homo sapien
accccagaggattccttgctatgaa

SEQ ID NO: 545126 - DNA, 25 bp, Homo sapien
ccttgctatgaaaatgcggcatttg

SEQ ID NO: 545127 - DNA, 25 bp, Homo sapien
tttgaatgcaatgggttttcatgtg

SEQ ID NO: 545128 - DNA, 25 bp, Homo sapien
caataactgggagatggacaaacta

SEQ ID NO: 545129 - DNA, 25 bp, Homo sapien
atctattcagtagaagctcttcctg

SEQ ID NO: 545130 - DNA, 25 bp, Homo sapien
tcagtagaagctcttcctgttgctg

SEQ ID NO: 545131 - DNA, 25 bp, Homo sapien
aaccttttcatattaggagacatgc

SEQ ID NO: 545132 - DNA, 25 bp, Homo sapien
atttggccatctcctggttatatac

SEQ ID NO: 545133 - DNA, 25 bp, Homo sapien
ttggccatctcctggttatatacaa

SEQ ID NO: 545134 - DNA, 25 bp, Homo sapien
gccatctcctggttatatacaaatg

SEQ ID NO: 545135 - DNA, 25 bp, Homo sapien
gttatatacaaatgtgacccgtgat

SEQ ID NO: 545136 - DNA, 25 bp, Homo sapien
tatacaaatgtgacccgtgataatg

SEQ ID NO: 545137 - DNA, 25 bp, Homo sapien
gtgacccgtgataatgtgattgaac

SEQ ID NO: 545138 - DNA, 25 bp, Homo sapien
gacccgtgataatgtgattgaacac

SEQ ID NO: 545139 - DNA, 25 bp, Homo sapien
gtgattgaacactttagtaatgcaa

SEQ ID NO: 545140 - DNA, 25 bp, Homo sapien
taaaaacctgtagcgattcgttaca

SEQ ID NO: 545141 - DNA, 25 bp, Homo sapien
aaacctgtagcgattcgttacactg

SEQ ID NO: 545142 - DNA, 25 bp, Homo sapien
acctgtagcgattcgttacactggg

SEQ ID NO: 545143 - DNA, 25 bp, Homo sapien
gagcaagatgtacccgcagaccaga

SEQ ID NO: 545144 - DNA, 25 bp, Homo sapien
atcagcctgctcaaccctttaaatt

SEQ ID NO: 545145 - DNA, 25 bp, Homo sapien
gcctgctcaaccctttaaatttaca

SEQ ID NO: 545146 - DNA, 25 bp, Homo sapien
aatttacaatttccgaatcctgtga

SEQ ID NO: 545147 - DNA, 25 bp, Homo sapien
atttccgaatcctgtgatcggatta

SEQ ID NO: 545148 - DNA, 25 bp, Homo sapien
gtttcagtttttacaggctcaatac

SEQ ID NO: 545149 - DNA, 25 bp, Homo sapien
tcagtttttacaggctcaataccac

SEQ ID NO: 545150 - DNA, 25 bp, Homo sapien
ggaatgtgagaaactcgccagtgag

SEQ ID NO: 545151 - DNA, 25 bp, Homo sapien
gacagagatgcagcggcattatgtc

SEQ ID NO: 545152 - DNA, 25 bp, Homo sapien
atgattcgcgacctgagcaagatgt

SEQ ID NO: 545153 - DNA, 25 bp, Homo sapien
ttcgcgacctgagcaagatgtaccc

SEQ ID NO: 545154 - DNA, 25 bp, Homo sapien
aaagtcattggtctgagactcttaa

SEQ ID NO: 545155 - DNA, 25 bp, Homo sapien
tctgagactcttaagtggaagcagc

SEQ ID NO: 545156 - DNA, 25 bp, Homo sapien
agcagcagatgctttgggtggtcat

SEQ ID NO: 545157 - DNA, 25 bp, Homo sapien
ttgggtggtcatgttcagccagtac

SEQ ID NO: 545158 - DNA, 25 bp, Homo sapien
atgttcagccagtaccatcgtcttt

SEQ ID NO: 545159 - DNA, 25 bp, Homo sapien
agtaccatcgtctttccattatcct

SEQ ID NO: 545160 - DNA, 25 bp, Homo sapien
tcctctgttctggaaactgggagag

SEQ ID NO: 545161 - DNA, 25 bp, Homo sapien
ggagagatggtctcactatcccctt

SEQ ID NO: 545162 - DNA, 25 bp, Homo sapien
agaaatagtggcaggatgtcattcc

SEQ ID NO: 545163 - DNA, 25 bp, Homo sapien
aggatgtcattccatctcattctct

SEQ ID NO: 545164 - DNA, 25 bp, Homo sapien
tctcttctttctcctcaaataaatg

SEQ ID NO: 545165 - DNA, 25 bp, Homo sapien
tggcgtctgcttgcccttctgagtc

SEQ ID NO: 545166 - DNA, 25 bp, Homo sapien
gagtctgccttttttgcactgaaca

SEQ ID NO: 545167 - DNA, 25 bp, Homo sapien
ttgcactgaacataagcactttata

SEQ ID NO: 545168 - DNA, 25 bp, Homo sapien
agcactttatactaatgggtcacaa

SEQ ID NO: 545169 - DNA, 25 bp, Homo sapien
gggtcacaaatcttgcagcccttaa

SEQ ID NO: 545170 - DNA, 25 bp, Homo sapien
gcagcccttaatttgggataagacc

SEQ ID NO: 545171 - DNA, 25 bp, Homo sapien
ggataagaccagattttcctgacat

SEQ ID NO: 545172 - DNA, 25 bp, Homo sapien
ttcctctaactcattgaactatcaa

SEQ ID NO: 545173 - DNA, 25 bp, Homo sapien
aggcaaccactgactagactgatat

SEQ ID NO: 545174 - DNA, 25 bp, Homo sapien
accaaaacagatacccatgttgagg

SEQ ID NO: 545175 - DNA, 25 bp, Homo sapien
gttttactacaaacaagccacaata

SEQ ID NO: 545176 - DNA, 25 bp, Homo sapien
atgatgtccatgatgtggcgctgct

SEQ ID NO: 545177 - DNA, 25 bp, Homo sapien
tggcgctgctggatgttcgtcagtt

SEQ ID NO: 545178 - DNA, 25 bp, Homo sapien
atgttcgtcagtttggattccttca

SEQ ID NO: 545179 - DNA, 25 bp, Homo sapien
tccttcatcatcactgcacgacaaa

SEQ ID NO: 545180 - DNA, 25 bp, Homo sapien
caaagcattctatgaggcctcttgg

SEQ ID NO: 545181 - DNA, 25 bp, Homo sapien
attctatgaggcctcttgggctgca

SEQ ID NO: 545182 - DNA, 25 bp, Homo sapien
gctgcaggcggatgccttcacctga

SEQ ID NO: 545183 - DNA, 25 bp, Homo sapien
tcacctgacaccctactgaaattta

SEQ ID NO: 545184 - DNA, 25 bp, Homo sapien
tgcactgagcatgccttctctatct

SEQ ID NO: 545185 - DNA, 25 bp, Homo sapien
gtcctctctcccttaacatggagaa

SEQ ID NO: 545186 - DNA, 25 bp, Homo sapien
atgccttctctatctttcctgcttc

SEQ ID NO: 545187 - DNA, 25 bp, Homo sapien
tgaaattttaagtcaagtcctttat

SEQ ID NO: 545188 - DNA, 25 bp, Homo sapien
agtcaagtcctttataaagaccata

SEQ ID NO: 545189 - DNA, 25 bp, Homo sapien
agaccatagcagtggaaaacagtgt

SEQ ID NO: 545190 - DNA, 25 bp, Homo sapien
agcagtggaaaacagtgtacttttt

SEQ ID NO: 545191 - DNA, 25 bp, Homo sapien
gacagcaatcaaaactaactttttg

SEQ ID NO: 545192 - DNA, 25 bp, Homo sapien
tttttgtagatagccatttcatttc

SEQ ID NO: 545193 - DNA, 25 bp, Homo sapien
ttctttaaactgtttcaacgccaat

SEQ ID NO: 545194 - DNA, 25 bp, Homo sapien
ctgtttcaacgccaatatgtattct

SEQ ID NO: 545195 - DNA, 25 bp, Homo sapien
tcaacgccaatatgtattctacaaa

SEQ ID NO: 545196 - DNA, 25 bp, Homo sapien
ttttaggctccagtgttatactttt

SEQ ID NO: 545197 - DNA, 25 bp, Homo sapien
ttaggctccagtgttatactttttt

SEQ ID NO: 545198 - DNA, 25 bp, Homo sapien
gacaactttcctaccatcttggagg

SEQ ID NO: 545199 - DNA, 25 bp, Homo sapien
actttcctaccatcttggaggcaga

SEQ ID NO: 545200 - DNA, 25 bp, Homo sapien
gggaaaagtgcacccgctcccgata

SEQ ID NO: 545201 - DNA, 25 bp, Homo sapien
cacccgctcccgataaagtacaaat

SEQ ID NO: 545202 - DNA, 25 bp, Homo sapien
tttttacttctcatctctggaaaaa

SEQ ID NO: 545203 - DNA, 25 bp, Homo sapien
tctggaaaaaagtccacaccggccg

SEQ ID NO: 545204 - DNA, 25 bp, Homo sapien
gggtgcatgagaaacgttttcattt

SEQ ID NO: 545205 - DNA, 25 bp, Homo sapien
agaaacgttttcatttgctccaggg

SEQ ID NO: 545206 - DNA, 25 bp, Homo sapien
tttctgcatcttctgatggaaagaa

SEQ ID NO: 545207 - DNA, 25 bp, Homo sapien
aagaaatctttacaagacacaggtt

SEQ ID NO: 545208 - DNA, 25 bp, Homo sapien
gacacaggttttccggtggttattg

SEQ ID NO: 545209 - DNA, 25 bp, Homo sapien
tgagatccccatgaccgaagcggtg

SEQ ID NO: 545210 - DNA, 25 bp, Homo sapien
atccccatgaccgaagcggtggagg

SEQ ID NO: 545211 - DNA, 25 bp, Homo sapien
gggacccgtgcaggtgacccaggta

SEQ ID NO: 545212 - DNA, 25 bp, Homo sapien
tggctatggttggaggtcagcttca

SEQ ID NO: 545213 - DNA, 25 bp, Homo sapien
aggccttctggaagcatggagtgca

SEQ ID NO: 545214 - DNA, 25 bp, Homo sapien
tgggctctaggctcggatcagctgc

SEQ ID NO: 545215 - DNA, 25 bp, Homo sapien
taggctcggatcagctgctacagga

SEQ ID NO: 545216 - DNA, 25 bp, Homo sapien
cagctgctacaggagctgagagacc

SEQ ID NO: 545217 - DNA, 25 bp, Homo sapien
agctgagagaccctaccctcacttt

SEQ ID NO: 545218 - DNA, 25 bp, Homo sapien
tgatggtgttgatggatggctctgt

SEQ ID NO: 545219 - DNA, 25 bp, Homo sapien
gctctgtgaagctggtgaccccgga

SEQ ID NO: 545220 - DNA, 25 bp, Homo sapien
gcagccacgccgatggttatacagt

SEQ ID NO: 545221 - DNA, 25 bp, Homo sapien
gaagaagacttcacctcttcctatt

SEQ ID NO: 545222 - DNA, 25 bp, Homo sapien
acttcacctcttcctattgagtttg

SEQ ID NO: 545223 - DNA, 25 bp, Homo sapien
attgagtttgcttggaatgctgaca

SEQ ID NO: 545224 - DNA, 25 bp, Homo sapien
atgctgacagcatcaggcaactctg

SEQ ID NO: 545225 - DNA, 25 bp, Homo sapien
caggcaactctgaactgaacatttg

SEQ ID NO: 545226 - DNA, 25 bp, Homo sapien
tttggcaaccttcatgttaccccaa

SEQ ID NO: 545227 - DNA, 25 bp, Homo sapien
gttaccccaaagcaaaaccattgtg

SEQ ID NO: 545228 - DNA, 25 bp, Homo sapien
aaaccattgtgtcaggagtcaaaca

SEQ ID NO: 545229 - DNA, 25 bp, Homo sapien
catgacgtctctattgtacaacctc

SEQ ID NO: 545230 - DNA, 25 bp, Homo sapien
tattgtacaacctcctttctcttgg

SEQ ID NO: 545231 - DNA, 25 bp, Homo sapien
acacttttgctttctagttatacta

SEQ ID NO: 545232 - DNA, 25 bp, Homo sapien
tatactattggttcattgtaaatgc

SEQ ID NO: 545233 - DNA, 25 bp, Homo sapien
gcttggtatagagctctagcttgtg

SEQ ID NO: 545234 - DNA, 25 bp, Homo sapien
gagctctagcttgtgtataccttaa

SEQ ID NO: 545235 - DNA, 25 bp, Homo sapien
gtataccttaaactgtaacttgcag

SEQ ID NO: 545236 - DNA, 25 bp, Homo sapien
caggtgtttttcagttgctgcactt

SEQ ID NO: 545237 - DNA, 25 bp, Homo sapien
gtttttcagttgctgcactttttat

SEQ ID NO: 545238 - DNA, 25 bp, Homo sapien
atttaatcttgctcagtcccagtaa

SEQ ID NO: 545239 - DNA, 25 bp, Homo sapien
gctcagtcccagtaactatctcaaa

SEQ ID NO: 545240 - DNA, 25 bp, Homo sapien
aactatctcaaaggtaattgctgga

SEQ ID NO: 545241 - DNA, 25 bp, Homo sapien
gctggaatatgcattttgaaatacg

SEQ ID NO: 545242 - DNA, 25 bp, Homo sapien
aagccaagggacacaggagaccacc

SEQ ID NO: 545243 - DNA, 25 bp, Homo sapien
ccgagcttgcctcagggccaagccg

SEQ ID NO: 545244 - DNA, 25 bp, Homo sapien
gggtcacccatggcctcagatgatg

SEQ ID NO: 545245 - DNA, 25 bp, Homo sapien
ggcccaggagaattaggaaggccat

SEQ ID NO: 545246 - DNA, 25 bp, Homo sapien
gcctccagtctgctctcagcttgtg

SEQ ID NO: 545247 - DNA, 25 bp, Homo sapien
tctgctctcagcttgtgccttgtaa

SEQ ID NO: 545248 - DNA, 25 bp, Homo sapien
tgctctcagcttgtgccttgtaaat

SEQ ID NO: 545249 - DNA, 25 bp, Homo sapien
gctctcagcttgtgccttgtaaata

SEQ ID NO: 545250 - DNA, 25 bp, Homo sapien
ctctcagcttgtgccttgtaaataa

SEQ ID NO: 545251 - DNA, 25 bp, Homo sapien
atgtacaggttggatgtggcctcct

SEQ ID NO: 545252 - DNA, 25 bp, Homo sapien
gtacaggttggatgtggcctccttc

SEQ ID NO: 545253 - DNA, 25 bp, Homo sapien
actgtaacagtgaccgataatgtga

SEQ ID NO: 545254 - DNA, 25 bp, Homo sapien
acaagtgcttgctgcagttgtttct

SEQ ID NO: 545255 - DNA, 25 bp, Homo sapien
tttctgaatctagccagatgctgga

SEQ ID NO: 545256 - DNA, 25 bp, Homo sapien
cagatgctggagtcgtgaagctgta

SEQ ID NO: 545257 - DNA, 25 bp, Homo sapien
gcagggaccatctctctttcttgca

SEQ ID NO: 545258 - DNA, 25 bp, Homo sapien
ctttcttgcactacaggcactcaat

SEQ ID NO: 545259 - DNA, 25 bp, Homo sapien
gaggaatcaagccataaatgtgcat

SEQ ID NO: 545260 - DNA, 25 bp, Homo sapien
taaatgtgcatttgctggacattat

SEQ ID NO: 545261 - DNA, 25 bp, Homo sapien
ggacattatgtaccatgtcatctct

SEQ ID NO: 545262 - DNA, 25 bp, Homo sapien
gtaccatgtcatctctatgactaca

SEQ ID NO: 545263 - DNA, 25 bp, Homo sapien
ctctatgactacagatttcaaggat

SEQ ID NO: 545264 - DNA, 25 bp, Homo sapien
ggaacatgtcggttctctgtcctgt

SEQ ID NO: 545265 - DNA, 25 bp, Homo sapien
gaacttgtagagtctttcagccata

SEQ ID NO: 545266 - DNA, 25 bp, Homo sapien
gagtctttcagccatagagggtcct

SEQ ID NO: 545267 - DNA, 25 bp, Homo sapien
tagagggtcctgtcatccattgaag

SEQ ID NO: 545268 - DNA, 25 bp, Homo sapien
gatcagtccattgggaccttttgcc

SEQ ID NO: 545269 - DNA, 25 bp, Homo sapien
gggaccttttgccagttttagcatt

SEQ ID NO: 545270 - DNA, 25 bp, Homo sapien
gggaaacccctgaatacttatcata

SEQ ID NO: 545271 - DNA, 25 bp, Homo sapien
agaagttcagccactgtagccctac

SEQ ID NO: 545272 - DNA, 25 bp, Homo sapien
cctcaggaccgcttttatgggaaag

SEQ ID NO: 545273 - DNA, 25 bp, Homo sapien
ttcctttaactgcttgagccatttg

SEQ ID NO: 545274 - DNA, 25 bp, Homo sapien
gtggctgcttttggtacttgtaata

SEQ ID NO: 545275 - DNA, 25 bp, Homo sapien
agagaagtctgaaaggctaccttga

SEQ ID NO: 545276 - DNA, 25 bp, Homo sapien
gataaggtactaacagcctgtggta

SEQ ID NO: 545277 - DNA, 25 bp, Homo sapien
aacagcctgtggtagctttaataga

SEQ ID NO: 545278 - DNA, 25 bp, Homo sapien
gaacatccaacttattcagattcaa

SEQ ID NO: 545279 - DNA, 25 bp, Homo sapien
atcgagtatttaccctctgcagata

SEQ ID NO: 545280 - DNA, 25 bp, Homo sapien
ctctgcagataagacaaggccatgt

SEQ ID NO: 545281 - DNA, 25 bp, Homo sapien
ggccatgtattagatgtttcctcat

SEQ ID NO: 545282 - DNA, 25 bp, Homo sapien
gatgtttcctcatgtgttatatcat

SEQ ID NO: 545283 - DNA, 25 bp, Homo sapien
tttcctgctcaaaagtgactatctg

SEQ ID NO: 545284 - DNA, 25 bp, Homo sapien
gtgactatctggtagtacattccca

SEQ ID NO: 545285 - DNA, 25 bp, Homo sapien
tggtagtacattcccagaggatcct

SEQ ID NO: 545286 - DNA, 25 bp, Homo sapien
tccaacaaaaatcgctctctggttt

SEQ ID NO: 545287 - DNA, 25 bp, Homo sapien
aaaatcgctctctggtttgcagtca

SEQ ID NO: 545288 - DNA, 25 bp, Homo sapien
gctctctggtttgcagtcatttatt

SEQ ID NO: 545289 - DNA, 25 bp, Homo sapien
tttatttattgtccgctgcaagctg

SEQ ID NO: 545290 - DNA, 25 bp, Homo sapien
ttgtccgctgcaagctgccccgaga

SEQ ID NO: 545291 - DNA, 25 bp, Homo sapien
gaaggcgtgcccctgggaattctcc

SEQ ID NO: 545292 - DNA, 25 bp, Homo sapien
agacgcctcgtccaatcatggtgac

SEQ ID NO: 545293 - DNA, 25 bp, Homo sapien
accctgccttgctcgcagttctgga

SEQ ID NO: 545294 - DNA, 25 bp, Homo sapien
gttctggaggatgctgctatcgacc

SEQ ID NO: 545295 - DNA, 25 bp, Homo sapien
atgctgctatcgaccttccgtgact

SEQ ID NO: 545296 - DNA, 25 bp, Homo sapien
tccgtgactcacgtgacctagtaca

SEQ ID NO: 545297 - DNA, 25 bp, Homo sapien
ctccagagcgaaaccagagacgcat

SEQ ID NO: 545298 - DNA, 25 bp, Homo sapien
agagacgcatcaaatcctggcactt

SEQ ID NO: 545299 - DNA, 25 bp, Homo sapien
atcctggcactttccgtttgttcaa

SEQ ID NO: 545300 - DNA, 25 bp, Homo sapien
ttcaaccccggagatgccttcaaat

SEQ ID NO: 545301 - DNA, 25 bp, Homo sapien
cagtttttcaacaagtggtggtggg

SEQ ID NO: 545302 - DNA, 25 bp, Homo sapien
ggaaatagtttctgggcttgcaccc

SEQ ID NO: 545303 - DNA, 25 bp, Homo sapien
agtttctgggcttgcacccgatttt

SEQ ID NO: 545304 - DNA, 25 bp, Homo sapien
cgattttccctgtggtgccaggaag

SEQ ID NO: 545305 - DNA, 25 bp, Homo sapien
gtcatgcctttactgtaaaacacga

SEQ ID NO: 545306 - DNA, 25 bp, Homo sapien
gatgaacaagaacgtcaacaactgc

SEQ ID NO: 545307 - DNA, 25 bp, Homo sapien
tgccaccacgcaggtgtttctaaaa

SEQ ID NO: 545308 - DNA, 25 bp, Homo sapien
gatacaaaagttaactggatgtggt

SEQ ID NO: 545309 - DNA, 25 bp, Homo sapien
ctgtggttcatagctactctggagg

SEQ ID NO: 545310 - DNA, 25 bp, Homo sapien
aggatgacctgagtgcgggaggttg

SEQ ID NO: 545311 - DNA, 25 bp, Homo sapien
agagaatacctagctcatggagtta

SEQ ID NO: 545312 - DNA, 25 bp, Homo sapien
gagaatacctagctcatggagttag

SEQ ID NO: 545313 - DNA, 25 bp, Homo sapien
gaatacctagctcatggagttagga

SEQ ID NO: 545314 - DNA, 25 bp, Homo sapien
atacctagctcatggagttaggaac

SEQ ID NO: 545315 - DNA, 25 bp, Homo sapien
acctagctcatggagttaggaacaa

SEQ ID NO: 545316 - DNA, 25 bp, Homo sapien
ctagctcatggagttaggaacaagt

SEQ ID NO: 545317 - DNA, 25 bp, Homo sapien
agctcatggagttaggaacaagtat

SEQ ID NO: 545318 - DNA, 25 bp, Homo sapien
catggagttaggaacaagtatgtta

SEQ ID NO: 545319 - DNA, 25 bp, Homo sapien
cttttattcaagtgcgcaggtaatt

SEQ ID NO: 545320 - DNA, 25 bp, Homo sapien
gtgcgcaggtaattacttggttgaa

SEQ ID NO: 545321 - DNA, 25 bp, Homo sapien
caatagtgtttctgtgccacagagc

SEQ ID NO: 545322 - DNA, 25 bp, Homo sapien
gatcaatttttatgtgccgttgcct

SEQ ID NO: 545323 - DNA, 25 bp, Homo sapien
tgtgccgttgccttgactataaagt

SEQ ID NO: 545324 - DNA, 25 bp, Homo sapien
ccactgcatcgtaatgggctcagtt

SEQ ID NO: 545325 - DNA, 25 bp, Homo sapien
gggctcagttagatggatcagctac

SEQ ID NO: 545326 - DNA, 25 bp, Homo sapien
gctacagagtgtatgagctccaggt

SEQ ID NO: 545327 - DNA, 25 bp, Homo sapien
gtttaccagcagaacataatccttt

SEQ ID NO: 545328 - DNA, 25 bp, Homo sapien
acataatcctttggcattgctcatc

SEQ ID NO: 545329 - DNA, 25 bp, Homo sapien
ggcattgctcatctgcgactgaaga

SEQ ID NO: 545330 - DNA, 25 bp, Homo sapien
atgacgacaacgtgcaacagcagaa

SEQ ID NO: 545331 - DNA, 25 bp, Homo sapien
gcttgcaagcagagtcagggtcacc

SEQ ID NO: 545332 - DNA, 25 bp, Homo sapien
gtgaatgccacaaaagttctctttc

SEQ ID NO: 545333 - DNA, 25 bp, Homo sapien
tctttcccactgtttaatttgacaa

SEQ ID NO: 545334 - DNA, 25 bp, Homo sapien
attttcaagaactctgctgaggtca

SEQ ID NO: 545335 - DNA, 25 bp, Homo sapien
gctgaggtcacttagagcgccatca

SEQ ID NO: 545336 - DNA, 25 bp, Homo sapien
tagagcgccatcacaacttatttgt

SEQ ID NO: 545337 - DNA, 25 bp, Homo sapien
cttatttgtgtgactaattgcctag

SEQ ID NO: 545338 - DNA, 25 bp, Homo sapien
agggcagggcttgtctcttacacat

SEQ ID NO: 545339 - DNA, 25 bp, Homo sapien
ttacacatctttataatcccctgca

SEQ ID NO: 545340 - DNA, 25 bp, Homo sapien
gcagcggctttcagtattttgtact

SEQ ID NO: 545341 - DNA, 25 bp, Homo sapien
agtgagaaattgtccttaatcatgc

SEQ ID NO: 545342 - DNA, 25 bp, Homo sapien
gggtagagattaattcttgcacagt

SEQ ID NO: 545343 - DNA, 25 bp, Homo sapien
gcaacaaactatgccatttaccttt

SEQ ID NO: 545344 - DNA, 25 bp, Homo sapien
cttttacctcttacttgaaggcaga

SEQ ID NO: 545345 - DNA, 25 bp, Homo sapien
ttgaaggcagaatcgcaaaacgttt

SEQ ID NO: 545346 - DNA, 25 bp, Homo sapien
gcaaaacgtttgaaatggcttttct

SEQ ID NO: 545347 - DNA, 25 bp, Homo sapien
gcttttctaaactactctactctgg

SEQ ID NO: 545348 - DNA, 25 bp, Homo sapien
tactctactctggtgagagctcatt

SEQ ID NO: 545349 - DNA, 25 bp, Homo sapien
gagctcatttaccacaagaagcctt

SEQ ID NO: 545350 - DNA, 25 bp, Homo sapien
taataaccccgtagatactgtacct

SEQ ID NO: 545351 - DNA, 25 bp, Homo sapien
aacatgactcgtattagctctataa

SEQ ID NO: 545352 - DNA, 25 bp, Homo sapien
aaaatcaactagagacgcgaacgtg

SEQ ID NO: 545353 - DNA, 25 bp, Homo sapien
gaccaagtcttgtcttgcatagtta

SEQ ID NO: 545354 - DNA, 25 bp, Homo sapien
cttgtcttgcatagttaagccggac

SEQ ID NO: 545355 - DNA, 25 bp, Homo sapien
taagccggacatttttctgtcagag

SEQ ID NO: 545356 - DNA, 25 bp, Homo sapien
agaaaaggcatcattgtccgctcca

SEQ ID NO: 545357 - DNA, 25 bp, Homo sapien
ttgtccgctccattaagaacagtga

SEQ ID NO: 545358 - DNA, 25 bp, Homo sapien
agaacagtgacgcacctgctacttc

SEQ ID NO: 545359 - DNA, 25 bp, Homo sapien
acaggcgctgctgctcacgtggaga

SEQ ID NO: 545360 - DNA, 25 bp, Homo sapien
cacgtggagacgctctcgaagcaga

SEQ ID NO: 545361 - DNA, 25 bp, Homo sapien
tctcgaagcagagttgacggacact

SEQ ID NO: 545362 - DNA, 25 bp, Homo sapien
ggacactgctcccaaaaggtcatta

SEQ ID NO: 545363 - DNA, 25 bp, Homo sapien
tcatgatgctgactggcgttagctg

SEQ ID NO: 545364 - DNA, 25 bp, Homo sapien
gactggcgttagctgattaacccat

SEQ ID NO: 545365 - DNA, 25 bp, Homo sapien
gattaacccatgtaaataggcactt

SEQ ID NO: 545366 - DNA, 25 bp, Homo sapien
gacaaagactggcttctggacttcc

SEQ ID NO: 545367 - DNA, 25 bp, Homo sapien
gcagtggccagaattagggaatcag

SEQ ID NO: 545368 - DNA, 25 bp, Homo sapien
aatcaaaccagtgtaaggcagtgct

SEQ ID NO: 545369 - DNA, 25 bp, Homo sapien
tgccattgcctggtcacattgaaat

SEQ ID NO: 545370 - DNA, 25 bp, Homo sapien
aaattggtggcttcattctagatgt

SEQ ID NO: 545371 - DNA, 25 bp, Homo sapien
cattctagatgtagcttgtgcagat

SEQ ID NO: 545372 - DNA, 25 bp, Homo sapien
aataggaaaacctaccatctcagtg

SEQ ID NO: 545373 - DNA, 25 bp, Homo sapien
ctaccatctcagtgagcaccagctg

SEQ ID NO: 545374 - DNA, 25 bp, Homo sapien
tctggaaaacgggaaccagctttct

SEQ ID NO: 545375 - DNA, 25 bp, Homo sapien
gttttcaccaacctgttgctcgctc

SEQ ID NO: 545376 - DNA, 25 bp, Homo sapien
cgcgcacagccaaggccagtaggtg

SEQ ID NO: 545377 - DNA, 25 bp, Homo sapien
gtcccattctgtgtttctacgatcg

SEQ ID NO: 545378 - DNA, 25 bp, Homo sapien
tgtgtttctacgatcgctccaggcg

SEQ ID NO: 545379 - DNA, 25 bp, Homo sapien
tttctacgatcgctccaggcgctgt

SEQ ID NO: 545380 - DNA, 25 bp, Homo sapien
acgatcgctccaggcgctgtcttta

SEQ ID NO: 545381 - DNA, 25 bp, Homo sapien
caggcgctgtctttactctccactt

SEQ ID NO: 545382 - DNA, 25 bp, Homo sapien
tttactctccacttccttctcgaag

SEQ ID NO: 545383 - DNA, 25 bp, Homo sapien
ttctcgaagtgccaaccgcggcctt

SEQ ID NO: 545384 - DNA, 25 bp, Homo sapien
aaccgcggcctttcaagctctgggc

SEQ ID NO: 545385 - DNA, 25 bp, Homo sapien
ggttgaacacatctgctaaacgaga

SEQ ID NO: 545386 - DNA, 25 bp, Homo sapien
aaagcttgatgttagtgccaggagt

SEQ ID NO: 545387 - DNA, 25 bp, Homo sapien
ggaaccaaaatgatacaccagaggg

SEQ ID NO: 545388 - DNA, 25 bp, Homo sapien
gatagagaaaccctcttcgacatct

SEQ ID NO: 545389 - DNA, 25 bp, Homo sapien
ttcgacatctgcaggccgctcgatg

SEQ ID NO: 545390 - DNA, 25 bp, Homo sapien
ccccatggtaccagggatggacaca

SEQ ID NO: 545391 - DNA, 25 bp, Homo sapien
gggatggacacagaaccctggccca

SEQ ID NO: 545392 - DNA, 25 bp, Homo sapien
ttgacccagccacaggtgttaatga

SEQ ID NO: 545393 - DNA, 25 bp, Homo sapien
gtgttaatgacacagccactcacag

SEQ ID NO: 545394 - DNA, 25 bp, Homo sapien
agccactcacagatgcccttcggtt

SEQ ID NO: 545395 - DNA, 25 bp, Homo sapien
ggttcacctcacacctttggttgaa

SEQ ID NO: 545396 - DNA, 25 bp, Homo sapien
aagccagctgtctgtactcgtgaac

SEQ ID NO: 545397 - DNA, 25 bp, Homo sapien
agctgtctgtactcgtgaactatgc

SEQ ID NO: 545398 - DNA, 25 bp, Homo sapien
gtctgtactcgtgaactatgcgttt

SEQ ID NO: 545399 - DNA, 25 bp, Homo sapien
tgaagaaccccaaagtggaagtgtt

SEQ ID NO: 545400 - DNA, 25 bp, Homo sapien
caaagtggaagtgtttggctaccct

SEQ ID NO: 545401 - DNA, 25 bp, Homo sapien
cagtggtcactgcaagaacattccc

SEQ ID NO: 545402 - DNA, 25 bp, Homo sapien
tggtcactgcaagaacattcccact

SEQ ID NO: 545403 - DNA, 25 bp, Homo sapien
gtatggattcctcgttcagatcatg

SEQ ID NO: 545404 - DNA, 25 bp, Homo sapien
gattcctcgttcagatcatgaagta

SEQ ID NO: 545405 - DNA, 25 bp, Homo sapien
agtactgtgtggtgtgtgatgagca

SEQ ID NO: 545406 - DNA, 25 bp, Homo sapien
aaatggatctatgctgaagccagct

SEQ ID NO: 545407 - DNA, 25 bp, Homo sapien
ttcattcattcttagcatacctttg

SEQ ID NO: 545408 - DNA, 25 bp, Homo sapien
cattcttagcatacctttgaaaaag

SEQ ID NO: 545409 - DNA, 25 bp, Homo sapien
atccataggttgatacattgaccca

SEQ ID NO: 545410 - DNA, 25 bp, Homo sapien
gttgatacattgacccattgaagta

SEQ ID NO: 545411 - DNA, 25 bp, Homo sapien
acattgacccattgaagtacttcat

SEQ ID NO: 545412 - DNA, 25 bp, Homo sapien
gacccattgaagtacttcattacgt

SEQ ID NO: 545413 - DNA, 25 bp, Homo sapien
gaagtacttcattacgtatttattg

SEQ ID NO: 545414 - DNA, 25 bp, Homo sapien
taattgttgaaattgggaccacttt

SEQ ID NO: 545415 - DNA, 25 bp, Homo sapien
tgaaattgggaccactttttataat

SEQ ID NO: 545416 - DNA, 25 bp, Homo sapien
aaaaaatgaacagacttccagtgct

SEQ ID NO: 545417 - DNA, 25 bp, Homo sapien
ttcaaataaactccgattcaaattt

SEQ ID NO: 545418 - DNA, 25 bp, Homo sapien
ttggccctgggccacaactcagtgg

SEQ ID NO: 545419 - DNA, 25 bp, Homo sapien
ctgggccacaactcagtggtgctat

SEQ ID NO: 545420 - DNA, 25 bp, Homo sapien
aactcagtggtgctatatgaccctg

SEQ ID NO: 545421 - DNA, 25 bp, Homo sapien
gtggtgctatatgaccctgtagtag

SEQ ID NO: 545422 - DNA, 25 bp, Homo sapien
ccctgtagtagggtgcatcctgcaa

SEQ ID NO: 545423 - DNA, 25 bp, Homo sapien
ggtgcatcctgcaagaggtgccctg

SEQ ID NO: 545424 - DNA, 25 bp, Homo sapien
atcctgcaagaggtgccctgcacag

SEQ ID NO: 545425 - DNA, 25 bp, Homo sapien
tgcacagacaggtgcaccctctctt

SEQ ID NO: 545426 - DNA, 25 bp, Homo sapien
tcttcagcctgcctgattggagacg

SEQ ID NO: 545427 - DNA, 25 bp, Homo sapien
agcctgcctgattggagacgcctgg

SEQ ID NO: 545428 - DNA, 25 bp, Homo sapien
ctgcctgattggagacgcctggaag

SEQ ID NO: 545429 - DNA, 25 bp, Homo sapien
gaacaatgaaatgctatgactccta

SEQ ID NO: 545430 - DNA, 25 bp, Homo sapien
atgctatgactcctactgcaggttt

SEQ ID NO: 545431 - DNA, 25 bp, Homo sapien
gactcctactgcaggtttaagaaga

SEQ ID NO: 545432 - DNA, 25 bp, Homo sapien
gatggtgaaggtgctcatagaccct

SEQ ID NO: 545433 - DNA, 25 bp, Homo sapien
ggtgctcatagacccttttggtgtt

SEQ ID NO: 545434 - DNA, 25 bp, Homo sapien
tggtgttaccaggttcctcaaacgg

SEQ ID NO: 545435 - DNA, 25 bp, Homo sapien
caggttcctcaaacgggacattcta

SEQ ID NO: 545436 - DNA, 25 bp, Homo sapien
gggcattctacatgtattggtttag

SEQ ID NO: 545437 - DNA, 25 bp, Homo sapien
tggtttagttccattacttacaatt

SEQ ID NO: 545438 - DNA, 25 bp, Homo sapien
ttaactggattaattttgactcttt

SEQ ID NO: 545439 - DNA, 25 bp, Homo sapien
gaagggtgaaaagtccggtgatata

SEQ ID NO: 545440 - DNA, 25 bp, Homo sapien
ttcattcattcttagcatacctttg

SEQ ID NO: 545441 - DNA, 25 bp, Homo sapien
cattcttagcatacctttgaaaaag

SEQ ID NO: 545442 - DNA, 25 bp, Homo sapien
atccataggttgatacattgaccca

SEQ ID NO: 545443 - DNA, 25 bp, Homo sapien
gttgatacattgacccattgaagta

SEQ ID NO: 545444 - DNA, 25 bp, Homo sapien
acattgacccattgaagtacttcat

SEQ ID NO: 545445 - DNA, 25 bp, Homo sapien
gaagtacttcattacgtatttattg

SEQ ID NO: 545446 - DNA, 25 bp, Homo sapien
taattgttgaaattgggaccacttt

SEQ ID NO: 545447 - DNA, 25 bp, Homo sapien
tgaaattgggaccactttttataat

SEQ ID NO: 545448 - DNA, 25 bp, Homo sapien
aaaaaatgaacagacttccagtgct

SEQ ID NO: 545449 - DNA, 25 bp, Homo sapien
gacttccagtgcttttctgttcaaa

SEQ ID NO: 545450 - DNA, 25 bp, Homo sapien
gttcaaataaactccgattcaaatt

SEQ ID NO: 545451 - DNA, 25 bp, Homo sapien
atacatgcacttttgaactctgaaa

SEQ ID NO: 545452 - DNA, 25 bp, Homo sapien
aactctgaaagtttgccaatctgaa

SEQ ID NO: 545453 - DNA, 25 bp, Homo sapien
gggtgtttctgaagaccactatctt

SEQ ID NO: 545454 - DNA, 25 bp, Homo sapien
gaccactatcttttacgaacactta

SEQ ID NO: 545455 - DNA, 25 bp, Homo sapien
gtttgcagttgtgtatgggcacgat

SEQ ID NO: 545456 - DNA, 25 bp, Homo sapien
gggcacgatactgtattctttacat

SEQ ID NO: 545457 - DNA, 25 bp, Homo sapien
ttacatttttatggccctacagcta

SEQ ID NO: 545458 - DNA, 25 bp, Homo sapien
acttcttatccctgcaagtatataa

SEQ ID NO: 545459 - DNA, 25 bp, Homo sapien
cactttagaacagctttgaaactag

SEQ ID NO: 545460 - DNA, 25 bp, Homo sapien
gtttcaaaggtaaaaggatctcatg

SEQ ID NO: 545461 - DNA, 25 bp, Homo sapien
aaggatctcatgtttctgaatctgc

SEQ ID NO: 545462 - DNA, 25 bp, Homo sapien
tggaaaaagactgatcaagttccag

SEQ ID NO: 545463 - DNA, 25 bp, Homo sapien
atgactggacccactgtgtagaaac

SEQ ID NO: 545464 - DNA, 25 bp, Homo sapien
gactggacccactgtgtagaaacaa

SEQ ID NO: 545465 - DNA, 25 bp, Homo sapien
gtagaaacaagtcaaagccaaagtc

SEQ ID NO: 545466 - DNA, 25 bp, Homo sapien
agaaggtgctgagtggttacacttt

SEQ ID NO: 545467 - DNA, 25 bp, Homo sapien
ggtgctgagtggttacactttgcaa

SEQ ID NO: 545468 - DNA, 25 bp, Homo sapien
tgctgagtggttacactttgcaagc

SEQ ID NO: 545469 - DNA, 25 bp, Homo sapien
ggtgaagatcacactgtgaagatac

SEQ ID NO: 545470 - DNA, 25 bp, Homo sapien
gtgaagatacacagagtcaataaat

SEQ ID NO: 545471 - DNA, 25 bp, Homo sapien
cagagtcaataaatgtgcactgtaa

SEQ ID NO: 545472 - DNA, 25 bp, Homo sapien
tcaataaatgtgcactgtaatggac

SEQ ID NO: 545473 - DNA, 25 bp, Homo sapien
agaccagcttcagtatcctcttcag

SEQ ID NO: 545474 - DNA, 25 bp, Homo sapien
agcttcagtatcctcttcagctagg

SEQ ID NO: 545475 - DNA, 25 bp, Homo sapien
tcttcagctaggattgccctaactt

SEQ ID NO: 545476 - DNA, 25 bp, Homo sapien
ttgccctaacttttaactttcacag

SEQ ID NO: 545477 - DNA, 25 bp, Homo sapien
taactttcacagtttcctgattcat

SEQ ID NO: 545478 - DNA, 25 bp, Homo sapien
gttaaacatcataatgcagtctctc

SEQ ID NO: 545479 - DNA, 25 bp, Homo sapien
gcagtctctcattaatttttaccat

SEQ ID NO: 545480 - DNA, 25 bp, Homo sapien
ttaatttttaccatcatttaccctg

SEQ ID NO: 545481 - DNA, 25 bp, Homo sapien
atttaccctgataatctgcctcttc

SEQ ID NO: 545482 - DNA, 25 bp, Homo sapien
cttactacctttctttgaattactg

SEQ ID NO: 545483 - DNA, 25 bp, Homo sapien
ttactgtaactgattggtcccacca

SEQ ID NO: 545484 - DNA, 25 bp, Homo sapien
ctttattcctagagttagccagtgt

SEQ ID NO: 545485 - DNA, 25 bp, Homo sapien
agttagccagtgtgtgttgtaaggt

SEQ ID NO: 545486 - DNA, 25 bp, Homo sapien
gaactattccttcattgtatctctt

SEQ ID NO: 545487 - DNA, 25 bp, Homo sapien
tcattgtatctcttatctgtccctg

SEQ ID NO: 545488 - DNA, 25 bp, Homo sapien
cttatctgtccctgacaggcagcat

SEQ ID NO: 545489 - DNA, 25 bp, Homo sapien
ggtgattcatttgatgcttccagaa

SEQ ID NO: 545490 - DNA, 25 bp, Homo sapien
gatgcttccagaaaccagagaaatc

SEQ ID NO: 545491 - DNA, 25 bp, Homo sapien
gagaaattatggaccctacgttctt

SEQ ID NO: 545492 - DNA, 25 bp, Homo sapien
ggaccctacgttcttatgatgacca

SEQ ID NO: 545493 - DNA, 25 bp, Homo sapien
tgaccagttagctcagatagcacct

SEQ ID NO: 545494 - DNA, 25 bp, Homo sapien
gatagcacctgagacagtacctgaa

SEQ ID NO: 545495 - DNA, 25 bp, Homo sapien
gtggagccagactacccggaatagg

SEQ ID NO: 545496 - DNA, 25 bp, Homo sapien
aggtgttttcataccggacggagat

SEQ ID NO: 545497 - DNA, 25 bp, Homo sapien
cagggtggtagagctttacgcccaa

SEQ ID NO: 545498 - DNA, 25 bp, Homo sapien
cgacttactcgattacacgctttac

SEQ ID NO: 545499 - DNA, 25 bp, Homo sapien
gctaactcttgcacatcaccagaaa

SEQ ID NO: 545500 - DNA, 25 bp, Homo sapien
ggtggcagaacagtcatggcattga

SEQ ID NO: 545501 - DNA, 25 bp, Homo sapien
atggcattgacgatcccaatggaaa

SEQ ID NO: 545502 - DNA, 25 bp, Homo sapien
gtatttcaccatacaggactgtaga

SEQ ID NO: 545503 - DNA, 25 bp, Homo sapien
gagtcccgggaagccataataccag

SEQ ID NO: 545504 - DNA, 25 bp, Homo sapien
ataataccagaaacagacctccagt

SEQ ID NO: 545505 - DNA, 25 bp, Homo sapien
tccagtttcattctcatccctagta

SEQ ID NO: 545506 - DNA, 25 bp, Homo sapien
tcagtcattcacaaggccttcagac

SEQ ID NO: 545507 - DNA, 25 bp, Homo sapien
cagcacacctgccacaggattagaa

SEQ ID NO: 545508 - DNA, 25 bp, Homo sapien
aatattgcatttctatttgatcatg

SEQ ID NO: 545509 - DNA, 25 bp, Homo sapien
tataaattttctttatcattcctcc

SEQ ID NO: 545510 - DNA, 25 bp, Homo sapien
gttccccagaggtagccagtgttaa

SEQ ID NO: 545511 - DNA, 25 bp, Homo sapien
gtgttaatagattatgtgcccttta

SEQ ID NO: 545512 - DNA, 25 bp, Homo sapien
gattatgtgccctttagaactatat

SEQ ID NO: 545513 - DNA, 25 bp, Homo sapien
actatattctatgcacactcttctg

SEQ ID NO: 545514 - DNA, 25 bp, Homo sapien
attctatgcacactcttctgtacct

SEQ ID NO: 545515 - DNA, 25 bp, Homo sapien
ctccatcccaagtacactatacatt

SEQ ID NO: 545516 - DNA, 25 bp, Homo sapien
cactatacatttttacgcggtcaag

SEQ ID NO: 545517 - DNA, 25 bp, Homo sapien
ctgcccgccggtgtttgtgtgttta

SEQ ID NO: 545518 - DNA, 25 bp, Homo sapien
atgcacaactcgcaaatataaattg

SEQ ID NO: 545519 - DNA, 25 bp, Homo sapien
agaaggcacagaccccgtagcgcat

SEQ ID NO: 545520 - DNA, 25 bp, Homo sapien
gtagcgcatgccaacttgcagggac

SEQ ID NO: 545521 - DNA, 25 bp, Homo sapien
atgccaacttgcagggactcggttt

SEQ ID NO: 545522 - DNA, 25 bp, Homo sapien
acttgcagggactcggtttaatctt

SEQ ID NO: 545523 - DNA, 25 bp, Homo sapien
ctcggtttaatcttgtctcatgaat

SEQ ID NO: 545524 - DNA, 25 bp, Homo sapien
tgtctcatgaatttccagatggccc

SEQ ID NO: 545525 - DNA, 25 bp, Homo sapien
agatggcccactctcttccatatca

SEQ ID NO: 545526 - DNA, 25 bp, Homo sapien
cactctcttccatatcacaaggaca

SEQ ID NO: 545527 - DNA, 25 bp, Homo sapien
gaatgccaaaaaggccatgagggcc

SEQ ID NO: 545528 - DNA, 25 bp, Homo sapien
gcactttctgaaactgatcattttg

SEQ ID NO: 545529 - DNA, 25 bp, Homo sapien
tatgtgaattctgcaatcatcattg

SEQ ID NO: 545530 - DNA, 25 bp, Homo sapien
atcatcattgccacatgctaatatt

SEQ ID NO: 545531 - DNA, 25 bp, Homo sapien
gctaatattggtacttctggaccct

SEQ ID NO: 545532 - DNA, 25 bp, Homo sapien
tggaccctttttagaccagagtcga

SEQ ID NO: 545533 - DNA, 25 bp, Homo sapien
taatgcaggatctgatgtcctcctc

SEQ ID NO: 545534 - DNA, 25 bp, Homo sapien
atgtcctcctctggtaaacagcatg

SEQ ID NO: 545535 - DNA, 25 bp, Homo sapien
gcatgcaccgcataaacaggtcctt

SEQ ID NO: 545536 - DNA, 25 bp, Homo sapien
taaacaggtccttcatggccttgaa

SEQ ID NO: 545537 - DNA, 25 bp, Homo sapien
atggccttgaagatgcactgctttt

SEQ ID NO: 545538 - DNA, 25 bp, Homo sapien
tgattatcctctatttcccagtgaa

SEQ ID NO: 545539 - DNA, 25 bp, Homo sapien
ggttagggaagtgtcaactctggat

SEQ ID NO: 545540 - DNA, 25 bp, Homo sapien
aagtgtcaactctggatgaaggtga

SEQ ID NO: 545541 - DNA, 25 bp, Homo sapien
gaaggtgatgtgtttgcctctcagt

SEQ ID NO: 545542 - DNA, 25 bp, Homo sapien
atgtgtttgcctctcagtctttcat

SEQ ID NO: 545543 - DNA, 25 bp, Homo sapien
agtctttcattcatagcctgctagt

SEQ ID NO: 545544 - DNA, 25 bp, Homo sapien
catagcctgctagtgaaaaggaagt

SEQ ID NO: 545545 - DNA, 25 bp, Homo sapien
gagattcttttgtgtgactttgtag

SEQ ID NO: 545546 - DNA, 25 bp, Homo sapien
gtgtgactttgtagtctctttgtat

SEQ ID NO: 545547 - DNA, 25 bp, Homo sapien
gtgtgttttgcaagaatgtgtggta

SEQ ID NO: 545548 - DNA, 25 bp, Homo sapien
agaatgtgtggtaagcctgggtaaa

SEQ ID NO: 545549 - DNA, 25 bp, Homo sapien
gaactgcggtgttgggagagtcttt

SEQ ID NO: 545550 - DNA, 25 bp, Homo sapien
aggagactgacatgagaggatcact

SEQ ID NO: 545551 - DNA, 25 bp, Homo sapien
atcacttgagactgggagattctga

SEQ ID NO: 545552 - DNA, 25 bp, Homo sapien
acttgagactgggagattctgaggc

SEQ ID NO: 545553 - DNA, 25 bp, Homo sapien
tccatcctaggtgagagggcaagac

SEQ ID NO: 545554 - DNA, 25 bp, Homo sapien
tcctaggtgagagggcaagaccctt

SEQ ID NO: 545555 - DNA, 25 bp, Homo sapien
aagaaattctggacatgtttttatc

SEQ ID NO: 545556 - DNA, 25 bp, Homo sapien
agaaattctggacatgtttttatca

SEQ ID NO: 545557 - DNA, 25 bp, Homo sapien
gaaattctggacatgtttttatcag

SEQ ID NO: 545558 - DNA, 25 bp, Homo sapien
aattctggacatgtttttatcagtt

SEQ ID NO: 545559 - DNA, 25 bp, Homo sapien
attctggacatgtttttatcagttt

SEQ ID NO: 545560 - DNA, 25 bp, Homo sapien
tgtttttatcagttttcaggacttg

SEQ ID NO: 545561 - DNA, 25 bp, Homo sapien
tactggatcctgaagaactcctggg

SEQ ID NO: 545562 - DNA, 25 bp, Homo sapien
agagaagggctatttccggctgcac

SEQ ID NO: 545563 - DNA, 25 bp, Homo sapien
gctgcaccgagggagcaatacctgt

SEQ ID NO: 545564 - DNA, 25 bp, Homo sapien
aatacctgtggcatcaccaagttcc

SEQ ID NO: 545565 - DNA, 25 bp, Homo sapien
actgcccgtgtgcagaaaccggata

SEQ ID NO: 545566 - DNA, 25 bp, Homo sapien
aaaccggatatgaagccccgagtct

SEQ ID NO: 545567 - DNA, 25 bp, Homo sapien
tcagctctgtcctgttaggccaact

SEQ ID NO: 545568 - DNA, 25 bp, Homo sapien
tgttaggccaactgcctccttgcca

SEQ ID NO: 545569 - DNA, 25 bp, Homo sapien
gggatatgggcagagacagtctcat

SEQ ID NO: 545570 - DNA, 25 bp, Homo sapien
agagacagtctcatcgcagtctcag

SEQ ID NO: 545571 - DNA, 25 bp, Homo sapien
accccatactggatcctgaagaact

SEQ ID NO: 545572 - DNA, 25 bp, Homo sapien
agctgtgcctagcaagcaaaaccca

SEQ ID NO: 545573 - DNA, 25 bp, Homo sapien
aagcctcctggccttacatacagaa

SEQ ID NO: 545574 - DNA, 25 bp, Homo sapien
tggccttacatacagaatgcctgga

SEQ ID NO: 545575 - DNA, 25 bp, Homo sapien
ttacatacagaatgcctggacaaga

SEQ ID NO: 545576 - DNA, 25 bp, Homo sapien
aagagagaacttgctgcgggctgct

SEQ ID NO: 545577 - DNA, 25 bp, Homo sapien
gagagaacttgctgcgggctgcttt

SEQ ID NO: 545578 - DNA, 25 bp, Homo sapien
gtattttaaaacacagcttgagagt

SEQ ID NO: 545579 - DNA, 25 bp, Homo sapien
tttaaaacacagcttgagagttcag

SEQ ID NO: 545580 - DNA, 25 bp, Homo sapien
ttggtggtttgctcacttaactgtt

SEQ ID NO: 545581 - DNA, 25 bp, Homo sapien
ggtttgctcacttaactgttgttaa

SEQ ID NO: 545582 - DNA, 25 bp, Homo sapien
taactgttgttaagatggcttgaaa

SEQ ID NO: 545583 - DNA, 25 bp, Homo sapien
ggtgtgggcagctgttccctgcctc

SEQ ID NO: 545584 - DNA, 25 bp, Homo sapien
ttccctgcctcgcagtgtcctggag

SEQ ID NO: 545585 - DNA, 25 bp, Homo sapien
tggaggcagctgtctcgcagactca

SEQ ID NO: 545586 - DNA, 25 bp, Homo sapien
agctgtctcgcagactcagcttggt

SEQ ID NO: 545587 - DNA, 25 bp, Homo sapien
tgtctcgcagactcagcttggtctc

SEQ ID NO: 545588 - DNA, 25 bp, Homo sapien
gcagactcagcttggtctcccgcag

SEQ ID NO: 545589 - DNA, 25 bp, Homo sapien
ttggtctcccgcaggcttcagaaaa

SEQ ID NO: 545590 - DNA, 25 bp, Homo sapien
gtctcccgcaggcttcagaaaaacc

SEQ ID NO: 545591 - DNA, 25 bp, Homo sapien
aaaacccaattgcacgtgtgggatt

SEQ ID NO: 545592 - DNA, 25 bp, Homo sapien
aattgcacgtgtgggattcttcccc

SEQ ID NO: 545593 - DNA, 25 bp, Homo sapien
tgcacgtgtgggattcttccccagc

SEQ ID NO: 545594 - DNA, 25 bp, Homo sapien
atcatttcctcctcttcacagtgtg

SEQ ID NO: 545595 - DNA, 25 bp, Homo sapien
ctcttcacagtgtgctgggagtcca

SEQ ID NO: 545596 - DNA, 25 bp, Homo sapien
agaaccctccccagtgtactgtgaa

SEQ ID NO: 545597 - DNA, 25 bp, Homo sapien
ttcttcctaatgacacgcgaccgtc

SEQ ID NO: 545598 - DNA, 25 bp, Homo sapien
taatgacacgcgaccgtcctggtgc

SEQ ID NO: 545599 - DNA, 25 bp, Homo sapien
gtgggaccctcagttctaggactgg

SEQ ID NO: 545600 - DNA, 25 bp, Homo sapien
aggactggtccgcagagaaagcacc

SEQ ID NO: 545601 - DNA, 25 bp, Homo sapien
acccaggagcagagcgcttcggagc

SEQ ID NO: 545602 - DNA, 25 bp, Homo sapien
agagcgcttcggagcggtcctcagt

SEQ ID NO: 545603 - DNA, 25 bp, Homo sapien
ggagcggtcctcagtggcgccacct

SEQ ID NO: 545604 - DNA, 25 bp, Homo sapien
ggcgccacctgctggtgctaatagg

SEQ ID NO: 545605 - DNA, 25 bp, Homo sapien
atcaggtcacctgtactctagtcag

SEQ ID NO: 545606 - DNA, 25 bp, Homo sapien
acctgtactctagtcagcactgtat

SEQ ID NO: 545607 - DNA, 25 bp, Homo sapien
gtcagcactgtatatattcttggag

SEQ ID NO: 545608 - DNA, 25 bp, Homo sapien
tattcttggagtttgtacatgggac

SEQ ID NO: 545609 - DNA, 25 bp, Homo sapien
gtacatgggacttagcaaccacact

SEQ ID NO: 545610 - DNA, 25 bp, Homo sapien
gggacttagcaaccacactgagtga

SEQ ID NO: 545611 - DNA, 25 bp, Homo sapien
tcagatctaaaattcgtaacaacct

SEQ ID NO: 545612 - DNA, 25 bp, Homo sapien
cctaaatttgagaggtggctgaaat

SEQ ID NO: 545613 - DNA, 25 bp, Homo sapien
aaattgcatagctttttgtaacatt

SEQ ID NO: 545614 - DNA, 25 bp, Homo sapien
actaaactcatacttttgctatctt

SEQ ID NO: 545615 - DNA, 25 bp, Homo sapien
ttttaatatttatctcgtttgggag

SEQ ID NO: 545616 - DNA, 25 bp, Homo sapien
agcttctccatgttcttcaacggcc

SEQ ID NO: 545617 - DNA, 25 bp, Homo sapien
ttcttcaacggcctcgcggacctgg

SEQ ID NO: 545618 - DNA, 25 bp, Homo sapien
tggcgggctctacggcgggcgacta

SEQ ID NO: 545619 - DNA, 25 bp, Homo sapien
ctttgtgctttacgccgtggccgcc

SEQ ID NO: 545620 - DNA, 25 bp, Homo sapien
tggccgcctcggtcatggtgctggg

SEQ ID NO: 545621 - DNA, 25 bp, Homo sapien
tcccgcccgtgttcgtggtgagcta

SEQ ID NO: 545622 - DNA, 25 bp, Homo sapien
ttcgtggtgagctacgccaaggacc

SEQ ID NO: 545623 - DNA, 25 bp, Homo sapien
atcctgggcttcattgacatcttcg

SEQ ID NO: 545624 - DNA, 25 bp, Homo sapien
ttcattgacatcttcgcgcggccgg

SEQ ID NO: 545625 - DNA, 25 bp, Homo sapien
gcttgggaaggtgcggccctactcc

SEQ ID NO: 545626 - DNA, 25 bp, Homo sapien
gaaggtgcggccctactccgtctac

SEQ ID NO: 545627 - DNA, 25 bp, Homo sapien
ggcaggaagcagttgggcacctaca

SEQ ID NO: 545628 - DNA, 25 bp, Homo sapien
gttgggcacctacagaccattgaat

SEQ ID NO: 545629 - DNA, 25 bp, Homo sapien
cagaccattgaattgccacatgatg

SEQ ID NO: 545630 - DNA, 25 bp, Homo sapien
gatggcatctacttcacatactggc

SEQ ID NO: 545631 - DNA, 25 bp, Homo sapien
acttcacatactggccagggcaaga

SEQ ID NO: 545632 - DNA, 25 bp, Homo sapien
ccattaggatgtatggcctgtcccc

SEQ ID NO: 545633 - DNA, 25 bp, Homo sapien
ccaggtaattgagcagccaggtcat

SEQ ID NO: 545634 - DNA, 25 bp, Homo sapien
gcagccaggtcattgaaccttacag

SEQ ID NO: 545635 - DNA, 25 bp, Homo sapien
tataatggactgacttgccagccct

SEQ ID NO: 545636 - DNA, 25 bp, Homo sapien
gcaaagacatgtcaccagggctcat

SEQ ID NO: 545637 - DNA, 25 bp, Homo sapien
ccagggctcatccaccaattaaagg

SEQ ID NO: 545638 - DNA, 25 bp, Homo sapien
tgccttgccatcttagatctttgat

SEQ ID NO: 545639 - DNA, 25 bp, Homo sapien
gatttactaacattttatctgatag

SEQ ID NO: 545640 - DNA, 25 bp, Homo sapien
gccatcttagatctttgatagactc

SEQ ID NO: 545641 - DNA, 25 bp, Homo sapien
tataatgttggtacactagccaggt

SEQ ID NO: 545642 - DNA, 25 bp, Homo sapien
tgttggtacactagccaggtttttt

SEQ ID NO: 545643 - DNA, 25 bp, Homo sapien
tattctttgcagctttctacatccc

SEQ ID NO: 545644 - DNA, 25 bp, Homo sapien
aaacgagatgtttcaaaatcaccat

SEQ ID NO: 545645 - DNA, 25 bp, Homo sapien
atctgatagcttcatacctaatggg

SEQ ID NO: 545646 - DNA, 25 bp, Homo sapien
ttcctgtgctcaggcaaaggtgaga

SEQ ID NO: 545647 - DNA, 25 bp, Homo sapien
gcaaaggtgagaaacgccatgtgtc

SEQ ID NO: 545648 - DNA, 25 bp, Homo sapien
agaaacgccatgtgtctcgtgtctc

SEQ ID NO: 545649 - DNA, 25 bp, Homo sapien
ccaggactgctgcttgggtttcttt

SEQ ID NO: 545650 - DNA, 25 bp, Homo sapien
ggactgctgcttgggtttcttttac

SEQ ID NO: 545651 - DNA, 25 bp, Homo sapien
ggtttcttttacatgagacagaaag

SEQ ID NO: 545652 - DNA, 25 bp, Homo sapien
gaaagaaatttgtgtcttgtgttaa

SEQ ID NO: 545653 - DNA, 25 bp, Homo sapien
tgtgtcttgtgttaaatgactgtta

SEQ ID NO: 545654 - DNA, 25 bp, Homo sapien
gactgttatttcagttctctgttac

SEQ ID NO: 545655 - DNA, 25 bp, Homo sapien
gttatttcagttctctgttacttgc

SEQ ID NO: 545656 - DNA, 25 bp, Homo sapien
atttcagttctctgttacttgcagc

SEQ ID NO: 545657 - DNA, 25 bp, Homo sapien
ggagagacaaatggcgcttcctcca

SEQ ID NO: 545658 - DNA, 25 bp, Homo sapien
gcttcctccagttttctgctgcgga

SEQ ID NO: 545659 - DNA, 25 bp, Homo sapien
tcctccagttttctgctgcggatgc

SEQ ID NO: 545660 - DNA, 25 bp, Homo sapien
ttctcagtccccttcaatttgtaga

SEQ ID NO: 545661 - DNA, 25 bp, Homo sapien
aatttgtagactcttgctcctgctt

SEQ ID NO: 545662 - DNA, 25 bp, Homo sapien
gacattccagtagaagttttttgct

SEQ ID NO: 545663 - DNA, 25 bp, Homo sapien
tgctttgtcggtggctgtcgtgaaa

SEQ ID NO: 545664 - DNA, 25 bp, Homo sapien
gtggctgtcgtgaaattgtgcttgt

SEQ ID NO: 545665 - DNA, 25 bp, Homo sapien
attgtgcttgtgtttcgtgatttct

SEQ ID NO: 545666 - DNA, 25 bp, Homo sapien
gggtgattgtctcgcttgttttcag

SEQ ID NO: 545667 - DNA, 25 bp, Homo sapien
cttgttttcagttgtcgattatatg

SEQ ID NO: 545668 - DNA, 25 bp, Homo sapien
gttgtcgattatatgggagggttct

SEQ ID NO: 545669 - DNA, 25 bp, Homo sapien
gggcctagagctctaattgtttgtt

SEQ ID NO: 545670 - DNA, 25 bp, Homo sapien
gagctctaattgtttgttttggaag

SEQ ID NO: 545671 - DNA, 25 bp, Homo sapien
agaaattcataaccctctggctgtg

SEQ ID NO: 545672 - DNA, 25 bp, Homo sapien
tctggctgtgggacagtatgtcaac

SEQ ID NO: 545673 - DNA, 25 bp, Homo sapien
acaattgttccaatgacagagcagc

SEQ ID NO: 545674 - DNA, 25 bp, Homo sapien
gagcagctaatgtctgttatcagga

SEQ ID NO: 545675 - DNA, 25 bp, Homo sapien
aggaatttgatgtgcctgcagtttt

SEQ ID NO: 545676 - DNA, 25 bp, Homo sapien
gttttccctatagaactgaagcagt

SEQ ID NO: 545677 - DNA, 25 bp, Homo sapien
gaagcagtatcttccaaacattgcc

SEQ ID NO: 545678 - DNA, 25 bp, Homo sapien
cgatgtgttgttcttgtcgcactta

SEQ ID NO: 545679 - DNA, 25 bp, Homo sapien
gtcgcacttagggacatcaatcaag

SEQ ID NO: 545680 - DNA, 25 bp, Homo sapien
aattgtcagctaactctgtgaatca

SEQ ID NO: 545681 - DNA, 25 bp, Homo sapien
aaattattaggttttctactcagct

SEQ ID NO: 545682 - DNA, 25 bp, Homo sapien
ggtcttagagcagcactgttctttt

SEQ ID NO: 545683 - DNA, 25 bp, Homo sapien
gcagccagctcctcaatgggcggtg

SEQ ID NO: 545684 - DNA, 25 bp, Homo sapien
tagagcagcactgttcttttcccct

SEQ ID NO: 545685 - DNA, 25 bp, Homo sapien
tcaatgggcggtgcctccaaatcta

SEQ ID NO: 545686 - DNA, 25 bp, Homo sapien
ggcggtgcctccaaatctaaagaat

SEQ ID NO: 545687 - DNA, 25 bp, Homo sapien
aaagaatatggaggtcctggagcac

SEQ ID NO: 545688 - DNA, 25 bp, Homo sapien
aggtcctggagcacaccaagaaatg

SEQ ID NO: 545689 - DNA, 25 bp, Homo sapien
aatgagggactttttctttgcagaa

SEQ ID NO: 545690 - DNA, 25 bp, Homo sapien
gaaagtttgaattctgtcttaatga

SEQ ID NO: 545691 - DNA, 25 bp, Homo sapien
gtcttaatgagacagaatgccatac

SEQ ID NO: 545692 - DNA, 25 bp, Homo sapien
gacagaatgccatacttgagcacct

SEQ ID NO: 545693 - DNA, 25 bp, Homo sapien
tcctgtaaagttgcttttaataagt

SEQ ID NO: 545694 - DNA, 25 bp, Homo sapien
gtaaagttgcttttaataagtatca

SEQ ID NO: 545695 - DNA, 25 bp, Homo sapien
agttgcttttaataagtatcaaatt

SEQ ID NO: 545696 - DNA, 25 bp, Homo sapien
tcaaattttctgtatgatcatgtaa

SEQ ID NO: 545697 - DNA, 25 bp, Homo sapien
aaattttctgtatgatcatgtaaaa

SEQ ID NO: 545698 - DNA, 25 bp, Homo sapien
taaatatgcagattttagagttaca

SEQ ID NO: 545699 - DNA, 25 bp, Homo sapien
atttttcatctgaatggagacttta

SEQ ID NO: 545700 - DNA, 25 bp, Homo sapien
tttcatctgaatggagactttattt

SEQ ID NO: 545701 - DNA, 25 bp, Homo sapien
ttcatctgaatggagactttatttg

SEQ ID NO: 545702 - DNA, 25 bp, Homo sapien
catctgaatggagactttatttggg

SEQ ID NO: 545703 - DNA, 25 bp, Homo sapien
actgatatttagtttgagaatgact

SEQ ID NO: 545704 - DNA, 25 bp, Homo sapien
ataccccataattgcccattatata

SEQ ID NO: 545705 - DNA, 25 bp, Homo sapien
ttgcccattatataccaaagacaat

SEQ ID NO: 545706 - DNA, 25 bp, Homo sapien
agacaatatctcaagttatctcatt

SEQ ID NO: 545707 - DNA, 25 bp, Homo sapien
ttatctcattgtagcagtgtctgtg

SEQ ID NO: 545708 - DNA, 25 bp, Homo sapien
gtgtctgtgagtcaaaacttcaatt

SEQ ID NO: 545709 - DNA, 25 bp, Homo sapien
attcatgtactcactactcatgtag

SEQ ID NO: 545710 - DNA, 25 bp, Homo sapien
ctactcatgtagttactgtatcttt

SEQ ID NO: 545711 - DNA, 25 bp, Homo sapien
aaggttggaaatcatatggcaaatc

SEQ ID NO: 545712 - DNA, 25 bp, Homo sapien
tatggcaaatcacatgttcctcagc

SEQ ID NO: 545713 - DNA, 25 bp, Homo sapien
gttcctcagcctcaaggtgtgttta

SEQ ID NO: 545714 - DNA, 25 bp, Homo sapien
gcctcaaggtgtgtttagttgtgaa

SEQ ID NO: 545715 - DNA, 25 bp, Homo sapien
ttaatccatggttggttaaatctgt

SEQ ID NO: 545716 - DNA, 25 bp, Homo sapien
ttaaatctgtagatatagagggcca

SEQ ID NO: 545717 - DNA, 25 bp, Homo sapien
gggccaactgtactgttagacacaa

SEQ ID NO: 545718 - DNA, 25 bp, Homo sapien
gcatttgcatatacctaccaccctt

SEQ ID NO: 545719 - DNA, 25 bp, Homo sapien
tagacacaagggtctcgaggcttgc

SEQ ID NO: 545720 - DNA, 25 bp, Homo sapien
acaagggtctcgaggcttgcagata

SEQ ID NO: 545721 - DNA, 25 bp, Homo sapien
gatagagactgaataaccctctcca

SEQ ID NO: 545722 - DNA, 25 bp, Homo sapien
actgaataaccctctccatgatgat

SEQ ID NO: 545723 - DNA, 25 bp, Homo sapien
ccatgatgatcccttagagttcccc

SEQ ID NO: 545724 - DNA, 25 bp, Homo sapien
tcccatatacttttaatcacctctg

SEQ ID NO: 545725 - DNA, 25 bp, Homo sapien
cttttaatcacctctggattaccta

SEQ ID NO: 545726 - DNA, 25 bp, Homo sapien
agtcttgaattttattataatcccg

SEQ ID NO: 545727 - DNA, 25 bp, Homo sapien
tcttgaattttattataatcccgtg

SEQ ID NO: 545728 - DNA, 25 bp, Homo sapien
atttactttgctgtatgatggagta

SEQ ID NO: 545729 - DNA, 25 bp, Homo sapien
tttactttgctgtatgatggagtac

SEQ ID NO: 545730 - DNA, 25 bp, Homo sapien
ttactttgctgtatgatggagtact

SEQ ID NO: 545731 - DNA, 25 bp, Homo sapien
actttgctgtatgatggagtacttt

SEQ ID NO: 545732 - DNA, 25 bp, Homo sapien
ctttgctgtatgatggagtactttc

SEQ ID NO: 545733 - DNA, 25 bp, Homo sapien
tttgctgtatgatggagtactttcc

SEQ ID NO: 545734 - DNA, 25 bp, Homo sapien
tgctgtatgatggagtactttccat

SEQ ID NO: 545735 - DNA, 25 bp, Homo sapien
gctgtatgatggagtactttccatt

SEQ ID NO: 545736 - DNA, 25 bp, Homo sapien
ctgtatgatggagtactttccattt

SEQ ID NO: 545737 - DNA, 25 bp, Homo sapien
aaacttgaccttgaacagagctgga

SEQ ID NO: 545738 - DNA, 25 bp, Homo sapien
ggaagatattcttgggagccccata

SEQ ID NO: 545739 - DNA, 25 bp, Homo sapien
ttgggagccccatattctacctcag

SEQ ID NO: 545740 - DNA, 25 bp, Homo sapien
cccatattctacctcagttaccgaa

SEQ ID NO: 545741 - DNA, 25 bp, Homo sapien
tgaaatcctaagcacaacttcagaa

SEQ ID NO: 545742 - DNA, 25 bp, Homo sapien
gaaaaccatgtctgatagcggatgt

SEQ ID NO: 545743 - DNA, 25 bp, Homo sapien
atagcggatgtcttcctgctgtgag

SEQ ID NO: 545744 - DNA, 25 bp, Homo sapien
ttcctgctgtgaggagctgcttgat

SEQ ID NO: 545745 - DNA, 25 bp, Homo sapien
gtgggcggaatgtatcctagtagaa

SEQ ID NO: 545746 - DNA, 25 bp, Homo sapien
gtatcctagtagaaacagtgaacct

SEQ ID NO: 545747 - DNA, 25 bp, Homo sapien
gaaacagtgaacctcagatatgaat

SEQ ID NO: 545748 - DNA, 25 bp, Homo sapien
aggaaaactgactacacaaacattg

SEQ ID NO: 545749 - DNA, 25 bp, Homo sapien
agaagcagaaagaagactcattggc

SEQ ID NO: 545750 - DNA, 25 bp, Homo sapien
atactgttatattttcttctaggcc

SEQ ID NO: 545751 - DNA, 25 bp, Homo sapien
tttcttctaggcctttttctatgaa

SEQ ID NO: 545752 - DNA, 25 bp, Homo sapien
atagattttgccaccgtggtatcct

SEQ ID NO: 545753 - DNA, 25 bp, Homo sapien
cgtggtatcctactatgcacactgt

SEQ ID NO: 545754 - DNA, 25 bp, Homo sapien
cacactgttttcttataatctgctt

SEQ ID NO: 545755 - DNA, 25 bp, Homo sapien
aatctgcttttgcacttaactgtac

SEQ ID NO: 545756 - DNA, 25 bp, Homo sapien
gcttttgcacttaactgtacattgt

SEQ ID NO: 545757 - DNA, 25 bp, Homo sapien
ctgtacattgtgaacctctttccat

SEQ ID NO: 545758 - DNA, 25 bp, Homo sapien
cattgtgaacctctttccatgtcaa

SEQ ID NO: 545759 - DNA, 25 bp, Homo sapien
tataaaagtcacatctgcatcttcc

SEQ ID NO: 545760 - DNA, 25 bp, Homo sapien
tgcatcttccaacttatggtacagt

SEQ ID NO: 545761 - DNA, 25 bp, Homo sapien
atgggaatttggaagcacccctgga

SEQ ID NO: 545762 - DNA, 25 bp, Homo sapien
aagcacccctggagcaaagaggcta

SEQ ID NO: 545763 - DNA, 25 bp, Homo sapien
ggctagggatagcattaacatctcc

SEQ ID NO: 545764 - DNA, 25 bp, Homo sapien
catctcccaagacaagtggtatagg

SEQ ID NO: 545765 - DNA, 25 bp, Homo sapien
ttcctctcctctaattctgaactta

SEQ ID NO: 545766 - DNA, 25 bp, Homo sapien
gtggccatgtatatgccaggcgtta

SEQ ID NO: 545767 - DNA, 25 bp, Homo sapien
tgccaggcgttaatacatcagagct

SEQ ID NO: 545768 - DNA, 25 bp, Homo sapien
tcagagctgcctgtatttaatttaa

SEQ ID NO: 545769 - DNA, 25 bp, Homo sapien
gtagcttattgttctatccagtaga

SEQ ID NO: 545770 - DNA, 25 bp, Homo sapien
tcctgtaaagttgcttttaataagt

SEQ ID NO: 545771 - DNA, 25 bp, Homo sapien
gtaaagttgcttttaataagtatca

SEQ ID NO: 545772 - DNA, 25 bp, Homo sapien
agttgcttttaataagtatcaaatt

SEQ ID NO: 545773 - DNA, 25 bp, Homo sapien
tcaaattttctgtatgatcatgtaa

SEQ ID NO: 545774 - DNA, 25 bp, Homo sapien
attcataatttgtgcaaagcagagg

SEQ ID NO: 545775 - DNA, 25 bp, Homo sapien
taaatatgcagattttagagttaca

SEQ ID NO: 545776 - DNA, 25 bp, Homo sapien
atttttcatctgaatggagacttta

SEQ ID NO: 545777 - DNA, 25 bp, Homo sapien
tttcatctgaatggagactttattt

SEQ ID NO: 545778 - DNA, 25 bp, Homo sapien
catctgaatggagactttatttggg

SEQ ID NO: 545779 - DNA, 25 bp, Homo sapien
actgatatttagtttgagaatgact

SEQ ID NO: 545780 - DNA, 25 bp, Homo sapien
tagtttgagaatgactttgtttact

SEQ ID NO: 545781 - DNA, 25 bp, Homo sapien
gattggaagaatttatgctacttcg

SEQ ID NO: 545782 - DNA, 25 bp, Homo sapien
gcgcctaacaaatgtggatgtctgt

SEQ ID NO: 545783 - DNA, 25 bp, Homo sapien
ggatgtctgtattatactgatacta

SEQ ID NO: 545784 - DNA, 25 bp, Homo sapien
caatagttagcaaagaaggccattt

SEQ ID NO: 545785 - DNA, 25 bp, Homo sapien
attcaatacttaccatataccatac

SEQ ID NO: 545786 - DNA, 25 bp, Homo sapien
tataccatacactagatagtaggtg

SEQ ID NO: 545787 - DNA, 25 bp, Homo sapien
aggtggatgtaaagatgcagttcct

SEQ ID NO: 545788 - DNA, 25 bp, Homo sapien
gggacatgtcttgacagtctttgta

SEQ ID NO: 545789 - DNA, 25 bp, Homo sapien
gtcttgacagtctttgtattcctgt

SEQ ID NO: 545790 - DNA, 25 bp, Homo sapien
gtattcctgttgtttagcatagtac

SEQ ID NO: 545791 - DNA, 25 bp, Homo sapien
cctgttgtttagcatagtactggca

SEQ ID NO: 545792 - DNA, 25 bp, Homo sapien
cagtcgccagcccctggtactaggg

SEQ ID NO: 545793 - DNA, 25 bp, Homo sapien
caattgctttgctgacttggtgcac

SEQ ID NO: 545794 - DNA, 25 bp, Homo sapien
attgctttgctgacttggtgcacaa

SEQ ID NO: 545795 - DNA, 25 bp, Homo sapien
acttggtgcacaactggatggagct

SEQ ID NO: 545796 - DNA, 25 bp, Homo sapien
caactggatggagctgcctgagaca

SEQ ID NO: 545797 - DNA, 25 bp, Homo sapien
gggtgacggaggtgggcaccgtgcc

SEQ ID NO: 545798 - DNA, 25 bp, Homo sapien
tctctgagcagcttcggcgccggct

SEQ ID NO: 545799 - DNA, 25 bp, Homo sapien
agggctcggcggacagctatggcag

SEQ ID NO: 545800 - DNA, 25 bp, Homo sapien
agacgcctgcctggagcactggcag

SEQ ID NO: 545801 - DNA, 25 bp, Homo sapien
agaggactggacagcagccctactg

SEQ ID NO: 545802 - DNA, 25 bp, Homo sapien
tggacagcagccctactgaacaggg

SEQ ID NO: 545803 - DNA, 25 bp, Homo sapien
attgtacaaccgattgtgaagctct

SEQ ID NO: 545804 - DNA, 25 bp, Homo sapien
accgattgtgaagctctagtgtgaa

SEQ ID NO: 545805 - DNA, 25 bp, Homo sapien
gctctagtgtgaatatttttacgtc

SEQ ID NO: 545806 - DNA, 25 bp, Homo sapien
gaatatttttacgtctgtattagac

SEQ ID NO: 545807 - DNA, 25 bp, Homo sapien
ctttgcaaatctattgttcgattga

SEQ ID NO: 545808 - DNA, 25 bp, Homo sapien
tggtgtacacccatcatgtaaaaag

SEQ ID NO: 545809 - DNA, 25 bp, Homo sapien
tcatgtaaaaagcaggcaccatctc

SEQ ID NO: 545810 - DNA, 25 bp, Homo sapien
gcaggcaccatctctaagatggatt

SEQ ID NO: 545811 - DNA, 25 bp, Homo sapien
gatggatttaatgctcatttttaag

SEQ ID NO: 545812 - DNA, 25 bp, Homo sapien
ttttaaggcatatactcagcttcta

SEQ ID NO: 545813 - DNA, 25 bp, Homo sapien
ggcatatactcagcttctatttaaa

SEQ ID NO: 545814 - DNA, 25 bp, Homo sapien
tgaggatccatttgtggaactgaat

SEQ ID NO: 545815 - DNA, 25 bp, Homo sapien
gtggaactgaatttaatgagacttc

SEQ ID NO: 545816 - DNA, 25 bp, Homo sapien
gagacttcattggtgatacactcaa

SEQ ID NO: 545817 - DNA, 25 bp, Homo sapien
gtgatacactcaatttttactgggt

SEQ ID NO: 545818 - DNA, 25 bp, Homo sapien
gctaataatgttggtcactgtctca

SEQ ID NO: 545819 - DNA, 25 bp, Homo sapien
agtagctttaagatgatgtggcaag

SEQ ID NO: 545820 - DNA, 25 bp, Homo sapien
acacaaagcttttgggtaaccagcg

SEQ ID NO: 545821 - DNA, 25 bp, Homo sapien
gggtaaccagcgttcttaaatgtat

SEQ ID NO: 545822 - DNA, 25 bp, Homo sapien
cagcgttcttaaatgtatggttttt

SEQ ID NO: 545823 - DNA, 25 bp, Homo sapien
tatggtttttgaccaggtgaaccct

SEQ ID NO: 545824 - DNA, 25 bp, Homo sapien
accaggtgaaccctttagaagtgat

SEQ ID NO: 545825 - DNA, 25 bp, Homo sapien
gaccctcatcctcagtgaagttaga

SEQ ID NO: 545826 - DNA, 25 bp, Homo sapien
gaagttagatgaccattcctgcctt

SEQ ID NO: 545827 - DNA, 25 bp, Homo sapien
tcatcccaccgattttcctaagtat

SEQ ID NO: 545828 - DNA, 25 bp, Homo sapien
tcctaagtatctgttgcctgcaact

SEQ ID NO: 545829 - DNA, 25 bp, Homo sapien
gcctgcaactaacactagttcctgt

SEQ ID NO: 545830 - DNA, 25 bp, Homo sapien
gtaaagtactgcacttggttgcaaa

SEQ ID NO: 545831 - DNA, 25 bp, Homo sapien
agagatggactctgccaacataggc

SEQ ID NO: 545832 - DNA, 25 bp, Homo sapien
gccaacataggcacggaaggtttac

SEQ ID NO: 545833 - DNA, 25 bp, Homo sapien
gatgtgatgagaaagccccggaaga

SEQ ID NO: 545834 - DNA, 25 bp, Homo sapien
tggatgtaaatacaggctgccctgg

SEQ ID NO: 545835 - DNA, 25 bp, Homo sapien
gaactcatgggattttcgcgaccct

SEQ ID NO: 545836 - DNA, 25 bp, Homo sapien
tttgctttattgacatactaggctt

SEQ ID NO: 545837 - DNA, 25 bp, Homo sapien
gacctgtgtgtgtaacaagcaagcc

SEQ ID NO: 545838 - DNA, 25 bp, Homo sapien
atagcaccatggttagactagcctg

SEQ ID NO: 545839 - DNA, 25 bp, Homo sapien
ggttagactagcctgcttttccaag

SEQ ID NO: 545840 - DNA, 25 bp, Homo sapien
cctgcttttccaagccatcatttta

SEQ ID NO: 545841 - DNA, 25 bp, Homo sapien
agggatcaaatgtctctccatccac

SEQ ID NO: 545842 - DNA, 25 bp, Homo sapien
catccacctgatgtgatctttttat

SEQ ID NO: 545843 - DNA, 25 bp, Homo sapien
acacagctaatgagttccattcagc

SEQ ID NO: 545844 - DNA, 25 bp, Homo sapien
gagttccattcagctgaaaatcttt

SEQ ID NO: 545845 - DNA, 25 bp, Homo sapien
aagctttaaagatgagcccatgaat

SEQ ID NO: 545846 - DNA, 25 bp, Homo sapien
atgaattcactttaaatttcaccag

SEQ ID NO: 545847 - DNA, 25 bp, Homo sapien
tgcatgggacccataacccagtgca

SEQ ID NO: 545848 - DNA, 25 bp, Homo sapien
gtgcacggcaaggacccagcaggaa

SEQ ID NO: 545849 - DNA, 25 bp, Homo sapien
acccaggacctgacgggcacttaga

SEQ ID NO: 545850 - DNA, 25 bp, Homo sapien
tgacgggcacttagacacacacagt

SEQ ID NO: 545851 - DNA, 25 bp, Homo sapien
acacacagtggcctgagctccaact

SEQ ID NO: 545852 - DNA, 25 bp, Homo sapien
ggcctgagctccaactccagcatga

SEQ ID NO: 545853 - DNA, 25 bp, Homo sapien
atgaccacgcgggagcttcagcagt

SEQ ID NO: 545854 - DNA, 25 bp, Homo sapien
gcttcagcagtactggcagaaccag

SEQ ID NO: 545855 - DNA, 25 bp, Homo sapien
agaaatgccgctggaagcacgtcaa

SEQ ID NO: 545856 - DNA, 25 bp, Homo sapien
ggaagcacgtcaaactgctctttga

SEQ ID NO: 545857 - DNA, 25 bp, Homo sapien
gcttcagctcgcatcgaggagagaa

SEQ ID NO: 545858 - DNA, 25 bp, Homo sapien
tgagtagaccaacactctcctgtcc

SEQ ID NO: 545859 - DNA, 25 bp, Homo sapien
cagcagatgaagacacaaccagaga

SEQ ID NO: 545860 - DNA, 25 bp, Homo sapien
caaccagagaggactaacaggcccc

SEQ ID NO: 545861 - DNA, 25 bp, Homo sapien
gggcagagcaacacagaatagacat

SEQ ID NO: 545862 - DNA, 25 bp, Homo sapien
ggaacagactttgaggccaggcagc

SEQ ID NO: 545863 - DNA, 25 bp, Homo sapien
aggcagccttgggtgtgcatctgtc

SEQ ID NO: 545864 - DNA, 25 bp, Homo sapien
atctgtccctactaagccatgtgac

SEQ ID NO: 545865 - DNA, 25 bp, Homo sapien
gagccaaggactgtactgcagtgca

SEQ ID NO: 545866 - DNA, 25 bp, Homo sapien
tgaggccagaaaggctgagacaact

SEQ ID NO: 545867 - DNA, 25 bp, Homo sapien
gaaaacctcccttctggctaatagt

SEQ ID NO: 545868 - DNA, 25 bp, Homo sapien
aatagtcaagcaccgcctgagtaga

SEQ ID NO: 545869 - DNA, 25 bp, Homo sapien
cactgcagatactggatgagcattt

SEQ ID NO: 545870 - DNA, 25 bp, Homo sapien
ggatgagcatttcctacaccatcag

SEQ ID NO: 545871 - DNA, 25 bp, Homo sapien
catttcctacaccatcagatttcat

SEQ ID NO: 545872 - DNA, 25 bp, Homo sapien
atttcatggaccttggagcttggca

SEQ ID NO: 545873 - DNA, 25 bp, Homo sapien
gagcttggcaaagaacagagactta

SEQ ID NO: 545874 - DNA, 25 bp, Homo sapien
tggtttcatcatagcccataactga

SEQ ID NO: 545875 - DNA, 25 bp, Homo sapien
atagcccataactgatcttactgat

SEQ ID NO: 545876 - DNA, 25 bp, Homo sapien
gatcttactgatcttttctttcaga

SEQ ID NO: 545877 - DNA, 25 bp, Homo sapien
cgggccaggccggattttcagcagc

SEQ ID NO: 545878 - DNA, 25 bp, Homo sapien
gccggattttcagcagccgtaaagc

SEQ ID NO: 545879 - DNA, 25 bp, Homo sapien
ttttcagcagccgtaaagcgggaga

SEQ ID NO: 545880 - DNA, 25 bp, Homo sapien
tgcgcgcactgcgcctggagaactg

SEQ ID NO: 545881 - DNA, 25 bp, Homo sapien
cgcctggagaactgcgcgcgcgtca

SEQ ID NO: 545882 - DNA, 25 bp, Homo sapien
acgggcgcgcgctgcagacattgca

SEQ ID NO: 545883 - DNA, 25 bp, Homo sapien
ctgcagacattgcacgtggacttct

SEQ ID NO: 545884 - DNA, 25 bp, Homo sapien
agacattgcacgtggacttctgccg

SEQ ID NO: 545885 - DNA, 25 bp, Homo sapien
attgcacgtggacttctgccgcaac

SEQ ID NO: 545886 - DNA, 25 bp, Homo sapien
acgtggacttctgccgcaacgtgag

SEQ ID NO: 545887 - DNA, 25 bp, Homo sapien
gacttctgccgcaacgtgagcgcgg

SEQ ID NO: 545888 - DNA, 25 bp, Homo sapien
gggcagagcacagcgccgccatgct

SEQ ID NO: 545889 - DNA, 25 bp, Homo sapien
ctcggcaagctgctgcagcgctaga

SEQ ID NO: 545890 - DNA, 25 bp, Homo sapien
gcaagctgctgcagcgctagacgcc

SEQ ID NO: 545891 - DNA, 25 bp, Homo sapien
tctggaaaacgggaaccagctttct

SEQ ID NO: 545892 - DNA, 25 bp, Homo sapien
gttttcaccaacctgttgctcgctc

SEQ ID NO: 545893 - DNA, 25 bp, Homo sapien
cgcgcacagccaaggccagtaggtg

SEQ ID NO: 545894 - DNA, 25 bp, Homo sapien
tgtgtttctacgatcgctccaggcg

SEQ ID NO: 545895 - DNA, 25 bp, Homo sapien
tttctacgatcgctccaggcgctgt

SEQ ID NO: 545896 - DNA, 25 bp, Homo sapien
acgatcgctccaggcgctgtcttta

SEQ ID NO: 545897 - DNA, 25 bp, Homo sapien
tcgctccaggcgctgtctttactct

SEQ ID NO: 545898 - DNA, 25 bp, Homo sapien
aggcgctgtctttactctccacttc

SEQ ID NO: 545899 - DNA, 25 bp, Homo sapien
ttctcgaagtgccaaccgcggcctt

SEQ ID NO: 545900 - DNA, 25 bp, Homo sapien
tcgaagtgccaaccgcggcctttca

SEQ ID NO: 545901 - DNA, 25 bp, Homo sapien
aaccgcggcctttcaagctctgggc

SEQ ID NO: 545902 - DNA, 25 bp, Homo sapien
agccagcttcttctgcatctgaggg

SEQ ID NO: 545903 - DNA, 25 bp, Homo sapien
acagatgtcttctagctgagtttct

SEQ ID NO: 545904 - DNA, 25 bp, Homo sapien
agctgagtttctaaccgcatgatga

SEQ ID NO: 545905 - DNA, 25 bp, Homo sapien
atgatgagactcagaccttccgctg

SEQ ID NO: 545906 - DNA, 25 bp, Homo sapien
accttccgctgcactagaaaatctg

SEQ ID NO: 545907 - DNA, 25 bp, Homo sapien
aaatctgcaacagtgtccctgagtc

SEQ ID NO: 545908 - DNA, 25 bp, Homo sapien
gagtcacttctccttagtgggcaga

SEQ ID NO: 545909 - DNA, 25 bp, Homo sapien
gtgggcagactcgtgttagatttgt

SEQ ID NO: 545910 - DNA, 25 bp, Homo sapien
aaacgacgcaaatctctgagctggg

SEQ ID NO: 545911 - DNA, 25 bp, Homo sapien
gaaccggcttagtaacagtcctgat

SEQ ID NO: 545912 - DNA, 25 bp, Homo sapien
taacagtcctgatcttcgcaagcca

SEQ ID NO: 545913 - DNA, 25 bp, Homo sapien
ttcaatgccacctgcctcaacaatg

SEQ ID NO: 545914 - DNA, 25 bp, Homo sapien
aatgccacctgcctcaacaatgagg

SEQ ID NO: 545915 - DNA, 25 bp, Homo sapien
atgccacctgcctcaacaatgaggt

SEQ ID NO: 545916 - DNA, 25 bp, Homo sapien
gccacctgcctcaacaatgaggtca

SEQ ID NO: 545917 - DNA, 25 bp, Homo sapien
gcctcaacaatgaggtcatccctgg

SEQ ID NO: 545918 - DNA, 25 bp, Homo sapien
ctggcctcaagtcttgtatgggact

SEQ ID NO: 545919 - DNA, 25 bp, Homo sapien
tggcctcaagtcttgtatgggactc

SEQ ID NO: 545920 - DNA, 25 bp, Homo sapien
gcctcaagtcttgtatgggactcaa

SEQ ID NO: 545921 - DNA, 25 bp, Homo sapien
gtatgggactcaagattggagacac

SEQ ID NO: 545922 - DNA, 25 bp, Homo sapien
tgggactcaagattggagacacggt

SEQ ID NO: 545923 - DNA, 25 bp, Homo sapien
ggactcaagattggagacacggtga

SEQ ID NO: 545924 - DNA, 25 bp, Homo sapien
ctagagattctctgtaatattggta

SEQ ID NO: 545925 - DNA, 25 bp, Homo sapien
tagagattctctgtaatattggtaa

SEQ ID NO: 545926 - DNA, 25 bp, Homo sapien
tgtaatattggtaatttggatgaag

SEQ ID NO: 545927 - DNA, 25 bp, Homo sapien
taatattggtaatttggatgaagga

SEQ ID NO: 545928 - DNA, 25 bp, Homo sapien
aatattggtaatttggatgaaggaa

SEQ ID NO: 545929 - DNA, 25 bp, Homo sapien
atattggtaatttggatgaaggaag

SEQ ID NO: 545930 - DNA, 25 bp, Homo sapien
tattggtaatttggatgaaggaagc

SEQ ID NO: 545931 - DNA, 25 bp, Homo sapien
attggtaatttggatgaaggaagct

SEQ ID NO: 545932 - DNA, 25 bp, Homo sapien
ttggtaatttggatgaaggaagcta

SEQ ID NO: 545933 - DNA, 25 bp, Homo sapien
tggtaatttggatgaaggaagctag

SEQ ID NO: 545934 - DNA, 25 bp, Homo sapien
aactatattctgtctgcattctatt

SEQ ID NO: 545935 - DNA, 25 bp, Homo sapien
tattcttcatgcgtaggtttctact

SEQ ID NO: 545936 - DNA, 25 bp, Homo sapien
ggtttctactagaacctgtggaggg

SEQ ID NO: 545937 - DNA, 25 bp, Homo sapien
atttagattgagtcagtccatgctg

SEQ ID NO: 545938 - DNA, 25 bp, Homo sapien
cagtccatgctgataagaagcgtga

SEQ ID NO: 545939 - DNA, 25 bp, Homo sapien
aagcgtgaggaccttgttggacaca

SEQ ID NO: 545940 - DNA, 25 bp, Homo sapien
gaccttgttggacacagagcttcta

SEQ ID NO: 545941 - DNA, 25 bp, Homo sapien
tagatctttccacctgtagcctcta

SEQ ID NO: 545942 - DNA, 25 bp, Homo sapien
gttagtttcttctcaagatgccttt

SEQ ID NO: 545943 - DNA, 25 bp, Homo sapien
actttacctgaaactgtgcctctgg

SEQ ID NO: 545944 - DNA, 25 bp, Homo sapien
gcctttttggctgaacattaccatt

SEQ ID NO: 545945 - DNA, 25 bp, Homo sapien
ggatgtctaagaggcatatgctgct

SEQ ID NO: 545946 - DNA, 25 bp, Homo sapien
gcatatgctgctttggaggtgtagt

SEQ ID NO: 545947 - DNA, 25 bp, Homo sapien
atgctgctttggaggtgtagtgaac

SEQ ID NO: 545948 - DNA, 25 bp, Homo sapien
agtgaacgtgtgtacagaagttttc

SEQ ID NO: 545949 - DNA, 25 bp, Homo sapien
gtgtacagaagttttcaatcttaac

SEQ ID NO: 545950 - DNA, 25 bp, Homo sapien
tgtgatgctatactattggaaaaat

SEQ ID NO: 545951 - DNA, 25 bp, Homo sapien
ttcatttataaactgccttcttcaa

SEQ ID NO: 545952 - DNA, 25 bp, Homo sapien
ataaactgccttcttcaacacatgt

SEQ ID NO: 545953 - DNA, 25 bp, Homo sapien
actgccttcttcaacacatgttaat

SEQ ID NO: 545954 - DNA, 25 bp, Homo sapien
gtattgatagtatgtcttccagaat

SEQ ID NO: 545955 - DNA, 25 bp, Homo sapien
tgcttacagtaaatatttcctagct

SEQ ID NO: 545956 - DNA, 25 bp, Homo sapien
aggagccacaaagtgagttgctaga

SEQ ID NO: 545957 - DNA, 25 bp, Homo sapien
agttgctagaacctgtctgtcacca

SEQ ID NO: 545958 - DNA, 25 bp, Homo sapien
tctgtcaccagctctttgaattcta

SEQ ID NO: 545959 - DNA, 25 bp, Homo sapien
gctctttgaattctatcgcagtgga

SEQ ID NO: 545960 - DNA, 25 bp, Homo sapien
tctatcgcagtggagaggagcagtt

SEQ ID NO: 545961 - DNA, 25 bp, Homo sapien
ggagcagttgcttcaatttacgctg

SEQ ID NO: 545962 - DNA, 25 bp, Homo sapien
atttacgctgcaatttctcccagaa

SEQ ID NO: 545963 - DNA, 25 bp, Homo sapien
atttctcccagaactaatttggtgc

SEQ ID NO: 545964 - DNA, 25 bp, Homo sapien
aatttggtgctaccttgcagtctca

SEQ ID NO: 545965 - DNA, 25 bp, Homo sapien
tgcagtctcagccagcagaaatgtg

SEQ ID NO: 545966 - DNA, 25 bp, Homo sapien
catagcagtggatgcattgaagctc

SEQ ID NO: 545967 - DNA, 25 bp, Homo sapien
aagtgcagagcttcataatctcctt

SEQ ID NO: 545968 - DNA, 25 bp, Homo sapien
cataatctcctttggttaaatttct

SEQ ID NO: 545969 - DNA, 25 bp, Homo sapien
aatttctacctattagtgtcagact

SEQ ID NO: 545970 - DNA, 25 bp, Homo sapien
gtgtcagactatattctggttcagt

SEQ ID NO: 545971 - DNA, 25 bp, Homo sapien
ttgtactttgctcccatttctggtc

SEQ ID NO: 545972 - DNA, 25 bp, Homo sapien
gaggaaagtcctctcatggtcactg

SEQ ID NO: 545973 - DNA, 25 bp, Homo sapien
aaagtcctctcatggtcactgttcc

SEQ ID NO: 545974 - DNA, 25 bp, Homo sapien
accttggtagtgtagttctgtaact

SEQ ID NO: 545975 - DNA, 25 bp, Homo sapien
gttctgtaacttgattgtagtggtt

SEQ ID NO: 545976 - DNA, 25 bp, Homo sapien
atttctggtctctggattttaatcc

SEQ ID NO: 545977 - DNA, 25 bp, Homo sapien
tttccttccttctgagatggaactg

SEQ ID NO: 545978 - DNA, 25 bp, Homo sapien
gtgactgcctccaggccctcaagga

SEQ ID NO: 545979 - DNA, 25 bp, Homo sapien
aggccctcaaggacgaattccacca

SEQ ID NO: 545980 - DNA, 25 bp, Homo sapien
tcaaggacgaattccaccaggactt

SEQ ID NO: 545981 - DNA, 25 bp, Homo sapien
aggacgaattccaccaggacttgtc

SEQ ID NO: 545982 - DNA, 25 bp, Homo sapien
acgaattccaccaggacttgtcccg

SEQ ID NO: 545983 - DNA, 25 bp, Homo sapien
cgctgcccctcatcttagcattggg

SEQ ID NO: 545984 - DNA, 25 bp, Homo sapien
ccctcatcttagcattgggcagaca

SEQ ID NO: 545985 - DNA, 25 bp, Homo sapien
catcttagcattgggcagacaccag

SEQ ID NO: 545986 - DNA, 25 bp, Homo sapien
ttagcattgggcagacaccagggca

SEQ ID NO: 545987 - DNA, 25 bp, Homo sapien
ggaatatgagctcctggtgctgccc

SEQ ID NO: 545988 - DNA, 25 bp, Homo sapien
tggtgctgcccgaggccttcaccat

SEQ ID NO: 545989 - DNA, 25 bp, Homo sapien
tcccgatcgattgatgcctatgtgt

SEQ ID NO: 545990 - DNA, 25 bp, Homo sapien
cgatcgattgatgcctatgtgtgat

SEQ ID NO: 545991 - DNA, 25 bp, Homo sapien
atgtgtgatagtttgttacgccact

SEQ ID NO: 545992 - DNA, 25 bp, Homo sapien
gtttgttacgccactgaatgcttat

SEQ ID NO: 545993 - DNA, 25 bp, Homo sapien
aatgcttatgcccactttatttgaa

SEQ ID NO: 545994 - DNA, 25 bp, Homo sapien
ttgaaacagcttacatgaacatatg

SEQ ID NO: 545995 - DNA, 25 bp, Homo sapien
gcttacatgaacatatgtcaggatt

SEQ ID NO: 545996 - DNA, 25 bp, Homo sapien
gtaaatataagctttcagttcattc

SEQ ID NO: 545997 - DNA, 25 bp, Homo sapien
tcagttcattcactgttaccagagg

SEQ ID NO: 545998 - DNA, 25 bp, Homo sapien
gttaccagaggcagactctgaaagt

SEQ ID NO: 545999 - DNA, 25 bp, Homo sapien
ggcagactctgaaagttttgtttcc

SEQ ID NO: 546000 - DNA, 25 bp, Homo sapien
tagtgttaagatgctgcagttgtgt

SEQ ID NO: 546001 - DNA, 25 bp, Homo sapien
gaggagaacataattaccttcacaa

SEQ ID NO: 546002 - DNA, 25 bp, Homo sapien
attatttatagatacactgggtgag

SEQ ID NO: 546003 - DNA, 25 bp, Homo sapien
atacactgggtgagaagcttactgt

SEQ ID NO: 546004 - DNA, 25 bp, Homo sapien
aagcttactgtagggcagtcaccca

SEQ ID NO: 546005 - DNA, 25 bp, Homo sapien
tactgtagggcagtcacccaaaaaa

SEQ ID NO: 546006 - DNA, 25 bp, Homo sapien
atttgtatctattaccatggcagca

SEQ ID NO: 546007 - DNA, 25 bp, Homo sapien
atctattaccatggcagcagtgtct

SEQ ID NO: 546008 - DNA, 25 bp, Homo sapien
tgctgcacactgtgtcctattactg

SEQ ID NO: 546009 - DNA, 25 bp, Homo sapien
gcacactgtgtcctattactgtaaa

SEQ ID NO: 546010 - DNA, 25 bp, Homo sapien
acactgtgtcctattactgtaaatc

SEQ ID NO: 546011 - DNA, 25 bp, Homo sapien
ttgtagttggtcctaacccttcctg

SEQ ID NO: 546012 - DNA, 25 bp, Homo sapien
aacccttcctggcacagctatcaaa

SEQ ID NO: 546013 - DNA, 25 bp, Homo sapien
tcctggcacagctatcaaaagtaca

SEQ ID NO: 546014 - DNA, 25 bp, Homo sapien
gtacagctgtttaaccagaaccaag

SEQ ID NO: 546015 - DNA, 25 bp, Homo sapien
gtacatgaaacactagaggactgca

SEQ ID NO: 546016 - DNA, 25 bp, Homo sapien
gaggactgcatgtttttccctgaga

SEQ ID NO: 546017 - DNA, 25 bp, Homo sapien
gcatgtttttccctgagagaagcgt

SEQ ID NO: 546018 - DNA, 25 bp, Homo sapien
aaagtagtcactgggagcgccatcc

SEQ ID NO: 546019 - DNA, 25 bp, Homo sapien
cactgggagcgccatccttctaagc

SEQ ID NO: 546020 - DNA, 25 bp, Homo sapien
atccttctaagcaaatcctcccttt

SEQ ID NO: 546021 - DNA, 25 bp, Homo sapien
gggaaacacactacatttgacaacc

SEQ ID NO: 546022 - DNA, 25 bp, Homo sapien
ttgtaagggctctctgtggtttgac

SEQ ID NO: 546023 - DNA, 25 bp, Homo sapien
ctgtggtttgacttactccagctac

SEQ ID NO: 546024 - DNA, 25 bp, Homo sapien
acttactccagctaccgttaaatga

SEQ ID NO: 546025 - DNA, 25 bp, Homo sapien
gggcaaatcaccttaaaacatgttc

SEQ ID NO: 546026 - DNA, 25 bp, Homo sapien
aaattgggtctatgattttttgcca

SEQ ID NO: 546027 - DNA, 25 bp, Homo sapien
gattttttgccaatcttagcctaaa

SEQ ID NO: 546028 - DNA, 25 bp, Homo sapien
gaaattgctttagcttctggtcagc

SEQ ID NO: 546029 - DNA, 25 bp, Homo sapien
tagcttctggtcagcactgattaaa

SEQ ID NO: 546030 - DNA, 25 bp, Homo sapien
gaagtggctatcctaaactggttta

SEQ ID NO: 546031 - DNA, 25 bp, Homo sapien
tctccacccacactatcatagattt

SEQ ID NO: 546032 - DNA, 25 bp, Homo sapien
ggtaaatacaattcttatctagtgg

SEQ ID NO: 546033 - DNA, 25 bp, Homo sapien
cttagagtccccaaaacttctgtat

SEQ ID NO: 546034 - DNA, 25 bp, Homo sapien
gagtccccaaaacttctgtatgtaa

SEQ ID NO: 546035 - DNA, 25 bp, Homo sapien
aaaccatcactgacatgtggtggtg

SEQ ID NO: 546036 - DNA, 25 bp, Homo sapien
accatcactgacatgtggtggtgtg

SEQ ID NO: 546037 - DNA, 25 bp, Homo sapien
gaggatttagtgagatgatgtgccc

SEQ ID NO: 546038 - DNA, 25 bp, Homo sapien
agatgatgtgcccaaaacacctaaa

SEQ ID NO: 546039 - DNA, 25 bp, Homo sapien
tgatgtgcccaaaacacctaaacag

SEQ ID NO: 546040 - DNA, 25 bp, Homo sapien
atagttggtgtaaagctaagagcaa

SEQ ID NO: 546041 - DNA, 25 bp, Homo sapien
aagaaggtccatttgcttgagatgt

SEQ ID NO: 546042 - DNA, 25 bp, Homo sapien
ggtccatttgcttgagatgttatat

SEQ ID NO: 546043 - DNA, 25 bp, Homo sapien
ttgcttgagatgttatatttgattc

SEQ ID NO: 546044 - DNA, 25 bp, Homo sapien
aagtgtgtttctgacaccagtagca

SEQ ID NO: 546045 - DNA, 25 bp, Homo sapien
ttctgacaccagtagcattgacttc

SEQ ID NO: 546046 - DNA, 25 bp, Homo sapien
agcattgacttcacttagaaacctg

SEQ ID NO: 546047 - DNA, 25 bp, Homo sapien
gacttcacttagaaacctgttagaa

SEQ ID NO: 546048 - DNA, 25 bp, Homo sapien
aacacttgagtcacaaactttgcag

SEQ ID NO: 546049 - DNA, 25 bp, Homo sapien
cttcatgtaattttgatgcaggcct

SEQ ID NO: 546050 - DNA, 25 bp, Homo sapien
tttgatgcaggcctaagtttttgag

SEQ ID NO: 546051 - DNA, 25 bp, Homo sapien
ggcctaagtttttgagccactgcag

SEQ ID NO: 546052 - DNA, 25 bp, Homo sapien
gtttttgagccactgcagtatgcat

SEQ ID NO: 546053 - DNA, 25 bp, Homo sapien
tttgagccactgcagtatgcatttc

SEQ ID NO: 546054 - DNA, 25 bp, Homo sapien
tatttttaagcaaagatcttggtct

SEQ ID NO: 546055 - DNA, 25 bp, Homo sapien
acaggtccccttctagaattctgga

SEQ ID NO: 546056 - DNA, 25 bp, Homo sapien
caggtccccttctagaattctggac

SEQ ID NO: 546057 - DNA, 25 bp, Homo sapien
gaattctggacagcatgagatgcgt

SEQ ID NO: 546058 - DNA, 25 bp, Homo sapien
gacagcatgagatgcgtgtgctgat

SEQ ID NO: 546059 - DNA, 25 bp, Homo sapien
tcctgatgacccctatggccaacat

SEQ ID NO: 546060 - DNA, 25 bp, Homo sapien
tgatgacccctatggccaacatcaa

SEQ ID NO: 546061 - DNA, 25 bp, Homo sapien
gggaacccttcacccttctgtgaga

SEQ ID NO: 546062 - DNA, 25 bp, Homo sapien
aacccttcacccttctgtgagattt

SEQ ID NO: 546063 - DNA, 25 bp, Homo sapien
cccttctgtgagattttccatcatc

SEQ ID NO: 546064 - DNA, 25 bp, Homo sapien
ttccatcatctcaagttctcttcta

SEQ ID NO: 546065 - DNA, 25 bp, Homo sapien
tcatctcaagttctcttctatccag

SEQ ID NO: 546066 - DNA, 25 bp, Homo sapien
tctaagcgtagttcaaagacattta

SEQ ID NO: 546067 - DNA, 25 bp, Homo sapien
gacatttaaattgacaagttaccag

SEQ ID NO: 546068 - DNA, 25 bp, Homo sapien
agatcccatctagtattatatattt

SEQ ID NO: 546069 - DNA, 25 bp, Homo sapien
ttttttctagttgatcattgagcag

SEQ ID NO: 546070 - DNA, 25 bp, Homo sapien
gttgatcattgagcagtaaatacca

SEQ ID NO: 546071 - DNA, 25 bp, Homo sapien
gtaaataccaaatactcgattagaa

SEQ ID NO: 546072 - DNA, 25 bp, Homo sapien
tataggtatgtctttgcttccattt

SEQ ID NO: 546073 - DNA, 25 bp, Homo sapien
tgaaacaatttatctcctctggtat

SEQ ID NO: 546074 - DNA, 25 bp, Homo sapien
ttatctcctctggtattattcttaa

SEQ ID NO: 546075 - DNA, 25 bp, Homo sapien
ggtattattcttaaaccacagatag

SEQ ID NO: 546076 - DNA, 25 bp, Homo sapien
ttgatgttacaactctaagcgtagt

SEQ ID NO: 546077 - DNA, 25 bp, Homo sapien
gttgttcatctattatgaagtcctt

SEQ ID NO: 546078 - DNA, 25 bp, Homo sapien
tgaagtccttgagtggtgaaaaatc

SEQ ID NO: 546079 - DNA, 25 bp, Homo sapien
agtggtgaaaaatccgttgtacatg

SEQ ID NO: 546080 - DNA, 25 bp, Homo sapien
atccgttgtacatgagaacatttct

SEQ ID NO: 546081 - DNA, 25 bp, Homo sapien
agaacatttctatgcatttaagcca

SEQ ID NO: 546082 - DNA, 25 bp, Homo sapien
gtgctcttctgtcaaccaatgaaat

SEQ ID NO: 546083 - DNA, 25 bp, Homo sapien
tcacatgtgtggcagtgcaagtaaa

SEQ ID NO: 546084 - DNA, 25 bp, Homo sapien
gactgaatcaggcatgatactgcac

SEQ ID NO: 546085 - DNA, 25 bp, Homo sapien
gtgttggtacatattcacggtagta

SEQ ID NO: 546086 - DNA, 25 bp, Homo sapien
cacggtagtaaatcagtacccctgt

SEQ ID NO: 546087 - DNA, 25 bp, Homo sapien
tagtaaatcagtacccctgttaaag

SEQ ID NO: 546088 - DNA, 25 bp, Homo sapien
ttttcctgtattactatctcctctc

SEQ ID NO: 546089 - DNA, 25 bp, Homo sapien
tgtattactatctcctctcctgtgc

SEQ ID NO: 546090 - DNA, 25 bp, Homo sapien
ttgacagtgtgtttagtggatggat

SEQ ID NO: 546091 - DNA, 25 bp, Homo sapien
gataatatgtatttctctttcccac

SEQ ID NO: 546092 - DNA, 25 bp, Homo sapien
tttttggcccacctcaccacaaaag

SEQ ID NO: 546093 - DNA, 25 bp, Homo sapien
cctcaccacaaaagctccatagttt

SEQ ID NO: 546094 - DNA, 25 bp, Homo sapien
atgtaagtttgaatggatgcttctt

SEQ ID NO: 546095 - DNA, 25 bp, Homo sapien
aagaaactttaactgcaaggagtca

SEQ ID NO: 546096 - DNA, 25 bp, Homo sapien
gagtcagtgacttttagtgctccct

SEQ ID NO: 546097 - DNA, 25 bp, Homo sapien
gtgacttttagtgctccctgataaa

SEQ ID NO: 546098 - DNA, 25 bp, Homo sapien
tttagtgctccctgataaatgatgt

SEQ ID NO: 546099 - DNA, 25 bp, Homo sapien
agagaaggtctcttccttattgata

SEQ ID NO: 546100 - DNA, 25 bp, Homo sapien
tccttattgatatcatggtatgcat

SEQ ID NO: 546101 - DNA, 25 bp, Homo sapien
ggtatgcattaattccatttgttac

SEQ ID NO: 546102 - DNA, 25 bp, Homo sapien
aattccatttgttactattgtgcac

SEQ ID NO: 546103 - DNA, 25 bp, Homo sapien
tattgtgcacaaaagccctgttcac

SEQ ID NO: 546104 - DNA, 25 bp, Homo sapien
ttcactgtatttagtagacataact

SEQ ID NO: 546105 - DNA, 25 bp, Homo sapien
actgttgaatagttactgaatcatg

SEQ ID NO: 546106 - DNA, 25 bp, Homo sapien
atgtaaagaatatgtgaccatcttc

SEQ ID NO: 546107 - DNA, 25 bp, Homo sapien
ggatttctgaacgtttcaaatttca

SEQ ID NO: 546108 - DNA, 25 bp, Homo sapien
atttcaatcaatgagcactgtcaac

SEQ ID NO: 546109 - DNA, 25 bp, Homo sapien
tgagcactgtcaacacccacaggag

SEQ ID NO: 546110 - DNA, 25 bp, Homo sapien
aacttgtatatcatgctccctcaaa

SEQ ID NO: 546111 - DNA, 25 bp, Homo sapien
ttgtatatcatgctccctcaaagaa

SEQ ID NO: 546112 - DNA, 25 bp, Homo sapien
ggaaagaaagccagaaattacaatt

SEQ ID NO: 546113 - DNA, 25 bp, Homo sapien
tttggatgctaaaaagtaactttct

SEQ ID NO: 546114 - DNA, 25 bp, Homo sapien
tctagttaaccctaaagtcctgtca

SEQ ID NO: 546115 - DNA, 25 bp, Homo sapien
ctaaagtcctgtcagattgtgaaga

SEQ ID NO: 546116 - DNA, 25 bp, Homo sapien
gtgaagaaatgttccaggatacact

SEQ ID NO: 546117 - DNA, 25 bp, Homo sapien
caggatacacttggattagttatgc

SEQ ID NO: 546118 - DNA, 25 bp, Homo sapien
cttggattagttatgcagtatttct

SEQ ID NO: 546119 - DNA, 25 bp, Homo sapien
gaaatatgtctttgaagctccactt

SEQ ID NO: 546120 - DNA, 25 bp, Homo sapien
tgtctttgaagctccacttacacaa

SEQ ID NO: 546121 - DNA, 25 bp, Homo sapien
actgtgatttccaccagagaaatta

SEQ ID NO: 546122 - DNA, 25 bp, Homo sapien
cagagtggctgagcatgtgctctga

SEQ ID NO: 546123 - DNA, 25 bp, Homo sapien
gagcatgtgctctgaggccaggccc

SEQ ID NO: 546124 - DNA, 25 bp, Homo sapien
ggcagagtggtctccgagttccagt

SEQ ID NO: 546125 - DNA, 25 bp, Homo sapien
gagtggtctccgagttccagtccct

SEQ ID NO: 546126 - DNA, 25 bp, Homo sapien
tcagtgtgaccccacgtgcacagaa

SEQ ID NO: 546127 - DNA, 25 bp, Homo sapien
gtgaccccacgtgcacagaaagtgc

SEQ ID NO: 546128 - DNA, 25 bp, Homo sapien
acagaaagtgctgcgagtggtgcat

SEQ ID NO: 546129 - DNA, 25 bp, Homo sapien
agaggttgatgcaggtacttagccc

SEQ ID NO: 546130 - DNA, 25 bp, Homo sapien
ttgatgcaggtacttagcccttggg

SEQ ID NO: 546131 - DNA, 25 bp, Homo sapien
gaacacaggtagttccttttcactg

SEQ ID NO: 546132 - DNA, 25 bp, Homo sapien
tttcctttgggcttgcattagctct

SEQ ID NO: 546133 - DNA, 25 bp, Homo sapien
gcttgcattagctctttcctagcaa

SEQ ID NO: 546134 - DNA, 25 bp, Homo sapien
tagcaacccattatcccagctcagt

SEQ ID NO: 546135 - DNA, 25 bp, Homo sapien
ttatcccagctcagtacctttcaaa

SEQ ID NO: 546136 - DNA, 25 bp, Homo sapien
ccagctcagtacctttcaaacagaa

SEQ ID NO: 546137 - DNA, 25 bp, Homo sapien
gggttttgttgtgatctgaatttgt

SEQ ID NO: 546138 - DNA, 25 bp, Homo sapien
aggaagctccccctttgcacaaagg

SEQ ID NO: 546139 - DNA, 25 bp, Homo sapien
gggatttgtttgcacaaagttcact

SEQ ID NO: 546140 - DNA, 25 bp, Homo sapien
gcacaaagttcactgtaaatactgt

SEQ ID NO: 546141 - DNA, 25 bp, Homo sapien
gtgatttcaaaagcacacatttaaa

SEQ ID NO: 546142 - DNA, 25 bp, Homo sapien
gactgactaaataaaaggtaccaca

SEQ ID NO: 546143 - DNA, 25 bp, Homo sapien
gatacaaaagttaactggatgtggt

SEQ ID NO: 546144 - DNA, 25 bp, Homo sapien
aggatgacctgagtgcgggaggttg

SEQ ID NO: 546145 - DNA, 25 bp, Homo sapien
agagaatacctagctcatggagtta

SEQ ID NO: 546146 - DNA, 25 bp, Homo sapien
gagaatacctagctcatggagttag

SEQ ID NO: 546147 - DNA, 25 bp, Homo sapien
agaatacctagctcatggagttagg

SEQ ID NO: 546148 - DNA, 25 bp, Homo sapien
gaatacctagctcatggagttagga

SEQ ID NO: 546149 - DNA, 25 bp, Homo sapien
atacctagctcatggagttaggaac

SEQ ID NO: 546150 - DNA, 25 bp, Homo sapien
acctagctcatggagttaggaacaa

SEQ ID NO: 546151 - DNA, 25 bp, Homo sapien
ctagctcatggagttaggaacaagt

SEQ ID NO: 546152 - DNA, 25 bp, Homo sapien
agctcatggagttaggaacaagtat

SEQ ID NO: 546153 - DNA, 25 bp, Homo sapien
catggagttaggaacaagtatgtta

SEQ ID NO: 546154 - DNA, 25 bp, Homo sapien
cagtcgccagcccctggtactaggg

SEQ ID NO: 546155 - DNA, 25 bp, Homo sapien
caattgctttgctgacttggtgcac

SEQ ID NO: 546156 - DNA, 25 bp, Homo sapien
attgctttgctgacttggtgcacaa

SEQ ID NO: 546157 - DNA, 25 bp, Homo sapien
acttggtgcacaactggatggagct

SEQ ID NO: 546158 - DNA, 25 bp, Homo sapien
actggatggagctgcctgagacagg

SEQ ID NO: 546159 - DNA, 25 bp, Homo sapien
gggtgacggaggtgggcaccgtgcc

SEQ ID NO: 546160 - DNA, 25 bp, Homo sapien
tctctgagcagcttcggcgccggct

SEQ ID NO: 546161 - DNA, 25 bp, Homo sapien
agggctcggcggacagctatggcag

SEQ ID NO: 546162 - DNA, 25 bp, Homo sapien
gcagaggactggacagcagccctac

SEQ ID NO: 546163 - DNA, 25 bp, Homo sapien
agaggactggacagcagccctactg

SEQ ID NO: 546164 - DNA, 25 bp, Homo sapien
tactgaacaggggtcgcagtcgcca

SEQ ID NO: 546165 - DNA, 25 bp, Homo sapien
gtctgtcagggatggcactgtgtta

SEQ ID NO: 546166 - DNA, 25 bp, Homo sapien
aaagtgggcgtgcaagggccgcatt

SEQ ID NO: 546167 - DNA, 25 bp, Homo sapien
agctctcggtacctggagctccaca

SEQ ID NO: 546168 - DNA, 25 bp, Homo sapien
cctggagctccacaggtcccagaat

SEQ ID NO: 546169 - DNA, 25 bp, Homo sapien
ggtggatcagagttcaaattctggt

SEQ ID NO: 546170 - DNA, 25 bp, Homo sapien
aaattctggttctgctactgtctaa

SEQ ID NO: 546171 - DNA, 25 bp, Homo sapien
gttctgctactgtctaattgcgtgc

SEQ ID NO: 546172 - DNA, 25 bp, Homo sapien
gctactgtctaattgcgtgctgcag

SEQ ID NO: 546173 - DNA, 25 bp, Homo sapien
aattgcgtgctgcagggactcaatc

SEQ ID NO: 546174 - DNA, 25 bp, Homo sapien
gtgctgcagggactcaatctcttca

SEQ ID NO: 546175 - DNA, 25 bp, Homo sapien
ctgcagggactcaatctcttcatct

SEQ ID NO: 546176 - DNA, 25 bp, Homo sapien
agcgatctgattttatactcttatg

SEQ ID NO: 546177 - DNA, 25 bp, Homo sapien
atactcttatgcagtggatctacca

SEQ ID NO: 546178 - DNA, 25 bp, Homo sapien
ggatctaccactactacaatgactg

SEQ ID NO: 546179 - DNA, 25 bp, Homo sapien
actactacaatgactgctacagggc

SEQ ID NO: 546180 - DNA, 25 bp, Homo sapien
caatgactgctacagggctgctaat

SEQ ID NO: 546181 - DNA, 25 bp, Homo sapien
ctgctacagggctgctaatgtttct

SEQ ID NO: 546182 - DNA, 25 bp, Homo sapien
atgtttctgaatattgtctaagtac

SEQ ID NO: 546183 - DNA, 25 bp, Homo sapien
gaatattgtctaagtacttctagaa

SEQ ID NO: 546184 - DNA, 25 bp, Homo sapien
tcttctatcttaaaggagccttcag

SEQ ID NO: 546185 - DNA, 25 bp, Homo sapien
taatttttgattcagtgggtacaca

SEQ ID NO: 546186 - DNA, 25 bp, Homo sapien
cagtgggtacacatacaggttttat

SEQ ID NO: 546187 - DNA, 25 bp, Homo sapien
acaattgagcttcttccttcgagtt

SEQ ID NO: 546188 - DNA, 25 bp, Homo sapien
cgagtttctttgatctaatcaagag

SEQ ID NO: 546189 - DNA, 25 bp, Homo sapien
tcaagagatagaaggcctccagctt

SEQ ID NO: 546190 - DNA, 25 bp, Homo sapien
gcttcacattcctcacgattattta

SEQ ID NO: 546191 - DNA, 25 bp, Homo sapien
gaaggatggctcagccaaggctaaa

SEQ ID NO: 546192 - DNA, 25 bp, Homo sapien
gccaaggctaaatttaggttacagt

SEQ ID NO: 546193 - DNA, 25 bp, Homo sapien
ggttacagtccctaatcttaacaca

SEQ ID NO: 546194 - DNA, 25 bp, Homo sapien
cagtccctaatcttaacacagtttt

SEQ ID NO: 546195 - DNA, 25 bp, Homo sapien
gtttaggtttcagcttttgggatat

SEQ ID NO: 546196 - DNA, 25 bp, Homo sapien
cagcttttgggatattattgttacc

SEQ ID NO: 546197 - DNA, 25 bp, Homo sapien
atgtcacgtttaaaaacacctcaca

SEQ ID NO: 546198 - DNA, 25 bp, Homo sapien
gaaccacaccagaagacatcctcag

SEQ ID NO: 546199 - DNA, 25 bp, Homo sapien
gacatcctcaggaacaaaggctgct

SEQ ID NO: 546200 - DNA, 25 bp, Homo sapien
aaaggctgctccagctctaccagtg

SEQ ID NO: 546201 - DNA, 25 bp, Homo sapien
acccttgacaacaacgtggtgaatg

SEQ ID NO: 546202 - DNA, 25 bp, Homo sapien
tccgcactaactacattggccacaa

SEQ ID NO: 546203 - DNA, 25 bp, Homo sapien
aaaggacttgcaagccatctgcggc

SEQ ID NO: 546204 - DNA, 25 bp, Homo sapien
gcatctcctgtgatgagctgtccag

SEQ ID NO: 546205 - DNA, 25 bp, Homo sapien
tgtccagcatggtcctggaactcag

SEQ ID NO: 546206 - DNA, 25 bp, Homo sapien
tgcgcaccattgtgaccacgctgca

SEQ ID NO: 546207 - DNA, 25 bp, Homo sapien
gcaggacagcatccgcaaagtgact

SEQ ID NO: 546208 - DNA, 25 bp, Homo sapien
ggtttgtctttggaaccacaccaga

SEQ ID NO: 546209 - DNA, 25 bp, Homo sapien
cagattaatttctccacagctggaa

SEQ ID NO: 546210 - DNA, 25 bp, Homo sapien
ataatgatacctctgacctttcttc

SEQ ID NO: 546211 - DNA, 25 bp, Homo sapien
gaagtacttgagtgtgcagctgcat

SEQ ID NO: 546212 - DNA, 25 bp, Homo sapien
ctgcatgaggcctcagcaggagaga

SEQ ID NO: 546213 - DNA, 25 bp, Homo sapien
tttaggtccaagaagctataccagt

SEQ ID NO: 546214 - DNA, 25 bp, Homo sapien
gctataccagtaggacaaggcagga

SEQ ID NO: 546215 - DNA, 25 bp, Homo sapien
tactacactttcaggatcaagcccc

SEQ ID NO: 546216 - DNA, 25 bp, Homo sapien
ccctctgactctcatttggaaactg

SEQ ID NO: 546217 - DNA, 25 bp, Homo sapien
ggatgtttgctaagcacctgcttct

SEQ ID NO: 546218 - DNA, 25 bp, Homo sapien
ctgcttcttaaggatgccgagggat

SEQ ID NO: 546219 - DNA, 25 bp, Homo sapien
ggccgtgagatcttattcagggctt

SEQ ID NO: 546220 - DNA, 25 bp, Homo sapien
ctctttcgggccgtagagccagggc

SEQ ID NO: 546221 - DNA, 25 bp, Homo sapien
tctttcgggccgtagagccagggct

SEQ ID NO: 546222 - DNA, 25 bp, Homo sapien
ctttcgggccgtagagccagggctg

SEQ ID NO: 546223 - DNA, 25 bp, Homo sapien
tttcgggccgtagagccagggctgg

SEQ ID NO: 546224 - DNA, 25 bp, Homo sapien
ttcgggccgtagagccagggctggt

SEQ ID NO: 546225 - DNA, 25 bp, Homo sapien
gggccgtagagccagggctggtgca

SEQ ID NO: 546226 - DNA, 25 bp, Homo sapien
ggccgtagagccagggctggtgcag

SEQ ID NO: 546227 - DNA, 25 bp, Homo sapien
gccgtagagccagggctggtgcaga

SEQ ID NO: 546228 - DNA, 25 bp, Homo sapien
agccagggctggtgcagaagttctc

SEQ ID NO: 546229 - DNA, 25 bp, Homo sapien
gccagggctggtgcagaagttctcc

SEQ ID NO: 546230 - DNA, 25 bp, Homo sapien
aagatggtggacagatagagaattg

SEQ ID NO: 546231 - DNA, 25 bp, Homo sapien
gaagggttctggctgccccaacctg

SEQ ID NO: 546232 - DNA, 25 bp, Homo sapien
aagggttctggctgccccaacctgc

SEQ ID NO: 546233 - DNA, 25 bp, Homo sapien
ccaacctgctgaagggcagaggtgg

SEQ ID NO: 546234 - DNA, 25 bp, Homo sapien
tcatctcattcaaaccccaccctag

SEQ ID NO: 546235 - DNA, 25 bp, Homo sapien
tccctgtcaaagctgtcacttcgcg

SEQ ID NO: 546236 - DNA, 25 bp, Homo sapien
cctgtcaaagctgtcacttcgcgtg

SEQ ID NO: 546237 - DNA, 25 bp, Homo sapien
ctgtcaaagctgtcacttcgcgtgc

SEQ ID NO: 546238 - DNA, 25 bp, Homo sapien
tgtcaaagctgtcacttcgcgtgcc

SEQ ID NO: 546239 - DNA, 25 bp, Homo sapien
gtcaaagctgtcacttcgcgtgccc

SEQ ID NO: 546240 - DNA, 25 bp, Homo sapien
tcaaagctgtcacttcgcgtgccct

SEQ ID NO: 546241 - DNA, 25 bp, Homo sapien
aaagctgtcacttcgcgtgccctcg

SEQ ID NO: 546242 - DNA, 25 bp, Homo sapien
ggtcttagagcagcactgttctttt

SEQ ID NO: 546243 - DNA, 25 bp, Homo sapien
ttctcacgctgacactgcagccagc

SEQ ID NO: 546244 - DNA, 25 bp, Homo sapien
ttagagcagcactgttcttttcccc

SEQ ID NO: 546245 - DNA, 25 bp, Homo sapien
gcagccagctcctcaatgggcggtg

SEQ ID NO: 546246 - DNA, 25 bp, Homo sapien
tcaatgggcggtgcctccaaatcta

SEQ ID NO: 546247 - DNA, 25 bp, Homo sapien
agagcagcactgttcttttcccctc

SEQ ID NO: 546248 - DNA, 25 bp, Homo sapien
aaagaatatggaggtcctggagcac

SEQ ID NO: 546249 - DNA, 25 bp, Homo sapien
gtttgaattctgtcttaatgagaca

SEQ ID NO: 546250 - DNA, 25 bp, Homo sapien
atgagacagaatgccatacttgagc

SEQ ID NO: 546251 - DNA, 25 bp, Homo sapien
gacagaatgccatacttgagcacct

SEQ ID NO: 546252 - DNA, 25 bp, Homo sapien
actgactccatctgaggggtccttg

SEQ ID NO: 546253 - DNA, 25 bp, Homo sapien
tggtcagctccaagtcagccctgaa

SEQ ID NO: 546254 - DNA, 25 bp, Homo sapien
gtcagccctgaaatgtccattactc

SEQ ID NO: 546255 - DNA, 25 bp, Homo sapien
cttctctttgtcaatgctgaggcat

SEQ ID NO: 546256 - DNA, 25 bp, Homo sapien
tgtcaatgctgaggcattctctcag

SEQ ID NO: 546257 - DNA, 25 bp, Homo sapien
agccccacagtgctccagtgtgtga

SEQ ID NO: 546258 - DNA, 25 bp, Homo sapien
ctccagtgtgtgaagggcaacagct

SEQ ID NO: 546259 - DNA, 25 bp, Homo sapien
cgtgcagctgggaacgcctcctctg

SEQ ID NO: 546260 - DNA, 25 bp, Homo sapien
aacgcctcctctgctatggctggag

SEQ ID NO: 546261 - DNA, 25 bp, Homo sapien
tgctatggctggagccactgctgaa

SEQ ID NO: 546262 - DNA, 25 bp, Homo sapien
agccactgctgaagggactccacct

SEQ ID NO: 546263 - DNA, 25 bp, Homo sapien
accaatggcccctgaacgggtatct

SEQ ID NO: 546264 - DNA, 25 bp, Homo sapien
gaacgtctgtgatactttctgctaa

SEQ ID NO: 546265 - DNA, 25 bp, Homo sapien
aatggttcgatgcagctttcttggt

SEQ ID NO: 546266 - DNA, 25 bp, Homo sapien
cagctttcttggtttatggtcttca

SEQ ID NO: 546267 - DNA, 25 bp, Homo sapien
atggtcttcaagtgtttagccacaa

SEQ ID NO: 546268 - DNA, 25 bp, Homo sapien
aaatgagagtcacaatcctgcccca

SEQ ID NO: 546269 - DNA, 25 bp, Homo sapien
ttacgccgtcgctgaaaacatggat

SEQ ID NO: 546270 - DNA, 25 bp, Homo sapien
acatggatcatcactcgagacaacg

SEQ ID NO: 546271 - DNA, 25 bp, Homo sapien
gatttcacatcgtcttcgtttttga

SEQ ID NO: 546272 - DNA, 25 bp, Homo sapien
tgatgtccagtttccgaagcatgcc

SEQ ID NO: 546273 - DNA, 25 bp, Homo sapien
gaagcatgccttggaaggccgtctc

SEQ ID NO: 546274 - DNA, 25 bp, Homo sapien
aaggccgtctcgtggttgcgctgca

SEQ ID NO: 546275 - DNA, 25 bp, Homo sapien
agatggggtcacgtggccaacctgc

SEQ ID NO: 546276 - DNA, 25 bp, Homo sapien
tcggacaggaagtaatggcatccca

SEQ ID NO: 546277 - DNA, 25 bp, Homo sapien
gccccgaattgctgcaaccctggag

SEQ ID NO: 546278 - DNA, 25 bp, Homo sapien
gagttgagactactggttttagagc

SEQ ID NO: 546279 - DNA, 25 bp, Homo sapien
actggttttagagcagttcctctgc

SEQ ID NO: 546280 - DNA, 25 bp, Homo sapien
tagagcagttcctctgcctccctaa

SEQ ID NO: 546281 - DNA, 25 bp, Homo sapien
taagctccacacctgtcaggattct

SEQ ID NO: 546282 - DNA, 25 bp, Homo sapien
gtcaggattctgttacttcttggta

SEQ ID NO: 546283 - DNA, 25 bp, Homo sapien
gattctgttacttcttggtaactgg

SEQ ID NO: 546284 - DNA, 25 bp, Homo sapien
tggtaactgggacttgcccaacttt

SEQ ID NO: 546285 - DNA, 25 bp, Homo sapien
taatgtgcacatgtaaaagattcaa

SEQ ID NO: 546286 - DNA, 25 bp, Homo sapien
acatagcaagacccccgtctctaca

SEQ ID NO: 546287 - DNA, 25 bp, Homo sapien
catagcaagacccccgtctctacaa

SEQ ID NO: 546288 - DNA, 25 bp, Homo sapien
atagcaagacccccgtctctacaaa

SEQ ID NO: 546289 - DNA, 25 bp, Homo sapien
gcagaagaatccttgaacccgtgag

SEQ ID NO: 546290 - DNA, 25 bp, Homo sapien
cagaagaatccttgaacccgtgagg

SEQ ID NO: 546291 - DNA, 25 bp, Homo sapien
agaagaatccttgaacccgtgaggc

SEQ ID NO: 546292 - DNA, 25 bp, Homo sapien
gaagaatccttgaacccgtgaggcg

SEQ ID NO: 546293 - DNA, 25 bp, Homo sapien
gaatccttgaacccgtgaggcggag

SEQ ID NO: 546294 - DNA, 25 bp, Homo sapien
aatccttgaacccgtgaggcggagg

SEQ ID NO: 546295 - DNA, 25 bp, Homo sapien
atccttgaacccgtgaggcggaggt

SEQ ID NO: 546296 - DNA, 25 bp, Homo sapien
tcccgcctttctgagttgagcctag

SEQ ID NO: 546297 - DNA, 25 bp, Homo sapien
ccgcctttctgagttgagcctagcg

SEQ ID NO: 546298 - DNA, 25 bp, Homo sapien
ggagctgcttgggatggccgccttg

SEQ ID NO: 546299 - DNA, 25 bp, Homo sapien
agctgcttgggatggccgccttggg

SEQ ID NO: 546300 - DNA, 25 bp, Homo sapien
agttcgggcgccttcgggcaggatc

SEQ ID NO: 546301 - DNA, 25 bp, Homo sapien
ccttcgggcaggatcgcccagcggg

SEQ ID NO: 546302 - DNA, 25 bp, Homo sapien
gccgcgttctcctgcttgcggacgg

SEQ ID NO: 546303 - DNA, 25 bp, Homo sapien
gcgttctcctgcttgcggacggctg

SEQ ID NO: 546304 - DNA, 25 bp, Homo sapien
gttctcctgcttgcggacggctgcg

SEQ ID NO: 546305 - DNA, 25 bp, Homo sapien
gcttgcggacggctgcgggcctgag

SEQ ID NO: 546306 - DNA, 25 bp, Homo sapien
acggctgcgggcctgagggctggac

SEQ ID NO: 546307 - DNA, 25 bp, Homo sapien
gctcttccagaggattccctcagat

SEQ ID NO: 546308 - DNA, 25 bp, Homo sapien
gaggcagcagtatgagctctgagca

SEQ ID NO: 546309 - DNA, 25 bp, Homo sapien
gctctgagcagaagtgggtattgtt

SEQ ID NO: 546310 - DNA, 25 bp, Homo sapien
tacagaggaagttctttgccacgag

SEQ ID NO: 546311 - DNA, 25 bp, Homo sapien
tttgccacgagaactttcaagcagt

SEQ ID NO: 546312 - DNA, 25 bp, Homo sapien
aggaattcccatcaggactcagacc

SEQ ID NO: 546313 - DNA, 25 bp, Homo sapien
gactcagaccccaggccgagatctt

SEQ ID NO: 546314 - DNA, 25 bp, Homo sapien
gatcttgccctgaatgtaccctgcc

SEQ ID NO: 546315 - DNA, 25 bp, Homo sapien
tgcatcccatgctaagcagggtcat

SEQ ID NO: 546316 - DNA, 25 bp, Homo sapien
gcagggtcatggtctgaactactca

SEQ ID NO: 546317 - DNA, 25 bp, Homo sapien
gattggatttccaaaccatccttgt

SEQ ID NO: 546318 - DNA, 25 bp, Homo sapien
atgttgttagccaagctacttcttc

SEQ ID NO: 546319 - DNA, 25 bp, Homo sapien
gttagccaagctacttcttcaacag

SEQ ID NO: 546320 - DNA, 25 bp, Homo sapien
agccaagctacttcttcaacagctg

SEQ ID NO: 546321 - DNA, 25 bp, Homo sapien
gctacttcttcaacagctgtatctg

SEQ ID NO: 546322 - DNA, 25 bp, Homo sapien
cttcttcaacagctgtatctgcttc

SEQ ID NO: 546323 - DNA, 25 bp, Homo sapien
aacagctgtatctgcttcaaagccg

SEQ ID NO: 546324 - DNA, 25 bp, Homo sapien
cagctgtatctgcttcaaagccgac

SEQ ID NO: 546325 - DNA, 25 bp, Homo sapien
atacgtcatcaattgcaacgtcttc

SEQ ID NO: 546326 - DNA, 25 bp, Homo sapien
gtcatcaattgcaacgtcttcaatg

SEQ ID NO: 546327 - DNA, 25 bp, Homo sapien
caattgcaacgtcttcaatgaaggg

SEQ ID NO: 546328 - DNA, 25 bp, Homo sapien
gtcttcaatgaagggtcttacgact

SEQ ID NO: 546329 - DNA, 25 bp, Homo sapien
cagccagtggctgtggtctacagaa

SEQ ID NO: 546330 - DNA, 25 bp, Homo sapien
gtggtctacagaattgtttcatata

SEQ ID NO: 546331 - DNA, 25 bp, Homo sapien
gagtttcaaaactttcgtcatagat

SEQ ID NO: 546332 - DNA, 25 bp, Homo sapien
gtcatagatatctgggacctttctc

SEQ ID NO: 546333 - DNA, 25 bp, Homo sapien
ggacctttctcaggatctgtgttca

SEQ ID NO: 546334 - DNA, 25 bp, Homo sapien
tgtgttcacacagccaatagatttg

SEQ ID NO: 546335 - DNA, 25 bp, Homo sapien
ggaatcaggcctaagagtacacatg

SEQ ID NO: 546336 - DNA, 25 bp, Homo sapien
aaagtgcgtattatgtacatctaga

SEQ ID NO: 546337 - DNA, 25 bp, Homo sapien
gtgacttgcagcctacctgtaattt

SEQ ID NO: 546338 - DNA, 25 bp, Homo sapien
tgtaatttctatccattgagcatgc

SEQ ID NO: 546339 - DNA, 25 bp, Homo sapien
gagcatgcatggatatacccaatag

SEQ ID NO: 546340 - DNA, 25 bp, Homo sapien
aataatgctcttttagcagttgtca

SEQ ID NO: 546341 - DNA, 25 bp, Homo sapien
gaatgtgtaggttttattgggtgat

SEQ ID NO: 546342 - DNA, 25 bp, Homo sapien
tttagcagttgtcatccacggatgg

SEQ ID NO: 546343 - DNA, 25 bp, Homo sapien
agtttgactattcctaaggtaatgc

SEQ ID NO: 546344 - DNA, 25 bp, Homo sapien
tattcctaaggtaatgcccacggtt

SEQ ID NO: 546345 - DNA, 25 bp, Homo sapien
taaggtaatgcccacggtttccagt

SEQ ID NO: 546346 - DNA, 25 bp, Homo sapien
gcagttgtcatccacggatggctaa

SEQ ID NO: 546347 - DNA, 25 bp, Homo sapien
aatgcccacggtttccagtgttgaa

SEQ ID NO: 546348 - DNA, 25 bp, Homo sapien
gcccacggtttccagtgttgaaggt

SEQ ID NO: 546349 - DNA, 25 bp, Homo sapien
tcatccacggatggctaagtgttaa

SEQ ID NO: 546350 - DNA, 25 bp, Homo sapien
agagtcggggtgacagcctttttca

SEQ ID NO: 546351 - DNA, 25 bp, Homo sapien
tggagaaatactatgcaacaagcat

SEQ ID NO: 546352 - DNA, 25 bp, Homo sapien
tctaaaggtggaaacgtgtgggtct

SEQ ID NO: 546353 - DNA, 25 bp, Homo sapien
gaaacgtgtgggtctccagtaaaag

SEQ ID NO: 546354 - DNA, 25 bp, Homo sapien
gtgggtctccagtaaaagatgacga

SEQ ID NO: 546355 - DNA, 25 bp, Homo sapien
aaagatgacgaatggaactacagaa

SEQ ID NO: 546356 - DNA, 25 bp, Homo sapien
ggaactacagaaatggacaagatca

SEQ ID NO: 546357 - DNA, 25 bp, Homo sapien
atggtattttggtggctggaagaac

SEQ ID NO: 546358 - DNA, 25 bp, Homo sapien
ctggaagaacgttagctgcaataaa

SEQ ID NO: 546359 - DNA, 25 bp, Homo sapien
attttcaatccaccaagtttggcgc

SEQ ID NO: 546360 - DNA, 25 bp, Homo sapien
aatccaccaagtttggcgcattaat

SEQ ID NO: 546361 - DNA, 25 bp, Homo sapien
aagtttggcgcattaattttgaata

SEQ ID NO: 546362 - DNA, 25 bp, Homo sapien
ttaaaaagtaaggatcgcatggcag

SEQ ID NO: 546363 - DNA, 25 bp, Homo sapien
ggatcgcatggcagaactagcatct

SEQ ID NO: 546364 - DNA, 25 bp, Homo sapien
aactagcatctgttcacctgttgat

SEQ ID NO: 546365 - DNA, 25 bp, Homo sapien
catctgttcacctgttgatcctgat

SEQ ID NO: 546366 - DNA, 25 bp, Homo sapien
ctgttgatcctgataccgtggatta

SEQ ID NO: 546367 - DNA, 25 bp, Homo sapien
ctgataccgtggattacgagacccc

SEQ ID NO: 546368 - DNA, 25 bp, Homo sapien
cccctcttttctgtgtggttcagaa

SEQ ID NO: 546369 - DNA, 25 bp, Homo sapien
gtgtggttcagaaacaagcccctca

SEQ ID NO: 546370 - DNA, 25 bp, Homo sapien
ggttcagaaacaagcccctcagaca

SEQ ID NO: 546371 - DNA, 25 bp, Homo sapien
gggttgccacatagcctgccagctg

SEQ ID NO: 546372 - DNA, 25 bp, Homo sapien
tgcttcctgggtgccctccagggag

SEQ ID NO: 546373 - DNA, 25 bp, Homo sapien
catgtgagcccagggtaggacgggc

SEQ ID NO: 546374 - DNA, 25 bp, Homo sapien
ctcccattaaagtcacgttgtctcg

SEQ ID NO: 546375 - DNA, 25 bp, Homo sapien
ttaaagtcacgttgtctcgaagcat

SEQ ID NO: 546376 - DNA, 25 bp, Homo sapien
agtcacgttgtctcgaagcatgggt

SEQ ID NO: 546377 - DNA, 25 bp, Homo sapien
tcacgttgtctcgaagcatgggttt

SEQ ID NO: 546378 - DNA, 25 bp, Homo sapien
acgttgtctcgaagcatgggtttcc

SEQ ID NO: 546379 - DNA, 25 bp, Homo sapien
gttgtctcgaagcatgggtttccag

SEQ ID NO: 546380 - DNA, 25 bp, Homo sapien
gtctcgaagcatgggtttccaggtc

SEQ ID NO: 546381 - DNA, 25 bp, Homo sapien
gaagcatgggtttccaggtccttga

SEQ ID NO: 546382 - DNA, 25 bp, Homo sapien
gcatgggtttccaggtccttgagca

SEQ ID NO: 546383 - DNA, 25 bp, Homo sapien
tgggtttccaggtccttgagcatag

SEQ ID NO: 546384 - DNA, 25 bp, Homo sapien
agacccgatccattcagtcacggtt

SEQ ID NO: 546385 - DNA, 25 bp, Homo sapien
cacggttcctgcagagtcggaatct

SEQ ID NO: 546386 - DNA, 25 bp, Homo sapien
gcagagtcggaatctaaactgtata

SEQ ID NO: 546387 - DNA, 25 bp, Homo sapien
ctaaactgtatagcactttgtgaag

SEQ ID NO: 546388 - DNA, 25 bp, Homo sapien
agtgattacatctaaggacctccag

SEQ ID NO: 546389 - DNA, 25 bp, Homo sapien
aagcatgggaacatctgggtgtgcc

SEQ ID NO: 546390 - DNA, 25 bp, Homo sapien
tgggtgtgccctgtgtccgaccatg

SEQ ID NO: 546391 - DNA, 25 bp, Homo sapien
aagattcttctttgtatatgaggat

SEQ ID NO: 546392 - DNA, 25 bp, Homo sapien
ggtcaggtgggcgatgccaacatta

SEQ ID NO: 546393 - DNA, 25 bp, Homo sapien
ggcgatgccaacattaatactcagg

SEQ ID NO: 546394 - DNA, 25 bp, Homo sapien
tcatgcgtgtgatcggaactcaggt

SEQ ID NO: 546395 - DNA, 25 bp, Homo sapien
cgtccagatccacaggctgctgaag

SEQ ID NO: 546396 - DNA, 25 bp, Homo sapien
aggctgctgaagtagtccagcccgc

SEQ ID NO: 546397 - DNA, 25 bp, Homo sapien
tgaagtagtccagcccgcggcagat

SEQ ID NO: 546398 - DNA, 25 bp, Homo sapien
atgagcgtggcagcgtgcaccagca

SEQ ID NO: 546399 - DNA, 25 bp, Homo sapien
gtggcagcgtgcaccagcagcacct

SEQ ID NO: 546400 - DNA, 25 bp, Homo sapien
tgcacgcccaagtagctgccgaggc

SEQ ID NO: 546401 - DNA, 25 bp, Homo sapien
ctgccgaggcagtagaggccgtaca

SEQ ID NO: 546402 - DNA, 25 bp, Homo sapien
ggcctcgacgccgtagtcgacgaag

SEQ ID NO: 546403 - DNA, 25 bp, Homo sapien
gacgccgtagtcgacgaagcagagc

SEQ ID NO: 546404 - DNA, 25 bp, Homo sapien
acgatgggcgtgtgcgcgcggtgca

SEQ ID NO: 546405 - DNA, 25 bp, Homo sapien
ccaggcgcgtcagcgagctcttgaa

SEQ ID NO: 546406 - DNA, 25 bp, Homo sapien
ccccagccctgagggatgaagggtc

SEQ ID NO: 546407 - DNA, 25 bp, Homo sapien
aagggtctgaagatggcactgcacg

SEQ ID NO: 546408 - DNA, 25 bp, Homo sapien
tctgaagatggcactgcacggtgac

SEQ ID NO: 546409 - DNA, 25 bp, Homo sapien
gctccgtttacaaaggaacatgagt

SEQ ID NO: 546410 - DNA, 25 bp, Homo sapien
ttttatatctgacctgaatttctgt

SEQ ID NO: 546411 - DNA, 25 bp, Homo sapien
cccattccccacatggtagaagtgt

SEQ ID NO: 546412 - DNA, 25 bp, Homo sapien
ggtagaagtgtaatctcacatcaat

SEQ ID NO: 546413 - DNA, 25 bp, Homo sapien
atttcccctctagatgagtgaaggg

SEQ ID NO: 546414 - DNA, 25 bp, Homo sapien
taggaggctggtgaacccaacggct

SEQ ID NO: 546415 - DNA, 25 bp, Homo sapien
ggctggtgaacccaacggctgaaat

SEQ ID NO: 546416 - DNA, 25 bp, Homo sapien
gaacccaacggctgaaatgtgaagg

SEQ ID NO: 546417 - DNA, 25 bp, Homo sapien
tatcctgcacgaaatattgcccttg

SEQ ID NO: 546418 - DNA, 25 bp, Homo sapien
aaatattgcccttgtttcctctact

SEQ ID NO: 546419 - DNA, 25 bp, Homo sapien
ttcctctactttcctcttggtgttt

SEQ ID NO: 546420 - DNA, 25 bp, Homo sapien
aacaggccaattccattttcttgag

SEQ ID NO: 546421 - DNA, 25 bp, Homo sapien
ggccaattccattttcttgagcaag

SEQ ID NO: 546422 - DNA, 25 bp, Homo sapien
gaaagcttagtgtgttacttcatca

SEQ ID NO: 546423 - DNA, 25 bp, Homo sapien
gtgttacttcatcaaggccagctaa

SEQ ID NO: 546424 - DNA, 25 bp, Homo sapien
gccagctaatactgtgttaaaccgg

SEQ ID NO: 546425 - DNA, 25 bp, Homo sapien
tactgtgttaaaccgggctgaaaat

SEQ ID NO: 546426 - DNA, 25 bp, Homo sapien
ggaaagtcttccttgtacgtggctg

SEQ ID NO: 546427 - DNA, 25 bp, Homo sapien
gtcttccttgtacgtggctgtaaat

SEQ ID NO: 546428 - DNA, 25 bp, Homo sapien
taggcttgagcaggccaaactcttc

SEQ ID NO: 546429 - DNA, 25 bp, Homo sapien
tcttctgccggacacttgaggacat

SEQ ID NO: 546430 - DNA, 25 bp, Homo sapien
tggcagatgcccctgagtctcagaa

SEQ ID NO: 546431 - DNA, 25 bp, Homo sapien
attgcctaccaggaacctgcagatg

SEQ ID NO: 546432 - DNA, 25 bp, Homo sapien
tgcagatgacagcagcttctcgctg

SEQ ID NO: 546433 - DNA, 25 bp, Homo sapien
aggttctccggcacctgcggcagga

SEQ ID NO: 546434 - DNA, 25 bp, Homo sapien
tactgtgggcagcttgaagacctca

SEQ ID NO: 546435 - DNA, 25 bp, Homo sapien
agcttgaagacctcagcggtgccca

SEQ ID NO: 546436 - DNA, 25 bp, Homo sapien
tccacgatgtcccaagagcctgagc

SEQ ID NO: 546437 - DNA, 25 bp, Homo sapien
tgagctcctcatcagtggaatggaa

SEQ ID NO: 546438 - DNA, 25 bp, Homo sapien
gtggaatggaaaagcccctccctct

SEQ ID NO: 546439 - DNA, 25 bp, Homo sapien
cctggcctccggtgagtattttata

SEQ ID NO: 546440 - DNA, 25 bp, Homo sapien
tttagtctacacttccatacttggc

SEQ ID NO: 546441 - DNA, 25 bp, Homo sapien
tctacacttccatacttggcttttt

SEQ ID NO: 546442 - DNA, 25 bp, Homo sapien
ttcatagcagtgtgtagagtgccac

SEQ ID NO: 546443 - DNA, 25 bp, Homo sapien
tgtagagtgccacttatgttttctt

SEQ ID NO: 546444 - DNA, 25 bp, Homo sapien
ttgtatggatttaccatcccctgtg

SEQ ID NO: 546445 - DNA, 25 bp, Homo sapien
accatcccctgtgtatttaagttgt

SEQ ID NO: 546446 - DNA, 25 bp, Homo sapien
tatttaagttgttccattctttggc

SEQ ID NO: 546447 - DNA, 25 bp, Homo sapien
tggccattataacttttttctgcaa

SEQ ID NO: 546448 - DNA, 25 bp, Homo sapien
atattctggtgacttatctttggcc

SEQ ID NO: 546449 - DNA, 25 bp, Homo sapien
ctggtgacttatctttggccattat

SEQ ID NO: 546450 - DNA, 25 bp, Homo sapien
ggagacacggtgagcttcagcattg

SEQ ID NO: 546451 - DNA, 25 bp, Homo sapien
tgagcttcagcattgaggccaaggt

SEQ ID NO: 546452 - DNA, 25 bp, Homo sapien
gaagtcctttaccataaagcccgtg

SEQ ID NO: 546453 - DNA, 25 bp, Homo sapien
aagcccgtgggcttcaaggacagcc

SEQ ID NO: 546454 - DNA, 25 bp, Homo sapien
aaggacagcctgatcgtccaggtca

SEQ ID NO: 546455 - DNA, 25 bp, Homo sapien
tgatcgtccaggtcacctttgattg

SEQ ID NO: 546456 - DNA, 25 bp, Homo sapien
gtccaggtcacctttgattgtgact

SEQ ID NO: 546457 - DNA, 25 bp, Homo sapien
gattgtgactgtgcctgccaggccc

SEQ ID NO: 546458 - DNA, 25 bp, Homo sapien
tgccaggcccaagctgaacctaata

SEQ ID NO: 546459 - DNA, 25 bp, Homo sapien
gaacctaatagccatcgctgcaaca

SEQ ID NO: 546460 - DNA, 25 bp, Homo sapien
tagccatcgctgcaacaatggcaat

SEQ ID NO: 546461 - DNA, 25 bp, Homo sapien
gggacgccgaactctctcaatggta

SEQ ID NO: 546462 - DNA, 25 bp, Homo sapien
gccgaactctctcaatggtatcaac

SEQ ID NO: 546463 - DNA, 25 bp, Homo sapien
aatggtatcaacaggctccttcgcc

SEQ ID NO: 546464 - DNA, 25 bp, Homo sapien
tctggctcctggtcatgttccatta

SEQ ID NO: 546465 - DNA, 25 bp, Homo sapien
ctcctggtcatgttccattattggg

SEQ ID NO: 546466 - DNA, 25 bp, Homo sapien
caccctgcagcatcaaggttgctat

SEQ ID NO: 546467 - DNA, 25 bp, Homo sapien
gcatcaaggttgctatggactctcc

SEQ ID NO: 546468 - DNA, 25 bp, Homo sapien
aaggttgctatggactctcctgccg

SEQ ID NO: 546469 - DNA, 25 bp, Homo sapien
tgccgggcaactcttgcgtaatcat

SEQ ID NO: 546470 - DNA, 25 bp, Homo sapien
ggcaactcttgcgtaatcatgacta

SEQ ID NO: 546471 - DNA, 25 bp, Homo sapien
tgcgtaatcatgactatctctagga

SEQ ID NO: 546472 - DNA, 25 bp, Homo sapien
tctctcttcttgttacctgcctgca

SEQ ID NO: 546473 - DNA, 25 bp, Homo sapien
gaagataatatgttatgccccgact

SEQ ID NO: 546474 - DNA, 25 bp, Homo sapien
gataatatgttatgccccgactgtg

SEQ ID NO: 546475 - DNA, 25 bp, Homo sapien
ttatgccccgactgtgctaagagga

SEQ ID NO: 546476 - DNA, 25 bp, Homo sapien
gacagtagagaagtagcagcaacct

SEQ ID NO: 546477 - DNA, 25 bp, Homo sapien
gtagcagcaacctgtttgaatacaa

SEQ ID NO: 546478 - DNA, 25 bp, Homo sapien
gaatacaatgtactaaaggagggat

SEQ ID NO: 546479 - DNA, 25 bp, Homo sapien
gtactttcagatcatgtaacctatt

SEQ ID NO: 546480 - DNA, 25 bp, Homo sapien
gatcatgtaacctattacgaaggag

SEQ ID NO: 546481 - DNA, 25 bp, Homo sapien
cctgggtgcctaccactcacaggag

SEQ ID NO: 546482 - DNA, 25 bp, Homo sapien
tcacaggaggatgatttctctcttc

SEQ ID NO: 546483 - DNA, 25 bp, Homo sapien
agtgtatagtctacaggttcataag

SEQ ID NO: 546484 - DNA, 25 bp, Homo sapien
gtatagtctacaggttcataagtga

SEQ ID NO: 546485 - DNA, 25 bp, Homo sapien
atagtctacaggttcataagtgagt

SEQ ID NO: 546486 - DNA, 25 bp, Homo sapien
agtctacaggttcataagtgagtat

SEQ ID NO: 546487 - DNA, 25 bp, Homo sapien
taagtgagtatatccatgagtataa

SEQ ID NO: 546488 - DNA, 25 bp, Homo sapien
gtgagtatatccatgagtataaaaa

SEQ ID NO: 546489 - DNA, 25 bp, Homo sapien
taaaaagaaggtcatttatgggtgg

SEQ ID NO: 546490 - DNA, 25 bp, Homo sapien
aggttcctgaaatatttcagtccat

SEQ ID NO: 546491 - DNA, 25 bp, Homo sapien
gaaatatttcagtccattcaagttt

SEQ ID NO: 546492 - DNA, 25 bp, Homo sapien
atatttcagtccattcaagttttaa

SEQ ID NO: 546493 - DNA, 25 bp, Homo sapien
caagttttaattataccaatgaatc

SEQ ID NO: 546494 - DNA, 25 bp, Homo sapien
atttatctaatctatcacctttgta

SEQ ID NO: 546495 - DNA, 25 bp, Homo sapien
tttatctaatctatcacctttgtat

SEQ ID NO: 546496 - DNA, 25 bp, Homo sapien
ttatctaatctatcacctttgtatt

SEQ ID NO: 546497 - DNA, 25 bp, Homo sapien
gaattttctgactgatgtaataaag

SEQ ID NO: 546498 - DNA, 25 bp, Homo sapien
catatttgagctgtaggataagtct

SEQ ID NO: 546499 - DNA, 25 bp, Homo sapien
atatttgagctgtaggataagtctt

SEQ ID NO: 546500 - DNA, 25 bp, Homo sapien
atttgagctgtaggataagtcttga

SEQ ID NO: 546501 - DNA, 25 bp, Homo sapien
tttgagctgtaggataagtcttgaa

SEQ ID NO: 546502 - DNA, 25 bp, Homo sapien
tgagctgtaggataagtcttgaatt

SEQ ID NO: 546503 - DNA, 25 bp, Homo sapien
gagctgtaggataagtcttgaattt

SEQ ID NO: 546504 - DNA, 25 bp, Homo sapien
agctgtaggataagtcttgaatttt

SEQ ID NO: 546505 - DNA, 25 bp, Homo sapien
ttcctcagtcctgcaagtaaggact

SEQ ID NO: 546506 - DNA, 25 bp, Homo sapien
agagtactgaaacaaggacttcttg

SEQ ID NO: 546507 - DNA, 25 bp, Homo sapien
ggacttcttgtcagaaacagcttct

SEQ ID NO: 546508 - DNA, 25 bp, Homo sapien
cagcttctggaatcttgggttttgt

SEQ ID NO: 546509 - DNA, 25 bp, Homo sapien
aaatacactattggccatgtccatc

SEQ ID NO: 546510 - DNA, 25 bp, Homo sapien
catgtccatcacgagagtgtttgta

SEQ ID NO: 546511 - DNA, 25 bp, Homo sapien
aattaccttgtacaggacctggcac

SEQ ID NO: 546512 - DNA, 25 bp, Homo sapien
aaatgttccctcagtgatcctttta

SEQ ID NO: 546513 - DNA, 25 bp, Homo sapien
agtgatccttttactctccttgtca

SEQ ID NO: 546514 - DNA, 25 bp, Homo sapien
ttactctccttgtcacttatttggg

SEQ ID NO: 546515 - DNA, 25 bp, Homo sapien
tttgatgttggtatgcttgccctgt

SEQ ID NO: 546516 - DNA, 25 bp, Homo sapien
ttgagtttctgagcagcttccaaaa

SEQ ID NO: 546517 - DNA, 25 bp, Homo sapien
gacggatgatgagcagttcgctgac

SEQ ID NO: 546518 - DNA, 25 bp, Homo sapien
ttcgctgacgagaagaactacttga

SEQ ID NO: 546519 - DNA, 25 bp, Homo sapien
ttgattaaacagatccgagacttga

SEQ ID NO: 546520 - DNA, 25 bp, Homo sapien
gagacttgaagaaaacggccccttg

SEQ ID NO: 546521 - DNA, 25 bp, Homo sapien
tgtcacagtcagtcgtctcatttgt

SEQ ID NO: 546522 - DNA, 25 bp, Homo sapien
agtcgtctcatttgtccagtttgta

SEQ ID NO: 546523 - DNA, 25 bp, Homo sapien
gtccagtttgtacagtgtgtcattt

SEQ ID NO: 546524 - DNA, 25 bp, Homo sapien
agaaagtcatcattcttgggaagac

SEQ ID NO: 546525 - DNA, 25 bp, Homo sapien
gggaagactttggaggtgcctattt

SEQ ID NO: 546526 - DNA, 25 bp, Homo sapien
ttttctgctgtaattgttctgggta

SEQ ID NO: 546527 - DNA, 25 bp, Homo sapien
ccgggtggcccaaagataacatctg

SEQ ID NO: 546528 - DNA, 25 bp, Homo sapien
agggttgttagaggactgtgtcatc

SEQ ID NO: 546529 - DNA, 25 bp, Homo sapien
tagaggactgtgtcatcctcaccaa

SEQ ID NO: 546530 - DNA, 25 bp, Homo sapien
aggactgtgtcatcctcaccaagct

SEQ ID NO: 546531 - DNA, 25 bp, Homo sapien
accaagctcattacatctgccaggg

SEQ ID NO: 546532 - DNA, 25 bp, Homo sapien
agctcattacatctgccagggcctg

SEQ ID NO: 546533 - DNA, 25 bp, Homo sapien
cagccttttcctgggatgcagtgaa

SEQ ID NO: 546534 - DNA, 25 bp, Homo sapien
atgcagtgaaatcccatccatgaac

SEQ ID NO: 546535 - DNA, 25 bp, Homo sapien
gtgaaatcccatccatgaactcgat

SEQ ID NO: 546536 - DNA, 25 bp, Homo sapien
ttccctattccaaaaatagtgccgg

SEQ ID NO: 546537 - DNA, 25 bp, Homo sapien
aaatagtgccgggtggcccaaagat

SEQ ID NO: 546538 - DNA, 25 bp, Homo sapien
tgctacgtggacgacaactgcgacc

SEQ ID NO: 546539 - DNA, 25 bp, Homo sapien
gctacgtggacgacaactgcgaccc

SEQ ID NO: 546540 - DNA, 25 bp, Homo sapien
gtggacgacaactgcgacccccaga

SEQ ID NO: 546541 - DNA, 25 bp, Homo sapien
agaccgtggccaaccgcgtggcctg

SEQ ID NO: 546542 - DNA, 25 bp, Homo sapien
accatcacccgtttctatggcgacg

SEQ ID NO: 546543 - DNA, 25 bp, Homo sapien
ccatcacccgtttctatggcgacga

SEQ ID NO: 546544 - DNA, 25 bp, Homo sapien
catcacccgtttctatggcgacgac

SEQ ID NO: 546545 - DNA, 25 bp, Homo sapien
atcacccgtttctatggcgacgacc

SEQ ID NO: 546546 - DNA, 25 bp, Homo sapien
gtttctatggcgacgacccccagag

SEQ ID NO: 546547 - DNA, 25 bp, Homo sapien
agagctccccaaacctgggccgcat

SEQ ID NO: 546548 - DNA, 25 bp, Homo sapien
caaacctgggccgcatcatcaacca

SEQ ID NO: 546549 - DNA, 25 bp, Homo sapien
ttggccagtagctgctgtgaccgag

SEQ ID NO: 546550 - DNA, 25 bp, Homo sapien
gctgctgtgaccgagtcaccaagat

SEQ ID NO: 546551 - DNA, 25 bp, Homo sapien
accacaaggtcaagtcgaaaacacg

SEQ ID NO: 546552 - DNA, 25 bp, Homo sapien
tcaccaagatgaccacagcaggacc

SEQ ID NO: 546553 - DNA, 25 bp, Homo sapien
aggacccttcacatgtggcctcaag

SEQ ID NO: 546554 - DNA, 25 bp, Homo sapien
atgtggcctcaagctcggccaggtc

SEQ ID NO: 546555 - DNA, 25 bp, Homo sapien
caggtccagcagtcacgtcgtgaag

SEQ ID NO: 546556 - DNA, 25 bp, Homo sapien
cgacatgttaaaacacttccttgac

SEQ ID NO: 546557 - DNA, 25 bp, Homo sapien
ttccttgaccctggagaacgaggat

SEQ ID NO: 546558 - DNA, 25 bp, Homo sapien
aggatggtggtgaacagcccctcag

SEQ ID NO: 546559 - DNA, 25 bp, Homo sapien
agcgacgtctgatcttggccagtag

SEQ ID NO: 546560 - DNA, 25 bp, Homo sapien
taactggatatgtaagtattgcatt

SEQ ID NO: 546561 - DNA, 25 bp, Homo sapien
aagcatcagattttattcttcttaa

SEQ ID NO: 546562 - DNA, 25 bp, Homo sapien
ttattcttcttaacagatttaggtt

SEQ ID NO: 546563 - DNA, 25 bp, Homo sapien
aaaatgtggctttctcacaagatga

SEQ ID NO: 546564 - DNA, 25 bp, Homo sapien
gtggctttctcacaagatgatactt

SEQ ID NO: 546565 - DNA, 25 bp, Homo sapien
ggctttctcacaagatgatactttt

SEQ ID NO: 546566 - DNA, 25 bp, Homo sapien
ttctcacaagatgatacttttttac

SEQ ID NO: 546567 - DNA, 25 bp, Homo sapien
ttattctgaatgatagcttatggtc

SEQ ID NO: 546568 - DNA, 25 bp, Homo sapien
gcttatggtcatatagttaatacag

SEQ ID NO: 546569 - DNA, 25 bp, Homo sapien
atagttaatacagaccaggccgggc

SEQ ID NO: 546570 - DNA, 25 bp, Homo sapien
agttaatacagaccaggccgggcgt

SEQ ID NO: 546571 - DNA, 25 bp, Homo sapien
gattaatgaggatgactgcggccca

SEQ ID NO: 546572 - DNA, 25 bp, Homo sapien
aatgaggatgactgcggcccaggcc

SEQ ID NO: 546573 - DNA, 25 bp, Homo sapien
gggccccggtgcctacacaatggca

SEQ ID NO: 546574 - DNA, 25 bp, Homo sapien
acctggtgggtggtttccgctgcac

SEQ ID NO: 546575 - DNA, 25 bp, Homo sapien
aggatacactggtttgcgctgcgag

SEQ ID NO: 546576 - DNA, 25 bp, Homo sapien
gtttgcgctgcgaggcagacatcaa

SEQ ID NO: 546577 - DNA, 25 bp, Homo sapien
gctgcgaggcagacatcaatgagtg

SEQ ID NO: 546578 - DNA, 25 bp, Homo sapien
atcaatgagtgtcgctcaggtgcct

SEQ ID NO: 546579 - DNA, 25 bp, Homo sapien
atgagtgtcgctcaggtgcctgcca

SEQ ID NO: 546580 - DNA, 25 bp, Homo sapien
gaggtttccgttgcctttgtcatgc

SEQ ID NO: 546581 - DNA, 25 bp, Homo sapien
ttgtcatgctggcttctcaggtcct

SEQ ID NO: 546582 - DNA, 25 bp, Homo sapien
ctatatacatctacagccagaatgg

SEQ ID NO: 546583 - DNA, 25 bp, Homo sapien
tatacatctacagccagaatggatt

SEQ ID NO: 546584 - DNA, 25 bp, Homo sapien
catctacagccagaatggattgttt

SEQ ID NO: 546585 - DNA, 25 bp, Homo sapien
tttcctttactaagttcacttacat

SEQ ID NO: 546586 - DNA, 25 bp, Homo sapien
gttcacttacattacttacagagtt

SEQ ID NO: 546587 - DNA, 25 bp, Homo sapien
acttacagagttttattcattgcca

SEQ ID NO: 546588 - DNA, 25 bp, Homo sapien
tacagagttttattcattgccataa

SEQ ID NO: 546589 - DNA, 25 bp, Homo sapien
agagttttattcattgccataatag

SEQ ID NO: 546590 - DNA, 25 bp, Homo sapien
gttgacatgccaaattaacatagtt

SEQ ID NO: 546591 - DNA, 25 bp, Homo sapien
gccaaattaacatagttccatctgg

SEQ ID NO: 546592 - DNA, 25 bp, Homo sapien
tgaaatgataatccggctgggcaca

SEQ ID NO: 546593 - DNA, 25 bp, Homo sapien
tctttcgggccgtagagccagggct

SEQ ID NO: 546594 - DNA, 25 bp, Homo sapien
agccagggctggtgcagaagttctc

SEQ ID NO: 546595 - DNA, 25 bp, Homo sapien
gccagggctggtgcagaagttctcc

SEQ ID NO: 546596 - DNA, 25 bp, Homo sapien
agaagttctccctgcgagactgcag

SEQ ID NO: 546597 - DNA, 25 bp, Homo sapien
tcagtgaagaactctaccaccgctg

SEQ ID NO: 546598 - DNA, 25 bp, Homo sapien
agctggctatggctctctttgagca

SEQ ID NO: 546599 - DNA, 25 bp, Homo sapien
gcaggagcaggccaatagcacttag

SEQ ID NO: 546600 - DNA, 25 bp, Homo sapien
attacctttcctttgtctgcctcag

SEQ ID NO: 546601 - DNA, 25 bp, Homo sapien
tgcctcagccccaggaagggcaagg

SEQ ID NO: 546602 - DNA, 25 bp, Homo sapien
caaggcaagatggtggacagataga

SEQ ID NO: 546603 - DNA, 25 bp, Homo sapien
caagatggtggacagatagagaatt

SEQ ID NO: 546604 - DNA, 25 bp, Homo sapien
taaaagcctttgaacaccacgctgt

SEQ ID NO: 546605 - DNA, 25 bp, Homo sapien
aaaagcctttgaacaccacgctgta

SEQ ID NO: 546606 - DNA, 25 bp, Homo sapien
aaagcctttgaacaccacgctgtag

SEQ ID NO: 546607 - DNA, 25 bp, Homo sapien
aagcctttgaacaccacgctgtagt

SEQ ID NO: 546608 - DNA, 25 bp, Homo sapien
gcctttgaacaccacgctgtagtct

SEQ ID NO: 546609 - DNA, 25 bp, Homo sapien
ttgaacaccacgctgtagtctccaa

SEQ ID NO: 546610 - DNA, 25 bp, Homo sapien
tgaacaccacgctgtagtctccaac

SEQ ID NO: 546611 - DNA, 25 bp, Homo sapien
aacaccacgctgtagtctccaacag

SEQ ID NO: 546612 - DNA, 25 bp, Homo sapien
accacgctgtagtctccaacagaaa

SEQ ID NO: 546613 - DNA, 25 bp, Homo sapien
cacgctgtagtctccaacagaaaaa

SEQ ID NO: 546614 - DNA, 25 bp, Homo sapien
gctgtagtctccaacagaaaaacac

SEQ ID NO: 546615 - DNA, 25 bp, Homo sapien
aggtgtgtgctgattactaatccac

SEQ ID NO: 546616 - DNA, 25 bp, Homo sapien
gctgattactaatccacatgggcaa

SEQ ID NO: 546617 - DNA, 25 bp, Homo sapien
catgggcaagaacaggatgtccgtc

SEQ ID NO: 546618 - DNA, 25 bp, Homo sapien
ggatgtccgtcattaccctgaatca

SEQ ID NO: 546619 - DNA, 25 bp, Homo sapien
caatgctaacacagtgccacttgag

SEQ ID NO: 546620 - DNA, 25 bp, Homo sapien
gtgccacttgagttcacattaagtt

SEQ ID NO: 546621 - DNA, 25 bp, Homo sapien
atttacaaagtctgaggtgtggaac

SEQ ID NO: 546622 - DNA, 25 bp, Homo sapien
ggtgtggaacagttatttaagcatt

SEQ ID NO: 546623 - DNA, 25 bp, Homo sapien
ttaagcattagtcaaccctggtcct

SEQ ID NO: 546624 - DNA, 25 bp, Homo sapien
accctggtccttaagacagttctag

SEQ ID NO: 546625 - DNA, 25 bp, Homo sapien
atatttgttcaactattttgaccaa

SEQ ID NO: 546626 - DNA, 25 bp, Homo sapien
aaaccaatattgaatctctgataaa

SEQ ID NO: 546627 - DNA, 25 bp, Homo sapien
tctgatgttactagctatgggaaat

SEQ ID NO: 546628 - DNA, 25 bp, Homo sapien
gaaattagaactggcacaaccctga

SEQ ID NO: 546629 - DNA, 25 bp, Homo sapien
tggcacaaccctgacattactaagt

SEQ ID NO: 546630 - DNA, 25 bp, Homo sapien
aaatgttaggatttttcggcatcgc

SEQ ID NO: 546631 - DNA, 25 bp, Homo sapien
ggatttttcggcatcgcatgttaga

SEQ ID NO: 546632 - DNA, 25 bp, Homo sapien
cggcatcgcatgttagaatctctaa

SEQ ID NO: 546633 - DNA, 25 bp, Homo sapien
ttctgaaggccaatatcataccatt

SEQ ID NO: 546634 - DNA, 25 bp, Homo sapien
gttttagagatattcaagcaatgct

SEQ ID NO: 546635 - DNA, 25 bp, Homo sapien
agcaatgctctcctaatatccatac

SEQ ID NO: 546636 - DNA, 25 bp, Homo sapien
aatatccatacgcaagtgtgtttat

SEQ ID NO: 546637 - DNA, 25 bp, Homo sapien
ttgataatggattccttattctgag

SEQ ID NO: 546638 - DNA, 25 bp, Homo sapien
ttattctgagaactccagacgactg

SEQ ID NO: 546639 - DNA, 25 bp, Homo sapien
tgagaactccagacgactgaaatat

SEQ ID NO: 546640 - DNA, 25 bp, Homo sapien
tccagacgactgaaatatatgagag

SEQ ID NO: 546641 - DNA, 25 bp, Homo sapien
aaggacatagtaggagcaggcctga

SEQ ID NO: 546642 - DNA, 25 bp, Homo sapien
atacaagatcttatttctatcttat

SEQ ID NO: 546643 - DNA, 25 bp, Homo sapien
gaaatatatatgaggattcctctcc

SEQ ID NO: 546644 - DNA, 25 bp, Homo sapien
caaacccatggtttctctaagaatt

SEQ ID NO: 546645 - DNA, 25 bp, Homo sapien
ggtgaggtgtcaggtcatcaaatat

SEQ ID NO: 546646 - DNA, 25 bp, Homo sapien
gtgtcaggtcatcaaatattcatgt

SEQ ID NO: 546647 - DNA, 25 bp, Homo sapien
atgttcatgggataggtcattgata

SEQ ID NO: 546648 - DNA, 25 bp, Homo sapien
tatggtagctttcatttcctttact

SEQ ID NO: 546649 - DNA, 25 bp, Homo sapien
tttcctttactctttaacagtgcag

SEQ ID NO: 546650 - DNA, 25 bp, Homo sapien
tactctttaacagtgcaggtggtca

SEQ ID NO: 546651 - DNA, 25 bp, Homo sapien
ctttaacagtgcaggtggtcagtga

SEQ ID NO: 546652 - DNA, 25 bp, Homo sapien
tggatgtacattcagccttgttctt

SEQ ID NO: 546653 - DNA, 25 bp, Homo sapien
gacactttcatggtcagaccgctga

SEQ ID NO: 546654 - DNA, 25 bp, Homo sapien
tttcatggtcagaccgctgaggctg

SEQ ID NO: 546655 - DNA, 25 bp, Homo sapien
agaccgctgaggctggcatctcttg

SEQ ID NO: 546656 - DNA, 25 bp, Homo sapien
cgctgaggctggcatctcttgtgac

SEQ ID NO: 546657 - DNA, 25 bp, Homo sapien
agtttagatttcacgattgggcctt

SEQ ID NO: 546658 - DNA, 25 bp, Homo sapien
tagatttcacgattgggccttagtt

SEQ ID NO: 546659 - DNA, 25 bp, Homo sapien
atattgtatgcagttttcccagtgt

SEQ ID NO: 546660 - DNA, 25 bp, Homo sapien
gtatgcagttttcccagtgttacga

SEQ ID NO: 546661 - DNA, 25 bp, Homo sapien
gcagttttcccagtgttacgagatt

SEQ ID NO: 546662 - DNA, 25 bp, Homo sapien
gttacgagattggtgttgctatcca

SEQ ID NO: 546663 - DNA, 25 bp, Homo sapien
ggtgttgctatccatttgttgtgaa

SEQ ID NO: 546664 - DNA, 25 bp, Homo sapien
gctatccatttgttgtgaatgaaga

SEQ ID NO: 546665 - DNA, 25 bp, Homo sapien
gtggactgtagttcttagctgaacc

SEQ ID NO: 546666 - DNA, 25 bp, Homo sapien
tgtagttcttagctgaaccctttct

SEQ ID NO: 546667 - DNA, 25 bp, Homo sapien
tgtttaaaacaatcatcaggcctat

SEQ ID NO: 546668 - DNA, 25 bp, Homo sapien
aaacaatcatcaggcctatcctctg

SEQ ID NO: 546669 - DNA, 25 bp, Homo sapien
agagaaaagggttcttggccaggct

SEQ ID NO: 546670 - DNA, 25 bp, Homo sapien
ttcgcgctgctgaccgggccaggct

SEQ ID NO: 546671 - DNA, 25 bp, Homo sapien
aggctctgagctgcccgctgtgtgc

SEQ ID NO: 546672 - DNA, 25 bp, Homo sapien
tgagctgcccgctgtgtgcatcggc

SEQ ID NO: 546673 - DNA, 25 bp, Homo sapien
ctgcccgctgtgtgcatcggcgtga

SEQ ID NO: 546674 - DNA, 25 bp, Homo sapien
ccgctgtgtgcatcggcgtgagccc

SEQ ID NO: 546675 - DNA, 25 bp, Homo sapien
ggaagtcggtgctcttccacacggt

SEQ ID NO: 546676 - DNA, 25 bp, Homo sapien
aagtcggtgctcttccacacggtgc

SEQ ID NO: 546677 - DNA, 25 bp, Homo sapien
tgctcttccacacggtgcgctttgg

SEQ ID NO: 546678 - DNA, 25 bp, Homo sapien
acacggtgcgctttggcgcgctctc

SEQ ID NO: 546679 - DNA, 25 bp, Homo sapien
gctttggcgcgctctcttgctggct

SEQ ID NO: 546680 - DNA, 25 bp, Homo sapien
ctgggcgagatgagcaccgagcaca

SEQ ID NO: 546681 - DNA, 25 bp, Homo sapien
ggtctaagtgctgactggctacgta

SEQ ID NO: 546682 - DNA, 25 bp, Homo sapien
ctgactggctacgtagttcgggcaa

SEQ ID NO: 546683 - DNA, 25 bp, Homo sapien
gtagttcgggcaaatcctccaaaag

SEQ ID NO: 546684 - DNA, 25 bp, Homo sapien
cccagtgactactttttgacttctg

SEQ ID NO: 546685 - DNA, 25 bp, Homo sapien
ttctctcagggaaaaacatgcagtc

SEQ ID NO: 546686 - DNA, 25 bp, Homo sapien
tgcagtcctctagtgtttcatgtac

SEQ ID NO: 546687 - DNA, 25 bp, Homo sapien
tagtgtttcatgtacattctgtggg

SEQ ID NO: 546688 - DNA, 25 bp, Homo sapien
gaacaccttggttctggttaaacag

SEQ ID NO: 546689 - DNA, 25 bp, Homo sapien
gtacttttgatagctgtgccaggaa

SEQ ID NO: 546690 - DNA, 25 bp, Homo sapien
gtcaaatgtagtgtgtttccctaac

SEQ ID NO: 546691 - DNA, 25 bp, Homo sapien
tagtgtgtttccctaactttctgtt

SEQ ID NO: 546692 - DNA, 25 bp, Homo sapien
agtcttgaattttattataatcccg

SEQ ID NO: 546693 - DNA, 25 bp, Homo sapien
tcttgaattttattataatcccgtg

SEQ ID NO: 546694 - DNA, 25 bp, Homo sapien
taatcccgtgaaaccatcatcagag

SEQ ID NO: 546695 - DNA, 25 bp, Homo sapien
aatctatcacctttgtatttacttg

SEQ ID NO: 546696 - DNA, 25 bp, Homo sapien
tctctctgctcttcaaacaaccatt

SEQ ID NO: 546697 - DNA, 25 bp, Homo sapien
tttactttgctgtatgatggagtac

SEQ ID NO: 546698 - DNA, 25 bp, Homo sapien
tttgctgtatgatggagtactttcc

SEQ ID NO: 546699 - DNA, 25 bp, Homo sapien
ctgtatgatggagtactttccattt

SEQ ID NO: 546700 - DNA, 25 bp, Homo sapien
atggagtactttccattttctggaa

SEQ ID NO: 546701 - DNA, 25 bp, Homo sapien
tctggaattttctgactgatgtaat

SEQ ID NO: 546702 - DNA, 25 bp, Homo sapien
acacatatttgagctgtaggataag

SEQ ID NO: 546703 - DNA, 25 bp, Homo sapien
tgcccccttccctggcccagtctca

SEQ ID NO: 546704 - DNA, 25 bp, Homo sapien
gcccccttccctggcccagtctcaa

SEQ ID NO: 546705 - DNA, 25 bp, Homo sapien
tctcaaaaaaaatgaggctgggcgt

SEQ ID NO: 546706 - DNA, 25 bp, Homo sapien
ctcaaaaaaaatgaggctgggcgtg

SEQ ID NO: 546707 - DNA, 25 bp, Homo sapien
tcaaaaaaaatgaggctgggcgtgg

SEQ ID NO: 546708 - DNA, 25 bp, Homo sapien
tgtaatcccagccaaggctggcaga

SEQ ID NO: 546709 - DNA, 25 bp, Homo sapien
gtaatcccagccaaggctggcagat

SEQ ID NO: 546710 - DNA, 25 bp, Homo sapien
taatcccagccaaggctggcagatc

SEQ ID NO: 546711 - DNA, 25 bp, Homo sapien
aatcccagccaaggctggcagatca

SEQ ID NO: 546712 - DNA, 25 bp, Homo sapien
atcccagccaaggctggcagatcac

SEQ ID NO: 546713 - DNA, 25 bp, Homo sapien
tcccagccaaggctggcagatcact

SEQ ID NO: 546714 - DNA, 25 bp, Homo sapien
cacaacctgggcatggaccatgatg

SEQ ID NO: 546715 - DNA, 25 bp, Homo sapien
catgatgagaacgtccagggctgcc

SEQ ID NO: 546716 - DNA, 25 bp, Homo sapien
atgagaacgtccagggctgccgctg

SEQ ID NO: 546717 - DNA, 25 bp, Homo sapien
gctgccgctgccaggaacgcttcga

SEQ ID NO: 546718 - DNA, 25 bp, Homo sapien
ttccccaggatgttcagtgactgca

SEQ ID NO: 546719 - DNA, 25 bp, Homo sapien
tgttcagtgactgcagccaggccta

SEQ ID NO: 546720 - DNA, 25 bp, Homo sapien
acaacgtacagctcatcacgggtgt

SEQ ID NO: 546721 - DNA, 25 bp, Homo sapien
atcacgggtgtcgacttcaccggga

SEQ ID NO: 546722 - DNA, 25 bp, Homo sapien
gtttgccagggtgtccgccatgtgc

SEQ ID NO: 546723 - DNA, 25 bp, Homo sapien
gggctgtgaaccaggaccacagcaa

SEQ ID NO: 546724 - DNA, 25 bp, Homo sapien
ccacagcaagaaccccgtgggcgtg

SEQ ID NO: 546725 - DNA, 25 bp, Homo sapien
tatcctgggatgtgagacaaaccga

SEQ ID NO: 546726 - DNA, 25 bp, Homo sapien
gacaaaccgatttctccatagatgg

SEQ ID NO: 546727 - DNA, 25 bp, Homo sapien
tttctccatagatgggctgcaggga

SEQ ID NO: 546728 - DNA, 25 bp, Homo sapien
gtgaaggttcctgggatcttaggta

SEQ ID NO: 546729 - DNA, 25 bp, Homo sapien
tcttaggtaaagactagacgccgcc

SEQ ID NO: 546730 - DNA, 25 bp, Homo sapien
agacgccgcctagtactggtctcta

SEQ ID NO: 546731 - DNA, 25 bp, Homo sapien
tggtctctactgtgctggctcagga

SEQ ID NO: 546732 - DNA, 25 bp, Homo sapien
gaaggacttagcctcaacctgagtt

SEQ ID NO: 546733 - DNA, 25 bp, Homo sapien
gcaggacttgatccaaacccacagt

SEQ ID NO: 546734 - DNA, 25 bp, Homo sapien
cagaatgttggcaagatcgggtttt

SEQ ID NO: 546735 - DNA, 25 bp, Homo sapien
tttgccttgagctatcctgggatgt

SEQ ID NO: 546736 - DNA, 25 bp, Homo sapien
gtagagggccaagagctagggacag

SEQ ID NO: 546737 - DNA, 25 bp, Homo sapien
gactggcccaggtggtagggaggaa

SEQ ID NO: 546738 - DNA, 25 bp, Homo sapien
tagggaggaaagaactcccagagtt

SEQ ID NO: 546739 - DNA, 25 bp, Homo sapien
ttcctttagccaggaaacctgctct

SEQ ID NO: 546740 - DNA, 25 bp, Homo sapien
tagccaggaaacctgctctactgac

SEQ ID NO: 546741 - DNA, 25 bp, Homo sapien
ctactgaccccgtgacttggacagt

SEQ ID NO: 546742 - DNA, 25 bp, Homo sapien
actgaccccgtgacttggacagtca

SEQ ID NO: 546743 - DNA, 25 bp, Homo sapien
acttggacagtcagacatcaccctg

SEQ ID NO: 546744 - DNA, 25 bp, Homo sapien
ttggacagtcagacatcaccctgag

SEQ ID NO: 546745 - DNA, 25 bp, Homo sapien
tacctatgtggcctgaacgattaaa

SEQ ID NO: 546746 - DNA, 25 bp, Homo sapien
ctatgtggcctgaacgattaaaaga

SEQ ID NO: 546747 - DNA, 25 bp, Homo sapien
acaaccaggaaggtgcaggcacgcc

SEQ ID NO: 546748 - DNA, 25 bp, Homo sapien
ctcccctatttattgcctcctggaa

SEQ ID NO: 546749 - DNA, 25 bp, Homo sapien
ctcatcactatgtcaccaaagtgtt

SEQ ID NO: 546750 - DNA, 25 bp, Homo sapien
agccaggcacaatgagggctcccaa

SEQ ID NO: 546751 - DNA, 25 bp, Homo sapien
acagctgcaaggatttatctgaacc

SEQ ID NO: 546752 - DNA, 25 bp, Homo sapien
aagaggaggagccatctaagtttct

SEQ ID NO: 546753 - DNA, 25 bp, Homo sapien
gagccatctaagtttctggaaacct

SEQ ID NO: 546754 - DNA, 25 bp, Homo sapien
gaacttggtattccagagacttctg

SEQ ID NO: 546755 - DNA, 25 bp, Homo sapien
agagacttctggaacgccgtgcaag

SEQ ID NO: 546756 - DNA, 25 bp, Homo sapien
ttctggaacgccgtgcaaggcctgc

SEQ ID NO: 546757 - DNA, 25 bp, Homo sapien
cccagcaagccacaaccaggaaggt

SEQ ID NO: 546758 - DNA, 25 bp, Homo sapien
ttcagctttcttaagtttctccctc

SEQ ID NO: 546759 - DNA, 25 bp, Homo sapien
agctttcttaagtttctccctcatt

SEQ ID NO: 546760 - DNA, 25 bp, Homo sapien
gctttcttaagtttctccctcattt

SEQ ID NO: 546761 - DNA, 25 bp, Homo sapien
tttctccctcatttagatttcatgg

SEQ ID NO: 546762 - DNA, 25 bp, Homo sapien
ccctcatttagatttcatggttttt

SEQ ID NO: 546763 - DNA, 25 bp, Homo sapien
taaattttagattcacatttttagg

SEQ ID NO: 546764 - DNA, 25 bp, Homo sapien
ggaaatttggagtattccagacaat

SEQ ID NO: 546765 - DNA, 25 bp, Homo sapien
tccagacaatatactagatacccag

SEQ ID NO: 546766 - DNA, 25 bp, Homo sapien
atatactagatacccagaaactttt

SEQ ID NO: 546767 - DNA, 25 bp, Homo sapien
ccagaaacttttctcagtaggttct

SEQ ID NO: 546768 - DNA, 25 bp, Homo sapien
atctggtccaaagtctttaaaatag

SEQ ID NO: 546769 - DNA, 25 bp, Homo sapien
gtctgcataaactgtgagagccaag

SEQ ID NO: 546770 - DNA, 25 bp, Homo sapien
gagccaagtcaacagcttttatcaa

SEQ ID NO: 546771 - DNA, 25 bp, Homo sapien
aagaatttactctctgaccagcaat

SEQ ID NO: 546772 - DNA, 25 bp, Homo sapien
gagccagattcagattttacccatg

SEQ ID NO: 546773 - DNA, 25 bp, Homo sapien
agactcagactttcaccacatttgg

SEQ ID NO: 546774 - DNA, 25 bp, Homo sapien
catttggaaaactacttgcatcata

SEQ ID NO: 546775 - DNA, 25 bp, Homo sapien
gtttatatgaagcagacactaagtg

SEQ ID NO: 546776 - DNA, 25 bp, Homo sapien
gacactaagtgctatagacactctc

SEQ ID NO: 546777 - DNA, 25 bp, Homo sapien
agacactctcagaatatcatacttg

SEQ ID NO: 546778 - DNA, 25 bp, Homo sapien
taaaatgccgaatctgagtcaacag

SEQ ID NO: 546779 - DNA, 25 bp, Homo sapien
gccgaatctgagtcaacagctgccc

SEQ ID NO: 546780 - DNA, 25 bp, Homo sapien
gtaaattttcaagctaatgcggcaa

SEQ ID NO: 546781 - DNA, 25 bp, Homo sapien
atgcggcaaaaccaatattgattct

SEQ ID NO: 546782 - DNA, 25 bp, Homo sapien
tgtccttgtagtaccttcagaggca

SEQ ID NO: 546783 - DNA, 25 bp, Homo sapien
atattgattctgacatttatgcttt

SEQ ID NO: 546784 - DNA, 25 bp, Homo sapien
gaccattacttattattttattgct

SEQ ID NO: 546785 - DNA, 25 bp, Homo sapien
agtaccttcagaggcagttaataag

SEQ ID NO: 546786 - DNA, 25 bp, Homo sapien
actttaggagtttgagtgcatctac

SEQ ID NO: 546787 - DNA, 25 bp, Homo sapien
taagggctggctgacatttatgact

SEQ ID NO: 546788 - DNA, 25 bp, Homo sapien
ggctgacatttatgacttatctttt

SEQ ID NO: 546789 - DNA, 25 bp, Homo sapien
ttctgtgtgtttaaccattactatt

SEQ ID NO: 546790 - DNA, 25 bp, Homo sapien
taaccattactatttttccgccagt

SEQ ID NO: 546791 - DNA, 25 bp, Homo sapien
tgtatagtctacaggttcataagtg

SEQ ID NO: 546792 - DNA, 25 bp, Homo sapien
agtctacaggttcataagtgagtat

SEQ ID NO: 546793 - DNA, 25 bp, Homo sapien
aagtgagtatatccatgagtataaa

SEQ ID NO: 546794 - DNA, 25 bp, Homo sapien
aaagaaggtcatttatgggtggaga

SEQ ID NO: 546795 - DNA, 25 bp, Homo sapien
ataaactacattttcagataaagga

SEQ ID NO: 546796 - DNA, 25 bp, Homo sapien
aagagtgttcactgcaggttcctga

SEQ ID NO: 546797 - DNA, 25 bp, Homo sapien
gagtgttcactgcaggttcctgaaa

SEQ ID NO: 546798 - DNA, 25 bp, Homo sapien
aggttcctgaaatatttcagtccat

SEQ ID NO: 546799 - DNA, 25 bp, Homo sapien
gaaatatttcagtccattcaagttt

SEQ ID NO: 546800 - DNA, 25 bp, Homo sapien
atatttcagtccattcaagttttaa

SEQ ID NO: 546801 - DNA, 25 bp, Homo sapien
caagttttaattataccaatgaatc

SEQ ID NO: 546802 - DNA, 25 bp, Homo sapien
cttagagtccccaaaacttctgtat

SEQ ID NO: 546803 - DNA, 25 bp, Homo sapien
gagtccccaaaacttctgtatgtaa

SEQ ID NO: 546804 - DNA, 25 bp, Homo sapien
aaaccatcactgacatgtggtggtg

SEQ ID NO: 546805 - DNA, 25 bp, Homo sapien
gaggatttagtgagatgatgtgccc

SEQ ID NO: 546806 - DNA, 25 bp, Homo sapien
tgatgtgcccaaaacacctaaacag

SEQ ID NO: 546807 - DNA, 25 bp, Homo sapien
atagttggtgtaaagctaagagcaa

SEQ ID NO: 546808 - DNA, 25 bp, Homo sapien
gccttagcacccagttggcatttaa

SEQ ID NO: 546809 - DNA, 25 bp, Homo sapien
caggaacttgtccaagaaggtccat

SEQ ID NO: 546810 - DNA, 25 bp, Homo sapien
aagaaggtccatttgcttgagatgt

SEQ ID NO: 546811 - DNA, 25 bp, Homo sapien
ggtccatttgcttgagatgttatat

SEQ ID NO: 546812 - DNA, 25 bp, Homo sapien
gttatatttgattcctttatcctaa

SEQ ID NO: 546813 - DNA, 25 bp, Homo sapien
gagaaagtattgagactgtcagtgt

SEQ ID NO: 546814 - DNA, 25 bp, Homo sapien
gtcagtgttgataaagcttctagca

SEQ ID NO: 546815 - DNA, 25 bp, Homo sapien
aagcttctagcaagattaggttgac

SEQ ID NO: 546816 - DNA, 25 bp, Homo sapien
ttaggttgactagaagtgcatcaca

SEQ ID NO: 546817 - DNA, 25 bp, Homo sapien
gaagtgcatcacagttctttatact

SEQ ID NO: 546818 - DNA, 25 bp, Homo sapien
gcatcacagttctttatacttttag

SEQ ID NO: 546819 - DNA, 25 bp, Homo sapien
atccagttacagaaattgtacctta

SEQ ID NO: 546820 - DNA, 25 bp, Homo sapien
gaaattgtaccttatcagttatact

SEQ ID NO: 546821 - DNA, 25 bp, Homo sapien
aaatgcgatgtatacctttgcccat

SEQ ID NO: 546822 - DNA, 25 bp, Homo sapien
atgtatacctttgcccattcaactt

SEQ ID NO: 546823 - DNA, 25 bp, Homo sapien
cccattcaactttagtccatatttt

SEQ ID NO: 546824 - DNA, 25 bp, Homo sapien
taggactacagatgcaggccactac

SEQ ID NO: 546825 - DNA, 25 bp, Homo sapien
acagatgcaggccactacacctggc

SEQ ID NO: 546826 - DNA, 25 bp, Homo sapien
gacagagcctcgctatattgctcag

SEQ ID NO: 546827 - DNA, 25 bp, Homo sapien
acagagcctcgctatattgctcagg

SEQ ID NO: 546828 - DNA, 25 bp, Homo sapien
agagcctcgctatattgctcaggcc

SEQ ID NO: 546829 - DNA, 25 bp, Homo sapien
gcctcgctatattgctcaggcctgt

SEQ ID NO: 546830 - DNA, 25 bp, Homo sapien
tgctcaggcctgtctcaaattccta

SEQ ID NO: 546831 - DNA, 25 bp, Homo sapien
tcaggcctgtctcaaattcctaagc

SEQ ID NO: 546832 - DNA, 25 bp, Homo sapien
aggcctgtctcaaattcctaagctc

SEQ ID NO: 546833 - DNA, 25 bp, Homo sapien
ggcctgtctcaaattcctaagctca

SEQ ID NO: 546834 - DNA, 25 bp, Homo sapien
tcagtttcccacgtgctggaattac

SEQ ID NO: 546835 - DNA, 25 bp, Homo sapien
agcgcgggtgcctcagaagccaagc

SEQ ID NO: 546836 - DNA, 25 bp, Homo sapien
gaaccagatgagagctgcgttttca

SEQ ID NO: 546837 - DNA, 25 bp, Homo sapien
atgagagctgcgttttcaagaagca

SEQ ID NO: 546838 - DNA, 25 bp, Homo sapien
gacaccttgggaaatcgacactctc

SEQ ID NO: 546839 - DNA, 25 bp, Homo sapien
aaatcgacactctcctgtccttggg

SEQ ID NO: 546840 - DNA, 25 bp, Homo sapien
ctggaaagaagctccgtcagcgtaa

SEQ ID NO: 546841 - DNA, 25 bp, Homo sapien
gctccgtcagcgtaaagtgaactct

SEQ ID NO: 546842 - DNA, 25 bp, Homo sapien
gtaaagtgaactcttagctttgact

SEQ ID NO: 546843 - DNA, 25 bp, Homo sapien
tagctttgactttgcagagggatcc

SEQ ID NO: 546844 - DNA, 25 bp, Homo sapien
gcagagggatccgttgtgtcacagt

SEQ ID NO: 546845 - DNA, 25 bp, Homo sapien
ttgtgtcacagtgacccgcattcct

SEQ ID NO: 546846 - DNA, 25 bp, Homo sapien
aggtcaggataggatttcaaggcca

SEQ ID NO: 546847 - DNA, 25 bp, Homo sapien
aggagaaagtcccaacccaccagtg

SEQ ID NO: 546848 - DNA, 25 bp, Homo sapien
aacccaccagtgcaaccaacaaaag

SEQ ID NO: 546849 - DNA, 25 bp, Homo sapien
aagagtaagttttacctacagcctg

SEQ ID NO: 546850 - DNA, 25 bp, Homo sapien
gcctgggttttcacaagtagcattt

SEQ ID NO: 546851 - DNA, 25 bp, Homo sapien
acaagtagcatttttattcctcctg

SEQ ID NO: 546852 - DNA, 25 bp, Homo sapien
aagctctaaacccaacctgtattat

SEQ ID NO: 546853 - DNA, 25 bp, Homo sapien
acccaacctgtattatatgcagcag

SEQ ID NO: 546854 - DNA, 25 bp, Homo sapien
tatgcagcagcaggttatctttgtt

SEQ ID NO: 546855 - DNA, 25 bp, Homo sapien
tattctgtacttagtcacctttccg

SEQ ID NO: 546856 - DNA, 25 bp, Homo sapien
acctttccgtgtgatctgcatttga

SEQ ID NO: 546857 - DNA, 25 bp, Homo sapien
agtgccacttgagagtctcttctct

SEQ ID NO: 546858 - DNA, 25 bp, Homo sapien
cacttgagagtctcttctcttcttc

SEQ ID NO: 546859 - DNA, 25 bp, Homo sapien
cttcttctacctggggacgaatatc

SEQ ID NO: 546860 - DNA, 25 bp, Homo sapien
tatccagaggtggtttggagcaaac

SEQ ID NO: 546861 - DNA, 25 bp, Homo sapien
aggatggcattgagaggcttgctgg

SEQ ID NO: 546862 - DNA, 25 bp, Homo sapien
ttgctggttatgaggcagaaagctg

SEQ ID NO: 546863 - DNA, 25 bp, Homo sapien
ggcagaaagctgacctcatgcatga

SEQ ID NO: 546864 - DNA, 25 bp, Homo sapien
gacctcatgcatgacttggttgcta

SEQ ID NO: 546865 - DNA, 25 bp, Homo sapien
atgcatgacttggttgctatctccc

SEQ ID NO: 546866 - DNA, 25 bp, Homo sapien
cccacaaaagtgtcctcggagttca

SEQ ID NO: 546867 - DNA, 25 bp, Homo sapien
caaaagtgtcctcggagttcagccc

SEQ ID NO: 546868 - DNA, 25 bp, Homo sapien
atgacaaagatctgcttttgtggca

SEQ ID NO: 546869 - DNA, 25 bp, Homo sapien
gatctgcttttgtggcagaggactt

SEQ ID NO: 546870 - DNA, 25 bp, Homo sapien
tattccttccctcccactaatttgt

SEQ ID NO: 546871 - DNA, 25 bp, Homo sapien
cactaatttgttggcctttaacagc

SEQ ID NO: 546872 - DNA, 25 bp, Homo sapien
gttggcctttaacagcaattttgaa

SEQ ID NO: 546873 - DNA, 25 bp, Homo sapien
gcaattttgaaaactgggtcttctg

SEQ ID NO: 546874 - DNA, 25 bp, Homo sapien
tgaaaactgggtcttctggttatgt

SEQ ID NO: 546875 - DNA, 25 bp, Homo sapien
ttagaggatgctgtgccattgagta

SEQ ID NO: 546876 - DNA, 25 bp, Homo sapien
gctgtttcagcgagtgggttttttc

SEQ ID NO: 546877 - DNA, 25 bp, Homo sapien
tcagcaaggtgatgattatctcatg

SEQ ID NO: 546878 - DNA, 25 bp, Homo sapien
gatgattatctcatgggaaatgaca

SEQ ID NO: 546879 - DNA, 25 bp, Homo sapien
gtgactgcctccaggccctcaagga

SEQ ID NO: 546880 - DNA, 25 bp, Homo sapien
aggccctcaaggacgaattccacca

SEQ ID NO: 546881 - DNA, 25 bp, Homo sapien
tcaaggacgaattccaccaggactt

SEQ ID NO: 546882 - DNA, 25 bp, Homo sapien
aggacgaattccaccaggacttgtc

SEQ ID NO: 546883 - DNA, 25 bp, Homo sapien
acgaattccaccaggacttgtcccg

SEQ ID NO: 546884 - DNA, 25 bp, Homo sapien
gcgctgcccctcatcttagcattgg

SEQ ID NO: 546885 - DNA, 25 bp, Homo sapien
gcccctcatcttagcattgggcaga

SEQ ID NO: 546886 - DNA, 25 bp, Homo sapien
cctcatcttagcattgggcagacac

SEQ ID NO: 546887 - DNA, 25 bp, Homo sapien
catcttagcattgggcagacaccag

SEQ ID NO: 546888 - DNA, 25 bp, Homo sapien
ttagcattgggcagacaccagggca

SEQ ID NO: 546889 - DNA, 25 bp, Homo sapien
acgctccaagcctggacatctcccg

SEQ ID NO: 546890 - DNA, 25 bp, Homo sapien
gggttagagaacaacaatattccta

SEQ ID NO: 546891 - DNA, 25 bp, Homo sapien
aacaatattcctatagtttctgtat

SEQ ID NO: 546892 - DNA, 25 bp, Homo sapien
attcctatagtttctgtattaatgc

SEQ ID NO: 546893 - DNA, 25 bp, Homo sapien
tttctgtattaatgcagtagagaca

SEQ ID NO: 546894 - DNA, 25 bp, Homo sapien
gacagaggttcctaacgcaaaaaga

SEQ ID NO: 546895 - DNA, 25 bp, Homo sapien
agtaaagaccgtcaaattagagctt

SEQ ID NO: 546896 - DNA, 25 bp, Homo sapien
gctatgtaattagcccgtaagttac

SEQ ID NO: 546897 - DNA, 25 bp, Homo sapien
agttttccagtcacattggtgccat

SEQ ID NO: 546898 - DNA, 25 bp, Homo sapien
ttccagtcacattggtgccattcag

SEQ ID NO: 546899 - DNA, 25 bp, Homo sapien
cagtcacattggtgccattcaggac

SEQ ID NO: 546900 - DNA, 25 bp, Homo sapien
ggaaatatgtacttagcagaatagt

SEQ ID NO: 546901 - DNA, 25 bp, Homo sapien
gcattatgaagctttggtattgtac

SEQ ID NO: 546902 - DNA, 25 bp, Homo sapien
gctttggtattgtacaaggtcagta

SEQ ID NO: 546903 - DNA, 25 bp, Homo sapien
caaggtcagtagtaagatgctcact

SEQ ID NO: 546904 - DNA, 25 bp, Homo sapien
gatgctcactagtctcagggcttgt

SEQ ID NO: 546905 - DNA, 25 bp, Homo sapien
agtctcagggcttgtgtaatattct

SEQ ID NO: 546906 - DNA, 25 bp, Homo sapien
gaaatggtcaagcaattatacacag

SEQ ID NO: 546907 - DNA, 25 bp, Homo sapien
ggtcaagcaattatacacagtattt

SEQ ID NO: 546908 - DNA, 25 bp, Homo sapien
aagcataccgtttgtctgtcacatt

SEQ ID NO: 546909 - DNA, 25 bp, Homo sapien
agggtcttttcaagctctaacaaag

SEQ ID NO: 546910 - DNA, 25 bp, Homo sapien
caagctctaacaaagtcactaacaa

SEQ ID NO: 546911 - DNA, 25 bp, Homo sapien
acaaatgcattattttctacagaat

SEQ ID NO: 546912 - DNA, 25 bp, Homo sapien
gaaatgtaaacgtgaccctcatgtt

SEQ ID NO: 546913 - DNA, 25 bp, Homo sapien
acgtgaccctcatgttaagatagaa

SEQ ID NO: 546914 - DNA, 25 bp, Homo sapien
gaaggacactgatgactggctgtgc

SEQ ID NO: 546915 - DNA, 25 bp, Homo sapien
tgatgactggctgtgcgtggatttt

SEQ ID NO: 546916 - DNA, 25 bp, Homo sapien
ggattttggcagcatggtgattcat

SEQ ID NO: 546917 - DNA, 25 bp, Homo sapien
ggtgattcatttgatgcttccagaa

SEQ ID NO: 546918 - DNA, 25 bp, Homo sapien
gatgcttccagaaaccagagaaatc

SEQ ID NO: 546919 - DNA, 25 bp, Homo sapien
gagaaattatggaccctacgttctt

SEQ ID NO: 546920 - DNA, 25 bp, Homo sapien
ggaccctacgttcttatgatgacca

SEQ ID NO: 546921 - DNA, 25 bp, Homo sapien
tgaccagttagctcagatagcacct

SEQ ID NO: 546922 - DNA, 25 bp, Homo sapien
gatagcacctgagacagtacctgaa

SEQ ID NO: 546923 - DNA, 25 bp, Homo sapien
aggttaatactctgtgcatcacatg

SEQ ID NO: 546924 - DNA, 25 bp, Homo sapien
tggaaaaaatccctctgctgaacct

SEQ ID NO: 546925 - DNA, 25 bp, Homo sapien
atccctctgctgaacctagtctata

SEQ ID NO: 546926 - DNA, 25 bp, Homo sapien
gaacctagtctatacaccaatatta

SEQ ID NO: 546927 - DNA, 25 bp, Homo sapien
atattatgtcattcaaggtaccgac

SEQ ID NO: 546928 - DNA, 25 bp, Homo sapien
aggtaccgacaacctgtttcaggag

SEQ ID NO: 546929 - DNA, 25 bp, Homo sapien
acctgtttcaggagagagacgttca

SEQ ID NO: 546930 - DNA, 25 bp, Homo sapien
gagagacgttcatttttccctaatg

SEQ ID NO: 546931 - DNA, 25 bp, Homo sapien
aaatgcaagcattctgttagaccta

SEQ ID NO: 546932 - DNA, 25 bp, Homo sapien
gttagacctattatattgcctgtta

SEQ ID NO: 546933 - DNA, 25 bp, Homo sapien
attgcctgttaatttgactgtaatg

SEQ ID NO: 546934 - DNA, 25 bp, Homo sapien
gtgacttccaaaagagtcactgcac

SEQ ID NO: 546935 - DNA, 25 bp, Homo sapien
gagtcactgcaccatttgtctgctt

SEQ ID NO: 546936 - DNA, 25 bp, Homo sapien
ctgcaccatttgtctgcttgaccct

SEQ ID NO: 546937 - DNA, 25 bp, Homo sapien
tgcttgaccctgttcatgcccagaa

SEQ ID NO: 546938 - DNA, 25 bp, Homo sapien
cctgttcatgcccagaagctgcaca

SEQ ID NO: 546939 - DNA, 25 bp, Homo sapien
aagctgcacagccaagaactcccaa

SEQ ID NO: 546940 - DNA, 25 bp, Homo sapien
cagccaagaactcccaagacaggtg

SEQ ID NO: 546941 - DNA, 25 bp, Homo sapien
tgtgcatctgtggagatagtggaat

SEQ ID NO: 546942 - DNA, 25 bp, Homo sapien
gaatagaaaggaccccagtttcaat

SEQ ID NO: 546943 - DNA, 25 bp, Homo sapien
cactaatttgatatagtcggcatct

SEQ ID NO: 546944 - DNA, 25 bp, Homo sapien
gatatagtcggcatctatacattaa

SEQ ID NO: 546945 - DNA, 25 bp, Homo sapien
agggctcagggatactcgggccttt

SEQ ID NO: 546946 - DNA, 25 bp, Homo sapien
gatactcgggcctttctgtgaaagt

SEQ ID NO: 546947 - DNA, 25 bp, Homo sapien
tgaaagttgtaaactccaccacagg

SEQ ID NO: 546948 - DNA, 25 bp, Homo sapien
tgtggcacacaggaaacacccctgg

SEQ ID NO: 546949 - DNA, 25 bp, Homo sapien
caggtgcgcaccctgtggcatgacc

SEQ ID NO: 546950 - DNA, 25 bp, Homo sapien
atgaccctcgtcacataggctggaa

SEQ ID NO: 546951 - DNA, 25 bp, Homo sapien
tggaaagatttcaccgcctacagat

SEQ ID NO: 546952 - DNA, 25 bp, Homo sapien
tacagatggcgtctcagccacaggc

SEQ ID NO: 546953 - DNA, 25 bp, Homo sapien
gccacaggccaaagacgggtttcat

SEQ ID NO: 546954 - DNA, 25 bp, Homo sapien
gctgactcaggacccatctatgata

SEQ ID NO: 546955 - DNA, 25 bp, Homo sapien
aaaacctatgctggtggtagactag

SEQ ID NO: 546956 - DNA, 25 bp, Homo sapien
ggcagcatggtgattcatttgatgc

SEQ ID NO: 546957 - DNA, 25 bp, Homo sapien
ggtgattcatttgatgcttccagaa

SEQ ID NO: 546958 - DNA, 25 bp, Homo sapien
tgattcatttgatgcttccagaaac

SEQ ID NO: 546959 - DNA, 25 bp, Homo sapien
gagaaattatggaccctacgttctt

SEQ ID NO: 546960 - DNA, 25 bp, Homo sapien
ttatggaccctacgttcttatgatg

SEQ ID NO: 546961 - DNA, 25 bp, Homo sapien
ggaccctacgttcttatgatgacca

SEQ ID NO: 546962 - DNA, 25 bp, Homo sapien
ccctacgttcttatgatgaccagtt

SEQ ID NO: 546963 - DNA, 25 bp, Homo sapien
atgatgaccagttagctcagatagc

SEQ ID NO: 546964 - DNA, 25 bp, Homo sapien
gaccagttagctcagatagcacctg

SEQ ID NO: 546965 - DNA, 25 bp, Homo sapien
gatagcacctgagacagtacctgaa

SEQ ID NO: 546966 - DNA, 25 bp, Homo sapien
tagcacctgagacagtacctgaaga

SEQ ID NO: 546967 - DNA, 25 bp, Homo sapien
gtctctaagtttgtggtgtaccaaa

SEQ ID NO: 546968 - DNA, 25 bp, Homo sapien
tctctaagtttgtggtgtaccaaat

SEQ ID NO: 546969 - DNA, 25 bp, Homo sapien
aagtttgtggtgtaccaaatcatcg

SEQ ID NO: 546970 - DNA, 25 bp, Homo sapien
gtttgtggtgtaccaaatcatcgtc

SEQ ID NO: 546971 - DNA, 25 bp, Homo sapien
ttgtggtgtaccaaatcatcgtcat

SEQ ID NO: 546972 - DNA, 25 bp, Homo sapien
tgtggtgtaccaaatcatcgtcatc

SEQ ID NO: 546973 - DNA, 25 bp, Homo sapien
gtggtgtaccaaatcatcgtcatcc

SEQ ID NO: 546974 - DNA, 25 bp, Homo sapien
ggtgtaccaaatcatcgtcatccag

SEQ ID NO: 546975 - DNA, 25 bp, Homo sapien
gtgtaccaaatcatcgtcatccaga

SEQ ID NO: 546976 - DNA, 25 bp, Homo sapien
tgtaccaaatcatcgtcatccagac

SEQ ID NO: 546977 - DNA, 25 bp, Homo sapien
gtaccaaatcatcgtcatccagact

SEQ ID NO: 546978 - DNA, 25 bp, Homo sapien
ggcaggcttctctgtagaaccccag

SEQ ID NO: 546979 - DNA, 25 bp, Homo sapien
ggagtcccgaacttctgcattcaca

SEQ ID NO: 546980 - DNA, 25 bp, Homo sapien
cagaccacctccacaattgttataa

SEQ ID NO: 546981 - DNA, 25 bp, Homo sapien
aattgttataaccaaaggcctcctg

SEQ ID NO: 546982 - DNA, 25 bp, Homo sapien
aaggcctcctgttctgttatttcac

SEQ ID NO: 546983 - DNA, 25 bp, Homo sapien
ttttgttttcactcacttctgactt

SEQ ID NO: 546984 - DNA, 25 bp, Homo sapien
acttctgactttagcctcgtgctga

SEQ ID NO: 546985 - DNA, 25 bp, Homo sapien
tttagcctcgtgctgagccgtgtat

SEQ ID NO: 546986 - DNA, 25 bp, Homo sapien
tgagccgtgtatccatgcagtcatg

SEQ ID NO: 546987 - DNA, 25 bp, Homo sapien
catgcagtcatgttcacgtgctagt

SEQ ID NO: 546988 - DNA, 25 bp, Homo sapien
gttcacgtgctagttacgtttttct

SEQ ID NO: 546989 - DNA, 25 bp, Homo sapien
tttgctgtggacaactagagccctc

SEQ ID NO: 546990 - DNA, 25 bp, Homo sapien
cttccttagccctgagcgaggtaaa

SEQ ID NO: 546991 - DNA, 25 bp, Homo sapien
gaggtaaacaattctgctctgcctt

SEQ ID NO: 546992 - DNA, 25 bp, Homo sapien
ctctgccttccggaagtttcaaatt

SEQ ID NO: 546993 - DNA, 25 bp, Homo sapien
tagctcttcaaccagcgttttcacg

SEQ ID NO: 546994 - DNA, 25 bp, Homo sapien
cagtcctgccacagtcttgaagaag

SEQ ID NO: 546995 - DNA, 25 bp, Homo sapien
aagagatcagctttcgcgtcttcat

SEQ ID NO: 546996 - DNA, 25 bp, Homo sapien
cgcgtcttcattcttgccaagatta

SEQ ID NO: 546997 - DNA, 25 bp, Homo sapien
ttgccaagattagctgcccttcgaa

SEQ ID NO: 546998 - DNA, 25 bp, Homo sapien
acaagctgccctttcggtgagccta

SEQ ID NO: 546999 - DNA, 25 bp, Homo sapien
atctctgtgttgcttgtttctagga

SEQ ID NO: 547000 - DNA, 25 bp, Homo sapien
atcaatcaaatcaatagtcagtctt

SEQ ID NO: 547001 - DNA, 25 bp, Homo sapien
caatagtcagtcttgtaaggaacaa

SEQ ID NO: 547002 - DNA, 25 bp, Homo sapien
gccatgagccaaaagtatcaataaa

SEQ ID NO: 547003 - DNA, 25 bp, Homo sapien
aaaaccaatgagtgtcaagctaaag

SEQ ID NO: 547004 - DNA, 25 bp, Homo sapien
gagtgtcaagctaaagtattgctta

SEQ ID NO: 547005 - DNA, 25 bp, Homo sapien
gtattgcttattcatgagcagttaa

SEQ ID NO: 547006 - DNA, 25 bp, Homo sapien
ggaaaactaatgttagctcgtgaaa

SEQ ID NO: 547007 - DNA, 25 bp, Homo sapien
ttctgtgattgtgagaactcccgtt

SEQ ID NO: 547008 - DNA, 25 bp, Homo sapien
gattgtgagaactcccgttcctgtc

SEQ ID NO: 547009 - DNA, 25 bp, Homo sapien
gttcctgtcccacattgtttaactt

SEQ ID NO: 547010 - DNA, 25 bp, Homo sapien
tgtcccacattgtttaacttgtata

SEQ ID NO: 547011 - DNA, 25 bp, Homo sapien
taataaccttttgaccctgaccttg

SEQ ID NO: 547012 - DNA, 25 bp, Homo sapien
gaccttgctgggtgaattagctctg

SEQ ID NO: 547013 - DNA, 25 bp, Homo sapien
attagctctgaaacactctctacaa

SEQ ID NO: 547014 - DNA, 25 bp, Homo sapien
aaccagtaatgcatttgtcccacat

SEQ ID NO: 547015 - DNA, 25 bp, Homo sapien
tttgtcccacatttcattctgatag

SEQ ID NO: 547016 - DNA, 25 bp, Homo sapien
gaacaccatagcaccaaacaaaaat

SEQ ID NO: 547017 - DNA, 25 bp, Homo sapien
aatccgaggcgttagataatgtctg

SEQ ID NO: 547018 - DNA, 25 bp, Homo sapien
actctctaggattttggttgtcatt

SEQ ID NO: 547019 - DNA, 25 bp, Homo sapien
ttaagtcactttctgttgcctcata

SEQ ID NO: 547020 - DNA, 25 bp, Homo sapien
ttctgttgcctcataggtcacattt

SEQ ID NO: 547021 - DNA, 25 bp, Homo sapien
taggtcacattttagacaggtttgt

SEQ ID NO: 547022 - DNA, 25 bp, Homo sapien
atagaggtcatatgcatagttttca

SEQ ID NO: 547023 - DNA, 25 bp, Homo sapien
gcatagttttcataggtgttttgta

SEQ ID NO: 547024 - DNA, 25 bp, Homo sapien
tttgtaagaactgattgctctcctg

SEQ ID NO: 547025 - DNA, 25 bp, Homo sapien
gaactgattgctctcctgtgagtta

SEQ ID NO: 547026 - DNA, 25 bp, Homo sapien
aagctatgtttactactgggaccct

SEQ ID NO: 547027 - DNA, 25 bp, Homo sapien
tatgtttactactgggaccctcaag

SEQ ID NO: 547028 - DNA, 25 bp, Homo sapien
gaccctcaagaggaataccacttat

SEQ ID NO: 547029 - DNA, 25 bp, Homo sapien
ataccacttatgttacactcctgca

SEQ ID NO: 547030 - DNA, 25 bp, Homo sapien
actcctgcactaaaggcacgtactg

SEQ ID NO: 547031 - DNA, 25 bp, Homo sapien
aaaggcacgtactgcagtgtgaaga

SEQ ID NO: 547032 - DNA, 25 bp, Homo sapien
ggaagagctctctgtattctataat

SEQ ID NO: 547033 - DNA, 25 bp, Homo sapien
tctggagcccaagttcttccaaagt

SEQ ID NO: 547034 - DNA, 25 bp, Homo sapien
acatgtggccaagctttagcattta

SEQ ID NO: 547035 - DNA, 25 bp, Homo sapien
gatttcagccatcaaggaactaatg

SEQ ID NO: 547036 - DNA, 25 bp, Homo sapien
ggaactaatgttgagctgtggagca

SEQ ID NO: 547037 - DNA, 25 bp, Homo sapien
gtaatgtgcacagctcattcatctt

SEQ ID NO: 547038 - DNA, 25 bp, Homo sapien
gctcattcatctttttggctcaact

SEQ ID NO: 547039 - DNA, 25 bp, Homo sapien
taggccatcctgtgaacacaagaag

SEQ ID NO: 547040 - DNA, 25 bp, Homo sapien
gaagccctgaaagctcaagatattt

SEQ ID NO: 547041 - DNA, 25 bp, Homo sapien
gatttcatatgcaagtttctcacac

SEQ ID NO: 547042 - DNA, 25 bp, Homo sapien
gcaagtttctcacacaagtctgaat

SEQ ID NO: 547043 - DNA, 25 bp, Homo sapien
agtctgaatcttacatatgccaaag

SEQ ID NO: 547044 - DNA, 25 bp, Homo sapien
actctcgctctggattccatttggg

SEQ ID NO: 547045 - DNA, 25 bp, Homo sapien
ctggattccatttgggtcagcctgg

SEQ ID NO: 547046 - DNA, 25 bp, Homo sapien
ccatttgggtcagcctggctggtcc

SEQ ID NO: 547047 - DNA, 25 bp, Homo sapien
tggctggtccccaaggcattaggat

SEQ ID NO: 547048 - DNA, 25 bp, Homo sapien
gctggtccccaaggcattaggatgg

SEQ ID NO: 547049 - DNA, 25 bp, Homo sapien
acctggaagatgagctctatgccca

SEQ ID NO: 547050 - DNA, 25 bp, Homo sapien
tggaccacgccctcaatgacatgac

SEQ ID NO: 547051 - DNA, 25 bp, Homo sapien
ctcaatgacatgacctctatataat

SEQ ID NO: 547052 - DNA, 25 bp, Homo sapien
gacctctatataattatcaccgttt

SEQ ID NO: 547053 - DNA, 25 bp, Homo sapien
ataattatcaccgtttctgctctgt

SEQ ID NO: 547054 - DNA, 25 bp, Homo sapien
accgtttctgctctgttctggatct

SEQ ID NO: 547055 - DNA, 25 bp, Homo sapien
taacctacaatactgggcttcattt

SEQ ID NO: 547056 - DNA, 25 bp, Homo sapien
ggcttcatttctgttatgccctaat

SEQ ID NO: 547057 - DNA, 25 bp, Homo sapien
gttatgccctaatctagtcatgctg

SEQ ID NO: 547058 - DNA, 25 bp, Homo sapien
gtcatgctgaatatccatactgtat

SEQ ID NO: 547059 - DNA, 25 bp, Homo sapien
agttcagtaacaatgcatggctcag

SEQ ID NO: 547060 - DNA, 25 bp, Homo sapien
tggtaatatagctttgccaccaagc

SEQ ID NO: 547061 - DNA, 25 bp, Homo sapien
gccaccaagcttttacagttttcct

SEQ ID NO: 547062 - DNA, 25 bp, Homo sapien
ttccttgaatgtacagagacttttt

SEQ ID NO: 547063 - DNA, 25 bp, Homo sapien
gcatggctcagattgtggaatattt

SEQ ID NO: 547064 - DNA, 25 bp, Homo sapien
gtaatctgtagtacttcacacttca

SEQ ID NO: 547065 - DNA, 25 bp, Homo sapien
gtagtacttcacacttcagattttt

SEQ ID NO: 547066 - DNA, 25 bp, Homo sapien
catgctcattttcttgcggcagtta

SEQ ID NO: 547067 - DNA, 25 bp, Homo sapien
ttcttgcggcagttatcttagaaag

SEQ ID NO: 547068 - DNA, 25 bp, Homo sapien
gattgtaagcactgtcatgatcaca

SEQ ID NO: 547069 - DNA, 25 bp, Homo sapien
gtcatgatcacagaatgcaagcttc

SEQ ID NO: 547070 - DNA, 25 bp, Homo sapien
tggtaccatgatcctcaacttagag

SEQ ID NO: 547071 - DNA, 25 bp, Homo sapien
agagagcttaactcacttctctcag

SEQ ID NO: 547072 - DNA, 25 bp, Homo sapien
aaattaggagttgagcacaggacag

SEQ ID NO: 547073 - DNA, 25 bp, Homo sapien
ggaaatgggctttgccacttttagc

SEQ ID NO: 547074 - DNA, 25 bp, Homo sapien
caggcttttctaaccagacttgatt

SEQ ID NO: 547075 - DNA, 25 bp, Homo sapien
ctaaccagacttgatttcctcatgt

SEQ ID NO: 547076 - DNA, 25 bp, Homo sapien
ttcctcatgttctagaaagatcact

SEQ ID NO: 547077 - DNA, 25 bp, Homo sapien
cagctcaaggcaggagctttcctgc

SEQ ID NO: 547078 - DNA, 25 bp, Homo sapien
tggagctcagagacaacaagaaaca

SEQ ID NO: 547079 - DNA, 25 bp, Homo sapien
aagccaaacaaggagtcacataaac

SEQ ID NO: 547080 - DNA, 25 bp, Homo sapien
ggagtcacataaacaagccattttt

SEQ ID NO: 547081 - DNA, 25 bp, Homo sapien
aacaagccatttttgcaggaagtaa

SEQ ID NO: 547082 - DNA, 25 bp, Homo sapien
ttgcaggaagtaatatgtgtctatc

SEQ ID NO: 547083 - DNA, 25 bp, Homo sapien
tgtgtctatctctatagcagttggg

SEQ ID NO: 547084 - DNA, 25 bp, Homo sapien
gagacaacaagaaacacccatgaaa

SEQ ID NO: 547085 - DNA, 25 bp, Homo sapien
gatgactgcattgtgaaaaacctcc

SEQ ID NO: 547086 - DNA, 25 bp, Homo sapien
tgtctgcattggctgttgagaagta

SEQ ID NO: 547087 - DNA, 25 bp, Homo sapien
gaagtgggtttcttcagctcaaggc

SEQ ID NO: 547088 - DNA, 25 bp, Homo sapien
ggcagagaacatcaaacttagtaag

SEQ ID NO: 547089 - DNA, 25 bp, Homo sapien
acttagtaaggctcttgtttcgtga

SEQ ID NO: 547090 - DNA, 25 bp, Homo sapien
gtttcgtgaaacttgtcagattctc

SEQ ID NO: 547091 - DNA, 25 bp, Homo sapien
gaaacttgtcagattctctaatatg

SEQ ID NO: 547092 - DNA, 25 bp, Homo sapien
agtatgaatactgcagatctgattt

SEQ ID NO: 547093 - DNA, 25 bp, Homo sapien
atttattttactatcctcatcttta

SEQ ID NO: 547094 - DNA, 25 bp, Homo sapien
ctcatctttaatgcagaaccttctt

SEQ ID NO: 547095 - DNA, 25 bp, Homo sapien
atgcagaaccttcttaggattaaat

SEQ ID NO: 547096 - DNA, 25 bp, Homo sapien
gacatttaccattccgagcaaactg

SEQ ID NO: 547097 - DNA, 25 bp, Homo sapien
gagcaaactgaggttactgccccaa

SEQ ID NO: 547098 - DNA, 25 bp, Homo sapien
tactgccccaaacggactgggctta

SEQ ID NO: 547099 - DNA, 25 bp, Homo sapien
aggaggctatgtttatgatacagac

SEQ ID NO: 547100 - DNA, 25 bp, Homo sapien
gctatgtttatgatacagactgtga

SEQ ID NO: 547101 - DNA, 25 bp, Homo sapien
tatcatagcctattctggtatcatg

SEQ ID NO: 547102 - DNA, 25 bp, Homo sapien
agcctattctggtatcatgtgcaaa

SEQ ID NO: 547103 - DNA, 25 bp, Homo sapien
tattctggtatcatgtgcaaaagct

SEQ ID NO: 547104 - DNA, 25 bp, Homo sapien
cattgctccccctaaatgacaatta

SEQ ID NO: 547105 - DNA, 25 bp, Homo sapien
taaggaaggaacattgagacagaat

SEQ ID NO: 547106 - DNA, 25 bp, Homo sapien
tgagacagaataaaatgatcccctt

SEQ ID NO: 547107 - DNA, 25 bp, Homo sapien
gaataaaatgatccccttctgggtt

SEQ ID NO: 547108 - DNA, 25 bp, Homo sapien
aattagcacatttagggatacacaa

SEQ ID NO: 547109 - DNA, 25 bp, Homo sapien
gcacatttagggatacacaaattat

SEQ ID NO: 547110 - DNA, 25 bp, Homo sapien
tttgatggactttgtgtcaccccag

SEQ ID NO: 547111 - DNA, 25 bp, Homo sapien
cccagcattacccaccaagagaaat

SEQ ID NO: 547112 - DNA, 25 bp, Homo sapien
agaaatcgtggctcacatcatccag

SEQ ID NO: 547113 - DNA, 25 bp, Homo sapien
ccagaaaatcttgctcagtggctct

SEQ ID NO: 547114 - DNA, 25 bp, Homo sapien
agtggctctgagactgtggatgtcc

SEQ ID NO: 547115 - DNA, 25 bp, Homo sapien
gtggatgtcctaaaggaggcctaca

SEQ ID NO: 547116 - DNA, 25 bp, Homo sapien
ggaggcctacatgcttctcatgaaa

SEQ ID NO: 547117 - DNA, 25 bp, Homo sapien
tcatgaaaattcaacggctacatcc

SEQ ID NO: 547118 - DNA, 25 bp, Homo sapien
tacatccagccaatgccaagacagt

SEQ ID NO: 547119 - DNA, 25 bp, Homo sapien
gagtgggactggaaactgctcacct

SEQ ID NO: 547120 - DNA, 25 bp, Homo sapien
ggaaactgctcacctatgtcatgga

SEQ ID NO: 547121 - DNA, 25 bp, Homo sapien
ggagtggtcttaattaacctgtgtt

SEQ ID NO: 547122 - DNA, 25 bp, Homo sapien
taacctgtgtttgaatttactctgt

SEQ ID NO: 547123 - DNA, 25 bp, Homo sapien
gaatttactctgtagctgctggact

SEQ ID NO: 547124 - DNA, 25 bp, Homo sapien
tactctgtagctgctggactcaatt

SEQ ID NO: 547125 - DNA, 25 bp, Homo sapien
gtagctgctggactcaattaaggaa

SEQ ID NO: 547126 - DNA, 25 bp, Homo sapien
acattcacaccaatcagacaccagg

SEQ ID NO: 547127 - DNA, 25 bp, Homo sapien
acaccaatcagacaccagggcaatg

SEQ ID NO: 547128 - DNA, 25 bp, Homo sapien
ggcaatgatcagatatggcagttct

SEQ ID NO: 547129 - DNA, 25 bp, Homo sapien
ggcagttctgtaccaatgtgaccgt

SEQ ID NO: 547130 - DNA, 25 bp, Homo sapien
gttctgtaccaatgtgaccgttgat

SEQ ID NO: 547131 - DNA, 25 bp, Homo sapien
ccaatgtgaccgttgatagaatatt

SEQ ID NO: 547132 - DNA, 25 bp, Homo sapien
gctgaccaataaggccaccctgtgg

SEQ ID NO: 547133 - DNA, 25 bp, Homo sapien
gaccaataaggccaccctgtggtat

SEQ ID NO: 547134 - DNA, 25 bp, Homo sapien
atgtggacaaggtcctcgaggtgcc

SEQ ID NO: 547135 - DNA, 25 bp, Homo sapien
gccggaagcggtatgaagcccagaa

SEQ ID NO: 547136 - DNA, 25 bp, Homo sapien
aagctggagcgcatggagaccaagt

SEQ ID NO: 547137 - DNA, 25 bp, Homo sapien
gggacatcgtccagccagtcctcaa

SEQ ID NO: 547138 - DNA, 25 bp, Homo sapien
aacccagagccgaacactgtcagct

SEQ ID NO: 547139 - DNA, 25 bp, Homo sapien
agagccgaacactgtcagctacagc

SEQ ID NO: 547140 - DNA, 25 bp, Homo sapien
gaacactgtcagctacagccagtcc

SEQ ID NO: 547141 - DNA, 25 bp, Homo sapien
actgtcagctacagccagtccagct

SEQ ID NO: 547142 - DNA, 25 bp, Homo sapien
gctacagccagtccagcttgatcca

SEQ ID NO: 547143 - DNA, 25 bp, Homo sapien
gaagggttctggctgccccaacctg

SEQ ID NO: 547144 - DNA, 25 bp, Homo sapien
tggctgccccaacctgctgaagggc

SEQ ID NO: 547145 - DNA, 25 bp, Homo sapien
agtagggactcagggccatgcctgc

SEQ ID NO: 547146 - DNA, 25 bp, Homo sapien
tcatctcattcaaaccccaccctag

SEQ ID NO: 547147 - DNA, 25 bp, Homo sapien
agtctcaagggctagcatccctgag

SEQ ID NO: 547148 - DNA, 25 bp, Homo sapien
tccctgtcaaagctgtcacttcgcg

SEQ ID NO: 547149 - DNA, 25 bp, Homo sapien
ctgtcaaagctgtcacttcgcgtgc

SEQ ID NO: 547150 - DNA, 25 bp, Homo sapien
tgtcaaagctgtcacttcgcgtgcc

SEQ ID NO: 547151 - DNA, 25 bp, Homo sapien
tcaaagctgtcacttcgcgtgccct

SEQ ID NO: 547152 - DNA, 25 bp, Homo sapien
aaagctgtcacttcgcgtgccctcg

SEQ ID NO: 547153 - DNA, 25 bp, Homo sapien
gcgtgccctcgctgcttctgtgtgt

SEQ ID NO: 547154 - DNA, 25 bp, Homo sapien
taaagggttgatttgctgcaagagt

SEQ ID NO: 547155 - DNA, 25 bp, Homo sapien
aaaacatccttgcagaatgattcaa

SEQ ID NO: 547156 - DNA, 25 bp, Homo sapien
agccaggctcaacttatagaatgtt

SEQ ID NO: 547157 - DNA, 25 bp, Homo sapien
tgatacatttcacttcagaagcact

SEQ ID NO: 547158 - DNA, 25 bp, Homo sapien
gaagcacttgtaggtctttactagt

SEQ ID NO: 547159 - DNA, 25 bp, Homo sapien
gagctatcattaaagtgtgccatct

SEQ ID NO: 547160 - DNA, 25 bp, Homo sapien
tgtgccatcttggataaaggccttt

SEQ ID NO: 547161 - DNA, 25 bp, Homo sapien
ataaaggccttttgcctactctctt

SEQ ID NO: 547162 - DNA, 25 bp, Homo sapien
ctactctcttctgcaattttgacac

SEQ ID NO: 547163 - DNA, 25 bp, Homo sapien
tttgacacctcaatattcacaccca

SEQ ID NO: 547164 - DNA, 25 bp, Homo sapien
taaacattactaagccccagttcta

SEQ ID NO: 547165 - DNA, 25 bp, Homo sapien
gtaagcattgctggccattttattg

SEQ ID NO: 547166 - DNA, 25 bp, Homo sapien
taaggtgacttgtagatttcccagc

SEQ ID NO: 547167 - DNA, 25 bp, Homo sapien
agatttcccagctagtgagtggcag

SEQ ID NO: 547168 - DNA, 25 bp, Homo sapien
ggcagagctgggttccaaaacctaa

SEQ ID NO: 547169 - DNA, 25 bp, Homo sapien
tattgcaaatgccttgccttgtggc

SEQ ID NO: 547170 - DNA, 25 bp, Homo sapien
cttgtggctcaaacgctatcagtca

SEQ ID NO: 547171 - DNA, 25 bp, Homo sapien
gttcctagagggaaacagacttcta

SEQ ID NO: 547172 - DNA, 25 bp, Homo sapien
gtgaaatttcacacctagtctgtat

SEQ ID NO: 547173 - DNA, 25 bp, Homo sapien
acctagtctgtatcaagcatgtgct

SEQ ID NO: 547174 - DNA, 25 bp, Homo sapien
caagcatgtgctaggttaatttaac

SEQ ID NO: 547175 - DNA, 25 bp, Homo sapien
taatttaaccttactgctctgtgaa

SEQ ID NO: 547176 - DNA, 25 bp, Homo sapien
ggcagggcctttgtcctggagcatc

SEQ ID NO: 547177 - DNA, 25 bp, Homo sapien
ggcctttgtcctggagcatctgtgg

SEQ ID NO: 547178 - DNA, 25 bp, Homo sapien
agagacaactcttcaatgccacctg

SEQ ID NO: 547179 - DNA, 25 bp, Homo sapien
tgtagtgactaaaaatggccccctt

SEQ ID NO: 547180 - DNA, 25 bp, Homo sapien
atgggcaagaaaaatacgtttcctg

SEQ ID NO: 547181 - DNA, 25 bp, Homo sapien
acgtttcctgaaagtcattctaagt

SEQ ID NO: 547182 - DNA, 25 bp, Homo sapien
aagttagatgtaatggatccaccaa

SEQ ID NO: 547183 - DNA, 25 bp, Homo sapien
taatggatccaccaatcttttcctc

SEQ ID NO: 547184 - DNA, 25 bp, Homo sapien
accaatcttttcctctgaggcttct

SEQ ID NO: 547185 - DNA, 25 bp, Homo sapien
gaggcttctgttgcgtaagccattt

SEQ ID NO: 547186 - DNA, 25 bp, Homo sapien
tctgttgcgtaagccatttctgtta

SEQ ID NO: 547187 - DNA, 25 bp, Homo sapien
gaagaactggatatgtgctaagcaa

SEQ ID NO: 547188 - DNA, 25 bp, Homo sapien
gcaagagggctttatttcacccaga

SEQ ID NO: 547189 - DNA, 25 bp, Homo sapien
gagggctttatttcacccagaaaat

SEQ ID NO: 547190 - DNA, 25 bp, Homo sapien
tcacccagaaaatctttcggtttat

SEQ ID NO: 547191 - DNA, 25 bp, Homo sapien
gaaaactaatgtacagattccacaa

SEQ ID NO: 547192 - DNA, 25 bp, Homo sapien
gattccacaactcattctggctgat

SEQ ID NO: 547193 - DNA, 25 bp, Homo sapien
tctggctgattctctgagcagcatt

SEQ ID NO: 547194 - DNA, 25 bp, Homo sapien
gctgattctctgagcagcattctga

SEQ ID NO: 547195 - DNA, 25 bp, Homo sapien
aaagtcttctacatccaatcccaac

SEQ ID NO: 547196 - DNA, 25 bp, Homo sapien
tcttctacatccaatcccaacaaat

SEQ ID NO: 547197 - DNA, 25 bp, Homo sapien
aatccaacaaaggatcactcaaggc

SEQ ID NO: 547198 - DNA, 25 bp, Homo sapien
attcctgctgagcaccgtggggcac

SEQ ID NO: 547199 - DNA, 25 bp, Homo sapien
ggcgtcagggatcctgctgccggca

SEQ ID NO: 547200 - DNA, 25 bp, Homo sapien
acccctgtgccgctggcatgagggc

SEQ ID NO: 547201 - DNA, 25 bp, Homo sapien
atgagggccgtgtccccactgtgaa

SEQ ID NO: 547202 - DNA, 25 bp, Homo sapien
gccgtgtccccactgtgaaggatga

SEQ ID NO: 547203 - DNA, 25 bp, Homo sapien
gtgtccccactgtgaaggatgaaga

SEQ ID NO: 547204 - DNA, 25 bp, Homo sapien
ccccactgtgaaggatgaagagcaa

SEQ ID NO: 547205 - DNA, 25 bp, Homo sapien
aggacccgtgtcctcagagcaccac

SEQ ID NO: 547206 - DNA, 25 bp, Homo sapien
ggccatgcagggagcgcctccctat

SEQ ID NO: 547207 - DNA, 25 bp, Homo sapien
cagggagcgcctccctatgttgcct

SEQ ID NO: 547208 - DNA, 25 bp, Homo sapien
ctttttatgtgcactaccccaccat

SEQ ID NO: 547209 - DNA, 25 bp, Homo sapien
caggagcctgcttcagtgtgagcga

SEQ ID NO: 547210 - DNA, 25 bp, Homo sapien
atattatagctgaagggtccctcct

SEQ ID NO: 547211 - DNA, 25 bp, Homo sapien
tcatctcagcctaggtcaccaggat

SEQ ID NO: 547212 - DNA, 25 bp, Homo sapien
gcctaggtcaccaggatgtctgaga

SEQ ID NO: 547213 - DNA, 25 bp, Homo sapien
atgggacgggcgtggccagtctcag

SEQ ID NO: 547214 - DNA, 25 bp, Homo sapien
gtttgggcccagacctcgttggagt

SEQ ID NO: 547215 - DNA, 25 bp, Homo sapien
agacctcgttggagtcccagacgtt

SEQ ID NO: 547216 - DNA, 25 bp, Homo sapien
cccagacgttgccaggctgttggaa

SEQ ID NO: 547217 - DNA, 25 bp, Homo sapien
aaaattgccttgttcctgtgatgcc

SEQ ID NO: 547218 - DNA, 25 bp, Homo sapien
tgccttgttcctgtgatgcctggga

SEQ ID NO: 547219 - DNA, 25 bp, Homo sapien
ttgtccacctcagctcggtgtggag

SEQ ID NO: 547220 - DNA, 25 bp, Homo sapien
gatagcagatcacttttgacataga

SEQ ID NO: 547221 - DNA, 25 bp, Homo sapien
aaataggtcagaactttaatgcttc

SEQ ID NO: 547222 - DNA, 25 bp, Homo sapien
gaactttaatgcttctgatcaaaga

SEQ ID NO: 547223 - DNA, 25 bp, Homo sapien
gataattgacaatcttctagaatta

SEQ ID NO: 547224 - DNA, 25 bp, Homo sapien
tagaccatggtgtgattagcgggaa

SEQ ID NO: 547225 - DNA, 25 bp, Homo sapien
gaagtgactatggaactaatgaatg

SEQ ID NO: 547226 - DNA, 25 bp, Homo sapien
aatgaatgttaggaccagattgtgg

SEQ ID NO: 547227 - DNA, 25 bp, Homo sapien
cagattgtggagagttttgagtgtc

SEQ ID NO: 547228 - DNA, 25 bp, Homo sapien
gagagttttgagtgtcaggtttttg

SEQ ID NO: 547229 - DNA, 25 bp, Homo sapien
caaaggagagcagcaagggcattct

SEQ ID NO: 547230 - DNA, 25 bp, Homo sapien
agcagcaagggcattctaggtagga

SEQ ID NO: 547231 - DNA, 25 bp, Homo sapien
ttccccagttttctcagccaggcgg

SEQ ID NO: 547232 - DNA, 25 bp, Homo sapien
cccagttttctcagccaggcggcgg

SEQ ID NO: 547233 - DNA, 25 bp, Homo sapien
ggcgactggcaatgtttggcctcaa

SEQ ID NO: 547234 - DNA, 25 bp, Homo sapien
gactggcaatgtttggcctcaaaag

SEQ ID NO: 547235 - DNA, 25 bp, Homo sapien
tgtttggcctcaaaagaaacgcggt

SEQ ID NO: 547236 - DNA, 25 bp, Homo sapien
gaaacgcggtaatcggactcaacct

SEQ ID NO: 547237 - DNA, 25 bp, Homo sapien
ggtaatcggactcaacctctactgt

SEQ ID NO: 547238 - DNA, 25 bp, Homo sapien
aatcggactcaacctctactgtggg

SEQ ID NO: 547239 - DNA, 25 bp, Homo sapien
gggagggcgacttttggctacggag

SEQ ID NO: 547240 - DNA, 25 bp, Homo sapien
ttttggctacggagaaggaggcctc

SEQ ID NO: 547241 - DNA, 25 bp, Homo sapien
gaggccggcgcggtgattggcggaa

SEQ ID NO: 547242 - DNA, 25 bp, Homo sapien
aaactctgtagcctttgaaagtgga

SEQ ID NO: 547243 - DNA, 25 bp, Homo sapien
agatgagatcttctggctcaccttg

SEQ ID NO: 547244 - DNA, 25 bp, Homo sapien
ttctggctcaccttgatcttcacat

SEQ ID NO: 547245 - DNA, 25 bp, Homo sapien
gatcttcacatgaacccattgtgac

SEQ ID NO: 547246 - DNA, 25 bp, Homo sapien
attgtgacctatctggatttcctag

SEQ ID NO: 547247 - DNA, 25 bp, Homo sapien
tatctggatttcctaggacctgtag

SEQ ID NO: 547248 - DNA, 25 bp, Homo sapien
ttgggttatattagtgcctcaggaa

SEQ ID NO: 547249 - DNA, 25 bp, Homo sapien
gtgcctcaggaatgtgtcactactg

SEQ ID NO: 547250 - DNA, 25 bp, Homo sapien
gtgtcactactggtcaagcaatact

SEQ ID NO: 547251 - DNA, 25 bp, Homo sapien
gtaatttaggtgagctatccagagc

SEQ ID NO: 547252 - DNA, 25 bp, Homo sapien
tatccagagctttcaacctcagggt

SEQ ID NO: 547253 - DNA, 25 bp, Homo sapien
ccttcactacatccacaagtcttat

SEQ ID NO: 547254 - DNA, 25 bp, Homo sapien
tacatccacaagtcttattcagcat

SEQ ID NO: 547255 - DNA, 25 bp, Homo sapien
tccacaagtcttattcagcatacaa

SEQ ID NO: 547256 - DNA, 25 bp, Homo sapien
gaaaagccctttgtatgcaagatat

SEQ ID NO: 547257 - DNA, 25 bp, Homo sapien
agccctttgtatgcaagatatgtgg

SEQ ID NO: 547258 - DNA, 25 bp, Homo sapien
atttctatattcctcacgccttaat

SEQ ID NO: 547259 - DNA, 25 bp, Homo sapien
tctatattcctcacgccttaatgtt

SEQ ID NO: 547260 - DNA, 25 bp, Homo sapien
tcacgccttaatgttcacctgcgaa

SEQ ID NO: 547261 - DNA, 25 bp, Homo sapien
ttaatgttcacctgcgaactcatac

SEQ ID NO: 547262 - DNA, 25 bp, Homo sapien
ttctatacacatacgaagtcacagt

SEQ ID NO: 547263 - DNA, 25 bp, Homo sapien
ggaaagccttcactacatccacaag

SEQ ID NO: 547264 - DNA, 25 bp, Homo sapien
gcaaagctttgtttactgaaggagc

SEQ ID NO: 547265 - DNA, 25 bp, Homo sapien
gaaggagctatttaatctatgttac

SEQ ID NO: 547266 - DNA, 25 bp, Homo sapien
gaaaggtcctcgctggctttacata

SEQ ID NO: 547267 - DNA, 25 bp, Homo sapien
gaaacgcgtgtacattttaaaagca

SEQ ID NO: 547268 - DNA, 25 bp, Homo sapien
gttcttgcattagactgaccagttt

SEQ ID NO: 547269 - DNA, 25 bp, Homo sapien
gtcctcgctggctttacataaatga

SEQ ID NO: 547270 - DNA, 25 bp, Homo sapien
gaccatatttgatgcttttctatgc

SEQ ID NO: 547271 - DNA, 25 bp, Homo sapien
gatgcttttctatgctcatttcaac

SEQ ID NO: 547272 - DNA, 25 bp, Homo sapien
ctatgctcatttcaacttggctttt

SEQ ID NO: 547273 - DNA, 25 bp, Homo sapien
gatgcttgtgattccagtttatctc

SEQ ID NO: 547274 - DNA, 25 bp, Homo sapien
ttcagttttgtttatcagcaaagct

SEQ ID NO: 547275 - DNA, 25 bp, Homo sapien
ctgtgcgagttctgttgggcctgct

SEQ ID NO: 547276 - DNA, 25 bp, Homo sapien
ctgctgtgcttcctcgtgatgtgat

SEQ ID NO: 547277 - DNA, 25 bp, Homo sapien
cctcgtgatgtgatgtgctgctgca

SEQ ID NO: 547278 - DNA, 25 bp, Homo sapien
atgtgctgctgcatgggatggccct

SEQ ID NO: 547279 - DNA, 25 bp, Homo sapien
tgcgtgaagcttggtggcttgctca

SEQ ID NO: 547280 - DNA, 25 bp, Homo sapien
tggcttgctcagtggagagttctgt

SEQ ID NO: 547281 - DNA, 25 bp, Homo sapien
tttctccccaccctgaagagagggt

SEQ ID NO: 547282 - DNA, 25 bp, Homo sapien
tgcacccaggagctgtttggtctaa

SEQ ID NO: 547283 - DNA, 25 bp, Homo sapien
aatggaagtgacagcgggagcccct

SEQ ID NO: 547284 - DNA, 25 bp, Homo sapien
cctctgtggcacatcggagtctaga

SEQ ID NO: 547285 - DNA, 25 bp, Homo sapien
acatcggagtctagaggtgcctggc

SEQ ID NO: 547286 - DNA, 25 bp, Homo sapien
gacacagttttgtctcattataaaa

SEQ ID NO: 547287 - DNA, 25 bp, Homo sapien
gaaatgattccaaatcatgtcctaa

SEQ ID NO: 547288 - DNA, 25 bp, Homo sapien
aatcatgtcctaagaatttctccca

SEQ ID NO: 547289 - DNA, 25 bp, Homo sapien
aagaatttctcccattcaaatgata

SEQ ID NO: 547290 - DNA, 25 bp, Homo sapien
attactgtcaaaaggaaaatctcaa

SEQ ID NO: 547291 - DNA, 25 bp, Homo sapien
tctcaaagttaccattacgctgctc

SEQ ID NO: 547292 - DNA, 25 bp, Homo sapien
aaagttaccattacgctgctctctt

SEQ ID NO: 547293 - DNA, 25 bp, Homo sapien
taccattacgctgctctcttgtaaa

SEQ ID NO: 547294 - DNA, 25 bp, Homo sapien
gctctcttgtaaatgaactagggat

SEQ ID NO: 547295 - DNA, 25 bp, Homo sapien
atatctcacattcacctcctatatg

SEQ ID NO: 547296 - DNA, 25 bp, Homo sapien
cattcacctcctatatgtatgtgta

SEQ ID NO: 547297 - DNA, 25 bp, Homo sapien
tctttctgtctgtccctttggccca

SEQ ID NO: 547298 - DNA, 25 bp, Homo sapien
ctgaccaacgatgagcatttcttag

SEQ ID NO: 547299 - DNA, 25 bp, Homo sapien
gcatttcttaggcttcagctcttga

SEQ ID NO: 547300 - DNA, 25 bp, Homo sapien
aggcttcagctcttgatacggaaac

SEQ ID NO: 547301 - DNA, 25 bp, Homo sapien
cggaaacgagtgtcttcactccagc

SEQ ID NO: 547302 - DNA, 25 bp, Homo sapien
agccagcatcatggtcttcggtgct

SEQ ID NO: 547303 - DNA, 25 bp, Homo sapien
ggcctgacctacctgaactgactgg

SEQ ID NO: 547304 - DNA, 25 bp, Homo sapien
actgactggccctccgaggtgggtc

SEQ ID NO: 547305 - DNA, 25 bp, Homo sapien
ctccgaggtgggtctgggacatcct

SEQ ID NO: 547306 - DNA, 25 bp, Homo sapien
tgggacatcctagaggccctacatt

SEQ ID NO: 547307 - DNA, 25 bp, Homo sapien
gaggccctacatttgtccttggata

SEQ ID NO: 547308 - DNA, 25 bp, Homo sapien
gaagctgttctaccttggaactcca

SEQ ID NO: 547309 - DNA, 25 bp, Homo sapien
ttggaactccatgcaactatccgtc

SEQ ID NO: 547310 - DNA, 25 bp, Homo sapien
aactatccgtctcgaataccagggc

SEQ ID NO: 547311 - DNA, 25 bp, Homo sapien
gtctcgaataccagggcagggcaag

SEQ ID NO: 547312 - DNA, 25 bp, Homo sapien
ggcaaggcggactgatgccgtccaa

SEQ ID NO: 547313 - DNA, 25 bp, Homo sapien
tgatgccgtccaaccaattatctca

SEQ ID NO: 547314 - DNA, 25 bp, Homo sapien
agattctctcacagcagatcgggag

SEQ ID NO: 547315 - DNA, 25 bp, Homo sapien
acagcagatcgggagacaggatgtt

SEQ ID NO: 547316 - DNA, 25 bp, Homo sapien
ggaattcagctccacaaagcttcag

SEQ ID NO: 547317 - DNA, 25 bp, Homo sapien
aaagcttcaggcctgaccacagctg

SEQ ID NO: 547318 - DNA, 25 bp, Homo sapien
ctctgcaggcactcaggaagctgtt

SEQ ID NO: 547319 - DNA, 25 bp, Homo sapien
ggacccaaattatcccttgatactg

SEQ ID NO: 547320 - DNA, 25 bp, Homo sapien
cccctattatccactattaagcttt

SEQ ID NO: 547321 - DNA, 25 bp, Homo sapien
gagattaaatattgtgcccacattt

SEQ ID NO: 547322 - DNA, 25 bp, Homo sapien
tgcccacattttacagtcattcgcg

SEQ ID NO: 547323 - DNA, 25 bp, Homo sapien
gtcattcgcgttcccgtttcaaatt

SEQ ID NO: 547324 - DNA, 25 bp, Homo sapien
ttaaaattaggcctccgaccttcag

SEQ ID NO: 547325 - DNA, 25 bp, Homo sapien
gaccttcagaccagcctgtgggctt

SEQ ID NO: 547326 - DNA, 25 bp, Homo sapien
ttaagtcataaaactcgcggaggtg

SEQ ID NO: 547327 - DNA, 25 bp, Homo sapien
gtgcattctagagctttcgggccga

SEQ ID NO: 547328 - DNA, 25 bp, Homo sapien
gaccccaatttctcgttggcgacga

SEQ ID NO: 547329 - DNA, 25 bp, Homo sapien
ttggcgacgaatgctaaccacgtgt

SEQ ID NO: 547330 - DNA, 25 bp, Homo sapien
gtagcatacgattcaggcgggataa

SEQ ID NO: 547331 - DNA, 25 bp, Homo sapien
aatcgagcatcacgcaagacacctg

SEQ ID NO: 547332 - DNA, 25 bp, Homo sapien
acgcaagacacctgcagaacgagga

SEQ ID NO: 547333 - DNA, 25 bp, Homo sapien
aacgaggacatcagggttcgcagaa

SEQ ID NO: 547334 - DNA, 25 bp, Homo sapien
cagggttcgcagaagcgctctgaac

SEQ ID NO: 547335 - DNA, 25 bp, Homo sapien
agaagcgctctgaacaagctccgcg

SEQ ID NO: 547336 - DNA, 25 bp, Homo sapien
ctctgaacaagctccgcgtgggatg

SEQ ID NO: 547337 - DNA, 25 bp, Homo sapien
gcgactgtgaggacgccggcttcac

SEQ ID NO: 547338 - DNA, 25 bp, Homo sapien
gacagggtcccggaggccactgagt

SEQ ID NO: 547339 - DNA, 25 bp, Homo sapien
gagcccagaacatgagtaaaagcct

SEQ ID NO: 547340 - DNA, 25 bp, Homo sapien
agaatcctggaagagtagcatacga

SEQ ID NO: 547341 - DNA, 25 bp, Homo sapien
actacagatgcaggccactacacct

SEQ ID NO: 547342 - DNA, 25 bp, Homo sapien
gacagagcctcgctatattgctcag

SEQ ID NO: 547343 - DNA, 25 bp, Homo sapien
acagagcctcgctatattgctcagg

SEQ ID NO: 547344 - DNA, 25 bp, Homo sapien
agagcctcgctatattgctcaggcc

SEQ ID NO: 547345 - DNA, 25 bp, Homo sapien
gagcctcgctatattgctcaggcct

SEQ ID NO: 547346 - DNA, 25 bp, Homo sapien
gcctcgctatattgctcaggcctgt

SEQ ID NO: 547347 - DNA, 25 bp, Homo sapien
tgctcaggcctgtctcaaattccta

SEQ ID NO: 547348 - DNA, 25 bp, Homo sapien
ctcaggcctgtctcaaattcctaag

SEQ ID NO: 547349 - DNA, 25 bp, Homo sapien
tcaggcctgtctcaaattcctaagc

SEQ ID NO: 547350 - DNA, 25 bp, Homo sapien
aggcctgtctcaaattcctaagctc

SEQ ID NO: 547351 - DNA, 25 bp, Homo sapien
ggcctgtctcaaattcctaagctca

SEQ ID NO: 547352 - DNA, 25 bp, Homo sapien
gaggtctgcttcagaaccttttgtt

SEQ ID NO: 547353 - DNA, 25 bp, Homo sapien
tttgttgtcaactgtcactgtttct

SEQ ID NO: 547354 - DNA, 25 bp, Homo sapien
tgtcaactgtcactgtttcttccaa

SEQ ID NO: 547355 - DNA, 25 bp, Homo sapien
actgtcactgtttcttccaaaagtc

SEQ ID NO: 547356 - DNA, 25 bp, Homo sapien
gtcacaatttgtacaagaacctttg

SEQ ID NO: 547357 - DNA, 25 bp, Homo sapien
agaacctttgctttccttagacttg

SEQ ID NO: 547358 - DNA, 25 bp, Homo sapien
gctttccttagacttgttctgcatt

SEQ ID NO: 547359 - DNA, 25 bp, Homo sapien
ccttagacttgttctgcattttatt

SEQ ID NO: 547360 - DNA, 25 bp, Homo sapien
ataagtaaagctttctgtatttcag

SEQ ID NO: 547361 - DNA, 25 bp, Homo sapien
tgtatttcagagagacataagttac

SEQ ID NO: 547362 - DNA, 25 bp, Homo sapien
gaatgtgtaaatgaagcttgcttgg

SEQ ID NO: 547363 - DNA, 25 bp, Homo sapien
ttctcagatctctggtttatgagtg

SEQ ID NO: 547364 - DNA, 25 bp, Homo sapien
agatctctggtttatgagtgacgct

SEQ ID NO: 547365 - DNA, 25 bp, Homo sapien
atctctggtttatgagtgacgctgc

SEQ ID NO: 547366 - DNA, 25 bp, Homo sapien
tggtttatgagtgacgctgcagcct

SEQ ID NO: 547367 - DNA, 25 bp, Homo sapien
gtttatgagtgacgctgcagcctct

SEQ ID NO: 547368 - DNA, 25 bp, Homo sapien
ttatgagtgacgctgcagcctctct

SEQ ID NO: 547369 - DNA, 25 bp, Homo sapien
atgagtgacgctgcagcctctctct

SEQ ID NO: 547370 - DNA, 25 bp, Homo sapien
ggactgactcctcggcaggtctgca

SEQ ID NO: 547371 - DNA, 25 bp, Homo sapien
tctgcagtgggaacctgtggagaca

SEQ ID NO: 547372 - DNA, 25 bp, Homo sapien
atcttggatgccactcccctgtgtt

SEQ ID NO: 547373 - DNA, 25 bp, Homo sapien
cttggatgccactcccctgtgttga

SEQ ID NO: 547374 - DNA, 25 bp, Homo sapien
tgaagagctaaaaactggccagtgt

SEQ ID NO: 547375 - DNA, 25 bp, Homo sapien
gggttagcagatcgaataacttgaa

SEQ ID NO: 547376 - DNA, 25 bp, Homo sapien
gaataacttgaaatagaccgtgcag

SEQ ID NO: 547377 - DNA, 25 bp, Homo sapien
aatagaccgtgcagtattcctagca

SEQ ID NO: 547378 - DNA, 25 bp, Homo sapien
tcctagcactcaatgtaatcaccct

SEQ ID NO: 547379 - DNA, 25 bp, Homo sapien
gtaatcaccctatttgtgacagaga

SEQ ID NO: 547380 - DNA, 25 bp, Homo sapien
aagatcatctacctataatttgaat

SEQ ID NO: 547381 - DNA, 25 bp, Homo sapien
tgtaattttcacaaccgctgtccat

SEQ ID NO: 547382 - DNA, 25 bp, Homo sapien
acaaccgctgtccattgtttgagga

SEQ ID NO: 547383 - DNA, 25 bp, Homo sapien
gctgtccattgtttgaggatgttac

SEQ ID NO: 547384 - DNA, 25 bp, Homo sapien
gaggatgttacctactaaactgaaa

SEQ ID NO: 547385 - DNA, 25 bp, Homo sapien
gaaatgttatttcacggcaaagctt

SEQ ID NO: 547386 - DNA, 25 bp, Homo sapien
tttcacggcaaagctttagaggtct

SEQ ID NO: 547387 - DNA, 25 bp, Homo sapien
tttagaggtctacactgctgcctac

SEQ ID NO: 547388 - DNA, 25 bp, Homo sapien
gctgcctaccagaatatacaaaaca

SEQ ID NO: 547389 - DNA, 25 bp, Homo sapien
aattctctgtatgcaccagattatt

SEQ ID NO: 547390 - DNA, 25 bp, Homo sapien
ccagattattcatctcgtttagata

SEQ ID NO: 547391 - DNA, 25 bp, Homo sapien
gcaaattcaaagtcacctcttcaga

SEQ ID NO: 547392 - DNA, 25 bp, Homo sapien
acctcttcagagatcactgtcagct

SEQ ID NO: 547393 - DNA, 25 bp, Homo sapien
actgtcagctaagtgtgtatctgga

SEQ ID NO: 547394 - DNA, 25 bp, Homo sapien
tgtatctggaacaggacaggtatcc

SEQ ID NO: 547395 - DNA, 25 bp, Homo sapien
acaggtatccacttgtcgactaaga

SEQ ID NO: 547396 - DNA, 25 bp, Homo sapien
gttgaaatgtgcctgtgtgcagcaa

SEQ ID NO: 547397 - DNA, 25 bp, Homo sapien
atgtgcctgtgtgcagcaaggcttc

SEQ ID NO: 547398 - DNA, 25 bp, Homo sapien
agcttccaaagcagctgtgactctg

SEQ ID NO: 547399 - DNA, 25 bp, Homo sapien
tgtgactctggatctcacccatcat

SEQ ID NO: 547400 - DNA, 25 bp, Homo sapien
ttagaggagtgaatctgtgctgcct

SEQ ID NO: 547401 - DNA, 25 bp, Homo sapien
tgctgccttaggaggcatggaacct

SEQ ID NO: 547402 - DNA, 25 bp, Homo sapien
ggcatggaacctgggacttttcttc

SEQ ID NO: 547403 - DNA, 25 bp, Homo sapien
gtgatagatgttgatctcgtgacaa

SEQ ID NO: 547404 - DNA, 25 bp, Homo sapien
gacaaaagagagattccctctttat

SEQ ID NO: 547405 - DNA, 25 bp, Homo sapien
agatcttttgtaagcccatgtgtta

SEQ ID NO: 547406 - DNA, 25 bp, Homo sapien
gtaagcccatgtgttagaaataaaa

SEQ ID NO: 547407 - DNA, 25 bp, Homo sapien
ctccatcacatcaaaatggttttgc

SEQ ID NO: 547408 - DNA, 25 bp, Homo sapien
ggttttgctaatggacatgttaaca

SEQ ID NO: 547409 - DNA, 25 bp, Homo sapien
agaaacacaaagctgttcttttcaa

SEQ ID NO: 547410 - DNA, 25 bp, Homo sapien
agatgcaattgatcccttactattc

SEQ ID NO: 547411 - DNA, 25 bp, Homo sapien
tattcaagtataaagtgcaacccac

SEQ ID NO: 547412 - DNA, 25 bp, Homo sapien
gaattacatgagtctgctattgtta

SEQ ID NO: 547413 - DNA, 25 bp, Homo sapien
gttaaagcaacacaaatcagccgga

SEQ ID NO: 547414 - DNA, 25 bp, Homo sapien
aatcagccggagaaaacacctattt

SEQ ID NO: 547415 - DNA, 25 bp, Homo sapien
aacacctattttctcgtgataaact

SEQ ID NO: 547416 - DNA, 25 bp, Homo sapien
gtgataaactaaagctttttctgaa

SEQ ID NO: 547417 - DNA, 25 bp, Homo sapien
ttttctgaagcaacactgtgaacca

SEQ ID NO: 547418 - DNA, 25 bp, Homo sapien
taagatttttaaacattggctgaaa

SEQ ID NO: 547419 - DNA, 25 bp, Homo sapien
gaaattgttggaactgatatggcca

SEQ ID NO: 547420 - DNA, 25 bp, Homo sapien
aactgatatggccaaatgaagtcca

SEQ ID NO: 547421 - DNA, 25 bp, Homo sapien
gaagtccatgaagaatcagattgca

SEQ ID NO: 547422 - DNA, 25 bp, Homo sapien
tcagattgcatatgttagagcccaa

SEQ ID NO: 547423 - DNA, 25 bp, Homo sapien
gttagagcccaaatttccattgtgt

SEQ ID NO: 547424 - DNA, 25 bp, Homo sapien
agcccaaatttccattgtgtgtttc

SEQ ID NO: 547425 - DNA, 25 bp, Homo sapien
taactctccctgaatttgcatgtga

SEQ ID NO: 547426 - DNA, 25 bp, Homo sapien
ccctgaatttgcatgtgacttgaga

SEQ ID NO: 547427 - DNA, 25 bp, Homo sapien
gaacagaagctaaattggaccccta

SEQ ID NO: 547428 - DNA, 25 bp, Homo sapien
taaattggacccctatgctgtaaaa

SEQ ID NO: 547429 - DNA, 25 bp, Homo sapien
tttctcaatcacctctcggatcttc

SEQ ID NO: 547430 - DNA, 25 bp, Homo sapien
tctcggatcttcagggccgggcaga

SEQ ID NO: 547431 - DNA, 25 bp, Homo sapien
gtatcctgggatttttacagcagtt

SEQ ID NO: 547432 - DNA, 25 bp, Homo sapien
tgcctgtgacctcctacataatcct

SEQ ID NO: 547433 - DNA, 25 bp, Homo sapien
tcctacataatcctcctgggagctc

SEQ ID NO: 547434 - DNA, 25 bp, Homo sapien
atcaagaaggagacgatccgatgga

SEQ ID NO: 547435 - DNA, 25 bp, Homo sapien
gatttcatgtttgaactctcagaca

SEQ ID NO: 547436 - DNA, 25 bp, Homo sapien
ttgaactctcagacaagcctcttct

SEQ ID NO: 547437 - DNA, 25 bp, Homo sapien
ctacaacctccaagttgttctgggt

SEQ ID NO: 547438 - DNA, 25 bp, Homo sapien
acctccaagttgttctgggtcggtg

SEQ ID NO: 547439 - DNA, 25 bp, Homo sapien
ttcaataactcccatccttgccttt

SEQ ID NO: 547440 - DNA, 25 bp, Homo sapien
caccctgtccttaaatcatgatcac

SEQ ID NO: 547441 - DNA, 25 bp, Homo sapien
taaatcatgatcacttaaatcaggg

SEQ ID NO: 547442 - DNA, 25 bp, Homo sapien
ctgtaaagggccagacgggaaatat

SEQ ID NO: 547443 - DNA, 25 bp, Homo sapien
gccagacgggaaatattttgggctt

SEQ ID NO: 547444 - DNA, 25 bp, Homo sapien
aggccatgcggcctctgtcacatct

SEQ ID NO: 547445 - DNA, 25 bp, Homo sapien
aactctgctgttgacatgcaaaagc

SEQ ID NO: 547446 - DNA, 25 bp, Homo sapien
gcagcaatagacaatatgcgtgtaa

SEQ ID NO: 547447 - DNA, 25 bp, Homo sapien
aatgagtgtggctgtaatccaagaa

SEQ ID NO: 547448 - DNA, 25 bp, Homo sapien
tggcctgcaggctgtagcttgccaa

SEQ ID NO: 547449 - DNA, 25 bp, Homo sapien
tgcaggctgtagcttgccaatcagt

SEQ ID NO: 547450 - DNA, 25 bp, Homo sapien
gctgtagcttgccaatcagtgactt

SEQ ID NO: 547451 - DNA, 25 bp, Homo sapien
ctgaattctttgaacccacagctga

SEQ ID NO: 547452 - DNA, 25 bp, Homo sapien
tgaattctttgaacccacagctgat

SEQ ID NO: 547453 - DNA, 25 bp, Homo sapien
gaattctttgaacccacagctgatg

SEQ ID NO: 547454 - DNA, 25 bp, Homo sapien
tttttaggtcaggatcttgggaagc

SEQ ID NO: 547455 - DNA, 25 bp, Homo sapien
tttaggtcaggatcttgggaagcta

SEQ ID NO: 547456 - DNA, 25 bp, Homo sapien
taggtcaggatcttgggaagctaag

SEQ ID NO: 547457 - DNA, 25 bp, Homo sapien
tcaggatcttgggaagctaaggaga

SEQ ID NO: 547458 - DNA, 25 bp, Homo sapien
tctgttttcctaggaaattcccaag

SEQ ID NO: 547459 - DNA, 25 bp, Homo sapien
taggaaattcccaagaagcttgtgt

SEQ ID NO: 547460 - DNA, 25 bp, Homo sapien
gtgaggagagataccatgttagaat

SEQ ID NO: 547461 - DNA, 25 bp, Homo sapien
gagagataccatgttagaatacctt

SEQ ID NO: 547462 - DNA, 25 bp, Homo sapien
gtgacaattactttgttcattgaca

SEQ ID NO: 547463 - DNA, 25 bp, Homo sapien
agatgtgttgaatttcctccctaga

SEQ ID NO: 547464 - DNA, 25 bp, Homo sapien
tgaatttcctccctagattttaagg

SEQ ID NO: 547465 - DNA, 25 bp, Homo sapien
gatgcattttagtgctgatgtgtgc

SEQ ID NO: 547466 - DNA, 25 bp, Homo sapien
acagtaggaacaaggcaagcatatt

SEQ ID NO: 547467 - DNA, 25 bp, Homo sapien
agtagggcccctaatgtctaagcta

SEQ ID NO: 547468 - DNA, 25 bp, Homo sapien
ttttagcatgcttgacacctttcct

SEQ ID NO: 547469 - DNA, 25 bp, Homo sapien
gacacctttccttggtatatgatgc

SEQ ID NO: 547470 - DNA, 25 bp, Homo sapien
gctatatcagcaacttgtactcatt

SEQ ID NO: 547471 - DNA, 25 bp, Homo sapien
tgtactcattggatctggagcctct

SEQ ID NO: 547472 - DNA, 25 bp, Homo sapien
gatctggagcctctagcttttaata

SEQ ID NO: 547473 - DNA, 25 bp, Homo sapien
gtggcacacgtgagattcaccattg

SEQ ID NO: 547474 - DNA, 25 bp, Homo sapien
attcaccattgcaatcaacaccaag

SEQ ID NO: 547475 - DNA, 25 bp, Homo sapien
ccaaggcccgtgagcagctcatctg

SEQ ID NO: 547476 - DNA, 25 bp, Homo sapien
agctcatctgcgagtgtggcctctt

SEQ ID NO: 547477 - DNA, 25 bp, Homo sapien
ctttgacaaggccaacgccacaggg

SEQ ID NO: 547478 - DNA, 25 bp, Homo sapien
gaaggacctgacctatgcctccctg

SEQ ID NO: 547479 - DNA, 25 bp, Homo sapien
tgtgctttcccgaggccatcaaggc

SEQ ID NO: 547480 - DNA, 25 bp, Homo sapien
gagcaaagaagacatcccctactac

SEQ ID NO: 547481 - DNA, 25 bp, Homo sapien
ttctaccgggacgacgggctcctgg

SEQ ID NO: 547482 - DNA, 25 bp, Homo sapien
tgggaagccatcaggacgttcacgg

SEQ ID NO: 547483 - DNA, 25 bp, Homo sapien
ccatcaggacgttcacggccgaggt

SEQ ID NO: 547484 - DNA, 25 bp, Homo sapien
tgcctgtgacctcctacataatcct

SEQ ID NO: 547485 - DNA, 25 bp, Homo sapien
tgtgacctcctacataatcctcctg

SEQ ID NO: 547486 - DNA, 25 bp, Homo sapien
gacctcctacataatcctcctggga

SEQ ID NO: 547487 - DNA, 25 bp, Homo sapien
tcctacataatcctcctgggagctc

SEQ ID NO: 547488 - DNA, 25 bp, Homo sapien
tcctgggagctcagatcaagaagga

SEQ ID NO: 547489 - DNA, 25 bp, Homo sapien
atcaagaaggagacgatccgatgga

SEQ ID NO: 547490 - DNA, 25 bp, Homo sapien
gatttcatgtttgaactctcagaca

SEQ ID NO: 547491 - DNA, 25 bp, Homo sapien
gtttgaactctcagacaagcctctt

SEQ ID NO: 547492 - DNA, 25 bp, Homo sapien
ttgaactctcagacaagcctcttct

SEQ ID NO: 547493 - DNA, 25 bp, Homo sapien
tgaactctcagacaagcctcttctc

SEQ ID NO: 547494 - DNA, 25 bp, Homo sapien
ttctcccttgctacaacctccaagt

SEQ ID NO: 547495 - DNA, 25 bp, Homo sapien
atacattggtgttttgattggaata

SEQ ID NO: 547496 - DNA, 25 bp, Homo sapien
attatagtgtatgtttcccatccag

SEQ ID NO: 547497 - DNA, 25 bp, Homo sapien
atagtgtatgtttcccatccagaaa

SEQ ID NO: 547498 - DNA, 25 bp, Homo sapien
gcctttctatttattagagtattat

SEQ ID NO: 547499 - DNA, 25 bp, Homo sapien
tatattcctgtgaaaatttttctaa

SEQ ID NO: 547500 - DNA, 25 bp, Homo sapien
cacttgttttacacaattttgttat

SEQ ID NO: 547501 - DNA, 25 bp, Homo sapien
tttatagttgattattgcttttaca

SEQ ID NO: 547502 - DNA, 25 bp, Homo sapien
tattgcttttacatgggaaagttat

SEQ ID NO: 547503 - DNA, 25 bp, Homo sapien
atatttgtatagtcatctcactgtt

SEQ ID NO: 547504 - DNA, 25 bp, Homo sapien
tttgtatagtcatctcactgttgtt

SEQ ID NO: 547505 - DNA, 25 bp, Homo sapien
atctcactgttgttaattttcaata

SEQ ID NO: 547506 - DNA, 25 bp, Homo sapien
aaatagatgggtatgaacactcaaa

SEQ ID NO: 547507 - DNA, 25 bp, Homo sapien
gaacactcaaaacatctcagactct

SEQ ID NO: 547508 - DNA, 25 bp, Homo sapien
aaacatctcagactcttgaaagtac

SEQ ID NO: 547509 - DNA, 25 bp, Homo sapien
gactcttgaaagtacacatgcttga

SEQ ID NO: 547510 - DNA, 25 bp, Homo sapien
gtacacatgcttgaacactggtttt

SEQ ID NO: 547511 - DNA, 25 bp, Homo sapien
gcttgaacactggttttctctgtat

SEQ ID NO: 547512 - DNA, 25 bp, Homo sapien
aacactggttttctctgtatacttt

SEQ ID NO: 547513 - DNA, 25 bp, Homo sapien
gggtggaatcctgcaaacctcacta

SEQ ID NO: 547514 - DNA, 25 bp, Homo sapien
tgcaaacctcactaggcgtgtccca

SEQ ID NO: 547515 - DNA, 25 bp, Homo sapien
gtgtcccacactgccctggagttgt

SEQ ID NO: 547516 - DNA, 25 bp, Homo sapien
acactgccctggagttgtctcaggg

SEQ ID NO: 547517 - DNA, 25 bp, Homo sapien
accgaattcttacaataaagaggat

SEQ ID NO: 547518 - DNA, 25 bp, Homo sapien
aaatggtattgagatcataaggaaa

SEQ ID NO: 547519 - DNA, 25 bp, Homo sapien
agtggaagtggatcaccatgaaagt

SEQ ID NO: 547520 - DNA, 25 bp, Homo sapien
tggaagtggatcaccatgaaagttt

SEQ ID NO: 547521 - DNA, 25 bp, Homo sapien
gaagtggatcaccatgaaagttttc

SEQ ID NO: 547522 - DNA, 25 bp, Homo sapien
aagtggatcaccatgaaagttttca

SEQ ID NO: 547523 - DNA, 25 bp, Homo sapien
agtggatcaccatgaaagttttcat

SEQ ID NO: 547524 - DNA, 25 bp, Homo sapien
atcatcttcatgtttagactgaaga

SEQ ID NO: 547525 - DNA, 25 bp, Homo sapien
gagggattggtcttgtgtcttgggg

SEQ ID NO: 547526 - DNA, 25 bp, Homo sapien
cttaactacttataactactgttat

SEQ ID NO: 547527 - DNA, 25 bp, Homo sapien
taaatagtctattaacacattttgt

SEQ ID NO: 547528 - DNA, 25 bp, Homo sapien
agtgcccagcagtgagggacctgac

SEQ ID NO: 547529 - DNA, 25 bp, Homo sapien
tgcccagcagtgagggacctgacct

SEQ ID NO: 547530 - DNA, 25 bp, Homo sapien
gcagagacaagagaggcaccaagga

SEQ ID NO: 547531 - DNA, 25 bp, Homo sapien
aggcaccaaggaggatccaagagct

SEQ ID NO: 547532 - DNA, 25 bp, Homo sapien
aggaggatccaagagctgactatgc

SEQ ID NO: 547533 - DNA, 25 bp, Homo sapien
ggatccaagagctgactatgcctgc

SEQ ID NO: 547534 - DNA, 25 bp, Homo sapien
atccaagagctgactatgcctgcat

SEQ ID NO: 547535 - DNA, 25 bp, Homo sapien
caagagctgactatgcctgcattgc

SEQ ID NO: 547536 - DNA, 25 bp, Homo sapien
agagctgactatgcctgcattgctg

SEQ ID NO: 547537 - DNA, 25 bp, Homo sapien
agctgactatgcctgcattgctgag

SEQ ID NO: 547538 - DNA, 25 bp, Homo sapien
ctgactatgcctgcattgctgagaa

SEQ ID NO: 547539 - DNA, 25 bp, Homo sapien
gggaaggccaccctatgtaaagtag

SEQ ID NO: 547540 - DNA, 25 bp, Homo sapien
aggccaccctatgtaaagtagcatc

SEQ ID NO: 547541 - DNA, 25 bp, Homo sapien
cactgctacactactctgtctttgc

SEQ ID NO: 547542 - DNA, 25 bp, Homo sapien
ttgcttttgttcaaagcatttttgt

SEQ ID NO: 547543 - DNA, 25 bp, Homo sapien
tgaagtgatgagtactgtgaagaaa

SEQ ID NO: 547544 - DNA, 25 bp, Homo sapien
tgttgtgttcttaacttaaaaatgg

SEQ ID NO: 547545 - DNA, 25 bp, Homo sapien
ggaaaccttgaaggaatcctagata

SEQ ID NO: 547546 - DNA, 25 bp, Homo sapien
gaaggaatcctagataaacttattt

SEQ ID NO: 547547 - DNA, 25 bp, Homo sapien
caggagtgatgttgtatgctatttt

SEQ ID NO: 547548 - DNA, 25 bp, Homo sapien
gatgttgtatgctattttacatagg

SEQ ID NO: 547549 - DNA, 25 bp, Homo sapien
cataggaatggtaagggaaggccac

SEQ ID NO: 547550 - DNA, 25 bp, Homo sapien
ccagtggaacacctcgccagagtgg

SEQ ID NO: 547551 - DNA, 25 bp, Homo sapien
cagtggaacacctcgccagagtggc

SEQ ID NO: 547552 - DNA, 25 bp, Homo sapien
gaacacctcgccagagtggcgtgtg

SEQ ID NO: 547553 - DNA, 25 bp, Homo sapien
acacctcgccagagtggcgtgtggc

SEQ ID NO: 547554 - DNA, 25 bp, Homo sapien
agagtggcgtgtggcaggccaccac

SEQ ID NO: 547555 - DNA, 25 bp, Homo sapien
ggccaccacagaggatcaatgcagc

SEQ ID NO: 547556 - DNA, 25 bp, Homo sapien
gccaccacagaggatcaatgcagcg

SEQ ID NO: 547557 - DNA, 25 bp, Homo sapien
ccaccacagaggatcaatgcagcgg

SEQ ID NO: 547558 - DNA, 25 bp, Homo sapien
accacagaggatcaatgcagcggct

SEQ ID NO: 547559 - DNA, 25 bp, Homo sapien
cacagaggatcaatgcagcggctga

SEQ ID NO: 547560 - DNA, 25 bp, Homo sapien
acagaggatcaatgcagcggctgaa

SEQ ID NO: 547561 - DNA, 25 bp, Homo sapien
ataaccaatgactgcccagaacacc

SEQ ID NO: 547562 - DNA, 25 bp, Homo sapien
gcccagaacaccttgaatcaattga

SEQ ID NO: 547563 - DNA, 25 bp, Homo sapien
gatgtcatgtgtcaagtgcttactg

SEQ ID NO: 547564 - DNA, 25 bp, Homo sapien
caagtgcttactgatttgattgatg

SEQ ID NO: 547565 - DNA, 25 bp, Homo sapien
ttctctatgggaggatgcatggcaa

SEQ ID NO: 547566 - DNA, 25 bp, Homo sapien
agatgtggcaggagtatttgctctt

SEQ ID NO: 547567 - DNA, 25 bp, Homo sapien
gtatttgctctttctagttttctga

SEQ ID NO: 547568 - DNA, 25 bp, Homo sapien
ctagttttctgaataaagcatctgc

SEQ ID NO: 547569 - DNA, 25 bp, Homo sapien
agcatctgctgtttaccaggctctt

SEQ ID NO: 547570 - DNA, 25 bp, Homo sapien
ctgtttaccaggctcttcagaagag

SEQ ID NO: 547571 - DNA, 25 bp, Homo sapien
gagtaatggtgtacttcctgaatta

SEQ ID NO: 547572 - DNA, 25 bp, Homo sapien
tgggcctcttctttgtaccagcagc

SEQ ID NO: 547573 - DNA, 25 bp, Homo sapien
ttctttgtaccagcagccctgcata

SEQ ID NO: 547574 - DNA, 25 bp, Homo sapien
agcagccctgcatacagggccctgt

SEQ ID NO: 547575 - DNA, 25 bp, Homo sapien
tgtgaggcccctgaagctctgtgag

SEQ ID NO: 547576 - DNA, 25 bp, Homo sapien
tgtgaggcccctgaagctctgtgaa

SEQ ID NO: 547577 - DNA, 25 bp, Homo sapien
aagccctgtgaactgcctgctgtcc

SEQ ID NO: 547578 - DNA, 25 bp, Homo sapien
tgctgtcctgtgaactgcctgctgc

SEQ ID NO: 547579 - DNA, 25 bp, Homo sapien
tgctgccctgtgaggtgtgggagcc

SEQ ID NO: 547580 - DNA, 25 bp, Homo sapien
ctgatgctgccgtgtgatgtttcaa

SEQ ID NO: 547581 - DNA, 25 bp, Homo sapien
gatgctgccgtgtgatgtttcaata

SEQ ID NO: 547582 - DNA, 25 bp, Homo sapien
tgtttcaataaaggtggatctcact

SEQ ID NO: 547583 - DNA, 25 bp, Homo sapien
catttagatggtggtgtagggcaaa

SEQ ID NO: 547584 - DNA, 25 bp, Homo sapien
agattgtagcgttttactctccctg

SEQ ID NO: 547585 - DNA, 25 bp, Homo sapien
ctccgccttgctgcaacagagagga

SEQ ID NO: 547586 - DNA, 25 bp, Homo sapien
gaaatgcccatgtccacagcttgta

SEQ ID NO: 547587 - DNA, 25 bp, Homo sapien
actatcttgttatccagtggcatgc

SEQ ID NO: 547588 - DNA, 25 bp, Homo sapien
gtggcatgccaaaggagaactgaat

SEQ ID NO: 547589 - DNA, 25 bp, Homo sapien
ctgaggcttctgctgtaaatcagaa

SEQ ID NO: 547590 - DNA, 25 bp, Homo sapien
aaacaagatgcacccagtatggtgg

SEQ ID NO: 547591 - DNA, 25 bp, Homo sapien
gagggttttgctgtcagtagctcaa

SEQ ID NO: 547592 - DNA, 25 bp, Homo sapien
ctgtcagtagctcaaagtatggtgt

SEQ ID NO: 547593 - DNA, 25 bp, Homo sapien
agtatggtgtagaaatggcctcctc

SEQ ID NO: 547594 - DNA, 25 bp, Homo sapien
cagctcccagacacgctactaagtg

SEQ ID NO: 547595 - DNA, 25 bp, Homo sapien
gacacgctactaagtgcctagggtt

SEQ ID NO: 547596 - DNA, 25 bp, Homo sapien
acgctactaagtgcctagggttgcc

SEQ ID NO: 547597 - DNA, 25 bp, Homo sapien
gctactaagtgcctagggttgcccg

SEQ ID NO: 547598 - DNA, 25 bp, Homo sapien
tactaagtgcctagggttgcccgct

SEQ ID NO: 547599 - DNA, 25 bp, Homo sapien
taagtgcctagggttgcccgctgtg

SEQ ID NO: 547600 - DNA, 25 bp, Homo sapien
cagggagcaacagagaggccaccaa

SEQ ID NO: 547601 - DNA, 25 bp, Homo sapien
gagcaacagagaggccaccaagcag

SEQ ID NO: 547602 - DNA, 25 bp, Homo sapien
agccgactccaagcccgcagagggc

SEQ ID NO: 547603 - DNA, 25 bp, Homo sapien
agggcagacgccaccctggactgct

SEQ ID NO: 547604 - DNA, 25 bp, Homo sapien
tctggcctattcctaccttccaggc

SEQ ID NO: 547605 - DNA, 25 bp, Homo sapien
tcccctgaaggctggaggcattctg

SEQ ID NO: 547606 - DNA, 25 bp, Homo sapien
ccactgcgcgttactccaggatatg

SEQ ID NO: 547607 - DNA, 25 bp, Homo sapien
aggctggaggcattctgctcaggac

SEQ ID NO: 547608 - DNA, 25 bp, Homo sapien
gcgcgttactccaggatatgccgag

SEQ ID NO: 547609 - DNA, 25 bp, Homo sapien
ccaggatatgccgagtgcacgtata

SEQ ID NO: 547610 - DNA, 25 bp, Homo sapien
gccgagtgcacgtataaggtcatct

SEQ ID NO: 547611 - DNA, 25 bp, Homo sapien
acgtataaggtcatcttcgtcgtcc

SEQ ID NO: 547612 - DNA, 25 bp, Homo sapien
aggtcatcttcgtcgtccccgtgga

SEQ ID NO: 547613 - DNA, 25 bp, Homo sapien
gaggcattctgctcaggacccctat

SEQ ID NO: 547614 - DNA, 25 bp, Homo sapien
tgcacgtcgtccaacgtgggactgg

SEQ ID NO: 547615 - DNA, 25 bp, Homo sapien
tgcccaaccatctcaccaggagaaa

SEQ ID NO: 547616 - DNA, 25 bp, Homo sapien
ctgggcctcttctttgtaccagcag

SEQ ID NO: 547617 - DNA, 25 bp, Homo sapien
gggcctcttctttgtaccagcagcc

SEQ ID NO: 547618 - DNA, 25 bp, Homo sapien
agcagccctgcatacagggccctgt

SEQ ID NO: 547619 - DNA, 25 bp, Homo sapien
tgaagctctgtgaaccccctgcagc

SEQ ID NO: 547620 - DNA, 25 bp, Homo sapien
aagccctgtgaactgcctgctgtcc

SEQ ID NO: 547621 - DNA, 25 bp, Homo sapien
tgctgccctgtgaggtgtgggagcc

SEQ ID NO: 547622 - DNA, 25 bp, Homo sapien
ggtgtgggagccctgatgctgccgt

SEQ ID NO: 547623 - DNA, 25 bp, Homo sapien
ctgatgctgccgtgtgatgtttcaa

SEQ ID NO: 547624 - DNA, 25 bp, Homo sapien
gatgctgccgtgtgatgtttcaata

SEQ ID NO: 547625 - DNA, 25 bp, Homo sapien
atgtttcaataaaggtggatctcac

SEQ ID NO: 547626 - DNA, 25 bp, Homo sapien
tttcaataaaggtggatctcactgt

SEQ ID NO: 547627 - DNA, 25 bp, Homo sapien
ttcagacattttcaccactccaaaa

SEQ ID NO: 547628 - DNA, 25 bp, Homo sapien
aaaagaaaccccacatcgactagca

SEQ ID NO: 547629 - DNA, 25 bp, Homo sapien
gaaaccccacatcgactagcagtta

SEQ ID NO: 547630 - DNA, 25 bp, Homo sapien
acatcgactagcagttactcatttg

SEQ ID NO: 547631 - DNA, 25 bp, Homo sapien
ctagcagttactcatttgcttctcc

SEQ ID NO: 547632 - DNA, 25 bp, Homo sapien
agttactcatttgcttctccctatg

SEQ ID NO: 547633 - DNA, 25 bp, Homo sapien
atttgcttctccctatgtcccctga

SEQ ID NO: 547634 - DNA, 25 bp, Homo sapien
ccactaatctatttgtctctataga

SEQ ID NO: 547635 - DNA, 25 bp, Homo sapien
atcatctgtatgtaagtggttaata

SEQ ID NO: 547636 - DNA, 25 bp, Homo sapien
aaggattggttgattgaagattgaa

SEQ ID NO: 547637 - DNA, 25 bp, Homo sapien
tgaaaagggtcagctgggaaaattt

SEQ ID NO: 547638 - DNA, 25 bp, Homo sapien
gtcttacattccatagggagaccca

SEQ ID NO: 547639 - DNA, 25 bp, Homo sapien
taaacagagatctcaaccctctcag

SEQ ID NO: 547640 - DNA, 25 bp, Homo sapien
ccatggacatccaagctgtaagaat

SEQ ID NO: 547641 - DNA, 25 bp, Homo sapien
taagaatccatgaggcattcagcca

SEQ ID NO: 547642 - DNA, 25 bp, Homo sapien
tttagtatcctgaaatgtgccgggc

SEQ ID NO: 547643 - DNA, 25 bp, Homo sapien
aatgtgccgggcgtgtgtcattcca

SEQ ID NO: 547644 - DNA, 25 bp, Homo sapien
gcgtgtgtcattccagtgcatggtt

SEQ ID NO: 547645 - DNA, 25 bp, Homo sapien
agtgcatggttccaccagcgttatt

SEQ ID NO: 547646 - DNA, 25 bp, Homo sapien
ggagtatggtcagctcaagcccagc

SEQ ID NO: 547647 - DNA, 25 bp, Homo sapien
tgagcgccggatggaacgtgcatca

SEQ ID NO: 547648 - DNA, 25 bp, Homo sapien
atcagatgcttcaccaggaagagtc

SEQ ID NO: 547649 - DNA, 25 bp, Homo sapien
agggcttcgagggtggtgattagcg

SEQ ID NO: 547650 - DNA, 25 bp, Homo sapien
gtgattagcggtggcgccagcccta

SEQ ID NO: 547651 - DNA, 25 bp, Homo sapien
agcggtggcgccagccctaggctac

SEQ ID NO: 547652 - DNA, 25 bp, Homo sapien
gccgtgcctgcattcgcagcagctc

SEQ ID NO: 547653 - DNA, 25 bp, Homo sapien
ggctggggacttggccgcttcccta

SEQ ID NO: 547654 - DNA, 25 bp, Homo sapien
tacccacagggcctgacttttacag

SEQ ID NO: 547655 - DNA, 25 bp, Homo sapien
cacagggcctgacttttacagcttt

SEQ ID NO: 547656 - DNA, 25 bp, Homo sapien
acagggcctgacttttacagctttt

SEQ ID NO: 547657 - DNA, 25 bp, Homo sapien
agggcctgacttttacagcttttct

SEQ ID NO: 547658 - DNA, 25 bp, Homo sapien
ggcctgacttttacagcttttctct

SEQ ID NO: 547659 - DNA, 25 bp, Homo sapien
ctgacttttacagcttttctctttt

SEQ ID NO: 547660 - DNA, 25 bp, Homo sapien
ctggtatcttagtatttcctgttca

SEQ ID NO: 547661 - DNA, 25 bp, Homo sapien
agtatttcctgttcatgcttagtag

SEQ ID NO: 547662 - DNA, 25 bp, Homo sapien
tttcctgttcatgcttagtagttta

SEQ ID NO: 547663 - DNA, 25 bp, Homo sapien
gtagtttattacttcacttgagggt

SEQ ID NO: 547664 - DNA, 25 bp, Homo sapien
tacttcacttgagggtacttgacaa

SEQ ID NO: 547665 - DNA, 25 bp, Homo sapien
gagggtacttgacaatatgaacaaa

SEQ ID NO: 547666 - DNA, 25 bp, Homo sapien
aaattgtatttctagctattggtaa

SEQ ID NO: 547667 - DNA, 25 bp, Homo sapien
agctattggtaagagttgtttcact

SEQ ID NO: 547668 - DNA, 25 bp, Homo sapien
gagttgtttcactattgctatgtag

SEQ ID NO: 547669 - DNA, 25 bp, Homo sapien
ttgtttcactattgctatgtaggac

SEQ ID NO: 547670 - DNA, 25 bp, Homo sapien
acttaaagttacatggtctgtttct

SEQ ID NO: 547671 - DNA, 25 bp, Homo sapien
gacagcatccctaaccagatactga

SEQ ID NO: 547672 - DNA, 25 bp, Homo sapien
agcagcacaaactaagacagggagg

SEQ ID NO: 547673 - DNA, 25 bp, Homo sapien
gacagggaggcttttgctatctctc

SEQ ID NO: 547674 - DNA, 25 bp, Homo sapien
ggaggcttttgctatctctcctctg

SEQ ID NO: 547675 - DNA, 25 bp, Homo sapien
gtcacaattatcttcgaaatggtct

SEQ ID NO: 547676 - DNA, 25 bp, Homo sapien
aatggtctttctactttcactttca

SEQ ID NO: 547677 - DNA, 25 bp, Homo sapien
actttcactttcatggctttccaat

SEQ ID NO: 547678 - DNA, 25 bp, Homo sapien
gcatgattacataaacatttgctca

SEQ ID NO: 547679 - DNA, 25 bp, Homo sapien
acatttgctcaagaacctgtataaa

SEQ ID NO: 547680 - DNA, 25 bp, Homo sapien
ccagatactgaacctgttggcacct

SEQ ID NO: 547681 - DNA, 25 bp, Homo sapien
acctgtataaaaagactggtggata

SEQ ID NO: 547682 - DNA, 25 bp, Homo sapien
gtgtaagtatttctaattcaccctt

SEQ ID NO: 547683 - DNA, 25 bp, Homo sapien
agggtagatccttgtgatttcagca

SEQ ID NO: 547684 - DNA, 25 bp, Homo sapien
gatccttgtgatttcagcactgtgt

SEQ ID NO: 547685 - DNA, 25 bp, Homo sapien
agcactgtgtgaagttctactcgta

SEQ ID NO: 547686 - DNA, 25 bp, Homo sapien
ccatcttctgttgacaaggctgtga

SEQ ID NO: 547687 - DNA, 25 bp, Homo sapien
ataaattgacctcagattccgtgcc

SEQ ID NO: 547688 - DNA, 25 bp, Homo sapien
aaggctgtgaaaacccatgctcagg

SEQ ID NO: 547689 - DNA, 25 bp, Homo sapien
gctcaggttcatccagctcagcaaa

SEQ ID NO: 547690 - DNA, 25 bp, Homo sapien
gctcagcaaacgtctcaaggaagaa

SEQ ID NO: 547691 - DNA, 25 bp, Homo sapien
ttccttgattcagcacgaaatggcc

SEQ ID NO: 547692 - DNA, 25 bp, Homo sapien
gcacgaaatggccttcagttccctg

SEQ ID NO: 547693 - DNA, 25 bp, Homo sapien
ctcttctgtgttttccttgccttaa

SEQ ID NO: 547694 - DNA, 25 bp, Homo sapien
tccttgccttaaccacaaattgtgg

SEQ ID NO: 547695 - DNA, 25 bp, Homo sapien
attgtggtgctttttgtatatttta

SEQ ID NO: 547696 - DNA, 25 bp, Homo sapien
aagttgaattctgactatttttaag

SEQ ID NO: 547697 - DNA, 25 bp, Homo sapien
gaatatttattatgcgaatctctat

SEQ ID NO: 547698 - DNA, 25 bp, Homo sapien
attatgcgaatctctattattttat

SEQ ID NO: 547699 - DNA, 25 bp, Homo sapien
atggtatttattgcaaaagactgtt

SEQ ID NO: 547700 - DNA, 25 bp, Homo sapien
aagactgttgaaatgtactcatgtt

SEQ ID NO: 547701 - DNA, 25 bp, Homo sapien
aaatgtactcatgtttgaatataac

SEQ ID NO: 547702 - DNA, 25 bp, Homo sapien
aggtgacacgaagaaagtacatatg

SEQ ID NO: 547703 - DNA, 25 bp, Homo sapien
agtacatatgttaactataatgcag

SEQ ID NO: 547704 - DNA, 25 bp, Homo sapien
gtgggtctgtccttccctactgttt

SEQ ID NO: 547705 - DNA, 25 bp, Homo sapien
gctcctaatgatagccattgagtac

SEQ ID NO: 547706 - DNA, 25 bp, Homo sapien
tgatagccattgagtacaagtctgc

SEQ ID NO: 547707 - DNA, 25 bp, Homo sapien
gagtacaagtctgccaaccgagaga

SEQ ID NO: 547708 - DNA, 25 bp, Homo sapien
tacaagtctgccaaccgagagagcc

SEQ ID NO: 547709 - DNA, 25 bp, Homo sapien
gtctgccaaccgagagagccgtata

SEQ ID NO: 547710 - DNA, 25 bp, Homo sapien
gccaaccgagagagccgtatattaa

SEQ ID NO: 547711 - DNA, 25 bp, Homo sapien
gagccgtatattaattaatcctgga

SEQ ID NO: 547712 - DNA, 25 bp, Homo sapien
aatcctggaaaccatcttaagatcc

SEQ ID NO: 547713 - DNA, 25 bp, Homo sapien
ctggaaaccatcttaagatccaaga

SEQ ID NO: 547714 - DNA, 25 bp, Homo sapien
ttttttactgcaaggcctgtcatga

SEQ ID NO: 547715 - DNA, 25 bp, Homo sapien
gagtttcttcgatcgtgagggcaat

SEQ ID NO: 547716 - DNA, 25 bp, Homo sapien
ggcaattattagtggcctctagccc

SEQ ID NO: 547717 - DNA, 25 bp, Homo sapien
gagaatccacgctacgagaactaac

SEQ ID NO: 547718 - DNA, 25 bp, Homo sapien
gaactaacatagtggacatcgcagt

SEQ ID NO: 547719 - DNA, 25 bp, Homo sapien
gacatcgcagttgtccgtagccgat

SEQ ID NO: 547720 - DNA, 25 bp, Homo sapien
tgtccgtagccgatttgcgggttac

SEQ ID NO: 547721 - DNA, 25 bp, Homo sapien
aaatccgagcgttctcgcgttggat

SEQ ID NO: 547722 - DNA, 25 bp, Homo sapien
tttcctccacgtgtgaagtgggaat

SEQ ID NO: 547723 - DNA, 25 bp, Homo sapien
gggaatggtagtgatatctcgtgct

SEQ ID NO: 547724 - DNA, 25 bp, Homo sapien
tatctcgtgctatctctgtcaaggg

SEQ ID NO: 547725 - DNA, 25 bp, Homo sapien
gaatttatttgaggccctacgacgt

SEQ ID NO: 547726 - DNA, 25 bp, Homo sapien
aaaagcatggtgagtccagacagca

SEQ ID NO: 547727 - DNA, 25 bp, Homo sapien
atggtgagtccagacagcagcaaaa

SEQ ID NO: 547728 - DNA, 25 bp, Homo sapien
aattgtgttcatctagatagtaagt

SEQ ID NO: 547729 - DNA, 25 bp, Homo sapien
tcatctagatagtaagtaactccta

SEQ ID NO: 547730 - DNA, 25 bp, Homo sapien
tagtaagtaactcctatttttactg

SEQ ID NO: 547731 - DNA, 25 bp, Homo sapien
tgtggaaactccctgttagtacgtc

SEQ ID NO: 547732 - DNA, 25 bp, Homo sapien
gaaactccctgttagtacgtcctag

SEQ ID NO: 547733 - DNA, 25 bp, Homo sapien
aaagcctgtggaatatggtggttat

SEQ ID NO: 547734 - DNA, 25 bp, Homo sapien
tggtggttattgatggcgttgcctt

SEQ ID NO: 547735 - DNA, 25 bp, Homo sapien
aaaagtttggtatgtttctctcaag

SEQ ID NO: 547736 - DNA, 25 bp, Homo sapien
gtttggtatgtttctctcaagaaaa

SEQ ID NO: 547737 - DNA, 25 bp, Homo sapien
gacgaggaagatttcaaagctggaa

SEQ ID NO: 547738 - DNA, 25 bp, Homo sapien
gtggtgggaacttctcaggaaaatg

SEQ ID NO: 547739 - DNA, 25 bp, Homo sapien
gatctgcgcgtatcctggagccggc

SEQ ID NO: 547740 - DNA, 25 bp, Homo sapien
agagaaagagaacacagacctgatc

SEQ ID NO: 547741 - DNA, 25 bp, Homo sapien
tggagccggcccagttgtgaactag

SEQ ID NO: 547742 - DNA, 25 bp, Homo sapien
gagccggcccagttgtgaactagga

SEQ ID NO: 547743 - DNA, 25 bp, Homo sapien
gccggcccagttgtgaactaggaga

SEQ ID NO: 547744 - DNA, 25 bp, Homo sapien
gaactaggagagctttgggacctct

SEQ ID NO: 547745 - DNA, 25 bp, Homo sapien
ctttgggacctctgtcccaagcaag

SEQ ID NO: 547746 - DNA, 25 bp, Homo sapien
tctgtcccaagcaagagagatgaat

SEQ ID NO: 547747 - DNA, 25 bp, Homo sapien
ctgtcccaagcaagagagatgaatg

SEQ ID NO: 547748 - DNA, 25 bp, Homo sapien
cagtttgccattcgccagcatgcag

SEQ ID NO: 547749 - DNA, 25 bp, Homo sapien
ttcgccagcatgcagtcttttgtca

SEQ ID NO: 547750 - DNA, 25 bp, Homo sapien
atttatctgtgttgcttttgtcttg

SEQ ID NO: 547751 - DNA, 25 bp, Homo sapien
gttgcttttgtcttgatttactaca

SEQ ID NO: 547752 - DNA, 25 bp, Homo sapien
gatttactacataaccaggaggaag

SEQ ID NO: 547753 - DNA, 25 bp, Homo sapien
caaatattgacaccaccatgcggct

SEQ ID NO: 547754 - DNA, 25 bp, Homo sapien
atgcggctgggtagtcccttctttt

SEQ ID NO: 547755 - DNA, 25 bp, Homo sapien
cttcttttttccaaggcgatacaga

SEQ ID NO: 547756 - DNA, 25 bp, Homo sapien
gatacagattacagttgctgacctt

SEQ ID NO: 547757 - DNA, 25 bp, Homo sapien
tctcatatatgaaaggcggccctca

SEQ ID NO: 547758 - DNA, 25 bp, Homo sapien
aaaggcggccctcatgcgcatcagg

SEQ ID NO: 547759 - DNA, 25 bp, Homo sapien
aggatgtagccaatctctctagccc

SEQ ID NO: 547760 - DNA, 25 bp, Homo sapien
tgtagccaatctctctagccctagt

SEQ ID NO: 547761 - DNA, 25 bp, Homo sapien
tctagccctagtcgcgtgtcgttgt

SEQ ID NO: 547762 - DNA, 25 bp, Homo sapien
tagtcgcgtgtcgttgtccaatgct

SEQ ID NO: 547763 - DNA, 25 bp, Homo sapien
gtgtcgttgtccaatgctctttcct

SEQ ID NO: 547764 - DNA, 25 bp, Homo sapien
ttgtccaatgctctttcctctccga

SEQ ID NO: 547765 - DNA, 25 bp, Homo sapien
gcagggctagagaaccctggacaca

SEQ ID NO: 547766 - DNA, 25 bp, Homo sapien
agtagtcaatactttcaagagcggg

SEQ ID NO: 547767 - DNA, 25 bp, Homo sapien
gccctgcggagacagtcctcggtca

SEQ ID NO: 547768 - DNA, 25 bp, Homo sapien
tgcggagacagtcctcggtcaccag

SEQ ID NO: 547769 - DNA, 25 bp, Homo sapien
gacagtcctcggtcaccagccagag

SEQ ID NO: 547770 - DNA, 25 bp, Homo sapien
ttattttgtcaaacattctatgcaa

SEQ ID NO: 547771 - DNA, 25 bp, Homo sapien
gaaatatgcaacagctaaactttat

SEQ ID NO: 547772 - DNA, 25 bp, Homo sapien
gcaacagctaaactttatggtacat

SEQ ID NO: 547773 - DNA, 25 bp, Homo sapien
gaaatgctgtatttaagcttcctgg

SEQ ID NO: 547774 - DNA, 25 bp, Homo sapien
tgctgtatttaagcttcctggaaat

SEQ ID NO: 547775 - DNA, 25 bp, Homo sapien
cttcctggaaatgtcgacaatcatt

SEQ ID NO: 547776 - DNA, 25 bp, Homo sapien
gtcgacaatcattttaatgaccaaa

SEQ ID NO: 547777 - DNA, 25 bp, Homo sapien
gaccaaaggtgctacttatttttca

SEQ ID NO: 547778 - DNA, 25 bp, Homo sapien
aaaggtgctacttatttttcaacat

SEQ ID NO: 547779 - DNA, 25 bp, Homo sapien
acttatttttcaacattgaccttga

SEQ ID NO: 547780 - DNA, 25 bp, Homo sapien
attgaccttgatcataagtgcttct

SEQ ID NO: 547781 - DNA, 25 bp, Homo sapien
tggacgaggaagatttcaaagctgg

SEQ ID NO: 547782 - DNA, 25 bp, Homo sapien
ggaagatttcaaagctggaaaaggg

SEQ ID NO: 547783 - DNA, 25 bp, Homo sapien
gggaagaggtggtgggaacttctca

SEQ ID NO: 547784 - DNA, 25 bp, Homo sapien
ggaagaggtggtgggaacttctcag

SEQ ID NO: 547785 - DNA, 25 bp, Homo sapien
aagaggtggtgggaacttctcagga

SEQ ID NO: 547786 - DNA, 25 bp, Homo sapien
agaggtggtgggaacttctcaggaa

SEQ ID NO: 547787 - DNA, 25 bp, Homo sapien
gaggtggtgggaacttctcaggaaa

SEQ ID NO: 547788 - DNA, 25 bp, Homo sapien
gtggtgggaacttctcaggaaaatg

SEQ ID NO: 547789 - DNA, 25 bp, Homo sapien
gatctgcgcgtatcctggagccggc

SEQ ID NO: 547790 - DNA, 25 bp, Homo sapien
gatgaatggagagtatagaggcaga

SEQ ID NO: 547791 - DNA, 25 bp, Homo sapien
aatggagagtatagaggcagaggat

SEQ ID NO: 547792 - DNA, 25 bp, Homo sapien
gacggatccaaacaagctgtctaaa

SEQ ID NO: 547793 - DNA, 25 bp, Homo sapien
aagctgtctaaaaagtcaccagaga

SEQ ID NO: 547794 - DNA, 25 bp, Homo sapien
gagggtggaattctgcatatatgac

SEQ ID NO: 547795 - DNA, 25 bp, Homo sapien
atatatgacagtctcactagctctg

SEQ ID NO: 547796 - DNA, 25 bp, Homo sapien
actagctctgtgaaaccttccaggt

SEQ ID NO: 547797 - DNA, 25 bp, Homo sapien
accttccaggtacaaaacagcactt

SEQ ID NO: 547798 - DNA, 25 bp, Homo sapien
aacagcacttggcataagcaaagat

SEQ ID NO: 547799 - DNA, 25 bp, Homo sapien
aaggcaatatcgtaaagggcagttt

SEQ ID NO: 547800 - DNA, 25 bp, Homo sapien
gatctatatttagcaatccatccta

SEQ ID NO: 547801 - DNA, 25 bp, Homo sapien
catcctaaccaacttccatttacta

SEQ ID NO: 547802 - DNA, 25 bp, Homo sapien
tttactattcaatgtggctattttc

SEQ ID NO: 547803 - DNA, 25 bp, Homo sapien
ccatggtgagagcaccagcaagctg

SEQ ID NO: 547804 - DNA, 25 bp, Homo sapien
agcaagctggccagtgtgacccgca

SEQ ID NO: 547805 - DNA, 25 bp, Homo sapien
cccagagctctaagcctcagtggct

SEQ ID NO: 547806 - DNA, 25 bp, Homo sapien
cccaggtgatggtgcacatggcaaa

SEQ ID NO: 547807 - DNA, 25 bp, Homo sapien
ggtgcacatggcaaaccccagacag

SEQ ID NO: 547808 - DNA, 25 bp, Homo sapien
tgggctggccacaggaatgccacaa

SEQ ID NO: 547809 - DNA, 25 bp, Homo sapien
aggaatgccacaacagcccgcagca

SEQ ID NO: 547810 - DNA, 25 bp, Homo sapien
agcccgcagcatatgccctagggtg

SEQ ID NO: 547811 - DNA, 25 bp, Homo sapien
atgccctagggtgaccacgcagtga

SEQ ID NO: 547812 - DNA, 25 bp, Homo sapien
gaccacgcagtgaggctggtgccca

SEQ ID NO: 547813 - DNA, 25 bp, Homo sapien
agtgaggctggtgcccatgctccac

SEQ ID NO: 547814 - DNA, 25 bp, Homo sapien
agatcccactttggataaaagtagt

SEQ ID NO: 547815 - DNA, 25 bp, Homo sapien
gtaacattttttgaccgaatcatgg

SEQ ID NO: 547816 - DNA, 25 bp, Homo sapien
gaatcatggtgattgtgacccacga

SEQ ID NO: 547817 - DNA, 25 bp, Homo sapien
atggtgattgtgacccacgaaagac

SEQ ID NO: 547818 - DNA, 25 bp, Homo sapien
gtgacccacgaaagacatacaaaga

SEQ ID NO: 547819 - DNA, 25 bp, Homo sapien
gattaaaatggctatcacaccccat

SEQ ID NO: 547820 - DNA, 25 bp, Homo sapien
aggccctcagccttgagcactgctt

SEQ ID NO: 547821 - DNA, 25 bp, Homo sapien
gccttgagcactgctttctttttgc

SEQ ID NO: 547822 - DNA, 25 bp, Homo sapien
tctttttgcctttcctgcccagtga

SEQ ID NO: 547823 - DNA, 25 bp, Homo sapien
tttgcctttcctgcccagtgagagt

SEQ ID NO: 547824 - DNA, 25 bp, Homo sapien
tgcccagtgagagtccaaccagtgt

SEQ ID NO: 547825 - DNA, 25 bp, Homo sapien
gaagtaactgcccaaatcttatctc

SEQ ID NO: 547826 - DNA, 25 bp, Homo sapien
atctctgttataatacatgagctaa

SEQ ID NO: 547827 - DNA, 25 bp, Homo sapien
taatcagtgggttgtagttacgaat

SEQ ID NO: 547828 - DNA, 25 bp, Homo sapien
caaggctgctaacaagttttcccac

SEQ ID NO: 547829 - DNA, 25 bp, Homo sapien
gttcaagtatctgttgttacaagca

SEQ ID NO: 547830 - DNA, 25 bp, Homo sapien
aagcagagttaaacagtccacacct

SEQ ID NO: 547831 - DNA, 25 bp, Homo sapien
gagttaaacagtccacacctgacac

SEQ ID NO: 547832 - DNA, 25 bp, Homo sapien
tccacacctgacacctcaggaattt

SEQ ID NO: 547833 - DNA, 25 bp, Homo sapien
ccaacctagcccatatattctaact

SEQ ID NO: 547834 - DNA, 25 bp, Homo sapien
agattagactagacaaggccccatg

SEQ ID NO: 547835 - DNA, 25 bp, Homo sapien
tagacaaggccccatgcaaaacaaa

SEQ ID NO: 547836 - DNA, 25 bp, Homo sapien
tgcatccatggctagtttgcctgaa

SEQ ID NO: 547837 - DNA, 25 bp, Homo sapien
tccatggctagtttgcctgaactat

SEQ ID NO: 547838 - DNA, 25 bp, Homo sapien
ggctagtttgcctgaactatatctg

SEQ ID NO: 547839 - DNA, 25 bp, Homo sapien
agtttgcctgaactatatctgagcc

SEQ ID NO: 547840 - DNA, 25 bp, Homo sapien
gcctgaactatatctgagccactga

SEQ ID NO: 547841 - DNA, 25 bp, Homo sapien
gaactatatctgagccactgagagt

SEQ ID NO: 547842 - DNA, 25 bp, Homo sapien
ctatatctgagccactgagagtatt

SEQ ID NO: 547843 - DNA, 25 bp, Homo sapien
atctgagccactgagagtatttatt

SEQ ID NO: 547844 - DNA, 25 bp, Homo sapien
gagccactgagagtatttattaagc

SEQ ID NO: 547845 - DNA, 25 bp, Homo sapien
tgactgtaaaccagaattccccttt

SEQ ID NO: 547846 - DNA, 25 bp, Homo sapien
tgtaaaccagaattccccttttcat

SEQ ID NO: 547847 - DNA, 25 bp, Homo sapien
gcctcctagatcattgtccttgatg

SEQ ID NO: 547848 - DNA, 25 bp, Homo sapien
tccttgatgtccaggctgggtcatt

SEQ ID NO: 547849 - DNA, 25 bp, Homo sapien
gtccaggctgggtcatttaaaatag

SEQ ID NO: 547850 - DNA, 25 bp, Homo sapien
gtggctgaattgagaccttgctgat

SEQ ID NO: 547851 - DNA, 25 bp, Homo sapien
gatgtattcatgtcagcacctgagt

SEQ ID NO: 547852 - DNA, 25 bp, Homo sapien
tgagtcacagcccaggtgcccggaa

SEQ ID NO: 547853 - DNA, 25 bp, Homo sapien
gaagcagcctcttcgcataggcagt

SEQ ID NO: 547854 - DNA, 25 bp, Homo sapien
tgcgattactttaaagctcaccttt

SEQ ID NO: 547855 - DNA, 25 bp, Homo sapien
tctctgttcgctgctgtcagcataa

SEQ ID NO: 547856 - DNA, 25 bp, Homo sapien
gcataatgattgtgttccttcccta

SEQ ID NO: 547857 - DNA, 25 bp, Homo sapien
ttccttccctatgggatccatctgt

SEQ ID NO: 547858 - DNA, 25 bp, Homo sapien
gacactaaaacagtatgttctggtt

SEQ ID NO: 547859 - DNA, 25 bp, Homo sapien
acagtatgttctggttttggccctc

SEQ ID NO: 547860 - DNA, 25 bp, Homo sapien
atgttctggttttggccctcttgca

SEQ ID NO: 547861 - DNA, 25 bp, Homo sapien
gtagctatatgttactgtattgcaa

SEQ ID NO: 547862 - DNA, 25 bp, Homo sapien
gttactgtattgcaaaatctgttaa

SEQ ID NO: 547863 - DNA, 25 bp, Homo sapien
aatctgttaagagcaggaccacatc

SEQ ID NO: 547864 - DNA, 25 bp, Homo sapien
gagcaggaccacatcgatagtattt

SEQ ID NO: 547865 - DNA, 25 bp, Homo sapien
ggaccacatcgatagtatttaataa

SEQ ID NO: 547866 - DNA, 25 bp, Homo sapien
aaaacacagttcttctttcagcttg

SEQ ID NO: 547867 - DNA, 25 bp, Homo sapien
cacagttcttctttcagcttgtctt

SEQ ID NO: 547868 - DNA, 25 bp, Homo sapien
tcagcttgtcttaagaatggttgcc

SEQ ID NO: 547869 - DNA, 25 bp, Homo sapien
gatcatcatcaaaacttatgtggct

SEQ ID NO: 547870 - DNA, 25 bp, Homo sapien
atcatcatcaaaacttatgtggctt

SEQ ID NO: 547871 - DNA, 25 bp, Homo sapien
tcatcatcaaaacttatgtggcttt

SEQ ID NO: 547872 - DNA, 25 bp, Homo sapien
acttatgtggctttttgacctttga

SEQ ID NO: 547873 - DNA, 25 bp, Homo sapien
cttatgtggctttttgacctttgaa

SEQ ID NO: 547874 - DNA, 25 bp, Homo sapien
ttatgtggctttttgacctttgaat

SEQ ID NO: 547875 - DNA, 25 bp, Homo sapien
tatgtggctttttgacctttgaata

SEQ ID NO: 547876 - DNA, 25 bp, Homo sapien
atgtggctttttgacctttgaatag

SEQ ID NO: 547877 - DNA, 25 bp, Homo sapien
tgtggctttttgacctttgaatagg

SEQ ID NO: 547878 - DNA, 25 bp, Homo sapien
gtggctttttgacctttgaataggg

SEQ ID NO: 547879 - DNA, 25 bp, Homo sapien
tggctttttgacctttgaataggga

SEQ ID NO: 547880 - DNA, 25 bp, Homo sapien
acagctggtcgaccttggcaatcag

SEQ ID NO: 547881 - DNA, 25 bp, Homo sapien
tggcaatcaggtcattcttcaccac

SEQ ID NO: 547882 - DNA, 25 bp, Homo sapien
caggtcattcttcaccacattcaag

SEQ ID NO: 547883 - DNA, 25 bp, Homo sapien
gaagctgtgagttttccagtagcag

SEQ ID NO: 547884 - DNA, 25 bp, Homo sapien
gagttttccagtagcagattcccca

SEQ ID NO: 547885 - DNA, 25 bp, Homo sapien
cagtagcagattccccacttctttg

SEQ ID NO: 547886 - DNA, 25 bp, Homo sapien
cacttctttgcccattcctgagaac

SEQ ID NO: 547887 - DNA, 25 bp, Homo sapien
attcctgagaactcccctaggaggt

SEQ ID NO: 547888 - DNA, 25 bp, Homo sapien
tgccgtcgacagctcatggtacagg

SEQ ID NO: 547889 - DNA, 25 bp, Homo sapien
ggtgttgatgccgaaagctttgttc

SEQ ID NO: 547890 - DNA, 25 bp, Homo sapien
aaagctttgttcacgatgccctggg

SEQ ID NO: 547891 - DNA, 25 bp, Homo sapien
ttaaagggaaactgaaaggctatga

SEQ ID NO: 547892 - DNA, 25 bp, Homo sapien
gggtaaataacatctgacagctaat

SEQ ID NO: 547893 - DNA, 25 bp, Homo sapien
ctgacagctaatgagatattttttc

SEQ ID NO: 547894 - DNA, 25 bp, Homo sapien
tatttgaaatgaagtcccaaatcta

SEQ ID NO: 547895 - DNA, 25 bp, Homo sapien
atagcttagccacataatacggttg

SEQ ID NO: 547896 - DNA, 25 bp, Homo sapien
acataatacggttgtgcgagcagag

SEQ ID NO: 547897 - DNA, 25 bp, Homo sapien
gttgtgcgagcagagaatctacctt

SEQ ID NO: 547898 - DNA, 25 bp, Homo sapien
gagcagagaatctacctttccactt

SEQ ID NO: 547899 - DNA, 25 bp, Homo sapien
agagaatctacctttccacttctaa

SEQ ID NO: 547900 - DNA, 25 bp, Homo sapien
tacctttccacttctaagcctgttt

SEQ ID NO: 547901 - DNA, 25 bp, Homo sapien
gggataatactttacaaggttgttg

SEQ ID NO: 547902 - DNA, 25 bp, Homo sapien
gtaaaaggaactcttctctgtccct

SEQ ID NO: 547903 - DNA, 25 bp, Homo sapien
ttctctgtcccttttatgatttccg

SEQ ID NO: 547904 - DNA, 25 bp, Homo sapien
gtcccttttatgatttccggtagct

SEQ ID NO: 547905 - DNA, 25 bp, Homo sapien
ttatgatttccggtagctgtttctt

SEQ ID NO: 547906 - DNA, 25 bp, Homo sapien
agctgtttctttcctgtactatgta

SEQ ID NO: 547907 - DNA, 25 bp, Homo sapien
gtactatgtatataggcccatgtct

SEQ ID NO: 547908 - DNA, 25 bp, Homo sapien
aggcccatgtctgtgtagtacttga

SEQ ID NO: 547909 - DNA, 25 bp, Homo sapien
gtctgtgtagtacttgagttaaact

SEQ ID NO: 547910 - DNA, 25 bp, Homo sapien
gagttaaactcacagttcagcttaa

SEQ ID NO: 547911 - DNA, 25 bp, Homo sapien
cacagttcagcttaagtaaaccaga

SEQ ID NO: 547912 - DNA, 25 bp, Homo sapien
gagaaggaaggtccagtgggtccct

SEQ ID NO: 547913 - DNA, 25 bp, Homo sapien
tggcaaacaacctcgtttccttaca

SEQ ID NO: 547914 - DNA, 25 bp, Homo sapien
ctcgtttccttacaaattccagcat

SEQ ID NO: 547915 - DNA, 25 bp, Homo sapien
attccagcatgtgactttggtgccg

SEQ ID NO: 547916 - DNA, 25 bp, Homo sapien
gactttggtgccgttacttgtgaaa

SEQ ID NO: 547917 - DNA, 25 bp, Homo sapien
tctgactcacaagaaagccaactgt

SEQ ID NO: 547918 - DNA, 25 bp, Homo sapien
aagccaactgtatgtcttgtgatgg

SEQ ID NO: 547919 - DNA, 25 bp, Homo sapien
gggacagttcataatgtagttgcta

SEQ ID NO: 547920 - DNA, 25 bp, Homo sapien
gtagttgctagaccactttacaaat

SEQ ID NO: 547921 - DNA, 25 bp, Homo sapien
gttcttgtcaccagatgtgttcaga

SEQ ID NO: 547922 - DNA, 25 bp, Homo sapien
tgtgttcagacattgctgtgcaatt

SEQ ID NO: 547923 - DNA, 25 bp, Homo sapien
gcgagaggagatacttattggtctt

SEQ ID NO: 547924 - DNA, 25 bp, Homo sapien
aatggcaagtagctctttcctgcct

SEQ ID NO: 547925 - DNA, 25 bp, Homo sapien
cctgcttctcagctcatttggaaaa

SEQ ID NO: 547926 - DNA, 25 bp, Homo sapien
actgcgcaaaagacattgagctcaa

SEQ ID NO: 547927 - DNA, 25 bp, Homo sapien
tgcagatgttgttttcaggttaatg

SEQ ID NO: 547928 - DNA, 25 bp, Homo sapien
gttttcaggttaatggacacgcaaa

SEQ ID NO: 547929 - DNA, 25 bp, Homo sapien
gacacgcaaagaaaccacagcacat

SEQ ID NO: 547930 - DNA, 25 bp, Homo sapien
aagaaaccacagcacatacttcttt

SEQ ID NO: 547931 - DNA, 25 bp, Homo sapien
gcttttaattatggtacgctgtctt

SEQ ID NO: 547932 - DNA, 25 bp, Homo sapien
taatgtgtcagatattgtgcttgaa

SEQ ID NO: 547933 - DNA, 25 bp, Homo sapien
attgtgcttgaaagattctcatctc

SEQ ID NO: 547934 - DNA, 25 bp, Homo sapien
tctcatctcagaatacttttggact

SEQ ID NO: 547935 - DNA, 25 bp, Homo sapien
gtgagaatcattggtattccataga

SEQ ID NO: 547936 - DNA, 25 bp, Homo sapien
cattggtattccatagaagagtgaa

SEQ ID NO: 547937 - DNA, 25 bp, Homo sapien
agagtgaattaaacacagccaaggg

SEQ ID NO: 547938 - DNA, 25 bp, Homo sapien
ccaggtgatagaggtgatctcccat

SEQ ID NO: 547939 - DNA, 25 bp, Homo sapien
gaggtgatctcccatactgttaaag

SEQ ID NO: 547940 - DNA, 25 bp, Homo sapien
ttttggtcccagtactctaggaggt

SEQ ID NO: 547941 - DNA, 25 bp, Homo sapien
ggtcccagtactctaggaggtcaca

SEQ ID NO: 547942 - DNA, 25 bp, Homo sapien
gtactctaggaggtcacacctctgt

SEQ ID NO: 547943 - DNA, 25 bp, Homo sapien
tctaggaggtcacacctctgtcctg

SEQ ID NO: 547944 - DNA, 25 bp, Homo sapien
tgtatactcttcctatgactcattc

SEQ ID NO: 547945 - DNA, 25 bp, Homo sapien
tactcttcctatgactcattctggt

SEQ ID NO: 547946 - DNA, 25 bp, Homo sapien
gaatcaagggtttctgaacctgaga

SEQ ID NO: 547947 - DNA, 25 bp, Homo sapien
ctgaacctgagataagcagcttttt

SEQ ID NO: 547948 - DNA, 25 bp, Homo sapien
tttgtttcataaaagctctagtcat

SEQ ID NO: 547949 - DNA, 25 bp, Homo sapien
tttttctgtgttgaaagtggaccac

SEQ ID NO: 547950 - DNA, 25 bp, Homo sapien
gtggaccacagtaatgttcatggat

SEQ ID NO: 547951 - DNA, 25 bp, Homo sapien
ttgttggctgaagcacttccatgtg

SEQ ID NO: 547952 - DNA, 25 bp, Homo sapien
gcacttccatgtggcttagaagctt

SEQ ID NO: 547953 - DNA, 25 bp, Homo sapien
agacacggcacctccgcctttgtga

SEQ ID NO: 547954 - DNA, 25 bp, Homo sapien
ctccgcctttgtgaactgtcattgg

SEQ ID NO: 547955 - DNA, 25 bp, Homo sapien
attggccactctgcaaatcctggtg

SEQ ID NO: 547956 - DNA, 25 bp, Homo sapien
caaatcctggtggtgcagtagttta

SEQ ID NO: 547957 - DNA, 25 bp, Homo sapien
gttgaaagaggctttatagcagctg

SEQ ID NO: 547958 - DNA, 25 bp, Homo sapien
taccactactgaatgccaacatttt

SEQ ID NO: 547959 - DNA, 25 bp, Homo sapien
tagcagctggtagctggcattagtt

SEQ ID NO: 547960 - DNA, 25 bp, Homo sapien
aggcactctgacatcaatttggaaa

SEQ ID NO: 547961 - DNA, 25 bp, Homo sapien
ggcactctgacatcaatttggaaat

SEQ ID NO: 547962 - DNA, 25 bp, Homo sapien
cacatgaggactgtgtatcacattc

SEQ ID NO: 547963 - DNA, 25 bp, Homo sapien
ccgattgttttgtcgacgtaatgtt

SEQ ID NO: 547964 - DNA, 25 bp, Homo sapien
ttgacatttacccaggctctttgtt

SEQ ID NO: 547965 - DNA, 25 bp, Homo sapien
tttattgtagggaaaagcgtttcat

SEQ ID NO: 547966 - DNA, 25 bp, Homo sapien
aagcgtttcatttgaatttcctccg

SEQ ID NO: 547967 - DNA, 25 bp, Homo sapien
cgtttcatttgaatttcctccgagg

SEQ ID NO: 547968 - DNA, 25 bp, Homo sapien
tgcaaggcaccgcagtgtcacacaa

SEQ ID NO: 547969 - DNA, 25 bp, Homo sapien
tacattcctcaaccatcagccaaga

SEQ ID NO: 547970 - DNA, 25 bp, Homo sapien
gcaaaagcaacaattcgcgcgccag

SEQ ID NO: 547971 - DNA, 25 bp, Homo sapien
atcctcccggcaattcttaggtcgc

SEQ ID NO: 547972 - DNA, 25 bp, Homo sapien
ttaggtcgcctttctggctaaattg

SEQ ID NO: 547973 - DNA, 25 bp, Homo sapien
gaacatccactgagactgcaggcca

SEQ ID NO: 547974 - DNA, 25 bp, Homo sapien
gaatcccacacctttgctgcagtat

SEQ ID NO: 547975 - DNA, 25 bp, Homo sapien
gctgcagtattaacagagctctctg

SEQ ID NO: 547976 - DNA, 25 bp, Homo sapien
agctctctggagactctggtcggag

SEQ ID NO: 547977 - DNA, 25 bp, Homo sapien
gataattgttttcttgtgctttcac

SEQ ID NO: 547978 - DNA, 25 bp, Homo sapien
gtgctttcactaaacgtacacgcat

SEQ ID NO: 547979 - DNA, 25 bp, Homo sapien
ttgctcttcgtacacacctgggaag

SEQ ID NO: 547980 - DNA, 25 bp, Homo sapien
acctgggaagagcacaattcggtca

SEQ ID NO: 547981 - DNA, 25 bp, Homo sapien
caattcggtcatacaggctggccat

SEQ ID NO: 547982 - DNA, 25 bp, Homo sapien
gagcagtgctgatcaatgctggcca

SEQ ID NO: 547983 - DNA, 25 bp, Homo sapien
aggctgtcaaactcacggcctggcc

SEQ ID NO: 547984 - DNA, 25 bp, Homo sapien
ggcccaacactcagggtacgtcgtt

SEQ ID NO: 547985 - DNA, 25 bp, Homo sapien
gaagactccaagtccaaggcattct

SEQ ID NO: 547986 - DNA, 25 bp, Homo sapien
aaggcattcttggtccatgtcttgg

SEQ ID NO: 547987 - DNA, 25 bp, Homo sapien
ggtccatgtcttggatgcaaggtaa

SEQ ID NO: 547988 - DNA, 25 bp, Homo sapien
tctccacaggcaccttcaagatgat

SEQ ID NO: 547989 - DNA, 25 bp, Homo sapien
agatgatttcaccttgctcttcgta

SEQ ID NO: 547990 - DNA, 25 bp, Homo sapien
gggacccagtaggagataatttgaa

SEQ ID NO: 547991 - DNA, 25 bp, Homo sapien
taatttgaatcgtgagcagtttcca

SEQ ID NO: 547992 - DNA, 25 bp, Homo sapien
ttgaatcgtgagcagtttccaccac

SEQ ID NO: 547993 - DNA, 25 bp, Homo sapien
aatcgtgagcagtttccaccacgca

SEQ ID NO: 547994 - DNA, 25 bp, Homo sapien
tcgtgagcagtttccaccacgcatg

SEQ ID NO: 547995 - DNA, 25 bp, Homo sapien
tgagcagtttccaccacgcatgctg

SEQ ID NO: 547996 - DNA, 25 bp, Homo sapien
gggtttccgcttcttgcgtcttcct

SEQ ID NO: 547997 - DNA, 25 bp, Homo sapien
gcttcttgcgtcttcctcattttct

SEQ ID NO: 547998 - DNA, 25 bp, Homo sapien
tgaggctccccatccatgtgaaact

SEQ ID NO: 547999 - DNA, 25 bp, Homo sapien
aggctccccatccatgtgaaactgt

SEQ ID NO: 548000 - DNA, 25 bp, Homo sapien
gctccccatccatgtgaaactgtaa

SEQ ID NO: 548001 - DNA, 25 bp, Homo sapien
aatttagtgtttaccttgcgtgcca

SEQ ID NO: 548002 - DNA, 25 bp, Homo sapien
tttaccttgcgtgccattttgtgtc

SEQ ID NO: 548003 - DNA, 25 bp, Homo sapien
cattttgtgtcatccttcattaaaa

SEQ ID NO: 548004 - DNA, 25 bp, Homo sapien
aaagcaattggaggtttgccagtta

SEQ ID NO: 548005 - DNA, 25 bp, Homo sapien
ttgccagttatctcacttccctttt

SEQ ID NO: 548006 - DNA, 25 bp, Homo sapien
atgttgttttaatgcactaatctga

SEQ ID NO: 548007 - DNA, 25 bp, Homo sapien
tactgaaggcggtgtttaacttggc

SEQ ID NO: 548008 - DNA, 25 bp, Homo sapien
ttaacttggcaagctctgagacttc

SEQ ID NO: 548009 - DNA, 25 bp, Homo sapien
agctctgagacttcaaatgggaaca

SEQ ID NO: 548010 - DNA, 25 bp, Homo sapien
gtaagtagctaagtaaaccacatct

SEQ ID NO: 548011 - DNA, 25 bp, Homo sapien
gtaaaccacatctttgcaaccaaaa

SEQ ID NO: 548012 - DNA, 25 bp, Homo sapien
gcagactttgaaaattgggcatgga

SEQ ID NO: 548013 - DNA, 25 bp, Homo sapien
gcatggagggactctagacagcgca

SEQ ID NO: 548014 - DNA, 25 bp, Homo sapien
ccgaggagttctggttgttggaatt

SEQ ID NO: 548015 - DNA, 25 bp, Homo sapien
caaaaatgttgaccagtatgttgtc

SEQ ID NO: 548016 - DNA, 25 bp, Homo sapien
cagtatgttgtcagggtccaagaga

SEQ ID NO: 548017 - DNA, 25 bp, Homo sapien
agggtccaagagatatactgccatt

SEQ ID NO: 548018 - DNA, 25 bp, Homo sapien
gatatactgccattggagaactggg

SEQ ID NO: 548019 - DNA, 25 bp, Homo sapien
gggaaagctactgatacactagatt

SEQ ID NO: 548020 - DNA, 25 bp, Homo sapien
ctactgatacactagattctacggg

SEQ ID NO: 548021 - DNA, 25 bp, Homo sapien
ggcattctacagaaatttactggaa

SEQ ID NO: 548022 - DNA, 25 bp, Homo sapien
aaatataatgcaagtgccccccctc

SEQ ID NO: 548023 - DNA, 25 bp, Homo sapien
tgctgtctcattcttggtatattct

SEQ ID NO: 548024 - DNA, 25 bp, Homo sapien
ggtatattcttgtgttaactgccca

SEQ ID NO: 548025 - DNA, 25 bp, Homo sapien
attcttgtgttaactgcccattggc

SEQ ID NO: 548026 - DNA, 25 bp, Homo sapien
gaaaatactcattgtaagcctgaaa

SEQ ID NO: 548027 - DNA, 25 bp, Homo sapien
aatctttcccactgttttttctgct

SEQ ID NO: 548028 - DNA, 25 bp, Homo sapien
ccactgttttttctgcttgttgtaa

SEQ ID NO: 548029 - DNA, 25 bp, Homo sapien
gaaagcaccttgtaaactgtaacct

SEQ ID NO: 548030 - DNA, 25 bp, Homo sapien
gtaaactgtaacctatcaatgtaaa

SEQ ID NO: 548031 - DNA, 25 bp, Homo sapien
ggtgtgttgttatttcattaattac

SEQ ID NO: 548032 - DNA, 25 bp, Homo sapien
atggaatttcctatgcactactgta

SEQ ID NO: 548033 - DNA, 25 bp, Homo sapien
tgcactactgtagctaggaaatgct

SEQ ID NO: 548034 - DNA, 25 bp, Homo sapien
gaacgttcgttgaagaaagctggta

SEQ ID NO: 548035 - DNA, 25 bp, Homo sapien
aaccaagtgcaagttcccagggaag

SEQ ID NO: 548036 - DNA, 25 bp, Homo sapien
aaggaagccgcattccttctgaacc

SEQ ID NO: 548037 - DNA, 25 bp, Homo sapien
gcattccttctgaacctcatcttgc

SEQ ID NO: 548038 - DNA, 25 bp, Homo sapien
ttgcttctgccatttcgcctgtacg

SEQ ID NO: 548039 - DNA, 25 bp, Homo sapien
tcgcctgtacgcaattacacttttc

SEQ ID NO: 548040 - DNA, 25 bp, Homo sapien
ttttcttttccaattgtcaacgcaa

SEQ ID NO: 548041 - DNA, 25 bp, Homo sapien
ttgatgaaatacgagctgcttcttg

SEQ ID NO: 548042 - DNA, 25 bp, Homo sapien
cgagctgcttcttgggtagtattta

SEQ ID NO: 548043 - DNA, 25 bp, Homo sapien
aacggcagccaaaaatctctatcaa

SEQ ID NO: 548044 - DNA, 25 bp, Homo sapien
gcttccattagcacagtggcagcaa

SEQ ID NO: 548045 - DNA, 25 bp, Homo sapien
agtagcatctgcattggtgaccaag

SEQ ID NO: 548046 - DNA, 25 bp, Homo sapien
ggtgaccaaggacactgcactttga

SEQ ID NO: 548047 - DNA, 25 bp, Homo sapien
tgcactttgaagaggtcgccactgg

SEQ ID NO: 548048 - DNA, 25 bp, Homo sapien
agaggtcgccactgggttatttagt

SEQ ID NO: 548049 - DNA, 25 bp, Homo sapien
ggttatttagtgtcttcactgcttt

SEQ ID NO: 548050 - DNA, 25 bp, Homo sapien
gaatatcaattgtttagacacacct

SEQ ID NO: 548051 - DNA, 25 bp, Homo sapien
gtttagacacacctacaatgataaa

SEQ ID NO: 548052 - DNA, 25 bp, Homo sapien
taaaggcccctctttccatgaaata

SEQ ID NO: 548053 - DNA, 25 bp, Homo sapien
tttccatgaaatacatctgtggttt

SEQ ID NO: 548054 - DNA, 25 bp, Homo sapien
atacatctgtggtttagcaaggaaa

SEQ ID NO: 548055 - DNA, 25 bp, Homo sapien
aatttttatttgtgtcttcatgtag

SEQ ID NO: 548056 - DNA, 25 bp, Homo sapien
catatgtatgtaagtttttctaccc

SEQ ID NO: 548057 - DNA, 25 bp, Homo sapien
atatgtatgtaagtttttctaccca

SEQ ID NO: 548058 - DNA, 25 bp, Homo sapien
tatgtatgtaagtttttctacccat

SEQ ID NO: 548059 - DNA, 25 bp, Homo sapien
atgtatgtaagtttttctacccatg

SEQ ID NO: 548060 - DNA, 25 bp, Homo sapien
tgtatgtaagtttttctacccatga

SEQ ID NO: 548061 - DNA, 25 bp, Homo sapien
gtatgtaagtttttctacccatgat

SEQ ID NO: 548062 - DNA, 25 bp, Homo sapien
gggcataggcccataggggatagaa

SEQ ID NO: 548063 - DNA, 25 bp, Homo sapien
ggcataggcccataggggatagaag

SEQ ID NO: 548064 - DNA, 25 bp, Homo sapien
gcataggcccataggggatagaagt

SEQ ID NO: 548065 - DNA, 25 bp, Homo sapien
acacagaccgcaaagggaggtaaag

SEQ ID NO: 548066 - DNA, 25 bp, Homo sapien
ggaggtaaagcttattcggctacaa

SEQ ID NO: 548067 - DNA, 25 bp, Homo sapien
gctacaaaagatgttgcttgtctct

SEQ ID NO: 548068 - DNA, 25 bp, Homo sapien
attgggcaagaggacacaatccgtc

SEQ ID NO: 548069 - DNA, 25 bp, Homo sapien
taagtagttccttcattgacgccaa

SEQ ID NO: 548070 - DNA, 25 bp, Homo sapien
attgacgccaaatgtcttttattta

SEQ ID NO: 548071 - DNA, 25 bp, Homo sapien
agaggacacaatccgtccaagttca

SEQ ID NO: 548072 - DNA, 25 bp, Homo sapien
ttgagtgtatgcttgcattcccacc

SEQ ID NO: 548073 - DNA, 25 bp, Homo sapien
tgtatgcttgcattcccaccttcaa

SEQ ID NO: 548074 - DNA, 25 bp, Homo sapien
ttcaaatcattgctctccgcccgag

SEQ ID NO: 548075 - DNA, 25 bp, Homo sapien
tccaagttcacagccgcagaagaac

SEQ ID NO: 548076 - DNA, 25 bp, Homo sapien
tttgagctactgcagcaaaaccctc

SEQ ID NO: 548077 - DNA, 25 bp, Homo sapien
tttactcttgactaccatacacttc

SEQ ID NO: 548078 - DNA, 25 bp, Homo sapien
gactaccatacacttctgatttaca

SEQ ID NO: 548079 - DNA, 25 bp, Homo sapien
gatttacagcagaagcctcagaagc

SEQ ID NO: 548080 - DNA, 25 bp, Homo sapien
ttcagttctcctttggcatgccact

SEQ ID NO: 548081 - DNA, 25 bp, Homo sapien
tggcatgccactggataccaagata

SEQ ID NO: 548082 - DNA, 25 bp, Homo sapien
aagctgtggacatgggcatttcctc

SEQ ID NO: 548083 - DNA, 25 bp, Homo sapien
atttcctctctgttgcagcaaggcg

SEQ ID NO: 548084 - DNA, 25 bp, Homo sapien
gagtaaaacgctacaatctttctaa

SEQ ID NO: 548085 - DNA, 25 bp, Homo sapien
tttcctagaattatgtccagctgtg

SEQ ID NO: 548086 - DNA, 25 bp, Homo sapien
gcatttctacccatactttgagcta

SEQ ID NO: 548087 - DNA, 25 bp, Homo sapien
taaggacctagcataccgtggagaa

SEQ ID NO: 548088 - DNA, 25 bp, Homo sapien
tagcataccgtggagaaccattaaa

SEQ ID NO: 548089 - DNA, 25 bp, Homo sapien
atgtcaacttacttcaaaggcgtag

SEQ ID NO: 548090 - DNA, 25 bp, Homo sapien
tcaaaggcgtagttttgggaatttg

SEQ ID NO: 548091 - DNA, 25 bp, Homo sapien
gatgcagtaaagattaccctgtttt

SEQ ID NO: 548092 - DNA, 25 bp, Homo sapien
gttttatgattgttccttgaaagtc

SEQ ID NO: 548093 - DNA, 25 bp, Homo sapien
gggacctgtccattgtgctctatta

SEQ ID NO: 548094 - DNA, 25 bp, Homo sapien
cattgtgctctattaatcttgtcag

SEQ ID NO: 548095 - DNA, 25 bp, Homo sapien
aatcttgtcagaaaactgtcaccaa

SEQ ID NO: 548096 - DNA, 25 bp, Homo sapien
aatttgagtttgtccttgttctagg

SEQ ID NO: 548097 - DNA, 25 bp, Homo sapien
ccttgttctaggagttactgggtag

SEQ ID NO: 548098 - DNA, 25 bp, Homo sapien
ccttgtggagggtgtccgatgactt

SEQ ID NO: 548099 - DNA, 25 bp, Homo sapien
tctcttccccttcctagaggaggaa

SEQ ID NO: 548100 - DNA, 25 bp, Homo sapien
gaagtgaccaagtttgaaggcggca

SEQ ID NO: 548101 - DNA, 25 bp, Homo sapien
tgaaggcggcagaaatggccacaca

SEQ ID NO: 548102 - DNA, 25 bp, Homo sapien
ccaagaagagcccatgcaactcagt

SEQ ID NO: 548103 - DNA, 25 bp, Homo sapien
tgacattggtggaagccttcatgcc

SEQ ID NO: 548104 - DNA, 25 bp, Homo sapien
cacttcctcctatgttgaccttaaa

SEQ ID NO: 548105 - DNA, 25 bp, Homo sapien
ctcctatgttgaccttaaacactgg

SEQ ID NO: 548106 - DNA, 25 bp, Homo sapien
acagtggtcccagggctacacttgg

SEQ ID NO: 548107 - DNA, 25 bp, Homo sapien
gctacacttggctttgactgcacag

SEQ ID NO: 548108 - DNA, 25 bp, Homo sapien
agcccctgctcagatccttgtggag

SEQ ID NO: 548109 - DNA, 25 bp, Homo sapien
gagctatggcccagaaacaacaggg

SEQ ID NO: 548110 - DNA, 25 bp, Homo sapien
actagagttcggtctgacagtcctt

SEQ ID NO: 548111 - DNA, 25 bp, Homo sapien
aagtctcctgtcttatggtccagaa

SEQ ID NO: 548112 - DNA, 25 bp, Homo sapien
ttccttctggcctctgctgaatgca

SEQ ID NO: 548113 - DNA, 25 bp, Homo sapien
gaatgcagggaatgcaatccttccc

SEQ ID NO: 548114 - DNA, 25 bp, Homo sapien
gctcttgcagttgctctgacgtaga

SEQ ID NO: 548115 - DNA, 25 bp, Homo sapien
gacgtagaaagatccttcgggtgct

SEQ ID NO: 548116 - DNA, 25 bp, Homo sapien
ttcgggtgctggaagtctccatgaa

SEQ ID NO: 548117 - DNA, 25 bp, Homo sapien
gtctccatgaagagcttgtgtcctg

SEQ ID NO: 548118 - DNA, 25 bp, Homo sapien
aagagcttgtgtcctgtcctttctt

SEQ ID NO: 548119 - DNA, 25 bp, Homo sapien
tttcttgcagattctatttcccctc

SEQ ID NO: 548120 - DNA, 25 bp, Homo sapien
cctggatgctgcatcacttccaggg

SEQ ID NO: 548121 - DNA, 25 bp, Homo sapien
gaatggattcatttgtgtggtagtc

SEQ ID NO: 548122 - DNA, 25 bp, Homo sapien
gtgtggtagtcaagattcccgctgt

SEQ ID NO: 548123 - DNA, 25 bp, Homo sapien
tcaagattcccgctgtggcacaagg

SEQ ID NO: 548124 - DNA, 25 bp, Homo sapien
gtggcacaaggtcacatgcactcgt

SEQ ID NO: 548125 - DNA, 25 bp, Homo sapien
aaggtcacatgcactcgtgtccaac

SEQ ID NO: 548126 - DNA, 25 bp, Homo sapien
actcgtgtccaactccaaatagtag

SEQ ID NO: 548127 - DNA, 25 bp, Homo sapien
gtagcttcacatagtatgtcagcac

SEQ ID NO: 548128 - DNA, 25 bp, Homo sapien
atccatcacctcttttagaaggtct

SEQ ID NO: 548129 - DNA, 25 bp, Homo sapien
tagaaggtcttcctctggattgaaa

SEQ ID NO: 548130 - DNA, 25 bp, Homo sapien
tcctctggattgaaaatggcctgaa

SEQ ID NO: 548131 - DNA, 25 bp, Homo sapien
gtgaaaatattcagaacgagctcct

SEQ ID NO: 548132 - DNA, 25 bp, Homo sapien
aaatattcagaacgagctccttaga

SEQ ID NO: 548133 - DNA, 25 bp, Homo sapien
attcagaacgagctccttagaagaa

SEQ ID NO: 548134 - DNA, 25 bp, Homo sapien
cagaacgagctccttagaagaaagg

SEQ ID NO: 548135 - DNA, 25 bp, Homo sapien
tactggaactattttccatctctag

SEQ ID NO: 548136 - DNA, 25 bp, Homo sapien
ctctagaaaaagtgcttcttcccct

SEQ ID NO: 548137 - DNA, 25 bp, Homo sapien
ttgaaagtacgcacacttctcatgt

SEQ ID NO: 548138 - DNA, 25 bp, Homo sapien
gaaagtacgcacacttctcatgtag

SEQ ID NO: 548139 - DNA, 25 bp, Homo sapien
agtacgcacacttctcatgtaggaa

SEQ ID NO: 548140 - DNA, 25 bp, Homo sapien
tacgcacacttctcatgtaggaaca

SEQ ID NO: 548141 - DNA, 25 bp, Homo sapien
gcacacttctcatgtaggaacaaaa

SEQ ID NO: 548142 - DNA, 25 bp, Homo sapien
tcctggatcctgcaatgcggcattg

SEQ ID NO: 548143 - DNA, 25 bp, Homo sapien
atgcggcattgctaaggtcctgtga

SEQ ID NO: 548144 - DNA, 25 bp, Homo sapien
ggcattgctaaggtcctgtgacagc

SEQ ID NO: 548145 - DNA, 25 bp, Homo sapien
taaggtcctgtgacagcagtggttg

SEQ ID NO: 548146 - DNA, 25 bp, Homo sapien
agcagtggttggaaggatcctggtt

SEQ ID NO: 548147 - DNA, 25 bp, Homo sapien
gggctttggaagagctcttctagcc

SEQ ID NO: 548148 - DNA, 25 bp, Homo sapien
ggaagagctcttctagccctttata

SEQ ID NO: 548149 - DNA, 25 bp, Homo sapien
agagctcttctagccctttataaaa

SEQ ID NO: 548150 - DNA, 25 bp, Homo sapien
gctcttctagccctttataaaagga

SEQ ID NO: 548151 - DNA, 25 bp, Homo sapien
ggttgaagaccaggcctggttttat

SEQ ID NO: 548152 - DNA, 25 bp, Homo sapien
gaagaccaggcctggttttattaga

SEQ ID NO: 548153 - DNA, 25 bp, Homo sapien
tgttcagttctaactagtggaaagt

SEQ ID NO: 548154 - DNA, 25 bp, Homo sapien
tagtggaaagttactctagcttttt

SEQ ID NO: 548155 - DNA, 25 bp, Homo sapien
aatagagcagtatctactcaagttt

SEQ ID NO: 548156 - DNA, 25 bp, Homo sapien
agcagtatctactcaagtttgtgta

SEQ ID NO: 548157 - DNA, 25 bp, Homo sapien
cagtatctactcaagtttgtgtaaa

SEQ ID NO: 548158 - DNA, 25 bp, Homo sapien
aatacattaatttctctggaagcag

SEQ ID NO: 548159 - DNA, 25 bp, Homo sapien
tacattaatttctctggaagcagga

SEQ ID NO: 548160 - DNA, 25 bp, Homo sapien
ggaagcaggaggcatgtttaaataa

SEQ ID NO: 548161 - DNA, 25 bp, Homo sapien
atttttctagccataaaggatggaa

SEQ ID NO: 548162 - DNA, 25 bp, Homo sapien
tggaagtcaagaactttttgttgtt

SEQ ID NO: 548163 - DNA, 25 bp, Homo sapien
ttttgttgtttagtcatgttaagta

SEQ ID NO: 548164 - DNA, 25 bp, Homo sapien
agccgctccaggtactttctgatgg

SEQ ID NO: 548165 - DNA, 25 bp, Homo sapien
aggtactttctgatggctccacagt

SEQ ID NO: 548166 - DNA, 25 bp, Homo sapien
ttctgatggctccacagtgcagctc

SEQ ID NO: 548167 - DNA, 25 bp, Homo sapien
cagactttcctcactcggatttgag

SEQ ID NO: 548168 - DNA, 25 bp, Homo sapien
tcactcggatttgaggactcgatgt

SEQ ID NO: 548169 - DNA, 25 bp, Homo sapien
tttgaggactcgatgtgctgaggca

SEQ ID NO: 548170 - DNA, 25 bp, Homo sapien
gagcctgtcctcttttgttcaaaat

SEQ ID NO: 548171 - DNA, 25 bp, Homo sapien
aatacatcttgaaacgtctttgtga

SEQ ID NO: 548172 - DNA, 25 bp, Homo sapien
gaaacgtctttgtgaaggctcttag

SEQ ID NO: 548173 - DNA, 25 bp, Homo sapien
aaggctcttagttttaatgcatgga

SEQ ID NO: 548174 - DNA, 25 bp, Homo sapien
aatgcatggatgctgttatttttcc

SEQ ID NO: 548175 - DNA, 25 bp, Homo sapien
ccagatggcatgtggtgtggcacct

SEQ ID NO: 548176 - DNA, 25 bp, Homo sapien
ggaggcctcaggatcacaaatgtta

SEQ ID NO: 548177 - DNA, 25 bp, Homo sapien
atatgtcctaatgtgctgcccagaa

SEQ ID NO: 548178 - DNA, 25 bp, Homo sapien
atgtgctgcccagaaacctcaactg

SEQ ID NO: 548179 - DNA, 25 bp, Homo sapien
gcactgtcagcgagatgttgggtct

SEQ ID NO: 548180 - DNA, 25 bp, Homo sapien
gaggtgatgagatcgggccacactt

SEQ ID NO: 548181 - DNA, 25 bp, Homo sapien
agatcgggccacacttgagctgagt

SEQ ID NO: 548182 - DNA, 25 bp, Homo sapien
ttgagctgagtcaccagaccctatt

SEQ ID NO: 548183 - DNA, 25 bp, Homo sapien
cagaccctattgcttcaacagtgct

SEQ ID NO: 548184 - DNA, 25 bp, Homo sapien
agccactctagctgctggatgtgat

SEQ ID NO: 548185 - DNA, 25 bp, Homo sapien
gtgatcctgggacatgtactccaag

SEQ ID NO: 548186 - DNA, 25 bp, Homo sapien
gtgcctttgagtattccgtcctcct

SEQ ID NO: 548187 - DNA, 25 bp, Homo sapien
ctcctcacatcctctggtgaacaaa

SEQ ID NO: 548188 - DNA, 25 bp, Homo sapien
caaattgtccccaaagctttgtggt

SEQ ID NO: 548189 - DNA, 25 bp, Homo sapien
gtccccaaagctttgtggtcagggt

SEQ ID NO: 548190 - DNA, 25 bp, Homo sapien
tggtcagggtatccagagctgctca

SEQ ID NO: 548191 - DNA, 25 bp, Homo sapien
gagctgctcaccacacaactatggg

SEQ ID NO: 548192 - DNA, 25 bp, Homo sapien
gaatacacagtgatggtccccattg

SEQ ID NO: 548193 - DNA, 25 bp, Homo sapien
cacagtgatggtccccattgcattt

SEQ ID NO: 548194 - DNA, 25 bp, Homo sapien
gccctaccttaaatgtccatccagt

SEQ ID NO: 548195 - DNA, 25 bp, Homo sapien
tgcacacctcctcattgccaaagga

SEQ ID NO: 548196 - DNA, 25 bp, Homo sapien
aaaggacctggcttagatacaagta

SEQ ID NO: 548197 - DNA, 25 bp, Homo sapien
tctgatctttttggaacaaactgtt

SEQ ID NO: 548198 - DNA, 25 bp, Homo sapien
attatgcattagacgttgagacagc

SEQ ID NO: 548199 - DNA, 25 bp, Homo sapien
gagacagcgtgatacttacaactca

SEQ ID NO: 548200 - DNA, 25 bp, Homo sapien
gatacttacaactcactagtatagt

SEQ ID NO: 548201 - DNA, 25 bp, Homo sapien
gtaacttattacaggatcatactaa

SEQ ID NO: 548202 - DNA, 25 bp, Homo sapien
aatttctgtcatatgtatactgaag

SEQ ID NO: 548203 - DNA, 25 bp, Homo sapien
aaaccagaatatgtagtctacggat

SEQ ID NO: 548204 - DNA, 25 bp, Homo sapien
gtagtctacggatattttttatcat

SEQ ID NO: 548205 - DNA, 25 bp, Homo sapien
attttactaaagtcctcctgccagg

SEQ ID NO: 548206 - DNA, 25 bp, Homo sapien
tactaaagtcctcctgccaggtagt

SEQ ID NO: 548207 - DNA, 25 bp, Homo sapien
tgccaggtagttcccactgatggaa

SEQ ID NO: 548208 - DNA, 25 bp, Homo sapien
aagttttctcacctttgagtaacag

SEQ ID NO: 548209 - DNA, 25 bp, Homo sapien
tgtccatacctagaagaccagtgca

SEQ ID NO: 548210 - DNA, 25 bp, Homo sapien
gaccagtgcaaatactttgagagca

SEQ ID NO: 548211 - DNA, 25 bp, Homo sapien
gagagcacctgggtctacaggacat

SEQ ID NO: 548212 - DNA, 25 bp, Homo sapien
ggtctacaggacataattggcatct

SEQ ID NO: 548213 - DNA, 25 bp, Homo sapien
cataattggcatctaaatcctcatt

SEQ ID NO: 548214 - DNA, 25 bp, Homo sapien
tgtaatacccttattctttttgaat

SEQ ID NO: 548215 - DNA, 25 bp, Homo sapien
ttttctctcttttgaatctagttgc

SEQ ID NO: 548216 - DNA, 25 bp, Homo sapien
atctagttgctggttttcgtttaat

SEQ ID NO: 548217 - DNA, 25 bp, Homo sapien
gctggttttcgtttaatgattttag

SEQ ID NO: 548218 - DNA, 25 bp, Homo sapien
tagtttaacaatcccaaccaacaat

SEQ ID NO: 548219 - DNA, 25 bp, Homo sapien
tgatcaatctatgcagttccctgaa

SEQ ID NO: 548220 - DNA, 25 bp, Homo sapien
tgcagttccctgaagatcaaagaat

SEQ ID NO: 548221 - DNA, 25 bp, Homo sapien
ctgttgctgcttggtgtggaaatgc

SEQ ID NO: 548222 - DNA, 25 bp, Homo sapien
gtgactgccaagaggcctggccaga

SEQ ID NO: 548223 - DNA, 25 bp, Homo sapien
ggcagctggccttcccacagtgaga

SEQ ID NO: 548224 - DNA, 25 bp, Homo sapien
cttcccacagtgagactggcagtgt

SEQ ID NO: 548225 - DNA, 25 bp, Homo sapien
ctggcagtgtgctcagatggccaca

SEQ ID NO: 548226 - DNA, 25 bp, Homo sapien
atggccacactgttcggaatccggt

SEQ ID NO: 548227 - DNA, 25 bp, Homo sapien
aggacgctgtgcagtcctgctctgt

SEQ ID NO: 548228 - DNA, 25 bp, Homo sapien
tagaatgggtccctatggtgtttac

SEQ ID NO: 548229 - DNA, 25 bp, Homo sapien
tggtgtttacactttgatcaatcta

SEQ ID NO: 548230 - DNA, 25 bp, Homo sapien
ccaactctttgaaggatgtgtccca

SEQ ID NO: 548231 - DNA, 25 bp, Homo sapien
tgtcccaaggtgtctcaagtctgat

SEQ ID NO: 548232 - DNA, 25 bp, Homo sapien
agtctgatgcaatgaaagctgcccc

SEQ ID NO: 548233 - DNA, 25 bp, Homo sapien
gactgagtccagaatgtcctgcgtg

SEQ ID NO: 548234 - DNA, 25 bp, Homo sapien
tgtttcccagagtgtctgtcctaac

SEQ ID NO: 548235 - DNA, 25 bp, Homo sapien
gtctgtcctaacaccgcttaaagat

SEQ ID NO: 548236 - DNA, 25 bp, Homo sapien
gtgatcctcaggtatatggtctcag

SEQ ID NO: 548237 - DNA, 25 bp, Homo sapien
ggtatatggtctcaggattggcccc

SEQ ID NO: 548238 - DNA, 25 bp, Homo sapien
gattggccccaagcacacggtgtgt

SEQ ID NO: 548239 - DNA, 25 bp, Homo sapien
tcttcacaaagcataggtacccatt

SEQ ID NO: 548240 - DNA, 25 bp, Homo sapien
aggtacccattaaagccatattgct

SEQ ID NO: 548241 - DNA, 25 bp, Homo sapien
agtcgcgcatctacttcggtggcaa

SEQ ID NO: 548242 - DNA, 25 bp, Homo sapien
aagcccggcatggacctggtccaga

SEQ ID NO: 548243 - DNA, 25 bp, Homo sapien
tggcctaccaagggcagcagcggct

SEQ ID NO: 548244 - DNA, 25 bp, Homo sapien
tgcgctgcctgcagttcgccggcag

SEQ ID NO: 548245 - DNA, 25 bp, Homo sapien
agttcgccggcagctacatggcatc

SEQ ID NO: 548246 - DNA, 25 bp, Homo sapien
agctacatggcatccgctgcgcggc

SEQ ID NO: 548247 - DNA, 25 bp, Homo sapien
agcccgagcagacgctggaagactt

SEQ ID NO: 548248 - DNA, 25 bp, Homo sapien
cgagcagacgctggaagactttttc

SEQ ID NO: 548249 - DNA, 25 bp, Homo sapien
aagactttttcatcaaccgcttcgg

SEQ ID NO: 548250 - DNA, 25 bp, Homo sapien
actttttcatcaaccgcttcggccg

SEQ ID NO: 548251 - DNA, 25 bp, Homo sapien
agcagcggctgctcggcggccatct

SEQ ID NO: 548252 - DNA, 25 bp, Homo sapien
gggatatctttagaatgcttgagaa

SEQ ID NO: 548253 - DNA, 25 bp, Homo sapien
gaaagttgctaggtgtgtgccacat

SEQ ID NO: 548254 - DNA, 25 bp, Homo sapien
gtgtgtgccacattggtgcaggtaa

SEQ ID NO: 548255 - DNA, 25 bp, Homo sapien
gtgcaggtaaatccatgctgttcac

SEQ ID NO: 548256 - DNA, 25 bp, Homo sapien
tgttcacagccaagcagcatttgca

SEQ ID NO: 548257 - DNA, 25 bp, Homo sapien
gagagttttacatagaccccaggaa

SEQ ID NO: 548258 - DNA, 25 bp, Homo sapien
tactaacctggttgatggccttggt

SEQ ID NO: 548259 - DNA, 25 bp, Homo sapien
atggccttggtggtggaattttgtt

SEQ ID NO: 548260 - DNA, 25 bp, Homo sapien
gaatgatgttcagtataacactatc

SEQ ID NO: 548261 - DNA, 25 bp, Homo sapien
acactatctgatttttagattggtc

SEQ ID NO: 548262 - DNA, 25 bp, Homo sapien
tagattggtcgatttctgttgtaat

SEQ ID NO: 548263 - DNA, 25 bp, Homo sapien
ggatttgtcttatctttgtagttta

SEQ ID NO: 548264 - DNA, 25 bp, Homo sapien
attttcaaattcatagcgtaactta

SEQ ID NO: 548265 - DNA, 25 bp, Homo sapien
tagcgtaacttacttgtttccataa

SEQ ID NO: 548266 - DNA, 25 bp, Homo sapien
acttgtttccataagcaaagctgta

SEQ ID NO: 548267 - DNA, 25 bp, Homo sapien
gtaaactgtgtatcagtgcttctag

SEQ ID NO: 548268 - DNA, 25 bp, Homo sapien
gtatcagtgcttctagtaatcttgc

SEQ ID NO: 548269 - DNA, 25 bp, Homo sapien
aatcttgctattgtcttggtactga

SEQ ID NO: 548270 - DNA, 25 bp, Homo sapien
tttagaccaatataatttgcccagg

SEQ ID NO: 548271 - DNA, 25 bp, Homo sapien
atataatttgcccaggaatcctttg

SEQ ID NO: 548272 - DNA, 25 bp, Homo sapien
cccaggaatcctttgtatgctaaac

SEQ ID NO: 548273 - DNA, 25 bp, Homo sapien
attaccattacatcgtttcataaca

SEQ ID NO: 548274 - DNA, 25 bp, Homo sapien
acaggctgcctcaccgggattgtct

SEQ ID NO: 548275 - DNA, 25 bp, Homo sapien
accgggattgtctgccactaaatag

SEQ ID NO: 548276 - DNA, 25 bp, Homo sapien
tgccactaaatagctggagtcacag

SEQ ID NO: 548277 - DNA, 25 bp, Homo sapien
gtcacagattgagataaatgccacc

SEQ ID NO: 548278 - DNA, 25 bp, Homo sapien
taaatgccaccttcaaggttgcagt

SEQ ID NO: 548279 - DNA, 25 bp, Homo sapien
gttgcagtgaaaagcataatcctat

SEQ ID NO: 548280 - DNA, 25 bp, Homo sapien
attttattactgcatgttcccgtcc

SEQ ID NO: 548281 - DNA, 25 bp, Homo sapien
tcccgtcccgtcttgtgaatgtgag

SEQ ID NO: 548282 - DNA, 25 bp, Homo sapien
gtcttgtgaatgtgagtccccgcca

SEQ ID NO: 548283 - DNA, 25 bp, Homo sapien
tgagtccccgccaccacgtgaggtg

SEQ ID NO: 548284 - DNA, 25 bp, Homo sapien
accacgtgaggtgcagtcgttgcag

SEQ ID NO: 548285 - DNA, 25 bp, Homo sapien
gagtaatcaatcacctcctcagaga

SEQ ID NO: 548286 - DNA, 25 bp, Homo sapien
acctcctcagagaaagtctgctcag

SEQ ID NO: 548287 - DNA, 25 bp, Homo sapien
ctctttagtatgacactggcaactg

SEQ ID NO: 548288 - DNA, 25 bp, Homo sapien
tctggctggaagctgttgtccccaa

SEQ ID NO: 548289 - DNA, 25 bp, Homo sapien
gttgtccccaacttcagaaagtgtc

SEQ ID NO: 548290 - DNA, 25 bp, Homo sapien
aagtgtctgcagatttcacaggctc

SEQ ID NO: 548291 - DNA, 25 bp, Homo sapien
atgacactggcaactgacggcactg

SEQ ID NO: 548292 - DNA, 25 bp, Homo sapien
agatttcacaggctctctcttgggt

SEQ ID NO: 548293 - DNA, 25 bp, Homo sapien
tctcttgggtcaagggaccagctct

SEQ ID NO: 548294 - DNA, 25 bp, Homo sapien
acactggcaactgacggcactgcgg

SEQ ID NO: 548295 - DNA, 25 bp, Homo sapien
gaccagctctgtgaacacggcaagt

SEQ ID NO: 548296 - DNA, 25 bp, Homo sapien
atgacaggaagcgacgcctctggca

SEQ ID NO: 548297 - DNA, 25 bp, Homo sapien
ctggcagggcccttgctgcagagtt

SEQ ID NO: 548298 - DNA, 25 bp, Homo sapien
cccttgctgcagagttggtggagaa

SEQ ID NO: 548299 - DNA, 25 bp, Homo sapien
gagaacagaaatccacgctcaatct

SEQ ID NO: 548300 - DNA, 25 bp, Homo sapien
agaaatccacgctcaatctcaggtc

SEQ ID NO: 548301 - DNA, 25 bp, Homo sapien
gggtcagatgcactgaagtagccaa

SEQ ID NO: 548302 - DNA, 25 bp, Homo sapien
gtagccaacagcgaagccagtccag

SEQ ID NO: 548303 - DNA, 25 bp, Homo sapien
tccttttgtctacggaagcctctgg

SEQ ID NO: 548304 - DNA, 25 bp, Homo sapien
ggaagcctctgggtgacaaaagtaa

SEQ ID NO: 548305 - DNA, 25 bp, Homo sapien
gtaaaagagagctgcccacaacttg

SEQ ID NO: 548306 - DNA, 25 bp, Homo sapien
tgcccacaacttgccaaaacagata

SEQ ID NO: 548307 - DNA, 25 bp, Homo sapien
gaataagtgaatgctatttgctcct

SEQ ID NO: 548308 - DNA, 25 bp, Homo sapien
gtgaatgctatttgctcctagctaa

SEQ ID NO: 548309 - DNA, 25 bp, Homo sapien
gctcctagctaattgcagcatgttt

SEQ ID NO: 548310 - DNA, 25 bp, Homo sapien
attgcagcatgtttcttgatatgaa

SEQ ID NO: 548311 - DNA, 25 bp, Homo sapien
acaactaactaggactgatcttaat

SEQ ID NO: 548312 - DNA, 25 bp, Homo sapien
gaaaaggctatgctttcaatctcct

SEQ ID NO: 548313 - DNA, 25 bp, Homo sapien
gctttcaatctcctacacaaatttt

SEQ ID NO: 548314 - DNA, 25 bp, Homo sapien
cctacacaaattttacatctggaat

SEQ ID NO: 548315 - DNA, 25 bp, Homo sapien
atctggaatgatctgaaggttcttc

SEQ ID NO: 548316 - DNA, 25 bp, Homo sapien
caaaattaggcttttttatgtcctg

SEQ ID NO: 548317 - DNA, 25 bp, Homo sapien
gatgatttcataacaccatattaga

SEQ ID NO: 548318 - DNA, 25 bp, Homo sapien
attgatgtgtgtctaggcaggacct

SEQ ID NO: 548319 - DNA, 25 bp, Homo sapien
ttgctgtatgtctcgtggtaggact

SEQ ID NO: 548320 - DNA, 25 bp, Homo sapien
gaactgaacattccagagcgtgtag

SEQ ID NO: 548321 - DNA, 25 bp, Homo sapien
cattccagagcgtgtagtgaatcac

SEQ ID NO: 548322 - DNA, 25 bp, Homo sapien
acgtaaagctagaaatgatccccag

SEQ ID NO: 548323 - DNA, 25 bp, Homo sapien
gctgtttatgcatagataatctctc

SEQ ID NO: 548324 - DNA, 25 bp, Homo sapien
agataatctctccattcccgtggaa

SEQ ID NO: 548325 - DNA, 25 bp, Homo sapien
gtttttcctgttcttaagacgtgat

SEQ ID NO: 548326 - DNA, 25 bp, Homo sapien
aagacgtgattttgctgtagaagat

SEQ ID NO: 548327 - DNA, 25 bp, Homo sapien
atggcacttataaccaaagcccaaa

SEQ ID NO: 548328 - DNA, 25 bp, Homo sapien
tcaggagtgggttgatttcagcacc

SEQ ID NO: 548329 - DNA, 25 bp, Homo sapien
gaattattggaatccatgggcaata

SEQ ID NO: 548330 - DNA, 25 bp, Homo sapien
gaatccatgggcaatacatcttcac

SEQ ID NO: 548331 - DNA, 25 bp, Homo sapien
gggcaatacatcttcacatgtccct

SEQ ID NO: 548332 - DNA, 25 bp, Homo sapien
catcttcacatgtcccttattcata

SEQ ID NO: 548333 - DNA, 25 bp, Homo sapien
cacatgtcccttattcatatgctaa

SEQ ID NO: 548334 - DNA, 25 bp, Homo sapien
gtcccttattcatatgctaagcaag

SEQ ID NO: 548335 - DNA, 25 bp, Homo sapien
atatttctctgaacattctgtctca

SEQ ID NO: 548336 - DNA, 25 bp, Homo sapien
ttctctgaacattctgtctcagaaa

SEQ ID NO: 548337 - DNA, 25 bp, Homo sapien
attgtaagaagtggctatctagctc

SEQ ID NO: 548338 - DNA, 25 bp, Homo sapien
gtggctatctagctcttgaacaagt

SEQ ID NO: 548339 - DNA, 25 bp, Homo sapien
aataattccttattccagataaatt

SEQ ID NO: 548340 - DNA, 25 bp, Homo sapien
tagataagcatgatgtttaggtcct

SEQ ID NO: 548341 - DNA, 25 bp, Homo sapien
caatatttgtatttaagtctccatt

SEQ ID NO: 548342 - DNA, 25 bp, Homo sapien
aagtctccattttaatgccttgtgg

SEQ ID NO: 548343 - DNA, 25 bp, Homo sapien
cattttaatgccttgtggtgttttt

SEQ ID NO: 548344 - DNA, 25 bp, Homo sapien
tttttatgcatgtcactaagttgtc

SEQ ID NO: 548345 - DNA, 25 bp, Homo sapien
gcatgtcactaagttgtcatcccac

SEQ ID NO: 548346 - DNA, 25 bp, Homo sapien
gtcactaagttgtcatcccacataa

SEQ ID NO: 548347 - DNA, 25 bp, Homo sapien
aagttgtcatcccacataaattgat

SEQ ID NO: 548348 - DNA, 25 bp, Homo sapien
taaattgatgtgcagcatagggtat

SEQ ID NO: 548349 - DNA, 25 bp, Homo sapien
gcagcatagggtattaaatctacat

SEQ ID NO: 548350 - DNA, 25 bp, Homo sapien
gtagtaacatttcacttgtaaattt

SEQ ID NO: 548351 - DNA, 25 bp, Homo sapien
agttgcatacaaagacatctgattg

SEQ ID NO: 548352 - DNA, 25 bp, Homo sapien
gggtatgttatatgcccctttcata

SEQ ID NO: 548353 - DNA, 25 bp, Homo sapien
atatgcccctttcataggctgctag

SEQ ID NO: 548354 - DNA, 25 bp, Homo sapien
tgctagggagttttcctggttctac

SEQ ID NO: 548355 - DNA, 25 bp, Homo sapien
ggttctactttcaggtggtgggatc

SEQ ID NO: 548356 - DNA, 25 bp, Homo sapien
gaccagaatttctcatatgttgtga

SEQ ID NO: 548357 - DNA, 25 bp, Homo sapien
tcaaatgttacagggttgccagcca

SEQ ID NO: 548358 - DNA, 25 bp, Homo sapien
tacagggttgccagccaaactatca

SEQ ID NO: 548359 - DNA, 25 bp, Homo sapien
gaaccattgttggagaatctactaa

SEQ ID NO: 548360 - DNA, 25 bp, Homo sapien
gaatctactaaaatacggcttcccg

SEQ ID NO: 548361 - DNA, 25 bp, Homo sapien
tacggcttcccgcaaacgaagatga

SEQ ID NO: 548362 - DNA, 25 bp, Homo sapien
gagtaatcaatcacctcctcagaga

SEQ ID NO: 548363 - DNA, 25 bp, Homo sapien
agtaatcaatcacctcctcagagaa

SEQ ID NO: 548364 - DNA, 25 bp, Homo sapien
aatcaatcacctcctcagagaaagt

SEQ ID NO: 548365 - DNA, 25 bp, Homo sapien
acctcctcagagaaagtctgctcag

SEQ ID NO: 548366 - DNA, 25 bp, Homo sapien
gaccagctctgtgaacacggcaagt

SEQ ID NO: 548367 - DNA, 25 bp, Homo sapien
agctctgtgaacacggcaagtaaca

SEQ ID NO: 548368 - DNA, 25 bp, Homo sapien
tgtgaacacggcaagtaacaacaga

SEQ ID NO: 548369 - DNA, 25 bp, Homo sapien
aaagaagaggctgttctaagaaaga

SEQ ID NO: 548370 - DNA, 25 bp, Homo sapien
ttctaagaaagactaccgagtaatc

SEQ ID NO: 548371 - DNA, 25 bp, Homo sapien
aagactaccgagtaatcaatcacct

SEQ ID NO: 548372 - DNA, 25 bp, Homo sapien
actaccgagtaatcaatcacctcct

SEQ ID NO: 548373 - DNA, 25 bp, Homo sapien
aaattcaagcccttacagtgtcctg

SEQ ID NO: 548374 - DNA, 25 bp, Homo sapien
ctgactgtgacatgacctttccttg

SEQ ID NO: 548375 - DNA, 25 bp, Homo sapien
tgtttctctgagcttatttcccatc

SEQ ID NO: 548376 - DNA, 25 bp, Homo sapien
gcttatttcccatcagaacattcat

SEQ ID NO: 548377 - DNA, 25 bp, Homo sapien
attcatacagaggaaaggccccata

SEQ ID NO: 548378 - DNA, 25 bp, Homo sapien
ggaaaggccccataagtgcaaaaca

SEQ ID NO: 548379 - DNA, 25 bp, Homo sapien
gctttggactcagaacttgcatgcc

SEQ ID NO: 548380 - DNA, 25 bp, Homo sapien
ttgcatgccaccagaagagccacat

SEQ ID NO: 548381 - DNA, 25 bp, Homo sapien
agccacatgctagcggaacctttta

SEQ ID NO: 548382 - DNA, 25 bp, Homo sapien
ttgcatctcattactcataagcgaa

SEQ ID NO: 548383 - DNA, 25 bp, Homo sapien
aagcgaactcacataaaaaacacca

SEQ ID NO: 548384 - DNA, 25 bp, Homo sapien
tgcattctgagttactatgattttt

SEQ ID NO: 548385 - DNA, 25 bp, Homo sapien
ttttttatctcctttcacttcaagt

SEQ ID NO: 548386 - DNA, 25 bp, Homo sapien
atctcctttcacttcaagttattaa

SEQ ID NO: 548387 - DNA, 25 bp, Homo sapien
aagttattaagcattcactcactga

SEQ ID NO: 548388 - DNA, 25 bp, Homo sapien
tcactcactgaacttttatggccat

SEQ ID NO: 548389 - DNA, 25 bp, Homo sapien
aacttttatggccattcactgagca

SEQ ID NO: 548390 - DNA, 25 bp, Homo sapien
ttatggccattcactgagcaaggca

SEQ ID NO: 548391 - DNA, 25 bp, Homo sapien
ttaactctgctcctaaaaggcagat

SEQ ID NO: 548392 - DNA, 25 bp, Homo sapien
ataaatctctttacttctcgggtct

SEQ ID NO: 548393 - DNA, 25 bp, Homo sapien
atctctttacttctcgggtcttgtt

SEQ ID NO: 548394 - DNA, 25 bp, Homo sapien
tcgggtcttgttttccacctctata

SEQ ID NO: 548395 - DNA, 25 bp, Homo sapien
gttggataaaatagcgaaatcttac

SEQ ID NO: 548396 - DNA, 25 bp, Homo sapien
atagcgaaatcttacaggatctgac

SEQ ID NO: 548397 - DNA, 25 bp, Homo sapien
gaaatcttacaggatctgacaggac

SEQ ID NO: 548398 - DNA, 25 bp, Homo sapien
atcttacaggatctgacaggactga

SEQ ID NO: 548399 - DNA, 25 bp, Homo sapien
tacaggatctgacaggactgagatt

SEQ ID NO: 548400 - DNA, 25 bp, Homo sapien
ggatctgacaggactgagattagga

SEQ ID NO: 548401 - DNA, 25 bp, Homo sapien
ggaagtgaggctgaattgaataagt

SEQ ID NO: 548402 - DNA, 25 bp, Homo sapien
gtatggggatgaatccttcttattt

SEQ ID NO: 548403 - DNA, 25 bp, Homo sapien
atttttgatacattgtccatcatag

SEQ ID NO: 548404 - DNA, 25 bp, Homo sapien
gatacattgtccatcatagactttt

SEQ ID NO: 548405 - DNA, 25 bp, Homo sapien
tgtccatcatagactttttacatta

SEQ ID NO: 548406 - DNA, 25 bp, Homo sapien
tgtgcttgtcattccagagtgctga

SEQ ID NO: 548407 - DNA, 25 bp, Homo sapien
gggctgatggtcttaaatgctcatt

SEQ ID NO: 548408 - DNA, 25 bp, Homo sapien
ctcattttctggtttggcatggtga

SEQ ID NO: 548409 - DNA, 25 bp, Homo sapien
gaactttaagtctcacccattatct

SEQ ID NO: 548410 - DNA, 25 bp, Homo sapien
atattgtgattctgtttattcttcc

SEQ ID NO: 548411 - DNA, 25 bp, Homo sapien
tccagaatgctgaactccttgttag

SEQ ID NO: 548412 - DNA, 25 bp, Homo sapien
tccttgttagcccttcagattgtta

SEQ ID NO: 548413 - DNA, 25 bp, Homo sapien
agtggttctcatttggtctgccaga

SEQ ID NO: 548414 - DNA, 25 bp, Homo sapien
gaatactgggttcttagttgacaac

SEQ ID NO: 548415 - DNA, 25 bp, Homo sapien
ggttgatttgtaacacagtcattct

SEQ ID NO: 548416 - DNA, 25 bp, Homo sapien
cagtcattctaggatgtggagctac

SEQ ID NO: 548417 - DNA, 25 bp, Homo sapien
agggcaagatctcccaccagtggct

SEQ ID NO: 548418 - DNA, 25 bp, Homo sapien
agatctcccaccagtggctggctgt

SEQ ID NO: 548419 - DNA, 25 bp, Homo sapien
cagcatggccatggctgctgcaagg

SEQ ID NO: 548420 - DNA, 25 bp, Homo sapien
catggccatggctgctgcaaggcag

SEQ ID NO: 548421 - DNA, 25 bp, Homo sapien
gctcctgtgtgcagcagcgtgtctg

SEQ ID NO: 548422 - DNA, 25 bp, Homo sapien
tgtgcagcagcgtgtctgctttgaa

SEQ ID NO: 548423 - DNA, 25 bp, Homo sapien
tgcagcagcgtgtctgctttgaaaa

SEQ ID NO: 548424 - DNA, 25 bp, Homo sapien
gcagcgtgtctgctttgaaaagcca

SEQ ID NO: 548425 - DNA, 25 bp, Homo sapien
agcgtgtctgctttgaaaagccaca

SEQ ID NO: 548426 - DNA, 25 bp, Homo sapien
gaaaagccacagagactcctgtggt

SEQ ID NO: 548427 - DNA, 25 bp, Homo sapien
agccacagagactcctgtggttagg

SEQ ID NO: 548428 - DNA, 25 bp, Homo sapien
attgatttcagccttcttctggtac

SEQ ID NO: 548429 - DNA, 25 bp, Homo sapien
gatttcagccttcttctggtacttt

SEQ ID NO: 548430 - DNA, 25 bp, Homo sapien
ttcagccttcttctggtacttttta

SEQ ID NO: 548431 - DNA, 25 bp, Homo sapien
atatgctgatcttgtgagtatttat

SEQ ID NO: 548432 - DNA, 25 bp, Homo sapien
tatttaatggagcaaggaacacaga

SEQ ID NO: 548433 - DNA, 25 bp, Homo sapien
ataaaatctatgtgtgcttgataag

SEQ ID NO: 548434 - DNA, 25 bp, Homo sapien
tctgtttttaattagagctatatca

SEQ ID NO: 548435 - DNA, 25 bp, Homo sapien
gagctatatcattttactctgaatg

SEQ ID NO: 548436 - DNA, 25 bp, Homo sapien
tttactctgaatgtcttaacataga

SEQ ID NO: 548437 - DNA, 25 bp, Homo sapien
acagattggattgatttcagccttc

SEQ ID NO: 548438 - DNA, 25 bp, Homo sapien
gattggattgatttcagccttcttc

SEQ ID NO: 548439 - DNA, 25 bp, Homo sapien
aatcaatttctatgacggtactaat

SEQ ID NO: 548440 - DNA, 25 bp, Homo sapien
atgcaaattcttcaccacttatgat

SEQ ID NO: 548441 - DNA, 25 bp, Homo sapien
caaactggagtttacagatggcctt

SEQ ID NO: 548442 - DNA, 25 bp, Homo sapien
tgcctagcccatttgttcatcctaa

SEQ ID NO: 548443 - DNA, 25 bp, Homo sapien
gttcatcctaacttcttcatcactt

SEQ ID NO: 548444 - DNA, 25 bp, Homo sapien
ttcatcacttcctgatgcacttggg

SEQ ID NO: 548445 - DNA, 25 bp, Homo sapien
gttgacacaacgttaccaatatttg

SEQ ID NO: 548446 - DNA, 25 bp, Homo sapien
tatctgcaattacctacgcttatct

SEQ ID NO: 548447 - DNA, 25 bp, Homo sapien
tacgcttatcttatcagaccctaga

SEQ ID NO: 548448 - DNA, 25 bp, Homo sapien
tagatgccatttgagccccttactt

SEQ ID NO: 548449 - DNA, 25 bp, Homo sapien
ccttacttctttgggcagtgggtga

SEQ ID NO: 548450 - DNA, 25 bp, Homo sapien
taaatgtcttttgggatgtttcctt

SEQ ID NO: 548451 - DNA, 25 bp, Homo sapien
tgtcttttgggatgtttccttaatt

SEQ ID NO: 548452 - DNA, 25 bp, Homo sapien
taatttactactttgtatgtacctt

SEQ ID NO: 548453 - DNA, 25 bp, Homo sapien
tactactttgtatgtacctttcttt

SEQ ID NO: 548454 - DNA, 25 bp, Homo sapien
tactttgtatgtacctttctttctc

SEQ ID NO: 548455 - DNA, 25 bp, Homo sapien
tccaagtatctttttcatgtttatt

SEQ ID NO: 548456 - DNA, 25 bp, Homo sapien
acctttctttctcctgacaaatgag

SEQ ID NO: 548457 - DNA, 25 bp, Homo sapien
tctcctgacaaatgaggttatttta

SEQ ID NO: 548458 - DNA, 25 bp, Homo sapien
tattttatatgagtctgtctgagag

SEQ ID NO: 548459 - DNA, 25 bp, Homo sapien
ttatatgagtctgtctgagagtaca

SEQ ID NO: 548460 - DNA, 25 bp, Homo sapien
gagtctgtctgagagtacagtaaat

SEQ ID NO: 548461 - DNA, 25 bp, Homo sapien
agagtggagccctccctcgccaaag

SEQ ID NO: 548462 - DNA, 25 bp, Homo sapien
gtgcccatccagagtctggcaccaa

SEQ ID NO: 548463 - DNA, 25 bp, Homo sapien
cagagtctggcaccaacgggccttg

SEQ ID NO: 548464 - DNA, 25 bp, Homo sapien
gggccttgccaagtagctgctgagt

SEQ ID NO: 548465 - DNA, 25 bp, Homo sapien
gtagctgctgagtgaatgggcacat

SEQ ID NO: 548466 - DNA, 25 bp, Homo sapien
gtgaatgggcacatgacgccaccct

SEQ ID NO: 548467 - DNA, 25 bp, Homo sapien
atgacgccaccctcagaaaggaaag

SEQ ID NO: 548468 - DNA, 25 bp, Homo sapien
aaggaaagcaagatccggcgcaccc

SEQ ID NO: 548469 - DNA, 25 bp, Homo sapien
cagggcgagcaaaaccccatgggat

SEQ ID NO: 548470 - DNA, 25 bp, Homo sapien
aaaccccatgggatccgcagaggaa

SEQ ID NO: 548471 - DNA, 25 bp, Homo sapien
ggaagtactggccacttcttcaacc

SEQ ID NO: 548472 - DNA, 25 bp, Homo sapien
gcttcttcgcttctctcttggaaag

SEQ ID NO: 548473 - DNA, 25 bp, Homo sapien
ttcttcgcttctctcttggaaagtc

SEQ ID NO: 548474 - DNA, 25 bp, Homo sapien
ttcgcttctctcttggaaagtccag

SEQ ID NO: 548475 - DNA, 25 bp, Homo sapien
tcgcttctctcttggaaagtccagt

SEQ ID NO: 548476 - DNA, 25 bp, Homo sapien
gcttctctcttggaaagtccagtct

SEQ ID NO: 548477 - DNA, 25 bp, Homo sapien
ttctctcttggaaagtccagtctct

SEQ ID NO: 548478 - DNA, 25 bp, Homo sapien
tctcttggaaagtccagtctctcct

SEQ ID NO: 548479 - DNA, 25 bp, Homo sapien
tcttggaaagtccagtctctcctcg

SEQ ID NO: 548480 - DNA, 25 bp, Homo sapien
ttggaaagtccagtctctcctcggc

SEQ ID NO: 548481 - DNA, 25 bp, Homo sapien
ggaaagtccagtctctcctcggctt

SEQ ID NO: 548482 - DNA, 25 bp, Homo sapien
aaagtccagtctctcctcggcttgc

SEQ ID NO: 548483 - DNA, 25 bp, Homo sapien
attttgtctgcccaatccatcctgc

SEQ ID NO: 548484 - DNA, 25 bp, Homo sapien
tgcccaatccatcctgctcaggaaa

SEQ ID NO: 548485 - DNA, 25 bp, Homo sapien
aatccatcctgctcaggaaaccaca

SEQ ID NO: 548486 - DNA, 25 bp, Homo sapien
tcctgctcaggaaaccacaaccttg

SEQ ID NO: 548487 - DNA, 25 bp, Homo sapien
gaagttaaagttcttgagcttattc

SEQ ID NO: 548488 - DNA, 25 bp, Homo sapien
gcaatctgaatgctactcataacat

SEQ ID NO: 548489 - DNA, 25 bp, Homo sapien
tctgaatgctactcataacataaca

SEQ ID NO: 548490 - DNA, 25 bp, Homo sapien
gtatgttaaacagctcttaaatctt

SEQ ID NO: 548491 - DNA, 25 bp, Homo sapien
aaacagctcttaaatcttactggct

SEQ ID NO: 548492 - DNA, 25 bp, Homo sapien
gctcttaaatcttactggcttacca

SEQ ID NO: 548493 - DNA, 25 bp, Homo sapien
ttaaatcttactggcttaccacatt

SEQ ID NO: 548494 - DNA, 25 bp, Homo sapien
taaagaagctggctctgtaagagtt

SEQ ID NO: 548495 - DNA, 25 bp, Homo sapien
gctggctctgtaagagttgtatatc

SEQ ID NO: 548496 - DNA, 25 bp, Homo sapien
gttgtatatcaaagtaccttttgct

SEQ ID NO: 548497 - DNA, 25 bp, Homo sapien
gtaccttttgctacaaggtgcatat

SEQ ID NO: 548498 - DNA, 25 bp, Homo sapien
gaaatgtaccctctatactttattt

SEQ ID NO: 548499 - DNA, 25 bp, Homo sapien
tttcatgcccctatcatgtttggtg

SEQ ID NO: 548500 - DNA, 25 bp, Homo sapien
cctatcatgtttggtgtgccttaaa

SEQ ID NO: 548501 - DNA, 25 bp, Homo sapien
tggtgtgccttaaatcttaccttta

SEQ ID NO: 548502 - DNA, 25 bp, Homo sapien
gaagttttacactaggaccagatcg

SEQ ID NO: 548503 - DNA, 25 bp, Homo sapien
gaccagatcgtccatacatgattgg

SEQ ID NO: 548504 - DNA, 25 bp, Homo sapien
gtccatacatgattggtcttctaca

SEQ ID NO: 548505 - DNA, 25 bp, Homo sapien
actctggaaagttcaaagagcttac

SEQ ID NO: 548506 - DNA, 25 bp, Homo sapien
aagagcttactgcaattctttccag

SEQ ID NO: 548507 - DNA, 25 bp, Homo sapien
ttactgcaattctttccagcttctc

SEQ ID NO: 548508 - DNA, 25 bp, Homo sapien
gctctttacaggagatttagaacca

SEQ ID NO: 548509 - DNA, 25 bp, Homo sapien
gtatataaactcaaacatgaacctg

SEQ ID NO: 548510 - DNA, 25 bp, Homo sapien
gaacctgatgatgtatatagatgca

SEQ ID NO: 548511 - DNA, 25 bp, Homo sapien
agatgcagatcaaagacctggcttc

SEQ ID NO: 548512 - DNA, 25 bp, Homo sapien
tttctgccagaaagctaactcattt

SEQ ID NO: 548513 - DNA, 25 bp, Homo sapien
gaaagctaactcatttgtatcatga

SEQ ID NO: 548514 - DNA, 25 bp, Homo sapien
gtatcatgaacattgtgctctagac

SEQ ID NO: 548515 - DNA, 25 bp, Homo sapien
attgtgctctagacacagaggagac

SEQ ID NO: 548516 - DNA, 25 bp, Homo sapien
cattgttatcgtggttgctgatggg

SEQ ID NO: 548517 - DNA, 25 bp, Homo sapien
gggtggaaagttgaactccatgtct

SEQ ID NO: 548518 - DNA, 25 bp, Homo sapien
ccatgtctgaggacaagaggtcccg

SEQ ID NO: 548519 - DNA, 25 bp, Homo sapien
ttggactggcctccttgttcatgac

SEQ ID NO: 548520 - DNA, 25 bp, Homo sapien
ttgttcatgaccaagaccaaacctg

SEQ ID NO: 548521 - DNA, 25 bp, Homo sapien
ccaagaccaaacctgggccctggat

SEQ ID NO: 548522 - DNA, 25 bp, Homo sapien
ttggcctgtcccgaggagaaatgag

SEQ ID NO: 548523 - DNA, 25 bp, Homo sapien
gaaatgagaaaatcccagatctctg

SEQ ID NO: 548524 - DNA, 25 bp, Homo sapien
aactccattcccctgtgttcttctg

SEQ ID NO: 548525 - DNA, 25 bp, Homo sapien
gttcttctgtcttctgtagtattta

SEQ ID NO: 548526 - DNA, 25 bp, Homo sapien
cattggtttctgataagtctgtatc

SEQ ID NO: 548527 - DNA, 25 bp, Homo sapien
accgaattcttacaataaagaggat

SEQ ID NO: 548528 - DNA, 25 bp, Homo sapien
aaatggtattgagatcataaggaaa

SEQ ID NO: 548529 - DNA, 25 bp, Homo sapien
agtggaagtggatcaccatgaaagt

SEQ ID NO: 548530 - DNA, 25 bp, Homo sapien
gtggaagtggatcaccatgaaagtt

SEQ ID NO: 548531 - DNA, 25 bp, Homo sapien
ggaagtggatcaccatgaaagtttt

SEQ ID NO: 548532 - DNA, 25 bp, Homo sapien
gaagtggatcaccatgaaagttttc

SEQ ID NO: 548533 - DNA, 25 bp, Homo sapien
aagtggatcaccatgaaagttttca

SEQ ID NO: 548534 - DNA, 25 bp, Homo sapien
agtggatcaccatgaaagttttcat

SEQ ID NO: 548535 - DNA, 25 bp, Homo sapien
atcatcttcatgtttagactgaaga

SEQ ID NO: 548536 - DNA, 25 bp, Homo sapien
gagggattggtcttgtgtcttgggg

SEQ ID NO: 548537 - DNA, 25 bp, Homo sapien
cttaactacttataactactgttat

SEQ ID NO: 548538 - DNA, 25 bp, Homo sapien
ggcaaatacatcattgaactagcac

SEQ ID NO: 548539 - DNA, 25 bp, Homo sapien
gaactagcacacatgatcaaggaca

SEQ ID NO: 548540 - DNA, 25 bp, Homo sapien
atcaaggacaatggctgggactgat

SEQ ID NO: 548541 - DNA, 25 bp, Homo sapien
gggactgattggacagcatctaccc

SEQ ID NO: 548542 - DNA, 25 bp, Homo sapien
cagtgtccacgtgaacgccattcaa

SEQ ID NO: 548543 - DNA, 25 bp, Homo sapien
gaacgccattcaaccgaacattctt

SEQ ID NO: 548544 - DNA, 25 bp, Homo sapien
acattcttcccaagcgtgagagagt

SEQ ID NO: 548545 - DNA, 25 bp, Homo sapien
gagagtgactgacacttggttccat

SEQ ID NO: 548546 - DNA, 25 bp, Homo sapien
gacacttggttccatccatttaggg

SEQ ID NO: 548547 - DNA, 25 bp, Homo sapien
tctttctggtgaccggcctctaaat

SEQ ID NO: 548548 - DNA, 25 bp, Homo sapien
cctctaaatcgctgtctctctgtct

SEQ ID NO: 548549 - DNA, 25 bp, Homo sapien
aggcagcagctcaaattcctttaga

SEQ ID NO: 548550 - DNA, 25 bp, Homo sapien
ttagagtacggtttcttgctcacct

SEQ ID NO: 548551 - DNA, 25 bp, Homo sapien
ttcttgctcacctgtcctgttccag

SEQ ID NO: 548552 - DNA, 25 bp, Homo sapien
cctgttccagatacacacttagctg

SEQ ID NO: 548553 - DNA, 25 bp, Homo sapien
acacttagctgacagtgatctctga

SEQ ID NO: 548554 - DNA, 25 bp, Homo sapien
cagtgatctctgaagaggtgacttt

SEQ ID NO: 548555 - DNA, 25 bp, Homo sapien
aggtgactttgaatttgctcttaca

SEQ ID NO: 548556 - DNA, 25 bp, Homo sapien
ttgctcttacaatatctaaacgaga

SEQ ID NO: 548557 - DNA, 25 bp, Homo sapien
gaataatctggtgcatacagagaat

SEQ ID NO: 548558 - DNA, 25 bp, Homo sapien
gaatttcggaaaacctattgtaatg

SEQ ID NO: 548559 - DNA, 25 bp, Homo sapien
gacagtcaaattaagttccttagtt

SEQ ID NO: 548560 - DNA, 25 bp, Homo sapien
caagaaactgcacgaaatctctccc

SEQ ID NO: 548561 - DNA, 25 bp, Homo sapien
cacccacttgggaaaggaacgagca

SEQ ID NO: 548562 - DNA, 25 bp, Homo sapien
ggaacgagcaaacatccctctaaga

SEQ ID NO: 548563 - DNA, 25 bp, Homo sapien
gaaagaaacctacacttgaatgatt

SEQ ID NO: 548564 - DNA, 25 bp, Homo sapien
atagcttcacatcagaactcagact

SEQ ID NO: 548565 - DNA, 25 bp, Homo sapien
ctggcgcttgccagatttcaagaaa

SEQ ID NO: 548566 - DNA, 25 bp, Homo sapien
tcagaactcagactaaccttgtggt

SEQ ID NO: 548567 - DNA, 25 bp, Homo sapien
aaccttgtggtttcaacgcgcactc

SEQ ID NO: 548568 - DNA, 25 bp, Homo sapien
actctgctctgtcctgaaatctgga

SEQ ID NO: 548569 - DNA, 25 bp, Homo sapien
gctctgtcctgaaatctggaactca

SEQ ID NO: 548570 - DNA, 25 bp, Homo sapien
ttacctcatcaccaagaaactgcac

SEQ ID NO: 548571 - DNA, 25 bp, Homo sapien
ttaagtttctactatgtgctgtgta

SEQ ID NO: 548572 - DNA, 25 bp, Homo sapien
tatgtgctgtgtattggtactataa

SEQ ID NO: 548573 - DNA, 25 bp, Homo sapien
gtgctgtgtattggtactataaata

SEQ ID NO: 548574 - DNA, 25 bp, Homo sapien
tttaccatgtgttctggggcgcatg

SEQ ID NO: 548575 - DNA, 25 bp, Homo sapien
gggcgcatgttaggctggatcacaa

SEQ ID NO: 548576 - DNA, 25 bp, Homo sapien
gctggatcacaaatcaagtctcaag

SEQ ID NO: 548577 - DNA, 25 bp, Homo sapien
tggatcacaaatcaagtctcaagaa

SEQ ID NO: 548578 - DNA, 25 bp, Homo sapien
tagagtatgaattaaaccagaaatc

SEQ ID NO: 548579 - DNA, 25 bp, Homo sapien
tgcattaatttaaggaacatacacc

SEQ ID NO: 548580 - DNA, 25 bp, Homo sapien
aaggaacatacacctcatgacccat

SEQ ID NO: 548581 - DNA, 25 bp, Homo sapien
gaacatacacctcatgacccatgag

SEQ ID NO: 548582 - DNA, 25 bp, Homo sapien
aaaagactttcttctcatccagtaa

SEQ ID NO: 548583 - DNA, 25 bp, Homo sapien
ttcttctcatccagtaatttgggct

SEQ ID NO: 548584 - DNA, 25 bp, Homo sapien
aagtcagggaagtcattgggaacat

SEQ ID NO: 548585 - DNA, 25 bp, Homo sapien
gaacatggatgaggttgtaagcatt

SEQ ID NO: 548586 - DNA, 25 bp, Homo sapien
gtaagcattggtacagtgtcctgtt

SEQ ID NO: 548587 - DNA, 25 bp, Homo sapien
ggacttttgaccctagagtagccct

SEQ ID NO: 548588 - DNA, 25 bp, Homo sapien
gaccctagagtagccctggtgttat

SEQ ID NO: 548589 - DNA, 25 bp, Homo sapien
gtagccctggtgttatattttagat

SEQ ID NO: 548590 - DNA, 25 bp, Homo sapien
gatatcccaagctatatcagacttt

SEQ ID NO: 548591 - DNA, 25 bp, Homo sapien
gactttacctgaatatactggagtt

SEQ ID NO: 548592 - DNA, 25 bp, Homo sapien
agttacttattatcccccattctat

SEQ ID NO: 548593 - DNA, 25 bp, Homo sapien
tccccgtagaatctagtgtatcagt

SEQ ID NO: 548594 - DNA, 25 bp, Homo sapien
tatcagtagctttccccagttctcc

SEQ ID NO: 548595 - DNA, 25 bp, Homo sapien
tccccagttctccaatggcagtata

SEQ ID NO: 548596 - DNA, 25 bp, Homo sapien
aatggcagtatatctcttggaccct

SEQ ID NO: 548597 - DNA, 25 bp, Homo sapien
gcagtatatctcttggaccctgaca

SEQ ID NO: 548598 - DNA, 25 bp, Homo sapien
gaccctgacaacatactggtcaaca

SEQ ID NO: 548599 - DNA, 25 bp, Homo sapien
ttttgttccgcttccaattccaaca

SEQ ID NO: 548600 - DNA, 25 bp, Homo sapien
aattccaacaaccagaactcctcgg

SEQ ID NO: 548601 - DNA, 25 bp, Homo sapien
tgcgctgtctagagtccctccatgc

SEQ ID NO: 548602 - DNA, 25 bp, Homo sapien
agggggggcacttgcattatatttc

SEQ ID NO: 548603 - DNA, 25 bp, Homo sapien
atatttccagtaaatttctgtagaa

SEQ ID NO: 548604 - DNA, 25 bp, Homo sapien
gtaactgtagaacctgccagcctcc

SEQ ID NO: 548605 - DNA, 25 bp, Homo sapien
gtgcccatatggcttcggctgatga

SEQ ID NO: 548606 - DNA, 25 bp, Homo sapien
tatggcttcggctgatgagggctca

SEQ ID NO: 548607 - DNA, 25 bp, Homo sapien
gatgagggctcagactctaggttgc

SEQ ID NO: 548608 - DNA, 25 bp, Homo sapien
ttgccctgaagatcaaggctttgtc

SEQ ID NO: 548609 - DNA, 25 bp, Homo sapien
tgaagatcaaggctttgtctcccat

SEQ ID NO: 548610 - DNA, 25 bp, Homo sapien
attctgcccattcctgggtttcttc

SEQ ID NO: 548611 - DNA, 25 bp, Homo sapien
cattcctgggtttcttcccaaaatg

SEQ ID NO: 548612 - DNA, 25 bp, Homo sapien
gccagtcatggcacaagggccagga

SEQ ID NO: 548613 - DNA, 25 bp, Homo sapien
gagctagtgattcttagaggccttc

SEQ ID NO: 548614 - DNA, 25 bp, Homo sapien
agctgaaatctcagcgcccgggttt

SEQ ID NO: 548615 - DNA, 25 bp, Homo sapien
tagctgccttgtcaacatcttcgag

SEQ ID NO: 548616 - DNA, 25 bp, Homo sapien
tcaacatcttcgagcatcggcagct

SEQ ID NO: 548617 - DNA, 25 bp, Homo sapien
gtgaaagaatctcctgatgtcataa

SEQ ID NO: 548618 - DNA, 25 bp, Homo sapien
gatgtcataatttccgggtgtcacc

SEQ ID NO: 548619 - DNA, 25 bp, Homo sapien
gggtgtcaccggaacatttgatcat

SEQ ID NO: 548620 - DNA, 25 bp, Homo sapien
tcatcattcctttggcaattccagc

SEQ ID NO: 548621 - DNA, 25 bp, Homo sapien
aaagcattgatttattcacctctac

SEQ ID NO: 548622 - DNA, 25 bp, Homo sapien
acaggaatcagactcagcctctttt

SEQ ID NO: 548623 - DNA, 25 bp, Homo sapien
ctcagcctcttttggttttcagtga

SEQ ID NO: 548624 - DNA, 25 bp, Homo sapien
gtatgccttttcaatttggaaccca

SEQ ID NO: 548625 - DNA, 25 bp, Homo sapien
gaacccagccaaggaggtttccagt

SEQ ID NO: 548626 - DNA, 25 bp, Homo sapien
ggattatatcctaaaccaatgccaa

SEQ ID NO: 548627 - DNA, 25 bp, Homo sapien
cagttgttcttttggtgttagctta

SEQ ID NO: 548628 - DNA, 25 bp, Homo sapien
gtgttagcttacctgtcttcatcta

SEQ ID NO: 548629 - DNA, 25 bp, Homo sapien
tacaagagactttgcttcgccctct

SEQ ID NO: 548630 - DNA, 25 bp, Homo sapien
gtcttcatctaacaataccaactta

SEQ ID NO: 548631 - DNA, 25 bp, Homo sapien
ggtctgtaggtttttgacttgctaa

SEQ ID NO: 548632 - DNA, 25 bp, Homo sapien
ttcgccctcttgaagctttatgctc

SEQ ID NO: 548633 - DNA, 25 bp, Homo sapien
gaagctttatgctctttccagattt

SEQ ID NO: 548634 - DNA, 25 bp, Homo sapien
tccagatttagcatggtgcccaaat

SEQ ID NO: 548635 - DNA, 25 bp, Homo sapien
atggtgcccaaattggccccagcaa

SEQ ID NO: 548636 - DNA, 25 bp, Homo sapien
agcaagcaacgccttctgaaaaaat

SEQ ID NO: 548637 - DNA, 25 bp, Homo sapien
aggcctggtgtctctagactcatta

SEQ ID NO: 548638 - DNA, 25 bp, Homo sapien
aacccctatgttagttcatctcgag

SEQ ID NO: 548639 - DNA, 25 bp, Homo sapien
agttcatctcgagccacatttttat

SEQ ID NO: 548640 - DNA, 25 bp, Homo sapien
tattgccataatccaggcctggaca

SEQ ID NO: 548641 - DNA, 25 bp, Homo sapien
gcctggacaggccaagatcttttaa

SEQ ID NO: 548642 - DNA, 25 bp, Homo sapien
aaatacagtctttgtgttgccatct

SEQ ID NO: 548643 - DNA, 25 bp, Homo sapien
gttgccatctgggaactggatttgg

SEQ ID NO: 548644 - DNA, 25 bp, Homo sapien
gaattgttcttccatgagactgcag

SEQ ID NO: 548645 - DNA, 25 bp, Homo sapien
aacggcagggccagaggtcccacga

SEQ ID NO: 548646 - DNA, 25 bp, Homo sapien
cagaggtcccacgagctggtcagac

SEQ ID NO: 548647 - DNA, 25 bp, Homo sapien
acgagctggtcagacccggttctgc

SEQ ID NO: 548648 - DNA, 25 bp, Homo sapien
tgatatccgggactcctatgagttg

SEQ ID NO: 548649 - DNA, 25 bp, Homo sapien
atccgggactcctatgagttggtca

SEQ ID NO: 548650 - DNA, 25 bp, Homo sapien
ggactcctatgagttggtcaaccac

SEQ ID NO: 548651 - DNA, 25 bp, Homo sapien
tatgagttggtcaaccacgccaagg

SEQ ID NO: 548652 - DNA, 25 bp, Homo sapien
agttggtcaaccacgccaagggact

SEQ ID NO: 548653 - DNA, 25 bp, Homo sapien
aagggactgccagactcctttcaca

SEQ ID NO: 548654 - DNA, 25 bp, Homo sapien
actcctttcacaagccagcttctga

SEQ ID NO: 548655 - DNA, 25 bp, Homo sapien
accatggacactacaggccctggaa

SEQ ID NO: 548656 - DNA, 25 bp, Homo sapien
atggacactacaggccctggaatgg

SEQ ID NO: 548657 - DNA, 25 bp, Homo sapien
ctggaatggccagggtggaccaaaa

SEQ ID NO: 548658 - DNA, 25 bp, Homo sapien
agggtggaccaaaagccatgccagc

SEQ ID NO: 548659 - DNA, 25 bp, Homo sapien
ctgtgaaacagaggtttgcctctct

SEQ ID NO: 548660 - DNA, 25 bp, Homo sapien
aggtttgcctctctttcctgagaac

SEQ ID NO: 548661 - DNA, 25 bp, Homo sapien
ctttcctgagaaccagaatgagtca

SEQ ID NO: 548662 - DNA, 25 bp, Homo sapien
gaatgagtcagaagcccagtacaca

SEQ ID NO: 548663 - DNA, 25 bp, Homo sapien
gaagcccagtacacatgggaacagt

SEQ ID NO: 548664 - DNA, 25 bp, Homo sapien
ttctctcccagataacaatctgagc

SEQ ID NO: 548665 - DNA, 25 bp, Homo sapien
tattgagtcaaacttcaggcagcat

SEQ ID NO: 548666 - DNA, 25 bp, Homo sapien
tcaggcagcatttgatgtaccctag

SEQ ID NO: 548667 - DNA, 25 bp, Homo sapien
ttgatgtaccctagccttggaaaag

SEQ ID NO: 548668 - DNA, 25 bp, Homo sapien
ttggaaaagggctaaaactgcattt

SEQ ID NO: 548669 - DNA, 25 bp, Homo sapien
atgtgaattatcatctttctatgtc

SEQ ID NO: 548670 - DNA, 25 bp, Homo sapien
aaggtcatcgcgcagcatcagaacc

SEQ ID NO: 548671 - DNA, 25 bp, Homo sapien
tacgcgctcctgagcaacgacaatg

SEQ ID NO: 548672 - DNA, 25 bp, Homo sapien
tgagcaacgacaatgccttcctgag

SEQ ID NO: 548673 - DNA, 25 bp, Homo sapien
acgacaatgccttcctgagctacca

SEQ ID NO: 548674 - DNA, 25 bp, Homo sapien
cgccgcacgtgcagctgttgcgcaa

SEQ ID NO: 548675 - DNA, 25 bp, Homo sapien
agctgttgcgcaagccggtgctcac

SEQ ID NO: 548676 - DNA, 25 bp, Homo sapien
tgcgcaagccggtgctcacggccat

SEQ ID NO: 548677 - DNA, 25 bp, Homo sapien
gaggagcagctctgggccgaagtgt

SEQ ID NO: 548678 - DNA, 25 bp, Homo sapien
aggccgggaccgtcctggacagcaa

SEQ ID NO: 548679 - DNA, 25 bp, Homo sapien
gtcctggacagcaaccacacggtgg

SEQ ID NO: 548680 - DNA, 25 bp, Homo sapien
agcaaccacacggtgggcgtcctgg

SEQ ID NO: 548681 - DNA, 25 bp, Homo sapien
acggccgaggtggtagacatctact

SEQ ID NO: 548682 - DNA, 25 bp, Homo sapien
gacatctactacgagggcgaccagg

SEQ ID NO: 548683 - DNA, 25 bp, Homo sapien
gagctgcaggacttcgtgaacgatg

SEQ ID NO: 548684 - DNA, 25 bp, Homo sapien
tgaacgatgtctacgtgtacggcat

SEQ ID NO: 548685 - DNA, 25 bp, Homo sapien
tcaggcttccccaagtcggtcaaga

SEQ ID NO: 548686 - DNA, 25 bp, Homo sapien
ccaagtcggtcaagagccgggagca

SEQ ID NO: 548687 - DNA, 25 bp, Homo sapien
gagcagctgtcggagtacctgaccg

SEQ ID NO: 548688 - DNA, 25 bp, Homo sapien
agtacctgaccgtggtgatcttcac

SEQ ID NO: 548689 - DNA, 25 bp, Homo sapien
aacttcggccagtacgactggtgct

SEQ ID NO: 548690 - DNA, 25 bp, Homo sapien
tggtgctcctggatccccaatgcgc

SEQ ID NO: 548691 - DNA, 25 bp, Homo sapien
ccaccgactgccaagggcgtggtga

SEQ ID NO: 548692 - DNA, 25 bp, Homo sapien
caggaagtgcccagcccgagaggct

SEQ ID NO: 548693 - DNA, 25 bp, Homo sapien
tcccctctgggaattgggcagccct

SEQ ID NO: 548694 - DNA, 25 bp, Homo sapien
ccctctgggaattgggcagccctgg

SEQ ID NO: 548695 - DNA, 25 bp, Homo sapien
gcagccctgggcagttgtactcatg

SEQ ID NO: 548696 - DNA, 25 bp, Homo sapien
gggcttaagatgcagctacctcagt

SEQ ID NO: 548697 - DNA, 25 bp, Homo sapien
gatgcagctacctcagtgcgcaggg

SEQ ID NO: 548698 - DNA, 25 bp, Homo sapien
agtgcgcagggcccgtctgtcctct

SEQ ID NO: 548699 - DNA, 25 bp, Homo sapien
gggcgagtagagacttccccagcct

SEQ ID NO: 548700 - DNA, 25 bp, Homo sapien
acttccccagcctggacgggcgtgg

SEQ ID NO: 548701 - DNA, 25 bp, Homo sapien
tgggttctgggtcagcttcttttac

SEQ ID NO: 548702 - DNA, 25 bp, Homo sapien
ggtcagcttcttttacctcaatttt

SEQ ID NO: 548703 - DNA, 25 bp, Homo sapien
aggagtatagcgattgtaacaagac

SEQ ID NO: 548704 - DNA, 25 bp, Homo sapien
gattgtaacaagacttcttgccatg

SEQ ID NO: 548705 - DNA, 25 bp, Homo sapien
gacttcttgccatggttatttggag

SEQ ID NO: 548706 - DNA, 25 bp, Homo sapien
tgccatggttatttggagctattaa

SEQ ID NO: 548707 - DNA, 25 bp, Homo sapien
aataactgctaaggtcctattttga

SEQ ID NO: 548708 - DNA, 25 bp, Homo sapien
gagctattaagattaactgcctttt

SEQ ID NO: 548709 - DNA, 25 bp, Homo sapien
agtttgtggctacattcctttttct

SEQ ID NO: 548710 - DNA, 25 bp, Homo sapien
gctaaggtcctattttgaatttgaa

SEQ ID NO: 548711 - DNA, 25 bp, Homo sapien
tttttctactgcaagaatgtttgct

SEQ ID NO: 548712 - DNA, 25 bp, Homo sapien
gaatgtttgctctcctttatgaaaa

SEQ ID NO: 548713 - DNA, 25 bp, Homo sapien
tgctctcctttatgaaaagttcaag

SEQ ID NO: 548714 - DNA, 25 bp, Homo sapien
gctgtctctgtgtggtcctacaaaa

SEQ ID NO: 548715 - DNA, 25 bp, Homo sapien
gtcctacaaaaactgtccattccca

SEQ ID NO: 548716 - DNA, 25 bp, Homo sapien
acccctttgctttgccatttgcaag

SEQ ID NO: 548717 - DNA, 25 bp, Homo sapien
ttgccatttgcaagagtctggaatt

SEQ ID NO: 548718 - DNA, 25 bp, Homo sapien
ggaattgtcaggtctcagcttcgaa

SEQ ID NO: 548719 - DNA, 25 bp, Homo sapien
agcttcgaaaagtcctggttccact

SEQ ID NO: 548720 - DNA, 25 bp, Homo sapien
tggttccactgacaggacacattct

SEQ ID NO: 548721 - DNA, 25 bp, Homo sapien
gacaggacacattctttagtgggaa

SEQ ID NO: 548722 - DNA, 25 bp, Homo sapien
gctgtgaacagcattagaactttgt

SEQ ID NO: 548723 - DNA, 25 bp, Homo sapien
gctgatatgccttaaactgtagttg

SEQ ID NO: 548724 - DNA, 25 bp, Homo sapien
gttgtagatccttgtcattttgctg

SEQ ID NO: 548725 - DNA, 25 bp, Homo sapien
aggaagtgcccagcccgagaggctg

SEQ ID NO: 548726 - DNA, 25 bp, Homo sapien
aggctgggaggtttgttgagggtgt

SEQ ID NO: 548727 - DNA, 25 bp, Homo sapien
ggggtgtgccccacctgaagccggg

SEQ ID NO: 548728 - DNA, 25 bp, Homo sapien
gtgtgccccacctgaagccggggct

SEQ ID NO: 548729 - DNA, 25 bp, Homo sapien
ctcctcccctctgggaattgggcag

SEQ ID NO: 548730 - DNA, 25 bp, Homo sapien
tcctcccctctgggaattgggcagc

SEQ ID NO: 548731 - DNA, 25 bp, Homo sapien
gcagggcccgtctgtcctctggggg

SEQ ID NO: 548732 - DNA, 25 bp, Homo sapien
gctgcttcgggcccgcggtgctcgg

SEQ ID NO: 548733 - DNA, 25 bp, Homo sapien
tggtgtggggcgagtagagacttcc

SEQ ID NO: 548734 - DNA, 25 bp, Homo sapien
gggcgtgggttctgggtcagcttct

SEQ ID NO: 548735 - DNA, 25 bp, Homo sapien
ggtcagcttcttttacctcaatttt

SEQ ID NO: 548736 - DNA, 25 bp, Homo sapien
aaccccaataacagcattctcacaa

SEQ ID NO: 548737 - DNA, 25 bp, Homo sapien
aacagcattctcacaataataacaa

SEQ ID NO: 548738 - DNA, 25 bp, Homo sapien
aaccaaacagctgaatgtacatatt

SEQ ID NO: 548739 - DNA, 25 bp, Homo sapien
ttttggaattccatctatgttccct

SEQ ID NO: 548740 - DNA, 25 bp, Homo sapien
tatgttccctttcaatttagcaaaa

SEQ ID NO: 548741 - DNA, 25 bp, Homo sapien
atgctacattaccatttaaacagat

SEQ ID NO: 548742 - DNA, 25 bp, Homo sapien
gcatattggaacctattgcacaaaa

SEQ ID NO: 548743 - DNA, 25 bp, Homo sapien
ggaacctattgcacaaaagcataaa

SEQ ID NO: 548744 - DNA, 25 bp, Homo sapien
aaaaatgctcttcatccacataaaa

SEQ ID NO: 548745 - DNA, 25 bp, Homo sapien
gaagcttgcaaaacatctcacaatt

SEQ ID NO: 548746 - DNA, 25 bp, Homo sapien
acaatttcattttatatgcctgtaa

SEQ ID NO: 548747 - DNA, 25 bp, Homo sapien
aagggcggttatttgcactgggcac

SEQ ID NO: 548748 - DNA, 25 bp, Homo sapien
ggttatttgcactgggcacccagga

SEQ ID NO: 548749 - DNA, 25 bp, Homo sapien
gggccactggtgctaagttcaccaa

SEQ ID NO: 548750 - DNA, 25 bp, Homo sapien
attaatgtacttagagtgcccaact

SEQ ID NO: 548751 - DNA, 25 bp, Homo sapien
gagtgcccaacttattgtcagcaat

SEQ ID NO: 548752 - DNA, 25 bp, Homo sapien
gtcagcaataatttactcactggca

SEQ ID NO: 548753 - DNA, 25 bp, Homo sapien
tttactcactggcaagatcggactg

SEQ ID NO: 548754 - DNA, 25 bp, Homo sapien
ggcaagatcggactgaataattcat

SEQ ID NO: 548755 - DNA, 25 bp, Homo sapien
gagaatactcatgattgctggttgt

SEQ ID NO: 548756 - DNA, 25 bp, Homo sapien
catgattgctggttgttagttggtt

SEQ ID NO: 548757 - DNA, 25 bp, Homo sapien
tttgtaccccaaattaagtcgcata

SEQ ID NO: 548758 - DNA, 25 bp, Homo sapien
gcacgtattgctttataactttggt

SEQ ID NO: 548759 - DNA, 25 bp, Homo sapien
ttggttgttgggagtatggctatca

SEQ ID NO: 548760 - DNA, 25 bp, Homo sapien
atggctatcatataccctcatcagt

SEQ ID NO: 548761 - DNA, 25 bp, Homo sapien
tatcatataccctcatcagtgtcat

SEQ ID NO: 548762 - DNA, 25 bp, Homo sapien
tttccccattttatcctccgcaaat

SEQ ID NO: 548763 - DNA, 25 bp, Homo sapien
ttatcctccgcaaatatctttctct

SEQ ID NO: 548764 - DNA, 25 bp, Homo sapien
atatctttctcttgcccattcagtg

SEQ ID NO: 548765 - DNA, 25 bp, Homo sapien
ctgcttttggtttttgatttagttg

SEQ ID NO: 548766 - DNA, 25 bp, Homo sapien
ggatgtatttccacagccttttatt

SEQ ID NO: 548767 - DNA, 25 bp, Homo sapien
ttccacagccttttattgttcttcc

SEQ ID NO: 548768 - DNA, 25 bp, Homo sapien
tattgttcttcctggacaaaaagac

SEQ ID NO: 548769 - DNA, 25 bp, Homo sapien
ccctctgccatacctaatttgcata

SEQ ID NO: 548770 - DNA, 25 bp, Homo sapien
atttgcataattgtcctaaggctca

SEQ ID NO: 548771 - DNA, 25 bp, Homo sapien
ttgtcctaaggctcaaattgcataa

SEQ ID NO: 548772 - DNA, 25 bp, Homo sapien
ataccatgtaattacaccaggttac

SEQ ID NO: 548773 - DNA, 25 bp, Homo sapien
gaaaatctgggctctaacagtccaa

SEQ ID NO: 548774 - DNA, 25 bp, Homo sapien
agctgtattttttatcattatcata

SEQ ID NO: 548775 - DNA, 25 bp, Homo sapien
gacaaccacttatttcagctttatt

SEQ ID NO: 548776 - DNA, 25 bp, Homo sapien
cagctttattctattccttgatgat

SEQ ID NO: 548777 - DNA, 25 bp, Homo sapien
attctattccttgatgatgatctac

SEQ ID NO: 548778 - DNA, 25 bp, Homo sapien
aactgtggtcaaagcccttcatgta

SEQ ID NO: 548779 - DNA, 25 bp, Homo sapien
aagcccttcatgtaccttgacctca

SEQ ID NO: 548780 - DNA, 25 bp, Homo sapien
gcccacataggcgaggttgagctgc

SEQ ID NO: 548781 - DNA, 25 bp, Homo sapien
cccacataggcgaggttgagctgct

SEQ ID NO: 548782 - DNA, 25 bp, Homo sapien
ccacataggcgaggttgagctgctg

SEQ ID NO: 548783 - DNA, 25 bp, Homo sapien
aggttgagctgctggtcccagctga

SEQ ID NO: 548784 - DNA, 25 bp, Homo sapien
ctgctggtcccagctgaggacgtac

SEQ ID NO: 548785 - DNA, 25 bp, Homo sapien
gctggtcccagctgaggacgtactg

SEQ ID NO: 548786 - DNA, 25 bp, Homo sapien
tgaggacgtactggtcagcctggct

SEQ ID NO: 548787 - DNA, 25 bp, Homo sapien
aggacgtactggtcagcctggctgt

SEQ ID NO: 548788 - DNA, 25 bp, Homo sapien
gggcagaagcctgtgctcctccaga

SEQ ID NO: 548789 - DNA, 25 bp, Homo sapien
gtgctcctccagaagcgccgcaggg

SEQ ID NO: 548790 - DNA, 25 bp, Homo sapien
gactgcggggcttcgggctgcactg

SEQ ID NO: 548791 - DNA, 25 bp, Homo sapien
ttttcccttctctattctttcacca

SEQ ID NO: 548792 - DNA, 25 bp, Homo sapien
tattctttcaccagaagccctcatt

SEQ ID NO: 548793 - DNA, 25 bp, Homo sapien
agaagccctcatttgaccagtgaac

SEQ ID NO: 548794 - DNA, 25 bp, Homo sapien
atttgaccagtgaactcctaggccc

SEQ ID NO: 548795 - DNA, 25 bp, Homo sapien
ttgacccgcacattagctgggcgat

SEQ ID NO: 548796 - DNA, 25 bp, Homo sapien
gatttccttgttctgctaattccta

SEQ ID NO: 548797 - DNA, 25 bp, Homo sapien
tgttctgctaattcctaattctgct

SEQ ID NO: 548798 - DNA, 25 bp, Homo sapien
tttttgaacacttatgatgccaggc

SEQ ID NO: 548799 - DNA, 25 bp, Homo sapien
gcactgtaatgcttgaaacccgatc

SEQ ID NO: 548800 - DNA, 25 bp, Homo sapien
aacccgatctttccctagagaatgt

SEQ ID NO: 548801 - DNA, 25 bp, Homo sapien
catttaatcacttcattatgccggg

SEQ ID NO: 548802 - DNA, 25 bp, Homo sapien
ttatagatacttctaataactttcc

SEQ ID NO: 548803 - DNA, 25 bp, Homo sapien
actttccttatatctatgactggat

SEQ ID NO: 548804 - DNA, 25 bp, Homo sapien
atatctatgactggatctataactc

SEQ ID NO: 548805 - DNA, 25 bp, Homo sapien
gactggatctataactccaagtatt

SEQ ID NO: 548806 - DNA, 25 bp, Homo sapien
aactccaagtattatctgtgtctct

SEQ ID NO: 548807 - DNA, 25 bp, Homo sapien
ccaagtattatctgtgtctcttctc

SEQ ID NO: 548808 - DNA, 25 bp, Homo sapien
tcttctctcaaattttttgtcactg

SEQ ID NO: 548809 - DNA, 25 bp, Homo sapien
gtcactgataaaatagggaatggct

SEQ ID NO: 548810 - DNA, 25 bp, Homo sapien
agggaatggctaatatatacagtat

SEQ ID NO: 548811 - DNA, 25 bp, Homo sapien
tatcaacttcaggttaatcaagaga

SEQ ID NO: 548812 - DNA, 25 bp, Homo sapien
cataggtattgaaaaatccaactgt

SEQ ID NO: 548813 - DNA, 25 bp, Homo sapien
aaagttctgctagagttagtcttga

SEQ ID NO: 548814 - DNA, 25 bp, Homo sapien
tacaaatagatgagcaatccctgtg

SEQ ID NO: 548815 - DNA, 25 bp, Homo sapien
caatccctgtggaatgctgcctgga

SEQ ID NO: 548816 - DNA, 25 bp, Homo sapien
gaatgctgcctggatattttcagaa

SEQ ID NO: 548817 - DNA, 25 bp, Homo sapien
accgtgaatatcgtgtgtggcctta

SEQ ID NO: 548818 - DNA, 25 bp, Homo sapien
tcgtgtgtggccttaaccaaggaac

SEQ ID NO: 548819 - DNA, 25 bp, Homo sapien
agccctttagaacttagcttcctca

SEQ ID NO: 548820 - DNA, 25 bp, Homo sapien
ggagctgggactgactgcatttgcc

SEQ ID NO: 548821 - DNA, 25 bp, Homo sapien
gcatttgccctttgtataaacccac

SEQ ID NO: 548822 - DNA, 25 bp, Homo sapien
caccccatagggttcactgggagca

SEQ ID NO: 548823 - DNA, 25 bp, Homo sapien
agggttcactgggagcataaagcaa

SEQ ID NO: 548824 - DNA, 25 bp, Homo sapien
agtgtccccagttctcagatctctg

SEQ ID NO: 548825 - DNA, 25 bp, Homo sapien
cagatctctggtttatgagtgacgc

SEQ ID NO: 548826 - DNA, 25 bp, Homo sapien
tggtttatgagtgacgctgcagcct

SEQ ID NO: 548827 - DNA, 25 bp, Homo sapien
ttatgagtgacgctgcagcctctct

SEQ ID NO: 548828 - DNA, 25 bp, Homo sapien
atgagtgacgctgcagcctctctct

SEQ ID NO: 548829 - DNA, 25 bp, Homo sapien
cctctctctgatgagctgcaggctg

SEQ ID NO: 548830 - DNA, 25 bp, Homo sapien
gggactgactcctcggcaggtctgc

SEQ ID NO: 548831 - DNA, 25 bp, Homo sapien
tgactcctcggcaggtctgcagtgg

SEQ ID NO: 548832 - DNA, 25 bp, Homo sapien
tctgcagtgggaacctgtggagaca

SEQ ID NO: 548833 - DNA, 25 bp, Homo sapien
gagacaaaagtgactccatcttgga

SEQ ID NO: 548834 - DNA, 25 bp, Homo sapien
atcttggatgccactcccctgtgtt

SEQ ID NO: 548835 - DNA, 25 bp, Homo sapien
tttgtacttctctctgcttctaacc

SEQ ID NO: 548836 - DNA, 25 bp, Homo sapien
taaccactgaggctctctaatcttc

SEQ ID NO: 548837 - DNA, 25 bp, Homo sapien
aatcttcctctggagttttagtgaa

SEQ ID NO: 548838 - DNA, 25 bp, Homo sapien
aaaggatttattgagcagcttctgg

SEQ ID NO: 548839 - DNA, 25 bp, Homo sapien
gcttctggaatataatgtgcatgtc

SEQ ID NO: 548840 - DNA, 25 bp, Homo sapien
atgtccaaaatgaactcagcgcttc

SEQ ID NO: 548841 - DNA, 25 bp, Homo sapien
gctgatgctgtgattttgagctgtg

SEQ ID NO: 548842 - DNA, 25 bp, Homo sapien
gagctgtggttacatgcagtcagta

SEQ ID NO: 548843 - DNA, 25 bp, Homo sapien
aaacctgtgagactgctggaggaaa

SEQ ID NO: 548844 - DNA, 25 bp, Homo sapien
cagcagctactttgggtcatgtctt

SEQ ID NO: 548845 - DNA, 25 bp, Homo sapien
gctactttgggtcatgtctttactg

SEQ ID NO: 548846 - DNA, 25 bp, Homo sapien
tgcatagttaagtaaatcaccccaa

SEQ ID NO: 548847 - DNA, 25 bp, Homo sapien
gcatagttaagtaaatcaccccaat

SEQ ID NO: 548848 - DNA, 25 bp, Homo sapien
catagttaagtaaatcaccccaatt

SEQ ID NO: 548849 - DNA, 25 bp, Homo sapien
cttttctttcatgtaatcttgtcag

SEQ ID NO: 548850 - DNA, 25 bp, Homo sapien
ttttctttcatgtaatcttgtcagt

SEQ ID NO: 548851 - DNA, 25 bp, Homo sapien
ttctttcatgtaatcttgtcagtag

SEQ ID NO: 548852 - DNA, 25 bp, Homo sapien
ctttcatgtaatcttgtcagtagac

SEQ ID NO: 548853 - DNA, 25 bp, Homo sapien
ttcatgtaatcttgtcagtagacaa

SEQ ID NO: 548854 - DNA, 25 bp, Homo sapien
tcttgtcagtagacaaatgatggtg

SEQ ID NO: 548855 - DNA, 25 bp, Homo sapien
aatgatggtgactatattctgtaat

SEQ ID NO: 548856 - DNA, 25 bp, Homo sapien
tgatggtgactatattctgtaataa

SEQ ID NO: 548857 - DNA, 25 bp, Homo sapien
atgtccacataaccgaggaagctct

SEQ ID NO: 548858 - DNA, 25 bp, Homo sapien
ccctggtcagccatgaatgaatagc

SEQ ID NO: 548859 - DNA, 25 bp, Homo sapien
gtcagccatgaatgaatagctctag

SEQ ID NO: 548860 - DNA, 25 bp, Homo sapien
atagctctaggactatagctgtgtc

SEQ ID NO: 548861 - DNA, 25 bp, Homo sapien
tatagctgtgtccatctcccagaag

SEQ ID NO: 548862 - DNA, 25 bp, Homo sapien
tcatcaatcaccatctggccgagaa

SEQ ID NO: 548863 - DNA, 25 bp, Homo sapien
caatcaccatctggccgagaacttg

SEQ ID NO: 548864 - DNA, 25 bp, Homo sapien
tggccgagaacttgcttcaaatact

SEQ ID NO: 548865 - DNA, 25 bp, Homo sapien
gagaacttgcttcaaatactggaaa

SEQ ID NO: 548866 - DNA, 25 bp, Homo sapien
atactggaaatcagcgtagtcgcca

SEQ ID NO: 548867 - DNA, 25 bp, Homo sapien
aaatcagcgtagtcgccagaggcac

SEQ ID NO: 548868 - DNA, 25 bp, Homo sapien
aacttcatgaaggagcaacccaaca

SEQ ID NO: 548869 - DNA, 25 bp, Homo sapien
ggagcaacccaacaaaagggctgaa

SEQ ID NO: 548870 - DNA, 25 bp, Homo sapien
gaagagcacagaaaagccatggaaa

SEQ ID NO: 548871 - DNA, 25 bp, Homo sapien
gagaaggacctagcgaaattttcaa

SEQ ID NO: 548872 - DNA, 25 bp, Homo sapien
gaacttgaaccacaacaatcacaaa

SEQ ID NO: 548873 - DNA, 25 bp, Homo sapien
gaagatgttcacctctctcctgaaa

SEQ ID NO: 548874 - DNA, 25 bp, Homo sapien
ctgaaaactattcccaccagaccgt

SEQ ID NO: 548875 - DNA, 25 bp, Homo sapien
cgtttagcctctgcttcaagcttag

SEQ ID NO: 548876 - DNA, 25 bp, Homo sapien
gcttagcaatatattcagtggcact

SEQ ID NO: 548877 - DNA, 25 bp, Homo sapien
ttcagtggcactcttatatcagaag

SEQ ID NO: 548878 - DNA, 25 bp, Homo sapien
gtttctactggcattctgattggat

SEQ ID NO: 548879 - DNA, 25 bp, Homo sapien
taggttttagaatagagctgacatt

SEQ ID NO: 548880 - DNA, 25 bp, Homo sapien
agagctgacattaacatatatatat

SEQ ID NO: 548881 - DNA, 25 bp, Homo sapien
ttgtaatatgagccagaattctttt

SEQ ID NO: 548882 - DNA, 25 bp, Homo sapien
aaagcttttccatagagcttattta

SEQ ID NO: 548883 - DNA, 25 bp, Homo sapien
tagagcttatttatatccttttttt

SEQ ID NO: 548884 - DNA, 25 bp, Homo sapien
ttcattttaaatgtgtcagcactgt

SEQ ID NO: 548885 - DNA, 25 bp, Homo sapien
taaatgtgtcagcactgtagtgtaa

SEQ ID NO: 548886 - DNA, 25 bp, Homo sapien
gtcagcactgtagtgtaaatagctt

SEQ ID NO: 548887 - DNA, 25 bp, Homo sapien
gatttatactgaaatgtgagccact

SEQ ID NO: 548888 - DNA, 25 bp, Homo sapien
atgtgagccacttaataaaggttca

SEQ ID NO: 548889 - DNA, 25 bp, Homo sapien
aataaaggttcatatgttcatatta

SEQ ID NO: 548890 - DNA, 25 bp, Homo sapien
gagaccttgagtatgcttctctctt

SEQ ID NO: 548891 - DNA, 25 bp, Homo sapien
cttgagtatgcttctctcttctgaa

SEQ ID NO: 548892 - DNA, 25 bp, Homo sapien
ctgaattgtattttgggtcttttat

SEQ ID NO: 548893 - DNA, 25 bp, Homo sapien
gggtcttttatctccatataactct

SEQ ID NO: 548894 - DNA, 25 bp, Homo sapien
aataatgcatgttttgcaagtgctt

SEQ ID NO: 548895 - DNA, 25 bp, Homo sapien
gagaactttgatgtctggaacctac

SEQ ID NO: 548896 - DNA, 25 bp, Homo sapien
gtctggaacctacagttgatccttt

SEQ ID NO: 548897 - DNA, 25 bp, Homo sapien
aacctacagttgatccttttttgtg

SEQ ID NO: 548898 - DNA, 25 bp, Homo sapien
aaaaatctggatgtgctggtcaagg

SEQ ID NO: 548899 - DNA, 25 bp, Homo sapien
atgtgctggtcaaggaatcctctga

SEQ ID NO: 548900 - DNA, 25 bp, Homo sapien
gcttagagcaatcagtgtggttttc

SEQ ID NO: 548901 - DNA, 25 bp, Homo sapien
agagaagtgggcatccttcctttaa

SEQ ID NO: 548902 - DNA, 25 bp, Homo sapien
agaagtgggcatccttcctttaaat

SEQ ID NO: 548903 - DNA, 25 bp, Homo sapien
taaattcaggaaccactgttgtttt

SEQ ID NO: 548904 - DNA, 25 bp, Homo sapien
gcatcccttatataagttgttttgg

SEQ ID NO: 548905 - DNA, 25 bp, Homo sapien
agttgttttggatttgggactatgt

SEQ ID NO: 548906 - DNA, 25 bp, Homo sapien
cagttagttctgttttttgtattgg

SEQ ID NO: 548907 - DNA, 25 bp, Homo sapien
attggttattcagcttacttttggt

SEQ ID NO: 548908 - DNA, 25 bp, Homo sapien
attcagcttacttttggtatcaaaa

SEQ ID NO: 548909 - DNA, 25 bp, Homo sapien
tcaaaattatgccagttttaagctc

SEQ ID NO: 548910 - DNA, 25 bp, Homo sapien
ctgaccatctgcctcttgagagaga

SEQ ID NO: 548911 - DNA, 25 bp, Homo sapien
gaccatctgcctcttgagagagaga

SEQ ID NO: 548912 - DNA, 25 bp, Homo sapien
tactttgattctgtttaccttctct

SEQ ID NO: 548913 - DNA, 25 bp, Homo sapien
tttaccttctctgatgacaattcca

SEQ ID NO: 548914 - DNA, 25 bp, Homo sapien
atgacaattccatcaagccttaaat

SEQ ID NO: 548915 - DNA, 25 bp, Homo sapien
cacttttgtgtgcatcttatctgag

SEQ ID NO: 548916 - DNA, 25 bp, Homo sapien
atcttatctgagtccagccatctgg

SEQ ID NO: 548917 - DNA, 25 bp, Homo sapien
agccatctggtactgctgtgcattt

SEQ ID NO: 548918 - DNA, 25 bp, Homo sapien
gtgcattttgaacaccgtgggcata

SEQ ID NO: 548919 - DNA, 25 bp, Homo sapien
aatggtcaggagtgtggtttcagca

SEQ ID NO: 548920 - DNA, 25 bp, Homo sapien
gtggtttcagcactactaacagatg

SEQ ID NO: 548921 - DNA, 25 bp, Homo sapien
gtttctacctcatttgaccataact

SEQ ID NO: 548922 - DNA, 25 bp, Homo sapien
gaccataactgtacttgtgagcttc

SEQ ID NO: 548923 - DNA, 25 bp, Homo sapien
gaccccaccagccagtcagctacaa

SEQ ID NO: 548924 - DNA, 25 bp, Homo sapien
caccagccagtcagctacaactcca

SEQ ID NO: 548925 - DNA, 25 bp, Homo sapien
accagccagtcagctacaactccac

SEQ ID NO: 548926 - DNA, 25 bp, Homo sapien
cagccagtcagctacaactccacat

SEQ ID NO: 548927 - DNA, 25 bp, Homo sapien
agccagtcagctacaactccacatc

SEQ ID NO: 548928 - DNA, 25 bp, Homo sapien
agtcagctacaactccacatcaact

SEQ ID NO: 548929 - DNA, 25 bp, Homo sapien
gtcagctacaactccacatcaactc

SEQ ID NO: 548930 - DNA, 25 bp, Homo sapien
tcagctacaactccacatcaactcc

SEQ ID NO: 548931 - DNA, 25 bp, Homo sapien
cagctacaactccacatcaactcca

SEQ ID NO: 548932 - DNA, 25 bp, Homo sapien
agctacaactccacatcaactccac

SEQ ID NO: 548933 - DNA, 25 bp, Homo sapien
tacaactccacatcaactccacatg

SEQ ID NO: 548934 - DNA, 25 bp, Homo sapien
aatcttcaagaagctaaaggcaaca

SEQ ID NO: 548935 - DNA, 25 bp, Homo sapien
aaaggcaacataaatattgtcattc

SEQ ID NO: 548936 - DNA, 25 bp, Homo sapien
aaatattgtcattcaccatgaaaag

SEQ ID NO: 548937 - DNA, 25 bp, Homo sapien
gtcattcaccatgaaaagacatttt

SEQ ID NO: 548938 - DNA, 25 bp, Homo sapien
gattcaataaaagtccaactacact

SEQ ID NO: 548939 - DNA, 25 bp, Homo sapien
tccaactacacttgaggcttatcat

SEQ ID NO: 548940 - DNA, 25 bp, Homo sapien
tacacttgaggcttatcatgaaacc

SEQ ID NO: 548941 - DNA, 25 bp, Homo sapien
gaggcttatcatgaaacctaaaatt

SEQ ID NO: 548942 - DNA, 25 bp, Homo sapien
gaagtgaattcagattttcaagacc

SEQ ID NO: 548943 - DNA, 25 bp, Homo sapien
ggagctcgtgtcagaaggtgactca

SEQ ID NO: 548944 - DNA, 25 bp, Homo sapien
tttatataacttctaaatcttcaag

SEQ ID NO: 548945 - DNA, 25 bp, Homo sapien
tttgacacctactatcgtggatttt

SEQ ID NO: 548946 - DNA, 25 bp, Homo sapien
agcatttaggcaggtggctcccaaa

SEQ ID NO: 548947 - DNA, 25 bp, Homo sapien
gcaggtggctcccaaattaccggaa

SEQ ID NO: 548948 - DNA, 25 bp, Homo sapien
ttaccggaaaggactgttcttgagg

SEQ ID NO: 548949 - DNA, 25 bp, Homo sapien
gactgttcttgaggtattcagggaa

SEQ ID NO: 548950 - DNA, 25 bp, Homo sapien
gagattcagatggtcacgtcagctt

SEQ ID NO: 548951 - DNA, 25 bp, Homo sapien
gtcacgtcagctttagagactttga

SEQ ID NO: 548952 - DNA, 25 bp, Homo sapien
gagactttgaatatgccctgaacta

SEQ ID NO: 548953 - DNA, 25 bp, Homo sapien
gaatatgccctgaactatggacaga

SEQ ID NO: 548954 - DNA, 25 bp, Homo sapien
ggaagcctaactattgtgaactact

SEQ ID NO: 548955 - DNA, 25 bp, Homo sapien
atgtcagcagactctactctactaa

SEQ ID NO: 548956 - DNA, 25 bp, Homo sapien
gagataggttgcctcttactcaagc

SEQ ID NO: 548957 - DNA, 25 bp, Homo sapien
tgggtcaggcacttggcttctcagt

SEQ ID NO: 548958 - DNA, 25 bp, Homo sapien
cagtcttgactttgattattctttt

SEQ ID NO: 548959 - DNA, 25 bp, Homo sapien
ctttccatttccagcttttagagct

SEQ ID NO: 548960 - DNA, 25 bp, Homo sapien
ttgcctcttactcaagctggaaggg

SEQ ID NO: 548961 - DNA, 25 bp, Homo sapien
ttttagagctgcttctgccttcctt

SEQ ID NO: 548962 - DNA, 25 bp, Homo sapien
ttggctcctggctttctcacatctt

SEQ ID NO: 548963 - DNA, 25 bp, Homo sapien
gctttctcacatcttcagattccaa

SEQ ID NO: 548964 - DNA, 25 bp, Homo sapien
ttcagattccaaagcgcatcactcc

SEQ ID NO: 548965 - DNA, 25 bp, Homo sapien
aaagcgcatcactccagtctgctcg

SEQ ID NO: 548966 - DNA, 25 bp, Homo sapien
agtctgctcgtgtcaccacaagctt

SEQ ID NO: 548967 - DNA, 25 bp, Homo sapien
gcttcgtgtgttctcaattttgagt

SEQ ID NO: 548968 - DNA, 25 bp, Homo sapien
ttgttttcaatatcctcctcatggt

SEQ ID NO: 548969 - DNA, 25 bp, Homo sapien
actttgggttatgtttctgctacca

SEQ ID NO: 548970 - DNA, 25 bp, Homo sapien
tttgggttatgtttctgctaccagc

SEQ ID NO: 548971 - DNA, 25 bp, Homo sapien
ttgggttatgtttctgctaccagca

SEQ ID NO: 548972 - DNA, 25 bp, Homo sapien
tgggttatgtttctgctaccagcag

SEQ ID NO: 548973 - DNA, 25 bp, Homo sapien
gggttatgtttctgctaccagcaga

SEQ ID NO: 548974 - DNA, 25 bp, Homo sapien
gttatgtttctgctaccagcagaga

SEQ ID NO: 548975 - DNA, 25 bp, Homo sapien
ctaccagcagagattcttagctata

SEQ ID NO: 548976 - DNA, 25 bp, Homo sapien
taccagcagagattcttagctatat

SEQ ID NO: 548977 - DNA, 25 bp, Homo sapien
accagcagagattcttagctatatg

SEQ ID NO: 548978 - DNA, 25 bp, Homo sapien
atggtgcaggagactgaccccagac

SEQ ID NO: 548979 - DNA, 25 bp, Homo sapien
atagtggtatcctaaaccagatttc

SEQ ID NO: 548980 - DNA, 25 bp, Homo sapien
aacagtcttttgatcattataaacc

SEQ ID NO: 548981 - DNA, 25 bp, Homo sapien
atcattataaaccaggatcttcaga

SEQ ID NO: 548982 - DNA, 25 bp, Homo sapien
tcagaaaccttgctaggagaagtta

SEQ ID NO: 548983 - DNA, 25 bp, Homo sapien
tgaccccagactagtcccagagaga

SEQ ID NO: 548984 - DNA, 25 bp, Homo sapien
aaaacctctgaaatccttcacgata

SEQ ID NO: 548985 - DNA, 25 bp, Homo sapien
ccagactagtcccagagagatgccc

SEQ ID NO: 548986 - DNA, 25 bp, Homo sapien
agagagatgcccactcattcgtcat

SEQ ID NO: 548987 - DNA, 25 bp, Homo sapien
tcattcgtcatcttctgttctccaa

SEQ ID NO: 548988 - DNA, 25 bp, Homo sapien
gtcatcttctgttctccaagaaaat

SEQ ID NO: 548989 - DNA, 25 bp, Homo sapien
aggcacatgccacggattaacatcg

SEQ ID NO: 548990 - DNA, 25 bp, Homo sapien
gcacatgccacggattaacatcgct

SEQ ID NO: 548991 - DNA, 25 bp, Homo sapien
cacatgccacggattaacatcgcta

SEQ ID NO: 548992 - DNA, 25 bp, Homo sapien
acatgccacggattaacatcgctaa

SEQ ID NO: 548993 - DNA, 25 bp, Homo sapien
catgccacggattaacatcgctaat

SEQ ID NO: 548994 - DNA, 25 bp, Homo sapien
atgccacggattaacatcgctaatt

SEQ ID NO: 548995 - DNA, 25 bp, Homo sapien
tgccacggattaacatcgctaattt

SEQ ID NO: 548996 - DNA, 25 bp, Homo sapien
gccacggattaacatcgctaatttt

SEQ ID NO: 548997 - DNA, 25 bp, Homo sapien
cacggattaacatcgctaattttgt

SEQ ID NO: 548998 - DNA, 25 bp, Homo sapien
acggattaacatcgctaattttgta

SEQ ID NO: 548999 - DNA, 25 bp, Homo sapien
ggattaacatcgctaattttgtatt

SEQ ID NO: 549000 - DNA, 25 bp, Homo sapien
atgggacttaatctataatagttac

SEQ ID NO: 549001 - DNA, 25 bp, Homo sapien
aatagttactatgtatttggtctac

SEQ ID NO: 549002 - DNA, 25 bp, Homo sapien
atgtatttggtctacattttccaaa

SEQ ID NO: 549003 - DNA, 25 bp, Homo sapien
aaaagtgttcagagtggccctccta

SEQ ID NO: 549004 - DNA, 25 bp, Homo sapien
caactcttcctgctaaactgtattc

SEQ ID NO: 549005 - DNA, 25 bp, Homo sapien
taaactgtattccagtttccaagtt

SEQ ID NO: 549006 - DNA, 25 bp, Homo sapien
gtttactaattgacttgggcctgtt

SEQ ID NO: 549007 - DNA, 25 bp, Homo sapien
gacttgggcctgttcaaataatact

SEQ ID NO: 549008 - DNA, 25 bp, Homo sapien
gggcctgttcaaataatacttcaca

SEQ ID NO: 549009 - DNA, 25 bp, Homo sapien
atacttcacagaaaccaaatgccaa

SEQ ID NO: 549010 - DNA, 25 bp, Homo sapien
cagaaaccaaatgccaaacggagga

SEQ ID NO: 549011 - DNA, 25 bp, Homo sapien
ttagcccggcatgttggtgcacgct

SEQ ID NO: 549012 - DNA, 25 bp, Homo sapien
tagcccggcatgttggtgcacgctt

SEQ ID NO: 549013 - DNA, 25 bp, Homo sapien
agcccggcatgttggtgcacgcttg

SEQ ID NO: 549014 - DNA, 25 bp, Homo sapien
gcccggcatgttggtgcacgcttgt

SEQ ID NO: 549015 - DNA, 25 bp, Homo sapien
cccggcatgttggtgcacgcttgta

SEQ ID NO: 549016 - DNA, 25 bp, Homo sapien
ccggcatgttggtgcacgcttgtaa

SEQ ID NO: 549017 - DNA, 25 bp, Homo sapien
cggcatgttggtgcacgcttgtaat

SEQ ID NO: 549018 - DNA, 25 bp, Homo sapien
ggcatgttggtgcacgcttgtaatc

SEQ ID NO: 549019 - DNA, 25 bp, Homo sapien
gcatgttggtgcacgcttgtaatcc

SEQ ID NO: 549020 - DNA, 25 bp, Homo sapien
aggcacgagaatcacctgaactcag

SEQ ID NO: 549021 - DNA, 25 bp, Homo sapien
ggcacgagaatcacctgaactcagg

SEQ ID NO: 549022 - DNA, 25 bp, Homo sapien
caacttggaataaccctcagctgtt

SEQ ID NO: 549023 - DNA, 25 bp, Homo sapien
tcagctgtttcctaacaaaggcatt

SEQ ID NO: 549024 - DNA, 25 bp, Homo sapien
aaggcattcctcacaattgctttag

SEQ ID NO: 549025 - DNA, 25 bp, Homo sapien
tcctcacaattgctttagtacggtt

SEQ ID NO: 549026 - DNA, 25 bp, Homo sapien
gctttagtacggttgctttaataag

SEQ ID NO: 549027 - DNA, 25 bp, Homo sapien
gcaggtcttttattgtatcaccaga

SEQ ID NO: 549028 - DNA, 25 bp, Homo sapien
tctgtgcattcaagaatcttttaaa

SEQ ID NO: 549029 - DNA, 25 bp, Homo sapien
atcttttaaatatagggcctctcag

SEQ ID NO: 549030 - DNA, 25 bp, Homo sapien
atatagggcctctcaggaagaaaat

SEQ ID NO: 549031 - DNA, 25 bp, Homo sapien
tgcactctcacattcatttacaatt

SEQ ID NO: 549032 - DNA, 25 bp, Homo sapien
ttccagtgggttcaaatgactaact

SEQ ID NO: 549033 - DNA, 25 bp, Homo sapien
gaaaacagggaagcagcatctttta

SEQ ID NO: 549034 - DNA, 25 bp, Homo sapien
taaggtgtctcgttagagcccaaag

SEQ ID NO: 549035 - DNA, 25 bp, Homo sapien
tagagcccaaagtggaatccggaag

SEQ ID NO: 549036 - DNA, 25 bp, Homo sapien
ccagagctgaggctgccccaagact

SEQ ID NO: 549037 - DNA, 25 bp, Homo sapien
tgccccaagactcagacttgctaag

SEQ ID NO: 549038 - DNA, 25 bp, Homo sapien
gacttgctaagaattacgccgccga

SEQ ID NO: 549039 - DNA, 25 bp, Homo sapien
gccgacttcaaacccagagagcatc

SEQ ID NO: 549040 - DNA, 25 bp, Homo sapien
agagagcatctttcttttaggcgaa

SEQ ID NO: 549041 - DNA, 25 bp, Homo sapien
taggcgaaaacgcatatatttattt

SEQ ID NO: 549042 - DNA, 25 bp, Homo sapien
gtaagttataccattctttcacatt

SEQ ID NO: 549043 - DNA, 25 bp, Homo sapien
gacttacactggaaatgcgaacatt

SEQ ID NO: 549044 - DNA, 25 bp, Homo sapien
atgattctcctataaggtaactctt

SEQ ID NO: 549045 - DNA, 25 bp, Homo sapien
ggtaactctttagtcctccatttag

SEQ ID NO: 549046 - DNA, 25 bp, Homo sapien
ttagtcctccatttagcacatttta

SEQ ID NO: 549047 - DNA, 25 bp, Homo sapien
aatcctccaaagaataagtatcatg

SEQ ID NO: 549048 - DNA, 25 bp, Homo sapien
ggcgttttattttcatggcctataa

SEQ ID NO: 549049 - DNA, 25 bp, Homo sapien
ttcatggcctataagcaggtacctt

SEQ ID NO: 549050 - DNA, 25 bp, Homo sapien
gcaggtaccttagtagggcagatat

SEQ ID NO: 549051 - DNA, 25 bp, Homo sapien
aaatcctctacaaatccaaggcagg

SEQ ID NO: 549052 - DNA, 25 bp, Homo sapien
gtggtggcagagtgactcattctcc

SEQ ID NO: 549053 - DNA, 25 bp, Homo sapien
ggcagagtgactcattctcctgtcc

SEQ ID NO: 549054 - DNA, 25 bp, Homo sapien
tcccatcaggtcaaatcaggaggct

SEQ ID NO: 549055 - DNA, 25 bp, Homo sapien
atttcaatggcaatctagtattttt

SEQ ID NO: 549056 - DNA, 25 bp, Homo sapien
gtttgagttttgtagggccatcacc

SEQ ID NO: 549057 - DNA, 25 bp, Homo sapien
gggccatcacctggaaagtcaatgt

SEQ ID NO: 549058 - DNA, 25 bp, Homo sapien
gtgactagacacaaagtagcccaga

SEQ ID NO: 549059 - DNA, 25 bp, Homo sapien
agcccagaggctacttttcttccta

SEQ ID NO: 549060 - DNA, 25 bp, Homo sapien
gctacttttcttcctacagcttatt

SEQ ID NO: 549061 - DNA, 25 bp, Homo sapien
acagcttattatagttgtaggttct

SEQ ID NO: 549062 - DNA, 25 bp, Homo sapien
gtaggttctatgacctcacttcatg

SEQ ID NO: 549063 - DNA, 25 bp, Homo sapien
ctcacttcatgggttccaggcaatt

SEQ ID NO: 549064 - DNA, 25 bp, Homo sapien
ttccaggcaattccgctgaaaggtt

SEQ ID NO: 549065 - DNA, 25 bp, Homo sapien
tccgctgaaaggtttgtctcctgaa

SEQ ID NO: 549066 - DNA, 25 bp, Homo sapien
attacactggtgtaggcctgtactg

SEQ ID NO: 549067 - DNA, 25 bp, Homo sapien
tacactggtgtaggcctgtactgct

SEQ ID NO: 549068 - DNA, 25 bp, Homo sapien
ccctaaacgccagaaagtgaatctt

SEQ ID NO: 549069 - DNA, 25 bp, Homo sapien
gtgaatcttaagaagctctgcccta

SEQ ID NO: 549070 - DNA, 25 bp, Homo sapien
tcttaagaagctctgccctaaactg

SEQ ID NO: 549071 - DNA, 25 bp, Homo sapien
agaagctctgccctaaactgagaac

SEQ ID NO: 549072 - DNA, 25 bp, Homo sapien
gctctgccctaaactgagaaccaca

SEQ ID NO: 549073 - DNA, 25 bp, Homo sapien
ctgaaaggtgaaggctcagcctccc

SEQ ID NO: 549074 - DNA, 25 bp, Homo sapien
catgggtcctgggttacattaggta

SEQ ID NO: 549075 - DNA, 25 bp, Homo sapien
ggttacattaggtaccgggctgatt

SEQ ID NO: 549076 - DNA, 25 bp, Homo sapien
taggtaccgggctgattgataggca

SEQ ID NO: 549077 - DNA, 25 bp, Homo sapien
gagcattggacaacgacacgcgact

SEQ ID NO: 549078 - DNA, 25 bp, Homo sapien
tacggaacgccttcacgacgcggat

SEQ ID NO: 549079 - DNA, 25 bp, Homo sapien
aacgacacgcgactagggctagaga

SEQ ID NO: 549080 - DNA, 25 bp, Homo sapien
gggctagagagattggctacatcct

SEQ ID NO: 549081 - DNA, 25 bp, Homo sapien
gctacatcctggctctggctggtga

SEQ ID NO: 549082 - DNA, 25 bp, Homo sapien
tggtgaccgaggactgtctccgcag

SEQ ID NO: 549083 - DNA, 25 bp, Homo sapien
aaggaggccccgctcttgaaagtat

SEQ ID NO: 549084 - DNA, 25 bp, Homo sapien
ggaggccccgctcttgaaagtattg

SEQ ID NO: 549085 - DNA, 25 bp, Homo sapien
cttcacgacgcggattctttaaatt

SEQ ID NO: 549086 - DNA, 25 bp, Homo sapien
gtattgactacttcaatctgtgtct

SEQ ID NO: 549087 - DNA, 25 bp, Homo sapien
ggattctttaaatttcactctctct

SEQ ID NO: 549088 - DNA, 25 bp, Homo sapien
cattttcaattagatgagttgggct

SEQ ID NO: 549089 - DNA, 25 bp, Homo sapien
gatgagttgggctggtataaaacat

SEQ ID NO: 549090 - DNA, 25 bp, Homo sapien
gctggtataaaacataagcctcaaa

SEQ ID NO: 549091 - DNA, 25 bp, Homo sapien
aagcctcaaaatgttcaaaggcaca

SEQ ID NO: 549092 - DNA, 25 bp, Homo sapien
ggcacaagtgcaatgtaagtttatt

SEQ ID NO: 549093 - DNA, 25 bp, Homo sapien
tttttcactcacataaataggataa

SEQ ID NO: 549094 - DNA, 25 bp, Homo sapien
acagtcattcagggcccagctgatg

SEQ ID NO: 549095 - DNA, 25 bp, Homo sapien
ttaagatgttgcttccatggttccc

SEQ ID NO: 549096 - DNA, 25 bp, Homo sapien
agatgttgcttccatggttcccttg

SEQ ID NO: 549097 - DNA, 25 bp, Homo sapien
gcttccatggttcccttggataaga

SEQ ID NO: 549098 - DNA, 25 bp, Homo sapien
ggttcccttggataagaaactgaga

SEQ ID NO: 549099 - DNA, 25 bp, Homo sapien
gaaaataggcttttctgtcttccta

SEQ ID NO: 549100 - DNA, 25 bp, Homo sapien
gcttttctgtcttcctaagtaaaca

SEQ ID NO: 549101 - DNA, 25 bp, Homo sapien
ctcacacctttatagtagacatctg

SEQ ID NO: 549102 - DNA, 25 bp, Homo sapien
agatattgctggaagtcatgataaa

SEQ ID NO: 549103 - DNA, 25 bp, Homo sapien
aaagtctatcttctgtgaccatatg

SEQ ID NO: 549104 - DNA, 25 bp, Homo sapien
gtgaccatatgtttccttagagagt

SEQ ID NO: 549105 - DNA, 25 bp, Homo sapien
gagttttagacattgaccctcatct

SEQ ID NO: 549106 - DNA, 25 bp, Homo sapien
gaaaaaggactctcaccagtctgtt

SEQ ID NO: 549107 - DNA, 25 bp, Homo sapien
ggactctcaccagtctgttaatatg

SEQ ID NO: 549108 - DNA, 25 bp, Homo sapien
agaacctcactcctgtcagcatatt

SEQ ID NO: 549109 - DNA, 25 bp, Homo sapien
tctcaagtgatccatagaatcttag

SEQ ID NO: 549110 - DNA, 25 bp, Homo sapien
gataccataatttgtacgggacagg

SEQ ID NO: 549111 - DNA, 25 bp, Homo sapien
aggtgtccttcgcacccaacagtgc

SEQ ID NO: 549112 - DNA, 25 bp, Homo sapien
acccaacagtgcgtctgaggaacga

SEQ ID NO: 549113 - DNA, 25 bp, Homo sapien
tgcgtctgaggaacgagctgcagtt

SEQ ID NO: 549114 - DNA, 25 bp, Homo sapien
aacgagctgcagtttgagcgttccc

SEQ ID NO: 549115 - DNA, 25 bp, Homo sapien
gagcgttcccctgagatgtgcgtag

SEQ ID NO: 549116 - DNA, 25 bp, Homo sapien
tccgtgtaaatgtccactcccatgg

SEQ ID NO: 549117 - DNA, 25 bp, Homo sapien
aatgtccactcccatggcttaattg

SEQ ID NO: 549118 - DNA, 25 bp, Homo sapien
ggcttaattgcctatcagacgcatt

SEQ ID NO: 549119 - DNA, 25 bp, Homo sapien
tatcagacgcattttcccagacgaa

SEQ ID NO: 549120 - DNA, 25 bp, Homo sapien
ttttcccagacgaaagcaatgttgg

SEQ ID NO: 549121 - DNA, 25 bp, Homo sapien
cctcctgaaggcagaggcttgccta

SEQ ID NO: 549122 - DNA, 25 bp, Homo sapien
gcttgcctaaatcagcctttataag

SEQ ID NO: 549123 - DNA, 25 bp, Homo sapien
atggactccagatcctttactactg

SEQ ID NO: 549124 - DNA, 25 bp, Homo sapien
agatcctttactactgaactcacag

SEQ ID NO: 549125 - DNA, 25 bp, Homo sapien
aactcacagggctgtaacactgtta

SEQ ID NO: 549126 - DNA, 25 bp, Homo sapien
gagaggaccaggacgatgccagcac

SEQ ID NO: 549127 - DNA, 25 bp, Homo sapien
agcaccccgtttatcctgagtgaac

SEQ ID NO: 549128 - DNA, 25 bp, Homo sapien
tgagtgaactctccggaggcctctt

SEQ ID NO: 549129 - DNA, 25 bp, Homo sapien
gaggcctcttcaagcttgtgggttc

SEQ ID NO: 549130 - DNA, 25 bp, Homo sapien
cttgtgggttctctgctgtcttgaa

SEQ ID NO: 549131 - DNA, 25 bp, Homo sapien
gaagccatccatccatttgataggt

SEQ ID NO: 549132 - DNA, 25 bp, Homo sapien
gaatggtccaacgtttccctgctga

SEQ ID NO: 549133 - DNA, 25 bp, Homo sapien
tttccctgctgattataatgccctc

SEQ ID NO: 549134 - DNA, 25 bp, Homo sapien
gctgattataatgccctctctgtta

SEQ ID NO: 549135 - DNA, 25 bp, Homo sapien
ttatcctaaattcttgacatccggt

SEQ ID NO: 549136 - DNA, 25 bp, Homo sapien
gacatccggtaaggaagtctcctct

SEQ ID NO: 549137 - DNA, 25 bp, Homo sapien
ggtaaggaagtctcctctgcccacc

SEQ ID NO: 549138 - DNA, 25 bp, Homo sapien
ttttgactgttcttgaccccttgct

SEQ ID NO: 549139 - DNA, 25 bp, Homo sapien
cttgctctttctgtgaactttagga

SEQ ID NO: 549140 - DNA, 25 bp, Homo sapien
gaatgttatctttctatccatgata

SEQ ID NO: 549141 - DNA, 25 bp, Homo sapien
gataattctgtatctctccattaat

SEQ ID NO: 549142 - DNA, 25 bp, Homo sapien
tctgtatctctccattaattcaagt

SEQ ID NO: 549143 - DNA, 25 bp, Homo sapien
tttcctcatgtttggtatgggtacc

SEQ ID NO: 549144 - DNA, 25 bp, Homo sapien
atgggtacccttttcagggattcat

SEQ ID NO: 549145 - DNA, 25 bp, Homo sapien
attgtcctgccctctgatgaaaaag

SEQ ID NO: 549146 - DNA, 25 bp, Homo sapien
ttatccctccatctcaggtgtctga

SEQ ID NO: 549147 - DNA, 25 bp, Homo sapien
ggctgatcttgaatctgagacccct

SEQ ID NO: 549148 - DNA, 25 bp, Homo sapien
ttgaatctgagacccctgggcagct

SEQ ID NO: 549149 - DNA, 25 bp, Homo sapien
tgggcagcttctgcatgctgattat

SEQ ID NO: 549150 - DNA, 25 bp, Homo sapien
actaagtggcaagaatatgttcccc

SEQ ID NO: 549151 - DNA, 25 bp, Homo sapien
agccatcttttggacccaatccatt

SEQ ID NO: 549152 - DNA, 25 bp, Homo sapien
tttggacccaatccattcttaggcc

SEQ ID NO: 549153 - DNA, 25 bp, Homo sapien
attcttaggcccagttcctattgca

SEQ ID NO: 549154 - DNA, 25 bp, Homo sapien
gaacaatgaattggctctattttct

SEQ ID NO: 549155 - DNA, 25 bp, Homo sapien
tttctctattgggaattacaggacc

SEQ ID NO: 549156 - DNA, 25 bp, Homo sapien
attacaggaccattttgattcttag

SEQ ID NO: 549157 - DNA, 25 bp, Homo sapien
tatcgctaagtaaatcatcctggag

SEQ ID NO: 549158 - DNA, 25 bp, Homo sapien
tggaggtcccaagtagctctatgcc

SEQ ID NO: 549159 - DNA, 25 bp, Homo sapien
tctatgcctgcaatcatggagacac

SEQ ID NO: 549160 - DNA, 25 bp, Homo sapien
cacaggcagacagataagcttcatg

SEQ ID NO: 549161 - DNA, 25 bp, Homo sapien
gcatcctctgtcttgggatttgtat

SEQ ID NO: 549162 - DNA, 25 bp, Homo sapien
gatttgtatccatggtggtctggtc

SEQ ID NO: 549163 - DNA, 25 bp, Homo sapien
gttaccaaacagcactatcccagga

SEQ ID NO: 549164 - DNA, 25 bp, Homo sapien
caggaactattgtctgcctgggaac

SEQ ID NO: 549165 - DNA, 25 bp, Homo sapien
aagccttccgagagagaatctagat

SEQ ID NO: 549166 - DNA, 25 bp, Homo sapien
ctgcagcctctagtttgaacatgac

SEQ ID NO: 549167 - DNA, 25 bp, Homo sapien
tgaacatgactactctgggctaaaa

SEQ ID NO: 549168 - DNA, 25 bp, Homo sapien
gcaggctagcctttgtcatgtgtga

SEQ ID NO: 549169 - DNA, 25 bp, Homo sapien
gtcatgtgtgatggcactcgttgcc

SEQ ID NO: 549170 - DNA, 25 bp, Homo sapien
aggtcttcacttcctcgtggagaac

SEQ ID NO: 549171 - DNA, 25 bp, Homo sapien
tggagaactccaccttcctactgag

SEQ ID NO: 549172 - DNA, 25 bp, Homo sapien
ttcctactgagtgccaggatcctga

SEQ ID NO: 549173 - DNA, 25 bp, Homo sapien
gatcctgacactcagtcaccgtgga

SEQ ID NO: 549174 - DNA, 25 bp, Homo sapien
tcaccgtggatctctcggacactta

SEQ ID NO: 549175 - DNA, 25 bp, Homo sapien
cactgacacttggaggttgtagcaa

SEQ ID NO: 549176 - DNA, 25 bp, Homo sapien
aaaagaaaccccacatcgactagca

SEQ ID NO: 549177 - DNA, 25 bp, Homo sapien
gaaaccccacatcgactagcagtta

SEQ ID NO: 549178 - DNA, 25 bp, Homo sapien
cccacatcgactagcagttactcat

SEQ ID NO: 549179 - DNA, 25 bp, Homo sapien
acatcgactagcagttactcatttg

SEQ ID NO: 549180 - DNA, 25 bp, Homo sapien
ctagcagttactcatttgcttctcc

SEQ ID NO: 549181 - DNA, 25 bp, Homo sapien
atttgcttctccctatgtcccctga

SEQ ID NO: 549182 - DNA, 25 bp, Homo sapien
cctatgtcccctgacaaccactaat

SEQ ID NO: 549183 - DNA, 25 bp, Homo sapien
ccactaatctatttgtctctataga

SEQ ID NO: 549184 - DNA, 25 bp, Homo sapien
atcatctgtatgtaagtggttaata

SEQ ID NO: 549185 - DNA, 25 bp, Homo sapien
aaggattggttgattgaagattgaa

SEQ ID NO: 549186 - DNA, 25 bp, Homo sapien
tgaaaagggtcagctgggaaaattt

SEQ ID NO: 549187 - DNA, 25 bp, Homo sapien
gcttaggttgcaaatggagagtatt

SEQ ID NO: 549188 - DNA, 25 bp, Homo sapien
acgtggtgatgtaaaaaacttctgc

SEQ ID NO: 549189 - DNA, 25 bp, Homo sapien
aaacttctgcaaaacttgttctgta

SEQ ID NO: 549190 - DNA, 25 bp, Homo sapien
aaaacttgttctgtagctcctgggt

SEQ ID NO: 549191 - DNA, 25 bp, Homo sapien
gttctgtagctcctgggtcaggtct

SEQ ID NO: 549192 - DNA, 25 bp, Homo sapien
gggtcaggtctatgccattttttct

SEQ ID NO: 549193 - DNA, 25 bp, Homo sapien
attttttcttatatctgctcacaca

SEQ ID NO: 549194 - DNA, 25 bp, Homo sapien
ctgctcacacagtacagaaatgact

SEQ ID NO: 549195 - DNA, 25 bp, Homo sapien
aattttgggtctgggctgttatatc

SEQ ID NO: 549196 - DNA, 25 bp, Homo sapien
ggtctgggctgttatatcactttgt

SEQ ID NO: 549197 - DNA, 25 bp, Homo sapien
tgggctgttatatcactttgtgtta

SEQ ID NO: 549198 - DNA, 25 bp, Homo sapien
ttttaactgctttaggcttctggct

SEQ ID NO: 549199 - DNA, 25 bp, Homo sapien
gaatccatgggcaatacatcttcac

SEQ ID NO: 549200 - DNA, 25 bp, Homo sapien
gggcaatacatcttcacatgtccct

SEQ ID NO: 549201 - DNA, 25 bp, Homo sapien
cttcacatgtcccttattcatatgc

SEQ ID NO: 549202 - DNA, 25 bp, Homo sapien
gtcccttattcatatgctaagcaag

SEQ ID NO: 549203 - DNA, 25 bp, Homo sapien
aactgctttaggcttctggctgtct

SEQ ID NO: 549204 - DNA, 25 bp, Homo sapien
atatttctctgaacattctgtctca

SEQ ID NO: 549205 - DNA, 25 bp, Homo sapien
ttctctgaacattctgtctcagaaa

SEQ ID NO: 549206 - DNA, 25 bp, Homo sapien
attgtaagaagtggctatctagctc

SEQ ID NO: 549207 - DNA, 25 bp, Homo sapien
gtggctatctagctcttgaacaagt

SEQ ID NO: 549208 - DNA, 25 bp, Homo sapien
aataattccttattccagataaatt

SEQ ID NO: 549209 - DNA, 25 bp, Homo sapien
ggtttttctgccagtgtcttgtctg

SEQ ID NO: 549210 - DNA, 25 bp, Homo sapien
agtgtcttgtctgaaggcagacttc

SEQ ID NO: 549211 - DNA, 25 bp, Homo sapien
taccctcacctgatgataattttct

SEQ ID NO: 549212 - DNA, 25 bp, Homo sapien
cttcttgctgcaaaactggttggct

SEQ ID NO: 549213 - DNA, 25 bp, Homo sapien
ggcttgcaacccagagagagcagct

SEQ ID NO: 549214 - DNA, 25 bp, Homo sapien
agagagcagcttcccttggctctgg

SEQ ID NO: 549215 - DNA, 25 bp, Homo sapien
tggccccagccacgtttacaggaag

SEQ ID NO: 549216 - DNA, 25 bp, Homo sapien
tttacaggaaggtgtgccccagagg

SEQ ID NO: 549217 - DNA, 25 bp, Homo sapien
aggaggaggaatcagctccctcgct

SEQ ID NO: 549218 - DNA, 25 bp, Homo sapien
ctccagtggccttgggtccgggtct

SEQ ID NO: 549219 - DNA, 25 bp, Homo sapien
cttgggtccgggtctcactgagcag

SEQ ID NO: 549220 - DNA, 25 bp, Homo sapien
cagtgtcacccacagatggtaagga

SEQ ID NO: 549221 - DNA, 25 bp, Homo sapien
attggtcacctcactcttctatgga

SEQ ID NO: 549222 - DNA, 25 bp, Homo sapien
tggacagagattcctgctgggatcc

SEQ ID NO: 549223 - DNA, 25 bp, Homo sapien
tttgagggcaagcagacccttcttc

SEQ ID NO: 549224 - DNA, 25 bp, Homo sapien
cttcttccagctcggactgtgaact

SEQ ID NO: 549225 - DNA, 25 bp, Homo sapien
tgtgaactccactgcagccgtaagg

SEQ ID NO: 549226 - DNA, 25 bp, Homo sapien
gcagccgtaaggactgtctgtgaca

SEQ ID NO: 549227 - DNA, 25 bp, Homo sapien
gtctgtgacagtgagcccgagatga

SEQ ID NO: 549228 - DNA, 25 bp, Homo sapien
cccgagatgactgggctctgtgctc

SEQ ID NO: 549229 - DNA, 25 bp, Homo sapien
ttggcctgccacagagaactgagct

SEQ ID NO: 549230 - DNA, 25 bp, Homo sapien
tgttcccaatcctggtccagtgtca

SEQ ID NO: 549231 - DNA, 25 bp, Homo sapien
ctcctgctgtaatgacccagagtag

SEQ ID NO: 549232 - DNA, 25 bp, Homo sapien
gtaatgacccagagtagcctcccca

SEQ ID NO: 549233 - DNA, 25 bp, Homo sapien
aggccggcatcttatgtgtgtcttc

SEQ ID NO: 549234 - DNA, 25 bp, Homo sapien
ttatgtgtgtcttccaccatcctca

SEQ ID NO: 549235 - DNA, 25 bp, Homo sapien
attgtgcaaggctcggaagagaacc

SEQ ID NO: 549236 - DNA, 25 bp, Homo sapien
actgggtgaaaacagaaagctcaat

SEQ ID NO: 549237 - DNA, 25 bp, Homo sapien
atgggctaggttcccagatcattag

SEQ ID NO: 549238 - DNA, 25 bp, Homo sapien
taggttcccagatcattagggcaga

SEQ ID NO: 549239 - DNA, 25 bp, Homo sapien
attagggcagagtttgcacgtcctc

SEQ ID NO: 549240 - DNA, 25 bp, Homo sapien
ttgcacgtcctctggtcactggaat

SEQ ID NO: 549241 - DNA, 25 bp, Homo sapien
gggttttggaacaaactcctgctga

SEQ ID NO: 549242 - DNA, 25 bp, Homo sapien
gatcatcatcaaaacttatgtggct

SEQ ID NO: 549243 - DNA, 25 bp, Homo sapien
tcatcatcaaaacttatgtggcttt

SEQ ID NO: 549244 - DNA, 25 bp, Homo sapien
acttatgtggctttttgacctttga

SEQ ID NO: 549245 - DNA, 25 bp, Homo sapien
cttatgtggctttttgacctttgaa

SEQ ID NO: 549246 - DNA, 25 bp, Homo sapien
ttatgtggctttttgacctttgaat

SEQ ID NO: 549247 - DNA, 25 bp, Homo sapien
tatgtggctttttgacctttgaata

SEQ ID NO: 549248 - DNA, 25 bp, Homo sapien
atgtggctttttgacctttgaatag

SEQ ID NO: 549249 - DNA, 25 bp, Homo sapien
tgtggctttttgacctttgaatagg

SEQ ID NO: 549250 - DNA, 25 bp, Homo sapien
gtggctttttgacctttgaataggg

SEQ ID NO: 549251 - DNA, 25 bp, Homo sapien
tggctttttgacctttgaataggga

SEQ ID NO: 549252 - DNA, 25 bp, Homo sapien
gctttttgacctttgaatagggaat

SEQ ID NO: 549253 - DNA, 25 bp, Homo sapien
actcctgactcctcttaaggtgcgg

SEQ ID NO: 549254 - DNA, 25 bp, Homo sapien
taaggtgcggctttgcctgaacagt

SEQ ID NO: 549255 - DNA, 25 bp, Homo sapien
tgcctgaacagttgggtggatctct

SEQ ID NO: 549256 - DNA, 25 bp, Homo sapien
gaatagacattgctccacggtcttt

SEQ ID NO: 549257 - DNA, 25 bp, Homo sapien
ggtctttcttctgtagtggcatatc

SEQ ID NO: 549258 - DNA, 25 bp, Homo sapien
tagtggcatatctcatcctcagttc

SEQ ID NO: 549259 - DNA, 25 bp, Homo sapien
ctcagttctgagatagcccactttg

SEQ ID NO: 549260 - DNA, 25 bp, Homo sapien
gcccactttgaaacacagcttcatg

SEQ ID NO: 549261 - DNA, 25 bp, Homo sapien
tgggcctggaagttgcttcaaactt

SEQ ID NO: 549262 - DNA, 25 bp, Homo sapien
aaacttgcattaaccgtctcatctg

SEQ ID NO: 549263 - DNA, 25 bp, Homo sapien
gtctcatctgagtcaaagtggcaaa

SEQ ID NO: 549264 - DNA, 25 bp, Homo sapien
gaaatcctcctttcttgaatccttt

SEQ ID NO: 549265 - DNA, 25 bp, Homo sapien
cacaacattttctagcaattgcata

SEQ ID NO: 549266 - DNA, 25 bp, Homo sapien
gaatctaatcattgtccaaagcttt

SEQ ID NO: 549267 - DNA, 25 bp, Homo sapien
ccttgagtaagggaatttttcattg

SEQ ID NO: 549268 - DNA, 25 bp, Homo sapien
ttttcattgaataggtgtgcacaac

SEQ ID NO: 549269 - DNA, 25 bp, Homo sapien
aataggtgtgcacaactgatttttt

SEQ ID NO: 549270 - DNA, 25 bp, Homo sapien
attttttagcttctcagttcagttc

SEQ ID NO: 549271 - DNA, 25 bp, Homo sapien
agcttctcagttcagttcacagatt

SEQ ID NO: 549272 - DNA, 25 bp, Homo sapien
ctcagttcagttcacagatttttgt

SEQ ID NO: 549273 - DNA, 25 bp, Homo sapien
aagtcatacattatagtctgcaagt

SEQ ID NO: 549274 - DNA, 25 bp, Homo sapien
gcaagtaggaccatctaattttatg

SEQ ID NO: 549275 - DNA, 25 bp, Homo sapien
acagattcagatgttaatctccttt

SEQ ID NO: 549276 - DNA, 25 bp, Homo sapien
aatcaagctgacagtattaaccatc

SEQ ID NO: 549277 - DNA, 25 bp, Homo sapien
agtattaaccatcacgcctgtggag

SEQ ID NO: 549278 - DNA, 25 bp, Homo sapien
tattaaccatcacgcctgtggagag

SEQ ID NO: 549279 - DNA, 25 bp, Homo sapien
tgagaagatgcagccagcgtgtccc

SEQ ID NO: 549280 - DNA, 25 bp, Homo sapien
taggctttctttactagaccttaag

SEQ ID NO: 549281 - DNA, 25 bp, Homo sapien
ttactagaccttaagctgtgctggg

SEQ ID NO: 549282 - DNA, 25 bp, Homo sapien
gaccttaagctgtgctgggaacatt

SEQ ID NO: 549283 - DNA, 25 bp, Homo sapien
agctgtgctgggaacattcacaggc

SEQ ID NO: 549284 - DNA, 25 bp, Homo sapien
gtttttaaggagaattccagctctt

SEQ ID NO: 549285 - DNA, 25 bp, Homo sapien
taaggagaattccagctcttttaaa

SEQ ID NO: 549286 - DNA, 25 bp, Homo sapien
gctttcaaaagcatgttcgtatttc

SEQ ID NO: 549287 - DNA, 25 bp, Homo sapien
aagcatgttcgtatttccagcccag

SEQ ID NO: 549288 - DNA, 25 bp, Homo sapien
gttttgcagttttcacagtaaatgt

SEQ ID NO: 549289 - DNA, 25 bp, Homo sapien
cagtaaatgtctgcgactgcatgca

SEQ ID NO: 549290 - DNA, 25 bp, Homo sapien
gactgcatgcagtcctgttagcaac

SEQ ID NO: 549291 - DNA, 25 bp, Homo sapien
agtcctgttagcaacactcgctctt

SEQ ID NO: 549292 - DNA, 25 bp, Homo sapien
ccacagcccacattaactactgagt

SEQ ID NO: 549293 - DNA, 25 bp, Homo sapien
aaagaggtatgctcgtccttgactt

SEQ ID NO: 549294 - DNA, 25 bp, Homo sapien
atgctcgtccttgacttccttggaa

SEQ ID NO: 549295 - DNA, 25 bp, Homo sapien
gacttccttggaatgaccggcgaca

SEQ ID NO: 549296 - DNA, 25 bp, Homo sapien
ttccttggaatgaccggcgacaggc

SEQ ID NO: 549297 - DNA, 25 bp, Homo sapien
gaagccatacctttagcctctgtta

SEQ ID NO: 549298 - DNA, 25 bp, Homo sapien
atacctttagcctctgttactgtct

SEQ ID NO: 549299 - DNA, 25 bp, Homo sapien
agcctctgttactgtcttaactgaa

SEQ ID NO: 549300 - DNA, 25 bp, Homo sapien
tactgtcttaactgaatgtgggaat

SEQ ID NO: 549301 - DNA, 25 bp, Homo sapien
ttcccgccggtcaaggacttccaag

SEQ ID NO: 549302 - DNA, 25 bp, Homo sapien
cgccggtcaaggacttccaagccaa

SEQ ID NO: 549303 - DNA, 25 bp, Homo sapien
ttgctcctgaattgcatttgggcca

SEQ ID NO: 549304 - DNA, 25 bp, Homo sapien
catttgggccaaagagtagagctct

SEQ ID NO: 549305 - DNA, 25 bp, Homo sapien
agagtagagctcttccatgcctgta

SEQ ID NO: 549306 - DNA, 25 bp, Homo sapien
ttccatgcctgtaccgcagtgaagt

SEQ ID NO: 549307 - DNA, 25 bp, Homo sapien
cctgtaccgcagtgaagtgtgtttc

SEQ ID NO: 549308 - DNA, 25 bp, Homo sapien
ctctgttaaccactacttgaagtct

SEQ ID NO: 549309 - DNA, 25 bp, Homo sapien
ctgttaaccactacttgaagtcttg

SEQ ID NO: 549310 - DNA, 25 bp, Homo sapien
gttaaccactacttgaagtcttgag

SEQ ID NO: 549311 - DNA, 25 bp, Homo sapien
taaccactacttgaagtcttgaggg

SEQ ID NO: 549312 - DNA, 25 bp, Homo sapien
gcctccagggagacataggggcctt

SEQ ID NO: 549313 - DNA, 25 bp, Homo sapien
agacataggggccttctcccttctt

SEQ ID NO: 549314 - DNA, 25 bp, Homo sapien
cccttgtacttgattccccagctgt

SEQ ID NO: 549315 - DNA, 25 bp, Homo sapien
ttgtacttgattccccagctgtctt

SEQ ID NO: 549316 - DNA, 25 bp, Homo sapien
tacttgattccccagctgtctttca

SEQ ID NO: 549317 - DNA, 25 bp, Homo sapien
tgattccccagctgtctttcacaca

SEQ ID NO: 549318 - DNA, 25 bp, Homo sapien
gggcttctctacaatgaggtttttt

SEQ ID NO: 549319 - DNA, 25 bp, Homo sapien
tgaggagcacgtcttcagccagcag

SEQ ID NO: 549320 - DNA, 25 bp, Homo sapien
agcagcagccaggacatatagcctc

SEQ ID NO: 549321 - DNA, 25 bp, Homo sapien
catcctaatccctctgctgttgctg

SEQ ID NO: 549322 - DNA, 25 bp, Homo sapien
gccggagtggtattctggtataagc

SEQ ID NO: 549323 - DNA, 25 bp, Homo sapien
gtattctggtataagcggcgagtcc

SEQ ID NO: 549324 - DNA, 25 bp, Homo sapien
gcttccagcaccaacggatgaccaa

SEQ ID NO: 549325 - DNA, 25 bp, Homo sapien
catgaacgtggagattggaaacccc

SEQ ID NO: 549326 - DNA, 25 bp, Homo sapien
tggaaaccccacctacaagatgtac

SEQ ID NO: 549327 - DNA, 25 bp, Homo sapien
caagatgtacgaaggcggagagcct

SEQ ID NO: 549328 - DNA, 25 bp, Homo sapien
aggcctactggacgctgactttgcc

SEQ ID NO: 549329 - DNA, 25 bp, Homo sapien
tactggacgctgactttgccctgga

SEQ ID NO: 549330 - DNA, 25 bp, Homo sapien
tatcaccagctccagggtggtgccc

SEQ ID NO: 549331 - DNA, 25 bp, Homo sapien
tatagacgagcccatgtctgcgatg

SEQ ID NO: 549332 - DNA, 25 bp, Homo sapien
gagcccatgtctgcgatgtaactgc

SEQ ID NO: 549333 - DNA, 25 bp, Homo sapien
tgcgatgtaactgcaccgcgctggg

SEQ ID NO: 549334 - DNA, 25 bp, Homo sapien
gtgagggcgccgtcctccagcttat

SEQ ID NO: 549335 - DNA, 25 bp, Homo sapien
tccagcttatgctaggcaggcgcgc

SEQ ID NO: 549336 - DNA, 25 bp, Homo sapien
gtgaccacgcctacagccgaagagg

SEQ ID NO: 549337 - DNA, 25 bp, Homo sapien
acgcctacagccgaagaggatggga

SEQ ID NO: 549338 - DNA, 25 bp, Homo sapien
ggatgggaaaatgcggccctgttcc

SEQ ID NO: 549339 - DNA, 25 bp, Homo sapien
gaaaatgcggccctgttcctgaaca

SEQ ID NO: 549340 - DNA, 25 bp, Homo sapien
atgcggccctgttcctgaacaggaa

SEQ ID NO: 549341 - DNA, 25 bp, Homo sapien
attatttttcgaactctgattctgc

SEQ ID NO: 549342 - DNA, 25 bp, Homo sapien
tcgaactctgattctgcatagtaaa

SEQ ID NO: 549343 - DNA, 25 bp, Homo sapien
ttcctgggatttttaccataaagca

SEQ ID NO: 549344 - DNA, 25 bp, Homo sapien
aagcagacagtgtttgtattttcaa

SEQ ID NO: 549345 - DNA, 25 bp, Homo sapien
gtattttcaactggagtacatgtat

SEQ ID NO: 549346 - DNA, 25 bp, Homo sapien
tttctttgtaaagtagcttcctatg

SEQ ID NO: 549347 - DNA, 25 bp, Homo sapien
agtagcttcctatgaaaatgtggac

SEQ ID NO: 549348 - DNA, 25 bp, Homo sapien
aaggtttcatatgtttgtgttcaaa

SEQ ID NO: 549349 - DNA, 25 bp, Homo sapien
tcctcattgctgcagcttactaaaa

SEQ ID NO: 549350 - DNA, 25 bp, Homo sapien
gaaaattgtttttgctcgtgtagat

SEQ ID NO: 549351 - DNA, 25 bp, Homo sapien
gtttttgctcgtgtagatatctgta

SEQ ID NO: 549352 - DNA, 25 bp, Homo sapien
agcagctcggctgaagtgggccctt

SEQ ID NO: 549353 - DNA, 25 bp, Homo sapien
aagtgggccctttgggcttgtgcac

SEQ ID NO: 549354 - DNA, 25 bp, Homo sapien
ttgggcttgtgcacggcgaacacgc

SEQ ID NO: 549355 - DNA, 25 bp, Homo sapien
gccgctcaaggacagcagcttggta

SEQ ID NO: 549356 - DNA, 25 bp, Homo sapien
gcttggtagccaaagcggccttgga

SEQ ID NO: 549357 - DNA, 25 bp, Homo sapien
attgctgcgaccgttcctgcagttt

SEQ ID NO: 549358 - DNA, 25 bp, Homo sapien
gtgtctgttttcaaagacggcgaag

SEQ ID NO: 549359 - DNA, 25 bp, Homo sapien
ttcaaagacggcgaagacaccaccg

SEQ ID NO: 549360 - DNA, 25 bp, Homo sapien
tcagaagcggccatacttttgtagc

SEQ ID NO: 549361 - DNA, 25 bp, Homo sapien
gccatacttttgtagcccagacctg

SEQ ID NO: 549362 - DNA, 25 bp, Homo sapien
agcccagacctgtttcatcgtggag

SEQ ID NO: 549363 - DNA, 25 bp, Homo sapien
tgaggcttccctcacctagaatggc

SEQ ID NO: 549364 - DNA, 25 bp, Homo sapien
tagaatggcccatccttcaggaccc

SEQ ID NO: 549365 - DNA, 25 bp, Homo sapien
tttgtcgcctggtctgacttgtgca

SEQ ID NO: 549366 - DNA, 25 bp, Homo sapien
tctcatcttctttccagggacttat

SEQ ID NO: 549367 - DNA, 25 bp, Homo sapien
cccaaggctgtcctctgttctggtg

SEQ ID NO: 549368 - DNA, 25 bp, Homo sapien
agctcagggctcttggaacttggtc

SEQ ID NO: 549369 - DNA, 25 bp, Homo sapien
ttggaacttggtctgcagtgactct

SEQ ID NO: 549370 - DNA, 25 bp, Homo sapien
tggttaggacccatgttctctaggt

SEQ ID NO: 549371 - DNA, 25 bp, Homo sapien
atgttctctaggtcccagcaccctg

SEQ ID NO: 549372 - DNA, 25 bp, Homo sapien
tgacttgtgcactgggatcttctcg

SEQ ID NO: 549373 - DNA, 25 bp, Homo sapien
tgggatcttctcgtgccaggccagg

SEQ ID NO: 549374 - DNA, 25 bp, Homo sapien
acattacctgtttaacatactgagg

SEQ ID NO: 549375 - DNA, 25 bp, Homo sapien
agatgaaacagacttgcaacatagt

SEQ ID NO: 549376 - DNA, 25 bp, Homo sapien
gacttgcaacatagtctgcatgaat

SEQ ID NO: 549377 - DNA, 25 bp, Homo sapien
gcaacatagtctgcatgaatgcaaa

SEQ ID NO: 549378 - DNA, 25 bp, Homo sapien
taacatactgaggtgcaactggaac

SEQ ID NO: 549379 - DNA, 25 bp, Homo sapien
gcaagtgataaggaaactgggcaaa

SEQ ID NO: 549380 - DNA, 25 bp, Homo sapien
ggtgcaactggaacatattacaata

SEQ ID NO: 549381 - DNA, 25 bp, Homo sapien
attatttgccactgtgggctaagtt

SEQ ID NO: 549382 - DNA, 25 bp, Homo sapien
gccactgtgggctaagtttactata

SEQ ID NO: 549383 - DNA, 25 bp, Homo sapien
agtttactatactggtcttagatat

SEQ ID NO: 549384 - DNA, 25 bp, Homo sapien
actggtcttagatataaaaggtcac

SEQ ID NO: 549385 - DNA, 25 bp, Homo sapien
aacattagcgttggtcttctcttgt

SEQ ID NO: 549386 - DNA, 25 bp, Homo sapien
gttggtcttctcttgtcaggaatga

SEQ ID NO: 549387 - DNA, 25 bp, Homo sapien
caggaatgaaggatgcttgcacaca

SEQ ID NO: 549388 - DNA, 25 bp, Homo sapien
acacacacacgaaatggttggtttg

SEQ ID NO: 549389 - DNA, 25 bp, Homo sapien
agtacataaagcttgcactctgcgt

SEQ ID NO: 549390 - DNA, 25 bp, Homo sapien
taaagcttgcactctgcgtcctata

SEQ ID NO: 549391 - DNA, 25 bp, Homo sapien
tgcactctgcgtcctatatctagca

SEQ ID NO: 549392 - DNA, 25 bp, Homo sapien
tgcgtcctatatctagcagcatggg

SEQ ID NO: 549393 - DNA, 25 bp, Homo sapien
gggtacgtttggcagttcactccat

SEQ ID NO: 549394 - DNA, 25 bp, Homo sapien
cgtttggcagttcactccattaggg

SEQ ID NO: 549395 - DNA, 25 bp, Homo sapien
gggtaaataatttatgaccattcat

SEQ ID NO: 549396 - DNA, 25 bp, Homo sapien
ccagtaatgattgtagcctaccctc

SEQ ID NO: 549397 - DNA, 25 bp, Homo sapien
tgacaatggcaccttagtaattaaa

SEQ ID NO: 549398 - DNA, 25 bp, Homo sapien
gaattacaaatcgtccacccaggag

SEQ ID NO: 549399 - DNA, 25 bp, Homo sapien
aatcgtccacccaggagtattgtca

SEQ ID NO: 549400 - DNA, 25 bp, Homo sapien
ctgtgtggccttgggagttcccaag

SEQ ID NO: 549401 - DNA, 25 bp, Homo sapien
gaaatcacgtgggagatgcctgacc

SEQ ID NO: 549402 - DNA, 25 bp, Homo sapien
tcccttctctcaacggcaagtaaag

SEQ ID NO: 549403 - DNA, 25 bp, Homo sapien
gcaacagcttatgacagaggaaact

SEQ ID NO: 549404 - DNA, 25 bp, Homo sapien
ggaaactatatctgtaaggctcaaa

SEQ ID NO: 549405 - DNA, 25 bp, Homo sapien
ggctcaaaatagtgttggtcataca

SEQ ID NO: 549406 - DNA, 25 bp, Homo sapien
ggtcatacactgattactgttccag

SEQ ID NO: 549407 - DNA, 25 bp, Homo sapien
agtctcaggccaatcactttgctgt

SEQ ID NO: 549408 - DNA, 25 bp, Homo sapien
tcaggccaatcactttgctgtgcac

SEQ ID NO: 549409 - DNA, 25 bp, Homo sapien
caatcactttgctgtgcaccatgat

SEQ ID NO: 549410 - DNA, 25 bp, Homo sapien
cactttgctgtgcaccatgatgagg

SEQ ID NO: 549411 - DNA, 25 bp, Homo sapien
caaaagactttgtatggacggccca

SEQ ID NO: 549412 - DNA, 25 bp, Homo sapien
gactttgtatggacggcccaactgg

SEQ ID NO: 549413 - DNA, 25 bp, Homo sapien
gtatggacggcccaactgggataat

SEQ ID NO: 549414 - DNA, 25 bp, Homo sapien
ggcccaactgggataatgaattcaa

SEQ ID NO: 549415 - DNA, 25 bp, Homo sapien
gacaattgcaagtcaacaccctaat

SEQ ID NO: 549416 - DNA, 25 bp, Homo sapien
ttgcaagtcaacaccctaataccag

SEQ ID NO: 549417 - DNA, 25 bp, Homo sapien
agtcaacaccctaataccagaatag

SEQ ID NO: 549418 - DNA, 25 bp, Homo sapien
ggatgtacacatctcattgttactg

SEQ ID NO: 549419 - DNA, 25 bp, Homo sapien
gtacacatctcattgttactgcgta

SEQ ID NO: 549420 - DNA, 25 bp, Homo sapien
cacatctcattgttactgcgtattt

SEQ ID NO: 549421 - DNA, 25 bp, Homo sapien
atctcattgttactgcgtatttttt

SEQ ID NO: 549422 - DNA, 25 bp, Homo sapien
taatacaaaactgggcatttagctg

SEQ ID NO: 549423 - DNA, 25 bp, Homo sapien
aaaactgggcatttagctgttccac

SEQ ID NO: 549424 - DNA, 25 bp, Homo sapien
actgggcatttagctgttccacatt

SEQ ID NO: 549425 - DNA, 25 bp, Homo sapien
ggcatttagctgttccacattgtgt

SEQ ID NO: 549426 - DNA, 25 bp, Homo sapien
catttagctgttccacattgtgtag

SEQ ID NO: 549427 - DNA, 25 bp, Homo sapien
tagctgttccacattgtgtagtaaa

SEQ ID NO: 549428 - DNA, 25 bp, Homo sapien
gttccacattgtgtagtaaatgttt

SEQ ID NO: 549429 - DNA, 25 bp, Homo sapien
agcagctcggctgaagtgggccctt

SEQ ID NO: 549430 - DNA, 25 bp, Homo sapien
cagctcggctgaagtgggccctttg

SEQ ID NO: 549431 - DNA, 25 bp, Homo sapien
aagtgggccctttgggcttgtgcac

SEQ ID NO: 549432 - DNA, 25 bp, Homo sapien
cctttgggcttgtgcacggcgaaca

SEQ ID NO: 549433 - DNA, 25 bp, Homo sapien
ttgggcttgtgcacggcgaacacgc

SEQ ID NO: 549434 - DNA, 25 bp, Homo sapien
ttgtgcacggcgaacacgccgctca

SEQ ID NO: 549435 - DNA, 25 bp, Homo sapien
gaacacgccgctcaaggacagcagc

SEQ ID NO: 549436 - DNA, 25 bp, Homo sapien
aaggacagcagcttggtagccaaag

SEQ ID NO: 549437 - DNA, 25 bp, Homo sapien
agcagcttggtagccaaagcggcct

SEQ ID NO: 549438 - DNA, 25 bp, Homo sapien
agcttggtagccaaagcggccttgg

SEQ ID NO: 549439 - DNA, 25 bp, Homo sapien
ttggtagccaaagcggccttggaga

SEQ ID NO: 549440 - DNA, 25 bp, Homo sapien
gatcctgaagtgctgacgagaaatt

SEQ ID NO: 549441 - DNA, 25 bp, Homo sapien
gaaattcaggaagcctgcaagccta

SEQ ID NO: 549442 - DNA, 25 bp, Homo sapien
ctgcaagcctagaggtcagctcagt

SEQ ID NO: 549443 - DNA, 25 bp, Homo sapien
tagaggtcagctcagtggccacctt

SEQ ID NO: 549444 - DNA, 25 bp, Homo sapien
gcaccattggaagctgcctagtttg

SEQ ID NO: 549445 - DNA, 25 bp, Homo sapien
aagctgcctagtttgaggcacggat

SEQ ID NO: 549446 - DNA, 25 bp, Homo sapien
ccctcttcctgaggaatgcatacaa

SEQ ID NO: 549447 - DNA, 25 bp, Homo sapien
ctgaggaatgcatacaagggtgctt

SEQ ID NO: 549448 - DNA, 25 bp, Homo sapien
ccaaggcaggagagccaaagctgga

SEQ ID NO: 549449 - DNA, 25 bp, Homo sapien
gaagctcttcttctgaaacctgtaa

SEQ ID NO: 549450 - DNA, 25 bp, Homo sapien
ccttcaaaattgtaatttccttctg

SEQ ID NO: 549451 - DNA, 25 bp, Homo sapien
cgaattgtacgtgggtctggactta

SEQ ID NO: 549452 - DNA, 25 bp, Homo sapien
aattgtacgtgggtctggacttaca

SEQ ID NO: 549453 - DNA, 25 bp, Homo sapien
ttgtacgtgggtctggacttacatt

SEQ ID NO: 549454 - DNA, 25 bp, Homo sapien
gtacgtgggtctggacttacatttt

SEQ ID NO: 549455 - DNA, 25 bp, Homo sapien
tgggtctggacttacatttttcacc

SEQ ID NO: 549456 - DNA, 25 bp, Homo sapien
ggtctggacttacatttttcaccca

SEQ ID NO: 549457 - DNA, 25 bp, Homo sapien
ggacttacatttttcacccagacga

SEQ ID NO: 549458 - DNA, 25 bp, Homo sapien
gacttacatttttcacccagacgaa

SEQ ID NO: 549459 - DNA, 25 bp, Homo sapien
ttacatttttcacccagacgaattg

SEQ ID NO: 549460 - DNA, 25 bp, Homo sapien
atttttcacccagacgaattgtacg

SEQ ID NO: 549461 - DNA, 25 bp, Homo sapien
tttcacccagacgaattgtacgtgg

SEQ ID NO: 549462 - DNA, 25 bp, Homo sapien
aagatgaacaaacgtccagcaagat

SEQ ID NO: 549463 - DNA, 25 bp, Homo sapien
gtccagcaagatactttaatcctct

SEQ ID NO: 549464 - DNA, 25 bp, Homo sapien
ttaatcctctattttgctcttcctt

SEQ ID NO: 549465 - DNA, 25 bp, Homo sapien
tattttgctcttccttgtccattgc

SEQ ID NO: 549466 - DNA, 25 bp, Homo sapien
ttccttgtccattgctgctgttaat

SEQ ID NO: 549467 - DNA, 25 bp, Homo sapien
gctgttaatgtattgctgacctctt

SEQ ID NO: 549468 - DNA, 25 bp, Homo sapien
tgacctctttcacagttggctctaa

SEQ ID NO: 549469 - DNA, 25 bp, Homo sapien
ttcacagttggctctaaagaatcaa

SEQ ID NO: 549470 - DNA, 25 bp, Homo sapien
cttttgcccagttaaatgttcacca

SEQ ID NO: 549471 - DNA, 25 bp, Homo sapien
gaagtcagatgcttcatgtcacagc

SEQ ID NO: 549472 - DNA, 25 bp, Homo sapien
agatgcttcatgtcacagcatttag

SEQ ID NO: 549473 - DNA, 25 bp, Homo sapien
tctgtcaaccaagtttctttaccct

SEQ ID NO: 549474 - DNA, 25 bp, Homo sapien
tattcctggccgtatcctttctgct

SEQ ID NO: 549475 - DNA, 25 bp, Homo sapien
ccccaccagcactatcaggagtagg

SEQ ID NO: 549476 - DNA, 25 bp, Homo sapien
accagcactatcaggagtaggaagt

SEQ ID NO: 549477 - DNA, 25 bp, Homo sapien
gtaggaagtgacatgcttagatttg

SEQ ID NO: 549478 - DNA, 25 bp, Homo sapien
ggaaccttaaggatcaactaatctg

SEQ ID NO: 549479 - DNA, 25 bp, Homo sapien
ggatcaactaatctgtaacacattg

SEQ ID NO: 549480 - DNA, 25 bp, Homo sapien
aatctgtaacacattgatcccctca

SEQ ID NO: 549481 - DNA, 25 bp, Homo sapien
taacacattgatcccctcattttac

SEQ ID NO: 549482 - DNA, 25 bp, Homo sapien
ttaggtatatctcagccaacccgtg

SEQ ID NO: 549483 - DNA, 25 bp, Homo sapien
tatctcagccaacccgtgacattat

SEQ ID NO: 549484 - DNA, 25 bp, Homo sapien
ataaatgtcttttgggatgtttcct

SEQ ID NO: 549485 - DNA, 25 bp, Homo sapien
taaatgtcttttgggatgtttcctt

SEQ ID NO: 549486 - DNA, 25 bp, Homo sapien
atgtcttttgggatgtttccttaat

SEQ ID NO: 549487 - DNA, 25 bp, Homo sapien
tgtcttttgggatgtttccttaatt

SEQ ID NO: 549488 - DNA, 25 bp, Homo sapien
taatttactactttgtatgtacctt

SEQ ID NO: 549489 - DNA, 25 bp, Homo sapien
tactactttgtatgtacctttcttt

SEQ ID NO: 549490 - DNA, 25 bp, Homo sapien
tctcctgacaaatgaggttatttta

SEQ ID NO: 549491 - DNA, 25 bp, Homo sapien
tattttatatgagtctgtctgagag

SEQ ID NO: 549492 - DNA, 25 bp, Homo sapien
ttatatgagtctgtctgagagtaca

SEQ ID NO: 549493 - DNA, 25 bp, Homo sapien
atgagtctgtctgagagtacagtaa

SEQ ID NO: 549494 - DNA, 25 bp, Homo sapien
gagtctgtctgagagtacagtaaat

SEQ ID NO: 549495 - DNA, 25 bp, Homo sapien
gggacccagtaggagataatttgaa

SEQ ID NO: 549496 - DNA, 25 bp, Homo sapien
taatttgaatcgtgagcagtttcca

SEQ ID NO: 549497 - DNA, 25 bp, Homo sapien
ttgaatcgtgagcagtttccaccac

SEQ ID NO: 549498 - DNA, 25 bp, Homo sapien
aatcgtgagcagtttccaccacgca

SEQ ID NO: 549499 - DNA, 25 bp, Homo sapien
tgagcagtttccaccacgcatgctg

SEQ ID NO: 549500 - DNA, 25 bp, Homo sapien
gggtttccgcttcttgcgtcttcct

SEQ ID NO: 549501 - DNA, 25 bp, Homo sapien
gcttcttgcgtcttcctcattttct

SEQ ID NO: 549502 - DNA, 25 bp, Homo sapien
ccatataagaagtgtcttttgcccc

SEQ ID NO: 549503 - DNA, 25 bp, Homo sapien
tgaggctccccatccatgtgaaact

SEQ ID NO: 549504 - DNA, 25 bp, Homo sapien
gctccccatccatgtgaaactgtaa

SEQ ID NO: 549505 - DNA, 25 bp, Homo sapien
tcccagtcttggatatgtcttcacc

SEQ ID NO: 549506 - DNA, 25 bp, Homo sapien
ggtaggcaactggttgtcatggaaa

SEQ ID NO: 549507 - DNA, 25 bp, Homo sapien
gtaggcaactggttgtcatggaaat

SEQ ID NO: 549508 - DNA, 25 bp, Homo sapien
gaaatggggatcatcacagtcccct

SEQ ID NO: 549509 - DNA, 25 bp, Homo sapien
aatggggatcatcacagtccccttc

SEQ ID NO: 549510 - DNA, 25 bp, Homo sapien
atggggatcatcacagtccccttcc

SEQ ID NO: 549511 - DNA, 25 bp, Homo sapien
gggatcatcacagtccccttcccct

SEQ ID NO: 549512 - DNA, 25 bp, Homo sapien
ggctgggcagtgttaagggtggcaa

SEQ ID NO: 549513 - DNA, 25 bp, Homo sapien
cagtgttaagggtggcaagatagtc

SEQ ID NO: 549514 - DNA, 25 bp, Homo sapien
agtgttaagggtggcaagatagtct

SEQ ID NO: 549515 - DNA, 25 bp, Homo sapien
tgttaagggtggcaagatagtctct

SEQ ID NO: 549516 - DNA, 25 bp, Homo sapien
gttaagggtggcaagatagtctctg

SEQ ID NO: 549517 - DNA, 25 bp, Homo sapien
aacaaacacgcatggtggaacacat

SEQ ID NO: 549518 - DNA, 25 bp, Homo sapien
ggctccctgcaggaagcgtgccctg

SEQ ID NO: 549519 - DNA, 25 bp, Homo sapien
tgcagcaggcgcgaaccacccgagc

SEQ ID NO: 549520 - DNA, 25 bp, Homo sapien
acgcatggtggaacacatgtgagca

SEQ ID NO: 549521 - DNA, 25 bp, Homo sapien
acatgcacctagacaggcacgccgg

SEQ ID NO: 549522 - DNA, 25 bp, Homo sapien
acctagacaggcacgccggctgggt

SEQ ID NO: 549523 - DNA, 25 bp, Homo sapien
acctgggcccttgcacctgtgtctg

SEQ ID NO: 549524 - DNA, 25 bp, Homo sapien
tggaacacatgtgagcaggacagga

SEQ ID NO: 549525 - DNA, 25 bp, Homo sapien
ttctttttggaacgcctgcccgcac

SEQ ID NO: 549526 - DNA, 25 bp, Homo sapien
ggcattgaccgccagcagcggaaaa

SEQ ID NO: 549527 - DNA, 25 bp, Homo sapien
attgaccgccagcagcggaaaaagg

SEQ ID NO: 549528 - DNA, 25 bp, Homo sapien
gttttcccagcacatacaaccatag

SEQ ID NO: 549529 - DNA, 25 bp, Homo sapien
tacaaccatagctttcagtgttttt

SEQ ID NO: 549530 - DNA, 25 bp, Homo sapien
gtttttgaactcttcatatacctgg

SEQ ID NO: 549531 - DNA, 25 bp, Homo sapien
atacctggatggtgcctttgacctt

SEQ ID NO: 549532 - DNA, 25 bp, Homo sapien
gacctttgtgtcacttcagtgtcaa

SEQ ID NO: 549533 - DNA, 25 bp, Homo sapien
aagaaacggcaacatttgcactgct

SEQ ID NO: 549534 - DNA, 25 bp, Homo sapien
gatggatgtcatttctcgttcacag

SEQ ID NO: 549535 - DNA, 25 bp, Homo sapien
tctcgttcacagctttacttggatg

SEQ ID NO: 549536 - DNA, 25 bp, Homo sapien
gatgatcttttttctgactactatg

SEQ ID NO: 549537 - DNA, 25 bp, Homo sapien
tgactactatgacaaacctctcagc

SEQ ID NO: 549538 - DNA, 25 bp, Homo sapien
tcagcatgactgatatttcactcaa

SEQ ID NO: 549539 - DNA, 25 bp, Homo sapien
acacctcgccagagtggcgtgtggc

SEQ ID NO: 549540 - DNA, 25 bp, Homo sapien
cagagtggcgtgtggcaggccacca

SEQ ID NO: 549541 - DNA, 25 bp, Homo sapien
agagtggcgtgtggcaggccaccac

SEQ ID NO: 549542 - DNA, 25 bp, Homo sapien
ggccaccacagaggatcaatgcagc

SEQ ID NO: 549543 - DNA, 25 bp, Homo sapien
gccaccacagaggatcaatgcagcg

SEQ ID NO: 549544 - DNA, 25 bp, Homo sapien
ccaccacagaggatcaatgcagcgg

SEQ ID NO: 549545 - DNA, 25 bp, Homo sapien
caccacagaggatcaatgcagcggc

SEQ ID NO: 549546 - DNA, 25 bp, Homo sapien
accacagaggatcaatgcagcggct

SEQ ID NO: 549547 - DNA, 25 bp, Homo sapien
ccacagaggatcaatgcagcggctg

SEQ ID NO: 549548 - DNA, 25 bp, Homo sapien
cacagaggatcaatgcagcggctga

SEQ ID NO: 549549 - DNA, 25 bp, Homo sapien
acagaggatcaatgcagcggctgaa

SEQ ID NO: 549550 - DNA, 25 bp, Homo sapien
gttccatcgcagtgaacgccgactc

SEQ ID NO: 549551 - DNA, 25 bp, Homo sapien
agtgaacgccgactcttcggtgcag

SEQ ID NO: 549552 - DNA, 25 bp, Homo sapien
ctcttcggtgcagttgttggccgaa

SEQ ID NO: 549553 - DNA, 25 bp, Homo sapien
gccgtgacgctggacatgttggacc

SEQ ID NO: 549554 - DNA, 25 bp, Homo sapien
ggcagccaaggcaaacttggagaag

SEQ ID NO: 549555 - DNA, 25 bp, Homo sapien
gggacagctgacgaggccacgcggg

SEQ ID NO: 549556 - DNA, 25 bp, Homo sapien
ggccacgcgggcagagatccagatc

SEQ ID NO: 549557 - DNA, 25 bp, Homo sapien
agagatccagatccgaatcgaggcc

SEQ ID NO: 549558 - DNA, 25 bp, Homo sapien
agatccgaatcgaggccaacgaggc

SEQ ID NO: 549559 - DNA, 25 bp, Homo sapien
gccaaggttgacctcagcttcggag

SEQ ID NO: 549560 - DNA, 25 bp, Homo sapien
aaggttgacctcagcttcggagcca

SEQ ID NO: 549561 - DNA, 25 bp, Homo sapien
aacactgccttggaaggtggtggac

SEQ ID NO: 549562 - DNA, 25 bp, Homo sapien
gtggtggacctttaaaacagaagct

SEQ ID NO: 549563 - DNA, 25 bp, Homo sapien
cagaagcttctcagtttttgtagca

SEQ ID NO: 549564 - DNA, 25 bp, Homo sapien
tgtagcatctgatatgagagaatat

SEQ ID NO: 549565 - DNA, 25 bp, Homo sapien
gatattcataaacttagggccaggc

SEQ ID NO: 549566 - DNA, 25 bp, Homo sapien
ttcataaacttagggccaggcaatg

SEQ ID NO: 549567 - DNA, 25 bp, Homo sapien
gggcccctggaatgctactgggcac

SEQ ID NO: 549568 - DNA, 25 bp, Homo sapien
tggaatgctactgggcactctctaa

SEQ ID NO: 549569 - DNA, 25 bp, Homo sapien
atgctactgggcactctctaaccta

SEQ ID NO: 549570 - DNA, 25 bp, Homo sapien
gcactctctaacctagtcctagaaa

SEQ ID NO: 549571 - DNA, 25 bp, Homo sapien
tagtcctagaaatttcagttccaat

SEQ ID NO: 549572 - DNA, 25 bp, Homo sapien
ttccactgtcgggtacaggaataag

SEQ ID NO: 549573 - DNA, 25 bp, Homo sapien
gagacagaagacatggcggcctaac

SEQ ID NO: 549574 - DNA, 25 bp, Homo sapien
cgttcgcgagggacaaggctttgct

SEQ ID NO: 549575 - DNA, 25 bp, Homo sapien
gagggacaaggctttgcttttcgaa

SEQ ID NO: 549576 - DNA, 25 bp, Homo sapien
gacaaggctttgcttttcgaagaaa

SEQ ID NO: 549577 - DNA, 25 bp, Homo sapien
gttacaagaaattgctacggaagga

SEQ ID NO: 549578 - DNA, 25 bp, Homo sapien
ttgctacggaaggaaaagaaggctc

SEQ ID NO: 549579 - DNA, 25 bp, Homo sapien
aagaaggctcaaacgtcactggaat

SEQ ID NO: 549580 - DNA, 25 bp, Homo sapien
aggctcaaacgtcactggaatctca

SEQ ID NO: 549581 - DNA, 25 bp, Homo sapien
cagttagtcggctgcaatggcgccg

SEQ ID NO: 549582 - DNA, 25 bp, Homo sapien
gaagtggcggcctggtggtattgag

SEQ ID NO: 549583 - DNA, 25 bp, Homo sapien
atttctcggtatttaactgtctcgc

SEQ ID NO: 549584 - DNA, 25 bp, Homo sapien
ttaactgtctcgctgtcttatccga

SEQ ID NO: 549585 - DNA, 25 bp, Homo sapien
gtcttatccgagtccctaatgaaac

SEQ ID NO: 549586 - DNA, 25 bp, Homo sapien
gaaacgacttgtgtgacaatctgtc

SEQ ID NO: 549587 - DNA, 25 bp, Homo sapien
tgacaatctgtctgtgccttacgaa

SEQ ID NO: 549588 - DNA, 25 bp, Homo sapien
ctgtgccttacgaaagtgtctgtgc

SEQ ID NO: 549589 - DNA, 25 bp, Homo sapien
gtgtctgtgcactttttatcctttt

SEQ ID NO: 549590 - DNA, 25 bp, Homo sapien
ggctagcatacgtggtagggttcta

SEQ ID NO: 549591 - DNA, 25 bp, Homo sapien
gttctagaaatctgtggtcatcgct

SEQ ID NO: 549592 - DNA, 25 bp, Homo sapien
ggtcatcgctgaaatcctttttgca

SEQ ID NO: 549593 - DNA, 25 bp, Homo sapien
gaaatcctttttgcatcatgttttt

SEQ ID NO: 549594 - DNA, 25 bp, Homo sapien
ggagcagcaggtggcggcggtgcat

SEQ ID NO: 549595 - DNA, 25 bp, Homo sapien
acagctgttgttagtccactcgcac

SEQ ID NO: 549596 - DNA, 25 bp, Homo sapien
tgttagtccactcgcacgcctcgaa

SEQ ID NO: 549597 - DNA, 25 bp, Homo sapien
gaatcccgtccgaactcgtcattgg

SEQ ID NO: 549598 - DNA, 25 bp, Homo sapien
gtccgaactcgtcattggctgcttc

SEQ ID NO: 549599 - DNA, 25 bp, Homo sapien
ttcctagcggcctgtgttgattgtc

SEQ ID NO: 549600 - DNA, 25 bp, Homo sapien
ctagcggcctgtgttgattgtctgc

SEQ ID NO: 549601 - DNA, 25 bp, Homo sapien
cctgtgttgattgtctgcccgaaga

SEQ ID NO: 549602 - DNA, 25 bp, Homo sapien
tgttgattgtctgcccgaagatccg

SEQ ID NO: 549603 - DNA, 25 bp, Homo sapien
aaatgcgcagctaagcgggtggcac

SEQ ID NO: 549604 - DNA, 25 bp, Homo sapien
gcagccggacgtaccctggcaggga

SEQ ID NO: 549605 - DNA, 25 bp, Homo sapien
atttgccaggcctaccaacctaact

SEQ ID NO: 549606 - DNA, 25 bp, Homo sapien
ccaggcctaccaacctaactgatga

SEQ ID NO: 549607 - DNA, 25 bp, Homo sapien
tatctgaactatgaatgccgccctg

SEQ ID NO: 549608 - DNA, 25 bp, Homo sapien
tgaactatgaatgccgccctggtta

SEQ ID NO: 549609 - DNA, 25 bp, Homo sapien
atgaatgccgccctggttattccgg

SEQ ID NO: 549610 - DNA, 25 bp, Homo sapien
atgccgccctggttattccggaaga

SEQ ID NO: 549611 - DNA, 25 bp, Homo sapien
ttccggaagaccgttttctatcatc

SEQ ID NO: 549612 - DNA, 25 bp, Homo sapien
ggaagaccgttttctatcatctgcc

SEQ ID NO: 549613 - DNA, 25 bp, Homo sapien
aagaccgttttctatcatctgccta

SEQ ID NO: 549614 - DNA, 25 bp, Homo sapien
gaccgttttctatcatctgcctaaa

SEQ ID NO: 549615 - DNA, 25 bp, Homo sapien
ccgttttctatcatctgcctaaaaa

SEQ ID NO: 549616 - DNA, 25 bp, Homo sapien
atattatttatggacctctggccaa

SEQ ID NO: 549617 - DNA, 25 bp, Homo sapien
cctctggccaaatggtacatgtact

SEQ ID NO: 549618 - DNA, 25 bp, Homo sapien
gtacatgtactggaagtggataacc

SEQ ID NO: 549619 - DNA, 25 bp, Homo sapien
gtggataaccagtatcacttacaca

SEQ ID NO: 549620 - DNA, 25 bp, Homo sapien
caaatttgtggagttaggtggaagc

SEQ ID NO: 549621 - DNA, 25 bp, Homo sapien
acaggtacagttacccgtttcaatg

SEQ ID NO: 549622 - DNA, 25 bp, Homo sapien
gtacagttacccgtttcaatgttat

SEQ ID NO: 549623 - DNA, 25 bp, Homo sapien
ggagatgttggcacctttgaattct

SEQ ID NO: 549624 - DNA, 25 bp, Homo sapien
tggcacctttgaattctacatcctg

SEQ ID NO: 549625 - DNA, 25 bp, Homo sapien
gaattctacatcctgtttctccaga

SEQ ID NO: 549626 - DNA, 25 bp, Homo sapien
ctacatcctgtttctccagaatgag

SEQ ID NO: 549627 - DNA, 25 bp, Homo sapien
gtggtgtttgtgtcttaactatgca

SEQ ID NO: 549628 - DNA, 25 bp, Homo sapien
gtgtcttaactatgcactgggccct

SEQ ID NO: 549629 - DNA, 25 bp, Homo sapien
ttaactatgcactgggcccttgtct

SEQ ID NO: 549630 - DNA, 25 bp, Homo sapien
atgcactgggcccttgtctgcgtcg

SEQ ID NO: 549631 - DNA, 25 bp, Homo sapien
gtctgcgtcggcttgcatacagagg

SEQ ID NO: 549632 - DNA, 25 bp, Homo sapien
tcggcttgcatacagagggcccctg

SEQ ID NO: 549633 - DNA, 25 bp, Homo sapien
gccagtcttcgggtgatgggaccaa

SEQ ID NO: 549634 - DNA, 25 bp, Homo sapien
ggaccaaaccccttcagttcagtag

SEQ ID NO: 549635 - DNA, 25 bp, Homo sapien
gttcagtagagaaaggctaggtcct

SEQ ID NO: 549636 - DNA, 25 bp, Homo sapien
aaaggctaggtcctctacaaagagc

SEQ ID NO: 549637 - DNA, 25 bp, Homo sapien
ggtcctctacaaagagctgcaagac

SEQ ID NO: 549638 - DNA, 25 bp, Homo sapien
aaattactggcaaaagatctttcag

SEQ ID NO: 549639 - DNA, 25 bp, Homo sapien
gatctttcagaccatataagcctgc

SEQ ID NO: 549640 - DNA, 25 bp, Homo sapien
ttcagaccatataagcctgcaaagt

SEQ ID NO: 549641 - DNA, 25 bp, Homo sapien
ataagcctgcaaagtgcaccagagt

SEQ ID NO: 549642 - DNA, 25 bp, Homo sapien
atactggagaaaactcccagaagtg

SEQ ID NO: 549643 - DNA, 25 bp, Homo sapien
ctcccagaagtgtgacaaatgtgac

SEQ ID NO: 549644 - DNA, 25 bp, Homo sapien
attaattctcataccttattgcaca

SEQ ID NO: 549645 - DNA, 25 bp, Homo sapien
tcatatcttaacatcagcgagttgg

SEQ ID NO: 549646 - DNA, 25 bp, Homo sapien
atcttaacatcagcgagttggtatt

SEQ ID NO: 549647 - DNA, 25 bp, Homo sapien
acatcagcgagttggtatttaataa

SEQ ID NO: 549648 - DNA, 25 bp, Homo sapien
gcattatcaatgaaattactggcaa

SEQ ID NO: 549649 - DNA, 25 bp, Homo sapien
tcgttggttcgcaaagtgcaaagct

SEQ ID NO: 549650 - DNA, 25 bp, Homo sapien
gttggttcgcaaagtgcaaagcttt

SEQ ID NO: 549651 - DNA, 25 bp, Homo sapien
tggttcgcaaagtgcaaagctttct

SEQ ID NO: 549652 - DNA, 25 bp, Homo sapien
ggttcgcaaagtgcaaagctttctt

SEQ ID NO: 549653 - DNA, 25 bp, Homo sapien
ttcgcaaagtgcaaagctttcttgt

SEQ ID NO: 549654 - DNA, 25 bp, Homo sapien
cgcaaagtgcaaagctttcttgtgc

SEQ ID NO: 549655 - DNA, 25 bp, Homo sapien
caaagtgcaaagctttcttgtgcat

SEQ ID NO: 549656 - DNA, 25 bp, Homo sapien
aagtgcaaagctttcttgtgcatga

SEQ ID NO: 549657 - DNA, 25 bp, Homo sapien
agtgcaaagctttcttgtgcatgac

SEQ ID NO: 549658 - DNA, 25 bp, Homo sapien
gtgcaaagctttcttgtgcatgacg

SEQ ID NO: 549659 - DNA, 25 bp, Homo sapien
gcaaagctttcttgtgcatgacgcc

SEQ ID NO: 549660 - DNA, 25 bp, Homo sapien
ttccacacagcttccatatctgaag

SEQ ID NO: 549661 - DNA, 25 bp, Homo sapien
cacagcttccatatctgaagtgttt

SEQ ID NO: 549662 - DNA, 25 bp, Homo sapien
gtaccataaacttgtgtttactctt

SEQ ID NO: 549663 - DNA, 25 bp, Homo sapien
aaagggctgtagcattactgaaaca

SEQ ID NO: 549664 - DNA, 25 bp, Homo sapien
ggctgtagcattactgaaacagtca

SEQ ID NO: 549665 - DNA, 25 bp, Homo sapien
gaaacagtcacagttgaccctgggt

SEQ ID NO: 549666 - DNA, 25 bp, Homo sapien
acagtcacagttgaccctgggtcaa

SEQ ID NO: 549667 - DNA, 25 bp, Homo sapien
gaccctgggtcaataattccactgt

SEQ ID NO: 549668 - DNA, 25 bp, Homo sapien
aataattccactgttgggcctcaca

SEQ ID NO: 549669 - DNA, 25 bp, Homo sapien
actgttgggcctcacacagtaccgg

SEQ ID NO: 549670 - DNA, 25 bp, Homo sapien
gtagtcttcactttgaaacacactt

SEQ ID NO: 549671 - DNA, 25 bp, Homo sapien
gtttgtccatctctagataacattg

SEQ ID NO: 549672 - DNA, 25 bp, Homo sapien
gagtgttacaggctctaaagtgcaa

SEQ ID NO: 549673 - DNA, 25 bp, Homo sapien
gtgtaagcatgcatggaggcctcga

SEQ ID NO: 549674 - DNA, 25 bp, Homo sapien
gaggcctcgaggcaccacaacaagg

SEQ ID NO: 549675 - DNA, 25 bp, Homo sapien
aacaaggccaggttcttagcacatc

SEQ ID NO: 549676 - DNA, 25 bp, Homo sapien
gttctctacctgtcatgcttcaaga

SEQ ID NO: 549677 - DNA, 25 bp, Homo sapien
gcttcaagagttccagctggcctgc

SEQ ID NO: 549678 - DNA, 25 bp, Homo sapien
ggcctgctgtgaagccagtagctat

SEQ ID NO: 549679 - DNA, 25 bp, Homo sapien
gctattttaaaagtgctggctgcag

SEQ ID NO: 549680 - DNA, 25 bp, Homo sapien
ggattaagccaaccctttacaactg

SEQ ID NO: 549681 - DNA, 25 bp, Homo sapien
gcccagaccgtaatggccatttctt

SEQ ID NO: 549682 - DNA, 25 bp, Homo sapien
attcacctctgtaatttaatccgtt

SEQ ID NO: 549683 - DNA, 25 bp, Homo sapien
taatccgtttctcttggattgtctg

SEQ ID NO: 549684 - DNA, 25 bp, Homo sapien
cttggattgtctggacgtgcccgat

SEQ ID NO: 549685 - DNA, 25 bp, Homo sapien
gttctttcttttgctcagtggagtt

SEQ ID NO: 549686 - DNA, 25 bp, Homo sapien
gtgggtggattttcaccgaccaatg

SEQ ID NO: 549687 - DNA, 25 bp, Homo sapien
ttttcaccgaccaatgatatcctct

SEQ ID NO: 549688 - DNA, 25 bp, Homo sapien
aatgatatcctcttctgacggtcac

SEQ ID NO: 549689 - DNA, 25 bp, Homo sapien
ttctttccacttcactggagtccag

SEQ ID NO: 549690 - DNA, 25 bp, Homo sapien
tggagtccagtattctgtaccacat

SEQ ID NO: 549691 - DNA, 25 bp, Homo sapien
tattctgtaccacatcacgcaacgt

SEQ ID NO: 549692 - DNA, 25 bp, Homo sapien
cacgcaacgtgttatcttgtggtgt

SEQ ID NO: 549693 - DNA, 25 bp, Homo sapien
tattttgggttctgcgacattgtga

SEQ ID NO: 549694 - DNA, 25 bp, Homo sapien
gttgttgtgcaatacttaattcaga

SEQ ID NO: 549695 - DNA, 25 bp, Homo sapien
ttaattcagacatgtaccacaagtt

SEQ ID NO: 549696 - DNA, 25 bp, Homo sapien
gggtctaggcatcatgcttttgtca

SEQ ID NO: 549697 - DNA, 25 bp, Homo sapien
gcttttgtcagcatactcttgagct

SEQ ID NO: 549698 - DNA, 25 bp, Homo sapien
tactcttgagcttttaagtctacta

SEQ ID NO: 549699 - DNA, 25 bp, Homo sapien
aagtctactatgtctgaactgtggt

SEQ ID NO: 549700 - DNA, 25 bp, Homo sapien
gaactgtggtttcttgtttatcctt

SEQ ID NO: 549701 - DNA, 25 bp, Homo sapien
tatccttttttccttagttggactg

SEQ ID NO: 549702 - DNA, 25 bp, Homo sapien
gactgtaatgtatggtctgtcaacc

SEQ ID NO: 549703 - DNA, 25 bp, Homo sapien
ggtctgtcaacctgtgaatctttaa

SEQ ID NO: 549704 - DNA, 25 bp, Homo sapien
gctaggcccatgctttggttcaaag

SEQ ID NO: 549705 - DNA, 25 bp, Homo sapien
ttggagaacatcttcttgctccttt

SEQ ID NO: 549706 - DNA, 25 bp, Homo sapien
cttgctccttttccggaaacgagat

SEQ ID NO: 549707 - DNA, 25 bp, Homo sapien
atggacacagagtcccagacgtcat

SEQ ID NO: 549708 - DNA, 25 bp, Homo sapien
gacgtcatcctttggaccaggaaga

SEQ ID NO: 549709 - DNA, 25 bp, Homo sapien
ggaagaaacaggctcctgccagcac

SEQ ID NO: 549710 - DNA, 25 bp, Homo sapien
gacagcaacgaaaatgttcccacgg

SEQ ID NO: 549711 - DNA, 25 bp, Homo sapien
gttcccacggagatcaggatgactt

SEQ ID NO: 549712 - DNA, 25 bp, Homo sapien
acttgctgaagctcagtggaggcta

SEQ ID NO: 549713 - DNA, 25 bp, Homo sapien
catcctgctgcccaacaagaagaag

SEQ ID NO: 549714 - DNA, 25 bp, Homo sapien
gtctccgatttcctgaacggtctaa

SEQ ID NO: 549715 - DNA, 25 bp, Homo sapien
gggaagaaacgacagcctcacttct

SEQ ID NO: 549716 - DNA, 25 bp, Homo sapien
aacgacagcctcacttctgtatgga

SEQ ID NO: 549717 - DNA, 25 bp, Homo sapien
gcctcacttctgtatggactgctga

SEQ ID NO: 549718 - DNA, 25 bp, Homo sapien
tctgtatggactgctgatgtggcct

SEQ ID NO: 549719 - DNA, 25 bp, Homo sapien
ctgatgtggcctgccatcctgttca

SEQ ID NO: 549720 - DNA, 25 bp, Homo sapien
gccatcctgttcagcgggcattgtc

SEQ ID NO: 549721 - DNA, 25 bp, Homo sapien
cagcgggcattgtctttggagcagc

SEQ ID NO: 549722 - DNA, 25 bp, Homo sapien
gcattgtctttggagcagcaggaga

SEQ ID NO: 549723 - DNA, 25 bp, Homo sapien
tcgcccctcctgttgggtaagggtg

SEQ ID NO: 549724 - DNA, 25 bp, Homo sapien
tgagtgtgacttgtgctgaaaacct

SEQ ID NO: 549725 - DNA, 25 bp, Homo sapien
gctgaaaacctggttcatatataat

SEQ ID NO: 549726 - DNA, 25 bp, Homo sapien
gaagtcaagtcatgccaataaattt

SEQ ID NO: 549727 - DNA, 25 bp, Homo sapien
gccaataaattttaacatccaaatg

SEQ ID NO: 549728 - DNA, 25 bp, Homo sapien
gaatttataaggctcatgatatagg

SEQ ID NO: 549729 - DNA, 25 bp, Homo sapien
atagcataggaattcagaactgggc

SEQ ID NO: 549730 - DNA, 25 bp, Homo sapien
agaactgggctctagaatcagattt

SEQ ID NO: 549731 - DNA, 25 bp, Homo sapien
agttgaattctagatctgccattta

SEQ ID NO: 549732 - DNA, 25 bp, Homo sapien
gaattctagatctgccatttattag

SEQ ID NO: 549733 - DNA, 25 bp, Homo sapien
ctgccatttattagctgtgggattt

SEQ ID NO: 549734 - DNA, 25 bp, Homo sapien
tctgatataaattctggtacttgac

SEQ ID NO: 549735 - DNA, 25 bp, Homo sapien
aaattctggtacttgacaccaaagt

SEQ ID NO: 549736 - DNA, 25 bp, Homo sapien
gtacttgacaccaaagtttgaagtc

SEQ ID NO: 549737 - DNA, 25 bp, Homo sapien
ggttaggacactaggttcttcccag

SEQ ID NO: 549738 - DNA, 25 bp, Homo sapien
aggttcttcccagcatatgagtgag

SEQ ID NO: 549739 - DNA, 25 bp, Homo sapien
tttgggctcctctactgcacaaggg

SEQ ID NO: 549740 - DNA, 25 bp, Homo sapien
agtccccaagtctactctgattgat

SEQ ID NO: 549741 - DNA, 25 bp, Homo sapien
tgattgattgtcatgggcacccaca

SEQ ID NO: 549742 - DNA, 25 bp, Homo sapien
atgggcacccacacagatcaggaca

SEQ ID NO: 549743 - DNA, 25 bp, Homo sapien
cagatcaggacaccctttgaatttt

SEQ ID NO: 549744 - DNA, 25 bp, Homo sapien
aaaaccttgggatctcaatgtgcaa

SEQ ID NO: 549745 - DNA, 25 bp, Homo sapien
aatgtgcaaactccttggactccag

SEQ ID NO: 549746 - DNA, 25 bp, Homo sapien
ttggactccagacccctgtctggtt

SEQ ID NO: 549747 - DNA, 25 bp, Homo sapien
tggcactcccagcagtgtgtggttt

SEQ ID NO: 549748 - DNA, 25 bp, Homo sapien
ctttcctctgacttaactagagaaa

SEQ ID NO: 549749 - DNA, 25 bp, Homo sapien
gaagctgcttttgaaccagactata

SEQ ID NO: 549750 - DNA, 25 bp, Homo sapien
caggaaacatttctaaggacctgaa

SEQ ID NO: 549751 - DNA, 25 bp, Homo sapien
aagagagcctggacacagcagcagt

SEQ ID NO: 549752 - DNA, 25 bp, Homo sapien
cagcagcagttgtccaggtgggcat

SEQ ID NO: 549753 - DNA, 25 bp, Homo sapien
ccaggtgggcataagcaggaatcag

SEQ ID NO: 549754 - DNA, 25 bp, Homo sapien
gcataagcaggaatcagagccacag

SEQ ID NO: 549755 - DNA, 25 bp, Homo sapien
aagccacagtccttctggaagccag

SEQ ID NO: 549756 - DNA, 25 bp, Homo sapien
agtccttctggaagccagacccgaa

SEQ ID NO: 549757 - DNA, 25 bp, Homo sapien
gaagccagacccgaagccacagtag

SEQ ID NO: 549758 - DNA, 25 bp, Homo sapien
acccgaagccacagtagcagtgcca

SEQ ID NO: 549759 - DNA, 25 bp, Homo sapien
gttagacacatgaacacgttagata

SEQ ID NO: 549760 - DNA, 25 bp, Homo sapien
gttagataacctacttattacacaa

SEQ ID NO: 549761 - DNA, 25 bp, Homo sapien
aaatctcatgttccttatgtcccag

SEQ ID NO: 549762 - DNA, 25 bp, Homo sapien
ggacatatttgcttcagttactctg

SEQ ID NO: 549763 - DNA, 25 bp, Homo sapien
ttgcttcagttactctgacagtttg

SEQ ID NO: 549764 - DNA, 25 bp, Homo sapien
gacagtttgggttaacttgctagtt

SEQ ID NO: 549765 - DNA, 25 bp, Homo sapien
gcagctagcaaatttgggacatgta

SEQ ID NO: 549766 - DNA, 25 bp, Homo sapien
aaagaaccaacagattacttctctg

SEQ ID NO: 549767 - DNA, 25 bp, Homo sapien
taattcctaaggaactgttcaccta

SEQ ID NO: 549768 - DNA, 25 bp, Homo sapien
ggaactgttcacctaatcagtactt

SEQ ID NO: 549769 - DNA, 25 bp, Homo sapien
ctggctagacagttcataataaaag

SEQ ID NO: 549770 - DNA, 25 bp, Homo sapien
tattgctgcttgattatttgatttt

SEQ ID NO: 549771 - DNA, 25 bp, Homo sapien
tttacatcagagctttataacacga

SEQ ID NO: 549772 - DNA, 25 bp, Homo sapien
tcagagctttataacacgaactttt

SEQ ID NO: 549773 - DNA, 25 bp, Homo sapien
aacacgaacttttgtacagaattgt

SEQ ID NO: 549774 - DNA, 25 bp, Homo sapien
cagaattgtgagttgtgaccatgta

SEQ ID NO: 549775 - DNA, 25 bp, Homo sapien
gtgagttgtgaccatgtaacatgag

SEQ ID NO: 549776 - DNA, 25 bp, Homo sapien
acatgagaggttttgctagggccta

SEQ ID NO: 549777 - DNA, 25 bp, Homo sapien
gaggttttgctagggcctattattt

SEQ ID NO: 549778 - DNA, 25 bp, Homo sapien
gagtttactgtaatgtgaaattttc

SEQ ID NO: 549779 - DNA, 25 bp, Homo sapien
gaatgatttgctgaattcattacaa

SEQ ID NO: 549780 - DNA, 25 bp, Homo sapien
accctgttatgtcactttttgatta

SEQ ID NO: 549781 - DNA, 25 bp, Homo sapien
ccccttgatggatgtgctgttgatt

SEQ ID NO: 549782 - DNA, 25 bp, Homo sapien
tgatggatgtgctgttgattgtaat

SEQ ID NO: 549783 - DNA, 25 bp, Homo sapien
gattgtaatatacttctgttgccaa

SEQ ID NO: 549784 - DNA, 25 bp, Homo sapien
ttgtaatatacttctgttgccaaat

SEQ ID NO: 549785 - DNA, 25 bp, Homo sapien
taatggtactgtttaattttccata

SEQ ID NO: 549786 - DNA, 25 bp, Homo sapien
gtaatccatcagaacgtgagctcct

SEQ ID NO: 549787 - DNA, 25 bp, Homo sapien
taaattgtagacttacgtatttgtc

SEQ ID NO: 549788 - DNA, 25 bp, Homo sapien
ttacgtatttgtctaaaggtttgat

SEQ ID NO: 549789 - DNA, 25 bp, Homo sapien
taaaggtttgatgaagcagggccaa

SEQ ID NO: 549790 - DNA, 25 bp, Homo sapien
gtgagctccttgtgcttccagtgac

SEQ ID NO: 549791 - DNA, 25 bp, Homo sapien
ttccagtgacaagcgggccacagtg

SEQ ID NO: 549792 - DNA, 25 bp, Homo sapien
atcttgcttcctccgtttcattttc

SEQ ID NO: 549793 - DNA, 25 bp, Homo sapien
tttcattttcccaatccgagctgca

SEQ ID NO: 549794 - DNA, 25 bp, Homo sapien
gaaaccgaaaacaaagcacagaaca

SEQ ID NO: 549795 - DNA, 25 bp, Homo sapien
agcacagaacaagcagacggtcact

SEQ ID NO: 549796 - DNA, 25 bp, Homo sapien
atggcccctctaccttagaaaggca

SEQ ID NO: 549797 - DNA, 25 bp, Homo sapien
cagggtcccagtggagctgacacat

SEQ ID NO: 549798 - DNA, 25 bp, Homo sapien
cagtggagctgacacatcctgacct

SEQ ID NO: 549799 - DNA, 25 bp, Homo sapien
atcctgacctcttgccagccattgg

SEQ ID NO: 549800 - DNA, 25 bp, Homo sapien
ttggcctttttattcagtgcctgat

SEQ ID NO: 549801 - DNA, 25 bp, Homo sapien
attcagtgcctgatctggccctcat

SEQ ID NO: 549802 - DNA, 25 bp, Homo sapien
gaaaggcaatgctccacatgcctac

SEQ ID NO: 549803 - DNA, 25 bp, Homo sapien
gcttggaagtgggttccctggccac

SEQ ID NO: 549804 - DNA, 25 bp, Homo sapien
ttggaagtgggttccctggccaccg

SEQ ID NO: 549805 - DNA, 25 bp, Homo sapien
tggaagtgggttccctggccaccgg

SEQ ID NO: 549806 - DNA, 25 bp, Homo sapien
ggttgacctctctcgctagcagggc

SEQ ID NO: 549807 - DNA, 25 bp, Homo sapien
gttgacctctctcgctagcagggcc

SEQ ID NO: 549808 - DNA, 25 bp, Homo sapien
tgacctctctcgctagcagggccca

SEQ ID NO: 549809 - DNA, 25 bp, Homo sapien
cgcgtcttccatcccctctaggatt

SEQ ID NO: 549810 - DNA, 25 bp, Homo sapien
tctaggattcccattgtcccctact

SEQ ID NO: 549811 - DNA, 25 bp, Homo sapien
taggattcccattgtcccctactcc

SEQ ID NO: 549812 - DNA, 25 bp, Homo sapien
ggattcccattgtcccctactccag

SEQ ID NO: 549813 - DNA, 25 bp, Homo sapien
cagcactaggcaggcacccccagcc

SEQ ID NO: 549814 - DNA, 25 bp, Homo sapien
gagagtgtgccattgcagagagact

SEQ ID NO: 549815 - DNA, 25 bp, Homo sapien
gtgtgccattgcagagagactccat

SEQ ID NO: 549816 - DNA, 25 bp, Homo sapien
gtgccattgcagagagactccatcc

SEQ ID NO: 549817 - DNA, 25 bp, Homo sapien
aaaaaaagacagctgtcccaggcca

SEQ ID NO: 549818 - DNA, 25 bp, Homo sapien
aagggtacttgggagagcccctcat

SEQ ID NO: 549819 - DNA, 25 bp, Homo sapien
ggtacttgggagagcccctcatgga

SEQ ID NO: 549820 - DNA, 25 bp, Homo sapien
ttgggagagcccctcatggagaacc

SEQ ID NO: 549821 - DNA, 25 bp, Homo sapien
cctcatggagaacctagtttagacc

SEQ ID NO: 549822 - DNA, 25 bp, Homo sapien
gaacctagtttagaccaagtagcag

SEQ ID NO: 549823 - DNA, 25 bp, Homo sapien
gtttagaccaagtagcagaagctgt

SEQ ID NO: 549824 - DNA, 25 bp, Homo sapien
gcagaagctgtggtcataacaaaac

SEQ ID NO: 549825 - DNA, 25 bp, Homo sapien
caccgtcctcatcataaagtctctg

SEQ ID NO: 549826 - DNA, 25 bp, Homo sapien
gtcctcatcataaagtctctgcgtt

SEQ ID NO: 549827 - DNA, 25 bp, Homo sapien
ctcatcataaagtctctgcgttctg

SEQ ID NO: 549828 - DNA, 25 bp, Homo sapien
gaccagccgctcctcaagcactggg

SEQ ID NO: 549829 - DNA, 25 bp, Homo sapien
actgggaggcccaagagccaatcca

SEQ ID NO: 549830 - DNA, 25 bp, Homo sapien
gggaggcccaagagccaatccagat

SEQ ID NO: 549831 - DNA, 25 bp, Homo sapien
ggcccaagagccaatccagatgcct

SEQ ID NO: 549832 - DNA, 25 bp, Homo sapien
atccagatgcctgagacaacggaga

SEQ ID NO: 549833 - DNA, 25 bp, Homo sapien
gatgcctgagacaacggagactgtg

SEQ ID NO: 549834 - DNA, 25 bp, Homo sapien
gagacaacggagactgtgctctgtg

SEQ ID NO: 549835 - DNA, 25 bp, Homo sapien
acaacggagactgtgctctgtgccc

SEQ ID NO: 549836 - DNA, 25 bp, Homo sapien
cttacaccaataccgcacgcaagag

SEQ ID NO: 549837 - DNA, 25 bp, Homo sapien
acaccaataccgcacgcaagagagt

SEQ ID NO: 549838 - DNA, 25 bp, Homo sapien
gagcacactcaccactcagtcagga

SEQ ID NO: 549839 - DNA, 25 bp, Homo sapien
cactcaccactcagtcaggacatgg

SEQ ID NO: 549840 - DNA, 25 bp, Homo sapien
ggacatggacttggaactcaggatg

SEQ ID NO: 549841 - DNA, 25 bp, Homo sapien
gtcatagacagacccaccagtagga

SEQ ID NO: 549842 - DNA, 25 bp, Homo sapien
atagacagacccaccagtaggaact

SEQ ID NO: 549843 - DNA, 25 bp, Homo sapien
gacccaccagtaggaactgtcacag

SEQ ID NO: 549844 - DNA, 25 bp, Homo sapien
ctgtcacagaatggcctgctgaact

SEQ ID NO: 549845 - DNA, 25 bp, Homo sapien
gtggagaggtctgaataaaccgtct

SEQ ID NO: 549846 - DNA, 25 bp, Homo sapien
ggtctgaataaaccgtctgtgtcat

SEQ ID NO: 549847 - DNA, 25 bp, Homo sapien
ctttttgtgggcgttcaagatggta

SEQ ID NO: 549848 - DNA, 25 bp, Homo sapien
aagatggtattgtgcccaccagtca

SEQ ID NO: 549849 - DNA, 25 bp, Homo sapien
tggtattgtgcccaccagtcagatc

SEQ ID NO: 549850 - DNA, 25 bp, Homo sapien
ccaccagtcagatcctgtgttttga

SEQ ID NO: 549851 - DNA, 25 bp, Homo sapien
atcctgtgttttgagtcccaaaggc

SEQ ID NO: 549852 - DNA, 25 bp, Homo sapien
tttgagtcccaaaggccatgccaag

SEQ ID NO: 549853 - DNA, 25 bp, Homo sapien
aaggccatgccaaggattggctttg

SEQ ID NO: 549854 - DNA, 25 bp, Homo sapien
ggctttgggaggctttaatcaccaa

SEQ ID NO: 549855 - DNA, 25 bp, Homo sapien
gaggctttaatcaccaacccatcaa

SEQ ID NO: 549856 - DNA, 25 bp, Homo sapien
tttaatcaccaacccatcaacatca

SEQ ID NO: 549857 - DNA, 25 bp, Homo sapien
cccaggccggttcaaataaatgtat

SEQ ID NO: 549858 - DNA, 25 bp, Homo sapien
tcttattttaagctgcagtaatcac

SEQ ID NO: 549859 - DNA, 25 bp, Homo sapien
gctgcagtaatcactgtacatttga

SEQ ID NO: 549860 - DNA, 25 bp, Homo sapien
atctgtacttcccttgaagcagctt

SEQ ID NO: 549861 - DNA, 25 bp, Homo sapien
tacttcccttgaagcagctttgctt

SEQ ID NO: 549862 - DNA, 25 bp, Homo sapien
gcagctttgcttattacagccacac

SEQ ID NO: 549863 - DNA, 25 bp, Homo sapien
ttgcttattacagccacacctgcat

SEQ ID NO: 549864 - DNA, 25 bp, Homo sapien
gcatctgttttgactagcccacata

SEQ ID NO: 549865 - DNA, 25 bp, Homo sapien
cccacataacctacacatttttcat

SEQ ID NO: 549866 - DNA, 25 bp, Homo sapien
ttttcatccaaagctatcccattac

SEQ ID NO: 549867 - DNA, 25 bp, Homo sapien
atcccattaccttatttatgtccat

SEQ ID NO: 549868 - DNA, 25 bp, Homo sapien
tattttcatatatagtatctgccaa

SEQ ID NO: 549869 - DNA, 25 bp, Homo sapien
tgagctcacaacttcattcccttac

SEQ ID NO: 549870 - DNA, 25 bp, Homo sapien
tcccttacacacttcagtgacatca

SEQ ID NO: 549871 - DNA, 25 bp, Homo sapien
acacacttcagtgacatcagtgctt

SEQ ID NO: 549872 - DNA, 25 bp, Homo sapien
ggaactgttcatcttgatgaggatc

SEQ ID NO: 549873 - DNA, 25 bp, Homo sapien
cggcggtgattatgggtgtacatat

SEQ ID NO: 549874 - DNA, 25 bp, Homo sapien
tttttgtcatcctgagatacttcta

SEQ ID NO: 549875 - DNA, 25 bp, Homo sapien
cctgagatacttctaatttcattgt

SEQ ID NO: 549876 - DNA, 25 bp, Homo sapien
gtggttttccctggaattcattaat

SEQ ID NO: 549877 - DNA, 25 bp, Homo sapien
ttcattaattgtttgctttggacat

SEQ ID NO: 549878 - DNA, 25 bp, Homo sapien
tttggacatgtggaaagagccttac

SEQ ID NO: 549879 - DNA, 25 bp, Homo sapien
gtggaaagagccttactaataaaat

SEQ ID NO: 549880 - DNA, 25 bp, Homo sapien
cacgtgcagctcataggtcaggttc

SEQ ID NO: 549881 - DNA, 25 bp, Homo sapien
ataggtcaggttcgccccagggctt

SEQ ID NO: 549882 - DNA, 25 bp, Homo sapien
caggtcagctctagttgcctcggtt

SEQ ID NO: 549883 - DNA, 25 bp, Homo sapien
ttgcctcggttctttcttcaccagt

SEQ ID NO: 549884 - DNA, 25 bp, Homo sapien
tcttcaccagtctcagagacaggcc

SEQ ID NO: 549885 - DNA, 25 bp, Homo sapien
gagacaggcctgacagtgactctgc

SEQ ID NO: 549886 - DNA, 25 bp, Homo sapien
tgacagtgactctgcatgccccatg

SEQ ID NO: 549887 - DNA, 25 bp, Homo sapien
atgccccatgctgatgctgactgag

SEQ ID NO: 549888 - DNA, 25 bp, Homo sapien
tttgggcttccacattaaaggtgta

SEQ ID NO: 549889 - DNA, 25 bp, Homo sapien
ggcataaggttcaaggccattgaca

SEQ ID NO: 549890 - DNA, 25 bp, Homo sapien
aaggccattgacatgcactgcaggt

SEQ ID NO: 549891 - DNA, 25 bp, Homo sapien
aatggcaggcagtaagtgcagcaga

SEQ ID NO: 549892 - DNA, 25 bp, Homo sapien
tgcagcagaatctggcaggactgat

SEQ ID NO: 549893 - DNA, 25 bp, Homo sapien
atctggcaggactgatatttgtgca

SEQ ID NO: 549894 - DNA, 25 bp, Homo sapien
tgatatttgtgcagtgggcctgcca

SEQ ID NO: 549895 - DNA, 25 bp, Homo sapien
acaccctctgcctaggaggctgtat

SEQ ID NO: 549896 - DNA, 25 bp, Homo sapien
aggaggctgtatgccagagctcatc

SEQ ID NO: 549897 - DNA, 25 bp, Homo sapien
gtatgccagagctcatctctagcaa

SEQ ID NO: 549898 - DNA, 25 bp, Homo sapien
gagctcatctctagcaaggaattta

SEQ ID NO: 549899 - DNA, 25 bp, Homo sapien
gaggaagcaggatcccactgagcac

SEQ ID NO: 549900 - DNA, 25 bp, Homo sapien
actgagcacctcttgcagaaggcaa

SEQ ID NO: 549901 - DNA, 25 bp, Homo sapien
gaactccacaaggtcgttggaatga

SEQ ID NO: 549902 - DNA, 25 bp, Homo sapien
aggacccaccagatgctaagatgct

SEQ ID NO: 549903 - DNA, 25 bp, Homo sapien
caccagatgctaagatgctacagat

SEQ ID NO: 549904 - DNA, 25 bp, Homo sapien
aacaaattgcggctctgcttcaagg

SEQ ID NO: 549905 - DNA, 25 bp, Homo sapien
ctctgcttcaaggacttctgcaaga

SEQ ID NO: 549906 - DNA, 25 bp, Homo sapien
aaatgtgaggatgcgctgcggaaaa

SEQ ID NO: 549907 - DNA, 25 bp, Homo sapien
ggatgcgctgcggaaaaataaggcc

SEQ ID NO: 549908 - DNA, 25 bp, Homo sapien
ataaggccctgattgggccggacca

SEQ ID NO: 549909 - DNA, 25 bp, Homo sapien
ttgggccggaccagaaggagtacca

SEQ ID NO: 549910 - DNA, 25 bp, Homo sapien
accagaaggagtaccaccgtgagct

SEQ ID NO: 549911 - DNA, 25 bp, Homo sapien
agtaccaccgtgagctggagcgcaa

SEQ ID NO: 549912 - DNA, 25 bp, Homo sapien
tgagctggagcgcaactactgccgc

SEQ ID NO: 549913 - DNA, 25 bp, Homo sapien
aggctgtacagcacaaccttcagca

SEQ ID NO: 549914 - DNA, 25 bp, Homo sapien
tctcccgggcttctgaaagcatcac

SEQ ID NO: 549915 - DNA, 25 bp, Homo sapien
aaagcatcaccgtctgcacgatgat

SEQ ID NO: 549916 - DNA, 25 bp, Homo sapien
ccgtctgcacgatgatctccagtgt

SEQ ID NO: 549917 - DNA, 25 bp, Homo sapien
tgtgtccagaaccactaggcttgcc

SEQ ID NO: 549918 - DNA, 25 bp, Homo sapien
actaggcttgcctcggttgccaggt

SEQ ID NO: 549919 - DNA, 25 bp, Homo sapien
accaaggcctcgtgttccatttcat

SEQ ID NO: 549920 - DNA, 25 bp, Homo sapien
tccatttcatccttggtcttgtcca

SEQ ID NO: 549921 - DNA, 25 bp, Homo sapien
tgtccacgcggtctgaggtttgctt

SEQ ID NO: 549922 - DNA, 25 bp, Homo sapien
aggtttgcttccagtgtgtgacgct

SEQ ID NO: 549923 - DNA, 25 bp, Homo sapien
agcgcacgttctctggattcccaaa

SEQ ID NO: 549924 - DNA, 25 bp, Homo sapien
tacataattacaacacagtgtggtg

SEQ ID NO: 549925 - DNA, 25 bp, Homo sapien
gcctgtaactacttactgtctctac

SEQ ID NO: 549926 - DNA, 25 bp, Homo sapien
acttactgtctctacttggactcat

SEQ ID NO: 549927 - DNA, 25 bp, Homo sapien
tacttggactcattccatggcaatg

SEQ ID NO: 549928 - DNA, 25 bp, Homo sapien
aaaaatgcccctccagagatcttac

SEQ ID NO: 549929 - DNA, 25 bp, Homo sapien
gagatcttacaggtttctatttatc

SEQ ID NO: 549930 - DNA, 25 bp, Homo sapien
ttatcataacactcaccatgcttta

SEQ ID NO: 549931 - DNA, 25 bp, Homo sapien
aacactcaccatgctttatattttt

SEQ ID NO: 549932 - DNA, 25 bp, Homo sapien
gttttgggaattctcttagcattag

SEQ ID NO: 549933 - DNA, 25 bp, Homo sapien
ttagcattagacagtgaacttccat

SEQ ID NO: 549934 - DNA, 25 bp, Homo sapien
gaacttccatgcagatgaccacatc

SEQ ID NO: 549935 - DNA, 25 bp, Homo sapien
cagaagcctgtcctcagtaatgtga

SEQ ID NO: 549936 - DNA, 25 bp, Homo sapien
gcctgtcctcagtaatgtgactata

SEQ ID NO: 549937 - DNA, 25 bp, Homo sapien
gtgactatagtgagctttagcaaaa

SEQ ID NO: 549938 - DNA, 25 bp, Homo sapien
gacatcttacttatcttttaccctt

SEQ ID NO: 549939 - DNA, 25 bp, Homo sapien
tacttatcttttaccctttcctcag

SEQ ID NO: 549940 - DNA, 25 bp, Homo sapien
gagacagaaattttaaagtcctcct

SEQ ID NO: 549941 - DNA, 25 bp, Homo sapien
aagtcctccttattcaagattttga

SEQ ID NO: 549942 - DNA, 25 bp, Homo sapien
tttgaaattcttagcctgggagtgc

SEQ ID NO: 549943 - DNA, 25 bp, Homo sapien
gctttctccagaatgaagagtccca

SEQ ID NO: 549944 - DNA, 25 bp, Homo sapien
gagtcccaatttgtatatcagtgtt

SEQ ID NO: 549945 - DNA, 25 bp, Homo sapien
ggtgagattttcgtggactatttta

SEQ ID NO: 549946 - DNA, 25 bp, Homo sapien
gcacatatttgtacaaagagtttaa

SEQ ID NO: 549947 - DNA, 25 bp, Homo sapien
caaagagtttaaggaatggtggctg

SEQ ID NO: 549948 - DNA, 25 bp, Homo sapien
aaatgtttactgacgaggccgggcg

SEQ ID NO: 549949 - DNA, 25 bp, Homo sapien
aatgtttactgacgaggccgggcgt

SEQ ID NO: 549950 - DNA, 25 bp, Homo sapien
aaaattagccatgcgaagtagcagg

SEQ ID NO: 549951 - DNA, 25 bp, Homo sapien
aattagccatgcgaagtagcaggtg

SEQ ID NO: 549952 - DNA, 25 bp, Homo sapien
attagccatgcgaagtagcaggtgc

SEQ ID NO: 549953 - DNA, 25 bp, Homo sapien
ttagccatgcgaagtagcaggtgcc

SEQ ID NO: 549954 - DNA, 25 bp, Homo sapien
tagccatgcgaagtagcaggtgcct

SEQ ID NO: 549955 - DNA, 25 bp, Homo sapien
agccatgcgaagtagcaggtgcctg

SEQ ID NO: 549956 - DNA, 25 bp, Homo sapien
gccatgcgaagtagcaggtgcctgt

SEQ ID NO: 549957 - DNA, 25 bp, Homo sapien
ggcagagatattcagaggtctttta

SEQ ID NO: 549958 - DNA, 25 bp, Homo sapien
cgtgagggctctcttaaaattttct

SEQ ID NO: 549959 - DNA, 25 bp, Homo sapien
aattttcttcacaagcggttatcca

SEQ ID NO: 549960 - DNA, 25 bp, Homo sapien
tcttcacaagcggttatccagtcgt

SEQ ID NO: 549961 - DNA, 25 bp, Homo sapien
acaagcggttatccagtcgtgcccc

SEQ ID NO: 549962 - DNA, 25 bp, Homo sapien
gggatctgagtcgtaccctcttgtt

SEQ ID NO: 549963 - DNA, 25 bp, Homo sapien
tgagtcgtaccctcttgtttttctc

SEQ ID NO: 549964 - DNA, 25 bp, Homo sapien
ctcttgtttttctctgagtcagtct

SEQ ID NO: 549965 - DNA, 25 bp, Homo sapien
tctgagtcagtcttaaggtgaaatg

SEQ ID NO: 549966 - DNA, 25 bp, Homo sapien
gaaatgaagtgtggcccagtggctc

SEQ ID NO: 549967 - DNA, 25 bp, Homo sapien
tcctcactgtcgcttctctagtttt

SEQ ID NO: 549968 - DNA, 25 bp, Homo sapien
acagatgggtgttggctatttagag

SEQ ID NO: 549969 - DNA, 25 bp, Homo sapien
ggctatttagagcttccctcatggg

SEQ ID NO: 549970 - DNA, 25 bp, Homo sapien
ggtgtggtaactctaagaatgtgcc

SEQ ID NO: 549971 - DNA, 25 bp, Homo sapien
agaatgtgccacaatgtcagccctg

SEQ ID NO: 549972 - DNA, 25 bp, Homo sapien
atgtcagccctgtagaaagataaat

SEQ ID NO: 549973 - DNA, 25 bp, Homo sapien
aaatggaatgggttctgtattgtcc

SEQ ID NO: 549974 - DNA, 25 bp, Homo sapien
gttctgtattgtccctagttgttat

SEQ ID NO: 549975 - DNA, 25 bp, Homo sapien
gtttaggaatgtcatgaagcagtca

SEQ ID NO: 549976 - DNA, 25 bp, Homo sapien
gaagcagtcatatatcttttccatc

SEQ ID NO: 549977 - DNA, 25 bp, Homo sapien
tatcttttccatcaggtgcagtctc

SEQ ID NO: 549978 - DNA, 25 bp, Homo sapien
ccatcaggtgcagtctccctggttg

SEQ ID NO: 549979 - DNA, 25 bp, Homo sapien
tggctgttaccaggacaaccggagg

SEQ ID NO: 549980 - DNA, 25 bp, Homo sapien
ggctgttaccaggacaaccggaggc

SEQ ID NO: 549981 - DNA, 25 bp, Homo sapien
gctgttaccaggacaaccggaggcg

SEQ ID NO: 549982 - DNA, 25 bp, Homo sapien
ctgttaccaggacaaccggaggcga

SEQ ID NO: 549983 - DNA, 25 bp, Homo sapien
tgttaccaggacaaccggaggcgat

SEQ ID NO: 549984 - DNA, 25 bp, Homo sapien
gttaccaggacaaccggaggcgatt

SEQ ID NO: 549985 - DNA, 25 bp, Homo sapien
ttaccaggacaaccggaggcgattg

SEQ ID NO: 549986 - DNA, 25 bp, Homo sapien
ccaggacaaccggaggcgattgacc

SEQ ID NO: 549987 - DNA, 25 bp, Homo sapien
caggacaaccggaggcgattgaccg

SEQ ID NO: 549988 - DNA, 25 bp, Homo sapien
aggacaaccggaggcgattgaccgt

SEQ ID NO: 549989 - DNA, 25 bp, Homo sapien
ggacaaccggaggcgattgaccgtt

SEQ ID NO: 549990 - DNA, 25 bp, Homo sapien
ggttcacttgcttgttgtccctcgt

SEQ ID NO: 549991 - DNA, 25 bp, Homo sapien
ttgttgtccctcgtccttgtcatat

SEQ ID NO: 549992 - DNA, 25 bp, Homo sapien
gtccttgtcatatccttttaactag

SEQ ID NO: 549993 - DNA, 25 bp, Homo sapien
tttaactaggcatctcagagaagca

SEQ ID NO: 549994 - DNA, 25 bp, Homo sapien
gaccctcaggatggcatgagaggtc

SEQ ID NO: 549995 - DNA, 25 bp, Homo sapien
tgagaggtcctcaatcccaagtgtg

SEQ ID NO: 549996 - DNA, 25 bp, Homo sapien
tcaatcccaagtgtggaactgtccc

SEQ ID NO: 549997 - DNA, 25 bp, Homo sapien
gggcctgggactccatgtgacaact

SEQ ID NO: 549998 - DNA, 25 bp, Homo sapien
tgacaactggcccaggagcttctga

SEQ ID NO: 549999 - DNA, 25 bp, Homo sapien
caggagcttctgatgtcacacagaa

SEQ ID NO: 550000 - DNA, 25 bp, Homo sapien
gtcacacagaattctgcagtcccaa

SEQ ID NO: 550001 - DNA, 25 bp, Homo sapien
ggtattacagatgcttgccaccacg

SEQ ID NO: 550002 - DNA, 25 bp, Homo sapien
gcctggcccactttagctattttta

SEQ ID NO: 550003 - DNA, 25 bp, Homo sapien
ataggacctattgttttggattact

SEQ ID NO: 550004 - DNA, 25 bp, Homo sapien
ggacctattgttttggattactatc

SEQ ID NO: 550005 - DNA, 25 bp, Homo sapien
acctattgttttggattactatctg

SEQ ID NO: 550006 - DNA, 25 bp, Homo sapien
attgttttggattactatctgagaa

SEQ ID NO: 550007 - DNA, 25 bp, Homo sapien
gattactatctgagaatttcatgga

SEQ ID NO: 550008 - DNA, 25 bp, Homo sapien
tttcatggattcactcctgggtata

SEQ ID NO: 550009 - DNA, 25 bp, Homo sapien
catggattcactcctgggtatagga

SEQ ID NO: 550010 - DNA, 25 bp, Homo sapien
attcactcctgggtataggagataa

SEQ ID NO: 550011 - DNA, 25 bp, Homo sapien
ggagataagaatacgtttaattcat

SEQ ID NO: 550012 - DNA, 25 bp, Homo sapien
gaattaagttcacctgataactcaa

SEQ ID NO: 550013 - DNA, 25 bp, Homo sapien
aagttcacctgataactcaaaagtg

SEQ ID NO: 550014 - DNA, 25 bp, Homo sapien
tataatacaattctgttttaatctg

SEQ ID NO: 550015 - DNA, 25 bp, Homo sapien
atctgtgtattctttttctcctact

SEQ ID NO: 550016 - DNA, 25 bp, Homo sapien
ggcatgaagagaaatacgccttttt

SEQ ID NO: 550017 - DNA, 25 bp, Homo sapien
aaacccaaaattatgtgaacaagca

SEQ ID NO: 550018 - DNA, 25 bp, Homo sapien
aatttcattttaggctattggctac

SEQ ID NO: 550019 - DNA, 25 bp, Homo sapien
cattttaggctattggctactgagt

SEQ ID NO: 550020 - DNA, 25 bp, Homo sapien
taggctattggctactgagtaaact

SEQ ID NO: 550021 - DNA, 25 bp, Homo sapien
tattggctactgagtaaacttgact

SEQ ID NO: 550022 - DNA, 25 bp, Homo sapien
actgagtaaacttgacttgtgaggg

SEQ ID NO: 550023 - DNA, 25 bp, Homo sapien
aagaagaaatcttaccttgctctgt

SEQ ID NO: 550024 - DNA, 25 bp, Homo sapien
gaagaaatcttaccttgctctgtat

SEQ ID NO: 550025 - DNA, 25 bp, Homo sapien
gaaatcttaccttgctctgtatctt

SEQ ID NO: 550026 - DNA, 25 bp, Homo sapien
aaatcttaccttgctctgtatcttt

SEQ ID NO: 550027 - DNA, 25 bp, Homo sapien
atcttaccttgctctgtatctttag

SEQ ID NO: 550028 - DNA, 25 bp, Homo sapien
cttaccttgctctgtatctttagga

SEQ ID NO: 550029 - DNA, 25 bp, Homo sapien
accttgctctgtatctttaggaaat

SEQ ID NO: 550030 - DNA, 25 bp, Homo sapien
aaacttcttaattatggaggtacat

SEQ ID NO: 550031 - DNA, 25 bp, Homo sapien
atggaggtacatctccaatacctaa

SEQ ID NO: 550032 - DNA, 25 bp, Homo sapien
ggaggtacatctccaatacctaaaa

SEQ ID NO: 550033 - DNA, 25 bp, Homo sapien
gtacatctccaatacctaaaattaa

SEQ ID NO: 550034 - DNA, 25 bp, Homo sapien
tccagatacccttaaaatgtttaag

SEQ ID NO: 550035 - DNA, 25 bp, Homo sapien
gagacatgtgaccatcattctccca

SEQ ID NO: 550036 - DNA, 25 bp, Homo sapien
tgaccatcattctcccagcgaatgt

SEQ ID NO: 550037 - DNA, 25 bp, Homo sapien
attctcccagcgaatgtgaatcatt

SEQ ID NO: 550038 - DNA, 25 bp, Homo sapien
gtgaatcatttagtgtgctactcaa

SEQ ID NO: 550039 - DNA, 25 bp, Homo sapien
agtgtgctactcaaaattaggtgta

SEQ ID NO: 550040 - DNA, 25 bp, Homo sapien
aatcgataccatttctttaaagctt

SEQ ID NO: 550041 - DNA, 25 bp, Homo sapien
aaataactgctttctaccctaagat

SEQ ID NO: 550042 - DNA, 25 bp, Homo sapien
aactgctttctaccctaagatgtta

SEQ ID NO: 550043 - DNA, 25 bp, Homo sapien
taagatgttactcattgctgtcttc

SEQ ID NO: 550044 - DNA, 25 bp, Homo sapien
tgctgtcttctttttaacaggtgat

SEQ ID NO: 550045 - DNA, 25 bp, Homo sapien
cctccactctagttctagatgagtg

SEQ ID NO: 550046 - DNA, 25 bp, Homo sapien
ctctagttctagatgagtgggaggc

SEQ ID NO: 550047 - DNA, 25 bp, Homo sapien
agtacgtcccgctgctgtgctctgg

SEQ ID NO: 550048 - DNA, 25 bp, Homo sapien
tgctctggggatttctgggatatat

SEQ ID NO: 550049 - DNA, 25 bp, Homo sapien
atatatggaggattctttccccaga

SEQ ID NO: 550050 - DNA, 25 bp, Homo sapien
agaggctcccaatcagcttttgttc

SEQ ID NO: 550051 - DNA, 25 bp, Homo sapien
tcagcttttgttctagacttcccca

SEQ ID NO: 550052 - DNA, 25 bp, Homo sapien
agcttttgttctagacttccccatc

SEQ ID NO: 550053 - DNA, 25 bp, Homo sapien
tgttctagacttccccatcccgaag

SEQ ID NO: 550054 - DNA, 25 bp, Homo sapien
ggttggctgttccagactcaggttc

SEQ ID NO: 550055 - DNA, 25 bp, Homo sapien
ttggctgttccagactcaggttcca

SEQ ID NO: 550056 - DNA, 25 bp, Homo sapien
gagaacgtggcctggaggaagaact

SEQ ID NO: 550057 - DNA, 25 bp, Homo sapien
aagaactggatggttggcggcgaag

SEQ ID NO: 550058 - DNA, 25 bp, Homo sapien
gcgcaggaatccgaggcagcctttc

SEQ ID NO: 550059 - DNA, 25 bp, Homo sapien
gcaggaatccgaggcagcctttctc

SEQ ID NO: 550060 - DNA, 25 bp, Homo sapien
ccagcggagagtccggaccgagata

SEQ ID NO: 550061 - DNA, 25 bp, Homo sapien
gaaatgctaaaggagatgccactgc

SEQ ID NO: 550062 - DNA, 25 bp, Homo sapien
aaggagatgccactgcaggacccaa

SEQ ID NO: 550063 - DNA, 25 bp, Homo sapien
gagatgccactgcaggacccaagga

SEQ ID NO: 550064 - DNA, 25 bp, Homo sapien
gcggccaggacccagcagctattgc

SEQ ID NO: 550065 - DNA, 25 bp, Homo sapien
ggccaggacccagcagctattgctg

SEQ ID NO: 550066 - DNA, 25 bp, Homo sapien
aggacccagcagctattgctggcca

SEQ ID NO: 550067 - DNA, 25 bp, Homo sapien
gtgtgttccaccctgaataatgtaa

SEQ ID NO: 550068 - DNA, 25 bp, Homo sapien
gtttcttttattccatagcctgctt

SEQ ID NO: 550069 - DNA, 25 bp, Homo sapien
atagcctgcttcattgggtatgcaa

SEQ ID NO: 550070 - DNA, 25 bp, Homo sapien
gggtatgcaaacttcctcttttaat

SEQ ID NO: 550071 - DNA, 25 bp, Homo sapien
acttcctcttttaatgttgacattg

SEQ ID NO: 550072 - DNA, 25 bp, Homo sapien
tgacattgaaatgccatctgtacca

SEQ ID NO: 550073 - DNA, 25 bp, Homo sapien
tgccatctgtaccaagactttttag

SEQ ID NO: 550074 - DNA, 25 bp, Homo sapien
gatgccattatgaaagtgactccct

SEQ ID NO: 550075 - DNA, 25 bp, Homo sapien
tatgaaagtgactccctgctgtcca

SEQ ID NO: 550076 - DNA, 25 bp, Homo sapien
tgtccacgttttatggtgccctgtg

SEQ ID NO: 550077 - DNA, 25 bp, Homo sapien
aactgtgcatcaattccctttgtat

SEQ ID NO: 550078 - DNA, 25 bp, Homo sapien
ttgcctgattcagtcccaaaaatga

SEQ ID NO: 550079 - DNA, 25 bp, Homo sapien
caaaaatgaatgtcaggccccgccc

SEQ ID NO: 550080 - DNA, 25 bp, Homo sapien
gaggccagagaggagtattgctcaa

SEQ ID NO: 550081 - DNA, 25 bp, Homo sapien
agtattgctcaatgcgtgctatgtg

SEQ ID NO: 550082 - DNA, 25 bp, Homo sapien
aatgcgtgctatgtgcaactcctca

SEQ ID NO: 550083 - DNA, 25 bp, Homo sapien
gctatgtgcaactcctcaggccttg

SEQ ID NO: 550084 - DNA, 25 bp, Homo sapien
aggccttgtgccacctccatgctga

SEQ ID NO: 550085 - DNA, 25 bp, Homo sapien
tacctacctctgaccttcttgtggg

SEQ ID NO: 550086 - DNA, 25 bp, Homo sapien
ctctgaccttcttgtgggtgagggt

SEQ ID NO: 550087 - DNA, 25 bp, Homo sapien
tgagggtggccatgcttatggccat

SEQ ID NO: 550088 - DNA, 25 bp, Homo sapien
gcttatggccatcttaaaactggag

SEQ ID NO: 550089 - DNA, 25 bp, Homo sapien
agggagcagtcccacacatatcacc

SEQ ID NO: 550090 - DNA, 25 bp, Homo sapien
agcagtcccacacatatcacctgat

SEQ ID NO: 550091 - DNA, 25 bp, Homo sapien
gggcaactagaggtcacctttgtaa

SEQ ID NO: 550092 - DNA, 25 bp, Homo sapien
tcacctttgtaatgaccaccttgct

SEQ ID NO: 550093 - DNA, 25 bp, Homo sapien
tttgtaatgaccaccttgctgcccc

SEQ ID NO: 550094 - DNA, 25 bp, Homo sapien
gttctctggcatgtgctgactggta

SEQ ID NO: 550095 - DNA, 25 bp, Homo sapien
tctggcatgtgctgactggtagctt

SEQ ID NO: 550096 - DNA, 25 bp, Homo sapien
tgactggtagcttgagaaccctcta

SEQ ID NO: 550097 - DNA, 25 bp, Homo sapien
ggtagcttgagaaccctctactaga

SEQ ID NO: 550098 - DNA, 25 bp, Homo sapien
taaagcccaggatagaaaagacatg

SEQ ID NO: 550099 - DNA, 25 bp, Homo sapien
aaaagacatgtttgtcatctctcca

SEQ ID NO: 550100 - DNA, 25 bp, Homo sapien
aggcggctgcagaagatgtcaatgt

SEQ ID NO: 550101 - DNA, 25 bp, Homo sapien
gtcaatgttactttcgaagatcaac

SEQ ID NO: 550102 - DNA, 25 bp, Homo sapien
gaaacaactccaaaacctagaagat

SEQ ID NO: 550103 - DNA, 25 bp, Homo sapien
aaacctagaagatgcttgtgatgac

SEQ ID NO: 550104 - DNA, 25 bp, Homo sapien
ttgtgatgacatcatgcttgcagat

SEQ ID NO: 550105 - DNA, 25 bp, Homo sapien
tgtgggaagccgaaggtcccgttga

SEQ ID NO: 550106 - DNA, 25 bp, Homo sapien
tcccgttgagtgtggttggccttga

SEQ ID NO: 550107 - DNA, 25 bp, Homo sapien
gttggccttgactcgggcgttgcac

SEQ ID NO: 550108 - DNA, 25 bp, Homo sapien
tgactcgggcgttgcaccggcatga

SEQ ID NO: 550109 - DNA, 25 bp, Homo sapien
gttgcaccggcatgatcgcattagc

SEQ ID NO: 550110 - DNA, 25 bp, Homo sapien
caccggcatgatcgcattagcctca

SEQ ID NO: 550111 - DNA, 25 bp, Homo sapien
gggggtctctaagaacaatctctga

SEQ ID NO: 550112 - DNA, 25 bp, Homo sapien
aatctctgagaagaacccttgggcc

SEQ ID NO: 550113 - DNA, 25 bp, Homo sapien
tgagaagaacccttgggcccctggg

SEQ ID NO: 550114 - DNA, 25 bp, Homo sapien
cccctgggagccaagttggacagga

SEQ ID NO: 550115 - DNA, 25 bp, Homo sapien
caggatgtcctgaagactagctttt

SEQ ID NO: 550116 - DNA, 25 bp, Homo sapien
tgtcctgaagactagcttttgataa

SEQ ID NO: 550117 - DNA, 25 bp, Homo sapien
gggccttcagagcacacctgttgga

SEQ ID NO: 550118 - DNA, 25 bp, Homo sapien
gagcacacctgttggacggtgcaaa

SEQ ID NO: 550119 - DNA, 25 bp, Homo sapien
acggtgcaaaccatatcttctccag

SEQ ID NO: 550120 - DNA, 25 bp, Homo sapien
ggcaaatacttttgtatcagaggaa

SEQ ID NO: 550121 - DNA, 25 bp, Homo sapien
ttatatctcaaatcaaaactctctc

SEQ ID NO: 550122 - DNA, 25 bp, Homo sapien
caagatcgtgtctgaccgcaacctg

SEQ ID NO: 550123 - DNA, 25 bp, Homo sapien
gatggccctgcacgcaaatatggcc

SEQ ID NO: 550124 - DNA, 25 bp, Homo sapien
tgcacgcaaatatggcctcacaggt

SEQ ID NO: 550125 - DNA, 25 bp, Homo sapien
aaatatggcctcacaggtgcatcat

SEQ ID NO: 550126 - DNA, 25 bp, Homo sapien
tatggcctcacaggtgcatcatagc

SEQ ID NO: 550127 - DNA, 25 bp, Homo sapien
acaggtgcatcatagccgctccaac

SEQ ID NO: 550128 - DNA, 25 bp, Homo sapien
cgatatctacccctccaagtggatt

SEQ ID NO: 550129 - DNA, 25 bp, Homo sapien
gctccgccagcggatctgcgaggaa

SEQ ID NO: 550130 - DNA, 25 bp, Homo sapien
ggatctgcgaggaagccgcctactc

SEQ ID NO: 550131 - DNA, 25 bp, Homo sapien
agccgagcccacacctggctatgag

SEQ ID NO: 550132 - DNA, 25 bp, Homo sapien
gtgggccagcggaagcgcctcatct

SEQ ID NO: 550133 - DNA, 25 bp, Homo sapien
aacttctgacaatatgatgctgtgc

SEQ ID NO: 550134 - DNA, 25 bp, Homo sapien
acaatatgatgctgtgcgagaaata

SEQ ID NO: 550135 - DNA, 25 bp, Homo sapien
acagtattaaatggcacctgatttt

SEQ ID NO: 550136 - DNA, 25 bp, Homo sapien
tgtgttaaattttagttccctgttg

SEQ ID NO: 550137 - DNA, 25 bp, Homo sapien
taatgcccccaaaatatgcagacct

SEQ ID NO: 550138 - DNA, 25 bp, Homo sapien
atatgcagacctttgggaatataaa

SEQ ID NO: 550139 - DNA, 25 bp, Homo sapien
aaaaatattgcacccacatgtctta

SEQ ID NO: 550140 - DNA, 25 bp, Homo sapien
tattgcacccacatgtcttaatggg

SEQ ID NO: 550141 - DNA, 25 bp, Homo sapien
ttatattgattgttgggttttgatt

SEQ ID NO: 550142 - DNA, 25 bp, Homo sapien
ttgattttggtgcttgctgctgaaa

SEQ ID NO: 550143 - DNA, 25 bp, Homo sapien
tttggtgcttgctgctgaaataaat

SEQ ID NO: 550144 - DNA, 25 bp, Homo sapien
aaggcggctgcagaagatgtcaatg

SEQ ID NO: 550145 - DNA, 25 bp, Homo sapien
ggcggctgcagaagatgtcaatgtt

SEQ ID NO: 550146 - DNA, 25 bp, Homo sapien
gtcaatgttactttcgaagatcaac

SEQ ID NO: 550147 - DNA, 25 bp, Homo sapien
gttactttcgaagatcaacaaaaga

SEQ ID NO: 550148 - DNA, 25 bp, Homo sapien
gataaacaaatttgcacggaataca

SEQ ID NO: 550149 - DNA, 25 bp, Homo sapien
ttgcacggaatacaagtagaatcac

SEQ ID NO: 550150 - DNA, 25 bp, Homo sapien
ggaatacaagtagaatcacagagct

SEQ ID NO: 550151 - DNA, 25 bp, Homo sapien
ctccaaaacctagaagatgcttgtg

SEQ ID NO: 550152 - DNA, 25 bp, Homo sapien
aacctagaagatgcttgtgatgaca

SEQ ID NO: 550153 - DNA, 25 bp, Homo sapien
ttgtgatgacatcatgcttgcagat

SEQ ID NO: 550154 - DNA, 25 bp, Homo sapien
tgatgacatcatgcttgcagatgat

SEQ ID NO: 550155 - DNA, 25 bp, Homo sapien
gccagaagtcataaaggaaaaggtt

SEQ ID NO: 550156 - DNA, 25 bp, Homo sapien
atgttatgtgtatttcatcacataa

SEQ ID NO: 550157 - DNA, 25 bp, Homo sapien
gttatgtgtatttcatcacataaaa

SEQ ID NO: 550158 - DNA, 25 bp, Homo sapien
gtatttcatcacataaaaaaagaca

SEQ ID NO: 550159 - DNA, 25 bp, Homo sapien
gggaaaatatttgctacataactaa

SEQ ID NO: 550160 - DNA, 25 bp, Homo sapien
ggaaaatatttgctacataactaag

SEQ ID NO: 550161 - DNA, 25 bp, Homo sapien
gaaaatatttgctacataactaaga

SEQ ID NO: 550162 - DNA, 25 bp, Homo sapien
aaaatatttgctacataactaagaa

SEQ ID NO: 550163 - DNA, 25 bp, Homo sapien
tttgctacataactaagaatgaagg

SEQ ID NO: 550164 - DNA, 25 bp, Homo sapien
aaacttttgtataatataagacaca

SEQ ID NO: 550165 - DNA, 25 bp, Homo sapien
agacacaaagaatgaatttaaagac

SEQ ID NO: 550166 - DNA, 25 bp, Homo sapien
caaagtatcttcacggtctcaatgg

SEQ ID NO: 550167 - DNA, 25 bp, Homo sapien
tcacggtctcaatggtgaaccaaca

SEQ ID NO: 550168 - DNA, 25 bp, Homo sapien
tggtgaaccaacaagattactctgt

SEQ ID NO: 550169 - DNA, 25 bp, Homo sapien
gattactctgttttataagcctttt

SEQ ID NO: 550170 - DNA, 25 bp, Homo sapien
tcttgaacttcgtaatagcactttg

SEQ ID NO: 550171 - DNA, 25 bp, Homo sapien
tagcactttgatttcctcacttaag

SEQ ID NO: 550172 - DNA, 25 bp, Homo sapien
acttaaggcaggcagtgtactctat

SEQ ID NO: 550173 - DNA, 25 bp, Homo sapien
ggcagtgtactctatggcaaatcta

SEQ ID NO: 550174 - DNA, 25 bp, Homo sapien
tggcaaatctaaacagtgatcttac

SEQ ID NO: 550175 - DNA, 25 bp, Homo sapien
gtgatcttactggacattttatggt

SEQ ID NO: 550176 - DNA, 25 bp, Homo sapien
tatggttcaagtattcaactagctt

SEQ ID NO: 550177 - DNA, 25 bp, Homo sapien
cagctgctcttctagggacctatgg

SEQ ID NO: 550178 - DNA, 25 bp, Homo sapien
atgtaatggtgactcttttctgatc

SEQ ID NO: 550179 - DNA, 25 bp, Homo sapien
tttctgatcagcaccttggccgtga

SEQ ID NO: 550180 - DNA, 25 bp, Homo sapien
ttggccgtgattcccaaggtcccag

SEQ ID NO: 550181 - DNA, 25 bp, Homo sapien
gtcccagccaaagcaaagggccagt

SEQ ID NO: 550182 - DNA, 25 bp, Homo sapien
gcaaagggccagttgtttcagttta

SEQ ID NO: 550183 - DNA, 25 bp, Homo sapien
taaacagacatgtctttagtctaat

SEQ ID NO: 550184 - DNA, 25 bp, Homo sapien
ctgccagtaaagttatttgttagct

SEQ ID NO: 550185 - DNA, 25 bp, Homo sapien
aagctatgttggtatctttccctaa

SEQ ID NO: 550186 - DNA, 25 bp, Homo sapien
tgttggtatctttccctaatcatca

SEQ ID NO: 550187 - DNA, 25 bp, Homo sapien
ggtatctttccctaatcatcaaagt

SEQ ID NO: 550188 - DNA, 25 bp, Homo sapien
atgataaacttagccgttcactccg

SEQ ID NO: 550189 - DNA, 25 bp, Homo sapien
tagccgttcactccgctattactat

SEQ ID NO: 550190 - DNA, 25 bp, Homo sapien
gtttgtgtgtgatccagaagccctt

SEQ ID NO: 550191 - DNA, 25 bp, Homo sapien
agaagcccttttctccatggccttt

SEQ ID NO: 550192 - DNA, 25 bp, Homo sapien
tttctccatggcctttccagataat

SEQ ID NO: 550193 - DNA, 25 bp, Homo sapien
ggcctttccagataatcagcgtcca

SEQ ID NO: 550194 - DNA, 25 bp, Homo sapien
atcagcgtccactgctgaagacaga

SEQ ID NO: 550195 - DNA, 25 bp, Homo sapien
gacatggaacgtcacatcaacgagg

SEQ ID NO: 550196 - DNA, 25 bp, Homo sapien
gaggaggacacagtgcctctttctc

SEQ ID NO: 550197 - DNA, 25 bp, Homo sapien
actttgatgagagcatggcctacat

SEQ ID NO: 550198 - DNA, 25 bp, Homo sapien
gagagcatggcctacatgccggaag

SEQ ID NO: 550199 - DNA, 25 bp, Homo sapien
tggctgcacccctggtctaggccag

SEQ ID NO: 550200 - DNA, 25 bp, Homo sapien
gccaggccgccattgggatcggtca

SEQ ID NO: 550201 - DNA, 25 bp, Homo sapien
ttgggatcggtcaggcccagcaagt

SEQ ID NO: 550202 - DNA, 25 bp, Homo sapien
caagtcctctgccaggctggtgagc

SEQ ID NO: 550203 - DNA, 25 bp, Homo sapien
aggctggtgagctcgttctcctcga

SEQ ID NO: 550204 - DNA, 25 bp, Homo sapien
gtgagctcgttctcctcgagtgcct

SEQ ID NO: 550205 - DNA, 25 bp, Homo sapien
cagctggaaggcctgctcgtacagt

SEQ ID NO: 550206 - DNA, 25 bp, Homo sapien
tggaaggcctgctcgtacagtccct

SEQ ID NO: 550207 - DNA, 25 bp, Homo sapien
agtccctcgcgctcgtactcgtagg

SEQ ID NO: 550208 - DNA, 25 bp, Homo sapien
gtactcgtaggccagcgagtccagc

SEQ ID NO: 550209 - DNA, 25 bp, Homo sapien
accttgcgccatttgagacccacag

SEQ ID NO: 550210 - DNA, 25 bp, Homo sapien
tgtcctccttctccgatcaatgcaa

SEQ ID NO: 550211 - DNA, 25 bp, Homo sapien
cctccttctccgatcaatgcaatgt

SEQ ID NO: 550212 - DNA, 25 bp, Homo sapien
tccttctccgatcaatgcaatgtcc

SEQ ID NO: 550213 - DNA, 25 bp, Homo sapien
cttctccgatcaatgcaatgtcccg

SEQ ID NO: 550214 - DNA, 25 bp, Homo sapien
tctccgatcaatgcaatgtcccgga

SEQ ID NO: 550215 - DNA, 25 bp, Homo sapien
cgatcaatgcaatgtcccggaatgg

SEQ ID NO: 550216 - DNA, 25 bp, Homo sapien
gatcaatgcaatgtcccggaatggc

SEQ ID NO: 550217 - DNA, 25 bp, Homo sapien
atcaatgcaatgtcccggaatggct

SEQ ID NO: 550218 - DNA, 25 bp, Homo sapien
tttctctgctcacctccggataaat

SEQ ID NO: 550219 - DNA, 25 bp, Homo sapien
tctctgctcacctccggataaatca

SEQ ID NO: 550220 - DNA, 25 bp, Homo sapien
tgctcacctccggataaatcacggg

SEQ ID NO: 550221 - DNA, 25 bp, Homo sapien
gatctttcagaccatataagcctgc

SEQ ID NO: 550222 - DNA, 25 bp, Homo sapien
tctttcagaccatataagcctgcaa

SEQ ID NO: 550223 - DNA, 25 bp, Homo sapien
ttcagaccatataagcctgcaaagt

SEQ ID NO: 550224 - DNA, 25 bp, Homo sapien
atactggagaaaactcccagaagtg

SEQ ID NO: 550225 - DNA, 25 bp, Homo sapien
ctcccagaagtgtgacaaatgtgac

SEQ ID NO: 550226 - DNA, 25 bp, Homo sapien
cccagaagtgtgacaaatgtgacaa

SEQ ID NO: 550227 - DNA, 25 bp, Homo sapien
tcatatcttaacatcagcgagttgg

SEQ ID NO: 550228 - DNA, 25 bp, Homo sapien
tatcttaacatcagcgagttggtat

SEQ ID NO: 550229 - DNA, 25 bp, Homo sapien
cttaacatcagcgagttggtattta

SEQ ID NO: 550230 - DNA, 25 bp, Homo sapien
catcagcgagttggtatttaataaa

SEQ ID NO: 550231 - DNA, 25 bp, Homo sapien
gcattatcaatgaaattactggcaa

SEQ ID NO: 550232 - DNA, 25 bp, Homo sapien
tgtaagagaaacagaccagagttcc

SEQ ID NO: 550233 - DNA, 25 bp, Homo sapien
agaccagagttcctccgatggccag

SEQ ID NO: 550234 - DNA, 25 bp, Homo sapien
accagagttcctccgatggccagga

SEQ ID NO: 550235 - DNA, 25 bp, Homo sapien
tcctccgatggccaggaacctttta

SEQ ID NO: 550236 - DNA, 25 bp, Homo sapien
tccgatggccaggaaccttttagta

SEQ ID NO: 550237 - DNA, 25 bp, Homo sapien
gatggccaggaaccttttagtactt

SEQ ID NO: 550238 - DNA, 25 bp, Homo sapien
gatagtatatgatctcttacctttt

SEQ ID NO: 550239 - DNA, 25 bp, Homo sapien
agtatatgatctcttaccttttatt

SEQ ID NO: 550240 - DNA, 25 bp, Homo sapien
attttctcataattgactattggga

SEQ ID NO: 550241 - DNA, 25 bp, Homo sapien
actattgggagatcaggagtcacaa

SEQ ID NO: 550242 - DNA, 25 bp, Homo sapien
ggagatcaggagtcacaaattcctt

SEQ ID NO: 550243 - DNA, 25 bp, Homo sapien
caccgtctcagacatcgtgcttctt

SEQ ID NO: 550244 - DNA, 25 bp, Homo sapien
gtctcagacatcgtgcttcttctgg

SEQ ID NO: 550245 - DNA, 25 bp, Homo sapien
gcttcttctggtgggccaggagtct

SEQ ID NO: 550246 - DNA, 25 bp, Homo sapien
ttctggtgggccaggagtctctcct

SEQ ID NO: 550247 - DNA, 25 bp, Homo sapien
aggagtctctcctcgtcgtcgaagg

SEQ ID NO: 550248 - DNA, 25 bp, Homo sapien
agtctctcctcgtcgtcgaaggtct

SEQ ID NO: 550249 - DNA, 25 bp, Homo sapien
tcgtcgtcgaaggtctggccacaga

SEQ ID NO: 550250 - DNA, 25 bp, Homo sapien
tcgtcgaaggtctggccacagatgg

SEQ ID NO: 550251 - DNA, 25 bp, Homo sapien
gaaggtctggccacagatggcacag

SEQ ID NO: 550252 - DNA, 25 bp, Homo sapien
gtctggccacagatggcacagcaga

SEQ ID NO: 550253 - DNA, 25 bp, Homo sapien
gccacagatggcacagcagaaggcg

SEQ ID NO: 550254 - DNA, 25 bp, Homo sapien
accctggcatcgaggttgtggatgt

SEQ ID NO: 550255 - DNA, 25 bp, Homo sapien
ggcatcgaggttgtggatgtggcca

SEQ ID NO: 550256 - DNA, 25 bp, Homo sapien
ccaccgggcgtgtgaaggccaatgc

SEQ ID NO: 550257 - DNA, 25 bp, Homo sapien
cgtgtgaaggccaatgccgccctgg

SEQ ID NO: 550258 - DNA, 25 bp, Homo sapien
tctctgcaaggcctcctttctccgg

SEQ ID NO: 550259 - DNA, 25 bp, Homo sapien
tttctccgggcctttcaccaggcgg

SEQ ID NO: 550260 - DNA, 25 bp, Homo sapien
aagccctacctcctggccttgaaga

SEQ ID NO: 550261 - DNA, 25 bp, Homo sapien
ctcctggccttgaagacctacgagg

SEQ ID NO: 550262 - DNA, 25 bp, Homo sapien
ctggccttgaagacctacgaggctg

SEQ ID NO: 550263 - DNA, 25 bp, Homo sapien
ccttgaagacctacgaggctgccaa

SEQ ID NO: 550264 - DNA, 25 bp, Homo sapien
ttgaagacctacgaggctgccaagg

SEQ ID NO: 550265 - DNA, 25 bp, Homo sapien
gttagctagaactttaaacctctca

SEQ ID NO: 550266 - DNA, 25 bp, Homo sapien
tttaaacctctcagagaagccatca

SEQ ID NO: 550267 - DNA, 25 bp, Homo sapien
gagaagccatcaaagtcagaaacaa

SEQ ID NO: 550268 - DNA, 25 bp, Homo sapien
gtcagaaacaaggtcgcacatcctg

SEQ ID NO: 550269 - DNA, 25 bp, Homo sapien
aacaaggtcgcacatcctgagtcca

SEQ ID NO: 550270 - DNA, 25 bp, Homo sapien
tgagtccactccgagcagctttgga

SEQ ID NO: 550271 - DNA, 25 bp, Homo sapien
ccgagcagctttggacgaataaact

SEQ ID NO: 550272 - DNA, 25 bp, Homo sapien
tgcttgttcttgtctctgttgttcc

SEQ ID NO: 550273 - DNA, 25 bp, Homo sapien
ttgtctctgttgttcctggatacca

SEQ ID NO: 550274 - DNA, 25 bp, Homo sapien
tcctggataccatcagctgcttgat

SEQ ID NO: 550275 - DNA, 25 bp, Homo sapien
aatacaatatgagctctgtcagata

SEQ ID NO: 550276 - DNA, 25 bp, Homo sapien
acaaagttctatttaccctgaggag

SEQ ID NO: 550277 - DNA, 25 bp, Homo sapien
aagttctatttaccctgaggagata

SEQ ID NO: 550278 - DNA, 25 bp, Homo sapien
gttctatttaccctgaggagatata

SEQ ID NO: 550279 - DNA, 25 bp, Homo sapien
taaatgggacaagcaaagagaaact

SEQ ID NO: 550280 - DNA, 25 bp, Homo sapien
tttgaagatttttgagtgtgatact

SEQ ID NO: 550281 - DNA, 25 bp, Homo sapien
aatcaggcttgatttaccaaccacc

SEQ ID NO: 550282 - DNA, 25 bp, Homo sapien
ggcttgatttaccaaccaccccatg

SEQ ID NO: 550283 - DNA, 25 bp, Homo sapien
ccatgtgcacatacaaacaaacaca

SEQ ID NO: 550284 - DNA, 25 bp, Homo sapien
accaaagccaggaaccctgcaacaa

SEQ ID NO: 550285 - DNA, 25 bp, Homo sapien
gccaggaaccctgcaacaaagttct

SEQ ID NO: 550286 - DNA, 25 bp, Homo sapien
aggaaccctgcaacaaagttctatt

SEQ ID NO: 550287 - DNA, 25 bp, Homo sapien
tcccaggtattttctacaggaccac

SEQ ID NO: 550288 - DNA, 25 bp, Homo sapien
ggtattttctacaggaccacttgag

SEQ ID NO: 550289 - DNA, 25 bp, Homo sapien
tgcagggacactgatgccacagctc

SEQ ID NO: 550290 - DNA, 25 bp, Homo sapien
ggccctcacatctgaaactggttgc

SEQ ID NO: 550291 - DNA, 25 bp, Homo sapien
tcacatctgaaactggttgccgaga

SEQ ID NO: 550292 - DNA, 25 bp, Homo sapien
tctgaaactggttgccgagagccct

SEQ ID NO: 550293 - DNA, 25 bp, Homo sapien
aaactggttgccgagagccctgagc

SEQ ID NO: 550294 - DNA, 25 bp, Homo sapien
tggttgccgagagccctgagccaag

SEQ ID NO: 550295 - DNA, 25 bp, Homo sapien
gagccctgagccaaggcaaggattt

SEQ ID NO: 550296 - DNA, 25 bp, Homo sapien
gagccaaggcaaggatttgccaaaa

SEQ ID NO: 550297 - DNA, 25 bp, Homo sapien
cagaaagactgttcctgtcaggatt

SEQ ID NO: 550298 - DNA, 25 bp, Homo sapien
ccatttttaagcagtactttacctg

SEQ ID NO: 550299 - DNA, 25 bp, Homo sapien
tttttctttagcaaaccaggttatg

SEQ ID NO: 550300 - DNA, 25 bp, Homo sapien
gtaaaggtttgttatacgtgccaca

SEQ ID NO: 550301 - DNA, 25 bp, Homo sapien
gttatacgtgccacaatatagcata

SEQ ID NO: 550302 - DNA, 25 bp, Homo sapien
atattatgccatcattccttctctt

SEQ ID NO: 550303 - DNA, 25 bp, Homo sapien
gccatcattccttctcttgttaaag

SEQ ID NO: 550304 - DNA, 25 bp, Homo sapien
ttgtgatttttataacctgtgctta

SEQ ID NO: 550305 - DNA, 25 bp, Homo sapien
cctgtgcttattactcaaatggtct

SEQ ID NO: 550306 - DNA, 25 bp, Homo sapien
caaatggtcttcaacatctttttaa

SEQ ID NO: 550307 - DNA, 25 bp, Homo sapien
agtttctattttgcttgaggtattt

SEQ ID NO: 550308 - DNA, 25 bp, Homo sapien
atatgtgccttgtgattgctgctgc

SEQ ID NO: 550309 - DNA, 25 bp, Homo sapien
ccccttgatggatgtgctgttgatt

SEQ ID NO: 550310 - DNA, 25 bp, Homo sapien
tgatggatgtgctgttgattgtaat

SEQ ID NO: 550311 - DNA, 25 bp, Homo sapien
gattgtaatatacttctgttgccaa

SEQ ID NO: 550312 - DNA, 25 bp, Homo sapien
ttgtaatatacttctgttgccaaat

SEQ ID NO: 550313 - DNA, 25 bp, Homo sapien
taatggtactgtttaattttccata

SEQ ID NO: 550314 - DNA, 25 bp, Homo sapien
ctaagaattactagacactattata

SEQ ID NO: 550315 - DNA, 25 bp, Homo sapien
taaattgtagacttacgtatttgtc

SEQ ID NO: 550316 - DNA, 25 bp, Homo sapien
ttacgtatttgtctaaaggtttgat

SEQ ID NO: 550317 - DNA, 25 bp, Homo sapien
taaaggtttgatgaagcagggccaa

SEQ ID NO: 550318 - DNA, 25 bp, Homo sapien
tgcttccagtgacaagcgggccaca

SEQ ID NO: 550319 - DNA, 25 bp, Homo sapien
ttccagtgacaagcgggccacagtg

SEQ ID NO: 550320 - DNA, 25 bp, Homo sapien
aaaaattcatggcagagtcagaaat

SEQ ID NO: 550321 - DNA, 25 bp, Homo sapien
aaaaacagccaacaagtctatttct

SEQ ID NO: 550322 - DNA, 25 bp, Homo sapien
agccaacaagtctatttcttcttat

SEQ ID NO: 550323 - DNA, 25 bp, Homo sapien
acataactgcatctttaattgggtg

SEQ ID NO: 550324 - DNA, 25 bp, Homo sapien
tctttaattgggtgtacttgaataa

SEQ ID NO: 550325 - DNA, 25 bp, Homo sapien
gaacagcaaatcaatttttatggtt

SEQ ID NO: 550326 - DNA, 25 bp, Homo sapien
tttatggttcattttctccaacaaa

SEQ ID NO: 550327 - DNA, 25 bp, Homo sapien
ggttcattttctccaacaaacaaca

SEQ ID NO: 550328 - DNA, 25 bp, Homo sapien
attttctccaacaaacaacaatatt

SEQ ID NO: 550329 - DNA, 25 bp, Homo sapien
gtaatatttattgcaacaggttatg

SEQ ID NO: 550330 - DNA, 25 bp, Homo sapien
ttattgcaacaggttatgaggtgga

SEQ ID NO: 550331 - DNA, 25 bp, Homo sapien
tgagtgactgggagtctcagttcac

SEQ ID NO: 550332 - DNA, 25 bp, Homo sapien
gggagtctcagttcactttcaagta

SEQ ID NO: 550333 - DNA, 25 bp, Homo sapien
actttcaagtatcatcacgtgggca

SEQ ID NO: 550334 - DNA, 25 bp, Homo sapien
gtatcatcacgtgggcaaactgctg

SEQ ID NO: 550335 - DNA, 25 bp, Homo sapien
ggaggagcccactgtgtactcagat

SEQ ID NO: 550336 - DNA, 25 bp, Homo sapien
gcccactgtgtactcagatgaggaa

SEQ ID NO: 550337 - DNA, 25 bp, Homo sapien
gaaccaaaagatgagagtgcccgga

SEQ ID NO: 550338 - DNA, 25 bp, Homo sapien
agagtgcccggaaaaatgattaaag

SEQ ID NO: 550339 - DNA, 25 bp, Homo sapien
aaatcatttgtaacagtccactctg

SEQ ID NO: 550340 - DNA, 25 bp, Homo sapien
tgtaacagtccactctgtctttaaa

SEQ ID NO: 550341 - DNA, 25 bp, Homo sapien
gaaagttttgagcacttgctataag

SEQ ID NO: 550342 - DNA, 25 bp, Homo sapien
gcatttaaaagtaagagctgtcggt

SEQ ID NO: 550343 - DNA, 25 bp, Homo sapien
agagctgtcggttgtacaagggccc

SEQ ID NO: 550344 - DNA, 25 bp, Homo sapien
agctgtcggttgtacaagggccctg

SEQ ID NO: 550345 - DNA, 25 bp, Homo sapien
tggggaccctcgaagcagaataaat

SEQ ID NO: 550346 - DNA, 25 bp, Homo sapien
taaaactttaagcagatccctttag

SEQ ID NO: 550347 - DNA, 25 bp, Homo sapien
gatccctttagaaaaaggctctctt

SEQ ID NO: 550348 - DNA, 25 bp, Homo sapien
aaaggctctcttctaaaacgcacag

SEQ ID NO: 550349 - DNA, 25 bp, Homo sapien
ggctctcttctaaaacgcacagtgg

SEQ ID NO: 550350 - DNA, 25 bp, Homo sapien
aaacgcacagtggaatgtcaagagt

SEQ ID NO: 550351 - DNA, 25 bp, Homo sapien
gttatacagttgaaacagttctatt

SEQ ID NO: 550352 - DNA, 25 bp, Homo sapien
aaacagttctattgaagctttctat

SEQ ID NO: 550353 - DNA, 25 bp, Homo sapien
actttacccttgtccatgcaaggca

SEQ ID NO: 550354 - DNA, 25 bp, Homo sapien
ttgtccatgcaaggcattcctcctg

SEQ ID NO: 550355 - DNA, 25 bp, Homo sapien
attcctcctgaatgcatccatgaat

SEQ ID NO: 550356 - DNA, 25 bp, Homo sapien
acttttgcgtcaaacatatgagcca

SEQ ID NO: 550357 - DNA, 25 bp, Homo sapien
tgagccattgtcatgctcagcctgt

SEQ ID NO: 550358 - DNA, 25 bp, Homo sapien
accattgctctgtctgatgtatgta

SEQ ID NO: 550359 - DNA, 25 bp, Homo sapien
atcatacaagacctgattttggttc

SEQ ID NO: 550360 - DNA, 25 bp, Homo sapien
attttggttctaacacagtggtctt

SEQ ID NO: 550361 - DNA, 25 bp, Homo sapien
tagagatgggttcttctggttgata

SEQ ID NO: 550362 - DNA, 25 bp, Homo sapien
gttgatacagactatgcattgcgtt

SEQ ID NO: 550363 - DNA, 25 bp, Homo sapien
agactatgcattgcgtttagcagat

SEQ ID NO: 550364 - DNA, 25 bp, Homo sapien
ttttctatcaccaaatttataaagg

SEQ ID NO: 550365 - DNA, 25 bp, Homo sapien
aaaggactaaacagtactattgagt

SEQ ID NO: 550366 - DNA, 25 bp, Homo sapien
aacagtactattgagtttactcggt

SEQ ID NO: 550367 - DNA, 25 bp, Homo sapien
gagtttactcggtttataaatccag

SEQ ID NO: 550368 - DNA, 25 bp, Homo sapien
tccagttttaactataattcaacaa

SEQ ID NO: 550369 - DNA, 25 bp, Homo sapien
aattcaacaatattttggtgtggtg

SEQ ID NO: 550370 - DNA, 25 bp, Homo sapien
tttggtgtggtgaaacgttgtttat

SEQ ID NO: 550371 - DNA, 25 bp, Homo sapien
tgtataagttttaatcaactgggaa

SEQ ID NO: 550372 - DNA, 25 bp, Homo sapien
atttgattgatcttgtgttttgttg

SEQ ID NO: 550373 - DNA, 25 bp, Homo sapien
cctttctctagtagtggtatagagg

SEQ ID NO: 550374 - DNA, 25 bp, Homo sapien
gaaggacagatgctcattgttgaat

SEQ ID NO: 550375 - DNA, 25 bp, Homo sapien
gtatttaatactatagctctgtcaa

SEQ ID NO: 550376 - DNA, 25 bp, Homo sapien
gctctgtcaatatcacatgaggcag

SEQ ID NO: 550377 - DNA, 25 bp, Homo sapien
gaggcagtttttcaaatacgtataa

SEQ ID NO: 550378 - DNA, 25 bp, Homo sapien
atacgtataaacagaggttgcttat

SEQ ID NO: 550379 - DNA, 25 bp, Homo sapien
acaaagtgggactctttatgatgtc

SEQ ID NO: 550380 - DNA, 25 bp, Homo sapien
gactctttatgatgtcatgaccatg

SEQ ID NO: 550381 - DNA, 25 bp, Homo sapien
tgaccatgataactaagcacctaag

SEQ ID NO: 550382 - DNA, 25 bp, Homo sapien
gcatgtatcttagctacctaaactg

SEQ ID NO: 550383 - DNA, 25 bp, Homo sapien
actgaaacatgggaggctgggctta

SEQ ID NO: 550384 - DNA, 25 bp, Homo sapien
gggaggctgggcttaattcaaaata

SEQ ID NO: 550385 - DNA, 25 bp, Homo sapien
attcaaaatatattgctccaaggca

SEQ ID NO: 550386 - DNA, 25 bp, Homo sapien
aacaaaaatctgacaaatagggttg

SEQ ID NO: 550387 - DNA, 25 bp, Homo sapien
caaatagggttgttaactgtgagcc

SEQ ID NO: 550388 - DNA, 25 bp, Homo sapien
aaatagggttgttaactgtgagcct

SEQ ID NO: 550389 - DNA, 25 bp, Homo sapien
aatagggttgttaactgtgagcctg

SEQ ID NO: 550390 - DNA, 25 bp, Homo sapien
atagggttgttaactgtgagcctga

SEQ ID NO: 550391 - DNA, 25 bp, Homo sapien
ggttgttaactgtgagcctgaggaa

SEQ ID NO: 550392 - DNA, 25 bp, Homo sapien
gttgttaactgtgagcctgaggaaa

SEQ ID NO: 550393 - DNA, 25 bp, Homo sapien
ttgttaactgtgagcctgaggaaaa

SEQ ID NO: 550394 - DNA, 25 bp, Homo sapien
tgttaactgtgagcctgaggaaaag

SEQ ID NO: 550395 - DNA, 25 bp, Homo sapien
ttaactgtgagcctgaggaaaagta

SEQ ID NO: 550396 - DNA, 25 bp, Homo sapien
aactgtgagcctgaggaaaagtata

SEQ ID NO: 550397 - DNA, 25 bp, Homo sapien
ggttatgccaaatttccaggccttt

SEQ ID NO: 550398 - DNA, 25 bp, Homo sapien
atttccaggcctttttgaagtattg

SEQ ID NO: 550399 - DNA, 25 bp, Homo sapien
atatgcacgcacttttcttgttgac

SEQ ID NO: 550400 - DNA, 25 bp, Homo sapien
cgcacttttcttgttgacaaagcaa

SEQ ID NO: 550401 - DNA, 25 bp, Homo sapien
gtgtaggtttggtgctctattgatt

SEQ ID NO: 550402 - DNA, 25 bp, Homo sapien
gtgctctattgattggtgagtgacc

SEQ ID NO: 550403 - DNA, 25 bp, Homo sapien
attggtgagtgaccagagcaagtat

SEQ ID NO: 550404 - DNA, 25 bp, Homo sapien
caagtatgaaggtgatgctgccaaa

SEQ ID NO: 550405 - DNA, 25 bp, Homo sapien
gctgccaaagcacaagccagtttct

SEQ ID NO: 550406 - DNA, 25 bp, Homo sapien
aaagcacaagccagtttcttgggaa

SEQ ID NO: 550407 - DNA, 25 bp, Homo sapien
ggaaaattcaagttacagtggagta

SEQ ID NO: 550408 - DNA, 25 bp, Homo sapien
acctgtctgacattgtcccctaaaa

SEQ ID NO: 550409 - DNA, 25 bp, Homo sapien
gacattgtcccctaaaaacaagtgc

SEQ ID NO: 550410 - DNA, 25 bp, Homo sapien
aaacaagtgcagtgtggcagctgct

SEQ ID NO: 550411 - DNA, 25 bp, Homo sapien
aatctgtctgttcagtttgtcaagg

SEQ ID NO: 550412 - DNA, 25 bp, Homo sapien
gtctgttcagtttgtcaaggaggat

SEQ ID NO: 550413 - DNA, 25 bp, Homo sapien
aattatgcttgggagagatctgaaa

SEQ ID NO: 550414 - DNA, 25 bp, Homo sapien
attttgcacttttgatactcttagg

SEQ ID NO: 550415 - DNA, 25 bp, Homo sapien
gcacttttgatactcttaggaacaa

SEQ ID NO: 550416 - DNA, 25 bp, Homo sapien
gatactcttaggaacaaataactta

SEQ ID NO: 550417 - DNA, 25 bp, Homo sapien
tgtattgtgaacaggcactgaagct

SEQ ID NO: 550418 - DNA, 25 bp, Homo sapien
ggcactgaagctgatgttattttaa

SEQ ID NO: 550419 - DNA, 25 bp, Homo sapien
gcttggaagtgggttccctggccac

SEQ ID NO: 550420 - DNA, 25 bp, Homo sapien
ttggaagtgggttccctggccaccg

SEQ ID NO: 550421 - DNA, 25 bp, Homo sapien
ggttgacctctctcgctagcagggc

SEQ ID NO: 550422 - DNA, 25 bp, Homo sapien
gttgacctctctcgctagcagggcc

SEQ ID NO: 550423 - DNA, 25 bp, Homo sapien
cgcgtcttccatcccctctaggatt

SEQ ID NO: 550424 - DNA, 25 bp, Homo sapien
tctaggattcccattgtcccctact

SEQ ID NO: 550425 - DNA, 25 bp, Homo sapien
gtctcagacatcgtgcttcttctgg

SEQ ID NO: 550426 - DNA, 25 bp, Homo sapien
ttctggtgggccaggagtctctcct

SEQ ID NO: 550427 - DNA, 25 bp, Homo sapien
aggagtctctcctcgtcgtcgaagg

SEQ ID NO: 550428 - DNA, 25 bp, Homo sapien
cgtcgtcgaaggtctggccacagat

SEQ ID NO: 550429 - DNA, 25 bp, Homo sapien
agatggcacagcagaaggcgccgtc

SEQ ID NO: 550430 - DNA, 25 bp, Homo sapien
ttttccttgaagagtcctgttctat

SEQ ID NO: 550431 - DNA, 25 bp, Homo sapien
tgttctatgtctttgccctttgacc

SEQ ID NO: 550432 - DNA, 25 bp, Homo sapien
tgccctttgacctttaacttgcaaa

SEQ ID NO: 550433 - DNA, 25 bp, Homo sapien
tgcaaactggcacaaactgaaggaa

SEQ ID NO: 550434 - DNA, 25 bp, Homo sapien
tggtgttgcttctccattggattag

SEQ ID NO: 550435 - DNA, 25 bp, Homo sapien
ttctccattggattagttgttctct

SEQ ID NO: 550436 - DNA, 25 bp, Homo sapien
tgttctctaaaacctagtaagcatg

SEQ ID NO: 550437 - DNA, 25 bp, Homo sapien
agcatgagctgtttccttagagtgg

SEQ ID NO: 550438 - DNA, 25 bp, Homo sapien
tctgcagatggacactttgctcttt

SEQ ID NO: 550439 - DNA, 25 bp, Homo sapien
tgctctttacatgcacactctgaaa

SEQ ID NO: 550440 - DNA, 25 bp, Homo sapien
acactctgaaaatgccctataggta

SEQ ID NO: 550441 - DNA, 25 bp, Homo sapien
tgcttgccgcgagggctccccagta

SEQ ID NO: 550442 - DNA, 25 bp, Homo sapien
gccatcgctctctcgccaaacaaaa

SEQ ID NO: 550443 - DNA, 25 bp, Homo sapien
cagaagcccccaaacagaacaaaat

SEQ ID NO: 550444 - DNA, 25 bp, Homo sapien
agttcacattcattcgattcattga

SEQ ID NO: 550445 - DNA, 25 bp, Homo sapien
acattcattcgattcattgagcctg

SEQ ID NO: 550446 - DNA, 25 bp, Homo sapien
tcattcgattcattgagcctgctgc

SEQ ID NO: 550447 - DNA, 25 bp, Homo sapien
ttcgattcattgagcctgctgctgt

SEQ ID NO: 550448 - DNA, 25 bp, Homo sapien
ggtctgtccgtagtaagcggcctgc

SEQ ID NO: 550449 - DNA, 25 bp, Homo sapien
tgtccgtagtaagcggcctgctgtc

SEQ ID NO: 550450 - DNA, 25 bp, Homo sapien
catgtgagacacagaacaggcgaga

SEQ ID NO: 550451 - DNA, 25 bp, Homo sapien
gcgagagagtgagggcccggcatgc

SEQ ID NO: 550452 - DNA, 25 bp, Homo sapien
tgagggctccacgttgtcagcgctc

SEQ ID NO: 550453 - DNA, 25 bp, Homo sapien
ggctccacgttgtcagcgctcagga

SEQ ID NO: 550454 - DNA, 25 bp, Homo sapien
tccacgttgtcagcgctcaggaatg

SEQ ID NO: 550455 - DNA, 25 bp, Homo sapien
acgttgtcagcgctcaggaatgtgc

SEQ ID NO: 550456 - DNA, 25 bp, Homo sapien
gctcaggaatgtgctccggcagagt

SEQ ID NO: 550457 - DNA, 25 bp, Homo sapien
tcaggaatgtgctccggcagagtgc

SEQ ID NO: 550458 - DNA, 25 bp, Homo sapien
atgtgctccggcagagtgctgaagc

SEQ ID NO: 550459 - DNA, 25 bp, Homo sapien
tgctccggcagagtgctgaagccat

SEQ ID NO: 550460 - DNA, 25 bp, Homo sapien
tccggcagagtgctgaagccataat

SEQ ID NO: 550461 - DNA, 25 bp, Homo sapien
agtgctgaagccataatccccaacc

SEQ ID NO: 550462 - DNA, 25 bp, Homo sapien
tgaagccataatccccaaccatttc

SEQ ID NO: 550463 - DNA, 25 bp, Homo sapien
gatagaggcgcgttgttctctgagc

SEQ ID NO: 550464 - DNA, 25 bp, Homo sapien
agaggcgcgttgttctctgagcgat

SEQ ID NO: 550465 - DNA, 25 bp, Homo sapien
gttgttctctgagcgatgtttaccg

SEQ ID NO: 550466 - DNA, 25 bp, Homo sapien
tgagcgatgtttaccgagaagcccg

SEQ ID NO: 550467 - DNA, 25 bp, Homo sapien
gatgtttaccgagaagcccgctccg

SEQ ID NO: 550468 - DNA, 25 bp, Homo sapien
ggtgtcagttgggaccccaaccctg

SEQ ID NO: 550469 - DNA, 25 bp, Homo sapien
gtgtcgggcgcccagagatgccgcg

SEQ ID NO: 550470 - DNA, 25 bp, Homo sapien
ttgaaaactccggtttctggcttgg

SEQ ID NO: 550471 - DNA, 25 bp, Homo sapien
aaactccggtttctggcttggcgat

SEQ ID NO: 550472 - DNA, 25 bp, Homo sapien
tctggcttggcgatcgggtgaccga

SEQ ID NO: 550473 - DNA, 25 bp, Homo sapien
agcagccgcgaggtgacagcgccgg

SEQ ID NO: 550474 - DNA, 25 bp, Homo sapien
tgtggcaagtgttaggaactccctt

SEQ ID NO: 550475 - DNA, 25 bp, Homo sapien
gaactcccttctggtgacagctggt

SEQ ID NO: 550476 - DNA, 25 bp, Homo sapien
gtgacagctggtcttcctagagtgt

SEQ ID NO: 550477 - DNA, 25 bp, Homo sapien
ggtcttcctagagtgttgctggtaa

SEQ ID NO: 550478 - DNA, 25 bp, Homo sapien
agtgttgctggtaactatcgcctct

SEQ ID NO: 550479 - DNA, 25 bp, Homo sapien
gtaactatcgcctcttggtcttctg

SEQ ID NO: 550480 - DNA, 25 bp, Homo sapien
agcatcagcacctttggcttaccat

SEQ ID NO: 550481 - DNA, 25 bp, Homo sapien
taccatccagtccttacttctgtga

SEQ ID NO: 550482 - DNA, 25 bp, Homo sapien
tacttctgtgactgtaagggcccca

SEQ ID NO: 550483 - DNA, 25 bp, Homo sapien
agtcccaagcctggtggatctgcat

SEQ ID NO: 550484 - DNA, 25 bp, Homo sapien
aagcctggtggatctgcatctcacg

SEQ ID NO: 550485 - DNA, 25 bp, Homo sapien
agatagcagggccaacttccaccag

SEQ ID NO: 550486 - DNA, 25 bp, Homo sapien
aggtctccagcgagaagcactcacg

SEQ ID NO: 550487 - DNA, 25 bp, Homo sapien
gaagcactcacggaagattcaggac

SEQ ID NO: 550488 - DNA, 25 bp, Homo sapien
attcaggacaagctacggaggatga

SEQ ID NO: 550489 - DNA, 25 bp, Homo sapien
ggaggatgaaggctacattccagta

SEQ ID NO: 550490 - DNA, 25 bp, Homo sapien
tacattccagtagccgagctcgggc

SEQ ID NO: 550491 - DNA, 25 bp, Homo sapien
agctcgggcctggtgtggaattcca

SEQ ID NO: 550492 - DNA, 25 bp, Homo sapien
ggaattccagatccgaatccgactg

SEQ ID NO: 550493 - DNA, 25 bp, Homo sapien
agctccagtcgtacctcaagcagag

SEQ ID NO: 550494 - DNA, 25 bp, Homo sapien
tcaagcagaggattgcccgcttcag

SEQ ID NO: 550495 - DNA, 25 bp, Homo sapien
tcagcggtgccgacatttccacact

SEQ ID NO: 550496 - DNA, 25 bp, Homo sapien
atctaatgtcttcctctttaaagtg

SEQ ID NO: 550497 - DNA, 25 bp, Homo sapien
tttaaagtgtgacccagagaccagt

SEQ ID NO: 550498 - DNA, 25 bp, Homo sapien
cacctgagacctgtgaacactgaag

SEQ ID NO: 550499 - DNA, 25 bp, Homo sapien
gtgaacactgaagctccagctcaga

SEQ ID NO: 550500 - DNA, 25 bp, Homo sapien
gaagctccagctcagacatgttggg

SEQ ID NO: 550501 - DNA, 25 bp, Homo sapien
gggaccattttaataagatacctag

SEQ ID NO: 550502 - DNA, 25 bp, Homo sapien
agatacctagctgattttttgcaca

SEQ ID NO: 550503 - DNA, 25 bp, Homo sapien
tcagggaaattaaatctgctcaatt

SEQ ID NO: 550504 - DNA, 25 bp, Homo sapien
atgtgatgttttttaggtgcacctt

SEQ ID NO: 550505 - DNA, 25 bp, Homo sapien
ttaggtgcaccttttctcatgactc

SEQ ID NO: 550506 - DNA, 25 bp, Homo sapien
atgactccttttactttatctaatg

SEQ ID NO: 550507 - DNA, 25 bp, Homo sapien
agctgactccaagggctggcaagcg

SEQ ID NO: 550508 - DNA, 25 bp, Homo sapien
tggcaagcgtccctgcaggccatga

SEQ ID NO: 550509 - DNA, 25 bp, Homo sapien
aagcgtccctgcaggccatgagcct

SEQ ID NO: 550510 - DNA, 25 bp, Homo sapien
ccctggaggaccgtgtccgtgagat

SEQ ID NO: 550511 - DNA, 25 bp, Homo sapien
caagcactgtgcttagtgacccaga

SEQ ID NO: 550512 - DNA, 25 bp, Homo sapien
cactgtgcttagtgacccagagcct

SEQ ID NO: 550513 - DNA, 25 bp, Homo sapien
ggagacctagcctgcgggccgaatc

SEQ ID NO: 550514 - DNA, 25 bp, Homo sapien
agcctgcgggccgaatctgacgttg

SEQ ID NO: 550515 - DNA, 25 bp, Homo sapien
atctgacgttgggtgattggtccac

SEQ ID NO: 550516 - DNA, 25 bp, Homo sapien
gattggtccaccctgaagctgtgtg

SEQ ID NO: 550517 - DNA, 25 bp, Homo sapien
ccaccctgaagctgtgtgccaggga

SEQ ID NO: 550518 - DNA, 25 bp, Homo sapien
gttatttaacaggtcaccagttaag

SEQ ID NO: 550519 - DNA, 25 bp, Homo sapien
gtcaccagttaagacttctgctttg

SEQ ID NO: 550520 - DNA, 25 bp, Homo sapien
ccagttaagacttctgctttgtaga

SEQ ID NO: 550521 - DNA, 25 bp, Homo sapien
gtagatacatgcagaagccatcaaa

SEQ ID NO: 550522 - DNA, 25 bp, Homo sapien
tactacattctattcagtcttggag

SEQ ID NO: 550523 - DNA, 25 bp, Homo sapien
ctattcagtcttggagtgttttgta

SEQ ID NO: 550524 - DNA, 25 bp, Homo sapien
gaatattgcactgatagatactaaa

SEQ ID NO: 550525 - DNA, 25 bp, Homo sapien
agcccttactaaaagcccctcatat

SEQ ID NO: 550526 - DNA, 25 bp, Homo sapien
agcccctcatatatcaattacttta

SEQ ID NO: 550527 - DNA, 25 bp, Homo sapien
tatgactacttaggttccgggctgg

SEQ ID NO: 550528 - DNA, 25 bp, Homo sapien
ggacaagttcacttaaaaaggcaat

SEQ ID NO: 550529 - DNA, 25 bp, Homo sapien
gagtgagaatcagtccagtcagaaa

SEQ ID NO: 550530 - DNA, 25 bp, Homo sapien
gtccagtcagaaaattttaggcatt

SEQ ID NO: 550531 - DNA, 25 bp, Homo sapien
aggcatttgggcaactgcattcaga

SEQ ID NO: 550532 - DNA, 25 bp, Homo sapien
atgagactgaatctccatgcctctt

SEQ ID NO: 550533 - DNA, 25 bp, Homo sapien
ccctagtagccttcaagaagtctct

SEQ ID NO: 550534 - DNA, 25 bp, Homo sapien
agtctctaaaacagggttaccacag

SEQ ID NO: 550535 - DNA, 25 bp, Homo sapien
ggttaccacagatttagccaggatg

SEQ ID NO: 550536 - DNA, 25 bp, Homo sapien
gccaggatgatgtgtagcagctttt

SEQ ID NO: 550537 - DNA, 25 bp, Homo sapien
atgtgtagcagcttttcttggaaca

SEQ ID NO: 550538 - DNA, 25 bp, Homo sapien
cttttcttggaacaggttgatggat

SEQ ID NO: 550539 - DNA, 25 bp, Homo sapien
ttttcttgaatttgccagtcacatg

SEQ ID NO: 550540 - DNA, 25 bp, Homo sapien
agtatctcgtactcacagttcacaa

SEQ ID NO: 550541 - DNA, 25 bp, Homo sapien
aaattaaccttcactgtctctttca

SEQ ID NO: 550542 - DNA, 25 bp, Homo sapien
gtctctttcacattaagagcttatg

SEQ ID NO: 550543 - DNA, 25 bp, Homo sapien
ttttctaacttgctggtttaccata

SEQ ID NO: 550544 - DNA, 25 bp, Homo sapien
tgctggtttaccataaactccccta

SEQ ID NO: 550545 - DNA, 25 bp, Homo sapien
taaaattcctaacccagtactgaga

SEQ ID NO: 550546 - DNA, 25 bp, Homo sapien
agtactgagagtcctccttctctgc

SEQ ID NO: 550547 - DNA, 25 bp, Homo sapien
gccacttgggcattattttactagt

SEQ ID NO: 550548 - DNA, 25 bp, Homo sapien
aagccatcatcgcacaagaatccaa

SEQ ID NO: 550549 - DNA, 25 bp, Homo sapien
ggttaagcatttaatctggctcatg

SEQ ID NO: 550550 - DNA, 25 bp, Homo sapien
tttaatctggctcatgctctatcat

SEQ ID NO: 550551 - DNA, 25 bp, Homo sapien
catgcagctgatctaaaagggaata

SEQ ID NO: 550552 - DNA, 25 bp, Homo sapien
atgcagctgatctaaaagggaataa

SEQ ID NO: 550553 - DNA, 25 bp, Homo sapien
tgcagctgatctaaaagggaataaa

SEQ ID NO: 550554 - DNA, 25 bp, Homo sapien
gcagctgatctaaaagggaataaaa

SEQ ID NO: 550555 - DNA, 25 bp, Homo sapien
aaaagggaataaaaggctgcgcata

SEQ ID NO: 550556 - DNA, 25 bp, Homo sapien
aaagggaataaaaggctgcgcataa

SEQ ID NO: 550557 - DNA, 25 bp, Homo sapien
aagggaataaaaggctgcgcataat

SEQ ID NO: 550558 - DNA, 25 bp, Homo sapien
agggaataaaaggctgcgcataatc

SEQ ID NO: 550559 - DNA, 25 bp, Homo sapien
gggaataaaaggctgcgcataatca

SEQ ID NO: 550560 - DNA, 25 bp, Homo sapien
ccccagagggcaggtcctgtttggt

SEQ ID NO: 550561 - DNA, 25 bp, Homo sapien
aggcggtcccattcttttggccagg

SEQ ID NO: 550562 - DNA, 25 bp, Homo sapien
tcttttggccagggattggttgagc

SEQ ID NO: 550563 - DNA, 25 bp, Homo sapien
gtgggcggcgctggtgaatgagacc

SEQ ID NO: 550564 - DNA, 25 bp, Homo sapien
aatgagaccggaaaagacgctgctg

SEQ ID NO: 550565 - DNA, 25 bp, Homo sapien
gacgctgctgggtgaggtttctgct

SEQ ID NO: 550566 - DNA, 25 bp, Homo sapien
tgaggtttctgctgctggatgcggt

SEQ ID NO: 550567 - DNA, 25 bp, Homo sapien
tggatgcggtttctcgttcctacaa

SEQ ID NO: 550568 - DNA, 25 bp, Homo sapien
ggtttctcgttcctacaaaggctca

SEQ ID NO: 550569 - DNA, 25 bp, Homo sapien
ttcctacaaaggctcacccaggtag

SEQ ID NO: 550570 - DNA, 25 bp, Homo sapien
tacaaaggctcacccaggtagggat

SEQ ID NO: 550571 - DNA, 25 bp, Homo sapien
gtgctacaaatgtgctttggcttta

SEQ ID NO: 550572 - DNA, 25 bp, Homo sapien
gacagacctgagaccaatctgggta

SEQ ID NO: 550573 - DNA, 25 bp, Homo sapien
aaattcgaatggttcaagcagccgt

SEQ ID NO: 550574 - DNA, 25 bp, Homo sapien
aagcagccgtgaaatcgctcttcat

SEQ ID NO: 550575 - DNA, 25 bp, Homo sapien
gaaatcgctcttcataaagtgggct

SEQ ID NO: 550576 - DNA, 25 bp, Homo sapien
taaagtgggcttaattctctagttt

SEQ ID NO: 550577 - DNA, 25 bp, Homo sapien
taatgtgtcaggtggcttatttgtg

SEQ ID NO: 550578 - DNA, 25 bp, Homo sapien
gcttatttgtggatgccatgattga

SEQ ID NO: 550579 - DNA, 25 bp, Homo sapien
gttcattttaagctcttacctatag

SEQ ID NO: 550580 - DNA, 25 bp, Homo sapien
aagctcttacctatagtacaagtac

SEQ ID NO: 550581 - DNA, 25 bp, Homo sapien
gtacaagtacatgatgctactgaat

SEQ ID NO: 550582 - DNA, 25 bp, Homo sapien
atgggggctcagcagcgacatctct

SEQ ID NO: 550583 - DNA, 25 bp, Homo sapien
gggctcagcagcgacatctctactc

SEQ ID NO: 550584 - DNA, 25 bp, Homo sapien
agccctggctgcaatgtctctacca

SEQ ID NO: 550585 - DNA, 25 bp, Homo sapien
tggctgcaatgtctctaccacatcc

SEQ ID NO: 550586 - DNA, 25 bp, Homo sapien
cccgcctctcagaaaagctgctgtg

SEQ ID NO: 550587 - DNA, 25 bp, Homo sapien
cgcctctcagaaaagctgctgtggt

SEQ ID NO: 550588 - DNA, 25 bp, Homo sapien
gccaggttcactgggaccagggcta

SEQ ID NO: 550589 - DNA, 25 bp, Homo sapien
caggttcactgggaccagggctaca

SEQ ID NO: 550590 - DNA, 25 bp, Homo sapien
gaccagggctacaggcacagagtct

SEQ ID NO: 550591 - DNA, 25 bp, Homo sapien
accagggctacaggcacagagtctc

SEQ ID NO: 550592 - DNA, 25 bp, Homo sapien
cagggctacaggcacagagtctcct

SEQ ID NO: 550593 - DNA, 25 bp, Homo sapien
gaaagctagcgcacctgcactttga

SEQ ID NO: 550594 - DNA, 25 bp, Homo sapien
cacctgcactttgaattcttgcttc

SEQ ID NO: 550595 - DNA, 25 bp, Homo sapien
gattttgctttttacagatgttgga

SEQ ID NO: 550596 - DNA, 25 bp, Homo sapien
tacagatgttggacgattttttctt

SEQ ID NO: 550597 - DNA, 25 bp, Homo sapien
gttgaattcataatcatggtctcat

SEQ ID NO: 550598 - DNA, 25 bp, Homo sapien
tcataatcatggtctcatttccttt

SEQ ID NO: 550599 - DNA, 25 bp, Homo sapien
ctttcaacacattcctttattttat

SEQ ID NO: 550600 - DNA, 25 bp, Homo sapien
gtcctttttttagctattgctgctg

SEQ ID NO: 550601 - DNA, 25 bp, Homo sapien
ggatgatttttaaactgtcaaatga

SEQ ID NO: 550602 - DNA, 25 bp, Homo sapien
tgtcaaatgaagtagtgttaacctc

SEQ ID NO: 550603 - DNA, 25 bp, Homo sapien
gtagtgttaacctcaaataggctaa

SEQ ID NO: 550604 - DNA, 25 bp, Homo sapien
ttcagttgcattgctgataaccagc

SEQ ID NO: 550605 - DNA, 25 bp, Homo sapien
gctgataaccagcattccacttgga

SEQ ID NO: 550606 - DNA, 25 bp, Homo sapien
gttaccattctgatatcacctcagg

SEQ ID NO: 550607 - DNA, 25 bp, Homo sapien
gaagtttgataactctatcatccag

SEQ ID NO: 550608 - DNA, 25 bp, Homo sapien
gggaccaaatctgcattaacttcac

SEQ ID NO: 550609 - DNA, 25 bp, Homo sapien
cagaattgcattgttcccagcataa

SEQ ID NO: 550610 - DNA, 25 bp, Homo sapien
gttctggttggctggtaaatcttgg

SEQ ID NO: 550611 - DNA, 25 bp, Homo sapien
gaaccttcaattcaacttcatcact

SEQ ID NO: 550612 - DNA, 25 bp, Homo sapien
tcatcactatagctttggtggccca

SEQ ID NO: 550613 - DNA, 25 bp, Homo sapien
accactttccactacgcagcgataa

SEQ ID NO: 550614 - DNA, 25 bp, Homo sapien
tacgcagcgataaagcccgccatct

SEQ ID NO: 550615 - DNA, 25 bp, Homo sapien
gatgatgtcggctgggactgggacc

SEQ ID NO: 550616 - DNA, 25 bp, Homo sapien
ggactgggaccatctgttcactgag

SEQ ID NO: 550617 - DNA, 25 bp, Homo sapien
catctgttcactgaggtgtcctcag

SEQ ID NO: 550618 - DNA, 25 bp, Homo sapien
tcactgaggtgtcctcagaggtcct

SEQ ID NO: 550619 - DNA, 25 bp, Homo sapien
agaggtcctcactgagtgggaccca

SEQ ID NO: 550620 - DNA, 25 bp, Homo sapien
ccactgcagacggagaaggaggacc

SEQ ID NO: 550621 - DNA, 25 bp, Homo sapien
cgtcacccatgctctagacatgaag

SEQ ID NO: 550622 - DNA, 25 bp, Homo sapien
gaagaaatgcaatgagcttaaagct

SEQ ID NO: 550623 - DNA, 25 bp, Homo sapien
aagaagcttgtaagcagctccgaat

SEQ ID NO: 550624 - DNA, 25 bp, Homo sapien
aagcagctccgaatttttacctgga

SEQ ID NO: 550625 - DNA, 25 bp, Homo sapien
gctccgaatttttacctggaatatt

SEQ ID NO: 550626 - DNA, 25 bp, Homo sapien
aatagaatgtggtgttctgtgcttt

SEQ ID NO: 550627 - DNA, 25 bp, Homo sapien
aacagattcataaattagttcctga

SEQ ID NO: 550628 - DNA, 25 bp, Homo sapien
aattagttcctgatgtacggtaaat

SEQ ID NO: 550629 - DNA, 25 bp, Homo sapien
aactcccactgtgtcagtcaaactg

SEQ ID NO: 550630 - DNA, 25 bp, Homo sapien
gagatgtgctcatttcataaccact

SEQ ID NO: 550631 - DNA, 25 bp, Homo sapien
gctcatttcataaccactcatttct

SEQ ID NO: 550632 - DNA, 25 bp, Homo sapien
actcatttctagtctgtcagagctg

SEQ ID NO: 550633 - DNA, 25 bp, Homo sapien
ctagtctgtcagagctgcactggtg

SEQ ID NO: 550634 - DNA, 25 bp, Homo sapien
tgtcagagctgcactggtggcttat

SEQ ID NO: 550635 - DNA, 25 bp, Homo sapien
agctgcactggtggcttattgctgg

SEQ ID NO: 550636 - DNA, 25 bp, Homo sapien
ctaatttgtgtgtctttacaactga

SEQ ID NO: 550637 - DNA, 25 bp, Homo sapien
gaaactatatgtatctcgtggatct

SEQ ID NO: 550638 - DNA, 25 bp, Homo sapien
actatatgtatctcgtggatctgcc

SEQ ID NO: 550639 - DNA, 25 bp, Homo sapien
tatatgtatctcgtggatctgccag

SEQ ID NO: 550640 - DNA, 25 bp, Homo sapien
atatgtatctcgtggatctgccagt

SEQ ID NO: 550641 - DNA, 25 bp, Homo sapien
atgtatctcgtggatctgccagtac

SEQ ID NO: 550642 - DNA, 25 bp, Homo sapien
gtatctcgtggatctgccagtacca

SEQ ID NO: 550643 - DNA, 25 bp, Homo sapien
atctcgtggatctgccagtaccagc

SEQ ID NO: 550644 - DNA, 25 bp, Homo sapien
actctttcagagttagagacacctg

SEQ ID NO: 550645 - DNA, 25 bp, Homo sapien
ctttcagagttagagacacctggga

SEQ ID NO: 550646 - DNA, 25 bp, Homo sapien
gacacctgggaaatactcacttaca

SEQ ID NO: 550647 - DNA, 25 bp, Homo sapien
acctgggaaatactcacttacacca

SEQ ID NO: 550648 - DNA, 25 bp, Homo sapien
agcagcgtgacttcagcgagtcccg

SEQ ID NO: 550649 - DNA, 25 bp, Homo sapien
agcgtgacttcagcgagtcccgcga

SEQ ID NO: 550650 - DNA, 25 bp, Homo sapien
gtgacttcagcgagtcccgcgagca

SEQ ID NO: 550651 - DNA, 25 bp, Homo sapien
gagtcccgcgagcacctggctagac

SEQ ID NO: 550652 - DNA, 25 bp, Homo sapien
gcgagcacctggctagacagttaac

SEQ ID NO: 550653 - DNA, 25 bp, Homo sapien
gagcacctggctagacagttaacaa

SEQ ID NO: 550654 - DNA, 25 bp, Homo sapien
acagttaacaagcacgtccttccag

SEQ ID NO: 550655 - DNA, 25 bp, Homo sapien
taacaagcacgtccttccagcctga

SEQ ID NO: 550656 - DNA, 25 bp, Homo sapien
tccccgtagtgaccaattcctatct

SEQ ID NO: 550657 - DNA, 25 bp, Homo sapien
cgtagtgaccaattcctatctcttc

SEQ ID NO: 550658 - DNA, 25 bp, Homo sapien
tagtgaccaattcctatctcttccc

SEQ ID NO: 550659 - DNA, 25 bp, Homo sapien
gggctcagcagcgacatctctactc

SEQ ID NO: 550660 - DNA, 25 bp, Homo sapien
agccctggctgcaatgtctctacca

SEQ ID NO: 550661 - DNA, 25 bp, Homo sapien
tggctgcaatgtctctaccacatcc

SEQ ID NO: 550662 - DNA, 25 bp, Homo sapien
cccgcctctcagaaaagctgctgtg

SEQ ID NO: 550663 - DNA, 25 bp, Homo sapien
cgcctctcagaaaagctgctgtggt

SEQ ID NO: 550664 - DNA, 25 bp, Homo sapien
gggattgggccatctgtctcctggc

SEQ ID NO: 550665 - DNA, 25 bp, Homo sapien
tggccttcctgttccagccactggg

SEQ ID NO: 550666 - DNA, 25 bp, Homo sapien
gccaggttcactgggaccagggcta

SEQ ID NO: 550667 - DNA, 25 bp, Homo sapien
caggttcactgggaccagggctaca

SEQ ID NO: 550668 - DNA, 25 bp, Homo sapien
accagggctacaggcacagagtctc

SEQ ID NO: 550669 - DNA, 25 bp, Homo sapien
cagggctacaggcacagagtctcct

SEQ ID NO: 550670 - DNA, 25 bp, Homo sapien
tccctcacttctcttaagccaagaa

SEQ ID NO: 550671 - DNA, 25 bp, Homo sapien
agccaagaagtttgctttccctagc

SEQ ID NO: 550672 - DNA, 25 bp, Homo sapien
aagaagtttgctttccctagctgca

SEQ ID NO: 550673 - DNA, 25 bp, Homo sapien
ttgctttccctagctgcagtgtaga

SEQ ID NO: 550674 - DNA, 25 bp, Homo sapien
tttccctagctgcagtgtagatggc

SEQ ID NO: 550675 - DNA, 25 bp, Homo sapien
gctgcagtgtagatggctcttgttt

SEQ ID NO: 550676 - DNA, 25 bp, Homo sapien
agtgtagatggctcttgtttttgtt

SEQ ID NO: 550677 - DNA, 25 bp, Homo sapien
taatcatttggcattcacatgtggc

SEQ ID NO: 550678 - DNA, 25 bp, Homo sapien
catttggcattcacatgtggctgtt

SEQ ID NO: 550679 - DNA, 25 bp, Homo sapien
catgtggctgttaatatgtgcttgt

SEQ ID NO: 550680 - DNA, 25 bp, Homo sapien
tggctgttaatatgtgcttgttttt

SEQ ID NO: 550681 - DNA, 25 bp, Homo sapien
aagctgggccatgccagtgaccgca

SEQ ID NO: 550682 - DNA, 25 bp, Homo sapien
agtgaccgcatcatcgccctggatg

SEQ ID NO: 550683 - DNA, 25 bp, Homo sapien
aaaattccaccttctcggagatctt

SEQ ID NO: 550684 - DNA, 25 bp, Homo sapien
tcaaaaaggagcacccggaccgctt

SEQ ID NO: 550685 - DNA, 25 bp, Homo sapien
accgcttcatcgagtgctacattgc

SEQ ID NO: 550686 - DNA, 25 bp, Homo sapien
gtgggctgtgccacccgcaacagga

SEQ ID NO: 550687 - DNA, 25 bp, Homo sapien
gcaacaggacggtgcccttctgcag

SEQ ID NO: 550688 - DNA, 25 bp, Homo sapien
ttttgcagccttcttcacgcgggcc

SEQ ID NO: 550689 - DNA, 25 bp, Homo sapien
tttgaccagattcgcatggccgcca

SEQ ID NO: 550690 - DNA, 25 bp, Homo sapien
atggccgccatctccgagagcaaca

SEQ ID NO: 550691 - DNA, 25 bp, Homo sapien
gagagcaacatcaacctctgcggct

SEQ ID NO: 550692 - DNA, 25 bp, Homo sapien
tctgtttctgctgttacctgattat

SEQ ID NO: 550693 - DNA, 25 bp, Homo sapien
gttacctgattatgccatctagttg

SEQ ID NO: 550694 - DNA, 25 bp, Homo sapien
tttaggtccttgaggcagtgcagtt

SEQ ID NO: 550695 - DNA, 25 bp, Homo sapien
agtgcagttgcatttatgacagtag

SEQ ID NO: 550696 - DNA, 25 bp, Homo sapien
aatgtggatttaatgaggaccttca

SEQ ID NO: 550697 - DNA, 25 bp, Homo sapien
aatttttccatacttgaccacagat

SEQ ID NO: 550698 - DNA, 25 bp, Homo sapien
ttttacttcacattggtatgcgaag

SEQ ID NO: 550699 - DNA, 25 bp, Homo sapien
atgcgaagtagtgcctgctggtacc

SEQ ID NO: 550700 - DNA, 25 bp, Homo sapien
tgctggtaccacttatatttttgtt

SEQ ID NO: 550701 - DNA, 25 bp, Homo sapien
tgttaggaccagtaggaggcaccaa

SEQ ID NO: 550702 - DNA, 25 bp, Homo sapien
ggaggcaccaacatccatggtgtaa

SEQ ID NO: 550703 - DNA, 25 bp, Homo sapien
gcagtggctagggacatttcctggg

SEQ ID NO: 550704 - DNA, 25 bp, Homo sapien
agggacatttcctggggacactctc

SEQ ID NO: 550705 - DNA, 25 bp, Homo sapien
tggaagggatgttacggtacaaacg

SEQ ID NO: 550706 - DNA, 25 bp, Homo sapien
ggatgttacggtacaaacgtatatt

SEQ ID NO: 550707 - DNA, 25 bp, Homo sapien
cgcgtgtgcacataggcgtgatgtc

SEQ ID NO: 550708 - DNA, 25 bp, Homo sapien
acataggcgtgatgtctgtgaccct

SEQ ID NO: 550709 - DNA, 25 bp, Homo sapien
ataggcgtgatgtctgtgaccctcc

SEQ ID NO: 550710 - DNA, 25 bp, Homo sapien
aggcgtgatgtctgtgaccctcctc

SEQ ID NO: 550711 - DNA, 25 bp, Homo sapien
gtgatgtctgtgaccctcctctcct

SEQ ID NO: 550712 - DNA, 25 bp, Homo sapien
ctcgtcacatttcccccagaatgaa

SEQ ID NO: 550713 - DNA, 25 bp, Homo sapien
ttcccccagaatgaatgctgtcctg

SEQ ID NO: 550714 - DNA, 25 bp, Homo sapien
aatgccgcggacacgttttcactgt

SEQ ID NO: 550715 - DNA, 25 bp, Homo sapien
gcggacacgttttcactgtcaccct

SEQ ID NO: 550716 - DNA, 25 bp, Homo sapien
gttttcactgtcaccctcgttctgt

SEQ ID NO: 550717 - DNA, 25 bp, Homo sapien
ctcgttctgtctgccacctgaaggg

SEQ ID NO: 550718 - DNA, 25 bp, Homo sapien
gaagggaatttgaggaccgccgcca

SEQ ID NO: 550719 - DNA, 25 bp, Homo sapien
ccgtacatacacacagctgcttttg

SEQ ID NO: 550720 - DNA, 25 bp, Homo sapien
tacacacagctgcttttgtggaggt

SEQ ID NO: 550721 - DNA, 25 bp, Homo sapien
cacagctgcttttgtggaggtggac

SEQ ID NO: 550722 - DNA, 25 bp, Homo sapien
acgaaaggctgtggccggcagacgt

SEQ ID NO: 550723 - DNA, 25 bp, Homo sapien
aggagttagcccttatccccactga

SEQ ID NO: 550724 - DNA, 25 bp, Homo sapien
ttatccccactgaccaggcgggagc

SEQ ID NO: 550725 - DNA, 25 bp, Homo sapien
gctgtttcaagcatttgtacatatt

SEQ ID NO: 550726 - DNA, 25 bp, Homo sapien
gaagtctaaggagtagcaagtcagt

SEQ ID NO: 550727 - DNA, 25 bp, Homo sapien
tagcaagtcagtgggaggacttttt

SEQ ID NO: 550728 - DNA, 25 bp, Homo sapien
tttttcacccctggcattagcagct

SEQ ID NO: 550729 - DNA, 25 bp, Homo sapien
gcattagcagcttcgacctcatttt

SEQ ID NO: 550730 - DNA, 25 bp, Homo sapien
gacctcattttccagatgcaccagc

SEQ ID NO: 550731 - DNA, 25 bp, Homo sapien
gatgcaccagctcctattaataagt

SEQ ID NO: 550732 - DNA, 25 bp, Homo sapien
aaagtgtatgtcacgtgcaggaaca

SEQ ID NO: 550733 - DNA, 25 bp, Homo sapien
caaaggtattttgtgtctagtgtca

SEQ ID NO: 550734 - DNA, 25 bp, Homo sapien
attggagctattcttcactggtcct

SEQ ID NO: 550735 - DNA, 25 bp, Homo sapien
tattcttcactggtccttaaccttg

SEQ ID NO: 550736 - DNA, 25 bp, Homo sapien
aagctgggccatgccagtgaccgca

SEQ ID NO: 550737 - DNA, 25 bp, Homo sapien
tgggccatgccagtgaccgcatcat

SEQ ID NO: 550738 - DNA, 25 bp, Homo sapien
agtgaccgcatcatcgccctggatg

SEQ ID NO: 550739 - DNA, 25 bp, Homo sapien
tgaccgcatcatcgccctggatggg

SEQ ID NO: 550740 - DNA, 25 bp, Homo sapien
aaaattccaccttctcggagatctt

SEQ ID NO: 550741 - DNA, 25 bp, Homo sapien
aattccaccttctcggagatcttca

SEQ ID NO: 550742 - DNA, 25 bp, Homo sapien
tccaccttctcggagatcttcaaaa

SEQ ID NO: 550743 - DNA, 25 bp, Homo sapien
caccttctcggagatcttcaaaaag

SEQ ID NO: 550744 - DNA, 25 bp, Homo sapien
ccttctcggagatcttcaaaaagga

SEQ ID NO: 550745 - DNA, 25 bp, Homo sapien
tcaaaaaggagcacccggaccgctt

SEQ ID NO: 550746 - DNA, 25 bp, Homo sapien
ggagcacccggaccgcttcatcgag

SEQ ID NO: 550747 - DNA, 25 bp, Homo sapien
gaatccttgatattactggccagca

SEQ ID NO: 550748 - DNA, 25 bp, Homo sapien
aagagcatatgccttccttaccgcc

SEQ ID NO: 550749 - DNA, 25 bp, Homo sapien
tctggtggtacccaggcaacagaat

SEQ ID NO: 550750 - DNA, 25 bp, Homo sapien
ggcaacagaatccaacatcatgacc

SEQ ID NO: 550751 - DNA, 25 bp, Homo sapien
aaggcagaggcgtagtcatccaact

SEQ ID NO: 550752 - DNA, 25 bp, Homo sapien
ggcgtagtcatccaacttttcaaag

SEQ ID NO: 550753 - DNA, 25 bp, Homo sapien
acttttcaaagtccaccacttcttg

SEQ ID NO: 550754 - DNA, 25 bp, Homo sapien
tccaccacttcttgattcacatttt

SEQ ID NO: 550755 - DNA, 25 bp, Homo sapien
catttttataagcttcctcgtcgaa

SEQ ID NO: 550756 - DNA, 25 bp, Homo sapien
taagcttcctcgtcgaaggtgagct

SEQ ID NO: 550757 - DNA, 25 bp, Homo sapien
atttaagcattgcaacaggcacaaa

SEQ ID NO: 550758 - DNA, 25 bp, Homo sapien
tgaatcggggaaaatatttgctaca

SEQ ID NO: 550759 - DNA, 25 bp, Homo sapien
gaatcggggaaaatatttgctacat

SEQ ID NO: 550760 - DNA, 25 bp, Homo sapien
aatcggggaaaatatttgctacata

SEQ ID NO: 550761 - DNA, 25 bp, Homo sapien
atcggggaaaatatttgctacataa

SEQ ID NO: 550762 - DNA, 25 bp, Homo sapien
tcggggaaaatatttgctacataac

SEQ ID NO: 550763 - DNA, 25 bp, Homo sapien
cggggaaaatatttgctacataact

SEQ ID NO: 550764 - DNA, 25 bp, Homo sapien
gggaaaatatttgctacataactaa

SEQ ID NO: 550765 - DNA, 25 bp, Homo sapien
ggaaaatatttgctacataactaag

SEQ ID NO: 550766 - DNA, 25 bp, Homo sapien
gaaaatatttgctacataactaaga

SEQ ID NO: 550767 - DNA, 25 bp, Homo sapien
aaaatatttgctacataactaagaa

SEQ ID NO: 550768 - DNA, 25 bp, Homo sapien
tttgctacataactaagaatgaagg

SEQ ID NO: 550769 - DNA, 25 bp, Homo sapien
tggcaattgactatagtgtgagcca

SEQ ID NO: 550770 - DNA, 25 bp, Homo sapien
ggcaattgactatagtgtgagccag

SEQ ID NO: 550771 - DNA, 25 bp, Homo sapien
gcaattgactatagtgtgagccagg

SEQ ID NO: 550772 - DNA, 25 bp, Homo sapien
caattgactatagtgtgagccagga

SEQ ID NO: 550773 - DNA, 25 bp, Homo sapien
aattgactatagtgtgagccaggaa

SEQ ID NO: 550774 - DNA, 25 bp, Homo sapien
attgactatagtgtgagccaggaat

SEQ ID NO: 550775 - DNA, 25 bp, Homo sapien
ttgactatagtgtgagccaggaatc

SEQ ID NO: 550776 - DNA, 25 bp, Homo sapien
tgactatagtgtgagccaggaatca

SEQ ID NO: 550777 - DNA, 25 bp, Homo sapien
gactatagtgtgagccaggaatcac

SEQ ID NO: 550778 - DNA, 25 bp, Homo sapien
actatagtgtgagccaggaatcact

SEQ ID NO: 550779 - DNA, 25 bp, Homo sapien
ctatagtgtgagccaggaatcactg

SEQ ID NO: 550780 - DNA, 25 bp, Homo sapien
ctcagggagtcacagcacaacggca

SEQ ID NO: 550781 - DNA, 25 bp, Homo sapien
cagctcctcggtcccagacggagga

SEQ ID NO: 550782 - DNA, 25 bp, Homo sapien
agcaagacacaagcgatgacaccga

SEQ ID NO: 550783 - DNA, 25 bp, Homo sapien
agcgatgacaccgatttacacacac

SEQ ID NO: 550784 - DNA, 25 bp, Homo sapien
gatttacacacacccggtttagacg

SEQ ID NO: 550785 - DNA, 25 bp, Homo sapien
cacacacccggtttagacgccaaag

SEQ ID NO: 550786 - DNA, 25 bp, Homo sapien
acccggtttagacgccaaagctctg

SEQ ID NO: 550787 - DNA, 25 bp, Homo sapien
ggtttagacgccaaagctctgcggg

SEQ ID NO: 550788 - DNA, 25 bp, Homo sapien
gaggagcggccctcaagagtcctcc

SEQ ID NO: 550789 - DNA, 25 bp, Homo sapien
gcggccctcaagagtcctccgggag

SEQ ID NO: 550790 - DNA, 25 bp, Homo sapien
cgccaggccccgaggagcagtcagg

SEQ ID NO: 550791 - DNA, 25 bp, Homo sapien
tgaagcctcgagttccatgcacatt

SEQ ID NO: 550792 - DNA, 25 bp, Homo sapien
attcacagcagccactcgaaactgg

SEQ ID NO: 550793 - DNA, 25 bp, Homo sapien
cactcgaaactggtaccatcggctg

SEQ ID NO: 550794 - DNA, 25 bp, Homo sapien
catcggctgggtcttatgtcagtca

SEQ ID NO: 550795 - DNA, 25 bp, Homo sapien
atgtcagtcagttgaactcgctcgt

SEQ ID NO: 550796 - DNA, 25 bp, Homo sapien
ttgaactcgctcgtctgtggtctgg

SEQ ID NO: 550797 - DNA, 25 bp, Homo sapien
actgtctgccagtgagtggcgtcat

SEQ ID NO: 550798 - DNA, 25 bp, Homo sapien
tccccatcactgttgacggtggagt

SEQ ID NO: 550799 - DNA, 25 bp, Homo sapien
gtggcgtcatcttcgctaggatgga

SEQ ID NO: 550800 - DNA, 25 bp, Homo sapien
taattccatcttctttgtaccacat

SEQ ID NO: 550801 - DNA, 25 bp, Homo sapien
tgtaccacatagatcacaggctcaa

SEQ ID NO: 550802 - DNA, 25 bp, Homo sapien
aatcagctgaccttgagatggtgag

SEQ ID NO: 550803 - DNA, 25 bp, Homo sapien
tgagatggtgagactatctgggatc

SEQ ID NO: 550804 - DNA, 25 bp, Homo sapien
atctgggtgggtccaatgtcatcac

SEQ ID NO: 550805 - DNA, 25 bp, Homo sapien
atgtcatcacaatgttccttataag

SEQ ID NO: 550806 - DNA, 25 bp, Homo sapien
agaaagaatcagaaaggcggcagca

SEQ ID NO: 550807 - DNA, 25 bp, Homo sapien
cggcagcatgaggaaggctcagcct

SEQ ID NO: 550808 - DNA, 25 bp, Homo sapien
gagcgaaggaatgcaggaagcctct

SEQ ID NO: 550809 - DNA, 25 bp, Homo sapien
tgctgacacctggacttgtacctag

SEQ ID NO: 550810 - DNA, 25 bp, Homo sapien
gacttgtacctagtgaaacccattt

SEQ ID NO: 550811 - DNA, 25 bp, Homo sapien
agacttcagacctccaaaactgtgc

SEQ ID NO: 550812 - DNA, 25 bp, Homo sapien
cagacctccaaaactgtgcagtaat

SEQ ID NO: 550813 - DNA, 25 bp, Homo sapien
aggtggcataagtggttcaagaaac

SEQ ID NO: 550814 - DNA, 25 bp, Homo sapien
gaaacttgagcttggctgtaatcaa

SEQ ID NO: 550815 - DNA, 25 bp, Homo sapien
ttgagcttggctgtaatcaaaagca

SEQ ID NO: 550816 - DNA, 25 bp, Homo sapien
agcaagattattcttatctccactt

SEQ ID NO: 550817 - DNA, 25 bp, Homo sapien
ttattcttatctccacttctctgaa

SEQ ID NO: 550818 - DNA, 25 bp, Homo sapien
tatctccacttctctgaatgttttt

SEQ ID NO: 550819 - DNA, 25 bp, Homo sapien
aacataaggctgatctttggtcagt

SEQ ID NO: 550820 - DNA, 25 bp, Homo sapien
aggctgatctttggtcagttactga

SEQ ID NO: 550821 - DNA, 25 bp, Homo sapien
gtcagttactgagggagtttgtaga

SEQ ID NO: 550822 - DNA, 25 bp, Homo sapien
gaagagtcagtatagtcttgtgttt

SEQ ID NO: 550823 - DNA, 25 bp, Homo sapien
cttcaactgagggtcattttaccag

SEQ ID NO: 550824 - DNA, 25 bp, Homo sapien
aacattattccatctcatttaaagg

SEQ ID NO: 550825 - DNA, 25 bp, Homo sapien
gaaatttatattctacacgtccaaa

SEQ ID NO: 550826 - DNA, 25 bp, Homo sapien
atattctacacgtccaaactgtctc

SEQ ID NO: 550827 - DNA, 25 bp, Homo sapien
aaactgtctcctagcagcttttgga

SEQ ID NO: 550828 - DNA, 25 bp, Homo sapien
gtctcctagcagcttttggactata

SEQ ID NO: 550829 - DNA, 25 bp, Homo sapien
gcagcttttggactatatatcactt

SEQ ID NO: 550830 - DNA, 25 bp, Homo sapien
ggactatatatcacttgatgttaaa

SEQ ID NO: 550831 - DNA, 25 bp, Homo sapien
gaagctctaatgtatacctagatta

SEQ ID NO: 550832 - DNA, 25 bp, Homo sapien
tcaaatcacagttttatgcttttaa

SEQ ID NO: 550833 - DNA, 25 bp, Homo sapien
tattttaatttctgagtgcatgtta

SEQ ID NO: 550834 - DNA, 25 bp, Homo sapien
ttctgagtgcatgttatatagtatt

SEQ ID NO: 550835 - DNA, 25 bp, Homo sapien
gagaaatgctatcaacatctgtgat

SEQ ID NO: 550836 - DNA, 25 bp, Homo sapien
atctgtgatttctaagagtcttacc

SEQ ID NO: 550837 - DNA, 25 bp, Homo sapien
gttactttaattcttgtgtcctgct

SEQ ID NO: 550838 - DNA, 25 bp, Homo sapien
taattcttgtgtcctgctgagtggt

SEQ ID NO: 550839 - DNA, 25 bp, Homo sapien
taccatttttatcaccctgtggcac

SEQ ID NO: 550840 - DNA, 25 bp, Homo sapien
cactgggtgtgttactgcgattaca

SEQ ID NO: 550841 - DNA, 25 bp, Homo sapien
gcgattacactgatgattctgagct

SEQ ID NO: 550842 - DNA, 25 bp, Homo sapien
gattctgagctgtgcttcttcaagt

SEQ ID NO: 550843 - DNA, 25 bp, Homo sapien
aagtagctcagttcttgcgttttat

SEQ ID NO: 550844 - DNA, 25 bp, Homo sapien
aacagttttgtgatgcttttgtgca

SEQ ID NO: 550845 - DNA, 25 bp, Homo sapien
atctcttctgagttttcgaatctgt

SEQ ID NO: 550846 - DNA, 25 bp, Homo sapien
gaaacctgaggctagacttctgaca

SEQ ID NO: 550847 - DNA, 25 bp, Homo sapien
tgaggctagacttctgacacaagaa

SEQ ID NO: 550848 - DNA, 25 bp, Homo sapien
tttaatgtcctagcttggtttggtc

SEQ ID NO: 550849 - DNA, 25 bp, Homo sapien
gaatctgtcgagagcacagtctccc

SEQ ID NO: 550850 - DNA, 25 bp, Homo sapien
agcacagtctcccagtcaataagaa

SEQ ID NO: 550851 - DNA, 25 bp, Homo sapien
gatgagctcgcacccttgagaagaa

SEQ ID NO: 550852 - DNA, 25 bp, Homo sapien
gtcctagcttggtttggtcttgaaa

SEQ ID NO: 550853 - DNA, 25 bp, Homo sapien
agaaccttcatgagccaattcccaa

SEQ ID NO: 550854 - DNA, 25 bp, Homo sapien
attcccaaagcatcaactccgcatg

SEQ ID NO: 550855 - DNA, 25 bp, Homo sapien
aactccgcatggatactttgcacac

SEQ ID NO: 550856 - DNA, 25 bp, Homo sapien
caaatgaaatgctcctcccttggcc

SEQ ID NO: 550857 - DNA, 25 bp, Homo sapien
tggaccgggactgggccatcacctt

SEQ ID NO: 550858 - DNA, 25 bp, Homo sapien
ttaactgagcctgccctggtcaagt

SEQ ID NO: 550859 - DNA, 25 bp, Homo sapien
agcctgccctggtcaagtactttga

SEQ ID NO: 550860 - DNA, 25 bp, Homo sapien
tcaagtactttgacaagcccgtgtg

SEQ ID NO: 550861 - DNA, 25 bp, Homo sapien
gtgcatgatggccaggattaccagt

SEQ ID NO: 550862 - DNA, 25 bp, Homo sapien
gatggccaggattaccagtgcaaaa

SEQ ID NO: 550863 - DNA, 25 bp, Homo sapien
acatccggatgatgggcaagcccct

SEQ ID NO: 550864 - DNA, 25 bp, Homo sapien
acctcggccagtgactatgaaatct

SEQ ID NO: 550865 - DNA, 25 bp, Homo sapien
gactatgaaatctcggccatgtccg

SEQ ID NO: 550866 - DNA, 25 bp, Homo sapien
atgtccggctgacacgggcgccttc

SEQ ID NO: 550867 - DNA, 25 bp, Homo sapien
ggagggattttttatgttcttctgt

SEQ ID NO: 550868 - DNA, 25 bp, Homo sapien
tcttttttcgttttgcagtaattag

SEQ ID NO: 550869 - DNA, 25 bp, Homo sapien
ttcgttttgcagtaattagtgttgg

SEQ ID NO: 550870 - DNA, 25 bp, Homo sapien
attagtgttggttctgtctcttttc

SEQ ID NO: 550871 - DNA, 25 bp, Homo sapien
ggttctgtctcttttcctgtctcca

SEQ ID NO: 550872 - DNA, 25 bp, Homo sapien
agatgtaagcatttctgaagggcag

SEQ ID NO: 550873 - DNA, 25 bp, Homo sapien
tttctgaagggcaggaaagctggta

SEQ ID NO: 550874 - DNA, 25 bp, Homo sapien
ctggtaggggctttatgaaatctcc

SEQ ID NO: 550875 - DNA, 25 bp, Homo sapien
ttatgaaatctccatgaggccagtt

SEQ ID NO: 550876 - DNA, 25 bp, Homo sapien
atgaggccagtttcatgacttagca

SEQ ID NO: 550877 - DNA, 25 bp, Homo sapien
cacagggctggtcttcagatccaag

SEQ ID NO: 550878 - DNA, 25 bp, Homo sapien
cagggctggtcttcagatccaaggc

SEQ ID NO: 550879 - DNA, 25 bp, Homo sapien
tgctggaacaggcagccggctactt

SEQ ID NO: 550880 - DNA, 25 bp, Homo sapien
tacgaggcggtgaatgaggtctaca

SEQ ID NO: 550881 - DNA, 25 bp, Homo sapien
tggaagcccaccgtgactacaagaa

SEQ ID NO: 550882 - DNA, 25 bp, Homo sapien
actacaagaagctggccgcggtgca

SEQ ID NO: 550883 - DNA, 25 bp, Homo sapien
tgcacggcaaactgcaggaggcctt

SEQ ID NO: 550884 - DNA, 25 bp, Homo sapien
gaggccttcaccaagatcatgcacc

SEQ ID NO: 550885 - DNA, 25 bp, Homo sapien
aagatcatgcaccagagttccggct

SEQ ID NO: 550886 - DNA, 25 bp, Homo sapien
gcgcgtgttcgggacgtatttccgc

SEQ ID NO: 550887 - DNA, 25 bp, Homo sapien
gtatttccgcgtgggcttctacggc

SEQ ID NO: 550888 - DNA, 25 bp, Homo sapien
acttcggtgacctggatgagcagga

SEQ ID NO: 550889 - DNA, 25 bp, Homo sapien
gtacaaggagccatcgatcacgaag

SEQ ID NO: 550890 - DNA, 25 bp, Homo sapien
gaaaatgagcccgaattatttcact

SEQ ID NO: 550891 - DNA, 25 bp, Homo sapien
gcccgaattatttcactattactgt

SEQ ID NO: 550892 - DNA, 25 bp, Homo sapien
taaagggttcatcttactctggcat

SEQ ID NO: 550893 - DNA, 25 bp, Homo sapien
ggttcatcttactctggcattctga

SEQ ID NO: 550894 - DNA, 25 bp, Homo sapien
tcttactctggcattctgagaatta

SEQ ID NO: 550895 - DNA, 25 bp, Homo sapien
gatgttataacacaaagtcattcct

SEQ ID NO: 550896 - DNA, 25 bp, Homo sapien
caaagtcattcctactcaaatgtaa

SEQ ID NO: 550897 - DNA, 25 bp, Homo sapien
aaaattgaggctccacggaggcccg

SEQ ID NO: 550898 - DNA, 25 bp, Homo sapien
aggcccgtgtccacatcagctgcag

SEQ ID NO: 550899 - DNA, 25 bp, Homo sapien
gcctgccctttgctgaagataccct

SEQ ID NO: 550900 - DNA, 25 bp, Homo sapien
tgaagataccctcgctttatacttg

SEQ ID NO: 550901 - DNA, 25 bp, Homo sapien
gttatccacaacctttatgtgcaat

SEQ ID NO: 550902 - DNA, 25 bp, Homo sapien
tccacaacctttatgtgcaataagg

SEQ ID NO: 550903 - DNA, 25 bp, Homo sapien
caataaggaaaactgcagtaggccc

SEQ ID NO: 550904 - DNA, 25 bp, Homo sapien
gaaaactgcagtaggcccccaaagt

SEQ ID NO: 550905 - DNA, 25 bp, Homo sapien
ctagcattttactcaatgtttgcct

SEQ ID NO: 550906 - DNA, 25 bp, Homo sapien
attttactcaatgtttgcctttgtg

SEQ ID NO: 550907 - DNA, 25 bp, Homo sapien
tactcaatgtttgcctttgtgtatg

SEQ ID NO: 550908 - DNA, 25 bp, Homo sapien
atgtttgcctttgtgtatgtttaga

SEQ ID NO: 550909 - DNA, 25 bp, Homo sapien
gcctttgtgtatgtttagattgcta

SEQ ID NO: 550910 - DNA, 25 bp, Homo sapien
gattgctattgtaaagctagccatg

SEQ ID NO: 550911 - DNA, 25 bp, Homo sapien
gtaaagctagccatgtgtgttcctg

SEQ ID NO: 550912 - DNA, 25 bp, Homo sapien
attcaagtttgttgctccgttttgc

SEQ ID NO: 550913 - DNA, 25 bp, Homo sapien
ctccgttttgcacctctgcaataaa

SEQ ID NO: 550914 - DNA, 25 bp, Homo sapien
gacaaagtagacttccttgtgttaa

SEQ ID NO: 550915 - DNA, 25 bp, Homo sapien
tttccttaactatatctgtctacag

SEQ ID NO: 550916 - DNA, 25 bp, Homo sapien
gtctacaggcagatacagatagttg

SEQ ID NO: 550917 - DNA, 25 bp, Homo sapien
ttgtatgaaaatctgcttgcctgta

SEQ ID NO: 550918 - DNA, 25 bp, Homo sapien
atctgcttgcctgtaaaatttgcat

SEQ ID NO: 550919 - DNA, 25 bp, Homo sapien
aaatgtgttgccgatggatcacttg

SEQ ID NO: 550920 - DNA, 25 bp, Homo sapien
gatcacttgggcctgtacacatacc

SEQ ID NO: 550921 - DNA, 25 bp, Homo sapien
acataccaattagcgtgaccacttc

SEQ ID NO: 550922 - DNA, 25 bp, Homo sapien
cgtgaccacttccatcttaaaaaca

SEQ ID NO: 550923 - DNA, 25 bp, Homo sapien
aggctcgggacctgttgcaagccgc

SEQ ID NO: 550924 - DNA, 25 bp, Homo sapien
gggacctgttgcaagccgctcagga

SEQ ID NO: 550925 - DNA, 25 bp, Homo sapien
gttgcaagccgctcaggacaagctg

SEQ ID NO: 550926 - DNA, 25 bp, Homo sapien
tacaggaattggaaggcacctatga

SEQ ID NO: 550927 - DNA, 25 bp, Homo sapien
cctatgaggaaaatgagcgggcact

SEQ ID NO: 550928 - DNA, 25 bp, Homo sapien
gccaggatgcgcagcgtgcttcaag

SEQ ID NO: 550929 - DNA, 25 bp, Homo sapien
atgcgcagcgtgcttcaagccatca

SEQ ID NO: 550930 - DNA, 25 bp, Homo sapien
agccatcaacttgcaggtgcagatc

SEQ ID NO: 550931 - DNA, 25 bp, Homo sapien
aggtgcagatctacaacacctgcca

SEQ ID NO: 550932 - DNA, 25 bp, Homo sapien
acatgcatgtctgcctatgcactga

SEQ ID NO: 550933 - DNA, 25 bp, Homo sapien
atgcatgtctgcctatgcactgaag

SEQ ID NO: 550934 - DNA, 25 bp, Homo sapien
tatgactacatcaaggtgagcctgc

SEQ ID NO: 550935 - DNA, 25 bp, Homo sapien
gagcctgcaatgaacacttgtcctg

SEQ ID NO: 550936 - DNA, 25 bp, Homo sapien
tgaacacttgtcctggagatgctgg

SEQ ID NO: 550937 - DNA, 25 bp, Homo sapien
gatgctggaaaatcttggctgagtt

SEQ ID NO: 550938 - DNA, 25 bp, Homo sapien
ttgatattgcggaaccttcaccttc

SEQ ID NO: 550939 - DNA, 25 bp, Homo sapien
ttcttctcccaggatagagagccta

SEQ ID NO: 550940 - DNA, 25 bp, Homo sapien
gagagcctagcagctagttcctcaa

SEQ ID NO: 550941 - DNA, 25 bp, Homo sapien
accatcttagttagatctattccag

SEQ ID NO: 550942 - DNA, 25 bp, Homo sapien
tctattccaggaatctctgatccga

SEQ ID NO: 550943 - DNA, 25 bp, Homo sapien
tctgatccgaaatgaccccactggc

SEQ ID NO: 550944 - DNA, 25 bp, Homo sapien
aggagagtcgtgaatctgcatttta

SEQ ID NO: 550945 - DNA, 25 bp, Homo sapien
aaacctttggatttgatgtagagga

SEQ ID NO: 550946 - DNA, 25 bp, Homo sapien
ggaagctttgcagacactgcttaga

SEQ ID NO: 550947 - DNA, 25 bp, Homo sapien
atgtgtataagctgctgtctttgat

SEQ ID NO: 550948 - DNA, 25 bp, Homo sapien
aagctgctgtctttgattactgtgt

SEQ ID NO: 550949 - DNA, 25 bp, Homo sapien
accctactattttgccgctgcaata

SEQ ID NO: 550950 - DNA, 25 bp, Homo sapien
gccgctgcaatatgtagtcacatca

SEQ ID NO: 550951 - DNA, 25 bp, Homo sapien
atgtagtcacatcaccatttccatt

SEQ ID NO: 550952 - DNA, 25 bp, Homo sapien
accatttccattcctctaattaggg

SEQ ID NO: 550953 - DNA, 25 bp, Homo sapien
aataccacttcttgttctttccaat

SEQ ID NO: 550954 - DNA, 25 bp, Homo sapien
tttattccattgtgtagccccaaga

SEQ ID NO: 550955 - DNA, 25 bp, Homo sapien
gtgtagccccaagaggtgcagcttc

SEQ ID NO: 550956 - DNA, 25 bp, Homo sapien
cctgcaccctgtttgggctggtgag

SEQ ID NO: 550957 - DNA, 25 bp, Homo sapien
tgcaccctgtttgggctggtgagct

SEQ ID NO: 550958 - DNA, 25 bp, Homo sapien
tgggagttcaggtgggctgctcaca

SEQ ID NO: 550959 - DNA, 25 bp, Homo sapien
tcagaggccccaccaatttctcgga

SEQ ID NO: 550960 - DNA, 25 bp, Homo sapien
agaggccccaccaatttctcggaca

SEQ ID NO: 550961 - DNA, 25 bp, Homo sapien
accaatttctcggacacttctcagt

SEQ ID NO: 550962 - DNA, 25 bp, Homo sapien
aatttctcggacacttctcagtgtg

SEQ ID NO: 550963 - DNA, 25 bp, Homo sapien
atttctcggacacttctcagtgtgt

SEQ ID NO: 550964 - DNA, 25 bp, Homo sapien
tctcggacacttctcagtgtgtgga

SEQ ID NO: 550965 - DNA, 25 bp, Homo sapien
ctcagtgtgtggaagctcatgtggg

SEQ ID NO: 550966 - DNA, 25 bp, Homo sapien
ggctcatgcctgggaagtgttgtgg

SEQ ID NO: 550967 - DNA, 25 bp, Homo sapien
aaagtttcccagtcttcagcagaga

SEQ ID NO: 550968 - DNA, 25 bp, Homo sapien
tcccagtcttcagcagagaagtttt

SEQ ID NO: 550969 - DNA, 25 bp, Homo sapien
gagaagttttctggaggtctctgaa

SEQ ID NO: 550970 - DNA, 25 bp, Homo sapien
ttttccagtagttagctttcttcct

SEQ ID NO: 550971 - DNA, 25 bp, Homo sapien
tagttagctttcttcctggattcct

SEQ ID NO: 550972 - DNA, 25 bp, Homo sapien
ggattcctcactttgaagagtgtga

SEQ ID NO: 550973 - DNA, 25 bp, Homo sapien
gaagagtgtgaggaaaacctatgtt

SEQ ID NO: 550974 - DNA, 25 bp, Homo sapien
gaagttttggcaattgactatagtg

SEQ ID NO: 550975 - DNA, 25 bp, Homo sapien
ttgactatagtgtgagccaggaatc

SEQ ID NO: 550976 - DNA, 25 bp, Homo sapien
ccaggaatcactggctgttaatctt

SEQ ID NO: 550977 - DNA, 25 bp, Homo sapien
atcactggctgttaatctttcaaag

SEQ ID NO: 550978 - DNA, 25 bp, Homo sapien
gatcatgtctcaataatctctgagc

SEQ ID NO: 550979 - DNA, 25 bp, Homo sapien
gtctcaataatctctgagcagacaa

SEQ ID NO: 550980 - DNA, 25 bp, Homo sapien
aattagttaggtctcataagtgatc

SEQ ID NO: 550981 - DNA, 25 bp, Homo sapien
gtctcataagtgatctcaacctcgc

SEQ ID NO: 550982 - DNA, 25 bp, Homo sapien
taagtgatctcaacctcgcttgatt

SEQ ID NO: 550983 - DNA, 25 bp, Homo sapien
atctcaacctcgcttgatttgcaaa

SEQ ID NO: 550984 - DNA, 25 bp, Homo sapien
aacctcgcttgatttgcaaatacaa

SEQ ID NO: 550985 - DNA, 25 bp, Homo sapien
gaaatgaagctcaaccagtcagaag

SEQ ID NO: 550986 - DNA, 25 bp, Homo sapien
gaagctcaaccagtcagaagtagcc

SEQ ID NO: 550987 - DNA, 25 bp, Homo sapien
gtcagaagtagccaacaaccttata

SEQ ID NO: 550988 - DNA, 25 bp, Homo sapien
tataaatagaaactgtccaacaagg

SEQ ID NO: 550989 - DNA, 25 bp, Homo sapien
gaagagtagaatttccccacagcaa

SEQ ID NO: 550990 - DNA, 25 bp, Homo sapien
ggattccgcccctgatctctgaaga

SEQ ID NO: 550991 - DNA, 25 bp, Homo sapien
ctgaagactgcttcttgtttgttcc

SEQ ID NO: 550992 - DNA, 25 bp, Homo sapien
gtttgttcctctgtgagccttaagg

SEQ ID NO: 550993 - DNA, 25 bp, Homo sapien
ctgtgagccttaaggattcctccac

SEQ ID NO: 550994 - DNA, 25 bp, Homo sapien
attcctccacagctggatgtgcaga

SEQ ID NO: 550995 - DNA, 25 bp, Homo sapien
ggatgtgcagaacaattctttgtca

SEQ ID NO: 550996 - DNA, 25 bp, Homo sapien
aacatcacttttcagctctatgtcc

SEQ ID NO: 550997 - DNA, 25 bp, Homo sapien
cagctctatgtccaattttccttga

SEQ ID NO: 550998 - DNA, 25 bp, Homo sapien
tgtctcatcctttaccttctggatt

SEQ ID NO: 550999 - DNA, 25 bp, Homo sapien
cttctggatttaggtgctttttaat

SEQ ID NO: 551000 - DNA, 25 bp, Homo sapien
gctggtcagccaaagaaacattcac

SEQ ID NO: 551001 - DNA, 25 bp, Homo sapien
tcactgctggtgaaccaataccata

SEQ ID NO: 551002 - DNA, 25 bp, Homo sapien
gcatgtattatctaagcacttgatc

SEQ ID NO: 551003 - DNA, 25 bp, Homo sapien
catgttgtacaagctctcaattttg

SEQ ID NO: 551004 - DNA, 25 bp, Homo sapien
tgtgatttggaaaagatgccttctg

SEQ ID NO: 551005 - DNA, 25 bp, Homo sapien
gatgccttctggatcttaagccagt

SEQ ID NO: 551006 - DNA, 25 bp, Homo sapien
aagccagttgtcagtggaggtcctc

SEQ ID NO: 551007 - DNA, 25 bp, Homo sapien
cagtggaggtcctcagggctgcaaa

SEQ ID NO: 551008 - DNA, 25 bp, Homo sapien
agttgggtggttttatccaatgtct

SEQ ID NO: 551009 - DNA, 25 bp, Homo sapien
atccaatgtctcaagcaagcaatgt

SEQ ID NO: 551010 - DNA, 25 bp, Homo sapien
atagagtaacaagtgctggtcagcc

SEQ ID NO: 551011 - DNA, 25 bp, Homo sapien
aatggcattgcccagactccaaaat

SEQ ID NO: 551012 - DNA, 25 bp, Homo sapien
gactccaaaatcctgaccagaatat

SEQ ID NO: 551013 - DNA, 25 bp, Homo sapien
gggttatttgtgaatcattttccaa

SEQ ID NO: 551014 - DNA, 25 bp, Homo sapien
gtacactttttgtgttacttaccat

SEQ ID NO: 551015 - DNA, 25 bp, Homo sapien
ttgtgttacttaccatttcaaagaa

SEQ ID NO: 551016 - DNA, 25 bp, Homo sapien
gaaacttattcttcaagaccatttc

SEQ ID NO: 551017 - DNA, 25 bp, Homo sapien
agaccatttcagatttccttaggaa

SEQ ID NO: 551018 - DNA, 25 bp, Homo sapien
taggaatgtatgtgttacccataat

SEQ ID NO: 551019 - DNA, 25 bp, Homo sapien
gtgttacccataattgaccacttca

SEQ ID NO: 551020 - DNA, 25 bp, Homo sapien
ataattgaccacttcaaacttgtaa

SEQ ID NO: 551021 - DNA, 25 bp, Homo sapien
gttctcatagtcaaaacagctaagt

SEQ ID NO: 551022 - DNA, 25 bp, Homo sapien
ggccatgggtaacctcattgtaact

SEQ ID NO: 551023 - DNA, 25 bp, Homo sapien
gggtaacctcattgtaactatcatc

SEQ ID NO: 551024 - DNA, 25 bp, Homo sapien
gtaactatcatcagaatgggcagag

SEQ ID NO: 551025 - DNA, 25 bp, Homo sapien
gcagagatgatcttgaagtgtcaca

SEQ ID NO: 551026 - DNA, 25 bp, Homo sapien
gtgtcacatacactaaagtccaaac

SEQ ID NO: 551027 - DNA, 25 bp, Homo sapien
aagtccaaacactatgtcagatggg

SEQ ID NO: 551028 - DNA, 25 bp, Homo sapien
tcagcccaatgtcaacccagttaaa

SEQ ID NO: 551029 - DNA, 25 bp, Homo sapien
aaatggttgaattagtttgcaaact

SEQ ID NO: 551030 - DNA, 25 bp, Homo sapien
aagtctgttaatgcacatcctgtgg

SEQ ID NO: 551031 - DNA, 25 bp, Homo sapien
ctgttaatgcacatcctgtgggaat

SEQ ID NO: 551032 - DNA, 25 bp, Homo sapien
cctgtgggaatggagtgttctaacc

SEQ ID NO: 551033 - DNA, 25 bp, Homo sapien
tatcgccagccttaaggtgtctgga

SEQ ID NO: 551034 - DNA, 25 bp, Homo sapien
tcgccagccttaaggtgtctggagc

SEQ ID NO: 551035 - DNA, 25 bp, Homo sapien
ccagccttaaggtgtctggagcccc

SEQ ID NO: 551036 - DNA, 25 bp, Homo sapien
acttggccaacctgaccttggaaga

SEQ ID NO: 551037 - DNA, 25 bp, Homo sapien
ttggccaacctgaccttggaagatg

SEQ ID NO: 551038 - DNA, 25 bp, Homo sapien
ggccaacctgaccttggaagatgct

SEQ ID NO: 551039 - DNA, 25 bp, Homo sapien
caacctgaccttggaagatgctgct

SEQ ID NO: 551040 - DNA, 25 bp, Homo sapien
tggaagatgctgctgagtgtctcaa

SEQ ID NO: 551041 - DNA, 25 bp, Homo sapien
tgcctgtcactctggagctgggctg

SEQ ID NO: 551042 - DNA, 25 bp, Homo sapien
ctgtcactctggagctgggctgctg

SEQ ID NO: 551043 - DNA, 25 bp, Homo sapien
tccgaccccggacagagctgagctg

SEQ ID NO: 551044 - DNA, 25 bp, Homo sapien
agacgtgaacgtgttcgaccccgat

SEQ ID NO: 551045 - DNA, 25 bp, Homo sapien
tgaacgtgttcgaccccgatcgctt

SEQ ID NO: 551046 - DNA, 25 bp, Homo sapien
gcgaggacaaggatggccgcttcca

SEQ ID NO: 551047 - DNA, 25 bp, Homo sapien
cattacctcccgttcggtggcggtg

SEQ ID NO: 551048 - DNA, 25 bp, Homo sapien
gtggagctggctagcaccagccgct

SEQ ID NO: 551049 - DNA, 25 bp, Homo sapien
tggctagcaccagccgctttgagct

SEQ ID NO: 551050 - DNA, 25 bp, Homo sapien
tgcaccccgtggatggcctcagcgt

SEQ ID NO: 551051 - DNA, 25 bp, Homo sapien
gtggatggcctcagcgtcaagttct

SEQ ID NO: 551052 - DNA, 25 bp, Homo sapien
atggcctcagcgtcaagttctttgg

SEQ ID NO: 551053 - DNA, 25 bp, Homo sapien
agcgtcaagttctttggcctggact

SEQ ID NO: 551054 - DNA, 25 bp, Homo sapien
caaccagaacgagatcctgccggag

SEQ ID NO: 551055 - DNA, 25 bp, Homo sapien
agagaagttttctggaggtctctga

SEQ ID NO: 551056 - DNA, 25 bp, Homo sapien
gagaagttttctggaggtctctgaa

SEQ ID NO: 551057 - DNA, 25 bp, Homo sapien
ttgaagagtgtgaggaaaacctatg

SEQ ID NO: 551058 - DNA, 25 bp, Homo sapien
tgaagagtgtgaggaaaacctatgt

SEQ ID NO: 551059 - DNA, 25 bp, Homo sapien
gaagagtgtgaggaaaacctatgtt

SEQ ID NO: 551060 - DNA, 25 bp, Homo sapien
agccaggaatcactggctgttaatc

SEQ ID NO: 551061 - DNA, 25 bp, Homo sapien
gccaggaatcactggctgttaatct

SEQ ID NO: 551062 - DNA, 25 bp, Homo sapien
ccaggaatcactggctgttaatctt

SEQ ID NO: 551063 - DNA, 25 bp, Homo sapien
ggttctgtaaacttttgtaatgcta

SEQ ID NO: 551064 - DNA, 25 bp, Homo sapien
gtaatgctatgaattctgtttaaat

SEQ ID NO: 551065 - DNA, 25 bp, Homo sapien
aattttgggctgtctattttctgct

SEQ ID NO: 551066 - DNA, 25 bp, Homo sapien
tgggctgtctattttctgctgaaac

SEQ ID NO: 551067 - DNA, 25 bp, Homo sapien
ggctgtctattttctgctgaaacca

SEQ ID NO: 551068 - DNA, 25 bp, Homo sapien
ttttctgctgaaaccatgcaaaatt

SEQ ID NO: 551069 - DNA, 25 bp, Homo sapien
gaaaccatgcaaaattgagctttgg

SEQ ID NO: 551070 - DNA, 25 bp, Homo sapien
ggttatgtattcatgggacctttaa

SEQ ID NO: 551071 - DNA, 25 bp, Homo sapien
tgggacctttaatttgtacagaaca

SEQ ID NO: 551072 - DNA, 25 bp, Homo sapien
agaacacagaacttatttctgtcag

SEQ ID NO: 551073 - DNA, 25 bp, Homo sapien
gagaatagatgtttcccaaaacaac

SEQ ID NO: 551074 - DNA, 25 bp, Homo sapien
cagaacatgggaagttagggaaaat

SEQ ID NO: 551075 - DNA, 25 bp, Homo sapien
gaattactgtcagaattacatacac

SEQ ID NO: 551076 - DNA, 25 bp, Homo sapien
attactgtcagaattacatacacaa

SEQ ID NO: 551077 - DNA, 25 bp, Homo sapien
ttactgtcagaattacatacacaat

SEQ ID NO: 551078 - DNA, 25 bp, Homo sapien
gtactgcaaaaatctgaatatttat

SEQ ID NO: 551079 - DNA, 25 bp, Homo sapien
gttttgcattttaatatgttgagcc

SEQ ID NO: 551080 - DNA, 25 bp, Homo sapien
tttgcattttaatatgttgagccac

SEQ ID NO: 551081 - DNA, 25 bp, Homo sapien
ttgcattttaatatgttgagccact

SEQ ID NO: 551082 - DNA, 25 bp, Homo sapien
tgcattttaatatgttgagccactg

SEQ ID NO: 551083 - DNA, 25 bp, Homo sapien
gcattttaatatgttgagccactgg

SEQ ID NO: 551084 - DNA, 25 bp, Homo sapien
cagattaatttgttataggagttta

SEQ ID NO: 551085 - DNA, 25 bp, Homo sapien
ccagccctgttccaggagaatttca

SEQ ID NO: 551086 - DNA, 25 bp, Homo sapien
ctgttccaggagaatttcaagtttt

SEQ ID NO: 551087 - DNA, 25 bp, Homo sapien
caagttttacaggttgagcttcaag

SEQ ID NO: 551088 - DNA, 25 bp, Homo sapien
caggttgagcttcaagatggttttt

SEQ ID NO: 551089 - DNA, 25 bp, Homo sapien
tctcatccaggctgaaggatttttt

SEQ ID NO: 551090 - DNA, 25 bp, Homo sapien
tttctttacaaaatgagttcctcaa

SEQ ID NO: 551091 - DNA, 25 bp, Homo sapien
gagttcctcaaattgaccaatagct

SEQ ID NO: 551092 - DNA, 25 bp, Homo sapien
gaccaatagctgctgctttcatatt

SEQ ID NO: 551093 - DNA, 25 bp, Homo sapien
atagctgctgctttcatattttgga

SEQ ID NO: 551094 - DNA, 25 bp, Homo sapien
gctgctgctttcatattttggataa

SEQ ID NO: 551095 - DNA, 25 bp, Homo sapien
ttttggataagggtctgtggtcccg

SEQ ID NO: 551096 - DNA, 25 bp, Homo sapien
gacatcaaagacttctgcactcacg

SEQ ID NO: 551097 - DNA, 25 bp, Homo sapien
gaagtagagcccatggccacggagt

SEQ ID NO: 551098 - DNA, 25 bp, Homo sapien
gagtgtgaccacatccagatcacgg

SEQ ID NO: 551099 - DNA, 25 bp, Homo sapien
agatcacggcgttgtcgcaggccct

SEQ ID NO: 551100 - DNA, 25 bp, Homo sapien
tgccctgcaagtggagtacgtggac

SEQ ID NO: 551101 - DNA, 25 bp, Homo sapien
ggacgagatggataccgccctgaac

SEQ ID NO: 551102 - DNA, 25 bp, Homo sapien
tgaaccaccacgtgttccctgaggc

SEQ ID NO: 551103 - DNA, 25 bp, Homo sapien
gctctataaaacatcccactacaac

SEQ ID NO: 551104 - DNA, 25 bp, Homo sapien
actacaacatcctttatgcagccga

SEQ ID NO: 551105 - DNA, 25 bp, Homo sapien
tttaggccatgcagtggaacctgtc

SEQ ID NO: 551106 - DNA, 25 bp, Homo sapien
gaacctgtcacctaatgggactgca

SEQ ID NO: 551107 - DNA, 25 bp, Homo sapien
acagtgtgagatgggattgagtcat

SEQ ID NO: 551108 - DNA, 25 bp, Homo sapien
gagtcatctggagatcagcacttgg

SEQ ID NO: 551109 - DNA, 25 bp, Homo sapien
tacaggaaaagggtgtggagccact

SEQ ID NO: 551110 - DNA, 25 bp, Homo sapien
aaagggtgtggagccactgagtata

SEQ ID NO: 551111 - DNA, 25 bp, Homo sapien
tgagccctacctactgccatactgt

SEQ ID NO: 551112 - DNA, 25 bp, Homo sapien
tactgccatactgtgctctgttaaa

SEQ ID NO: 551113 - DNA, 25 bp, Homo sapien
ctgccatactgtgctctgttaaact

SEQ ID NO: 551114 - DNA, 25 bp, Homo sapien
catactgtgctctgttaaactcctg

SEQ ID NO: 551115 - DNA, 25 bp, Homo sapien
actgtgctctgttaaactcctgtgt

SEQ ID NO: 551116 - DNA, 25 bp, Homo sapien
gtgctctgttaaactcctgtgttca

SEQ ID NO: 551117 - DNA, 25 bp, Homo sapien
tgttaaactcctgtgttcagagtct

SEQ ID NO: 551118 - DNA, 25 bp, Homo sapien
gaggaacatggcagcctctagctca

SEQ ID NO: 551119 - DNA, 25 bp, Homo sapien
cctctagctcatacttgtcgttgta

SEQ ID NO: 551120 - DNA, 25 bp, Homo sapien
acttgtcgttgtacaattgagatca

SEQ ID NO: 551121 - DNA, 25 bp, Homo sapien
agatcaagtgaattggccccggtct

SEQ ID NO: 551122 - DNA, 25 bp, Homo sapien
gccccggtctcacattttcagtgaa

SEQ ID NO: 551123 - DNA, 25 bp, Homo sapien
ttttcagtgaagtcagactcagaac

SEQ ID NO: 551124 - DNA, 25 bp, Homo sapien
gactcagaactaggtcctgggtttc

SEQ ID NO: 551125 - DNA, 25 bp, Homo sapien
cagaactaggtcctgggtttcatgt

SEQ ID NO: 551126 - DNA, 25 bp, Homo sapien
actgtgtacacaccatgcccacata

SEQ ID NO: 551127 - DNA, 25 bp, Homo sapien
tgcccacatacaacatacctatcag

SEQ ID NO: 551128 - DNA, 25 bp, Homo sapien
gctgaagccaaccagagatcttgat

SEQ ID NO: 551129 - DNA, 25 bp, Homo sapien
cctgagatggcaagaccagcccctt

SEQ ID NO: 551130 - DNA, 25 bp, Homo sapien
ctgagatggcaagaccagccccttg

SEQ ID NO: 551131 - DNA, 25 bp, Homo sapien
tgagatggcaagaccagccccttgt

SEQ ID NO: 551132 - DNA, 25 bp, Homo sapien
gagatggcaagaccagccccttgtc

SEQ ID NO: 551133 - DNA, 25 bp, Homo sapien
agatggcaagaccagccccttgtct

SEQ ID NO: 551134 - DNA, 25 bp, Homo sapien
gatggcaagaccagccccttgtctt

SEQ ID NO: 551135 - DNA, 25 bp, Homo sapien
atggcaagaccagccccttgtcttc

SEQ ID NO: 551136 - DNA, 25 bp, Homo sapien
tggcaagaccagccccttgtcttcc

SEQ ID NO: 551137 - DNA, 25 bp, Homo sapien
ggcaagaccagccccttgtcttcct

SEQ ID NO: 551138 - DNA, 25 bp, Homo sapien
gaccagccccttgtcttcctcagcc

SEQ ID NO: 551139 - DNA, 25 bp, Homo sapien
atccacttctacttattaaatagta

SEQ ID NO: 551140 - DNA, 25 bp, Homo sapien
aagagtactaaagggccagtgtgca

SEQ ID NO: 551141 - DNA, 25 bp, Homo sapien
cagtgtgcagatgggtggattaaaa

SEQ ID NO: 551142 - DNA, 25 bp, Homo sapien
gtactaaagggcttacttcaggcaa

SEQ ID NO: 551143 - DNA, 25 bp, Homo sapien
ggcaaaagtgttcctgacgtaccaa

SEQ ID NO: 551144 - DNA, 25 bp, Homo sapien
tgttcctgacgtaccaaaaagtaag

SEQ ID NO: 551145 - DNA, 25 bp, Homo sapien
atagtttattttcatgcctccctgc

SEQ ID NO: 551146 - DNA, 25 bp, Homo sapien
ctccctgctcctagtaatgtatgtt

SEQ ID NO: 551147 - DNA, 25 bp, Homo sapien
aatgtatgttttgtgctgaactggc

SEQ ID NO: 551148 - DNA, 25 bp, Homo sapien
tgaactggcagctatcccaatgtga

SEQ ID NO: 551149 - DNA, 25 bp, Homo sapien
ggcagctatcccaatgtgaaatgta

SEQ ID NO: 551150 - DNA, 25 bp, Homo sapien
tttggatgtatctggtgtcattttt

SEQ ID NO: 551151 - DNA, 25 bp, Homo sapien
aggtggcccaggtgtttttagcaga

SEQ ID NO: 551152 - DNA, 25 bp, Homo sapien
tgtttttagcagagatcccggaaga

SEQ ID NO: 551153 - DNA, 25 bp, Homo sapien
tttttagcagagatcccggaagacc

SEQ ID NO: 551154 - DNA, 25 bp, Homo sapien
tttagcagagatcccggaagacccc

SEQ ID NO: 551155 - DNA, 25 bp, Homo sapien
cagagatcccggaagaccccaagct

SEQ ID NO: 551156 - DNA, 25 bp, Homo sapien
agagatcccggaagaccccaagctc

SEQ ID NO: 551157 - DNA, 25 bp, Homo sapien
agatcccggaagaccccaagctctt

SEQ ID NO: 551158 - DNA, 25 bp, Homo sapien
agctcttccggcatcacaacaaatt

SEQ ID NO: 551159 - DNA, 25 bp, Homo sapien
gctcttccggcatcacaacaaattg

SEQ ID NO: 551160 - DNA, 25 bp, Homo sapien
tcttccggcatcacaacaaattgcg

SEQ ID NO: 551161 - DNA, 25 bp, Homo sapien
ttccggcatcacaacaaattgcggc

SEQ ID NO: 551162 - DNA, 25 bp, Homo sapien
gcagagaatcttttgcactaagtca

SEQ ID NO: 551163 - DNA, 25 bp, Homo sapien
agagaatcttttgcactaagtcatg

SEQ ID NO: 551164 - DNA, 25 bp, Homo sapien
gagaatcttttgcactaagtcatgc

SEQ ID NO: 551165 - DNA, 25 bp, Homo sapien
tattactcagagtcacccaagcctc

SEQ ID NO: 551166 - DNA, 25 bp, Homo sapien
tactcagagtcacccaagcctcttg

SEQ ID NO: 551167 - DNA, 25 bp, Homo sapien
agagtcacccaagcctcttggctga

SEQ ID NO: 551168 - DNA, 25 bp, Homo sapien
agtcacccaagcctcttggctgagg

SEQ ID NO: 551169 - DNA, 25 bp, Homo sapien
acccaagcctcttggctgagggtga

SEQ ID NO: 551170 - DNA, 25 bp, Homo sapien
cccaagcctcttggctgagggtgaa

SEQ ID NO: 551171 - DNA, 25 bp, Homo sapien
tcttggctgagggtgaaggtgggac

SEQ ID NO: 551172 - DNA, 25 bp, Homo sapien
cgctcgtgcggtgtcaacgctgcag

SEQ ID NO: 551173 - DNA, 25 bp, Homo sapien
acggcctctccctctcagtgtgagg

SEQ ID NO: 551174 - DNA, 25 bp, Homo sapien
tcagtgtgaggcttcacccatgcta

SEQ ID NO: 551175 - DNA, 25 bp, Homo sapien
tgaggcttcacccatgctaggcaag

SEQ ID NO: 551176 - DNA, 25 bp, Homo sapien
ttcacccatgctaggcaagcccagg

SEQ ID NO: 551177 - DNA, 25 bp, Homo sapien
aagcccagggcacagatgccgggat

SEQ ID NO: 551178 - DNA, 25 bp, Homo sapien
tctcagtgcgggaacgtcacccctg

SEQ ID NO: 551179 - DNA, 25 bp, Homo sapien
aagcccagggcacagatgctgcgat

SEQ ID NO: 551180 - DNA, 25 bp, Homo sapien
ggcacagatgctgcgatggcctctt

SEQ ID NO: 551181 - DNA, 25 bp, Homo sapien
atggcctcttcctcttaagtgtggg

SEQ ID NO: 551182 - DNA, 25 bp, Homo sapien
tatttccatattgaagcagcttgag

SEQ ID NO: 551183 - DNA, 25 bp, Homo sapien
attgaagcagcttgagtttctactg

SEQ ID NO: 551184 - DNA, 25 bp, Homo sapien
aggagccacagccatttcttagagg

SEQ ID NO: 551185 - DNA, 25 bp, Homo sapien
cagccatttcttagagggtttcaaa

SEQ ID NO: 551186 - DNA, 25 bp, Homo sapien
caaaaggacagcctttggcgccttt

SEQ ID NO: 551187 - DNA, 25 bp, Homo sapien
ttttccttctaacctttgagtccag

SEQ ID NO: 551188 - DNA, 25 bp, Homo sapien
cctttccagttttcattcactcgaa

SEQ ID NO: 551189 - DNA, 25 bp, Homo sapien
attcactcgaagtaactgcactcaa

SEQ ID NO: 551190 - DNA, 25 bp, Homo sapien
gtaactgcactcaagctgtgctcaa

SEQ ID NO: 551191 - DNA, 25 bp, Homo sapien
gctgtgctcaaaatcggcaacgcat

SEQ ID NO: 551192 - DNA, 25 bp, Homo sapien
cggcaacgcatttatttacaccaag

SEQ ID NO: 551193 - DNA, 25 bp, Homo sapien
gaaaatagcagacgtttcccctctc

SEQ ID NO: 551194 - DNA, 25 bp, Homo sapien
aactctgggtatcccacagatgcaa

SEQ ID NO: 551195 - DNA, 25 bp, Homo sapien
tgccagacgggctctccgggtcctt

SEQ ID NO: 551196 - DNA, 25 bp, Homo sapien
ggctctccgggtccttctccgagag

SEQ ID NO: 551197 - DNA, 25 bp, Homo sapien
tccttctccgagagccgggcgggca

SEQ ID NO: 551198 - DNA, 25 bp, Homo sapien
ggcgggcacgcgtcattgtgttacc

SEQ ID NO: 551199 - DNA, 25 bp, Homo sapien
gggcacgcgtcattgtgttacctgc

SEQ ID NO: 551200 - DNA, 25 bp, Homo sapien
gcgtcattgtgttacctgcggccgg

SEQ ID NO: 551201 - DNA, 25 bp, Homo sapien
cattgtgttacctgcggccggcccg

SEQ ID NO: 551202 - DNA, 25 bp, Homo sapien
ggtgagcacgccctctcatgaatat

SEQ ID NO: 551203 - DNA, 25 bp, Homo sapien
agcacgccctctcatgaatattaat

SEQ ID NO: 551204 - DNA, 25 bp, Homo sapien
tgaatattaataagcgcgcatgcgc

SEQ ID NO: 551205 - DNA, 25 bp, Homo sapien
ccggcgtgctgggtagaggtggcca

SEQ ID NO: 551206 - DNA, 25 bp, Homo sapien
agtccccagatccagaacatgggaa

SEQ ID NO: 551207 - DNA, 25 bp, Homo sapien
cagaacatgggaagttagggaaaat

SEQ ID NO: 551208 - DNA, 25 bp, Homo sapien
gaattactgtcagaattacatacac

SEQ ID NO: 551209 - DNA, 25 bp, Homo sapien
ttactgtcagaattacatacacaat

SEQ ID NO: 551210 - DNA, 25 bp, Homo sapien
aaaagacatttcattgtactgcaaa

SEQ ID NO: 551211 - DNA, 25 bp, Homo sapien
gtactgcaaaaatctgaatatttat

SEQ ID NO: 551212 - DNA, 25 bp, Homo sapien
gcattttaatatgttgagccactgg

SEQ ID NO: 551213 - DNA, 25 bp, Homo sapien
tgttgagccactggaaatttgtaac

SEQ ID NO: 551214 - DNA, 25 bp, Homo sapien
gagccactggaaatttgtaacagat

SEQ ID NO: 551215 - DNA, 25 bp, Homo sapien
cagattaatttgttataggagttta

SEQ ID NO: 551216 - DNA, 25 bp, Homo sapien
tgtcattgtctccattgtctttgtc

SEQ ID NO: 551217 - DNA, 25 bp, Homo sapien
tgcgtggtgctctttgctgcactat

SEQ ID NO: 551218 - DNA, 25 bp, Homo sapien
gctgcactatttgccgtcatcggga

SEQ ID NO: 551219 - DNA, 25 bp, Homo sapien
gtcatcgggaggagcagcctgaacc

SEQ ID NO: 551220 - DNA, 25 bp, Homo sapien
tggtgggcctttctgtgtcctactc

SEQ ID NO: 551221 - DNA, 25 bp, Homo sapien
tactccttgcaggtatgaagggcct

SEQ ID NO: 551222 - DNA, 25 bp, Homo sapien
tgcaggtatgaagggcctggacccc

SEQ ID NO: 551223 - DNA, 25 bp, Homo sapien
aaaccacacaggtgttccaggcatc

SEQ ID NO: 551224 - DNA, 25 bp, Homo sapien
gtgttccaggcatctcccgagtgcc

SEQ ID NO: 551225 - DNA, 25 bp, Homo sapien
tcagtatgggcaccagccacagggt

SEQ ID NO: 551226 - DNA, 25 bp, Homo sapien
cagccacagggtctgttctcaagga

SEQ ID NO: 551227 - DNA, 25 bp, Homo sapien
acagggtctgttctcaaggactgtg

SEQ ID NO: 551228 - DNA, 25 bp, Homo sapien
catgcccagcctcaaatatgttttt

SEQ ID NO: 551229 - DNA, 25 bp, Homo sapien
gttattttgctcaagtacttaagta

SEQ ID NO: 551230 - DNA, 25 bp, Homo sapien
tgctcaagtacttaagtagtctggc

SEQ ID NO: 551231 - DNA, 25 bp, Homo sapien
taagtagtctggctcaagtactttg

SEQ ID NO: 551232 - DNA, 25 bp, Homo sapien
gaagaaatggttatggcttatccaa

SEQ ID NO: 551233 - DNA, 25 bp, Homo sapien
tatggcttatccaaaaagaatgtca

SEQ ID NO: 551234 - DNA, 25 bp, Homo sapien
aagaatgtcagcatgacctggtgta

SEQ ID NO: 551235 - DNA, 25 bp, Homo sapien
gtcagcatgacctggtgtagactta

SEQ ID NO: 551236 - DNA, 25 bp, Homo sapien
gcatgacctggtgtagacttaaaaa

SEQ ID NO: 551237 - DNA, 25 bp, Homo sapien
gatcattgaaatatcaaggattcta

SEQ ID NO: 551238 - DNA, 25 bp, Homo sapien
gattctagtaattgtatttcctgaa

SEQ ID NO: 551239 - DNA, 25 bp, Homo sapien
aaccataggtgcattttactgtttt

SEQ ID NO: 551240 - DNA, 25 bp, Homo sapien
accataggtgcattttactgttttg

SEQ ID NO: 551241 - DNA, 25 bp, Homo sapien
ccataggtgcattttactgttttgt

SEQ ID NO: 551242 - DNA, 25 bp, Homo sapien
cataggtgcattttactgttttgta

SEQ ID NO: 551243 - DNA, 25 bp, Homo sapien
tttcatttttggaggtagtatacac

SEQ ID NO: 551244 - DNA, 25 bp, Homo sapien
ttcatttttggaggtagtatacaca

SEQ ID NO: 551245 - DNA, 25 bp, Homo sapien
catttttggaggtagtatacacagc

SEQ ID NO: 551246 - DNA, 25 bp, Homo sapien
tttttggaggtagtatacacagcag

SEQ ID NO: 551247 - DNA, 25 bp, Homo sapien
tttggaggtagtatacacagcagat

SEQ ID NO: 551248 - DNA, 25 bp, Homo sapien
ttggaggtagtatacacagcagata

SEQ ID NO: 551249 - DNA, 25 bp, Homo sapien
ttttaatctgactttcattccttca

SEQ ID NO: 551250 - DNA, 25 bp, Homo sapien
cctgatctcccaatagtcaattatg

SEQ ID NO: 551251 - DNA, 25 bp, Homo sapien
gatctcccaatagtcaattatgaga

SEQ ID NO: 551252 - DNA, 25 bp, Homo sapien
aaaggtaagagatcatatactatca

SEQ ID NO: 551253 - DNA, 25 bp, Homo sapien
agttgtcttcaacatacttcagcat

SEQ ID NO: 551254 - DNA, 25 bp, Homo sapien
gtcttcaacatacttcagcattctt

SEQ ID NO: 551255 - DNA, 25 bp, Homo sapien
gaagtactaaaaggttcctggccat

SEQ ID NO: 551256 - DNA, 25 bp, Homo sapien
gtactaaaaggttcctggccatcgg

SEQ ID NO: 551257 - DNA, 25 bp, Homo sapien
taaaaggttcctggccatcggagga

SEQ ID NO: 551258 - DNA, 25 bp, Homo sapien
tggccatcggaggaactctggtctg

SEQ ID NO: 551259 - DNA, 25 bp, Homo sapien
catcggaggaactctggtctgtttc

SEQ ID NO: 551260 - DNA, 25 bp, Homo sapien
ctctggtctgtttctcttacataaa

SEQ ID NO: 551261 - DNA, 25 bp, Homo sapien
agagaggagcctgtctctcagggca

SEQ ID NO: 551262 - DNA, 25 bp, Homo sapien
gagcctgtctctcagggcacatgag

SEQ ID NO: 551263 - DNA, 25 bp, Homo sapien
tcagggcacatgagtcgtcgtggca

SEQ ID NO: 551264 - DNA, 25 bp, Homo sapien
aggagacgggcctcagtcacagtgt

SEQ ID NO: 551265 - DNA, 25 bp, Homo sapien
tcacagacccttgtcacagtggaca

SEQ ID NO: 551266 - DNA, 25 bp, Homo sapien
gacccttgtcacagtggacactagt

SEQ ID NO: 551267 - DNA, 25 bp, Homo sapien
gtcacagtggacactagtcattcct

SEQ ID NO: 551268 - DNA, 25 bp, Homo sapien
gcagcccaggaggactaaaaagatt

SEQ ID NO: 551269 - DNA, 25 bp, Homo sapien
atgaagtctgtgttactcattctga

SEQ ID NO: 551270 - DNA, 25 bp, Homo sapien
agaaaagaacttacctgagaggagt

SEQ ID NO: 551271 - DNA, 25 bp, Homo sapien
cttggacgctgactggacagagagg

SEQ ID NO: 551272 - DNA, 25 bp, Homo sapien
tcttttttcgttttgcagtaattag

SEQ ID NO: 551273 - DNA, 25 bp, Homo sapien
tttcgttttgcagtaattagtgttg

SEQ ID NO: 551274 - DNA, 25 bp, Homo sapien
cgttttgcagtaattagtgttggtt

SEQ ID NO: 551275 - DNA, 25 bp, Homo sapien
atagatgtaagcatttctgaagggc

SEQ ID NO: 551276 - DNA, 25 bp, Homo sapien
gatgtaagcatttctgaagggcagg

SEQ ID NO: 551277 - DNA, 25 bp, Homo sapien
ctggtaggggctttatgaaatctcc

SEQ ID NO: 551278 - DNA, 25 bp, Homo sapien
ccacagggctggtcttcagatccaa

SEQ ID NO: 551279 - DNA, 25 bp, Homo sapien
cacagggctggtcttcagatccaag

SEQ ID NO: 551280 - DNA, 25 bp, Homo sapien
acagggctggtcttcagatccaagg

SEQ ID NO: 551281 - DNA, 25 bp, Homo sapien
cagggctggtcttcagatccaaggc

SEQ ID NO: 551282 - DNA, 25 bp, Homo sapien
agggctggtcttcagatccaaggcg

SEQ ID NO: 551283 - DNA, 25 bp, Homo sapien
ggctgagcatcggagtggagttcgt

SEQ ID NO: 551284 - DNA, 25 bp, Homo sapien
tgcgtggtgctctttgctgcactat

SEQ ID NO: 551285 - DNA, 25 bp, Homo sapien
gtggtgctctttgctgcactatttg

SEQ ID NO: 551286 - DNA, 25 bp, Homo sapien
tgctctttgctgcactatttgccgt

SEQ ID NO: 551287 - DNA, 25 bp, Homo sapien
tttgctgcactatttgccgtcatcg

SEQ ID NO: 551288 - DNA, 25 bp, Homo sapien
gctgcactatttgccgtcatcggga

SEQ ID NO: 551289 - DNA, 25 bp, Homo sapien
gcactatttgccgtcatcgggagga

SEQ ID NO: 551290 - DNA, 25 bp, Homo sapien
tatttgccgtcatcgggaggagcag

SEQ ID NO: 551291 - DNA, 25 bp, Homo sapien
tcgggaggagcagcctgaacccggg

SEQ ID NO: 551292 - DNA, 25 bp, Homo sapien
ggctggtgggcctttctgtgtccta

SEQ ID NO: 551293 - DNA, 25 bp, Homo sapien
tggtgggcctttctgtgtcctactc

SEQ ID NO: 551294 - DNA, 25 bp, Homo sapien
gaattaagttcacctgataactcaa

SEQ ID NO: 551295 - DNA, 25 bp, Homo sapien
aagttcacctgataactcaaaagtg

SEQ ID NO: 551296 - DNA, 25 bp, Homo sapien
acctgataactcaaaagtgaatgta

SEQ ID NO: 551297 - DNA, 25 bp, Homo sapien
tataatacaattctgttttaatctg

SEQ ID NO: 551298 - DNA, 25 bp, Homo sapien
ctcctactttttactggggtgagag

SEQ ID NO: 551299 - DNA, 25 bp, Homo sapien
aaacccaaaattatgtgaacaagca

SEQ ID NO: 551300 - DNA, 25 bp, Homo sapien
aatttcattttaggctattggctac

SEQ ID NO: 551301 - DNA, 25 bp, Homo sapien
ttcattttaggctattggctactga

SEQ ID NO: 551302 - DNA, 25 bp, Homo sapien
attttaggctattggctactgagta

SEQ ID NO: 551303 - DNA, 25 bp, Homo sapien
taggctattggctactgagtaaact

SEQ ID NO: 551304 - DNA, 25 bp, Homo sapien
tattggctactgagtaaacttgact

SEQ ID NO: 551305 - DNA, 25 bp, Homo sapien
cggagacagggcagctcccctacga

SEQ ID NO: 551306 - DNA, 25 bp, Homo sapien
ttctccatcagggagcagcgtgact

SEQ ID NO: 551307 - DNA, 25 bp, Homo sapien
agcagcgtgacttcagcgagtcccg

SEQ ID NO: 551308 - DNA, 25 bp, Homo sapien
gtgacttcagcgagtcccgcgagca

SEQ ID NO: 551309 - DNA, 25 bp, Homo sapien
gagtcccgcgagcacctggctagac

SEQ ID NO: 551310 - DNA, 25 bp, Homo sapien
gcgagcacctggctagacagttaac

SEQ ID NO: 551311 - DNA, 25 bp, Homo sapien
gagcacctggctagacagttaacaa

SEQ ID NO: 551312 - DNA, 25 bp, Homo sapien
acagttaacaagcacgtccttccag

SEQ ID NO: 551313 - DNA, 25 bp, Homo sapien
taacaagcacgtccttccagcctga

SEQ ID NO: 551314 - DNA, 25 bp, Homo sapien
tccccgtagtgaccaattcctatct

SEQ ID NO: 551315 - DNA, 25 bp, Homo sapien
gtagtgaccaattcctatctcttcc

SEQ ID NO: 551316 - DNA, 25 bp, Homo sapien
acttagggcagtcctgagatgctca

SEQ ID NO: 551317 - DNA, 25 bp, Homo sapien
gagatgctcaggcagtagccctttt

SEQ ID NO: 551318 - DNA, 25 bp, Homo sapien
tttctcagttccctttgcgggtctt

SEQ ID NO: 551319 - DNA, 25 bp, Homo sapien
cctttgcgggtcttggtcagatgat

SEQ ID NO: 551320 - DNA, 25 bp, Homo sapien
cttggtcagatgatgccctctagac

SEQ ID NO: 551321 - DNA, 25 bp, Homo sapien
tagacccgtgctgtccaatatgtag

SEQ ID NO: 551322 - DNA, 25 bp, Homo sapien
gtagccgctagccatgtgcagctgt

SEQ ID NO: 551323 - DNA, 25 bp, Homo sapien
tcaggcccttgcaacgtggctggtt

SEQ ID NO: 551324 - DNA, 25 bp, Homo sapien
cgtggctggttcgagctgtgataca

SEQ ID NO: 551325 - DNA, 25 bp, Homo sapien
gtgtaaacacaaaccagacttcgaa

SEQ ID NO: 551326 - DNA, 25 bp, Homo sapien
accagacttcgaaggcttagtatga

SEQ ID NO: 551327 - DNA, 25 bp, Homo sapien
ccagcagcttgcgggcgtgttctcg

SEQ ID NO: 551328 - DNA, 25 bp, Homo sapien
cttgcgggcgtgttctcgcggttcc

SEQ ID NO: 551329 - DNA, 25 bp, Homo sapien
tgttctcgcggttccgggcctcaag

SEQ ID NO: 551330 - DNA, 25 bp, Homo sapien
tccgggcctcaaggcgacggaaacg

SEQ ID NO: 551331 - DNA, 25 bp, Homo sapien
gacggaaacgaaaggcgagcgaagc

SEQ ID NO: 551332 - DNA, 25 bp, Homo sapien
gagcgaagcgcggaggatccggcga

SEQ ID NO: 551333 - DNA, 25 bp, Homo sapien
aggatccggcgagaagaagcgtcag

SEQ ID NO: 551334 - DNA, 25 bp, Homo sapien
agaagcgtcagggagcctcggcggt

SEQ ID NO: 551335 - DNA, 25 bp, Homo sapien
aggaagtgctccgaggcctcgccga

SEQ ID NO: 551336 - DNA, 25 bp, Homo sapien
tcgccgaggcctagcgccggctttg

SEQ ID NO: 551337 - DNA, 25 bp, Homo sapien
ctagcgccggctttgtgtccgaggc

SEQ ID NO: 551338 - DNA, 25 bp, Homo sapien
gcacatatttgtacaaagagtttaa

SEQ ID NO: 551339 - DNA, 25 bp, Homo sapien
acaaagagtttaaggaatggtggct

SEQ ID NO: 551340 - DNA, 25 bp, Homo sapien
caaagagtttaaggaatggtggctg

SEQ ID NO: 551341 - DNA, 25 bp, Homo sapien
aaatgtttactgacgaggccgggcg

SEQ ID NO: 551342 - DNA, 25 bp, Homo sapien
aatgtttactgacgaggccgggcgt

SEQ ID NO: 551343 - DNA, 25 bp, Homo sapien
aaaattagccatgcgaagtagcagg

SEQ ID NO: 551344 - DNA, 25 bp, Homo sapien
aattagccatgcgaagtagcaggtg

SEQ ID NO: 551345 - DNA, 25 bp, Homo sapien
attagccatgcgaagtagcaggtgc

SEQ ID NO: 551346 - DNA, 25 bp, Homo sapien
ttagccatgcgaagtagcaggtgcc

SEQ ID NO: 551347 - DNA, 25 bp, Homo sapien
tagccatgcgaagtagcaggtgcct

SEQ ID NO: 551348 - DNA, 25 bp, Homo sapien
agccatgcgaagtagcaggtgcctg

SEQ ID NO: 551349 - DNA, 25 bp, Homo sapien
agccttcgtagagatctcccggcag

SEQ ID NO: 551350 - DNA, 25 bp, Homo sapien
aacttcaagttgttcatcatccggg

SEQ ID NO: 551351 - DNA, 25 bp, Homo sapien
ggttcaccccagcagattgaccacg

SEQ ID NO: 551352 - DNA, 25 bp, Homo sapien
agcagattgaccacgccaagcagct

SEQ ID NO: 551353 - DNA, 25 bp, Homo sapien
gattgaccacgccaagcagcttatc

SEQ ID NO: 551354 - DNA, 25 bp, Homo sapien
accacgccaagcagcttatcgagga

SEQ ID NO: 551355 - DNA, 25 bp, Homo sapien
gccaagcagcttatcgaggaaaaga

SEQ ID NO: 551356 - DNA, 25 bp, Homo sapien
aaaagatcgagggtcctctctgccc

SEQ ID NO: 551357 - DNA, 25 bp, Homo sapien
gagggtcctctctgcccagttggac

SEQ ID NO: 551358 - DNA, 25 bp, Homo sapien
cccagttggaccaggcccaggtggc

SEQ ID NO: 551359 - DNA, 25 bp, Homo sapien
tcaatcctgggcccttcaaccaggg

SEQ ID NO: 551360 - DNA, 25 bp, Homo sapien
agtttgtgttctgaaagcctccgtg

SEQ ID NO: 551361 - DNA, 25 bp, Homo sapien
gttctgaaagcctccgtgctgctgg

SEQ ID NO: 551362 - DNA, 25 bp, Homo sapien
ggaaatacaggatccttcagcactg

SEQ ID NO: 551363 - DNA, 25 bp, Homo sapien
cttcagcactgaggtgtttaagatt

SEQ ID NO: 551364 - DNA, 25 bp, Homo sapien
ggtgtttaagatttgcaactagcaa

SEQ ID NO: 551365 - DNA, 25 bp, Homo sapien
gcaactagcaatgcaattttttcta

SEQ ID NO: 551366 - DNA, 25 bp, Homo sapien
ctaaacattgatgtccttgatcatt

SEQ ID NO: 551367 - DNA, 25 bp, Homo sapien
ccttgatcattttatgttctcatat

SEQ ID NO: 551368 - DNA, 25 bp, Homo sapien
gttctcatattacttttgattctac

SEQ ID NO: 551369 - DNA, 25 bp, Homo sapien
cttttgattctactatgattgtgtg

SEQ ID NO: 551370 - DNA, 25 bp, Homo sapien
gtggtggtgaacaaagatcattaca

SEQ ID NO: 551371 - DNA, 25 bp, Homo sapien
gtctttcttcttggacgggacataa

SEQ ID NO: 551372 - DNA, 25 bp, Homo sapien
ttggacgggacataactgttccagg

SEQ ID NO: 551373 - DNA, 25 bp, Homo sapien
gaggactgggttttaaccactgcac

SEQ ID NO: 551374 - DNA, 25 bp, Homo sapien
ttttaaccactgcacgaccatctgg

SEQ ID NO: 551375 - DNA, 25 bp, Homo sapien
atctggctctcccaaaagcaggatc

SEQ ID NO: 551376 - DNA, 25 bp, Homo sapien
aaaagcaggatcatctctcctcggt

SEQ ID NO: 551377 - DNA, 25 bp, Homo sapien
atctctcctcggtagtgcctgggca

SEQ ID NO: 551378 - DNA, 25 bp, Homo sapien
tagtgcctgggcatcctggaactta

SEQ ID NO: 551379 - DNA, 25 bp, Homo sapien
ggtgctgggtcttgtttagtaaact

SEQ ID NO: 551380 - DNA, 25 bp, Homo sapien
ttttgttattccttgtgacatactt

SEQ ID NO: 551381 - DNA, 25 bp, Homo sapien
tccttgtgacatactttcttacatg

SEQ ID NO: 551382 - DNA, 25 bp, Homo sapien
gtgccaaccaaatcctaatatcaat

SEQ ID NO: 551383 - DNA, 25 bp, Homo sapien
acaggatataaagcctgctgcctcc

SEQ ID NO: 551384 - DNA, 25 bp, Homo sapien
tgagctcagcgcctttttgcgaaac

SEQ ID NO: 551385 - DNA, 25 bp, Homo sapien
gcgcctttttgcgaaactctactat

SEQ ID NO: 551386 - DNA, 25 bp, Homo sapien
gaaactctactattcctcatcttgt

SEQ ID NO: 551387 - DNA, 25 bp, Homo sapien
gggatgtacatgtggtcgaattcca

SEQ ID NO: 551388 - DNA, 25 bp, Homo sapien
gagccctgcaaaaatactgaattgt

SEQ ID NO: 551389 - DNA, 25 bp, Homo sapien
agtgtttacaaatctcctgtgcagt

SEQ ID NO: 551390 - DNA, 25 bp, Homo sapien
ctcctgtgcagtgggacgactcgaa

SEQ ID NO: 551391 - DNA, 25 bp, Homo sapien
gagaaagcgcagtcctgaaagtcag

SEQ ID NO: 551392 - DNA, 25 bp, Homo sapien
agtcaggtcacgattatgggcccac

SEQ ID NO: 551393 - DNA, 25 bp, Homo sapien
gttaaaatgctgctacctgcattct

SEQ ID NO: 551394 - DNA, 25 bp, Homo sapien
cctgcattctaaaacgtgcaagtca

SEQ ID NO: 551395 - DNA, 25 bp, Homo sapien
acaagacacctccttagggcagcat

SEQ ID NO: 551396 - DNA, 25 bp, Homo sapien
acccctgcagtcacggtgtttgaat

SEQ ID NO: 551397 - DNA, 25 bp, Homo sapien
acggtgtttgaatggcagctgatgc

SEQ ID NO: 551398 - DNA, 25 bp, Homo sapien
tggcccacccagagtatcggtgcat

SEQ ID NO: 551399 - DNA, 25 bp, Homo sapien
agagtatcggtgcatctctcctaaa

SEQ ID NO: 551400 - DNA, 25 bp, Homo sapien
ggtgcatctctcctaaagccacagt

SEQ ID NO: 551401 - DNA, 25 bp, Homo sapien
agttcagcactgcatgttgaccagg

SEQ ID NO: 551402 - DNA, 25 bp, Homo sapien
gttgaccaggcggatatcctataat

SEQ ID NO: 551403 - DNA, 25 bp, Homo sapien
atatagatgctcgtttggatccaaa

SEQ ID NO: 551404 - DNA, 25 bp, Homo sapien
gttgactcaggaactttctgagaat

SEQ ID NO: 551405 - DNA, 25 bp, Homo sapien
gacacaggtgtctttgaacaaactt

SEQ ID NO: 551406 - DNA, 25 bp, Homo sapien
aaattatttcacagcaagggagagg

SEQ ID NO: 551407 - DNA, 25 bp, Homo sapien
atttttgtttatgttcttgagctga

SEQ ID NO: 551408 - DNA, 25 bp, Homo sapien
gagctgatgtagtggaacttgccta

SEQ ID NO: 551409 - DNA, 25 bp, Homo sapien
gtagtggaacttgcctagcacattc

SEQ ID NO: 551410 - DNA, 25 bp, Homo sapien
aggtcccagccagttggcagagcat

SEQ ID NO: 551411 - DNA, 25 bp, Homo sapien
agccagttggcagagcatgctctca

SEQ ID NO: 551412 - DNA, 25 bp, Homo sapien
agagcatgctctcatctccttattc

SEQ ID NO: 551413 - DNA, 25 bp, Homo sapien
atctccttattccataccctgggcg

SEQ ID NO: 551414 - DNA, 25 bp, Homo sapien
gcgtcccctttctgttgactcagga

SEQ ID NO: 551415 - DNA, 25 bp, Homo sapien
gaattcattggtttaacttgcatca

SEQ ID NO: 551416 - DNA, 25 bp, Homo sapien
ataccatgtgagtgtgctcattctc

SEQ ID NO: 551417 - DNA, 25 bp, Homo sapien
cattctgctgttcagtgtctcttga

SEQ ID NO: 551418 - DNA, 25 bp, Homo sapien
gtctcttgagagagcctctttgcat

SEQ ID NO: 551419 - DNA, 25 bp, Homo sapien
ctctttgcatgttttccagaatctg

SEQ ID NO: 551420 - DNA, 25 bp, Homo sapien
gttctttttgctcaaaggtgtgacc

SEQ ID NO: 551421 - DNA, 25 bp, Homo sapien
aaaggtgtgaccagtcattgcccct

SEQ ID NO: 551422 - DNA, 25 bp, Homo sapien
attctccaggagaaacatcccagaa

SEQ ID NO: 551423 - DNA, 25 bp, Homo sapien
agaaccagcactgtttagcctgata

SEQ ID NO: 551424 - DNA, 25 bp, Homo sapien
gcctgatacctttctaatgtccatg

SEQ ID NO: 551425 - DNA, 25 bp, Homo sapien
ctaatgtccatgtcaattttcaata

SEQ ID NO: 551426 - DNA, 25 bp, Homo sapien
tttatttccatctctaagatcccat

SEQ ID NO: 551427 - DNA, 25 bp, Homo sapien
gccctcggagtcagtgagcttgtct

SEQ ID NO: 551428 - DNA, 25 bp, Homo sapien
gtcagtgagcttgtctttgtgtttt

SEQ ID NO: 551429 - DNA, 25 bp, Homo sapien
ctttgtgtttttgctgggacctaat

SEQ ID NO: 551430 - DNA, 25 bp, Homo sapien
tttgctgggacctaatacacaatgg

SEQ ID NO: 551431 - DNA, 25 bp, Homo sapien
atacacaatgggtcactcaggaatt

SEQ ID NO: 551432 - DNA, 25 bp, Homo sapien
gtccagagaaatgtgacctgcaaga

SEQ ID NO: 551433 - DNA, 25 bp, Homo sapien
tttcaaggcccagctaaagtattag

SEQ ID NO: 551434 - DNA, 25 bp, Homo sapien
aaggctgccctctcggagtttgttg

SEQ ID NO: 551435 - DNA, 25 bp, Homo sapien
ctcggagtttgttgctgcctccttg

SEQ ID NO: 551436 - DNA, 25 bp, Homo sapien
tgcctccttgtccaaaaggacctaa

SEQ ID NO: 551437 - DNA, 25 bp, Homo sapien
agagaggagcctgtctctcagggca

SEQ ID NO: 551438 - DNA, 25 bp, Homo sapien
gaggagcctgtctctcagggcacat

SEQ ID NO: 551439 - DNA, 25 bp, Homo sapien
gagcctgtctctcagggcacatgag

SEQ ID NO: 551440 - DNA, 25 bp, Homo sapien
gtctctcagggcacatgagtcgtcg

SEQ ID NO: 551441 - DNA, 25 bp, Homo sapien
tcagggcacatgagtcgtcgtggca

SEQ ID NO: 551442 - DNA, 25 bp, Homo sapien
aggagacgggcctcagtcacagtgt

SEQ ID NO: 551443 - DNA, 25 bp, Homo sapien
tcacagacccttgtcacagtggaca

SEQ ID NO: 551444 - DNA, 25 bp, Homo sapien
gacccttgtcacagtggacactagt

SEQ ID NO: 551445 - DNA, 25 bp, Homo sapien
gtcacagtggacactagtcattcct

SEQ ID NO: 551446 - DNA, 25 bp, Homo sapien
agaaaagaacttacctgagaggagt

SEQ ID NO: 551447 - DNA, 25 bp, Homo sapien
cttggacgctgactggacagagagg

SEQ ID NO: 551448 - DNA, 25 bp, Homo sapien
cctgatctcccaatagtcaattatg

SEQ ID NO: 551449 - DNA, 25 bp, Homo sapien
gatctcccaatagtcaattatgaga

SEQ ID NO: 551450 - DNA, 25 bp, Homo sapien
aaaggtaagagatcatatactatca

SEQ ID NO: 551451 - DNA, 25 bp, Homo sapien
gaagtactaaaaggttcctggccat

SEQ ID NO: 551452 - DNA, 25 bp, Homo sapien
gtactaaaaggttcctggccatcgg

SEQ ID NO: 551453 - DNA, 25 bp, Homo sapien
taaaaggttcctggccatcggagga

SEQ ID NO: 551454 - DNA, 25 bp, Homo sapien
aaggttcctggccatcggaggaact

SEQ ID NO: 551455 - DNA, 25 bp, Homo sapien
tggccatcggaggaactctggtctg

SEQ ID NO: 551456 - DNA, 25 bp, Homo sapien
catcggaggaactctggtctgtttc

SEQ ID NO: 551457 - DNA, 25 bp, Homo sapien
ctctggtctgtttctcttacataaa

SEQ ID NO: 551458 - DNA, 25 bp, Homo sapien
tctggtctgtttctcttacataaaa

SEQ ID NO: 551459 - DNA, 25 bp, Homo sapien
tgctacttactgtactgaggtaaaa

SEQ ID NO: 551460 - DNA, 25 bp, Homo sapien
tgcttttcctgcaaagtatattttg

SEQ ID NO: 551461 - DNA, 25 bp, Homo sapien
atattttgcagacccaggcagtgct

SEQ ID NO: 551462 - DNA, 25 bp, Homo sapien
agtgctgctcgctctgttcctggtt

SEQ ID NO: 551463 - DNA, 25 bp, Homo sapien
ctggttcacccagtgccgtgtgtgc

SEQ ID NO: 551464 - DNA, 25 bp, Homo sapien
gtgtgtgctcagtgcatcctgtgca

SEQ ID NO: 551465 - DNA, 25 bp, Homo sapien
tgcatcctgtgcacgggtcactgtg

SEQ ID NO: 551466 - DNA, 25 bp, Homo sapien
tgtgcacgggtcactgtgtgccctg

SEQ ID NO: 551467 - DNA, 25 bp, Homo sapien
gcctgggtgagcatcattcttcggg

SEQ ID NO: 551468 - DNA, 25 bp, Homo sapien
gaaccttgatgaaaacaaagctgca

SEQ ID NO: 551469 - DNA, 25 bp, Homo sapien
aacaaagctgcattccaaaaagtta

SEQ ID NO: 551470 - DNA, 25 bp, Homo sapien
ctacttgctaggctgaggcacgata

SEQ ID NO: 551471 - DNA, 25 bp, Homo sapien
tacttgctaggctgaggcacgataa

SEQ ID NO: 551472 - DNA, 25 bp, Homo sapien
acttgctaggctgaggcacgataat

SEQ ID NO: 551473 - DNA, 25 bp, Homo sapien
cttgctaggctgaggcacgataatc

SEQ ID NO: 551474 - DNA, 25 bp, Homo sapien
ttgctaggctgaggcacgataatca

SEQ ID NO: 551475 - DNA, 25 bp, Homo sapien
tgctaggctgaggcacgataatcac

SEQ ID NO: 551476 - DNA, 25 bp, Homo sapien
gctaggctgaggcacgataatcact

SEQ ID NO: 551477 - DNA, 25 bp, Homo sapien
ggcacgataatcacttgaaccggga

SEQ ID NO: 551478 - DNA, 25 bp, Homo sapien
gcacgataatcacttgaaccgggag

SEQ ID NO: 551479 - DNA, 25 bp, Homo sapien
aattagggccggttgcggtggctca

SEQ ID NO: 551480 - DNA, 25 bp, Homo sapien
attagccgggtgtggggttgcacac

SEQ ID NO: 551481 - DNA, 25 bp, Homo sapien
aggagcactacaaaaagctggccga

SEQ ID NO: 551482 - DNA, 25 bp, Homo sapien
agcactacaaaaagctggccgagga

SEQ ID NO: 551483 - DNA, 25 bp, Homo sapien
agcaaaagcagtacaaggtgcacct

SEQ ID NO: 551484 - DNA, 25 bp, Homo sapien
aaaagcagtacaaggtgcacctgga

SEQ ID NO: 551485 - DNA, 25 bp, Homo sapien
agcagtacaaggtgcacctggacct

SEQ ID NO: 551486 - DNA, 25 bp, Homo sapien
agtacaaggtgcacctggacctctg

SEQ ID NO: 551487 - DNA, 25 bp, Homo sapien
gtacaaggtgcacctggacctctgg

SEQ ID NO: 551488 - DNA, 25 bp, Homo sapien
tacaaggtgcacctggacctctggg

SEQ ID NO: 551489 - DNA, 25 bp, Homo sapien
ctggacctctgggttaagagcctgt

SEQ ID NO: 551490 - DNA, 25 bp, Homo sapien
ggacctctgggttaagagcctgtct

SEQ ID NO: 551491 - DNA, 25 bp, Homo sapien
agcctgtctccccaggaccgtgcag

SEQ ID NO: 551492 - DNA, 25 bp, Homo sapien
gtggcaagctaccaactaagttgta

SEQ ID NO: 551493 - DNA, 25 bp, Homo sapien
agattccatgggttgaacaagccac

SEQ ID NO: 551494 - DNA, 25 bp, Homo sapien
ggttgaacaagccacgttgcagaaa

SEQ ID NO: 551495 - DNA, 25 bp, Homo sapien
agagtaaatcccacgacataagctg

SEQ ID NO: 551496 - DNA, 25 bp, Homo sapien
acataagctggtatcagtggttcgg

SEQ ID NO: 551497 - DNA, 25 bp, Homo sapien
agttccattctatgactcttgtctc

SEQ ID NO: 551498 - DNA, 25 bp, Homo sapien
cctccaggaggactgttctaactag

SEQ ID NO: 551499 - DNA, 25 bp, Homo sapien
gttctaactagtaatcttggcccta

SEQ ID NO: 551500 - DNA, 25 bp, Homo sapien
atcttggccctattcattacatcct

SEQ ID NO: 551501 - DNA, 25 bp, Homo sapien
attacatcctctgcttgtcattctg

SEQ ID NO: 551502 - DNA, 25 bp, Homo sapien
tatagtctgtacttcagttctcatc

SEQ ID NO: 551503 - DNA, 25 bp, Homo sapien
gccgtagaagcccacgcggaaatac

SEQ ID NO: 551504 - DNA, 25 bp, Homo sapien
agccggaactctggtgcatgatctt

SEQ ID NO: 551505 - DNA, 25 bp, Homo sapien
ttggtgaaggcctcctgcagtttgc

SEQ ID NO: 551506 - DNA, 25 bp, Homo sapien
gcggccagcttcttgtagtcacggt

SEQ ID NO: 551507 - DNA, 25 bp, Homo sapien
tgtagtcacggtgggcttccaggat

SEQ ID NO: 551508 - DNA, 25 bp, Homo sapien
tccagccggtgtgagatctctgcca

SEQ ID NO: 551509 - DNA, 25 bp, Homo sapien
aggttcttgtagacctcattcaccg

SEQ ID NO: 551510 - DNA, 25 bp, Homo sapien
atctctgccagcttcgtgatcgatg

SEQ ID NO: 551511 - DNA, 25 bp, Homo sapien
tgatcgatggctccttgtacacaaa

SEQ ID NO: 551512 - DNA, 25 bp, Homo sapien
ttgtacacaaactcctgctcatcca

SEQ ID NO: 551513 - DNA, 25 bp, Homo sapien
tgctcatccaggtcaccgaagtggg

SEQ ID NO: 551514 - DNA, 25 bp, Homo sapien
attggttatgatgagggcctcggac

SEQ ID NO: 551515 - DNA, 25 bp, Homo sapien
agggcctcggacttactggtataat

SEQ ID NO: 551516 - DNA, 25 bp, Homo sapien
ataatccagaccttctcatgggttt

SEQ ID NO: 551517 - DNA, 25 bp, Homo sapien
ccttctcatgggtttattttccttg

SEQ ID NO: 551518 - DNA, 25 bp, Homo sapien
attttccttgtttagttgctgtgtt

SEQ ID NO: 551519 - DNA, 25 bp, Homo sapien
tttttcacagtatgacttaccctcc

SEQ ID NO: 551520 - DNA, 25 bp, Homo sapien
gatggcagctcttcaaatctttgtt

SEQ ID NO: 551521 - DNA, 25 bp, Homo sapien
atgggacaaggctcaagcacccact

SEQ ID NO: 551522 - DNA, 25 bp, Homo sapien
acttcttctctttcagctgttacat

SEQ ID NO: 551523 - DNA, 25 bp, Homo sapien
gaacagctttctagatcatatttct

SEQ ID NO: 551524 - DNA, 25 bp, Homo sapien
tagatcatatttctctaggacttct

SEQ ID NO: 551525 - DNA, 25 bp, Homo sapien
aggacctcggccaggcgaaactgaa

SEQ ID NO: 551526 - DNA, 25 bp, Homo sapien
ctgaaaggcagcacgatgcggttgc

SEQ ID NO: 551527 - DNA, 25 bp, Homo sapien
tgaggttgaaggtgttgcccccgat

SEQ ID NO: 551528 - DNA, 25 bp, Homo sapien
ccgatgacaggcgtggaccctgagc

SEQ ID NO: 551529 - DNA, 25 bp, Homo sapien
cgtggaccctgagccgaagctgcag

SEQ ID NO: 551530 - DNA, 25 bp, Homo sapien
gtgacgcgggactgatactccttga

SEQ ID NO: 551531 - DNA, 25 bp, Homo sapien
gatactccttgaggcacactttgaa

SEQ ID NO: 551532 - DNA, 25 bp, Homo sapien
cacactttgaagtatgtgtcacact

SEQ ID NO: 551533 - DNA, 25 bp, Homo sapien
ttgatcatgcccgagtgagaagcct

SEQ ID NO: 551534 - DNA, 25 bp, Homo sapien
atgcccgagtgagaagccttttcaa

SEQ ID NO: 551535 - DNA, 25 bp, Homo sapien
gaagccttttcaataatactgtcag

SEQ ID NO: 551536 - DNA, 25 bp, Homo sapien
aacagaaattggtaccttgcacaca

SEQ ID NO: 551537 - DNA, 25 bp, Homo sapien
gaaattggtaccttgcacacatcat

SEQ ID NO: 551538 - DNA, 25 bp, Homo sapien
gtaccttgcacacatcatctgtaag

SEQ ID NO: 551539 - DNA, 25 bp, Homo sapien
tgcacacatcatctgtaagctgttt

SEQ ID NO: 551540 - DNA, 25 bp, Homo sapien
acatcatctgtaagctgtttggttt

SEQ ID NO: 551541 - DNA, 25 bp, Homo sapien
ggtagaatgaccttgtaatgtaact

SEQ ID NO: 551542 - DNA, 25 bp, Homo sapien
gtaactgctcttgggcaatattctc

SEQ ID NO: 551543 - DNA, 25 bp, Homo sapien
gctcttgggcaatattctctgtaca

SEQ ID NO: 551544 - DNA, 25 bp, Homo sapien
ttctctgtacatattagcgacaaca

SEQ ID NO: 551545 - DNA, 25 bp, Homo sapien
acatttgtttggttatagtgcaata

SEQ ID NO: 551546 - DNA, 25 bp, Homo sapien
caataaagtttgatcttcctctgct

SEQ ID NO: 551547 - DNA, 25 bp, Homo sapien
ttgctttcctttgttacacagattt

SEQ ID NO: 551548 - DNA, 25 bp, Homo sapien
tttgtgttgcactttttctccagag

SEQ ID NO: 551549 - DNA, 25 bp, Homo sapien
gataaagcacttcttcccaaaggga

SEQ ID NO: 551550 - DNA, 25 bp, Homo sapien
aaaattatgcatttcatctactcag

SEQ ID NO: 551551 - DNA, 25 bp, Homo sapien
actcagttaccgactgcaagtctct

SEQ ID NO: 551552 - DNA, 25 bp, Homo sapien
gctctagctctcaagctttgggtga

SEQ ID NO: 551553 - DNA, 25 bp, Homo sapien
aagctttgggtgaatattcctgtga

SEQ ID NO: 551554 - DNA, 25 bp, Homo sapien
aactccttttactgagtttgcagta

SEQ ID NO: 551555 - DNA, 25 bp, Homo sapien
gcagtactgtatttgcactgtttgt

SEQ ID NO: 551556 - DNA, 25 bp, Homo sapien
tgtttgtattcctctgggcccttat

SEQ ID NO: 551557 - DNA, 25 bp, Homo sapien
gggcccttattgctacttttgcttt

SEQ ID NO: 551558 - DNA, 25 bp, Homo sapien
gagttcttaatagtttctggatatc

SEQ ID NO: 551559 - DNA, 25 bp, Homo sapien
tctggatatcagatgcctttgtggt

SEQ ID NO: 551560 - DNA, 25 bp, Homo sapien
gatgcctttgtggttttcacatctc

SEQ ID NO: 551561 - DNA, 25 bp, Homo sapien
atctctgcaggcaactgtgtgtctc

SEQ ID NO: 551562 - DNA, 25 bp, Homo sapien
aaactgcaggattgggctgcaccat

SEQ ID NO: 551563 - DNA, 25 bp, Homo sapien
agatcagacagacccaggctcagct

SEQ ID NO: 551564 - DNA, 25 bp, Homo sapien
gggtgtgcagcctcatccttggagc

SEQ ID NO: 551565 - DNA, 25 bp, Homo sapien
ggtgtccttgttcatattgaggctc

SEQ ID NO: 551566 - DNA, 25 bp, Homo sapien
ttgaggctctctagtgaaggcttac

SEQ ID NO: 551567 - DNA, 25 bp, Homo sapien
gaaggcttacggtcaggcacgactg

SEQ ID NO: 551568 - DNA, 25 bp, Homo sapien
ggcacgactgcaaattaaagcttca

SEQ ID NO: 551569 - DNA, 25 bp, Homo sapien
ttacgcgttgtctcattccaccaaa

SEQ ID NO: 551570 - DNA, 25 bp, Homo sapien
gttgtctcattccaccaaattcaga

SEQ ID NO: 551571 - DNA, 25 bp, Homo sapien
gaatatttacacaatgccttcatga

SEQ ID NO: 551572 - DNA, 25 bp, Homo sapien
cacaatgccttcatgattttatttt

SEQ ID NO: 551573 - DNA, 25 bp, Homo sapien
atttttctggaaattgaagtgtcaa

SEQ ID NO: 551574 - DNA, 25 bp, Homo sapien
tgaagtgtcaattgggttctcaata

SEQ ID NO: 551575 - DNA, 25 bp, Homo sapien
gggttctcaatatttcatgactcca

SEQ ID NO: 551576 - DNA, 25 bp, Homo sapien
aatatttcatgactccaaggatgca

SEQ ID NO: 551577 - DNA, 25 bp, Homo sapien
tcatgactccaaggatgcattaaat

SEQ ID NO: 551578 - DNA, 25 bp, Homo sapien
gtaagagaagatacctgccgcggag

SEQ ID NO: 551579 - DNA, 25 bp, Homo sapien
gaggagggtggcataattatttttt

SEQ ID NO: 551580 - DNA, 25 bp, Homo sapien
cctgagatggcaagaccagcccctt

SEQ ID NO: 551581 - DNA, 25 bp, Homo sapien
ctgagatggcaagaccagccccttg

SEQ ID NO: 551582 - DNA, 25 bp, Homo sapien
tgagatggcaagaccagccccttgt

SEQ ID NO: 551583 - DNA, 25 bp, Homo sapien
gagatggcaagaccagccccttgtc

SEQ ID NO: 551584 - DNA, 25 bp, Homo sapien
agatggcaagaccagccccttgtct

SEQ ID NO: 551585 - DNA, 25 bp, Homo sapien
gatggcaagaccagccccttgtctt

SEQ ID NO: 551586 - DNA, 25 bp, Homo sapien
ggcaagaccagccccttgtcttcct

SEQ ID NO: 551587 - DNA, 25 bp, Homo sapien
gtcttcctcagcctgctcaacgtga

SEQ ID NO: 551588 - DNA, 25 bp, Homo sapien
atgatgatccacttctacttattaa

SEQ ID NO: 551589 - DNA, 25 bp, Homo sapien
gatgatccacttctacttattaaat

SEQ ID NO: 551590 - DNA, 25 bp, Homo sapien
atccacttctacttattaaatagta

SEQ ID NO: 551591 - DNA, 25 bp, Homo sapien
tgggcctcatttcttgctgcagaga

SEQ ID NO: 551592 - DNA, 25 bp, Homo sapien
gcagagaatcttttgcactaagtca

SEQ ID NO: 551593 - DNA, 25 bp, Homo sapien
gagaatcttttgcactaagtcatgc

SEQ ID NO: 551594 - DNA, 25 bp, Homo sapien
atgctgtttcctcaaagaagctttg

SEQ ID NO: 551595 - DNA, 25 bp, Homo sapien
tattactcagagtcacccaagcctc

SEQ ID NO: 551596 - DNA, 25 bp, Homo sapien
tactcagagtcacccaagcctcttg

SEQ ID NO: 551597 - DNA, 25 bp, Homo sapien
agagtcacccaagcctcttggctga

SEQ ID NO: 551598 - DNA, 25 bp, Homo sapien
cccaagcctcttggctgagggtgaa

SEQ ID NO: 551599 - DNA, 25 bp, Homo sapien
cgctcgtgcggtgtcaacgctgcag

SEQ ID NO: 551600 - DNA, 25 bp, Homo sapien
gttgtggcaccttggtgccctctga

SEQ ID NO: 551601 - DNA, 25 bp, Homo sapien
gacccacctgcattaaacctatttt

SEQ ID NO: 551602 - DNA, 25 bp, Homo sapien
tatttgtacgtttgggatatgagcc

SEQ ID NO: 551603 - DNA, 25 bp, Homo sapien
ggatatgagccaacactggtgcatg

SEQ ID NO: 551604 - DNA, 25 bp, Homo sapien
ctggtgcatgactactactttaata

SEQ ID NO: 551605 - DNA, 25 bp, Homo sapien
aggaataacgaggactccaagtctt

SEQ ID NO: 551606 - DNA, 25 bp, Homo sapien
actccaagtcttcgtgggcaggcag

SEQ ID NO: 551607 - DNA, 25 bp, Homo sapien
tacatccctgggttcaaaacttagc

SEQ ID NO: 551608 - DNA, 25 bp, Homo sapien
gggttcaaaacttagctccaggctg

SEQ ID NO: 551609 - DNA, 25 bp, Homo sapien
taacagacttacaaagcctttgtct

SEQ ID NO: 551610 - DNA, 25 bp, Homo sapien
gcctttgtctgctgatttattttat

SEQ ID NO: 551611 - DNA, 25 bp, Homo sapien
tccatgataccttagcagttgctgt

SEQ ID NO: 551612 - DNA, 25 bp, Homo sapien
cagttgctgtttccgatggtagaat

SEQ ID NO: 551613 - DNA, 25 bp, Homo sapien
ggtgacacaaagcatacccttctgt

SEQ ID NO: 551614 - DNA, 25 bp, Homo sapien
aagcatacccttctgtgaagatttt

SEQ ID NO: 551615 - DNA, 25 bp, Homo sapien
gaagattttcactttacgccaaggc

SEQ ID NO: 551616 - DNA, 25 bp, Homo sapien
actttacgccaaggcatgattgtca

SEQ ID NO: 551617 - DNA, 25 bp, Homo sapien
acaggagctgaattctgggttctca

SEQ ID NO: 551618 - DNA, 25 bp, Homo sapien
gaattctgggttctcaaatgtgaaa

SEQ ID NO: 551619 - DNA, 25 bp, Homo sapien
tttaattcaagcattttgtcatgtg

SEQ ID NO: 551620 - DNA, 25 bp, Homo sapien
ttttgtcatgtggttcttatttctt

SEQ ID NO: 551621 - DNA, 25 bp, Homo sapien
tttcttcaaccaagtttgtttacag

SEQ ID NO: 551622 - DNA, 25 bp, Homo sapien
gtttgtttacagtcactgcctttga

SEQ ID NO: 551623 - DNA, 25 bp, Homo sapien
gtcactgcctttgaaatacagtcaa

SEQ ID NO: 551624 - DNA, 25 bp, Homo sapien
gactccaaaatcctgaccagaatat

SEQ ID NO: 551625 - DNA, 25 bp, Homo sapien
aatcctgaccagaatataaatcacc

SEQ ID NO: 551626 - DNA, 25 bp, Homo sapien
gtacactttttgtgttacttaccat

SEQ ID NO: 551627 - DNA, 25 bp, Homo sapien
ttgtgttacttaccatttcaaagaa

SEQ ID NO: 551628 - DNA, 25 bp, Homo sapien
gaaacttattcttcaagaccatttc

SEQ ID NO: 551629 - DNA, 25 bp, Homo sapien
aagaccatttcagatttccttagga

SEQ ID NO: 551630 - DNA, 25 bp, Homo sapien
gaccatttcagatttccttaggaat

SEQ ID NO: 551631 - DNA, 25 bp, Homo sapien
taggaatgtatgtgttacccataat

SEQ ID NO: 551632 - DNA, 25 bp, Homo sapien
gtgttacccataattgaccacttca

SEQ ID NO: 551633 - DNA, 25 bp, Homo sapien
ataattgaccacttcaaacttgtaa

SEQ ID NO: 551634 - DNA, 25 bp, Homo sapien
gttctcatagtcaaaacagctaagt

SEQ ID NO: 551635 - DNA, 25 bp, Homo sapien
atgggcacagtgcagccccagctcg

SEQ ID NO: 551636 - DNA, 25 bp, Homo sapien
tgactgccggtggaggtgcaaccca

SEQ ID NO: 551637 - DNA, 25 bp, Homo sapien
gctcagcacaggctcatggattgcc

SEQ ID NO: 551638 - DNA, 25 bp, Homo sapien
agcacaggctcatggattgcccggg

SEQ ID NO: 551639 - DNA, 25 bp, Homo sapien
tcttggcacagggacctccaggtac

SEQ ID NO: 551640 - DNA, 25 bp, Homo sapien
acagggacctccaggtacggcacag

SEQ ID NO: 551641 - DNA, 25 bp, Homo sapien
tccaggtacggcacagggtccgaga

SEQ ID NO: 551642 - DNA, 25 bp, Homo sapien
tcgggcccagtagtccagggctcga

SEQ ID NO: 551643 - DNA, 25 bp, Homo sapien
gtagtccagggctcgaactcggtag

SEQ ID NO: 551644 - DNA, 25 bp, Homo sapien
ctcgaactcggtaggagccagagac

SEQ ID NO: 551645 - DNA, 25 bp, Homo sapien
taggagccagagacagcacctgtgt

SEQ ID NO: 551646 - DNA, 25 bp, Homo sapien
cttcatgtgacctattcctcaaatg

SEQ ID NO: 551647 - DNA, 25 bp, Homo sapien
tgacctattcctcaaatgctgcatt

SEQ ID NO: 551648 - DNA, 25 bp, Homo sapien
aaatgctgcattctccaaaacttcc

SEQ ID NO: 551649 - DNA, 25 bp, Homo sapien
caaaacttccttacctgccttctat

SEQ ID NO: 551650 - DNA, 25 bp, Homo sapien
tctatcccctagtcattcttatcaa

SEQ ID NO: 551651 - DNA, 25 bp, Homo sapien
gtcattcttatcaatacttccaaaa

SEQ ID NO: 551652 - DNA, 25 bp, Homo sapien
gtgttagtgactatagcccttttat

SEQ ID NO: 551653 - DNA, 25 bp, Homo sapien
actatagcccttttatctctcttaa

SEQ ID NO: 551654 - DNA, 25 bp, Homo sapien
gcaaacacattgctgttagctcaaa

SEQ ID NO: 551655 - DNA, 25 bp, Homo sapien
tgctgttagctcaaattaatgtcag

SEQ ID NO: 551656 - DNA, 25 bp, Homo sapien
gtcagtgagtagaatcttaagcttt

SEQ ID NO: 551657 - DNA, 25 bp, Homo sapien
attgctggccactctgcaggaggca

SEQ ID NO: 551658 - DNA, 25 bp, Homo sapien
accacgcaggagaacgtggcctgga

SEQ ID NO: 551659 - DNA, 25 bp, Homo sapien
aagaactggatggttggcggcgaag

SEQ ID NO: 551660 - DNA, 25 bp, Homo sapien
gcgcaggaatccgaggcagcctttc

SEQ ID NO: 551661 - DNA, 25 bp, Homo sapien
gcaggaatccgaggcagcctttctc

SEQ ID NO: 551662 - DNA, 25 bp, Homo sapien
ccagcggagagtccggaccgagata

SEQ ID NO: 551663 - DNA, 25 bp, Homo sapien
gaaatgctaaaggagatgccactgc

SEQ ID NO: 551664 - DNA, 25 bp, Homo sapien
aaggagatgccactgcaggacccaa

SEQ ID NO: 551665 - DNA, 25 bp, Homo sapien
gagatgccactgcaggacccaagga

SEQ ID NO: 551666 - DNA, 25 bp, Homo sapien
gcggccaggacccagcagctattgc

SEQ ID NO: 551667 - DNA, 25 bp, Homo sapien
aggacccagcagctattgctggcca

SEQ ID NO: 551668 - DNA, 25 bp, Homo sapien
tgactgtaaagttggtccctgctta

SEQ ID NO: 551669 - DNA, 25 bp, Homo sapien
gtccctgcttaaattcatacccata

SEQ ID NO: 551670 - DNA, 25 bp, Homo sapien
attcatacccatagttttgagtcgg

SEQ ID NO: 551671 - DNA, 25 bp, Homo sapien
gagtcggtatgacaccactgcagtg

SEQ ID NO: 551672 - DNA, 25 bp, Homo sapien
caaggtgaatccgtgtgccatgcat

SEQ ID NO: 551673 - DNA, 25 bp, Homo sapien
atgcatggaccaccttgggataccg

SEQ ID NO: 551674 - DNA, 25 bp, Homo sapien
tgggataccgcagcaccatcaacat

SEQ ID NO: 551675 - DNA, 25 bp, Homo sapien
atcaacatccgccttgctgatggaa

SEQ ID NO: 551676 - DNA, 25 bp, Homo sapien
cgatgggctcggactcttagctggc

SEQ ID NO: 551677 - DNA, 25 bp, Homo sapien
tggcaggctaggacacacagtgaac

SEQ ID NO: 551678 - DNA, 25 bp, Homo sapien
aatgtactgtgaatcgttcctgata

SEQ ID NO: 551679 - DNA, 25 bp, Homo sapien
gctcgaagggtccttgtagccggga

SEQ ID NO: 551680 - DNA, 25 bp, Homo sapien
catttctttctttcggccaggctga

SEQ ID NO: 551681 - DNA, 25 bp, Homo sapien
atttctttctttcggccaggctgag

SEQ ID NO: 551682 - DNA, 25 bp, Homo sapien
caggctgaggccctgacgtggatgg

SEQ ID NO: 551683 - DNA, 25 bp, Homo sapien
aggccctgacgtggatgggcaaact

SEQ ID NO: 551684 - DNA, 25 bp, Homo sapien
cctgacgtggatgggcaaactgcag

SEQ ID NO: 551685 - DNA, 25 bp, Homo sapien
acgtggatgggcaaactgcaggcct

SEQ ID NO: 551686 - DNA, 25 bp, Homo sapien
tggatgggcaaactgcaggcctggg

SEQ ID NO: 551687 - DNA, 25 bp, Homo sapien
agcaagccgggccgtccgtgttcca

SEQ ID NO: 551688 - DNA, 25 bp, Homo sapien
cttgtgcatgacgccctgctctggg

SEQ ID NO: 551689 - DNA, 25 bp, Homo sapien
ggagcgtctggcgcgatctctgcct

SEQ ID NO: 551690 - DNA, 25 bp, Homo sapien
taaatagctggcacttagcagttta

SEQ ID NO: 551691 - DNA, 25 bp, Homo sapien
gctggcacttagcagtttagttttc

SEQ ID NO: 551692 - DNA, 25 bp, Homo sapien
gcacttagcagtttagttttccaaa

SEQ ID NO: 551693 - DNA, 25 bp, Homo sapien
tagttttccaaactttattctgaat

SEQ ID NO: 551694 - DNA, 25 bp, Homo sapien
attctgaatcaaattgctgaggtga

SEQ ID NO: 551695 - DNA, 25 bp, Homo sapien
gctgaggtgattctaaatgtctaat

SEQ ID NO: 551696 - DNA, 25 bp, Homo sapien
aggtgattctaaatgtctaatgttg

SEQ ID NO: 551697 - DNA, 25 bp, Homo sapien
gaaagtgtttatgctaaagacttgt

SEQ ID NO: 551698 - DNA, 25 bp, Homo sapien
gctaaagacttgtattttgtggcat

SEQ ID NO: 551699 - DNA, 25 bp, Homo sapien
gtattttgtggcattagttcttcat

SEQ ID NO: 551700 - DNA, 25 bp, Homo sapien
ttttgtggcattagttcttcatgtt

SEQ ID NO: 551701 - DNA, 25 bp, Homo sapien
gacttccttcacttcagctgacgga

SEQ ID NO: 551702 - DNA, 25 bp, Homo sapien
ttcacttcagctgacggacccatgg

SEQ ID NO: 551703 - DNA, 25 bp, Homo sapien
agctgacggacccatggcagctgct

SEQ ID NO: 551704 - DNA, 25 bp, Homo sapien
caggagctttgtgagctgcaggcat

SEQ ID NO: 551705 - DNA, 25 bp, Homo sapien
gcatggcgatggtgcgcctgttcca

SEQ ID NO: 551706 - DNA, 25 bp, Homo sapien
tgtgccgaccacaggagccaagcct

SEQ ID NO: 551707 - DNA, 25 bp, Homo sapien
agccaagccttttccactgtgtgga

SEQ ID NO: 551708 - DNA, 25 bp, Homo sapien
cactgtgtggactcatgtggccaag

SEQ ID NO: 551709 - DNA, 25 bp, Homo sapien
ccagccaatcgggacagttcaagga

SEQ ID NO: 551710 - DNA, 25 bp, Homo sapien
gaggagacccctattacacaggttg

SEQ ID NO: 551711 - DNA, 25 bp, Homo sapien
gacccctattacacaggttggaata

SEQ ID NO: 551712 - DNA, 25 bp, Homo sapien
gctattggtttgcttactttttatt

SEQ ID NO: 551713 - DNA, 25 bp, Homo sapien
gcttattgacatatgtatttattct

SEQ ID NO: 551714 - DNA, 25 bp, Homo sapien
ttcaccaggctgataatatctgcct

SEQ ID NO: 551715 - DNA, 25 bp, Homo sapien
ggctgataatatctgcctaatttta

SEQ ID NO: 551716 - DNA, 25 bp, Homo sapien
gtaggtttcaacttattctattgta

SEQ ID NO: 551717 - DNA, 25 bp, Homo sapien
gatactgttaaatctaatagaggca

SEQ ID NO: 551718 - DNA, 25 bp, Homo sapien
atagaggcattgtcacttttacgta

SEQ ID NO: 551719 - DNA, 25 bp, Homo sapien
aggcattgtcacttttacgtataat

SEQ ID NO: 551720 - DNA, 25 bp, Homo sapien
gcattgtcacttttacgtataattt

SEQ ID NO: 551721 - DNA, 25 bp, Homo sapien
atttaaattatggagcacttcatca

SEQ ID NO: 551722 - DNA, 25 bp, Homo sapien
tatggagcacttcatcatataaaaa

SEQ ID NO: 551723 - DNA, 25 bp, Homo sapien
gcggaatcgtcatcgaaggcctggc

SEQ ID NO: 551724 - DNA, 25 bp, Homo sapien
ggaatcgtcatcgaaggcctggctg

SEQ ID NO: 551725 - DNA, 25 bp, Homo sapien
gaatcgtcatcgaaggcctggctga

SEQ ID NO: 551726 - DNA, 25 bp, Homo sapien
aatcgtcatcgaaggcctggctgat

SEQ ID NO: 551727 - DNA, 25 bp, Homo sapien
atcgtcatcgaaggcctggctgatc

SEQ ID NO: 551728 - DNA, 25 bp, Homo sapien
gggtccaccagcgtctgcccgatgg

SEQ ID NO: 551729 - DNA, 25 bp, Homo sapien
agcgtctgcccgatggcatccacct

SEQ ID NO: 551730 - DNA, 25 bp, Homo sapien
atcgtgctgtcaatgggtcccggcc

SEQ ID NO: 551731 - DNA, 25 bp, Homo sapien
cgtgctgtcaatgggtcccggcctt

SEQ ID NO: 551732 - DNA, 25 bp, Homo sapien
caaccctgctcaggctaaacctggg

SEQ ID NO: 551733 - DNA, 25 bp, Homo sapien
ggagactcaggacccgtcggcccgg

SEQ ID NO: 551734 - DNA, 25 bp, Homo sapien
ttgccaggtccttgggatggttgac

SEQ ID NO: 551735 - DNA, 25 bp, Homo sapien
gcctctgcagtagccttttgtgagt

SEQ ID NO: 551736 - DNA, 25 bp, Homo sapien
gagtctgctaaggtagctctcacac

SEQ ID NO: 551737 - DNA, 25 bp, Homo sapien
gggttgatacctgagcctgcaatag

SEQ ID NO: 551738 - DNA, 25 bp, Homo sapien
gagcctgcaatagagccctgaaatc

SEQ ID NO: 551739 - DNA, 25 bp, Homo sapien
gagcatggcttgagtgtgtgaatat

SEQ ID NO: 551740 - DNA, 25 bp, Homo sapien
atgtgtgcacatgcttaatgagcgt

SEQ ID NO: 551741 - DNA, 25 bp, Homo sapien
gcaagtgtgcacacgtttgtggaga

SEQ ID NO: 551742 - DNA, 25 bp, Homo sapien
agaggcatgtccagtatgctttgca

SEQ ID NO: 551743 - DNA, 25 bp, Homo sapien
atgctttgcagggtgtgtttgctct

SEQ ID NO: 551744 - DNA, 25 bp, Homo sapien
tttgctcttttccatgcccatgcaa

SEQ ID NO: 551745 - DNA, 25 bp, Homo sapien
gtgtttccaaaccagttgtgccgtc

SEQ ID NO: 551746 - DNA, 25 bp, Homo sapien
agaatagaaatctcctctcgcttct

SEQ ID NO: 551747 - DNA, 25 bp, Homo sapien
ctctggccttgtgaggttgtggaca

SEQ ID NO: 551748 - DNA, 25 bp, Homo sapien
gtggacaactggaagattctgactc

SEQ ID NO: 551749 - DNA, 25 bp, Homo sapien
ggaatccagaactaggtctaccttc

SEQ ID NO: 551750 - DNA, 25 bp, Homo sapien
ggtctaccttcaacatttatgcagt

SEQ ID NO: 551751 - DNA, 25 bp, Homo sapien
cagggcagggatgtttatatctttc

SEQ ID NO: 551752 - DNA, 25 bp, Homo sapien
atatctttcataagggctgttgcaa

SEQ ID NO: 551753 - DNA, 25 bp, Homo sapien
gggctgttgcaaccatatgaactga

SEQ ID NO: 551754 - DNA, 25 bp, Homo sapien
gatattctttacaccaagccatcag

SEQ ID NO: 551755 - DNA, 25 bp, Homo sapien
aagccatcaggctccttttatcaaa

SEQ ID NO: 551756 - DNA, 25 bp, Homo sapien
tcttgctggatttcatggccagtaa

SEQ ID NO: 551757 - DNA, 25 bp, Homo sapien
ttgctggatttcatggccagtaagt

SEQ ID NO: 551758 - DNA, 25 bp, Homo sapien
gctggatttcatggccagtaagtaa

SEQ ID NO: 551759 - DNA, 25 bp, Homo sapien
ggatttcatggccagtaagtaaatt

SEQ ID NO: 551760 - DNA, 25 bp, Homo sapien
tttcatggccagtaagtaaatttaa

SEQ ID NO: 551761 - DNA, 25 bp, Homo sapien
tttctgctagagacctttgatttgg

SEQ ID NO: 551762 - DNA, 25 bp, Homo sapien
ttctgctagagacctttgatttgga

SEQ ID NO: 551763 - DNA, 25 bp, Homo sapien
tgctagagacctttgatttggaaat

SEQ ID NO: 551764 - DNA, 25 bp, Homo sapien
gatttggaaattagttattttgcat

SEQ ID NO: 551765 - DNA, 25 bp, Homo sapien
tttgcatgtttgtcaactgtatatg

SEQ ID NO: 551766 - DNA, 25 bp, Homo sapien
gtttgtcaactgtatatgtatgaaa

SEQ ID NO: 551767 - DNA, 25 bp, Homo sapien
gctattggcagctgttaaatcagat

SEQ ID NO: 551768 - DNA, 25 bp, Homo sapien
taaatcagattcagccacaaaccag

SEQ ID NO: 551769 - DNA, 25 bp, Homo sapien
agattcagccacaaaccagaattct

SEQ ID NO: 551770 - DNA, 25 bp, Homo sapien
agaccaatgagttagatgactttaa

SEQ ID NO: 551771 - DNA, 25 bp, Homo sapien
ctcacttacttctccttgatacata

SEQ ID NO: 551772 - DNA, 25 bp, Homo sapien
cttctccttgatacatagttcctgg

SEQ ID NO: 551773 - DNA, 25 bp, Homo sapien
gatacatagttcctggtctaccttc

SEQ ID NO: 551774 - DNA, 25 bp, Homo sapien
tggtctaccttctgaccctttttct

SEQ ID NO: 551775 - DNA, 25 bp, Homo sapien
aatagccagtgtctatttcactagg

SEQ ID NO: 551776 - DNA, 25 bp, Homo sapien
gtgtctatttcactaggccatttac

SEQ ID NO: 551777 - DNA, 25 bp, Homo sapien
tttcactaggccatttacttacaag

SEQ ID NO: 551778 - DNA, 25 bp, Homo sapien
aatcagatacagttgatgggcaggg

SEQ ID NO: 551779 - DNA, 25 bp, Homo sapien
gggtaagagacaactccagtgcagt

SEQ ID NO: 551780 - DNA, 25 bp, Homo sapien
agacaactccagtgcagtgccaggt

SEQ ID NO: 551781 - DNA, 25 bp, Homo sapien
caactccagtgcagtgccaggtggg

SEQ ID NO: 551782 - DNA, 25 bp, Homo sapien
ggacacactcgcagggcagggcatt

SEQ ID NO: 551783 - DNA, 25 bp, Homo sapien
cactcgcagggcagggcattctgga

SEQ ID NO: 551784 - DNA, 25 bp, Homo sapien
agggcattctggaggtgtgggtaca

SEQ ID NO: 551785 - DNA, 25 bp, Homo sapien
gaaggccagtgcgtgggcaggctga

SEQ ID NO: 551786 - DNA, 25 bp, Homo sapien
ggagggaatatgacccccctcaagt

SEQ ID NO: 551787 - DNA, 25 bp, Homo sapien
ctcaagtccccaaagtggcaggcaa

SEQ ID NO: 551788 - DNA, 25 bp, Homo sapien
aagtccccaaagtggcaggcaaggg

SEQ ID NO: 551789 - DNA, 25 bp, Homo sapien
aacatttaccatcttcaaagtacaa

SEQ ID NO: 551790 - DNA, 25 bp, Homo sapien
agtacaaatcttacatgtccttcaa

SEQ ID NO: 551791 - DNA, 25 bp, Homo sapien
ggaggtcttaatacagttcctagtt

SEQ ID NO: 551792 - DNA, 25 bp, Homo sapien
atacagttcctagttccttacttct

SEQ ID NO: 551793 - DNA, 25 bp, Homo sapien
acagttcctagttccttacttctgt

SEQ ID NO: 551794 - DNA, 25 bp, Homo sapien
gaaaagtatgtctctggatccctgg

SEQ ID NO: 551795 - DNA, 25 bp, Homo sapien
atgatgtccaaagcaaattgtgaag

SEQ ID NO: 551796 - DNA, 25 bp, Homo sapien
ccagaaacggtggaaggaccagtgt

SEQ ID NO: 551797 - DNA, 25 bp, Homo sapien
ggaccagtgtaatagtcacagactt

SEQ ID NO: 551798 - DNA, 25 bp, Homo sapien
atagtcacagacttgcatcctggct

SEQ ID NO: 551799 - DNA, 25 bp, Homo sapien
gtcacagacttgcatcctggctctg

SEQ ID NO: 551800 - DNA, 25 bp, Homo sapien
cagtgggatatcaatgcttatttac

SEQ ID NO: 551801 - DNA, 25 bp, Homo sapien
tacattttcctactgctatttatat

SEQ ID NO: 551802 - DNA, 25 bp, Homo sapien
agaggatgccttttatccccacatt

SEQ ID NO: 551803 - DNA, 25 bp, Homo sapien
tttatccccacattaaagcacagat

SEQ ID NO: 551804 - DNA, 25 bp, Homo sapien
ataaaaaccaaattgtctgtcattc

SEQ ID NO: 551805 - DNA, 25 bp, Homo sapien
gtctgtcattcaaattataactgca

SEQ ID NO: 551806 - DNA, 25 bp, Homo sapien
agtgaggtgctaattttgtgtgaga

SEQ ID NO: 551807 - DNA, 25 bp, Homo sapien
gatgaactttgtaaactactttggg

SEQ ID NO: 551808 - DNA, 25 bp, Homo sapien
tttctcctttagtcttatgcttcca

SEQ ID NO: 551809 - DNA, 25 bp, Homo sapien
ttatgcttccacttttgtctcagat

SEQ ID NO: 551810 - DNA, 25 bp, Homo sapien
cttttgtctcagattcacaatccat

SEQ ID NO: 551811 - DNA, 25 bp, Homo sapien
gatgggttttccctgatgctcccga

SEQ ID NO: 551812 - DNA, 25 bp, Homo sapien
cctcccaaggtatttctgatgactc

SEQ ID NO: 551813 - DNA, 25 bp, Homo sapien
atttctgatgactccgccccagtac

SEQ ID NO: 551814 - DNA, 25 bp, Homo sapien
cagtacttgctttgcttcatttggg

SEQ ID NO: 551815 - DNA, 25 bp, Homo sapien
aagcggtcccggagcaggctttcct

SEQ ID NO: 551816 - DNA, 25 bp, Homo sapien
aagactgctctgagcgtgcggcctt

SEQ ID NO: 551817 - DNA, 25 bp, Homo sapien
tgttacgggcgaaaggccactggcc

SEQ ID NO: 551818 - DNA, 25 bp, Homo sapien
gggaagttctttctgcaccagtgat

SEQ ID NO: 551819 - DNA, 25 bp, Homo sapien
ttctgcaccagtgatggaaaacgca

SEQ ID NO: 551820 - DNA, 25 bp, Homo sapien
aaaacgcaagactttccagtcgcaa

SEQ ID NO: 551821 - DNA, 25 bp, Homo sapien
actttccagtcgcaacccctgagag

SEQ ID NO: 551822 - DNA, 25 bp, Homo sapien
tgtctgacttagagcaacgtctgga

SEQ ID NO: 551823 - DNA, 25 bp, Homo sapien
tagagcaacgtctggagaaaagtca

SEQ ID NO: 551824 - DNA, 25 bp, Homo sapien
gaatgaacaagaagcttttcgcaat

SEQ ID NO: 551825 - DNA, 25 bp, Homo sapien
gaagcttttcgcaataacctgaaga

SEQ ID NO: 551826 - DNA, 25 bp, Homo sapien
tcgcaataacctgaagacactctta

SEQ ID NO: 551827 - DNA, 25 bp, Homo sapien
gaagacactcttagaaattctggat

SEQ ID NO: 551828 - DNA, 25 bp, Homo sapien
aattacgagataacttggccaagct

SEQ ID NO: 551829 - DNA, 25 bp, Homo sapien
agatacactgtctctcttcatagga

SEQ ID NO: 551830 - DNA, 25 bp, Homo sapien
cactgtctctcttcataggactgtt

SEQ ID NO: 551831 - DNA, 25 bp, Homo sapien
ataggactgtttaggctctgcatca

SEQ ID NO: 551832 - DNA, 25 bp, Homo sapien
tttaggctctgcatcaagattgcac

SEQ ID NO: 551833 - DNA, 25 bp, Homo sapien
caggaggatgacgtggagggtgtgt

SEQ ID NO: 551834 - DNA, 25 bp, Homo sapien
gagggtgtgtgcaagcctctgtcct

SEQ ID NO: 551835 - DNA, 25 bp, Homo sapien
gggtgtgtgcaagcctctgtcctgc

SEQ ID NO: 551836 - DNA, 25 bp, Homo sapien
tgtgtgcaagcctctgtcctgcggc

SEQ ID NO: 551837 - DNA, 25 bp, Homo sapien
aagcctctgtcctgcggctgggaga

SEQ ID NO: 551838 - DNA, 25 bp, Homo sapien
agcctctgtcctgcggctgggagat

SEQ ID NO: 551839 - DNA, 25 bp, Homo sapien
ggagatcacagacaccctgtgcgtg

SEQ ID NO: 551840 - DNA, 25 bp, Homo sapien
agatcacagacaccctgtgcgtggg

SEQ ID NO: 551841 - DNA, 25 bp, Homo sapien
atcacagacaccctgtgcgtgggcc

SEQ ID NO: 551842 - DNA, 25 bp, Homo sapien
acagacaccctgtgcgtgggccctg

SEQ ID NO: 551843 - DNA, 25 bp, Homo sapien
cttcaccccagcgagcatcatgtga

SEQ ID NO: 551844 - DNA, 25 bp, Homo sapien
cctgggtcccatggccttggaaatg

SEQ ID NO: 551845 - DNA, 25 bp, Homo sapien
ggctgcacagagtgactttgggaca

SEQ ID NO: 551846 - DNA, 25 bp, Homo sapien
tgactttgggacagcagccccggac

SEQ ID NO: 551847 - DNA, 25 bp, Homo sapien
ggactcttgccatcatcacatgagc

SEQ ID NO: 551848 - DNA, 25 bp, Homo sapien
atcatcacatgagccctgctgggca

SEQ ID NO: 551849 - DNA, 25 bp, Homo sapien
acatgagccctgctgggcacagctg

SEQ ID NO: 551850 - DNA, 25 bp, Homo sapien
cacagctgcgatgccaggagacaca

SEQ ID NO: 551851 - DNA, 25 bp, Homo sapien
gccactggccactgaatggctggca

SEQ ID NO: 551852 - DNA, 25 bp, Homo sapien
gaatggctggcacccacaagccagt

SEQ ID NO: 551853 - DNA, 25 bp, Homo sapien
ggcctgtgtgccgtgaactcagtca

SEQ ID NO: 551854 - DNA, 25 bp, Homo sapien
aactcagtcagcctgcgtgggagat

SEQ ID NO: 551855 - DNA, 25 bp, Homo sapien
taaaaaacaaccttcaacctctgat

SEQ ID NO: 551856 - DNA, 25 bp, Homo sapien
caaccttcaacctctgattatttat

SEQ ID NO: 551857 - DNA, 25 bp, Homo sapien
tccaacaacagctcttcagtagggt

SEQ ID NO: 551858 - DNA, 25 bp, Homo sapien
acaacagctcttcagtagggtaaaa

SEQ ID NO: 551859 - DNA, 25 bp, Homo sapien
ttcagtagggtaaaagtcttaacag

SEQ ID NO: 551860 - DNA, 25 bp, Homo sapien
gtcttaacagttcttcaaacgaaca

SEQ ID NO: 551861 - DNA, 25 bp, Homo sapien
aaatgttataaatggcctactctga

SEQ ID NO: 551862 - DNA, 25 bp, Homo sapien
atggcctactctgatttaaaaacct

SEQ ID NO: 551863 - DNA, 25 bp, Homo sapien
aaaacctaagttccgatgatgatga

SEQ ID NO: 551864 - DNA, 25 bp, Homo sapien
aacagcatctggtgaattcttggca

SEQ ID NO: 551865 - DNA, 25 bp, Homo sapien
ctggtgaattcttggcaatgtttcc

SEQ ID NO: 551866 - DNA, 25 bp, Homo sapien
tattctgaacaaaacaccaggccca

SEQ ID NO: 551867 - DNA, 25 bp, Homo sapien
attctgaacaaaacaccaggcccag

SEQ ID NO: 551868 - DNA, 25 bp, Homo sapien
aatagtaagcttccaaattatcttg

SEQ ID NO: 551869 - DNA, 25 bp, Homo sapien
tagtaagcttccaaattatcttgag

SEQ ID NO: 551870 - DNA, 25 bp, Homo sapien
agtaagcttccaaattatcttgagg

SEQ ID NO: 551871 - DNA, 25 bp, Homo sapien
gtaagcttccaaattatcttgaggc

SEQ ID NO: 551872 - DNA, 25 bp, Homo sapien
aagcttccaaattatcttgaggcta

SEQ ID NO: 551873 - DNA, 25 bp, Homo sapien
agcttccaaattatcttgaggctag

SEQ ID NO: 551874 - DNA, 25 bp, Homo sapien
gcttccaaattatcttgaggctagc

SEQ ID NO: 551875 - DNA, 25 bp, Homo sapien
ttccaaattatcttgaggctagcac

SEQ ID NO: 551876 - DNA, 25 bp, Homo sapien
tccaaattatcttgaggctagcaca

SEQ ID NO: 551877 - DNA, 25 bp, Homo sapien
agtcccatcagcactgttatagttg

SEQ ID NO: 551878 - DNA, 25 bp, Homo sapien
atcagcactgttatagttggtcaga

SEQ ID NO: 551879 - DNA, 25 bp, Homo sapien
atagttggtcagatgagtcattatc

SEQ ID NO: 551880 - DNA, 25 bp, Homo sapien
gagtcattatctatgacacagtcag

SEQ ID NO: 551881 - DNA, 25 bp, Homo sapien
tatgacacagtcagaaactacatct

SEQ ID NO: 551882 - DNA, 25 bp, Homo sapien
gaaactacatctgaccagagtgata

SEQ ID NO: 551883 - DNA, 25 bp, Homo sapien
ttgaaggtaggatcagagctctgaa

SEQ ID NO: 551884 - DNA, 25 bp, Homo sapien
agctctgaaggatgagttgcggaaa

SEQ ID NO: 551885 - DNA, 25 bp, Homo sapien
aaatcagttgtgaaccagctgaaga

SEQ ID NO: 551886 - DNA, 25 bp, Homo sapien
ggaaagactgaaagcccaagaagcc

SEQ ID NO: 551887 - DNA, 25 bp, Homo sapien
gcccaagaagccagtctgatcaagc

SEQ ID NO: 551888 - DNA, 25 bp, Homo sapien
aagtcacatgcataaggcctgttca

SEQ ID NO: 551889 - DNA, 25 bp, Homo sapien
tgcataaggcctgttcagagagcag

SEQ ID NO: 551890 - DNA, 25 bp, Homo sapien
agagcagagcctccatctttttgct

SEQ ID NO: 551891 - DNA, 25 bp, Homo sapien
gctccttttctactttgtacttcac

SEQ ID NO: 551892 - DNA, 25 bp, Homo sapien
tgtatatttccattgtaaccctgac

SEQ ID NO: 551893 - DNA, 25 bp, Homo sapien
aaagcactttttgatcatgaaatac

SEQ ID NO: 551894 - DNA, 25 bp, Homo sapien
aaatctttgtgtgatgtggatcata

SEQ ID NO: 551895 - DNA, 25 bp, Homo sapien
atgtggatcatagtttctcaggctc

SEQ ID NO: 551896 - DNA, 25 bp, Homo sapien
ctcaggctcccttagataattgctt

SEQ ID NO: 551897 - DNA, 25 bp, Homo sapien
gaatattgttctaactctgtgtaag

SEQ ID NO: 551898 - DNA, 25 bp, Homo sapien
agaaggtttgtattattgatccaga

SEQ ID NO: 551899 - DNA, 25 bp, Homo sapien
aagactcaatagatttgcttttgat

SEQ ID NO: 551900 - DNA, 25 bp, Homo sapien
aacacttccatacagtgaacgccat

SEQ ID NO: 551901 - DNA, 25 bp, Homo sapien
gtgaacgccataagcacaactgcaa

SEQ ID NO: 551902 - DNA, 25 bp, Homo sapien
tagggcaaaatgtggcagtgcagac

SEQ ID NO: 551903 - DNA, 25 bp, Homo sapien
gcagacatttcagcatatcaagagc

SEQ ID NO: 551904 - DNA, 25 bp, Homo sapien
tttcagcatatcaagagcacttcca

SEQ ID NO: 551905 - DNA, 25 bp, Homo sapien
atcaagagcacttccaaattacagg

SEQ ID NO: 551906 - DNA, 25 bp, Homo sapien
atctcaatagataattttgctgaag

SEQ ID NO: 551907 - DNA, 25 bp, Homo sapien
gataagtgaaggcaactcataagga

SEQ ID NO: 551908 - DNA, 25 bp, Homo sapien
aaatatgtaaaatggccgataggaa

SEQ ID NO: 551909 - DNA, 25 bp, Homo sapien
ggaaagatgtttaacgtcactaatt

SEQ ID NO: 551910 - DNA, 25 bp, Homo sapien
tctacctctgacctctccggaggtt

SEQ ID NO: 551911 - DNA, 25 bp, Homo sapien
ctccaagccggacttagggcttcaa

SEQ ID NO: 551912 - DNA, 25 bp, Homo sapien
ttagggcttcaagaggcgggcgtgc

SEQ ID NO: 551913 - DNA, 25 bp, Homo sapien
tctggagtcccctaccatgactgaa

SEQ ID NO: 551914 - DNA, 25 bp, Homo sapien
gagtcccctaccatgactgaaggcg

SEQ ID NO: 551915 - DNA, 25 bp, Homo sapien
accatgactgaaggcgccagagact

SEQ ID NO: 551916 - DNA, 25 bp, Homo sapien
gagactggcggtgtcttaagactcc

SEQ ID NO: 551917 - DNA, 25 bp, Homo sapien
gcgctgtcaagcaacactctgcgga

SEQ ID NO: 551918 - DNA, 25 bp, Homo sapien
tgtcaagcaacactctgcggacctg

SEQ ID NO: 551919 - DNA, 25 bp, Homo sapien
actctgcggacctgccggcgtagtt

SEQ ID NO: 551920 - DNA, 25 bp, Homo sapien
gacctgccggcgtagttgcagcggg

SEQ ID NO: 551921 - DNA, 25 bp, Homo sapien
agaggtcaagtcatgcaaccatctt

SEQ ID NO: 551922 - DNA, 25 bp, Homo sapien
tagattactgatgtccatggcaagt

SEQ ID NO: 551923 - DNA, 25 bp, Homo sapien
atgtccatggcaagtgatctgttct

SEQ ID NO: 551924 - DNA, 25 bp, Homo sapien
gtgatctgttcttggtattttgttt

SEQ ID NO: 551925 - DNA, 25 bp, Homo sapien
aatgtaatcacccattggtcaggcc

SEQ ID NO: 551926 - DNA, 25 bp, Homo sapien
aatcacccattggtcaggcccagga

SEQ ID NO: 551927 - DNA, 25 bp, Homo sapien
aggactggtcaccatgagctctgct

SEQ ID NO: 551928 - DNA, 25 bp, Homo sapien
tggtcaccatgagctctgctagcca

SEQ ID NO: 551929 - DNA, 25 bp, Homo sapien
ccaacgatgcttccggctctcatgg

SEQ ID NO: 551930 - DNA, 25 bp, Homo sapien
atgcttccggctctcatggattcca

SEQ ID NO: 551931 - DNA, 25 bp, Homo sapien
ggctctcatggattccacagcaaat

SEQ ID NO: 551932 - DNA, 25 bp, Homo sapien
atccaccctgtagggcccatgttgg

SEQ ID NO: 551933 - DNA, 25 bp, Homo sapien
ctgtagggcccatgttggtgtagca

SEQ ID NO: 551934 - DNA, 25 bp, Homo sapien
ttggtgtagcagtgatggcttctgt

SEQ ID NO: 551935 - DNA, 25 bp, Homo sapien
tgtagcagtgatggcttctgtggat

SEQ ID NO: 551936 - DNA, 25 bp, Homo sapien
tctgtgacctctgtcggtgtaactt

SEQ ID NO: 551937 - DNA, 25 bp, Homo sapien
gatttcctgccccttccacaatatg

SEQ ID NO: 551938 - DNA, 25 bp, Homo sapien
gacctctgtcggtgtaacttgacaa

SEQ ID NO: 551939 - DNA, 25 bp, Homo sapien
gtcggtgtaacttgacaatttctaa

SEQ ID NO: 551940 - DNA, 25 bp, Homo sapien
gtaacttgacaatttctaaatggaa

SEQ ID NO: 551941 - DNA, 25 bp, Homo sapien
tgccccttccacaatatgctgtttc

SEQ ID NO: 551942 - DNA, 25 bp, Homo sapien
ttccacaatatgctgtttccccagg

SEQ ID NO: 551943 - DNA, 25 bp, Homo sapien
tccctaacgagactctctgtgctgg

SEQ ID NO: 551944 - DNA, 25 bp, Homo sapien
gtgctaattacatggcaggaagaat

SEQ ID NO: 551945 - DNA, 25 bp, Homo sapien
tacacagaaacatacacataccgag

SEQ ID NO: 551946 - DNA, 25 bp, Homo sapien
gaaacatacacataccgagaaacct

SEQ ID NO: 551947 - DNA, 25 bp, Homo sapien
atacacataccgagaaacctatttc

SEQ ID NO: 551948 - DNA, 25 bp, Homo sapien
gagaaacctatttctcagacccctt

SEQ ID NO: 551949 - DNA, 25 bp, Homo sapien
tatttctcagacccctttttctcct

SEQ ID NO: 551950 - DNA, 25 bp, Homo sapien
acacatactcccacttgcaactatt

SEQ ID NO: 551951 - DNA, 25 bp, Homo sapien
atactcccacttgcaactattctgt

SEQ ID NO: 551952 - DNA, 25 bp, Homo sapien
actcccacttgcaactattctgttt

SEQ ID NO: 551953 - DNA, 25 bp, Homo sapien
tcccacttgcaactattctgtttct

SEQ ID NO: 551954 - DNA, 25 bp, Homo sapien
tatgcctgcgccctggtaaaggtga

SEQ ID NO: 551955 - DNA, 25 bp, Homo sapien
atgcctgcgccctggtaaaggtgac

SEQ ID NO: 551956 - DNA, 25 bp, Homo sapien
tgcctgcgccctggtaaaggtgacc

SEQ ID NO: 551957 - DNA, 25 bp, Homo sapien
gcctgcgccctggtaaaggtgaccc

SEQ ID NO: 551958 - DNA, 25 bp, Homo sapien
tgcgccctggtaaaggtgacccctg

SEQ ID NO: 551959 - DNA, 25 bp, Homo sapien
gcgccctggtaaaggtgacccctgc

SEQ ID NO: 551960 - DNA, 25 bp, Homo sapien
ccctggtaaaggtgacccctgccat

SEQ ID NO: 551961 - DNA, 25 bp, Homo sapien
cctggtaaaggtgacccctgccatt

SEQ ID NO: 551962 - DNA, 25 bp, Homo sapien
ctggtaaaggtgacccctgccattt

SEQ ID NO: 551963 - DNA, 25 bp, Homo sapien
ggtgtcattttttgataatcttgaa

SEQ ID NO: 551964 - DNA, 25 bp, Homo sapien
gaatggcaaataacccaatagcctg

SEQ ID NO: 551965 - DNA, 25 bp, Homo sapien
gtaccagagacatctgtgattgttc

SEQ ID NO: 551966 - DNA, 25 bp, Homo sapien
catctgtgattgttctattacttga

SEQ ID NO: 551967 - DNA, 25 bp, Homo sapien
acttgaatagttctacagtcttttt

SEQ ID NO: 551968 - DNA, 25 bp, Homo sapien
aatgtttacaattatccagttttag

SEQ ID NO: 551969 - DNA, 25 bp, Homo sapien
gagagactttaacgccattgcctgg

SEQ ID NO: 551970 - DNA, 25 bp, Homo sapien
gccattgcctggttacttgttttat

SEQ ID NO: 551971 - DNA, 25 bp, Homo sapien
gcctggttacttgttttatgctgta

SEQ ID NO: 551972 - DNA, 25 bp, Homo sapien
gttttatgctgtaatctagtttatt

SEQ ID NO: 551973 - DNA, 25 bp, Homo sapien
ttatacctgccttaaataatttggc

SEQ ID NO: 551974 - DNA, 25 bp, Homo sapien
gtattgctcttaagagtcctttctc

SEQ ID NO: 551975 - DNA, 25 bp, Homo sapien
gagtcctttctcagcatattattct

SEQ ID NO: 551976 - DNA, 25 bp, Homo sapien
agctctggatgctacccctgggata

SEQ ID NO: 551977 - DNA, 25 bp, Homo sapien
acccctgggatatctactgctgtta

SEQ ID NO: 551978 - DNA, 25 bp, Homo sapien
ggatatctactgctgttatgtgaat

SEQ ID NO: 551979 - DNA, 25 bp, Homo sapien
gtgaccattatagtaagggctcttt

SEQ ID NO: 551980 - DNA, 25 bp, Homo sapien
ggatgtatacattttatagtctggc

SEQ ID NO: 551981 - DNA, 25 bp, Homo sapien
atagtctggctatcagtttgatatc

SEQ ID NO: 551982 - DNA, 25 bp, Homo sapien
cagtttgatatcttgctgtcaagta

SEQ ID NO: 551983 - DNA, 25 bp, Homo sapien
gctgtcaagtatgtttctcaatctg

SEQ ID NO: 551984 - DNA, 25 bp, Homo sapien
agtatgtttctcaatctgtatttat

SEQ ID NO: 551985 - DNA, 25 bp, Homo sapien
aacttgaacttcagagggtgctcct

SEQ ID NO: 551986 - DNA, 25 bp, Homo sapien
ttgaacttcagagggtgctccttgg

SEQ ID NO: 551987 - DNA, 25 bp, Homo sapien
gccctgatgagagagacacagaagg

SEQ ID NO: 551988 - DNA, 25 bp, Homo sapien
ctgcctctgcggcagcgagcctgct

SEQ ID NO: 551989 - DNA, 25 bp, Homo sapien
gcagctgggtggctgttcggtgcag

SEQ ID NO: 551990 - DNA, 25 bp, Homo sapien
agggcgccgggctttcagcactcac

SEQ ID NO: 551991 - DNA, 25 bp, Homo sapien
tttcagcactcactatacctgctgt

SEQ ID NO: 551992 - DNA, 25 bp, Homo sapien
agcactcactatacctgctgtttgg

SEQ ID NO: 551993 - DNA, 25 bp, Homo sapien
cactcactatacctgctgtttggtt

SEQ ID NO: 551994 - DNA, 25 bp, Homo sapien
ctcactatacctgctgtttggtttg

SEQ ID NO: 551995 - DNA, 25 bp, Homo sapien
tgcccccaacagacatgggcggagg

SEQ ID NO: 551996 - DNA, 25 bp, Homo sapien
ttgttcgaaatagagacaggcagcc

SEQ ID NO: 551997 - DNA, 25 bp, Homo sapien
gagaatccaagggttgagagccagt

SEQ ID NO: 551998 - DNA, 25 bp, Homo sapien
aatccaagggttgagagccagtggc

SEQ ID NO: 551999 - DNA, 25 bp, Homo sapien
tgtttactggttcttgcaaatggga

SEQ ID NO: 552000 - DNA, 25 bp, Homo sapien
actggttcttgcaaatgggagctga

SEQ ID NO: 552001 - DNA, 25 bp, Homo sapien
gttcttgcaaatgggagctgagcag

SEQ ID NO: 552002 - DNA, 25 bp, Homo sapien
gaccactcttctttaagccatagac

SEQ ID NO: 552003 - DNA, 25 bp, Homo sapien
accactcttctttaagccatagacc

SEQ ID NO: 552004 - DNA, 25 bp, Homo sapien
aagcggagggttgacaccaccgtga

SEQ ID NO: 552005 - DNA, 25 bp, Homo sapien
agcggagggttgacaccaccgtgaa

SEQ ID NO: 552006 - DNA, 25 bp, Homo sapien
ttgacaccaccgtgaaccagagggt

SEQ ID NO: 552007 - DNA, 25 bp, Homo sapien
ccatgtctgacctgaacccgattct

SEQ ID NO: 552008 - DNA, 25 bp, Homo sapien
atgtctgacctgaacccgattctgg

SEQ ID NO: 552009 - DNA, 25 bp, Homo sapien
tgtctgacctgaacccgattctggg

SEQ ID NO: 552010 - DNA, 25 bp, Homo sapien
acctgaacccgattctggggagcat

SEQ ID NO: 552011 - DNA, 25 bp, Homo sapien
tctggggagcatcttcccgctccgg

SEQ ID NO: 552012 - DNA, 25 bp, Homo sapien
cacgacctccacagggttacattgt

SEQ ID NO: 552013 - DNA, 25 bp, Homo sapien
acgacctccacagggttacattgta

SEQ ID NO: 552014 - DNA, 25 bp, Homo sapien
gacctccacagggttacattgtaat

SEQ ID NO: 552015 - DNA, 25 bp, Homo sapien
acctccacagggttacattgtaata

SEQ ID NO: 552016 - DNA, 25 bp, Homo sapien
cctccacagggttacattgtaatat

SEQ ID NO: 552017 - DNA, 25 bp, Homo sapien
ctccacagggttacattgtaatata

SEQ ID NO: 552018 - DNA, 25 bp, Homo sapien
ggcagttcctcccagaagatcaaag

SEQ ID NO: 552019 - DNA, 25 bp, Homo sapien
aaaggatcctgcagctttaacctaa

SEQ ID NO: 552020 - DNA, 25 bp, Homo sapien
cctgcagctttaacctaatatctag

SEQ ID NO: 552021 - DNA, 25 bp, Homo sapien
caggtttcgggcaggatgtattgat

SEQ ID NO: 552022 - DNA, 25 bp, Homo sapien
gcaggatgtattgatcagacaccaa

SEQ ID NO: 552023 - DNA, 25 bp, Homo sapien
agacaccaagttcagccctcggtta

SEQ ID NO: 552024 - DNA, 25 bp, Homo sapien
aacctggctttaatagtgattcatg

SEQ ID NO: 552025 - DNA, 25 bp, Homo sapien
gggccaatctcttatcctttctgtg

SEQ ID NO: 552026 - DNA, 25 bp, Homo sapien
atccccacctgaaatgagactagtc

SEQ ID NO: 552027 - DNA, 25 bp, Homo sapien
atgagactagtcatactaacctacc

SEQ ID NO: 552028 - DNA, 25 bp, Homo sapien
acctacctcctctgatgtattgtga

SEQ ID NO: 552029 - DNA, 25 bp, Homo sapien
gtttgtttacacagatagatcttat

SEQ ID NO: 552030 - DNA, 25 bp, Homo sapien
tagatcttattgacccatatggcac

SEQ ID NO: 552031 - DNA, 25 bp, Homo sapien
gacccatatggcactagaactgtat

SEQ ID NO: 552032 - DNA, 25 bp, Homo sapien
tatggcactagaactgtatcagata

SEQ ID NO: 552033 - DNA, 25 bp, Homo sapien
atcagatataatatgggatcccagc

SEQ ID NO: 552034 - DNA, 25 bp, Homo sapien
gaagttatattaccagttacagcaa

SEQ ID NO: 552035 - DNA, 25 bp, Homo sapien
taccagttacagcaaaatactttgt

SEQ ID NO: 552036 - DNA, 25 bp, Homo sapien
aatgtagattctttatactgaagct

SEQ ID NO: 552037 - DNA, 25 bp, Homo sapien
atactgaagctattgacttgtagtg

SEQ ID NO: 552038 - DNA, 25 bp, Homo sapien
gacttgtagtgtgttggtgaaatgc

SEQ ID NO: 552039 - DNA, 25 bp, Homo sapien
ggtaaaccacattacaatcaagcca

SEQ ID NO: 552040 - DNA, 25 bp, Homo sapien
ttccctatccggagatgctgttttc

SEQ ID NO: 552041 - DNA, 25 bp, Homo sapien
gagatgctgttttcagggagtcctg

SEQ ID NO: 552042 - DNA, 25 bp, Homo sapien
gggagtcctgacactatgatgggaa

SEQ ID NO: 552043 - DNA, 25 bp, Homo sapien
ctgacactatgatgggaacaaggct

SEQ ID NO: 552044 - DNA, 25 bp, Homo sapien
ggaacaaggctatttggtttactat

SEQ ID NO: 552045 - DNA, 25 bp, Homo sapien
ggtttactatatcattagtgctaat

SEQ ID NO: 552046 - DNA, 25 bp, Homo sapien
gggcactcagatgttcagtaaatat

SEQ ID NO: 552047 - DNA, 25 bp, Homo sapien
gatgctgggttaaagcccggcgccc

SEQ ID NO: 552048 - DNA, 25 bp, Homo sapien
ggcgccctcaccaatgagacctttg

SEQ ID NO: 552049 - DNA, 25 bp, Homo sapien
agacctttgtgggaagctctactgc

SEQ ID NO: 552050 - DNA, 25 bp, Homo sapien
tgggaagctctactgcctcagtttc

SEQ ID NO: 552051 - DNA, 25 bp, Homo sapien
agaatccaagggttgagagccagtg

SEQ ID NO: 552052 - DNA, 25 bp, Homo sapien
aatccaagggttgagagccagtggc

SEQ ID NO: 552053 - DNA, 25 bp, Homo sapien
caagggttgagagccagtggcgggt

SEQ ID NO: 552054 - DNA, 25 bp, Homo sapien
tgtttactggttcttgcaaatggga

SEQ ID NO: 552055 - DNA, 25 bp, Homo sapien
gtttactggttcttgcaaatgggag

SEQ ID NO: 552056 - DNA, 25 bp, Homo sapien
tttactggttcttgcaaatgggagc

SEQ ID NO: 552057 - DNA, 25 bp, Homo sapien
ttactggttcttgcaaatgggagct

SEQ ID NO: 552058 - DNA, 25 bp, Homo sapien
tactggttcttgcaaatgggagctg

SEQ ID NO: 552059 - DNA, 25 bp, Homo sapien
actggttcttgcaaatgggagctga

SEQ ID NO: 552060 - DNA, 25 bp, Homo sapien
tggttcttgcaaatgggagctgagc

SEQ ID NO: 552061 - DNA, 25 bp, Homo sapien
gttcttgcaaatgggagctgagcag

SEQ ID NO: 552062 - DNA, 25 bp, Homo sapien
tctttgctactattaaaagtcggag

SEQ ID NO: 552063 - DNA, 25 bp, Homo sapien
gtcggagaagtggaattcaaacgtt

SEQ ID NO: 552064 - DNA, 25 bp, Homo sapien
gctatagttgtatcttaataatgcc

SEQ ID NO: 552065 - DNA, 25 bp, Homo sapien
aatgccaagtgtcaaaacaacccca

SEQ ID NO: 552066 - DNA, 25 bp, Homo sapien
aaccccattaaaatgccgcctgatt

SEQ ID NO: 552067 - DNA, 25 bp, Homo sapien
taaaatgccgcctgattaaataatg

SEQ ID NO: 552068 - DNA, 25 bp, Homo sapien
aataatgtgctgctaaatatagtgc

SEQ ID NO: 552069 - DNA, 25 bp, Homo sapien
gtgcacatgaaaacagcaagactgt

SEQ ID NO: 552070 - DNA, 25 bp, Homo sapien
atctgtatctttgtatgtatctctg

SEQ ID NO: 552071 - DNA, 25 bp, Homo sapien
tgtatctctgtatctgtacctttgc

SEQ ID NO: 552072 - DNA, 25 bp, Homo sapien
tctgtatctgtacctttgctgtatc

SEQ ID NO: 552073 - DNA, 25 bp, Homo sapien
ctgaggatggagataaaatcccgaa

SEQ ID NO: 552074 - DNA, 25 bp, Homo sapien
cacatggctcccctgtttgaaaaag

SEQ ID NO: 552075 - DNA, 25 bp, Homo sapien
aaagggcctgaataatactctgctt

SEQ ID NO: 552076 - DNA, 25 bp, Homo sapien
gggcctgaataatactctgcttctg

SEQ ID NO: 552077 - DNA, 25 bp, Homo sapien
cctgaataatactctgcttctgcct

SEQ ID NO: 552078 - DNA, 25 bp, Homo sapien
tgcttctgcctcatgacatcagatg

SEQ ID NO: 552079 - DNA, 25 bp, Homo sapien
gcctcatgacatcagatgctactgt

SEQ ID NO: 552080 - DNA, 25 bp, Homo sapien
catcagatgctactgttttggtttt

SEQ ID NO: 552081 - DNA, 25 bp, Homo sapien
ttctttgagccccaattcaccattt

SEQ ID NO: 552082 - DNA, 25 bp, Homo sapien
agccccaattcaccatttcaggatg

SEQ ID NO: 552083 - DNA, 25 bp, Homo sapien
aattcaccatttcaggatgtggatg

SEQ ID NO: 552084 - DNA, 25 bp, Homo sapien
aatgtgtaatttgtgactctaatat

SEQ ID NO: 552085 - DNA, 25 bp, Homo sapien
agctgccccagagcattaaacatgg

SEQ ID NO: 552086 - DNA, 25 bp, Homo sapien
gaagcaaaatgttcttgtttgccat

SEQ ID NO: 552087 - DNA, 25 bp, Homo sapien
tgtttgccatcatgtgtttcacacc

SEQ ID NO: 552088 - DNA, 25 bp, Homo sapien
gtgtttcacaccacaattctgtgcc

SEQ ID NO: 552089 - DNA, 25 bp, Homo sapien
acaccacaattctgtgccacagtta

SEQ ID NO: 552090 - DNA, 25 bp, Homo sapien
aagagggtctggtacccttgcagga

SEQ ID NO: 552091 - DNA, 25 bp, Homo sapien
ggtctggtacccttgcaggaccttt

SEQ ID NO: 552092 - DNA, 25 bp, Homo sapien
taggttgtgggaaaaagtcgcagaa

SEQ ID NO: 552093 - DNA, 25 bp, Homo sapien
aagatactcaaagtggagcagggaa

SEQ ID NO: 552094 - DNA, 25 bp, Homo sapien
gagcagggaatggagacagacatca

SEQ ID NO: 552095 - DNA, 25 bp, Homo sapien
gttaggtcaagaacctaggacacat

SEQ ID NO: 552096 - DNA, 25 bp, Homo sapien
gaacctaggacacataaacaaacag

SEQ ID NO: 552097 - DNA, 25 bp, Homo sapien
gaaagatgtcagctagaaccttagt

SEQ ID NO: 552098 - DNA, 25 bp, Homo sapien
gtcagctagaaccttagttgtcatt

SEQ ID NO: 552099 - DNA, 25 bp, Homo sapien
agttgtcattaagctttgtcttcct

SEQ ID NO: 552100 - DNA, 25 bp, Homo sapien
attaagctttgtcttccttatccca

SEQ ID NO: 552101 - DNA, 25 bp, Homo sapien
ttgtcttccttatcccagatattga

SEQ ID NO: 552102 - DNA, 25 bp, Homo sapien
atcccagatattgaaggcagtttac

SEQ ID NO: 552103 - DNA, 25 bp, Homo sapien
caaagtaactaactaactgtagcaa

SEQ ID NO: 552104 - DNA, 25 bp, Homo sapien
ggtctcttctgttccataatactgc

SEQ ID NO: 552105 - DNA, 25 bp, Homo sapien
cttctgttccataatactgctgtaa

SEQ ID NO: 552106 - DNA, 25 bp, Homo sapien
agcccacaaaggcaccctggccttg

SEQ ID NO: 552107 - DNA, 25 bp, Homo sapien
tctccctccgctcagggcttgaagg

SEQ ID NO: 552108 - DNA, 25 bp, Homo sapien
cagggcttgaaggtcggtggcggag

SEQ ID NO: 552109 - DNA, 25 bp, Homo sapien
tctcacagggcccaactctaaagtg

SEQ ID NO: 552110 - DNA, 25 bp, Homo sapien
cacagggcccaactctaaagtggaa

SEQ ID NO: 552111 - DNA, 25 bp, Homo sapien
cagggcccaactctaaagtggaaga

SEQ ID NO: 552112 - DNA, 25 bp, Homo sapien
agtggaagaaccttgttagaccgag

SEQ ID NO: 552113 - DNA, 25 bp, Homo sapien
gaagaaccttgttagaccgagagct

SEQ ID NO: 552114 - DNA, 25 bp, Homo sapien
gaaccttgttagaccgagagcttgc

SEQ ID NO: 552115 - DNA, 25 bp, Homo sapien
ccttgttagaccgagagcttgccat

SEQ ID NO: 552116 - DNA, 25 bp, Homo sapien
ttgttagaccgagagcttgccatcc

SEQ ID NO: 552117 - DNA, 25 bp, Homo sapien
cttcagccaaaacactttctgggct

SEQ ID NO: 552118 - DNA, 25 bp, Homo sapien
cactttctgggctattagaatggga

SEQ ID NO: 552119 - DNA, 25 bp, Homo sapien
atgggagtgcaaaactgatgcagta

SEQ ID NO: 552120 - DNA, 25 bp, Homo sapien
tgatgcagtagaagcccttacggca

SEQ ID NO: 552121 - DNA, 25 bp, Homo sapien
agcccttacggcactgaatcactat

SEQ ID NO: 552122 - DNA, 25 bp, Homo sapien
tacggcactgaatcactatcagata

SEQ ID NO: 552123 - DNA, 25 bp, Homo sapien
ctatcagataagagtgccgaatggt

SEQ ID NO: 552124 - DNA, 25 bp, Homo sapien
agagtgccgaatggttccaatccct

SEQ ID NO: 552125 - DNA, 25 bp, Homo sapien
cgaatggttccaatccctatacatt

SEQ ID NO: 552126 - DNA, 25 bp, Homo sapien
ttgcttttctacatcatcccattta

SEQ ID NO: 552127 - DNA, 25 bp, Homo sapien
tacatcatcccatttataagaagag

SEQ ID NO: 552128 - DNA, 25 bp, Homo sapien
gttgtgtacactgtggagtcgacag

SEQ ID NO: 552129 - DNA, 25 bp, Homo sapien
gggcctacaacaggcaggtactgct

SEQ ID NO: 552130 - DNA, 25 bp, Homo sapien
caacaggcaggtactgctgccaggg

SEQ ID NO: 552131 - DNA, 25 bp, Homo sapien
gggctctgaactagtgcctgctacc

SEQ ID NO: 552132 - DNA, 25 bp, Homo sapien
gaactagtgcctgctacccaggaca

SEQ ID NO: 552133 - DNA, 25 bp, Homo sapien
gcagcctggcacaagtgaagaagaa

SEQ ID NO: 552134 - DNA, 25 bp, Homo sapien
cagtgggaaaactgggtttatctca

SEQ ID NO: 552135 - DNA, 25 bp, Homo sapien
gaggacccagttgttataaggcgct

SEQ ID NO: 552136 - DNA, 25 bp, Homo sapien
agagcggagctcgaagcacccaggt

SEQ ID NO: 552137 - DNA, 25 bp, Homo sapien
gaagcacccaggttgcccacggaaa

SEQ ID NO: 552138 - DNA, 25 bp, Homo sapien
ccaggttgcccacggaaaatccaat

SEQ ID NO: 552139 - DNA, 25 bp, Homo sapien
agggttacctaatgctcagtctgtg

SEQ ID NO: 552140 - DNA, 25 bp, Homo sapien
gctcagtctgtgaaacctaaataga

SEQ ID NO: 552141 - DNA, 25 bp, Homo sapien
tgttcaaattacttaccttccactc

SEQ ID NO: 552142 - DNA, 25 bp, Homo sapien
cttaccttccactctgaagacttta

SEQ ID NO: 552143 - DNA, 25 bp, Homo sapien
ttaggagttctgtctactagtaaac

SEQ ID NO: 552144 - DNA, 25 bp, Homo sapien
gtctactagtaaacattccaaattg

SEQ ID NO: 552145 - DNA, 25 bp, Homo sapien
aaattgctacccaacattactgtta

SEQ ID NO: 552146 - DNA, 25 bp, Homo sapien
actgttaacagattttcctccgtat

SEQ ID NO: 552147 - DNA, 25 bp, Homo sapien
acagattttcctccgtattcttcta

SEQ ID NO: 552148 - DNA, 25 bp, Homo sapien
aaattataccccatgggcttgccag

SEQ ID NO: 552149 - DNA, 25 bp, Homo sapien
ggcttgccaggtaatgacgaaaact

SEQ ID NO: 552150 - DNA, 25 bp, Homo sapien
tgagctagggttgcagcagaaattg

SEQ ID NO: 552151 - DNA, 25 bp, Homo sapien
gaaattgagttgcagcttgcccttg

SEQ ID NO: 552152 - DNA, 25 bp, Homo sapien
gagttgcagcttgcccttgtccaga

SEQ ID NO: 552153 - DNA, 25 bp, Homo sapien
ttctgcttgcgtttttgaaacagga

SEQ ID NO: 552154 - DNA, 25 bp, Homo sapien
aaacaggaggtgcacgtaccaccca

SEQ ID NO: 552155 - DNA, 25 bp, Homo sapien
gtaccacccaattatctatggcagc

SEQ ID NO: 552156 - DNA, 25 bp, Homo sapien
gcagcatgcatgtataggccgaact

SEQ ID NO: 552157 - DNA, 25 bp, Homo sapien
tgtataggccgaactattatcagct

SEQ ID NO: 552158 - DNA, 25 bp, Homo sapien
accaccctcctattgtgtctgaagt

SEQ ID NO: 552159 - DNA, 25 bp, Homo sapien
gtgtctgaagtttcacgtgtgttta

SEQ ID NO: 552160 - DNA, 25 bp, Homo sapien
atggatcacacgatttctttaaggg

SEQ ID NO: 552161 - DNA, 25 bp, Homo sapien
gttctgcaggtcagcatcattgtgt

SEQ ID NO: 552162 - DNA, 25 bp, Homo sapien
ggaccctgtggttcaaccttagaat

SEQ ID NO: 552163 - DNA, 25 bp, Homo sapien
gaatctgtttcctgtaggctctttc

SEQ ID NO: 552164 - DNA, 25 bp, Homo sapien
tcattaaagttttccacttcaccct

SEQ ID NO: 552165 - DNA, 25 bp, Homo sapien
acttcaccctcccatagtctagagg

SEQ ID NO: 552166 - DNA, 25 bp, Homo sapien
gtctagagggatgcccattccatgg

SEQ ID NO: 552167 - DNA, 25 bp, Homo sapien
attccatggtcctccagagaatagt

SEQ ID NO: 552168 - DNA, 25 bp, Homo sapien
tgtttagcccacatcacgtcagtta

SEQ ID NO: 552169 - DNA, 25 bp, Homo sapien
atcacgtcagttatcaacaccgcca

SEQ ID NO: 552170 - DNA, 25 bp, Homo sapien
tgtgcttactgttcctacagccaca

SEQ ID NO: 552171 - DNA, 25 bp, Homo sapien
gccacaccaggcttgaagagttagt

SEQ ID NO: 552172 - DNA, 25 bp, Homo sapien
cctcctaaagagacactgcctgatt

SEQ ID NO: 552173 - DNA, 25 bp, Homo sapien
gacactgcctgattcaggattttct

SEQ ID NO: 552174 - DNA, 25 bp, Homo sapien
gaagcagatttagtgagaccgttac

SEQ ID NO: 552175 - DNA, 25 bp, Homo sapien
tgagaccgttacttcctaaggacat

SEQ ID NO: 552176 - DNA, 25 bp, Homo sapien
ggacatggaacgtcttacaagcctt

SEQ ID NO: 552177 - DNA, 25 bp, Homo sapien
acaagccttagagctggcattgaag

SEQ ID NO: 552178 - DNA, 25 bp, Homo sapien
ttgaaggacctttacttgcaagtga

SEQ ID NO: 552179 - DNA, 25 bp, Homo sapien
acttgcaagtgatgttggacgtgac

SEQ ID NO: 552180 - DNA, 25 bp, Homo sapien
tggacgtgacagatctgctgccagc

SEQ ID NO: 552181 - DNA, 25 bp, Homo sapien
gctgccagcccggttgtaagtagta

SEQ ID NO: 552182 - DNA, 25 bp, Homo sapien
gcccggttgtaagtagtatgccaga

SEQ ID NO: 552183 - DNA, 25 bp, Homo sapien
taatgtttctcttttgttaacttat

SEQ ID NO: 552184 - DNA, 25 bp, Homo sapien
ttatttttcaaacactgagccatag

SEQ ID NO: 552185 - DNA, 25 bp, Homo sapien
tttcaaacactgagccatagtctta

SEQ ID NO: 552186 - DNA, 25 bp, Homo sapien
cactgagccatagtcttaaatttaa

SEQ ID NO: 552187 - DNA, 25 bp, Homo sapien
aattgtatcatgtagtcgggcagcc

SEQ ID NO: 552188 - DNA, 25 bp, Homo sapien
tgtatcatgtagtcgggcagcctat

SEQ ID NO: 552189 - DNA, 25 bp, Homo sapien
agtcgggcagcctattgatactgtc

SEQ ID NO: 552190 - DNA, 25 bp, Homo sapien
gggcagcctattgatactgtcaggg

SEQ ID NO: 552191 - DNA, 25 bp, Homo sapien
aaaaatgggtcagaactcagcatct

SEQ ID NO: 552192 - DNA, 25 bp, Homo sapien
gaactcagcatctgtcatgaaaaaa

SEQ ID NO: 552193 - DNA, 25 bp, Homo sapien
gaaagtgtctgttttgtggtgtata

SEQ ID NO: 552194 - DNA, 25 bp, Homo sapien
aagggagaacccatcagattcgcct

SEQ ID NO: 552195 - DNA, 25 bp, Homo sapien
catcagattcgccttgggtgtagat

SEQ ID NO: 552196 - DNA, 25 bp, Homo sapien
gattcgccttgggtgtagatgaaac

SEQ ID NO: 552197 - DNA, 25 bp, Homo sapien
tggaaggtgccgaccagccaggccc

SEQ ID NO: 552198 - DNA, 25 bp, Homo sapien
gggccatcggtgacgtgggaacgat

SEQ ID NO: 552199 - DNA, 25 bp, Homo sapien
ttcagggaagcagtggctcagagct

SEQ ID NO: 552200 - DNA, 25 bp, Homo sapien
agtggctcagagctccgtgacgttt

SEQ ID NO: 552201 - DNA, 25 bp, Homo sapien
gagctccgtgacgttttttggaacg

SEQ ID NO: 552202 - DNA, 25 bp, Homo sapien
gaggtgcgagatgcagacatttaac

SEQ ID NO: 552203 - DNA, 25 bp, Homo sapien
gatgcagacatttaacacatccggg

SEQ ID NO: 552204 - DNA, 25 bp, Homo sapien
tagccaggcagaggagcgtcagacc

SEQ ID NO: 552205 - DNA, 25 bp, Homo sapien
agggaaggaaagctcctgcccatct

SEQ ID NO: 552206 - DNA, 25 bp, Homo sapien
aagattagcacagggcaccaactgg

SEQ ID NO: 552207 - DNA, 25 bp, Homo sapien
cacagggcaccaactggacagaggc

SEQ ID NO: 552208 - DNA, 25 bp, Homo sapien
ctctcactggacagcatcacctgga

SEQ ID NO: 552209 - DNA, 25 bp, Homo sapien
ggacagcatcacctggacacagagc

SEQ ID NO: 552210 - DNA, 25 bp, Homo sapien
tggacacagagcctcacctagtctg

SEQ ID NO: 552211 - DNA, 25 bp, Homo sapien
gcctcacctagtctgtgtcccatgg

SEQ ID NO: 552212 - DNA, 25 bp, Homo sapien
cacaactttgctttggacagtgaca

SEQ ID NO: 552213 - DNA, 25 bp, Homo sapien
aactttgctttggacagtgacacca

SEQ ID NO: 552214 - DNA, 25 bp, Homo sapien
tggacagtgacaccaagaatactca

SEQ ID NO: 552215 - DNA, 25 bp, Homo sapien
caagaatactcacccctttacttag

SEQ ID NO: 552216 - DNA, 25 bp, Homo sapien
agctgttctcttcatatcctattac

SEQ ID NO: 552217 - DNA, 25 bp, Homo sapien
tcatatcctattacagtctctcaga

SEQ ID NO: 552218 - DNA, 25 bp, Homo sapien
ttacagtctctcagattcttgtggg

SEQ ID NO: 552219 - DNA, 25 bp, Homo sapien
ggcactcttagatctcccttggaga

SEQ ID NO: 552220 - DNA, 25 bp, Homo sapien
agatctcccttggagacaaggttat

SEQ ID NO: 552221 - DNA, 25 bp, Homo sapien
tatatgttgttaatctcgcagagct

SEQ ID NO: 552222 - DNA, 25 bp, Homo sapien
tcgcagagcttccttttagtcacaa

SEQ ID NO: 552223 - DNA, 25 bp, Homo sapien
ttagtcacaatagccttcattttct

SEQ ID NO: 552224 - DNA, 25 bp, Homo sapien
tgccatgccccttcataagggagaa

SEQ ID NO: 552225 - DNA, 25 bp, Homo sapien
atcctccccgcataatctatggaat

SEQ ID NO: 552226 - DNA, 25 bp, Homo sapien
taggagtcctgtgtggagtcttatc

SEQ ID NO: 552227 - DNA, 25 bp, Homo sapien
agagctgtcctcaaagcatccagtg

SEQ ID NO: 552228 - DNA, 25 bp, Homo sapien
agctgtcctcaaagcatccagtgaa

SEQ ID NO: 552229 - DNA, 25 bp, Homo sapien
cagtgaacactggaagaggcttcta

SEQ ID NO: 552230 - DNA, 25 bp, Homo sapien
gaacactggaagaggcttctagaag

SEQ ID NO: 552231 - DNA, 25 bp, Homo sapien
acctgcagagacttcctgcctggaa

SEQ ID NO: 552232 - DNA, 25 bp, Homo sapien
actcatctgtgaactgggacagaag

SEQ ID NO: 552233 - DNA, 25 bp, Homo sapien
ttcagaatatctgcactgtcttctg

SEQ ID NO: 552234 - DNA, 25 bp, Homo sapien
cagaatatctgcactgtcttctgat

SEQ ID NO: 552235 - DNA, 25 bp, Homo sapien
tgtcttctgatcctgttagtcactg

SEQ ID NO: 552236 - DNA, 25 bp, Homo sapien
gtcttctgatcctgttagtcactgt

SEQ ID NO: 552237 - DNA, 25 bp, Homo sapien
cttctgatcctgttagtcactgtgg

SEQ ID NO: 552238 - DNA, 25 bp, Homo sapien
gaaattatccaacacagtaatattg

SEQ ID NO: 552239 - DNA, 25 bp, Homo sapien
aatattggtacctgtcattttttca

SEQ ID NO: 552240 - DNA, 25 bp, Homo sapien
ctgtcattttttcacttctgtttaa

SEQ ID NO: 552241 - DNA, 25 bp, Homo sapien
gcaagataacttgggtaatcttcta

SEQ ID NO: 552242 - DNA, 25 bp, Homo sapien
aaaaactcactgttagtgactttga

SEQ ID NO: 552243 - DNA, 25 bp, Homo sapien
ctcactgttagtgactttgatgcct

SEQ ID NO: 552244 - DNA, 25 bp, Homo sapien
tgttagtgactttgatgccttttaa

SEQ ID NO: 552245 - DNA, 25 bp, Homo sapien
aagagctttttcatttcattccatc

SEQ ID NO: 552246 - DNA, 25 bp, Homo sapien
ttttcatttcattccatctttaaaa

SEQ ID NO: 552247 - DNA, 25 bp, Homo sapien
aaagagatctctagcgtgtgtgaat

SEQ ID NO: 552248 - DNA, 25 bp, Homo sapien
aagagatctctagcgtgtgtgaata

SEQ ID NO: 552249 - DNA, 25 bp, Homo sapien
cagccttgtattccatactcagaga

SEQ ID NO: 552250 - DNA, 25 bp, Homo sapien
ttgtattccatactcagagaccctg

SEQ ID NO: 552251 - DNA, 25 bp, Homo sapien
tacttacttgacatctcaacttgaa

SEQ ID NO: 552252 - DNA, 25 bp, Homo sapien
gacatctcaacttgaaagtccaatt

SEQ ID NO: 552253 - DNA, 25 bp, Homo sapien
gtccaattaatatgcacttcaaact

SEQ ID NO: 552254 - DNA, 25 bp, Homo sapien
tcaaactttaataggcttcaaacag

SEQ ID NO: 552255 - DNA, 25 bp, Homo sapien
ggcttcaaacagaatttctttcatt

SEQ ID NO: 552256 - DNA, 25 bp, Homo sapien
aacagcttctctcatcatcttgaaa

SEQ ID NO: 552257 - DNA, 25 bp, Homo sapien
catcttgaaattagtgaatggcatt

SEQ ID NO: 552258 - DNA, 25 bp, Homo sapien
agaatccaactgtttcattcccact

SEQ ID NO: 552259 - DNA, 25 bp, Homo sapien
tccaactgtttcattcccacttctg

SEQ ID NO: 552260 - DNA, 25 bp, Homo sapien
gcagggcagtactggaccaggtcta

SEQ ID NO: 552261 - DNA, 25 bp, Homo sapien
actggaccaggtctacgtcagcatt

SEQ ID NO: 552262 - DNA, 25 bp, Homo sapien
ggtctacgtcagcattcaggttcaa

SEQ ID NO: 552263 - DNA, 25 bp, Homo sapien
tacgtcagcattcaggttcaatggg

SEQ ID NO: 552264 - DNA, 25 bp, Homo sapien
gcttcaaacttcctgatctaattat

SEQ ID NO: 552265 - DNA, 25 bp, Homo sapien
acttcctgatctaattatgttttta

SEQ ID NO: 552266 - DNA, 25 bp, Homo sapien
gacacttagaagttattgaggactt

SEQ ID NO: 552267 - DNA, 25 bp, Homo sapien
gttattgaggactttaaagagcttt

SEQ ID NO: 552268 - DNA, 25 bp, Homo sapien
tgggttaatatttatgacatttgac

SEQ ID NO: 552269 - DNA, 25 bp, Homo sapien
ggatgttttgtgaaaaagcaatcta

SEQ ID NO: 552270 - DNA, 25 bp, Homo sapien
aagcaatctattgtgtccaaataaa

SEQ ID NO: 552271 - DNA, 25 bp, Homo sapien
aatgtatttgctctggcccttgctt

SEQ ID NO: 552272 - DNA, 25 bp, Homo sapien
tttgctctggcccttgctttttacc

SEQ ID NO: 552273 - DNA, 25 bp, Homo sapien
gctttttaccctccagagctaagag

SEQ ID NO: 552274 - DNA, 25 bp, Homo sapien
gagctaagaggtagcagagtctctt

SEQ ID NO: 552275 - DNA, 25 bp, Homo sapien
gagtctcttgggatgagtgattcac

SEQ ID NO: 552276 - DNA, 25 bp, Homo sapien
atgagtgattcaccctcttacttgg

SEQ ID NO: 552277 - DNA, 25 bp, Homo sapien
tcttacttggcgaccactgatgaga

SEQ ID NO: 552278 - DNA, 25 bp, Homo sapien
cttggcgaccactgatgagatcaac

SEQ ID NO: 552279 - DNA, 25 bp, Homo sapien
tgatgagatcaacaacaggtgaact

SEQ ID NO: 552280 - DNA, 25 bp, Homo sapien
gataatattatctacctcacaagct

SEQ ID NO: 552281 - DNA, 25 bp, Homo sapien
attatctacctcacaagcttatgaa

SEQ ID NO: 552282 - DNA, 25 bp, Homo sapien
ttcaccttcctcaggcaggagctgc

SEQ ID NO: 552283 - DNA, 25 bp, Homo sapien
aggagctgcctgtgcgcctggccaa

SEQ ID NO: 552284 - DNA, 25 bp, Homo sapien
atgaaagagatcaacctgcttcccg

SEQ ID NO: 552285 - DNA, 25 bp, Homo sapien
gcttcccgaccgagtgctgagcaca

SEQ ID NO: 552286 - DNA, 25 bp, Homo sapien
ctggtgcagagctggtatgtccaga

SEQ ID NO: 552287 - DNA, 25 bp, Homo sapien
agctggtatgtccagagcctcctgg

SEQ ID NO: 552288 - DNA, 25 bp, Homo sapien
aggaccatcgcaccctgagccagtt

SEQ ID NO: 552289 - DNA, 25 bp, Homo sapien
tgagccagttcactgacgccctggt

SEQ ID NO: 552290 - DNA, 25 bp, Homo sapien
atccggaaccggcacaacgacgtgg

SEQ ID NO: 552291 - DNA, 25 bp, Homo sapien
acaacgacgtggtgcccaccatggc

SEQ ID NO: 552292 - DNA, 25 bp, Homo sapien
ggatccagcaatgcctgtgagaaaa

SEQ ID NO: 552293 - DNA, 25 bp, Homo sapien
tacatctcaatctggtagataaagt

SEQ ID NO: 552294 - DNA, 25 bp, Homo sapien
aatatttagtacctgattagcgtgt

SEQ ID NO: 552295 - DNA, 25 bp, Homo sapien
agtacctgattagcgtgtatgcaaa

SEQ ID NO: 552296 - DNA, 25 bp, Homo sapien
aagtaatttgcttcgtttgttgaat

SEQ ID NO: 552297 - DNA, 25 bp, Homo sapien
ttcgtttgttgaattagaagccagc

SEQ ID NO: 552298 - DNA, 25 bp, Homo sapien
tagaagccagctgccttactaaact

SEQ ID NO: 552299 - DNA, 25 bp, Homo sapien
agctgccttactaaactaccacatt

SEQ ID NO: 552300 - DNA, 25 bp, Homo sapien
aaactaccacatttgctttgctcat

SEQ ID NO: 552301 - DNA, 25 bp, Homo sapien
acatttgctttgctcattctcttgg

SEQ ID NO: 552302 - DNA, 25 bp, Homo sapien
gctcattctcttggctttgcagata

SEQ ID NO: 552303 - DNA, 25 bp, Homo sapien
attctcttggctttgcagatagaaa

SEQ ID NO: 552304 - DNA, 25 bp, Homo sapien
tattaactgagtaacatcctcctga

SEQ ID NO: 552305 - DNA, 25 bp, Homo sapien
aactgagtaacatcctcctgatgag

SEQ ID NO: 552306 - DNA, 25 bp, Homo sapien
gagtaacatcctcctgatgagaagt

SEQ ID NO: 552307 - DNA, 25 bp, Homo sapien
aacatcctcctgatgagaagtacta

SEQ ID NO: 552308 - DNA, 25 bp, Homo sapien
cctcctgatgagaagtactatatta

SEQ ID NO: 552309 - DNA, 25 bp, Homo sapien
ttgttttgttgtctcccaagttaat

SEQ ID NO: 552310 - DNA, 25 bp, Homo sapien
gttttgttgtctcccaagttaatat

SEQ ID NO: 552311 - DNA, 25 bp, Homo sapien
ttgttgtctcccaagttaatattat

SEQ ID NO: 552312 - DNA, 25 bp, Homo sapien
tatatttagatatcagagagtcagg

SEQ ID NO: 552313 - DNA, 25 bp, Homo sapien
aatgtattcagtgtatctaatactg

SEQ ID NO: 552314 - DNA, 25 bp, Homo sapien
gtatctaatactgaaatgcggaaaa

SEQ ID NO: 552315 - DNA, 25 bp, Homo sapien
tttaaacatttgacatcagaagctt

SEQ ID NO: 552316 - DNA, 25 bp, Homo sapien
agaagctttatttgtaaacctcaca

SEQ ID NO: 552317 - DNA, 25 bp, Homo sapien
gaagctttatttgtaaacctcacac

SEQ ID NO: 552318 - DNA, 25 bp, Homo sapien
aagctttatttgtaaacctcacaca

SEQ ID NO: 552319 - DNA, 25 bp, Homo sapien
ctttatttgtaaacctcacacagat

SEQ ID NO: 552320 - DNA, 25 bp, Homo sapien
tatttgtaaacctcacacagataag

SEQ ID NO: 552321 - DNA, 25 bp, Homo sapien
tttgtaaacctcacacagataagga

SEQ ID NO: 552322 - DNA, 25 bp, Homo sapien
gtaaacctcacacagataaggacca

SEQ ID NO: 552323 - DNA, 25 bp, Homo sapien
aaacctcacacagataaggaccaag

SEQ ID NO: 552324 - DNA, 25 bp, Homo sapien
ctcacacagataaggaccaagggct

SEQ ID NO: 552325 - DNA, 25 bp, Homo sapien
tcacacagataaggaccaagggctg

SEQ ID NO: 552326 - DNA, 25 bp, Homo sapien
cttctaatatttcagtgactgttag

SEQ ID NO: 552327 - DNA, 25 bp, Homo sapien
gccaggttcctcctcgggttccatt

SEQ ID NO: 552328 - DNA, 25 bp, Homo sapien
tcctgggacaatccactggtctggg

SEQ ID NO: 552329 - DNA, 25 bp, Homo sapien
aatccactggtctgggtaccggctg

SEQ ID NO: 552330 - DNA, 25 bp, Homo sapien
ggtaccggctgctactcaccagcag

SEQ ID NO: 552331 - DNA, 25 bp, Homo sapien
tgctcgctccggaagcacaggcacg

SEQ ID NO: 552332 - DNA, 25 bp, Homo sapien
tcttgaagccctcgcggtcgtaggt

SEQ ID NO: 552333 - DNA, 25 bp, Homo sapien
tatgttctgtgctttcggtcttggt

SEQ ID NO: 552334 - DNA, 25 bp, Homo sapien
tcaaatatgcccagaagtctgccta

SEQ ID NO: 552335 - DNA, 25 bp, Homo sapien
agaagtctgcctagttttcctttga

SEQ ID NO: 552336 - DNA, 25 bp, Homo sapien
tgcctagttttcctttgactccagc

SEQ ID NO: 552337 - DNA, 25 bp, Homo sapien
gattcagtaatgtagaccagaccac

SEQ ID NO: 552338 - DNA, 25 bp, Homo sapien
taatgtagaccagaccacacaccag

SEQ ID NO: 552339 - DNA, 25 bp, Homo sapien
agcacctgtgagtctcatctcagat

SEQ ID NO: 552340 - DNA, 25 bp, Homo sapien
gagtctcatctcagatcacagctct

SEQ ID NO: 552341 - DNA, 25 bp, Homo sapien
acagctctcagcatagggcttcatg

SEQ ID NO: 552342 - DNA, 25 bp, Homo sapien
agcatagggcttcatgcatcaccgc

SEQ ID NO: 552343 - DNA, 25 bp, Homo sapien
atcaccgcctctacagaggctaagg

SEQ ID NO: 552344 - DNA, 25 bp, Homo sapien
gaggctaaggctgccagtcaaattt

SEQ ID NO: 552345 - DNA, 25 bp, Homo sapien
ggaattatagcgtagtactgggaca

SEQ ID NO: 552346 - DNA, 25 bp, Homo sapien
caaaatctcaaatcttggatgttcc

SEQ ID NO: 552347 - DNA, 25 bp, Homo sapien
atgggagccatgagtaaatagttaa

SEQ ID NO: 552348 - DNA, 25 bp, Homo sapien
aaaaaaggtccgtgccaagctgctc

SEQ ID NO: 552349 - DNA, 25 bp, Homo sapien
aaaaaggtccgtgccaagctgctcc

SEQ ID NO: 552350 - DNA, 25 bp, Homo sapien
aaggtccgtgccaagctgctccctg

SEQ ID NO: 552351 - DNA, 25 bp, Homo sapien
gggtccaaaccacatgtgtcctgcc

SEQ ID NO: 552352 - DNA, 25 bp, Homo sapien
ggtccaaaccacatgtgtcctgcct

SEQ ID NO: 552353 - DNA, 25 bp, Homo sapien
tccaaaccacatgtgtcctgcctct

SEQ ID NO: 552354 - DNA, 25 bp, Homo sapien
aaaccacatgtgtcctgcctctcct

SEQ ID NO: 552355 - DNA, 25 bp, Homo sapien
gccaggtatagtggcaggaacctgt

SEQ ID NO: 552356 - DNA, 25 bp, Homo sapien
tggccctaccacattctggtgctgt

SEQ ID NO: 552357 - DNA, 25 bp, Homo sapien
ggccctaccacattctggtgctgtc

SEQ ID NO: 552358 - DNA, 25 bp, Homo sapien
accacattctggtgctgtcctcact

SEQ ID NO: 552359 - DNA, 25 bp, Homo sapien
ctctctcattgcttgtatgacttca

SEQ ID NO: 552360 - DNA, 25 bp, Homo sapien
gacttcacaagcaactcaggatcat

SEQ ID NO: 552361 - DNA, 25 bp, Homo sapien
aggatcattctagcaggctttccca

SEQ ID NO: 552362 - DNA, 25 bp, Homo sapien
aggctttcccactgtcaaacagaga

SEQ ID NO: 552363 - DNA, 25 bp, Homo sapien
actgtcaaacagagacttcattcta

SEQ ID NO: 552364 - DNA, 25 bp, Homo sapien
agctccagctctgctagctctatat

SEQ ID NO: 552365 - DNA, 25 bp, Homo sapien
ctgctagctctatatatttactgat

SEQ ID NO: 552366 - DNA, 25 bp, Homo sapien
tggaaagcactgaccaaggagactt

SEQ ID NO: 552367 - DNA, 25 bp, Homo sapien
caaggagacttttaagccagtggtt

SEQ ID NO: 552368 - DNA, 25 bp, Homo sapien
gccagtggttcttcagaatcaccta

SEQ ID NO: 552369 - DNA, 25 bp, Homo sapien
ttcagaatcacctagatgcctccac

SEQ ID NO: 552370 - DNA, 25 bp, Homo sapien
cagtgggccgcaccaaccacctcag

SEQ ID NO: 552371 - DNA, 25 bp, Homo sapien
accttcctgaagaatatccggcagt

SEQ ID NO: 552372 - DNA, 25 bp, Homo sapien
agcctgcctcgattcgcccctgtgg

SEQ ID NO: 552373 - DNA, 25 bp, Homo sapien
ccttcctgaagaatatccggcagtt

SEQ ID NO: 552374 - DNA, 25 bp, Homo sapien
cttcctgaagaatatccggcagttt

SEQ ID NO: 552375 - DNA, 25 bp, Homo sapien
tgtggtcaccactcctgttaaggcc

SEQ ID NO: 552376 - DNA, 25 bp, Homo sapien
gtggtcaccactcctgttaaggccg

SEQ ID NO: 552377 - DNA, 25 bp, Homo sapien
ttcctgaagaatatccggcagttta

SEQ ID NO: 552378 - DNA, 25 bp, Homo sapien
cctgaagaatatccggcagtttatt

SEQ ID NO: 552379 - DNA, 25 bp, Homo sapien
aagaatatccggcagtttattatgc

SEQ ID NO: 552380 - DNA, 25 bp, Homo sapien
ctcctgccgatgactctccagctga

SEQ ID NO: 552381 - DNA, 25 bp, Homo sapien
actaagcatggtgaggacatggccc

SEQ ID NO: 552382 - DNA, 25 bp, Homo sapien
gtctgcacagagcaaacacagcatt

SEQ ID NO: 552383 - DNA, 25 bp, Homo sapien
gcaaacacagcattatctacacagg

SEQ ID NO: 552384 - DNA, 25 bp, Homo sapien
aacacagcattatctacacaggaat

SEQ ID NO: 552385 - DNA, 25 bp, Homo sapien
tacacaggaatgtagattctttgtc

SEQ ID NO: 552386 - DNA, 25 bp, Homo sapien
gtctccagcaaagaattcaacccaa

SEQ ID NO: 552387 - DNA, 25 bp, Homo sapien
aaactgatttcctctgtttggcttg

SEQ ID NO: 552388 - DNA, 25 bp, Homo sapien
tttcctctgtttggcttggttgata

SEQ ID NO: 552389 - DNA, 25 bp, Homo sapien
ctctgtttggcttggttgatagcgt

SEQ ID NO: 552390 - DNA, 25 bp, Homo sapien
cctgccagctgagcgcatgactaag

SEQ ID NO: 552391 - DNA, 25 bp, Homo sapien
agctgagcgcatgactaagcatggt

SEQ ID NO: 552392 - DNA, 25 bp, Homo sapien
gatgttgccagattacggtggacaa

SEQ ID NO: 552393 - DNA, 25 bp, Homo sapien
aaaaacaactctccaacagcaactc

SEQ ID NO: 552394 - DNA, 25 bp, Homo sapien
actctccaacagcaactcacaaatg

SEQ ID NO: 552395 - DNA, 25 bp, Homo sapien
gcatgaaatgttttaacctctagac

SEQ ID NO: 552396 - DNA, 25 bp, Homo sapien
tttaacctctagacagactgccaga

SEQ ID NO: 552397 - DNA, 25 bp, Homo sapien
gtaccttgaaacaactgcagttcta

SEQ ID NO: 552398 - DNA, 25 bp, Homo sapien
gcagttctaactcattgtcaccatt

SEQ ID NO: 552399 - DNA, 25 bp, Homo sapien
actcattgtcaccatttctgtttga

SEQ ID NO: 552400 - DNA, 25 bp, Homo sapien
accatttctgtttgacacgttccac

SEQ ID NO: 552401 - DNA, 25 bp, Homo sapien
gttccacttcctttgcaattattgt

SEQ ID NO: 552402 - DNA, 25 bp, Homo sapien
ttgtatttagttgtgcactagtgtc

SEQ ID NO: 552403 - DNA, 25 bp, Homo sapien
gtgttgacttgaattgctgtccctc

SEQ ID NO: 552404 - DNA, 25 bp, Homo sapien
aagcctttcctgtgaatgaacccga

SEQ ID NO: 552405 - DNA, 25 bp, Homo sapien
gaacccgaaaacactcgacaggtcg

SEQ ID NO: 552406 - DNA, 25 bp, Homo sapien
gacaggtcgtgaataatcgttttaa

SEQ ID NO: 552407 - DNA, 25 bp, Homo sapien
gagcatcggatgaacgggacttata

SEQ ID NO: 552408 - DNA, 25 bp, Homo sapien
ggtgcaccgagctgtcgggttaaac

SEQ ID NO: 552409 - DNA, 25 bp, Homo sapien
caaacaacttgtaccctgaccaaat

SEQ ID NO: 552410 - DNA, 25 bp, Homo sapien
gtaccctgaccaaatccgattgtta

SEQ ID NO: 552411 - DNA, 25 bp, Homo sapien
acttatagctaaggcgtactcccca

SEQ ID NO: 552412 - DNA, 25 bp, Homo sapien
ttggtctttttacgcacgcagcaac

SEQ ID NO: 552413 - DNA, 25 bp, Homo sapien
gcaactcgtcctcacgtgcataggg

SEQ ID NO: 552414 - DNA, 25 bp, Homo sapien
acgggtctggtgtctcctggcaaga

SEQ ID NO: 552415 - DNA, 25 bp, Homo sapien
ctggtgtctcctggcaagatactca

SEQ ID NO: 552416 - DNA, 25 bp, Homo sapien
aagatactcaggctcccttttgttg

SEQ ID NO: 552417 - DNA, 25 bp, Homo sapien
tcccttttgttgtaggagctcctgg

SEQ ID NO: 552418 - DNA, 25 bp, Homo sapien
actgaaaagggcatcctgttgcaaa

SEQ ID NO: 552419 - DNA, 25 bp, Homo sapien
aggcaaaaagcctgcttggccctca

SEQ ID NO: 552420 - DNA, 25 bp, Homo sapien
aaggatggaccttaggcctctatcc

SEQ ID NO: 552421 - DNA, 25 bp, Homo sapien
ggcctctatccctgaccttgcaaaa

SEQ ID NO: 552422 - DNA, 25 bp, Homo sapien
ttgcaaaaacccacattgcccagtt

SEQ ID NO: 552423 - DNA, 25 bp, Homo sapien
acattgcccagttggcttaagggac

SEQ ID NO: 552424 - DNA, 25 bp, Homo sapien
agggaagctatagacaggccttggc

SEQ ID NO: 552425 - DNA, 25 bp, Homo sapien
catgcagtaatgattaacttgtgtc

SEQ ID NO: 552426 - DNA, 25 bp, Homo sapien
gattaacttgtgtcaatgatggtaa

SEQ ID NO: 552427 - DNA, 25 bp, Homo sapien
gatggtaatgagaccaaacttgtac

SEQ ID NO: 552428 - DNA, 25 bp, Homo sapien
gttactagactataccttggccttt

SEQ ID NO: 552429 - DNA, 25 bp, Homo sapien
gagaacaggcattattaggatagca

SEQ ID NO: 552430 - DNA, 25 bp, Homo sapien
taggatagcattccaccacaactag

SEQ ID NO: 552431 - DNA, 25 bp, Homo sapien
gatagcattccaccacaactagaaa

SEQ ID NO: 552432 - DNA, 25 bp, Homo sapien
aatgtgtcttaattgtaatctgtat

SEQ ID NO: 552433 - DNA, 25 bp, Homo sapien
ttttcctatggatatttttggtgtt

SEQ ID NO: 552434 - DNA, 25 bp, Homo sapien
ggtgttttaccacagtgaactgatt

SEQ ID NO: 552435 - DNA, 25 bp, Homo sapien
cagtgaactgatttgtagcacttat

SEQ ID NO: 552436 - DNA, 25 bp, Homo sapien
ttgatcatgattgtgcttggctgga

SEQ ID NO: 552437 - DNA, 25 bp, Homo sapien
tgtgtgttacatgggcacgtttcca

SEQ ID NO: 552438 - DNA, 25 bp, Homo sapien
acgtttccagagttgatgcctccaa

SEQ ID NO: 552439 - DNA, 25 bp, Homo sapien
ttgatgcctccaactctgaagtggc

SEQ ID NO: 552440 - DNA, 25 bp, Homo sapien
aacacaactgaggaggcgggcttta

SEQ ID NO: 552441 - DNA, 25 bp, Homo sapien
tcgaacagacatgcgagacctctac

SEQ ID NO: 552442 - DNA, 25 bp, Homo sapien
ctttaggtgaagatctgctgcagaa

SEQ ID NO: 552443 - DNA, 25 bp, Homo sapien
atgcgagacctctaccaactgaagg

SEQ ID NO: 552444 - DNA, 25 bp, Homo sapien
caactgaaggtttcgtgagcgcact

SEQ ID NO: 552445 - DNA, 25 bp, Homo sapien
cgtgagcgcactcctttgccaagat

SEQ ID NO: 552446 - DNA, 25 bp, Homo sapien
gaatagtctttcactgtgcaatttt

SEQ ID NO: 552447 - DNA, 25 bp, Homo sapien
aaaaaaggtccgtgccaagctgctc

SEQ ID NO: 552448 - DNA, 25 bp, Homo sapien
aaaaaggtccgtgccaagctgctcc

SEQ ID NO: 552449 - DNA, 25 bp, Homo sapien
tttccctggggtccaaaccacatgt

SEQ ID NO: 552450 - DNA, 25 bp, Homo sapien
gggtccaaaccacatgtgtcctgcc

SEQ ID NO: 552451 - DNA, 25 bp, Homo sapien
ggtccaaaccacatgtgtcctgcct

SEQ ID NO: 552452 - DNA, 25 bp, Homo sapien
gtccaaaccacatgtgtcctgcctc

SEQ ID NO: 552453 - DNA, 25 bp, Homo sapien
tccaaaccacatgtgtcctgcctct

SEQ ID NO: 552454 - DNA, 25 bp, Homo sapien
aaaccacatgtgtcctgcctctcct

SEQ ID NO: 552455 - DNA, 25 bp, Homo sapien
ctggccctaccacattctggtgctg

SEQ ID NO: 552456 - DNA, 25 bp, Homo sapien
tggccctaccacattctggtgctgt

SEQ ID NO: 552457 - DNA, 25 bp, Homo sapien
ggccctaccacattctggtgctgtc

SEQ ID NO: 552458 - DNA, 25 bp, Homo sapien
gaaaagggtcttacgtagtcattat

SEQ ID NO: 552459 - DNA, 25 bp, Homo sapien
gggtcttacgtagtcattatgattc

SEQ ID NO: 552460 - DNA, 25 bp, Homo sapien
gtcattatgattcatggaattctat

SEQ ID NO: 552461 - DNA, 25 bp, Homo sapien
ggaattctattccatgaagccttaa

SEQ ID NO: 552462 - DNA, 25 bp, Homo sapien
tttccctgaaactttatcatttgat

SEQ ID NO: 552463 - DNA, 25 bp, Homo sapien
cataaggcataaatttcagctgtaa

SEQ ID NO: 552464 - DNA, 25 bp, Homo sapien
aaagctacattcaatctgactctgg

SEQ ID NO: 552465 - DNA, 25 bp, Homo sapien
gctacattcaatctgactctggttt

SEQ ID NO: 552466 - DNA, 25 bp, Homo sapien
aaaactgctgtcataattatacatg

SEQ ID NO: 552467 - DNA, 25 bp, Homo sapien
gatactgcaacttttggaaggctaa

SEQ ID NO: 552468 - DNA, 25 bp, Homo sapien
gcaacttttggaaggctaatttggt

SEQ ID NO: 552469 - DNA, 25 bp, Homo sapien
cctgctctctggaggtactgagaca

SEQ ID NO: 552470 - DNA, 25 bp, Homo sapien
ctgctctctggaggtactgagacag

SEQ ID NO: 552471 - DNA, 25 bp, Homo sapien
tgctctctggaggtactgagacagg

SEQ ID NO: 552472 - DNA, 25 bp, Homo sapien
ctctctggaggtactgagacagggt

SEQ ID NO: 552473 - DNA, 25 bp, Homo sapien
ctctggaggtactgagacagggtgc

SEQ ID NO: 552474 - DNA, 25 bp, Homo sapien
tctggaggtactgagacagggtgct

SEQ ID NO: 552475 - DNA, 25 bp, Homo sapien
ctggaggtactgagacagggtgctg

SEQ ID NO: 552476 - DNA, 25 bp, Homo sapien
ggaggtactgagacagggtgctgat

SEQ ID NO: 552477 - DNA, 25 bp, Homo sapien
gaggtactgagacagggtgctgatg

SEQ ID NO: 552478 - DNA, 25 bp, Homo sapien
ggtactgagacagggtgctgatggg

SEQ ID NO: 552479 - DNA, 25 bp, Homo sapien
gccacccggggcctggacctatgca

SEQ ID NO: 552480 - DNA, 25 bp, Homo sapien
tcaacatccctctgccgtcgggtga

SEQ ID NO: 552481 - DNA, 25 bp, Homo sapien
caacatccctctgccgtcgggtgac

SEQ ID NO: 552482 - DNA, 25 bp, Homo sapien
aacatccctctgccgtcgggtgacc

SEQ ID NO: 552483 - DNA, 25 bp, Homo sapien
tctgccgtcgggtgaccccctagcc

SEQ ID NO: 552484 - DNA, 25 bp, Homo sapien
ctccagtccatgctcttctggacgt

SEQ ID NO: 552485 - DNA, 25 bp, Homo sapien
tccagtccatgctcttctggacgtg

SEQ ID NO: 552486 - DNA, 25 bp, Homo sapien
ccagtccatgctcttctggacgtgg

SEQ ID NO: 552487 - DNA, 25 bp, Homo sapien
cagtccatgctcttctggacgtgga

SEQ ID NO: 552488 - DNA, 25 bp, Homo sapien
agtccatgctcttctggacgtggac

SEQ ID NO: 552489 - DNA, 25 bp, Homo sapien
gtccatgctcttctggacgtggact

SEQ ID NO: 552490 - DNA, 25 bp, Homo sapien
tccatgctcttctggacgtggactc

SEQ ID NO: 552491 - DNA, 25 bp, Homo sapien
gaacctattctggtagaatcagact

SEQ ID NO: 552492 - DNA, 25 bp, Homo sapien
attctggtagaatcagactcatcct

SEQ ID NO: 552493 - DNA, 25 bp, Homo sapien
agactcatcctctggtggggaacta

SEQ ID NO: 552494 - DNA, 25 bp, Homo sapien
agtgatagatgattcttaccgagaa

SEQ ID NO: 552495 - DNA, 25 bp, Homo sapien
aagagaagcgacactccaagtccaa

SEQ ID NO: 552496 - DNA, 25 bp, Homo sapien
agaagcgacactccaagtccaagag

SEQ ID NO: 552497 - DNA, 25 bp, Homo sapien
ttaggactttctgccgtgccagtgg

SEQ ID NO: 552498 - DNA, 25 bp, Homo sapien
actttctgccgtgccagtgggagag

SEQ ID NO: 552499 - DNA, 25 bp, Homo sapien
ccagtgggagaggtcacagtgacat

SEQ ID NO: 552500 - DNA, 25 bp, Homo sapien
gaggtcacagtgacatctggccctc

SEQ ID NO: 552501 - DNA, 25 bp, Homo sapien
cagcatcccatacgctggagcagca

SEQ ID NO: 552502 - DNA, 25 bp, Homo sapien
ggctgcgtctccaggtacagggccc

SEQ ID NO: 552503 - DNA, 25 bp, Homo sapien
tgcgtctccaggtacagggccctgc

SEQ ID NO: 552504 - DNA, 25 bp, Homo sapien
tctccaggtacagggccctgccagt

SEQ ID NO: 552505 - DNA, 25 bp, Homo sapien
gtcccatgctggctacttgcagcac

SEQ ID NO: 552506 - DNA, 25 bp, Homo sapien
atgctggctacttgcagcacccctc

SEQ ID NO: 552507 - DNA, 25 bp, Homo sapien
gagcatcatgtgagtgggcctcgtt

SEQ ID NO: 552508 - DNA, 25 bp, Homo sapien
agcatcatgtgagtgggcctcgttc

SEQ ID NO: 552509 - DNA, 25 bp, Homo sapien
gcatcatgtgagtgggcctcgttcc

SEQ ID NO: 552510 - DNA, 25 bp, Homo sapien
catcatgtgagtgggcctcgttccc

SEQ ID NO: 552511 - DNA, 25 bp, Homo sapien
ccagcggggcctcagagatgcatct

SEQ ID NO: 552512 - DNA, 25 bp, Homo sapien
cctcagagatgcatctgggagaggt

SEQ ID NO: 552513 - DNA, 25 bp, Homo sapien
tcaagtgttacaactggatatgtgt

SEQ ID NO: 552514 - DNA, 25 bp, Homo sapien
gttgttgcaatttagcttgctttca

SEQ ID NO: 552515 - DNA, 25 bp, Homo sapien
ttgctttcaagcttcaccccttgca

SEQ ID NO: 552516 - DNA, 25 bp, Homo sapien
ttcaccccttgcacttaacataagc

SEQ ID NO: 552517 - DNA, 25 bp, Homo sapien
ccccttgcacttaacataagctatt

SEQ ID NO: 552518 - DNA, 25 bp, Homo sapien
agctatttttggcattgtgttatca

SEQ ID NO: 552519 - DNA, 25 bp, Homo sapien
tttggcattgtgttatcatcggctt

SEQ ID NO: 552520 - DNA, 25 bp, Homo sapien
ggcattgtgttatcatcggcttatt

SEQ ID NO: 552521 - DNA, 25 bp, Homo sapien
ttgtgttatcatcggcttattttat

SEQ ID NO: 552522 - DNA, 25 bp, Homo sapien
atcatcggcttattttatagatcaa

SEQ ID NO: 552523 - DNA, 25 bp, Homo sapien
tcccttttttgctgaggaaatgaag

SEQ ID NO: 552524 - DNA, 25 bp, Homo sapien
cagacaccaagctgggcctgcagag

SEQ ID NO: 552525 - DNA, 25 bp, Homo sapien
gggcacagtaggacacagtgactgc

SEQ ID NO: 552526 - DNA, 25 bp, Homo sapien
gacacagtgactgcccaggtgtcca

SEQ ID NO: 552527 - DNA, 25 bp, Homo sapien
acagtgactgcccaggtgtccacac

SEQ ID NO: 552528 - DNA, 25 bp, Homo sapien
cagtgactgcccaggtgtccacaca

SEQ ID NO: 552529 - DNA, 25 bp, Homo sapien
acctgtaggcctctgagccagcgtc

SEQ ID NO: 552530 - DNA, 25 bp, Homo sapien
gagaagcaggtttggagaggaccct

SEQ ID NO: 552531 - DNA, 25 bp, Homo sapien
aggtttggagaggaccctgtgccca

SEQ ID NO: 552532 - DNA, 25 bp, Homo sapien
gtttggagaggaccctgtgcccacc

SEQ ID NO: 552533 - DNA, 25 bp, Homo sapien
ccaccctgacagacaccctggctgg

SEQ ID NO: 552534 - DNA, 25 bp, Homo sapien
catccttggctccagagctcgaaga

SEQ ID NO: 552535 - DNA, 25 bp, Homo sapien
ttattgtcatgtgttgcttgccttg

SEQ ID NO: 552536 - DNA, 25 bp, Homo sapien
gcttgccttgtatagttgacttcat

SEQ ID NO: 552537 - DNA, 25 bp, Homo sapien
tcattgtctggataactatacaacc

SEQ ID NO: 552538 - DNA, 25 bp, Homo sapien
ctatacaacctgaaaactgtcattt

SEQ ID NO: 552539 - DNA, 25 bp, Homo sapien
atttcaggttctgtgctctttttgg

SEQ ID NO: 552540 - DNA, 25 bp, Homo sapien
ctttttggagtctttaagctcagta

SEQ ID NO: 552541 - DNA, 25 bp, Homo sapien
gtctttaagctcagtattagtctat

SEQ ID NO: 552542 - DNA, 25 bp, Homo sapien
gtctattgcagctatctcgttttca

SEQ ID NO: 552543 - DNA, 25 bp, Homo sapien
gcagctatctcgttttcatgctaaa

SEQ ID NO: 552544 - DNA, 25 bp, Homo sapien
atagtttttgttatcttgtctctta

SEQ ID NO: 552545 - DNA, 25 bp, Homo sapien
gttatcttgtctcttatttttgaca

SEQ ID NO: 552546 - DNA, 25 bp, Homo sapien
cctgttccggtatccatgaggacat

SEQ ID NO: 552547 - DNA, 25 bp, Homo sapien
catgaggacataatttacctttcag

SEQ ID NO: 552548 - DNA, 25 bp, Homo sapien
tttacctttcagtcaccacaaattt

SEQ ID NO: 552549 - DNA, 25 bp, Homo sapien
cagtcaccacaaatttataggcatt

SEQ ID NO: 552550 - DNA, 25 bp, Homo sapien
taggcatttgtatcctggactaaaa

SEQ ID NO: 552551 - DNA, 25 bp, Homo sapien
tgaggttgggtttgtcatcacagag

SEQ ID NO: 552552 - DNA, 25 bp, Homo sapien
taactatatagaagctgttccagca

SEQ ID NO: 552553 - DNA, 25 bp, Homo sapien
agctgttccagcaaccatagactga

SEQ ID NO: 552554 - DNA, 25 bp, Homo sapien
gcaaccatagactgaagatacgaaa

SEQ ID NO: 552555 - DNA, 25 bp, Homo sapien
atccatttatttaagacctgttccg

SEQ ID NO: 552556 - DNA, 25 bp, Homo sapien
ttaagacctgttccggtatccatga

SEQ ID NO: 552557 - DNA, 25 bp, Homo sapien
cagacaccaagctgggcctgcagag

SEQ ID NO: 552558 - DNA, 25 bp, Homo sapien
gggcacagtaggacacagtgactgc

SEQ ID NO: 552559 - DNA, 25 bp, Homo sapien
gtgactgcccaggtgtccacacacc

SEQ ID NO: 552560 - DNA, 25 bp, Homo sapien
tgactgcccaggtgtccacacacct

SEQ ID NO: 552561 - DNA, 25 bp, Homo sapien
gactgcccaggtgtccacacacctg

SEQ ID NO: 552562 - DNA, 25 bp, Homo sapien
actgcccaggtgtccacacacctgt

SEQ ID NO: 552563 - DNA, 25 bp, Homo sapien
ggtggtggggatgaaggcctgacca

SEQ ID NO: 552564 - DNA, 25 bp, Homo sapien
gagaagcaggtttggagaggaccct

SEQ ID NO: 552565 - DNA, 25 bp, Homo sapien
agaagcaggtttggagaggaccctg

SEQ ID NO: 552566 - DNA, 25 bp, Homo sapien
ttgggacttgagtgtagaagaaaca

SEQ ID NO: 552567 - DNA, 25 bp, Homo sapien
tcaaaaaacaggaagttggaactat

SEQ ID NO: 552568 - DNA, 25 bp, Homo sapien
gtattgtttttacggattttacatg

SEQ ID NO: 552569 - DNA, 25 bp, Homo sapien
tacggattttacatgtatagttaaa

SEQ ID NO: 552570 - DNA, 25 bp, Homo sapien
aatattaaaattcatctcttgcagt

SEQ ID NO: 552571 - DNA, 25 bp, Homo sapien
tcatctcttgcagttcaataaaagc

SEQ ID NO: 552572 - DNA, 25 bp, Homo sapien
atctcttgcagttcaataaaagcta

SEQ ID NO: 552573 - DNA, 25 bp, Homo sapien
gcagttcaataaaagctatagtata

SEQ ID NO: 552574 - DNA, 25 bp, Homo sapien
ttatataattcttttgtgaaccaat

SEQ ID NO: 552575 - DNA, 25 bp, Homo sapien
aattcttttgtgaaccaatatgtaa

SEQ ID NO: 552576 - DNA, 25 bp, Homo sapien
gtgaaccaatatgtaaaactagaat

SEQ ID NO: 552577 - DNA, 25 bp, Homo sapien
gcataatgcaacaacacagttttca

SEQ ID NO: 552578 - DNA, 25 bp, Homo sapien
cctggaacccagtctagcaaaatga

SEQ ID NO: 552579 - DNA, 25 bp, Homo sapien
aaggccctagggagatttatttctg

SEQ ID NO: 552580 - DNA, 25 bp, Homo sapien
gttaaatagttaactctgctgagta

SEQ ID NO: 552581 - DNA, 25 bp, Homo sapien
ctctgctgagtatgacaaatagtgt

SEQ ID NO: 552582 - DNA, 25 bp, Homo sapien
aatagtgtctactatctcaaccctc

SEQ ID NO: 552583 - DNA, 25 bp, Homo sapien
ctactatctcaaccctccaaaattt

SEQ ID NO: 552584 - DNA, 25 bp, Homo sapien
aaccctccaaaatttgcagagtgtt

SEQ ID NO: 552585 - DNA, 25 bp, Homo sapien
gcagagtgttgggactgtcatttgt

SEQ ID NO: 552586 - DNA, 25 bp, Homo sapien
gttgaataaaattgggcagctaaat

SEQ ID NO: 552587 - DNA, 25 bp, Homo sapien
gttccatgtgcctcccaaataaaaa

SEQ ID NO: 552588 - DNA, 25 bp, Homo sapien
aattcagcactgtgacttgaacccc

SEQ ID NO: 552589 - DNA, 25 bp, Homo sapien
acttgaacccccaaatctttcacat

SEQ ID NO: 552590 - DNA, 25 bp, Homo sapien
tacaggtgaaacattaagccacaaa

SEQ ID NO: 552591 - DNA, 25 bp, Homo sapien
aagaagacaagatcctaattcctgt

SEQ ID NO: 552592 - DNA, 25 bp, Homo sapien
caagatcctaattcctgtcattagt

SEQ ID NO: 552593 - DNA, 25 bp, Homo sapien
gtcattagtgacctaagtaccccat

SEQ ID NO: 552594 - DNA, 25 bp, Homo sapien
gtgacctaagtaccccatatcagaa

SEQ ID NO: 552595 - DNA, 25 bp, Homo sapien
gtaccccatatcagaaactttgcaa

SEQ ID NO: 552596 - DNA, 25 bp, Homo sapien
aactttgcaaaacagatctagggac

SEQ ID NO: 552597 - DNA, 25 bp, Homo sapien
gaagggctttgaaagacatttttct

SEQ ID NO: 552598 - DNA, 25 bp, Homo sapien
tttcgtgtgccagaactacagttta

SEQ ID NO: 552599 - DNA, 25 bp, Homo sapien
ggtgcagacacttcctgggcagtcc

SEQ ID NO: 552600 - DNA, 25 bp, Homo sapien
gcagacacttcctgggcagtcccag

SEQ ID NO: 552601 - DNA, 25 bp, Homo sapien
accgttggctgccatccagttggta

SEQ ID NO: 552602 - DNA, 25 bp, Homo sapien
tggctgccatccagttggtacccaa

SEQ ID NO: 552603 - DNA, 25 bp, Homo sapien
ccagttggtacccaagcacctgaag

SEQ ID NO: 552604 - DNA, 25 bp, Homo sapien
gcacctgaagcctcaaagctggatt

SEQ ID NO: 552605 - DNA, 25 bp, Homo sapien
tgaagcctcaaagctggattcgctc

SEQ ID NO: 552606 - DNA, 25 bp, Homo sapien
gaaaaccaccccacactgggaatag

SEQ ID NO: 552607 - DNA, 25 bp, Homo sapien
tgggaatagccaccttgcccttgta

SEQ ID NO: 552608 - DNA, 25 bp, Homo sapien
gaatagccaccttgcccttgtagaa

SEQ ID NO: 552609 - DNA, 25 bp, Homo sapien
ttgtagaatccatccgcccatccgt

SEQ ID NO: 552610 - DNA, 25 bp, Homo sapien
cccctgttttgtgtgccagtatttt

SEQ ID NO: 552611 - DNA, 25 bp, Homo sapien
gtttactttggatttctggatgtta

SEQ ID NO: 552612 - DNA, 25 bp, Homo sapien
aaaagccacgaaaaccctggccatg

SEQ ID NO: 552613 - DNA, 25 bp, Homo sapien
aaaaccctggccatgctgtttgtca

SEQ ID NO: 552614 - DNA, 25 bp, Homo sapien
catgctgtttgtcaggcccacctgg

SEQ ID NO: 552615 - DNA, 25 bp, Homo sapien
gctgagtgcaggaagcaagcgcttt

SEQ ID NO: 552616 - DNA, 25 bp, Homo sapien
agcaagcgcttttcaggagctcact

SEQ ID NO: 552617 - DNA, 25 bp, Homo sapien
ggagctcactgcaacaccgggcaaa

SEQ ID NO: 552618 - DNA, 25 bp, Homo sapien
gcaaacacttcttccgccagggatg

SEQ ID NO: 552619 - DNA, 25 bp, Homo sapien
ggatgcggttaggacaatgccacgt

SEQ ID NO: 552620 - DNA, 25 bp, Homo sapien
atgccacgtggcgtcacagtatgct

SEQ ID NO: 552621 - DNA, 25 bp, Homo sapien
actttcaagatggaaagtccgtcag

SEQ ID NO: 552622 - DNA, 25 bp, Homo sapien
ctcagctgtggttttacctagcact

SEQ ID NO: 552623 - DNA, 25 bp, Homo sapien
tcagctgtggttttacctagcactc

SEQ ID NO: 552624 - DNA, 25 bp, Homo sapien
cagctgtggttttacctagcactcc

SEQ ID NO: 552625 - DNA, 25 bp, Homo sapien
agctgtggttttacctagcactcct

SEQ ID NO: 552626 - DNA, 25 bp, Homo sapien
gctgtggttttacctagcactcctc

SEQ ID NO: 552627 - DNA, 25 bp, Homo sapien
ctgtggttttacctagcactcctca

SEQ ID NO: 552628 - DNA, 25 bp, Homo sapien
tgtggttttacctagcactcctcag

SEQ ID NO: 552629 - DNA, 25 bp, Homo sapien
gtggttttacctagcactcctcagg

SEQ ID NO: 552630 - DNA, 25 bp, Homo sapien
tggttttacctagcactcctcaggc

SEQ ID NO: 552631 - DNA, 25 bp, Homo sapien
gttttacctagcactcctcaggcct

SEQ ID NO: 552632 - DNA, 25 bp, Homo sapien
gatgcctatcacaacaaacccattg

SEQ ID NO: 552633 - DNA, 25 bp, Homo sapien
tgcctatcacaacaaacccattggg

SEQ ID NO: 552634 - DNA, 25 bp, Homo sapien
tccaaagaagatagcaactccacgg

SEQ ID NO: 552635 - DNA, 25 bp, Homo sapien
aagaagatagcaactccacggagag

SEQ ID NO: 552636 - DNA, 25 bp, Homo sapien
gatagcaactccacggagagcaaat

SEQ ID NO: 552637 - DNA, 25 bp, Homo sapien
ctccacggagagcaaatcaagcagt

SEQ ID NO: 552638 - DNA, 25 bp, Homo sapien
acggagagcaaatcaagcagtgagg

SEQ ID NO: 552639 - DNA, 25 bp, Homo sapien
agtgaggaagatggccagttgaaaa

SEQ ID NO: 552640 - DNA, 25 bp, Homo sapien
aaaacattgagatagagagccggaa

SEQ ID NO: 552641 - DNA, 25 bp, Homo sapien
gagagccggaaattaacagttgatg

SEQ ID NO: 552642 - DNA, 25 bp, Homo sapien
gaaattaacagttgatgcctatcac

SEQ ID NO: 552643 - DNA, 25 bp, Homo sapien
tttgtctcctggcagtcaactcgtc

SEQ ID NO: 552644 - DNA, 25 bp, Homo sapien
tggcagtcaactcgtctcttactga

SEQ ID NO: 552645 - DNA, 25 bp, Homo sapien
gtctcttactgacctgcccattgct

SEQ ID NO: 552646 - DNA, 25 bp, Homo sapien
attgctcccttgcaatgtattttcc

SEQ ID NO: 552647 - DNA, 25 bp, Homo sapien
aaatctgcctttcttgacctaaact

SEQ ID NO: 552648 - DNA, 25 bp, Homo sapien
gcctttcttgacctaaactgtcatg

SEQ ID NO: 552649 - DNA, 25 bp, Homo sapien
aaactgtcatggtaaattcttctta

SEQ ID NO: 552650 - DNA, 25 bp, Homo sapien
gtcgccacaagccatgacaagtctg

SEQ ID NO: 552651 - DNA, 25 bp, Homo sapien
gacaagtctgcgatttcatggtctt

SEQ ID NO: 552652 - DNA, 25 bp, Homo sapien
agtctgcgatttcatggtctttttt

SEQ ID NO: 552653 - DNA, 25 bp, Homo sapien
cacaatctataggtcttagtcacat

SEQ ID NO: 552654 - DNA, 25 bp, Homo sapien
tgagagcctcaaggcgcgcggccaa

SEQ ID NO: 552655 - DNA, 25 bp, Homo sapien
agatgcgtgcgcagcgcgtccacat

SEQ ID NO: 552656 - DNA, 25 bp, Homo sapien
agcttctcttgcagctcgtgcagct

SEQ ID NO: 552657 - DNA, 25 bp, Homo sapien
ttgcagctcgtgcagcttctggcgc

SEQ ID NO: 552658 - DNA, 25 bp, Homo sapien
tggcgcgcgccctcttggagctctg

SEQ ID NO: 552659 - DNA, 25 bp, Homo sapien
tcttggagctctgcgcgcagcggct

SEQ ID NO: 552660 - DNA, 25 bp, Homo sapien
agcggctccaccttctggcggtaga

SEQ ID NO: 552661 - DNA, 25 bp, Homo sapien
ggctccaccttctggcggtagagct

SEQ ID NO: 552662 - DNA, 25 bp, Homo sapien
gccacttcttctggaagtcgtccag

SEQ ID NO: 552663 - DNA, 25 bp, Homo sapien
ttctggaagtcgtccaggtagggct

SEQ ID NO: 552664 - DNA, 25 bp, Homo sapien
ggctgcaccttggcctccaggttat

SEQ ID NO: 552665 - DNA, 25 bp, Homo sapien
tgccaaggtggctgccaaagcccag

SEQ ID NO: 552666 - DNA, 25 bp, Homo sapien
aaggtggctgccaaagcccagctcc

SEQ ID NO: 552667 - DNA, 25 bp, Homo sapien
ggtggctgccaaagcccagctccga

SEQ ID NO: 552668 - DNA, 25 bp, Homo sapien
caaagcccagctccgagctgcagct

SEQ ID NO: 552669 - DNA, 25 bp, Homo sapien
tgggcttggtgctggcatccctgga

SEQ ID NO: 552670 - DNA, 25 bp, Homo sapien
acttggagttggtgtcggcgtccct

SEQ ID NO: 552671 - DNA, 25 bp, Homo sapien
tggtgtcggcgtccctggacttgga

SEQ ID NO: 552672 - DNA, 25 bp, Homo sapien
cctggctgccgctaaagcagccaaa

SEQ ID NO: 552673 - DNA, 25 bp, Homo sapien
tgccgctaaagcagccaaatatgga

SEQ ID NO: 552674 - DNA, 25 bp, Homo sapien
aaagcagccaaatatggagcagcag

SEQ ID NO: 552675 - DNA, 25 bp, Homo sapien
ggctctcggtggagtaggcatccca

SEQ ID NO: 552676 - DNA, 25 bp, Homo sapien
gttgtgaacacagtgcagggcacat

SEQ ID NO: 552677 - DNA, 25 bp, Homo sapien
agagctcagtcaatggtaggtttca

SEQ ID NO: 552678 - DNA, 25 bp, Homo sapien
aggtttcatgcaactgctgctctag

SEQ ID NO: 552679 - DNA, 25 bp, Homo sapien
aggctggaaaagttgttcttgcact

SEQ ID NO: 552680 - DNA, 25 bp, Homo sapien
gttgttcttgcactggatgcagcat

SEQ ID NO: 552681 - DNA, 25 bp, Homo sapien
aagctggctgctaagatgtcactgg

SEQ ID NO: 552682 - DNA, 25 bp, Homo sapien
gaagcctgaaggaaagcctctcatt

SEQ ID NO: 552683 - DNA, 25 bp, Homo sapien
agcctctcattgctgtagagctctc

SEQ ID NO: 552684 - DNA, 25 bp, Homo sapien
ggaaggtcaggagtccagcccattc

SEQ ID NO: 552685 - DNA, 25 bp, Homo sapien
gtgggatagcgattgcattttcctt

SEQ ID NO: 552686 - DNA, 25 bp, Homo sapien
gattgcattttccttttgctctgga

SEQ ID NO: 552687 - DNA, 25 bp, Homo sapien
ttcatattctaacttgtcttttcaa

SEQ ID NO: 552688 - DNA, 25 bp, Homo sapien
gagctttcactgtacaatgtgtgga

SEQ ID NO: 552689 - DNA, 25 bp, Homo sapien
ggaaaatcaccatagatcatggctg

SEQ ID NO: 552690 - DNA, 25 bp, Homo sapien
gatcatggctgaaatagtttgtaat

SEQ ID NO: 552691 - DNA, 25 bp, Homo sapien
gtaattgtctgagtctgtgcacgta

SEQ ID NO: 552692 - DNA, 25 bp, Homo sapien
gagtctgtgcacgtacttttagata

SEQ ID NO: 552693 - DNA, 25 bp, Homo sapien
gctgagtgactgcatgatgagatac

SEQ ID NO: 552694 - DNA, 25 bp, Homo sapien
gagatacaacttctgaatgctgcac

SEQ ID NO: 552695 - DNA, 25 bp, Homo sapien
aatgctgcacattcttccaaaatga

SEQ ID NO: 552696 - DNA, 25 bp, Homo sapien
attcttccaaaatgatccttagcac

SEQ ID NO: 552697 - DNA, 25 bp, Homo sapien
atgatccttagcacaatctattgta

SEQ ID NO: 552698 - DNA, 25 bp, Homo sapien
ttccctatccggagatgctgttttc

SEQ ID NO: 552699 - DNA, 25 bp, Homo sapien
ctatccggagatgctgttttcaggg

SEQ ID NO: 552700 - DNA, 25 bp, Homo sapien
gagatgctgttttcagggagtcctg

SEQ ID NO: 552701 - DNA, 25 bp, Homo sapien
cagggagtcctgacactatgatggg

SEQ ID NO: 552702 - DNA, 25 bp, Homo sapien
gagtcctgacactatgatgggaaca

SEQ ID NO: 552703 - DNA, 25 bp, Homo sapien
ctgacactatgatgggaacaaggct

SEQ ID NO: 552704 - DNA, 25 bp, Homo sapien
ggaacaaggctatttggtttactat

SEQ ID NO: 552705 - DNA, 25 bp, Homo sapien
ggctatttggtttactatatcatta

SEQ ID NO: 552706 - DNA, 25 bp, Homo sapien
ggtttactatatcattagtgctaat

SEQ ID NO: 552707 - DNA, 25 bp, Homo sapien
gcaccaagcctacccagcacatagt

SEQ ID NO: 552708 - DNA, 25 bp, Homo sapien
gatgctgggttaaagcccggcgccc

SEQ ID NO: 552709 - DNA, 25 bp, Homo sapien
taaatatgcacaggttcttggactg

SEQ ID NO: 552710 - DNA, 25 bp, Homo sapien
aaatatgcacaggttcttggactga

SEQ ID NO: 552711 - DNA, 25 bp, Homo sapien
aatatgcacaggttcttggactgat

SEQ ID NO: 552712 - DNA, 25 bp, Homo sapien
atatgcacaggttcttggactgatt

SEQ ID NO: 552713 - DNA, 25 bp, Homo sapien
tatgcacaggttcttggactgattt

SEQ ID NO: 552714 - DNA, 25 bp, Homo sapien
atgcacaggttcttggactgattta

SEQ ID NO: 552715 - DNA, 25 bp, Homo sapien
tgcacaggttcttggactgatttaa

SEQ ID NO: 552716 - DNA, 25 bp, Homo sapien
gcacaggttcttggactgatttaaa

SEQ ID NO: 552717 - DNA, 25 bp, Homo sapien
cacaggttcttggactgatttaaaa

SEQ ID NO: 552718 - DNA, 25 bp, Homo sapien
caggttcttggactgatttaaaagg

SEQ ID NO: 552719 - DNA, 25 bp, Homo sapien
gttcttggactgatttaaaaggata

SEQ ID NO: 552720 - DNA, 25 bp, Homo sapien
ttggtggtgttcttgtcttaaccct

SEQ ID NO: 552721 - DNA, 25 bp, Homo sapien
ggtgttcttgtcttaaccctagata

SEQ ID NO: 552722 - DNA, 25 bp, Homo sapien
ttgtcttaaccctagatagaatcta

SEQ ID NO: 552723 - DNA, 25 bp, Homo sapien
atagaatctaatgaactcagaggct

SEQ ID NO: 552724 - DNA, 25 bp, Homo sapien
aatgaactcagaggcttagctcgcc

SEQ ID NO: 552725 - DNA, 25 bp, Homo sapien
ttagctcgcctctttagggtccatg

SEQ ID NO: 552726 - DNA, 25 bp, Homo sapien
tctttagggtccatggtggcagcag

SEQ ID NO: 552727 - DNA, 25 bp, Homo sapien
aacagtgaaggatggttcctggccc

SEQ ID NO: 552728 - DNA, 25 bp, Homo sapien
tggcccctctgagtgacagctggtg

SEQ ID NO: 552729 - DNA, 25 bp, Homo sapien
cctctgagtgacagctggtggcagc

SEQ ID NO: 552730 - DNA, 25 bp, Homo sapien
cagctggtggcagcactccttgctg

SEQ ID NO: 552731 - DNA, 25 bp, Homo sapien
ctctgattgtgcagtgtcatgtcct

SEQ ID NO: 552732 - DNA, 25 bp, Homo sapien
cccctcgtgtttgatgttggccaat

SEQ ID NO: 552733 - DNA, 25 bp, Homo sapien
tgatgttggccaatgccgccagcat

SEQ ID NO: 552734 - DNA, 25 bp, Homo sapien
aatgccgccagcatgatctagcagg

SEQ ID NO: 552735 - DNA, 25 bp, Homo sapien
gccagcatgatctagcaggccaaat

SEQ ID NO: 552736 - DNA, 25 bp, Homo sapien
gcaggccaaatcctaatctaccatt

SEQ ID NO: 552737 - DNA, 25 bp, Homo sapien
aatcctaatctaccattctctgaca

SEQ ID NO: 552738 - DNA, 25 bp, Homo sapien
accgtgggaggcacctgtgacactg

SEQ ID NO: 552739 - DNA, 25 bp, Homo sapien
gaggcacctgtgacactgccctttt

SEQ ID NO: 552740 - DNA, 25 bp, Homo sapien
gcccttttcctgtgcagctgttttt

SEQ ID NO: 552741 - DNA, 25 bp, Homo sapien
attcttttcactcctcgttactctt

SEQ ID NO: 552742 - DNA, 25 bp, Homo sapien
cagtgagagctgaaatgagaccatt

SEQ ID NO: 552743 - DNA, 25 bp, Homo sapien
gaaatgagaccatttactttgttta

SEQ ID NO: 552744 - DNA, 25 bp, Homo sapien
aatgctgtactgtgcaagtttggaa

SEQ ID NO: 552745 - DNA, 25 bp, Homo sapien
atcttgagtttgtttatacctccaa

SEQ ID NO: 552746 - DNA, 25 bp, Homo sapien
tatacctccaagtttttacactgaa

SEQ ID NO: 552747 - DNA, 25 bp, Homo sapien
aagctgttgagctaaacctgtatac

SEQ ID NO: 552748 - DNA, 25 bp, Homo sapien
gctaaacctgtatacttgtgctttt

SEQ ID NO: 552749 - DNA, 25 bp, Homo sapien
aacctgtatacttgtgctttttatt

SEQ ID NO: 552750 - DNA, 25 bp, Homo sapien
ttttattttctggatgcacaatgaa

SEQ ID NO: 552751 - DNA, 25 bp, Homo sapien
tttatacttgtatctcactgcatca

SEQ ID NO: 552752 - DNA, 25 bp, Homo sapien
gtatctcactgcatcatatctgatt

SEQ ID NO: 552753 - DNA, 25 bp, Homo sapien
gattaaacctatacaagtctggcaa

SEQ ID NO: 552754 - DNA, 25 bp, Homo sapien
tacaagtctggcaatgagctctgca

SEQ ID NO: 552755 - DNA, 25 bp, Homo sapien
atgagctctgcatgaggaaatggaa

SEQ ID NO: 552756 - DNA, 25 bp, Homo sapien
aatgattctaggaaagtgaacgtaa

SEQ ID NO: 552757 - DNA, 25 bp, Homo sapien
ccttttctgatcatgggctctggaa

SEQ ID NO: 552758 - DNA, 25 bp, Homo sapien
gatcatgggctctggaaagtattca

SEQ ID NO: 552759 - DNA, 25 bp, Homo sapien
gaaagtattcatggcctttaccagc

SEQ ID NO: 552760 - DNA, 25 bp, Homo sapien
tttaccagcattcagtataaaccag

SEQ ID NO: 552761 - DNA, 25 bp, Homo sapien
ccagcattcagtataaaccagagat

SEQ ID NO: 552762 - DNA, 25 bp, Homo sapien
aaccagagataaggacatatgtact

SEQ ID NO: 552763 - DNA, 25 bp, Homo sapien
aggacatatgtacttacgtgtgtct

SEQ ID NO: 552764 - DNA, 25 bp, Homo sapien
acgggacgcccagtccagagctggt

SEQ ID NO: 552765 - DNA, 25 bp, Homo sapien
tccagagctggtgagccctgggcca

SEQ ID NO: 552766 - DNA, 25 bp, Homo sapien
cagagatggttggtccacagggcta

SEQ ID NO: 552767 - DNA, 25 bp, Homo sapien
gatggttggtccacagggctagccc

SEQ ID NO: 552768 - DNA, 25 bp, Homo sapien
atggttggtccacagggctagccct

SEQ ID NO: 552769 - DNA, 25 bp, Homo sapien
agggctagccctgggtggtgggaga

SEQ ID NO: 552770 - DNA, 25 bp, Homo sapien
gtcagggtgagagagagctgggcca

SEQ ID NO: 552771 - DNA, 25 bp, Homo sapien
agctgctgcaggatgattttgaggt

SEQ ID NO: 552772 - DNA, 25 bp, Homo sapien
ctgctgcaggatgattttgaggtgt

SEQ ID NO: 552773 - DNA, 25 bp, Homo sapien
ggaagcactcttggttggttttggt

SEQ ID NO: 552774 - DNA, 25 bp, Homo sapien
gaagcactcttggttggttttggtt

SEQ ID NO: 552775 - DNA, 25 bp, Homo sapien
gcagcaatactttaggatccacgtg

SEQ ID NO: 552776 - DNA, 25 bp, Homo sapien
taggatccacgtggcagaactggaa

SEQ ID NO: 552777 - DNA, 25 bp, Homo sapien
gaactggaaacaatgctaccatctg

SEQ ID NO: 552778 - DNA, 25 bp, Homo sapien
aacaatgctaccatctgataagggt

SEQ ID NO: 552779 - DNA, 25 bp, Homo sapien
ggcgtaagaggcaacagagccgtct

SEQ ID NO: 552780 - DNA, 25 bp, Homo sapien
gaggcaatattttctacttgcaatc

SEQ ID NO: 552781 - DNA, 25 bp, Homo sapien
acttgcaatcaatttgagtgactca

SEQ ID NO: 552782 - DNA, 25 bp, Homo sapien
aacagagccgtctagaagaacaaga

SEQ ID NO: 552783 - DNA, 25 bp, Homo sapien
gtgactcttggattacagcatggag

SEQ ID NO: 552784 - DNA, 25 bp, Homo sapien
attacagcatggagactatgtcagc

SEQ ID NO: 552785 - DNA, 25 bp, Homo sapien
ggagactatgtcagcagcaatactt

SEQ ID NO: 552786 - DNA, 25 bp, Homo sapien
ttttgttgttgtggagttccctctt

SEQ ID NO: 552787 - DNA, 25 bp, Homo sapien
agttccctcttgctgtatcttctat

SEQ ID NO: 552788 - DNA, 25 bp, Homo sapien
gctgtatcttctatgcaattccttt

SEQ ID NO: 552789 - DNA, 25 bp, Homo sapien
cttctatgcaattccttttctaaaa

SEQ ID NO: 552790 - DNA, 25 bp, Homo sapien
aaaaccccccggcagaggcagagtg

SEQ ID NO: 552791 - DNA, 25 bp, Homo sapien
tccggatatctgtccggcgccttgc

SEQ ID NO: 552792 - DNA, 25 bp, Homo sapien
tgagggataccagctccgggtgtgc

SEQ ID NO: 552793 - DNA, 25 bp, Homo sapien
tgccaatcctgattttccctgcagt

SEQ ID NO: 552794 - DNA, 25 bp, Homo sapien
tttccctgcagtccccttggtttgt

SEQ ID NO: 552795 - DNA, 25 bp, Homo sapien
gtaaattgcctgcatttattctgtc

SEQ ID NO: 552796 - DNA, 25 bp, Homo sapien
ttctgtcagccaacatgtacaaaat

SEQ ID NO: 552797 - DNA, 25 bp, Homo sapien
aagcctcaaatgtattttagtgcca

SEQ ID NO: 552798 - DNA, 25 bp, Homo sapien
atgtattttagtgccacccactggc

SEQ ID NO: 552799 - DNA, 25 bp, Homo sapien
ctggccataggtacaattcagttgt

SEQ ID NO: 552800 - DNA, 25 bp, Homo sapien
ggtacaattcagttgttggcttgtt

SEQ ID NO: 552801 - DNA, 25 bp, Homo sapien
gttggcttgttttgacttaattcta

SEQ ID NO: 552802 - DNA, 25 bp, Homo sapien
aggtctcaagcctgtatttttatga

SEQ ID NO: 552803 - DNA, 25 bp, Homo sapien
ttttttaaaaccctgcatatatatg

SEQ ID NO: 552804 - DNA, 25 bp, Homo sapien
gaaagcagcataagagtagtcacaa

SEQ ID NO: 552805 - DNA, 25 bp, Homo sapien
gtagtcacaaacatgttttgcaaca

SEQ ID NO: 552806 - DNA, 25 bp, Homo sapien
gttgctcagttatactgttcttctt

SEQ ID NO: 552807 - DNA, 25 bp, Homo sapien
atactgttcttcttatgtatgtaaa

SEQ ID NO: 552808 - DNA, 25 bp, Homo sapien
tgcggtctctgttattattatgggt

SEQ ID NO: 552809 - DNA, 25 bp, Homo sapien
tattattatgggtgtctcccttcct

SEQ ID NO: 552810 - DNA, 25 bp, Homo sapien
ggacaggccatgagccagagataca

SEQ ID NO: 552811 - DNA, 25 bp, Homo sapien
aggcaagatgcagggctctctgctc

SEQ ID NO: 552812 - DNA, 25 bp, Homo sapien
ctggctctttatcgtcgtcgggaca

SEQ ID NO: 552813 - DNA, 25 bp, Homo sapien
gggacaccctttgtccaaactcaag

SEQ ID NO: 552814 - DNA, 25 bp, Homo sapien
gtccaaactcaaggaatcccgggag

SEQ ID NO: 552815 - DNA, 25 bp, Homo sapien
gaatcccgggaggtctggctttgcc

SEQ ID NO: 552816 - DNA, 25 bp, Homo sapien
gctttgccgctttggctgggactca

SEQ ID NO: 552817 - DNA, 25 bp, Homo sapien
ctgggactcaggtacctgggcatac

SEQ ID NO: 552818 - DNA, 25 bp, Homo sapien
gtacctgggcatacctgcatctgtg

SEQ ID NO: 552819 - DNA, 25 bp, Homo sapien
ctcaggctcagctggagagtcatcg

SEQ ID NO: 552820 - DNA, 25 bp, Homo sapien
aggctcagctggagagtcatcggca

SEQ ID NO: 552821 - DNA, 25 bp, Homo sapien
ctcagctggagagtcatcggcagga

SEQ ID NO: 552822 - DNA, 25 bp, Homo sapien
gagtcatcggcaggaggaggctctg

SEQ ID NO: 552823 - DNA, 25 bp, Homo sapien
ctcaggggcacaggcataataaact

SEQ ID NO: 552824 - DNA, 25 bp, Homo sapien
aataaactgccggatattcttcagg

SEQ ID NO: 552825 - DNA, 25 bp, Homo sapien
actgccggatattcttcaggaaggt

SEQ ID NO: 552826 - DNA, 25 bp, Homo sapien
ggacacctcggccttaacaggagtg

SEQ ID NO: 552827 - DNA, 25 bp, Homo sapien
acacctcggccttaacaggagtggt

SEQ ID NO: 552828 - DNA, 25 bp, Homo sapien
ctcggccttaacaggagtggtgacc

SEQ ID NO: 552829 - DNA, 25 bp, Homo sapien
ttggtgcggcccactgcccgaggct

SEQ ID NO: 552830 - DNA, 25 bp, Homo sapien
aactgaggagtgtgcctgaagagtc

SEQ ID NO: 552831 - DNA, 25 bp, Homo sapien
tgtgcctgaagagtcaggtctggca

SEQ ID NO: 552832 - DNA, 25 bp, Homo sapien
agagaaaggatttcttgccctaggt

SEQ ID NO: 552833 - DNA, 25 bp, Homo sapien
gccctaggtttaaacaagcaatgtc

SEQ ID NO: 552834 - DNA, 25 bp, Homo sapien
ttcagagggcagctaagcagaaaag

SEQ ID NO: 552835 - DNA, 25 bp, Homo sapien
acataacttccaaaggcatcggctg

SEQ ID NO: 552836 - DNA, 25 bp, Homo sapien
ttgtgaacccgtggctgagcaggac

SEQ ID NO: 552837 - DNA, 25 bp, Homo sapien
gacagaaatgtcacacaggtggact

SEQ ID NO: 552838 - DNA, 25 bp, Homo sapien
tgttttccctctcagtactacatgg

SEQ ID NO: 552839 - DNA, 25 bp, Homo sapien
gtactacatggcaagtcacgtctcc

SEQ ID NO: 552840 - DNA, 25 bp, Homo sapien
ggcaagtcacgtctccaaactgagg

SEQ ID NO: 552841 - DNA, 25 bp, Homo sapien
aaagaaaacacgatccaatgactgg

SEQ ID NO: 552842 - DNA, 25 bp, Homo sapien
aatgtctctcattactctcatatct

SEQ ID NO: 552843 - DNA, 25 bp, Homo sapien
cattactctcatatcttcggctgaa

SEQ ID NO: 552844 - DNA, 25 bp, Homo sapien
atatcttcggctgaattctctccta

SEQ ID NO: 552845 - DNA, 25 bp, Homo sapien
ggctgaattctctcctatagtggac

SEQ ID NO: 552846 - DNA, 25 bp, Homo sapien
tatagtggacagaaagttgcccctt

SEQ ID NO: 552847 - DNA, 25 bp, Homo sapien
gaaagttgccccttttcttcataag

SEQ ID NO: 552848 - DNA, 25 bp, Homo sapien
atagcagaagctactcagagaaata

SEQ ID NO: 552849 - DNA, 25 bp, Homo sapien
acatggaaatacaaaggcttaactc

SEQ ID NO: 552850 - DNA, 25 bp, Homo sapien
ggcttaactctaaaggtctgcataa

SEQ ID NO: 552851 - DNA, 25 bp, Homo sapien
aaaggtctgcataaacactgaaaat

SEQ ID NO: 552852 - DNA, 25 bp, Homo sapien
tattaataatgctgtttgttcagca

SEQ ID NO: 552853 - DNA, 25 bp, Homo sapien
tttgttcagcatttttcggtcattt

SEQ ID NO: 552854 - DNA, 25 bp, Homo sapien
gttcagcatttttcggtcatttgat

SEQ ID NO: 552855 - DNA, 25 bp, Homo sapien
cagcatttttcggtcatttgatttt

SEQ ID NO: 552856 - DNA, 25 bp, Homo sapien
catttttcggtcatttgattttgca

SEQ ID NO: 552857 - DNA, 25 bp, Homo sapien
ggtcatttgattttgcattttgcac

SEQ ID NO: 552858 - DNA, 25 bp, Homo sapien
tgattttgcattttgcacttcctcc

SEQ ID NO: 552859 - DNA, 25 bp, Homo sapien
ttttgcattttgcacttcctcccag

SEQ ID NO: 552860 - DNA, 25 bp, Homo sapien
attttgcacttcctcccaggatatt

SEQ ID NO: 552861 - DNA, 25 bp, Homo sapien
aatatgaagtattggtgcagtttga

SEQ ID NO: 552862 - DNA, 25 bp, Homo sapien
tattggtgcagtttgagggtgtttt

SEQ ID NO: 552863 - DNA, 25 bp, Homo sapien
gagtccacggtgtttattgggccac

SEQ ID NO: 552864 - DNA, 25 bp, Homo sapien
gtttattgggccaccccacgcatgg

SEQ ID NO: 552865 - DNA, 25 bp, Homo sapien
accctggtctgtcatgcctgttttt

SEQ ID NO: 552866 - DNA, 25 bp, Homo sapien
ctggtctgtcatgcctgtttttcct

SEQ ID NO: 552867 - DNA, 25 bp, Homo sapien
ttttcctacactcagcggcaaagct

SEQ ID NO: 552868 - DNA, 25 bp, Homo sapien
tacactcagcggcaaagctgcagga

SEQ ID NO: 552869 - DNA, 25 bp, Homo sapien
tgagcctggaatagcccttcctagt

SEQ ID NO: 552870 - DNA, 25 bp, Homo sapien
acagcagcctcgaaacaccaggcag

SEQ ID NO: 552871 - DNA, 25 bp, Homo sapien
cgaaacaccaggcagcagccttgct

SEQ ID NO: 552872 - DNA, 25 bp, Homo sapien
agcagccttgctgggagtccacggt

SEQ ID NO: 552873 - DNA, 25 bp, Homo sapien
ttgctgggagtccacggtgtttatt

SEQ ID NO: 552874 - DNA, 25 bp, Homo sapien
ctatctttaaatgttattcatgcta

SEQ ID NO: 552875 - DNA, 25 bp, Homo sapien
gaagagatgctcttttccaagctat

SEQ ID NO: 552876 - DNA, 25 bp, Homo sapien
gatgctcttttccaagctataatgg

SEQ ID NO: 552877 - DNA, 25 bp, Homo sapien
agctataatggatgctttgtttaat

SEQ ID NO: 552878 - DNA, 25 bp, Homo sapien
ttttccaattcaaattctagctatt

SEQ ID NO: 552879 - DNA, 25 bp, Homo sapien
tctagctattgctttcctataaatg

SEQ ID NO: 552880 - DNA, 25 bp, Homo sapien
gctttcctataaatgtttgggttgt

SEQ ID NO: 552881 - DNA, 25 bp, Homo sapien
tgtttgggttgtgtttggtattgtt

SEQ ID NO: 552882 - DNA, 25 bp, Homo sapien
tggttaatagttttccagttgcatt

SEQ ID NO: 552883 - DNA, 25 bp, Homo sapien
atagttttccagttgcatttaattt

SEQ ID NO: 552884 - DNA, 25 bp, Homo sapien
gaatatgataccttgtcacatgtaa

SEQ ID NO: 552885 - DNA, 25 bp, Homo sapien
ccaaaaccattagggctcagaggaa

SEQ ID NO: 552886 - DNA, 25 bp, Homo sapien
aaccattagggctcagaggaaggta

SEQ ID NO: 552887 - DNA, 25 bp, Homo sapien
attagggctcagaggaaggtatccc

SEQ ID NO: 552888 - DNA, 25 bp, Homo sapien
agggctcagaggaaggtatcccaat

SEQ ID NO: 552889 - DNA, 25 bp, Homo sapien
ggctcagaggaaggtatcccaatga

SEQ ID NO: 552890 - DNA, 25 bp, Homo sapien
ggaaggtatcccaatgaatatcaat

SEQ ID NO: 552891 - DNA, 25 bp, Homo sapien
aaggtatcccaatgaatatcaatta

SEQ ID NO: 552892 - DNA, 25 bp, Homo sapien
tttcaagatggaaagtccgtcagac

SEQ ID NO: 552893 - DNA, 25 bp, Homo sapien
aaagtccgtcagactcagctgtggt

SEQ ID NO: 552894 - DNA, 25 bp, Homo sapien
gactcagctgtggttttacctagca

SEQ ID NO: 552895 - DNA, 25 bp, Homo sapien
gtggttttacctagcactcctcagg

SEQ ID NO: 552896 - DNA, 25 bp, Homo sapien
cacaaataattatcagccaccgcgc

SEQ ID NO: 552897 - DNA, 25 bp, Homo sapien
cctggcctctcctgaatcttttatc

SEQ ID NO: 552898 - DNA, 25 bp, Homo sapien
tttctgttcccttcaggacctaggc

SEQ ID NO: 552899 - DNA, 25 bp, Homo sapien
tcaggacctaggcttttgaaaccca

SEQ ID NO: 552900 - DNA, 25 bp, Homo sapien
acatgcctttgttatctgctttctg

SEQ ID NO: 552901 - DNA, 25 bp, Homo sapien
tttctgcaatcacgtctcttccatg

SEQ ID NO: 552902 - DNA, 25 bp, Homo sapien
actgagcagagaatggtgtggccaa

SEQ ID NO: 552903 - DNA, 25 bp, Homo sapien
aggtgtgagctaggtgtctgttccc

SEQ ID NO: 552904 - DNA, 25 bp, Homo sapien
agctaggtgtctgttcccattttag

SEQ ID NO: 552905 - DNA, 25 bp, Homo sapien
aatactgttcctacatcagaaatac

SEQ ID NO: 552906 - DNA, 25 bp, Homo sapien
accacattaagacgtatagagccag

SEQ ID NO: 552907 - DNA, 25 bp, Homo sapien
agtatgttgcagttactcatattaa

SEQ ID NO: 552908 - DNA, 25 bp, Homo sapien
acatatgttgaattttaagtactac

SEQ ID NO: 552909 - DNA, 25 bp, Homo sapien
ttaagtactacagatttaactgatt

SEQ ID NO: 552910 - DNA, 25 bp, Homo sapien
gaaaggctaacagacatggatacac

SEQ ID NO: 552911 - DNA, 25 bp, Homo sapien
aacagacatggatacacgtgtacag

SEQ ID NO: 552912 - DNA, 25 bp, Homo sapien
tacacgtgtacagtatgcattcaaa

SEQ ID NO: 552913 - DNA, 25 bp, Homo sapien
tttaagtcactgtccatttgtattg

SEQ ID NO: 552914 - DNA, 25 bp, Homo sapien
gtccatttgtattgacatgcctctg

SEQ ID NO: 552915 - DNA, 25 bp, Homo sapien
gtattgacatgcctctgtttctagt

SEQ ID NO: 552916 - DNA, 25 bp, Homo sapien
gacatgcctctgtttctagtccagt

SEQ ID NO: 552917 - DNA, 25 bp, Homo sapien
ttctagtccagtttggagattttat

SEQ ID NO: 552918 - DNA, 25 bp, Homo sapien
atgtctgacctgaacccgattctgg

SEQ ID NO: 552919 - DNA, 25 bp, Homo sapien
acgacctccacagggttacattgta

SEQ ID NO: 552920 - DNA, 25 bp, Homo sapien
acctccacagggttacattgtaata

SEQ ID NO: 552921 - DNA, 25 bp, Homo sapien
acattgtaatatatatgccccagct

SEQ ID NO: 552922 - DNA, 25 bp, Homo sapien
acctgtctgatggtggcatcttcct

SEQ ID NO: 552923 - DNA, 25 bp, Homo sapien
tgatggtggcatcttcctgcagaca

SEQ ID NO: 552924 - DNA, 25 bp, Homo sapien
gtgggaatcagtcttcacagacaga

SEQ ID NO: 552925 - DNA, 25 bp, Homo sapien
tcttcacagacagacgtgagccagg

SEQ ID NO: 552926 - DNA, 25 bp, Homo sapien
aggactcgttccttgcagaggtcag

SEQ ID NO: 552927 - DNA, 25 bp, Homo sapien
gaggtcagtcctcacctgcaggtgt

SEQ ID NO: 552928 - DNA, 25 bp, Homo sapien
gggcaggcacacaccatgtctgacc

SEQ ID NO: 552929 - DNA, 25 bp, Homo sapien
actatgcctttatctcgcacaatcc

SEQ ID NO: 552930 - DNA, 25 bp, Homo sapien
tatctcgcacaatccccatggaagg

SEQ ID NO: 552931 - DNA, 25 bp, Homo sapien
tggaaggccccgaaacagactgaca

SEQ ID NO: 552932 - DNA, 25 bp, Homo sapien
agtctagtgcataaatggttctcgg

SEQ ID NO: 552933 - DNA, 25 bp, Homo sapien
atggttctcgggatacttgattact

SEQ ID NO: 552934 - DNA, 25 bp, Homo sapien
ggatacttgattactttccagctat

SEQ ID NO: 552935 - DNA, 25 bp, Homo sapien
agggctttttgaaagcagcgcctgc

SEQ ID NO: 552936 - DNA, 25 bp, Homo sapien
ctgctttgctgtttttactgccttc

SEQ ID NO: 552937 - DNA, 25 bp, Homo sapien
tactgccttctttctagacacaatc

SEQ ID NO: 552938 - DNA, 25 bp, Homo sapien
agacacaatcgacttttacactggg

SEQ ID NO: 552939 - DNA, 25 bp, Homo sapien
agaccagagctcacttttctgcatt

SEQ ID NO: 552940 - DNA, 25 bp, Homo sapien
gggtccgtgtcctgacagcagtagc

SEQ ID NO: 552941 - DNA, 25 bp, Homo sapien
tccctcctaaagatactttgcttca

SEQ ID NO: 552942 - DNA, 25 bp, Homo sapien
atcctttcacttttgaagttcctct

SEQ ID NO: 552943 - DNA, 25 bp, Homo sapien
tttgaagttcctctgggccagtgta

SEQ ID NO: 552944 - DNA, 25 bp, Homo sapien
gggccagtgtagatactttgtttca

SEQ ID NO: 552945 - DNA, 25 bp, Homo sapien
tttcttcttttcattgtgtaactcc

SEQ ID NO: 552946 - DNA, 25 bp, Homo sapien
cattgtgtaactccttctgggccag

SEQ ID NO: 552947 - DNA, 25 bp, Homo sapien
gccagcatagcttcgctggatgagc

SEQ ID NO: 552948 - DNA, 25 bp, Homo sapien
gcttttccatctcatatgtcttatt

SEQ ID NO: 552949 - DNA, 25 bp, Homo sapien
gtcttatttgtgtgcagtgactgct

SEQ ID NO: 552950 - DNA, 25 bp, Homo sapien
ttgtgtgcagtgactgctttccaga

SEQ ID NO: 552951 - DNA, 25 bp, Homo sapien
tatggtggaaaagaactgtactgtc

SEQ ID NO: 552952 - DNA, 25 bp, Homo sapien
ctgtactgtctgttatgatttcctt

SEQ ID NO: 552953 - DNA, 25 bp, Homo sapien
atgatttccttcaatgtgcataatg

SEQ ID NO: 552954 - DNA, 25 bp, Homo sapien
gtttccatggttacctgacctaaat

SEQ ID NO: 552955 - DNA, 25 bp, Homo sapien
atggttacctgacctaaattagata

SEQ ID NO: 552956 - DNA, 25 bp, Homo sapien
agataaattgtagggctttagcttt

SEQ ID NO: 552957 - DNA, 25 bp, Homo sapien
ggtgttgacatacattccctctaat

SEQ ID NO: 552958 - DNA, 25 bp, Homo sapien
gttgacatacattccctctaatttg

SEQ ID NO: 552959 - DNA, 25 bp, Homo sapien
cattccctctaatttgaactggtat

SEQ ID NO: 552960 - DNA, 25 bp, Homo sapien
gaactggtattgtttacgtttgata

SEQ ID NO: 552961 - DNA, 25 bp, Homo sapien
gtttacgtttgatacaacattaagg

SEQ ID NO: 552962 - DNA, 25 bp, Homo sapien
cctttaccctgcccttgttgaacat

SEQ ID NO: 552963 - DNA, 25 bp, Homo sapien
tttatataatctaacctggacatca

SEQ ID NO: 552964 - DNA, 25 bp, Homo sapien
acctggacatcaagctgttctctct

SEQ ID NO: 552965 - DNA, 25 bp, Homo sapien
ggacatcaagctgttctctctctct

SEQ ID NO: 552966 - DNA, 25 bp, Homo sapien
ttcatattactcttgtatcgagtcc

SEQ ID NO: 552967 - DNA, 25 bp, Homo sapien
attactcttgtatcgagtccatgag

SEQ ID NO: 552968 - DNA, 25 bp, Homo sapien
tcttgtatcgagtccatgaggtcta

SEQ ID NO: 552969 - DNA, 25 bp, Homo sapien
tatcgagtccatgaggtctaaggca

SEQ ID NO: 552970 - DNA, 25 bp, Homo sapien
gagtccatgaggtctaaggcaactt

SEQ ID NO: 552971 - DNA, 25 bp, Homo sapien
gtccatgaggtctaaggcaacttag

SEQ ID NO: 552972 - DNA, 25 bp, Homo sapien
ctaaggcaacttagatcaaagtttt

SEQ ID NO: 552973 - DNA, 25 bp, Homo sapien
gaaactaagactttgtgtcattatt

SEQ ID NO: 552974 - DNA, 25 bp, Homo sapien
gaggtagctaaggactgatgttgaa

SEQ ID NO: 552975 - DNA, 25 bp, Homo sapien
aagtgtattcagtctatagtaagct

SEQ ID NO: 552976 - DNA, 25 bp, Homo sapien
agtctatagtaagctgatgtcaggt

SEQ ID NO: 552977 - DNA, 25 bp, Homo sapien
gatgtcaggtcagtaaattttgttt

SEQ ID NO: 552978 - DNA, 25 bp, Homo sapien
gggatgttggtattttcgatcaagt

SEQ ID NO: 552979 - DNA, 25 bp, Homo sapien
tagtaaacgctcctatttgtgttag

SEQ ID NO: 552980 - DNA, 25 bp, Homo sapien
acgctcctatttgtgttagattttg

SEQ ID NO: 552981 - DNA, 25 bp, Homo sapien
tgtattaccctatattttctttaat

SEQ ID NO: 552982 - DNA, 25 bp, Homo sapien
tcaaaggtaagccagattatttcat

SEQ ID NO: 552983 - DNA, 25 bp, Homo sapien
gcactttggccatttattttttcaa

SEQ ID NO: 552984 - DNA, 25 bp, Homo sapien
acttctctggacatgcgcgtttgag

SEQ ID NO: 552985 - DNA, 25 bp, Homo sapien
gggtcctgtaaggtgcttcatcgtc

SEQ ID NO: 552986 - DNA, 25 bp, Homo sapien
aaggtgcttcatcgtctgtgattac

SEQ ID NO: 552987 - DNA, 25 bp, Homo sapien
gcttcatcgtctgtgattactgctt

SEQ ID NO: 552988 - DNA, 25 bp, Homo sapien
cgtctgtgattactgcttgggatgt

SEQ ID NO: 552989 - DNA, 25 bp, Homo sapien
cttgggatgtgttctttggcagctt

SEQ ID NO: 552990 - DNA, 25 bp, Homo sapien
ctttggcagcttgtgagattacttt

SEQ ID NO: 552991 - DNA, 25 bp, Homo sapien
gcagcttgtgagattactttaccta

SEQ ID NO: 552992 - DNA, 25 bp, Homo sapien
ttgtgagattactttacctagtgtt

SEQ ID NO: 552993 - DNA, 25 bp, Homo sapien
acatcttaattgacaatggcgtttt

SEQ ID NO: 552994 - DNA, 25 bp, Homo sapien
ggcgtttttttatacataaccatgg

SEQ ID NO: 552995 - DNA, 25 bp, Homo sapien
aagcgattcatctaggacctcggca

SEQ ID NO: 552996 - DNA, 25 bp, Homo sapien
tcatctaggacctcggcaggcggtg

SEQ ID NO: 552997 - DNA, 25 bp, Homo sapien
gtgcgaccaagcgttcgggccgaga

SEQ ID NO: 552998 - DNA, 25 bp, Homo sapien
cggccggagcccaagggaaccagat

SEQ ID NO: 552999 - DNA, 25 bp, Homo sapien
cgttgaacccgatctcctaagaagt

SEQ ID NO: 553000 - DNA, 25 bp, Homo sapien
atctcctaagaagtgtgctgcaaca

SEQ ID NO: 553001 - DNA, 25 bp, Homo sapien
caacagcgtttgattgcattaggag

SEQ ID NO: 553002 - DNA, 25 bp, Homo sapien
gttatcgcagctcgaatttcagttt

SEQ ID NO: 553003 - DNA, 25 bp, Homo sapien
gcagctcgaatttcagtttaaacga

SEQ ID NO: 553004 - DNA, 25 bp, Homo sapien
tggccctcacttagcttgtgaacag

SEQ ID NO: 553005 - DNA, 25 bp, Homo sapien
tagcttgtgaacaggcctttttaaa

SEQ ID NO: 553006 - DNA, 25 bp, Homo sapien
aatccttgaagacatttttgcccat

SEQ ID NO: 553007 - DNA, 25 bp, Homo sapien
tttgcccattttgtataagaaacag

SEQ ID NO: 553008 - DNA, 25 bp, Homo sapien
aggtgtttatacttgttatgtttca

SEQ ID NO: 553009 - DNA, 25 bp, Homo sapien
gaattcatgacagcatttcctagag

SEQ ID NO: 553010 - DNA, 25 bp, Homo sapien
gaaaaagcttaggtacgcgtctcca

SEQ ID NO: 553011 - DNA, 25 bp, Homo sapien
taggtacgcgtctccaaatgatggt

SEQ ID NO: 553012 - DNA, 25 bp, Homo sapien
acgcgtctccaaatgatggtttctt

SEQ ID NO: 553013 - DNA, 25 bp, Homo sapien
gatggtttctttttctacaccttag

SEQ ID NO: 553014 - DNA, 25 bp, Homo sapien
tacaccttagctttttcatagctca

SEQ ID NO: 553015 - DNA, 25 bp, Homo sapien
agctcaattcttcttacaacttctc

SEQ ID NO: 553016 - DNA, 25 bp, Homo sapien
attcttcttacaacttctcttgtgt

SEQ ID NO: 553017 - DNA, 25 bp, Homo sapien
atagcaagtgatttaatattttgaa

SEQ ID NO: 553018 - DNA, 25 bp, Homo sapien
aaagatggctaaaatccttttaatg

SEQ ID NO: 553019 - DNA, 25 bp, Homo sapien
aagatggctaaaatccttttaatga

SEQ ID NO: 553020 - DNA, 25 bp, Homo sapien
gatggctaaaatccttttaatgaac

SEQ ID NO: 553021 - DNA, 25 bp, Homo sapien
ggctaaaatccttttaatgaacagc

SEQ ID NO: 553022 - DNA, 25 bp, Homo sapien
taaaatccttttaatgaacagcact

SEQ ID NO: 553023 - DNA, 25 bp, Homo sapien
aaaatccttttaatgaacagcacta

SEQ ID NO: 553024 - DNA, 25 bp, Homo sapien
aaatccttttaatgaacagcactaa

SEQ ID NO: 553025 - DNA, 25 bp, Homo sapien
aatccttttaatgaacagcactaaa

SEQ ID NO: 553026 - DNA, 25 bp, Homo sapien
cagcactaaagttatatgtattaga

SEQ ID NO: 553027 - DNA, 25 bp, Homo sapien
ttttggcttttttacagataatatt

SEQ ID NO: 553028 - DNA, 25 bp, Homo sapien
aacgtaactaatacaggaccctgat

SEQ ID NO: 553029 - DNA, 25 bp, Homo sapien
tacaggaccctgatttctgaaacat

SEQ ID NO: 553030 - DNA, 25 bp, Homo sapien
ggaaagatgattctggacttgctag

SEQ ID NO: 553031 - DNA, 25 bp, Homo sapien
gacttgctagatgatgaattatgcc

SEQ ID NO: 553032 - DNA, 25 bp, Homo sapien
gaattatgcctaacaatatctgtag

SEQ ID NO: 553033 - DNA, 25 bp, Homo sapien
tttagagtcagatgaccacctggct

SEQ ID NO: 553034 - DNA, 25 bp, Homo sapien
acctggctggatgctattagacaga

SEQ ID NO: 553035 - DNA, 25 bp, Homo sapien
taatcttaaagagccctagtttcct

SEQ ID NO: 553036 - DNA, 25 bp, Homo sapien
cctagtttcctcacctatgagatga

SEQ ID NO: 553037 - DNA, 25 bp, Homo sapien
gaggattgctactttgtcaaaccca

SEQ ID NO: 553038 - DNA, 25 bp, Homo sapien
aaagccactgtgagataaggtacgt

SEQ ID NO: 553039 - DNA, 25 bp, Homo sapien
tagtctccccatcttaagatagcat

SEQ ID NO: 553040 - DNA, 25 bp, Homo sapien
agtctccccatcttaagatagcatc

SEQ ID NO: 553041 - DNA, 25 bp, Homo sapien
gtctccccatcttaagatagcatct

SEQ ID NO: 553042 - DNA, 25 bp, Homo sapien
tctccccatcttaagatagcatctt

SEQ ID NO: 553043 - DNA, 25 bp, Homo sapien
ctccccatcttaagatagcatcttt

SEQ ID NO: 553044 - DNA, 25 bp, Homo sapien
tccccatcttaagatagcatctttc

SEQ ID NO: 553045 - DNA, 25 bp, Homo sapien
cccatcttaagatagcatctttcac

SEQ ID NO: 553046 - DNA, 25 bp, Homo sapien
catcttaagatagcatctttcacag

SEQ ID NO: 553047 - DNA, 25 bp, Homo sapien
cttaagatagcatctttcacagagt

SEQ ID NO: 553048 - DNA, 25 bp, Homo sapien
taagatagcatctttcacagagtca

SEQ ID NO: 553049 - DNA, 25 bp, Homo sapien
aagatagcatctttcacagagtcac

SEQ ID NO: 553050 - DNA, 25 bp, Homo sapien
gaggaacatcaacatcacggccttt

SEQ ID NO: 553051 - DNA, 25 bp, Homo sapien
tcacggcctttgaatgccaccgcaa

SEQ ID NO: 553052 - DNA, 25 bp, Homo sapien
accgcaactcctctaagtggtgttt

SEQ ID NO: 553053 - DNA, 25 bp, Homo sapien
ccagggactgggacttcgacagaaa

SEQ ID NO: 553054 - DNA, 25 bp, Homo sapien
atcaactcttgaacctcatagcact

SEQ ID NO: 553055 - DNA, 25 bp, Homo sapien
acctcatagcactttaagccctcag

SEQ ID NO: 553056 - DNA, 25 bp, Homo sapien
ccctcaggaggaccattctaacaga

SEQ ID NO: 553057 - DNA, 25 bp, Homo sapien
tgcctatgatccttcctctgtggat

SEQ ID NO: 553058 - DNA, 25 bp, Homo sapien
tgttacctcccagcattcatcagga

SEQ ID NO: 553059 - DNA, 25 bp, Homo sapien
tcatcaggagcccagtctgctgcat

SEQ ID NO: 553060 - DNA, 25 bp, Homo sapien
gtctcgttcatctacttcttctaaa

SEQ ID NO: 553061 - DNA, 25 bp, Homo sapien
ctccctcctgagctgagaaacggaa

SEQ ID NO: 553062 - DNA, 25 bp, Homo sapien
cctcctgagctgagaaacggaacct

SEQ ID NO: 553063 - DNA, 25 bp, Homo sapien
tgagctgagaaacggaacctcgcga

SEQ ID NO: 553064 - DNA, 25 bp, Homo sapien
tgagaaacggaacctcgcgaaccac

SEQ ID NO: 553065 - DNA, 25 bp, Homo sapien
gaaacggaacctcgcgaaccactgg

SEQ ID NO: 553066 - DNA, 25 bp, Homo sapien
acggaacctcgcgaaccactggtgg

SEQ ID NO: 553067 - DNA, 25 bp, Homo sapien
ggaacctcgcgaaccactggtggca

SEQ ID NO: 553068 - DNA, 25 bp, Homo sapien
acctcgcgaaccactggtggcacat

SEQ ID NO: 553069 - DNA, 25 bp, Homo sapien
gcgaaccactggtggcacatccttc

SEQ ID NO: 553070 - DNA, 25 bp, Homo sapien
acccgcccccggatcagaaatatat

SEQ ID NO: 553071 - DNA, 25 bp, Homo sapien
ccccggatcagaaatatatctatat

SEQ ID NO: 553072 - DNA, 25 bp, Homo sapien
tgcatcaggccacaggtcttggctt

SEQ ID NO: 553073 - DNA, 25 bp, Homo sapien
aggtcttggctttctccttatcacc

SEQ ID NO: 553074 - DNA, 25 bp, Homo sapien
ttctccttatcaccatttgctgtta

SEQ ID NO: 553075 - DNA, 25 bp, Homo sapien
accatttgctgttatcacggcacac

SEQ ID NO: 553076 - DNA, 25 bp, Homo sapien
cgccaagtggttacccaagtcacca

SEQ ID NO: 553077 - DNA, 25 bp, Homo sapien
aagtcaccactcctgacccaaaaat

SEQ ID NO: 553078 - DNA, 25 bp, Homo sapien
catggcattaaaacgttgcaaattc

SEQ ID NO: 553079 - DNA, 25 bp, Homo sapien
accaggaccatgtagggtgcagtct

SEQ ID NO: 553080 - DNA, 25 bp, Homo sapien
gtagggtgcagtctttactccctaa

SEQ ID NO: 553081 - DNA, 25 bp, Homo sapien
acctccgcagccagtgaagtgtgtt

SEQ ID NO: 553082 - DNA, 25 bp, Homo sapien
gccagtgaagtgtgttgtgcctgct

SEQ ID NO: 553083 - DNA, 25 bp, Homo sapien
acatgatgaatcaaaagcacttggc

SEQ ID NO: 553084 - DNA, 25 bp, Homo sapien
aaagcacttggcatgtgagggctat

SEQ ID NO: 553085 - DNA, 25 bp, Homo sapien
aagcacttggcatgtgagggctatt

SEQ ID NO: 553086 - DNA, 25 bp, Homo sapien
agcacttggcatgtgagggctatta

SEQ ID NO: 553087 - DNA, 25 bp, Homo sapien
gcacttggcatgtgagggctattaa

SEQ ID NO: 553088 - DNA, 25 bp, Homo sapien
cacttggcatgtgagggctattaaa

SEQ ID NO: 553089 - DNA, 25 bp, Homo sapien
acttggcatgtgagggctattaaaa

SEQ ID NO: 553090 - DNA, 25 bp, Homo sapien
cttggcatgtgagggctattaaaat

SEQ ID NO: 553091 - DNA, 25 bp, Homo sapien
ttggcatgtgagggctattaaaata

SEQ ID NO: 553092 - DNA, 25 bp, Homo sapien
tggcatgtgagggctattaaaatag

SEQ ID NO: 553093 - DNA, 25 bp, Homo sapien
gcatgtgagggctattaaaatagcc

SEQ ID NO: 553094 - DNA, 25 bp, Homo sapien
atccaccctgtagggcccatgttgg

SEQ ID NO: 553095 - DNA, 25 bp, Homo sapien
ctgtagggcccatgttggtgtagca

SEQ ID NO: 553096 - DNA, 25 bp, Homo sapien
ttggtgtagcagtgatggcttctgt

SEQ ID NO: 553097 - DNA, 25 bp, Homo sapien
tgtagcagtgatggcttctgtggat

SEQ ID NO: 553098 - DNA, 25 bp, Homo sapien
tctgtgacctctgtcggtgtaactt

SEQ ID NO: 553099 - DNA, 25 bp, Homo sapien
gatttcctgccccttccacaatatg

SEQ ID NO: 553100 - DNA, 25 bp, Homo sapien
gacctctgtcggtgtaacttgacaa

SEQ ID NO: 553101 - DNA, 25 bp, Homo sapien
gtcggtgtaacttgacaatttctaa

SEQ ID NO: 553102 - DNA, 25 bp, Homo sapien
aaagggttgctgtgttttctctgtc

SEQ ID NO: 553103 - DNA, 25 bp, Homo sapien
ttccacaatatgctgtttccccagg

SEQ ID NO: 553104 - DNA, 25 bp, Homo sapien
tgtttccccaggagcctcaggcctg

SEQ ID NO: 553105 - DNA, 25 bp, Homo sapien
tgaccccacagaacttggccgtgtg

SEQ ID NO: 553106 - DNA, 25 bp, Homo sapien
ccccacagaacttggccgtgtgctt

SEQ ID NO: 553107 - DNA, 25 bp, Homo sapien
caggccttgccagtgcagtggactt

SEQ ID NO: 553108 - DNA, 25 bp, Homo sapien
gccttgccagtgcagtggacttcaa

SEQ ID NO: 553109 - DNA, 25 bp, Homo sapien
ttgccagtgcagtggacttcaagca

SEQ ID NO: 553110 - DNA, 25 bp, Homo sapien
acttcaagcaccacatcgaggtgct

SEQ ID NO: 553111 - DNA, 25 bp, Homo sapien
agcaccacatcgaggtgctgcacta

SEQ ID NO: 553112 - DNA, 25 bp, Homo sapien
acaatctccagatgtcgcgccttac

SEQ ID NO: 553113 - DNA, 25 bp, Homo sapien
atctccagatgtcgcgccttacttg

SEQ ID NO: 553114 - DNA, 25 bp, Homo sapien
atgtcgcgccttacttgcgacccaa

SEQ ID NO: 553115 - DNA, 25 bp, Homo sapien
ttacttgcgacccaaacgacagcca

SEQ ID NO: 553116 - DNA, 25 bp, Homo sapien
gtgaggtcactcgagaattcatgga

SEQ ID NO: 553117 - DNA, 25 bp, Homo sapien
tcactcgagaattcatggacacggc

SEQ ID NO: 553118 - DNA, 25 bp, Homo sapien
actcgagaattcatggacacggccc

SEQ ID NO: 553119 - DNA, 25 bp, Homo sapien
agaattcatggacacggcccccagt

SEQ ID NO: 553120 - DNA, 25 bp, Homo sapien
gggcatcttgcaagacctttagtgc

SEQ ID NO: 553121 - DNA, 25 bp, Homo sapien
atcttgcaagacctttagtgccaca

SEQ ID NO: 553122 - DNA, 25 bp, Homo sapien
gccacaaataagcatcgagcacctc

SEQ ID NO: 553123 - DNA, 25 bp, Homo sapien
aaataagcatcgagcacctccccat

SEQ ID NO: 553124 - DNA, 25 bp, Homo sapien
tccttatcccccatggtgtttatta

SEQ ID NO: 553125 - DNA, 25 bp, Homo sapien
tatcccccatggtgtttattattta

SEQ ID NO: 553126 - DNA, 25 bp, Homo sapien
ttattatttatttccctccccatgc

SEQ ID NO: 553127 - DNA, 25 bp, Homo sapien
gtgccgctgctcgtgcttgctctgg

SEQ ID NO: 553128 - DNA, 25 bp, Homo sapien
tgctcgtgcttgctctggccagcta

SEQ ID NO: 553129 - DNA, 25 bp, Homo sapien
tagccgattgcctcgtgccctacag

SEQ ID NO: 553130 - DNA, 25 bp, Homo sapien
tacagccgagccctttatcggcgtc

SEQ ID NO: 553131 - DNA, 25 bp, Homo sapien
aggccgttcccacatcaggaaaggt

SEQ ID NO: 553132 - DNA, 25 bp, Homo sapien
aaggtctgggtctaatgaccctcga

SEQ ID NO: 553133 - DNA, 25 bp, Homo sapien
ggtctaatgaccctcgagtcaagaa

SEQ ID NO: 553134 - DNA, 25 bp, Homo sapien
gaccctcgagtcaagaacaaccctg

SEQ ID NO: 553135 - DNA, 25 bp, Homo sapien
tcttattcggcccaaggacttgaag

SEQ ID NO: 553136 - DNA, 25 bp, Homo sapien
attcggcccaaggacttgaagcccg

SEQ ID NO: 553137 - DNA, 25 bp, Homo sapien
ttgaagcccggcatcttccgacctg

SEQ ID NO: 553138 - DNA, 25 bp, Homo sapien
ggtgtcacactgagcctttgggatc

SEQ ID NO: 553139 - DNA, 25 bp, Homo sapien
ttgggatcctttccctggatacata

SEQ ID NO: 553140 - DNA, 25 bp, Homo sapien
ttccctggatacataaccctagtag

SEQ ID NO: 553141 - DNA, 25 bp, Homo sapien
aatgaccaaatccaacctactgcaa

SEQ ID NO: 553142 - DNA, 25 bp, Homo sapien
acctactgcaaatgttactatggaa

SEQ ID NO: 553143 - DNA, 25 bp, Homo sapien
atctcaatgcaaaagtagcctttgt

SEQ ID NO: 553144 - DNA, 25 bp, Homo sapien
aaggattttgcctattagtatcata

SEQ ID NO: 553145 - DNA, 25 bp, Homo sapien
gaacacttagaattattagccattt

SEQ ID NO: 553146 - DNA, 25 bp, Homo sapien
atcatatggcatgtagctatcaagc

SEQ ID NO: 553147 - DNA, 25 bp, Homo sapien
tatcaagccagtttcgtttagttat

SEQ ID NO: 553148 - DNA, 25 bp, Homo sapien
aagcatatgatacgtggtgtcacac

SEQ ID NO: 553149 - DNA, 25 bp, Homo sapien
gttaaaccttgatacacactcagat

SEQ ID NO: 553150 - DNA, 25 bp, Homo sapien
actcagatctgcagtgacttgacca

SEQ ID NO: 553151 - DNA, 25 bp, Homo sapien
gacttgaccagcactgtgggttcat

SEQ ID NO: 553152 - DNA, 25 bp, Homo sapien
catgctttactgtctgataacgaat

SEQ ID NO: 553153 - DNA, 25 bp, Homo sapien
tagctctgtcacctaaacctgatga

SEQ ID NO: 553154 - DNA, 25 bp, Homo sapien
taaacctgatgagggctgagccttc

SEQ ID NO: 553155 - DNA, 25 bp, Homo sapien
tgagccttcatttcgccgttttttg

SEQ ID NO: 553156 - DNA, 25 bp, Homo sapien
tgaacgagatggactctggctatgt

SEQ ID NO: 553157 - DNA, 25 bp, Homo sapien
gaggcttgagcctagactgtcaaca

SEQ ID NO: 553158 - DNA, 25 bp, Homo sapien
tagactgtcaacacccaggccaaag

SEQ ID NO: 553159 - DNA, 25 bp, Homo sapien
attgcctgcttttcatcttatggag

SEQ ID NO: 553160 - DNA, 25 bp, Homo sapien
aggtttggagaggaccctgtgccca

SEQ ID NO: 553161 - DNA, 25 bp, Homo sapien
tgactgactgtattctctggccaca

SEQ ID NO: 553162 - DNA, 25 bp, Homo sapien
gtattctctggccacattcaagtcc

SEQ ID NO: 553163 - DNA, 25 bp, Homo sapien
gaagtaggaccaggccatccttggc

SEQ ID NO: 553164 - DNA, 25 bp, Homo sapien
agagctcgaagaccccaagacagcc

SEQ ID NO: 553165 - DNA, 25 bp, Homo sapien
tctcagcggcgccacagagagcctg

SEQ ID NO: 553166 - DNA, 25 bp, Homo sapien
gggctcagccttctgcatcaggaca

SEQ ID NO: 553167 - DNA, 25 bp, Homo sapien
tcaggacatggcctcgtccactgag

SEQ ID NO: 553168 - DNA, 25 bp, Homo sapien
ctcgtccactgagggcacgatttaa

SEQ ID NO: 553169 - DNA, 25 bp, Homo sapien
tgagggcacgatttaaacatttgac

SEQ ID NO: 553170 - DNA, 25 bp, Homo sapien
tttaaacatttgacatcagaagctt

SEQ ID NO: 553171 - DNA, 25 bp, Homo sapien
atctatattctcgactaaagtctca

SEQ ID NO: 553172 - DNA, 25 bp, Homo sapien
ctatattctcgactaaagtctcatc

SEQ ID NO: 553173 - DNA, 25 bp, Homo sapien
atattctcgactaaagtctcatcag

SEQ ID NO: 553174 - DNA, 25 bp, Homo sapien
tattctcgactaaagtctcatcagg

SEQ ID NO: 553175 - DNA, 25 bp, Homo sapien
attctcgactaaagtctcatcagga

SEQ ID NO: 553176 - DNA, 25 bp, Homo sapien
gcgtctgtctaatgtggtgggtctt

SEQ ID NO: 553177 - DNA, 25 bp, Homo sapien
cgtctgtctaatgtggtgggtcttt

SEQ ID NO: 553178 - DNA, 25 bp, Homo sapien
gtctgtctaatgtggtgggtctttt

SEQ ID NO: 553179 - DNA, 25 bp, Homo sapien
tctgtctaatgtggtgggtcttttt

SEQ ID NO: 553180 - DNA, 25 bp, Homo sapien
ctgtctaatgtggtgggtctttttt

SEQ ID NO: 553181 - DNA, 25 bp, Homo sapien
tgtctaatgtggtgggtcttttttt

SEQ ID NO: 553182 - DNA, 25 bp, Homo sapien
ggaacttattattgatacacatgat

SEQ ID NO: 553183 - DNA, 25 bp, Homo sapien
atgaatctcaacatggatgggtttc

SEQ ID NO: 553184 - DNA, 25 bp, Homo sapien
tgggtttcaaaagcatcatgttaag

SEQ ID NO: 553185 - DNA, 25 bp, Homo sapien
aagagtgcatattatatggcctatt

SEQ ID NO: 553186 - DNA, 25 bp, Homo sapien
ttatatggcctatttatttcaaact

SEQ ID NO: 553187 - DNA, 25 bp, Homo sapien
tcaaactctagaattctgaagtcaa

SEQ ID NO: 553188 - DNA, 25 bp, Homo sapien
gaagtcaaatctaacgtatagccac

SEQ ID NO: 553189 - DNA, 25 bp, Homo sapien
taacgtatagccacagaaagcagaa

SEQ ID NO: 553190 - DNA, 25 bp, Homo sapien
tagttgactagggatggctgttcag

SEQ ID NO: 553191 - DNA, 25 bp, Homo sapien
ggctttagagaactttttgggtgat

SEQ ID NO: 553192 - DNA, 25 bp, Homo sapien
tttgggtgatggacacacactatat

SEQ ID NO: 553193 - DNA, 25 bp, Homo sapien
aatgtgccatttttttcactcagaa

SEQ ID NO: 553194 - DNA, 25 bp, Homo sapien
tttgaaactgctaattacacacgtg

SEQ ID NO: 553195 - DNA, 25 bp, Homo sapien
acacacgtgtgatgtatgttggttt

SEQ ID NO: 553196 - DNA, 25 bp, Homo sapien
tggttttttagtgcaatttcttctg

SEQ ID NO: 553197 - DNA, 25 bp, Homo sapien
gtgcaatttcttctgtagctattct

SEQ ID NO: 553198 - DNA, 25 bp, Homo sapien
ctgtagctattctttgaccaaactg

SEQ ID NO: 553199 - DNA, 25 bp, Homo sapien
tgaccaaactgtgggtattgttaat

SEQ ID NO: 553200 - DNA, 25 bp, Homo sapien
gtgtggtttataatctgacaaagtc

SEQ ID NO: 553201 - DNA, 25 bp, Homo sapien
tgacaaagtcatgaagctcagtttg

SEQ ID NO: 553202 - DNA, 25 bp, Homo sapien
tcagtttggctgtaatttaattccc

SEQ ID NO: 553203 - DNA, 25 bp, Homo sapien
atttatttttgtactgtgctgattc

SEQ ID NO: 553204 - DNA, 25 bp, Homo sapien
tggcctcgtccactgagggcacgat

SEQ ID NO: 553205 - DNA, 25 bp, Homo sapien
ggcctcgtccactgagggcacgatt

SEQ ID NO: 553206 - DNA, 25 bp, Homo sapien
gcctcgtccactgagggcacgattt

SEQ ID NO: 553207 - DNA, 25 bp, Homo sapien
cctcgtccactgagggcacgattta

SEQ ID NO: 553208 - DNA, 25 bp, Homo sapien
ctcgtccactgagggcacgatttaa

SEQ ID NO: 553209 - DNA, 25 bp, Homo sapien
tccactgagggcacgatttaaacat

SEQ ID NO: 553210 - DNA, 25 bp, Homo sapien
ccactgagggcacgatttaaacatt

SEQ ID NO: 553211 - DNA, 25 bp, Homo sapien
cactgagggcacgatttaaacattt

SEQ ID NO: 553212 - DNA, 25 bp, Homo sapien
actgagggcacgatttaaacatttg

SEQ ID NO: 553213 - DNA, 25 bp, Homo sapien
ctgagggcacgatttaaacatttga

SEQ ID NO: 553214 - DNA, 25 bp, Homo sapien
tgagggcacgatttaaacatttgac

SEQ ID NO: 553215 - DNA, 25 bp, Homo sapien
cttctaatatttcagtgactgttag

SEQ ID NO: 553216 - DNA, 25 bp, Homo sapien
tttcagtgactgttagaacataaac

SEQ ID NO: 553217 - DNA, 25 bp, Homo sapien
tatgttctgtgctttcggtcttggt

SEQ ID NO: 553218 - DNA, 25 bp, Homo sapien
tcaaatatgcccagaagtctgccta

SEQ ID NO: 553219 - DNA, 25 bp, Homo sapien
agaagtctgcctagttttcctttga

SEQ ID NO: 553220 - DNA, 25 bp, Homo sapien
aagtctgcctagttttcctttgact

SEQ ID NO: 553221 - DNA, 25 bp, Homo sapien
tgcctagttttcctttgactccagc

SEQ ID NO: 553222 - DNA, 25 bp, Homo sapien
cctagttttcctttgactccagcct

SEQ ID NO: 553223 - DNA, 25 bp, Homo sapien
tcataaacttccctcacggcagcac

SEQ ID NO: 553224 - DNA, 25 bp, Homo sapien
gccaggttcctcctcgggttccatt

SEQ ID NO: 553225 - DNA, 25 bp, Homo sapien
tcctcctgggacaatccactggtct

SEQ ID NO: 553226 - DNA, 25 bp, Homo sapien
ctgagtgtgagtgagcatgtcaagt

SEQ ID NO: 553227 - DNA, 25 bp, Homo sapien
gtgagtgagcatgtcaagttgtctg

SEQ ID NO: 553228 - DNA, 25 bp, Homo sapien
gtgagcatgtcaagttgtctgacac

SEQ ID NO: 553229 - DNA, 25 bp, Homo sapien
aagttgtctgacactgtgacattag

SEQ ID NO: 553230 - DNA, 25 bp, Homo sapien
gacactgtgacattagtgcacccta

SEQ ID NO: 553231 - DNA, 25 bp, Homo sapien
tgtgacattagtgcaccctactgac

SEQ ID NO: 553232 - DNA, 25 bp, Homo sapien
gacattagtgcaccctactgacaac

SEQ ID NO: 553233 - DNA, 25 bp, Homo sapien
tctcctctccctgttttgtacataa

SEQ ID NO: 553234 - DNA, 25 bp, Homo sapien
gtacataaattgacatgagctgcaa

SEQ ID NO: 553235 - DNA, 25 bp, Homo sapien
cataaattgacatgagctgcaacat

SEQ ID NO: 553236 - DNA, 25 bp, Homo sapien
gtgtcatggttttgttacctttttg

SEQ ID NO: 553237 - DNA, 25 bp, Homo sapien
tcaccacctctgagggtgccgatga

SEQ ID NO: 553238 - DNA, 25 bp, Homo sapien
tgggactcctcggtgggccaactat

SEQ ID NO: 553239 - DNA, 25 bp, Homo sapien
tcctcggtgggccaactatgtcaag

SEQ ID NO: 553240 - DNA, 25 bp, Homo sapien
gggccaactatgtcaagggagtgat

SEQ ID NO: 553241 - DNA, 25 bp, Homo sapien
aagggagtgattcagtactacccag

SEQ ID NO: 553242 - DNA, 25 bp, Homo sapien
gagtgattcagtactacccagctgc

SEQ ID NO: 553243 - DNA, 25 bp, Homo sapien
ctgtccagctcagcatccttggaag

SEQ ID NO: 553244 - DNA, 25 bp, Homo sapien
cttggaagtggccacgtacaccttc

SEQ ID NO: 553245 - DNA, 25 bp, Homo sapien
cagcagctctgtccagactcgggca

SEQ ID NO: 553246 - DNA, 25 bp, Homo sapien
ctctgtccagactcgggcacaatag

SEQ ID NO: 553247 - DNA, 25 bp, Homo sapien
agactcgggcacaatagctgcccgc

SEQ ID NO: 553248 - DNA, 25 bp, Homo sapien
ggaagacattaatcctagcattgtc

SEQ ID NO: 553249 - DNA, 25 bp, Homo sapien
aatcctagcattgtcatttatatac

SEQ ID NO: 553250 - DNA, 25 bp, Homo sapien
gaaatcctgatgaggacctgctttt

SEQ ID NO: 553251 - DNA, 25 bp, Homo sapien
tgatgaggacctgctttttgtttgt

SEQ ID NO: 553252 - DNA, 25 bp, Homo sapien
ctttgaaacccagccctattgtatt

SEQ ID NO: 553253 - DNA, 25 bp, Homo sapien
gaaacccagccctattgtatttgta

SEQ ID NO: 553254 - DNA, 25 bp, Homo sapien
acccagccctattgtatttgtattt

SEQ ID NO: 553255 - DNA, 25 bp, Homo sapien
gtataataatctgtaccttgtggta

SEQ ID NO: 553256 - DNA, 25 bp, Homo sapien
ccttgtggtatttggtactattaga

SEQ ID NO: 553257 - DNA, 25 bp, Homo sapien
tctagtggtttgatccaaatcccat

SEQ ID NO: 553258 - DNA, 25 bp, Homo sapien
gatccaaatcccattacagttgtat

SEQ ID NO: 553259 - DNA, 25 bp, Homo sapien
gaaattatccaacacagtaatattg

SEQ ID NO: 553260 - DNA, 25 bp, Homo sapien
atccaacacagtaatattggtacct

SEQ ID NO: 553261 - DNA, 25 bp, Homo sapien
aatattggtacctgtcattttttca

SEQ ID NO: 553262 - DNA, 25 bp, Homo sapien
gcaagataacttgggtaatcttcta

SEQ ID NO: 553263 - DNA, 25 bp, Homo sapien
aaaaactcactgttagtgactttga

SEQ ID NO: 553264 - DNA, 25 bp, Homo sapien
aactcactgttagtgactttgatgc

SEQ ID NO: 553265 - DNA, 25 bp, Homo sapien
ctcactgttagtgactttgatgcct

SEQ ID NO: 553266 - DNA, 25 bp, Homo sapien
tgttagtgactttgatgccttttaa

SEQ ID NO: 553267 - DNA, 25 bp, Homo sapien
taaagagatctctagcgtgtgtgaa

SEQ ID NO: 553268 - DNA, 25 bp, Homo sapien
aaagagatctctagcgtgtgtgaat

SEQ ID NO: 553269 - DNA, 25 bp, Homo sapien
aagagatctctagcgtgtgtgaata

SEQ ID NO: 553270 - DNA, 25 bp, Homo sapien
gctccttaattccaaacatcccatg

SEQ ID NO: 553271 - DNA, 25 bp, Homo sapien
aaacatcccatgagtatatcaagat

SEQ ID NO: 553272 - DNA, 25 bp, Homo sapien
aaggaccaagggacctctgtgactc

SEQ ID NO: 553273 - DNA, 25 bp, Homo sapien
ctgtgactcatagaagggctggctg

SEQ ID NO: 553274 - DNA, 25 bp, Homo sapien
ggctggctgaatcctgaagtagcat

SEQ ID NO: 553275 - DNA, 25 bp, Homo sapien
gaagtagcatagtgggacctggtct

SEQ ID NO: 553276 - DNA, 25 bp, Homo sapien
ggacctggtctacaatttatgcaca

SEQ ID NO: 553277 - DNA, 25 bp, Homo sapien
actgacagccttgctgtgccacgtg

SEQ ID NO: 553278 - DNA, 25 bp, Homo sapien
tgctgtgccacgtgtctcaccaaga

SEQ ID NO: 553279 - DNA, 25 bp, Homo sapien
gtgtctcaccaagacccagttggga

SEQ ID NO: 553280 - DNA, 25 bp, Homo sapien
aaagagcgtcatattgccaacaggt

SEQ ID NO: 553281 - DNA, 25 bp, Homo sapien
atctaggacttctatttaagttatt

SEQ ID NO: 553282 - DNA, 25 bp, Homo sapien
aataaatcttccttgagagccttgg

SEQ ID NO: 553283 - DNA, 25 bp, Homo sapien
gtcagggttataaatggcacagtgc

SEQ ID NO: 553284 - DNA, 25 bp, Homo sapien
aatggcacagtgcatttgctgtagg

SEQ ID NO: 553285 - DNA, 25 bp, Homo sapien
atttgctgtaggaatgtggtttggc

SEQ ID NO: 553286 - DNA, 25 bp, Homo sapien
ggtttggcattgttttatacacaca

SEQ ID NO: 553287 - DNA, 25 bp, Homo sapien
ataccttaatgcttattcttgatgg

SEQ ID NO: 553288 - DNA, 25 bp, Homo sapien
gcttattcttgatggcatctgtcag

SEQ ID NO: 553289 - DNA, 25 bp, Homo sapien
gcatctgtcagatattagaattgaa

SEQ ID NO: 553290 - DNA, 25 bp, Homo sapien
tgatgccctcatcaggtcgttaaaa

SEQ ID NO: 553291 - DNA, 25 bp, Homo sapien
gccctcatcaggtcgttaaaaattc

SEQ ID NO: 553292 - DNA, 25 bp, Homo sapien
ccaaaaccattagggctcagaggaa

SEQ ID NO: 553293 - DNA, 25 bp, Homo sapien
aaccattagggctcagaggaaggta

SEQ ID NO: 553294 - DNA, 25 bp, Homo sapien
cattagggctcagaggaaggtatcc

SEQ ID NO: 553295 - DNA, 25 bp, Homo sapien
ttagggctcagaggaaggtatccca

SEQ ID NO: 553296 - DNA, 25 bp, Homo sapien
agggctcagaggaaggtatcccaat

SEQ ID NO: 553297 - DNA, 25 bp, Homo sapien
ggctcagaggaaggtatcccaatga

SEQ ID NO: 553298 - DNA, 25 bp, Homo sapien
ctcagaggaaggtatcccaatgaat

SEQ ID NO: 553299 - DNA, 25 bp, Homo sapien
agaggaaggtatcccaatgaatatc

SEQ ID NO: 553300 - DNA, 25 bp, Homo sapien
ggaaggtatcccaatgaatatcaat

SEQ ID NO: 553301 - DNA, 25 bp, Homo sapien
gaaggtatcccaatgaatatcaatt

SEQ ID NO: 553302 - DNA, 25 bp, Homo sapien
aaggtatcccaatgaatatcaatta

SEQ ID NO: 553303 - DNA, 25 bp, Homo sapien
tggcattctgttttgatggattttc

SEQ ID NO: 553304 - DNA, 25 bp, Homo sapien
ttgatggattttcatttcttcgcac

SEQ ID NO: 553305 - DNA, 25 bp, Homo sapien
atttcttcgcacttctgagacggca

SEQ ID NO: 553306 - DNA, 25 bp, Homo sapien
tcttcgcacttctgagacggcaaag

SEQ ID NO: 553307 - DNA, 25 bp, Homo sapien
gcacttctgagacggcaaagccaac

SEQ ID NO: 553308 - DNA, 25 bp, Homo sapien
gacggcaaagccaaccacttagaag

SEQ ID NO: 553309 - DNA, 25 bp, Homo sapien
aagccaaccacttagaagccttcca

SEQ ID NO: 553310 - DNA, 25 bp, Homo sapien
ctgctctctgatgtacctctgggta

SEQ ID NO: 553311 - DNA, 25 bp, Homo sapien
ctctctgatgtacctctgggtagtg

SEQ ID NO: 553312 - DNA, 25 bp, Homo sapien
gtacctctgggtagtgagatggaaa

SEQ ID NO: 553313 - DNA, 25 bp, Homo sapien
ggggagaaggatacttttgcacagc

SEQ ID NO: 553314 - DNA, 25 bp, Homo sapien
gggcagtctggtacggaacatattt

SEQ ID NO: 553315 - DNA, 25 bp, Homo sapien
ggcagtctggtacggaacatattta

SEQ ID NO: 553316 - DNA, 25 bp, Homo sapien
agtctggtacggaacatatttattg

SEQ ID NO: 553317 - DNA, 25 bp, Homo sapien
tggtacggaacatatttattgcctc

SEQ ID NO: 553318 - DNA, 25 bp, Homo sapien
gtacggaacatatttattgcctcca

SEQ ID NO: 553319 - DNA, 25 bp, Homo sapien
ggaacatatttattgcctccatgca

SEQ ID NO: 553320 - DNA, 25 bp, Homo sapien
tatttattgcctccatgcatgtgtg

SEQ ID NO: 553321 - DNA, 25 bp, Homo sapien
gtgaggactggtgtgcgtggacacg

SEQ ID NO: 553322 - DNA, 25 bp, Homo sapien
ggctctttcagggaccacagaggag

SEQ ID NO: 553323 - DNA, 25 bp, Homo sapien
agccaccctgaaatccccaataatg

SEQ ID NO: 553324 - DNA, 25 bp, Homo sapien
gaaatccccaataatggtgcctcag

SEQ ID NO: 553325 - DNA, 25 bp, Homo sapien
gttccctcccagttagcttacagtg

SEQ ID NO: 553326 - DNA, 25 bp, Homo sapien
tagcttacagtgctacaggaccatg

SEQ ID NO: 553327 - DNA, 25 bp, Homo sapien
aggacacactccagttgccgtacca

SEQ ID NO: 553328 - DNA, 25 bp, Homo sapien
tgccgtaccagtggcacttctctgg

SEQ ID NO: 553329 - DNA, 25 bp, Homo sapien
acttctctgggttcttcacatggca

SEQ ID NO: 553330 - DNA, 25 bp, Homo sapien
atggcaccatcatccagaatactcc

SEQ ID NO: 553331 - DNA, 25 bp, Homo sapien
gataaagcaacttcgggagtagtgt

SEQ ID NO: 553332 - DNA, 25 bp, Homo sapien
tcagagaaggactcatgatttccag

SEQ ID NO: 553333 - DNA, 25 bp, Homo sapien
catgatttccaggagtcaaaagccc

SEQ ID NO: 553334 - DNA, 25 bp, Homo sapien
gtccaccaacagaactatgccagtt

SEQ ID NO: 553335 - DNA, 25 bp, Homo sapien
agaactatgccagttggtcttcatc

SEQ ID NO: 553336 - DNA, 25 bp, Homo sapien
gcaggtgaccagcagtgtcattgta

SEQ ID NO: 553337 - DNA, 25 bp, Homo sapien
caggtgaccagcagtgtcattgtat

SEQ ID NO: 553338 - DNA, 25 bp, Homo sapien
aggtgaccagcagtgtcattgtatt

SEQ ID NO: 553339 - DNA, 25 bp, Homo sapien
ggtgaccagcagtgtcattgtattt

SEQ ID NO: 553340 - DNA, 25 bp, Homo sapien
gtgaccagcagtgtcattgtattta

SEQ ID NO: 553341 - DNA, 25 bp, Homo sapien
tgaccagcagtgtcattgtatttat

SEQ ID NO: 553342 - DNA, 25 bp, Homo sapien
gaccagcagtgtcattgtatttata

SEQ ID NO: 553343 - DNA, 25 bp, Homo sapien
accagcagtgtcattgtatttatat

SEQ ID NO: 553344 - DNA, 25 bp, Homo sapien
gtatttatatacagagcttatgact

SEQ ID NO: 553345 - DNA, 25 bp, Homo sapien
tatttatatacagagcttatgactt

SEQ ID NO: 553346 - DNA, 25 bp, Homo sapien
atttatatacagagcttatgacttt

SEQ ID NO: 553347 - DNA, 25 bp, Homo sapien
gattcacttaacttcctactttata

SEQ ID NO: 553348 - DNA, 25 bp, Homo sapien
aagctgccaaagaacacatcccaag

SEQ ID NO: 553349 - DNA, 25 bp, Homo sapien
acacatcccaagcagtaatcacaga

SEQ ID NO: 553350 - DNA, 25 bp, Homo sapien
gatgaagcaccttacaggacccctc

SEQ ID NO: 553351 - DNA, 25 bp, Homo sapien
tcaaacgcgcatgtccagagaagta

SEQ ID NO: 553352 - DNA, 25 bp, Homo sapien
gtccagagaagtattaatgccttaa

SEQ ID NO: 553353 - DNA, 25 bp, Homo sapien
ttaatgccttaatagactactgaag

SEQ ID NO: 553354 - DNA, 25 bp, Homo sapien
gactactgaaggttaactatttaca

SEQ ID NO: 553355 - DNA, 25 bp, Homo sapien
aggttaactatttacatcattctaa

SEQ ID NO: 553356 - DNA, 25 bp, Homo sapien
tgtattacagtgctataaattctcc

SEQ ID NO: 553357 - DNA, 25 bp, Homo sapien
tagattgtttccttaccgtgtttga

SEQ ID NO: 553358 - DNA, 25 bp, Homo sapien
actgggctttattttcgctgaagga

SEQ ID NO: 553359 - DNA, 25 bp, Homo sapien
cgctgaaggaactgtgttgggaccc

SEQ ID NO: 553360 - DNA, 25 bp, Homo sapien
tgttgggacccttgacatctgtcag

SEQ ID NO: 553361 - DNA, 25 bp, Homo sapien
gacatctgtcaggtttgcacatgct

SEQ ID NO: 553362 - DNA, 25 bp, Homo sapien
gcagcaggacagacagtgaatcaca

SEQ ID NO: 553363 - DNA, 25 bp, Homo sapien
gaatcacagagtctgccctgagcag

SEQ ID NO: 553364 - DNA, 25 bp, Homo sapien
gggactcctagccatggtcagactg

SEQ ID NO: 553365 - DNA, 25 bp, Homo sapien
tggtcagactgtacaaaacggtttt

SEQ ID NO: 553366 - DNA, 25 bp, Homo sapien
gaaaatgttactgaaagtcactttt

SEQ ID NO: 553367 - DNA, 25 bp, Homo sapien
gtcacttttatgagcatctgcctta

SEQ ID NO: 553368 - DNA, 25 bp, Homo sapien
ttaataaacagacattgattccctt

SEQ ID NO: 553369 - DNA, 25 bp, Homo sapien
gtatgtactgtattgtcatcaagga

SEQ ID NO: 553370 - DNA, 25 bp, Homo sapien
gtcatcaaggatactgtcccttatt

SEQ ID NO: 553371 - DNA, 25 bp, Homo sapien
actgtcccttatttgaaggcatcta

SEQ ID NO: 553372 - DNA, 25 bp, Homo sapien
aactgttttcagatccaagtgctca

SEQ ID NO: 553373 - DNA, 25 bp, Homo sapien
agtgctcagatctaaagcctctgca

SEQ ID NO: 553374 - DNA, 25 bp, Homo sapien
agcctctgcaacaagtcaggtggtg

SEQ ID NO: 553375 - DNA, 25 bp, Homo sapien
aagtcaggtggtggtcatgtttccc

SEQ ID NO: 553376 - DNA, 25 bp, Homo sapien
tggtggtcatgtttcccttctagtt

SEQ ID NO: 553377 - DNA, 25 bp, Homo sapien
tctagttttggctgacaggaagctc

SEQ ID NO: 553378 - DNA, 25 bp, Homo sapien
caggaagctcagttcagtaccataa

SEQ ID NO: 553379 - DNA, 25 bp, Homo sapien
agtaccataactacagaacctgtca

SEQ ID NO: 553380 - DNA, 25 bp, Homo sapien
attactagtccaggtggtagatgac

SEQ ID NO: 553381 - DNA, 25 bp, Homo sapien
ccaggtggtagatgacagattttta

SEQ ID NO: 553382 - DNA, 25 bp, Homo sapien
ttttattatttacacttctctcaaa

SEQ ID NO: 553383 - DNA, 25 bp, Homo sapien
ataaaccctcatataattccctaag

SEQ ID NO: 553384 - DNA, 25 bp, Homo sapien
attccctaagatgggtggcatgcca

SEQ ID NO: 553385 - DNA, 25 bp, Homo sapien
gatgggtggcatgccaagtagctaa

SEQ ID NO: 553386 - DNA, 25 bp, Homo sapien
ccagcccaaaagtacttattcgaat

SEQ ID NO: 553387 - DNA, 25 bp, Homo sapien
aattaggtaccctattatcatggta

SEQ ID NO: 553388 - DNA, 25 bp, Homo sapien
tcttttttggccagcttttctagat

SEQ ID NO: 553389 - DNA, 25 bp, Homo sapien
ggccagcttttctagataaggttgt

SEQ ID NO: 553390 - DNA, 25 bp, Homo sapien
aaggttgtattgctactgcaactaa

SEQ ID NO: 553391 - DNA, 25 bp, Homo sapien
ggagtcagtatttttattcgccttc

SEQ ID NO: 553392 - DNA, 25 bp, Homo sapien
atttttattcgccttctagaacttg

SEQ ID NO: 553393 - DNA, 25 bp, Homo sapien
atccacacatcacccatttatatta

SEQ ID NO: 553394 - DNA, 25 bp, Homo sapien
aaaggcttaccttctgtcatcaagt

SEQ ID NO: 553395 - DNA, 25 bp, Homo sapien
agtgattgtatcatcctggatcgtc

SEQ ID NO: 553396 - DNA, 25 bp, Homo sapien
gtatcatcctggatcgtcatttcca

SEQ ID NO: 553397 - DNA, 25 bp, Homo sapien
gtcatttccaaggaactagcctttc

SEQ ID NO: 553398 - DNA, 25 bp, Homo sapien
gcctttcttttcctaagcgtctgta

SEQ ID NO: 553399 - DNA, 25 bp, Homo sapien
cctaagcgtctgtatgtgttctaaa

SEQ ID NO: 553400 - DNA, 25 bp, Homo sapien
gtatgtgttctaaaacttccagtat

SEQ ID NO: 553401 - DNA, 25 bp, Homo sapien
gtagcaagtcttactggagtaccta

SEQ ID NO: 553402 - DNA, 25 bp, Homo sapien
tggcaagttttgatatgagtataca

SEQ ID NO: 553403 - DNA, 25 bp, Homo sapien
tttggtctctatttcattttttgca

SEQ ID NO: 553404 - DNA, 25 bp, Homo sapien
aaatatgtctcgctagtgatgtttt

SEQ ID NO: 553405 - DNA, 25 bp, Homo sapien
gtctcgctagtgatgtttttatgat

SEQ ID NO: 553406 - DNA, 25 bp, Homo sapien
gtgatgtttttatgatatccctgat

SEQ ID NO: 553407 - DNA, 25 bp, Homo sapien
atgatatccctgatcctaactgaag

SEQ ID NO: 553408 - DNA, 25 bp, Homo sapien
atccctgatcctaactgaagagaca

SEQ ID NO: 553409 - DNA, 25 bp, Homo sapien
gagacagttatttatagtcatttat

SEQ ID NO: 553410 - DNA, 25 bp, Homo sapien
attaggttaacattgttgctccctg

SEQ ID NO: 553411 - DNA, 25 bp, Homo sapien
taacattgttgctccctgtgacaaa

SEQ ID NO: 553412 - DNA, 25 bp, Homo sapien
gttgctccctgtgacaaaattttat

SEQ ID NO: 553413 - DNA, 25 bp, Homo sapien
gacagtttgggtgtaggttactgat

SEQ ID NO: 553414 - DNA, 25 bp, Homo sapien
tttgggtgtaggttactgatgtctc

SEQ ID NO: 553415 - DNA, 25 bp, Homo sapien
gggtgtaggttactgatgtctcaac

SEQ ID NO: 553416 - DNA, 25 bp, Homo sapien
gtgtaggttactgatgtctcaactg

SEQ ID NO: 553417 - DNA, 25 bp, Homo sapien
gtaggttactgatgtctcaactgaa

SEQ ID NO: 553418 - DNA, 25 bp, Homo sapien
taggttactgatgtctcaactgaat

SEQ ID NO: 553419 - DNA, 25 bp, Homo sapien
tataagctgctgttggctattatgc

SEQ ID NO: 553420 - DNA, 25 bp, Homo sapien
taagctgctgttggctattatgctg

SEQ ID NO: 553421 - DNA, 25 bp, Homo sapien
gggcaatttcctgttgcaagggtct

SEQ ID NO: 553422 - DNA, 25 bp, Homo sapien
tgaaaggcaagttcacctgaaattt

SEQ ID NO: 553423 - DNA, 25 bp, Homo sapien
aggcaagttcacctgaaattttgta

SEQ ID NO: 553424 - DNA, 25 bp, Homo sapien
gtaccagaaaggttttcagcgcgcc

SEQ ID NO: 553425 - DNA, 25 bp, Homo sapien
gaaaggttttcagcgcgccgaccta

SEQ ID NO: 553426 - DNA, 25 bp, Homo sapien
gctaagagggctgaaataagaacca

SEQ ID NO: 553427 - DNA, 25 bp, Homo sapien
taagaaccagtgactgagcgccggg

SEQ ID NO: 553428 - DNA, 25 bp, Homo sapien
tggaagatgttcatcgcgccgtacc

SEQ ID NO: 553429 - DNA, 25 bp, Homo sapien
gcgccgtaccctactagaggtttgg

SEQ ID NO: 553430 - DNA, 25 bp, Homo sapien
gcggaccccgtgataaatacacaga

SEQ ID NO: 553431 - DNA, 25 bp, Homo sapien
actaccgccttgaatctggacagct

SEQ ID NO: 553432 - DNA, 25 bp, Homo sapien
aatctggacagctacctcaggtggt

SEQ ID NO: 553433 - DNA, 25 bp, Homo sapien
gctacctcaggtggttaatatctaa

SEQ ID NO: 553434 - DNA, 25 bp, Homo sapien
atatctaacaggagcagagtggagc

SEQ ID NO: 553435 - DNA, 25 bp, Homo sapien
cagccttgtattccatactcagaga

SEQ ID NO: 553436 - DNA, 25 bp, Homo sapien
ttgtattccatactcagagaccctg

SEQ ID NO: 553437 - DNA, 25 bp, Homo sapien
tacttacttgacatctcaacttgaa

SEQ ID NO: 553438 - DNA, 25 bp, Homo sapien
gacatctcaacttgaaagtccaatt

SEQ ID NO: 553439 - DNA, 25 bp, Homo sapien
gtccaattaatatgcacttcaaact

SEQ ID NO: 553440 - DNA, 25 bp, Homo sapien
tcaaactttaataggcttcaaacag

SEQ ID NO: 553441 - DNA, 25 bp, Homo sapien
aactttaataggcttcaaacagaat

SEQ ID NO: 553442 - DNA, 25 bp, Homo sapien
atcatcttgaaattagtgaatggca

SEQ ID NO: 553443 - DNA, 25 bp, Homo sapien
agaatccaactgtttcattcccact

SEQ ID NO: 553444 - DNA, 25 bp, Homo sapien
gaatccaactgtttcattcccactt

SEQ ID NO: 553445 - DNA, 25 bp, Homo sapien
tccaactgtttcattcccacttctg

SEQ ID NO: 553446 - DNA, 25 bp, Homo sapien
tgggaacacggctcaggacctagct

SEQ ID NO: 553447 - DNA, 25 bp, Homo sapien
aggacctagctatcctggacatgcg

SEQ ID NO: 553448 - DNA, 25 bp, Homo sapien
tggacatgcgcctgggttctaatag

SEQ ID NO: 553449 - DNA, 25 bp, Homo sapien
atgcgcctgggttctaatagaggat

SEQ ID NO: 553450 - DNA, 25 bp, Homo sapien
gaggatgggttcaatcctgacccac

SEQ ID NO: 553451 - DNA, 25 bp, Homo sapien
gttcaatcctgacccaccgttcagg

SEQ ID NO: 553452 - DNA, 25 bp, Homo sapien
ggccccgcagcggttcagaatcaag

SEQ ID NO: 553453 - DNA, 25 bp, Homo sapien
gttcagaatcaagctggagttcatt

SEQ ID NO: 553454 - DNA, 25 bp, Homo sapien
tcaagctggagttcattaatgataa

SEQ ID NO: 553455 - DNA, 25 bp, Homo sapien
atagtatgtgtaatgttgtccagta

SEQ ID NO: 553456 - DNA, 25 bp, Homo sapien
gtaatgttgtccagtaataaaagct

SEQ ID NO: 553457 - DNA, 25 bp, Homo sapien
aggcctctgcgtggctttctgcaca

SEQ ID NO: 553458 - DNA, 25 bp, Homo sapien
gacacagacacgtgggcagaactcc

SEQ ID NO: 553459 - DNA, 25 bp, Homo sapien
acacgtgggcagaactccagggaga

SEQ ID NO: 553460 - DNA, 25 bp, Homo sapien
cagcaagggagaaccatgtgtggcc

SEQ ID NO: 553461 - DNA, 25 bp, Homo sapien
gtggccctgctttttctcaaaccct

SEQ ID NO: 553462 - DNA, 25 bp, Homo sapien
tcaaaccctgtgtggttcccggctt

SEQ ID NO: 553463 - DNA, 25 bp, Homo sapien
tggctttctgcacacggtggtatga

SEQ ID NO: 553464 - DNA, 25 bp, Homo sapien
gttcccggcttcacagttgatggga

SEQ ID NO: 553465 - DNA, 25 bp, Homo sapien
gccccaaggatattttgacattgtg

SEQ ID NO: 553466 - DNA, 25 bp, Homo sapien
tgcacacggtggtatgactgagata

SEQ ID NO: 553467 - DNA, 25 bp, Homo sapien
ccctgggtttccttcagaagcagaa

SEQ ID NO: 553468 - DNA, 25 bp, Homo sapien
ccaagctgtttgtgatggcatcagt

SEQ ID NO: 553469 - DNA, 25 bp, Homo sapien
aagccctgtagccttctcctgggag

SEQ ID NO: 553470 - DNA, 25 bp, Homo sapien
tattttttcagattccctaagtgct

SEQ ID NO: 553471 - DNA, 25 bp, Homo sapien
gagtacattttaagggcacttggaa

SEQ ID NO: 553472 - DNA, 25 bp, Homo sapien
ttgtgatggcatcagtctcctcatt

SEQ ID NO: 553473 - DNA, 25 bp, Homo sapien
gagtgaggtgggatctattctccta

SEQ ID NO: 553474 - DNA, 25 bp, Homo sapien
gtgggatctattctcctaagtacca

SEQ ID NO: 553475 - DNA, 25 bp, Homo sapien
tattctcctaagtaccaaggctgta

SEQ ID NO: 553476 - DNA, 25 bp, Homo sapien
accaaggctgtagaaccataagtta

SEQ ID NO: 553477 - DNA, 25 bp, Homo sapien
cagtctcctcatttaagactgacat

SEQ ID NO: 553478 - DNA, 25 bp, Homo sapien
gatcctgtctgcttggaggcattat

SEQ ID NO: 553479 - DNA, 25 bp, Homo sapien
ctgtgaagccaggatgcctgggcat

SEQ ID NO: 553480 - DNA, 25 bp, Homo sapien
gatgcctgggcattccctggcaaga

SEQ ID NO: 553481 - DNA, 25 bp, Homo sapien
cctggcaagaccaccgcaggatggg

SEQ ID NO: 553482 - DNA, 25 bp, Homo sapien
ggatgggcagcagagctctgaccta

SEQ ID NO: 553483 - DNA, 25 bp, Homo sapien
gggcagcagagctctgacctaagaa

SEQ ID NO: 553484 - DNA, 25 bp, Homo sapien
gacctaagaagctggacttttgggc

SEQ ID NO: 553485 - DNA, 25 bp, Homo sapien
aagctggacttttgggcagtctgcc

SEQ ID NO: 553486 - DNA, 25 bp, Homo sapien
gtgtcctcagaacactctactcgca

SEQ ID NO: 553487 - DNA, 25 bp, Homo sapien
ctcccggtgatccatgaactctgac

SEQ ID NO: 553488 - DNA, 25 bp, Homo sapien
ggtgatccatgaactctgacccctc

SEQ ID NO: 553489 - DNA, 25 bp, Homo sapien
cctccccagtaaaggcttctgtaga

SEQ ID NO: 553490 - DNA, 25 bp, Homo sapien
cctgctagattttataatggatttg

SEQ ID NO: 553491 - DNA, 25 bp, Homo sapien
aaatacccagggttctcagaatgga

SEQ ID NO: 553492 - DNA, 25 bp, Homo sapien
tacccagggttctcagaatggaata

SEQ ID NO: 553493 - DNA, 25 bp, Homo sapien
gaatggaataaatatcccttttaat

SEQ ID NO: 553494 - DNA, 25 bp, Homo sapien
acaactgttagctttaattggcagc

SEQ ID NO: 553495 - DNA, 25 bp, Homo sapien
taattggcagctctcttcttttttc

SEQ ID NO: 553496 - DNA, 25 bp, Homo sapien
tcttcttttcactggctttttactt

SEQ ID NO: 553497 - DNA, 25 bp, Homo sapien
ttcactggctttttacttggtgctt

SEQ ID NO: 553498 - DNA, 25 bp, Homo sapien
gctttttacttggtgctttttcttg

SEQ ID NO: 553499 - DNA, 25 bp, Homo sapien
tgttttgcactggtggtctgtgttc

SEQ ID NO: 553500 - DNA, 25 bp, Homo sapien
gcactggtggtctgtgttctgtgaa

SEQ ID NO: 553501 - DNA, 25 bp, Homo sapien
atgaactcagatttgcaaaccaggt

SEQ ID NO: 553502 - DNA, 25 bp, Homo sapien
ggtaaggtgtatgcttttaactttg

SEQ ID NO: 553503 - DNA, 25 bp, Homo sapien
gtataaacacccagcggaaacgtat

SEQ ID NO: 553504 - DNA, 25 bp, Homo sapien
gtatacctttcagtgcatagtgcat

SEQ ID NO: 553505 - DNA, 25 bp, Homo sapien
gcatagtgcattgtgtgcttaccct

SEQ ID NO: 553506 - DNA, 25 bp, Homo sapien
tgtgtgcttaccctgggttgtttaa

SEQ ID NO: 553507 - DNA, 25 bp, Homo sapien
ccctccaagtgaaagcctgtcggga

SEQ ID NO: 553508 - DNA, 25 bp, Homo sapien
agtaacacctttactgttctcccat

SEQ ID NO: 553509 - DNA, 25 bp, Homo sapien
actgttctcccattgatgatcatat

SEQ ID NO: 553510 - DNA, 25 bp, Homo sapien
tgatcatatacgttacctcttccta

SEQ ID NO: 553511 - DNA, 25 bp, Homo sapien
acgttacctcttcctagcggtacat

SEQ ID NO: 553512 - DNA, 25 bp, Homo sapien
aaatctttgcctgttagaaaacact

SEQ ID NO: 553513 - DNA, 25 bp, Homo sapien
cactactttcagacatttaaatgca

SEQ ID NO: 553514 - DNA, 25 bp, Homo sapien
gcatataggcaatgcttaagtacct

SEQ ID NO: 553515 - DNA, 25 bp, Homo sapien
taggcaatgcttaagtacctaaaaa

SEQ ID NO: 553516 - DNA, 25 bp, Homo sapien
gaaattactgaggtatctctattaa

SEQ ID NO: 553517 - DNA, 25 bp, Homo sapien
tctctattaagagtgacatattcat

SEQ ID NO: 553518 - DNA, 25 bp, Homo sapien
caagaaattgttgcatttatcattt

SEQ ID NO: 553519 - DNA, 25 bp, Homo sapien
cattttaatgcaaagtagtatcaag

SEQ ID NO: 553520 - DNA, 25 bp, Homo sapien
gaggtaggaatctcagttctgtgtt

SEQ ID NO: 553521 - DNA, 25 bp, Homo sapien
gtaggaatctcagttctgtgtttta

SEQ ID NO: 553522 - DNA, 25 bp, Homo sapien
gttttaatgtggaattcttatgctt

SEQ ID NO: 553523 - DNA, 25 bp, Homo sapien
tccccacctcagacgggacgcccag

SEQ ID NO: 553524 - DNA, 25 bp, Homo sapien
acgggacgcccagtccagagctggt

SEQ ID NO: 553525 - DNA, 25 bp, Homo sapien
cgggacgcccagtccagagctggtg

SEQ ID NO: 553526 - DNA, 25 bp, Homo sapien
ggcctgccccattcaccggccagcg

SEQ ID NO: 553527 - DNA, 25 bp, Homo sapien
cagagatggttggtccacagggcta

SEQ ID NO: 553528 - DNA, 25 bp, Homo sapien
gatggttggtccacagggctagccc

SEQ ID NO: 553529 - DNA, 25 bp, Homo sapien
atggttggtccacagggctagccct

SEQ ID NO: 553530 - DNA, 25 bp, Homo sapien
cccagggtcagggtgagagagagct

SEQ ID NO: 553531 - DNA, 25 bp, Homo sapien
gtcagggtgagagagagctgggcca

SEQ ID NO: 553532 - DNA, 25 bp, Homo sapien
cagggtgagagagagctgggccagg

SEQ ID NO: 553533 - DNA, 25 bp, Homo sapien
gctgctgcaggatgattttgaggtg

SEQ ID NO: 553534 - DNA, 25 bp, Homo sapien
tgcagacaacatattagcacattgc

SEQ ID NO: 553535 - DNA, 25 bp, Homo sapien
ttctcatttgttttaatccatgttc

SEQ ID NO: 553536 - DNA, 25 bp, Homo sapien
tttgttttaatccatgttcttccca

SEQ ID NO: 553537 - DNA, 25 bp, Homo sapien
gttttaatccatgttcttcccattt

SEQ ID NO: 553538 - DNA, 25 bp, Homo sapien
atccatgttcttcccatttatacag

SEQ ID NO: 553539 - DNA, 25 bp, Homo sapien
gttcttcccatttatacaggagcaa

SEQ ID NO: 553540 - DNA, 25 bp, Homo sapien
cagcagagagaattactatggttgt

SEQ ID NO: 553541 - DNA, 25 bp, Homo sapien
ttgtataccttttctcgctccttgc

SEQ ID NO: 553542 - DNA, 25 bp, Homo sapien
tccttgctcctcaaatgccttagag

SEQ ID NO: 553543 - DNA, 25 bp, Homo sapien
cttgctcctcaaatgccttagagtt

SEQ ID NO: 553544 - DNA, 25 bp, Homo sapien
atgccttagagtttaaaatctattg

SEQ ID NO: 553545 - DNA, 25 bp, Homo sapien
acatagcgcatgtcacttgctggtt

SEQ ID NO: 553546 - DNA, 25 bp, Homo sapien
cttgctggtttggtgatggctttgc

SEQ ID NO: 553547 - DNA, 25 bp, Homo sapien
aggtgctgaggatcaagccggcttc

SEQ ID NO: 553548 - DNA, 25 bp, Homo sapien
atcaagccggcttctgagcctgttc

SEQ ID NO: 553549 - DNA, 25 bp, Homo sapien
tgagcctgttcatatgactggccct

SEQ ID NO: 553550 - DNA, 25 bp, Homo sapien
ctgttcatatgactggccctgtggg

SEQ ID NO: 553551 - DNA, 25 bp, Homo sapien
tccttggtgtctctagggtcttaag

SEQ ID NO: 553552 - DNA, 25 bp, Homo sapien
tagggtcttaaggagcctccctcat

SEQ ID NO: 553553 - DNA, 25 bp, Homo sapien
agcctccctcatgtctttaaggtag

SEQ ID NO: 553554 - DNA, 25 bp, Homo sapien
aaggtagcatcattgatctttggat

SEQ ID NO: 553555 - DNA, 25 bp, Homo sapien
ctttggatgtggcttttggattttc

SEQ ID NO: 553556 - DNA, 25 bp, Homo sapien
ggataaatgagattttacaaaattc

SEQ ID NO: 553557 - DNA, 25 bp, Homo sapien
acaaaattcaatcatttaaggacaa

SEQ ID NO: 553558 - DNA, 25 bp, Homo sapien
caaaattcaatcatttaaggacaaa

SEQ ID NO: 553559 - DNA, 25 bp, Homo sapien
attcaatcatttaaggacaaatttg

SEQ ID NO: 553560 - DNA, 25 bp, Homo sapien
caatcatttaaggacaaatttgagt

SEQ ID NO: 553561 - DNA, 25 bp, Homo sapien
tcatttaaggacaaatttgagttct

SEQ ID NO: 553562 - DNA, 25 bp, Homo sapien
caagcgattctcctcactttgtttt

SEQ ID NO: 553563 - DNA, 25 bp, Homo sapien
aagcgattctcctcactttgttttt

SEQ ID NO: 553564 - DNA, 25 bp, Homo sapien
agcgattctcctcactttgtttttg

SEQ ID NO: 553565 - DNA, 25 bp, Homo sapien
gcgattctcctcactttgtttttgt

SEQ ID NO: 553566 - DNA, 25 bp, Homo sapien
cgattctcctcactttgtttttgta

SEQ ID NO: 553567 - DNA, 25 bp, Homo sapien
tgggaccctaccataaccctcagga

SEQ ID NO: 553568 - DNA, 25 bp, Homo sapien
ggaaacttaccactactatcagctt

SEQ ID NO: 553569 - DNA, 25 bp, Homo sapien
gctgccctgagaagatacgtcacaa

SEQ ID NO: 553570 - DNA, 25 bp, Homo sapien
tacgtcacaaaagccttagcctggg

SEQ ID NO: 553571 - DNA, 25 bp, Homo sapien
ccttagcctgggtgaagtgctggat

SEQ ID NO: 553572 - DNA, 25 bp, Homo sapien
ggaccgaatggctgagtctttgtat

SEQ ID NO: 553573 - DNA, 25 bp, Homo sapien
gtctttgtatgagatccgctttcgg

SEQ ID NO: 553574 - DNA, 25 bp, Homo sapien
agaattctgtgccacatgcagctca

SEQ ID NO: 553575 - DNA, 25 bp, Homo sapien
atgcagctcagttctgcacaggtgg

SEQ ID NO: 553576 - DNA, 25 bp, Homo sapien
gctgcgccaggccattgaagaactg

SEQ ID NO: 553577 - DNA, 25 bp, Homo sapien
gtggtagatgacttgccaatccggg

SEQ ID NO: 553578 - DNA, 25 bp, Homo sapien
gacagtttgggtgtaggttactgat

SEQ ID NO: 553579 - DNA, 25 bp, Homo sapien
gggtgtaggttactgatgtctcaac

SEQ ID NO: 553580 - DNA, 25 bp, Homo sapien
gtgtaggttactgatgtctcaactg

SEQ ID NO: 553581 - DNA, 25 bp, Homo sapien
taggttactgatgtctcaactgaat

SEQ ID NO: 553582 - DNA, 25 bp, Homo sapien
tataagctgctgttggctattatgc

SEQ ID NO: 553583 - DNA, 25 bp, Homo sapien
taagctgctgttggctattatgctg

SEQ ID NO: 553584 - DNA, 25 bp, Homo sapien
gggcaatttcctgttgcaagggtct

SEQ ID NO: 553585 - DNA, 25 bp, Homo sapien
tgaaaggcaagttcacctgaaattt

SEQ ID NO: 553586 - DNA, 25 bp, Homo sapien
aggcaagttcacctgaaattttgta

SEQ ID NO: 553587 - DNA, 25 bp, Homo sapien
gtgattactgattgcctgattttaa

SEQ ID NO: 553588 - DNA, 25 bp, Homo sapien
aaatgttgccttctgggacatcttc

SEQ ID NO: 553589 - DNA, 25 bp, Homo sapien
gatgactgtggtggtttgtcgctaa

SEQ ID NO: 553590 - DNA, 25 bp, Homo sapien
gtttgtcgctaaggaggcaacagta

SEQ ID NO: 553591 - DNA, 25 bp, Homo sapien
cgtagagcagttagcatgatccatg

SEQ ID NO: 553592 - DNA, 25 bp, Homo sapien
gcatgatccatggttattccttact

SEQ ID NO: 553593 - DNA, 25 bp, Homo sapien
ggttattccttactcatgaacagtg

SEQ ID NO: 553594 - DNA, 25 bp, Homo sapien
tcatgaacagtgtcggcgcacctca

SEQ ID NO: 553595 - DNA, 25 bp, Homo sapien
ggcgcacctcattatctgtgcattt

SEQ ID NO: 553596 - DNA, 25 bp, Homo sapien
tcattatctgtgcatttgtttttcc

SEQ ID NO: 553597 - DNA, 25 bp, Homo sapien
ttttcctgggcagtcctgtcagcca

SEQ ID NO: 553598 - DNA, 25 bp, Homo sapien
tgtcagccagttaatccaccagctc

SEQ ID NO: 553599 - DNA, 25 bp, Homo sapien
agttaatccaccagctcttaggaag

SEQ ID NO: 553600 - DNA, 25 bp, Homo sapien
atttttcagctacagtactgagttt

SEQ ID NO: 553601 - DNA, 25 bp, Homo sapien
gtactgagttttttctgcctatggg

SEQ ID NO: 553602 - DNA, 25 bp, Homo sapien
ttctgcctatgggatagtaaccaca

SEQ ID NO: 553603 - DNA, 25 bp, Homo sapien
gtaaccacagtcttaaatcactaaa

SEQ ID NO: 553604 - DNA, 25 bp, Homo sapien
gactgtatttttgtataatgtccca

SEQ ID NO: 553605 - DNA, 25 bp, Homo sapien
gaaagcaacagtccttataattaga

SEQ ID NO: 553606 - DNA, 25 bp, Homo sapien
gcaaaagttttgcatacccaaatga

SEQ ID NO: 553607 - DNA, 25 bp, Homo sapien
aggtactgtggaccccatgtcaaac

SEQ ID NO: 553608 - DNA, 25 bp, Homo sapien
ggaccccatgtcaaactgttaaata

SEQ ID NO: 553609 - DNA, 25 bp, Homo sapien
gctgcatatctgttactttgtagaa

SEQ ID NO: 553610 - DNA, 25 bp, Homo sapien
tcttatcaaggtacattatttttca

SEQ ID NO: 553611 - DNA, 25 bp, Homo sapien
cccagccatgcctaaaatatttcta

SEQ ID NO: 553612 - DNA, 25 bp, Homo sapien
cagccatgcctaaaatatttctaat

SEQ ID NO: 553613 - DNA, 25 bp, Homo sapien
aatatttctaattaccactttcaat

SEQ ID NO: 553614 - DNA, 25 bp, Homo sapien
acaaaattcaatcatttaaggacaa

SEQ ID NO: 553615 - DNA, 25 bp, Homo sapien
tcatttaaggacaaatttgagttct

SEQ ID NO: 553616 - DNA, 25 bp, Homo sapien
aaggacaaatttgagttctgaatac

SEQ ID NO: 553617 - DNA, 25 bp, Homo sapien
caagcgattctcctcactttgtttt

SEQ ID NO: 553618 - DNA, 25 bp, Homo sapien
aagcgattctcctcactttgttttt

SEQ ID NO: 553619 - DNA, 25 bp, Homo sapien
agcgattctcctcactttgtttttg

SEQ ID NO: 553620 - DNA, 25 bp, Homo sapien
gcgattctcctcactttgtttttgt

SEQ ID NO: 553621 - DNA, 25 bp, Homo sapien
cgattctcctcactttgtttttgta

SEQ ID NO: 553622 - DNA, 25 bp, Homo sapien
gggtgcctcacaagcacagcacctt

SEQ ID NO: 553623 - DNA, 25 bp, Homo sapien
aagcacagcaccttggctccatcgg

SEQ ID NO: 553624 - DNA, 25 bp, Homo sapien
gctccatcggctgcttgagagaggt

SEQ ID NO: 553625 - DNA, 25 bp, Homo sapien
agtcccgccgtagtgctcctggatg

SEQ ID NO: 553626 - DNA, 25 bp, Homo sapien
agtgctcctggatgtgccgcatggc

SEQ ID NO: 553627 - DNA, 25 bp, Homo sapien
gcggaggcctccagcagtgtcaccg

SEQ ID NO: 553628 - DNA, 25 bp, Homo sapien
agtgtcaccgtgcagccaccgaagc

SEQ ID NO: 553629 - DNA, 25 bp, Homo sapien
tcatgcggctgccataaaccccagg

SEQ ID NO: 553630 - DNA, 25 bp, Homo sapien
tgccataaaccccaggcacagcaag

SEQ ID NO: 553631 - DNA, 25 bp, Homo sapien
agtttattgagcacccggatatgga

SEQ ID NO: 553632 - DNA, 25 bp, Homo sapien
gatatggaagatggcaccgggcaca

SEQ ID NO: 553633 - DNA, 25 bp, Homo sapien
cctcttttgggctttgctagtcacc

SEQ ID NO: 553634 - DNA, 25 bp, Homo sapien
acagcaggcatacccagacagagca

SEQ ID NO: 553635 - DNA, 25 bp, Homo sapien
agacagagcaccctcaaacccggga

SEQ ID NO: 553636 - DNA, 25 bp, Homo sapien
caaacccgggatgcttccttttcat

SEQ ID NO: 553637 - DNA, 25 bp, Homo sapien
atttattccacacacttgagccaca

SEQ ID NO: 553638 - DNA, 25 bp, Homo sapien
tattccacacacttgagccacacgg

SEQ ID NO: 553639 - DNA, 25 bp, Homo sapien
aggccaaggtaatgcagttctctgt

SEQ ID NO: 553640 - DNA, 25 bp, Homo sapien
ctctgtgatttcaaggattcttcca

SEQ ID NO: 553641 - DNA, 25 bp, Homo sapien
gatttcaaggattcttccagctcta

SEQ ID NO: 553642 - DNA, 25 bp, Homo sapien
aaggattcttccagctctaactttt

SEQ ID NO: 553643 - DNA, 25 bp, Homo sapien
ggattcttccagctctaactttttt

SEQ ID NO: 553644 - DNA, 25 bp, Homo sapien
tgtaacctaaggagggtcttataga

SEQ ID NO: 553645 - DNA, 25 bp, Homo sapien
atgttaactaaatcttggactggga

SEQ ID NO: 553646 - DNA, 25 bp, Homo sapien
aacagatttacgcttttgaggctca

SEQ ID NO: 553647 - DNA, 25 bp, Homo sapien
tttgaggctcaaaccaactagtgtt

SEQ ID NO: 553648 - DNA, 25 bp, Homo sapien
ggctcaaaccaactagtgttctcat

SEQ ID NO: 553649 - DNA, 25 bp, Homo sapien
ccaactagtgttctcatgggctgtt

SEQ ID NO: 553650 - DNA, 25 bp, Homo sapien
atggaaaacaggctatgtccaggga

SEQ ID NO: 553651 - DNA, 25 bp, Homo sapien
ccagggacagatgattggtggttaa

SEQ ID NO: 553652 - DNA, 25 bp, Homo sapien
aaaattacacctggattttcttctg

SEQ ID NO: 553653 - DNA, 25 bp, Homo sapien
caaggaacttggatttgaactgtga

SEQ ID NO: 553654 - DNA, 25 bp, Homo sapien
ggatttgaactgtgaatctactgtt

SEQ ID NO: 553655 - DNA, 25 bp, Homo sapien
gatgggcaatcaagtgccccttttg

SEQ ID NO: 553656 - DNA, 25 bp, Homo sapien
ggagagggtgtatcattgcctcaat

SEQ ID NO: 553657 - DNA, 25 bp, Homo sapien
attgcctcaatggtgcgtctgcctg

SEQ ID NO: 553658 - DNA, 25 bp, Homo sapien
gtctgcctgcactgagggcattaca

SEQ ID NO: 553659 - DNA, 25 bp, Homo sapien
gcactgagggcattacacatggctg

SEQ ID NO: 553660 - DNA, 25 bp, Homo sapien
attacacatggctgactcgacctcc

SEQ ID NO: 553661 - DNA, 25 bp, Homo sapien
tattttgtgaagctccacaaacggg

SEQ ID NO: 553662 - DNA, 25 bp, Homo sapien
ggtcacgtcatccaggtgaggccac

SEQ ID NO: 553663 - DNA, 25 bp, Homo sapien
gtgaggccaccaccggtacagaaac

SEQ ID NO: 553664 - DNA, 25 bp, Homo sapien
cggtacagaaacctctcggcaatgg

SEQ ID NO: 553665 - DNA, 25 bp, Homo sapien
tctcggcaatggttcttagccaggg

SEQ ID NO: 553666 - DNA, 25 bp, Homo sapien
gcgaacagtgttccccaggatctgg

SEQ ID NO: 553667 - DNA, 25 bp, Homo sapien
aggatctgggtcacgtctcccggcg

SEQ ID NO: 553668 - DNA, 25 bp, Homo sapien
gaaggagagcttgtcctcgagctgc

SEQ ID NO: 553669 - DNA, 25 bp, Homo sapien
cttgtcctcgagctgcagcagtaga

SEQ ID NO: 553670 - DNA, 25 bp, Homo sapien
agagactgaggttagacctgacgaa

SEQ ID NO: 553671 - DNA, 25 bp, Homo sapien
aggaccgcggactgtccaggatgtt

SEQ ID NO: 553672 - DNA, 25 bp, Homo sapien
tctcaagccaggagagaccgccatc

SEQ ID NO: 553673 - DNA, 25 bp, Homo sapien
agaccgccatcctactaggcagagg

SEQ ID NO: 553674 - DNA, 25 bp, Homo sapien
gcctacactaggcaggtggacatct

SEQ ID NO: 553675 - DNA, 25 bp, Homo sapien
tgaaggtcgagagcctgctgatcct

SEQ ID NO: 553676 - DNA, 25 bp, Homo sapien
tgatcctccattgatcctgtttgaa

SEQ ID NO: 553677 - DNA, 25 bp, Homo sapien
aacagctacagggtaaaatcctgca

SEQ ID NO: 553678 - DNA, 25 bp, Homo sapien
agggtaaaatcctgcagcacccact

SEQ ID NO: 553679 - DNA, 25 bp, Homo sapien
gtaaaatcctgcagcacccactctg

SEQ ID NO: 553680 - DNA, 25 bp, Homo sapien
aatcctgcagcacccactctggaaa

SEQ ID NO: 553681 - DNA, 25 bp, Homo sapien
aaatactgctcttaattttcctgaa

SEQ ID NO: 553682 - DNA, 25 bp, Homo sapien
gaaggtggccccctgtttctagttg

SEQ ID NO: 553683 - DNA, 25 bp, Homo sapien
tgtttctagttggtccaggattagg

SEQ ID NO: 553684 - DNA, 25 bp, Homo sapien
ctagttggtccaggattagggatgt

SEQ ID NO: 553685 - DNA, 25 bp, Homo sapien
gggtatagggcatttaaatcctctc

SEQ ID NO: 553686 - DNA, 25 bp, Homo sapien
gtatagggcatttaaatcctctcaa

SEQ ID NO: 553687 - DNA, 25 bp, Homo sapien
agggcatttaaatcctctcaagcgc

SEQ ID NO: 553688 - DNA, 25 bp, Homo sapien
accaggaagctttgcttgaccccaa

SEQ ID NO: 553689 - DNA, 25 bp, Homo sapien
gatgggtacgtcagtagcacacaga

SEQ ID NO: 553690 - DNA, 25 bp, Homo sapien
gagaacatgacctcttgtgaccttt

SEQ ID NO: 553691 - DNA, 25 bp, Homo sapien
tgaccttttggacctggagctacct

SEQ ID NO: 553692 - DNA, 25 bp, Homo sapien
cccgcggaggtaggactgattgttt

SEQ ID NO: 553693 - DNA, 25 bp, Homo sapien
gattgtttaccatctgtgcagggcc

SEQ ID NO: 553694 - DNA, 25 bp, Homo sapien
agggcccaggacaatccctgcatgt

SEQ ID NO: 553695 - DNA, 25 bp, Homo sapien
ccctgcatgtgccagatgtgcagaa

SEQ ID NO: 553696 - DNA, 25 bp, Homo sapien
atttctctcttcagcgaacaccttc

SEQ ID NO: 553697 - DNA, 25 bp, Homo sapien
gaacaccttctcaaacatctcatgc

SEQ ID NO: 553698 - DNA, 25 bp, Homo sapien
aaacatctcatgcttaaacctgccc

SEQ ID NO: 553699 - DNA, 25 bp, Homo sapien
gaccaactacctccgtcagcaagaa

SEQ ID NO: 553700 - DNA, 25 bp, Homo sapien
aggagtttgagccaccaacttcagt

SEQ ID NO: 553701 - DNA, 25 bp, Homo sapien
ttgagccaccaacttcagtgccttt

SEQ ID NO: 553702 - DNA, 25 bp, Homo sapien
acttcagtgcctttctgtaccccaa

SEQ ID NO: 553703 - DNA, 25 bp, Homo sapien
tgtaccccaagccagcacaagattg

SEQ ID NO: 553704 - DNA, 25 bp, Homo sapien
agccagcacaagattggaccaatcc

SEQ ID NO: 553705 - DNA, 25 bp, Homo sapien
ttttgcaccaaagtgccggacaacc

SEQ ID NO: 553706 - DNA, 25 bp, Homo sapien
aagtgccggacaacctttgtggtgg

SEQ ID NO: 553707 - DNA, 25 bp, Homo sapien
tgggggggggtcttcacattatcat

SEQ ID NO: 553708 - DNA, 25 bp, Homo sapien
cacattatcataacctctcctctaa

SEQ ID NO: 553709 - DNA, 25 bp, Homo sapien
ggaggcattaaaattcactgtgccc

SEQ ID NO: 553710 - DNA, 25 bp, Homo sapien
cagtacttcatcatgttgtggttta

SEQ ID NO: 553711 - DNA, 25 bp, Homo sapien
ttgtggtttaattctaattggtggg

SEQ ID NO: 553712 - DNA, 25 bp, Homo sapien
aaacgttaatattcagatccagtca

SEQ ID NO: 553713 - DNA, 25 bp, Homo sapien
attcagatccagtcaatacatgcag

SEQ ID NO: 553714 - DNA, 25 bp, Homo sapien
agatccagtcaatacatgcagacca

SEQ ID NO: 553715 - DNA, 25 bp, Homo sapien
aatctgatttgtgcagagttctcca

SEQ ID NO: 553716 - DNA, 25 bp, Homo sapien
ttgtgcagagttctccatctgactc

SEQ ID NO: 553717 - DNA, 25 bp, Homo sapien
atctgactctcacttatttctgtag

SEQ ID NO: 553718 - DNA, 25 bp, Homo sapien
tgactctcacttatttctgtagata

SEQ ID NO: 553719 - DNA, 25 bp, Homo sapien
ctcggtgctgggagcttgcaatttt

SEQ ID NO: 553720 - DNA, 25 bp, Homo sapien
tgggagcttgcaattttgttcttat

SEQ ID NO: 553721 - DNA, 25 bp, Homo sapien
aagggtggtttcttgctggatttca

SEQ ID NO: 553722 - DNA, 25 bp, Homo sapien
aatttggatgtttctgctagagacc

SEQ ID NO: 553723 - DNA, 25 bp, Homo sapien
taaaaacccctaagatttgtatatg

SEQ ID NO: 553724 - DNA, 25 bp, Homo sapien
gatttgtatatgttcatctttaggc

SEQ ID NO: 553725 - DNA, 25 bp, Homo sapien
atttgtatatgttcatctttaggct

SEQ ID NO: 553726 - DNA, 25 bp, Homo sapien
tttgtatatgttcatctttaggctt

SEQ ID NO: 553727 - DNA, 25 bp, Homo sapien
gaaagggagagaaatcatattggaa

SEQ ID NO: 553728 - DNA, 25 bp, Homo sapien
agggagagaaatcatattggaaatc

SEQ ID NO: 553729 - DNA, 25 bp, Homo sapien
tgaaatctgcttgtaaaactctcat

SEQ ID NO: 553730 - DNA, 25 bp, Homo sapien
gaaatctgcttgtaaaactctcatc

SEQ ID NO: 553731 - DNA, 25 bp, Homo sapien
aaatctgcttgtaaaactctcatct

SEQ ID NO: 553732 - DNA, 25 bp, Homo sapien
tttgttcagcatttttcggtcattt

SEQ ID NO: 553733 - DNA, 25 bp, Homo sapien
gttcagcatttttcggtcatttgat

SEQ ID NO: 553734 - DNA, 25 bp, Homo sapien
cagcatttttcggtcatttgatttt

SEQ ID NO: 553735 - DNA, 25 bp, Homo sapien
ggtcatttgattttgcattttgcac

SEQ ID NO: 553736 - DNA, 25 bp, Homo sapien
tgattttgcattttgcacttcctcc

SEQ ID NO: 553737 - DNA, 25 bp, Homo sapien
ttttgcattttgcacttcctcccag

SEQ ID NO: 553738 - DNA, 25 bp, Homo sapien
attttgcacttcctcccaggatatt

SEQ ID NO: 553739 - DNA, 25 bp, Homo sapien
aatatgaagtattggtgcagtttga

SEQ ID NO: 553740 - DNA, 25 bp, Homo sapien
tattggtgcagtttgagggtgtttt

SEQ ID NO: 553741 - DNA, 25 bp, Homo sapien
gaaaacagttctatttatcctcctc

SEQ ID NO: 553742 - DNA, 25 bp, Homo sapien
aacagttctatttatcctcctccct

SEQ ID NO: 553743 - DNA, 25 bp, Homo sapien
gaggattcttacaaattcattaatg

SEQ ID NO: 553744 - DNA, 25 bp, Homo sapien
aaactatttcaaatgcataccacaa

SEQ ID NO: 553745 - DNA, 25 bp, Homo sapien
gcaataatacaataccccttccaag

SEQ ID NO: 553746 - DNA, 25 bp, Homo sapien
aataatacaataccccttccaagtg

SEQ ID NO: 553747 - DNA, 25 bp, Homo sapien
tacaataccccttccaagtgccttt

SEQ ID NO: 553748 - DNA, 25 bp, Homo sapien
gcctttttaaattgtatagttgatg

SEQ ID NO: 553749 - DNA, 25 bp, Homo sapien
atgattgaatgagttctgtatgaaa

SEQ ID NO: 553750 - DNA, 25 bp, Homo sapien
gaaactgagatgttgtctatagcta

SEQ ID NO: 553751 - DNA, 25 bp, Homo sapien
gagatgttgtctatagctatgtcta

SEQ ID NO: 553752 - DNA, 25 bp, Homo sapien
agctatgtctataaacaacctgaag

SEQ ID NO: 553753 - DNA, 25 bp, Homo sapien
caacctgaagacttgtgaaatcaat

SEQ ID NO: 553754 - DNA, 25 bp, Homo sapien
ctagtggtctcacctgaaggcaaga

SEQ ID NO: 553755 - DNA, 25 bp, Homo sapien
tggtctcacctgaaggcaagaggga

SEQ ID NO: 553756 - DNA, 25 bp, Homo sapien
cctgctctctggaggtactgagaca

SEQ ID NO: 553757 - DNA, 25 bp, Homo sapien
tgctctctggaggtactgagacagg

SEQ ID NO: 553758 - DNA, 25 bp, Homo sapien
ctctctggaggtactgagacagggt

SEQ ID NO: 553759 - DNA, 25 bp, Homo sapien
ggaggtactgagacagggtgctgat

SEQ ID NO: 553760 - DNA, 25 bp, Homo sapien
ctggacctatgcagggaggccacgt

SEQ ID NO: 553761 - DNA, 25 bp, Homo sapien
acctatgcagggaggccacgtccca

SEQ ID NO: 553762 - DNA, 25 bp, Homo sapien
cacctcttgtttctgggtccctgct

SEQ ID NO: 553763 - DNA, 25 bp, Homo sapien
agagagaggtatttaactgcaataa

SEQ ID NO: 553764 - DNA, 25 bp, Homo sapien
aactgcaataaactgccccatgtgg

SEQ ID NO: 553765 - DNA, 25 bp, Homo sapien
gcctttcctttgaggtaccgtgtgc

SEQ ID NO: 553766 - DNA, 25 bp, Homo sapien
tttcctttgaggtaccgtgtgcggt

SEQ ID NO: 553767 - DNA, 25 bp, Homo sapien
tcctttgaggtaccgtgtgcggttt

SEQ ID NO: 553768 - DNA, 25 bp, Homo sapien
tttgaggtaccgtgtgcggtttcct

SEQ ID NO: 553769 - DNA, 25 bp, Homo sapien
gaggtaccgtgtgcggtttcctgaa

SEQ ID NO: 553770 - DNA, 25 bp, Homo sapien
taccgtgtgcggtttcctgaaccta

SEQ ID NO: 553771 - DNA, 25 bp, Homo sapien
tgaacctatctctatccctgtctga

SEQ ID NO: 553772 - DNA, 25 bp, Homo sapien
acctatctctatccctgtctgatag

SEQ ID NO: 553773 - DNA, 25 bp, Homo sapien
atctctatccctgtctgatagaggg

SEQ ID NO: 553774 - DNA, 25 bp, Homo sapien
cctgtctgatagagggaacccctgt

SEQ ID NO: 553775 - DNA, 25 bp, Homo sapien
ctgtctgatagagggaacccctgta

SEQ ID NO: 553776 - DNA, 25 bp, Homo sapien
tgaaagaagttcagattggcatttg

SEQ ID NO: 553777 - DNA, 25 bp, Homo sapien
gattggcatttgaagtattgagtgt

SEQ ID NO: 553778 - DNA, 25 bp, Homo sapien
agtgtatgggatctctaaggatttc

SEQ ID NO: 553779 - DNA, 25 bp, Homo sapien
ggagtcaacaaactggctcttgatt

SEQ ID NO: 553780 - DNA, 25 bp, Homo sapien
aactggctcttgattttcagcaccc

SEQ ID NO: 553781 - DNA, 25 bp, Homo sapien
ttgattttcagcaccctactctcat

SEQ ID NO: 553782 - DNA, 25 bp, Homo sapien
tcagcaccctactctcatgaaaaaa

SEQ ID NO: 553783 - DNA, 25 bp, Homo sapien
ggctcagatcagatgagaactcact

SEQ ID NO: 553784 - DNA, 25 bp, Homo sapien
gaactcacttaaatccactcaatgt

SEQ ID NO: 553785 - DNA, 25 bp, Homo sapien
gatggtagagctgggactagcaaca

SEQ ID NO: 553786 - DNA, 25 bp, Homo sapien
gctgggactagcaacattgctgcag

SEQ ID NO: 553787 - DNA, 25 bp, Homo sapien
acagtggagagcaaattggaaaaca

SEQ ID NO: 553788 - DNA, 25 bp, Homo sapien
gagagcaaattggaaaacagttcta

SEQ ID NO: 553789 - DNA, 25 bp, Homo sapien
gagcaaattggaaaacagttctatt

SEQ ID NO: 553790 - DNA, 25 bp, Homo sapien
gcaaattggaaaacagttctattta

SEQ ID NO: 553791 - DNA, 25 bp, Homo sapien
attggaaaacagttctatttatcct

SEQ ID NO: 553792 - DNA, 25 bp, Homo sapien
ttggaaaacagttctatttatcctc

SEQ ID NO: 553793 - DNA, 25 bp, Homo sapien
tggaaaacagttctatttatcctcc

SEQ ID NO: 553794 - DNA, 25 bp, Homo sapien
ggaaaacagttctatttatcctcct

SEQ ID NO: 553795 - DNA, 25 bp, Homo sapien
gaaaacagttctatttatcctcctc

SEQ ID NO: 553796 - DNA, 25 bp, Homo sapien
aacagttctatttatcctcctccct

SEQ ID NO: 553797 - DNA, 25 bp, Homo sapien
acagttctatttatcctcctccctc

SEQ ID NO: 553798 - DNA, 25 bp, Homo sapien
cctgctctctggaggtactgagaca

SEQ ID NO: 553799 - DNA, 25 bp, Homo sapien
ctgctctctggaggtactgagacag

SEQ ID NO: 553800 - DNA, 25 bp, Homo sapien
tgctctctggaggtactgagacagg

SEQ ID NO: 553801 - DNA, 25 bp, Homo sapien
ctctctggaggtactgagacagggt

SEQ ID NO: 553802 - DNA, 25 bp, Homo sapien
ctctggaggtactgagacagggtgc

SEQ ID NO: 553803 - DNA, 25 bp, Homo sapien
tctggaggtactgagacagggtgct

SEQ ID NO: 553804 - DNA, 25 bp, Homo sapien
ctggaggtactgagacagggtgctg

SEQ ID NO: 553805 - DNA, 25 bp, Homo sapien
ggaggtactgagacagggtgctgat

SEQ ID NO: 553806 - DNA, 25 bp, Homo sapien
gaggtactgagacagggtgctgatg

SEQ ID NO: 553807 - DNA, 25 bp, Homo sapien
ggtactgagacagggtgctgatggg

SEQ ID NO: 553808 - DNA, 25 bp, Homo sapien
gccacccggggcctggacctatgca

SEQ ID NO: 553809 - DNA, 25 bp, Homo sapien
ttacctcctttaagaggacttggag

SEQ ID NO: 553810 - DNA, 25 bp, Homo sapien
gaagcttactttttgctatatcagc

SEQ ID NO: 553811 - DNA, 25 bp, Homo sapien
agactcatctcccagcacaaatggg

SEQ ID NO: 553812 - DNA, 25 bp, Homo sapien
atgaaatggtactggccctaggagg

SEQ ID NO: 553813 - DNA, 25 bp, Homo sapien
actggccctaggaggatttcctcaa

SEQ ID NO: 553814 - DNA, 25 bp, Homo sapien
tcttggccttgaacctacctctggg

SEQ ID NO: 553815 - DNA, 25 bp, Homo sapien
ctacctctgggttggatcttactat

SEQ ID NO: 553816 - DNA, 25 bp, Homo sapien
ggatcttactattgtagctgctcac

SEQ ID NO: 553817 - DNA, 25 bp, Homo sapien
tattgtagctgctcactataccctc

SEQ ID NO: 553818 - DNA, 25 bp, Homo sapien
tataccctcctgcatgcttagaata

SEQ ID NO: 553819 - DNA, 25 bp, Homo sapien
gggagcactggtaaaacacagtatt

SEQ ID NO: 553820 - DNA, 25 bp, Homo sapien
atatttggaggttctggtgtttgta

SEQ ID NO: 553821 - DNA, 25 bp, Homo sapien
gaggttctggtgtttgtaggtcact

SEQ ID NO: 553822 - DNA, 25 bp, Homo sapien
tctggtgtttgtaggtcactgaaca

SEQ ID NO: 553823 - DNA, 25 bp, Homo sapien
tgtttgtaggtcactgaacagacat

SEQ ID NO: 553824 - DNA, 25 bp, Homo sapien
taaataagatttgtccccaaatggt

SEQ ID NO: 553825 - DNA, 25 bp, Homo sapien
ccccaaatggttttgctcaccttga

SEQ ID NO: 553826 - DNA, 25 bp, Homo sapien
atggttttgctcaccttgatttttt

SEQ ID NO: 553827 - DNA, 25 bp, Homo sapien
atgtgtatagtttatgtcaagggca

SEQ ID NO: 553828 - DNA, 25 bp, Homo sapien
agggcattaaaagcctcctgaagca

SEQ ID NO: 553829 - DNA, 25 bp, Homo sapien
aagcctcctgaagcataatcttatc

SEQ ID NO: 553830 - DNA, 25 bp, Homo sapien
gaagcataatcttatcaaagggata

SEQ ID NO: 553831 - DNA, 25 bp, Homo sapien
tattctgaacaaaacaccaggccca

SEQ ID NO: 553832 - DNA, 25 bp, Homo sapien
attctgaacaaaacaccaggcccag

SEQ ID NO: 553833 - DNA, 25 bp, Homo sapien
aggcccagataatttcaaagttgtg

SEQ ID NO: 553834 - DNA, 25 bp, Homo sapien
agataatttcaaagttgtgccaaac

SEQ ID NO: 553835 - DNA, 25 bp, Homo sapien
aatagtaagcttccaaattatcttg

SEQ ID NO: 553836 - DNA, 25 bp, Homo sapien
tagtaagcttccaaattatcttgag

SEQ ID NO: 553837 - DNA, 25 bp, Homo sapien
gtaagcttccaaattatcttgaggc

SEQ ID NO: 553838 - DNA, 25 bp, Homo sapien
aagcttccaaattatcttgaggcta

SEQ ID NO: 553839 - DNA, 25 bp, Homo sapien
gcttccaaattatcttgaggctagc

SEQ ID NO: 553840 - DNA, 25 bp, Homo sapien
ttccaaattatcttgaggctagcac

SEQ ID NO: 553841 - DNA, 25 bp, Homo sapien
tccaaattatcttgaggctagcaca

SEQ ID NO: 553842 - DNA, 25 bp, Homo sapien
aagctaatgttgtgtcgagaagcaa

SEQ ID NO: 553843 - DNA, 25 bp, Homo sapien
gctaatgttgtgtcgagaagcaaca

SEQ ID NO: 553844 - DNA, 25 bp, Homo sapien
gttgtgtcgagaagcaacactttgt

SEQ ID NO: 553845 - DNA, 25 bp, Homo sapien
tgtgtcgagaagcaacactttgtga

SEQ ID NO: 553846 - DNA, 25 bp, Homo sapien
tgtcgagaagcaacactttgtgatc

SEQ ID NO: 553847 - DNA, 25 bp, Homo sapien
gtcgagaagcaacactttgtgatct

SEQ ID NO: 553848 - DNA, 25 bp, Homo sapien
tcgagaagcaacactttgtgatctc

SEQ ID NO: 553849 - DNA, 25 bp, Homo sapien
gagaagcaacactttgtgatctcat

SEQ ID NO: 553850 - DNA, 25 bp, Homo sapien
agaagcaacactttgtgatctcatg

SEQ ID NO: 553851 - DNA, 25 bp, Homo sapien
gaagcaacactttgtgatctcatgg

SEQ ID NO: 553852 - DNA, 25 bp, Homo sapien
aagcaacactttgtgatctcatggc

SEQ ID NO: 553853 - DNA, 25 bp, Homo sapien
cgagggatgtttctggtttcatttc

SEQ ID NO: 553854 - DNA, 25 bp, Homo sapien
gatgtttctggtttcatttcaaata

SEQ ID NO: 553855 - DNA, 25 bp, Homo sapien
aagaggactggctcagtggtggcaa

SEQ ID NO: 553856 - DNA, 25 bp, Homo sapien
ggcaaaatactggtgatgctcccta

SEQ ID NO: 553857 - DNA, 25 bp, Homo sapien
aaatactggtgatgctccctagagc

SEQ ID NO: 553858 - DNA, 25 bp, Homo sapien
tactggtgatgctccctagagcagg

SEQ ID NO: 553859 - DNA, 25 bp, Homo sapien
atcagcctgccaagattgtttttta

SEQ ID NO: 553860 - DNA, 25 bp, Homo sapien
tagtgctcctgctgtcaagatttct

SEQ ID NO: 553861 - DNA, 25 bp, Homo sapien
tcctgctgtcaagatttctgtcatg

SEQ ID NO: 553862 - DNA, 25 bp, Homo sapien
gatttctgtcatggaaaccttgttt

SEQ ID NO: 553863 - DNA, 25 bp, Homo sapien
gtcatggaaaccttgtttgagaaag

SEQ ID NO: 553864 - DNA, 25 bp, Homo sapien
gttttattctgtgttgtttactggt

SEQ ID NO: 553865 - DNA, 25 bp, Homo sapien
attattatcttgatactacctctca

SEQ ID NO: 553866 - DNA, 25 bp, Homo sapien
gatactacctctcaagggtattgtt

SEQ ID NO: 553867 - DNA, 25 bp, Homo sapien
gtattgttacaaaatgccacttatg

SEQ ID NO: 553868 - DNA, 25 bp, Homo sapien
tgccacttatggttaaagagataga

SEQ ID NO: 553869 - DNA, 25 bp, Homo sapien
caaagagttctatttgacagaagct

SEQ ID NO: 553870 - DNA, 25 bp, Homo sapien
cagaagcttgaaactctggcatcta

SEQ ID NO: 553871 - DNA, 25 bp, Homo sapien
tggcatctatctgcccaacgatggg

SEQ ID NO: 553872 - DNA, 25 bp, Homo sapien
gtaatttaatcctttgtagatacat

SEQ ID NO: 553873 - DNA, 25 bp, Homo sapien
tttatacgtgttcatatttttctca

SEQ ID NO: 553874 - DNA, 25 bp, Homo sapien
ttttctcattttgcattgtgtaaag

SEQ ID NO: 553875 - DNA, 25 bp, Homo sapien
aaatgtagattgttaacgcttgaga

SEQ ID NO: 553876 - DNA, 25 bp, Homo sapien
gttaacgcttgagaatcatggctat

SEQ ID NO: 553877 - DNA, 25 bp, Homo sapien
aacgcttgagaatcatggctatggt

SEQ ID NO: 553878 - DNA, 25 bp, Homo sapien
tggctatggtttctaatgttctggt

SEQ ID NO: 553879 - DNA, 25 bp, Homo sapien
gctatggtttctaatgttctggtaa

SEQ ID NO: 553880 - DNA, 25 bp, Homo sapien
tgttctggtaacaagctgttatctt

SEQ ID NO: 553881 - DNA, 25 bp, Homo sapien
aacaagctgttatcttttaagacat

SEQ ID NO: 553882 - DNA, 25 bp, Homo sapien
taatgactcaaaggtacactataca

SEQ ID NO: 553883 - DNA, 25 bp, Homo sapien
ggtacactatacatttaccattatt

SEQ ID NO: 553884 - DNA, 25 bp, Homo sapien
cattatttataccatagctaaggtt

SEQ ID NO: 553885 - DNA, 25 bp, Homo sapien
tattaccatttatagattcattttg

SEQ ID NO: 553886 - DNA, 25 bp, Homo sapien
aactgggaactctagccgtggtcca

SEQ ID NO: 553887 - DNA, 25 bp, Homo sapien
ggaactctagccgtggtccaggaga

SEQ ID NO: 553888 - DNA, 25 bp, Homo sapien
ctctagccgtggtccaggagacgga

SEQ ID NO: 553889 - DNA, 25 bp, Homo sapien
aaaggatcaagactccagatctgca

SEQ ID NO: 553890 - DNA, 25 bp, Homo sapien
cagatctgcacctgagccaaagaaa

SEQ ID NO: 553891 - DNA, 25 bp, Homo sapien
ggaaaatccagcttctaagttcagt

SEQ ID NO: 553892 - DNA, 25 bp, Homo sapien
cagcttctaagttcagttctgcaag

SEQ ID NO: 553893 - DNA, 25 bp, Homo sapien
gttcagttctgcaagcaagtatgct

SEQ ID NO: 553894 - DNA, 25 bp, Homo sapien
aagcaagtatgctgctctctctgtt

SEQ ID NO: 553895 - DNA, 25 bp, Homo sapien
tgctgctctctctgttgatggtgaa

SEQ ID NO: 553896 - DNA, 25 bp, Homo sapien
gctctctctgttgatggtgaagatg

SEQ ID NO: 553897 - DNA, 25 bp, Homo sapien
acaaacatagagctgcatgggcaat

SEQ ID NO: 553898 - DNA, 25 bp, Homo sapien
gcatgggcaattcaaacaaatctgt

SEQ ID NO: 553899 - DNA, 25 bp, Homo sapien
tgtgaagtgcagtacccattcagaa

SEQ ID NO: 553900 - DNA, 25 bp, Homo sapien
gtacccattcagaaatcacacttcc

SEQ ID NO: 553901 - DNA, 25 bp, Homo sapien
gaaatcacacttcctgaaaaccgtt

SEQ ID NO: 553902 - DNA, 25 bp, Homo sapien
gaaaaccgttcaaaagcagagtcca

SEQ ID NO: 553903 - DNA, 25 bp, Homo sapien
agcagagtccagacgggctgttgat

SEQ ID NO: 553904 - DNA, 25 bp, Homo sapien
ctccacctgtaaccctataaatgtc

SEQ ID NO: 553905 - DNA, 25 bp, Homo sapien
cctgtaaccctataaatgtctgtaa

SEQ ID NO: 553906 - DNA, 25 bp, Homo sapien
ggatcaatttgggaatatctgctga

SEQ ID NO: 553907 - DNA, 25 bp, Homo sapien
gggaatatctgctgagagaccaaaa

SEQ ID NO: 553908 - DNA, 25 bp, Homo sapien
tgtcctttgccaactcttaacctag

SEQ ID NO: 553909 - DNA, 25 bp, Homo sapien
tttgccaactcttaacctagttaat

SEQ ID NO: 553910 - DNA, 25 bp, Homo sapien
ttaacctagttaatcctagttctgt

SEQ ID NO: 553911 - DNA, 25 bp, Homo sapien
gacattggaccaggctcagtaaata

SEQ ID NO: 553912 - DNA, 25 bp, Homo sapien
gaccaggctcagtaaataaacgaat

SEQ ID NO: 553913 - DNA, 25 bp, Homo sapien
taaacgaatggatttccagcctttt

SEQ ID NO: 553914 - DNA, 25 bp, Homo sapien
tgcttttagtcctctgaatctgctt

SEQ ID NO: 553915 - DNA, 25 bp, Homo sapien
tttagtcctctgaatctgcttcttt

SEQ ID NO: 553916 - DNA, 25 bp, Homo sapien
tgaatctgcttcttttcttactgct

SEQ ID NO: 553917 - DNA, 25 bp, Homo sapien
ctgcttcttttcttactgctgcttt

SEQ ID NO: 553918 - DNA, 25 bp, Homo sapien
attgggtctgtgtttaattttgatg

SEQ ID NO: 553919 - DNA, 25 bp, Homo sapien
acgtggtcgtagtctggcccggaca

SEQ ID NO: 553920 - DNA, 25 bp, Homo sapien
tagtctggcccggacaggaaatccc

SEQ ID NO: 553921 - DNA, 25 bp, Homo sapien
cggacaggaaatcccgcccacaggg

SEQ ID NO: 553922 - DNA, 25 bp, Homo sapien
aaacgctccagtcgccggcgtagcg

SEQ ID NO: 553923 - DNA, 25 bp, Homo sapien
tggctgtcgtttgggtcgcaagtaa

SEQ ID NO: 553924 - DNA, 25 bp, Homo sapien
ctgtcgtttgggtcgcaagtaaggc

SEQ ID NO: 553925 - DNA, 25 bp, Homo sapien
caagtaaggcgcgacatctggagat

SEQ ID NO: 553926 - DNA, 25 bp, Homo sapien
taaggcgcgacatctggagattgtc

SEQ ID NO: 553927 - DNA, 25 bp, Homo sapien
gtcttcgaagtcaccggtgaccctc

SEQ ID NO: 553928 - DNA, 25 bp, Homo sapien
tgtcactgcccgtcacgtggtcgta

SEQ ID NO: 553929 - DNA, 25 bp, Homo sapien
tgcccgtcacgtggtcgtagtctgg

SEQ ID NO: 553930 - DNA, 25 bp, Homo sapien
attaaggctttggtattggtgccag

SEQ ID NO: 553931 - DNA, 25 bp, Homo sapien
tattggtgccagagtgccacgatca

SEQ ID NO: 553932 - DNA, 25 bp, Homo sapien
gagtgccacgatcagatcctagctc

SEQ ID NO: 553933 - DNA, 25 bp, Homo sapien
tctgccgtgtcctgccagctgtgtg

SEQ ID NO: 553934 - DNA, 25 bp, Homo sapien
gatcttgggcaaggaatcctcacct

SEQ ID NO: 553935 - DNA, 25 bp, Homo sapien
tggtttctacttccataaagtgggt

SEQ ID NO: 553936 - DNA, 25 bp, Homo sapien
atgaaacgttaatcctcacagagtt

SEQ ID NO: 553937 - DNA, 25 bp, Homo sapien
gagaggattaagtgagaccatgctt

SEQ ID NO: 553938 - DNA, 25 bp, Homo sapien
gaccatgcttattaggtgcttctta

SEQ ID NO: 553939 - DNA, 25 bp, Homo sapien
ttaatattattatctgcaacagtgg

SEQ ID NO: 553940 - DNA, 25 bp, Homo sapien
caacagtggttgagtagttcagaac

SEQ ID NO: 553941 - DNA, 25 bp, Homo sapien
gaaatatttacctagaagatgaaag

SEQ ID NO: 553942 - DNA, 25 bp, Homo sapien
atgaaaggtagacaactgacaagct

SEQ ID NO: 553943 - DNA, 25 bp, Homo sapien
caactgacaagctatcagaaccaat

SEQ ID NO: 553944 - DNA, 25 bp, Homo sapien
gacaagctatcagaaccaatagagt

SEQ ID NO: 553945 - DNA, 25 bp, Homo sapien
agctatcagaaccaatagagttgaa

SEQ ID NO: 553946 - DNA, 25 bp, Homo sapien
aacatatagcaatattttatgggaa

SEQ ID NO: 553947 - DNA, 25 bp, Homo sapien
aatcacctagggaaagcctaacaag

SEQ ID NO: 553948 - DNA, 25 bp, Homo sapien
tcacctagggaaagcctaacaagaa

SEQ ID NO: 553949 - DNA, 25 bp, Homo sapien
gaaagcctaacaagaaatatgctag

SEQ ID NO: 553950 - DNA, 25 bp, Homo sapien
gaaatatgctagagtcttatgttct

SEQ ID NO: 553951 - DNA, 25 bp, Homo sapien
tatgctagagtcttatgttcttttt

SEQ ID NO: 553952 - DNA, 25 bp, Homo sapien
tgatgccagcccctaggctccaaga

SEQ ID NO: 553953 - DNA, 25 bp, Homo sapien
gatgccagcccctaggctccaagag

SEQ ID NO: 553954 - DNA, 25 bp, Homo sapien
atgccagcccctaggctccaagagc

SEQ ID NO: 553955 - DNA, 25 bp, Homo sapien
gcctgggcactcaccccctggctta

SEQ ID NO: 553956 - DNA, 25 bp, Homo sapien
cctggcttagacaccttctcaaggg

SEQ ID NO: 553957 - DNA, 25 bp, Homo sapien
ctggcttagacaccttctcaagggc

SEQ ID NO: 553958 - DNA, 25 bp, Homo sapien
gcttagacaccttctcaagggctgg

SEQ ID NO: 553959 - DNA, 25 bp, Homo sapien
cttagacaccttctcaagggctggc

SEQ ID NO: 553960 - DNA, 25 bp, Homo sapien
ttagacaccttctcaagggctggcc

SEQ ID NO: 553961 - DNA, 25 bp, Homo sapien
ggcatgccctcctggggccaagagt

SEQ ID NO: 553962 - DNA, 25 bp, Homo sapien
aagagtgggcctgcaacccacccac

SEQ ID NO: 553963 - DNA, 25 bp, Homo sapien
agccgtttagatttggccagagacg

SEQ ID NO: 553964 - DNA, 25 bp, Homo sapien
gagacgccagatttagcaaaggact

SEQ ID NO: 553965 - DNA, 25 bp, Homo sapien
caaaggactgggttcttatcttctt

SEQ ID NO: 553966 - DNA, 25 bp, Homo sapien
ttcattcatgaatatatgccttggg

SEQ ID NO: 553967 - DNA, 25 bp, Homo sapien
tgccttgggaggacactggtgattc

SEQ ID NO: 553968 - DNA, 25 bp, Homo sapien
ggtgattcccacagaattaggccaa

SEQ ID NO: 553969 - DNA, 25 bp, Homo sapien
gaattaggccaatgatttgccacat

SEQ ID NO: 553970 - DNA, 25 bp, Homo sapien
acattaccctttaagctagcccata

SEQ ID NO: 553971 - DNA, 25 bp, Homo sapien
aagctagcccataattccaccagat

SEQ ID NO: 553972 - DNA, 25 bp, Homo sapien
agatcccacaccaagtttcagttca

SEQ ID NO: 553973 - DNA, 25 bp, Homo sapien
caagtttcagttcatgactcatact

SEQ ID NO: 553974 - DNA, 25 bp, Homo sapien
gaactactaattatctctcaaggct

SEQ ID NO: 553975 - DNA, 25 bp, Homo sapien
gaaaaattaattgccttaggtggag

SEQ ID NO: 553976 - DNA, 25 bp, Homo sapien
ggagaacttaattcctagtatccac

SEQ ID NO: 553977 - DNA, 25 bp, Homo sapien
gtatccaccaaacttaactccgtat

SEQ ID NO: 553978 - DNA, 25 bp, Homo sapien
aaacttaactccgtatctccatatg

SEQ ID NO: 553979 - DNA, 25 bp, Homo sapien
taactccgtatctccatatggtgtc

SEQ ID NO: 553980 - DNA, 25 bp, Homo sapien
gtatctccatatggtgtctccatat

SEQ ID NO: 553981 - DNA, 25 bp, Homo sapien
tccaactgaaggatcgcccaacgtt

SEQ ID NO: 553982 - DNA, 25 bp, Homo sapien
ggatcgcccaacgtttttggattat

SEQ ID NO: 553983 - DNA, 25 bp, Homo sapien
tgctttctttctttgggacttttga

SEQ ID NO: 553984 - DNA, 25 bp, Homo sapien
tctttgggacttttgaatttctttg

SEQ ID NO: 553985 - DNA, 25 bp, Homo sapien
attaccgatggttgatggacatgcc

SEQ ID NO: 553986 - DNA, 25 bp, Homo sapien
ggacatgccaaggtattgacctctt

SEQ ID NO: 553987 - DNA, 25 bp, Homo sapien
caaggtattgacctcttaagccagt

SEQ ID NO: 553988 - DNA, 25 bp, Homo sapien
cctcttaagccagtagtggctggtt

SEQ ID NO: 553989 - DNA, 25 bp, Homo sapien
tagtggctggttagagcttggcaaa

SEQ ID NO: 553990 - DNA, 25 bp, Homo sapien
ttagagcttggcaaaggagcagccc

SEQ ID NO: 553991 - DNA, 25 bp, Homo sapien
agtttatctcagtgtgccatacaaa

SEQ ID NO: 553992 - DNA, 25 bp, Homo sapien
attttctctggatgttacagtgtga

SEQ ID NO: 553993 - DNA, 25 bp, Homo sapien
ggaagtagtgccctgttgagccata

SEQ ID NO: 553994 - DNA, 25 bp, Homo sapien
tgttgagccatattagagccccagg

SEQ ID NO: 553995 - DNA, 25 bp, Homo sapien
tgtgcattcctgtatattttttctt

SEQ ID NO: 553996 - DNA, 25 bp, Homo sapien
tttaaagcaagaatggaagaccctt

SEQ ID NO: 553997 - DNA, 25 bp, Homo sapien
ttttttacttagagaatcgttctag

SEQ ID NO: 553998 - DNA, 25 bp, Homo sapien
gaatcgttctagtgtttttgccgaa

SEQ ID NO: 553999 - DNA, 25 bp, Homo sapien
gtgtttttgccgaagattaccgctg

SEQ ID NO: 554000 - DNA, 25 bp, Homo sapien
tttgccgaagattaccgctggccta

SEQ ID NO: 554001 - DNA, 25 bp, Homo sapien
aagattaccgctggcctactgtgaa

SEQ ID NO: 554002 - DNA, 25 bp, Homo sapien
tgacctgtgattagactgggcggct

SEQ ID NO: 554003 - DNA, 25 bp, Homo sapien
cagttcagtgcattgttgttgttgc

SEQ ID NO: 554004 - DNA, 25 bp, Homo sapien
cagtgccaactcagcacattgtata

SEQ ID NO: 554005 - DNA, 25 bp, Homo sapien
cagcacattgtatatgattcggttt

SEQ ID NO: 554006 - DNA, 25 bp, Homo sapien
tatgattcggtttatacatattacc

SEQ ID NO: 554007 - DNA, 25 bp, Homo sapien
gcagcggcgtcaaagtggtcacctt

SEQ ID NO: 554008 - DNA, 25 bp, Homo sapien
gcggcgtcaaagtggtcaccttctg

SEQ ID NO: 554009 - DNA, 25 bp, Homo sapien
ttctgtggccacacgtccaaaacca

SEQ ID NO: 554010 - DNA, 25 bp, Homo sapien
gccacacgtccaaaaccaatcaggt

SEQ ID NO: 554011 - DNA, 25 bp, Homo sapien
aaccaatcaggtcaactcgggcggt

SEQ ID NO: 554012 - DNA, 25 bp, Homo sapien
aatcaggtcaactcgggcggtgtgc

SEQ ID NO: 554013 - DNA, 25 bp, Homo sapien
ggtgtggctggctgtcaatgactac

SEQ ID NO: 554014 - DNA, 25 bp, Homo sapien
ggctggctgtcaatgactactacga

SEQ ID NO: 554015 - DNA, 25 bp, Homo sapien
tgactactacgacatggtgggcatc

SEQ ID NO: 554016 - DNA, 25 bp, Homo sapien
agggctctgacagcgtcttctccgg

SEQ ID NO: 554017 - DNA, 25 bp, Homo sapien
tcttccccgactagggcgggcagat

SEQ ID NO: 554018 - DNA, 25 bp, Homo sapien
agcatgacagcctccaatcagaaag

SEQ ID NO: 554019 - DNA, 25 bp, Homo sapien
gaatgggcagatactgacagaaatt

SEQ ID NO: 554020 - DNA, 25 bp, Homo sapien
taaagagctcttcctgattctcatc

SEQ ID NO: 554021 - DNA, 25 bp, Homo sapien
aggcattgaacttggcacttcctgt

SEQ ID NO: 554022 - DNA, 25 bp, Homo sapien
attgaacttggcacttcctgtattc

SEQ ID NO: 554023 - DNA, 25 bp, Homo sapien
cttcctgtattctttgtgatcacta

SEQ ID NO: 554024 - DNA, 25 bp, Homo sapien
attctttgtgatcactattgagtgc

SEQ ID NO: 554025 - DNA, 25 bp, Homo sapien
gagtgcattagttaacacccaaggg

SEQ ID NO: 554026 - DNA, 25 bp, Homo sapien
gtgaaaggagctgatctactgtatt

SEQ ID NO: 554027 - DNA, 25 bp, Homo sapien
ggagctgatctactgtattgtaatg

SEQ ID NO: 554028 - DNA, 25 bp, Homo sapien
tgtaatgtaaaacagctacagccag

SEQ ID NO: 554029 - DNA, 25 bp, Homo sapien
taactccccattacaccactgattt

SEQ ID NO: 554030 - DNA, 25 bp, Homo sapien
ccccattacaccactgatttcaaag

SEQ ID NO: 554031 - DNA, 25 bp, Homo sapien
attacaccactgatttcaaagaaaa

SEQ ID NO: 554032 - DNA, 25 bp, Homo sapien
attaatgtagtatccagtgtgtctt

SEQ ID NO: 554033 - DNA, 25 bp, Homo sapien
atgtagtatccagtgtgtctttaga

SEQ ID NO: 554034 - DNA, 25 bp, Homo sapien
atccagtgtgtctttagataaccct

SEQ ID NO: 554035 - DNA, 25 bp, Homo sapien
cagtgtgtctttagataaccctgtc

SEQ ID NO: 554036 - DNA, 25 bp, Homo sapien
gtctttagataaccctgtccttaat

SEQ ID NO: 554037 - DNA, 25 bp, Homo sapien
ttagataaccctgtccttaatgata

SEQ ID NO: 554038 - DNA, 25 bp, Homo sapien
gataaccctgtccttaatgatattt

SEQ ID NO: 554039 - DNA, 25 bp, Homo sapien
tatttaactccccattacaccactg

SEQ ID NO: 554040 - DNA, 25 bp, Homo sapien
aatgaggtcaaccatggtgccatca

SEQ ID NO: 554041 - DNA, 25 bp, Homo sapien
ggtgccatcataagtccaggatcca

SEQ ID NO: 554042 - DNA, 25 bp, Homo sapien
taagtccaggatccaaacttcatgg

SEQ ID NO: 554043 - DNA, 25 bp, Homo sapien
gcagttctgtcggtcgaacgggaaa

SEQ ID NO: 554044 - DNA, 25 bp, Homo sapien
aaaacgtgacgtccatggtgcagga

SEQ ID NO: 554045 - DNA, 25 bp, Homo sapien
gggtccagacaacagttccgtttga

SEQ ID NO: 554046 - DNA, 25 bp, Homo sapien
agaataaaggcaggcgtctcaggac

SEQ ID NO: 554047 - DNA, 25 bp, Homo sapien
gggataggagtacacgccgtccctt

SEQ ID NO: 554048 - DNA, 25 bp, Homo sapien
ttcatcccctttgcattcagtattt

SEQ ID NO: 554049 - DNA, 25 bp, Homo sapien
atttcccattctccgttatcgaaga

SEQ ID NO: 554050 - DNA, 25 bp, Homo sapien
gaagtcttttctgtcgacattttca

SEQ ID NO: 554051 - DNA, 25 bp, Homo sapien
acctcggagcagtcgagggcccgaa

SEQ ID NO: 554052 - DNA, 25 bp, Homo sapien
gcccgaaggtgctcgaagaacgcag

SEQ ID NO: 554053 - DNA, 25 bp, Homo sapien
cgaagaacgcaggatccgtgtctgg

SEQ ID NO: 554054 - DNA, 25 bp, Homo sapien
aggccaggaactgcacgtcggcgtc

SEQ ID NO: 554055 - DNA, 25 bp, Homo sapien
aggaactgcacgtcggcgtcccgca

SEQ ID NO: 554056 - DNA, 25 bp, Homo sapien
gcaggaagcgcacacagtcgcgcaa

SEQ ID NO: 554057 - DNA, 25 bp, Homo sapien
aagccggcggccaaggcgaaggcgc

SEQ ID NO: 554058 - DNA, 25 bp, Homo sapien
cagcggcggaagaagagctcgaact

SEQ ID NO: 554059 - DNA, 25 bp, Homo sapien
agaagagctcgaactcggcggcgtc

SEQ ID NO: 554060 - DNA, 25 bp, Homo sapien
gcgccaatagcccaacgccatggtg

SEQ ID NO: 554061 - DNA, 25 bp, Homo sapien
ccaacgccatggtggcctggtagag

SEQ ID NO: 554062 - DNA, 25 bp, Homo sapien
catccttcatttggagattgaaagg

SEQ ID NO: 554063 - DNA, 25 bp, Homo sapien
tcatttggagattgaaaggaaaaac

SEQ ID NO: 554064 - DNA, 25 bp, Homo sapien
aaaaacagactggatgcattggctc

SEQ ID NO: 554065 - DNA, 25 bp, Homo sapien
aaaacagactggatgcattggctca

SEQ ID NO: 554066 - DNA, 25 bp, Homo sapien
aaacagactggatgcattggctcac

SEQ ID NO: 554067 - DNA, 25 bp, Homo sapien
aacagactggatgcattggctcacc

SEQ ID NO: 554068 - DNA, 25 bp, Homo sapien
acagactggatgcattggctcacct

SEQ ID NO: 554069 - DNA, 25 bp, Homo sapien
gactggatgcattggctcacctctg

SEQ ID NO: 554070 - DNA, 25 bp, Homo sapien
actggatgcattggctcacctctgt

SEQ ID NO: 554071 - DNA, 25 bp, Homo sapien
ctggatgcattggctcacctctgta

SEQ ID NO: 554072 - DNA, 25 bp, Homo sapien
ggatgcattggctcacctctgtaat

SEQ ID NO: 554073 - DNA, 25 bp, Homo sapien
cctccacctctgaggagcgtctggg

SEQ ID NO: 554074 - DNA, 25 bp, Homo sapien
gggaggcacatttatgcactttgta

SEQ ID NO: 554075 - DNA, 25 bp, Homo sapien
ttatgcactttgtatcaccctccga

SEQ ID NO: 554076 - DNA, 25 bp, Homo sapien
tgcactttgtatcaccctccgaact

SEQ ID NO: 554077 - DNA, 25 bp, Homo sapien
ttcccttccctggatttcatcacta

SEQ ID NO: 554078 - DNA, 25 bp, Homo sapien
gatttcatcactagtggttgaaggt

SEQ ID NO: 554079 - DNA, 25 bp, Homo sapien
tcactagtggttgaaggttttgtcc

SEQ ID NO: 554080 - DNA, 25 bp, Homo sapien
gataccaatttatagcattttttat

SEQ ID NO: 554081 - DNA, 25 bp, Homo sapien
gatttttataatgggtgggactgta

SEQ ID NO: 554082 - DNA, 25 bp, Homo sapien
aatgggtgggactgtatccctgcct

SEQ ID NO: 554083 - DNA, 25 bp, Homo sapien
aggtaccccacagagaccaatgaca

SEQ ID NO: 554084 - DNA, 25 bp, Homo sapien
gtgactgtttctagttaagtaattt

SEQ ID NO: 554085 - DNA, 25 bp, Homo sapien
aactatgaactctcaccaaaaagat

SEQ ID NO: 554086 - DNA, 25 bp, Homo sapien
accaaaaagatacacatgcaacatg

SEQ ID NO: 554087 - DNA, 25 bp, Homo sapien
aaatacatgttagactttgcataca

SEQ ID NO: 554088 - DNA, 25 bp, Homo sapien
gttagactttgcatacaattttagg

SEQ ID NO: 554089 - DNA, 25 bp, Homo sapien
atgggcctctaagcctatccatgta

SEQ ID NO: 554090 - DNA, 25 bp, Homo sapien
ctctaagcctatccatgtattccag

SEQ ID NO: 554091 - DNA, 25 bp, Homo sapien
aagcctatccatgtattccaggtta

SEQ ID NO: 554092 - DNA, 25 bp, Homo sapien
gtattccaggttaagccctctgtta

SEQ ID NO: 554093 - DNA, 25 bp, Homo sapien
ggttaagccctctgttatgatcaat

SEQ ID NO: 554094 - DNA, 25 bp, Homo sapien
gccctctgttatgatcaatccatta

SEQ ID NO: 554095 - DNA, 25 bp, Homo sapien
tttttgtaccagagtcccagactaa

SEQ ID NO: 554096 - DNA, 25 bp, Homo sapien
agagtcccagactaactgttggtag

SEQ ID NO: 554097 - DNA, 25 bp, Homo sapien
gtaggaatcttgtaaccagtcatgt

SEQ ID NO: 554098 - DNA, 25 bp, Homo sapien
tgttttggccgctgggaagctcaaa

SEQ ID NO: 554099 - DNA, 25 bp, Homo sapien
gctcaaagtcaaattcgagaccctt

SEQ ID NO: 554100 - DNA, 25 bp, Homo sapien
tttccaattgtgctgagtctcctac

SEQ ID NO: 554101 - DNA, 25 bp, Homo sapien
agtctcctactagactcgcttcatt

SEQ ID NO: 554102 - DNA, 25 bp, Homo sapien
agactcgcttcattctagctttctg

SEQ ID NO: 554103 - DNA, 25 bp, Homo sapien
cattctagctttctgcttttacctt

SEQ ID NO: 554104 - DNA, 25 bp, Homo sapien
tctgcttttacctttaccctaatct

SEQ ID NO: 554105 - DNA, 25 bp, Homo sapien
gctgagatatctgttttgcaacaag

SEQ ID NO: 554106 - DNA, 25 bp, Homo sapien
aggtttccaatatcttactcattta

SEQ ID NO: 554107 - DNA, 25 bp, Homo sapien
tactcatttaccaactcgaagaatt

SEQ ID NO: 554108 - DNA, 25 bp, Homo sapien
acacatttatagctgtacatccaga

SEQ ID NO: 554109 - DNA, 25 bp, Homo sapien
gctgtacatccagaccgattataca

SEQ ID NO: 554110 - DNA, 25 bp, Homo sapien
gaccgattatacaggcatctacaga

SEQ ID NO: 554111 - DNA, 25 bp, Homo sapien
caggcatctacagaataggtacaga

SEQ ID NO: 554112 - DNA, 25 bp, Homo sapien
acataatccttcaatgtctccattt

SEQ ID NO: 554113 - DNA, 25 bp, Homo sapien
gtaaaatactacagtcagctcacta

SEQ ID NO: 554114 - DNA, 25 bp, Homo sapien
ctacagtcagctcactatacacaca

SEQ ID NO: 554115 - DNA, 25 bp, Homo sapien
cacacaaatcatgaacagcagcttt

SEQ ID NO: 554116 - DNA, 25 bp, Homo sapien
agcagcttttcattaaggtttccaa

SEQ ID NO: 554117 - DNA, 25 bp, Homo sapien
tgaatctcccagtgttcagtctccc

SEQ ID NO: 554118 - DNA, 25 bp, Homo sapien
agccagagcctccatatgcttgaag

SEQ ID NO: 554119 - DNA, 25 bp, Homo sapien
agcctccatatgcttgaagtgctga

SEQ ID NO: 554120 - DNA, 25 bp, Homo sapien
gaagtgctgattacctacaaatgat

SEQ ID NO: 554121 - DNA, 25 bp, Homo sapien
gattacctacaaatgatttcagatc

SEQ ID NO: 554122 - DNA, 25 bp, Homo sapien
gatttcagatcatgtttgctaaaga

SEQ ID NO: 554123 - DNA, 25 bp, Homo sapien
ctggaagtgtgagatctgtaagaaa

SEQ ID NO: 554124 - DNA, 25 bp, Homo sapien
cttggagtcaagagatctggaaatc

SEQ ID NO: 554125 - DNA, 25 bp, Homo sapien
gagatctggaaatcttttaatcagt

SEQ ID NO: 554126 - DNA, 25 bp, Homo sapien
ttaatcagttaaattgtgcagcaat

SEQ ID NO: 554127 - DNA, 25 bp, Homo sapien
gtgcagcaatagatttttaacttta

SEQ ID NO: 554128 - DNA, 25 bp, Homo sapien
aaaagtacaggatggcttatctgat

SEQ ID NO: 554129 - DNA, 25 bp, Homo sapien
acaggatggcttatctgatattgca

SEQ ID NO: 554130 - DNA, 25 bp, Homo sapien
atggcttatctgatattgcagagaa

SEQ ID NO: 554131 - DNA, 25 bp, Homo sapien
attcctaaagaaagaccagagcgat

SEQ ID NO: 554132 - DNA, 25 bp, Homo sapien
agaccagagcgatgaaacttctgaa

SEQ ID NO: 554133 - DNA, 25 bp, Homo sapien
gtatgaatcttcatctgatggcact

SEQ ID NO: 554134 - DNA, 25 bp, Homo sapien
atctgatggcactgaaaagttacct

SEQ ID NO: 554135 - DNA, 25 bp, Homo sapien
ctgaaaagttacctgagcgagaaga

SEQ ID NO: 554136 - DNA, 25 bp, Homo sapien
ttacctgagcgagaagaaatttgtc

SEQ ID NO: 554137 - DNA, 25 bp, Homo sapien
gcgagaagaaatttgtcattttcct

SEQ ID NO: 554138 - DNA, 25 bp, Homo sapien
ttgtcattttcctaagggcataaaa

SEQ ID NO: 554139 - DNA, 25 bp, Homo sapien
accgcatgtcgctggtgaagaggag

SEQ ID NO: 554140 - DNA, 25 bp, Homo sapien
aggaggtttgccacagggatgtacc

SEQ ID NO: 554141 - DNA, 25 bp, Homo sapien
gtttgccacagggatgtacctggtg

SEQ ID NO: 554142 - DNA, 25 bp, Homo sapien
gccacagggatgtacctggtgagct

SEQ ID NO: 554143 - DNA, 25 bp, Homo sapien
ctggtgagctgctgaacccgcaaat

SEQ ID NO: 554144 - DNA, 25 bp, Homo sapien
tgagctgctgaacccgcaaatgctg

SEQ ID NO: 554145 - DNA, 25 bp, Homo sapien
tgctgaacccgcaaatgctgctgcc

SEQ ID NO: 554146 - DNA, 25 bp, Homo sapien
tacactgcgccctggtgctggctga

SEQ ID NO: 554147 - DNA, 25 bp, Homo sapien
tgaggcccatactccacggagagga

SEQ ID NO: 554148 - DNA, 25 bp, Homo sapien
atactccacggagaggagccccatg

SEQ ID NO: 554149 - DNA, 25 bp, Homo sapien
tggctgagcccgagattcgctcctc

SEQ ID NO: 554150 - DNA, 25 bp, Homo sapien
tttaaaatactcaggactatgggtg

SEQ ID NO: 554151 - DNA, 25 bp, Homo sapien
tatgggtgagtagtgtttaattttc

SEQ ID NO: 554152 - DNA, 25 bp, Homo sapien
gtctttattcctatacaagcaatat

SEQ ID NO: 554153 - DNA, 25 bp, Homo sapien
gaaagttttaattattgcaatcata

SEQ ID NO: 554154 - DNA, 25 bp, Homo sapien
tgcaatcatagtacaattccatttg

SEQ ID NO: 554155 - DNA, 25 bp, Homo sapien
aaatattctgtttctacttgttcat

SEQ ID NO: 554156 - DNA, 25 bp, Homo sapien
ttctgtttctacttgttcataatta

SEQ ID NO: 554157 - DNA, 25 bp, Homo sapien
aaatgctatctagttgggcttccat

SEQ ID NO: 554158 - DNA, 25 bp, Homo sapien
atctagttgggcttccatgcattca

SEQ ID NO: 554159 - DNA, 25 bp, Homo sapien
ggcttccatgcattcactcaacaaa

SEQ ID NO: 554160 - DNA, 25 bp, Homo sapien
actcaacaaatattctaggcctggc

SEQ ID NO: 554161 - DNA, 25 bp, Homo sapien
gttgctggtcagtcttagtgtttta

SEQ ID NO: 554162 - DNA, 25 bp, Homo sapien
gttttattgctctgagtaactgaca

SEQ ID NO: 554163 - DNA, 25 bp, Homo sapien
tcagtttttgtagtaaaggcgtcac

SEQ ID NO: 554164 - DNA, 25 bp, Homo sapien
ttttgtagtaaaggcgtcacatgca

SEQ ID NO: 554165 - DNA, 25 bp, Homo sapien
gtagtaaaggcgtcacatgcaaaca

SEQ ID NO: 554166 - DNA, 25 bp, Homo sapien
gtaaaggcgtcacatgcaaacaaac

SEQ ID NO: 554167 - DNA, 25 bp, Homo sapien
ttaaaccactttcctggaaacagag

SEQ ID NO: 554168 - DNA, 25 bp, Homo sapien
tggaaacagagcaattactggcctg

SEQ ID NO: 554169 - DNA, 25 bp, Homo sapien
cagagcaattactggcctgttgggt

SEQ ID NO: 554170 - DNA, 25 bp, Homo sapien
agagcaattactggcctgttgggtg

SEQ ID NO: 554171 - DNA, 25 bp, Homo sapien
gcctgttgggtgaaaaatcttttct

SEQ ID NO: 554172 - DNA, 25 bp, Homo sapien
gacaagattctgcagatcattacgg

SEQ ID NO: 554173 - DNA, 25 bp, Homo sapien
ttctgcagatcattacggaattgat

SEQ ID NO: 554174 - DNA, 25 bp, Homo sapien
actgaaattcatggtcaactgcttt

SEQ ID NO: 554175 - DNA, 25 bp, Homo sapien
gaaattcatggtcaactgctttaaa

SEQ ID NO: 554176 - DNA, 25 bp, Homo sapien
gatacagtcatgaaattatctgaaa

SEQ ID NO: 554177 - DNA, 25 bp, Homo sapien
attatctgaaaatgggtcatcacat

SEQ ID NO: 554178 - DNA, 25 bp, Homo sapien
atgggtcatcacattaagtatttca

SEQ ID NO: 554179 - DNA, 25 bp, Homo sapien
ttacttaaaatgttggtactagcca

SEQ ID NO: 554180 - DNA, 25 bp, Homo sapien
atgttggtactagccattaacttaa

SEQ ID NO: 554181 - DNA, 25 bp, Homo sapien
gattattctgaatgtatttgccact

SEQ ID NO: 554182 - DNA, 25 bp, Homo sapien
gtatttgccactacatttacaataa

SEQ ID NO: 554183 - DNA, 25 bp, Homo sapien
atgagaagtaaaacattctgctggg

SEQ ID NO: 554184 - DNA, 25 bp, Homo sapien
aaacattctgctggggtgctacata

SEQ ID NO: 554185 - DNA, 25 bp, Homo sapien
tttctgtatctcactaaatgcggtt

SEQ ID NO: 554186 - DNA, 25 bp, Homo sapien
ctgtatctcactaaatgcggttgaa

SEQ ID NO: 554187 - DNA, 25 bp, Homo sapien
atctcactaaatgcggttgaagagt

SEQ ID NO: 554188 - DNA, 25 bp, Homo sapien
cgcgcgcgcatgtggccaaaaaata

SEQ ID NO: 554189 - DNA, 25 bp, Homo sapien
gccaaaaaatagtgccataatgtca

SEQ ID NO: 554190 - DNA, 25 bp, Homo sapien
aatgtcaaattcttcctttgctctg

SEQ ID NO: 554191 - DNA, 25 bp, Homo sapien
gtcaaattcttcctttgctctgttt

SEQ ID NO: 554192 - DNA, 25 bp, Homo sapien
gttgatgacatcaggcacttttcag

SEQ ID NO: 554193 - DNA, 25 bp, Homo sapien
atgacatcaggcacttttcagtgtt

SEQ ID NO: 554194 - DNA, 25 bp, Homo sapien
ctgagggcagggttgcggcagacat

SEQ ID NO: 554195 - DNA, 25 bp, Homo sapien
gttgcggcagacatgcggccagttg

SEQ ID NO: 554196 - DNA, 25 bp, Homo sapien
agacatgcggccagttggggacctc

SEQ ID NO: 554197 - DNA, 25 bp, Homo sapien
tgggcccgagtgtgtgctggcaggg

SEQ ID NO: 554198 - DNA, 25 bp, Homo sapien
tggcagggggctttcttttcgccgc

SEQ ID NO: 554199 - DNA, 25 bp, Homo sapien
ctcctccttcccaggcggaggctgt

SEQ ID NO: 554200 - DNA, 25 bp, Homo sapien
tgacccctgcctagcacactggttt

SEQ ID NO: 554201 - DNA, 25 bp, Homo sapien
acccctgcctagcacactggttttg

SEQ ID NO: 554202 - DNA, 25 bp, Homo sapien
tcggtccctcagtaacgcgcagttc

SEQ ID NO: 554203 - DNA, 25 bp, Homo sapien
gtccctcagtaacgcgcagttccaa

SEQ ID NO: 554204 - DNA, 25 bp, Homo sapien
ctcagtaacgcgcagttccaagtcc

SEQ ID NO: 554205 - DNA, 25 bp, Homo sapien
tggtttcttaagtccagaactgcaa

SEQ ID NO: 554206 - DNA, 25 bp, Homo sapien
ccttttcatcactgagaatatcata

SEQ ID NO: 554207 - DNA, 25 bp, Homo sapien
gtccagaactgcaatggagctccag

SEQ ID NO: 554208 - DNA, 25 bp, Homo sapien
agaactgcaatggagctccagagga

SEQ ID NO: 554209 - DNA, 25 bp, Homo sapien
agctccagaggagatgtaatacctt

SEQ ID NO: 554210 - DNA, 25 bp, Homo sapien
gatgtaataccttaattactttgat

SEQ ID NO: 554211 - DNA, 25 bp, Homo sapien
gaatatcatatggtactaacaaagg

SEQ ID NO: 554212 - DNA, 25 bp, Homo sapien
gaagaagatcgttttctgatttgta

SEQ ID NO: 554213 - DNA, 25 bp, Homo sapien
tgatttgtatgcttcgaccaacttg

SEQ ID NO: 554214 - DNA, 25 bp, Homo sapien
ttgtatgcttcgaccaacttggatt

SEQ ID NO: 554215 - DNA, 25 bp, Homo sapien
atgcttcgaccaacttggatttgac

SEQ ID NO: 554216 - DNA, 25 bp, Homo sapien
ttgactgactatatcatggtccagg

SEQ ID NO: 554217 - DNA, 25 bp, Homo sapien
catggtccaggttactttacatttc

SEQ ID NO: 554218 - DNA, 25 bp, Homo sapien
ttcttatatattccagtcactgctg

SEQ ID NO: 554219 - DNA, 25 bp, Homo sapien
actgtagactaccatcttcctaaag

SEQ ID NO: 554220 - DNA, 25 bp, Homo sapien
cttcctaaagggatattggtatttg

SEQ ID NO: 554221 - DNA, 25 bp, Homo sapien
agtgctcctttctacaaacatgatg

SEQ ID NO: 554222 - DNA, 25 bp, Homo sapien
acatgatgtgccaaaattgttttat

SEQ ID NO: 554223 - DNA, 25 bp, Homo sapien
cactgctgttattgtctgagggtag

SEQ ID NO: 554224 - DNA, 25 bp, Homo sapien
gttattgtctgagggtaggcagctt

SEQ ID NO: 554225 - DNA, 25 bp, Homo sapien
taggcagcttggaaaaatgtaggca

SEQ ID NO: 554226 - DNA, 25 bp, Homo sapien
gtaggcaacaccaagttttaatctt

SEQ ID NO: 554227 - DNA, 25 bp, Homo sapien
tggtttcttaagtccagaactgcaa

SEQ ID NO: 554228 - DNA, 25 bp, Homo sapien
gtttcttaagtccagaactgcaatg

SEQ ID NO: 554229 - DNA, 25 bp, Homo sapien
taagtccagaactgcaatggagctc

SEQ ID NO: 554230 - DNA, 25 bp, Homo sapien
gtccagaactgcaatggagctccag

SEQ ID NO: 554231 - DNA, 25 bp, Homo sapien
ccagaactgcaatggagctccagag

SEQ ID NO: 554232 - DNA, 25 bp, Homo sapien
gaactgcaatggagctccagaggag

SEQ ID NO: 554233 - DNA, 25 bp, Homo sapien
agctccagaggagatgtaatacctt

SEQ ID NO: 554234 - DNA, 25 bp, Homo sapien
cagaggagatgtaataccttaatta

SEQ ID NO: 554235 - DNA, 25 bp, Homo sapien
gatgtaataccttaattactttgat

SEQ ID NO: 554236 - DNA, 25 bp, Homo sapien
gagaatatcatatggtactaacaaa

SEQ ID NO: 554237 - DNA, 25 bp, Homo sapien
gaagaagatcgttttctgatttgta

SEQ ID NO: 554238 - DNA, 25 bp, Homo sapien
gaagttgctccgagctgtctttatt

SEQ ID NO: 554239 - DNA, 25 bp, Homo sapien
ctttattctcttcttggtcaaggtt

SEQ ID NO: 554240 - DNA, 25 bp, Homo sapien
aggttaacaattgctaaatgatcgc

SEQ ID NO: 554241 - DNA, 25 bp, Homo sapien
gatcgcaaattcacctaaacaatac

SEQ ID NO: 554242 - DNA, 25 bp, Homo sapien
tacaaagccatctttacatgcatta

SEQ ID NO: 554243 - DNA, 25 bp, Homo sapien
acatgcattaaacgagggctacaac

SEQ ID NO: 554244 - DNA, 25 bp, Homo sapien
acgagggctacaacaatattgtttt

SEQ ID NO: 554245 - DNA, 25 bp, Homo sapien
tatgtacttagtgttagagggtcaa

SEQ ID NO: 554246 - DNA, 25 bp, Homo sapien
gagggtcaaaataatctttctgctt

SEQ ID NO: 554247 - DNA, 25 bp, Homo sapien
gcttagcatctcttaaaccatacct

SEQ ID NO: 554248 - DNA, 25 bp, Homo sapien
agcaggattattacatttacagtac

SEQ ID NO: 554249 - DNA, 25 bp, Homo sapien
ttctgaacaacttttttggaacatt

SEQ ID NO: 554250 - DNA, 25 bp, Homo sapien
tatctatattccaaagcatgtaata

SEQ ID NO: 554251 - DNA, 25 bp, Homo sapien
gatttgttaaactggtccttagtca

SEQ ID NO: 554252 - DNA, 25 bp, Homo sapien
ggtccttagtcatttgtataattag

SEQ ID NO: 554253 - DNA, 25 bp, Homo sapien
atttgtatagccttctagaatcaga

SEQ ID NO: 554254 - DNA, 25 bp, Homo sapien
tgtatagccttctagaatcagaaat

SEQ ID NO: 554255 - DNA, 25 bp, Homo sapien
gccttctagaatcagaaataacctt

SEQ ID NO: 554256 - DNA, 25 bp, Homo sapien
gaaataacctttttgcatattcttt

SEQ ID NO: 554257 - DNA, 25 bp, Homo sapien
aacctttttgcatattcttttattg

SEQ ID NO: 554258 - DNA, 25 bp, Homo sapien
ttgcatattcttttattgttctgac

SEQ ID NO: 554259 - DNA, 25 bp, Homo sapien
gtcaataaacaaaaggtgtgctact

SEQ ID NO: 554260 - DNA, 25 bp, Homo sapien
actctgtccgggacaagtgtgtgga

SEQ ID NO: 554261 - DNA, 25 bp, Homo sapien
gtgtggagatgctgtcagcagccct

SEQ ID NO: 554262 - DNA, 25 bp, Homo sapien
gccctgaaggcggacgatgattaca

SEQ ID NO: 554263 - DNA, 25 bp, Homo sapien
ggcggacgatgattacaaggactat

SEQ ID NO: 554264 - DNA, 25 bp, Homo sapien
aggactatggagtcaactgtgacaa

SEQ ID NO: 554265 - DNA, 25 bp, Homo sapien
gtcaactgtgacaagatggcatcag

SEQ ID NO: 554266 - DNA, 25 bp, Homo sapien
agatcatatctaccaagagctcaag

SEQ ID NO: 554267 - DNA, 25 bp, Homo sapien
gagctcaagagcacggacatgaagt

SEQ ID NO: 554268 - DNA, 25 bp, Homo sapien
atgaagtaccggaaccgcgtgcgca

SEQ ID NO: 554269 - DNA, 25 bp, Homo sapien
gcagccgcataagcaacctcaagga

SEQ ID NO: 554270 - DNA, 25 bp, Homo sapien
tctccgcagggcttatagccaagat

SEQ ID NO: 554271 - DNA, 25 bp, Homo sapien
caggcacagaagtcatcccggcagc

SEQ ID NO: 554272 - DNA, 25 bp, Homo sapien
caggaagcccagaaagttctccaaa

SEQ ID NO: 554273 - DNA, 25 bp, Homo sapien
gaaagttctccaaactggtcctgct

SEQ ID NO: 554274 - DNA, 25 bp, Homo sapien
gcctccaaagacagcaccaaggtgg

SEQ ID NO: 554275 - DNA, 25 bp, Homo sapien
ccaagcgcaagggtgtgcactgtgt

SEQ ID NO: 554276 - DNA, 25 bp, Homo sapien
agcgcaagggtgtgcactgtgtcat

SEQ ID NO: 554277 - DNA, 25 bp, Homo sapien
caagggtgtgcactgtgtcatgtcc

SEQ ID NO: 554278 - DNA, 25 bp, Homo sapien
agggtgtgcactgtgtcatgtccct

SEQ ID NO: 554279 - DNA, 25 bp, Homo sapien
aacggagcaggcaggacccaggcac

SEQ ID NO: 554280 - DNA, 25 bp, Homo sapien
acccaggcacagacagaacagaaga

SEQ ID NO: 554281 - DNA, 25 bp, Homo sapien
acagaagacagtggattagcagcgg

SEQ ID NO: 554282 - DNA, 25 bp, Homo sapien
tccggctcctgctgtcagacatttt

SEQ ID NO: 554283 - DNA, 25 bp, Homo sapien
gtcagacattttgttcctctctgcc

SEQ ID NO: 554284 - DNA, 25 bp, Homo sapien
catccctctatttcagtgtggtttc

SEQ ID NO: 554285 - DNA, 25 bp, Homo sapien
cccgacaatgtatctctcactgaga

SEQ ID NO: 554286 - DNA, 25 bp, Homo sapien
ggtggtcccatggtttgtctttact

SEQ ID NO: 554287 - DNA, 25 bp, Homo sapien
tttcccatattttcacttctgctta

SEQ ID NO: 554288 - DNA, 25 bp, Homo sapien
gtgtggtttctgttcctgagttctc

SEQ ID NO: 554289 - DNA, 25 bp, Homo sapien
ctgagttctctgtgatgtcctttat

SEQ ID NO: 554290 - DNA, 25 bp, Homo sapien
tgatgtcctttatcccatatgtgcc

SEQ ID NO: 554291 - DNA, 25 bp, Homo sapien
tatgtgcccacattgagtcagtctg

SEQ ID NO: 554292 - DNA, 25 bp, Homo sapien
attgagtcagtctgagcagagccct

SEQ ID NO: 554293 - DNA, 25 bp, Homo sapien
cttagcaaaatgtcctctagattca

SEQ ID NO: 554294 - DNA, 25 bp, Homo sapien
agcaaaatgtcctctagattcatcc

SEQ ID NO: 554295 - DNA, 25 bp, Homo sapien
tgtcctctagattcatccacaacac

SEQ ID NO: 554296 - DNA, 25 bp, Homo sapien
tcctctagattcatccacaacacga

SEQ ID NO: 554297 - DNA, 25 bp, Homo sapien
tctagattcatccacaacacgattt

SEQ ID NO: 554298 - DNA, 25 bp, Homo sapien
agattcatccacaacacgatttcct

SEQ ID NO: 554299 - DNA, 25 bp, Homo sapien
gattcatccacaacacgatttcctt

SEQ ID NO: 554300 - DNA, 25 bp, Homo sapien
attcatccacaacacgatttccttc

SEQ ID NO: 554301 - DNA, 25 bp, Homo sapien
tccacaacacgatttccttcctttt

SEQ ID NO: 554302 - DNA, 25 bp, Homo sapien
gtaagaacctgatcaagttgaacat

SEQ ID NO: 554303 - DNA, 25 bp, Homo sapien
gaacctgatcaagttgaacatgtat

SEQ ID NO: 554304 - DNA, 25 bp, Homo sapien
aagattggttcctgagagccccgag

SEQ ID NO: 554305 - DNA, 25 bp, Homo sapien
atgacagtgtctgggctgccaaaga

SEQ ID NO: 554306 - DNA, 25 bp, Homo sapien
gccaaagaagcagtgcccctgtgat

SEQ ID NO: 554307 - DNA, 25 bp, Homo sapien
gcccctgtgatcatttcaagggcaa

SEQ ID NO: 554308 - DNA, 25 bp, Homo sapien
aacaagacaccaaaggcaccacaga

SEQ ID NO: 554309 - DNA, 25 bp, Homo sapien
aaacaagcattccagagcctgccag

SEQ ID NO: 554310 - DNA, 25 bp, Homo sapien
agcctgccagcaatttctcaaacaa

SEQ ID NO: 554311 - DNA, 25 bp, Homo sapien
cagctaagaagctttgctctgcctt

SEQ ID NO: 554312 - DNA, 25 bp, Homo sapien
aagctttgctctgcctttgtaggag

SEQ ID NO: 554313 - DNA, 25 bp, Homo sapien
tttgtaggagctctgagcgcccact

SEQ ID NO: 554314 - DNA, 25 bp, Homo sapien
gcccactcttccaattaaacattct

SEQ ID NO: 554315 - DNA, 25 bp, Homo sapien
gcctcctcctggttggccttgtcta

SEQ ID NO: 554316 - DNA, 25 bp, Homo sapien
gtgtcccacctgagtcagcggtgac

SEQ ID NO: 554317 - DNA, 25 bp, Homo sapien
tcagcggtgacctctgagggctgat

SEQ ID NO: 554318 - DNA, 25 bp, Homo sapien
gagagggacttgctgggccttggtg

SEQ ID NO: 554319 - DNA, 25 bp, Homo sapien
ctggtggtgccttgaaggtatgatc

SEQ ID NO: 554320 - DNA, 25 bp, Homo sapien
gtttcccctttgtgttaagcgtgag

SEQ ID NO: 554321 - DNA, 25 bp, Homo sapien
ccctttgtgttaagcgtgaggcaga

SEQ ID NO: 554322 - DNA, 25 bp, Homo sapien
gcagagggagacgttagtccagcat

SEQ ID NO: 554323 - DNA, 25 bp, Homo sapien
gacgttagtccagcatttccaaagt

SEQ ID NO: 554324 - DNA, 25 bp, Homo sapien
tgggtccgttggttcccgagatact

SEQ ID NO: 554325 - DNA, 25 bp, Homo sapien
tggttcccgagatacttttaggtgg

SEQ ID NO: 554326 - DNA, 25 bp, Homo sapien
ggaaaacatctacagttgtacagct

SEQ ID NO: 554327 - DNA, 25 bp, Homo sapien
ttgtacagctgtatcctcctcaaaa

SEQ ID NO: 554328 - DNA, 25 bp, Homo sapien
tgtatcctcctcaaaatccggtgaa

SEQ ID NO: 554329 - DNA, 25 bp, Homo sapien
tcctcctcaaaatccggtgaagaat

SEQ ID NO: 554330 - DNA, 25 bp, Homo sapien
aatgctatttttctaggctgagctt

SEQ ID NO: 554331 - DNA, 25 bp, Homo sapien
ctaggctgagcttttgttataaact

SEQ ID NO: 554332 - DNA, 25 bp, Homo sapien
aaggcaagggttatgatcctgatgt

SEQ ID NO: 554333 - DNA, 25 bp, Homo sapien
gacttactagtgtaatttgcatttt

SEQ ID NO: 554334 - DNA, 25 bp, Homo sapien
ggtcatttatgggatcagtaagcac

SEQ ID NO: 554335 - DNA, 25 bp, Homo sapien
atgggatcagtaagcacagtagtgt

SEQ ID NO: 554336 - DNA, 25 bp, Homo sapien
gtgtgattatatctgggaaaacatc

SEQ ID NO: 554337 - DNA, 25 bp, Homo sapien
gattttctggtattcttgttcactt

SEQ ID NO: 554338 - DNA, 25 bp, Homo sapien
ggtattcttgttcacttgattacat

SEQ ID NO: 554339 - DNA, 25 bp, Homo sapien
tttgtataaagttctgattgccagt

SEQ ID NO: 554340 - DNA, 25 bp, Homo sapien
attgccagttgctcagataacaagt

SEQ ID NO: 554341 - DNA, 25 bp, Homo sapien
caagtgacaaggcagaattctttaa

SEQ ID NO: 554342 - DNA, 25 bp, Homo sapien
atcagtaaagttccttaagcctaag

SEQ ID NO: 554343 - DNA, 25 bp, Homo sapien
aagcctaaggctaaatcttgaatac

SEQ ID NO: 554344 - DNA, 25 bp, Homo sapien
tgaattctttaatatcctgatggca

SEQ ID NO: 554345 - DNA, 25 bp, Homo sapien
tatcctgatggcaagcagactgata

SEQ ID NO: 554346 - DNA, 25 bp, Homo sapien
agactgatagctgcacatttggcat

SEQ ID NO: 554347 - DNA, 25 bp, Homo sapien
gcacatttggcatgctttgtttaat

SEQ ID NO: 554348 - DNA, 25 bp, Homo sapien
gagaaatctggaaccttcttctggg

SEQ ID NO: 554349 - DNA, 25 bp, Homo sapien
atctggaaccttcttctgggtagat

SEQ ID NO: 554350 - DNA, 25 bp, Homo sapien
aatgttgagcactttgtacatgctt

SEQ ID NO: 554351 - DNA, 25 bp, Homo sapien
gagcataatctttgtcatctgtttt

SEQ ID NO: 554352 - DNA, 25 bp, Homo sapien
ttttttcccctagacaatatcaggt

SEQ ID NO: 554353 - DNA, 25 bp, Homo sapien
gacaatatcaggttaccgtcaacat

SEQ ID NO: 554354 - DNA, 25 bp, Homo sapien
ggttaccgtcaacattaatccattt

SEQ ID NO: 554355 - DNA, 25 bp, Homo sapien
aaaaggacatggactgttgccatta

SEQ ID NO: 554356 - DNA, 25 bp, Homo sapien
gactgttgccattaatacttttgga

SEQ ID NO: 554357 - DNA, 25 bp, Homo sapien
tttggattccatataacccttaaca

SEQ ID NO: 554358 - DNA, 25 bp, Homo sapien
taacccttaacacaataacttctag

SEQ ID NO: 554359 - DNA, 25 bp, Homo sapien
accgcatgtcgctggtgaagaggag

SEQ ID NO: 554360 - DNA, 25 bp, Homo sapien
aggaggtttgccacagggatgtacc

SEQ ID NO: 554361 - DNA, 25 bp, Homo sapien
gtttgccacagggatgtacctggtg

SEQ ID NO: 554362 - DNA, 25 bp, Homo sapien
gccacagggatgtacctggtgagct

SEQ ID NO: 554363 - DNA, 25 bp, Homo sapien
ctggtgagctgctgaacccgcaaat

SEQ ID NO: 554364 - DNA, 25 bp, Homo sapien
ggtgagctgctgaacccgcaaatgc

SEQ ID NO: 554365 - DNA, 25 bp, Homo sapien
tgagctgctgaacccgcaaatgctg

SEQ ID NO: 554366 - DNA, 25 bp, Homo sapien
tgctgaacccgcaaatgctgctgcc

SEQ ID NO: 554367 - DNA, 25 bp, Homo sapien
agctctacactgcgccctggtgctg

SEQ ID NO: 554368 - DNA, 25 bp, Homo sapien
ctgaggcccatactccacggagagg

SEQ ID NO: 554369 - DNA, 25 bp, Homo sapien
tgaggcccatactccacggagagga

SEQ ID NO: 554370 - DNA, 25 bp, Homo sapien
gagccgcttctgcttcttaaagtac

SEQ ID NO: 554371 - DNA, 25 bp, Homo sapien
tacttgatcatctgcgagaggtccc

SEQ ID NO: 554372 - DNA, 25 bp, Homo sapien
cgtcagccaactccagcacaatgtt

SEQ ID NO: 554373 - DNA, 25 bp, Homo sapien
acaatgttcagctcgttgtcttcga

SEQ ID NO: 554374 - DNA, 25 bp, Homo sapien
gttgtcttcgataaacgagtccaaa

SEQ ID NO: 554375 - DNA, 25 bp, Homo sapien
atatttgggtggttcagttgcttca

SEQ ID NO: 554376 - DNA, 25 bp, Homo sapien
tcagttgcttcaagaggccgatctc

SEQ ID NO: 554377 - DNA, 25 bp, Homo sapien
aagaggccgatctccttgacacagt

SEQ ID NO: 554378 - DNA, 25 bp, Homo sapien
ttggcgtccatcatctcaaagatct

SEQ ID NO: 554379 - DNA, 25 bp, Homo sapien
tcaaagatctgcaccttcttcagag

SEQ ID NO: 554380 - DNA, 25 bp, Homo sapien
aggtggccttgtacacctcgctgaa

SEQ ID NO: 554381 - DNA, 25 bp, Homo sapien
aactgcatgtctgttctttggtaga

SEQ ID NO: 554382 - DNA, 25 bp, Homo sapien
aatagcttttgctttatattaagta

SEQ ID NO: 554383 - DNA, 25 bp, Homo sapien
atattctctctatttggataaggaa

SEQ ID NO: 554384 - DNA, 25 bp, Homo sapien
tctctatttggataaggaaaccttc

SEQ ID NO: 554385 - DNA, 25 bp, Homo sapien
ggaaaccttcgctttatttgacaat

SEQ ID NO: 554386 - DNA, 25 bp, Homo sapien
accttcgctttatttgacaatgtat

SEQ ID NO: 554387 - DNA, 25 bp, Homo sapien
gatatactcttctaattcacctctg

SEQ ID NO: 554388 - DNA, 25 bp, Homo sapien
atactcttctaattcacctctgtgt

SEQ ID NO: 554389 - DNA, 25 bp, Homo sapien
ctcttctaattcacctctgtgtctt

SEQ ID NO: 554390 - DNA, 25 bp, Homo sapien
gtatctaacaggaaagcagttctta

SEQ ID NO: 554391 - DNA, 25 bp, Homo sapien
caggaaagcagttcttatgaaattt

SEQ ID NO: 554392 - DNA, 25 bp, Homo sapien
ttctgcacacgtgtctgagagcgtc

SEQ ID NO: 554393 - DNA, 25 bp, Homo sapien
gagagcgtctgccatagacgtctgt

SEQ ID NO: 554394 - DNA, 25 bp, Homo sapien
agacgtctgtgcgtttccgtgaagc

SEQ ID NO: 554395 - DNA, 25 bp, Homo sapien
tccgtgaagcactgcgccctaagga

SEQ ID NO: 554396 - DNA, 25 bp, Homo sapien
taaggacccaactctgactagcagc

SEQ ID NO: 554397 - DNA, 25 bp, Homo sapien
cgctcaggagactcgcactgggtgt

SEQ ID NO: 554398 - DNA, 25 bp, Homo sapien
actgggtgtagactgcgtctttgca

SEQ ID NO: 554399 - DNA, 25 bp, Homo sapien
agaggcttctgatgacgccagagct

SEQ ID NO: 554400 - DNA, 25 bp, Homo sapien
gccagagctgtaagtgtcgtgacga

SEQ ID NO: 554401 - DNA, 25 bp, Homo sapien
gcccttcttaagctgttctgtttct

SEQ ID NO: 554402 - DNA, 25 bp, Homo sapien
ttctgtttctgtggctttaactgac

SEQ ID NO: 554403 - DNA, 25 bp, Homo sapien
ttaatggctgtcatgttcactctga

SEQ ID NO: 554404 - DNA, 25 bp, Homo sapien
acaattattctagggatattttcag

SEQ ID NO: 554405 - DNA, 25 bp, Homo sapien
aaatgcgtgtgccatatgcaattgc

SEQ ID NO: 554406 - DNA, 25 bp, Homo sapien
gcgtgtgccatatgcaattgcattt

SEQ ID NO: 554407 - DNA, 25 bp, Homo sapien
aattgcatttcttgtgccaagaaac

SEQ ID NO: 554408 - DNA, 25 bp, Homo sapien
atagttcaattttatggccttacag

SEQ ID NO: 554409 - DNA, 25 bp, Homo sapien
tatggccttacagatggcttttatt

SEQ ID NO: 554410 - DNA, 25 bp, Homo sapien
ggcttttattttgtttgcagctgac

SEQ ID NO: 554411 - DNA, 25 bp, Homo sapien
tgtttgcagctgacactgcagttcc

SEQ ID NO: 554412 - DNA, 25 bp, Homo sapien
gacactgcagttcctttcatgcaaa

SEQ ID NO: 554413 - DNA, 25 bp, Homo sapien
cagttcctttcatgcaaaataccat

SEQ ID NO: 554414 - DNA, 25 bp, Homo sapien
ctatacattcggagaagtcgcaaat

SEQ ID NO: 554415 - DNA, 25 bp, Homo sapien
gaagggattacttgaaggagactat

SEQ ID NO: 554416 - DNA, 25 bp, Homo sapien
gaagttgtagtgagcacaggagtct

SEQ ID NO: 554417 - DNA, 25 bp, Homo sapien
cacaggagtcttgggacgaggccta

SEQ ID NO: 554418 - DNA, 25 bp, Homo sapien
gggacgaggcctagacttgatcagt

SEQ ID NO: 554419 - DNA, 25 bp, Homo sapien
agacttgatcagtgtcaggctggtt

SEQ ID NO: 554420 - DNA, 25 bp, Homo sapien
agtgtcaggctggttgtcaattttg

SEQ ID NO: 554421 - DNA, 25 bp, Homo sapien
ggttgtcaattttgatatgccttca

SEQ ID NO: 554422 - DNA, 25 bp, Homo sapien
ttgatatgccttcaagtatggatga

SEQ ID NO: 554423 - DNA, 25 bp, Homo sapien
atcacagggctgaaaagcatatcta

SEQ ID NO: 554424 - DNA, 25 bp, Homo sapien
aaagcatatctatacattcggagaa

SEQ ID NO: 554425 - DNA, 25 bp, Homo sapien
aagagagaattgatgtccctgacta

SEQ ID NO: 554426 - DNA, 25 bp, Homo sapien
tccctgactaacagcatcagacctt

SEQ ID NO: 554427 - DNA, 25 bp, Homo sapien
atcagaccttttgacacctgcttga

SEQ ID NO: 554428 - DNA, 25 bp, Homo sapien
gacacctgcttgaccaggatttgga

SEQ ID NO: 554429 - DNA, 25 bp, Homo sapien
aatacagagatttgacagagtggct

SEQ ID NO: 554430 - DNA, 25 bp, Homo sapien
cagagtggctgatgtcaaggagaac

SEQ ID NO: 554431 - DNA, 25 bp, Homo sapien
tactgtaaggagttcttctctcaat

SEQ ID NO: 554432 - DNA, 25 bp, Homo sapien
agttcttctctcaatgtgtgacctg

SEQ ID NO: 554433 - DNA, 25 bp, Homo sapien
tgccctgtctatcaccagtgggtat

SEQ ID NO: 554434 - DNA, 25 bp, Homo sapien
gtgggtatctgagcttaaggcctct

SEQ ID NO: 554435 - DNA, 25 bp, Homo sapien
atctgagcttaaggcctctgtaatg

SEQ ID NO: 554436 - DNA, 25 bp, Homo sapien
caaacattgatagtagggactccat

SEQ ID NO: 554437 - DNA, 25 bp, Homo sapien
ggactccatggaatatttgcccagt

SEQ ID NO: 554438 - DNA, 25 bp, Homo sapien
gcccagtaatggtaagaaatctttc

SEQ ID NO: 554439 - DNA, 25 bp, Homo sapien
ggatggttcttcttttacccaatct

SEQ ID NO: 554440 - DNA, 25 bp, Homo sapien
tgttgagtggtacttgtattccctt

SEQ ID NO: 554441 - DNA, 25 bp, Homo sapien
gtattcccttatcaaattaatcaca

SEQ ID NO: 554442 - DNA, 25 bp, Homo sapien
acatagcttttatacagaaactctt

SEQ ID NO: 554443 - DNA, 25 bp, Homo sapien
gtgtgagctgttaaggtgccaaatt

SEQ ID NO: 554444 - DNA, 25 bp, Homo sapien
aaattggctgtcatttgtattcatg

SEQ ID NO: 554445 - DNA, 25 bp, Homo sapien
gacacataccataaagcatctgcta

SEQ ID NO: 554446 - DNA, 25 bp, Homo sapien
atctgctaatgctttaatggattga

SEQ ID NO: 554447 - DNA, 25 bp, Homo sapien
attaattttggctaatggaattgca

SEQ ID NO: 554448 - DNA, 25 bp, Homo sapien
tggaattgcaaagttcctcctaccc

SEQ ID NO: 554449 - DNA, 25 bp, Homo sapien
aattgcaaagttcctcctaccctca

SEQ ID NO: 554450 - DNA, 25 bp, Homo sapien
tcacctccagatatggcagcatacg

SEQ ID NO: 554451 - DNA, 25 bp, Homo sapien
gggcataagaccgtttagttcaacg

SEQ ID NO: 554452 - DNA, 25 bp, Homo sapien
gtttagttcaacgtgttctacacat

SEQ ID NO: 554453 - DNA, 25 bp, Homo sapien
gttcaacgtgttctacacattccag

SEQ ID NO: 554454 - DNA, 25 bp, Homo sapien
aacgtgttctacacattccagctgt

SEQ ID NO: 554455 - DNA, 25 bp, Homo sapien
cgtgttctacacattccagctgttt

SEQ ID NO: 554456 - DNA, 25 bp, Homo sapien
actagttacccggatatcctattat

SEQ ID NO: 554457 - DNA, 25 bp, Homo sapien
gggacactatatttgctcactgata

SEQ ID NO: 554458 - DNA, 25 bp, Homo sapien
gaaagagtttgcaatgtggccatct

SEQ ID NO: 554459 - DNA, 25 bp, Homo sapien
ttgcaatgtggccatctcaggttgc

SEQ ID NO: 554460 - DNA, 25 bp, Homo sapien
tctcaggttgcagaggccactcgtt

SEQ ID NO: 554461 - DNA, 25 bp, Homo sapien
gtcctctcacagctttctttaggga

SEQ ID NO: 554462 - DNA, 25 bp, Homo sapien
ttagggaattcaacctccaggacag

SEQ ID NO: 554463 - DNA, 25 bp, Homo sapien
ccaggacagccaactttgaatactg

SEQ ID NO: 554464 - DNA, 25 bp, Homo sapien
tgaatactgttaaacttggtctttt

SEQ ID NO: 554465 - DNA, 25 bp, Homo sapien
atttgatacttgctaaccgtattta

SEQ ID NO: 554466 - DNA, 25 bp, Homo sapien
cctttcggaattgctgtgtaaacac

SEQ ID NO: 554467 - DNA, 25 bp, Homo sapien
aacaccagtgtaatggcagttcctt

SEQ ID NO: 554468 - DNA, 25 bp, Homo sapien
gtaatggcagttccttagcaaatag

SEQ ID NO: 554469 - DNA, 25 bp, Homo sapien
tttttgcatctatgaagttttttca

SEQ ID NO: 554470 - DNA, 25 bp, Homo sapien
gtgtatcgcacaatatttctagtcg

SEQ ID NO: 554471 - DNA, 25 bp, Homo sapien
tatttctagtcgacagcactgcttt

SEQ ID NO: 554472 - DNA, 25 bp, Homo sapien
gaaaatgcagacacagcacgcctct

SEQ ID NO: 554473 - DNA, 25 bp, Homo sapien
gcagacacagcacgcctctttggga

SEQ ID NO: 554474 - DNA, 25 bp, Homo sapien
agcacgcctctttgggaccgcggtt

SEQ ID NO: 554475 - DNA, 25 bp, Homo sapien
gaccgcggtttatactttcgaagtg

SEQ ID NO: 554476 - DNA, 25 bp, Homo sapien
tatactttcgaagtgctcggagccc

SEQ ID NO: 554477 - DNA, 25 bp, Homo sapien
tttcgaagtgctcggagcccttcct

SEQ ID NO: 554478 - DNA, 25 bp, Homo sapien
ctccagggtctctcccggagttaca

SEQ ID NO: 554479 - DNA, 25 bp, Homo sapien
cgggaacccaacgcggtgtcagaga

SEQ ID NO: 554480 - DNA, 25 bp, Homo sapien
agcaggctctgcatgaatctttgtg

SEQ ID NO: 554481 - DNA, 25 bp, Homo sapien
gaatctttgtgcacttgcacctctt

SEQ ID NO: 554482 - DNA, 25 bp, Homo sapien
ttgcacctctttttcacatgggcca

SEQ ID NO: 554483 - DNA, 25 bp, Homo sapien
tgggccacagtttcagtacttcagc

SEQ ID NO: 554484 - DNA, 25 bp, Homo sapien
tatctagggtgttactcaagcccag

SEQ ID NO: 554485 - DNA, 25 bp, Homo sapien
tttggagtctcctgtgatcacatct

SEQ ID NO: 554486 - DNA, 25 bp, Homo sapien
tcacatcttgtctcggctgtaggaa

SEQ ID NO: 554487 - DNA, 25 bp, Homo sapien
gacgtcctctacataaaagctccat

SEQ ID NO: 554488 - DNA, 25 bp, Homo sapien
gaaaagctactcctagtcttaacat

SEQ ID NO: 554489 - DNA, 25 bp, Homo sapien
taacatttgcagtccttgtgtcact

SEQ ID NO: 554490 - DNA, 25 bp, Homo sapien
actgtcttctggtcctgatgtagtc

SEQ ID NO: 554491 - DNA, 25 bp, Homo sapien
ttctctgattgtgggagtggcaaga

SEQ ID NO: 554492 - DNA, 25 bp, Homo sapien
gagacgtcctccataagtggagcac

SEQ ID NO: 554493 - DNA, 25 bp, Homo sapien
gggagagtcttctgtgcctggtttc

SEQ ID NO: 554494 - DNA, 25 bp, Homo sapien
ctggtttcttctcctctatctcata

SEQ ID NO: 554495 - DNA, 25 bp, Homo sapien
ataatgcattatgggcccgaggaat

SEQ ID NO: 554496 - DNA, 25 bp, Homo sapien
ataagactccaaccctaatggccca

SEQ ID NO: 554497 - DNA, 25 bp, Homo sapien
ggcccaacagggaaattctcatttt

SEQ ID NO: 554498 - DNA, 25 bp, Homo sapien
tcgatgatattctgatggactggtt

SEQ ID NO: 554499 - DNA, 25 bp, Homo sapien
gatggactggtttggtcttaatacc

SEQ ID NO: 554500 - DNA, 25 bp, Homo sapien
tcttaataccagtcaaccgttgtcc

SEQ ID NO: 554501 - DNA, 25 bp, Homo sapien
cagtcaaccgttgtccttctggaaa

SEQ ID NO: 554502 - DNA, 25 bp, Homo sapien
tgcctcctcctaacagaaatatcac

SEQ ID NO: 554503 - DNA, 25 bp, Homo sapien
accctttgtgattaatggtacaatc

SEQ ID NO: 554504 - DNA, 25 bp, Homo sapien
atatctttttcatatcttttttgtt

SEQ ID NO: 554505 - DNA, 25 bp, Homo sapien
gttttcttgttgcttatgatctgat

SEQ ID NO: 554506 - DNA, 25 bp, Homo sapien
tgatctgatgtgtgtcttgtcatat

SEQ ID NO: 554507 - DNA, 25 bp, Homo sapien
ctgatgtgtgtcttgtcatatacag

SEQ ID NO: 554508 - DNA, 25 bp, Homo sapien
cttccaggttcagggttctttcttg

SEQ ID NO: 554509 - DNA, 25 bp, Homo sapien
gttcagggttctttcttgggtatat

SEQ ID NO: 554510 - DNA, 25 bp, Homo sapien
gggttctttcttgggtatatgacaa

SEQ ID NO: 554511 - DNA, 25 bp, Homo sapien
acaatgagattgtcaatgcttttta

SEQ ID NO: 554512 - DNA, 25 bp, Homo sapien
caatgctttttagggcacactgcct

SEQ ID NO: 554513 - DNA, 25 bp, Homo sapien
tacaacgcgctcattgggcccaaca

SEQ ID NO: 554514 - DNA, 25 bp, Homo sapien
gtactcgcgctaccagaaggcagcc

SEQ ID NO: 554515 - DNA, 25 bp, Homo sapien
gggcccaacagggactactttgtga

SEQ ID NO: 554516 - DNA, 25 bp, Homo sapien
actactttgtgaaagcaggcagcat

SEQ ID NO: 554517 - DNA, 25 bp, Homo sapien
aaagcaggcagcataagaggccgag

SEQ ID NO: 554518 - DNA, 25 bp, Homo sapien
aggtgcagctggcaacagagcccca

SEQ ID NO: 554519 - DNA, 25 bp, Homo sapien
gctggccgtggtatatatagccgat

SEQ ID NO: 554520 - DNA, 25 bp, Homo sapien
ggccgtggtatatatagccgatatc

SEQ ID NO: 554521 - DNA, 25 bp, Homo sapien
atatagccgatatcatgaagggaaa

SEQ ID NO: 554522 - DNA, 25 bp, Homo sapien
ctgaggcagcgcagcagcccagcta

SEQ ID NO: 554523 - DNA, 25 bp, Homo sapien
agcccagctacgtgtactcctgcga

SEQ ID NO: 554524 - DNA, 25 bp, Homo sapien
gttcacttccagattccataattcg

SEQ ID NO: 554525 - DNA, 25 bp, Homo sapien
acttcttgttcatctgttttcacca

SEQ ID NO: 554526 - DNA, 25 bp, Homo sapien
tctgttttcaccagggccccaataa

SEQ ID NO: 554527 - DNA, 25 bp, Homo sapien
ggccccaataactccaaggctggtg

SEQ ID NO: 554528 - DNA, 25 bp, Homo sapien
caaggctggtgagccggagatactc

SEQ ID NO: 554529 - DNA, 25 bp, Homo sapien
ggagatactcaaagggacgtgtttt

SEQ ID NO: 554530 - DNA, 25 bp, Homo sapien
gacgtgttttgctgacagtgtgcaa

SEQ ID NO: 554531 - DNA, 25 bp, Homo sapien
gatgtgtgctgcgagaaacgctgac

SEQ ID NO: 554532 - DNA, 25 bp, Homo sapien
acctggtttctggatgtgatgctac

SEQ ID NO: 554533 - DNA, 25 bp, Homo sapien
gtcatctaacaagatcttctggagg

SEQ ID NO: 554534 - DNA, 25 bp, Homo sapien
cttctggaggatgaatgtggcaact

SEQ ID NO: 554535 - DNA, 25 bp, Homo sapien
atgacacatttgtccatcgtcctgt

SEQ ID NO: 554536 - DNA, 25 bp, Homo sapien
atcgtcctgtgtatctgctttccag

SEQ ID NO: 554537 - DNA, 25 bp, Homo sapien
tttccagaggacaccggagcattct

SEQ ID NO: 554538 - DNA, 25 bp, Homo sapien
gctgcctcacatagctgttttgcaa

SEQ ID NO: 554539 - DNA, 25 bp, Homo sapien
tgttttgcaacagcctttattgcca

SEQ ID NO: 554540 - DNA, 25 bp, Homo sapien
gcctttattgccaacacccttggaa

SEQ ID NO: 554541 - DNA, 25 bp, Homo sapien
acccttggaagaacatctcctgtag

SEQ ID NO: 554542 - DNA, 25 bp, Homo sapien
gatgttcgaattttctgttagccta

SEQ ID NO: 554543 - DNA, 25 bp, Homo sapien
gttagcctattgctcaagcactaca

SEQ ID NO: 554544 - DNA, 25 bp, Homo sapien
gaatgtacatagtccctttggccat

SEQ ID NO: 554545 - DNA, 25 bp, Homo sapien
ctctcaccccagaatatcctaataa

SEQ ID NO: 554546 - DNA, 25 bp, Homo sapien
cagaccaactgtacttcgtcttggg

SEQ ID NO: 554547 - DNA, 25 bp, Homo sapien
agagccacttccagccaaggtgctt

SEQ ID NO: 554548 - DNA, 25 bp, Homo sapien
agcctgcgcaagtttctctcctcta

SEQ ID NO: 554549 - DNA, 25 bp, Homo sapien
ttctctcctctacttgggagacata

SEQ ID NO: 554550 - DNA, 25 bp, Homo sapien
gagatctcagaagatgccacgctgg

SEQ ID NO: 554551 - DNA, 25 bp, Homo sapien
tcagaagatgccacgctggcggagc

SEQ ID NO: 554552 - DNA, 25 bp, Homo sapien
gagctgaagtctcaggccatgacct

SEQ ID NO: 554553 - DNA, 25 bp, Homo sapien
tcctttcctggagttcggtgtcccg

SEQ ID NO: 554554 - DNA, 25 bp, Homo sapien
cacctcagagcctggacggtggaga

SEQ ID NO: 554555 - DNA, 25 bp, Homo sapien
gaactgaccggcagccactcaggga

SEQ ID NO: 554556 - DNA, 25 bp, Homo sapien
cagccactcagggaatataaactag

SEQ ID NO: 554557 - DNA, 25 bp, Homo sapien
cagttctggtccttcaagcctgtat

SEQ ID NO: 554558 - DNA, 25 bp, Homo sapien
agttctggtccttcaagcctgtatg

SEQ ID NO: 554559 - DNA, 25 bp, Homo sapien
gttctggtccttcaagcctgtatgg

SEQ ID NO: 554560 - DNA, 25 bp, Homo sapien
ttctggtccttcaagcctgtatggt

SEQ ID NO: 554561 - DNA, 25 bp, Homo sapien
ctggtccttcaagcctgtatggttt

SEQ ID NO: 554562 - DNA, 25 bp, Homo sapien
ggtccttcaagcctgtatggtttgg

SEQ ID NO: 554563 - DNA, 25 bp, Homo sapien
gtccttcaagcctgtatggtttgga

SEQ ID NO: 554564 - DNA, 25 bp, Homo sapien
ccttcaagcctgtatggtttggatt

SEQ ID NO: 554565 - DNA, 25 bp, Homo sapien
ggacagttgatgtggagtcaatctc

SEQ ID NO: 554566 - DNA, 25 bp, Homo sapien
cagttgatgtggagtcaatctcttt

SEQ ID NO: 554567 - DNA, 25 bp, Homo sapien
gatgtggagtcaatctctttggtac

SEQ ID NO: 554568 - DNA, 25 bp, Homo sapien
tacaacgcgctcattgggcccaaca

SEQ ID NO: 554569 - DNA, 25 bp, Homo sapien
aacgcgctcattgggcccaacaggg

SEQ ID NO: 554570 - DNA, 25 bp, Homo sapien
gtactcgcgctaccagaaggcagcc

SEQ ID NO: 554571 - DNA, 25 bp, Homo sapien
tcattgggcccaacagggactactt

SEQ ID NO: 554572 - DNA, 25 bp, Homo sapien
attgggcccaacagggactactttg

SEQ ID NO: 554573 - DNA, 25 bp, Homo sapien
gggcccaacagggactactttgtga

SEQ ID NO: 554574 - DNA, 25 bp, Homo sapien
ggcccaacagggactactttgtgaa

SEQ ID NO: 554575 - DNA, 25 bp, Homo sapien
cccaacagggactactttgtgaaag

SEQ ID NO: 554576 - DNA, 25 bp, Homo sapien
tcgcgctaccagaaggcagccaggg

SEQ ID NO: 554577 - DNA, 25 bp, Homo sapien
agcccagctacgtgtactcctgcga

SEQ ID NO: 554578 - DNA, 25 bp, Homo sapien
tacacactggcctactacggctacc

SEQ ID NO: 554579 - DNA, 25 bp, Homo sapien
agcatttaactgatttgggaacttg

SEQ ID NO: 554580 - DNA, 25 bp, Homo sapien
tagcctctcagtatgctaggaactt

SEQ ID NO: 554581 - DNA, 25 bp, Homo sapien
taatgacccacttcgaatggtggtt

SEQ ID NO: 554582 - DNA, 25 bp, Homo sapien
gaaagtaaaatctgtatcgccgtct

SEQ ID NO: 554583 - DNA, 25 bp, Homo sapien
gtaaaatctgtatcgccgtcttatg

SEQ ID NO: 554584 - DNA, 25 bp, Homo sapien
atcgccgtcttatgtttccatttac

SEQ ID NO: 554585 - DNA, 25 bp, Homo sapien
gtcttatgtttccatttacctagaa

SEQ ID NO: 554586 - DNA, 25 bp, Homo sapien
tcagtatgctaggaacttacacttt

SEQ ID NO: 554587 - DNA, 25 bp, Homo sapien
agaaatactttacctttgagcacag

SEQ ID NO: 554588 - DNA, 25 bp, Homo sapien
caggaaattaatccccttctggttg

SEQ ID NO: 554589 - DNA, 25 bp, Homo sapien
ttgcctttaccaagtattgcagata

SEQ ID NO: 554590 - DNA, 25 bp, Homo sapien
agccctgcatgcacgtggctggtat

SEQ ID NO: 554591 - DNA, 25 bp, Homo sapien
atgcacgtggctggtatgccctgcg

SEQ ID NO: 554592 - DNA, 25 bp, Homo sapien
acacagtgctgtgagtctctggttc

SEQ ID NO: 554593 - DNA, 25 bp, Homo sapien
tgctgtgagtctctggttcatgtca

SEQ ID NO: 554594 - DNA, 25 bp, Homo sapien
tgagtctctggttcatgtcactctg

SEQ ID NO: 554595 - DNA, 25 bp, Homo sapien
ggctgctccagcacaaagaggtttt

SEQ ID NO: 554596 - DNA, 25 bp, Homo sapien
gtatgatttttgtagcacaaccctt

SEQ ID NO: 554597 - DNA, 25 bp, Homo sapien
gtagcacaacccttgaatacataaa

SEQ ID NO: 554598 - DNA, 25 bp, Homo sapien
acataaagcacgattggctccccag

SEQ ID NO: 554599 - DNA, 25 bp, Homo sapien
taaagcacgattggctccccagaag

SEQ ID NO: 554600 - DNA, 25 bp, Homo sapien
ttggctccccagaaggcaggtgttg

SEQ ID NO: 554601 - DNA, 25 bp, Homo sapien
cagttactgaattctgttcaagcga

SEQ ID NO: 554602 - DNA, 25 bp, Homo sapien
gtcagaagcacagatatcctggttt

SEQ ID NO: 554603 - DNA, 25 bp, Homo sapien
agatatcctggtttgctcctgagga

SEQ ID NO: 554604 - DNA, 25 bp, Homo sapien
tgctcctgaggatcatggatacggt

SEQ ID NO: 554605 - DNA, 25 bp, Homo sapien
ggatacggtactgaagtttctacta

SEQ ID NO: 554606 - DNA, 25 bp, Homo sapien
gtttctactaagaacacaccatgct

SEQ ID NO: 554607 - DNA, 25 bp, Homo sapien
agaacacaccatgctcagagaacaa

SEQ ID NO: 554608 - DNA, 25 bp, Homo sapien
gagaacaaacttgacatccaggaaa

SEQ ID NO: 554609 - DNA, 25 bp, Homo sapien
ggaacagatcatatattgaccgaga

SEQ ID NO: 554610 - DNA, 25 bp, Homo sapien
agattctgagtatctcttgcaagaa

SEQ ID NO: 554611 - DNA, 25 bp, Homo sapien
atgaaccagatggaactttagacca

SEQ ID NO: 554612 - DNA, 25 bp, Homo sapien
agaccagctccccacattcctgaat

SEQ ID NO: 554613 - DNA, 25 bp, Homo sapien
ccacattcctgaattccacttccag

SEQ ID NO: 554614 - DNA, 25 bp, Homo sapien
actcaccggctgtcctagaatgggc

SEQ ID NO: 554615 - DNA, 25 bp, Homo sapien
tcaccggctgtcctagaatgggcag

SEQ ID NO: 554616 - DNA, 25 bp, Homo sapien
caccggctgtcctagaatgggcagg

SEQ ID NO: 554617 - DNA, 25 bp, Homo sapien
agagcgaagttctgggtgggatgac

SEQ ID NO: 554618 - DNA, 25 bp, Homo sapien
gggaggggcctcagtccagaaacct

SEQ ID NO: 554619 - DNA, 25 bp, Homo sapien
tcagtccagaaacctcgaccgctag

SEQ ID NO: 554620 - DNA, 25 bp, Homo sapien
agtccagaaacctcgaccgctagct

SEQ ID NO: 554621 - DNA, 25 bp, Homo sapien
tgggcagcaggtcggcgggaccaca

SEQ ID NO: 554622 - DNA, 25 bp, Homo sapien
ggcgggaccacatgcctgggtctca

SEQ ID NO: 554623 - DNA, 25 bp, Homo sapien
gtgactctggcggaggacaacatag

SEQ ID NO: 554624 - DNA, 25 bp, Homo sapien
tggcggaggacaacatagccttctt

SEQ ID NO: 554625 - DNA, 25 bp, Homo sapien
gaggacaacatagccttcttctcga

SEQ ID NO: 554626 - DNA, 25 bp, Homo sapien
atagccttcttctcgagccagggtc

SEQ ID NO: 554627 - DNA, 25 bp, Homo sapien
ccagcggctgtcaggcgtttttgcc

SEQ ID NO: 554628 - DNA, 25 bp, Homo sapien
ctgtcaggcgtttttgccggtgtac

SEQ ID NO: 554629 - DNA, 25 bp, Homo sapien
tgggtgtggcgcacctctttgacct

SEQ ID NO: 554630 - DNA, 25 bp, Homo sapien
cggccaacgggtaccgcagcctagt

SEQ ID NO: 554631 - DNA, 25 bp, Homo sapien
gggtaccgcagcctagtgcacacag

SEQ ID NO: 554632 - DNA, 25 bp, Homo sapien
tcctgcacaaatcccgctatgtggc

SEQ ID NO: 554633 - DNA, 25 bp, Homo sapien
acaaatcccgctatgtggcctccaa

SEQ ID NO: 554634 - DNA, 25 bp, Homo sapien
ggcagcccttcaccagagttcggag

SEQ ID NO: 554635 - DNA, 25 bp, Homo sapien
ccttcaccagagttcggaggagcag

SEQ ID NO: 554636 - DNA, 25 bp, Homo sapien
gaggagcagtgtgtggcgccacgtc

SEQ ID NO: 554637 - DNA, 25 bp, Homo sapien
tggccatacccacacagaagcagtg

SEQ ID NO: 554638 - DNA, 25 bp, Homo sapien
atacccacacagaagcagtgctgcc

SEQ ID NO: 554639 - DNA, 25 bp, Homo sapien
atctgggccagcttggactctgctt

SEQ ID NO: 554640 - DNA, 25 bp, Homo sapien
tgggccagcttggactctgcttcct

SEQ ID NO: 554641 - DNA, 25 bp, Homo sapien
cacctccctggatagcaggaacttg

SEQ ID NO: 554642 - DNA, 25 bp, Homo sapien
tccctggatagcaggaacttgacct

SEQ ID NO: 554643 - DNA, 25 bp, Homo sapien
aacttgacctgccatgtgtgccctg

SEQ ID NO: 554644 - DNA, 25 bp, Homo sapien
tgacctgccatgtgtgccctgcctt

SEQ ID NO: 554645 - DNA, 25 bp, Homo sapien
gggagaacctggagccatcctacct

SEQ ID NO: 554646 - DNA, 25 bp, Homo sapien
tggagccatcctacctcttgggtgg

SEQ ID NO: 554647 - DNA, 25 bp, Homo sapien
ttgggtggcctggtttgatttccag

SEQ ID NO: 554648 - DNA, 25 bp, Homo sapien
tgatttccaggacaaggcgatttgc

SEQ ID NO: 554649 - DNA, 25 bp, Homo sapien
ccaggacaaggcgatttgcgtgaca

SEQ ID NO: 554650 - DNA, 25 bp, Homo sapien
aggcgatttgcgtgacagcctgcta

SEQ ID NO: 554651 - DNA, 25 bp, Homo sapien
gatttgcgtgacagcctgctatcca

SEQ ID NO: 554652 - DNA, 25 bp, Homo sapien
tgcgtgacagcctgctatccacttt

SEQ ID NO: 554653 - DNA, 25 bp, Homo sapien
agcctgctatccactttccctttga

SEQ ID NO: 554654 - DNA, 25 bp, Homo sapien
tttgcttctggttacacgtgggaat

SEQ ID NO: 554655 - DNA, 25 bp, Homo sapien
gcttctggttacacgtgggaataga

SEQ ID NO: 554656 - DNA, 25 bp, Homo sapien
tgtgtggagctggatccagccaccg

SEQ ID NO: 554657 - DNA, 25 bp, Homo sapien
cgtggctggcatcattgtcactgat

SEQ ID NO: 554658 - DNA, 25 bp, Homo sapien
tgatgtcattgccactctgctcctt

SEQ ID NO: 554659 - DNA, 25 bp, Homo sapien
ctgctttgctggacatgagactgga

SEQ ID NO: 554660 - DNA, 25 bp, Homo sapien
tgccgacacacaagctctgttgagg

SEQ ID NO: 554661 - DNA, 25 bp, Homo sapien
ggaatgaccaggtctatcagcccct

SEQ ID NO: 554662 - DNA, 25 bp, Homo sapien
agcccctccgagatcgagatgatgc

SEQ ID NO: 554663 - DNA, 25 bp, Homo sapien
gctcagtacagccaccttggaggaa

SEQ ID NO: 554664 - DNA, 25 bp, Homo sapien
aactgggctcggaacaagtgaacct

SEQ ID NO: 554665 - DNA, 25 bp, Homo sapien
ggtggcttctagaagcagccattac

SEQ ID NO: 554666 - DNA, 25 bp, Homo sapien
aagcagccattaccaactgtacctt

SEQ ID NO: 554667 - DNA, 25 bp, Homo sapien
tgaaaacagaggcattcggtctatg

SEQ ID NO: 554668 - DNA, 25 bp, Homo sapien
ggtctatgcctgagtcctgtgtata

SEQ ID NO: 554669 - DNA, 25 bp, Homo sapien
gacacgggatgcagtttgcagcttt

SEQ ID NO: 554670 - DNA, 25 bp, Homo sapien
gcagtttgcagctttagtgcctttc

SEQ ID NO: 554671 - DNA, 25 bp, Homo sapien
tagtgcctttcttcgccttttaaat

SEQ ID NO: 554672 - DNA, 25 bp, Homo sapien
gccttttaaattgccacgaatcaca

SEQ ID NO: 554673 - DNA, 25 bp, Homo sapien
gatggctatttagtggccctacaat

SEQ ID NO: 554674 - DNA, 25 bp, Homo sapien
ttagtggccctacaatgctgcaaca

SEQ ID NO: 554675 - DNA, 25 bp, Homo sapien
aacacatcagcttgcattttagtct

SEQ ID NO: 554676 - DNA, 25 bp, Homo sapien
gtatttgtatcagctgttagtggtg

SEQ ID NO: 554677 - DNA, 25 bp, Homo sapien
gtgaaatagggctctagttaacctt

SEQ ID NO: 554678 - DNA, 25 bp, Homo sapien
gtatcaccccgttatggttgaactt

SEQ ID NO: 554679 - DNA, 25 bp, Homo sapien
tttctccttcaaaattaccagactt

SEQ ID NO: 554680 - DNA, 25 bp, Homo sapien
attaccagacttggcagcagtggca

SEQ ID NO: 554681 - DNA, 25 bp, Homo sapien
gcagtggcaaattattgggctaaaa

SEQ ID NO: 554682 - DNA, 25 bp, Homo sapien
gacttaatcagacatattctgggtt

SEQ ID NO: 554683 - DNA, 25 bp, Homo sapien
ggctcctaatataatacctggtgca

SEQ ID NO: 554684 - DNA, 25 bp, Homo sapien
gcaaacattatacttccactcattc

SEQ ID NO: 554685 - DNA, 25 bp, Homo sapien
acttccactcattcagatggttgca

SEQ ID NO: 554686 - DNA, 25 bp, Homo sapien
atggttgcatcctgccaggcatcca

SEQ ID NO: 554687 - DNA, 25 bp, Homo sapien
tgggactgggaatatggacacttga

SEQ ID NO: 554688 - DNA, 25 bp, Homo sapien
gacaggttacaagtgaacataatca

SEQ ID NO: 554689 - DNA, 25 bp, Homo sapien
aaactgggagagtcaaaagtgagca

SEQ ID NO: 554690 - DNA, 25 bp, Homo sapien
gtgagcagaagctctccatttctac

SEQ ID NO: 554691 - DNA, 25 bp, Homo sapien
atttctacttctgtcacaaaccaca

SEQ ID NO: 554692 - DNA, 25 bp, Homo sapien
ttctgtcacaaaccacattaaattg

SEQ ID NO: 554693 - DNA, 25 bp, Homo sapien
gtaaataaggcccttctccacttga

SEQ ID NO: 554694 - DNA, 25 bp, Homo sapien
tctccacttgacttcaggcagcaga

SEQ ID NO: 554695 - DNA, 25 bp, Homo sapien
gacttcaggcagcagattgtctaga

SEQ ID NO: 554696 - DNA, 25 bp, Homo sapien
gcagcagattgtctagaagcctaag

SEQ ID NO: 554697 - DNA, 25 bp, Homo sapien
gaagcctaaggacagcaatttctct

SEQ ID NO: 554698 - DNA, 25 bp, Homo sapien
cctaaggacagcaatttctctgaca

SEQ ID NO: 554699 - DNA, 25 bp, Homo sapien
caaactactgcccacgggccgaatt

SEQ ID NO: 554700 - DNA, 25 bp, Homo sapien
ttttctgctctgtagtccaaaaaca

SEQ ID NO: 554701 - DNA, 25 bp, Homo sapien
gtgaaggtgagcagcatgtcgaata

SEQ ID NO: 554702 - DNA, 25 bp, Homo sapien
atgtcgaatatgtcaccagccactt

SEQ ID NO: 554703 - DNA, 25 bp, Homo sapien
cagccacttcatccttatggtgctg

SEQ ID NO: 554704 - DNA, 25 bp, Homo sapien
tatggtgctgtaatgttgtggtgaa

SEQ ID NO: 554705 - DNA, 25 bp, Homo sapien
gtgaaggctgccatgttgaactcag

SEQ ID NO: 554706 - DNA, 25 bp, Homo sapien
tgaactcaggaatccgctgcagcag

SEQ ID NO: 554707 - DNA, 25 bp, Homo sapien
tcttctgtgtcttcaaactccaggt

SEQ ID NO: 554708 - DNA, 25 bp, Homo sapien
caaactccaggtagtacttgtccat

SEQ ID NO: 554709 - DNA, 25 bp, Homo sapien
gtacttgtccatgaaatttctctgt

SEQ ID NO: 554710 - DNA, 25 bp, Homo sapien
ctctgtaataactggaactcgtcat

SEQ ID NO: 554711 - DNA, 25 bp, Homo sapien
gatgataacacagaaccatgaacag

SEQ ID NO: 554712 - DNA, 25 bp, Homo sapien
ccatgaacaggaatagaactcgtat

SEQ ID NO: 554713 - DNA, 25 bp, Homo sapien
agaaatagggctggtggctctcttg

SEQ ID NO: 554714 - DNA, 25 bp, Homo sapien
ggctggtggctctcttggtaagatc

SEQ ID NO: 554715 - DNA, 25 bp, Homo sapien
ggctctcttggtaagatctagttaa

SEQ ID NO: 554716 - DNA, 25 bp, Homo sapien
atatgcctgaagataatgtgtggaa

SEQ ID NO: 554717 - DNA, 25 bp, Homo sapien
gtggaaggatatttgccatatgcta

SEQ ID NO: 554718 - DNA, 25 bp, Homo sapien
gatatttgccatatgctaactggtt

SEQ ID NO: 554719 - DNA, 25 bp, Homo sapien
catatgctaactggttttttggcca

SEQ ID NO: 554720 - DNA, 25 bp, Homo sapien
taactggttttttggccagggagag

SEQ ID NO: 554721 - DNA, 25 bp, Homo sapien
tatacttacagtgatcattattttc

SEQ ID NO: 554722 - DNA, 25 bp, Homo sapien
acctattctgtagatgcctgtataa

SEQ ID NO: 554723 - DNA, 25 bp, Homo sapien
agatgcctgtataatcggtctggat

SEQ ID NO: 554724 - DNA, 25 bp, Homo sapien
aatcggtctggatgtacagctataa

SEQ ID NO: 554725 - DNA, 25 bp, Homo sapien
tagagcctgctgtaccttttttctt

SEQ ID NO: 554726 - DNA, 25 bp, Homo sapien
aaattcttcgagttggtaaatgagt

SEQ ID NO: 554727 - DNA, 25 bp, Homo sapien
aaagctgctgttcatgatttgtgtg

SEQ ID NO: 554728 - DNA, 25 bp, Homo sapien
gatttgtgtgtatagtgagctgact

SEQ ID NO: 554729 - DNA, 25 bp, Homo sapien
gtgagctgactgtagtattttacta

SEQ ID NO: 554730 - DNA, 25 bp, Homo sapien
ctgtaatttatatcccctttgaact

SEQ ID NO: 554731 - DNA, 25 bp, Homo sapien
atatcccctttgaactttattgtgt

SEQ ID NO: 554732 - DNA, 25 bp, Homo sapien
aattggtacacatttctgtgtgtgt

SEQ ID NO: 554733 - DNA, 25 bp, Homo sapien
tagagctgcagctgtctggcgccac

SEQ ID NO: 554734 - DNA, 25 bp, Homo sapien
ctgcagctgtctggcgccactgtaa

SEQ ID NO: 554735 - DNA, 25 bp, Homo sapien
gctgtctggcgccactgtaatgctg

SEQ ID NO: 554736 - DNA, 25 bp, Homo sapien
gtctggcgccactgtaatgctgtct

SEQ ID NO: 554737 - DNA, 25 bp, Homo sapien
tggcgccactgtaatgctgtctcct

SEQ ID NO: 554738 - DNA, 25 bp, Homo sapien
ggcgccactgtaatgctgtctcctc

SEQ ID NO: 554739 - DNA, 25 bp, Homo sapien
tcctcctctgagtgagttcatcctg

SEQ ID NO: 554740 - DNA, 25 bp, Homo sapien
ctcctctgagtgagttcatcctgga

SEQ ID NO: 554741 - DNA, 25 bp, Homo sapien
cctctgagtgagttcatcctggaaa

SEQ ID NO: 554742 - DNA, 25 bp, Homo sapien
ctgagtgagttcatcctggaaacat

SEQ ID NO: 554743 - DNA, 25 bp, Homo sapien
gtgagttcatcctggaaacattttc

SEQ ID NO: 554744 - DNA, 25 bp, Homo sapien
cccagcacctggagccttggatcat

SEQ ID NO: 554745 - DNA, 25 bp, Homo sapien
gagccttggatcatttacttccagg

SEQ ID NO: 554746 - DNA, 25 bp, Homo sapien
ggatcatttacttccaggaccggat

SEQ ID NO: 554747 - DNA, 25 bp, Homo sapien
atcatttacttccaggaccggatct

SEQ ID NO: 554748 - DNA, 25 bp, Homo sapien
tttacttccaggaccggatctccat

SEQ ID NO: 554749 - DNA, 25 bp, Homo sapien
ttccaggaccggatctccattcaga

SEQ ID NO: 554750 - DNA, 25 bp, Homo sapien
ggatctccattcagaccctgatcta

SEQ ID NO: 554751 - DNA, 25 bp, Homo sapien
attcagaccctgatctacagtctcc

SEQ ID NO: 554752 - DNA, 25 bp, Homo sapien
ttcttcccttctttctggttggtgc

SEQ ID NO: 554753 - DNA, 25 bp, Homo sapien
tgggccaggtgggaatttctgatta

SEQ ID NO: 554754 - DNA, 25 bp, Homo sapien
ccaggtgggaatttctgattaaatc

SEQ ID NO: 554755 - DNA, 25 bp, Homo sapien
atacccacttcctgatactttggtt

SEQ ID NO: 554756 - DNA, 25 bp, Homo sapien
caggtcccttcatttgtactttgga

SEQ ID NO: 554757 - DNA, 25 bp, Homo sapien
gtcccttcatttgtactttggagtt

SEQ ID NO: 554758 - DNA, 25 bp, Homo sapien
catttgtactttggagtttttctca

SEQ ID NO: 554759 - DNA, 25 bp, Homo sapien
gtactttggagtttttctcatgtaa

SEQ ID NO: 554760 - DNA, 25 bp, Homo sapien
gaaaatattgttcagtttggataga

SEQ ID NO: 554761 - DNA, 25 bp, Homo sapien
gttcagtttggatagaaagcatgga

SEQ ID NO: 554762 - DNA, 25 bp, Homo sapien
aaaagttctatgtacttgatgtgaa

SEQ ID NO: 554763 - DNA, 25 bp, Homo sapien
atgtacttgatgtgaatatgcgaat

SEQ ID NO: 554764 - DNA, 25 bp, Homo sapien
gtgaatatgcgaatactgctataat

SEQ ID NO: 554765 - DNA, 25 bp, Homo sapien
atgcgaatactgctataataaagat

SEQ ID NO: 554766 - DNA, 25 bp, Homo sapien
ataggtatacacttacgacttcaca

SEQ ID NO: 554767 - DNA, 25 bp, Homo sapien
ggtatacacttacgacttcacaaaa

SEQ ID NO: 554768 - DNA, 25 bp, Homo sapien
ttacgacttcacaaaacctatactt

SEQ ID NO: 554769 - DNA, 25 bp, Homo sapien
gacttcacaaaacctatacttaata

SEQ ID NO: 554770 - DNA, 25 bp, Homo sapien
ttaagttgttggtgacatctgcatc

SEQ ID NO: 554771 - DNA, 25 bp, Homo sapien
gtgacatctgcatcatttcatagga

SEQ ID NO: 554772 - DNA, 25 bp, Homo sapien
gacatctgcatcatttcataggatt

SEQ ID NO: 554773 - DNA, 25 bp, Homo sapien
gcatcatttcataggattagaactt

SEQ ID NO: 554774 - DNA, 25 bp, Homo sapien
gacaagtgggaatcataaattaaac

SEQ ID NO: 554775 - DNA, 25 bp, Homo sapien
aacgttaatggtttcttatgctctt

SEQ ID NO: 554776 - DNA, 25 bp, Homo sapien
ttaatggtttcttatgctcttttta

SEQ ID NO: 554777 - DNA, 25 bp, Homo sapien
ggaggacaccccatcgtgcagctgc

SEQ ID NO: 554778 - DNA, 25 bp, Homo sapien
gtgcagctgcatggctacttggaga

SEQ ID NO: 554779 - DNA, 25 bp, Homo sapien
gctacttggagaatgagccgctgat

SEQ ID NO: 554780 - DNA, 25 bp, Homo sapien
aggtgcaccgcatcacagggaagac

SEQ ID NO: 554781 - DNA, 25 bp, Homo sapien
atcacagggaagaccgtgtccacca

SEQ ID NO: 554782 - DNA, 25 bp, Homo sapien
actcctgccggagaacagcatgcga

SEQ ID NO: 554783 - DNA, 25 bp, Homo sapien
agaacagcatgcgagccgtcattga

SEQ ID NO: 554784 - DNA, 25 bp, Homo sapien
gagccgtcattgactgtgccggaat

SEQ ID NO: 554785 - DNA, 25 bp, Homo sapien
gactgtgccggaatcctgaaactca

SEQ ID NO: 554786 - DNA, 25 bp, Homo sapien
tcagaaactccgacattgaacttcg

SEQ ID NO: 554787 - DNA, 25 bp, Homo sapien
aacttcggaaaggagagacggacat

SEQ ID NO: 554788 - DNA, 25 bp, Homo sapien
acaagctgaggcctacgatgattta

SEQ ID NO: 554789 - DNA, 25 bp, Homo sapien
gatttaggctgaggataccatctgc

SEQ ID NO: 554790 - DNA, 25 bp, Homo sapien
gataccatctgcctgagagaaccct

SEQ ID NO: 554791 - DNA, 25 bp, Homo sapien
agagaaccctcctcttggagtcttg

SEQ ID NO: 554792 - DNA, 25 bp, Homo sapien
ggagtcttgctcctcaaaatgtgac

SEQ ID NO: 554793 - DNA, 25 bp, Homo sapien
agcagcattggcatccctggaagcg

SEQ ID NO: 554794 - DNA, 25 bp, Homo sapien
ccctggaagcgtggtaccaatgcat

SEQ ID NO: 554795 - DNA, 25 bp, Homo sapien
ttggacctcaactcagacctattca

SEQ ID NO: 554796 - DNA, 25 bp, Homo sapien
tcaatccaactctccagtttagcaa

SEQ ID NO: 554797 - DNA, 25 bp, Homo sapien
ggatggaccacaagaactgctcaaa

SEQ ID NO: 554798 - DNA, 25 bp, Homo sapien
actgctcaaagcacctggactagta

SEQ ID NO: 554799 - DNA, 25 bp, Homo sapien
gtaggacgtggctctttattcgtga

SEQ ID NO: 554800 - DNA, 25 bp, Homo sapien
ttcgtgagttttccatttacctccg

SEQ ID NO: 554801 - DNA, 25 bp, Homo sapien
tttacctccgctgaacctagagctt

SEQ ID NO: 554802 - DNA, 25 bp, Homo sapien
tagagcttcagacgccctatggcgt

SEQ ID NO: 554803 - DNA, 25 bp, Homo sapien
cggccttgagcgctgagcaagcaaa

SEQ ID NO: 554804 - DNA, 25 bp, Homo sapien
agcaagcaaaggtggtcctcgcgga

SEQ ID NO: 554805 - DNA, 25 bp, Homo sapien
tcgcggaggtgatccaggcgttctc

SEQ ID NO: 554806 - DNA, 25 bp, Homo sapien
tccgccccggagaatgcagtgcgca

SEQ ID NO: 554807 - DNA, 25 bp, Homo sapien
aatgcagtgcgcatggacgaggctc

SEQ ID NO: 554808 - DNA, 25 bp, Homo sapien
acgaggctcgggataacgcctgcaa

SEQ ID NO: 554809 - DNA, 25 bp, Homo sapien
ggataacgcctgcaacgacatgggt

SEQ ID NO: 554810 - DNA, 25 bp, Homo sapien
cctccttgtctgtggaccatgataa

SEQ ID NO: 554811 - DNA, 25 bp, Homo sapien
ggaccatgataagcccaagtagtga

SEQ ID NO: 554812 - DNA, 25 bp, Homo sapien
caagtagtgacttcagagctgggta

SEQ ID NO: 554813 - DNA, 25 bp, Homo sapien
tgaaaagacctttacgtggagaatt

SEQ ID NO: 554814 - DNA, 25 bp, Homo sapien
cgtggagaatttgcatgcgtaatat

SEQ ID NO: 554815 - DNA, 25 bp, Homo sapien
gaaggtgttctttaggtatgttaca

SEQ ID NO: 554816 - DNA, 25 bp, Homo sapien
ttacaggattactttaaaccatttg

SEQ ID NO: 554817 - DNA, 25 bp, Homo sapien
aaaccatttgactttcgctccaaag

SEQ ID NO: 554818 - DNA, 25 bp, Homo sapien
gactttcgctccaaagttatgttgg

SEQ ID NO: 554819 - DNA, 25 bp, Homo sapien
taaaagtctcatatgttcacatgct

SEQ ID NO: 554820 - DNA, 25 bp, Homo sapien
gttcacatgcttaaatctgggtatc

SEQ ID NO: 554821 - DNA, 25 bp, Homo sapien
tgaagaagagggtatttctagtttt

SEQ ID NO: 554822 - DNA, 25 bp, Homo sapien
gaactaaatccaaaacatgacactg

SEQ ID NO: 554823 - DNA, 25 bp, Homo sapien
atatatttgaatgctgctacaacag

SEQ ID NO: 554824 - DNA, 25 bp, Homo sapien
atgctgctacaacagatgatcttca

SEQ ID NO: 554825 - DNA, 25 bp, Homo sapien
aacagatgatcttcatccctgaagt

SEQ ID NO: 554826 - DNA, 25 bp, Homo sapien
gatgatcttcatccctgaagttttc

SEQ ID NO: 554827 - DNA, 25 bp, Homo sapien
tgatcttcatccctgaagttttcag

SEQ ID NO: 554828 - DNA, 25 bp, Homo sapien
tttcagctaaacttggtttcctaga

SEQ ID NO: 554829 - DNA, 25 bp, Homo sapien
cttggtttcctagaatagactgtta

SEQ ID NO: 554830 - DNA, 25 bp, Homo sapien
gtgctaagtttataattcaggtttg

SEQ ID NO: 554831 - DNA, 25 bp, Homo sapien
taattcaggtttgatcaaggtgtga

SEQ ID NO: 554832 - DNA, 25 bp, Homo sapien
gaggcttttgaatgtctgcagtgaa

SEQ ID NO: 554833 - DNA, 25 bp, Homo sapien
ttacttcctcactctaacatcagaa

SEQ ID NO: 554834 - DNA, 25 bp, Homo sapien
gaaagtcatcgagaagcctggacta

SEQ ID NO: 554835 - DNA, 25 bp, Homo sapien
gcctggactaacttactgcttttgt

SEQ ID NO: 554836 - DNA, 25 bp, Homo sapien
aaagctcatgcatcattctactacc

SEQ ID NO: 554837 - DNA, 25 bp, Homo sapien
ttctactaccctctcttatgtgaaa

SEQ ID NO: 554838 - DNA, 25 bp, Homo sapien
atgcaatttgacttgattcctgaac

SEQ ID NO: 554839 - DNA, 25 bp, Homo sapien
attcctgaacttcgtgctgttctta

SEQ ID NO: 554840 - DNA, 25 bp, Homo sapien
gaagattttttctgcgaatcggagt

SEQ ID NO: 554841 - DNA, 25 bp, Homo sapien
cggagtagtttttcagatatcacaa

SEQ ID NO: 554842 - DNA, 25 bp, Homo sapien
gatatcacaaccacctgaacaggaa

SEQ ID NO: 554843 - DNA, 25 bp, Homo sapien
tctccacggtagaggcgtgttctca

SEQ ID NO: 554844 - DNA, 25 bp, Homo sapien
aggcgtgttctcagtttagcaggct

SEQ ID NO: 554845 - DNA, 25 bp, Homo sapien
ttagcaggctggtgttaaggctgta

SEQ ID NO: 554846 - DNA, 25 bp, Homo sapien
gttaaggctgtaggaggacccagtt

SEQ ID NO: 554847 - DNA, 25 bp, Homo sapien
gctgtaggaggacccagtttcccca

SEQ ID NO: 554848 - DNA, 25 bp, Homo sapien
atgacagtgccttctaactagccag

SEQ ID NO: 554849 - DNA, 25 bp, Homo sapien
gtgccttctaactagccagagaata

SEQ ID NO: 554850 - DNA, 25 bp, Homo sapien
agagaataggtagcttccctcctga

SEQ ID NO: 554851 - DNA, 25 bp, Homo sapien
ttccctcctgatgatggctcataat

SEQ ID NO: 554852 - DNA, 25 bp, Homo sapien
tgatgatggctcataatctgaagca

SEQ ID NO: 554853 - DNA, 25 bp, Homo sapien
ataatctgaagcatcttgagctggg

SEQ ID NO: 554854 - DNA, 25 bp, Homo sapien
aagctagagagatgtgtaggccaca

SEQ ID NO: 554855 - DNA, 25 bp, Homo sapien
tgtgtaggccacattgcagagtttg

SEQ ID NO: 554856 - DNA, 25 bp, Homo sapien
aacccaagtggtgcattcttctgta

SEQ ID NO: 554857 - DNA, 25 bp, Homo sapien
ggtgcattcttctgtaaatgttaga

SEQ ID NO: 554858 - DNA, 25 bp, Homo sapien
atgttagagagatcagtggctgccc

SEQ ID NO: 554859 - DNA, 25 bp, Homo sapien
agagatcagtggctgccctgcacat

SEQ ID NO: 554860 - DNA, 25 bp, Homo sapien
gagaacgattggagacaggcagatt

SEQ ID NO: 554861 - DNA, 25 bp, Homo sapien
aaggacggagttgtactccaagcca

SEQ ID NO: 554862 - DNA, 25 bp, Homo sapien
gttgtactccaagccaaagatgatg

SEQ ID NO: 554863 - DNA, 25 bp, Homo sapien
taagttagtgcaatgggaccaagtc

SEQ ID NO: 554864 - DNA, 25 bp, Homo sapien
tgggaccaagtctagagctatttag

SEQ ID NO: 554865 - DNA, 25 bp, Homo sapien
tgaatgggcctggttgggagcagcc

SEQ ID NO: 554866 - DNA, 25 bp, Homo sapien
cacccatctcactatgcaattcgag

SEQ ID NO: 554867 - DNA, 25 bp, Homo sapien
atctcactatgcaattcgagttcca

SEQ ID NO: 554868 - DNA, 25 bp, Homo sapien
tcactatgcaattcgagttccaagc

SEQ ID NO: 554869 - DNA, 25 bp, Homo sapien
tgcaattcgagttccaagcaacatt

SEQ ID NO: 554870 - DNA, 25 bp, Homo sapien
gagttccaagcaacatttgctcctg

SEQ ID NO: 554871 - DNA, 25 bp, Homo sapien
aagcaacatttgctcctgccctggg

SEQ ID NO: 554872 - DNA, 25 bp, Homo sapien
gaccagggcctctcctgtgggatct

SEQ ID NO: 554873 - DNA, 25 bp, Homo sapien
ctcctgtgggatctttgttttgtgt

SEQ ID NO: 554874 - DNA, 25 bp, Homo sapien
accataatggttgtgtactgaacca

SEQ ID NO: 554875 - DNA, 25 bp, Homo sapien
gtgtactgaaccacttcatatttgt

SEQ ID NO: 554876 - DNA, 25 bp, Homo sapien
ctgcctctggcaccccctttcattg

SEQ ID NO: 554877 - DNA, 25 bp, Homo sapien
tgcctctggcaccccctttcattgg

SEQ ID NO: 554878 - DNA, 25 bp, Homo sapien
ctctggcaccccctttcattggttc

SEQ ID NO: 554879 - DNA, 25 bp, Homo sapien
gggcgctctgagattaaagagtttt

SEQ ID NO: 554880 - DNA, 25 bp, Homo sapien
ggcgctctgagattaaagagtttta

SEQ ID NO: 554881 - DNA, 25 bp, Homo sapien
gcgctctgagattaaagagttttac

SEQ ID NO: 554882 - DNA, 25 bp, Homo sapien
cgctctgagattaaagagttttacc

SEQ ID NO: 554883 - DNA, 25 bp, Homo sapien
gctctgagattaaagagttttacct

SEQ ID NO: 554884 - DNA, 25 bp, Homo sapien
ctctgagattaaagagttttacctc

SEQ ID NO: 554885 - DNA, 25 bp, Homo sapien
tctgagattaaagagttttacctct

SEQ ID NO: 554886 - DNA, 25 bp, Homo sapien
ctgagattaaagagttttacctctg

SEQ ID NO: 554887 - DNA, 25 bp, Homo sapien
ataaatttccaaattcagatcagca

SEQ ID NO: 554888 - DNA, 25 bp, Homo sapien
tgttgtactaaatagattgtcttct

SEQ ID NO: 554889 - DNA, 25 bp, Homo sapien
aatttcctgtagtctgaattatgta

SEQ ID NO: 554890 - DNA, 25 bp, Homo sapien
gtagtattgtttcacatgttccagt

SEQ ID NO: 554891 - DNA, 25 bp, Homo sapien
tttcacatgttccagtgtcctctta

SEQ ID NO: 554892 - DNA, 25 bp, Homo sapien
atgttccagtgtcctcttatttcct

SEQ ID NO: 554893 - DNA, 25 bp, Homo sapien
tgtcctcttatttcctgtgagttgg

SEQ ID NO: 554894 - DNA, 25 bp, Homo sapien
gattaaattcagattttctctcttt

SEQ ID NO: 554895 - DNA, 25 bp, Homo sapien
tcagattttctctctttagatcatc

SEQ ID NO: 554896 - DNA, 25 bp, Homo sapien
tctctctttagatcatcaactttag

SEQ ID NO: 554897 - DNA, 25 bp, Homo sapien
tcaactttagatcatcaacttggat

SEQ ID NO: 554898 - DNA, 25 bp, Homo sapien
aaatagttccctagctcctcaagtg

SEQ ID NO: 554899 - DNA, 25 bp, Homo sapien
agttccctagctcctcaagtgtgct

SEQ ID NO: 554900 - DNA, 25 bp, Homo sapien
gttgatatattattgaaggtactac

SEQ ID NO: 554901 - DNA, 25 bp, Homo sapien
gaaatctctggagtgcagaagttaa

SEQ ID NO: 554902 - DNA, 25 bp, Homo sapien
ccttcatactgaaaatatatcctta

SEQ ID NO: 554903 - DNA, 25 bp, Homo sapien
aaacctctatacaaatgtagtacag

SEQ ID NO: 554904 - DNA, 25 bp, Homo sapien
atgtagtacagcatacaaattttta

SEQ ID NO: 554905 - DNA, 25 bp, Homo sapien
atggaatgaaggcacgaaccattgc

SEQ ID NO: 554906 - DNA, 25 bp, Homo sapien
gaaggcacgaaccattgcaagtctt

SEQ ID NO: 554907 - DNA, 25 bp, Homo sapien
ggcacgaaccattgcaagtcttttg

SEQ ID NO: 554908 - DNA, 25 bp, Homo sapien
gaaccattgcaagtcttttggaaat

SEQ ID NO: 554909 - DNA, 25 bp, Homo sapien
gtagttgcacaaattctgaatccca

SEQ ID NO: 554910 - DNA, 25 bp, Homo sapien
attgtcccgttgcacaaaggcttgc

SEQ ID NO: 554911 - DNA, 25 bp, Homo sapien
atgttgatgaattgtggtctgtcca

SEQ ID NO: 554912 - DNA, 25 bp, Homo sapien
aaaacttgcttaacatcctcaaaag

SEQ ID NO: 554913 - DNA, 25 bp, Homo sapien
aaaagttacttctcctttgccagct

SEQ ID NO: 554914 - DNA, 25 bp, Homo sapien
ctttgccagctttgtcaaacagctg

SEQ ID NO: 554915 - DNA, 25 bp, Homo sapien
gtcaaacagctgaaaggctaccata

SEQ ID NO: 554916 - DNA, 25 bp, Homo sapien
aggctaccataaacaaagcatcagg

SEQ ID NO: 554917 - DNA, 25 bp, Homo sapien
gggcacacaggacagattcaaaggc

SEQ ID NO: 554918 - DNA, 25 bp, Homo sapien
aaactgagtaaattccgcatatgtc

SEQ ID NO: 554919 - DNA, 25 bp, Homo sapien
cgcatatgtcaggtgtctttttctt

SEQ ID NO: 554920 - DNA, 25 bp, Homo sapien
aagttcagacaggatctggccacag

SEQ ID NO: 554921 - DNA, 25 bp, Homo sapien
cagacaggatctggccacagcaagt

SEQ ID NO: 554922 - DNA, 25 bp, Homo sapien
caagtacttagtggatggtcattat

SEQ ID NO: 554923 - DNA, 25 bp, Homo sapien
aatatttcgaactctgtgtcctggg

SEQ ID NO: 554924 - DNA, 25 bp, Homo sapien
actctgtgtcctgggatacaggcta

SEQ ID NO: 554925 - DNA, 25 bp, Homo sapien
ccaggctttatctgtgtcaagggta

SEQ ID NO: 554926 - DNA, 25 bp, Homo sapien
gtcaagggtacttcccagttccaag

SEQ ID NO: 554927 - DNA, 25 bp, Homo sapien
agttccaagcctttgcttctgcctg

SEQ ID NO: 554928 - DNA, 25 bp, Homo sapien
cactgttctaagtcctgtctgccaa

SEQ ID NO: 554929 - DNA, 25 bp, Homo sapien
tgtctgccaacatccacttaatgtg

SEQ ID NO: 554930 - DNA, 25 bp, Homo sapien
atccacttaatgtgacctcctggga

SEQ ID NO: 554931 - DNA, 25 bp, Homo sapien
ccaagcgcaagggtgtgcactgtgt

SEQ ID NO: 554932 - DNA, 25 bp, Homo sapien
agcgcaagggtgtgcactgtgtcat

SEQ ID NO: 554933 - DNA, 25 bp, Homo sapien
gcaagggtgtgcactgtgtcatgtc

SEQ ID NO: 554934 - DNA, 25 bp, Homo sapien
aagggtgtgcactgtgtcatgtccc

SEQ ID NO: 554935 - DNA, 25 bp, Homo sapien
agggtgtgcactgtgtcatgtccct

SEQ ID NO: 554936 - DNA, 25 bp, Homo sapien
tgcactgtgtcatgtccctgggggt

SEQ ID NO: 554937 - DNA, 25 bp, Homo sapien
aacggagcaggcaggacccaggcac

SEQ ID NO: 554938 - DNA, 25 bp, Homo sapien
acggagcaggcaggacccaggcaca

SEQ ID NO: 554939 - DNA, 25 bp, Homo sapien
acccaggcacagacagaacagaaga

SEQ ID NO: 554940 - DNA, 25 bp, Homo sapien
caggcacagacagaacagaagacag

SEQ ID NO: 554941 - DNA, 25 bp, Homo sapien
acagaagacagtggattagcagcgg

SEQ ID NO: 554942 - DNA, 25 bp, Homo sapien
gcaggagcacgtgctgttttttatt

SEQ ID NO: 554943 - DNA, 25 bp, Homo sapien
tggacttaacttcagagaaaccgct

SEQ ID NO: 554944 - DNA, 25 bp, Homo sapien
gaaaccgctgacatctagaactgac

SEQ ID NO: 554945 - DNA, 25 bp, Homo sapien
tctagaactgacctaccacaagcat

SEQ ID NO: 554946 - DNA, 25 bp, Homo sapien
taccacaagcatccaccaaaggagt

SEQ ID NO: 554947 - DNA, 25 bp, Homo sapien
ctgctgtgcagcactgcattgtcat

SEQ ID NO: 554948 - DNA, 25 bp, Homo sapien
gcagcactgcattgtcatgacattt

SEQ ID NO: 554949 - DNA, 25 bp, Homo sapien
gcattgtcatgacatttccaacact

SEQ ID NO: 554950 - DNA, 25 bp, Homo sapien
gtgtgaattatctaaatgcgtctac

SEQ ID NO: 554951 - DNA, 25 bp, Homo sapien
atgcgtctaccattttgcactaggg

SEQ ID NO: 554952 - DNA, 25 bp, Homo sapien
accattttgcactagggaggaagga

SEQ ID NO: 554953 - DNA, 25 bp, Homo sapien
tttgtccctgagagtactccacgat

SEQ ID NO: 554954 - DNA, 25 bp, Homo sapien
tactccacgattactaggttcttga

SEQ ID NO: 554955 - DNA, 25 bp, Homo sapien
aggttcttgattcccttatatggca

SEQ ID NO: 554956 - DNA, 25 bp, Homo sapien
tggcaatcaggcagaggcgttcctt

SEQ ID NO: 554957 - DNA, 25 bp, Homo sapien
agaggcgttccttaagcattagaga

SEQ ID NO: 554958 - DNA, 25 bp, Homo sapien
gatgaagtccttagtacagttgaaa

SEQ ID NO: 554959 - DNA, 25 bp, Homo sapien
aatcaattgttttgcctcaccagtc

SEQ ID NO: 554960 - DNA, 25 bp, Homo sapien
gttttgcctcaccagtcattttaaa

SEQ ID NO: 554961 - DNA, 25 bp, Homo sapien
gaatacttatttctcagtgcttaaa

SEQ ID NO: 554962 - DNA, 25 bp, Homo sapien
aatttctttttcaactgtgagattg

SEQ ID NO: 554963 - DNA, 25 bp, Homo sapien
ataaacagtctctatttctgtggaa

SEQ ID NO: 554964 - DNA, 25 bp, Homo sapien
agaaaggtcgcagcagtagctttgg

SEQ ID NO: 554965 - DNA, 25 bp, Homo sapien
ggaagatatggcacttctccaaccc

SEQ ID NO: 554966 - DNA, 25 bp, Homo sapien
ctgctgataaaatatgagccggtta

SEQ ID NO: 554967 - DNA, 25 bp, Homo sapien
atgagccggttattacttctgtttg

SEQ ID NO: 554968 - DNA, 25 bp, Homo sapien
ggttattacttctgtttgggagact

SEQ ID NO: 554969 - DNA, 25 bp, Homo sapien
tgtgctctctgtggtgcctctcttg

SEQ ID NO: 554970 - DNA, 25 bp, Homo sapien
ttggctctactccacagataccaga

SEQ ID NO: 554971 - DNA, 25 bp, Homo sapien
gagcagaccagctttgaggttgacc

SEQ ID NO: 554972 - DNA, 25 bp, Homo sapien
ttgaggttgacctgtttctctttgt

SEQ ID NO: 554973 - DNA, 25 bp, Homo sapien
cccaggaagacattaagcagcctta

SEQ ID NO: 554974 - DNA, 25 bp, Homo sapien
aagcagccttaagcttaaattccta

SEQ ID NO: 554975 - DNA, 25 bp, Homo sapien
ggattttagcagtttcttggtcatt

SEQ ID NO: 554976 - DNA, 25 bp, Homo sapien
ttcttggtcatttcaatgatttgag

SEQ ID NO: 554977 - DNA, 25 bp, Homo sapien
gatgtggttttttagtctgaggcaa

SEQ ID NO: 554978 - DNA, 25 bp, Homo sapien
acaaacagtccctagtgtcttctct

SEQ ID NO: 554979 - DNA, 25 bp, Homo sapien
tccctagtgtcttctcttgtgttaa

SEQ ID NO: 554980 - DNA, 25 bp, Homo sapien
tctgccccaaactcaagtgaatcag

SEQ ID NO: 554981 - DNA, 25 bp, Homo sapien
agtgtcttctcttgtgttaacgcca

SEQ ID NO: 554982 - DNA, 25 bp, Homo sapien
caagtgaatcagttcctgctcttca

SEQ ID NO: 554983 - DNA, 25 bp, Homo sapien
ttctcttgtgttaacgccacactgg

SEQ ID NO: 554984 - DNA, 25 bp, Homo sapien
ttaacgccacactggaaatttccct

SEQ ID NO: 554985 - DNA, 25 bp, Homo sapien
ctcgctccctcagatacacattaaa

SEQ ID NO: 554986 - DNA, 25 bp, Homo sapien
gaattgcttcgctggcattcttcaa

SEQ ID NO: 554987 - DNA, 25 bp, Homo sapien
ggcattcttcaagacctttactatt

SEQ ID NO: 554988 - DNA, 25 bp, Homo sapien
cattattttttaacgcctggacctg

SEQ ID NO: 554989 - DNA, 25 bp, Homo sapien
ttttaacgcctggacctgagaatct

SEQ ID NO: 554990 - DNA, 25 bp, Homo sapien
gagaatctctacacctcaaaaaggc

SEQ ID NO: 554991 - DNA, 25 bp, Homo sapien
aaaggcttagttgtttttcatctgc

SEQ ID NO: 554992 - DNA, 25 bp, Homo sapien
tttcatctgccaaacgtcaagggag

SEQ ID NO: 554993 - DNA, 25 bp, Homo sapien
gtcaagggagcctctagtgcctgga

SEQ ID NO: 554994 - DNA, 25 bp, Homo sapien
tctagtgcctggacagggcggactc

SEQ ID NO: 554995 - DNA, 25 bp, Homo sapien
ggctgtagcataggtcggctttgca

SEQ ID NO: 554996 - DNA, 25 bp, Homo sapien
cataggtcggctttgcataaataga

SEQ ID NO: 554997 - DNA, 25 bp, Homo sapien
aagtatgtggtggaagtacctttct

SEQ ID NO: 554998 - DNA, 25 bp, Homo sapien
gtacctttcttcaggaaattctgtc

SEQ ID NO: 554999 - DNA, 25 bp, Homo sapien
ctgtcctaagcttttaccctgagaa

SEQ ID NO: 555000 - DNA, 25 bp, Homo sapien
gggagactccactgaaacacatctg

SEQ ID NO: 555001 - DNA, 25 bp, Homo sapien
gaaacacatctgctagaccactaag

SEQ ID NO: 555002 - DNA, 25 bp, Homo sapien
gaccactaagtttatccttgtcacc

SEQ ID NO: 555003 - DNA, 25 bp, Homo sapien
ccttgtcacccagtttgctcttgga

SEQ ID NO: 555004 - DNA, 25 bp, Homo sapien
ttcccttttgtcactgaaccaatca

SEQ ID NO: 555005 - DNA, 25 bp, Homo sapien
aacttgtgctttacctcctatagca

SEQ ID NO: 555006 - DNA, 25 bp, Homo sapien
tttacctcctatagcacagccgaga

SEQ ID NO: 555007 - DNA, 25 bp, Homo sapien
ccgagacaaggctggaacatttaat

SEQ ID NO: 555008 - DNA, 25 bp, Homo sapien
tttctcccagtgaaatcccatagcc

SEQ ID NO: 555009 - DNA, 25 bp, Homo sapien
ccatagcccttacctagagtctagg

SEQ ID NO: 555010 - DNA, 25 bp, Homo sapien
gaagatacactgagattgacctgag

SEQ ID NO: 555011 - DNA, 25 bp, Homo sapien
ttgacctgaggagacatctacacac

SEQ ID NO: 555012 - DNA, 25 bp, Homo sapien
atctacacacaccagtggcagctgc

SEQ ID NO: 555013 - DNA, 25 bp, Homo sapien
tcctaagtctgtcatcctctggaag

SEQ ID NO: 555014 - DNA, 25 bp, Homo sapien
gatgggtggtgctccaatctctggt

SEQ ID NO: 555015 - DNA, 25 bp, Homo sapien
aatctctggtgcctaaaaacccaag

SEQ ID NO: 555016 - DNA, 25 bp, Homo sapien
ttatttctctcttaacactggcaat

SEQ ID NO: 555017 - DNA, 25 bp, Homo sapien
aataaccagtccacaccactgttgc

SEQ ID NO: 555018 - DNA, 25 bp, Homo sapien
acctcttaataatctcatgctgtgt

SEQ ID NO: 555019 - DNA, 25 bp, Homo sapien
ttctgagtcgcccatctgttgctgt

SEQ ID NO: 555020 - DNA, 25 bp, Homo sapien
agtcgcccatctgttgctgtgggag

SEQ ID NO: 555021 - DNA, 25 bp, Homo sapien
gctgtgggagtgtgaacggatcgct

SEQ ID NO: 555022 - DNA, 25 bp, Homo sapien
gagctttgctctctctaggtgggca

SEQ ID NO: 555023 - DNA, 25 bp, Homo sapien
tttgctctctctaggtgggcaagtt

SEQ ID NO: 555024 - DNA, 25 bp, Homo sapien
aggtgggcaagtttcctgggctctc

SEQ ID NO: 555025 - DNA, 25 bp, Homo sapien
ggtgggcaagtttcctgggctctct

SEQ ID NO: 555026 - DNA, 25 bp, Homo sapien
gaatgaacatggcttcatccaggtt

SEQ ID NO: 555027 - DNA, 25 bp, Homo sapien
gaacatggcttcatccaggttaact

SEQ ID NO: 555028 - DNA, 25 bp, Homo sapien
ggcttcatccaggttaactgatgct

SEQ ID NO: 555029 - DNA, 25 bp, Homo sapien
atccaggttaactgatgctgccatt

SEQ ID NO: 555030 - DNA, 25 bp, Homo sapien
tgatctgttgttgctgaatcagaga

SEQ ID NO: 555031 - DNA, 25 bp, Homo sapien
tgggcattatttatgcccctttctg

SEQ ID NO: 555032 - DNA, 25 bp, Homo sapien
atttatgcccctttctgtggaagag

SEQ ID NO: 555033 - DNA, 25 bp, Homo sapien
gtagagatgctctttgtgattaact

SEQ ID NO: 555034 - DNA, 25 bp, Homo sapien
gagatgctctttgtgattaacttag

SEQ ID NO: 555035 - DNA, 25 bp, Homo sapien
gctctttgtgattaacttagaatat

SEQ ID NO: 555036 - DNA, 25 bp, Homo sapien
gtacatgttcagactaacattcttt

SEQ ID NO: 555037 - DNA, 25 bp, Homo sapien
gttcagactaacattcttttgcagt

SEQ ID NO: 555038 - DNA, 25 bp, Homo sapien
cagactaacattcttttgcagtata

SEQ ID NO: 555039 - DNA, 25 bp, Homo sapien
taacattcttttgcagtatagtgag

SEQ ID NO: 555040 - DNA, 25 bp, Homo sapien
attttgttgattgtgcttttatgta

SEQ ID NO: 555041 - DNA, 25 bp, Homo sapien
tgaacctggacatcagcagtttatt

SEQ ID NO: 555042 - DNA, 25 bp, Homo sapien
aacctggacatcagcagtttattca

SEQ ID NO: 555043 - DNA, 25 bp, Homo sapien
cctggacatcagcagtttattcagc

SEQ ID NO: 555044 - DNA, 25 bp, Homo sapien
ctcagctacagaatccagaagtcag

SEQ ID NO: 555045 - DNA, 25 bp, Homo sapien
tggaacaactcagtgcaatgggatt

SEQ ID NO: 555046 - DNA, 25 bp, Homo sapien
aacaggaggtgatatcaatgcagct

SEQ ID NO: 555047 - DNA, 25 bp, Homo sapien
caggaggtgatatcaatgcagctat

SEQ ID NO: 555048 - DNA, 25 bp, Homo sapien
ggaggtgatatcaatgcagctattg

SEQ ID NO: 555049 - DNA, 25 bp, Homo sapien
ggtgatatcaatgcagctattgaaa

SEQ ID NO: 555050 - DNA, 25 bp, Homo sapien
gctattgaaaggttactgggctccc

SEQ ID NO: 555051 - DNA, 25 bp, Homo sapien
ctattgaaaggttactgggctccca

SEQ ID NO: 555052 - DNA, 25 bp, Homo sapien
cctccagctaagaaactcaacttcg

SEQ ID NO: 555053 - DNA, 25 bp, Homo sapien
gaccctggattctggccttctcatg

SEQ ID NO: 555054 - DNA, 25 bp, Homo sapien
ggattctggccttctcatgacctct

SEQ ID NO: 555055 - DNA, 25 bp, Homo sapien
ctgacctctcactgttcatgccgga

SEQ ID NO: 555056 - DNA, 25 bp, Homo sapien
tgttcatgccggacctgtggatctc

SEQ ID NO: 555057 - DNA, 25 bp, Homo sapien
tgccggacctgtggatctcctggga

SEQ ID NO: 555058 - DNA, 25 bp, Homo sapien
atctcctgggactccgagcaaggcc

SEQ ID NO: 555059 - DNA, 25 bp, Homo sapien
gactccgagcaaggcctgcacgaga

SEQ ID NO: 555060 - DNA, 25 bp, Homo sapien
tcgctattcccgcataagcatctgc

SEQ ID NO: 555061 - DNA, 25 bp, Homo sapien
aacccctttgaccttcatctgatgg

SEQ ID NO: 555062 - DNA, 25 bp, Homo sapien
ctttgaccttcatctgatggacatt

SEQ ID NO: 555063 - DNA, 25 bp, Homo sapien
gtgatcaatggtcaagagattactg

SEQ ID NO: 555064 - DNA, 25 bp, Homo sapien
tactgagaaactctttttctataat

SEQ ID NO: 555065 - DNA, 25 bp, Homo sapien
cagtattgtcatgtacaagcgtacc

SEQ ID NO: 555066 - DNA, 25 bp, Homo sapien
gtacaagcgtacctaatgcacactt

SEQ ID NO: 555067 - DNA, 25 bp, Homo sapien
gcgtacctaatgcacactttatctt

SEQ ID NO: 555068 - DNA, 25 bp, Homo sapien
aatgcacactttatcttttattgta

SEQ ID NO: 555069 - DNA, 25 bp, Homo sapien
tctttggtttctatggagtacacct

SEQ ID NO: 555070 - DNA, 25 bp, Homo sapien
ggtttctatggagtacacctaccag

SEQ ID NO: 555071 - DNA, 25 bp, Homo sapien
gagtacacctaccagagactaccag

SEQ ID NO: 555072 - DNA, 25 bp, Homo sapien
cacctaccagagactaccagtgtaa

SEQ ID NO: 555073 - DNA, 25 bp, Homo sapien
cagagactaccagtgtaaagtgata

SEQ ID NO: 555074 - DNA, 25 bp, Homo sapien
aagagttcaggaatcaccccaggtg

SEQ ID NO: 555075 - DNA, 25 bp, Homo sapien
accccaggtggtgtagcttctgaga

SEQ ID NO: 555076 - DNA, 25 bp, Homo sapien
tgggattccagttccgggactgtgt

SEQ ID NO: 555077 - DNA, 25 bp, Homo sapien
gttccgggactgtgtgtcacttgca

SEQ ID NO: 555078 - DNA, 25 bp, Homo sapien
gactgtgtgtcacttgcatacctgt

SEQ ID NO: 555079 - DNA, 25 bp, Homo sapien
tcacttgcatacctgtgccttggta

SEQ ID NO: 555080 - DNA, 25 bp, Homo sapien
atacctgtgccttggtaccacaggg

SEQ ID NO: 555081 - DNA, 25 bp, Homo sapien
gggaggaagacttttcactagcgta

SEQ ID NO: 555082 - DNA, 25 bp, Homo sapien
agacttttcactagcgtatcctttt

SEQ ID NO: 555083 - DNA, 25 bp, Homo sapien
ttttcactagcgtatccttttctac

SEQ ID NO: 555084 - DNA, 25 bp, Homo sapien
tagcgtatccttttctaccttttga

SEQ ID NO: 555085 - DNA, 25 bp, Homo sapien
gttttattgctctgagtaactgaca

SEQ ID NO: 555086 - DNA, 25 bp, Homo sapien
tcagtttttgtagtaaaggcgtcac

SEQ ID NO: 555087 - DNA, 25 bp, Homo sapien
gtttttgtagtaaaggcgtcacatg

SEQ ID NO: 555088 - DNA, 25 bp, Homo sapien
ttttgtagtaaaggcgtcacatgca

SEQ ID NO: 555089 - DNA, 25 bp, Homo sapien
tgtagtaaaggcgtcacatgcaaac

SEQ ID NO: 555090 - DNA, 25 bp, Homo sapien
tagtaaaggcgtcacatgcaaacaa

SEQ ID NO: 555091 - DNA, 25 bp, Homo sapien
gtaaaggcgtcacatgcaaacaaac

SEQ ID NO: 555092 - DNA, 25 bp, Homo sapien
ctggaaacagagcaattactggcct

SEQ ID NO: 555093 - DNA, 25 bp, Homo sapien
ggaaacagagcaattactggcctgt

SEQ ID NO: 555094 - DNA, 25 bp, Homo sapien
cagagcaattactggcctgttgggt

SEQ ID NO: 555095 - DNA, 25 bp, Homo sapien
agagcaattactggcctgttgggtg

SEQ ID NO: 555096 - DNA, 25 bp, Homo sapien
aaagtagtttgcgattgcagtagaa

SEQ ID NO: 555097 - DNA, 25 bp, Homo sapien
ataagtggtttacttctcccatcca

SEQ ID NO: 555098 - DNA, 25 bp, Homo sapien
tggtttacttctcccatccattgta

SEQ ID NO: 555099 - DNA, 25 bp, Homo sapien
gtttcttttgaattatgccactgct

SEQ ID NO: 555100 - DNA, 25 bp, Homo sapien
atgccactgctgaacttttaacaaa

SEQ ID NO: 555101 - DNA, 25 bp, Homo sapien
ataatttgagtttaggtgatccacc

SEQ ID NO: 555102 - DNA, 25 bp, Homo sapien
ttaggtgatccaccccttaattgta

SEQ ID NO: 555103 - DNA, 25 bp, Homo sapien
ccccgatggtatatttctgagtaag

SEQ ID NO: 555104 - DNA, 25 bp, Homo sapien
tgagtaagctactatctgaacatta

SEQ ID NO: 555105 - DNA, 25 bp, Homo sapien
gaacattagttagatccatctcact

SEQ ID NO: 555106 - DNA, 25 bp, Homo sapien
gttagatccatctcactatttaata

SEQ ID NO: 555107 - DNA, 25 bp, Homo sapien
gatggtttagagttgcagggcatta

SEQ ID NO: 555108 - DNA, 25 bp, Homo sapien
ataataatatttttgtgcactttaa

SEQ ID NO: 555109 - DNA, 25 bp, Homo sapien
gtgtaatcttgtaagttcaaagctg

SEQ ID NO: 555110 - DNA, 25 bp, Homo sapien
tgtaagttcaaagctgggttctcag

SEQ ID NO: 555111 - DNA, 25 bp, Homo sapien
tcaaagctgggttctcagtgagcag

SEQ ID NO: 555112 - DNA, 25 bp, Homo sapien
ctcagtgagcagcaaaaggtgttag

SEQ ID NO: 555113 - DNA, 25 bp, Homo sapien
aaggtgttagatgcatcaccacact

SEQ ID NO: 555114 - DNA, 25 bp, Homo sapien
tgttagatgcatcaccacacttcac

SEQ ID NO: 555115 - DNA, 25 bp, Homo sapien
agatgcatcaccacacttcacagga

SEQ ID NO: 555116 - DNA, 25 bp, Homo sapien
acacttcacaggacctcctgaatga

SEQ ID NO: 555117 - DNA, 25 bp, Homo sapien
acaggacctcctgaatgactgcaga

SEQ ID NO: 555118 - DNA, 25 bp, Homo sapien
gtttctgttgagtgcctcccatatc

SEQ ID NO: 555119 - DNA, 25 bp, Homo sapien
gtgcctcccatatctcaggaacttt

SEQ ID NO: 555120 - DNA, 25 bp, Homo sapien
tagaactcctagtttagtttactct

SEQ ID NO: 555121 - DNA, 25 bp, Homo sapien
atctgcgtaagtaagtatagtttcc

SEQ ID NO: 555122 - DNA, 25 bp, Homo sapien
gtatagtttccttaagcaccaactg

SEQ ID NO: 555123 - DNA, 25 bp, Homo sapien
gaaagccagtggtactgtccaccac

SEQ ID NO: 555124 - DNA, 25 bp, Homo sapien
gtggtactgtccaccacattctgga

SEQ ID NO: 555125 - DNA, 25 bp, Homo sapien
gggctccatgaagcacatgggtcta

SEQ ID NO: 555126 - DNA, 25 bp, Homo sapien
gcacatgggtctaaaaacagctcat

SEQ ID NO: 555127 - DNA, 25 bp, Homo sapien
gtttactctttgtagttcactttag

SEQ ID NO: 555128 - DNA, 25 bp, Homo sapien
gtaagtttctatctctatgtagtca

SEQ ID NO: 555129 - DNA, 25 bp, Homo sapien
aaacaccagctttgacccgaagtag

SEQ ID NO: 555130 - DNA, 25 bp, Homo sapien
caccagctttgacccgaagtagttg

SEQ ID NO: 555131 - DNA, 25 bp, Homo sapien
tttgacccgaagtagttgaagagct

SEQ ID NO: 555132 - DNA, 25 bp, Homo sapien
gaagagctacttcattcttttctga

SEQ ID NO: 555133 - DNA, 25 bp, Homo sapien
cttttctgaagttgtgtgttgctgc

SEQ ID NO: 555134 - DNA, 25 bp, Homo sapien
ctgaagttgtgtgttgctgctagaa

SEQ ID NO: 555135 - DNA, 25 bp, Homo sapien
gttgctgctagaaatagtcatttgt

SEQ ID NO: 555136 - DNA, 25 bp, Homo sapien
ttatgtttttgtactctgcagactg

SEQ ID NO: 555137 - DNA, 25 bp, Homo sapien
ttttgtactctgcagactgaaaaga

SEQ ID NO: 555138 - DNA, 25 bp, Homo sapien
gacaaagtttatcttggccttactg

SEQ ID NO: 555139 - DNA, 25 bp, Homo sapien
gtttatcttggccttactgtataaa

SEQ ID NO: 555140 - DNA, 25 bp, Homo sapien
gaaagtgagaaatcttcgccagaga

SEQ ID NO: 555141 - DNA, 25 bp, Homo sapien
gaaatcttcgccagagactcactgc

SEQ ID NO: 555142 - DNA, 25 bp, Homo sapien
cccgggctcgtcacagatgtcaaac

SEQ ID NO: 555143 - DNA, 25 bp, Homo sapien
tttggctgcatagaatgcatgtcac

SEQ ID NO: 555144 - DNA, 25 bp, Homo sapien
gaatgcatgtcaccttgagacggtc

SEQ ID NO: 555145 - DNA, 25 bp, Homo sapien
atgtcaccttgagacggtcgagaga

SEQ ID NO: 555146 - DNA, 25 bp, Homo sapien
tcgagagagagacctattttgcaat

SEQ ID NO: 555147 - DNA, 25 bp, Homo sapien
gacctattttgcaatcagtgacatt

SEQ ID NO: 555148 - DNA, 25 bp, Homo sapien
aagatcagccctttgtacagaaaaa

SEQ ID NO: 555149 - DNA, 25 bp, Homo sapien
aattctgatactttttggcttgtaa

SEQ ID NO: 555150 - DNA, 25 bp, Homo sapien
atggcttcttgaactttttacaata

SEQ ID NO: 555151 - DNA, 25 bp, Homo sapien
gagaagctgtagtttttaccaaatt

SEQ ID NO: 555152 - DNA, 25 bp, Homo sapien
taccaaattgtgtacatctgggcag

SEQ ID NO: 555153 - DNA, 25 bp, Homo sapien
atctgggcagatgtttaatttctgt

SEQ ID NO: 555154 - DNA, 25 bp, Homo sapien
ttctgtgactaatcactgaactaga

SEQ ID NO: 555155 - DNA, 25 bp, Homo sapien
aaattttttatgtctgaagcctgag

SEQ ID NO: 555156 - DNA, 25 bp, Homo sapien
atgtctgaagcctgagtctattttg

SEQ ID NO: 555157 - DNA, 25 bp, Homo sapien
gcctgagtctattttggatctgtaa

SEQ ID NO: 555158 - DNA, 25 bp, Homo sapien
ggatctgtaaataatcattgccagt

SEQ ID NO: 555159 - DNA, 25 bp, Homo sapien
atcattgccagtgtgacttttgttc

SEQ ID NO: 555160 - DNA, 25 bp, Homo sapien
gccagtgtgacttttgttcaacaaa

SEQ ID NO: 555161 - DNA, 25 bp, Homo sapien
gattgtactgtattaagaaccgatg

SEQ ID NO: 555162 - DNA, 25 bp, Homo sapien
tttttcagaagttccaaacagcaac

SEQ ID NO: 555163 - DNA, 25 bp, Homo sapien
aaacagcaactttgagagcagtggg

SEQ ID NO: 555164 - DNA, 25 bp, Homo sapien
gggtgcttggcagctgttctgtgtt

SEQ ID NO: 555165 - DNA, 25 bp, Homo sapien
gttttccaggaatccaactgagcat

SEQ ID NO: 555166 - DNA, 25 bp, Homo sapien
ggaatccaactgagcattgaaatct

SEQ ID NO: 555167 - DNA, 25 bp, Homo sapien
ccaactgagcattgaaatctctcat

SEQ ID NO: 555168 - DNA, 25 bp, Homo sapien
ctctcatttgccgacttatttttat

SEQ ID NO: 555169 - DNA, 25 bp, Homo sapien
tcatttgccgacttatttttatagg

SEQ ID NO: 555170 - DNA, 25 bp, Homo sapien
tagtattggaactacttctaatttt

SEQ ID NO: 555171 - DNA, 25 bp, Homo sapien
gtagtgtaatgtataattgctcttg

SEQ ID NO: 555172 - DNA, 25 bp, Homo sapien
attgctcttgtttattgcttttaca

SEQ ID NO: 555173 - DNA, 25 bp, Homo sapien
gacactgcctatccatgctattaat

SEQ ID NO: 555174 - DNA, 25 bp, Homo sapien
gaagggctagttttgcatgcacttt

SEQ ID NO: 555175 - DNA, 25 bp, Homo sapien
gcatgcactttctctcatgtgcaga

SEQ ID NO: 555176 - DNA, 25 bp, Homo sapien
tgcagagcaactacacataggtgag

SEQ ID NO: 555177 - DNA, 25 bp, Homo sapien
gtttcactcacaggatgacattctg

SEQ ID NO: 555178 - DNA, 25 bp, Homo sapien
atgacattctgtctgttccgggctc

SEQ ID NO: 555179 - DNA, 25 bp, Homo sapien
gttccgggctcatcatgtgagacta

SEQ ID NO: 555180 - DNA, 25 bp, Homo sapien
gggtgacttactcagcctctaaaag

SEQ ID NO: 555181 - DNA, 25 bp, Homo sapien
agcctctaaaagttcagccaacaga

SEQ ID NO: 555182 - DNA, 25 bp, Homo sapien
gatagcctttatttaactcctgaga

SEQ ID NO: 555183 - DNA, 25 bp, Homo sapien
ggaaccttcaaacactgaccaaccg

SEQ ID NO: 555184 - DNA, 25 bp, Homo sapien
ggatgccctggaagcacccagcatc

SEQ ID NO: 555185 - DNA, 25 bp, Homo sapien
agcatcacacccaggcttgtgcggg

SEQ ID NO: 555186 - DNA, 25 bp, Homo sapien
gtctgtcccggctggagaacagcgt

SEQ ID NO: 555187 - DNA, 25 bp, Homo sapien
ggagaacagcgtccacgcagtcctg

SEQ ID NO: 555188 - DNA, 25 bp, Homo sapien
ccccaaggtgctgtctgtctagaca

SEQ ID NO: 555189 - DNA, 25 bp, Homo sapien
tgtctgtctagacaggctgtcccac

SEQ ID NO: 555190 - DNA, 25 bp, Homo sapien
accccagggtggctagtggccatat

SEQ ID NO: 555191 - DNA, 25 bp, Homo sapien
gccatatgcagggaatggtgcttct

SEQ ID NO: 555192 - DNA, 25 bp, Homo sapien
aatggtgcttctggctgtggcacgc

SEQ ID NO: 555193 - DNA, 25 bp, Homo sapien
tgtggcacgcactggatcacccagg

SEQ ID NO: 555194 - DNA, 25 bp, Homo sapien
gatcacccaggtcccagcagacatg

SEQ ID NO: 555195 - DNA, 25 bp, Homo sapien
ttctctttctgccaagttcggctca

SEQ ID NO: 555196 - DNA, 25 bp, Homo sapien
gccaagttcggctcaataagcgcaa

SEQ ID NO: 555197 - DNA, 25 bp, Homo sapien
gctcaataagcgcaaggaatacatg

SEQ ID NO: 555198 - DNA, 25 bp, Homo sapien
ggaatacatggtgcgctagggcccc

SEQ ID NO: 555199 - DNA, 25 bp, Homo sapien
tttaaagactccctgcaccgtgtca

SEQ ID NO: 555200 - DNA, 25 bp, Homo sapien
ggtttcccgggcgagagactgaatc

SEQ ID NO: 555201 - DNA, 25 bp, Homo sapien
gggcgagagactgaatcccttctcc

SEQ ID NO: 555202 - DNA, 25 bp, Homo sapien
gagagactgaatcccttctcccatc

SEQ ID NO: 555203 - DNA, 25 bp, Homo sapien
tcgctgtgtcccgtatctcaataaa

SEQ ID NO: 555204 - DNA, 25 bp, Homo sapien
gctgtgtcccgtatctcaataaaga

SEQ ID NO: 555205 - DNA, 25 bp, Homo sapien
atctcaataaagagaatctgctctc

SEQ ID NO: 555206 - DNA, 25 bp, Homo sapien
agaccagctccccacattcctgaat

SEQ ID NO: 555207 - DNA, 25 bp, Homo sapien
ctgaattccacttccaggcagaaag

SEQ ID NO: 555208 - DNA, 25 bp, Homo sapien
ccaggcagaaaggagtgggctcccc

SEQ ID NO: 555209 - DNA, 25 bp, Homo sapien
actcaccggctgtcctagaatgggc

SEQ ID NO: 555210 - DNA, 25 bp, Homo sapien
caccggctgtcctagaatgggcagg

SEQ ID NO: 555211 - DNA, 25 bp, Homo sapien
agagcgaagttctgggtgggatgac

SEQ ID NO: 555212 - DNA, 25 bp, Homo sapien
gggaggggcctcagtccagaaacct

SEQ ID NO: 555213 - DNA, 25 bp, Homo sapien
tcagtccagaaacctcgaccgctag

SEQ ID NO: 555214 - DNA, 25 bp, Homo sapien
agtccagaaacctcgaccgctagct

SEQ ID NO: 555215 - DNA, 25 bp, Homo sapien
tgggcagcaggtcggcgggaccaca

SEQ ID NO: 555216 - DNA, 25 bp, Homo sapien
ggcgggaccacatgcctgggtctca

SEQ ID NO: 555217 - DNA, 25 bp, Homo sapien
ggagagcaagcacaaagtcatcatg

SEQ ID NO: 555218 - DNA, 25 bp, Homo sapien
gtcatcatggcttcagcgtctgctc

SEQ ID NO: 555219 - DNA, 25 bp, Homo sapien
tcagcgtctgctcgtggaaaccaag

SEQ ID NO: 555220 - DNA, 25 bp, Homo sapien
caagataaagatgcccattttccac

SEQ ID NO: 555221 - DNA, 25 bp, Homo sapien
aaagtttctggaagagagctctgcc

SEQ ID NO: 555222 - DNA, 25 bp, Homo sapien
ctcttgtaagcatgcttgtcaccca

SEQ ID NO: 555223 - DNA, 25 bp, Homo sapien
tgtcacccagggactagtctaccaa

SEQ ID NO: 555224 - DNA, 25 bp, Homo sapien
gtctaccaaggttatttggcagcta

SEQ ID NO: 555225 - DNA, 25 bp, Homo sapien
gcagctaattctagatttggatcat

SEQ ID NO: 555226 - DNA, 25 bp, Homo sapien
ggatcattgcccaaagttgcacttg

SEQ ID NO: 555227 - DNA, 25 bp, Homo sapien
attgcccaaagttgcacttgctggt

SEQ ID NO: 555228 - DNA, 25 bp, Homo sapien
atcacagcccttggatcaagtgaca

SEQ ID NO: 555229 - DNA, 25 bp, Homo sapien
tgtgtggaacctgggtcgactcaac

SEQ ID NO: 555230 - DNA, 25 bp, Homo sapien
ggtcgactcaaccatgtagccatag

SEQ ID NO: 555231 - DNA, 25 bp, Homo sapien
gtagccatagcagtgccagatttgg

SEQ ID NO: 555232 - DNA, 25 bp, Homo sapien
agatttggaaaaggctgcagcattt

SEQ ID NO: 555233 - DNA, 25 bp, Homo sapien
gtatctgttgtttttgtcaacctgg

SEQ ID NO: 555234 - DNA, 25 bp, Homo sapien
taccaagatggaactgcttcatcca

SEQ ID NO: 555235 - DNA, 25 bp, Homo sapien
tcatccattgggacgtgacagtcca

SEQ ID NO: 555236 - DNA, 25 bp, Homo sapien
gtgacagtccaattgcaggttttct

SEQ ID NO: 555237 - DNA, 25 bp, Homo sapien
ggctggaggaatgcatcacatctgc

SEQ ID NO: 555238 - DNA, 25 bp, Homo sapien
catcacatctgcatcgaggtggata

SEQ ID NO: 555239 - DNA, 25 bp, Homo sapien
aacagctatgattctgaagtcacct

SEQ ID NO: 555240 - DNA, 25 bp, Homo sapien
gctatgattctgaagtcacctttct

SEQ ID NO: 555241 - DNA, 25 bp, Homo sapien
tgattctgaagtcacctttctcaaa

SEQ ID NO: 555242 - DNA, 25 bp, Homo sapien
acttttcctgtagttaccatagaca

SEQ ID NO: 555243 - DNA, 25 bp, Homo sapien
tgtagttaccatagacagacatctg

SEQ ID NO: 555244 - DNA, 25 bp, Homo sapien
catctgtcgttagacctgtgtggta

SEQ ID NO: 555245 - DNA, 25 bp, Homo sapien
tctgtcgttagacctgtgtggtatt

SEQ ID NO: 555246 - DNA, 25 bp, Homo sapien
gtcgttagacctgtgtggtatttca

SEQ ID NO: 555247 - DNA, 25 bp, Homo sapien
gacctgtgtggtatttcaaagaact

SEQ ID NO: 555248 - DNA, 25 bp, Homo sapien
ctgtgtggtatttcaaagaactcat

SEQ ID NO: 555249 - DNA, 25 bp, Homo sapien
ggtatttcaaagaactcatatgtta

SEQ ID NO: 555250 - DNA, 25 bp, Homo sapien
gaattcagggaagagactgtcgcct

SEQ ID NO: 555251 - DNA, 25 bp, Homo sapien
agggaagagactgtcgcctgccttc

SEQ ID NO: 555252 - DNA, 25 bp, Homo sapien
gccttcctccgttgttgcgtgagaa

SEQ ID NO: 555253 - DNA, 25 bp, Homo sapien
gttgttgcgtgagaacccgtgtgcc

SEQ ID NO: 555254 - DNA, 25 bp, Homo sapien
gttgcgtgagaacccgtgtgcccct

SEQ ID NO: 555255 - DNA, 25 bp, Homo sapien
tccatctttgaactcaaacacgagg

SEQ ID NO: 555256 - DNA, 25 bp, Homo sapien
aacacgaggaactaactgcaccctg

SEQ ID NO: 555257 - DNA, 25 bp, Homo sapien
gaggaactaactgcaccctggtcct

SEQ ID NO: 555258 - DNA, 25 bp, Homo sapien
accttcctccactctaagggatatc

SEQ ID NO: 555259 - DNA, 25 bp, Homo sapien
aagggatatcaacactgcccagcac

SEQ ID NO: 555260 - DNA, 25 bp, Homo sapien
aataagatgcactttatgtcatttt

SEQ ID NO: 555261 - DNA, 25 bp, Homo sapien
aattatctgtaggtagtgaaatgct

SEQ ID NO: 555262 - DNA, 25 bp, Homo sapien
aatgctaatgttgatttgtctttaa

SEQ ID NO: 555263 - DNA, 25 bp, Homo sapien
tctttaagggcttgttaactatcct

SEQ ID NO: 555264 - DNA, 25 bp, Homo sapien
taagggcttgttaactatcctttat

SEQ ID NO: 555265 - DNA, 25 bp, Homo sapien
ttgttaactatcctttattttctca

SEQ ID NO: 555266 - DNA, 25 bp, Homo sapien
ttttctcatttgtcttaaattaaga

SEQ ID NO: 555267 - DNA, 25 bp, Homo sapien
aaattactcatctaagcaaaaaatg

SEQ ID NO: 555268 - DNA, 25 bp, Homo sapien
tttattgtaccttatagtctgtcac

SEQ ID NO: 555269 - DNA, 25 bp, Homo sapien
tattgtaccttatagtctgtcacca

SEQ ID NO: 555270 - DNA, 25 bp, Homo sapien
tgtaccttatagtctgtcaccaaaa

SEQ ID NO: 555271 - DNA, 25 bp, Homo sapien
taccttatagtctgtcaccaaaaaa

SEQ ID NO: 555272 - DNA, 25 bp, Homo sapien
tgttaacaaattctaccaaagtggg

SEQ ID NO: 555273 - DNA, 25 bp, Homo sapien
atttgcctgtgattaaagatgctgt

SEQ ID NO: 555274 - DNA, 25 bp, Homo sapien
gcctgtgattaaagatgctgtaaac

SEQ ID NO: 555275 - DNA, 25 bp, Homo sapien
tatacagtttcatcagtctattagt

SEQ ID NO: 555276 - DNA, 25 bp, Homo sapien
ttttattaagtctaagatgccatca

SEQ ID NO: 555277 - DNA, 25 bp, Homo sapien
gatgccatcagtggttagcaaacac

SEQ ID NO: 555278 - DNA, 25 bp, Homo sapien
ggttagcaaacaccactgttttatg

SEQ ID NO: 555279 - DNA, 25 bp, Homo sapien
agcaaacaccactgttttatgcact

SEQ ID NO: 555280 - DNA, 25 bp, Homo sapien
tttatgcactgctaagaaagaataa

SEQ ID NO: 555281 - DNA, 25 bp, Homo sapien
aagaaagaataaagggctgtgtgca

SEQ ID NO: 555282 - DNA, 25 bp, Homo sapien
ggctcacacctgtgggacgccaagg

SEQ ID NO: 555283 - DNA, 25 bp, Homo sapien
tgaatgggcctggttgggagcagcc

SEQ ID NO: 555284 - DNA, 25 bp, Homo sapien
cacccatctcactatgcaattcgag

SEQ ID NO: 555285 - DNA, 25 bp, Homo sapien
atctcactatgcaattcgagttcca

SEQ ID NO: 555286 - DNA, 25 bp, Homo sapien
tcactatgcaattcgagttccaagc

SEQ ID NO: 555287 - DNA, 25 bp, Homo sapien
tgcaattcgagttccaagcaacatt

SEQ ID NO: 555288 - DNA, 25 bp, Homo sapien
aattcgagttccaagcaacatttgc

SEQ ID NO: 555289 - DNA, 25 bp, Homo sapien
gagttccaagcaacatttgctcctg

SEQ ID NO: 555290 - DNA, 25 bp, Homo sapien
gttccaagcaacatttgctcctgcc

SEQ ID NO: 555291 - DNA, 25 bp, Homo sapien
tctcctgtgggatctttgttttgtg

SEQ ID NO: 555292 - DNA, 25 bp, Homo sapien
ctcctgtgggatctttgttttgtgt

SEQ ID NO: 555293 - DNA, 25 bp, Homo sapien
ccataatggttgtgtactgaaccac

SEQ ID NO: 555294 - DNA, 25 bp, Homo sapien
tcggccaagggaacaaccccggctg

SEQ ID NO: 555295 - DNA, 25 bp, Homo sapien
gagacgacgtcctccattttgtcgg

SEQ ID NO: 555296 - DNA, 25 bp, Homo sapien
ccaagggaacaaccccggctgctgg

SEQ ID NO: 555297 - DNA, 25 bp, Homo sapien
ggctgctggcgtctgcgtccgcggg

SEQ ID NO: 555298 - DNA, 25 bp, Homo sapien
gacgacgtcctccattttgtcggaa

SEQ ID NO: 555299 - DNA, 25 bp, Homo sapien
gacgtcctccattttgtcggaacga

SEQ ID NO: 555300 - DNA, 25 bp, Homo sapien
acgacggtggagagacccagacgca

SEQ ID NO: 555301 - DNA, 25 bp, Homo sapien
gtcctccattttgtcggaacgactg

SEQ ID NO: 555302 - DNA, 25 bp, Homo sapien
cctccattttgtcggaacgactgtg

SEQ ID NO: 555303 - DNA, 25 bp, Homo sapien
tttgtcggaacgactgtgggaactt

SEQ ID NO: 555304 - DNA, 25 bp, Homo sapien
acttgtcctcggaagccccaactgg

SEQ ID NO: 555305 - DNA, 25 bp, Homo sapien
agagcacctccttacgtggcagcta

SEQ ID NO: 555306 - DNA, 25 bp, Homo sapien
gcagctacaacagcctacacgatgg

SEQ ID NO: 555307 - DNA, 25 bp, Homo sapien
aagttatctggacacgttggcggat

SEQ ID NO: 555308 - DNA, 25 bp, Homo sapien
gttggcggatgatgtcccaggccat

SEQ ID NO: 555309 - DNA, 25 bp, Homo sapien
gacttggaccaattcagtgacagct

SEQ ID NO: 555310 - DNA, 25 bp, Homo sapien
tcagtgacagctccctcatagagga

SEQ ID NO: 555311 - DNA, 25 bp, Homo sapien
ggactcacaggcactacacaagcgt

SEQ ID NO: 555312 - DNA, 25 bp, Homo sapien
gattctgaatactactgctttggct

SEQ ID NO: 555313 - DNA, 25 bp, Homo sapien
catgggactggtgtgcaatgaactt

SEQ ID NO: 555314 - DNA, 25 bp, Homo sapien
aacttgtatttatccttcttctccg

SEQ ID NO: 555315 - DNA, 25 bp, Homo sapien
tcttctccgctgctatatttttggt

SEQ ID NO: 555316 - DNA, 25 bp, Homo sapien
gggtctgagacccaaaggcacagtt

SEQ ID NO: 555317 - DNA, 25 bp, Homo sapien
gacccaaaggcacagtttagaggat

SEQ ID NO: 555318 - DNA, 25 bp, Homo sapien
acgaacccagggagcatattgctgt

SEQ ID NO: 555319 - DNA, 25 bp, Homo sapien
gagcatattgctgtaaacgcttcaa

SEQ ID NO: 555320 - DNA, 25 bp, Homo sapien
cgcgaaccaacctggaaaccagcaa

SEQ ID NO: 555321 - DNA, 25 bp, Homo sapien
gaaagttcttaagtttgtggccaag

SEQ ID NO: 555322 - DNA, 25 bp, Homo sapien
aaggtccataatcaagaccccaagg

SEQ ID NO: 555323 - DNA, 25 bp, Homo sapien
aaggactggccagcgcagtactgtg

SEQ ID NO: 555324 - DNA, 25 bp, Homo sapien
agcgcagtactgtgaggctttggca

SEQ ID NO: 555325 - DNA, 25 bp, Homo sapien
gctccatcctcttgaaaggtggatt

SEQ ID NO: 555326 - DNA, 25 bp, Homo sapien
ttgaaaggtggattcagagggaccc

SEQ ID NO: 555327 - DNA, 25 bp, Homo sapien
agagaaactgctgtatactaggtgt

SEQ ID NO: 555328 - DNA, 25 bp, Homo sapien
actgctgtatactaggtgttatgaa

SEQ ID NO: 555329 - DNA, 25 bp, Homo sapien
agaccaatggagtaattcatcttaa

SEQ ID NO: 555330 - DNA, 25 bp, Homo sapien
tgcgaacctcactccatcctaagaa

SEQ ID NO: 555331 - DNA, 25 bp, Homo sapien
ctcactccatcctaagaacaatctt

SEQ ID NO: 555332 - DNA, 25 bp, Homo sapien
aatgtaagcaaatgaccttctcatt

SEQ ID NO: 555333 - DNA, 25 bp, Homo sapien
gaccttctcattttggttgccagaa

SEQ ID NO: 555334 - DNA, 25 bp, Homo sapien
tttggttgccagaatgctcagtttg

SEQ ID NO: 555335 - DNA, 25 bp, Homo sapien
atcctaagaacaatcttcgcatctg

SEQ ID NO: 555336 - DNA, 25 bp, Homo sapien
ttcgcatctgcctttctggactttc

SEQ ID NO: 555337 - DNA, 25 bp, Homo sapien
tctggactttctgctatgaactaaa

SEQ ID NO: 555338 - DNA, 25 bp, Homo sapien
gttcacctctgctgtaagttaattt

SEQ ID NO: 555339 - DNA, 25 bp, Homo sapien
cctctgctgtaagttaatttgggtt

SEQ ID NO: 555340 - DNA, 25 bp, Homo sapien
tttttgtttagggactgtagtggat

SEQ ID NO: 555341 - DNA, 25 bp, Homo sapien
tgtagtggattatggccaagcagca

SEQ ID NO: 555342 - DNA, 25 bp, Homo sapien
gattatggccaagcagcagtagcta

SEQ ID NO: 555343 - DNA, 25 bp, Homo sapien
gcagtagctagttaagtcttaatca

SEQ ID NO: 555344 - DNA, 25 bp, Homo sapien
gttaagtcttaatcatgaaggtagt

SEQ ID NO: 555345 - DNA, 25 bp, Homo sapien
taaaattattatgcccttttcactc

SEQ ID NO: 555346 - DNA, 25 bp, Homo sapien
ttattatgcccttttcactcatttc

SEQ ID NO: 555347 - DNA, 25 bp, Homo sapien
tttcactcatttcataatatgtttg

SEQ ID NO: 555348 - DNA, 25 bp, Homo sapien
aaacaagctgggttatgttggcaca

SEQ ID NO: 555349 - DNA, 25 bp, Homo sapien
gattaggtcaaaatggaacagcgat

SEQ ID NO: 555350 - DNA, 25 bp, Homo sapien
ggtcaaaatggaacagcgattactt

SEQ ID NO: 555351 - DNA, 25 bp, Homo sapien
aaatggaacagcgattactttcatc

SEQ ID NO: 555352 - DNA, 25 bp, Homo sapien
atggaacagcgattactttcatcaa

SEQ ID NO: 555353 - DNA, 25 bp, Homo sapien
ataataattcaaaaagactcttctg

SEQ ID NO: 555354 - DNA, 25 bp, Homo sapien
aaaagactcttctgggatattgcaa

SEQ ID NO: 555355 - DNA, 25 bp, Homo sapien
aaagactcttctgggatattgcaaa

SEQ ID NO: 555356 - DNA, 25 bp, Homo sapien
gactcttctgggatattgcaaaacg

SEQ ID NO: 555357 - DNA, 25 bp, Homo sapien
actcttctgggatattgcaaaacga

SEQ ID NO: 555358 - DNA, 25 bp, Homo sapien
tcttctgggatattgcaaaacgagt

SEQ ID NO: 555359 - DNA, 25 bp, Homo sapien
tctgggatattgcaaaacgagtaaa

SEQ ID NO: 555360 - DNA, 25 bp, Homo sapien
aggtttaaacagagccaatccaagg

SEQ ID NO: 555361 - DNA, 25 bp, Homo sapien
gaaggtcacctccatataagagtgt

SEQ ID NO: 555362 - DNA, 25 bp, Homo sapien
gagtgtattggtcatggcatcttca

SEQ ID NO: 555363 - DNA, 25 bp, Homo sapien
ggcatcttcaatgtcctttgtctta

SEQ ID NO: 555364 - DNA, 25 bp, Homo sapien
attttttggcagtaagtcttccaga

SEQ ID NO: 555365 - DNA, 25 bp, Homo sapien
gtcttccagaaatcattcctttgtc

SEQ ID NO: 555366 - DNA, 25 bp, Homo sapien
tttttatgctcattgatcactccaa

SEQ ID NO: 555367 - DNA, 25 bp, Homo sapien
gatcactccaataattctttgctct

SEQ ID NO: 555368 - DNA, 25 bp, Homo sapien
aattctttgctctagtttgttatta

SEQ ID NO: 555369 - DNA, 25 bp, Homo sapien
gatttatccagatttgcaggaccac

SEQ ID NO: 555370 - DNA, 25 bp, Homo sapien
ttgcaggaccactagaatcatttgt

SEQ ID NO: 555371 - DNA, 25 bp, Homo sapien
ttgctgccttggctttctgacccct

SEQ ID NO: 555372 - DNA, 25 bp, Homo sapien
ttctgaccccttccaggcttcaggg

SEQ ID NO: 555373 - DNA, 25 bp, Homo sapien
gggcctgggagatctcatgcctcag

SEQ ID NO: 555374 - DNA, 25 bp, Homo sapien
agcagagacatgtcatgtcagcccc

SEQ ID NO: 555375 - DNA, 25 bp, Homo sapien
agaatttctagagcacttgtcctgt

SEQ ID NO: 555376 - DNA, 25 bp, Homo sapien
ctagagcacttgtcctgttgttcct

SEQ ID NO: 555377 - DNA, 25 bp, Homo sapien
gacattactcagtctgggccatgga

SEQ ID NO: 555378 - DNA, 25 bp, Homo sapien
ggaatccatccaataaacacagcaa

SEQ ID NO: 555379 - DNA, 25 bp, Homo sapien
ggacagatgtgggtcactttccctg

SEQ ID NO: 555380 - DNA, 25 bp, Homo sapien
atgtgggtcactttccctggcagtg

SEQ ID NO: 555381 - DNA, 25 bp, Homo sapien
ctggcagtgccctctagccttgctg

SEQ ID NO: 555382 - DNA, 25 bp, Homo sapien
ctcttaataacctgagatttctatg

SEQ ID NO: 555383 - DNA, 25 bp, Homo sapien
gagatttctatggtttgactccagg

SEQ ID NO: 555384 - DNA, 25 bp, Homo sapien
ttctatggtttgactccaggatcaa

SEQ ID NO: 555385 - DNA, 25 bp, Homo sapien
ccaggatcaaaacacaagggacttt

SEQ ID NO: 555386 - DNA, 25 bp, Homo sapien
agggactttgtattatttcacttat

SEQ ID NO: 555387 - DNA, 25 bp, Homo sapien
atgtttaaggttgcttcccgctcat

SEQ ID NO: 555388 - DNA, 25 bp, Homo sapien
gttgcttcccgctcataaatacata

SEQ ID NO: 555389 - DNA, 25 bp, Homo sapien
gcttcccgctcataaatacataata

SEQ ID NO: 555390 - DNA, 25 bp, Homo sapien
tgtgtttattaaccgattctccata

SEQ ID NO: 555391 - DNA, 25 bp, Homo sapien
tcatctgttgtatttagagaaccat

SEQ ID NO: 555392 - DNA, 25 bp, Homo sapien
gagaaccatattcattgcatgcaaa

SEQ ID NO: 555393 - DNA, 25 bp, Homo sapien
aaaacagctacatacaacctagtac

SEQ ID NO: 555394 - DNA, 25 bp, Homo sapien
tacaacctagtacacttgaagtcag

SEQ ID NO: 555395 - DNA, 25 bp, Homo sapien
gtacacttgaagtcagacagacatt

SEQ ID NO: 555396 - DNA, 25 bp, Homo sapien
gacagacatttcagttgcttacctc

SEQ ID NO: 555397 - DNA, 25 bp, Homo sapien
acatttcagttgcttacctccagta

SEQ ID NO: 555398 - DNA, 25 bp, Homo sapien
agttgcttacctccagtactgagcc

SEQ ID NO: 555399 - DNA, 25 bp, Homo sapien
ttacctccagtactgagccttgctt

SEQ ID NO: 555400 - DNA, 25 bp, Homo sapien
cagtactgagccttgctttgggaaa

SEQ ID NO: 555401 - DNA, 25 bp, Homo sapien
aagatttagaccaagtcactgccag

SEQ ID NO: 555402 - DNA, 25 bp, Homo sapien
ttagaccaagtcactgccagttttt

SEQ ID NO: 555403 - DNA, 25 bp, Homo sapien
gtcactgccagtttttgcctttgtt

SEQ ID NO: 555404 - DNA, 25 bp, Homo sapien
atatcgtacttgatgaaatccatga

SEQ ID NO: 555405 - DNA, 25 bp, Homo sapien
atccatgaaagaaatctgcagtcag

SEQ ID NO: 555406 - DNA, 25 bp, Homo sapien
atctgcagtcagatgttttaatgac

SEQ ID NO: 555407 - DNA, 25 bp, Homo sapien
actgttgttaaagaccttctcaatt

SEQ ID NO: 555408 - DNA, 25 bp, Homo sapien
gaccttctcaattttcgatctgact

SEQ ID NO: 555409 - DNA, 25 bp, Homo sapien
caattttcgatctgacttgaaagta

SEQ ID NO: 555410 - DNA, 25 bp, Homo sapien
tattgatgagtgcaacattgaatgc

SEQ ID NO: 555411 - DNA, 25 bp, Homo sapien
cagaatattttggtaactgtccaat

SEQ ID NO: 555412 - DNA, 25 bp, Homo sapien
aactgtccaatgatacatatacctg

SEQ ID NO: 555413 - DNA, 25 bp, Homo sapien
gatacatatacctggttttaccttt

SEQ ID NO: 555414 - DNA, 25 bp, Homo sapien
ttacctttccggttgtggaatatct

SEQ ID NO: 555415 - DNA, 25 bp, Homo sapien
ataaaatggtggactatttgcatat

SEQ ID NO: 555416 - DNA, 25 bp, Homo sapien
gcatataacctgtgtacatcccgta

SEQ ID NO: 555417 - DNA, 25 bp, Homo sapien
taacctgtgtacatcccgtattatt

SEQ ID NO: 555418 - DNA, 25 bp, Homo sapien
gtacatcccgtattatttaaatcat

SEQ ID NO: 555419 - DNA, 25 bp, Homo sapien
ccgtattatttaaatcatccctaga

SEQ ID NO: 555420 - DNA, 25 bp, Homo sapien
catccctagatcacttataatacgt

SEQ ID NO: 555421 - DNA, 25 bp, Homo sapien
gtgtgtggaatattttcattccaag

SEQ ID NO: 555422 - DNA, 25 bp, Homo sapien
ttcattccaaggtcagttgaaccca

SEQ ID NO: 555423 - DNA, 25 bp, Homo sapien
attccaaggtcagttgaacccatgg

SEQ ID NO: 555424 - DNA, 25 bp, Homo sapien
aggtcagttgaacccatggacatag

SEQ ID NO: 555425 - DNA, 25 bp, Homo sapien
catggacataggaggctgactgtgt

SEQ ID NO: 555426 - DNA, 25 bp, Homo sapien
ctgagatggagctgagactttattt

SEQ ID NO: 555427 - DNA, 25 bp, Homo sapien
gagatggagctgagactttatttat

SEQ ID NO: 555428 - DNA, 25 bp, Homo sapien
aggaggtccctccaacatgtttgga

SEQ ID NO: 555429 - DNA, 25 bp, Homo sapien
gtccctccaacatgtttggacccag

SEQ ID NO: 555430 - DNA, 25 bp, Homo sapien
ccaacatgtttggacccagctcctt

SEQ ID NO: 555431 - DNA, 25 bp, Homo sapien
ctgcccagaaccaagtgccatttct

SEQ ID NO: 555432 - DNA, 25 bp, Homo sapien
aagtgccatttctcactctggagcc

SEQ ID NO: 555433 - DNA, 25 bp, Homo sapien
tgccatttctcactctggagcctta

SEQ ID NO: 555434 - DNA, 25 bp, Homo sapien
catttctcactctggagccttaata

SEQ ID NO: 555435 - DNA, 25 bp, Homo sapien
cactctggagccttaataaactgca

SEQ ID NO: 555436 - DNA, 25 bp, Homo sapien
ggagccttaataaactgcaatttgt

SEQ ID NO: 555437 - DNA, 25 bp, Homo sapien
tttcattccaaggtcagttgaaccc

SEQ ID NO: 555438 - DNA, 25 bp, Homo sapien
ttcattccaaggtcagttgaaccca

SEQ ID NO: 555439 - DNA, 25 bp, Homo sapien
tcattccaaggtcagttgaacccat

SEQ ID NO: 555440 - DNA, 25 bp, Homo sapien
cattccaaggtcagttgaacccatg

SEQ ID NO: 555441 - DNA, 25 bp, Homo sapien
attccaaggtcagttgaacccatgg

SEQ ID NO: 555442 - DNA, 25 bp, Homo sapien
ttccaaggtcagttgaacccatgga

SEQ ID NO: 555443 - DNA, 25 bp, Homo sapien
ccaaggtcagttgaacccatggaca

SEQ ID NO: 555444 - DNA, 25 bp, Homo sapien
caaggtcagttgaacccatggacat

SEQ ID NO: 555445 - DNA, 25 bp, Homo sapien
aaggtcagttgaacccatggacata

SEQ ID NO: 555446 - DNA, 25 bp, Homo sapien
aggtcagttgaacccatggacatag

SEQ ID NO: 555447 - DNA, 25 bp, Homo sapien
ggtcagttgaacccatggacatagg

SEQ ID NO: 555448 - DNA, 25 bp, Homo sapien
gagacagcaatggagcaggacatag

SEQ ID NO: 555449 - DNA, 25 bp, Homo sapien
ggacatagacagtagcacggaggat

SEQ ID NO: 555450 - DNA, 25 bp, Homo sapien
gaggatggaactgaacccagccctt

SEQ ID NO: 555451 - DNA, 25 bp, Homo sapien
agagctctgctgaacggtcctagtg

SEQ ID NO: 555452 - DNA, 25 bp, Homo sapien
gaacggtcctagtgtttggacacaa

SEQ ID NO: 555453 - DNA, 25 bp, Homo sapien
gtgtttggacacaatagtgcacttt

SEQ ID NO: 555454 - DNA, 25 bp, Homo sapien
agtgcactttaaaacctgcttggtt

SEQ ID NO: 555455 - DNA, 25 bp, Homo sapien
gcttggttaccaagtgtccagggaa

SEQ ID NO: 555456 - DNA, 25 bp, Homo sapien
ccagggaaacccttgtattttgatg

SEQ ID NO: 555457 - DNA, 25 bp, Homo sapien
aaagagcactttgcccgtacttagg

SEQ ID NO: 555458 - DNA, 25 bp, Homo sapien
tacttaggctgtggaccctaaaaca

SEQ ID NO: 555459 - DNA, 25 bp, Homo sapien
aggtgaatgtcattggcattggcac

SEQ ID NO: 555460 - DNA, 25 bp, Homo sapien
agccttccctgggtggcgtctataa

SEQ ID NO: 555461 - DNA, 25 bp, Homo sapien
tccctgggtggcgtctataagctgg

SEQ ID NO: 555462 - DNA, 25 bp, Homo sapien
gggccagccacgaatgaagctgacc

SEQ ID NO: 555463 - DNA, 25 bp, Homo sapien
tgaagctgaccgaggaccccgagaa

SEQ ID NO: 555464 - DNA, 25 bp, Homo sapien
accccgagaagcagacgttgcctgg

SEQ ID NO: 555465 - DNA, 25 bp, Homo sapien
agaagcagacgttgcctgggagcaa

SEQ ID NO: 555466 - DNA, 25 bp, Homo sapien
tgggagcaaggctgctttccggctc

SEQ ID NO: 555467 - DNA, 25 bp, Homo sapien
tttccggctcctgggctctgacggg

SEQ ID NO: 555468 - DNA, 25 bp, Homo sapien
tctgacgggtctccactcatggaca

SEQ ID NO: 555469 - DNA, 25 bp, Homo sapien
tccactcatggacatgctgcagtta

SEQ ID NO: 555470 - DNA, 25 bp, Homo sapien
agagttgacatttataaccatggaa

SEQ ID NO: 555471 - DNA, 25 bp, Homo sapien
aaccatggaagctgttattttacat

SEQ ID NO: 555472 - DNA, 25 bp, Homo sapien
atcatcttcaaaccatatcagcctt

SEQ ID NO: 555473 - DNA, 25 bp, Homo sapien
accatatcagccttaaacacattta

SEQ ID NO: 555474 - DNA, 25 bp, Homo sapien
gtagattagatttgcttttaagcta

SEQ ID NO: 555475 - DNA, 25 bp, Homo sapien
gcttttaagctaggcatatcattac

SEQ ID NO: 555476 - DNA, 25 bp, Homo sapien
atatcattacagtgcgtgtttccgt

SEQ ID NO: 555477 - DNA, 25 bp, Homo sapien
ttacagtgcgtgtttccgtcagaag

SEQ ID NO: 555478 - DNA, 25 bp, Homo sapien
gtttccgtcagaagggcatgctcac

SEQ ID NO: 555479 - DNA, 25 bp, Homo sapien
aagggcatgctcacgattaaatact

SEQ ID NO: 555480 - DNA, 25 bp, Homo sapien
gctcacgattaaatactgtcttcag

SEQ ID NO: 555481 - DNA, 25 bp, Homo sapien
ctttttaccatccttgtgtttgtca

SEQ ID NO: 555482 - DNA, 25 bp, Homo sapien
accatccttgtgtttgtcatttaaa

SEQ ID NO: 555483 - DNA, 25 bp, Homo sapien
gggcatgacgtgtattcctaggact

SEQ ID NO: 555484 - DNA, 25 bp, Homo sapien
tgacgtgtattcctaggactgagcc

SEQ ID NO: 555485 - DNA, 25 bp, Homo sapien
tgatgctttctccatttactgtcac

SEQ ID NO: 555486 - DNA, 25 bp, Homo sapien
ttactgtcacaattggattgcactg

SEQ ID NO: 555487 - DNA, 25 bp, Homo sapien
acaattggattgcactgtaggacac

SEQ ID NO: 555488 - DNA, 25 bp, Homo sapien
agctggtacccaagatttggtctgt

SEQ ID NO: 555489 - DNA, 25 bp, Homo sapien
ttctgcccagaaagtggaagcgctt

SEQ ID NO: 555490 - DNA, 25 bp, Homo sapien
ggaagcgcttcccttaaggcaagag

SEQ ID NO: 555491 - DNA, 25 bp, Homo sapien
tgtatgttcccttcagctaagctct

SEQ ID NO: 555492 - DNA, 25 bp, Homo sapien
atgtctaattttcttggctagtctt

SEQ ID NO: 555493 - DNA, 25 bp, Homo sapien
ggctagtctttcaaggaccagattc

SEQ ID NO: 555494 - DNA, 25 bp, Homo sapien
gtctttcaaggaccagattcatgag

SEQ ID NO: 555495 - DNA, 25 bp, Homo sapien
ggaccagattcatgagtgttatttg

SEQ ID NO: 555496 - DNA, 25 bp, Homo sapien
ttttgagtgatgtgctcctgagctt

SEQ ID NO: 555497 - DNA, 25 bp, Homo sapien
tgatgtgctcctgagcttgttctta

SEQ ID NO: 555498 - DNA, 25 bp, Homo sapien
gctcctgagcttgttcttaaaatct

SEQ ID NO: 555499 - DNA, 25 bp, Homo sapien
ctaccagtggtagcttttggaaaga

SEQ ID NO: 555500 - DNA, 25 bp, Homo sapien
gaatgtgtttcataccgatgtgcag

SEQ ID NO: 555501 - DNA, 25 bp, Homo sapien
gtttcataccgatgtgcaggcctca

SEQ ID NO: 555502 - DNA, 25 bp, Homo sapien
agcttcaagaggagtttgtgaaact

SEQ ID NO: 555503 - DNA, 25 bp, Homo sapien
agaatccgcatgtttccccagtgat

SEQ ID NO: 555504 - DNA, 25 bp, Homo sapien
gcatgtttccccagtgattacactc

SEQ ID NO: 555505 - DNA, 25 bp, Homo sapien
attacactccactgccaccgtggtg

SEQ ID NO: 555506 - DNA, 25 bp, Homo sapien
cgtggtgcctggctttaactcccac

SEQ ID NO: 555507 - DNA, 25 bp, Homo sapien
tgctatgactcctctctgcagagac

SEQ ID NO: 555508 - DNA, 25 bp, Homo sapien
atgactcctctctgcagagacgcga

SEQ ID NO: 555509 - DNA, 25 bp, Homo sapien
agagacgcgactggcggctccagca

SEQ ID NO: 555510 - DNA, 25 bp, Homo sapien
tccagcagggactacctttcttata

SEQ ID NO: 555511 - DNA, 25 bp, Homo sapien
agtgcgttctgtgatcgccaagttc

SEQ ID NO: 555512 - DNA, 25 bp, Homo sapien
gccaagttcaaagctgtgcacatgt

SEQ ID NO: 555513 - DNA, 25 bp, Homo sapien
tgcacatgtggacactcaataaatg

SEQ ID NO: 555514 - DNA, 25 bp, Homo sapien
gcaagatttcattctacttggtgat

SEQ ID NO: 555515 - DNA, 25 bp, Homo sapien
gaatcatgacagtcctcattccaat

SEQ ID NO: 555516 - DNA, 25 bp, Homo sapien
attccaatctctctttaattctctc

SEQ ID NO: 555517 - DNA, 25 bp, Homo sapien
ccctgcccacactctgtatttgaaa

SEQ ID NO: 555518 - DNA, 25 bp, Homo sapien
gtttttgctctttccggagcttcac

SEQ ID NO: 555519 - DNA, 25 bp, Homo sapien
ttcacccctctacttacatattgta

SEQ ID NO: 555520 - DNA, 25 bp, Homo sapien
atctatcattgaaaggtcctctctg

SEQ ID NO: 555521 - DNA, 25 bp, Homo sapien
aaaggtcctctctgccagcagtggt

SEQ ID NO: 555522 - DNA, 25 bp, Homo sapien
agtggtgccaccctttggtttgctg

SEQ ID NO: 555523 - DNA, 25 bp, Homo sapien
ttgctgtggtactttgctgtgtact

SEQ ID NO: 555524 - DNA, 25 bp, Homo sapien
tactccgtggcatcatgttactgtg

SEQ ID NO: 555525 - DNA, 25 bp, Homo sapien
ttaacagccactatatcccttgagg

SEQ ID NO: 555526 - DNA, 25 bp, Homo sapien
gccactatatcccttgaggcaagtg

SEQ ID NO: 555527 - DNA, 25 bp, Homo sapien
ttgaggcaagtgaagggccccagaa

SEQ ID NO: 555528 - DNA, 25 bp, Homo sapien
ggccccagaagtgagggatcttatt

SEQ ID NO: 555529 - DNA, 25 bp, Homo sapien
tagtatggtctctcccatcaggagg

SEQ ID NO: 555530 - DNA, 25 bp, Homo sapien
ttgctaagtagatcagacagagttc

SEQ ID NO: 555531 - DNA, 25 bp, Homo sapien
atatgttgcctgtattgtctcatct

SEQ ID NO: 555532 - DNA, 25 bp, Homo sapien
aaatagcactcatatcttgggttat

SEQ ID NO: 555533 - DNA, 25 bp, Homo sapien
ggcaaatattgcatgggacctggca

SEQ ID NO: 555534 - DNA, 25 bp, Homo sapien
catgggacctggcaataagattgaa

SEQ ID NO: 555535 - DNA, 25 bp, Homo sapien
aagcaaagtctgatcgcatccttat

SEQ ID NO: 555536 - DNA, 25 bp, Homo sapien
cctgtgctatctgggtgtatataca

SEQ ID NO: 555537 - DNA, 25 bp, Homo sapien
gtgctatctgggtgtatatacaaat

SEQ ID NO: 555538 - DNA, 25 bp, Homo sapien
aaaatccaaatactaatgtgcatat

SEQ ID NO: 555539 - DNA, 25 bp, Homo sapien
aatgagtcagactacatatttggta

SEQ ID NO: 555540 - DNA, 25 bp, Homo sapien
agccagatttttttcactcagtgat

SEQ ID NO: 555541 - DNA, 25 bp, Homo sapien
tttcactcagtgatatatcatgaac

SEQ ID NO: 555542 - DNA, 25 bp, Homo sapien
gaacatatttccatgctaatataat

SEQ ID NO: 555543 - DNA, 25 bp, Homo sapien
aataattttagatgctgtaactaca

SEQ ID NO: 555544 - DNA, 25 bp, Homo sapien
agatgctgtaactacaatttcattg

SEQ ID NO: 555545 - DNA, 25 bp, Homo sapien
tacaatttcattgttaatgggcaat

SEQ ID NO: 555546 - DNA, 25 bp, Homo sapien
gttaatgggcaatttgttgctttac

SEQ ID NO: 555547 - DNA, 25 bp, Homo sapien
tggtcagattccaaagtcctttctt

SEQ ID NO: 555548 - DNA, 25 bp, Homo sapien
atactgttgtggacaatctcagctg

SEQ ID NO: 555549 - DNA, 25 bp, Homo sapien
aatctcagctgggtcaataagggca

SEQ ID NO: 555550 - DNA, 25 bp, Homo sapien
gaatctttagggtaattcctccagt

SEQ ID NO: 555551 - DNA, 25 bp, Homo sapien
taattcctccagtgacctgtcaagg

SEQ ID NO: 555552 - DNA, 25 bp, Homo sapien
gtgacctgtcaaggcttatgctaac

SEQ ID NO: 555553 - DNA, 25 bp, Homo sapien
aggcttatgctaacaggagacttgc

SEQ ID NO: 555554 - DNA, 25 bp, Homo sapien
gagacttgcaggagaccgtgtgatt

SEQ ID NO: 555555 - DNA, 25 bp, Homo sapien
ccgtgtgatttgtgtagtgagcctt

SEQ ID NO: 555556 - DNA, 25 bp, Homo sapien
gagcctttgaaaatggttagtaccg

SEQ ID NO: 555557 - DNA, 25 bp, Homo sapien
agctgtgtgcttaatttactctgtt

SEQ ID NO: 555558 - DNA, 25 bp, Homo sapien
agctggtcctgttgtgaactcatct

SEQ ID NO: 555559 - DNA, 25 bp, Homo sapien
tccagttacccctattgtactgtat

SEQ ID NO: 555560 - DNA, 25 bp, Homo sapien
atccttgtgaaagggcatgctccat

SEQ ID NO: 555561 - DNA, 25 bp, Homo sapien
gcatgctccatgtgggatggctcgt

SEQ ID NO: 555562 - DNA, 25 bp, Homo sapien
gggatggctcgtgtacagcataaat

SEQ ID NO: 555563 - DNA, 25 bp, Homo sapien
acagcataaatctatcaaacttgga

SEQ ID NO: 555564 - DNA, 25 bp, Homo sapien
gtactgtatatacgtgtgctgccat

SEQ ID NO: 555565 - DNA, 25 bp, Homo sapien
acgtgtgctgccatgtgtaaattct

SEQ ID NO: 555566 - DNA, 25 bp, Homo sapien
tgctgccatgtgtaaattctgtttc

SEQ ID NO: 555567 - DNA, 25 bp, Homo sapien
gtttcaggttttggagttttcatct

SEQ ID NO: 555568 - DNA, 25 bp, Homo sapien
ttcatcttaagtacagctggtcctg

SEQ ID NO: 555569 - DNA, 25 bp, Homo sapien
gaaagcccagccaaaatgaggtgtg

SEQ ID NO: 555570 - DNA, 25 bp, Homo sapien
gcccagccaaaatgaggtgtgaatt

SEQ ID NO: 555571 - DNA, 25 bp, Homo sapien
aggtgtgaatttgtcatactgttac

SEQ ID NO: 555572 - DNA, 25 bp, Homo sapien
tgtgaatttgtcatactgttacatt

SEQ ID NO: 555573 - DNA, 25 bp, Homo sapien
aacaaaatatatcccctcccatttg

SEQ ID NO: 555574 - DNA, 25 bp, Homo sapien
ttcttttgaaagaatggccttttag

SEQ ID NO: 555575 - DNA, 25 bp, Homo sapien
agttgtatagccaaagacatttagt

SEQ ID NO: 555576 - DNA, 25 bp, Homo sapien
atagccaaagacatttagtattttc

SEQ ID NO: 555577 - DNA, 25 bp, Homo sapien
ccttctgaagcagccacaacttaga

SEQ ID NO: 555578 - DNA, 25 bp, Homo sapien
gaagcagccacaacttagataatgt

SEQ ID NO: 555579 - DNA, 25 bp, Homo sapien
gccacaacttagataatgtcagaac

SEQ ID NO: 555580 - DNA, 25 bp, Homo sapien
agcgtctgacgggaagcctgatctg

SEQ ID NO: 555581 - DNA, 25 bp, Homo sapien
gcctgatctggaaccttcccaagga

SEQ ID NO: 555582 - DNA, 25 bp, Homo sapien
atctggaaccttcccaaggactcag

SEQ ID NO: 555583 - DNA, 25 bp, Homo sapien
aggactcaggcaagcctttgtggct

SEQ ID NO: 555584 - DNA, 25 bp, Homo sapien
agcctttgtggctggatcatgagag

SEQ ID NO: 555585 - DNA, 25 bp, Homo sapien
agggactccatcttgagccatgtcc

SEQ ID NO: 555586 - DNA, 25 bp, Homo sapien
ggctttcttcagtcccttggtcaga

SEQ ID NO: 555587 - DNA, 25 bp, Homo sapien
cttggtcagaccataaactgcattt

SEQ ID NO: 555588 - DNA, 25 bp, Homo sapien
cataaactgcatttttgattctttg

SEQ ID NO: 555589 - DNA, 25 bp, Homo sapien
gattcaaaccctaggatccatcagt

SEQ ID NO: 555590 - DNA, 25 bp, Homo sapien
gatccatcagtcttgcaaggacatt

SEQ ID NO: 555591 - DNA, 25 bp, Homo sapien
tcacagctgttggagggaagtagcc

SEQ ID NO: 555592 - DNA, 25 bp, Homo sapien
ggaagtagcctcttgcagggaaata

SEQ ID NO: 555593 - DNA, 25 bp, Homo sapien
tggaatctcctatgtgcctgttaaa

SEQ ID NO: 555594 - DNA, 25 bp, Homo sapien
gtgcctgttaaagattccagggcca

SEQ ID NO: 555595 - DNA, 25 bp, Homo sapien
tccagggccaagaactcggcaggct

SEQ ID NO: 555596 - DNA, 25 bp, Homo sapien
gggttatgcggttcaggactgcttc

SEQ ID NO: 555597 - DNA, 25 bp, Homo sapien
gaagggactgcctgtacttctgtac

SEQ ID NO: 555598 - DNA, 25 bp, Homo sapien
tacttctgtaccaccgttgcccttt

SEQ ID NO: 555599 - DNA, 25 bp, Homo sapien
gttgccctttacactttgctcaggg

SEQ ID NO: 555600 - DNA, 25 bp, Homo sapien
ggaagggaactgtctggcaaagcat

SEQ ID NO: 555601 - DNA, 25 bp, Homo sapien
agtggatgcatccagagctcagtcc

SEQ ID NO: 555602 - DNA, 25 bp, Homo sapien
tagaagcccccatggcttctggcag

SEQ ID NO: 555603 - DNA, 25 bp, Homo sapien
ctggcagctggacatcagccccagg

SEQ ID NO: 555604 - DNA, 25 bp, Homo sapien
tgtcccactgttacacgcatgaatg

SEQ ID NO: 555605 - DNA, 25 bp, Homo sapien
gactcagggctggaccgacgtccta

SEQ ID NO: 555606 - DNA, 25 bp, Homo sapien
tggaccgacgtcctagtggacctga

SEQ ID NO: 555607 - DNA, 25 bp, Homo sapien
gacgtcctagtggacctgatgtgaa

SEQ ID NO: 555608 - DNA, 25 bp, Homo sapien
ggacctgatgtgaaattcctgtcaa

SEQ ID NO: 555609 - DNA, 25 bp, Homo sapien
gatgtgaaattcctgtcaaacaaac

SEQ ID NO: 555610 - DNA, 25 bp, Homo sapien
cctgtcaaacaaacaccacttttca

SEQ ID NO: 555611 - DNA, 25 bp, Homo sapien
caaacaccacttttcaatggtttgc

SEQ ID NO: 555612 - DNA, 25 bp, Homo sapien
tcaatggtttgctaggagtatttct

SEQ ID NO: 555613 - DNA, 25 bp, Homo sapien
ccatccacaaaaatttatctttaag

SEQ ID NO: 555614 - DNA, 25 bp, Homo sapien
tgctactttaatgttctgacatttg

SEQ ID NO: 555615 - DNA, 25 bp, Homo sapien
gaaaacactattatccatcaaactt

SEQ ID NO: 555616 - DNA, 25 bp, Homo sapien
acatttgtgattatttgccagtctt

SEQ ID NO: 555617 - DNA, 25 bp, Homo sapien
gtgattatttgccagtctttacttt

SEQ ID NO: 555618 - DNA, 25 bp, Homo sapien
gattatttgccagtctttacttttt

SEQ ID NO: 555619 - DNA, 25 bp, Homo sapien
tacttattaaggtttctctatgtaa

SEQ ID NO: 555620 - DNA, 25 bp, Homo sapien
aaacttaaaagcatttggacctgat

SEQ ID NO: 555621 - DNA, 25 bp, Homo sapien
gcatttggacctgatatttaaagat

SEQ ID NO: 555622 - DNA, 25 bp, Homo sapien
tgaagttttccacatattgaagtat

SEQ ID NO: 555623 - DNA, 25 bp, Homo sapien
tattgaagtattcaagacatcttcc

SEQ ID NO: 555624 - DNA, 25 bp, Homo sapien
acacgttctcagacacacacaagag

SEQ ID NO: 555625 - DNA, 25 bp, Homo sapien
gacacacacaagagtgcttgccggt

SEQ ID NO: 555626 - DNA, 25 bp, Homo sapien
acaagagtgcttgccggttatacca

SEQ ID NO: 555627 - DNA, 25 bp, Homo sapien
gtgcttgccggttataccaaaccct

SEQ ID NO: 555628 - DNA, 25 bp, Homo sapien
tataccaaaccctactattactgcc

SEQ ID NO: 555629 - DNA, 25 bp, Homo sapien
aaaccctactattactgcctgcaga

SEQ ID NO: 555630 - DNA, 25 bp, Homo sapien
accctactattactgcctgcagaaa

SEQ ID NO: 555631 - DNA, 25 bp, Homo sapien
tttttctgacatttggtcctgcttg

SEQ ID NO: 555632 - DNA, 25 bp, Homo sapien
ctgacatttggtcctgcttgaaaca

SEQ ID NO: 555633 - DNA, 25 bp, Homo sapien
catttggtcctgcttgaaacaacaa

SEQ ID NO: 555634 - DNA, 25 bp, Homo sapien
ggtcctgcttgaaacaacaaaagaa

SEQ ID NO: 555635 - DNA, 25 bp, Homo sapien
gctatatagaggcatttattggtaa

SEQ ID NO: 555636 - DNA, 25 bp, Homo sapien
gtaaattataatcagcagttgcacc

SEQ ID NO: 555637 - DNA, 25 bp, Homo sapien
tcagcagttgcaccatggaagtatt

SEQ ID NO: 555638 - DNA, 25 bp, Homo sapien
gtgtgtctgaagagtatcacttata

SEQ ID NO: 555639 - DNA, 25 bp, Homo sapien
gagtatcacttatatgcagtgcata

SEQ ID NO: 555640 - DNA, 25 bp, Homo sapien
tatgcagtgcatatacatgtaagtg

SEQ ID NO: 555641 - DNA, 25 bp, Homo sapien
atgtaagtgcattactttgctcaaa

SEQ ID NO: 555642 - DNA, 25 bp, Homo sapien
aaatatcttctgacctattacagtc

SEQ ID NO: 555643 - DNA, 25 bp, Homo sapien
ctattacagtcaactcatgcatgag

SEQ ID NO: 555644 - DNA, 25 bp, Homo sapien
tgtattacagaaggtcttacagcct

SEQ ID NO: 555645 - DNA, 25 bp, Homo sapien
ggtcttacagccttagtttctgttt

SEQ ID NO: 555646 - DNA, 25 bp, Homo sapien
atagtccatactgagtgtcatcaac

SEQ ID NO: 555647 - DNA, 25 bp, Homo sapien
gtccatactgagtgtcatcaacaat

SEQ ID NO: 555648 - DNA, 25 bp, Homo sapien
ccatactgagtgtcatcaacaatcc

SEQ ID NO: 555649 - DNA, 25 bp, Homo sapien
gtcatcaacaatccagactgaagtc

SEQ ID NO: 555650 - DNA, 25 bp, Homo sapien
aacaatccagactgaagtcttctat

SEQ ID NO: 555651 - DNA, 25 bp, Homo sapien
atccagactgaagtcttctatttta

SEQ ID NO: 555652 - DNA, 25 bp, Homo sapien
ttctattttaatctcaatccccttt

SEQ ID NO: 555653 - DNA, 25 bp, Homo sapien
attttaatctcaatccccttttctg

SEQ ID NO: 555654 - DNA, 25 bp, Homo sapien
tttaatctcaatccccttttctgat

SEQ ID NO: 555655 - DNA, 25 bp, Homo sapien
tccccttttctgatttgccacccat

SEQ ID NO: 555656 - DNA, 25 bp, Homo sapien
atttgccacccatgcctcttcaggc

SEQ ID NO: 555657 - DNA, 25 bp, Homo sapien
attaattttggctaatggaattgca

SEQ ID NO: 555658 - DNA, 25 bp, Homo sapien
tggaattgcaaagttcctcctaccc

SEQ ID NO: 555659 - DNA, 25 bp, Homo sapien
aattgcaaagttcctcctaccctca

SEQ ID NO: 555660 - DNA, 25 bp, Homo sapien
cctaccctcacctccagatatggca

SEQ ID NO: 555661 - DNA, 25 bp, Homo sapien
agatatggcagcatacggggcataa

SEQ ID NO: 555662 - DNA, 25 bp, Homo sapien
gggcataagaccgtttagttcaacg

SEQ ID NO: 555663 - DNA, 25 bp, Homo sapien
cataagaccgtttagttcaacgtgt

SEQ ID NO: 555664 - DNA, 25 bp, Homo sapien
gtttagttcaacgtgttctacacat

SEQ ID NO: 555665 - DNA, 25 bp, Homo sapien
gttcaacgtgttctacacattccag

SEQ ID NO: 555666 - DNA, 25 bp, Homo sapien
aacgtgttctacacattccagctgt

SEQ ID NO: 555667 - DNA, 25 bp, Homo sapien
cgtgttctacacattccagctgttt

SEQ ID NO: 555668 - DNA, 25 bp, Homo sapien
aacagctatgattctgaagtcacct

SEQ ID NO: 555669 - DNA, 25 bp, Homo sapien
gctatgattctgaagtcacctttct

SEQ ID NO: 555670 - DNA, 25 bp, Homo sapien
tgattctgaagtcacctttctcaaa

SEQ ID NO: 555671 - DNA, 25 bp, Homo sapien
gaagtcacctttctcaaaccttgaa

SEQ ID NO: 555672 - DNA, 25 bp, Homo sapien
gagctctaggatctctataaacatt

SEQ ID NO: 555673 - DNA, 25 bp, Homo sapien
acttttcctgtagttaccatagaca

SEQ ID NO: 555674 - DNA, 25 bp, Homo sapien
tgtagttaccatagacagacatctg

SEQ ID NO: 555675 - DNA, 25 bp, Homo sapien
catctgtcgttagacctgtgtggta

SEQ ID NO: 555676 - DNA, 25 bp, Homo sapien
gtcgttagacctgtgtggtatttca

SEQ ID NO: 555677 - DNA, 25 bp, Homo sapien
gacctgtgtggtatttcaaagaact

SEQ ID NO: 555678 - DNA, 25 bp, Homo sapien
gtggtatttcaaagaactcatatgt

SEQ ID NO: 555679 - DNA, 25 bp, Homo sapien
ggcagcccttcaccagagttcggag

SEQ ID NO: 555680 - DNA, 25 bp, Homo sapien
ccttcaccagagttcggaggagcag

SEQ ID NO: 555681 - DNA, 25 bp, Homo sapien
gaggagcagtgtgtggcgccacgtc

SEQ ID NO: 555682 - DNA, 25 bp, Homo sapien
tggccatacccacacagaagcagtg

SEQ ID NO: 555683 - DNA, 25 bp, Homo sapien
atacccacacagaagcagtgctgcc

SEQ ID NO: 555684 - DNA, 25 bp, Homo sapien
atctgggccagcttggactctgctt

SEQ ID NO: 555685 - DNA, 25 bp, Homo sapien
cagcagggaagctctgggccacctc

SEQ ID NO: 555686 - DNA, 25 bp, Homo sapien
cacctccctggatagcaggaacttg

SEQ ID NO: 555687 - DNA, 25 bp, Homo sapien
tccctggatagcaggaacttgacct

SEQ ID NO: 555688 - DNA, 25 bp, Homo sapien
aacttgacctgccatgtgtgccctg

SEQ ID NO: 555689 - DNA, 25 bp, Homo sapien
gccagctgtgcttgttatcttccat

SEQ ID NO: 555690 - DNA, 25 bp, Homo sapien
ttctgacttcagcattgatacctaa

SEQ ID NO: 555691 - DNA, 25 bp, Homo sapien
gcattgatacctaaattgatttcca

SEQ ID NO: 555692 - DNA, 25 bp, Homo sapien
attgatttccagtacacagttttat

SEQ ID NO: 555693 - DNA, 25 bp, Homo sapien
gaatatgtagtaatctcagttaacc

SEQ ID NO: 555694 - DNA, 25 bp, Homo sapien
gtaatctcagttaaccagaacctta

SEQ ID NO: 555695 - DNA, 25 bp, Homo sapien
gaatctcctacagatttttccttac

SEQ ID NO: 555696 - DNA, 25 bp, Homo sapien
ctcctacagatttttccttacactt

SEQ ID NO: 555697 - DNA, 25 bp, Homo sapien
tattccttaacctctaggtaaatgg

SEQ ID NO: 555698 - DNA, 25 bp, Homo sapien
gtaaacatacaagatgtcattgctt

SEQ ID NO: 555699 - DNA, 25 bp, Homo sapien
acgttggaaaattcatcaaggtaca

SEQ ID NO: 555700 - DNA, 25 bp, Homo sapien
ggtacaaatcattttctgacttcag

SEQ ID NO: 555701 - DNA, 25 bp, Homo sapien
gccctaaccacccaggatgaaaatg

SEQ ID NO: 555702 - DNA, 25 bp, Homo sapien
gaaaatggccagaccaagcgcaagt

SEQ ID NO: 555703 - DNA, 25 bp, Homo sapien
tggccagaccaagcgcaagttgcag

SEQ ID NO: 555704 - DNA, 25 bp, Homo sapien
accaagcgcaagttgcaggcaggca

SEQ ID NO: 555705 - DNA, 25 bp, Homo sapien
caggcaggcaagaagagtcaggaca

SEQ ID NO: 555706 - DNA, 25 bp, Homo sapien
gacaagcagaaaaagcggcagcgag

SEQ ID NO: 555707 - DNA, 25 bp, Homo sapien
aaaagcggcagcgagaccgcatggt

SEQ ID NO: 555708 - DNA, 25 bp, Homo sapien
catggtggaaaggtaaccagcttcc

SEQ ID NO: 555709 - DNA, 25 bp, Homo sapien
agagcagggccatagctctgccagc

SEQ ID NO: 555710 - DNA, 25 bp, Homo sapien
gcagggccatagctctgccagctcg

SEQ ID NO: 555711 - DNA, 25 bp, Homo sapien
tgctcggccgtgcatggaccctgct

SEQ ID NO: 555712 - DNA, 25 bp, Homo sapien
aagttgattctgcttggagaatttc

SEQ ID NO: 555713 - DNA, 25 bp, Homo sapien
ggagaatttctcaagctttacattt

SEQ ID NO: 555714 - DNA, 25 bp, Homo sapien
agaatttctcaagctttacattttt

SEQ ID NO: 555715 - DNA, 25 bp, Homo sapien
aaactctaagaggtgtgcatatata

SEQ ID NO: 555716 - DNA, 25 bp, Homo sapien
ttggttgatgtaaattttgtttctg

SEQ ID NO: 555717 - DNA, 25 bp, Homo sapien
gctttttgtagactgccatgtgcaa

SEQ ID NO: 555718 - DNA, 25 bp, Homo sapien
gccatgtgcaagtaaaattcctgct

SEQ ID NO: 555719 - DNA, 25 bp, Homo sapien
gtgcaagtaaaattcctgcttctgc

SEQ ID NO: 555720 - DNA, 25 bp, Homo sapien
caagtaaaattcctgcttctgccat

SEQ ID NO: 555721 - DNA, 25 bp, Homo sapien
cctgcttctgccatgttaaaatttt

SEQ ID NO: 555722 - DNA, 25 bp, Homo sapien
gcttctgccatgttaaaattttaat

SEQ ID NO: 555723 - DNA, 25 bp, Homo sapien
gatgaaaatggccagaccaagcgca

SEQ ID NO: 555724 - DNA, 25 bp, Homo sapien
gaaaatggccagaccaagcgcaagt

SEQ ID NO: 555725 - DNA, 25 bp, Homo sapien
atggccagaccaagcgcaagttgca

SEQ ID NO: 555726 - DNA, 25 bp, Homo sapien
tggccagaccaagcgcaagttgcag

SEQ ID NO: 555727 - DNA, 25 bp, Homo sapien
ccagaccaagcgcaagttgcaggca

SEQ ID NO: 555728 - DNA, 25 bp, Homo sapien
accaagcgcaagttgcaggcaggca

SEQ ID NO: 555729 - DNA, 25 bp, Homo sapien
agcgcaagttgcaggcaggcaagaa

SEQ ID NO: 555730 - DNA, 25 bp, Homo sapien
caggcaggcaagaagagtcaggaca

SEQ ID NO: 555731 - DNA, 25 bp, Homo sapien
gcaggcaagaagagtcaggacaagc

SEQ ID NO: 555732 - DNA, 25 bp, Homo sapien
gacaagcagaaaaagcggcagcgag

SEQ ID NO: 555733 - DNA, 25 bp, Homo sapien
aaaagcggcagcgagaccgcatggt

SEQ ID NO: 555734 - DNA, 25 bp, Homo sapien
tttggtaggagcttgaatcttcgcc

SEQ ID NO: 555735 - DNA, 25 bp, Homo sapien
tgaatcttcgccatcatcagagggt

SEQ ID NO: 555736 - DNA, 25 bp, Homo sapien
atcttcgccatcatcagagggtcca

SEQ ID NO: 555737 - DNA, 25 bp, Homo sapien
ttcagtctcccctcaaatcttcgag

SEQ ID NO: 555738 - DNA, 25 bp, Homo sapien
aaatcttcgagtccacctgggtgtt

SEQ ID NO: 555739 - DNA, 25 bp, Homo sapien
ggcttcagtcagagtgcacgtcttg

SEQ ID NO: 555740 - DNA, 25 bp, Homo sapien
gtcagagtgcacgtcttgaagccca

SEQ ID NO: 555741 - DNA, 25 bp, Homo sapien
agagtgcacgtcttgaagcccatca

SEQ ID NO: 555742 - DNA, 25 bp, Homo sapien
gcacgtcttgaagcccatcagagag

SEQ ID NO: 555743 - DNA, 25 bp, Homo sapien
tgtgacatatgtgataaggacttcc

SEQ ID NO: 555744 - DNA, 25 bp, Homo sapien
tcaccgttcacgtcttacatatcat

SEQ ID NO: 555745 - DNA, 25 bp, Homo sapien
ggcatgccgtggtgcaggcttccaa

SEQ ID NO: 555746 - DNA, 25 bp, Homo sapien
aggcttccaagctgcccatgtccat

SEQ ID NO: 555747 - DNA, 25 bp, Homo sapien
gtgggcaatgcggacttcgctgcca

SEQ ID NO: 555748 - DNA, 25 bp, Homo sapien
ttcgctgccatggagttcctggatg

SEQ ID NO: 555749 - DNA, 25 bp, Homo sapien
gaggcagcccgcgatattgtgcagt

SEQ ID NO: 555750 - DNA, 25 bp, Homo sapien
gcgatattgtgcagttcgttccctt

SEQ ID NO: 555751 - DNA, 25 bp, Homo sapien
gcagttcgttccctttcgagagttc

SEQ ID NO: 555752 - DNA, 25 bp, Homo sapien
tcgagagttccgcaacgcagcaaaa

SEQ ID NO: 555753 - DNA, 25 bp, Homo sapien
caacgcagcaaaagagaccttggcc

SEQ ID NO: 555754 - DNA, 25 bp, Homo sapien
gagctgccccaacaagttgtgcagt

SEQ ID NO: 555755 - DNA, 25 bp, Homo sapien
caacaagttgtgcagtatttcaagc

SEQ ID NO: 555756 - DNA, 25 bp, Homo sapien
gggcatatcaagtttttgaccaaag

SEQ ID NO: 555757 - DNA, 25 bp, Homo sapien
atgcggttgatgaccgaggcctcta

SEQ ID NO: 555758 - DNA, 25 bp, Homo sapien
gaccgaggcctctataaacaaggac

SEQ ID NO: 555759 - DNA, 25 bp, Homo sapien
gagccaggggatttgttccttatat

SEQ ID NO: 555760 - DNA, 25 bp, Homo sapien
gtgacgatcctcatgaatgactatc

SEQ ID NO: 555761 - DNA, 25 bp, Homo sapien
gatcctcatgaatgactatcctaaa

SEQ ID NO: 555762 - DNA, 25 bp, Homo sapien
ttttgctgggtttattcgtgctggt

SEQ ID NO: 555763 - DNA, 25 bp, Homo sapien
atcgtgagtaagaagcctgccttgc

SEQ ID NO: 555764 - DNA, 25 bp, Homo sapien
taagaagcctgccttgctgttcctg

SEQ ID NO: 555765 - DNA, 25 bp, Homo sapien
gggaagatgccatagttttcgttac

SEQ ID NO: 555766 - DNA, 25 bp, Homo sapien
gccatagttttcgttactggatgtt

SEQ ID NO: 555767 - DNA, 25 bp, Homo sapien
ggtggtattggcctatattcccatt

SEQ ID NO: 555768 - DNA, 25 bp, Homo sapien
ggtattggcctatattcccattgac

SEQ ID NO: 555769 - DNA, 25 bp, Homo sapien
attggcctatattcccattgacaaa

SEQ ID NO: 555770 - DNA, 25 bp, Homo sapien
ggcctatattcccattgacaaatgc

SEQ ID NO: 555771 - DNA, 25 bp, Homo sapien
ttttttcccatgtctccataacttt

SEQ ID NO: 555772 - DNA, 25 bp, Homo sapien
ttcccatgtctccataacttttact

SEQ ID NO: 555773 - DNA, 25 bp, Homo sapien
gtctccataacttttactaacattt

SEQ ID NO: 555774 - DNA, 25 bp, Homo sapien
gtttttagcagcacaacagtaatcc

SEQ ID NO: 555775 - DNA, 25 bp, Homo sapien
gcagcacaacagtaatccatataaa

SEQ ID NO: 555776 - DNA, 25 bp, Homo sapien
tcccttttattggtggtattggcct

SEQ ID NO: 555777 - DNA, 25 bp, Homo sapien
attggtggtattggcctatattccc

SEQ ID NO: 555778 - DNA, 25 bp, Homo sapien
gtaatttgtagctctaccttcagga

SEQ ID NO: 555779 - DNA, 25 bp, Homo sapien
gtagctctaccttcaggaaatgtca

SEQ ID NO: 555780 - DNA, 25 bp, Homo sapien
accttcaggaaatgtcagtgattca

SEQ ID NO: 555781 - DNA, 25 bp, Homo sapien
ttgtttatgagagccatttggtctg

SEQ ID NO: 555782 - DNA, 25 bp, Homo sapien
gtgattcaacattcaaatctaccta

SEQ ID NO: 555783 - DNA, 25 bp, Homo sapien
aatctacctaatcaactgtatcttt

SEQ ID NO: 555784 - DNA, 25 bp, Homo sapien
caactgtatctttactacctatata

SEQ ID NO: 555785 - DNA, 25 bp, Homo sapien
atgtgcatattcagtcttctgattc

SEQ ID NO: 555786 - DNA, 25 bp, Homo sapien
cagtcttctgattcataggtcctaa

SEQ ID NO: 555787 - DNA, 25 bp, Homo sapien
tcataggtcctaaatgcttttgtat

SEQ ID NO: 555788 - DNA, 25 bp, Homo sapien
atttggtctgagtaacatgtatagg

SEQ ID NO: 555789 - DNA, 25 bp, Homo sapien
cctcctgtagcccaggcaagagaga

SEQ ID NO: 555790 - DNA, 25 bp, Homo sapien
ctgtagcccaggcaagagagaagca

SEQ ID NO: 555791 - DNA, 25 bp, Homo sapien
gagagaagcaaccaccacaagctct

SEQ ID NO: 555792 - DNA, 25 bp, Homo sapien
aagcaaccaccacaagctctcggga

SEQ ID NO: 555793 - DNA, 25 bp, Homo sapien
agctctcgggactagctgccttcgc

SEQ ID NO: 555794 - DNA, 25 bp, Homo sapien
gctgccttcgcaccttgctgtgtga

SEQ ID NO: 555795 - DNA, 25 bp, Homo sapien
ttgctgtgtgacctgaggccctcac

SEQ ID NO: 555796 - DNA, 25 bp, Homo sapien
aatttcctcatctgggtctcccagg

SEQ ID NO: 555797 - DNA, 25 bp, Homo sapien
tgggtctcccaggacacatcacata

SEQ ID NO: 555798 - DNA, 25 bp, Homo sapien
tcttctgggctactgccactgtgtg

SEQ ID NO: 555799 - DNA, 25 bp, Homo sapien
tgccactgtgtgccttctgccaacg

SEQ ID NO: 555800 - DNA, 25 bp, Homo sapien
gtgatagcagcagcactctaggcat

SEQ ID NO: 555801 - DNA, 25 bp, Homo sapien
agcagcactctaggcatggtgaacg

SEQ ID NO: 555802 - DNA, 25 bp, Homo sapien
atggtgaacgcctgggaccaagcca

SEQ ID NO: 555803 - DNA, 25 bp, Homo sapien
gggaccaagccatgtggcgtttttt

SEQ ID NO: 555804 - DNA, 25 bp, Homo sapien
gcctttctggaagactcaagatatg

SEQ ID NO: 555805 - DNA, 25 bp, Homo sapien
aagatatgtctcttcattctctctc

SEQ ID NO: 555806 - DNA, 25 bp, Homo sapien
tcattctctctcagtatttgtttac

SEQ ID NO: 555807 - DNA, 25 bp, Homo sapien
tagtgggcacaagctgtaatattca

SEQ ID NO: 555808 - DNA, 25 bp, Homo sapien
gcaaaactttgtcgactggcactgt

SEQ ID NO: 555809 - DNA, 25 bp, Homo sapien
actggcactgtttacaagtctgtta

SEQ ID NO: 555810 - DNA, 25 bp, Homo sapien
aagtctgttagctgcataagctcaa

SEQ ID NO: 555811 - DNA, 25 bp, Homo sapien
cggccagttttgacacgccccagtg

SEQ ID NO: 555812 - DNA, 25 bp, Homo sapien
gaacaaccagggtcatctgcacttg

SEQ ID NO: 555813 - DNA, 25 bp, Homo sapien
atctgcacttgatgactgctccccg

SEQ ID NO: 555814 - DNA, 25 bp, Homo sapien
tcccactacagggatcaagtgacct

SEQ ID NO: 555815 - DNA, 25 bp, Homo sapien
caagtgacctgggaagaaccgagtt

SEQ ID NO: 555816 - DNA, 25 bp, Homo sapien
aggatgtgtttccttagatttcctt

SEQ ID NO: 555817 - DNA, 25 bp, Homo sapien
ctttcctaggcgatttccagggaga

SEQ ID NO: 555818 - DNA, 25 bp, Homo sapien
agggagagccctgattggacaatca

SEQ ID NO: 555819 - DNA, 25 bp, Homo sapien
cagatcacactgcagtttccatgtt

SEQ ID NO: 555820 - DNA, 25 bp, Homo sapien
gcagtttccatgttagcactgtgga

SEQ ID NO: 555821 - DNA, 25 bp, Homo sapien
agcactgtggatgggtttttaatca

SEQ ID NO: 555822 - DNA, 25 bp, Homo sapien
actttgcattgttaattggtatctt

SEQ ID NO: 555823 - DNA, 25 bp, Homo sapien
ttgcattgttaattggtatcttaca

SEQ ID NO: 555824 - DNA, 25 bp, Homo sapien
ggtatcttacaaattacaacttatg

SEQ ID NO: 555825 - DNA, 25 bp, Homo sapien
gtacatttataaattctccatatga

SEQ ID NO: 555826 - DNA, 25 bp, Homo sapien
gaaaaatactcatctgaaatgctaa

SEQ ID NO: 555827 - DNA, 25 bp, Homo sapien
tactcatctgaaatgctaaaagcaa

SEQ ID NO: 555828 - DNA, 25 bp, Homo sapien
atgactttttaaagcaagttatgtc

SEQ ID NO: 555829 - DNA, 25 bp, Homo sapien
gcaagttatgtctgttatttttcac

SEQ ID NO: 555830 - DNA, 25 bp, Homo sapien
agttatgtctgttatttttcacctg

SEQ ID NO: 555831 - DNA, 25 bp, Homo sapien
gatgcttttataagtgtttttgttc

SEQ ID NO: 555832 - DNA, 25 bp, Homo sapien
catgtataacatacttagcacttac

SEQ ID NO: 555833 - DNA, 25 bp, Homo sapien
tccagcctcccagatggtgcaagtg

SEQ ID NO: 555834 - DNA, 25 bp, Homo sapien
agcctcccagatggtgcaagtggtc

SEQ ID NO: 555835 - DNA, 25 bp, Homo sapien
cagatggtgcaagtggtccccgcag

SEQ ID NO: 555836 - DNA, 25 bp, Homo sapien
tgggcctggtgttatgacccctcag

SEQ ID NO: 555837 - DNA, 25 bp, Homo sapien
gtgttatgacccctcagggcctgcc

SEQ ID NO: 555838 - DNA, 25 bp, Homo sapien
ctccatccagattgtccagactcta

SEQ ID NO: 555839 - DNA, 25 bp, Homo sapien
agattgtccagactctacccgcagt

SEQ ID NO: 555840 - DNA, 25 bp, Homo sapien
agactctacccgcagtccagctggt

SEQ ID NO: 555841 - DNA, 25 bp, Homo sapien
agtccagctggtgcacacgttttga

SEQ ID NO: 555842 - DNA, 25 bp, Homo sapien
cagctggtgcacacgttttgaggag

SEQ ID NO: 555843 - DNA, 25 bp, Homo sapien
gacagaaactcctcatcatccgcag

SEQ ID NO: 555844 - DNA, 25 bp, Homo sapien
agatgcctacgggaaggagctgttt

SEQ ID NO: 555845 - DNA, 25 bp, Homo sapien
aggagctgtttgacaaggccaacaa

SEQ ID NO: 555846 - DNA, 25 bp, Homo sapien
aggccaacaaacaccacttcttaca

SEQ ID NO: 555847 - DNA, 25 bp, Homo sapien
gggtgccccattgcagaaagccact

SEQ ID NO: 555848 - DNA, 25 bp, Homo sapien
ttgcagaaagccactctgggctggg

SEQ ID NO: 555849 - DNA, 25 bp, Homo sapien
gctgggttattgctagcttccggaa

SEQ ID NO: 555850 - DNA, 25 bp, Homo sapien
tagcttccggaacgaccttattctg

SEQ ID NO: 555851 - DNA, 25 bp, Homo sapien
cagcttttactaccaggctctgagt

SEQ ID NO: 555852 - DNA, 25 bp, Homo sapien
aggctctgagtggagaccccagcat

SEQ ID NO: 555853 - DNA, 25 bp, Homo sapien
ttgtccggagctgcggccttaggct

SEQ ID NO: 555854 - DNA, 25 bp, Homo sapien
ggccttaggcttcgcttcctacggg

SEQ ID NO: 555855 - DNA, 25 bp, Homo sapien
gggtcctatgtgatggcacaggtca

SEQ ID NO: 555856 - DNA, 25 bp, Homo sapien
gtgatggcacaggtcacaaaaccat

SEQ ID NO: 555857 - DNA, 25 bp, Homo sapien
aaaccatggagccaaccagctctgt

SEQ ID NO: 555858 - DNA, 25 bp, Homo sapien
cagcaccttccagataaaagcttaa

SEQ ID NO: 555859 - DNA, 25 bp, Homo sapien
aagagctacatactttccaaaggca

SEQ ID NO: 555860 - DNA, 25 bp, Homo sapien
aaaggcaccattgcttcttcactgg

SEQ ID NO: 555861 - DNA, 25 bp, Homo sapien
ttgcttcttcactgggtgacatttg

SEQ ID NO: 555862 - DNA, 25 bp, Homo sapien
aatgcagcatcccttgttcaaaaaa

SEQ ID NO: 555863 - DNA, 25 bp, Homo sapien
aataattgcccataatgccaccatc

SEQ ID NO: 555864 - DNA, 25 bp, Homo sapien
aatgccaccatctaggacaatgaga

SEQ ID NO: 555865 - DNA, 25 bp, Homo sapien
aagaatttcaagacacggcagcaga

SEQ ID NO: 555866 - DNA, 25 bp, Homo sapien
ggcctctccggcagggagtcctagc

SEQ ID NO: 555867 - DNA, 25 bp, Homo sapien
ggcagggagtcctagcgcagacttt

SEQ ID NO: 555868 - DNA, 25 bp, Homo sapien
gagtcctagcgcagactttgcggtt

SEQ ID NO: 555869 - DNA, 25 bp, Homo sapien
cctagcgcagactttgcggttcatg

SEQ ID NO: 555870 - DNA, 25 bp, Homo sapien
gcagactttgcggttcatggagagt

SEQ ID NO: 555871 - DNA, 25 bp, Homo sapien
actttgcggttcatggagagtctct

SEQ ID NO: 555872 - DNA, 25 bp, Homo sapien
tttgcggttcatggagagtctctgg

SEQ ID NO: 555873 - DNA, 25 bp, Homo sapien
gttcatggagagtctctgggagaca

SEQ ID NO: 555874 - DNA, 25 bp, Homo sapien
ggagacaggcacctgcggacgctgc

SEQ ID NO: 555875 - DNA, 25 bp, Homo sapien
gcggacgctgcagataagttacgac

SEQ ID NO: 555876 - DNA, 25 bp, Homo sapien
gacgctgcagataagttacgacgca

SEQ ID NO: 555877 - DNA, 25 bp, Homo sapien
gaaacagtctgctgatctgcaatct

SEQ ID NO: 555878 - DNA, 25 bp, Homo sapien
gcaatctttctgtgatctgcaagtg

SEQ ID NO: 555879 - DNA, 25 bp, Homo sapien
atctgcaagtgctgaggttcaattc

SEQ ID NO: 555880 - DNA, 25 bp, Homo sapien
ggttcaattcaactcagacttcata

SEQ ID NO: 555881 - DNA, 25 bp, Homo sapien
aaagccaaagcctggttttatgatt

SEQ ID NO: 555882 - DNA, 25 bp, Homo sapien
tggttttatgattgcagccctcagc

SEQ ID NO: 555883 - DNA, 25 bp, Homo sapien
cctgggctgcctgaagacgaagaga

SEQ ID NO: 555884 - DNA, 25 bp, Homo sapien
gcaaggttattgttggctcaggcct

SEQ ID NO: 555885 - DNA, 25 bp, Homo sapien
tcaggccttgttagccagacttcgt

SEQ ID NO: 555886 - DNA, 25 bp, Homo sapien
gacttcgtgctctgtacgcattcaa

SEQ ID NO: 555887 - DNA, 25 bp, Homo sapien
agcaggatattcaggccctggaaca

SEQ ID NO: 555888 - DNA, 25 bp, Homo sapien
aagtattgtcttctacgtgtgctat

SEQ ID NO: 555889 - DNA, 25 bp, Homo sapien
gtcttctacgtgtgctattttcagt

SEQ ID NO: 555890 - DNA, 25 bp, Homo sapien
acgtgtgctattttcagtagcagag

SEQ ID NO: 555891 - DNA, 25 bp, Homo sapien
gtagcagagtaagcacaaggtttta

SEQ ID NO: 555892 - DNA, 25 bp, Homo sapien
gcacaaggttttaatcgagttgcat

SEQ ID NO: 555893 - DNA, 25 bp, Homo sapien
aatcgagttgcataagacacctttg

SEQ ID NO: 555894 - DNA, 25 bp, Homo sapien
ataagacacctttgcatagctattt

SEQ ID NO: 555895 - DNA, 25 bp, Homo sapien
gcatagctatttaattgcccaatgt

SEQ ID NO: 555896 - DNA, 25 bp, Homo sapien
ctttaatgccatttctaatgctttt

SEQ ID NO: 555897 - DNA, 25 bp, Homo sapien
tgtatgttatcgtagacaagacccc

SEQ ID NO: 555898 - DNA, 25 bp, Homo sapien
tttcagcagaaagttatgcttctag

SEQ ID NO: 555899 - DNA, 25 bp, Homo sapien
ttctgaacaacttttttggaacatt

SEQ ID NO: 555900 - DNA, 25 bp, Homo sapien
ttctatctatattccaaagcatgta

SEQ ID NO: 555901 - DNA, 25 bp, Homo sapien
gatttgttaaactggtccttagtca

SEQ ID NO: 555902 - DNA, 25 bp, Homo sapien
ggtccttagtcatttgtataattag

SEQ ID NO: 555903 - DNA, 25 bp, Homo sapien
atttgtatagccttctagaatcaga

SEQ ID NO: 555904 - DNA, 25 bp, Homo sapien
gccttctagaatcagaaataacctt

SEQ ID NO: 555905 - DNA, 25 bp, Homo sapien
gaaataacctttttgcatattcttt

SEQ ID NO: 555906 - DNA, 25 bp, Homo sapien
aacctttttgcatattcttttattg

SEQ ID NO: 555907 - DNA, 25 bp, Homo sapien
ttgcatattcttttattgttctgac

SEQ ID NO: 555908 - DNA, 25 bp, Homo sapien
ttgttctgacttttcaagacctatt

SEQ ID NO: 555909 - DNA, 25 bp, Homo sapien
gtcaataaacaaaaggtgtgctact

SEQ ID NO: 555910 - DNA, 25 bp, Homo sapien
ggcacgcagcagatctcctcagaga

SEQ ID NO: 555911 - DNA, 25 bp, Homo sapien
atctcctcagagagcaggcaaacaa

SEQ ID NO: 555912 - DNA, 25 bp, Homo sapien
aataccagcgaactcctgtttaaga

SEQ ID NO: 555913 - DNA, 25 bp, Homo sapien
gtgaaatatacgaaccaccctcctg

SEQ ID NO: 555914 - DNA, 25 bp, Homo sapien
tgccctctgggttcacaatacgtgt

SEQ ID NO: 555915 - DNA, 25 bp, Homo sapien
atacgtgtacacttgactgtgaagt

SEQ ID NO: 555916 - DNA, 25 bp, Homo sapien
gttcttctttgaccctcagcctgcg

SEQ ID NO: 555917 - DNA, 25 bp, Homo sapien
tcagcctgcggatgcctctagaaac

SEQ ID NO: 555918 - DNA, 25 bp, Homo sapien
gcctctagaaacctcgtgttgattg

SEQ ID NO: 555919 - DNA, 25 bp, Homo sapien
agaaacctcgtgttgattgcaggag

SEQ ID NO: 555920 - DNA, 25 bp, Homo sapien
aggagtcggaattaaccctctgctt

SEQ ID NO: 555921 - DNA, 25 bp, Homo sapien
attattgctgagtcattggtgcctt

SEQ ID NO: 555922 - DNA, 25 bp, Homo sapien
attgctgagtcattggtgccttatt

SEQ ID NO: 555923 - DNA, 25 bp, Homo sapien
gctgagtcattggtgccttattctt

SEQ ID NO: 555924 - DNA, 25 bp, Homo sapien
tgagtcattggtgccttattcttca

SEQ ID NO: 555925 - DNA, 25 bp, Homo sapien
atctcctaagcatcctgatgttagt

SEQ ID NO: 555926 - DNA, 25 bp, Homo sapien
cctaagcatcctgatgttagttttt

SEQ ID NO: 555927 - DNA, 25 bp, Homo sapien
gactataaaattgacctgcattctt

SEQ ID NO: 555928 - DNA, 25 bp, Homo sapien
aaattgacctgcattctttactagc

SEQ ID NO: 555929 - DNA, 25 bp, Homo sapien
ttgacctgcattctttactagcaat

SEQ ID NO: 555930 - DNA, 25 bp, Homo sapien
acctgcattctttactagcaattca

SEQ ID NO: 555931 - DNA, 25 bp, Homo sapien
attctttactagcaattcaaacggt

SEQ ID NO: 555932 - DNA, 25 bp, Homo sapien
atggaacatacattgatcttgagtt

SEQ ID NO: 555933 - DNA, 25 bp, Homo sapien
gatcttgagttaatgcgtggttgaa

SEQ ID NO: 555934 - DNA, 25 bp, Homo sapien
gggcaacttgaaatatatgcagtaa

SEQ ID NO: 555935 - DNA, 25 bp, Homo sapien
gtagtccatgcatacaagtccctaa

SEQ ID NO: 555936 - DNA, 25 bp, Homo sapien
atacaagtccctaacatggtagatg

SEQ ID NO: 555937 - DNA, 25 bp, Homo sapien
atggtagatgatgttgcctcccggc

SEQ ID NO: 555938 - DNA, 25 bp, Homo sapien
tcccggccctgctcagaaagaatac

SEQ ID NO: 555939 - DNA, 25 bp, Homo sapien
acactgtgtactgctagcacccaaa

SEQ ID NO: 555940 - DNA, 25 bp, Homo sapien
tgtactgctagcacccaaagtggaa

SEQ ID NO: 555941 - DNA, 25 bp, Homo sapien
ttaagcattcagattgtttagtcaa

SEQ ID NO: 555942 - DNA, 25 bp, Homo sapien
agaaaaccagaagggcagttgccta

SEQ ID NO: 555943 - DNA, 25 bp, Homo sapien
ccgtaggtttgtaactgtttcatag

SEQ ID NO: 555944 - DNA, 25 bp, Homo sapien
cgtaggtttgtaactgtttcataga

SEQ ID NO: 555945 - DNA, 25 bp, Homo sapien
gtaggtttgtaactgtttcatagaa

SEQ ID NO: 555946 - DNA, 25 bp, Homo sapien
taggtttgtaactgtttcatagaag

SEQ ID NO: 555947 - DNA, 25 bp, Homo sapien
aggtttgtaactgtttcatagaaga

SEQ ID NO: 555948 - DNA, 25 bp, Homo sapien
ggtttgtaactgtttcatagaagag

SEQ ID NO: 555949 - DNA, 25 bp, Homo sapien
gtttgtaactgtttcatagaagagc

SEQ ID NO: 555950 - DNA, 25 bp, Homo sapien
tttgtaactgtttcatagaagagcc

SEQ ID NO: 555951 - DNA, 25 bp, Homo sapien
ttgtaactgtttcatagaagagccc

SEQ ID NO: 555952 - DNA, 25 bp, Homo sapien
gttcacctctgctgtaagttaattt

SEQ ID NO: 555953 - DNA, 25 bp, Homo sapien
tcacctctgctgtaagttaatttgg

SEQ ID NO: 555954 - DNA, 25 bp, Homo sapien
cacctctgctgtaagttaatttggg

SEQ ID NO: 555955 - DNA, 25 bp, Homo sapien
ctctgctgtaagttaatttgggtta

SEQ ID NO: 555956 - DNA, 25 bp, Homo sapien
tttttgtttagggactgtagtggat

SEQ ID NO: 555957 - DNA, 25 bp, Homo sapien
tgtagtggattatggccaagcagca

SEQ ID NO: 555958 - DNA, 25 bp, Homo sapien
gcagtagctagttaagtcttaatca

SEQ ID NO: 555959 - DNA, 25 bp, Homo sapien
gttaagtcttaatcatgaaggtagt

SEQ ID NO: 555960 - DNA, 25 bp, Homo sapien
catgaaggtagtagaaacctagaat

SEQ ID NO: 555961 - DNA, 25 bp, Homo sapien
taaaattattatgcccttttcactc

SEQ ID NO: 555962 - DNA, 25 bp, Homo sapien
tttcactcatttcataatatgtttg

SEQ ID NO: 555963 - DNA, 25 bp, Homo sapien
ttggaaactgtcaacttacaaaggc

SEQ ID NO: 555964 - DNA, 25 bp, Homo sapien
acagaatcatgattgccatgggcca

SEQ ID NO: 555965 - DNA, 25 bp, Homo sapien
gccatgggccactttatttacatga

SEQ ID NO: 555966 - DNA, 25 bp, Homo sapien
acatgaagacaactggagaacgact

SEQ ID NO: 555967 - DNA, 25 bp, Homo sapien
gagaacgactaagaccaaattatgg

SEQ ID NO: 555968 - DNA, 25 bp, Homo sapien
aaagctgttgctggcaagaccatca

SEQ ID NO: 555969 - DNA, 25 bp, Homo sapien
aagaccatcaagactgttctgacac

SEQ ID NO: 555970 - DNA, 25 bp, Homo sapien
catcatccctgactgagtactctga

SEQ ID NO: 555971 - DNA, 25 bp, Homo sapien
ctgactgagtactctgacatcacgg

SEQ ID NO: 555972 - DNA, 25 bp, Homo sapien
ggaaagtgttgaacctgggaccctg

SEQ ID NO: 555973 - DNA, 25 bp, Homo sapien
tgggaccctgaggaattcaccagga

SEQ ID NO: 555974 - DNA, 25 bp, Homo sapien
tctttctcattgaatcatcttaaat

SEQ ID NO: 555975 - DNA, 25 bp, Homo sapien
cttggccctgaatttagctgattta

SEQ ID NO: 555976 - DNA, 25 bp, Homo sapien
aaagcacttagattgtcttacgtat

SEQ ID NO: 555977 - DNA, 25 bp, Homo sapien
gattgtcttacgtatgtgcatacta

SEQ ID NO: 555978 - DNA, 25 bp, Homo sapien
gtgcatactatacctttacagcgtt

SEQ ID NO: 555979 - DNA, 25 bp, Homo sapien
ttacagcgtttattgtcttgtctct

SEQ ID NO: 555980 - DNA, 25 bp, Homo sapien
ctcttgtcagtagaccttcagtaca

SEQ ID NO: 555981 - DNA, 25 bp, Homo sapien
gtcagtagaccttcagtacacagta

SEQ ID NO: 555982 - DNA, 25 bp, Homo sapien
ccttcagtacacagtatgtgggata

SEQ ID NO: 555983 - DNA, 25 bp, Homo sapien
atgtcagtcaagttggtcagcacca

SEQ ID NO: 555984 - DNA, 25 bp, Homo sapien
ttggtcagcaccagcatctgtccag

SEQ ID NO: 555985 - DNA, 25 bp, Homo sapien
gatgcgaggactctccagggcaggg

SEQ ID NO: 555986 - DNA, 25 bp, Homo sapien
tccaaagctgctccgtaccccgagg

SEQ ID NO: 555987 - DNA, 25 bp, Homo sapien
atccgccggcgggatgatgcccggt

SEQ ID NO: 555988 - DNA, 25 bp, Homo sapien
atgatgcccggtgtggaggtctgaa

SEQ ID NO: 555989 - DNA, 25 bp, Homo sapien
ggaggtctgaaggttgtggcacggg

SEQ ID NO: 555990 - DNA, 25 bp, Homo sapien
gctgacgttggaggatgcatagcca

SEQ ID NO: 555991 - DNA, 25 bp, Homo sapien
ggaggatgcatagccatagtgttct

SEQ ID NO: 555992 - DNA, 25 bp, Homo sapien
gatgcatagccatagtgttcttcct

SEQ ID NO: 555993 - DNA, 25 bp, Homo sapien
atagtgttcttcctccgctgacttc

SEQ ID NO: 555994 - DNA, 25 bp, Homo sapien
ttcttcctccgctgacttcatggtg

SEQ ID NO: 555995 - DNA, 25 bp, Homo sapien
ctgacttcatggtgccgccggcgcg

SEQ ID NO: 555996 - DNA, 25 bp, Homo sapien
cccgctaatattaaattcttccctg

SEQ ID NO: 555997 - DNA, 25 bp, Homo sapien
ggtcccagttgttcacatttggcta

SEQ ID NO: 555998 - DNA, 25 bp, Homo sapien
acatttggctaacaaggtccttgat

SEQ ID NO: 555999 - DNA, 25 bp, Homo sapien
ggtccttgattgtcacagtattttc

SEQ ID NO: 556000 - DNA, 25 bp, Homo sapien
gagctattatgaactgcctggtgat

SEQ ID NO: 556001 - DNA, 25 bp, Homo sapien
ggtgatattttcagcaagagcaact

SEQ ID NO: 556002 - DNA, 25 bp, Homo sapien
ctaaaatgtgtatggcctgtgctat

SEQ ID NO: 556003 - DNA, 25 bp, Homo sapien
gcctgtgctatatagccatggagga

SEQ ID NO: 556004 - DNA, 25 bp, Homo sapien
gctaaagccagccagaaatgtggat

SEQ ID NO: 556005 - DNA, 25 bp, Homo sapien
aaattttatggttcacaagggattg

SEQ ID NO: 556006 - DNA, 25 bp, Homo sapien
ggattgggaatgagtgtcccacccc

SEQ ID NO: 556007 - DNA, 25 bp, Homo sapien
tcatgtaaacatgctgccacctttt

SEQ ID NO: 556008 - DNA, 25 bp, Homo sapien
taaacatgctgccaccttttcttct

SEQ ID NO: 556009 - DNA, 25 bp, Homo sapien
ttcttctttctcagagaactcaaat

SEQ ID NO: 556010 - DNA, 25 bp, Homo sapien
tcagagaactcaaatttgctatagt

SEQ ID NO: 556011 - DNA, 25 bp, Homo sapien
gctatagtttgtcatttttgcttac

SEQ ID NO: 556012 - DNA, 25 bp, Homo sapien
taacttttcaaccttctagttatat

SEQ ID NO: 556013 - DNA, 25 bp, Homo sapien
tcaaccttctagttatatttatcca

SEQ ID NO: 556014 - DNA, 25 bp, Homo sapien
cataatcgggattccatttgtgtaa

SEQ ID NO: 556015 - DNA, 25 bp, Homo sapien
gaaaagaactatttgttacaatgag

SEQ ID NO: 556016 - DNA, 25 bp, Homo sapien
ttttgtgagtaaaccctactggaca

SEQ ID NO: 556017 - DNA, 25 bp, Homo sapien
gtaaaccctactggacagtgacata

SEQ ID NO: 556018 - DNA, 25 bp, Homo sapien
ggacttatagtaccccctcaggaca

SEQ ID NO: 556019 - DNA, 25 bp, Homo sapien
gggcaggaaggttatctcctcccgg

SEQ ID NO: 556020 - DNA, 25 bp, Homo sapien
gggtaaagccatttcgtcctctcca

SEQ ID NO: 556021 - DNA, 25 bp, Homo sapien
gccatttcgtcctctccagtttggg

SEQ ID NO: 556022 - DNA, 25 bp, Homo sapien
gaatgaggcctgctcctcttgtaaa

SEQ ID NO: 556023 - DNA, 25 bp, Homo sapien
aggcctgctcctcttgtaaataccc

SEQ ID NO: 556024 - DNA, 25 bp, Homo sapien
aagcccctgtacataacctggagcg

SEQ ID NO: 556025 - DNA, 25 bp, Homo sapien
acataacctggagcgtgtgaccttc

SEQ ID NO: 556026 - DNA, 25 bp, Homo sapien
agcgtgtgaccttcagagcttttca

SEQ ID NO: 556027 - DNA, 25 bp, Homo sapien
ttcagagcttttcactttatgcaaa

SEQ ID NO: 556028 - DNA, 25 bp, Homo sapien
tttatgcaaaatggctcctgtgagg

SEQ ID NO: 556029 - DNA, 25 bp, Homo sapien
ggctgtgggcggagctgggtcagtc

SEQ ID NO: 556030 - DNA, 25 bp, Homo sapien
agctgggtcagtcccgtatttattt

SEQ ID NO: 556031 - DNA, 25 bp, Homo sapien
tctcctgcagggaggtggctgtccc

SEQ ID NO: 556032 - DNA, 25 bp, Homo sapien
gtcccgcgggaagccatcagcttgg

SEQ ID NO: 556033 - DNA, 25 bp, Homo sapien
gggaagccatcagcttgggccagct

SEQ ID NO: 556034 - DNA, 25 bp, Homo sapien
aagccatcagcttgggccagctggc

SEQ ID NO: 556035 - DNA, 25 bp, Homo sapien
ccagctggcaggtggcaggaatgga

SEQ ID NO: 556036 - DNA, 25 bp, Homo sapien
ggagccgggcctgtacatagcgcac

SEQ ID NO: 556037 - DNA, 25 bp, Homo sapien
gccgggcctgtacatagcgcacaga

SEQ ID NO: 556038 - DNA, 25 bp, Homo sapien
ggcctgtacatagcgcacagatgtt

SEQ ID NO: 556039 - DNA, 25 bp, Homo sapien
gtacatagcgcacagatgtttgttt

SEQ ID NO: 556040 - DNA, 25 bp, Homo sapien
gccagctgccacaatgtgactttga

SEQ ID NO: 556041 - DNA, 25 bp, Homo sapien
caatgtgactttgatgtccacctgt

SEQ ID NO: 556042 - DNA, 25 bp, Homo sapien
gcacaccaactgaacacagctctga

SEQ ID NO: 556043 - DNA, 25 bp, Homo sapien
gaagcaaagtgtgtggacccaaaac

SEQ ID NO: 556044 - DNA, 25 bp, Homo sapien
gtgtgtggacccaaaactgccaagc

SEQ ID NO: 556045 - DNA, 25 bp, Homo sapien
ccaaaactgccaagcctgagtctgt

SEQ ID NO: 556046 - DNA, 25 bp, Homo sapien
tgagtctgtcccgtgcttctgctgc

SEQ ID NO: 556047 - DNA, 25 bp, Homo sapien
tgctccatcctttgagttctgcatt

SEQ ID NO: 556048 - DNA, 25 bp, Homo sapien
attgccatcctgacgtcggccacag

SEQ ID NO: 556049 - DNA, 25 bp, Homo sapien
gctttcttccagctgttgttctcaa

SEQ ID NO: 556050 - DNA, 25 bp, Homo sapien
cagctgttgttctcaagttccctgc

SEQ ID NO: 556051 - DNA, 25 bp, Homo sapien
gtgctgacttcctacaagaaaaaac

SEQ ID NO: 556052 - DNA, 25 bp, Homo sapien
gatttgttttaagatggtattgact

SEQ ID NO: 556053 - DNA, 25 bp, Homo sapien
acccgagtagcaaaggatcgaaggc

SEQ ID NO: 556054 - DNA, 25 bp, Homo sapien
caaaggatcgaaggcgactgtcgct

SEQ ID NO: 556055 - DNA, 25 bp, Homo sapien
ggatcgaaggcgactgtcgctacaa

SEQ ID NO: 556056 - DNA, 25 bp, Homo sapien
gaaggcgactgtcgctacaaccctc

SEQ ID NO: 556057 - DNA, 25 bp, Homo sapien
tcccccttgtaccagttctctgata

SEQ ID NO: 556058 - DNA, 25 bp, Homo sapien
gatggtattgacttatacagaagtg

SEQ ID NO: 556059 - DNA, 25 bp, Homo sapien
cttatacagaagtgaggcaggagaa

SEQ ID NO: 556060 - DNA, 25 bp, Homo sapien
caattcgtgctgacttcctacaaga

SEQ ID NO: 556061 - DNA, 25 bp, Homo sapien
attcgtgctgacttcctacaagaaa

SEQ ID NO: 556062 - DNA, 25 bp, Homo sapien
aatgtgcctgtcttcaattcacaag

SEQ ID NO: 556063 - DNA, 25 bp, Homo sapien
gggttataacaattatttgccagat

SEQ ID NO: 556064 - DNA, 25 bp, Homo sapien
tttgccagattaacactagggaatt

SEQ ID NO: 556065 - DNA, 25 bp, Homo sapien
ataaccagcttatcttatcagtagt

SEQ ID NO: 556066 - DNA, 25 bp, Homo sapien
cagtagttttattgctgatcaggca

SEQ ID NO: 556067 - DNA, 25 bp, Homo sapien
gctgatcaggcaaaaatagttttcc

SEQ ID NO: 556068 - DNA, 25 bp, Homo sapien
aacttagtgtgagtttgttcatcac

SEQ ID NO: 556069 - DNA, 25 bp, Homo sapien
gttcatcacaggtctgatatgagtt

SEQ ID NO: 556070 - DNA, 25 bp, Homo sapien
gtttaagggatttcgcactccctga

SEQ ID NO: 556071 - DNA, 25 bp, Homo sapien
atttcgcactccctgaatcagagaa

SEQ ID NO: 556072 - DNA, 25 bp, Homo sapien
cagagaagtaagaccccttccttag

SEQ ID NO: 556073 - DNA, 25 bp, Homo sapien
gtcattggtgccttattcttcagat

SEQ ID NO: 556074 - DNA, 25 bp, Homo sapien
tcttcagatgtttcagtctgtgatc

SEQ ID NO: 556075 - DNA, 25 bp, Homo sapien
ttcagatgtttcagtctgtgatctc

SEQ ID NO: 556076 - DNA, 25 bp, Homo sapien
tcagatgtttcagtctgtgatctcc

SEQ ID NO: 556077 - DNA, 25 bp, Homo sapien
cagatgtttcagtctgtgatctcct

SEQ ID NO: 556078 - DNA, 25 bp, Homo sapien
tctgtgatctcctaagcatcctgat

SEQ ID NO: 556079 - DNA, 25 bp, Homo sapien
agcatcctgatgttagtttttgact

SEQ ID NO: 556080 - DNA, 25 bp, Homo sapien
aaattgacctgcattctttactagc

SEQ ID NO: 556081 - DNA, 25 bp, Homo sapien
tctttactagcaattcaaacggtca

SEQ ID NO: 556082 - DNA, 25 bp, Homo sapien
caaacggtcagcactcttgtaagtg

SEQ ID NO: 556083 - DNA, 25 bp, Homo sapien
aaacggtcagcactcttgtaagtgt

SEQ ID NO: 556084 - DNA, 25 bp, Homo sapien
gggacttcgcacagcaccctgcagt

SEQ ID NO: 556085 - DNA, 25 bp, Homo sapien
tggatttccctttcttgctattctc

SEQ ID NO: 556086 - DNA, 25 bp, Homo sapien
ctctatcccccaaacatgctggaag

SEQ ID NO: 556087 - DNA, 25 bp, Homo sapien
gaaggcatcagcttatgagaaccca

SEQ ID NO: 556088 - DNA, 25 bp, Homo sapien
atcagcttatgagaacccacttttt

SEQ ID NO: 556089 - DNA, 25 bp, Homo sapien
aacccacttttttctgcatgactag

SEQ ID NO: 556090 - DNA, 25 bp, Homo sapien
tttctgcatgactagcttgtaagga

SEQ ID NO: 556091 - DNA, 25 bp, Homo sapien
gaatctatggacaggatttccaaga

SEQ ID NO: 556092 - DNA, 25 bp, Homo sapien
agacagaccttagcaagatgggcca

SEQ ID NO: 556093 - DNA, 25 bp, Homo sapien
accttagcaagatgggccaggactt

SEQ ID NO: 556094 - DNA, 25 bp, Homo sapien
caggacttgggacttcgcacagcac

SEQ ID NO: 556095 - DNA, 25 bp, Homo sapien
acaaagagccgttttaatgatgttg

SEQ ID NO: 556096 - DNA, 25 bp, Homo sapien
atgttgagtacatttggctgtttta

SEQ ID NO: 556097 - DNA, 25 bp, Homo sapien
gtttgcctaactcccaaactgttgg

SEQ ID NO: 556098 - DNA, 25 bp, Homo sapien
tgagggtcagtgatacatttggctg

SEQ ID NO: 556099 - DNA, 25 bp, Homo sapien
gatacatttggctgactctggttca

SEQ ID NO: 556100 - DNA, 25 bp, Homo sapien
ggctgactctggttcagtattctct

SEQ ID NO: 556101 - DNA, 25 bp, Homo sapien
ctctggttcagtattctcttaggtg

SEQ ID NO: 556102 - DNA, 25 bp, Homo sapien
ttctcttaggtgattatattctctc

SEQ ID NO: 556103 - DNA, 25 bp, Homo sapien
atattctctcatgtacagttacagg

SEQ ID NO: 556104 - DNA, 25 bp, Homo sapien
gaattcagaccaataaaatcaaggg

SEQ ID NO: 556105 - DNA, 25 bp, Homo sapien
tacaagttgattgcattacttctgt

SEQ ID NO: 556106 - DNA, 25 bp, Homo sapien
ggtggatcagaccaaagatggatta

SEQ ID NO: 556107 - DNA, 25 bp, Homo sapien
gaatttgttgcctttgaatctgtcc

SEQ ID NO: 556108 - DNA, 25 bp, Homo sapien
gtgcccctgatgctttgtttatggt

SEQ ID NO: 556109 - DNA, 25 bp, Homo sapien
gtttatggtagcctttcagctgttt

SEQ ID NO: 556110 - DNA, 25 bp, Homo sapien
agctgtttgacaaagctggcaaagg

SEQ ID NO: 556111 - DNA, 25 bp, Homo sapien
gttaagcaagtttttggacagacca

SEQ ID NO: 556112 - DNA, 25 bp, Homo sapien
ggacagaccacaattcatcaacata

SEQ ID NO: 556113 - DNA, 25 bp, Homo sapien
acatattccatttaactgggattca

SEQ ID NO: 556114 - DNA, 25 bp, Homo sapien
gattcagaatttgtgcaactacatt

SEQ ID NO: 556115 - DNA, 25 bp, Homo sapien
aaaagacacctgacatatgcggaat

SEQ ID NO: 556116 - DNA, 25 bp, Homo sapien
gacatatgcggaatttactcagttt

SEQ ID NO: 556117 - DNA, 25 bp, Homo sapien
agtcccaggagatccacaggtccgg

SEQ ID NO: 556118 - DNA, 25 bp, Homo sapien
aggagatccacaggtccggcatgaa

SEQ ID NO: 556119 - DNA, 25 bp, Homo sapien
gagatccacaggtccggcatgaaca

SEQ ID NO: 556120 - DNA, 25 bp, Homo sapien
agatccacaggtccggcatgaacag

SEQ ID NO: 556121 - DNA, 25 bp, Homo sapien
ccacaggtccggcatgaacagtgag

SEQ ID NO: 556122 - DNA, 25 bp, Homo sapien
atcagcagaggtcatgagaaggcca

SEQ ID NO: 556123 - DNA, 25 bp, Homo sapien
agcagaggtcatgagaaggccagaa

SEQ ID NO: 556124 - DNA, 25 bp, Homo sapien
agaaggccagaatccagggtcaggc

SEQ ID NO: 556125 - DNA, 25 bp, Homo sapien
aacaggaagtaaaatgggccgagat

SEQ ID NO: 556126 - DNA, 25 bp, Homo sapien
ccgagatggagcgagcccccagtgt

SEQ ID NO: 556127 - DNA, 25 bp, Homo sapien
gcgagcccccagtgtgcttccaagg

SEQ ID NO: 556128 - DNA, 25 bp, Homo sapien
tataataattgttgcctttccctcc

SEQ ID NO: 556129 - DNA, 25 bp, Homo sapien
tctccactaagccagcaactaaatg

SEQ ID NO: 556130 - DNA, 25 bp, Homo sapien
agccagcaactaaatgtattcagaa

SEQ ID NO: 556131 - DNA, 25 bp, Homo sapien
atcaaggagggcagaagaatttttt

SEQ ID NO: 556132 - DNA, 25 bp, Homo sapien
ctaagtttagatttattacctgtca

SEQ ID NO: 556133 - DNA, 25 bp, Homo sapien
attacctgtcatttagggcaaaaat

SEQ ID NO: 556134 - DNA, 25 bp, Homo sapien
gggcaaaaatccagtgtccccagca

SEQ ID NO: 556135 - DNA, 25 bp, Homo sapien
agtgtccccagcacatgatgaccca

SEQ ID NO: 556136 - DNA, 25 bp, Homo sapien
ccagcacatgatgacccaactttgt

SEQ ID NO: 556137 - DNA, 25 bp, Homo sapien
tgatgacccaactttgtctcacagt

SEQ ID NO: 556138 - DNA, 25 bp, Homo sapien
ccaactttgtctcacagttgcaagt

SEQ ID NO: 556139 - DNA, 25 bp, Homo sapien
gtgcagctggaagtcatcagtgagt

SEQ ID NO: 556140 - DNA, 25 bp, Homo sapien
agtcatcagtgagttctgcctcagt

SEQ ID NO: 556141 - DNA, 25 bp, Homo sapien
agtgagttctgcctcagtcagctcc

SEQ ID NO: 556142 - DNA, 25 bp, Homo sapien
aagtgaggacgcagtcacctttgaa

SEQ ID NO: 556143 - DNA, 25 bp, Homo sapien
gtcacctttgaagactccggaggct

SEQ ID NO: 556144 - DNA, 25 bp, Homo sapien
aatccctactgcagctgccgaggac

SEQ ID NO: 556145 - DNA, 25 bp, Homo sapien
gtgctgtgggccgttcggaaacacc

SEQ ID NO: 556146 - DNA, 25 bp, Homo sapien
ttcggaaacacctgcgccggctgta

SEQ ID NO: 556147 - DNA, 25 bp, Homo sapien
aggcacagacggcaccacgtccgat

SEQ ID NO: 556148 - DNA, 25 bp, Homo sapien
tgcagctgccgaggacggccgtcaa

SEQ ID NO: 556149 - DNA, 25 bp, Homo sapien
tcaagtctgtctccacgctcatggt

SEQ ID NO: 556150 - DNA, 25 bp, Homo sapien
gcttaccatcatcttagtgaccaag

SEQ ID NO: 556151 - DNA, 25 bp, Homo sapien
tagtgaccaaggcagcgaagctgtt

SEQ ID NO: 556152 - DNA, 25 bp, Homo sapien
gctgtttctgtaccttggaacagtc

SEQ ID NO: 556153 - DNA, 25 bp, Homo sapien
ttggaacagtcttccctgacaagcc

SEQ ID NO: 556154 - DNA, 25 bp, Homo sapien
gtgataaagccaccagccttgggat

SEQ ID NO: 556155 - DNA, 25 bp, Homo sapien
caccagccttgggatcaggactgaa

SEQ ID NO: 556156 - DNA, 25 bp, Homo sapien
ggagatttctcctgcgctaagccaa

SEQ ID NO: 556157 - DNA, 25 bp, Homo sapien
gagaaggtttcagcacttcagacag

SEQ ID NO: 556158 - DNA, 25 bp, Homo sapien
gctcccagctgcttgcagatgttga

SEQ ID NO: 556159 - DNA, 25 bp, Homo sapien
gaaagcctcggtttgtcttgaggtt

SEQ ID NO: 556160 - DNA, 25 bp, Homo sapien
ttgtcttgaggttgtcagcaggtgc

SEQ ID NO: 556161 - DNA, 25 bp, Homo sapien
gtatccaggatgacttgtgaatttc

SEQ ID NO: 556162 - DNA, 25 bp, Homo sapien
gaatttcacggactacagctaccag

SEQ ID NO: 556163 - DNA, 25 bp, Homo sapien
acagctaccagatgcgtttacccct

SEQ ID NO: 556164 - DNA, 25 bp, Homo sapien
cagatgcgtttacccctggtttcca

SEQ ID NO: 556165 - DNA, 25 bp, Homo sapien
tggtttccaggtctacagtttcgaa

SEQ ID NO: 556166 - DNA, 25 bp, Homo sapien
aggtctacagtttcgaagtctatta

SEQ ID NO: 556167 - DNA, 25 bp, Homo sapien
gttatcagaattactaagcaatccc

SEQ ID NO: 556168 - DNA, 25 bp, Homo sapien
aagcaatcccaacatgctgaccaat

SEQ ID NO: 556169 - DNA, 25 bp, Homo sapien
ctgaccaatgaacttaaagcggagt

SEQ ID NO: 556170 - DNA, 25 bp, Homo sapien
ggagttcctcatccttttacatatg

SEQ ID NO: 556171 - DNA, 25 bp, Homo sapien
agaagttactctcaatcaccttcct

SEQ ID NO: 556172 - DNA, 25 bp, Homo sapien
gacttgtagtcaggctttgctgttc

SEQ ID NO: 556173 - DNA, 25 bp, Homo sapien
ctttgctgttcgtcacagtgtcatt

SEQ ID NO: 556174 - DNA, 25 bp, Homo sapien
gtgtcattttccattcaggtaccat

SEQ ID NO: 556175 - DNA, 25 bp, Homo sapien
tggtcccatcaacaggtctagtatg

SEQ ID NO: 556176 - DNA, 25 bp, Homo sapien
gtctagtatgtagctcactgataac

SEQ ID NO: 556177 - DNA, 25 bp, Homo sapien
agaggaagatgtgtctcctcccacc

SEQ ID NO: 556178 - DNA, 25 bp, Homo sapien
ccaccctcttcctaatggtcattat

SEQ ID NO: 556179 - DNA, 25 bp, Homo sapien
ggtcattatgcctttctccatctat

SEQ ID NO: 556180 - DNA, 25 bp, Homo sapien
tttctccatctattgtctctttcac

SEQ ID NO: 556181 - DNA, 25 bp, Homo sapien
aattgttgactgcagtttcggaagt

SEQ ID NO: 556182 - DNA, 25 bp, Homo sapien
tcggaagtttgatctgagaaccaac

SEQ ID NO: 556183 - DNA, 25 bp, Homo sapien
atatactattggtttctcaattcga

SEQ ID NO: 556184 - DNA, 25 bp, Homo sapien
ctattggtttctcaattcgaatata

SEQ ID NO: 556185 - DNA, 25 bp, Homo sapien
tcgaatataaataagttgtctcaat

SEQ ID NO: 556186 - DNA, 25 bp, Homo sapien
gatgaagaccctattctacttcaat

SEQ ID NO: 556187 - DNA, 25 bp, Homo sapien
tgaagaccctattctacttcaatat

SEQ ID NO: 556188 - DNA, 25 bp, Homo sapien
ctacttcaatatgtgtttaaagtgt

SEQ ID NO: 556189 - DNA, 25 bp, Homo sapien
agtgtggagtataagctttaaagta

SEQ ID NO: 556190 - DNA, 25 bp, Homo sapien
ttaaagtaattctcattgggaagtt

SEQ ID NO: 556191 - DNA, 25 bp, Homo sapien
agtaaattgcttatgtagcttgctc

SEQ ID NO: 556192 - DNA, 25 bp, Homo sapien
atgtagcttgctcttcaaataggaa

SEQ ID NO: 556193 - DNA, 25 bp, Homo sapien
tttttagtgttgaaagatggatgca

SEQ ID NO: 556194 - DNA, 25 bp, Homo sapien
accatggttacagcggatgccccga

SEQ ID NO: 556195 - DNA, 25 bp, Homo sapien
atggttacagcggatgccccgagac

SEQ ID NO: 556196 - DNA, 25 bp, Homo sapien
atgccccgagactctgcttggtaaa

SEQ ID NO: 556197 - DNA, 25 bp, Homo sapien
cccgagactctgcttggtaaacgtg

SEQ ID NO: 556198 - DNA, 25 bp, Homo sapien
gagactctgcttggtaaacgtggca

SEQ ID NO: 556199 - DNA, 25 bp, Homo sapien
cttggtaaacgtggcagagcagaat

SEQ ID NO: 556200 - DNA, 25 bp, Homo sapien
gaggaagggcccctctcctggcatc

SEQ ID NO: 556201 - DNA, 25 bp, Homo sapien
gaagggcccctctcctggcatctgt

SEQ ID NO: 556202 - DNA, 25 bp, Homo sapien
tgtctcttgctacctaagcctgtgc

SEQ ID NO: 556203 - DNA, 25 bp, Homo sapien
tcttgctacctaagcctgtgcctct

SEQ ID NO: 556204 - DNA, 25 bp, Homo sapien
tgccgagccctggtctggccacgag

SEQ ID NO: 556205 - DNA, 25 bp, Homo sapien
gaatgaaggactaataacactgaat

SEQ ID NO: 556206 - DNA, 25 bp, Homo sapien
ttatctgcagatatgtacagaccac

SEQ ID NO: 556207 - DNA, 25 bp, Homo sapien
gtacagaccacatcctaagattgac

SEQ ID NO: 556208 - DNA, 25 bp, Homo sapien
catcctaagattgacttctgcctca

SEQ ID NO: 556209 - DNA, 25 bp, Homo sapien
cctaagattgacttctgcctcaaca

SEQ ID NO: 556210 - DNA, 25 bp, Homo sapien
agaaatacatgagccagtgccttat

SEQ ID NO: 556211 - DNA, 25 bp, Homo sapien
gagccagtgccttattggaaatgat

SEQ ID NO: 556212 - DNA, 25 bp, Homo sapien
gcgtcgtcgctctagccagtaaatg

SEQ ID NO: 556213 - DNA, 25 bp, Homo sapien
gctctagccagtaaatgacctgcga

SEQ ID NO: 556214 - DNA, 25 bp, Homo sapien
aatgacctgcgacataactatttgc

SEQ ID NO: 556215 - DNA, 25 bp, Homo sapien
gcgacataactatttgcaaaacaaa

SEQ ID NO: 556216 - DNA, 25 bp, Homo sapien
ttgtaccttaaaccagtagctctca

SEQ ID NO: 556217 - DNA, 25 bp, Homo sapien
gtagctctcaaattttagtataaaa

SEQ ID NO: 556218 - DNA, 25 bp, Homo sapien
aaatcagttgtagacaccaccctca

SEQ ID NO: 556219 - DNA, 25 bp, Homo sapien
gtagacaccaccctcagagattctg

SEQ ID NO: 556220 - DNA, 25 bp, Homo sapien
attaggtagatctggagtagaccca

SEQ ID NO: 556221 - DNA, 25 bp, Homo sapien
gagtagacccagaaatacacagttt

SEQ ID NO: 556222 - DNA, 25 bp, Homo sapien
ggttcaaacatcctgatcatcctag

SEQ ID NO: 556223 - DNA, 25 bp, Homo sapien
atcctgatcatcctaggcaaacatt

SEQ ID NO: 556224 - DNA, 25 bp, Homo sapien
ggcaaacattgacaaatactgctct

SEQ ID NO: 556225 - DNA, 25 bp, Homo sapien
aatactgctctgaatcctgttctat

SEQ ID NO: 556226 - DNA, 25 bp, Homo sapien
gctctgaatcctgttctatagatat

SEQ ID NO: 556227 - DNA, 25 bp, Homo sapien
acgccgtcgccacctgctgggagaa

SEQ ID NO: 556228 - DNA, 25 bp, Homo sapien
tcgccacctgctgggagaagctctt

SEQ ID NO: 556229 - DNA, 25 bp, Homo sapien
ctgctgggagaagctcttcgcgctg

SEQ ID NO: 556230 - DNA, 25 bp, Homo sapien
gtagagcctggagacgcgcctcgtt

SEQ ID NO: 556231 - DNA, 25 bp, Homo sapien
tggagacgcgcctcgttctgtagac

SEQ ID NO: 556232 - DNA, 25 bp, Homo sapien
acgcgcctcgttctgtagacttgtt

SEQ ID NO: 556233 - DNA, 25 bp, Homo sapien
gttctgtagacttgttggtgacctc

SEQ ID NO: 556234 - DNA, 25 bp, Homo sapien
gtagacttgttggtgacctcggccc

SEQ ID NO: 556235 - DNA, 25 bp, Homo sapien
aggacttggagaagggagcgcgcct

SEQ ID NO: 556236 - DNA, 25 bp, Homo sapien
tccacgcgccgaaggcctcaataaa

SEQ ID NO: 556237 - DNA, 25 bp, Homo sapien
ggcctcaataaacggagctggcgct

SEQ ID NO: 556238 - DNA, 25 bp, Homo sapien
gcaagcctgcctggtaaagagtatc

SEQ ID NO: 556239 - DNA, 25 bp, Homo sapien
agcccctgtgtatttctttctggag

SEQ ID NO: 556240 - DNA, 25 bp, Homo sapien
tttctttctggaggctctggcaaaa

SEQ ID NO: 556241 - DNA, 25 bp, Homo sapien
gcaaaaacccacttccaggctctgt

SEQ ID NO: 556242 - DNA, 25 bp, Homo sapien
aggctctgtcatgtcgttagcagaa

SEQ ID NO: 556243 - DNA, 25 bp, Homo sapien
gtcgttagcagaatgcacttccttt

SEQ ID NO: 556244 - DNA, 25 bp, Homo sapien
atgcacttccttttggctgtaggac

SEQ ID NO: 556245 - DNA, 25 bp, Homo sapien
cagggcacattctcagaccacatgc

SEQ ID NO: 556246 - DNA, 25 bp, Homo sapien
atctcaagtgagcaactctctctca

SEQ ID NO: 556247 - DNA, 25 bp, Homo sapien
atgttgactcctccttacctttctg

SEQ ID NO: 556248 - DNA, 25 bp, Homo sapien
ttacctttctgatctctctgacata

SEQ ID NO: 556249 - DNA, 25 bp, Homo sapien
tgcttgcctgtgagttggcatttct

SEQ ID NO: 556250 - DNA, 25 bp, Homo sapien
tgtgagttggcatttctcctccatg

SEQ ID NO: 556251 - DNA, 25 bp, Homo sapien
gcaagctgcttttcgtgtgttacat

SEQ ID NO: 556252 - DNA, 25 bp, Homo sapien
gtgttacatggagtcgattcctaac

SEQ ID NO: 556253 - DNA, 25 bp, Homo sapien
gtcgattcctaacaggttgactaag

SEQ ID NO: 556254 - DNA, 25 bp, Homo sapien
gttaggatagtagttccctgtgatg

SEQ ID NO: 556255 - DNA, 25 bp, Homo sapien
gagaaggtgtaccaaacaactgggc

SEQ ID NO: 556256 - DNA, 25 bp, Homo sapien
aaacaactgggcacaccagagctcc

SEQ ID NO: 556257 - DNA, 25 bp, Homo sapien
ccagagctcccaatcttcaatatgt

SEQ ID NO: 556258 - DNA, 25 bp, Homo sapien
atactttttcatacaccgacatcct

SEQ ID NO: 556259 - DNA, 25 bp, Homo sapien
ttttttgtcatcactgtgcttgcct

SEQ ID NO: 556260 - DNA, 25 bp, Homo sapien
atactttttaagctaatgtctcaat

SEQ ID NO: 556261 - DNA, 25 bp, Homo sapien
atatttaatcttcagtgcgctagac

SEQ ID NO: 556262 - DNA, 25 bp, Homo sapien
ttaatcttcagtgcgctagaccaat

SEQ ID NO: 556263 - DNA, 25 bp, Homo sapien
gctagaccaatccatttaaatgaat

SEQ ID NO: 556264 - DNA, 25 bp, Homo sapien
agttctgaagattttaagtatggga

SEQ ID NO: 556265 - DNA, 25 bp, Homo sapien
gtatacttttctttacaagatcctt

SEQ ID NO: 556266 - DNA, 25 bp, Homo sapien
tttacaagatccttttcttactgtg

SEQ ID NO: 556267 - DNA, 25 bp, Homo sapien
tcttactgtgtatctaatcataggt

SEQ ID NO: 556268 - DNA, 25 bp, Homo sapien
ataggtataatttggtgaccatggt

SEQ ID NO: 556269 - DNA, 25 bp, Homo sapien
gatttccatttgtttcatgttagaa

SEQ ID NO: 556270 - DNA, 25 bp, Homo sapien
aacagtactaaactgttctgtgacc

SEQ ID NO: 556271 - DNA, 25 bp, Homo sapien
cagacactccagttgggtcttttat

SEQ ID NO: 556272 - DNA, 25 bp, Homo sapien
ctccagttgggtcttttatataaat

SEQ ID NO: 556273 - DNA, 25 bp, Homo sapien
aatggcaaaaggctccatacccttc

SEQ ID NO: 556274 - DNA, 25 bp, Homo sapien
gggaatgatgataacacccacttca

SEQ ID NO: 556275 - DNA, 25 bp, Homo sapien
acacccacttcatagaatggtcatg

SEQ ID NO: 556276 - DNA, 25 bp, Homo sapien
agaataaaagtcaagcacttagcct

SEQ ID NO: 556277 - DNA, 25 bp, Homo sapien
gcctctggtgcacaataagtattaa

SEQ ID NO: 556278 - DNA, 25 bp, Homo sapien
taaataagtatacctattcctcctt

SEQ ID NO: 556279 - DNA, 25 bp, Homo sapien
taatattaccaaatgtccagcttat

SEQ ID NO: 556280 - DNA, 25 bp, Homo sapien
tgtccagcttatacacatttacaag

SEQ ID NO: 556281 - DNA, 25 bp, Homo sapien
tacacatttacaagacttagctagt

SEQ ID NO: 556282 - DNA, 25 bp, Homo sapien
aaatgttccagtgactatgactgca

SEQ ID NO: 556283 - DNA, 25 bp, Homo sapien
gttccagtgactatgactgcaagat

SEQ ID NO: 556284 - DNA, 25 bp, Homo sapien
gactatgactgcaagatcactgtgt

SEQ ID NO: 556285 - DNA, 25 bp, Homo sapien
gactgcaagatcactgtgtgcagaa

SEQ ID NO: 556286 - DNA, 25 bp, Homo sapien
tgtgtgcagaaatctctagaaatgt

SEQ ID NO: 556287 - DNA, 25 bp, Homo sapien
gaaatctctagaaatgtgtgtcttg

SEQ ID NO: 556288 - DNA, 25 bp, Homo sapien
agaaatgtgtgtcttgtagctcaag

SEQ ID NO: 556289 - DNA, 25 bp, Homo sapien
agctcaagttattactagagacaac

SEQ ID NO: 556290 - DNA, 25 bp, Homo sapien
gacaacaagggttttgtggattcct

SEQ ID NO: 556291 - DNA, 25 bp, Homo sapien
agggttttgtggattcctgtagcct

SEQ ID NO: 556292 - DNA, 25 bp, Homo sapien
ggttttgtggattcctgtagcctct

SEQ ID NO: 556293 - DNA, 25 bp, Homo sapien
aaatttcttggctactgactttaat

SEQ ID NO: 556294 - DNA, 25 bp, Homo sapien
aatggactttcatggcgttcacagc

SEQ ID NO: 556295 - DNA, 25 bp, Homo sapien
tgggatggcccacgtcatctttaac

SEQ ID NO: 556296 - DNA, 25 bp, Homo sapien
gtcatctttaaccttgaactcactg

SEQ ID NO: 556297 - DNA, 25 bp, Homo sapien
aaccttgaactcactgatgtttgaa

SEQ ID NO: 556298 - DNA, 25 bp, Homo sapien
ctggcttagccatattgaatttcaa

SEQ ID NO: 556299 - DNA, 25 bp, Homo sapien
ataagtgttcaatggtgttagttac

SEQ ID NO: 556300 - DNA, 25 bp, Homo sapien
gctagttatagtatcctctgagtaa

SEQ ID NO: 556301 - DNA, 25 bp, Homo sapien
gtatcctctgagtaagctgatccat

SEQ ID NO: 556302 - DNA, 25 bp, Homo sapien
gtaagctgatccatcttttggcaaa

SEQ ID NO: 556303 - DNA, 25 bp, Homo sapien
atgttgtgagagacttttcatttga

SEQ ID NO: 556304 - DNA, 25 bp, Homo sapien
agacccctggtctgcccatggatct

SEQ ID NO: 556305 - DNA, 25 bp, Homo sapien
atattttgaaaccacatttcttaag

SEQ ID NO: 556306 - DNA, 25 bp, Homo sapien
gggtatgccaattacacttacaata

SEQ ID NO: 556307 - DNA, 25 bp, Homo sapien
aataaggctcatcagtggtatccag

SEQ ID NO: 556308 - DNA, 25 bp, Homo sapien
gctcatcagtggtatccagttgcct

SEQ ID NO: 556309 - DNA, 25 bp, Homo sapien
tatccagttgcctcttactcattca

SEQ ID NO: 556310 - DNA, 25 bp, Homo sapien
gcctcttactcattcatcatctaac

SEQ ID NO: 556311 - DNA, 25 bp, Homo sapien
tactcattcatcatctaacaaaggt

SEQ ID NO: 556312 - DNA, 25 bp, Homo sapien
ttggtgttccaaatgatcaaatgaa

SEQ ID NO: 556313 - DNA, 25 bp, Homo sapien
aatgaagcagcagactcgtgtaatt

SEQ ID NO: 556314 - DNA, 25 bp, Homo sapien
gcagcagactcgtgtaattaaaaaa

SEQ ID NO: 556315 - DNA, 25 bp, Homo sapien
acatatgtacagtatcagtagggaa

SEQ ID NO: 556316 - DNA, 25 bp, Homo sapien
agatgttgttttcttttgtcattta

SEQ ID NO: 556317 - DNA, 25 bp, Homo sapien
tcttttgtcatttaattaggccatc

SEQ ID NO: 556318 - DNA, 25 bp, Homo sapien
ttgtcatttaattaggccatctgtc

SEQ ID NO: 556319 - DNA, 25 bp, Homo sapien
gtcatttaattaggccatctgtcct

SEQ ID NO: 556320 - DNA, 25 bp, Homo sapien
atttaattaggccatctgtcctgtt

SEQ ID NO: 556321 - DNA, 25 bp, Homo sapien
ttaattaggccatctgtcctgtttt

SEQ ID NO: 556322 - DNA, 25 bp, Homo sapien
attaggccatctgtcctgttttaaa

SEQ ID NO: 556323 - DNA, 25 bp, Homo sapien
aggccatctgtcctgttttaaagaa

SEQ ID NO: 556324 - DNA, 25 bp, Homo sapien
gccatctgtcctgttttaaagaaat

SEQ ID NO: 556325 - DNA, 25 bp, Homo sapien
tttcttccagaatgtgtactttata

SEQ ID NO: 556326 - DNA, 25 bp, Homo sapien
cattctgcgtgtcctcccccacgcc

SEQ ID NO: 556327 - DNA, 25 bp, Homo sapien
attctgcgtgtcctcccccacgcca

SEQ ID NO: 556328 - DNA, 25 bp, Homo sapien
ttctgcgtgtcctcccccacgccac

SEQ ID NO: 556329 - DNA, 25 bp, Homo sapien
gtgtcctcccccacgccacctgtgt

SEQ ID NO: 556330 - DNA, 25 bp, Homo sapien
tgtcctcccccacgccacctgtgtc

SEQ ID NO: 556331 - DNA, 25 bp, Homo sapien
gtcctcccccacgccacctgtgtcg

SEQ ID NO: 556332 - DNA, 25 bp, Homo sapien
tcctcccccacgccacctgtgtcgg

SEQ ID NO: 556333 - DNA, 25 bp, Homo sapien
cctcccccacgccacctgtgtcggg

SEQ ID NO: 556334 - DNA, 25 bp, Homo sapien
cagaagcctctgcccttgcactacc

SEQ ID NO: 556335 - DNA, 25 bp, Homo sapien
atgctgaagtgctagcctaagctca

SEQ ID NO: 556336 - DNA, 25 bp, Homo sapien
taagctcactaacctgccaacttag

SEQ ID NO: 556337 - DNA, 25 bp, Homo sapien
gaaggtaaccatggctaggatgact

SEQ ID NO: 556338 - DNA, 25 bp, Homo sapien
atgactgggaatctgatggactcaa

SEQ ID NO: 556339 - DNA, 25 bp, Homo sapien
aaaactccttagtggcaagaggcca

SEQ ID NO: 556340 - DNA, 25 bp, Homo sapien
gaggccaaagatggtcagcgaattg

SEQ ID NO: 556341 - DNA, 25 bp, Homo sapien
agcgaattgttgtttccggctgttg

SEQ ID NO: 556342 - DNA, 25 bp, Homo sapien
tttccggctgttggaagttgactgc

SEQ ID NO: 556343 - DNA, 25 bp, Homo sapien
ggccagtccctgagtaggaatggac

SEQ ID NO: 556344 - DNA, 25 bp, Homo sapien
tggacaacaaggtggtcaccatgct

SEQ ID NO: 556345 - DNA, 25 bp, Homo sapien
tgctgacagctattccctgtgtgat

SEQ ID NO: 556346 - DNA, 25 bp, Homo sapien
aagagccggttttatcctcgtcatt

SEQ ID NO: 556347 - DNA, 25 bp, Homo sapien
agagccggttttatcctcgtcattc

SEQ ID NO: 556348 - DNA, 25 bp, Homo sapien
gagccggttttatcctcgtcattct

SEQ ID NO: 556349 - DNA, 25 bp, Homo sapien
agccggttttatcctcgtcattctg

SEQ ID NO: 556350 - DNA, 25 bp, Homo sapien
cggttttatcctcgtcattctgcgt

SEQ ID NO: 556351 - DNA, 25 bp, Homo sapien
ggttttatcctcgtcattctgcgtg

SEQ ID NO: 556352 - DNA, 25 bp, Homo sapien
gttttatcctcgtcattctgcgtgt

SEQ ID NO: 556353 - DNA, 25 bp, Homo sapien
ttttatcctcgtcattctgcgtgtc

SEQ ID NO: 556354 - DNA, 25 bp, Homo sapien
ttatcctcgtcattctgcgtgtcct

SEQ ID NO: 556355 - DNA, 25 bp, Homo sapien
tgcccttgcactaccttgtctgtca

SEQ ID NO: 556356 - DNA, 25 bp, Homo sapien
tgactcctgcctgatagctcctgtg

SEQ ID NO: 556357 - DNA, 25 bp, Homo sapien
aaacttctgggaacagattttaatg

SEQ ID NO: 556358 - DNA, 25 bp, Homo sapien
gaatgtttacattccatccaattta

SEQ ID NO: 556359 - DNA, 25 bp, Homo sapien
gtttacattccatccaatttacctt

SEQ ID NO: 556360 - DNA, 25 bp, Homo sapien
catccaatttacctttatacctaga

SEQ ID NO: 556361 - DNA, 25 bp, Homo sapien
aggttttattcagctgagtatggaa

SEQ ID NO: 556362 - DNA, 25 bp, Homo sapien
aactatggctgagcaattgtgtatt

SEQ ID NO: 556363 - DNA, 25 bp, Homo sapien
ggctgagcaattgtgtatttgagta

SEQ ID NO: 556364 - DNA, 25 bp, Homo sapien
attttatagtattcaaacccatgga

SEQ ID NO: 556365 - DNA, 25 bp, Homo sapien
aaacccatggaatagtctttgataa

SEQ ID NO: 556366 - DNA, 25 bp, Homo sapien
aaaatgttaccgactatatagtagg

SEQ ID NO: 556367 - DNA, 25 bp, Homo sapien
gtaggatagctctaaattactaaaa

SEQ ID NO: 556368 - DNA, 25 bp, Homo sapien
gtcacatccaccatagcgtgtatca

SEQ ID NO: 556369 - DNA, 25 bp, Homo sapien
gcgtgtatcatgcaacagacccgtg

SEQ ID NO: 556370 - DNA, 25 bp, Homo sapien
aacagacccgtgctcttagagggag

SEQ ID NO: 556371 - DNA, 25 bp, Homo sapien
tagtgtgtgtcttcccatggcaaat

SEQ ID NO: 556372 - DNA, 25 bp, Homo sapien
ttaatgtgtgtctacagggcatgct

SEQ ID NO: 556373 - DNA, 25 bp, Homo sapien
cagggcatgctgttgtctcaaaatt

SEQ ID NO: 556374 - DNA, 25 bp, Homo sapien
ttaggtatcagttcccagcctcaga

SEQ ID NO: 556375 - DNA, 25 bp, Homo sapien
tctcaggcaggtggaccggatctca

SEQ ID NO: 556376 - DNA, 25 bp, Homo sapien
gaccggatctcagctgcagaacata

SEQ ID NO: 556377 - DNA, 25 bp, Homo sapien
tagtgagtggccaaacctacacagc

SEQ ID NO: 556378 - DNA, 25 bp, Homo sapien
acacagcccagccagtagtgtgctt

SEQ ID NO: 556379 - DNA, 25 bp, Homo sapien
aggacttcctccctctaaggagctc

SEQ ID NO: 556380 - DNA, 25 bp, Homo sapien
tccctcagcctagagaaggacaact

SEQ ID NO: 556381 - DNA, 25 bp, Homo sapien
agagaaggacaactgcttccccttg

SEQ ID NO: 556382 - DNA, 25 bp, Homo sapien
gaaggacaactgcttccccttgggc

SEQ ID NO: 556383 - DNA, 25 bp, Homo sapien
cacctccttgaggaaagaactggga

SEQ ID NO: 556384 - DNA, 25 bp, Homo sapien
gttggtgtcaaaggcattgaagaga

SEQ ID NO: 556385 - DNA, 25 bp, Homo sapien
gaactgggagtaaatctgcttgaag

SEQ ID NO: 556386 - DNA, 25 bp, Homo sapien
aatctgcttgaagttctcctcattg

SEQ ID NO: 556387 - DNA, 25 bp, Homo sapien
ctcattgacaattccgctgggacat

SEQ ID NO: 556388 - DNA, 25 bp, Homo sapien
gacaattccgctgggacattcctgg

SEQ ID NO: 556389 - DNA, 25 bp, Homo sapien
aaaagtggcataggtgctggagtct

SEQ ID NO: 556390 - DNA, 25 bp, Homo sapien
gtagatcaataaaccaaactccctg

SEQ ID NO: 556391 - DNA, 25 bp, Homo sapien
atcaataaaccaaactccctgtcac

SEQ ID NO: 556392 - DNA, 25 bp, Homo sapien
acctcagactctgcacctgttaaag

SEQ ID NO: 556393 - DNA, 25 bp, Homo sapien
agactctgcacctgttaaagccctg

SEQ ID NO: 556394 - DNA, 25 bp, Homo sapien
ctgcacctgttaaagccctgtaaag

SEQ ID NO: 556395 - DNA, 25 bp, Homo sapien
tgttaaagccctgtaaagagccgac

SEQ ID NO: 556396 - DNA, 25 bp, Homo sapien
agccctgtaaagagccgacatgtaa

SEQ ID NO: 556397 - DNA, 25 bp, Homo sapien
agagccgacatgtaaggacttatac

SEQ ID NO: 556398 - DNA, 25 bp, Homo sapien
ggacttatactgactggatacagag

SEQ ID NO: 556399 - DNA, 25 bp, Homo sapien
gactggatacagagaatatggagca

SEQ ID NO: 556400 - DNA, 25 bp, Homo sapien
atatggagcaaatcaaacgtattta

SEQ ID NO: 556401 - DNA, 25 bp, Homo sapien
tcaatgagtactctcacatgttacc

SEQ ID NO: 556402 - DNA, 25 bp, Homo sapien
caatgagtactctcacatgttacct

SEQ ID NO: 556403 - DNA, 25 bp, Homo sapien
aatgagtactctcacatgttacctc

SEQ ID NO: 556404 - DNA, 25 bp, Homo sapien
atgagtactctcacatgttacctct

SEQ ID NO: 556405 - DNA, 25 bp, Homo sapien
tgagtactctcacatgttacctctt

SEQ ID NO: 556406 - DNA, 25 bp, Homo sapien
gagtactctcacatgttacctctta

SEQ ID NO: 556407 - DNA, 25 bp, Homo sapien
agtactctcacatgttacctcttaa

SEQ ID NO: 556408 - DNA, 25 bp, Homo sapien
gtactctcacatgttacctcttaaa

SEQ ID NO: 556409 - DNA, 25 bp, Homo sapien
tactctcacatgttacctcttaaat

SEQ ID NO: 556410 - DNA, 25 bp, Homo sapien
ctcacatgttacctcttaaatgtac

SEQ ID NO: 556411 - DNA, 25 bp, Homo sapien
cctgccactagccagtgagggaaat

SEQ ID NO: 556412 - DNA, 25 bp, Homo sapien
ccactagccagtgagggaaatagat

SEQ ID NO: 556413 - DNA, 25 bp, Homo sapien
gatgaaatagatctgactctacctt

SEQ ID NO: 556414 - DNA, 25 bp, Homo sapien
agatctgactctaccttgaaggtct

SEQ ID NO: 556415 - DNA, 25 bp, Homo sapien
gactctaccttgaaggtctgcagca

SEQ ID NO: 556416 - DNA, 25 bp, Homo sapien
tctaccttgaaggtctgcagcaggg

SEQ ID NO: 556417 - DNA, 25 bp, Homo sapien
gggtcagcaaacttctagccctcag

SEQ ID NO: 556418 - DNA, 25 bp, Homo sapien
aaacttctagccctcaggtcaatag

SEQ ID NO: 556419 - DNA, 25 bp, Homo sapien
ttctagccctcaggtcaatagcctg

SEQ ID NO: 556420 - DNA, 25 bp, Homo sapien
aggtcaatagcctgccgcctgtttt

SEQ ID NO: 556421 - DNA, 25 bp, Homo sapien
gaatgatttgtacgtttttcaatgt

SEQ ID NO: 556422 - DNA, 25 bp, Homo sapien
tgtgccccttcgatggttgtaataa

SEQ ID NO: 556423 - DNA, 25 bp, Homo sapien
gttgtaataagaagtttgctcagtc

SEQ ID NO: 556424 - DNA, 25 bp, Homo sapien
tttgctcagtcaactaacctgaaat

SEQ ID NO: 556425 - DNA, 25 bp, Homo sapien
gaaatctcacatcttaacacatgct

SEQ ID NO: 556426 - DNA, 25 bp, Homo sapien
ttaacacatgctaaggccaaaaaca

SEQ ID NO: 556427 - DNA, 25 bp, Homo sapien
gagagaagacccttctcgaccacgg

SEQ ID NO: 556428 - DNA, 25 bp, Homo sapien
agcatcttccagaagtgtgattggg

SEQ ID NO: 556429 - DNA, 25 bp, Homo sapien
gggaataaatatgcctctcctttgt

SEQ ID NO: 556430 - DNA, 25 bp, Homo sapien
tatgcctctcctttgtatattattt

SEQ ID NO: 556431 - DNA, 25 bp, Homo sapien
aaatgaatcctacacacctaaggga

SEQ ID NO: 556432 - DNA, 25 bp, Homo sapien
acacacctaagggacatgttttgat

SEQ ID NO: 556433 - DNA, 25 bp, Homo sapien
gcttgagagaattgattaaactact

SEQ ID NO: 556434 - DNA, 25 bp, Homo sapien
gattaaactacttggttagcacaga

SEQ ID NO: 556435 - DNA, 25 bp, Homo sapien
ggttagcacagatagagctgaatca

SEQ ID NO: 556436 - DNA, 25 bp, Homo sapien
gatggtaagctaagtaattttacac

SEQ ID NO: 556437 - DNA, 25 bp, Homo sapien
ggcagagttgcattcataattagtc

SEQ ID NO: 556438 - DNA, 25 bp, Homo sapien
gcattcataattagtctctccttca

SEQ ID NO: 556439 - DNA, 25 bp, Homo sapien
ataattagtctctccttcagactga

SEQ ID NO: 556440 - DNA, 25 bp, Homo sapien
agtctctccttcagactgaatatta

SEQ ID NO: 556441 - DNA, 25 bp, Homo sapien
caaaatatagccattggtgttgcaa

SEQ ID NO: 556442 - DNA, 25 bp, Homo sapien
aaaacctgtcatgttactaagagca

SEQ ID NO: 556443 - DNA, 25 bp, Homo sapien
actaagagcaggagatgaggcagcc

SEQ ID NO: 556444 - DNA, 25 bp, Homo sapien
gaaaaatcatgactgatcgcataat

SEQ ID NO: 556445 - DNA, 25 bp, Homo sapien
gactgatcgcataatttttaatgta

SEQ ID NO: 556446 - DNA, 25 bp, Homo sapien
aaatgagctcactaagggtaattaa

SEQ ID NO: 556447 - DNA, 25 bp, Homo sapien
gttctcacgaatattagtgcatctt

SEQ ID NO: 556448 - DNA, 25 bp, Homo sapien
gcatcttgtcactttgatttgtcac

SEQ ID NO: 556449 - DNA, 25 bp, Homo sapien
gtcactttgatttgtcacctggtta

SEQ ID NO: 556450 - DNA, 25 bp, Homo sapien
ttgtcacctggttaaatagctggaa

SEQ ID NO: 556451 - DNA, 25 bp, Homo sapien
tagctggaagcttgtgcaaatgaaa

SEQ ID NO: 556452 - DNA, 25 bp, Homo sapien
tactagtaggttcagagagagatct

SEQ ID NO: 556453 - DNA, 25 bp, Homo sapien
gagagatctgagatgttccttaaca

SEQ ID NO: 556454 - DNA, 25 bp, Homo sapien
gatgttccttaacatgtagccatgt

SEQ ID NO: 556455 - DNA, 25 bp, Homo sapien
ttaccactttttgtattgcatccat

SEQ ID NO: 556456 - DNA, 25 bp, Homo sapien
attgcatccatataagagtgtctta

SEQ ID NO: 556457 - DNA, 25 bp, Homo sapien
gagtgtcttactagccagatgattc

SEQ ID NO: 556458 - DNA, 25 bp, Homo sapien
ggcaaatgattctctgggtccaaag

SEQ ID NO: 556459 - DNA, 25 bp, Homo sapien
atgagtagcttattacatctgcaga

SEQ ID NO: 556460 - DNA, 25 bp, Homo sapien
gcaacaactccactgctagttacag

SEQ ID NO: 556461 - DNA, 25 bp, Homo sapien
tgctagttacagctctccgtaggac

SEQ ID NO: 556462 - DNA, 25 bp, Homo sapien
tctccgtaggaccaccaaaacgtat

SEQ ID NO: 556463 - DNA, 25 bp, Homo sapien
gtattcaagagctctaggattccat

SEQ ID NO: 556464 - DNA, 25 bp, Homo sapien
ttacatctgcagagctaccttatta

SEQ ID NO: 556465 - DNA, 25 bp, Homo sapien
agagtaaggaccacatgattgcttt

SEQ ID NO: 556466 - DNA, 25 bp, Homo sapien
tgtgctaaaggcagctctggtccat

SEQ ID NO: 556467 - DNA, 25 bp, Homo sapien
gcagctctggtccattcggatgatg

SEQ ID NO: 556468 - DNA, 25 bp, Homo sapien
ggtccattcggatgatgaagtgttt

SEQ ID NO: 556469 - DNA, 25 bp, Homo sapien
gaggattgaatgctctagttcagct

SEQ ID NO: 556470 - DNA, 25 bp, Homo sapien
atgctctagttcagctaagtgtcgt

SEQ ID NO: 556471 - DNA, 25 bp, Homo sapien
ttcagctaagtgtcgttgttggtcc

SEQ ID NO: 556472 - DNA, 25 bp, Homo sapien
ctaagtgtcgttgttggtccttctc

SEQ ID NO: 556473 - DNA, 25 bp, Homo sapien
gtccttctctaaacgaccatctgaa

SEQ ID NO: 556474 - DNA, 25 bp, Homo sapien
atactgctccatatgctgttgaaga

SEQ ID NO: 556475 - DNA, 25 bp, Homo sapien
gttttttctacctgttgacgtgtca

SEQ ID NO: 556476 - DNA, 25 bp, Homo sapien
tctacctgttgacgtgtcaagcact

SEQ ID NO: 556477 - DNA, 25 bp, Homo sapien
caaaattgtatagcatgtgactctt

SEQ ID NO: 556478 - DNA, 25 bp, Homo sapien
agcatgtgactcttttggctttcag

SEQ ID NO: 556479 - DNA, 25 bp, Homo sapien
tggctttcagagttctcaaaaatat

SEQ ID NO: 556480 - DNA, 25 bp, Homo sapien
gtactgtatgtttagaggcaaccaa

SEQ ID NO: 556481 - DNA, 25 bp, Homo sapien
aggcaaccaattatatactcaatat

SEQ ID NO: 556482 - DNA, 25 bp, Homo sapien
aatatggttttactgtgccttacac

SEQ ID NO: 556483 - DNA, 25 bp, Homo sapien
gtgccttacacaaagagaaactcta

SEQ ID NO: 556484 - DNA, 25 bp, Homo sapien
agagtctttactgcactgttaggtg

SEQ ID NO: 556485 - DNA, 25 bp, Homo sapien
ctgcactgttaggtgatggcacaca

SEQ ID NO: 556486 - DNA, 25 bp, Homo sapien
taatagagcctagcagttactttgt

SEQ ID NO: 556487 - DNA, 25 bp, Homo sapien
gttaatttaccaccatacattttat

SEQ ID NO: 556488 - DNA, 25 bp, Homo sapien
gtctctgagctcagtcttaccaaat

SEQ ID NO: 556489 - DNA, 25 bp, Homo sapien
tgagctcagtcttaccaaattcgcc

SEQ ID NO: 556490 - DNA, 25 bp, Homo sapien
aaattcgccctttaacagcttgctc

SEQ ID NO: 556491 - DNA, 25 bp, Homo sapien
gccctttaacagcttgctctggcaa

SEQ ID NO: 556492 - DNA, 25 bp, Homo sapien
cttgctctggcaaccccataaatga

SEQ ID NO: 556493 - DNA, 25 bp, Homo sapien
aatgacacctgagctccgtagaagc

SEQ ID NO: 556494 - DNA, 25 bp, Homo sapien
agctccgtagaagctaagctcctga

SEQ ID NO: 556495 - DNA, 25 bp, Homo sapien
agaagctaagctcctgagacccagg

SEQ ID NO: 556496 - DNA, 25 bp, Homo sapien
catgcttagccccagctttttggaa

SEQ ID NO: 556497 - DNA, 25 bp, Homo sapien
tgctgcaaagattcaggtggaccct

SEQ ID NO: 556498 - DNA, 25 bp, Homo sapien
agattcaggtggaccctcctctaat

SEQ ID NO: 556499 - DNA, 25 bp, Homo sapien
atcaagacccgcacgcgcaggaaca

SEQ ID NO: 556500 - DNA, 25 bp, Homo sapien
tggagacttggaagccgccaccacc

SEQ ID NO: 556501 - DNA, 25 bp, Homo sapien
acccgcacgcgcaggaacaagggtt

SEQ ID NO: 556502 - DNA, 25 bp, Homo sapien
gacccgtaaggatggcttgcatgga

SEQ ID NO: 556503 - DNA, 25 bp, Homo sapien
gcatggagatggtcctcgcgaacga

SEQ ID NO: 556504 - DNA, 25 bp, Homo sapien
gatggtcctcgcgaacgagctacag

SEQ ID NO: 556505 - DNA, 25 bp, Homo sapien
gaacgagctacagctaccgtgcctg

SEQ ID NO: 556506 - DNA, 25 bp, Homo sapien
tacagctaccgtgcctgacagcagt

SEQ ID NO: 556507 - DNA, 25 bp, Homo sapien
accaccattaccttctgaacggcag

SEQ ID NO: 556508 - DNA, 25 bp, Homo sapien
attaccttctgaacggcagccggcg

SEQ ID NO: 556509 - DNA, 25 bp, Homo sapien
gcagccggcggaccgcagaatcact

SEQ ID NO: 556510 - DNA, 25 bp, Homo sapien
gacttttttgtcacttcgtgctcca

SEQ ID NO: 556511 - DNA, 25 bp, Homo sapien
tgtcacttcgtgctccaggatcaca

SEQ ID NO: 556512 - DNA, 25 bp, Homo sapien
aggatcacacctggatgaactatca

SEQ ID NO: 556513 - DNA, 25 bp, Homo sapien
cacctggatgaactatcactttcaa

SEQ ID NO: 556514 - DNA, 25 bp, Homo sapien
caaatgaccttgtcttttctcgggc

SEQ ID NO: 556515 - DNA, 25 bp, Homo sapien
atgaccttgtcttttctcgggcctt

SEQ ID NO: 556516 - DNA, 25 bp, Homo sapien
ctgggaccctggataatattctact

SEQ ID NO: 556517 - DNA, 25 bp, Homo sapien
ggaccctggataatattctactttg

SEQ ID NO: 556518 - DNA, 25 bp, Homo sapien
aagagaccaggtgggctctgagaca

SEQ ID NO: 556519 - DNA, 25 bp, Homo sapien
agaccctttctacgtcggtgccttg

SEQ ID NO: 556520 - DNA, 25 bp, Homo sapien
acgtcggtgccttgacatgtgactt

SEQ ID NO: 556521 - DNA, 25 bp, Homo sapien
ttaggctcctctttattagaaacct

SEQ ID NO: 556522 - DNA, 25 bp, Homo sapien
taggctcctctttattagaaaccta

SEQ ID NO: 556523 - DNA, 25 bp, Homo sapien
gctcctctttattagaaacctaaat

SEQ ID NO: 556524 - DNA, 25 bp, Homo sapien
ctcctctttattagaaacctaaatg

SEQ ID NO: 556525 - DNA, 25 bp, Homo sapien
tcctctttattagaaacctaaatgt

SEQ ID NO: 556526 - DNA, 25 bp, Homo sapien
taaagaatattttaggccaggtacg

SEQ ID NO: 556527 - DNA, 25 bp, Homo sapien
agaatattttaggccaggtacggtg

SEQ ID NO: 556528 - DNA, 25 bp, Homo sapien
gaatattttaggccaggtacggtgg

SEQ ID NO: 556529 - DNA, 25 bp, Homo sapien
tcagtaggctgagccgggaggatct

SEQ ID NO: 556530 - DNA, 25 bp, Homo sapien
cagtaggctgagccgggaggatctc

SEQ ID NO: 556531 - DNA, 25 bp, Homo sapien
gagccgggaggatctcttgaacctg

SEQ ID NO: 556532 - DNA, 25 bp, Homo sapien
ctcatttccgtttcctacctgtttg

SEQ ID NO: 556533 - DNA, 25 bp, Homo sapien
catttccgtttcctacctgtttgct

SEQ ID NO: 556534 - DNA, 25 bp, Homo sapien
agtcctccgcatgagctgttgccct

SEQ ID NO: 556535 - DNA, 25 bp, Homo sapien
acgagggagaggactgattcagggc

SEQ ID NO: 556536 - DNA, 25 bp, Homo sapien
ctcaagctgggctctgtgtgaggcc

SEQ ID NO: 556537 - DNA, 25 bp, Homo sapien
tcccaaccttggctctagactgtta

SEQ ID NO: 556538 - DNA, 25 bp, Homo sapien
aaccttggctctagactgttactct

SEQ ID NO: 556539 - DNA, 25 bp, Homo sapien
ggctctagactgttactcttaagct

SEQ ID NO: 556540 - DNA, 25 bp, Homo sapien
agactgttactcttaagctttgaga

SEQ ID NO: 556541 - DNA, 25 bp, Homo sapien
cttaagctttgagaaattttcacat

SEQ ID NO: 556542 - DNA, 25 bp, Homo sapien
aattttcacattgatgactatttta

SEQ ID NO: 556543 - DNA, 25 bp, Homo sapien
aatgttccagtgactatgactgcaa

SEQ ID NO: 556544 - DNA, 25 bp, Homo sapien
gactatgactgcaagatcactgtgt

SEQ ID NO: 556545 - DNA, 25 bp, Homo sapien
gactgcaagatcactgtgtgcagaa

SEQ ID NO: 556546 - DNA, 25 bp, Homo sapien
gtgtgcagaaatctctagaaatgtg

SEQ ID NO: 556547 - DNA, 25 bp, Homo sapien
agaaatgtgtgtcttgtagctcaag

SEQ ID NO: 556548 - DNA, 25 bp, Homo sapien
agctcaagttattactagagacaac

SEQ ID NO: 556549 - DNA, 25 bp, Homo sapien
gacaacaagggttttgtggattcct

SEQ ID NO: 556550 - DNA, 25 bp, Homo sapien
agggttttgtggattcctgtagcct

SEQ ID NO: 556551 - DNA, 25 bp, Homo sapien
ggttttgtggattcctgtagcctct

SEQ ID NO: 556552 - DNA, 25 bp, Homo sapien
tgtagcctctctggcctgtttactt

SEQ ID NO: 556553 - DNA, 25 bp, Homo sapien
gcctgtttacttcaaggccattgct

SEQ ID NO: 556554 - DNA, 25 bp, Homo sapien
aggagatccctgaaaattatgagga

SEQ ID NO: 556555 - DNA, 25 bp, Homo sapien
gacaatgtgctcaaccacctcaatg

SEQ ID NO: 556556 - DNA, 25 bp, Homo sapien
aaccacctcaatgatgggaaacacg

SEQ ID NO: 556557 - DNA, 25 bp, Homo sapien
gggaaacacgaactcatggatgcca

SEQ ID NO: 556558 - DNA, 25 bp, Homo sapien
acacgaactcatggatgccagtgaa

SEQ ID NO: 556559 - DNA, 25 bp, Homo sapien
ccagtgaactggtggcagagattaa

SEQ ID NO: 556560 - DNA, 25 bp, Homo sapien
gtggcagagattaacaaactgcttc

SEQ ID NO: 556561 - DNA, 25 bp, Homo sapien
aaactgcttcaagatgtccgccaga

SEQ ID NO: 556562 - DNA, 25 bp, Homo sapien
aagatgtccgccagagctaggagat

SEQ ID NO: 556563 - DNA, 25 bp, Homo sapien
gattttagcgaagcatttttgtttc

SEQ ID NO: 556564 - DNA, 25 bp, Homo sapien
ctggcattgccaaatagttgcattt

SEQ ID NO: 556565 - DNA, 25 bp, Homo sapien
agtggcctcatgtcttaccatcatg

SEQ ID NO: 556566 - DNA, 25 bp, Homo sapien
acatgtaaccatcctctacctggac

SEQ ID NO: 556567 - DNA, 25 bp, Homo sapien
aagctccacgttctttgccagggtt

SEQ ID NO: 556568 - DNA, 25 bp, Homo sapien
gttgggcaaaagagagtcatcctgt

SEQ ID NO: 556569 - DNA, 25 bp, Homo sapien
agagagtcatcctgttaccttaaaa

SEQ ID NO: 556570 - DNA, 25 bp, Homo sapien
gagtcatcctgttaccttaaaaagg

SEQ ID NO: 556571 - DNA, 25 bp, Homo sapien
aaggagtctagggtgagccccagtc

SEQ ID NO: 556572 - DNA, 25 bp, Homo sapien
gagtctagggtgagccccagtctgc

SEQ ID NO: 556573 - DNA, 25 bp, Homo sapien
gcctcagagtggtgtaggcctcacc

SEQ ID NO: 556574 - DNA, 25 bp, Homo sapien
agtggtgtaggcctcacccttgtgc

SEQ ID NO: 556575 - DNA, 25 bp, Homo sapien
aggcctcacccttgtgctcacatgt

SEQ ID NO: 556576 - DNA, 25 bp, Homo sapien
gaaaatgaaccaatgatgtgctgtg

SEQ ID NO: 556577 - DNA, 25 bp, Homo sapien
gctgtggaatgtgatggttgtcttc

SEQ ID NO: 556578 - DNA, 25 bp, Homo sapien
ggttgtcttcatatagagtcacatg

SEQ ID NO: 556579 - DNA, 25 bp, Homo sapien
agagtcacatggtttctctttttat

SEQ ID NO: 556580 - DNA, 25 bp, Homo sapien
ggaataactataaggtgcactacaa

SEQ ID NO: 556581 - DNA, 25 bp, Homo sapien
tataaggtgcactacaaaaagatgt

SEQ ID NO: 556582 - DNA, 25 bp, Homo sapien
aaacatgttttaaatcaggtcagat

SEQ ID NO: 556583 - DNA, 25 bp, Homo sapien
gagcaagtagtttcaacatactcca

SEQ ID NO: 556584 - DNA, 25 bp, Homo sapien
gtttcaacatactccaggaactgag

SEQ ID NO: 556585 - DNA, 25 bp, Homo sapien
gtgggttttgagctccatatactct

SEQ ID NO: 556586 - DNA, 25 bp, Homo sapien
gagctccatatactcttagcaagta

SEQ ID NO: 556587 - DNA, 25 bp, Homo sapien
tcatgtaaattacttcaggcttttc

SEQ ID NO: 556588 - DNA, 25 bp, Homo sapien
aattacttcaggcttttcttgttag

SEQ ID NO: 556589 - DNA, 25 bp, Homo sapien
cttttcttgttagggcttcttgaat

SEQ ID NO: 556590 - DNA, 25 bp, Homo sapien
atctgtataccaaaggtgagctttt

SEQ ID NO: 556591 - DNA, 25 bp, Homo sapien
tttccttctaaatggcaaatttgtg

SEQ ID NO: 556592 - DNA, 25 bp, Homo sapien
aaatttgtgtgacagcatttaagac

SEQ ID NO: 556593 - DNA, 25 bp, Homo sapien
agcatttaagacactcagtttctat

SEQ ID NO: 556594 - DNA, 25 bp, Homo sapien
gacactcagtttctattcaaaagca

SEQ ID NO: 556595 - DNA, 25 bp, Homo sapien
taagaaaacaagttatgttcacggg

SEQ ID NO: 556596 - DNA, 25 bp, Homo sapien
atgttcacgggttatgtcataataa

SEQ ID NO: 556597 - DNA, 25 bp, Homo sapien
cacgggttatgtcataataaggtcc

SEQ ID NO: 556598 - DNA, 25 bp, Homo sapien
tactgggcccatgctgtctccttga

SEQ ID NO: 556599 - DNA, 25 bp, Homo sapien
atgctgtctccttgaccaggaatgt

SEQ ID NO: 556600 - DNA, 25 bp, Homo sapien
atagcccccttcactgtaagatctg

SEQ ID NO: 556601 - DNA, 25 bp, Homo sapien
tgcatcagagaaaagccagacagct

SEQ ID NO: 556602 - DNA, 25 bp, Homo sapien
tctgaatgcttctttaatgtctctg

SEQ ID NO: 556603 - DNA, 25 bp, Homo sapien
aatgtctctgagaaggagttccttc

SEQ ID NO: 556604 - DNA, 25 bp, Homo sapien
tgagaaggagttccttcctccttta

SEQ ID NO: 556605 - DNA, 25 bp, Homo sapien
agttccttcctcctttactgtccat

SEQ ID NO: 556606 - DNA, 25 bp, Homo sapien
gccagacagctggaaggctctattc

SEQ ID NO: 556607 - DNA, 25 bp, Homo sapien
tggaaggctctattcccaggccact

SEQ ID NO: 556608 - DNA, 25 bp, Homo sapien
atgcctccttactgggcccatgctg

SEQ ID NO: 556609 - DNA, 25 bp, Homo sapien
aacacgttcaacttcttcaagcaga

SEQ ID NO: 556610 - DNA, 25 bp, Homo sapien
cctcccaggcagtatgtaccagaag

SEQ ID NO: 556611 - DNA, 25 bp, Homo sapien
aatttagcagtaaaacagtcctggt

SEQ ID NO: 556612 - DNA, 25 bp, Homo sapien
aaacagtcctggtcattctaactac

SEQ ID NO: 556613 - DNA, 25 bp, Homo sapien
gtcctggtcattctaactacctgta

SEQ ID NO: 556614 - DNA, 25 bp, Homo sapien
aactacctgtatgatcttgaacaaa

SEQ ID NO: 556615 - DNA, 25 bp, Homo sapien
gaacaaagtcacttagtttccctgg

SEQ ID NO: 556616 - DNA, 25 bp, Homo sapien
cacttagtttccctgggccttggtg

SEQ ID NO: 556617 - DNA, 25 bp, Homo sapien
gtctttcgtctataaaatattgtac

SEQ ID NO: 556618 - DNA, 25 bp, Homo sapien
aatattgtaccagattatctctgaa

SEQ ID NO: 556619 - DNA, 25 bp, Homo sapien
gattatctctgaaatcacttcaagg

SEQ ID NO: 556620 - DNA, 25 bp, Homo sapien
tccacattaaaattgctcttgattt

SEQ ID NO: 556621 - DNA, 25 bp, Homo sapien
tgctcttgattttagtttctccata

SEQ ID NO: 556622 - DNA, 25 bp, Homo sapien
gtttctccataatcattttccctaa

SEQ ID NO: 556623 - DNA, 25 bp, Homo sapien
tttccctaaacaatgaactctgttc

SEQ ID NO: 556624 - DNA, 25 bp, Homo sapien
taaacaatgaactctgttcaccttt

SEQ ID NO: 556625 - DNA, 25 bp, Homo sapien
gcacagtgaatattactggtagccc

SEQ ID NO: 556626 - DNA, 25 bp, Homo sapien
tactggtagcccaaatcttctaaca

SEQ ID NO: 556627 - DNA, 25 bp, Homo sapien
ctggtagcccaaatcttctaacata

SEQ ID NO: 556628 - DNA, 25 bp, Homo sapien
aaagcttctgataagcatatatgtt

SEQ ID NO: 556629 - DNA, 25 bp, Homo sapien
gaaaatattgatacctggactggaa

SEQ ID NO: 556630 - DNA, 25 bp, Homo sapien
attgatacctggactggaaagaaaa

SEQ ID NO: 556631 - DNA, 25 bp, Homo sapien
gttttgtaagagacaaccagtcaat

SEQ ID NO: 556632 - DNA, 25 bp, Homo sapien
gtcaattcaaagatgcaggcaggcg

SEQ ID NO: 556633 - DNA, 25 bp, Homo sapien
gagtataatggagacctctagcctc

SEQ ID NO: 556634 - DNA, 25 bp, Homo sapien
aggatggccatgttcgccaaagcat

SEQ ID NO: 556635 - DNA, 25 bp, Homo sapien
gaagatgttgatgaaaccgcactgt

SEQ ID NO: 556636 - DNA, 25 bp, Homo sapien
gatgaaaccgcactgttgaaacaaa

SEQ ID NO: 556637 - DNA, 25 bp, Homo sapien
agacctctagcctctaatcatgggc

SEQ ID NO: 556638 - DNA, 25 bp, Homo sapien
agcctctaatcatgggcactaaagg

SEQ ID NO: 556639 - DNA, 25 bp, Homo sapien
gacttgaagggattgaaccaactac

SEQ ID NO: 556640 - DNA, 25 bp, Homo sapien
aaccaactactgcaagtcatgggca

SEQ ID NO: 556641 - DNA, 25 bp, Homo sapien
gtcatgggcattcaatgttttgtaa

SEQ ID NO: 556642 - DNA, 25 bp, Homo sapien
gccctctgacctgggatgatgtaaa

SEQ ID NO: 556643 - DNA, 25 bp, Homo sapien
ggatgatgtaaaatgaagtccctta

SEQ ID NO: 556644 - DNA, 25 bp, Homo sapien
agtcccttatcagatgcagacctca

SEQ ID NO: 556645 - DNA, 25 bp, Homo sapien
cttatcagatgcagacctcatggtc

SEQ ID NO: 556646 - DNA, 25 bp, Homo sapien
gatgcagacctcatggtcttgtact

SEQ ID NO: 556647 - DNA, 25 bp, Homo sapien
gtcttgtacttctcagccagaacta

SEQ ID NO: 556648 - DNA, 25 bp, Homo sapien
ttgtacttctcagccagaactataa

SEQ ID NO: 556649 - DNA, 25 bp, Homo sapien
ttaagacatctactttgcccattta

SEQ ID NO: 556650 - DNA, 25 bp, Homo sapien
tgcccatttatactggaggctttag

SEQ ID NO: 556651 - DNA, 25 bp, Homo sapien
actggaggctttagccagaattctg

SEQ ID NO: 556652 - DNA, 25 bp, Homo sapien
ttctgtttataaagtttgcaggcca

SEQ ID NO: 556653 - DNA, 25 bp, Homo sapien
tgattgccatgactcttccctctga

SEQ ID NO: 556654 - DNA, 25 bp, Homo sapien
ctctgaccaacccaaggaacactgg

SEQ ID NO: 556655 - DNA, 25 bp, Homo sapien
gaccaacccaaggaacactggattg

SEQ ID NO: 556656 - DNA, 25 bp, Homo sapien
actggattggacgaggtgtagcact

SEQ ID NO: 556657 - DNA, 25 bp, Homo sapien
gaggtgtagcactgttatgtcaact

SEQ ID NO: 556658 - DNA, 25 bp, Homo sapien
gtagcactgttatgtcaacttaatt

SEQ ID NO: 556659 - DNA, 25 bp, Homo sapien
tgtcaacttaattcataaccagaag

SEQ ID NO: 556660 - DNA, 25 bp, Homo sapien
ttggctggctgagtagagaaagcat

SEQ ID NO: 556661 - DNA, 25 bp, Homo sapien
atttacttatgagcaaatgcagcta

SEQ ID NO: 556662 - DNA, 25 bp, Homo sapien
gcagctaaacttaatatgactcata

SEQ ID NO: 556663 - DNA, 25 bp, Homo sapien
atatgactcatacttaaatgtaagg

SEQ ID NO: 556664 - DNA, 25 bp, Homo sapien
tccctaggcgttcaccggctttctt

SEQ ID NO: 556665 - DNA, 25 bp, Homo sapien
tcaccggctttcttgccatctgctg

SEQ ID NO: 556666 - DNA, 25 bp, Homo sapien
gctgcatgaaaactgactttgccga

SEQ ID NO: 556667 - DNA, 25 bp, Homo sapien
gaaaatgacagaccgcaaccgggat

SEQ ID NO: 556668 - DNA, 25 bp, Homo sapien
aaaagtacttcaccttcaaattcag

SEQ ID NO: 556669 - DNA, 25 bp, Homo sapien
tgaaatctgaacaactgcctccttg

SEQ ID NO: 556670 - DNA, 25 bp, Homo sapien
tgaacaactgcctccttgtgtgaac

SEQ ID NO: 556671 - DNA, 25 bp, Homo sapien
ttgtgtgaaccctggcaatcctgtg

SEQ ID NO: 556672 - DNA, 25 bp, Homo sapien
gtgaaccctggcaatcctgtgtttt

SEQ ID NO: 556673 - DNA, 25 bp, Homo sapien
gttggatccaaagacactccagaca

SEQ ID NO: 556674 - DNA, 25 bp, Homo sapien
cacctcactatcaaaacctcaaatg

SEQ ID NO: 556675 - DNA, 25 bp, Homo sapien
tgcctgcttcccttagcccctgata

SEQ ID NO: 556676 - DNA, 25 bp, Homo sapien
aactgccctgcctggacacagagag

SEQ ID NO: 556677 - DNA, 25 bp, Homo sapien
gggtcctgtgaagtcaggccttgaa

SEQ ID NO: 556678 - DNA, 25 bp, Homo sapien
gcatatacatgcacagagatgcaca

SEQ ID NO: 556679 - DNA, 25 bp, Homo sapien
gccttgaaggagtgggcgtctctca

SEQ ID NO: 556680 - DNA, 25 bp, Homo sapien
ccttgaaggagtgggcgtctctcag

SEQ ID NO: 556681 - DNA, 25 bp, Homo sapien
gaaggagtgggcgtctctcagcccc

SEQ ID NO: 556682 - DNA, 25 bp, Homo sapien
ggagtgggcgtctctcagcccctct

SEQ ID NO: 556683 - DNA, 25 bp, Homo sapien
tggaagcctcgcaccaggactgtcc

SEQ ID NO: 556684 - DNA, 25 bp, Homo sapien
ctctcccgcagagcattcaggacca

SEQ ID NO: 556685 - DNA, 25 bp, Homo sapien
atgctacagcatgtgcacacagaca

SEQ ID NO: 556686 - DNA, 25 bp, Homo sapien
atcagcagtctaacaacacgacaga

SEQ ID NO: 556687 - DNA, 25 bp, Homo sapien
aacacgacagatgacaggcccagag

SEQ ID NO: 556688 - DNA, 25 bp, Homo sapien
gatgacaggcccagaggcacaccca

SEQ ID NO: 556689 - DNA, 25 bp, Homo sapien
ccatcaccctgtgcaggatgtcaaa

SEQ ID NO: 556690 - DNA, 25 bp, Homo sapien
gaagatcatccagacttaaatgttt

SEQ ID NO: 556691 - DNA, 25 bp, Homo sapien
gacttaaatgtttgggccttgctaa

SEQ ID NO: 556692 - DNA, 25 bp, Homo sapien
ttgggccttgctaagaccatagagt

SEQ ID NO: 556693 - DNA, 25 bp, Homo sapien
catagagtctttgtgctttggaaac

SEQ ID NO: 556694 - DNA, 25 bp, Homo sapien
gctttggaaacagtcctccatacaa

SEQ ID NO: 556695 - DNA, 25 bp, Homo sapien
tccatacaaagaccccttcctagaa

SEQ ID NO: 556696 - DNA, 25 bp, Homo sapien
cagaaaggagaccatgctaatattc

SEQ ID NO: 556697 - DNA, 25 bp, Homo sapien
tgtccctttaatttgcgatgcatca

SEQ ID NO: 556698 - DNA, 25 bp, Homo sapien
gcgatgcatcacaacaaatgattgt

SEQ ID NO: 556699 - DNA, 25 bp, Homo sapien
atgaccacccttcagtgagccggca

SEQ ID NO: 556700 - DNA, 25 bp, Homo sapien
cagtgagccggcagctgagcgacac

SEQ ID NO: 556701 - DNA, 25 bp, Homo sapien
tgagcgacacggacaaagccgcctg

SEQ ID NO: 556702 - DNA, 25 bp, Homo sapien
gacaaagccgcctggctcagggttg

SEQ ID NO: 556703 - DNA, 25 bp, Homo sapien
gggaaaacactctttagtcagtaga

SEQ ID NO: 556704 - DNA, 25 bp, Homo sapien
gttaaaccacctgatttattccata

SEQ ID NO: 556705 - DNA, 25 bp, Homo sapien
aatgcagctcataaatactgcgctg

SEQ ID NO: 556706 - DNA, 25 bp, Homo sapien
atactgcgctgaaagctcagccttg

SEQ ID NO: 556707 - DNA, 25 bp, Homo sapien
gctcagccttgatacaagctcactt

SEQ ID NO: 556708 - DNA, 25 bp, Homo sapien
gttattttctgagcttagataatac

SEQ ID NO: 556709 - DNA, 25 bp, Homo sapien
ctgagcttagataatactatgtgta

SEQ ID NO: 556710 - DNA, 25 bp, Homo sapien
tctaaagccttcaaattagaagtgg

SEQ ID NO: 556711 - DNA, 25 bp, Homo sapien
aatactctcttatttgctctagtgt

SEQ ID NO: 556712 - DNA, 25 bp, Homo sapien
atttgctctagtgtactagtccagt

SEQ ID NO: 556713 - DNA, 25 bp, Homo sapien
gtactagtccagtagtgtttgcatg

SEQ ID NO: 556714 - DNA, 25 bp, Homo sapien
catgtggatgtctgtggatgacagt

SEQ ID NO: 556715 - DNA, 25 bp, Homo sapien
gatgtctgtggatgacagttattgt

SEQ ID NO: 556716 - DNA, 25 bp, Homo sapien
cagttattgtagcactttggcagtg

SEQ ID NO: 556717 - DNA, 25 bp, Homo sapien
gtagcactttggcagtgcactaaaa

SEQ ID NO: 556718 - DNA, 25 bp, Homo sapien
gtgcactaaaattttgccactatga

SEQ ID NO: 556719 - DNA, 25 bp, Homo sapien
gcgtgctcccgatgctgctatggaa

SEQ ID NO: 556720 - DNA, 25 bp, Homo sapien
gatgctgctatggaaggtgctactt

SEQ ID NO: 556721 - DNA, 25 bp, Homo sapien
gtgctacttgacctaagggactccc

SEQ ID NO: 556722 - DNA, 25 bp, Homo sapien
tcctcgcaggtgttctgggctccgt

SEQ ID NO: 556723 - DNA, 25 bp, Homo sapien
tctgggctccgttgtaccaagtgga

SEQ ID NO: 556724 - DNA, 25 bp, Homo sapien
gcaagcgttgtgcagagcccatagc

SEQ ID NO: 556725 - DNA, 25 bp, Homo sapien
ccctctccacattatcagttgacag

SEQ ID NO: 556726 - DNA, 25 bp, Homo sapien
agttgacagtgtacaatgcctttga

SEQ ID NO: 556727 - DNA, 25 bp, Homo sapien
tgtacaatgcctttgatgaactgtt

SEQ ID NO: 556728 - DNA, 25 bp, Homo sapien
gaactgttttgtaagtgctgctata

SEQ ID NO: 556729 - DNA, 25 bp, Homo sapien
agtgctgctatatctatccattttt

SEQ ID NO: 556730 - DNA, 25 bp, Homo sapien
ggctcactttgctggaatttttctg

SEQ ID NO: 556731 - DNA, 25 bp, Homo sapien
ggaatttttctgaatccaggttaag

SEQ ID NO: 556732 - DNA, 25 bp, Homo sapien
ggttaagatttccagaagtcagctt

SEQ ID NO: 556733 - DNA, 25 bp, Homo sapien
ggaaaacgtgacactcctaccaaag

SEQ ID NO: 556734 - DNA, 25 bp, Homo sapien
gacactcctaccaaagtccagatgg

SEQ ID NO: 556735 - DNA, 25 bp, Homo sapien
ggtgtgtggcctttatttctattta

SEQ ID NO: 556736 - DNA, 25 bp, Homo sapien
gaaagttatcacataccatgggttt

SEQ ID NO: 556737 - DNA, 25 bp, Homo sapien
acataccatgggtttcagtgttttt

SEQ ID NO: 556738 - DNA, 25 bp, Homo sapien
ctcttgcaaaataaccgcttcctgg

SEQ ID NO: 556739 - DNA, 25 bp, Homo sapien
aaataaccgcttcctggctgttggc

SEQ ID NO: 556740 - DNA, 25 bp, Homo sapien
ggctgttggctcactttgctggaat

SEQ ID NO: 556741 - DNA, 25 bp, Homo sapien
tctgtgtgccacttaggtcaggccc

SEQ ID NO: 556742 - DNA, 25 bp, Homo sapien
taggtcaggccctccactacatggt

SEQ ID NO: 556743 - DNA, 25 bp, Homo sapien
actacatggtcctgcttctcttgca

SEQ ID NO: 556744 - DNA, 25 bp, Homo sapien
gcttctcttgcatgagttagctact

SEQ ID NO: 556745 - DNA, 25 bp, Homo sapien
tcatatcatgagagcatccctttct

SEQ ID NO: 556746 - DNA, 25 bp, Homo sapien
atccctttcttaattttctgcgcta

SEQ ID NO: 556747 - DNA, 25 bp, Homo sapien
ccatgtatgtgctatggcccatatg

SEQ ID NO: 556748 - DNA, 25 bp, Homo sapien
aacttgtttatctacagctagccag

SEQ ID NO: 556749 - DNA, 25 bp, Homo sapien
gctagccagatggtctgtaacagca

SEQ ID NO: 556750 - DNA, 25 bp, Homo sapien
gtaacagcacacaaagaagccattt

SEQ ID NO: 556751 - DNA, 25 bp, Homo sapien
actttcagagggtcagcacgttttg

SEQ ID NO: 556752 - DNA, 25 bp, Homo sapien
gcgtcaccaacgctgggtctcagct

SEQ ID NO: 556753 - DNA, 25 bp, Homo sapien
tgtgctacagccatgtcactcctgg

SEQ ID NO: 556754 - DNA, 25 bp, Homo sapien
tggacagggccctgctcccagctag

SEQ ID NO: 556755 - DNA, 25 bp, Homo sapien
ggccctgctcccagctagtgggctg

SEQ ID NO: 556756 - DNA, 25 bp, Homo sapien
ggatggctcgtagactatgggaaac

SEQ ID NO: 556757 - DNA, 25 bp, Homo sapien
tgggtctcagctccaacttctttct

SEQ ID NO: 556758 - DNA, 25 bp, Homo sapien
aacttctttcttcagcagagccgcg

SEQ ID NO: 556759 - DNA, 25 bp, Homo sapien
ttctttcttcagcagagccgcgccg

SEQ ID NO: 556760 - DNA, 25 bp, Homo sapien
tcctggtgcagcaatgagtctccaa

SEQ ID NO: 556761 - DNA, 25 bp, Homo sapien
ggtgcagcaatgagtctccaacttt

SEQ ID NO: 556762 - DNA, 25 bp, Homo sapien
tgcagcaatgagtctccaactttcg

SEQ ID NO: 556763 - DNA, 25 bp, Homo sapien
caagggaaagtgctccatcagctgt

SEQ ID NO: 556764 - DNA, 25 bp, Homo sapien
gagaagcagctcttgggtccgtgtt

SEQ ID NO: 556765 - DNA, 25 bp, Homo sapien
tcttgggtccgtgtttctgccttag

SEQ ID NO: 556766 - DNA, 25 bp, Homo sapien
aaggcaggagttgggcatctagctc

SEQ ID NO: 556767 - DNA, 25 bp, Homo sapien
ttgggcatctagctccagcactcat

SEQ ID NO: 556768 - DNA, 25 bp, Homo sapien
actcatccctcttgaaactgctggt

SEQ ID NO: 556769 - DNA, 25 bp, Homo sapien
tccctcttgaaactgctggtttgtt

SEQ ID NO: 556770 - DNA, 25 bp, Homo sapien
gagaaagctcaacaggcttcactag

SEQ ID NO: 556771 - DNA, 25 bp, Homo sapien
tggcagcagctcagatattttccct

SEQ ID NO: 556772 - DNA, 25 bp, Homo sapien
agctcagatattttccctcctctgt

SEQ ID NO: 556773 - DNA, 25 bp, Homo sapien
gcacagacggctgtcccaagggaaa

SEQ ID NO: 556774 - DNA, 25 bp, Homo sapien
gctgataagacgtgggcccaggtat

SEQ ID NO: 556775 - DNA, 25 bp, Homo sapien
gcccaggtataaggagctgtccctg

SEQ ID NO: 556776 - DNA, 25 bp, Homo sapien
aagctcgatggcaaggcaggacaaa

SEQ ID NO: 556777 - DNA, 25 bp, Homo sapien
aaaagcctatgtcttccttatcaca

SEQ ID NO: 556778 - DNA, 25 bp, Homo sapien
gtaatctgaatcgtggttcctcctc

SEQ ID NO: 556779 - DNA, 25 bp, Homo sapien
tcccgaaggcctctgagcaagctat

SEQ ID NO: 556780 - DNA, 25 bp, Homo sapien
ctgagcaagctatcctgttggtgtt

SEQ ID NO: 556781 - DNA, 25 bp, Homo sapien
gttagaatcaaacaccaccgaggca

SEQ ID NO: 556782 - DNA, 25 bp, Homo sapien
accgaggcatagtgaagttcttccc

SEQ ID NO: 556783 - DNA, 25 bp, Homo sapien
atggtcaccagctttgatccatttc

SEQ ID NO: 556784 - DNA, 25 bp, Homo sapien
gatccatttctgaacatcctccagg

SEQ ID NO: 556785 - DNA, 25 bp, Homo sapien
cacctgtgctacagccatgtcactc

SEQ ID NO: 556786 - DNA, 25 bp, Homo sapien
ggccctgctcccagctagtgggctg

SEQ ID NO: 556787 - DNA, 25 bp, Homo sapien
gccctgctcccagctagtgggctgg

SEQ ID NO: 556788 - DNA, 25 bp, Homo sapien
ccctgctcccagctagtgggctggg

SEQ ID NO: 556789 - DNA, 25 bp, Homo sapien
gtgggctgggatggctcgtagacta

SEQ ID NO: 556790 - DNA, 25 bp, Homo sapien
gggctgggatggctcgtagactatg

SEQ ID NO: 556791 - DNA, 25 bp, Homo sapien
ggctgggatggctcgtagactatgg

SEQ ID NO: 556792 - DNA, 25 bp, Homo sapien
gctgggatggctcgtagactatggg

SEQ ID NO: 556793 - DNA, 25 bp, Homo sapien
ctgggatggctcgtagactatggga

SEQ ID NO: 556794 - DNA, 25 bp, Homo sapien
tgggatggctcgtagactatgggaa

SEQ ID NO: 556795 - DNA, 25 bp, Homo sapien
ggatggctcgtagactatgggaaac

SEQ ID NO: 556796 - DNA, 25 bp, Homo sapien
tgtagctgcgccttccgaatccagc

SEQ ID NO: 556797 - DNA, 25 bp, Homo sapien
agattctcctaccagctgcttgggt

SEQ ID NO: 556798 - DNA, 25 bp, Homo sapien
tgggtcacgtcggtggaactcctaa

SEQ ID NO: 556799 - DNA, 25 bp, Homo sapien
ggaactcctaaagggatgccttcaa

SEQ ID NO: 556800 - DNA, 25 bp, Homo sapien
gaataagcttcaatcagactgccct

SEQ ID NO: 556801 - DNA, 25 bp, Homo sapien
atcagactgcccttcccaaagaaaa

SEQ ID NO: 556802 - DNA, 25 bp, Homo sapien
aacagccacctgaaggcactggcga

SEQ ID NO: 556803 - DNA, 25 bp, Homo sapien
attctggagaagagtcaacacttgg

SEQ ID NO: 556804 - DNA, 25 bp, Homo sapien
aagaagggagctgcactgggtacat

SEQ ID NO: 556805 - DNA, 25 bp, Homo sapien
gggaaggaacagtgtctctgcatga

SEQ ID NO: 556806 - DNA, 25 bp, Homo sapien
gtgtctctgcatgagaatggccaaa

SEQ ID NO: 556807 - DNA, 25 bp, Homo sapien
gggtttctaaagtgtagatctgatt

SEQ ID NO: 556808 - DNA, 25 bp, Homo sapien
gatctgattatatactgcttaaaac

SEQ ID NO: 556809 - DNA, 25 bp, Homo sapien
gcttaaaaccttccatgatgcttta

SEQ ID NO: 556810 - DNA, 25 bp, Homo sapien
ttccatgatgctttattgcccttaa

SEQ ID NO: 556811 - DNA, 25 bp, Homo sapien
gctttattgcccttaagattataca

SEQ ID NO: 556812 - DNA, 25 bp, Homo sapien
atacatagaatctcgttcttcctag

SEQ ID NO: 556813 - DNA, 25 bp, Homo sapien
gttcttcctagaatgttttcctgtc

SEQ ID NO: 556814 - DNA, 25 bp, Homo sapien
aatgttttcctgtctaacccatata

SEQ ID NO: 556815 - DNA, 25 bp, Homo sapien
tcctgtctaacccatatactgcata

SEQ ID NO: 556816 - DNA, 25 bp, Homo sapien
gtctaacccatatactgcataattc

SEQ ID NO: 556817 - DNA, 25 bp, Homo sapien
agttgatgccctccagtttatcctc

SEQ ID NO: 556818 - DNA, 25 bp, Homo sapien
gcgtcaccaacgctgggtctcagct

SEQ ID NO: 556819 - DNA, 25 bp, Homo sapien
tgggtctcagctccaacttctttct

SEQ ID NO: 556820 - DNA, 25 bp, Homo sapien
ggtctcagctccaacttctttcttc

SEQ ID NO: 556821 - DNA, 25 bp, Homo sapien
tttcttcagcagagccgcgccgcct

SEQ ID NO: 556822 - DNA, 25 bp, Homo sapien
tcctggtgcagcaatgagtctccaa

SEQ ID NO: 556823 - DNA, 25 bp, Homo sapien
cctggtgcagcaatgagtctccaac

SEQ ID NO: 556824 - DNA, 25 bp, Homo sapien
ctggtgcagcaatgagtctccaact

SEQ ID NO: 556825 - DNA, 25 bp, Homo sapien
tggtgcagcaatgagtctccaactt

SEQ ID NO: 556826 - DNA, 25 bp, Homo sapien
ggtgcagcaatgagtctccaacttt

SEQ ID NO: 556827 - DNA, 25 bp, Homo sapien
gtgcagcaatgagtctccaactttc

SEQ ID NO: 556828 - DNA, 25 bp, Homo sapien
tgcagcaatgagtctccaactttcg

SEQ ID NO: 556829 - DNA, 25 bp, Homo sapien
acagtggcgaaggtgcaggtgaaca

SEQ ID NO: 556830 - DNA, 25 bp, Homo sapien
tcctggagggaacatattccactgc

SEQ ID NO: 556831 - DNA, 25 bp, Homo sapien
gagggaacatattccactgcgccat

SEQ ID NO: 556832 - DNA, 25 bp, Homo sapien
gggaacatattccactgcgccatgt

SEQ ID NO: 556833 - DNA, 25 bp, Homo sapien
gaacatattccactgcgccatgtcc

SEQ ID NO: 556834 - DNA, 25 bp, Homo sapien
tctccagggcctgtatctctgtgga

SEQ ID NO: 556835 - DNA, 25 bp, Homo sapien
ccagggcctgtatctctgtggaagt

SEQ ID NO: 556836 - DNA, 25 bp, Homo sapien
gtatctctgtggaagtggggctcat

SEQ ID NO: 556837 - DNA, 25 bp, Homo sapien
ccacacatggagcaagcatcttcac

SEQ ID NO: 556838 - DNA, 25 bp, Homo sapien
acacatggagcaagcatcttcactg

SEQ ID NO: 556839 - DNA, 25 bp, Homo sapien
acatggagcaagcatcttcactgaa

SEQ ID NO: 556840 - DNA, 25 bp, Homo sapien
ccacccttttaaagcaccttcagag

SEQ ID NO: 556841 - DNA, 25 bp, Homo sapien
aagcaccttcagaggttcccaatgg

SEQ ID NO: 556842 - DNA, 25 bp, Homo sapien
ccttcagaggttcccaatggtgaca

SEQ ID NO: 556843 - DNA, 25 bp, Homo sapien
ggttcccaatggtgacagtaaacaa

SEQ ID NO: 556844 - DNA, 25 bp, Homo sapien
agtaaacaagtctccactgtcctgg

SEQ ID NO: 556845 - DNA, 25 bp, Homo sapien
aaacaagtctccactgtcctggcca

SEQ ID NO: 556846 - DNA, 25 bp, Homo sapien
tctgctgtgttcaccctactcctga

SEQ ID NO: 556847 - DNA, 25 bp, Homo sapien
accctactcctgatctttctggctg

SEQ ID NO: 556848 - DNA, 25 bp, Homo sapien
tttctggctgctcagggactgacag

SEQ ID NO: 556849 - DNA, 25 bp, Homo sapien
agctgggtctgaggagccaagcaga

SEQ ID NO: 556850 - DNA, 25 bp, Homo sapien
gacagccaagatgtgaggctgtgat

SEQ ID NO: 556851 - DNA, 25 bp, Homo sapien
ttttcatagttcctgcatcctagaa

SEQ ID NO: 556852 - DNA, 25 bp, Homo sapien
tcatagttcctgcatcctagaaaaa

SEQ ID NO: 556853 - DNA, 25 bp, Homo sapien
tagttcctgcatcctagaaaaaata

SEQ ID NO: 556854 - DNA, 25 bp, Homo sapien
taaaatattccttggtgtctagaaa

SEQ ID NO: 556855 - DNA, 25 bp, Homo sapien
atcattttgctttctcacttaagct

SEQ ID NO: 556856 - DNA, 25 bp, Homo sapien
ttgctttctcacttaagctgatctg

SEQ ID NO: 556857 - DNA, 25 bp, Homo sapien
ctttctcacttaagctgatctgaat

SEQ ID NO: 556858 - DNA, 25 bp, Homo sapien
ctcacttaagctgatctgaatgatg

SEQ ID NO: 556859 - DNA, 25 bp, Homo sapien
ctgaatgatgatttggtactgcctt

SEQ ID NO: 556860 - DNA, 25 bp, Homo sapien
gaatgatgatttggtactgccttta

SEQ ID NO: 556861 - DNA, 25 bp, Homo sapien
gatgatttggtactgcctttatgag

SEQ ID NO: 556862 - DNA, 25 bp, Homo sapien
cccctgcccttgtggattgtatatt

SEQ ID NO: 556863 - DNA, 25 bp, Homo sapien
tttgcttcaatggtcttgtctctac

SEQ ID NO: 556864 - DNA, 25 bp, Homo sapien
ggtcttgtctctactcagctaaaat

SEQ ID NO: 556865 - DNA, 25 bp, Homo sapien
ctctactcagctaaaatggactttg

SEQ ID NO: 556866 - DNA, 25 bp, Homo sapien
atggactttgtaccccgctatttat

SEQ ID NO: 556867 - DNA, 25 bp, Homo sapien
tatttatgtcctccctcatgcaaag

SEQ ID NO: 556868 - DNA, 25 bp, Homo sapien
gaagcttggtgtagcaggaagacct

SEQ ID NO: 556869 - DNA, 25 bp, Homo sapien
gacctggaaagacctcaaccttggg

SEQ ID NO: 556870 - DNA, 25 bp, Homo sapien
tgttgtgtgtctactgggtgccaga

SEQ ID NO: 556871 - DNA, 25 bp, Homo sapien
agacactggtctaaggcaccgagcg

SEQ ID NO: 556872 - DNA, 25 bp, Homo sapien
ccgagcgcccagtaggaaaccaaat

SEQ ID NO: 556873 - DNA, 25 bp, Homo sapien
gacagagtacagcaagaacagcaca

SEQ ID NO: 556874 - DNA, 25 bp, Homo sapien
tgccaatcacagttaaccacaagaa

SEQ ID NO: 556875 - DNA, 25 bp, Homo sapien
gttaaccacaagaacacttcggctg

SEQ ID NO: 556876 - DNA, 25 bp, Homo sapien
gaacacttcggctgtagtcagctaa

SEQ ID NO: 556877 - DNA, 25 bp, Homo sapien
gtagtcagctaaggagaatcacata

SEQ ID NO: 556878 - DNA, 25 bp, Homo sapien
agctgacttctctgttgcaccttca

SEQ ID NO: 556879 - DNA, 25 bp, Homo sapien
ttcaccctacttagggacactaagg

SEQ ID NO: 556880 - DNA, 25 bp, Homo sapien
gacactaagggttcctgcctggaga

SEQ ID NO: 556881 - DNA, 25 bp, Homo sapien
tcctgcctggagaatgaaaacaact

SEQ ID NO: 556882 - DNA, 25 bp, Homo sapien
gaaaacaactccttagatctaatcg

SEQ ID NO: 556883 - DNA, 25 bp, Homo sapien
tatttgttagtttaggacattcctc

SEQ ID NO: 556884 - DNA, 25 bp, Homo sapien
tttgtgaagccgaaatgactgcaga

SEQ ID NO: 556885 - DNA, 25 bp, Homo sapien
gcagagagaaaagtgtgccatcccc

SEQ ID NO: 556886 - DNA, 25 bp, Homo sapien
tgtcttccaagttactcggactccg

SEQ ID NO: 556887 - DNA, 25 bp, Homo sapien
actcggactccgaagttgtggcaat

SEQ ID NO: 556888 - DNA, 25 bp, Homo sapien
gtctcacatcaagtagctcttgttt

SEQ ID NO: 556889 - DNA, 25 bp, Homo sapien
gctcttgtttctgttaggcgtgaga

SEQ ID NO: 556890 - DNA, 25 bp, Homo sapien
ctgttaggcgtgagagcttgctcca

SEQ ID NO: 556891 - DNA, 25 bp, Homo sapien
agtaacaaattctttcagcagctcc

SEQ ID NO: 556892 - DNA, 25 bp, Homo sapien
cagcagctcctcttaggagaggtaa

SEQ ID NO: 556893 - DNA, 25 bp, Homo sapien
gtaactgtttcgaaatacttctggg

SEQ ID NO: 556894 - DNA, 25 bp, Homo sapien
ctgtgtctgaaagtcctgtttgcaa

SEQ ID NO: 556895 - DNA, 25 bp, Homo sapien
cccgccccgtgtgatttgtttcatt

SEQ ID NO: 556896 - DNA, 25 bp, Homo sapien
tcggcagtgccatgctccggcccaa

SEQ ID NO: 556897 - DNA, 25 bp, Homo sapien
ggcgaggacgagaaatccggcccct

SEQ ID NO: 556898 - DNA, 25 bp, Homo sapien
aggacgagaaatccggcccctgcag

SEQ ID NO: 556899 - DNA, 25 bp, Homo sapien
cctgcagcagcagtagcgacagcga

SEQ ID NO: 556900 - DNA, 25 bp, Homo sapien
gcagcagcagtagcgacagcgacag

SEQ ID NO: 556901 - DNA, 25 bp, Homo sapien
gtagcgacagcgacagcggagacga

SEQ ID NO: 556902 - DNA, 25 bp, Homo sapien
agacgagggcgatgaatacgacgac

SEQ ID NO: 556903 - DNA, 25 bp, Homo sapien
gaatacgacgacattgtggttcaca

SEQ ID NO: 556904 - DNA, 25 bp, Homo sapien
atacgacgacattgtggttcacagc

SEQ ID NO: 556905 - DNA, 25 bp, Homo sapien
cgacgacattgtggttcacagcagc

SEQ ID NO: 556906 - DNA, 25 bp, Homo sapien
ttccatcaagaaactccctatcaaa

SEQ ID NO: 556907 - DNA, 25 bp, Homo sapien
aactccctatcaaaggatccatttc

SEQ ID NO: 556908 - DNA, 25 bp, Homo sapien
aaaggatccatttcacccctaatca

SEQ ID NO: 556909 - DNA, 25 bp, Homo sapien
tggcccttcagccttactccaagaa

SEQ ID NO: 556910 - DNA, 25 bp, Homo sapien
atcaccacactaaggaaatcccgag

SEQ ID NO: 556911 - DNA, 25 bp, Homo sapien
cactaaggaaatcccgagttcctgg

SEQ ID NO: 556912 - DNA, 25 bp, Homo sapien
ggtgggatcatcctgtacagcagag

SEQ ID NO: 556913 - DNA, 25 bp, Homo sapien
tacagcagagaggacgtcactggac

SEQ ID NO: 556914 - DNA, 25 bp, Homo sapien
agagaggacgtcactggacacctcc

SEQ ID NO: 556915 - DNA, 25 bp, Homo sapien
aggtgctccaggacaggctggccct

SEQ ID NO: 556916 - DNA, 25 bp, Homo sapien
ttggtctgcagcacttctcagagac

SEQ ID NO: 556917 - DNA, 25 bp, Homo sapien
agtcacgccatgaggtcagggccac

SEQ ID NO: 556918 - DNA, 25 bp, Homo sapien
tcagggccacggatgccattgtctg

SEQ ID NO: 556919 - DNA, 25 bp, Homo sapien
gatgccattgtctgctggaagccag

SEQ ID NO: 556920 - DNA, 25 bp, Homo sapien
gccagtgcagcacttggagcttaga

SEQ ID NO: 556921 - DNA, 25 bp, Homo sapien
gagcttagaagatgcacacaactct

SEQ ID NO: 556922 - DNA, 25 bp, Homo sapien
agacgaagactgtggctgaggcttt

SEQ ID NO: 556923 - DNA, 25 bp, Homo sapien
gctgaggctttgttttcaggccgaa

SEQ ID NO: 556924 - DNA, 25 bp, Homo sapien
tttcaggccgaaagcaggacactca

SEQ ID NO: 556925 - DNA, 25 bp, Homo sapien
attgcccaccaatgtcctctttctg

SEQ ID NO: 556926 - DNA, 25 bp, Homo sapien
tttctggcgtccctcacattcctgg

SEQ ID NO: 556927 - DNA, 25 bp, Homo sapien
tccgttcagtcacgccatgaggtca

SEQ ID NO: 556928 - DNA, 25 bp, Homo sapien
aggagatccctgaaaattatgagga

SEQ ID NO: 556929 - DNA, 25 bp, Homo sapien
gacaatgtgctcaaccacctcaatg

SEQ ID NO: 556930 - DNA, 25 bp, Homo sapien
aaccacctcaatgatgggaaacacg

SEQ ID NO: 556931 - DNA, 25 bp, Homo sapien
gggaaacacgaactcatggatgcca

SEQ ID NO: 556932 - DNA, 25 bp, Homo sapien
acacgaactcatggatgccagtgaa

SEQ ID NO: 556933 - DNA, 25 bp, Homo sapien
ccagtgaactggtggcagagattaa

SEQ ID NO: 556934 - DNA, 25 bp, Homo sapien
gtggcagagattaacaaactgcttc

SEQ ID NO: 556935 - DNA, 25 bp, Homo sapien
gattttagcgaagcatttttgtttc

SEQ ID NO: 556936 - DNA, 25 bp, Homo sapien
ctggcattgccaaatagttgcattt

SEQ ID NO: 556937 - DNA, 25 bp, Homo sapien
gccaaatagttgcatttatcataaa

SEQ ID NO: 556938 - DNA, 25 bp, Homo sapien
ttatcataaatgtgtctgtgtatat

SEQ ID NO: 556939 - DNA, 25 bp, Homo sapien
attttgttgctgtgcaagcatcaca

SEQ ID NO: 556940 - DNA, 25 bp, Homo sapien
gtgcaagcatcacagaatgtactta

SEQ ID NO: 556941 - DNA, 25 bp, Homo sapien
tacacaaacctaaatactagagcct

SEQ ID NO: 556942 - DNA, 25 bp, Homo sapien
aaatactagagcctaccacacacct

SEQ ID NO: 556943 - DNA, 25 bp, Homo sapien
acctaggctatgtggtagagcctcc

SEQ ID NO: 556944 - DNA, 25 bp, Homo sapien
ggctatgtggtagagcctcctgctc

SEQ ID NO: 556945 - DNA, 25 bp, Homo sapien
ctgctcccactacaaacgtgtacag

SEQ ID NO: 556946 - DNA, 25 bp, Homo sapien
ctcccactacaaacgtgtacagcat

SEQ ID NO: 556947 - DNA, 25 bp, Homo sapien
tgttactttgctgaataccataggc

SEQ ID NO: 556948 - DNA, 25 bp, Homo sapien
attgtaatgcaatggtatctgtata

SEQ ID NO: 556949 - DNA, 25 bp, Homo sapien
tgcaatggtatctgtatatttaaac

SEQ ID NO: 556950 - DNA, 25 bp, Homo sapien
gatgaatacgacgacattgtggttc

SEQ ID NO: 556951 - DNA, 25 bp, Homo sapien
atgaatacgacgacattgtggttca

SEQ ID NO: 556952 - DNA, 25 bp, Homo sapien
tgaatacgacgacattgtggttcac

SEQ ID NO: 556953 - DNA, 25 bp, Homo sapien
gaatacgacgacattgtggttcaca

SEQ ID NO: 556954 - DNA, 25 bp, Homo sapien
aatacgacgacattgtggttcacag

SEQ ID NO: 556955 - DNA, 25 bp, Homo sapien
atacgacgacattgtggttcacagc

SEQ ID NO: 556956 - DNA, 25 bp, Homo sapien
tacgacgacattgtggttcacagca

SEQ ID NO: 556957 - DNA, 25 bp, Homo sapien
acgacgacattgtggttcacagcag

SEQ ID NO: 556958 - DNA, 25 bp, Homo sapien
cgacgacattgtggttcacagcagc

SEQ ID NO: 556959 - DNA, 25 bp, Homo sapien
gtctttctttgttataactattcat

SEQ ID NO: 556960 - DNA, 25 bp, Homo sapien
ctattcatttttagcttttgtctcc

SEQ ID NO: 556961 - DNA, 25 bp, Homo sapien
tgtctccagtgcatgatctcatatt

SEQ ID NO: 556962 - DNA, 25 bp, Homo sapien
atttattgtgctgtgatctctctgt

SEQ ID NO: 556963 - DNA, 25 bp, Homo sapien
tgctgtgatctctctgtgtggaatg

SEQ ID NO: 556964 - DNA, 25 bp, Homo sapien
aatgccttggtgagagagatgctta

SEQ ID NO: 556965 - DNA, 25 bp, Homo sapien
gactattatcatttctgaccaagct

SEQ ID NO: 556966 - DNA, 25 bp, Homo sapien
atcatttctgaccaagcttctatta

SEQ ID NO: 556967 - DNA, 25 bp, Homo sapien
ctgaccaagcttctattaatgttat

SEQ ID NO: 556968 - DNA, 25 bp, Homo sapien
acactatcttgattgtactctccag

SEQ ID NO: 556969 - DNA, 25 bp, Homo sapien
gattgtactctccagaaaatttttc

SEQ ID NO: 556970 - DNA, 25 bp, Homo sapien
ggaagggccagccacatgccatctt

SEQ ID NO: 556971 - DNA, 25 bp, Homo sapien
catcttccctgcgatcaggcaaaaa

SEQ ID NO: 556972 - DNA, 25 bp, Homo sapien
aagtcaaacctttatatgcatgtgt

SEQ ID NO: 556973 - DNA, 25 bp, Homo sapien
ttttttctcttcaagttgctttgtc

SEQ ID NO: 556974 - DNA, 25 bp, Homo sapien
aagttgctttgtcttttccatcctc

SEQ ID NO: 556975 - DNA, 25 bp, Homo sapien
atcctcatcacaagcccttgtttga

SEQ ID NO: 556976 - DNA, 25 bp, Homo sapien
agcccttgtttgagtgtcttatccc

SEQ ID NO: 556977 - DNA, 25 bp, Homo sapien
agtgtcttatccctgagcaatcttt

SEQ ID NO: 556978 - DNA, 25 bp, Homo sapien
cctgagcaatctttcgatggatgga

SEQ ID NO: 556979 - DNA, 25 bp, Homo sapien
ggagatgatcattaggtacttttgt

SEQ ID NO: 556980 - DNA, 25 bp, Homo sapien
tgtttcaacctttattcctgtaaat

SEQ ID NO: 556981 - DNA, 25 bp, Homo sapien
ctgcccatgtttcctcccaggaaga

SEQ ID NO: 556982 - DNA, 25 bp, Homo sapien
aagagcgggcagagtggcccagccc

SEQ ID NO: 556983 - DNA, 25 bp, Homo sapien
aggcagtgcttcctgagcagaccac

SEQ ID NO: 556984 - DNA, 25 bp, Homo sapien
gtgcttcctgagcagaccacccgga

SEQ ID NO: 556985 - DNA, 25 bp, Homo sapien
ctgagcagaccacccggactgtctt

SEQ ID NO: 556986 - DNA, 25 bp, Homo sapien
tggagaaagagcacgcccggccccg

SEQ ID NO: 556987 - DNA, 25 bp, Homo sapien
cttctcaggcattctgccctcctgg

SEQ ID NO: 556988 - DNA, 25 bp, Homo sapien
ctgaaggggctttgtggcatctctg

SEQ ID NO: 556989 - DNA, 25 bp, Homo sapien
tgctgcactcatgggcctggtctca

SEQ ID NO: 556990 - DNA, 25 bp, Homo sapien
catgggcctggtctcactccttgga

SEQ ID NO: 556991 - DNA, 25 bp, Homo sapien
tgggcctggtctcactccttggact

SEQ ID NO: 556992 - DNA, 25 bp, Homo sapien
tcacctgccagggtactgcggttac

SEQ ID NO: 556993 - DNA, 25 bp, Homo sapien
ctgccagggtactgcggttacaggc

SEQ ID NO: 556994 - DNA, 25 bp, Homo sapien
gccactttgccggtttctgaacata

SEQ ID NO: 556995 - DNA, 25 bp, Homo sapien
ctttgccggtttctgaacatagtat

SEQ ID NO: 556996 - DNA, 25 bp, Homo sapien
aacatagtatgttcagcctcagcaa

SEQ ID NO: 556997 - DNA, 25 bp, Homo sapien
atgttcagcctcagcaagaatgtgt

SEQ ID NO: 556998 - DNA, 25 bp, Homo sapien
agaatgtgtcagttgatgacgcaaa

SEQ ID NO: 556999 - DNA, 25 bp, Homo sapien
gtcagttgatgacgcaaatttcata

SEQ ID NO: 557000 - DNA, 25 bp, Homo sapien
aatggaatcttcaagctgttaagta

SEQ ID NO: 557001 - DNA, 25 bp, Homo sapien
cttcaagctgttaagtatctagact

SEQ ID NO: 557002 - DNA, 25 bp, Homo sapien
atctagactttactacccccagact

SEQ ID NO: 557003 - DNA, 25 bp, Homo sapien
gtgtccggccatgaagatggcaaga

SEQ ID NO: 557004 - DNA, 25 bp, Homo sapien
gcaagaagcctctgagacagcccaa

SEQ ID NO: 557005 - DNA, 25 bp, Homo sapien
cagcagaaagcaaaacagaccagaa

SEQ ID NO: 557006 - DNA, 25 bp, Homo sapien
aaagcaatgattttagcagcaccca

SEQ ID NO: 557007 - DNA, 25 bp, Homo sapien
gccgaaagcacaggccgcagggagg

SEQ ID NO: 557008 - DNA, 25 bp, Homo sapien
atgattttagcagcacccattttaa

SEQ ID NO: 557009 - DNA, 25 bp, Homo sapien
cagcacccattttaaagatccttcc

SEQ ID NO: 557010 - DNA, 25 bp, Homo sapien
cttcccagtctgcagcttacatttt

SEQ ID NO: 557011 - DNA, 25 bp, Homo sapien
cttacattttcaccctctcaaaagt

SEQ ID NO: 557012 - DNA, 25 bp, Homo sapien
ttttcaccctctcaaaagtgtcttc

SEQ ID NO: 557013 - DNA, 25 bp, Homo sapien
ctctcaaaagtgtcttctgtccatt

SEQ ID NO: 557014 - DNA, 25 bp, Homo sapien
gaaggccagcattgtgtacagcttt

SEQ ID NO: 557015 - DNA, 25 bp, Homo sapien
actacccaggctgaaactactgttg

SEQ ID NO: 557016 - DNA, 25 bp, Homo sapien
gttgaaccacaccaatatcttgcgg

SEQ ID NO: 557017 - DNA, 25 bp, Homo sapien
tatcttgcggcctcagtatcagtat

SEQ ID NO: 557018 - DNA, 25 bp, Homo sapien
gatgaagattctgtcagcgtctggg

SEQ ID NO: 557019 - DNA, 25 bp, Homo sapien
ggccaataagggagtcatagctgct

SEQ ID NO: 557020 - DNA, 25 bp, Homo sapien
atagctgctctccaagatcctacga

SEQ ID NO: 557021 - DNA, 25 bp, Homo sapien
agatcctacgattcttcaagctacc

SEQ ID NO: 557022 - DNA, 25 bp, Homo sapien
tgctggtcacggctcaacatatttc

SEQ ID NO: 557023 - DNA, 25 bp, Homo sapien
gctcaacatatttctggcattcttt

SEQ ID NO: 557024 - DNA, 25 bp, Homo sapien
gttggcccattgctatcttattaaa

SEQ ID NO: 557025 - DNA, 25 bp, Homo sapien
gagaggctaaaaatgctagagttcc

SEQ ID NO: 557026 - DNA, 25 bp, Homo sapien
aatgctagagttcctagaagagctc

SEQ ID NO: 557027 - DNA, 25 bp, Homo sapien
gaagagctcataggaatcaccccat

SEQ ID NO: 557028 - DNA, 25 bp, Homo sapien
aatcaccccatcacaagcaatcttt

SEQ ID NO: 557029 - DNA, 25 bp, Homo sapien
aagagccaagcaagccctgctggtc

SEQ ID NO: 557030 - DNA, 25 bp, Homo sapien
tgggtcttaaagagtgctgcccctc

SEQ ID NO: 557031 - DNA, 25 bp, Homo sapien
aggcctcccaagctgccaggtgcat

SEQ ID NO: 557032 - DNA, 25 bp, Homo sapien
ggtgcattcactcacttcgactcca

SEQ ID NO: 557033 - DNA, 25 bp, Homo sapien
acttcgactccatctgagggtccag

SEQ ID NO: 557034 - DNA, 25 bp, Homo sapien
cccatcacatgctggacacagcagt

SEQ ID NO: 557035 - DNA, 25 bp, Homo sapien
tggacacagcagtcggctccttcat

SEQ ID NO: 557036 - DNA, 25 bp, Homo sapien
aatataagtcataccggctgcgagc

SEQ ID NO: 557037 - DNA, 25 bp, Homo sapien
cggctgcgagcccagctatataaaa

SEQ ID NO: 557038 - DNA, 25 bp, Homo sapien
gcgagcccagctatataaaaagaga

SEQ ID NO: 557039 - DNA, 25 bp, Homo sapien
aagagagtgaccaatcaacttctgg

SEQ ID NO: 557040 - DNA, 25 bp, Homo sapien
agttccctgggactgacacaagttt

SEQ ID NO: 557041 - DNA, 25 bp, Homo sapien
ccctgggactgacacaagtttattt

SEQ ID NO: 557042 - DNA, 25 bp, Homo sapien
tcctcagagccttggaattctattt

SEQ ID NO: 557043 - DNA, 25 bp, Homo sapien
ggaattctattttatgaacctagag

SEQ ID NO: 557044 - DNA, 25 bp, Homo sapien
agcagaatccttacttttgtgagtc

SEQ ID NO: 557045 - DNA, 25 bp, Homo sapien
gaatccttacttttgtgagtctggt

SEQ ID NO: 557046 - DNA, 25 bp, Homo sapien
ttgtgagtctggttgaataaagctt

SEQ ID NO: 557047 - DNA, 25 bp, Homo sapien
tagactgtatgttgtgctgttttga

SEQ ID NO: 557048 - DNA, 25 bp, Homo sapien
gaattcttactatacctgagtcttt

SEQ ID NO: 557049 - DNA, 25 bp, Homo sapien
acctgagtcttttgtaagctatagt

SEQ ID NO: 557050 - DNA, 25 bp, Homo sapien
gctatagttttatgtacaaccttgt

SEQ ID NO: 557051 - DNA, 25 bp, Homo sapien
caaccttgtacagtttttttgacat

SEQ ID NO: 557052 - DNA, 25 bp, Homo sapien
ttttgacatacaattcagaactttg

SEQ ID NO: 557053 - DNA, 25 bp, Homo sapien
caattcagaactttgtttattctct

SEQ ID NO: 557054 - DNA, 25 bp, Homo sapien
ctttgttctggccaatacatttttt

SEQ ID NO: 557055 - DNA, 25 bp, Homo sapien
gctgttttgagtacactttatttcg

SEQ ID NO: 557056 - DNA, 25 bp, Homo sapien
agtattttctatacactctgaaatc

SEQ ID NO: 557057 - DNA, 25 bp, Homo sapien
aatcatgagcatttcactttttcta

SEQ ID NO: 557058 - DNA, 25 bp, Homo sapien
aaaaagttagcccataagcacgtgg

SEQ ID NO: 557059 - DNA, 25 bp, Homo sapien
agcacgtgggctgatcttgttggac

SEQ ID NO: 557060 - DNA, 25 bp, Homo sapien
gggctgatcttgttggactttaatt

SEQ ID NO: 557061 - DNA, 25 bp, Homo sapien
atggtatcctttttcacacacctta

SEQ ID NO: 557062 - DNA, 25 bp, Homo sapien
gaggtgctccggaaaagcattctga

SEQ ID NO: 557063 - DNA, 25 bp, Homo sapien
aacttagctatccacatgaggttag

SEQ ID NO: 557064 - DNA, 25 bp, Homo sapien
gagcttttacattcagacactaggg

SEQ ID NO: 557065 - DNA, 25 bp, Homo sapien
attcagacactagggctggcttggg

SEQ ID NO: 557066 - DNA, 25 bp, Homo sapien
ggccatttcctcagtggctgagtca

SEQ ID NO: 557067 - DNA, 25 bp, Homo sapien
ggctgagtcaggttccagaccttaa

SEQ ID NO: 557068 - DNA, 25 bp, Homo sapien
tgctcctgctcttgcaaagtgcaga

SEQ ID NO: 557069 - DNA, 25 bp, Homo sapien
agagcgcgcgccttgtgagagacaa

SEQ ID NO: 557070 - DNA, 25 bp, Homo sapien
gcgcgcgccttgtgagagacaacga

SEQ ID NO: 557071 - DNA, 25 bp, Homo sapien
gagagacaacgactgcctcagagtt

SEQ ID NO: 557072 - DNA, 25 bp, Homo sapien
acgactgcctcagagttaaattaga

SEQ ID NO: 557073 - DNA, 25 bp, Homo sapien
gttgctgagaattctgtagtcatca

SEQ ID NO: 557074 - DNA, 25 bp, Homo sapien
ctgtagtcatcagtaatggtgacat

SEQ ID NO: 557075 - DNA, 25 bp, Homo sapien
tgacattaatttatctcttagaaaa

SEQ ID NO: 557076 - DNA, 25 bp, Homo sapien
agaagcgggcatttcagttagagga

SEQ ID NO: 557077 - DNA, 25 bp, Homo sapien
aaactgaaccagattgcaaatattc

SEQ ID NO: 557078 - DNA, 25 bp, Homo sapien
gaagcattggaagagtcgagagaac

SEQ ID NO: 557079 - DNA, 25 bp, Homo sapien
gagaaggtcttggatctggaaccaa

SEQ ID NO: 557080 - DNA, 25 bp, Homo sapien
gagactgctgtgcaccccacagtct

SEQ ID NO: 557081 - DNA, 25 bp, Homo sapien
tgctgtgcaccccacagtctgactg

SEQ ID NO: 557082 - DNA, 25 bp, Homo sapien
cacagagccgcctctgttggcagga

SEQ ID NO: 557083 - DNA, 25 bp, Homo sapien
agccgcctctgttggcaggaggcac

SEQ ID NO: 557084 - DNA, 25 bp, Homo sapien
tcctgtgtattgagaagcagtgttt

SEQ ID NO: 557085 - DNA, 25 bp, Homo sapien
cagtgtttgccaatatattttgctt

SEQ ID NO: 557086 - DNA, 25 bp, Homo sapien
ttttgctttcaattccaagaggagc

SEQ ID NO: 557087 - DNA, 25 bp, Homo sapien
aggagctctgggaaaacctgtggat

SEQ ID NO: 557088 - DNA, 25 bp, Homo sapien
aacctgtggataaaaccaaatgcca

SEQ ID NO: 557089 - DNA, 25 bp, Homo sapien
accaaatgccaaatgttggacgttg

SEQ ID NO: 557090 - DNA, 25 bp, Homo sapien
aaatgccaaatgttggacgttgttt

SEQ ID NO: 557091 - DNA, 25 bp, Homo sapien
gggtggtggccgacgggcaagtaga

SEQ ID NO: 557092 - DNA, 25 bp, Homo sapien
ctgtccttcccgctgggctcactcc

SEQ ID NO: 557093 - DNA, 25 bp, Homo sapien
tggccgacgggcaagtagagaccgc

SEQ ID NO: 557094 - DNA, 25 bp, Homo sapien
gccgacgggcaagtagagaccgcga

SEQ ID NO: 557095 - DNA, 25 bp, Homo sapien
ccacttcccacaggagctgcttgtc

SEQ ID NO: 557096 - DNA, 25 bp, Homo sapien
gcttgtccccaaatcttgcctcagg

SEQ ID NO: 557097 - DNA, 25 bp, Homo sapien
cttgtccccaaatcttgcctcagga

SEQ ID NO: 557098 - DNA, 25 bp, Homo sapien
ttgtccccaaatcttgcctcaggac

SEQ ID NO: 557099 - DNA, 25 bp, Homo sapien
cgggcaagtagagaccgcgagggtc

SEQ ID NO: 557100 - DNA, 25 bp, Homo sapien
agtagagaccgcgagggtctggagg

SEQ ID NO: 557101 - DNA, 25 bp, Homo sapien
gtctggaggggcgaccggcctggca

SEQ ID NO: 557102 - DNA, 25 bp, Homo sapien
aaagagcatgaaagccccagccagc

SEQ ID NO: 557103 - DNA, 25 bp, Homo sapien
gggaggactcacagaaaccctctgt

SEQ ID NO: 557104 - DNA, 25 bp, Homo sapien
gaaaccctctgtacccagtcatggg

SEQ ID NO: 557105 - DNA, 25 bp, Homo sapien
agtcatgggccaaagacaccgtcat

SEQ ID NO: 557106 - DNA, 25 bp, Homo sapien
gggccaaagacaccgtcatgcaagg

SEQ ID NO: 557107 - DNA, 25 bp, Homo sapien
gggtgaaggctccacactcgtcccg

SEQ ID NO: 557108 - DNA, 25 bp, Homo sapien
ggacctcgagcagtctctggcagca

SEQ ID NO: 557109 - DNA, 25 bp, Homo sapien
cgagcagtctctggcagcagcctat

SEQ ID NO: 557110 - DNA, 25 bp, Homo sapien
atgtgccggtcgttgtggactctaa

SEQ ID NO: 557111 - DNA, 25 bp, Homo sapien
ggcagaatccggacaagctcaggtt

SEQ ID NO: 557112 - DNA, 25 bp, Homo sapien
ccggacaagctcaggttcaatttct

SEQ ID NO: 557113 - DNA, 25 bp, Homo sapien
ggttgccatgttttttagattaagt

SEQ ID NO: 557114 - DNA, 25 bp, Homo sapien
tgttttttagattaagtactgcacg

SEQ ID NO: 557115 - DNA, 25 bp, Homo sapien
tcgcttctgaaactgtcataagaaa

SEQ ID NO: 557116 - DNA, 25 bp, Homo sapien
tgaaactgtcataagaaactgcctc

SEQ ID NO: 557117 - DNA, 25 bp, Homo sapien
tgcagggtggacacacaagagcaga

SEQ ID NO: 557118 - DNA, 25 bp, Homo sapien
agggtggacacacaagagcagaatc

SEQ ID NO: 557119 - DNA, 25 bp, Homo sapien
gcctttaataactcatctgtgcctc

SEQ ID NO: 557120 - DNA, 25 bp, Homo sapien
ctttaataactcatctgtgcctcac

SEQ ID NO: 557121 - DNA, 25 bp, Homo sapien
taataactcatctgtgcctcacatg

SEQ ID NO: 557122 - DNA, 25 bp, Homo sapien
taactcatctgtgcctcacatgtca

SEQ ID NO: 557123 - DNA, 25 bp, Homo sapien
tcatctgtgcctcacatgtcagact

SEQ ID NO: 557124 - DNA, 25 bp, Homo sapien
gtttccccagccgttgtagtatcta

SEQ ID NO: 557125 - DNA, 25 bp, Homo sapien
tccccagccgttgtagtatctagta

SEQ ID NO: 557126 - DNA, 25 bp, Homo sapien
ggaccatagttatgtagcccagccc

SEQ ID NO: 557127 - DNA, 25 bp, Homo sapien
gcctgaccccagagcagaaccggaa

SEQ ID NO: 557128 - DNA, 25 bp, Homo sapien
agcagaaccggaacaccaggttggg

SEQ ID NO: 557129 - DNA, 25 bp, Homo sapien
gaccctttgccccttaggagaggtg

SEQ ID NO: 557130 - DNA, 25 bp, Homo sapien
ccccttaggagaggtgttggtcaca

SEQ ID NO: 557131 - DNA, 25 bp, Homo sapien
gttggtcacagatgtttacctcagt

SEQ ID NO: 557132 - DNA, 25 bp, Homo sapien
agatgtttacctcagtttatgtcac

SEQ ID NO: 557133 - DNA, 25 bp, Homo sapien
gtttatgtcactgtcgaagaaacaa

SEQ ID NO: 557134 - DNA, 25 bp, Homo sapien
aacactgtagacatgaagacttaga

SEQ ID NO: 557135 - DNA, 25 bp, Homo sapien
agtcagggacactcacagcaggagt

SEQ ID NO: 557136 - DNA, 25 bp, Homo sapien
gcaggagtgcctttgataatcatca

SEQ ID NO: 557137 - DNA, 25 bp, Homo sapien
gtgcctttgataatcatcagcccca

SEQ ID NO: 557138 - DNA, 25 bp, Homo sapien
ttgataatcatcagccccagatggc

SEQ ID NO: 557139 - DNA, 25 bp, Homo sapien
ggcacccagcatggctagaactctg

SEQ ID NO: 557140 - DNA, 25 bp, Homo sapien
gcatggctagaactctgaccaactt

SEQ ID NO: 557141 - DNA, 25 bp, Homo sapien
tagaactctgaccaacttctcactc

SEQ ID NO: 557142 - DNA, 25 bp, Homo sapien
ttactagcgccccactcatgaagat

SEQ ID NO: 557143 - DNA, 25 bp, Homo sapien
agcgccccactcatgaagatagaag

SEQ ID NO: 557144 - DNA, 25 bp, Homo sapien
gatttcaatgttagccaaagtcaag

SEQ ID NO: 557145 - DNA, 25 bp, Homo sapien
aatgttagccaaagtcaagccaaac

SEQ ID NO: 557146 - DNA, 25 bp, Homo sapien
gagggtctccaccaggcccactgaa

SEQ ID NO: 557147 - DNA, 25 bp, Homo sapien
tgaacagaaccccacggctgccaga

SEQ ID NO: 557148 - DNA, 25 bp, Homo sapien
acggctgccagaatgttccctgagc

SEQ ID NO: 557149 - DNA, 25 bp, Homo sapien
acactgtggccagtgggacagtcct

SEQ ID NO: 557150 - DNA, 25 bp, Homo sapien
ggacagtcctggtggctgacatcag

SEQ ID NO: 557151 - DNA, 25 bp, Homo sapien
atcagcgtccatgcttggctcaggg

SEQ ID NO: 557152 - DNA, 25 bp, Homo sapien
ggtcctgggtagagtcctagcccca

SEQ ID NO: 557153 - DNA, 25 bp, Homo sapien
gcccttcctccatgtgtttgtaaat

SEQ ID NO: 557154 - DNA, 25 bp, Homo sapien
tgtaaatactctggcatcctttggc

SEQ ID NO: 557155 - DNA, 25 bp, Homo sapien
gccctgagaaggtttttaaatgtgt

SEQ ID NO: 557156 - DNA, 25 bp, Homo sapien
ttacttctctaaacatgacgattgc

SEQ ID NO: 557157 - DNA, 25 bp, Homo sapien
ggcatggccacgtccatcggagtgt

SEQ ID NO: 557158 - DNA, 25 bp, Homo sapien
tccatcggagtgtccttctcggtgg

SEQ ID NO: 557159 - DNA, 25 bp, Homo sapien
gggagcccgagaacacctatattct

SEQ ID NO: 557160 - DNA, 25 bp, Homo sapien
agaacacctatattctgcggcctgt

SEQ ID NO: 557161 - DNA, 25 bp, Homo sapien
atattctgcggcctgttttccagca

SEQ ID NO: 557162 - DNA, 25 bp, Homo sapien
tgttttccagcagaggttcaggccc

SEQ ID NO: 557163 - DNA, 25 bp, Homo sapien
gttcaggccctctgtggttaaagac

SEQ ID NO: 557164 - DNA, 25 bp, Homo sapien
aaagactgtatccatgctgtgctca

SEQ ID NO: 557165 - DNA, 25 bp, Homo sapien
ggcaaatgctgaatattctccagaa

SEQ ID NO: 557166 - DNA, 25 bp, Homo sapien
atgcctcagcttacaaaacatttat

SEQ ID NO: 557167 - DNA, 25 bp, Homo sapien
gctaggccttcatcgcgagctacgc

SEQ ID NO: 557168 - DNA, 25 bp, Homo sapien
ttttagggtttgtgctctgagataa

SEQ ID NO: 557169 - DNA, 25 bp, Homo sapien
gtgctctgagataaacgaaagctac

SEQ ID NO: 557170 - DNA, 25 bp, Homo sapien
caaacacacactacagagagggaaa

SEQ ID NO: 557171 - DNA, 25 bp, Homo sapien
gaaagctacagcgagagaacataac

SEQ ID NO: 557172 - DNA, 25 bp, Homo sapien
gagagaacataaccaatcccaaaga

SEQ ID NO: 557173 - DNA, 25 bp, Homo sapien
ctgggaggaatatttgacagtactt

SEQ ID NO: 557174 - DNA, 25 bp, Homo sapien
tgatattgtctctcagagttgcaaa

SEQ ID NO: 557175 - DNA, 25 bp, Homo sapien
gagttgcaaactagattgtacacaa

SEQ ID NO: 557176 - DNA, 25 bp, Homo sapien
acaacattagtgtcagatagctttg

SEQ ID NO: 557177 - DNA, 25 bp, Homo sapien
gagagggaaacactaccgcgaccca

SEQ ID NO: 557178 - DNA, 25 bp, Homo sapien
accgcgacccaggattgtcctgaaa

SEQ ID NO: 557179 - DNA, 25 bp, Homo sapien
gattcacttcctaaattggaggcca

SEQ ID NO: 557180 - DNA, 25 bp, Homo sapien
tgacttgaggcctttgcagttttct

SEQ ID NO: 557181 - DNA, 25 bp, Homo sapien
ggtcatgcctttgtaatcattccga

SEQ ID NO: 557182 - DNA, 25 bp, Homo sapien
taatcattccgatggcctgcatcaa

SEQ ID NO: 557183 - DNA, 25 bp, Homo sapien
ggtggccagagcctttggtctaacc

SEQ ID NO: 557184 - DNA, 25 bp, Homo sapien
agagcctttggtctaaccctgagtg

SEQ ID NO: 557185 - DNA, 25 bp, Homo sapien
taaccctgagtgtctgggcgttgtg

SEQ ID NO: 557186 - DNA, 25 bp, Homo sapien
gcagagcgagaaagccctggctgtt

SEQ ID NO: 557187 - DNA, 25 bp, Homo sapien
gtgtgtccaccagtgcttcctggca

SEQ ID NO: 557188 - DNA, 25 bp, Homo sapien
tgcttcacttcttgtttccagagat

SEQ ID NO: 557189 - DNA, 25 bp, Homo sapien
ttcttgtttccagagattcacggca

SEQ ID NO: 557190 - DNA, 25 bp, Homo sapien
ctgagcatgaaggtgtgtctgttct

SEQ ID NO: 557191 - DNA, 25 bp, Homo sapien
gaaaccgaggcgtctaccatgacga

SEQ ID NO: 557192 - DNA, 25 bp, Homo sapien
cgataagcaaccaacgttcagagca

SEQ ID NO: 557193 - DNA, 25 bp, Homo sapien
gagcactctatgaagcaatacggga

SEQ ID NO: 557194 - DNA, 25 bp, Homo sapien
ggattttccctttcaagacaatctc

SEQ ID NO: 557195 - DNA, 25 bp, Homo sapien
aagacaatctctttcaatccatgta

SEQ ID NO: 557196 - DNA, 25 bp, Homo sapien
tctctttcaatccatgtattacccc

SEQ ID NO: 557197 - DNA, 25 bp, Homo sapien
cactttatgtggacgaatcccgcaa

SEQ ID NO: 557198 - DNA, 25 bp, Homo sapien
aatcccgcaagtttttctgaagcaa

SEQ ID NO: 557199 - DNA, 25 bp, Homo sapien
gaaaagggcttatgagaaacacgtc

SEQ ID NO: 557200 - DNA, 25 bp, Homo sapien
aaacacgtcatcatccatgttggcc

SEQ ID NO: 557201 - DNA, 25 bp, Homo sapien
tggcagcagaggaatgtcacaggtc

SEQ ID NO: 557202 - DNA, 25 bp, Homo sapien
aatgtcacaggtcagcagcctaggc

SEQ ID NO: 557203 - DNA, 25 bp, Homo sapien
agcctaggcctccagctataaatag

SEQ ID NO: 557204 - DNA, 25 bp, Homo sapien
gctataaatagtccggagggcccga

SEQ ID NO: 557205 - DNA, 25 bp, Homo sapien
agcagggctgtcagcttcctgtgtg

SEQ ID NO: 557206 - DNA, 25 bp, Homo sapien
cagcttcctgtgtggcagcacctgg

SEQ ID NO: 557207 - DNA, 25 bp, Homo sapien
tgtggcagcacctggcacactggct

SEQ ID NO: 557208 - DNA, 25 bp, Homo sapien
ggcacactggctctggccagcatta

SEQ ID NO: 557209 - DNA, 25 bp, Homo sapien
tggctctggccagcattatgctaaa

SEQ ID NO: 557210 - DNA, 25 bp, Homo sapien
agcattatgctaaaaccctgttact

SEQ ID NO: 557211 - DNA, 25 bp, Homo sapien
tgctaaaaccctgttactctccaat

SEQ ID NO: 557212 - DNA, 25 bp, Homo sapien
tctctgactggtgaaatacatggat

SEQ ID NO: 557213 - DNA, 25 bp, Homo sapien
tctgactggtgaaatacatggatac

SEQ ID NO: 557214 - DNA, 25 bp, Homo sapien
ctggtgaaatacatggatacctttt

SEQ ID NO: 557215 - DNA, 25 bp, Homo sapien
ggtgaaatacatggataccttttat

SEQ ID NO: 557216 - DNA, 25 bp, Homo sapien
gaaatacatggataccttttataga

SEQ ID NO: 557217 - DNA, 25 bp, Homo sapien
aatacatggataccttttatagaaa

SEQ ID NO: 557218 - DNA, 25 bp, Homo sapien
tacatggataccttttatagaaaaa

SEQ ID NO: 557219 - DNA, 25 bp, Homo sapien
tatagaaaaagcattctgggctggg

SEQ ID NO: 557220 - DNA, 25 bp, Homo sapien
gggaggcgtagctagcggtgggcca

SEQ ID NO: 557221 - DNA, 25 bp, Homo sapien
gcgtagctagcggtgggccaggacc

SEQ ID NO: 557222 - DNA, 25 bp, Homo sapien
cggtgggccaggaccgtgccactgt

SEQ ID NO: 557223 - DNA, 25 bp, Homo sapien
gccttcaggaaagtgaaagacgctt

SEQ ID NO: 557224 - DNA, 25 bp, Homo sapien
agacgcttaggctgtcaacacttaa

SEQ ID NO: 557225 - DNA, 25 bp, Homo sapien
tgtcaacacttaaaggaagtcccct

SEQ ID NO: 557226 - DNA, 25 bp, Homo sapien
ccccttgaagcccagagtggacaga

SEQ ID NO: 557227 - DNA, 25 bp, Homo sapien
gagtggacagactagacccattgat

SEQ ID NO: 557228 - DNA, 25 bp, Homo sapien
cactggccatggtccgtggacaaga

SEQ ID NO: 557229 - DNA, 25 bp, Homo sapien
tggtccgtggacaagacattcctgt

SEQ ID NO: 557230 - DNA, 25 bp, Homo sapien
cgtggacaagacattcctgtgggcc

SEQ ID NO: 557231 - DNA, 25 bp, Homo sapien
attcctgtgggccatggcacaccgg

SEQ ID NO: 557232 - DNA, 25 bp, Homo sapien
aaatgtgtacttgtggggtctcgcc

SEQ ID NO: 557233 - DNA, 25 bp, Homo sapien
actcctgtcattggacgtttcttcc

SEQ ID NO: 557234 - DNA, 25 bp, Homo sapien
gaactacgaggatgaattgactcaa

SEQ ID NO: 557235 - DNA, 25 bp, Homo sapien
attgactcaagtagctctagctctg

SEQ ID NO: 557236 - DNA, 25 bp, Homo sapien
agtagctctagctctggttgaggat

SEQ ID NO: 557237 - DNA, 25 bp, Homo sapien
gaggatgtcatcaattatgctgtta

SEQ ID NO: 557238 - DNA, 25 bp, Homo sapien
tggaagaggagcgaaaccctttgaa

SEQ ID NO: 557239 - DNA, 25 bp, Homo sapien
catcaagtggatgactcacggtgaa

SEQ ID NO: 557240 - DNA, 25 bp, Homo sapien
gatgactcacggtgaattcactgtg

SEQ ID NO: 557241 - DNA, 25 bp, Homo sapien
tcactgtggaaaagggtcttaaaca

SEQ ID NO: 557242 - DNA, 25 bp, Homo sapien
tgaggataacaaagccgcaagccaa

SEQ ID NO: 557243 - DNA, 25 bp, Homo sapien
agccgcaagccaaacaatgccgaat

SEQ ID NO: 557244 - DNA, 25 bp, Homo sapien
aatgccgaatacacaagacaagaac

SEQ ID NO: 557245 - DNA, 25 bp, Homo sapien
agtggtcgcccatctgccctttgat

SEQ ID NO: 557246 - DNA, 25 bp, Homo sapien
tgccctttgatgacaccaatctcaa

SEQ ID NO: 557247 - DNA, 25 bp, Homo sapien
atgacaccaatctcaaaaagctgct

SEQ ID NO: 557248 - DNA, 25 bp, Homo sapien
aggaggtcactttcccagctaacca

SEQ ID NO: 557249 - DNA, 25 bp, Homo sapien
actgctcattgcctgtgtggcacaa

SEQ ID NO: 557250 - DNA, 25 bp, Homo sapien
ttgcctgtgtggcacaatggagaaa

SEQ ID NO: 557251 - DNA, 25 bp, Homo sapien
aaaaactcaggcaagacctctctct

SEQ ID NO: 557252 - DNA, 25 bp, Homo sapien
agccactaagcgtgccaccattctg

SEQ ID NO: 557253 - DNA, 25 bp, Homo sapien
agcgtgccaccattctggacatcat

SEQ ID NO: 557254 - DNA, 25 bp, Homo sapien
acatcatcaaggattcctgggtgct

SEQ ID NO: 557255 - DNA, 25 bp, Homo sapien
tcaaggattcctgggtgctcaagtt

SEQ ID NO: 557256 - DNA, 25 bp, Homo sapien
ggcctagaatttacactgggttgac

SEQ ID NO: 557257 - DNA, 25 bp, Homo sapien
agaatttacactgggttgactagtt

SEQ ID NO: 557258 - DNA, 25 bp, Homo sapien
tacactgggttgactagttatgatg

SEQ ID NO: 557259 - DNA, 25 bp, Homo sapien
ctgggttgactagttatgatgggaa

SEQ ID NO: 557260 - DNA, 25 bp, Homo sapien
ttttttagtatgcacgtagaagaat

SEQ ID NO: 557261 - DNA, 25 bp, Homo sapien
tagagaagggttctttgaagaaaca

SEQ ID NO: 557262 - DNA, 25 bp, Homo sapien
ttgaagaaacactgcaattttgggt

SEQ ID NO: 557263 - DNA, 25 bp, Homo sapien
ctgcaattttgggtgttctctttct

SEQ ID NO: 557264 - DNA, 25 bp, Homo sapien
tgcaattttgggtgttctctttctt

SEQ ID NO: 557265 - DNA, 25 bp, Homo sapien
caattttgggtgttctctttcttgt

SEQ ID NO: 557266 - DNA, 25 bp, Homo sapien
gttctctttcttgtttgcatatggc

SEQ ID NO: 557267 - DNA, 25 bp, Homo sapien
cacaagtctatggagacaggccaaa

SEQ ID NO: 557268 - DNA, 25 bp, Homo sapien
ctcctggtctgtacccaaaaaagct

SEQ ID NO: 557269 - DNA, 25 bp, Homo sapien
ggaaaacaggccaatgccccggcaa

SEQ ID NO: 557270 - DNA, 25 bp, Homo sapien
aatgccccggcaagaaaggttgaga

SEQ ID NO: 557271 - DNA, 25 bp, Homo sapien
gccccggcaagaaaggttgagatca

SEQ ID NO: 557272 - DNA, 25 bp, Homo sapien
tgagatcagatgttaggaagaactt

SEQ ID NO: 557273 - DNA, 25 bp, Homo sapien
gggtccagttctctatggattctta

SEQ ID NO: 557274 - DNA, 25 bp, Homo sapien
agttctctatggattcttacattta

SEQ ID NO: 557275 - DNA, 25 bp, Homo sapien
ggattcttacatttaatttgtaggg

SEQ ID NO: 557276 - DNA, 25 bp, Homo sapien
taatttgtagggaaatgccattttt

SEQ ID NO: 557277 - DNA, 25 bp, Homo sapien
caaggcatggggctcacaagtctat

SEQ ID NO: 557278 - DNA, 25 bp, Homo sapien
gtgaacccactgaaaagtgattttt

SEQ ID NO: 557279 - DNA, 25 bp, Homo sapien
atttttaatgttctccagcaaactt

SEQ ID NO: 557280 - DNA, 25 bp, Homo sapien
aatgttctccagcaaacttcactcc

SEQ ID NO: 557281 - DNA, 25 bp, Homo sapien
aaacttcactcctgtttcatgttca

SEQ ID NO: 557282 - DNA, 25 bp, Homo sapien
actcctgtttcatgttcactggtat

SEQ ID NO: 557283 - DNA, 25 bp, Homo sapien
ttcactggtatttggtgcatttgct

SEQ ID NO: 557284 - DNA, 25 bp, Homo sapien
tatttggtgcatttgcttgtaatac

SEQ ID NO: 557285 - DNA, 25 bp, Homo sapien
gctagtagtttacattaaattgcct

SEQ ID NO: 557286 - DNA, 25 bp, Homo sapien
gaatctagtaatttatcagttttgt

SEQ ID NO: 557287 - DNA, 25 bp, Homo sapien
taatttttagcctaccatgtgtaca

SEQ ID NO: 557288 - DNA, 25 bp, Homo sapien
gcctaccatgtgtacaaaatctact

SEQ ID NO: 557289 - DNA, 25 bp, Homo sapien
agtttctttcctgtcatatattctg

SEQ ID NO: 557290 - DNA, 25 bp, Homo sapien
gtgagttctctccaatgatctgttc

SEQ ID NO: 557291 - DNA, 25 bp, Homo sapien
tgttcttcaaccactgtctcatggt

SEQ ID NO: 557292 - DNA, 25 bp, Homo sapien
ttttttcatctgaggaccacatggt

SEQ ID NO: 557293 - DNA, 25 bp, Homo sapien
gaccacatggtgaccgagaactcgc

SEQ ID NO: 557294 - DNA, 25 bp, Homo sapien
agggtcttgatctgcacctgcttct

SEQ ID NO: 557295 - DNA, 25 bp, Homo sapien
ctttatgagggcaagctattgttct

SEQ ID NO: 557296 - DNA, 25 bp, Homo sapien
tgttcttggagcatcatcttcttta

SEQ ID NO: 557297 - DNA, 25 bp, Homo sapien
atttttcttggcttcattctagcaa

SEQ ID NO: 557298 - DNA, 25 bp, Homo sapien
caaattctgccagttgtttgggatc

SEQ ID NO: 557299 - DNA, 25 bp, Homo sapien
aatgccaggtattcctccaggagga

SEQ ID NO: 557300 - DNA, 25 bp, Homo sapien
ataacaaccatgtgtgcggcgttca

SEQ ID NO: 557301 - DNA, 25 bp, Homo sapien
ttcacgataccccaggctcagtgag

SEQ ID NO: 557302 - DNA, 25 bp, Homo sapien
ggctcagtgagccttttactcaggg

SEQ ID NO: 557303 - DNA, 25 bp, Homo sapien
tttactcagggtctcatgtgatgct

SEQ ID NO: 557304 - DNA, 25 bp, Homo sapien
catgaagtttagaagcctgtgcaca

SEQ ID NO: 557305 - DNA, 25 bp, Homo sapien
gaagcctgtgcacacgaagagacgt

SEQ ID NO: 557306 - DNA, 25 bp, Homo sapien
cgaagagacgtggtgtttccctatt

SEQ ID NO: 557307 - DNA, 25 bp, Homo sapien
gtggtgtttccctattgatccaaac

SEQ ID NO: 557308 - DNA, 25 bp, Homo sapien
tgatccaaactgcatgctgacctgt

SEQ ID NO: 557309 - DNA, 25 bp, Homo sapien
tttccatgccactgcggaagtgcta

SEQ ID NO: 557310 - DNA, 25 bp, Homo sapien
gaagaccagggcattgccaagtgaa

SEQ ID NO: 557311 - DNA, 25 bp, Homo sapien
attttcccatcttaggctccagaag

SEQ ID NO: 557312 - DNA, 25 bp, Homo sapien
gaagcagaatcaagtgggatgtctt

SEQ ID NO: 557313 - DNA, 25 bp, Homo sapien
caaaaggcccactaggtggagtgaa

SEQ ID NO: 557314 - DNA, 25 bp, Homo sapien
accgagacgggctggatggaaaact

SEQ ID NO: 557315 - DNA, 25 bp, Homo sapien
tcaatttcacctttaagttttctca

SEQ ID NO: 557316 - DNA, 25 bp, Homo sapien
ggaggagcattaagaatcagccacc

SEQ ID NO: 557317 - DNA, 25 bp, Homo sapien
gaatcagccaccttagtacatactt

SEQ ID NO: 557318 - DNA, 25 bp, Homo sapien
agccaccttagtacatacttaaaga

SEQ ID NO: 557319 - DNA, 25 bp, Homo sapien
aagatttactgaaacctgatcctgt

SEQ ID NO: 557320 - DNA, 25 bp, Homo sapien
aaaactctttccagacagactccgg

SEQ ID NO: 557321 - DNA, 25 bp, Homo sapien
tgcaacctgcgacacctgccatttt

SEQ ID NO: 557322 - DNA, 25 bp, Homo sapien
aagcaagttcatatctgagccagag

SEQ ID NO: 557323 - DNA, 25 bp, Homo sapien
aggacactagataaagccatgagct

SEQ ID NO: 557324 - DNA, 25 bp, Homo sapien
gagccagagggcataattatgtcag

SEQ ID NO: 557325 - DNA, 25 bp, Homo sapien
aattatgtcggaataaaatgccctg

SEQ ID NO: 557326 - DNA, 25 bp, Homo sapien
aaatgccctgtactaaagaggtcaa

SEQ ID NO: 557327 - DNA, 25 bp, Homo sapien
tactaaagaggtcaactaacaggct

SEQ ID NO: 557328 - DNA, 25 bp, Homo sapien
acaggctgggaaatcttaagttttg

SEQ ID NO: 557329 - DNA, 25 bp, Homo sapien
atgagcttgagatggtgtacttgaa

SEQ ID NO: 557330 - DNA, 25 bp, Homo sapien
gaaaggaccgtttcaagatcaggtt

SEQ ID NO: 557331 - DNA, 25 bp, Homo sapien
gatcaggttttataacacactcatt

SEQ ID NO: 557332 - DNA, 25 bp, Homo sapien
aacacactcattatttatttcttct

SEQ ID NO: 557333 - DNA, 25 bp, Homo sapien
tgatcagctgatatggaagtatgtc

SEQ ID NO: 557334 - DNA, 25 bp, Homo sapien
aggagtgctgtgcaattccattcaa

SEQ ID NO: 557335 - DNA, 25 bp, Homo sapien
gtgcaattccattcaatgccagtga

SEQ ID NO: 557336 - DNA, 25 bp, Homo sapien
attccattcaatgccagtgatgctt

SEQ ID NO: 557337 - DNA, 25 bp, Homo sapien
ccagtgatgcttatggccgttttta

SEQ ID NO: 557338 - DNA, 25 bp, Homo sapien
tatggccgtttttatgagttctgtc

SEQ ID NO: 557339 - DNA, 25 bp, Homo sapien
ttatgagttctgtcattttcaaatg

SEQ ID NO: 557340 - DNA, 25 bp, Homo sapien
gtttaagcagggactgacgtaatca

SEQ ID NO: 557341 - DNA, 25 bp, Homo sapien
gacgtaatcagatctgtgtttttcc

SEQ ID NO: 557342 - DNA, 25 bp, Homo sapien
ggtaatgcaaaagcatcattccaca

SEQ ID NO: 557343 - DNA, 25 bp, Homo sapien
gcatcattccacaattctcttgtaa

SEQ ID NO: 557344 - DNA, 25 bp, Homo sapien
gtgaccattcagagctgtcccagaa

SEQ ID NO: 557345 - DNA, 25 bp, Homo sapien
aagcaggctgccacgcagagtgagc

SEQ ID NO: 557346 - DNA, 25 bp, Homo sapien
gcagagtgagctgcactacgcaaat

SEQ ID NO: 557347 - DNA, 25 bp, Homo sapien
tgcactacgcaaatctggagctgct

SEQ ID NO: 557348 - DNA, 25 bp, Homo sapien
tggagctgctgatgtggcctctgca

SEQ ID NO: 557349 - DNA, 25 bp, Homo sapien
ggcctctgcaggaaaagccagcacc

SEQ ID NO: 557350 - DNA, 25 bp, Homo sapien
ggtggaatacagcactgtggcctcc

SEQ ID NO: 557351 - DNA, 25 bp, Homo sapien
gggaagaacttcactatgcctcggt

SEQ ID NO: 557352 - DNA, 25 bp, Homo sapien
atgcctcggtggtgtttgattctaa

SEQ ID NO: 557353 - DNA, 25 bp, Homo sapien
gtttgattctaacaccaacaggata

SEQ ID NO: 557354 - DNA, 25 bp, Homo sapien
aacaggatagctgctcagaggcctc

SEQ ID NO: 557355 - DNA, 25 bp, Homo sapien
gaaaaagacttctctgtaaagatac

SEQ ID NO: 557356 - DNA, 25 bp, Homo sapien
gttaaatgctagagaagctctttaa

SEQ ID NO: 557357 - DNA, 25 bp, Homo sapien
tgtcaaatagagaaagaacccctgc

SEQ ID NO: 557358 - DNA, 25 bp, Homo sapien
gagaaagaacccctgcatagaaagt

SEQ ID NO: 557359 - DNA, 25 bp, Homo sapien
gaacccctgcatagaaagtgctgtt

SEQ ID NO: 557360 - DNA, 25 bp, Homo sapien
gaaagtgctgttttaactatctgat

SEQ ID NO: 557361 - DNA, 25 bp, Homo sapien
ctaaacaatagcttatcagagtcag

SEQ ID NO: 557362 - DNA, 25 bp, Homo sapien
aatagcttatcagagtcagctcaaa

SEQ ID NO: 557363 - DNA, 25 bp, Homo sapien
gtattctctcatggttttagctttt

SEQ ID NO: 557364 - DNA, 25 bp, Homo sapien
ctctcatggttttagcttttgactt

SEQ ID NO: 557365 - DNA, 25 bp, Homo sapien
ctgtgtaaatagacataaggtgctt

SEQ ID NO: 557366 - DNA, 25 bp, Homo sapien
aagcaggctgccacgcagagtgagc

SEQ ID NO: 557367 - DNA, 25 bp, Homo sapien
tgccacgcagagtgagctgcactac

SEQ ID NO: 557368 - DNA, 25 bp, Homo sapien
gcagagtgagctgcactacgcaaat

SEQ ID NO: 557369 - DNA, 25 bp, Homo sapien
agtgagctgcactacgcaaatctgg

SEQ ID NO: 557370 - DNA, 25 bp, Homo sapien
gctgcactacgcaaatctggagctg

SEQ ID NO: 557371 - DNA, 25 bp, Homo sapien
gcactacgcaaatctggagctgctg

SEQ ID NO: 557372 - DNA, 25 bp, Homo sapien
tggagctgctgatgtggcctctgca

SEQ ID NO: 557373 - DNA, 25 bp, Homo sapien
ggcctctgcaggaaaagccagcacc

SEQ ID NO: 557374 - DNA, 25 bp, Homo sapien
aggtggaatacagcactgtggcctc

SEQ ID NO: 557375 - DNA, 25 bp, Homo sapien
tggaatacagcactgtggcctcccc

SEQ ID NO: 557376 - DNA, 25 bp, Homo sapien
gatagctgctcagaggcctcgggag

SEQ ID NO: 557377 - DNA, 25 bp, Homo sapien
tggagcaaggtctcttcccggcttg

SEQ ID NO: 557378 - DNA, 25 bp, Homo sapien
tctcttcccggcttggcaatctcag

SEQ ID NO: 557379 - DNA, 25 bp, Homo sapien
aatctcagctgtgccggcgctacgg

SEQ ID NO: 557380 - DNA, 25 bp, Homo sapien
aaaccaaagggcaggcacggcagca

SEQ ID NO: 557381 - DNA, 25 bp, Homo sapien
aggcacggcagcaaacgcctgagtg

SEQ ID NO: 557382 - DNA, 25 bp, Homo sapien
aaacgcctgagtgctgctgccttcg

SEQ ID NO: 557383 - DNA, 25 bp, Homo sapien
tgctgccttcggtgactatatgaga

SEQ ID NO: 557384 - DNA, 25 bp, Homo sapien
gagaatggaaacttctaaggaagcc

SEQ ID NO: 557385 - DNA, 25 bp, Homo sapien
tgttaccccctttactcagagataa

SEQ ID NO: 557386 - DNA, 25 bp, Homo sapien
taacatagattatccaggctgagat

SEQ ID NO: 557387 - DNA, 25 bp, Homo sapien
aattttcaacacagactccctgctt

SEQ ID NO: 557388 - DNA, 25 bp, Homo sapien
aatgctaatgcaaatctccatggcg

SEQ ID NO: 557389 - DNA, 25 bp, Homo sapien
atctccatggcgatccttctgagaa

SEQ ID NO: 557390 - DNA, 25 bp, Homo sapien
cttctgagaattatcgtgggccaca

SEQ ID NO: 557391 - DNA, 25 bp, Homo sapien
tgggccacaggtgtctcctggcagt

SEQ ID NO: 557392 - DNA, 25 bp, Homo sapien
attctggtccaggagattttggatc

SEQ ID NO: 557393 - DNA, 25 bp, Homo sapien
acaacaccgagcgaaatgccaagta

SEQ ID NO: 557394 - DNA, 25 bp, Homo sapien
tatcaacaccgttacatgctggtat

SEQ ID NO: 557395 - DNA, 25 bp, Homo sapien
aattatcaagctggtggttctgaga

SEQ ID NO: 557396 - DNA, 25 bp, Homo sapien
gaatttacaattctctcctggcatt

SEQ ID NO: 557397 - DNA, 25 bp, Homo sapien
attctctcctggcattgaggacaaa

SEQ ID NO: 557398 - DNA, 25 bp, Homo sapien
atttccaatgatgaagccaatgcta

SEQ ID NO: 557399 - DNA, 25 bp, Homo sapien
gtatttttcattaacgcaaagacct

SEQ ID NO: 557400 - DNA, 25 bp, Homo sapien
cgcaaagacctatttctcctttttg

SEQ ID NO: 557401 - DNA, 25 bp, Homo sapien
ttttgtacattgtccatgtgcgcaa

SEQ ID NO: 557402 - DNA, 25 bp, Homo sapien
atgtgcgcaacccttaacgagcaat

SEQ ID NO: 557403 - DNA, 25 bp, Homo sapien
caatagaatgtatggtcacctgggt

SEQ ID NO: 557404 - DNA, 25 bp, Homo sapien
ctgtgccctgcatgattctgtgttg

SEQ ID NO: 557405 - DNA, 25 bp, Homo sapien
atgattctgtgttgccgctgctgca

SEQ ID NO: 557406 - DNA, 25 bp, Homo sapien
gttgccgctgctgcatagttcccag

SEQ ID NO: 557407 - DNA, 25 bp, Homo sapien
cccaccagggcttgtgtcataggga

SEQ ID NO: 557408 - DNA, 25 bp, Homo sapien
gtgtcatagggagccctttgcactc

SEQ ID NO: 557409 - DNA, 25 bp, Homo sapien
actcctcgtgtgttggcaaacgcag

SEQ ID NO: 557410 - DNA, 25 bp, Homo sapien
gagactgctgtgcaccccacagtct

SEQ ID NO: 557411 - DNA, 25 bp, Homo sapien
tgctgtgcaccccacagtctgactg

SEQ ID NO: 557412 - DNA, 25 bp, Homo sapien
accccacagtctgactgcacagagc

SEQ ID NO: 557413 - DNA, 25 bp, Homo sapien
cacagagccgcctctgttggcagga

SEQ ID NO: 557414 - DNA, 25 bp, Homo sapien
agccgcctctgttggcaggaggcac

SEQ ID NO: 557415 - DNA, 25 bp, Homo sapien
tcctgtgtattgagaagcagtgttt

SEQ ID NO: 557416 - DNA, 25 bp, Homo sapien
ctgtgtattgagaagcagtgtttgc

SEQ ID NO: 557417 - DNA, 25 bp, Homo sapien
aacctgtggataaaaccaaatgcca

SEQ ID NO: 557418 - DNA, 25 bp, Homo sapien
ggataaaaccaaatgccaaatgttg

SEQ ID NO: 557419 - DNA, 25 bp, Homo sapien
accaaatgccaaatgttggacgttg

SEQ ID NO: 557420 - DNA, 25 bp, Homo sapien
aaatgccaaatgttggacgttgttt

SEQ ID NO: 557421 - DNA, 25 bp, Homo sapien
ttaaaaatccagctgcagtggccgt

SEQ ID NO: 557422 - DNA, 25 bp, Homo sapien
aatccagctgcagtggccgtggaag

SEQ ID NO: 557423 - DNA, 25 bp, Homo sapien
tctgcctgtgggaggcttgaagcca

SEQ ID NO: 557424 - DNA, 25 bp, Homo sapien
actgccgagcagaaacagtttattg

SEQ ID NO: 557425 - DNA, 25 bp, Homo sapien
gaaacagtttattgccacaagccaa

SEQ ID NO: 557426 - DNA, 25 bp, Homo sapien
aagccaagtactactccaggcacgg

SEQ ID NO: 557427 - DNA, 25 bp, Homo sapien
tccaggcacggaggactcagaagat

SEQ ID NO: 557428 - DNA, 25 bp, Homo sapien
gattttccattaagaaggaacctct

SEQ ID NO: 557429 - DNA, 25 bp, Homo sapien
ctctttctgctgatgtctgaagaac

SEQ ID NO: 557430 - DNA, 25 bp, Homo sapien
ttgtgagccacataagagaattaag

SEQ ID NO: 557431 - DNA, 25 bp, Homo sapien
gtactggaagaagaacgtcatatta

SEQ ID NO: 557432 - DNA, 25 bp, Homo sapien
gaaagcaaccgttatttagtatctg

SEQ ID NO: 557433 - DNA, 25 bp, Homo sapien
aaagcaaccgttatttagtatctgt

SEQ ID NO: 557434 - DNA, 25 bp, Homo sapien
tagtatctgttattgctgagtacaa

SEQ ID NO: 557435 - DNA, 25 bp, Homo sapien
gtatctgttattgctgagtacaatg

SEQ ID NO: 557436 - DNA, 25 bp, Homo sapien
atctgttattgctgagtacaatgta

SEQ ID NO: 557437 - DNA, 25 bp, Homo sapien
ctgttattgctgagtacaatgtaat

SEQ ID NO: 557438 - DNA, 25 bp, Homo sapien
gtaatatagaacttgaacttgaatt

SEQ ID NO: 557439 - DNA, 25 bp, Homo sapien
cttgaattcaaacttacactcctcc

SEQ ID NO: 557440 - DNA, 25 bp, Homo sapien
tgaattcaaacttacactcctccaa

SEQ ID NO: 557441 - DNA, 25 bp, Homo sapien
gaattcaaacttacactcctccaaa

SEQ ID NO: 557442 - DNA, 25 bp, Homo sapien
caaacttacactcctccaaaacctg

SEQ ID NO: 557443 - DNA, 25 bp, Homo sapien
gacattgagaacaccagccttgcac

SEQ ID NO: 557444 - DNA, 25 bp, Homo sapien
gaccatgccctctgggatcacactg

SEQ ID NO: 557445 - DNA, 25 bp, Homo sapien
cagaatctccttcggatgggcctgg

SEQ ID NO: 557446 - DNA, 25 bp, Homo sapien
cctttctagtcctggtggctctagt

SEQ ID NO: 557447 - DNA, 25 bp, Homo sapien
ggctctagtgtggttcctggttgaa

SEQ ID NO: 557448 - DNA, 25 bp, Homo sapien
tggttcctggttgaagactggctca

SEQ ID NO: 557449 - DNA, 25 bp, Homo sapien
aagactggctcagcaggaagaggac

SEQ ID NO: 557450 - DNA, 25 bp, Homo sapien
agagagcgagccagcagagcttcca

SEQ ID NO: 557451 - DNA, 25 bp, Homo sapien
aggctgaacacacagactctttgaa

SEQ ID NO: 557452 - DNA, 25 bp, Homo sapien
gactctttgaagaatgaccatgaga

SEQ ID NO: 557453 - DNA, 25 bp, Homo sapien
atctgaaagctggtgttgagcctgg

SEQ ID NO: 557454 - DNA, 25 bp, Homo sapien
aaggagagcccttgtcgcttttctt

SEQ ID NO: 557455 - DNA, 25 bp, Homo sapien
gagagcccttgtcgcttttcttacc

SEQ ID NO: 557456 - DNA, 25 bp, Homo sapien
ggagcaagggagtatgtgtttcaaa

SEQ ID NO: 557457 - DNA, 25 bp, Homo sapien
agggagtatgtgtttcaaaggaatc

SEQ ID NO: 557458 - DNA, 25 bp, Homo sapien
gttttaattgcacagacacatggac

SEQ ID NO: 557459 - DNA, 25 bp, Homo sapien
ttgcacagacacatggacaaaaagt

SEQ ID NO: 557460 - DNA, 25 bp, Homo sapien
aaaagtcattttgtatctgccaagt

SEQ ID NO: 557461 - DNA, 25 bp, Homo sapien
gtcattttgtatctgccaagtgtgg

SEQ ID NO: 557462 - DNA, 25 bp, Homo sapien
gtatctgccaagtgtggtaccttcc

SEQ ID NO: 557463 - DNA, 25 bp, Homo sapien
tgccaagtgtggtaccttcctttgt

SEQ ID NO: 557464 - DNA, 25 bp, Homo sapien
tggtaccttcctttgtttatttgct

SEQ ID NO: 557465 - DNA, 25 bp, Homo sapien
acaaaactagcatattctctttcct

SEQ ID NO: 557466 - DNA, 25 bp, Homo sapien
tctctttcctagaagtcctttgttt

SEQ ID NO: 557467 - DNA, 25 bp, Homo sapien
ccttttgttggtttacgagctctca

SEQ ID NO: 557468 - DNA, 25 bp, Homo sapien
ttacgagctctcaattctaacctcc

SEQ ID NO: 557469 - DNA, 25 bp, Homo sapien
ttctaacctcctagtacacgaataa

SEQ ID NO: 557470 - DNA, 25 bp, Homo sapien
aggtgggaggatcctctgaccataa

SEQ ID NO: 557471 - DNA, 25 bp, Homo sapien
tctgaccataagagttcctgaccag

SEQ ID NO: 557472 - DNA, 25 bp, Homo sapien
gtgcaatactgactccatctcaaac

SEQ ID NO: 557473 - DNA, 25 bp, Homo sapien
aagctatacaactccgtttctcttg

SEQ ID NO: 557474 - DNA, 25 bp, Homo sapien
aactccgtttctcttgctaatttgt

SEQ ID NO: 557475 - DNA, 25 bp, Homo sapien
cttgctaatttgtcttttgtcagtt

SEQ ID NO: 557476 - DNA, 25 bp, Homo sapien
attggaatagtacacctttctcagg

SEQ ID NO: 557477 - DNA, 25 bp, Homo sapien
gaaggcaacctgttctgttcatggt

SEQ ID NO: 557478 - DNA, 25 bp, Homo sapien
acttcattgtcatgtgtctaccctt

SEQ ID NO: 557479 - DNA, 25 bp, Homo sapien
tgtgtctacccttaaaattgctatt

SEQ ID NO: 557480 - DNA, 25 bp, Homo sapien
tagtacacctttctcagggttttca

SEQ ID NO: 557481 - DNA, 25 bp, Homo sapien
tatttagtcacttctgggttcctct

SEQ ID NO: 557482 - DNA, 25 bp, Homo sapien
gggttcctcttgtcagtttatatgc

SEQ ID NO: 557483 - DNA, 25 bp, Homo sapien
aacattttggcatgtgggacttggg

SEQ ID NO: 557484 - DNA, 25 bp, Homo sapien
ggttgtcatattattcccaacatgg

SEQ ID NO: 557485 - DNA, 25 bp, Homo sapien
caacatgggaatatagtggcttcta

SEQ ID NO: 557486 - DNA, 25 bp, Homo sapien
tagtggcttctaaagtttgcaaatg

SEQ ID NO: 557487 - DNA, 25 bp, Homo sapien
ttttttacagtgaacctgtattcag

SEQ ID NO: 557488 - DNA, 25 bp, Homo sapien
acctgtattcagttattgtcactct

SEQ ID NO: 557489 - DNA, 25 bp, Homo sapien
ttattgtcactctgagaactctcca

SEQ ID NO: 557490 - DNA, 25 bp, Homo sapien
tcttttccacagttaacaacacagc

SEQ ID NO: 557491 - DNA, 25 bp, Homo sapien
ttaacaacacagctgttacacctcc

SEQ ID NO: 557492 - DNA, 25 bp, Homo sapien
tttttcacagtgaacctgtattcag

SEQ ID NO: 557493 - DNA, 25 bp, Homo sapien
gtattcagctattctcactctgaga

SEQ ID NO: 557494 - DNA, 25 bp, Homo sapien
ctattctcactctgagaactctcca

SEQ ID NO: 557495 - DNA, 25 bp, Homo sapien
gagaactctccaataacaatttctt

SEQ ID NO: 557496 - DNA, 25 bp, Homo sapien
tttccacagttaacaacaaagttct

SEQ ID NO: 557497 - DNA, 25 bp, Homo sapien
cctaaaggcatattctgacaacttt

SEQ ID NO: 557498 - DNA, 25 bp, Homo sapien
gaatgggtcaggagaccgctgcttc

SEQ ID NO: 557499 - DNA, 25 bp, Homo sapien
ctgcttctgggcataagtcctgcaa

SEQ ID NO: 557500 - DNA, 25 bp, Homo sapien
agccccaactcacccatgagggatg

SEQ ID NO: 557501 - DNA, 25 bp, Homo sapien
tgagaaaggcatgtgttgtttaagc

SEQ ID NO: 557502 - DNA, 25 bp, Homo sapien
gagctttttgtcactatctgtcaag

SEQ ID NO: 557503 - DNA, 25 bp, Homo sapien
atctgtcaagactgatactactggg

SEQ ID NO: 557504 - DNA, 25 bp, Homo sapien
gggcttttcctattgatttgggagt

SEQ ID NO: 557505 - DNA, 25 bp, Homo sapien
aaatgtgagcctttgtgatacgaat

SEQ ID NO: 557506 - DNA, 25 bp, Homo sapien
tgatacgaattcaatttgttttcct

SEQ ID NO: 557507 - DNA, 25 bp, Homo sapien
ttgttttcctgtcttttgacatttg

SEQ ID NO: 557508 - DNA, 25 bp, Homo sapien
tgtcttttgacatttgactttgcat

SEQ ID NO: 557509 - DNA, 25 bp, Homo sapien
ctcattttgatttccaattacctga

SEQ ID NO: 557510 - DNA, 25 bp, Homo sapien
tgatttccaattacctgatgacata

SEQ ID NO: 557511 - DNA, 25 bp, Homo sapien
gaacattatgcttgtttgctatctg

SEQ ID NO: 557512 - DNA, 25 bp, Homo sapien
gcttgtttgctatctgtatgtcttc

SEQ ID NO: 557513 - DNA, 25 bp, Homo sapien
gtatgtcttctctgataaggtgcct

SEQ ID NO: 557514 - DNA, 25 bp, Homo sapien
gtcttctctgataaggtgcctgttt

SEQ ID NO: 557515 - DNA, 25 bp, Homo sapien
gataaggtgcctgtttataccattg

SEQ ID NO: 557516 - DNA, 25 bp, Homo sapien
gcctgtttataccattggcccattt

SEQ ID NO: 557517 - DNA, 25 bp, Homo sapien
tgtttataccattggcccattttaa

SEQ ID NO: 557518 - DNA, 25 bp, Homo sapien
ggtatactgcttggcatttgcacca

SEQ ID NO: 557519 - DNA, 25 bp, Homo sapien
tgagagctcctattactccacatcc

SEQ ID NO: 557520 - DNA, 25 bp, Homo sapien
aggtgggaggatcctctgaccataa

SEQ ID NO: 557521 - DNA, 25 bp, Homo sapien
gggaggatcctctgaccataagagt

SEQ ID NO: 557522 - DNA, 25 bp, Homo sapien
gatcctctgaccataagagttcctg

SEQ ID NO: 557523 - DNA, 25 bp, Homo sapien
tctgaccataagagttcctgaccag

SEQ ID NO: 557524 - DNA, 25 bp, Homo sapien
gtgcaatactgactccatctcaaac

SEQ ID NO: 557525 - DNA, 25 bp, Homo sapien
aacagaaagctatacaactccgttt

SEQ ID NO: 557526 - DNA, 25 bp, Homo sapien
aagctatacaactccgtttctcttg

SEQ ID NO: 557527 - DNA, 25 bp, Homo sapien
tatacaactccgtttctcttgctaa

SEQ ID NO: 557528 - DNA, 25 bp, Homo sapien
atacaactccgtttctcttgctaat

SEQ ID NO: 557529 - DNA, 25 bp, Homo sapien
ctcttgctaatttgtcttttgtcag

SEQ ID NO: 557530 - DNA, 25 bp, Homo sapien
cttgctaatttgtcttttgtcagtt

SEQ ID NO: 557531 - DNA, 25 bp, Homo sapien
tcctgctagttgttccatatttcta

SEQ ID NO: 557532 - DNA, 25 bp, Homo sapien
gctcattttttcatgcgagttcata

SEQ ID NO: 557533 - DNA, 25 bp, Homo sapien
gggaatacgcaatccagtttcaatt

SEQ ID NO: 557534 - DNA, 25 bp, Homo sapien
ttttattcagaagtaggtcacctaa

SEQ ID NO: 557535 - DNA, 25 bp, Homo sapien
ggttattagtctagtgtcgcttagc

SEQ ID NO: 557536 - DNA, 25 bp, Homo sapien
gtgtcgcttagcaaggtacttaaaa

SEQ ID NO: 557537 - DNA, 25 bp, Homo sapien
aaatctgcacatatccttgtgctgc

SEQ ID NO: 557538 - DNA, 25 bp, Homo sapien
gagttcatataaaatcctcgaaagt

SEQ ID NO: 557539 - DNA, 25 bp, Homo sapien
aacggagctagaatcatcttcgggc

SEQ ID NO: 557540 - DNA, 25 bp, Homo sapien
tcatcttcgggcttattcctgctag

SEQ ID NO: 557541 - DNA, 25 bp, Homo sapien
gcttattcctgctagttgttccata

SEQ ID NO: 557542 - DNA, 25 bp, Homo sapien
tctgacaggaaatgcttgtggtcgt

SEQ ID NO: 557543 - DNA, 25 bp, Homo sapien
tatttggtttgagagcccttgttcc

SEQ ID NO: 557544 - DNA, 25 bp, Homo sapien
ggtttgagagcccttgttcctccat

SEQ ID NO: 557545 - DNA, 25 bp, Homo sapien
ttgttcctccatctagtggagtcct

SEQ ID NO: 557546 - DNA, 25 bp, Homo sapien
tccatctagtggagtccttattaaa

SEQ ID NO: 557547 - DNA, 25 bp, Homo sapien
aatgctagcaatgtggcaattgagt

SEQ ID NO: 557548 - DNA, 25 bp, Homo sapien
gcaattgagtgccagtagcttaatt

SEQ ID NO: 557549 - DNA, 25 bp, Homo sapien
agtagcttaatttcatgtttctaaa

SEQ ID NO: 557550 - DNA, 25 bp, Homo sapien
tgtttctaaatggacactgggtgca

SEQ ID NO: 557551 - DNA, 25 bp, Homo sapien
tcggcaaggtgattagattattaga

SEQ ID NO: 557552 - DNA, 25 bp, Homo sapien
ttagaaaattctgctcaatgagtac

SEQ ID NO: 557553 - DNA, 25 bp, Homo sapien
gagatggagctgagactttatttat

SEQ ID NO: 557554 - DNA, 25 bp, Homo sapien
aggaggtccctccaacatgtttgga

SEQ ID NO: 557555 - DNA, 25 bp, Homo sapien
tgtgtgtagatgttaacccggcgcc

SEQ ID NO: 557556 - DNA, 25 bp, Homo sapien
ctgcccagaaccaagtgccatttct

SEQ ID NO: 557557 - DNA, 25 bp, Homo sapien
aagtgccatttctcactctggagcc

SEQ ID NO: 557558 - DNA, 25 bp, Homo sapien
catttctcactctggagccttaata

SEQ ID NO: 557559 - DNA, 25 bp, Homo sapien
ggagccttaataaactgcaatttgt

SEQ ID NO: 557560 - DNA, 25 bp, Homo sapien
tgtagatgttaacccggcgccaact

SEQ ID NO: 557561 - DNA, 25 bp, Homo sapien
gctctccttccgcagaacaatcgag

SEQ ID NO: 557562 - DNA, 25 bp, Homo sapien
gcagaacaatcgagctttccaggaa

SEQ ID NO: 557563 - DNA, 25 bp, Homo sapien
aggaaagcagcgaggcaccctgaga

SEQ ID NO: 557564 - DNA, 25 bp, Homo sapien
gtcaacatgtgctttctttgctaag

SEQ ID NO: 557565 - DNA, 25 bp, Homo sapien
gggatttctgacttcctgccagctt

SEQ ID NO: 557566 - DNA, 25 bp, Homo sapien
gtacggcaacaaggtgattctggct

SEQ ID NO: 557567 - DNA, 25 bp, Homo sapien
ggctagagtctcagtagggctgcca

SEQ ID NO: 557568 - DNA, 25 bp, Homo sapien
agagggagccctggagtcatcagct

SEQ ID NO: 557569 - DNA, 25 bp, Homo sapien
ctggagtcatcagctctggacaggc

SEQ ID NO: 557570 - DNA, 25 bp, Homo sapien
ggaggtggcctttcaagtcctctga

SEQ ID NO: 557571 - DNA, 25 bp, Homo sapien
tctgacctgcgcatcctgtgtgttg

SEQ ID NO: 557572 - DNA, 25 bp, Homo sapien
aggagcttcctcaggaatctgtggt

SEQ ID NO: 557573 - DNA, 25 bp, Homo sapien
aatctgtggtctgtagatgccctca

SEQ ID NO: 557574 - DNA, 25 bp, Homo sapien
tgccctcaagggtcaacatgtgctt

SEQ ID NO: 557575 - DNA, 25 bp, Homo sapien
atacaccctgcaatgtgcacattaa

SEQ ID NO: 557576 - DNA, 25 bp, Homo sapien
aagggcttgaaacatattggattac

SEQ ID NO: 557577 - DNA, 25 bp, Homo sapien
ggattacatgctcacatttaacaaa

SEQ ID NO: 557578 - DNA, 25 bp, Homo sapien
ggctggaatttacaagctaattgtt

SEQ ID NO: 557579 - DNA, 25 bp, Homo sapien
atctactcaagatagttacctaagg

SEQ ID NO: 557580 - DNA, 25 bp, Homo sapien
gttacctaaggctttgtggcaatga

SEQ ID NO: 557581 - DNA, 25 bp, Homo sapien
ggctttgtggcaatgaccttgaact

SEQ ID NO: 557582 - DNA, 25 bp, Homo sapien
gtggcaatgaccttgaactgagagc

SEQ ID NO: 557583 - DNA, 25 bp, Homo sapien
agtgagcacatgtcatgctagccaa

SEQ ID NO: 557584 - DNA, 25 bp, Homo sapien
gtcatgctagccaagaggacattat

SEQ ID NO: 557585 - DNA, 25 bp, Homo sapien
aggcattatttatacaccctgcaat

SEQ ID NO: 557586 - DNA, 25 bp, Homo sapien
gaacttgggctttgaggcgagacct

SEQ ID NO: 557587 - DNA, 25 bp, Homo sapien
aacttgggctttgaggcgagaccta

SEQ ID NO: 557588 - DNA, 25 bp, Homo sapien
cttgggctttgaggcgagacctaat

SEQ ID NO: 557589 - DNA, 25 bp, Homo sapien
ggctttgaggcgagacctaattctt

SEQ ID NO: 557590 - DNA, 25 bp, Homo sapien
tttgaggcgagacctaattcttagg

SEQ ID NO: 557591 - DNA, 25 bp, Homo sapien
ggcgagacctaattcttagggtgct

SEQ ID NO: 557592 - DNA, 25 bp, Homo sapien
gagacctaattcttagggtgctcta

SEQ ID NO: 557593 - DNA, 25 bp, Homo sapien
acctaattcttagggtgctctatga

SEQ ID NO: 557594 - DNA, 25 bp, Homo sapien
gtgctctatgaggacatgggtggtg

SEQ ID NO: 557595 - DNA, 25 bp, Homo sapien
gggcaaagtgacagccgcctgagcc

SEQ ID NO: 557596 - DNA, 25 bp, Homo sapien
ttgcccccaggatgaatacgacgac

SEQ ID NO: 557597 - DNA, 25 bp, Homo sapien
atttacgccttcataattgcactgc

SEQ ID NO: 557598 - DNA, 25 bp, Homo sapien
ttgcactgctctttgggacagccaa

SEQ ID NO: 557599 - DNA, 25 bp, Homo sapien
aaaaatgtgcgaactatcaggacca

SEQ ID NO: 557600 - DNA, 25 bp, Homo sapien
atcaggaccaccaccgttaaggaag

SEQ ID NO: 557601 - DNA, 25 bp, Homo sapien
aataacactaattcagcctcccgat

SEQ ID NO: 557602 - DNA, 25 bp, Homo sapien
gcctcccgatccctgtaaagataca

SEQ ID NO: 557603 - DNA, 25 bp, Homo sapien
gatggcaaagctcaagtccacattt

SEQ ID NO: 557604 - DNA, 25 bp, Homo sapien
gtccacatttcttgaagtccacagg

SEQ ID NO: 557605 - DNA, 25 bp, Homo sapien
gaagcacagggtcctgtttcacatc

SEQ ID NO: 557606 - DNA, 25 bp, Homo sapien
aaacgggaggcattggcttctgtcc

SEQ ID NO: 557607 - DNA, 25 bp, Homo sapien
gtcccaggttcttgtaggtcgctga

SEQ ID NO: 557608 - DNA, 25 bp, Homo sapien
cagcttgcccagagtcgagcttaaa

SEQ ID NO: 557609 - DNA, 25 bp, Homo sapien
tggagcagcatgatttttgtctgaa

SEQ ID NO: 557610 - DNA, 25 bp, Homo sapien
ggaccagtggaaaggtgtgcatttt

SEQ ID NO: 557611 - DNA, 25 bp, Homo sapien
aaggatttgcttccccatcttgtgc

SEQ ID NO: 557612 - DNA, 25 bp, Homo sapien
cttccccatcttgtgctttctgtgt

SEQ ID NO: 557613 - DNA, 25 bp, Homo sapien
tctgtgtcttgcagcacgacctggc

SEQ ID NO: 557614 - DNA, 25 bp, Homo sapien
ctccacctaggaatcataccttcat

SEQ ID NO: 557615 - DNA, 25 bp, Homo sapien
ataagcatcctcattcctgtttcct

SEQ ID NO: 557616 - DNA, 25 bp, Homo sapien
ttccttgtggatgtcatggtctgct

SEQ ID NO: 557617 - DNA, 25 bp, Homo sapien
tcatggtctgctgtgaagtctgctt

SEQ ID NO: 557618 - DNA, 25 bp, Homo sapien
aagtctgcttggtgacccgtccaga

SEQ ID NO: 557619 - DNA, 25 bp, Homo sapien
aggtgatcaggagtgcagctgtcaa

SEQ ID NO: 557620 - DNA, 25 bp, Homo sapien
aggagtgcagctgtcaaactcacag

SEQ ID NO: 557621 - DNA, 25 bp, Homo sapien
aaactcacagatgccgttgttctca

SEQ ID NO: 557622 - DNA, 25 bp, Homo sapien
gatgccgttgttctcaatttgacca

SEQ ID NO: 557623 - DNA, 25 bp, Homo sapien
gttgttctcaatttgaccagccaat

SEQ ID NO: 557624 - DNA, 25 bp, Homo sapien
tgaccagccaatatgtggagttact

SEQ ID NO: 557625 - DNA, 25 bp, Homo sapien
gtggagttactagacagagaacaac

SEQ ID NO: 557626 - DNA, 25 bp, Homo sapien
aagatccgtgtattagtgtccagag

SEQ ID NO: 557627 - DNA, 25 bp, Homo sapien
cagctgaggctgctttgcaaaccct

SEQ ID NO: 557628 - DNA, 25 bp, Homo sapien
caaaccctcctgagaaggtgtaaag

SEQ ID NO: 557629 - DNA, 25 bp, Homo sapien
aagagacaagcattcctctgtaagc

SEQ ID NO: 557630 - DNA, 25 bp, Homo sapien
ttccttcgtgtcctctgggcccggg

SEQ ID NO: 557631 - DNA, 25 bp, Homo sapien
agttgtccccactcagtgtggccct

SEQ ID NO: 557632 - DNA, 25 bp, Homo sapien
ttcttcgcctgccttcgcgacagtg

SEQ ID NO: 557633 - DNA, 25 bp, Homo sapien
tgccttcgcgacagtgcggtgggac

SEQ ID NO: 557634 - DNA, 25 bp, Homo sapien
gcagagcgcacagcaggccaggaga

SEQ ID NO: 557635 - DNA, 25 bp, Homo sapien
ccttctcccaagaatactgtcagat

SEQ ID NO: 557636 - DNA, 25 bp, Homo sapien
tctcccaagaatactgtcagatgct

SEQ ID NO: 557637 - DNA, 25 bp, Homo sapien
gaatactgtcagatgctgatcctga

SEQ ID NO: 557638 - DNA, 25 bp, Homo sapien
agatgctgatcctgacaccacctgg

SEQ ID NO: 557639 - DNA, 25 bp, Homo sapien
gctgatcctgacaccacctggaatt

SEQ ID NO: 557640 - DNA, 25 bp, Homo sapien
atcctgacaccacctggaattcctt

SEQ ID NO: 557641 - DNA, 25 bp, Homo sapien
ggaagtgatgccatgggacttccaa

SEQ ID NO: 557642 - DNA, 25 bp, Homo sapien
tcattctgccagttgtattttccaa

SEQ ID NO: 557643 - DNA, 25 bp, Homo sapien
gtaaccagtgaaacagcttcctctg

SEQ ID NO: 557644 - DNA, 25 bp, Homo sapien
tgaggaagccatgcagccacaggac

SEQ ID NO: 557645 - DNA, 25 bp, Homo sapien
aggaagccatgcagccacaggacag

SEQ ID NO: 557646 - DNA, 25 bp, Homo sapien
atgcagccacaggacaggccatgtg

SEQ ID NO: 557647 - DNA, 25 bp, Homo sapien
gtattttccaatcattggtgccacc

SEQ ID NO: 557648 - DNA, 25 bp, Homo sapien
ttttccaatcattggtgccaccaat

SEQ ID NO: 557649 - DNA, 25 bp, Homo sapien
ttggtgccaccaatatatcccatcc

SEQ ID NO: 557650 - DNA, 25 bp, Homo sapien
aatatatcccatcccatatactctt

SEQ ID NO: 557651 - DNA, 25 bp, Homo sapien
tatatcccatcccatatactcttct

SEQ ID NO: 557652 - DNA, 25 bp, Homo sapien
ggattgattcagcattaccagctta

SEQ ID NO: 557653 - DNA, 25 bp, Homo sapien
gcattaccagcttatccaacaaaag

SEQ ID NO: 557654 - DNA, 25 bp, Homo sapien
taacatatacattaacaacgtcgaa

SEQ ID NO: 557655 - DNA, 25 bp, Homo sapien
taacaacgtcgaaagtagcctactt

SEQ ID NO: 557656 - DNA, 25 bp, Homo sapien
gatttacatcaagattaccatgggt

SEQ ID NO: 557657 - DNA, 25 bp, Homo sapien
atgggtattttccaaaacacctgat

SEQ ID NO: 557658 - DNA, 25 bp, Homo sapien
aacacctgatattacctgaggacag

SEQ ID NO: 557659 - DNA, 25 bp, Homo sapien
gaggacagaacttgcattctcaaac

SEQ ID NO: 557660 - DNA, 25 bp, Homo sapien
gcattctcaaactttctctggagaa

SEQ ID NO: 557661 - DNA, 25 bp, Homo sapien
actttctctggagaagctcaggttt

SEQ ID NO: 557662 - DNA, 25 bp, Homo sapien
gaaacctacttaagaaggtctgtgt

SEQ ID NO: 557663 - DNA, 25 bp, Homo sapien
ctggaactgcgtgacattgagctgg

SEQ ID NO: 557664 - DNA, 25 bp, Homo sapien
actgcgtgacattgagctggtgatg

SEQ ID NO: 557665 - DNA, 25 bp, Homo sapien
cgcaggccaatgtgtccagggccaa

SEQ ID NO: 557666 - DNA, 25 bp, Homo sapien
ccgtgcgggctctgagagacaacca

SEQ ID NO: 557667 - DNA, 25 bp, Homo sapien
gggctctgagagacaaccacagtga

SEQ ID NO: 557668 - DNA, 25 bp, Homo sapien
tctgagagacaaccacagtgacatc

SEQ ID NO: 557669 - DNA, 25 bp, Homo sapien
acagtgacatcgtcaacgccatcat

SEQ ID NO: 557670 - DNA, 25 bp, Homo sapien
atcgtcaacgccatcatggaactga

SEQ ID NO: 557671 - DNA, 25 bp, Homo sapien
ggaactgaccatgtagccactgacc

SEQ ID NO: 557672 - DNA, 25 bp, Homo sapien
gaccatgtagccactgaccggaagc

SEQ ID NO: 557673 - DNA, 25 bp, Homo sapien
gctctgctactcaataaatcggtgt

SEQ ID NO: 557674 - DNA, 25 bp, Homo sapien
tacacttctggagctccccgggaga

SEQ ID NO: 557675 - DNA, 25 bp, Homo sapien
gggagacggcaactacccaaccgtg

SEQ ID NO: 557676 - DNA, 25 bp, Homo sapien
ctacccaaccgtgtgggtgtgtttg

SEQ ID NO: 557677 - DNA, 25 bp, Homo sapien
gtgtgtttgtcacccagaaatactc

SEQ ID NO: 557678 - DNA, 25 bp, Homo sapien
cagaaatactctccacaccatgctg

SEQ ID NO: 557679 - DNA, 25 bp, Homo sapien
accatgctgcactgctgcggatgag

SEQ ID NO: 557680 - DNA, 25 bp, Homo sapien
ttccacctatttctctccataagta

SEQ ID NO: 557681 - DNA, 25 bp, Homo sapien
gaccataaaagaccatctagggact

SEQ ID NO: 557682 - DNA, 25 bp, Homo sapien
aaaagaccatctagggacttcagaa

SEQ ID NO: 557683 - DNA, 25 bp, Homo sapien
gacttcagaacccaaataatgacac

SEQ ID NO: 557684 - DNA, 25 bp, Homo sapien
tgacacaatgttaatttgcaggttc

SEQ ID NO: 557685 - DNA, 25 bp, Homo sapien
gtatcaactcggtgtttgttcgttt

SEQ ID NO: 557686 - DNA, 25 bp, Homo sapien
tgtttgttcgttttcttcaccttgc

SEQ ID NO: 557687 - DNA, 25 bp, Homo sapien
ttttcttcaccttgcggtttgtgcc

SEQ ID NO: 557688 - DNA, 25 bp, Homo sapien
acgtggcaaaccgtgagccgctgcg

SEQ ID NO: 557689 - DNA, 25 bp, Homo sapien
accgtgagccgctgcgtttgagttt

SEQ ID NO: 557690 - DNA, 25 bp, Homo sapien
tggttttgcgcgtcctaccctgtgt

SEQ ID NO: 557691 - DNA, 25 bp, Homo sapien
ctgtgtcacctcagggttatgatct

SEQ ID NO: 557692 - DNA, 25 bp, Homo sapien
agggttatgatctggcccctggcaa

SEQ ID NO: 557693 - DNA, 25 bp, Homo sapien
cctggcaaggctccccaagtgtgat

SEQ ID NO: 557694 - DNA, 25 bp, Homo sapien
ctgcattttgaggatggagtcagtc

SEQ ID NO: 557695 - DNA, 25 bp, Homo sapien
ggagtcagtctggtggcattttttg

SEQ ID NO: 557696 - DNA, 25 bp, Homo sapien
tttgtgttagccactctcctatctc

SEQ ID NO: 557697 - DNA, 25 bp, Homo sapien
tgttagccactctcctatctcattt

SEQ ID NO: 557698 - DNA, 25 bp, Homo sapien
ctcctatctcatttctccaattgaa

SEQ ID NO: 557699 - DNA, 25 bp, Homo sapien
atctcatttctccaattgaagtaat

SEQ ID NO: 557700 - DNA, 25 bp, Homo sapien
gtaatgcataaatcttccattctct

SEQ ID NO: 557701 - DNA, 25 bp, Homo sapien
gcataaatcttccattctctttttt

SEQ ID NO: 557702 - DNA, 25 bp, Homo sapien
cttttttctctcattcatggataga

SEQ ID NO: 557703 - DNA, 25 bp, Homo sapien
agagcttcttatcaatagccctctc

SEQ ID NO: 557704 - DNA, 25 bp, Homo sapien
ttatcaatagccctctcagatttgt

SEQ ID NO: 557705 - DNA, 25 bp, Homo sapien
tcaatagccctctcagatttgttct

SEQ ID NO: 557706 - DNA, 25 bp, Homo sapien
atagccctctcagatttgttctgaa

SEQ ID NO: 557707 - DNA, 25 bp, Homo sapien
gccagcatctacctacttggagaga

SEQ ID NO: 557708 - DNA, 25 bp, Homo sapien
ggagagaagctcaaccactggaaat

SEQ ID NO: 557709 - DNA, 25 bp, Homo sapien
gctagaatctgttggaatctgcttc

SEQ ID NO: 557710 - DNA, 25 bp, Homo sapien
ccagtggcccgattggaagtcacca

SEQ ID NO: 557711 - DNA, 25 bp, Homo sapien
aagtcaccagccaagcaccaactgg

SEQ ID NO: 557712 - DNA, 25 bp, Homo sapien
agcaccaactggtcaagaatatcag

SEQ ID NO: 557713 - DNA, 25 bp, Homo sapien
ataaaaatatttctagcccttgcta

SEQ ID NO: 557714 - DNA, 25 bp, Homo sapien
agcccttgctactatctgacagcag

SEQ ID NO: 557715 - DNA, 25 bp, Homo sapien
gggtgaatctaacttcctatctgcc

SEQ ID NO: 557716 - DNA, 25 bp, Homo sapien
tctaacttcctatctgccaactagg

SEQ ID NO: 557717 - DNA, 25 bp, Homo sapien
ttctactgggaaaaatgcttctcaa

SEQ ID NO: 557718 - DNA, 25 bp, Homo sapien
gaaatccttgtccatgaagcatgaa

SEQ ID NO: 557719 - DNA, 25 bp, Homo sapien
gaagcatgaatttgggaatctgtta

SEQ ID NO: 557720 - DNA, 25 bp, Homo sapien
gttatttgaatccttggcattgagg

SEQ ID NO: 557721 - DNA, 25 bp, Homo sapien
tgaaggtcactcatggttgtccaat

SEQ ID NO: 557722 - DNA, 25 bp, Homo sapien
gtcactcatggttgtccaataggga

SEQ ID NO: 557723 - DNA, 25 bp, Homo sapien
ttgtccaatagggaagtgatcattt

SEQ ID NO: 557724 - DNA, 25 bp, Homo sapien
ggtccagatgggatggagcctcctc

SEQ ID NO: 557725 - DNA, 25 bp, Homo sapien
ctctactaagacagttatcctgaaa

SEQ ID NO: 557726 - DNA, 25 bp, Homo sapien
atcttctccatcattgctgaatgca

SEQ ID NO: 557727 - DNA, 25 bp, Homo sapien
ctccatcattgctgaatgcatagat

SEQ ID NO: 557728 - DNA, 25 bp, Homo sapien
aagtatatcctgaaaaatgcataag

SEQ ID NO: 557729 - DNA, 25 bp, Homo sapien
cgacagcggagacgagggcgatgaa

SEQ ID NO: 557730 - DNA, 25 bp, Homo sapien
gacagcggagacgagggcgatgaat

SEQ ID NO: 557731 - DNA, 25 bp, Homo sapien
acagcggagacgagggcgatgaata

SEQ ID NO: 557732 - DNA, 25 bp, Homo sapien
cagcggagacgagggcgatgaatac

SEQ ID NO: 557733 - DNA, 25 bp, Homo sapien
agcggagacgagggcgatgaatacg

SEQ ID NO: 557734 - DNA, 25 bp, Homo sapien
gcggagacgagggcgatgaatacga

SEQ ID NO: 557735 - DNA, 25 bp, Homo sapien
cggagacgagggcgatgaatacgac

SEQ ID NO: 557736 - DNA, 25 bp, Homo sapien
ggagacgagggcgatgaatacgacg

SEQ ID NO: 557737 - DNA, 25 bp, Homo sapien
gagacgagggcgatgaatacgacga

SEQ ID NO: 557738 - DNA, 25 bp, Homo sapien
agacgagggcgatgaatacgacgac

SEQ ID NO: 557739 - DNA, 25 bp, Homo sapien
gaagtattcaccgagctgatgcaag

SEQ ID NO: 557740 - DNA, 25 bp, Homo sapien
accgagctgatgcaagtgattgagc

SEQ ID NO: 557741 - DNA, 25 bp, Homo sapien
gagcaaagggacaaactcgtcgatt

SEQ ID NO: 557742 - DNA, 25 bp, Homo sapien
caaactcgtcgattccttagaggaa

SEQ ID NO: 557743 - DNA, 25 bp, Homo sapien
gagaaaaagccgaggaccagcactt

SEQ ID NO: 557744 - DNA, 25 bp, Homo sapien
ggaccagcactttgaaagcttcgta

SEQ ID NO: 557745 - DNA, 25 bp, Homo sapien
tgaaagcttcgtattctccagaggc

SEQ ID NO: 557746 - DNA, 25 bp, Homo sapien
aatgcgatatgagtcggagctccta

SEQ ID NO: 557747 - DNA, 25 bp, Homo sapien
ggagctcctaatcatggcccaggaa

SEQ ID NO: 557748 - DNA, 25 bp, Homo sapien
cccaggaactggaattagaagatca

SEQ ID NO: 557749 - DNA, 25 bp, Homo sapien
gatcatcaaagcagactggagcaga

SEQ ID NO: 557750 - DNA, 25 bp, Homo sapien
aatggaacgggcctttgcttccgca

SEQ ID NO: 557751 - DNA, 25 bp, Homo sapien
tttgcttccgcagcacaaagcgtca

SEQ ID NO: 557752 - DNA, 25 bp, Homo sapien
ccgcagcacaaagcgtcacgaggtg

SEQ ID NO: 557753 - DNA, 25 bp, Homo sapien
ggaaaggccggcgactatctacacc

SEQ ID NO: 557754 - DNA, 25 bp, Homo sapien
agcttttactgggagcgctgagcgc

SEQ ID NO: 557755 - DNA, 25 bp, Homo sapien
tgcacgtgttgcagtgaggagccct

SEQ ID NO: 557756 - DNA, 25 bp, Homo sapien
tgaggagccctgaaacatgcgtgtt

SEQ ID NO: 557757 - DNA, 25 bp, Homo sapien
aaacatgcgtgttttactgcacaag

SEQ ID NO: 557758 - DNA, 25 bp, Homo sapien
ttactgcacaagatgtgcccttgaa

SEQ ID NO: 557759 - DNA, 25 bp, Homo sapien
tctcgctaagatcggccctaagaga

SEQ ID NO: 557760 - DNA, 25 bp, Homo sapien
aaggctgtttcctagaaaggagcat

SEQ ID NO: 557761 - DNA, 25 bp, Homo sapien
ggtttcagtttgctaatagggattt

SEQ ID NO: 557762 - DNA, 25 bp, Homo sapien
ttcagcatctcttgaagaatcttgc

SEQ ID NO: 557763 - DNA, 25 bp, Homo sapien
gcatctcttgaagaatcttgctaca

SEQ ID NO: 557764 - DNA, 25 bp, Homo sapien
cttgaagaatcttgctacagccaaa

SEQ ID NO: 557765 - DNA, 25 bp, Homo sapien
gaatcttgctacagccaaatggcat

SEQ ID NO: 557766 - DNA, 25 bp, Homo sapien
aatggcatctcactttttaaagacg

SEQ ID NO: 557767 - DNA, 25 bp, Homo sapien
tagttgattcacagtacagaacaag

SEQ ID NO: 557768 - DNA, 25 bp, Homo sapien
gattcacagtacagaacaaggtata

SEQ ID NO: 557769 - DNA, 25 bp, Homo sapien
aaaccctgctaggtagtgttataat

SEQ ID NO: 557770 - DNA, 25 bp, Homo sapien
ggtagtgttataattgctagattaa

SEQ ID NO: 557771 - DNA, 25 bp, Homo sapien
gactagaacaggttcattttaagat

SEQ ID NO: 557772 - DNA, 25 bp, Homo sapien
ggacccaagtcattcacagactgtt

SEQ ID NO: 557773 - DNA, 25 bp, Homo sapien
gactacaattaagtcttctcttagt

SEQ ID NO: 557774 - DNA, 25 bp, Homo sapien
gtagatgatatcaactccaaaccca

SEQ ID NO: 557775 - DNA, 25 bp, Homo sapien
tccaaacccacacaagcaagctgag

SEQ ID NO: 557776 - DNA, 25 bp, Homo sapien
gcaagctgagttccattcaaagcaa

SEQ ID NO: 557777 - DNA, 25 bp, Homo sapien
aaagcaataacagcacctactctgt

SEQ ID NO: 557778 - DNA, 25 bp, Homo sapien
gaaaacagcttagcagcttcacagt

SEQ ID NO: 557779 - DNA, 25 bp, Homo sapien
gcagcttcacagtaatgatgtcttc

SEQ ID NO: 557780 - DNA, 25 bp, Homo sapien
agaattctgatgagccaaggactgt

SEQ ID NO: 557781 - DNA, 25 bp, Homo sapien
aagaaatttcccatatacagcactt

SEQ ID NO: 557782 - DNA, 25 bp, Homo sapien
tacagcacttcagaaggacccaagt

SEQ ID NO: 557783 - DNA, 25 bp, Homo sapien
ctcaccagaatctgaccatgctggt

SEQ ID NO: 557784 - DNA, 25 bp, Homo sapien
aatctgaccatgctggtgccctgat

SEQ ID NO: 557785 - DNA, 25 bp, Homo sapien
ggtaactttggccaagacttttcag

SEQ ID NO: 557786 - DNA, 25 bp, Homo sapien
gaactgcaaaattctggtgtggtgt

SEQ ID NO: 557787 - DNA, 25 bp, Homo sapien
aattctggtgtggtgtgaatgctgt

SEQ ID NO: 557788 - DNA, 25 bp, Homo sapien
tgaatgctgtggctcagtccgaaca

SEQ ID NO: 557789 - DNA, 25 bp, Homo sapien
ttggccaagacttttcagtaggaaa

SEQ ID NO: 557790 - DNA, 25 bp, Homo sapien
gtggctcagtccgaacatgtttttt

SEQ ID NO: 557791 - DNA, 25 bp, Homo sapien
tttatcattattacacgattgcaat

SEQ ID NO: 557792 - DNA, 25 bp, Homo sapien
cacgattgcaatatcagttttgttt

SEQ ID NO: 557793 - DNA, 25 bp, Homo sapien
gagctattttcaagaaagaccttct

SEQ ID NO: 557794 - DNA, 25 bp, Homo sapien
ccatacagaccagggagagaggctc

SEQ ID NO: 557795 - DNA, 25 bp, Homo sapien
agagaggctccttacactgacattc

SEQ ID NO: 557796 - DNA, 25 bp, Homo sapien
gaggctccttacactgacattcaaa

SEQ ID NO: 557797 - DNA, 25 bp, Homo sapien
ggctccttacactgacattcaaagt

SEQ ID NO: 557798 - DNA, 25 bp, Homo sapien
tacactgacattcaaagtcctcaat

SEQ ID NO: 557799 - DNA, 25 bp, Homo sapien
gacattcaaagtcctcaatgacccg

SEQ ID NO: 557800 - DNA, 25 bp, Homo sapien
attcaaagtcctcaatgacccggcc

SEQ ID NO: 557801 - DNA, 25 bp, Homo sapien
tccctacaaaccatcaaagcagaac

SEQ ID NO: 557802 - DNA, 25 bp, Homo sapien
agcagaacaaaaacctgtccctccg

SEQ ID NO: 557803 - DNA, 25 bp, Homo sapien
cagaacaaaaacctgtccctccgat

SEQ ID NO: 557804 - DNA, 25 bp, Homo sapien
ggttttagcaaaccacaagaagcac

SEQ ID NO: 557805 - DNA, 25 bp, Homo sapien
aatgaggactgattggaacccatct

SEQ ID NO: 557806 - DNA, 25 bp, Homo sapien
ggaacccatctcctgggaatcagag

SEQ ID NO: 557807 - DNA, 25 bp, Homo sapien
tgggcaaaaagtcccattcatttta

SEQ ID NO: 557808 - DNA, 25 bp, Homo sapien
gactgtgaagaaactcgctaccaac

SEQ ID NO: 557809 - DNA, 25 bp, Homo sapien
cgctaccaactctactgtattctga

SEQ ID NO: 557810 - DNA, 25 bp, Homo sapien
acagatcccacggtagaacctgagg

SEQ ID NO: 557811 - DNA, 25 bp, Homo sapien
acctgaggtgtatgacagcggtgtc

SEQ ID NO: 557812 - DNA, 25 bp, Homo sapien
ttatttagctaccatcgcagacgcc

SEQ ID NO: 557813 - DNA, 25 bp, Homo sapien
atcgcagacgccaacacaagcagtc

SEQ ID NO: 557814 - DNA, 25 bp, Homo sapien
acacaagcagtctcacaaaggcagt

SEQ ID NO: 557815 - DNA, 25 bp, Homo sapien
gtagttttccagaaggctgtaatga

SEQ ID NO: 557816 - DNA, 25 bp, Homo sapien
accagcgactgtgaccagcaatagc

SEQ ID NO: 557817 - DNA, 25 bp, Homo sapien
agcgactgtgaccagcaatagcccc

SEQ ID NO: 557818 - DNA, 25 bp, Homo sapien
agctgtccggtagctggtgactagc

SEQ ID NO: 557819 - DNA, 25 bp, Homo sapien
tggtgactagctgtatttccccctg

SEQ ID NO: 557820 - DNA, 25 bp, Homo sapien
tttccccctgggtaggcatctggtg

SEQ ID NO: 557821 - DNA, 25 bp, Homo sapien
gcatctggtgtcaggaagggacgct

SEQ ID NO: 557822 - DNA, 25 bp, Homo sapien
aagggacgctgagaggccgcagcct

SEQ ID NO: 557823 - DNA, 25 bp, Homo sapien
agctctgactgtaggaacactccac

SEQ ID NO: 557824 - DNA, 25 bp, Homo sapien
tgtaggaacactccaccctggtaca

SEQ ID NO: 557825 - DNA, 25 bp, Homo sapien
gggacagagaggcatcacacagaca

SEQ ID NO: 557826 - DNA, 25 bp, Homo sapien
acagagaggcatcacacagacatcc

SEQ ID NO: 557827 - DNA, 25 bp, Homo sapien
tacagttcagtggagagtcaaagga

SEQ ID NO: 557828 - DNA, 25 bp, Homo sapien
aggcgctggaacactgctgcagttg

SEQ ID NO: 557829 - DNA, 25 bp, Homo sapien
ctgctgcagttgtgttcagaagctg

SEQ ID NO: 557830 - DNA, 25 bp, Homo sapien
gaagctggcacaatacataaccgtg

SEQ ID NO: 557831 - DNA, 25 bp, Homo sapien
gtgcaggtgcctgatggaaacatcc

SEQ ID NO: 557832 - DNA, 25 bp, Homo sapien
aaagagtgtcccacggcagcctgga

SEQ ID NO: 557833 - DNA, 25 bp, Homo sapien
accagcactcagaacaacagcaagt

SEQ ID NO: 557834 - DNA, 25 bp, Homo sapien
cagcaagtgtgtgtaacagcgggca

SEQ ID NO: 557835 - DNA, 25 bp, Homo sapien
tggattgtctgttgtttggaacaac

SEQ ID NO: 557836 - DNA, 25 bp, Homo sapien
gacaagagtcgcctgtttcgagtac

SEQ ID NO: 557837 - DNA, 25 bp, Homo sapien
gtcgcctgtttcgagtacagttcag

SEQ ID NO: 557838 - DNA, 25 bp, Homo sapien
aattttacacagattgcttacgagc

SEQ ID NO: 557839 - DNA, 25 bp, Homo sapien
gcttacgagcaagagttaagtggct

SEQ ID NO: 557840 - DNA, 25 bp, Homo sapien
ttaagtggctaacaagtcatgaaat

SEQ ID NO: 557841 - DNA, 25 bp, Homo sapien
acaagtcatgaaatcttacggagaa

SEQ ID NO: 557842 - DNA, 25 bp, Homo sapien
cttacggagaagcaggtaaagccaa

SEQ ID NO: 557843 - DNA, 25 bp, Homo sapien
tcccctttgcggcaggaactctact

SEQ ID NO: 557844 - DNA, 25 bp, Homo sapien
ggcaggaactctactccatcgaggg

SEQ ID NO: 557845 - DNA, 25 bp, Homo sapien
gggctttgctgcagtggcactgccc

SEQ ID NO: 557846 - DNA, 25 bp, Homo sapien
agtggcactgcccacgcatactcaa

SEQ ID NO: 557847 - DNA, 25 bp, Homo sapien
gggctttcgaagcttatcaaaagca

SEQ ID NO: 557848 - DNA, 25 bp, Homo sapien
tgaaaaagcattttccaacgcaacc

SEQ ID NO: 557849 - DNA, 25 bp, Homo sapien
gacgtaagggattcaaagacacact

SEQ ID NO: 557850 - DNA, 25 bp, Homo sapien
gtaagggattcaaagacacactcat

SEQ ID NO: 557851 - DNA, 25 bp, Homo sapien
gggattcaaagacacactcataaga

SEQ ID NO: 557852 - DNA, 25 bp, Homo sapien
tcaaagacacactcataagaatcgt

SEQ ID NO: 557853 - DNA, 25 bp, Homo sapien
atcgtgaatttgtcctcatgcaaaa

SEQ ID NO: 557854 - DNA, 25 bp, Homo sapien
tcgtgaatttgtcctcatgcaaaat

SEQ ID NO: 557855 - DNA, 25 bp, Homo sapien
ggactggctacaaaaccgaaacaag

SEQ ID NO: 557856 - DNA, 25 bp, Homo sapien
gactggctacaaaaccgaaacaagg

SEQ ID NO: 557857 - DNA, 25 bp, Homo sapien
gggactttatattaattgtcagtta

SEQ ID NO: 557858 - DNA, 25 bp, Homo sapien
gcaggccatcaaggtcaaacatttg

SEQ ID NO: 557859 - DNA, 25 bp, Homo sapien
caggccatcaaggtcaaacatttga

SEQ ID NO: 557860 - DNA, 25 bp, Homo sapien
ttttttacagtgaacctgtattcag

SEQ ID NO: 557861 - DNA, 25 bp, Homo sapien
ttaacaacacagctgttacacctcc

SEQ ID NO: 557862 - DNA, 25 bp, Homo sapien
taacaacacagctgttacacctccc

SEQ ID NO: 557863 - DNA, 25 bp, Homo sapien
aacaacacagctgttacacctccct

SEQ ID NO: 557864 - DNA, 25 bp, Homo sapien
acaacacagctgttacacctccctt

SEQ ID NO: 557865 - DNA, 25 bp, Homo sapien
acagctgttacacctcccttccttt

SEQ ID NO: 557866 - DNA, 25 bp, Homo sapien
ttcctttttttcacagtgaacctgt

SEQ ID NO: 557867 - DNA, 25 bp, Homo sapien
tttttcacagtgaacctgtattcag

SEQ ID NO: 557868 - DNA, 25 bp, Homo sapien
ccacagttaacaacaaagttctgtt

SEQ ID NO: 557869 - DNA, 25 bp, Homo sapien
cctaaaggcatattctgacaacttt

SEQ ID NO: 557870 - DNA, 25 bp, Homo sapien
ttgatttaagatatatgcaaagcaa

SEQ ID NO: 557871 - DNA, 25 bp, Homo sapien
gtcaggatagacgacattgtgggtc

SEQ ID NO: 557872 - DNA, 25 bp, Homo sapien
caggatagacgacattgtgggtcac

SEQ ID NO: 557873 - DNA, 25 bp, Homo sapien
aggatagacgacattgtgggtcaca

SEQ ID NO: 557874 - DNA, 25 bp, Homo sapien
ggatagacgacattgtgggtcacag

SEQ ID NO: 557875 - DNA, 25 bp, Homo sapien
gatagacgacattgtgggtcacagg

SEQ ID NO: 557876 - DNA, 25 bp, Homo sapien
atagacgacattgtgggtcacaggc

SEQ ID NO: 557877 - DNA, 25 bp, Homo sapien
cccgccccgtgtgatttgtttcatt

SEQ ID NO: 557878 - DNA, 25 bp, Homo sapien
ccccgtgtgatttgtttcattgtta

SEQ ID NO: 557879 - DNA, 25 bp, Homo sapien
gagaaatccggcccctgcagcagca

SEQ ID NO: 557880 - DNA, 25 bp, Homo sapien
cctgcagcagcagtagcgacagcga

SEQ ID NO: 557881 - DNA, 25 bp, Homo sapien
ctgcagcagcagtagcgacagcgac

SEQ ID NO: 557882 - DNA, 25 bp, Homo sapien
gaaggagagtctcgcctgtcacgct

SEQ ID NO: 557883 - DNA, 25 bp, Homo sapien
gaaacagcctggcagactcccatct

SEQ ID NO: 557884 - DNA, 25 bp, Homo sapien
cctggtgccatctccggagcggaaa

SEQ ID NO: 557885 - DNA, 25 bp, Homo sapien
gctggcgaccaaggccgcactgaga

SEQ ID NO: 557886 - DNA, 25 bp, Homo sapien
gcactgagagccctggtttggtcaa

SEQ ID NO: 557887 - DNA, 25 bp, Homo sapien
ggtttggtcaacagttgggctccaa

SEQ ID NO: 557888 - DNA, 25 bp, Homo sapien
ggagccctggtattccttgaacatg

SEQ ID NO: 557889 - DNA, 25 bp, Homo sapien
ttgaacatgcatacctttcccagcg

SEQ ID NO: 557890 - DNA, 25 bp, Homo sapien
atacctttcccagcgtgagggacat

SEQ ID NO: 557891 - DNA, 25 bp, Homo sapien
gctccgagctcctgagggctttcga

SEQ ID NO: 557892 - DNA, 25 bp, Homo sapien
tcctgagggctttcgagccgagatg

SEQ ID NO: 557893 - DNA, 25 bp, Homo sapien
gggtggtggccgacgggcaagtaga

SEQ ID NO: 557894 - DNA, 25 bp, Homo sapien
tggccgacgggcaagtagagaccgc

SEQ ID NO: 557895 - DNA, 25 bp, Homo sapien
gccgacgggcaagtagagaccgcga

SEQ ID NO: 557896 - DNA, 25 bp, Homo sapien
ccacttcccacaggagctgcttgtc

SEQ ID NO: 557897 - DNA, 25 bp, Homo sapien
ccacaggagctgcttgtccccaaat

SEQ ID NO: 557898 - DNA, 25 bp, Homo sapien
aggagctgcttgtccccaaatcttg

SEQ ID NO: 557899 - DNA, 25 bp, Homo sapien
gcttgtccccaaatcttgcctcagg

SEQ ID NO: 557900 - DNA, 25 bp, Homo sapien
cttgtccccaaatcttgcctcagga

SEQ ID NO: 557901 - DNA, 25 bp, Homo sapien
ttgtccccaaatcttgcctcaggac

SEQ ID NO: 557902 - DNA, 25 bp, Homo sapien
cgggcaagtagagaccgcgagggtc

SEQ ID NO: 557903 - DNA, 25 bp, Homo sapien
agtagagaccgcgagggtctggagg

SEQ ID NO: 557904 - DNA, 25 bp, Homo sapien
tagtgtcaaggttaacaagcagctg

SEQ ID NO: 557905 - DNA, 25 bp, Homo sapien
caagcagctgacttcatgataaatt

SEQ ID NO: 557906 - DNA, 25 bp, Homo sapien
tatctttatcatgagcagaagcctc

SEQ ID NO: 557907 - DNA, 25 bp, Homo sapien
agcagaagcctcatgtaattagaag

SEQ ID NO: 557908 - DNA, 25 bp, Homo sapien
ctcatgtaattagaagggcgcttaa

SEQ ID NO: 557909 - DNA, 25 bp, Homo sapien
agacactttatcacactgatgtgat

SEQ ID NO: 557910 - DNA, 25 bp, Homo sapien
gtgatattaggtcaactcaatgcaa

SEQ ID NO: 557911 - DNA, 25 bp, Homo sapien
aggtcaactcaatgcaatatttttt

SEQ ID NO: 557912 - DNA, 25 bp, Homo sapien
ggattattttcccattagcataaag

SEQ ID NO: 557913 - DNA, 25 bp, Homo sapien
gcataaagttcagttcagttgttca

SEQ ID NO: 557914 - DNA, 25 bp, Homo sapien
tcagttcagttgttcaaacacctgt

SEQ ID NO: 557915 - DNA, 25 bp, Homo sapien
cgaaatacaacagcccataacagag

SEQ ID NO: 557916 - DNA, 25 bp, Homo sapien
agcccataacagagacttcctcgga

SEQ ID NO: 557917 - DNA, 25 bp, Homo sapien
tcggaccccactaacagggcaagga

SEQ ID NO: 557918 - DNA, 25 bp, Homo sapien
ggaacaagaagactacaccgctcat

SEQ ID NO: 557919 - DNA, 25 bp, Homo sapien
atcacaaaccctgcctgtatcgaaa

SEQ ID NO: 557920 - DNA, 25 bp, Homo sapien
gaaagccactttcctgctctgaagc

SEQ ID NO: 557921 - DNA, 25 bp, Homo sapien
tctgaagctactgcctcttagagaa

SEQ ID NO: 557922 - DNA, 25 bp, Homo sapien
aaagggaatagctctttatgggctg

SEQ ID NO: 557923 - DNA, 25 bp, Homo sapien
cagggtccctgttaatttctggcct

SEQ ID NO: 557924 - DNA, 25 bp, Homo sapien
ctgttaatttctggccttggtgctc

SEQ ID NO: 557925 - DNA, 25 bp, Homo sapien
agcctcccttgtctatgtctctatc

SEQ ID NO: 557926 - DNA, 25 bp, Homo sapien
ctcgatgagcaggtccttgacgtac

SEQ ID NO: 557927 - DNA, 25 bp, Homo sapien
gagcaggtccttgacgtactggatc

SEQ ID NO: 557928 - DNA, 25 bp, Homo sapien
aggtccttgacgtactggatctcgc

SEQ ID NO: 557929 - DNA, 25 bp, Homo sapien
ttgacgtactggatctcgcgctcca

SEQ ID NO: 557930 - DNA, 25 bp, Homo sapien
tggatctcgcgctccacggactctg

SEQ ID NO: 557931 - DNA, 25 bp, Homo sapien
gttccttcagctcgcgattccgtgc

SEQ ID NO: 557932 - DNA, 25 bp, Homo sapien
gctggcggtacctcagagccgccga

SEQ ID NO: 557933 - DNA, 25 bp, Homo sapien
agagccgccgacttgttctggtctc

SEQ ID NO: 557934 - DNA, 25 bp, Homo sapien
tggtctctcttcttttgcttgcggt

SEQ ID NO: 557935 - DNA, 25 bp, Homo sapien
ttttgcttgcggtcccctcgggtgg

SEQ ID NO: 557936 - DNA, 25 bp, Homo sapien
ctcgggtggtggcaggatgtgggta

SEQ ID NO: 557937 - DNA, 25 bp, Homo sapien
gggaaggcgtttactcaaagatcag

SEQ ID NO: 557938 - DNA, 25 bp, Homo sapien
gtttactcaaagatcagtcctcacg

SEQ ID NO: 557939 - DNA, 25 bp, Homo sapien
gatcagtcctcacggaacatcagag

SEQ ID NO: 557940 - DNA, 25 bp, Homo sapien
ggaatgccttccgaggaatcaccag

SEQ ID NO: 557941 - DNA, 25 bp, Homo sapien
cttcagacagaggtcagatcttagt

SEQ ID NO: 557942 - DNA, 25 bp, Homo sapien
ggtcagatcttagtaaacaccagag

SEQ ID NO: 557943 - DNA, 25 bp, Homo sapien
gaatccataatagacgtggtaccta

SEQ ID NO: 557944 - DNA, 25 bp, Homo sapien
tagacgtggtacctatgtatgtaaa

SEQ ID NO: 557945 - DNA, 25 bp, Homo sapien
atcattcaggcagaactcagctctt

SEQ ID NO: 557946 - DNA, 25 bp, Homo sapien
tcaggcagaactcagctcttactca

SEQ ID NO: 557947 - DNA, 25 bp, Homo sapien
gcagaactcagctcttactcaacat

SEQ ID NO: 557948 - DNA, 25 bp, Homo sapien
ggcttgctcaggtctactgcctggg

SEQ ID NO: 557949 - DNA, 25 bp, Homo sapien
ctcaggtctactgcctgggctgtgg

SEQ ID NO: 557950 - DNA, 25 bp, Homo sapien
gctggctgcagctcaaaggaaggac

SEQ ID NO: 557951 - DNA, 25 bp, Homo sapien
ggctgcagctcaaaggaaggaccct

SEQ ID NO: 557952 - DNA, 25 bp, Homo sapien
accctgagcaggcatggttattgca

SEQ ID NO: 557953 - DNA, 25 bp, Homo sapien
gagcaggcatggttattgcagcaac

SEQ ID NO: 557954 - DNA, 25 bp, Homo sapien
caggcatggttattgcagcaacagc

SEQ ID NO: 557955 - DNA, 25 bp, Homo sapien
atggttattgcagcaacagctccaa

SEQ ID NO: 557956 - DNA, 25 bp, Homo sapien
gttattgcagcaacagctccaagaa

SEQ ID NO: 557957 - DNA, 25 bp, Homo sapien
ttgcagcaacagctccaagaagtgc

SEQ ID NO: 557958 - DNA, 25 bp, Homo sapien
agcaacagctccaagaagtgctcgg

SEQ ID NO: 557959 - DNA, 25 bp, Homo sapien
atatttgccatgtgtattgctactt

SEQ ID NO: 557960 - DNA, 25 bp, Homo sapien
acatcatcagtatatacatggtttt

SEQ ID NO: 557961 - DNA, 25 bp, Homo sapien
taaactttttctaggtatgtgtata

SEQ ID NO: 557962 - DNA, 25 bp, Homo sapien
agacattattggttactgcctgaat

SEQ ID NO: 557963 - DNA, 25 bp, Homo sapien
tggttactgcctgaatattcctctc

SEQ ID NO: 557964 - DNA, 25 bp, Homo sapien
catattatgtcctctcttgctggca

SEQ ID NO: 557965 - DNA, 25 bp, Homo sapien
ctggcagaatgcttatccttggctc

SEQ ID NO: 557966 - DNA, 25 bp, Homo sapien
ttggctcagccatgtgctcatagaa

SEQ ID NO: 557967 - DNA, 25 bp, Homo sapien
tcagccatgtgctcatagaagttga

SEQ ID NO: 557968 - DNA, 25 bp, Homo sapien
gaagttgactctatgcctaactcag

SEQ ID NO: 557969 - DNA, 25 bp, Homo sapien
gactctatgcctaactcagaaggta

SEQ ID NO: 557970 - DNA, 25 bp, Homo sapien
agacttctcatttatcactctctgg

SEQ ID NO: 557971 - DNA, 25 bp, Homo sapien
ttatcactctctgggttctatgaaa

SEQ ID NO: 557972 - DNA, 25 bp, Homo sapien
ctgggttctatgaaattgtggtgca

SEQ ID NO: 557973 - DNA, 25 bp, Homo sapien
gagtaaacaccctcaaccatagtaa

SEQ ID NO: 557974 - DNA, 25 bp, Homo sapien
ataattccacatttcctatataaag

SEQ ID NO: 557975 - DNA, 25 bp, Homo sapien
aaaatgcgtaagtattccaataaga

SEQ ID NO: 557976 - DNA, 25 bp, Homo sapien
aactttgtatgtagtgatttctatg

SEQ ID NO: 557977 - DNA, 25 bp, Homo sapien
ctaatttaggagtactggtgcagct

SEQ ID NO: 557978 - DNA, 25 bp, Homo sapien
ggagtactggtgcagctacgatcca

SEQ ID NO: 557979 - DNA, 25 bp, Homo sapien
ggtgcagctacgatccagacagcag

SEQ ID NO: 557980 - DNA, 25 bp, Homo sapien
attccatggcttatccagacttctc

SEQ ID NO: 557981 - DNA, 25 bp, Homo sapien
ggggggtcaggatagacgacattgt

SEQ ID NO: 557982 - DNA, 25 bp, Homo sapien
gggggtcaggatagacgacattgtg

SEQ ID NO: 557983 - DNA, 25 bp, Homo sapien
gggtcaggatagacgacattgtggg

SEQ ID NO: 557984 - DNA, 25 bp, Homo sapien
ggtcaggatagacgacattgtgggt

SEQ ID NO: 557985 - DNA, 25 bp, Homo sapien
gtcaggatagacgacattgtgggtc

SEQ ID NO: 557986 - DNA, 25 bp, Homo sapien
tcaggatagacgacattgtgggtca

SEQ ID NO: 557987 - DNA, 25 bp, Homo sapien
caggatagacgacattgtgggtcac

SEQ ID NO: 557988 - DNA, 25 bp, Homo sapien
aggatagacgacattgtgggtcaca

SEQ ID NO: 557989 - DNA, 25 bp, Homo sapien
ggatagacgacattgtgggtcacag

SEQ ID NO: 557990 - DNA, 25 bp, Homo sapien
gatagacgacattgtgggtcacagg

SEQ ID NO: 557991 - DNA, 25 bp, Homo sapien
atagacgacattgtgggtcacaggc

SEQ ID NO: 557992 - DNA, 25 bp, Homo sapien
gaatggcccttctgggttcacaatt

SEQ ID NO: 557993 - DNA, 25 bp, Homo sapien
tcacaattctgcttccgtcggttaa

SEQ ID NO: 557994 - DNA, 25 bp, Homo sapien
gtcggttaacagcaacttagtccct

SEQ ID NO: 557995 - DNA, 25 bp, Homo sapien
aacttagtcccttctatgcctgtgg

SEQ ID NO: 557996 - DNA, 25 bp, Homo sapien
aggataggctggattatgctgctct

SEQ ID NO: 557997 - DNA, 25 bp, Homo sapien
tatgctgctctaacaaccccaaatt

SEQ ID NO: 557998 - DNA, 25 bp, Homo sapien
aaccccaaatttctctgatctaata

SEQ ID NO: 557999 - DNA, 25 bp, Homo sapien
gtctctgctcattgtagttcctgcc

SEQ ID NO: 558000 - DNA, 25 bp, Homo sapien
agttcctgccctggctacaggcata

SEQ ID NO: 558001 - DNA, 25 bp, Homo sapien
ggaaatcaaaggctttcttggcaaa

SEQ ID NO: 558002 - DNA, 25 bp, Homo sapien
gctctagaagctttagcactggcaa

SEQ ID NO: 558003 - DNA, 25 bp, Homo sapien
gggaaggcgtttactcaaagatcag

SEQ ID NO: 558004 - DNA, 25 bp, Homo sapien
ggcgtttactcaaagatcagtcctc

SEQ ID NO: 558005 - DNA, 25 bp, Homo sapien
gtttactcaaagatcagtcctcacg

SEQ ID NO: 558006 - DNA, 25 bp, Homo sapien
tactcaaagatcagtcctcacggaa

SEQ ID NO: 558007 - DNA, 25 bp, Homo sapien
tcaaagatcagtcctcacggaacat

SEQ ID NO: 558008 - DNA, 25 bp, Homo sapien
aagatcagtcctcacggaacatcag

SEQ ID NO: 558009 - DNA, 25 bp, Homo sapien
gatcagtcctcacggaacatcagag

SEQ ID NO: 558010 - DNA, 25 bp, Homo sapien
tcagtcctcacggaacatcagagaa

SEQ ID NO: 558011 - DNA, 25 bp, Homo sapien
tgtgggaatgccttccgaggaatca

SEQ ID NO: 558012 - DNA, 25 bp, Homo sapien
tgggaatgccttccgaggaatcacc

SEQ ID NO: 558013 - DNA, 25 bp, Homo sapien
gaatgccttccgaggaatcaccagc

SEQ ID NO: 558014 - DNA, 25 bp, Homo sapien
ggtttcagtttgctaatagggattt

SEQ ID NO: 558015 - DNA, 25 bp, Homo sapien
cagtttgctaatagggattttttgt

SEQ ID NO: 558016 - DNA, 25 bp, Homo sapien
ttcagcatctcttgaagaatcttgc

SEQ ID NO: 558017 - DNA, 25 bp, Homo sapien
gcatctcttgaagaatcttgctaca

SEQ ID NO: 558018 - DNA, 25 bp, Homo sapien
cttgaagaatcttgctacagccaaa

SEQ ID NO: 558019 - DNA, 25 bp, Homo sapien
tagttgattcacagtacagaacaag

SEQ ID NO: 558020 - DNA, 25 bp, Homo sapien
gattcacagtacagaacaaggtata

SEQ ID NO: 558021 - DNA, 25 bp, Homo sapien
aaaccctgctaggtagtgttataat

SEQ ID NO: 558022 - DNA, 25 bp, Homo sapien
ctgctaggtagtgttataattgcta

SEQ ID NO: 558023 - DNA, 25 bp, Homo sapien
ggtagtgttataattgctagattaa

SEQ ID NO: 558024 - DNA, 25 bp, Homo sapien
gactagaacaggttcattttaagat

SEQ ID NO: 558025 - DNA, 25 bp, Homo sapien
ggtgtcaccactgctttgggggaaa

SEQ ID NO: 558026 - DNA, 25 bp, Homo sapien
tggctgggatgaggctaatacattc

SEQ ID NO: 558027 - DNA, 25 bp, Homo sapien
gaggctaatacattcatgcaatatt

SEQ ID NO: 558028 - DNA, 25 bp, Homo sapien
gggctgcgttatcagcatgctctcc

SEQ ID NO: 558029 - DNA, 25 bp, Homo sapien
ttatcagcatgctctccctgccttg

SEQ ID NO: 558030 - DNA, 25 bp, Homo sapien
tgccttgggcttttctttccgtcat

SEQ ID NO: 558031 - DNA, 25 bp, Homo sapien
ttgggcttttctttccgtcatgttt

SEQ ID NO: 558032 - DNA, 25 bp, Homo sapien
gcttttctttccgtcatgttttcct

SEQ ID NO: 558033 - DNA, 25 bp, Homo sapien
tttccgtcatgttttccttttcgtg

SEQ ID NO: 558034 - DNA, 25 bp, Homo sapien
gtcatgttttccttttcgtgttcct

SEQ ID NO: 558035 - DNA, 25 bp, Homo sapien
ttccttttcgtgttccttctctgat

SEQ ID NO: 558036 - DNA, 25 bp, Homo sapien
aaatcattcaacactccttatgcat

SEQ ID NO: 558037 - DNA, 25 bp, Homo sapien
ttcaacactccttatgcattaaatg

SEQ ID NO: 558038 - DNA, 25 bp, Homo sapien
actatcaattggtgggattaggctt

SEQ ID NO: 558039 - DNA, 25 bp, Homo sapien
ggtgggattaggcttgacattttat

SEQ ID NO: 558040 - DNA, 25 bp, Homo sapien
atatattttttctgaatgtgtctga

SEQ ID NO: 558041 - DNA, 25 bp, Homo sapien
aatgtgtctgagtccaagagtgggc

SEQ ID NO: 558042 - DNA, 25 bp, Homo sapien
aattttctactttggactaatctat

SEQ ID NO: 558043 - DNA, 25 bp, Homo sapien
atagaggtttttgaaagtctgcatt

SEQ ID NO: 558044 - DNA, 25 bp, Homo sapien
agtctgcattactaacttgttgaat

SEQ ID NO: 558045 - DNA, 25 bp, Homo sapien
attcatgatattctgcctatggcac

SEQ ID NO: 558046 - DNA, 25 bp, Homo sapien
gcctatggcacaaattgtaaacctt

SEQ ID NO: 558047 - DNA, 25 bp, Homo sapien
gagagaggagtcagccccagtgaca

SEQ ID NO: 558048 - DNA, 25 bp, Homo sapien
gccccagtgacatgctgacttgaat

SEQ ID NO: 558049 - DNA, 25 bp, Homo sapien
acttgaatgttgtgtttgtcccctc

SEQ ID NO: 558050 - DNA, 25 bp, Homo sapien
tgtgtttgtcccctccgctagaatg

SEQ ID NO: 558051 - DNA, 25 bp, Homo sapien
gtaagccccaggatggcaattatat

SEQ ID NO: 558052 - DNA, 25 bp, Homo sapien
tggcaattatatctctctgtgctga

SEQ ID NO: 558053 - DNA, 25 bp, Homo sapien
gaatggactactaacgtttttgttg

SEQ ID NO: 558054 - DNA, 25 bp, Homo sapien
tttctacctcttttgttctcatagg

SEQ ID NO: 558055 - DNA, 25 bp, Homo sapien
ttttttgacctatgtgattgcagca

SEQ ID NO: 558056 - DNA, 25 bp, Homo sapien
tgtgattgcagcatactgcctcgtt

SEQ ID NO: 558057 - DNA, 25 bp, Homo sapien
gcatactgcctcgtttaattcttac

SEQ ID NO: 558058 - DNA, 25 bp, Homo sapien
gtgtccggccatgaagatggcaaga

SEQ ID NO: 558059 - DNA, 25 bp, Homo sapien
gcaagaagcctctgagacagcccaa

SEQ ID NO: 558060 - DNA, 25 bp, Homo sapien
cagcagaaagcaaaacagaccagaa

SEQ ID NO: 558061 - DNA, 25 bp, Homo sapien
aaagcaatgattttagcagcaccca

SEQ ID NO: 558062 - DNA, 25 bp, Homo sapien
gccgaaagcacaggccgcagggagg

SEQ ID NO: 558063 - DNA, 25 bp, Homo sapien
atgattttagcagcacccattttaa

SEQ ID NO: 558064 - DNA, 25 bp, Homo sapien
tttagcagcacccattttaaagatc

SEQ ID NO: 558065 - DNA, 25 bp, Homo sapien
cttacattttcaccctctcaaaagt

SEQ ID NO: 558066 - DNA, 25 bp, Homo sapien
ttttcaccctctcaaaagtgtcttc

SEQ ID NO: 558067 - DNA, 25 bp, Homo sapien
tcaccctctcaaaagtgtcttctgt

SEQ ID NO: 558068 - DNA, 25 bp, Homo sapien
ctctcaaaagtgtcttctgtccatt

SEQ ID NO: 558069 - DNA, 25 bp, Homo sapien
acgcaccacagaaccgtcgacgaag

SEQ ID NO: 558070 - DNA, 25 bp, Homo sapien
aaccgtcgacgaagagcatgatgga

SEQ ID NO: 558071 - DNA, 25 bp, Homo sapien
tggaacggaagctggcccaccgcaa

SEQ ID NO: 558072 - DNA, 25 bp, Homo sapien
gcaagaccagcaagttccccgagaa

SEQ ID NO: 558073 - DNA, 25 bp, Homo sapien
gaaccccagtgaccacaagctggat

SEQ ID NO: 558074 - DNA, 25 bp, Homo sapien
gagaagctgtgccagaggtcacaca

SEQ ID NO: 558075 - DNA, 25 bp, Homo sapien
gtcacacagcgctatgtgagcgtca

SEQ ID NO: 558076 - DNA, 25 bp, Homo sapien
gtgagcgtcatgaacaggctgcaga

SEQ ID NO: 558077 - DNA, 25 bp, Homo sapien
tgaacaggctgcagagtctgggcta

SEQ ID NO: 558078 - DNA, 25 bp, Homo sapien
ccggcttcagtcaatgactctcgag

SEQ ID NO: 558079 - DNA, 25 bp, Homo sapien
gtcaatgactctcgaggtccacgca

SEQ ID NO: 558080 - DNA, 25 bp, Homo sapien
ctgcccatgtttcctcccaggaaga

SEQ ID NO: 558081 - DNA, 25 bp, Homo sapien
tttcctcccaggaagagcgggcaga

SEQ ID NO: 558082 - DNA, 25 bp, Homo sapien
aagagcgggcagagtggcccagccc

SEQ ID NO: 558083 - DNA, 25 bp, Homo sapien
aggcagtgcttcctgagcagaccac

SEQ ID NO: 558084 - DNA, 25 bp, Homo sapien
ctgagcagaccacccggactgtctt

SEQ ID NO: 558085 - DNA, 25 bp, Homo sapien
tggagaaagagcacgcccggccccg

SEQ ID NO: 558086 - DNA, 25 bp, Homo sapien
agtgaccttctcaggcattctgccc

SEQ ID NO: 558087 - DNA, 25 bp, Homo sapien
ctgaaggggctttgtggcatctctg

SEQ ID NO: 558088 - DNA, 25 bp, Homo sapien
tgctgcactcatgggcctggtctca

SEQ ID NO: 558089 - DNA, 25 bp, Homo sapien
atgggcctggtctcactccttggac

SEQ ID NO: 558090 - DNA, 25 bp, Homo sapien
tcactccttggacttgtcaccttgt

SEQ ID NO: 558091 - DNA, 25 bp, Homo sapien
gagtctcagcccaaggagctgtaca

SEQ ID NO: 558092 - DNA, 25 bp, Homo sapien
agctgtacacagagatggccgttat

SEQ ID NO: 558093 - DNA, 25 bp, Homo sapien
gagatggccgttatctggctcttgc

SEQ ID NO: 558094 - DNA, 25 bp, Homo sapien
ttatctggctcttgccaacacccaa

SEQ ID NO: 558095 - DNA, 25 bp, Homo sapien
aggacttttacctgtgccccatcta

SEQ ID NO: 558096 - DNA, 25 bp, Homo sapien
acaagacactgactcgtgctggaac

SEQ ID NO: 558097 - DNA, 25 bp, Homo sapien
gacactgactcgtgctggaacacta

SEQ ID NO: 558098 - DNA, 25 bp, Homo sapien
gtgctggaacactatcaaccacagg

SEQ ID NO: 558099 - DNA, 25 bp, Homo sapien
accaactatgtcattgctgtggaga

SEQ ID NO: 558100 - DNA, 25 bp, Homo sapien
tatgtcattgctgtggagatcccca

SEQ ID NO: 558101 - DNA, 25 bp, Homo sapien
gccccagcgacactggataaagcgt

SEQ ID NO: 558102 - DNA, 25 bp, Homo sapien
gtgcatttcggagcaccaagcaaat

SEQ ID NO: 558103 - DNA, 25 bp, Homo sapien
aagcaaatacgagcagagagacctg

SEQ ID NO: 558104 - DNA, 25 bp, Homo sapien
taacatggctgagtgaattgtcaat

SEQ ID NO: 558105 - DNA, 25 bp, Homo sapien
gaattgtcaatgcaagttcctttac

SEQ ID NO: 558106 - DNA, 25 bp, Homo sapien
gcaagttcctttactaactctttgt

SEQ ID NO: 558107 - DNA, 25 bp, Homo sapien
tctttgttaagttttgctttgtact

SEQ ID NO: 558108 - DNA, 25 bp, Homo sapien
tttgtactccttacatcctctttct

SEQ ID NO: 558109 - DNA, 25 bp, Homo sapien
gccattgttttaatttcttctcgtt

SEQ ID NO: 558110 - DNA, 25 bp, Homo sapien
taatttcttctcgttatcattttta

SEQ ID NO: 558111 - DNA, 25 bp, Homo sapien
aatacagctttcttcctaccttcac

SEQ ID NO: 558112 - DNA, 25 bp, Homo sapien
ctaccttcacgattgacttggtgga

SEQ ID NO: 558113 - DNA, 25 bp, Homo sapien
cactgctcctgttccaagcaaagaa

SEQ ID NO: 558114 - DNA, 25 bp, Homo sapien
caaagaagatctgctcactccggaa

SEQ ID NO: 558115 - DNA, 25 bp, Homo sapien
agatctgctcactccggaaaaagaa

SEQ ID NO: 558116 - DNA, 25 bp, Homo sapien
ctgaagagaagctagcacttgcaaa

SEQ ID NO: 558117 - DNA, 25 bp, Homo sapien
gaggataacaaagccgcaagccaaa

SEQ ID NO: 558118 - DNA, 25 bp, Homo sapien
gccgcaagccaaacaatgccgaata

SEQ ID NO: 558119 - DNA, 25 bp, Homo sapien
attgactcaagtagctctagctctg

SEQ ID NO: 558120 - DNA, 25 bp, Homo sapien
agcacttgcaaacattccatctggc

SEQ ID NO: 558121 - DNA, 25 bp, Homo sapien
agtagctctagctctggttgaggat

SEQ ID NO: 558122 - DNA, 25 bp, Homo sapien
gaggatgtcatcaattatgctgtta

SEQ ID NO: 558123 - DNA, 25 bp, Homo sapien
gagagaatcctgagacatccccagc

SEQ ID NO: 558124 - DNA, 25 bp, Homo sapien
tccagtggcaatcatttattgtgtt

SEQ ID NO: 558125 - DNA, 25 bp, Homo sapien
attcactgtgattatgtagtcttct

SEQ ID NO: 558126 - DNA, 25 bp, Homo sapien
gtagtcttctggctagtatcaggca

SEQ ID NO: 558127 - DNA, 25 bp, Homo sapien
ctggctagtatcaggcagctctgct

SEQ ID NO: 558128 - DNA, 25 bp, Homo sapien
ggtacaatttaatcttggcctccac

SEQ ID NO: 558129 - DNA, 25 bp, Homo sapien
atcttggcctccacaagcatattaa

SEQ ID NO: 558130 - DNA, 25 bp, Homo sapien
aaagctcacgtgttaatcagtgcat

SEQ ID NO: 558131 - DNA, 25 bp, Homo sapien
atcagtgcattcttatgctcctaca

SEQ ID NO: 558132 - DNA, 25 bp, Homo sapien
atgctcctacattaaatgccttggg

SEQ ID NO: 558133 - DNA, 25 bp, Homo sapien
aaatgccttgggtaaatggataaat

SEQ ID NO: 558134 - DNA, 25 bp, Homo sapien
ataaatggacatgtgcccagcttta

SEQ ID NO: 558135 - DNA, 25 bp, Homo sapien
gtggaagccctgaaagctttatagt

SEQ ID NO: 558136 - DNA, 25 bp, Homo sapien
gccctgaaagctttatagtcctgga

SEQ ID NO: 558137 - DNA, 25 bp, Homo sapien
gaaagctttatagtcctggacatca

SEQ ID NO: 558138 - DNA, 25 bp, Homo sapien
ttttcttatattaccacaattgaga

SEQ ID NO: 558139 - DNA, 25 bp, Homo sapien
ggaacatacacagatatttggcaga

SEQ ID NO: 558140 - DNA, 25 bp, Homo sapien
gatatttggcagaagtcgagtaagg

SEQ ID NO: 558141 - DNA, 25 bp, Homo sapien
aaaagagtccgtgagtttcagtcat

SEQ ID NO: 558142 - DNA, 25 bp, Homo sapien
agagtccgtgagtttcagtcatttt

SEQ ID NO: 558143 - DNA, 25 bp, Homo sapien
gtttcagtcattttcactgctcttt

SEQ ID NO: 558144 - DNA, 25 bp, Homo sapien
gtagaagactaaagatgtcactgaa

SEQ ID NO: 558145 - DNA, 25 bp, Homo sapien
tgtcactgaagacatcacagatact

SEQ ID NO: 558146 - DNA, 25 bp, Homo sapien
ggctgtctatctgcaagctggaggt

SEQ ID NO: 558147 - DNA, 25 bp, Homo sapien
aagggttcgggcagctcctcctgct

SEQ ID NO: 558148 - DNA, 25 bp, Homo sapien
tccaggcatggaggtctgtccacta

SEQ ID NO: 558149 - DNA, 25 bp, Homo sapien
gtctgtccactactgggcttctggg

SEQ ID NO: 558150 - DNA, 25 bp, Homo sapien
ggcttctgggctatttgcccctgat

SEQ ID NO: 558151 - DNA, 25 bp, Homo sapien
gagctcctctaccttactaaagaga

SEQ ID NO: 558152 - DNA, 25 bp, Homo sapien
tgatttgctccctggtacgggctct

SEQ ID NO: 558153 - DNA, 25 bp, Homo sapien
tggtacgggctcttgttaacaggca

SEQ ID NO: 558154 - DNA, 25 bp, Homo sapien
cgggctcttgttaacaggcaggcaa

SEQ ID NO: 558155 - DNA, 25 bp, Homo sapien
ctaccttactaaagagaggcctctt

SEQ ID NO: 558156 - DNA, 25 bp, Homo sapien
tcaggaccttttcattctgccggtg

SEQ ID NO: 558157 - DNA, 25 bp, Homo sapien
agttttgtgccctaagcctcatttc

SEQ ID NO: 558158 - DNA, 25 bp, Homo sapien
tgtgccctaagcctcatttctcatg

SEQ ID NO: 558159 - DNA, 25 bp, Homo sapien
taagcctcatttctcatgttcagac

SEQ ID NO: 558160 - DNA, 25 bp, Homo sapien
atgttcagacctcacatcttctaag

SEQ ID NO: 558161 - DNA, 25 bp, Homo sapien
ttcagacctcacatcttctaagccg

SEQ ID NO: 558162 - DNA, 25 bp, Homo sapien
tcacatcttctaagccgccctgtgt

SEQ ID NO: 558163 - DNA, 25 bp, Homo sapien
ttctaagccgccctgtgtctctgac

SEQ ID NO: 558164 - DNA, 25 bp, Homo sapien
tgaccccttctcatttgcctagtat

SEQ ID NO: 558165 - DNA, 25 bp, Homo sapien
ttctcatttgcctagtatctctgcc

SEQ ID NO: 558166 - DNA, 25 bp, Homo sapien
atttgcctagtatctctgcccctgc

SEQ ID NO: 558167 - DNA, 25 bp, Homo sapien
tgcctccctaattagctagggctgg

SEQ ID NO: 558168 - DNA, 25 bp, Homo sapien
ttcaacaagccagaaagcaatggat

SEQ ID NO: 558169 - DNA, 25 bp, Homo sapien
atggatgaggataacaaagccgcaa

SEQ ID NO: 558170 - DNA, 25 bp, Homo sapien
gaggataacaaagccgcaagccaaa

SEQ ID NO: 558171 - DNA, 25 bp, Homo sapien
agccgcaagccaaacaatgccgaat

SEQ ID NO: 558172 - DNA, 25 bp, Homo sapien
aacaatgccgaatacacaagacaag

SEQ ID NO: 558173 - DNA, 25 bp, Homo sapien
tacacaagacaagaactacgaggat

SEQ ID NO: 558174 - DNA, 25 bp, Homo sapien
gaactacgaggatgaattgactcaa

SEQ ID NO: 558175 - DNA, 25 bp, Homo sapien
attgactcaagtagctctagctctg

SEQ ID NO: 558176 - DNA, 25 bp, Homo sapien
gactcaagtagctctagctctggtt

SEQ ID NO: 558177 - DNA, 25 bp, Homo sapien
agtagctctagctctggttgaggat

SEQ ID NO: 558178 - DNA, 25 bp, Homo sapien
gaggatgtcatcaattatgctgtta

SEQ ID NO: 558179 - DNA, 25 bp, Homo sapien
gaggcggaactgcactatctaccgg

SEQ ID NO: 558180 - DNA, 25 bp, Homo sapien
tacttcgtgtgtgcagacaaagaga

SEQ ID NO: 558181 - DNA, 25 bp, Homo sapien
tggaggcctatgacttcccagaggt

SEQ ID NO: 558182 - DNA, 25 bp, Homo sapien
gcaagtgggacaactgcctttctga

SEQ ID NO: 558183 - DNA, 25 bp, Homo sapien
gacaactgcctttctgaggacatgg

SEQ ID NO: 558184 - DNA, 25 bp, Homo sapien
gaggacatggctgagaacatctgtt

SEQ ID NO: 558185 - DNA, 25 bp, Homo sapien
gagaacatctgttcgtcctcttcct

SEQ ID NO: 558186 - DNA, 25 bp, Homo sapien
cagagaacacttgccctcgagaagc

SEQ ID NO: 558187 - DNA, 25 bp, Homo sapien
tgccctcgagaagccaccaagaaat

SEQ ID NO: 558188 - DNA, 25 bp, Homo sapien
tggactccatcacatcccaggacat

SEQ ID NO: 558189 - DNA, 25 bp, Homo sapien
ggacatcctaatggcttccaggtgg

SEQ ID NO: 558190 - DNA, 25 bp, Homo sapien
gaaggagcagaaaccaaaaatggca

SEQ ID NO: 558191 - DNA, 25 bp, Homo sapien
ggagaaatctcaggaatgtggcatc

SEQ ID NO: 558192 - DNA, 25 bp, Homo sapien
atctcaggaatgtggcatcccatct

SEQ ID NO: 558193 - DNA, 25 bp, Homo sapien
aatgtggcatcccatctccccttga

SEQ ID NO: 558194 - DNA, 25 bp, Homo sapien
tgagacctatcactgaattcacaac

SEQ ID NO: 558195 - DNA, 25 bp, Homo sapien
gaattcacaacccttcgagctcatg

SEQ ID NO: 558196 - DNA, 25 bp, Homo sapien
agctcatgctggtgcactgagtccc

SEQ ID NO: 558197 - DNA, 25 bp, Homo sapien
actgagtcccttgggcgctgtaaag

SEQ ID NO: 558198 - DNA, 25 bp, Homo sapien
ttaaccccttgactgtaaactcaga

SEQ ID NO: 558199 - DNA, 25 bp, Homo sapien
gtaaactcagacttagagacatctg

SEQ ID NO: 558200 - DNA, 25 bp, Homo sapien
tcagacttagagacatctgagtcac

SEQ ID NO: 558201 - DNA, 25 bp, Homo sapien
tcagtgctctcctcagagatctgaa

SEQ ID NO: 558202 - DNA, 25 bp, Homo sapien
tctgaattctactttcatgcggccc

SEQ ID NO: 558203 - DNA, 25 bp, Homo sapien
tgagccacctcctcagaagtttgag

SEQ ID NO: 558204 - DNA, 25 bp, Homo sapien
agtttgagcctcaacaccgtgggat

SEQ ID NO: 558205 - DNA, 25 bp, Homo sapien
aacaccgtgggatcccttctttgtg

SEQ ID NO: 558206 - DNA, 25 bp, Homo sapien
tttgtgctccagagatccagtaaca

SEQ ID NO: 558207 - DNA, 25 bp, Homo sapien
gagatccagtaacagccagccatca

SEQ ID NO: 558208 - DNA, 25 bp, Homo sapien
ctcttcattcttcataggcctgaac

SEQ ID NO: 558209 - DNA, 25 bp, Homo sapien
aagggacttgctccattctaatcag

SEQ ID NO: 558210 - DNA, 25 bp, Homo sapien
ttattgcacccctcagagatcacag

SEQ ID NO: 558211 - DNA, 25 bp, Homo sapien
agatcacagcagcagtcagtgctct

SEQ ID NO: 558212 - DNA, 25 bp, Homo sapien
gctgtaaccacctcagttaaggtca

SEQ ID NO: 558213 - DNA, 25 bp, Homo sapien
ttaaggtcatctaccgagcttggcc

SEQ ID NO: 558214 - DNA, 25 bp, Homo sapien
gagcttggccttcccaataatgttg

SEQ ID NO: 558215 - DNA, 25 bp, Homo sapien
ggccttcccaataatgttgttgaca

SEQ ID NO: 558216 - DNA, 25 bp, Homo sapien
agctgtgagtatgctgcggacttta

SEQ ID NO: 558217 - DNA, 25 bp, Homo sapien
atgctgcggactttaattcaaacca

SEQ ID NO: 558218 - DNA, 25 bp, Homo sapien
gaaatgagctttgtcatgccctgtg

SEQ ID NO: 558219 - DNA, 25 bp, Homo sapien
gtcatgccctgtgttcagatggaag

SEQ ID NO: 558220 - DNA, 25 bp, Homo sapien
caaaccagaccttaatacctaggag

SEQ ID NO: 558221 - DNA, 25 bp, Homo sapien
gatatatcacaaagccgaattaccg

SEQ ID NO: 558222 - DNA, 25 bp, Homo sapien
taccgggaacaatgctgtaaccacc

SEQ ID NO: 558223 - DNA, 25 bp, Homo sapien
attacatatgtacagtatcagtagg

SEQ ID NO: 558224 - DNA, 25 bp, Homo sapien
acatatgtacagtatcagtagggaa

SEQ ID NO: 558225 - DNA, 25 bp, Homo sapien
tgtacagtatcagtagggaaaatgt

SEQ ID NO: 558226 - DNA, 25 bp, Homo sapien
tttcttttgtcatttaattaggcca

SEQ ID NO: 558227 - DNA, 25 bp, Homo sapien
tcttttgtcatttaattaggccatc

SEQ ID NO: 558228 - DNA, 25 bp, Homo sapien
ttttgtcatttaattaggccatctg

SEQ ID NO: 558229 - DNA, 25 bp, Homo sapien
ttgtcatttaattaggccatctgtc

SEQ ID NO: 558230 - DNA, 25 bp, Homo sapien
gtcatttaattaggccatctgtcct

SEQ ID NO: 558231 - DNA, 25 bp, Homo sapien
atttaattaggccatctgtcctgtt

SEQ ID NO: 558232 - DNA, 25 bp, Homo sapien
ttaattaggccatctgtcctgtttt

SEQ ID NO: 558233 - DNA, 25 bp, Homo sapien
atattaactaatacccatatttata

SEQ ID NO: 558234 - DNA, 25 bp, Homo sapien
gaacttgggctttgaggcgagacct

SEQ ID NO: 558235 - DNA, 25 bp, Homo sapien
cttgggctttgaggcgagacctaat

SEQ ID NO: 558236 - DNA, 25 bp, Homo sapien
ggctttgaggcgagacctaattctt

SEQ ID NO: 558237 - DNA, 25 bp, Homo sapien
gcgagacctaattcttagggtgctc

SEQ ID NO: 558238 - DNA, 25 bp, Homo sapien
acctaattcttagggtgctctatga

SEQ ID NO: 558239 - DNA, 25 bp, Homo sapien
gtgctctatgaggacatgggtggtg

SEQ ID NO: 558240 - DNA, 25 bp, Homo sapien
gggcaaagtgacagccgcctgagcc

SEQ ID NO: 558241 - DNA, 25 bp, Homo sapien
ttgcccccaggatgaatacgacgac

SEQ ID NO: 558242 - DNA, 25 bp, Homo sapien
atacgacgacattgtggttcacagc

SEQ ID NO: 558243 - DNA, 25 bp, Homo sapien
cgacgacattgtggttcacagcagc

SEQ ID NO: 558244 - DNA, 25 bp, Homo sapien
cccgccccgtgtgatttgtttcatt

SEQ ID NO: 558245 - DNA, 25 bp, Homo sapien
aatgccttaatcagctttccaaaca

SEQ ID NO: 558246 - DNA, 25 bp, Homo sapien
ctggatctcctgctatccttacacg

SEQ ID NO: 558247 - DNA, 25 bp, Homo sapien
tccttacacgccttgtatctatcaa

SEQ ID NO: 558248 - DNA, 25 bp, Homo sapien
gtatctatcaactaaagctgtcatt

SEQ ID NO: 558249 - DNA, 25 bp, Homo sapien
agctgtcattaatgacttgggcaaa

SEQ ID NO: 558250 - DNA, 25 bp, Homo sapien
aagtcttcctgtgaattagccagta

SEQ ID NO: 558251 - DNA, 25 bp, Homo sapien
ttagccagtagggtctgacacaact

SEQ ID NO: 558252 - DNA, 25 bp, Homo sapien
gtagggtctgacacaactagtcaac

SEQ ID NO: 558253 - DNA, 25 bp, Homo sapien
actagtcaactaacaaggttcctga

SEQ ID NO: 558254 - DNA, 25 bp, Homo sapien
aggttcctgactagtacctcagtat

SEQ ID NO: 558255 - DNA, 25 bp, Homo sapien
acctcagtatttcagcaccttaagc

SEQ ID NO: 558256 - DNA, 25 bp, Homo sapien
gaaatggtggtttccttctgataag

SEQ ID NO: 558257 - DNA, 25 bp, Homo sapien
ggtttccttctgataagggatacag

SEQ ID NO: 558258 - DNA, 25 bp, Homo sapien
gatacagtggaccatgtcgcttata

SEQ ID NO: 558259 - DNA, 25 bp, Homo sapien
ggaccatgtcgcttatatatcaccc

SEQ ID NO: 558260 - DNA, 25 bp, Homo sapien
tcgcttatatatcaccctactaggg

SEQ ID NO: 558261 - DNA, 25 bp, Homo sapien
atataattttcccttctaagcaagg

SEQ ID NO: 558262 - DNA, 25 bp, Homo sapien
ttctaagcaagggaaatggcagtgc

SEQ ID NO: 558263 - DNA, 25 bp, Homo sapien
atggcagtgctaaatagttttgtaa

SEQ ID NO: 558264 - DNA, 25 bp, Homo sapien
taatatttttcagatgcatttgcat

SEQ ID NO: 558265 - DNA, 25 bp, Homo sapien
tttgcattgactatgggagaaaaat

SEQ ID NO: 558266 - DNA, 25 bp, Homo sapien
aggactgaaattctgttacatgatg

SEQ ID NO: 558267 - DNA, 25 bp, Homo sapien
gctcacaatcgagcacacgcgtgtg

SEQ ID NO: 558268 - DNA, 25 bp, Homo sapien
acatgtgcacagatcagtgtcagaa

SEQ ID NO: 558269 - DNA, 25 bp, Homo sapien
agtgtcagaagcatcgacctgcgag

SEQ ID NO: 558270 - DNA, 25 bp, Homo sapien
gaagcatcgacctgcgagctcacag

SEQ ID NO: 558271 - DNA, 25 bp, Homo sapien
ctgcgagctcacagagctgggagca

SEQ ID NO: 558272 - DNA, 25 bp, Homo sapien
acgcacaccccgaatggctatggaa

SEQ ID NO: 558273 - DNA, 25 bp, Homo sapien
accccgaatggctatggaagctgca

SEQ ID NO: 558274 - DNA, 25 bp, Homo sapien
agggacactgggagtccctgctctc

SEQ ID NO: 558275 - DNA, 25 bp, Homo sapien
gagtccctgctctcatggcaaagca

SEQ ID NO: 558276 - DNA, 25 bp, Homo sapien
ggaaggcagcgaactggcccgctca

SEQ ID NO: 558277 - DNA, 25 bp, Homo sapien
cagggccacggcaggcgctcacaat

SEQ ID NO: 558278 - DNA, 25 bp, Homo sapien
acaccccaagcctcgtctgctgtct

SEQ ID NO: 558279 - DNA, 25 bp, Homo sapien
tgcctgcttcccttagcccctgata

SEQ ID NO: 558280 - DNA, 25 bp, Homo sapien
ttcccttagcccctgataccacctt

SEQ ID NO: 558281 - DNA, 25 bp, Homo sapien
ggggtcctgtgaagtcaggccttga

SEQ ID NO: 558282 - DNA, 25 bp, Homo sapien
gccttgaaggagtgggcgtctctca

SEQ ID NO: 558283 - DNA, 25 bp, Homo sapien
ccttgaaggagtgggcgtctctcag

SEQ ID NO: 558284 - DNA, 25 bp, Homo sapien
gaaggagtgggcgtctctcagcccc

SEQ ID NO: 558285 - DNA, 25 bp, Homo sapien
aaggagtgggcgtctctcagcccct

SEQ ID NO: 558286 - DNA, 25 bp, Homo sapien
ggagtgggcgtctctcagcccctct

SEQ ID NO: 558287 - DNA, 25 bp, Homo sapien
agcccctctggaagcctcgcaccag

SEQ ID NO: 558288 - DNA, 25 bp, Homo sapien
ctctcccgcagagcattcaggacca

SEQ ID NO: 558289 - DNA, 25 bp, Homo sapien
gtctcttgagaggagcattctgcca

SEQ ID NO: 558290 - DNA, 25 bp, Homo sapien
ttgagaggagcattctgccattctg

SEQ ID NO: 558291 - DNA, 25 bp, Homo sapien
ccattctggtgtagctgtttctgtt

SEQ ID NO: 558292 - DNA, 25 bp, Homo sapien
ctctccagcagctattttaggtatt

SEQ ID NO: 558293 - DNA, 25 bp, Homo sapien
attattttagagtgtgtgcttgcat

SEQ ID NO: 558294 - DNA, 25 bp, Homo sapien
gtgcttgcatgtgttttgtctcaat

SEQ ID NO: 558295 - DNA, 25 bp, Homo sapien
gtgttttgtctcaatgtatgccaat

SEQ ID NO: 558296 - DNA, 25 bp, Homo sapien
agtcctcctgacatcttaatctatc

SEQ ID NO: 558297 - DNA, 25 bp, Homo sapien
ctgacatcttaatctatctgccaac

SEQ ID NO: 558298 - DNA, 25 bp, Homo sapien
taatctatctgccaacgctacatgc

SEQ ID NO: 558299 - DNA, 25 bp, Homo sapien
acaacataagtctgttatcttcaac

SEQ ID NO: 558300 - DNA, 25 bp, Homo sapien
ggaaattgtctcaagtgagcatgat

SEQ ID NO: 558301 - DNA, 25 bp, Homo sapien
gatgagggtttatctttctcaggaa

SEQ ID NO: 558302 - DNA, 25 bp, Homo sapien
tttctcaggaaaggtgcagtgctat

SEQ ID NO: 558303 - DNA, 25 bp, Homo sapien
tagggagttaaaccagcctgcctca

SEQ ID NO: 558304 - DNA, 25 bp, Homo sapien
tcagctgccaaatgcacaggtgact

SEQ ID NO: 558305 - DNA, 25 bp, Homo sapien
gccaaatgcacaggtgacttcagtc

SEQ ID NO: 558306 - DNA, 25 bp, Homo sapien
atcaggaaatccattgcagccagtt

SEQ ID NO: 558307 - DNA, 25 bp, Homo sapien
cattgcagccagttagtatagagaa

SEQ ID NO: 558308 - DNA, 25 bp, Homo sapien
gaaatttggacttaaaacatcttgt

SEQ ID NO: 558309 - DNA, 25 bp, Homo sapien
gtcttggagtccagtgaacctccat

SEQ ID NO: 558310 - DNA, 25 bp, Homo sapien
gtgaacctccatttggtcctagaaa

SEQ ID NO: 558311 - DNA, 25 bp, Homo sapien
accatgttatactgttatgtcctaa

SEQ ID NO: 558312 - DNA, 25 bp, Homo sapien
caaatcactatttgagaaaccctca

SEQ ID NO: 558313 - DNA, 25 bp, Homo sapien
tagacaaaaccccaaactaagccat

SEQ ID NO: 558314 - DNA, 25 bp, Homo sapien
gaaacaagattctctccattgcagt

SEQ ID NO: 558315 - DNA, 25 bp, Homo sapien
gattctctccattgcagtttgtagc

SEQ ID NO: 558316 - DNA, 25 bp, Homo sapien
gtagcaatgttatttctgtgtatgt

SEQ ID NO: 558317 - DNA, 25 bp, Homo sapien
tctgtgtatgtcatgagaaggctaa

SEQ ID NO: 558318 - DNA, 25 bp, Homo sapien
gagaaggctaaatatcagtgttaat

SEQ ID NO: 558319 - DNA, 25 bp, Homo sapien
ttcttgtttgaatccgtgaaatcat

SEQ ID NO: 558320 - DNA, 25 bp, Homo sapien
gaatccgtgaaatcatgcctgtaaa

SEQ ID NO: 558321 - DNA, 25 bp, Homo sapien
catgcctgtaaagcccaaacatttg

SEQ ID NO: 558322 - DNA, 25 bp, Homo sapien
gatgaatacgacgacattgtggttc

SEQ ID NO: 558323 - DNA, 25 bp, Homo sapien
atgaatacgacgacattgtggttca

SEQ ID NO: 558324 - DNA, 25 bp, Homo sapien
tgaatacgacgacattgtggttcac

SEQ ID NO: 558325 - DNA, 25 bp, Homo sapien
gaatacgacgacattgtggttcaca

SEQ ID NO: 558326 - DNA, 25 bp, Homo sapien
aatacgacgacattgtggttcacag

SEQ ID NO: 558327 - DNA, 25 bp, Homo sapien
atacgacgacattgtggttcacagc

SEQ ID NO: 558328 - DNA, 25 bp, Homo sapien
tacgacgacattgtggttcacagca

SEQ ID NO: 558329 - DNA, 25 bp, Homo sapien
acgacgacattgtggttcacagcag

SEQ ID NO: 558330 - DNA, 25 bp, Homo sapien
cgacgacattgtggttcacagcagc

SEQ ID NO: 558331 - DNA, 25 bp, Homo sapien
atgaattaaatgttagacgtgctta

SEQ ID NO: 558332 - DNA, 25 bp, Homo sapien
tagacgtgcttaacattttatatgc

SEQ ID NO: 558333 - DNA, 25 bp, Homo sapien
gatcacattattgagtgcctttgga

SEQ ID NO: 558334 - DNA, 25 bp, Homo sapien
ttattgagtgcctttggattttaaa

SEQ ID NO: 558335 - DNA, 25 bp, Homo sapien
gattgctattcagatgaataccatt

SEQ ID NO: 558336 - DNA, 25 bp, Homo sapien
gaataccatttcattattgcctgca

SEQ ID NO: 558337 - DNA, 25 bp, Homo sapien
accatttcattattgcctgcactac

SEQ ID NO: 558338 - DNA, 25 bp, Homo sapien
attattgcctgcactactctgtcaa

SEQ ID NO: 558339 - DNA, 25 bp, Homo sapien
tgcctgcactactctgtcaaattaa

SEQ ID NO: 558340 - DNA, 25 bp, Homo sapien
atgttgaagtttatcacagttctac

SEQ ID NO: 558341 - DNA, 25 bp, Homo sapien
gaagtttatcacagttctacattaa

SEQ ID NO: 558342 - DNA, 25 bp, Homo sapien
ggaatcttgtatagtgtctggtatt

SEQ ID NO: 558343 - DNA, 25 bp, Homo sapien
gtatagtgtctggtatttaggtaac

SEQ ID NO: 558344 - DNA, 25 bp, Homo sapien
agttaaaccaaactccataggtgag

SEQ ID NO: 558345 - DNA, 25 bp, Homo sapien
actccataggtgagacttctaagag

SEQ ID NO: 558346 - DNA, 25 bp, Homo sapien
agacttctaagagcctttaaaatgc

SEQ ID NO: 558347 - DNA, 25 bp, Homo sapien
tatagcctaaacatagaatcctggt

SEQ ID NO: 558348 - DNA, 25 bp, Homo sapien
aaacatagaatcctggtagcatctt

SEQ ID NO: 558349 - DNA, 25 bp, Homo sapien
cttggcctcacccattagaaggtaa

SEQ ID NO: 558350 - DNA, 25 bp, Homo sapien
cacccattagaaggtaagctccata

SEQ ID NO: 558351 - DNA, 25 bp, Homo sapien
ggtaagctccataaaaggtgactat

SEQ ID NO: 558352 - DNA, 25 bp, Homo sapien
gactatgctgtatcaaggaatcttg

SEQ ID NO: 558353 - DNA, 25 bp, Homo sapien
aacttgtccataggattgagttcta

SEQ ID NO: 558354 - DNA, 25 bp, Homo sapien
gagttctatattaggcacttcttca

SEQ ID NO: 558355 - DNA, 25 bp, Homo sapien
tatattaggcacttcttcatatttc

SEQ ID NO: 558356 - DNA, 25 bp, Homo sapien
ggatgcatcatgctaattaatatta

SEQ ID NO: 558357 - DNA, 25 bp, Homo sapien
aacactactctttttggttctgcat

SEQ ID NO: 558358 - DNA, 25 bp, Homo sapien
ctactctttttggttctgcatttaa

SEQ ID NO: 558359 - DNA, 25 bp, Homo sapien
attcttcagtagaagtgttctggtc

SEQ ID NO: 558360 - DNA, 25 bp, Homo sapien
gttctggtctgtctccaaactccta

SEQ ID NO: 558361 - DNA, 25 bp, Homo sapien
aattgcagtggacatgttttctgaa

SEQ ID NO: 558362 - DNA, 25 bp, Homo sapien
tggacgcgctcagtctgttgactca

SEQ ID NO: 558363 - DNA, 25 bp, Homo sapien
gtctgttgactcagtgcgggtgacc

SEQ ID NO: 558364 - DNA, 25 bp, Homo sapien
ccaccaagggcaaagcagcccaggt

SEQ ID NO: 558365 - DNA, 25 bp, Homo sapien
cagcccaggtggtgattaggaacag

SEQ ID NO: 558366 - DNA, 25 bp, Homo sapien
agcccaggtggtgattaggaacaga

SEQ ID NO: 558367 - DNA, 25 bp, Homo sapien
aattttcacagaagacgggtcacgc

SEQ ID NO: 558368 - DNA, 25 bp, Homo sapien
ttttcacagaagacgggtcacgctg

SEQ ID NO: 558369 - DNA, 25 bp, Homo sapien
cacagaagacgggtcacgctgaggg

SEQ ID NO: 558370 - DNA, 25 bp, Homo sapien
tgttgaggacccacagattgggcgc

SEQ ID NO: 558371 - DNA, 25 bp, Homo sapien
tgaggacccacagattgggcgccga

SEQ ID NO: 558372 - DNA, 25 bp, Homo sapien
aggacccacagattgggcgccgaga

SEQ ID NO: 558373 - DNA, 25 bp, Homo sapien
cctttcccagttacccgaagctcag

SEQ ID NO: 558374 - DNA, 25 bp, Homo sapien
agcacctgagcctgtacctggggtg

SEQ ID NO: 558375 - DNA, 25 bp, Homo sapien
atcatcttagcctatcctatggtaa

SEQ ID NO: 558376 - DNA, 25 bp, Homo sapien
tatggtaagacctgcaggcccgtac

SEQ ID NO: 558377 - DNA, 25 bp, Homo sapien
cgtacaatccgccagtttgatgagc

SEQ ID NO: 558378 - DNA, 25 bp, Homo sapien
tgatgagcgctacacatctgtggcc

SEQ ID NO: 558379 - DNA, 25 bp, Homo sapien
ggatatcaagactgtgttacctact

SEQ ID NO: 558380 - DNA, 25 bp, Homo sapien
acaaagcagcaagccctagaaccaa

SEQ ID NO: 558381 - DNA, 25 bp, Homo sapien
aagatagatgccatccggatccctg

SEQ ID NO: 558382 - DNA, 25 bp, Homo sapien
gtggtggacatagactttgtactac

SEQ ID NO: 558383 - DNA, 25 bp, Homo sapien
ctgtgctctatctcagtgcagcaga

SEQ ID NO: 558384 - DNA, 25 bp, Homo sapien
ggtataatattcagccatgcccctg

SEQ ID NO: 558385 - DNA, 25 bp, Homo sapien
aaatgagtcttccactatcttccta

SEQ ID NO: 558386 - DNA, 25 bp, Homo sapien
caggcgcgcgtctagaaagagattg

SEQ ID NO: 558387 - DNA, 25 bp, Homo sapien
agaaagagattggtcgccgcgagat

SEQ ID NO: 558388 - DNA, 25 bp, Homo sapien
agagcgagggtcgagatgcctatcc

SEQ ID NO: 558389 - DNA, 25 bp, Homo sapien
gagggtcgagatgcctatcccaaag

SEQ ID NO: 558390 - DNA, 25 bp, Homo sapien
cgagatgcctatcccaaagcttgga

SEQ ID NO: 558391 - DNA, 25 bp, Homo sapien
caaagcttggaaacagcgagaacgt

SEQ ID NO: 558392 - DNA, 25 bp, Homo sapien
gcgagaacgtgttatttccgtggtc

SEQ ID NO: 558393 - DNA, 25 bp, Homo sapien
tgttatttccgtggtctcccatgca

SEQ ID NO: 558394 - DNA, 25 bp, Homo sapien
catgcaccccggtttacgaggcgtt

SEQ ID NO: 558395 - DNA, 25 bp, Homo sapien
cgttccttgtaggtcggacgggcat

SEQ ID NO: 558396 - DNA, 25 bp, Homo sapien
cttgtaggtcggacgggcatccctg

SEQ ID NO: 558397 - DNA, 25 bp, Homo sapien
aagcagctgtaaagatccaggcctg

SEQ ID NO: 558398 - DNA, 25 bp, Homo sapien
caccctggtgcgcaggacactgctg

SEQ ID NO: 558399 - DNA, 25 bp, Homo sapien
ggtgcgcaggacactgctgcatgca

SEQ ID NO: 558400 - DNA, 25 bp, Homo sapien
tgctggtggcggatgacgctgtcga

SEQ ID NO: 558401 - DNA, 25 bp, Homo sapien
atgacgctgtcgagggtgctggaga

SEQ ID NO: 558402 - DNA, 25 bp, Homo sapien
agaaacggcaggcagctctgatcgc

SEQ ID NO: 558403 - DNA, 25 bp, Homo sapien
aacggcaggcagctctgatcgccta

SEQ ID NO: 558404 - DNA, 25 bp, Homo sapien
tgatcgcctacgcaaccagagagag

SEQ ID NO: 558405 - DNA, 25 bp, Homo sapien
acgcaaccagagagagggcagtgat

SEQ ID NO: 558406 - DNA, 25 bp, Homo sapien
agggcagtgatcaagctccagtctt

SEQ ID NO: 558407 - DNA, 25 bp, Homo sapien
aagcattgaatggaagacattgcag

SEQ ID NO: 558408 - DNA, 25 bp, Homo sapien
gaaaatgcaagtccttcctcctgac

SEQ ID NO: 558409 - DNA, 25 bp, Homo sapien
tcctcctgaccctagaaaatctctg

SEQ ID NO: 558410 - DNA, 25 bp, Homo sapien
tgctgccaaggctgggactctgctg

SEQ ID NO: 558411 - DNA, 25 bp, Homo sapien
tgctgccaacttcaggcctgggaaa

SEQ ID NO: 558412 - DNA, 25 bp, Homo sapien
caggcctgggaaaaccaagactcca

SEQ ID NO: 558413 - DNA, 25 bp, Homo sapien
gactccaggagctctacctctagga

SEQ ID NO: 558414 - DNA, 25 bp, Homo sapien
aggagctctacctctaggattcttc

SEQ ID NO: 558415 - DNA, 25 bp, Homo sapien
tacctctaggattcttccaaacatc

SEQ ID NO: 558416 - DNA, 25 bp, Homo sapien
gggtaacaaaccagccaacaaatgg

SEQ ID NO: 558417 - DNA, 25 bp, Homo sapien
aaatgggaggtttttcctgagtgca

SEQ ID NO: 558418 - DNA, 25 bp, Homo sapien
ggtttttcctgagtgcatgatgaga

SEQ ID NO: 558419 - DNA, 25 bp, Homo sapien
tgtcttcccatagagagcagtttgg

SEQ ID NO: 558420 - DNA, 25 bp, Homo sapien
gagcagtttgggattaatacacatg

SEQ ID NO: 558421 - DNA, 25 bp, Homo sapien
gggattaatacacatgattctgtct

SEQ ID NO: 558422 - DNA, 25 bp, Homo sapien
tgcactggaagtttttaccccaatt

SEQ ID NO: 558423 - DNA, 25 bp, Homo sapien
agttacatttttacctccagtcatt

SEQ ID NO: 558424 - DNA, 25 bp, Homo sapien
tacatttttacctccagtcattttg

SEQ ID NO: 558425 - DNA, 25 bp, Homo sapien
ttttacctccagtcattttggctct

SEQ ID NO: 558426 - DNA, 25 bp, Homo sapien
tccagtcattttggctctcttttag

SEQ ID NO: 558427 - DNA, 25 bp, Homo sapien
ggtttattaagggaactccagcaat

SEQ ID NO: 558428 - DNA, 25 bp, Homo sapien
gggaactccagcaatgttaaataga

SEQ ID NO: 558429 - DNA, 25 bp, Homo sapien
aaatagacatgttagatccactacc

SEQ ID NO: 558430 - DNA, 25 bp, Homo sapien
aagtctgggccagctgggatccgac

SEQ ID NO: 558431 - DNA, 25 bp, Homo sapien
gggccagctgggatccgaccagaaa

SEQ ID NO: 558432 - DNA, 25 bp, Homo sapien
tgggatccgaccagaaaccgcaagc

SEQ ID NO: 558433 - DNA, 25 bp, Homo sapien
caggctgagcgctaactgaaggcgc

SEQ ID NO: 558434 - DNA, 25 bp, Homo sapien
tgagcgctaactgaaggcgcgacct

SEQ ID NO: 558435 - DNA, 25 bp, Homo sapien
aactgaaggcgcgacctgagcccgg

SEQ ID NO: 558436 - DNA, 25 bp, Homo sapien
gagctgcgcagccaggacagcggtc

SEQ ID NO: 558437 - DNA, 25 bp, Homo sapien
gacagcggtcggcagcacagggcct

SEQ ID NO: 558438 - DNA, 25 bp, Homo sapien
acctcacgtcggaagccagcactgc

SEQ ID NO: 558439 - DNA, 25 bp, Homo sapien
gcggttcctcctacttcagagcaag

SEQ ID NO: 558440 - DNA, 25 bp, Homo sapien
ttcctcctacttcagagcaagtctg

SEQ ID NO: 558441 - DNA, 25 bp, Homo sapien
tctgggcgctcttgccttcaagaag

SEQ ID NO: 558442 - DNA, 25 bp, Homo sapien
gggaggctcacagacgcagcatcca

SEQ ID NO: 558443 - DNA, 25 bp, Homo sapien
gaagagtccctattctgtacagcca

SEQ ID NO: 558444 - DNA, 25 bp, Homo sapien
ggcctgtggtcccatgaaggacatc

SEQ ID NO: 558445 - DNA, 25 bp, Homo sapien
atgaaggacatcaggctggcagatt

SEQ ID NO: 558446 - DNA, 25 bp, Homo sapien
tggcagattggagcacaccccttct

SEQ ID NO: 558447 - DNA, 25 bp, Homo sapien
taacccctcttgaaagcttccttga

SEQ ID NO: 558448 - DNA, 25 bp, Homo sapien
gaaagcttccttgaatctgccagtc

SEQ ID NO: 558449 - DNA, 25 bp, Homo sapien
tgtacagccacgcactgaggcaaga

SEQ ID NO: 558450 - DNA, 25 bp, Homo sapien
ggaattcagagaaacagctccaggc

SEQ ID NO: 558451 - DNA, 25 bp, Homo sapien
acagctccaggctccagctcaaagg

SEQ ID NO: 558452 - DNA, 25 bp, Homo sapien
cacattgcctttccctttgatttta

SEQ ID NO: 558453 - DNA, 25 bp, Homo sapien
ttggctcaaatgacatgcccggact

SEQ ID NO: 558454 - DNA, 25 bp, Homo sapien
catgcccggactatatcgtgtgata

SEQ ID NO: 558455 - DNA, 25 bp, Homo sapien
gtaatttacgtacaagtcttgaaag

SEQ ID NO: 558456 - DNA, 25 bp, Homo sapien
aacaaagtagcatctactctgcccc

SEQ ID NO: 558457 - DNA, 25 bp, Homo sapien
gccccagccttgacatcttattaca

SEQ ID NO: 558458 - DNA, 25 bp, Homo sapien
aatgctggctctttaatttccctaa

SEQ ID NO: 558459 - DNA, 25 bp, Homo sapien
atttccctaatcaagactggtccta

SEQ ID NO: 558460 - DNA, 25 bp, Homo sapien
aagactggtcctatttagcccacct

SEQ ID NO: 558461 - DNA, 25 bp, Homo sapien
actccgacgcctgatgaagttccag

SEQ ID NO: 558462 - DNA, 25 bp, Homo sapien
gaacagtggaatcaagcacagagat

SEQ ID NO: 558463 - DNA, 25 bp, Homo sapien
taatggacaatgctggccactgcca

SEQ ID NO: 558464 - DNA, 25 bp, Homo sapien
caatgctggccactgccattctgtg

SEQ ID NO: 558465 - DNA, 25 bp, Homo sapien
gaaagactatgagacctgaacatat

SEQ ID NO: 558466 - DNA, 25 bp, Homo sapien
gaagagtgacgttgtctaagatgta

SEQ ID NO: 558467 - DNA, 25 bp, Homo sapien
gtctaagatgtaatgagtgctctct

SEQ ID NO: 558468 - DNA, 25 bp, Homo sapien
gtgctctctgagagaatcactcaat

SEQ ID NO: 558469 - DNA, 25 bp, Homo sapien
gagaatcactcaattcctattggag

SEQ ID NO: 558470 - DNA, 25 bp, Homo sapien
attcctattggagtgcaatccttac

SEQ ID NO: 558471 - DNA, 25 bp, Homo sapien
gagtgcaatccttacttgagaactt

SEQ ID NO: 558472 - DNA, 25 bp, Homo sapien
actttattactcttgttctgtgtag

SEQ ID NO: 558473 - DNA, 25 bp, Homo sapien
attctttttgatagagggtcagtgt

SEQ ID NO: 558474 - DNA, 25 bp, Homo sapien
gtgtttcattgccttgatgtttgag

SEQ ID NO: 558475 - DNA, 25 bp, Homo sapien
gatgtttgagtgtaatctagcattt

SEQ ID NO: 558476 - DNA, 25 bp, Homo sapien
aatctagcattttaatacagtgttt

SEQ ID NO: 558477 - DNA, 25 bp, Homo sapien
tacagtgtttattttgcatgatctt

SEQ ID NO: 558478 - DNA, 25 bp, Homo sapien
ggatgttattgacattatacactga

SEQ ID NO: 558479 - DNA, 25 bp, Homo sapien
tacactgaagtcttaacattttaac

SEQ ID NO: 558480 - DNA, 25 bp, Homo sapien
tttaacatttatagtgcttatttgc

SEQ ID NO: 558481 - DNA, 25 bp, Homo sapien
tctttttcaggtgagtagttgccgc

SEQ ID NO: 558482 - DNA, 25 bp, Homo sapien
tcaggtgagtagttgccgcgtaata

SEQ ID NO: 558483 - DNA, 25 bp, Homo sapien
agttgccgcgtaatatcattggagt

SEQ ID NO: 558484 - DNA, 25 bp, Homo sapien
gcgtaatatcattggagtacattct

SEQ ID NO: 558485 - DNA, 25 bp, Homo sapien
gtctacaactaatggatctcctcct

SEQ ID NO: 558486 - DNA, 25 bp, Homo sapien
aatttcttttattcccatccatatg

SEQ ID NO: 558487 - DNA, 25 bp, Homo sapien
tattcccatccatatgactatgtca

SEQ ID NO: 558488 - DNA, 25 bp, Homo sapien
gactatgtcatctacagcacagctt

SEQ ID NO: 558489 - DNA, 25 bp, Homo sapien
ctaatggatctcctccttagttcct

SEQ ID NO: 558490 - DNA, 25 bp, Homo sapien
cctccttagttcctgttggatatct

SEQ ID NO: 558491 - DNA, 25 bp, Homo sapien
gttcctgttggatatcttgggatgg

SEQ ID NO: 558492 - DNA, 25 bp, Homo sapien
gtcatgagggtagaagcgtcaccac

SEQ ID NO: 558493 - DNA, 25 bp, Homo sapien
agcgtcaccacgaggactgctttta

SEQ ID NO: 558494 - DNA, 25 bp, Homo sapien
ggactgcttttactctcagggtcac

SEQ ID NO: 558495 - DNA, 25 bp, Homo sapien
tgcttttactctcagggtcacctgc

SEQ ID NO: 558496 - DNA, 25 bp, Homo sapien
ttgatcaatttaccagcaaccctct

SEQ ID NO: 558497 - DNA, 25 bp, Homo sapien
taccagcaaccctctgaaggaatga

SEQ ID NO: 558498 - DNA, 25 bp, Homo sapien
aggagagttgtgattgctatgtcaa

SEQ ID NO: 558499 - DNA, 25 bp, Homo sapien
gtacattattgtagcaaccttatat

SEQ ID NO: 558500 - DNA, 25 bp, Homo sapien
gtagcaaccttatatctgatttgag

SEQ ID NO: 558501 - DNA, 25 bp, Homo sapien
tctgatttgagatactgtgttgcca

SEQ ID NO: 558502 - DNA, 25 bp, Homo sapien
ttgccaaatgtccatgttatgttta

SEQ ID NO: 558503 - DNA, 25 bp, Homo sapien
gtccatgttatgtttatttctctat

SEQ ID NO: 558504 - DNA, 25 bp, Homo sapien
gtttatttctctattggttgtattt

SEQ ID NO: 558505 - DNA, 25 bp, Homo sapien
gcctttaaactgtgttagaatcttt

SEQ ID NO: 558506 - DNA, 25 bp, Homo sapien
aggatatcttttcagttacactttt

SEQ ID NO: 558507 - DNA, 25 bp, Homo sapien
agctacaaggtagtttcgcccattt

SEQ ID NO: 558508 - DNA, 25 bp, Homo sapien
tcgcccatttacacgaagacaattt

SEQ ID NO: 558509 - DNA, 25 bp, Homo sapien
tatttaacccgttcctatacactgg

SEQ ID NO: 558510 - DNA, 25 bp, Homo sapien
tatacactggtgtctctttgctgtc

SEQ ID NO: 558511 - DNA, 25 bp, Homo sapien
gtctctttgctgtccagcatgaaat

SEQ ID NO: 558512 - DNA, 25 bp, Homo sapien
atgaggtctgacttttattttcaaa

SEQ ID NO: 558513 - DNA, 25 bp, Homo sapien
gacaattacttggtttcatcctttt

SEQ ID NO: 558514 - DNA, 25 bp, Homo sapien
ccttttgtttggattctagcttgct

SEQ ID NO: 558515 - DNA, 25 bp, Homo sapien
ggattctagcttgctttctcagaac

SEQ ID NO: 558516 - DNA, 25 bp, Homo sapien
ggatgactcctgagggtcttactta

SEQ ID NO: 558517 - DNA, 25 bp, Homo sapien
gggtcttacttattaaatgggtcag

SEQ ID NO: 558518 - DNA, 25 bp, Homo sapien
ccagcgcccctgattggacgaagcg

SEQ ID NO: 558519 - DNA, 25 bp, Homo sapien
ctgattggacgaagcgccgggcccc

SEQ ID NO: 558520 - DNA, 25 bp, Homo sapien
aggctgccctccagtgatgccatca

SEQ ID NO: 558521 - DNA, 25 bp, Homo sapien
agtgatgccatcatgactcagtgca

SEQ ID NO: 558522 - DNA, 25 bp, Homo sapien
ttcaagcgatcttccatcctgacct

SEQ ID NO: 558523 - DNA, 25 bp, Homo sapien
catcctgacctccaaaagggctgga

SEQ ID NO: 558524 - DNA, 25 bp, Homo sapien
tcctgacctccaaaagggctggatt

SEQ ID NO: 558525 - DNA, 25 bp, Homo sapien
tgacctccaaaagggctggattata

SEQ ID NO: 558526 - DNA, 25 bp, Homo sapien
gctggattatacacataagccatgt

SEQ ID NO: 558527 - DNA, 25 bp, Homo sapien
acacataagccatgtcacactttat

SEQ ID NO: 558528 - DNA, 25 bp, Homo sapien
taagccatgtcacactttatatgtt

SEQ ID NO: 558529 - DNA, 25 bp, Homo sapien
gagaacaatagctatgtcccacccc

SEQ ID NO: 558530 - DNA, 25 bp, Homo sapien
tatgtcccaccccagtttgtatttc

SEQ ID NO: 558531 - DNA, 25 bp, Homo sapien
gtatttccgttggttgttggcactt

SEQ ID NO: 558532 - DNA, 25 bp, Homo sapien
accttgtctgttttctggcactcac

SEQ ID NO: 558533 - DNA, 25 bp, Homo sapien
tctgttttctggcactcactataat

SEQ ID NO: 558534 - DNA, 25 bp, Homo sapien
actcactataatcagccttgcacta

SEQ ID NO: 558535 - DNA, 25 bp, Homo sapien
aatcagccttgcactagagctgttt

SEQ ID NO: 558536 - DNA, 25 bp, Homo sapien
cttgcactagagctgtttgtggact

SEQ ID NO: 558537 - DNA, 25 bp, Homo sapien
acccattaaattgtgagctcttaga

SEQ ID NO: 558538 - DNA, 25 bp, Homo sapien
tttcatgtctgatcccctaccaaat

SEQ ID NO: 558539 - DNA, 25 bp, Homo sapien
cagtgccttgcatcaagtagatttc

SEQ ID NO: 558540 - DNA, 25 bp, Homo sapien
ttccaaggtgatcactttactgtag

SEQ ID NO: 558541 - DNA, 25 bp, Homo sapien
aacaactctaatgcacccaatgaag

SEQ ID NO: 558542 - DNA, 25 bp, Homo sapien
gaaatccaacagtcagaacagcata

SEQ ID NO: 558543 - DNA, 25 bp, Homo sapien
gcatactccagcaaggcagcgaaca

SEQ ID NO: 558544 - DNA, 25 bp, Homo sapien
acagccatccagatgtcgattgcct

SEQ ID NO: 558545 - DNA, 25 bp, Homo sapien
ccagatgtcgattgccttcacgtag

SEQ ID NO: 558546 - DNA, 25 bp, Homo sapien
gtaggacacctacaacatccagcga

SEQ ID NO: 558547 - DNA, 25 bp, Homo sapien
gcgacagaacgatcaaccttcttga

SEQ ID NO: 558548 - DNA, 25 bp, Homo sapien
caaccttcttgaagtccttccgtgg

SEQ ID NO: 558549 - DNA, 25 bp, Homo sapien
ttccgtggcctactgagtggatttt

SEQ ID NO: 558550 - DNA, 25 bp, Homo sapien
tgagtggattttcaacccctatcga

SEQ ID NO: 558551 - DNA, 25 bp, Homo sapien
acattgtggcgtggctaaattgagc

SEQ ID NO: 558552 - DNA, 25 bp, Homo sapien
ttacctcacatatttatcatctttc

SEQ ID NO: 558553 - DNA, 25 bp, Homo sapien
tatcatctttcatggtaagaacaca

SEQ ID NO: 558554 - DNA, 25 bp, Homo sapien
aactatagtcaccatttgtgcaaca

SEQ ID NO: 558555 - DNA, 25 bp, Homo sapien
gtcaccatttgtgcaacagatcttt

SEQ ID NO: 558556 - DNA, 25 bp, Homo sapien
tttgtgcaacagatcttttgaactt

SEQ ID NO: 558557 - DNA, 25 bp, Homo sapien
ctgaagttttatattcttcgatcaa

SEQ ID NO: 558558 - DNA, 25 bp, Homo sapien
tatcttctcaattactgttccctac

SEQ ID NO: 558559 - DNA, 25 bp, Homo sapien
tagtaaccattattttactctctgt

SEQ ID NO: 558560 - DNA, 25 bp, Homo sapien
ttactctctgtttctatgtgtttaa

SEQ ID NO: 558561 - DNA, 25 bp, Homo sapien
ttaacttttttagatgccatatata

SEQ ID NO: 558562 - DNA, 25 bp, Homo sapien
gaagtaccgttaattgcccatgtgt

SEQ ID NO: 558563 - DNA, 25 bp, Homo sapien
gcccatgtgtttcaacttgcagaca

SEQ ID NO: 558564 - DNA, 25 bp, Homo sapien
ttgcagacaggcaagaatttggctt

SEQ ID NO: 558565 - DNA, 25 bp, Homo sapien
aatatgtacatcttggttcataatg

SEQ ID NO: 558566 - DNA, 25 bp, Homo sapien
aggtctggaagtgtgttgctaaaaa

SEQ ID NO: 558567 - DNA, 25 bp, Homo sapien
ggtgactcatactaggattacatat

SEQ ID NO: 558568 - DNA, 25 bp, Homo sapien
aaaacatcatatgtgggccttatat

SEQ ID NO: 558569 - DNA, 25 bp, Homo sapien
gtgggccttatatgtaataatgtgt

SEQ ID NO: 558570 - DNA, 25 bp, Homo sapien
ttaattactctgacataacatgggc

SEQ ID NO: 558571 - DNA, 25 bp, Homo sapien
aaatccttaagagatctttttcagt

SEQ ID NO: 558572 - DNA, 25 bp, Homo sapien
cagttttctgaagtaccgttaattg

SEQ ID NO: 558573 - DNA, 25 bp, Homo sapien
tagagtgggcccaggcatcagcatt

SEQ ID NO: 558574 - DNA, 25 bp, Homo sapien
caggcatcagcatttctgtttggca

SEQ ID NO: 558575 - DNA, 25 bp, Homo sapien
gtggtgcacgttttgaggaactact

SEQ ID NO: 558576 - DNA, 25 bp, Homo sapien
ggaactactaaagcctgcctgtgat

SEQ ID NO: 558577 - DNA, 25 bp, Homo sapien
gacttcaccaaaattactcccaggg

SEQ ID NO: 558578 - DNA, 25 bp, Homo sapien
actcccagggagacttctgcatttg

SEQ ID NO: 558579 - DNA, 25 bp, Homo sapien
tctgcatttggctggaaggacattt

SEQ ID NO: 558580 - DNA, 25 bp, Homo sapien
gacatttgagtaaaccgctgaggct

SEQ ID NO: 558581 - DNA, 25 bp, Homo sapien
ggtggttgaaacataatcctctaag

SEQ ID NO: 558582 - DNA, 25 bp, Homo sapien
atcctctaagggagatcggttccga

SEQ ID NO: 558583 - DNA, 25 bp, Homo sapien
atcggttccgataccctgagttagg

SEQ ID NO: 558584 - DNA, 25 bp, Homo sapien
tgcgccccaggtacctggagataag

SEQ ID NO: 558585 - DNA, 25 bp, Homo sapien
gagctgtaatggagcaaatccctga

SEQ ID NO: 558586 - DNA, 25 bp, Homo sapien
gactcactggaccagtttgactgca

SEQ ID NO: 558587 - DNA, 25 bp, Homo sapien
ttgactgcaagcttttaaacccctc

SEQ ID NO: 558588 - DNA, 25 bp, Homo sapien
ttaaacccctccctgcagaaagtgg

SEQ ID NO: 558589 - DNA, 25 bp, Homo sapien
gaaaggaccaattcaaacgcctcat

SEQ ID NO: 558590 - DNA, 25 bp, Homo sapien
aacgcctcattgctggttgcattgg

SEQ ID NO: 558591 - DNA, 25 bp, Homo sapien
tgctggttgcattgggaaacccttg

SEQ ID NO: 558592 - DNA, 25 bp, Homo sapien
gaaacccttgggagagcagttccga

SEQ ID NO: 558593 - DNA, 25 bp, Homo sapien
gcagttccgaaaagaagttcacatt

SEQ ID NO: 558594 - DNA, 25 bp, Homo sapien
aaacaaagccaatgctggagacgga

SEQ ID NO: 558595 - DNA, 25 bp, Homo sapien
ttccctcctgaacgtctatcaagtg

SEQ ID NO: 558596 - DNA, 25 bp, Homo sapien
aacgtctatcaagtggaccatatga

SEQ ID NO: 558597 - DNA, 25 bp, Homo sapien
gtgacaattctatatcattcaacct

SEQ ID NO: 558598 - DNA, 25 bp, Homo sapien
agaacataacctttgtttctattat

SEQ ID NO: 558599 - DNA, 25 bp, Homo sapien
gtgaccttacttttaaccatcctag

SEQ ID NO: 558600 - DNA, 25 bp, Homo sapien
ttaaccatcctagagctctttaacc

SEQ ID NO: 558601 - DNA, 25 bp, Homo sapien
ctagagctctttaacctgttcacac

SEQ ID NO: 558602 - DNA, 25 bp, Homo sapien
gttcacactggatttcaaggatctt

SEQ ID NO: 558603 - DNA, 25 bp, Homo sapien
agtgatggccctggttgacggtacc

SEQ ID NO: 558604 - DNA, 25 bp, Homo sapien
ggttgacggtaccacacctgaagac

SEQ ID NO: 558605 - DNA, 25 bp, Homo sapien
acctgaagacctatgccctttcctt

SEQ ID NO: 558606 - DNA, 25 bp, Homo sapien
gggtattgcttatcacagaggttct

SEQ ID NO: 558607 - DNA, 25 bp, Homo sapien
ttgcttatcacagaggttctgaaga

SEQ ID NO: 558608 - DNA, 25 bp, Homo sapien
gaagtacataatgaagagggcttta

SEQ ID NO: 558609 - DNA, 25 bp, Homo sapien
aattgccaacaaagtgagtcaccag

SEQ ID NO: 558610 - DNA, 25 bp, Homo sapien
tcaccagggctggcagtagtgtgac

SEQ ID NO: 558611 - DNA, 25 bp, Homo sapien
gctgtcctgagctgttaggagagta

SEQ ID NO: 558612 - DNA, 25 bp, Homo sapien
tggtgacctccgtgggtttatatgt

SEQ ID NO: 558613 - DNA, 25 bp, Homo sapien
gacctccgtgggtttatatgtcgga

SEQ ID NO: 558614 - DNA, 25 bp, Homo sapien
ttatatgtcggaaactcttctctcc

SEQ ID NO: 558615 - DNA, 25 bp, Homo sapien
tctgttctccaactcttttaaatgg

SEQ ID NO: 558616 - DNA, 25 bp, Homo sapien
caactcttttaaatggtgcccaact

SEQ ID NO: 558617 - DNA, 25 bp, Homo sapien
taaactgttgcagggatgccgtttt

SEQ ID NO: 558618 - DNA, 25 bp, Homo sapien
gcagggatgccgttttgatgcaatt

SEQ ID NO: 558619 - DNA, 25 bp, Homo sapien
gccgttttgatgcaattttgtgcga

SEQ ID NO: 558620 - DNA, 25 bp, Homo sapien
aattttgtgcgaacaaattggacaa

SEQ ID NO: 558621 - DNA, 25 bp, Homo sapien
ttccttgtattttatcgaagtaatg

SEQ ID NO: 558622 - DNA, 25 bp, Homo sapien
agatggcagttttacaatttgtcac

SEQ ID NO: 558623 - DNA, 25 bp, Homo sapien
gacagaagttgtcaaaaacactcta

SEQ ID NO: 558624 - DNA, 25 bp, Homo sapien
aaacactctaaatccagtatggcaa

SEQ ID NO: 558625 - DNA, 25 bp, Homo sapien
aatccagtatggcaagcattcaaga

SEQ ID NO: 558626 - DNA, 25 bp, Homo sapien
ggcaagcattcaagatctcagtcag

SEQ ID NO: 558627 - DNA, 25 bp, Homo sapien
caaagtagaggtgtatgactgggac

SEQ ID NO: 558628 - DNA, 25 bp, Homo sapien
aaatattttcgttttattggcagat

SEQ ID NO: 558629 - DNA, 25 bp, Homo sapien
ggcagatttattgccatggctctgt

SEQ ID NO: 558630 - DNA, 25 bp, Homo sapien
atggctctgttccatgggaaattca

SEQ ID NO: 558631 - DNA, 25 bp, Homo sapien
tgggaaattcatagacacgggtttt

SEQ ID NO: 558632 - DNA, 25 bp, Homo sapien
ttaccattctataagcgtatcttga

SEQ ID NO: 558633 - DNA, 25 bp, Homo sapien
gcgtatcttgaacaaaccagttgga

SEQ ID NO: 558634 - DNA, 25 bp, Homo sapien
aaccagttggactcaaggatttaga

SEQ ID NO: 558635 - DNA, 25 bp, Homo sapien
attttacaattctctcatctgggtt

SEQ ID NO: 558636 - DNA, 25 bp, Homo sapien
ggaaatgtacttctccgttgacaaa

SEQ ID NO: 558637 - DNA, 25 bp, Homo sapien
gagtcatgatctgaaacctaatggt

SEQ ID NO: 558638 - DNA, 25 bp, Homo sapien
aaacctaatggtggcaatattcttg

SEQ ID NO: 558639 - DNA, 25 bp, Homo sapien
aagtttgatgtaattgtttcaggaa

SEQ ID NO: 558640 - DNA, 25 bp, Homo sapien
agcattctggaatgagcctacttca

SEQ ID NO: 558641 - DNA, 25 bp, Homo sapien
aacagttaatattttcaattccagt

SEQ ID NO: 558642 - DNA, 25 bp, Homo sapien
tattttcaattccagtatatcactt

SEQ ID NO: 558643 - DNA, 25 bp, Homo sapien
gatgtccaagtaattttggttttct

SEQ ID NO: 558644 - DNA, 25 bp, Homo sapien
ttgaatcataagcttgacctgcccc

SEQ ID NO: 558645 - DNA, 25 bp, Homo sapien
gttaatgtaaatttctcatcctcga

SEQ ID NO: 558646 - DNA, 25 bp, Homo sapien
gtaaatttctcatcctcgaaaaggg

SEQ ID NO: 558647 - DNA, 25 bp, Homo sapien
tttctcatcctcgaaaagggtgaac

SEQ ID NO: 558648 - DNA, 25 bp, Homo sapien
agggtgaacataaatgcctttaagg

SEQ ID NO: 558649 - DNA, 25 bp, Homo sapien
aatgcctttaaggagtatatctaaa

SEQ ID NO: 558650 - DNA, 25 bp, Homo sapien
ttctcaagctttcttggcaaatcaa

SEQ ID NO: 558651 - DNA, 25 bp, Homo sapien
gcaaatcaagagcttctgccttttg

SEQ ID NO: 558652 - DNA, 25 bp, Homo sapien
aatcaagagcttctgccttttggag

SEQ ID NO: 558653 - DNA, 25 bp, Homo sapien
aagagcttctgccttttggaggaca

SEQ ID NO: 558654 - DNA, 25 bp, Homo sapien
cacccatatcagctcttagaggaca

SEQ ID NO: 558655 - DNA, 25 bp, Homo sapien
tcagctcttagaggacattccacag

SEQ ID NO: 558656 - DNA, 25 bp, Homo sapien
ggttatcttccttatgctctagatg

SEQ ID NO: 558657 - DNA, 25 bp, Homo sapien
tccttatgctctagatggacatctg

SEQ ID NO: 558658 - DNA, 25 bp, Homo sapien
tcatctgtagaaaagccccatcctt

SEQ ID NO: 558659 - DNA, 25 bp, Homo sapien
aaaagccccatccttctgcaggtgg

SEQ ID NO: 558660 - DNA, 25 bp, Homo sapien
ttctgcaggtggcctcttctcaagc

SEQ ID NO: 558661 - DNA, 25 bp, Homo sapien
gtggtgatgcgcaccaaccctacgc

SEQ ID NO: 558662 - DNA, 25 bp, Homo sapien
tacgctggccgagtccatgcgtcgg

SEQ ID NO: 558663 - DNA, 25 bp, Homo sapien
ccatgcgtcggctggaggatgcctt

SEQ ID NO: 558664 - DNA, 25 bp, Homo sapien
tggaggatgccttcgtcaactgcaa

SEQ ID NO: 558665 - DNA, 25 bp, Homo sapien
ggatgccttcgtcaactgcaaggag

SEQ ID NO: 558666 - DNA, 25 bp, Homo sapien
tgccttcgtcaactgcaaggaggag

SEQ ID NO: 558667 - DNA, 25 bp, Homo sapien
tgctgaccctgaggaaagaaactat

SEQ ID NO: 558668 - DNA, 25 bp, Homo sapien
agagctgctgcatgagaccaagcaa

SEQ ID NO: 558669 - DNA, 25 bp, Homo sapien
ctgcatgagaccaagcaaaggctgt

SEQ ID NO: 558670 - DNA, 25 bp, Homo sapien
aagcaaaggctgtaggccccactgg

SEQ ID NO: 558671 - DNA, 25 bp, Homo sapien
aatgctgtcagatctgaataaggac

SEQ ID NO: 558672 - DNA, 25 bp, Homo sapien
taaagaaggccatcatctactcagc

SEQ ID NO: 558673 - DNA, 25 bp, Homo sapien
atctactcagcctttacctaagtgg

SEQ ID NO: 558674 - DNA, 25 bp, Homo sapien
atcctgtcttttgcgcatttaactt

SEQ ID NO: 558675 - DNA, 25 bp, Homo sapien
taacttacaagaatttacctgcatc

SEQ ID NO: 558676 - DNA, 25 bp, Homo sapien
tacctgcatcagtcagttatgtgaa

SEQ ID NO: 558677 - DNA, 25 bp, Homo sapien
atatttcagcgtacacaaggccctt

SEQ ID NO: 558678 - DNA, 25 bp, Homo sapien
acaaggcccttgtgctttttaggag

SEQ ID NO: 558679 - DNA, 25 bp, Homo sapien
gtgctttttaggaggagttctttgg

SEQ ID NO: 558680 - DNA, 25 bp, Homo sapien
agaataaatctctcatgactctata

SEQ ID NO: 558681 - DNA, 25 bp, Homo sapien
atgactctatatccttcttgacacc

SEQ ID NO: 558682 - DNA, 25 bp, Homo sapien
atatccttcttgacacctaaccaag

SEQ ID NO: 558683 - DNA, 25 bp, Homo sapien
tcatttcttgcctctggtaacttgg

SEQ ID NO: 558684 - DNA, 25 bp, Homo sapien
gggtggatttccttgggctctctag

SEQ ID NO: 558685 - DNA, 25 bp, Homo sapien
tgggctctctaggtgtactgctatg

SEQ ID NO: 558686 - DNA, 25 bp, Homo sapien
agatgcaaaatgtcacccagcttcc

SEQ ID NO: 558687 - DNA, 25 bp, Homo sapien
acatatccttgtctgtgcattcatg

SEQ ID NO: 558688 - DNA, 25 bp, Homo sapien
tgtgcattcatgcatctacctcatt

SEQ ID NO: 558689 - DNA, 25 bp, Homo sapien
cattccggttttctttctaatctca

SEQ ID NO: 558690 - DNA, 25 bp, Homo sapien
tctaatctcatgtattcctgttgtg

SEQ ID NO: 558691 - DNA, 25 bp, Homo sapien
tgttcttttcccgatccttttgtag

SEQ ID NO: 558692 - DNA, 25 bp, Homo sapien
tgacaattgggtttccacgcacgtg

SEQ ID NO: 558693 - DNA, 25 bp, Homo sapien
gtcagcacattaactgcctggcatg

SEQ ID NO: 558694 - DNA, 25 bp, Homo sapien
ttggatgtcaaattgtttattctat

SEQ ID NO: 558695 - DNA, 25 bp, Homo sapien
gtttattctattgggtcttttgctg

SEQ ID NO: 558696 - DNA, 25 bp, Homo sapien
ttctattgggtcttttgctgaacag

SEQ ID NO: 558697 - DNA, 25 bp, Homo sapien
gttttaagaggttcttagctctcct

SEQ ID NO: 558698 - DNA, 25 bp, Homo sapien
ttaagaggttcttagctctcctaaa

SEQ ID NO: 558699 - DNA, 25 bp, Homo sapien
ataaggacattttccctctactgct

SEQ ID NO: 558700 - DNA, 25 bp, Homo sapien
taaggacattttccctctactgctt

SEQ ID NO: 558701 - DNA, 25 bp, Homo sapien
attttgtccttttcttacagtatga

SEQ ID NO: 558702 - DNA, 25 bp, Homo sapien
cggtaaaatgcctatcgaagtcttt

SEQ ID NO: 558703 - DNA, 25 bp, Homo sapien
aaaatgcctatcgaagtctttgcac

SEQ ID NO: 558704 - DNA, 25 bp, Homo sapien
tgcctatcgaagtctttgcacactg

SEQ ID NO: 558705 - DNA, 25 bp, Homo sapien
aatggtgtctgagtctgtgtttcgt

SEQ ID NO: 558706 - DNA, 25 bp, Homo sapien
gtgtctgagtctgtgtttcgttgga

SEQ ID NO: 558707 - DNA, 25 bp, Homo sapien
gtttcgttggatgtgtctgaggtcc

SEQ ID NO: 558708 - DNA, 25 bp, Homo sapien
gggtggccttgcttacccagctgtg

SEQ ID NO: 558709 - DNA, 25 bp, Homo sapien
gccagctgggttatgctgtctccaa

SEQ ID NO: 558710 - DNA, 25 bp, Homo sapien
tgggttatgctgtctccaaagctat

SEQ ID NO: 558711 - DNA, 25 bp, Homo sapien
gctgtctccaaagctatctgcagtg

SEQ ID NO: 558712 - DNA, 25 bp, Homo sapien
ccagctgtgcggaacaggcttggtt

SEQ ID NO: 558713 - DNA, 25 bp, Homo sapien
cttggttgggagtgcctggcctcac

SEQ ID NO: 558714 - DNA, 25 bp, Homo sapien
agtgcctggcctcaccctttgtggg

SEQ ID NO: 558715 - DNA, 25 bp, Homo sapien
gaaaccagattctctgggcagcagt

SEQ ID NO: 558716 - DNA, 25 bp, Homo sapien
aaatactgtgctaagctggtgcttg

SEQ ID NO: 558717 - DNA, 25 bp, Homo sapien
aagctggtgcttggatacatattac

SEQ ID NO: 558718 - DNA, 25 bp, Homo sapien
ggatacatattacagcatcttgtgt

SEQ ID NO: 558719 - DNA, 25 bp, Homo sapien
tattacagcatcttgtgttttattt

SEQ ID NO: 558720 - DNA, 25 bp, Homo sapien
gacaaacagaattttggtgccataa

SEQ ID NO: 558721 - DNA, 25 bp, Homo sapien
gagaagattgtgatgcatatatata

SEQ ID NO: 558722 - DNA, 25 bp, Homo sapien
gtctcacatatttatataatcctca

SEQ ID NO: 558723 - DNA, 25 bp, Homo sapien
taatcctcaaatatactgtaccatt

SEQ ID NO: 558724 - DNA, 25 bp, Homo sapien
aatattcagttcagtttgtacctgt

SEQ ID NO: 558725 - DNA, 25 bp, Homo sapien
gtttgtacctgttagcagtctttca

SEQ ID NO: 558726 - DNA, 25 bp, Homo sapien
acctgttagcagtctttcagtttgg

SEQ ID NO: 558727 - DNA, 25 bp, Homo sapien
aaggatctcatttgggtatctggaa

SEQ ID NO: 558728 - DNA, 25 bp, Homo sapien
tttccccttttatgtctcctcataa

SEQ ID NO: 558729 - DNA, 25 bp, Homo sapien
tatgtctcctcataaactccagaga

SEQ ID NO: 558730 - DNA, 25 bp, Homo sapien
gagacagtctggaaggccctcttaa

SEQ ID NO: 558731 - DNA, 25 bp, Homo sapien
tggaaggccctcttaaatttgtcaa

SEQ ID NO: 558732 - DNA, 25 bp, Homo sapien
gcagtaaagtgtctcacgctcagtt

SEQ ID NO: 558733 - DNA, 25 bp, Homo sapien
acgctcagtttttctagcagatcgt

SEQ ID NO: 558734 - DNA, 25 bp, Homo sapien
gatcgtaatactctcagttgaccct

SEQ ID NO: 558735 - DNA, 25 bp, Homo sapien
tctcagttgaccctgctgggatttg

SEQ ID NO: 558736 - DNA, 25 bp, Homo sapien
gaacctgcagtttctattaagtttg

SEQ ID NO: 558737 - DNA, 25 bp, Homo sapien
ggtgatagttctgtttctttgttat

SEQ ID NO: 558738 - DNA, 25 bp, Homo sapien
ctacgtaggtggaacaggacgcgtt

SEQ ID NO: 558739 - DNA, 25 bp, Homo sapien
tgataggtttgtgcgcgggtccctc

SEQ ID NO: 558740 - DNA, 25 bp, Homo sapien
gctcctcctgggtgctatttgacaa

SEQ ID NO: 558741 - DNA, 25 bp, Homo sapien
gggtgctatttgacaattcctgcct

SEQ ID NO: 558742 - DNA, 25 bp, Homo sapien
tatttgacaattcctgcctctgcca

SEQ ID NO: 558743 - DNA, 25 bp, Homo sapien
gcctctgccattggtcagtgttgga

SEQ ID NO: 558744 - DNA, 25 bp, Homo sapien
gtcagtgttggatcagatggttgta

SEQ ID NO: 558745 - DNA, 25 bp, Homo sapien
agatggttgtatttccttctggccc

SEQ ID NO: 558746 - DNA, 25 bp, Homo sapien
tcagctaaaacccaatctcggatat

SEQ ID NO: 558747 - DNA, 25 bp, Homo sapien
aacccaatctcggatatactactaa

SEQ ID NO: 558748 - DNA, 25 bp, Homo sapien
tatactactaataggcgcggcgctc

SEQ ID NO: 558749 - DNA, 25 bp, Homo sapien
caggacgctgttcctgaatcaggaa

SEQ ID NO: 558750 - DNA, 25 bp, Homo sapien
agggactggtgacctgaactgccac

SEQ ID NO: 558751 - DNA, 25 bp, Homo sapien
tgtccttagactcctgaggttttta

SEQ ID NO: 558752 - DNA, 25 bp, Homo sapien
tccctggtgctcagatgcaatgaaa

SEQ ID NO: 558753 - DNA, 25 bp, Homo sapien
gtgaggcaacaaatctatggctagg

SEQ ID NO: 558754 - DNA, 25 bp, Homo sapien
tatggctaggtaaagggtcaactcc

SEQ ID NO: 558755 - DNA, 25 bp, Homo sapien
ttcagatgttccttcctgcctagta

SEQ ID NO: 558756 - DNA, 25 bp, Homo sapien
tagtaatgttccagctttaccccag

SEQ ID NO: 558757 - DNA, 25 bp, Homo sapien
gaggtttttacacttgcttgctgac

SEQ ID NO: 558758 - DNA, 25 bp, Homo sapien
gcttgctgactctgtggactttgac

SEQ ID NO: 558759 - DNA, 25 bp, Homo sapien
atgatgtaatttgctttgactgtaa

SEQ ID NO: 558760 - DNA, 25 bp, Homo sapien
gggaagcttcttcacccgcttgtcc

SEQ ID NO: 558761 - DNA, 25 bp, Homo sapien
gaagcttcttcacccgcttgtccat

SEQ ID NO: 558762 - DNA, 25 bp, Homo sapien
ttcttcacccgcttgtccatgtctg

SEQ ID NO: 558763 - DNA, 25 bp, Homo sapien
cttgtccatgtctgccccgctctgg

SEQ ID NO: 558764 - DNA, 25 bp, Homo sapien
ttggccggctccagccgctgttcta

SEQ ID NO: 558765 - DNA, 25 bp, Homo sapien
agccgctgttctacctgcagcaggt

SEQ ID NO: 558766 - DNA, 25 bp, Homo sapien
cgctgttctacctgcagcaggtcct

SEQ ID NO: 558767 - DNA, 25 bp, Homo sapien
acccaggaactcagcggtctccggg

SEQ ID NO: 558768 - DNA, 25 bp, Homo sapien
gggtgcgtcccaagctgcccgtctg

SEQ ID NO: 558769 - DNA, 25 bp, Homo sapien
gtctgggccagctgccgcatgcggt

SEQ ID NO: 558770 - DNA, 25 bp, Homo sapien
tgccgcatgcggtgcagctgcctct

SEQ ID NO: 558771 - DNA, 25 bp, Homo sapien
gaaaggaaattcacccgaggtcgca

SEQ ID NO: 558772 - DNA, 25 bp, Homo sapien
ggaaattcacccgaggtcgcagggc

SEQ ID NO: 558773 - DNA, 25 bp, Homo sapien
gtcgcagggccttgagtactcattt

SEQ ID NO: 558774 - DNA, 25 bp, Homo sapien
ccttgagtactcattttggtgctga

SEQ ID NO: 558775 - DNA, 25 bp, Homo sapien
ttggtgctgattacctctctgcaaa

SEQ ID NO: 558776 - DNA, 25 bp, Homo sapien
attacctctctgcaaatggacacgg

SEQ ID NO: 558777 - DNA, 25 bp, Homo sapien
atggacacggcatcataaattggta

SEQ ID NO: 558778 - DNA, 25 bp, Homo sapien
taaattggtagtttcctgctctttt

SEQ ID NO: 558779 - DNA, 25 bp, Homo sapien
tttcctgctctttttgtgtaatctt

SEQ ID NO: 558780 - DNA, 25 bp, Homo sapien
gggctgccctcgtgcactgatggtt

SEQ ID NO: 558781 - DNA, 25 bp, Homo sapien
cctcgtgcactgatggttgtgtgga

SEQ ID NO: 558782 - DNA, 25 bp, Homo sapien
tcatatgacgtttccttcatggaga

SEQ ID NO: 558783 - DNA, 25 bp, Homo sapien
ttccttcatggagaaagtcgacacc

SEQ ID NO: 558784 - DNA, 25 bp, Homo sapien
agtcgacaccaggaagatgccaatg

SEQ ID NO: 558785 - DNA, 25 bp, Homo sapien
gcagaaacaaccatgaatcctccaa

SEQ ID NO: 558786 - DNA, 25 bp, Homo sapien
accatgaatcctccaaagaccacaa

SEQ ID NO: 558787 - DNA, 25 bp, Homo sapien
gaccacaacccccaaggtttgagtg

SEQ ID NO: 558788 - DNA, 25 bp, Homo sapien
cccaaggtttgagtgtcgtaaatat

SEQ ID NO: 558789 - DNA, 25 bp, Homo sapien
agtgtcgtaaatatccatcctggct

SEQ ID NO: 558790 - DNA, 25 bp, Homo sapien
gtaaatatccatcctggcttgcttt

SEQ ID NO: 558791 - DNA, 25 bp, Homo sapien
tatccatcctggcttgctttccttt

SEQ ID NO: 558792 - DNA, 25 bp, Homo sapien
cgggagagaggagccggccaagcct

SEQ ID NO: 558793 - DNA, 25 bp, Homo sapien
caaaacttacttctgtctggtagca

SEQ ID NO: 558794 - DNA, 25 bp, Homo sapien
agagtacctacatttggctttccag

SEQ ID NO: 558795 - DNA, 25 bp, Homo sapien
gccgggctgtttagcagctggtctc

SEQ ID NO: 558796 - DNA, 25 bp, Homo sapien
cagttccagattcctctacattaaa

SEQ ID NO: 558797 - DNA, 25 bp, Homo sapien
taaaatcttcgcctgggttacatct

SEQ ID NO: 558798 - DNA, 25 bp, Homo sapien
acatcttctctcaggattgaatatc

SEQ ID NO: 558799 - DNA, 25 bp, Homo sapien
aacagctttcttggactctccaggt

SEQ ID NO: 558800 - DNA, 25 bp, Homo sapien
gactctccaggtactccaatttgga

SEQ ID NO: 558801 - DNA, 25 bp, Homo sapien
ttaggttcctacagcctagctgtta

SEQ ID NO: 558802 - DNA, 25 bp, Homo sapien
gttacagcgtccttgctacagaaag

SEQ ID NO: 558803 - DNA, 25 bp, Homo sapien
gaaagagatcgttgtctgaccagag

SEQ ID NO: 558804 - DNA, 25 bp, Homo sapien
acacacaaggattttagatttgaaa

SEQ ID NO: 558805 - DNA, 25 bp, Homo sapien
ttcaaaatgtactgtaacctttctt

SEQ ID NO: 558806 - DNA, 25 bp, Homo sapien
aattgtctttattgacatttgtaaa

SEQ ID NO: 558807 - DNA, 25 bp, Homo sapien
aaagaatgtgttttgcccagttatt

SEQ ID NO: 558808 - DNA, 25 bp, Homo sapien
tgtgttttgcccagttattaagtat

SEQ ID NO: 558809 - DNA, 25 bp, Homo sapien
tgttttgcccagttattaagtattt

SEQ ID NO: 558810 - DNA, 25 bp, Homo sapien
ttatgcaatttcagaatcacaatga

SEQ ID NO: 558811 - DNA, 25 bp, Homo sapien
catatacatgcacattcacctcaac

SEQ ID NO: 558812 - DNA, 25 bp, Homo sapien
atacatgcacattcacctcaacttg

SEQ ID NO: 558813 - DNA, 25 bp, Homo sapien
atgcacattcacctcaacttgcaca

SEQ ID NO: 558814 - DNA, 25 bp, Homo sapien
ttcacctcaacttgcacacacatca

SEQ ID NO: 558815 - DNA, 25 bp, Homo sapien
agacaccccgtcaacgaaggtccag

SEQ ID NO: 558816 - DNA, 25 bp, Homo sapien
acgaaggtccagaagcggcgttaag

SEQ ID NO: 558817 - DNA, 25 bp, Homo sapien
gcgttaagggcctaaagaccaccag

SEQ ID NO: 558818 - DNA, 25 bp, Homo sapien
gcgaaaagaccccttcgagggagct

SEQ ID NO: 558819 - DNA, 25 bp, Homo sapien
ggagctcgagccaaaaagccggtga

SEQ ID NO: 558820 - DNA, 25 bp, Homo sapien
gtgaaactaacacccctgcaggaaa

SEQ ID NO: 558821 - DNA, 25 bp, Homo sapien
gaaagctagaggaccaatactgcgt

SEQ ID NO: 558822 - DNA, 25 bp, Homo sapien
aatactgcgtggtcgttatcaccgg

SEQ ID NO: 558823 - DNA, 25 bp, Homo sapien
gtggtcgttatcaccggctgaaaga

SEQ ID NO: 558824 - DNA, 25 bp, Homo sapien
aggtgaccagtgagccacagaagcc

SEQ ID NO: 558825 - DNA, 25 bp, Homo sapien
catcaacctcaagtaccaaagggag

SEQ ID NO: 558826 - DNA, 25 bp, Homo sapien
gggagaaactgtccagggcctcaca

SEQ ID NO: 558827 - DNA, 25 bp, Homo sapien
ctcacagggaggcattcatggagct

SEQ ID NO: 558828 - DNA, 25 bp, Homo sapien
cagggatcctgaccgcagggcccat

SEQ ID NO: 558829 - DNA, 25 bp, Homo sapien
agggcccatcaattgctacatagag

SEQ ID NO: 558830 - DNA, 25 bp, Homo sapien
gtttaacagaccctctctaggacac

SEQ ID NO: 558831 - DNA, 25 bp, Homo sapien
agaccctctctaggacacaactgtt

SEQ ID NO: 558832 - DNA, 25 bp, Homo sapien
gacacaactgtttctgctttgagca

SEQ ID NO: 558833 - DNA, 25 bp, Homo sapien
ataatttctaacctgaggccaacat

SEQ ID NO: 558834 - DNA, 25 bp, Homo sapien
aacatgtcccactgccccttgggtt

SEQ ID NO: 558835 - DNA, 25 bp, Homo sapien
gttgtttcctgagccaagcatccaa

SEQ ID NO: 558836 - DNA, 25 bp, Homo sapien
gagccaagcatccaatatcatgccc

SEQ ID NO: 558837 - DNA, 25 bp, Homo sapien
ccttgttggagaggcttcctgttta

SEQ ID NO: 558838 - DNA, 25 bp, Homo sapien
aggcttcctgtttatgcctcacaag

SEQ ID NO: 558839 - DNA, 25 bp, Homo sapien
ggaagaagcatgcactcccgctttg

SEQ ID NO: 558840 - DNA, 25 bp, Homo sapien
tccttgcctgtagtcttgacagcat

SEQ ID NO: 558841 - DNA, 25 bp, Homo sapien
gtcttgacagcatccgtatgtacgt

SEQ ID NO: 558842 - DNA, 25 bp, Homo sapien
gtatgtacgtgtcctggcatttccc

SEQ ID NO: 558843 - DNA, 25 bp, Homo sapien
tgatgactgatacccaccgggtctg

SEQ ID NO: 558844 - DNA, 25 bp, Homo sapien
gggtctgacattccaagtaaccagt

SEQ ID NO: 558845 - DNA, 25 bp, Homo sapien
gtatgtaactggtagtttgatccca

SEQ ID NO: 558846 - DNA, 25 bp, Homo sapien
gtttgatcccaatagccatagcgac

SEQ ID NO: 558847 - DNA, 25 bp, Homo sapien
ccaatagccatagcgactccaggtg

SEQ ID NO: 558848 - DNA, 25 bp, Homo sapien
agtctccaaactggacagtgcacaa

SEQ ID NO: 558849 - DNA, 25 bp, Homo sapien
aaactggacagtgcacaagggccca

SEQ ID NO: 558850 - DNA, 25 bp, Homo sapien
gacagtgcacaagggcccagaacaa

SEQ ID NO: 558851 - DNA, 25 bp, Homo sapien
tgcacaagggcccagaacaactctg

SEQ ID NO: 558852 - DNA, 25 bp, Homo sapien
agggcccagaacaactctgatgcca

SEQ ID NO: 558853 - DNA, 25 bp, Homo sapien
agaacaactctgatgccaccacaaa

SEQ ID NO: 558854 - DNA, 25 bp, Homo sapien
aactctgatgccaccacaaaacaaa

SEQ ID NO: 558855 - DNA, 25 bp, Homo sapien
atgccaccacaaaacaaacatgttc

SEQ ID NO: 558856 - DNA, 25 bp, Homo sapien
aaacatgttcactagcggattccat

SEQ ID NO: 558857 - DNA, 25 bp, Homo sapien
gttcactagcggattccattctttg

SEQ ID NO: 558858 - DNA, 25 bp, Homo sapien
actagcggattccattctttgggtt

SEQ ID NO: 558859 - DNA, 25 bp, Homo sapien
tctgctcctctgaaatgaagacggc

SEQ ID NO: 558860 - DNA, 25 bp, Homo sapien
aatgaagacggcctcacatatccct

SEQ ID NO: 558861 - DNA, 25 bp, Homo sapien
ggcctcacatatccctttggaaaca

SEQ ID NO: 558862 - DNA, 25 bp, Homo sapien
ggaaacaatcaagtgtgcttctcat

SEQ ID NO: 558863 - DNA, 25 bp, Homo sapien
gtgcttctcatgactaaaggttaaa

SEQ ID NO: 558864 - DNA, 25 bp, Homo sapien
aaagctgtaagactgttggcattta

SEQ ID NO: 558865 - DNA, 25 bp, Homo sapien
ggcatttactgaactgactgtgaca

SEQ ID NO: 558866 - DNA, 25 bp, Homo sapien
taattcatcttgattgagccaattg

SEQ ID NO: 558867 - DNA, 25 bp, Homo sapien
gattgagccaattgtgttctatgtt

SEQ ID NO: 558868 - DNA, 25 bp, Homo sapien
tgttgtaggacatgctgcttccctg

SEQ ID NO: 558869 - DNA, 25 bp, Homo sapien
ctgcttccctgctttcttaatgtta

SEQ ID NO: 558870 - DNA, 25 bp, Homo sapien
tatcttttgaagatggttccctctt

SEQ ID NO: 558871 - DNA, 25 bp, Homo sapien
tccctcttaagacttttgcgaatga

SEQ ID NO: 558872 - DNA, 25 bp, Homo sapien
taagatttcaattatgttccaggaa

SEQ ID NO: 558873 - DNA, 25 bp, Homo sapien
gccatacagaaagctgcaccttgag

SEQ ID NO: 558874 - DNA, 25 bp, Homo sapien
atttttgtctagaacaggtgggaag

SEQ ID NO: 558875 - DNA, 25 bp, Homo sapien
ggaagagatagtttagccacatcca

SEQ ID NO: 558876 - DNA, 25 bp, Homo sapien
gtttagccacatccaagagacctgt

SEQ ID NO: 558877 - DNA, 25 bp, Homo sapien
ccaagagacctgtaaattgggtaca

SEQ ID NO: 558878 - DNA, 25 bp, Homo sapien
gaagacacaagaatcctggagtgga

SEQ ID NO: 558879 - DNA, 25 bp, Homo sapien
attgggtaatgatgacagccttcga

SEQ ID NO: 558880 - DNA, 25 bp, Homo sapien
gacagccttcgaggtcttgagagta

SEQ ID NO: 558881 - DNA, 25 bp, Homo sapien
aacagaatacaaaacagctaagaaa

SEQ ID NO: 558882 - DNA, 25 bp, Homo sapien
ataatttgtttttggtgtaagcaca

SEQ ID NO: 558883 - DNA, 25 bp, Homo sapien
atttgtttttggtgtaagcacagga

SEQ ID NO: 558884 - DNA, 25 bp, Homo sapien
ttgtttttggtgtaagcacaggata

SEQ ID NO: 558885 - DNA, 25 bp, Homo sapien
tttttggtgtaagcacaggataaaa

SEQ ID NO: 558886 - DNA, 25 bp, Homo sapien
cacaggataaaaaaggagagcgtca

SEQ ID NO: 558887 - DNA, 25 bp, Homo sapien
aaaaggagagcgtcaaagaaaagag

SEQ ID NO: 558888 - DNA, 25 bp, Homo sapien
aagaaaagagacataacacctaaca

SEQ ID NO: 558889 - DNA, 25 bp, Homo sapien
cataacacctaacattcataaaaat

SEQ ID NO: 558890 - DNA, 25 bp, Homo sapien
ttaaaatggtactgtattagctaat

SEQ ID NO: 558891 - DNA, 25 bp, Homo sapien
tatatgtttggatttatgcattaaa

SEQ ID NO: 558892 - DNA, 25 bp, Homo sapien
aatgtggactgcctccttggactta

SEQ ID NO: 558893 - DNA, 25 bp, Homo sapien
gactgcctccttggacttaaaaaga

SEQ ID NO: 558894 - DNA, 25 bp, Homo sapien
gaactgatttcttagctttggactt

SEQ ID NO: 558895 - DNA, 25 bp, Homo sapien
tagctttggacttgacaactgacga

SEQ ID NO: 558896 - DNA, 25 bp, Homo sapien
cttgacaactgacgaatgctctggg

SEQ ID NO: 558897 - DNA, 25 bp, Homo sapien
ggtgacctggcccttgctgtccgtt

SEQ ID NO: 558898 - DNA, 25 bp, Homo sapien
cgttccactcccatccttgatgatg

SEQ ID NO: 558899 - DNA, 25 bp, Homo sapien
gagacacctgtgtttatgttgtcac

SEQ ID NO: 558900 - DNA, 25 bp, Homo sapien
gtttatgttgtcacttcgcttgcca

SEQ ID NO: 558901 - DNA, 25 bp, Homo sapien
acacctcacccgatcttggttataa

SEQ ID NO: 558902 - DNA, 25 bp, Homo sapien
cccgatcttggttataaggtacagt

SEQ ID NO: 558903 - DNA, 25 bp, Homo sapien
ttctgtcgcagagctaatgctgttt

SEQ ID NO: 558904 - DNA, 25 bp, Homo sapien
gctaatgctgtttactcactcactt

SEQ ID NO: 558905 - DNA, 25 bp, Homo sapien
aatgctgtttactcactcacttcaa

SEQ ID NO: 558906 - DNA, 25 bp, Homo sapien
tttactcactcacttcaacaacact

SEQ ID NO: 558907 - DNA, 25 bp, Homo sapien
ctcacttcaacaacactaactgcgg

SEQ ID NO: 558908 - DNA, 25 bp, Homo sapien
acaacactaactgcggtggtggcct

SEQ ID NO: 558909 - DNA, 25 bp, Homo sapien
gtcgtgtgttcctggacagagaaac

SEQ ID NO: 558910 - DNA, 25 bp, Homo sapien
ggcctgcgggacacatatagcagca

SEQ ID NO: 558911 - DNA, 25 bp, Homo sapien
catattttgctcttaaccccaccca

SEQ ID NO: 558912 - DNA, 25 bp, Homo sapien
ccacccacctttttaatcacactag

SEQ ID NO: 558913 - DNA, 25 bp, Homo sapien
cacactagattttaagatcaatccc

SEQ ID NO: 558914 - DNA, 25 bp, Homo sapien
aagatactgtataattttatgcctt

SEQ ID NO: 558915 - DNA, 25 bp, Homo sapien
atgcctttgcaaagattcgttcttg

SEQ ID NO: 558916 - DNA, 25 bp, Homo sapien
gcaaagattcgttcttgtatttgaa

SEQ ID NO: 558917 - DNA, 25 bp, Homo sapien
aattcagttgctaaagtagatccaa

SEQ ID NO: 558918 - DNA, 25 bp, Homo sapien
gctgaagtcatgtcaagtactgtct

SEQ ID NO: 558919 - DNA, 25 bp, Homo sapien
tcaagtactgtctggagggtttttt

SEQ ID NO: 558920 - DNA, 25 bp, Homo sapien
ggcatttggcatttaactgtctctt

SEQ ID NO: 558921 - DNA, 25 bp, Homo sapien
ggcatttaactgtctcttgttttat

SEQ ID NO: 558922 - DNA, 25 bp, Homo sapien
gacataaaatgctgccaagtatcta

SEQ ID NO: 558923 - DNA, 25 bp, Homo sapien
atgctgccaagtatctaagaaatgt

SEQ ID NO: 558924 - DNA, 25 bp, Homo sapien
aaatgaaatatgttgctgggtgcgt

SEQ ID NO: 558925 - DNA, 25 bp, Homo sapien
tggtgtcagggaccagctcagccct

SEQ ID NO: 558926 - DNA, 25 bp, Homo sapien
accatcacccgtgtgctggagacag

SEQ ID NO: 558927 - DNA, 25 bp, Homo sapien
tcacccgtgtgctggagacagtgga

SEQ ID NO: 558928 - DNA, 25 bp, Homo sapien
acagcactgtggcagacctgctgca

SEQ ID NO: 558929 - DNA, 25 bp, Homo sapien
accgtggagggcatccgctcagcca

SEQ ID NO: 558930 - DNA, 25 bp, Homo sapien
aggcccaggctgaccccaactatga

SEQ ID NO: 558931 - DNA, 25 bp, Homo sapien
actatgattagagccctgcacaggg

SEQ ID NO: 558932 - DNA, 25 bp, Homo sapien
tggcagacctgctgcacagctcggg

SEQ ID NO: 558933 - DNA, 25 bp, Homo sapien
aagggctggttcagtggcctccaga

SEQ ID NO: 558934 - DNA, 25 bp, Homo sapien
cgctcggtccccagcctggtgggaa

SEQ ID NO: 558935 - DNA, 25 bp, Homo sapien
gtgggaagcgtcagctcggccttct

SEQ ID NO: 558936 - DNA, 25 bp, Homo sapien
gtgggagacaaagctgttaacagga

SEQ ID NO: 558937 - DNA, 25 bp, Homo sapien
atttgtaaagtcaagagccaagcaa

SEQ ID NO: 558938 - DNA, 25 bp, Homo sapien
ggacaagaaatctatcacctgtggg

SEQ ID NO: 558939 - DNA, 25 bp, Homo sapien
gaaatctatcacctgtgggtatgaa

SEQ ID NO: 558940 - DNA, 25 bp, Homo sapien
tcacctgtgggtatgaatggttcta

SEQ ID NO: 558941 - DNA, 25 bp, Homo sapien
aatggttctagggaagtctgttgac

SEQ ID NO: 558942 - DNA, 25 bp, Homo sapien
gtctgttgacaattggagggtctca

SEQ ID NO: 558943 - DNA, 25 bp, Homo sapien
ttggagggtctcaaaggcgctttat

SEQ ID NO: 558944 - DNA, 25 bp, Homo sapien
gtctcaaaggcgctttatggtactt

SEQ ID NO: 558945 - DNA, 25 bp, Homo sapien
ggcgctttatggtacttattttatg

SEQ ID NO: 558946 - DNA, 25 bp, Homo sapien
tatggtacttattttatgaccctga

SEQ ID NO: 558947 - DNA, 25 bp, Homo sapien
agctgggtctacttatggacaaaca

SEQ ID NO: 558948 - DNA, 25 bp, Homo sapien
catctaaatgtgtggaagtatctga

SEQ ID NO: 558949 - DNA, 25 bp, Homo sapien
gtaaatttccacttagctagctagc

SEQ ID NO: 558950 - DNA, 25 bp, Homo sapien
agctagctagcattgtcagacttca

SEQ ID NO: 558951 - DNA, 25 bp, Homo sapien
tagcattgtcagacttcaatctcct

SEQ ID NO: 558952 - DNA, 25 bp, Homo sapien
ttcaatctcctcatggctctggccg

SEQ ID NO: 558953 - DNA, 25 bp, Homo sapien
ctggccgtcctgttttaagcatgat

SEQ ID NO: 558954 - DNA, 25 bp, Homo sapien
gcatgataattgttggccacatctc

SEQ ID NO: 558955 - DNA, 25 bp, Homo sapien
gccacatctcacatagttctcattg

SEQ ID NO: 558956 - DNA, 25 bp, Homo sapien
aagtgtgactttgttgacattttat

SEQ ID NO: 558957 - DNA, 25 bp, Homo sapien
gactttgtcatatgttcctaacccc

SEQ ID NO: 558958 - DNA, 25 bp, Homo sapien
agcacagactgtagatgtccttcca

SEQ ID NO: 558959 - DNA, 25 bp, Homo sapien
gtagatgtccttccaattcttggga

SEQ ID NO: 558960 - DNA, 25 bp, Homo sapien
attcttgggaggctaaactgagtct

SEQ ID NO: 558961 - DNA, 25 bp, Homo sapien
gaggctaaactgagtctaccatttc

SEQ ID NO: 558962 - DNA, 25 bp, Homo sapien
ttacctattttttgagaattgccag

SEQ ID NO: 558963 - DNA, 25 bp, Homo sapien
aattgccagttgtacagtgtttagc

SEQ ID NO: 558964 - DNA, 25 bp, Homo sapien
agtgtttagcatgtggaatgtacca

SEQ ID NO: 558965 - DNA, 25 bp, Homo sapien
ggaatgtaccaaatatatctatgtt

SEQ ID NO: 558966 - DNA, 25 bp, Homo sapien
aaatgtggataacttctgacctagg

SEQ ID NO: 558967 - DNA, 25 bp, Homo sapien
ggataacttctgacctaggaaacat

SEQ ID NO: 558968 - DNA, 25 bp, Homo sapien
catctcttcagttggcatttattga

SEQ ID NO: 558969 - DNA, 25 bp, Homo sapien
ttacattcccgaccccaagagagca

SEQ ID NO: 558970 - DNA, 25 bp, Homo sapien
tgctccccggaatcctcagaaacgg

SEQ ID NO: 558971 - DNA, 25 bp, Homo sapien
tccccggaatcctcagaaacgggat

SEQ ID NO: 558972 - DNA, 25 bp, Homo sapien
ctcagaaacgggatttgtatttgcc

SEQ ID NO: 558973 - DNA, 25 bp, Homo sapien
gggatttgtatttgccgtgactggt

SEQ ID NO: 558974 - DNA, 25 bp, Homo sapien
tgtatttgccgtgactggttggcct

SEQ ID NO: 558975 - DNA, 25 bp, Homo sapien
actggttggcctgaacacgtagggc

SEQ ID NO: 558976 - DNA, 25 bp, Homo sapien
ttggcctgaacacgtagggctccgt

SEQ ID NO: 558977 - DNA, 25 bp, Homo sapien
ggcctgaacacgtagggctccgtga

SEQ ID NO: 558978 - DNA, 25 bp, Homo sapien
aacacgtagggctccgtgactggga

SEQ ID NO: 558979 - DNA, 25 bp, Homo sapien
agggctccgtgactgggacaggaat

SEQ ID NO: 558980 - DNA, 25 bp, Homo sapien
tatgcttagtgttcctgggttgtat

SEQ ID NO: 558981 - DNA, 25 bp, Homo sapien
atgcttagtgttcctgggttgtatt

SEQ ID NO: 558982 - DNA, 25 bp, Homo sapien
gaagaatgggagttcatgccacata

SEQ ID NO: 558983 - DNA, 25 bp, Homo sapien
gaatgggagttcatgccacatagta

SEQ ID NO: 558984 - DNA, 25 bp, Homo sapien
gggagttcatgccacatagtatttt

SEQ ID NO: 558985 - DNA, 25 bp, Homo sapien
gagttcatgccacatagtattttac

SEQ ID NO: 558986 - DNA, 25 bp, Homo sapien
ttcatgccacatagtattttaccaa

SEQ ID NO: 558987 - DNA, 25 bp, Homo sapien
atgccacatagtattttaccaattt

SEQ ID NO: 558988 - DNA, 25 bp, Homo sapien
aatacttcatgatcacttgaattaa

SEQ ID NO: 558989 - DNA, 25 bp, Homo sapien
gatttatatacagaccatttcagag

SEQ ID NO: 558990 - DNA, 25 bp, Homo sapien
cagaggaagttaacatgtcttacaa

SEQ ID NO: 558991 - DNA, 25 bp, Homo sapien
agcagccaccggcttctttgggttt

SEQ ID NO: 558992 - DNA, 25 bp, Homo sapien
gtttctaagctctctcttcccgttt

SEQ ID NO: 558993 - DNA, 25 bp, Homo sapien
cttcccgtttcgatatttcttcagg

SEQ ID NO: 558994 - DNA, 25 bp, Homo sapien
ggaagagcagccactcttgagcctt

SEQ ID NO: 558995 - DNA, 25 bp, Homo sapien
ttgagccttccaaatgcagcgctgg

SEQ ID NO: 558996 - DNA, 25 bp, Homo sapien
tgcagcgctggaaagaggatcatct

SEQ ID NO: 558997 - DNA, 25 bp, Homo sapien
ggatcatctcttgtagtgactcctc

SEQ ID NO: 558998 - DNA, 25 bp, Homo sapien
tttcttatgacacttcagtcgtggg

SEQ ID NO: 558999 - DNA, 25 bp, Homo sapien
aatgaggtccccatgctgagtcctc

SEQ ID NO: 559000 - DNA, 25 bp, Homo sapien
gggacacagcctgccagggcgaatt

SEQ ID NO: 559001 - DNA, 25 bp, Homo sapien
agggcgaattgtcccacccctgcag

SEQ ID NO: 559002 - DNA, 25 bp, Homo sapien
ggcccggaaggcgagagctcggagt

SEQ ID NO: 559003 - DNA, 25 bp, Homo sapien
agagctcggagtgacggcctgggac

SEQ ID NO: 559004 - DNA, 25 bp, Homo sapien
gagtgacggcctgggacctgccact

SEQ ID NO: 559005 - DNA, 25 bp, Homo sapien
tgacggcctgggacctgccactgtg

SEQ ID NO: 559006 - DNA, 25 bp, Homo sapien
gaggccgcgacctctgccacgtgga

SEQ ID NO: 559007 - DNA, 25 bp, Homo sapien
tccctggtggcgatggcgcggcact

SEQ ID NO: 559008 - DNA, 25 bp, Homo sapien
atggcgcggcactggccgagcactg

SEQ ID NO: 559009 - DNA, 25 bp, Homo sapien
ttcctccttgttggttgctgagtgg

SEQ ID NO: 559010 - DNA, 25 bp, Homo sapien
tgttggttgctgagtgggcggccaa

SEQ ID NO: 559011 - DNA, 25 bp, Homo sapien
gggagaaaaggagccgcttctgcct

SEQ ID NO: 559012 - DNA, 25 bp, Homo sapien
aaaaggagccgcttctgcctccctt

SEQ ID NO: 559013 - DNA, 25 bp, Homo sapien
actcatcttaacgattttatcagca

SEQ ID NO: 559014 - DNA, 25 bp, Homo sapien
gtttgtggttttgacacctcattag

SEQ ID NO: 559015 - DNA, 25 bp, Homo sapien
cctcattagaggtttcatcagtgta

SEQ ID NO: 559016 - DNA, 25 bp, Homo sapien
tttcatcagtgtaaggagccaacct

SEQ ID NO: 559017 - DNA, 25 bp, Homo sapien
caagagagaaattgcccctccaaat

SEQ ID NO: 559018 - DNA, 25 bp, Homo sapien
gaggagtctcactttatatagatag

SEQ ID NO: 559019 - DNA, 25 bp, Homo sapien
tatatggcacatgggattgtgactc

SEQ ID NO: 559020 - DNA, 25 bp, Homo sapien
gtgtgttagcacaatatggtcaaaa

SEQ ID NO: 559021 - DNA, 25 bp, Homo sapien
tatggtcaaaaacctctgatccaat

SEQ ID NO: 559022 - DNA, 25 bp, Homo sapien
aaaacctctgatccaattcaaccta

SEQ ID NO: 559023 - DNA, 25 bp, Homo sapien
atccaattcaacctactcatcttaa

SEQ ID NO: 559024 - DNA, 25 bp, Homo sapien
gtataaccagagacaagctgcttat

SEQ ID NO: 559025 - DNA, 25 bp, Homo sapien
aggccaatggccagcacatagggaa

SEQ ID NO: 559026 - DNA, 25 bp, Homo sapien
gaaaattagtgctcatccccaggat

SEQ ID NO: 559027 - DNA, 25 bp, Homo sapien
atccccaggattcaagaccatagcc

SEQ ID NO: 559028 - DNA, 25 bp, Homo sapien
tcagagatcacagggagcttcacat

SEQ ID NO: 559029 - DNA, 25 bp, Homo sapien
gagcttcacatgctgtctatcacag

SEQ ID NO: 559030 - DNA, 25 bp, Homo sapien
acagccaagcatttacaagccaata

SEQ ID NO: 559031 - DNA, 25 bp, Homo sapien
tgttctgttctacttgcttcatgta

SEQ ID NO: 559032 - DNA, 25 bp, Homo sapien
gcttcatgtagcttttcttactcca

SEQ ID NO: 559033 - DNA, 25 bp, Homo sapien
gtagcttttcttactccagtggaaa

SEQ ID NO: 559034 - DNA, 25 bp, Homo sapien
atccaactaggtgagagtgtataac

SEQ ID NO: 559035 - DNA, 25 bp, Homo sapien
cgtccgcgatggtgagtgatagcac

SEQ ID NO: 559036 - DNA, 25 bp, Homo sapien
tccatatgcctgagaccctaacaaa

SEQ ID NO: 559037 - DNA, 25 bp, Homo sapien
ttacaactcatatgcctggagccag

SEQ ID NO: 559038 - DNA, 25 bp, Homo sapien
gacatgtgcaggatgactctgccaa

SEQ ID NO: 559039 - DNA, 25 bp, Homo sapien
ttacatattgcagagcccagcacct

SEQ ID NO: 559040 - DNA, 25 bp, Homo sapien
aggtggagtgactctcatctttttc

SEQ ID NO: 559041 - DNA, 25 bp, Homo sapien
tcatctttttcttctaccccgtata

SEQ ID NO: 559042 - DNA, 25 bp, Homo sapien
taccccgtatatagccagcttggtg

SEQ ID NO: 559043 - DNA, 25 bp, Homo sapien
gccagcttggtgacctactatttga

SEQ ID NO: 559044 - DNA, 25 bp, Homo sapien
tatttgaggctatacccaggcccag

SEQ ID NO: 559045 - DNA, 25 bp, Homo sapien
ccaggcccagaccacagatgaaatt

SEQ ID NO: 559046 - DNA, 25 bp, Homo sapien
aatccttagactatacatagctctt

SEQ ID NO: 559047 - DNA, 25 bp, Homo sapien
agctcttgatttaaatgtgatcata

SEQ ID NO: 559048 - DNA, 25 bp, Homo sapien
gatcataggtgttatttttagttgc

SEQ ID NO: 559049 - DNA, 25 bp, Homo sapien
ggtgttatttttagttgcatagggt

SEQ ID NO: 559050 - DNA, 25 bp, Homo sapien
tttagttgcatagggtatttgatac

SEQ ID NO: 559051 - DNA, 25 bp, Homo sapien
gcatagggtatttgatacaatcatt

SEQ ID NO: 559052 - DNA, 25 bp, Homo sapien
ggaaagcagatagtttgcatttcag

SEQ ID NO: 559053 - DNA, 25 bp, Homo sapien
taatggatcatacacaataggtttt

SEQ ID NO: 559054 - DNA, 25 bp, Homo sapien
aaatagaacgcttgagaggcacttt

SEQ ID NO: 559055 - DNA, 25 bp, Homo sapien
gaacgcttgagaggcactttgtaaa

SEQ ID NO: 559056 - DNA, 25 bp, Homo sapien
acgcttgagaggcactttgtaaaga

SEQ ID NO: 559057 - DNA, 25 bp, Homo sapien
accttttgtgggtcatttcagcaac

SEQ ID NO: 559058 - DNA, 25 bp, Homo sapien
catttcagcaacctctttgctctct

SEQ ID NO: 559059 - DNA, 25 bp, Homo sapien
tttccttcctgcagtcttgtctgtg

SEQ ID NO: 559060 - DNA, 25 bp, Homo sapien
cttcctgcagtcttgtctgtgtgtc

SEQ ID NO: 559061 - DNA, 25 bp, Homo sapien
aatccactgtgttctgttgttctgt

SEQ ID NO: 559062 - DNA, 25 bp, Homo sapien
tctgttgttctgttttgctgcagtt

SEQ ID NO: 559063 - DNA, 25 bp, Homo sapien
gttttgctgcagttttctacttgtc

SEQ ID NO: 559064 - DNA, 25 bp, Homo sapien
gcagttttctacttgtcttctttaa

SEQ ID NO: 559065 - DNA, 25 bp, Homo sapien
tacttgtcttctttaattgcatcag

SEQ ID NO: 559066 - DNA, 25 bp, Homo sapien
taagaccttttctcaaatcttaaat

SEQ ID NO: 559067 - DNA, 25 bp, Homo sapien
gccttcaccttttgtgggtcatttc

SEQ ID NO: 559068 - DNA, 25 bp, Homo sapien
atggagatgggctggctaactactg

SEQ ID NO: 559069 - DNA, 25 bp, Homo sapien
ggctggctaactactgagctgaagt

SEQ ID NO: 559070 - DNA, 25 bp, Homo sapien
gctgaagtactcgaggctgcctgta

SEQ ID NO: 559071 - DNA, 25 bp, Homo sapien
cgaggctgcctgtagctcccaggga

SEQ ID NO: 559072 - DNA, 25 bp, Homo sapien
ctgtagctcccagggaggcctgcaa

SEQ ID NO: 559073 - DNA, 25 bp, Homo sapien
caacgcctggctccaaaagagacag

SEQ ID NO: 559074 - DNA, 25 bp, Homo sapien
aaagagacagagacccgaggtgttt

SEQ ID NO: 559075 - DNA, 25 bp, Homo sapien
gagacccgaggtgttttctgacaat

SEQ ID NO: 559076 - DNA, 25 bp, Homo sapien
ttctgacaatatgttctgtgttggg

SEQ ID NO: 559077 - DNA, 25 bp, Homo sapien
gcctgcggacagaccaagacttcat

SEQ ID NO: 559078 - DNA, 25 bp, Homo sapien
ttggaggtgatttacagtgaaagac

SEQ ID NO: 559079 - DNA, 25 bp, Homo sapien
ggatccaaacctaaagcctacaata

SEQ ID NO: 559080 - DNA, 25 bp, Homo sapien
aagcctacaatagaccatgagtgga

SEQ ID NO: 559081 - DNA, 25 bp, Homo sapien
atgagtggaaactccacccaggacc

SEQ ID NO: 559082 - DNA, 25 bp, Homo sapien
aggacccacaaatcacctgagtgat

SEQ ID NO: 559083 - DNA, 25 bp, Homo sapien
atcacctgagtgatattttcccaga

SEQ ID NO: 559084 - DNA, 25 bp, Homo sapien
gagactaattagtccatgctgcctg

SEQ ID NO: 559085 - DNA, 25 bp, Homo sapien
cagttctttgtttctatcttctaga

SEQ ID NO: 559086 - DNA, 25 bp, Homo sapien
ggaatattctggctattgtgttcag

SEQ ID NO: 559087 - DNA, 25 bp, Homo sapien
ttgtgttcagaaatcactttcaaca

SEQ ID NO: 559088 - DNA, 25 bp, Homo sapien
actttcaacaagacgagcagagctg

SEQ ID NO: 559089 - DNA, 25 bp, Homo sapien
gagcagagctgtaattttccactga

SEQ ID NO: 559090 - DNA, 25 bp, Homo sapien
ctcagagctgccaaaaaccatcact

SEQ ID NO: 559091 - DNA, 25 bp, Homo sapien
aaccatcactggcaagattgaacgg

SEQ ID NO: 559092 - DNA, 25 bp, Homo sapien
ctggtcagatgtaatcggcagtgaa

SEQ ID NO: 559093 - DNA, 25 bp, Homo sapien
taatcggcagtgaactcagaacgca

SEQ ID NO: 559094 - DNA, 25 bp, Homo sapien
gtgaactcagaacgcactgcacacc

SEQ ID NO: 559095 - DNA, 25 bp, Homo sapien
tttagtctccccactatggtgagga

SEQ ID NO: 559096 - DNA, 25 bp, Homo sapien
gtctccccactatggtgaggacgag

SEQ ID NO: 559097 - DNA, 25 bp, Homo sapien
aagtatcaggagtgccatgattcca

SEQ ID NO: 559098 - DNA, 25 bp, Homo sapien
gagtgccatgattccaatgttttcc

SEQ ID NO: 559099 - DNA, 25 bp, Homo sapien
ctccaagtcctctgtatctttagaa

SEQ ID NO: 559100 - DNA, 25 bp, Homo sapien
ttagaatttcccaggtgagcactca

SEQ ID NO: 559101 - DNA, 25 bp, Homo sapien
accgttgtgcgctatgtcctggagg

SEQ ID NO: 559102 - DNA, 25 bp, Homo sapien
gtgcgctatgtcctggagggagcat

SEQ ID NO: 559103 - DNA, 25 bp, Homo sapien
agctggagaccacagcatcactgga

SEQ ID NO: 559104 - DNA, 25 bp, Homo sapien
ggagaccacagcatcactggacttg

SEQ ID NO: 559105 - DNA, 25 bp, Homo sapien
acagcatcactggacttgccagaca

SEQ ID NO: 559106 - DNA, 25 bp, Homo sapien
gcatcactggacttgccagacaaca

SEQ ID NO: 559107 - DNA, 25 bp, Homo sapien
actggacttgccagacaacaagtgg

SEQ ID NO: 559108 - DNA, 25 bp, Homo sapien
aactcagagtacgagatctggcccg

SEQ ID NO: 559109 - DNA, 25 bp, Homo sapien
agagtacgagatctggcccgtcaaa

SEQ ID NO: 559110 - DNA, 25 bp, Homo sapien
agtacgagatctggcccgtcaaagg

SEQ ID NO: 559111 - DNA, 25 bp, Homo sapien
cttttccatccaacaattaaagatc

SEQ ID NO: 559112 - DNA, 25 bp, Homo sapien
gggaagatattagcagacatcatca

SEQ ID NO: 559113 - DNA, 25 bp, Homo sapien
gaagatattagcagacatcatcact

SEQ ID NO: 559114 - DNA, 25 bp, Homo sapien
agatattagcagacatcatcactga

SEQ ID NO: 559115 - DNA, 25 bp, Homo sapien
gagggtggtgcccatgagtggagat

SEQ ID NO: 559116 - DNA, 25 bp, Homo sapien
tggtgcccatgagtggagatgccag

SEQ ID NO: 559117 - DNA, 25 bp, Homo sapien
gagatgccagggtctatggctgaaa

SEQ ID NO: 559118 - DNA, 25 bp, Homo sapien
agatgccagggtctatggctgaaac

SEQ ID NO: 559119 - DNA, 25 bp, Homo sapien
gatgccagggtctatggctgaaact

SEQ ID NO: 559120 - DNA, 25 bp, Homo sapien
atgccagggtctatggctgaaactg

SEQ ID NO: 559121 - DNA, 25 bp, Homo sapien
agggtctatggctgaaactgggaac

SEQ ID NO: 559122 - DNA, 25 bp, Homo sapien
gggtctatggctgaaactgggaact

SEQ ID NO: 559123 - DNA, 25 bp, Homo sapien
aacaggcatgcaaggttgctttatt

SEQ ID NO: 559124 - DNA, 25 bp, Homo sapien
ccaggaaatatttgttgtcagggac

SEQ ID NO: 559125 - DNA, 25 bp, Homo sapien
gtcagggacaatgcaagtggtaaac

SEQ ID NO: 559126 - DNA, 25 bp, Homo sapien
gcaagtggtaaacattttatccctt

SEQ ID NO: 559127 - DNA, 25 bp, Homo sapien
gaggacatgaggaaagcctgcaaaa

SEQ ID NO: 559128 - DNA, 25 bp, Homo sapien
aaaagtacgcatgaggtccctactc

SEQ ID NO: 559129 - DNA, 25 bp, Homo sapien
gcatgaggtccctactccagggagt

SEQ ID NO: 559130 - DNA, 25 bp, Homo sapien
gtcacaatcactgggctacaaggct

SEQ ID NO: 559131 - DNA, 25 bp, Homo sapien
gctgctgatagacacttctattgca

SEQ ID NO: 559132 - DNA, 25 bp, Homo sapien
gctcattatatttcttgactccaga

SEQ ID NO: 559133 - DNA, 25 bp, Homo sapien
gactccagagtatttcagcagataa

SEQ ID NO: 559134 - DNA, 25 bp, Homo sapien
acacacacacaaggattttagattt

SEQ ID NO: 559135 - DNA, 25 bp, Homo sapien
ttcaaaatgtactgtaacctttctt

SEQ ID NO: 559136 - DNA, 25 bp, Homo sapien
tgtactgtaacctttctttggttct

SEQ ID NO: 559137 - DNA, 25 bp, Homo sapien
tctttggttcttactgttttcattt

SEQ ID NO: 559138 - DNA, 25 bp, Homo sapien
aattgtctttattgacatttgtaaa

SEQ ID NO: 559139 - DNA, 25 bp, Homo sapien
aaagaatgtgttttgcccagttatt

SEQ ID NO: 559140 - DNA, 25 bp, Homo sapien
gtgttttgcccagttattaagtatt

SEQ ID NO: 559141 - DNA, 25 bp, Homo sapien
ttatgcaatttcagaatcacaatga

SEQ ID NO: 559142 - DNA, 25 bp, Homo sapien
catatacatgcacattcacctcaac

SEQ ID NO: 559143 - DNA, 25 bp, Homo sapien
atacatgcacattcacctcaacttg

SEQ ID NO: 559144 - DNA, 25 bp, Homo sapien
atgcacattcacctcaacttgcaca

SEQ ID NO: 559145 - DNA, 25 bp, Homo sapien
ataacttggctagggcaagtctcca

SEQ ID NO: 559146 - DNA, 25 bp, Homo sapien
ggctagggcaagtctccaaagtaat

SEQ ID NO: 559147 - DNA, 25 bp, Homo sapien
gggcaagtctccaaagtaattcaga

SEQ ID NO: 559148 - DNA, 25 bp, Homo sapien
gtaattcagatttaactcttcactg

SEQ ID NO: 559149 - DNA, 25 bp, Homo sapien
atttaactcttcactgctagaccca

SEQ ID NO: 559150 - DNA, 25 bp, Homo sapien
ttcactgctagacccagttgtgttc

SEQ ID NO: 559151 - DNA, 25 bp, Homo sapien
gctagacccagttgtgttcaacttt

SEQ ID NO: 559152 - DNA, 25 bp, Homo sapien
ttattgccaacacactttatctctc

SEQ ID NO: 559153 - DNA, 25 bp, Homo sapien
ttgccaacacactttatctctctgt

SEQ ID NO: 559154 - DNA, 25 bp, Homo sapien
acactttatctctctgtgtacagtg

SEQ ID NO: 559155 - DNA, 25 bp, Homo sapien
ctctgtgtacagtgttaatctgatt

SEQ ID NO: 559156 - DNA, 25 bp, Homo sapien
aaacaaatctacaggcatgtcttta

SEQ ID NO: 559157 - DNA, 25 bp, Homo sapien
ggcatgtctttatataccatcaggt

SEQ ID NO: 559158 - DNA, 25 bp, Homo sapien
taccatcaggtctaagttttcaaag

SEQ ID NO: 559159 - DNA, 25 bp, Homo sapien
ggtagatataactgcagataactca

SEQ ID NO: 559160 - DNA, 25 bp, Homo sapien
tgcagataactcattacagtcataa

SEQ ID NO: 559161 - DNA, 25 bp, Homo sapien
attacagtcataatctctgcccatg

SEQ ID NO: 559162 - DNA, 25 bp, Homo sapien
agtcataatctctgcccatgtgtat

SEQ ID NO: 559163 - DNA, 25 bp, Homo sapien
atagacttgtgtatatgcatgaatc

SEQ ID NO: 559164 - DNA, 25 bp, Homo sapien
gtatatgcatgaatcatcagagatg

SEQ ID NO: 559165 - DNA, 25 bp, Homo sapien
atgaaactggtttgagagactcatg

SEQ ID NO: 559166 - DNA, 25 bp, Homo sapien
gagagactcatgtgaaccttacgaa

SEQ ID NO: 559167 - DNA, 25 bp, Homo sapien
tcccatgggaatgtatcttcctcca

SEQ ID NO: 559168 - DNA, 25 bp, Homo sapien
gaatgtatcttcctccatggcatgt

SEQ ID NO: 559169 - DNA, 25 bp, Homo sapien
tccatggcatgtcttgagggtcctt

SEQ ID NO: 559170 - DNA, 25 bp, Homo sapien
ttgagggtcctttcttgttaggagt

SEQ ID NO: 559171 - DNA, 25 bp, Homo sapien
tgttaggagtttatcctgccagccc

SEQ ID NO: 559172 - DNA, 25 bp, Homo sapien
tcctgccagcccataaatggactat

SEQ ID NO: 559173 - DNA, 25 bp, Homo sapien
gagaagcagttttgcaccagcctta

SEQ ID NO: 559174 - DNA, 25 bp, Homo sapien
ttttgcaccagccttattcctgtgc

SEQ ID NO: 559175 - DNA, 25 bp, Homo sapien
tattcctgtgccttgttttcctctt

SEQ ID NO: 559176 - DNA, 25 bp, Homo sapien
gaagtcactttaaatccttcttggg

SEQ ID NO: 559177 - DNA, 25 bp, Homo sapien
aatccttcttgggaatgacacagta

SEQ ID NO: 559178 - DNA, 25 bp, Homo sapien
tcttatccttgggagctgacatcaa

SEQ ID NO: 559179 - DNA, 25 bp, Homo sapien
gggagctgacatcaattctaaagat

SEQ ID NO: 559180 - DNA, 25 bp, Homo sapien
aaaaatcgatcagccctgcatctgg

SEQ ID NO: 559181 - DNA, 25 bp, Homo sapien
tgcatctggcctgtgcaggtcagca

SEQ ID NO: 559182 - DNA, 25 bp, Homo sapien
gtgcaggtcagcacttggcctgtgc

SEQ ID NO: 559183 - DNA, 25 bp, Homo sapien
tggcctgtgccaagtttctcctgca

SEQ ID NO: 559184 - DNA, 25 bp, Homo sapien
aagtttctcctgcagtcgggactga

SEQ ID NO: 559185 - DNA, 25 bp, Homo sapien
gattctgaagacatcacgggcaccc

SEQ ID NO: 559186 - DNA, 25 bp, Homo sapien
gggctctggccatagcgcaatgaca

SEQ ID NO: 559187 - DNA, 25 bp, Homo sapien
gcgcaatgacataaggatgtttcca

SEQ ID NO: 559188 - DNA, 25 bp, Homo sapien
gaggcaataaagtgcatggtaattc

SEQ ID NO: 559189 - DNA, 25 bp, Homo sapien
atattgtgttatctgttgggtctgg

SEQ ID NO: 559190 - DNA, 25 bp, Homo sapien
gtgttatctgttgggtctgggacat

SEQ ID NO: 559191 - DNA, 25 bp, Homo sapien
tgggtctgggacatttagtttagtt

SEQ ID NO: 559192 - DNA, 25 bp, Homo sapien
ctaataactgttttactgctttaag

SEQ ID NO: 559193 - DNA, 25 bp, Homo sapien
taactgttttactgctttaagaaat

SEQ ID NO: 559194 - DNA, 25 bp, Homo sapien
gtttgttctatgaaataaacctagt

SEQ ID NO: 559195 - DNA, 25 bp, Homo sapien
agggaagctgagacattttaagatc

SEQ ID NO: 559196 - DNA, 25 bp, Homo sapien
aaatatggacttttcatgtatgcat

SEQ ID NO: 559197 - DNA, 25 bp, Homo sapien
ggacttttcatgtatgcatagggaa

SEQ ID NO: 559198 - DNA, 25 bp, Homo sapien
tgtatgcatagggaagacacttcac

SEQ ID NO: 559199 - DNA, 25 bp, Homo sapien
gcatagggaagacacttcacaaatt

SEQ ID NO: 559200 - DNA, 25 bp, Homo sapien
gcatttcagaaacattgccctttca

SEQ ID NO: 559201 - DNA, 25 bp, Homo sapien
gaaacattgccctttcaagcaagtt

SEQ ID NO: 559202 - DNA, 25 bp, Homo sapien
gttaaaacaatatccctcaacatta

SEQ ID NO: 559203 - DNA, 25 bp, Homo sapien
aaataccatctttttagccatcagt

SEQ ID NO: 559204 - DNA, 25 bp, Homo sapien
atctttttagccatcagtaccactg

SEQ ID NO: 559205 - DNA, 25 bp, Homo sapien
atcagtaccactgggcatgtgtcat

SEQ ID NO: 559206 - DNA, 25 bp, Homo sapien
gggcagatatagctccctttcatat

SEQ ID NO: 559207 - DNA, 25 bp, Homo sapien
gctccctttcatatgctataccaga

SEQ ID NO: 559208 - DNA, 25 bp, Homo sapien
tctgggtttttaccttcaaagcaca

SEQ ID NO: 559209 - DNA, 25 bp, Homo sapien
ttaccttcaaagcacaggcagctgt

SEQ ID NO: 559210 - DNA, 25 bp, Homo sapien
tggtaaactgtccaattattaattt

SEQ ID NO: 559211 - DNA, 25 bp, Homo sapien
aagacctgcagcattgagcgtgtcc

SEQ ID NO: 559212 - DNA, 25 bp, Homo sapien
cattgagcgtgtcctgcggaaaaca

SEQ ID NO: 559213 - DNA, 25 bp, Homo sapien
aggttccagaaatggctgcaggcca

SEQ ID NO: 559214 - DNA, 25 bp, Homo sapien
gcctcacgccggacctggtgcagga

SEQ ID NO: 559215 - DNA, 25 bp, Homo sapien
agaactaaagttcctgtgtatgctg

SEQ ID NO: 559216 - DNA, 25 bp, Homo sapien
ctgtgtatgctgagataacaccagt

SEQ ID NO: 559217 - DNA, 25 bp, Homo sapien
taacaccagtgaaaaagcctggcat

SEQ ID NO: 559218 - DNA, 25 bp, Homo sapien
agcccagcactgagaacttccagaa

SEQ ID NO: 559219 - DNA, 25 bp, Homo sapien
gaacttccagaaagtgttagccttc

SEQ ID NO: 559220 - DNA, 25 bp, Homo sapien
aaagtgttagccttctcccaactgt

SEQ ID NO: 559221 - DNA, 25 bp, Homo sapien
ttctcccaactgtgttataccaacc

SEQ ID NO: 559222 - DNA, 25 bp, Homo sapien
gtaggttggccttttatccacagga

SEQ ID NO: 559223 - DNA, 25 bp, Homo sapien
gggaatccccaaacagcagccatag

SEQ ID NO: 559224 - DNA, 25 bp, Homo sapien
caaacagcagccatagactcactgg

SEQ ID NO: 559225 - DNA, 25 bp, Homo sapien
gactcactggctctcattaaacggg

SEQ ID NO: 559226 - DNA, 25 bp, Homo sapien
atttcgctttaatgacaccattcat

SEQ ID NO: 559227 - DNA, 25 bp, Homo sapien
gacaccattcatcattcgtttttta

SEQ ID NO: 559228 - DNA, 25 bp, Homo sapien
aagctccctaatgaggctcttttgc

SEQ ID NO: 559229 - DNA, 25 bp, Homo sapien
ttttgccagctaataggactctcga

SEQ ID NO: 559230 - DNA, 25 bp, Homo sapien
ggactctcgatttccatgagaacca

SEQ ID NO: 559231 - DNA, 25 bp, Homo sapien
tgagaaccattcttgcccagaggat

SEQ ID NO: 559232 - DNA, 25 bp, Homo sapien
gagctgttgctcaccacaccaggat

SEQ ID NO: 559233 - DNA, 25 bp, Homo sapien
gctctttctgggatctgtctccctc

SEQ ID NO: 559234 - DNA, 25 bp, Homo sapien
gtgggtcccgtgaatgactgtttta

SEQ ID NO: 559235 - DNA, 25 bp, Homo sapien
gactgttttagagtacccatgtggg

SEQ ID NO: 559236 - DNA, 25 bp, Homo sapien
tagagtacccatgtgggttccctga

SEQ ID NO: 559237 - DNA, 25 bp, Homo sapien
taataaggaggttagcactgagctt

SEQ ID NO: 559238 - DNA, 25 bp, Homo sapien
ggacgtgctgtcacaccagcaggac

SEQ ID NO: 559239 - DNA, 25 bp, Homo sapien
ggaaggagcaggctacttcctttct

SEQ ID NO: 559240 - DNA, 25 bp, Homo sapien
ctacttcctttcttgacgtgcaaat

SEQ ID NO: 559241 - DNA, 25 bp, Homo sapien
cgtgcaaataactcgtataggctaa

SEQ ID NO: 559242 - DNA, 25 bp, Homo sapien
cgtataggctaatcaacaggcttat

SEQ ID NO: 559243 - DNA, 25 bp, Homo sapien
tcctctgtaacttggagatgtttgt

SEQ ID NO: 559244 - DNA, 25 bp, Homo sapien
tgaacatctctgtaatctccaagcc

SEQ ID NO: 559245 - DNA, 25 bp, Homo sapien
aagcctcagtgtcgcgatgcctata

SEQ ID NO: 559246 - DNA, 25 bp, Homo sapien
gtcgcgatgcctataaaacctacaa

SEQ ID NO: 559247 - DNA, 25 bp, Homo sapien
tatgctgtgtgtgggcattgtgcca

SEQ ID NO: 559248 - DNA, 25 bp, Homo sapien
tgccctaccaaactatctctgaaaa

SEQ ID NO: 559249 - DNA, 25 bp, Homo sapien
tgccccggcaatctgcaatgggatg

SEQ ID NO: 559250 - DNA, 25 bp, Homo sapien
ggatgcttcaaggaatcctgtcttt

SEQ ID NO: 559251 - DNA, 25 bp, Homo sapien
ctgtcttttgcggatggatgtgttt

SEQ ID NO: 559252 - DNA, 25 bp, Homo sapien
gaaaataccatgtgctctgtctcta

SEQ ID NO: 559253 - DNA, 25 bp, Homo sapien
gtctctacctggagctacaatgtgt

SEQ ID NO: 559254 - DNA, 25 bp, Homo sapien
aagagcccgattcactgcaaactgt

SEQ ID NO: 559255 - DNA, 25 bp, Homo sapien
gggaagtaatctagctcctgactat

SEQ ID NO: 559256 - DNA, 25 bp, Homo sapien
tatgttgaactatgtcgctgctttt

SEQ ID NO: 559257 - DNA, 25 bp, Homo sapien
tatgtcgctgctttttacaaacttg

SEQ ID NO: 559258 - DNA, 25 bp, Homo sapien
aacttgtcttgatccaaagcagtca

SEQ ID NO: 559259 - DNA, 25 bp, Homo sapien
aatgataaccctgcatatctgggaa

SEQ ID NO: 559260 - DNA, 25 bp, Homo sapien
gcatatctgggaatcataagtcaac

SEQ ID NO: 559261 - DNA, 25 bp, Homo sapien
cataagtcaactatgtatctctgtg

SEQ ID NO: 559262 - DNA, 25 bp, Homo sapien
gattgtctataatctcgctagcctt

SEQ ID NO: 559263 - DNA, 25 bp, Homo sapien
ataatctcgctagccttgtactgtg

SEQ ID NO: 559264 - DNA, 25 bp, Homo sapien
agccttgtactgtgtgtgcatagca

SEQ ID NO: 559265 - DNA, 25 bp, Homo sapien
gtgtgcatagcaattacagggaagt

SEQ ID NO: 559266 - DNA, 25 bp, Homo sapien
atcacctagggcgataagcacatca

SEQ ID NO: 559267 - DNA, 25 bp, Homo sapien
gataagcacatcagaagacttcgtt

SEQ ID NO: 559268 - DNA, 25 bp, Homo sapien
gacccaagttaggagtcagaagact

SEQ ID NO: 559269 - DNA, 25 bp, Homo sapien
gaagacttgggcttcaagagtggct

SEQ ID NO: 559270 - DNA, 25 bp, Homo sapien
gctgtgggtgggtataagatttctc

SEQ ID NO: 559271 - DNA, 25 bp, Homo sapien
taagatttctccttggtgacaccca

SEQ ID NO: 559272 - DNA, 25 bp, Homo sapien
gacacccaagggttgacgtagatga

SEQ ID NO: 559273 - DNA, 25 bp, Homo sapien
gtagatgacctctttgataaccaga

SEQ ID NO: 559274 - DNA, 25 bp, Homo sapien
agaaggcaagatcagcttcgccgct

SEQ ID NO: 559275 - DNA, 25 bp, Homo sapien
cgctctgcgaaagccagccgtggag

SEQ ID NO: 559276 - DNA, 25 bp, Homo sapien
aatattatattatcacctagggcga

SEQ ID NO: 559277 - DNA, 25 bp, Homo sapien
ccagtgtgggcgaggtacatctttg

SEQ ID NO: 559278 - DNA, 25 bp, Homo sapien
gtgtgggcgaggtacatctttgtat

SEQ ID NO: 559279 - DNA, 25 bp, Homo sapien
gtgggcgaggtacatctttgtatcc

SEQ ID NO: 559280 - DNA, 25 bp, Homo sapien
gggcgaggtacatctttgtatcccc

SEQ ID NO: 559281 - DNA, 25 bp, Homo sapien
catttcacggatgagggactgaggc

SEQ ID NO: 559282 - DNA, 25 bp, Homo sapien
cacggatgagggactgaggctccaa

SEQ ID NO: 559283 - DNA, 25 bp, Homo sapien
ccaagatctcacagcaggaagtgat

SEQ ID NO: 559284 - DNA, 25 bp, Homo sapien
tctcacagcaggaagtgatggaact

SEQ ID NO: 559285 - DNA, 25 bp, Homo sapien
gaactgggattcaaacacaagtcgt

SEQ ID NO: 559286 - DNA, 25 bp, Homo sapien
gggattcaaacacaagtcgtttcca

SEQ ID NO: 559287 - DNA, 25 bp, Homo sapien
tcaaacacaagtcgtttccagcttt

SEQ ID NO: 559288 - DNA, 25 bp, Homo sapien
aacaggatgtgacttctgaaaagac

SEQ ID NO: 559289 - DNA, 25 bp, Homo sapien
gaaaatggtttctcaaggagattgg

SEQ ID NO: 559290 - DNA, 25 bp, Homo sapien
agaccacggcacctcgaaggctgcg

SEQ ID NO: 559291 - DNA, 25 bp, Homo sapien
acctcgaaggctgcggtgaaggctt

SEQ ID NO: 559292 - DNA, 25 bp, Homo sapien
ggctgcggtgaaggcttaggtctca

SEQ ID NO: 559293 - DNA, 25 bp, Homo sapien
ggttgtctgagatgaaccccccaac

SEQ ID NO: 559294 - DNA, 25 bp, Homo sapien
gatgaaccccccaactgaatgaatg

SEQ ID NO: 559295 - DNA, 25 bp, Homo sapien
ccaactgaatgaatggaccttcttc

SEQ ID NO: 559296 - DNA, 25 bp, Homo sapien
atggaccttcttctggccaagggga

SEQ ID NO: 559297 - DNA, 25 bp, Homo sapien
agaaaccctgaacccgagtcctcag

SEQ ID NO: 559298 - DNA, 25 bp, Homo sapien
gaacccgagtcctcagccatgacgg

SEQ ID NO: 559299 - DNA, 25 bp, Homo sapien
aagttcaaccaaaccaggactgcca

SEQ ID NO: 559300 - DNA, 25 bp, Homo sapien
gactgccactggctgctaaagggaa

SEQ ID NO: 559301 - DNA, 25 bp, Homo sapien
ggaagaaaaggctccatgaagaatt

SEQ ID NO: 559302 - DNA, 25 bp, Homo sapien
gtttctatggaaacattcaccagat

SEQ ID NO: 559303 - DNA, 25 bp, Homo sapien
tagcagcatgctatactgtgcaagt

SEQ ID NO: 559304 - DNA, 25 bp, Homo sapien
gcatgctatactgtgcaagtgaaga

SEQ ID NO: 559305 - DNA, 25 bp, Homo sapien
gaagaagaaggcatcttcctttcat

SEQ ID NO: 559306 - DNA, 25 bp, Homo sapien
ctgcctgaagttagaagactacatg

SEQ ID NO: 559307 - DNA, 25 bp, Homo sapien
ttcctttcatcaccacatctagagt

SEQ ID NO: 559308 - DNA, 25 bp, Homo sapien
ttcatcaccacatctagagtgtgac

SEQ ID NO: 559309 - DNA, 25 bp, Homo sapien
aaagtttgctttgagcttggttctt

SEQ ID NO: 559310 - DNA, 25 bp, Homo sapien
gaaaggaaattatctctgaaaagga

SEQ ID NO: 559311 - DNA, 25 bp, Homo sapien
aaattatctctgaaaaggaatggga

SEQ ID NO: 559312 - DNA, 25 bp, Homo sapien
aagatggtgaaggcctgcaggtata

SEQ ID NO: 559313 - DNA, 25 bp, Homo sapien
gaaggcctgcaggtataggtgttca

SEQ ID NO: 559314 - DNA, 25 bp, Homo sapien
aggcctgcaggtataggtgttcagc

SEQ ID NO: 559315 - DNA, 25 bp, Homo sapien
gcctgcaggtataggtgttcagcat

SEQ ID NO: 559316 - DNA, 25 bp, Homo sapien
gcaggtataggtgttcagcatgtca

SEQ ID NO: 559317 - DNA, 25 bp, Homo sapien
ggtataggtgttcagcatgtcatct

SEQ ID NO: 559318 - DNA, 25 bp, Homo sapien
gtataggtgttcagcatgtcatctg

SEQ ID NO: 559319 - DNA, 25 bp, Homo sapien
ataggtgttcagcatgtcatctgaa

SEQ ID NO: 559320 - DNA, 25 bp, Homo sapien
ggtgttcagcatgtcatctgaaata

SEQ ID NO: 559321 - DNA, 25 bp, Homo sapien
attgtccctaccccggcgagcattg

SEQ ID NO: 559322 - DNA, 25 bp, Homo sapien
gcgagcattgccctgcgaggactac

SEQ ID NO: 559323 - DNA, 25 bp, Homo sapien
gagcattgccctgcgaggactacac

SEQ ID NO: 559324 - DNA, 25 bp, Homo sapien
tgcgaggactacacccgatgcttct

SEQ ID NO: 559325 - DNA, 25 bp, Homo sapien
tcctctcttccggaggacacagcca

SEQ ID NO: 559326 - DNA, 25 bp, Homo sapien
agaagcagttcaacctcatcagcag

SEQ ID NO: 559327 - DNA, 25 bp, Homo sapien
agcagttcaacctcatcagcaggtg

SEQ ID NO: 559328 - DNA, 25 bp, Homo sapien
ttcaacctcatcagcaggtggccga

SEQ ID NO: 559329 - DNA, 25 bp, Homo sapien
aacctcatcagcaggtggccgacct

SEQ ID NO: 559330 - DNA, 25 bp, Homo sapien
cgacctgactatgggccggtcggct

SEQ ID NO: 559331 - DNA, 25 bp, Homo sapien
ggtcggctctggaccgaaccacagc

SEQ ID NO: 559332 - DNA, 25 bp, Homo sapien
tcagcatccgtatctgtaatgggaa

SEQ ID NO: 559333 - DNA, 25 bp, Homo sapien
atacaaaacctatccccaagttgag

SEQ ID NO: 559334 - DNA, 25 bp, Homo sapien
agattgtgtaaagcgcacttggcac

SEQ ID NO: 559335 - DNA, 25 bp, Homo sapien
gcgcacttggcacatgacagtcaca

SEQ ID NO: 559336 - DNA, 25 bp, Homo sapien
ttatgccagcattgtaagccctagg

SEQ ID NO: 559337 - DNA, 25 bp, Homo sapien
acagggctctggcttgtttaaccat

SEQ ID NO: 559338 - DNA, 25 bp, Homo sapien
ttgtttaaccatcgtgtctctggtc

SEQ ID NO: 559339 - DNA, 25 bp, Homo sapien
aaacctggtgtgtagggatgcctca

SEQ ID NO: 559340 - DNA, 25 bp, Homo sapien
atgcctcagtcgcttacatgttgat

SEQ ID NO: 559341 - DNA, 25 bp, Homo sapien
agtgaatcgtcggtttctttctgga

SEQ ID NO: 559342 - DNA, 25 bp, Homo sapien
ttctttctggacactgacttcaaaa

SEQ ID NO: 559343 - DNA, 25 bp, Homo sapien
gcctttgcccacaagtgcctcagtg

SEQ ID NO: 559344 - DNA, 25 bp, Homo sapien
aggagggctcaggacaatcctctat

SEQ ID NO: 559345 - DNA, 25 bp, Homo sapien
agggctcaggacaatcctctatttc

SEQ ID NO: 559346 - DNA, 25 bp, Homo sapien
gctcaggacaatcctctatttcctg

SEQ ID NO: 559347 - DNA, 25 bp, Homo sapien
tttcctcgtccaccctgggcttggg

SEQ ID NO: 559348 - DNA, 25 bp, Homo sapien
aggtttgcctgctcctacgggactg

SEQ ID NO: 559349 - DNA, 25 bp, Homo sapien
tttgcctgctcctacgggactgatt

SEQ ID NO: 559350 - DNA, 25 bp, Homo sapien
tcctacgggactgattcttctcttg

SEQ ID NO: 559351 - DNA, 25 bp, Homo sapien
acgggactgattcttctcttgccga

SEQ ID NO: 559352 - DNA, 25 bp, Homo sapien
gactgattcttctcttgccgacatg

SEQ ID NO: 559353 - DNA, 25 bp, Homo sapien
gattcttctcttgccgacatgtttt

SEQ ID NO: 559354 - DNA, 25 bp, Homo sapien
aactgggacgctgatattgctgtta

SEQ ID NO: 559355 - DNA, 25 bp, Homo sapien
gctgttagtaattcaagtcccaact

SEQ ID NO: 559356 - DNA, 25 bp, Homo sapien
agtcccaactatcaagtgattgccg

SEQ ID NO: 559357 - DNA, 25 bp, Homo sapien
gtgattgccgataatccagaaggct

SEQ ID NO: 559358 - DNA, 25 bp, Homo sapien
tccagaaggcttacttttcagatac

SEQ ID NO: 559359 - DNA, 25 bp, Homo sapien
taatgtggacccaaaggcgcagcca

SEQ ID NO: 559360 - DNA, 25 bp, Homo sapien
aggatacatcgactatgcccacagg

SEQ ID NO: 559361 - DNA, 25 bp, Homo sapien
gcagccaggtgacaactctactaga

SEQ ID NO: 559362 - DNA, 25 bp, Homo sapien
gaatcactatcctgacagaactcta

SEQ ID NO: 559363 - DNA, 25 bp, Homo sapien
atgcccacaggctaaagacggaaga

SEQ ID NO: 559364 - DNA, 25 bp, Homo sapien
ttcttccaaggcctacagatataag

SEQ ID NO: 559365 - DNA, 25 bp, Homo sapien
caaagagaggcgttcctgccaggat

SEQ ID NO: 559366 - DNA, 25 bp, Homo sapien
aaagagaggcgttcctgccaggata

SEQ ID NO: 559367 - DNA, 25 bp, Homo sapien
aagagaggcgttcctgccaggatag

SEQ ID NO: 559368 - DNA, 25 bp, Homo sapien
agagaggcgttcctgccaggatagg

SEQ ID NO: 559369 - DNA, 25 bp, Homo sapien
gagaggcgttcctgccaggataggt

SEQ ID NO: 559370 - DNA, 25 bp, Homo sapien
agaggcgttcctgccaggataggtt

SEQ ID NO: 559371 - DNA, 25 bp, Homo sapien
gaggcgttcctgccaggataggttg

SEQ ID NO: 559372 - DNA, 25 bp, Homo sapien
aggcgttcctgccaggataggttgc

SEQ ID NO: 559373 - DNA, 25 bp, Homo sapien
ggcgttcctgccaggataggttgca

SEQ ID NO: 559374 - DNA, 25 bp, Homo sapien
gcgttcctgccaggataggttgcat

SEQ ID NO: 559375 - DNA, 25 bp, Homo sapien
cgttcctgccaggataggttgcatc

SEQ ID NO: 559376 - DNA, 25 bp, Homo sapien
agagagttctgtctattccttctca

SEQ ID NO: 559377 - DNA, 25 bp, Homo sapien
ctattccttctcaaacccattatat

SEQ ID NO: 559378 - DNA, 25 bp, Homo sapien
aacccattatatggcacaacatcag

SEQ ID NO: 559379 - DNA, 25 bp, Homo sapien
tggagaccctgtcacatcatctcaa

SEQ ID NO: 559380 - DNA, 25 bp, Homo sapien
acatcatctcaaatagcagcatcga

SEQ ID NO: 559381 - DNA, 25 bp, Homo sapien
ccaagtctgatccaacatgtgtagt

SEQ ID NO: 559382 - DNA, 25 bp, Homo sapien
atccaacatgtgtagtttctagaaa

SEQ ID NO: 559383 - DNA, 25 bp, Homo sapien
gtttctagaaaattgaagtctccac

SEQ ID NO: 559384 - DNA, 25 bp, Homo sapien
gaagtctccacaatctgatagaaac

SEQ ID NO: 559385 - DNA, 25 bp, Homo sapien
gaagtggtaactgtgcctttgtcaa

SEQ ID NO: 559386 - DNA, 25 bp, Homo sapien
gtgcctttgtcaatccagtttacgg

SEQ ID NO: 559387 - DNA, 25 bp, Homo sapien
tggacggccccatccggacgctgaa

SEQ ID NO: 559388 - DNA, 25 bp, Homo sapien
catccggacgctgaagctgccgttg

SEQ ID NO: 559389 - DNA, 25 bp, Homo sapien
gaagctgccgttgccgcgtgtggag

SEQ ID NO: 559390 - DNA, 25 bp, Homo sapien
tgcagcgctactttctgccagcgga

SEQ ID NO: 559391 - DNA, 25 bp, Homo sapien
agcgctactttctgccagcggacgc

SEQ ID NO: 559392 - DNA, 25 bp, Homo sapien
gctactttctgccagcggacgcgga

SEQ ID NO: 559393 - DNA, 25 bp, Homo sapien
ttctgccagcggacgcggaccctga

SEQ ID NO: 559394 - DNA, 25 bp, Homo sapien
gaccctgacacctacagctgaccgg

SEQ ID NO: 559395 - DNA, 25 bp, Homo sapien
gccaaggcctgcatcgggaataaag

SEQ ID NO: 559396 - DNA, 25 bp, Homo sapien
ccaaggcctgcatcgggaataaagt

SEQ ID NO: 559397 - DNA, 25 bp, Homo sapien
aggcctgcatcgggaataaagtcca

SEQ ID NO: 559398 - DNA, 25 bp, Homo sapien
tgacaagcgctactgtctccgggct

SEQ ID NO: 559399 - DNA, 25 bp, Homo sapien
agcgctactgtctccgggctacaga

SEQ ID NO: 559400 - DNA, 25 bp, Homo sapien
tctccgggctacagaggacactgga

SEQ ID NO: 559401 - DNA, 25 bp, Homo sapien
gggctacagaggacactggagctca

SEQ ID NO: 559402 - DNA, 25 bp, Homo sapien
ggagctcagagctggacaaccggcc

SEQ ID NO: 559403 - DNA, 25 bp, Homo sapien
tcagagctggacaaccggcccaggc

SEQ ID NO: 559404 - DNA, 25 bp, Homo sapien
agcaggccgtctgccgcactctggg

SEQ ID NO: 559405 - DNA, 25 bp, Homo sapien
tgggactggagcaactgggactctc

SEQ ID NO: 559406 - DNA, 25 bp, Homo sapien
gactggagcaactgggactctcctg

SEQ ID NO: 559407 - DNA, 25 bp, Homo sapien
ggagcaactgggactctcctggctg

SEQ ID NO: 559408 - DNA, 25 bp, Homo sapien
aactgggactctcctggctgctgac

SEQ ID NO: 559409 - DNA, 25 bp, Homo sapien
ttgagtatcctagaggcacttgccc

SEQ ID NO: 559410 - DNA, 25 bp, Homo sapien
ggagtgatttgtgttcttagaagcc

SEQ ID NO: 559411 - DNA, 25 bp, Homo sapien
tgtgttcttagaagcctcatcttcc

SEQ ID NO: 559412 - DNA, 25 bp, Homo sapien
agtccattgagtcaagaaccttgtc

SEQ ID NO: 559413 - DNA, 25 bp, Homo sapien
gaaccttgtcttcttaatgtatgta

SEQ ID NO: 559414 - DNA, 25 bp, Homo sapien
catttactgtatgaacttgctttac

SEQ ID NO: 559415 - DNA, 25 bp, Homo sapien
cttgctttactatggtaagccctga

SEQ ID NO: 559416 - DNA, 25 bp, Homo sapien
tggtaagccctgacaaatgattgat

SEQ ID NO: 559417 - DNA, 25 bp, Homo sapien
aagaaagacggcctggcttccatga

SEQ ID NO: 559418 - DNA, 25 bp, Homo sapien
atatgtcttacgtactctgcaaaaa

SEQ ID NO: 559419 - DNA, 25 bp, Homo sapien
ctgcaaaaatccttattgagagttt

SEQ ID NO: 559420 - DNA, 25 bp, Homo sapien
ccaccaagggcaaagcagcccaggt

SEQ ID NO: 559421 - DNA, 25 bp, Homo sapien
cagcccaggtggtgattaggaacag

SEQ ID NO: 559422 - DNA, 25 bp, Homo sapien
aattttcacagaagacgggtcacgc

SEQ ID NO: 559423 - DNA, 25 bp, Homo sapien
ttttcacagaagacgggtcacgctg

SEQ ID NO: 559424 - DNA, 25 bp, Homo sapien
tgttgaggacccacagattgggcgc

SEQ ID NO: 559425 - DNA, 25 bp, Homo sapien
aggacccacagattgggcgccgaga

SEQ ID NO: 559426 - DNA, 25 bp, Homo sapien
tcccagttacccgaagctcaggtgg

SEQ ID NO: 559427 - DNA, 25 bp, Homo sapien
agctcaggtggccttcttgcaggtc

SEQ ID NO: 559428 - DNA, 25 bp, Homo sapien
gtggccttcttgcaggtccccgtag

SEQ ID NO: 559429 - DNA, 25 bp, Homo sapien
cgtagcacctgagcctgtacctggg

SEQ ID NO: 559430 - DNA, 25 bp, Homo sapien
ttgttatgctatcctgtgctagccg

SEQ ID NO: 559431 - DNA, 25 bp, Homo sapien
acagcaggactcctgtgcgctgagc

SEQ ID NO: 559432 - DNA, 25 bp, Homo sapien
tgcgctgagctgagcactgtggttt

SEQ ID NO: 559433 - DNA, 25 bp, Homo sapien
gctgagcactgtggtttttgttatt

SEQ ID NO: 559434 - DNA, 25 bp, Homo sapien
attttgttttagatctcctctggca

SEQ ID NO: 559435 - DNA, 25 bp, Homo sapien
tctcctctggcaaacacgacatata

SEQ ID NO: 559436 - DNA, 25 bp, Homo sapien
gaatttcacagatgacaacccttac

SEQ ID NO: 559437 - DNA, 25 bp, Homo sapien
acatggtggcacaattctgaagaaa

SEQ ID NO: 559438 - DNA, 25 bp, Homo sapien
acaacccttactgatgggaagcaga

SEQ ID NO: 559439 - DNA, 25 bp, Homo sapien
ggaagcagaatcctcacgctgggaa

SEQ ID NO: 559440 - DNA, 25 bp, Homo sapien
gaatcctcacgctgggaagcgtcag

SEQ ID NO: 559441 - DNA, 25 bp, Homo sapien
tgcccagcgagtagacagcaggact

SEQ ID NO: 559442 - DNA, 25 bp, Homo sapien
attgtgtaatactaccttagaggac

SEQ ID NO: 559443 - DNA, 25 bp, Homo sapien
tactaccttagaggacagcagttcc

SEQ ID NO: 559444 - DNA, 25 bp, Homo sapien
gacagcagttcctaatacctacttt

SEQ ID NO: 559445 - DNA, 25 bp, Homo sapien
gcagttcctaatacctacttttatt

SEQ ID NO: 559446 - DNA, 25 bp, Homo sapien
ctacttttattatgagtctctgcca

SEQ ID NO: 559447 - DNA, 25 bp, Homo sapien
gtctctgccatttataaagaactgt

SEQ ID NO: 559448 - DNA, 25 bp, Homo sapien
actctggtgcagcttgaatcttggt

SEQ ID NO: 559449 - DNA, 25 bp, Homo sapien
ggtagcaaaacagtgacttcatcag

SEQ ID NO: 559450 - DNA, 25 bp, Homo sapien
gaaaattttgtcactctctattaga

SEQ ID NO: 559451 - DNA, 25 bp, Homo sapien
aaaactcttgtattactatgtgata

SEQ ID NO: 559452 - DNA, 25 bp, Homo sapien
gtgataacacagatctttacaactt

SEQ ID NO: 559453 - DNA, 25 bp, Homo sapien
actcctcaaatacaccactcaggtg

SEQ ID NO: 559454 - DNA, 25 bp, Homo sapien
accactcaggtgaccattaaatcat

SEQ ID NO: 559455 - DNA, 25 bp, Homo sapien
aaatcatttacattgttcctccctg

SEQ ID NO: 559456 - DNA, 25 bp, Homo sapien
tttacattgttcctccctgtctcca

SEQ ID NO: 559457 - DNA, 25 bp, Homo sapien
atggccatctcataggtgcccctgg

SEQ ID NO: 559458 - DNA, 25 bp, Homo sapien
ccatctcataggtgcccctggagtt

SEQ ID NO: 559459 - DNA, 25 bp, Homo sapien
gtggcctacctcaagaactaaaaca

SEQ ID NO: 559460 - DNA, 25 bp, Homo sapien
gaaggaatttgttctcaagcttatg

SEQ ID NO: 559461 - DNA, 25 bp, Homo sapien
tgttctcaagcttatggataccggc

SEQ ID NO: 559462 - DNA, 25 bp, Homo sapien
agcttatggataccggctgcctcga

SEQ ID NO: 559463 - DNA, 25 bp, Homo sapien
cggtcccaaatcttcctatagtgag

SEQ ID NO: 559464 - DNA, 25 bp, Homo sapien
cccaatccgagcatttcctggagtg

SEQ ID NO: 559465 - DNA, 25 bp, Homo sapien
atttcctggagtgctcgccacattc

SEQ ID NO: 559466 - DNA, 25 bp, Homo sapien
cttcctggtgcttttctatggtggg

SEQ ID NO: 559467 - DNA, 25 bp, Homo sapien
aaaaagagagctccttctggctcct

SEQ ID NO: 559468 - DNA, 25 bp, Homo sapien
gggaggccttgttttgaacatcgct

SEQ ID NO: 559469 - DNA, 25 bp, Homo sapien
tttgaacatcgctgtgacgtcactc

SEQ ID NO: 559470 - DNA, 25 bp, Homo sapien
tccgagctaagcacccctcggtggg

SEQ ID NO: 559471 - DNA, 25 bp, Homo sapien
cctgggaattgttgcgcggcctgct

SEQ ID NO: 559472 - DNA, 25 bp, Homo sapien
tctggctcctggtgacccatattta

SEQ ID NO: 559473 - DNA, 25 bp, Homo sapien
tgacccatatttaggacaccatccc

SEQ ID NO: 559474 - DNA, 25 bp, Homo sapien
acacattcctacagtgtcacctggt

SEQ ID NO: 559475 - DNA, 25 bp, Homo sapien
agctcaggtggccttcttgcaggtc

SEQ ID NO: 559476 - DNA, 25 bp, Homo sapien
gctcaggtggccttcttgcaggtcc

SEQ ID NO: 559477 - DNA, 25 bp, Homo sapien
ctcaggtggccttcttgcaggtccc

SEQ ID NO: 559478 - DNA, 25 bp, Homo sapien
tcaggtggccttcttgcaggtcccc

SEQ ID NO: 559479 - DNA, 25 bp, Homo sapien
caggtggccttcttgcaggtccccg

SEQ ID NO: 559480 - DNA, 25 bp, Homo sapien
aggtggccttcttgcaggtccccgt

SEQ ID NO: 559481 - DNA, 25 bp, Homo sapien
ggtggccttcttgcaggtccccgta

SEQ ID NO: 559482 - DNA, 25 bp, Homo sapien
gtggccttcttgcaggtccccgtag

SEQ ID NO: 559483 - DNA, 25 bp, Homo sapien
tggccttcttgcaggtccccgtagc

SEQ ID NO: 559484 - DNA, 25 bp, Homo sapien
ggccttcttgcaggtccccgtagca

SEQ ID NO: 559485 - DNA, 25 bp, Homo sapien
gccttcttgcaggtccccgtagcac

SEQ ID NO: 559486 - DNA, 25 bp, Homo sapien
ctgccaagctctaggacagtcctgg

SEQ ID NO: 559487 - DNA, 25 bp, Homo sapien
catgtctgtgactgcaccagggtga

SEQ ID NO: 559488 - DNA, 25 bp, Homo sapien
cagggtgagcctgcctcggtgtcct

SEQ ID NO: 559489 - DNA, 25 bp, Homo sapien
acctatgagagaaggctgccgggtt

SEQ ID NO: 559490 - DNA, 25 bp, Homo sapien
cattctgccaggtagagggcagcat

SEQ ID NO: 559491 - DNA, 25 bp, Homo sapien
agggcagcatctcatgtgaccaggc

SEQ ID NO: 559492 - DNA, 25 bp, Homo sapien
agatgatggctgtgctctcggagag

SEQ ID NO: 559493 - DNA, 25 bp, Homo sapien
ctctcggagagtgtgactgagcctc

SEQ ID NO: 559494 - DNA, 25 bp, Homo sapien
tgtgactgagcctcccgagggctgc

SEQ ID NO: 559495 - DNA, 25 bp, Homo sapien
agggcgagagagtcagtccagcaat

SEQ ID NO: 559496 - DNA, 25 bp, Homo sapien
agagagtcagtccagcaatcagaag

SEQ ID NO: 559497 - DNA, 25 bp, Homo sapien
gagtaaattgcccttatgagagcct

SEQ ID NO: 559498 - DNA, 25 bp, Homo sapien
tatgagagccttgcatctgtccaaa

SEQ ID NO: 559499 - DNA, 25 bp, Homo sapien
ggccctggagaaatgcagagatgca

SEQ ID NO: 559500 - DNA, 25 bp, Homo sapien
gtccatcagggtgtccagtttcaat

SEQ ID NO: 559501 - DNA, 25 bp, Homo sapien
ggaactgatcctcagacaagccagg

SEQ ID NO: 559502 - DNA, 25 bp, Homo sapien
ggaggaatgctgtctaggctatagt

SEQ ID NO: 559503 - DNA, 25 bp, Homo sapien
tctaggctatagtgactctcttgga

SEQ ID NO: 559504 - DNA, 25 bp, Homo sapien
actctcttggaggtaatagctgcaa

SEQ ID NO: 559505 - DNA, 25 bp, Homo sapien
atagctgcaagaactctcccaacag

SEQ ID NO: 559506 - DNA, 25 bp, Homo sapien
ctcccaacagggacttctgtgcaaa

SEQ ID NO: 559507 - DNA, 25 bp, Homo sapien
ggacttctgtgcaaaaggctgagta

SEQ ID NO: 559508 - DNA, 25 bp, Homo sapien
agtttgacatcgactgcgggcgcct

SEQ ID NO: 559509 - DNA, 25 bp, Homo sapien
tgcgggcgcctgagcagcattccca

SEQ ID NO: 559510 - DNA, 25 bp, Homo sapien
gcattcccacggctgtcttcgagat

SEQ ID NO: 559511 - DNA, 25 bp, Homo sapien
ctgtcttcgagatccacggcaagaa

SEQ ID NO: 559512 - DNA, 25 bp, Homo sapien
agcatgctcacgctgagggccattg

SEQ ID NO: 559513 - DNA, 25 bp, Homo sapien
agggcttctgcaccagtggtttcca

SEQ ID NO: 559514 - DNA, 25 bp, Homo sapien
tggtttccagggtgactatagttcc

SEQ ID NO: 559515 - DNA, 25 bp, Homo sapien
ctatagttcccagcagtggatcctg

SEQ ID NO: 559516 - DNA, 25 bp, Homo sapien
gtcttcatctgggagtattacagtg

SEQ ID NO: 559517 - DNA, 25 bp, Homo sapien
gagggccattgatctgtcgtactac

SEQ ID NO: 559518 - DNA, 25 bp, Homo sapien
tgatctgtcgtactacacaggctcc

SEQ ID NO: 559519 - DNA, 25 bp, Homo sapien
tgccatttagactggccttgtcatg

SEQ ID NO: 559520 - DNA, 25 bp, Homo sapien
atttagactggccttgtcatgttgc

SEQ ID NO: 559521 - DNA, 25 bp, Homo sapien
tagactggccttgtcatgttgccca

SEQ ID NO: 559522 - DNA, 25 bp, Homo sapien
tggcgtcgggactcctgggctcatt

SEQ ID NO: 559523 - DNA, 25 bp, Homo sapien
gtcgggactcctgggctcattcgat

SEQ ID NO: 559524 - DNA, 25 bp, Homo sapien
ctcctgcatcagctagaactacagt

SEQ ID NO: 559525 - DNA, 25 bp, Homo sapien
gcatcagctagaactacagtagttt

SEQ ID NO: 559526 - DNA, 25 bp, Homo sapien
gagagtatcttatttgagttgttgt

SEQ ID NO: 559527 - DNA, 25 bp, Homo sapien
ttgttgttttcagtaatgctgtcaa

SEQ ID NO: 559528 - DNA, 25 bp, Homo sapien
tcagtaatgctgtcaagtattgtta

SEQ ID NO: 559529 - DNA, 25 bp, Homo sapien
gtcaagtattgttagagggtgataa

SEQ ID NO: 559530 - DNA, 25 bp, Homo sapien
ggatgacaaagcatatcgtaatatc

SEQ ID NO: 559531 - DNA, 25 bp, Homo sapien
acagagctctcttctttacttaaca

SEQ ID NO: 559532 - DNA, 25 bp, Homo sapien
agctctcttctttacttaacactag

SEQ ID NO: 559533 - DNA, 25 bp, Homo sapien
taaaggatcttcatgcagatcatgc

SEQ ID NO: 559534 - DNA, 25 bp, Homo sapien
gatcatgctgcaagtcatattggaa

SEQ ID NO: 559535 - DNA, 25 bp, Homo sapien
agcacaaggcattgtcacttgcttg

SEQ ID NO: 559536 - DNA, 25 bp, Homo sapien
aggcattgtcacttgcttgagagca

SEQ ID NO: 559537 - DNA, 25 bp, Homo sapien
gcttgagagcaacaccatatcatgg

SEQ ID NO: 559538 - DNA, 25 bp, Homo sapien
gcaacaccatatcatgggagcagaa

SEQ ID NO: 559539 - DNA, 25 bp, Homo sapien
aagaaaggtgttccttcccatggat

SEQ ID NO: 559540 - DNA, 25 bp, Homo sapien
tcccatggatatttgtatgctgcat

SEQ ID NO: 559541 - DNA, 25 bp, Homo sapien
tcctttctttagaagcccctgccag

SEQ ID NO: 559542 - DNA, 25 bp, Homo sapien
gaacacatctcagcggtggtgacta

SEQ ID NO: 559543 - DNA, 25 bp, Homo sapien
agctctctgctgattgctgttcctc

SEQ ID NO: 559544 - DNA, 25 bp, Homo sapien
ccagtctgtggaagctttgcccata

SEQ ID NO: 559545 - DNA, 25 bp, Homo sapien
tgtggaagctttgcccatatgcttt

SEQ ID NO: 559546 - DNA, 25 bp, Homo sapien
atctcagcggtggtgactagtcctc

SEQ ID NO: 559547 - DNA, 25 bp, Homo sapien
agcggtggtgactagtcctcggatt

SEQ ID NO: 559548 - DNA, 25 bp, Homo sapien
aggacaacgccttttccttgtgtct

SEQ ID NO: 559549 - DNA, 25 bp, Homo sapien
tggtgactagtcctcggatttcctg

SEQ ID NO: 559550 - DNA, 25 bp, Homo sapien
ggatttcctgccatggtgctgccat

SEQ ID NO: 559551 - DNA, 25 bp, Homo sapien
taggctgttcctgctgcaccgaacg

SEQ ID NO: 559552 - DNA, 25 bp, Homo sapien
tgccttaacttcctggagccaccag

SEQ ID NO: 559553 - DNA, 25 bp, Homo sapien
ttaacttcctggagccaccagcctg

SEQ ID NO: 559554 - DNA, 25 bp, Homo sapien
tggagccaccagcctggtgagccat

SEQ ID NO: 559555 - DNA, 25 bp, Homo sapien
tctgcctgccaccaaggtcctgtgg

SEQ ID NO: 559556 - DNA, 25 bp, Homo sapien
cagtggtacggcctgcggcagggtg

SEQ ID NO: 559557 - DNA, 25 bp, Homo sapien
gcggcagggtggcactccggccagc

SEQ ID NO: 559558 - DNA, 25 bp, Homo sapien
tgcccttcccctgacacatgaacag

SEQ ID NO: 559559 - DNA, 25 bp, Homo sapien
acatgaacagatgccttaacttcct

SEQ ID NO: 559560 - DNA, 25 bp, Homo sapien
gaacagatgccttaacttcctggag

SEQ ID NO: 559561 - DNA, 25 bp, Homo sapien
acagatgccttaacttcctggagcc

SEQ ID NO: 559562 - DNA, 25 bp, Homo sapien
agatgccttaacttcctggagccac

SEQ ID NO: 559563 - DNA, 25 bp, Homo sapien
tcgcacttcaactggccggtgcagg

SEQ ID NO: 559564 - DNA, 25 bp, Homo sapien
ggtgcagggcgccaactaccacgtc

SEQ ID NO: 559565 - DNA, 25 bp, Homo sapien
ttcatcaagtaccactgctccaagg

SEQ ID NO: 559566 - DNA, 25 bp, Homo sapien
actgctccaaggctccctggcagga

SEQ ID NO: 559567 - DNA, 25 bp, Homo sapien
cctcggaggtgctgacgcggcatct

SEQ ID NO: 559568 - DNA, 25 bp, Homo sapien
ggcagaaccgcttcttcacggcgct

SEQ ID NO: 559569 - DNA, 25 bp, Homo sapien
tcttcacggcgctcaaggtcgtcaa

SEQ ID NO: 559570 - DNA, 25 bp, Homo sapien
gctcaaggtcgtcaacctcggtatt

SEQ ID NO: 559571 - DNA, 25 bp, Homo sapien
gtcaacctcggtattccaactttat

SEQ ID NO: 559572 - DNA, 25 bp, Homo sapien
ttatatggacttggctcctggttat

SEQ ID NO: 559573 - DNA, 25 bp, Homo sapien
tgctgacgcggcatctgctgcagcg

SEQ ID NO: 559574 - DNA, 25 bp, Homo sapien
gaatatgggattcttccttggcctt

SEQ ID NO: 559575 - DNA, 25 bp, Homo sapien
ggcatctttttcatacacctcaggg

SEQ ID NO: 559576 - DNA, 25 bp, Homo sapien
gctgcactgcgaatctgactgttaa

SEQ ID NO: 559577 - DNA, 25 bp, Homo sapien
aatcttcctcatttctattatcttg

SEQ ID NO: 559578 - DNA, 25 bp, Homo sapien
tagcttattactttctggcattcac

SEQ ID NO: 559579 - DNA, 25 bp, Homo sapien
tttctggcattcacacaagtcactg

SEQ ID NO: 559580 - DNA, 25 bp, Homo sapien
aagtcactgaaaactattgcagaag

SEQ ID NO: 559581 - DNA, 25 bp, Homo sapien
gttaagaatttcaaagacccagaga

SEQ ID NO: 559582 - DNA, 25 bp, Homo sapien
aaatgttactgtgtgcctttctagt

SEQ ID NO: 559583 - DNA, 25 bp, Homo sapien
gcctttctagtggtcacaggctgac

SEQ ID NO: 559584 - DNA, 25 bp, Homo sapien
gctgaccaccctccgtgaatatggg

SEQ ID NO: 559585 - DNA, 25 bp, Homo sapien
agacatgccatctaccgtcattatg

SEQ ID NO: 559586 - DNA, 25 bp, Homo sapien
accgtcattatgcaaggaccagcaa

SEQ ID NO: 559587 - DNA, 25 bp, Homo sapien
gagaatgagacttctgcagtttgtt

SEQ ID NO: 559588 - DNA, 25 bp, Homo sapien
agtttgttactggaacctgccgatt

SEQ ID NO: 559589 - DNA, 25 bp, Homo sapien
ggaacctgccgattgccagtaggag

SEQ ID NO: 559590 - DNA, 25 bp, Homo sapien
ccgattgccagtaggaggatttgct

SEQ ID NO: 559591 - DNA, 25 bp, Homo sapien
gggagcaatggaccacagaaattct

SEQ ID NO: 559592 - DNA, 25 bp, Homo sapien
gaaaattggctacccagaagtcata

SEQ ID NO: 559593 - DNA, 25 bp, Homo sapien
ggctacccagaagtcatacctgttt

SEQ ID NO: 559594 - DNA, 25 bp, Homo sapien
ggacctgccaccatacaagagctat

SEQ ID NO: 559595 - DNA, 25 bp, Homo sapien
gaaggaaaagctgttgtttgccata

SEQ ID NO: 559596 - DNA, 25 bp, Homo sapien
agaccgccaatgtggtgccagtaca

SEQ ID NO: 559597 - DNA, 25 bp, Homo sapien
gccagtacagaggacttgcaatctt

SEQ ID NO: 559598 - DNA, 25 bp, Homo sapien
gcaatcttgtgactcctgtatctat

SEQ ID NO: 559599 - DNA, 25 bp, Homo sapien
ctatttctggagtttacccttctga

SEQ ID NO: 559600 - DNA, 25 bp, Homo sapien
acaagccatggcatcagaccacagt

SEQ ID NO: 559601 - DNA, 25 bp, Homo sapien
agaccacagttcctgcattggctac

SEQ ID NO: 559602 - DNA, 25 bp, Homo sapien
attggctaccaaccaggctgttcct

SEQ ID NO: 559603 - DNA, 25 bp, Homo sapien
gctcagagtattctcgagcttccca

SEQ ID NO: 559604 - DNA, 25 bp, Homo sapien
ttcccacctctgaaagcgaatcaaa

SEQ ID NO: 559605 - DNA, 25 bp, Homo sapien
ttcaattgaatctgagcctcaccaa

SEQ ID NO: 559606 - DNA, 25 bp, Homo sapien
accaacatcattctttgcacacatg

SEQ ID NO: 559607 - DNA, 25 bp, Homo sapien
agatgggactgcaatttcctggcca

SEQ ID NO: 559608 - DNA, 25 bp, Homo sapien
gactgcaatttcctggccatttgag

SEQ ID NO: 559609 - DNA, 25 bp, Homo sapien
caatttcctggccatttgagcacca

SEQ ID NO: 559610 - DNA, 25 bp, Homo sapien
tgagcaccagacaagatctacgctt

SEQ ID NO: 559611 - DNA, 25 bp, Homo sapien
gatctacgcttatcaaaattgccaa

SEQ ID NO: 559612 - DNA, 25 bp, Homo sapien
aattgccaagccagcaaagtctatg

SEQ ID NO: 559613 - DNA, 25 bp, Homo sapien
taggactccctctccatttcttgga

SEQ ID NO: 559614 - DNA, 25 bp, Homo sapien
atttcttggagcactgtgcgtcttc

SEQ ID NO: 559615 - DNA, 25 bp, Homo sapien
tcttgtaaaatctcctctttgctct

SEQ ID NO: 559616 - DNA, 25 bp, Homo sapien
taaaatctcctctttgctcttcagt

SEQ ID NO: 559617 - DNA, 25 bp, Homo sapien
tcctctttgctcttcagtaccatag

SEQ ID NO: 559618 - DNA, 25 bp, Homo sapien
gaatttcccagacattcagatttct

SEQ ID NO: 559619 - DNA, 25 bp, Homo sapien
aaatctgacagtataaaccctatta

SEQ ID NO: 559620 - DNA, 25 bp, Homo sapien
aaccctattatattcctgcatggca

SEQ ID NO: 559621 - DNA, 25 bp, Homo sapien
ggcataaaatcttcagttgctgaat

SEQ ID NO: 559622 - DNA, 25 bp, Homo sapien
gttgctgaatggtgatatccacttt

SEQ ID NO: 559623 - DNA, 25 bp, Homo sapien
gaaagagtactctaccctgttctgc

SEQ ID NO: 559624 - DNA, 25 bp, Homo sapien
tctaccctgttctgcattcatacaa

SEQ ID NO: 559625 - DNA, 25 bp, Homo sapien
tgcattcatacaacctaagccaacc

SEQ ID NO: 559626 - DNA, 25 bp, Homo sapien
atactgcatttagtctataggcttg

SEQ ID NO: 559627 - DNA, 25 bp, Homo sapien
tataggcttgttttgtttggcccac

SEQ ID NO: 559628 - DNA, 25 bp, Homo sapien
tttggcccacaaagcattttattat

SEQ ID NO: 559629 - DNA, 25 bp, Homo sapien
gtggaataaagtcattcacaccaag

SEQ ID NO: 559630 - DNA, 25 bp, Homo sapien
ttcacaccaagacatgccattacgg

SEQ ID NO: 559631 - DNA, 25 bp, Homo sapien
gacatgccattacggcttggtataa

SEQ ID NO: 559632 - DNA, 25 bp, Homo sapien
gatagtctatcatgctccagagtct

SEQ ID NO: 559633 - DNA, 25 bp, Homo sapien
gctccagagtctgtggccattatac

SEQ ID NO: 559634 - DNA, 25 bp, Homo sapien
cattatacacagttagtttgggcca

SEQ ID NO: 559635 - DNA, 25 bp, Homo sapien
gtttgggccaattcattttatgtcg

SEQ ID NO: 559636 - DNA, 25 bp, Homo sapien
attttatgtcggttgtgcagttgca

SEQ ID NO: 559637 - DNA, 25 bp, Homo sapien
gtgcagttgcaatgtgtcctaacct

SEQ ID NO: 559638 - DNA, 25 bp, Homo sapien
agttgcaatgtgtcctaaccttggg

SEQ ID NO: 559639 - DNA, 25 bp, Homo sapien
gggagcttcaactgcaatatttgta

SEQ ID NO: 559640 - DNA, 25 bp, Homo sapien
tggtccttggcgaccatctgggacg

SEQ ID NO: 559641 - DNA, 25 bp, Homo sapien
attgtccctaccccggcgagcattg

SEQ ID NO: 559642 - DNA, 25 bp, Homo sapien
gcgagcattgccctgcgaggactac

SEQ ID NO: 559643 - DNA, 25 bp, Homo sapien
tgcgaggactacacccgatgcttct

SEQ ID NO: 559644 - DNA, 25 bp, Homo sapien
cgccgccgctgccttgaagaagcag

SEQ ID NO: 559645 - DNA, 25 bp, Homo sapien
tcttccggaggacacagccagcctg

SEQ ID NO: 559646 - DNA, 25 bp, Homo sapien
agaagcagttcaacctcatcagcag

SEQ ID NO: 559647 - DNA, 25 bp, Homo sapien
agttcaacctcatcagcaggtggcc

SEQ ID NO: 559648 - DNA, 25 bp, Homo sapien
aacctcatcagcaggtggccgacct

SEQ ID NO: 559649 - DNA, 25 bp, Homo sapien
cgacctgactatgggccggtcggct

SEQ ID NO: 559650 - DNA, 25 bp, Homo sapien
ggtcggctctggaccgaaccacagc

SEQ ID NO: 559651 - DNA, 25 bp, Homo sapien
agatttcttaaagcgtgttctacca

SEQ ID NO: 559652 - DNA, 25 bp, Homo sapien
gtgttctaccagtattcaacctctg

SEQ ID NO: 559653 - DNA, 25 bp, Homo sapien
tctttttaccgtatgtccccagaat

SEQ ID NO: 559654 - DNA, 25 bp, Homo sapien
tcttcttcctcgatcatatagagca

SEQ ID NO: 559655 - DNA, 25 bp, Homo sapien
ctcgatcatatagagcatatctgct

SEQ ID NO: 559656 - DNA, 25 bp, Homo sapien
aagcccttcttcagacctatcattg

SEQ ID NO: 559657 - DNA, 25 bp, Homo sapien
ttcttcagacctatcattgcacatc

SEQ ID NO: 559658 - DNA, 25 bp, Homo sapien
gacctatcattgcacatctgaaacc

SEQ ID NO: 559659 - DNA, 25 bp, Homo sapien
gaaaccaatcaaggtacccctcata

SEQ ID NO: 559660 - DNA, 25 bp, Homo sapien
tcaaggtacccctcataaaccaaag

SEQ ID NO: 559661 - DNA, 25 bp, Homo sapien
aaccaaaggaccacctgagactgct

SEQ ID NO: 559662 - DNA, 25 bp, Homo sapien
tgcagtggagaggaggtcttccagc

SEQ ID NO: 559663 - DNA, 25 bp, Homo sapien
tggagggctgagaatgaacctgact

SEQ ID NO: 559664 - DNA, 25 bp, Homo sapien
gggctgagaatgaacctgactagag

SEQ ID NO: 559665 - DNA, 25 bp, Homo sapien
tgactagaggttctggagataccca

SEQ ID NO: 559666 - DNA, 25 bp, Homo sapien
gttctggagatacccagaggtcccc

SEQ ID NO: 559667 - DNA, 25 bp, Homo sapien
ccaggtcatcacttggctcagtgga

SEQ ID NO: 559668 - DNA, 25 bp, Homo sapien
aggtcatcacttggctcagtggaag

SEQ ID NO: 559669 - DNA, 25 bp, Homo sapien
atcacttggctcagtggaagccctc

SEQ ID NO: 559670 - DNA, 25 bp, Homo sapien
acttggctcagtggaagccctcttt

SEQ ID NO: 559671 - DNA, 25 bp, Homo sapien
cagtggaagccctctttccccaaat

SEQ ID NO: 559672 - DNA, 25 bp, Homo sapien
aagacagtttccttgaaatcaataa

SEQ ID NO: 559673 - DNA, 25 bp, Homo sapien
aaccaacctacacagcgttatccag

SEQ ID NO: 559674 - DNA, 25 bp, Homo sapien
tccgagagaagccatgagagacaag

SEQ ID NO: 559675 - DNA, 25 bp, Homo sapien
gagagaagccatgagagacaagtct

SEQ ID NO: 559676 - DNA, 25 bp, Homo sapien
aagtagaccttccagagccccagtt

SEQ ID NO: 559677 - DNA, 25 bp, Homo sapien
cttccagagccccagtttgtaaatg

SEQ ID NO: 559678 - DNA, 25 bp, Homo sapien
tccagagccccagtttgtaaatgaa

SEQ ID NO: 559679 - DNA, 25 bp, Homo sapien
gagccccagtttgtaaatgaacctg

SEQ ID NO: 559680 - DNA, 25 bp, Homo sapien
gtttgtaaatgaacctgtgtcacat

SEQ ID NO: 559681 - DNA, 25 bp, Homo sapien
aaagccctggttgactctgacagcc

SEQ ID NO: 559682 - DNA, 25 bp, Homo sapien
tggttgactctgacagccccgtggg

SEQ ID NO: 559683 - DNA, 25 bp, Homo sapien
gttgactctgacagccccgtgggtg

SEQ ID NO: 559684 - DNA, 25 bp, Homo sapien
acacgcgcgcacacgtgtgcacgca

SEQ ID NO: 559685 - DNA, 25 bp, Homo sapien
cacgcgcgcacacgtgtgcacgcac

SEQ ID NO: 559686 - DNA, 25 bp, Homo sapien
caaagagaggcgttcctgccaggat

SEQ ID NO: 559687 - DNA, 25 bp, Homo sapien
aaagagaggcgttcctgccaggata

SEQ ID NO: 559688 - DNA, 25 bp, Homo sapien
aagagaggcgttcctgccaggatag

SEQ ID NO: 559689 - DNA, 25 bp, Homo sapien
agagaggcgttcctgccaggatagg

SEQ ID NO: 559690 - DNA, 25 bp, Homo sapien
gagaggcgttcctgccaggataggt

SEQ ID NO: 559691 - DNA, 25 bp, Homo sapien
agaggcgttcctgccaggataggtt

SEQ ID NO: 559692 - DNA, 25 bp, Homo sapien
ggcgttcctgccaggataggttgca

SEQ ID NO: 559693 - DNA, 25 bp, Homo sapien
gcgttcctgccaggataggttgcat

SEQ ID NO: 559694 - DNA, 25 bp, Homo sapien
cgttcctgccaggataggttgcatc

SEQ ID NO: 559695 - DNA, 25 bp, Homo sapien
aatcacttgtttagatacaacttta

SEQ ID NO: 559696 - DNA, 25 bp, Homo sapien
gaatgtgtgactatgtatacagaaa

SEQ ID NO: 559697 - DNA, 25 bp, Homo sapien
gaaaatagactaaaatgtgcagcaa

SEQ ID NO: 559698 - DNA, 25 bp, Homo sapien
atatactgtaatctggtttttgaag

SEQ ID NO: 559699 - DNA, 25 bp, Homo sapien
tgaagtatctactattctggaatat

SEQ ID NO: 559700 - DNA, 25 bp, Homo sapien
aaaaggtgccttgattcagttgcgt

SEQ ID NO: 559701 - DNA, 25 bp, Homo sapien
aggtgccttgattcagttgcgtgac

SEQ ID NO: 559702 - DNA, 25 bp, Homo sapien
gccttgattcagttgcgtgacttag

SEQ ID NO: 559703 - DNA, 25 bp, Homo sapien
gattcagttgcgtgacttagaacat

SEQ ID NO: 559704 - DNA, 25 bp, Homo sapien
gcgtgacttagaacattcatcctat

SEQ ID NO: 559705 - DNA, 25 bp, Homo sapien
gacttagaacattcatcctatttta

SEQ ID NO: 559706 - DNA, 25 bp, Homo sapien
gtttaaatgagtacccattgacaat

SEQ ID NO: 559707 - DNA, 25 bp, Homo sapien
tgagtacccattgacaattatcatt

SEQ ID NO: 559708 - DNA, 25 bp, Homo sapien
gacaattatcatttaatagtgcagt

SEQ ID NO: 559709 - DNA, 25 bp, Homo sapien
tcatttaatagtgcagttaagttca

SEQ ID NO: 559710 - DNA, 25 bp, Homo sapien
aatgtattcatagccgattgtgagc

SEQ ID NO: 559711 - DNA, 25 bp, Homo sapien
gtattcatagccgattgtgagctgc

SEQ ID NO: 559712 - DNA, 25 bp, Homo sapien
attcatagccgattgtgagctgctc

SEQ ID NO: 559713 - DNA, 25 bp, Homo sapien
tcatagccgattgtgagctgctcta

SEQ ID NO: 559714 - DNA, 25 bp, Homo sapien
atagccgattgtgagctgctctacc

SEQ ID NO: 559715 - DNA, 25 bp, Homo sapien
tagccgattgtgagctgctctacca

SEQ ID NO: 559716 - DNA, 25 bp, Homo sapien
agctgctctaccacattttcctgtt

SEQ ID NO: 559717 - DNA, 25 bp, Homo sapien
cagttgccttagaagtggtgagatg

SEQ ID NO: 559718 - DNA, 25 bp, Homo sapien
tgtctgacacatgattggagctctt

SEQ ID NO: 559719 - DNA, 25 bp, Homo sapien
gacacatgattggagctctttttga

SEQ ID NO: 559720 - DNA, 25 bp, Homo sapien
attggagctctttttgaaatgtttc

SEQ ID NO: 559721 - DNA, 25 bp, Homo sapien
ttgaaatgtttcttgcccttcctgg

SEQ ID NO: 559722 - DNA, 25 bp, Homo sapien
tatttatgcagtgattatgcttgtc

SEQ ID NO: 559723 - DNA, 25 bp, Homo sapien
ctggtggtatcctggcggccttgct

SEQ ID NO: 559724 - DNA, 25 bp, Homo sapien
ggccttgctcctgctgatagttgtc

SEQ ID NO: 559725 - DNA, 25 bp, Homo sapien
gctcctgctgatagttgtcgtgctc

SEQ ID NO: 559726 - DNA, 25 bp, Homo sapien
gatagttgtcgtgctctgtctttac

SEQ ID NO: 559727 - DNA, 25 bp, Homo sapien
gttgtcgtgctctgtctttacttca

SEQ ID NO: 559728 - DNA, 25 bp, Homo sapien
agtggtgcaagcactctgcatggag

SEQ ID NO: 559729 - DNA, 25 bp, Homo sapien
ggacaggctcaatgatatcagcctt

SEQ ID NO: 559730 - DNA, 25 bp, Homo sapien
agcccgaccttctggccgcagagtg

SEQ ID NO: 559731 - DNA, 25 bp, Homo sapien
tgcagcgggaacagaatgagagatt

SEQ ID NO: 559732 - DNA, 25 bp, Homo sapien
gattcaacgtgtatcttatgcctac

SEQ ID NO: 559733 - DNA, 25 bp, Homo sapien
gtatcttatgcctacaccaaacctg

SEQ ID NO: 559734 - DNA, 25 bp, Homo sapien
atgcctacaccaaacctggatattt

SEQ ID NO: 559735 - DNA, 25 bp, Homo sapien
acctggatatttatggtgaatgcac

SEQ ID NO: 559736 - DNA, 25 bp, Homo sapien
gaatgcacaatgcagatcactcatg

SEQ ID NO: 559737 - DNA, 25 bp, Homo sapien
gcaggatttatgtggacatgttttc

SEQ ID NO: 559738 - DNA, 25 bp, Homo sapien
tttatccaagataaatgctcaaggg

SEQ ID NO: 559739 - DNA, 25 bp, Homo sapien
tccgccgcagcagaattaaactttt

SEQ ID NO: 559740 - DNA, 25 bp, Homo sapien
taaacttttttctgtgtctgaggcc

SEQ ID NO: 559741 - DNA, 25 bp, Homo sapien
cttttttctgtgtctgaggccctgc

SEQ ID NO: 559742 - DNA, 25 bp, Homo sapien
tgtctgtatgtgtgtccgcgtgtag

SEQ ID NO: 559743 - DNA, 25 bp, Homo sapien
tctgtatgtgtgtccgcgtgtagtg

SEQ ID NO: 559744 - DNA, 25 bp, Homo sapien
ggagggtgacctagattgcagcata

SEQ ID NO: 559745 - DNA, 25 bp, Homo sapien
acctagattgcagcataaggactct

SEQ ID NO: 559746 - DNA, 25 bp, Homo sapien
aaggactctaagtgagactgaagga

SEQ ID NO: 559747 - DNA, 25 bp, Homo sapien
ggcagacaggcttttatcctctgag

SEQ ID NO: 559748 - DNA, 25 bp, Homo sapien
gacaggcttttatcctctgagagac

SEQ ID NO: 559749 - DNA, 25 bp, Homo sapien
ttatcctctgagagacttagaggtg

SEQ ID NO: 559750 - DNA, 25 bp, Homo sapien
catagccttttaggtgtttttacag

SEQ ID NO: 559751 - DNA, 25 bp, Homo sapien
gccttttaggtgtttttacagtatg

SEQ ID NO: 559752 - DNA, 25 bp, Homo sapien
gtgaaaaatacaagactcattctag

SEQ ID NO: 559753 - DNA, 25 bp, Homo sapien
ctagagttaaattaccaatcttggt

SEQ ID NO: 559754 - DNA, 25 bp, Homo sapien
tcttggttgatattatctgcttcca

SEQ ID NO: 559755 - DNA, 25 bp, Homo sapien
atgttgctagtaaatattggttttt

SEQ ID NO: 559756 - DNA, 25 bp, Homo sapien
cttaatgtagtgaatttgtgtaacc

SEQ ID NO: 559757 - DNA, 25 bp, Homo sapien
gtgtaaccatgttgtattgttgaga

SEQ ID NO: 559758 - DNA, 25 bp, Homo sapien
aattaacttttgtaactgtcgcttg

SEQ ID NO: 559759 - DNA, 25 bp, Homo sapien
taacttttgtaactgtcgcttggaa

SEQ ID NO: 559760 - DNA, 25 bp, Homo sapien
gtaactgtcgcttggaaataactca

SEQ ID NO: 559761 - DNA, 25 bp, Homo sapien
ctggaatgatgcgttctggcagaac

SEQ ID NO: 559762 - DNA, 25 bp, Homo sapien
atgcgttctggcagaacccctggga

SEQ ID NO: 559763 - DNA, 25 bp, Homo sapien
gggcctggcagtgattatcttattc

SEQ ID NO: 559764 - DNA, 25 bp, Homo sapien
gattatcttattcatcaccgctgtc

SEQ ID NO: 559765 - DNA, 25 bp, Homo sapien
gctgtcctgcttctcatcttatttg

SEQ ID NO: 559766 - DNA, 25 bp, Homo sapien
atcttatttgccatcgtgtttggtt

SEQ ID NO: 559767 - DNA, 25 bp, Homo sapien
tgccatcgtgtttggtttactcact

SEQ ID NO: 559768 - DNA, 25 bp, Homo sapien
tttggtttactcacttccacagaaa

SEQ ID NO: 559769 - DNA, 25 bp, Homo sapien
aaacactcagtgtgaagcgggtgaa

SEQ ID NO: 559770 - DNA, 25 bp, Homo sapien
tgaagaggagtgacctgacttgctg

SEQ ID NO: 559771 - DNA, 25 bp, Homo sapien
cttcgcggttccctctggctcaggg

SEQ ID NO: 559772 - DNA, 25 bp, Homo sapien
gagcacatgaaggattgcctcccaa

SEQ ID NO: 559773 - DNA, 25 bp, Homo sapien
tctgccggtcttatctctgcaacaa

SEQ ID NO: 559774 - DNA, 25 bp, Homo sapien
gaaggattgcctcccaaattttgtc

SEQ ID NO: 559775 - DNA, 25 bp, Homo sapien
attttgtcaccactaattcttgccc

SEQ ID NO: 559776 - DNA, 25 bp, Homo sapien
ttggctgcttctacgtgttacagtt

SEQ ID NO: 559777 - DNA, 25 bp, Homo sapien
agttccaccttaaaatttcaggcag

SEQ ID NO: 559778 - DNA, 25 bp, Homo sapien
aggcagggtttctcaataccacctt

SEQ ID NO: 559779 - DNA, 25 bp, Homo sapien
gtgtgctcgtgaacataaccagctt

SEQ ID NO: 559780 - DNA, 25 bp, Homo sapien
tctgcaacaacctcaccaatttgga

SEQ ID NO: 559781 - DNA, 25 bp, Homo sapien
cagattttcatcatattgggagcat

SEQ ID NO: 559782 - DNA, 25 bp, Homo sapien
taagtctatcacatctgcgtcctgt

SEQ ID NO: 559783 - DNA, 25 bp, Homo sapien
cagcatggatctgcattgaatgtca

SEQ ID NO: 559784 - DNA, 25 bp, Homo sapien
tgtcaagctaaccaagagtctgcca

SEQ ID NO: 559785 - DNA, 25 bp, Homo sapien
caagagtctgccacttcagaagtgt

SEQ ID NO: 559786 - DNA, 25 bp, Homo sapien
tcagaagtgtgtaccgttgcacggg

SEQ ID NO: 559787 - DNA, 25 bp, Homo sapien
gtaaccgtgcttttcacttcactgt

SEQ ID NO: 559788 - DNA, 25 bp, Homo sapien
aagtaccaacagcagtgctttgaag

SEQ ID NO: 559789 - DNA, 25 bp, Homo sapien
tgtctctctcactggctcaaaacac

SEQ ID NO: 559790 - DNA, 25 bp, Homo sapien
ggctcaaaacacaacagctgtgcct

SEQ ID NO: 559791 - DNA, 25 bp, Homo sapien
aacagctgtgcctgttggacaacag

SEQ ID NO: 559792 - DNA, 25 bp, Homo sapien
aattcccaaagtatggacaccagaa

SEQ ID NO: 559793 - DNA, 25 bp, Homo sapien
ggcttgggatgttgtggttaataac

SEQ ID NO: 559794 - DNA, 25 bp, Homo sapien
tctgaggttctagcttgagctggca

SEQ ID NO: 559795 - DNA, 25 bp, Homo sapien
agcttgagctggcaaatgggtttca

SEQ ID NO: 559796 - DNA, 25 bp, Homo sapien
aaatgggtttcagtgaggcgtgtct

SEQ ID NO: 559797 - DNA, 25 bp, Homo sapien
gaggcgtgtctgaaataacctgtat

SEQ ID NO: 559798 - DNA, 25 bp, Homo sapien
tgtattgttgttgcaggaactctct

SEQ ID NO: 559799 - DNA, 25 bp, Homo sapien
gaactctctgggttcagcctggttt

SEQ ID NO: 559800 - DNA, 25 bp, Homo sapien
agcctggttttgaattcctctctga

SEQ ID NO: 559801 - DNA, 25 bp, Homo sapien
aaggacagcactggcatgctgcagc

SEQ ID NO: 559802 - DNA, 25 bp, Homo sapien
ggatgacagggttccaatcccatgg

SEQ ID NO: 559803 - DNA, 25 bp, Homo sapien
ggttccaatcccatggttgtacaga

SEQ ID NO: 559804 - DNA, 25 bp, Homo sapien
aaaaaattgatggaggtcactgttg

SEQ ID NO: 559805 - DNA, 25 bp, Homo sapien
tgaaatgtacttctgtttattctta

SEQ ID NO: 559806 - DNA, 25 bp, Homo sapien
tacacacatagttttagcaaattgg

SEQ ID NO: 559807 - DNA, 25 bp, Homo sapien
aatatattcatttgtatggcaagat

SEQ ID NO: 559808 - DNA, 25 bp, Homo sapien
tatggcaagataaatgcagtcatct

SEQ ID NO: 559809 - DNA, 25 bp, Homo sapien
aatgcagtcatcttaatactagtct

SEQ ID NO: 559810 - DNA, 25 bp, Homo sapien
atactagtctatacatttttgccaa

SEQ ID NO: 559811 - DNA, 25 bp, Homo sapien
ctatacatttttgccaaatggcgca

SEQ ID NO: 559812 - DNA, 25 bp, Homo sapien
gccaaatggcgcaaatatacctcca

SEQ ID NO: 559813 - DNA, 25 bp, Homo sapien
accatgtatgagacacttttttaca

SEQ ID NO: 559814 - DNA, 25 bp, Homo sapien
caaaaagtgccgtatatacatatgt

SEQ ID NO: 559815 - DNA, 25 bp, Homo sapien
atacatatgtaacaggtgagtgtgt

SEQ ID NO: 559816 - DNA, 25 bp, Homo sapien
gaaccctattcaaccatttttgtag

SEQ ID NO: 559817 - DNA, 25 bp, Homo sapien
tagcacaatgaaagcctaccttcag

SEQ ID NO: 559818 - DNA, 25 bp, Homo sapien
aaagcctaccttcagaaggcacctg

SEQ ID NO: 559819 - DNA, 25 bp, Homo sapien
aaggcacctggattaaagctactaa

SEQ ID NO: 559820 - DNA, 25 bp, Homo sapien
ttaaagctactaaactacttcctgt

SEQ ID NO: 559821 - DNA, 25 bp, Homo sapien
gatggcctcttcaatctgttcatag

SEQ ID NO: 559822 - DNA, 25 bp, Homo sapien
agaggccactagtaaccaggagaaa

SEQ ID NO: 559823 - DNA, 25 bp, Homo sapien
gcaagcaggagtgctgtaacccaat

SEQ ID NO: 559824 - DNA, 25 bp, Homo sapien
gtgctgtaacccaatgccagggagt

SEQ ID NO: 559825 - DNA, 25 bp, Homo sapien
tgccagggagtacagagccactgct

SEQ ID NO: 559826 - DNA, 25 bp, Homo sapien
gagccactgctctaaaatgtaaata

SEQ ID NO: 559827 - DNA, 25 bp, Homo sapien
aggaggacgcgtggccagcaggtgc

SEQ ID NO: 559828 - DNA, 25 bp, Homo sapien
aggctgagctgcatctctggactcc

SEQ ID NO: 559829 - DNA, 25 bp, Homo sapien
agctgcatctctggactccaaggag

SEQ ID NO: 559830 - DNA, 25 bp, Homo sapien
agcttggagaggtgactgaaaccct

SEQ ID NO: 559831 - DNA, 25 bp, Homo sapien
gagaggtgactgaaaccctgcccca

SEQ ID NO: 559832 - DNA, 25 bp, Homo sapien
ggagatgaaaatgccagccctgcta

SEQ ID NO: 559833 - DNA, 25 bp, Homo sapien
agcctgtctccatctgtgggtcctt

SEQ ID NO: 559834 - DNA, 25 bp, Homo sapien
atctgtgggtccttgggcaaattgc

SEQ ID NO: 559835 - DNA, 25 bp, Homo sapien
gggcaaattgcctcatctctctgag

SEQ ID NO: 559836 - DNA, 25 bp, Homo sapien
agccctgctagatccaggcgggatg

SEQ ID NO: 559837 - DNA, 25 bp, Homo sapien
acagtggcttgtacaggcctgggct

SEQ ID NO: 559838 - DNA, 25 bp, Homo sapien
ttccactgaactgtgcggatgccac

SEQ ID NO: 559839 - DNA, 25 bp, Homo sapien
aactgtgcggatgccacagtgaccc

SEQ ID NO: 559840 - DNA, 25 bp, Homo sapien
aggcacagcatgacctcctgaagtc

SEQ ID NO: 559841 - DNA, 25 bp, Homo sapien
agcatgacctcctgaagtcgagcct

SEQ ID NO: 559842 - DNA, 25 bp, Homo sapien
gaagtcgagcctgcttgctttgaac

SEQ ID NO: 559843 - DNA, 25 bp, Homo sapien
gcttgctttgaacctaccagttaaa

SEQ ID NO: 559844 - DNA, 25 bp, Homo sapien
tctcctcaaaatgtttggataccgc

SEQ ID NO: 559845 - DNA, 25 bp, Homo sapien
aaatgtttggataccgcccattggc

SEQ ID NO: 559846 - DNA, 25 bp, Homo sapien
agctccctgaccagtgtgcgtgtgt

SEQ ID NO: 559847 - DNA, 25 bp, Homo sapien
tcacctttgggtgtgcggtgtgccc

SEQ ID NO: 559848 - DNA, 25 bp, Homo sapien
ggtgtgcccccaggacctgtaagta

SEQ ID NO: 559849 - DNA, 25 bp, Homo sapien
atattttgatggtcagtactggctc

SEQ ID NO: 559850 - DNA, 25 bp, Homo sapien
agtactggctctggtgggtgttcct

SEQ ID NO: 559851 - DNA, 25 bp, Homo sapien
ttgttttaggctttctcctgtttct

SEQ ID NO: 559852 - DNA, 25 bp, Homo sapien
ttctcctgtttctcagaggatttat

SEQ ID NO: 559853 - DNA, 25 bp, Homo sapien
tcggaagatgccagaaactttctca

SEQ ID NO: 559854 - DNA, 25 bp, Homo sapien
tccccaggaccagagttctctttat

SEQ ID NO: 559855 - DNA, 25 bp, Homo sapien
aaagatgttttctggcaaaggcctt

SEQ ID NO: 559856 - DNA, 25 bp, Homo sapien
ggcaaaggccttcctgcatttatga

SEQ ID NO: 559857 - DNA, 25 bp, Homo sapien
ttatgaattctctctcaagaagcaa

SEQ ID NO: 559858 - DNA, 25 bp, Homo sapien
gagaacacctgcaggaagtgaatca

SEQ ID NO: 559859 - DNA, 25 bp, Homo sapien
gaggaataatcacctgctttaaaaa

SEQ ID NO: 559860 - DNA, 25 bp, Homo sapien
ttgttcctagtttgatgcccttatg

SEQ ID NO: 559861 - DNA, 25 bp, Homo sapien
cctgctggcaagagatttgtcttct

SEQ ID NO: 559862 - DNA, 25 bp, Homo sapien
gactgctgcagttagaaggctcact

SEQ ID NO: 559863 - DNA, 25 bp, Homo sapien
tagaaggctcactgcttctcctaag

SEQ ID NO: 559864 - DNA, 25 bp, Homo sapien
ttctcctaagccttctgcacagatg

SEQ ID NO: 559865 - DNA, 25 bp, Homo sapien
gagctgccctctgacagcaggtgca

SEQ ID NO: 559866 - DNA, 25 bp, Homo sapien
aggtgcagcagagatggctacagct

SEQ ID NO: 559867 - DNA, 25 bp, Homo sapien
tcttgtcttcaattggctttcgggc

SEQ ID NO: 559868 - DNA, 25 bp, Homo sapien
gctttcgggccttgtatgtggtaaa

SEQ ID NO: 559869 - DNA, 25 bp, Homo sapien
ggtaaaatcaccaaatcacagtcaa

SEQ ID NO: 559870 - DNA, 25 bp, Homo sapien
gtcaagactgtgtttttgttcctag

SEQ ID NO: 559871 - DNA, 25 bp, Homo sapien
tgcaaacgcgatttctctgtggagc

SEQ ID NO: 559872 - DNA, 25 bp, Homo sapien
tctgtggagccttcacggaattgct

SEQ ID NO: 559873 - DNA, 25 bp, Homo sapien
ggaattgctgcttttcactatgatt

SEQ ID NO: 559874 - DNA, 25 bp, Homo sapien
attgctgcataacaggccacttctg

SEQ ID NO: 559875 - DNA, 25 bp, Homo sapien
gcataacaggccacttctgtgtgta

SEQ ID NO: 559876 - DNA, 25 bp, Homo sapien
gcctgaatgggtgggttatcccaat

SEQ ID NO: 559877 - DNA, 25 bp, Homo sapien
gtacattttgttttaagccaggtgc

SEQ ID NO: 559878 - DNA, 25 bp, Homo sapien
taagccaggtgcacaagttagagtt

SEQ ID NO: 559879 - DNA, 25 bp, Homo sapien
caagttagagttgctttttgggact

SEQ ID NO: 559880 - DNA, 25 bp, Homo sapien
aaacctgatatcactcttggcagcc

SEQ ID NO: 559881 - DNA, 25 bp, Homo sapien
tcttggcagcctgactaaagccatt

SEQ ID NO: 559882 - DNA, 25 bp, Homo sapien
attacctcccaaagcctcagtctcc

SEQ ID NO: 559883 - DNA, 25 bp, Homo sapien
gtctcctcatgtgtaaaatagggaa

SEQ ID NO: 559884 - DNA, 25 bp, Homo sapien
tggtgcgcacctgttaactcagcta

SEQ ID NO: 559885 - DNA, 25 bp, Homo sapien
ggtgcgcacctgttaactcagctac

SEQ ID NO: 559886 - DNA, 25 bp, Homo sapien
gcgcacctgttaactcagctactgg

SEQ ID NO: 559887 - DNA, 25 bp, Homo sapien
cacctgttaactcagctactggggg

SEQ ID NO: 559888 - DNA, 25 bp, Homo sapien
acctgttaactcagctactgggggt

SEQ ID NO: 559889 - DNA, 25 bp, Homo sapien
cctgttaactcagctactgggggtg

SEQ ID NO: 559890 - DNA, 25 bp, Homo sapien
ctgttaactcagctactgggggtgc

SEQ ID NO: 559891 - DNA, 25 bp, Homo sapien
tgttaactcagctactgggggtgct

SEQ ID NO: 559892 - DNA, 25 bp, Homo sapien
gttaactcagctactgggggtgctg

SEQ ID NO: 559893 - DNA, 25 bp, Homo sapien
gagcatttgagcttcagatttctaa

SEQ ID NO: 559894 - DNA, 25 bp, Homo sapien
agatttctaacagcctctttgcaac

SEQ ID NO: 559895 - DNA, 25 bp, Homo sapien
gtagctgaaggcaactgcaatcctt

SEQ ID NO: 559896 - DNA, 25 bp, Homo sapien
tgcaatccttcatgatgtttccctt

SEQ ID NO: 559897 - DNA, 25 bp, Homo sapien
gtttcccttggccagaaatgcacta

SEQ ID NO: 559898 - DNA, 25 bp, Homo sapien
aaaggttcggaatttgcctctgcgc

SEQ ID NO: 559899 - DNA, 25 bp, Homo sapien
aatgcactaagcagtctcaagattc

SEQ ID NO: 559900 - DNA, 25 bp, Homo sapien
tagccatgtaaaacactcaccagat

SEQ ID NO: 559901 - DNA, 25 bp, Homo sapien
ataaatatggtaatgctgtgctagc

SEQ ID NO: 559902 - DNA, 25 bp, Homo sapien
ttgcctctgcgccatctatttttgc

SEQ ID NO: 559903 - DNA, 25 bp, Homo sapien
gttacctgtgacgtccttggaagca

SEQ ID NO: 559904 - DNA, 25 bp, Homo sapien
gggtcgtcttcagaagctcctgcag

SEQ ID NO: 559905 - DNA, 25 bp, Homo sapien
agaagctcctgcagtctcgtggcgg

SEQ ID NO: 559906 - DNA, 25 bp, Homo sapien
aggtcacttgttaacttcttctctt

SEQ ID NO: 559907 - DNA, 25 bp, Homo sapien
ttctctttttctagtctctccttca

SEQ ID NO: 559908 - DNA, 25 bp, Homo sapien
tagtctctccttcagctgtgaggcc

SEQ ID NO: 559909 - DNA, 25 bp, Homo sapien
gtgaggcctcctctgtttctgaaga

SEQ ID NO: 559910 - DNA, 25 bp, Homo sapien
cctcctctgtttctgaagactctag

SEQ ID NO: 559911 - DNA, 25 bp, Homo sapien
ggctgtgcggagcttctccaattct

SEQ ID NO: 559912 - DNA, 25 bp, Homo sapien
tctccaattcttcttgtaaccgaca

SEQ ID NO: 559913 - DNA, 25 bp, Homo sapien
tgtaaccgacatgccgaggtctgag

SEQ ID NO: 559914 - DNA, 25 bp, Homo sapien
gaggtctgagcctcctcaaactcgg

SEQ ID NO: 559915 - DNA, 25 bp, Homo sapien
ctcctgagttaattctccggcagct

SEQ ID NO: 559916 - DNA, 25 bp, Homo sapien
ttttttccttcttgattactcatgt

SEQ ID NO: 559917 - DNA, 25 bp, Homo sapien
gattactcatgtatttcttccattt

SEQ ID NO: 559918 - DNA, 25 bp, Homo sapien
cttaatttcaatataggacagtgct

SEQ ID NO: 559919 - DNA, 25 bp, Homo sapien
gaacgtatgggtgaacaaattttat

SEQ ID NO: 559920 - DNA, 25 bp, Homo sapien
taagtgtgggatattgcattggaat

SEQ ID NO: 559921 - DNA, 25 bp, Homo sapien
gcattggaatggtctgttccttgaa

SEQ ID NO: 559922 - DNA, 25 bp, Homo sapien
gttccttgaaagttgcagagtctgt

SEQ ID NO: 559923 - DNA, 25 bp, Homo sapien
agagtctgtgatgccagatggacca

SEQ ID NO: 559924 - DNA, 25 bp, Homo sapien
gatggaccagaactcctgagttaat

SEQ ID NO: 559925 - DNA, 25 bp, Homo sapien
gaactcctgagttaattctccggca

SEQ ID NO: 559926 - DNA, 25 bp, Homo sapien
aggatgcttagaattgcgaggatgc

SEQ ID NO: 559927 - DNA, 25 bp, Homo sapien
cccgtttccctggtgttatgaggtg

SEQ ID NO: 559928 - DNA, 25 bp, Homo sapien
ggtgttatgaggtgcttcccatagt

SEQ ID NO: 559929 - DNA, 25 bp, Homo sapien
ggtgcttcccatagtgtggagacta

SEQ ID NO: 559930 - DNA, 25 bp, Homo sapien
ggagactaaaggtgtttatcactta

SEQ ID NO: 559931 - DNA, 25 bp, Homo sapien
tcacttaacagtatggcttccaagt

SEQ ID NO: 559932 - DNA, 25 bp, Homo sapien
ggcttccaagtttaactgtcccaga

SEQ ID NO: 559933 - DNA, 25 bp, Homo sapien
ccctctccatgtaacacctggaaag

SEQ ID NO: 559934 - DNA, 25 bp, Homo sapien
ttagttttcagtgaagtggccccac

SEQ ID NO: 559935 - DNA, 25 bp, Homo sapien
tgcaagttggcccacacgatgtgtc

SEQ ID NO: 559936 - DNA, 25 bp, Homo sapien
ggctgctctagaggatgcttagaat

SEQ ID NO: 559937 - DNA, 25 bp, Homo sapien
gaaacatagtgtcttttggccaaat

SEQ ID NO: 559938 - DNA, 25 bp, Homo sapien
ggccaaattgaacctacttgtaatg

SEQ ID NO: 559939 - DNA, 25 bp, Homo sapien
gtggaccaacttactttacacattt

SEQ ID NO: 559940 - DNA, 25 bp, Homo sapien
actttacacattttcatcagtccca

SEQ ID NO: 559941 - DNA, 25 bp, Homo sapien
agtcccaatgtatggaattagctta

SEQ ID NO: 559942 - DNA, 25 bp, Homo sapien
ggaattagcttagttttctcatgct

SEQ ID NO: 559943 - DNA, 25 bp, Homo sapien
gcttagttttctcatgcttgattaa

SEQ ID NO: 559944 - DNA, 25 bp, Homo sapien
attcctcttctagactttgtgtata

SEQ ID NO: 559945 - DNA, 25 bp, Homo sapien
ggtaaaactacaaatctcctcctca

SEQ ID NO: 559946 - DNA, 25 bp, Homo sapien
aaatctcctcctcagggtgatattt

SEQ ID NO: 559947 - DNA, 25 bp, Homo sapien
gagtatgacatcaattaacagtctt

SEQ ID NO: 559948 - DNA, 25 bp, Homo sapien
atgaggaccgaaaggcttaggtgac

SEQ ID NO: 559949 - DNA, 25 bp, Homo sapien
gaccgaaaggcttaggtgacttgat

SEQ ID NO: 559950 - DNA, 25 bp, Homo sapien
ccccatgggtagaaccttcctgatt

SEQ ID NO: 559951 - DNA, 25 bp, Homo sapien
tcaggggccctggaagaaatgtttg

SEQ ID NO: 559952 - DNA, 25 bp, Homo sapien
atgggtagaaccttcctgattggct

SEQ ID NO: 559953 - DNA, 25 bp, Homo sapien
ggtagaaccttcctgattggctgtg

SEQ ID NO: 559954 - DNA, 25 bp, Homo sapien
agaaccttcctgattggctgtgggt

SEQ ID NO: 559955 - DNA, 25 bp, Homo sapien
cttcctgattggctgtgggttgtat

SEQ ID NO: 559956 - DNA, 25 bp, Homo sapien
ctgattggctgtgggttgtatcaaa

SEQ ID NO: 559957 - DNA, 25 bp, Homo sapien
acctttgactgggtgaggctgagat

SEQ ID NO: 559958 - DNA, 25 bp, Homo sapien
atgggtgtggtggttccagtgagtc

SEQ ID NO: 559959 - DNA, 25 bp, Homo sapien
gtcagcagaatatgtcaatgttttg

SEQ ID NO: 559960 - DNA, 25 bp, Homo sapien
aatgttttggttgaagaagctgctt

SEQ ID NO: 559961 - DNA, 25 bp, Homo sapien
aagctgcttgaatctgggcttttct

SEQ ID NO: 559962 - DNA, 25 bp, Homo sapien
ctgcttgaatctgggcttttctgtg

SEQ ID NO: 559963 - DNA, 25 bp, Homo sapien
ttttctgtgccatgtgttctcccag

SEQ ID NO: 559964 - DNA, 25 bp, Homo sapien
gtgccatgtgttctcccagggccag

SEQ ID NO: 559965 - DNA, 25 bp, Homo sapien
cagcacaaagaagggcttttggtgc

SEQ ID NO: 559966 - DNA, 25 bp, Homo sapien
gcccaagaccaccataatcatcatt

SEQ ID NO: 559967 - DNA, 25 bp, Homo sapien
aaccaaaacctcatgctgaccagag

SEQ ID NO: 559968 - DNA, 25 bp, Homo sapien
aaaacctcatgctgaccagagttga

SEQ ID NO: 559969 - DNA, 25 bp, Homo sapien
catgctgaccagagttgaggaacag

SEQ ID NO: 559970 - DNA, 25 bp, Homo sapien
cccttaagctatctttcagatcatt

SEQ ID NO: 559971 - DNA, 25 bp, Homo sapien
ctatctttcagatcattcagagcat

SEQ ID NO: 559972 - DNA, 25 bp, Homo sapien
tcattcagagcataaggatgggcat

SEQ ID NO: 559973 - DNA, 25 bp, Homo sapien
gagaaagccagggatttgacaccac

SEQ ID NO: 559974 - DNA, 25 bp, Homo sapien
aaagccagggatttgacaccacctc

SEQ ID NO: 559975 - DNA, 25 bp, Homo sapien
ccctcccactggaggcgggaggaca

SEQ ID NO: 559976 - DNA, 25 bp, Homo sapien
aggacaacggaagcggtcagccagt

SEQ ID NO: 559977 - DNA, 25 bp, Homo sapien
aacggaagcggtcagccagtttctg

SEQ ID NO: 559978 - DNA, 25 bp, Homo sapien
tcagccagtttctgcgggaaacaag

SEQ ID NO: 559979 - DNA, 25 bp, Homo sapien
cagtttctgcgggaaacaagcaggc

SEQ ID NO: 559980 - DNA, 25 bp, Homo sapien
acaagcaggccacacggaatagaaa

SEQ ID NO: 559981 - DNA, 25 bp, Homo sapien
gtctgtttactgcagtgaaattcat

SEQ ID NO: 559982 - DNA, 25 bp, Homo sapien
catcaaatgtttcagtgtggttttc

SEQ ID NO: 559983 - DNA, 25 bp, Homo sapien
gtggttttctgtagcctatcattta

SEQ ID NO: 559984 - DNA, 25 bp, Homo sapien
ttaggattttctgcctactctatcc

SEQ ID NO: 559985 - DNA, 25 bp, Homo sapien
ttttctgcctactctatccagttgt

SEQ ID NO: 559986 - DNA, 25 bp, Homo sapien
atccagttgtccaaatgatatccta

SEQ ID NO: 559987 - DNA, 25 bp, Homo sapien
tacaaatgccctttcagtttctatt

SEQ ID NO: 559988 - DNA, 25 bp, Homo sapien
tttccattaaattgccctcatgtcc

SEQ ID NO: 559989 - DNA, 25 bp, Homo sapien
tgccctcatgtcctaatgtgcagtt

SEQ ID NO: 559990 - DNA, 25 bp, Homo sapien
gattttcaagagtgctagacttcca

SEQ ID NO: 559991 - DNA, 25 bp, Homo sapien
gagtgctagacttccaatttgagag

SEQ ID NO: 559992 - DNA, 25 bp, Homo sapien
gctgcacgatgatccggtggaagat

SEQ ID NO: 559993 - DNA, 25 bp, Homo sapien
agcgggcccttttcatcatcatggt

SEQ ID NO: 559994 - DNA, 25 bp, Homo sapien
gataaacaacctcattgcctcagaa

SEQ ID NO: 559995 - DNA, 25 bp, Homo sapien
ttgcctcagaatcctactacaccta

SEQ ID NO: 559996 - DNA, 25 bp, Homo sapien
tccatttccggaatctcgagcatgc

SEQ ID NO: 559997 - DNA, 25 bp, Homo sapien
tctgagacattccaggatgggctcc

SEQ ID NO: 559998 - DNA, 25 bp, Homo sapien
gttcagctccaggatgacagaggac

SEQ ID NO: 559999 - DNA, 25 bp, Homo sapien
gctgaacccaaggaagccgtggaga

SEQ ID NO: 560000 - DNA, 25 bp, Homo sapien
aagccgtggagagacagttgatgac

SEQ ID NO: 560001 - DNA, 25 bp, Homo sapien
tcatcatggtgtcagctagcgtgtt

SEQ ID NO: 560002 - DNA, 25 bp, Homo sapien
tgtcagctagcgtgtttgtgggcct

SEQ ID NO: 560003 - DNA, 25 bp, Homo sapien
atgtgtgcattgacaacgtactcag

SEQ ID NO: 560004 - DNA, 25 bp, Homo sapien
aacgtactcagaagattatgttcca

SEQ ID NO: 560005 - DNA, 25 bp, Homo sapien
atgttccaccatatgattatcagcc

SEQ ID NO: 560006 - DNA, 25 bp, Homo sapien
gattatcagccacatgcttatccct

SEQ ID NO: 560007 - DNA, 25 bp, Homo sapien
ccacatgcttatccctgtcaagatg

SEQ ID NO: 560008 - DNA, 25 bp, Homo sapien
gcttatccctgtcaagatgattatt

SEQ ID NO: 560009 - DNA, 25 bp, Homo sapien
gatgattattccatagtccacagaa

SEQ ID NO: 560010 - DNA, 25 bp, Homo sapien
agtccacagaaaatgccgttctcag

SEQ ID NO: 560011 - DNA, 25 bp, Homo sapien
aaatgccgttctcagttcacggatc

SEQ ID NO: 560012 - DNA, 25 bp, Homo sapien
gttctcagttcacggatctaaatgg

SEQ ID NO: 560013 - DNA, 25 bp, Homo sapien
gttcacggatctaaatggttctaaa

SEQ ID NO: 560014 - DNA, 25 bp, Homo sapien
gtcagaaagtctcggactcctctct

SEQ ID NO: 560015 - DNA, 25 bp, Homo sapien
aaagtctcggactcctctctgcttg

SEQ ID NO: 560016 - DNA, 25 bp, Homo sapien
ctctgcttgcatgtgtaaagttttc

SEQ ID NO: 560017 - DNA, 25 bp, Homo sapien
atgtgtaaagttttcattttcaggg

SEQ ID NO: 560018 - DNA, 25 bp, Homo sapien
taaagctgtatgacttagtgctgaa

SEQ ID NO: 560019 - DNA, 25 bp, Homo sapien
ctgtatgacttagtgctgaaggata

SEQ ID NO: 560020 - DNA, 25 bp, Homo sapien
tagctcttgggttggcagcataaac

SEQ ID NO: 560021 - DNA, 25 bp, Homo sapien
ctcttgggttggcagcataaaccaa

SEQ ID NO: 560022 - DNA, 25 bp, Homo sapien
aaaagaatgtttagtgacacgtgaa

SEQ ID NO: 560023 - DNA, 25 bp, Homo sapien
gtttagtgacacgtgaaaaatacat

SEQ ID NO: 560024 - DNA, 25 bp, Homo sapien
aaataaagtgcattagcacacggtc

SEQ ID NO: 560025 - DNA, 25 bp, Homo sapien
cttcaaattgtgtgacgccaccaag

SEQ ID NO: 560026 - DNA, 25 bp, Homo sapien
tgacgccaccaaggccagatgactt

SEQ ID NO: 560027 - DNA, 25 bp, Homo sapien
gaaggcaatatccagctgtcatctt

SEQ ID NO: 560028 - DNA, 25 bp, Homo sapien
agctgtcatcttcttgatcctcata

SEQ ID NO: 560029 - DNA, 25 bp, Homo sapien
cttgatcctcatatgctactactag

SEQ ID NO: 560030 - DNA, 25 bp, Homo sapien
tagcatctagcatttactgagcaga

SEQ ID NO: 560031 - DNA, 25 bp, Homo sapien
gagcagatagttttattgtccagtt

SEQ ID NO: 560032 - DNA, 25 bp, Homo sapien
gaagatatagcccagattcactccc

SEQ ID NO: 560033 - DNA, 25 bp, Homo sapien
tcccaggcaggcagatgccagtgtc

SEQ ID NO: 560034 - DNA, 25 bp, Homo sapien
tctgctctctttaccaccaaaatat

SEQ ID NO: 560035 - DNA, 25 bp, Homo sapien
accaccaaaatatcctgctacatgt

SEQ ID NO: 560036 - DNA, 25 bp, Homo sapien
tatgatgccagaaaaactccgaatg

SEQ ID NO: 560037 - DNA, 25 bp, Homo sapien
ctccgaatgagcctctccagggaaa

SEQ ID NO: 560038 - DNA, 25 bp, Homo sapien
gagacacggagcttttgtacagaga

SEQ ID NO: 560039 - DNA, 25 bp, Homo sapien
gttcctaaaggagcagaggtattac

SEQ ID NO: 560040 - DNA, 25 bp, Homo sapien
gaggtattactgaacactccagggt

SEQ ID NO: 560041 - DNA, 25 bp, Homo sapien
actccagggtcacgttcatcagaac

SEQ ID NO: 560042 - DNA, 25 bp, Homo sapien
agcagaatgatctcaccaggtctct

SEQ ID NO: 560043 - DNA, 25 bp, Homo sapien
ccaggtctctgccaacaaaattctc

SEQ ID NO: 560044 - DNA, 25 bp, Homo sapien
aattctcaggagctgttagagccta

SEQ ID NO: 560045 - DNA, 25 bp, Homo sapien
ggagctgttagagcctaaaactcac

SEQ ID NO: 560046 - DNA, 25 bp, Homo sapien
atcagaaacagacgtcagacaggca

SEQ ID NO: 560047 - DNA, 25 bp, Homo sapien
gactcagatgcagcaagctttgcaa

SEQ ID NO: 560048 - DNA, 25 bp, Homo sapien
aggctgacgagagctgagatcttca

SEQ ID NO: 560049 - DNA, 25 bp, Homo sapien
gctgacttggacaattccaggtcaa

SEQ ID NO: 560050 - DNA, 25 bp, Homo sapien
gagatcttcagtggccgatgggtac

SEQ ID NO: 560051 - DNA, 25 bp, Homo sapien
tgctgggagcgtagccacgtctgct

SEQ ID NO: 560052 - DNA, 25 bp, Homo sapien
acgtctgctccaaggtggcttgaat

SEQ ID NO: 560053 - DNA, 25 bp, Homo sapien
gcccaagtccttttgactggctgag

SEQ ID NO: 560054 - DNA, 25 bp, Homo sapien
tttgtccctctcgtaataagtgcat

SEQ ID NO: 560055 - DNA, 25 bp, Homo sapien
aataagtgcatttcccagacagcag

SEQ ID NO: 560056 - DNA, 25 bp, Homo sapien
ggaactgtctactttcgactttgtg

SEQ ID NO: 560057 - DNA, 25 bp, Homo sapien
tttaagcagtggaccgggagcccaa

SEQ ID NO: 560058 - DNA, 25 bp, Homo sapien
ctgtgcccacagcagacttaagact

SEQ ID NO: 560059 - DNA, 25 bp, Homo sapien
cagacttaagactgcctctaaaatg

SEQ ID NO: 560060 - DNA, 25 bp, Homo sapien
gactgcctctaaaatgtccatgaag

SEQ ID NO: 560061 - DNA, 25 bp, Homo sapien
aagccattgtccagtagagctgtta

SEQ ID NO: 560062 - DNA, 25 bp, Homo sapien
gtagagctgttagttttaacaccag

SEQ ID NO: 560063 - DNA, 25 bp, Homo sapien
ttaacaccagtgagtattacctttg

SEQ ID NO: 560064 - DNA, 25 bp, Homo sapien
gatgcatgtgtataggtgtatgtgt

SEQ ID NO: 560065 - DNA, 25 bp, Homo sapien
gtttgtgtttttggacttgtgtgga

SEQ ID NO: 560066 - DNA, 25 bp, Homo sapien
gaaagggttccatttaggcatttgc

SEQ ID NO: 560067 - DNA, 25 bp, Homo sapien
aggcatttgcaaatattcgatggca

SEQ ID NO: 560068 - DNA, 25 bp, Homo sapien
tttgctatgattttgtgtgtacatg

SEQ ID NO: 560069 - DNA, 25 bp, Homo sapien
aggtgatttcttacagtgctctttc

SEQ ID NO: 560070 - DNA, 25 bp, Homo sapien
gtgctctttctccatacttgaggat

SEQ ID NO: 560071 - DNA, 25 bp, Homo sapien
acttgaggatcaacccatggatatg

SEQ ID NO: 560072 - DNA, 25 bp, Homo sapien
acccatggatatgcttctaggccta

SEQ ID NO: 560073 - DNA, 25 bp, Homo sapien
ctaggcctagatatgctccggagac

SEQ ID NO: 560074 - DNA, 25 bp, Homo sapien
tgctccggagacatcaatgttccat

SEQ ID NO: 560075 - DNA, 25 bp, Homo sapien
gtcatcggcaccactggcacgcaga

SEQ ID NO: 560076 - DNA, 25 bp, Homo sapien
ttcttcctgagggagagttgccctt

SEQ ID NO: 560077 - DNA, 25 bp, Homo sapien
ttgcccttatgctctaggatggtaa

SEQ ID NO: 560078 - DNA, 25 bp, Homo sapien
ggcacacagagaattattggccgtg

SEQ ID NO: 560079 - DNA, 25 bp, Homo sapien
attggccgtgttcatctagctcaga

SEQ ID NO: 560080 - DNA, 25 bp, Homo sapien
gaacagcttgtttagtctttacact

SEQ ID NO: 560081 - DNA, 25 bp, Homo sapien
gtttagtctttacactttgcctgaa

SEQ ID NO: 560082 - DNA, 25 bp, Homo sapien
tgaaagttgcttctcctcgtccctt

SEQ ID NO: 560083 - DNA, 25 bp, Homo sapien
tcgtccctttgtgtgcctgggtggc

SEQ ID NO: 560084 - DNA, 25 bp, Homo sapien
tggcctcggccctgtgcgttggcaa

SEQ ID NO: 560085 - DNA, 25 bp, Homo sapien
gcgttggcaacgcaggatcaaatgt

SEQ ID NO: 560086 - DNA, 25 bp, Homo sapien
gcagcttttgcagaaaacaactcag

SEQ ID NO: 560087 - DNA, 25 bp, Homo sapien
tcaatgttttcctacaagagccaag

SEQ ID NO: 560088 - DNA, 25 bp, Homo sapien
aagagccaagtagcaccatgtacag

SEQ ID NO: 560089 - DNA, 25 bp, Homo sapien
gcaccatgtacagaagacgcctttt

SEQ ID NO: 560090 - DNA, 25 bp, Homo sapien
ggaatattgaaatcgttctgcatgt

SEQ ID NO: 560091 - DNA, 25 bp, Homo sapien
atgagcatctaagtggttgggtttt

SEQ ID NO: 560092 - DNA, 25 bp, Homo sapien
tgagcatctaagtggttgggtttta

SEQ ID NO: 560093 - DNA, 25 bp, Homo sapien
agtggttgggttttagagatcaatc

SEQ ID NO: 560094 - DNA, 25 bp, Homo sapien
gttgggttttagagatcaatcaaga

SEQ ID NO: 560095 - DNA, 25 bp, Homo sapien
gaaagcatgtattcttgatttttgt

SEQ ID NO: 560096 - DNA, 25 bp, Homo sapien
tttttgtgccttggtaaagttgata

SEQ ID NO: 560097 - DNA, 25 bp, Homo sapien
gtgccttggtaaagttgataactat

SEQ ID NO: 560098 - DNA, 25 bp, Homo sapien
gaatatttgaccaaattattccagc

SEQ ID NO: 560099 - DNA, 25 bp, Homo sapien
ttccagcatcagaataataagcaaa

SEQ ID NO: 560100 - DNA, 25 bp, Homo sapien
gttagtgttttgttagactgtttat

SEQ ID NO: 560101 - DNA, 25 bp, Homo sapien
gtgttttgttagactgtttatgaaa

SEQ ID NO: 560102 - DNA, 25 bp, Homo sapien
caattttgaatcttggtatagtgga

SEQ ID NO: 560103 - DNA, 25 bp, Homo sapien
aaggggctgtagttcttgtcttctc

SEQ ID NO: 560104 - DNA, 25 bp, Homo sapien
tcttgtcttctccatgaatattctt

SEQ ID NO: 560105 - DNA, 25 bp, Homo sapien
tttatgtgccacttctaccatctgt

SEQ ID NO: 560106 - DNA, 25 bp, Homo sapien
gtgccacttctaccatctgtgaaat

SEQ ID NO: 560107 - DNA, 25 bp, Homo sapien
cacttctaccatctgtgaaatgagg

SEQ ID NO: 560108 - DNA, 25 bp, Homo sapien
cttgaggaagtggtattagatgatc

SEQ ID NO: 560109 - DNA, 25 bp, Homo sapien
gatcattaatagtcctgtcagcata

SEQ ID NO: 560110 - DNA, 25 bp, Homo sapien
tagtcctgtcagcatattattgtag

SEQ ID NO: 560111 - DNA, 25 bp, Homo sapien
gtcagcatattattgtagggtttta

SEQ ID NO: 560112 - DNA, 25 bp, Homo sapien
attgcattttagaccataataacca

SEQ ID NO: 560113 - DNA, 25 bp, Homo sapien
cacctttgaccatcttgaagttgca

SEQ ID NO: 560114 - DNA, 25 bp, Homo sapien
tgcaaaatcctaaactgaaccattg

SEQ ID NO: 560115 - DNA, 25 bp, Homo sapien
gaaccattgtaagtcaggcaccatc

SEQ ID NO: 560116 - DNA, 25 bp, Homo sapien
aggcaccatctgtaaatgtctcata

SEQ ID NO: 560117 - DNA, 25 bp, Homo sapien
aatgtctcatatttcctactgggaa

SEQ ID NO: 560118 - DNA, 25 bp, Homo sapien
actgattttctgaaactggcactca

SEQ ID NO: 560119 - DNA, 25 bp, Homo sapien
gaaactggcactcaatttaagtcaa

SEQ ID NO: 560120 - DNA, 25 bp, Homo sapien
aaggcttgcattgctaggacttaca

SEQ ID NO: 560121 - DNA, 25 bp, Homo sapien
ttgctaggacttacagctttagtgg

SEQ ID NO: 560122 - DNA, 25 bp, Homo sapien
acagaatggtttatggatactcgaa

SEQ ID NO: 560123 - DNA, 25 bp, Homo sapien
gtttctactgaatgggaatcacctt

SEQ ID NO: 560124 - DNA, 25 bp, Homo sapien
aacagacttccattattgcattcat

SEQ ID NO: 560125 - DNA, 25 bp, Homo sapien
gacaaatactttttgagtgtctgtg

SEQ ID NO: 560126 - DNA, 25 bp, Homo sapien
ttgagtgtctgtgtcactgggcact

SEQ ID NO: 560127 - DNA, 25 bp, Homo sapien
gtctgtgtcactgggcactgtacta

SEQ ID NO: 560128 - DNA, 25 bp, Homo sapien
tgggcactgtactaccttgtaacta

SEQ ID NO: 560129 - DNA, 25 bp, Homo sapien
taccttgtaactacctaggcagtcg

SEQ ID NO: 560130 - DNA, 25 bp, Homo sapien
gaagtaccctttgtaaggccaggca

SEQ ID NO: 560131 - DNA, 25 bp, Homo sapien
ggacatgtacaaatagatggctact

SEQ ID NO: 560132 - DNA, 25 bp, Homo sapien
gatggctactgattttcagttgata

SEQ ID NO: 560133 - DNA, 25 bp, Homo sapien
gtctaattaggtgaataccatctta

SEQ ID NO: 560134 - DNA, 25 bp, Homo sapien
accatcttattctagcaagagtatc

SEQ ID NO: 560135 - DNA, 25 bp, Homo sapien
atttgaacctactccagattagtag

SEQ ID NO: 560136 - DNA, 25 bp, Homo sapien
attatctgatgttctgtggccacat

SEQ ID NO: 560137 - DNA, 25 bp, Homo sapien
tctgatgttctgtggccacatggaa

SEQ ID NO: 560138 - DNA, 25 bp, Homo sapien
atacattggtagttgcaaccagact

SEQ ID NO: 560139 - DNA, 25 bp, Homo sapien
ggtagttgcaaccagactagagtca

SEQ ID NO: 560140 - DNA, 25 bp, Homo sapien
gactagagtcaacattgagaaacca

SEQ ID NO: 560141 - DNA, 25 bp, Homo sapien
caatagaaccactaacttgggctgg

SEQ ID NO: 560142 - DNA, 25 bp, Homo sapien
actaacttgggctggtgaggcacag

SEQ ID NO: 560143 - DNA, 25 bp, Homo sapien
gaggcacagctactggtcaaaacct

SEQ ID NO: 560144 - DNA, 25 bp, Homo sapien
caggaggcccagtaccactcacagt

SEQ ID NO: 560145 - DNA, 25 bp, Homo sapien
agtaccactcacagtcaggatcggg

SEQ ID NO: 560146 - DNA, 25 bp, Homo sapien
atggttagagtgaatgcccagtttc

SEQ ID NO: 560147 - DNA, 25 bp, Homo sapien
agagtgaatgcccagtttcacatct

SEQ ID NO: 560148 - DNA, 25 bp, Homo sapien
cacatctgccttttggagtttggaa

SEQ ID NO: 560149 - DNA, 25 bp, Homo sapien
gagaagaatctcactgtgggtgata

SEQ ID NO: 560150 - DNA, 25 bp, Homo sapien
tgtgtagtttgctgtaagggccact

SEQ ID NO: 560151 - DNA, 25 bp, Homo sapien
gctgtaagggccactgatatgacaa

SEQ ID NO: 560152 - DNA, 25 bp, Homo sapien
atgacaagaatgattatcccacagt

SEQ ID NO: 560153 - DNA, 25 bp, Homo sapien
gaatgattatcccacagtaagaatg

SEQ ID NO: 560154 - DNA, 25 bp, Homo sapien
ggactgtaaatgttccctactggaa

SEQ ID NO: 560155 - DNA, 25 bp, Homo sapien
tagaaatatgtctctctccaacttt

SEQ ID NO: 560156 - DNA, 25 bp, Homo sapien
tctctccaactttccaccaaataaa

SEQ ID NO: 560157 - DNA, 25 bp, Homo sapien
aacagaatacaaaacagctaagaaa

SEQ ID NO: 560158 - DNA, 25 bp, Homo sapien
acagctaagaaaacatgccacattt

SEQ ID NO: 560159 - DNA, 25 bp, Homo sapien
gctaagaaaacatgccacattttat

SEQ ID NO: 560160 - DNA, 25 bp, Homo sapien
ccacattttattttagcattttcaa

SEQ ID NO: 560161 - DNA, 25 bp, Homo sapien
taatttgtttttggtgtaagcacag

SEQ ID NO: 560162 - DNA, 25 bp, Homo sapien
ttgtttttggtgtaagcacaggata

SEQ ID NO: 560163 - DNA, 25 bp, Homo sapien
cacaggataaaaaaggagagcgtca

SEQ ID NO: 560164 - DNA, 25 bp, Homo sapien
aagaaaagagacataacacctaaca

SEQ ID NO: 560165 - DNA, 25 bp, Homo sapien
cataacacctaacattcataaaaat

SEQ ID NO: 560166 - DNA, 25 bp, Homo sapien
ttaaaatggtactgtattagctaat

SEQ ID NO: 560167 - DNA, 25 bp, Homo sapien
tatatgtttggatttatgcattaaa

SEQ ID NO: 560168 - DNA, 25 bp, Homo sapien
taaataggccaataagtcttaaact

SEQ ID NO: 560169 - DNA, 25 bp, Homo sapien
aacttgagtacttggcttagaagaa

SEQ ID NO: 560170 - DNA, 25 bp, Homo sapien
tttgactaagtggtttgtttctggg

SEQ ID NO: 560171 - DNA, 25 bp, Homo sapien
tagcctataaggaaattgtgtcttc

SEQ ID NO: 560172 - DNA, 25 bp, Homo sapien
atctgctgaccttgttcactcatga

SEQ ID NO: 560173 - DNA, 25 bp, Homo sapien
tgctgaccttgttcactcatgaagc

SEQ ID NO: 560174 - DNA, 25 bp, Homo sapien
tgaagcatttgggtatcatacttat

SEQ ID NO: 560175 - DNA, 25 bp, Homo sapien
gggtatcatacttatagtgtctgaa

SEQ ID NO: 560176 - DNA, 25 bp, Homo sapien
taaactgtattgagctagacaaggt

SEQ ID NO: 560177 - DNA, 25 bp, Homo sapien
agacaaggtatagcctcctcttcaa

SEQ ID NO: 560178 - DNA, 25 bp, Homo sapien
tatagcctcctcttcaagtagcaaa

SEQ ID NO: 560179 - DNA, 25 bp, Homo sapien
actgttccctataacatatggtgtt

SEQ ID NO: 560180 - DNA, 25 bp, Homo sapien
taaaatgttgagaaccagagtcagg

SEQ ID NO: 560181 - DNA, 25 bp, Homo sapien
ccagagtcaggttgctacataatta

SEQ ID NO: 560182 - DNA, 25 bp, Homo sapien
attagctaacagatttcttcattgt

SEQ ID NO: 560183 - DNA, 25 bp, Homo sapien
gatttcttcattgtagtcatctgta

SEQ ID NO: 560184 - DNA, 25 bp, Homo sapien
ttcattgtagtcatctgtaaactgg

SEQ ID NO: 560185 - DNA, 25 bp, Homo sapien
aaactgggttctatatttatggtga

SEQ ID NO: 560186 - DNA, 25 bp, Homo sapien
tgatgtgaatttttatgccctttaa

SEQ ID NO: 560187 - DNA, 25 bp, Homo sapien
gtgtcattttcataatcagttggtt

SEQ ID NO: 560188 - DNA, 25 bp, Homo sapien
ggttttattcaggatccacaaagat

SEQ ID NO: 560189 - DNA, 25 bp, Homo sapien
ggatccacaaagatgtcagatgact

SEQ ID NO: 560190 - DNA, 25 bp, Homo sapien
gaccttgcaaatggtgtcataccca

SEQ ID NO: 560191 - DNA, 25 bp, Homo sapien
gtgtcatacccaggaagcttccctt

SEQ ID NO: 560192 - DNA, 25 bp, Homo sapien
ggattgtttgagataacctagctct

SEQ ID NO: 560193 - DNA, 25 bp, Homo sapien
aacctagctctttatatcttccctt

SEQ ID NO: 560194 - DNA, 25 bp, Homo sapien
gatcatagaaaggaattacgctggg

SEQ ID NO: 560195 - DNA, 25 bp, Homo sapien
gatgctttgtcgagcagaaccccaa

SEQ ID NO: 560196 - DNA, 25 bp, Homo sapien
ttgtcgagcagaaccccaatccaaa

SEQ ID NO: 560197 - DNA, 25 bp, Homo sapien
cccaatccaaacctcagcatatata

SEQ ID NO: 560198 - DNA, 25 bp, Homo sapien
aacctcagcatatatatgtcccaaa

SEQ ID NO: 560199 - DNA, 25 bp, Homo sapien
aagaaaaggtctgcactccgttggg

SEQ ID NO: 560200 - DNA, 25 bp, Homo sapien
gggtgttcgttgtgaccttgcaaat

SEQ ID NO: 560201 - DNA, 25 bp, Homo sapien
tgcccagatgacttaccgaaatgtt

SEQ ID NO: 560202 - DNA, 25 bp, Homo sapien
gatgacttaccgaaatgttacagat

SEQ ID NO: 560203 - DNA, 25 bp, Homo sapien
ggaaacaactgaactatgaccaatc

SEQ ID NO: 560204 - DNA, 25 bp, Homo sapien
actatgaccaatcccagcacggagg

SEQ ID NO: 560205 - DNA, 25 bp, Homo sapien
gcacggaggcccagaaaactttaag

SEQ ID NO: 560206 - DNA, 25 bp, Homo sapien
tattaatgtctcaaggtcaggagca

SEQ ID NO: 560207 - DNA, 25 bp, Homo sapien
ggtcaggagcaacctcaaggctaaa

SEQ ID NO: 560208 - DNA, 25 bp, Homo sapien
aaggctaaaactcagatctcaggac

SEQ ID NO: 560209 - DNA, 25 bp, Homo sapien
cagatctcaggactcaatttcacag

SEQ ID NO: 560210 - DNA, 25 bp, Homo sapien
gactcaatttcacagaagttccact

SEQ ID NO: 560211 - DNA, 25 bp, Homo sapien
gaagttccactataaaggcaataat

SEQ ID NO: 560212 - DNA, 25 bp, Homo sapien
ctggtgaggctgaagattgtcactc

SEQ ID NO: 560213 - DNA, 25 bp, Homo sapien
gattgtcactcagacccaagtgcta

SEQ ID NO: 560214 - DNA, 25 bp, Homo sapien
gaaacagtgttaagtttatcaccat

SEQ ID NO: 560215 - DNA, 25 bp, Homo sapien
gaatcttgttactgaaccaacacat

SEQ ID NO: 560216 - DNA, 25 bp, Homo sapien
gttcttggcagtgcaaatccctcaa

SEQ ID NO: 560217 - DNA, 25 bp, Homo sapien
gcaaatccctcaaaggaagtcattt

SEQ ID NO: 560218 - DNA, 25 bp, Homo sapien
aggaagtcatttcagaaactcccaa

SEQ ID NO: 560219 - DNA, 25 bp, Homo sapien
aagcccgatgtctccaaacaaggat

SEQ ID NO: 560220 - DNA, 25 bp, Homo sapien
aaccaacacattacttcatacacag

SEQ ID NO: 560221 - DNA, 25 bp, Homo sapien
atgagttcatcttcatacaaccaag

SEQ ID NO: 560222 - DNA, 25 bp, Homo sapien
gaagatctcatttcatctactggtg

SEQ ID NO: 560223 - DNA, 25 bp, Homo sapien
actttcgcttcctggccggtactgg

SEQ ID NO: 560224 - DNA, 25 bp, Homo sapien
ttcctggccggtactggaatggctg

SEQ ID NO: 560225 - DNA, 25 bp, Homo sapien
cgccctttgggttctgcatgtgttc

SEQ ID NO: 560226 - DNA, 25 bp, Homo sapien
gggtcctgccctttgtgtgtccggg

SEQ ID NO: 560227 - DNA, 25 bp, Homo sapien
gggtagtgaccttagcgtggagtgg

SEQ ID NO: 560228 - DNA, 25 bp, Homo sapien
gtgctggctgttctcattcctcttt

SEQ ID NO: 560229 - DNA, 25 bp, Homo sapien
tggctgttctcattcctctttccct

SEQ ID NO: 560230 - DNA, 25 bp, Homo sapien
ctctttcccttcttttagcaataag

SEQ ID NO: 560231 - DNA, 25 bp, Homo sapien
cccttcttttagcaataagtctggg

SEQ ID NO: 560232 - DNA, 25 bp, Homo sapien
tgcatgtgttcctggcagctgggcc

SEQ ID NO: 560233 - DNA, 25 bp, Homo sapien
tgagggcactttcgcttcctggccg

SEQ ID NO: 560234 - DNA, 25 bp, Homo sapien
gggttaccagtcagtctcctgaagg

SEQ ID NO: 560235 - DNA, 25 bp, Homo sapien
aaggtggtgatccttctatcttctc

SEQ ID NO: 560236 - DNA, 25 bp, Homo sapien
tgatccttctatcttctctagtctg

SEQ ID NO: 560237 - DNA, 25 bp, Homo sapien
ctctagtctgcctttgggatttttt

SEQ ID NO: 560238 - DNA, 25 bp, Homo sapien
gatatatctcgggtgtgccataata

SEQ ID NO: 560239 - DNA, 25 bp, Homo sapien
gggtgtgccataataataccagcta

SEQ ID NO: 560240 - DNA, 25 bp, Homo sapien
taataccagctatggagtcccaaga

SEQ ID NO: 560241 - DNA, 25 bp, Homo sapien
tggagtcccaagatgtaaacatttt

SEQ ID NO: 560242 - DNA, 25 bp, Homo sapien
agcatatagcagttctgcctcttaa

SEQ ID NO: 560243 - DNA, 25 bp, Homo sapien
taaaccacttgctacatgacccatg

SEQ ID NO: 560244 - DNA, 25 bp, Homo sapien
gacccatgaaaaccctagacttgtg

SEQ ID NO: 560245 - DNA, 25 bp, Homo sapien
gtcccagaaagacaccattggtaat

SEQ ID NO: 560246 - DNA, 25 bp, Homo sapien
ggctggtacaggatgccttaaggtg

SEQ ID NO: 560247 - DNA, 25 bp, Homo sapien
gaagaataatgagcacagggaagag

SEQ ID NO: 560248 - DNA, 25 bp, Homo sapien
agagagaagcaggacaaagtagcag

SEQ ID NO: 560249 - DNA, 25 bp, Homo sapien
aaagcacagatgaatgtcttcaaga

SEQ ID NO: 560250 - DNA, 25 bp, Homo sapien
aagaagctcttgtatttctctgcac

SEQ ID NO: 560251 - DNA, 25 bp, Homo sapien
gaagctcttgtatttctctgcacag

SEQ ID NO: 560252 - DNA, 25 bp, Homo sapien
agctcttgtatttctctgcacagtg

SEQ ID NO: 560253 - DNA, 25 bp, Homo sapien
ctcttgtatttctctgcacagtgta

SEQ ID NO: 560254 - DNA, 25 bp, Homo sapien
ttgtatttctctgcacagtgtaaat

SEQ ID NO: 560255 - DNA, 25 bp, Homo sapien
ctgcacagtgtaaatatccttgcta

SEQ ID NO: 560256 - DNA, 25 bp, Homo sapien
gggagggataattaacactacagta

SEQ ID NO: 560257 - DNA, 25 bp, Homo sapien
gtatacatgctaccatatctccagt

SEQ ID NO: 560258 - DNA, 25 bp, Homo sapien
gctaccatatctccagttggtgatt

SEQ ID NO: 560259 - DNA, 25 bp, Homo sapien
tccagttggtgatttaaagtgagct

SEQ ID NO: 560260 - DNA, 25 bp, Homo sapien
agtgagcttatgtacagtttgtggt

SEQ ID NO: 560261 - DNA, 25 bp, Homo sapien
cagtttgtggtgtatgtgttaatga

SEQ ID NO: 560262 - DNA, 25 bp, Homo sapien
gagatatttcaattcagtcagattt

SEQ ID NO: 560263 - DNA, 25 bp, Homo sapien
tggtgtttttgcaccctttttcaag

SEQ ID NO: 560264 - DNA, 25 bp, Homo sapien
atgcaagatggtactgtaacattcc

SEQ ID NO: 560265 - DNA, 25 bp, Homo sapien
tatctataaccagcctttgttaaca

SEQ ID NO: 560266 - DNA, 25 bp, Homo sapien
aagggaactgatatacttgtgtgta

SEQ ID NO: 560267 - DNA, 25 bp, Homo sapien
gcaagttccaacttctgctaaaatt

SEQ ID NO: 560268 - DNA, 25 bp, Homo sapien
ggttaattggttcctttgcatgatt

SEQ ID NO: 560269 - DNA, 25 bp, Homo sapien
gttcctttgcatgattcagggcaca

SEQ ID NO: 560270 - DNA, 25 bp, Homo sapien
cttctctgtccacaaaatttgctcg

SEQ ID NO: 560271 - DNA, 25 bp, Homo sapien
tgtccacaaaatttgctcgcctgca

SEQ ID NO: 560272 - DNA, 25 bp, Homo sapien
aggcggtatgtgttctgggctctca

SEQ ID NO: 560273 - DNA, 25 bp, Homo sapien
gttctgggctctcacgaagctaaga

SEQ ID NO: 560274 - DNA, 25 bp, Homo sapien
ggctctcacgaagctaagaaactct

SEQ ID NO: 560275 - DNA, 25 bp, Homo sapien
aagaaactctaaatccaggtgacat

SEQ ID NO: 560276 - DNA, 25 bp, Homo sapien
aaatccaggtgacatcgtggcacac

SEQ ID NO: 560277 - DNA, 25 bp, Homo sapien
caggtgacatcgtggcacaccgcca

SEQ ID NO: 560278 - DNA, 25 bp, Homo sapien
ttctcactttgatacgttaatactg

SEQ ID NO: 560279 - DNA, 25 bp, Homo sapien
ggtattcataggaaccgcggttatt

SEQ ID NO: 560280 - DNA, 25 bp, Homo sapien
aaactagcttggaccttgggctgca

SEQ ID NO: 560281 - DNA, 25 bp, Homo sapien
ttgggctgcaggacgactaggattc

SEQ ID NO: 560282 - DNA, 25 bp, Homo sapien
taggattcacccataacgacacagt

SEQ ID NO: 560283 - DNA, 25 bp, Homo sapien
taacgacacagtgccctatgtttct

SEQ ID NO: 560284 - DNA, 25 bp, Homo sapien
gtgccctatgtttcttaacttcttg

SEQ ID NO: 560285 - DNA, 25 bp, Homo sapien
tcttaacttcttgttgccatttgaa

SEQ ID NO: 560286 - DNA, 25 bp, Homo sapien
ttgccatttgaaactctgtactctt

SEQ ID NO: 560287 - DNA, 25 bp, Homo sapien
aactctgtactcttatgtttaaagg

SEQ ID NO: 560288 - DNA, 25 bp, Homo sapien
taaagggttctgtatagccattttt

SEQ ID NO: 560289 - DNA, 25 bp, Homo sapien
gctctgctcagagaactctttctct

SEQ ID NO: 560290 - DNA, 25 bp, Homo sapien
gagcctctttgaaagtgacgttaat

SEQ ID NO: 560291 - DNA, 25 bp, Homo sapien
gacgttaatgcagaggacacttcac

SEQ ID NO: 560292 - DNA, 25 bp, Homo sapien
gcagaggacacttcactgatttctt

SEQ ID NO: 560293 - DNA, 25 bp, Homo sapien
accgtgtgccttaagagaggcattc

SEQ ID NO: 560294 - DNA, 25 bp, Homo sapien
gaggcattctctctcaagccaaggg

SEQ ID NO: 560295 - DNA, 25 bp, Homo sapien
aagccaagggatcttgtccatcctg

SEQ ID NO: 560296 - DNA, 25 bp, Homo sapien
caagggatcttgtccatcctgtttt

SEQ ID NO: 560297 - DNA, 25 bp, Homo sapien
gagacattgactacctcagaggacc

SEQ ID NO: 560298 - DNA, 25 bp, Homo sapien
gccctggtgaacagggcttctgcca

SEQ ID NO: 560299 - DNA, 25 bp, Homo sapien
tgccacggccttcacagtcaaggtg

SEQ ID NO: 560300 - DNA, 25 bp, Homo sapien
ggtaaccatcactgaaaccctgtgg

SEQ ID NO: 560301 - DNA, 25 bp, Homo sapien
aaaccctgtgggaccaggtgctgac

SEQ ID NO: 560302 - DNA, 25 bp, Homo sapien
gggaccaggtgctgacagtttttaa

SEQ ID NO: 560303 - DNA, 25 bp, Homo sapien
aactgctccatgacacccatgacat

SEQ ID NO: 560304 - DNA, 25 bp, Homo sapien
gaagcataaggcctccagattcctt

SEQ ID NO: 560305 - DNA, 25 bp, Homo sapien
taaggcctccagattccttgatgac

SEQ ID NO: 560306 - DNA, 25 bp, Homo sapien
tgatgaccccaaagttgagaagatt

SEQ ID NO: 560307 - DNA, 25 bp, Homo sapien
agcagccatcaggaggccgtatcca

SEQ ID NO: 560308 - DNA, 25 bp, Homo sapien
agaaatgacctccaagcagcagaga

SEQ ID NO: 560309 - DNA, 25 bp, Homo sapien
gcagcagagaagcacatccatagaa

SEQ ID NO: 560310 - DNA, 25 bp, Homo sapien
agaagagacaatgagaccacaggaa

SEQ ID NO: 560311 - DNA, 25 bp, Homo sapien
gaaagcagagaagccgttgtgtcct

SEQ ID NO: 560312 - DNA, 25 bp, Homo sapien
cgttgtgtcctcctaaggatgcttc

SEQ ID NO: 560313 - DNA, 25 bp, Homo sapien
ggatgcttctgagaagtctcgctat

SEQ ID NO: 560314 - DNA, 25 bp, Homo sapien
gaaatagcccgtggccatggattct

SEQ ID NO: 560315 - DNA, 25 bp, Homo sapien
gccattgccaatgttctgaggacca

SEQ ID NO: 560316 - DNA, 25 bp, Homo sapien
ttctgaggaccatgagtgcttctcc

SEQ ID NO: 560317 - DNA, 25 bp, Homo sapien
tgcttctccccgtggaaattcttca

SEQ ID NO: 560318 - DNA, 25 bp, Homo sapien
ccccgtggaaattcttcagttctgt

SEQ ID NO: 560319 - DNA, 25 bp, Homo sapien
ctgtgtgtctacttgaaatgtgctt

SEQ ID NO: 560320 - DNA, 25 bp, Homo sapien
gtgcttgatgtcagcgtcctccctt

SEQ ID NO: 560321 - DNA, 25 bp, Homo sapien
gcgtcctcccttatttagaaatctc

SEQ ID NO: 560322 - DNA, 25 bp, Homo sapien
aagtttatggtttccatggagcttc

SEQ ID NO: 560323 - DNA, 25 bp, Homo sapien
tttatggtttccatggagcttctaa

SEQ ID NO: 560324 - DNA, 25 bp, Homo sapien
atctttcatccagtatgttttaaat

SEQ ID NO: 560325 - DNA, 25 bp, Homo sapien
ggtttaaagttttgatgccaatggt

SEQ ID NO: 560326 - DNA, 25 bp, Homo sapien
tgatgccaatggtctttttatgttt

SEQ ID NO: 560327 - DNA, 25 bp, Homo sapien
tgccaatggtctttttatgttttca

SEQ ID NO: 560328 - DNA, 25 bp, Homo sapien
ggatttgattaaggcgttccttggt

SEQ ID NO: 560329 - DNA, 25 bp, Homo sapien
gattaaggcgttccttggtgaagtt

SEQ ID NO: 560330 - DNA, 25 bp, Homo sapien
gttccttggtgaagttttcttcatg

SEQ ID NO: 560331 - DNA, 25 bp, Homo sapien
ttggtgaagttttcttcatgtttct

SEQ ID NO: 560332 - DNA, 25 bp, Homo sapien
atatttgaagtttatggtttccatg

SEQ ID NO: 560333 - DNA, 25 bp, Homo sapien
cttgatatctgggaccttctggaga

SEQ ID NO: 560334 - DNA, 25 bp, Homo sapien
ggaccttctggagaaaacccatgaa

SEQ ID NO: 560335 - DNA, 25 bp, Homo sapien
tgaaccagcccagtctcaaaacatt

SEQ ID NO: 560336 - DNA, 25 bp, Homo sapien
tatgatcacctacatcaaaccctgg

SEQ ID NO: 560337 - DNA, 25 bp, Homo sapien
tcaaaccctggatcttttcttctaa

SEQ ID NO: 560338 - DNA, 25 bp, Homo sapien
taaacagcaatttatagccacagct

SEQ ID NO: 560339 - DNA, 25 bp, Homo sapien
tagccacagctgattattatggaac

SEQ ID NO: 560340 - DNA, 25 bp, Homo sapien
attccttggacattaagtcgccctt

SEQ ID NO: 560341 - DNA, 25 bp, Homo sapien
agtcgcccttccaccaatgagatgg

SEQ ID NO: 560342 - DNA, 25 bp, Homo sapien
gatggcaagtgtcaaccactatttt

SEQ ID NO: 560343 - DNA, 25 bp, Homo sapien
gaagtcaagcatctggaatacgtag

SEQ ID NO: 560344 - DNA, 25 bp, Homo sapien
ttctgatatctgattttcacacgaa

SEQ ID NO: 560345 - DNA, 25 bp, Homo sapien
aatgccaagatctgggagcctcttt

SEQ ID NO: 560346 - DNA, 25 bp, Homo sapien
tcctctagacacactgcctgagata

SEQ ID NO: 560347 - DNA, 25 bp, Homo sapien
ttgcatcttattggctgtgggcaga

SEQ ID NO: 560348 - DNA, 25 bp, Homo sapien
tgtgggcagagactaggacccttat

SEQ ID NO: 560349 - DNA, 25 bp, Homo sapien
gacccttatgggtacatttcagtaa

SEQ ID NO: 560350 - DNA, 25 bp, Homo sapien
gtaatctctcactgcctaaaatggt

SEQ ID NO: 560351 - DNA, 25 bp, Homo sapien
ctgcctaaaatggtaatccctccag

SEQ ID NO: 560352 - DNA, 25 bp, Homo sapien
gaatataaccctctggagagctcaa

SEQ ID NO: 560353 - DNA, 25 bp, Homo sapien
gtaggaacctggacggtgcttgttt

SEQ ID NO: 560354 - DNA, 25 bp, Homo sapien
ggacggtgcttgtttgaattttctg

SEQ ID NO: 560355 - DNA, 25 bp, Homo sapien
tgtggttggcaatgagctctgtgct

SEQ ID NO: 560356 - DNA, 25 bp, Homo sapien
ttggcaatgagctctgtgctgtcag

SEQ ID NO: 560357 - DNA, 25 bp, Homo sapien
gtgctgtcagctttcatgagggagc

SEQ ID NO: 560358 - DNA, 25 bp, Homo sapien
tcagctttcatgagggagctccctg

SEQ ID NO: 560359 - DNA, 25 bp, Homo sapien
ggtcttcctccccatgactttgctg

SEQ ID NO: 560360 - DNA, 25 bp, Homo sapien
tcatcgcctacttcaggatcaaact

SEQ ID NO: 560361 - DNA, 25 bp, Homo sapien
tgaggttaatgaagaactgtcccag

SEQ ID NO: 560362 - DNA, 25 bp, Homo sapien
aactgtcccagaactgtgatcgcca

SEQ ID NO: 560363 - DNA, 25 bp, Homo sapien
gtgatcgccaacataatcccaagga

SEQ ID NO: 560364 - DNA, 25 bp, Homo sapien
caacataatcccaaggatggctctt

SEQ ID NO: 560365 - DNA, 25 bp, Homo sapien
gactttccaataactaaagcacaat

SEQ ID NO: 560366 - DNA, 25 bp, Homo sapien
acatgtctatgttcagaagctgcct

SEQ ID NO: 560367 - DNA, 25 bp, Homo sapien
gaagctgccttgatgccacatgcgg

SEQ ID NO: 560368 - DNA, 25 bp, Homo sapien
ccacatgcgggaggctggaaacgct

SEQ ID NO: 560369 - DNA, 25 bp, Homo sapien
tgaaggatgaccactgctcagcagc

SEQ ID NO: 560370 - DNA, 25 bp, Homo sapien
cagcagtctaccagtgatggatgag

SEQ ID NO: 560371 - DNA, 25 bp, Homo sapien
gagagttggtgcacaaataccccag

SEQ ID NO: 560372 - DNA, 25 bp, Homo sapien
cttgcctctcagtttggataatcct

SEQ ID NO: 560373 - DNA, 25 bp, Homo sapien
ggtgtgtactatgctatttctgaga

SEQ ID NO: 560374 - DNA, 25 bp, Homo sapien
gattaagccctagttacccatagtg

SEQ ID NO: 560375 - DNA, 25 bp, Homo sapien
tagacatgtttgatccgagacggaa

SEQ ID NO: 560376 - DNA, 25 bp, Homo sapien
gtgggaacacctacatgtctatgtt

SEQ ID NO: 560377 - DNA, 25 bp, Homo sapien
gaagaacaatgacctccgggagaag

SEQ ID NO: 560378 - DNA, 25 bp, Homo sapien
ccgagcaggcctgcaaggagaagct

SEQ ID NO: 560379 - DNA, 25 bp, Homo sapien
gcaaggagaagctgcactccctgac

SEQ ID NO: 560380 - DNA, 25 bp, Homo sapien
tccctgacccaggccaaggaggaat

SEQ ID NO: 560381 - DNA, 25 bp, Homo sapien
aaggaggaatcggagaagcagctct

SEQ ID NO: 560382 - DNA, 25 bp, Homo sapien
aagcagctctgtctgattgaggcgc

SEQ ID NO: 560383 - DNA, 25 bp, Homo sapien
tctgtctgattgaggcgcagaccat

SEQ ID NO: 560384 - DNA, 25 bp, Homo sapien
agaactctctgtcttggcacaacag

SEQ ID NO: 560385 - DNA, 25 bp, Homo sapien
ttggcacaacagaattacaccgagt

SEQ ID NO: 560386 - DNA, 25 bp, Homo sapien
cagaattacaccgagtggctgcagg

SEQ ID NO: 560387 - DNA, 25 bp, Homo sapien
atctcaaagagaaaggccccacgct

SEQ ID NO: 560388 - DNA, 25 bp, Homo sapien
gaagaagcccccgaggtgctctact

SEQ ID NO: 560389 - DNA, 25 bp, Homo sapien
gtgctctactgggctgtcccagtgg

SEQ ID NO: 560390 - DNA, 25 bp, Homo sapien
agtggcagcgggagtcggccttgtg

SEQ ID NO: 560391 - DNA, 25 bp, Homo sapien
tggtgggcatcatcgggacagtggt

SEQ ID NO: 560392 - DNA, 25 bp, Homo sapien
atcgggacagtggtctggaggtgca

SEQ ID NO: 560393 - DNA, 25 bp, Homo sapien
gtggccggagggaagatcctccaat

SEQ ID NO: 560394 - DNA, 25 bp, Homo sapien
gatcctccaatgagcctgcgcactg

SEQ ID NO: 560395 - DNA, 25 bp, Homo sapien
aatgagcctgcgcactgtggccctc

SEQ ID NO: 560396 - DNA, 25 bp, Homo sapien
gagcctgcgcactgtggccctctag

SEQ ID NO: 560397 - DNA, 25 bp, Homo sapien
ggtcctcaccctaaactccctatag

SEQ ID NO: 560398 - DNA, 25 bp, Homo sapien
aggacatgcttcaatgcctggtgcc

SEQ ID NO: 560399 - DNA, 25 bp, Homo sapien
gggactccccgaaggcagaaataag

SEQ ID NO: 560400 - DNA, 25 bp, Homo sapien
gtttctaaaaataggcagcggcctg

SEQ ID NO: 560401 - DNA, 25 bp, Homo sapien
ggaagaaactcctggtcctttcgct

SEQ ID NO: 560402 - DNA, 25 bp, Homo sapien
ttcgcttttaaggaacgtgccacct

SEQ ID NO: 560403 - DNA, 25 bp, Homo sapien
acgtgccacctagacaagtgttcca

SEQ ID NO: 560404 - DNA, 25 bp, Homo sapien
aagtgttccagcctccggtgaacca

SEQ ID NO: 560405 - DNA, 25 bp, Homo sapien
cagtcttcctagtgagagcacgaga

SEQ ID NO: 560406 - DNA, 25 bp, Homo sapien
agagcacgagaagcccgttgtcctt

SEQ ID NO: 560407 - DNA, 25 bp, Homo sapien
attcctcagctatggatttccctga

SEQ ID NO: 560408 - DNA, 25 bp, Homo sapien
gaactgaccatattctcgatgcctc

SEQ ID NO: 560409 - DNA, 25 bp, Homo sapien
gggcctagagttactcgggctcccg

SEQ ID NO: 560410 - DNA, 25 bp, Homo sapien
acacactcatactctgcacatcttg

SEQ ID NO: 560411 - DNA, 25 bp, Homo sapien
actctgcacatcttggctacattaa

SEQ ID NO: 560412 - DNA, 25 bp, Homo sapien
aggcactatgaaggtagaacactac

SEQ ID NO: 560413 - DNA, 25 bp, Homo sapien
tatcctagtcagaagcctgatttaa

SEQ ID NO: 560414 - DNA, 25 bp, Homo sapien
gaagcctgatttaacactgaacttt

SEQ ID NO: 560415 - DNA, 25 bp, Homo sapien
acactgaactttgaagggaagctta

SEQ ID NO: 560416 - DNA, 25 bp, Homo sapien
gaagcttagctgtagctcatggctt

SEQ ID NO: 560417 - DNA, 25 bp, Homo sapien
agctgtagctcatggctttcaaaga

SEQ ID NO: 560418 - DNA, 25 bp, Homo sapien
acatttactggttctatggaaaata

SEQ ID NO: 560419 - DNA, 25 bp, Homo sapien
gaaaatagtcttcttgctaggtaga

SEQ ID NO: 560420 - DNA, 25 bp, Homo sapien
aaattgcattggtggtgttaaaatc

SEQ ID NO: 560421 - DNA, 25 bp, Homo sapien
gggaagcttcttcacccgcttgtcc

SEQ ID NO: 560422 - DNA, 25 bp, Homo sapien
ttcttcacccgcttgtccatgtctg

SEQ ID NO: 560423 - DNA, 25 bp, Homo sapien
cctgcagccgcttgtggatgttgtg

SEQ ID NO: 560424 - DNA, 25 bp, Homo sapien
ttggccggctccagccgctgttcta

SEQ ID NO: 560425 - DNA, 25 bp, Homo sapien
agccgctgttctacctgcagcaggt

SEQ ID NO: 560426 - DNA, 25 bp, Homo sapien
cgctgttctacctgcagcaggtcct

SEQ ID NO: 560427 - DNA, 25 bp, Homo sapien
agcaggtcctcacccaggaactcag

SEQ ID NO: 560428 - DNA, 25 bp, Homo sapien
acccaggaactcagcggtctccggg

SEQ ID NO: 560429 - DNA, 25 bp, Homo sapien
gggtgcgtcccaagctgcccgtctg

SEQ ID NO: 560430 - DNA, 25 bp, Homo sapien
gtctgggccagctgccgcatgcggt

SEQ ID NO: 560431 - DNA, 25 bp, Homo sapien
tgccgcatgcggtgcagctgcctct

SEQ ID NO: 560432 - DNA, 25 bp, Homo sapien
tcttcagttttacaatagttgggaa

SEQ ID NO: 560433 - DNA, 25 bp, Homo sapien
attgttttgtttcatctgtgttcct

SEQ ID NO: 560434 - DNA, 25 bp, Homo sapien
ttcatctgtgttccttttctcttgg

SEQ ID NO: 560435 - DNA, 25 bp, Homo sapien
ttttctcttggattccacatggcat

SEQ ID NO: 560436 - DNA, 25 bp, Homo sapien
tggattccacatggcatcatgtaat

SEQ ID NO: 560437 - DNA, 25 bp, Homo sapien
catgtaatcaattttttgctgcctt

SEQ ID NO: 560438 - DNA, 25 bp, Homo sapien
tgctgccttgcactgattgctcaca

SEQ ID NO: 560439 - DNA, 25 bp, Homo sapien
ttgctcacagtctcatatgttgctt

SEQ ID NO: 560440 - DNA, 25 bp, Homo sapien
tcatatgttgcttctccaaactaac

SEQ ID NO: 560441 - DNA, 25 bp, Homo sapien
tcactctcaacactccttatttttc

SEQ ID NO: 560442 - DNA, 25 bp, Homo sapien
atttttcagtgtttggtgctttgag

SEQ ID NO: 560443 - DNA, 25 bp, Homo sapien
tcctctacctcagatgcattttggc

SEQ ID NO: 560444 - DNA, 25 bp, Homo sapien
tggctggaagattgtgcccaagttg

SEQ ID NO: 560445 - DNA, 25 bp, Homo sapien
gggtaaagcccaactggtatcaaag

SEQ ID NO: 560446 - DNA, 25 bp, Homo sapien
gttggttagcaaatctgtggtcata

SEQ ID NO: 560447 - DNA, 25 bp, Homo sapien
ggtcatatgagcatttatcttgcag

SEQ ID NO: 560448 - DNA, 25 bp, Homo sapien
gttttgtgcctcaccaggcacaagt

SEQ ID NO: 560449 - DNA, 25 bp, Homo sapien
accaggcacaagtttgctgtactta

SEQ ID NO: 560450 - DNA, 25 bp, Homo sapien
gctgtacttatcaaggactgtctgt

SEQ ID NO: 560451 - DNA, 25 bp, Homo sapien
caaggactgtctgtagactcaccaa

SEQ ID NO: 560452 - DNA, 25 bp, Homo sapien
gggccccttctccatactggataat

SEQ ID NO: 560453 - DNA, 25 bp, Homo sapien
aagacaatgaaagctcttcctcctc

SEQ ID NO: 560454 - DNA, 25 bp, Homo sapien
ttaatctaggcagtctcattatttt

SEQ ID NO: 560455 - DNA, 25 bp, Homo sapien
ttatgtttccaaataagacccagga

SEQ ID NO: 560456 - DNA, 25 bp, Homo sapien
agacccaggaacactgatagtttac

SEQ ID NO: 560457 - DNA, 25 bp, Homo sapien
aacactgatagtttacagatccaag

SEQ ID NO: 560458 - DNA, 25 bp, Homo sapien
acagatccaagaatcttttgagaat

SEQ ID NO: 560459 - DNA, 25 bp, Homo sapien
ttggttttgcagattaagaggtaag

SEQ ID NO: 560460 - DNA, 25 bp, Homo sapien
aagaggtaagttcttattttcattg

SEQ ID NO: 560461 - DNA, 25 bp, Homo sapien
ttttcattgttgtttgctgtttcac

SEQ ID NO: 560462 - DNA, 25 bp, Homo sapien
tgttgtttgctgtttcactagagaa

SEQ ID NO: 560463 - DNA, 25 bp, Homo sapien
gtttgctgtttcactagagaaaact

SEQ ID NO: 560464 - DNA, 25 bp, Homo sapien
aagaccctcctccaacactgaggat

SEQ ID NO: 560465 - DNA, 25 bp, Homo sapien
agtgttactgaatatcacctgcaca

SEQ ID NO: 560466 - DNA, 25 bp, Homo sapien
tgaatatcacctgcacaacctttac

SEQ ID NO: 560467 - DNA, 25 bp, Homo sapien
gcacaacctttactgcttgcagttt

SEQ ID NO: 560468 - DNA, 25 bp, Homo sapien
ttttttcctgttgctttgtacatga

SEQ ID NO: 560469 - DNA, 25 bp, Homo sapien
gttgctttgtacatgatccgttatt

SEQ ID NO: 560470 - DNA, 25 bp, Homo sapien
gatccgttattcaaatggccttata

SEQ ID NO: 560471 - DNA, 25 bp, Homo sapien
tcaaatggccttataggcattcaat

SEQ ID NO: 560472 - DNA, 25 bp, Homo sapien
agatctgataaatggaactttgtga

SEQ ID NO: 560473 - DNA, 25 bp, Homo sapien
gtcacatatagctattgaacctttg

SEQ ID NO: 560474 - DNA, 25 bp, Homo sapien
tgaacctttgaatcatggctagttt

SEQ ID NO: 560475 - DNA, 25 bp, Homo sapien
gaatcatggctagttttagagtttt

SEQ ID NO: 560476 - DNA, 25 bp, Homo sapien
agtatttaacttcctctggagggcg

SEQ ID NO: 560477 - DNA, 25 bp, Homo sapien
ggaatacatcctcactgacatacgg

SEQ ID NO: 560478 - DNA, 25 bp, Homo sapien
catacggaagggacacatgtgcaat

SEQ ID NO: 560479 - DNA, 25 bp, Homo sapien
atgtgcaatgcaaagctcctgagaa

SEQ ID NO: 560480 - DNA, 25 bp, Homo sapien
gagaaacatgccagagttctccggg

SEQ ID NO: 560481 - DNA, 25 bp, Homo sapien
cctctgagatggtccatttcattca

SEQ ID NO: 560482 - DNA, 25 bp, Homo sapien
ggtccatttcattcatcagatgcag

SEQ ID NO: 560483 - DNA, 25 bp, Homo sapien
atgcagtattacatcacatttgagg

SEQ ID NO: 560484 - DNA, 25 bp, Homo sapien
cacatttgaggtgcttgaatgttct

SEQ ID NO: 560485 - DNA, 25 bp, Homo sapien
tcttgggatgagctttggaacaaag

SEQ ID NO: 560486 - DNA, 25 bp, Homo sapien
ggcccaggatttggatcacatcatt

SEQ ID NO: 560487 - DNA, 25 bp, Homo sapien
ggaagtcactaaatctcagcccgaa

SEQ ID NO: 560488 - DNA, 25 bp, Homo sapien
atctcagcccgaaaagtgggatgaa

SEQ ID NO: 560489 - DNA, 25 bp, Homo sapien
atgaagaggcccaagatgctgcagg

SEQ ID NO: 560490 - DNA, 25 bp, Homo sapien
gaactccaaagggacctagacgcag

SEQ ID NO: 560491 - DNA, 25 bp, Homo sapien
ccaaagggacctagacgcagcagag

SEQ ID NO: 560492 - DNA, 25 bp, Homo sapien
gacctagacgcagcagaggtgaagc

SEQ ID NO: 560493 - DNA, 25 bp, Homo sapien
ggtgaagccaagaaaatccagatgc

SEQ ID NO: 560494 - DNA, 25 bp, Homo sapien
aggccgcagaggagaagctctcaga

SEQ ID NO: 560495 - DNA, 25 bp, Homo sapien
ggaaccagacgcagaggaaccggcc

SEQ ID NO: 560496 - DNA, 25 bp, Homo sapien
gaggaaccggccacagaagaaccga

SEQ ID NO: 560497 - DNA, 25 bp, Homo sapien
gccacagaagaaccgaccgcacagg

SEQ ID NO: 560498 - DNA, 25 bp, Homo sapien
tccatgaccagcgtgtgcgcagggc

SEQ ID NO: 560499 - DNA, 25 bp, Homo sapien
catgaccagcgtgtgcgcagggcct

SEQ ID NO: 560500 - DNA, 25 bp, Homo sapien
gtccccgactgccattggcaacagt

SEQ ID NO: 560501 - DNA, 25 bp, Homo sapien
gactgccattggcaacagtggccct

SEQ ID NO: 560502 - DNA, 25 bp, Homo sapien
gccattggcaacagtggccctgcag

SEQ ID NO: 560503 - DNA, 25 bp, Homo sapien
cacccaggttttcggcccagtgaag

SEQ ID NO: 560504 - DNA, 25 bp, Homo sapien
tttcggcccagtgaagaggccactg

SEQ ID NO: 560505 - DNA, 25 bp, Homo sapien
ctcccaggcaggtgttttatgttca

SEQ ID NO: 560506 - DNA, 25 bp, Homo sapien
cccaggcaggtgttttatgttcagc

SEQ ID NO: 560507 - DNA, 25 bp, Homo sapien
caggcaggtgttttatgttcagcaa

SEQ ID NO: 560508 - DNA, 25 bp, Homo sapien
gcaggtgttttatgttcagcaataa

SEQ ID NO: 560509 - DNA, 25 bp, Homo sapien
tcaaattctgagtccctgactggtg

SEQ ID NO: 560510 - DNA, 25 bp, Homo sapien
aagactttctagtgtcattttcaga

SEQ ID NO: 560511 - DNA, 25 bp, Homo sapien
attttcagaacttagccttctcaag

SEQ ID NO: 560512 - DNA, 25 bp, Homo sapien
gaagcttgtgaaggaacctgtggcc

SEQ ID NO: 560513 - DNA, 25 bp, Homo sapien
tggccaggccaagatctgccttaga

SEQ ID NO: 560514 - DNA, 25 bp, Homo sapien
ttagaccttctctcctagtgcatgt

SEQ ID NO: 560515 - DNA, 25 bp, Homo sapien
ctcctagtgcatgttcaggatgtca

SEQ ID NO: 560516 - DNA, 25 bp, Homo sapien
caggatgtcatcgaagtaccagact

SEQ ID NO: 560517 - DNA, 25 bp, Homo sapien
agtaccagacttcctctcaggttct

SEQ ID NO: 560518 - DNA, 25 bp, Homo sapien
aggttctctgcacatcctcagtgga

SEQ ID NO: 560519 - DNA, 25 bp, Homo sapien
gtggacctgtctttcagaagtgcca

SEQ ID NO: 560520 - DNA, 25 bp, Homo sapien
taagtgacttgccttagtgcacacc

SEQ ID NO: 560521 - DNA, 25 bp, Homo sapien
cagaaagtgacagcaccagcatttg

SEQ ID NO: 560522 - DNA, 25 bp, Homo sapien
aacagcctctctgaggcgaagtgga

SEQ ID NO: 560523 - DNA, 25 bp, Homo sapien
accagcatttgaaccctgacacaag

SEQ ID NO: 560524 - DNA, 25 bp, Homo sapien
cctgacacaagcatctccaaaactg

SEQ ID NO: 560525 - DNA, 25 bp, Homo sapien
aaactgcattcttcccactgtgcca

SEQ ID NO: 560526 - DNA, 25 bp, Homo sapien
agttaagatgagtccaccagccctg

SEQ ID NO: 560527 - DNA, 25 bp, Homo sapien
gtccaccagccctgtttagactttg

SEQ ID NO: 560528 - DNA, 25 bp, Homo sapien
tagactttggtgtttgaactgcgtt

SEQ ID NO: 560529 - DNA, 25 bp, Homo sapien
gtttgaactgcgttttgaaggcaaa

SEQ ID NO: 560530 - DNA, 25 bp, Homo sapien
gaagagtgagtagatcagctggata

SEQ ID NO: 560531 - DNA, 25 bp, Homo sapien
aacctatgaagaaacatcgcgttgt

SEQ ID NO: 560532 - DNA, 25 bp, Homo sapien
atcgcgttgtcattggaacttccaa

SEQ ID NO: 560533 - DNA, 25 bp, Homo sapien
gaacttccaagcctttgctgttaag

SEQ ID NO: 560534 - DNA, 25 bp, Homo sapien
agcctttgctgttaagagccaggtt

SEQ ID NO: 560535 - DNA, 25 bp, Homo sapien
gagccaggttcttaaatcaacccgc

SEQ ID NO: 560536 - DNA, 25 bp, Homo sapien
gccccacacacatgttgcttacatg

SEQ ID NO: 560537 - DNA, 25 bp, Homo sapien
gttgcttacatgctgcgttttctca

SEQ ID NO: 560538 - DNA, 25 bp, Homo sapien
cttacatgctgcgttttctcacggt

SEQ ID NO: 560539 - DNA, 25 bp, Homo sapien
tcaacagctgggagattaatcaacc

SEQ ID NO: 560540 - DNA, 25 bp, Homo sapien
gggagattaatcaaccacactgaaa

SEQ ID NO: 560541 - DNA, 25 bp, Homo sapien
ataacttagttattgacctggagac

SEQ ID NO: 560542 - DNA, 25 bp, Homo sapien
ctagttccctgcaacacagggcaga

SEQ ID NO: 560543 - DNA, 25 bp, Homo sapien
cagaagaggaatggattcccaccac

SEQ ID NO: 560544 - DNA, 25 bp, Homo sapien
tcccaccactgcaagtcctggtgtg

SEQ ID NO: 560545 - DNA, 25 bp, Homo sapien
gggctcccaatagcttaaacacaac

SEQ ID NO: 560546 - DNA, 25 bp, Homo sapien
cctggagttgagaccttcttagttc

SEQ ID NO: 560547 - DNA, 25 bp, Homo sapien
gttgagaccttcttagttctcctgg

SEQ ID NO: 560548 - DNA, 25 bp, Homo sapien
gaccttcttagttctcctggccaaa

SEQ ID NO: 560549 - DNA, 25 bp, Homo sapien
ggccttcctcttccaggcggttctt

SEQ ID NO: 560550 - DNA, 25 bp, Homo sapien
aggcggttcttcacctctgatcatc

SEQ ID NO: 560551 - DNA, 25 bp, Homo sapien
gatcatctccgaggcccaagggcta

SEQ ID NO: 560552 - DNA, 25 bp, Homo sapien
ccaggagttcctgcatctggtaggg

SEQ ID NO: 560553 - DNA, 25 bp, Homo sapien
cacacagcctagctggcttgtctag

SEQ ID NO: 560554 - DNA, 25 bp, Homo sapien
ggcttgtctagactcttctaggcat

SEQ ID NO: 560555 - DNA, 25 bp, Homo sapien
gacattatgtcttgttttcctgact

SEQ ID NO: 560556 - DNA, 25 bp, Homo sapien
ttgggttttgtttctcactgtgtct

SEQ ID NO: 560557 - DNA, 25 bp, Homo sapien
tgtcttctccggctatcatatatgt

SEQ ID NO: 560558 - DNA, 25 bp, Homo sapien
ggctatcatatatgtcccctgaatc

SEQ ID NO: 560559 - DNA, 25 bp, Homo sapien
atgtcccctgaatctcatagtgagc

SEQ ID NO: 560560 - DNA, 25 bp, Homo sapien
tctcatagtgagctgccaaatttga

SEQ ID NO: 560561 - DNA, 25 bp, Homo sapien
tttgaagtgcatcacccagttgtct

SEQ ID NO: 560562 - DNA, 25 bp, Homo sapien
atcacccagttgtctgcatctggaa

SEQ ID NO: 560563 - DNA, 25 bp, Homo sapien
gaaccagtcaagcagtggctgtagt

SEQ ID NO: 560564 - DNA, 25 bp, Homo sapien
attctcttgaattgaacagcttcaa

SEQ ID NO: 560565 - DNA, 25 bp, Homo sapien
ctctgtgacttcatgacttgttgga

SEQ ID NO: 560566 - DNA, 25 bp, Homo sapien
gaagatgttccagcttatagcccca

SEQ ID NO: 560567 - DNA, 25 bp, Homo sapien
gccccagctaaggtttcaactaata

SEQ ID NO: 560568 - DNA, 25 bp, Homo sapien
ggtttcaactaatagccagactcaa

SEQ ID NO: 560569 - DNA, 25 bp, Homo sapien
gccagactcaaccaccaggtatatg

SEQ ID NO: 560570 - DNA, 25 bp, Homo sapien
gaaccttcagatgattctagtctcc

SEQ ID NO: 560571 - DNA, 25 bp, Homo sapien
atgattctagtctccagccttcaag

SEQ ID NO: 560572 - DNA, 25 bp, Homo sapien
aagcttccccagtcgatgctgagtg

SEQ ID NO: 560573 - DNA, 25 bp, Homo sapien
aattattctcactgagccctgtcca

SEQ ID NO: 560574 - DNA, 25 bp, Homo sapien
actgagccctgtccaaattgcaaat

SEQ ID NO: 560575 - DNA, 25 bp, Homo sapien
gcattgccagcaagggtcccagcag

SEQ ID NO: 560576 - DNA, 25 bp, Homo sapien
gtgctcgccacaactgctaccggga

SEQ ID NO: 560577 - DNA, 25 bp, Homo sapien
aactgctaccgggagctgcacaacg

SEQ ID NO: 560578 - DNA, 25 bp, Homo sapien
taccgggagctgcacaacgcctgga

SEQ ID NO: 560579 - DNA, 25 bp, Homo sapien
acaacgcctggagcgtgcgccagga

SEQ ID NO: 560580 - DNA, 25 bp, Homo sapien
ggcaccaggactcatgcccctttga

SEQ ID NO: 560581 - DNA, 25 bp, Homo sapien
tgctgtccctcctgcggcgtgtgcg

SEQ ID NO: 560582 - DNA, 25 bp, Homo sapien
gctggaccaagccaccagtgtcgtt

SEQ ID NO: 560583 - DNA, 25 bp, Homo sapien
gactcatgcccctttgagctaacgg

SEQ ID NO: 560584 - DNA, 25 bp, Homo sapien
gagctaacggcctgccccaacgagg

SEQ ID NO: 560585 - DNA, 25 bp, Homo sapien
aacgagggctgcacctcgcaggtgc

SEQ ID NO: 560586 - DNA, 25 bp, Homo sapien
gagatggagtccaggtgtcgtcctc

SEQ ID NO: 560587 - DNA, 25 bp, Homo sapien
atggagtccaggtgtcgtcctcact

SEQ ID NO: 560588 - DNA, 25 bp, Homo sapien
tcacttgggccgtgtgtctctgggc

SEQ ID NO: 560589 - DNA, 25 bp, Homo sapien
agtgggtctaataacagttcttgcc

SEQ ID NO: 560590 - DNA, 25 bp, Homo sapien
gggtctaataacagttcttgccctc

SEQ ID NO: 560591 - DNA, 25 bp, Homo sapien
tcaccaaggtaaagactgggccctc

SEQ ID NO: 560592 - DNA, 25 bp, Homo sapien
ttaaatgggccaaatcatatgaggg

SEQ ID NO: 560593 - DNA, 25 bp, Homo sapien
agagacgggtcccttcagtggccac

SEQ ID NO: 560594 - DNA, 25 bp, Homo sapien
gggtcccttcagtggccacgaacat

SEQ ID NO: 560595 - DNA, 25 bp, Homo sapien
gtggccacgaacattttggtcacga

SEQ ID NO: 560596 - DNA, 25 bp, Homo sapien
acattttggtcacgagatggagtcc

SEQ ID NO: 560597 - DNA, 25 bp, Homo sapien
gttctgcaaagtcttacacaaaagc

SEQ ID NO: 560598 - DNA, 25 bp, Homo sapien
gtcttacacaaaagcccaatacagt

SEQ ID NO: 560599 - DNA, 25 bp, Homo sapien
cacaaaagcccaatacagtacatga

SEQ ID NO: 560600 - DNA, 25 bp, Homo sapien
gcccaatacagtacatgaactacgg

SEQ ID NO: 560601 - DNA, 25 bp, Homo sapien
tacagtacatgaactacggaaaagc

SEQ ID NO: 560602 - DNA, 25 bp, Homo sapien
tgaactacggaaaagcagaactgct

SEQ ID NO: 560603 - DNA, 25 bp, Homo sapien
aagcagaactgctctgaacaaggaa

SEQ ID NO: 560604 - DNA, 25 bp, Homo sapien
aagaggtgggagatctgagtcctgg

SEQ ID NO: 560605 - DNA, 25 bp, Homo sapien
ttcaacttcagtcacctccttggaa

SEQ ID NO: 560606 - DNA, 25 bp, Homo sapien
aacttcagtcacctccttggaatct

SEQ ID NO: 560607 - DNA, 25 bp, Homo sapien
cttcagtcacctccttggaatctgg

SEQ ID NO: 560608 - DNA, 25 bp, Homo sapien
ctgcacgggcacttcatgctgcatg

SEQ ID NO: 560609 - DNA, 25 bp, Homo sapien
tgcacgggcacttcatgctgcatgc

SEQ ID NO: 560610 - DNA, 25 bp, Homo sapien
acgggcacttcatgctgcatgcccg

SEQ ID NO: 560611 - DNA, 25 bp, Homo sapien
aaattggggttgtgacagtggtcat

SEQ ID NO: 560612 - DNA, 25 bp, Homo sapien
gggtactgccggtctgtgttgtctt

SEQ ID NO: 560613 - DNA, 25 bp, Homo sapien
gtactgccggtctgtgttgtcttag

SEQ ID NO: 560614 - DNA, 25 bp, Homo sapien
actgccggtctgtgttgtcttagaa

SEQ ID NO: 560615 - DNA, 25 bp, Homo sapien
tgccggtctgtgttgtcttagaagt

SEQ ID NO: 560616 - DNA, 25 bp, Homo sapien
gccggtctgtgttgtcttagaagta

SEQ ID NO: 560617 - DNA, 25 bp, Homo sapien
cggtctgtgttgtcttagaagtaga

SEQ ID NO: 560618 - DNA, 25 bp, Homo sapien
gtctgtgttgtcttagaagtagatg

SEQ ID NO: 560619 - DNA, 25 bp, Homo sapien
aatgcccaccagacgcaaagataca

SEQ ID NO: 560620 - DNA, 25 bp, Homo sapien
cccaccagacgcaaagatacacttt

SEQ ID NO: 560621 - DNA, 25 bp, Homo sapien
tttggactgtgaacatggaagcctc

SEQ ID NO: 560622 - DNA, 25 bp, Homo sapien
actgtgaacatggaagcctcagcct

SEQ ID NO: 560623 - DNA, 25 bp, Homo sapien
gaacatggaagcctcagcctgaatg

SEQ ID NO: 560624 - DNA, 25 bp, Homo sapien
atggaagcctcagcctgaatgtgag

SEQ ID NO: 560625 - DNA, 25 bp, Homo sapien
aatgcagctgttgttagacaactgt

SEQ ID NO: 560626 - DNA, 25 bp, Homo sapien
agacaactgttgaaaactccagaaa

SEQ ID NO: 560627 - DNA, 25 bp, Homo sapien
aaactccagaaatacatcacccaag

SEQ ID NO: 560628 - DNA, 25 bp, Homo sapien
tacatcacccaaggtggcagttctc

SEQ ID NO: 560629 - DNA, 25 bp, Homo sapien
atatcatattttttacaaggaacat

SEQ ID NO: 560630 - DNA, 25 bp, Homo sapien
tgagcagccctgtacagtggccact

SEQ ID NO: 560631 - DNA, 25 bp, Homo sapien
tttccctggtagtaggtgacacatc

SEQ ID NO: 560632 - DNA, 25 bp, Homo sapien
gtgacacatctacaaggtggcccca

SEQ ID NO: 560633 - DNA, 25 bp, Homo sapien
agccttcagccctagagtctgactg

SEQ ID NO: 560634 - DNA, 25 bp, Homo sapien
ctagagtctgactgccctggtccaa

SEQ ID NO: 560635 - DNA, 25 bp, Homo sapien
gggcccatgcaccctgttgacattc

SEQ ID NO: 560636 - DNA, 25 bp, Homo sapien
ggacaatttaggcaggaaccgcaca

SEQ ID NO: 560637 - DNA, 25 bp, Homo sapien
ggaaccgcacactgctatgacatat

SEQ ID NO: 560638 - DNA, 25 bp, Homo sapien
accgcacactgctatgacatatcca

SEQ ID NO: 560639 - DNA, 25 bp, Homo sapien
gtgctttctcgaggagtgatgtccc

SEQ ID NO: 560640 - DNA, 25 bp, Homo sapien
tctcgaggagtgatgtcccataccc

SEQ ID NO: 560641 - DNA, 25 bp, Homo sapien
gcgtcgatctggtgcaggttgtccc

SEQ ID NO: 560642 - DNA, 25 bp, Homo sapien
tcgatctggtgcaggttgtcccggt

SEQ ID NO: 560643 - DNA, 25 bp, Homo sapien
ggtgcaggttgtcccggtgcggtgt

SEQ ID NO: 560644 - DNA, 25 bp, Homo sapien
tgtcccggtgcggtgtgaggatgca

SEQ ID NO: 560645 - DNA, 25 bp, Homo sapien
gcctcggtgtactcggcccgcgaac

SEQ ID NO: 560646 - DNA, 25 bp, Homo sapien
gcccgcgtctagcttgtccatgcag

SEQ ID NO: 560647 - DNA, 25 bp, Homo sapien
gcgtctagcttgtccatgcagctga

SEQ ID NO: 560648 - DNA, 25 bp, Homo sapien
cgtctagcttgtccatgcagctgat

SEQ ID NO: 560649 - DNA, 25 bp, Homo sapien
aggaaggcggcaggcccttccacgg

SEQ ID NO: 560650 - DNA, 25 bp, Homo sapien
ttccacggcgtcgatctggtgcagg

SEQ ID NO: 560651 - DNA, 25 bp, Homo sapien
ccacggcgtcgatctggtgcaggtt

SEQ ID NO: 560652 - DNA, 25 bp, Homo sapien
gacttggattgacttctgaatatat

SEQ ID NO: 560653 - DNA, 25 bp, Homo sapien
atattgcttatcagtcagggtgttg

SEQ ID NO: 560654 - DNA, 25 bp, Homo sapien
gtcagggtgttgaatgcctggcact

SEQ ID NO: 560655 - DNA, 25 bp, Homo sapien
cagtggaacttcataccggtgtgtc

SEQ ID NO: 560656 - DNA, 25 bp, Homo sapien
ataccggtgtgtctaagggcaaaat

SEQ ID NO: 560657 - DNA, 25 bp, Homo sapien
ggaaccgtagtgttctgactttaga

SEQ ID NO: 560658 - DNA, 25 bp, Homo sapien
agaatgtaacatgcactccagtcat

SEQ ID NO: 560659 - DNA, 25 bp, Homo sapien
gtcatgatcagtgaagccctgtgca

SEQ ID NO: 560660 - DNA, 25 bp, Homo sapien
cctgtgcatgcggtttgatttggtt

SEQ ID NO: 560661 - DNA, 25 bp, Homo sapien
gatttggttttacttctctacacgt

SEQ ID NO: 560662 - DNA, 25 bp, Homo sapien
ttttacttctctacacgtctgtgct

SEQ ID NO: 560663 - DNA, 25 bp, Homo sapien
caggaagccagtgagtagtaattac

SEQ ID NO: 560664 - DNA, 25 bp, Homo sapien
cagagaactggtcatcttccgtgtc

SEQ ID NO: 560665 - DNA, 25 bp, Homo sapien
tcttccgtgtcctacctagtggcaa

SEQ ID NO: 560666 - DNA, 25 bp, Homo sapien
gtacagctgagatttataccctcct

SEQ ID NO: 560667 - DNA, 25 bp, Homo sapien
aatggatgaaacagacaggctatta

SEQ ID NO: 560668 - DNA, 25 bp, Homo sapien
cttttaaccctcacatccttcaaat

SEQ ID NO: 560669 - DNA, 25 bp, Homo sapien
aatcaggatctcttattatcaaatt

SEQ ID NO: 560670 - DNA, 25 bp, Homo sapien
atccttcaaatggatgtctccaggc

SEQ ID NO: 560671 - DNA, 25 bp, Homo sapien
ttatcaaattattgccttggccaca

SEQ ID NO: 560672 - DNA, 25 bp, Homo sapien
attgccttggccacagtgaggctga

SEQ ID NO: 560673 - DNA, 25 bp, Homo sapien
ttatcaagctgctcaggaagccagt

SEQ ID NO: 560674 - DNA, 25 bp, Homo sapien
acaattaaccccattcagatcgtcc

SEQ ID NO: 560675 - DNA, 25 bp, Homo sapien
agatcgtccgctactggaactacag

SEQ ID NO: 560676 - DNA, 25 bp, Homo sapien
gtccgctactggaactacagtcata

SEQ ID NO: 560677 - DNA, 25 bp, Homo sapien
tggaactacagtcatagcgccccac

SEQ ID NO: 560678 - DNA, 25 bp, Homo sapien
atagcgccccacaggatgacctcat

SEQ ID NO: 560679 - DNA, 25 bp, Homo sapien
tgccatgctcaatcccaaagtccag

SEQ ID NO: 560680 - DNA, 25 bp, Homo sapien
caagaaaacagtggccgacaccctg

SEQ ID NO: 560681 - DNA, 25 bp, Homo sapien
tggccgacaccctgacttgcggcag

SEQ ID NO: 560682 - DNA, 25 bp, Homo sapien
ccccgtgatgtctgatcgagaatgc

SEQ ID NO: 560683 - DNA, 25 bp, Homo sapien
gtctgatcgagaatgccaaaaaaca

SEQ ID NO: 560684 - DNA, 25 bp, Homo sapien
aaagccacaggaattccttatgtgt

SEQ ID NO: 560685 - DNA, 25 bp, Homo sapien
tccatcacttgcaaaatgaattcat

SEQ ID NO: 560686 - DNA, 25 bp, Homo sapien
taaatgagacatttctgcttagatt

SEQ ID NO: 560687 - DNA, 25 bp, Homo sapien
tgagacatttctgcttagatttttt

SEQ ID NO: 560688 - DNA, 25 bp, Homo sapien
gtgtaggaagctgctgtacaattaa

SEQ ID NO: 560689 - DNA, 25 bp, Homo sapien
gaagctgctgtacaattaacttgga

SEQ ID NO: 560690 - DNA, 25 bp, Homo sapien
gctgtacaattaacttggagatctg

SEQ ID NO: 560691 - DNA, 25 bp, Homo sapien
gatctgaaaatgctttttgtcctca

SEQ ID NO: 560692 - DNA, 25 bp, Homo sapien
aaaatgctttttgtcctcattgttg

SEQ ID NO: 560693 - DNA, 25 bp, Homo sapien
gtcctcattgttgcagtttcaattg

SEQ ID NO: 560694 - DNA, 25 bp, Homo sapien
gttgcagtttcaattgtaatccatt

SEQ ID NO: 560695 - DNA, 25 bp, Homo sapien
gtttcaattgtaatccattgcatct

SEQ ID NO: 560696 - DNA, 25 bp, Homo sapien
acaacttagtacattaaagctacga

SEQ ID NO: 560697 - DNA, 25 bp, Homo sapien
ttaaagctacgaaaactcatcctgg

SEQ ID NO: 560698 - DNA, 25 bp, Homo sapien
gctacgaaaactcatcctggctgta

SEQ ID NO: 560699 - DNA, 25 bp, Homo sapien
tacgaaaactcatcctggctgtagg

SEQ ID NO: 560700 - DNA, 25 bp, Homo sapien
aactcatcctggctgtaggatagta

SEQ ID NO: 560701 - DNA, 25 bp, Homo sapien
aagttttcaattacgagcaatttgg

SEQ ID NO: 560702 - DNA, 25 bp, Homo sapien
ggtgcttttcaaaagagtaactgaa

SEQ ID NO: 560703 - DNA, 25 bp, Homo sapien
gaaattgttgcaggccaaaacagca

SEQ ID NO: 560704 - DNA, 25 bp, Homo sapien
acagcaatatgatatctcagattta

SEQ ID NO: 560705 - DNA, 25 bp, Homo sapien
atctcagatttagttcaataagaac

SEQ ID NO: 560706 - DNA, 25 bp, Homo sapien
gaacagtgaaacttttggttcacta

SEQ ID NO: 560707 - DNA, 25 bp, Homo sapien
atttctgaaagctagtgttggccat

SEQ ID NO: 560708 - DNA, 25 bp, Homo sapien
gatttcaggcagagtacattcttac

SEQ ID NO: 560709 - DNA, 25 bp, Homo sapien
acaatcaatattcagttccagcccg

SEQ ID NO: 560710 - DNA, 25 bp, Homo sapien
tattcagttccagcccgcacagtag

SEQ ID NO: 560711 - DNA, 25 bp, Homo sapien
cacagtagccctagcaaatgccagt

SEQ ID NO: 560712 - DNA, 25 bp, Homo sapien
aatgccagtgctccttccagagatt

SEQ ID NO: 560713 - DNA, 25 bp, Homo sapien
gctccttccagagattcacctatgg

SEQ ID NO: 560714 - DNA, 25 bp, Homo sapien
aaaatgtatgggtcctgtgctgata

SEQ ID NO: 560715 - DNA, 25 bp, Homo sapien
ggtcctgtgctgataatgtttctgt

SEQ ID NO: 560716 - DNA, 25 bp, Homo sapien
ttctgttcatatttctatgccctgg

SEQ ID NO: 560717 - DNA, 25 bp, Homo sapien
ttctatgccctggtacctggatcag

SEQ ID NO: 560718 - DNA, 25 bp, Homo sapien
actacggcctcatggtctttgccga

SEQ ID NO: 560719 - DNA, 25 bp, Homo sapien
atggtctttgccgacaagcggtttg

SEQ ID NO: 560720 - DNA, 25 bp, Homo sapien
ctttgccgacaagcggtttgcccgt

SEQ ID NO: 560721 - DNA, 25 bp, Homo sapien
aagctgccccgctggatccaggagc

SEQ ID NO: 560722 - DNA, 25 bp, Homo sapien
ggagcacctcacagatgccaacctc

SEQ ID NO: 560723 - DNA, 25 bp, Homo sapien
agggtgtccaggtggccaagtactt

SEQ ID NO: 560724 - DNA, 25 bp, Homo sapien
acagcccttccaccgggaggatcag

SEQ ID NO: 560725 - DNA, 25 bp, Homo sapien
tccaccgggaggatcagctgggcct

SEQ ID NO: 560726 - DNA, 25 bp, Homo sapien
tcagcctggagcagctagaatcaga

SEQ ID NO: 560727 - DNA, 25 bp, Homo sapien
gagcagctagaatcagaggagacgc

SEQ ID NO: 560728 - DNA, 25 bp, Homo sapien
tagagcagattgctcagcagctctg

SEQ ID NO: 560729 - DNA, 25 bp, Homo sapien
agtgagtagatctttttgagctcta

SEQ ID NO: 560730 - DNA, 25 bp, Homo sapien
gatctttttgagctctagttttttg

SEQ ID NO: 560731 - DNA, 25 bp, Homo sapien
gagctctagttttttgtcttgaaag

SEQ ID NO: 560732 - DNA, 25 bp, Homo sapien
aagagtaatgtttcatccatggtct

SEQ ID NO: 560733 - DNA, 25 bp, Homo sapien
gtaatgtttcatccatggtcttgca

SEQ ID NO: 560734 - DNA, 25 bp, Homo sapien
gtttcatccatggtcttgcatgtga

SEQ ID NO: 560735 - DNA, 25 bp, Homo sapien
atggtcttgcatgtgatattcttac

SEQ ID NO: 560736 - DNA, 25 bp, Homo sapien
gtgatattcttaccattgacgctag

SEQ ID NO: 560737 - DNA, 25 bp, Homo sapien
gatattcttaccattgacgctagta

SEQ ID NO: 560738 - DNA, 25 bp, Homo sapien
accattgacgctagtaaagtaaaat

SEQ ID NO: 560739 - DNA, 25 bp, Homo sapien
ttgtgattgtcctttgttatattct

SEQ ID NO: 560740 - DNA, 25 bp, Homo sapien
aaccggcggacctccctgtgggctg

SEQ ID NO: 560741 - DNA, 25 bp, Homo sapien
ggctgtgagtctcagcagtgctcta

SEQ ID NO: 560742 - DNA, 25 bp, Homo sapien
tgtgagtctcagcagtgctctactc

SEQ ID NO: 560743 - DNA, 25 bp, Homo sapien
agcagtgctctactcctggccatag

SEQ ID NO: 560744 - DNA, 25 bp, Homo sapien
tgctctactcctggccatagctgga

SEQ ID NO: 560745 - DNA, 25 bp, Homo sapien
aggaacagggcagcccgcatgtctt

SEQ ID NO: 560746 - DNA, 25 bp, Homo sapien
agcccgcatgtcttccagaagtgaa

SEQ ID NO: 560747 - DNA, 25 bp, Homo sapien
cgcatgtcttccagaagtgaacaga

SEQ ID NO: 560748 - DNA, 25 bp, Homo sapien
aagtgaacagaggccgcagctacca

SEQ ID NO: 560749 - DNA, 25 bp, Homo sapien
taccaccgtcacaaagttcactcat

SEQ ID NO: 560750 - DNA, 25 bp, Homo sapien
tacagtccacactgaaggtcaccag

SEQ ID NO: 560751 - DNA, 25 bp, Homo sapien
aatctgtggaaagtgtgacactcct

SEQ ID NO: 560752 - DNA, 25 bp, Homo sapien
gtgtgacactcctagattggcagat

SEQ ID NO: 560753 - DNA, 25 bp, Homo sapien
gattggcagatatttgcgtgtttga

SEQ ID NO: 560754 - DNA, 25 bp, Homo sapien
ttgaattgtgatacgtgaccactgg

SEQ ID NO: 560755 - DNA, 25 bp, Homo sapien
ggatgatcttttccaataaagtctt

SEQ ID NO: 560756 - DNA, 25 bp, Homo sapien
aaccttaactgctgaatgtgcctca

SEQ ID NO: 560757 - DNA, 25 bp, Homo sapien
gctgaatgtgcctcaattaatataa

SEQ ID NO: 560758 - DNA, 25 bp, Homo sapien
ggatgtaccagaaaacttccctctc

SEQ ID NO: 560759 - DNA, 25 bp, Homo sapien
cagggtccctgtttccgaagctgga

SEQ ID NO: 560760 - DNA, 25 bp, Homo sapien
agtggcatggtcacagcgtcaacca

SEQ ID NO: 560761 - DNA, 25 bp, Homo sapien
atggtcacagcgtcaaccacttggg

SEQ ID NO: 560762 - DNA, 25 bp, Homo sapien
taacgtgcattaaaatggagttctt

SEQ ID NO: 560763 - DNA, 25 bp, Homo sapien
aatggagttcttattatagaataac

SEQ ID NO: 560764 - DNA, 25 bp, Homo sapien
ggctaacttccagactatgggaaaa

SEQ ID NO: 560765 - DNA, 25 bp, Homo sapien
gtatgtgacccccagatcactaagc

SEQ ID NO: 560766 - DNA, 25 bp, Homo sapien
aagctgtagcatattcactaaacaa

SEQ ID NO: 560767 - DNA, 25 bp, Homo sapien
tagcatattcactaaacaatgtttt

SEQ ID NO: 560768 - DNA, 25 bp, Homo sapien
aatgttttatatgaggatagggacc

SEQ ID NO: 560769 - DNA, 25 bp, Homo sapien
gatagggacctttaaatatgtgttt

SEQ ID NO: 560770 - DNA, 25 bp, Homo sapien
atatgtgttttatagaatatctcac

SEQ ID NO: 560771 - DNA, 25 bp, Homo sapien
gaatatctcacacatttgtaatgga

SEQ ID NO: 560772 - DNA, 25 bp, Homo sapien
cacatttgtaatggataacgtgcat

SEQ ID NO: 560773 - DNA, 25 bp, Homo sapien
actacaagctccattggaatcggga

SEQ ID NO: 560774 - DNA, 25 bp, Homo sapien
tacaagctccattggaatcgggatt

SEQ ID NO: 560775 - DNA, 25 bp, Homo sapien
aagctccattggaatcgggattttg

SEQ ID NO: 560776 - DNA, 25 bp, Homo sapien
gctccattggaatcgggattttgaa

SEQ ID NO: 560777 - DNA, 25 bp, Homo sapien
tggaatcgggattttgaactgtctt

SEQ ID NO: 560778 - DNA, 25 bp, Homo sapien
gaatcgggattttgaactgtcttgt

SEQ ID NO: 560779 - DNA, 25 bp, Homo sapien
aatcgggattttgaactgtcttgtt

SEQ ID NO: 560780 - DNA, 25 bp, Homo sapien
tcgggattttgaactgtcttgttca

SEQ ID NO: 560781 - DNA, 25 bp, Homo sapien
ggattttgaactgtcttgttcaaca

SEQ ID NO: 560782 - DNA, 25 bp, Homo sapien
gtcttgttcaacactccactccagt

SEQ ID NO: 560783 - DNA, 25 bp, Homo sapien
actccactccagtgcctagacagtg

SEQ ID NO: 560784 - DNA, 25 bp, Homo sapien
gaagaaacgtctatgtgtacagatg

SEQ ID NO: 560785 - DNA, 25 bp, Homo sapien
tgtacagatgaatgataaactctct

SEQ ID NO: 560786 - DNA, 25 bp, Homo sapien
gggccggtttcgaagttgatgcaat

SEQ ID NO: 560787 - DNA, 25 bp, Homo sapien
gatgcaatcggtttaaacatggctg

SEQ ID NO: 560788 - DNA, 25 bp, Homo sapien
aacatggctgaacgcgtgtgtacac

SEQ ID NO: 560789 - DNA, 25 bp, Homo sapien
gtgtgtacacgggactgacgcaacc

SEQ ID NO: 560790 - DNA, 25 bp, Homo sapien
tgacgcaacccacgtgtaactgtca

SEQ ID NO: 560791 - DNA, 25 bp, Homo sapien
gtgtaactgtcagccgggccctgag

SEQ ID NO: 560792 - DNA, 25 bp, Homo sapien
ccgggccctgagtaatcgcttaaag

SEQ ID NO: 560793 - DNA, 25 bp, Homo sapien
cttaaagatgttcctacgggcttgt

SEQ ID NO: 560794 - DNA, 25 bp, Homo sapien
acgggcttgttgctgttgatgtttt

SEQ ID NO: 560795 - DNA, 25 bp, Homo sapien
gtcagggagggcgaactcgatctca

SEQ ID NO: 560796 - DNA, 25 bp, Homo sapien
ctcagagttttattttcatcaggga

SEQ ID NO: 560797 - DNA, 25 bp, Homo sapien
ggattacgttgaggtacccagaaat

SEQ ID NO: 560798 - DNA, 25 bp, Homo sapien
agatttgcccaaaatggcatatttt

SEQ ID NO: 560799 - DNA, 25 bp, Homo sapien
agaccagaacccagtttcctctggg

SEQ ID NO: 560800 - DNA, 25 bp, Homo sapien
tttcctctgggattatttgttagta

SEQ ID NO: 560801 - DNA, 25 bp, Homo sapien
agtaatcgttttacaggctgagcat

SEQ ID NO: 560802 - DNA, 25 bp, Homo sapien
gcttgaaggactttttctcattttc

SEQ ID NO: 560803 - DNA, 25 bp, Homo sapien
cattttcacttgttttctctaataa

SEQ ID NO: 560804 - DNA, 25 bp, Homo sapien
tcaacttcacaagatgaggcctcat

SEQ ID NO: 560805 - DNA, 25 bp, Homo sapien
gaggcctcatggaagagtgtttacc

SEQ ID NO: 560806 - DNA, 25 bp, Homo sapien
cctctgtcctcaaatgtccaaaatg

SEQ ID NO: 560807 - DNA, 25 bp, Homo sapien
ttggaggacctctgttcatatccca

SEQ ID NO: 560808 - DNA, 25 bp, Homo sapien
gttcatatcccacgcctgggctctt

SEQ ID NO: 560809 - DNA, 25 bp, Homo sapien
ggctcttgccagcagtggagttact

SEQ ID NO: 560810 - DNA, 25 bp, Homo sapien
gagttactgtagagggatgtcccaa

SEQ ID NO: 560811 - DNA, 25 bp, Homo sapien
gagggatgtcccaagcttgttttcc

SEQ ID NO: 560812 - DNA, 25 bp, Homo sapien
atgtcccaagcttgttttccaatca

SEQ ID NO: 560813 - DNA, 25 bp, Homo sapien
ttgttttccaatcagtgttaagctg

SEQ ID NO: 560814 - DNA, 25 bp, Homo sapien
cgtgtgtgtgagagcacatcagtgt

SEQ ID NO: 560815 - DNA, 25 bp, Homo sapien
gcacatcagtgtgtgcaggctgtgt

SEQ ID NO: 560816 - DNA, 25 bp, Homo sapien
tcccttcagacccatcattgagaac

SEQ ID NO: 560817 - DNA, 25 bp, Homo sapien
cagccctcgggaaccggcaggagca

SEQ ID NO: 560818 - DNA, 25 bp, Homo sapien
gtgcagaggtccagggataccagca

SEQ ID NO: 560819 - DNA, 25 bp, Homo sapien
cagaggtccagggataccagcagca

SEQ ID NO: 560820 - DNA, 25 bp, Homo sapien
gaggtccagggataccagcagcagc

SEQ ID NO: 560821 - DNA, 25 bp, Homo sapien
ggtccagggataccagcagcagccc

SEQ ID NO: 560822 - DNA, 25 bp, Homo sapien
aacacaggcggcaggggcttcccct

SEQ ID NO: 560823 - DNA, 25 bp, Homo sapien
aaaggacctataaaaggcatcacca

SEQ ID NO: 560824 - DNA, 25 bp, Homo sapien
ggacctataaaaggcatcaccaagc

SEQ ID NO: 560825 - DNA, 25 bp, Homo sapien
aaaaggcatcaccaagcccaatgga

SEQ ID NO: 560826 - DNA, 25 bp, Homo sapien
aaggcatcaccaagcccaatggaca

SEQ ID NO: 560827 - DNA, 25 bp, Homo sapien
gctgttctggaaaaggcccaaacac

SEQ ID NO: 560828 - DNA, 25 bp, Homo sapien
ggcccctgcctatataaacaatttg

SEQ ID NO: 560829 - DNA, 25 bp, Homo sapien
gggtcttgccatgaaggacattcaa

SEQ ID NO: 560830 - DNA, 25 bp, Homo sapien
gagaaaggcaatctgttttgtctat

SEQ ID NO: 560831 - DNA, 25 bp, Homo sapien
gcaatctgttttgtctattgtccaa

SEQ ID NO: 560832 - DNA, 25 bp, Homo sapien
tctattgtccaatcagtgcacgtga

SEQ ID NO: 560833 - DNA, 25 bp, Homo sapien
gtccaatcagtgcacgtgaagattt

SEQ ID NO: 560834 - DNA, 25 bp, Homo sapien
gaagatttgttacagtatccagaaa

SEQ ID NO: 560835 - DNA, 25 bp, Homo sapien
gaccaagcctgttaaacaactccat

SEQ ID NO: 560836 - DNA, 25 bp, Homo sapien
gaagatgaaccagttgccagcacca

SEQ ID NO: 560837 - DNA, 25 bp, Homo sapien
agcaccaccctgtcagctatgttag

SEQ ID NO: 560838 - DNA, 25 bp, Homo sapien
tgtcagctatgttaggcccctgcct

SEQ ID NO: 560839 - DNA, 25 bp, Homo sapien
ttccaaaacgacgtgctgctcctaa

SEQ ID NO: 560840 - DNA, 25 bp, Homo sapien
tccaaaacgacgtgctgctcctaaa

SEQ ID NO: 560841 - DNA, 25 bp, Homo sapien
ccaaaacgacgtgctgctcctaaaa

SEQ ID NO: 560842 - DNA, 25 bp, Homo sapien
tgctgctcctaaaaacaatggtctt

SEQ ID NO: 560843 - DNA, 25 bp, Homo sapien
gctgctcctaaaaacaatggtcttt

SEQ ID NO: 560844 - DNA, 25 bp, Homo sapien
ctgctcctaaaaacaatggtctttt

SEQ ID NO: 560845 - DNA, 25 bp, Homo sapien
tgctcctaaaaacaatggtcttttg

SEQ ID NO: 560846 - DNA, 25 bp, Homo sapien
gctcctaaaaacaatggtcttttga

SEQ ID NO: 560847 - DNA, 25 bp, Homo sapien
taaaaacaatggtcttttgatcagt

SEQ ID NO: 560848 - DNA, 25 bp, Homo sapien
aaaaacaatggtcttttgatcagtt

SEQ ID NO: 560849 - DNA, 25 bp, Homo sapien
aacaatggtcttttgatcagtttct

SEQ ID NO: 560850 - DNA, 25 bp, Homo sapien
taatctttccatattgaggacagcc

SEQ ID NO: 560851 - DNA, 25 bp, Homo sapien
ttccatattgaggacagcctctgca

SEQ ID NO: 560852 - DNA, 25 bp, Homo sapien
taaatttttatagtagtcctccatt

SEQ ID NO: 560853 - DNA, 25 bp, Homo sapien
agtagtcctccattactggcaatta

SEQ ID NO: 560854 - DNA, 25 bp, Homo sapien
attactggcaattaaggagcaaccc

SEQ ID NO: 560855 - DNA, 25 bp, Homo sapien
ggagcaacccacaaaatgtcattat

SEQ ID NO: 560856 - DNA, 25 bp, Homo sapien
cattatgtggttctttgattaggca

SEQ ID NO: 560857 - DNA, 25 bp, Homo sapien
attgcaaacagcttttctattcctt

SEQ ID NO: 560858 - DNA, 25 bp, Homo sapien
tgtctaaagttaacctgcaacattt

SEQ ID NO: 560859 - DNA, 25 bp, Homo sapien
aacctgcaacattttctagtaggac

SEQ ID NO: 560860 - DNA, 25 bp, Homo sapien
acattttctagtaggacaagtcaat

SEQ ID NO: 560861 - DNA, 25 bp, Homo sapien
ggagctgaatgtgttatgcttccaa

SEQ ID NO: 560862 - DNA, 25 bp, Homo sapien
atgtgttatgcttccaaacaactga

SEQ ID NO: 560863 - DNA, 25 bp, Homo sapien
gatagttgtttcatattctctcagg

SEQ ID NO: 560864 - DNA, 25 bp, Homo sapien
taatgttcccgactcgggtgattcc

SEQ ID NO: 560865 - DNA, 25 bp, Homo sapien
actcgggtgattccagctgtgttgc

SEQ ID NO: 560866 - DNA, 25 bp, Homo sapien
gtgttgctggcagtgttgtctcaac

SEQ ID NO: 560867 - DNA, 25 bp, Homo sapien
tcaaccctctccctaaaatgactga

SEQ ID NO: 560868 - DNA, 25 bp, Homo sapien
taaaatgactgagccctgggttcat

SEQ ID NO: 560869 - DNA, 25 bp, Homo sapien
gagccctgggttcatctaatgtggt

SEQ ID NO: 560870 - DNA, 25 bp, Homo sapien
ggttcatctaatgtggttttcctta

SEQ ID NO: 560871 - DNA, 25 bp, Homo sapien
aaggcacagaagatcacagctagag

SEQ ID NO: 560872 - DNA, 25 bp, Homo sapien
gaaaactttctcaactgcaactgcc

SEQ ID NO: 560873 - DNA, 25 bp, Homo sapien
aactgccaccgtggagcccatataa

SEQ ID NO: 560874 - DNA, 25 bp, Homo sapien
ccgtggagcccatataagcatacat

SEQ ID NO: 560875 - DNA, 25 bp, Homo sapien
agcatacatggctttatccataatg

SEQ ID NO: 560876 - DNA, 25 bp, Homo sapien
tcagagttcttttcgatagcatggc

SEQ ID NO: 560877 - DNA, 25 bp, Homo sapien
tttcgatagcatggcacctgaattt

SEQ ID NO: 560878 - DNA, 25 bp, Homo sapien
gtctgatttgacaagaatcctgtag

SEQ ID NO: 560879 - DNA, 25 bp, Homo sapien
gaatcctgtaggactgatctatata

SEQ ID NO: 560880 - DNA, 25 bp, Homo sapien
gatctatatattgagccacaggata

SEQ ID NO: 560881 - DNA, 25 bp, Homo sapien
gtgaagattccaatggttcaatacc

SEQ ID NO: 560882 - DNA, 25 bp, Homo sapien
attatctaactgcagtaatcctctg

SEQ ID NO: 560883 - DNA, 25 bp, Homo sapien
caaagtatagacacatcaagcctgt

SEQ ID NO: 560884 - DNA, 25 bp, Homo sapien
tcaagcctgtatcaaggaattctag

SEQ ID NO: 560885 - DNA, 25 bp, Homo sapien
gaaattccaagcaaaatcgagtgat

SEQ ID NO: 560886 - DNA, 25 bp, Homo sapien
tcgagtgatctataagccaattgtg

SEQ ID NO: 560887 - DNA, 25 bp, Homo sapien
aaataattccaatgctcctcgggtt

SEQ ID NO: 560888 - DNA, 25 bp, Homo sapien
tgctcctcgggttctgagccaaaaa

SEQ ID NO: 560889 - DNA, 25 bp, Homo sapien
cacaagttacactccagggtggagc

SEQ ID NO: 560890 - DNA, 25 bp, Homo sapien
ggtggagcagcattttttgttagaa

SEQ ID NO: 560891 - DNA, 25 bp, Homo sapien
cttctcttagaaaatcgtccctgga

SEQ ID NO: 560892 - DNA, 25 bp, Homo sapien
cgtccctggaaaatgagccgtcact

SEQ ID NO: 560893 - DNA, 25 bp, Homo sapien
gtcactgggacgcacccaaaagagt

SEQ ID NO: 560894 - DNA, 25 bp, Homo sapien
aaaggagatgtaccagtttaaccag

SEQ ID NO: 560895 - DNA, 25 bp, Homo sapien
ggagatgtaccagtttaaccagtaa

SEQ ID NO: 560896 - DNA, 25 bp, Homo sapien
tgtaccagtttaaccagtaagggca

SEQ ID NO: 560897 - DNA, 25 bp, Homo sapien
cagtttaaccagtaagggcaataag

SEQ ID NO: 560898 - DNA, 25 bp, Homo sapien
gcaataagaacagcttcgactgaca

SEQ ID NO: 560899 - DNA, 25 bp, Homo sapien
tcgactgacagttcaattatacttc

SEQ ID NO: 560900 - DNA, 25 bp, Homo sapien
gttcaattatacttctgattgcatt

SEQ ID NO: 560901 - DNA, 25 bp, Homo sapien
aagatagttctcacaatctaatcca

SEQ ID NO: 560902 - DNA, 25 bp, Homo sapien
gttctcacaatctaatccaatcaaa

SEQ ID NO: 560903 - DNA, 25 bp, Homo sapien
aatctaatccaatcaaaacttgaat

SEQ ID NO: 560904 - DNA, 25 bp, Homo sapien
gacctaaaatgtcaggatctttttt

SEQ ID NO: 560905 - DNA, 25 bp, Homo sapien
gtaatctgagcagtgactcatggaa

SEQ ID NO: 560906 - DNA, 25 bp, Homo sapien
ttctctccctttccagcaagggcag

SEQ ID NO: 560907 - DNA, 25 bp, Homo sapien
gcaagggcagagctcctaaagccag

SEQ ID NO: 560908 - DNA, 25 bp, Homo sapien
gcacctggccagcttatgtggcaga

SEQ ID NO: 560909 - DNA, 25 bp, Homo sapien
atgtggcagatggtctcagttacaa

SEQ ID NO: 560910 - DNA, 25 bp, Homo sapien
gtctcagttacaacttcgctgcttt

SEQ ID NO: 560911 - DNA, 25 bp, Homo sapien
tgagtccgacttccgttgatagcaa

SEQ ID NO: 560912 - DNA, 25 bp, Homo sapien
gacttccgttgatagcaaggcactg

SEQ ID NO: 560913 - DNA, 25 bp, Homo sapien
ggcactgggtggcagcaaccttttt

SEQ ID NO: 560914 - DNA, 25 bp, Homo sapien
gtggcagcaaccttttttctagtag

SEQ ID NO: 560915 - DNA, 25 bp, Homo sapien
atttctccacagtatccttttcatt

SEQ ID NO: 560916 - DNA, 25 bp, Homo sapien
agaaggaccaggtgccagagccgga

SEQ ID NO: 560917 - DNA, 25 bp, Homo sapien
ctggaggagccgacactggaggtgg

SEQ ID NO: 560918 - DNA, 25 bp, Homo sapien
aggtggtggaacaagcttctcccta

SEQ ID NO: 560919 - DNA, 25 bp, Homo sapien
tggtggaacaagcttctccctactc

SEQ ID NO: 560920 - DNA, 25 bp, Homo sapien
aagcttctccctactccatggatga

SEQ ID NO: 560921 - DNA, 25 bp, Homo sapien
ttctccctactccatggatgacagg

SEQ ID NO: 560922 - DNA, 25 bp, Homo sapien
cttcatgtcaggcttcactggctat

SEQ ID NO: 560923 - DNA, 25 bp, Homo sapien
atgtcaggcttcactggctatgtgc

SEQ ID NO: 560924 - DNA, 25 bp, Homo sapien
aggcttcactggctatgtgccctgc

SEQ ID NO: 560925 - DNA, 25 bp, Homo sapien
agaacataccctcagaacctgggtc

SEQ ID NO: 560926 - DNA, 25 bp, Homo sapien
cataccctcagaacctgggtctttt

SEQ ID NO: 560927 - DNA, 25 bp, Homo sapien
gacctaagtaggcaacatgaaagac

SEQ ID NO: 560928 - DNA, 25 bp, Homo sapien
aatgatgtttcatacacacaggcta

SEQ ID NO: 560929 - DNA, 25 bp, Homo sapien
gtttcatacacacaggctaccaacg

SEQ ID NO: 560930 - DNA, 25 bp, Homo sapien
ggctaccaacgagagttttctatgt

SEQ ID NO: 560931 - DNA, 25 bp, Homo sapien
aggttaatggcatccttctggtacc

SEQ ID NO: 560932 - DNA, 25 bp, Homo sapien
gttaatggcatccttctggtacctg

SEQ ID NO: 560933 - DNA, 25 bp, Homo sapien
acatttagagtgtattctgatttaa

SEQ ID NO: 560934 - DNA, 25 bp, Homo sapien
atagtatttatgtagtttgcaaaag

SEQ ID NO: 560935 - DNA, 25 bp, Homo sapien
ttgatctgggttctattttgaattt

SEQ ID NO: 560936 - DNA, 25 bp, Homo sapien
gaatttttctccttcagagacctaa

SEQ ID NO: 560937 - DNA, 25 bp, Homo sapien
tctccttcagagacctaagtaggca

SEQ ID NO: 560938 - DNA, 25 bp, Homo sapien
tctctctctttacccttttctcctt

SEQ ID NO: 560939 - DNA, 25 bp, Homo sapien
tttgacattggtagtaatattggta

SEQ ID NO: 560940 - DNA, 25 bp, Homo sapien
ttgacattggtagtaatattggtat

SEQ ID NO: 560941 - DNA, 25 bp, Homo sapien
tgacattggtagtaatattggtata

SEQ ID NO: 560942 - DNA, 25 bp, Homo sapien
gacattggtagtaatattggtatag

SEQ ID NO: 560943 - DNA, 25 bp, Homo sapien
acattggtagtaatattggtataga

SEQ ID NO: 560944 - DNA, 25 bp, Homo sapien
cattggtagtaatattggtatagaa

SEQ ID NO: 560945 - DNA, 25 bp, Homo sapien
ggtagtaatattggtatagaattct

SEQ ID NO: 560946 - DNA, 25 bp, Homo sapien
gtagtaatattggtatagaattcta

SEQ ID NO: 560947 - DNA, 25 bp, Homo sapien
tagaattctaagttgtttaactgcc

SEQ ID NO: 560948 - DNA, 25 bp, Homo sapien
agaattctaagttgtttaactgcct

SEQ ID NO: 560949 - DNA, 25 bp, Homo sapien
gcccaccagacgcaaagatacactt

SEQ ID NO: 560950 - DNA, 25 bp, Homo sapien
agatacacttttttcctttggactg

SEQ ID NO: 560951 - DNA, 25 bp, Homo sapien
tttggactgtgaacatggaagcctc

SEQ ID NO: 560952 - DNA, 25 bp, Homo sapien
gaacatggaagcctcagcctgaatg

SEQ ID NO: 560953 - DNA, 25 bp, Homo sapien
atggaagcctcagcctgaatgtgag

SEQ ID NO: 560954 - DNA, 25 bp, Homo sapien
aatgcagctgttgttagacaactgt

SEQ ID NO: 560955 - DNA, 25 bp, Homo sapien
agacaactgttgaaaactccagaaa

SEQ ID NO: 560956 - DNA, 25 bp, Homo sapien
aaactccagaaatacatcacccaag

SEQ ID NO: 560957 - DNA, 25 bp, Homo sapien
tacatcacccaaggtggcagttctc

SEQ ID NO: 560958 - DNA, 25 bp, Homo sapien
gtggcagttctcagtatttggcaga

SEQ ID NO: 560959 - DNA, 25 bp, Homo sapien
atatcatattttttacaaggaacat

SEQ ID NO: 560960 - DNA, 25 bp, Homo sapien
attctgtgggactccctccctgtgc

SEQ ID NO: 560961 - DNA, 25 bp, Homo sapien
ctgtgctgtcaggaatctacaggac

SEQ ID NO: 560962 - DNA, 25 bp, Homo sapien
ggaatctacaggacttggctcgtat

SEQ ID NO: 560963 - DNA, 25 bp, Homo sapien
acaggacttggctcgtatttacatt

SEQ ID NO: 560964 - DNA, 25 bp, Homo sapien
tggctcgtatttacattcgacgcac

SEQ ID NO: 560965 - DNA, 25 bp, Homo sapien
gtatttacattcgacgcacacttag

SEQ ID NO: 560966 - DNA, 25 bp, Homo sapien
tcgacgcacacttagaaatttcata

SEQ ID NO: 560967 - DNA, 25 bp, Homo sapien
aacagagaattaacacttacgtatt

SEQ ID NO: 560968 - DNA, 25 bp, Homo sapien
acacttacgtatttgtgggtaatca

SEQ ID NO: 560969 - DNA, 25 bp, Homo sapien
tgtgggtaatcagcttattcctcag

SEQ ID NO: 560970 - DNA, 25 bp, Homo sapien
tattcctcagcctctagacagtgaa

SEQ ID NO: 560971 - DNA, 25 bp, Homo sapien
cccagtcctaggcaagggtctgctc

SEQ ID NO: 560972 - DNA, 25 bp, Homo sapien
tgctcccatctgtcatgggaaggag

SEQ ID NO: 560973 - DNA, 25 bp, Homo sapien
gatgagaccacagctaactttcctt

SEQ ID NO: 560974 - DNA, 25 bp, Homo sapien
agaccacagctaactttccttctgg

SEQ ID NO: 560975 - DNA, 25 bp, Homo sapien
ctgtgttccaggattctccagaatg

SEQ ID NO: 560976 - DNA, 25 bp, Homo sapien
ggattctagcaggatcaagtcaggt

SEQ ID NO: 560977 - DNA, 25 bp, Homo sapien
tagcaggatcaagtcaggtcccctt

SEQ ID NO: 560978 - DNA, 25 bp, Homo sapien
gatcaagtcaggtccccttcatcat

SEQ ID NO: 560979 - DNA, 25 bp, Homo sapien
gggaggcttccactcctgcagcatc

SEQ ID NO: 560980 - DNA, 25 bp, Homo sapien
actcctgcagcatcaggcactggga

SEQ ID NO: 560981 - DNA, 25 bp, Homo sapien
tttaacatattaaagttctggacag

SEQ ID NO: 560982 - DNA, 25 bp, Homo sapien
gctcctgcaggataagtggccacca

SEQ ID NO: 560983 - DNA, 25 bp, Homo sapien
aggataagtggccaccaccagacca

SEQ ID NO: 560984 - DNA, 25 bp, Homo sapien
tgcttccagggtccacaatctgctc

SEQ ID NO: 560985 - DNA, 25 bp, Homo sapien
caatctgctccaggacacaagactg

SEQ ID NO: 560986 - DNA, 25 bp, Homo sapien
tcaaactaccactggccaccttggt

SEQ ID NO: 560987 - DNA, 25 bp, Homo sapien
tggatccctcatctgccattcttgg

SEQ ID NO: 560988 - DNA, 25 bp, Homo sapien
ttcttggcagttgcattttgtggtc

SEQ ID NO: 560989 - DNA, 25 bp, Homo sapien
ggcagttgcattttgtggtcagaaa

SEQ ID NO: 560990 - DNA, 25 bp, Homo sapien
gggcagaaacacgtggaccagccac

SEQ ID NO: 560991 - DNA, 25 bp, Homo sapien
accaacctcatccattcaaggaagc

SEQ ID NO: 560992 - DNA, 25 bp, Homo sapien
agcagaaatggtcaggctcctgcag

SEQ ID NO: 560993 - DNA, 25 bp, Homo sapien
ctttctatttgcgaggccctgataa

SEQ ID NO: 560994 - DNA, 25 bp, Homo sapien
ttctatttgcgaggccctgataaaa

SEQ ID NO: 560995 - DNA, 25 bp, Homo sapien
ttgcgaggccctgataaaagtactg

SEQ ID NO: 560996 - DNA, 25 bp, Homo sapien
tgcgaggccctgataaaagtactgt

SEQ ID NO: 560997 - DNA, 25 bp, Homo sapien
cgaggccctgataaaagtactgtcc

SEQ ID NO: 560998 - DNA, 25 bp, Homo sapien
ggccctgataaaagtactgtcctgg

SEQ ID NO: 560999 - DNA, 25 bp, Homo sapien
cctgataaaagtactgtcctggcca

SEQ ID NO: 561000 - DNA, 25 bp, Homo sapien
tgataaaagtactgtcctggccagg

SEQ ID NO: 561001 - DNA, 25 bp, Homo sapien
ggccaagataagatagcgccattgt

SEQ ID NO: 561002 - DNA, 25 bp, Homo sapien
caagataagatagcgccattgtact

SEQ ID NO: 561003 - DNA, 25 bp, Homo sapien
agataagatagcgccattgtactcc

SEQ ID NO: 561004 - DNA, 25 bp, Homo sapien
gtcatcaataccactgttaagaaga

SEQ ID NO: 561005 - DNA, 25 bp, Homo sapien
gaagaaaattcttggccaaattgaa

SEQ ID NO: 561006 - DNA, 25 bp, Homo sapien
tttaatggagtttaactgagcagac

SEQ ID NO: 561007 - DNA, 25 bp, Homo sapien
aactgagcagacaattcacaaatct

SEQ ID NO: 561008 - DNA, 25 bp, Homo sapien
aattcacaaatctagaagcctcctg

SEQ ID NO: 561009 - DNA, 25 bp, Homo sapien
acagccagactggttatagctcagc

SEQ ID NO: 561010 - DNA, 25 bp, Homo sapien
gactggttatagctcagcattggcc

SEQ ID NO: 561011 - DNA, 25 bp, Homo sapien
ttatagctcagcattggccttattt

SEQ ID NO: 561012 - DNA, 25 bp, Homo sapien
cagcattggccttatttgaacgaga

SEQ ID NO: 561013 - DNA, 25 bp, Homo sapien
ggccttatttgaacgagatttgaac

SEQ ID NO: 561014 - DNA, 25 bp, Homo sapien
agatttgaacagttggccacctttg

SEQ ID NO: 561015 - DNA, 25 bp, Homo sapien
caatgggatggagactttttcccct

SEQ ID NO: 561016 - DNA, 25 bp, Homo sapien
agtgcccaagcgttcaagtctcctg

SEQ ID NO: 561017 - DNA, 25 bp, Homo sapien
aagtctcctggatcagacagatggg

SEQ ID NO: 561018 - DNA, 25 bp, Homo sapien
atgggattttagctgctgctttaaa

SEQ ID NO: 561019 - DNA, 25 bp, Homo sapien
aaggtacttcagttcagctcttgcc

SEQ ID NO: 561020 - DNA, 25 bp, Homo sapien
gcctctgtcactaatcttgctttat

SEQ ID NO: 561021 - DNA, 25 bp, Homo sapien
tatgaactcctttgattttctgaat

SEQ ID NO: 561022 - DNA, 25 bp, Homo sapien
aggttctctattattctgtccttct

SEQ ID NO: 561023 - DNA, 25 bp, Homo sapien
tattctgtccttcttccaaactgga

SEQ ID NO: 561024 - DNA, 25 bp, Homo sapien
aatggctgtatctaattctcaggat

SEQ ID NO: 561025 - DNA, 25 bp, Homo sapien
tctcaggatattttggatgtgtgcc

SEQ ID NO: 561026 - DNA, 25 bp, Homo sapien
agctggtgcaggtgggcttgccaag

SEQ ID NO: 561027 - DNA, 25 bp, Homo sapien
ttcacttctaaatctgctggccaca

SEQ ID NO: 561028 - DNA, 25 bp, Homo sapien
acttctaaatctgctggccacaagc

SEQ ID NO: 561029 - DNA, 25 bp, Homo sapien
aaatctgctggccacaagccctgct

SEQ ID NO: 561030 - DNA, 25 bp, Homo sapien
acaagccctgctaaagatacacatc

SEQ ID NO: 561031 - DNA, 25 bp, Homo sapien
agccctgctaaagatacacatctca

SEQ ID NO: 561032 - DNA, 25 bp, Homo sapien
aaagttttaaatcatgtcaactgga

SEQ ID NO: 561033 - DNA, 25 bp, Homo sapien
gtcaactggataatacttgctttat

SEQ ID NO: 561034 - DNA, 25 bp, Homo sapien
gctttatgtgagaatacttcagcag

SEQ ID NO: 561035 - DNA, 25 bp, Homo sapien
gaatacttcagcagaatggatacga

SEQ ID NO: 561036 - DNA, 25 bp, Homo sapien
cagcagaatggatacgaattttcaa

SEQ ID NO: 561037 - DNA, 25 bp, Homo sapien
gtaaatcttgacaaccaacaacaga

SEQ ID NO: 561038 - DNA, 25 bp, Homo sapien
aacaacagaatattagtcagtgcta

SEQ ID NO: 561039 - DNA, 25 bp, Homo sapien
gaaatgcactatcaagacatggaag

SEQ ID NO: 561040 - DNA, 25 bp, Homo sapien
aggaatcttgaatgcctattgctaa

SEQ ID NO: 561041 - DNA, 25 bp, Homo sapien
gaatgcctattgctaaatgaaagag

SEQ ID NO: 561042 - DNA, 25 bp, Homo sapien
gaggccaacctgcaaagaccaaata

SEQ ID NO: 561043 - DNA, 25 bp, Homo sapien
acctgcaaagaccaaataatgtgtg

SEQ ID NO: 561044 - DNA, 25 bp, Homo sapien
taatgtgtgattccacctgttctgg

SEQ ID NO: 561045 - DNA, 25 bp, Homo sapien
gattccacctgttctggaaagggca

SEQ ID NO: 561046 - DNA, 25 bp, Homo sapien
ggaattaaattactggtggttgtca

SEQ ID NO: 561047 - DNA, 25 bp, Homo sapien
gaaaaggtggaagacacaggctttt

SEQ ID NO: 561048 - DNA, 25 bp, Homo sapien
aacccactggtgcaagtcctagatt

SEQ ID NO: 561049 - DNA, 25 bp, Homo sapien
cactggtgcaagtcctagattccaa

SEQ ID NO: 561050 - DNA, 25 bp, Homo sapien
actcagcaaacaaggtagacagtgt

SEQ ID NO: 561051 - DNA, 25 bp, Homo sapien
gtggccataccaaagaggctaccga

SEQ ID NO: 561052 - DNA, 25 bp, Homo sapien
aaagaggctaccgattccttcctgc

SEQ ID NO: 561053 - DNA, 25 bp, Homo sapien
tcctgctacctggatccctgaagtt

SEQ ID NO: 561054 - DNA, 25 bp, Homo sapien
atccctgaagttgccctggtctctg

SEQ ID NO: 561055 - DNA, 25 bp, Homo sapien
gtctctgcaccttctaaacctagtt

SEQ ID NO: 561056 - DNA, 25 bp, Homo sapien
aacctagttcttaagagctttccat

SEQ ID NO: 561057 - DNA, 25 bp, Homo sapien
gctttccattacatgagctgtctca

SEQ ID NO: 561058 - DNA, 25 bp, Homo sapien
agctgtctcaaagccctccaataaa

SEQ ID NO: 561059 - DNA, 25 bp, Homo sapien
acaagcagaggcaaggcctgcctga

SEQ ID NO: 561060 - DNA, 25 bp, Homo sapien
gcaaggcctgcctgagactgaggaa

SEQ ID NO: 561061 - DNA, 25 bp, Homo sapien
ggtttgaccactcccgaggctgcca

SEQ ID NO: 561062 - DNA, 25 bp, Homo sapien
cactcccgaggctgccatgcggtgg

SEQ ID NO: 561063 - DNA, 25 bp, Homo sapien
atgcggtgggaccaccctgctgtcc

SEQ ID NO: 561064 - DNA, 25 bp, Homo sapien
ttgtctctccagcaagactgtgcac

SEQ ID NO: 561065 - DNA, 25 bp, Homo sapien
aagactgtgcactccttgcaggcag

SEQ ID NO: 561066 - DNA, 25 bp, Homo sapien
tgctgctcttgtgtcccacgtggta

SEQ ID NO: 561067 - DNA, 25 bp, Homo sapien
tgtcccacgtggtacttagttcaag

SEQ ID NO: 561068 - DNA, 25 bp, Homo sapien
ggtacttagttcaaggctgccccag

SEQ ID NO: 561069 - DNA, 25 bp, Homo sapien
gatgcttaataaacagctcttcact

SEQ ID NO: 561070 - DNA, 25 bp, Homo sapien
attgtgtacaaagtaatttctgtta

SEQ ID NO: 561071 - DNA, 25 bp, Homo sapien
tttacatgtatgtgttaaggatatg

SEQ ID NO: 561072 - DNA, 25 bp, Homo sapien
ataacttcctctgcctgttgggata

SEQ ID NO: 561073 - DNA, 25 bp, Homo sapien
aacttcctctgcctgttgggataat

SEQ ID NO: 561074 - DNA, 25 bp, Homo sapien
acttcctctgcctgttgggataatg

SEQ ID NO: 561075 - DNA, 25 bp, Homo sapien
cttcctctgcctgttgggataatgg

SEQ ID NO: 561076 - DNA, 25 bp, Homo sapien
ttcctctgcctgttgggataatgga

SEQ ID NO: 561077 - DNA, 25 bp, Homo sapien
tcctctgcctgttgggataatggag

SEQ ID NO: 561078 - DNA, 25 bp, Homo sapien
cctctgcctgttgggataatggaga

SEQ ID NO: 561079 - DNA, 25 bp, Homo sapien
ctgcctgttgggataatggagagtt

SEQ ID NO: 561080 - DNA, 25 bp, Homo sapien
gcctgttgggataatggagagtttt

SEQ ID NO: 561081 - DNA, 25 bp, Homo sapien
gtacccttgcttccaaaacgacgtg

SEQ ID NO: 561082 - DNA, 25 bp, Homo sapien
gctgctcctaaaaacaatggtcttt

SEQ ID NO: 561083 - DNA, 25 bp, Homo sapien
ctacattttttcacctttgctcatt

SEQ ID NO: 561084 - DNA, 25 bp, Homo sapien
attttggagcaaagtgggaacagta

SEQ ID NO: 561085 - DNA, 25 bp, Homo sapien
aagtgggaacagtaagcagcagatc

SEQ ID NO: 561086 - DNA, 25 bp, Homo sapien
gggaacagtaagcagcagatctatc

SEQ ID NO: 561087 - DNA, 25 bp, Homo sapien
agacagcagtagtaacagcagccag

SEQ ID NO: 561088 - DNA, 25 bp, Homo sapien
agccagtcacagagttaaagtaacc

SEQ ID NO: 561089 - DNA, 25 bp, Homo sapien
aagtgataaaatcaaagccatcgga

SEQ ID NO: 561090 - DNA, 25 bp, Homo sapien
agccatcggatgaagaaaggatatt

SEQ ID NO: 561091 - DNA, 25 bp, Homo sapien
ttaccaagaaactcacgattaactt

SEQ ID NO: 561092 - DNA, 25 bp, Homo sapien
tgatctccgcagaggctgcctgctg

SEQ ID NO: 561093 - DNA, 25 bp, Homo sapien
ggccttcgtgctccgaaacaagaga

SEQ ID NO: 561094 - DNA, 25 bp, Homo sapien
ttcgtgctccgaaacaagagacctg

SEQ ID NO: 561095 - DNA, 25 bp, Homo sapien
caagagacctgggagccctcgggaa

SEQ ID NO: 561096 - DNA, 25 bp, Homo sapien
tttctcaccagcccgccagttgtgg

SEQ ID NO: 561097 - DNA, 25 bp, Homo sapien
agcccgccagttgtggcaaccctgt

SEQ ID NO: 561098 - DNA, 25 bp, Homo sapien
ttgttcccctaatctatcactttgt

SEQ ID NO: 561099 - DNA, 25 bp, Homo sapien
gttcccctaatctatcactttgttc

SEQ ID NO: 561100 - DNA, 25 bp, Homo sapien
cccctaatctatcactttgttcttt

SEQ ID NO: 561101 - DNA, 25 bp, Homo sapien
gcaccagcaggcactgaagctgcgg

SEQ ID NO: 561102 - DNA, 25 bp, Homo sapien
gaagctgcggccctgatctccgcag

SEQ ID NO: 561103 - DNA, 25 bp, Homo sapien
tcgcgatcgagccagccgcagtaag

SEQ ID NO: 561104 - DNA, 25 bp, Homo sapien
tcgagccagccgcagtaagctttcc

SEQ ID NO: 561105 - DNA, 25 bp, Homo sapien
gccgcagtaagctttcccgccagag

SEQ ID NO: 561106 - DNA, 25 bp, Homo sapien
tgcctctggcggacaccgagaagct

SEQ ID NO: 561107 - DNA, 25 bp, Homo sapien
gacaccgagaagctgatccgcgaga

SEQ ID NO: 561108 - DNA, 25 bp, Homo sapien
aagctgatccgcgagaaagacgaag

SEQ ID NO: 561109 - DNA, 25 bp, Homo sapien
aaagacgaagagctgcgccgcatgc

SEQ ID NO: 561110 - DNA, 25 bp, Homo sapien
agacgaagagctgcgccgcatgcaa

SEQ ID NO: 561111 - DNA, 25 bp, Homo sapien
gatgcaggcccaaatgcagcagagc

SEQ ID NO: 561112 - DNA, 25 bp, Homo sapien
caggcccaaatgcagcagagccagg

SEQ ID NO: 561113 - DNA, 25 bp, Homo sapien
caggcccagggcgagcagtcagacg

SEQ ID NO: 561114 - DNA, 25 bp, Homo sapien
attttggagcaaagtgggaacagta

SEQ ID NO: 561115 - DNA, 25 bp, Homo sapien
gagcaaagtgggaacagtaagcagc

SEQ ID NO: 561116 - DNA, 25 bp, Homo sapien
agcaaagtgggaacagtaagcagca

SEQ ID NO: 561117 - DNA, 25 bp, Homo sapien
caaagtgggaacagtaagcagcaga

SEQ ID NO: 561118 - DNA, 25 bp, Homo sapien
aagtgggaacagtaagcagcagatc

SEQ ID NO: 561119 - DNA, 25 bp, Homo sapien
agtgggaacagtaagcagcagatct

SEQ ID NO: 561120 - DNA, 25 bp, Homo sapien
gtgggaacagtaagcagcagatcta

SEQ ID NO: 561121 - DNA, 25 bp, Homo sapien
tgggaacagtaagcagcagatctat

SEQ ID NO: 561122 - DNA, 25 bp, Homo sapien
gggaacagtaagcagcagatctatc

SEQ ID NO: 561123 - DNA, 25 bp, Homo sapien
accaagtgataaaatcaaagccatc

SEQ ID NO: 561124 - DNA, 25 bp, Homo sapien
taccaagaaactcacgattaactta

SEQ ID NO: 561125 - DNA, 25 bp, Homo sapien
tggcggccaagctgctccacatcta

SEQ ID NO: 561126 - DNA, 25 bp, Homo sapien
acatctaccaacaatcccggaagga

SEQ ID NO: 561127 - DNA, 25 bp, Homo sapien
gaaggacaactccaattccctgcag

SEQ ID NO: 561128 - DNA, 25 bp, Homo sapien
attccctgcaggtgaaaacgtgcca

SEQ ID NO: 561129 - DNA, 25 bp, Homo sapien
tgaaaacgtgccacctggtcaggta

SEQ ID NO: 561130 - DNA, 25 bp, Homo sapien
tggtcaggtactggatctccgcctt

SEQ ID NO: 561131 - DNA, 25 bp, Homo sapien
gcggagtttgacttgaacccggagt

SEQ ID NO: 561132 - DNA, 25 bp, Homo sapien
gaacccggagttggctgagcagatc

SEQ ID NO: 561133 - DNA, 25 bp, Homo sapien
gggaaccgacggcacagcagcctaa

SEQ ID NO: 561134 - DNA, 25 bp, Homo sapien
ggcacagcagcctaatcgacataga

SEQ ID NO: 561135 - DNA, 25 bp, Homo sapien
gcagcctaatcgacatagacagcgt

SEQ ID NO: 561136 - DNA, 25 bp, Homo sapien
tactctcttttttgggactactgtg

SEQ ID NO: 561137 - DNA, 25 bp, Homo sapien
tcttttttgggactactgtgttttg

SEQ ID NO: 561138 - DNA, 25 bp, Homo sapien
ctgtgttttgctgttctagaaaatc

SEQ ID NO: 561139 - DNA, 25 bp, Homo sapien
gttttgctgttctagaaaatcataa

SEQ ID NO: 561140 - DNA, 25 bp, Homo sapien
ttttttgcgcaactgtggacacttt

SEQ ID NO: 561141 - DNA, 25 bp, Homo sapien
tgcgcaactgtggacactttcaatg

SEQ ID NO: 561142 - DNA, 25 bp, Homo sapien
tgtggacactttcaatggtgccttg

SEQ ID NO: 561143 - DNA, 25 bp, Homo sapien
gaaatctatgacctcaacttttcaa

SEQ ID NO: 561144 - DNA, 25 bp, Homo sapien
ctatgacctcaacttttcaaaagac

SEQ ID NO: 561145 - DNA, 25 bp, Homo sapien
ttcaatgttattttagccatgtaaa

SEQ ID NO: 561146 - DNA, 25 bp, Homo sapien
tagccatgtaaataagtgtagatag

SEQ ID NO: 561147 - DNA, 25 bp, Homo sapien
aatacaactattactctacggaaat

SEQ ID NO: 561148 - DNA, 25 bp, Homo sapien
actattactctacggaaatattagg

SEQ ID NO: 561149 - DNA, 25 bp, Homo sapien
gggtagcgcaaacaaagttctgaca

SEQ ID NO: 561150 - DNA, 25 bp, Homo sapien
gcgcaaacaaagttctgacactaaa

SEQ ID NO: 561151 - DNA, 25 bp, Homo sapien
gttctgacactaaactttactgagc

SEQ ID NO: 561152 - DNA, 25 bp, Homo sapien
gacactaaactttactgagccctgc

SEQ ID NO: 561153 - DNA, 25 bp, Homo sapien
actaaactttactgagccctgcatc

SEQ ID NO: 561154 - DNA, 25 bp, Homo sapien
aaactttactgagccctgcatcctg

SEQ ID NO: 561155 - DNA, 25 bp, Homo sapien
gacccgccagtctcgccgggaggaa

SEQ ID NO: 561156 - DNA, 25 bp, Homo sapien
agcgccgcggtacaaccacggcact

SEQ ID NO: 561157 - DNA, 25 bp, Homo sapien
cgggcgcaagcgtttggtgtgtctg

SEQ ID NO: 561158 - DNA, 25 bp, Homo sapien
tggtagggctggcacttatttcttc

SEQ ID NO: 561159 - DNA, 25 bp, Homo sapien
ggctggcacttatttcttccatctg

SEQ ID NO: 561160 - DNA, 25 bp, Homo sapien
ttccatctgcctcagagtttatcca

SEQ ID NO: 561161 - DNA, 25 bp, Homo sapien
ttgaattttccgtaccttaaccatg

SEQ ID NO: 561162 - DNA, 25 bp, Homo sapien
tccgtaccttaaccatgcctaaatg

SEQ ID NO: 561163 - DNA, 25 bp, Homo sapien
aaccatgcctaaatgctttggcttg

SEQ ID NO: 561164 - DNA, 25 bp, Homo sapien
atgctttggcttgttcaattttggc

SEQ ID NO: 561165 - DNA, 25 bp, Homo sapien
tggcttgttcaattttggcagatta

SEQ ID NO: 561166 - DNA, 25 bp, Homo sapien
tggcagattaagcagttcaaggtaa

SEQ ID NO: 561167 - DNA, 25 bp, Homo sapien
gagaagtaagttcccaaccacaagg

SEQ ID NO: 561168 - DNA, 25 bp, Homo sapien
aactgacttaacatatactataggg

SEQ ID NO: 561169 - DNA, 25 bp, Homo sapien
atatctgtgagtagtttctggaatc

SEQ ID NO: 561170 - DNA, 25 bp, Homo sapien
gaatccttctttcccctgaatgagt

SEQ ID NO: 561171 - DNA, 25 bp, Homo sapien
tttcccctgaatgagttatgtgcac

SEQ ID NO: 561172 - DNA, 25 bp, Homo sapien
gagttatgtgcacttatctgtccca

SEQ ID NO: 561173 - DNA, 25 bp, Homo sapien
gtgcacttatctgtcccacaaagga

SEQ ID NO: 561174 - DNA, 25 bp, Homo sapien
aaggataaagggacacatgggttag

SEQ ID NO: 561175 - DNA, 25 bp, Homo sapien
ccagcccaccaaatgcttaggtata

SEQ ID NO: 561176 - DNA, 25 bp, Homo sapien
atgcttaggtatagactagtcacta

SEQ ID NO: 561177 - DNA, 25 bp, Homo sapien
gaatgtaggaatctcaggctctcag

SEQ ID NO: 561178 - DNA, 25 bp, Homo sapien
ccagcttctctgtgttggaaacacc

SEQ ID NO: 561179 - DNA, 25 bp, Homo sapien
tgtgttggaaacacctggacagggc

SEQ ID NO: 561180 - DNA, 25 bp, Homo sapien
gaagcagagcttatcatagtatata

SEQ ID NO: 561181 - DNA, 25 bp, Homo sapien
agtatatatgtttagtaccctgtca

SEQ ID NO: 561182 - DNA, 25 bp, Homo sapien
taagtctggtagaagttaggctttt

SEQ ID NO: 561183 - DNA, 25 bp, Homo sapien
ggctttttacaagacatgctgctta

SEQ ID NO: 561184 - DNA, 25 bp, Homo sapien
atgctgcttactgcaccaaggaggc

SEQ ID NO: 561185 - DNA, 25 bp, Homo sapien
gcaccaaggaggcaagaaggctttt

SEQ ID NO: 561186 - DNA, 25 bp, Homo sapien
caagaaggctttttagagagcccag

SEQ ID NO: 561187 - DNA, 25 bp, Homo sapien
agaatttcctttcctcaactcctgc

SEQ ID NO: 561188 - DNA, 25 bp, Homo sapien
cctgcttccaagacagtcattttgc

SEQ ID NO: 561189 - DNA, 25 bp, Homo sapien
cattttgcatgataaccgtttcccc

SEQ ID NO: 561190 - DNA, 25 bp, Homo sapien
tgcatgataaccgtttccccaaaaa

SEQ ID NO: 561191 - DNA, 25 bp, Homo sapien
atctgaatttgcactaatggtgtct

SEQ ID NO: 561192 - DNA, 25 bp, Homo sapien
gcactaatggtgtctgagagcaaaa

SEQ ID NO: 561193 - DNA, 25 bp, Homo sapien
gagtgtgacctctattggaaacctt

SEQ ID NO: 561194 - DNA, 25 bp, Homo sapien
gacctctattggaaacctttgttca

SEQ ID NO: 561195 - DNA, 25 bp, Homo sapien
gcaagcttcctgattatgttcactg

SEQ ID NO: 561196 - DNA, 25 bp, Homo sapien
gttcactgtaatattaatgacctaa

SEQ ID NO: 561197 - DNA, 25 bp, Homo sapien
atgacctaagtttgaatgtatttcc

SEQ ID NO: 561198 - DNA, 25 bp, Homo sapien
gaatgtatttccttacagtccatta

SEQ ID NO: 561199 - DNA, 25 bp, Homo sapien
gtccattaatttgacatccatcttt

SEQ ID NO: 561200 - DNA, 25 bp, Homo sapien
taatgttttcttcacacagcttctt

SEQ ID NO: 561201 - DNA, 25 bp, Homo sapien
ttttcttcacacagcttcttaaacc

SEQ ID NO: 561202 - DNA, 25 bp, Homo sapien
tattggaacggttgcacagaacttc

SEQ ID NO: 561203 - DNA, 25 bp, Homo sapien
caaataatttttaccgccacgcaag

SEQ ID NO: 561204 - DNA, 25 bp, Homo sapien
gccacgcaagatttagccctgaggt

SEQ ID NO: 561205 - DNA, 25 bp, Homo sapien
aagatttagccctgaggtcttaatc

SEQ ID NO: 561206 - DNA, 25 bp, Homo sapien
ggacagtaaaagctgtcgtccctcc

SEQ ID NO: 561207 - DNA, 25 bp, Homo sapien
tccgtcccctttcgcagaaatggca

SEQ ID NO: 561208 - DNA, 25 bp, Homo sapien
atggcaacgaatgaccaccagcatt

SEQ ID NO: 561209 - DNA, 25 bp, Homo sapien
gaccaccagcattagctgagccagg

SEQ ID NO: 561210 - DNA, 25 bp, Homo sapien
ggagggttgattgcctaaacgactc

SEQ ID NO: 561211 - DNA, 25 bp, Homo sapien
gattgcctaaacgactctgcatcgc

SEQ ID NO: 561212 - DNA, 25 bp, Homo sapien
tgcatcgccgcctctttttgaaact

SEQ ID NO: 561213 - DNA, 25 bp, Homo sapien
aggtataaatggtcatcttattatt

SEQ ID NO: 561214 - DNA, 25 bp, Homo sapien
gttggtgtcatatcaaggatctttt

SEQ ID NO: 561215 - DNA, 25 bp, Homo sapien
ggatcttttaaattatgccactaca

SEQ ID NO: 561216 - DNA, 25 bp, Homo sapien
aaattatgccactacaggatgtatc

SEQ ID NO: 561217 - DNA, 25 bp, Homo sapien
aggatgtatcatttcaagtctattt

SEQ ID NO: 561218 - DNA, 25 bp, Homo sapien
tttcaagtctattttgcacagctaa

SEQ ID NO: 561219 - DNA, 25 bp, Homo sapien
gtctattttgcacagctaaacagta

SEQ ID NO: 561220 - DNA, 25 bp, Homo sapien
gtagcaaaagatgccaattagcatg

SEQ ID NO: 561221 - DNA, 25 bp, Homo sapien
aattagcatgataatggtgtcttca

SEQ ID NO: 561222 - DNA, 25 bp, Homo sapien
ttaactgaaacctaacacatgttga

SEQ ID NO: 561223 - DNA, 25 bp, Homo sapien
ccatatcatacctagtttatctctt

SEQ ID NO: 561224 - DNA, 25 bp, Homo sapien
agatttacacaagcagcacgggaaa

SEQ ID NO: 561225 - DNA, 25 bp, Homo sapien
acgggaaatctgaggcccagacatt

SEQ ID NO: 561226 - DNA, 25 bp, Homo sapien
cccagacatttccttatcaacagaa

SEQ ID NO: 561227 - DNA, 25 bp, Homo sapien
cttatcaacagaatactccggtgga

SEQ ID NO: 561228 - DNA, 25 bp, Homo sapien
actccggtggattttcaagcaggct

SEQ ID NO: 561229 - DNA, 25 bp, Homo sapien
agcagaggtttcgagcaggagccca

SEQ ID NO: 561230 - DNA, 25 bp, Homo sapien
gtgtgggagtcctcgtgtgaccctc

SEQ ID NO: 561231 - DNA, 25 bp, Homo sapien
ggaactgactgtatggtctgcaaaa

SEQ ID NO: 561232 - DNA, 25 bp, Homo sapien
agctttagagaatctgcacagccaa

SEQ ID NO: 561233 - DNA, 25 bp, Homo sapien
gcacagccaagttgcactgaatcca

SEQ ID NO: 561234 - DNA, 25 bp, Homo sapien
agcatgaaaggagctgcacaacttt

SEQ ID NO: 561235 - DNA, 25 bp, Homo sapien
ccagttcttcctgcgtgcgggcgag

SEQ ID NO: 561236 - DNA, 25 bp, Homo sapien
tgcgggcgagagtggttgggccctc

SEQ ID NO: 561237 - DNA, 25 bp, Homo sapien
tgggccctcgggaacccactcagag

SEQ ID NO: 561238 - DNA, 25 bp, Homo sapien
gggaacccactcagagcgaggctaa

SEQ ID NO: 561239 - DNA, 25 bp, Homo sapien
aacccactcagagcgaggctaaatt

SEQ ID NO: 561240 - DNA, 25 bp, Homo sapien
gcgaggctaaatttacggagggact

SEQ ID NO: 561241 - DNA, 25 bp, Homo sapien
cggagggactttctgttagcagcat

SEQ ID NO: 561242 - DNA, 25 bp, Homo sapien
ttctgttagcagcatgagggcctgt

SEQ ID NO: 561243 - DNA, 25 bp, Homo sapien
gcatgagggcctgtggttagaccta

SEQ ID NO: 561244 - DNA, 25 bp, Homo sapien
gagggcctgtggttagacctataga

SEQ ID NO: 561245 - DNA, 25 bp, Homo sapien
ggaatcctggggtcctccaaatcta

SEQ ID NO: 561246 - DNA, 25 bp, Homo sapien
ggtgtcataattttgactccatcaa

SEQ ID NO: 561247 - DNA, 25 bp, Homo sapien
aacagcaagtactcatttgggccca

SEQ ID NO: 561248 - DNA, 25 bp, Homo sapien
gcaagtactcatttgggcccatttt

SEQ ID NO: 561249 - DNA, 25 bp, Homo sapien
ggaaaactcttgagtggctcaatct

SEQ ID NO: 561250 - DNA, 25 bp, Homo sapien
ttcaagcgattttattccccagcat

SEQ ID NO: 561251 - DNA, 25 bp, Homo sapien
tttattccccagcataccaagaagc

SEQ ID NO: 561252 - DNA, 25 bp, Homo sapien
ctgggattacagttttgaagatgaa

SEQ ID NO: 561253 - DNA, 25 bp, Homo sapien
ggaaggaaggacatcaggctctgaa

SEQ ID NO: 561254 - DNA, 25 bp, Homo sapien
aggctctgaacatccatccatgtaa

SEQ ID NO: 561255 - DNA, 25 bp, Homo sapien
gaacatccatccatgtaaaacattg

SEQ ID NO: 561256 - DNA, 25 bp, Homo sapien
gactagctgttaaacagggcttttt

SEQ ID NO: 561257 - DNA, 25 bp, Homo sapien
tttcttttgtgttgaacagagggaa

SEQ ID NO: 561258 - DNA, 25 bp, Homo sapien
aacagagggaatttcattatcgtat

SEQ ID NO: 561259 - DNA, 25 bp, Homo sapien
gagggaatttcattatcgtataaaa

SEQ ID NO: 561260 - DNA, 25 bp, Homo sapien
gaaaatgtgattaatgggtaccaga

SEQ ID NO: 561261 - DNA, 25 bp, Homo sapien
taatgggtaccagagtaactacact

SEQ ID NO: 561262 - DNA, 25 bp, Homo sapien
aatgggtaccagagtaactacactt

SEQ ID NO: 561263 - DNA, 25 bp, Homo sapien
gagtaactacacttgcttattcttt

SEQ ID NO: 561264 - DNA, 25 bp, Homo sapien
gcttattctttttctacttaattca

SEQ ID NO: 561265 - DNA, 25 bp, Homo sapien
ttattctttttctacttaattcaga

SEQ ID NO: 561266 - DNA, 25 bp, Homo sapien
tctttttctacttaattcagaatag

SEQ ID NO: 561267 - DNA, 25 bp, Homo sapien
acttaaatgtcgaacaaaatgagag

SEQ ID NO: 561268 - DNA, 25 bp, Homo sapien
actcggcatgtgatgaacacccata

SEQ ID NO: 561269 - DNA, 25 bp, Homo sapien
aactgctaagcttggatttaactga

SEQ ID NO: 561270 - DNA, 25 bp, Homo sapien
catgttatcctaaaagtgagaagac

SEQ ID NO: 561271 - DNA, 25 bp, Homo sapien
gtgagaagacataaccaagacatgg

SEQ ID NO: 561272 - DNA, 25 bp, Homo sapien
aaataaatgtgaaagctggagccga

SEQ ID NO: 561273 - DNA, 25 bp, Homo sapien
gctggagccgaagagtcaaagagct

SEQ ID NO: 561274 - DNA, 25 bp, Homo sapien
gaacacccatagttaagaaaccatg

SEQ ID NO: 561275 - DNA, 25 bp, Homo sapien
gaaaccatggagcaagaaagcttgt

SEQ ID NO: 561276 - DNA, 25 bp, Homo sapien
aagcttgtggaaagtctctctcctt

SEQ ID NO: 561277 - DNA, 25 bp, Homo sapien
tctccttcctcataagacatgcaca

SEQ ID NO: 561278 - DNA, 25 bp, Homo sapien
acatgcacactaatacacatacaca

SEQ ID NO: 561279 - DNA, 25 bp, Homo sapien
agaaaaaacattccatcggtttgct

SEQ ID NO: 561280 - DNA, 25 bp, Homo sapien
ccatcggtttgctgcgtttggagaa

SEQ ID NO: 561281 - DNA, 25 bp, Homo sapien
gtttgctgcgtttggagaatcatca

SEQ ID NO: 561282 - DNA, 25 bp, Homo sapien
gagaatcatcaagcagtggcactga

SEQ ID NO: 561283 - DNA, 25 bp, Homo sapien
gaaatgaacaacaagaacttctcca

SEQ ID NO: 561284 - DNA, 25 bp, Homo sapien
agctgtgcaaagactgtggcatcat

SEQ ID NO: 561285 - DNA, 25 bp, Homo sapien
atcatggatggcaagacagtcacct

SEQ ID NO: 561286 - DNA, 25 bp, Homo sapien
atggcaagacagtcacctccacgga

SEQ ID NO: 561287 - DNA, 25 bp, Homo sapien
tccacggacgtggacatcgtgttca

SEQ ID NO: 561288 - DNA, 25 bp, Homo sapien
caagaacgcccgaaccatcacgttt

SEQ ID NO: 561289 - DNA, 25 bp, Homo sapien
aaccatcacgtttcaacagttcaaa

SEQ ID NO: 561290 - DNA, 25 bp, Homo sapien
cacaggagccaagggtgttgacaga

SEQ ID NO: 561291 - DNA, 25 bp, Homo sapien
tttttacatcacaagcgccagggtc

SEQ ID NO: 561292 - DNA, 25 bp, Homo sapien
ccccaggactcctatggcttaatag

SEQ ID NO: 561293 - DNA, 25 bp, Homo sapien
tatggcttaatagtggtcctgatgg

SEQ ID NO: 561294 - DNA, 25 bp, Homo sapien
ttgaatccatgagtggctgcctcta

SEQ ID NO: 561295 - DNA, 25 bp, Homo sapien
aaaggccagcatcggaggaccctgt

SEQ ID NO: 561296 - DNA, 25 bp, Homo sapien
caagcgccagggtctgtttattaaa

SEQ ID NO: 561297 - DNA, 25 bp, Homo sapien
gccaggagcggaaggttcatgttct

SEQ ID NO: 561298 - DNA, 25 bp, Homo sapien
ttattaaaaccccttcccagcagag

SEQ ID NO: 561299 - DNA, 25 bp, Homo sapien
agggcagtacagtgtcttgtcccag

SEQ ID NO: 561300 - DNA, 25 bp, Homo sapien
cttgtcccagcagaaaaggtccttc

SEQ ID NO: 561301 - DNA, 25 bp, Homo sapien
aagtgagtgtgaatagaagacccca

SEQ ID NO: 561302 - DNA, 25 bp, Homo sapien
gtgaatagaagaccccacactgcct

SEQ ID NO: 561303 - DNA, 25 bp, Homo sapien
tagaagaccccacactgcctggagt

SEQ ID NO: 561304 - DNA, 25 bp, Homo sapien
tggagtcctggattcttccacgtct

SEQ ID NO: 561305 - DNA, 25 bp, Homo sapien
agtcctggattcttccacgtctgat

SEQ ID NO: 561306 - DNA, 25 bp, Homo sapien
ggattcttccacgtctgatgagtga

SEQ ID NO: 561307 - DNA, 25 bp, Homo sapien
ttcttccacgtctgatgagtgacct

SEQ ID NO: 561308 - DNA, 25 bp, Homo sapien
ttccacgtctgatgagtgaccttgg

SEQ ID NO: 561309 - DNA, 25 bp, Homo sapien
gagtgaccttggatctcttaatctc

SEQ ID NO: 561310 - DNA, 25 bp, Homo sapien
tgaccttggatctcttaatctctct

SEQ ID NO: 561311 - DNA, 25 bp, Homo sapien
accttggatctcttaatctctctag

SEQ ID NO: 561312 - DNA, 25 bp, Homo sapien
gacactgagtcagccattcatgaag

SEQ ID NO: 561313 - DNA, 25 bp, Homo sapien
gccattcatgaagctgaacatcatt

SEQ ID NO: 561314 - DNA, 25 bp, Homo sapien
acatcatttcaagggacgctggctc

SEQ ID NO: 561315 - DNA, 25 bp, Homo sapien
acgctggctccggtatcatggtgaa

SEQ ID NO: 561316 - DNA, 25 bp, Homo sapien
gctccggtatcatggtgaacgccaa

SEQ ID NO: 561317 - DNA, 25 bp, Homo sapien
aacgccaaggtgaagagcagccgca

SEQ ID NO: 561318 - DNA, 25 bp, Homo sapien
agagcagccgcatgagatcccaaag

SEQ ID NO: 561319 - DNA, 25 bp, Homo sapien
aggaaagcccgggagtcacacaagt

SEQ ID NO: 561320 - DNA, 25 bp, Homo sapien
gtcacacaagtggagtacagcagca

SEQ ID NO: 561321 - DNA, 25 bp, Homo sapien
ctgcccttggctttggtcttgccag

SEQ ID NO: 561322 - DNA, 25 bp, Homo sapien
cttgccagggaacagctgatgccga

SEQ ID NO: 561323 - DNA, 25 bp, Homo sapien
aatacagtgttcatgacttaattga

SEQ ID NO: 561324 - DNA, 25 bp, Homo sapien
gaatgtgaagccactggttggctta

SEQ ID NO: 561325 - DNA, 25 bp, Homo sapien
gaagccactggttggcttatgcctt

SEQ ID NO: 561326 - DNA, 25 bp, Homo sapien
ttggcttatgccttctgatctatca

SEQ ID NO: 561327 - DNA, 25 bp, Homo sapien
atgccttctgatctatcattcttgc

SEQ ID NO: 561328 - DNA, 25 bp, Homo sapien
ccttctgatctatcattcttgcctc

SEQ ID NO: 561329 - DNA, 25 bp, Homo sapien
ttttaatagggtttacagctagaat

SEQ ID NO: 561330 - DNA, 25 bp, Homo sapien
cagctagaattttgaatgccaaagt

SEQ ID NO: 561331 - DNA, 25 bp, Homo sapien
agttttcaatgttaatggctagtat

SEQ ID NO: 561332 - DNA, 25 bp, Homo sapien
tgttaatggctagtatttttccact

SEQ ID NO: 561333 - DNA, 25 bp, Homo sapien
tttccactggactattgtttgttga

SEQ ID NO: 561334 - DNA, 25 bp, Homo sapien
cagtgttgagtggaaaagtgtttct

SEQ ID NO: 561335 - DNA, 25 bp, Homo sapien
gaaagacctgtgaagtatcctagtc

SEQ ID NO: 561336 - DNA, 25 bp, Homo sapien
ctgtgaagtatcctagtcagggaaa

SEQ ID NO: 561337 - DNA, 25 bp, Homo sapien
gaagtatcctagtcagggaaagaac

SEQ ID NO: 561338 - DNA, 25 bp, Homo sapien
ttctggaagaatgtaagttgctata

SEQ ID NO: 561339 - DNA, 25 bp, Homo sapien
aatgtaagttgctatatgtggaggg

SEQ ID NO: 561340 - DNA, 25 bp, Homo sapien
aggggttctaattactgtctgtgag

SEQ ID NO: 561341 - DNA, 25 bp, Homo sapien
tactgtctgtgagagttactacttt

SEQ ID NO: 561342 - DNA, 25 bp, Homo sapien
gtctgtgagagttactactttgtaa

SEQ ID NO: 561343 - DNA, 25 bp, Homo sapien
gtaacttatggtttctgcttcagta

SEQ ID NO: 561344 - DNA, 25 bp, Homo sapien
ggtttctgcttcagtattgtgttgg

SEQ ID NO: 561345 - DNA, 25 bp, Homo sapien
ggcctcttttgtagctttgaactaa

SEQ ID NO: 561346 - DNA, 25 bp, Homo sapien
gtagctttgaactaacctgcctaag

SEQ ID NO: 561347 - DNA, 25 bp, Homo sapien
ttgaactaacctgcctaagaagaga

SEQ ID NO: 561348 - DNA, 25 bp, Homo sapien
gatgtagtgggaacgctccctcctc

SEQ ID NO: 561349 - DNA, 25 bp, Homo sapien
tcctcgagcattaaccgggttgacc

SEQ ID NO: 561350 - DNA, 25 bp, Homo sapien
tcgctgtcttcagtccaatcaagat

SEQ ID NO: 561351 - DNA, 25 bp, Homo sapien
gaaagatgatcagaccggaacaggt

SEQ ID NO: 561352 - DNA, 25 bp, Homo sapien
ggtaaacgttccatatagagatgct

SEQ ID NO: 561353 - DNA, 25 bp, Homo sapien
gatccccacccaaggaagcaaagtt

SEQ ID NO: 561354 - DNA, 25 bp, Homo sapien
aaagttactcagaccaatcctggtg

SEQ ID NO: 561355 - DNA, 25 bp, Homo sapien
gggtgacagatgttacagccttcac

SEQ ID NO: 561356 - DNA, 25 bp, Homo sapien
gaaactgtggtttaggtctttctgt

SEQ ID NO: 561357 - DNA, 25 bp, Homo sapien
gtctttctgtggaatgccattacat

SEQ ID NO: 561358 - DNA, 25 bp, Homo sapien
gtggaatgccattacatctttatat

SEQ ID NO: 561359 - DNA, 25 bp, Homo sapien
atctttatattagtcaagtccatga

SEQ ID NO: 561360 - DNA, 25 bp, Homo sapien
gaatggcatgcagctagcctttgta

SEQ ID NO: 561361 - DNA, 25 bp, Homo sapien
atgtttagatcgtcttgaattgtta

SEQ ID NO: 561362 - DNA, 25 bp, Homo sapien
gaattgttagtctcaggcagtgtta

SEQ ID NO: 561363 - DNA, 25 bp, Homo sapien
aggcagtgttatcctgctctcaggc

SEQ ID NO: 561364 - DNA, 25 bp, Homo sapien
ttatcctgctctcaggccaacaggg

SEQ ID NO: 561365 - DNA, 25 bp, Homo sapien
atgcagctagcctttgtataaaaat

SEQ ID NO: 561366 - DNA, 25 bp, Homo sapien
attttctagatttgaaccctaatag

SEQ ID NO: 561367 - DNA, 25 bp, Homo sapien
gcggcgctactggagttcttcatca

SEQ ID NO: 561368 - DNA, 25 bp, Homo sapien
tggagttcttcatcacacttgcctt

SEQ ID NO: 561369 - DNA, 25 bp, Homo sapien
tactaccagcgcttcgaccgaatta

SEQ ID NO: 561370 - DNA, 25 bp, Homo sapien
cttcgaccgaattaactggccctgt

SEQ ID NO: 561371 - DNA, 25 bp, Homo sapien
tgcgctgtgtcagtgccatcatcat

SEQ ID NO: 561372 - DNA, 25 bp, Homo sapien
tttgcagctgtgacctcccgggacg

SEQ ID NO: 561373 - DNA, 25 bp, Homo sapien
gacggagctgccattgctgcttttg

SEQ ID NO: 561374 - DNA, 25 bp, Homo sapien
atcatcctggtttccatctttgcct

SEQ ID NO: 561375 - DNA, 25 bp, Homo sapien
atctttgcctatgatgccttcaaga

SEQ ID NO: 561376 - DNA, 25 bp, Homo sapien
tgccttcaagatctaccggactgag

SEQ ID NO: 561377 - DNA, 25 bp, Homo sapien
gatctaccggactgagatggcaccc

SEQ ID NO: 561378 - DNA, 25 bp, Homo sapien
gatatagctgtataggacacctcct

SEQ ID NO: 561379 - DNA, 25 bp, Homo sapien
taggacacctccttaaacatctcct

SEQ ID NO: 561380 - DNA, 25 bp, Homo sapien
aaatgactagtttcccagcactttc

SEQ ID NO: 561381 - DNA, 25 bp, Homo sapien
cagcactttctggttaccatggata

SEQ ID NO: 561382 - DNA, 25 bp, Homo sapien
acatccagagcctgcaggttacact

SEQ ID NO: 561383 - DNA, 25 bp, Homo sapien
aggttacactcagggactcttgcca

SEQ ID NO: 561384 - DNA, 25 bp, Homo sapien
tcttgccagctcatgaataatatcg

SEQ ID NO: 561385 - DNA, 25 bp, Homo sapien
gaataatatcgctgaagcccgctgc

SEQ ID NO: 561386 - DNA, 25 bp, Homo sapien
ctgccgctgcgatatgtacacatgt

SEQ ID NO: 561387 - DNA, 25 bp, Homo sapien
taatatcttctcctctcactaaaat

SEQ ID NO: 561388 - DNA, 25 bp, Homo sapien
aagcccatgtgtattactggcaata

SEQ ID NO: 561389 - DNA, 25 bp, Homo sapien
tacaaactgataacaagacttgctt

SEQ ID NO: 561390 - DNA, 25 bp, Homo sapien
aacaagacttgctttcacaattact

SEQ ID NO: 561391 - DNA, 25 bp, Homo sapien
caagacttgctttcacaattactat

SEQ ID NO: 561392 - DNA, 25 bp, Homo sapien
acttgctttcacaattactatttac

SEQ ID NO: 561393 - DNA, 25 bp, Homo sapien
gctttcacaattactatttacattt

SEQ ID NO: 561394 - DNA, 25 bp, Homo sapien
aatgcctgtatattatactcatatt

SEQ ID NO: 561395 - DNA, 25 bp, Homo sapien
atactcatatttgaaagtgatcaga

SEQ ID NO: 561396 - DNA, 25 bp, Homo sapien
agtgatcagaaagtgttatttaaca

SEQ ID NO: 561397 - DNA, 25 bp, Homo sapien
ctggaccctttgattctaagtaaat

SEQ ID NO: 561398 - DNA, 25 bp, Homo sapien
tggaccctttgattctaagtaaatt

SEQ ID NO: 561399 - DNA, 25 bp, Homo sapien
agtaagttagcagtaatagactatt

SEQ ID NO: 561400 - DNA, 25 bp, Homo sapien
tggcatgcccactggctgtggtaaa

SEQ ID NO: 561401 - DNA, 25 bp, Homo sapien
tgcccactggctgtggtaaaattta

SEQ ID NO: 561402 - DNA, 25 bp, Homo sapien
taatcctcattgctttgggagtgac

SEQ ID NO: 561403 - DNA, 25 bp, Homo sapien
ttgggagtgacttaaggccttttga

SEQ ID NO: 561404 - DNA, 25 bp, Homo sapien
ttaaggccttttgaagtggagcttt

SEQ ID NO: 561405 - DNA, 25 bp, Homo sapien
ttttctgtgaactatgataactata

SEQ ID NO: 561406 - DNA, 25 bp, Homo sapien
gtgtctatttccaaaatgatttctg

SEQ ID NO: 561407 - DNA, 25 bp, Homo sapien
tctgatggattgtagagcaaagcac

SEQ ID NO: 561408 - DNA, 25 bp, Homo sapien
gagcaaagcacattgcctaaattca

SEQ ID NO: 561409 - DNA, 25 bp, Homo sapien
catttgttaatgaattgggtaccat

SEQ ID NO: 561410 - DNA, 25 bp, Homo sapien
atgaattgggtaccattgttattaa

SEQ ID NO: 561411 - DNA, 25 bp, Homo sapien
tggatgtacattcagaaatgttctt

SEQ ID NO: 561412 - DNA, 25 bp, Homo sapien
gacactttcatggtccagaaagctg

SEQ ID NO: 561413 - DNA, 25 bp, Homo sapien
tcatggtccagaaagctgaaggcct

SEQ ID NO: 561414 - DNA, 25 bp, Homo sapien
tgaaggcctgggcatctcttgtgac

SEQ ID NO: 561415 - DNA, 25 bp, Homo sapien
tcttgtgacatttttctaatattag

SEQ ID NO: 561416 - DNA, 25 bp, Homo sapien
ttagattttcacgtattaggcactt

SEQ ID NO: 561417 - DNA, 25 bp, Homo sapien
gattttcacgtattaggcactttag

SEQ ID NO: 561418 - DNA, 25 bp, Homo sapien
tttcacgtattaggcactttagttg

SEQ ID NO: 561419 - DNA, 25 bp, Homo sapien
aggcactttagttgaatcttccagc

SEQ ID NO: 561420 - DNA, 25 bp, Homo sapien
gcactttagttgaatcttccagcaa

SEQ ID NO: 561421 - DNA, 25 bp, Homo sapien
agttgaatcttccagcaaaagctgt

SEQ ID NO: 561422 - DNA, 25 bp, Homo sapien
gcatgaggaccgactaccccaggag

SEQ ID NO: 561423 - DNA, 25 bp, Homo sapien
agtgtgctggctcctgcttatgtgt

SEQ ID NO: 561424 - DNA, 25 bp, Homo sapien
tgcttatgtgtcagtctgtctcctc

SEQ ID NO: 561425 - DNA, 25 bp, Homo sapien
aagggaagtcatcgctcccgctggc

SEQ ID NO: 561426 - DNA, 25 bp, Homo sapien
tggctcagaaccatggctgtgcagc

SEQ ID NO: 561427 - DNA, 25 bp, Homo sapien
gtggagacaagatctacaacccctt

SEQ ID NO: 561428 - DNA, 25 bp, Homo sapien
atctacaaccccttggagcagtgct

SEQ ID NO: 561429 - DNA, 25 bp, Homo sapien
agcagtgctgttacaatgacgccat

SEQ ID NO: 561430 - DNA, 25 bp, Homo sapien
gacgccatcgtgtccctgagcgaga

SEQ ID NO: 561431 - DNA, 25 bp, Homo sapien
agctctgctgtcttgattcctttgg

SEQ ID NO: 561432 - DNA, 25 bp, Homo sapien
attcctttggcctcacaaacgattt

SEQ ID NO: 561433 - DNA, 25 bp, Homo sapien
tatggaaacgccttcaattgccgct

SEQ ID NO: 561434 - DNA, 25 bp, Homo sapien
tcactcgacatcaacggattcatag

SEQ ID NO: 561435 - DNA, 25 bp, Homo sapien
atagtggaagaaaccctaccattgt

SEQ ID NO: 561436 - DNA, 25 bp, Homo sapien
gaaaccctaccattgtaacagatgt

SEQ ID NO: 561437 - DNA, 25 bp, Homo sapien
gaaagactttttacgtacacttcag

SEQ ID NO: 561438 - DNA, 25 bp, Homo sapien
aacatccaagaattcctattagcga

SEQ ID NO: 561439 - DNA, 25 bp, Homo sapien
gaggaaacatcttaccatctggtca

SEQ ID NO: 561440 - DNA, 25 bp, Homo sapien
taccatctggtcattcatactgaag

SEQ ID NO: 561441 - DNA, 25 bp, Homo sapien
gaaactccataagtatcatctctgt

SEQ ID NO: 561442 - DNA, 25 bp, Homo sapien
catctctgtgggaaaacctgtttta

SEQ ID NO: 561443 - DNA, 25 bp, Homo sapien
aacctgttttagatcatcatttgtc

SEQ ID NO: 561444 - DNA, 25 bp, Homo sapien
atagtttaagtgatgacaagttcca

SEQ ID NO: 561445 - DNA, 25 bp, Homo sapien
agttccaatagcttatatgcccaga

SEQ ID NO: 561446 - DNA, 25 bp, Homo sapien
aatagcttatatgcccagaaggcct

SEQ ID NO: 561447 - DNA, 25 bp, Homo sapien
aacaaacttttatatccttctcatg

SEQ ID NO: 561448 - DNA, 25 bp, Homo sapien
tttatatccttctcatgtcttctac

SEQ ID NO: 561449 - DNA, 25 bp, Homo sapien
tatccttctcatgtcttctactgta

SEQ ID NO: 561450 - DNA, 25 bp, Homo sapien
ttcatatgctttgctactctaaacc

SEQ ID NO: 561451 - DNA, 25 bp, Homo sapien
atgctttgctactctaaacctagtt

SEQ ID NO: 561452 - DNA, 25 bp, Homo sapien
aacctagtttgaaatcaacagtctt

SEQ ID NO: 561453 - DNA, 25 bp, Homo sapien
aatggaaacctcttacatgtgattt

SEQ ID NO: 561454 - DNA, 25 bp, Homo sapien
catgtgattttccttgccatctaga

SEQ ID NO: 561455 - DNA, 25 bp, Homo sapien
tttgacattggtagtaatattggta

SEQ ID NO: 561456 - DNA, 25 bp, Homo sapien
ttgacattggtagtaatattggtat

SEQ ID NO: 561457 - DNA, 25 bp, Homo sapien
tgacattggtagtaatattggtata

SEQ ID NO: 561458 - DNA, 25 bp, Homo sapien
gacattggtagtaatattggtatag

SEQ ID NO: 561459 - DNA, 25 bp, Homo sapien
acattggtagtaatattggtataga

SEQ ID NO: 561460 - DNA, 25 bp, Homo sapien
cattggtagtaatattggtatagaa

SEQ ID NO: 561461 - DNA, 25 bp, Homo sapien
ggtagtaatattggtatagaattct

SEQ ID NO: 561462 - DNA, 25 bp, Homo sapien
gtagtaatattggtatagaattcta

SEQ ID NO: 561463 - DNA, 25 bp, Homo sapien
agtaatattggtatagaattctaag

SEQ ID NO: 561464 - DNA, 25 bp, Homo sapien
tagaattctaagttgtttaactgcc

SEQ ID NO: 561465 - DNA, 25 bp, Homo sapien
agaattctaagttgtttaactgcct

SEQ ID NO: 561466 - DNA, 25 bp, Homo sapien
ctttgccatggcctcatgatggatg

SEQ ID NO: 561467 - DNA, 25 bp, Homo sapien
tgccccttgacttgatacttgacca

SEQ ID NO: 561468 - DNA, 25 bp, Homo sapien
ggaaatgtcagtatacctgtgctca

SEQ ID NO: 561469 - DNA, 25 bp, Homo sapien
acctgtgctcaggtatactgtgcta

SEQ ID NO: 561470 - DNA, 25 bp, Homo sapien
gtgctaggtcttaagaagcctccag

SEQ ID NO: 561471 - DNA, 25 bp, Homo sapien
aagcctccagtgtttccagctatac

SEQ ID NO: 561472 - DNA, 25 bp, Homo sapien
gctatacatctgcaatcaccatgag

SEQ ID NO: 561473 - DNA, 25 bp, Homo sapien
agaaggacctgctcaagcaaaccac

SEQ ID NO: 561474 - DNA, 25 bp, Homo sapien
agattcttgccacaggtatgaagta

SEQ ID NO: 561475 - DNA, 25 bp, Homo sapien
ctgttaatagccttgatttttcacc

SEQ ID NO: 561476 - DNA, 25 bp, Homo sapien
ctgtgccaccatatatatctttgcc

SEQ ID NO: 561477 - DNA, 25 bp, Homo sapien
atacgcactgcactggttacatgga

SEQ ID NO: 561478 - DNA, 25 bp, Homo sapien
agtgtccataccaaagcaccattca

SEQ ID NO: 561479 - DNA, 25 bp, Homo sapien
ataccaaagcaccattcaactctgt

SEQ ID NO: 561480 - DNA, 25 bp, Homo sapien
gagagtttttacacaatggctactt

SEQ ID NO: 561481 - DNA, 25 bp, Homo sapien
tggctacttgtagaacctccgaact

SEQ ID NO: 561482 - DNA, 25 bp, Homo sapien
agaacctccgaactacctacagagt

SEQ ID NO: 561483 - DNA, 25 bp, Homo sapien
agtccccgtggtgacatgctgtaaa

SEQ ID NO: 561484 - DNA, 25 bp, Homo sapien
gttacatggattacagctgcagact

SEQ ID NO: 561485 - DNA, 25 bp, Homo sapien
acagctgcagacttctaacacaaaa

SEQ ID NO: 561486 - DNA, 25 bp, Homo sapien
cacacacaagtacacggacccaggt

SEQ ID NO: 561487 - DNA, 25 bp, Homo sapien
aggtggaggcctcagccccttattt

SEQ ID NO: 561488 - DNA, 25 bp, Homo sapien
cggacaccattttacgtcgctgtgg

SEQ ID NO: 561489 - DNA, 25 bp, Homo sapien
cattttacgtcgctgtggtagctga
